United States Patent 7,618,814 (MICRORNA-RELATED NUCLEIC ACIDS AND USES THEREOF) - sequence listing, part 10

SEQ ID NO: 359903 - RNA, 32 nt, Human
cauuuggugaucagucagucacacauaaguuc

SEQ ID NO: 359904 - RNA, 32 nt, Human
cauuugguucagaaucaguucccuuucucugg

SEQ ID NO: 359905 - RNA, 32 nt, Human
cauuuguaaucaaaugauggccauuuguucug

SEQ ID NO: 359906 - RNA, 32 nt, Human
cauuuguacacaaaugugacuaugucuuggca

SEQ ID NO: 359907 - RNA, 32 nt, Human
cauuuguaccugcuguuagugauguggauaau

SEQ ID NO: 359908 - RNA, 32 nt, Human
cauuuguagccauuuuuaaaaguuuuugucuu

SEQ ID NO: 359909 - RNA, 32 nt, Human
cauuuguaggcggugacccgccccuucucugg

SEQ ID NO: 359910 - RNA, 32 nt, Human
cauuuguauauucuaccuugcacuacagucau

SEQ ID NO: 359911 - RNA, 32 nt, Human
cauuuguaucagaaaaacauuacaaauuuacu

SEQ ID NO: 359912 - RNA, 32 nt, Human
cauuuguaugugcuggagugagacaggaguau

SEQ ID NO: 359913 - RNA, 32 nt, Human
cauuugucaaacccucuucaaaggaggaacag

SEQ ID NO: 359914 - RNA, 32 nt, Human
cauuugucacuuccaucucagcuaaugcaccc

SEQ ID NO: 359915 - RNA, 21 nt, Human
cauuugucagcccuugccaaa

SEQ ID NO: 359916 - RNA, 32 nt, Human
cauuugucaguuucaaagcugcuucacauuuu

SEQ ID NO: 359917 - RNA, 32 nt, Human
cauuugucaguuucaaaucugcuucacauuuu

SEQ ID NO: 359918 - RNA, 32 nt, Human
cauuugucaucgucuauugguaaagaagaaaa

SEQ ID NO: 359919 - RNA, 32 nt, Human
cauuugucaugaccacacauuguuuccaggac

SEQ ID NO: 359920 - RNA, 32 nt, Human
cauuugucauguucacuuaccugcugauggaa

SEQ ID NO: 359921 - RNA, 32 nt, Human
cauuuguccccaaauacgcuuagcugugugcc

SEQ ID NO: 359922 - RNA, 32 nt, Human
cauuuguccuggguucccuugugugaucuguu

SEQ ID NO: 359923 - RNA, 32 nt, Human
cauuugucgugguuaccagugcagccugucaa

SEQ ID NO: 359924 - RNA, 32 nt, Human
cauuugucucagaacauuuccuuggcuggaca

SEQ ID NO: 359925 - RNA, 32 nt, Human
cauuugucugugaggaaaggccagcacuaagc

SEQ ID NO: 359926 - RNA, 32 nt, Human
cauuugucuuccagaacaccgugccuuagaaa

SEQ ID NO: 359927 - RNA, 32 nt, Human
cauuugucuuuuucucaguggagggaguguau

SEQ ID NO: 359928 - RNA, 32 nt, Human
cauuugugaaaccagugagagaaggcuugaug

SEQ ID NO: 359929 - RNA, 32 nt, Human
cauuugugaacugucuucucauauuuuaaguc

SEQ ID NO: 359930 - RNA, 24 nt, Human
cauuugugaaggcucugccagaca

SEQ ID NO: 359931 - RNA, 32 nt, Human
cauuugugacccuucagccccugcugaacccu

SEQ ID NO: 359932 - RNA, 32 nt, Human
cauuugugaggguccagcugaaggugagggga

SEQ ID NO: 359933 - RNA, 32 nt, Human
cauuugugcaacuucaaacauauugggugcuu

SEQ ID NO: 359934 - RNA, 32 nt, Human
cauuugugcccagguugaggcuauagugagcc

SEQ ID NO: 359935 - RNA, 32 nt, Human
cauuuguggcuuuuuguaguuuacuuaagcca

SEQ ID NO: 359936 - RNA, 32 nt, Human
cauuugugucuucaaauuucucuccuuugguu

SEQ ID NO: 359937 - RNA, 32 nt, Human
cauuugugugugugcaaguguguaugugcgug

SEQ ID NO: 359938 - RNA, 32 nt, Human
cauuuguguguuggcuuugcagcugcugucug

SEQ ID NO: 359939 - RNA, 32 nt, Human
cauuuguucaaaggauagaaagcaucuaaaag

SEQ ID NO: 359940 - RNA, 31 nt, Human
cauuuguucacgugccucacagcaggccuuu

SEQ ID NO: 359941 - RNA, 32 nt, Human
cauuuguucucucaccaaaccccaugccaaau

SEQ ID NO: 359942 - RNA, 32 nt, Human
cauuuguucucucccugcuccaacccugcagu

SEQ ID NO: 359943 - RNA, 32 nt, Human
cauuuguucucuuggaucucacucucucuguc

SEQ ID NO: 359944 - RNA, 32 nt, Human
cauuuguucugcugucuuucuaauccagccaa

SEQ ID NO: 359945 - RNA, 32 nt, Human
cauuuguugcugcugcugcucauuccacacug

SEQ ID NO: 359946 - RNA, 32 nt, Human
cauuuguuuaaaacaguuuaaugaguaaguuu

SEQ ID NO: 359947 - RNA, 32 nt, Human
cauuuguuuguauucauguucaugugauuaac

SEQ ID NO: 359948 - RNA, 32 nt, Human
cauuuguuuuugcuuuuguugccuguacuuuu

SEQ ID NO: 359949 - RNA, 32 nt, Human
cauuuuaaaauggaugucucuuuaaaaauuuu

SEQ ID NO: 359950 - RNA, 32 nt, Human
cauuuuaaagaauaccagaaguagaaucacau

SEQ ID NO: 359951 - RNA, 32 nt, Human
cauuuuaaagagaccccacaggaguucuggcc

SEQ ID NO: 359952 - RNA, 32 nt, Human
cauuuuaaagugugaacacuccccuauguaaa

SEQ ID NO: 359953 - RNA, 32 nt, Human
cauuuuaacccccauuuuaucagcacccucuu

SEQ ID NO: 359954 - RNA, 32 nt, Human
cauuuuaacugaaugucuaaagugauuaucuu

SEQ ID NO: 359955 - RNA, 32 nt, Human
cauuuuaaggacauagccaggccaggugcagu

SEQ ID NO: 359956 - RNA, 32 nt, Human
cauuuuacaacugccuguucuuucuccagucc

SEQ ID NO: 359957 - RNA, 32 nt, Human
cauuuuacaauccauuauuuuugaccacugcu

SEQ ID NO: 359958 - RNA, 32 nt, Human
cauuuuacagaggaagagaccgagguauaaag

SEQ ID NO: 359959 - RNA, 32 nt, Human
cauuuuacagugguuugccauuaggguauuca

SEQ ID NO: 359960 - RNA, 32 nt, Human
cauuuuacccuucggcacuauuuucugcuauu

SEQ ID NO: 359961 - RNA, 21 nt, Human
cauuuuacuaacuaccuggac

SEQ ID NO: 359962 - RNA, 32 nt, Human
cauuuuacucaucccucugccuccaagaaggc

SEQ ID NO: 359963 - RNA, 32 nt, Human
cauuuuagccaggcaguauuuacucauuauua

SEQ ID NO: 359964 - RNA, 32 nt, Human
cauuuuagccaguguaccugggcacagacucg

SEQ ID NO: 359965 - RNA, 32 nt, Human
cauuuuagcuaauccuggaaaauugaucgaca

SEQ ID NO: 359966 - RNA, 32 nt, Human
cauuuuaggagcaaugauauauacaaaauaag

SEQ ID NO: 359967 - RNA, 32 nt, Human
cauuuuagggccugugaccaaaaugaagcuug

SEQ ID NO: 359968 - RNA, 32 nt, Human
cauuuuagguucaauagcugaaguuuuucaug

SEQ ID NO: 359969 - RNA, 32 nt, Human
cauuuuauaaaugauaucaaagaagagucaac

SEQ ID NO: 359970 - RNA, 32 nt, Human
cauuuuaugaaaaggcaucuucaugguccagg

SEQ ID NO: 359971 - RNA, 32 nt, Human
cauuuuauggcuccucccucccauguccucag

SEQ ID NO: 359972 - RNA, 32 nt, Human
cauuuuauuacauccaggcuacauucuugauu

SEQ ID NO: 359973 - RNA, 32 nt, Human
cauuuuauuuuauuaguuacuaauucaagcug

SEQ ID NO: 359974 - RNA, 32 nt, Human
cauuuucaaaggacagggagggagcauccccc

SEQ ID NO: 359975 - RNA, 32 nt, Human
cauuuucaaauguuuauguuguguauauagca

SEQ ID NO: 359976 - RNA, 32 nt, Human
cauuuucaacacuuaaaaguauggagacuauu

SEQ ID NO: 359977 - RNA, 32 nt, Human
cauuuucaagauacauuucaucugcugcugaa

SEQ ID NO: 359978 - RNA, 32 nt, Human
cauuuucacaacauaucagacuucaccaaaua

SEQ ID NO: 359979 - RNA, 19 nt, Human
cauuuucacaccagcccac

SEQ ID NO: 359980 - RNA, 32 nt, Human
cauuuucacagaaaucaagauguuauuuuugu

SEQ ID NO: 359981 - RNA, 32 nt, Human
cauuuucacagaauucuggcuucauuaagauc

SEQ ID NO: 359982 - RNA, 32 nt, Human
cauuuucaccccacccuuccccuccuucuccc

SEQ ID NO: 359983 - RNA, 23 nt, Human
cauuuucaccuuuugacauuucu

SEQ ID NO: 359984 - RNA, 32 nt, Human
cauuuucagaagauaaugacucacaugggaau

SEQ ID NO: 359985 - RNA, 32 nt, Human
cauuuucagagccucaucugucagccuuaaug

SEQ ID NO: 359986 - RNA, 32 nt, Human
cauuuucagcacucagcacagugccuugugua

SEQ ID NO: 359987 - RNA, 32 nt, Human
cauuuucaggaaaugccuggagcugcuggucc

SEQ ID NO: 359988 - RNA, 32 nt, Human
cauuuucauagccuccuacagugagaaacgcc

SEQ ID NO: 359989 - RNA, 32 nt, Human
cauuuucaucuucuuccaugguuccacagaag

SEQ ID NO: 359990 - RNA, 32 nt, Human
cauuuucaugauauuguucacugccucuacca

SEQ ID NO: 359991 - RNA, 32 nt, Human
cauuuuccaaacagagguuaaauaugagcuga

SEQ ID NO: 359992 - RNA, 30 nt, Human
cauuuuccaaguccaagggcacaauuguug

SEQ ID NO: 359993 - RNA, 22 nt, Human
cauuuuccacaccuguccacuc

SEQ ID NO: 359994 - RNA, 32 nt, Human
cauuuuccacuuuguuuuccccaaaacauauc

SEQ ID NO: 359995 - RNA, 32 nt, Human
cauuuuccauaaagguaacaaagggcagcuca

SEQ ID NO: 359996 - RNA, 32 nt, Human
cauuuuccaugcaaccuccuucugccagcagc

SEQ ID NO: 359997 - RNA, 32 nt, Human
cauuuucccaacgucaggugugcauuucaugu

SEQ ID NO: 359998 - RNA, 32 nt, Human
cauuuucccagaacagaagcaccaagaaaauu

SEQ ID NO: 359999 - RNA, 21 nt, Human
cauuuucccauugagagccuu

SEQ ID NO: 360000 - RNA, 32 nt, Human
cauuuuccccucuccuccucccugcuaccauu

SEQ ID NO: 360001 - RNA, 32 nt, Human
cauuuucccuccaggaccaccuugguuucuag

SEQ ID NO: 360002 - RNA, 20 nt, Human
cauuuucccucuuugaaccu

SEQ ID NO: 360003 - RNA, 24 nt, Human
cauuuucccugccagguguccuuu

SEQ ID NO: 360004 - RNA, 32 nt, Human
cauuuuccuaguuucauuucaauaacauuuua

SEQ ID NO: 360005 - RNA, 32 nt, Human
cauuuuccuauguaacaaauuugcaaauugug

SEQ ID NO: 360006 - RNA, 32 nt, Human
cauuuuccucauucacaaaaugggccaauagu

SEQ ID NO: 360007 - RNA, 32 nt, Human
cauuuuccucuuguccuggcccuucagucugc

SEQ ID NO: 360008 - RNA, 32 nt, Human
cauuuuccugcaacucugccuucuugagucca

SEQ ID NO: 360009 - RNA, 32 nt, Human
cauuuuccuguaagucauuaugaauuuuucug

SEQ ID NO: 360010 - RNA, 32 nt, Human
cauuuuccuguccuuacaucucagcuuaaaug

SEQ ID NO: 360011 - RNA, 32 nt, Human
cauuuuccuucccuucuccaucucucuggccc

SEQ ID NO: 360012 - RNA, 23 nt, Human
cauuuuccuuuuguaguaccuuu

SEQ ID NO: 360013 - RNA, 32 nt, Human
cauuuucgccgccagucuuuugcuccuguuuc

SEQ ID NO: 360014 - RNA, 32 nt, Human
cauuuucgcuucucccuggacugggcccugau

SEQ ID NO: 360015 - RNA, 32 nt, Human
cauuuucucaaagggcauaccuugugcauugu

SEQ ID NO: 360016 - RNA, 32 nt, Human
cauuuucucaaaguaaugggcauucuaugauu

SEQ ID NO: 360017 - RNA, 32 nt, Human
cauuuucucaacaaaaauuaauagcugguucu

SEQ ID NO: 360018 - RNA, 32 nt, Human
cauuuucucccauggaaucacgaagagcaaga

SEQ ID NO: 360019 - RNA, 32 nt, Human
cauuuucucccgggagagguuggaguguccaa

SEQ ID NO: 360020 - RNA, 32 nt, Human
cauuuucucccuuuuaaagaucaucucuucag

SEQ ID NO: 360021 - RNA, 32 nt, Human
cauuuucuccucccagcccccugcugccuucu

SEQ ID NO: 360022 - RNA, 32 nt, Human
cauuuucuccuuccucccuucccuuauuuucu

SEQ ID NO: 360023 - RNA, 24 nt, Human
cauuuucuccuucucuucacacuc

SEQ ID NO: 360024 - RNA, 32 nt, Human
cauuuucucuacuguuuucuucauacugaaga

SEQ ID NO: 360025 - RNA, 32 nt, Human
cauuuucucuagaauuuuaauuacaaacaaaa

SEQ ID NO: 360026 - RNA, 32 nt, Human
cauuuucucuggcccucuaccuugcuuccugg

SEQ ID NO: 360027 - RNA, 32 nt, Human
cauuuucucuggguaaagggaaaggcaaugaa

SEQ ID NO: 360028 - RNA, 32 nt, Human
cauuuucugaggugcuuggcucugauucaggg

SEQ ID NO: 360029 - RNA, 32 nt, Human
cauuuucugaguaaaaguuauuuucauauaug

SEQ ID NO: 360030 - RNA, 32 nt, Human
cauuuucugcagccccuuccucucagugagcu

SEQ ID NO: 360031 - RNA, 32 nt, Human
cauuuucugcugcugcugacagauuaacccaa

SEQ ID NO: 360032 - RNA, 32 nt, Human
cauuuucugcuguagucucggugcaggguauu

SEQ ID NO: 360033 - RNA, 32 nt, Human
cauuuucuggggaaggcaggaggcagaaagac

SEQ ID NO: 360034 - RNA, 32 nt, Human
cauuuucuuagaccucuucagcugauuguuua

SEQ ID NO: 360035 - RNA, 32 nt, Human
cauuuucuuagcagugucucucacagagaaaa

SEQ ID NO: 360036 - RNA, 32 nt, Human
cauuuucuucaaccaggaggugaggagguuuc

SEQ ID NO: 360037 - RNA, 32 nt, Human
cauuuucuuccaggaucaucaccuuuguucua

SEQ ID NO: 360038 - RNA, 24 nt, Human
cauuuucuucuaccucaguuuaaa

SEQ ID NO: 360039 - RNA, 32 nt, Human
cauuuucuucuucucucucuuaacuucacaau

SEQ ID NO: 360040 - RNA, 32 nt, Human
cauuuucuugccugucacaaucaugccacaca

SEQ ID NO: 360041 - RNA, 32 nt, Human
cauuuucuuuaccaguauccuuaaucaaguag

SEQ ID NO: 360042 - RNA, 32 nt, Human
cauuuugaaaagagcagcugcugcuuagggcc

SEQ ID NO: 360043 - RNA, 27 nt, Human
cauuuugaaaguauuuugacaacuccu

SEQ ID NO: 360044 - RNA, 32 nt, Human
cauuuugacagugucuugguuggagaugaaca

SEQ ID NO: 360045 - RNA, 32 nt, Human
cauuuugagaggcugaggcggguggaucaccu

SEQ ID NO: 360046 - RNA, 32 nt, Human
cauuuugagaggcugaggcggguggaucacuu

SEQ ID NO: 360047 - RNA, 32 nt, Human
cauuuugaggaaauauguugucgaugcuuuug

SEQ ID NO: 360048 - RNA, 22 nt, Human
cauuuugaggcugggugcagug

SEQ ID NO: 360049 - RNA, 32 nt, Human
cauuuugaggcugggugcaguggcucacgcuu

SEQ ID NO: 360050 - RNA, 32 nt, Human
cauuuugagggagucacuacaguuccugacua

SEQ ID NO: 360051 - RNA, 32 nt, Human
cauuuugaggggaggaguuccacagauuguuu

SEQ ID NO: 360052 - RNA, 32 nt, Human
cauuuugauacuugucuauccuucauagugcc

SEQ ID NO: 360053 - RNA, 32 nt, Human
cauuuugcacuagauauuuaccucucacuguu

SEQ ID NO: 360054 - RNA, 32 nt, Human
cauuuugcagaaucugcaccuacagcucaaua

SEQ ID NO: 360055 - RNA, 32 nt, Human
cauuuugcagggacucugaagugaccuuuagu

SEQ ID NO: 360056 - RNA, 32 nt, Human
cauuuugcaucagccuggagugaaccaugaac

SEQ ID NO: 360057 - RNA, 20 nt, Human
cauuuugccuucuuguuucc

SEQ ID NO: 360058 - RNA, 22 nt, Human
cauuuugccuugcaucguuucc

SEQ ID NO: 360059 - RNA, 24 nt, Human
cauuuugccuuucugacauuuccu

SEQ ID NO: 360060 - RNA, 32 nt, Human
cauuuugcggaggggcggccugggaggggagg

SEQ ID NO: 360061 - RNA, 32 nt, Human
cauuuugcuaagggaaagaagccagacccaau

SEQ ID NO: 360062 - RNA, 32 nt, Human
cauuuugcucacucucaaccuuccucgcccac

SEQ ID NO: 360063 - RNA, 32 nt, Human
cauuuuggaaacaaaaaggcagcagugaucug

SEQ ID NO: 360064 - RNA, 32 nt, Human
cauuuuggaagagacgaaagaaaggaaaauaa

SEQ ID NO: 360065 - RNA, 32 nt, Human
cauuuuggaaggccaaggcgggcagauuaccu

SEQ ID NO: 360066 - RNA, 32 nt, Human
cauuuuggagggagcuuccuuccuuccuuccu

SEQ ID NO: 360067 - RNA, 32 nt, Human
cauuuuggcacugaugcuguuuucucuugucu

SEQ ID NO: 360068 - RNA, 23 nt, Human
cauuuuggccugcaaaccuucaa

SEQ ID NO: 360069 - RNA, 32 nt, Human
cauuuugggaaagaguggaauucuggguguua

SEQ ID NO: 360070 - RNA, 31 nt, Human
cauuuugggaagcuaagauggguggaucacu

SEQ ID NO: 360071 - RNA, 32 nt, Human
cauuuugggacuccgaggugggcagaucacuu

SEQ ID NO: 360072 - RNA, 32 nt, Human
cauuuugggagaccaaggugggcagauugccu

SEQ ID NO: 360073 - RNA, 32 nt, Human
cauuuugggaggacgaggcggguggaucacuc

SEQ ID NO: 360074 - RNA, 32 nt, Human
cauuuugggaggcagaggcaggaggauugcuu

SEQ ID NO: 360075 - RNA, 32 nt, Human
cauuuugggaggcagaggcgggcggaucaucu

SEQ ID NO: 360076 - RNA, 32 nt, Human
cauuuugggaggccaagaugggcagaucagga

SEQ ID NO: 360077 - RNA, 32 nt, Human
cauuuugggaggccaaggagggcagaucaccu

SEQ ID NO: 360078 - RNA, 32 nt, Human
cauuuugggaggccaaggugggaggauugcuu

SEQ ID NO: 360079 - RNA, 32 nt, Human
cauuuugggaggccaaggugggcagaucaccu

SEQ ID NO: 360080 - RNA, 32 nt, Human
cauuuugggaggccaaggugggcagauugccu

SEQ ID NO: 360081 - RNA, 32 nt, Human
cauuuugggaggccacagugggcagauugcuu

SEQ ID NO: 360082 - RNA, 32 nt, Human
cauuuugggaggccgagauagguggaucaccu

SEQ ID NO: 360083 - RNA, 32 nt, Human
cauuuugggaggccgaggcagguggaucaccu

SEQ ID NO: 360084 - RNA, 32 nt, Human
cauuuugggaggccgaggcgggcggaucacuu

SEQ ID NO: 360085 - RNA, 32 nt, Human
cauuuugggaggccgaggcggguggaucacaa

SEQ ID NO: 360086 - RNA, 32 nt, Human
cauuuugggaggccgaggcggguggaucacca

SEQ ID NO: 360087 - RNA, 32 nt, Human
cauuuugggaggccgaggcggguggaucauga

SEQ ID NO: 360088 - RNA, 32 nt, Human
cauuuugggaggccgggguuggaggaucauuu

SEQ ID NO: 360089 - RNA, 32 nt, Human
cauuuugggaggcugaggcaaguggauaacuu

SEQ ID NO: 360090 - RNA, 32 nt, Human
cauuuugggaggcugaggcaggaggaucacuu

SEQ ID NO: 360091 - RNA, 32 nt, Human
cauuuugggaggcugaggcagguggaucaccu

SEQ ID NO: 360092 - RNA, 32 nt, Human
cauuuugggaggcugaggcagguggaucacuu

SEQ ID NO: 360093 - RNA, 32 nt, Human
cauuuugggaggcugaggugggcagaucacuu

SEQ ID NO: 360094 - RNA, 32 nt, Human
cauuuugggugacugaggcggguggauugcuu

SEQ ID NO: 360095 - RNA, 32 nt, Human
cauuuugguaggccgaggagggcagaucacuu

SEQ ID NO: 360096 - RNA, 32 nt, Human
cauuuugguuaacccaguccuucaccugcccu

SEQ ID NO: 360097 - RNA, 32 nt, Human
cauuuuguaccaucugcuccccaauggccaaa

SEQ ID NO: 360098 - RNA, 32 nt, Human
cauuuuguagcuuguuagauuuucugccagag

SEQ ID NO: 360099 - RNA, 32 nt, Human
cauuuugucacaucuguuggagagauaaucac

SEQ ID NO: 360100 - RNA, 32 nt, Human
cauuuugucacuuaaugccaguacaaucugug

SEQ ID NO: 360101 - RNA, 32 nt, Human
cauuuugucagcagcagugaccacagccuuac

SEQ ID NO: 360102 - RNA, 32 nt, Human
cauuuuguccccaguggcuaagaaacuaaagg

SEQ ID NO: 360103 - RNA, 32 nt, Human
cauuuugucugugggcccugggccagacucua

SEQ ID NO: 360104 - RNA, 32 nt, Human
cauuuugugccacccauuuagguaucacuacc

SEQ ID NO: 360105 - RNA, 32 nt, Human
cauuuugugguuucucugaugguucugggcag

SEQ ID NO: 360106 - RNA, 32 nt, Human
cauuuugugucuuuacuccacccuucacccua

SEQ ID NO: 360107 - RNA, 32 nt, Human
cauuuuguugacugucagguuaggugucccuu

SEQ ID NO: 360108 - RNA, 32 nt, Human
cauuuuguugcccaggcuggucuccaauuucu

SEQ ID NO: 360109 - RNA, 32 nt, Human
cauuuuguuuuugaaagaggugggauccaaaa

SEQ ID NO: 360110 - RNA, 32 nt, Human
cauuuuuaaaaagaaggacuuaggggucguuu

SEQ ID NO: 360111 - RNA, 32 nt, Human
cauuuuuaaaggcuucauuccuacaacaacca

SEQ ID NO: 360112 - RNA, 20 nt, Human
cauuuuuaaauccuuacuca

SEQ ID NO: 360113 - RNA, 32 nt, Human
cauuuuuacugaugcugggauuauagguguga

SEQ ID NO: 360114 - RNA, 32 nt, Human
cauuuuuaggccgggugcaguggcucaugccu

SEQ ID NO: 360115 - RNA, 32 nt, Human
cauuuuuaggguuucuccaucccugggguuug

SEQ ID NO: 360116 - RNA, 32 nt, Human
cauuuuuaguauuuagauugugccucaaaguu

SEQ ID NO: 360117 - RNA, 32 nt, Human
cauuuuuaucuauuuuucccuuucucuuacau

SEQ ID NO: 360118 - RNA, 31 nt, Human
cauuuuucaauaaaacuacugaaaauuugaa

SEQ ID NO: 360119 - RNA, 32 nt, Human
cauuuuucacaucuucauucacugggauucug

SEQ ID NO: 360120 - RNA, 32 nt, Human
cauuuuucagacuuuuaugcucugcuucucuu

SEQ ID NO: 360121 - RNA, 32 nt, Human
cauuuuucagagguggaaaugguucagaaagg

SEQ ID NO: 360122 - RNA, 32 nt, Human
cauuuuucaugcagucauuugcagugaauuau

SEQ ID NO: 360123 - RNA, 32 nt, Human
cauuuuucauggcugcauaguauuccauggug

SEQ ID NO: 360124 - RNA, 32 nt, Human
cauuuuucccggcacuuaccugccuuucucuc

SEQ ID NO: 360125 - RNA, 32 nt, Human
cauuuuuccguguccuccuuuauuuaacucca

SEQ ID NO: 360126 - RNA, 32 nt, Human
cauuuuuccuuccucccuuccuucccuucccu

SEQ ID NO: 360127 - RNA, 32 nt, Human
cauuuuuccuucucccuucccuuuggacagug

SEQ ID NO: 360128 - RNA, 32 nt, Human
cauuuuucuacuuugcuuuucucuccauacuu

SEQ ID NO: 360129 - RNA, 32 nt, Human
cauuuuucuagcauuuucagaaacucaucgga

SEQ ID NO: 360130 - RNA, 32 nt, Human
cauuuuucuccucaucuuaagcauuuugaaac

SEQ ID NO: 360131 - RNA, 32 nt, Human
cauuuuucuccucucucuuucauuguuugacu

SEQ ID NO: 360132 - RNA, 32 nt, Human
cauuuuucucucauuccauuucugccuuaacu

SEQ ID NO: 360133 - RNA, 32 nt, Human
cauuuuucuuccaggaugguguuacugcaguu

SEQ ID NO: 360134 - RNA, 32 nt, Human
cauuuuugaacagugacugagauucuagaaaa

SEQ ID NO: 360135 - RNA, 32 nt, Human
cauuuuugaagacaucaaagacucagguuaaa

SEQ ID NO: 360136 - RNA, 32 nt, Human
cauuuuugagaacaggcuuuugauaaacucac

SEQ ID NO: 360137 - RNA, 32 nt, Human
cauuuuugagugguccaagccugcuguuuuga

SEQ ID NO: 360138 - RNA, 32 nt, Human
cauuuuugcaauuggagauguuugugaggaaa

SEQ ID NO: 360139 - RNA, 32 nt, Human
cauuuuugucauuuccauuaccacagauguaa

SEQ ID NO: 360140 - RNA, 32 nt, Human
cauuuuuguccacaucuccuaggacccauaag

SEQ ID NO: 360141 - RNA, 21 nt, Human
cauuuuuuggcaguguucaua

SEQ ID NO: 360142 - RNA, 22 nt, Human
ccaaaaaacuguagucuacuca

SEQ ID NO: 360143 - RNA, 24 nt, Human
ccaaaaaaggcugggauuacaggc

SEQ ID NO: 360144 - RNA, 32 nt, Human
ccaaaaacaaagugcaaagcugcuugaaucag

SEQ ID NO: 360145 - RNA, 32 nt, Human
ccaaaaaccaaaacagugauauuuccagaacu

SEQ ID NO: 360146 - RNA, 32 nt, Human
ccaaaaaccauucuguccuccuggaccucuua

SEQ ID NO: 360147 - RNA, 32 nt, Human
ccaaaaagaaaaucagcuuuucuaagaucaag

SEQ ID NO: 360148 - RNA, 22 nt, Human
ccaaaaagagggaagagucaca

SEQ ID NO: 360149 - RNA, 32 nt, Human
ccaaaaagcaaacagaaagaaggaaggauggu

SEQ ID NO: 360150 - RNA, 22 nt, Human
ccaaaaagccuacaacauagau

SEQ ID NO: 360151 - RNA, 31 nt, Human
ccaaaaagcuaguuuugucuaccucaguucu

SEQ ID NO: 360152 - RNA, 23 nt, Human
ccaaaaaggggucaauuguccag

SEQ ID NO: 360153 - RNA, 32 nt, Human
ccaaaaagguaggagguaucaccaucuggaau

SEQ ID NO: 360154 - RNA, 24 nt, Human
ccaaaaaguuccaguugcaaagau

SEQ ID NO: 360155 - RNA, 22 nt, Human
ccaaaaaguugcaaucaaagau

SEQ ID NO: 360156 - RNA, 32 nt, Human
ccaaaaauacaaaaaguuagcugggcauggug

SEQ ID NO: 360157 - RNA, 32 nt, Human
ccaaaaauacaaaaauuagcuagacauagugg

SEQ ID NO: 360158 - RNA, 32 nt, Human
ccaaaaauacaaaaauuagcugggcguggugg

SEQ ID NO: 360159 - RNA, 32 nt, Human
ccaaaaauacaaaaauuagcugggcuucgugg

SEQ ID NO: 360160 - RNA, 32 nt, Human
ccaaaaauacaaaaauuagcugggcuuggugg

SEQ ID NO: 360161 - RNA, 32 nt, Human
ccaaaaauacaaaaauuagcugggugcgaugg

SEQ ID NO: 360162 - RNA, 32 nt, Human
ccaaaaaucaaccuaucaaagcuucaaaaacu

SEQ ID NO: 360163 - RNA, 32 nt, Human
ccaaaaaucucaucuuggguguuuucagggcu

SEQ ID NO: 360164 - RNA, 32 nt, Human
ccaaaaauuaacccaaacuugcauuauuuguc

SEQ ID NO: 360165 - RNA, 32 nt, Human
ccaaaaauuagcccagcuaauuuuuguauuuu

SEQ ID NO: 360166 - RNA, 32 nt, Human
ccaaaaauucacugaccaaccaaccaaacucc

SEQ ID NO: 360167 - RNA, 32 nt, Human
ccaaaaauuccucugcgcugggguccgacugc

SEQ ID NO: 360168 - RNA, 20 nt, Human
ccaaaacaaaagaaccaaga

SEQ ID NO: 360169 - RNA, 32 nt, Human
ccaaaacaacccagcuucaccccaugucccuu

SEQ ID NO: 360170 - RNA, 32 nt, Human
ccaaaacacacguuucuuuguuacagucauuu

SEQ ID NO: 360171 - RNA, 32 nt, Human
ccaaaacaccacugcuuccuacccagguggcg

SEQ ID NO: 360172 - RNA, 32 nt, Human
ccaaaacagccuguucucuccucucuccuccc

SEQ ID NO: 360173 - RNA, 32 nt, Human
ccaaaacaucauuauguggcacaugauuauaa

SEQ ID NO: 360174 - RNA, 32 nt, Human
ccaaaacauuuccaacacagaacuuccauuca

SEQ ID NO: 360175 - RNA, 23 nt, Human
ccaaaaccaaaggacaacugagg

SEQ ID NO: 360176 - RNA, 32 nt, Human
ccaaaaccaacaccaacucugccaacggagcc

SEQ ID NO: 360177 - RNA, 32 nt, Human
ccaaaaccaaguuucaggaaaauaacucuaug

SEQ ID NO: 360178 - RNA, 32 nt, Human
ccaaaaccaccaugacacaguuuuuauagugu

SEQ ID NO: 360179 - RNA, 31 nt, Human
ccaaaaccaguggaaagauggguagagucau

SEQ ID NO: 360180 - RNA, 32 nt, Human
ccaaaacccagccaucggggaagggucagggc

SEQ ID NO: 360181 - RNA, 32 nt, Human
ccaaaacccagcugcaccccuuccugggcaca

SEQ ID NO: 360182 - RNA, 21 nt, Human
ccaaaaccccaccucccuuua

SEQ ID NO: 360183 - RNA, 32 nt, Human
ccaaaacccccagcuacugcagacugucuggc

SEQ ID NO: 360184 - RNA, 32 nt, Human
ccaaaacccuaccccucucucucccucucuca

SEQ ID NO: 360185 - RNA, 32 nt, Human
ccaaaacccuccuucacagggcccagaggcuu

SEQ ID NO: 360186 - RNA, 32 nt, Human
ccaaaacccuucuugcaugcaggauguaauga

SEQ ID NO: 360187 - RNA, 32 nt, Human
ccaaaaccuagagugguaguuuuauguaaaug

SEQ ID NO: 360188 - RNA, 32 nt, Human
ccaaaaccuggcacccagaacaguuggaagug

SEQ ID NO: 360189 - RNA, 24 nt, Human
ccaaaacgaggggaagaggaugau

SEQ ID NO: 360190 - RNA, 32 nt, Human
ccaaaacggcuuuucugacacuccagguagcg

SEQ ID NO: 360191 - RNA, 21 nt, Human
ccaaaacgguaauacgugaaa

SEQ ID NO: 360192 - RNA, 32 nt, Human
ccaaaacuagaaagaaggaagcagggagcggu

SEQ ID NO: 360193 - RNA, 32 nt, Human
ccaaaacucuagacauaacaggcuauguuuuu

SEQ ID NO: 360194 - RNA, 32 nt, Human
ccaaaacugucuucaaccacaugacucaacag

SEQ ID NO: 360195 - RNA, 22 nt, Human
ccaaaacuuuuauuaaaaccaa

SEQ ID NO: 360196 - RNA, 32 nt, Human
ccaaaagaccacagcauaaagagcuucugaaa

SEQ ID NO: 360197 - RNA, 32 nt, Human
ccaaaagagaagcaauccaugcagugauggau

SEQ ID NO: 360198 - RNA, 32 nt, Human
ccaaaagagagaggagaaaauacagcucugau

SEQ ID NO: 360199 - RNA, 32 nt, Human
ccaaaagagaucugcugaucugcugagaauuu

SEQ ID NO: 360200 - RNA, 32 nt, Human
ccaaaagagaugacccugccccuugcccaggg

SEQ ID NO: 360201 - RNA, 25 nt, Human
ccaaaagagcugggauuacaagugu

SEQ ID NO: 360202 - RNA, 32 nt, Human
ccaaaagaucacauuuauacccaaagcuuucu

SEQ ID NO: 360203 - RNA, 32 nt, Human
ccaaaagaucacugcaaaccugccucaagaag

SEQ ID NO: 360204 - RNA, 32 nt, Human
ccaaaagcacacaagcacauacagacauaugc

SEQ ID NO: 360205 - RNA, 32 nt, Human
ccaaaagcagaggcucgcucuuuccuugccua

SEQ ID NO: 360206 - RNA, 32 nt, Human
ccaaaagccaaggggaauuuugcagugauagg

SEQ ID NO: 360207 - RNA, 32 nt, Human
ccaaaagcccagggcuccaggcugccaucagg

SEQ ID NO: 360208 - RNA, 32 nt, Human
ccaaaagccugggaagaauuuucccuauccag

SEQ ID NO: 360209 - RNA, 32 nt, Human
ccaaaagcuggagugugaggcaggaggcugga

SEQ ID NO: 360210 - RNA, 23 nt, Human
ccaaaagcugggauuacaggcgu

SEQ ID NO: 360211 - RNA, 32 nt, Human
ccaaaagcuggguuccaggaacuggaucauau

SEQ ID NO: 360212 - RNA, 32 nt, Human
ccaaaagcugugccuuugccugacccggcgua

SEQ ID NO: 360213 - RNA, 32 nt, Human
ccaaaagcuuuccagaugaucugccucggaug

SEQ ID NO: 360214 - RNA, 32 nt, Human
ccaaaagcuuugccacauucuucacauuugua

SEQ ID NO: 360215 - RNA, 32 nt, Human
ccaaaaggaaaucaacugaguggguguuugga

SEQ ID NO: 360216 - RNA, 32 nt, Human
ccaaaaggaacgugucucucuccaagucugug

SEQ ID NO: 360217 - RNA, 32 nt, Human
ccaaaaggagggaaagugugaagaauaaagua

SEQ ID NO: 360218 - RNA, 32 nt, Human
ccaaaaggauuuuagcauauguuaagaggaau

SEQ ID NO: 360219 - RNA, 24 nt, Human
ccaaaaggcagacauugcagugag

SEQ ID NO: 360220 - RNA, 24 nt, Human
ccaaaaggcggagguugcagugag

SEQ ID NO: 360221 - RNA, 32 nt, Human
ccaaaagggaaagagaaagugaaaagaaacug

SEQ ID NO: 360222 - RNA, 32 nt, Human
ccaaaagggaaagagaaaguggaagaaacuga

SEQ ID NO: 360223 - RNA, 32 nt, Human
ccaaaaggggcugcugccugagggcuaacuag

SEQ ID NO: 360224 - RNA, 32 nt, Human
ccaaaagggggaggcgagaggagccagaagca

SEQ ID NO: 360225 - RNA, 32 nt, Human
ccaaaagguaccccgauggccaagcaauuccu

SEQ ID NO: 360226 - RNA, 32 nt, Human
ccaaaagguagaagcagcccaagugucauccc

SEQ ID NO: 360227 - RNA, 24 nt, Human
ccaaaagguggaggcugcagugag

SEQ ID NO: 360228 - RNA, 32 nt, Human
ccaaaaguagcuuuguuuuccuuuguauuuug

SEQ ID NO: 360229 - RNA, 32 nt, Human
ccaaaagucugcuucacugagaugcuaccuug

SEQ ID NO: 360230 - RNA, 18 nt, Human
ccaaaagugagaucgcca

SEQ ID NO: 360231 - RNA, 32 nt, Human
ccaaaagugccacccuggcuucaugucuugaa

SEQ ID NO: 360232 - RNA, 25 nt, Human
ccaaaagugcuggaauuacaggcgu

SEQ ID NO: 360233 - RNA, 21 nt, Human
ccaaaagugcuggauuacagg

SEQ ID NO: 360234 - RNA, 22 nt, Human
ccaaaagugcugggauuacagg

SEQ ID NO: 360235 - RNA, 23 nt, Human
ccaaaagugcugggauuacaggc

SEQ ID NO: 360236 - RNA, 24 nt, Human
ccaaaagugcugggauuacaggca

SEQ ID NO: 360237 - RNA, 25 nt, Human
ccaaaagugcugggauuacaggcgu

SEQ ID NO: 360238 - RNA, 23 nt, Human
ccaaaagugcugggauuacuagc

SEQ ID NO: 360239 - RNA, 23 nt, Human
ccaaaagugcuggguuuacaggc

SEQ ID NO: 360240 - RNA, 32 nt, Human
ccaaaagugcuugagaaucugccugagggcuu

SEQ ID NO: 360241 - RNA, 25 nt, Human
ccaaaaguguugggauuacaggugu

SEQ ID NO: 360242 - RNA, 32 nt, Human
ccaaaaguuugagaccagccugggcaacauag

SEQ ID NO: 360243 - RNA, 32 nt, Human
ccaaaaguuuuuaaaauaugcuacucugaaaa

SEQ ID NO: 360244 - RNA, 32 nt, Human
ccaaaauaauguccacuucucccuuucaugcu

SEQ ID NO: 360245 - RNA, 23 nt, Human
ccaaaauacuaugccccuuaaua

SEQ ID NO: 360246 - RNA, 32 nt, Human
ccaaaauaguacagccuugaaucuauaaaacu

SEQ ID NO: 360247 - RNA, 32 nt, Human
ccaaaauaguggaaccccgucgcuacuaaaaa

SEQ ID NO: 360248 - RNA, 25 nt, Human
ccaaaauauuaacuggggagcugcu

SEQ ID NO: 360249 - RNA, 32 nt, Human
ccaaaaucacuugaggccaggaguucaagaaa

SEQ ID NO: 360250 - RNA, 32 nt, Human
ccaaaaucacuugaggccaggaguucaagacc

SEQ ID NO: 360251 - RNA, 32 nt, Human
ccaaaaucagauuguuuucacaguuaugauuc

SEQ ID NO: 360252 - RNA, 32 nt, Human
ccaaaaucccagacacucccauggacaccgaa

SEQ ID NO: 360253 - RNA, 17 nt, Human
ccaaaaucccucgggug

SEQ ID NO: 360254 - RNA, 23 nt, Human
ccaaaauccugggauuacaggcg

SEQ ID NO: 360255 - RNA, 32 nt, Human
ccaaaaugaaaaaccagaaggccauuuggugu

SEQ ID NO: 360256 - RNA, 19 nt, Human
ccaaaaugaaccagauacc

SEQ ID NO: 360257 - RNA, 32 nt, Human
ccaaaaugaauaguuacucaccauggaaaaga

SEQ ID NO: 360258 - RNA, 32 nt, Human
ccaaaaugaauccauuucccaguuugacaaau

SEQ ID NO: 360259 - RNA, 32 nt, Human
ccaaaaugaauuccaagacaaugaaggaguga

SEQ ID NO: 360260 - RNA, 32 nt, Human
ccaaaaugaccuucaggaccggccuguuuccc

SEQ ID NO: 360261 - RNA, 32 nt, Human
ccaaaaugagccaagcaugguggcgggagccu

SEQ ID NO: 360262 - RNA, 24 nt, Human
ccaaaaugaugaaaccccaucucu

SEQ ID NO: 360263 - RNA, 30 nt, Human
ccaaaaugauuucuucaaagcccagacuug

SEQ ID NO: 360264 - RNA, 32 nt, Human
ccaaaaugccugcuuaguuuuuaaagauggaa

SEQ ID NO: 360265 - RNA, 32 nt, Human
ccaaaaugccugucccagccuccuggccccau

SEQ ID NO: 360266 - RNA, 24 nt, Human
ccaaaaugcugagauuacaggugu

SEQ ID NO: 360267 - RNA, 26 nt, Human
ccaaaaugcugcgauuauauaggcgu

SEQ ID NO: 360268 - RNA, 22 nt, Human
ccaaaaugcugggacuaugggc

SEQ ID NO: 360269 - RNA, 24 nt, Human
ccaaaaugcugggauuacaagcgu

SEQ ID NO: 360270 - RNA, 24 nt, Human
ccaaaaugcugggauuacagaugu

SEQ ID NO: 360271 - RNA, 21 nt, Human
ccaaaaugcugggauuacagg

SEQ ID NO: 360272 - RNA, 24 nt, Human
ccaaaaugcugggauuacaggagu

SEQ ID NO: 360273 - RNA, 22 nt, Human
ccaaaaugcugggauuacaggc

SEQ ID NO: 360274 - RNA, 24 nt, Human
ccaaaaugcugggauuacaggcgu

SEQ ID NO: 360275 - RNA, 24 nt, Human
ccaaaaugcugggauuacaggggu

SEQ ID NO: 360276 - RNA, 22 nt, Human
ccaaaaugcugggauuacaugc

SEQ ID NO: 360277 - RNA, 24 nt, Human
ccaaaaugcugggauuagaggugu

SEQ ID NO: 360278 - RNA, 22 nt, Human
ccaaaaugcuucgauugcaggc

SEQ ID NO: 360279 - RNA, 22 nt, Human
ccaaaaugcuuggauuacaggc

SEQ ID NO: 360280 - RNA, 32 nt, Human
ccaaaauggagauggcaucaaacuagugguca

SEQ ID NO: 360281 - RNA, 32 nt, Human
ccaaaaugggaaaggaaaagacucauaccaac

SEQ ID NO: 360282 - RNA, 30 nt, Human
ccaaaaugggaaaggaaaagacucauauca

SEQ ID NO: 360283 - RNA, 32 nt, Human
ccaaaaugggaaaggaaaagacucauaucaac

SEQ ID NO: 360284 - RNA, 24 nt, Human
ccaaaauggugggauuacaggugu

SEQ ID NO: 360285 - RNA, 19 nt, Human
ccaaaauguccucccacaa

SEQ ID NO: 360286 - RNA, 32 nt, Human
ccaaaaugugaagcggggagggcggagacgca

SEQ ID NO: 360287 - RNA, 22 nt, Human
ccaaaauguugagauugcaggc

SEQ ID NO: 360288 - RNA, 22 nt, Human
ccaaaauguugcaauuacaggc

SEQ ID NO: 360289 - RNA, 32 nt, Human
ccaaaauuagcugggugugguggugcacgcau

SEQ ID NO: 360290 - RNA, 22 nt, Human
ccaaaauucugggauuacaggc

SEQ ID NO: 360291 - RNA, 32 nt, Human
ccaaaauuuucuucccugacaaugucuccuac

SEQ ID NO: 360292 - RNA, 32 nt, Human
ccaaacaaaaagcaggaaaaacaaaugggaaa

SEQ ID NO: 360293 - RNA, 21 nt, Human
ccaaacaaauggauuuuccca

SEQ ID NO: 360294 - RNA, 32 nt, Human
ccaaacacacaaaagcccaugguugcgguugc

SEQ ID NO: 360295 - RNA, 18 nt, Human
ccaaacacauucuccuuu

SEQ ID NO: 360296 - RNA, 19 nt, Human
ccaaacaccaagcgcucca

SEQ ID NO: 360297 - RNA, 32 nt, Human
ccaaacaccacagccuucuccagagccggcac

SEQ ID NO: 360298 - RNA, 20 nt, Human
ccaaacaccacauguucuca

SEQ ID NO: 360299 - RNA, 20 nt, Human
ccaaacaccaccuuuuugcc

SEQ ID NO: 360300 - RNA, 32 nt, Human
ccaaacaccagaccacacaguccuccaaaaau

SEQ ID NO: 360301 - RNA, 20 nt, Human
ccaaacacccagcauagcca

SEQ ID NO: 360302 - RNA, 20 nt, Human
ccaaacacccgugcccgcca

SEQ ID NO: 360303 - RNA, 18 nt, Human
ccaaacaccuccuuccca

SEQ ID NO: 360304 - RNA, 18 nt, Human
ccaaacaccucuuuccca

SEQ ID NO: 360305 - RNA, 32 nt, Human
ccaaacaccugacucuuauuacuggaccuaaa

SEQ ID NO: 360306 - RNA, 32 nt, Human
ccaaacaccuucagugcugguggcccucaggc

SEQ ID NO: 360307 - RNA, 19 nt, Human
ccaaacaccuugcugacca

SEQ ID NO: 360308 - RNA, 23 nt, Human
ccaaacacgcggcaccaggagau

SEQ ID NO: 360309 - RNA, 32 nt, Human
ccaaacacuaaccccgcucaggagacucgcac

SEQ ID NO: 360310 - RNA, 32 nt, Human
ccaaacacuagcucuguauuaauccccaucau

SEQ ID NO: 360311 - RNA, 32 nt, Human
ccaaacacugcauauucucacgcacagguggg

SEQ ID NO: 360312 - RNA, 32 nt, Human
ccaaacacugugccuacagccucccaggggug

SEQ ID NO: 360313 - RNA, 19 nt, Human
ccaaacacuuugccagcca

SEQ ID NO: 360314 - RNA, 32 nt, Human
ccaaacagaaagcaguggagguggggguugcu

SEQ ID NO: 360315 - RNA, 21 nt, Human
ccaaacagagacagcuuccag

SEQ ID NO: 360316 - RNA, 32 nt, Human
ccaaacagaguccugguuuccucagccucacc

SEQ ID NO: 360317 - RNA, 21 nt, Human
ccaaacagauggcuuuccagg

SEQ ID NO: 360318 - RNA, 18 nt, Human
ccaaacagcaaaccaaga

SEQ ID NO: 360319 - RNA, 21 nt, Human
ccaaacagcauauuggccagg

SEQ ID NO: 360320 - RNA, 32 nt, Human
ccaaacagccuacucgggguucuuggguagcc

SEQ ID NO: 360321 - RNA, 32 nt, Human
ccaaacagcugcagcuuugggcauuuuucuuu

SEQ ID NO: 360322 - RNA, 23 nt, Human
ccaaacaggcccuccucccuccc

SEQ ID NO: 360323 - RNA, 32 nt, Human
ccaaacaggcugguguacagggagcaacaccg

SEQ ID NO: 360324 - RNA, 22 nt, Human
ccaaacaggguggcuccccagg

SEQ ID NO: 360325 - RNA, 18 nt, Human
ccaaacauccauccaucc

SEQ ID NO: 360326 - RNA, 32 nt, Human
ccaaacaucuuauugauacuuacuucaagaag

SEQ ID NO: 360327 - RNA, 32 nt, Human
ccaaacaugcaaaguagaaggggccuggccac

SEQ ID NO: 360328 - RNA, 32 nt, Human
ccaaacaugggaauuuccuaguuauauuuuug

SEQ ID NO: 360329 - RNA, 21 nt, Human
ccaaacauggugaaacccugu

SEQ ID NO: 360330 - RNA, 19 nt, Human
ccaaacauuacaccuccca

SEQ ID NO: 360331 - RNA, 32 nt, Human
ccaaaccaaaaauaaagaguuuaguugaggag

SEQ ID NO: 360332 - RNA, 20 nt, Human
ccaaaccaaacugcacgaca

SEQ ID NO: 360333 - RNA, 32 nt, Human
ccaaaccaagacaacauguacauaaagauuuc

SEQ ID NO: 360334 - RNA, 18 nt, Human
ccaaaccaagugcuucca

SEQ ID NO: 360335 - RNA, 32 nt, Human
ccaaaccaaucucgguggaaacuccuauccua

SEQ ID NO: 360336 - RNA, 32 nt, Human
ccaaaccacagccucugcaucaaccagcccca

SEQ ID NO: 360337 - RNA, 32 nt, Human
ccaaaccacaucuuuucaugcuuugagacuuc

SEQ ID NO: 360338 - RNA, 32 nt, Human
ccaaaccagaaaccuccaauucucauguggaa

SEQ ID NO: 360339 - RNA, 32 nt, Human
ccaaaccagagguggaggaagaacgguaggaa

SEQ ID NO: 360340 - RNA, 32 nt, Human
ccaaacccaagaaggucuggcaaagucaggcu

SEQ ID NO: 360341 - RNA, 32 nt, Human
ccaaacccaaguguccaaggcuccaguccuag

SEQ ID NO: 360342 - RNA, 32 nt, Human
ccaaacccacacaccagccuccucagacaaaa

SEQ ID NO: 360343 - RNA, 32 nt, Human
ccaaacccagccaccccacuacccgcuacccg

SEQ ID NO: 360344 - RNA, 32 nt, Human
ccaaacccagcccagaaguuguauuuuaugug

SEQ ID NO: 360345 - RNA, 32 nt, Human
ccaaacccagucccucuacucucccaucucac

SEQ ID NO: 360346 - RNA, 22 nt, Human
ccaaacccauaggucugaaacu

SEQ ID NO: 360347 - RNA, 32 nt, Human
ccaaaccccagccugcaagucugucccaggcu

SEQ ID NO: 360348 - RNA, 32 nt, Human
ccaaaccccucucggccgggugcaguggcuua

SEQ ID NO: 360349 - RNA, 32 nt, Human
ccaaacccuacuccaagucugaaccuccaagg

SEQ ID NO: 360350 - RNA, 32 nt, Human
ccaaacccugaggagcucugcaggccccacau

SEQ ID NO: 360351 - RNA, 23 nt, Human
ccaaacccuuccccaggccagcu

SEQ ID NO: 360352 - RNA, 32 nt, Human
ccaaacccuuucucuuucucccaggcagggcu

SEQ ID NO: 360353 - RNA, 32 nt, Human
ccaaaccgcacacccagacgcacacgcauacc

SEQ ID NO: 360354 - RNA, 18 nt, Human
ccaaaccgcgggcgcacg

SEQ ID NO: 360355 - RNA, 23 nt, Human
ccaaaccuaauaaaguuuuccca

SEQ ID NO: 360356 - RNA, 32 nt, Human
ccaaaccuccacugcugcucccggguccugcu

SEQ ID NO: 360357 - RNA, 32 nt, Human
ccaaaccucuacuguuugggacaguaagccaa

SEQ ID NO: 360358 - RNA, 32 nt, Human
ccaaaccugccugacuuccugcuccuggccac

SEQ ID NO: 360359 - RNA, 21 nt, Human
ccaaaccugcugcagcugcca

SEQ ID NO: 360360 - RNA, 20 nt, Human
ccaaaccugcugucaccuug

SEQ ID NO: 360361 - RNA, 23 nt, Human
ccaaaccugcuuccgcaaugggu

SEQ ID NO: 360362 - RNA, 18 nt, Human
ccaaaccugcuuuuccca

SEQ ID NO: 360363 - RNA, 22 nt, Human
ccaaaccuggaagcagcagcag

SEQ ID NO: 360364 - RNA, 32 nt, Human
ccaaaccugugauuccagaaaaguagauccua

SEQ ID NO: 360365 - RNA, 32 nt, Human
ccaaaccuguuccccucugcuacuagccacug

SEQ ID NO: 360366 - RNA, 32 nt, Human
ccaaaccuguucugucccacuggccagccauc

SEQ ID NO: 360367 - RNA, 32 nt, Human
ccaaaccuguucuucuguuucuguggcaccua

SEQ ID NO: 360368 - RNA, 32 nt, Human
ccaaaccuuaaaacgaaggcaaaccuuccuuc

SEQ ID NO: 360369 - RNA, 32 nt, Human
ccaaaccuugcuguucacagucuccaauucuu

SEQ ID NO: 360370 - RNA, 32 nt, Human
ccaaacgaggaaggacacagacccaaaagcca

SEQ ID NO: 360371 - RNA, 32 nt, Human
ccaaacgcccuuuccuccucaggcacacagcu

SEQ ID NO: 360372 - RNA, 32 nt, Human
ccaaacggauuugcgugaaaccagcccaaggu

SEQ ID NO: 360373 - RNA, 32 nt, Human
ccaaacggcuggggaagaagagauuuggacau

SEQ ID NO: 360374 - RNA, 19 nt, Human
ccaaacguccuggacugca

SEQ ID NO: 360375 - RNA, 32 nt, Human
ccaaacguucagagucacagacuguagaaaau

SEQ ID NO: 360376 - RNA, 32 nt, Human
ccaaacuaaaccaaaagaagaaguaaaacagc

SEQ ID NO: 360377 - RNA, 31 nt, Human
ccaaacuaccucucugauagcugguguucau

SEQ ID NO: 360378 - RNA, 32 nt, Human
ccaaacucacuguccccacuguggcaugaggg

SEQ ID NO: 360379 - RNA, 32 nt, Human
ccaaacucagauuuuaagguuuggacaagaag

SEQ ID NO: 360380 - RNA, 32 nt, Human
ccaaacucagcaugacuccuguccucuucaau

SEQ ID NO: 360381 - RNA, 32 nt, Human
ccaaacucagcccuucuuggaauacagccuuu

SEQ ID NO: 360382 - RNA, 32 nt, Human
ccaaacucaggcugccccgagugggcuucagc

SEQ ID NO: 360383 - RNA, 32 nt, Human
ccaaacuccacaaguaugggacccuggagggg

SEQ ID NO: 360384 - RNA, 32 nt, Human
ccaaacuccaccaccuauccccaaaccuguaa

SEQ ID NO: 360385 - RNA, 32 nt, Human
ccaaacuccaccuucugugcuuuuugcuuggg

SEQ ID NO: 360386 - RNA, 24 nt, Human
ccaaacuccagagguggaccuggg

SEQ ID NO: 360387 - RNA, 25 nt, Human
ccaaacuccaggcucagaugucaca

SEQ ID NO: 360388 - RNA, 32 nt, Human
ccaaacuccgccccaaaaaggagaguaacaaa

SEQ ID NO: 360389 - RNA, 32 nt, Human
ccaaacuccuuaucuuuugcagucucucuggg

SEQ ID NO: 360390 - RNA, 32 nt, Human
ccaaacucucaggcacaaagucaaauggcuaa

SEQ ID NO: 360391 - RNA, 32 nt, Human
ccaaacucuccagccacucucuucuacgcugc

SEQ ID NO: 360392 - RNA, 32 nt, Human
ccaaacucucccuuucuccauccaaucggucc

SEQ ID NO: 360393 - RNA, 32 nt, Human
ccaaacucugcaggagaaaggcagcaugguac

SEQ ID NO: 360394 - RNA, 32 nt, Human
ccaaacucugccagggcucccagugagggucc

SEQ ID NO: 360395 - RNA, 32 nt, Human
ccaaacucugugucagcaucuuugcccuucug

SEQ ID NO: 360396 - RNA, 32 nt, Human
ccaaacucuucccauaaauuaucuuuucuucu

SEQ ID NO: 360397 - RNA, 32 nt, Human
ccaaacucuucugucacuaucaguguccaucu

SEQ ID NO: 360398 - RNA, 22 nt, Human
ccaaacucuugccuuucuugua

SEQ ID NO: 360399 - RNA, 32 nt, Human
ccaaacucuuucuccugucuuggguuggcugg

SEQ ID NO: 360400 - RNA, 32 nt, Human
ccaaacugaaaauacagauagcuguuccguca

SEQ ID NO: 360401 - RNA, 32 nt, Human
ccaaacugacagguaaauguagcccucagagc

SEQ ID NO: 360402 - RNA, 19 nt, Human
ccaaacugcagugcugcca

SEQ ID NO: 360403 - RNA, 32 nt, Human
ccaaacugccacuccacuccaggugggccacu

SEQ ID NO: 360404 - RNA, 24 nt, Human
ccaaacugcugggauuacaggcgu

SEQ ID NO: 360405 - RNA, 24 nt, Human
ccaaacugcugggauuacaggugu

SEQ ID NO: 360406 - RNA, 21 nt, Human
ccaaacugcugggauuauagg

SEQ ID NO: 360407 - RNA, 24 nt, Human
ccaaacugcugggauuauaggcgu

SEQ ID NO: 360408 - RNA, 32 nt, Human
ccaaacuggagauucuucaccuucgcucuaug

SEQ ID NO: 360409 - RNA, 23 nt, Human
ccaaacuggagcugucccuggcc

SEQ ID NO: 360410 - RNA, 32 nt, Human
ccaaacuggaucggucaacauggucuuccccc

SEQ ID NO: 360411 - RNA, 22 nt, Human
ccaaacuggggccaccucugua

SEQ ID NO: 360412 - RNA, 32 nt, Human
ccaaacugggguccaccaagugggggaagggg

SEQ ID NO: 360413 - RNA, 22 nt, Human
ccaaacuggugagauuacaggc

SEQ ID NO: 360414 - RNA, 18 nt, Human
ccaaacugugacaggaga

SEQ ID NO: 360415 - RNA, 32 nt, Human
ccaaacugugacugguauuuauuggacccaga

SEQ ID NO: 360416 - RNA, 32 nt, Human
ccaaacuuaggaucccucccagccccagcccu

SEQ ID NO: 360417 - RNA, 20 nt, Human
ccaaacuuaguggacaaugg

SEQ ID NO: 360418 - RNA, 32 nt, Human
ccaaacuucaaaaaguuaauuauugucauaau

SEQ ID NO: 360419 - RNA, 32 nt, Human
ccaaacuucagcaacuguuaauacucagauca

SEQ ID NO: 360420 - RNA, 32 nt, Human
ccaaacuuccugcuuaguguucugaaaucugu

SEQ ID NO: 360421 - RNA, 32 nt, Human
ccaaacuucucccuguucccaaacccugccua

SEQ ID NO: 360422 - RNA, 32 nt, Human
ccaaacuucuggcaaauuuaccugugaauuuc

SEQ ID NO: 360423 - RNA, 24 nt, Human
ccaaacuucugggauuacaggcgu

SEQ ID NO: 360424 - RNA, 31 nt, Human
ccaaacuucuuucauuuaaagaaccaaacuu

SEQ ID NO: 360425 - RNA, 20 nt, Human
ccaaacuuggcuuccuagcc

SEQ ID NO: 360426 - RNA, 32 nt, Human
ccaaacuuguucuccccguccugguccagggc

SEQ ID NO: 360427 - RNA, 32 nt, Human
ccaaacuuugcuuaaggaugagaaaugagaug

SEQ ID NO: 360428 - RNA, 32 nt, Human
ccaaacuuuuccuggugauugaauucuuacca

SEQ ID NO: 360429 - RNA, 32 nt, Human
ccaaacuuuucugccaaccucuuacucugaau

SEQ ID NO: 360430 - RNA, 32 nt, Human
ccaaagaaaaggcccugccagguccaauguug

SEQ ID NO: 360431 - RNA, 32 nt, Human
ccaaagaaacaaagauccacacacauccucac

SEQ ID NO: 360432 - RNA, 32 nt, Human
ccaaagaaacauagacaacuguagaggcaaug

SEQ ID NO: 360433 - RNA, 25 nt, Human
ccaaagaaagugcugggauuacagg

SEQ ID NO: 360434 - RNA, 32 nt, Human
ccaaagaacagauccuggaauugcuggugcug

SEQ ID NO: 360435 - RNA, 32 nt, Human
ccaaagaacaucugcacuccugaacacacccu

SEQ ID NO: 360436 - RNA, 32 nt, Human
ccaaagaaccacggcccucucccuuuacuguu

SEQ ID NO: 360437 - RNA, 22 nt, Human
ccaaagaacugggauuacaggc

SEQ ID NO: 360438 - RNA, 32 nt, Human
ccaaagaagaggagggaucaaguuaugaaggc

SEQ ID NO: 360439 - RNA, 32 nt, Human
ccaaagaagccuugccaucuggcgcucccaug

SEQ ID NO: 360440 - RNA, 32 nt, Human
ccaaagaagguguuuuccugaagaacugucua

SEQ ID NO: 360441 - RNA, 32 nt, Human
ccaaagaauucucauguacucuaccuucaaga

SEQ ID NO: 360442 - RNA, 32 nt, Human
ccaaagacauacaguguuuuacauucucuccu

SEQ ID NO: 360443 - RNA, 18 nt, Human
ccaaagacaucagucucc

SEQ ID NO: 360444 - RNA, 32 nt, Human
ccaaagaccccuagcgcggccuggugagcggg

SEQ ID NO: 360445 - RNA, 32 nt, Human
ccaaagacccuccucccugcaggcacuguggg

SEQ ID NO: 360446 - RNA, 32 nt, Human
ccaaagacccugggaaccuccucuggucuucc

SEQ ID NO: 360447 - RNA, 32 nt, Human
ccaaagacucagagaacuagaguuuaagcuga

SEQ ID NO: 360448 - RNA, 32 nt, Human
ccaaagacuguacuggccagugucauuuuauu

SEQ ID NO: 360449 - RNA, 32 nt, Human
ccaaagagaagaucuggucagcagagccgccc

SEQ ID NO: 360450 - RNA, 22 nt, Human
ccaaagagacaagcacuugaaa

SEQ ID NO: 360451 - RNA, 32 nt, Human
ccaaagagagcgcugaaaauggacucacuguc

SEQ ID NO: 360452 - RNA, 32 nt, Human
ccaaagagagugagaguagaagcugaaagacu

SEQ ID NO: 360453 - RNA, 19 nt, Human
ccaaagagaugugcugcag

SEQ ID NO: 360454 - RNA, 32 nt, Human
ccaaagagcagcuucucagaucuucaguguuc

SEQ ID NO: 360455 - RNA, 32 nt, Human
ccaaagagcagggcagaggguggcaguggcac

SEQ ID NO: 360456 - RNA, 32 nt, Human
ccaaagagccaugugucauguaauacugaacc

SEQ ID NO: 360457 - RNA, 32 nt, Human
ccaaagagcgaaggaagguucaguucagagga

SEQ ID NO: 360458 - RNA, 24 nt, Human
ccaaagagcugagauuacaggcgu

SEQ ID NO: 360459 - RNA, 24 nt, Human
ccaaagagcugggauuacaggcgu

SEQ ID NO: 360460 - RNA, 24 nt, Human
ccaaagagcugggauuacaggugu

SEQ ID NO: 360461 - RNA, 32 nt, Human
ccaaagaggaagccaaaggggaagaaacagaa

SEQ ID NO: 360462 - RNA, 32 nt, Human
ccaaagaggaguauggugggagagggagugga

SEQ ID NO: 360463 - RNA, 32 nt, Human
ccaaagaggcagcagcgaggguaggaaguucu

SEQ ID NO: 360464 - RNA, 32 nt, Human
ccaaagaguccugagagaacagaagguguaac

SEQ ID NO: 360465 - RNA, 32 nt, Human
ccaaagaguguguccaccacuccacugugcuc

SEQ ID NO: 360466 - RNA, 32 nt, Human
ccaaagauccuuugcugaguguucuguuuuug

SEQ ID NO: 360467 - RNA, 24 nt, Human
ccaaagaugcuggaccugugcuaa

SEQ ID NO: 360468 - RNA, 32 nt, Human
ccaaagauggccaugauuucuguaugugagac

SEQ ID NO: 360469 - RNA, 32 nt, Human
ccaaagauugggccggguucaaagggagccca

SEQ ID NO: 360470 - RNA, 32 nt, Human
ccaaagauugugaggaaggaaaaucagaggac

SEQ ID NO: 360471 - RNA, 32 nt, Human
ccaaagcaaaccuggugugcagaagcaaguca

SEQ ID NO: 360472 - RNA, 32 nt, Human
ccaaagcaaauucagcuuuccacagcagcacc

SEQ ID NO: 360473 - RNA, 32 nt, Human
ccaaagcaacaccagaaccaagaaggagcucc

SEQ ID NO: 360474 - RNA, 32 nt, Human
ccaaagcaacugugggcaucaggcuguggggc

SEQ ID NO: 360475 - RNA, 32 nt, Human
ccaaagcaagagccuugcuuguuucacccugg

SEQ ID NO: 360476 - RNA, 31 nt, Human
ccaaagcacagcuagcaaaucaaaacaaacu

SEQ ID NO: 360477 - RNA, 22 nt, Human
ccaaagcacugggauuacaagc

SEQ ID NO: 360478 - RNA, 22 nt, Human
ccaaagcacugggauuacaggc

SEQ ID NO: 360479 - RNA, 23 nt, Human
ccaaagcacugggauuacaggca

SEQ ID NO: 360480 - RNA, 24 nt, Human
ccaaagcacugggauuacaggcgu

SEQ ID NO: 360481 - RNA, 24 nt, Human
ccaaagcacuuggauuacagaugu

SEQ ID NO: 360482 - RNA, 32 nt, Human
ccaaagcagccuguugagcugguucuccaggg

SEQ ID NO: 360483 - RNA, 20 nt, Human
ccaaagcaggaagcugcaca

SEQ ID NO: 360484 - RNA, 23 nt, Human
ccaaagcaggaggaucacuugag

SEQ ID NO: 360485 - RNA, 32 nt, Human
ccaaagcaggcggaucaccugaggucaggagu

SEQ ID NO: 360486 - RNA, 32 nt, Human
ccaaagcaggugaaucaccugaggucaggagu

SEQ ID NO: 360487 - RNA, 32 nt, Human
ccaaagcaguaaaauaugauuaauuuucauaa

SEQ ID NO: 360488 - RNA, 32 nt, Human
ccaaagcaucagcuaggcuggagugauuuguu

SEQ ID NO: 360489 - RNA, 32 nt, Human
ccaaagcauguggcauuuggauggccagagug

SEQ ID NO: 360490 - RNA, 22 nt, Human
ccaaagcauugggauuacaggc

SEQ ID NO: 360491 - RNA, 32 nt, Human
ccaaagccacaccacagucgguggugaugcaa

SEQ ID NO: 360492 - RNA, 32 nt, Human
ccaaagccagccccaauuggcacaaggguuca

SEQ ID NO: 360493 - RNA, 32 nt, Human
ccaaagccagccugggcaacauggugaaaccc

SEQ ID NO: 360494 - RNA, 32 nt, Human
ccaaagccauucucccccucuuugggcagugc

SEQ ID NO: 360495 - RNA, 32 nt, Human
ccaaagcccagaaugcagccccgacccaaguu

SEQ ID NO: 360496 - RNA, 21 nt, Human
ccaaagccccagggggugcag

SEQ ID NO: 360497 - RNA, 22 nt, Human
ccaaagccccuaccugcugcug

SEQ ID NO: 360498 - RNA, 19 nt, Human
ccaaagcccugcugagcag

SEQ ID NO: 360499 - RNA, 32 nt, Human
ccaaagccguggacacagcauucgaguguugg

SEQ ID NO: 360500 - RNA, 32 nt, Human
ccaaagccuauuucuucuguaguauuucaagu

SEQ ID NO: 360501 - RNA, 32 nt, Human
ccaaagccuccaccccuuccugaagacccagc

SEQ ID NO: 360502 - RNA, 32 nt, Human
ccaaagccucuuccuccacggccuuugcuccu

SEQ ID NO: 360503 - RNA, 32 nt, Human
ccaaagccugcucucuccuaaggcucucauuc

SEQ ID NO: 360504 - RNA, 32 nt, Human
ccaaagccuucaugccuguaauccgagugcuu

SEQ ID NO: 360505 - RNA, 32 nt, Human
ccaaagccuuucucccuucuugccagaucgau

SEQ ID NO: 360506 - RNA, 32 nt, Human
ccaaagccuuuugucacccaggcuggagugcc

SEQ ID NO: 360507 - RNA, 22 nt, Human
ccaaagcgaagccugugcuacu

SEQ ID NO: 360508 - RNA, 26 nt, Human
ccaaagcgagccuccaggcccagcaa

SEQ ID NO: 360509 - RNA, 24 nt, Human
ccaaagcgauaggauuacaggcgu

SEQ ID NO: 360510 - RNA, 32 nt, Human
ccaaagcgccgagacgagggugcugugucccu

SEQ ID NO: 360511 - RNA, 22 nt, Human
ccaaagcgcuaggauuacaagc

SEQ ID NO: 360512 - RNA, 22 nt, Human
ccaaagcgcugagauuguaggc

SEQ ID NO: 360513 - RNA, 24 nt, Human
ccaaagcgcugggauuacaggcgu

SEQ ID NO: 360514 - RNA, 24 nt, Human
ccaaagcgcugggauuacaggugu

SEQ ID NO: 360515 - RNA, 22 nt, Human
ccaaagcgcugggauuauaggu

SEQ ID NO: 360516 - RNA, 32 nt, Human
ccaaagcggacuaucuggaggcugggcgcaug

SEQ ID NO: 360517 - RNA, 24 nt, Human
ccaaagcggguggguuacuugagg

SEQ ID NO: 360518 - RNA, 22 nt, Human
ccaaagcguugggauuauaggc

SEQ ID NO: 360519 - RNA, 32 nt, Human
ccaaagcuagaaaaggaggaggaagaaacuga

SEQ ID NO: 360520 - RNA, 32 nt, Human
ccaaagcuagaaagggguggacccuggccccg

SEQ ID NO: 360521 - RNA, 32 nt, Human
ccaaagcuagcccaaggcuggggaaggggagg

SEQ ID NO: 360522 - RNA, 32 nt, Human
ccaaagcucacaccuucagccuccaacaugaa

SEQ ID NO: 360523 - RNA, 32 nt, Human
ccaaagcuccccaccccagccugguggcagag

SEQ ID NO: 360524 - RNA, 32 nt, Human
ccaaagcucguguuaagcugugagccccagug

SEQ ID NO: 360525 - RNA, 32 nt, Human
ccaaagcucucauuguacaaaaagccaagccc

SEQ ID NO: 360526 - RNA, 32 nt, Human
ccaaagcucucuccccacccuaccugcccacc

SEQ ID NO: 360527 - RNA, 32 nt, Human
ccaaagcucugcuccugcuccuuaggguggga

SEQ ID NO: 360528 - RNA, 32 nt, Human
ccaaagcugcagccauggaagcagccagggcc

SEQ ID NO: 360529 - RNA, 19 nt, Human
ccaaagcugcugggugcag

SEQ ID NO: 360530 - RNA, 32 nt, Human
ccaaagcugcuuucuucucugccuccuccuca

SEQ ID NO: 360531 - RNA, 32 nt, Human
ccaaagcuggccuccagucccucggcagcgcu

SEQ ID NO: 360532 - RNA, 32 nt, Human
ccaaagcugguuacacaugaccugcaaagucu

SEQ ID NO: 360533 - RNA, 32 nt, Human
ccaaagcuugaagaaagauuguaauagcauuu

SEQ ID NO: 360534 - RNA, 32 nt, Human
ccaaagcuuguugauagagugcaucagaauuu

SEQ ID NO: 360535 - RNA, 32 nt, Human
ccaaagcuuugaagacuuuuaaauccaacccu

SEQ ID NO: 360536 - RNA, 32 nt, Human
ccaaagcuuuggaguggcugcagccaucugga

SEQ ID NO: 360537 - RNA, 32 nt, Human
ccaaaggaaagcuugaaaaaugaagacauuag

SEQ ID NO: 360538 - RNA, 32 nt, Human
ccaaaggaacuggaugggcugcagugaggugg

SEQ ID NO: 360539 - RNA, 32 nt, Human
ccaaaggaagcuaaacaccaccucacacuuga

SEQ ID NO: 360540 - RNA, 32 nt, Human
ccaaaggagaugugcuuccaucagggaauaca

SEQ ID NO: 360541 - RNA, 32 nt, Human
ccaaaggagcagucagggaggggcggugagcc

SEQ ID NO: 360542 - RNA, 21 nt, Human
ccaaaggagguacuuccuccu

SEQ ID NO: 360543 - RNA, 32 nt, Human
ccaaaggauagcuucuuuuucaugaugccagg

SEQ ID NO: 360544 - RNA, 32 nt, Human
ccaaaggauguuuucuuugugaccagaacaca

SEQ ID NO: 360545 - RNA, 32 nt, Human
ccaaaggcacacaaucacagagcauuccuuuu

SEQ ID NO: 360546 - RNA, 32 nt, Human
ccaaaggcaggcaugguggggcuggcaugagu

SEQ ID NO: 360547 - RNA, 32 nt, Human
ccaaaggccacauacaugacaaaaagacugaa

SEQ ID NO: 360548 - RNA, 18 nt, Human
ccaaaggccacauggcca

SEQ ID NO: 360549 - RNA, 32 nt, Human
ccaaaggccaggaguuugaggcugcagugagc

SEQ ID NO: 360550 - RNA, 32 nt, Human
ccaaaggccauggagagcuggagccuggugcc

SEQ ID NO: 360551 - RNA, 32 nt, Human
ccaaaggccccgcaguuuuugcacuugagcug

SEQ ID NO: 360552 - RNA, 32 nt, Human
ccaaaggcccggcgcccuacugugcugccuga

SEQ ID NO: 360553 - RNA, 18 nt, Human
ccaaaggccgcgggcggg

SEQ ID NO: 360554 - RNA, 32 nt, Human
ccaaaggccguucaguucuccugggcuccagc

SEQ ID NO: 360555 - RNA, 32 nt, Human
ccaaaggccuggggcuuccuuggcucuucucc

SEQ ID NO: 360556 - RNA, 18 nt, Human
ccaaaggcuaugcuugcc

SEQ ID NO: 360557 - RNA, 32 nt, Human
ccaaaggcugagggccccaaagccacuugucu

SEQ ID NO: 360558 - RNA, 32 nt, Human
ccaaaggcuugucccuggaauuauuuggcaug

SEQ ID NO: 360559 - RNA, 32 nt, Human
ccaaagggaauagagauucuccaggaauuucc

SEQ ID NO: 360560 - RNA, 32 nt, Human
ccaaagggagagaaacagagacucagggagag

SEQ ID NO: 360561 - RNA, 32 nt, Human
ccaaagggagcacagucugcacccagcucuaa

SEQ ID NO: 360562 - RNA, 32 nt, Human
ccaaagggagcacagucugcacccagcucuca

SEQ ID NO: 360563 - RNA, 23 nt, Human
ccaaagggagggauuacuggcgu

SEQ ID NO: 360564 - RNA, 18 nt, Human
ccaaagggaggggggcgg

SEQ ID NO: 360565 - RNA, 32 nt, Human
ccaaagggauuccaaggcuaaaucuuuguaac

SEQ ID NO: 360566 - RNA, 24 nt, Human
ccaaagggcuagaauuacaggugu

SEQ ID NO: 360567 - RNA, 32 nt, Human
ccaaagggcugaggcagggaggccgugggcca

SEQ ID NO: 360568 - RNA, 24 nt, Human
ccaaagggcugggauuacaggugu

SEQ ID NO: 360569 - RNA, 32 nt, Human
ccaaaggggaaagacuugaugguacguggagc

SEQ ID NO: 360570 - RNA, 32 nt, Human
ccaaaggggcagagggugguggagaggagagg

SEQ ID NO: 360571 - RNA, 21 nt, Human
ccaaaggggccauggaagguu

SEQ ID NO: 360572 - RNA, 32 nt, Human
ccaaaggguaauccccaagacaauggguaaaa

SEQ ID NO: 360573 - RNA, 24 nt, Human
ccaaaggguugggauuacaggugu

SEQ ID NO: 360574 - RNA, 22 nt, Human
ccaaaggguugggauuaccggc

SEQ ID NO: 360575 - RNA, 32 nt, Human
ccaaagguaaagcccaucacuucuagagggag

SEQ ID NO: 360576 - RNA, 32 nt, Human
ccaaagguagguguccaugcagauuuuauugg

SEQ ID NO: 360577 - RNA, 20 nt, Human
ccaaagguggagguugcagu

SEQ ID NO: 360578 - RNA, 32 nt, Human
ccaaagguuuggaagauggaaaaaggaaucca

SEQ ID NO: 360579 - RNA, 32 nt, Human
ccaaagguuuugggcaguggcagcagcaggag

SEQ ID NO: 360580 - RNA, 32 nt, Human
ccaaaguaaaacauuaggucaggcaugguggc

SEQ ID NO: 360581 - RNA, 32 nt, Human
ccaaaguaaauucagggccccauugcuacuua

SEQ ID NO: 360582 - RNA, 24 nt, Human
ccaaaguacugggacuacaggcgu

SEQ ID NO: 360583 - RNA, 22 nt, Human
ccaaaguacugggauuacaggc

SEQ ID NO: 360584 - RNA, 24 nt, Human
ccaaaguacugggauuacaggcgu

SEQ ID NO: 360585 - RNA, 23 nt, Human
ccaaaguacugggauuacaggug

SEQ ID NO: 360586 - RNA, 22 nt, Human
ccaaaguacugggauuauaggc

SEQ ID NO: 360587 - RNA, 24 nt, Human
ccaaaguacugggauuauaggugu

SEQ ID NO: 360588 - RNA, 23 nt, Human
ccaaaguagcugggauuacaggc

SEQ ID NO: 360589 - RNA, 32 nt, Human
ccaaaguauacagccuggagugaauguuaaua

SEQ ID NO: 360590 - RNA, 24 nt, Human
ccaaaguauugggacuacaggcgu

SEQ ID NO: 360591 - RNA, 32 nt, Human
ccaaagucacagguuuuucacgacugaaaaca

SEQ ID NO: 360592 - RNA, 32 nt, Human
ccaaagucaccaguucagaagugcuaagcuaa

SEQ ID NO: 360593 - RNA, 32 nt, Human
ccaaagucacccagcugaacagugguagaguu

SEQ ID NO: 360594 - RNA, 32 nt, Human
ccaaagucacuuccccaagaucugccagaccu

SEQ ID NO: 360595 - RNA, 32 nt, Human
ccaaagucagcugucuccugcuuucuugcccu

SEQ ID NO: 360596 - RNA, 32 nt, Human
ccaaagucaugucugcuuccucugccuccagc

SEQ ID NO: 360597 - RNA, 32 nt, Human
ccaaaguccaaucaagugauccugggaaacaa

SEQ ID NO: 360598 - RNA, 32 nt, Human
ccaaaguccacauucuuuguuauguguguuuu

SEQ ID NO: 360599 - RNA, 22 nt, Human
ccaaaguccugggauuacaggc

SEQ ID NO: 360600 - RNA, 24 nt, Human
ccaaaguccugggauuacaggugu

SEQ ID NO: 360601 - RNA, 32 nt, Human
ccaaagucuaaaagacuucuggucccaagcau

SEQ ID NO: 360602 - RNA, 32 nt, Human
ccaaagucuaccucaguggauggcagugugga

SEQ ID NO: 360603 - RNA, 32 nt, Human
ccaaagucugagccaccagccacaccugacag

SEQ ID NO: 360604 - RNA, 32 nt, Human
ccaaagucugcaaccuugauguucaggucaag

SEQ ID NO: 360605 - RNA, 32 nt, Human
ccaaagugaauccauuuuccaguucaaaaagu

SEQ ID NO: 360606 - RNA, 28 nt, Human
ccaaagugaccuggacaagauucauaga

SEQ ID NO: 360607 - RNA, 24 nt, Human
ccaaagugauggaauuacaggugu

SEQ ID NO: 360608 - RNA, 24 nt, Human
ccaaagugaugggauuacagaugu

SEQ ID NO: 360609 - RNA, 22 nt, Human
ccaaagugaugggauuacaggc

SEQ ID NO: 360610 - RNA, 24 nt, Human
ccaaagugaugggauuauaggcgu

SEQ ID NO: 360611 - RNA, 22 nt, Human
ccaaagugcagggauuacaggc

SEQ ID NO: 360612 - RNA, 32 nt, Human
ccaaagugccagccuucucuucugccuuaccu

SEQ ID NO: 360613 - RNA, 22 nt, Human
ccaaagugccaggauuacaggc

SEQ ID NO: 360614 - RNA, 32 nt, Human
ccaaagugcccggacccaaaacaggaaagugu

SEQ ID NO: 360615 - RNA, 22 nt, Human
ccaaagugccgagauuacagcg

SEQ ID NO: 360616 - RNA, 24 nt, Human
ccaaagugccgagauuacaggugu

SEQ ID NO: 360617 - RNA, 27 nt, Human
ccaaagugccgccgggauuacaggcgu

SEQ ID NO: 360618 - RNA, 32 nt, Human
ccaaagugccgccgggauuacaggcgugagcc

SEQ ID NO: 360619 - RNA, 22 nt, Human
ccaaagugccgggaugacaggc

SEQ ID NO: 360620 - RNA, 22 nt, Human
ccaaagugccgggauuacaggc

SEQ ID NO: 360621 - RNA, 24 nt, Human
ccaaagugccgggauuacaggcgu

SEQ ID NO: 360622 - RNA, 19 nt, Human
ccaaagugccucauaggca

SEQ ID NO: 360623 - RNA, 23 nt, Human
ccaaagugcgggauuacaagcgu

SEQ ID NO: 360624 - RNA, 22 nt, Human
ccaaagugcgguccacauacgu

SEQ ID NO: 360625 - RNA, 24 nt, Human
ccaaagugcuaggauaacaggugu

SEQ ID NO: 360626 - RNA, 23 nt, Human
ccaaagugcuaggauuacacagc

SEQ ID NO: 360627 - RNA, 20 nt, Human
ccaaagugcuaggauuacag

SEQ ID NO: 360628 - RNA, 23 nt, Human
ccaaagugcuaggauuacagaug

SEQ ID NO: 360629 - RNA, 23 nt, Human
ccaaagugcuaggauuacagcgu

SEQ ID NO: 360630 - RNA, 21 nt, Human
ccaaagugcuaggauuacagg

SEQ ID NO: 360631 - RNA, 22 nt, Human
ccaaagugcuaggauuacaggc

SEQ ID NO: 360632 - RNA, 24 nt, Human
ccaaagugcuaggauuacaggcgu

SEQ ID NO: 360633 - RNA, 22 nt, Human
ccaaagugcuaggauuacaggu

SEQ ID NO: 360634 - RNA, 24 nt, Human
ccaaagugcuaggauuacaggugu

SEQ ID NO: 360635 - RNA, 24 nt, Human
ccaaagugcuaggauuacgggugu

SEQ ID NO: 360636 - RNA, 24 nt, Human
ccaaagugcuaggauuauaggagu

SEQ ID NO: 360637 - RNA, 22 nt, Human
ccaaagugcuaggauuauaggc

SEQ ID NO: 360638 - RNA, 24 nt, Human
ccaaagugcuaggauuauaggcgu

SEQ ID NO: 360639 - RNA, 24 nt, Human
ccaaagugcuaggauuccaggcgu

SEQ ID NO: 360640 - RNA, 24 nt, Human
ccaaagugcuaggauuccaggugu

SEQ ID NO: 360641 - RNA, 20 nt, Human
ccaaagugcuaggguuacag

SEQ ID NO: 360642 - RNA, 22 nt, Human
ccaaagugcuaggguuacaggc

SEQ ID NO: 360643 - RNA, 22 nt, Human
ccaaagugcuagguuuacaggc

SEQ ID NO: 360644 - RNA, 24 nt, Human
ccaaagugcuaugauuacagacgu

SEQ ID NO: 360645 - RNA, 25 nt, Human
ccaaagugcucaggauuacaggcgu

SEQ ID NO: 360646 - RNA, 20 nt, Human
ccaaagugcucggauuacag

SEQ ID NO: 360647 - RNA, 24 nt, Human
ccaaagugcucggauuacaggugu

SEQ ID NO: 360648 - RNA, 22 nt, Human
ccaaagugcugaaauuacaggc

SEQ ID NO: 360649 - RNA, 19 nt, Human
ccaaagugcugacauaggc

SEQ ID NO: 360650 - RNA, 22 nt, Human
ccaaagugcugacauuacaggc

SEQ ID NO: 360651 - RNA, 24 nt, Human
ccaaagugcugagauuacaagcgu

SEQ ID NO: 360652 - RNA, 20 nt, Human
ccaaagugcugagauuacag

SEQ ID NO: 360653 - RNA, 24 nt, Human
ccaaagugcugagauuacagacgu

SEQ ID NO: 360654 - RNA, 24 nt, Human
ccaaagugcugagauuacagaugu

SEQ ID NO: 360655 - RNA, 24 nt, Human
ccaaagugcugagauuacaggagu

SEQ ID NO: 360656 - RNA, 22 nt, Human
ccaaagugcugagauuacaggc

SEQ ID NO: 360657 - RNA, 24 nt, Human
ccaaagugcugagauuacaggcgu

SEQ ID NO: 360658 - RNA, 32 nt, Human
ccaaagugcugagauuacaggcguggccacca

SEQ ID NO: 360659 - RNA, 24 nt, Human
ccaaagugcugagauuacaggugu

SEQ ID NO: 360660 - RNA, 22 nt, Human
ccaaagugcugagauuacuggc

SEQ ID NO: 360661 - RNA, 21 nt, Human
ccaaagugcugagauuauagg

SEQ ID NO: 360662 - RNA, 22 nt, Human
ccaaagugcugagauuauaggc

SEQ ID NO: 360663 - RNA, 24 nt, Human
ccaaagugcugagauuauaggcgu

SEQ ID NO: 360664 - RNA, 24 nt, Human
ccaaagugcugagauugcagaugu

SEQ ID NO: 360665 - RNA, 22 nt, Human
ccaaagugcugauauuacaggc

SEQ ID NO: 360666 - RNA, 24 nt, Human
ccaaagugcugcaguuacaggcgu

SEQ ID NO: 360667 - RNA, 24 nt, Human
ccaaagugcugccauuacaggcgu

SEQ ID NO: 360668 - RNA, 20 nt, Human
ccaaagugcugcgauuacag

SEQ ID NO: 360669 - RNA, 22 nt, Human
ccaaagugcugcgauuacaggc

SEQ ID NO: 360670 - RNA, 24 nt, Human
ccaaagugcugcgauuacaggcgu

SEQ ID NO: 360671 - RNA, 32 nt, Human
ccaaagugcugcugggauuacaggcgugagcc

SEQ ID NO: 360672 - RNA, 22 nt, Human
ccaaagugcuggaaccacaggc

SEQ ID NO: 360673 - RNA, 24 nt, Human
ccaaagugcuggaauaacaggugu

SEQ ID NO: 360674 - RNA, 24 nt, Human
ccaaagugcuggaaucacaggggu

SEQ ID NO: 360675 - RNA, 20 nt, Human
ccaaagugcuggaauuacag

SEQ ID NO: 360676 - RNA, 22 nt, Human
ccaaagugcuggaauuacaggc

SEQ ID NO: 360677 - RNA, 23 nt, Human
ccaaagugcuggaauuacaggcg

SEQ ID NO: 360678 - RNA, 24 nt, Human
ccaaagugcuggaauuacaggcgu

SEQ ID NO: 360679 - RNA, 24 nt, Human
ccaaagugcuggaauuacaggugu

SEQ ID NO: 360680 - RNA, 24 nt, Human
ccaaagugcuggaauuacaugggu

SEQ ID NO: 360681 - RNA, 32 nt, Human
ccaaagugcuggaauuacaugggugagcuacc

SEQ ID NO: 360682 - RNA, 22 nt, Human
ccaaagugcuggaauuacuggc

SEQ ID NO: 360683 - RNA, 22 nt, Human
ccaaagugcuggaauuagaggc

SEQ ID NO: 360684 - RNA, 22 nt, Human
ccaaagugcuggaauuauaggc

SEQ ID NO: 360685 - RNA, 24 nt, Human
ccaaagugcuggaauuauaggcgu

SEQ ID NO: 360686 - RNA, 24 nt, Human
ccaaagugcuggaauugcagacgu

SEQ ID NO: 360687 - RNA, 21 nt, Human
ccaaagugcuggaauugcagg

SEQ ID NO: 360688 - RNA, 22 nt, Human
ccaaagugcuggaauugcaggc

SEQ ID NO: 360689 - RNA, 22 nt, Human
ccaaagugcuggaauuuacagg

SEQ ID NO: 360690 - RNA, 23 nt, Human
ccaaagugcuggaauuuacaggu

SEQ ID NO: 360691 - RNA, 21 nt, Human
ccaaagugcuggauuacaggc

SEQ ID NO: 360692 - RNA, 23 nt, Human
ccaaagugcuggauuacaggcgu

SEQ ID NO: 360693 - RNA, 23 nt, Human
ccaaagugcuggauuacaggugu

SEQ ID NO: 360694 - RNA, 22 nt, Human
ccaaagugcuggcacuacaggc

SEQ ID NO: 360695 - RNA, 24 nt, Human
ccaaagugcuggcauuacaggcgu

SEQ ID NO: 360696 - RNA, 24 nt, Human
ccaaagugcuggcauuacaggugu

SEQ ID NO: 360697 - RNA, 24 nt, Human
ccaaagugcuggcauuucaggcgu

SEQ ID NO: 360698 - RNA, 22 nt, Human
ccaaagugcugggaauacaggc

SEQ ID NO: 360699 - RNA, 24 nt, Human
ccaaagugcugggaauacaggugu

SEQ ID NO: 360700 - RNA, 25 nt, Human
ccaaagugcugggaauuacaggcgu

SEQ ID NO: 360701 - RNA, 22 nt, Human
ccaaagugcugggacgugacag

SEQ ID NO: 360702 - RNA, 22 nt, Human
ccaaagugcugggacuacaggc

SEQ ID NO: 360703 - RNA, 24 nt, Human
ccaaagugcugggacuauaagugu

SEQ ID NO: 360704 - RNA, 22 nt, Human
ccaaagugcugggagccacugc

SEQ ID NO: 360705 - RNA, 24 nt, Human
ccaaagugcugggauaauaggugu

SEQ ID NO: 360706 - RNA, 24 nt, Human
ccaaagugcugggaucacagacgu

SEQ ID NO: 360707 - RNA, 22 nt, Human
ccaaagugcugggaucacaggc

SEQ ID NO: 360708 - RNA, 23 nt, Human
ccaaagugcugggaucacaggcg

SEQ ID NO: 360709 - RNA, 24 nt, Human
ccaaagugcugggaucacaggcgu

SEQ ID NO: 360710 - RNA, 23 nt, Human
ccaaagugcugggaugacagcgu

SEQ ID NO: 360711 - RNA, 21 nt, Human
ccaaagugcugggaugacagg

SEQ ID NO: 360712 - RNA, 22 nt, Human
ccaaagugcugggaugacaggc

SEQ ID NO: 360713 - RNA, 24 nt, Human
ccaaagugcugggaugacaggcgu

SEQ ID NO: 360714 - RNA, 24 nt, Human
ccaaagugcugggaugacaggugu

SEQ ID NO: 360715 - RNA, 22 nt, Human
ccaaagugcugggaugaccagc

SEQ ID NO: 360716 - RNA, 24 nt, Human
ccaaagugcugggaugauaggcgu

SEQ ID NO: 360717 - RNA, 24 nt, Human
ccaaagugcugggaugccaggcgu

SEQ ID NO: 360718 - RNA, 21 nt, Human
ccaaagugcugggauuaaagc

SEQ ID NO: 360719 - RNA, 24 nt, Human
ccaaagugcugggauuaaaggcgu

SEQ ID NO: 360720 - RNA, 24 nt, Human
ccaaagugcugggauuaaaggugu

SEQ ID NO: 360721 - RNA, 23 nt, Human
ccaaagugcugggauuaacaggu

SEQ ID NO: 360722 - RNA, 25 nt, Human
ccaaagugcugggauuaacgggugu

SEQ ID NO: 360723 - RNA, 23 nt, Human
ccaaagugcugggauuaaggcgu

SEQ ID NO: 360724 - RNA, 24 nt, Human
ccaaagugcugggauuaauggcgu

SEQ ID NO: 360725 - RNA, 19 nt, Human
ccaaagugcugggauuaca

SEQ ID NO: 360726 - RNA, 22 nt, Human
ccaaagugcugggauuacaagc

SEQ ID NO: 360727 - RNA, 24 nt, Human
ccaaagugcugggauuacaagcgu

SEQ ID NO: 360728 - RNA, 24 nt, Human
ccaaagugcugggauuacaagggu

SEQ ID NO: 360729 - RNA, 22 nt, Human
ccaaagugcugggauuacaagu

SEQ ID NO: 360730 - RNA, 24 nt, Human
ccaaagugcugggauuacaagugu

SEQ ID NO: 360731 - RNA, 20 nt, Human
ccaaagugcugggauuacag

SEQ ID NO: 360732 - RNA, 24 nt, Human
ccaaagugcugggauuacagacgu

SEQ ID NO: 360733 - RNA, 24 nt, Human
ccaaagugcugggauuacagaugu

SEQ ID NO: 360734 - RNA, 21 nt, Human
ccaaagugcugggauuacagc

SEQ ID NO: 360735 - RNA, 24 nt, Human
ccaaagugcugggauuacagccgu

SEQ ID NO: 360736 - RNA, 22 nt, Human
ccaaagugcugggauuacagcg

SEQ ID NO: 360737 - RNA, 23 nt, Human
ccaaagugcugggauuacagcgu

SEQ ID NO: 360738 - RNA, 24 nt, Human
ccaaagugcugggauuacagcugu

SEQ ID NO: 360739 - RNA, 21 nt, Human
ccaaagugcugggauuacagg

SEQ ID NO: 360740 - RNA, 24 nt, Human
ccaaagugcugggauuacaggagu

SEQ ID NO: 360741 - RNA, 22 nt, Human
ccaaagugcugggauuacaggc

SEQ ID NO: 360742 - RNA, 23 nt, Human
ccaaagugcugggauuacaggca

SEQ ID NO: 360743 - RNA, 32 nt, Human
ccaaagugcugggauuacaggcauggccacca

SEQ ID NO: 360744 - RNA, 23 nt, Human
ccaaagugcugggauuacaggcg

SEQ ID NO: 360745 - RNA, 24 nt, Human
ccaaagugcugggauuacaggcgu

SEQ ID NO: 360746 - RNA, 23 nt, Human
ccaaagugcugggauuacagggc

SEQ ID NO: 360747 - RNA, 24 nt, Human
ccaaagugcugggauuacaggggu

SEQ ID NO: 360748 - RNA, 22 nt, Human
ccaaagugcugggauuacaggu

SEQ ID NO: 360749 - RNA, 23 nt, Human
ccaaagugcugggauuacaggug

SEQ ID NO: 360750 - RNA, 24 nt, Human
ccaaagugcugggauuacaggugu

SEQ ID NO: 360751 - RNA, 32 nt, Human
ccaaagugcugggauuacagguguggccaccg

SEQ ID NO: 360752 - RNA, 24 nt, Human
ccaaagugcugggauuacagucgu

SEQ ID NO: 360753 - RNA, 24 nt, Human
ccaaagugcugggauuacaguugu

SEQ ID NO: 360754 - RNA, 24 nt, Human
ccaaagugcugggauuacaugcgu

SEQ ID NO: 360755 - RNA, 22 nt, Human
ccaaagugcugggauuaccagc

SEQ ID NO: 360756 - RNA, 22 nt, Human
ccaaagugcugggauuaccggc

SEQ ID NO: 360757 - RNA, 22 nt, Human
ccaaagugcugggauuaccggu

SEQ ID NO: 360758 - RNA, 24 nt, Human
ccaaagugcugggauuacgagcgu

SEQ ID NO: 360759 - RNA, 24 nt, Human
ccaaagugcugggauuacggacgu

SEQ ID NO: 360760 - RNA, 22 nt, Human
ccaaagugcugggauuacgggc

SEQ ID NO: 360761 - RNA, 24 nt, Human
ccaaagugcugggauuacgggcgu

SEQ ID NO: 360762 - RNA, 24 nt, Human
ccaaagugcugggauuacuagacg

SEQ ID NO: 360763 - RNA, 22 nt, Human
ccaaagugcugggauuacuggc

SEQ ID NO: 360764 - RNA, 24 nt, Human
ccaaagugcugggauuacuggcgu

SEQ ID NO: 360765 - RNA, 24 nt, Human
ccaaagugcugggauuagaagcgu

SEQ ID NO: 360766 - RNA, 22 nt, Human
ccaaagugcugggauuagaggc

SEQ ID NO: 360767 - RNA, 24 nt, Human
ccaaagugcugggauuagaggcgu

SEQ ID NO: 360768 - RNA, 22 nt, Human
ccaaagugcugggauuaggugu

SEQ ID NO: 360769 - RNA, 22 nt, Human
ccaaagugcugggauuauacgu

SEQ ID NO: 360770 - RNA, 20 nt, Human
ccaaagugcugggauuauag

SEQ ID NO: 360771 - RNA, 24 nt, Human
ccaaagugcugggauuauagaugu

SEQ ID NO: 360772 - RNA, 22 nt, Human
ccaaagugcugggauuauaggc

SEQ ID NO: 360773 - RNA, 24 nt, Human
ccaaagugcugggauuauaggcgu

SEQ ID NO: 360774 - RNA, 24 nt, Human
ccaaagugcugggauuauaggugu

SEQ ID NO: 360775 - RNA, 23 nt, Human
ccaaagugcugggauuaugggcg

SEQ ID NO: 360776 - RNA, 24 nt, Human
ccaaagugcugggauuaugggcgu

SEQ ID NO: 360777 - RNA, 20 nt, Human
ccaaagugcugggauuccag

SEQ ID NO: 360778 - RNA, 24 nt, Human
ccaaagugcugggauuccaggugu

SEQ ID NO: 360779 - RNA, 24 nt, Human
ccaaagugcugggauucugggugu

SEQ ID NO: 360780 - RNA, 23 nt, Human
ccaaagugcugggauugcagcgu

SEQ ID NO: 360781 - RNA, 22 nt, Human
ccaaagugcugggauugcaggc

SEQ ID NO: 360782 - RNA, 24 nt, Human
ccaaagugcugggauugcaggcgu

SEQ ID NO: 360783 - RNA, 24 nt, Human
ccaaagugcugggauugcaggggu

SEQ ID NO: 360784 - RNA, 23 nt, Human
ccaaagugcugggauugcaggug

SEQ ID NO: 360785 - RNA, 24 nt, Human
ccaaagugcugggauugcaggugu

SEQ ID NO: 360786 - RNA, 20 nt, Human
ccaaagugcugggauuguag

SEQ ID NO: 360787 - RNA, 22 nt, Human
ccaaagugcugggauugugggc

SEQ ID NO: 360788 - RNA, 22 nt, Human
ccaaagugcugggcuuacaggc

SEQ ID NO: 360789 - RNA, 25 nt, Human
ccaaagugcugggggcuacaggugu

SEQ ID NO: 360790 - RNA, 20 nt, Human
ccaaagugcugggguuacag

SEQ ID NO: 360791 - RNA, 24 nt, Human
ccaaagugcugggguuacaggugu

SEQ ID NO: 360792 - RNA, 22 nt, Human
ccaaagugcuggguuaacaggc

SEQ ID NO: 360793 - RNA, 24 nt, Human
ccaaagugcuggguuuaccagcgu

SEQ ID NO: 360794 - RNA, 20 nt, Human
ccaaagugcugguauuacag

SEQ ID NO: 360795 - RNA, 24 nt, Human
ccaaagugcugguauuacagaugu

SEQ ID NO: 360796 - RNA, 24 nt, Human
ccaaagugcugguauuacaggcgu

SEQ ID NO: 360797 - RNA, 22 nt, Human
ccaaagugcuguaauuacaggc

SEQ ID NO: 360798 - RNA, 22 nt, Human
ccaaagugcugugauuacaggc

SEQ ID NO: 360799 - RNA, 24 nt, Human
ccaaagugcugugauuacaggugu

SEQ ID NO: 360800 - RNA, 22 nt, Human
ccaaagugcugugcauacaggc

SEQ ID NO: 360801 - RNA, 22 nt, Human
ccaaagugcuguuacuacaggu

SEQ ID NO: 360802 - RNA, 18 nt, Human
ccaaagugcuuccaaggc

SEQ ID NO: 360803 - RNA, 22 nt, Human
ccaaagugcuuggauuacaggc

SEQ ID NO: 360804 - RNA, 24 nt, Human
ccaaagugcuuggauuacaggugu

SEQ ID NO: 360805 - RNA, 32 nt, Human
ccaaagugggccgaucaccugagcucaggaau

SEQ ID NO: 360806 - RNA, 32 nt, Human
ccaaagugggcggaucaccugaggccaggagu

SEQ ID NO: 360807 - RNA, 32 nt, Human
ccaaaguggguaguauaguccucaaauaucgg

SEQ ID NO: 360808 - RNA, 32 nt, Human
ccaaaguggguggaucaccugaggucaggagu

SEQ ID NO: 360809 - RNA, 23 nt, Human
ccaaaguggguggauugcuugag

SEQ ID NO: 360810 - RNA, 22 nt, Human
ccaaaguggguggcuuaccaga

SEQ ID NO: 360811 - RNA, 32 nt, Human
ccaaaguggguuauuucaaggcauuuuugaag

SEQ ID NO: 360812 - RNA, 20 nt, Human
ccaaaguggugaaacccugu

SEQ ID NO: 360813 - RNA, 24 nt, Human
ccaaaguggugggaucacaggcgu

SEQ ID NO: 360814 - RNA, 24 nt, Human
ccaaaguggugggauuacaggugu

SEQ ID NO: 360815 - RNA, 32 nt, Human
ccaaagugucugcaauggacaacaauugaagg

SEQ ID NO: 360816 - RNA, 23 nt, Human
ccaaaguguggggauuacaggug

SEQ ID NO: 360817 - RNA, 32 nt, Human
ccaaagugugugacuagucaaugaagugcgac

SEQ ID NO: 360818 - RNA, 22 nt, Human
ccaaaguguuaggauuacaggc

SEQ ID NO: 360819 - RNA, 24 nt, Human
ccaaaguguuaggauuacaggcgu

SEQ ID NO: 360820 - RNA, 24 nt, Human
ccaaaguguuaggauuauaggcgu

SEQ ID NO: 360821 - RNA, 32 nt, Human
ccaaaguguucaauuauccuugcaaguucaaa

SEQ ID NO: 360822 - RNA, 24 nt, Human
ccaaaguguucagauuacaggugu

SEQ ID NO: 360823 - RNA, 24 nt, Human
ccaaaguguucggauuacaaacgu

SEQ ID NO: 360824 - RNA, 22 nt, Human
ccaaaguguugagauuacaggc

SEQ ID NO: 360825 - RNA, 24 nt, Human
ccaaaguguuggaauuacaggcgu

SEQ ID NO: 360826 - RNA, 20 nt, Human
ccaaaguguugggauuacag

SEQ ID NO: 360827 - RNA, 21 nt, Human
ccaaaguguugggauuacagg

SEQ ID NO: 360828 - RNA, 22 nt, Human
ccaaaguguugggauuacaggc

SEQ ID NO: 360829 - RNA, 24 nt, Human
ccaaaguguugggauuacaggcgu

SEQ ID NO: 360830 - RNA, 24 nt, Human
ccaaaguguugggauuacaggugu

SEQ ID NO: 360831 - RNA, 24 nt, Human
ccaaaguguugggauuauaagcgu

SEQ ID NO: 360832 - RNA, 22 nt, Human
ccaaaguguugggauuauaggc

SEQ ID NO: 360833 - RNA, 24 nt, Human
ccaaaguguugggauuauaggcgu

SEQ ID NO: 360834 - RNA, 22 nt, Human
ccaaaguguugggauugcaggc

SEQ ID NO: 360835 - RNA, 32 nt, Human
ccaaaguuaagcaaaugacaccauuuucuucc

SEQ ID NO: 360836 - RNA, 32 nt, Human
ccaaaguuagaggugugucuucaugguuccca

SEQ ID NO: 360837 - RNA, 32 nt, Human
ccaaaguuaucagcuacccauaccucauguuu

SEQ ID NO: 360838 - RNA, 22 nt, Human
ccaaaguucagggauuacaggc

SEQ ID NO: 360839 - RNA, 24 nt, Human
ccaaaguucuaggauuacaggugu

SEQ ID NO: 360840 - RNA, 24 nt, Human
ccaaaguucugggauuacaagugu

SEQ ID NO: 360841 - RNA, 22 nt, Human
ccaaaguucugggauuacaggc

SEQ ID NO: 360842 - RNA, 24 nt, Human
ccaaaguucugggauuacaggcgu

SEQ ID NO: 360843 - RNA, 24 nt, Human
ccaaaguucugggauuacaggggu

SEQ ID NO: 360844 - RNA, 23 nt, Human
ccaaaguucugggauuacagggu

SEQ ID NO: 360845 - RNA, 24 nt, Human
ccaaaguucugggauuacaggugu

SEQ ID NO: 360846 - RNA, 32 nt, Human
ccaaaguucuuccaguccuccuaggcaucuua

SEQ ID NO: 360847 - RNA, 32 nt, Human
ccaaaguuggagccuggcaugggcagggagcc

SEQ ID NO: 360848 - RNA, 21 nt, Human
ccaaaguugugggacauguug

SEQ ID NO: 360849 - RNA, 32 nt, Human
ccaaaguuucucuuugucauaacccuggucug

SEQ ID NO: 360850 - RNA, 32 nt, Human
ccaaaguuuucugaagcacagaguccaucuca

SEQ ID NO: 360851 - RNA, 24 nt, Human
ccaaaguuuugggauuacaagugu

SEQ ID NO: 360852 - RNA, 32 nt, Human
ccaaauaaaaaggcaaacaacaugacauuucu

SEQ ID NO: 360853 - RNA, 32 nt, Human
ccaaauaaacagccuuuucccuaacaaaguaa

SEQ ID NO: 360854 - RNA, 32 nt, Human
ccaaauaaacauccuuuucccuaacaaaguaa

SEQ ID NO: 360855 - RNA, 19 nt, Human
ccaaauaaauaccuugcca

SEQ ID NO: 360856 - RNA, 32 nt, Human
ccaaauaagaaggcaggagcugcuugcugagg

SEQ ID NO: 360857 - RNA, 32 nt, Human
ccaaauaaguacagucaucuucucuaguucuc

SEQ ID NO: 360858 - RNA, 32 nt, Human
ccaaauaauguaaaaccucaaaagcaagggcu

SEQ ID NO: 360859 - RNA, 19 nt, Human
ccaaauacccacccugcca

SEQ ID NO: 360860 - RNA, 32 nt, Human
ccaaauaccugaggaagccacaguccauggca

SEQ ID NO: 360861 - RNA, 32 nt, Human
ccaaauacucaaaguuuacguaaugaaaauua

SEQ ID NO: 360862 - RNA, 32 nt, Human
ccaaauacucaccuauucucucucacaugaug

SEQ ID NO: 360863 - RNA, 32 nt, Human
ccaaauacuugcagggaguaguuuuccgcugu

SEQ ID NO: 360864 - RNA, 31 nt, Human
ccaaauacuuuuuaugaacauuuaaaacaag

SEQ ID NO: 360865 - RNA, 32 nt, Human
ccaaauagaccagaauuggcccauaccauaga

SEQ ID NO: 360866 - RNA, 32 nt, Human
ccaaauagacuugccugaugccaggcugcuac

SEQ ID NO: 360867 - RNA, 22 nt, Human
ccaaauagccacacuguguccu

SEQ ID NO: 360868 - RNA, 24 nt, Human
ccaaauagcuaggacuacaggcgu

SEQ ID NO: 360869 - RNA, 24 nt, Human
ccaaauagcugggaccacaggugu

SEQ ID NO: 360870 - RNA, 23 nt, Human
ccaaauagcugggauuacaggug

SEQ ID NO: 360871 - RNA, 24 nt, Human
ccaaauagcugugauuacaggcgu

SEQ ID NO: 360872 - RNA, 32 nt, Human
ccaaauagcuuuuauaguaaaccauguaauga

SEQ ID NO: 360873 - RNA, 22 nt, Human
ccaaauaguugggauuacaggc

SEQ ID NO: 360874 - RNA, 19 nt, Human
ccaaauaugacacuggcca

SEQ ID NO: 360875 - RNA, 32 nt, Human
ccaaauauggaacuaacuggagaaggugcacg

SEQ ID NO: 360876 - RNA, 19 nt, Human
ccaaauauguauuuuccua

SEQ ID NO: 360877 - RNA, 32 nt, Human
ccaaauauucccagcaguugcugacagugaga

SEQ ID NO: 360878 - RNA, 32 nt, Human
ccaaauauuuaaaagaaguuauuccuugagaa

SEQ ID NO: 360879 - RNA, 32 nt, Human
ccaaaucaacagaauauacauucuucucagca

SEQ ID NO: 360880 - RNA, 32 nt, Human
ccaaaucaaucaggcccauccaucccaugccu

SEQ ID NO: 360881 - RNA, 32 nt, Human
ccaaaucacagccccguuuugucacaggggaa

SEQ ID NO: 360882 - RNA, 32 nt, Human
ccaaaucacaucucaccuccgaacuguucaag

SEQ ID NO: 360883 - RNA, 22 nt, Human
ccaaaucacugggauuauaggc

SEQ ID NO: 360884 - RNA, 19 nt, Human
ccaaaucaugauacaagaa

SEQ ID NO: 360885 - RNA, 32 nt, Human
ccaaauccagugagcuccagauucuuccaagg

SEQ ID NO: 360886 - RNA, 32 nt, Human
ccaaaucccccugggcaggaggcaguggagaa

SEQ ID NO: 360887 - RNA, 32 nt, Human
ccaaauccccgcgccaucagccuggaugggca

SEQ ID NO: 360888 - RNA, 32 nt, Human
ccaaaucgccuaauaaacuuuccucuugcaaa

SEQ ID NO: 360889 - RNA, 32 nt, Human
ccaaaucucaaagcaaugagaagcauuccuaa

SEQ ID NO: 360890 - RNA, 32 nt, Human
ccaaaucucacuggcugaccugguggccgugg

SEQ ID NO: 360891 - RNA, 32 nt, Human
ccaaaucugaaaucugaaauguucaugagcau

SEQ ID NO: 360892 - RNA, 32 nt, Human
ccaaaucugcaagcuccuguuuuacuguagaa

SEQ ID NO: 360893 - RNA, 32 nt, Human
ccaaaucugcacguaccagcagucagccgccc

SEQ ID NO: 360894 - RNA, 32 nt, Human
ccaaaucugcauugcaaugagacccccaggga

SEQ ID NO: 360895 - RNA, 32 nt, Human
ccaaaucugccuggcccucggaccccucugcc

SEQ ID NO: 360896 - RNA, 32 nt, Human
ccaaaucugucccaccaccuguuuucauaugg

SEQ ID NO: 360897 - RNA, 32 nt, Human
ccaaaucuuaacucauuuuagcauuaacucaa

SEQ ID NO: 360898 - RNA, 32 nt, Human
ccaaaucuucccgacagccaacagguuuccag

SEQ ID NO: 360899 - RNA, 32 nt, Human
ccaaaucuuccucuggagcuuugcagccaagg

SEQ ID NO: 360900 - RNA, 32 nt, Human
ccaaaucuugguggaagagcccaggggcuggu

SEQ ID NO: 360901 - RNA, 32 nt, Human
ccaaaugaacuccacuuacuugcucagucuuc

SEQ ID NO: 360902 - RNA, 32 nt, Human
ccaaaugacauggcacaugugugcccagacca

SEQ ID NO: 360903 - RNA, 25 nt, Human
ccaaaugagagagaaacuaugggaa

SEQ ID NO: 360904 - RNA, 32 nt, Human
ccaaaugagccacaacacccagccagucacau

SEQ ID NO: 360905 - RNA, 32 nt, Human
ccaaaugauacaggcaagguuucugcagaucu

SEQ ID NO: 360906 - RNA, 32 nt, Human
ccaaaugaucagucucugucuccugggcccug

SEQ ID NO: 360907 - RNA, 32 nt, Human
ccaaaugauucaguccuugaaaacaagucucu

SEQ ID NO: 360908 - RNA, 20 nt, Human
ccaaaugauucauuuuccua

SEQ ID NO: 360909 - RNA, 32 nt, Human
ccaaaugcacugccuuucucuguccccaugac

SEQ ID NO: 360910 - RNA, 32 nt, Human
ccaaaugcagggaggggaggcagauggagccc

SEQ ID NO: 360911 - RNA, 31 nt, Human
ccaaaugccaaugguacccuguugagaaagg

SEQ ID NO: 360912 - RNA, 32 nt, Human
ccaaaugccauccagaugugugcaauguggca

SEQ ID NO: 360913 - RNA, 32 nt, Human
ccaaaugccugggcacccuguucccuccugau

SEQ ID NO: 360914 - RNA, 32 nt, Human
ccaaaugcuaugaacggcccuuucuuaaagac

SEQ ID NO: 360915 - RNA, 32 nt, Human
ccaaaugcugagugagugccagaaacacaaug

SEQ ID NO: 360916 - RNA, 27 nt, Human
ccaaaugcugauucugucaggcacuga

SEQ ID NO: 360917 - RNA, 19 nt, Human
ccaaaugcugggauuacag

SEQ ID NO: 360918 - RNA, 29 nt, Human
ccaaaugcugggcucaggccugggugcug

SEQ ID NO: 360919 - RNA, 27 nt, Human
ccaaaugcuguccuuucccuuacagag

SEQ ID NO: 360920 - RNA, 32 nt, Human
ccaaauggagaguguagccuggggcugguguu

SEQ ID NO: 360921 - RNA, 32 nt, Human
ccaaauggcagaggcagggucgcugguccucc

SEQ ID NO: 360922 - RNA, 32 nt, Human
ccaaauggcuaacauucaugaccucaguaucc

SEQ ID NO: 360923 - RNA, 32 nt, Human
ccaaaugggauaugcaggguugcacugugcag

SEQ ID NO: 360924 - RNA, 32 nt, Human
ccaaauggggaaagaggaagggaacugucuaa

SEQ ID NO: 360925 - RNA, 32 nt, Human
ccaaaugguccauuugaaugcaucccuaauau

SEQ ID NO: 360926 - RNA, 20 nt, Human
ccaaauggugaaaccccauc

SEQ ID NO: 360927 - RNA, 19 nt, Human
ccaaauggugaaacccugu

SEQ ID NO: 360928 - RNA, 32 nt, Human
ccaaauguccacgcccagaacaacaguuggca

SEQ ID NO: 360929 - RNA, 32 nt, Human
ccaaaugugccauuaagauuuggaugggaagu

SEQ ID NO: 360930 - RNA, 32 nt, Human
ccaaauguggucucuuaagggaagaugagggu

SEQ ID NO: 360931 - RNA, 32 nt, Human
ccaaauguuagaaaaauagcugugaacagaga

SEQ ID NO: 360932 - RNA, 20 nt, Human
ccaaauguucucuacaugaa

SEQ ID NO: 360933 - RNA, 32 nt, Human
ccaaauguugggguagggaagggaggggaagc

SEQ ID NO: 360934 - RNA, 32 nt, Human
ccaaauguuuccagugauauguuuuccuggga

SEQ ID NO: 360935 - RNA, 23 nt, Human
ccaaauuaaaauccugauguuca

SEQ ID NO: 360936 - RNA, 23 nt, Human
ccaaauuaacaagacacaggcac

SEQ ID NO: 360937 - RNA, 32 nt, Human
ccaaauuacacaauuuuacuuuugaaaauauu

SEQ ID NO: 360938 - RNA, 31 nt, Human
ccaaauuacacugaaucuaggaggggaguug

SEQ ID NO: 360939 - RNA, 32 nt, Human
ccaaauuacagauucagauuugcccaguuccu

SEQ ID NO: 360940 - RNA, 32 nt, Human
ccaaauuagcaacuaccagaccucacguguug

SEQ ID NO: 360941 - RNA, 32 nt, Human
ccaaauuagcuccacuaagaugaagaagaggg

SEQ ID NO: 360942 - RNA, 32 nt, Human
ccaaauucaaagaaaacccuaaguguggaugu

SEQ ID NO: 360943 - RNA, 32 nt, Human
ccaaauucaagcauuucaucucaagaguugua

SEQ ID NO: 360944 - RNA, 32 nt, Human
ccaaauucagaaagauuuccaucauuauccag

SEQ ID NO: 360945 - RNA, 32 nt, Human
ccaaauucaguuaaccuauuuugugucuguag

SEQ ID NO: 360946 - RNA, 32 nt, Human
ccaaauuccagcugccgcucuaguugcuucug

SEQ ID NO: 360947 - RNA, 32 nt, Human
ccaaauucccccaaagacaggagguguggcug

SEQ ID NO: 360948 - RNA, 32 nt, Human
ccaaauucuggcuucacauuuguauuuagggc

SEQ ID NO: 360949 - RNA, 32 nt, Human
ccaaauucuuuuggugcaauugaggagauaug

SEQ ID NO: 360950 - RNA, 32 nt, Human
ccaaauugcccuuguguuucucuccacccaaa

SEQ ID NO: 360951 - RNA, 22 nt, Human
ccaaauugccgggauuacaggc

SEQ ID NO: 360952 - RNA, 32 nt, Human
ccaaauugcuccccaccucccaucccuguuuu

SEQ ID NO: 360953 - RNA, 22 nt, Human
ccaaauugcugggauuacaggc

SEQ ID NO: 360954 - RNA, 24 nt, Human
ccaaauugcugggauuacaggugu

SEQ ID NO: 360955 - RNA, 22 nt, Human
ccaaauugcugggauuccaggc

SEQ ID NO: 360956 - RNA, 23 nt, Human
ccaaauugcugggauuuacaggc

SEQ ID NO: 360957 - RNA, 32 nt, Human
ccaaauuguauggaugggagggagaggugucu

SEQ ID NO: 360958 - RNA, 24 nt, Human
ccaaauuguugggauuauaggcgu

SEQ ID NO: 360959 - RNA, 25 nt, Human
ccaaauuucaaaggaacuuuuugug

SEQ ID NO: 360960 - RNA, 32 nt, Human
ccaaauuucucacaguaaaaucaaggcaguaa

SEQ ID NO: 360961 - RNA, 32 nt, Human
ccaaauuucucauucuucaggccaggaaaccg

SEQ ID NO: 360962 - RNA, 32 nt, Human
ccaaauuucugaagaaacuaaucucagauugg

SEQ ID NO: 360963 - RNA, 32 nt, Human
ccaaauuugcccaccaccuguaucuguaaaua

SEQ ID NO: 360964 - RNA, 32 nt, Human
ccaaauuugccucaccccaggcaguaauuuuu

SEQ ID NO: 360965 - RNA, 18 nt, Human
ccaaauuugcuauuccca

SEQ ID NO: 360966 - RNA, 31 nt, Human
ccaaauuuggaguaaagaugggagaaaauaa

SEQ ID NO: 360967 - RNA, 32 nt, Human
ccaaauuugucguagacuugugcaauauauac

SEQ ID NO: 360968 - RNA, 32 nt, Human
ccaaauuuuauggucuuccaggaaaaguuauu

SEQ ID NO: 360969 - RNA, 32 nt, Human
ccaaauuuucaucacgaaguggagauuuggac

SEQ ID NO: 360970 - RNA, 32 nt, Human
ccaacaaaacucaaggguagaggcuagaacag

SEQ ID NO: 360971 - RNA, 31 nt, Human
ccaacaaacaagggaacuaggaccgacagug

SEQ ID NO: 360972 - RNA, 32 nt, Human
ccaacaaagauggcugggcaugguggcucaga

SEQ ID NO: 360973 - RNA, 32 nt, Human
ccaacaaaggucacuaaggaaaccuguugacu

SEQ ID NO: 360974 - RNA, 23 nt, Human
ccaacaaauuguacagcugcaca

SEQ ID NO: 360975 - RNA, 32 nt, Human
ccaacaacacccugguuuggagcugggaggaa

SEQ ID NO: 360976 - RNA, 22 nt, Human
ccaacaacaguuaaaacuuuga

SEQ ID NO: 360977 - RNA, 19 nt, Human
ccaacaacauccucugcca

SEQ ID NO: 360978 - RNA, 32 nt, Human
ccaacaacccagagcagguguugcagacagga

SEQ ID NO: 360979 - RNA, 32 nt, Human
ccaacaacgcuuguagagcucagucugggcug

SEQ ID NO: 360980 - RNA, 32 nt, Human
ccaacaacugcacuuuagaauaccagcaguga

SEQ ID NO: 360981 - RNA, 32 nt, Human
ccaacaacugucccuccuugagcaccagcccc

SEQ ID NO: 360982 - RNA, 32 nt, Human
ccaacaagacaacauggcucccaagaagccug

SEQ ID NO: 360983 - RNA, 19 nt, Human
ccaacaagagcacauuuua

SEQ ID NO: 360984 - RNA, 15 nt, Human
ccaacaagagcacug

SEQ ID NO: 360985 - RNA, 32 nt, Human
ccaacaaggcagcugauuccaggccugcucag

SEQ ID NO: 360986 - RNA, 32 nt, Human
ccaacaauauccaccucaccaaauucuaguuc

SEQ ID NO: 360987 - RNA, 22 nt, Human
ccaacaaugacuuucagucaaa

SEQ ID NO: 360988 - RNA, 22 nt, Human
ccaacaauggaaaaaugucaaa

SEQ ID NO: 360989 - RNA, 32 nt, Human
ccaacaaugggaugagacuugacaucuggaau

SEQ ID NO: 360990 - RNA, 32 nt, Human
ccaacaauuuccucuucugccaauuaaccacu

SEQ ID NO: 360991 - RNA, 18 nt, Human
ccaacacacacaugcaca

SEQ ID NO: 360992 - RNA, 18 nt, Human
ccaacacacauacucaca

SEQ ID NO: 360993 - RNA, 18 nt, Human
ccaacacacauaugcaca

SEQ ID NO: 360994 - RNA, 18 nt, Human
ccaacacaccucuccaca

SEQ ID NO: 360995 - RNA, 32 nt, Human
ccaacacacgaguguucacccgccuggaugag

SEQ ID NO: 360996 - RNA, 32 nt, Human
ccaacacacgguuuaauuuucauggggcucug

SEQ ID NO: 360997 - RNA, 18 nt, Human
ccaacacacuccugcaca

SEQ ID NO: 360998 - RNA, 18 nt, Human
ccaacacacugcaccaca

SEQ ID NO: 360999 - RNA, 32 nt, Human
ccaacacacuggaucauccuucaaaagcuucu

SEQ ID NO: 361000 - RNA, 22 nt, Human
ccaacacagacagauugcuccu

SEQ ID NO: 361001 - RNA, 17 nt, Human
ccaacacagagcucaca

SEQ ID NO: 361002 - RNA, 32 nt, Human
ccaacacagcaugguacugguaccaacacaga

SEQ ID NO: 361003 - RNA, 32 nt, Human
ccaacacagccaaccuagccugugcagccucc

SEQ ID NO: 361004 - RNA, 24 nt, Human
ccaacacaggaggaucacuugaga

SEQ ID NO: 361005 - RNA, 26 nt, Human
ccaacacaguaaacccugucuccaca

SEQ ID NO: 361006 - RNA, 21 nt, Human
ccaacacaguucuccaagcuc

SEQ ID NO: 361007 - RNA, 32 nt, Human
ccaacacauacagcugauacacgcagaccaga

SEQ ID NO: 361008 - RNA, 31 nt, Human
ccaacacauacuucuacuuuuaaauaaacaa

SEQ ID NO: 361009 - RNA, 17 nt, Human
ccaacacauagggccac

SEQ ID NO: 361010 - RNA, 22 nt, Human
ccaacacaugagaccccaccuc

SEQ ID NO: 361011 - RNA, 18 nt, Human
ccaacacaugcgaguaca

SEQ ID NO: 361012 - RNA, 20 nt, Human
ccaacacaugcucacugcca

SEQ ID NO: 361013 - RNA, 32 nt, Human
ccaacacauuuauuuuccuugaccuacaaagg

SEQ ID NO: 361014 - RNA, 17 nt, Human
ccaacaccaggguugua

SEQ ID NO: 361015 - RNA, 32 nt, Human
ccaacaccauuucugggcuccuggggcucagc

SEQ ID NO: 361016 - RNA, 32 nt, Human
ccaacacccacugaucuuuaacucucacaugu

SEQ ID NO: 361017 - RNA, 32 nt, Human
ccaacacccagaugcaugcacacgcacacaca

SEQ ID NO: 361018 - RNA, 32 nt, Human
ccaacaccccauugaugcuguuccuucuaccu

SEQ ID NO: 361019 - RNA, 32 nt, Human
ccaacacccugcacuccugcuugcgccggcag

SEQ ID NO: 361020 - RNA, 32 nt, Human
ccaacacccuucucggaggcucaggucaagug

SEQ ID NO: 361021 - RNA, 32 nt, Human
ccaacaccugcucuugccugguaggaacaggc

SEQ ID NO: 361022 - RNA, 32 nt, Human
ccaacaccugugcuccugacagcuccaugcac

SEQ ID NO: 361023 - RNA, 32 nt, Human
ccaacaccuugaucuuggacuuccagccucca

SEQ ID NO: 361024 - RNA, 32 nt, Human
ccaacaccuugauguuggaugugaacugugag

SEQ ID NO: 361025 - RNA, 32 nt, Human
ccaacacgacgcauccuugggccccgccgugc

SEQ ID NO: 361026 - RNA, 32 nt, Human
ccaacacggguccauucuuccuggugauggca

SEQ ID NO: 361027 - RNA, 32 nt, Human
ccaacacguaaggaccuaauuaaaccaaacca

SEQ ID NO: 361028 - RNA, 32 nt, Human
ccaacacuaagcugucucgagccaagcuguga

SEQ ID NO: 361029 - RNA, 23 nt, Human
ccaacacuacccuucccugcacu

SEQ ID NO: 361030 - RNA, 32 nt, Human
ccaacacuccaccgcgaucugccugcggggga

SEQ ID NO: 361031 - RNA, 32 nt, Human
ccaacacucccucuuggagcuguucccugggu

SEQ ID NO: 361032 - RNA, 19 nt, Human
ccaacacucccuucuccca

SEQ ID NO: 361033 - RNA, 32 nt, Human
ccaacacuccugucugugggacuugaucugaa

SEQ ID NO: 361034 - RNA, 32 nt, Human
ccaacacugagcaaguaugcuguggaguccca

SEQ ID NO: 361035 - RNA, 32 nt, Human
ccaacacugcuggaggccuccauucucuguuc

SEQ ID NO: 361036 - RNA, 32 nt, Human
ccaacacuuacuuccuguuccuccucauucug

SEQ ID NO: 361037 - RNA, 32 nt, Human
ccaacacuugcagccccuccagagaaaaagcc

SEQ ID NO: 361038 - RNA, 32 nt, Human
ccaacagaaaugcagcauuuguggugugugaa

SEQ ID NO: 361039 - RNA, 32 nt, Human
ccaacagacacagcaggaggagagggaggugg

SEQ ID NO: 361040 - RNA, 24 nt, Human
ccaacagaccucugcuggcaucug

SEQ ID NO: 361041 - RNA, 32 nt, Human
ccaacagagaagggaaagcagucuguucugaa

SEQ ID NO: 361042 - RNA, 32 nt, Human
ccaacagagucguggugcuggaugcugugucg

SEQ ID NO: 361043 - RNA, 32 nt, Human
ccaacagauccucaucagcaaagcauuuggcu

SEQ ID NO: 361044 - RNA, 32 nt, Human
ccaacagaugcuuuucugucucugccucccuc

SEQ ID NO: 361045 - RNA, 32 nt, Human
ccaacagaugugagccacuuuucucagccugu

SEQ ID NO: 361046 - RNA, 32 nt, Human
ccaacagauuccuauggaguucuugaauucca

SEQ ID NO: 361047 - RNA, 19 nt, Human
ccaacagcagccccugcca

SEQ ID NO: 361048 - RNA, 32 nt, Human
ccaacagccacaccucuuccucgacaaucaca

SEQ ID NO: 361049 - RNA, 21 nt, Human
ccaacagccaccaagccugac

SEQ ID NO: 361050 - RNA, 32 nt, Human
ccaacagccaccagcagccaggagacaggccu

SEQ ID NO: 361051 - RNA, 32 nt, Human
ccaacagccacuuccagaaaaaucuuccaguu

SEQ ID NO: 361052 - RNA, 32 nt, Human
ccaacagccagccugcagccagcuggauggag

SEQ ID NO: 361053 - RNA, 32 nt, Human
ccaacagcccagcuggacauucugagacacuc

SEQ ID NO: 361054 - RNA, 32 nt, Human
ccaacagccuggccuugaauccaccucuuguu

SEQ ID NO: 361055 - RNA, 32 nt, Human
ccaacagccugggagaugagacaggguuagag

SEQ ID NO: 361056 - RNA, 32 nt, Human
ccaacagccuucagccucagaaacgcaugggg

SEQ ID NO: 361057 - RNA, 20 nt, Human
ccaacagccuuggaacucca

SEQ ID NO: 361058 - RNA, 32 nt, Human
ccaacagcuucgcccaaguuuggggacaggcu

SEQ ID NO: 361059 - RNA, 32 nt, Human
ccaacaggaagccacacagagggaagcagaaa

SEQ ID NO: 361060 - RNA, 32 nt, Human
ccaacaggagcagguuugaggggccaggccuc

SEQ ID NO: 361061 - RNA, 32 nt, Human
ccaacaggcugguaccaccacacucagcuaag

SEQ ID NO: 361062 - RNA, 32 nt, Human
ccaacaggggcagaggagggagcgugucuggu

SEQ ID NO: 361063 - RNA, 20 nt, Human
ccaacagggugaaaccccgu

SEQ ID NO: 361064 - RNA, 20 nt, Human
ccaacagggugaaacccugu

SEQ ID NO: 361065 - RNA, 32 nt, Human
ccaacaggguucaccaggaugagagaggagag

SEQ ID NO: 361066 - RNA, 32 nt, Human
ccaacaggucacuccuauucuuagagaaugug

SEQ ID NO: 361067 - RNA, 20 nt, Human
ccaacaggugaaaccccauc

SEQ ID NO: 361068 - RNA, 32 nt, Human
ccaacagucaucucuuccucuucaggccgcca

SEQ ID NO: 361069 - RNA, 32 nt, Human
ccaacagucguauccuggugaaugucuguuca

SEQ ID NO: 361070 - RNA, 32 nt, Human
ccaacagucugucaguguacagcagcaguacu

SEQ ID NO: 361071 - RNA, 32 nt, Human
ccaacagugaagauuaguguauuagugaaugc

SEQ ID NO: 361072 - RNA, 32 nt, Human
ccaacaguuuagcaagagucacucugagauug

SEQ ID NO: 361073 - RNA, 32 nt, Human
ccaacauaaagacaaaaggaagaaaaggagga

SEQ ID NO: 361074 - RNA, 32 nt, Human
ccaacauaaaguggagguuucaacacaggaga

SEQ ID NO: 361075 - RNA, 24 nt, Human
ccaacauaaugaaaccccaucccu

SEQ ID NO: 361076 - RNA, 24 nt, Human
ccaacauaaugaaaccccaucucu

SEQ ID NO: 361077 - RNA, 32 nt, Human
ccaacauacagcugugaugucauuucuguauu

SEQ ID NO: 361078 - RNA, 20 nt, Human
ccaacauacugaaaccccgu

SEQ ID NO: 361079 - RNA, 32 nt, Human
ccaacauaguggaccacauucuuuuugaaaua

SEQ ID NO: 361080 - RNA, 27 nt, Human
ccaacauaguuucaccccaucucuacu

SEQ ID NO: 361081 - RNA, 32 nt, Human
ccaacauauagugaaacccagucucuacuaaa

SEQ ID NO: 361082 - RNA, 32 nt, Human
ccaacauauagugaaacccugucucuacuaaa

SEQ ID NO: 361083 - RNA, 32 nt, Human
ccaacauauccauuucuuuuccuaguuacgga

SEQ ID NO: 361084 - RNA, 32 nt, Human
ccaacaucaaagcaucucacuccagccucugc

SEQ ID NO: 361085 - RNA, 32 nt, Human
ccaacaucaccacuacuuaccucaagucgugc

SEQ ID NO: 361086 - RNA, 32 nt, Human
ccaacaucagaccaagucccauggacaugcug

SEQ ID NO: 361087 - RNA, 19 nt, Human
ccaacaucaguggcagcag

SEQ ID NO: 361088 - RNA, 20 nt, Human
ccaacaucaugaaaccccgu

SEQ ID NO: 361089 - RNA, 32 nt, Human
ccaacaucaugguagcagcacacacuuccaaa

SEQ ID NO: 361090 - RNA, 19 nt, Human
ccaacauccauccguccuu

SEQ ID NO: 361091 - RNA, 22 nt, Human
ccaacauccuagagcacaggga

SEQ ID NO: 361092 - RNA, 32 nt, Human
ccaacauccucucaucccaggacauuuggggc

SEQ ID NO: 361093 - RNA, 20 nt, Human
ccaacauccuggucucuagg

SEQ ID NO: 361094 - RNA, 32 nt, Human
ccaacaucgcggaccccugugccuugucacag

SEQ ID NO: 361095 - RNA, 32 nt, Human
ccaacaucuauggugucccaggcacagugcca

SEQ ID NO: 361096 - RNA, 32 nt, Human
ccaacaucugaucugcugagauaugucugauc

SEQ ID NO: 361097 - RNA, 18 nt, Human
ccaacaucugccaccucu

SEQ ID NO: 361098 - RNA, 32 nt, Human
ccaacaucuuaguguuugcucucuccgggaag

SEQ ID NO: 361099 - RNA, 18 nt, Human
ccaacaucuuccauggac

SEQ ID NO: 361100 - RNA, 18 nt, Human
ccaacaugacacuaccau

SEQ ID NO: 361101 - RNA, 24 nt, Human
ccaacaugacgaaaccccaucucu

SEQ ID NO: 361102 - RNA, 32 nt, Human
ccaacaugccacaguguguugugcacagacac

SEQ ID NO: 361103 - RNA, 20 nt, Human
ccaacauggagaaaccccgu

SEQ ID NO: 361104 - RNA, 32 nt, Human
ccaacauggagaaacccugucucuauuaaaaa

SEQ ID NO: 361105 - RNA, 21 nt, Human
ccaacauggcaaaaacccauc

SEQ ID NO: 361106 - RNA, 32 nt, Human
ccaacauggcaaaaccccaucuguacuaaaaa

SEQ ID NO: 361107 - RNA, 32 nt, Human
ccaacauggccaaaaacugucucuacuaaaaa

SEQ ID NO: 361108 - RNA, 21 nt, Human
ccaacauggcgaaaacccauc

SEQ ID NO: 361109 - RNA, 32 nt, Human
ccaacauggcgaaaccccaucgcuacuaaaaa

SEQ ID NO: 361110 - RNA, 20 nt, Human
ccaacauggcgaaaucccgu

SEQ ID NO: 361111 - RNA, 32 nt, Human
ccaacaugggcaacauggugaaacacugucuc

SEQ ID NO: 361112 - RNA, 20 nt, Human
ccaacauggggaaaccccgu

SEQ ID NO: 361113 - RNA, 21 nt, Human
ccaacaugggucacuacucgu

SEQ ID NO: 361114 - RNA, 20 nt, Human
ccaacaugguaaaaucccgu

SEQ ID NO: 361115 - RNA, 18 nt, Human
ccaacaugguacagcaca

SEQ ID NO: 361116 - RNA, 32 nt, Human
ccaacauggugaaaacccaucuguacuaaaaa

SEQ ID NO: 361117 - RNA, 32 nt, Human
ccaacauggugaaacacuaucucuacuaaaaa

SEQ ID NO: 361118 - RNA, 18 nt, Human
ccaacauggugaaacccc

SEQ ID NO: 361119 - RNA, 32 nt, Human
ccaacauggugaaaccccaugucuacuaaaaa

SEQ ID NO: 361120 - RNA, 20 nt, Human
ccaacauggugaaaccccgu

SEQ ID NO: 361121 - RNA, 20 nt, Human
ccaacauggugaaacccugu

SEQ ID NO: 361122 - RNA, 19 nt, Human
ccaacauggugaaaccucg

SEQ ID NO: 361123 - RNA, 20 nt, Human
ccaacauggugaaaccucgu

SEQ ID NO: 361124 - RNA, 20 nt, Human
ccaacauggugacaccccgu

SEQ ID NO: 361125 - RNA, 20 nt, Human
ccaacauggugauaccccgu

SEQ ID NO: 361126 - RNA, 20 nt, Human
ccaacaugguuaaaccccgu

SEQ ID NO: 361127 - RNA, 19 nt, Human
ccaacaugugaaaccccgu

SEQ ID NO: 361128 - RNA, 32 nt, Human
ccaacaugugccagucucgggggcgagguaca

SEQ ID NO: 361129 - RNA, 32 nt, Human
ccaacauuccucacuacuacuuuuucuucccu

SEQ ID NO: 361130 - RNA, 32 nt, Human
ccaacauucucccaaucucucucuguuaaccc

SEQ ID NO: 361131 - RNA, 17 nt, Human
ccaacauugugcugcac

SEQ ID NO: 361132 - RNA, 17 nt, Human
ccaacauuuccagcucu

SEQ ID NO: 361133 - RNA, 32 nt, Human
ccaacauuuguaggggcacuaauccagcccuu

SEQ ID NO: 361134 - RNA, 18 nt, Human
ccaaccaaaaugcugcac

SEQ ID NO: 361135 - RNA, 23 nt, Human
ccaaccaaacccugaacagagga

SEQ ID NO: 361136 - RNA, 21 nt, Human
ccaaccaaagagccagccaga

SEQ ID NO: 361137 - RNA, 23 nt, Human
ccaaccaaaugacuucaggaaga

SEQ ID NO: 361138 - RNA, 32 nt, Human
ccaaccaacauggugaaaccccgucucuccua

SEQ ID NO: 361139 - RNA, 24 nt, Human
ccaaccaacauggugaaaccucgu

SEQ ID NO: 361140 - RNA, 32 nt, Human
ccaaccaacauggugaaaccucgugucuacua

SEQ ID NO: 361141 - RNA, 22 nt, Human
ccaaccaagcccuccagcaagg

SEQ ID NO: 361142 - RNA, 32 nt, Human
ccaaccaagcugccauggccaagggccgaacc

SEQ ID NO: 361143 - RNA, 32 nt, Human
ccaaccaaggggacaugauacagggaacaggu

SEQ ID NO: 361144 - RNA, 32 nt, Human
ccaaccaaggggauucuucgaucgugcaaguc

SEQ ID NO: 361145 - RNA, 32 nt, Human
ccaaccaauggcaggcugaaacuagcagauaa

SEQ ID NO: 361146 - RNA, 32 nt, Human
ccaaccacaaaaccacacacauagaccaucuc

SEQ ID NO: 361147 - RNA, 32 nt, Human
ccaaccacaagcaccaaagcagaggggcaggc

SEQ ID NO: 361148 - RNA, 32 nt, Human
ccaaccacaagucgcccuugacugcggcggcc

SEQ ID NO: 361149 - RNA, 32 nt, Human
ccaaccacacucuuggaccacagugccauaaa

SEQ ID NO: 361150 - RNA, 24 nt, Human
ccaaccacaucccaaguguccccu

SEQ ID NO: 361151 - RNA, 32 nt, Human
ccaaccaccagcgcauccacacgggcgagaag

SEQ ID NO: 361152 - RNA, 23 nt, Human
ccaaccacccaguccaggcuucc

SEQ ID NO: 361153 - RNA, 32 nt, Human
ccaaccacccaugcucuaaccuggagacagcc

SEQ ID NO: 361154 - RNA, 26 nt, Human
ccaaccaccccgacccagggcugccu

SEQ ID NO: 361155 - RNA, 32 nt, Human
ccaaccaccccugggauggcacuggcaggaca

SEQ ID NO: 361156 - RNA, 20 nt, Human
ccaaccaccugggcgagcca

SEQ ID NO: 361157 - RNA, 32 nt, Human
ccaaccaccuuuccauccccagccccucucau

SEQ ID NO: 361158 - RNA, 21 nt, Human
ccaaccacggcaauacugaaa

SEQ ID NO: 361159 - RNA, 21 nt, Human
ccaaccacguggaaagcuccu

SEQ ID NO: 361160 - RNA, 32 nt, Human
ccaaccagacacgggaaggagcagggcugccu

SEQ ID NO: 361161 - RNA, 32 nt, Human
ccaaccagagugagagggcagauaggcaggau

SEQ ID NO: 361162 - RNA, 32 nt, Human
ccaaccagaguugugucuaacuuuaggcaucu

SEQ ID NO: 361163 - RNA, 32 nt, Human
ccaaccagauaacauuuacucuaaguacccag

SEQ ID NO: 361164 - RNA, 32 nt, Human
ccaaccagcaggaugcggcuguggaaggcggu

SEQ ID NO: 361165 - RNA, 32 nt, Human
ccaaccagccugggugacagagggagacccug

SEQ ID NO: 361166 - RNA, 32 nt, Human
ccaaccagcgggccucauccuacacccucacc

SEQ ID NO: 361167 - RNA, 32 nt, Human
ccaaccaggccaggcugcgcucagaacacacc

SEQ ID NO: 361168 - RNA, 32 nt, Human
ccaaccauacaaaaauuccuuuucccgaagga

SEQ ID NO: 361169 - RNA, 32 nt, Human
ccaaccauagucagagguggcacaucugcuca

SEQ ID NO: 361170 - RNA, 32 nt, Human
ccaaccaucacagaggacagaugaguauuguc

SEQ ID NO: 361171 - RNA, 32 nt, Human
ccaaccaugcagccaccaaccccagccagugu

SEQ ID NO: 361172 - RNA, 21 nt, Human
ccaaccaugccaagccugccu

SEQ ID NO: 361173 - RNA, 32 nt, Human
ccaaccaugcuuuaaagaaccugcucuuuacg

SEQ ID NO: 361174 - RNA, 32 nt, Human
ccaaccauggccugugguggcuucacgggcua

SEQ ID NO: 361175 - RNA, 32 nt, Human
ccaaccaugguggcucacaccuguaaucccaa

SEQ ID NO: 361176 - RNA, 32 nt, Human
ccaaccauuaucccuuugaauauugcuucugc

SEQ ID NO: 361177 - RNA, 31 nt, Human
ccaacccaaauguccaucaaugauagacugg

SEQ ID NO: 361178 - RNA, 31 nt, Human
ccaacccaaauguccauccacaguugaagcu

SEQ ID NO: 361179 - RNA, 32 nt, Human
ccaacccaagccagguaggcaauacuuucccu

SEQ ID NO: 361180 - RNA, 32 nt, Human
ccaacccaagcccccagaccaucuguggaggu

SEQ ID NO: 361181 - RNA, 32 nt, Human
ccaacccagagcuccccacagaccugguguaa

SEQ ID NO: 361182 - RNA, 21 nt, Human
ccaacccagcggacccuccca

SEQ ID NO: 361183 - RNA, 32 nt, Human
ccaacccagcuccacccagcaguguccugggg

SEQ ID NO: 361184 - RNA, 32 nt, Human
ccaacccaggaucaggcaggacggcuggggcu

SEQ ID NO: 361185 - RNA, 20 nt, Human
ccaacccaucccuuaagggc

SEQ ID NO: 361186 - RNA, 32 nt, Human
ccaacccaucuauuuccagaucuacacaguca

SEQ ID NO: 361187 - RNA, 32 nt, Human
ccaaccccaaccccaaugagcaguacaguauu

SEQ ID NO: 361188 - RNA, 23 nt, Human
ccaaccccaagcucugggcacau

SEQ ID NO: 361189 - RNA, 28 nt, Human
ccaaccccaagugccuucaugcccuagg

SEQ ID NO: 361190 - RNA, 32 nt, Human
ccaaccccacucuuguaacacugcacaugcaa

SEQ ID NO: 361191 - RNA, 32 nt, Human
ccaaccccagcccuggguagccugcagcaugg

SEQ ID NO: 361192 - RNA, 32 nt, Human
ccaaccccagcuggaugugccucccaggccug

SEQ ID NO: 361193 - RNA, 32 nt, Human
ccaacccccaaaccagguggaaaaaggaaggg

SEQ ID NO: 361194 - RNA, 21 nt, Human
ccaacccccaaacugcugcug

SEQ ID NO: 361195 - RNA, 32 nt, Human
ccaacccccagcacccgggcucagggaccaca

SEQ ID NO: 361196 - RNA, 32 nt, Human
ccaacccccuacugcuguucccagucagucug

SEQ ID NO: 361197 - RNA, 32 nt, Human
ccaacccccucagcgaccacagugccucgccc

SEQ ID NO: 361198 - RNA, 22 nt, Human
ccaacccccugcucugcugcaa

SEQ ID NO: 361199 - RNA, 18 nt, Human
ccaaccccgcuucugcca

SEQ ID NO: 361200 - RNA, 32 nt, Human
ccaaccccggaaaauccucugucuccagucuc

SEQ ID NO: 361201 - RNA, 32 nt, Human
ccaaccccgucucucccucccuugccacccaa

SEQ ID NO: 361202 - RNA, 32 nt, Human
ccaaccccuaggcuugaggguggagagccagg

SEQ ID NO: 361203 - RNA, 32 nt, Human
ccaaccccucccccacgucucucugccugcug

SEQ ID NO: 361204 - RNA, 21 nt, Human
ccaaccccucccucccaccac

SEQ ID NO: 361205 - RNA, 21 nt, Human
ccaaccccucucagagccuca

SEQ ID NO: 361206 - RNA, 32 nt, Human
ccaaccccugcucccacacagugcagaccgga

SEQ ID NO: 361207 - RNA, 32 nt, Human
ccaaccccugcucugcaccaucugggcccucg

SEQ ID NO: 361208 - RNA, 32 nt, Human
ccaaccccugcucugucauucgugaccugcuc

SEQ ID NO: 361209 - RNA, 32 nt, Human
ccaaccccugcucuuccaggucgggccccggg

SEQ ID NO: 361210 - RNA, 32 nt, Human
ccaaccccugcucuugccagcuggccccugcu

SEQ ID NO: 361211 - RNA, 32 nt, Human
ccaaccccugggauggcucacagccugcuccc

SEQ ID NO: 361212 - RNA, 32 nt, Human
ccaaccccuguacuccccuuugcuccaucagu

SEQ ID NO: 361213 - RNA, 32 nt, Human
ccaaccccuguggagcccgcacccccacccuu

SEQ ID NO: 361214 - RNA, 32 nt, Human
ccaacccgauauaccaggugcucugggggaug

SEQ ID NO: 361215 - RNA, 32 nt, Human
ccaacccgcuuccugacugaccugagcaaggu

SEQ ID NO: 361216 - RNA, 32 nt, Human
ccaacccgggcagaggaggaggugcggcggcg

SEQ ID NO: 361217 - RNA, 24 nt, Human
ccaacccuaccccugggcccugcc

SEQ ID NO: 361218 - RNA, 32 nt, Human
ccaacccuaggcuguuuccccaaaaagaaaaa

SEQ ID NO: 361219 - RNA, 32 nt, Human
ccaacccucucugaaguggaaguggacugaca

SEQ ID NO: 361220 - RNA, 32 nt, Human
ccaacccucugcucccguuucucccucugguu

SEQ ID NO: 361221 - RNA, 32 nt, Human
ccaacccugcauggucaaguggugcuaaccca

SEQ ID NO: 361222 - RNA, 32 nt, Human
ccaacccugccugccgcugcaccugccugccg

SEQ ID NO: 361223 - RNA, 32 nt, Human
ccaacccugccuggaucucccugcuucacccc

SEQ ID NO: 361224 - RNA, 32 nt, Human
ccaacccugcgagaggcagccuccucuugcaa

SEQ ID NO: 361225 - RNA, 32 nt, Human
ccaacccuguccacccuugaccaccucugggg

SEQ ID NO: 361226 - RNA, 32 nt, Human
ccaacccuguggccuucagggcucagagcagc

SEQ ID NO: 361227 - RNA, 32 nt, Human
ccaacccuucccucccuuuccccaccucuuac

SEQ ID NO: 361228 - RNA, 22 nt, Human
ccaacccuugggccaggcugcc

SEQ ID NO: 361229 - RNA, 32 nt, Human
ccaaccgaagucacuccaggcugggaucaaau

SEQ ID NO: 361230 - RNA, 32 nt, Human
ccaaccgacauggcugccccaggugggaaggg

SEQ ID NO: 361231 - RNA, 32 nt, Human
ccaaccgaccaacauggugaaaccccaucuuu

SEQ ID NO: 361232 - RNA, 32 nt, Human
ccaaccgaccagcaaccccaauuuuccagccc

SEQ ID NO: 361233 - RNA, 32 nt, Human
ccaaccgcaaccugccuugaccaggaaggagc

SEQ ID NO: 361234 - RNA, 32 nt, Human
ccaaccgcauccucuuccaggaguuccggcag

SEQ ID NO: 361235 - RNA, 32 nt, Human
ccaaccgcuccgcugcgcgcaggcugggcugc

SEQ ID NO: 361236 - RNA, 32 nt, Human
ccaaccuacaacuugaaguacaauucaccugg

SEQ ID NO: 361237 - RNA, 32 nt, Human
ccaaccuagagauucacuccuuaucuaugaag

SEQ ID NO: 361238 - RNA, 32 nt, Human
ccaaccuagcuagcaacauuuguuuuagucug

SEQ ID NO: 361239 - RNA, 32 nt, Human
ccaaccuaucgcugcuggcagcacuuuuugag

SEQ ID NO: 361240 - RNA, 32 nt, Human
ccaaccucaagcaauccuccugccucagccuc

SEQ ID NO: 361241 - RNA, 32 nt, Human
ccaaccucacacugcuaugauugccaacucca

SEQ ID NO: 361242 - RNA, 32 nt, Human
ccaaccucacauccuacuagucuuccaagagg

SEQ ID NO: 361243 - RNA, 32 nt, Human
ccaaccucaggugauccgcccaccucggccuc

SEQ ID NO: 361244 - RNA, 32 nt, Human
ccaaccucauuuccuguuucaccuugauuuuc

SEQ ID NO: 361245 - RNA, 32 nt, Human
ccaaccuccaccuccuccuuccauuuugacca

SEQ ID NO: 361246 - RNA, 32 nt, Human
ccaaccucccaaaucgcugagcugcuuguuua

SEQ ID NO: 361247 - RNA, 32 nt, Human
ccaaccuccuccuggguuccagcgauucuccu

SEQ ID NO: 361248 - RNA, 32 nt, Human
ccaaccuccugcagguggacagugaguucaca

SEQ ID NO: 361249 - RNA, 26 nt, Human
ccaaccuccuuccccaccuccuuccc

SEQ ID NO: 361250 - RNA, 18 nt, Human
ccaaccucuaacugcaga

SEQ ID NO: 361251 - RNA, 22 nt, Human
ccaaccucuauacaccauaaag

SEQ ID NO: 361252 - RNA, 32 nt, Human
ccaaccucugggcaaaugcucaucugacuucc

SEQ ID NO: 361253 - RNA, 32 nt, Human
ccaaccucuuacucugaauucagugcugcuuu

SEQ ID NO: 361254 - RNA, 32 nt, Human
ccaaccucuugggcaccccauggcuggcugcu

SEQ ID NO: 361255 - RNA, 32 nt, Human
ccaaccucuuuuuccuccuggacacauuggaa

SEQ ID NO: 361256 - RNA, 32 nt, Human
ccaaccugagccaccucuuccuccacgggaac

SEQ ID NO: 361257 - RNA, 32 nt, Human
ccaaccugaggcugccccggccgccugcgcac

SEQ ID NO: 361258 - RNA, 32 nt, Human
ccaaccugcucacccuguggcucuucuccaac

SEQ ID NO: 361259 - RNA, 19 nt, Human
ccaaccuggaaucccugca

SEQ ID NO: 361260 - RNA, 24 nt, Human
ccaaccuggacaacaagagcgaaa

SEQ ID NO: 361261 - RNA, 23 nt, Human
ccaaccuggacaacagagcgaga

SEQ ID NO: 361262 - RNA, 32 nt, Human
ccaaccuggaucacucuuccacccaaccgagg

SEQ ID NO: 361263 - RNA, 32 nt, Human
ccaaccuggccaacauggugaaaccuugucuc

SEQ ID NO: 361264 - RNA, 32 nt, Human
ccaaccuggccaacauguugaaaccucgucug

SEQ ID NO: 361265 - RNA, 32 nt, Human
ccaaccuggcugcugcaguacuugcucuaacu

SEQ ID NO: 361266 - RNA, 32 nt, Human
ccaaccugggcaaaauagugagagacccugua

SEQ ID NO: 361267 - RNA, 32 nt, Human
ccaaccugggcaacaagagcgaaacuccaucu

SEQ ID NO: 361268 - RNA, 24 nt, Human
ccaaccugggcaacaagagugaaa

SEQ ID NO: 361269 - RNA, 32 nt, Human
ccaaccugggcaacaagagugaaacuccaucu

SEQ ID NO: 361270 - RNA, 32 nt, Human
ccaaccugggcaacaccgugagaccccaucuc

SEQ ID NO: 361271 - RNA, 32 nt, Human
ccaaccugggcaacagaacaagaacccaucuc

SEQ ID NO: 361272 - RNA, 32 nt, Human
ccaaccugggcaacagaaugagacccugucuc

SEQ ID NO: 361273 - RNA, 23 nt, Human
ccaaccugggcaacagagggaga

SEQ ID NO: 361274 - RNA, 32 nt, Human
ccaaccugggcaacagaguaagaccuugucuu

SEQ ID NO: 361275 - RNA, 32 nt, Human
ccaaccugggcaacagaguaagacuccuucuc

SEQ ID NO: 361276 - RNA, 32 nt, Human
ccaaccugggcaacagagugagacccugucuc

SEQ ID NO: 361277 - RNA, 23 nt, Human
ccaaccugggcaacauagugaga

SEQ ID NO: 361278 - RNA, 32 nt, Human
ccaaccugggcaacauagugagacccccaucu

SEQ ID NO: 361279 - RNA, 32 nt, Human
ccaaccugggcaacauagugagaccuccaucu

SEQ ID NO: 361280 - RNA, 32 nt, Human
ccaaccugggcaacauagugagauucuguuaa

SEQ ID NO: 361281 - RNA, 32 nt, Human
ccaaccugggcaacauagugggacuucaucuc

SEQ ID NO: 361282 - RNA, 32 nt, Human
ccaaccugggcaacaugaugaaacucuagcuc

SEQ ID NO: 361283 - RNA, 32 nt, Human
ccaaccugggcaacauggugaaaccccugucu

SEQ ID NO: 361284 - RNA, 23 nt, Human
ccaaccugggcaauagagcgaga

SEQ ID NO: 361285 - RNA, 32 nt, Human
ccaaccugggcaauagaggaagacuccggucu

SEQ ID NO: 361286 - RNA, 32 nt, Human
ccaaccugggcaauauagcaagaucccaucuc

SEQ ID NO: 361287 - RNA, 32 nt, Human
ccaaccugggcaauauagugagacccuauuuc

SEQ ID NO: 361288 - RNA, 17 nt, Human
ccaaccugggcugcaga

SEQ ID NO: 361289 - RNA, 32 nt, Human
ccaaccuggggucccuggaggccagaaaagug

SEQ ID NO: 361290 - RNA, 23 nt, Human
ccaaccuggguaacaaagugaga

SEQ ID NO: 361291 - RNA, 24 nt, Human
ccaaccugggugacaagagugaaa

SEQ ID NO: 361292 - RNA, 32 nt, Human
ccaaccugggugacagacucugucuccaaaac

SEQ ID NO: 361293 - RNA, 23 nt, Human
ccaaccugggugacagagcgaaa

SEQ ID NO: 361294 - RNA, 23 nt, Human
ccaaccugggugacagagcgaga

SEQ ID NO: 361295 - RNA, 20 nt, Human
ccaaccuggugaaaccccgu

SEQ ID NO: 361296 - RNA, 20 nt, Human
ccaaccuggugaaacccugu

SEQ ID NO: 361297 - RNA, 32 nt, Human
ccaaccuguaguucagccaccuucaacacuug

SEQ ID NO: 361298 - RNA, 32 nt, Human
ccaaccugucuccagccaccuucuguggaguc

SEQ ID NO: 361299 - RNA, 18 nt, Human
ccaaccuguguacugaca

SEQ ID NO: 361300 - RNA, 32 nt, Human
ccaaccuuacuuccagcuugcacaucagaauu

SEQ ID NO: 361301 - RNA, 32 nt, Human
ccaaccuuauuuccagcuugcacaucagaauu

SEQ ID NO: 361302 - RNA, 32 nt, Human
ccaaccuucccaaacgccuccccugccccaau

SEQ ID NO: 361303 - RNA, 32 nt, Human
ccaaccuugcauucugagauaaaccccacuug

SEQ ID NO: 361304 - RNA, 32 nt, Human
ccaaccuugccagcuggcccagcuucaccucu

SEQ ID NO: 361305 - RNA, 32 nt, Human
ccaaccuuuccaggccuucucuacgucugcuu

SEQ ID NO: 361306 - RNA, 32 nt, Human
ccaaccuuuuucuguggcuuuagcaguggggc

SEQ ID NO: 361307 - RNA, 32 nt, Human
ccaacgaccuaaugauguucagcucuuuuaug

SEQ ID NO: 361308 - RNA, 32 nt, Human
ccaacgacucaaaucacaucaagcagaaccag

SEQ ID NO: 361309 - RNA, 32 nt, Human
ccaacgacuguaggaggaaaaauuaaggggag

SEQ ID NO: 361310 - RNA, 32 nt, Human
ccaacgagccaccacagccaccagucccagaa

SEQ ID NO: 361311 - RNA, 32 nt, Human
ccaacgagguacugagugucggcaucagcacu

SEQ ID NO: 361312 - RNA, 23 nt, Human
ccaacgaugccccccaggccccu

SEQ ID NO: 361313 - RNA, 32 nt, Human
ccaacgccaacuggcaaccucuuuacucuuag

SEQ ID NO: 361314 - RNA, 32 nt, Human
ccaacgccacucggugcauuuccccaggcgcu

SEQ ID NO: 361315 - RNA, 32 nt, Human
ccaacgcccaaagcccugaugaccugguucuu

SEQ ID NO: 361316 - RNA, 32 nt, Human
ccaacgcccagccuggcaagggugagcccaga

SEQ ID NO: 361317 - RNA, 32 nt, Human
ccaacgccccacccacugccucccucuggccu

SEQ ID NO: 361318 - RNA, 21 nt, Human
ccaacgcccccuuucccucuc

SEQ ID NO: 361319 - RNA, 32 nt, Human
ccaacgcccugagacaccagcccugcuuuaag

SEQ ID NO: 361320 - RNA, 22 nt, Human
ccaacgccuccucccugagcca

SEQ ID NO: 361321 - RNA, 32 nt, Human
ccaacgccuucugggcuuucuucagaggucac

SEQ ID NO: 361322 - RNA, 32 nt, Human
ccaacgcgcuugaggaccagcccagccggggc

SEQ ID NO: 361323 - RNA, 32 nt, Human
ccaacgcggucugguuuuccagccugggagug

SEQ ID NO: 361324 - RNA, 32 nt, Human
ccaacgcugccaacaccuugaucucugacuuc

SEQ ID NO: 361325 - RNA, 32 nt, Human
ccaacggccagagcuacaggacugccugggac

SEQ ID NO: 361326 - RNA, 32 nt, Human
ccaacggccccagcuucucagcucgcuggaug

SEQ ID NO: 361327 - RNA, 32 nt, Human
ccaacggcggagggggcggggaagggagauuc

SEQ ID NO: 361328 - RNA, 32 nt, Human
ccaacggcucugcuaucauuuguacucgggaa

SEQ ID NO: 361329 - RNA, 32 nt, Human
ccaacgggaccuaccuccucccggcuaccuaa

SEQ ID NO: 361330 - RNA, 32 nt, Human
ccaacgggaggauggcuucacagcagagccag

SEQ ID NO: 361331 - RNA, 21 nt, Human
ccaacgggcacaagcauucua

SEQ ID NO: 361332 - RNA, 32 nt, Human
ccaacggggcuuucauacccaaggaucuguuu

SEQ ID NO: 361333 - RNA, 24 nt, Human
ccaacgggggcggaucacuugagg

SEQ ID NO: 361334 - RNA, 32 nt, Human
ccaacgggggcggaucacuugaggucagaagu

SEQ ID NO: 361335 - RNA, 32 nt, Human
ccaacggugaaugucuacuaugugccacacgu

SEQ ID NO: 361336 - RNA, 32 nt, Human
ccaacgucuauagcugcuccaucccagccacc

SEQ ID NO: 361337 - RNA, 32 nt, Human
ccaacgugagagagacaggcagacagacagaa

SEQ ID NO: 361338 - RNA, 32 nt, Human
ccaacgugcagcaggugcagauccaccagauc

SEQ ID NO: 361339 - RNA, 22 nt, Human
ccaacgugcugggauuacaggc

SEQ ID NO: 361340 - RNA, 24 nt, Human
ccaacgugcugggauuacaggugu

SEQ ID NO: 361341 - RNA, 24 nt, Human
ccaacgugcugggauuauaggcgu

SEQ ID NO: 361342 - RNA, 32 nt, Human
ccaacguggagaaacacuaucucuacuaaaaa

SEQ ID NO: 361343 - RNA, 32 nt, Human
ccaacguggagaaaccccgucucuauuaaaaa

SEQ ID NO: 361344 - RNA, 24 nt, Human
ccaacguggauggaucaccugagg

SEQ ID NO: 361345 - RNA, 32 nt, Human
ccaacguggauggaucaccugaggucaggagu

SEQ ID NO: 361346 - RNA, 20 nt, Human
ccaacguggugaaacaccgu

SEQ ID NO: 361347 - RNA, 20 nt, Human
ccaacguggugaaaccccgu

SEQ ID NO: 361348 - RNA, 20 nt, Human
ccaacguggugaaacccugu

SEQ ID NO: 361349 - RNA, 20 nt, Human
ccaacguggugaaaccucgu

SEQ ID NO: 361350 - RNA, 20 nt, Human
ccaacguggugaaaucccgu

SEQ ID NO: 361351 - RNA, 20 nt, Human
ccaacguguugaaaccccgu

SEQ ID NO: 361352 - RNA, 32 nt, Human
ccaacuaaaccucaaaugaaccagccccuaac

SEQ ID NO: 361353 - RNA, 32 nt, Human
ccaacuaagcaagauugugaucccagaaauug

SEQ ID NO: 361354 - RNA, 22 nt, Human
ccaacuaccuccgucagcaaga

SEQ ID NO: 361355 - RNA, 32 nt, Human
ccaacuacucaaucauacaaaaagaagaguau

SEQ ID NO: 361356 - RNA, 20 nt, Human
ccaacuacucaggaggcuga

SEQ ID NO: 361357 - RNA, 20 nt, Human
ccaacuacucgggaggccga

SEQ ID NO: 361358 - RNA, 23 nt, Human
ccaacuagcugggacuacaggug

SEQ ID NO: 361359 - RNA, 32 nt, Human
ccaacuaguuauugaauguaaaccagauggca

SEQ ID NO: 361360 - RNA, 32 nt, Human
ccaacuaguuucuuccuggggccaguuuuggg

SEQ ID NO: 361361 - RNA, 32 nt, Human
ccaacuauaauuauaaucaaaaucaaugcagg

SEQ ID NO: 361362 - RNA, 32 nt, Human
ccaacuauggaagggagcugagcuccaguauu

SEQ ID NO: 361363 - RNA, 32 nt, Human
ccaacuauguggagcugcggcaguaggccccc

SEQ ID NO: 361364 - RNA, 25 nt, Human
ccaacucaagugucaccuccuuccc

SEQ ID NO: 361365 - RNA, 32 nt, Human
ccaacucagccgcagcguuccccagcuccccu

SEQ ID NO: 361366 - RNA, 32 nt, Human
ccaacucagcuccaaaaccacacacaaugucu

SEQ ID NO: 361367 - RNA, 19 nt, Human
ccaacucaucauuuuccua

SEQ ID NO: 361368 - RNA, 32 nt, Human
ccaacucauucuaugaggccaacaucaucuug

SEQ ID NO: 361369 - RNA, 32 nt, Human
ccaacuccagcagcuggacucugggcccacaa

SEQ ID NO: 361370 - RNA, 32 nt, Human
ccaacuccagcggucccaugucagccuucuga

SEQ ID NO: 361371 - RNA, 32 nt, Human
ccaacucccaaaagcuagaacacugccaacug

SEQ ID NO: 361372 - RNA, 32 nt, Human
ccaacucccacaccccuggaucuaggcagcca

SEQ ID NO: 361373 - RNA, 32 nt, Human
ccaacucccagccuagggcagcagggagucuu

SEQ ID NO: 361374 - RNA, 32 nt, Human
ccaacucccccaggcucccuguccacugcccu

SEQ ID NO: 361375 - RNA, 17 nt, Human
ccaacuccgagggccca

SEQ ID NO: 361376 - RNA, 32 nt, Human
ccaacuccguggaagcucugcugagaugcaga

SEQ ID NO: 361377 - RNA, 32 nt, Human
ccaacuccguugugguccagccccaggccucc

SEQ ID NO: 361378 - RNA, 32 nt, Human
ccaacuccuacaaaugagaauucuugcacaaa

SEQ ID NO: 361379 - RNA, 32 nt, Human
ccaacuccuccaauggcugaagcuacuuccuc

SEQ ID NO: 361380 - RNA, 32 nt, Human
ccaacuccucuauccaagacugugcccacauc

SEQ ID NO: 361381 - RNA, 24 nt, Human
ccaacuccucuggcccuccuuccc

SEQ ID NO: 361382 - RNA, 32 nt, Human
ccaacuccuuucucccgagccugcuggcagau

SEQ ID NO: 361383 - RNA, 32 nt, Human
ccaacucucacacccagcccaggcugcagucu

SEQ ID NO: 361384 - RNA, 32 nt, Human
ccaacucucacccugugaauccacugacuggg

SEQ ID NO: 361385 - RNA, 32 nt, Human
ccaacucucauggaugacuuugagggguucaa

SEQ ID NO: 361386 - RNA, 32 nt, Human
ccaacucuccccugaccugugagcccagcugg

SEQ ID NO: 361387 - RNA, 32 nt, Human
ccaacucugaaagagagugaaaaugcagacaa

SEQ ID NO: 361388 - RNA, 32 nt, Human
ccaacucuggcagucucuccuggcagaucucc

SEQ ID NO: 361389 - RNA, 32 nt, Human
ccaacucuggcuuaaagaucuugcuguggcuc

SEQ ID NO: 361390 - RNA, 32 nt, Human
ccaacucuguucccuucuccuuucaucccaga

SEQ ID NO: 361391 - RNA, 32 nt, Human
ccaacucuguucuauuucuuugcaggagccug

SEQ ID NO: 361392 - RNA, 32 nt, Human
ccaacucuguuuccucauugcccccugagaug

SEQ ID NO: 361393 - RNA, 32 nt, Human
ccaacucuucccccucucccaguugucccgau

SEQ ID NO: 361394 - RNA, 32 nt, Human
ccaacucuuccucuuucuucuucuugagagag

SEQ ID NO: 361395 - RNA, 32 nt, Human
ccaacucuucuuccuuccccugaccuaggugu

SEQ ID NO: 361396 - RNA, 32 nt, Human
ccaacucuucuuuuuaaagauucuuguggcug

SEQ ID NO: 361397 - RNA, 18 nt, Human
ccaacugacacuggcaca

SEQ ID NO: 361398 - RNA, 32 nt, Human
ccaacugaccaccuuuguuucucccccauguu

SEQ ID NO: 361399 - RNA, 32 nt, Human
ccaacugacuggcccgggcaaugauuccccaa

SEQ ID NO: 361400 - RNA, 32 nt, Human
ccaacugagcuuuucaggucucaggcacagca

SEQ ID NO: 361401 - RNA, 32 nt, Human
ccaacugaguccaaacuuuucuaaugucuguc

SEQ ID NO: 361402 - RNA, 32 nt, Human
ccaacugcaaacaagcucgccuaucugucauc

SEQ ID NO: 361403 - RNA, 32 nt, Human
ccaacugcaccagcacugccucccccagggau

SEQ ID NO: 361404 - RNA, 22 nt, Human
ccaacugcacucccugcugcug

SEQ ID NO: 361405 - RNA, 32 nt, Human
ccaacugcagugaucuaggcacuuccuccagc

SEQ ID NO: 361406 - RNA, 32 nt, Human
ccaacugccaaggcagggcagagcagacaagg

SEQ ID NO: 361407 - RNA, 32 nt, Human
ccaacugcccccguggucgccugguggcugga

SEQ ID NO: 361408 - RNA, 21 nt, Human
ccaacugcuccccccacccca

SEQ ID NO: 361409 - RNA, 32 nt, Human
ccaacugcucugccccuagcuccaggggccug

SEQ ID NO: 361410 - RNA, 21 nt, Human
ccaacugcuguccccaaggaa

SEQ ID NO: 361411 - RNA, 32 nt, Human
ccaacuggacaacgugugggauggaccuggaa

SEQ ID NO: 361412 - RNA, 24 nt, Human
ccaacuggaccuucuuguacucca

SEQ ID NO: 361413 - RNA, 32 nt, Human
ccaacuggagggugccuggcucuuugaagaaa

SEQ ID NO: 361414 - RNA, 32 nt, Human
ccaacuggcaagucgugcuaacccgaagaccc

SEQ ID NO: 361415 - RNA, 32 nt, Human
ccaacuggcaccaaggaauugccuccagccug

SEQ ID NO: 361416 - RNA, 19 nt, Human
ccaacuggcaucugugaug

SEQ ID NO: 361417 - RNA, 32 nt, Human
ccaacuggggaagagauggcagaggguccccc

SEQ ID NO: 361418 - RNA, 18 nt, Human
ccaacuggggccugcaua

SEQ ID NO: 361419 - RNA, 32 nt, Human
ccaacugucaucugagaaaccaacacauuuuu

SEQ ID NO: 361420 - RNA, 23 nt, Human
ccaacugucgccugguugggccc

SEQ ID NO: 361421 - RNA, 32 nt, Human
ccaacugugcaggugcuggggagugggaggcu

SEQ ID NO: 361422 - RNA, 32 nt, Human
ccaacuguguggcagaacgugcagugagggug

SEQ ID NO: 361423 - RNA, 23 nt, Human
ccaacuguguugcuccacccgga

SEQ ID NO: 361424 - RNA, 32 nt, Human
ccaacuguuucccugcugaaugccucgcuccc

SEQ ID NO: 361425 - RNA, 21 nt, Human
ccaacuuaagcagaacuugag

SEQ ID NO: 361426 - RNA, 32 nt, Human
ccaacuuaauaaacacauuucugggguuccuc

SEQ ID NO: 361427 - RNA, 32 nt, Human
ccaacuuaaucagauaaacagauuauguaaug

SEQ ID NO: 361428 - RNA, 32 nt, Human
ccaacuucacaccagccccaacccgcuuuggg

SEQ ID NO: 361429 - RNA, 32 nt, Human
ccaacuucauuagcuccagucuguggcuccug

SEQ ID NO: 361430 - RNA, 32 nt, Human
ccaacuucauuucugaaccuucacugcuucca

SEQ ID NO: 361431 - RNA, 24 nt, Human
ccaacuuccaauacaacagccauc

SEQ ID NO: 361432 - RNA, 32 nt, Human
ccaacuuccaaucauuccagcuagaagagcuu

SEQ ID NO: 361433 - RNA, 32 nt, Human
ccaacuuccgccuuaagaaaacaggaccagcc

SEQ ID NO: 361434 - RNA, 32 nt, Human
ccaacuuccucagucuuuucugccucaacuuc

SEQ ID NO: 361435 - RNA, 22 nt, Human
ccaacuuccuguugcuggcccc

SEQ ID NO: 361436 - RNA, 32 nt, Human
ccaacuucuagagacggcuuugcucauuacca

SEQ ID NO: 361437 - RNA, 32 nt, Human
ccaacuucucuugcuuucuaugcuguuuguag

SEQ ID NO: 361438 - RNA, 19 nt, Human
ccaacuucuggaagcauug

SEQ ID NO: 361439 - RNA, 32 nt, Human
ccaacuugagggcccagagcaggaagcauuca

SEQ ID NO: 361440 - RNA, 32 nt, Human
ccaacuugauccuggcccugaggagucauugg

SEQ ID NO: 361441 - RNA, 31 nt, Human
ccaacuugcaacacaagacccuaggagggag

SEQ ID NO: 361442 - RNA, 32 nt, Human
ccaacuuggaacccgacgugccagggcccagu

SEQ ID NO: 361443 - RNA, 32 nt, Human
ccaacuuggagugcucuggucauuugcaucug

SEQ ID NO: 361444 - RNA, 27 nt, Human
ccaacuugggcaacagacagagcgaga

SEQ ID NO: 361445 - RNA, 32 nt, Human
ccaacuugggcaacagacagagcgagacucug

SEQ ID NO: 361446 - RNA, 32 nt, Human
ccaacuugggcaacauagcaagaccccaucuc

SEQ ID NO: 361447 - RNA, 23 nt, Human
ccaacuugggcaacauggugaaa

SEQ ID NO: 361448 - RNA, 32 nt, Human
ccaacuugggcaacauggugaaacacugucuc

SEQ ID NO: 361449 - RNA, 20 nt, Human
ccaacuuggugaaaccccgu

SEQ ID NO: 361450 - RNA, 19 nt, Human
ccaacuugguugcugggga

SEQ ID NO: 361451 - RNA, 32 nt, Human
ccaacuuguagcuuuuuaucccuuacccuacc

SEQ ID NO: 361452 - RNA, 32 nt, Human
ccaacuugucuuccuuucucucuucccuuccc

SEQ ID NO: 361453 - RNA, 24 nt, Human
ccaacuuguuuccuccccucaaag

SEQ ID NO: 361454 - RNA, 32 nt, Human
ccaacuuugagacuuugcaggcugccaggugc

SEQ ID NO: 361455 - RNA, 32 nt, Human
ccaacuuugcugucuguucuuccaaauguuua

SEQ ID NO: 361456 - RNA, 19 nt, Human
ccaacuuuugcauuuccca

SEQ ID NO: 361457 - RNA, 32 nt, Human
ccaacuuuugccagaaagcagaaaaaugcucu

SEQ ID NO: 361458 - RNA, 32 nt, Human
ccaagaaaaacacucaucacacacagagaaga

SEQ ID NO: 361459 - RNA, 32 nt, Human
ccaagaaaaagcuuucucagccuucaaagacc

SEQ ID NO: 361460 - RNA, 32 nt, Human
ccaagaaaaaggaaaagaaagagugccaccaa

SEQ ID NO: 361461 - RNA, 22 nt, Human
ccaagaaaaccaggaguugcuu

SEQ ID NO: 361462 - RNA, 32 nt, Human
ccaagaaaaccuggcauauuuccuaaaacagu

SEQ ID NO: 361463 - RNA, 20 nt, Human
ccaagaaaagagauccacau

SEQ ID NO: 361464 - RNA, 32 nt, Human
ccaagaaaagaggccaaagcaagagcagauuc

SEQ ID NO: 361465 - RNA, 20 nt, Human
ccaagaaaauuuuuccucuu

SEQ ID NO: 361466 - RNA, 32 nt, Human
ccaagaaacaccuaacaccacaccucaaaugg

SEQ ID NO: 361467 - RNA, 32 nt, Human
ccaagaaacaucugguacagcugccaaacauc

SEQ ID NO: 361468 - RNA, 32 nt, Human
ccaagaaagacauuuuuaugugauaaaugcag

SEQ ID NO: 361469 - RNA, 32 nt, Human
ccaagaaagaggaggagaguugaaaagagagg

SEQ ID NO: 361470 - RNA, 32 nt, Human
ccaagaaagcagcuggguucagaaggccgggu

SEQ ID NO: 361471 - RNA, 32 nt, Human
ccaagaaagccaagugugagggcugaaagaau

SEQ ID NO: 361472 - RNA, 32 nt, Human
ccaagaaagggaagggaaaggacuaacgccaa

SEQ ID NO: 361473 - RNA, 32 nt, Human
ccaagaaagggaggggaaggaaugagcuaaaa

SEQ ID NO: 361474 - RNA, 32 nt, Human
ccaagaaagggaguggaggugcagcgaaggac

SEQ ID NO: 361475 - RNA, 32 nt, Human
ccaagaaagugaugauucuggaaaaggaacgc

SEQ ID NO: 361476 - RNA, 32 nt, Human
ccaagaaaugucccagcugagggccuuugucc

SEQ ID NO: 361477 - RNA, 32 nt, Human
ccaagaaauguucuauggaaguuuacguuuua

SEQ ID NO: 361478 - RNA, 32 nt, Human
ccaagaaauuuucccuguuuggaaaguuugcc

SEQ ID NO: 361479 - RNA, 32 nt, Human
ccaagaacaaaggcuuucugaaucuucucagg

SEQ ID NO: 361480 - RNA, 32 nt, Human
ccaagaacaccguggaugcugaagggaagaga

SEQ ID NO: 361481 - RNA, 32 nt, Human
ccaagaacagcauuucuguccugaaugaaagu

SEQ ID NO: 361482 - RNA, 32 nt, Human
ccaagaacaggccuggcccaaggugccacccc

SEQ ID NO: 361483 - RNA, 27 nt, Human
ccaagaaccaauaaauuucuguugaau

SEQ ID NO: 361484 - RNA, 19 nt, Human
ccaagaaccacuuccaugc

SEQ ID NO: 361485 - RNA, 32 nt, Human
ccaagaacgugagaguugaagcucccaacauc

SEQ ID NO: 361486 - RNA, 32 nt, Human
ccaagaacuccagcuuccccacugccucugug

SEQ ID NO: 361487 - RNA, 32 nt, Human
ccaagaacucuguucuucacuacuucucaaca

SEQ ID NO: 361488 - RNA, 32 nt, Human
ccaagaacugggagguggacguggcggcccag

SEQ ID NO: 361489 - RNA, 22 nt, Human
ccaagaagaaagcaccaagaca

SEQ ID NO: 361490 - RNA, 32 nt, Human
ccaagaagaaagugugagaaguugaugggcag

SEQ ID NO: 361491 - RNA, 25 nt, Human
ccaagaagagaggccucaccagaca

SEQ ID NO: 361492 - RNA, 32 nt, Human
ccaagaagagcagcaaagcugaaguagcagca

SEQ ID NO: 361493 - RNA, 32 nt, Human
ccaagaagaugaugagacagaggcagagccau

SEQ ID NO: 361494 - RNA, 18 nt, Human
ccaagaagcagaaucuca

SEQ ID NO: 361495 - RNA, 18 nt, Human
ccaagaagcccucugcag

SEQ ID NO: 361496 - RNA, 22 nt, Human
ccaagaagcugggauuacaggc

SEQ ID NO: 361497 - RNA, 32 nt, Human
ccaagaaggaagcaguagcugagcaccugccc

SEQ ID NO: 361498 - RNA, 32 nt, Human
ccaagaaggagaaaguugaggaccgcugacag

SEQ ID NO: 361499 - RNA, 32 nt, Human
ccaagaaggaggaggaggagagaaaggcggcu

SEQ ID NO: 361500 - RNA, 32 nt, Human
ccaagaaggcaggagcuggagcuguucuugcc

SEQ ID NO: 361501 - RNA, 32 nt, Human
ccaagaagggagcacagggcaaggaggagcug

SEQ ID NO: 361502 - RNA, 32 nt, Human
ccaagaagucuguccaaccccaaaaggcucuu

SEQ ID NO: 361503 - RNA, 32 nt, Human
ccaagaagucuugggauuggauuuuaccauau

SEQ ID NO: 361504 - RNA, 23 nt, Human
ccaagaaugcugagguuacaggc

SEQ ID NO: 361505 - RNA, 22 nt, Human
ccaagaauuauaccucucccuu

SEQ ID NO: 361506 - RNA, 32 nt, Human
ccaagaauuugagcguagccugggcaacacag

SEQ ID NO: 361507 - RNA, 24 nt, Human
ccaagacaagcagaucacuugagg

SEQ ID NO: 361508 - RNA, 28 nt, Human
ccaagacaaguacuaccccucaccauca

SEQ ID NO: 361509 - RNA, 32 nt, Human
ccaagacacagcagaacagaaaguucaacugc

SEQ ID NO: 361510 - RNA, 32 nt, Human
ccaagacacuguucuucaagagaaagaccaga

SEQ ID NO: 361511 - RNA, 32 nt, Human
ccaagacagaacucccagccuguguaaucuau

SEQ ID NO: 361512 - RNA, 20 nt, Human
ccaagacagcagucuuccuu

SEQ ID NO: 361513 - RNA, 32 nt, Human
ccaagacaggaaccuugucucuguugaagagc

SEQ ID NO: 361514 - RNA, 23 nt, Human
ccaagacaggaggaucacuugag

SEQ ID NO: 361515 - RNA, 24 nt, Human
ccaagacaggaggaucacuugagg

SEQ ID NO: 361516 - RNA, 32 nt, Human
ccaagacaggcagaucacaaggucaggaguuc

SEQ ID NO: 361517 - RNA, 24 nt, Human
ccaagacagguggaucaccugagg

SEQ ID NO: 361518 - RNA, 32 nt, Human
ccaagacagguggaucaccugagguuaggggu

SEQ ID NO: 361519 - RNA, 24 nt, Human
ccaagacagguggaucacuugagg

SEQ ID NO: 361520 - RNA, 23 nt, Human
ccaagacagguggaucucuugag

SEQ ID NO: 361521 - RNA, 32 nt, Human
ccaagacaguaucagacacagccccagaaggg

SEQ ID NO: 361522 - RNA, 21 nt, Human
ccaagacaugaaaagcugcca

SEQ ID NO: 361523 - RNA, 32 nt, Human
ccaagacaugggcuuuugucucucauagcaca

SEQ ID NO: 361524 - RNA, 32 nt, Human
ccaagacauggggacuuugcagugagcaaugg

SEQ ID NO: 361525 - RNA, 24 nt, Human
ccaagaccaauagaucacuugagg

SEQ ID NO: 361526 - RNA, 32 nt, Human
ccaagaccacccuggccaacauggugaagucc

SEQ ID NO: 361527 - RNA, 32 nt, Human
ccaagaccagacucgccaacauggugaaaccg

SEQ ID NO: 361528 - RNA, 32 nt, Human
ccaagaccagccuggccaacauggugaaaccc

SEQ ID NO: 361529 - RNA, 32 nt, Human
ccaagaccagccuggccaacauggugaaaucc

SEQ ID NO: 361530 - RNA, 32 nt, Human
ccaagaccagccuggccaagauggugaaaccc

SEQ ID NO: 361531 - RNA, 32 nt, Human
ccaagaccagccuggccaauguggugaaacuc

SEQ ID NO: 361532 - RNA, 32 nt, Human
ccaagaccagccugggcaacauggcaaaacac

SEQ ID NO: 361533 - RNA, 32 nt, Human
ccaagaccaugaucacauaugcagccucaaau

SEQ ID NO: 361534 - RNA, 32 nt, Human
ccaagaccaugucccggaacucaucggucacc

SEQ ID NO: 361535 - RNA, 32 nt, Human
ccaagacccagaguccagcuuagagaauagag

SEQ ID NO: 361536 - RNA, 32 nt, Human
ccaagacccccguuggugacugaagaugacac

SEQ ID NO: 361537 - RNA, 22 nt, Human
ccaagacccuaucuccucccca

SEQ ID NO: 361538 - RNA, 22 nt, Human
ccaagacccucugugcucccca

SEQ ID NO: 361539 - RNA, 32 nt, Human
ccaagaccucaucugccugcagcgucacaccg

SEQ ID NO: 361540 - RNA, 32 nt, Human
ccaagaccucaucugccugcagugucaaaucg

SEQ ID NO: 361541 - RNA, 32 nt, Human
ccaagaccugcaggaugucugggccuggagaa

SEQ ID NO: 361542 - RNA, 21 nt, Human
ccaagaccuggaucucccuuu

SEQ ID NO: 361543 - RNA, 22 nt, Human
ccaagacgagggccucauugau

SEQ ID NO: 361544 - RNA, 32 nt, Human
ccaagacgccauugcaccccagccugggcaau

SEQ ID NO: 361545 - RNA, 30 nt, Human
ccaagacgccgaauaucaaaaucuucagcg

SEQ ID NO: 361546 - RNA, 32 nt, Human
ccaagacgggcggaucaccugaggugaggagu

SEQ ID NO: 361547 - RNA, 32 nt, Human
ccaagacggguggaucacuugaggucaggagu

SEQ ID NO: 361548 - RNA, 24 nt, Human
ccaagacuauggguaacagggcau

SEQ ID NO: 361549 - RNA, 32 nt, Human
ccaagacucaggcuggggccaagagccgaccc

SEQ ID NO: 361550 - RNA, 32 nt, Human
ccaagacucuuguugccuuucuuccaagccau

SEQ ID NO: 361551 - RNA, 18 nt, Human
ccaagacugaccaugccc

SEQ ID NO: 361552 - RNA, 32 nt, Human
ccaagacugaggaugugacugacauuccugga

SEQ ID NO: 361553 - RNA, 32 nt, Human
ccaagacugcaucuagaaucgcucaaacaccu

SEQ ID NO: 361554 - RNA, 23 nt, Human
ccaagacuuauacccaggaugau

SEQ ID NO: 361555 - RNA, 22 nt, Human
ccaagacuucauugucccucuu

SEQ ID NO: 361556 - RNA, 32 nt, Human
ccaagacuuccauagaccaucuggaccaguag

SEQ ID NO: 361557 - RNA, 32 nt, Human
ccaagagaaacaagguuggauaagcgcuuccu

SEQ ID NO: 361558 - RNA, 32 nt, Human
ccaagagaacaaccaucuucacacaacaaccu

SEQ ID NO: 361559 - RNA, 32 nt, Human
ccaagagaauacaggugggcuccccagggugc

SEQ ID NO: 361560 - RNA, 32 nt, Human
ccaagagacccaaggcuccagauggaacacug

SEQ ID NO: 361561 - RNA, 32 nt, Human
ccaagagaccccuguccugucccuucaccagu

SEQ ID NO: 361562 - RNA, 32 nt, Human
ccaagagagcacgcauccuaaugagaacggag

SEQ ID NO: 361563 - RNA, 32 nt, Human
ccaagagaggaagcagagggaggcggaagcgu

SEQ ID NO: 361564 - RNA, 32 nt, Human
ccaagagaggagcagacaaggagaagguggug

SEQ ID NO: 361565 - RNA, 32 nt, Human
ccaagagagguuagggaauuugcucaaggucg

SEQ ID NO: 361566 - RNA, 32 nt, Human
ccaagagaguauuaugagggaggccgaggacu

SEQ ID NO: 361567 - RNA, 32 nt, Human
ccaagagauaacacauuccacgcacagugaug

SEQ ID NO: 361568 - RNA, 32 nt, Human
ccaagagauccaucaagacaaugggaauggcc

SEQ ID NO: 361569 - RNA, 32 nt, Human
ccaagagaugaaggaaaggagugaaagggaag

SEQ ID NO: 361570 - RNA, 19 nt, Human
ccaagagaugacacuggag

SEQ ID NO: 361571 - RNA, 32 nt, Human
ccaagagaugugagccaguuuucccagccugu

SEQ ID NO: 361572 - RNA, 32 nt, Human
ccaagagcaaacaaaccccaaagcuagcagaa

SEQ ID NO: 361573 - RNA, 32 nt, Human
ccaagagcaccaggcugugcuuggguccuugc

SEQ ID NO: 361574 - RNA, 32 nt, Human
ccaagagcacuuauugacccuuccucaggccu

SEQ ID NO: 361575 - RNA, 19 nt, Human
ccaagagcagacagaggag

SEQ ID NO: 361576 - RNA, 32 nt, Human
ccaagagcagcacaugcaaucaacuggaauaa

SEQ ID NO: 361577 - RNA, 32 nt, Human
ccaagagcaggaagagguugcuggagcaagag

SEQ ID NO: 361578 - RNA, 32 nt, Human
ccaagagcauuuguagucuggugacaaccccc

SEQ ID NO: 361579 - RNA, 32 nt, Human
ccaagagccacagggcggccucuccccaacca

SEQ ID NO: 361580 - RNA, 23 nt, Human
ccaagagccaggagcccagggcu

SEQ ID NO: 361581 - RNA, 23 nt, Human
ccaagagccccagccacacugug

SEQ ID NO: 361582 - RNA, 32 nt, Human
ccaagagccccauagacacagcagguucacuc

SEQ ID NO: 361583 - RNA, 32 nt, Human
ccaagagcccucuugcagaaagcugcccggcu

SEQ ID NO: 361584 - RNA, 32 nt, Human
ccaagagccugcguaucguggaaagggagagu

SEQ ID NO: 361585 - RNA, 21 nt, Human
ccaagagcucgaaggggccau

SEQ ID NO: 361586 - RNA, 32 nt, Human
ccaagaggacccggaaguaaucacauaggaaa

SEQ ID NO: 361587 - RNA, 23 nt, Human
ccaagaggaggcggcugcggguc

SEQ ID NO: 361588 - RNA, 32 nt, Human
ccaagaggauucauccugggagagggggcaag

SEQ ID NO: 361589 - RNA, 32 nt, Human
ccaagaggcagaagagcagagcagucgggggc

SEQ ID NO: 361590 - RNA, 24 nt, Human
ccaagaggcagaggaugcaaugag

SEQ ID NO: 361591 - RNA, 24 nt, Human
ccaagaggcagaggucgcagugag

SEQ ID NO: 361592 - RNA, 20 nt, Human
ccaagaggcagagguugcag

SEQ ID NO: 361593 - RNA, 24 nt, Human
ccaagaggcagagguuguaaugag

SEQ ID NO: 361594 - RNA, 24 nt, Human
ccaagaggcagaguuugcagugag

SEQ ID NO: 361595 - RNA, 24 nt, Human
ccaagaggcggagacugcagugag

SEQ ID NO: 361596 - RNA, 24 nt, Human
ccaagaggcggagguuguggugag

SEQ ID NO: 361597 - RNA, 32 nt, Human
ccaagaggcugacagagaggaagcagugcauu

SEQ ID NO: 361598 - RNA, 32 nt, Human
ccaagaggcugcagccaggccacuggccccug

SEQ ID NO: 361599 - RNA, 32 nt, Human
ccaagagggaaagccagaguucccuguucuag

SEQ ID NO: 361600 - RNA, 24 nt, Human
ccaagagguagagguugcagugag

SEQ ID NO: 361601 - RNA, 25 nt, Human
ccaagagguccaaggcugcagugag

SEQ ID NO: 361602 - RNA, 24 nt, Human
ccaagaggucgaggcugcagugag

SEQ ID NO: 361603 - RNA, 23 nt, Human
ccaagaggucuuucacugauaca

SEQ ID NO: 361604 - RNA, 32 nt, Human
ccaagaggugagugauugauguaucuuaaauc

SEQ ID NO: 361605 - RNA, 32 nt, Human
ccaagaggugccucauuagaacagaagacucu

SEQ ID NO: 361606 - RNA, 24 nt, Human
ccaagagguggagguuacagugag

SEQ ID NO: 361607 - RNA, 24 nt, Human
ccaagagguggagguugcggugag

SEQ ID NO: 361608 - RNA, 32 nt, Human
ccaagagguggauagcuggagcugucagucaa

SEQ ID NO: 361609 - RNA, 24 nt, Human
ccaagagguugaggcugcagugag

SEQ ID NO: 361610 - RNA, 32 nt, Human
ccaagaguaccaggacucaguguuucauauga

SEQ ID NO: 361611 - RNA, 32 nt, Human
ccaagaguccacccuucccagcucagcucagu

SEQ ID NO: 361612 - RNA, 32 nt, Human
ccaagaguggcagccuuuagggaaaauggagc

SEQ ID NO: 361613 - RNA, 32 nt, Human
ccaagaguucuuuaggugccuccugucuuaug

SEQ ID NO: 361614 - RNA, 32 nt, Human
ccaagaguugaaaugcuggcuucagaaucaua

SEQ ID NO: 361615 - RNA, 32 nt, Human
ccaagaguuugagaccagccuaggugacaaag

SEQ ID NO: 361616 - RNA, 24 nt, Human
ccaagaguuugagccugcggugag

SEQ ID NO: 361617 - RNA, 32 nt, Human
ccaagauaaccagccaugccaguaagccggcc

SEQ ID NO: 361618 - RNA, 32 nt, Human
ccaagauacgcugaagugugggaaaugcagau

SEQ ID NO: 361619 - RNA, 32 nt, Human
ccaagauauaaagcaagucauuuggaaccugc

SEQ ID NO: 361620 - RNA, 32 nt, Human
ccaagauauagagaggagaggagugaagaaaa

SEQ ID NO: 361621 - RNA, 22 nt, Human
ccaagauauccuuccugaggca

SEQ ID NO: 361622 - RNA, 32 nt, Human
ccaagaucacauaccagagucuggagcugagc

SEQ ID NO: 361623 - RNA, 32 nt, Human
ccaagaucaccccauacuccagccucuuuccu

SEQ ID NO: 361624 - RNA, 32 nt, Human
ccaagaucagccuggccaacaugucgaagugc

SEQ ID NO: 361625 - RNA, 32 nt, Human
ccaagauccagccugggcgacagagccagacu

SEQ ID NO: 361626 - RNA, 32 nt, Human
ccaagaucgcccacugcacuccagguugggcu

SEQ ID NO: 361627 - RNA, 32 nt, Human
ccaagaucuaacugucaaaugcuuuaggggaa

SEQ ID NO: 361628 - RNA, 32 nt, Human
ccaagaucuaccugcggggcaaauggucuggc

SEQ ID NO: 361629 - RNA, 32 nt, Human
ccaagaucuuuuugccccaucuccuagagaaa

SEQ ID NO: 361630 - RNA, 32 nt, Human
ccaagaugacccucacccaggucuccaccugg

SEQ ID NO: 361631 - RNA, 32 nt, Human
ccaagaugagcagaaggaagagagcagggaag

SEQ ID NO: 361632 - RNA, 32 nt, Human
ccaagaugagccccaguguucuugccuccuac

SEQ ID NO: 361633 - RNA, 30 nt, Human
ccaagaugagugccuugggagcugucauug

SEQ ID NO: 361634 - RNA, 32 nt, Human
ccaagaugaugaagccccaucuguacuaaaaa

SEQ ID NO: 361635 - RNA, 32 nt, Human
ccaagaugcaccacugcaccccagccugggcg

SEQ ID NO: 361636 - RNA, 32 nt, Human
ccaagaugcacugcaccccagccugggcgaca

SEQ ID NO: 361637 - RNA, 32 nt, Human
ccaagauggaguuuugcucugucacccaggcu

SEQ ID NO: 361638 - RNA, 31 nt, Human
ccaagauggcacuucuuuuuauuucuugucc

SEQ ID NO: 361639 - RNA, 29 nt, Human
ccaagauggcugcuguauccccaagaauc

SEQ ID NO: 361640 - RNA, 32 nt, Human
ccaagauggcuggaucaccugaggucaggcgu

SEQ ID NO: 361641 - RNA, 23 nt, Human
ccaagaugggcaaaucacuugag

SEQ ID NO: 361642 - RNA, 23 nt, Human
ccaagaugggcagaucgccugag

SEQ ID NO: 361643 - RNA, 32 nt, Human
ccaagaugggcggaucaccugaggucaggagu

SEQ ID NO: 361644 - RNA, 24 nt, Human
ccaagaugggcggauugcuugagg

SEQ ID NO: 361645 - RNA, 32 nt, Human
ccaagaugggcggauugcuugaggucaggagu

SEQ ID NO: 361646 - RNA, 24 nt, Human
ccaagauggguggaucaccugagg

SEQ ID NO: 361647 - RNA, 32 nt, Human
ccaagauggguggaucaccugaggucaggagu

SEQ ID NO: 361648 - RNA, 24 nt, Human
ccaagauggguggauuaccugagg

SEQ ID NO: 361649 - RNA, 20 nt, Human
ccaagauggugaaaccccgu

SEQ ID NO: 361650 - RNA, 20 nt, Human
ccaagauggugaaacccugu

SEQ ID NO: 361651 - RNA, 20 nt, Human
ccaagauggugaaaucccgu

SEQ ID NO: 361652 - RNA, 32 nt, Human
ccaagauguccccagaggggauauuguaucuc

SEQ ID NO: 361653 - RNA, 32 nt, Human
ccaagauguucuggacaacauccagcuacuuc

SEQ ID NO: 361654 - RNA, 32 nt, Human
ccaagauucucccauuauccccuguugucucc

SEQ ID NO: 361655 - RNA, 32 nt, Human
ccaagauucucccauuuaaaaugccacagacc

SEQ ID NO: 361656 - RNA, 32 nt, Human
ccaagauugcacacugcacuccagccugggug

SEQ ID NO: 361657 - RNA, 32 nt, Human
ccaagauugcacccugcacucuagccugggca

SEQ ID NO: 361658 - RNA, 21 nt, Human
ccaagauugcacuacugcacu

SEQ ID NO: 361659 - RNA, 32 nt, Human
ccaagauugcacuugugagaaggccugacagg

SEQ ID NO: 361660 - RNA, 21 nt, Human
ccaagauugcgccacugcacu

SEQ ID NO: 361661 - RNA, 23 nt, Human
ccaagauuggaaagccagcuuca

SEQ ID NO: 361662 - RNA, 32 nt, Human
ccaagauuucccaggcucaauacaguguaauu

SEQ ID NO: 361663 - RNA, 32 nt, Human
ccaagauuucugagagcuaaacacaggacuug

SEQ ID NO: 361664 - RNA, 32 nt, Human
ccaagcaaagagaagucucaguggagcaugag

SEQ ID NO: 361665 - RNA, 32 nt, Human
ccaagcaaagcuuccuguuuggaacacagaac

SEQ ID NO: 361666 - RNA, 32 nt, Human
ccaagcaaaggccagauagccugacagauagg

SEQ ID NO: 361667 - RNA, 32 nt, Human
ccaagcaagauggcggaggagccgcagucugu

SEQ ID NO: 361668 - RNA, 32 nt, Human
ccaagcaagcuugauggacaauggagugggau

SEQ ID NO: 361669 - RNA, 32 nt, Human
ccaagcaaggggaauggagcacuuuaagggcg

SEQ ID NO: 361670 - RNA, 32 nt, Human
ccaagcaaucccaaccuggugcuaggucauuu

SEQ ID NO: 361671 - RNA, 32 nt, Human
ccaagcaauccucccaccucagccucuggugu

SEQ ID NO: 361672 - RNA, 32 nt, Human
ccaagcacagccucugcuccuccuggagccgg

SEQ ID NO: 361673 - RNA, 23 nt, Human
ccaagcacagggccagcuguggg

SEQ ID NO: 361674 - RNA, 18 nt, Human
ccaagcacauacuuggua

SEQ ID NO: 361675 - RNA, 22 nt, Human
ccaagcacccccggccuggggg

SEQ ID NO: 361676 - RNA, 17 nt, Human
ccaagcaccucacacca

SEQ ID NO: 361677 - RNA, 17 nt, Human
ccaagcaccuccaacca

SEQ ID NO: 361678 - RNA, 32 nt, Human
ccaagcacuccugcgcugaaucgggccauugu

SEQ ID NO: 361679 - RNA, 32 nt, Human
ccaagcacugccucccuccugcucuguccagg

SEQ ID NO: 361680 - RNA, 32 nt, Human
ccaagcacuguacagaauacuuugugguuccu

SEQ ID NO: 361681 - RNA, 21 nt, Human
ccaagcacuuccugccgcggg

SEQ ID NO: 361682 - RNA, 32 nt, Human
ccaagcagacacaccugcccuccccagccagc

SEQ ID NO: 361683 - RNA, 25 nt, Human
ccaagcagacuccagccccuggacc

SEQ ID NO: 361684 - RNA, 32 nt, Human
ccaagcagaggugagaaggagaguggggcaca

SEQ ID NO: 361685 - RNA, 32 nt, Human
ccaagcagagguggagaaggggacacugaggu

SEQ ID NO: 361686 - RNA, 32 nt, Human
ccaagcagcagaaugagccaggaguagcagga

SEQ ID NO: 361687 - RNA, 32 nt, Human
ccaagcagcagcaacagcagccccaccgcccc

SEQ ID NO: 361688 - RNA, 19 nt, Human
ccaagcagcaguggcgguu

SEQ ID NO: 361689 - RNA, 31 nt, Human
ccaagcagcauucagcacaccccaagggaca

SEQ ID NO: 361690 - RNA, 23 nt, Human
ccaagcagcugagauuacaggug

SEQ ID NO: 361691 - RNA, 23 nt, Human
ccaagcagcugggauuacaggug

SEQ ID NO: 361692 - RNA, 17 nt, Human
ccaagcaggacauguug

SEQ ID NO: 361693 - RNA, 32 nt, Human
ccaagcagggauguggacauuuggauggugac

SEQ ID NO: 361694 - RNA, 32 nt, Human
ccaagcaggggagaggaaugaggggagcagcu

SEQ ID NO: 361695 - RNA, 22 nt, Human
ccaagcaggguucccccuuccc

SEQ ID NO: 361696 - RNA, 17 nt, Human
ccaagcagucccaugug

SEQ ID NO: 361697 - RNA, 32 nt, Human
ccaagcagugccugaggggccacccuaggacu

SEQ ID NO: 361698 - RNA, 32 nt, Human
ccaagcaguucuggggucccaaccugggugga

SEQ ID NO: 361699 - RNA, 24 nt, Human
ccaagcaguugggacuacaggcgu

SEQ ID NO: 361700 - RNA, 32 nt, Human
ccaagcauaaugacagagagaggcagauuuca

SEQ ID NO: 361701 - RNA, 32 nt, Human
ccaagcaucaaagccuuuggccuuucuccucc

SEQ ID NO: 361702 - RNA, 19 nt, Human
ccaagcaucacaccugcca

SEQ ID NO: 361703 - RNA, 32 nt, Human
ccaagcaucacaccugcgaugccugcacgagc

SEQ ID NO: 361704 - RNA, 32 nt, Human
ccaagcaugccacccguuaccggccagaaccu

SEQ ID NO: 361705 - RNA, 32 nt, Human
ccaagcaugguggcucacgccuguaaucccag

SEQ ID NO: 361706 - RNA, 32 nt, Human
ccaagcaugguggcucauguuuguaauccuag

SEQ ID NO: 361707 - RNA, 32 nt, Human
ccaagccaacagcaaagggaaaauuugggcca

SEQ ID NO: 361708 - RNA, 25 nt, Human
ccaagccaaggcaugucccugggcc

SEQ ID NO: 361709 - RNA, 32 nt, Human
ccaagccaauaaagggcugugaugaguggcug

SEQ ID NO: 361710 - RNA, 18 nt, Human
ccaagccacccugaagaa

SEQ ID NO: 361711 - RNA, 32 nt, Human
ccaagccaccuugcccgcagcccaggcuccug

SEQ ID NO: 361712 - RNA, 27 nt, Human
ccaagccacugcacuucggaggggcug

SEQ ID NO: 361713 - RNA, 32 nt, Human
ccaagccagagaaccgaagacccggccggccc

SEQ ID NO: 361714 - RNA, 22 nt, Human
ccaagccagagugcaguggugu

SEQ ID NO: 361715 - RNA, 32 nt, Human
ccaagccagcagaaacagccucagccuaccgc

SEQ ID NO: 361716 - RNA, 22 nt, Human
ccaagccagcgggaauggcagc

SEQ ID NO: 361717 - RNA, 32 nt, Human
ccaagccagggagggacgaggggcuggcucuc

SEQ ID NO: 361718 - RNA, 32 nt, Human
ccaagccauccccaccacccagccaugaugau

SEQ ID NO: 361719 - RNA, 32 nt, Human
ccaagccaugaccuacagccagcacucaaggg

SEQ ID NO: 361720 - RNA, 22 nt, Human
ccaagcccaccagcuuucagcg

SEQ ID NO: 361721 - RNA, 22 nt, Human
ccaagcccacccaccagccacu

SEQ ID NO: 361722 - RNA, 32 nt, Human
ccaagcccaccccuccucccaccaucaccucc

SEQ ID NO: 361723 - RNA, 32 nt, Human
ccaagcccagaggucacauaaagcuuuggacc

SEQ ID NO: 361724 - RNA, 32 nt, Human
ccaagcccagauggcagcaucuccccaucccg

SEQ ID NO: 361725 - RNA, 19 nt, Human
ccaagcccagcccugugcc

SEQ ID NO: 361726 - RNA, 22 nt, Human
ccaagcccagccuccccuugug

SEQ ID NO: 361727 - RNA, 23 nt, Human
ccaagcccagcgcaacaaaggaa

SEQ ID NO: 361728 - RNA, 18 nt, Human
ccaagcccagcuccccua

SEQ ID NO: 361729 - RNA, 32 nt, Human
ccaagcccaggaagucaagaaugcacugagcu

SEQ ID NO: 361730 - RNA, 32 nt, Human
ccaagcccaggaguuugaggcugcagugaguu

SEQ ID NO: 361731 - RNA, 32 nt, Human
ccaagcccagggagucugaaugugaguccaag

SEQ ID NO: 361732 - RNA, 21 nt, Human
ccaagcccauaucuguacacu

SEQ ID NO: 361733 - RNA, 19 nt, Human
ccaagcccaugugucccau

SEQ ID NO: 361734 - RNA, 32 nt, Human
ccaagcccauuguuucugucaugguuuccauc

SEQ ID NO: 361735 - RNA, 20 nt, Human
ccaagccccacccuggcccc

SEQ ID NO: 361736 - RNA, 32 nt, Human
ccaagccccacugaugauggcugagagggaag

SEQ ID NO: 361737 - RNA, 32 nt, Human
ccaagccccagccucagccugcgccugagcug

SEQ ID NO: 361738 - RNA, 32 nt, Human
ccaagccccaggaagaaaaugaugcagcucug

SEQ ID NO: 361739 - RNA, 32 nt, Human
ccaagccccaggagaugggcacugagaaagug

SEQ ID NO: 361740 - RNA, 23 nt, Human
ccaagccccaggagcugugccac

SEQ ID NO: 361741 - RNA, 17 nt, Human
ccaagcccccuccccug

SEQ ID NO: 361742 - RNA, 18 nt, Human
ccaagccccugcccaugu

SEQ ID NO: 361743 - RNA, 32 nt, Human
ccaagccccugccuccagccuuccugaguuuc

SEQ ID NO: 361744 - RNA, 32 nt, Human
ccaagccccuggcaaccacuaaucuacuuucu

SEQ ID NO: 361745 - RNA, 18 nt, Human
ccaagccccuuccuccau

SEQ ID NO: 361746 - RNA, 24 nt, Human
ccaagcccucacccagcccaugug

SEQ ID NO: 361747 - RNA, 18 nt, Human
ccaagcccugcaucccca

SEQ ID NO: 361748 - RNA, 32 nt, Human
ccaagcccugcauccccacaugcggggcagag

SEQ ID NO: 361749 - RNA, 17 nt, Human
ccaagcccuggacccau

SEQ ID NO: 361750 - RNA, 25 nt, Human
ccaagcccuggcccgucugugcacu

SEQ ID NO: 361751 - RNA, 20 nt, Human
ccaagcccugucuuaaggcc

SEQ ID NO: 361752 - RNA, 32 nt, Human
ccaagcccuuccgggcuggaacuggugucgga

SEQ ID NO: 361753 - RNA, 21 nt, Human
ccaagccgagggcaacuuugg

SEQ ID NO: 361754 - RNA, 22 nt, Human
ccaagccggagacccgcagcgc

SEQ ID NO: 361755 - RNA, 32 nt, Human
ccaagccuagagccaccagcccagcuuccuuc

SEQ ID NO: 361756 - RNA, 32 nt, Human
ccaagccuagcucaucuugcuguuguuguuag

SEQ ID NO: 361757 - RNA, 32 nt, Human
ccaagccucaguuucccuaucuguaaaaugga

SEQ ID NO: 361758 - RNA, 32 nt, Human
ccaagccuccaccacagcuuccugguuaacuu

SEQ ID NO: 361759 - RNA, 22 nt, Human
ccaagccuccccuccaccacug

SEQ ID NO: 361760 - RNA, 30 nt, Human
ccaagccuccucuccagguuccugcccugc

SEQ ID NO: 361761 - RNA, 32 nt, Human
ccaagccuccuggaugggggugggaggcccug

SEQ ID NO: 361762 - RNA, 21 nt, Human
ccaagccucucucucuggacc

SEQ ID NO: 361763 - RNA, 32 nt, Human
ccaagccucuggacugggggcucucuucagug

SEQ ID NO: 361764 - RNA, 32 nt, Human
ccaagccucugugcaccugcagucucuuucca

SEQ ID NO: 361765 - RNA, 32 nt, Human
ccaagccugcccaagcagucuacugauccagc

SEQ ID NO: 361766 - RNA, 32 nt, Human
ccaagccugccugccaggccucugcgccuggc

SEQ ID NO: 361767 - RNA, 32 nt, Human
ccaagccugccuggacggcuguucugugacuu

SEQ ID NO: 361768 - RNA, 32 nt, Human
ccaagccugcugucuugugaucacuuagcgaa

SEQ ID NO: 361769 - RNA, 32 nt, Human
ccaagccugcugugcuccuguggcagugaugg

SEQ ID NO: 361770 - RNA, 32 nt, Human
ccaagccuggcuaauuaaaaacaaauguuuaa

SEQ ID NO: 361771 - RNA, 32 nt, Human
ccaagccuggcucgagcacaggaagcucaucu

SEQ ID NO: 361772 - RNA, 32 nt, Human
ccaagccuggguaacaugcacaccucucaaac

SEQ ID NO: 361773 - RNA, 32 nt, Human
ccaagccugggucugugucucuggugugugug

SEQ ID NO: 361774 - RNA, 32 nt, Human
ccaagccuggguggcagaugaacagugcuucc

SEQ ID NO: 361775 - RNA, 32 nt, Human
ccaagccuguagucccagcuacucgggaggcu

SEQ ID NO: 361776 - RNA, 32 nt, Human
ccaagccuucccaguuaucauaaccuugaaug

SEQ ID NO: 361777 - RNA, 32 nt, Human
ccaagccuucuccaccuccucuucucuccucc

SEQ ID NO: 361778 - RNA, 32 nt, Human
ccaagccuugguggacaccacaccugcagcuc

SEQ ID NO: 361779 - RNA, 32 nt, Human
ccaagccuuuccagauggacuucugcagccca

SEQ ID NO: 361780 - RNA, 32 nt, Human
ccaagcgaacagcaaccuccugcuacccuccc

SEQ ID NO: 361781 - RNA, 32 nt, Human
ccaagcgacagagugaccagaaacccuuuuac

SEQ ID NO: 361782 - RNA, 21 nt, Human
ccaagcgaggacaacaggaag

SEQ ID NO: 361783 - RNA, 32 nt, Human
ccaagcgccccagcaggcacugugcugggcuu

SEQ ID NO: 361784 - RNA, 19 nt, Human
ccaagcgccgggcugcaga

SEQ ID NO: 361785 - RNA, 25 nt, Human
ccaagcgccuggaggacgggacaga

SEQ ID NO: 361786 - RNA, 23 nt, Human
ccaagcgcugagauuacaggugu

SEQ ID NO: 361787 - RNA, 32 nt, Human
ccaagcggaggaggagaaaaaggaauaagaag

SEQ ID NO: 361788 - RNA, 21 nt, Human
ccaagcgggggccacuugaga

SEQ ID NO: 361789 - RNA, 32 nt, Human
ccaagcggugucucucauccugacuggggauc

SEQ ID NO: 361790 - RNA, 32 nt, Human
ccaagcgugguggcucacgccuguaaucccag

SEQ ID NO: 361791 - RNA, 20 nt, Human
ccaagcguguggagcugggg

SEQ ID NO: 361792 - RNA, 32 nt, Human
ccaagcuacccucugaagaaauacucacugca

SEQ ID NO: 361793 - RNA, 32 nt, Human
ccaagcuaggagaggggagaagccgggggcug

SEQ ID NO: 361794 - RNA, 32 nt, Human
ccaagcucaaagauacugucuccugugugguc

SEQ ID NO: 361795 - RNA, 32 nt, Human
ccaagcucaaagcuggagugcaauggcgcaau

SEQ ID NO: 361796 - RNA, 32 nt, Human
ccaagcucaagcaauccuccugccucugccuc

SEQ ID NO: 361797 - RNA, 32 nt, Human
ccaagcucacacagcaggaacugagccagaaa

SEQ ID NO: 361798 - RNA, 23 nt, Human
ccaagcucaccagcccugcgcca

SEQ ID NO: 361799 - RNA, 32 nt, Human
ccaagcucaguuaaaucccccaccuccaacuu

SEQ ID NO: 361800 - RNA, 18 nt, Human
ccaagcucccaagaggcu

SEQ ID NO: 361801 - RNA, 32 nt, Human
ccaagcucccuccuaauuccccguuguugcag

SEQ ID NO: 361802 - RNA, 23 nt, Human
ccaagcucccugucacccagcca

SEQ ID NO: 361803 - RNA, 32 nt, Human
ccaagcuccgcaccccagaggaguguucugga

SEQ ID NO: 361804 - RNA, 32 nt, Human
ccaagcuccgggaggcugcaguggcggcagcu

SEQ ID NO: 361805 - RNA, 32 nt, Human
ccaagcucuaccccauccccaucccagaccug

SEQ ID NO: 361806 - RNA, 32 nt, Human
ccaagcucugagcucugcucccagggagcacg

SEQ ID NO: 361807 - RNA, 32 nt, Human
ccaagcucugcggcacccaaggguucccaggg

SEQ ID NO: 361808 - RNA, 21 nt, Human
ccaagcucugcucccuggauc

SEQ ID NO: 361809 - RNA, 32 nt, Human
ccaagcucugcuccucuccccagcaagugaga

SEQ ID NO: 361810 - RNA, 32 nt, Human
ccaagcucugcucuccuccucugugagcucug

SEQ ID NO: 361811 - RNA, 32 nt, Human
ccaagcucuucauugcugaccaugaagagacc

SEQ ID NO: 361812 - RNA, 32 nt, Human
ccaagcucuuggaagggguaacagugaaccgc

SEQ ID NO: 361813 - RNA, 32 nt, Human
ccaagcugaacaaccucuaccugcggcugcag

SEQ ID NO: 361814 - RNA, 18 nt, Human
ccaagcugaagcugcagg

SEQ ID NO: 361815 - RNA, 18 nt, Human
ccaagcugagccuggcca

SEQ ID NO: 361816 - RNA, 32 nt, Human
ccaagcugagccuggccaagcuagguggacag

SEQ ID NO: 361817 - RNA, 23 nt, Human
ccaagcugaugcauuccuacaga

SEQ ID NO: 361818 - RNA, 32 nt, Human
ccaagcugccaagccccugccuccagccuucc

SEQ ID NO: 361819 - RNA, 22 nt, Human
ccaagcugccccuuucccuccu

SEQ ID NO: 361820 - RNA, 32 nt, Human
ccaagcugcucuuuuaaaagucacuaaugacu

SEQ ID NO: 361821 - RNA, 32 nt, Human
ccaagcuggaccgcaaccacagcuuccgccac

SEQ ID NO: 361822 - RNA, 32 nt, Human
ccaagcuggaguacaaugacaggaucucggcu

SEQ ID NO: 361823 - RNA, 19 nt, Human
ccaagcuggagugcagugg

SEQ ID NO: 361824 - RNA, 32 nt, Human
ccaagcuggaucugaaauauguuccucccagg

SEQ ID NO: 361825 - RNA, 21 nt, Human
ccaagcuggccagcgccgacc

SEQ ID NO: 361826 - RNA, 22 nt, Human
ccaagcuggcccagccuggagc

SEQ ID NO: 361827 - RNA, 32 nt, Human
ccaagcuggccgagguugcaguccaugagcug

SEQ ID NO: 361828 - RNA, 21 nt, Human
ccaagcuggccggcccuagcc

SEQ ID NO: 361829 - RNA, 21 nt, Human
ccaagcuggccuuccugaacc

SEQ ID NO: 361830 - RNA, 18 nt, Human
ccaagcuggcuuuuccca

SEQ ID NO: 361831 - RNA, 22 nt, Human
ccaagcugggagcuccugggcc

SEQ ID NO: 361832 - RNA, 32 nt, Human
ccaagcugggcagcccuguccucuccacaaga

SEQ ID NO: 361833 - RNA, 32 nt, Human
ccaagcugguggcucugugugcucugauccga

SEQ ID NO: 361834 - RNA, 32 nt, Human
ccaagcugucuucagccuuccccagcuaaaga

SEQ ID NO: 361835 - RNA, 21 nt, Human
ccaagcugugcguucuggacc

SEQ ID NO: 361836 - RNA, 32 nt, Human
ccaagcuuaaggagaggagagcaucugcucug

SEQ ID NO: 361837 - RNA, 32 nt, Human
ccaagcuuagagcaagcugcccugccaaagga

SEQ ID NO: 361838 - RNA, 24 nt, Human
ccaagcuucauggagccgcggcgc

SEQ ID NO: 361839 - RNA, 23 nt, Human
ccaagcuucaugguuccuggacc

SEQ ID NO: 361840 - RNA, 32 nt, Human
ccaagcuuccaucaagucagggaguggagcaa

SEQ ID NO: 361841 - RNA, 32 nt, Human
ccaagcuugcaccacauucagcauuaaucacu

SEQ ID NO: 361842 - RNA, 19 nt, Human
ccaagcuugcuccgcgcca

SEQ ID NO: 361843 - RNA, 29 nt, Human
ccaagcuuggcugucucauccccaaggac

SEQ ID NO: 361844 - RNA, 32 nt, Human
ccaagcuuguuggcucaugccuauagucccag

SEQ ID NO: 361845 - RNA, 32 nt, Human
ccaaggaaaggaaggaaggaaggaaaaggagg

SEQ ID NO: 361846 - RNA, 32 nt, Human
ccaaggaaaggcuuuugucucuggccuuuuaa

SEQ ID NO: 361847 - RNA, 32 nt, Human
ccaaggaaccugacaaccauguguacaccagg

SEQ ID NO: 361848 - RNA, 32 nt, Human
ccaaggaaccuggagaccaucaucucauuucc

SEQ ID NO: 361849 - RNA, 32 nt, Human
ccaaggaacucuacuucagucaauaccauauc

SEQ ID NO: 361850 - RNA, 32 nt, Human
ccaaggaacugcugcccucccuuccuucuacu

SEQ ID NO: 361851 - RNA, 32 nt, Human
ccaaggaacugguuauguauguguguacaguu

SEQ ID NO: 361852 - RNA, 32 nt, Human
ccaaggaagaagggcggaaccagaaguagggc

SEQ ID NO: 361853 - RNA, 32 nt, Human
ccaaggaagaauuuccucugaagcaccggaac

SEQ ID NO: 361854 - RNA, 32 nt, Human
ccaaggaagacuuccuggaggaaauggccauu

SEQ ID NO: 361855 - RNA, 25 nt, Human
ccaaggaaggcagcggcagcuccac

SEQ ID NO: 361856 - RNA, 32 nt, Human
ccaaggaaggggccugguggugcuccacuugc

SEQ ID NO: 361857 - RNA, 32 nt, Human
ccaaggaauugccuccagccugaguccuaggc

SEQ ID NO: 361858 - RNA, 32 nt, Human
ccaaggacaaauggcagccacuguugaguacu

SEQ ID NO: 361859 - RNA, 32 nt, Human
ccaaggacaggagagacauggaguggcgcugg

SEQ ID NO: 361860 - RNA, 19 nt, Human
ccaaggacagggcuggcuc

SEQ ID NO: 361861 - RNA, 24 nt, Human
ccaaggacaguggaucaccugagg

SEQ ID NO: 361862 - RNA, 32 nt, Human
ccaaggacaguggaucaccugaggucaggggu

SEQ ID NO: 361863 - RNA, 32 nt, Human
ccaaggacauccugcagggcucuguagaugga

SEQ ID NO: 361864 - RNA, 32 nt, Human
ccaaggaccaaagaagguguguaagugaagug

SEQ ID NO: 361865 - RNA, 32 nt, Human
ccaaggaccaaaggaggggguggcaggggccu

SEQ ID NO: 361866 - RNA, 21 nt, Human
ccaaggaccaaauccuggagu

SEQ ID NO: 361867 - RNA, 32 nt, Human
ccaaggaccagcuggguccccuuugcuuucuu

SEQ ID NO: 361868 - RNA, 32 nt, Human
ccaaggacccagagagaaaggugagagugcag

SEQ ID NO: 361869 - RNA, 32 nt, Human
ccaaggacccuccaaggcuggcaguguggugu

SEQ ID NO: 361870 - RNA, 32 nt, Human
ccaaggaccgcagugaggaggaauguaccacu

SEQ ID NO: 361871 - RNA, 32 nt, Human
ccaaggaccguagaugccucucuagagcauga

SEQ ID NO: 361872 - RNA, 32 nt, Human
ccaaggacucaggcuaauuccuaaguugauca

SEQ ID NO: 361873 - RNA, 21 nt, Human
ccaaggacuggccugugcacu

SEQ ID NO: 361874 - RNA, 32 nt, Human
ccaaggacuugcucaaguggcagcgggcgggc

SEQ ID NO: 361875 - RNA, 22 nt, Human
ccaaggagacacccagacccuu

SEQ ID NO: 361876 - RNA, 32 nt, Human
ccaaggagaccccuccuggccugaugcccagc

SEQ ID NO: 361877 - RNA, 32 nt, Human
ccaaggagacuccgggcuugagcccaggccuc

SEQ ID NO: 361878 - RNA, 32 nt, Human
ccaaggagagccaccccugcuuucuggccauc

SEQ ID NO: 361879 - RNA, 32 nt, Human
ccaaggagaggacacagacacaguuguuugcu

SEQ ID NO: 361880 - RNA, 32 nt, Human
ccaaggagaguggaucaccugaggucgggagu

SEQ ID NO: 361881 - RNA, 32 nt, Human
ccaaggagauggaucacuugaggccaggaguu

SEQ ID NO: 361882 - RNA, 32 nt, Human
ccaaggagcagggagacaggaggcagagaaga

SEQ ID NO: 361883 - RNA, 32 nt, Human
ccaaggagcagggggcaggagauggaaaauug

SEQ ID NO: 361884 - RNA, 32 nt, Human
ccaaggagcauccuuggcagugggaauguucu

SEQ ID NO: 361885 - RNA, 32 nt, Human
ccaaggagccgggacccaggagagggcugcua

SEQ ID NO: 361886 - RNA, 32 nt, Human
ccaaggagcucaauaacuucaugauguaaauu

SEQ ID NO: 361887 - RNA, 22 nt, Human
ccaaggagcugggaugugccag

SEQ ID NO: 361888 - RNA, 22 nt, Human
ccaaggagcugggauuacaggc

SEQ ID NO: 361889 - RNA, 31 nt, Human
ccaaggaggagaccugaguugcugggaauuu

SEQ ID NO: 361890 - RNA, 32 nt, Human
ccaaggaggagggagagcggcgggaggggccg

SEQ ID NO: 361891 - RNA, 32 nt, Human
ccaaggaggagguggaggaggugcuggacucc

SEQ ID NO: 361892 - RNA, 32 nt, Human
ccaaggaggccgguauuacuguaaagcagaga

SEQ ID NO: 361893 - RNA, 32 nt, Human
ccaaggaggcugggaccucucucuucugcaau

SEQ ID NO: 361894 - RNA, 32 nt, Human
ccaaggaggcugugcacagcaggugugagaug

SEQ ID NO: 361895 - RNA, 32 nt, Human
ccaaggagggcaaaucaccugagaucaggagu

SEQ ID NO: 361896 - RNA, 32 nt, Human
ccaaggagggcagaucaccugaggucagcagu

SEQ ID NO: 361897 - RNA, 32 nt, Human
ccaaggaggggcuguaaaauggaggccauugu

SEQ ID NO: 361898 - RNA, 24 nt, Human
ccaaggaggguggaucaccugagg

SEQ ID NO: 361899 - RNA, 32 nt, Human
ccaaggaggguggaucaccugaggucaggagu

SEQ ID NO: 361900 - RNA, 24 nt, Human
ccaaggaggguggaucacuuaagg

SEQ ID NO: 361901 - RNA, 24 nt, Human
ccaaggaggguggaucacuugaga

SEQ ID NO: 361902 - RNA, 32 nt, Human
ccaaggaggguggaucacuugaggucaggagu

SEQ ID NO: 361903 - RNA, 32 nt, Human
ccaaggagguggagguugcagugagccgggau

SEQ ID NO: 361904 - RNA, 32 nt, Human
ccaaggagguggucagcuccccugggagcagu

SEQ ID NO: 361905 - RNA, 23 nt, Human
ccaaggaguccgggaggugccug

SEQ ID NO: 361906 - RNA, 32 nt, Human
ccaaggaguguggaauguccuugaguguauua

SEQ ID NO: 361907 - RNA, 32 nt, Human
ccaaggaguucuuguucucgaagaaccccagg

SEQ ID NO: 361908 - RNA, 32 nt, Human
ccaaggauauggggcaggaggcucccucugcu

SEQ ID NO: 361909 - RNA, 32 nt, Human
ccaaggaucagccuggaugccuagaggacuag

SEQ ID NO: 361910 - RNA, 32 nt, Human
ccaaggaucugaaguccauccccauaggugga

SEQ ID NO: 361911 - RNA, 32 nt, Human
ccaaggaugagcuggagcacagccugggggag

SEQ ID NO: 361912 - RNA, 32 nt, Human
ccaaggauggaugcagagggugaggcacccau

SEQ ID NO: 361913 - RNA, 32 nt, Human
ccaaggauggucuggaggacaaacaaaggagg

SEQ ID NO: 361914 - RNA, 32 nt, Human
ccaaggauguuuugaagggaagggaaguuuaa

SEQ ID NO: 361915 - RNA, 32 nt, Human
ccaaggauuuccucucagagcuguugcacaga

SEQ ID NO: 361916 - RNA, 32 nt, Human
ccaaggcaacacaguuuugccauaaagaaucc

SEQ ID NO: 361917 - RNA, 23 nt, Human
ccaaggcaagaggaucacuugag

SEQ ID NO: 361918 - RNA, 32 nt, Human
ccaaggcaagcagaucaccugaagucaggaga

SEQ ID NO: 361919 - RNA, 23 nt, Human
ccaaggcaaggggaucacuugag

SEQ ID NO: 361920 - RNA, 32 nt, Human
ccaaggcacacgugcccaugaccaucacugac

SEQ ID NO: 361921 - RNA, 32 nt, Human
ccaaggcacagcugugucgcacguuccgcccg

SEQ ID NO: 361922 - RNA, 32 nt, Human
ccaaggcacucagccuucuagugcaguagcau

SEQ ID NO: 361923 - RNA, 32 nt, Human
ccaaggcagaagcagcaggggauggcgugguc

SEQ ID NO: 361924 - RNA, 22 nt, Human
ccaaggcagaaggaucacuuga

SEQ ID NO: 361925 - RNA, 23 nt, Human
ccaaggcagaaggaucacuugag

SEQ ID NO: 361926 - RNA, 24 nt, Human
ccaaggcagaaggaucacuugaga

SEQ ID NO: 361927 - RNA, 32 nt, Human
ccaaggcagagucagagguuccacaggaggag

SEQ ID NO: 361928 - RNA, 24 nt, Human
ccaaggcagauggaacacuugagg

SEQ ID NO: 361929 - RNA, 32 nt, Human
ccaaggcagauggagaaaacuucgugaaaccc

SEQ ID NO: 361930 - RNA, 22 nt, Human
ccaaggcagauggaucaugagg

SEQ ID NO: 361931 - RNA, 32 nt, Human
ccaaggcagcaggcuggacucggugcagggac

SEQ ID NO: 361932 - RNA, 32 nt, Human
ccaaggcagccagaucaccugaggucagaagu

SEQ ID NO: 361933 - RNA, 32 nt, Human
ccaaggcagccccuuccuuccagccugggcuc

SEQ ID NO: 361934 - RNA, 32 nt, Human
ccaaggcagcgcuaaggaaggaggguagggac

SEQ ID NO: 361935 - RNA, 32 nt, Human
ccaaggcagcuuuccuuacccugacacagccc

SEQ ID NO: 361936 - RNA, 23 nt, Human
ccaaggcaggaagaucacuugag

SEQ ID NO: 361937 - RNA, 23 nt, Human
ccaaggcaggaggaucacuugag

SEQ ID NO: 361938 - RNA, 24 nt, Human
ccaaggcaggaggaucacuugagg

SEQ ID NO: 361939 - RNA, 32 nt, Human
ccaaggcaggaggaucgcuugaggucagaagu

SEQ ID NO: 361940 - RNA, 32 nt, Human
ccaaggcaggaggaucgcuugaggucaggagu

SEQ ID NO: 361941 - RNA, 32 nt, Human
ccaaggcaggcaaucacuugaggucaggaguu

SEQ ID NO: 361942 - RNA, 32 nt, Human
ccaaggcaggcacaucaccugaguucaggagu

SEQ ID NO: 361943 - RNA, 32 nt, Human
ccaaggcaggcagaucaccugaagucaggagu

SEQ ID NO: 361944 - RNA, 32 nt, Human
ccaaggcaggcagaucaccugaggccaggcug

SEQ ID NO: 361945 - RNA, 32 nt, Human
ccaaggcaggcagaucaccugaggucagagcu

SEQ ID NO: 361946 - RNA, 32 nt, Human
ccaaggcaggcagaucaccugaggucaggagu

SEQ ID NO: 361947 - RNA, 32 nt, Human
ccaaggcaggcagaucacgaggucaggagauu

SEQ ID NO: 361948 - RNA, 32 nt, Human
ccaaggcaggcagaucacgaggucaggaguuc

SEQ ID NO: 361949 - RNA, 24 nt, Human
ccaaggcaggcagaucacuuaagg

SEQ ID NO: 361950 - RNA, 24 nt, Human
ccaaggcaggcagaucacuugagg

SEQ ID NO: 361951 - RNA, 32 nt, Human
ccaaggcaggcagaucacuugaggucaggacu

SEQ ID NO: 361952 - RNA, 32 nt, Human
ccaaggcaggcagaucacuugaggucaggagu

SEQ ID NO: 361953 - RNA, 32 nt, Human
ccaaggcaggcagaucaucugaggucaugagu

SEQ ID NO: 361954 - RNA, 24 nt, Human
ccaaggcaggcagaucauuugaga

SEQ ID NO: 361955 - RNA, 24 nt, Human
ccaaggcaggcagaucauuugagg

SEQ ID NO: 361956 - RNA, 23 nt, Human
ccaaggcaggcagaucgcuugag

SEQ ID NO: 361957 - RNA, 28 nt, Human
ccaaggcaggcagguggaucaccugagg

SEQ ID NO: 361958 - RNA, 32 nt, Human
ccaaggcaggcagguggaucaccugaggucag

SEQ ID NO: 361959 - RNA, 25 nt, Human
ccaaggcaggcauaucaacuugagg

SEQ ID NO: 361960 - RNA, 23 nt, Human
ccaaggcaggcauaucacuugag

SEQ ID NO: 361961 - RNA, 32 nt, Human
ccaaggcaggcggaucaccugaggucaggaau

SEQ ID NO: 361962 - RNA, 32 nt, Human
ccaaggcaggcggaucaccugaggucaggagu

SEQ ID NO: 361963 - RNA, 32 nt, Human
ccaaggcaggcggaucaccugaggucgggagu

SEQ ID NO: 361964 - RNA, 32 nt, Human
ccaaggcaggcggaucaccugaggucuggagu

SEQ ID NO: 361965 - RNA, 32 nt, Human
ccaaggcaggcggaucaccugagguugggagu

SEQ ID NO: 361966 - RNA, 32 nt, Human
ccaaggcaggcggaucaucugaggucaggagu

SEQ ID NO: 361967 - RNA, 32 nt, Human
ccaaggcaggcugauugcuugaggucaggagu

SEQ ID NO: 361968 - RNA, 25 nt, Human
ccaaggcaggcuggaucaccugagg

SEQ ID NO: 361969 - RNA, 32 nt, Human
ccaaggcaggguggacagugugagagagcuag

SEQ ID NO: 361970 - RNA, 24 nt, Human
ccaaggcagguggaucaacugagg

SEQ ID NO: 361971 - RNA, 32 nt, Human
ccaaggcagguggaucaacugaggucaggagu

SEQ ID NO: 361972 - RNA, 18 nt, Human
ccaaggcagguggaucac

SEQ ID NO: 361973 - RNA, 23 nt, Human
ccaaggcagguggaucaccugag

SEQ ID NO: 361974 - RNA, 24 nt, Human
ccaaggcagguggaucaccugagg

SEQ ID NO: 361975 - RNA, 32 nt, Human
ccaaggcagguggaucaccugaggucaagagu

SEQ ID NO: 361976 - RNA, 32 nt, Human
ccaaggcagguggaucaccugaggucagaagu

SEQ ID NO: 361977 - RNA, 32 nt, Human
ccaaggcagguggaucaccugaggucaggagu

SEQ ID NO: 361978 - RNA, 32 nt, Human
ccaaggcagguggaucaccugagguuaggagu

SEQ ID NO: 361979 - RNA, 22 nt, Human
ccaaggcagguggaucacgagg

SEQ ID NO: 361980 - RNA, 24 nt, Human
ccaaggcagguggaucacuuaaga

SEQ ID NO: 361981 - RNA, 24 nt, Human
ccaaggcagguggaucacuugagg

SEQ ID NO: 361982 - RNA, 32 nt, Human
ccaaggcagguggaucacuugaggucaggagc

SEQ ID NO: 361983 - RNA, 22 nt, Human
ccaaggcagguggaucaugaga

SEQ ID NO: 361984 - RNA, 24 nt, Human
ccaaggcagguggaucauuugagg

SEQ ID NO: 361985 - RNA, 32 nt, Human
ccaaggcagguggaucauuugaggucaggagu

SEQ ID NO: 361986 - RNA, 23 nt, Human
ccaaggcagguggaucgcuugag

SEQ ID NO: 361987 - RNA, 24 nt, Human
ccaaggcagguggaucgcuugagg

SEQ ID NO: 361988 - RNA, 23 nt, Human
ccaaggcagguggauugcuugag

SEQ ID NO: 361989 - RNA, 24 nt, Human
ccaaggcagguggauugucugagg

SEQ ID NO: 361990 - RNA, 32 nt, Human
ccaaggcagguggauugucugaggucaggagu

SEQ ID NO: 361991 - RNA, 24 nt, Human
ccaaggcaggugggucaguugagg

SEQ ID NO: 361992 - RNA, 32 nt, Human
ccaaggcaggugggucaguugaggucaggagu

SEQ ID NO: 361993 - RNA, 23 nt, Human
ccaaggcagguggugacuugaga

SEQ ID NO: 361994 - RNA, 32 nt, Human
ccaaggcauggacccugacaccugccaacagc

SEQ ID NO: 361995 - RNA, 32 nt, Human
ccaaggccaagcagcccccugaggcagauucu

SEQ ID NO: 361996 - RNA, 32 nt, Human
ccaaggccaaguagcucgggagaacagggcaa

SEQ ID NO: 361997 - RNA, 32 nt, Human
ccaaggccaccugacuccuaucacgacgcacc

SEQ ID NO: 361998 - RNA, 32 nt, Human
ccaaggccacuucgucugaggaaggcucaacu

SEQ ID NO: 361999 - RNA, 32 nt, Human
ccaaggccagcccugguucccugcugcagcca

SEQ ID NO: 362000 - RNA, 24 nt, Human
ccaaggccagcggaucacuugagg

SEQ ID NO: 362001 - RNA, 32 nt, Human
ccaaggccagcggaucacuugaggucaggagu

SEQ ID NO: 362002 - RNA, 24 nt, Human
ccaaggccaggagagaagaaucca

SEQ ID NO: 362003 - RNA, 32 nt, Human
ccaaggccaggaguucaagaccagccuggcca

SEQ ID NO: 362004 - RNA, 32 nt, Human
ccaaggccagugcagccccagguucccgagcg

SEQ ID NO: 362005 - RNA, 32 nt, Human
ccaaggccauccaggagcccaccaagaggugc

SEQ ID NO: 362006 - RNA, 32 nt, Human
ccaaggccauggaaguggaggcugcagaggcc

SEQ ID NO: 362007 - RNA, 32 nt, Human
ccaaggcccaagcacuggaaagggaaauugcu

SEQ ID NO: 362008 - RNA, 32 nt, Human
ccaaggcccacuguccagcugcagaaauucgu

SEQ ID NO: 362009 - RNA, 32 nt, Human
ccaaggccccacacaaggaggucugcaggaca

SEQ ID NO: 362010 - RNA, 32 nt, Human
ccaaggccccaccccacccagaagcccaguag

SEQ ID NO: 362011 - RNA, 32 nt, Human
ccaaggcccccagcaggcucuccagucccagg

SEQ ID NO: 362012 - RNA, 32 nt, Human
ccaaggcccuccaggcaaugcacugggaaggg

SEQ ID NO: 362013 - RNA, 32 nt, Human
ccaaggcccucugugcccucagccagcccugu

SEQ ID NO: 362014 - RNA, 32 nt, Human
ccaaggcccugagccccaugcccagcccugcc

SEQ ID NO: 362015 - RNA, 32 nt, Human
ccaaggcccugaguaccucuugccuuguuugc

SEQ ID NO: 362016 - RNA, 22 nt, Human
ccaaggcccuggagcugcaggg

SEQ ID NO: 362017 - RNA, 32 nt, Human
ccaaggccgcccagggcagagagaggagacga

SEQ ID NO: 362018 - RNA, 23 nt, Human
ccaaggccgcugcuacugccgcc

SEQ ID NO: 362019 - RNA, 32 nt, Human
ccaaggccgguggaucaccugaggucaggagu

SEQ ID NO: 362020 - RNA, 32 nt, Human
ccaaggccucaauaacggaccuaggccuuauu

SEQ ID NO: 362021 - RNA, 22 nt, Human
ccaaggccucuuccuggacugc

SEQ ID NO: 362022 - RNA, 32 nt, Human
ccaaggcgagcagauuacuugaggucaggagu

SEQ ID NO: 362023 - RNA, 32 nt, Human
ccaaggcgaguggaucaccugaggucaggagu

SEQ ID NO: 362024 - RNA, 25 nt, Human
ccaaggcgcagcgggagcgcacagg

SEQ ID NO: 362025 - RNA, 24 nt, Human
ccaaggcggauggaucaccugagg

SEQ ID NO: 362026 - RNA, 32 nt, Human
ccaaggcggauggaucaccugaggucaggagc

SEQ ID NO: 362027 - RNA, 23 nt, Human
ccaaggcggauggaucacuugag

SEQ ID NO: 362028 - RNA, 24 nt, Human
ccaaggcgggaggaucacuugagg

SEQ ID NO: 362029 - RNA, 32 nt, Human
ccaaggcgggaggaucacuugaggucaggagu

SEQ ID NO: 362030 - RNA, 32 nt, Human
ccaaggcgggcaaaucaccugaggucaagagu

SEQ ID NO: 362031 - RNA, 32 nt, Human
ccaaggcgggcagaucaccugaggucaagagu

SEQ ID NO: 362032 - RNA, 32 nt, Human
ccaaggcgggcagaucaccugaggucaauagu

SEQ ID NO: 362033 - RNA, 32 nt, Human
ccaaggcgggcagaucaccugaggucaggagu

SEQ ID NO: 362034 - RNA, 32 nt, Human
ccaaggcgggcagaucaccugaggucggcagu

SEQ ID NO: 362035 - RNA, 32 nt, Human
ccaaggcgggcagaucaccugagguuaggagu

SEQ ID NO: 362036 - RNA, 24 nt, Human
ccaaggcgggcagaucacuugagg

SEQ ID NO: 362037 - RNA, 32 nt, Human
ccaaggcgggcagaucacuugaggucaggagu

SEQ ID NO: 362038 - RNA, 32 nt, Human
ccaaggcgggcagaucauuugaggucaggagu

SEQ ID NO: 362039 - RNA, 23 nt, Human
ccaaggcgggcagaucgcuugag

SEQ ID NO: 362040 - RNA, 24 nt, Human
ccaaggcgggcagaugacuugagg

SEQ ID NO: 362041 - RNA, 32 nt, Human
ccaaggcgggcagaugacuugaggucaggagu

SEQ ID NO: 362042 - RNA, 32 nt, Human
ccaaggcgggcagauuaccugaggucaggaga

SEQ ID NO: 362043 - RNA, 32 nt, Human
ccaaggcgggcagcucaccugaggucaggcgu

SEQ ID NO: 362044 - RNA, 32 nt, Human
ccaaggcgggcggauaaccugaggucaggggu

SEQ ID NO: 362045 - RNA, 32 nt, Human
ccaaggcgggcggaucaccugaggucaggagu

SEQ ID NO: 362046 - RNA, 28 nt, Human
ccaaggcgggcggaucacgaagucggga

SEQ ID NO: 362047 - RNA, 24 nt, Human
ccaaggcgggcggaucacuugagg

SEQ ID NO: 362048 - RNA, 32 nt, Human
ccaaggcgggcggaucacuugaggucaggagu

SEQ ID NO: 362049 - RNA, 32 nt, Human
ccaaggcgggcguaucaccugaggucaggagu

SEQ ID NO: 362050 - RNA, 32 nt, Human
ccaaggcggguagaucacuugaggucaggagu

SEQ ID NO: 362051 - RNA, 32 nt, Human
ccaaggcgggucaaucaccugaggucaggagu

SEQ ID NO: 362052 - RNA, 24 nt, Human
ccaaggcgggucgauuacuugagg

SEQ ID NO: 362053 - RNA, 32 nt, Human
ccaaggcgggucgauuacuugaggucaggagu

SEQ ID NO: 362054 - RNA, 32 nt, Human
ccaaggcgggugaaucaccugaggucaggagu

SEQ ID NO: 362055 - RNA, 32 nt, Human
ccaaggcgggugcaucaccugaggucgggagu

SEQ ID NO: 362056 - RNA, 32 nt, Human
ccaaggcggguggaacacuugaggucaggagu

SEQ ID NO: 362057 - RNA, 24 nt, Human
ccaaggcggguggauaaccugagg

SEQ ID NO: 362058 - RNA, 23 nt, Human
ccaaggcggguggauacccugag

SEQ ID NO: 362059 - RNA, 32 nt, Human
ccaaggcggguggaucaauugaggucaggagu

SEQ ID NO: 362060 - RNA, 18 nt, Human
ccaaggcggguggaucac

SEQ ID NO: 362061 - RNA, 24 nt, Human
ccaaggcggguggaucacccgagg

SEQ ID NO: 362062 - RNA, 22 nt, Human
ccaaggcggguggaucaccuga

SEQ ID NO: 362063 - RNA, 32 nt, Human
ccaaggcggguggaucaccugacaucaggagu

SEQ ID NO: 362064 - RNA, 32 nt, Human
ccaaggcggguggaucaccugagaucaggagu

SEQ ID NO: 362065 - RNA, 24 nt, Human
ccaaggcggguggaucaccugagg

SEQ ID NO: 362066 - RNA, 32 nt, Human
ccaaggcggguggaucaccugaggccaggaag

SEQ ID NO: 362067 - RNA, 32 nt, Human
ccaaggcggguggaucaccugaggucacgagu

SEQ ID NO: 362068 - RNA, 32 nt, Human
ccaaggcggguggaucaccugaggucaggagu

SEQ ID NO: 362069 - RNA, 22 nt, Human
ccaaggcggguggaucacgagg

SEQ ID NO: 362070 - RNA, 24 nt, Human
ccaaggcggguggaucacuugagg

SEQ ID NO: 362071 - RNA, 32 nt, Human
ccaaggcggguggaucacuugaggucaggagu

SEQ ID NO: 362072 - RNA, 22 nt, Human
ccaaggcggguggaucauuuga

SEQ ID NO: 362073 - RNA, 22 nt, Human
ccaaggcggguggauuacgagg

SEQ ID NO: 362074 - RNA, 24 nt, Human
ccaaggcggguggauugcuugagg

SEQ ID NO: 362075 - RNA, 24 nt, Human
ccaaggcggguggcucacuugagg

SEQ ID NO: 362076 - RNA, 22 nt, Human
ccaaggcgggugggucacauga

SEQ ID NO: 362077 - RNA, 24 nt, Human
ccaaggcguguggaucaccugagg

SEQ ID NO: 362078 - RNA, 32 nt, Human
ccaaggcguguggaucaccugaggucaggagu

SEQ ID NO: 362079 - RNA, 32 nt, Human
ccaaggcuaauugguggugggaaaguggacag

SEQ ID NO: 362080 - RNA, 32 nt, Human
ccaaggcucacugcagcgcgcuccugaccccu

SEQ ID NO: 362081 - RNA, 18 nt, Human
ccaaggcucagaaagguu

SEQ ID NO: 362082 - RNA, 23 nt, Human
ccaaggcucaggaaaaacugggg

SEQ ID NO: 362083 - RNA, 32 nt, Human
ccaaggcuccaaaggcugaggucuccccaguu

SEQ ID NO: 362084 - RNA, 22 nt, Human
ccaaggcuccaauaaacgugcu

SEQ ID NO: 362085 - RNA, 32 nt, Human
ccaaggcuccggcucccaggccuguguccuac

SEQ ID NO: 362086 - RNA, 20 nt, Human
ccaaggcuccuccaacaugc

SEQ ID NO: 362087 - RNA, 26 nt, Human
ccaaggcucuacugggucccuggacc

SEQ ID NO: 362088 - RNA, 32 nt, Human
ccaaggcucuacugggucccuggaccuaaccc

SEQ ID NO: 362089 - RNA, 32 nt, Human
ccaaggcucuucuccuuggaggacagugggaa

SEQ ID NO: 362090 - RNA, 20 nt, Human
ccaaggcuggaaugcagugg

SEQ ID NO: 362091 - RNA, 32 nt, Human
ccaaggcuggacuggguuggcugcaguguggu

SEQ ID NO: 362092 - RNA, 19 nt, Human
ccaaggcuggagugcaggg

SEQ ID NO: 362093 - RNA, 20 nt, Human
ccaaggcuggagugcagugg

SEQ ID NO: 362094 - RNA, 22 nt, Human
ccaaggcuggcagaucacuuga

SEQ ID NO: 362095 - RNA, 24 nt, Human
ccaaggcuggcagaucacuugagg

SEQ ID NO: 362096 - RNA, 32 nt, Human
ccaaggcugggaacagaggggauguggugaga

SEQ ID NO: 362097 - RNA, 32 nt, Human
ccaaggcugggggaagaagcucucuccucccu

SEQ ID NO: 362098 - RNA, 24 nt, Human
ccaaggcugguggaucaccugagg

SEQ ID NO: 362099 - RNA, 32 nt, Human
ccaaggcugguggaucaccugaggucaggagu

SEQ ID NO: 362100 - RNA, 32 nt, Human
ccaaggcugugcacguccccugugcugauucu

SEQ ID NO: 362101 - RNA, 32 nt, Human
ccaaggcugugccuguauuaaggcuuuuccgu

SEQ ID NO: 362102 - RNA, 32 nt, Human
ccaaggcuguucucaccagcugccucagauga

SEQ ID NO: 362103 - RNA, 21 nt, Human
ccaaggcuuccuccacccugc

SEQ ID NO: 362104 - RNA, 21 nt, Human
ccaaggcuucuccaauucugc

SEQ ID NO: 362105 - RNA, 24 nt, Human
ccaaggcuucuucauuggugcugu

SEQ ID NO: 362106 - RNA, 32 nt, Human
ccaaggcuuuacugcugauagugcuaauuggc

SEQ ID NO: 362107 - RNA, 32 nt, Human
ccaaggcuuucccaucuuggggccuuugccca

SEQ ID NO: 362108 - RNA, 32 nt, Human
ccaagggaagcuggguccugcccaccaagguc

SEQ ID NO: 362109 - RNA, 32 nt, Human
ccaagggagccggcucagaggggccggcgcgc

SEQ ID NO: 362110 - RNA, 32 nt, Human
ccaagggaggaagcagagggaggcagaagcgu

SEQ ID NO: 362111 - RNA, 32 nt, Human
ccaagggaggaucgcgaggggagccaggggag

SEQ ID NO: 362112 - RNA, 32 nt, Human
ccaagggaggcggaucaccugaggucaggagu

SEQ ID NO: 362113 - RNA, 32 nt, Human
ccaagggaggcuuggcggcuguggaggcgagu

SEQ ID NO: 362114 - RNA, 32 nt, Human
ccaagggaggggagcagccuaguuggucuugg

SEQ ID NO: 362115 - RNA, 23 nt, Human
ccaagggaguggaucaccugagg

SEQ ID NO: 362116 - RNA, 32 nt, Human
ccaagggaugucagggcagcucugugcaucug

SEQ ID NO: 362117 - RNA, 32 nt, Human
ccaagggcaagugcuagaguugcagugaauuu

SEQ ID NO: 362118 - RNA, 22 nt, Human
ccaagggcagagccugugcccu

SEQ ID NO: 362119 - RNA, 22 nt, Human
ccaagggcagaggauguaauga

SEQ ID NO: 362120 - RNA, 32 nt, Human
ccaagggcaucuccagccucaggccggcaggu

SEQ ID NO: 362121 - RNA, 18 nt, Human
ccaagggccacggcuggg

SEQ ID NO: 362122 - RNA, 32 nt, Human
ccaagggccacuggucucccugggcuugcagu

SEQ ID NO: 362123 - RNA, 32 nt, Human
ccaagggccauggggaagauggagcaaaccua

SEQ ID NO: 362124 - RNA, 32 nt, Human
ccaagggccggcuccguugagggaagggagcc

SEQ ID NO: 362125 - RNA, 32 nt, Human
ccaagggccuguccccauccugacuuaaaggc

SEQ ID NO: 362126 - RNA, 32 nt, Human
ccaagggcgguggcucacgccuguaaucccag

SEQ ID NO: 362127 - RNA, 32 nt, Human
ccaagggcuccagggccagggugugagggaug

SEQ ID NO: 362128 - RNA, 18 nt, Human
ccaagggcucugcuccag

SEQ ID NO: 362129 - RNA, 32 nt, Human
ccaagggcucuuucuuauuauggcagggagug

SEQ ID NO: 362130 - RNA, 32 nt, Human
ccaagggcugggacugggaagggacgcgacgc

SEQ ID NO: 362131 - RNA, 32 nt, Human
ccaagggcuguggcugaugaugguaaauaaga

SEQ ID NO: 362132 - RNA, 32 nt, Human
ccaagggcuucugcacccuccacccugucccc

SEQ ID NO: 362133 - RNA, 32 nt, Human
ccaaggggaagguggagcaagaaaugaaaagg

SEQ ID NO: 362134 - RNA, 22 nt, Human
ccaaggggagugaccccugcca

SEQ ID NO: 362135 - RNA, 32 nt, Human
ccaaggggagugagaugaggugggcuugaaag

SEQ ID NO: 362136 - RNA, 22 nt, Human
ccaaggggagugggaacgacag

SEQ ID NO: 362137 - RNA, 17 nt, Human
ccaaggggccucuccau

SEQ ID NO: 362138 - RNA, 30 nt, Human
ccaaggggccucuccaugccuucuuaggaa

SEQ ID NO: 362139 - RNA, 32 nt, Human
ccaaggggcgccaggagcagagccagggccug

SEQ ID NO: 362140 - RNA, 32 nt, Human
ccaaggggcugcaggagacuccagggcaggga

SEQ ID NO: 362141 - RNA, 32 nt, Human
ccaaggggcuggggcaggagacagaucagggc

SEQ ID NO: 362142 - RNA, 32 nt, Human
ccaagggggacugaggcaggagagagagcagc

SEQ ID NO: 362143 - RNA, 32 nt, Human
ccaagggggcagaucacuucaggucgggaguu

SEQ ID NO: 362144 - RNA, 32 nt, Human
ccaagggggcggguaucacaaccccgacgcca

SEQ ID NO: 362145 - RNA, 32 nt, Human
ccaaggggguuauuuaaacugucaguucccaa

SEQ ID NO: 362146 - RNA, 32 nt, Human
ccaaggggugaguggacguguuggaagagaga

SEQ ID NO: 362147 - RNA, 24 nt, Human
ccaagggguggggguugcagugag

SEQ ID NO: 362148 - RNA, 32 nt, Human
ccaagggguuuaauaaauaacccuugaaaacu

SEQ ID NO: 362149 - RNA, 32 nt, Human
ccaaggguaaagggauggggcagaggcauaaa

SEQ ID NO: 362150 - RNA, 32 nt, Human
ccaagggugggacuaggcggcucugccccuag

SEQ ID NO: 362151 - RNA, 32 nt, Human
ccaaggguguagaaaaggcaucaacacucugg

SEQ ID NO: 362152 - RNA, 32 nt, Human
ccaaggguucucucuccugcuugcgcuuagug

SEQ ID NO: 362153 - RNA, 32 nt, Human
ccaagguaaaauauaucccacauugagaucau

SEQ ID NO: 362154 - RNA, 23 nt, Human
ccaagguagaagaaucacuugag

SEQ ID NO: 362155 - RNA, 23 nt, Human
ccaagguaggaggaucacuugag

SEQ ID NO: 362156 - RNA, 32 nt, Human
ccaagguaggcagaucaccugaggucaggagu

SEQ ID NO: 362157 - RNA, 32 nt, Human
ccaaggucacaggcacagaaccuuuccccugc

SEQ ID NO: 362158 - RNA, 32 nt, Human
ccaaggucagcagaucaccugaggucaggagu

SEQ ID NO: 362159 - RNA, 32 nt, Human
ccaaggucagcccugaggccagggugaaaggu

SEQ ID NO: 362160 - RNA, 32 nt, Human
ccaaggucaggaguucaagaccagccuggcca

SEQ ID NO: 362161 - RNA, 32 nt, Human
ccaaggucaggaguuugagaccagccuggcca

SEQ ID NO: 362162 - RNA, 32 nt, Human
ccaaggucagggacuggucacagggagggcuc

SEQ ID NO: 362163 - RNA, 32 nt, Human
ccaaggucaucaccagcccuguuugcaucccc

SEQ ID NO: 362164 - RNA, 18 nt, Human
ccaagguccauccauucu

SEQ ID NO: 362165 - RNA, 32 nt, Human
ccaaggucccucaggcugguugugaaaucagu

SEQ ID NO: 362166 - RNA, 32 nt, Human
ccaaggucgcacagcuagugguggagcuggag

SEQ ID NO: 362167 - RNA, 32 nt, Human
ccaaggucgcucauggucacucccugcgcccc

SEQ ID NO: 362168 - RNA, 22 nt, Human
ccaaggucugaccuaggguucc

SEQ ID NO: 362169 - RNA, 32 nt, Human
ccaaggugacacuggguccaggagcucccugg

SEQ ID NO: 362170 - RNA, 24 nt, Human
ccaaggugagcaagucacuugagg

SEQ ID NO: 362171 - RNA, 32 nt, Human
ccaaggugagcggaucaccugaagucagggau

SEQ ID NO: 362172 - RNA, 32 nt, Human
ccaaggugaguggaucaccugaggucagaagu

SEQ ID NO: 362173 - RNA, 32 nt, Human
ccaaggugcagaaugguuuggaaaguagcugu

SEQ ID NO: 362174 - RNA, 32 nt, Human
ccaaggugcccucuccccggggaccuuagggu

SEQ ID NO: 362175 - RNA, 32 nt, Human
ccaaggugccugugcucccagcagguccaagu

SEQ ID NO: 362176 - RNA, 22 nt, Human
ccaaggugcuaggauuacaggc

SEQ ID NO: 362177 - RNA, 32 nt, Human
ccaaggugcugauguccaugauugugaugaug

SEQ ID NO: 362178 - RNA, 26 nt, Human
ccaaggugcugcuggucuccuggacc

SEQ ID NO: 362179 - RNA, 24 nt, Human
ccaaggugcuggaauuacaggcgu

SEQ ID NO: 362180 - RNA, 24 nt, Human
ccaaggugcuggaauuacaggugu

SEQ ID NO: 362181 - RNA, 21 nt, Human
ccaaggugcuggauuacaggc

SEQ ID NO: 362182 - RNA, 24 nt, Human
ccaaggugcugggacuacaggcgu

SEQ ID NO: 362183 - RNA, 24 nt, Human
ccaaggugcugggauuacaagcgu

SEQ ID NO: 362184 - RNA, 21 nt, Human
ccaaggugcugggauuacagg

SEQ ID NO: 362185 - RNA, 22 nt, Human
ccaaggugcugggauuacaggc

SEQ ID NO: 362186 - RNA, 24 nt, Human
ccaaggugcugggauuacaggugu

SEQ ID NO: 362187 - RNA, 32 nt, Human
ccaaggugcugggauuacaggugugcugcaca

SEQ ID NO: 362188 - RNA, 24 nt, Human
ccaaggugcugggauuauaggcgu

SEQ ID NO: 362189 - RNA, 24 nt, Human
ccaaggugcugggauugcagacgu

SEQ ID NO: 362190 - RNA, 24 nt, Human
ccaaggugcugggauugcaggcgu

SEQ ID NO: 362191 - RNA, 23 nt, Human
ccaagguggaaggaucacuuaga

SEQ ID NO: 362192 - RNA, 24 nt, Human
ccaagguggacaggucacuuaagg

SEQ ID NO: 362193 - RNA, 21 nt, Human
ccaagguggagaagaaucacg

SEQ ID NO: 362194 - RNA, 32 nt, Human
ccaagguggagaagaaucacgaaaaggagaag

SEQ ID NO: 362195 - RNA, 32 nt, Human
ccaagguggauagaucacuugaggucaugagu

SEQ ID NO: 362196 - RNA, 32 nt, Human
ccaagguggauggaucucuugaggucaggagu

SEQ ID NO: 362197 - RNA, 31 nt, Human
ccaagguggaugggccccaugccaaggaaua

SEQ ID NO: 362198 - RNA, 22 nt, Human
ccaagguggcagagguugcagu

SEQ ID NO: 362199 - RNA, 24 nt, Human
ccaagguggcagagguugcaguaa

SEQ ID NO: 362200 - RNA, 32 nt, Human
ccaagguggccaacagcuuccuggcugccauc

SEQ ID NO: 362201 - RNA, 32 nt, Human
ccaagguggcuagguacacucccccacuuccc

SEQ ID NO: 362202 - RNA, 23 nt, Human
ccaaggugggaagaucacuugag

SEQ ID NO: 362203 - RNA, 32 nt, Human
ccaaggugggaggaccaccugaggucaagagu

SEQ ID NO: 362204 - RNA, 24 nt, Human
ccaaggugggaggaucaccugagg

SEQ ID NO: 362205 - RNA, 32 nt, Human
ccaaggugggaggaucaccugaggucaggagu

SEQ ID NO: 362206 - RNA, 32 nt, Human
ccaaggugggaggaucaccugaugucgggagu

SEQ ID NO: 362207 - RNA, 23 nt, Human
ccaaggugggaggaucacucgag

SEQ ID NO: 362208 - RNA, 23 nt, Human
ccaaggugggaggaucacugaga

SEQ ID NO: 362209 - RNA, 22 nt, Human
ccaaggugggaggaucacuuga

SEQ ID NO: 362210 - RNA, 23 nt, Human
ccaaggugggaggaucacuugag

SEQ ID NO: 362211 - RNA, 24 nt, Human
ccaaggugggaggaucacuugagg

SEQ ID NO: 362212 - RNA, 24 nt, Human
ccaaggugggaggaucgcuugaga

SEQ ID NO: 362213 - RNA, 24 nt, Human
ccaaggugggaggauuacuugaga

SEQ ID NO: 362214 - RNA, 32 nt, Human
ccaaggugggaggcagcugacaacaccaccca

SEQ ID NO: 362215 - RNA, 32 nt, Human
ccaaggugggagggaagaucgauugagcccag

SEQ ID NO: 362216 - RNA, 32 nt, Human
ccaaggugggcaaaucaccugaggucaggagu

SEQ ID NO: 362217 - RNA, 24 nt, Human
ccaaggugggcaaggacgagcucu

SEQ ID NO: 362218 - RNA, 23 nt, Human
ccaaggugggcaaucauuugagg

SEQ ID NO: 362219 - RNA, 24 nt, Human
ccaaggugggcacaucacuuaagg

SEQ ID NO: 362220 - RNA, 24 nt, Human
ccaaggugggcagaucaccugagg

SEQ ID NO: 362221 - RNA, 32 nt, Human
ccaaggugggcagaucaccugaggucaggagu

SEQ ID NO: 362222 - RNA, 22 nt, Human
ccaaggugggcagaucacgagg

SEQ ID NO: 362223 - RNA, 24 nt, Human
ccaaggugggcagaucacuggagg

SEQ ID NO: 362224 - RNA, 24 nt, Human
ccaaggugggcagaucacuugagg

SEQ ID NO: 362225 - RNA, 32 nt, Human
ccaaggugggcagaucacuugaggucaggagu

SEQ ID NO: 362226 - RNA, 22 nt, Human
ccaaggugggcagaucaggagg

SEQ ID NO: 362227 - RNA, 22 nt, Human
ccaaggugggcagaucaugagg

SEQ ID NO: 362228 - RNA, 24 nt, Human
ccaaggugggcagaucgccugagg

SEQ ID NO: 362229 - RNA, 32 nt, Human
ccaaggugggcagaucgccugaggucuggagu

SEQ ID NO: 362230 - RNA, 23 nt, Human
ccaaggugggcagaucgcuugag

SEQ ID NO: 362231 - RNA, 19 nt, Human
ccaaggugggcagaucuca

SEQ ID NO: 362232 - RNA, 24 nt, Human
ccaaggugggcagaucuuuuaagg

SEQ ID NO: 362233 - RNA, 24 nt, Human
ccaaggugggcagaugacuugagg

SEQ ID NO: 362234 - RNA, 32 nt, Human
ccaaggugggcagaugacuugaggucaggggu

SEQ ID NO: 362235 - RNA, 23 nt, Human
ccaaggugggcagauugccugag

SEQ ID NO: 362236 - RNA, 24 nt, Human
ccaaggugggcggauaaccugagg

SEQ ID NO: 362237 - RNA, 32 nt, Human
ccaaggugggcggauaaccugaggucaggagu

SEQ ID NO: 362238 - RNA, 24 nt, Human
ccaaggugggcggaucacccugag

SEQ ID NO: 362239 - RNA, 22 nt, Human
ccaaggugggcggaucaccuga

SEQ ID NO: 362240 - RNA, 23 nt, Human
ccaaggugggcggaucaccugag

SEQ ID NO: 362241 - RNA, 32 nt, Human
ccaaggugggcggaucaccugagaucgagagu

SEQ ID NO: 362242 - RNA, 32 nt, Human
ccaaggugggcggaucaccugagcucaggagu

SEQ ID NO: 362243 - RNA, 24 nt, Human
ccaaggugggcggaucaccugagg

SEQ ID NO: 362244 - RNA, 32 nt, Human
ccaaggugggcggaucaccugaggucaggagu

SEQ ID NO: 362245 - RNA, 32 nt, Human
ccaaggugggcggaucaccugaggucaguuca

SEQ ID NO: 362246 - RNA, 32 nt, Human
ccaaggugggcggaucaccugaggucgggagu

SEQ ID NO: 362247 - RNA, 32 nt, Human
ccaaggugggcggaucaccugagguuaggagu

SEQ ID NO: 362248 - RNA, 32 nt, Human
ccaaggugggcggaucaccugaugucaggggu

SEQ ID NO: 362249 - RNA, 22 nt, Human
ccaaggugggcggaucacgagg

SEQ ID NO: 362250 - RNA, 24 nt, Human
ccaaggugggcggaucacuugagg

SEQ ID NO: 362251 - RNA, 32 nt, Human
ccaaggugggcggaucacuugaggucaggaau

SEQ ID NO: 362252 - RNA, 32 nt, Human
ccaaggugggcggaucacuugaggucaggagu

SEQ ID NO: 362253 - RNA, 24 nt, Human
ccaaggugggcggaucaucugagg

SEQ ID NO: 362254 - RNA, 22 nt, Human
ccaaggugggcggaucaugagg

SEQ ID NO: 362255 - RNA, 24 nt, Human
ccaaggugggcggaucgccugagg

SEQ ID NO: 362256 - RNA, 32 nt, Human
ccaaggugggcggaucgccugaggucaggagu

SEQ ID NO: 362257 - RNA, 32 nt, Human
ccaaggugggcggaugaccugaggucaggagu

SEQ ID NO: 362258 - RNA, 23 nt, Human
ccaaggugggcggauugcuugag

SEQ ID NO: 362259 - RNA, 22 nt, Human
ccaaggugggcugugaccgaga

SEQ ID NO: 362260 - RNA, 32 nt, Human
ccaaggugggguggaagcuuggggaagaccca

SEQ ID NO: 362261 - RNA, 32 nt, Human
ccaagguggguaaaucacuugaggucaggagu

SEQ ID NO: 362262 - RNA, 22 nt, Human
ccaagguggguaaauuacuuga

SEQ ID NO: 362263 - RNA, 22 nt, Human
ccaagguggguagaucacgaga

SEQ ID NO: 362264 - RNA, 32 nt, Human
ccaagguggguagaucacuugaggucaggagu

SEQ ID NO: 362265 - RNA, 24 nt, Human
ccaagguggguagaucaucugagg

SEQ ID NO: 362266 - RNA, 32 nt, Human
ccaagguggguagaucaucugaggucaggaau

SEQ ID NO: 362267 - RNA, 23 nt, Human
ccaagguggguagaucauuucag

SEQ ID NO: 362268 - RNA, 24 nt, Human
ccaagguggguagaucauuugagg

SEQ ID NO: 362269 - RNA, 32 nt, Human
ccaagguggguagaucauuugaggucaggagc

SEQ ID NO: 362270 - RNA, 22 nt, Human
ccaaggugggugaaucaccuga

SEQ ID NO: 362271 - RNA, 32 nt, Human
ccaaggugggugaaucaccugaagucaggagu

SEQ ID NO: 362272 - RNA, 24 nt, Human
ccaaggugggugaauugcuugagg

SEQ ID NO: 362273 - RNA, 32 nt, Human
ccaaggugggugaauugcuugaggucaggaau

SEQ ID NO: 362274 - RNA, 32 nt, Human
ccaagguggguggaccacaugaggucaggagu

SEQ ID NO: 362275 - RNA, 24 nt, Human
ccaagguggguggaucaccugagg

SEQ ID NO: 362276 - RNA, 32 nt, Human
ccaagguggguggaucaccugagggcaggagu

SEQ ID NO: 362277 - RNA, 32 nt, Human
ccaagguggguggaucaccugaggucagaagu

SEQ ID NO: 362278 - RNA, 32 nt, Human
ccaagguggguggaucaccugaggucagcagu

SEQ ID NO: 362279 - RNA, 32 nt, Human
ccaagguggguggaucaccugaggucaggagc

SEQ ID NO: 362280 - RNA, 32 nt, Human
ccaagguggguggaucaccugaggucaggagu

SEQ ID NO: 362281 - RNA, 32 nt, Human
ccaagguggguggaucaccugaggucaggcgu

SEQ ID NO: 362282 - RNA, 32 nt, Human
ccaagguggguggaucaccugaggucaggggu

SEQ ID NO: 362283 - RNA, 32 nt, Human
ccaagguggguggaucaccuguggucaagagu

SEQ ID NO: 362284 - RNA, 22 nt, Human
ccaagguggguggaucacgagg

SEQ ID NO: 362285 - RNA, 22 nt, Human
ccaagguggguggaucacuuga

SEQ ID NO: 362286 - RNA, 23 nt, Human
ccaagguggguggaucacuugag

SEQ ID NO: 362287 - RNA, 24 nt, Human
ccaagguggguggaucacuugagg

SEQ ID NO: 362288 - RNA, 32 nt, Human
ccaagguggguggaucacuugaggucaggagu

SEQ ID NO: 362289 - RNA, 24 nt, Human
ccaagguggguggaucaucuaagg

SEQ ID NO: 362290 - RNA, 22 nt, Human
ccaaggugggugggucacuuga

SEQ ID NO: 362291 - RNA, 24 nt, Human
ccaaggugggugggucaucugagg

SEQ ID NO: 362292 - RNA, 32 nt, Human
ccaaggugggugggucaucugaggucaggagu

SEQ ID NO: 362293 - RNA, 22 nt, Human
ccaaggugugaacaugcccuga

SEQ ID NO: 362294 - RNA, 32 nt, Human
ccaaggugugggcgcaucuagggcaggucuug

SEQ ID NO: 362295 - RNA, 24 nt, Human
ccaagguguugggaccacaggcgu

SEQ ID NO: 362296 - RNA, 24 nt, Human
ccaagguguugggauuacagaugu

SEQ ID NO: 362297 - RNA, 22 nt, Human
ccaagguuaaggaugagcacag

SEQ ID NO: 362298 - RNA, 32 nt, Human
ccaagguuaggguguugaaggaagguagaggg

SEQ ID NO: 362299 - RNA, 32 nt, Human
ccaagguuaucuuggaacuaaaugacuuuucu

SEQ ID NO: 362300 - RNA, 32 nt, Human
ccaagguuauuuuauuuauuguaagcauuuug

SEQ ID NO: 362301 - RNA, 32 nt, Human
ccaagguugaccucagcuucggagccaccucu

SEQ ID NO: 362302 - RNA, 19 nt, Human
ccaagguugagaagaauca

SEQ ID NO: 362303 - RNA, 23 nt, Human
ccaagguuggaauuaacaggcgu

SEQ ID NO: 362304 - RNA, 32 nt, Human
ccaagguuggcagaucaccugaggucaggagu

SEQ ID NO: 362305 - RNA, 32 nt, Human
ccaagguuucaagugauccucccgccucagcc

SEQ ID NO: 362306 - RNA, 24 nt, Human
ccaagguuuuggaauuacaggugu

SEQ ID NO: 362307 - RNA, 32 nt, Human
ccaaguaaccaccacuucugccuuagauaaua

SEQ ID NO: 362308 - RNA, 23 nt, Human
ccaaguaacuaggacuacaggca

SEQ ID NO: 362309 - RNA, 22 nt, Human
ccaaguaacugggauuacaggc

SEQ ID NO: 362310 - RNA, 32 nt, Human
ccaaguacagcaugggcaucacgagccugcug

SEQ ID NO: 362311 - RNA, 32 nt, Human
ccaaguacaugcagugcacagaagagcaaguc

SEQ ID NO: 362312 - RNA, 18 nt, Human
ccaaguaccugcucacca

SEQ ID NO: 362313 - RNA, 24 nt, Human
ccaaguaccugggacuacaggcgu

SEQ ID NO: 362314 - RNA, 23 nt, Human
ccaaguaccugggacuacaggug

SEQ ID NO: 362315 - RNA, 24 nt, Human
ccaaguaccugggacuacaggugu

SEQ ID NO: 362316 - RNA, 32 nt, Human
ccaaguacgaugggaugggauuccaaguaaac

SEQ ID NO: 362317 - RNA, 32 nt, Human
ccaaguagagcugaaaugggaaggaaccccug

SEQ ID NO: 362318 - RNA, 22 nt, Human
ccaaguagccaggauuacaggc

SEQ ID NO: 362319 - RNA, 22 nt, Human
ccaaguagccggaauuacaggc

SEQ ID NO: 362320 - RNA, 32 nt, Human
ccaaguagcuagcugggacuacaggcacgcac

SEQ ID NO: 362321 - RNA, 24 nt, Human
ccaaguagcuaggacuacaggcgu

SEQ ID NO: 362322 - RNA, 23 nt, Human
ccaaguagcuaggacuacaggug

SEQ ID NO: 362323 - RNA, 24 nt, Human
ccaaguagcugagacuacaggugu

SEQ ID NO: 362324 - RNA, 23 nt, Human
ccaaguagcugagauuacagacg

SEQ ID NO: 362325 - RNA, 22 nt, Human
ccaaguagcugagauuacaggc

SEQ ID NO: 362326 - RNA, 23 nt, Human
ccaaguagcugagauuacaggcg

SEQ ID NO: 362327 - RNA, 24 nt, Human
ccaaguagcugagauuacaggugu

SEQ ID NO: 362328 - RNA, 24 nt, Human
ccaaguagcuggaacuacaggugu

SEQ ID NO: 362329 - RNA, 21 nt, Human
ccaaguagcuggaauuacagg

SEQ ID NO: 362330 - RNA, 22 nt, Human
ccaaguagcuggaauuacaggc

SEQ ID NO: 362331 - RNA, 24 nt, Human
ccaaguagcuggaauuacaggcgu

SEQ ID NO: 362332 - RNA, 24 nt, Human
ccaaguagcugggaccacaggcgu

SEQ ID NO: 362333 - RNA, 23 nt, Human
ccaaguagcugggacuacaggcg

SEQ ID NO: 362334 - RNA, 24 nt, Human
ccaaguagcugggacuacaggcgu

SEQ ID NO: 362335 - RNA, 23 nt, Human
ccaaguagcugggacuacaggug

SEQ ID NO: 362336 - RNA, 24 nt, Human
ccaaguagcugggacuacaggugu

SEQ ID NO: 362337 - RNA, 23 nt, Human
ccaaguagcugggauaacaggcg

SEQ ID NO: 362338 - RNA, 24 nt, Human
ccaaguagcugggaucacaggcgu

SEQ ID NO: 362339 - RNA, 22 nt, Human
ccaaguagcugggauuaaaggc

SEQ ID NO: 362340 - RNA, 22 nt, Human
ccaaguagcugggauuaaggcg

SEQ ID NO: 362341 - RNA, 23 nt, Human
ccaaguagcugggauuacaagug

SEQ ID NO: 362342 - RNA, 20 nt, Human
ccaaguagcugggauuacag

SEQ ID NO: 362343 - RNA, 24 nt, Human
ccaaguagcugggauuacagaugu

SEQ ID NO: 362344 - RNA, 21 nt, Human
ccaaguagcugggauuacagg

SEQ ID NO: 362345 - RNA, 24 nt, Human
ccaaguagcugggauuacaggagu

SEQ ID NO: 362346 - RNA, 22 nt, Human
ccaaguagcugggauuacaggc

SEQ ID NO: 362347 - RNA, 23 nt, Human
ccaaguagcugggauuacaggcg

SEQ ID NO: 362348 - RNA, 23 nt, Human
ccaaguagcugggauuacaggug

SEQ ID NO: 362349 - RNA, 24 nt, Human
ccaaguagcugggauuacaggugu

SEQ ID NO: 362350 - RNA, 22 nt, Human
ccaaguagcugggauuacgggc

SEQ ID NO: 362351 - RNA, 22 nt, Human
ccaaguagcugggguuacaggc

SEQ ID NO: 362352 - RNA, 23 nt, Human
ccaaguagcugugacuacaggcg

SEQ ID NO: 362353 - RNA, 32 nt, Human
ccaaguaggaggaggcugggauccguguuuca

SEQ ID NO: 362354 - RNA, 32 nt, Human
ccaaguaggcaggcaacagauauguugauugu

SEQ ID NO: 362355 - RNA, 22 nt, Human
ccaaguaggugggauuacaggc

SEQ ID NO: 362356 - RNA, 23 nt, Human
ccaaguaggugggauuacaggcg

SEQ ID NO: 362357 - RNA, 32 nt, Human
ccaaguaguaaaguuuucagggaaacugacug

SEQ ID NO: 362358 - RNA, 32 nt, Human
ccaaguaguacagcuagagcccagggucccug

SEQ ID NO: 362359 - RNA, 22 nt, Human
ccaaguaguugggauuacaggc

SEQ ID NO: 362360 - RNA, 23 nt, Human
ccaaguaguugggauuacaggcg

SEQ ID NO: 362361 - RNA, 22 nt, Human
ccaaguaguugggauuacgggc

SEQ ID NO: 362362 - RNA, 22 nt, Human
ccaaguaguugggauugcaggc

SEQ ID NO: 362363 - RNA, 32 nt, Human
ccaaguaguuuaccuaugcaagaccugugaca

SEQ ID NO: 362364 - RNA, 24 nt, Human
ccaaguaucugggaccacaggcgu

SEQ ID NO: 362365 - RNA, 32 nt, Human
ccaaguaugguggccggcgccuguaaucccag

SEQ ID NO: 362366 - RNA, 32 nt, Human
ccaaguauugauuuaacuucauuuuucuaaua

SEQ ID NO: 362367 - RNA, 32 nt, Human
ccaagucaaaaugugaagaaagagaugaauua

SEQ ID NO: 362368 - RNA, 32 nt, Human
ccaagucaacaucaggcuacugaaguugaggc

SEQ ID NO: 362369 - RNA, 32 nt, Human
ccaagucacacaggcuucuguauuauguauuu

SEQ ID NO: 362370 - RNA, 32 nt, Human
ccaagucacucagaggacaacuacccauauuc

SEQ ID NO: 362371 - RNA, 20 nt, Human
ccaagucagccaucuguccu

SEQ ID NO: 362372 - RNA, 32 nt, Human
ccaagucagcuuugccuuccacgcugucucca

SEQ ID NO: 362373 - RNA, 32 nt, Human
ccaagucaggagaauggugugaucaccuguca

SEQ ID NO: 362374 - RNA, 32 nt, Human
ccaagucagugaauugucaaccugcauauccu

SEQ ID NO: 362375 - RNA, 32 nt, Human
ccaagucaucuagaaauugcaaaggaaaagac

SEQ ID NO: 362376 - RNA, 32 nt, Human
ccaagucauuugcaccuuuaccucucacaugg

SEQ ID NO: 362377 - RNA, 32 nt, Human
ccaaguccaagaacaaaugccagccacguccu

SEQ ID NO: 362378 - RNA, 32 nt, Human
ccaaguccaagaaccacaccacacacaaccag

SEQ ID NO: 362379 - RNA, 32 nt, Human
ccaaguccagaaggaaggaauggagcugagca

SEQ ID NO: 362380 - RNA, 32 nt, Human
ccaaguccagcccuggaucucccaauggccuu

SEQ ID NO: 362381 - RNA, 21 nt, Human
ccaagucccauuauuaucaca

SEQ ID NO: 362382 - RNA, 32 nt, Human
ccaagucccuuuccacuuuaaccuucuacaaa

SEQ ID NO: 362383 - RNA, 23 nt, Human
ccaaguccuaccacacaaaggaa

SEQ ID NO: 362384 - RNA, 32 nt, Human
ccacucauucacccaaccucaggguucucccc

SEQ ID NO: 362385 - RNA, 32 nt, Human
ccacucauuuuaguggcugccuccgggugaug

SEQ ID NO: 362386 - RNA, 32 nt, Human
ccacucauuuuauauuuagaaaaauccuaaau

SEQ ID NO: 362387 - RNA, 32 nt, Human
ccacucauuuuucuccuccuugggagcugggc

SEQ ID NO: 362388 - RNA, 32 nt, Human
ccacuccaaaaacccagugugggggcaaaggg

SEQ ID NO: 362389 - RNA, 32 nt, Human
ccacuccaagcccagcccauggagauugaccu

SEQ ID NO: 362390 - RNA, 32 nt, Human
ccacuccaaucacccuacaagaugccaaggag

SEQ ID NO: 362391 - RNA, 32 nt, Human
ccacuccaaugccccgcaggucgcgagcugcu

SEQ ID NO: 362392 - RNA, 32 nt, Human
ccacuccacacacacccuguuugcccgugagc

SEQ ID NO: 362393 - RNA, 18 nt, Human
ccacuccaccucggaccc

SEQ ID NO: 362394 - RNA, 32 nt, Human
ccacuccacugcacccaguguggccguacacc

SEQ ID NO: 362395 - RNA, 32 nt, Human
ccacuccagaggcugaggcaggagaaucgcuu

SEQ ID NO: 362396 - RNA, 32 nt, Human
ccacuccagagugaguagacaagacuuugaca

SEQ ID NO: 362397 - RNA, 20 nt, Human
ccacuccagcaccccagcca

SEQ ID NO: 362398 - RNA, 32 nt, Human
ccacuccagccugagcaacagagcgagacccu

SEQ ID NO: 362399 - RNA, 32 nt, Human
ccacuccagcucccuguauugauauaaccugu

SEQ ID NO: 362400 - RNA, 32 nt, Human
ccacuccaggagcugaguuggguggaaggugc

SEQ ID NO: 362401 - RNA, 32 nt, Human
ccacuccagggucuccguucugcuagaagcug

SEQ ID NO: 362402 - RNA, 32 nt, Human
ccacuccaguaguauccucuguuuucagacau

SEQ ID NO: 362403 - RNA, 32 nt, Human
ccacuccaguguucccagccccaaggccaggc

SEQ ID NO: 362404 - RNA, 32 nt, Human
ccacuccauaccacagcccuuggcccagccau

SEQ ID NO: 362405 - RNA, 32 nt, Human
ccacuccaucaccucucaaccuuugcuucgac

SEQ ID NO: 362406 - RNA, 32 nt, Human
ccacuccauccaggagcacugcaguuuccacg

SEQ ID NO: 362407 - RNA, 28 nt, Human
ccacucccaagugugcccucuucccucu

SEQ ID NO: 362408 - RNA, 17 nt, Human
ccacucccacccagcca

SEQ ID NO: 362409 - RNA, 32 nt, Human
ccacucccaccccacaccagcccugccucaag

SEQ ID NO: 362410 - RNA, 32 nt, Human
ccacucccaguucuguguuccagaaauugaga

SEQ ID NO: 362411 - RNA, 32 nt, Human
ccacucccaugugucuucagcuuucuuuugca

SEQ ID NO: 362412 - RNA, 32 nt, Human
ccacuccccaaaacugaccccaaucucugugu

SEQ ID NO: 362413 - RNA, 32 nt, Human
ccacuccccacccccagccucugccggcuccc

SEQ ID NO: 362414 - RNA, 32 nt, Human
ccacuccccacccugcaggacaggggugucug

SEQ ID NO: 362415 - RNA, 23 nt, Human
ccacuccccacuuauucuagggc

SEQ ID NO: 362416 - RNA, 21 nt, Human
ccacuccccagccacuggugc

SEQ ID NO: 362417 - RNA, 32 nt, Human
ccacuccccagccugcugccagcacucacugu

SEQ ID NO: 362418 - RNA, 32 nt, Human
ccacucccccagagcccugccaccccaugugu

SEQ ID NO: 362419 - RNA, 32 nt, Human
ccacucccccagcaaacauaacuccuaguaug

SEQ ID NO: 362420 - RNA, 32 nt, Human
ccacuccccucagaucucaguuagaacaugac

SEQ ID NO: 362421 - RNA, 19 nt, Human
ccacuccccuccugacagg

SEQ ID NO: 362422 - RNA, 32 nt, Human
ccacuccccugccccagcucgagccaggcucu

SEQ ID NO: 362423 - RNA, 32 nt, Human
ccacuccccuggcacuguuacuugccucugcg

SEQ ID NO: 362424 - RNA, 19 nt, Human
ccacuccccuggcauucca

SEQ ID NO: 362425 - RNA, 20 nt, Human
ccacucccggccuaggcacc

SEQ ID NO: 362426 - RNA, 20 nt, Human
ccacucccggccugacacca

SEQ ID NO: 362427 - RNA, 32 nt, Human
ccacucccggugcugaggcugcaucagacccu

SEQ ID NO: 362428 - RNA, 18 nt, Human
ccacucccgugcucgccu

SEQ ID NO: 362429 - RNA, 32 nt, Human
ccacucccuaucuccuucccaccccuacacac

SEQ ID NO: 362430 - RNA, 21 nt, Human
ccacucccuccaaggaccagg

SEQ ID NO: 362431 - RNA, 32 nt, Human
ccacucccuccaccgccucaccuucccugcug

SEQ ID NO: 362432 - RNA, 32 nt, Human
ccacucccuccagcagccugguucaccacaca

SEQ ID NO: 362433 - RNA, 32 nt, Human
ccacucccuccagggcgcaccugcaggucugc

SEQ ID NO: 362434 - RNA, 32 nt, Human
ccacucccugccuccuuugagggacuggggga

SEQ ID NO: 362435 - RNA, 32 nt, Human
ccacucccugcucuucuucuucauccaacucu

SEQ ID NO: 362436 - RNA, 21 nt, Human
ccacucccugggcacagaguc

SEQ ID NO: 362437 - RNA, 32 nt, Human
ccacucccuucccaugaucuaugaccucaucc

SEQ ID NO: 362438 - RNA, 32 nt, Human
ccacuccgaaggcagggaggaggacuuggcaa

SEQ ID NO: 362439 - RNA, 19 nt, Human
ccacuccgacugccuggga

SEQ ID NO: 362440 - RNA, 32 nt, Human
ccacuccgcagcuuucggccucggugagcggg

SEQ ID NO: 362441 - RNA, 32 nt, Human
ccacuccgcaucucaagaauagaaggcacggc

SEQ ID NO: 362442 - RNA, 32 nt, Human
ccacuccggggagggggccaagaggcaacggc

SEQ ID NO: 362443 - RNA, 32 nt, Human
ccacuccuaacacuagcaucagucccacucau

SEQ ID NO: 362444 - RNA, 32 nt, Human
ccacuccuaaucccucuccuuucuggcauccu

SEQ ID NO: 362445 - RNA, 19 nt, Human
ccacuccuaccacaaggac

SEQ ID NO: 362446 - RNA, 32 nt, Human
ccacuccuagccccagccuccaaggaugcggc

SEQ ID NO: 362447 - RNA, 32 nt, Human
ccacuccuaggauacaacaagagcaagcccaa

SEQ ID NO: 362448 - RNA, 17 nt, Human
ccacuccuccucacuaa

SEQ ID NO: 362449 - RNA, 32 nt, Human
ccacuccucugcuuccucuguuggccccagau

SEQ ID NO: 362450 - RNA, 32 nt, Human
ccacuccucuuccuccgccauccucauuuaua

SEQ ID NO: 362451 - RNA, 32 nt, Human
ccacuccugaacccccauuucugauuugucag

SEQ ID NO: 362452 - RNA, 23 nt, Human
ccacuccugagcgccacauccca

SEQ ID NO: 362453 - RNA, 32 nt, Human
ccacuccugcacacuggugugcagccuuugug

SEQ ID NO: 362454 - RNA, 32 nt, Human
ccacuccugcagcucuucucacaggaccagcc

SEQ ID NO: 362455 - RNA, 32 nt, Human
ccacuccugcagcugccacgguuucugccacc

SEQ ID NO: 362456 - RNA, 32 nt, Human
ccacuccugcagcugcuggugcugcuucuuac

SEQ ID NO: 362457 - RNA, 32 nt, Human
ccacuccugccugcuucccggugagcugcccc

SEQ ID NO: 362458 - RNA, 32 nt, Human
ccacuccugccuuccaaaucccugcagaaaac

SEQ ID NO: 362459 - RNA, 32 nt, Human
ccacuccugcucccucucccuuuucacuguug

SEQ ID NO: 362460 - RNA, 32 nt, Human
ccacuccugcugcaaaggcugcuggaauuuuc

SEQ ID NO: 362461 - RNA, 32 nt, Human
ccacuccugcugcaaaggcugcugggauuuuc

SEQ ID NO: 362462 - RNA, 32 nt, Human
ccacuccuucuaccugcacgcucugcgcaucc

SEQ ID NO: 362463 - RNA, 32 nt, Human
ccacuccuugccugccucaaagggggccuggc

SEQ ID NO: 362464 - RNA, 32 nt, Human
ccacucgaugccauggagaaggucaguugcag

SEQ ID NO: 362465 - RNA, 31 nt, Human
ccacucgccauuugcugacaugagauuggga

SEQ ID NO: 362466 - RNA, 32 nt, Human
ccacucgccccgcuuccucuggaucucucuag

SEQ ID NO: 362467 - RNA, 32 nt, Human
ccacucgccucaccugagccuggguggaacaa

SEQ ID NO: 362468 - RNA, 32 nt, Human
ccacucgccugacuccccuuggaccucaguua

SEQ ID NO: 362469 - RNA, 24 nt, Human
ccacucggcaucucugugaaagca

SEQ ID NO: 362470 - RNA, 32 nt, Human
ccacucggcccaggaggucagcagucuguucu

SEQ ID NO: 362471 - RNA, 32 nt, Human
ccacucgggaggcugagacaggagaaucgcuu

SEQ ID NO: 362472 - RNA, 32 nt, Human
ccacucgggaggcugaggcaagagaguuacuu

SEQ ID NO: 362473 - RNA, 32 nt, Human
ccacucgggaggcugaggcaggagaaugaugu

SEQ ID NO: 362474 - RNA, 20 nt, Human
ccacucgugcaucccugaga

SEQ ID NO: 362475 - RNA, 32 nt, Human
ccacucuaagugauuccuccagggugggaagc

SEQ ID NO: 362476 - RNA, 32 nt, Human
ccacucuacuaaaaauauaagaaauuagccgg

SEQ ID NO: 362477 - RNA, 32 nt, Human
ccacucuagaguaaugauggucccugugguau

SEQ ID NO: 362478 - RNA, 32 nt, Human
ccacucuaucuuugugguucaugaggacuuug

SEQ ID NO: 362479 - RNA, 32 nt, Human
ccacucucaauacccuguucccaaacccauuc

SEQ ID NO: 362480 - RNA, 32 nt, Human
ccacucucacacuuugucacuggaauuuuauu

SEQ ID NO: 362481 - RNA, 32 nt, Human
ccacucucagugucucaugcacugaaugcaac

SEQ ID NO: 362482 - RNA, 18 nt, Human
ccacucuccagcugccuu

SEQ ID NO: 362483 - RNA, 32 nt, Human
ccacucuccagucucccuccccugacucccuc

SEQ ID NO: 362484 - RNA, 32 nt, Human
ccacucucccacccucucgaucuguauauccu

SEQ ID NO: 362485 - RNA, 32 nt, Human
ccacucuccccagauccuggagaguggguugu

SEQ ID NO: 362486 - RNA, 32 nt, Human
ccacucuccccgacuucauucacucaaacuuc

SEQ ID NO: 362487 - RNA, 32 nt, Human
ccacucuccuccccucuuuuccuuccuuccua

SEQ ID NO: 362488 - RNA, 32 nt, Human
ccacucucgggaaggauuugcauuuugagcuu

SEQ ID NO: 362489 - RNA, 32 nt, Human
ccacucucuccccuccccucagugcccuugcc

SEQ ID NO: 362490 - RNA, 32 nt, Human
ccacucucucuuccucacccuacaaucagcca

SEQ ID NO: 362491 - RNA, 18 nt, Human
ccacucucuggcugccuu

SEQ ID NO: 362492 - RNA, 32 nt, Human
ccacucucuuggaaccaccacaccuguuuaaa

SEQ ID NO: 362493 - RNA, 32 nt, Human
ccacucugaagucugcugacugugucucuuga

SEQ ID NO: 362494 - RNA, 32 nt, Human
ccacucugacagucuccuccaguuccagcaau

SEQ ID NO: 362495 - RNA, 32 nt, Human
ccacucugaccgggcuuccucccuccacgcuu

SEQ ID NO: 362496 - RNA, 32 nt, Human
ccacucugaguguggccaguucuauaaccauc

SEQ ID NO: 362497 - RNA, 32 nt, Human
ccacucugcacucucccccucuauggaucagg

SEQ ID NO: 362498 - RNA, 32 nt, Human
ccacucugcagccucaaacuccugggcuccag

SEQ ID NO: 362499 - RNA, 32 nt, Human
ccacucugccacagguugcaucuugaccuggu

SEQ ID NO: 362500 - RNA, 23 nt, Human
ccacucugccagcuuccuggagc

SEQ ID NO: 362501 - RNA, 32 nt, Human
ccacucugcccagcuggguuggaucuucucuc

SEQ ID NO: 362502 - RNA, 32 nt, Human
ccacucugccgugcucacacagacacacccag

SEQ ID NO: 362503 - RNA, 32 nt, Human
ccacucugcgccccucgaucucccaggcucuu

SEQ ID NO: 362504 - RNA, 32 nt, Human
ccacucugcuuugcccaagugugacagcacug

SEQ ID NO: 362505 - RNA, 32 nt, Human
ccacucuggccuggccuauuuccccagagcuc

SEQ ID NO: 362506 - RNA, 29 nt, Human
ccacucuggcugccguuguccuguccugc

SEQ ID NO: 362507 - RNA, 32 nt, Human
ccacucuggcuggcuucucuccccugccccaa

SEQ ID NO: 362508 - RNA, 32 nt, Human
ccacucugggcaacagaaugagauccugucuc

SEQ ID NO: 362509 - RNA, 32 nt, Human
ccacucugggcugggugggccagguguuccuu

SEQ ID NO: 362510 - RNA, 32 nt, Human
ccacucuggggcccagccugccugccgcaccc

SEQ ID NO: 362511 - RNA, 32 nt, Human
ccacucugggucccucagaaaagagggacgug

SEQ ID NO: 362512 - RNA, 24 nt, Human
ccacucugugccuuggcucaugcu

SEQ ID NO: 362513 - RNA, 32 nt, Human
ccacucuucuuucauagucacauuuuggcccc

SEQ ID NO: 362514 - RNA, 32 nt, Human
ccacucuugcccaggcuggagcgcaaguggcg

SEQ ID NO: 362515 - RNA, 32 nt, Human
ccacucuuucagggauguccaagguccauguu

SEQ ID NO: 362516 - RNA, 32 nt, Human
ccacucuuuccagauugagucugugcuguuua

SEQ ID NO: 362517 - RNA, 32 nt, Human
ccacucuuucugcccucaccugggcaacguuu

SEQ ID NO: 362518 - RNA, 32 nt, Human
ccacugaaaauagaaaaauuagcugggcaugg

SEQ ID NO: 362519 - RNA, 32 nt, Human
ccacugaaacucgcugguuuugcucgaauuag

SEQ ID NO: 362520 - RNA, 21 nt, Human
ccacugaaagaagugggacuu

SEQ ID NO: 362521 - RNA, 19 nt, Human
ccacugaaccccauugccc

SEQ ID NO: 362522 - RNA, 32 nt, Human
ccacugaagaggaggaggagggucuagaggcc

SEQ ID NO: 362523 - RNA, 32 nt, Human
ccacugaaggauguaggcggaggcagaucucu

SEQ ID NO: 362524 - RNA, 32 nt, Human
ccacugaagugaggacacaccggagccaggcg

SEQ ID NO: 362525 - RNA, 21 nt, Human
ccacugaaugacuggggccag

SEQ ID NO: 362526 - RNA, 32 nt, Human
ccacugacagauucaccucccccacaucccua

SEQ ID NO: 362527 - RNA, 32 nt, Human
ccacugacauuuagggauguggccauagaauu

SEQ ID NO: 362528 - RNA, 32 nt, Human
ccacugaccaggcugugaacauugacuguggc

SEQ ID NO: 362529 - RNA, 32 nt, Human
ccacugaccaggcuuccaaugacuaggucacc

SEQ ID NO: 362530 - RNA, 32 nt, Human
ccacugaccagguggccagggggcaggguggg

SEQ ID NO: 362531 - RNA, 21 nt, Human
ccacugacccccgcugccucc

SEQ ID NO: 362532 - RNA, 31 nt, Human
ccacugacccuuucugggccuguuuccuuac

SEQ ID NO: 362533 - RNA, 32 nt, Human
ccacugacucacugugaccuugggaucuugug

SEQ ID NO: 362534 - RNA, 32 nt, Human
ccacugagaagcaggcggguugggugggagga

SEQ ID NO: 362535 - RNA, 32 nt, Human
ccacugagagcggggguccugccccaucuuag

SEQ ID NO: 362536 - RNA, 32 nt, Human
ccacugagaggacagagagaaauaagugcccu

SEQ ID NO: 362537 - RNA, 32 nt, Human
ccacugagagguguuuaaugugauccaagacc

SEQ ID NO: 362538 - RNA, 32 nt, Human
ccacugagcacagccugguagggcuggaauua

SEQ ID NO: 362539 - RNA, 32 nt, Human
ccacugagcagccaaccgcagccucuggccac

SEQ ID NO: 362540 - RNA, 24 nt, Human
ccacugagcaguucagagccccag

SEQ ID NO: 362541 - RNA, 19 nt, Human
ccacugagcccacauccca

SEQ ID NO: 362542 - RNA, 32 nt, Human
ccacugagcucuuaacccuccccaccugaggg

SEQ ID NO: 362543 - RNA, 32 nt, Human
ccacugaggaacaggauccacuuugaacaguc

SEQ ID NO: 362544 - RNA, 32 nt, Human
ccacugaggaacggccuggugaaggacaagcg

SEQ ID NO: 362545 - RNA, 32 nt, Human
ccacugaggaccacaucacugcagacccaggg

SEQ ID NO: 362546 - RNA, 32 nt, Human
ccacugaggagaagguaagggaguacuuuggu

SEQ ID NO: 362547 - RNA, 32 nt, Human
ccacugaggcaauggaugcuguuucucucccu

SEQ ID NO: 362548 - RNA, 32 nt, Human
ccacugaggccaguggaauuuccccaggccuu

SEQ ID NO: 362549 - RNA, 32 nt, Human
ccacugagucagugauaauuugcugaagaagc

SEQ ID NO: 362550 - RNA, 32 nt, Human
ccacugagugagcaacagaugagggaaauugc

SEQ ID NO: 362551 - RNA, 32 nt, Human
ccacugaguggcuucagccucgcuggaagaag

SEQ ID NO: 362552 - RNA, 32 nt, Human
ccacugauccccaacgggagcaagacuucuaa

SEQ ID NO: 362553 - RNA, 32 nt, Human
ccacugaugaaauuaugaccaggugggcccga

SEQ ID NO: 362554 - RNA, 24 nt, Human
ccacugaugcaggagcugccaccc

SEQ ID NO: 362555 - RNA, 19 nt, Human
ccacugaugcauccuccaa

SEQ ID NO: 362556 - RNA, 32 nt, Human
ccacugaugugucucuuggauuucuuccaggu

SEQ ID NO: 362557 - RNA, 31 nt, Human
ccacugauugagagaguggaggggaagagac

SEQ ID NO: 362558 - RNA, 17 nt, Human
ccacugcaaacugcagg

SEQ ID NO: 362559 - RNA, 32 nt, Human
ccacugcaaagauuccagccuggguccaggaa

SEQ ID NO: 362560 - RNA, 32 nt, Human
ccacugcaaauuucaaaagccuugucaauggu

SEQ ID NO: 362561 - RNA, 21 nt, Human
ccacugcaacacccaccagca

SEQ ID NO: 362562 - RNA, 32 nt, Human
ccacugcaacaucuucuccuacgacuacuccg

SEQ ID NO: 362563 - RNA, 32 nt, Human
ccacugcaagacaaguguuggggaagauggga

SEQ ID NO: 362564 - RNA, 32 nt, Human
ccacugcaagcccaugaacuucccagagagug

SEQ ID NO: 362565 - RNA, 32 nt, Human
ccacugcacacuccaaucugggugaaagaccg

SEQ ID NO: 362566 - RNA, 32 nt, Human
ccacugcacacugcacuccauccugggcgaca

SEQ ID NO: 362567 - RNA, 32 nt, Human
ccacugcaccacuacucccaagccuagggaug

SEQ ID NO: 362568 - RNA, 32 nt, Human
ccacugcaccacuccagccugggcaacaagag

SEQ ID NO: 362569 - RNA, 22 nt, Human
ccacugcaccccagccugggca

SEQ ID NO: 362570 - RNA, 32 nt, Human
ccacugcacccccuccugcugcagaggggcag

SEQ ID NO: 362571 - RNA, 21 nt, Human
ccacugcacccggcccugaga

SEQ ID NO: 362572 - RNA, 32 nt, Human
ccacugcaccucuagucugggugacagagcaa

SEQ ID NO: 362573 - RNA, 20 nt, Human
ccacugcaccuggcccagga

SEQ ID NO: 362574 - RNA, 32 nt, Human
ccacugcacgcacuccagccugggcgacagag

SEQ ID NO: 362575 - RNA, 32 nt, Human
ccacugcacgcacuccagccugggugacagag

SEQ ID NO: 362576 - RNA, 17 nt, Human
ccacugcacggggcccc

SEQ ID NO: 362577 - RNA, 32 nt, Human
ccacugcacucauccuggaagacagagugaga

SEQ ID NO: 362578 - RNA, 22 nt, Human
ccacugcacuccaaccugggca

SEQ ID NO: 362579 - RNA, 32 nt, Human
ccacugcacuccagagccugggcgacagagcg

SEQ ID NO: 362580 - RNA, 32 nt, Human
ccacugcacuccagcacuccagccugggugac

SEQ ID NO: 362581 - RNA, 22 nt, Human
ccacugcacuccagcccaggca

SEQ ID NO: 362582 - RNA, 22 nt, Human
ccacugcacuccagccuaagca

SEQ ID NO: 362583 - RNA, 21 nt, Human
ccacugcacuccagccuaggc

SEQ ID NO: 362584 - RNA, 22 nt, Human
ccacugcacuccagccuaggca

SEQ ID NO: 362585 - RNA, 22 nt, Human
ccacugcacuccagccucagca

SEQ ID NO: 362586 - RNA, 22 nt, Human
ccacugcacuccagccugagca

SEQ ID NO: 362587 - RNA, 22 nt, Human
ccacugcacuccagccuggaca

SEQ ID NO: 362588 - RNA, 21 nt, Human
ccacugcacuccagccuggca

SEQ ID NO: 362589 - RNA, 22 nt, Human
ccacugcacuccagccugggca

SEQ ID NO: 362590 - RNA, 22 nt, Human
ccacugcacuccagccuuggca

SEQ ID NO: 362591 - RNA, 32 nt, Human
ccacugcacuccagcuggagugacagagccaa

SEQ ID NO: 362592 - RNA, 32 nt, Human
ccacugcacuccaggccugggugacagugcga

SEQ ID NO: 362593 - RNA, 32 nt, Human
ccacugcacuccauccagccugggugacaggg

SEQ ID NO: 362594 - RNA, 22 nt, Human
ccacugcacucuagccuaagca

SEQ ID NO: 362595 - RNA, 32 nt, Human
ccacugcacugcaacccugcuuucaaaccgaa

SEQ ID NO: 362596 - RNA, 32 nt, Human
ccacugcacugcacgccagccuaggcgacaga

SEQ ID NO: 362597 - RNA, 32 nt, Human
ccacugcacugcacuccagccugggugacaaa

SEQ ID NO: 362598 - RNA, 32 nt, Human
ccacugcacuuccagccugggugacagaguga

SEQ ID NO: 362599 - RNA, 32 nt, Human
ccacugcacuugagccucuugggaaacauaac

SEQ ID NO: 362600 - RNA, 32 nt, Human
ccacugcacuuuucagccugggugccacagcg

SEQ ID NO: 362601 - RNA, 17 nt, Human
ccacugcagacugcagg

SEQ ID NO: 362602 - RNA, 32 nt, Human
ccacugcagcagccaugaagggcaguggguag

SEQ ID NO: 362603 - RNA, 32 nt, Human
ccacugcagcagccaugagacagacuuguggu

SEQ ID NO: 362604 - RNA, 20 nt, Human
ccacugcagccucagcccag

SEQ ID NO: 362605 - RNA, 32 nt, Human
ccacugcagccucugccugcucugccgccgag

SEQ ID NO: 362606 - RNA, 18 nt, Human
ccacugcagcucuuccaa

SEQ ID NO: 362607 - RNA, 32 nt, Human
ccacugcaggaauguggccacagggagcagag

SEQ ID NO: 362608 - RNA, 23 nt, Human
ccacugcaggagagcugcccccu

SEQ ID NO: 362609 - RNA, 32 nt, Human
ccacugcagggccagccacucgccaggaggcc

SEQ ID NO: 362610 - RNA, 32 nt, Human
ccacugcaguccgcagcccagccugggcgaca

SEQ ID NO: 362611 - RNA, 32 nt, Human
ccacugcaguccgcaguccagccugggcgaca

SEQ ID NO: 362612 - RNA, 32 nt, Human
ccacugcaucugggcugcagggccagagcuag

SEQ ID NO: 362613 - RNA, 32 nt, Human
ccacugcaugacccucuaucccugccaucugu

SEQ ID NO: 362614 - RNA, 32 nt, Human
ccacugccaacucccucugccccagccccacc

SEQ ID NO: 362615 - RNA, 32 nt, Human
ccacugccaccugggcccggagccuccacgau

SEQ ID NO: 362616 - RNA, 32 nt, Human
ccacugccaccuguacaccuuccacgcccgcu

SEQ ID NO: 362617 - RNA, 23 nt, Human
ccacugccacuccaguccugcca

SEQ ID NO: 362618 - RNA, 21 nt, Human
ccacugccagaaagugauaga

SEQ ID NO: 362619 - RNA, 32 nt, Human
ccacugccagcagucucuugaucuggcccggc

SEQ ID NO: 362620 - RNA, 32 nt, Human
ccacugccagccucaggcaacauagagagccu

SEQ ID NO: 362621 - RNA, 17 nt, Human
ccacugccauccauccu

SEQ ID NO: 362622 - RNA, 32 nt, Human
ccacugcccaauagugaccucacuuccagguc

SEQ ID NO: 362623 - RNA, 32 nt, Human
ccacugcccauuuuaccagcucacauucccga

SEQ ID NO: 362624 - RNA, 32 nt, Human
ccacugccccaggagcacuuuagggcucucag

SEQ ID NO: 362625 - RNA, 32 nt, Human
ccacugcccccuucacugucugugugugguga

SEQ ID NO: 362626 - RNA, 32 nt, Human
ccacugccccucacucuucucuggacccccac

SEQ ID NO: 362627 - RNA, 20 nt, Human
ccacugcccguggucuccaa

SEQ ID NO: 362628 - RNA, 32 nt, Human
ccacugcccuaggcucuuaaauacucauuggg

SEQ ID NO: 362629 - RNA, 32 nt, Human
ccacugcccuccagggccaggauucaggccuc

SEQ ID NO: 362630 - RNA, 32 nt, Human
ccacugcccugacaggaaccucaagagcaaca

SEQ ID NO: 362631 - RNA, 32 nt, Human
ccacugcccuggcugaugaguccuucgguggc

SEQ ID NO: 362632 - RNA, 21 nt, Human
ccacugccgcaggugcccccu

SEQ ID NO: 362633 - RNA, 32 nt, Human
ccacugccgcggccgcugggccugagugucgc

SEQ ID NO: 362634 - RNA, 32 nt, Human
ccacugccgcugccaguaccagccuggagcca

SEQ ID NO: 362635 - RNA, 32 nt, Human
ccacugccggcuugcagccugcuuuuauuccc

SEQ ID NO: 362636 - RNA, 22 nt, Human
ccacugccuaacaucugccccc

SEQ ID NO: 362637 - RNA, 32 nt, Human
ccacugccuacgugccugcccucugcccacug

SEQ ID NO: 362638 - RNA, 32 nt, Human
ccacugccuccgugcccugccuacuccuucuc

SEQ ID NO: 362639 - RNA, 32 nt, Human
ccacugccugcaccacccaccuccagagugca

SEQ ID NO: 362640 - RNA, 32 nt, Human
ccacugccugcagcaggcuucaaaaagcaaca

SEQ ID NO: 362641 - RNA, 32 nt, Human
ccacugccugcaggagccugggcugacugguu

SEQ ID NO: 362642 - RNA, 32 nt, Human
ccacugccuggagauagagugagacccugucu

SEQ ID NO: 362643 - RNA, 32 nt, Human
ccacugccuggaugccggcuugaguucugcgc

SEQ ID NO: 362644 - RNA, 32 nt, Human
ccacugccugggagcagcucacucagcuugcc

SEQ ID NO: 362645 - RNA, 32 nt, Human
ccacugccuuccucuagugcagccuggaagac

SEQ ID NO: 362646 - RNA, 31 nt, Human
ccacugccuugcucugggccuguggugcucc

SEQ ID NO: 362647 - RNA, 32 nt, Human
ccacugcgcccagccccaaguggcuuuuucaa

SEQ ID NO: 362648 - RNA, 32 nt, Human
ccacugcgccccaccucccugccugugugugu

SEQ ID NO: 362649 - RNA, 32 nt, Human
ccacugcgcccggccaucauuugccuauuuuc

SEQ ID NO: 362650 - RNA, 32 nt, Human
ccacugcgccuccagcgcccccgccuucuccg

SEQ ID NO: 362651 - RNA, 20 nt, Human
ccacugcgccuggccgcaga

SEQ ID NO: 362652 - RNA, 32 nt, Human
ccacugcggggaggagggggaggaggagcggg

SEQ ID NO: 362653 - RNA, 32 nt, Human
ccacugcgucagcuaauuuuuguauuuuuagu

SEQ ID NO: 362654 - RNA, 32 nt, Human
ccacugcgugcacucaccuggccgccgggcca

SEQ ID NO: 362655 - RNA, 23 nt, Human
ccacugcuaaaacugaagcacca

SEQ ID NO: 362656 - RNA, 32 nt, Human
ccacugcuaacaacaggacugccuuucccugg

SEQ ID NO: 362657 - RNA, 32 nt, Human
ccacugcuacaggagcccccagccugguuuaa

SEQ ID NO: 362658 - RNA, 32 nt, Human
ccacugcucaaagggcaacaacuuuaagaaca

SEQ ID NO: 362659 - RNA, 32 nt, Human
ccacugcucaacuucccccuccugcaggggau

SEQ ID NO: 362660 - RNA, 21 nt, Human
ccacugcucaccuaggcgcua

SEQ ID NO: 362661 - RNA, 32 nt, Human
ccacugcucacugcuuuccacuugcuaggaug

SEQ ID NO: 362662 - RNA, 32 nt, Human
ccacugcucagaccucuggaccugacaggaga

SEQ ID NO: 362663 - RNA, 32 nt, Human
ccacugcucaggggcuccuucuggcugcagua

SEQ ID NO: 362664 - RNA, 32 nt, Human
ccacugcucccccgucccaucggggugggcua

SEQ ID NO: 362665 - RNA, 32 nt, Human
ccacugcuccguucugagccucgguguauuuu

SEQ ID NO: 362666 - RNA, 32 nt, Human
ccacugcuccuugguccuuggcauuaugacgg

SEQ ID NO: 362667 - RNA, 22 nt, Human
ccacugcucguuguaaaugcca

SEQ ID NO: 362668 - RNA, 32 nt, Human
ccacugcucucgggggcgccauggacgaggcc

SEQ ID NO: 362669 - RNA, 32 nt, Human
ccacugcugaauccucaauggaaagggucgac

SEQ ID NO: 362670 - RNA, 32 nt, Human
ccacugcugacuuucugaaaaguuuuccaguu

SEQ ID NO: 362671 - RNA, 32 nt, Human
ccacugcugagugcccguguccccacagcccc

SEQ ID NO: 362672 - RNA, 32 nt, Human
ccacugcugccucuccaucccucucucauugg

SEQ ID NO: 362673 - RNA, 32 nt, Human
ccacugcugcuugugcggcucagcugaccgag

SEQ ID NO: 362674 - RNA, 32 nt, Human
ccacugcuggcuucagccccuugagcagccca

SEQ ID NO: 362675 - RNA, 32 nt, Human
ccacugcugggcacacuggggcucccucaucu

SEQ ID NO: 362676 - RNA, 32 nt, Human
ccacugcuguuuucacauccuuucccuuaccc

SEQ ID NO: 362677 - RNA, 32 nt, Human
ccacugcuuccucucggcgcaccccaggggag

SEQ ID NO: 362678 - RNA, 32 nt, Human
ccacugcuuugcuagacgugcuuucugccaug

SEQ ID NO: 362679 - RNA, 32 nt, Human
ccacuggaaaccagagucacacugcgcgucug

SEQ ID NO: 362680 - RNA, 25 nt, Human
ccacuggaaagcagacugcuuggga

SEQ ID NO: 362681 - RNA, 32 nt, Human
ccacuggaacaguucagccauuugaauaaauu

SEQ ID NO: 362682 - RNA, 32 nt, Human
ccacuggacucagguccugaaugaagcugucc

SEQ ID NO: 362683 - RNA, 32 nt, Human
ccacuggaggugagaagccgaauggccuuggu

SEQ ID NO: 362684 - RNA, 24 nt, Human
ccacuggagucagcaggcccagug

SEQ ID NO: 362685 - RNA, 31 nt, Human
ccacuggagugaaaugugucacuggauaucu

SEQ ID NO: 362686 - RNA, 32 nt, Human
ccacuggagugcccggccaggucuccaagccc

SEQ ID NO: 362687 - RNA, 17 nt, Human
ccacuggauaucaguug

SEQ ID NO: 362688 - RNA, 32 nt, Human
ccacuggaucgugcuggccucucccagauguc

SEQ ID NO: 362689 - RNA, 25 nt, Human
ccacuggcaaagggaggcaggggaa

SEQ ID NO: 362690 - RNA, 32 nt, Human
ccacuggcaaauccaaccagcaaccagaaaug

SEQ ID NO: 362691 - RNA, 32 nt, Human
ccacuggccagagagggagcugcuagagaucc

SEQ ID NO: 362692 - RNA, 32 nt, Human
ccacuggcccagggccaccucuugcuugggga

SEQ ID NO: 362693 - RNA, 32 nt, Human
ccacuggcgagaggaguuugaccuggauguga

SEQ ID NO: 362694 - RNA, 32 nt, Human
ccacuggcucacugcccaugauucagagcuuu

SEQ ID NO: 362695 - RNA, 32 nt, Human
ccacuggcucagaaaggcugaguccuaagaau

SEQ ID NO: 362696 - RNA, 32 nt, Human
ccacuggcuccaggcuccucacaacagcagcu

SEQ ID NO: 362697 - RNA, 32 nt, Human
ccacuggcuguagcugugcucuggguccccag

SEQ ID NO: 362698 - RNA, 32 nt, Human
ccacuggcuucaugcuggaguaauggguaaca

SEQ ID NO: 362699 - RNA, 32 nt, Human
ccacuggcuuccaagacacugaagacccggcc

SEQ ID NO: 362700 - RNA, 18 nt, Human
ccacugggaaucauggug

SEQ ID NO: 362701 - RNA, 32 nt, Human
ccacugggaccagcaggugaagcguugcaaca

SEQ ID NO: 362702 - RNA, 20 nt, Human
ccacugggacgguggccaga

SEQ ID NO: 362703 - RNA, 32 nt, Human
ccacugggacucaagagaggaaccuggggccc

SEQ ID NO: 362704 - RNA, 32 nt, Human
ccacugggagcacaaugcccacaucaucuuaa

SEQ ID NO: 362705 - RNA, 32 nt, Human
ccacugggagugaauggaucaugaggugggau

SEQ ID NO: 362706 - RNA, 32 nt, Human
ccacugggcaccaccugggcccugagucuccc

SEQ ID NO: 362707 - RNA, 32 nt, Human
ccacugggcaggcagaauuuguuugagggaua

SEQ ID NO: 362708 - RNA, 32 nt, Human
ccacugggccaagugcaguggaucaugucugu

SEQ ID NO: 362709 - RNA, 19 nt, Human
ccacugggccccucagggg

SEQ ID NO: 362710 - RNA, 23 nt, Human
ccacugggccugcuggccucccu

SEQ ID NO: 362711 - RNA, 21 nt, Human
ccacugggcgacagagugaga

SEQ ID NO: 362712 - RNA, 32 nt, Human
ccacugggcgacagagugagacuucgacucaa

SEQ ID NO: 362713 - RNA, 32 nt, Human
ccacuggggacccccacccgaccccacuccca

SEQ ID NO: 362714 - RNA, 32 nt, Human
ccacuggggacccccagcucagccaugcuggc

SEQ ID NO: 362715 - RNA, 32 nt, Human
ccacuggggagguggcgcugggcgcgcgggau

SEQ ID NO: 362716 - RNA, 32 nt, Human
ccacuggggauugggccccugccagacccccu

SEQ ID NO: 362717 - RNA, 17 nt, Human
ccacuggggccaaggug

SEQ ID NO: 362718 - RNA, 22 nt, Human
ccacuggggcccaagugcagca

SEQ ID NO: 362719 - RNA, 18 nt, Human
ccacuggggcugguggga

SEQ ID NO: 362720 - RNA, 32 nt, Human
ccacugggggucuuagacuauauuacccaugg

SEQ ID NO: 362721 - RNA, 31 nt, Human
ccacuggggguggaaugggguagggugggau

SEQ ID NO: 362722 - RNA, 32 nt, Human
ccacugggguguugugcucacuucagggccca

SEQ ID NO: 362723 - RNA, 32 nt, Human
ccacugggucacagugcuuuuccacgagagaa

SEQ ID NO: 362724 - RNA, 32 nt, Human
ccacugggucugcagcucacacauaggcauga

SEQ ID NO: 362725 - RNA, 32 nt, Human
ccacugguacuuccuuucucccugcgggccag

SEQ ID NO: 362726 - RNA, 32 nt, Human
ccacugguauaaauacaucucucuccaauuug

SEQ ID NO: 362727 - RNA, 32 nt, Human
ccacugguccaucugguuuucucuccaggggu

SEQ ID NO: 362728 - RNA, 32 nt, Human
ccacugguccccucucuggcucuguggguccc

SEQ ID NO: 362729 - RNA, 32 nt, Human
ccacuggucggcacuuugccacuguguggcag

SEQ ID NO: 362730 - RNA, 28 nt, Human
ccacuggucggugcugccugguccuggc

SEQ ID NO: 362731 - RNA, 32 nt, Human
ccacuggucugucuuuggauaauaggaauuca

SEQ ID NO: 362732 - RNA, 32 nt, Human
ccacuggucuugcaucccaaaugucucuuugu

SEQ ID NO: 362733 - RNA, 32 nt, Human
ccacuggugcugagaccccacccuagaacaau

SEQ ID NO: 362734 - RNA, 24 nt, Human
ccacugguggccaaauagccgaug

SEQ ID NO: 362735 - RNA, 32 nt, Human
ccacuggugguuuguguguguaugaagguaaa

SEQ ID NO: 362736 - RNA, 32 nt, Human
ccacugguguuuucugucccucuuguucauug

SEQ ID NO: 362737 - RNA, 32 nt, Human
ccacugguuccuucuuccugggucuucagcau

SEQ ID NO: 362738 - RNA, 20 nt, Human
ccacuguaaauuuaauagau

SEQ ID NO: 362739 - RNA, 32 nt, Human
ccacuguaagcagcccuagcucuuggguccag

SEQ ID NO: 362740 - RNA, 32 nt, Human
ccacuguaagccaaaagguggggaaguccuga

SEQ ID NO: 362741 - RNA, 18 nt, Human
ccacuguacaucauccuu

SEQ ID NO: 362742 - RNA, 32 nt, Human
ccacuguacccagccaaaauuguuuucuuuuu

SEQ ID NO: 362743 - RNA, 32 nt, Human
ccacuguacuccagccuggacaacagcgagag

SEQ ID NO: 362744 - RNA, 32 nt, Human
ccacuguacugcaaccugggacagagugagac

SEQ ID NO: 362745 - RNA, 18 nt, Human
ccacuguauauuaauuga

SEQ ID NO: 362746 - RNA, 32 nt, Human
ccacuguaucuucuauuucuaccacauuuugc

SEQ ID NO: 362747 - RNA, 32 nt, Human
ccacugucacggucaaccagagccugcugagc

SEQ ID NO: 362748 - RNA, 32 nt, Human
ccacugucagcaaagccuggagaaaugggacc

SEQ ID NO: 362749 - RNA, 32 nt, Human
ccacugucagcaccugaagguacccaccagau

SEQ ID NO: 362750 - RNA, 32 nt, Human
ccacugucagccacacaccugcccccaucaca

SEQ ID NO: 362751 - RNA, 27 nt, Human
ccacugucauaaucucuuuccaucuua

SEQ ID NO: 362752 - RNA, 18 nt, Human
ccacuguccagcugcaga

SEQ ID NO: 362753 - RNA, 32 nt, Human
ccacuguccaggcaaaugccaggccuuguccc

SEQ ID NO: 362754 - RNA, 32 nt, Human
ccacuguccagguggagacugagcaaaggaag

SEQ ID NO: 362755 - RNA, 32 nt, Human
ccacugucccacucugguggggcugcucucga

SEQ ID NO: 362756 - RNA, 32 nt, Human
ccacugucccgcuagugccugcuaggugcaug

SEQ ID NO: 362757 - RNA, 32 nt, Human
ccacugucgcccagacuggaguccaguggcac

SEQ ID NO: 362758 - RNA, 32 nt, Human
ccacugucgggaggggagacggagcugagcau

SEQ ID NO: 362759 - RNA, 19 nt, Human
ccacugucuccccauccuu

SEQ ID NO: 362760 - RNA, 32 nt, Human
ccacugucucucuccuucucuccaguuuuggu

SEQ ID NO: 362761 - RNA, 32 nt, Human
ccacugucucuucaccccggcagcuaaagaaa

SEQ ID NO: 362762 - RNA, 32 nt, Human
ccacugugaccuggcccacggcugcugugcac

SEQ ID NO: 362763 - RNA, 23 nt, Human
ccacugugagccccgggcuccug

SEQ ID NO: 362764 - RNA, 32 nt, Human
ccacugugaggugagaaugaaaguggaucuca

SEQ ID NO: 362765 - RNA, 20 nt, Human
ccacugugcacugcuuguga

SEQ ID NO: 362766 - RNA, 32 nt, Human
ccacugugcaggaguagggaggaaaaggaguu

SEQ ID NO: 362767 - RNA, 32 nt, Human
ccacugugcccagccaaaagagaaauuucuac

SEQ ID NO: 362768 - RNA, 32 nt, Human
ccacugugcccagccaagaaauaaaguuuuua

SEQ ID NO: 362769 - RNA, 32 nt, Human
ccacugugcccagccacgagcugcuuuuuauc

SEQ ID NO: 362770 - RNA, 32 nt, Human
ccacugugcccagccagagguucucuuaugcu

SEQ ID NO: 362771 - RNA, 32 nt, Human
ccacugugcccagcugagauguuucuuauuau

SEQ ID NO: 362772 - RNA, 32 nt, Human
ccacugugcccaggcugugggcaccaggcaga

SEQ ID NO: 362773 - RNA, 32 nt, Human
ccacugugcccagucaggaugucuuuaaugua

SEQ ID NO: 362774 - RNA, 32 nt, Human
ccacugugcccucugugucagugugugcucca

SEQ ID NO: 362775 - RNA, 32 nt, Human
ccacugugccucuccccucagugucccuucug

SEQ ID NO: 362776 - RNA, 32 nt, Human
ccacugugccuggccagaaauuguuuugaaag

SEQ ID NO: 362777 - RNA, 32 nt, Human
ccacugugcuauauacacagcauaagauuaau

SEQ ID NO: 362778 - RNA, 32 nt, Human
ccacugugcuugguagagugcaucacucacca

SEQ ID NO: 362779 - RNA, 32 nt, Human
ccacuguggagagcugguuucccacuggaguu

SEQ ID NO: 362780 - RNA, 32 nt, Human
ccacuguggagcuucccuggggugcccgggca

SEQ ID NO: 362781 - RNA, 32 nt, Human
ccacuguggcuagauauauacacacacauaua

SEQ ID NO: 362782 - RNA, 32 nt, Human
ccacugugguuuugacuuaagaaagcaaaacu

SEQ ID NO: 362783 - RNA, 32 nt, Human
ccacugugugcacuugcuguuuucccugucca

SEQ ID NO: 362784 - RNA, 32 nt, Human
ccacugugugcccauuuccuagggaaggggaa

SEQ ID NO: 362785 - RNA, 32 nt, Human
ccacuguuagaucugcagaaggggacacccug

SEQ ID NO: 362786 - RNA, 21 nt, Human
ccacuguuagcagcugccccu

SEQ ID NO: 362787 - RNA, 32 nt, Human
ccacuguuagcugaaaccgggguggggagaaa

SEQ ID NO: 362788 - RNA, 32 nt, Human
ccacuguuauuuuccuuccucucuggcagggc

SEQ ID NO: 362789 - RNA, 32 nt, Human
ccacuguugcagaaugaagucaccucgccccc

SEQ ID NO: 362790 - RNA, 32 nt, Human
ccacuguugcugaggccugccugccagccacu

SEQ ID NO: 362791 - RNA, 32 nt, Human
ccacuguuggauuuuaaucugcuuccauuaac

SEQ ID NO: 362792 - RNA, 24 nt, Human
ccacuguuucccccuaaaauguca

SEQ ID NO: 362793 - RNA, 32 nt, Human
ccacuuaaacucuugucagucugggcucaggg

SEQ ID NO: 362794 - RNA, 32 nt, Human
ccacuuaacagaugaggaaacugaggccuaga

SEQ ID NO: 362795 - RNA, 31 nt, Human
ccacuuaaccucucuggaccuuguuuguaag

SEQ ID NO: 362796 - RNA, 32 nt, Human
ccacuuaauaaauaagguuacuugguacacug

SEQ ID NO: 362797 - RNA, 23 nt, Human
ccacuuaauauagcccccacugc

SEQ ID NO: 362798 - RNA, 19 nt, Human
ccacuuacaaagcugcaca

SEQ ID NO: 362799 - RNA, 32 nt, Human
ccacuuaccaggaaauuccuucagaacuagau

SEQ ID NO: 362800 - RNA, 17 nt, Human
ccacuuaccccuucuca

SEQ ID NO: 362801 - RNA, 32 nt, Human
ccacuuacccggccucugccucuuguuaauuu

SEQ ID NO: 362802 - RNA, 32 nt, Human
ccacuuaccuuuccagagauggaguuucacca

SEQ ID NO: 362803 - RNA, 32 nt, Human
ccacuuagagacaaugauuaacagggcccuau

SEQ ID NO: 362804 - RNA, 32 nt, Human
ccacuuagauugagaauuuuauuugaaaagaa

SEQ ID NO: 362805 - RNA, 22 nt, Human
ccacuuaggauggcacagggug

SEQ ID NO: 362806 - RNA, 32 nt, Human
ccacuuaucucucacaaaauauauagacauuu

SEQ ID NO: 362807 - RNA, 32 nt, Human
ccacuuaucugaucagaacaaauguuuauuaa

SEQ ID NO: 362808 - RNA, 32 nt, Human
ccacuuauguagccuuuucccacuggggccgg

SEQ ID NO: 362809 - RNA, 32 nt, Human
ccacuuauugcacuccagcccgggcgacagag

SEQ ID NO: 362810 - RNA, 32 nt, Human
ccacuuauugcguguacacaaggccuggggca

SEQ ID NO: 362811 - RNA, 32 nt, Human
ccacuucaagaggcuggugcugcuagaucuca

SEQ ID NO: 362812 - RNA, 22 nt, Human
ccacuucacaaagaacugcugg

SEQ ID NO: 362813 - RNA, 32 nt, Human
ccacuucacaauauuugauauucaggagcauu

SEQ ID NO: 362814 - RNA, 31 nt, Human
ccacuucacagcuggagacaccggaguaugu

SEQ ID NO: 362815 - RNA, 31 nt, Human
ccacuucacagcugggaacugaggcucacag

SEQ ID NO: 362816 - RNA, 32 nt, Human
ccacuucacaguuucagauggagaacacacaa

SEQ ID NO: 362817 - RNA, 32 nt, Human
ccacuucacaugccguugacucucacagucua

SEQ ID NO: 362818 - RNA, 32 nt, Human
ccacuucacucugcuacuacucaacuuucucc

SEQ ID NO: 362819 - RNA, 32 nt, Human
ccacuucacuggcugcuccaugaauccagccc

SEQ ID NO: 362820 - RNA, 20 nt, Human
ccacuucagaagccuacugg

SEQ ID NO: 362821 - RNA, 32 nt, Human
ccacuucagcaacagcccuuuccccaggagaa

SEQ ID NO: 362822 - RNA, 20 nt, Human
ccacuucagcagcacugcca

SEQ ID NO: 362823 - RNA, 32 nt, Human
ccacuucagcagcacugccacugccuuuggcc

SEQ ID NO: 362824 - RNA, 32 nt, Human
ccacuucagccucccccacucuugccgccucc

SEQ ID NO: 362825 - RNA, 32 nt, Human
ccacuucagcuucugccagacagauggaacuc

SEQ ID NO: 362826 - RNA, 32 nt, Human
ccacuucaggggcaaacaucuccaucaucagc

SEQ ID NO: 362827 - RNA, 32 nt, Human
ccacuucauauucuucucacccagcacacucc

SEQ ID NO: 362828 - RNA, 32 nt, Human
ccacuuccaccccuugguaucuggacccacgu

SEQ ID NO: 362829 - RNA, 32 nt, Human
ccacuuccagaaccuaccccaagagcaagacu

SEQ ID NO: 362830 - RNA, 32 nt, Human
ccacuuccaggagcccagagggccaagagaga

SEQ ID NO: 362831 - RNA, 32 nt, Human
ccacuuccaggccagggugguggcuucucugc

SEQ ID NO: 362832 - RNA, 32 nt, Human
ccacuucccagaggcagagccugagucaccgg

SEQ ID NO: 362833 - RNA, 18 nt, Human
ccacuucccaggcugccu

SEQ ID NO: 362834 - RNA, 31 nt, Human
ccacuucccaucucugggccucgucuuuccu

SEQ ID NO: 362835 - RNA, 32 nt, Human
ccacuuccccuaugccucuccccacccaccau

SEQ ID NO: 362836 - RNA, 32 nt, Human
ccacuuccccuccaagacccuguguucauuug

SEQ ID NO: 362837 - RNA, 17 nt, Human
ccacuuccccucucuga

SEQ ID NO: 362838 - RNA, 32 nt, Human
ccacuucccuacucgcuacuacaacaaguauc

SEQ ID NO: 362839 - RNA, 32 nt, Human
ccacuucccucucuccccuggcccgcaaaguu

SEQ ID NO: 362840 - RNA, 32 nt, Human
ccacuucccuggcagguacaagggccaccuga

SEQ ID NO: 362841 - RNA, 32 nt, Human
ccacuuccuaacccagggacccugcacagcca

SEQ ID NO: 362842 - RNA, 32 nt, Human
ccacuuccuacuuccuccuuuagccuagcaga

SEQ ID NO: 362843 - RNA, 32 nt, Human
ccacuuccuccaccccaguggguaugucugag

SEQ ID NO: 362844 - RNA, 32 nt, Human
ccacuuccuccccuuucuacugcucucccauu

SEQ ID NO: 362845 - RNA, 32 nt, Human
ccacuuccucccuucccucauccugcauguuc

SEQ ID NO: 362846 - RNA, 32 nt, Human
ccacuuccucuccugagaccaggaacucagca

SEQ ID NO: 362847 - RNA, 32 nt, Human
ccacuuccugacuaaggagcugcagcgauaca

SEQ ID NO: 362848 - RNA, 32 nt, Human
ccacuuccuuucuacccugccugugcacagug

SEQ ID NO: 362849 - RNA, 32 nt, Human
ccacuucgagagcaagacagagcugcugccuu

SEQ ID NO: 362850 - RNA, 32 nt, Human
ccacuucggccuuccaaaguggccgcaaagug

SEQ ID NO: 362851 - RNA, 32 nt, Human
ccacuucgucuccugaaucuuguucugcugcc

SEQ ID NO: 362852 - RNA, 32 nt, Human
ccacuucuagcugcuucuccucuuguuucugc

SEQ ID NO: 362853 - RNA, 32 nt, Human
ccacuucuauuccuaaggucaccaagaauauc

SEQ ID NO: 362854 - RNA, 21 nt, Human
ccacuucucagccugguacuu

SEQ ID NO: 362855 - RNA, 18 nt, Human
ccacuucucagcucuccc

SEQ ID NO: 362856 - RNA, 32 nt, Human
ccacuucuccaacuucccuugagcugaaaaau

SEQ ID NO: 362857 - RNA, 32 nt, Human
ccacuucuccaccccaucaagacuucacaccu

SEQ ID NO: 362858 - RNA, 20 nt, Human
ccacuucucccugugaaagc

SEQ ID NO: 362859 - RNA, 32 nt, Human
ccacuucuccgugcaugacucugggugugagu

SEQ ID NO: 362860 - RNA, 32 nt, Human
ccacuucucugugucaucacacauacccacuu

SEQ ID NO: 362861 - RNA, 32 nt, Human
ccacuucucuucuguggccagaucuugaucau

SEQ ID NO: 362862 - RNA, 32 nt, Human
ccacuucugacaccuucuuucucucccguuuc

SEQ ID NO: 362863 - RNA, 20 nt, Human
ccacuucugaccuggggccu

SEQ ID NO: 362864 - RNA, 32 nt, Human
ccacuucugccagaggacacacacaugcacgc

SEQ ID NO: 362865 - RNA, 32 nt, Human
ccacuucugcugggcugaccugcagcggagag

SEQ ID NO: 362866 - RNA, 32 nt, Human
ccacuucuggagaggccucaggaagcuuccaa

SEQ ID NO: 362867 - RNA, 32 nt, Human
ccacuucuguauccucagagaugcugcgugga

SEQ ID NO: 362868 - RNA, 32 nt, Human
ccacuucuucacugagauaggagauguggaga

SEQ ID NO: 362869 - RNA, 32 nt, Human
ccacuucuuccuggaucaucucuccccaucac

SEQ ID NO: 362870 - RNA, 32 nt, Human
ccacuucuuccuugcgucucccugcaugcugc

SEQ ID NO: 362871 - RNA, 32 nt, Human
ccacuucuucuguuccaugagcugcagggcuu

SEQ ID NO: 362872 - RNA, 32 nt, Human
ccacuucuucuuucuucccuuuccuuccacgg

SEQ ID NO: 362873 - RNA, 32 nt, Human
ccacuugacuucagagcuuucucuccaaagac

SEQ ID NO: 362874 - RNA, 32 nt, Human
ccacuugagugccaccacgcccagcuaguuuu

SEQ ID NO: 362875 - RNA, 32 nt, Human
ccacuugcacacacgcacacacucaugcucac

SEQ ID NO: 362876 - RNA, 23 nt, Human
ccacuugcaccccaccccagcca

SEQ ID NO: 362877 - RNA, 32 nt, Human
ccacuugcagguuccagguuuuacuggcugca

SEQ ID NO: 362878 - RNA, 32 nt, Human
ccacuugcaugcuuccaagccuucaaaacaua

SEQ ID NO: 362879 - RNA, 32 nt, Human
ccacuugccaguuuaauuccagccuuacccau

SEQ ID NO: 362880 - RNA, 32 nt, Human
ccacuugccaucuuucucuauaucuccaguaa

SEQ ID NO: 362881 - RNA, 32 nt, Human
ccacuugcccugccgguuucuugguacuggga

SEQ ID NO: 362882 - RNA, 32 nt, Human
ccacuugcgccucuccagccuccgcaggccca

SEQ ID NO: 362883 - RNA, 32 nt, Human
ccacuugcuggagcugcuggaggcccuggggu

SEQ ID NO: 362884 - RNA, 32 nt, Human
ccacuuggagaaaguccggcuggagcugaccg

SEQ ID NO: 362885 - RNA, 32 nt, Human
ccacuuggagaucuuugcuuccuugcuuuuau

SEQ ID NO: 362886 - RNA, 32 nt, Human
ccacuuggcacccagagggggcugugggugga

SEQ ID NO: 362887 - RNA, 32 nt, Human
ccacuuggcccaggauguugaaagggugcaaa

SEQ ID NO: 362888 - RNA, 32 nt, Human
ccacuuggcucugucuacgggauuguaucaca

SEQ ID NO: 362889 - RNA, 32 nt, Human
ccacuugggaccagauguccagcuggagcaag

SEQ ID NO: 362890 - RNA, 32 nt, Human
ccacuugggaccccguucaggaccuuuugcag

SEQ ID NO: 362891 - RNA, 32 nt, Human
ccacuugggaggcugaggcaggagaaucgcuu

SEQ ID NO: 362892 - RNA, 32 nt, Human
ccacuugggaggcugaggcaggagaauugcuu

SEQ ID NO: 362893 - RNA, 32 nt, Human
ccacuugggaggcugaggugggaggaucgguu

SEQ ID NO: 362894 - RNA, 32 nt, Human
ccacuugggagucugaggcaggagaauggcgu

SEQ ID NO: 362895 - RNA, 32 nt, Human
ccacuuguaacuccagccugggcaacagagug

SEQ ID NO: 362896 - RNA, 32 nt, Human
ccacuugucauccauaaagcaagcucaaccuu

SEQ ID NO: 362897 - RNA, 32 nt, Human
ccacuugucccacgugccccagcagaguccca

SEQ ID NO: 362898 - RNA, 32 nt, Human
ccacuugucccucucccuccccaggacuucug

SEQ ID NO: 362899 - RNA, 32 nt, Human
ccacuugucuuuucugugaauuaugacuauuc

SEQ ID NO: 362900 - RNA, 32 nt, Human
ccacuugugcacacgaugggcaucuaacauca

SEQ ID NO: 362901 - RNA, 21 nt, Human
ccacuugugccuggggucccu

SEQ ID NO: 362902 - RNA, 32 nt, Human
ccacuugugcugccgccaugucucuagugauc

SEQ ID NO: 362903 - RNA, 32 nt, Human
ccacuuguuucuuuuaaaugcuuauuaaaagu

SEQ ID NO: 362904 - RNA, 32 nt, Human
ccacuuuaaauacuuuuaucuacugaaucgca

SEQ ID NO: 362905 - RNA, 23 nt, Human
ccacuuuaaguuuggcuagacuu

SEQ ID NO: 362906 - RNA, 32 nt, Human
ccacuuuagcaaacccugcugcagaggacugu

SEQ ID NO: 362907 - RNA, 32 nt, Human
ccacuuuagcuguuuugacuauuugaauuuuc

SEQ ID NO: 362908 - RNA, 32 nt, Human
ccacuuuagucccuggccaccagcacacccca

SEQ ID NO: 362909 - RNA, 32 nt, Human
ccacuuuagugacaaaacagcacuccacugcu

SEQ ID NO: 362910 - RNA, 32 nt, Human
ccacuuuauauccaccuuuuccuuuuguucaa

SEQ ID NO: 362911 - RNA, 32 nt, Human
ccacuuuauccagauccugcaguugaaggaag

SEQ ID NO: 362912 - RNA, 32 nt, Human
ccacuuucaagugacaauccucuccuuggccc

SEQ ID NO: 362913 - RNA, 31 nt, Human
ccacuuucaauaaagaccugacuuggagaca

SEQ ID NO: 362914 - RNA, 32 nt, Human
ccacuuucagccaggcuggagcaagguaccuu

SEQ ID NO: 362915 - RNA, 32 nt, Human
ccacuuuccaaauaaacuaaagccuggauuug

SEQ ID NO: 362916 - RNA, 20 nt, Human
ccacuuucccacacugugaa

SEQ ID NO: 362917 - RNA, 32 nt, Human
ccacuuucccccacccuucccacccucuagac

SEQ ID NO: 362918 - RNA, 32 nt, Human
ccacuuuccuucaugaacaucccccucccaac

SEQ ID NO: 362919 - RNA, 32 nt, Human
ccacuuucuagccagaggagagaggacccccu

SEQ ID NO: 362920 - RNA, 32 nt, Human
ccacuuucuccccugggggacguugguucaga

SEQ ID NO: 362921 - RNA, 32 nt, Human
ccacuuucucccuccuccuuuuccuguguucu

SEQ ID NO: 362922 - RNA, 32 nt, Human
ccacuuucuccuccccuuccugagccgcacuu

SEQ ID NO: 362923 - RNA, 32 nt, Human
ccacuuucucuucccucuacucacuauuuccc

SEQ ID NO: 362924 - RNA, 32 nt, Human
ccacuuucugccagcaucugcagccacuuucu

SEQ ID NO: 362925 - RNA, 32 nt, Human
ccacuuucuuauuggguugucuugcuuucuua

SEQ ID NO: 362926 - RNA, 17 nt, Human
ccacuuugacccucgac

SEQ ID NO: 362927 - RNA, 32 nt, Human
ccacuuugagggugagugccuccagcagaaac

SEQ ID NO: 362928 - RNA, 32 nt, Human
ccacuuugcaaaggagcucacuguggugucug

SEQ ID NO: 362929 - RNA, 32 nt, Human
ccacuuugcacuguuugggagacagaaaccug

SEQ ID NO: 362930 - RNA, 32 nt, Human
ccacuuugccacuccuaugguuuagggauuaa

SEQ ID NO: 362931 - RNA, 32 nt, Human
ccacuuugccucugcugcucugccagucugca

SEQ ID NO: 362932 - RNA, 32 nt, Human
ccacuuuggcacggaagccuuacagugugggg

SEQ ID NO: 362933 - RNA, 32 nt, Human
ccacuuuggcuuauaaaccacauguacaauau

SEQ ID NO: 362934 - RNA, 32 nt, Human
ccacuuuguccagauugggagaaguggaaauu

SEQ ID NO: 362935 - RNA, 18 nt, Human
ccacuuuguccugugaca

SEQ ID NO: 362936 - RNA, 32 nt, Human
ccacuuuguuacugguaccugauguacacgga

SEQ ID NO: 362937 - RNA, 21 nt, Human
ccacuuuuaauggguccucca

SEQ ID NO: 362938 - RNA, 32 nt, Human
ccacuuuuaccccucucuccccacuccucuuc

SEQ ID NO: 362939 - RNA, 32 nt, Human
ccacuuuuauuuccaagaggaggggcauucuu

SEQ ID NO: 362940 - RNA, 32 nt, Human
ccacuuuucaccgacacucuaagugacuagug

SEQ ID NO: 362941 - RNA, 32 nt, Human
ccacuuuucccagccaaguggugcuuucuucc

SEQ ID NO: 362942 - RNA, 32 nt, Human
ccacuuuucucccaggccucaguucugaagcu

SEQ ID NO: 362943 - RNA, 32 nt, Human
ccacuuuucuggaugagguguccccuuucucc

SEQ ID NO: 362944 - RNA, 32 nt, Human
ccacuuuucuuuccccuuccuuccuuccuuuu

SEQ ID NO: 362945 - RNA, 32 nt, Human
ccacuuuugcccaccucuucugcgugccccuc

SEQ ID NO: 362946 - RNA, 32 nt, Human
ccacuuuuuccaccugggguccaaugucgugg

SEQ ID NO: 362947 - RNA, 32 nt, Human
ccacuuuuuccagaucuuccucuugcucuuca

SEQ ID NO: 362948 - RNA, 32 nt, Human
ccacuuuuucuuucuuucuuucuuucuuucuu

SEQ ID NO: 362949 - RNA, 32 nt, Human
ccagaaaaacaguagcaguuuccugguccugu

SEQ ID NO: 362950 - RNA, 25 nt, Human
ccagaaaaaccaagaagacaggcac

SEQ ID NO: 362951 - RNA, 32 nt, Human
ccagaaaaaccagcuuaucaucuaucaagcuc

SEQ ID NO: 362952 - RNA, 32 nt, Human
ccagaaaaagauuuuguuuugcuuuaugaaaa

SEQ ID NO: 362953 - RNA, 26 nt, Human
ccagaaaaagguauggagcuaacuca

SEQ ID NO: 362954 - RNA, 32 nt, Human
ccagaaaaauauaugaaggagaggaggguaaa

SEQ ID NO: 362955 - RNA, 32 nt, Human
ccagaaaacaucugcucacuuccuucaaaaug

SEQ ID NO: 362956 - RNA, 32 nt, Human
ccagaaaagaaagcgcaaaagaauggugacuc

SEQ ID NO: 362957 - RNA, 32 nt, Human
ccagaaaagaagucuuaagauauuucaaggaa

SEQ ID NO: 362958 - RNA, 32 nt, Human
ccagaaaaggaagcuuuggagagaugggggaa

SEQ ID NO: 362959 - RNA, 32 nt, Human
ccagaaaaggaaggaaggauggagacggaaca

SEQ ID NO: 362960 - RNA, 32 nt, Human
ccagaaaaguagaaguggagauuaccugguau

SEQ ID NO: 362961 - RNA, 32 nt, Human
ccagaaaauacauguacagcagcuaagguugu

SEQ ID NO: 362962 - RNA, 32 nt, Human
ccagaaaauacugauguucacuuaaagauauu

SEQ ID NO: 362963 - RNA, 18 nt, Human
ccagaaaauuacuuugga

SEQ ID NO: 362964 - RNA, 32 nt, Human
ccagaaacaaagcagaucccagaucugaaaag

SEQ ID NO: 362965 - RNA, 32 nt, Human
ccagaaacacccugacaggcucagagaggaga

SEQ ID NO: 362966 - RNA, 18 nt, Human
ccagaaacaucucuggcc

SEQ ID NO: 362967 - RNA, 32 nt, Human
ccagaaaccagcuccaaacugguuguacuggu

SEQ ID NO: 362968 - RNA, 32 nt, Human
ccagaaacugcagaggacaugacaguguggca

SEQ ID NO: 362969 - RNA, 24 nt, Human
ccagaaagaacauuugaaucugga

SEQ ID NO: 362970 - RNA, 22 nt, Human
ccagaaagaccaccacuuugca

SEQ ID NO: 362971 - RNA, 32 nt, Human
ccagaaagagaaagacggagaggcagagaccc

SEQ ID NO: 362972 - RNA, 32 nt, Human
ccagaaagagauguccuuguggcugggggccc

SEQ ID NO: 362973 - RNA, 32 nt, Human
ccagaaagagccucuuguaacaaguauucaaa

SEQ ID NO: 362974 - RNA, 24 nt, Human
ccagaaagcggaaccucccgggcc

SEQ ID NO: 362975 - RNA, 32 nt, Human
ccagaaagcggaaccucccgggccagucgcgc

SEQ ID NO: 362976 - RNA, 32 nt, Human
ccagaaagcuccaggaaucgggaaagaagccc

SEQ ID NO: 362977 - RNA, 31 nt, Human
ccagaaaggaaacugacccucagcagcugcc

SEQ ID NO: 362978 - RNA, 32 nt, Human
ccagaaaggaagagcaucucugccauucgugu

SEQ ID NO: 362979 - RNA, 32 nt, Human
ccagaaaggaggcgaggaaggagggagugugu

SEQ ID NO: 362980 - RNA, 32 nt, Human
ccagaaaggcaccauuuugucgcggcugcccg

SEQ ID NO: 362981 - RNA, 22 nt, Human
ccagaaaggcugcacucuggga

SEQ ID NO: 362982 - RNA, 21 nt, Human
ccagaaagggaaggagagccg

SEQ ID NO: 362983 - RNA, 32 nt, Human
ccagaaagggauggcagccaggagggccuggg

SEQ ID NO: 362984 - RNA, 32 nt, Human
ccagaaagggcccucugcuguggucugaaccc

SEQ ID NO: 362985 - RNA, 32 nt, Human
ccagaaaggggcaggcugaggcugggggaggg

SEQ ID NO: 362986 - RNA, 18 nt, Human
ccagaaagggugcagugg

SEQ ID NO: 362987 - RNA, 31 nt, Human
ccagaaagugagagcuaaauggagaggcuga

SEQ ID NO: 362988 - RNA, 32 nt, Human
ccagaaagugauuaacuuuggccguugcaauc

SEQ ID NO: 362989 - RNA, 23 nt, Human
ccagaaaguggcaguugcaguga

SEQ ID NO: 362990 - RNA, 24 nt, Human
ccagaaaguggcaguugcagugag

SEQ ID NO: 362991 - RNA, 24 nt, Human
ccagaaaguugaggcugcagugag

SEQ ID NO: 362992 - RNA, 32 nt, Human
ccagaaauaagaagccaagggaaaaggagaaa

SEQ ID NO: 362993 - RNA, 32 nt, Human
ccagaaauacaacacacauauguuguauguuu

SEQ ID NO: 362994 - RNA, 25 nt, Human
ccagaaauacagcagccacuuugca

SEQ ID NO: 362995 - RNA, 32 nt, Human
ccagaaauaucuucacuugucauuguuauaua

SEQ ID NO: 362996 - RNA, 25 nt, Human
ccagaaaucagccugggagaagcug

SEQ ID NO: 362997 - RNA, 32 nt, Human
ccagaaaucaggggaaggagaccccuaucugu

SEQ ID NO: 362998 - RNA, 32 nt, Human
ccagaaauugacugagaaaaccaaaguaaaga

SEQ ID NO: 362999 - RNA, 32 nt, Human
ccagaaauugagcuucagaagauugaggauag

SEQ ID NO: 363000 - RNA, 32 nt, Human
ccagaaauuucuccuccaucugauuuugaaca

SEQ ID NO: 363001 - RNA, 32 nt, Human
ccagaaauuugagaccagccugggcaacauag

SEQ ID NO: 363002 - RNA, 32 nt, Human
ccagaaauuugucaguucaugcaguaggauaa

SEQ ID NO: 363003 - RNA, 24 nt, Human
ccagaacaaaaugacuccugauga

SEQ ID NO: 363004 - RNA, 32 nt, Human
ccagaacaaaccucuauauguugcugaaacac

SEQ ID NO: 363005 - RNA, 32 nt, Human
ccagaacaagcagagaggcugauuuuguccuu

SEQ ID NO: 363006 - RNA, 32 nt, Human
ccagaacacagugcucugucuccucccaccag

SEQ ID NO: 363007 - RNA, 16 nt, Human
ccagaacaccaccucu

SEQ ID NO: 363008 - RNA, 32 nt, Human
ccagaacaccuuuucuccugcaaaggaucaca

SEQ ID NO: 363009 - RNA, 32 nt, Human
ccagaacacuuaggagggugucuuuggaccaa

SEQ ID NO: 363010 - RNA, 32 nt, Human
ccagaacagcauaacaagggcaggucugacug

SEQ ID NO: 363011 - RNA, 32 nt, Human
ccagaacagcauggcccgaagcgugcggggcc

SEQ ID NO: 363012 - RNA, 32 nt, Human
ccagaacaggcagagacagggcacagucucua

SEQ ID NO: 363013 - RNA, 32 nt, Human
ccagaacaggcagucucacaagcacgcagcac

SEQ ID NO: 363014 - RNA, 32 nt, Human
ccagaacauaagcccugaagugggcaggggaa

SEQ ID NO: 363015 - RNA, 31 nt, Human
ccagaacauacuuauauguaaaguauuauuu

SEQ ID NO: 363016 - RNA, 32 nt, Human
ccagaacauuuacuucaacucuaccuuaguag

SEQ ID NO: 363017 - RNA, 32 nt, Human
ccagaacccaggaggcagagcuugcagugagc

SEQ ID NO: 363018 - RNA, 32 nt, Human
ccagaaccccugcaaaucacacaugaccuuug

SEQ ID NO: 363019 - RNA, 32 nt, Human
ccagaaccccugcgaaucacacaugaccuuug

SEQ ID NO: 363020 - RNA, 32 nt, Human
ccagaaccccuggcagccacagagcucaggcu

SEQ ID NO: 363021 - RNA, 20 nt, Human
ccagaacccgcagcuguggg

SEQ ID NO: 363022 - RNA, 32 nt, Human
ccagaaccgcgaccuccgcaaccuugagcggc

SEQ ID NO: 363023 - RNA, 32 nt, Human
ccagaaccuauugagcuugcagggaagccaag

SEQ ID NO: 363024 - RNA, 32 nt, Human
ccagaaccucacugcguccuccuccuccaaaa

SEQ ID NO: 363025 - RNA, 19 nt, Human
ccagaaccuggacugaaga

SEQ ID NO: 363026 - RNA, 32 nt, Human
ccagaaccuggacugaagaaccaccuagaaau

SEQ ID NO: 363027 - RNA, 32 nt, Human
ccagaaccuggcaccgagcgaugaggagucca

SEQ ID NO: 363028 - RNA, 32 nt, Human
ccagaaccugggagacagcuucucagcaagga

SEQ ID NO: 363029 - RNA, 32 nt, Human
ccagaaccuucucugacaccagccuggcgccc

SEQ ID NO: 363030 - RNA, 32 nt, Human
ccagaacgacggaggaaggggcggagagggac

SEQ ID NO: 363031 - RNA, 30 nt, Human
ccagaacgagaaaggaaaagacucauauca

SEQ ID NO: 363032 - RNA, 32 nt, Human
ccagaacuaaacccuuccuuucccucugaugg

SEQ ID NO: 363033 - RNA, 32 nt, Human
ccagaacuaaggcauuaaagaaaauagcaaau

SEQ ID NO: 363034 - RNA, 21 nt, Human
ccagaacuagugccucuguag

SEQ ID NO: 363035 - RNA, 20 nt, Human
ccagaacucagcagcuccau

SEQ ID NO: 363036 - RNA, 32 nt, Human
ccagaacucauuuugugccacccauuuaggua

SEQ ID NO: 363037 - RNA, 32 nt, Human
ccagaacucccacuuugcggugcucugguacg

SEQ ID NO: 363038 - RNA, 20 nt, Human
ccagaacucugggaagccaa

SEQ ID NO: 363039 - RNA, 21 nt, Human
ccagaacugaagaggaagcaa

SEQ ID NO: 363040 - RNA, 32 nt, Human
ccagaacugcagcccauccucgcugggcucuu

SEQ ID NO: 363041 - RNA, 32 nt, Human
ccagaacugcagcccauccucgcugggcuguc

SEQ ID NO: 363042 - RNA, 32 nt, Human
ccagaacugcagcccguccucccugggcuguc

SEQ ID NO: 363043 - RNA, 32 nt, Human
ccagaacugcagcccguccucgcuggguuguc

SEQ ID NO: 363044 - RNA, 22 nt, Human
ccagaacugccugccacaggug

SEQ ID NO: 363045 - RNA, 28 nt, Human
ccagaacugccuuuggcccuacggaugg

SEQ ID NO: 363046 - RNA, 32 nt, Human
ccagaacuguguccaagguuuccucagauuug

SEQ ID NO: 363047 - RNA, 32 nt, Human
ccagaacuugcuggaaaugugccuacaauggc

SEQ ID NO: 363048 - RNA, 32 nt, Human
ccagaacuugugcccucccuguccuuagccua

SEQ ID NO: 363049 - RNA, 22 nt, Human
ccagaacuuuuaacucuuccag

SEQ ID NO: 363050 - RNA, 32 nt, Human
ccagaacuuuucacagccucccccucuuucuu

SEQ ID NO: 363051 - RNA, 32 nt, Human
ccagaagaaaaagcgauagcaagagaaacugu

SEQ ID NO: 363052 - RNA, 19 nt, Human
ccagaagaacugagacaca

SEQ ID NO: 363053 - RNA, 32 nt, Human
ccagaagaagagaccugcaacugugagagucc

SEQ ID NO: 363054 - RNA, 21 nt, Human
ccagaagaaucucuacaggga

SEQ ID NO: 363055 - RNA, 22 nt, Human
ccagaagacaggcugcagugag

SEQ ID NO: 363056 - RNA, 32 nt, Human
ccagaagacauccagucccugacuccaccugc

SEQ ID NO: 363057 - RNA, 32 nt, Human
ccagaagacccaaaggagaguacugguuugug

SEQ ID NO: 363058 - RNA, 32 nt, Human
ccagaagacccaggcaguguagcgacagccuc

SEQ ID NO: 363059 - RNA, 21 nt, Human
ccagaagacguccccaacuca

SEQ ID NO: 363060 - RNA, 32 nt, Human
ccagaagagagacaacaaucacugcagucagc

SEQ ID NO: 363061 - RNA, 32 nt, Human
ccagaagagcccuuaugccccugggccgcgcu

SEQ ID NO: 363062 - RNA, 23 nt, Human
ccagaagagccuuguggaggccg

SEQ ID NO: 363063 - RNA, 32 nt, Human
ccagaagaggagagcaaaggagucaggaaugg

SEQ ID NO: 363064 - RNA, 18 nt, Human
ccagaagaggcaucucca

SEQ ID NO: 363065 - RNA, 32 nt, Human
ccagaagaucaugcagucaucagucccacgga

SEQ ID NO: 363066 - RNA, 32 nt, Human
ccagaagauuccagucuuaaagaaacagaagg

SEQ ID NO: 363067 - RNA, 32 nt, Human
ccagaagcaaacaauuugugggccagugucaa

SEQ ID NO: 363068 - RNA, 22 nt, Human
ccagaagcaacaucccaucucu

SEQ ID NO: 363069 - RNA, 32 nt, Human
ccagaagcaagaaaaguuucuucucuccccuc

SEQ ID NO: 363070 - RNA, 25 nt, Human
ccagaagcacugggaucacaggugu

SEQ ID NO: 363071 - RNA, 17 nt, Human
ccagaagcagaaucuca

SEQ ID NO: 363072 - RNA, 32 nt, Human
ccagaagcagaugccagcgccaugcuuccuau

SEQ ID NO: 363073 - RNA, 19 nt, Human
ccagaagcagggaugccau

SEQ ID NO: 363074 - RNA, 32 nt, Human
ccagaagcaucucaagugagaacagcagcaag

SEQ ID NO: 363075 - RNA, 20 nt, Human
ccagaagccagacccaggcc

SEQ ID NO: 363076 - RNA, 32 nt, Human
ccagaagccagccggcuggcagcccccaucug

SEQ ID NO: 363077 - RNA, 32 nt, Human
ccagaagccagccuuucgcucccggacccggc

SEQ ID NO: 363078 - RNA, 20 nt, Human
ccagaagccccagcucuggc

SEQ ID NO: 363079 - RNA, 32 nt, Human
ccagaagcccccagaggugacagcuucaccug

SEQ ID NO: 363080 - RNA, 23 nt, Human
ccagaagccccucaugccaagcc

SEQ ID NO: 363081 - RNA, 26 nt, Human
ccagaagccccuggacacuccgggcc

SEQ ID NO: 363082 - RNA, 32 nt, Human
ccagaagcucaagagcagccugggcaauacag

SEQ ID NO: 363083 - RNA, 22 nt, Human
ccagaagcugccagcccaggcc

SEQ ID NO: 363084 - RNA, 32 nt, Human
ccagaagcugccguagaaagccaugcgcuacu

SEQ ID NO: 363085 - RNA, 18 nt, Human
ccagaagcuggacugcag

SEQ ID NO: 363086 - RNA, 32 nt, Human
ccagaagcuggacugcaguccacggcaccacu

SEQ ID NO: 363087 - RNA, 32 nt, Human
ccagaagcuguuggagagacauucaggagaga

SEQ ID NO: 363088 - RNA, 24 nt, Human
ccagaagcuugaagcugcagugag

SEQ ID NO: 363089 - RNA, 27 nt, Human
ccagaaggaaugaaggccugcagugag

SEQ ID NO: 363090 - RNA, 32 nt, Human
ccagaaggagauuuaaccauaguagaaagaau

SEQ ID NO: 363091 - RNA, 32 nt, Human
ccagaaggaggcugaagaguugcugcccgacu

SEQ ID NO: 363092 - RNA, 32 nt, Human
ccagaaggauccaagacaaaacagaucugaau

SEQ ID NO: 363093 - RNA, 32 nt, Human
ccagaaggcacaagccucccacugccccuuuc

SEQ ID NO: 363094 - RNA, 24 nt, Human
ccagaaggcagagcuugcagugag

SEQ ID NO: 363095 - RNA, 24 nt, Human
ccagaaggcagagguugcagugag

SEQ ID NO: 363096 - RNA, 24 nt, Human
ccagaaggcagagguuguagugag

SEQ ID NO: 363097 - RNA, 32 nt, Human
ccagaaggcaggcaggaagagacagagaugga

SEQ ID NO: 363098 - RNA, 32 nt, Human
ccagaaggcaucugcagaugcccacacaggcc

SEQ ID NO: 363099 - RNA, 32 nt, Human
ccagaaggcccuuugcuuaguuucuugguacu

SEQ ID NO: 363100 - RNA, 23 nt, Human
ccagaaggcgaagguugcaguga

SEQ ID NO: 363101 - RNA, 24 nt, Human
ccagaaggcggaaguugcagugag

SEQ ID NO: 363102 - RNA, 23 nt, Human
ccagaaggcggagguugcaguga

SEQ ID NO: 363103 - RNA, 24 nt, Human
ccagaaggcggagguugcagugag

SEQ ID NO: 363104 - RNA, 32 nt, Human
ccagaaggcggggagagcagcagcggcccaag

SEQ ID NO: 363105 - RNA, 32 nt, Human
ccagaaggcugccugagggccucugaggccuc

SEQ ID NO: 363106 - RNA, 32 nt, Human
ccagaagggaagggaguucuuucacagcuuuc

SEQ ID NO: 363107 - RNA, 32 nt, Human
ccagaagggacuggccucugcccacaccuuga

SEQ ID NO: 363108 - RNA, 32 nt, Human
ccagaagggagagaggcagcaagucagaaagu

SEQ ID NO: 363109 - RNA, 32 nt, Human
ccagaagggccugaaggacgggauuauuuuau

SEQ ID NO: 363110 - RNA, 22 nt, Human
ccagaaggggggagggacaccg

SEQ ID NO: 363111 - RNA, 24 nt, Human
ccagaaggucgaggcugcagugag

SEQ ID NO: 363112 - RNA, 24 nt, Human
ccagaaggugcagguugcagugag

SEQ ID NO: 363113 - RNA, 23 nt, Human
ccagaagguggagguggcaguga

SEQ ID NO: 363114 - RNA, 32 nt, Human
ccagaagguggcugagggaacugaggccagca

SEQ ID NO: 363115 - RNA, 24 nt, Human
ccagaagguugagacugcagugag

SEQ ID NO: 363116 - RNA, 32 nt, Human
ccagaaguaagcucugcauguuccccuuccug

SEQ ID NO: 363117 - RNA, 32 nt, Human
ccagaagucaggccucaguauacaucagagaa

SEQ ID NO: 363118 - RNA, 32 nt, Human
ccagaagucauuguauucaaagaagaauaagc

SEQ ID NO: 363119 - RNA, 32 nt, Human
ccagaaguccccaggcaggaguguggugggac

SEQ ID NO: 363120 - RNA, 32 nt, Human
ccagaagucugaagacuuuuuccccaggacau

SEQ ID NO: 363121 - RNA, 32 nt, Human
ccagaagugagggcccagaggucugggucccc

SEQ ID NO: 363122 - RNA, 31 nt, Human
ccagaaguggagagagaaugagaccuggaga

SEQ ID NO: 363123 - RNA, 23 nt, Human
ccagaaguucaagguuacaguga

SEQ ID NO: 363124 - RNA, 32 nt, Human
ccagaaguucaagguuacagugaacuacgauu

SEQ ID NO: 363125 - RNA, 24 nt, Human
ccagaaguucaaguuugcagugag

SEQ ID NO: 363126 - RNA, 19 nt, Human
ccagaaguugcugcagugg

SEQ ID NO: 363127 - RNA, 32 nt, Human
ccagaaguuugagaccagccuaggcaacauug

SEQ ID NO: 363128 - RNA, 32 nt, Human
ccagaaguuugagaccagccugggcaacauag

SEQ ID NO: 363129 - RNA, 32 nt, Human
ccagaaguuugagacuagccugggcaauauga

SEQ ID NO: 363130 - RNA, 24 nt, Human
ccagaaguuugaggcugcagugag

SEQ ID NO: 363131 - RNA, 32 nt, Human
ccagaauaaagugagggaaaucaggucuuuau

SEQ ID NO: 363132 - RNA, 32 nt, Human
ccagaauagaagggagagagaaaacauuucua

SEQ ID NO: 363133 - RNA, 25 nt, Human
ccagaauagcugggauuacaggcgu

SEQ ID NO: 363134 - RNA, 32 nt, Human
ccagaauaucugauccauuuuaaugguuggaa

SEQ ID NO: 363135 - RNA, 32 nt, Human
ccagaauauguggggaaaaagggcuauugcua

SEQ ID NO: 363136 - RNA, 32 nt, Human
ccagaaucaaacuuuacuuccccaaauaagca

SEQ ID NO: 363137 - RNA, 32 nt, Human
ccagaaucccucagcugcacugaagacgagcc

SEQ ID NO: 363138 - RNA, 32 nt, Human
ccagaaucgguugcagaagaucaugggcaucu

SEQ ID NO: 363139 - RNA, 32 nt, Human
ccagaaucuauccugcaucgcagcccaccgug

SEQ ID NO: 363140 - RNA, 32 nt, Human
ccagaaucucaaggagcugcuggccgucaggg

SEQ ID NO: 363141 - RNA, 32 nt, Human
ccagaaucucgcucugcacuccagccuaggug

SEQ ID NO: 363142 - RNA, 32 nt, Human
ccagaaucuggaccccagagucuggaagcagg

SEQ ID NO: 363143 - RNA, 23 nt, Human
ccagaaucugggccaccccagca

SEQ ID NO: 363144 - RNA, 32 nt, Human
ccagaaugagacacaggaggagccacagccug

SEQ ID NO: 363145 - RNA, 32 nt, Human
ccagaaugcaggcauuucuguaccaaaaggca

SEQ ID NO: 363146 - RNA, 32 nt, Human
ccagaaugccaccaucccaccucugagacucc

SEQ ID NO: 363147 - RNA, 24 nt, Human
ccagaaugccaggauuacagaugu

SEQ ID NO: 363148 - RNA, 20 nt, Human
ccagaaugccuggacugcag

SEQ ID NO: 363149 - RNA, 32 nt, Human
ccagaaugccuggacugcaguggauguacccc

SEQ ID NO: 363150 - RNA, 24 nt, Human
ccagaaugcugggauuacaggcgu

SEQ ID NO: 363151 - RNA, 32 nt, Human
ccagaauggagaucuccucucaucagucucac

SEQ ID NO: 363152 - RNA, 21 nt, Human
ccagaauggccuggggcucag

SEQ ID NO: 363153 - RNA, 18 nt, Human
ccagaaugguagauccac

SEQ ID NO: 363154 - RNA, 32 nt, Human
ccagaaugugaagacaaguaguagaagaaaau

SEQ ID NO: 363155 - RNA, 32 nt, Human
ccagaaugugccacuugacuuaucuuuauugu

SEQ ID NO: 363156 - RNA, 32 nt, Human
ccagaauguucuggacaugcaccaccagccgg

SEQ ID NO: 363157 - RNA, 18 nt, Human
ccagaauguucugggaua

SEQ ID NO: 363158 - RNA, 32 nt, Human
ccagaauuacuggccaagaugccucagcucau

SEQ ID NO: 363159 - RNA, 22 nt, Human
ccagaauucacccacccgggcc

SEQ ID NO: 363160 - RNA, 32 nt, Human
ccagaauuggggucgccccuccccagccggac

SEQ ID NO: 363161 - RNA, 32 nt, Human
ccagaauugugacugaaguguacccagagaca

SEQ ID NO: 363162 - RNA, 32 nt, Human
ccagaauuuaaaccuauacucacuuucccaaa

SEQ ID NO: 363163 - RNA, 32 nt, Human
ccagaauuuauuuccacaucugcucuuucagu

SEQ ID NO: 363164 - RNA, 32 nt, Human
ccagaauuugacuugacgggauggcuuacaag

SEQ ID NO: 363165 - RNA, 32 nt, Human
ccagaauuugcucucccacucagugugcucug

SEQ ID NO: 363166 - RNA, 32 nt, Human
ccagaauuuguaacugagaagaucuuuucuuu

SEQ ID NO: 363167 - RNA, 32 nt, Human
ccagacaaaacaauuauguuacauuccucaaa

SEQ ID NO: 363168 - RNA, 20 nt, Human
ccagacaacaaaugaggaca

SEQ ID NO: 363169 - RNA, 25 nt, Human
ccagacaacaaucagaaccaaagca

SEQ ID NO: 363170 - RNA, 32 nt, Human
ccagacaacuuuguacucccaccacccccaau

SEQ ID NO: 363171 - RNA, 32 nt, Human
ccagacaagacccuggacagaggcuggugggg

SEQ ID NO: 363172 - RNA, 22 nt, Human
ccagacaagagcugggaggcaa

SEQ ID NO: 363173 - RNA, 21 nt, Human
ccagacaaggcacagaggcaa

SEQ ID NO: 363174 - RNA, 32 nt, Human
ccagacaaggcccacugcaguuccuauggcgc

SEQ ID NO: 363175 - RNA, 20 nt, Human
ccagacaauaaagggaccaa

SEQ ID NO: 363176 - RNA, 32 nt, Human
ccagacaaucaagcucuugagcacagguuuag

SEQ ID NO: 363177 - RNA, 32 nt, Human
ccagacaaucaaguucuugagcacagguuuag

SEQ ID NO: 363178 - RNA, 32 nt, Human
ccagacaaugauuuucucuuuauguacucugu

SEQ ID NO: 363179 - RNA, 32 nt, Human
ccagacacaggcagaccuggcgcucuugaccc

SEQ ID NO: 363180 - RNA, 19 nt, Human
ccagacacaggccgggaca

SEQ ID NO: 363181 - RNA, 32 nt, Human
ccagacacaggcuugggaaagacacgucaaaa

SEQ ID NO: 363182 - RNA, 32 nt, Human
ccagacacaggucccugagccuuggggagucc

SEQ ID NO: 363183 - RNA, 26 nt, Human
ccagacacaguaggacaaauauugua

SEQ ID NO: 363184 - RNA, 22 nt, Human
ccagacacagugcgguaccaga

SEQ ID NO: 363185 - RNA, 32 nt, Human
ccagacacauacaaguuccuauccugauucug

SEQ ID NO: 363186 - RNA, 21 nt, Human
ccagacacaucgcacugugga

SEQ ID NO: 363187 - RNA, 32 nt, Human
ccagacacauguccaagaagcccaggaaaggc

SEQ ID NO: 363188 - RNA, 21 nt, Human
ccagacacauguuucucccca

SEQ ID NO: 363189 - RNA, 32 nt, Human
ccagacaccacuguccauccugugaggcuccc

SEQ ID NO: 363190 - RNA, 32 nt, Human
ccagacacccacccucgcuucagccacaguuu

SEQ ID NO: 363191 - RNA, 18 nt, Human
ccagacacccaggacuua

SEQ ID NO: 363192 - RNA, 32 nt, Human
ccagacaccccugcucuaguccuugccacaca

SEQ ID NO: 363193 - RNA, 32 nt, Human
ccagacacccgcugccccagugccaccucacc

SEQ ID NO: 363194 - RNA, 32 nt, Human
ccagacacccuacacauauugccuccuauucu

SEQ ID NO: 363195 - RNA, 19 nt, Human
ccagacaccgguuuuccua

SEQ ID NO: 363196 - RNA, 32 nt, Human
ccagacaccuccggcccacacagccguucacc

SEQ ID NO: 363197 - RNA, 32 nt, Human
ccagacaccugcccuaauccucagccugcuca

SEQ ID NO: 363198 - RNA, 24 nt, Human
ccagacaccuugcucccucuccca

SEQ ID NO: 363199 - RNA, 32 nt, Human
ccagacacguagcugggcuggagaagcggcca

SEQ ID NO: 363200 - RNA, 32 nt, Human
ccagacacucuucuucucccaccucacucucc

SEQ ID NO: 363201 - RNA, 32 nt, Human
ccagacacugcacccugacuggggauccugug

SEQ ID NO: 363202 - RNA, 32 nt, Human
ccagacacugcacucaugcagcggaaaggaca

SEQ ID NO: 363203 - RNA, 32 nt, Human
ccagacacuuauuaacaaacuuuuauuacuag

SEQ ID NO: 363204 - RNA, 32 nt, Human
ccagacagagcaggugcggggaagggaagggc

SEQ ID NO: 363205 - RNA, 32 nt, Human
ccagacagagugcuaggcaugggggcagaggu

SEQ ID NO: 363206 - RNA, 32 nt, Human
ccagacagccucccccuguccccucuaugacc

SEQ ID NO: 363207 - RNA, 24 nt, Human
ccagacaggaaggagaagaggcag

SEQ ID NO: 363208 - RNA, 17 nt, Human
ccagacaggacugcaga

SEQ ID NO: 363209 - RNA, 23 nt, Human
ccagacaggaggagugggacaga

SEQ ID NO: 363210 - RNA, 32 nt, Human
ccagacaggaggaucacuuaagcgcagaagau

SEQ ID NO: 363211 - RNA, 32 nt, Human
ccagacaggaugaaagcguaggagaacuuucu

SEQ ID NO: 363212 - RNA, 32 nt, Human
ccagacaggcagcaggagucucggcugacaua

SEQ ID NO: 363213 - RNA, 32 nt, Human
ccagacaggggagcagaugagggaggagccuu

SEQ ID NO: 363214 - RNA, 32 nt, Human
ccagacagguuauguuaccugcagaggcugcc

SEQ ID NO: 363215 - RNA, 20 nt, Human
ccagacagucacuuuuccca

SEQ ID NO: 363216 - RNA, 32 nt, Human
ccagacagucuacaacugcccccuccagccca

SEQ ID NO: 363217 - RNA, 32 nt, Human
ccagacagugucgcuaagugcauuucacaguu

SEQ ID NO: 363218 - RNA, 32 nt, Human
ccagacaguguuggucaggauggcagaagaga

SEQ ID NO: 363219 - RNA, 32 nt, Human
ccagacauacaucccuccucugguaccacagu

SEQ ID NO: 363220 - RNA, 32 nt, Human
ccagacaucacugagccagagacuggagaugc

SEQ ID NO: 363221 - RNA, 32 nt, Human
ccagacaucugacuaauggcucugugccacac

SEQ ID NO: 363222 - RNA, 32 nt, Human
ccagacaucugcauguucuuguccucacuugc

SEQ ID NO: 363223 - RNA, 32 nt, Human
ccagacaugagagcccugcugggcuuucuggc

SEQ ID NO: 363224 - RNA, 32 nt, Human
ccagacaugcauaggaauggccacagguuuac

SEQ ID NO: 363225 - RNA, 18 nt, Human
ccagacaugccacuguga

SEQ ID NO: 363226 - RNA, 31 nt, Human
ccagacauggaggcccuuccuccagucagau

SEQ ID NO: 363227 - RNA, 32 nt, Human
ccagacaugguggcucacaccuguaaucccaa

SEQ ID NO: 363228 - RNA, 32 nt, Human
ccagacaugguggcucaugccuguaaucccag

SEQ ID NO: 363229 - RNA, 32 nt, Human
ccagacaugguggcucaugccuguaaucucag

SEQ ID NO: 363230 - RNA, 18 nt, Human
ccagacaugguuuuuccc

SEQ ID NO: 363231 - RNA, 32 nt, Human
ccagacauuuuaauagagauugcuugagccau

SEQ ID NO: 363232 - RNA, 32 nt, Human
ccagaccaagaguacaggaaaucaaauuguug

SEQ ID NO: 363233 - RNA, 31 nt, Human
ccagaccaauaaaauaccugguugaaauaca

SEQ ID NO: 363234 - RNA, 32 nt, Human
ccagaccaaugaacaguuucaggcuggcgugg

SEQ ID NO: 363235 - RNA, 32 nt, Human
ccagaccacaauauuucuucuuccucagggac

SEQ ID NO: 363236 - RNA, 32 nt, Human
ccagaccacaugcaguuuucaugcgucaugcu

SEQ ID NO: 363237 - RNA, 32 nt, Human
ccagaccaccggccaggagagaccuucucucc

SEQ ID NO: 363238 - RNA, 20 nt, Human
ccagaccaccuuuucuucca

SEQ ID NO: 363239 - RNA, 16 nt, Human
ccagaccacucaggug

SEQ ID NO: 363240 - RNA, 32 nt, Human
ccagaccacuccaagcugcuucuagagggacu

SEQ ID NO: 363241 - RNA, 32 nt, Human
ccagaccagacaccuggcagcccugccucaua

SEQ ID NO: 363242 - RNA, 23 nt, Human
ccagaccagagggacucagacac

SEQ ID NO: 363243 - RNA, 32 nt, Human
ccagaccagaguuugaugccagcagcuucggc

SEQ ID NO: 363244 - RNA, 32 nt, Human
ccagaccaggcuggccagcauggugaaacccc

SEQ ID NO: 363245 - RNA, 32 nt, Human
ccagaccagucucccaggaggcugaggcugcu

SEQ ID NO: 363246 - RNA, 32 nt, Human
ccagaccauagugaaaccgugucucuacaaaa

SEQ ID NO: 363247 - RNA, 32 nt, Human
ccagaccaucgauuucccguugcugaccucac

SEQ ID NO: 363248 - RNA, 32 nt, Human
ccagaccauuuuagaaaaagauaaaaaguuaa

SEQ ID NO: 363249 - RNA, 22 nt, Human
ccagacccaaaagcuuuuccua

SEQ ID NO: 363250 - RNA, 24 nt, Human
ccagacccaacaaaccuccagcca

SEQ ID NO: 363251 - RNA, 32 nt, Human
ccagacccaagugauccucccaccucagccuc

SEQ ID NO: 363252 - RNA, 32 nt, Human
ccagacccaccuggccccagagccucaugcca

SEQ ID NO: 363253 - RNA, 21 nt, Human
ccagacccaggacucugcgac

SEQ ID NO: 363254 - RNA, 32 nt, Human
ccagacccagggaccuggaguguguuuggacu

SEQ ID NO: 363255 - RNA, 32 nt, Human
ccagacccagggggaggaaggguggaggggcc

SEQ ID NO: 363256 - RNA, 32 nt, Human
ccagacccagguuuucuaguucagaagacuaa

SEQ ID NO: 363257 - RNA, 19 nt, Human
ccagacccaucccacucuc

SEQ ID NO: 363258 - RNA, 32 nt, Human
ccagacccaugaccaccucuggcucuacuauu

SEQ ID NO: 363259 - RNA, 32 nt, Human
ccagacccaugugauuucugcuuucuucuuua

SEQ ID NO: 363260 - RNA, 32 nt, Human
ccagaccccacucaaaacgauuuggucagguu

SEQ ID NO: 363261 - RNA, 32 nt, Human
ccagaccccagccuuucuccucaggccuaaga

SEQ ID NO: 363262 - RNA, 21 nt, Human
ccagaccccccuccccgcugc

SEQ ID NO: 363263 - RNA, 32 nt, Human
ccagaccccgagccaccccaggaaaagcacaa

SEQ ID NO: 363264 - RNA, 32 nt, Human
ccagaccccucccagcccucuccuccuguucc

SEQ ID NO: 363265 - RNA, 32 nt, Human
ccagaccccuccugacugggucccaaagccaa

SEQ ID NO: 363266 - RNA, 32 nt, Human
ccagaccccuucucccugaccuggcucuucca

SEQ ID NO: 363267 - RNA, 23 nt, Human
ccagacccgccaccgcacccgga

SEQ ID NO: 363268 - RNA, 32 nt, Human
ccagacccuaaaggggagcccuggaugcaguc

SEQ ID NO: 363269 - RNA, 32 nt, Human
ccagacccucgaggcugccacuccgucguggu

SEQ ID NO: 363270 - RNA, 18 nt, Human
ccagacccugcacuuuca

SEQ ID NO: 363271 - RNA, 32 nt, Human
ccagacccugccaucccucccacccccgacca

SEQ ID NO: 363272 - RNA, 32 nt, Human
ccagacccugcccagggacccccaucaccagc

SEQ ID NO: 363273 - RNA, 32 nt, Human
ccagacccugcucuccugcgagaugggauugg

SEQ ID NO: 363274 - RNA, 32 nt, Human
ccagacccuggacuuagccaccagagagcuac

SEQ ID NO: 363275 - RNA, 25 nt, Human
ccagacccuggcacccuccugagcc

SEQ ID NO: 363276 - RNA, 24 nt, Human
ccagaccgcacagaggccuggggc

SEQ ID NO: 363277 - RNA, 32 nt, Human
ccagaccgcagaguucaaggaggccuuccagc

SEQ ID NO: 363278 - RNA, 31 nt, Human
ccagaccgccucucuggaagguguuguaggc

SEQ ID NO: 363279 - RNA, 23 nt, Human
ccagaccgcggccuucaguguca

SEQ ID NO: 363280 - RNA, 20 nt, Human
ccagaccggagccgcaggcc

SEQ ID NO: 363281 - RNA, 32 nt, Human
ccagaccgugccagacccaggugccccagugc

SEQ ID NO: 363282 - RNA, 18 nt, Human
ccagaccgugggagagcc

SEQ ID NO: 363283 - RNA, 20 nt, Human
ccagaccuagaccugggcca

SEQ ID NO: 363284 - RNA, 32 nt, Human
ccagaccucaacagcacagagcacuuccaggc

SEQ ID NO: 363285 - RNA, 19 nt, Human
ccagaccucagagaucuca

SEQ ID NO: 363286 - RNA, 18 nt, Human
ccagaccuccacauuccc

SEQ ID NO: 363287 - RNA, 32 nt, Human
ccagaccucggcgauaagaggcugcacagcga

SEQ ID NO: 363288 - RNA, 21 nt, Human
ccagaccugaaguguuuucca

SEQ ID NO: 363289 - RNA, 19 nt, Human
ccagaccugcaaacguccc

SEQ ID NO: 363290 - RNA, 32 nt, Human
ccagaccugcaaacguccccuccuggaagggg

SEQ ID NO: 363291 - RNA, 19 nt, Human
ccagaccugcagacgccca

SEQ ID NO: 363292 - RNA, 22 nt, Human
ccagaccugcagacgcccagau

SEQ ID NO: 363293 - RNA, 32 nt, Human
ccagaccugcagccccagacccgccguaguau

SEQ ID NO: 363294 - RNA, 19 nt, Human
ccagaccugcauccuccua

SEQ ID NO: 363295 - RNA, 20 nt, Human
ccagaccugccccccacccg

SEQ ID NO: 363296 - RNA, 19 nt, Human
ccagaccugccccccugga

SEQ ID NO: 363297 - RNA, 17 nt, Human
ccagaccugcccucagg

SEQ ID NO: 363298 - RNA, 24 nt, Human
ccagaccugcccugcucugugaca

SEQ ID NO: 363299 - RNA, 18 nt, Human
ccagaccugccucuuccc

SEQ ID NO: 363300 - RNA, 32 nt, Human
ccagaccugccugccuuccugacuucuguucc

SEQ ID NO: 363301 - RNA, 32 nt, Human
ccagaccugcucaugaagaaggcuccucggug

SEQ ID NO: 363302 - RNA, 21 nt, Human
ccagaccugcuccuuugaccc

SEQ ID NO: 363303 - RNA, 32 nt, Human
ccagaccugcugcagggcuguggcuggagaaa

SEQ ID NO: 363304 - RNA, 32 nt, Human
ccagaccugggagcuccuugagcccgggcugu

SEQ ID NO: 363305 - RNA, 18 nt, Human
ccagaccugggauuccca

SEQ ID NO: 363306 - RNA, 32 nt, Human
ccagaccugggcaggcagcaggcucaggccca

SEQ ID NO: 363307 - RNA, 32 nt, Human
ccagaccuggggaccccaccuacacaggggca

SEQ ID NO: 363308 - RNA, 32 nt, Human
ccagaccuggggacugaguggggaaaggaguu

SEQ ID NO: 363309 - RNA, 18 nt, Human
ccagaccugugcuuccua

SEQ ID NO: 363310 - RNA, 18 nt, Human
ccagaccugugugcccca

SEQ ID NO: 363311 - RNA, 32 nt, Human
ccagaccuguucugaccucaugagugucaaac

SEQ ID NO: 363312 - RNA, 32 nt, Human
ccagaccuugaaaagaacaugcucaaaauaaa

SEQ ID NO: 363313 - RNA, 32 nt, Human
ccagaccuugacacaaaggacaucaaacugcc

SEQ ID NO: 363314 - RNA, 32 nt, Human
ccagaccuuggcugugccuccugcucucuuca

SEQ ID NO: 363315 - RNA, 32 nt, Human
ccagaccuuguucacacucucacauguuuaga

SEQ ID NO: 363316 - RNA, 23 nt, Human
ccagacgaagaacauuguguccu

SEQ ID NO: 363317 - RNA, 32 nt, Human
ccagacgagaggagagaaagagguagaauauu

SEQ ID NO: 363318 - RNA, 32 nt, Human
ccagacgagcaaggagacucauggucugguuc

SEQ ID NO: 363319 - RNA, 32 nt, Human
ccagacgaggaagguauccagccucaagucau

SEQ ID NO: 363320 - RNA, 32 nt, Human
ccagacgaggggaugcagcccagagccaguaa

SEQ ID NO: 363321 - RNA, 22 nt, Human
ccagacgauuucagugaccaaa

SEQ ID NO: 363322 - RNA, 32 nt, Human
ccagacgcagaggcagucccagcccgcgauga

SEQ ID NO: 363323 - RNA, 32 nt, Human
ccagacgcaguggcucacgccuguaaucccag

SEQ ID NO: 363324 - RNA, 32 nt, Human
ccagacgcaguggcucaugccuguaaucccag

SEQ ID NO: 363325 - RNA, 32 nt, Human
ccagacgcaguggcucaugccuguaauccuag

SEQ ID NO: 363326 - RNA, 32 nt, Human
ccagacgccaaugccuccuaagccaggagcug

SEQ ID NO: 363327 - RNA, 32 nt, Human
ccagacgccacaccugcugugucccgagaguc

SEQ ID NO: 363328 - RNA, 32 nt, Human
ccagacgccaggagaacugaucaaguccgaga

SEQ ID NO: 363329 - RNA, 15 nt, Human
ccagacgcccaccuc

SEQ ID NO: 363330 - RNA, 32 nt, Human
ccagacgccuggcugcugaucgccuuccccac

SEQ ID NO: 363331 - RNA, 19 nt, Human
ccagacgcgaguccugcgc

SEQ ID NO: 363332 - RNA, 32 nt, Human
ccagacgcgccaggccuggagauggcuggaaa

SEQ ID NO: 363333 - RNA, 20 nt, Human
ccagacgcgccgccgcugcc

SEQ ID NO: 363334 - RNA, 32 nt, Human
ccagacgcgcugcagccuccagcccgcggcaa

SEQ ID NO: 363335 - RNA, 32 nt, Human
ccagacgcgggcgccacaugcccagccuggga

SEQ ID NO: 363336 - RNA, 19 nt, Human
ccagacgcugccgcugccg

SEQ ID NO: 363337 - RNA, 32 nt, Human
ccagacgcuguggcucacaccuguaaucccag

SEQ ID NO: 363338 - RNA, 32 nt, Human
ccagacggacaagccuguguacagaccccagc

SEQ ID NO: 363339 - RNA, 32 nt, Human
ccagacggcugaaccccuggccccagagcccc

SEQ ID NO: 363340 - RNA, 24 nt, Human
ccagacggcugggauuccaggcgu

SEQ ID NO: 363341 - RNA, 32 nt, Human
ccagacggggcggcuggcugggcagaggggcu

SEQ ID NO: 363342 - RNA, 32 nt, Human
ccagacggggcuggagugugaggguccugcag

SEQ ID NO: 363343 - RNA, 32 nt, Human
ccagacgguagaacaaaaggaagaauauugau

SEQ ID NO: 363344 - RNA, 32 nt, Human
ccagacgguaucuccuggaugccagugagcgg

SEQ ID NO: 363345 - RNA, 32 nt, Human
ccagacggugaaggccaaccagcuggagcugg

SEQ ID NO: 363346 - RNA, 28 nt, Human
ccagacgucugugcugccugguuugcau

SEQ ID NO: 363347 - RNA, 32 nt, Human
ccagacgugauggcacauaccuguaauccaag

SEQ ID NO: 363348 - RNA, 32 nt, Human
ccagacgugguagcucacaccuguaaucccag

SEQ ID NO: 363349 - RNA, 32 nt, Human
ccagacgugguggcaugcgccuguaaucccag

SEQ ID NO: 363350 - RNA, 32 nt, Human
ccagacgugguggcgggcgccuguaaucccag

SEQ ID NO: 363351 - RNA, 32 nt, Human
ccagacgugguggcucacaccuguaaucccag

SEQ ID NO: 363352 - RNA, 32 nt, Human
ccagacgugguggugggugccuguaauccaac

SEQ ID NO: 363353 - RNA, 32 nt, Human
ccagacuaacuugggcaacacagggcgacccc

SEQ ID NO: 363354 - RNA, 20 nt, Human
ccagacuaacuuuacuguga

SEQ ID NO: 363355 - RNA, 32 nt, Human
ccagacuacagccugggugacagagugagauc

SEQ ID NO: 363356 - RNA, 32 nt, Human
ccagacucaagccauccucccaccucaaccuc

SEQ ID NO: 363357 - RNA, 32 nt, Human
ccagacucaagugauccuuccaccucagccuc

SEQ ID NO: 363358 - RNA, 32 nt, Human
ccagacucacacaucuuccuccaggucaggga

SEQ ID NO: 363359 - RNA, 32 nt, Human
ccagacucagagggcagcaggagcagcagcag

SEQ ID NO: 363360 - RNA, 32 nt, Human
ccagacucagauggugucucacuguggcaucc

SEQ ID NO: 363361 - RNA, 19 nt, Human
ccagacucaucccacucuc

SEQ ID NO: 363362 - RNA, 32 nt, Human
ccagacucauggccccagcugccuccugggcu

SEQ ID NO: 363363 - RNA, 32 nt, Human
ccagacuccaaagcccugguccuuuccugaug

SEQ ID NO: 363364 - RNA, 18 nt, Human
ccagacuccagaugucga

SEQ ID NO: 363365 - RNA, 20 nt, Human
ccagacuccaggccgccugc

SEQ ID NO: 363366 - RNA, 19 nt, Human
ccagacucccagcaggaca

SEQ ID NO: 363367 - RNA, 21 nt, Human
ccagacuccccaacugaaaca

SEQ ID NO: 363368 - RNA, 32 nt, Human
ccagacuccccaacugaaacaccagaagguuu

SEQ ID NO: 363369 - RNA, 32 nt, Human
ccagacuccuucccaucucuuuaguucuuccu

SEQ ID NO: 363370 - RNA, 19 nt, Human
ccagacuccuuuccucuga

SEQ ID NO: 363371 - RNA, 32 nt, Human
ccagacucgccacucucgaccagcacaagcuu

SEQ ID NO: 363372 - RNA, 32 nt, Human
ccagacucuccuccucuuaccuuugugccuug

SEQ ID NO: 363373 - RNA, 32 nt, Human
ccagacucuccucugaacucgggccucacaug

SEQ ID NO: 363374 - RNA, 32 nt, Human
ccagacucugagcugcucaccggagucauugg

SEQ ID NO: 363375 - RNA, 24 nt, Human
ccagacucugccaaaaccaagaua

SEQ ID NO: 363376 - RNA, 32 nt, Human
ccagacucugcucucccagcacugacucacuc

SEQ ID NO: 363377 - RNA, 32 nt, Human
ccagacucugucucccccuugaggucacagau

SEQ ID NO: 363378 - RNA, 32 nt, Human
ccagacucuuaguguugcguccugccuuguuu

SEQ ID NO: 363379 - RNA, 22 nt, Human
ccagacucuucacuccgcggca

SEQ ID NO: 363380 - RNA, 32 nt, Human
ccagacucuucaggacacuugcuccugcagca

SEQ ID NO: 363381 - RNA, 32 nt, Human
ccagacucuuccuagccuuucuaaaccaaagu

SEQ ID NO: 363382 - RNA, 32 nt, Human
ccagacucuuccuggacuggcuugccuccucc

SEQ ID NO: 363383 - RNA, 32 nt, Human
ccagacugaagcaggaggauugcuugggccca

SEQ ID NO: 363384 - RNA, 32 nt, Human
ccagacugaucuugagcuucugagcuccagcg

SEQ ID NO: 363385 - RNA, 18 nt, Human
ccagacugcagagcaaga

SEQ ID NO: 363386 - RNA, 32 nt, Human
ccagacugcagccuggcccauggcuguuuucc

SEQ ID NO: 363387 - RNA, 19 nt, Human
ccagacugcauucuggaua

SEQ ID NO: 363388 - RNA, 32 nt, Human
ccagacugccacugccccugucacugcaccca

SEQ ID NO: 363389 - RNA, 32 nt, Human
ccagacugccuucuguauuccccuguguacag

SEQ ID NO: 363390 - RNA, 32 nt, Human
ccagacugcguccuuuuuaagcgaacauuuua

SEQ ID NO: 363391 - RNA, 16 nt, Human
ccagacuggacugcag

SEQ ID NO: 363392 - RNA, 32 nt, Human
ccagacuggagugcaauggugcggucacagcu

SEQ ID NO: 363393 - RNA, 19 nt, Human
ccagacuggagugcagugg

SEQ ID NO: 363394 - RNA, 32 nt, Human
ccagacugggaaccaccaucugagacaggacc

SEQ ID NO: 363395 - RNA, 32 nt, Human
ccagacugggcaacauggugagacucugccuc

SEQ ID NO: 363396 - RNA, 32 nt, Human
ccagacugggcaauauagcaagaccccaucuc

SEQ ID NO: 363397 - RNA, 32 nt, Human
ccagacugggccaccaggaguucaagaccagc

SEQ ID NO: 363398 - RNA, 32 nt, Human
ccagacuggggaggggcagggggagaggcccc

SEQ ID NO: 363399 - RNA, 32 nt, Human
ccagacugggggcccuuccagacugggggccc

SEQ ID NO: 363400 - RNA, 32 nt, Human
ccagacugucuucaaauucuucugccuagccu

SEQ ID NO: 363401 - RNA, 32 nt, Human
ccagacugugaauccugugcucugcccgugac

SEQ ID NO: 363402 - RNA, 32 nt, Human
ccagacugugagcuccuugagggcagggacug

SEQ ID NO: 363403 - RNA, 32 nt, Human
ccagacuguguccuccaucaccgcagggucgg

SEQ ID NO: 363404 - RNA, 32 nt, Human
ccagacuuaacccagcagacacucugacauca

SEQ ID NO: 363405 - RNA, 32 nt, Human
ccagacuucauaccagcucccaacaccaugac

SEQ ID NO: 363406 - RNA, 32 nt, Human
ccagacuucauuuugacagcuaccuuagauca

SEQ ID NO: 363407 - RNA, 32 nt, Human
ccagacuucccuaaauucccugccuuacgguu

SEQ ID NO: 363408 - RNA, 20 nt, Human
ccagacuucgcccagcgaca

SEQ ID NO: 363409 - RNA, 19 nt, Human
ccagacuucgcuauuccca

SEQ ID NO: 363410 - RNA, 32 nt, Human
ccagacuucugucuuuucagcugcagugaagg

SEQ ID NO: 363411 - RNA, 32 nt, Human
ccagacuugcagcaucagagucuccugagucg

SEQ ID NO: 363412 - RNA, 32 nt, Human
ccagacuugccagaggggucucuccccauagc

SEQ ID NO: 363413 - RNA, 18 nt, Human
ccagacuuggggcuguga

SEQ ID NO: 363414 - RNA, 32 nt, Human
ccagacuugucacuauggagugucacagucuu

SEQ ID NO: 363415 - RNA, 20 nt, Human
ccagacuuuaauguuccucc

SEQ ID NO: 363416 - RNA, 32 nt, Human
ccagacuuuagcagccuccuguucccauucuu

SEQ ID NO: 363417 - RNA, 32 nt, Human
ccagacuuucaaggagauacugcagugaguuu

SEQ ID NO: 363418 - RNA, 32 nt, Human
ccagacuuucucaagcuccuccucacugcccu

SEQ ID NO: 363419 - RNA, 32 nt, Human
ccagacuuucugaaauagaucuaaauuuugcc

SEQ ID NO: 363420 - RNA, 32 nt, Human
ccagacuuugaauuaguaacagcucuaagaug

SEQ ID NO: 363421 - RNA, 32 nt, Human
ccagacuuugagccugcaucuucuugcaucua

SEQ ID NO: 363422 - RNA, 32 nt, Human
ccagacuuugggaggccgaggcaggcggauca

SEQ ID NO: 363423 - RNA, 32 nt, Human
ccagagaaaagagccucagcaagagaguuuug

SEQ ID NO: 363424 - RNA, 20 nt, Human
ccagagaaaaggaagcuguu

SEQ ID NO: 363425 - RNA, 32 nt, Human
ccagagaaaccagcuaaaucaugacaccuuca

SEQ ID NO: 363426 - RNA, 32 nt, Human
ccagagaaacuuuuguucuucucuccuuggcc

SEQ ID NO: 363427 - RNA, 32 nt, Human
ccagagaacagccuugaccagagauguggaga

SEQ ID NO: 363428 - RNA, 32 nt, Human
ccagagaacagcguggucacccugccaaggga

SEQ ID NO: 363429 - RNA, 32 nt, Human
ccagagaacccccaacccaccugucccuggga

SEQ ID NO: 363430 - RNA, 32 nt, Human
ccagagaacccuacugugucaugugagcaggc

SEQ ID NO: 363431 - RNA, 32 nt, Human
ccagagaacgcccucaucucuccucaccccug

SEQ ID NO: 363432 - RNA, 32 nt, Human
ccagagaagccaugggccaccugcucugugcc

SEQ ID NO: 363433 - RNA, 32 nt, Human
ccagagaagcugcagaagacacaggcagggag

SEQ ID NO: 363434 - RNA, 32 nt, Human
ccagagaagggccccacagcgcagcggcgggc

SEQ ID NO: 363435 - RNA, 32 nt, Human
ccagagaaggugcggggccagcugcuaugugg

SEQ ID NO: 363436 - RNA, 19 nt, Human
ccagagaagguuuuuccca

SEQ ID NO: 363437 - RNA, 32 nt, Human
ccagagacacgcgaccauguuggggcucuugg

SEQ ID NO: 363438 - RNA, 32 nt, Human
ccagagacaggaaaauccucuggcuggcuaac

SEQ ID NO: 363439 - RNA, 32 nt, Human
ccagagacaugagguccugcugggacaaguac

SEQ ID NO: 363440 - RNA, 32 nt, Human
ccagagacauugaaggaaaugauaauuccuug

SEQ ID NO: 363441 - RNA, 32 nt, Human
ccagagaccaccccgcuccuugcugcagcuga

SEQ ID NO: 363442 - RNA, 32 nt, Human
ccagagaccauuuauuauaaagcugcaaagaa

SEQ ID NO: 363443 - RNA, 18 nt, Human
ccagagacccaagccaag

SEQ ID NO: 363444 - RNA, 32 nt, Human
ccagagaccccaacucugcccuggcuucucug

SEQ ID NO: 363445 - RNA, 32 nt, Human
ccagagaccccaccccucauacccccagggac

SEQ ID NO: 363446 - RNA, 32 nt, Human
ccagagacccuucagugcuguguguuuuuccu

SEQ ID NO: 363447 - RNA, 32 nt, Human
ccagagacgaagaaagaguccugggauuugua

SEQ ID NO: 363448 - RNA, 32 nt, Human
ccagagacuacccuuuucuccauagacgugac

SEQ ID NO: 363449 - RNA, 32 nt, Human
ccagagacucuuuucagcagaaaguuaugcuu

SEQ ID NO: 363450 - RNA, 32 nt, Human
ccagagacugccagcauccccuccagggaagg

SEQ ID NO: 363451 - RNA, 24 nt, Human
ccagagacuuccuggucaauacuc

SEQ ID NO: 363452 - RNA, 32 nt, Human
ccagagagaaacagaagugcugaggggucgca

SEQ ID NO: 363453 - RNA, 17 nt, Human
ccagagagaccaccaaa

SEQ ID NO: 363454 - RNA, 21 nt, Human
ccagagagagggagcccugua

SEQ ID NO: 363455 - RNA, 32 nt, Human
ccagagagagugagagagauugacagagaaag

SEQ ID NO: 363456 - RNA, 25 nt, Human
ccagagagcagcccacgggcaucac

SEQ ID NO: 363457 - RNA, 32 nt, Human
ccagagagcccgaggaggugucucaggcugcc

SEQ ID NO: 363458 - RNA, 32 nt, Human
ccagagagcucccaaaugcagaaggauucaaa

SEQ ID NO: 363459 - RNA, 32 nt, Human
ccagagagcugaaccugcaucccggaccugcg

SEQ ID NO: 363460 - RNA, 32 nt, Human
ccagagaggaaggggcugcugaggucugaugg

SEQ ID NO: 363461 - RNA, 32 nt, Human
ccagagaggagaaaacccuuucaagggaaauu

SEQ ID NO: 363462 - RNA, 32 nt, Human
ccagagaggagccuauggaauguggaucaaau

SEQ ID NO: 363463 - RNA, 32 nt, Human
ccagagaggaugacccaggucuuguaguggca

SEQ ID NO: 363464 - RNA, 21 nt, Human
ccagagaggcagcuuuuccca

SEQ ID NO: 363465 - RNA, 32 nt, Human
ccagagaggcccagauggaggcuguucauucc

SEQ ID NO: 363466 - RNA, 19 nt, Human
ccagagaggcccuaggggc

SEQ ID NO: 363467 - RNA, 32 nt, Human
ccagagaggcugcaucagucucaggccccuaa

SEQ ID NO: 363468 - RNA, 32 nt, Human
ccagagaggcugcugcucauugagcugcacuc

SEQ ID NO: 363469 - RNA, 32 nt, Human
ccagagagugggggugaugaugaccaagaauu

SEQ ID NO: 363470 - RNA, 32 nt, Human
ccagagagugucacuccucuuugaagacgaug

SEQ ID NO: 363471 - RNA, 32 nt, Human
ccagagagugucuucgaggguaucaucauuuc

SEQ ID NO: 363472 - RNA, 32 nt, Human
ccagagauccccaucgaacugaaggaucacug

SEQ ID NO: 363473 - RNA, 32 nt, Human
ccagagaucucuguacuucaaggacagccuug

SEQ ID NO: 363474 - RNA, 32 nt, Human
ccagagaugccaccacuugugucuccacaaug

SEQ ID NO: 363475 - RNA, 32 nt, Human
ccagagaugccuguaauggugagacuuuggau

SEQ ID NO: 363476 - RNA, 21 nt, Human
ccagagauguaagacauguug

SEQ ID NO: 363477 - RNA, 32 nt, Human
ccagagauuucaucaagccauggauucuuggu

SEQ ID NO: 363478 - RNA, 32 nt, Human
ccagagcaacacagugagacccccaucucuac

SEQ ID NO: 363479 - RNA, 32 nt, Human
ccagagcaaggcuccugucacuccacucccug

SEQ ID NO: 363480 - RNA, 32 nt, Human
ccagagcaagugauccuggagcugcagccugc

SEQ ID NO: 363481 - RNA, 32 nt, Human
ccagagcacaagacugggggcaacuguagaug

SEQ ID NO: 363482 - RNA, 32 nt, Human
ccagagcaccugccugcccugccgaugugucc

SEQ ID NO: 363483 - RNA, 32 nt, Human
ccagagcacuccugccccuagccugggaccau

SEQ ID NO: 363484 - RNA, 32 nt, Human
ccagagcacucugcgcccccagccugccccag

SEQ ID NO: 363485 - RNA, 32 nt, Human
ccagagcacuuuacuccaggcagggccccugc

SEQ ID NO: 363486 - RNA, 32 nt, Human
ccagagcagaagcagggagaagggagugagga

SEQ ID NO: 363487 - RNA, 32 nt, Human
ccagagcagagaaacgccugaccugccugugu

SEQ ID NO: 363488 - RNA, 32 nt, Human
ccagagcagagcccaggaaucuggauuuugua

SEQ ID NO: 363489 - RNA, 32 nt, Human
ccagagcagagccccuuaccucccaggucaga

SEQ ID NO: 363490 - RNA, 32 nt, Human
ccagagcagagggucugaaaccuuagugagca

SEQ ID NO: 363491 - RNA, 32 nt, Human
ccagagcagcagagacagagccaggagcaguc

SEQ ID NO: 363492 - RNA, 32 nt, Human
ccagagcagccauggaggagguggugauugcc

SEQ ID NO: 363493 - RNA, 32 nt, Human
ccagagcagccccgcaccacccucgagcuuca

SEQ ID NO: 363494 - RNA, 32 nt, Human
ccagagcaggcagagggaaugacguggcaauu

SEQ ID NO: 363495 - RNA, 32 nt, Human
ccagagcagggcuggagggaaggagccaggag

SEQ ID NO: 363496 - RNA, 32 nt, Human
ccagagcagggugagcuggagcggcuguccau

SEQ ID NO: 363497 - RNA, 32 nt, Human
ccagagcaggguggacaggagagaccugaauc

SEQ ID NO: 363498 - RNA, 32 nt, Human
ccagagcaggguggcgcaggagcuggcaagac

SEQ ID NO: 363499 - RNA, 32 nt, Human
ccagagcagugcacuccagucugcagguacug

SEQ ID NO: 363500 - RNA, 32 nt, Human
ccagagcauugacuuccucuuccuagacuuga

SEQ ID NO: 363501 - RNA, 32 nt, Human
ccagagccaaagcuggagcccagaccguagcu

SEQ ID NO: 363502 - RNA, 32 nt, Human
ccagagccaagcggcggcagagcgaggggcau

SEQ ID NO: 363503 - RNA, 32 nt, Human
ccagagccaaugaggucaucucauccuugagg

SEQ ID NO: 363504 - RNA, 32 nt, Human
ccagagccacauccuuuaucgaggaagcuggg

SEQ ID NO: 363505 - RNA, 32 nt, Human
ccagagccacaugugcucaucaaacuugcauu

SEQ ID NO: 363506 - RNA, 32 nt, Human
ccagagccacuagcaaucucacccuaagagga

SEQ ID NO: 363507 - RNA, 20 nt, Human
ccagagccagcuagcccaca

SEQ ID NO: 363508 - RNA, 18 nt, Human
ccagagccaggagaguug

SEQ ID NO: 363509 - RNA, 21 nt, Human
ccagagccagggagccccaua

SEQ ID NO: 363510 - RNA, 32 nt, Human
ccagagccagggagcccuuagccucaacucug

SEQ ID NO: 363511 - RNA, 21 nt, Human
ccagagccaggggacagguug

SEQ ID NO: 363512 - RNA, 32 nt, Human
ccagagccauggacucuacacugugaacuugg

SEQ ID NO: 363513 - RNA, 32 nt, Human
ccagagcccacccucccaagcucaggggcauc

SEQ ID NO: 363514 - RNA, 32 nt, Human
ccagagcccaccuccccaacaugugaagacag

SEQ ID NO: 363515 - RNA, 32 nt, Human
ccagagcccacuccaacuucggauccaaguug

SEQ ID NO: 363516 - RNA, 32 nt, Human
ccagagcccaggacacagcaguagacuggggc

SEQ ID NO: 363517 - RNA, 32 nt, Human
ccagagcccaggacugagggcuccucccgggc

SEQ ID NO: 363518 - RNA, 28 nt, Human
ccagagcccaggcuggccucaucugcac

SEQ ID NO: 363519 - RNA, 32 nt, Human
ccagagcccaggcugggcgcccaugcccagaa

SEQ ID NO: 363520 - RNA, 32 nt, Human
ccagagccccucugccccuccugccgacguca

SEQ ID NO: 363521 - RNA, 32 nt, Human
ccagagccccugccugccccaggggagccaga

SEQ ID NO: 363522 - RNA, 32 nt, Human
ccagagcccgggccuauuuugccaucucaguu

SEQ ID NO: 363523 - RNA, 32 nt, Human
ccagagcccuggauggugaugcgcuggcuggg

SEQ ID NO: 363524 - RNA, 32 nt, Human
ccagagcccuucggaaccucccgagagauggu

SEQ ID NO: 363525 - RNA, 20 nt, Human
ccagagccgcccgcgccgcc

SEQ ID NO: 363526 - RNA, 32 nt, Human
ccagagccgggacggcagcccaggcgcccggg

SEQ ID NO: 363527 - RNA, 32 nt, Human
ccagagccucaaggggcccagccacgucaaac

SEQ ID NO: 363528 - RNA, 32 nt, Human
ccagagccuccaaagagagcugaggggaugug

SEQ ID NO: 363529 - RNA, 32 nt, Human
ccagagccuccaggagccaggccuuuggacaa

SEQ ID NO: 363530 - RNA, 32 nt, Human
ccagagccuccaggagccaggccuuuggacac

SEQ ID NO: 363531 - RNA, 32 nt, Human
ccagagccuccccucuucuuguccuucagcca

SEQ ID NO: 363532 - RNA, 32 nt, Human
ccagagccucugcgccuccacagggaaaaggc

SEQ ID NO: 363533 - RNA, 32 nt, Human
ccagagccugagccacugcgccccgccagacg

SEQ ID NO: 363534 - RNA, 32 nt, Human
ccagagccugaguacaguuuccuuccaaaugg

SEQ ID NO: 363535 - RNA, 32 nt, Human
ccagagccuggggcuccugggcugcagaccug

SEQ ID NO: 363536 - RNA, 32 nt, Human
ccagagccuucucuucacauaaugggacaugc

SEQ ID NO: 363537 - RNA, 20 nt, Human
ccagagccuugcagagccag

SEQ ID NO: 363538 - RNA, 32 nt, Human
ccagagccuuucucugccaucagcccuacguc

SEQ ID NO: 363539 - RNA, 32 nt, Human
ccagagcgauguucccgcagagccggcacccg

SEQ ID NO: 363540 - RNA, 32 nt, Human
ccagagcggcagcccccggccucagaggcuau

SEQ ID NO: 363541 - RNA, 24 nt, Human
ccagagcuaaccugggaggugcug

SEQ ID NO: 363542 - RNA, 21 nt, Human
ccagagcuaagcauuuuccca

SEQ ID NO: 363543 - RNA, 32 nt, Human
ccagagcuacucuugcuaucaacucgccgcau

SEQ ID NO: 363544 - RNA, 32 nt, Human
ccagagcuagcgccuguggcucccgggcuggu

SEQ ID NO: 363545 - RNA, 32 nt, Human
ccagagcuaguugcugucugguguuugcuggu

SEQ ID NO: 363546 - RNA, 32 nt, Human
ccagagcucacugagccuccaccuggggucuc

SEQ ID NO: 363547 - RNA, 32 nt, Human
ccagagcucacugucuagcccagggugacaca

SEQ ID NO: 363548 - RNA, 20 nt, Human
ccagagcucagagcuaacca

SEQ ID NO: 363549 - RNA, 32 nt, Human
ccagagcucaggaagccaggcuggaggaagag

SEQ ID NO: 363550 - RNA, 32 nt, Human
ccagagcuccaaggacagccugaagaucucag

SEQ ID NO: 363551 - RNA, 32 nt, Human
ccagagcucccaagccccugcccgccacaucu

SEQ ID NO: 363552 - RNA, 32 nt, Human
ccagagcuccuauagggcaagacacuguuucu

SEQ ID NO: 363553 - RNA, 32 nt, Human
ccagagcuccucuccagucaaggcuguugggc

SEQ ID NO: 363554 - RNA, 32 nt, Human
ccagagcuccuggaggaaaggcagucgggacu

SEQ ID NO: 363555 - RNA, 32 nt, Human
ccagagcuccuugccaucugcuaagaagacug

SEQ ID NO: 363556 - RNA, 19 nt, Human
ccagagcucgggagaugcc

SEQ ID NO: 363557 - RNA, 32 nt, Human
ccagagcucgggaggaaggcaaagaggggaag

SEQ ID NO: 363558 - RNA, 32 nt, Human
ccagagcucuacaaggaauucuggccugacuc

SEQ ID NO: 363559 - RNA, 32 nt, Human
ccagagcucuccagagaugagccuccccuauc

SEQ ID NO: 363560 - RNA, 32 nt, Human
ccagagcugaagcagaacauuccagaacccgu

SEQ ID NO: 363561 - RNA, 20 nt, Human
ccagagcugaauaacauguu

SEQ ID NO: 363562 - RNA, 32 nt, Human
ccagagcugcagugggcagccuaggagugcca

SEQ ID NO: 363563 - RNA, 32 nt, Human
ccagagcugccagagaaaggaaaccucuuccc

SEQ ID NO: 363564 - RNA, 20 nt, Human
ccagagcugcccaccuccca

SEQ ID NO: 363565 - RNA, 32 nt, Human
ccagagcugcccucagcauccgggccgggacc

SEQ ID NO: 363566 - RNA, 18 nt, Human
ccagagcugccucuggga

SEQ ID NO: 363567 - RNA, 32 nt, Human
ccagagcugccucugggaagucugcaguaguu

SEQ ID NO: 363568 - RNA, 32 nt, Human
ccagagcugcugcugcucacugccaguccuug

SEQ ID NO: 363569 - RNA, 32 nt, Human
ccagagcugcuggcuccccuguuuacucugag

SEQ ID NO: 363570 - RNA, 32 nt, Human
ccagagcugcuucacauaucucaaccggccuc

SEQ ID NO: 363571 - RNA, 32 nt, Human
ccagagcugcuuguggguuucugggguggaag

SEQ ID NO: 363572 - RNA, 18 nt, Human
ccagagcuggacgugcug

SEQ ID NO: 363573 - RNA, 32 nt, Human
ccagagcuuccagauggaggugaugaugauga

SEQ ID NO: 363574 - RNA, 32 nt, Human
ccagagcuucuccaggaggccaagcagaggcu

SEQ ID NO: 363575 - RNA, 32 nt, Human
ccagaggaacacacccacaccaggccucagga

SEQ ID NO: 363576 - RNA, 32 nt, Human
ccagaggaacagcuucauucagagcaggggca

SEQ ID NO: 363577 - RNA, 32 nt, Human
ccagaggaagggacaccaagccuuggcucuac

SEQ ID NO: 363578 - RNA, 16 nt, Human
ccagaggaaggugcug

SEQ ID NO: 363579 - RNA, 32 nt, Human
ccagaggaaguggcagauuucucagugaauuu

SEQ ID NO: 363580 - RNA, 32 nt, Human
ccagaggacacacacaugcacgcaugcuguau

SEQ ID NO: 363581 - RNA, 32 nt, Human
ccagaggaccagccugggagaggcuuucuagc

SEQ ID NO: 363582 - RNA, 32 nt, Human
ccagaggacuccugcccugccacacccuggac

SEQ ID NO: 363583 - RNA, 32 nt, Human
ccagaggacugaccacagccuggcuggcagcu

SEQ ID NO: 363584 - RNA, 32 nt, Human
ccagaggagacgaacccaggagaguagcuggg

SEQ ID NO: 363585 - RNA, 32 nt, Human
ccagaggagagcugaagagaggagggggaggc

SEQ ID NO: 363586 - RNA, 32 nt, Human
ccagaggagaggggcaguguucccacccaccu

SEQ ID NO: 363587 - RNA, 32 nt, Human
ccagaggagaguggggugggucuggaaacccc

SEQ ID NO: 363588 - RNA, 32 nt, Human
ccagaggagcaauagcccugggccacaagcgu

SEQ ID NO: 363589 - RNA, 22 nt, Human
ccagaggagccccgccccugua

SEQ ID NO: 363590 - RNA, 32 nt, Human
ccagaggagcuccuuuccccagcaggccucac

SEQ ID NO: 363591 - RNA, 32 nt, Human
ccagaggaggagggcaaaggggcagaugcugc

SEQ ID NO: 363592 - RNA, 32 nt, Human
ccagaggaggcagcgggauuguaguggcgcgc

SEQ ID NO: 363593 - RNA, 32 nt, Human
ccagaggaggcaggcgagugagcgaguccgag

SEQ ID NO: 363594 - RNA, 32 nt, Human
ccagaggaggcagggguaggaaagcucuuggc

SEQ ID NO: 363595 - RNA, 24 nt, Human
ccagaggaggccacagaccccuca

SEQ ID NO: 363596 - RNA, 21 nt, Human
ccagaggaggcgagggacaga

SEQ ID NO: 363597 - RNA, 32 nt, Human
ccagaggaggcggaagaggagcccgagccugg

SEQ ID NO: 363598 - RNA, 32 nt, Human
ccagaggagggaggggcacagugaagaaggga

SEQ ID NO: 363599 - RNA, 32 nt, Human
ccagaggaggguggggucagggccgccccuuc

SEQ ID NO: 363600 - RNA, 32 nt, Human
ccagaggaguacggauuaaggggccgaagaaa

SEQ ID NO: 363601 - RNA, 32 nt, Human
ccagaggaguuucuuaaugagauauuuguauu

SEQ ID NO: 363602 - RNA, 32 nt, Human
ccagaggauaagccacugggcacugggcuggg

SEQ ID NO: 363603 - RNA, 32 nt, Human
ccagaggaucaccagugcauccuucaucacag

SEQ ID NO: 363604 - RNA, 32 nt, Human
ccagaggauuauuuuccugccuuggcagagga

SEQ ID NO: 363605 - RNA, 32 nt, Human
ccagaggauugcuucaucugauacguaggccu

SEQ ID NO: 363606 - RNA, 32 nt, Human
ccagaggcaaaguggaccuggcaaccacaaga

SEQ ID NO: 363607 - RNA, 32 nt, Human
ccagaggcacaagaggaggacaucccaugcgg

SEQ ID NO: 363608 - RNA, 19 nt, Human
ccagaggcacuuccaccuu

SEQ ID NO: 363609 - RNA, 22 nt, Human
ccagaggcagagguugcaauga

SEQ ID NO: 363610 - RNA, 23 nt, Human
ccagaggcagagguugcaaugag

SEQ ID NO: 363611 - RNA, 19 nt, Human
ccagaggcagagguugcag

SEQ ID NO: 363612 - RNA, 23 nt, Human
ccagaggcagagguugcagugag

SEQ ID NO: 363613 - RNA, 23 nt, Human
ccagaggcagagguugcggugag

SEQ ID NO: 363614 - RNA, 32 nt, Human
ccagaggcagcuccagccugggggacagguga

SEQ ID NO: 363615 - RNA, 32 nt, Human
ccagaggcagcugccaccgugcccucagccga

SEQ ID NO: 363616 - RNA, 32 nt, Human
ccagaggcaggcggagguugaagaaaggaacc

SEQ ID NO: 363617 - RNA, 32 nt, Human
ccagaggccacacuccgccuugcucagccccu

SEQ ID NO: 363618 - RNA, 32 nt, Human
ccagaggccacugaagaugguaggcaggauuc

SEQ ID NO: 363619 - RNA, 32 nt, Human
ccagaggccacugcaccugggcuaggggucca

SEQ ID NO: 363620 - RNA, 32 nt, Human
ccagaggccagaauggugggaaagacagaucc

SEQ ID NO: 363621 - RNA, 32 nt, Human
ccagaggccauggagcugagauugagacuagc

SEQ ID NO: 363622 - RNA, 32 nt, Human
ccagaggcccaaugcuggaauggcaccaucau

SEQ ID NO: 363623 - RNA, 32 nt, Human
ccagaggccccaggcucugugcugaugaacag

SEQ ID NO: 363624 - RNA, 32 nt, Human
ccagaggcccccacuuuccuaacucgugcucc

SEQ ID NO: 363625 - RNA, 32 nt, Human
ccagaggccugcagccucccacaugccuuaag

SEQ ID NO: 363626 - RNA, 32 nt, Human
ccagaggccugcugcagauggggaagagcugg

SEQ ID NO: 363627 - RNA, 32 nt, Human
ccagaggccuggcucaaggugaccucaccuuc

SEQ ID NO: 363628 - RNA, 32 nt, Human
ccagaggccugggugggaggggaccaagggug

SEQ ID NO: 363629 - RNA, 32 nt, Human
ccagaggcgcccagcaccuggagcucacugga

SEQ ID NO: 363630 - RNA, 22 nt, Human
ccagaggcggagguugcaguga

SEQ ID NO: 363631 - RNA, 23 nt, Human
ccagaggcggagguugcagugag

SEQ ID NO: 363632 - RNA, 23 nt, Human
ccagaggcggagguuguagugag

SEQ ID NO: 363633 - RNA, 18 nt, Human
ccagaggcggcagcccac

SEQ ID NO: 363634 - RNA, 32 nt, Human
ccagaggcgggcagggcagacugacggacgga

SEQ ID NO: 363635 - RNA, 32 nt, Human
ccagaggcgggcccugagccggcaccuccccu

SEQ ID NO: 363636 - RNA, 32 nt, Human
ccagaggcgguggagaggaggaaggggcgggg

SEQ ID NO: 363637 - RNA, 32 nt, Human
ccagaggcucaggccugggucuaaggggcacg

SEQ ID NO: 363638 - RNA, 23 nt, Human
ccagaggcugcaggacugggcac

SEQ ID NO: 363639 - RNA, 32 nt, Human
ccagaggcuggcagagggaaagggguacacug

SEQ ID NO: 363640 - RNA, 32 nt, Human
ccagaggcuuggucccacaggccagggaccaa

SEQ ID NO: 363641 - RNA, 32 nt, Human
ccagagggaacaguaacagcccaggggccuuu

SEQ ID NO: 363642 - RNA, 32 nt, Human
ccagagggaaggcagaaggagaugagggugau

SEQ ID NO: 363643 - RNA, 32 nt, Human
ccagagggagagaggacucuggaccuaggaaa

SEQ ID NO: 363644 - RNA, 20 nt, Human
ccagagggagcacagcccua

SEQ ID NO: 363645 - RNA, 21 nt, Human
ccagagggagguagagagccc

SEQ ID NO: 363646 - RNA, 24 nt, Human
ccagagggaugcaggagcccuaua

SEQ ID NO: 363647 - RNA, 32 nt, Human
ccagagggcccagccccagcuguugccuggcu

SEQ ID NO: 363648 - RNA, 20 nt, Human
ccagagggccccgcccagug

SEQ ID NO: 363649 - RNA, 32 nt, Human
ccagagggccugcuucccaugggcauugcaag

SEQ ID NO: 363650 - RNA, 32 nt, Human
ccagaggggagaggagagagccuggacagccu

SEQ ID NO: 363651 - RNA, 22 nt, Human
ccagaggggaggcucugggaca

SEQ ID NO: 363652 - RNA, 32 nt, Human
ccagaggggcagcuccaguacaggcagcggca

SEQ ID NO: 363653 - RNA, 32 nt, Human
ccagagggggcaggcaccagccaggguaugau

SEQ ID NO: 363654 - RNA, 32 nt, Human
ccagaggggucugaagcuguuugggaaagcag

SEQ ID NO: 363655 - RNA, 32 nt, Human
ccagaggggugggucagagcaguggaggggag

SEQ ID NO: 363656 - RNA, 32 nt, Human
ccagaggguccccagggacucugcaguguccu

SEQ ID NO: 363657 - RNA, 32 nt, Human
ccagaggguccucagcccuccugccugggcua

SEQ ID NO: 363658 - RNA, 32 nt, Human
ccagaggguggaaggagccaggacgcaccccc

SEQ ID NO: 363659 - RNA, 23 nt, Human
ccagaggucaagacugcagugag

SEQ ID NO: 363660 - RNA, 23 nt, Human
ccagaggucaaggcugcagugag

SEQ ID NO: 363661 - RNA, 19 nt, Human
ccagaggucagcauucuca

SEQ ID NO: 363662 - RNA, 32 nt, Human
ccagaggugaagcugcccagggcuccggaggu

SEQ ID NO: 363663 - RNA, 32 nt, Human
ccagaggugaaggagucagagaggcgacagga

SEQ ID NO: 363664 - RNA, 20 nt, Human
ccagagguggagguugcagu

SEQ ID NO: 363665 - RNA, 23 nt, Human
ccagagguggagguugcagugag

SEQ ID NO: 363666 - RNA, 32 nt, Human
ccagagguggcacaauggagcgaucuccagga

SEQ ID NO: 363667 - RNA, 32 nt, Human
ccagagguggcccuuguuuacagugaggacuc

SEQ ID NO: 363668 - RNA, 32 nt, Human
ccagagguggcugagccccaggagaggggacc

SEQ ID NO: 363669 - RNA, 22 nt, Human
ccagaggugucagagguggcug

SEQ ID NO: 363670 - RNA, 21 nt, Human
ccagagguguccuuggacuca

SEQ ID NO: 363671 - RNA, 32 nt, Human
ccagaggugugccagauccuuaggcaggauuu

SEQ ID NO: 363672 - RNA, 22 nt, Human
ccagagguuaagucugcaguga

SEQ ID NO: 363673 - RNA, 23 nt, Human
ccagagguuaagucugcagugag

SEQ ID NO: 363674 - RNA, 32 nt, Human
ccagagguuuccaaucagccuugccugcuuuc

SEQ ID NO: 363675 - RNA, 32 nt, Human
ccagagguuugcaaccagccugagcaaaauau

SEQ ID NO: 363676 - RNA, 32 nt, Human
ccagaguaaagucacugaagaguggaagcgag

SEQ ID NO: 363677 - RNA, 32 nt, Human
ccagaguaacaagauucuugguggugacagaa

SEQ ID NO: 363678 - RNA, 23 nt, Human
ccagaguaacagggauuacaggc

SEQ ID NO: 363679 - RNA, 32 nt, Human
ccagaguaacagggauuacaggcauacuccac

SEQ ID NO: 363680 - RNA, 18 nt, Human
ccagaguaaggauagagg

SEQ ID NO: 363681 - RNA, 32 nt, Human
ccagaguacuagggaaggaggaagggaggaca

SEQ ID NO: 363682 - RNA, 22 nt, Human
ccagaguacugggauuacaggc

SEQ ID NO: 363683 - RNA, 32 nt, Human
ccagaguagcccaagcccugaagucacugcuc

SEQ ID NO: 363684 - RNA, 25 nt, Human
ccagaguagcugggaccacaggugu

SEQ ID NO: 363685 - RNA, 24 nt, Human
ccagaguagcugggacuacaggug

SEQ ID NO: 363686 - RNA, 23 nt, Human
ccagaguagcugggauuacaggc

SEQ ID NO: 363687 - RNA, 24 nt, Human
ccagaguagcugggauuacaggcg

SEQ ID NO: 363688 - RNA, 32 nt, Human
ccagagucacagacugacacguuucccacugu

SEQ ID NO: 363689 - RNA, 32 nt, Human
ccagagucacaguguaaaguuagauguugaaa

SEQ ID NO: 363690 - RNA, 32 nt, Human
ccagagucacccaguuggugacugggaaaguu

SEQ ID NO: 363691 - RNA, 32 nt, Human
ccagagucagcggccacugaggccucagaggc

SEQ ID NO: 363692 - RNA, 32 nt, Human
ccagaguccaauaacucgugcucaucugcagc

SEQ ID NO: 363693 - RNA, 32 nt, Human
ccagaguccacuccaacuucggauccaaguug

SEQ ID NO: 363694 - RNA, 32 nt, Human
ccagagucccaaaugcugaauuauugaaccau

SEQ ID NO: 363695 - RNA, 32 nt, Human
ccagaguccuucaggggcaccccucugccuug

SEQ ID NO: 363696 - RNA, 32 nt, Human
ccagaguccuuguggcccacagcauagcacug

SEQ ID NO: 363697 - RNA, 23 nt, Human
ccagagucuaagacugcagugag

SEQ ID NO: 363698 - RNA, 32 nt, Human
ccagagucuccaagcccaucaagagcaaguuu

SEQ ID NO: 363699 - RNA, 24 nt, Human
ccagagucugaaggaauucaugga

SEQ ID NO: 363700 - RNA, 24 nt, Human
ccagagucugccacuggggcucag

SEQ ID NO: 363701 - RNA, 32 nt, Human
ccagagucugcguaacagucucccacuggcug

SEQ ID NO: 363702 - RNA, 32 nt, Human
ccagagucugugggaaaauggaacacauauuu

SEQ ID NO: 363703 - RNA, 32 nt, Human
ccagagugacacacccccuaggccccuacaua

SEQ ID NO: 363704 - RNA, 32 nt, Human
ccagagugaccccugccccaccccugugcauu

SEQ ID NO: 363705 - RNA, 24 nt, Human
ccagagugccaggaacacugugga

SEQ ID NO: 363706 - RNA, 32 nt, Human
ccagagugcccaggaggcaggcagugcggggu

SEQ ID NO: 363707 - RNA, 22 nt, Human
ccagagugcuaggauuacaggc

SEQ ID NO: 363708 - RNA, 24 nt, Human
ccagagugcugagauuacaggcgu

SEQ ID NO: 363709 - RNA, 25 nt, Human
ccagagugcugagauuuacaggcgu

SEQ ID NO: 363710 - RNA, 22 nt, Human
ccagagugcuggaauuacaagc

SEQ ID NO: 363711 - RNA, 22 nt, Human
ccagagugcuggaauuacuggc

SEQ ID NO: 363712 - RNA, 22 nt, Human
ccagagugcugggauuacaggc

SEQ ID NO: 363713 - RNA, 24 nt, Human
ccagagugcugggauuacaggcgu

SEQ ID NO: 363714 - RNA, 24 nt, Human
ccagagugcugggauuacaggugu

SEQ ID NO: 363715 - RNA, 23 nt, Human
ccagagugcugggauuuacaggc

SEQ ID NO: 363716 - RNA, 32 nt, Human
ccagaguggagaauuagaaaguaagacguguu

SEQ ID NO: 363717 - RNA, 32 nt, Human
ccagaguggcucacccuguccagaccuuugag

SEQ ID NO: 363718 - RNA, 32 nt, Human
ccagaguggcugggaugugggagcagcaucuc

SEQ ID NO: 363719 - RNA, 32 nt, Human
ccagagugggaccaaguccaacaguagcaugg

SEQ ID NO: 363720 - RNA, 32 nt, Human
ccagaguggggccaggacagugccucagagcu

SEQ ID NO: 363721 - RNA, 32 nt, Human
ccagaguggugaaauaacaaggccagccacau

SEQ ID NO: 363722 - RNA, 32 nt, Human
ccagagugucccauuggugccaaaaauacacg

SEQ ID NO: 363723 - RNA, 31 nt, Human
ccagagugugagagacgauugucucgucggc

SEQ ID NO: 363724 - RNA, 32 nt, Human
ccagaguguuacuggcuuacaaauuggauuga

SEQ ID NO: 363725 - RNA, 24 nt, Human
ccagaguguuaggauuacaggcgu

SEQ ID NO: 363726 - RNA, 32 nt, Human
ccagaguguucugccuugugcugccucccuuc

SEQ ID NO: 363727 - RNA, 32 nt, Human
ccagaguuaggguuugcgacuccgccucccug

SEQ ID NO: 363728 - RNA, 32 nt, Human
ccagaguucaaaugugacuccaccucuuaaaa

SEQ ID NO: 363729 - RNA, 32 nt, Human
ccagaguucaguccuggcuggaggagccacag

SEQ ID NO: 363730 - RNA, 24 nt, Human
ccagaguucugggauuacgggcgu

SEQ ID NO: 363731 - RNA, 32 nt, Human
ccagaguugcuguucccaccucuggcugugag

SEQ ID NO: 363732 - RNA, 32 nt, Human
ccagaguuggcuaugccuuuucagacauugau

SEQ ID NO: 363733 - RNA, 22 nt, Human
ccagaguuuaaaagggaaccaa

SEQ ID NO: 363734 - RNA, 32 nt, Human
ccagaguuugaaaccagccuagguaacauagu

SEQ ID NO: 363735 - RNA, 32 nt, Human
ccagaguuugcagccgaguagggacuccuccc

SEQ ID NO: 363736 - RNA, 32 nt, Human
ccagaguuugguuuggucccugguuuucaguc

SEQ ID NO: 363737 - RNA, 32 nt, Human
ccagaguuuuaucaaaaugcuuucugggccag

SEQ ID NO: 363738 - RNA, 32 nt, Human
ccagaguuuuuaugccucucccuggcauucuc

SEQ ID NO: 363739 - RNA, 32 nt, Human
ccagauaagaagcuggugccucuugucucucu

SEQ ID NO: 363740 - RNA, 32 nt, Human
ccagauaagaauagguguuccuuugugcucau

SEQ ID NO: 363741 - RNA, 32 nt, Human
ccagauaagcacuggugaaaucaaagaccaac

SEQ ID NO: 363742 - RNA, 22 nt, Human
ccagauacacccuguugccaua

SEQ ID NO: 363743 - RNA, 32 nt, Human
ccagauaccaugucaggauauuuuuagugucu

SEQ ID NO: 363744 - RNA, 32 nt, Human
ccagauacccagaugggaaggaaggagacagc

SEQ ID NO: 363745 - RNA, 32 nt, Human
ccagauacugaacaaguuagugcaaugaagua

SEQ ID NO: 363746 - RNA, 32 nt, Human
ccagauacuggcaauacuccagccuggugaca

SEQ ID NO: 363747 - RNA, 32 nt, Human
ccagauagaaacacugggacagugguuugaac

SEQ ID NO: 363748 - RNA, 32 nt, Human
ccagauagagaaauagugacaagugaagaaca

SEQ ID NO: 363749 - RNA, 24 nt, Human
ccagauagcagagguugcagugag

SEQ ID NO: 363750 - RNA, 21 nt, Human
ccagauagcagucaugacuua

SEQ ID NO: 363751 - RNA, 32 nt, Human
ccagauagccccacugcacuccagccugggug

SEQ ID NO: 363752 - RNA, 32 nt, Human
ccagauagccuccagcgccacagccuuuuacc

SEQ ID NO: 363753 - RNA, 22 nt, Human
ccagauagcuggcagagggcag

SEQ ID NO: 363754 - RNA, 23 nt, Human
ccagauagcugggccacaggcgu

SEQ ID NO: 363755 - RNA, 20 nt, Human
ccagauaucagccacuuuca

SEQ ID NO: 363756 - RNA, 16 nt, Human
ccagauauccaccccu

SEQ ID NO: 363757 - RNA, 32 nt, Human
ccagauaugauggcaggcgccuguaaucccag

SEQ ID NO: 363758 - RNA, 32 nt, Human
ccagauauuucaucugaagaguucacaggcua

SEQ ID NO: 363759 - RNA, 32 nt, Human
ccagauauuucccacaguucggccugcugacc

SEQ ID NO: 363760 - RNA, 32 nt, Human
ccagauauuucuucauuuucuuuuggaggacc

SEQ ID NO: 363761 - RNA, 32 nt, Human
ccagaucaacacaaaccuuaccccacccccac

SEQ ID NO: 363762 - RNA, 32 nt, Human
ccagaucaagggaaccucagaaauccauugaa

SEQ ID NO: 363763 - RNA, 32 nt, Human
ccagaucacaccauugcacuccagccuaggca

SEQ ID NO: 363764 - RNA, 32 nt, Human
ccagaucacagaaguauugugccauaugugga

SEQ ID NO: 363765 - RNA, 32 nt, Human
ccagaucacgcaccccagcuccggaagauggg

SEQ ID NO: 363766 - RNA, 32 nt, Human
ccagaucacgccacugcacucuagccugggca

SEQ ID NO: 363767 - RNA, 32 nt, Human
ccagaucacgccagugcacuccagccugagag

SEQ ID NO: 363768 - RNA, 20 nt, Human
ccagaucagcuccuaacccu

SEQ ID NO: 363769 - RNA, 32 nt, Human
ccagaucaggugugacguggaaaccaagcaug

SEQ ID NO: 363770 - RNA, 32 nt, Human
ccagaucagugcagaacucauggaggaggcuu

SEQ ID NO: 363771 - RNA, 32 nt, Human
ccagaucaguggaggaagaggagaaagaggga

SEQ ID NO: 363772 - RNA, 32 nt, Human
ccagaucauacccccuuccugccuguaacccu

SEQ ID NO: 363773 - RNA, 32 nt, Human
ccagaucaucccucgaguccccagcgagaaag

SEQ ID NO: 363774 - RNA, 32 nt, Human
ccagaucaugccacuguacuccagccuaggug

SEQ ID NO: 363775 - RNA, 32 nt, Human
ccagauccaagggaccucagaaauccauugaa

SEQ ID NO: 363776 - RNA, 32 nt, Human
ccagauccacaucuucacucaagccaggagag

SEQ ID NO: 363777 - RNA, 22 nt, Human
ccagauccacccccauuucaga

SEQ ID NO: 363778 - RNA, 32 nt, Human
ccagauccagaggcggcggcggcggcggcagc

SEQ ID NO: 363779 - RNA, 32 nt, Human
ccagauccagcuaggcuagauguacaguaucu

SEQ ID NO: 363780 - RNA, 32 nt, Human
ccagauccagcuuuaagccuuugauggucaac

SEQ ID NO: 363781 - RNA, 32 nt, Human
ccagauccccucccaguggcacccacgccacc

SEQ ID NO: 363782 - RNA, 18 nt, Human
ccagauccuccacuccca

SEQ ID NO: 363783 - RNA, 22 nt, Human
ccagauccugccaggagguggc

SEQ ID NO: 363784 - RNA, 18 nt, Human
ccagauccuggacucaga

SEQ ID NO: 363785 - RNA, 32 nt, Human
ccagauccuggacucagagcuguuugagcuga

SEQ ID NO: 363786 - RNA, 32 nt, Human
ccagauccuugaagcucacuccgccuccucac

SEQ ID NO: 363787 - RNA, 32 nt, Human
ccagaucgagccacugcauuccagccugggcg

SEQ ID NO: 363788 - RNA, 32 nt, Human
ccagaucgcaccacugcacuccagucuggcaa

SEQ ID NO: 363789 - RNA, 32 nt, Human
ccagaucgcaccauugcacucuagccugggca

SEQ ID NO: 363790 - RNA, 32 nt, Human
ccagaucgcagcugaaggaucuguugagcgcu

SEQ ID NO: 363791 - RNA, 32 nt, Human
ccagaucgcgacacugcacuccagccugggca

SEQ ID NO: 363792 - RNA, 32 nt, Human
ccagaucgcgccauugcacuccagccugggua

SEQ ID NO: 363793 - RNA, 32 nt, Human
ccagaucgcgccgcugcacuccagccugggcg

SEQ ID NO: 363794 - RNA, 32 nt, Human
ccagaucgcgguauauagagauaugcauuuua

SEQ ID NO: 363795 - RNA, 32 nt, Human
ccagaucguccggcucggaagggacgccggca

SEQ ID NO: 363796 - RNA, 32 nt, Human
ccagaucuaagaauggcuucaggcuggggcug

SEQ ID NO: 363797 - RNA, 32 nt, Human
ccagaucuauuuuucuaccagagagaggagca

SEQ ID NO: 363798 - RNA, 32 nt, Human
ccagaucucagaggagccuggcuaagcaaaac

SEQ ID NO: 363799 - RNA, 32 nt, Human
ccagaucucauccugccucauccugaguccca

SEQ ID NO: 363800 - RNA, 32 nt, Human
ccagaucucauggaaacuggcagggguccugu

SEQ ID NO: 363801 - RNA, 32 nt, Human
ccagaucuccaucuucagccuagaucucuuca

SEQ ID NO: 363802 - RNA, 32 nt, Human
ccagaucucugccugccaacaagccccguguu

SEQ ID NO: 363803 - RNA, 32 nt, Human
ccagaucugaaaagcaggcuugaggaggcaag

SEQ ID NO: 363804 - RNA, 32 nt, Human
ccagaucugaggccaagcuaugugcuagagcc

SEQ ID NO: 363805 - RNA, 19 nt, Human
ccagaucugauuuucucca

SEQ ID NO: 363806 - RNA, 32 nt, Human
ccagaucugccuggggucaggcugcuucuaaa

SEQ ID NO: 363807 - RNA, 20 nt, Human
ccagaucuggaagguggcug

SEQ ID NO: 363808 - RNA, 20 nt, Human
ccagaucugugcagcagcuu

SEQ ID NO: 363809 - RNA, 32 nt, Human
ccagaucuucccaucuuguggcauguggugcc

SEQ ID NO: 363810 - RNA, 32 nt, Human
ccagaucuuccucuugcucuucacugaggaau

SEQ ID NO: 363811 - RNA, 32 nt, Human
ccagaucuugaccccaauacaggggcuggaua

SEQ ID NO: 363812 - RNA, 32 nt, Human
ccagaugaccucacccacccaggacuucaugc

SEQ ID NO: 363813 - RNA, 32 nt, Human
ccagaugacugcagauaggcacacagaggugu

SEQ ID NO: 363814 - RNA, 32 nt, Human
ccagaugagagaucacggucaugaagaucagc

SEQ ID NO: 363815 - RNA, 32 nt, Human
ccagaugagaucuuacagggagagagauuggg

SEQ ID NO: 363816 - RNA, 15 nt, Human
ccagaugauuuuccu

SEQ ID NO: 363817 - RNA, 32 nt, Human
ccagaugcaaguggaacaacacccucaucugc

SEQ ID NO: 363818 - RNA, 32 nt, Human
ccagaugcagaggcagaggcagccacacagcc

SEQ ID NO: 363819 - RNA, 32 nt, Human
ccagaugcagcccagcaugacacugcccucag

SEQ ID NO: 363820 - RNA, 32 nt, Human
ccagaugcagcggggauucuguucucugacug

SEQ ID NO: 363821 - RNA, 17 nt, Human
ccagaugcagcugcaga

SEQ ID NO: 363822 - RNA, 32 nt, Human
ccagaugcagcuuuuacccauucuuuguccuu

SEQ ID NO: 363823 - RNA, 32 nt, Human
ccagaugcaguggcucaggccuguaaucccag

SEQ ID NO: 363824 - RNA, 16 nt, Human
ccagaugccacucucu

SEQ ID NO: 363825 - RNA, 32 nt, Human
ccagaugccagggaagggacagaggaaaacag

SEQ ID NO: 363826 - RNA, 32 nt, Human
ccagaugccaucaaauacauguuuccaauaaa

SEQ ID NO: 363827 - RNA, 32 nt, Human
ccagaugcccugcugagugucccugaaaccau

SEQ ID NO: 363828 - RNA, 32 nt, Human
ccagaugcccuggcaccucuaggaccaacugg

SEQ ID NO: 363829 - RNA, 32 nt, Human
ccagaugccugggaaggaacaucucccuucca

SEQ ID NO: 363830 - RNA, 28 nt, Human
ccagaugccuugcuuaccgaaagccucc

SEQ ID NO: 363831 - RNA, 32 nt, Human
ccagaugcgguggcacccgccuguaaucccag

SEQ ID NO: 363832 - RNA, 32 nt, Human
ccagaugcuaaagagaagaaacccaaagccaa

SEQ ID NO: 363833 - RNA, 32 nt, Human
ccagaugcuggaugagcucugggcaggguuga

SEQ ID NO: 363834 - RNA, 32 nt, Human
ccagauggaaggacaggcagcacgggagccag

SEQ ID NO: 363835 - RNA, 32 nt, Human
ccagauggaaggaggcaggcaugggggacacc

SEQ ID NO: 363836 - RNA, 23 nt, Human
ccagauggacuugaaggcucccu

SEQ ID NO: 363837 - RNA, 32 nt, Human
ccagauggagggguacugaggaagcaucugaa

SEQ ID NO: 363838 - RNA, 32 nt, Human
ccagauggagguggaggguugauuugggaagc

SEQ ID NO: 363839 - RNA, 32 nt, Human
ccagauggagucucgcuuuguugcccaggcug

SEQ ID NO: 363840 - RNA, 32 nt, Human
ccagauggauccucuacagugcuaacccaaac

SEQ ID NO: 363841 - RNA, 18 nt, Human
ccagauggcauuuucuca

SEQ ID NO: 363842 - RNA, 32 nt, Human
ccagauggccaaccuguccuuguuaaguuacu

SEQ ID NO: 363843 - RNA, 32 nt, Human
ccagauggccugaugacaacaagaguuuguga

SEQ ID NO: 363844 - RNA, 32 nt, Human
ccagauggcgccacugcacuccagccugagug

SEQ ID NO: 363845 - RNA, 32 nt, Human
ccagauggcucagugauccuugcagaacuucu

SEQ ID NO: 363846 - RNA, 32 nt, Human
ccagauggcucgcagagauugaggaacuugcc

SEQ ID NO: 363847 - RNA, 20 nt, Human
ccagauggcucuuuuuccca

SEQ ID NO: 363848 - RNA, 32 nt, Human
ccagauggcugaaccucugcccccggagcccc

SEQ ID NO: 363849 - RNA, 32 nt, Human
ccagauggcuucacugaaaccugcuuuuguaa

SEQ ID NO: 363850 - RNA, 32 nt, Human
ccagauggcuuugugauucccuccagugaagc

SEQ ID NO: 363851 - RNA, 32 nt, Human
ccagaugggaucuuacucuguugcccaggcug

SEQ ID NO: 363852 - RNA, 29 nt, Human
ccagaugggauuacugagucagaggaagu

SEQ ID NO: 363853 - RNA, 32 nt, Human
ccagaugggauuauaguccugcuucuggaaca

SEQ ID NO: 363854 - RNA, 32 nt, Human
ccagaugggcagaaggcagggugcacaggugg

SEQ ID NO: 363855 - RNA, 32 nt, Human
ccagaugggcugggccuuugggcccuccucag

SEQ ID NO: 363856 - RNA, 32 nt, Human
ccagauggggcagcuggcugggcagaggggcu

SEQ ID NO: 363857 - RNA, 32 nt, Human
ccagaugggggaggggaugacaaggcuaugga

SEQ ID NO: 363858 - RNA, 23 nt, Human
ccagauggguggaucaccugagg

SEQ ID NO: 363859 - RNA, 32 nt, Human
ccagauggguucuaaugcagcugcuggggccu

SEQ ID NO: 363860 - RNA, 32 nt, Human
ccagaugguggagcugggcucuucuggcaggg

SEQ ID NO: 363861 - RNA, 32 nt, Human
ccagauggugucagaggaguacgcaguuguau

SEQ ID NO: 363862 - RNA, 32 nt, Human
ccagaugguuccuacuuaaaugauuucauaag

SEQ ID NO: 363863 - RNA, 32 nt, Human
ccagaugguuugaggccgcagagccagaccau

SEQ ID NO: 363864 - RNA, 32 nt, Human
ccagauguaggcuuagccaguuuauuuucucu

SEQ ID NO: 363865 - RNA, 32 nt, Human
ccagaugucaggagggacugaccucaggaccu

SEQ ID NO: 363866 - RNA, 15 nt, Human
ccagauguccaccuc

SEQ ID NO: 363867 - RNA, 32 nt, Human
ccagauguccuccucagacuccugagaucgcc

SEQ ID NO: 363868 - RNA, 32 nt, Human
ccagaugugacucaccuuucugcugcccucuu

SEQ ID NO: 363869 - RNA, 32 nt, Human
ccagaugugauggcgcaugccuguaaucccag

SEQ ID NO: 363870 - RNA, 32 nt, Human
ccagaugugguggcacaugccuguaaucccag

SEQ ID NO: 363871 - RNA, 32 nt, Human
ccagaugugguggcaugcaucuguaguccaag

SEQ ID NO: 363872 - RNA, 32 nt, Human
ccagaugugguggcgcacaccuguaaucccag

SEQ ID NO: 363873 - RNA, 32 nt, Human
ccagaugugguggcucaugccuguaaucccaa

SEQ ID NO: 363874 - RNA, 29 nt, Human
ccagauguucacagaaggagaggaaaugu

SEQ ID NO: 363875 - RNA, 32 nt, Human
ccagauguucggagccucagcgugcccaaugc

SEQ ID NO: 363876 - RNA, 19 nt, Human
ccagauguugcuuucucca

SEQ ID NO: 363877 - RNA, 32 nt, Human
ccagauguuguucugucaguugccaaaggacu

SEQ ID NO: 363878 - RNA, 32 nt, Human
ccagauuaaccuuuguuuccucuucaguaaaa

SEQ ID NO: 363879 - RNA, 32 nt, Human
ccagauuacacuccagccugagucagcacccc

SEQ ID NO: 363880 - RNA, 32 nt, Human
ccagauucaagcaacucucugccucagccucc

SEQ ID NO: 363881 - RNA, 32 nt, Human
ccagauucaagcaauucuccugccucagccuc

SEQ ID NO: 363882 - RNA, 32 nt, Human
ccagauucaagcaauucuccuguuucagccuc

SEQ ID NO: 363883 - RNA, 32 nt, Human
ccagauucaagugauccucccaucucagccuc

SEQ ID NO: 363884 - RNA, 32 nt, Human
ccagauucacgccauucuccugccucagccuc

SEQ ID NO: 363885 - RNA, 32 nt, Human
ccagauuccacagcccaaauggcgggacaguu

SEQ ID NO: 363886 - RNA, 32 nt, Human
ccagauuccguacccucucucccgacagccug

SEQ ID NO: 363887 - RNA, 32 nt, Human
ccagauuccucuuuccuauucuuugguuaauu

SEQ ID NO: 363888 - RNA, 32 nt, Human
ccagauucuucaggauucuccgugaagggaua

SEQ ID NO: 363889 - RNA, 32 nt, Human
ccagauucuugagacguuucucuuucugaucu

SEQ ID NO: 363890 - RNA, 31 nt, Human
ccagauugaaaugaauucuguugaaaaagag

SEQ ID NO: 363891 - RNA, 32 nt, Human
ccagauugcaacaggcugggcuucaguggcag

SEQ ID NO: 363892 - RNA, 23 nt, Human
ccagauugcacaggauacugggu

SEQ ID NO: 363893 - RNA, 32 nt, Human
ccagauugcaccacuacacuccagccugggca

SEQ ID NO: 363894 - RNA, 32 nt, Human
ccagauugcaccacugcucucuagccugggca

SEQ ID NO: 363895 - RNA, 32 nt, Human
ccagauugcaccauugcccuccagccugagca

SEQ ID NO: 363896 - RNA, 32 nt, Human
ccagauugcccacugcacuccagccugggcaa

SEQ ID NO: 363897 - RNA, 18 nt, Human
ccagauugcucugcccca

SEQ ID NO: 363898 - RNA, 22 nt, Human
ccagauugcuggguuuacaggc

SEQ ID NO: 363899 - RNA, 29 nt, Human
ccagauuggcugcugaaauagccccuaac

SEQ ID NO: 363900 - RNA, 32 nt, Human
ccagauuggggugggagcaagggacagggagc

SEQ ID NO: 363901 - RNA, 32 nt, Human
ccagauugucagcuccuugagggcaagagcca

SEQ ID NO: 363902 - RNA, 32 nt, Human
ccagauugucauucuucagggauggcagcccu

SEQ ID NO: 363903 - RNA, 32 nt, Human
ccagauugugccacugcacuccagccugggca

SEQ ID NO: 363904 - RNA, 32 nt, Human
ccagauugugccacugcacucuagccucggug

SEQ ID NO: 363905 - RNA, 32 nt, Human
ccagauugugccacugcauucuagccugggcg

SEQ ID NO: 363906 - RNA, 32 nt, Human
ccagauugugccaggucagcugucccuuccuc

SEQ ID NO: 363907 - RNA, 21 nt, Human
ccagauuucagcuuugaguua

SEQ ID NO: 363908 - RNA, 18 nt, Human
ccagauuuccacucucuc

SEQ ID NO: 363909 - RNA, 32 nt, Human
ccagauuuccccucagcuuacaguuccugaau

SEQ ID NO: 363910 - RNA, 18 nt, Human
ccagauuucucuuuccca

SEQ ID NO: 363911 - RNA, 18 nt, Human
ccagauuucuguuuccca

SEQ ID NO: 363912 - RNA, 32 nt, Human
ccagauuucuuaauaccuggucuuccucaaag

SEQ ID NO: 363913 - RNA, 32 nt, Human
ccagauuugggcagaccagcagugcucgccag

SEQ ID NO: 363914 - RNA, 32 nt, Human
ccagauuuuacugccuuugcuaggcuuuugcu

SEQ ID NO: 363915 - RNA, 32 nt, Human
ccagauuuuguggagccuuaagacacucccuc

SEQ ID NO: 363916 - RNA, 32 nt, Human
ccagcaaaauagagucccucagggugacaguu

SEQ ID NO: 363917 - RNA, 18 nt, Human
ccagcaaacaggcauucu

SEQ ID NO: 363918 - RNA, 32 nt, Human
ccagcaaagcaaauguugggaaaguauuuacu

SEQ ID NO: 363919 - RNA, 32 nt, Human
ccagcaaagcagagaugagagcgugggaacug

SEQ ID NO: 363920 - RNA, 32 nt, Human
ccagcaaagcaguaugcucccgaucaaguaga

SEQ ID NO: 363921 - RNA, 32 nt, Human
ccagcaaaggacacaucucuccagcaaaggac

SEQ ID NO: 363922 - RNA, 32 nt, Human
ccagcaaaggagacgacacagacaagaccuca

SEQ ID NO: 363923 - RNA, 32 nt, Human
ccagcaaagugggaggaggaguggggauucua

SEQ ID NO: 363924 - RNA, 32 nt, Human
ccagcaaauaaaagcaggcagaaaaaugugaa

SEQ ID NO: 363925 - RNA, 19 nt, Human
ccagcaaaucaucgggcca

SEQ ID NO: 363926 - RNA, 32 nt, Human
ccagcaacaacaaaacaggucuacccuggagu

SEQ ID NO: 363927 - RNA, 32 nt, Human
ccagcaacaacaaaagaacuaguccucuuaga

SEQ ID NO: 363928 - RNA, 32 nt, Human
ccagcaacaagcgcauccugugcucagauaag

SEQ ID NO: 363929 - RNA, 32 nt, Human
ccagcaacacagagcuggcgacugcagcugca

SEQ ID NO: 363930 - RNA, 32 nt, Human
ccagcaacagacguuuccagccacuuuccucg

SEQ ID NO: 363931 - RNA, 19 nt, Human
ccagcaacagguucuccaa

SEQ ID NO: 363932 - RNA, 32 nt, Human
ccagcaacaucagagcugaacuucuuaagaaa

SEQ ID NO: 363933 - RNA, 32 nt, Human
ccagcaaccagcuccauccuggcugcuugccu

SEQ ID NO: 363934 - RNA, 23 nt, Human
ccagcaaccccccacccucccca

SEQ ID NO: 363935 - RNA, 32 nt, Human
ccagcaaccugcacuccagccugggugacaga

SEQ ID NO: 363936 - RNA, 32 nt, Human
ccagcaacuacacuccagacccgugcugaccc

SEQ ID NO: 363937 - RNA, 32 nt, Human
ccagcaacucucuugccccucuucccauauuu

SEQ ID NO: 363938 - RNA, 32 nt, Human
ccagcaacugggaggugggacugucagaagcu

SEQ ID NO: 363939 - RNA, 20 nt, Human
ccagcaacuguggccucucg

SEQ ID NO: 363940 - RNA, 32 nt, Human
ccagcaagaagguucagaacagccuggcuuug

SEQ ID NO: 363941 - RNA, 32 nt, Human
ccagcaagacuuccuguccugacgaggcacga

SEQ ID NO: 363942 - RNA, 32 nt, Human
ccagcaagagcugggcaacagcuggcuuguga

SEQ ID NO: 363943 - RNA, 19 nt, Human
ccagcaagaggaagcuguc

SEQ ID NO: 363944 - RNA, 32 nt, Human
ccagcaagagguggagcugccagccugaggug

SEQ ID NO: 363945 - RNA, 32 nt, Human
ccagcaagaguuucaggaaguggguugcuagg

SEQ ID NO: 363946 - RNA, 32 nt, Human
ccagcaagcagggcugcagugggagcugggag

SEQ ID NO: 363947 - RNA, 32 nt, Human
ccagcaagcauuucugcccuagcuaauucucc

SEQ ID NO: 363948 - RNA, 32 nt, Human
ccagcaaggaggggccggccagcucugcuugc

SEQ ID NO: 363949 - RNA, 32 nt, Human
ccagcaaggaguuuacagucaaacaggagaga

SEQ ID NO: 363950 - RNA, 32 nt, Human
ccagcaaggaugaagaaauggagcagcacaga

SEQ ID NO: 363951 - RNA, 32 nt, Human
ccagcaaggaugacguccugccaccuccugga

SEQ ID NO: 363952 - RNA, 32 nt, Human
ccagcaaggcccugccagcccacccaccagag

SEQ ID NO: 363953 - RNA, 32 nt, Human
ccagcaauaccccacuucaccuacaauaauug

SEQ ID NO: 363954 - RNA, 32 nt, Human
ccagcaauaccccacuucaccuacaauauugu

SEQ ID NO: 363955 - RNA, 22 nt, Human
ccagcaaugcagucacccaggg

SEQ ID NO: 363956 - RNA, 32 nt, Human
ccagcaaugcccugccuugcugccuucacccu

SEQ ID NO: 363957 - RNA, 32 nt, Human
ccagcaauugcacuccugggccucugacagag

SEQ ID NO: 363958 - RNA, 18 nt, Human
ccagcaauuucacucuca

SEQ ID NO: 363959 - RNA, 32 nt, Human
ccagcacacccacuuccaacuaucuguuaaaa

SEQ ID NO: 363960 - RNA, 22 nt, Human
ccagcacaccucaccuccaugc

SEQ ID NO: 363961 - RNA, 32 nt, Human
ccagcacaccucagcaagaugccaggauuggg

SEQ ID NO: 363962 - RNA, 32 nt, Human
ccagcacaccugcagguguaagggacgauugg

SEQ ID NO: 363963 - RNA, 19 nt, Human
ccagcacacgaccuacaca

SEQ ID NO: 363964 - RNA, 32 nt, Human
ccagcacacucgcucugcuccacacacgagac

SEQ ID NO: 363965 - RNA, 18 nt, Human
ccagcacagaacagcuca

SEQ ID NO: 363966 - RNA, 18 nt, Human
ccagcacagagcagagcu

SEQ ID NO: 363967 - RNA, 18 nt, Human
ccagcacagagggaccau

SEQ ID NO: 363968 - RNA, 24 nt, Human
ccagcacagaugccacuguccagg

SEQ ID NO: 363969 - RNA, 32 nt, Human
ccagcacagcacaggcgugugcacacagaggu

SEQ ID NO: 363970 - RNA, 32 nt, Human
ccagcacagccccagcccggagcccagccccc

SEQ ID NO: 363971 - RNA, 23 nt, Human
ccagcacagcguuggugcugccu

SEQ ID NO: 363972 - RNA, 32 nt, Human
ccagcacaggauucagcaaacauuuucuguaa

SEQ ID NO: 363973 - RNA, 32 nt, Human
ccagcacaggcagggguagaagcaaaggcagg

SEQ ID NO: 363974 - RNA, 32 nt, Human
ccagcacaggcagguguucacaggacacacac

SEQ ID NO: 363975 - RNA, 32 nt, Human
ccagcacaggcucuugcugggugccugugccc

SEQ ID NO: 363976 - RNA, 18 nt, Human
ccagcacagggccacaca

SEQ ID NO: 363977 - RNA, 18 nt, Human
ccagcacagugccucaca

SEQ ID NO: 363978 - RNA, 32 nt, Human
ccagcacauccagcaguggcaaaggagccccu

SEQ ID NO: 363979 - RNA, 32 nt, Human
ccagcacaugaggcugaggcugaggggcaguc

SEQ ID NO: 363980 - RNA, 21 nt, Human
ccagcacaugcaaagcuggcu

SEQ ID NO: 363981 - RNA, 32 nt, Human
ccagcacaugccacaauccuaugcucuugccu

SEQ ID NO: 363982 - RNA, 32 nt, Human
ccagcacauuucagaaggcugcugaauaguag

SEQ ID NO: 363983 - RNA, 20 nt, Human
ccagcaccaacagagccaag

SEQ ID NO: 363984 - RNA, 32 nt, Human
ccagcaccaagccuacccagcacauaguaggu

SEQ ID NO: 363985 - RNA, 32 nt, Human
ccagcaccacgauggccccaggacguuguuua

SEQ ID NO: 363986 - RNA, 32 nt, Human
ccagcaccagccuggccaacacggugaaaccc

SEQ ID NO: 363987 - RNA, 32 nt, Human
ccagcaccagggagguugggcagacaagaccu

SEQ ID NO: 363988 - RNA, 32 nt, Human
ccagcacccaagaaaagagggaagagacgcgu

SEQ ID NO: 363989 - RNA, 17 nt, Human
ccagcacccaagagcaa

SEQ ID NO: 363990 - RNA, 32 nt, Human
ccagcacccaccucccuacucucccucauggc

SEQ ID NO: 363991 - RNA, 32 nt, Human
ccagcacccagccggcccuccgucuccugagg

SEQ ID NO: 363992 - RNA, 32 nt, Human
ccagcaccccacuccagccucgaggaagcuuu

SEQ ID NO: 363993 - RNA, 32 nt, Human
ccagcaccccagccagccugguacgcagaucc

SEQ ID NO: 363994 - RNA, 32 nt, Human
ccagcaccccaggcagucugugugugaggcau

SEQ ID NO: 363995 - RNA, 18 nt, Human
ccagcacccccagcccca

SEQ ID NO: 363996 - RNA, 32 nt, Human
ccagcacccccagcuaccucccaggacagacc

SEQ ID NO: 363997 - RNA, 17 nt, Human
ccagcacccgggcucag

SEQ ID NO: 363998 - RNA, 21 nt, Human
ccagcacccucccugcuucug

SEQ ID NO: 363999 - RNA, 32 nt, Human
ccagcacccucuuccucuucuaaccugcuuuc

SEQ ID NO: 364000 - RNA, 18 nt, Human
ccagcacccuggcuccca

SEQ ID NO: 364001 - RNA, 19 nt, Human
ccagcacccuggggucuuu

SEQ ID NO: 364002 - RNA, 32 nt, Human
ccagcaccgccuagcccugccaccccacugcc

SEQ ID NO: 364003 - RNA, 20 nt, Human
ccagcaccggcgcgugcaca

SEQ ID NO: 364004 - RNA, 32 nt, Human
ccagcaccucaugcagcaagugcugccaauag

SEQ ID NO: 364005 - RNA, 32 nt, Human
ccagcaccucccaccaaccaaccacacccggu

SEQ ID NO: 364006 - RNA, 32 nt, Human
ccagcaccucccaccaaccagccacacccggu

SEQ ID NO: 364007 - RNA, 32 nt, Human
ccagcaccuccccuccuccagcuuccuggccu

SEQ ID NO: 364008 - RNA, 32 nt, Human
ccagcaccugcacccacaccaggcuggagcca

SEQ ID NO: 364009 - RNA, 32 nt, Human
ccagcaccugcucucaccaugaccucgccugg

SEQ ID NO: 364010 - RNA, 32 nt, Human
ccagcaccugcucuccccguuccuccccaccu

SEQ ID NO: 364011 - RNA, 32 nt, Human
ccagcaccugggcagguacaagcacgaaaucc

SEQ ID NO: 364012 - RNA, 21 nt, Human
ccagcaccuucugcccuuccc

SEQ ID NO: 364013 - RNA, 32 nt, Human
ccagcaccuugaucuugaacuucucagccucc

SEQ ID NO: 364014 - RNA, 24 nt, Human
ccagcacgaccgaggagguggcug

SEQ ID NO: 364015 - RNA, 21 nt, Human
ccagcacgagauggaccaccu

SEQ ID NO: 364016 - RNA, 23 nt, Human
ccagcacgcaugcccacaggcca

SEQ ID NO: 364017 - RNA, 32 nt, Human
ccagcacgcccuggcccggcagcugcugcucu

SEQ ID NO: 364018 - RNA, 21 nt, Human
ccagcacgccggagcuggccu

SEQ ID NO: 364019 - RNA, 32 nt, Human
ccagcacgcguugcggcagccuggcgagcguc

SEQ ID NO: 364020 - RNA, 32 nt, Human
ccagcacgcuaagcuccagucggcgccgaagg

SEQ ID NO: 364021 - RNA, 21 nt, Human
ccagcacgcuggacugcgaga

SEQ ID NO: 364022 - RNA, 32 nt, Human
ccagcacggaaggugggcugaggcccagggug

SEQ ID NO: 364023 - RNA, 32 nt, Human
ccagcacggccuccccuccacuuccagucugu

SEQ ID NO: 364024 - RNA, 19 nt, Human
ccagcacgggcggagccgc

SEQ ID NO: 364025 - RNA, 20 nt, Human
ccagcacggugaaaccccgu

SEQ ID NO: 364026 - RNA, 19 nt, Human
ccagcacgucgccugggcu

SEQ ID NO: 364027 - RNA, 32 nt, Human
ccagcacguguggcugacgaauuuguuucuac

SEQ ID NO: 364028 - RNA, 32 nt, Human
ccagcacuauguacauguuccuggugaaaugg

SEQ ID NO: 364029 - RNA, 32 nt, Human
ccagcacucccaggacaguggagucagcagua

SEQ ID NO: 364030 - RNA, 32 nt, Human
ccagcacucccagggcccgagcgcgugccuuc

SEQ ID NO: 364031 - RNA, 20 nt, Human
ccagcacucccucccuccag

SEQ ID NO: 364032 - RNA, 32 nt, Human
ccagcacuccgagagguggaaggggcccugcc

SEQ ID NO: 364033 - RNA, 32 nt, Human
ccagcacucugccugcuccuucuuguauccaa

SEQ ID NO: 364034 - RNA, 32 nt, Human
ccagcacucuuucugcaagugucuugcucaca

SEQ ID NO: 364035 - RNA, 22 nt, Human
ccagcacugaaucccagcgcug

SEQ ID NO: 364036 - RNA, 32 nt, Human
ccagcacugagaggccgaucacuugaggucag

SEQ ID NO: 364037 - RNA, 32 nt, Human
ccagcacugcagccucaaccuccugggcucaa

SEQ ID NO: 364038 - RNA, 32 nt, Human
ccagcacugcccaccucugcucccagccgcca

SEQ ID NO: 364039 - RNA, 32 nt, Human
ccagcacugcccagguggcuggagcgagucac

SEQ ID NO: 364040 - RNA, 32 nt, Human
ccagcacugccuccuguuuucucccucucaug

SEQ ID NO: 364041 - RNA, 32 nt, Human
ccagcacugccuggcuccacgugccuccuggu

SEQ ID NO: 364042 - RNA, 32 nt, Human
ccagcacugcgagcuucugccuucccuguagu

SEQ ID NO: 364043 - RNA, 32 nt, Human
ccagcacugcucacugcgacuccuggaaaugu

SEQ ID NO: 364044 - RNA, 32 nt, Human
ccagcacugcuccccacucaccugugcucagg

SEQ ID NO: 364045 - RNA, 23 nt, Human
ccagcacugcuguuccauggcug

SEQ ID NO: 364046 - RNA, 32 nt, Human
ccagcacuggaagagcugguuccuggcuccga

SEQ ID NO: 364047 - RNA, 32 nt, Human
ccagcacuggaauuuugaaaacaaauaaggug

SEQ ID NO: 364048 - RNA, 20 nt, Human
ccagcacuggccacacccca

SEQ ID NO: 364049 - RNA, 32 nt, Human
ccagcacugggcaggcacagagcaggggcugc

SEQ ID NO: 364050 - RNA, 32 nt, Human
ccagcacugugcagcugaucuccacaacacug

SEQ ID NO: 364051 - RNA, 32 nt, Human
ccagcacugugcuguuguugucugacuguggc

SEQ ID NO: 364052 - RNA, 21 nt, Human
ccagcacuguucaggcugccu

SEQ ID NO: 364053 - RNA, 32 nt, Human
ccagcacuguucaugguaucuuauuucccagg

SEQ ID NO: 364054 - RNA, 32 nt, Human
ccagcacuguuggucaccgcaggccugucuuc

SEQ ID NO: 364055 - RNA, 32 nt, Human
ccagcacuucacuuugggaggcugaggcgggu

SEQ ID NO: 364056 - RNA, 20 nt, Human
ccagcacuucgggaggcuga

SEQ ID NO: 364057 - RNA, 32 nt, Human
ccagcacuuggcaggcaggaggugcggucucc

SEQ ID NO: 364058 - RNA, 32 nt, Human
ccagcacuugggaggccaaggcaggcggauca

SEQ ID NO: 364059 - RNA, 32 nt, Human
ccagcacuuguuacaaacacacgaugcaccuu

SEQ ID NO: 364060 - RNA, 32 nt, Human
ccagcacuuuauacacuucuggcucacaggaa

SEQ ID NO: 364061 - RNA, 32 nt, Human
ccagcacuuugggaagcugagguggguggauu

SEQ ID NO: 364062 - RNA, 32 nt, Human
ccagcacuuugggagacugagguggguggauc

SEQ ID NO: 364063 - RNA, 20 nt, Human
ccagcacuuugggaggcuga

SEQ ID NO: 364064 - RNA, 32 nt, Human
ccagcacuuuucccagcuuucucuccagcauc

SEQ ID NO: 364065 - RNA, 32 nt, Human
ccagcagaaacacacaucacuguuucaaaccu

SEQ ID NO: 364066 - RNA, 32 nt, Human
ccagcagaaagagaguaggccggauguuuuca

SEQ ID NO: 364067 - RNA, 20 nt, Human
ccagcagaaagcugcaguga

SEQ ID NO: 364068 - RNA, 32 nt, Human
ccagcagaaauccucauuucugugcuacggau

SEQ ID NO: 364069 - RNA, 31 nt, Human
ccagcagaaaugucucuccucuagguaucgu

SEQ ID NO: 364070 - RNA, 32 nt, Human
ccagcagaacauucuucucuucaaaggaugca

SEQ ID NO: 364071 - RNA, 32 nt, Human
ccagcagaaccagcucaagaaaggagaugccc

SEQ ID NO: 364072 - RNA, 32 nt, Human
ccagcagaacgcgccgggagguggugaccgcc

SEQ ID NO: 364073 - RNA, 32 nt, Human
ccagcagaacggguugaacgugucgacaaccc

SEQ ID NO: 364074 - RNA, 32 nt, Human
ccagcagaagccagcagagaggcaugggacag

SEQ ID NO: 364075 - RNA, 32 nt, Human
ccagcagaagugacuggcggggaccaggaugc

SEQ ID NO: 364076 - RNA, 32 nt, Human
ccagcagaccucccaacuccaccagaaacguc

SEQ ID NO: 364077 - RNA, 27 nt, Human
ccagcagacgcuccgccccacccggug

SEQ ID NO: 364078 - RNA, 32 nt, Human
ccagcagacgcuccgccccacccggugaugga

SEQ ID NO: 364079 - RNA, 32 nt, Human
ccagcagacuccugcucucuauccaaaauaaa

SEQ ID NO: 364080 - RNA, 32 nt, Human
ccagcagacuccugcucucuauccaaaauaag

SEQ ID NO: 364081 - RNA, 21 nt, Human
ccagcagagaauuuugacuug

SEQ ID NO: 364082 - RNA, 32 nt, Human
ccagcagagacuccuuuucuccuaaccguccc

SEQ ID NO: 364083 - RNA, 32 nt, Human
ccagcagagacugacagccacugugaggaacg

SEQ ID NO: 364084 - RNA, 32 nt, Human
ccagcagagagaguugaccccuccugaacugg

SEQ ID NO: 364085 - RNA, 22 nt, Human
ccagcagagagaugugauuccg

SEQ ID NO: 364086 - RNA, 32 nt, Human
ccagcagagagggacugaggcggacagugguc

SEQ ID NO: 364087 - RNA, 32 nt, Human
ccagcagagagggaguaggagagaagaaacau

SEQ ID NO: 364088 - RNA, 32 nt, Human
ccagcagagaggggccugguguaucacuggag

SEQ ID NO: 364089 - RNA, 32 nt, Human
ccagcagagcagcucagacuccugggacuccg

SEQ ID NO: 364090 - RNA, 32 nt, Human
ccagcagaggaagggccacucuucucaugggc

SEQ ID NO: 364091 - RNA, 25 nt, Human
ccagcagaggaggacaguggcucug

SEQ ID NO: 364092 - RNA, 32 nt, Human
ccagcagaggccuccggagaaaccccaaccuc

SEQ ID NO: 364093 - RNA, 32 nt, Human
ccagcagaggcuacagaacagcaaagauuccu

SEQ ID NO: 364094 - RNA, 32 nt, Human
ccagcagagggaggcagggcacugccuggccu

SEQ ID NO: 364095 - RNA, 32 nt, Human
ccagcagagggagggaucaggcagcaguguuu

SEQ ID NO: 364096 - RNA, 32 nt, Human
ccagcagagggugugguuggaggccucagaca

SEQ ID NO: 364097 - RNA, 32 nt, Human
ccagcagaggucagaggggacucugaccacag

SEQ ID NO: 364098 - RNA, 22 nt, Human
ccagcagaggugugacgggagg

SEQ ID NO: 364099 - RNA, 32 nt, Human
ccagcagaguacagcaauuuuugguguuuauu

SEQ ID NO: 364100 - RNA, 21 nt, Human
ccagcagauacagacuucuca

SEQ ID NO: 364101 - RNA, 32 nt, Human
ccagcagaugacccguugccuccccgggaaug

SEQ ID NO: 364102 - RNA, 32 nt, Human
ccagcagauggagggccaggaggaggaagagu

SEQ ID NO: 364103 - RNA, 32 nt, Human
ccagcagauuccgucucucaccuagacagaca

SEQ ID NO: 364104 - RNA, 32 nt, Human
ccagcagcaacucccugugcucccuucucuuu

SEQ ID NO: 364105 - RNA, 21 nt, Human
ccagcagcaagcagggcaguu

SEQ ID NO: 364106 - RNA, 32 nt, Human
ccagcagcacagacaucugcuccaucagaccu

SEQ ID NO: 364107 - RNA, 32 nt, Human
ccagcagcacccugcccgccucugccugccaa

SEQ ID NO: 364108 - RNA, 32 nt, Human
ccagcagcagaauggggaauggagaggugggc

SEQ ID NO: 364109 - RNA, 32 nt, Human
ccagcagcagcaucugccuuugucaucacugg

SEQ ID NO: 364110 - RNA, 32 nt, Human
ccagcagcagcuccaggucugcgcagcaggaa

SEQ ID NO: 364111 - RNA, 32 nt, Human
ccagcagcagcucuggaaggcagugcucagcc

SEQ ID NO: 364112 - RNA, 22 nt, Human
ccagcagcagcuggcccggcuu

SEQ ID NO: 364113 - RNA, 32 nt, Human
ccagcagcaggaagaaaccccaggaggaagaa

SEQ ID NO: 364114 - RNA, 23 nt, Human
ccagcagcaggaaggcugugccu

SEQ ID NO: 364115 - RNA, 22 nt, Human
ccagcagcaggagcuccaggcu

SEQ ID NO: 364116 - RNA, 32 nt, Human
ccagcagcaggaggagaaagaacauggcgggc

SEQ ID NO: 364117 - RNA, 32 nt, Human
ccagcagcaggccaaggcugugcucaagcauu

SEQ ID NO: 364118 - RNA, 18 nt, Human
ccagcagcaggcugcggc

SEQ ID NO: 364119 - RNA, 23 nt, Human
ccagcagcagggaggacgggagg

SEQ ID NO: 364120 - RNA, 25 nt, Human
ccagcagcagggcgcgggcaccggg

SEQ ID NO: 364121 - RNA, 32 nt, Human
ccagcagcaggggucccggcaggccugacccc

SEQ ID NO: 364122 - RNA, 22 nt, Human
ccagcagcagguccaggcggcu

SEQ ID NO: 364123 - RNA, 21 nt, Human
ccagcagcaggucccucgggc

SEQ ID NO: 364124 - RNA, 22 nt, Human
ccagcagcaguagccagggcuu

SEQ ID NO: 364125 - RNA, 32 nt, Human
ccagcagcagucuccgccaccuccgggcucca

SEQ ID NO: 364126 - RNA, 19 nt, Human
ccagcagcaguggcccuca

SEQ ID NO: 364127 - RNA, 32 nt, Human
ccagcagcagugggagaggcacugcucugggg

SEQ ID NO: 364128 - RNA, 32 nt, Human
ccagcagcauuccacacccagcucuuccucac

SEQ ID NO: 364129 - RNA, 23 nt, Human
ccagcagccaagacaguaaguga

SEQ ID NO: 364130 - RNA, 22 nt, Human
ccagcagccaagaggguagugg

SEQ ID NO: 364131 - RNA, 22 nt, Human
ccagcagccaccuccucugaga

SEQ ID NO: 364132 - RNA, 32 nt, Human
ccagcagccagggcagcuccaggugaggcggg

SEQ ID NO: 364133 - RNA, 32 nt, Human
ccagcagcccagccacagaggagccagcgaac

SEQ ID NO: 364134 - RNA, 21 nt, Human
ccagcagccccagacugccca

SEQ ID NO: 364135 - RNA, 32 nt, Human
ccagcagccccaggcauagcaucccuucuccu

SEQ ID NO: 364136 - RNA, 23 nt, Human
ccagcagcccggccacgcagcuu

SEQ ID NO: 364137 - RNA, 32 nt, Human
ccagcagcccucaacuugggacucuggguccg

SEQ ID NO: 364138 - RNA, 32 nt, Human
ccagcagcccuucgugaauccugcacugccac

SEQ ID NO: 364139 - RNA, 32 nt, Human
ccagcagccgccaucucacacgccucccuccu

SEQ ID NO: 364140 - RNA, 21 nt, Human
ccagcagccgccuccaugccc

SEQ ID NO: 364141 - RNA, 22 nt, Human
ccagcagccgccuccaugcccu

SEQ ID NO: 364142 - RNA, 23 nt, Human
ccagcagccgcgccgagccugac

SEQ ID NO: 364143 - RNA, 32 nt, Human
ccagcagccgcugaccauagccagcaaaagac

SEQ ID NO: 364144 - RNA, 32 nt, Human
ccagcagccgcuuucagccacugugugugcgu

SEQ ID NO: 364145 - RNA, 32 nt, Human
ccagcagccucagcgucugccuccccagcaca

SEQ ID NO: 364146 - RNA, 32 nt, Human
ccagcagccuccacagccuuuaucucaacagc

SEQ ID NO: 364147 - RNA, 32 nt, Human
ccagcagccucugcucccuccuggggacccac

SEQ ID NO: 364148 - RNA, 32 nt, Human
ccagcagccugacagaacacaggcuggcuuga

SEQ ID NO: 364149 - RNA, 31 nt, Human
ccagcagccuggucucccagucaggacacaa

SEQ ID NO: 364150 - RNA, 32 nt, Human
ccagcagccugucaaucacucgccaaggcagu

SEQ ID NO: 364151 - RNA, 18 nt, Human
ccagcagcggacugcagg

SEQ ID NO: 364152 - RNA, 32 nt, Human
ccagcagcggcguguccuccuugagugagagu

SEQ ID NO: 364153 - RNA, 32 nt, Human
ccagcagcuacaccccuacaggcuuccaggca

SEQ ID NO: 364154 - RNA, 20 nt, Human
ccagcagcuaccucagugac

SEQ ID NO: 364155 - RNA, 23 nt, Human
ccagcagcuaccugagccugacg

SEQ ID NO: 364156 - RNA, 32 nt, Human
ccagcagcuagcagaggcuuucucaucuuuua

SEQ ID NO: 364157 - RNA, 32 nt, Human
ccagcagcuccucauccccaaagucugcaggg

SEQ ID NO: 364158 - RNA, 18 nt, Human
ccagcagcucugccuggu

SEQ ID NO: 364159 - RNA, 32 nt, Human
ccagcagcucuugcccagagcugugcagugca

SEQ ID NO: 364160 - RNA, 19 nt, Human
ccagcagcugcagcucggc

SEQ ID NO: 364161 - RNA, 32 nt, Human
ccagcagcugcagcucggccucugcugccugc

SEQ ID NO: 364162 - RNA, 32 nt, Human
ccagcagcugcucugcucaccagccugacccc

SEQ ID NO: 364163 - RNA, 32 nt, Human
ccagcagcuguggugggggaggguuccccucc

SEQ ID NO: 364164 - RNA, 32 nt, Human
ccagcagcuuaaguccagcucauuucaguuuc

SEQ ID NO: 364165 - RNA, 32 nt, Human
ccagcaggaagagcuauaagcacuaagugcgu

SEQ ID NO: 364166 - RNA, 32 nt, Human
ccagcaggaagagcuauaagcacuagugcguc

SEQ ID NO: 364167 - RNA, 32 nt, Human
ccagcaggaaggucucaccugaggugaaccuu

SEQ ID NO: 364168 - RNA, 22 nt, Human
ccagcaggaauggguccucgaa

SEQ ID NO: 364169 - RNA, 21 nt, Human
ccagcaggacagagcugcuca

SEQ ID NO: 364170 - RNA, 32 nt, Human
ccagcaggagccaagaggaacaggaaaacaaa

SEQ ID NO: 364171 - RNA, 32 nt, Human
ccagcaggagcugaugccggaggcagugggug

SEQ ID NO: 364172 - RNA, 32 nt, Human
ccagcaggaggaagcccaggagcuggguccug

SEQ ID NO: 364173 - RNA, 32 nt, Human
ccagcaggaggaugagccagcucugcaguucc

SEQ ID NO: 364174 - RNA, 32 nt, Human
ccagcaggaggcagggguagagugauggaagg

SEQ ID NO: 364175 - RNA, 32 nt, Human
ccagcaggaggcugacgaguucccuggcagga

SEQ ID NO: 364176 - RNA, 32 nt, Human
ccagcaggaggugggcaacucaguccuacaac

SEQ ID NO: 364177 - RNA, 32 nt, Human
ccagcaggagugaacaggaacaggaaaacaaa

SEQ ID NO: 364178 - RNA, 32 nt, Human
ccagcaggcaaacugagggucucuuagggagg

SEQ ID NO: 364179 - RNA, 24 nt, Human
ccagcaggcagagguugcagugag

SEQ ID NO: 364180 - RNA, 32 nt, Human
ccagcaggcagcccugggcuggggguagggga

SEQ ID NO: 364181 - RNA, 20 nt, Human
ccagcaggccagguccaggg

SEQ ID NO: 364182 - RNA, 32 nt, Human
ccagcaggcccagcaugcagguggugggacac

SEQ ID NO: 364183 - RNA, 32 nt, Human
ccagcaggccccuggagguguguagucacucu

SEQ ID NO: 364184 - RNA, 32 nt, Human
ccagcaggcccuggugggcuugggaggaggca

SEQ ID NO: 364185 - RNA, 32 nt, Human
ccagcaggccuggguuccgugagcgcgaacuc

SEQ ID NO: 364186 - RNA, 21 nt, Human
ccagcaggcuagcucaggcuu

SEQ ID NO: 364187 - RNA, 32 nt, Human
ccagcaggcuucaugugcaugugcacacugcc

SEQ ID NO: 364188 - RNA, 32 nt, Human
ccagcagggaaacugugugcauucuacuguca

SEQ ID NO: 364189 - RNA, 21 nt, Human
ccagcagggaaaucuggccug

SEQ ID NO: 364190 - RNA, 19 nt, Human
ccagcagggagagaggguc

SEQ ID NO: 364191 - RNA, 32 nt, Human
ccagcagggagcucaggacagagcaggcuccc

SEQ ID NO: 364192 - RNA, 32 nt, Human
ccagcagggagcugggagcugggggaaacgac

SEQ ID NO: 364193 - RNA, 32 nt, Human
ccagcagggaggugccgguguccaggauggcc

SEQ ID NO: 364194 - RNA, 32 nt, Human
ccagcagggaggugggcauggcagggaaugga

SEQ ID NO: 364195 - RNA, 20 nt, Human
ccagcagggagucccuccag

SEQ ID NO: 364196 - RNA, 26 nt, Human
ccagcagggauggggcaucgguccug

SEQ ID NO: 364197 - RNA, 21 nt, Human
ccagcagggcuuccugucccg

SEQ ID NO: 364198 - RNA, 22 nt, Human
ccagcaggggaacuugagcuug

SEQ ID NO: 364199 - RNA, 22 nt, Human
ccagcaggggaccccuguuuug

SEQ ID NO: 364200 - RNA, 23 nt, Human
ccagcaggggagaggggccaucu

SEQ ID NO: 364201 - RNA, 32 nt, Human
ccagcaggggcagcagccaggucucugauggc

SEQ ID NO: 364202 - RNA, 23 nt, Human
ccagcaggggcugcccgagucug

SEQ ID NO: 364203 - RNA, 24 nt, Human
ccagcagggguccacguugucccg

SEQ ID NO: 364204 - RNA, 19 nt, Human
ccagcagguaggggcacag

SEQ ID NO: 364205 - RNA, 32 nt, Human
ccagcaggucaaaugauaguuucuccaucaag

SEQ ID NO: 364206 - RNA, 32 nt, Human
ccagcaggucucaugcaggcccagggcugggg

SEQ ID NO: 364207 - RNA, 32 nt, Human
ccagcagguggaugagaucacagaccucaacg

SEQ ID NO: 364208 - RNA, 20 nt, Human
ccagcaguagcagggcugcc

SEQ ID NO: 364209 - RNA, 32 nt, Human
ccagcaguaugcgaggcaucaccaccaucacg

SEQ ID NO: 364210 - RNA, 32 nt, Human
ccagcagucccaguuaugcauuucaaguuugg

SEQ ID NO: 364211 - RNA, 32 nt, Human
ccagcagucuaccugcucguugccugccacug

SEQ ID NO: 364212 - RNA, 32 nt, Human
ccagcagucugccuggaggccagggagcagug

SEQ ID NO: 364213 - RNA, 32 nt, Human
ccagcagucuugcccuuuacugagcuuagugu

SEQ ID NO: 364214 - RNA, 20 nt, Human
ccagcagugacccaugcgcu

SEQ ID NO: 364215 - RNA, 32 nt, Human
ccagcagugaccuaggaaaacaucccagagaa

SEQ ID NO: 364216 - RNA, 32 nt, Human
ccagcagugagcuguguaagcaccuuacauuc

SEQ ID NO: 364217 - RNA, 32 nt, Human
ccagcagugaggggcaggcucuucuggucacc

SEQ ID NO: 364218 - RNA, 21 nt, Human
ccagcagugcccccagcacug

SEQ ID NO: 364219 - RNA, 32 nt, Human
ccagcagugcccugcccugcccugcagugucu

SEQ ID NO: 364220 - RNA, 32 nt, Human
ccagcagugccuggcugucuccugugaugagc

SEQ ID NO: 364221 - RNA, 32 nt, Human
ccagcagugucauaggaguggagggggauaag

SEQ ID NO: 364222 - RNA, 32 nt, Human
ccagcaguucaagaccagccugggcaacacag

SEQ ID NO: 364223 - RNA, 32 nt, Human
ccagcauaaggcaucagguuguuagaugcugg

SEQ ID NO: 364224 - RNA, 32 nt, Human
ccagcauaccugcugguguguaaguguggacu

SEQ ID NO: 364225 - RNA, 32 nt, Human
ccagcauagaagcaagcaccaaugcagacaug

SEQ ID NO: 364226 - RNA, 19 nt, Human
ccagcauagacacaccuca

SEQ ID NO: 364227 - RNA, 20 nt, Human
ccagcauagugaaacccugu

SEQ ID NO: 364228 - RNA, 32 nt, Human
ccagcaucaacauguuuccauccuuggggaau

SEQ ID NO: 364229 - RNA, 32 nt, Human
ccagcaucaacuuaccggcuuuguaagagagc

SEQ ID NO: 364230 - RNA, 32 nt, Human
ccagcaucaagaggaagaagaagagggaggac

SEQ ID NO: 364231 - RNA, 32 nt, Human
ccagcaucaagauccgccggccuggauacaaa

SEQ ID NO: 364232 - RNA, 18 nt, Human
ccagcaucaagucuccag

SEQ ID NO: 364233 - RNA, 32 nt, Human
ccagcaucacaggucuaaaugcaucaggaauu

SEQ ID NO: 364234 - RNA, 32 nt, Human
ccagcaucagccccaauguccagccucuuuaa

SEQ ID NO: 364235 - RNA, 32 nt, Human
ccagcaucagcccuggggagagaggcucccaa

SEQ ID NO: 364236 - RNA, 32 nt, Human
ccagcaucaggcgugacccuauccugaucccu

SEQ ID NO: 364237 - RNA, 32 nt, Human
ccagcaucauggccuccucccaguacuucagg

SEQ ID NO: 364238 - RNA, 32 nt, Human
ccagcauccacucugucuuguccuccuggaag

SEQ ID NO: 364239 - RNA, 32 nt, Human
ccagcauccagcugccucguugucuauccugg

SEQ ID NO: 364240 - RNA, 32 nt, Human
ccagcaucccagagccaaaaacaaauagugcc

SEQ ID NO: 364241 - RNA, 24 nt, Human
ccagcaucccagcugggccagaga

SEQ ID NO: 364242 - RNA, 22 nt, Human
ccagcauccccgcccgaucucg

SEQ ID NO: 364243 - RNA, 21 nt, Human
ccagcauccuccugcugcagg

SEQ ID NO: 364244 - RNA, 24 nt, Human
ccagcauccuggggauccagcgga

SEQ ID NO: 364245 - RNA, 32 nt, Human
ccagcauccuuuaguacaguguuuccacucuu

SEQ ID NO: 364246 - RNA, 32 nt, Human
ccagcaucuagaugcagcuacucucauuccag

SEQ ID NO: 364247 - RNA, 18 nt, Human
ccagcaucucauuuuccc

SEQ ID NO: 364248 - RNA, 32 nt, Human
ccagcaucucggucuucagcucacaccagccu

SEQ ID NO: 364249 - RNA, 32 nt, Human
ccagcaucucuccccucagcccugucuccucu

SEQ ID NO: 364250 - RNA, 32 nt, Human
ccagcaucucuguugcuaacacacagagcuca

SEQ ID NO: 364251 - RNA, 32 nt, Human
ccagcaucugcagccacuuucugccagcaucu

SEQ ID NO: 364252 - RNA, 32 nt, Human
ccagcaucugcugucagguggcucaggucuuc

SEQ ID NO: 364253 - RNA, 32 nt, Human
ccagcaucuggaacagagccugggacaagcua

SEQ ID NO: 364254 - RNA, 32 nt, Human
ccagcaucuguguccagccuguguucuugcca

SEQ ID NO: 364255 - RNA, 30 nt, Human
ccagcaugaaagucucugccgcccuucugu

SEQ ID NO: 364256 - RNA, 32 nt, Human
ccagcaugccugucuaauuuuuguauuuuagu

SEQ ID NO: 364257 - RNA, 32 nt, Human
ccagcaugcuaccugaauggcgguuuuuaucc

SEQ ID NO: 364258 - RNA, 32 nt, Human
ccagcaugcucugcccaccccacgccgaggug

SEQ ID NO: 364259 - RNA, 32 nt, Human
ccagcaugcuuuuaauaugcugggugacccac

SEQ ID NO: 364260 - RNA, 32 nt, Human
ccagcauggaguauguggccucuugucauccc

SEQ ID NO: 364261 - RNA, 20 nt, Human
ccagcauggcaaaaccccgu

SEQ ID NO: 364262 - RNA, 30 nt, Human
ccagcauggccgcgcugcuccugggcgcgg

SEQ ID NO: 364263 - RNA, 21 nt, Human
ccagcauggccuaagccugac

SEQ ID NO: 364264 - RNA, 20 nt, Human
ccagcauggcgaaacccugu

SEQ ID NO: 364265 - RNA, 20 nt, Human
ccagcauggcgaaaccucgu

SEQ ID NO: 364266 - RNA, 24 nt, Human
ccagcauggcugcccccacggcug

SEQ ID NO: 364267 - RNA, 28 nt, Human
ccagcaugggaagaggccccuccagaga

SEQ ID NO: 364268 - RNA, 32 nt, Human
ccagcaugggagaaagauggaggccagauuca

SEQ ID NO: 364269 - RNA, 32 nt, Human
ccagcaugggcaacauaacaagaccccauccc

SEQ ID NO: 364270 - RNA, 20 nt, Human
ccagcauggugaaaccccgu

SEQ ID NO: 364271 - RNA, 20 nt, Human
ccagcauggugaaacccugu

SEQ ID NO: 364272 - RNA, 20 nt, Human
ccagcauguccagccccuga

SEQ ID NO: 364273 - RNA, 31 nt, Human
ccagcauguccauuugaacaugcagaggguu

SEQ ID NO: 364274 - RNA, 32 nt, Human
ccagcaugugccagucucgggggcgagguaca

SEQ ID NO: 364275 - RNA, 32 nt, Human
ccagcauguggggacuccagccaccugaguua

SEQ ID NO: 364276 - RNA, 32 nt, Human
ccagcauguguguccacacauacauaggaugg

SEQ ID NO: 364277 - RNA, 21 nt, Human
ccagcauuaccuucccuuccc

SEQ ID NO: 364278 - RNA, 32 nt, Human
ccagcauuccaaagugcugggauuacaggugu

SEQ ID NO: 364279 - RNA, 32 nt, Human
ccagcauuccaaauagacucagacucacugcc

SEQ ID NO: 364280 - RNA, 16 nt, Human
ccagcauuccagcucu

SEQ ID NO: 364281 - RNA, 32 nt, Human
ccagcauuccagcuguuucacccuucagcaac

SEQ ID NO: 364282 - RNA, 21 nt, Human
ccagcauuccccacagcacug

SEQ ID NO: 364283 - RNA, 32 nt, Human
ccagcauugcuacugugcaggccaaggguacu

SEQ ID NO: 364284 - RNA, 32 nt, Human
ccagcauuggucauaaccuucugccucccuaa

SEQ ID NO: 364285 - RNA, 32 nt, Human
ccagcauugucccagugcuuugaguuggacgg

SEQ ID NO: 364286 - RNA, 32 nt, Human
ccagcauugugcuuuuucccugggcuuauuug

SEQ ID NO: 364287 - RNA, 32 nt, Human
ccagcauuugauguucccucucuaaugauaac

SEQ ID NO: 364288 - RNA, 32 nt, Human
ccagcauuugggaggcucaggugggaggauug

SEQ ID NO: 364289 - RNA, 32 nt, Human
ccagcauuugggaggcugaggcaggcagauca

SEQ ID NO: 364290 - RNA, 32 nt, Human
ccagcauuugguucuucucaagaguugaccau

SEQ ID NO: 364291 - RNA, 22 nt, Human
ccagcauuugugaagcuuuugc

SEQ ID NO: 364292 - RNA, 22 nt, Human
ccagcauuuucccacuccagug

SEQ ID NO: 364293 - RNA, 32 nt, Human
ccagcauuuucuucucuucauugcugcuucuc

SEQ ID NO: 364294 - RNA, 22 nt, Human
ccagccaaaaggggggauugug

SEQ ID NO: 364295 - RNA, 32 nt, Human
ccagccaaaucagcuaggccauggccuugccu

SEQ ID NO: 364296 - RNA, 32 nt, Human
ccagccaacacaugggcuacugcugggaagcc

SEQ ID NO: 364297 - RNA, 32 nt, Human
ccagccaacagcuguggcuuaaaucugagucc

SEQ ID NO: 364298 - RNA, 32 nt, Human
ccagccaacauggcaaaaccccaucucuacua

SEQ ID NO: 364299 - RNA, 24 nt, Human
ccagccaacauggcgaaaccaugu

SEQ ID NO: 364300 - RNA, 32 nt, Human
ccagccaacauggcgaaaccaugucucuacua

SEQ ID NO: 364301 - RNA, 32 nt, Human
ccagccaacauggugaaaacccugucucuacu

SEQ ID NO: 364302 - RNA, 32 nt, Human
ccagccaagaucacccaggagcuugugccccc

SEQ ID NO: 364303 - RNA, 32 nt, Human
ccagccaaggagcagcccugcccagggggcau

SEQ ID NO: 364304 - RNA, 32 nt, Human
ccagccaaggcaacauagugaggccccaucuu

SEQ ID NO: 364305 - RNA, 32 nt, Human
ccagccaaggcuguucaggugggaccauggug

SEQ ID NO: 364306 - RNA, 32 nt, Human
ccagccaagggcccuggccacgugugcgccac

SEQ ID NO: 364307 - RNA, 32 nt, Human
ccagccaagggugagcaucucugcugagacag

SEQ ID NO: 364308 - RNA, 32 nt, Human
ccagccaagugcgguaccagcccuucgggccu

SEQ ID NO: 364309 - RNA, 32 nt, Human
ccagccaaguggugcuuucuuccaaaugccuu

SEQ ID NO: 364310 - RNA, 32 nt, Human
ccagccaauuuagugaaaccccaucucuacua

SEQ ID NO: 364311 - RNA, 32 nt, Human
ccagccacaaagcucauacccagcccuaccaa

SEQ ID NO: 364312 - RNA, 32 nt, Human
ccagccacaaguguuggagcugcagagagacc

SEQ ID NO: 364313 - RNA, 32 nt, Human
ccagccacacaggcacaugcacaggcacggug

SEQ ID NO: 364314 - RNA, 32 nt, Human
ccagccacagcacuccagccugggugacagag

SEQ ID NO: 364315 - RNA, 25 nt, Human
ccagccacagcgggagcggcagcaa

SEQ ID NO: 364316 - RNA, 32 nt, Human
ccagccacaggcaggaugcuccuugaucacgg

SEQ ID NO: 364317 - RNA, 32 nt, Human
ccagccacauguggacccucagccuggguggg

SEQ ID NO: 364318 - RNA, 20 nt, Human
ccagccaccagggagcugcc

SEQ ID NO: 364319 - RNA, 32 nt, Human
ccagccaccagucccuggcaugcccagugauc

SEQ ID NO: 364320 - RNA, 32 nt, Human
ccagccacccagccaggaggggcuguccaauc

SEQ ID NO: 364321 - RNA, 32 nt, Human
ccagccaccccagaaaagcugcagccugcagg

SEQ ID NO: 364322 - RNA, 19 nt, Human
ccagccacccccagcccca

SEQ ID NO: 364323 - RNA, 32 nt, Human
ccagccaccuccacuugcuuccuccuccuucc

SEQ ID NO: 364324 - RNA, 32 nt, Human
ccagccaccucggggaacuccagaccaagggu

SEQ ID NO: 364325 - RNA, 32 nt, Human
ccagccaccucugcaaccugccaccuccugcu

SEQ ID NO: 364326 - RNA, 18 nt, Human
ccagccaccuggcccuca

SEQ ID NO: 364327 - RNA, 23 nt, Human
ccagccacguucccuuuccuccu

SEQ ID NO: 364328 - RNA, 32 nt, Human
ccagccacuauuaggccaucaaaggaguccuc

SEQ ID NO: 364329 - RNA, 20 nt, Human
ccagccacucaggaggcuga

SEQ ID NO: 364330 - RNA, 32 nt, Human
ccagccacuccugaugggguugcucacacugc

SEQ ID NO: 364331 - RNA, 32 nt, Human
ccagccacucucccuggggccugguggguagg

SEQ ID NO: 364332 - RNA, 23 nt, Human
ccagccacucucccuucccugaa

SEQ ID NO: 364333 - RNA, 32 nt, Human
ccagccacugaggagggguggcagaggauugu

SEQ ID NO: 364334 - RNA, 32 nt, Human
ccagccacugcaucugcugcacaguugaacga

SEQ ID NO: 364335 - RNA, 32 nt, Human
ccagccacugcuuagcuaucauagucaccauu

SEQ ID NO: 364336 - RNA, 32 nt, Human
ccagccacuuguccuagccaaauguccaaaac

SEQ ID NO: 364337 - RNA, 32 nt, Human
ccagccagaacccauuuugcagucuucucuuc

SEQ ID NO: 364338 - RNA, 32 nt, Human
ccagccagacaagauggcaaagugugcagaug

SEQ ID NO: 364339 - RNA, 32 nt, Human
ccagccagacacacucccaugacgcccacagc

SEQ ID NO: 364340 - RNA, 32 nt, Human
ccagccagacuggccucaauggcggacucagu

SEQ ID NO: 364341 - RNA, 32 nt, Human
ccagccagagcccacugcugggaccuucaagc

SEQ ID NO: 364342 - RNA, 32 nt, Human
ccagccagaugcgccugugaaccaaagcuucg

SEQ ID NO: 364343 - RNA, 32 nt, Human
ccagccagauggacuccagccugccuggcagg

SEQ ID NO: 364344 - RNA, 32 nt, Human
ccagccagauggggucacaaugcugcagaaaa

SEQ ID NO: 364345 - RNA, 32 nt, Human
ccagccagcaccucugccuucucagggacaag

SEQ ID NO: 364346 - RNA, 32 nt, Human
ccagccagcauuccgagugacugagguggaug

SEQ ID NO: 364347 - RNA, 32 nt, Human
ccagccagccagggcccugcccagcuucaauu

SEQ ID NO: 364348 - RNA, 20 nt, Human
ccagccagccccagacucca

SEQ ID NO: 364349 - RNA, 32 nt, Human
ccagccagcgccucccuccaccccaggacgcc

SEQ ID NO: 364350 - RNA, 32 nt, Human
ccagccagcucuugccgccaccucggucgcga

SEQ ID NO: 364351 - RNA, 32 nt, Human
ccagccagcugcagguggcaucugccacgaag

SEQ ID NO: 364352 - RNA, 32 nt, Human
ccagccaggaaggcuggggcccuacuguuugu

SEQ ID NO: 364353 - RNA, 32 nt, Human
ccagccaggaaggguggaggaaaguucuuugc

SEQ ID NO: 364354 - RNA, 32 nt, Human
ccagccaggagagaggacagagccagggcaga

SEQ ID NO: 364355 - RNA, 32 nt, Human
ccagccaggagcugugggaggaaacgcccuca

SEQ ID NO: 364356 - RNA, 32 nt, Human
ccagccaggagggacccccagguccagaguga

SEQ ID NO: 364357 - RNA, 32 nt, Human
ccagccaggcccccucccuggaggccagcccc

SEQ ID NO: 364358 - RNA, 18 nt, Human
ccagccaggccuaagggc

SEQ ID NO: 364359 - RNA, 22 nt, Human
ccagccaggccucccugcucug

SEQ ID NO: 364360 - RNA, 32 nt, Human
ccagccaggccugcugcuagugugggaggggu

SEQ ID NO: 364361 - RNA, 17 nt, Human
ccagccaggccuggcca

SEQ ID NO: 364362 - RNA, 32 nt, Human
ccagccaggccugggcagugaccucuuucucu

SEQ ID NO: 364363 - RNA, 32 nt, Human
ccagccaggccuugguccucagcugcugucau

SEQ ID NO: 364364 - RNA, 32 nt, Human
ccagccagggagaccagguguugucugacauc

SEQ ID NO: 364365 - RNA, 32 nt, Human
ccagccagggaggggcagcugcagugaccagg

SEQ ID NO: 364366 - RNA, 32 nt, Human
ccagccagggaugcagaggccacccagaggcc

SEQ ID NO: 364367 - RNA, 32 nt, Human
ccagccagggcaacauaauaagacuuuucucu

SEQ ID NO: 364368 - RNA, 32 nt, Human
ccagccagggcaacauggugaaaccccaucuc

SEQ ID NO: 364369 - RNA, 32 nt, Human
ccagccagggcaacauggugagaccucaucuc

SEQ ID NO: 364370 - RNA, 32 nt, Human
ccagccagggcccggccuccugacucuccuac

SEQ ID NO: 364371 - RNA, 32 nt, Human
ccagccagggcuauuaaauaauaacaggaggg

SEQ ID NO: 364372 - RNA, 32 nt, Human
ccagccagggcugagaggauucgagguggcug

SEQ ID NO: 364373 - RNA, 32 nt, Human
ccagccagggcugaggagcugucacagagagg

SEQ ID NO: 364374 - RNA, 32 nt, Human
ccagccaggggccagacacagugcaggcacag

SEQ ID NO: 364375 - RNA, 32 nt, Human
ccagccagguccucaccuguguguacaccagc

SEQ ID NO: 364376 - RNA, 32 nt, Human
ccagccaguuuccaugugaaaaagccaucugg

SEQ ID NO: 364377 - RNA, 21 nt, Human
ccagccaguuucuggcugccu

SEQ ID NO: 364378 - RNA, 32 nt, Human
ccagccauaaaucugcauccugggacacaggc

SEQ ID NO: 364379 - RNA, 32 nt, Human
ccagccauagcuacuucuuuaagcuccuccag

SEQ ID NO: 364380 - RNA, 32 nt, Human
ccagccauaggcucuucucuguccgcagggcu

SEQ ID NO: 364381 - RNA, 32 nt, Human
ccagccauccugggaccccaggcgugcagguu

SEQ ID NO: 364382 - RNA, 31 nt, Human
ccagccaugaccuucgggcgcagcggggcgg

SEQ ID NO: 364383 - RNA, 32 nt, Human
ccagccaugccaccgcccuggccacccugcgg

SEQ ID NO: 364384 - RNA, 31 nt, Human
ccagccaugccuuuaaaccgcacuuugucca

SEQ ID NO: 364385 - RNA, 32 nt, Human
ccagccaugcuuccuguacagccuguggaacu

SEQ ID NO: 364386 - RNA, 32 nt, Human
ccagccaugcuuccuguacggccugcagaacu

SEQ ID NO: 364387 - RNA, 32 nt, Human
ccagccaugcuuccuguacggccuguggaacc

SEQ ID NO: 364388 - RNA, 32 nt, Human
ccagccaugcuuccuguauagccugcgggacu

SEQ ID NO: 364389 - RNA, 32 nt, Human
ccagccaugguggcgggcgccuguaaucccag

SEQ ID NO: 364390 - RNA, 32 nt, Human
ccagccauguguuggggagacaucaaaaccac

SEQ ID NO: 364391 - RNA, 32 nt, Human
ccagcccaaacagaaccuucagacaacugcag

SEQ ID NO: 364392 - RNA, 32 nt, Human
ccagcccaaacucaggcuggaggcagccccga

SEQ ID NO: 364393 - RNA, 23 nt, Human
ccagcccaaacugcacagcccca

SEQ ID NO: 364394 - RNA, 32 nt, Human
ccagcccaacuccugguucccugaugaagcuu

SEQ ID NO: 364395 - RNA, 32 nt, Human
ccagcccaacuuccuguugcuggccccugccc

SEQ ID NO: 364396 - RNA, 32 nt, Human
ccagcccaagaggagcccccacugccugcggg

SEQ ID NO: 364397 - RNA, 32 nt, Human
ccagcccaaucacucccugccugguccagaac

SEQ ID NO: 364398 - RNA, 32 nt, Human
ccagcccacaccauuccagugcucagccuagc

SEQ ID NO: 364399 - RNA, 32 nt, Human
ccagcccacagcucuuucuacucugcagacag

SEQ ID NO: 364400 - RNA, 32 nt, Human
ccagcccacagcuucucccagccugaaaccaa

SEQ ID NO: 364401 - RNA, 22 nt, Human
ccagcccacauuccuccuuccu

SEQ ID NO: 364402 - RNA, 32 nt, Human
ccagcccaccagugccuggccagccugccccc

SEQ ID NO: 364403 - RNA, 32 nt, Human
ccagcccaccccacccucccugggcagggucu

SEQ ID NO: 364404 - RNA, 32 nt, Human
ccagcccacccgcaugcacagagcaggggcua

SEQ ID NO: 364405 - RNA, 26 nt, Human
ccagcccacccugccccuuucuuccc

SEQ ID NO: 364406 - RNA, 24 nt, Human
ccagcccaccuccgccuccaagua

SEQ ID NO: 364407 - RNA, 16 nt, Human
ccagcccacgccuggc

SEQ ID NO: 364408 - RNA, 21 nt, Human
ccagcccacuccacccugcca

SEQ ID NO: 364409 - RNA, 32 nt, Human
ccagcccacuccagugugaucugcacccuggc

SEQ ID NO: 364410 - RNA, 32 nt, Human
ccagcccagaacugaagcgcugcggcauggcg

SEQ ID NO: 364411 - RNA, 23 nt, Human
ccagcccagaacuuuuccuucuc

SEQ ID NO: 364412 - RNA, 32 nt, Human
ccagcccagaauccuccucucccucaccagag

SEQ ID NO: 364413 - RNA, 23 nt, Human
ccagcccagacaacagagugaga

SEQ ID NO: 364414 - RNA, 32 nt, Human
ccagcccagacuccucagacuuuucucucagu

SEQ ID NO: 364415 - RNA, 32 nt, Human
ccagcccagagcacucggccagcagcgacucc

SEQ ID NO: 364416 - RNA, 19 nt, Human
ccagcccagauggcacuca

SEQ ID NO: 364417 - RNA, 32 nt, Human
ccagcccagcacagcaagcgaggccauuuguc

SEQ ID NO: 364418 - RNA, 23 nt, Human
ccagcccagcacuggaccauucc

SEQ ID NO: 364419 - RNA, 32 nt, Human
ccagcccagcagcugcagcugcuaagauggcc

SEQ ID NO: 364420 - RNA, 32 nt, Human
ccagcccagcaugcaccagcucuuucagaaaa

SEQ ID NO: 364421 - RNA, 32 nt, Human
ccagcccagcccacagcagucucaaccucucg

SEQ ID NO: 364422 - RNA, 32 nt, Human
ccagcccagcccagccuacccaaccucaucuc

SEQ ID NO: 364423 - RNA, 32 nt, Human
ccagcccagccccuccaugcacauuuggacgc

SEQ ID NO: 364424 - RNA, 32 nt, Human
ccagcccagccccugaacggcauguuagacag

SEQ ID NO: 364425 - RNA, 22 nt, Human
ccagcccagcgccucccacccc

SEQ ID NO: 364426 - RNA, 32 nt, Human
ccagcccagcuggccggaaggagacugugguu

SEQ ID NO: 364427 - RNA, 32 nt, Human
ccagcccagcuuugaacaguccugggccccaa

SEQ ID NO: 364428 - RNA, 32 nt, Human
ccagcccaggagguggcuggauugcagggcug

SEQ ID NO: 364429 - RNA, 32 nt, Human
ccagcccaggaguucaagaccagccugggcaa

SEQ ID NO: 364430 - RNA, 23 nt, Human
ccagcccaggcaacagagugaga

SEQ ID NO: 364431 - RNA, 32 nt, Human
ccagcccaggcaacauggugaaaccccaucuc

SEQ ID NO: 364432 - RNA, 32 nt, Human
ccagcccaggcagagaucaggugggcagaggc

SEQ ID NO: 364433 - RNA, 24 nt, Human
ccagcccaggccccugggcaucuc

SEQ ID NO: 364434 - RNA, 21 nt, Human
ccagcccaggcccucuccccc

SEQ ID NO: 364435 - RNA, 21 nt, Human
ccagcccaggcccugccuccc

SEQ ID NO: 364436 - RNA, 32 nt, Human
ccagcccagggacuuuuccggaaaguuuuuau

SEQ ID NO: 364437 - RNA, 18 nt, Human
ccagcccagggcucuggg

SEQ ID NO: 364438 - RNA, 21 nt, Human
ccagcccaggggccccuuccc

SEQ ID NO: 364439 - RNA, 32 nt, Human
ccagcccaggucugcacucgccuggaucaccu

SEQ ID NO: 364440 - RNA, 23 nt, Human
ccagcccaggugacagagcgaga

SEQ ID NO: 364441 - RNA, 32 nt, Human
ccagcccaguccaggaccuggcuggaugcuuc

SEQ ID NO: 364442 - RNA, 32 nt, Human
ccagcccaguccccugucuccuggggccaggc

SEQ ID NO: 364443 - RNA, 31 nt, Human
ccagcccaguuucaaacuccugaccucaggu

SEQ ID NO: 364444 - RNA, 32 nt, Human
ccagcccaucauuccuuuuccccuuggcacuc

SEQ ID NO: 364445 - RNA, 32 nt, Human
ccagcccauccuaccagccuucugccacguca

SEQ ID NO: 364446 - RNA, 32 nt, Human
ccagcccaucuucucccgcuucuugcgcuccu

SEQ ID NO: 364447 - RNA, 32 nt, Human
ccagcccaugcaccccuccccuaucccugaug

SEQ ID NO: 364448 - RNA, 32 nt, Human
ccagcccaugccucacagacaguaggauccca

SEQ ID NO: 364449 - RNA, 32 nt, Human
ccagcccaugucaggggaacagccuggaacag

SEQ ID NO: 364450 - RNA, 32 nt, Human
ccagcccauuggagaaaaguuacuguucaguc

SEQ ID NO: 364451 - RNA, 28 nt, Human
ccagccccaaaacucuccucugcugcug

SEQ ID NO: 364452 - RNA, 23 nt, Human
ccagccccaaaacuggggcuuca

SEQ ID NO: 364453 - RNA, 21 nt, Human
ccagccccaaaaugccaauag

SEQ ID NO: 364454 - RNA, 19 nt, Human
ccagccccaaacugagaca

SEQ ID NO: 364455 - RNA, 32 nt, Human
ccagccccaaagccaccggcaugugaagcugc

SEQ ID NO: 364456 - RNA, 32 nt, Human
ccagccccaaaggcaauucuguuuucagauug

SEQ ID NO: 364457 - RNA, 32 nt, Human
ccagccccaacauuucacuccagccuggcccc

SEQ ID NO: 364458 - RNA, 24 nt, Human
ccagccccaagagaccuguugcug

SEQ ID NO: 364459 - RNA, 28 nt, Human
ccagccccaaguggcuuuuucaauuaca

SEQ ID NO: 364460 - RNA, 21 nt, Human
ccagccccaaguuccagcuca

SEQ ID NO: 364461 - RNA, 32 nt, Human
ccagccccacacaggcccagcacugcauuugg

SEQ ID NO: 364462 - RNA, 24 nt, Human
ccagccccacaccugcuccuuccc

SEQ ID NO: 364463 - RNA, 20 nt, Human
ccagccccacagcccacguc

SEQ ID NO: 364464 - RNA, 20 nt, Human
ccagccccaccccuaagugc

SEQ ID NO: 364465 - RNA, 20 nt, Human
ccagccccacccugucccca

SEQ ID NO: 364466 - RNA, 32 nt, Human
ccagccccacccuuggccaucucccuuuggga

SEQ ID NO: 364467 - RNA, 32 nt, Human
ccagccccaccgcccacgccuggguaguagca

SEQ ID NO: 364468 - RNA, 23 nt, Human
ccagccccaccuuguacacacag

SEQ ID NO: 364469 - RNA, 18 nt, Human
ccagccccacgcugccca

SEQ ID NO: 364470 - RNA, 17 nt, Human
ccagccccacuggcccc

SEQ ID NO: 364471 - RNA, 32 nt, Human
ccagccccagaacccucuggggaagaauguug

SEQ ID NO: 364472 - RNA, 32 nt, Human
ccagccccagagggaguggcgagcccagcugc

SEQ ID NO: 364473 - RNA, 32 nt, Human
ccagccccagcacggcccggucccgcaugcca

SEQ ID NO: 364474 - RNA, 32 nt, Human
ccagccccagcccaguccuccuaggagcagga

SEQ ID NO: 364475 - RNA, 32 nt, Human
ccagccccagccccuggagauugcugucugcu

SEQ ID NO: 364476 - RNA, 32 nt, Human
ccagccccagccgcuccuccacgccuguccuu

SEQ ID NO: 364477 - RNA, 32 nt, Human
ccagccccagcucugcauaccugcaccugcac

SEQ ID NO: 364478 - RNA, 32 nt, Human
ccagccccagcuguuggcuacaugaguauuua

SEQ ID NO: 364479 - RNA, 32 nt, Human
ccagccccaggccaagcaaaaagaaagccccg

SEQ ID NO: 364480 - RNA, 32 nt, Human
ccagccccagggcuccagcccagcccggugga

SEQ ID NO: 364481 - RNA, 32 nt, Human
ccagccccaguaagagcacaagaggaagagag

SEQ ID NO: 364482 - RNA, 32 nt, Human
ccagccccaguaggaggagagcaggcagagcu

SEQ ID NO: 364483 - RNA, 32 nt, Human
ccagccccagugggcaagaccaaaguguggcg

SEQ ID NO: 364484 - RNA, 32 nt, Human
ccagccccaguucuuuuaucccugggcccaac

SEQ ID NO: 364485 - RNA, 24 nt, Human
ccagccccaucaccgaaacacaua

SEQ ID NO: 364486 - RNA, 23 nt, Human
ccagccccaucccccacagucca

SEQ ID NO: 364487 - RNA, 32 nt, Human
ccagccccaucggauccagacccggccaccag

SEQ ID NO: 364488 - RNA, 32 nt, Human
ccagccccaucuuacccgucugguuuuugagu

SEQ ID NO: 364489 - RNA, 32 nt, Human
ccagccccaugaggacccucaggcccggggcg

SEQ ID NO: 364490 - RNA, 21 nt, Human
ccagccccaugcaugcugcug

SEQ ID NO: 364491 - RNA, 32 nt, Human
ccagccccaugccaugguaggaggcagagucu

SEQ ID NO: 364492 - RNA, 32 nt, Human
ccagccccauugcccaccuccacuucccauug

SEQ ID NO: 364493 - RNA, 32 nt, Human
ccagcccccacugugcccagacaugugugcuc

SEQ ID NO: 364494 - RNA, 22 nt, Human
ccagcccccagcaagggcacuc

SEQ ID NO: 364495 - RNA, 32 nt, Human
ccagcccccagccuccucccucagccugggcu

SEQ ID NO: 364496 - RNA, 32 nt, Human
ccagcccccagccuugguggggaccaagcagc

SEQ ID NO: 364497 - RNA, 32 nt, Human
ccagcccccaggagcaagaccaagaccgcagg

SEQ ID NO: 364498 - RNA, 25 nt, Human
ccagcccccaggaggccccugcugc

SEQ ID NO: 364499 - RNA, 21 nt, Human
ccagcccccagugggacauca

SEQ ID NO: 364500 - RNA, 23 nt, Human
ccagccccccaagccuggccuca

SEQ ID NO: 364501 - RNA, 20 nt, Human
ccagccccccacacuaggcu

SEQ ID NO: 364502 - RNA, 26 nt, Human
ccagccccccgcggcugagguacuca

SEQ ID NO: 364503 - RNA, 21 nt, Human
ccagcccccgaccccgggcca

SEQ ID NO: 364504 - RNA, 24 nt, Human
ccagcccccggagagucaggccca

SEQ ID NO: 364505 - RNA, 23 nt, Human
ccagcccccggggauucaggcuc

SEQ ID NO: 364506 - RNA, 18 nt, Human
ccagcccccuccauccca

SEQ ID NO: 364507 - RNA, 19 nt, Human
ccagcccccugaccacuca

SEQ ID NO: 364508 - RNA, 23 nt, Human
ccagcccccugcagcccugcugc

SEQ ID NO: 364509 - RNA, 22 nt, Human
ccagcccccugccccgggcccg

SEQ ID NO: 364510 - RNA, 32 nt, Human
ccagcccccugcccuuuucuugcccugucucu

SEQ ID NO: 364511 - RNA, 32 nt, Human
ccagcccccugccggaugucuggcuggcaucu

SEQ ID NO: 364512 - RNA, 22 nt, Human
ccagcccccugugccuggcccc

SEQ ID NO: 364513 - RNA, 19 nt, Human
ccagcccccuucucccaca

SEQ ID NO: 364514 - RNA, 32 nt, Human
ccagcccccuuucccuuccuccuccuccagau

SEQ ID NO: 364515 - RNA, 32 nt, Human
ccagccccgaggaggaggaggaggaggaggaa

SEQ ID NO: 364516 - RNA, 21 nt, Human
ccagccccgccgggggcgcuc

SEQ ID NO: 364517 - RNA, 18 nt, Human
ccagccccgcugccccca

SEQ ID NO: 364518 - RNA, 19 nt, Human
ccagccccggccacagcca

SEQ ID NO: 364519 - RNA, 18 nt, Human
ccagccccguggccgcca

SEQ ID NO: 364520 - RNA, 32 nt, Human
ccagccccucacgccuccucucagucuacuca

SEQ ID NO: 364521 - RNA, 21 nt, Human
ccagccccucaggaacccuca

SEQ ID NO: 364522 - RNA, 32 nt, Human
ccagccccuccaaaggcucuuuccacagcugu

SEQ ID NO: 364523 - RNA, 32 nt, Human
ccagccccuccaccccuccccuacccccacaa

SEQ ID NO: 364524 - RNA, 32 nt, Human
ccagccccuccaccccuucuucaugcacagcu

SEQ ID NO: 364525 - RNA, 18 nt, Human
ccagccccuccagcacca

SEQ ID NO: 364526 - RNA, 32 nt, Human
ccagccccuccagcagcacagcauguccuggg

SEQ ID NO: 364527 - RNA, 32 nt, Human
ccagccccuccaggaccccuggacccacugcc

SEQ ID NO: 364528 - RNA, 32 nt, Human
ccagccccuccaggacccggucccccugcugc

SEQ ID NO: 364529 - RNA, 21 nt, Human
ccagccccuccagggcuuuca

SEQ ID NO: 364530 - RNA, 32 nt, Human
ccagccccuccaguacaaucccacuggaagaa

SEQ ID NO: 364531 - RNA, 21 nt, Human
ccagccccuccaucuguacuu

SEQ ID NO: 364532 - RNA, 17 nt, Human
ccagccccucccagcac

SEQ ID NO: 364533 - RNA, 22 nt, Human
ccagccccuccccagacucuca

SEQ ID NO: 364534 - RNA, 32 nt, Human
ccagccccucccccaauaaacucgccucuugg

SEQ ID NO: 364535 - RNA, 32 nt, Human
ccagccccuccccuccccuaccagucuucccg

SEQ ID NO: 364536 - RNA, 19 nt, Human
ccagccccucccucccacu

SEQ ID NO: 364537 - RNA, 21 nt, Human
ccagccccucccucuggguuc

SEQ ID NO: 364538 - RNA, 20 nt, Human
ccagccccuccucaccacuc

SEQ ID NO: 364539 - RNA, 32 nt, Human
ccagccccuccuccccacaaccccuagugggg

SEQ ID NO: 364540 - RNA, 25 nt, Human
ccagccccuccuccucagccacuca

SEQ ID NO: 364541 - RNA, 23 nt, Human
ccagccccuccucugaacacuca

SEQ ID NO: 364542 - RNA, 22 nt, Human
ccagccccuccucuuucccuca

SEQ ID NO: 364543 - RNA, 23 nt, Human
ccagccccucgaacgccuggcuu

SEQ ID NO: 364544 - RNA, 21 nt, Human
ccagccccucucccagacuca

SEQ ID NO: 364545 - RNA, 22 nt, Human
ccagccccucugcagagacaca

SEQ ID NO: 364546 - RNA, 21 nt, Human
ccagccccucuucugugccuu

SEQ ID NO: 364547 - RNA, 32 nt, Human
ccagccccugaccccaugucuccuggacucag

SEQ ID NO: 364548 - RNA, 21 nt, Human
ccagccccugcaacccaggcu

SEQ ID NO: 364549 - RNA, 32 nt, Human
ccagccccugcacacucccacccaggacagcc

SEQ ID NO: 364550 - RNA, 32 nt, Human
ccagccccugcagcaggaagcccccaguccca

SEQ ID NO: 364551 - RNA, 32 nt, Human
ccagccccugcagggauucugggcuacgagug

SEQ ID NO: 364552 - RNA, 32 nt, Human
ccagccccugcaggggcccaggcugccucuca

SEQ ID NO: 364553 - RNA, 32 nt, Human
ccagccccugccagucccccauggccccgugg

SEQ ID NO: 364554 - RNA, 21 nt, Human
ccagccccugccauaggccca

SEQ ID NO: 364555 - RNA, 21 nt, Human
ccagccccugcccccaggcuu

SEQ ID NO: 364556 - RNA, 21 nt, Human
ccagccccugccgcccagcuc

SEQ ID NO: 364557 - RNA, 20 nt, Human
ccagccccugcggcugcaag

SEQ ID NO: 364558 - RNA, 18 nt, Human
ccagccccugcucagguc

SEQ ID NO: 364559 - RNA, 32 nt, Human
ccagccccugcucccucugcggggaacguggc

SEQ ID NO: 364560 - RNA, 32 nt, Human
ccagccccugcuccuccucccagggagccaac

SEQ ID NO: 364561 - RNA, 22 nt, Human
ccagccccuggaugcagccuca

SEQ ID NO: 364562 - RNA, 21 nt, Human
ccagccccuggcccaggguca

SEQ ID NO: 364563 - RNA, 21 nt, Human
ccagccccuggcuuccugacc

SEQ ID NO: 364564 - RNA, 24 nt, Human
ccagccccugggcuggaagcacca

SEQ ID NO: 364565 - RNA, 24 nt, Human
ccagccccugucccuggggccuca

SEQ ID NO: 364566 - RNA, 18 nt, Human
ccagccccuguccucccu

SEQ ID NO: 364567 - RNA, 23 nt, Human
ccagccccugugggcgaggcuca

SEQ ID NO: 364568 - RNA, 23 nt, Human
ccagccccuguucucccagcuca

SEQ ID NO: 364569 - RNA, 21 nt, Human
ccagccccuguuuacugguuc

SEQ ID NO: 364570 - RNA, 22 nt, Human
ccagccccuuccaacccaguca

SEQ ID NO: 364571 - RNA, 20 nt, Human
ccagccccuuccaugguacu

SEQ ID NO: 364572 - RNA, 20 nt, Human
ccagccccuucccccaggcu

SEQ ID NO: 364573 - RNA, 26 nt, Human
ccagccccuuccucuguccgugcuca

SEQ ID NO: 364574 - RNA, 25 nt, Human
ccagccccuuccuucugcccacccg

SEQ ID NO: 364575 - RNA, 23 nt, Human
ccagccccuucuugucuuggcac

SEQ ID NO: 364576 - RNA, 21 nt, Human
ccagccccuuggaacaggcuu

SEQ ID NO: 364577 - RNA, 21 nt, Human
ccagccccuugucccaugccc

SEQ ID NO: 364578 - RNA, 32 nt, Human
ccagccccuuguccucugccuucugcuggcag

SEQ ID NO: 364579 - RNA, 32 nt, Human
ccagccccuuucucccucugccugaccacugg

SEQ ID NO: 364580 - RNA, 32 nt, Human
ccagccccuuucuucagggccccaaggggaaa

SEQ ID NO: 364581 - RNA, 25 nt, Human
ccagcccgacucccuccuccuuccc

SEQ ID NO: 364582 - RNA, 32 nt, Human
ccagcccgaguaagggcaucccggagccccca

SEQ ID NO: 364583 - RNA, 32 nt, Human
ccagcccgccucccggagccagccugcaccgu

SEQ ID NO: 364584 - RNA, 18 nt, Human
ccagcccgcggcucuggg

SEQ ID NO: 364585 - RNA, 25 nt, Human
ccagcccgcuccuucggcccugcca

SEQ ID NO: 364586 - RNA, 32 nt, Human
ccagcccggacaacauggcgaaaccucaucuc

SEQ ID NO: 364587 - RNA, 32 nt, Human
ccagcccggagcagccauccccugccaggucu

SEQ ID NO: 364588 - RNA, 32 nt, Human
ccagcccggagccaccaccgccgcggccgaag

SEQ ID NO: 364589 - RNA, 32 nt, Human
ccagcccggaggcugcagcccagaaacucuac

SEQ ID NO: 364590 - RNA, 32 nt, Human
ccagcccggcacuccagccuggcgacaagagu

SEQ ID NO: 364591 - RNA, 19 nt, Human
ccagcccggccacugcgga

SEQ ID NO: 364592 - RNA, 32 nt, Human
ccagcccggccagcagucccuucugggacagc

SEQ ID NO: 364593 - RNA, 32 nt, Human
ccagcccggcucccagugucugcccggcuccc

SEQ ID NO: 364594 - RNA, 23 nt, Human
ccagcccgggcgacagagcgaga

SEQ ID NO: 364595 - RNA, 23 nt, Human
ccagcccgggugacagagcgaga

SEQ ID NO: 364596 - RNA, 23 nt, Human
ccagcccgggugacagagugaaa

SEQ ID NO: 364597 - RNA, 32 nt, Human
ccagcccguccacccuggaguggucuucuuca

SEQ ID NO: 364598 - RNA, 32 nt, Human
ccagcccgugcagcugcucuacuccaggaaug

SEQ ID NO: 364599 - RNA, 32 nt, Human
ccagcccgugcccugaggggcucuugacaccc

SEQ ID NO: 364600 - RNA, 25 nt, Human
ccagcccuaaauaccccagcugcug

SEQ ID NO: 364601 - RNA, 32 nt, Human
ccagcccuaacuccaacucuaaagcuaacucc

SEQ ID NO: 364602 - RNA, 18 nt, Human
ccagcccuacaccuccca

SEQ ID NO: 364603 - RNA, 32 nt, Human
ccagcccuacagacuugcugugugaccucagg

SEQ ID NO: 364604 - RNA, 19 nt, Human
ccagcccuacagggcgagg

SEQ ID NO: 364605 - RNA, 32 nt, Human
ccagcccuagcagccuucuccccaaccaggau

SEQ ID NO: 364606 - RNA, 27 nt, Human
ccagcccuagcaucacugggccccaca

SEQ ID NO: 364607 - RNA, 22 nt, Human
ccagcccuaggcugggguucuu

SEQ ID NO: 364608 - RNA, 19 nt, Human
ccagcccucacccagguuu

SEQ ID NO: 364609 - RNA, 32 nt, Human
ccagcccucagacuggaucuucugccuccaaa

SEQ ID NO: 364610 - RNA, 23 nt, Human
ccagcccucaggcccucccugcc

SEQ ID NO: 364611 - RNA, 20 nt, Human
ccagcccucauccagaguuu

SEQ ID NO: 364612 - RNA, 32 nt, Human
ccagcccuccacguccucccaggcuggcucug

SEQ ID NO: 364613 - RNA, 32 nt, Human
ccagcccuccagcgucugccuccaggagcugc

SEQ ID NO: 364614 - RNA, 24 nt, Human
ccagcccucccagccccaggccca

SEQ ID NO: 364615 - RNA, 24 nt, Human
ccagcccuccccuaccgaccucug

SEQ ID NO: 364616 - RNA, 22 nt, Human
ccagcccuccccucccaucugu

SEQ ID NO: 364617 - RNA, 21 nt, Human
ccagcccucccgcucaggcca

SEQ ID NO: 364618 - RNA, 32 nt, Human
ccagcccucccgcugcagccugcagggagcga

SEQ ID NO: 364619 - RNA, 32 nt, Human
ccagcccuccuccuccucggaauccuggguuu

SEQ ID NO: 364620 - RNA, 31 nt, Human
ccagcccuccucucugcauccugggucccag

SEQ ID NO: 364621 - RNA, 23 nt, Human
ccagcccuccucugggagccuca

SEQ ID NO: 364622 - RNA, 26 nt, Human
ccagcccuccugcugcccacggccca

SEQ ID NO: 364623 - RNA, 32 nt, Human
ccagcccuccugggccagcccagagggcccuu

SEQ ID NO: 364624 - RNA, 21 nt, Human
ccagcccuccugucugagcuu

SEQ ID NO: 364625 - RNA, 32 nt, Human
ccagcccucuaauuugugccucucuuguguug

SEQ ID NO: 364626 - RNA, 32 nt, Human
ccagcccucucuuugugcauuagcaacaguaa

SEQ ID NO: 364627 - RNA, 32 nt, Human
ccagcccucugccuuuucaucccagaaugugu

SEQ ID NO: 364628 - RNA, 32 nt, Human
ccagcccugacaggcccugcgugugccaugug

SEQ ID NO: 364629 - RNA, 32 nt, Human
ccagcccugagauguccaugguuuggcuguuu

SEQ ID NO: 364630 - RNA, 22 nt, Human
ccagcccugaguucugggcuca

SEQ ID NO: 364631 - RNA, 32 nt, Human
ccagcccugcagcccccuuccccaggagcaag

SEQ ID NO: 364632 - RNA, 32 nt, Human
ccagcccugcagcuucagcaccugccccaccc

SEQ ID NO: 364633 - RNA, 32 nt, Human
ccagcccugcaguaaucuccaggccugguuau

SEQ ID NO: 364634 - RNA, 32 nt, Human
ccagcccugcccacccucccuccacuccucuc

SEQ ID NO: 364635 - RNA, 32 nt, Human
ccagcccugcccagcccugcccggaggcagac

SEQ ID NO: 364636 - RNA, 32 nt, Human
ccagcccugcccugcccugcccugcccugccc

SEQ ID NO: 364637 - RNA, 32 nt, Human
ccagcccugccgcauuuccuuucaguggcuug

SEQ ID NO: 364638 - RNA, 32 nt, Human
ccagcccugccuccagggcuccugggcugcca

SEQ ID NO: 364639 - RNA, 32 nt, Human
ccagcccugccuccuccuuucucccuuuuccu

SEQ ID NO: 364640 - RNA, 32 nt, Human
ccagcccugccucucugcggauucccugccug

SEQ ID NO: 364641 - RNA, 32 nt, Human
ccagcccugccugagcagccuuuccuccuugc

SEQ ID NO: 364642 - RNA, 32 nt, Human
ccagcccugccugggccuaccuccugcccagc

SEQ ID NO: 364643 - RNA, 32 nt, Human
ccagcccugccuguccccagccagcacugcag

SEQ ID NO: 364644 - RNA, 32 nt, Human
ccagcccugcuauuuccagccuccugaaggcu

SEQ ID NO: 364645 - RNA, 32 nt, Human
ccagcccugcucaggaagucucuggcugucuu

SEQ ID NO: 364646 - RNA, 31 nt, Human
ccagcccugcucccugggccuuccuccagcc

SEQ ID NO: 364647 - RNA, 32 nt, Human
ccagcccugcucucagcacuucccauguggaa

SEQ ID NO: 364648 - RNA, 32 nt, Human
ccagcccugcugccaucauuggcugaagcacc

SEQ ID NO: 364649 - RNA, 32 nt, Human
ccagcccugcugcccagagggacugagccacu

SEQ ID NO: 364650 - RNA, 20 nt, Human
ccagcccugcuggggcccag

SEQ ID NO: 364651 - RNA, 32 nt, Human
ccagcccuggaccccagcagaugaggaaacgg

SEQ ID NO: 364652 - RNA, 32 nt, Human
ccagcccuggccugcagggugggcaggguggg

SEQ ID NO: 364653 - RNA, 32 nt, Human
ccagcccuggcugaccuggccuagcaguuugg

SEQ ID NO: 364654 - RNA, 32 nt, Human
ccagcccuggcuguuuacucaggcucucuuag

SEQ ID NO: 364655 - RNA, 32 nt, Human
ccagcccugggaauggagucuugauucuucuc

SEQ ID NO: 364656 - RNA, 32 nt, Human
ccagcccuggggacccagcucagggaggcucu

SEQ ID NO: 364657 - RNA, 17 nt, Human
ccagcccuggggcucag

SEQ ID NO: 364658 - RNA, 24 nt, Human
ccagcccuggggcugggcccccca

SEQ ID NO: 364659 - RNA, 32 nt, Human
ccagcccuggguccucccacccucucuccucc

SEQ ID NO: 364660 - RNA, 32 nt, Human
ccagcccuggugagccaaggacaaccacacag

SEQ ID NO: 364661 - RNA, 21 nt, Human
ccagcccugguucccugcugc

SEQ ID NO: 364662 - RNA, 32 nt, Human
ccagcccugucaccgcugcuuccagaggaggc

SEQ ID NO: 364663 - RNA, 32 nt, Human
ccagcccugucccucacuguccucuguccuug

SEQ ID NO: 364664 - RNA, 20 nt, Human
ccagcccuguccugaccuca

SEQ ID NO: 364665 - RNA, 32 nt, Human
ccagcccugugcaguggugaggaggccccugg

SEQ ID NO: 364666 - RNA, 22 nt, Human
ccagcccugugccgggucccag

SEQ ID NO: 364667 - RNA, 32 nt, Human
ccagcccugugggcaccaugcucuaaacugaa

SEQ ID NO: 364668 - RNA, 32 nt, Human
ccagcccuuaagccugccuccaccuuccuggu

SEQ ID NO: 364669 - RNA, 21 nt, Human
ccagcccuucccccucccuca

SEQ ID NO: 364670 - RNA, 24 nt, Human
ccagcccuucccucccucugcaga

SEQ ID NO: 364671 - RNA, 32 nt, Human
ccagcccuuccuagugcccaugggcuuuacau

SEQ ID NO: 364672 - RNA, 32 nt, Human
ccagcccuuccucucacuccugccuccgcugg

SEQ ID NO: 364673 - RNA, 19 nt, Human
ccagcccuuccuugccacu

SEQ ID NO: 364674 - RNA, 32 nt, Human
ccagcccuucucccucccucccuuccucccuc

SEQ ID NO: 364675 - RNA, 22 nt, Human
ccagcccuucucccuguaccca

SEQ ID NO: 364676 - RNA, 22 nt, Human
ccagcccuucuuggagccuuca

SEQ ID NO: 364677 - RNA, 32 nt, Human
ccagcccuugaggcagaggugccgagugacug

SEQ ID NO: 364678 - RNA, 32 nt, Human
ccagcccuugagucugucacacucucuugggc

SEQ ID NO: 364679 - RNA, 23 nt, Human
ccagcccuugauuucccugcugc

SEQ ID NO: 364680 - RNA, 32 nt, Human
ccagcccuugcuuggucacagguuacacagau

SEQ ID NO: 364681 - RNA, 22 nt, Human
ccagcccuugggccuggcucca

SEQ ID NO: 364682 - RNA, 24 nt, Human
ccagcccuuuacuaagggcaauua

SEQ ID NO: 364683 - RNA, 32 nt, Human
ccagcccuuuugaagagcagcuucuguguucc

SEQ ID NO: 364684 - RNA, 17 nt, Human
ccagccgaagcugcagg

SEQ ID NO: 364685 - RNA, 32 nt, Human
ccagccgaaugagaucaaaaguuggggguggg

SEQ ID NO: 364686 - RNA, 21 nt, Human
ccagccgacacacacagucca

SEQ ID NO: 364687 - RNA, 32 nt, Human
ccagccgacacacacaguccacugagaugaua

SEQ ID NO: 364688 - RNA, 21 nt, Human
ccagccgagccacaucgcuca

SEQ ID NO: 364689 - RNA, 21 nt, Human
ccagccgagggacccuggugg

SEQ ID NO: 364690 - RNA, 32 nt, Human
ccagccgauguguccucaucucaggcccgugc

SEQ ID NO: 364691 - RNA, 19 nt, Human
ccagccgcagccggggcca

SEQ ID NO: 364692 - RNA, 32 nt, Human
ccagccgcagcgcauucucaugcuguggcccc

SEQ ID NO: 364693 - RNA, 32 nt, Human
ccagccgcaugcuggggacaggccuggaaggc

SEQ ID NO: 364694 - RNA, 32 nt, Human
ccagccgcauuuucacagcugacugaccacuc

SEQ ID NO: 364695 - RNA, 32 nt, Human
ccagccgccaccucugcccucucccaucccug

SEQ ID NO: 364696 - RNA, 32 nt, Human
ccagccgccagucauggacacagggcacugcc

SEQ ID NO: 364697 - RNA, 32 nt, Human
ccagccgccguggaguaacacagccagcaguu

SEQ ID NO: 364698 - RNA, 32 nt, Human
ccagccgccuggcugcugccgcugccuccucc

SEQ ID NO: 364699 - RNA, 21 nt, Human
ccagccgcgcugccgccgccg

SEQ ID NO: 364700 - RNA, 24 nt, Human
ccagccgcggggacuccgggcccg

SEQ ID NO: 364701 - RNA, 32 nt, Human
ccagccgcuaccuaacagcuggagcuugagug

SEQ ID NO: 364702 - RNA, 32 nt, Human
ccagccgcuagugcugguggccgccgcugcug

SEQ ID NO: 364703 - RNA, 21 nt, Human
ccagccgcuccuccacgccug

SEQ ID NO: 364704 - RNA, 32 nt, Human
ccagccgcuccuccacgccuguccuuagaaag

SEQ ID NO: 364705 - RNA, 32 nt, Human
ccagccgcuggaggaagccuucucugccagcg

SEQ ID NO: 364706 - RNA, 32 nt, Human
ccagccgcuggcucccagccuggcugaagcgg

SEQ ID NO: 364707 - RNA, 32 nt, Human
ccagccggaaggcggggaauccggcugacacc

SEQ ID NO: 364708 - RNA, 32 nt, Human
ccagccggacccauggccugcccauaucuuac

SEQ ID NO: 364709 - RNA, 32 nt, Human
ccagccggacucaggugggucuggaggagcac

SEQ ID NO: 364710 - RNA, 32 nt, Human
ccagccggagcagccggagcugaagcggauca

SEQ ID NO: 364711 - RNA, 23 nt, Human
ccagccggagccaccuccuuccc

SEQ ID NO: 364712 - RNA, 32 nt, Human
ccagccggcagcaguguguccagccugccucu

SEQ ID NO: 364713 - RNA, 32 nt, Human
ccagccggcagcccgggccuuucucguucaca

SEQ ID NO: 364714 - RNA, 32 nt, Human
ccagccggccagacucucaucuugaugucuug

SEQ ID NO: 364715 - RNA, 18 nt, Human
ccagccggccugguccca

SEQ ID NO: 364716 - RNA, 32 nt, Human
ccagccggccuugggagccuggaggagcaaag

SEQ ID NO: 364717 - RNA, 32 nt, Human
ccagccggcggaccucaggcgguggacgucgg

SEQ ID NO: 364718 - RNA, 32 nt, Human
ccagccgggccaacacugagaaacccugccuc

SEQ ID NO: 364719 - RNA, 17 nt, Human
ccagccgggccaccucu

SEQ ID NO: 364720 - RNA, 19 nt, Human
ccagccgggccauagcuca

SEQ ID NO: 364721 - RNA, 32 nt, Human
ccagccgggccauagcucaggcugcagcagaa

SEQ ID NO: 364722 - RNA, 32 nt, Human
ccagccgggcuggaggcugugcagaagguauc

SEQ ID NO: 364723 - RNA, 32 nt, Human
ccagccgggcuucaguuccauauuugccaugu

SEQ ID NO: 364724 - RNA, 32 nt, Human
ccagccggggcaacauggcaaaacccugucuc

SEQ ID NO: 364725 - RNA, 32 nt, Human
ccagccgggggcccugcacaggcagccucagg

SEQ ID NO: 364726 - RNA, 32 nt, Human
ccagccgguaucccaggucucccuucagugcc

SEQ ID NO: 364727 - RNA, 32 nt, Human
ccagccggugcucagguggcccaggggccgca

SEQ ID NO: 364728 - RNA, 32 nt, Human
ccagccgguggcaagguguuaaccucagaaga

SEQ ID NO: 364729 - RNA, 32 nt, Human
ccagccgucccgagcuaccagcagguuucauu

SEQ ID NO: 364730 - RNA, 32 nt, Human
ccagccguccuccugcagcuggagccuucagg

SEQ ID NO: 364731 - RNA, 22 nt, Human
ccagccgugagaggacugcuca

SEQ ID NO: 364732 - RNA, 32 nt, Human
ccagccgugaugacaggcaccuguaaucccag

SEQ ID NO: 364733 - RNA, 32 nt, Human
ccagccgugcagcugcccaggcgcuauggcga

SEQ ID NO: 364734 - RNA, 32 nt, Human
ccagccgugcggugcagccucaugcccccaac

SEQ ID NO: 364735 - RNA, 32 nt, Human
ccagccgugggugggggcccugaggugaagag

SEQ ID NO: 364736 - RNA, 32 nt, Human
ccagccgugguggcuuacaccuguaaucccag

SEQ ID NO: 364737 - RNA, 23 nt, Human
ccagccuaagcaauagagcgaga

SEQ ID NO: 364738 - RNA, 32 nt, Human
ccagccuaauaucagacuggagccagaaguag

SEQ ID NO: 364739 - RNA, 24 nt, Human
ccagccuagaacauccugcucuga

SEQ ID NO: 364740 - RNA, 32 nt, Human
ccagccuagccaccucugccucuugggucagc

SEQ ID NO: 364741 - RNA, 23 nt, Human
ccagccuagccugaacccugcca

SEQ ID NO: 364742 - RNA, 22 nt, Human
ccagccuagcgacagagcaaga

SEQ ID NO: 364743 - RNA, 24 nt, Human
ccagccuaggcaacaagagcgaaa

SEQ ID NO: 364744 - RNA, 24 nt, Human
ccagccuaggcaacaagagugaaa

SEQ ID NO: 364745 - RNA, 21 nt, Human
ccagccuaggcaacagagcga

SEQ ID NO: 364746 - RNA, 23 nt, Human
ccagccuaggcaacagagcgaga

SEQ ID NO: 364747 - RNA, 23 nt, Human
ccagccuaggcaacagagggaga

SEQ ID NO: 364748 - RNA, 23 nt, Human
ccagccuaggcaacagagugaga

SEQ ID NO: 364749 - RNA, 32 nt, Human
ccagccuaggcaacauagcaagaccucaucuu

SEQ ID NO: 364750 - RNA, 23 nt, Human
ccagccuaggcaacauagcgaga

SEQ ID NO: 364751 - RNA, 23 nt, Human
ccagccuaggcaacauagugaga

SEQ ID NO: 364752 - RNA, 32 nt, Human
ccagccuaggcaacauagugagaugcucaucu

SEQ ID NO: 364753 - RNA, 32 nt, Human
ccagccuaggcaacauggagaaaccccgucuc

SEQ ID NO: 364754 - RNA, 23 nt, Human
ccagccuaggcgacagagcgaga

SEQ ID NO: 364755 - RNA, 32 nt, Human
ccagccuaggguggggaagugaggaagaaggg

SEQ ID NO: 364756 - RNA, 23 nt, Human
ccagccuaggugacagagcgaga

SEQ ID NO: 364757 - RNA, 32 nt, Human
ccagccuauccaagugccaggaagggaagcac

SEQ ID NO: 364758 - RNA, 22 nt, Human
ccagccuaucugauggcauggu

SEQ ID NO: 364759 - RNA, 32 nt, Human
ccagccucaagcgaugcucccaccuccaccuc

SEQ ID NO: 364760 - RNA, 32 nt, Human
ccagccucaaguuucaccuauccucacugauc

SEQ ID NO: 364761 - RNA, 23 nt, Human
ccagccucacacugaccucagca

SEQ ID NO: 364762 - RNA, 24 nt, Human
ccagccucagcaacaagagugaaa

SEQ ID NO: 364763 - RNA, 32 nt, Human
ccagccucagcaucaccacggagcucacccac

SEQ ID NO: 364764 - RNA, 32 nt, Human
ccagccucagccagggcagggagggggacucc

SEQ ID NO: 364765 - RNA, 32 nt, Human
ccagccucagccccaacucccagcaaagccca

SEQ ID NO: 364766 - RNA, 19 nt, Human
ccagccucagcuggcccca

SEQ ID NO: 364767 - RNA, 23 nt, Human
ccagccucaggcaggaaacagca

SEQ ID NO: 364768 - RNA, 32 nt, Human
ccagccucagguccucugcuucuccccaccca

SEQ ID NO: 364769 - RNA, 32 nt, Human
ccagccucaggucgccccgccugggcccgcgc

SEQ ID NO: 364770 - RNA, 32 nt, Human
ccagccucaggugauccacccaccucagccuc

SEQ ID NO: 364771 - RNA, 32 nt, Human
ccagccucagugcagcccccuccugaccccac

SEQ ID NO: 364772 - RNA, 32 nt, Human
ccagccucauuuccaacuccgacuuccuacuu

SEQ ID NO: 364773 - RNA, 23 nt, Human
ccagccuccaacuccagcugagu

SEQ ID NO: 364774 - RNA, 24 nt, Human
ccagccuccaagcucagcagcauc

SEQ ID NO: 364775 - RNA, 32 nt, Human
ccagccuccacaacugugaggaauaauguaug

SEQ ID NO: 364776 - RNA, 32 nt, Human
ccagccuccacccccacuccagccucagcggg

SEQ ID NO: 364777 - RNA, 22 nt, Human
ccagccuccacccccauccaga

SEQ ID NO: 364778 - RNA, 32 nt, Human
ccagccuccagccucucauuucuggggcuccc

SEQ ID NO: 364779 - RNA, 32 nt, Human
ccagccuccagccugaccccagagcagaaccg

SEQ ID NO: 364780 - RNA, 18 nt, Human
ccagccuccaggccccca

SEQ ID NO: 364781 - RNA, 21 nt, Human
ccagccuccaguccuggguuc

SEQ ID NO: 364782 - RNA, 32 nt, Human
ccagccuccaucuacaccaagaacacccagca

SEQ ID NO: 364783 - RNA, 32 nt, Human
ccagccucccaaaauacugggauuacaggcuu

SEQ ID NO: 364784 - RNA, 32 nt, Human
ccagccucccaaaaugcugggauuacaggcgu

SEQ ID NO: 364785 - RNA, 32 nt, Human
ccagccucccaaagcgcugggauuacaggugu

SEQ ID NO: 364786 - RNA, 32 nt, Human
ccagccucccaaagugcuaagauuacaggcgu

SEQ ID NO: 364787 - RNA, 32 nt, Human
ccagccucccaaagugcugggauuacaagugu

SEQ ID NO: 364788 - RNA, 32 nt, Human
ccagccucccaaagugcugggauuacaggcau

SEQ ID NO: 364789 - RNA, 32 nt, Human
ccagccucccaaagugcugggauuacaggcgu

SEQ ID NO: 364790 - RNA, 32 nt, Human
ccagccucccaaagugcugggauuacaggugu

SEQ ID NO: 364791 - RNA, 32 nt, Human
ccagccucccaaagugcugggauugcaggcau

SEQ ID NO: 364792 - RNA, 32 nt, Human
ccagccucccaaguagcugggauuacaggugu

SEQ ID NO: 364793 - RNA, 32 nt, Human
ccagccucccaaguagcugggauuauaggugc

SEQ ID NO: 364794 - RNA, 32 nt, Human
ccagccucccacagugcugggauuacaggcgu

SEQ ID NO: 364795 - RNA, 22 nt, Human
ccagccucccacccugguccca

SEQ ID NO: 364796 - RNA, 24 nt, Human
ccagccucccagucccugcucuga

SEQ ID NO: 364797 - RNA, 32 nt, Human
ccagccucccauauagcugggauuauaggugc

SEQ ID NO: 364798 - RNA, 32 nt, Human
ccagccucccauccucugguggucugggagga

SEQ ID NO: 364799 - RNA, 19 nt, Human
ccagccuccccacccaggc

SEQ ID NO: 364800 - RNA, 22 nt, Human
ccagccuccccggggacaccca

SEQ ID NO: 364801 - RNA, 23 nt, Human
ccagccuccccugaacccugcca

SEQ ID NO: 364802 - RNA, 22 nt, Human
ccagccuccgucuucuggucca

SEQ ID NO: 364803 - RNA, 32 nt, Human
ccagccuccucagacaaaaugguacaccccaa

SEQ ID NO: 364804 - RNA, 32 nt, Human
ccagccuccucgcccuccuccacccccucucc

SEQ ID NO: 364805 - RNA, 18 nt, Human
ccagccuccucgcuccca

SEQ ID NO: 364806 - RNA, 21 nt, Human
ccagccuccucuuucccuccc

SEQ ID NO: 364807 - RNA, 32 nt, Human
ccagccuccugagcuccaugcccaucaggacu

SEQ ID NO: 364808 - RNA, 17 nt, Human
ccagccuccuggcccca

SEQ ID NO: 364809 - RNA, 23 nt, Human
ccagccucggaaauaccucaaua

SEQ ID NO: 364810 - RNA, 32 nt, Human
ccagccucggcaacauggcaaaaucuugucuc

SEQ ID NO: 364811 - RNA, 32 nt, Human
ccagccucggccucucccuccugaguugccuu

SEQ ID NO: 364812 - RNA, 21 nt, Human
ccagccucggccuuccuuccc

SEQ ID NO: 364813 - RNA, 32 nt, Human
ccagccucggggccgguugccuccucuucucu

SEQ ID NO: 364814 - RNA, 19 nt, Human
ccagccucguggcguggga

SEQ ID NO: 364815 - RNA, 23 nt, Human
ccagccucguggucuucuccaag

SEQ ID NO: 364816 - RNA, 32 nt, Human
ccagccucuacccaucccucccucccaauuag

SEQ ID NO: 364817 - RNA, 20 nt, Human
ccagccucuacguuagguuc

SEQ ID NO: 364818 - RNA, 32 nt, Human
ccagccucuaucuccugagccuauagagcccc

SEQ ID NO: 364819 - RNA, 32 nt, Human
ccagccucuccaagcucaaguacaaauacagc

SEQ ID NO: 364820 - RNA, 22 nt, Human
ccagccucuccccacagucuca

SEQ ID NO: 364821 - RNA, 32 nt, Human
ccagccucuccccgcucuggauccugcacucu

SEQ ID NO: 364822 - RNA, 32 nt, Human
ccagccucuccccuccucuuggccuccagagu

SEQ ID NO: 364823 - RNA, 20 nt, Human
ccagccucucccuccagcac

SEQ ID NO: 364824 - RNA, 24 nt, Human
ccagccucucccugccaaagccca

SEQ ID NO: 364825 - RNA, 20 nt, Human
ccagccucuccggcgcgcuc

SEQ ID NO: 364826 - RNA, 32 nt, Human
ccagccucuccucugcugagaauccccacuug

SEQ ID NO: 364827 - RNA, 24 nt, Human
ccagccucucugccaagucacuca

SEQ ID NO: 364828 - RNA, 32 nt, Human
ccagccucucuggagcugaaucguggcuggcu

SEQ ID NO: 364829 - RNA, 23 nt, Human
ccagccucucuggccagggccuu

SEQ ID NO: 364830 - RNA, 21 nt, Human
ccagccucucuggggcauggc

SEQ ID NO: 364831 - RNA, 32 nt, Human
ccagccucugcaacagcucugccuccucucca

SEQ ID NO: 364832 - RNA, 32 nt, Human
ccagccucugccggcuccccuaggcaaccccu

SEQ ID NO: 364833 - RNA, 32 nt, Human
ccagccucugcugcuccugcuccuggguuuga

SEQ ID NO: 364834 - RNA, 32 nt, Human
ccagccucugcuucccuccucucuccagugcu

SEQ ID NO: 364835 - RNA, 32 nt, Human
ccagccucugucccucuuugccugugugagca

SEQ ID NO: 364836 - RNA, 23 nt, Human
ccagccucugucuugggagcuca

SEQ ID NO: 364837 - RNA, 32 nt, Human
ccagccucugugggccugugaccugcagaaau

SEQ ID NO: 364838 - RNA, 20 nt, Human
ccagccucuguuggcggcuc

SEQ ID NO: 364839 - RNA, 32 nt, Human
ccagccucuuccauucccuuucuuuucaugcc

SEQ ID NO: 364840 - RNA, 23 nt, Human
ccagccucuucccccugggcuuc

SEQ ID NO: 364841 - RNA, 32 nt, Human
ccagccucuuccucagucccccaaaccaaagc

SEQ ID NO: 364842 - RNA, 19 nt, Human
ccagccucuuccugggcca

SEQ ID NO: 364843 - RNA, 23 nt, Human
ccagccucuuccugggccagcca

SEQ ID NO: 364844 - RNA, 32 nt, Human
ccagccucuucucucacuauccguuucugaca

SEQ ID NO: 364845 - RNA, 21 nt, Human
ccagccucuucugcgcaccca

SEQ ID NO: 364846 - RNA, 32 nt, Human
ccagccucuuuccaucauccuuccuccaccug

SEQ ID NO: 364847 - RNA, 22 nt, Human
ccagccucuuuccccuaggggc

SEQ ID NO: 364848 - RNA, 32 nt, Human
ccagccucuuucucccuaccaaccuccuccuc

SEQ ID NO: 364849 - RNA, 32 nt, Human
ccagccucuuucucccugccaaccuccuccuc

SEQ ID NO: 364850 - RNA, 25 nt, Human
ccagccucuuucugaaugcagcuca

SEQ ID NO: 364851 - RNA, 32 nt, Human
ccagccugaagaaaugucaagcagagccccag

SEQ ID NO: 364852 - RNA, 32 nt, Human
ccagccugaagacagagcaaggcuccaucuua

SEQ ID NO: 364853 - RNA, 18 nt, Human
ccagccugaagagcgaga

SEQ ID NO: 364854 - RNA, 32 nt, Human
ccagccugaaguuugugggggccaaaccuggg

SEQ ID NO: 364855 - RNA, 32 nt, Human
ccagccugaccaaaauggugaaaccuccucuc

SEQ ID NO: 364856 - RNA, 32 nt, Human
ccagccugaccaacacugagaaaccccaucuc

SEQ ID NO: 364857 - RNA, 32 nt, Human
ccagccugaccaacauagagaaaccucgucuc

SEQ ID NO: 364858 - RNA, 32 nt, Human
ccagccugaccaacauggagaaacccaaucuc

SEQ ID NO: 364859 - RNA, 32 nt, Human
ccagccugaccaacauggagaaacccagucuc

SEQ ID NO: 364860 - RNA, 32 nt, Human
ccagccugaccaacauggagaaaccucgucuc

SEQ ID NO: 364861 - RNA, 23 nt, Human
ccagccugaccaacauggugaaa

SEQ ID NO: 364862 - RNA, 32 nt, Human
ccagccugaccaacauggugaaaccucaacuc

SEQ ID NO: 364863 - RNA, 32 nt, Human
ccagccugaccaacauggugaaaccucaucuc

SEQ ID NO: 364864 - RNA, 32 nt, Human
ccagccugaccaacauggugaaaccucgucuc

SEQ ID NO: 364865 - RNA, 32 nt, Human
ccagccugaccaacguggagaaaccucgucuc

SEQ ID NO: 364866 - RNA, 32 nt, Human
ccagccugaccaacguggcgaaaccucgucuc

SEQ ID NO: 364867 - RNA, 32 nt, Human
ccagccugaccaauaugaugaaaccccgucuc

SEQ ID NO: 364868 - RNA, 32 nt, Human
ccagccugaccaucauggugaaaccucaucuc

SEQ ID NO: 364869 - RNA, 32 nt, Human
ccagccugaccgacauggagaaaccucgucuc

SEQ ID NO: 364870 - RNA, 32 nt, Human
ccagccugaccuggcccgccgcugcagcggug

SEQ ID NO: 364871 - RNA, 32 nt, Human
ccagccugacuagguacaggcaagcuugugug

SEQ ID NO: 364872 - RNA, 21 nt, Human
ccagccugacucaaaaggaga

SEQ ID NO: 364873 - RNA, 32 nt, Human
ccagccugacugugguucccagcuccagcccu

SEQ ID NO: 364874 - RNA, 32 nt, Human
ccagccugagacugugcaacuccagguggaag

SEQ ID NO: 364875 - RNA, 21 nt, Human
ccagccugagaggagucaaga

SEQ ID NO: 364876 - RNA, 23 nt, Human
ccagccugagcaacaaagcaaga

SEQ ID NO: 364877 - RNA, 22 nt, Human
ccagccugagcaacaagagcga

SEQ ID NO: 364878 - RNA, 24 nt, Human
ccagccugagcaacaagagcgaaa

SEQ ID NO: 364879 - RNA, 23 nt, Human
ccagccugagcaacacagugaga

SEQ ID NO: 364880 - RNA, 21 nt, Human
ccagccugagcaacagagcga

SEQ ID NO: 364881 - RNA, 23 nt, Human
ccagccugagcaacagagcgaga

SEQ ID NO: 364882 - RNA, 23 nt, Human
ccagccugagcaacagagugaga

SEQ ID NO: 364883 - RNA, 23 nt, Human
ccagccugagcaacauagcgaga

SEQ ID NO: 364884 - RNA, 32 nt, Human
ccagccugagcaacauagcgagaccccaucuu

SEQ ID NO: 364885 - RNA, 23 nt, Human
ccagccugagcaacauagugaga

SEQ ID NO: 364886 - RNA, 32 nt, Human
ccagccugagcaacauaucaaaaccccaucuc

SEQ ID NO: 364887 - RNA, 32 nt, Human
ccagccugagcaacauaucaaaaccccgucuc

SEQ ID NO: 364888 - RNA, 23 nt, Human
ccagccugagcaacaugaugaga

SEQ ID NO: 364889 - RNA, 32 nt, Human
ccagccugagcaacauggcgaaaccucauauc

SEQ ID NO: 364890 - RNA, 23 nt, Human
ccagccugagcaacauggugaaa

SEQ ID NO: 364891 - RNA, 21 nt, Human
ccagccugaggaggagggaga

SEQ ID NO: 364892 - RNA, 18 nt, Human
ccagccugagggcagugg

SEQ ID NO: 364893 - RNA, 20 nt, Human
ccagccugagguggaugaga

SEQ ID NO: 364894 - RNA, 32 nt, Human
ccagccugagucuucuccuugcucugcggggu

SEQ ID NO: 364895 - RNA, 23 nt, Human
ccagccugagugacagagcgaga

SEQ ID NO: 364896 - RNA, 32 nt, Human
ccagccugaguuucucuuucucucuuuuuaac

SEQ ID NO: 364897 - RNA, 32 nt, Human
ccagccugaucaacguggugaaaccucuacua

SEQ ID NO: 364898 - RNA, 32 nt, Human
ccagccugaugccaccuccucuguucuuggaa

SEQ ID NO: 364899 - RNA, 23 nt, Human
ccagccugcaaaaagggacagcu

SEQ ID NO: 364900 - RNA, 32 nt, Human
ccagccugcaaccauccugccuuuccccaggg

SEQ ID NO: 364901 - RNA, 24 nt, Human
ccagccugcacaacaagagugaaa

SEQ ID NO: 364902 - RNA, 19 nt, Human
ccagccugcaccucagcca

SEQ ID NO: 364903 - RNA, 32 nt, Human
ccagccugcagaggagagaagccugagcaagc

SEQ ID NO: 364904 - RNA, 32 nt, Human
ccagccugcagcaacagaacacuugaccuuaa

SEQ ID NO: 364905 - RNA, 21 nt, Human
ccagccugcauccucuccuca

SEQ ID NO: 364906 - RNA, 32 nt, Human
ccagccugcauccucuccucaggccuccuucc

SEQ ID NO: 364907 - RNA, 32 nt, Human
ccagccugccaagaaaacgguaggggagcaug

SEQ ID NO: 364908 - RNA, 32 nt, Human
ccagccugccaaguagcugggauuacagacag

SEQ ID NO: 364909 - RNA, 32 nt, Human
ccagccugccaaucaacccuccuggguguggc

SEQ ID NO: 364910 - RNA, 32 nt, Human
ccagccugcccaaauggugaaaccccaucucu

SEQ ID NO: 364911 - RNA, 32 nt, Human
ccagccugcccacuacauccagccuguggcuu

SEQ ID NO: 364912 - RNA, 25 nt, Human
ccagccugccccggcagcccgggcc

SEQ ID NO: 364913 - RNA, 19 nt, Human
ccagccugccccuugcugc

SEQ ID NO: 364914 - RNA, 32 nt, Human
ccagccugccuauaagguugggauuagcaugc

SEQ ID NO: 364915 - RNA, 32 nt, Human
ccagccugccugaccuggauucugagaacugg

SEQ ID NO: 364916 - RNA, 32 nt, Human
ccagccugccuggaugacagagcgagacucca

SEQ ID NO: 364917 - RNA, 32 nt, Human
ccagccugcgggaaggugguauggccggcugu

SEQ ID NO: 364918 - RNA, 21 nt, Human
ccagccugcuauaggcuggcu

SEQ ID NO: 364919 - RNA, 19 nt, Human
ccagccugcuccuggcccc

SEQ ID NO: 364920 - RNA, 22 nt, Human
ccagccugcuggucagcaggcu

SEQ ID NO: 364921 - RNA, 32 nt, Human
ccagccugcuguucccgcuuuccauauagcuu

SEQ ID NO: 364922 - RNA, 32 nt, Human
ccagccuggaacccugagauggccuccagcuc

SEQ ID NO: 364923 - RNA, 32 nt, Human
ccagccuggaagcagggaguaaggcuggacuc

SEQ ID NO: 364924 - RNA, 24 nt, Human
ccagccuggacaacaagagcgaaa

SEQ ID NO: 364925 - RNA, 23 nt, Human
ccagccuggacaacacagugaga

SEQ ID NO: 364926 - RNA, 21 nt, Human
ccagccuggacaacagagcga

SEQ ID NO: 364927 - RNA, 23 nt, Human
ccagccuggacaacagagcgaga

SEQ ID NO: 364928 - RNA, 23 nt, Human
ccagccuggacaacagagugaga

SEQ ID NO: 364929 - RNA, 32 nt, Human
ccagccuggacaacauaaugagacccucgucu

SEQ ID NO: 364930 - RNA, 23 nt, Human
ccagccuggacaacauagugaga

SEQ ID NO: 364931 - RNA, 32 nt, Human
ccagccuggacaacaucgugaaaccuugucuc

SEQ ID NO: 364932 - RNA, 23 nt, Human
ccagccuggacaacauggugaga

SEQ ID NO: 364933 - RNA, 32 nt, Human
ccagccuggacaacauugugaaaccuugucuc

SEQ ID NO: 364934 - RNA, 24 nt, Human
ccagccuggacagcaggagcgaaa

SEQ ID NO: 364935 - RNA, 21 nt, Human
ccagccuggaccccgugcaga

SEQ ID NO: 364936 - RNA, 32 nt, Human
ccagccuggaccccgugcagagcuucucccaa

SEQ ID NO: 364937 - RNA, 20 nt, Human
ccagccuggacuuggcccca

SEQ ID NO: 364938 - RNA, 20 nt, Human
ccagccuggagagggcuggc

SEQ ID NO: 364939 - RNA, 20 nt, Human
ccagccuggaguacaguggc

SEQ ID NO: 364940 - RNA, 32 nt, Human
ccagccuggagucuuauucuccaccugagaau

SEQ ID NO: 364941 - RNA, 19 nt, Human
ccagccuggagugcagugg

SEQ ID NO: 364942 - RNA, 23 nt, Human
ccagccuggauaacagagcgaga

SEQ ID NO: 364943 - RNA, 32 nt, Human
ccagccuggaucugucucucccuuccccuccu

SEQ ID NO: 364944 - RNA, 24 nt, Human
ccagccuggaugacaagagugaaa

SEQ ID NO: 364945 - RNA, 32 nt, Human
ccagccuggaugacagagaaggucaugggaac

SEQ ID NO: 364946 - RNA, 23 nt, Human
ccagccuggaugacagagcgaaa

SEQ ID NO: 364947 - RNA, 23 nt, Human
ccagccuggaugacagagugaaa

SEQ ID NO: 364948 - RNA, 32 nt, Human
ccagccuggaugacauaaugagauucugucuc

SEQ ID NO: 364949 - RNA, 22 nt, Human
ccagccuggcaacagagcaaga

SEQ ID NO: 364950 - RNA, 24 nt, Human
ccagccuggcaacagagcaaggcu

SEQ ID NO: 364951 - RNA, 22 nt, Human
ccagccuggcaacagagcgaga

SEQ ID NO: 364952 - RNA, 32 nt, Human
ccagccuggcagcuucucacaugguaaacacg

SEQ ID NO: 364953 - RNA, 32 nt, Human
ccagccuggccaaauggugaaaccccaucucu

SEQ ID NO: 364954 - RNA, 23 nt, Human
ccagccuggccaacaaggcgaaa

SEQ ID NO: 364955 - RNA, 32 nt, Human
ccagccuggccaacacgaugaaaccccgucuc

SEQ ID NO: 364956 - RNA, 32 nt, Human
ccagccuggccaacauaaugaaaccccaucuc

SEQ ID NO: 364957 - RNA, 32 nt, Human
ccagccuggccaacauaauuaaaaugucucua

SEQ ID NO: 364958 - RNA, 32 nt, Human
ccagccuggccaacaugacccaucuuuacuaa

SEQ ID NO: 364959 - RNA, 32 nt, Human
ccagccuggccaacaugaugaaaccccaucuc

SEQ ID NO: 364960 - RNA, 32 nt, Human
ccagccuggccaacaugaugaaaccccgucuc

SEQ ID NO: 364961 - RNA, 32 nt, Human
ccaggcuggaguguaguggugugaucucggcu

SEQ ID NO: 364962 - RNA, 32 nt, Human
ccaggcuggaguguagugguguguucuuggcu

SEQ ID NO: 364963 - RNA, 19 nt, Human
ccaggcuggaguucagugg

SEQ ID NO: 364964 - RNA, 32 nt, Human
ccaggcuggauggagugcaguggcgugaucuc

SEQ ID NO: 364965 - RNA, 32 nt, Human
ccaggcuggauggagugcccuggcgcgaucuc

SEQ ID NO: 364966 - RNA, 32 nt, Human
ccaggcuggauggagugcccuggcgcgaucuu

SEQ ID NO: 364967 - RNA, 19 nt, Human
ccaggcuggcagagcugga

SEQ ID NO: 364968 - RNA, 32 nt, Human
ccaggcuggccuuuggguuggcccaggcagga

SEQ ID NO: 364969 - RNA, 19 nt, Human
ccaggcuggcgugcagugg

SEQ ID NO: 364970 - RNA, 25 nt, Human
ccaggcuggcucuggagcugugagg

SEQ ID NO: 364971 - RNA, 32 nt, Human
ccaggcugggagaaggggccguugggugucua

SEQ ID NO: 364972 - RNA, 32 nt, Human
ccaggcugggagaaggggcuccugggugucug

SEQ ID NO: 364973 - RNA, 32 nt, Human
ccaggcugggagaagguggaaggucccagagc

SEQ ID NO: 364974 - RNA, 32 nt, Human
ccaggcugggagagggagcagggcggcggccc

SEQ ID NO: 364975 - RNA, 32 nt, Human
ccaggcugggcaacauagugagaccuguuguc

SEQ ID NO: 364976 - RNA, 32 nt, Human
ccaggcugggcaacaugacgaaauccugucuc

SEQ ID NO: 364977 - RNA, 32 nt, Human
ccaggcugggcaacauggugaaaccccagcuc

SEQ ID NO: 364978 - RNA, 32 nt, Human
ccaggcugggcagcaagagcaagacucuaucu

SEQ ID NO: 364979 - RNA, 32 nt, Human
ccaggcugggcuguggcuucaagcuuuggaaa

SEQ ID NO: 364980 - RNA, 18 nt, Human
ccaggcuggggugcagug

SEQ ID NO: 364981 - RNA, 19 nt, Human
ccaggcuggggugcagugg

SEQ ID NO: 364982 - RNA, 21 nt, Human
ccaggcuggggugcaguggug

SEQ ID NO: 364983 - RNA, 32 nt, Human
ccaggcuggggugggagaaggaagcaggacag

SEQ ID NO: 364984 - RNA, 18 nt, Human
ccaggcugggugcagugg

SEQ ID NO: 364985 - RNA, 32 nt, Human
ccaggcuggucucaaacccccagccucaacug

SEQ ID NO: 364986 - RNA, 32 nt, Human
ccaggcuggucuccaucaccugaucucaggug

SEQ ID NO: 364987 - RNA, 32 nt, Human
ccaggcuggucucgaacuccugacugaccuug

SEQ ID NO: 364988 - RNA, 32 nt, Human
ccaggcuggucucgaacuccugccucaaguga

SEQ ID NO: 364989 - RNA, 32 nt, Human
ccaggcuggucucgacccugaccucaggguga

SEQ ID NO: 364990 - RNA, 32 nt, Human
ccaggcuguaagcauucugagcugggcuuguu

SEQ ID NO: 364991 - RNA, 32 nt, Human
ccaggcuguacccgcugcucucagcugggccc

SEQ ID NO: 364992 - RNA, 19 nt, Human
ccaggcuguagugcagugg

SEQ ID NO: 364993 - RNA, 32 nt, Human
ccaggcugucacucaauucggucauuucauuc

SEQ ID NO: 364994 - RNA, 32 nt, Human
ccaggcugucucaaacuccuggccucaagugg

SEQ ID NO: 364995 - RNA, 32 nt, Human
ccaggcugucuuagccccuggaguucagaagu

SEQ ID NO: 364996 - RNA, 32 nt, Human
ccaggcugucuucuccucaucacagggacgag

SEQ ID NO: 364997 - RNA, 22 nt, Human
ccaggcugugaccucgcugccu

SEQ ID NO: 364998 - RNA, 32 nt, Human
ccaggcugugagaggauuauacugaguaguag

SEQ ID NO: 364999 - RNA, 32 nt, Human
ccaggcugugcaagccccugaggucuugagag

SEQ ID NO: 365000 - RNA, 32 nt, Human
ccaggcugugcccuccagaggacccuugccuc

SEQ ID NO: 365001 - RNA, 32 nt, Human
ccaggcugugcgcacccaggagaaggagcaga

SEQ ID NO: 365002 - RNA, 21 nt, Human
ccaggcugugguaaaacguug

SEQ ID NO: 365003 - RNA, 32 nt, Human
ccaggcuguuccugccuaaaucuccagcccug

SEQ ID NO: 365004 - RNA, 32 nt, Human
ccaggcuuaaacgauucucccaccucagccuc

SEQ ID NO: 365005 - RNA, 32 nt, Human
ccaggcuuaagcaauucuccugccucagccuc

SEQ ID NO: 365006 - RNA, 19 nt, Human
ccaggcuuacaucuuccca

SEQ ID NO: 365007 - RNA, 32 nt, Human
ccaggcuuagcuccagccucccggcggccucu

SEQ ID NO: 365008 - RNA, 32 nt, Human
ccaggcuucacacccaagcuggcucagcagcc

SEQ ID NO: 365009 - RNA, 32 nt, Human
ccaggcuucauggauucuugacauguaauugu

SEQ ID NO: 365010 - RNA, 18 nt, Human
ccaggcuucauucaccca

SEQ ID NO: 365011 - RNA, 32 nt, Human
ccaggcuuccaagaaagaggaggagaguugaa

SEQ ID NO: 365012 - RNA, 20 nt, Human
ccaggcuucccccacuuccc

SEQ ID NO: 365013 - RNA, 23 nt, Human
ccaggcuuccuggagggugacug

SEQ ID NO: 365014 - RNA, 32 nt, Human
ccaggcuugagugacagagcaagacuguaucu

SEQ ID NO: 365015 - RNA, 19 nt, Human
ccaggcuugagugcagugg

SEQ ID NO: 365016 - RNA, 32 nt, Human
ccaggcuugcagccuuucuucggagaguggag

SEQ ID NO: 365017 - RNA, 32 nt, Human
ccaggcuugcagcugcuccauccuccccugaa

SEQ ID NO: 365018 - RNA, 19 nt, Human
ccaggcuugcagucuccca

SEQ ID NO: 365019 - RNA, 21 nt, Human
ccaggcuugccccucagcuca

SEQ ID NO: 365020 - RNA, 32 nt, Human
ccaggcuugccccucagcucagcacuguugac

SEQ ID NO: 365021 - RNA, 32 nt, Human
ccaggcuuggccaggauguccuuugcucuggg

SEQ ID NO: 365022 - RNA, 22 nt, Human
ccaggcuugggggugauggagg

SEQ ID NO: 365023 - RNA, 32 nt, Human
ccaggcuugggugggguuuguggugcaggcag

SEQ ID NO: 365024 - RNA, 32 nt, Human
ccaggcuuggugaggaagaggaaggggccuca

SEQ ID NO: 365025 - RNA, 32 nt, Human
ccaggcuugguggcucacgccuguaaucccag

SEQ ID NO: 365026 - RNA, 32 nt, Human
ccaggcuugguggcucaggccuguaaucccag

SEQ ID NO: 365027 - RNA, 32 nt, Human
ccaggcuugguggcucaugccuguaauuccag

SEQ ID NO: 365028 - RNA, 32 nt, Human
ccaggcuuuaucugucagguggcaauucucac

SEQ ID NO: 365029 - RNA, 32 nt, Human
ccaggcuuugcaaacccagccucccagugcuc

SEQ ID NO: 365030 - RNA, 32 nt, Human
ccaggcuuugccugaugacaaguauacucuga

SEQ ID NO: 365031 - RNA, 32 nt, Human
ccaggcuuugcuguuccccagcagccugcaga

SEQ ID NO: 365032 - RNA, 32 nt, Human
ccaggcuuugguuucugcccacucagaguggc

SEQ ID NO: 365033 - RNA, 32 nt, Human
ccagggaaaccagcuacucagggacuucucuu

SEQ ID NO: 365034 - RNA, 32 nt, Human
ccagggaaaggagaaaagagaaaacaggcugg

SEQ ID NO: 365035 - RNA, 32 nt, Human
ccagggaacaaagcaauugucugccucucccu

SEQ ID NO: 365036 - RNA, 24 nt, Human
ccagggaacccuccccugcugcug

SEQ ID NO: 365037 - RNA, 32 nt, Human
ccagggaacuaaauucauuccugaugccagau

SEQ ID NO: 365038 - RNA, 21 nt, Human
ccagggaacucaguuuuccca

SEQ ID NO: 365039 - RNA, 32 nt, Human
ccagggaagaaugacagccacagggagauggu

SEQ ID NO: 365040 - RNA, 32 nt, Human
ccagggaagaggaggaagaagaggaggaggag

SEQ ID NO: 365041 - RNA, 32 nt, Human
ccagggaagaggcagggagggagcugaggacc

SEQ ID NO: 365042 - RNA, 32 nt, Human
ccagggaagcggagguugcagugagccgagug

SEQ ID NO: 365043 - RNA, 32 nt, Human
ccagggaaggaggcagcuaggcuguagaugga

SEQ ID NO: 365044 - RNA, 32 nt, Human
ccagggaagggacugggaggggagagaagaga

SEQ ID NO: 365045 - RNA, 32 nt, Human
ccagggaaucuaggagagaugaggcccgucag

SEQ ID NO: 365046 - RNA, 32 nt, Human
ccagggaaugcacacacgugcacuggagcagc

SEQ ID NO: 365047 - RNA, 32 nt, Human
ccagggaauuuucacccucucaguccucagga

SEQ ID NO: 365048 - RNA, 19 nt, Human
ccagggacacauuuuccca

SEQ ID NO: 365049 - RNA, 23 nt, Human
ccagggacaccccuccccagcuc

SEQ ID NO: 365050 - RNA, 32 nt, Human
ccagggacagccgccucagguccuggugaagg

SEQ ID NO: 365051 - RNA, 32 nt, Human
ccagggacaggagccacccuccccaggcccaa

SEQ ID NO: 365052 - RNA, 32 nt, Human
ccagggaccacaccugccacucagggaagaga

SEQ ID NO: 365053 - RNA, 32 nt, Human
ccagggaccagcccuggugggcaugggguggg

SEQ ID NO: 365054 - RNA, 32 nt, Human
ccagggacccagacaaggagcaucuggaaaac

SEQ ID NO: 365055 - RNA, 17 nt, Human
ccagggaccugccucug

SEQ ID NO: 365056 - RNA, 23 nt, Human
ccagggacgaagaagagccacag

SEQ ID NO: 365057 - RNA, 32 nt, Human
ccagggacggaaugccuggucuugagcaaccu

SEQ ID NO: 365058 - RNA, 32 nt, Human
ccagggacggcaugagcaggaggcggggacgu

SEQ ID NO: 365059 - RNA, 32 nt, Human
ccagggacuacugcacccgcuucugccuuguu

SEQ ID NO: 365060 - RNA, 18 nt, Human
ccagggacucggaggaag

SEQ ID NO: 365061 - RNA, 32 nt, Human
ccagggacucugcccauguucccagggccuca

SEQ ID NO: 365062 - RNA, 32 nt, Human
ccagggacucuuccuguuucauaaggaaagga

SEQ ID NO: 365063 - RNA, 32 nt, Human
ccagggacugggaggugggggugauagauaua

SEQ ID NO: 365064 - RNA, 32 nt, Human
ccagggacugugugcucaggagcacuguggua

SEQ ID NO: 365065 - RNA, 32 nt, Human
ccagggacuuggggaggaagaauggggaguga

SEQ ID NO: 365066 - RNA, 32 nt, Human
ccagggacuuugggccugcucuagcuucagaa

SEQ ID NO: 365067 - RNA, 32 nt, Human
ccagggagaagggagagcaggaguauuggggc

SEQ ID NO: 365068 - RNA, 32 nt, Human
ccagggagaagguucuucgcucaguaugaaga

SEQ ID NO: 365069 - RNA, 32 nt, Human
ccagggagaccgugucaguagggaugugugcc

SEQ ID NO: 365070 - RNA, 32 nt, Human
ccagggagaggagccagugacacaggcagagc

SEQ ID NO: 365071 - RNA, 32 nt, Human
ccagggagagggagcgcgagagagggagggag

SEQ ID NO: 365072 - RNA, 32 nt, Human
ccagggagcagccacacgucugucuguguuua

SEQ ID NO: 365073 - RNA, 21 nt, Human
ccagggagcaggguuccccac

SEQ ID NO: 365074 - RNA, 32 nt, Human
ccagggagccaccugaguggagcucagaacac

SEQ ID NO: 365075 - RNA, 32 nt, Human
ccagggagccacuggcuguacacaccugggcc

SEQ ID NO: 365076 - RNA, 32 nt, Human
ccagggagcccccagaggacuuuauucggacc

SEQ ID NO: 365077 - RNA, 19 nt, Human
ccagggagccgggguuagg

SEQ ID NO: 365078 - RNA, 32 nt, Human
ccagggagcuccagggccccucucuccuccca

SEQ ID NO: 365079 - RNA, 32 nt, Human
ccagggagcugcaggggcaugggaaggugggc

SEQ ID NO: 365080 - RNA, 32 nt, Human
ccagggagcugcccggcuggccuaggcaggca

SEQ ID NO: 365081 - RNA, 32 nt, Human
ccagggaggacaggaugcugggcaggggaagc

SEQ ID NO: 365082 - RNA, 32 nt, Human
ccagggaggagauguggagaggauguggccaa

SEQ ID NO: 365083 - RNA, 24 nt, Human
ccagggaggaggagcuugcaguga

SEQ ID NO: 365084 - RNA, 25 nt, Human
ccagggaggaggagcuugcagugag

SEQ ID NO: 365085 - RNA, 32 nt, Human
ccagggaggaggagcuugcagugagccgagau

SEQ ID NO: 365086 - RNA, 19 nt, Human
ccagggaggcaaggggcug

SEQ ID NO: 365087 - RNA, 24 nt, Human
ccagggaggcagagauugcaguga

SEQ ID NO: 365088 - RNA, 25 nt, Human
ccagggaggcagagauugcagugag

SEQ ID NO: 365089 - RNA, 32 nt, Human
ccagggaggcagagauugcagugagccgagau

SEQ ID NO: 365090 - RNA, 32 nt, Human
ccagggaggcagagguugcagugagcccagau

SEQ ID NO: 365091 - RNA, 32 nt, Human
ccagggaggcagagguugcagugagccgagau

SEQ ID NO: 365092 - RNA, 22 nt, Human
ccagggaggcagagguugcugu

SEQ ID NO: 365093 - RNA, 24 nt, Human
ccagggaggcagaguuugcaguga

SEQ ID NO: 365094 - RNA, 18 nt, Human
ccagggaggcagcaccau

SEQ ID NO: 365095 - RNA, 21 nt, Human
ccagggaggcagcugcugccu

SEQ ID NO: 365096 - RNA, 25 nt, Human
ccagggaggcccccaccugcugccu

SEQ ID NO: 365097 - RNA, 24 nt, Human
ccagggaggcggagcuugcaguga

SEQ ID NO: 365098 - RNA, 25 nt, Human
ccagggaggcggagcuugcagugag

SEQ ID NO: 365099 - RNA, 21 nt, Human
ccagggaggcggagguugcag

SEQ ID NO: 365100 - RNA, 32 nt, Human
ccagggaggcggagguugcagcaagccaagau

SEQ ID NO: 365101 - RNA, 23 nt, Human
ccagggaggcggagguugcagug

SEQ ID NO: 365102 - RNA, 24 nt, Human
ccagggaggcggagguugcaguga

SEQ ID NO: 365103 - RNA, 25 nt, Human
ccagggaggcggagguugcagugag

SEQ ID NO: 365104 - RNA, 32 nt, Human
ccagggaggcggagguugcagugagccgaggu

SEQ ID NO: 365105 - RNA, 32 nt, Human
ccagggaggcggagguugcugcaaagcauggu

SEQ ID NO: 365106 - RNA, 23 nt, Human
ccagggaggcugcccacagucua

SEQ ID NO: 365107 - RNA, 32 nt, Human
ccagggagggacccccacccccaagcacuggg

SEQ ID NO: 365108 - RNA, 32 nt, Human
ccagggagggagaaggaagagggggagcuggu

SEQ ID NO: 365109 - RNA, 20 nt, Human
ccagggagggagcaugggaa

SEQ ID NO: 365110 - RNA, 32 nt, Human
ccagggagggccugaaggcugguggcugggcu

SEQ ID NO: 365111 - RNA, 32 nt, Human
ccagggagggccuggcagagacugagcacugg

SEQ ID NO: 365112 - RNA, 32 nt, Human
ccagggaggggaggggaugggaagcaccacca

SEQ ID NO: 365113 - RNA, 32 nt, Human
ccagggaggggauggcccugagcccagcggcu

SEQ ID NO: 365114 - RNA, 32 nt, Human
ccagggaggguggaggcccaggagaccaaagg

SEQ ID NO: 365115 - RNA, 32 nt, Human
ccagggagguagaggcuucagugagcugagau

SEQ ID NO: 365116 - RNA, 24 nt, Human
ccagggagguagagguugcaguga

SEQ ID NO: 365117 - RNA, 25 nt, Human
ccagggagguagagguugcagugag

SEQ ID NO: 365118 - RNA, 32 nt, Human
ccagggagguagagguugcagugagcugagau

SEQ ID NO: 365119 - RNA, 32 nt, Human
ccagggagguaggccagagggagcgcgggcuu

SEQ ID NO: 365120 - RNA, 24 nt, Human
ccagggaggucaaggcugcaguga

SEQ ID NO: 365121 - RNA, 25 nt, Human
ccagggaggucaaggcugcagugag

SEQ ID NO: 365122 - RNA, 32 nt, Human
ccagggaggucaaggcugcagugagcaaugau

SEQ ID NO: 365123 - RNA, 25 nt, Human
ccagggaggucgaggcugcagugag

SEQ ID NO: 365124 - RNA, 32 nt, Human
ccagggaggucgaugcugcagugagcuauggu

SEQ ID NO: 365125 - RNA, 32 nt, Human
ccagggagguggaggcuacagugagccaugau

SEQ ID NO: 365126 - RNA, 24 nt, Human
ccagggagguggagguugcaguga

SEQ ID NO: 365127 - RNA, 25 nt, Human
ccagggagguggagguugcagugag

SEQ ID NO: 365128 - RNA, 32 nt, Human
ccagggagguggagguugcagugagccaagau

SEQ ID NO: 365129 - RNA, 32 nt, Human
ccagggagguggagguugcagugagccgagau

SEQ ID NO: 365130 - RNA, 32 nt, Human
ccagggagguggagguugcagugagcugagau

SEQ ID NO: 365131 - RNA, 32 nt, Human
ccagggagguugaggcugcagugagcuaugau

SEQ ID NO: 365132 - RNA, 25 nt, Human
ccagggagucaaaggcuguagugag

SEQ ID NO: 365133 - RNA, 24 nt, Human
ccagggagucagagguugcaguga

SEQ ID NO: 365134 - RNA, 25 nt, Human
ccagggagucagagguugcagugag

SEQ ID NO: 365135 - RNA, 25 nt, Human
ccagggagucagagguuucagugag

SEQ ID NO: 365136 - RNA, 24 nt, Human
ccagggagucggagauugcaguga

SEQ ID NO: 365137 - RNA, 25 nt, Human
ccagggagucggagauugcagugag

SEQ ID NO: 365138 - RNA, 32 nt, Human
ccagggagucggagauugcagugagcugagau

SEQ ID NO: 365139 - RNA, 32 nt, Human
ccagggagugcagagccagggagagggguacc

SEQ ID NO: 365140 - RNA, 32 nt, Human
ccagggauaaagagcuuccucacuggauggga

SEQ ID NO: 365141 - RNA, 23 nt, Human
ccagggaucccccagcuccccca

SEQ ID NO: 365142 - RNA, 32 nt, Human
ccagggaugagcugaugguugcuggaggaggc

SEQ ID NO: 365143 - RNA, 25 nt, Human
ccagggaugcaaagguugcagugag

SEQ ID NO: 365144 - RNA, 32 nt, Human
ccagggaugcaggggauccaggauucucugcc

SEQ ID NO: 365145 - RNA, 18 nt, Human
ccagggaugcaguggugu

SEQ ID NO: 365146 - RNA, 32 nt, Human
ccagggaugccacccuuucgucaccucuucca

SEQ ID NO: 365147 - RNA, 32 nt, Human
ccagggaugccaccgaacauccuacaaugcac

SEQ ID NO: 365148 - RNA, 32 nt, Human
ccagggaugcugagguugcacgagcugagauc

SEQ ID NO: 365149 - RNA, 32 nt, Human
ccagggauucaaggccaaccugggcaauagag

SEQ ID NO: 365150 - RNA, 32 nt, Human
ccagggcaaagcaguggcucagggcuccuugg

SEQ ID NO: 365151 - RNA, 32 nt, Human
ccagggcaacacagcaagaccccaucucuaca

SEQ ID NO: 365152 - RNA, 32 nt, Human
ccagggcaacacagccagacgcccuuguuuuu

SEQ ID NO: 365153 - RNA, 32 nt, Human
ccagggcaacacagcccgcacuccacaaguac

SEQ ID NO: 365154 - RNA, 25 nt, Human
ccagggcaacacagcgagacccugu

SEQ ID NO: 365155 - RNA, 32 nt, Human
ccagggcaacacagcgagacccugucccaaaa

SEQ ID NO: 365156 - RNA, 25 nt, Human
ccagggcaacaugaugagacccugu

SEQ ID NO: 365157 - RNA, 21 nt, Human
ccagggcaacauggugaaacc

SEQ ID NO: 365158 - RNA, 22 nt, Human
ccagggcaacauggugagaccu

SEQ ID NO: 365159 - RNA, 32 nt, Human
ccagggcaagggaacagcagaacuuaggguca

SEQ ID NO: 365160 - RNA, 32 nt, Human
ccagggcaagggacaggaggacagggguucuc

SEQ ID NO: 365161 - RNA, 22 nt, Human
ccagggcaaugauuucccugca

SEQ ID NO: 365162 - RNA, 32 nt, Human
ccagggcacaucugugguacccagggacgucc

SEQ ID NO: 365163 - RNA, 17 nt, Human
ccagggcacccgccucu

SEQ ID NO: 365164 - RNA, 32 nt, Human
ccagggcagaaaccuugccuucaaggguuuuu

SEQ ID NO: 365165 - RNA, 32 nt, Human
ccagggcagcaacuggcccuccugucccucac

SEQ ID NO: 365166 - RNA, 19 nt, Human
ccagggcagcagagcuagg

SEQ ID NO: 365167 - RNA, 18 nt, Human
ccagggcagcagggccag

SEQ ID NO: 365168 - RNA, 32 nt, Human
ccagggcagccccugggcaggagacguggcug

SEQ ID NO: 365169 - RNA, 32 nt, Human
ccagggcagcguucagcacacuccugggcaug

SEQ ID NO: 365170 - RNA, 32 nt, Human
ccagggcaggaaggaauggaaggauggagcua

SEQ ID NO: 365171 - RNA, 19 nt, Human
ccagggcaggagagcgcag

SEQ ID NO: 365172 - RNA, 32 nt, Human
ccagggcaggaugguuuaccugccuggacagc

SEQ ID NO: 365173 - RNA, 32 nt, Human
ccagggcaggcagaucaucugaggucaggagu

SEQ ID NO: 365174 - RNA, 32 nt, Human
ccagggcaggcagaugggggcggcggcacacc

SEQ ID NO: 365175 - RNA, 21 nt, Human
ccagggcaggccugggacaga

SEQ ID NO: 365176 - RNA, 32 nt, Human
ccagggcaggccugggacagagucaaggcuca

SEQ ID NO: 365177 - RNA, 32 nt, Human
ccagggcaggcuccucccaggcggcuguauuc

SEQ ID NO: 365178 - RNA, 19 nt, Human
ccagggcaggcucuggaca

SEQ ID NO: 365179 - RNA, 32 nt, Human
ccagggcagggugggcagccuaugggggcucu

SEQ ID NO: 365180 - RNA, 32 nt, Human
ccagggcagguggauugccugaggucgggagu

SEQ ID NO: 365181 - RNA, 32 nt, Human
ccagggcaucacauccuggggcucagaccccu

SEQ ID NO: 365182 - RNA, 32 nt, Human
ccagggcauccaggaacaggcuccagggcagg

SEQ ID NO: 365183 - RNA, 32 nt, Human
ccagggcaucuggagucugaaggacccuaguu

SEQ ID NO: 365184 - RNA, 22 nt, Human
ccagggcaugguccugcugcuu

SEQ ID NO: 365185 - RNA, 32 nt, Human
ccagggcauuguccuccagcccgucaugccca

SEQ ID NO: 365186 - RNA, 32 nt, Human
ccagggccaagccugugacucaacuccagggg

SEQ ID NO: 365187 - RNA, 32 nt, Human
ccagggccaaggagcugggacucacaggagug

SEQ ID NO: 365188 - RNA, 20 nt, Human
ccagggccacacugaugagc

SEQ ID NO: 365189 - RNA, 32 nt, Human
ccagggccacagcagagaggggcgcaggagcu

SEQ ID NO: 365190 - RNA, 32 nt, Human
ccagggccaccaagggcucugcuccagccucu

SEQ ID NO: 365191 - RNA, 32 nt, Human
ccagggccacccagagguaagaggacauuuag

SEQ ID NO: 365192 - RNA, 32 nt, Human
ccagggccacggaggggccaggagucucacag

SEQ ID NO: 365193 - RNA, 32 nt, Human
ccagggccacuuguugaagucugagcacuuua

SEQ ID NO: 365194 - RNA, 32 nt, Human
ccagggccagagagccggagagaggagccccc

SEQ ID NO: 365195 - RNA, 22 nt, Human
ccagggccaggagggcgggagg

SEQ ID NO: 365196 - RNA, 32 nt, Human
ccagggccaggccagaaaucagccugggagaa

SEQ ID NO: 365197 - RNA, 32 nt, Human
ccagggccagggcugcagccugaggcucaggc

SEQ ID NO: 365198 - RNA, 17 nt, Human
ccagggccagggcuuag

SEQ ID NO: 365199 - RNA, 25 nt, Human
ccagggccauccccacuuccugccu

SEQ ID NO: 365200 - RNA, 32 nt, Human
ccagggcccaaagcccagcucuuuguucaguu

SEQ ID NO: 365201 - RNA, 19 nt, Human
ccagggcccaccccagcca

SEQ ID NO: 365202 - RNA, 32 nt, Human
ccagggcccaggaacugucaucagagcagaaa

SEQ ID NO: 365203 - RNA, 32 nt, Human
ccagggcccaggagagagaagcagggagggag

SEQ ID NO: 365204 - RNA, 32 nt, Human
ccagggcccaggccucagcccaggccucggga

SEQ ID NO: 365205 - RNA, 18 nt, Human
ccagggcccaucugggag

SEQ ID NO: 365206 - RNA, 25 nt, Human
ccagggccccacccaccuccugcuu

SEQ ID NO: 365207 - RNA, 18 nt, Human
ccagggccccacccagug

SEQ ID NO: 365208 - RNA, 32 nt, Human
ccagggcccccagggcuauacauuucccugaa

SEQ ID NO: 365209 - RNA, 21 nt, Human
ccagggcccccucccucguca

SEQ ID NO: 365210 - RNA, 21 nt, Human
ccagggccccucacccugccu

SEQ ID NO: 365211 - RNA, 32 nt, Human
ccagggcccgggagagugugagguuucaggaa

SEQ ID NO: 365212 - RNA, 32 nt, Human
ccagggcccucagacagaagguuccacagaaa

SEQ ID NO: 365213 - RNA, 21 nt, Human
ccagggcccuccuggcuccca

SEQ ID NO: 365214 - RNA, 18 nt, Human
ccagggcccucgguggga

SEQ ID NO: 365215 - RNA, 32 nt, Human
ccagggcccugccucuugugcagagcucagcg

SEQ ID NO: 365216 - RNA, 32 nt, Human
ccagggcccugguggaggcugcugugggacgg

SEQ ID NO: 365217 - RNA, 32 nt, Human
ccagggcccuugggacagggacaggaacagca

SEQ ID NO: 365218 - RNA, 32 nt, Human
ccagggcccuuuacucucuucucccuccagac

SEQ ID NO: 365219 - RNA, 32 nt, Human
ccagggccgauuuugcuccuucaagggacauu

SEQ ID NO: 365220 - RNA, 32 nt, Human
ccagggccgcaccggcuuuccugcugcagauc

SEQ ID NO: 365221 - RNA, 32 nt, Human
ccagggccgcacuccggagacucgcgguugcu

SEQ ID NO: 365222 - RNA, 24 nt, Human
ccagggccgcuccuccaccacccu

SEQ ID NO: 365223 - RNA, 32 nt, Human
ccagggccgcucggucacgcugcgcagcucuc

SEQ ID NO: 365224 - RNA, 32 nt, Human
ccagggccgcuuccagcuuggagauacacagc

SEQ ID NO: 365225 - RNA, 32 nt, Human
ccagggccggcgggggcacugcgcacuggccg

SEQ ID NO: 365226 - RNA, 21 nt, Human
ccagggccgggcgcccgggcc

SEQ ID NO: 365227 - RNA, 32 nt, Human
ccagggccgggcggagccagagccagacgcgc

SEQ ID NO: 365228 - RNA, 32 nt, Human
ccagggccguuggcuuaugccuguaaucccag

SEQ ID NO: 365229 - RNA, 32 nt, Human
ccagggccuaggacaguaacuggcauacugua

SEQ ID NO: 365230 - RNA, 32 nt, Human
ccagggccuaggcugauagucagagccugugg

SEQ ID NO: 365231 - RNA, 32 nt, Human
ccagggccucacugcucuacuucaucaugaac

SEQ ID NO: 365232 - RNA, 32 nt, Human
ccagggccucauucagucucagaccaaguuua

SEQ ID NO: 365233 - RNA, 32 nt, Human
ccagggccuccagggcccagguucgagaccca

SEQ ID NO: 365234 - RNA, 25 nt, Human
ccagggccucccuccaccuccuccu

SEQ ID NO: 365235 - RNA, 32 nt, Human
ccagggccuccuggcuccagggcaugugggug

SEQ ID NO: 365236 - RNA, 32 nt, Human
ccagggccucggcggcugcugaagggauucua

SEQ ID NO: 365237 - RNA, 32 nt, Human
ccagggccucucccucccucccucccucucug

SEQ ID NO: 365238 - RNA, 32 nt, Human
ccagggccucuccuuggaaggucuuuugaagg

SEQ ID NO: 365239 - RNA, 32 nt, Human
ccagggccucugggacacuugccuugacuugc

SEQ ID NO: 365240 - RNA, 32 nt, Human
ccagggccugagcaccagucucaggccugcuu

SEQ ID NO: 365241 - RNA, 32 nt, Human
ccagggccuggcccuaccuccuggucuuguaa

SEQ ID NO: 365242 - RNA, 32 nt, Human
ccagggccuggcccugcugcacaugcccugcc

SEQ ID NO: 365243 - RNA, 32 nt, Human
ccagggccugggaaauuucuacuuauccucau

SEQ ID NO: 365244 - RNA, 32 nt, Human
ccagggccugggaagagggucgcucuccggcc

SEQ ID NO: 365245 - RNA, 32 nt, Human
ccagggccugggacugcuccuuccccagccag

SEQ ID NO: 365246 - RNA, 22 nt, Human
ccagggccugggaguuucagga

SEQ ID NO: 365247 - RNA, 32 nt, Human
ccagggccugugccagcucccuucccuccccg

SEQ ID NO: 365248 - RNA, 32 nt, Human
ccagggccuuucuccucccaggaucugggaaa

SEQ ID NO: 365249 - RNA, 32 nt, Human
ccagggcgagaguugaaaaacuaccuacaggg

SEQ ID NO: 365250 - RNA, 32 nt, Human
ccagggcgaggagggagggugaaggaacggag

SEQ ID NO: 365251 - RNA, 32 nt, Human
ccagggcgcugcagaggggcugugugccacag

SEQ ID NO: 365252 - RNA, 32 nt, Human
ccagggcggcucagcggacaauaaccgggcua

SEQ ID NO: 365253 - RNA, 23 nt, Human
ccagggcggcuccucccuccgca

SEQ ID NO: 365254 - RNA, 32 nt, Human
ccagggcggggugggaaucgguugagagccgc

SEQ ID NO: 365255 - RNA, 32 nt, Human
ccagggcgguagcgugaaacuugguggaagac

SEQ ID NO: 365256 - RNA, 32 nt, Human
ccagggcguccuccagcucagccacugcacug

SEQ ID NO: 365257 - RNA, 21 nt, Human
ccagggcgucgugcuuccgca

SEQ ID NO: 365258 - RNA, 32 nt, Human
ccagggcuaauccagaggugggggaggggcua

SEQ ID NO: 365259 - RNA, 32 nt, Human
ccagggcuacagccugugcccagcccucuaau

SEQ ID NO: 365260 - RNA, 25 nt, Human
ccagggcuacuuccaccuuuugccu

SEQ ID NO: 365261 - RNA, 32 nt, Human
ccagggcuagaugucgccgugacugaggccaa

SEQ ID NO: 365262 - RNA, 32 nt, Human
ccagggcuaggggaaggagcugggagaaggag

SEQ ID NO: 365263 - RNA, 32 nt, Human
ccagggcucaaggauccuccugccucagucuc

SEQ ID NO: 365264 - RNA, 32 nt, Human
ccagggcucaaucucugggggcugaggagcag

SEQ ID NO: 365265 - RNA, 32 nt, Human
ccagggcucacugcagccuugaccucccaggc

SEQ ID NO: 365266 - RNA, 32 nt, Human
ccagggcucauuugaccucuacuucaucuugg

SEQ ID NO: 365267 - RNA, 32 nt, Human
ccagggcuccacggggcgcccuugucucaguc

SEQ ID NO: 365268 - RNA, 32 nt, Human
ccagggcucccaggcagggagaggcaggugag

SEQ ID NO: 365269 - RNA, 22 nt, Human
ccagggcucccauccuucugca

SEQ ID NO: 365270 - RNA, 20 nt, Human
ccagggcuccccugcuccuu

SEQ ID NO: 365271 - RNA, 32 nt, Human
ccagggcucccuggcccaguacagcugugcgg

SEQ ID NO: 365272 - RNA, 32 nt, Human
ccagggcuccuccucauccagacuugccugug

SEQ ID NO: 365273 - RNA, 22 nt, Human
ccagggcucuccagaaacggag

SEQ ID NO: 365274 - RNA, 24 nt, Human
ccagggcucuccccacccucccca

SEQ ID NO: 365275 - RNA, 25 nt, Human
ccagggcucuccuccaccccugccu

SEQ ID NO: 365276 - RNA, 25 nt, Human
ccagggcucucuuccccuccugucu

SEQ ID NO: 365277 - RNA, 32 nt, Human
ccagggcucugcacucucaaggcuggccccau

SEQ ID NO: 365278 - RNA, 32 nt, Human
ccagggcugagcuguguggugcaggccaaacg

SEQ ID NO: 365279 - RNA, 21 nt, Human
ccagggcugaggaccccucca

SEQ ID NO: 365280 - RNA, 19 nt, Human
ccagggcugaugcuguaca

SEQ ID NO: 365281 - RNA, 32 nt, Human
ccagggcugcagcucucuacagcgugugugcc

SEQ ID NO: 365282 - RNA, 32 nt, Human
ccagggcugccuggcucugucccaggcgcggg

SEQ ID NO: 365283 - RNA, 32 nt, Human
ccagggcugccugggccugguuauuguguggg

SEQ ID NO: 365284 - RNA, 32 nt, Human
ccagggcugccuuccagcacuucauggggcac

SEQ ID NO: 365285 - RNA, 32 nt, Human
ccagggcugcuggcuagggagggacagggcag

SEQ ID NO: 365286 - RNA, 18 nt, Human
ccagggcugcuuugcugu

SEQ ID NO: 365287 - RNA, 23 nt, Human
ccagggcuggaggcaggucccag

SEQ ID NO: 365288 - RNA, 23 nt, Human
ccagggcugggggaggugggagg

SEQ ID NO: 365289 - RNA, 32 nt, Human
ccagggcuggugcugcucuucccucagcucug

SEQ ID NO: 365290 - RNA, 32 nt, Human
ccagggcuguaaccuggugucugguagcccca

SEQ ID NO: 365291 - RNA, 32 nt, Human
ccagggcuguaacugccaggcucucuuugccc

SEQ ID NO: 365292 - RNA, 32 nt, Human
ccagggcuguagcacaggcuucacagugauuu

SEQ ID NO: 365293 - RNA, 32 nt, Human
ccagggcugugacugcagccuguguaggacca

SEQ ID NO: 365294 - RNA, 32 nt, Human
ccagggcugugaggacggaaacaggcaggcag

SEQ ID NO: 365295 - RNA, 32 nt, Human
ccagggcugugcuaaggagggaagccugugaa

SEQ ID NO: 365296 - RNA, 32 nt, Human
ccagggcuguguggaucugacaggguauagga

SEQ ID NO: 365297 - RNA, 32 nt, Human
ccagggcuguucugucaagguucagcugcagg

SEQ ID NO: 365298 - RNA, 32 nt, Human
ccagggcuguuugcacagaaacaugcugcacc

SEQ ID NO: 365299 - RNA, 32 nt, Human
ccagggcuuccagccucgugcugucucgggac

SEQ ID NO: 365300 - RNA, 32 nt, Human
ccagggcuuccugccaagcaccugccugccug

SEQ ID NO: 365301 - RNA, 32 nt, Human
ccagggcuugaacuuggccucuacccaaacuu

SEQ ID NO: 365302 - RNA, 32 nt, Human
ccagggcuuggcuccacccauuuccuugaccu

SEQ ID NO: 365303 - RNA, 32 nt, Human
ccagggcuuguggacucucugccugcuuccug

SEQ ID NO: 365304 - RNA, 25 nt, Human
ccagggcuuuccuccucuucugccu

SEQ ID NO: 365305 - RNA, 25 nt, Human
ccagggcuuugacuacuuccugucu

SEQ ID NO: 365306 - RNA, 25 nt, Human
ccagggcuuugccaccucccugccu

SEQ ID NO: 365307 - RNA, 26 nt, Human
ccagggcuuugcccuuccuccugccu

SEQ ID NO: 365308 - RNA, 26 nt, Human
ccagggcuuuuucuaaucuccugccu

SEQ ID NO: 365309 - RNA, 25 nt, Human
ccagggcuuuuuuccucuccugucu

SEQ ID NO: 365310 - RNA, 32 nt, Human
ccaggggaacucgccaccugcccacgcuaguu

SEQ ID NO: 365311 - RNA, 32 nt, Human
ccaggggaagaaaaggggagaaaacggagaag

SEQ ID NO: 365312 - RNA, 18 nt, Human
ccaggggaagacucggag

SEQ ID NO: 365313 - RNA, 18 nt, Human
ccaggggaagcugcagug

SEQ ID NO: 365314 - RNA, 32 nt, Human
ccaggggaaggagaaagagacauuacagagca

SEQ ID NO: 365315 - RNA, 32 nt, Human
ccaggggaaggaugagguuuacuuggcugggg

SEQ ID NO: 365316 - RNA, 32 nt, Human
ccaggggacaagggauuugaggugaggguugg

SEQ ID NO: 365317 - RNA, 32 nt, Human
ccaggggacaggucggggcaguauuuggggga

SEQ ID NO: 365318 - RNA, 32 nt, Human
ccaggggaccacgcacgucccacccacccagc

SEQ ID NO: 365319 - RNA, 32 nt, Human
ccaggggaccuguugggugcucugccugccuc

SEQ ID NO: 365320 - RNA, 32 nt, Human
ccaggggagaauggguguuguauggggaggca

SEQ ID NO: 365321 - RNA, 32 nt, Human
ccaggggagacacuuucuugggcucugucuuu

SEQ ID NO: 365322 - RNA, 32 nt, Human
ccaggggagagggucuggagaagcagugagcc

SEQ ID NO: 365323 - RNA, 32 nt, Human
ccaggggagcaguggagguaagggcuccaccc

SEQ ID NO: 365324 - RNA, 32 nt, Human
ccaggggagcccaggcugcccugcacuccugc

SEQ ID NO: 365325 - RNA, 32 nt, Human
ccaggggagccgggcuugcagacaacagcagu

SEQ ID NO: 365326 - RNA, 32 nt, Human
ccaggggagcuaggaggaagcggggagagaga

SEQ ID NO: 365327 - RNA, 31 nt, Human
ccaggggaggcauagcagaaagacuggcccc

SEQ ID NO: 365328 - RNA, 32 nt, Human
ccaggggaggcauagcagaaagacuggccccu

SEQ ID NO: 365329 - RNA, 32 nt, Human
ccaggggagggcuugggggcagcucugggagg

SEQ ID NO: 365330 - RNA, 32 nt, Human
ccaggggagggugggcccugcucacagccaga

SEQ ID NO: 365331 - RNA, 32 nt, Human
ccaggggaggugggguuuggugagagacgcca

SEQ ID NO: 365332 - RNA, 25 nt, Human
ccaggggaugccaccucugcugcuc

SEQ ID NO: 365333 - RNA, 32 nt, Human
ccaggggaugccaccucugcugcuccagucgu

SEQ ID NO: 365334 - RNA, 32 nt, Human
ccaggggcaccggcugcccacagggaacacau

SEQ ID NO: 365335 - RNA, 32 nt, Human
ccaggggcagcaucccccuccaggcccuaaga

SEQ ID NO: 365336 - RNA, 21 nt, Human
ccaggggcaucagagcugccu

SEQ ID NO: 365337 - RNA, 32 nt, Human
ccaggggccaaugaaagccaaaaagcuggugu

SEQ ID NO: 365338 - RNA, 32 nt, Human
ccaggggccacuuggaccaagcuccagucagu

SEQ ID NO: 365339 - RNA, 21 nt, Human
ccaggggccaggccucuucca

SEQ ID NO: 365340 - RNA, 18 nt, Human
ccaggggccaggcuggga

SEQ ID NO: 365341 - RNA, 19 nt, Human
ccaggggcccucccggguc

SEQ ID NO: 365342 - RNA, 17 nt, Human
ccaggggccggccagcu

SEQ ID NO: 365343 - RNA, 32 nt, Human
ccaggggccuccaggacccggaggagaggcag

SEQ ID NO: 365344 - RNA, 32 nt, Human
ccaggggccuugagggucugaggucccagccc

SEQ ID NO: 365345 - RNA, 32 nt, Human
ccaggggccuuuaccauguucucuccacaucc

SEQ ID NO: 365346 - RNA, 21 nt, Human
ccaggggcgcuccagccgccu

SEQ ID NO: 365347 - RNA, 32 nt, Human
ccaggggcgcuuggcaucucccauggacugau

SEQ ID NO: 365348 - RNA, 32 nt, Human
ccaggggcgguggcucacgccuguaaucccag

SEQ ID NO: 365349 - RNA, 32 nt, Human
ccaggggcgguggcucaugccuguaaucccag

SEQ ID NO: 365350 - RNA, 32 nt, Human
ccaggggcucugagcauuuccacaaugcacag

SEQ ID NO: 365351 - RNA, 32 nt, Human
ccaggggcugacgcuuaccucaagucccugca

SEQ ID NO: 365352 - RNA, 32 nt, Human
ccaggggcugguaggucauucaaagcuguggc

SEQ ID NO: 365353 - RNA, 32 nt, Human
ccaggggcuggugugugggagcugcuaccugg

SEQ ID NO: 365354 - RNA, 32 nt, Human
ccaggggcugugugacggcugccugaaguucu

SEQ ID NO: 365355 - RNA, 32 nt, Human
ccaggggcuucagaaaaggaguggccacagca

SEQ ID NO: 365356 - RNA, 32 nt, Human
ccaggggcuuccaagaugaggcccagagacuc

SEQ ID NO: 365357 - RNA, 32 nt, Human
ccaggggcuuugacacaguccucugcuguccc

SEQ ID NO: 365358 - RNA, 32 nt, Human
ccagggggaagcuuggcuucagggaggaccua

SEQ ID NO: 365359 - RNA, 32 nt, Human
ccagggggacagcagagcuugggugaccauac

SEQ ID NO: 365360 - RNA, 23 nt, Human
ccagggggacuagccccugugga

SEQ ID NO: 365361 - RNA, 32 nt, Human
ccagggggagcugggguugcagggcaacagua

SEQ ID NO: 365362 - RNA, 32 nt, Human
ccagggggaggcagagauggcacagcaagaga

SEQ ID NO: 365363 - RNA, 21 nt, Human
ccagggggaugagcucuccaa

SEQ ID NO: 365364 - RNA, 32 nt, Human
ccagggggauuccaaagaccuggugucuggag

SEQ ID NO: 365365 - RNA, 32 nt, Human
ccagggggcaaggaaagcuggcaaacacacca

SEQ ID NO: 365366 - RNA, 24 nt, Human
ccagggggcagagguugcagugag

SEQ ID NO: 365367 - RNA, 32 nt, Human
ccagggggcaggcagaggcaagagaagaggaa

SEQ ID NO: 365368 - RNA, 32 nt, Human
ccagggggcccagucuucuguggggugcacag

SEQ ID NO: 365369 - RNA, 32 nt, Human
ccagggggccugggaggagccgagaccagccu

SEQ ID NO: 365370 - RNA, 32 nt, Human
ccagggggcgaacgcagcacagaggaagaggc

SEQ ID NO: 365371 - RNA, 24 nt, Human
ccagggggcggagguugcagugag

SEQ ID NO: 365372 - RNA, 18 nt, Human
ccagggggcuccacucca

SEQ ID NO: 365373 - RNA, 21 nt, Human
ccagggggcugaggcacacag

SEQ ID NO: 365374 - RNA, 32 nt, Human
ccagggggcugaggcacacagagaggccaacu

SEQ ID NO: 365375 - RNA, 32 nt, Human
ccagggggcugaggcaggagaauuguuugaag

SEQ ID NO: 365376 - RNA, 22 nt, Human
ccagggggucagggaugagcca

SEQ ID NO: 365377 - RNA, 25 nt, Human
ccaggggguuugaggcugcagugag

SEQ ID NO: 365378 - RNA, 20 nt, Human
ccagggguaaccccaggcca

SEQ ID NO: 365379 - RNA, 32 nt, Human
ccagggguaguggcacgggcagauaucucacc

SEQ ID NO: 365380 - RNA, 32 nt, Human
ccagggguccaagggaacaggagaggucacug

SEQ ID NO: 365381 - RNA, 32 nt, Human
ccagggguccagggccagccugagaugcccgu

SEQ ID NO: 365382 - RNA, 32 nt, Human
ccaggggucccagcuacucaggaggcugaggu

SEQ ID NO: 365383 - RNA, 32 nt, Human
ccaggggucccucccucccuccuucccaaagc

SEQ ID NO: 365384 - RNA, 32 nt, Human
ccaggggucucugacggggguggacccccauc

SEQ ID NO: 365385 - RNA, 32 nt, Human
ccaggggucugggcuccagccauggagggugg

SEQ ID NO: 365386 - RNA, 32 nt, Human
ccaggggugaagcaggaggggccaggccucua

SEQ ID NO: 365387 - RNA, 32 nt, Human
ccaggggugcaggagcagaagguggggagggu

SEQ ID NO: 365388 - RNA, 32 nt, Human
ccaggggugcuaagcaguuaguggugcaggug

SEQ ID NO: 365389 - RNA, 32 nt, Human
ccaggggugcugcugccuaagccacccacaua

SEQ ID NO: 365390 - RNA, 32 nt, Human
ccagggguggaggccucuguccuccacuuuga

SEQ ID NO: 365391 - RNA, 22 nt, Human
ccagggguggaggcugcaauga

SEQ ID NO: 365392 - RNA, 32 nt, Human
ccagggguggcaaucuuugcucugccuucccc

SEQ ID NO: 365393 - RNA, 32 nt, Human
ccaggggugggugaaagaagagauagaacuua

SEQ ID NO: 365394 - RNA, 32 nt, Human
ccaggggugguggaaggagcacugggcuaggg

SEQ ID NO: 365395 - RNA, 32 nt, Human
ccaggggugguggcucacgccuguaaucccag

SEQ ID NO: 365396 - RNA, 24 nt, Human
ccaggggugguuugggggcgcuca

SEQ ID NO: 365397 - RNA, 32 nt, Human
ccaggggugugaggaagcagacucccuguuau

SEQ ID NO: 365398 - RNA, 32 nt, Human
ccaggggugugguggaggggaaggccacgugc

SEQ ID NO: 365399 - RNA, 24 nt, Human
ccagggguucacagcugcagugag

SEQ ID NO: 365400 - RNA, 24 nt, Human
ccagggguugcaggcugcagugag

SEQ ID NO: 365401 - RNA, 32 nt, Human
ccagggguugucauggacuggcugccuuacaa

SEQ ID NO: 365402 - RNA, 24 nt, Human
ccagggguuugaggcugcagugag

SEQ ID NO: 365403 - RNA, 24 nt, Human
ccagggguuugcggcugcagugag

SEQ ID NO: 365404 - RNA, 25 nt, Human
ccaggguaaccuccagccuccugcc

SEQ ID NO: 365405 - RNA, 32 nt, Human
ccaggguaagggcaggccccuccaacaggugc

SEQ ID NO: 365406 - RNA, 32 nt, Human
ccaggguacagugggagccucaggaaggucag

SEQ ID NO: 365407 - RNA, 32 nt, Human
ccaggguaccacaacagacaauggcucagcga

SEQ ID NO: 365408 - RNA, 32 nt, Human
ccaggguagacuugagagaguucacauuccac

SEQ ID NO: 365409 - RNA, 32 nt, Human
ccaggguagagaaugaaggguauggaaguagu

SEQ ID NO: 365410 - RNA, 32 nt, Human
ccaggguagggagacaagcagcaguuuguucu

SEQ ID NO: 365411 - RNA, 32 nt, Human
ccaggguagggugagagggggaccaugaaugg

SEQ ID NO: 365412 - RNA, 32 nt, Human
ccaggguaguccuggccagcauggugaaaccc

SEQ ID NO: 365413 - RNA, 32 nt, Human
ccaggguauagacuagauauuuuugcuguugc

SEQ ID NO: 365414 - RNA, 32 nt, Human
ccaggguauauguggcagccuuugccauauca

SEQ ID NO: 365415 - RNA, 32 nt, Human
ccagggucacaucaaccgccagaaguggaguu

SEQ ID NO: 365416 - RNA, 32 nt, Human
ccagggucaccaggccagagccuccagugguc

SEQ ID NO: 365417 - RNA, 31 nt, Human
ccagggucacucagguagaguugagauucaa

SEQ ID NO: 365418 - RNA, 32 nt, Human
ccagggucagcaggcucaggccggcucagggc

SEQ ID NO: 365419 - RNA, 25 nt, Human
ccagggucaggcccccuccucuccc

SEQ ID NO: 365420 - RNA, 32 nt, Human
ccaggguccaccccuucucucugggcuuguug

SEQ ID NO: 365421 - RNA, 32 nt, Human
ccaggguccacucagaacuuuccucuuggacu

SEQ ID NO: 365422 - RNA, 31 nt, Human
ccaggguccaggcccaucacaguugacucca

SEQ ID NO: 365423 - RNA, 32 nt, Human
ccagggucccaggugucauggcaacagaacgu

SEQ ID NO: 365424 - RNA, 32 nt, Human
ccagggucccguugauguaacagagcagagga

SEQ ID NO: 365425 - RNA, 32 nt, Human
ccagggucccucaaagcuucuguggcuucgug

SEQ ID NO: 365426 - RNA, 25 nt, Human
ccaggguccuccuccaccuccuccu

SEQ ID NO: 365427 - RNA, 25 nt, Human
ccaggguccuccuccgccuccuccu

SEQ ID NO: 365428 - RNA, 32 nt, Human
ccaggguccuccuccuuccucucuccuuguaa

SEQ ID NO: 365429 - RNA, 26 nt, Human
ccaggguccucuaucaccuccugucu

SEQ ID NO: 365430 - RNA, 32 nt, Human
ccaggguccucugggcccucuucuugacuagg

SEQ ID NO: 365431 - RNA, 32 nt, Human
ccaggguccucuuccuccauuuggcucuuuuc

SEQ ID NO: 365432 - RNA, 32 nt, Human
ccaggguccucuuccuccguuuggcucuuuuc

SEQ ID NO: 365433 - RNA, 21 nt, Human
ccaggguccugguccuggaca

SEQ ID NO: 365434 - RNA, 25 nt, Human
ccaggguccuucccaccucuugccu

SEQ ID NO: 365435 - RNA, 25 nt, Human
ccaggguccuuccugcuucuugccu

SEQ ID NO: 365436 - RNA, 32 nt, Human
ccaggguccuuucaaggagguugaaugagaca

SEQ ID NO: 365437 - RNA, 25 nt, Human
ccagggucgugcacucucugggaua

SEQ ID NO: 365438 - RNA, 32 nt, Human
ccagggucuacccuuuguuucccaggcugguc

SEQ ID NO: 365439 - RNA, 32 nt, Human
ccagggucuaugaguuggcuucggguccuugu

SEQ ID NO: 365440 - RNA, 32 nt, Human
ccagggucucacuauguugcccaggcaggucu

SEQ ID NO: 365441 - RNA, 32 nt, Human
ccagggucucacucugugucucaggcuggagu

SEQ ID NO: 365442 - RNA, 32 nt, Human
ccagggucuccuccuccucuuccuucaucgcu

SEQ ID NO: 365443 - RNA, 32 nt, Human
ccagggucucuggagucucugccccuguccaa

SEQ ID NO: 365444 - RNA, 32 nt, Human
ccagggucugaacugccuccauccuagggcaa

SEQ ID NO: 365445 - RNA, 23 nt, Human
ccagggucuucccugcugagcca

SEQ ID NO: 365446 - RNA, 32 nt, Human
ccagggucuucccuuggucuuugugcgucagg

SEQ ID NO: 365447 - RNA, 25 nt, Human
ccagggucuuccuucaccuccuccu

SEQ ID NO: 365448 - RNA, 20 nt, Human
ccagggugaacccucaggug

SEQ ID NO: 365449 - RNA, 32 nt, Human
ccagggugacaucguagccaaauguuuacugu

SEQ ID NO: 365450 - RNA, 32 nt, Human
ccagggugaccccagcccuggggcccagccac

SEQ ID NO: 365451 - RNA, 32 nt, Human
ccagggugacuuugaugccacugguuugucuc

SEQ ID NO: 365452 - RNA, 32 nt, Human
ccagggugaggcggagccccuuggccaccaga

SEQ ID NO: 365453 - RNA, 32 nt, Human
ccagggugagggugggaacacauccuagaagg

SEQ ID NO: 365454 - RNA, 32 nt, Human
ccagggugaggguugugcccagcugggccacg

SEQ ID NO: 365455 - RNA, 32 nt, Human
ccagggugcggugcagagcagagcaggcaggg

SEQ ID NO: 365456 - RNA, 32 nt, Human
ccagggugcucugccugcucagccaggccucu

SEQ ID NO: 365457 - RNA, 24 nt, Human
ccagggugcugagauuacaggugu

SEQ ID NO: 365458 - RNA, 22 nt, Human
ccagggugcugggauuacaggc

SEQ ID NO: 365459 - RNA, 24 nt, Human
ccagggugcugggauuacaggugu

SEQ ID NO: 365460 - RNA, 32 nt, Human
ccaggguggacaaaucgccagagauguggugc

SEQ ID NO: 365461 - RNA, 17 nt, Human
ccaggguggagagccag

SEQ ID NO: 365462 - RNA, 21 nt, Human
ccaggguggaggacugagcac

SEQ ID NO: 365463 - RNA, 32 nt, Human
ccaggguggagguuuggugccggggguugaga

SEQ ID NO: 365464 - RNA, 32 nt, Human
ccaggguggagugcaguggcaggaucacagcu

SEQ ID NO: 365465 - RNA, 32 nt, Human
ccaggguggagugcaguggugugaucucggcu

SEQ ID NO: 365466 - RNA, 32 nt, Human
ccaggguggcugccucggcccucccagcucuu

SEQ ID NO: 365467 - RNA, 32 nt, Human
ccagggugggcagaugucuccaguggggucag

SEQ ID NO: 365468 - RNA, 32 nt, Human
ccagggugggcuacaugcaaugugguugcugc

SEQ ID NO: 365469 - RNA, 32 nt, Human
ccaggguggggaggggagcagcagagggaggc

SEQ ID NO: 365470 - RNA, 24 nt, Human
ccaggguggguggaucaccugagg

SEQ ID NO: 365471 - RNA, 32 nt, Human
ccaggguggguggaucaccugaggucaggagu

SEQ ID NO: 365472 - RNA, 31 nt, Human
ccagggugggugggagugggcugagggcucg

SEQ ID NO: 365473 - RNA, 32 nt, Human
ccaggguggucugcauggaacuucuuucccgg

SEQ ID NO: 365474 - RNA, 22 nt, Human
ccaggguggugguggcgggggg

SEQ ID NO: 365475 - RNA, 32 nt, Human
ccagggugucauggaagggcugcugacaagau

SEQ ID NO: 365476 - RNA, 32 nt, Human
ccaggguguccgggggcuggccagucagagaa

SEQ ID NO: 365477 - RNA, 32 nt, Human
ccagggugucucccgcuuuacucuucaggaau

SEQ ID NO: 365478 - RNA, 32 nt, Human
ccagggugucuucaucuucaauuuggguuuaa

SEQ ID NO: 365479 - RNA, 32 nt, Human
ccagggugugccagcccgucucugugcagucc

SEQ ID NO: 365480 - RNA, 32 nt, Human
ccagggugugggcuucggggcugcagauggcc

SEQ ID NO: 365481 - RNA, 32 nt, Human
ccaggguuauucuccuccucgagucacaguca

SEQ ID NO: 365482 - RNA, 32 nt, Human
ccaggguucaaaggacacacccuagaugagcc

SEQ ID NO: 365483 - RNA, 26 nt, Human
ccaggguucaauuccaccuccuuccu

SEQ ID NO: 365484 - RNA, 26 nt, Human
ccaggguucacuuacaccuccugccu

SEQ ID NO: 365485 - RNA, 32 nt, Human
ccaggguuccacccugcucugccugccugggg

SEQ ID NO: 365486 - RNA, 32 nt, Human
ccaggguucccaagguuucucccaucugguca

SEQ ID NO: 365487 - RNA, 25 nt, Human
ccaggguucuagucacuuccugccu

SEQ ID NO: 365488 - RNA, 32 nt, Human
ccaggguucucaggcagauuguaggagagcca

SEQ ID NO: 365489 - RNA, 25 nt, Human
ccaggguucucuuccgcuccugccu

SEQ ID NO: 365490 - RNA, 26 nt, Human
ccaggguucugaccacucuccugccu

SEQ ID NO: 365491 - RNA, 25 nt, Human
ccaggguucugaucccuuccugucu

SEQ ID NO: 365492 - RNA, 26 nt, Human
ccaggguucugccuacacuccugccu

SEQ ID NO: 365493 - RNA, 25 nt, Human
ccaggguucugcuccgcuuccuccu

SEQ ID NO: 365494 - RNA, 24 nt, Human
ccaggguucuuucaucuuuugccu

SEQ ID NO: 365495 - RNA, 19 nt, Human
ccaggguuggggcugcaca

SEQ ID NO: 365496 - RNA, 32 nt, Human
ccaggguuguggggacacaggagggccaggga

SEQ ID NO: 365497 - RNA, 32 nt, Human
ccaggguuuagagugaaacagccagucugaag

SEQ ID NO: 365498 - RNA, 26 nt, Human
ccaggguuuauugcuacuuccugccu

SEQ ID NO: 365499 - RNA, 32 nt, Human
ccaggguuucucaaccucuacugacauuuugc

SEQ ID NO: 365500 - RNA, 25 nt, Human
ccaggguuuugaccccuuccugucu

SEQ ID NO: 365501 - RNA, 25 nt, Human
ccaggguuuugcucaccuuuugccu

SEQ ID NO: 365502 - RNA, 26 nt, Human
ccaggguuuugcucuaccaccugccu

SEQ ID NO: 365503 - RNA, 26 nt, Human
ccaggguuuuggccucaucucugccu

SEQ ID NO: 365504 - RNA, 32 nt, Human
ccaggguuuugguggcuggcgaagcugagggc

SEQ ID NO: 365505 - RNA, 32 nt, Human
ccaggguuuuucacuucuccccacaucucccu

SEQ ID NO: 365506 - RNA, 25 nt, Human
ccaggguuuuucugccugccugccu

SEQ ID NO: 365507 - RNA, 32 nt, Human
ccagguaacagucccugggacugagcaguggc

SEQ ID NO: 365508 - RNA, 32 nt, Human
ccagguaacagugguuaccugggagacaauau

SEQ ID NO: 365509 - RNA, 32 nt, Human
ccagguaaccacuccugggagcaguggggaac

SEQ ID NO: 365510 - RNA, 32 nt, Human
ccagguaaccuuuaaaugaaacuugccuaaaa

SEQ ID NO: 365511 - RNA, 32 nt, Human
ccagguaacgucuguaucauacaguuaguguu

SEQ ID NO: 365512 - RNA, 32 nt, Human
ccagguaacuggagccggaaaccgguggaggu

SEQ ID NO: 365513 - RNA, 32 nt, Human
ccagguaaggagaguccuggucuuugucaacc

SEQ ID NO: 365514 - RNA, 18 nt, Human
ccagguaagggggugcag

SEQ ID NO: 365515 - RNA, 32 nt, Human
ccagguaauuccagguaauuaaccuauccauc

SEQ ID NO: 365516 - RNA, 32 nt, Human
ccagguacaguggcucaugccuguaaucccag

SEQ ID NO: 365517 - RNA, 32 nt, Human
ccagguacagugucucacaccuguaaucccag

SEQ ID NO: 365518 - RNA, 21 nt, Human
ccagguacccccgccucccca

SEQ ID NO: 365519 - RNA, 32 nt, Human
ccagguacuguucugagcacuuuacaaacacu

SEQ ID NO: 365520 - RNA, 32 nt, Human
ccagguagcugccugugaaugcacugcucucc

SEQ ID NO: 365521 - RNA, 22 nt, Human
ccagguagcugggauuacaggc

SEQ ID NO: 365522 - RNA, 32 nt, Human
ccagguaguguugagacccaggccuguggccc

SEQ ID NO: 365523 - RNA, 32 nt, Human
ccagguaguucccacugauggaaauguuuaug

SEQ ID NO: 365524 - RNA, 32 nt, Human
ccagguauccucagucuuucugcuuuacuauu

SEQ ID NO: 365525 - RNA, 32 nt, Human
ccagguaucugaaugcuuugguuggcagugcg

SEQ ID NO: 365526 - RNA, 32 nt, Human
ccagguauggugcuaggcaugcuaggcaccaa

SEQ ID NO: 365527 - RNA, 32 nt, Human
ccagguaugguggcacauaccuguggucucag

SEQ ID NO: 365528 - RNA, 32 nt, Human
ccagguaugguggcacgugccuguaaucccag

SEQ ID NO: 365529 - RNA, 32 nt, Human
ccagguaugguggcauacgccuguaauccuag

SEQ ID NO: 365530 - RNA, 32 nt, Human
ccagguaugguggcucacgccuguaaucccag

SEQ ID NO: 365531 - RNA, 32 nt, Human
ccagguaugguggugaacaccuguaaucccag

SEQ ID NO: 365532 - RNA, 32 nt, Human
ccagguaugguggugcauaccuguaaucccag

SEQ ID NO: 365533 - RNA, 32 nt, Human
ccagguaugguggugcaugccuguaaucccag

SEQ ID NO: 365534 - RNA, 32 nt, Human
ccagguaugguggugggcaccuguaaucccag

SEQ ID NO: 365535 - RNA, 18 nt, Human
ccagguauucucuuccca

SEQ ID NO: 365536 - RNA, 32 nt, Human
ccagguauuuuucuauuucucuccuuaauuuu

SEQ ID NO: 365537 - RNA, 32 nt, Human
ccaggucaacagguucaaauauucaagaaggu

SEQ ID NO: 365538 - RNA, 21 nt, Human
ccaggucacauacucguccug

SEQ ID NO: 365539 - RNA, 32 nt, Human
ccaggucacaugcacguauguccagggcaugg

SEQ ID NO: 365540 - RNA, 18 nt, Human
ccaggucaccccaucucu

SEQ ID NO: 365541 - RNA, 32 nt, Human
ccaggucacuuucaggaggcagauaauaaagg

SEQ ID NO: 365542 - RNA, 32 nt, Human
ccaggucagacucgggcuucauccucucuugc

SEQ ID NO: 365543 - RNA, 21 nt, Human
ccaggucagagauguccccug

SEQ ID NO: 365544 - RNA, 32 nt, Human
ccaggucagcaggagcagcagcagggauguau

SEQ ID NO: 365545 - RNA, 20 nt, Human
ccaggucagcgauuuuccca

SEQ ID NO: 365546 - RNA, 32 nt, Human
ccaggucaggagaucaagaccauccuggcuaa

SEQ ID NO: 365547 - RNA, 21 nt, Human
ccaggucaggaggaccuggag

SEQ ID NO: 365548 - RNA, 32 nt, Human
ccaggucaggaggagguagagagagggcagcc

SEQ ID NO: 365549 - RNA, 32 nt, Human
ccaggucaggcacaaggagaaaagguuccugg

SEQ ID NO: 365550 - RNA, 21 nt, Human
ccaggucaggcccacccccug

SEQ ID NO: 365551 - RNA, 24 nt, Human
ccaggucaggcccgauuuguccug

SEQ ID NO: 365552 - RNA, 32 nt, Human
ccaggucagguggcguuugcuguggcggcuag

SEQ ID NO: 365553 - RNA, 32 nt, Human
ccaggucauacuacccuagagccugggaccug

SEQ ID NO: 365554 - RNA, 32 nt, Human
ccaggucaucagcuauugcucuuuggagguug

SEQ ID NO: 365555 - RNA, 32 nt, Human
ccaggucauccaggcuggauguggcuugggag

SEQ ID NO: 365556 - RNA, 32 nt, Human
ccaggucaucccuccccgggccuggggcgcuc

SEQ ID NO: 365557 - RNA, 32 nt, Human
ccaggucaugggagaagagccuggagauucuu

SEQ ID NO: 365558 - RNA, 32 nt, Human
ccaggucauugucaguuuaugguauuauguug

SEQ ID NO: 365559 - RNA, 32 nt, Human
ccagguccaccagggugucugcauggagguga

SEQ ID NO: 365560 - RNA, 32 nt, Human
ccagguccagcccucccgcugcagccugcagg

SEQ ID NO: 365561 - RNA, 16 nt, Human
ccagguccauugccac

SEQ ID NO: 365562 - RNA, 32 nt, Human
ccaggucccaggcugggcggccucggugcccg

SEQ ID NO: 365563 - RNA, 32 nt, Human
ccaggucccaggggagagguuggggcuggcag

SEQ ID NO: 365564 - RNA, 32 nt, Human
ccaggucccauuccaggaggcuuuucauauag

SEQ ID NO: 365565 - RNA, 32 nt, Human
ccagguccccacugcucucacacccuuaggcu

SEQ ID NO: 365566 - RNA, 32 nt, Human
ccagguccccuccagaaaggacucugcuccac

SEQ ID NO: 365567 - RNA, 32 nt, Human
ccagguccccuggaugauguggcaggacacuc

SEQ ID NO: 365568 - RNA, 23 nt, Human
ccaggucccgcagcugccucuga

SEQ ID NO: 365569 - RNA, 32 nt, Human
ccaggucccuccaaauccacacggucaucaug

SEQ ID NO: 365570 - RNA, 32 nt, Human
ccaggucccugccucagccuucagcagaguug

SEQ ID NO: 365571 - RNA, 24 nt, Human
ccaggucccuggccccagggaugg

SEQ ID NO: 365572 - RNA, 32 nt, Human
ccagguccucaccuggguccucucagugaagc

SEQ ID NO: 365573 - RNA, 32 nt, Human
ccagguccucagcuccagacugggugaugcug

SEQ ID NO: 365574 - RNA, 19 nt, Human
ccagguccucauccucuuc

SEQ ID NO: 365575 - RNA, 32 nt, Human
ccagguccucauccucuucugcacccugcugu

SEQ ID NO: 365576 - RNA, 32 nt, Human
ccagguccugagcccuuccucuguaaaagugu

SEQ ID NO: 365577 - RNA, 32 nt, Human
ccagguccugcagcuugugcucugcccagcag

SEQ ID NO: 365578 - RNA, 32 nt, Human
ccagguccugccuugugagauguggccccagc

SEQ ID NO: 365579 - RNA, 32 nt, Human
ccagguccuggcccagucccuccacugccucg

SEQ ID NO: 365580 - RNA, 32 nt, Human
ccagguccuggccgaguuuccucugccccuuc

SEQ ID NO: 365581 - RNA, 32 nt, Human
ccagguccuggggugugucuguccucaugcuu

SEQ ID NO: 365582 - RNA, 32 nt, Human
ccagguccuguuccucuuucuccccgacucca

SEQ ID NO: 365583 - RNA, 32 nt, Human
ccagguccuuucucagccuccagcugggcugu

SEQ ID NO: 365584 - RNA, 32 nt, Human
ccagguccuuuucuuuucuuuuuaauugcuca

SEQ ID NO: 365585 - RNA, 17 nt, Human
ccaggucgggggcucag

SEQ ID NO: 365586 - RNA, 32 nt, Human
ccaggucucacuuuccccaucuguaaaacagg

SEQ ID NO: 365587 - RNA, 23 nt, Human
ccaggucuccugacauuguguuc

SEQ ID NO: 365588 - RNA, 32 nt, Human
ccaggucuccugggcaucuggcccugcugccc

SEQ ID NO: 365589 - RNA, 32 nt, Human
ccaggucucuacuguccccugcagccaccaca

SEQ ID NO: 365590 - RNA, 32 nt, Human
ccaggucugccaguuucugugccugcagagag

SEQ ID NO: 365591 - RNA, 32 nt, Human
ccaggucugcuccccaccuuacucggauggcc

SEQ ID NO: 365592 - RNA, 32 nt, Human
ccaggucugcucccugggaugcuuucucccug

SEQ ID NO: 365593 - RNA, 32 nt, Human
ccaggucugggagccccaggcuggccucagac

SEQ ID NO: 365594 - RNA, 32 nt, Human
ccaggucugggagucccaggccaucugcucaa

SEQ ID NO: 365595 - RNA, 32 nt, Human
ccaggucugggcagauucaaccaugggagcca

SEQ ID NO: 365596 - RNA, 19 nt, Human
ccaggucuggggcugcaca

SEQ ID NO: 365597 - RNA, 32 nt, Human
ccaggucugggugaaagggauacuuuuaugca

SEQ ID NO: 365598 - RNA, 32 nt, Human
ccaggucuguccuugcaggcagccugguacca

SEQ ID NO: 365599 - RNA, 32 nt, Human
ccaggucugucugacaucuguguccucacucu

SEQ ID NO: 365600 - RNA, 32 nt, Human
ccaggucugucugccuaagagccuuuugagga

SEQ ID NO: 365601 - RNA, 32 nt, Human
ccaggucugugccaccuccucucuccucugug

SEQ ID NO: 365602 - RNA, 32 nt, Human
ccaggucuuaccugcuuuccugcuccauggaa

SEQ ID NO: 365603 - RNA, 32 nt, Human
ccaggucuuucagggcccucccuugaggacag

SEQ ID NO: 365604 - RNA, 32 nt, Human
ccaggugaacacagcggcugccagucuccugg

SEQ ID NO: 365605 - RNA, 32 nt, Human
ccaggugaagagaggauagagugaagaacuga

SEQ ID NO: 365606 - RNA, 32 nt, Human
ccaggugaaggugagauugaagauaaccagcu

SEQ ID NO: 365607 - RNA, 32 nt, Human
ccaggugaaguggcucacaccuguaaucccag

SEQ ID NO: 365608 - RNA, 32 nt, Human
ccaggugacaucauaaauacuugcugaaugaa

SEQ ID NO: 365609 - RNA, 32 nt, Human
ccaggugacucugccaagcagcuguggcccca

SEQ ID NO: 365610 - RNA, 32 nt, Human
ccaggugagagaaggaagugaggccauagaug

SEQ ID NO: 365611 - RNA, 32 nt, Human
ccaggugagcugguggcauggggccgccugug

SEQ ID NO: 365612 - RNA, 32 nt, Human
ccaggugaggaacagacccucuggccucucac

SEQ ID NO: 365613 - RNA, 32 nt, Human
ccaggugaggccuggcccugccccaccaugac

SEQ ID NO: 365614 - RNA, 32 nt, Human
ccaggugaggugagcgugugugcucucaggga

SEQ ID NO: 365615 - RNA, 32 nt, Human
ccaggugagugagcccucgugggaucugguug

SEQ ID NO: 365616 - RNA, 21 nt, Human
ccaggugauccacuccauccu

SEQ ID NO: 365617 - RNA, 21 nt, Human
ccaggugaugccgggggucag

SEQ ID NO: 365618 - RNA, 20 nt, Human
ccaggugauggcagggccag

SEQ ID NO: 365619 - RNA, 19 nt, Human
ccaggugaugggcugcaca

SEQ ID NO: 365620 - RNA, 32 nt, Human
ccaggugauuccagugacacagacacacguuu

SEQ ID NO: 365621 - RNA, 32 nt, Human
ccaggugcaaucuacuggaaauguagcacuua

SEQ ID NO: 365622 - RNA, 32 nt, Human
ccaggugcaauggcucaugccuguaaucccaa

SEQ ID NO: 365623 - RNA, 32 nt, Human
ccaggugcaauggcucaugucucuaaucccag

SEQ ID NO: 365624 - RNA, 32 nt, Human
ccaggugcaauggcucgcaccuguaaucccag

SEQ ID NO: 365625 - RNA, 32 nt, Human
ccaggugcaccacugccgucauuucagcuucu

SEQ ID NO: 365626 - RNA, 32 nt, Human
ccaggugcacuggcucaugcuuguaaucucag

SEQ ID NO: 365627 - RNA, 32 nt, Human
ccaggugcagaaacggaagaugaccacucugu

SEQ ID NO: 365628 - RNA, 32 nt, Human
ccaggugcagccuggacaacaugaugagaucc

SEQ ID NO: 365629 - RNA, 32 nt, Human
ccaggugcaggagugguaccccagggaguccc

SEQ ID NO: 365630 - RNA, 32 nt, Human
ccaggugcagguugggaaugaggcuugcugag

SEQ ID NO: 365631 - RNA, 32 nt, Human
ccaggugcaguagcucaugccuguaaucccag

SEQ ID NO: 365632 - RNA, 32 nt, Human
ccaggugcaguggaucacgccuguaaucccag

SEQ ID NO: 365633 - RNA, 32 nt, Human
ccaggugcaguggcccaugccuguaaucccag

SEQ ID NO: 365634 - RNA, 32 nt, Human
ccaggugcaguggcucacaccuguaaucccaa

SEQ ID NO: 365635 - RNA, 32 nt, Human
ccaggugcaguggcucacaccuguaaucccag

SEQ ID NO: 365636 - RNA, 32 nt, Human
ccaggugcaguggcucacaccuguaauccuag

SEQ ID NO: 365637 - RNA, 32 nt, Human
ccaggugcaguggcucacgccuguaaucccag

SEQ ID NO: 365638 - RNA, 32 nt, Human
ccaggugcaguggcucacuccuguaauccgag

SEQ ID NO: 365639 - RNA, 32 nt, Human
ccaggugcaguggcucacuccuguaauccuag

SEQ ID NO: 365640 - RNA, 32 nt, Human
ccaggugcaguggcucaggccuguaaucccag

SEQ ID NO: 365641 - RNA, 32 nt, Human
ccaggugcaguggcucaugccuauaaucccag

SEQ ID NO: 365642 - RNA, 32 nt, Human
ccaggugcaguggcucaugccuguaaucccag

SEQ ID NO: 365643 - RNA, 32 nt, Human
ccaggugcaguggcuuacaccuguaaucccag

SEQ ID NO: 365644 - RNA, 32 nt, Human
ccaggugcagugguucaugccuguaaucccag

SEQ ID NO: 365645 - RNA, 32 nt, Human
ccaggugccagccugggcucagguuccaagac

SEQ ID NO: 365646 - RNA, 32 nt, Human
ccaggugccaucaucucuuuaccuggggccuu

SEQ ID NO: 365647 - RNA, 32 nt, Human
ccaggugccaugaggaagccucgucggaaguc

SEQ ID NO: 365648 - RNA, 32 nt, Human
ccaggugcccagaacagcccaucguggggacu

SEQ ID NO: 365649 - RNA, 23 nt, Human
ccaggugccccccauguuccaga

SEQ ID NO: 365650 - RNA, 22 nt, Human
ccaggugcccgcuccccgcgag

SEQ ID NO: 365651 - RNA, 32 nt, Human
ccaggugcccuagggggcacauuucccacaac

SEQ ID NO: 365652 - RNA, 22 nt, Human
ccaggugccggcggcccgggcc

SEQ ID NO: 365653 - RNA, 32 nt, Human
ccaggugccguggcucacaccuguaaucugaa

SEQ ID NO: 365654 - RNA, 32 nt, Human
ccaggugccguggcucacgccuguaaucccag

SEQ ID NO: 365655 - RNA, 24 nt, Human
ccaggugccucaccaccugcugag

SEQ ID NO: 365656 - RNA, 24 nt, Human
ccaggugccucggaggaugcggag

SEQ ID NO: 365657 - RNA, 20 nt, Human
ccaggugccuugccgcagag

SEQ ID NO: 365658 - RNA, 32 nt, Human
ccaggugccuuuggagguuaaggcuagguuag

SEQ ID NO: 365659 - RNA, 32 nt, Human
ccaggugcggcagcucacaccuguaaucccag

SEQ ID NO: 365660 - RNA, 32 nt, Human
ccaggugcggugacucaugccuguaaucccug

SEQ ID NO: 365661 - RNA, 32 nt, Human
ccaggugcgguggcucaagccuguaaucccag

SEQ ID NO: 365662 - RNA, 32 nt, Human
ccaggugcgguggcucacaccuguaaucccag

SEQ ID NO: 365663 - RNA, 32 nt, Human
ccaggugcgguggcucacaccuguaaucucag

SEQ ID NO: 365664 - RNA, 32 nt, Human
ccaggugcgguggcucacaccuguaauuccag

SEQ ID NO: 365665 - RNA, 32 nt, Human
ccaggugcgguggcucacgccuguaaucccag

SEQ ID NO: 365666 - RNA, 32 nt, Human
ccaggugcgguggcucacgccuguaauccuag

SEQ ID NO: 365667 - RNA, 32 nt, Human
ccaggugcgguggcucacuccuguaauccuag

SEQ ID NO: 365668 - RNA, 32 nt, Human
ccaggugcgguggcucauaccuauaauccuaa

SEQ ID NO: 365669 - RNA, 32 nt, Human
ccaggugcgguggcucauaccuguaaucccag

SEQ ID NO: 365670 - RNA, 32 nt, Human
ccaggugcgguggcucaugccuauaaucccag

SEQ ID NO: 365671 - RNA, 32 nt, Human
ccaggugcgguggcucaugccuguaaucccag

SEQ ID NO: 365672 - RNA, 32 nt, Human
ccaggugcgguggcucaugucuguaaucccag

SEQ ID NO: 365673 - RNA, 32 nt, Human
ccaggugcgguggcucguaccuguaauccagc

SEQ ID NO: 365674 - RNA, 32 nt, Human
ccaggugcggugguucgugccuguaaucccag

SEQ ID NO: 365675 - RNA, 17 nt, Human
ccaggugcuacccugca

SEQ ID NO: 365676 - RNA, 32 nt, Human
ccaggugcuagcccuggcaggcacagcccucc

SEQ ID NO: 365677 - RNA, 32 nt, Human
ccaggugcucagcucccagugcacugaagcuc

SEQ ID NO: 365678 - RNA, 32 nt, Human
ccaggugcucagucccuggugcacugaagcuc

SEQ ID NO: 365679 - RNA, 32 nt, Human
ccaggugcucauuguaaccauuucucacuagu

SEQ ID NO: 365680 - RNA, 25 nt, Human
ccaggugcucccucccuuccugcag

SEQ ID NO: 365681 - RNA, 23 nt, Human
ccaggugcugggauuauaggcgu

SEQ ID NO: 365682 - RNA, 32 nt, Human
ccaggugcuguggcucacaccuguaaucccag

SEQ ID NO: 365683 - RNA, 23 nt, Human
ccaggugcuuccugccagcaaag

SEQ ID NO: 365684 - RNA, 23 nt, Human
ccaggugcuuggcugccucagag

SEQ ID NO: 365685 - RNA, 21 nt, Human
ccagguggaagaaaguuucca

SEQ ID NO: 365686 - RNA, 23 nt, Human
ccagguggaccugggggauggcu

SEQ ID NO: 365687 - RNA, 32 nt, Human
ccagguggacuuccaccuccagccucuggucc

SEQ ID NO: 365688 - RNA, 32 nt, Human
ccagguggaggcggcggcggcagaggaguggg

SEQ ID NO: 365689 - RNA, 32 nt, Human
ccagguggagugagucugaggacagcagauga

SEQ ID NO: 365690 - RNA, 18 nt, Human
ccagguggauccucuuua

SEQ ID NO: 365691 - RNA, 32 nt, Human
ccagguggcaggcagagcaggaugcagaggca

SEQ ID NO: 365692 - RNA, 22 nt, Human
ccagguggccaccuuccuuccc

SEQ ID NO: 365693 - RNA, 23 nt, Human
ccagguggcggagguugcaguga

SEQ ID NO: 365694 - RNA, 24 nt, Human
ccagguggcggagguugcagugag

SEQ ID NO: 365695 - RNA, 32 nt, Human
ccagguggcucccaccuguagucccagcacuu

SEQ ID NO: 365696 - RNA, 32 nt, Human
ccaggugggaagaucacuugaggccaggaguu

SEQ ID NO: 365697 - RNA, 32 nt, Human
ccaggugggaggaucgcuugagcccagaaguu

SEQ ID NO: 365698 - RNA, 32 nt, Human
ccaggugggagugggcccaaacccagccccuc

SEQ ID NO: 365699 - RNA, 32 nt, Human
ccaggugggcaggcuggauggaaaugggccag

SEQ ID NO: 365700 - RNA, 19 nt, Human
ccaggugggcauggucccc

SEQ ID NO: 365701 - RNA, 23 nt, Human
ccaggugggcggaucacuugagg

SEQ ID NO: 365702 - RNA, 32 nt, Human
ccaggugggcuguggcggcauccagguggaag

SEQ ID NO: 365703 - RNA, 21 nt, Human
ccagguggggacucugaccug

SEQ ID NO: 365704 - RNA, 32 nt, Human
ccagguggggcggguggggagcuguccggugc

SEQ ID NO: 365705 - RNA, 18 nt, Human
ccagguggguggcagagc

SEQ ID NO: 365706 - RNA, 20 nt, Human
ccagguggguggcagagcaa

SEQ ID NO: 365707 - RNA, 21 nt, Human
ccagguggugacagagcagaa

SEQ ID NO: 365708 - RNA, 32 nt, Human
ccagguggugagcauaguaccuaacagauagu

SEQ ID NO: 365709 - RNA, 32 nt, Human
ccaggugguggaggugggguuggagcaggaag

SEQ ID NO: 365710 - RNA, 24 nt, Human
ccaggugguggagguugcagugag

SEQ ID NO: 365711 - RNA, 32 nt, Human
ccaggugguuuguggcagcuacucuucaccug

SEQ ID NO: 365712 - RNA, 32 nt, Human
ccagguguagugccucaugccuguaauuccag

SEQ ID NO: 365713 - RNA, 32 nt, Human
ccagguguaguggcucacaccuguaaucucag

SEQ ID NO: 365714 - RNA, 32 nt, Human
ccagguguaguggcucacgccuguaaucccag

SEQ ID NO: 365715 - RNA, 32 nt, Human
ccagguguaguggcucaugccuguaaucccag

SEQ ID NO: 365716 - RNA, 32 nt, Human
ccagguguaguggcucaugccuguaauccuag

SEQ ID NO: 365717 - RNA, 32 nt, Human
ccagguguccccgagcucucccuucccgagcc

SEQ ID NO: 365718 - RNA, 32 nt, Human
ccaggugucccgguucucaagauguaacacag

SEQ ID NO: 365719 - RNA, 21 nt, Human
ccagguguccugaggcucccu

SEQ ID NO: 365720 - RNA, 32 nt, Human
ccaggugugaaaagugaggcucagggagcuag

SEQ ID NO: 365721 - RNA, 32 nt, Human
ccaggugugauggcucacaccuguaaucccca

SEQ ID NO: 365722 - RNA, 32 nt, Human
ccaggugugauggcucaugccuguaauccagu

SEQ ID NO: 365723 - RNA, 32 nt, Human
ccaggugugauggcucaugccuguaaucccag

SEQ ID NO: 365724 - RNA, 32 nt, Human
ccaggugugauggugcaugccuguaaucccag

SEQ ID NO: 365725 - RNA, 32 nt, Human
ccaggugugauggugggugccuguaaucccag

SEQ ID NO: 365726 - RNA, 18 nt, Human
ccaggugugccagggacc

SEQ ID NO: 365727 - RNA, 23 nt, Human
ccaggugugcggccgccugagcc

SEQ ID NO: 365728 - RNA, 32 nt, Human
ccagguguggagguacaugccuguaaucccag

SEQ ID NO: 365729 - RNA, 25 nt, Human
ccagguguggccaccuggggcucag

SEQ ID NO: 365730 - RNA, 32 nt, Human
ccagguguggcggcgagcaccuguaaucccag

SEQ ID NO: 365731 - RNA, 32 nt, Human
ccaggugugggcucuccugugcucugaauugu

SEQ ID NO: 365732 - RNA, 32 nt, Human
ccagguguggggaacgagagugcacugcauga

SEQ ID NO: 365733 - RNA, 32 nt, Human
ccaggugugguagcucacaccuguaauuccca

SEQ ID NO: 365734 - RNA, 32 nt, Human
ccaggugugguggcacaugccuguaaucccag

SEQ ID NO: 365735 - RNA, 32 nt, Human
ccaggugugguggcgcauaccuguagucccag

SEQ ID NO: 365736 - RNA, 32 nt, Human
ccaggugugguggcgcaugccuguaaucccag

SEQ ID NO: 365737 - RNA, 32 nt, Human
ccaggugugguggcucaagccuguaaucccag

SEQ ID NO: 365738 - RNA, 32 nt, Human
ccaggugugguggcucacaccuguaaucccag

SEQ ID NO: 365739 - RNA, 32 nt, Human
ccaggugugguggcucacgccuguaaucccaa

SEQ ID NO: 365740 - RNA, 32 nt, Human
ccaggugugguggcucacgccuguaaucccag

SEQ ID NO: 365741 - RNA, 32 nt, Human
ccaggugugguggcucacuccuguaaucccgg

SEQ ID NO: 365742 - RNA, 32 nt, Human
ccaggugugguggcucaggccuguaaucccaa

SEQ ID NO: 365743 - RNA, 32 nt, Human
ccaggugugguggcucaggccuguaaucccag

SEQ ID NO: 365744 - RNA, 32 nt, Human
ccaggugugguggcucaugccuguaauagcag

SEQ ID NO: 365745 - RNA, 32 nt, Human
ccaggugugguggcucaugccuguaaucccag

SEQ ID NO: 365746 - RNA, 32 nt, Human
ccaggugugguggcucaugccuguaaucccga

SEQ ID NO: 365747 - RNA, 32 nt, Human
ccaggugugguggcucaugccuguagucccug

SEQ ID NO: 365748 - RNA, 32 nt, Human
ccaggugugguggcuccgaccuguaaucccag

SEQ ID NO: 365749 - RNA, 32 nt, Human
ccaggugugguggcugacaccuguaaucccag

SEQ ID NO: 365750 - RNA, 32 nt, Human
ccaggugugguggcuuaccccuguaaucccag

SEQ ID NO: 365751 - RNA, 32 nt, Human
ccaggugugguggcuuacgccuguaaucccag

SEQ ID NO: 365752 - RNA, 32 nt, Human
ccaggugugguggcuuaugccuguaauccuag

SEQ ID NO: 365753 - RNA, 32 nt, Human
ccaggugugguggugcaugccuguaaucccag

SEQ ID NO: 365754 - RNA, 32 nt, Human
ccaggugugguguugcaugccuguaaucccag

SEQ ID NO: 365755 - RNA, 32 nt, Human
ccagguguucugcaccuugcagccugcacacu

SEQ ID NO: 365756 - RNA, 32 nt, Human
ccagguguugacuccagcuccagcuucagcuc

SEQ ID NO: 365757 - RNA, 32 nt, Human
ccagguguugucugacaucccacacacaucgg

SEQ ID NO: 365758 - RNA, 32 nt, Human
ccagguguuucagaacaaggccucgggcacuc

SEQ ID NO: 365759 - RNA, 32 nt, Human
ccagguguuugcugaaagaagcugcuguaaug

SEQ ID NO: 365760 - RNA, 32 nt, Human
ccagguuacugcacuugucugaugugacguag

SEQ ID NO: 365761 - RNA, 32 nt, Human
ccagguuaucaggggcuucacugugaaaccug

SEQ ID NO: 365762 - RNA, 20 nt, Human
ccagguuaugccuggcccca

SEQ ID NO: 365763 - RNA, 31 nt, Human
ccagguuauucucuggagguugguggaugaa

SEQ ID NO: 365764 - RNA, 32 nt, Human
ccagguucaaacgauccucccgccucagccuc

SEQ ID NO: 365765 - RNA, 32 nt, Human
ccagguucaaacgauucuccugccucagccuc

SEQ ID NO: 365766 - RNA, 32 nt, Human
ccagguucaacugauucuccugccucagacuc

SEQ ID NO: 365767 - RNA, 32 nt, Human
ccagguucaacugauucuccugccucagccuc

SEQ ID NO: 365768 - RNA, 32 nt, Human
ccagguucaagagauccucccaccucagcuuc

SEQ ID NO: 365769 - RNA, 32 nt, Human
ccagguucaagcaaaagacccaccucucugca

SEQ ID NO: 365770 - RNA, 32 nt, Human
ccagguucaagcaagucuugugccucaguuua

SEQ ID NO: 365771 - RNA, 32 nt, Human
ccagguucaagcaauuauccugccucagccac

SEQ ID NO: 365772 - RNA, 32 nt, Human
ccagguucaagcaauuauccugccucagccuc

SEQ ID NO: 365773 - RNA, 32 nt, Human
ccagguucaagcaauuauccugccucaggcuc

SEQ ID NO: 365774 - RNA, 32 nt, Human
ccagguucaagcaauuccccugccucagcuuc

SEQ ID NO: 365775 - RNA, 32 nt, Human
ccagguucaagcaauucucccaccucagccuc

SEQ ID NO: 365776 - RNA, 32 nt, Human
ccagguucaagcaauucucccgccucagccuc

SEQ ID NO: 365777 - RNA, 32 nt, Human
ccagguucaagcaauucuccuaccucagccuc

SEQ ID NO: 365778 - RNA, 32 nt, Human
ccagguucaagcaauucuccugcaucagccuc

SEQ ID NO: 365779 - RNA, 32 nt, Human
ccagguucaagcaauucuccugccucacccuc

SEQ ID NO: 365780 - RNA, 32 nt, Human
ccagguucaagcaauucuccugccucagccuc

SEQ ID NO: 365781 - RNA, 32 nt, Human
ccagguucaagcaauucuccugccucagccuu

SEQ ID NO: 365782 - RNA, 32 nt, Human
ccagguucaagcaauucuccugccucagcucc

SEQ ID NO: 365783 - RNA, 32 nt, Human
ccagguucaagcaauucuccugccucagcuuc

SEQ ID NO: 365784 - RNA, 32 nt, Human
ccagguucaagcaauucuccugccucaggcuc

SEQ ID NO: 365785 - RNA, 32 nt, Human
ccagguucaagcaauucuccugccucagucuc

SEQ ID NO: 365786 - RNA, 32 nt, Human
ccagguucaagcaauucuccugccucggccuc

SEQ ID NO: 365787 - RNA, 32 nt, Human
ccagguucaagcaauucuccugccuuagccuc

SEQ ID NO: 365788 - RNA, 32 nt, Human
ccagguucaagcaauucuccugucucagccuc

SEQ ID NO: 365789 - RNA, 32 nt, Human
ccagguucaagcaauucuccuguuucagccuc

SEQ ID NO: 365790 - RNA, 32 nt, Human
ccagguucaagcaauucuccuuccucagccuc

SEQ ID NO: 365791 - RNA, 32 nt, Human
ccagguucaagcaauucucgugccucagccuc

SEQ ID NO: 365792 - RNA, 32 nt, Human
ccagguucaagcaauucucugucucagccucc

SEQ ID NO: 365793 - RNA, 32 nt, Human
ccagguucaagcaauucucuugccucagccuc

SEQ ID NO: 365794 - RNA, 32 nt, Human
ccagguucaagcaauucucuugccucggccuc

SEQ ID NO: 365795 - RNA, 32 nt, Human
ccagguucaagcaauucugccucagccuccca

SEQ ID NO: 365796 - RNA, 32 nt, Human
ccagguucaagcaauucugcugucucagcuuc

SEQ ID NO: 365797 - RNA, 32 nt, Human
ccagguucaagcaauucuucugccucagccuc

SEQ ID NO: 365798 - RNA, 32 nt, Human
ccagguucaagcaauuuuccugcuucagcuuc

SEQ ID NO: 365799 - RNA, 32 nt, Human
ccagguucaagcaauuuucgugccucagccuc

SEQ ID NO: 365800 - RNA, 32 nt, Human
ccagguucaagcacuucucguaccucagacuc

SEQ ID NO: 365801 - RNA, 32 nt, Human
ccagguucaagcaguucuccuaccucagccuc

SEQ ID NO: 365802 - RNA, 32 nt, Human
ccagguucaagcaguucuccugccucagccuc

SEQ ID NO: 365803 - RNA, 32 nt, Human
ccagguucaagcaguucuccugucucagccuc

SEQ ID NO: 365804 - RNA, 32 nt, Human
ccagguucaagcaguucucugccccacccucc

SEQ ID NO: 365805 - RNA, 32 nt, Human
ccagguucaagcaguucuuccucagccuccgg

SEQ ID NO: 365806 - RNA, 32 nt, Human
ccagguucaagcauucuucugccucagccucc

SEQ ID NO: 365807 - RNA, 32 nt, Human
ccagguucaagcgauccuccugccucagucuc

SEQ ID NO: 365808 - RNA, 32 nt, Human
ccagguucaagcgaugcucauaccucagccuc

SEQ ID NO: 365809 - RNA, 32 nt, Human
ccagguucaagcgauucucccgccucagccuc

SEQ ID NO: 365810 - RNA, 32 nt, Human
ccagguucaagcgauucucccgccucagguuc

SEQ ID NO: 365811 - RNA, 32 nt, Human
ccagguucaagcgauucucccgccucaguagc

SEQ ID NO: 365812 - RNA, 32 nt, Human
ccagguucaagcgauucuccuaccucagcccc

SEQ ID NO: 365813 - RNA, 32 nt, Human
ccagguucaagcgauucucgugccucagccuc

SEQ ID NO: 365814 - RNA, 32 nt, Human
ccagguucaagcgauuuucgugccucagcuug

SEQ ID NO: 365815 - RNA, 32 nt, Human
ccagguucaagcuauucuacugccucagccuc

SEQ ID NO: 365816 - RNA, 32 nt, Human
ccagguucaagcuauucuccugccucagccuc

SEQ ID NO: 365817 - RNA, 32 nt, Human
ccagguucaaggaauuccugugccucagcuuc

SEQ ID NO: 365818 - RNA, 32 nt, Human
ccagguucaagggauucgucugccucggccuc

SEQ ID NO: 365819 - RNA, 32 nt, Human
ccagguucaagggauucucccaccucagccuc

SEQ ID NO: 365820 - RNA, 32 nt, Human
ccagguucaaguaauucuccugccucagccuc

SEQ ID NO: 365821 - RNA, 32 nt, Human
ccagguucaagugauucucccaccucagccuc

SEQ ID NO: 365822 - RNA, 32 nt, Human
ccagguucaagugauucucccugccuccgccu

SEQ ID NO: 365823 - RNA, 32 nt, Human
ccagguucaagugauucuccuaccucagccuc

SEQ ID NO: 365824 - RNA, 32 nt, Human
ccagguucaaucgguuuuccugccucagccuc

SEQ ID NO: 365825 - RNA, 32 nt, Human
ccagguucaauugauucuccugccucagccuc

SEQ ID NO: 365826 - RNA, 32 nt, Human
ccagguucacaccauucuccugccucaaccuc

SEQ ID NO: 365827 - RNA, 32 nt, Human
ccagguucacaccauucuccugccucagccuc

SEQ ID NO: 365828 - RNA, 32 nt, Human
ccagguucacaccauucuccugccucagcuuc

SEQ ID NO: 365829 - RNA, 32 nt, Human
ccagguucacgccauccuccugccucagcuac

SEQ ID NO: 365830 - RNA, 32 nt, Human
ccagguucacgccauucucccgccucaaccuc

SEQ ID NO: 365831 - RNA, 32 nt, Human
ccagguucacgccauucucccgccucgggagc

SEQ ID NO: 365832 - RNA, 32 nt, Human
ccagguucacgccauucuccugccucagccaa

SEQ ID NO: 365833 - RNA, 32 nt, Human
ccagguucacgccauucuccugccucagccuc

SEQ ID NO: 365834 - RNA, 32 nt, Human
ccagguucacgccauuguccugccucagccuc

SEQ ID NO: 365835 - RNA, 32 nt, Human
ccagguucaggcaauucuccugccucagccuc

SEQ ID NO: 365836 - RNA, 28 nt, Human
ccagguucaguagcugccucgucuggcu

SEQ ID NO: 365837 - RNA, 18 nt, Human
ccagguucauccagccuu

SEQ ID NO: 365838 - RNA, 32 nt, Human
ccagguucaugcaauucuccugccucagucuc

SEQ ID NO: 365839 - RNA, 32 nt, Human
ccagguucaugccauucuccugccucacccuc

SEQ ID NO: 365840 - RNA, 32 nt, Human
ccagguucaugccauucuccugccucagccuc

SEQ ID NO: 365841 - RNA, 32 nt, Human
ccagguucaugccauucuccugcuucagccuc

SEQ ID NO: 365842 - RNA, 32 nt, Human
ccagguucaugucauucuccugccucagccuc

SEQ ID NO: 365843 - RNA, 32 nt, Human
ccagguuccagcaacacuagcuaccuaccaaa

SEQ ID NO: 365844 - RNA, 32 nt, Human
ccagguuccagcaauucuccugccucagccuc

SEQ ID NO: 365845 - RNA, 32 nt, Human
ccagguuccagcuauucuccugccucagccuc

SEQ ID NO: 365846 - RNA, 20 nt, Human
ccagguuccauccaccaccu

SEQ ID NO: 365847 - RNA, 32 nt, Human
ccagguuccccuuccucccucccuucaccggc

SEQ ID NO: 365848 - RNA, 32 nt, Human
ccagguucccgccauucuccugccucagccuc

SEQ ID NO: 365849 - RNA, 21 nt, Human
ccagguucccugagcuguggg

SEQ ID NO: 365850 - RNA, 32 nt, Human
ccagguuccuccccucaccccauauuccauca

SEQ ID NO: 365851 - RNA, 32 nt, Human
ccagguuccuguaacucccugccuccuccucu

SEQ ID NO: 365852 - RNA, 32 nt, Human
ccagguucgggcaauucuccugccucagccuc

SEQ ID NO: 365853 - RNA, 32 nt, Human
ccagguucuaucuccccgucacacccgaggcc

SEQ ID NO: 365854 - RNA, 32 nt, Human
ccagguucuggagguuggagguuccgcucagu

SEQ ID NO: 365855 - RNA, 32 nt, Human
ccagguucuuuuccuuccuuccuuccuuccuc

SEQ ID NO: 365856 - RNA, 32 nt, Human
ccagguugaagcaauucuccugccucagccuu

SEQ ID NO: 365857 - RNA, 32 nt, Human
ccagguugaaggccaccgcguccaacagcccc

SEQ ID NO: 365858 - RNA, 19 nt, Human
ccagguugagccuaggggc

SEQ ID NO: 365859 - RNA, 32 nt, Human
ccagguugccuaggagugggguccacugauga

SEQ ID NO: 365860 - RNA, 31 nt, Human
ccagguugccucucuccugugggccucuguc

SEQ ID NO: 365861 - RNA, 22 nt, Human
ccagguugcuugggccccggag

SEQ ID NO: 365862 - RNA, 32 nt, Human
ccagguuggagaccagccuaggcaacauggcg

SEQ ID NO: 365863 - RNA, 19 nt, Human
ccagguuggagugcagugg

SEQ ID NO: 365864 - RNA, 32 nt, Human
ccagguuggagugcaguggcacgaucuaggcu

SEQ ID NO: 365865 - RNA, 22 nt, Human
ccagguuggagugcaguggcgu

SEQ ID NO: 365866 - RNA, 32 nt, Human
ccagguuggagugcaguggcgugucuuggguu

SEQ ID NO: 365867 - RNA, 32 nt, Human
ccagguuggagugcaguggugugaucucgguu

SEQ ID NO: 365868 - RNA, 32 nt, Human
ccagguuggagugcaguggugugaucuuggcu

SEQ ID NO: 365869 - RNA, 32 nt, Human
ccagguuggccaaauaccauccacagugaggg

SEQ ID NO: 365870 - RNA, 32 nt, Human
ccagguuggccaggcuggucuugugaacuccu

SEQ ID NO: 365871 - RNA, 24 nt, Human
ccagguugugaggaaccgcagcgc

SEQ ID NO: 365872 - RNA, 32 nt, Human
ccagguuuaagcaauccucccaccucagcccc

SEQ ID NO: 365873 - RNA, 32 nt, Human
ccagguuuaagcaauucucaugcuucagccua

SEQ ID NO: 365874 - RNA, 32 nt, Human
ccagguuuaagcaauucuccugcuucaaccuc

SEQ ID NO: 365875 - RNA, 21 nt, Human
ccagguuuccucccggaggca

SEQ ID NO: 365876 - RNA, 21 nt, Human
ccagguuugcccccugcacag

SEQ ID NO: 365877 - RNA, 32 nt, Human
ccagguuugguggugcaugccuguaaucccag

SEQ ID NO: 365878 - RNA, 20 nt, Human
ccagguuuuccaccauccuu

SEQ ID NO: 365879 - RNA, 32 nt, Human
ccagguuuucccucuuaaaauauuugucccac

SEQ ID NO: 365880 - RNA, 23 nt, Human
ccaguaaaagagaagagucacag

SEQ ID NO: 365881 - RNA, 32 nt, Human
ccaguaaaccaaaaagcagauccuugaaacuu

SEQ ID NO: 365882 - RNA, 32 nt, Human
ccaguaaccccagcuacuagggaggcugaggc

SEQ ID NO: 365883 - RNA, 32 nt, Human
ccaguaagaagaggaggaggccaggcaggcaa

SEQ ID NO: 365884 - RNA, 32 nt, Human
ccaguaaggaggagaggcugucucagcugcag

SEQ ID NO: 365885 - RNA, 32 nt, Human
ccaguaaggucgcugccuuccuucucugccag

SEQ ID NO: 365886 - RNA, 32 nt, Human
ccaguaaguaaauuuaaaugcuucauuuuuaa

SEQ ID NO: 365887 - RNA, 32 nt, Human
ccaguaagucaccugcuccuguccgcaagcuu

SEQ ID NO: 365888 - RNA, 23 nt, Human
ccaguaaucccagcuacucggga

SEQ ID NO: 365889 - RNA, 32 nt, Human
ccaguaaucccagcuacucgggaggcugaagc

SEQ ID NO: 365890 - RNA, 32 nt, Human
ccaguaaucccagcuacucuuggaggcugagg

SEQ ID NO: 365891 - RNA, 23 nt, Human
ccaguaaucccagcuacuuggga

SEQ ID NO: 365892 - RNA, 32 nt, Human
ccaguaaucccagcuacuugggaggccaaggu

SEQ ID NO: 365893 - RNA, 32 nt, Human
ccaguaaucccagcuacuugggaggcucaggc

SEQ ID NO: 365894 - RNA, 32 nt, Human
ccaguaauuccagcuacuugggagguugaggc

SEQ ID NO: 365895 - RNA, 32 nt, Human
ccaguacaccaaggcuguagggaucaagcaug

SEQ ID NO: 365896 - RNA, 32 nt, Human
ccaguacaccuguagauauuacuguacuuuua

SEQ ID NO: 365897 - RNA, 32 nt, Human
ccaguacacgucuacccucugccucagcagau

SEQ ID NO: 365898 - RNA, 32 nt, Human
ccaguacagguaaaaucccagaggaauccaaa

SEQ ID NO: 365899 - RNA, 19 nt, Human
ccaguacaugccacccagu

SEQ ID NO: 365900 - RNA, 32 nt, Human
ccaguaccacaggcaagugcaccaccaugacu

SEQ ID NO: 365901 - RNA, 32 nt, Human
ccaguaccacggcaccugggcccuggggccug

SEQ ID NO: 365902 - RNA, 32 nt, Human
ccaguaccaugcacacuccugucccgaacucc

SEQ ID NO: 365903 - RNA, 20 nt, Human
ccaguacccacuauccagug

SEQ ID NO: 365904 - RNA, 32 nt, Human
ccaguaccccucucugccguggcugauuuguu

SEQ ID NO: 365905 - RNA, 22 nt, Human
ccaguacccgaagagguggcug

SEQ ID NO: 365906 - RNA, 32 nt, Human
ccaguaccuguuugaccuucuuugccaccauc

SEQ ID NO: 365907 - RNA, 32 nt, Human
ccaguaccuuuccuaagucuuugcucaaauua

SEQ ID NO: 365908 - RNA, 32 nt, Human
ccaguacuaggagcauugguugcaguggagga

SEQ ID NO: 365909 - RNA, 32 nt, Human
ccaguacugagaaaugggagcacacaguacug

SEQ ID NO: 365910 - RNA, 32 nt, Human
ccaguacuucacccucuacuaugccuucuaug

SEQ ID NO: 365911 - RNA, 32 nt, Human
ccaguacuuggcuguugagaagaguuuggauc

SEQ ID NO: 365912 - RNA, 32 nt, Human
ccaguacuugggaggccaaggcaggcauauca

SEQ ID NO: 365913 - RNA, 32 nt, Human
ccaguagagauggguuucaccauguuggccaa

SEQ ID NO: 365914 - RNA, 24 nt, Human
ccaguagaggcagcacugaucugg

SEQ ID NO: 365915 - RNA, 22 nt, Human
ccaguagagggggcuuugauuc

SEQ ID NO: 365916 - RNA, 24 nt, Human
ccaguagaggggugagggauucug

SEQ ID NO: 365917 - RNA, 21 nt, Human
ccaguagagguagauauucug

SEQ ID NO: 365918 - RNA, 32 nt, Human
ccaguagauggaauugcaauccuuugcaguuu

SEQ ID NO: 365919 - RNA, 31 nt, Human
ccaguagcaaugucuuccucuuaugaccaga

SEQ ID NO: 365920 - RNA, 22 nt, Human
ccaguagcaggacccggucucg

SEQ ID NO: 365921 - RNA, 22 nt, Human
ccaguagcaggagaaagaaaga

SEQ ID NO: 365922 - RNA, 32 nt, Human
ccaguagcaguggagcaggcccuguccugccc

SEQ ID NO: 365923 - RNA, 32 nt, Human
ccaguagcaucucugucaucauucagauuuug

SEQ ID NO: 365924 - RNA, 32 nt, Human
ccaguagcccaggagcuugggugugcugacga

SEQ ID NO: 365925 - RNA, 32 nt, Human
ccaguagccugggcccacagagcugcugggau

SEQ ID NO: 365926 - RNA, 23 nt, Human
ccaguagcuggaacuacaggcgu

SEQ ID NO: 365927 - RNA, 23 nt, Human
ccaguagcuggaacuacaggugu

SEQ ID NO: 365928 - RNA, 22 nt, Human
ccaguagcugggacuacaggcg

SEQ ID NO: 365929 - RNA, 21 nt, Human
ccaguagcugggauuacaggc

SEQ ID NO: 365930 - RNA, 22 nt, Human
ccaguagcugggauuacaggcg

SEQ ID NO: 365931 - RNA, 23 nt, Human
ccaguagcugggauuacaggcgu

SEQ ID NO: 365932 - RNA, 32 nt, Human
ccaguaggagccagggcugaguguggaaauua

SEQ ID NO: 365933 - RNA, 32 nt, Human
ccaguaggagcuaucacuauauuuugcagaau

SEQ ID NO: 365934 - RNA, 24 nt, Human
ccaguaggcggaaguugcagugag

SEQ ID NO: 365935 - RNA, 32 nt, Human
ccaguaggggagagagcaguuaaggcacacag

SEQ ID NO: 365936 - RNA, 24 nt, Human
ccaguaggucgaggcugcagugag

SEQ ID NO: 365937 - RNA, 23 nt, Human
ccaguagucccagcuacucagga

SEQ ID NO: 365938 - RNA, 32 nt, Human
ccaguagucccagcuacucaggaggcugaggc

SEQ ID NO: 365939 - RNA, 32 nt, Human
ccaguagucccagcuacuccugaggcugaggu

SEQ ID NO: 365940 - RNA, 32 nt, Human
ccaguagucccagcuacucgaaaggcuaagac

SEQ ID NO: 365941 - RNA, 23 nt, Human
ccaguagucccagcuacucggga

SEQ ID NO: 365942 - RNA, 32 nt, Human
ccaguagucccagcuacucgggaggcugaggc

SEQ ID NO: 365943 - RNA, 22 nt, Human
ccaguaguuuugacacuuccca

SEQ ID NO: 365944 - RNA, 32 nt, Human
ccaguaguuuuuaaccaauuuccuguguucca

SEQ ID NO: 365945 - RNA, 32 nt, Human
ccaguauaccagccucuuccuggugauucugu

SEQ ID NO: 365946 - RNA, 32 nt, Human
ccaguauacuccauaccagccugaggugucuc

SEQ ID NO: 365947 - RNA, 32 nt, Human
ccaguauagacagaaguaaacccagcugacuu

SEQ ID NO: 365948 - RNA, 32 nt, Human
ccaguauauggcccuggcucugcauuggaccu

SEQ ID NO: 365949 - RNA, 32 nt, Human
ccaguaucagguuauuuuaggagaugauggug

SEQ ID NO: 365950 - RNA, 32 nt, Human
ccaguaucuccaaggguaccuucaggcagcca

SEQ ID NO: 365951 - RNA, 32 nt, Human
ccaguaucugacuguggcaugaucucaguuaa

SEQ ID NO: 365952 - RNA, 32 nt, Human
ccaguaugaggugagaggaugacacgucugcc

SEQ ID NO: 365953 - RNA, 20 nt, Human
ccaguauggugaaacccugu

SEQ ID NO: 365954 - RNA, 32 nt, Human
ccaguauggugguauguacucacaaagauuaa

SEQ ID NO: 365955 - RNA, 32 nt, Human
ccaguauucccagcuacucuggaggcugaggc

SEQ ID NO: 365956 - RNA, 32 nt, Human
ccaguauugugucugugccccuguguguguuu

SEQ ID NO: 365957 - RNA, 32 nt, Human
ccaguauuuaaucaaagaaauggaauaagggu

SEQ ID NO: 365958 - RNA, 25 nt, Human
ccaguauuucagcuuucccugaaga

SEQ ID NO: 365959 - RNA, 32 nt, Human
ccaguauuuccccucuggagcuggauugagga

SEQ ID NO: 365960 - RNA, 32 nt, Human
ccaguauuuuaccuuuuguuaaaacaagugau

SEQ ID NO: 365961 - RNA, 32 nt, Human
ccagucaaacauauuugugcauuacauuucau

SEQ ID NO: 365962 - RNA, 32 nt, Human
ccagucaaaccugccucccacuucucacuaaa

SEQ ID NO: 365963 - RNA, 19 nt, Human
ccagucaaagccaccucca

SEQ ID NO: 365964 - RNA, 32 nt, Human
ccagucacaacugccauuuccagucucugcug

SEQ ID NO: 365965 - RNA, 32 nt, Human
ccagucacagauaagggaauaaccuuggccau

SEQ ID NO: 365966 - RNA, 32 nt, Human
ccagucacaggcaggggccuugaggaugauuu

SEQ ID NO: 365967 - RNA, 32 nt, Human
ccagucacaguuuuugguuccucuuuucuuuc

SEQ ID NO: 365968 - RNA, 32 nt, Human
ccagucacaucacugcacccguccuguguccu

SEQ ID NO: 365969 - RNA, 32 nt, Human
ccagucacauuuucuccuuccgaaucucaucc

SEQ ID NO: 365970 - RNA, 32 nt, Human
ccagucaccacccuccuggaccacacucggcc

SEQ ID NO: 365971 - RNA, 32 nt, Human
ccagucaccacugagcagcauggggcacgcua

SEQ ID NO: 365972 - RNA, 32 nt, Human
ccagucaccaggguucuccauuccaagugagu

SEQ ID NO: 365973 - RNA, 32 nt, Human
ccagucaccaggguucuccauuccaagugucu

SEQ ID NO: 365974 - RNA, 32 nt, Human
ccagucacccugcccugaauucuauccuacuc

SEQ ID NO: 365975 - RNA, 32 nt, Human
ccagucacguuccucaggcuuacuugaucuau

SEQ ID NO: 365976 - RNA, 32 nt, Human
ccagucacucaguuccagaagggguucaugga

SEQ ID NO: 365977 - RNA, 17 nt, Human
ccagucacuccaccuuu

SEQ ID NO: 365978 - RNA, 32 nt, Human
ccagucacugcccccgcacucccacagggcuc

SEQ ID NO: 365979 - RNA, 32 nt, Human
ccagucacuuaaccucucugugccucaguuuc

SEQ ID NO: 365980 - RNA, 32 nt, Human
ccagucagaacagcaggaaucuguugaugcag

SEQ ID NO: 365981 - RNA, 32 nt, Human
ccagucagagaaagggggccauggacugcugu

SEQ ID NO: 365982 - RNA, 32 nt, Human
ccagucagagcucuuggcugcaccacauagau

SEQ ID NO: 365983 - RNA, 32 nt, Human
ccagucagcaaccuguaacucacauucucuuc

SEQ ID NO: 365984 - RNA, 32 nt, Human
ccagucagcaugaacuucccccucucugaggc

SEQ ID NO: 365985 - RNA, 32 nt, Human
ccagucagccaggauugugagcuguuugggaa

SEQ ID NO: 365986 - RNA, 19 nt, Human
ccagucagcccugcugcuc

SEQ ID NO: 365987 - RNA, 32 nt, Human
ccagucagcccuuuugaguucccgccucaccc

SEQ ID NO: 365988 - RNA, 32 nt, Human
ccagucagcuggccagauuuccucacuaccug

SEQ ID NO: 365989 - RNA, 19 nt, Human
ccagucagcuugggucccu

SEQ ID NO: 365990 - RNA, 32 nt, Human
ccagucaggaugacgguauuaugcuucuugga

SEQ ID NO: 365991 - RNA, 32 nt, Human
ccagucagggugguguggcgguugcagcggcc

SEQ ID NO: 365992 - RNA, 32 nt, Human
ccagucaguaucuaaucuggcuuuuguuaacu

SEQ ID NO: 365993 - RNA, 32 nt, Human
ccagucaucgaggggguugggaagggagggag

SEQ ID NO: 365994 - RNA, 32 nt, Human
ccagucaugcuuccuguuaagccuguggaacu

SEQ ID NO: 365995 - RNA, 32 nt, Human
ccagucaugguacuaccccagccuggggucca

SEQ ID NO: 365996 - RNA, 32 nt, Human
ccagucaugguggcacacgccuguaaucucag

SEQ ID NO: 365997 - RNA, 32 nt, Human
ccagucauggugucaugagaaggacucaaaau

SEQ ID NO: 365998 - RNA, 23 nt, Human
ccaguccaaaccugcaccaucca

SEQ ID NO: 365999 - RNA, 32 nt, Human
ccaguccaaagaaacucuaccuaacagggaac

SEQ ID NO: 366000 - RNA, 32 nt, Human
ccaguccaaaggacagugugucacugugaacu

SEQ ID NO: 366001 - RNA, 32 nt, Human
ccaguccaaauugucugucugcucuuauuuuu

SEQ ID NO: 366002 - RNA, 32 nt, Human
ccaguccaacugucaacucauccacucaacuu

SEQ ID NO: 366003 - RNA, 32 nt, Human
ccaguccacaaacugguuggugugcuugcucu

SEQ ID NO: 366004 - RNA, 32 nt, Human
ccaguccaccccguuucuccccacccugaaga

SEQ ID NO: 366005 - RNA, 32 nt, Human
ccaguccacuccacucugggcugggcugugau

SEQ ID NO: 366006 - RNA, 17 nt, Human
ccaguccacugcagaga

SEQ ID NO: 366007 - RNA, 32 nt, Human
ccaguccagccaguccgcccagucucucgcgu

SEQ ID NO: 366008 - RNA, 32 nt, Human
ccaguccagcccagccuugugccugcagugga

SEQ ID NO: 366009 - RNA, 32 nt, Human
ccaguccagcuggggaaacugaggcucuggga

SEQ ID NO: 366010 - RNA, 32 nt, Human
ccaguccagcuuugaggcugggcccaggauca

SEQ ID NO: 366011 - RNA, 32 nt, Human
ccaguccaggaggaaagagccaaggcccacuu

SEQ ID NO: 366012 - RNA, 32 nt, Human
ccaguccaggcagagcagguggcuggcugucu

SEQ ID NO: 366013 - RNA, 32 nt, Human
ccaguccaguuugcacuggugcagcccaacuc

SEQ ID NO: 366014 - RNA, 20 nt, Human
ccagucccacccugcugcug

SEQ ID NO: 366015 - RNA, 32 nt, Human
ccagucccacgccaccaccccaccccaagcca

SEQ ID NO: 366016 - RNA, 32 nt, Human
ccagucccagcgcuccggagguggugggcgcg

SEQ ID NO: 366017 - RNA, 32 nt, Human
ccagucccaguuccaguccaggaaauagagau

SEQ ID NO: 366018 - RNA, 32 nt, Human
ccagucccauccagagcauggagcccgacccc

SEQ ID NO: 366019 - RNA, 27 nt, Human
ccaguccccacuucuucccugccacgc

SEQ ID NO: 366020 - RNA, 19 nt, Human
ccaguccccagccaggcuc

SEQ ID NO: 366021 - RNA, 32 nt, Human
ccaguccccagcucacucagccacacacacca

SEQ ID NO: 366022 - RNA, 18 nt, Human
ccaguccccagcucgcca

SEQ ID NO: 366023 - RNA, 24 nt, Human
ccaguccccagggugggggugcca

SEQ ID NO: 366024 - RNA, 20 nt, Human
ccagucccccacccaggcuu

SEQ ID NO: 366025 - RNA, 26 nt, Human
ccagucccccagaccucacaggcuca

SEQ ID NO: 366026 - RNA, 32 nt, Human
ccagucccccucccuucuccccaaagcgcucc

SEQ ID NO: 366027 - RNA, 20 nt, Human
ccaguccccgcuucccugcu

SEQ ID NO: 366028 - RNA, 21 nt, Human
ccaguccccgggcucggccuc

SEQ ID NO: 366029 - RNA, 32 nt, Human
ccaguccccgugcccacggggcucccucuccc

SEQ ID NO: 366030 - RNA, 32 nt, Human
ccaguccccucacccuuccuugacuuaccucc

SEQ ID NO: 366031 - RNA, 32 nt, Human
ccaguccccucaccugaugaucccaacacuuc

SEQ ID NO: 366032 - RNA, 32 nt, Human
ccaguccccugccugugcuccugcuggggaag

SEQ ID NO: 366033 - RNA, 23 nt, Human
ccaguccccuuccuucgguguuu

SEQ ID NO: 366034 - RNA, 22 nt, Human
ccaguccccuucuccacugcug

SEQ ID NO: 366035 - RNA, 32 nt, Human
ccagucccuaucucccccauccccucccggcu

SEQ ID NO: 366036 - RNA, 32 nt, Human
ccagucccuccacccacccaccgggcucagcu

SEQ ID NO: 366037 - RNA, 21 nt, Human
ccagucccucccgcccgccca

SEQ ID NO: 366038 - RNA, 24 nt, Human
ccagucccucccucaccagccuca

SEQ ID NO: 366039 - RNA, 32 nt, Human
ccagucccugcagccaagggaagccgcugccu

SEQ ID NO: 366040 - RNA, 32 nt, Human
ccagucccugcucgacucuuacuggcucccuc

SEQ ID NO: 366041 - RNA, 21 nt, Human
ccagucccugcucucaggcca

SEQ ID NO: 366042 - RNA, 28 nt, Human
ccagucccuggagccaccgcggguccuu

SEQ ID NO: 366043 - RNA, 22 nt, Human
ccagucccugggcuagugcuca

SEQ ID NO: 366044 - RNA, 22 nt, Human
ccagucccuguccggaaugcca

SEQ ID NO: 366045 - RNA, 22 nt, Human
ccagucccuguggcugcugcug

SEQ ID NO: 366046 - RNA, 23 nt, Human
ccagucccuucucuccagcuuca

SEQ ID NO: 366047 - RNA, 18 nt, Human
ccaguccgaggccagcuu

SEQ ID NO: 366048 - RNA, 32 nt, Human
ccaguccgugucccuccgccuccaggagggga

SEQ ID NO: 366049 - RNA, 22 nt, Human
ccaguccucagagacccugcug

SEQ ID NO: 366050 - RNA, 21 nt, Human
ccaguccucaguucccacugc

SEQ ID NO: 366051 - RNA, 32 nt, Human
ccaguccucauuuuuccucccaauacccaccc

SEQ ID NO: 366052 - RNA, 21 nt, Human
ccaguccuccaagccugcugc

SEQ ID NO: 366053 - RNA, 32 nt, Human
ccaguccucccagcugccauguuucaaagacg

SEQ ID NO: 366054 - RNA, 24 nt, Human
ccaguccucccccgagaggugcug

SEQ ID NO: 366055 - RNA, 24 nt, Human
ccaguccuccccuuuuugugugcu

SEQ ID NO: 366056 - RNA, 32 nt, Human
ccaguccuccucagcccuccccaagucgcuuc

SEQ ID NO: 366057 - RNA, 19 nt, Human
ccaguccuccugggauccu

SEQ ID NO: 366058 - RNA, 23 nt, Human
ccaguccuccugggauccugcug

SEQ ID NO: 366059 - RNA, 21 nt, Human
ccaguccucggccgccaggcu

SEQ ID NO: 366060 - RNA, 21 nt, Human
ccaguccucggcuccugcugc

SEQ ID NO: 366061 - RNA, 24 nt, Human
ccaguccucucccccugcugucug

SEQ ID NO: 366062 - RNA, 32 nt, Human
ccaguccucucugccuccuccuggcugaagcu

SEQ ID NO: 366063 - RNA, 20 nt, Human
ccaguccucuucugcugcuc

SEQ ID NO: 366064 - RNA, 24 nt, Human
ccaguccucuucuucccucugcug

SEQ ID NO: 366065 - RNA, 32 nt, Human
ccaguccucuuguccuccuuuguuugccauca

SEQ ID NO: 366066 - RNA, 32 nt, Human
ccaguccugccucugcuccugccugguggugu

SEQ ID NO: 366067 - RNA, 32 nt, Human
ccaguccugccugaacagcccucucucucacu

SEQ ID NO: 366068 - RNA, 32 nt, Human
ccaguccugccuggccaggcagaucugugccc

SEQ ID NO: 366069 - RNA, 32 nt, Human
ccaguccugccuguccuucuacucagcuguua

SEQ ID NO: 366070 - RNA, 32 nt, Human
ccaguccugcuccccucaccuuccuugggccc

SEQ ID NO: 366071 - RNA, 23 nt, Human
ccaguccuggaggacccgcugcu

SEQ ID NO: 366072 - RNA, 32 nt, Human
ccaguccuggccagggcaguuaccaggacggu

SEQ ID NO: 366073 - RNA, 32 nt, Human
ccaguccugggcaucgacuacacacacgugcg

SEQ ID NO: 366074 - RNA, 32 nt, Human
ccaguccuggggacucuaaggacucugaggac

SEQ ID NO: 366075 - RNA, 21 nt, Human
ccaguccugucggcugggccc

SEQ ID NO: 366076 - RNA, 32 nt, Human
ccaguccuguucucuuaugugucccaaugagu

SEQ ID NO: 366077 - RNA, 32 nt, Human
ccaguccuguucugacgguauuccugcgccac

SEQ ID NO: 366078 - RNA, 32 nt, Human
ccaguccuuccaggcccugccuggcucuaaac

SEQ ID NO: 366079 - RNA, 23 nt, Human
ccaguccuucccucuuggacuca

SEQ ID NO: 366080 - RNA, 22 nt, Human
ccaguccuuuaucccugcccug

SEQ ID NO: 366081 - RNA, 32 nt, Human
ccaguccuuuauucccuucugcauacugcaau

SEQ ID NO: 366082 - RNA, 21 nt, Human
ccagucgagcagccugugugg

SEQ ID NO: 366083 - RNA, 23 nt, Human
ccagucgcccagcuccaguguca

SEQ ID NO: 366084 - RNA, 32 nt, Human
ccagucgcugagugccugagccgggaagcagu

SEQ ID NO: 366085 - RNA, 32 nt, Human
ccagucgggcuucaucuuuacgcagcgggccc

SEQ ID NO: 366086 - RNA, 32 nt, Human
ccagucgggggaggagaaagacgcgauuaaca

SEQ ID NO: 366087 - RNA, 32 nt, Human
ccagucggucagccggacuggauuuccacgcg

SEQ ID NO: 366088 - RNA, 26 nt, Human
ccagucguagcccggccgcccgcgcc

SEQ ID NO: 366089 - RNA, 32 nt, Human
ccagucgugacuucauuucccuuccuucuguc

SEQ ID NO: 366090 - RNA, 31 nt, Human
ccagucguucucaaggaagggcugggggcca

SEQ ID NO: 366091 - RNA, 32 nt, Human
ccagucuacacccucccacgggguggaaaugg

SEQ ID NO: 366092 - RNA, 18 nt, Human
ccagucuacauuuuccca

SEQ ID NO: 366093 - RNA, 32 nt, Human
ccagucuagaccugcaucuugaggccacaccc

SEQ ID NO: 366094 - RNA, 32 nt, Human
ccagucucacugcacaccacugccucaugcuu

SEQ ID NO: 366095 - RNA, 32 nt, Human
ccagucucacugcgcccucuccuccaaccucc

SEQ ID NO: 366096 - RNA, 32 nt, Human
ccagucucagccaacaguaccaaaagugauuu

SEQ ID NO: 366097 - RNA, 18 nt, Human
ccagucucaggggucacc

SEQ ID NO: 366098 - RNA, 22 nt, Human
ccagucucagucagguaugucu

SEQ ID NO: 366099 - RNA, 32 nt, Human
ccagucuccaaagccgauggcaucuccgggcu

SEQ ID NO: 366100 - RNA, 21 nt, Human
ccagucuccaacccuggccuu

SEQ ID NO: 366101 - RNA, 32 nt, Human
ccagucuccaccuuuauuguucuugaaagccc

SEQ ID NO: 366102 - RNA, 20 nt, Human
ccagucuccacuuugguccc

SEQ ID NO: 366103 - RNA, 31 nt, Human
ccagucuccagcuagaaaaacucagaacauc

SEQ ID NO: 366104 - RNA, 32 nt, Human
ccagucuccaggagccucucccuccgagauac

SEQ ID NO: 366105 - RNA, 32 nt, Human
ccagucucccaaaguacugggauuacaggcgu

SEQ ID NO: 366106 - RNA, 32 nt, Human
ccagucuccuaaaucacaauauggccuuggua

SEQ ID NO: 366107 - RNA, 22 nt, Human
ccagucuccuauacccagcaga

SEQ ID NO: 366108 - RNA, 32 nt, Human
ccagucuccugacauuaagacacaccucugga

SEQ ID NO: 366109 - RNA, 32 nt, Human
ccagucuccuguggcucccuggugcuggguuu

SEQ ID NO: 366110 - RNA, 32 nt, Human
ccagucucuagcuagugccucuugcccucucc

SEQ ID NO: 366111 - RNA, 24 nt, Human
ccagucucuccgauaccaguuuca

SEQ ID NO: 366112 - RNA, 22 nt, Human
ccagucucuccucggaggcccu

SEQ ID NO: 366113 - RNA, 23 nt, Human
ccagucucuccucggaggcccuu

SEQ ID NO: 366114 - RNA, 19 nt, Human
ccagucucugacccuuccc

SEQ ID NO: 366115 - RNA, 32 nt, Human
ccagucucugcaccugggauucagcucaagga

SEQ ID NO: 366116 - RNA, 22 nt, Human
ccagucucugccucuguguuca

SEQ ID NO: 366117 - RNA, 32 nt, Human
ccagucucuggcaccuggcugcucugaucugg

SEQ ID NO: 366118 - RNA, 22 nt, Human
ccagucucugugcucggguuca

SEQ ID NO: 366119 - RNA, 32 nt, Human
ccagucugaccagcaagucccggggucacccu

SEQ ID NO: 366120 - RNA, 32 nt, Human
ccagucugauccauggggcugaaggguaaauu

SEQ ID NO: 366121 - RNA, 32 nt, Human
ccagucugccagcugaguccugguuuuggaug

SEQ ID NO: 366122 - RNA, 32 nt, Human
ccagucugccucuugggucuuccucccaggcc

SEQ ID NO: 366123 - RNA, 19 nt, Human
ccagucuggagucccuccc

SEQ ID NO: 366124 - RNA, 19 nt, Human
ccagucuggagugcagugg

SEQ ID NO: 366125 - RNA, 32 nt, Human
ccagucuggagugcaguggcaaaaucauggcu

SEQ ID NO: 366126 - RNA, 32 nt, Human
ccagucuggagugcagugguacaauaauggcu

SEQ ID NO: 366127 - RNA, 32 nt, Human
ccagucuggagugcaguggugugaucaugguu

SEQ ID NO: 366128 - RNA, 32 nt, Human
ccagucuggccaacauggcgaaaccucauuuc

SEQ ID NO: 366129 - RNA, 32 nt, Human
ccagucuggccaaugugaugaaaccccgucuc

SEQ ID NO: 366130 - RNA, 19 nt, Human
ccagucuggccgggguccc

SEQ ID NO: 366131 - RNA, 32 nt, Human
ccagucuggccuuggccuccagccuggagaag

SEQ ID NO: 366132 - RNA, 32 nt, Human
ccagucuggcucagucugguccacacucugga

SEQ ID NO: 366133 - RNA, 29 nt, Human
ccagucuggcugcgggcaacccuugaguu

SEQ ID NO: 366134 - RNA, 32 nt, Human
ccagucugggacaacagagcaagacccugucu

SEQ ID NO: 366135 - RNA, 24 nt, Human
ccagucugggcaacaaaaaugaaa

SEQ ID NO: 366136 - RNA, 32 nt, Human
ccagucugggcaacaaaaaugaaacuccgucu

SEQ ID NO: 366137 - RNA, 32 nt, Human
ccagucugggcaacagagcgagacuccaucuc

SEQ ID NO: 366138 - RNA, 32 nt, Human
ccagucugggcaacagagcgagacucccucuu

SEQ ID NO: 366139 - RNA, 32 nt, Human
ccagucugggcaacagagugagacccugucuc

SEQ ID NO: 366140 - RNA, 32 nt, Human
ccagucugggcaacauagcaagacucugccuc

SEQ ID NO: 366141 - RNA, 32 nt, Human
ccagucugggcaacauagcgagacuccaucuc

SEQ ID NO: 366142 - RNA, 32 nt, Human
ccagucugggcaacauagugaaacccugucuc

SEQ ID NO: 366143 - RNA, 32 nt, Human
ccagucugggcaacauagugagacccuuuccc

SEQ ID NO: 366144 - RNA, 32 nt, Human
ccagucugggcaacauggugaaaccccaucuc

SEQ ID NO: 366145 - RNA, 32 nt, Human
ccagucugggcaacauggugagacccucgucu

SEQ ID NO: 366146 - RNA, 32 nt, Human
ccagucugggcaacauguugagaccuccaucu

SEQ ID NO: 366147 - RNA, 32 nt, Human
ccagucugggcgacaggagcaagacucugucu

SEQ ID NO: 366148 - RNA, 32 nt, Human
ccagucugggcugccggguucuagucuccuuu

SEQ ID NO: 366149 - RNA, 32 nt, Human
ccagucuguccaaacaaaccuugaguuguuua

SEQ ID NO: 366150 - RNA, 32 nt, Human
ccagucugugucuuugccuucugcuguagguc

SEQ ID NO: 366151 - RNA, 32 nt, Human
ccagucuguucucaaacucgugagcuaaagcu

SEQ ID NO: 366152 - RNA, 32 nt, Human
ccagucuuagucugaagaccuggaaccagaag

SEQ ID NO: 366153 - RNA, 32 nt, Human
ccagucuucgccuuccucuuuuuaagcuguuu

SEQ ID NO: 366154 - RNA, 32 nt, Human
ccagucuucucccuguccccucaugggucccg

SEQ ID NO: 366155 - RNA, 18 nt, Human
ccagucuucugaggcccu

SEQ ID NO: 366156 - RNA, 32 nt, Human
ccagucuucuguccugggaggcugagauuuau

SEQ ID NO: 366157 - RNA, 19 nt, Human
ccagucuugaaaugcauuc

SEQ ID NO: 366158 - RNA, 32 nt, Human
ccagucuugccuggcucuccuccuuggcccag

SEQ ID NO: 366159 - RNA, 32 nt, Human
ccagucuugguugugcuccugaugacgggcac

SEQ ID NO: 366160 - RNA, 32 nt, Human
ccagucuuguuggcgcacgccuguaaucucag

SEQ ID NO: 366161 - RNA, 32 nt, Human
ccagucuuucuaccguucuccugggccuacau

SEQ ID NO: 366162 - RNA, 23 nt, Human
ccagucuuucuccccggcauuca

SEQ ID NO: 366163 - RNA, 32 nt, Human
ccagucuuucugacacacagugaagcucaacu

SEQ ID NO: 366164 - RNA, 32 nt, Human
ccagugaaagaguagugcauuuaauuggagua

SEQ ID NO: 366165 - RNA, 32 nt, Human
ccagugaaagaugaagagagaugaggcaggac

SEQ ID NO: 366166 - RNA, 32 nt, Human
ccagugaaagcaggccaggugcgguggcucac

SEQ ID NO: 366167 - RNA, 32 nt, Human
ccagugaagcuggagccaggguguaaggcaag

SEQ ID NO: 366168 - RNA, 32 nt, Human
ccagugaagggccuuccaugcagcuucccagc

SEQ ID NO: 366169 - RNA, 32 nt, Human
ccagugaaggucacuggacucuagccuacaac

SEQ ID NO: 366170 - RNA, 32 nt, Human
ccagugaaguagugacggaagccugaucauag

SEQ ID NO: 366171 - RNA, 32 nt, Human
ccagugaauagagaggcucaaggcugaguaaa

SEQ ID NO: 366172 - RNA, 32 nt, Human
ccagugaauggcacuuacguuuucauuuuuca

SEQ ID NO: 366173 - RNA, 32 nt, Human
ccagugaaugguggacugaguggugcgaggug

SEQ ID NO: 366174 - RNA, 32 nt, Human
ccagugacaaguguucggagggcagcagagag

SEQ ID NO: 366175 - RNA, 32 nt, Human
ccagugacagggacuguugccaucucccauuc

SEQ ID NO: 366176 - RNA, 32 nt, Human
ccagugacaugacaacugugaccuaagaaaug

SEQ ID NO: 366177 - RNA, 32 nt, Human
ccagugaccagaaaaauuaaaccucaauuuac

SEQ ID NO: 366178 - RNA, 32 nt, Human
ccagugaccggacccagcccgaguaagggcau

SEQ ID NO: 366179 - RNA, 18 nt, Human
ccagugaccugggaccug

SEQ ID NO: 366180 - RNA, 18 nt, Human
ccagugacguccacuucu

SEQ ID NO: 366181 - RNA, 32 nt, Human
ccagugacucagagauccagucuggaagcccu

SEQ ID NO: 366182 - RNA, 32 nt, Human
ccagugagacaauugugaaaccagcuucaauu

SEQ ID NO: 366183 - RNA, 32 nt, Human
ccagugagagaccuggccucagccuggcagcg

SEQ ID NO: 366184 - RNA, 32 nt, Human
ccagugagauccaagcaaauaaguaggcuaca

SEQ ID NO: 366185 - RNA, 32 nt, Human
ccagugagccagcccccaccuuccaggcgccu

SEQ ID NO: 366186 - RNA, 19 nt, Human
ccagugagcccugcuguuc

SEQ ID NO: 366187 - RNA, 32 nt, Human
ccagugagccugaccccgggaggggccguccc

SEQ ID NO: 366188 - RNA, 32 nt, Human
ccagugagcuaguggagagggagcaagggagg

SEQ ID NO: 366189 - RNA, 32 nt, Human
ccagugagcuuggaagagagcaccuugaggca

SEQ ID NO: 366190 - RNA, 32 nt, Human
ccagugaggaagggagaggccagcugcacucc

SEQ ID NO: 366191 - RNA, 32 nt, Human
ccagugaggagaagaugagcgcaagggggauu

SEQ ID NO: 366192 - RNA, 32 nt, Human
ccagugaggagggugcuucaguuuuacucccu

SEQ ID NO: 366193 - RNA, 32 nt, Human
ccagugaggcuucaguguacagcaaccaaaau

SEQ ID NO: 366194 - RNA, 32 nt, Human
ccagugagggagaaagugaucugcagggaggu

SEQ ID NO: 366195 - RNA, 32 nt, Human
ccagugaggucagcuucugcccuccagcaaua

SEQ ID NO: 366196 - RNA, 32 nt, Human
ccagugagguccaggcugcacuaagccaagau

SEQ ID NO: 366197 - RNA, 18 nt, Human
ccagugauccuccauccu

SEQ ID NO: 366198 - RNA, 32 nt, Human
ccagugaugaagagagaauggaagagacaaaa

SEQ ID NO: 366199 - RNA, 32 nt, Human
ccagugaugaauccgaagaacucugucuccau

SEQ ID NO: 366200 - RNA, 18 nt, Human
ccagugaugauuuuccua

SEQ ID NO: 366201 - RNA, 32 nt, Human
ccagugauguggggcucaagggggccucaccu

SEQ ID NO: 366202 - RNA, 32 nt, Human
ccagugauguuuaccaggaggcaucuugccag

SEQ ID NO: 366203 - RNA, 32 nt, Human
ccagugauuggcugcccggaaggaggcggaga

SEQ ID NO: 366204 - RNA, 32 nt, Human
ccagugauuugccucuuagguucuuucuuaaa

SEQ ID NO: 366205 - RNA, 22 nt, Human
ccagugcaaggacccccuuccc

SEQ ID NO: 366206 - RNA, 32 nt, Human
ccagugcaagucaucuggauuugcauuuagcu

SEQ ID NO: 366207 - RNA, 32 nt, Human
ccagugcacccaaugacccccucccuuggggc

SEQ ID NO: 366208 - RNA, 32 nt, Human
ccagugcacccaggcuucuagggcagcguugc

SEQ ID NO: 366209 - RNA, 22 nt, Human
ccagugcacucagccccaggua

SEQ ID NO: 366210 - RNA, 22 nt, Human
ccagugcacuccagccuuggug

SEQ ID NO: 366211 - RNA, 32 nt, Human
ccagugcacuuugccauuaaagucucuucaca

SEQ ID NO: 366212 - RNA, 32 nt, Human
ccagugcagacugucuaaugcccccagcccac

SEQ ID NO: 366213 - RNA, 30 nt, Human
ccagugcagauugaaucagaaagccaaagc

SEQ ID NO: 366214 - RNA, 32 nt, Human
ccagugcagcugauuugaccuccagugggaua

SEQ ID NO: 366215 - RNA, 19 nt, Human
ccagugcagggcgcaguca

SEQ ID NO: 366216 - RNA, 32 nt, Human
ccagugcaggguggcagcagaauguucuggaa

SEQ ID NO: 366217 - RNA, 32 nt, Human
ccagugcagggugggugaggaagugcacaggg

SEQ ID NO: 366218 - RNA, 32 nt, Human
ccagugcagguauuucagaaggagaaggcugg

SEQ ID NO: 366219 - RNA, 24 nt, Human
ccagugcagguggaucacuugagg

SEQ ID NO: 366220 - RNA, 32 nt, Human
ccagugcaguuuuucucuugaaggaucauuua

SEQ ID NO: 366221 - RNA, 32 nt, Human
ccagugcauaccaccaugccugggugauuuuu

SEQ ID NO: 366222 - RNA, 32 nt, Human
ccagugcaucccguuccugcugcagcagcugc

SEQ ID NO: 366223 - RNA, 32 nt, Human
ccagugcauuucuucauggcuucugcuuuuua

SEQ ID NO: 366224 - RNA, 32 nt, Human
ccagugccacagucugcacugagcuuggcuca

SEQ ID NO: 366225 - RNA, 32 nt, Human
ccagugccaggcaggcuucagggcaccguccu

SEQ ID NO: 366226 - RNA, 32 nt, Human
ccagugccaggugggagagggagcagaacagc

SEQ ID NO: 366227 - RNA, 32 nt, Human
ccagugcccaggaguuggggauguccuacaaa

SEQ ID NO: 366228 - RNA, 17 nt, Human
ccagugcccaguuugua

SEQ ID NO: 366229 - RNA, 32 nt, Human
ccagugcccauuccacugugaggugucauucc

SEQ ID NO: 366230 - RNA, 21 nt, Human
ccagugccccucccugcucug

SEQ ID NO: 366231 - RNA, 32 nt, Human
ccagugcccugagcgucuccauggccugccug

SEQ ID NO: 366232 - RNA, 32 nt, Human
ccagugcccugaggguggcauuuuccuaccuu

SEQ ID NO: 366233 - RNA, 32 nt, Human
ccagugcccuggaagcuggggacgccaccguc

SEQ ID NO: 366234 - RNA, 32 nt, Human
ccagugcccugggucagggcuguggggagcag

SEQ ID NO: 366235 - RNA, 32 nt, Human
ccagugccgcauuuauccaucuguaagaaggc

SEQ ID NO: 366236 - RNA, 32 nt, Human
ccagugccgccaucugucuucugugucugccu

SEQ ID NO: 366237 - RNA, 32 nt, Human
ccagugccggagguggggccugguguguuugg

SEQ ID NO: 366238 - RNA, 32 nt, Human
ccagugccuccaucccuccuucugccucccca

SEQ ID NO: 366239 - RNA, 32 nt, Human
ccagugccuccugucaauuucacugcacacug

SEQ ID NO: 366240 - RNA, 22 nt, Human
ccagugccucucccugcugcuc

SEQ ID NO: 366241 - RNA, 32 nt, Human
ccagugccucuccuggucguggaaggugcuac

SEQ ID NO: 366242 - RNA, 32 nt, Human
ccagugccucuggccuuccuacugaaagcaga

SEQ ID NO: 366243 - RNA, 32 nt, Human
ccagugccugcagcucaccuguggguuuuccc

SEQ ID NO: 366244 - RNA, 32 nt, Human
ccagugccuggaacagugucuggugcacauaa

SEQ ID NO: 366245 - RNA, 32 nt, Human
ccagugccuggccucagacucugugggcucug

SEQ ID NO: 366246 - RNA, 32 nt, Human
ccagugccuggugguccagccugugaugggca

SEQ ID NO: 366247 - RNA, 21 nt, Human
ccagugccugucuggagcuca

SEQ ID NO: 366248 - RNA, 32 nt, Human
ccagugccuugcucagccuccugguugcaaca

SEQ ID NO: 366249 - RNA, 32 nt, Human
ccagugccuuucuccccucagcaccuucaucu

SEQ ID NO: 366250 - RNA, 32 nt, Human
ccagugccuuuguccuucccuuggggcuugcc

SEQ ID NO: 366251 - RNA, 32 nt, Human
ccagugcgggaaucacacacauaccucagaau

SEQ ID NO: 366252 - RNA, 32 nt, Human
ccagugcggggaggcccugcccugggauacca

SEQ ID NO: 366253 - RNA, 32 nt, Human
ccagugcggguguggagaagaucuucuggcuu

SEQ ID NO: 366254 - RNA, 32 nt, Human
ccagugcucccucucagcucagucuccccucu

SEQ ID NO: 366255 - RNA, 32 nt, Human
ccagugcucugccuaccugccccaccccucac

SEQ ID NO: 366256 - RNA, 32 nt, Human
ccagugcucugugggagccccaggacaaguga

SEQ ID NO: 366257 - RNA, 32 nt, Human
ccagugcugcacucccacccugggcuccacuc

SEQ ID NO: 366258 - RNA, 32 nt, Human
ccagugcugcagcucugcagaauguucagcau

SEQ ID NO: 366259 - RNA, 32 nt, Human
ccagugcugcagguuucuccugggugaagaug

SEQ ID NO: 366260 - RNA, 32 nt, Human
ccagugcugccaacuguacagcugcgccucca

SEQ ID NO: 366261 - RNA, 32 nt, Human
ccagugcugccugcuugguggcgggggugaug

SEQ ID NO: 366262 - RNA, 22 nt, Human
ccagugcugcugagcuugugug

SEQ ID NO: 366263 - RNA, 32 nt, Human
ccagugcugcugcugaccuucacugacagcuc

SEQ ID NO: 366264 - RNA, 31 nt, Human
ccagugcugggacaaagauggggaaggugug

SEQ ID NO: 366265 - RNA, 32 nt, Human
ccagugcugggacaaagauggggaaggugugu

SEQ ID NO: 366266 - RNA, 32 nt, Human
ccagugcugggugcgcuuaacaacugcguucu

SEQ ID NO: 366267 - RNA, 18 nt, Human
ccagugcuucccaaggcc

SEQ ID NO: 366268 - RNA, 32 nt, Human
ccagugcuugcuugcuuucuucauucucuggg

SEQ ID NO: 366269 - RNA, 32 nt, Human
ccagugcuuggcgaucagcccaauugaaggac

SEQ ID NO: 366270 - RNA, 32 nt, Human
ccagugcuuucuggagcucacaccuggcgcuc

SEQ ID NO: 366271 - RNA, 32 nt, Human
ccagugcuuugcuuaugggugcucgcuggggu

SEQ ID NO: 366272 - RNA, 32 nt, Human
ccaguggaaaaaggaaaagacugguacaaauc

SEQ ID NO: 366273 - RNA, 32 nt, Human
ccaguggaaccagcuuccuccaaggagaugac

SEQ ID NO: 366274 - RNA, 32 nt, Human
ccaguggaaugagaaacuaaugaggaccuaaa

SEQ ID NO: 366275 - RNA, 32 nt, Human
ccaguggacaagacaggagacuggaagaaggg

SEQ ID NO: 366276 - RNA, 32 nt, Human
ccaguggacuacaggauuacuugagaguuauc

SEQ ID NO: 366277 - RNA, 32 nt, Human
ccaguggacuuuggacaguggggagcaggccc

SEQ ID NO: 366278 - RNA, 32 nt, Human
ccaguggagcagcagguguucgaacacauagg

SEQ ID NO: 366279 - RNA, 32 nt, Human
ccaguggaggaagaaggaaggagaggcuugga

SEQ ID NO: 366280 - RNA, 32 nt, Human
ccaguggagggagcaagaggagagggaugucg

SEQ ID NO: 366281 - RNA, 32 nt, Human
ccaguggaggguguucaggcagagggaacagc

SEQ ID NO: 366282 - RNA, 32 nt, Human
ccaguggaguuccaggagcaccaccugaguga

SEQ ID NO: 366283 - RNA, 32 nt, Human
ccaguggauccccugcggucaggcugggcagc

SEQ ID NO: 366284 - RNA, 32 nt, Human
ccaguggaugagggccaccaggaagcacaggu

SEQ ID NO: 366285 - RNA, 32 nt, Human
ccaguggauugcugaugucucuacauugauuc

SEQ ID NO: 366286 - RNA, 32 nt, Human
ccaguggcacaaucucggcucacugcauccuc

SEQ ID NO: 366287 - RNA, 32 nt, Human
ccaguggcacugacaaggggacggaguccaag

SEQ ID NO: 366288 - RNA, 32 nt, Human
ccaguggcagcccaaguuagagcccagcauua

SEQ ID NO: 366289 - RNA, 32 nt, Human
ccaguggcagccucgcccucugggucagggug

SEQ ID NO: 366290 - RNA, 32 nt, Human
ccaguggccaccuguaccuguacaacgucagc

SEQ ID NO: 366291 - RNA, 21 nt, Human
ccaguggccaggcccugugga

SEQ ID NO: 366292 - RNA, 32 nt, Human
ccaguggcccagccaggaguggauuucaaaga

SEQ ID NO: 366293 - RNA, 32 nt, Human
ccaguggccuuccucccuuccuuucacagccg

SEQ ID NO: 366294 - RNA, 32 nt, Human
ccaguggccuuggcagaggcagguguggccuc

SEQ ID NO: 366295 - RNA, 32 nt, Human
ccaguggcgagaucuuggcucacuacaaccuc

SEQ ID NO: 366296 - RNA, 32 nt, Human
ccaguggcugccaggauuucugguggaagaga

SEQ ID NO: 366297 - RNA, 19 nt, Human
ccaguggcuggagacuuca

SEQ ID NO: 366298 - RNA, 32 nt, Human
ccaguggcugggaugguggaauugggguuauu

SEQ ID NO: 366299 - RNA, 32 nt, Human
ccaguggcuucuggagcagccuggugaacccu

SEQ ID NO: 366300 - RNA, 32 nt, Human
ccagugggaaccuggguuuucuagcuggugaa

SEQ ID NO: 366301 - RNA, 19 nt, Human
ccagugggaggaggggcag

SEQ ID NO: 366302 - RNA, 32 nt, Human
ccagugggaggcggaggccgugagcgcccagg

SEQ ID NO: 366303 - RNA, 32 nt, Human
ccagugggauagauacgauuagcaccaggauc

SEQ ID NO: 366304 - RNA, 18 nt, Human
ccagugggccuggggucc

SEQ ID NO: 366305 - RNA, 19 nt, Human
ccagugggccugggguccc

SEQ ID NO: 366306 - RNA, 32 nt, Human
ccagugggcugcagggccugcuuggaggaagg

SEQ ID NO: 366307 - RNA, 32 nt, Human
ccagugggcuugagcuugcugugcuugguauu

SEQ ID NO: 366308 - RNA, 32 nt, Human
ccagugggcuuggcacuccaccuugggcuucc

SEQ ID NO: 366309 - RNA, 22 nt, Human
ccaguggggagugggugggagg

SEQ ID NO: 366310 - RNA, 32 nt, Human
ccaguggggccagcacacacgaagcaacagua

SEQ ID NO: 366311 - RNA, 32 nt, Human
ccagugggggauaccccagagcccauggccug

SEQ ID NO: 366312 - RNA, 31 nt, Human
ccagugggggcugucgcagccaacaccccgg

SEQ ID NO: 366313 - RNA, 32 nt, Human
ccaguggggugaggccagccaagucccugugu

SEQ ID NO: 366314 - RNA, 32 nt, Human
ccagugggucagcaggcacggcuggcagccuu

SEQ ID NO: 366315 - RNA, 32 nt, Human
ccagugggugaggaugggagggcagggugggg

SEQ ID NO: 366316 - RNA, 21 nt, Human
ccaguggguggcucugacucg

SEQ ID NO: 366317 - RNA, 32 nt, Human
ccaguggguggguggggugggguggggcaagu

SEQ ID NO: 366318 - RNA, 32 nt, Human
ccagugguaaugcccagaguccuggcucuauc

SEQ ID NO: 366319 - RNA, 21 nt, Human
ccaguggucaaaccgcacuca

SEQ ID NO: 366320 - RNA, 32 nt, Human
ccagugguccgggaguucaggauugcaugaaa

SEQ ID NO: 366321 - RNA, 32 nt, Human
ccaguggucuagucaacauuuccucuugcaga

SEQ ID NO: 366322 - RNA, 32 nt, Human
ccaguggugcaaggcuggagaaugggguauga

SEQ ID NO: 366323 - RNA, 32 nt, Human
ccagugguggaaggcacaccauggcuuccucu

SEQ ID NO: 366324 - RNA, 32 nt, Human
ccaguggugggacucagcccagacugcccugg

SEQ ID NO: 366325 - RNA, 32 nt, Human
ccaguggugugaucauagcucacugcauccuc

SEQ ID NO: 366326 - RNA, 19 nt, Human
ccagugguguggucaauca

SEQ ID NO: 366327 - RNA, 32 nt, Human
ccagugguucucaaacuuuaaaaugccucagc

SEQ ID NO: 366328 - RNA, 32 nt, Human
ccagugguucucaaagugugacccauagacua

SEQ ID NO: 366329 - RNA, 20 nt, Human
ccagugguuuguccaggcuc

SEQ ID NO: 366330 - RNA, 32 nt, Human
ccaguguaaaaaggaaguuggaaugggaguug

SEQ ID NO: 366331 - RNA, 32 nt, Human
ccaguguaaccagcuuaguaaccagaguaucu

SEQ ID NO: 366332 - RNA, 32 nt, Human
ccaguguaauuucugucaaccacggacguuug

SEQ ID NO: 366333 - RNA, 21 nt, Human
ccaguguaggagggugggagg

SEQ ID NO: 366334 - RNA, 32 nt, Human
ccaguguauccaggguguuccaggugagcugg

SEQ ID NO: 366335 - RNA, 22 nt, Human
ccaguguauuugggacucaugg

SEQ ID NO: 366336 - RNA, 32 nt, Human
ccagugucacccagggugagugcaaaauaaag

SEQ ID NO: 366337 - RNA, 32 nt, Human
ccagugucaccuacaacauggaauggaggguc

SEQ ID NO: 366338 - RNA, 32 nt, Human
ccagugucacuucugcaguccuccucugcuca

SEQ ID NO: 366339 - RNA, 32 nt, Human
ccagugucauucuccaccauuucugcaguuua

SEQ ID NO: 366340 - RNA, 19 nt, Human
ccaguguccaggccggcca

SEQ ID NO: 366341 - RNA, 32 nt, Human
ccaguguccaggcuguggugcaggcgugggga

SEQ ID NO: 366342 - RNA, 32 nt, Human
ccagugucccuggaugaggugaugauuucccg

SEQ ID NO: 366343 - RNA, 32 nt, Human
ccaguguccuacugggagcucagucuguagug

SEQ ID NO: 366344 - RNA, 32 nt, Human
ccaguguccugacuucugucugccacaugagg

SEQ ID NO: 366345 - RNA, 32 nt, Human
ccaguguccugugccagccuucaugcccagcc

SEQ ID NO: 366346 - RNA, 22 nt, Human
ccagugucuauagacuauugug

SEQ ID NO: 366347 - RNA, 32 nt, Human
ccagugucucacugccaaaccucuugguuacg

SEQ ID NO: 366348 - RNA, 32 nt, Human
ccagugucuccuugauauugauccuagcagau

SEQ ID NO: 366349 - RNA, 32 nt, Human
ccagugucucuaauaaacuuucucuucuuucu

SEQ ID NO: 366350 - RNA, 32 nt, Human
ccagugucucucugcaccuccacccaucccuc

SEQ ID NO: 366351 - RNA, 32 nt, Human
ccagugucugacacaaagccugggacaugugg

SEQ ID NO: 366352 - RNA, 32 nt, Human
ccagugucuguggccuggcaaguggccacgcc

SEQ ID NO: 366353 - RNA, 32 nt, Human
ccagugucuguucauugccucugccuugcccc

SEQ ID NO: 366354 - RNA, 32 nt, Human
ccagugugaagcucggcgggggugggcagggc

SEQ ID NO: 366355 - RNA, 32 nt, Human
ccagugugaaggaggagagagguggagggcug

SEQ ID NO: 366356 - RNA, 32 nt, Human
ccagugugaccucacccucuccagucaccccu

SEQ ID NO: 366357 - RNA, 21 nt, Human
ccagugugacuggccggggug

SEQ ID NO: 366358 - RNA, 32 nt, Human
ccagugugagugcugcucuuuccaccugccuu

SEQ ID NO: 366359 - RNA, 22 nt, Human
ccagugugcugggauuacaggc

SEQ ID NO: 366360 - RNA, 32 nt, Human
ccaguguggagcaugaccugaccugcagccca

SEQ ID NO: 366361 - RNA, 32 nt, Human
ccaguguggccgagguugcagugaguguagau

SEQ ID NO: 366362 - RNA, 32 nt, Human
ccagugugggcaacagagugagaaccaucucu

SEQ ID NO: 366363 - RNA, 32 nt, Human
ccagugugggcaacguagugaaacccugccuc

SEQ ID NO: 366364 - RNA, 30 nt, Human
ccagugugguuguagagauuguagagaggg

SEQ ID NO: 366365 - RNA, 28 nt, Human
ccaguguguaaauaaagcucuuuugcca

SEQ ID NO: 366366 - RNA, 22 nt, Human
ccagugugugccccacccagug

SEQ ID NO: 366367 - RNA, 32 nt, Human
ccaguguguguggcggguguagaaggagcuaa

SEQ ID NO: 366368 - RNA, 32 nt, Human
ccaguguguugugacuccugaggucucucagc

SEQ ID NO: 366369 - RNA, 32 nt, Human
ccaguguuauugaggugaucaagaucuguucc

SEQ ID NO: 366370 - RNA, 32 nt, Human
ccaguguucaaagcugaacuucagauggacuu

SEQ ID NO: 366371 - RNA, 32 nt, Human
ccaguguucccaguucccaccaguccaacugc

SEQ ID NO: 366372 - RNA, 32 nt, Human
ccaguguucucccagggcuugcuaaauccagc

SEQ ID NO: 366373 - RNA, 32 nt, Human
ccaguguucugaguuauugaaaggcuuucuuu

SEQ ID NO: 366374 - RNA, 32 nt, Human
ccaguguugcauuuugucuuacucugaaagaa

SEQ ID NO: 366375 - RNA, 21 nt, Human
ccaguguugggaagcuuuugc

SEQ ID NO: 366376 - RNA, 32 nt, Human
ccaguguuucaggcacaggaaguacagcagug

SEQ ID NO: 366377 - RNA, 24 nt, Human
ccaguguuuccucagcucauccgc

SEQ ID NO: 366378 - RNA, 22 nt, Human
ccaguguuucugucagucuuuc

SEQ ID NO: 366379 - RNA, 32 nt, Human
ccaguguuuggaggggaggaugagugccuguc

SEQ ID NO: 366380 - RNA, 32 nt, Human
ccaguguuuuucuguggcauugccugguaaag

SEQ ID NO: 366381 - RNA, 20 nt, Human
ccaguuaaaaagccugugug

SEQ ID NO: 366382 - RNA, 32 nt, Human
ccaguuaaaaccucccagcugaccucagacua

SEQ ID NO: 366383 - RNA, 32 nt, Human
ccaguuaaaagacguccaucuucaagaagugg

SEQ ID NO: 366384 - RNA, 32 nt, Human
ccaguuaaacaugccucuucuacagcuccauu

SEQ ID NO: 366385 - RNA, 31 nt, Human
ccaguuaaagggccuguuucuuacuggccug

SEQ ID NO: 366386 - RNA, 32 nt, Human
ccaguuaaccaccauucugcggccugguucug

SEQ ID NO: 366387 - RNA, 32 nt, Human
ccaguuaaccugggcucccugaugcccagcug

SEQ ID NO: 366388 - RNA, 32 nt, Human
ccaguuaagcagcagcugcacgcccaggcugc

SEQ ID NO: 366389 - RNA, 20 nt, Human
ccaguuaagccacagaacuc

SEQ ID NO: 366390 - RNA, 32 nt, Human
ccaguuaaguagugucuucucucuccaccaaa

SEQ ID NO: 366391 - RNA, 32 nt, Human
ccaguuaauggaaucagcaccuuuccuucauu

SEQ ID NO: 366392 - RNA, 20 nt, Human
ccaguuaauggcacugcuca

SEQ ID NO: 366393 - RNA, 32 nt, Human
ccaguuacagaugcuugguuaguuugggacau

SEQ ID NO: 366394 - RNA, 32 nt, Human
ccaguuacagcuccccggcucuucuguguggc

SEQ ID NO: 366395 - RNA, 32 nt, Human
ccaguuaccaccaaacaucugggaaacuucug

SEQ ID NO: 366396 - RNA, 20 nt, Human
ccaguuaccaccuccugccu

SEQ ID NO: 366397 - RNA, 32 nt, Human
ccaguuacccaagaggaagcugccuugggccu

SEQ ID NO: 366398 - RNA, 32 nt, Human
ccaguuaccuucuccauugucuuaguucuguc

SEQ ID NO: 366399 - RNA, 32 nt, Human
ccaguuacucaguagacugagcucuuuuggua

SEQ ID NO: 366400 - RNA, 32 nt, Human
ccaguuacuugaaccugggaggcggagguugc

SEQ ID NO: 366401 - RNA, 32 nt, Human
ccaguuagcacaaaggaaaauauuucaauaaa

SEQ ID NO: 366402 - RNA, 31 nt, Human
ccaguuaggcacuuuuugucccugguaagac

SEQ ID NO: 366403 - RNA, 18 nt, Human
ccaguuauccuggcccca

SEQ ID NO: 366404 - RNA, 32 nt, Human
ccaguuaugcccagcuccuuccuccuccuccu

SEQ ID NO: 366405 - RNA, 25 nt, Human
ccaguuauguugacuuccuucugca

SEQ ID NO: 366406 - RNA, 32 nt, Human
ccaguuauuauacaaccaaauacaacuuccag

SEQ ID NO: 366407 - RNA, 32 nt, Human
ccaguucaaagccaccuuagacaguguggcaa

SEQ ID NO: 366408 - RNA, 32 nt, Human
ccaguucaccccucaccuccagccuggaggag

SEQ ID NO: 366409 - RNA, 32 nt, Human
ccaguucacucaggccuuacuaauccauacca

SEQ ID NO: 366410 - RNA, 17 nt, Human
ccaguucacugcugcca

SEQ ID NO: 366411 - RNA, 32 nt, Human
ccaguucagacucuaacuucucccaaaguguc

SEQ ID NO: 366412 - RNA, 32 nt, Human
ccaguucagcuuggggacaggggcaggaggaa

SEQ ID NO: 366413 - RNA, 32 nt, Human
ccaguucaguccacaccaucucuucuuugagu

SEQ ID NO: 366414 - RNA, 32 nt, Human
ccaguuccaaaccuuaauugaacguaagagaa

SEQ ID NO: 366415 - RNA, 32 nt, Human
ccaguuccaaaccuuaauugaauguaagagaa

SEQ ID NO: 366416 - RNA, 28 nt, Human
ccaguuccaagugcaucccuuauucuau

SEQ ID NO: 366417 - RNA, 26 nt, Human
ccaguuccacaugcuggauuauggug

SEQ ID NO: 366418 - RNA, 32 nt, Human
ccaguuccacuucuaccuuggagcucacuggu

SEQ ID NO: 366419 - RNA, 32 nt, Human
ccaguuccauggcaaggcucagacuuuuaaug

SEQ ID NO: 366420 - RNA, 32 nt, Human
ccaguucccaaaucuuuaucuaucucagacuu

SEQ ID NO: 366421 - RNA, 21 nt, Human
ccaguucccacacucaggcca

SEQ ID NO: 366422 - RNA, 32 nt, Human
ccaguucccaggcgcacucuacuccagcccuu

SEQ ID NO: 366423 - RNA, 32 nt, Human
ccaguucccaggcugcaguugagggucugucc

SEQ ID NO: 366424 - RNA, 32 nt, Human
ccaguuccccguuuagaacucauuagcugugu

SEQ ID NO: 366425 - RNA, 32 nt, Human
ccaguuccccuccuugcggccccaucagcgaa

SEQ ID NO: 366426 - RNA, 22 nt, Human
ccaguucccgugacgaggcuca

SEQ ID NO: 366427 - RNA, 32 nt, Human
ccaguucccuaaucaaucagagucagaacucu

SEQ ID NO: 366428 - RNA, 23 nt, Human
ccaguucccuccccaggccuccu

SEQ ID NO: 366429 - RNA, 32 nt, Human
ccaguucccuccccaggccuccugggccaccu

SEQ ID NO: 366430 - RNA, 32 nt, Human
ccaguucccuguugaagaaacaguucccuguu

SEQ ID NO: 366431 - RNA, 32 nt, Human
ccaguucccuucuccccucccggccaaaccca

SEQ ID NO: 366432 - RNA, 32 nt, Human
ccaguuccggcacgaggaccaugggccggcug

SEQ ID NO: 366433 - RNA, 32 nt, Human
ccaguuccuaucucccacccgccugguuccag

SEQ ID NO: 366434 - RNA, 32 nt, Human
ccaguuccucaccagcuacucuggccauauau

SEQ ID NO: 366435 - RNA, 23 nt, Human
ccaguuccucagucagguacuua

SEQ ID NO: 366436 - RNA, 32 nt, Human
ccaguuccuccuaccccugccucugucggaga

SEQ ID NO: 366437 - RNA, 32 nt, Human
ccaguuccuccuuguuucaucucuuugcuaag

SEQ ID NO: 366438 - RNA, 32 nt, Human
ccaguuccucuucacaugaagccccuggcauu

SEQ ID NO: 366439 - RNA, 23 nt, Human
ccaguuccugggaccaggccuca

SEQ ID NO: 366440 - RNA, 21 nt, Human
ccaguuccuguccguccaugc

SEQ ID NO: 366441 - RNA, 21 nt, Human
ccaguuccuguucuguguuca

SEQ ID NO: 366442 - RNA, 32 nt, Human
ccaguuccuugaaggcccccaagaggggcgag

SEQ ID NO: 366443 - RNA, 32 nt, Human
ccaguuccuuuccuccccacuucaccaacacu

SEQ ID NO: 366444 - RNA, 32 nt, Human
ccaguuccuuucucccauucccagccucauuu

SEQ ID NO: 366445 - RNA, 32 nt, Human
ccaguucgccuggagcccuccgccuucacauu

SEQ ID NO: 366446 - RNA, 32 nt, Human
ccaguucgugagaguuccuguucugcauccuc

SEQ ID NO: 366447 - RNA, 19 nt, Human
ccaguucuacagagugaga

SEQ ID NO: 366448 - RNA, 32 nt, Human
ccaguucuaccucuugcugucuguguguucuu

SEQ ID NO: 366449 - RNA, 23 nt, Human
ccaguucucauggguggcacuca

SEQ ID NO: 366450 - RNA, 32 nt, Human
ccaguucuccacugucucuucuggaccaggaa

SEQ ID NO: 366451 - RNA, 32 nt, Human
ccaguucuccuccucagccuuuuccuccucag

SEQ ID NO: 366452 - RNA, 22 nt, Human
ccaguucuccuucccugcagag

SEQ ID NO: 366453 - RNA, 20 nt, Human
ccaguucucguuuugggcca

SEQ ID NO: 366454 - RNA, 32 nt, Human
ccaguucucuagaccucugcccaaaccagagc

SEQ ID NO: 366455 - RNA, 32 nt, Human
ccaguucucugccugcaccaugacugucguac

SEQ ID NO: 366456 - RNA, 32 nt, Human
ccaguucugcagugacaggcccaggggcugcc

SEQ ID NO: 366457 - RNA, 32 nt, Human
ccaguucuggaaaggccaggauguggguucag

SEQ ID NO: 366458 - RNA, 21 nt, Human
ccaguucugggaggcgggggg

SEQ ID NO: 366459 - RNA, 24 nt, Human
ccaguucuucccccaaaguauuca

SEQ ID NO: 366460 - RNA, 19 nt, Human
ccaguucuucucccugagc

SEQ ID NO: 366461 - RNA, 21 nt, Human
ccaguucuuuacauuuuucca

SEQ ID NO: 366462 - RNA, 32 nt, Human
ccaguucuuuccgucucugccucucucugucu

SEQ ID NO: 366463 - RNA, 32 nt, Human
ccaguucuuuggccuaugccaggcucucuggu

SEQ ID NO: 366464 - RNA, 23 nt, Human
ccaguugaaaauaccagcuuugg

SEQ ID NO: 366465 - RNA, 32 nt, Human
ccaguugaauaauggcccauucaugccaaccu

SEQ ID NO: 366466 - RNA, 32 nt, Human
ccaguugacaagauuuuuccacccucgagcag

SEQ ID NO: 366467 - RNA, 20 nt, Human
ccaguugagaacagccucug

SEQ ID NO: 366468 - RNA, 24 nt, Human
ccaguugagaaugagccugugugg

SEQ ID NO: 366469 - RNA, 21 nt, Human
ccaguugagccagggcagcca

SEQ ID NO: 366470 - RNA, 32 nt, Human
ccaguugaggaaacggaggcccagggaggcug

SEQ ID NO: 366471 - RNA, 21 nt, Human
ccaguugaugaaccugucugg

SEQ ID NO: 366472 - RNA, 31 nt, Human
ccaguugcaaugucugucaguaacgaggcuu

SEQ ID NO: 366473 - RNA, 19 nt, Human
ccaguugcauucugugaua

SEQ ID NO: 366474 - RNA, 23 nt, Human
ccaguugcccugaacccagcaga

SEQ ID NO: 366475 - RNA, 32 nt, Human
ccaguugccggaggucugggcaccaggccaau

SEQ ID NO: 366476 - RNA, 32 nt, Human
ccaguugcuggcuuagucauuggccacccuaa

SEQ ID NO: 366477 - RNA, 32 nt, Human
ccaguugcugggacggaaggcugaauguaggg

SEQ ID NO: 366478 - RNA, 27 nt, Human
ccaguuggaaaaggaggcccgguuccg

SEQ ID NO: 366479 - RNA, 32 nt, Human
ccaguuggaagagauuucagaugugcuacagc

SEQ ID NO: 366480 - RNA, 32 nt, Human
ccaguuggagccagacagcgggguggacaagu

SEQ ID NO: 366481 - RNA, 32 nt, Human
ccaguuggagccaggaacaggcaggagcccag

SEQ ID NO: 366482 - RNA, 32 nt, Human
ccaguuggcggaggaggagaaggaaggggccg

SEQ ID NO: 366483 - RNA, 32 nt, Human
ccaguugggagcacuggagugcagggaggaga

SEQ ID NO: 366484 - RNA, 20 nt, Human
ccaguuggggagacagaggg

SEQ ID NO: 366485 - RNA, 32 nt, Human
ccaguugguaauuuaaaaguacacuucacuuc

SEQ ID NO: 366486 - RNA, 23 nt, Human
ccaguugguacuuuuucacuccc

SEQ ID NO: 366487 - RNA, 19 nt, Human
ccaguuggugcugcuuucu

SEQ ID NO: 366488 - RNA, 20 nt, Human
ccaguuguaguaggugccag

SEQ ID NO: 366489 - RNA, 32 nt, Human
ccaguuguccuccaaaaaccucacucaccacg

SEQ ID NO: 366490 - RNA, 18 nt, Human
ccaguugucuuuuuccca

SEQ ID NO: 366491 - RNA, 32 nt, Human
ccaguugugaaggggcuccaagugccuuguuc

SEQ ID NO: 366492 - RNA, 32 nt, Human
ccaguugugcuggcucacaucuguaaugccag

SEQ ID NO: 366493 - RNA, 32 nt, Human
ccaguuguggcuguggaguuagagucacauag

SEQ ID NO: 366494 - RNA, 32 nt, Human
ccaguuguguugguuucucggugacuuggagu

SEQ ID NO: 366495 - RNA, 32 nt, Human
ccaguuguucccuucagacucaggggcuccac

SEQ ID NO: 366496 - RNA, 32 nt, Human
ccaguuguuccuucuaggcugcccaagcccca

SEQ ID NO: 366497 - RNA, 32 nt, Human
ccaguuguucucaaagugugguaccuggauca

SEQ ID NO: 366498 - RNA, 19 nt, Human
ccaguuuacccauuuuccc

SEQ ID NO: 366499 - RNA, 32 nt, Human
ccaguuuagccaagggcuuuguuccuggcaug

SEQ ID NO: 366500 - RNA, 32 nt, Human
ccaguuuagcuccaaaggaaaagagggaaaua

SEQ ID NO: 366501 - RNA, 32 nt, Human
ccaguuuaucugugccccagcuuccucacuua

SEQ ID NO: 366502 - RNA, 32 nt, Human
ccaguuucaaagcuccucggcuaugcuaaugu

SEQ ID NO: 366503 - RNA, 32 nt, Human
ccaguuucaagcaauucucaugccucagauuc

SEQ ID NO: 366504 - RNA, 32 nt, Human
ccaguuucaagcgauucuccugccucagccuc

SEQ ID NO: 366505 - RNA, 21 nt, Human
ccaguuucaugaaguaugucu

SEQ ID NO: 366506 - RNA, 32 nt, Human
ccaguuuccaauaccaacucaccuacaaagau

SEQ ID NO: 366507 - RNA, 32 nt, Human
ccaguuuccagucgggggaacugaggcagagc

SEQ ID NO: 366508 - RNA, 32 nt, Human
ccaguuuccccagccucagccccagccccagc

SEQ ID NO: 366509 - RNA, 32 nt, Human
ccaguuuccgcuccggucucucggcaugagag

SEQ ID NO: 366510 - RNA, 32 nt, Human
ccaguuuccuaugcauccuuccagaaauuacc

SEQ ID NO: 366511 - RNA, 32 nt, Human
ccaguuuccugagauuagaaccuguguguaug

SEQ ID NO: 366512 - RNA, 20 nt, Human
ccaguuucuacagacugcca

SEQ ID NO: 366513 - RNA, 19 nt, Human
ccaguuucucagagugcuc

SEQ ID NO: 366514 - RNA, 22 nt, Human
ccaguuucucaggaggaugccu

SEQ ID NO: 366515 - RNA, 32 nt, Human
ccaguuucuccaaccuuuacuguggagcaaca

SEQ ID NO: 366516 - RNA, 32 nt, Human
ccaguuucuccccuagacucaggcuuccuuug

SEQ ID NO: 366517 - RNA, 25 nt, Human
ccaguuucugaaucaucuccaagua

SEQ ID NO: 366518 - RNA, 32 nt, Human
ccaguuucuggaggcagauggguaaccaggaa

SEQ ID NO: 366519 - RNA, 23 nt, Human
ccaguuucuuccggcgcagcucu

SEQ ID NO: 366520 - RNA, 32 nt, Human
ccaguuucuucuuuucucccagucuccuguuc

SEQ ID NO: 366521 - RNA, 24 nt, Human
ccaguuucuuguccugggcccuca

SEQ ID NO: 366522 - RNA, 21 nt, Human
ccaguuucuuuaggcagcucu

SEQ ID NO: 366523 - RNA, 32 nt, Human
ccaguuugcaccuguccccacccuccacucag

SEQ ID NO: 366524 - RNA, 32 nt, Human
ccaguuugcaggaagaaaggaagagaauggaa

SEQ ID NO: 366525 - RNA, 15 nt, Human
ccaguuugcauuccc

SEQ ID NO: 366526 - RNA, 32 nt, Human
ccaguuugcauucuccaaauguuuccagugau

SEQ ID NO: 366527 - RNA, 32 nt, Human
ccaguuugccagcagcuauuugccuauagaga

SEQ ID NO: 366528 - RNA, 20 nt, Human
ccaguuugggcaacaagagc

SEQ ID NO: 366529 - RNA, 32 nt, Human
ccaguuugggcaacagaaugaggcuccaucuc

SEQ ID NO: 366530 - RNA, 23 nt, Human
ccaguuugggcaacauagugaga

SEQ ID NO: 366531 - RNA, 32 nt, Human
ccaguuugggcaacauagugagaucucaucuc

SEQ ID NO: 366532 - RNA, 32 nt, Human
ccaguuugguucugaagcugguccuuauuuac

SEQ ID NO: 366533 - RNA, 32 nt, Human
ccaguuuucacuuuuugaagcauugcaucuuu

SEQ ID NO: 366534 - RNA, 32 nt, Human
ccaguuuucucagccaggcggcggcggcgacu

SEQ ID NO: 366535 - RNA, 32 nt, Human
ccaguuuucucuccaucucuuuucuuuguaca

SEQ ID NO: 366536 - RNA, 32 nt, Human
ccaguuuucuuccuuguuuacacaaguucaau

SEQ ID NO: 366537 - RNA, 32 nt, Human
ccaguuuucuuuugccugucauggugaccuga

SEQ ID NO: 366538 - RNA, 32 nt, Human
ccaguuuugacacgccccagugcccuggagaa

SEQ ID NO: 366539 - RNA, 32 nt, Human
ccaguuuugauugcuggcaucuugccacccca

SEQ ID NO: 366540 - RNA, 32 nt, Human
ccaguuuugguaucacagcaauguuuucucau

SEQ ID NO: 366541 - RNA, 23 nt, Human
ccauaaaaacaaaguccauuuua

SEQ ID NO: 366542 - RNA, 32 nt, Human
ccauaaaacuggaagcugcuuccccuguaguc

SEQ ID NO: 366543 - RNA, 21 nt, Human
ccauaaaauacagacauuuua

SEQ ID NO: 366544 - RNA, 32 nt, Human
ccauaaaaugaauggcguuucucuccauauuu

SEQ ID NO: 366545 - RNA, 22 nt, Human
ccauaaaaugccuuuagcauuu

SEQ ID NO: 366546 - RNA, 32 nt, Human
ccauaaaaugugaaaacuggagaagaucuuag

SEQ ID NO: 366547 - RNA, 32 nt, Human
ccauaaacaaaaaguaucucagaucugucacu

SEQ ID NO: 366548 - RNA, 32 nt, Human
ccauaaacaccuucccuguccuggcccuccga

SEQ ID NO: 366549 - RNA, 32 nt, Human
ccauaaacagcccucuugugucuguuuucuuc

SEQ ID NO: 366550 - RNA, 32 nt, Human
ccauaaaccagcuggagcagacccuuuucauc

SEQ ID NO: 366551 - RNA, 32 nt, Human
ccauaaacuauguauuuuggcaagacacuuca

SEQ ID NO: 366552 - RNA, 31 nt, Human
ccauaaagcgcauccuuuacauuguaccuau

SEQ ID NO: 366553 - RNA, 32 nt, Human
ccauaaaguaauuuugugaaagaaggagcaag

SEQ ID NO: 366554 - RNA, 32 nt, Human
ccauaaagugauauauuuaauauuuuuauucu

SEQ ID NO: 366555 - RNA, 32 nt, Human
ccauaaauaaaagauucucugauaccuucauu

SEQ ID NO: 366556 - RNA, 32 nt, Human
ccauaaaucucaggaauguuuuaggcagaaaa

SEQ ID NO: 366557 - RNA, 32 nt, Human
ccauaacaaaggacuguagacugaggggcuua

SEQ ID NO: 366558 - RNA, 32 nt, Human
ccauaacaaauaguaacauuucuacagcaaaa

SEQ ID NO: 366559 - RNA, 32 nt, Human
ccauaacaaguuuacuuguggaaaagaaaagg

SEQ ID NO: 366560 - RNA, 19 nt, Human
ccauaaccaccccugggaa

SEQ ID NO: 366561 - RNA, 32 nt, Human
ccauaacccagccucagacccauggagcccac

SEQ ID NO: 366562 - RNA, 32 nt, Human
ccauaacccugaccgccuggggcaggaaguau

SEQ ID NO: 366563 - RNA, 32 nt, Human
ccauaaccucucccacagccagugccaagucc

SEQ ID NO: 366564 - RNA, 32 nt, Human
ccauaacguuuacaguuguaguacaguugugg

SEQ ID NO: 366565 - RNA, 32 nt, Human
ccauaagaagaaaagggggagccccagaugug

SEQ ID NO: 366566 - RNA, 32 nt, Human
ccauaagaguuucuccaaaaguggucaguuug

SEQ ID NO: 366567 - RNA, 32 nt, Human
ccauaagccacagccucacaggaagugggggu

SEQ ID NO: 366568 - RNA, 32 nt, Human
ccauaagcccagggaugugacagcugcagcgg

SEQ ID NO: 366569 - RNA, 32 nt, Human
ccauaagccuccaucguuuucucuuuucuccu

SEQ ID NO: 366570 - RNA, 32 nt, Human
ccauaaggaugaggacaggggaggccagaggg

SEQ ID NO: 366571 - RNA, 32 nt, Human
ccauaaggcaacacuuguuauccaccagauaa

SEQ ID NO: 366572 - RNA, 24 nt, Human
ccauaaggcagagguugcagugag

SEQ ID NO: 366573 - RNA, 32 nt, Human
ccauaaggcugaugcugauuuggccagagaug

SEQ ID NO: 366574 - RNA, 32 nt, Human
ccauaagucugauucucuuuaacugugugacc

SEQ ID NO: 366575 - RNA, 32 nt, Human
ccauaaguguuuuggagcucaucuggggugag

SEQ ID NO: 366576 - RNA, 32 nt, Human
ccauaauaagagucuucagagagaugauggga

SEQ ID NO: 366577 - RNA, 32 nt, Human
ccauaauauaaaugugugaaucagggcuguga

SEQ ID NO: 366578 - RNA, 32 nt, Human
ccauaaucuguaggcuuuaauuuuagaaauuc

SEQ ID NO: 366579 - RNA, 32 nt, Human
ccauaaugaaugugagaaagcugucauuuaaa

SEQ ID NO: 366580 - RNA, 24 nt, Human
ccauaaugcugggauuacaggcgu

SEQ ID NO: 366581 - RNA, 32 nt, Human
ccauaauggucaguacagagaagagaaaagcu

SEQ ID NO: 366582 - RNA, 32 nt, Human
ccauaauggucuucucugcuguuccuugaaca

SEQ ID NO: 366583 - RNA, 32 nt, Human
ccauaauguccucaguggaaggugaugggggc

SEQ ID NO: 366584 - RNA, 32 nt, Human
ccauaauucauagugauagagugcagugaugu

SEQ ID NO: 366585 - RNA, 25 nt, Human
ccauacaaauccaccgcagcacagg

SEQ ID NO: 366586 - RNA, 32 nt, Human
ccauacaacucaaccaaacuuaccccugagcc

SEQ ID NO: 366587 - RNA, 32 nt, Human
ccauacaacugccugaguuccuaaguggccuc

SEQ ID NO: 366588 - RNA, 32 nt, Human
ccauacacaggugugcuucuagucagugugua

SEQ ID NO: 366589 - RNA, 32 nt, Human
ccauacacaguuacagagaucagucaaaucca

SEQ ID NO: 366590 - RNA, 23 nt, Human
ccauacacauuuggcucaggguu

SEQ ID NO: 366591 - RNA, 32 nt, Human
ccauacaccagagacacacuggcagguuaggc

SEQ ID NO: 366592 - RNA, 32 nt, Human
ccauacaccauguuguauuauaagagccauuu

SEQ ID NO: 366593 - RNA, 32 nt, Human
ccauacaccggcugccggggacugccucgacu

SEQ ID NO: 366594 - RNA, 32 nt, Human
ccauacagaauuagcagagaaaauacacacag

SEQ ID NO: 366595 - RNA, 32 nt, Human
ccauacagccugguggucuagauguguuugga

SEQ ID NO: 366596 - RNA, 32 nt, Human
ccauacagcuugagccagugaggcagauuggg

SEQ ID NO: 366597 - RNA, 32 nt, Human
ccauacaggagauuguggccacugugacucuc

SEQ ID NO: 366598 - RNA, 32 nt, Human
ccauacaggcaacuuagcuggugaaaggacuc

SEQ ID NO: 366599 - RNA, 19 nt, Human
ccauacaugagacugcaga

SEQ ID NO: 366600 - RNA, 32 nt, Human
ccauacaugguggcugacgccuguaaucccag

SEQ ID NO: 366601 - RNA, 32 nt, Human
ccauaccacugcauuccagccugggugacaga

SEQ ID NO: 366602 - RNA, 32 nt, Human
ccauaccagugcauuccagccuggguacacag

SEQ ID NO: 366603 - RNA, 32 nt, Human
ccauacccaaauacacagcaaugaauggcaca

SEQ ID NO: 366604 - RNA, 32 nt, Human
ccauacccaagaaauagcuagcaucaagaaug

SEQ ID NO: 366605 - RNA, 32 nt, Human
ccauacccacaguaagcauccauuccauugau

SEQ ID NO: 366606 - RNA, 32 nt, Human
ccauacccauuucuuucuuuccuuccuuccuu

SEQ ID NO: 366607 - RNA, 32 nt, Human
ccauaccccuggcuucuccuugcaccuucauu

SEQ ID NO: 366608 - RNA, 32 nt, Human
ccauaccgccugcaaggcagagaggacacagg

SEQ ID NO: 366609 - RNA, 32 nt, Human
ccauaccuagcuaauuuuuccucuuuuuagua

SEQ ID NO: 366610 - RNA, 32 nt, Human
ccauaccuccacugcugaaguuccuccagccc

SEQ ID NO: 366611 - RNA, 32 nt, Human
ccauaccuccuccccuccaccccacacccugu

SEQ ID NO: 366612 - RNA, 32 nt, Human
ccauaccucugccuccccaaaaagcuccuauu

SEQ ID NO: 366613 - RNA, 32 nt, Human
ccauaccugccuagcccuuuggcuccauccug

SEQ ID NO: 366614 - RNA, 21 nt, Human
ccauaccuggugagucuggaa

SEQ ID NO: 366615 - RNA, 32 nt, Human
ccauacgaggcaggguuuccugguuugugaga

SEQ ID NO: 366616 - RNA, 32 nt, Human
ccauacgcaggugggagggaggaacaccggug

SEQ ID NO: 366617 - RNA, 32 nt, Human
ccauacgccaugccauagcuugugcuaucugu

SEQ ID NO: 366618 - RNA, 32 nt, Human
ccauacgcuccaaaagauggcugugauagauc

SEQ ID NO: 366619 - RNA, 32 nt, Human
ccauacgcugcccucgcagccuggcggccucc

SEQ ID NO: 366620 - RNA, 32 nt, Human
ccauacuacuagggaguaacuguagagugaga

SEQ ID NO: 366621 - RNA, 32 nt, Human
ccauacucagccacacauucucacaacaaucu

SEQ ID NO: 366622 - RNA, 32 nt, Human
ccauacuccucaggguucugagguccuuguau

SEQ ID NO: 366623 - RNA, 32 nt, Human
ccauacuccuuuccuuuuccuccuauugaaac

SEQ ID NO: 366624 - RNA, 32 nt, Human
ccauacucuguuccagcuggaguagccuccug

SEQ ID NO: 366625 - RNA, 32 nt, Human
ccauacucuuauguaccagcacuucugaugga

SEQ ID NO: 366626 - RNA, 32 nt, Human
ccauacucuuuccccucuauuucuuuguauga

SEQ ID NO: 366627 - RNA, 32 nt, Human
ccauacugucgguggagaagaggcucaacuuc

SEQ ID NO: 366628 - RNA, 23 nt, Human
ccauacuguucuggugguaguga

SEQ ID NO: 366629 - RNA, 32 nt, Human
ccauacuuagggaggcagacgucaaaggcaag

SEQ ID NO: 366630 - RNA, 32 nt, Human
ccauacuuguaaucccagcuauugggaaggau

SEQ ID NO: 366631 - RNA, 32 nt, Human
ccauagaacucauauugacacucagcuguuuu

SEQ ID NO: 366632 - RNA, 32 nt, Human
ccauagaaguagugacuaaggagcuucugaag

SEQ ID NO: 366633 - RNA, 32 nt, Human
ccauagagacaccucacaagguucccauuuuu

SEQ ID NO: 366634 - RNA, 32 nt, Human
ccauagagacugucaacguuguccucaugaca

SEQ ID NO: 366635 - RNA, 32 nt, Human
ccauagagaggaggagaagaaacuaaccaaca

SEQ ID NO: 366636 - RNA, 32 nt, Human
ccauagagccgucuccagagcugccggugccu

SEQ ID NO: 366637 - RNA, 32 nt, Human
ccauagaggagaagcuaaagagggagggggcc

SEQ ID NO: 366638 - RNA, 32 nt, Human
ccauagaggagagaggucuugaggggugggag

SEQ ID NO: 366639 - RNA, 32 nt, Human
ccauagaggccccacaggacagcaaccagaaa

SEQ ID NO: 366640 - RNA, 32 nt, Human
ccauagaguauuagcuacagaaaccuuuccau

SEQ ID NO: 366641 - RNA, 32 nt, Human
ccauagagucucacugauucugagauggcuuu

SEQ ID NO: 366642 - RNA, 32 nt, Human
ccauagaucucaguuugaucaaaaagaaggcu

SEQ ID NO: 366643 - RNA, 32 nt, Human
ccauagaucuggaucuggcccugcugcuucuc

SEQ ID NO: 366644 - RNA, 32 nt, Human
ccauagauuuuguauacguugugcacaaaauc

SEQ ID NO: 366645 - RNA, 32 nt, Human
ccauagcaaccagcaacuccaggguaccacaa

SEQ ID NO: 366646 - RNA, 32 nt, Human
ccauagcagcuuugucucugucacaucagcaa

SEQ ID NO: 366647 - RNA, 32 nt, Human
ccauagcaugccugccccaucuugccuguagc

SEQ ID NO: 366648 - RNA, 32 nt, Human
ccauagccacugcccccuccccuggaugccca

SEQ ID NO: 366649 - RNA, 32 nt, Human
ccauagccaguuuccagaugggccacagacug

SEQ ID NO: 366650 - RNA, 32 nt, Human
ccauagcccaccagcaucccagagcugccucu

SEQ ID NO: 366651 - RNA, 22 nt, Human
ccauagcccacugcagccucca

SEQ ID NO: 366652 - RNA, 32 nt, Human
ccauagcccacugcagccuccaccucccaggc

SEQ ID NO: 366653 - RNA, 22 nt, Human
ccauagcccauuaguggaagga

SEQ ID NO: 366654 - RNA, 19 nt, Human
ccauagccccuccuggaga

SEQ ID NO: 366655 - RNA, 20 nt, Human
ccauagccuaccagccugcc

SEQ ID NO: 366656 - RNA, 32 nt, Human
ccauagccucuggaacugugcguucugcauag

SEQ ID NO: 366657 - RNA, 32 nt, Human
ccauagcgcugaggcccuggccccgccuccag

SEQ ID NO: 366658 - RNA, 32 nt, Human
ccauagcggagaacuccugacgcccagcccug

SEQ ID NO: 366659 - RNA, 32 nt, Human
ccauagcucacugcagcaucaaauuccuaggc

SEQ ID NO: 366660 - RNA, 21 nt, Human
ccauagcugggacuacaggcg

SEQ ID NO: 366661 - RNA, 32 nt, Human
ccauagcugguggucaagaugagggagaggcc

SEQ ID NO: 366662 - RNA, 32 nt, Human
ccauagcuguaaaccucugcuuggcccagcag

SEQ ID NO: 366663 - RNA, 32 nt, Human
ccauaggaagccuuccuuucuggccaaggugg

SEQ ID NO: 366664 - RNA, 22 nt, Human
ccauaggaauaaccacaaccca

SEQ ID NO: 366665 - RNA, 32 nt, Human
ccauaggacauuucacacaguccuuagaaccc

SEQ ID NO: 366666 - RNA, 32 nt, Human
ccauaggacuuaaaggugauuuggaugcguug

SEQ ID NO: 366667 - RNA, 32 nt, Human
ccauaggagagcugggggcaggagaauggggu

SEQ ID NO: 366668 - RNA, 32 nt, Human
ccauaggaggauggacagggagucggggagau

SEQ ID NO: 366669 - RNA, 21 nt, Human
ccauaggcacagcacauccca

SEQ ID NO: 366670 - RNA, 32 nt, Human
ccauaggcagaggcaggccuuccuacacccua

SEQ ID NO: 366671 - RNA, 32 nt, Human
ccauaggcauuuuccagaauuccucaugucac

SEQ ID NO: 366672 - RNA, 32 nt, Human
ccauaggcugagaugaggcacagggucugguu

SEQ ID NO: 366673 - RNA, 32 nt, Human
ccauaggcuuguucacaugcacgcagccaguu

SEQ ID NO: 366674 - RNA, 20 nt, Human
ccauagggagagcccuccaa

SEQ ID NO: 366675 - RNA, 32 nt, Human
ccauagggcuuccauggguggaaacuugugag

SEQ ID NO: 366676 - RNA, 32 nt, Human
ccauaggguaacugugguuaccgaggcaauac

SEQ ID NO: 366677 - RNA, 22 nt, Human
ccauagggugaauaaaggaaug

SEQ ID NO: 366678 - RNA, 32 nt, Human
ccauagguagugcuggcuccaggugaagacuu

SEQ ID NO: 366679 - RNA, 32 nt, Human
ccauagguuuugcauaauguguuuccauuuuc

SEQ ID NO: 366680 - RNA, 32 nt, Human
ccauaguaaagaaaaugacagaucguggucag

SEQ ID NO: 366681 - RNA, 24 nt, Human
ccauagucaccaaauucuguuuua

SEQ ID NO: 366682 - RNA, 32 nt, Human
ccauagucccucaauaagauucagaggaagaa

SEQ ID NO: 366683 - RNA, 32 nt, Human
ccauaguccuguaauucauuuugcuuaaacga

SEQ ID NO: 366684 - RNA, 32 nt, Human
ccauagucucuuauucacccuggaccaacagg

SEQ ID NO: 366685 - RNA, 32 nt, Human
ccauagucuggcugcauuacuggucauuugac

SEQ ID NO: 366686 - RNA, 32 nt, Human
ccauagucuuagcuacucaggaggcugaggag

SEQ ID NO: 366687 - RNA, 31 nt, Human
ccauagugacuucuccaccaagcuggagaag

SEQ ID NO: 366688 - RNA, 22 nt, Human
ccauagugcuagaauuacaggc

SEQ ID NO: 366689 - RNA, 24 nt, Human
ccauagugcugggauuacaggugu

SEQ ID NO: 366690 - RNA, 31 nt, Human
ccauaguggaggcugggaugggugagagaau

SEQ ID NO: 366691 - RNA, 24 nt, Human
ccauaguggcucgugccuguaauc

SEQ ID NO: 366692 - RNA, 32 nt, Human
ccauaguggcugucaucccagcacuuuaggag

SEQ ID NO: 366693 - RNA, 32 nt, Human
ccauagugggcucuggcuuuucuugaauagau

SEQ ID NO: 366694 - RNA, 32 nt, Human
ccauaguuacagccacuacauccccaccgccg

SEQ ID NO: 366695 - RNA, 32 nt, Human
ccauaguucuccaacagagaaaucuugaaaag

SEQ ID NO: 366696 - RNA, 32 nt, Human
ccauaguucugccuccccagcuucuccucccc

SEQ ID NO: 366697 - RNA, 32 nt, Human
ccauaguuucuggggagggguggagaacucac

SEQ ID NO: 366698 - RNA, 32 nt, Human
ccauauaaaaugguauuugaaagugagaguuc

SEQ ID NO: 366699 - RNA, 32 nt, Human
ccauauaaagaaauguguuauguauguugugc

SEQ ID NO: 366700 - RNA, 32 nt, Human
ccauauacaaucuuccuuccuuagguaauuug

SEQ ID NO: 366701 - RNA, 20 nt, Human
ccauauacuaacauccccca

SEQ ID NO: 366702 - RNA, 32 nt, Human
ccauauacugugcugguugaggccaaagguua

SEQ ID NO: 366703 - RNA, 32 nt, Human
ccauaucaaauuccucagcuuuguucugugcc

SEQ ID NO: 366704 - RNA, 32 nt, Human
ccauaucacaccaccaaaggcuuuuggaccau

SEQ ID NO: 366705 - RNA, 32 nt, Human
ccauaucacugaggguacaggucuucacagaa

SEQ ID NO: 366706 - RNA, 32 nt, Human
ccauaucagaagaugaugaauugugucaggac

SEQ ID NO: 366707 - RNA, 32 nt, Human
ccauaucaggcuaugaaaugaagagaaaauga

SEQ ID NO: 366708 - RNA, 20 nt, Human
ccauaucaguaacuucgagu

SEQ ID NO: 366709 - RNA, 32 nt, Human
ccauaucaucaaggagcugauaaucuagugga

SEQ ID NO: 366710 - RNA, 32 nt, Human
ccauauccacagguuucacaccugcaaccaaa

SEQ ID NO: 366711 - RNA, 32 nt, Human
ccauauccaucuuucacaucaaugucuguccu

SEQ ID NO: 366712 - RNA, 32 nt, Human
ccauauccccagugcugggauggcacacaggu

SEQ ID NO: 366713 - RNA, 32 nt, Human
ccauauccuacagauccucccauuucuaggga

SEQ ID NO: 366714 - RNA, 32 nt, Human
ccauauccugccaugugagcucagggaaugca

SEQ ID NO: 366715 - RNA, 20 nt, Human
ccauauccugguccuuggca

SEQ ID NO: 366716 - RNA, 32 nt, Human
ccauaucucauuccgccccagcuacugaggga

SEQ ID NO: 366717 - RNA, 31 nt, Human
ccauaucuggguggagaaugggugaaaagua

SEQ ID NO: 366718 - RNA, 32 nt, Human
ccauaucuggguggagaaugggugaaaaguac

SEQ ID NO: 366719 - RNA, 32 nt, Human
ccauaucuucuccagaaggcaaauacuuuugu

SEQ ID NO: 366720 - RNA, 32 nt, Human
ccauaucuuggcuauugugaauaauccugcag

SEQ ID NO: 366721 - RNA, 32 nt, Human
ccauaugaaggagcaggaggagaggaagaaac

SEQ ID NO: 366722 - RNA, 32 nt, Human
ccauaugacaauuucaaaaugcaugugauugg

SEQ ID NO: 366723 - RNA, 32 nt, Human
ccauaugccacucuguaccccaaagagaguuc

SEQ ID NO: 366724 - RNA, 23 nt, Human
ccauaugccuccccuggccccca

SEQ ID NO: 366725 - RNA, 21 nt, Human
ccauauggaauagggauccac

SEQ ID NO: 366726 - RNA, 32 nt, Human
ccauauggaguacugaucagcccacacuugcc

SEQ ID NO: 366727 - RNA, 29 nt, Human
ccauaugggggcugcugaaaaguugguau

SEQ ID NO: 366728 - RNA, 32 nt, Human
ccauaugguaugcacauguagccaauauuggu

SEQ ID NO: 366729 - RNA, 32 nt, Human
ccauauggucucaagaugucaaagcaaaacaa

SEQ ID NO: 366730 - RNA, 32 nt, Human
ccauauguaaauaccaccuugcauuucauugu

SEQ ID NO: 366731 - RNA, 21 nt, Human
ccauauguaccccauccccca

SEQ ID NO: 366732 - RNA, 32 nt, Human
ccauaugugucuguaagagagacagagaccaa

SEQ ID NO: 366733 - RNA, 32 nt, Human
ccauauguugcccaggcuggucucgaacuccu

SEQ ID NO: 366734 - RNA, 32 nt, Human
ccauauguuuuacgguuaucugugcuauaaac

SEQ ID NO: 366735 - RNA, 23 nt, Human
ccauauuagccuggcuggucuca

SEQ ID NO: 366736 - RNA, 32 nt, Human
ccauauuagcuuccagagggugagugagggac

SEQ ID NO: 366737 - RNA, 23 nt, Human
ccauauuaggaaaaggccugcca

SEQ ID NO: 366738 - RNA, 32 nt, Human
ccauauucuuugcuccucucugcuccaauacc

SEQ ID NO: 366739 - RNA, 32 nt, Human
ccauauugacaaaugagggaacaggugguguc

SEQ ID NO: 366740 - RNA, 32 nt, Human
ccauauugcccaggcuggucucgaaugccugg

SEQ ID NO: 366741 - RNA, 23 nt, Human
ccauauugcccaggcuggucuua

SEQ ID NO: 366742 - RNA, 23 nt, Human
ccauauugcccaggguggucuca

SEQ ID NO: 366743 - RNA, 23 nt, Human
ccauauuggccaggcuggucuca

SEQ ID NO: 366744 - RNA, 32 nt, Human
ccauauuucugggcagagauuuacauugggcc

SEQ ID NO: 366745 - RNA, 32 nt, Human
ccauauuucuucuuccccuuuuagguaaacuu

SEQ ID NO: 366746 - RNA, 32 nt, Human
ccauauuuguucugcauucccugccacaagga

SEQ ID NO: 366747 - RNA, 32 nt, Human
ccauauuuuaucaauuuuaagaccaugaguug

SEQ ID NO: 366748 - RNA, 32 nt, Human
ccauauuuuguaggggaaauagaacacccuac

SEQ ID NO: 366749 - RNA, 32 nt, Human
ccauauuuugugaagaaagugcaugcaggaau

SEQ ID NO: 366750 - RNA, 32 nt, Human
ccaucaaaagugaaaguggcuucuagguacug

SEQ ID NO: 366751 - RNA, 32 nt, Human
ccaucaaaguuacuuccagccuggagagaacc

SEQ ID NO: 366752 - RNA, 32 nt, Human
ccaucaacauuacuuuucuuucuuaaggcaag

SEQ ID NO: 366753 - RNA, 32 nt, Human
ccaucaaccuauauugaaugucauauguccag

SEQ ID NO: 366754 - RNA, 32 nt, Human
ccaucaacuucaccaugagucaaacaaggaag

SEQ ID NO: 366755 - RNA, 32 nt, Human
ccaucaagaaggacuggaaggacuggcccagc

SEQ ID NO: 366756 - RNA, 24 nt, Human
ccaucaaggacaaggaggaaccuc

SEQ ID NO: 366757 - RNA, 32 nt, Human
ccaucaaggcgggagggccugcagugauucag

SEQ ID NO: 366758 - RNA, 32 nt, Human
ccaucaaguggacuggggcagugcaguagcac

SEQ ID NO: 366759 - RNA, 19 nt, Human
ccaucaauuuucuauccuu

SEQ ID NO: 366760 - RNA, 32 nt, Human
ccaucacaaaggaaccgcccagggagaagcag

SEQ ID NO: 366761 - RNA, 32 nt, Human
ccaucacaccugagaugucagacaugggaagu

SEQ ID NO: 366762 - RNA, 32 nt, Human
ccaucacagacuccccugacaaccuuuccugg

SEQ ID NO: 366763 - RNA, 32 nt, Human
ccaucacagagcaguccuugcaggugccuuuc

SEQ ID NO: 366764 - RNA, 32 nt, Human
ccaucacagcacacgcuguccugcauugcagc

SEQ ID NO: 366765 - RNA, 32 nt, Human
ccaucacagccaugcugacugagugacuggag

SEQ ID NO: 366766 - RNA, 32 nt, Human
ccaucacaguccugcccuucacccucaagcac

SEQ ID NO: 366767 - RNA, 32 nt, Human
ccaucacaugaccacauagcaugaggccacug

SEQ ID NO: 366768 - RNA, 32 nt, Human
ccaucaccaagaggagguucagggaagcugca

SEQ ID NO: 366769 - RNA, 32 nt, Human
ccaucaccaccaccaucaccaccaccaccagu

SEQ ID NO: 366770 - RNA, 32 nt, Human
ccaucaccagaggaagagagcuuggcaggaaa

SEQ ID NO: 366771 - RNA, 23 nt, Human
ccaucaccaucacccacugcuca

SEQ ID NO: 366772 - RNA, 32 nt, Human
ccaucaccaucccacugacucugugagaacau

SEQ ID NO: 366773 - RNA, 32 nt, Human
ccaucacccaggcuggaguccaguggugugau

SEQ ID NO: 366774 - RNA, 20 nt, Human
ccaucacccaggugcucagu

SEQ ID NO: 366775 - RNA, 32 nt, Human
ccaucaccccagacccaugcaggaagagccag

SEQ ID NO: 366776 - RNA, 32 nt, Human
ccaucaccccggcuaauucuguauuuuuagua

SEQ ID NO: 366777 - RNA, 32 nt, Human
ccaucaccccuggcuauuuuuguauuuuuagu

SEQ ID NO: 366778 - RNA, 32 nt, Human
ccaucacccucagcuacuaguggcuuugcuuu

SEQ ID NO: 366779 - RNA, 32 nt, Human
ccaucaccucaacuccagccagggaggaauag

SEQ ID NO: 366780 - RNA, 32 nt, Human
ccaucaccuccaguuuggcuucugagcagaga

SEQ ID NO: 366781 - RNA, 32 nt, Human
ccaucaccuccccuuggccccucccucuucau

SEQ ID NO: 366782 - RNA, 32 nt, Human
ccaucaccugcucugcucuuacaaggaucagu

SEQ ID NO: 366783 - RNA, 32 nt, Human
ccaucaccugcucugcucuuacaaggauccga

SEQ ID NO: 366784 - RNA, 32 nt, Human
ccaucaccugcucugcucuuauaaggaucugg

SEQ ID NO: 366785 - RNA, 17 nt, Human
ccaucaccuuguccccu

SEQ ID NO: 366786 - RNA, 32 nt, Human
ccaucacgccucgcucccuccuggcccucugg

SEQ ID NO: 366787 - RNA, 20 nt, Human
ccaucacuaccaaccagggu

SEQ ID NO: 366788 - RNA, 32 nt, Human
ccaucacuacuaaacauacaaaauuagccggg

SEQ ID NO: 366789 - RNA, 19 nt, Human
ccaucacuacuuuucagaa

SEQ ID NO: 366790 - RNA, 32 nt, Human
ccaucacucaggcuggaguacagugcugagau

SEQ ID NO: 366791 - RNA, 16 nt, Human
ccaucacucuaccucu

SEQ ID NO: 366792 - RNA, 32 nt, Human
ccaucacucucauccuguauuuuuauaagaaa

SEQ ID NO: 366793 - RNA, 32 nt, Human
ccaucacucucuuccuccucuagacucugugu

SEQ ID NO: 366794 - RNA, 32 nt, Human
ccaucacucugccucccucccaccucuugucc

SEQ ID NO: 366795 - RNA, 32 nt, Human
ccaucacugagcuccacuccuuccucauuuug

SEQ ID NO: 366796 - RNA, 32 nt, Human
ccaucacugauauuaaaaggcuugaucaugau

SEQ ID NO: 366797 - RNA, 22 nt, Human
ccaucacugccaacugcagggg

SEQ ID NO: 366798 - RNA, 19 nt, Human
ccaucacugccuucuugaa

SEQ ID NO: 366799 - RNA, 32 nt, Human
ccaucacugcgccacugcuccguggaggaggu

SEQ ID NO: 366800 - RNA, 22 nt, Human
ccaucacugcuggcagccuggg

SEQ ID NO: 366801 - RNA, 32 nt, Human
ccaucacugcugucccuccugaggucuggauu

SEQ ID NO: 366802 - RNA, 19 nt, Human
ccaucacugcuguuccucc

SEQ ID NO: 366803 - RNA, 32 nt, Human
ccaucacuggacugcuggacaggcucagugga

SEQ ID NO: 366804 - RNA, 32 nt, Human
ccaucacuggagguauuccagcagagucuagg

SEQ ID NO: 366805 - RNA, 32 nt, Human
ccaucacugugacaucugccugggcuugagug

SEQ ID NO: 366806 - RNA, 32 nt, Human
ccaucacuguucuggcaccggagaaaggauuc

SEQ ID NO: 366807 - RNA, 17 nt, Human
ccaucacuugcccagag

SEQ ID NO: 366808 - RNA, 18 nt, Human
ccaucacuugccuuggua

SEQ ID NO: 366809 - RNA, 32 nt, Human
ccaucacuuugagaggccaggaguuugagacc

SEQ ID NO: 366810 - RNA, 32 nt, Human
ccaucagaaaggaccuaugaauuuguacuuuu

SEQ ID NO: 366811 - RNA, 32 nt, Human
ccaucagaacaagggcuaaggguuuauggguc

SEQ ID NO: 366812 - RNA, 32 nt, Human
ccaucagaacagcuccaccgggacuugugggc

SEQ ID NO: 366813 - RNA, 32 nt, Human
ccaucagaaggagaaggaaggagacucaccuc

SEQ ID NO: 366814 - RNA, 32 nt, Human
ccaucagaaggugaguacaccaggugggcagg

SEQ ID NO: 366815 - RNA, 32 nt, Human
ccaucagaauugcuucucagcacuuuggguaa

SEQ ID NO: 366816 - RNA, 32 nt, Human
ccaucagacagggucuggaguggggcugccgu

SEQ ID NO: 366817 - RNA, 32 nt, Human
ccaucagacgcugcuuucuccucccagagacc

SEQ ID NO: 366818 - RNA, 32 nt, Human
ccaucagagagcaaaccacauguucugucuug

SEQ ID NO: 366819 - RNA, 32 nt, Human
ccaucagagaugacauucuaugugauauuuuu

SEQ ID NO: 366820 - RNA, 32 nt, Human
ccaucagagauucuaggagagcugucgacaac

SEQ ID NO: 366821 - RNA, 32 nt, Human
ccaucagagcaguggcuggggcacuggaagua

SEQ ID NO: 366822 - RNA, 32 nt, Human
ccaucagaggacaccuguacuggagagcaaca

SEQ ID NO: 366823 - RNA, 32 nt, Human
ccaucagaucaaaggagggagagcuguuuugg

SEQ ID NO: 366824 - RNA, 32 nt, Human
ccaucagcaagaaccugaguuugaagugacaa

SEQ ID NO: 366825 - RNA, 23 nt, Human
ccaucagcaccaggccacuggca

SEQ ID NO: 366826 - RNA, 32 nt, Human
ccaucagcaggccuuaccugcacuccaggcuc

SEQ ID NO: 366827 - RNA, 21 nt, Human
ccaucagccagcaaccuuaga

SEQ ID NO: 366828 - RNA, 32 nt, Human
ccaucagccaggcuggagugcaguggugcaau

SEQ ID NO: 366829 - RNA, 20 nt, Human
ccaucagccaugugcugcua

SEQ ID NO: 366830 - RNA, 32 nt, Human
ccaucagccccaaacuccugucucacuuccag

SEQ ID NO: 366831 - RNA, 19 nt, Human
ccaucagcccgccaggguc

SEQ ID NO: 366832 - RNA, 32 nt, Human
ccaucagcccugcccagaugucagccugggag

SEQ ID NO: 366833 - RNA, 32 nt, Human
ccaucagccucaccagcaaagcagagaugaga

SEQ ID NO: 366834 - RNA, 24 nt, Human
ccaucagcgcggccaggggcccag

SEQ ID NO: 366835 - RNA, 32 nt, Human
ccaucagcuaaaagagguagauagcagugguu

SEQ ID NO: 366836 - RNA, 21 nt, Human
ccaucagcuaaacuuuacaga

SEQ ID NO: 366837 - RNA, 32 nt, Human
ccaucagcucacugugguucuugcuuugggug

SEQ ID NO: 366838 - RNA, 32 nt, Human
ccaucagcuccagacuuccugggacaucucgg

SEQ ID NO: 366839 - RNA, 24 nt, Human
ccaucagcugaagcacucuucaga

SEQ ID NO: 366840 - RNA, 32 nt, Human
ccaucaggaaccaagcaaaggccagauagccu

SEQ ID NO: 366841 - RNA, 32 nt, Human
ccaucaggcaugcucucccccaccucugucca

SEQ ID NO: 366842 - RNA, 32 nt, Human
ccaucaggccuaugucaacaagacauaauccg

SEQ ID NO: 366843 - RNA, 32 nt, Human
ccaucaggccuggccucaguggccagccacau

SEQ ID NO: 366844 - RNA, 32 nt, Human
ccaucagggacaggaugaccuggagaacuuag

SEQ ID NO: 366845 - RNA, 32 nt, Human
ccaucagggccucccuugcccgccugagagca

SEQ ID NO: 366846 - RNA, 32 nt, Human
ccaucagggguagcgagguugcaggagcuggc

SEQ ID NO: 366847 - RNA, 32 nt, Human
ccaucaguagagacauugcuguuccugcccau

SEQ ID NO: 366848 - RNA, 32 nt, Human
ccaucaguccauuccaguuggcaccagccuga

SEQ ID NO: 366849 - RNA, 32 nt, Human
ccaucagugccccgucuacagcucccccagcu

SEQ ID NO: 366850 - RNA, 32 nt, Human
ccaucaguggcugaggccagagacccacacca

SEQ ID NO: 366851 - RNA, 32 nt, Human
ccaucaguggugcuggcugcuguugggagcuc

SEQ ID NO: 366852 - RNA, 22 nt, Human
ccaucagugucaucaccaaagc

SEQ ID NO: 366853 - RNA, 23 nt, Human
ccaucagugucccuagggacagg

SEQ ID NO: 366854 - RNA, 32 nt, Human
ccaucaguuagagcaagaaacagggauccgaa

SEQ ID NO: 366855 - RNA, 32 nt, Human
ccaucaguucuuccuuucuuuuuccucucuaa

SEQ ID NO: 366856 - RNA, 32 nt, Human
ccaucaguuuuccucccucucagaccugucuu

SEQ ID NO: 366857 - RNA, 32 nt, Human
ccaucauaaagcagagacuuacaugagugaaa

SEQ ID NO: 366858 - RNA, 32 nt, Human
ccaucauaggcuucauaguggagagaaaccuu

SEQ ID NO: 366859 - RNA, 16 nt, Human
ccaucaucacccagaa

SEQ ID NO: 366860 - RNA, 32 nt, Human
ccaucauccaggcugcagugcagcagcgccau

SEQ ID NO: 366861 - RNA, 32 nt, Human
ccaucaucccagccccacgagaucuuacccgc

SEQ ID NO: 366862 - RNA, 32 nt, Human
ccaucaucccccaagagccaucaucuuaggag

SEQ ID NO: 366863 - RNA, 20 nt, Human
ccaucauccucuggcuuggc

SEQ ID NO: 366864 - RNA, 32 nt, Human
ccaucauccugacugccagcagucuggccaga

SEQ ID NO: 366865 - RNA, 32 nt, Human
ccaucauccuucaacagccacagucugaauug

SEQ ID NO: 366866 - RNA, 32 nt, Human
ccaucaucuccugccuuccuccugggcccucu

SEQ ID NO: 366867 - RNA, 32 nt, Human
ccaucaugccugacuaauuuuguauuuuuagu

SEQ ID NO: 366868 - RNA, 32 nt, Human
ccaucaugcugagggagcagauucuucccaag

SEQ ID NO: 366869 - RNA, 30 nt, Human
ccaucaugcugcugccuguguucacccuga

SEQ ID NO: 366870 - RNA, 32 nt, Human
ccaucauggagcagaggugaggagaggcagcc

SEQ ID NO: 366871 - RNA, 32 nt, Human
ccaucaugggagacauccagauggcacaccag

SEQ ID NO: 366872 - RNA, 20 nt, Human
ccaucauggugaaacccugu

SEQ ID NO: 366873 - RNA, 32 nt, Human
ccaucaugucucaaacuuggacccacgaacac

SEQ ID NO: 366874 - RNA, 32 nt, Human
ccaucauguguuucacaccacaauucugugcc

SEQ ID NO: 366875 - RNA, 20 nt, Human
ccaucauguuuauucauccu

SEQ ID NO: 366876 - RNA, 19 nt, Human
ccaucauuaacaccaagaa

SEQ ID NO: 366877 - RNA, 32 nt, Human
ccaucauuagcuuccuccugggucauuuacag

SEQ ID NO: 366878 - RNA, 32 nt, Human
ccaucauucaucccuuaacaggcacauuagau

SEQ ID NO: 366879 - RNA, 32 nt, Human
ccaucauucugucuguccacacgggcaucauu

SEQ ID NO: 366880 - RNA, 32 nt, Human
ccaucauucuguguggaggugaguggaguggg

SEQ ID NO: 366881 - RNA, 32 nt, Human
ccaucauuucacuaaagcggaaugaggaugcc

SEQ ID NO: 366882 - RNA, 18 nt, Human
ccauccaaacauccaucc

SEQ ID NO: 366883 - RNA, 32 nt, Human
ccauccaaacuaagauaugcagagagaugcug

SEQ ID NO: 366884 - RNA, 32 nt, Human
ccauccacaagaacuuuccuccaagugaggcc

SEQ ID NO: 366885 - RNA, 32 nt, Human
ccauccacacagaagccugaggaaaagggcuc

SEQ ID NO: 366886 - RNA, 32 nt, Human
ccauccacagccaugaauuuccuccggcgacg

SEQ ID NO: 366887 - RNA, 32 nt, Human
ccauccacaucagggagcuuuccccaggcaaa

SEQ ID NO: 366888 - RNA, 21 nt, Human
ccauccaccaaggcuccaucc

SEQ ID NO: 366889 - RNA, 18 nt, Human
ccauccaccaccccgugc

SEQ ID NO: 366890 - RNA, 32 nt, Human
ccauccacccaccuuucccucauucccucucu

SEQ ID NO: 366891 - RNA, 32 nt, Human
ccauccacccgcuucagggaggaacuggacuc

SEQ ID NO: 366892 - RNA, 19 nt, Human
ccauccacccuuccguccu

SEQ ID NO: 366893 - RNA, 32 nt, Human
ccauccacuucucucuccuucucccucuguca

SEQ ID NO: 366894 - RNA, 23 nt, Human
ccauccagaaaauuacaacucca

SEQ ID NO: 366895 - RNA, 32 nt, Human
ccauccagagugagugccuggggcagagugag

SEQ ID NO: 366896 - RNA, 21 nt, Human
ccauccagauaacuccauccu

SEQ ID NO: 366897 - RNA, 20 nt, Human
ccauccagaucccccuuccc

SEQ ID NO: 366898 - RNA, 32 nt, Human
ccauccagccaaagaccugucauuucaaccuc

SEQ ID NO: 366899 - RNA, 32 nt, Human
ccauccagccugggugacagggcgagacucug

SEQ ID NO: 366900 - RNA, 32 nt, Human
ccauccagccugggugacagggugagacucug

SEQ ID NO: 366901 - RNA, 32 nt, Human
ccauccagcuucuagccucccuucucuggaau

SEQ ID NO: 366902 - RNA, 21 nt, Human
ccauccaggaauggaguccau

SEQ ID NO: 366903 - RNA, 32 nt, Human
ccauccaggaaugggagcccggaguagacuga

SEQ ID NO: 366904 - RNA, 26 nt, Human
ccauccaggagcucucacggccccau

SEQ ID NO: 366905 - RNA, 32 nt, Human
ccauccaggccugcuguuccaaacuuuuucag

SEQ ID NO: 366906 - RNA, 32 nt, Human
ccauccaggggcaguggcaacagggagauucc

SEQ ID NO: 366907 - RNA, 32 nt, Human
ccauccaguacauucuuucuucuuucaugaaa

SEQ ID NO: 366908 - RNA, 32 nt, Human
ccauccaguagaggagaaagacgucgagacag

SEQ ID NO: 366909 - RNA, 32 nt, Human
ccauccagugccuguccucgccacagggccuc

SEQ ID NO: 366910 - RNA, 22 nt, Human
ccauccaguuuucccgugcuga

SEQ ID NO: 366911 - RNA, 32 nt, Human
ccauccauaacuuggaauacugcucuggaaug

SEQ ID NO: 366912 - RNA, 32 nt, Human
ccauccauacaguguggagagcagaggagugg

SEQ ID NO: 366913 - RNA, 19 nt, Human
ccauccauacuggcauccu

SEQ ID NO: 366914 - RNA, 19 nt, Human
ccauccauaguccaucucc

SEQ ID NO: 366915 - RNA, 18 nt, Human
ccauccaucaaguccauc

SEQ ID NO: 366916 - RNA, 17 nt, Human
ccauccaucacccaucu

SEQ ID NO: 366917 - RNA, 17 nt, Human
ccauccaucagcucccu

SEQ ID NO: 366918 - RNA, 32 nt, Human
ccauccaucauaaccaccccagccugggaagg

SEQ ID NO: 366919 - RNA, 17 nt, Human
ccauccaucaucuaccc

SEQ ID NO: 366920 - RNA, 18 nt, Human
ccauccauccaaacaucc

SEQ ID NO: 366921 - RNA, 20 nt, Human
ccauccauccacacauaucc

SEQ ID NO: 366922 - RNA, 20 nt, Human
ccauccauccagacagcccu

SEQ ID NO: 366923 - RNA, 18 nt, Human
ccauccauccaggcaccc

SEQ ID NO: 366924 - RNA, 20 nt, Human
ccauccauccauccacucuu

SEQ ID NO: 366925 - RNA, 18 nt, Human
ccauccauccauccaucc

SEQ ID NO: 366926 - RNA, 18 nt, Human
ccauccauccauccgucc

SEQ ID NO: 366927 - RNA, 32 nt, Human
ccauccauccaugaccagaggauuauuuuccu

SEQ ID NO: 366928 - RNA, 20 nt, Human
ccauccauccaugccauacc

SEQ ID NO: 366929 - RNA, 32 nt, Human
ccauccauccaugccauaccacuugucagggc

SEQ ID NO: 366930 - RNA, 19 nt, Human
ccauccauccauuacucuu

SEQ ID NO: 366931 - RNA, 19 nt, Human
ccauccaucccacccuccu

SEQ ID NO: 366932 - RNA, 19 nt, Human
ccauccaucccaugccucc

SEQ ID NO: 366933 - RNA, 18 nt, Human
ccauccaucccccucuuu

SEQ ID NO: 366934 - RNA, 16 nt, Human
ccauccaucccuauuc

SEQ ID NO: 366935 - RNA, 18 nt, Human
ccauccauccgauccucc

SEQ ID NO: 366936 - RNA, 19 nt, Human
ccauccauccguccaccuu

SEQ ID NO: 366937 - RNA, 18 nt, Human
ccauccauccuccuaccu

SEQ ID NO: 366938 - RNA, 16 nt, Human
ccauccauccucuucc

SEQ ID NO: 366939 - RNA, 18 nt, Human
ccauccaucuccgucucc

SEQ ID NO: 366940 - RNA, 32 nt, Human
ccauccaucuccgucucccuagagcaaggaau

SEQ ID NO: 366941 - RNA, 18 nt, Human
ccauccaucuguccaucc

SEQ ID NO: 366942 - RNA, 18 nt, Human
ccauccaucuuuccaucc

SEQ ID NO: 366943 - RNA, 32 nt, Human
ccauccaugagcuguaucuugaucugucugac

SEQ ID NO: 366944 - RNA, 23 nt, Human
ccauccaugaggacauucagagc

SEQ ID NO: 366945 - RNA, 20 nt, Human
ccauccauggcccagccccu

SEQ ID NO: 366946 - RNA, 20 nt, Human
ccauccaugggccccaccuu

SEQ ID NO: 366947 - RNA, 22 nt, Human
ccauccaugugcuuccagggug

SEQ ID NO: 366948 - RNA, 32 nt, Human
ccauccauuaagcugcuaucucagccuguccc

SEQ ID NO: 366949 - RNA, 18 nt, Human
ccauccauuauuuaucuu

SEQ ID NO: 366950 - RNA, 19 nt, Human
ccaucccaaacugcauuua

SEQ ID NO: 366951 - RNA, 32 nt, Human
ccaucccaacacuccugucugugggacuugau

SEQ ID NO: 366952 - RNA, 32 nt, Human
ccaucccaacccagggaggccugugucacucu

SEQ ID NO: 366953 - RNA, 31 nt, Human
ccaucccaagauuauguccucacuuauaacu

SEQ ID NO: 366954 - RNA, 32 nt, Human
ccaucccaagccuuucaccaaugagguacaac

SEQ ID NO: 366955 - RNA, 32 nt, Human
ccaucccacaugcugagccgccacaaagacca

SEQ ID NO: 366956 - RNA, 32 nt, Human
ccaucccaccucccgagccuuccucuucccgc

SEQ ID NO: 366957 - RNA, 32 nt, Human
ccaucccacuggcugcaggccuccugcugcuc

SEQ ID NO: 366958 - RNA, 32 nt, Human
ccaucccagaagaggagugggagccagcucag

SEQ ID NO: 366959 - RNA, 32 nt, Human
ccaucccaggagaccuugaaggaagccuuuga

SEQ ID NO: 366960 - RNA, 32 nt, Human
ccaucccaggcagagcaccacugugauuuguu

SEQ ID NO: 366961 - RNA, 20 nt, Human
ccaucccagggagcucagca

SEQ ID NO: 366962 - RNA, 32 nt, Human
ccaucccaggucuaaagccacaaguuucuuuu

SEQ ID NO: 366963 - RNA, 32 nt, Human
ccaucccagugaaauaaacauguauuagacac

SEQ ID NO: 366964 - RNA, 18 nt, Human
ccaucccauccaccccuu

SEQ ID NO: 366965 - RNA, 32 nt, Human
ccaucccaugucccuccagggggaccccacag

SEQ ID NO: 366966 - RNA, 32 nt, Human
ccaucccauucugcccccuccccacccugggu

SEQ ID NO: 366967 - RNA, 32 nt, Human
ccauccccaccuggcccugccagggcccugac

SEQ ID NO: 366968 - RNA, 32 nt, Human
ccauccccagcgauucccucucccaggcccca

SEQ ID NO: 366969 - RNA, 32 nt, Human
ccauccccagcguuuguucagugccuugguug

SEQ ID NO: 366970 - RNA, 32 nt, Human
ccauccccaggaggcgacauuccaaugcuagg

SEQ ID NO: 366971 - RNA, 32 nt, Human
ccauccccagggagguggcccaggaaggugcc

SEQ ID NO: 366972 - RNA, 21 nt, Human
ccauccccauuuggcuucucc

SEQ ID NO: 366973 - RNA, 21 nt, Human
ccaucccccacccaccugcca

SEQ ID NO: 366974 - RNA, 32 nt, Human
ccaucccccaggagaaugacagaagcaaagga

SEQ ID NO: 366975 - RNA, 32 nt, Human
ccaucccccaggaggacuggauuugguaugau

SEQ ID NO: 366976 - RNA, 32 nt, Human
ccaucccccaggaugacgccaccucugagauc

SEQ ID NO: 366977 - RNA, 32 nt, Human
ccaucccccagugguaccucaggacccagggc

SEQ ID NO: 366978 - RNA, 32 nt, Human
ccaucccccauggauacugaggcauagcugua

SEQ ID NO: 366979 - RNA, 32 nt, Human
ccaucccccugcccucguggccagcccggcug

SEQ ID NO: 366980 - RNA, 32 nt, Human
ccaucccccugccucccauucugcaccacacc

SEQ ID NO: 366981 - RNA, 32 nt, Human
ccaucccccugccugcugccucagucugcaac

SEQ ID NO: 366982 - RNA, 21 nt, Human
ccauccccgcugcuccucccu

SEQ ID NO: 366983 - RNA, 32 nt, Human
ccauccccggcagggagggaccgucagcucac

SEQ ID NO: 366984 - RNA, 32 nt, Human
ccauccccggccugggagguucaugcagaccc

SEQ ID NO: 366985 - RNA, 21 nt, Human
ccauccccuacuuuccucccu

SEQ ID NO: 366986 - RNA, 19 nt, Human
ccauccccucccucauccu

SEQ ID NO: 366987 - RNA, 18 nt, Human
ccauccccuccuagcaca

SEQ ID NO: 366988 - RNA, 32 nt, Human
ccauccccucuaccugcagacagggucggagg

SEQ ID NO: 366989 - RNA, 32 nt, Human
ccauccccugcagcuacuuggugacuuaacaa

SEQ ID NO: 366990 - RNA, 32 nt, Human
ccauccccugcucuccucaguagggcacccug

SEQ ID NO: 366991 - RNA, 32 nt, Human
ccauccccuuccccuugguguugaccuuugac

SEQ ID NO: 366992 - RNA, 32 nt, Human
ccauccccuugugugugucccucugcccagcu

SEQ ID NO: 366993 - RNA, 32 nt, Human
ccaucccggcccuccgccuccuggcccugccu

SEQ ID NO: 366994 - RNA, 19 nt, Human
ccaucccucacccaucuuu

SEQ ID NO: 366995 - RNA, 32 nt, Human
ccaucccucacccccacccucacuuucaaucc

SEQ ID NO: 366996 - RNA, 24 nt, Human
ccaucccuccacggucacguuccu

SEQ ID NO: 366997 - RNA, 32 nt, Human
ccaucccuccauccauccauucauccaucuau

SEQ ID NO: 366998 - RNA, 20 nt, Human
ccaucccuccauucauccuu

SEQ ID NO: 366999 - RNA, 23 nt, Human
ccaucccucccucccguccuucc

SEQ ID NO: 367000 - RNA, 32 nt, Human
ccaucccucccucccguccuuccccucuucuu

SEQ ID NO: 367001 - RNA, 22 nt, Human
ccaucccuccuccaacuuuucc

SEQ ID NO: 367002 - RNA, 21 nt, Human
ccaucccuccuucaucucccu

SEQ ID NO: 367003 - RNA, 32 nt, Human
ccaucccucgccgcugucccuuagcugacgcc

SEQ ID NO: 367004 - RNA, 32 nt, Human
ccaucccucggcaagcucaccaccucauccuu

SEQ ID NO: 367005 - RNA, 32 nt, Human
ccaucccucucaaucuucccugcccaggacug

SEQ ID NO: 367006 - RNA, 32 nt, Human
ccaucccucugucccuugcucuucuucaagcu

SEQ ID NO: 367007 - RNA, 32 nt, Human
ccaucccucuuuucuuuuguccuugccuuguu

SEQ ID NO: 367008 - RNA, 32 nt, Human
ccaucccugaccgggccgaggcugcuggaugc

SEQ ID NO: 367009 - RNA, 32 nt, Human
ccaucccugaggcucgcuggaaggcacugcuc

SEQ ID NO: 367010 - RNA, 32 nt, Human
ccaucccugcagcgcugcaccagcucccacgg

SEQ ID NO: 367011 - RNA, 32 nt, Human
ccaucccugcaugccugauccccaguuccuau

SEQ ID NO: 367012 - RNA, 32 nt, Human
ccaucccugccacauacaggugcucaauaaac

SEQ ID NO: 367013 - RNA, 32 nt, Human
ccaucccugcuccccacucucacuucccuucc

SEQ ID NO: 367014 - RNA, 18 nt, Human
ccaucccugcuuuuccca

SEQ ID NO: 367015 - RNA, 32 nt, Human
ccaucccuggauagcuauuugcacgaaucaug

SEQ ID NO: 367016 - RNA, 25 nt, Human
ccaucccuggcccagagcaggaggg

SEQ ID NO: 367017 - RNA, 32 nt, Human
ccaucccuggguuguggaucccuuccuuccag

SEQ ID NO: 367018 - RNA, 18 nt, Human
ccaucccuggugcugaca

SEQ ID NO: 367019 - RNA, 32 nt, Human
ccaucccugucccugucuggccuuacucuucc

SEQ ID NO: 367020 - RNA, 32 nt, Human
ccaucccuuaggugagcuucaaucuaagcauc

SEQ ID NO: 367021 - RNA, 21 nt, Human
ccaucccuuccgccgccuccu

SEQ ID NO: 367022 - RNA, 32 nt, Human
ccaucccuuccucccuuacccagcuaugauuc

SEQ ID NO: 367023 - RNA, 32 nt, Human
ccauccgcaggcucuguaguucugcuuucuau

SEQ ID NO: 367024 - RNA, 32 nt, Human
ccauccgccaccuccccucccgcugccccaga

SEQ ID NO: 367025 - RNA, 32 nt, Human
ccauccgccucaucuuguauuguuccauggac

SEQ ID NO: 367026 - RNA, 21 nt, Human
ccauccgcgccgccgccgccg

SEQ ID NO: 367027 - RNA, 32 nt, Human
ccauccgcgggugccggaucuggaccuaggug

SEQ ID NO: 367028 - RNA, 32 nt, Human
ccauccggugguuguucgagacuugcccaaug

SEQ ID NO: 367029 - RNA, 32 nt, Human
ccauccguauccagcagcgcggcuacuccgac

SEQ ID NO: 367030 - RNA, 32 nt, Human
ccauccgucagguggcguucagucucagaaua

SEQ ID NO: 367031 - RNA, 32 nt, Human
ccauccgucaucaucccuaaucugauacugga

SEQ ID NO: 367032 - RNA, 32 nt, Human
ccauccguccguccccuccugccugccccucu

SEQ ID NO: 367033 - RNA, 32 nt, Human
ccauccuaacagaaguaacccagcaagucaag

SEQ ID NO: 367034 - RNA, 32 nt, Human
ccauccuaggaccugggcagacccacauggcc

SEQ ID NO: 367035 - RNA, 32 nt, Human
ccauccuaggagaaaggcagaaugucauaauu

SEQ ID NO: 367036 - RNA, 32 nt, Human
ccauccucaaggcccugccccaguggacccug

SEQ ID NO: 367037 - RNA, 32 nt, Human
ccauccucaaggcccuuccccaguggcggcag

SEQ ID NO: 367038 - RNA, 32 nt, Human
ccauccucacacacucagccucugccucaggu

SEQ ID NO: 367039 - RNA, 32 nt, Human
ccauccucaccgcgaacgccacugugacgcgc

SEQ ID NO: 367040 - RNA, 32 nt, Human
ccauccucagcccucugcccacugggcccagg

SEQ ID NO: 367041 - RNA, 32 nt, Human
ccauccucauccaagucuucauugcuuuguca

SEQ ID NO: 367042 - RNA, 32 nt, Human
ccauccuccaaaucugugagcacuccaaguga

SEQ ID NO: 367043 - RNA, 32 nt, Human
ccauccuccaacaaaugcucagaucugcacca

SEQ ID NO: 367044 - RNA, 32 nt, Human
ccauccuccauggccagcuaagccaacaccuc

SEQ ID NO: 367045 - RNA, 32 nt, Human
ccauccucccaaagugcugggauuacaagugu

SEQ ID NO: 367046 - RNA, 32 nt, Human
ccauccucccaaauagaugggacuacugaugc

SEQ ID NO: 367047 - RNA, 32 nt, Human
ccauccuccccugcuccagccagggaggacug

SEQ ID NO: 367048 - RNA, 21 nt, Human
ccauccucccucccccagcca

SEQ ID NO: 367049 - RNA, 32 nt, Human
ccauccucccugcucagccacagccccugcuu

SEQ ID NO: 367050 - RNA, 32 nt, Human
ccauccuccugccucagccuccugaguagcua

SEQ ID NO: 367051 - RNA, 32 nt, Human
ccauccuccugccucagccuccugaguagcug

SEQ ID NO: 367052 - RNA, 32 nt, Human
ccauccuccugccucggccuccugagcagcug

SEQ ID NO: 367053 - RNA, 32 nt, Human
ccauccucgguuucccuguccuugccccgggc

SEQ ID NO: 367054 - RNA, 17 nt, Human
ccauccucuaucuaucc

SEQ ID NO: 367055 - RNA, 32 nt, Human
ccauccucuccaagauccaccagaacagauac

SEQ ID NO: 367056 - RNA, 32 nt, Human
ccauccucucccacuuccaucuggcaucccac

SEQ ID NO: 367057 - RNA, 32 nt, Human
ccauccucucccacuuccaucuggcgucccau

SEQ ID NO: 367058 - RNA, 32 nt, Human
ccauccucuccccuccuuccuccccuggguca

SEQ ID NO: 367059 - RNA, 32 nt, Human
ccauccucugaaccccaaucccccagccccac

SEQ ID NO: 367060 - RNA, 22 nt, Human
ccauccucugacuuccugggcc

SEQ ID NO: 367061 - RNA, 32 nt, Human
ccauccucugcccucuguuggcuguuguccuc

SEQ ID NO: 367062 - RNA, 32 nt, Human
ccauccucugcugcuccuuuaaaacaaauugc

SEQ ID NO: 367063 - RNA, 32 nt, Human
ccauccucuucuccccguacugccucaacccu

SEQ ID NO: 367064 - RNA, 32 nt, Human
ccauccugagccagggaacagccccaggguug

SEQ ID NO: 367065 - RNA, 32 nt, Human
ccauccugaugcuucagaccacccucccuucu

SEQ ID NO: 367066 - RNA, 20 nt, Human
ccauccugcccacagcucca

SEQ ID NO: 367067 - RNA, 19 nt, Human
ccauccugccccugcccac

SEQ ID NO: 367068 - RNA, 32 nt, Human
ccauccugcccuuguggcccccggcugcagcc

SEQ ID NO: 367069 - RNA, 32 nt, Human
ccauccugccugggcaucccuggugcugggga

SEQ ID NO: 367070 - RNA, 25 nt, Human
ccauccugcuaccaucaaacauuca

SEQ ID NO: 367071 - RNA, 32 nt, Human
ccauccugcucagauaugacuccugggcaauu

SEQ ID NO: 367072 - RNA, 32 nt, Human
ccauccugcucuccuccagccgagggacccug

SEQ ID NO: 367073 - RNA, 32 nt, Human
ccauccugcuucugcugcuguggcugcugcca

SEQ ID NO: 367074 - RNA, 32 nt, Human
ccauccuggaggcagcaggucggguagaguga

SEQ ID NO: 367075 - RNA, 32 nt, Human
ccauccuggaggggcaggcucugcgcaucugc

SEQ ID NO: 367076 - RNA, 32 nt, Human
ccauccuggcauauggaaggcagcaguugaau

SEQ ID NO: 367077 - RNA, 32 nt, Human
ccauccuggccaaaauggugaaaccucgucuc

SEQ ID NO: 367078 - RNA, 32 nt, Human
ccauccuggccaacacagugaaaccucgucuc

SEQ ID NO: 367079 - RNA, 32 nt, Human
ccauccuggccaacaugaugaaaccccgucuc

SEQ ID NO: 367080 - RNA, 32 nt, Human
ccauccuggccaacaugaugaaacccuaucuc

SEQ ID NO: 367081 - RNA, 32 nt, Human
ccauccuggccaacauggugaaaccucaucuc

SEQ ID NO: 367082 - RNA, 32 nt, Human
ccauccuggccaacauggugaaaccucgucuc

SEQ ID NO: 367083 - RNA, 32 nt, Human
ccauccuggccaacauggugaaaccugucucu

SEQ ID NO: 367084 - RNA, 32 nt, Human
ccauccuggccaacauggugaaaccuugucua

SEQ ID NO: 367085 - RNA, 32 nt, Human
ccauccuggcccagggcaucugggaggaaccg

SEQ ID NO: 367086 - RNA, 32 nt, Human
ccauccuggcuaacaaggugaaaccucgucuc

SEQ ID NO: 367087 - RNA, 32 nt, Human
ccauccuggcuaacacagugaaaccucaucuc

SEQ ID NO: 367088 - RNA, 32 nt, Human
ccauccuggcuaacacgaugaaaccccgucuc

SEQ ID NO: 367089 - RNA, 32 nt, Human
ccauccuggcuaacacggugaaaccucgucuc

SEQ ID NO: 367090 - RNA, 32 nt, Human
ccauccuggcuaaugcggugaaaccucaucuc

SEQ ID NO: 367091 - RNA, 32 nt, Human
ccauccuggcuacauggugaaaccccgucucu

SEQ ID NO: 367092 - RNA, 20 nt, Human
ccauccuggcugcugaucca

SEQ ID NO: 367093 - RNA, 32 nt, Human
ccauccugggaagccugccugugugcaccaag

SEQ ID NO: 367094 - RNA, 24 nt, Human
ccauccugggcaacaagaacgaaa

SEQ ID NO: 367095 - RNA, 32 nt, Human
ccauccugggcaacaagaacgaaacuccgucu

SEQ ID NO: 367096 - RNA, 32 nt, Human
ccauccugggcaacagagugagacuuugucuc

SEQ ID NO: 367097 - RNA, 32 nt, Human
ccauccugggcaacagagugaggcucugucug

SEQ ID NO: 367098 - RNA, 32 nt, Human
ccauccugggcaacagggugagaccuuaucuc

SEQ ID NO: 367099 - RNA, 32 nt, Human
ccauccugggcaacauaaugaaacaccaucuc

SEQ ID NO: 367100 - RNA, 32 nt, Human
ccauccugggcaacauagggagauccugucuc

SEQ ID NO: 367101 - RNA, 32 nt, Human
ccauccugggcaacauagugagacccugucuc

SEQ ID NO: 367102 - RNA, 32 nt, Human
ccauccugggcaacauggcgaaacccuaucuc

SEQ ID NO: 367103 - RNA, 32 nt, Human
ccauccugggcaauauggcaaaaccccaucuu

SEQ ID NO: 367104 - RNA, 32 nt, Human
ccauccugggcagaagcugaaggccagcuuca

SEQ ID NO: 367105 - RNA, 32 nt, Human
ccauccugucacuccuggaauaagaugccaga

SEQ ID NO: 367106 - RNA, 18 nt, Human
ccauccugucuucauccu

SEQ ID NO: 367107 - RNA, 32 nt, Human
ccauccugugcuucuguggcccccagcaagcu

SEQ ID NO: 367108 - RNA, 32 nt, Human
ccauccuguggccacgaugggggccaggacac

SEQ ID NO: 367109 - RNA, 32 nt, Human
ccauccuguggcuagaaccggcggggaagggg

SEQ ID NO: 367110 - RNA, 32 nt, Human
ccauccugugggcucugagacuuugcauggau

SEQ ID NO: 367111 - RNA, 32 nt, Human
ccauccuguuggccacacccagcuccauggau

SEQ ID NO: 367112 - RNA, 32 nt, Human
ccauccuuaccaccacaccacacgcacacucc

SEQ ID NO: 367113 - RNA, 32 nt, Human
ccauccuuauccacagucugggucccauccag

SEQ ID NO: 367114 - RNA, 32 nt, Human
ccauccuucaaaaacaacuaaaggaugauaug

SEQ ID NO: 367115 - RNA, 32 nt, Human
ccauccuuccagagaagucucugggaccuuuu

SEQ ID NO: 367116 - RNA, 32 nt, Human
ccauccuucccccagcugcuuccucggggagg

SEQ ID NO: 367117 - RNA, 32 nt, Human
ccauccuucuauucucuggucuucuauuuuug

SEQ ID NO: 367118 - RNA, 32 nt, Human
ccauccuucugccucacugucccuaguaguug

SEQ ID NO: 367119 - RNA, 32 nt, Human
ccauccuucuuuccuucauccuuuuccuucau

SEQ ID NO: 367120 - RNA, 32 nt, Human
ccauccuugaaaaggccacuucucagugaggg

SEQ ID NO: 367121 - RNA, 32 nt, Human
ccauccuugcccagccgguguggugcuugugu

SEQ ID NO: 367122 - RNA, 24 nt, Human
ccauccuugccuucaguucucucc

SEQ ID NO: 367123 - RNA, 24 nt, Human
ccauccuugccuugccgcucuaca

SEQ ID NO: 367124 - RNA, 32 nt, Human
ccauccuugcugucccuucacccuccaugccc

SEQ ID NO: 367125 - RNA, 32 nt, Human
ccauccuuggggaguggccuggagaggccucg

SEQ ID NO: 367126 - RNA, 20 nt, Human
ccauccuuguuuucccucca

SEQ ID NO: 367127 - RNA, 20 nt, Human
ccauccuuguuuugucccca

SEQ ID NO: 367128 - RNA, 21 nt, Human
ccauccuuuauaaauagucaa

SEQ ID NO: 367129 - RNA, 32 nt, Human
ccauccuuucccuacguuuucucccaucuuuu

SEQ ID NO: 367130 - RNA, 32 nt, Human
ccauccuuuccuagcuccauccuuccguccca

SEQ ID NO: 367131 - RNA, 32 nt, Human
ccauccuuuccucucuccucagggcgccucuc

SEQ ID NO: 367132 - RNA, 32 nt, Human
ccauccuuuucugcaaccccuccacuccccuc

SEQ ID NO: 367133 - RNA, 32 nt, Human
ccaucgaaaucccauucuccuguccagaggcc

SEQ ID NO: 367134 - RNA, 32 nt, Human
ccaucgagagcaucaaaugcuacuguucagca

SEQ ID NO: 367135 - RNA, 32 nt, Human
ccaucgagggagcaggagcaucaggcggccgg

SEQ ID NO: 367136 - RNA, 32 nt, Human
ccaucgagggcuccugagcucauccugaggac

SEQ ID NO: 367137 - RNA, 32 nt, Human
ccaucgagucucuggucucugccuucaggccc

SEQ ID NO: 367138 - RNA, 32 nt, Human
ccaucgaugaaggaauaucucuucucagaagg

SEQ ID NO: 367139 - RNA, 32 nt, Human
ccaucgauggggaacucacuuccuuuggaaaa

SEQ ID NO: 367140 - RNA, 18 nt, Human
ccaucgcaccccauccuu

SEQ ID NO: 367141 - RNA, 32 nt, Human
ccaucgcacuccagacuacagccugggugaca

SEQ ID NO: 367142 - RNA, 32 nt, Human
ccaucgcagaguucuuggcgcaccaaugacuc

SEQ ID NO: 367143 - RNA, 32 nt, Human
ccaucgcaugcccagggaccacugccuggcau

SEQ ID NO: 367144 - RNA, 32 nt, Human
ccaucgccacugccaccugccucccgcugaau

SEQ ID NO: 367145 - RNA, 32 nt, Human
ccaucgccauccaccggggcauggcccaggag

SEQ ID NO: 367146 - RNA, 32 nt, Human
ccaucgccauuuuugcuccaacugaggaaacu

SEQ ID NO: 367147 - RNA, 32 nt, Human
ccaucgcccaggccugggaugcagugauguga

SEQ ID NO: 367148 - RNA, 32 nt, Human
ccaucgcccaggcugcagugcagugacacgau

SEQ ID NO: 367149 - RNA, 32 nt, Human
ccaucgccuuccaaagucagcacucuacacuc

SEQ ID NO: 367150 - RNA, 32 nt, Human
ccaucgcgccacugcacucuagccugggugac

SEQ ID NO: 367151 - RNA, 29 nt, Human
ccaucgcgggcugcaucaucccccagcca

SEQ ID NO: 367152 - RNA, 32 nt, Human
ccaucgcugcagaccuuagaguggauguccgg

SEQ ID NO: 367153 - RNA, 32 nt, Human
ccaucgcugcagcugccauuggugccgaugac

SEQ ID NO: 367154 - RNA, 16 nt, Human
ccaucgcugccugcca

SEQ ID NO: 367155 - RNA, 32 nt, Human
ccaucgcugccuggcucugcgcugaccacggg

SEQ ID NO: 367156 - RNA, 23 nt, Human
ccaucggaaaggaauccacauca

SEQ ID NO: 367157 - RNA, 32 nt, Human
ccaucggacagcccccagccccaugaggaccc

SEQ ID NO: 367158 - RNA, 32 nt, Human
ccaucggaucacugccuucuuccuccucuugc

SEQ ID NO: 367159 - RNA, 32 nt, Human
ccaucggcaggcagugguucgguuuaagagau

SEQ ID NO: 367160 - RNA, 32 nt, Human
ccaucggccugaggggcagccugguggccaga

SEQ ID NO: 367161 - RNA, 32 nt, Human
ccaucgggaugguggaggcugugaaggccgug

SEQ ID NO: 367162 - RNA, 32 nt, Human
ccaucgggcaggugccuggucgggccuggcuu

SEQ ID NO: 367163 - RNA, 32 nt, Human
ccaucggggcugcggccagggcggagggagga

SEQ ID NO: 367164 - RNA, 32 nt, Human
ccaucguaagauugagccucaaguuugcaaua

SEQ ID NO: 367165 - RNA, 32 nt, Human
ccaucguaccacugcacuccagccuggaugac

SEQ ID NO: 367166 - RNA, 32 nt, Human
ccaucguaggcuucauacuggagagaaaccuu

SEQ ID NO: 367167 - RNA, 32 nt, Human
ccaucguccaggcuggagugcaguggcgcgau

SEQ ID NO: 367168 - RNA, 32 nt, Human
ccaucguccccaucguccuccuugucccugac

SEQ ID NO: 367169 - RNA, 22 nt, Human
ccaucguccuccuugucccuga

SEQ ID NO: 367170 - RNA, 32 nt, Human
ccaucgugcacacccacccauggugcacaccu

SEQ ID NO: 367171 - RNA, 17 nt, Human
ccaucguguacugcaga

SEQ ID NO: 367172 - RNA, 32 nt, Human
ccaucguguauauguaccacauuuuucucaug

SEQ ID NO: 367173 - RNA, 23 nt, Human
ccaucgugugagggaaaaugcuc

SEQ ID NO: 367174 - RNA, 32 nt, Human
ccaucguuuccucagggagacugggcggaggu

SEQ ID NO: 367175 - RNA, 22 nt, Human
ccaucuaaacccaccuuguuca

SEQ ID NO: 367176 - RNA, 22 nt, Human
ccaucuaaagaagaaaaagaaa

SEQ ID NO: 367177 - RNA, 32 nt, Human
ccaucuaaucuaacuucaagaucaucaggaua

SEQ ID NO: 367178 - RNA, 32 nt, Human
ccaucuacaggguucccuaggccagguggaga

SEQ ID NO: 367179 - RNA, 32 nt, Human
ccaucuacuuuuccacuccagagugggaaaaa

SEQ ID NO: 367180 - RNA, 18 nt, Human
ccaucuauccccauuccu

SEQ ID NO: 367181 - RNA, 32 nt, Human
ccaucucaaaaacaaaaacaaaacaaaacaac

SEQ ID NO: 367182 - RNA, 32 nt, Human
ccaucucaagaggcaucuucuacauguuuugu

SEQ ID NO: 367183 - RNA, 31 nt, Human
ccaucucacagcuggggacugagccagggcu

SEQ ID NO: 367184 - RNA, 32 nt, Human
ccaucucaccacacugcuuuacagucuuccug

SEQ ID NO: 367185 - RNA, 32 nt, Human
ccaucucaccaggagaaagagccacaucccca

SEQ ID NO: 367186 - RNA, 15 nt, Human
ccaucucacccaaga

SEQ ID NO: 367187 - RNA, 32 nt, Human
ccaucucaccucuucauucucuuguuacauuu

SEQ ID NO: 367188 - RNA, 32 nt, Human
ccaucucacucacacacacaggcauccauaca

SEQ ID NO: 367189 - RNA, 32 nt, Human
ccaucucacugcauucccuggcugcccgaccc

SEQ ID NO: 367190 - RNA, 32 nt, Human
ccaucucacuggacugcagacccggccuggug

SEQ ID NO: 367191 - RNA, 32 nt, Human
ccaucucacuucucuacugccucccagcccca

SEQ ID NO: 367192 - RNA, 32 nt, Human
ccaucucagaagagacuugacuuguggauggu

SEQ ID NO: 367193 - RNA, 32 nt, Human
ccaucucagaagccuuaacuuaaucacaucug

SEQ ID NO: 367194 - RNA, 32 nt, Human
ccaucucagccagcccugcucucucccucuuc

SEQ ID NO: 367195 - RNA, 32 nt, Human
ccaucucaguaggaacuugagggaagguugag

SEQ ID NO: 367196 - RNA, 32 nt, Human
ccaucucaugcagagcucccaccaagaggagc

SEQ ID NO: 367197 - RNA, 32 nt, Human
ccaucucaugccccuggcugggacguggcuca

SEQ ID NO: 367198 - RNA, 32 nt, Human
ccaucucaugcuggccuugguggaugggaugg

SEQ ID NO: 367199 - RNA, 32 nt, Human
ccaucucauggacugaaagguagauagacaga

SEQ ID NO: 367200 - RNA, 32 nt, Human
ccaucucauuuaagcccuugcaaccaaugaga

SEQ ID NO: 367201 - RNA, 18 nt, Human
ccaucuccaccucugggc

SEQ ID NO: 367202 - RNA, 32 nt, Human
ccaucuccagaagaggggagcagaguccgagc

SEQ ID NO: 367203 - RNA, 32 nt, Human
ccaucuccagaggcaccuuccacuagcaacag

SEQ ID NO: 367204 - RNA, 32 nt, Human
ccaucuccaggaaagacugagaaaaagagcgu

SEQ ID NO: 367205 - RNA, 32 nt, Human
ccaucuccauaaggagccaucaggcugucauu

SEQ ID NO: 367206 - RNA, 32 nt, Human
ccaucuccaugcccucuccuucuguguccccu

SEQ ID NO: 367207 - RNA, 18 nt, Human
ccaucuccccauccgucc

SEQ ID NO: 367208 - RNA, 32 nt, Human
ccaucucccuccccagaaacagugugcauggg

SEQ ID NO: 367209 - RNA, 32 nt, Human
ccaucucccugccuggcccccaaccucagggc

SEQ ID NO: 367210 - RNA, 32 nt, Human
ccaucucccuugagaggcacagaagguuagag

SEQ ID NO: 367211 - RNA, 32 nt, Human
ccaucuccuccacuuccucccuucccucaucc

SEQ ID NO: 367212 - RNA, 32 nt, Human
ccaucuccucugccagaggcucuggcuauuug

SEQ ID NO: 367213 - RNA, 32 nt, Human
ccaucuccuucauucugggcagugccagccac

SEQ ID NO: 367214 - RNA, 32 nt, Human
ccaucuccuucccagcucuccuuuucuguaag

SEQ ID NO: 367215 - RNA, 32 nt, Human
ccaucuccuugcagagacccacuaccagcugg

SEQ ID NO: 367216 - RNA, 32 nt, Human
ccaucuccuuggaggcaguggugugaaucuuc

SEQ ID NO: 367217 - RNA, 32 nt, Human
ccaucuccuuguucccccucucucuuuugccu

SEQ ID NO: 367218 - RNA, 32 nt, Human
ccaucucgacccuggggcugaggccugagucc

SEQ ID NO: 367219 - RNA, 32 nt, Human
ccaucucgcccaccccuccuuccuugaccagc

SEQ ID NO: 367220 - RNA, 32 nt, Human
ccaucucgcuccuccuccucuguuccaauucu

SEQ ID NO: 367221 - RNA, 25 nt, Human
ccaucucuaaaacuaaaaagaaaga

SEQ ID NO: 367222 - RNA, 28 nt, Human
ccaucucuaagugcugaacucaucccug

SEQ ID NO: 367223 - RNA, 32 nt, Human
ccaucucuacaaaaauacaaaaauuaauuggg

SEQ ID NO: 367224 - RNA, 32 nt, Human
ccaucucuacaaaaauacaaaaauuagccagg

SEQ ID NO: 367225 - RNA, 32 nt, Human
ccaucucuacaaaaauacaaaauuagccaggu

SEQ ID NO: 367226 - RNA, 32 nt, Human
ccaucucuacaaaaauuuaaaaauuagccuag

SEQ ID NO: 367227 - RNA, 22 nt, Human
ccaucucuacaaaacaugaaaa

SEQ ID NO: 367228 - RNA, 32 nt, Human
ccaucucuacaaaagauuaaaaauuagcugcg

SEQ ID NO: 367229 - RNA, 32 nt, Human
ccaucucuacaaauaaauaaaaauuagcuggg

SEQ ID NO: 367230 - RNA, 32 nt, Human
ccaucucuacaacaaaaauacaaaaauuagcc

SEQ ID NO: 367231 - RNA, 32 nt, Human
ccaucucuacgaaaaauacaaaauuagccaga

SEQ ID NO: 367232 - RNA, 32 nt, Human
ccaucucuacuaaaaacgcaaaauuagccggg

SEQ ID NO: 367233 - RNA, 32 nt, Human
ccaucucuacuaaaaauacaaaauuaccuggg

SEQ ID NO: 367234 - RNA, 32 nt, Human
ccaucucuacuaaaaauacaaaauuagcaggg

SEQ ID NO: 367235 - RNA, 32 nt, Human
ccaucucuacuaaaaauacaaaauuagccagg

SEQ ID NO: 367236 - RNA, 32 nt, Human
ccaucucuacuaaaaauacaaaauuagccggg

SEQ ID NO: 367237 - RNA, 32 nt, Human
ccaucucuacuaaaaauacaaaauuagccucg

SEQ ID NO: 367238 - RNA, 32 nt, Human
ccaucucuacuaaaaauacaaaauuagcuggg

SEQ ID NO: 367239 - RNA, 32 nt, Human
ccaucucuacuaaaaauauaaaauuagccagg

SEQ ID NO: 367240 - RNA, 32 nt, Human
ccaucucuacuaaaauacaaaaaguuagcugg

SEQ ID NO: 367241 - RNA, 32 nt, Human
ccaucucuacuaaaauacaaaaauuagccggg

SEQ ID NO: 367242 - RNA, 32 nt, Human
ccaucucuacuaaaauacaaaaauuagcuggg

SEQ ID NO: 367243 - RNA, 32 nt, Human
ccaucucuacuaaaauacaaaaauuauccggg

SEQ ID NO: 367244 - RNA, 32 nt, Human
ccaucucuacuaaaauacaaaauuagccaggc

SEQ ID NO: 367245 - RNA, 32 nt, Human
ccaucucuacuaaaauauaaaaauuagccggg

SEQ ID NO: 367246 - RNA, 32 nt, Human
ccaucucuacuaaacauacaaaauuagcuggg

SEQ ID NO: 367247 - RNA, 32 nt, Human
ccaucucuacuaaauacagaaaauuagccagg

SEQ ID NO: 367248 - RNA, 32 nt, Human
ccaucucuagugaagacagaaccagagggaau

SEQ ID NO: 367249 - RNA, 32 nt, Human
ccaucucuauuaaagauacaaaauuagccagg

SEQ ID NO: 367250 - RNA, 32 nt, Human
ccaucucucagggagacaaagaaccuccuucc

SEQ ID NO: 367251 - RNA, 32 nt, Human
ccaucucucccagcagucuuggggucugggug

SEQ ID NO: 367252 - RNA, 32 nt, Human
ccaucucucccgaaaauacaaaauuagccagg

SEQ ID NO: 367253 - RNA, 18 nt, Human
ccaucucuccucauccuu

SEQ ID NO: 367254 - RNA, 32 nt, Human
ccaucucucuaaaaauacaaaaauuagcuggg

SEQ ID NO: 367255 - RNA, 32 nt, Human
ccaucucucuacugcuggacuguggaggguca

SEQ ID NO: 367256 - RNA, 32 nt, Human
ccaucucucuccauaucaaucuggaccaucuc

SEQ ID NO: 367257 - RNA, 32 nt, Human
ccaucucucucccacuucuucuccccuccccc

SEQ ID NO: 367258 - RNA, 32 nt, Human
ccaucucucuccccucucuucucucaugaugc

SEQ ID NO: 367259 - RNA, 32 nt, Human
ccaucucucuuuuugacccucucaggacuggg

SEQ ID NO: 367260 - RNA, 32 nt, Human
ccaucucugaagaaacaacccaucguucuuuu

SEQ ID NO: 367261 - RNA, 20 nt, Human
ccaucucugaccagcuggga

SEQ ID NO: 367262 - RNA, 32 nt, Human
ccaucucugaugggagagggugaggaaaucag

SEQ ID NO: 367263 - RNA, 32 nt, Human
ccaucucugcacccacaaucacacugauuuuu

SEQ ID NO: 367264 - RNA, 32 nt, Human
ccaucucugcccaugagccacagggaacaugu

SEQ ID NO: 367265 - RNA, 32 nt, Human
ccaucucugccuggccaggggcugcugaccca

SEQ ID NO: 367266 - RNA, 32 nt, Human
ccaucucugcucccgccagccuuguuuucagg

SEQ ID NO: 367267 - RNA, 32 nt, Human
ccaucucugggaauuguguggguauuaauguu

SEQ ID NO: 367268 - RNA, 32 nt, Human
ccaucucugggccucagaguccucagccacaa

SEQ ID NO: 367269 - RNA, 32 nt, Human
ccaucucuggucucaaagccagucccagccug

SEQ ID NO: 367270 - RNA, 32 nt, Human
ccaucugaaaaacaaaaacaaaaacagaaaac

SEQ ID NO: 367271 - RNA, 21 nt, Human
ccaucugaaaaauaaaagaaa

SEQ ID NO: 367272 - RNA, 32 nt, Human
ccaucugaagagcauuaaaagcauuuaaaaag

SEQ ID NO: 367273 - RNA, 32 nt, Human
ccaucugaagccccacucuuaaaaaguugcac

SEQ ID NO: 367274 - RNA, 32 nt, Human
ccaucugaauguguugggggcucugcacuuga

SEQ ID NO: 367275 - RNA, 32 nt, Human
ccaucugacaccgccucaccccggaccuuauu

SEQ ID NO: 367276 - RNA, 32 nt, Human
ccaucugacauuuggggauucacugcaugaag

SEQ ID NO: 367277 - RNA, 32 nt, Human
ccaucugaccagcugcugguaucugccaggac

SEQ ID NO: 367278 - RNA, 32 nt, Human
ccaucugacccauggggccugccugugagaaa

SEQ ID NO: 367279 - RNA, 32 nt, Human
ccaucugacucaugucucuucucaucugguuc

SEQ ID NO: 367280 - RNA, 32 nt, Human
ccaucugagaugggguccuguuguuuauuauc

SEQ ID NO: 367281 - RNA, 32 nt, Human
ccaucugagcuggcugugggcugagauccugg

SEQ ID NO: 367282 - RNA, 32 nt, Human
ccaucugaggauacauacucuggguuuccauu

SEQ ID NO: 367283 - RNA, 32 nt, Human
ccaucugaggcaaucuugccucccaggggaaa

SEQ ID NO: 367284 - RNA, 32 nt, Human
ccaucugaguaagggguguaaaccccaagagu

SEQ ID NO: 367285 - RNA, 32 nt, Human
ccaucugaguccugauuuagccagcagugacc

SEQ ID NO: 367286 - RNA, 22 nt, Human
ccaucugauaagaaagaauaga

SEQ ID NO: 367287 - RNA, 32 nt, Human
ccaucugaucgacuucaacuugcugaugguga

SEQ ID NO: 367288 - RNA, 32 nt, Human
ccaucugcaagcuggagaaucaggaaagcugg

SEQ ID NO: 367289 - RNA, 32 nt, Human
ccaucugcaccccuggcccugcucugggcuuc

SEQ ID NO: 367290 - RNA, 32 nt, Human
ccaucugcagagcgaggaggcccgggcugguu

SEQ ID NO: 367291 - RNA, 32 nt, Human
ccaucugcagcccgccuuccucugccuccuga

SEQ ID NO: 367292 - RNA, 32 nt, Human
ccaucugcaggcagagaaggcccagugugucc

SEQ ID NO: 367293 - RNA, 32 nt, Human
ccaucugccccagcugccuccacagacugcug

SEQ ID NO: 367294 - RNA, 32 nt, Human
ccaucugccugggaguccuccugggccugcca

SEQ ID NO: 367295 - RNA, 26 nt, Human
ccaucugccuucaggucuucuucaca

SEQ ID NO: 367296 - RNA, 24 nt, Human
ccaucugccuuggccucccagggu

SEQ ID NO: 367297 - RNA, 32 nt, Human
ccaucugcggcccugucccauggcuuaaccgc

SEQ ID NO: 367298 - RNA, 32 nt, Human
ccaucugcgugaccuggaugugagauguggag

SEQ ID NO: 367299 - RNA, 32 nt, Human
ccaucugcucuggguauuuuuguuuuuguuua

SEQ ID NO: 367300 - RNA, 32 nt, Human
ccaucugcuggcaccugaggagagugagcagc

SEQ ID NO: 367301 - RNA, 32 nt, Human
ccaucugcuggcacuccagccgcgugcaggug

SEQ ID NO: 367302 - RNA, 32 nt, Human
ccaucuggagaagggggaagacuccucgaaaa

SEQ ID NO: 367303 - RNA, 32 nt, Human
ccaucuggagcacggcuggccacggucagccc

SEQ ID NO: 367304 - RNA, 32 nt, Human
ccaucuggagugagugcaggaccaggucccgc

SEQ ID NO: 367305 - RNA, 32 nt, Human
ccaucuggcgacagcaaaugcaaaagagggga

SEQ ID NO: 367306 - RNA, 31 nt, Human
ccaucugggagggguuugugggugaacucgg

SEQ ID NO: 367307 - RNA, 32 nt, Human
ccaucugggcuauucugggguagaaggaaggc

SEQ ID NO: 367308 - RNA, 32 nt, Human
ccaucuggggcugaggacacacagauacauaa

SEQ ID NO: 367309 - RNA, 32 nt, Human
ccaucuggucacuggcagucugggcagguugc

SEQ ID NO: 367310 - RNA, 19 nt, Human
ccaucuggugcuuuuccca

SEQ ID NO: 367311 - RNA, 19 nt, Human
ccaucugguguagcacaga

SEQ ID NO: 367312 - RNA, 32 nt, Human
ccaucuguacuaaaaauacaaaauuagcuggg

SEQ ID NO: 367313 - RNA, 32 nt, Human
ccaucuguauaaaaacaccuugggggcaggca

SEQ ID NO: 367314 - RNA, 32 nt, Human
ccaucugucaccaggggcuuagggaaggccga

SEQ ID NO: 367315 - RNA, 32 nt, Human
ccaucugucacccaggcuggugugcaggggug

SEQ ID NO: 367316 - RNA, 16 nt, Human
ccaucuguccacaucc

SEQ ID NO: 367317 - RNA, 18 nt, Human
ccaucuguccauccuccu

SEQ ID NO: 367318 - RNA, 32 nt, Human
ccaucuguccugugugucuguccuccuuguga

SEQ ID NO: 367319 - RNA, 32 nt, Human
ccaucugucuccuguaaaagauaagaauuuuc

SEQ ID NO: 367320 - RNA, 32 nt, Human
ccaucugucuucagcacauuccacggcaucgc

SEQ ID NO: 367321 - RNA, 32 nt, Human
ccaucugucuucugagacuuugcccuucucca

SEQ ID NO: 367322 - RNA, 32 nt, Human
ccaucugugaggugacaggcaaggaugaaaga

SEQ ID NO: 367323 - RNA, 32 nt, Human
ccaucugugcaagguguccacauugcuagcug

SEQ ID NO: 367324 - RNA, 22 nt, Human
ccaucugugggaaaucccagga

SEQ ID NO: 367325 - RNA, 32 nt, Human
ccaucugugggacaaccacaaggucuggaaac

SEQ ID NO: 367326 - RNA, 18 nt, Human
ccaucuguguuccaccuu

SEQ ID NO: 367327 - RNA, 32 nt, Human
ccaucuguuccaagcuauuuguccauguaaaa

SEQ ID NO: 367328 - RNA, 32 nt, Human
ccaucuguucccucccugucaucuccucucug

SEQ ID NO: 367329 - RNA, 32 nt, Human
ccaucuguuggccaccugcaggccagucucaa

SEQ ID NO: 367330 - RNA, 24 nt, Human
ccaucuguugugcgcauugaagug

SEQ ID NO: 367331 - RNA, 32 nt, Human
ccaucuuaaagaagaucagacagaguacuuag

SEQ ID NO: 367332 - RNA, 32 nt, Human
ccaucuuaaggagaaugagcaaauaccuugug

SEQ ID NO: 367333 - RNA, 32 nt, Human
ccaucuuagaagaagcgaaagugacuguugau

SEQ ID NO: 367334 - RNA, 32 nt, Human
ccaucuuaucauguggaguuuaucucacccug

SEQ ID NO: 367335 - RNA, 32 nt, Human
ccaucuuaugcaaaucuggaugccauaaauaa

SEQ ID NO: 367336 - RNA, 32 nt, Human
ccaucuucaccuucccuccucacucugggucc

SEQ ID NO: 367337 - RNA, 32 nt, Human
ccaucuucccguuucuauccucgacuccaaag

SEQ ID NO: 367338 - RNA, 22 nt, Human
ccaucuuccggcuccagcguca

SEQ ID NO: 367339 - RNA, 32 nt, Human
ccaucuuccucccacuuaccugccuccccucc

SEQ ID NO: 367340 - RNA, 32 nt, Human
ccaucuuccucuacuucucuccuucauuucag

SEQ ID NO: 367341 - RNA, 32 nt, Human
ccaucuuccugacauguugccugggaugugac

SEQ ID NO: 367342 - RNA, 32 nt, Human
ccaucuucgugcccauucaccuggugaaggag

SEQ ID NO: 367343 - RNA, 32 nt, Human
ccaucuucuagacuguaacccugccucccugc

SEQ ID NO: 367344 - RNA, 32 nt, Human
ccaucuucuccaccaaccccaaccuccugcug

SEQ ID NO: 367345 - RNA, 32 nt, Human
ccaucuucuccucuauucuggucuccccugcc

SEQ ID NO: 367346 - RNA, 32 nt, Human
ccaucuucucucuccuagagcccauacagcac

SEQ ID NO: 367347 - RNA, 32 nt, Human
ccaucuucugagaugauccugauucccagaau

SEQ ID NO: 367348 - RNA, 32 nt, Human
ccaucuucuucuuccuccuccgucuccuuucc

SEQ ID NO: 367349 - RNA, 32 nt, Human
ccaucuugaacaaacaaaacauuaggcuccug

SEQ ID NO: 367350 - RNA, 32 nt, Human
ccaucuugcaccuguuccacagcuaaguacag

SEQ ID NO: 367351 - RNA, 32 nt, Human
ccaucuuggaagcagcccgccgccauuuugga

SEQ ID NO: 367352 - RNA, 20 nt, Human
ccaucuuggcagccauccuu

SEQ ID NO: 367353 - RNA, 32 nt, Human
ccaucuuggccaggcuggugugaucauggcuc

SEQ ID NO: 367354 - RNA, 32 nt, Human
ccaucuuggcucacugcaccuccaccuuccgg

SEQ ID NO: 367355 - RNA, 29 nt, Human
ccaucuuggcugcuguccugccucugacc

SEQ ID NO: 367356 - RNA, 32 nt, Human
ccaucuugggauuccuccccuggaaguugucc

SEQ ID NO: 367357 - RNA, 32 nt, Human
ccaucuugggcaacagaaugagauccugucuc

SEQ ID NO: 367358 - RNA, 32 nt, Human
ccaucuugggcaacauggugaaacccugucua

SEQ ID NO: 367359 - RNA, 32 nt, Human
ccaucuuggucucaccuuuucucuccauaucc

SEQ ID NO: 367360 - RNA, 32 nt, Human
ccaucuuguucuggccuagaggucaguccuuu

SEQ ID NO: 367361 - RNA, 32 nt, Human
ccaucuuuacaaaaauacaaaaauuagcugga

SEQ ID NO: 367362 - RNA, 32 nt, Human
ccaucuuucaauguugcagccugguugagaag

SEQ ID NO: 367363 - RNA, 32 nt, Human
ccaucuuuccccagccucucaucaccgaccgu

SEQ ID NO: 367364 - RNA, 32 nt, Human
ccaucuuuccccggaggucucuuccaaauccc

SEQ ID NO: 367365 - RNA, 32 nt, Human
ccaucuuuccuccagcacuuuugggguaagga

SEQ ID NO: 367366 - RNA, 32 nt, Human
ccaucuuugagccuuccuaguccuccaccugg

SEQ ID NO: 367367 - RNA, 32 nt, Human
ccaucuuugcauuguuccuccuugcucgccgc

SEQ ID NO: 367368 - RNA, 32 nt, Human
ccaucuuugcucauggcaacaguuagcuggag

SEQ ID NO: 367369 - RNA, 32 nt, Human
ccaucuuuguacucauccaccccagccggcuu

SEQ ID NO: 367370 - RNA, 32 nt, Human
ccaucuuuguuucauugccuucaucaaccuuc

SEQ ID NO: 367371 - RNA, 32 nt, Human
ccaugaaaacagaacccaaaaggguaaguggu

SEQ ID NO: 367372 - RNA, 32 nt, Human
ccaugaaacccauggcuucucacgggacagac

SEQ ID NO: 367373 - RNA, 32 nt, Human
ccaugaaagacuugugaauccaggaagagaga

SEQ ID NO: 367374 - RNA, 27 nt, Human
ccaugaaagauccaagucgcagcagua

SEQ ID NO: 367375 - RNA, 32 nt, Human
ccaugaacauggcagugcuaugacuuuucuga

SEQ ID NO: 367376 - RNA, 32 nt, Human
ccaugaaccaggcuguccaggaauggcagcug

SEQ ID NO: 367377 - RNA, 32 nt, Human
ccaugaaccagggcaugaaacugaaagugcau

SEQ ID NO: 367378 - RNA, 32 nt, Human
ccaugaacuccuccuccauuuccuuuuuggga

SEQ ID NO: 367379 - RNA, 27 nt, Human
ccaugaagaaggaggugugcuccgugg

SEQ ID NO: 367380 - RNA, 32 nt, Human
ccaugaagagucuggaaaacaauguuucaaag

SEQ ID NO: 367381 - RNA, 32 nt, Human
ccaugaagaugaucuuggcuguggagagccag

SEQ ID NO: 367382 - RNA, 19 nt, Human
ccaugaagcuccauucuca

SEQ ID NO: 367383 - RNA, 27 nt, Human
ccaugaagcugcugcugcugcacccgg

SEQ ID NO: 367384 - RNA, 32 nt, Human
ccaugaaggaagagaggaaaguuuuuaaguaa

SEQ ID NO: 367385 - RNA, 31 nt, Human
ccaugaaggaugucuccaugcuaggagcugc

SEQ ID NO: 367386 - RNA, 32 nt, Human
ccaugaaggccaugcagcgacugugguggcag

SEQ ID NO: 367387 - RNA, 21 nt, Human
ccaugaagguggcccaggacc

SEQ ID NO: 367388 - RNA, 32 nt, Human
ccaugaaguccuuuauagcaaaaguuuccagu

SEQ ID NO: 367389 - RNA, 32 nt, Human
ccaugaagugucaccaguaucuacuacuguga

SEQ ID NO: 367390 - RNA, 24 nt, Human
ccaugaauagaaaauacuucuuua

SEQ ID NO: 367391 - RNA, 32 nt, Human
ccaugaauagcaggagcugggaagaaaggaag

SEQ ID NO: 367392 - RNA, 32 nt, Human
ccaugaaucucucauccagccccgcagggauc

SEQ ID NO: 367393 - RNA, 32 nt, Human
ccaugaauggaggcugcaggaggcugaguccg

SEQ ID NO: 367394 - RNA, 32 nt, Human
ccaugaauggcagcaggaggcagacagguuuc

SEQ ID NO: 367395 - RNA, 32 nt, Human
ccaugaaugucagagacauugacuggaggccu

SEQ ID NO: 367396 - RNA, 32 nt, Human
ccaugaauuaugccagcaagaaugaagcacag

SEQ ID NO: 367397 - RNA, 32 nt, Human
ccaugaauuccugcccaaggauacuuaaucag

SEQ ID NO: 367398 - RNA, 21 nt, Human
ccaugacaaacaccaggaugc

SEQ ID NO: 367399 - RNA, 32 nt, Human
ccaugacaccaacugucaccacuaacucagag

SEQ ID NO: 367400 - RNA, 32 nt, Human
ccaugacauccaaccugggcucuccuggcccc

SEQ ID NO: 367401 - RNA, 32 nt, Human
ccaugacaucucaaagcaacagguaauugaag

SEQ ID NO: 367402 - RNA, 32 nt, Human
ccaugacauuucuuuccccacucugaccucag

SEQ ID NO: 367403 - RNA, 32 nt, Human
ccaugaccacuccugcccuccugccccgugcu

SEQ ID NO: 367404 - RNA, 32 nt, Human
ccaugaccagaggcuggaguggggguguguua

SEQ ID NO: 367405 - RNA, 32 nt, Human
ccaugaccagcagcaaccacagagccuuuuca

SEQ ID NO: 367406 - RNA, 32 nt, Human
ccaugaccccuuggacacuggacugcaugcac

SEQ ID NO: 367407 - RNA, 20 nt, Human
ccaugacccucgcucaggga

SEQ ID NO: 367408 - RNA, 32 nt, Human
ccaugaccuguaucccacguacuccaacuucc

SEQ ID NO: 367409 - RNA, 32 nt, Human
ccaugaccuucaugauaccagugagaagccag

SEQ ID NO: 367410 - RNA, 32 nt, Human
ccaugaccuuccuccuccucuucacuuggcca

SEQ ID NO: 367411 - RNA, 32 nt, Human
ccaugacggcugguccccacaggaccagcugg

SEQ ID NO: 367412 - RNA, 32 nt, Human
ccaugacucaacacuuauuauccaauggguaa

SEQ ID NO: 367413 - RNA, 32 nt, Human
ccaugacugcggcugcccuccuccaggccccc

SEQ ID NO: 367414 - RNA, 32 nt, Human
ccaugacuguugcugcacuccagccugaguga

SEQ ID NO: 367415 - RNA, 24 nt, Human
ccaugacuuccucucgccacugcu

SEQ ID NO: 367416 - RNA, 32 nt, Human
ccaugacuuuucugcccugcccucagccuguu

SEQ ID NO: 367417 - RNA, 22 nt, Human
ccaugagaaguguccuuguuca

SEQ ID NO: 367418 - RNA, 32 nt, Human
ccaugagaauaagagaaagaaaaugaagauca

SEQ ID NO: 367419 - RNA, 32 nt, Human
ccaugagaauuccaggcucacaaagggagagg

SEQ ID NO: 367420 - RNA, 32 nt, Human
ccaugagaccucagagcuucagaucgaggccu

SEQ ID NO: 367421 - RNA, 32 nt, Human
ccaugagagaagggccucuguccuuagguaga

SEQ ID NO: 367422 - RNA, 32 nt, Human
ccaugagagcugccagaauuucaaguccaguu

SEQ ID NO: 367423 - RNA, 32 nt, Human
ccaugagagggugggagggcccagggagggcu

SEQ ID NO: 367424 - RNA, 32 nt, Human
ccaugagauucccaaugccaugggcuuucccc

SEQ ID NO: 367425 - RNA, 32 nt, Human
ccaugagauucugcuuugggcuucacuucuuu

SEQ ID NO: 367426 - RNA, 32 nt, Human
ccaugagcaacagauuugagguaccagugcau

SEQ ID NO: 367427 - RNA, 32 nt, Human
ccaugagcacagaggcugcucuggagucaaca

SEQ ID NO: 367428 - RNA, 21 nt, Human
ccaugagcccacagcuugcca

SEQ ID NO: 367429 - RNA, 27 nt, Human
ccaugagcuacacaggcuuuguccagg

SEQ ID NO: 367430 - RNA, 32 nt, Human
ccaugagcugagucucugccucugccucuccc

SEQ ID NO: 367431 - RNA, 32 nt, Human
ccaugagcuggcuucucucugcaacaggagaa

SEQ ID NO: 367432 - RNA, 32 nt, Human
ccaugagcuucuuccaggcucauguggcccag

SEQ ID NO: 367433 - RNA, 32 nt, Human
ccaugaggaagauuuuuaacaaaagccuccag

SEQ ID NO: 367434 - RNA, 32 nt, Human
ccaugaggacaguugugugccacuggaagaga

SEQ ID NO: 367435 - RNA, 32 nt, Human
ccaugaggacugggaagaguccugcccacagc

SEQ ID NO: 367436 - RNA, 32 nt, Human
ccaugaggagccaagaccagcaggucccacag

SEQ ID NO: 367437 - RNA, 32 nt, Human
ccaugaggaugaggacaggaagccagacccgg

SEQ ID NO: 367438 - RNA, 32 nt, Human
ccaugaggcaacacauuauccaccggguaacu

SEQ ID NO: 367439 - RNA, 32 nt, Human
ccaugaggcaccacugcacucuagccugggca

SEQ ID NO: 367440 - RNA, 32 nt, Human
ccaugaggccacccuggaaucagaacugcaca

SEQ ID NO: 367441 - RNA, 32 nt, Human
ccaugaggcccagcugagagcagcucagcucg

SEQ ID NO: 367442 - RNA, 32 nt, Human
ccaugaggcccagguuacagugagccaagauc

SEQ ID NO: 367443 - RNA, 24 nt, Human
ccaugaggcggagguugcagugag

SEQ ID NO: 367444 - RNA, 32 nt, Human
ccaugaggcuggugcuugcaguuccugcaagu

SEQ ID NO: 367445 - RNA, 32 nt, Human
ccaugaggcugucuccccacagcuuuauccaa

SEQ ID NO: 367446 - RNA, 32 nt, Human
ccaugagggaggaacacucagacugaagggcu

SEQ ID NO: 367447 - RNA, 27 nt, Human
ccaugagggcccuggugcuucugcugu

SEQ ID NO: 367448 - RNA, 27 nt, Human
ccaugagggcucugcugcuccuggggu

SEQ ID NO: 367449 - RNA, 32 nt, Human
ccaugaggggccaagacacugccuaaggugug

SEQ ID NO: 367450 - RNA, 32 nt, Human
ccaugaggguggaucacuugaggucagaaguu

SEQ ID NO: 367451 - RNA, 32 nt, Human
ccaugagguccaguguugucaccaucuacuag

SEQ ID NO: 367452 - RNA, 32 nt, Human
ccaugagguccaguguugucaccaucuauuag

SEQ ID NO: 367453 - RNA, 24 nt, Human
ccaugagguggaaguugcagugag

SEQ ID NO: 367454 - RNA, 32 nt, Human
ccaugagguguuuucugugugcagaacauugu

SEQ ID NO: 367455 - RNA, 32 nt, Human
ccaugagguuucuucucuacugugccuucauc

SEQ ID NO: 367456 - RNA, 32 nt, Human
ccaugagugaauagacagcauuggcuggucca

SEQ ID NO: 367457 - RNA, 32 nt, Human
ccaugagugaauaugcugaaugaggaccuuuu

SEQ ID NO: 367458 - RNA, 32 nt, Human
ccaugagugcaggauuuggcugaugggcaguc

SEQ ID NO: 367459 - RNA, 21 nt, Human
ccaugagugucccuggccccu

SEQ ID NO: 367460 - RNA, 32 nt, Human
ccaugaguucacugcauucucccuuccccgcc

SEQ ID NO: 367461 - RNA, 32 nt, Human
ccaugaguugggggucgggugggggagggaaa

SEQ ID NO: 367462 - RNA, 32 nt, Human
ccaugaguuugagaccagccuggguaacauag

SEQ ID NO: 367463 - RNA, 32 nt, Human
ccaugaguuuguuuugcuuuucauacagacuu

SEQ ID NO: 367464 - RNA, 32 nt, Human
ccaugauaacagacauuauuuuaagcugcuau

SEQ ID NO: 367465 - RNA, 19 nt, Human
ccaugauacuccacuccca

SEQ ID NO: 367466 - RNA, 32 nt, Human
ccaugauccaauaugaccucaucuugacuaca

SEQ ID NO: 367467 - RNA, 32 nt, Human
ccaugaucucaccaugcacuccagccuagaca

SEQ ID NO: 367468 - RNA, 32 nt, Human
ccaugaugauggcccugagcacuggccucuuc

SEQ ID NO: 367469 - RNA, 32 nt, Human
ccaugaugcuuccugaggguguucuagaagcc

SEQ ID NO: 367470 - RNA, 32 nt, Human
ccaugauggaaagacuuaaagaugaauuugag

SEQ ID NO: 367471 - RNA, 32 nt, Human
ccaugauggaugcuuguuucaaaggguuuccu

SEQ ID NO: 367472 - RNA, 32 nt, Human
ccaugauggauuuggaaacuuacuggcuagcu

SEQ ID NO: 367473 - RNA, 32 nt, Human
ccaugauguagugccucuuucauccacuagug

SEQ ID NO: 367474 - RNA, 32 nt, Human
ccaugauguauacauuuguugaugacaguuga

SEQ ID NO: 367475 - RNA, 20 nt, Human
ccaugauucccuccucguca

SEQ ID NO: 367476 - RNA, 32 nt, Human
ccaugauuccuacccugucccagucaucucuu

SEQ ID NO: 367477 - RNA, 32 nt, Human
ccaugauucugaagcaugcacaccucugaaga

SEQ ID NO: 367478 - RNA, 32 nt, Human
ccaugauucugccucuguuuuauaccugcaca

SEQ ID NO: 367479 - RNA, 32 nt, Human
ccaugauugcacuccaaccugggcgacagaga

SEQ ID NO: 367480 - RNA, 32 nt, Human
ccaugauuguaaguuuccugaggucuccucag

SEQ ID NO: 367481 - RNA, 32 nt, Human
ccaugcaacucugucugucugcugcccaucug

SEQ ID NO: 367482 - RNA, 32 nt, Human
ccaugcacacacucacaggaggcccguggacu

SEQ ID NO: 367483 - RNA, 32 nt, Human
ccaugcacacagaaccuccuugugucuguuuc

SEQ ID NO: 367484 - RNA, 18 nt, Human
ccaugcacagccauccuu

SEQ ID NO: 367485 - RNA, 23 nt, Human
ccaugcacagggccauucaggaa

SEQ ID NO: 367486 - RNA, 32 nt, Human
ccaugcacauaguaagucugacuauggcaguc

SEQ ID NO: 367487 - RNA, 32 nt, Human
ccaugcacauuuaauuuauuucagagaaacuc

SEQ ID NO: 367488 - RNA, 22 nt, Human
ccaugcaccaacccacugccca

SEQ ID NO: 367489 - RNA, 23 nt, Human
ccaugcacgggcagggggcgugg

SEQ ID NO: 367490 - RNA, 32 nt, Human
ccaugcacuuuaccagcucaacgcauccacuc

SEQ ID NO: 367491 - RNA, 32 nt, Human
ccaugcagaaacuaagggaagggaccuuacaa

SEQ ID NO: 367492 - RNA, 32 nt, Human
ccaugcagacacacgccuguguccacccuggc

SEQ ID NO: 367493 - RNA, 32 nt, Human
ccaugcagacuccucagaucugaacacaguuu

SEQ ID NO: 367494 - RNA, 32 nt, Human
ccaugcagagacucugggcugcgcagcccccg

SEQ ID NO: 367495 - RNA, 32 nt, Human
ccaugcagagcaggaagccucagcugggccug

SEQ ID NO: 367496 - RNA, 32 nt, Human
ccaugcagagcuggagguuggggugaugucuu

SEQ ID NO: 367497 - RNA, 32 nt, Human
ccaugcagagugagcagggagaggcugggcac

SEQ ID NO: 367498 - RNA, 32 nt, Human
ccaugcagaguuuccaggugugcacuggaagu

SEQ ID NO: 367499 - RNA, 27 nt, Human
ccaugcagcauuuuccaccugccccga

SEQ ID NO: 367500 - RNA, 32 nt, Human
ccaugcagccccugauguucuguuccaccgua

SEQ ID NO: 367501 - RNA, 32 nt, Human
ccaugcagccuggaaggcgagaggagggccaa

SEQ ID NO: 367502 - RNA, 32 nt, Human
ccaugcaggacugguucagcuugggcugucug

SEQ ID NO: 367503 - RNA, 32 nt, Human
ccaugcaggagagaacacagaaggacugaugu

SEQ ID NO: 367504 - RNA, 32 nt, Human
ccaugcaggagggagagaagagugugauggca

SEQ ID NO: 367505 - RNA, 32 nt, Human
ccaugcaggaugacgccuucccggccugcaag

SEQ ID NO: 367506 - RNA, 32 nt, Human
ccaugcagggagggcacgaggaauaaugccgc

SEQ ID NO: 367507 - RNA, 32 nt, Human
ccaugcagggggcuccuggggguggggaggug

SEQ ID NO: 367508 - RNA, 19 nt, Human
cccacgcuggagugcaaug

SEQ ID NO: 367509 - RNA, 20 nt, Human
cccacgcuggagugcaaugg

SEQ ID NO: 367510 - RNA, 23 nt, Human
cccacgcuggagugcaauggugu

SEQ ID NO: 367511 - RNA, 19 nt, Human
cccacgcuggagugcagug

SEQ ID NO: 367512 - RNA, 22 nt, Human
cccacgcuggagugcugugaug

SEQ ID NO: 367513 - RNA, 32 nt, Human
cccacgcuggucuugaacuccugggcucaagc

SEQ ID NO: 367514 - RNA, 32 nt, Human
cccacggacuccuggucuggcccaauaaagac

SEQ ID NO: 367515 - RNA, 20 nt, Human
cccacggacuguaccaggca

SEQ ID NO: 367516 - RNA, 20 nt, Human
cccacggagagcuccaggca

SEQ ID NO: 367517 - RNA, 32 nt, Human
cccacggagauggauguccaggugcgcagagu

SEQ ID NO: 367518 - RNA, 32 nt, Human
cccacggaggcccccagcacacccaacguggc

SEQ ID NO: 367519 - RNA, 32 nt, Human
cccacggaggggacugcucucccccgcugcau

SEQ ID NO: 367520 - RNA, 32 nt, Human
cccacggaggggcaugcuuccacgcaccaagu

SEQ ID NO: 367521 - RNA, 32 nt, Human
cccacggaguaaggagacaugggggacuuuug

SEQ ID NO: 367522 - RNA, 32 nt, Human
cccacggaguuuggugacagagagugagcuug

SEQ ID NO: 367523 - RNA, 32 nt, Human
cccacggaucauucugaaucuuccugccccuc

SEQ ID NO: 367524 - RNA, 32 nt, Human
cccacggcaccuucuucugccuauuuagucaa

SEQ ID NO: 367525 - RNA, 32 nt, Human
cccacggcauccacccucuccagccagccccg

SEQ ID NO: 367526 - RNA, 32 nt, Human
cccacggccagacacaugcacacacaucacac

SEQ ID NO: 367527 - RNA, 22 nt, Human
cccacggcccacacgcucacuu

SEQ ID NO: 367528 - RNA, 19 nt, Human
cccacggccccgcucugcc

SEQ ID NO: 367529 - RNA, 24 nt, Human
cccacggccccucgggccccggcc

SEQ ID NO: 367530 - RNA, 17 nt, Human
cccacggcccugucaga

SEQ ID NO: 367531 - RNA, 32 nt, Human
cccacggcccuuaaacuugcugggcagguuug

SEQ ID NO: 367532 - RNA, 32 nt, Human
cccacggccgaauaccgugagccggaauccug

SEQ ID NO: 367533 - RNA, 32 nt, Human
cccacggcgggcaagggcccagcugugugcuc

SEQ ID NO: 367534 - RNA, 32 nt, Human
cccacggcugagggccuggcagcugcugcgcc

SEQ ID NO: 367535 - RNA, 32 nt, Human
cccacggcugauaggcugccuggugcgggcag

SEQ ID NO: 367536 - RNA, 32 nt, Human
cccacggcugggugguccuaagccacugggug

SEQ ID NO: 367537 - RNA, 32 nt, Human
cccacggcuucacucaggaccugcugggcuug

SEQ ID NO: 367538 - RNA, 32 nt, Human
cccacgggacccccaccaccagccucuugaag

SEQ ID NO: 367539 - RNA, 32 nt, Human
cccacgggagaggggagagggacgcacagcac

SEQ ID NO: 367540 - RNA, 32 nt, Human
cccacgggagcacuuccuacccccacgagggc

SEQ ID NO: 367541 - RNA, 32 nt, Human
cccacgggcccccagccccagccccucuccug

SEQ ID NO: 367542 - RNA, 21 nt, Human
cccacgggccccucaccccag

SEQ ID NO: 367543 - RNA, 32 nt, Human
cccacgggccugagagacuauaagagcguucc

SEQ ID NO: 367544 - RNA, 32 nt, Human
cccacgggccuuccaccucccucagcuuccug

SEQ ID NO: 367545 - RNA, 20 nt, Human
cccacgggcuccugccugcc

SEQ ID NO: 367546 - RNA, 32 nt, Human
cccacgggcugcagcggcagucgcgggggucc

SEQ ID NO: 367547 - RNA, 32 nt, Human
cccacggggaggagaaggaggaguggacccag

SEQ ID NO: 367548 - RNA, 32 nt, Human
cccacgggggcugcaguggauucacuguguca

SEQ ID NO: 367549 - RNA, 32 nt, Human
cccacgggggcugcauuucacacuccuccacc

SEQ ID NO: 367550 - RNA, 32 nt, Human
cccacgggucccggggauggcgucggagccgc

SEQ ID NO: 367551 - RNA, 32 nt, Human
cccacgggugugaccuugggggccagugugug

SEQ ID NO: 367552 - RNA, 32 nt, Human
cccacgguauucuuucuuugcaggucaccagu

SEQ ID NO: 367553 - RNA, 32 nt, Human
cccacggucuuccacuaccagccugggccucc

SEQ ID NO: 367554 - RNA, 32 nt, Human
cccacggugggcuuagccugccuaggcccuuc

SEQ ID NO: 367555 - RNA, 32 nt, Human
cccacguaaauauaugaauauauuucugacau

SEQ ID NO: 367556 - RNA, 28 nt, Human
cccacgucaggccuggccucaucucaga

SEQ ID NO: 367557 - RNA, 19 nt, Human
cccacguccccccuuugga

SEQ ID NO: 367558 - RNA, 32 nt, Human
cccacgucccuccugcagcccagcuccgcccg

SEQ ID NO: 367559 - RNA, 23 nt, Human
cccacguccuucucagccugccc

SEQ ID NO: 367560 - RNA, 32 nt, Human
cccacgucucagccacaguucuccacucgccu

SEQ ID NO: 367561 - RNA, 32 nt, Human
cccacgucucugucucugggccuuuguucccc

SEQ ID NO: 367562 - RNA, 32 nt, Human
cccacgucuguaaucccugcacuuugggaggc

SEQ ID NO: 367563 - RNA, 32 nt, Human
cccacgucuguuccucacccuccaucucuggg

SEQ ID NO: 367564 - RNA, 22 nt, Human
cccacgugcaaaaucaacauca

SEQ ID NO: 367565 - RNA, 32 nt, Human
cccacgugcagcccuguugggaagaaaggaag

SEQ ID NO: 367566 - RNA, 32 nt, Human
cccacgugccacucaauacaaauguucugcua

SEQ ID NO: 367567 - RNA, 32 nt, Human
cccacguggagcagcugcaggagcugcagacc

SEQ ID NO: 367568 - RNA, 32 nt, Human
cccacguggcagccccaccucuugagagcccc

SEQ ID NO: 367569 - RNA, 32 nt, Human
cccacguggcaucgauccucccugcccgcgaa

SEQ ID NO: 367570 - RNA, 23 nt, Human
cccacgugggcugggcggcugga

SEQ ID NO: 367571 - RNA, 32 nt, Human
cccacgugguguccccaaggaagggagaguug

SEQ ID NO: 367572 - RNA, 32 nt, Human
cccacgugucugcccagagucaaguccugugu

SEQ ID NO: 367573 - RNA, 19 nt, Human
cccacuaaccagacuggaa

SEQ ID NO: 367574 - RNA, 32 nt, Human
cccacuaaggagaaagaaguugauuccuucau

SEQ ID NO: 367575 - RNA, 32 nt, Human
cccacuaauaugcacauccagaaaaauuucca

SEQ ID NO: 367576 - RNA, 32 nt, Human
cccacuacaagugauccucaggcagguaaccc

SEQ ID NO: 367577 - RNA, 18 nt, Human
cccacuaccgcugccacg

SEQ ID NO: 367578 - RNA, 25 nt, Human
cccacuaccucauaagcugcaguga

SEQ ID NO: 367579 - RNA, 18 nt, Human
cccacuacucccuccuca

SEQ ID NO: 367580 - RNA, 32 nt, Human
cccacuacugcauuccagccuggguggacaga

SEQ ID NO: 367581 - RNA, 32 nt, Human
cccacuacuguacuccccucauggcccaggga

SEQ ID NO: 367582 - RNA, 32 nt, Human
cccacuacuuccuucccugccucccagcucag

SEQ ID NO: 367583 - RNA, 32 nt, Human
cccacuagacaaguccagccuggcaaggguuc

SEQ ID NO: 367584 - RNA, 32 nt, Human
cccacuagccaagagaaacagagaaagaccau

SEQ ID NO: 367585 - RNA, 17 nt, Human
cccacuagccccacuga

SEQ ID NO: 367586 - RNA, 30 nt, Human
cccacuagccucuccauacuuacuccucuc

SEQ ID NO: 367587 - RNA, 23 nt, Human
cccacuagcugggacuacaggca

SEQ ID NO: 367588 - RNA, 32 nt, Human
cccacuagggccugggguuaauugcucaaagg

SEQ ID NO: 367589 - RNA, 32 nt, Human
cccacuaggugaagcaugaguugucggagguc

SEQ ID NO: 367590 - RNA, 32 nt, Human
cccacuauccaucccagccucugguaaccauc

SEQ ID NO: 367591 - RNA, 32 nt, Human
cccacuaucuugcacacaggugcucuaaccau

SEQ ID NO: 367592 - RNA, 31 nt, Human
cccacuaugacccccagcuccuccagggaga

SEQ ID NO: 367593 - RNA, 32 nt, Human
cccacuauggacauaaaaauuuuugcaaggcc

SEQ ID NO: 367594 - RNA, 32 nt, Human
cccacucacaccuuccucccacagaaacagug

SEQ ID NO: 367595 - RNA, 32 nt, Human
cccacucaccccucagacuccugcugcccaug

SEQ ID NO: 367596 - RNA, 32 nt, Human
cccacucacugcacugggguccuugggguuug

SEQ ID NO: 367597 - RNA, 16 nt, Human
cccacucacugcccca

SEQ ID NO: 367598 - RNA, 32 nt, Human
cccacucagacuccugcguagcugggaccaca

SEQ ID NO: 367599 - RNA, 32 nt, Human
cccacucaggaggaguggaggcagguuguaga

SEQ ID NO: 367600 - RNA, 32 nt, Human
cccacucaggaugcaggcucuccccagggggc

SEQ ID NO: 367601 - RNA, 17 nt, Human
cccacucagugccucca

SEQ ID NO: 367602 - RNA, 32 nt, Human
cccacucaguguccccuccaaacuucacacuu

SEQ ID NO: 367603 - RNA, 32 nt, Human
cccacucaugcaaccguccucacuuuuccuuc

SEQ ID NO: 367604 - RNA, 32 nt, Human
cccacucaugcucuccagcgcuuggacuugcu

SEQ ID NO: 367605 - RNA, 32 nt, Human
cccacuccaaggucucugcugagagcugaaca

SEQ ID NO: 367606 - RNA, 32 nt, Human
cccacuccacccuggccaagaucugccugggc

SEQ ID NO: 367607 - RNA, 32 nt, Human
cccacuccacuccgcccagucugggacuccac

SEQ ID NO: 367608 - RNA, 32 nt, Human
cccacuccagcaccccagccagccugguacgc

SEQ ID NO: 367609 - RNA, 32 nt, Human
cccacuccagccgcaagcauaacugaagaaau

SEQ ID NO: 367610 - RNA, 32 nt, Human
cccacuccaggaaggcagcccaaucccuaggu

SEQ ID NO: 367611 - RNA, 32 nt, Human
cccacuccagugguggaggugcagucgcugga

SEQ ID NO: 367612 - RNA, 32 nt, Human
cccacuccauagccauguggauuuuuauccaa

SEQ ID NO: 367613 - RNA, 32 nt, Human
cccacuccauagucugguauucugagcacuag

SEQ ID NO: 367614 - RNA, 32 nt, Human
cccacuccaucaaucccugaccauguaaggcu

SEQ ID NO: 367615 - RNA, 32 nt, Human
cccacuccaucaucuccaggugccccacgccu

SEQ ID NO: 367616 - RNA, 17 nt, Human
cccacuccaugcugcuu

SEQ ID NO: 367617 - RNA, 21 nt, Human
cccacucccaaaccagagcca

SEQ ID NO: 367618 - RNA, 32 nt, Human
cccacucccacacuucuuugccuauaaaucuu

SEQ ID NO: 367619 - RNA, 32 nt, Human
cccacucccacucccucucucucccucucugc

SEQ ID NO: 367620 - RNA, 20 nt, Human
cccacucccagcccuccuca

SEQ ID NO: 367621 - RNA, 32 nt, Human
cccacucccagccggggcuccccacacacacu

SEQ ID NO: 367622 - RNA, 32 nt, Human
cccacucccaggcggggcaggaaggggccgag

SEQ ID NO: 367623 - RNA, 32 nt, Human
cccacuccccacccuucuccccuuccuuugcc

SEQ ID NO: 367624 - RNA, 32 nt, Human
cccacuccccaccuucaauuccugggccccaa

SEQ ID NO: 367625 - RNA, 32 nt, Human
cccacuccccacucucagccugggagacuccu

SEQ ID NO: 367626 - RNA, 32 nt, Human
cccacuccccacugagguccccaaaccccacc

SEQ ID NO: 367627 - RNA, 32 nt, Human
cccacuccccuccugacagguuccccaacagc

SEQ ID NO: 367628 - RNA, 32 nt, Human
cccacuccccucucuuccccagcaggcuguag

SEQ ID NO: 367629 - RNA, 32 nt, Human
cccacucccucacuuuuacuccuuccuccaac

SEQ ID NO: 367630 - RNA, 32 nt, Human
cccacucccuuuccccacuccuucuuuauugc

SEQ ID NO: 367631 - RNA, 32 nt, Human
cccacuccuagagacagcugugcucacuuuuc

SEQ ID NO: 367632 - RNA, 32 nt, Human
cccacuccuaucuccugccugucugccucugu

SEQ ID NO: 367633 - RNA, 32 nt, Human
cccacuccuauguacuauccccaaacuccuuu

SEQ ID NO: 367634 - RNA, 21 nt, Human
cccacuccucacacucuucua

SEQ ID NO: 367635 - RNA, 23 nt, Human
cccacuccuccaugaggggcuga

SEQ ID NO: 367636 - RNA, 32 nt, Human
cccacuccugaaccaugaggccucgcucuggg

SEQ ID NO: 367637 - RNA, 32 nt, Human
cccacuccugaagauccaucucuuggggcucc

SEQ ID NO: 367638 - RNA, 32 nt, Human
cccacuccugccccagcuguucuccagggcuu

SEQ ID NO: 367639 - RNA, 22 nt, Human
cccacuccugcucugcucgccu

SEQ ID NO: 367640 - RNA, 19 nt, Human
cccacuccugcugggcuga

SEQ ID NO: 367641 - RNA, 32 nt, Human
cccacuccugggcugcucagagcugcugcucc

SEQ ID NO: 367642 - RNA, 32 nt, Human
cccacuccugucaccgagacccccaggcuuca

SEQ ID NO: 367643 - RNA, 32 nt, Human
cccacuccuuuccugcauuucucccucccucc

SEQ ID NO: 367644 - RNA, 32 nt, Human
cccacucgauuccugcuccucagaccuccggg

SEQ ID NO: 367645 - RNA, 32 nt, Human
cccacucgccucaccugagccuggguggaaca

SEQ ID NO: 367646 - RNA, 32 nt, Human
cccacucggcccaggaggucagcagucuguuc

SEQ ID NO: 367647 - RNA, 32 nt, Human
cccacucggccuggccuuccucugccugcaag

SEQ ID NO: 367648 - RNA, 23 nt, Human
cccacucucaccucuccuccccu

SEQ ID NO: 367649 - RNA, 32 nt, Human
cccacucucagacccucuuuugucuucauuuu

SEQ ID NO: 367650 - RNA, 32 nt, Human
cccacucucaggccacugcccaccucacucag

SEQ ID NO: 367651 - RNA, 32 nt, Human
cccacucuccacccuacugcgugcucuuacuu

SEQ ID NO: 367652 - RNA, 32 nt, Human
cccacucuccaccucacuagcuccccaauccc

SEQ ID NO: 367653 - RNA, 32 nt, Human
cccacucuccacugcuuguccugcucucacgc

SEQ ID NO: 367654 - RNA, 22 nt, Human
cccacucuccagacccgccgcu

SEQ ID NO: 367655 - RNA, 20 nt, Human
cccacucuccagcucugccc

SEQ ID NO: 367656 - RNA, 20 nt, Human
cccacucucccagcuggacu

SEQ ID NO: 367657 - RNA, 19 nt, Human
cccacucuccccacacuaa

SEQ ID NO: 367658 - RNA, 22 nt, Human
cccacucuccccacccuccuca

SEQ ID NO: 367659 - RNA, 32 nt, Human
cccacucuccuccccucuuuuccuuccuuccu

SEQ ID NO: 367660 - RNA, 32 nt, Human
cccacucuccugcugcucggguucugaggcac

SEQ ID NO: 367661 - RNA, 23 nt, Human
cccacucucgugguaggcucccu

SEQ ID NO: 367662 - RNA, 32 nt, Human
cccacucucuucagcagccacccggcccuccc

SEQ ID NO: 367663 - RNA, 32 nt, Human
cccacucucuucucccccugacccccgcucca

SEQ ID NO: 367664 - RNA, 19 nt, Human
cccacucugaccccacuaa

SEQ ID NO: 367665 - RNA, 23 nt, Human
cccacucugcaaggcugcgguga

SEQ ID NO: 367666 - RNA, 21 nt, Human
cccacucugcccccgccuacc

SEQ ID NO: 367667 - RNA, 21 nt, Human
cccacucugcccguccaccuu

SEQ ID NO: 367668 - RNA, 32 nt, Human
cccacucugccucuugcuccuccagggcagca

SEQ ID NO: 367669 - RNA, 32 nt, Human
cccacucugcuccccaggcuugagugagugug

SEQ ID NO: 367670 - RNA, 21 nt, Human
cccacucugcucggccgccuu

SEQ ID NO: 367671 - RNA, 32 nt, Human
cccacucuggaauuucccuaccaauaaaagca

SEQ ID NO: 367672 - RNA, 32 nt, Human
cccacucuggucucaaacuccugggcucaacc

SEQ ID NO: 367673 - RNA, 32 nt, Human
cccacucugucacccaggcuggagugcagugg

SEQ ID NO: 367674 - RNA, 24 nt, Human
cccacucugucccuagcccagccu

SEQ ID NO: 367675 - RNA, 32 nt, Human
cccacucugucuccguuccuguccucaucucu

SEQ ID NO: 367676 - RNA, 32 nt, Human
cccacucugucugccugcaucuccucuguugc

SEQ ID NO: 367677 - RNA, 32 nt, Human
cccacucuguugcccaggcuagagugcaaugg

SEQ ID NO: 367678 - RNA, 22 nt, Human
cccacucuucccucagcucacc

SEQ ID NO: 367679 - RNA, 32 nt, Human
cccacucuugcccaggcuggagcgcaaguggc

SEQ ID NO: 367680 - RNA, 32 nt, Human
cccacucuuguucaagcgagugugugagcuau

SEQ ID NO: 367681 - RNA, 32 nt, Human
cccacucuuugccuccccgccccuucccugag

SEQ ID NO: 367682 - RNA, 32 nt, Human
cccacugaaaccaaggucuuuucaaauguggc

SEQ ID NO: 367683 - RNA, 20 nt, Human
cccacugaaaccuccaccuc

SEQ ID NO: 367684 - RNA, 32 nt, Human
cccacugaaauacaaaacuuaaccgggcuugg

SEQ ID NO: 367685 - RNA, 20 nt, Human
cccacugaagcuggcccagc

SEQ ID NO: 367686 - RNA, 32 nt, Human
cccacugaaguguucccuaaggaacagcauuu

SEQ ID NO: 367687 - RNA, 32 nt, Human
cccacugacccacucggauggaccaaccugcu

SEQ ID NO: 367688 - RNA, 32 nt, Human
cccacugacccccgcugccucccccaacaccg

SEQ ID NO: 367689 - RNA, 32 nt, Human
cccacugaccugcccauguccagagggacugg

SEQ ID NO: 367690 - RNA, 32 nt, Human
cccacugagcaucuccuucccgcccugugucc

SEQ ID NO: 367691 - RNA, 32 nt, Human
cccacugagccaagcccccuaacuuugggccu

SEQ ID NO: 367692 - RNA, 21 nt, Human
cccacugagccccagcugcug

SEQ ID NO: 367693 - RNA, 32 nt, Human
cccacugagggcccuggacagggcucauuaaa

SEQ ID NO: 367694 - RNA, 32 nt, Human
cccacugaggggucccuucagcaaagaccugg

SEQ ID NO: 367695 - RNA, 32 nt, Human
cccacugaggguggggcagcuguggggagcug

SEQ ID NO: 367696 - RNA, 32 nt, Human
cccacugagguccuagagugccuccagggugg

SEQ ID NO: 367697 - RNA, 32 nt, Human
cccacugaggugccccacagcagcagguguug

SEQ ID NO: 367698 - RNA, 32 nt, Human
cccacugaguggcuucagccucgcuggaagaa

SEQ ID NO: 367699 - RNA, 32 nt, Human
cccacugcaaacccacugcccucuucucccca

SEQ ID NO: 367700 - RNA, 32 nt, Human
cccacugcaaccucugccuccuggguucaagc

SEQ ID NO: 367701 - RNA, 32 nt, Human
cccacugcaagcuugaacauuugaugguggac

SEQ ID NO: 367702 - RNA, 32 nt, Human
cccacugcacuccagccugggugacagagcga

SEQ ID NO: 367703 - RNA, 32 nt, Human
cccacugcacuccagccugggugacagaggga

SEQ ID NO: 367704 - RNA, 32 nt, Human
cccacugcacucugcaaccaguguugccugcc

SEQ ID NO: 367705 - RNA, 32 nt, Human
cccacugcagcccuccagccucugguccccag

SEQ ID NO: 367706 - RNA, 32 nt, Human
cccacugcagcccucgaacuucccaggcaccc

SEQ ID NO: 367707 - RNA, 32 nt, Human
cccacugcagccuccaacuccugggcucaagc

SEQ ID NO: 367708 - RNA, 21 nt, Human
cccacugcaggcuguggcucc

SEQ ID NO: 367709 - RNA, 32 nt, Human
cccacugcaguggauacaaggaagggccuuuc

SEQ ID NO: 367710 - RNA, 32 nt, Human
cccacugcauaauguggaaacugaccucaaga

SEQ ID NO: 367711 - RNA, 32 nt, Human
cccacugcaucuggaguacagcuucuccuagg

SEQ ID NO: 367712 - RNA, 32 nt, Human
cccacugcauuccagccugggcaacagcguga

SEQ ID NO: 367713 - RNA, 32 nt, Human
cccacugcauuccagccugggugacagagcga

SEQ ID NO: 367714 - RNA, 32 nt, Human
cccacugccagcugccccuccugggagggccc

SEQ ID NO: 367715 - RNA, 32 nt, Human
cccacugccaggcuugccugugcuggggccac

SEQ ID NO: 367716 - RNA, 32 nt, Human
cccacugccaucacccagcaccccagaucacc

SEQ ID NO: 367717 - RNA, 21 nt, Human
cccacugccccaaaccggccu

SEQ ID NO: 367718 - RNA, 32 nt, Human
cccacugccuccaggaagccaaggagaauuau

SEQ ID NO: 367719 - RNA, 32 nt, Human
cccacugccucccuccuuccuggguggagcag

SEQ ID NO: 367720 - RNA, 32 nt, Human
cccacugccugcccagagccaucaggaugagc

SEQ ID NO: 367721 - RNA, 32 nt, Human
cccacugccuguguuugaauucugagugguuu

SEQ ID NO: 367722 - RNA, 32 nt, Human
cccacugcucuuccucuuaagaaagugcucca

SEQ ID NO: 367723 - RNA, 32 nt, Human
cccacugcugcacuuuagccugggugaaaaag

SEQ ID NO: 367724 - RNA, 32 nt, Human
cccacugcugccucuccaucccucucucauug

SEQ ID NO: 367725 - RNA, 32 nt, Human
cccacugcugccucuccugggcauggcuguua

SEQ ID NO: 367726 - RNA, 32 nt, Human
cccacugcuguccaccaugaguaggagggagg

SEQ ID NO: 367727 - RNA, 32 nt, Human
cccacugcuuccaaacucugccugugucccau

SEQ ID NO: 367728 - RNA, 32 nt, Human
cccacugcuucuuccuccuuucucaaccauca

SEQ ID NO: 367729 - RNA, 32 nt, Human
cccacuggaacucuccucacaccuggcagcuu

SEQ ID NO: 367730 - RNA, 32 nt, Human
cccacuggagguggagggugggaagagaaggg

SEQ ID NO: 367731 - RNA, 32 nt, Human
cccacuggagugauuucagugaaucagacaag

SEQ ID NO: 367732 - RNA, 21 nt, Human
cccacuggauccaggccccca

SEQ ID NO: 367733 - RNA, 32 nt, Human
cccacuggauccucuguagaauuagcagguca

SEQ ID NO: 367734 - RNA, 23 nt, Human
cccacuggcaccagcaguguggg

SEQ ID NO: 367735 - RNA, 21 nt, Human
cccacuggccaggacgcccca

SEQ ID NO: 367736 - RNA, 32 nt, Human
cccacuggccaggacucugagaucagagcugg

SEQ ID NO: 367737 - RNA, 21 nt, Human
cccacuggcccugcggcaucc

SEQ ID NO: 367738 - RNA, 32 nt, Human
cccacuggccgauucacucagugugggguccu

SEQ ID NO: 367739 - RNA, 23 nt, Human
cccacuggccucuucuggugcca

SEQ ID NO: 367740 - RNA, 21 nt, Human
cccacuggccugagcaugcca

SEQ ID NO: 367741 - RNA, 32 nt, Human
cccacuggcugccugggagccccacaccaccg

SEQ ID NO: 367742 - RNA, 21 nt, Human
cccacugggaccccgacacca

SEQ ID NO: 367743 - RNA, 32 nt, Human
cccacugggccggccacagucuggacccgcac

SEQ ID NO: 367744 - RNA, 32 nt, Human
cccacugggguguguggcagagccaggaccca

SEQ ID NO: 367745 - RNA, 32 nt, Human
cccacuggguagaaggaacagggagcggccag

SEQ ID NO: 367746 - RNA, 32 nt, Human
cccacuggguugccccggccaggccugcgagg

SEQ ID NO: 367747 - RNA, 32 nt, Human
cccacugguaugggccucccgccccuuccaca

SEQ ID NO: 367748 - RNA, 32 nt, Human
cccacuggucuuccaccuuccccagcucccuc

SEQ ID NO: 367749 - RNA, 28 nt, Human
cccacugguuacauauccauggcuccug

SEQ ID NO: 367750 - RNA, 32 nt, Human
cccacugguuuauagauccucugacuugugug

SEQ ID NO: 367751 - RNA, 32 nt, Human
cccacuguacauuuguugaauucugagaugcu

SEQ ID NO: 367752 - RNA, 32 nt, Human
cccacuguaccagaaaccagacuuguaucgac

SEQ ID NO: 367753 - RNA, 17 nt, Human
cccacuguagacaggaa

SEQ ID NO: 367754 - RNA, 32 nt, Human
cccacuguccucccgcugccccggguggugag

SEQ ID NO: 367755 - RNA, 21 nt, Human
cccacugucgugguggcccca

SEQ ID NO: 367756 - RNA, 32 nt, Human
cccacugucucuaaccacuccugggcuaagga

SEQ ID NO: 367757 - RNA, 32 nt, Human
cccacugugagugaggggccaagggaucuccu

SEQ ID NO: 367758 - RNA, 32 nt, Human
cccacugugcagcccccaagucaccagaguuu

SEQ ID NO: 367759 - RNA, 32 nt, Human
cccacugugcagcucaaaugugguguucacuc

SEQ ID NO: 367760 - RNA, 32 nt, Human
cccacugugccuaggacuugaggucccucuuu

SEQ ID NO: 367761 - RNA, 32 nt, Human
cccacugugccuuccgggccuccugggcuucu

SEQ ID NO: 367762 - RNA, 32 nt, Human
cccacugugcugcucuucagguccccacagcc

SEQ ID NO: 367763 - RNA, 32 nt, Human
cccacugugcuguagccugggugacaguguga

SEQ ID NO: 367764 - RNA, 32 nt, Human
cccacugugcuuuccucuaaccaaaauauacg

SEQ ID NO: 367765 - RNA, 32 nt, Human
cccacugugguucuggcaccuccagggcugau

SEQ ID NO: 367766 - RNA, 32 nt, Human
cccacuguucugaaaggagacauugcucuaug

SEQ ID NO: 367767 - RNA, 32 nt, Human
cccacuguucugaaaggagacauugcuuuaug

SEQ ID NO: 367768 - RNA, 32 nt, Human
cccacuguugcauuggggauuaauuuuccaac

SEQ ID NO: 367769 - RNA, 23 nt, Human
cccacuguuuccucuuucugcuu

SEQ ID NO: 367770 - RNA, 32 nt, Human
cccacuuacccugggcuggagaguugguuuca

SEQ ID NO: 367771 - RNA, 19 nt, Human
cccacuucacccccuacca

SEQ ID NO: 367772 - RNA, 32 nt, Human
cccacuucacucugucccaccugcuuucuguc

SEQ ID NO: 367773 - RNA, 32 nt, Human
cccacuuccaagcagaaaucgucacauguaag

SEQ ID NO: 367774 - RNA, 32 nt, Human
cccacuuccaucauuuccuucucccccaaccc

SEQ ID NO: 367775 - RNA, 21 nt, Human
cccacuucccaccccgucucc

SEQ ID NO: 367776 - RNA, 32 nt, Human
cccacuucccaguggcugcuuccuggggaccc

SEQ ID NO: 367777 - RNA, 20 nt, Human
cccacuuccccagucucgcc

SEQ ID NO: 367778 - RNA, 32 nt, Human
cccacuuccccucugugucugugucugugugu

SEQ ID NO: 367779 - RNA, 23 nt, Human
cccacuucccucagcccccaggg

SEQ ID NO: 367780 - RNA, 32 nt, Human
cccacuuccgacccucucaggccuuuuccgcu

SEQ ID NO: 367781 - RNA, 32 nt, Human
cccacuuccguggccaccuccaugcagaagcc

SEQ ID NO: 367782 - RNA, 15 nt, Human
cccacuuccuggcca

SEQ ID NO: 367783 - RNA, 32 nt, Human
cccacuuccuucuggccugggaggucuguaau

SEQ ID NO: 367784 - RNA, 32 nt, Human
cccacuuccuuuccuacuguccuggaaccugu

SEQ ID NO: 367785 - RNA, 32 nt, Human
cccacuuccuuugacccagaguugccuuccag

SEQ ID NO: 367786 - RNA, 16 nt, Human
cccacuucgcugugcc

SEQ ID NO: 367787 - RNA, 32 nt, Human
cccacuucgcuugccaucacagcacgccuauc

SEQ ID NO: 367788 - RNA, 32 nt, Human
cccacuucggcacagcugcucucccaugggug

SEQ ID NO: 367789 - RNA, 18 nt, Human
cccacuucucaucacaca

SEQ ID NO: 367790 - RNA, 32 nt, Human
cccacuucucuuccacugagcuucacuaauaa

SEQ ID NO: 367791 - RNA, 32 nt, Human
cccacuugacacagcacccgacucccaguuuc

SEQ ID NO: 367792 - RNA, 32 nt, Human
cccacuugagaccugcugcuuccuucaaaaug

SEQ ID NO: 367793 - RNA, 32 nt, Human
cccacuugagcccagauuccuggaagagcaga

SEQ ID NO: 367794 - RNA, 32 nt, Human
cccacuugcaaucccagcuauuugggaggcug

SEQ ID NO: 367795 - RNA, 22 nt, Human
cccacuugcgagccucaguccc

SEQ ID NO: 367796 - RNA, 32 nt, Human
cccacuuggacaccagucccuggguagauacc

SEQ ID NO: 367797 - RNA, 32 nt, Human
cccacuuggagcagugggaggaaaucuggguu

SEQ ID NO: 367798 - RNA, 20 nt, Human
cccacuuggccugcgugcug

SEQ ID NO: 367799 - RNA, 32 nt, Human
cccacuugggaaucugaggcagaggaggguga

SEQ ID NO: 367800 - RNA, 32 nt, Human
cccacuugugggaaccagccuccaagagggcc

SEQ ID NO: 367801 - RNA, 19 nt, Human
cccacuuucaccuccccac

SEQ ID NO: 367802 - RNA, 20 nt, Human
cccacuuucccacucaccuu

SEQ ID NO: 367803 - RNA, 32 nt, Human
cccacuuuccuucugucucuccuuccucccuu

SEQ ID NO: 367804 - RNA, 32 nt, Human
cccacuuucuccuuuuccuuccuuccuggcag

SEQ ID NO: 367805 - RNA, 22 nt, Human
cccacuuuucucccuccugucu

SEQ ID NO: 367806 - RNA, 32 nt, Human
cccagaaaaacagaaagagcaucuggggagcg

SEQ ID NO: 367807 - RNA, 32 nt, Human
cccagaaacuauuugaccaugauaauucaguu

SEQ ID NO: 367808 - RNA, 32 nt, Human
cccagaaagaccuggaaaggagcccagcaugu

SEQ ID NO: 367809 - RNA, 32 nt, Human
cccagaaagaggaaguuucuucaggaacagac

SEQ ID NO: 367810 - RNA, 21 nt, Human
cccagaaagaucuuucuagua

SEQ ID NO: 367811 - RNA, 22 nt, Human
cccagaaagcagaacccaggaa

SEQ ID NO: 367812 - RNA, 22 nt, Human
cccagaaaggaaacugaucucu

SEQ ID NO: 367813 - RNA, 32 nt, Human
cccagaaagggcccugcccuagacccugccag

SEQ ID NO: 367814 - RNA, 32 nt, Human
cccagaaagucacaggguacagcaacucauac

SEQ ID NO: 367815 - RNA, 32 nt, Human
cccagaaagugcucucaccuccgacacugguc

SEQ ID NO: 367816 - RNA, 32 nt, Human
cccagaaaguggagguuuccucuuggcauuuu

SEQ ID NO: 367817 - RNA, 24 nt, Human
cccagaaaguugaggcugcaguga

SEQ ID NO: 367818 - RNA, 32 nt, Human
cccagaacaaacacccuucagagccuaaccaa

SEQ ID NO: 367819 - RNA, 32 nt, Human
cccagaacaagaucuagcuucucauuugguca

SEQ ID NO: 367820 - RNA, 32 nt, Human
cccagaacaccgccuagaauuuggauuguaau

SEQ ID NO: 367821 - RNA, 32 nt, Human
cccagaacacuggccugaaucagccagcucuu

SEQ ID NO: 367822 - RNA, 21 nt, Human
cccagaacaucccuggcccca

SEQ ID NO: 367823 - RNA, 32 nt, Human
cccagaaccaaagaaugugaaggggguccaug

SEQ ID NO: 367824 - RNA, 32 nt, Human
cccagaaccagcuggcagcaagccucguauac

SEQ ID NO: 367825 - RNA, 32 nt, Human
cccagaaccccagguagguagagcaagaagau

SEQ ID NO: 367826 - RNA, 22 nt, Human
cccagaaccccaguagcagcag

SEQ ID NO: 367827 - RNA, 32 nt, Human
cccagaaccccugcccuggcagccuggaagac

SEQ ID NO: 367828 - RNA, 32 nt, Human
cccagaaccccuggccagucgcugggcugggc

SEQ ID NO: 367829 - RNA, 24 nt, Human
cccagaacccgccaaugcugggga

SEQ ID NO: 367830 - RNA, 23 nt, Human
cccagaacccuuggucuugccac

SEQ ID NO: 367831 - RNA, 32 nt, Human
cccagaaccgcucuccccuucccugcccagug

SEQ ID NO: 367832 - RNA, 20 nt, Human
cccagaaccucagaacgaga

SEQ ID NO: 367833 - RNA, 19 nt, Human
cccagaacuaugccuggag

SEQ ID NO: 367834 - RNA, 24 nt, Human
cccagaacucccugggcagagcca

SEQ ID NO: 367835 - RNA, 19 nt, Human
cccagaacucccuucaagg

SEQ ID NO: 367836 - RNA, 18 nt, Human
cccagaacuccuguagag

SEQ ID NO: 367837 - RNA, 18 nt, Human
cccagaacucgucuguga

SEQ ID NO: 367838 - RNA, 20 nt, Human
cccagaacucugugcccagg

SEQ ID NO: 367839 - RNA, 18 nt, Human
cccagaacuggcaugugg

SEQ ID NO: 367840 - RNA, 32 nt, Human
cccagaacugugaauggccugcuccaggccau

SEQ ID NO: 367841 - RNA, 25 nt, Human
cccagaacuucagaacuguguggag

SEQ ID NO: 367842 - RNA, 19 nt, Human
cccagaacuuccuccccac

SEQ ID NO: 367843 - RNA, 32 nt, Human
cccagaagacacaccuggccuccagcaggcug

SEQ ID NO: 367844 - RNA, 21 nt, Human
cccagaagacacuccuggcca

SEQ ID NO: 367845 - RNA, 20 nt, Human
cccagaagacaggcugcagu

SEQ ID NO: 367846 - RNA, 22 nt, Human
cccagaagacaggcugcaguga

SEQ ID NO: 367847 - RNA, 21 nt, Human
cccagaagaccaaccccugug

SEQ ID NO: 367848 - RNA, 19 nt, Human
cccagaagaccaagagcca

SEQ ID NO: 367849 - RNA, 32 nt, Human
cccagaagaggaagaagaggaaggaaaaggag

SEQ ID NO: 367850 - RNA, 23 nt, Human
cccagaagaggacacaccagccc

SEQ ID NO: 367851 - RNA, 32 nt, Human
cccagaagcacugggccuuggccacagcaaca

SEQ ID NO: 367852 - RNA, 19 nt, Human
cccagaagcagcucugggc

SEQ ID NO: 367853 - RNA, 20 nt, Human
cccagaagcaguggcuggga

SEQ ID NO: 367854 - RNA, 23 nt, Human
cccagaagcgggcccucaggcca

SEQ ID NO: 367855 - RNA, 24 nt, Human
cccagaagcucaaggcugcaguga

SEQ ID NO: 367856 - RNA, 24 nt, Human
cccagaagcuugaagcugcaguga

SEQ ID NO: 367857 - RNA, 21 nt, Human
cccagaaggaaaucucugacc

SEQ ID NO: 367858 - RNA, 32 nt, Human
cccagaaggaagcaacaaagacagcaacugaa

SEQ ID NO: 367859 - RNA, 31 nt, Human
cccagaaggagcuucuuuaccucuuagcccu

SEQ ID NO: 367860 - RNA, 32 nt, Human
cccagaaggaggaggagaugaaggugaagcug

SEQ ID NO: 367861 - RNA, 32 nt, Human
cccagaaggaggcagagcuccgcagcuggauc

SEQ ID NO: 367862 - RNA, 19 nt, Human
cccagaaggcagagcagga

SEQ ID NO: 367863 - RNA, 24 nt, Human
cccagaaggcagagcuugcaguga

SEQ ID NO: 367864 - RNA, 24 nt, Human
cccagaaggcagagguagugguga

SEQ ID NO: 367865 - RNA, 24 nt, Human
cccagaaggcagagguugcaguga

SEQ ID NO: 367866 - RNA, 32 nt, Human
cccagaaggcagagguugcagugagcugagau

SEQ ID NO: 367867 - RNA, 23 nt, Human
cccagaaggcagagguugcauga

SEQ ID NO: 367868 - RNA, 24 nt, Human
cccagaaggcagagguuguaguga

SEQ ID NO: 367869 - RNA, 32 nt, Human
cccagaaggcagggaaaggcucugaaagccag

SEQ ID NO: 367870 - RNA, 32 nt, Human
cccagaaggcagggguugcagugagccaagau

SEQ ID NO: 367871 - RNA, 22 nt, Human
cccagaaggcgaagguugcagu

SEQ ID NO: 367872 - RNA, 24 nt, Human
cccagaaggcgaagguugcaguga

SEQ ID NO: 367873 - RNA, 24 nt, Human
cccagaaggcggaaguugcaguga

SEQ ID NO: 367874 - RNA, 32 nt, Human
cccagaaggcggaaguugcagugagccgagac

SEQ ID NO: 367875 - RNA, 32 nt, Human
cccagaaggcggaaguugcagugagccgagau

SEQ ID NO: 367876 - RNA, 32 nt, Human
cccagaaggcggaaguugcagugagcugagau

SEQ ID NO: 367877 - RNA, 32 nt, Human
cccagaaggggagcaggaggagagggaaguag

SEQ ID NO: 367878 - RNA, 24 nt, Human
cccagaaggucgaggcugcaggga

SEQ ID NO: 367879 - RNA, 24 nt, Human
cccagaaggucgaggcugcaguga

SEQ ID NO: 367880 - RNA, 32 nt, Human
cccagaaggucgaggcugcagugagcugagau

SEQ ID NO: 367881 - RNA, 22 nt, Human
cccagaaggugcagguugcagu

SEQ ID NO: 367882 - RNA, 24 nt, Human
cccagaaggugcagguugcaguga

SEQ ID NO: 367883 - RNA, 32 nt, Human
cccagaaggugcagguugcagugagcugagau

SEQ ID NO: 367884 - RNA, 32 nt, Human
cccagaagguggagguagcagugagccgagau

SEQ ID NO: 367885 - RNA, 32 nt, Human
cccagaagguggagguugcagugagccgagau

SEQ ID NO: 367886 - RNA, 20 nt, Human
cccagaaggugugagcuguc

SEQ ID NO: 367887 - RNA, 24 nt, Human
cccagaagguugagacugcaguga

SEQ ID NO: 367888 - RNA, 32 nt, Human
cccagaaguaccuuugcacuccugguuuucag

SEQ ID NO: 367889 - RNA, 32 nt, Human
cccagaaguagaagaauggggauggaguggug

SEQ ID NO: 367890 - RNA, 31 nt, Human
cccagaagugagagcaguuggcugcgcccca

SEQ ID NO: 367891 - RNA, 31 nt, Human
cccagaagugagagcaguuggcugugcccca

SEQ ID NO: 367892 - RNA, 32 nt, Human
cccagaaguggagaaccuuucccaccuguaga

SEQ ID NO: 367893 - RNA, 24 nt, Human
cccagaaguucaagaccagccuga

SEQ ID NO: 367894 - RNA, 24 nt, Human
cccagaaguucaaggcugcaauga

SEQ ID NO: 367895 - RNA, 21 nt, Human
cccagaaguucccucugccca

SEQ ID NO: 367896 - RNA, 24 nt, Human
cccagaaguuugaggcugcaauga

SEQ ID NO: 367897 - RNA, 24 nt, Human
cccagaaguuugaggcugcaguga

SEQ ID NO: 367898 - RNA, 32 nt, Human
cccagaaucuacugggcucugcagagagccca

SEQ ID NO: 367899 - RNA, 32 nt, Human
cccagaaucuagaagaauaaaugccaagaggg

SEQ ID NO: 367900 - RNA, 32 nt, Human
cccagaaucuguguuuuuaaaauacuacauga

SEQ ID NO: 367901 - RNA, 32 nt, Human
cccagaaugccacuccuguguuccccugcaag

SEQ ID NO: 367902 - RNA, 23 nt, Human
cccagaaugggaaccucagagaa

SEQ ID NO: 367903 - RNA, 32 nt, Human
cccagaauguacuuaucuuaccucggcaugua

SEQ ID NO: 367904 - RNA, 32 nt, Human
cccagaauguggcaguggaggugguagccucc

SEQ ID NO: 367905 - RNA, 31 nt, Human
cccagaauguugacagucgcucuccuagccc

SEQ ID NO: 367906 - RNA, 32 nt, Human
cccagaauucugauuccauguguaaugcgaau

SEQ ID NO: 367907 - RNA, 32 nt, Human
cccagaauucugggcaagucacccaggaugcu

SEQ ID NO: 367908 - RNA, 32 nt, Human
cccagaauugcaguucagaauggcaguccugg

SEQ ID NO: 367909 - RNA, 32 nt, Human
cccagaauuucucaucaggagugggcaagacc

SEQ ID NO: 367910 - RNA, 32 nt, Human
cccagaauuugaggccagccugggcaacguga

SEQ ID NO: 367911 - RNA, 32 nt, Human
cccagacaagcagcuggguuggcuucugagaa

SEQ ID NO: 367912 - RNA, 32 nt, Human
cccagacacaugcuaacaggaccuacaggaug

SEQ ID NO: 367913 - RNA, 32 nt, Human
cccagacaccuugcucccucucccaaaucaca

SEQ ID NO: 367914 - RNA, 32 nt, Human
cccagacacgacgacuucgcucggaggcacau

SEQ ID NO: 367915 - RNA, 18 nt, Human
cccagacacgcagucugc

SEQ ID NO: 367916 - RNA, 32 nt, Human
cccagacagcagcuguccccugugcuggugug

SEQ ID NO: 367917 - RNA, 32 nt, Human
cccagacagcaguucagaagucucauuacaca

SEQ ID NO: 367918 - RNA, 23 nt, Human
cccagacagccccagcccaguca

SEQ ID NO: 367919 - RNA, 32 nt, Human
cccagacagccuccuccaccauucccuucauc

SEQ ID NO: 367920 - RNA, 32 nt, Human
cccagacagccuguuucuauccuguuuaauaa

SEQ ID NO: 367921 - RNA, 32 nt, Human
cccagacagcuggcgcucacacauucaccguu

SEQ ID NO: 367922 - RNA, 32 nt, Human
cccagacaggcccacagacgagggcuggucuc

SEQ ID NO: 367923 - RNA, 23 nt, Human
cccagacaggccugggcccuggg

SEQ ID NO: 367924 - RNA, 32 nt, Human
cccagacaggguggccaggcagaggugcuccu

SEQ ID NO: 367925 - RNA, 32 nt, Human
cccagacagguggcgaaggcagaggagugguc

SEQ ID NO: 367926 - RNA, 32 nt, Human
cccagacagguggcgacggcagaggagcggaa

SEQ ID NO: 367927 - RNA, 32 nt, Human
cccagacaucaccuuucauucuggaccuacca

SEQ ID NO: 367928 - RNA, 18 nt, Human
cccagacaucccgaggaa

SEQ ID NO: 367929 - RNA, 17 nt, Human
cccagaccaacucccca

SEQ ID NO: 367930 - RNA, 32 nt, Human
cccagaccacggcagggcaugaccuggggagg

SEQ ID NO: 367931 - RNA, 20 nt, Human
cccagaccagagacaguggc

SEQ ID NO: 367932 - RNA, 21 nt, Human
cccagacccacagcccguguu

SEQ ID NO: 367933 - RNA, 22 nt, Human
cccagacccaccuccugcccca

SEQ ID NO: 367934 - RNA, 32 nt, Human
cccagacccagccugaccaacgauggcauuuc

SEQ ID NO: 367935 - RNA, 32 nt, Human
cccagacccagccugccuaaaggggcugccuu

SEQ ID NO: 367936 - RNA, 32 nt, Human
cccagacccaggaaguauaagucauugacagu

SEQ ID NO: 367937 - RNA, 32 nt, Human
cccagaccccaggaucagggagguguaaguag

SEQ ID NO: 367938 - RNA, 32 nt, Human
cccagacccuccagaucagcucagaguuugaa

SEQ ID NO: 367939 - RNA, 32 nt, Human
cccagacccucuugccuccagugagaaggaga

SEQ ID NO: 367940 - RNA, 32 nt, Human
cccagaccgagaaggucggaggcagaagccgg

SEQ ID NO: 367941 - RNA, 32 nt, Human
cccagaccucaagugauccgcccgccuuggcc

SEQ ID NO: 367942 - RNA, 32 nt, Human
cccagaccucaccuccaucccccucugucugc

SEQ ID NO: 367943 - RNA, 32 nt, Human
cccagaccucacuugccucugccuccaucuug

SEQ ID NO: 367944 - RNA, 32 nt, Human
cccagaccuccaccuccuccagacccccuccc

SEQ ID NO: 367945 - RNA, 18 nt, Human
cccagaccuccccacuga

SEQ ID NO: 367946 - RNA, 24 nt, Human
cccagaccugccccuuucacuagg

SEQ ID NO: 367947 - RNA, 32 nt, Human
cccagaccugcuccccugucccuggggaggag

SEQ ID NO: 367948 - RNA, 21 nt, Human
cccagaccuggccaggccagc

SEQ ID NO: 367949 - RNA, 32 nt, Human
cccagaccugggauggcggaggccggccugag

SEQ ID NO: 367950 - RNA, 32 nt, Human
cccagaccuggucaucugcagcucuggcccag

SEQ ID NO: 367951 - RNA, 32 nt, Human
cccagaccugugaaggugggagcagcucacca

SEQ ID NO: 367952 - RNA, 32 nt, Human
cccagacgccaggaaaagaagaaacaacaaag

SEQ ID NO: 367953 - RNA, 19 nt, Human
cccagacgcgcaggccaag

SEQ ID NO: 367954 - RNA, 32 nt, Human
cccagacgcggagaaaauggcggcaggggucg

SEQ ID NO: 367955 - RNA, 24 nt, Human
cccagacgcgggcgccacaugccc

SEQ ID NO: 367956 - RNA, 32 nt, Human
cccagacgggcuucugcauccauucccucuuu

SEQ ID NO: 367957 - RNA, 22 nt, Human
cccagacuaaaggcuacaguga

SEQ ID NO: 367958 - RNA, 20 nt, Human
cccagacuagaaugcagugg

SEQ ID NO: 367959 - RNA, 20 nt, Human
cccagacuagagugcaaugg

SEQ ID NO: 367960 - RNA, 20 nt, Human
cccagacuagagugcagugg

SEQ ID NO: 367961 - RNA, 21 nt, Human
cccagacuagagugcaguggc

SEQ ID NO: 367962 - RNA, 32 nt, Human
cccagacuauccagagugaaugcagcuccgcu

SEQ ID NO: 367963 - RNA, 32 nt, Human
cccagacucaaggccuccagccacuuauuucc

SEQ ID NO: 367964 - RNA, 32 nt, Human
cccagacucacacaucuuccuccaggucaggg

SEQ ID NO: 367965 - RNA, 23 nt, Human
cccagacucagugggagcccugg

SEQ ID NO: 367966 - RNA, 32 nt, Human
cccagacuccagcccuggaccgcgcaucccga

SEQ ID NO: 367967 - RNA, 19 nt, Human
cccagacuccaggugccuu

SEQ ID NO: 367968 - RNA, 32 nt, Human
cccagacucccagagagaaaauaaccucgcca

SEQ ID NO: 367969 - RNA, 32 nt, Human
cccagacucccagggcaccugcuugcaccuuu

SEQ ID NO: 367970 - RNA, 32 nt, Human
cccagacuccgccugaggccagccugcgggaa

SEQ ID NO: 367971 - RNA, 32 nt, Human
cccagacucggccuccucuccugggacucggc

SEQ ID NO: 367972 - RNA, 32 nt, Human
cccagacucuaggaagcuggaauggagggcag

SEQ ID NO: 367973 - RNA, 32 nt, Human
cccagacucugucugugccgaguguauuauaa

SEQ ID NO: 367974 - RNA, 21 nt, Human
cccagacugcagguuaucuga

SEQ ID NO: 367975 - RNA, 20 nt, Human
cccagacuggaaugcaguga

SEQ ID NO: 367976 - RNA, 20 nt, Human
cccagacuggacugcagugg

SEQ ID NO: 367977 - RNA, 19 nt, Human
cccagacuggagugcaaug

SEQ ID NO: 367978 - RNA, 19 nt, Human
cccagacuggagugcaggg

SEQ ID NO: 367979 - RNA, 19 nt, Human
cccagacuggagugcagug

SEQ ID NO: 367980 - RNA, 20 nt, Human
cccagacuggagugcagugg

SEQ ID NO: 367981 - RNA, 21 nt, Human
cccagacuggagugcaguggc

SEQ ID NO: 367982 - RNA, 23 nt, Human
cccagacuggagugcaguggugu

SEQ ID NO: 367983 - RNA, 19 nt, Human
cccagacuggagugcgaug

SEQ ID NO: 367984 - RNA, 20 nt, Human
cccagacuggagugcugugg

SEQ ID NO: 367985 - RNA, 32 nt, Human
cccagacuggcggaucaccugaggucaggaga

SEQ ID NO: 367986 - RNA, 20 nt, Human
cccagacuggcgugcagugg

SEQ ID NO: 367987 - RNA, 24 nt, Human
cccagacugggaaccaccaucuga

SEQ ID NO: 367988 - RNA, 32 nt, Human
cccagacuggggccuuugcccucaaggggguu

SEQ ID NO: 367989 - RNA, 32 nt, Human
cccagacuggucucgaacuccugggcucaaac

SEQ ID NO: 367990 - RNA, 32 nt, Human
cccagacugugagcuccuugagggcagggacu

SEQ ID NO: 367991 - RNA, 32 nt, Human
cccagacuuccuuuguguuaguuaauaaagcu

SEQ ID NO: 367992 - RNA, 32 nt, Human
cccagacuucuccacgcgcuggcuccauaaag

SEQ ID NO: 367993 - RNA, 32 nt, Human
cccagacuucugucuuuucagcugcagugaag

SEQ ID NO: 367994 - RNA, 32 nt, Human
cccagacuugaacaucagcagagaugcggugc

SEQ ID NO: 367995 - RNA, 32 nt, Human
cccagacuugcaggcucacggugcagggugaa

SEQ ID NO: 367996 - RNA, 24 nt, Human
cccagacuugggccguugcucuga

SEQ ID NO: 367997 - RNA, 24 nt, Human
cccagacuugggcuguugcucuga

SEQ ID NO: 367998 - RNA, 32 nt, Human
cccagacuuuacaugacacagcuuuaucacca

SEQ ID NO: 367999 - RNA, 19 nt, Human
cccagagaaaaccauguac

SEQ ID NO: 368000 - RNA, 32 nt, Human
cccagagaaaagagccucagcaagagaguuuu

SEQ ID NO: 368001 - RNA, 20 nt, Human
cccagagaaauacugacgaa

SEQ ID NO: 368002 - RNA, 32 nt, Human
cccagagaaccuagcagagagcucuguacgug

SEQ ID NO: 368003 - RNA, 20 nt, Human
cccagagaaggaacuucgaa

SEQ ID NO: 368004 - RNA, 32 nt, Human
cccagagaauggcugagcaggacagugggaga

SEQ ID NO: 368005 - RNA, 32 nt, Human
cccagagacaucgauucaccccaaagugcugg

SEQ ID NO: 368006 - RNA, 20 nt, Human
cccagagaccaagaucauca

SEQ ID NO: 368007 - RNA, 32 nt, Human
cccagagaccuccaccucaacuucuggcuguc

SEQ ID NO: 368008 - RNA, 32 nt, Human
cccagagaccuucugaucuccaaaaagaggag

SEQ ID NO: 368009 - RNA, 21 nt, Human
cccagagaccuuugcccacac

SEQ ID NO: 368010 - RNA, 23 nt, Human
cccagagacuaggacccaaagaa

SEQ ID NO: 368011 - RNA, 22 nt, Human
cccagagacucccucacccagg

SEQ ID NO: 368012 - RNA, 32 nt, Human
cccagagacucuuuucagcagaaaguuaugcu

SEQ ID NO: 368013 - RNA, 32 nt, Human
cccagagagaaaaagagagagcaggguggggu

SEQ ID NO: 368014 - RNA, 32 nt, Human
cccagagagaaaaagcaucccaccuggggagg

SEQ ID NO: 368015 - RNA, 32 nt, Human
cccagagagacaccagagaacccaccauggcc

SEQ ID NO: 368016 - RNA, 32 nt, Human
cccagagagacagggccaucccucaugucugu

SEQ ID NO: 368017 - RNA, 18 nt, Human
cccagagagaccaugcau

SEQ ID NO: 368018 - RNA, 32 nt, Human
cccagagagacugccuucccuacacuagaagu

SEQ ID NO: 368019 - RNA, 32 nt, Human
cccagagagagcuguccgccagugcaucauua

SEQ ID NO: 368020 - RNA, 32 nt, Human
cccagagagcaucuggcuucaauuuuccuuuu

SEQ ID NO: 368021 - RNA, 32 nt, Human
cccagagagccccagagcucucaagcuccuuu

SEQ ID NO: 368022 - RNA, 21 nt, Human
cccagagagccccucauccuu

SEQ ID NO: 368023 - RNA, 32 nt, Human
cccagagagcuuguucccucccucccugugca

SEQ ID NO: 368024 - RNA, 32 nt, Human
cccagagaggaugccacagggaaaguaugaaa

SEQ ID NO: 368025 - RNA, 32 nt, Human
cccagagaggggaagagauucauccaaggcaa

SEQ ID NO: 368026 - RNA, 24 nt, Human
cccagagaggguagcuaccuugcc

SEQ ID NO: 368027 - RNA, 32 nt, Human
cccagagaguccauacaaauucugcuccggga

SEQ ID NO: 368028 - RNA, 22 nt, Human
cccagagaguggauggccaagu

SEQ ID NO: 368029 - RNA, 32 nt, Human
cccagagaucagcagggucgcuggacuaggau

SEQ ID NO: 368030 - RNA, 32 nt, Human
cccagagaugccccaggguggaggggguggga

SEQ ID NO: 368031 - RNA, 32 nt, Human
cccagagcaaaauaauucaguguaauacaucu

SEQ ID NO: 368032 - RNA, 32 nt, Human
cccagagcaaucuagaaucuuugagugcuugg

SEQ ID NO: 368033 - RNA, 32 nt, Human
cccagagcaaugacaccagucuggacucuggg

SEQ ID NO: 368034 - RNA, 32 nt, Human
cccagagcacagagagagcugggaugaagaau

SEQ ID NO: 368035 - RNA, 32 nt, Human
cccagagcaccaacagcacccagcccacggcu

SEQ ID NO: 368036 - RNA, 32 nt, Human
cccagagcacucugcgcccccagccugcccca

SEQ ID NO: 368037 - RNA, 32 nt, Human
cccagagcagagccccuuaccucccaggucag

SEQ ID NO: 368038 - RNA, 32 nt, Human
cccagagcagcaaacacaugaaagucagaagu

SEQ ID NO: 368039 - RNA, 32 nt, Human
cccagagcagcaucucucucauccuggaaggc

SEQ ID NO: 368040 - RNA, 32 nt, Human
cccagagcagguguugcagacaggagggccac

SEQ ID NO: 368041 - RNA, 20 nt, Human
cccagagccaacuuacccca

SEQ ID NO: 368042 - RNA, 22 nt, Human
cccagagccaagguggcuggga

SEQ ID NO: 368043 - RNA, 24 nt, Human
cccagagccacacaacucuugagg

SEQ ID NO: 368044 - RNA, 32 nt, Human
cccagagccacccgcuaugagcacaggccggg

SEQ ID NO: 368045 - RNA, 32 nt, Human
cccagagccacgggucuugcugugcugggggu

SEQ ID NO: 368046 - RNA, 32 nt, Human
cccagagccagccugggauugucagccuucaa

SEQ ID NO: 368047 - RNA, 32 nt, Human
cccagagccagcgucuucauggggaagaugaa

SEQ ID NO: 368048 - RNA, 32 nt, Human
cccagagccaggcggugcaggagccaggccca

SEQ ID NO: 368049 - RNA, 32 nt, Human
cccagagccaggggacagguuggggcuguggg

SEQ ID NO: 368050 - RNA, 32 nt, Human
cccagagccaggggagccagagcugcuuuagc

SEQ ID NO: 368051 - RNA, 26 nt, Human
cccagagcccaaggaagagcugggaa

SEQ ID NO: 368052 - RNA, 20 nt, Human
cccagagcccccuccccagc

SEQ ID NO: 368053 - RNA, 32 nt, Human
cccagagcccccugucccccagcuucagccgg

SEQ ID NO: 368054 - RNA, 32 nt, Human
cccagagcccucucccugucacucccugaaac

SEQ ID NO: 368055 - RNA, 32 nt, Human
cccagagccgggcccuguuuccuuggacgggg

SEQ ID NO: 368056 - RNA, 32 nt, Human
cccagagccuccagaggaaugcagcccuguug

SEQ ID NO: 368057 - RNA, 23 nt, Human
cccagagccucccaaggcuggga

SEQ ID NO: 368058 - RNA, 24 nt, Human
cccagagccucccaaggcugggaa

SEQ ID NO: 368059 - RNA, 21 nt, Human
cccagagccuccgccuguggc

SEQ ID NO: 368060 - RNA, 21 nt, Human
cccagagccuccuggcccccg

SEQ ID NO: 368061 - RNA, 32 nt, Human
cccagagccuuguuuggcccugaucucugacu

SEQ ID NO: 368062 - RNA, 23 nt, Human
cccagagcggaagauugcgguga

SEQ ID NO: 368063 - RNA, 32 nt, Human
cccagagcgggacaaaccagaggcccuuugca

SEQ ID NO: 368064 - RNA, 32 nt, Human
cccagagcguccacagcaccauucccagugua

SEQ ID NO: 368065 - RNA, 32 nt, Human
cccagagcuaaccccugucuucuuccccaggc

SEQ ID NO: 368066 - RNA, 24 nt, Human
cccagagcuacagcugggcuggga

SEQ ID NO: 368067 - RNA, 32 nt, Human
cccagagcucagaacuaacugugagauguacc

SEQ ID NO: 368068 - RNA, 32 nt, Human
cccagagcuggaccugagcuauucucacucgg

SEQ ID NO: 368069 - RNA, 32 nt, Human
cccagagcuggccucccccaacaccugcugcg

SEQ ID NO: 368070 - RNA, 32 nt, Human
cccagagcuuccaugcaaaggaauucuucaag

SEQ ID NO: 368071 - RNA, 32 nt, Human
cccagagcuucuuccuuuggcuacgcaggaug

SEQ ID NO: 368072 - RNA, 32 nt, Human
cccagagcuuguggcuuugaugccauuugucu

SEQ ID NO: 368073 - RNA, 32 nt, Human
cccagaggaaaagaagucacaguuaugaaaga

SEQ ID NO: 368074 - RNA, 17 nt, Human
cccagaggaaagcuguu

SEQ ID NO: 368075 - RNA, 30 nt, Human
cccagaggaagcccagggcccagccaacuc

SEQ ID NO: 368076 - RNA, 32 nt, Human
cccagaggacaguggguggagugguaccuacu

SEQ ID NO: 368077 - RNA, 21 nt, Human
cccagaggaccccucccuggc

SEQ ID NO: 368078 - RNA, 32 nt, Human
cccagaggacucccguggugggcacaguucua

SEQ ID NO: 368079 - RNA, 32 nt, Human
cccagaggagaggagacagacacacacuggcu

SEQ ID NO: 368080 - RNA, 32 nt, Human
cccagaggagaggauaggaaccucuccuccag

SEQ ID NO: 368081 - RNA, 22 nt, Human
cccagaggagagugugcacuca

SEQ ID NO: 368082 - RNA, 32 nt, Human
cccagaggagccaagccgcacagacccgagaa

SEQ ID NO: 368083 - RNA, 32 nt, Human
cccagaggagcucuuaccuggcccagaaucug

SEQ ID NO: 368084 - RNA, 22 nt, Human
cccagaggcacauccggacaag

SEQ ID NO: 368085 - RNA, 23 nt, Human
cccagaggcagagguugcaguga

SEQ ID NO: 368086 - RNA, 23 nt, Human
cccagaggcagagguugcgguga

SEQ ID NO: 368087 - RNA, 23 nt, Human
cccagaggcagagguugugguga

SEQ ID NO: 368088 - RNA, 32 nt, Human
cccagaggcagugggagcuguuggggagccgu

SEQ ID NO: 368089 - RNA, 18 nt, Human
cccagaggccagggccag

SEQ ID NO: 368090 - RNA, 32 nt, Human
cccagaggcccaggcugaucggugucggagcg

SEQ ID NO: 368091 - RNA, 22 nt, Human
cccagaggcccuccuguccgaa

SEQ ID NO: 368092 - RNA, 25 nt, Human
cccagaggccucugaaccccagggu

SEQ ID NO: 368093 - RNA, 32 nt, Human
cccagaggccugcucuccucacacauugugug

SEQ ID NO: 368094 - RNA, 23 nt, Human
cccagaggcggagguuguaguga

SEQ ID NO: 368095 - RNA, 32 nt, Human
cccagaggcugaagcaaacagugucccuucug

SEQ ID NO: 368096 - RNA, 32 nt, Human
cccagaggcugaggcaggcggaucaccugagg

SEQ ID NO: 368097 - RNA, 32 nt, Human
cccagaggcugaucugcaaaucaagcuacaug

SEQ ID NO: 368098 - RNA, 32 nt, Human
cccagaggcugcagagagcaaaacagcugcca

SEQ ID NO: 368099 - RNA, 18 nt, Human
cccagaggcugggcccug

SEQ ID NO: 368100 - RNA, 18 nt, Human
cccagaggcugggucccu

SEQ ID NO: 368101 - RNA, 23 nt, Human
cccagaggcuuuuccagcaccca

SEQ ID NO: 368102 - RNA, 32 nt, Human
cccagagggaaagaccuugccuuagaagaaga

SEQ ID NO: 368103 - RNA, 32 nt, Human
cccagagggaaagaggagaaaugugagacuua

SEQ ID NO: 368104 - RNA, 32 nt, Human
cccagagggaaaggagguuugccagagggacc

SEQ ID NO: 368105 - RNA, 16 nt, Human
cccagagggaguuguc

SEQ ID NO: 368106 - RNA, 32 nt, Human
cccagagggauauugcuucaguugaccucauu

SEQ ID NO: 368107 - RNA, 32 nt, Human
cccagagggcacuuucagcugcccucaauaau

SEQ ID NO: 368108 - RNA, 21 nt, Human
cccagagggcagaagcagcgu

SEQ ID NO: 368109 - RNA, 32 nt, Human
cccagagggcucaggaugccccaggaaggaaa

SEQ ID NO: 368110 - RNA, 16 nt, Human
cccagaggggagccgg

SEQ ID NO: 368111 - RNA, 18 nt, Human
cccagagggggcaugcac

SEQ ID NO: 368112 - RNA, 32 nt, Human
cccagagggucagaacuggacagcugcagaga

SEQ ID NO: 368113 - RNA, 21 nt, Human
cccagaggucaagacugcagu

SEQ ID NO: 368114 - RNA, 23 nt, Human
cccagaggucaagacugcaguga

SEQ ID NO: 368115 - RNA, 23 nt, Human
cccagaggucaaggcugcaguga

SEQ ID NO: 368116 - RNA, 32 nt, Human
cccagaggucccaucugaagcuggaguacccu

SEQ ID NO: 368117 - RNA, 32 nt, Human
cccagagguggaccaggcaucuccuggccacc

SEQ ID NO: 368118 - RNA, 32 nt, Human
cccagagguggaggccacggaggcagggucuc

SEQ ID NO: 368119 - RNA, 23 nt, Human
cccagagguggagguugcaguga

SEQ ID NO: 368120 - RNA, 32 nt, Human
cccagagguucacagcgugugcccaggacagc

SEQ ID NO: 368121 - RNA, 32 nt, Human
cccagaguaaacaacagaaauuuuucuuaaau

SEQ ID NO: 368122 - RNA, 19 nt, Human
cccagagucaaggccaagu

SEQ ID NO: 368123 - RNA, 32 nt, Human
cccagagucaccaaggcaaaguuggggcuggu

SEQ ID NO: 368124 - RNA, 32 nt, Human
cccagagucaucugauuggacaggcaugggug

SEQ ID NO: 368125 - RNA, 32 nt, Human
cccagagucaucuucgggacgcccagggcccg

SEQ ID NO: 368126 - RNA, 18 nt, Human
cccagaguccaggagcug

SEQ ID NO: 368127 - RNA, 32 nt, Human
cccagagucccaggccccuggaguuguuuucg

SEQ ID NO: 368128 - RNA, 32 nt, Human
cccagaguccccaaaauugagugucaaacaga

SEQ ID NO: 368129 - RNA, 32 nt, Human
cccagaguccccagagguaaccacuagagggg

SEQ ID NO: 368130 - RNA, 19 nt, Human
cccagaguccccccacuag

SEQ ID NO: 368131 - RNA, 23 nt, Human
cccagagucuaagacugcaguga

SEQ ID NO: 368132 - RNA, 32 nt, Human
cccagagucucucaugagguugcaguuaagac

SEQ ID NO: 368133 - RNA, 32 nt, Human
cccagagucugaggacugucacugcaacgugc

SEQ ID NO: 368134 - RNA, 20 nt, Human
cccagagucuggccauaaac

SEQ ID NO: 368135 - RNA, 32 nt, Human
cccagagugcaggaucauagggacagcggggg

SEQ ID NO: 368136 - RNA, 22 nt, Human
cccagagugcccguggcuccca

SEQ ID NO: 368137 - RNA, 23 nt, Human
cccagagugcuaggauuacaggc

SEQ ID NO: 368138 - RNA, 24 nt, Human
cccagagugcuaggauuacaggca

SEQ ID NO: 368139 - RNA, 24 nt, Human
cccagagugcuggaauuacaagca

SEQ ID NO: 368140 - RNA, 22 nt, Human
cccagagugcugggauuacagg

SEQ ID NO: 368141 - RNA, 24 nt, Human
cccagagugcugggauuacaggca

SEQ ID NO: 368142 - RNA, 32 nt, Human
cccagagugcuggguugggauuacaggcguga

SEQ ID NO: 368143 - RNA, 32 nt, Human
cccagauaccaugucaggauauuuuuaguguc

SEQ ID NO: 368144 - RNA, 32 nt, Human
cccagauacucuuuccuuuccucucuccuguu

SEQ ID NO: 368145 - RNA, 32 nt, Human
cccagauagaucaggcaaggcuuggagagcug

SEQ ID NO: 368146 - RNA, 24 nt, Human
cccagauagcagagguugcaguga

SEQ ID NO: 368147 - RNA, 32 nt, Human
cccagauagccucgggcgcugccuguagucau

SEQ ID NO: 368148 - RNA, 32 nt, Human
cccagauagccucgggugcugccuguagucau

SEQ ID NO: 368149 - RNA, 24 nt, Human
cccagauagcugggacuacaggca

SEQ ID NO: 368150 - RNA, 32 nt, Human
cccagauagcugguggugggcgcuaauccucc

SEQ ID NO: 368151 - RNA, 32 nt, Human
cccagauaggagagaucauuaaaacagugcau

SEQ ID NO: 368152 - RNA, 21 nt, Human
cccagauaucaccccugagga

SEQ ID NO: 368153 - RNA, 21 nt, Human
cccagauauccucaccucagg

SEQ ID NO: 368154 - RNA, 32 nt, Human
cccagaucacggugggaagugaaagaggggcu

SEQ ID NO: 368155 - RNA, 21 nt, Human
cccagaucagcugcagacaag

SEQ ID NO: 368156 - RNA, 32 nt, Human
cccagaucagcugcagacaagagcagagcuuu

SEQ ID NO: 368157 - RNA, 32 nt, Human
cccagaucagcuuugcacauggugcugaccuc

SEQ ID NO: 368158 - RNA, 32 nt, Human
cccagaucauagaccucucugcauaguaguca

SEQ ID NO: 368159 - RNA, 32 nt, Human
cccagauccagaggagcucgacugggggucca

SEQ ID NO: 368160 - RNA, 32 nt, Human
cccagauccccacuuuuccccuccagugccuc

SEQ ID NO: 368161 - RNA, 32 nt, Human
cccagauccccuuggagccucugcccuccucc

SEQ ID NO: 368162 - RNA, 32 nt, Human
cccagaucccgcaaucagagcggccagagagc

SEQ ID NO: 368163 - RNA, 21 nt, Human
cccagaucccucccagcccca

SEQ ID NO: 368164 - RNA, 32 nt, Human
cccagaucucaggagucucugccuucaggguc

SEQ ID NO: 368165 - RNA, 28 nt, Human
cccagaucucauccugccucauccugag

SEQ ID NO: 368166 - RNA, 32 nt, Human
cccagaucucugcacuucucagucccagaucc

SEQ ID NO: 368167 - RNA, 19 nt, Human
cccagaucucugccugcca

SEQ ID NO: 368168 - RNA, 32 nt, Human
cccagaucuugaguucuucccucugagagugg

SEQ ID NO: 368169 - RNA, 32 nt, Human
cccagaugcaggagucacccagcuuccuucuc

SEQ ID NO: 368170 - RNA, 30 nt, Human
cccagaugcaugcacacgcacacacauauu

SEQ ID NO: 368171 - RNA, 32 nt, Human
cccagaugcccaggcucacuucaguguugagu

SEQ ID NO: 368172 - RNA, 32 nt, Human
cccagauggaaauccuguaugaauguggaagc

SEQ ID NO: 368173 - RNA, 32 nt, Human
cccagauggguggaucaccugaggucaggagu

SEQ ID NO: 368174 - RNA, 29 nt, Human
cccagaugucugugcuuaugccuggccug

SEQ ID NO: 368175 - RNA, 21 nt, Human
cccagauuccacugcugggaa

SEQ ID NO: 368176 - RNA, 32 nt, Human
cccagauuccacugcugggaauaaucuccagg

SEQ ID NO: 368177 - RNA, 32 nt, Human
cccagauugcccacugcacuccagccugggca

SEQ ID NO: 368178 - RNA, 20 nt, Human
cccagauuggagugcagugg

SEQ ID NO: 368179 - RNA, 21 nt, Human
cccagauuggagugcaguggc

SEQ ID NO: 368180 - RNA, 32 nt, Human
cccagauugggguggagcaggaaggagcucuu

SEQ ID NO: 368181 - RNA, 32 nt, Human
cccagauuuucucccuccugacucacugagac

SEQ ID NO: 368182 - RNA, 32 nt, Human
cccagcaaagccagagagcuuuguccccggcc

SEQ ID NO: 368183 - RNA, 32 nt, Human
cccagcaaaguccacccaggaaaaagaaacca

SEQ ID NO: 368184 - RNA, 32 nt, Human
cccagcaaauucaguaaccaccaggcacaaau

SEQ ID NO: 368185 - RNA, 20 nt, Human
cccagcaacccuggccccca

SEQ ID NO: 368186 - RNA, 32 nt, Human
cccagcaaccucugcccugccucccucucaga

SEQ ID NO: 368187 - RNA, 32 nt, Human
cccagcaacugcuucucucccuucucucuccu

SEQ ID NO: 368188 - RNA, 20 nt, Human
cccagcaagaggaagcuguc

SEQ ID NO: 368189 - RNA, 32 nt, Human
cccagcaagccagccaccugcccagccgggcc

SEQ ID NO: 368190 - RNA, 32 nt, Human
cccagcaagcucaccgccuccuuggaggagag

SEQ ID NO: 368191 - RNA, 20 nt, Human
cccagcaagcucagccgcug

SEQ ID NO: 368192 - RNA, 32 nt, Human
cccagcaagggcccugugugggacagcaggag

SEQ ID NO: 368193 - RNA, 18 nt, Human
cccagcaagggggugcag

SEQ ID NO: 368194 - RNA, 32 nt, Human
cccagcaaucacccuccucacuuccuugucua

SEQ ID NO: 368195 - RNA, 32 nt, Human
cccagcaaucugugcuuucuuucacaagcccu

SEQ ID NO: 368196 - RNA, 21 nt, Human
cccagcaaucuguuccugcuu

SEQ ID NO: 368197 - RNA, 32 nt, Human
cccagcaauugcacuccugggccucugacaga

SEQ ID NO: 368198 - RNA, 32 nt, Human
cccagcacaagcugcccuugcuguccugugca

SEQ ID NO: 368199 - RNA, 32 nt, Human
cccagcacaaguacugaugagcucuccacugc

SEQ ID NO: 368200 - RNA, 32 nt, Human
cccagcacacaacugcacugaagccuuguucc

SEQ ID NO: 368201 - RNA, 32 nt, Human
cccagcacacacacauacaacacagaucauuu

SEQ ID NO: 368202 - RNA, 32 nt, Human
cccagcacaccuggaaaguucugcaaggccuc

SEQ ID NO: 368203 - RNA, 32 nt, Human
cccagcacacgcgcucgcacacacacgcacgc

SEQ ID NO: 368204 - RNA, 16 nt, Human
cccagcacacugggag

SEQ ID NO: 368205 - RNA, 32 nt, Human
cccagcacaggccuggcagacagcagguccuc

SEQ ID NO: 368206 - RNA, 32 nt, Human
cccagcacauugggaagaucacuugaggcaag

SEQ ID NO: 368207 - RNA, 27 nt, Human
cccagcacauuuuccuguaagcacuca

SEQ ID NO: 368208 - RNA, 32 nt, Human
cccagcaccacacaccccgccccugaaaggag

SEQ ID NO: 368209 - RNA, 32 nt, Human
cccagcaccacugcccaccuagcuguccuggc

SEQ ID NO: 368210 - RNA, 32 nt, Human
cccagcaccagggggagcaaacccugccccug

SEQ ID NO: 368211 - RNA, 32 nt, Human
cccagcacccaccugaguccaccucaguccug

SEQ ID NO: 368212 - RNA, 22 nt, Human
cccagcacccgccccuuccuca

SEQ ID NO: 368213 - RNA, 19 nt, Human
cccagcacccuggcuccca

SEQ ID NO: 368214 - RNA, 32 nt, Human
cccagcaccuccccuccuccagcuuccuggcc

SEQ ID NO: 368215 - RNA, 32 nt, Human
cccagcaccuuccagauugagagcaagguaga

SEQ ID NO: 368216 - RNA, 32 nt, Human
cccagcacgccugcuuuguggggcagggccau

SEQ ID NO: 368217 - RNA, 16 nt, Human
cccagcacgcugggag

SEQ ID NO: 368218 - RNA, 32 nt, Human
cccagcacgggcuuggcacagagcaggugccu

SEQ ID NO: 368219 - RNA, 32 nt, Human
cccagcacgucugccucuggcuucacccagcc

SEQ ID NO: 368220 - RNA, 32 nt, Human
cccagcacugaggagcucgccugcugcccucu

SEQ ID NO: 368221 - RNA, 32 nt, Human
cccagcacugcagccucaaccuccugggcuca

SEQ ID NO: 368222 - RNA, 23 nt, Human
cccagcacugcaggcagcggcgc

SEQ ID NO: 368223 - RNA, 18 nt, Human
cccagcacugcccagugc

SEQ ID NO: 368224 - RNA, 18 nt, Human
cccagcacugugcuguug

SEQ ID NO: 368225 - RNA, 32 nt, Human
cccagcacuuugggaggccaggaguucgagac

SEQ ID NO: 368226 - RNA, 32 nt, Human
cccagcagaaggauccgccacaggggaggugu

SEQ ID NO: 368227 - RNA, 22 nt, Human
cccagcagaaucaaaguggauc

SEQ ID NO: 368228 - RNA, 32 nt, Human
cccagcagacaggccguaggggaugccgggag

SEQ ID NO: 368229 - RNA, 32 nt, Human
cccagcagacccuccuguugguuccagcgaag

SEQ ID NO: 368230 - RNA, 32 nt, Human
cccagcagagagaguugaccccuccugaacug

SEQ ID NO: 368231 - RNA, 32 nt, Human
cccagcagagcagcaggauccccagccagacu

SEQ ID NO: 368232 - RNA, 24 nt, Human
cccagcagagcccacaagagaguc

SEQ ID NO: 368233 - RNA, 23 nt, Human
cccagcagagccgugggaggguc

SEQ ID NO: 368234 - RNA, 20 nt, Human
cccagcagagcuacaggagg

SEQ ID NO: 368235 - RNA, 24 nt, Human
cccagcagagcuggcuucuggguc

SEQ ID NO: 368236 - RNA, 24 nt, Human
cccagcagagcugggggagggauc

SEQ ID NO: 368237 - RNA, 21 nt, Human
cccagcagagcuugggaaggg

SEQ ID NO: 368238 - RNA, 24 nt, Human
cccagcagaggacuccagccuucu

SEQ ID NO: 368239 - RNA, 21 nt, Human
cccagcagaggcaggcuggga

SEQ ID NO: 368240 - RNA, 32 nt, Human
cccagcagagguggggccggcagagaaggggc

SEQ ID NO: 368241 - RNA, 32 nt, Human
cccagcagagucccagcauggcaccuuccuug

SEQ ID NO: 368242 - RNA, 22 nt, Human
cccagcagagugaaaguggauc

SEQ ID NO: 368243 - RNA, 32 nt, Human
cccagcagaguggugcggcacauucaagucag

SEQ ID NO: 368244 - RNA, 32 nt, Human
cccagcagauaugggcaccugaggcggagucu

SEQ ID NO: 368245 - RNA, 32 nt, Human
cccagcagaucuacucugggaugucuguuuca

SEQ ID NO: 368246 - RNA, 24 nt, Human
cccagcagauggagguugcaguga

SEQ ID NO: 368247 - RNA, 32 nt, Human
cccagcagauggagguugcagugagccaagau

SEQ ID NO: 368248 - RNA, 22 nt, Human
cccagcagaugugucggacaag

SEQ ID NO: 368249 - RNA, 32 nt, Human
cccagcagcacacccaugugcagugcgccugc

SEQ ID NO: 368250 - RNA, 32 nt, Human
cccagcagccagagcaccagcccagccauggu

SEQ ID NO: 368251 - RNA, 32 nt, Human
cccagcagccaucucaaccaccuaucccugcg

SEQ ID NO: 368252 - RNA, 23 nt, Human
cccagcagcccacucucguccga

SEQ ID NO: 368253 - RNA, 32 nt, Human
cccagcagcccccagccgaggggcccagggcc

SEQ ID NO: 368254 - RNA, 32 nt, Human
cccagcagccgcugcccccucacugcccaccc

SEQ ID NO: 368255 - RNA, 32 nt, Human
cccagcagccggaccagccuugggcaacagcg

SEQ ID NO: 368256 - RNA, 21 nt, Human
cccagcagccucagaaggauc

SEQ ID NO: 368257 - RNA, 32 nt, Human
cccagcagccugggggaagugucaggagaugu

SEQ ID NO: 368258 - RNA, 19 nt, Human
cccagcagccugugcccug

SEQ ID NO: 368259 - RNA, 32 nt, Human
cccagcagcucugcaaccuccgcuccaccacu

SEQ ID NO: 368260 - RNA, 32 nt, Human
cccagcagcugauguccaaggaucaggaugag

SEQ ID NO: 368261 - RNA, 32 nt, Human
cccagcagcugccuccugaggugacacagccu

SEQ ID NO: 368262 - RNA, 23 nt, Human
cccagcagcugggacuacaggca

SEQ ID NO: 368263 - RNA, 32 nt, Human
cccagcaggaacagcuacuacucauccugcag

SEQ ID NO: 368264 - RNA, 32 nt, Human
cccagcaggacgccccauccugggugaggggg

SEQ ID NO: 368265 - RNA, 20 nt, Human
cccagcaggaggaagcccag

SEQ ID NO: 368266 - RNA, 32 nt, Human
cccagcaggaggaaugaacaacuccagaugcg

SEQ ID NO: 368267 - RNA, 32 nt, Human
cccagcaggaggcagggguagagugauggaag

SEQ ID NO: 368268 - RNA, 18 nt, Human
cccagcaggagggaggcg

SEQ ID NO: 368269 - RNA, 21 nt, Human
cccagcaggagugggaggguc

SEQ ID NO: 368270 - RNA, 24 nt, Human
cccagcaggcagagguugcaguga

SEQ ID NO: 368271 - RNA, 32 nt, Human
cccagcaggcagagguugcagugagccaagau

SEQ ID NO: 368272 - RNA, 32 nt, Human
cccagcaggcagagguugcagugagcugagau

SEQ ID NO: 368273 - RNA, 20 nt, Human
cccagcaggcagcggcugga

SEQ ID NO: 368274 - RNA, 20 nt, Human
cccagcaggcccaggccagc

SEQ ID NO: 368275 - RNA, 19 nt, Human
cccagcaggccgggcgcgg

SEQ ID NO: 368276 - RNA, 23 nt, Human
cccagcaggcggagguugcggug

SEQ ID NO: 368277 - RNA, 24 nt, Human
cccagcaggcggagguugcgguga

SEQ ID NO: 368278 - RNA, 32 nt, Human
cccagcaggcggagguugcggugagucgagau

SEQ ID NO: 368279 - RNA, 23 nt, Human
cccagcaggcuagagugcgaugg

SEQ ID NO: 368280 - RNA, 20 nt, Human
cccagcagggcuggcccgga

SEQ ID NO: 368281 - RNA, 19 nt, Human
cccagcaggggacccggag

SEQ ID NO: 368282 - RNA, 21 nt, Human
cccagcaggggaggaggcauc

SEQ ID NO: 368283 - RNA, 32 nt, Human
cccagcaggggcagaaggaggaagggacuggu

SEQ ID NO: 368284 - RNA, 32 nt, Human
cccagcaggggugggaggugugggcagaagau

SEQ ID NO: 368285 - RNA, 32 nt, Human
cccagcaggguagaagaggcugagggacacac

SEQ ID NO: 368286 - RNA, 32 nt, Human
cccagcagguaaugacuccacagggaagaggc

SEQ ID NO: 368287 - RNA, 32 nt, Human
cccagcagguaugggcaucugggaaaccucca

SEQ ID NO: 368288 - RNA, 32 nt, Human
cccagcaggucucaugcaggcccagggcuggg

SEQ ID NO: 368289 - RNA, 21 nt, Human
cccagcaguagggaggggcag

SEQ ID NO: 368290 - RNA, 32 nt, Human
cccagcagucccucggcacacaggcauaucag

SEQ ID NO: 368291 - RNA, 32 nt, Human
cccagcaguuccacuuuucgguauuuaucuag

SEQ ID NO: 368292 - RNA, 32 nt, Human
cccagcaguucugagugaguucugagccagcc

SEQ ID NO: 368293 - RNA, 24 nt, Human
cccagcauaacaaacacuagcuca

SEQ ID NO: 368294 - RNA, 18 nt, Human
cccagcauacugaugaca

SEQ ID NO: 368295 - RNA, 32 nt, Human
cccagcauauagaaauggcucagaacguucca

SEQ ID NO: 368296 - RNA, 19 nt, Human
cccagcauccagacuggaa

SEQ ID NO: 368297 - RNA, 32 nt, Human
cccagcaucccaacuucucugcagcgaaaggg

SEQ ID NO: 368298 - RNA, 19 nt, Human
cccagcauccccucaccca

SEQ ID NO: 368299 - RNA, 32 nt, Human
cccagcaucccuccuacucugcccuuggugga

SEQ ID NO: 368300 - RNA, 32 nt, Human
cccagcaucucccucacugaaaccagguggcc

SEQ ID NO: 368301 - RNA, 32 nt, Human
cccagcaugaagagaugggcucugcucugaga

SEQ ID NO: 368302 - RNA, 32 nt, Human
cccagcaugauuuuuggguucaucuuaucagu

SEQ ID NO: 368303 - RNA, 32 nt, Human
cccagcaugccagugcuuccuccaugaauuug

SEQ ID NO: 368304 - RNA, 31 nt, Human
cccagcauggagaugugugaccagagacaca

SEQ ID NO: 368305 - RNA, 24 nt, Human
cccagcauggauggccacagcuca

SEQ ID NO: 368306 - RNA, 21 nt, Human
cccagcaugggacacaagcca

SEQ ID NO: 368307 - RNA, 23 nt, Human
cccagcauguccucacaugcuca

SEQ ID NO: 368308 - RNA, 32 nt, Human
cccagcauugcaguauggugugguguuuguag

SEQ ID NO: 368309 - RNA, 32 nt, Human
cccagcauugugagugacagagccuggaucug

SEQ ID NO: 368310 - RNA, 32 nt, Human
cccagcauuugcucagcuucuggggaggccuc

SEQ ID NO: 368311 - RNA, 32 nt, Human
cccagccaaaaauacagcugggcugaaaccug

SEQ ID NO: 368312 - RNA, 32 nt, Human
cccagccaaaugucugugcucucugugucacu

SEQ ID NO: 368313 - RNA, 32 nt, Human
cccagccaacacagauggucacuccagaggcu

SEQ ID NO: 368314 - RNA, 32 nt, Human
cccagccaaccagcauuucuuaaggugaaaau

SEQ ID NO: 368315 - RNA, 22 nt, Human
cccagccaacucccggcacuga

SEQ ID NO: 368316 - RNA, 32 nt, Human
cccagccaagauuccuccuuugggaggccaag

SEQ ID NO: 368317 - RNA, 32 nt, Human
cccagccaaggaggggccugaggcucucccua

SEQ ID NO: 368318 - RNA, 32 nt, Human
cccagccaaggcuuccuuccucucacucggcc

SEQ ID NO: 368319 - RNA, 32 nt, Human
cccagccacaaguguuggagcugcagagagac

SEQ ID NO: 368320 - RNA, 32 nt, Human
cccagccacacaccaggcugugcucaaggcca

SEQ ID NO: 368321 - RNA, 32 nt, Human
cccagccacaccaccuuguugugugaccuugg

SEQ ID NO: 368322 - RNA, 31 nt, Human
cccagccacagcuagaggucccgggcgcacc

SEQ ID NO: 368323 - RNA, 32 nt, Human
cccagccacagcuggaagcccaggccugcagc

SEQ ID NO: 368324 - RNA, 32 nt, Human
cccagccacaggcuucuuguccaccucuucuc

SEQ ID NO: 368325 - RNA, 32 nt, Human
cccagccaccacugccucucagcuuaaacagg

SEQ ID NO: 368326 - RNA, 23 nt, Human
cccagccaccagcccucauccuc

SEQ ID NO: 368327 - RNA, 32 nt, Human
cccagccacccaugcuaguugcagagaaaagc

SEQ ID NO: 368328 - RNA, 22 nt, Human
cccagccacccccggagcgcag

SEQ ID NO: 368329 - RNA, 32 nt, Human
cccagccacggcucccccucccgaggccauca

SEQ ID NO: 368330 - RNA, 21 nt, Human
cccagccacuccuccccacug

SEQ ID NO: 368331 - RNA, 32 nt, Human
cccagccacuccuccccacugcagccaguguc

SEQ ID NO: 368332 - RNA, 21 nt, Human
cccagccacucugaacgcuga

SEQ ID NO: 368333 - RNA, 32 nt, Human
cccagccacucuuuuccuccuaccucugccau

SEQ ID NO: 368334 - RNA, 32 nt, Human
cccagccacugcacuucaccggaugccgucug

SEQ ID NO: 368335 - RNA, 20 nt, Human
cccagccacugcagcacagg

SEQ ID NO: 368336 - RNA, 32 nt, Human
cccagccagaaggcucugagacauagcagcag

SEQ ID NO: 368337 - RNA, 32 nt, Human
cccagccagacuggaccaaaggaaaagccuuu

SEQ ID NO: 368338 - RNA, 31 nt, Human
cccagccagagagcaggugcaggugucaucc

SEQ ID NO: 368339 - RNA, 20 nt, Human
cccagccagagcaagcuugg

SEQ ID NO: 368340 - RNA, 32 nt, Human
cccagccagaggcgcagccccagcaagaggag

SEQ ID NO: 368341 - RNA, 32 nt, Human
cccagccagaucucaucuggggagucugaggu

SEQ ID NO: 368342 - RNA, 22 nt, Human
cccagccagcagagauggagag

SEQ ID NO: 368343 - RNA, 32 nt, Human
cccagccagcauggccggcaggagcgcaccgc

SEQ ID NO: 368344 - RNA, 32 nt, Human
cccagccagccaccccugccacucaccccucc

SEQ ID NO: 368345 - RNA, 18 nt, Human
cccagccagccccucaca

SEQ ID NO: 368346 - RNA, 32 nt, Human
cccagccagcccgauugugggcugaggggucu

SEQ ID NO: 368347 - RNA, 32 nt, Human
cccagccagcccucaaaacacaaaggaacaaa

SEQ ID NO: 368348 - RNA, 32 nt, Human
cccagccagccucugucaccaugguaacccug

SEQ ID NO: 368349 - RNA, 20 nt, Human
cccagccagccuggcuggga

SEQ ID NO: 368350 - RNA, 32 nt, Human
cccagccagcggaacaguuucuauuacccccu

SEQ ID NO: 368351 - RNA, 32 nt, Human
cccagccagcgggcccagcccgcggaggaggg

SEQ ID NO: 368352 - RNA, 22 nt, Human
cccagccagcucgggagguggg

SEQ ID NO: 368353 - RNA, 22 nt, Human
cccagccagcugggacccuggg

SEQ ID NO: 368354 - RNA, 32 nt, Human
cccagccagcuggucuggcccuggacgugccu

SEQ ID NO: 368355 - RNA, 21 nt, Human
cccagccagcuuccaggcgcu

SEQ ID NO: 368356 - RNA, 32 nt, Human
cccagccaggagagaggacagagccagggcag

SEQ ID NO: 368357 - RNA, 19 nt, Human
cccagccaggaggggccag

SEQ ID NO: 368358 - RNA, 24 nt, Human
cccagccaggcaccgagaucauca

SEQ ID NO: 368359 - RNA, 21 nt, Human
cccagccagggcagcgccagc

SEQ ID NO: 368360 - RNA, 32 nt, Human
cccagccaggguggccccggcgggggcggguc

SEQ ID NO: 368361 - RNA, 24 nt, Human
cccagccagguucucuggguccag

SEQ ID NO: 368362 - RNA, 32 nt, Human
cccagccaucaagcccuccgauaccuucggcu

SEQ ID NO: 368363 - RNA, 32 nt, Human
cccagccaucacugcuggcagccugggcaaac

SEQ ID NO: 368364 - RNA, 32 nt, Human
cccagccaucugauuggugacagggucaaccc

SEQ ID NO: 368365 - RNA, 32 nt, Human
cccagccaucugcaugacauggguauuuauua

SEQ ID NO: 368366 - RNA, 32 nt, Human
cccagccaucuguaaaaauuaggcaggucccu

SEQ ID NO: 368367 - RNA, 32 nt, Human
cccagccaugucguccauccugccuuucacuc

SEQ ID NO: 368368 - RNA, 32 nt, Human
cccagcccaacaccaucucuuccuaccucuca

SEQ ID NO: 368369 - RNA, 32 nt, Human
cccagcccaagccaugagcuucuuccaggcuc

SEQ ID NO: 368370 - RNA, 25 nt, Human
cccagcccaaggccccucugugagg

SEQ ID NO: 368371 - RNA, 32 nt, Human
cccagcccaagugccuggcacacagcuaaugu

SEQ ID NO: 368372 - RNA, 32 nt, Human
cccagcccacagagccugaauuuguaagcaac

SEQ ID NO: 368373 - RNA, 32 nt, Human
cccagcccacauuccuccuuccugcuccgaac

SEQ ID NO: 368374 - RNA, 32 nt, Human
cccagcccacccccaaacagacacagcguagc

SEQ ID NO: 368375 - RNA, 21 nt, Human
cccagcccaccccugccccca

SEQ ID NO: 368376 - RNA, 21 nt, Human
cccagcccacccuggcccuca

SEQ ID NO: 368377 - RNA, 32 nt, Human
cccagcccacgggacgccagaccucgaccguc

SEQ ID NO: 368378 - RNA, 32 nt, Human
cccagcccacugcuucagcugugggccaucug

SEQ ID NO: 368379 - RNA, 15 nt, Human
cccagcccacuucug

SEQ ID NO: 368380 - RNA, 32 nt, Human
cccagcccagagcagccaucaggcuggaggug

SEQ ID NO: 368381 - RNA, 32 nt, Human
cccagcccagcauggcaccccugcugcccauc

SEQ ID NO: 368382 - RNA, 21 nt, Human
cccagcccagccagcuaccca

SEQ ID NO: 368383 - RNA, 20 nt, Human
cccagcccagcccagcccca

SEQ ID NO: 368384 - RNA, 32 nt, Human
cccagcccagcccagccugagaaauacccuca

SEQ ID NO: 368385 - RNA, 20 nt, Human
cccagcccagcccagcugcu

SEQ ID NO: 368386 - RNA, 32 nt, Human
cccagcccagccccaaagagaaagaagagaca

SEQ ID NO: 368387 - RNA, 32 nt, Human
cccagcccagccccaaagagaaagaagagagc

SEQ ID NO: 368388 - RNA, 17 nt, Human
cccagcccagcccgccg

SEQ ID NO: 368389 - RNA, 21 nt, Human
cccagcccagccugagcccca

SEQ ID NO: 368390 - RNA, 32 nt, Human
cccagcccagccugagccccaacaacaacuuu

SEQ ID NO: 368391 - RNA, 20 nt, Human
cccagcccagcuccagcucc

SEQ ID NO: 368392 - RNA, 22 nt, Human
cccagcccagcuggggcaccca

SEQ ID NO: 368393 - RNA, 32 nt, Human
cccagcccaggaguuugaggcugcaaugagcc

SEQ ID NO: 368394 - RNA, 32 nt, Human
cccagcccaggccugguggagggggaggggag

SEQ ID NO: 368395 - RNA, 32 nt, Human
cccagcccagggauucuugaacuaucuguagg

SEQ ID NO: 368396 - RNA, 22 nt, Human
cccagcccagggcacgccccug

SEQ ID NO: 368397 - RNA, 32 nt, Human
cccagcccagguacaugaggccaaggugaacu

SEQ ID NO: 368398 - RNA, 24 nt, Human
cccagcccaguccccuugcuccca

SEQ ID NO: 368399 - RNA, 32 nt, Human
cccagcccaucuuacugcaagcagcguccuga

SEQ ID NO: 368400 - RNA, 21 nt, Human
cccagcccaugccuccggguc

SEQ ID NO: 368401 - RNA, 21 nt, Human
cccagcccauuccggccccca

SEQ ID NO: 368402 - RNA, 22 nt, Human
cccagccccaaagccagccccc

SEQ ID NO: 368403 - RNA, 18 nt, Human
cccagccccaagaucuca

SEQ ID NO: 368404 - RNA, 22 nt, Human
cccagccccaagguugauccca

SEQ ID NO: 368405 - RNA, 25 nt, Human
cccagccccaaguuccagcucacca

SEQ ID NO: 368406 - RNA, 32 nt, Human
cccagccccacagccugagccucccagcugcc

SEQ ID NO: 368407 - RNA, 19 nt, Human
cccagccccaccaccccca

SEQ ID NO: 368408 - RNA, 18 nt, Human
cccagccccaccaccucc

SEQ ID NO: 368409 - RNA, 20 nt, Human
cccagccccaccacucacca

SEQ ID NO: 368410 - RNA, 20 nt, Human
cccagccccaccagagcccc

SEQ ID NO: 368411 - RNA, 22 nt, Human
cccagccccaccaugaugcccc

SEQ ID NO: 368412 - RNA, 19 nt, Human
cccagccccaccccagcuc

SEQ ID NO: 368413 - RNA, 20 nt, Human
cccagccccacccccuuccc

SEQ ID NO: 368414 - RNA, 23 nt, Human
cccagccccaccccuaagugccc

SEQ ID NO: 368415 - RNA, 20 nt, Human
cccagccccacccucugccc

SEQ ID NO: 368416 - RNA, 21 nt, Human
cccagccccacccugucccca

SEQ ID NO: 368417 - RNA, 21 nt, Human
cccagccccaccgcccacccc

SEQ ID NO: 368418 - RNA, 21 nt, Human
cccagccccaccucagucucc

SEQ ID NO: 368419 - RNA, 19 nt, Human
cccagccccaccugacucc

SEQ ID NO: 368420 - RNA, 32 nt, Human
cccagccccaccugccaaagucccagguuuac

SEQ ID NO: 368421 - RNA, 32 nt, Human
cccagccccaccuuccccuccugaugcccuga

SEQ ID NO: 368422 - RNA, 20 nt, Human
cccagccccacgcccuacca

SEQ ID NO: 368423 - RNA, 22 nt, Human
cccagccccacgccggcuacca

SEQ ID NO: 368424 - RNA, 21 nt, Human
cccagccccacucagcugccc

SEQ ID NO: 368425 - RNA, 18 nt, Human
cccagccccacuccccgc

SEQ ID NO: 368426 - RNA, 23 nt, Human
cccagccccacuccccgcagucc

SEQ ID NO: 368427 - RNA, 20 nt, Human
cccagccccacuccgggccu

SEQ ID NO: 368428 - RNA, 22 nt, Human
cccagccccacuccuguugccc

SEQ ID NO: 368429 - RNA, 22 nt, Human
cccagccccacucggauguccc

SEQ ID NO: 368430 - RNA, 19 nt, Human
cccagccccacugcccucc

SEQ ID NO: 368431 - RNA, 16 nt, Human
cccagccccacuucug

SEQ ID NO: 368432 - RNA, 22 nt, Human
cccagccccagagaaacugcca

SEQ ID NO: 368433 - RNA, 21 nt, Human
cccagccccagcaggcccuca

SEQ ID NO: 368434 - RNA, 32 nt, Human
cccagccccagcaggcccucagccuggaagag

SEQ ID NO: 368435 - RNA, 20 nt, Human
cccagccccagccaacuccc

SEQ ID NO: 368436 - RNA, 23 nt, Human
cccagccccagccccggccccca

SEQ ID NO: 368437 - RNA, 21 nt, Human
cccagccccagccccggcucc

SEQ ID NO: 368438 - RNA, 21 nt, Human
cccagccccagcccggcccca

SEQ ID NO: 368439 - RNA, 32 nt, Human
cccagccccagccucugcucuuuugagcagcc

SEQ ID NO: 368440 - RNA, 32 nt, Human
cccagccccaggaccacuggccccuuggccug

SEQ ID NO: 368441 - RNA, 32 nt, Human
cccagccccaggagccagaccacuccugccuc

SEQ ID NO: 368442 - RNA, 20 nt, Human
cccagccccaggcccagcag

SEQ ID NO: 368443 - RNA, 19 nt, Human
cccagccccaggccugccc

SEQ ID NO: 368444 - RNA, 32 nt, Human
cccagccccaggcugcagcccauucgcaggca

SEQ ID NO: 368445 - RNA, 32 nt, Human
cccagccccaucacacuggcucuggcuucaag

SEQ ID NO: 368446 - RNA, 20 nt, Human
cccagccccaucccaaaccc

SEQ ID NO: 368447 - RNA, 18 nt, Human
cccagccccaucccuccc

SEQ ID NO: 368448 - RNA, 20 nt, Human
cccagccccaucccuguccu

SEQ ID NO: 368449 - RNA, 32 nt, Human
cccagccccauccgcaagccaggcugggccug

SEQ ID NO: 368450 - RNA, 20 nt, Human
cccagccccauccuacccca

SEQ ID NO: 368451 - RNA, 19 nt, Human
cccagccccaugaggaccc

SEQ ID NO: 368452 - RNA, 22 nt, Human
cccagccccaugaggacccuca

SEQ ID NO: 368453 - RNA, 21 nt, Human
cccagccccaugauuacccca

SEQ ID NO: 368454 - RNA, 21 nt, Human
cccagccccaugggacacccg

SEQ ID NO: 368455 - RNA, 32 nt, Human
cccagccccauucuacuccgagucgagucugu

SEQ ID NO: 368456 - RNA, 22 nt, Human
cccagccccauugcccaccucc

SEQ ID NO: 368457 - RNA, 24 nt, Human
cccagcccccacaugccagcccca

SEQ ID NO: 368458 - RNA, 23 nt, Human
cccagcccccagcaagggcacuc

SEQ ID NO: 368459 - RNA, 22 nt, Human
cccagcccccaggaggccccug

SEQ ID NO: 368460 - RNA, 23 nt, Human
cccagcccccauggggcagcagc

SEQ ID NO: 368461 - RNA, 19 nt, Human
cccagccccccaccgcccc

SEQ ID NO: 368462 - RNA, 21 nt, Human
cccagccccccaccgccccca

SEQ ID NO: 368463 - RNA, 22 nt, Human
cccagccccccagauggcuccc

SEQ ID NO: 368464 - RNA, 22 nt, Human
cccagccccccagcagcacccg

SEQ ID NO: 368465 - RNA, 32 nt, Human
cccagcccccgcagcccucuggcccccuccau

SEQ ID NO: 368466 - RNA, 25 nt, Human
cccagcccccguccguccaggcuca

SEQ ID NO: 368467 - RNA, 22 nt, Human
cccagcccccgucuguccccca

SEQ ID NO: 368468 - RNA, 32 nt, Human
cccagcccccucucccccugagccauuguggg

SEQ ID NO: 368469 - RNA, 32 nt, Human
cccagcccccuguccuggaagauaccuuagag

SEQ ID NO: 368470 - RNA, 32 nt, Human
cccagcccccuucgcccguuuccaucacgagu

SEQ ID NO: 368471 - RNA, 32 nt, Human
cccagcccccuuguaaacucuagucacuauaa

SEQ ID NO: 368472 - RNA, 23 nt, Human
cccagccccgaaugccuugaaga

SEQ ID NO: 368473 - RNA, 32 nt, Human
cccagccccgaggaggaggaggaggaggagga

SEQ ID NO: 368474 - RNA, 20 nt, Human
cccagccccgaggccagugg

SEQ ID NO: 368475 - RNA, 22 nt, Human
cccagccccgcccaggcugcug

SEQ ID NO: 368476 - RNA, 20 nt, Human
cccagccccgcgcagcccca

SEQ ID NO: 368477 - RNA, 20 nt, Human
cccagccccgcgcggcuccc

SEQ ID NO: 368478 - RNA, 20 nt, Human
cccagccccgcugacaccca

SEQ ID NO: 368479 - RNA, 19 nt, Human
cccagccccggacagcucc

SEQ ID NO: 368480 - RNA, 22 nt, Human
cccagccccggcagccucagca

SEQ ID NO: 368481 - RNA, 23 nt, Human
cccagccccggccacagccacgg

SEQ ID NO: 368482 - RNA, 21 nt, Human
cccagccccggcccccagcag

SEQ ID NO: 368483 - RNA, 32 nt, Human
cccagccccggcugugucuacuccaggccaag

SEQ ID NO: 368484 - RNA, 20 nt, Human
cccagccccgggaggcuccc

SEQ ID NO: 368485 - RNA, 24 nt, Human
cccagccccgggucccgguuccca

SEQ ID NO: 368486 - RNA, 21 nt, Human
cccagccccggugagccccca

SEQ ID NO: 368487 - RNA, 32 nt, Human
cccagccccuaccuugagacccucuucucugg

SEQ ID NO: 368488 - RNA, 32 nt, Human
cccagccccuacugcugugaacccuggggccu

SEQ ID NO: 368489 - RNA, 32 nt, Human
cccagccccucagccauccagggcuacccacu

SEQ ID NO: 368490 - RNA, 22 nt, Human
cccagccccucaggaacccuca

SEQ ID NO: 368491 - RNA, 18 nt, Human
cccagccccucccagcac

SEQ ID NO: 368492 - RNA, 20 nt, Human
cccagccccucccagcaccc

SEQ ID NO: 368493 - RNA, 23 nt, Human
cccagccccucccagccagccuc

SEQ ID NO: 368494 - RNA, 32 nt, Human
cccagccccucccagccagccucugucaccau

SEQ ID NO: 368495 - RNA, 20 nt, Human
cccagccccucccagcccuu

SEQ ID NO: 368496 - RNA, 21 nt, Human
cccagccccucccaggugccu

SEQ ID NO: 368497 - RNA, 23 nt, Human
cccagccccucccaguccccuca

SEQ ID NO: 368498 - RNA, 32 nt, Human
cccagccccuccccuccccauaccaaagugcu

SEQ ID NO: 368499 - RNA, 24 nt, Human
cccagccccuccucugaacacuca

SEQ ID NO: 368500 - RNA, 23 nt, Human
cccagccccuccucuuucccuca

SEQ ID NO: 368501 - RNA, 24 nt, Human
cccagccccuccugccccagccca

SEQ ID NO: 368502 - RNA, 21 nt, Human
cccagccccuccugcguacca

SEQ ID NO: 368503 - RNA, 23 nt, Human
cccagccccucgucgcggguuca

SEQ ID NO: 368504 - RNA, 21 nt, Human
cccagccccucuuaguucucc

SEQ ID NO: 368505 - RNA, 32 nt, Human
cccagccccugagaccuaucccccucaugcua

SEQ ID NO: 368506 - RNA, 32 nt, Human
cccagccccugagcccccuccugagccuacca

SEQ ID NO: 368507 - RNA, 15 nt, Human
cccagccccugcagc

SEQ ID NO: 368508 - RNA, 19 nt, Human
cccagccccugccagcucc

SEQ ID NO: 368509 - RNA, 32 nt, Human
cccagccccugccaugagcucugggcuggguc

SEQ ID NO: 368510 - RNA, 32 nt, Human
cccagccccugcccaccuucagcaggaugagg

SEQ ID NO: 368511 - RNA, 32 nt, Human
cccagccccugccccugccacccuccgguggc

SEQ ID NO: 368512 - RNA, 32 nt, Human
cccagccccugccccuggacaccugcugacag

SEQ ID NO: 368513 - RNA, 32 nt, Human
cccagccccugccucugcccaagugggccagc

SEQ ID NO: 368514 - RNA, 32 nt, Human
cccagccccugccugguccugcccaccucacc

SEQ ID NO: 368515 - RNA, 32 nt, Human
cccagccccuggcaaccacaaaucuuuccaac

SEQ ID NO: 368516 - RNA, 32 nt, Human
cccagccccuggcaaccacugaucugcuuuca

SEQ ID NO: 368517 - RNA, 21 nt, Human
cccagccccuggcagcaccca

SEQ ID NO: 368518 - RNA, 32 nt, Human
cccagccccuggcauccacccuucuagcuuuc

SEQ ID NO: 368519 - RNA, 22 nt, Human
cccagccccugugguagcccca

SEQ ID NO: 368520 - RNA, 32 nt, Human
cccagccccuucccuugggccugcuguggugc

SEQ ID NO: 368521 - RNA, 32 nt, Human
cccagccccuugggcucgcugccuuaugcagu

SEQ ID NO: 368522 - RNA, 24 nt, Human
cccagccccuuuuccccaguccca

SEQ ID NO: 368523 - RNA, 32 nt, Human
cccagccccuuuucucugcucuuguuucacuc

SEQ ID NO: 368524 - RNA, 21 nt, Human
cccagcccgaggaggcacuca

SEQ ID NO: 368525 - RNA, 21 nt, Human
cccagcccgcagccagccccc

SEQ ID NO: 368526 - RNA, 20 nt, Human
cccagcccgcccaacuccca

SEQ ID NO: 368527 - RNA, 22 nt, Human
cccagcccgccguccagcgcug

SEQ ID NO: 368528 - RNA, 32 nt, Human
cccagcccgcucccccucucugugcccugguc

SEQ ID NO: 368529 - RNA, 21 nt, Human
cccagcccgcugcagccgcca

SEQ ID NO: 368530 - RNA, 17 nt, Human
cccagcccggagcgcag

SEQ ID NO: 368531 - RNA, 22 nt, Human
cccagcccggcgaggggccuca

SEQ ID NO: 368532 - RNA, 32 nt, Human
cccagcccgggugacagagcgagacuccgucu

SEQ ID NO: 368533 - RNA, 20 nt, Human
cccagcccggucccuggcca

SEQ ID NO: 368534 - RNA, 32 nt, Human
cccagcccgucuccucuucccuucccuggccc

SEQ ID NO: 368535 - RNA, 19 nt, Human
cccagcccgugcagcugcu

SEQ ID NO: 368536 - RNA, 32 nt, Human
cccagcccgugggagagaagggggucucugac

SEQ ID NO: 368537 - RNA, 32 nt, Human
cccagcccuaaaggaaggguagacccgugucu

SEQ ID NO: 368538 - RNA, 19 nt, Human
cccagcccuacaaccccca

SEQ ID NO: 368539 - RNA, 32 nt, Human
cccagcccuaccugccagugcuggugucaggg

SEQ ID NO: 368540 - RNA, 32 nt, Human
cccagcccuauccggcgaggagcggagcgcug

SEQ ID NO: 368541 - RNA, 20 nt, Human
cccagcccucacagcuccca

SEQ ID NO: 368542 - RNA, 25 nt, Human
cccagcccucacccccuagccccca

SEQ ID NO: 368543 - RNA, 32 nt, Human
cccagcccucagaggcucagaggcucucugag

SEQ ID NO: 368544 - RNA, 24 nt, Human
cccagcccucagccccaggcccca

SEQ ID NO: 368545 - RNA, 23 nt, Human
cccagcccucagcuggcugccca

SEQ ID NO: 368546 - RNA, 21 nt, Human
cccagcccucagucaccccca

SEQ ID NO: 368547 - RNA, 32 nt, Human
cccagcccucaguuuucagucaaguuccgucu

SEQ ID NO: 368548 - RNA, 32 nt, Human
cccagcccucauccucccuugcucacaaaguu

SEQ ID NO: 368549 - RNA, 32 nt, Human
cccagcccucauugcugggggccaggccuugg

SEQ ID NO: 368550 - RNA, 32 nt, Human
cccagcccuccaaacccuggauuugcaacauc

SEQ ID NO: 368551 - RNA, 32 nt, Human
cccagcccuccaguggccugugggugagggaa

SEQ ID NO: 368552 - RNA, 32 nt, Human
cccagcccucccccgugcguaucucgcuuaag

SEQ ID NO: 368553 - RNA, 32 nt, Human
cccagcccuccccucccaucugugccucugua

SEQ ID NO: 368554 - RNA, 32 nt, Human
cccagcccucccuuccuuccucugccggcaag

SEQ ID NO: 368555 - RNA, 24 nt, Human
cccagcccuccucugggagccuca

SEQ ID NO: 368556 - RNA, 32 nt, Human
cccagcccucgccucugcgagaaugaacauau

SEQ ID NO: 368557 - RNA, 32 nt, Human
cccagcccucuucucgguuccccacacccagg

SEQ ID NO: 368558 - RNA, 32 nt, Human
cccagcccucuugaccuggccacagagagcug

SEQ ID NO: 368559 - RNA, 24 nt, Human
cccagcccugaacaaagcaccuca

SEQ ID NO: 368560 - RNA, 20 nt, Human
cccagcccugcaguccccca

SEQ ID NO: 368561 - RNA, 32 nt, Human
cccagcccugccaugcgcuuguggaccucuau

SEQ ID NO: 368562 - RNA, 26 nt, Human
cccagcccugccuccccggucuccca

SEQ ID NO: 368563 - RNA, 32 nt, Human
cccagcccugccuguacauacacaugcacacc

SEQ ID NO: 368564 - RNA, 32 nt, Human
cccagcccugcucaccuuucuuaccucucugg

SEQ ID NO: 368565 - RNA, 32 nt, Human
cccagcccugcucccaccuggacuggcucagu

SEQ ID NO: 368566 - RNA, 32 nt, Human
cccagcccugcucuccgcgcucggccagaggg

SEQ ID NO: 368567 - RNA, 20 nt, Human
cccagcccuggcaucugccc

SEQ ID NO: 368568 - RNA, 32 nt, Human
cccagcccuggcccuggccgcggucucagccc

SEQ ID NO: 368569 - RNA, 32 nt, Human
cccagcccuggccuccccacucuguccugggu

SEQ ID NO: 368570 - RNA, 23 nt, Human
cccagcccugggaaccacuccca

SEQ ID NO: 368571 - RNA, 32 nt, Human
cccagcccugggaaccacucccaccacaggca

SEQ ID NO: 368572 - RNA, 23 nt, Human
cccagcccuguccccuaccccca

SEQ ID NO: 368573 - RNA, 22 nt, Human
cccagcccugugccggguccca

SEQ ID NO: 368574 - RNA, 32 nt, Human
cccagcccugugccuccuagcccaggauuugu

SEQ ID NO: 368575 - RNA, 20 nt, Human
cccagcccugugggccccca

SEQ ID NO: 368576 - RNA, 20 nt, Human
cccagcccuguucugcuugu

SEQ ID NO: 368577 - RNA, 21 nt, Human
cccagcccuguugaagcacca

SEQ ID NO: 368578 - RNA, 19 nt, Human
cccagcccuuauuauuuua

SEQ ID NO: 368579 - RNA, 20 nt, Human
cccagcccuucccaccccca

SEQ ID NO: 368580 - RNA, 32 nt, Human
cccagcccuuccccacagcccaaaggaacuua

SEQ ID NO: 368581 - RNA, 32 nt, Human
cccagcccuuccugaagccagaagcguugcug

SEQ ID NO: 368582 - RNA, 32 nt, Human
cccagcccuuccuuuauuuccaugggaauuua

SEQ ID NO: 368583 - RNA, 22 nt, Human
cccagcccuugggccuggcucc

SEQ ID NO: 368584 - RNA, 24 nt, Human
cccagcccuugggccuggcuccaa

SEQ ID NO: 368585 - RNA, 32 nt, Human
cccagcccuuucucugccaccagccagcacuc

SEQ ID NO: 368586 - RNA, 21 nt, Human
cccagcccuuucuggauccca

SEQ ID NO: 368587 - RNA, 22 nt, Human
cccagcccuuugccugccccca

SEQ ID NO: 368588 - RNA, 32 nt, Human
cccagccgacgccacucacugccuccuuccuc

SEQ ID NO: 368589 - RNA, 24 nt, Human
cccagccgagccgagccggcccga

SEQ ID NO: 368590 - RNA, 23 nt, Human
cccagccgaggagcuggcugggg

SEQ ID NO: 368591 - RNA, 32 nt, Human
cccagccgaggcccccagcccagugggagcaa

SEQ ID NO: 368592 - RNA, 32 nt, Human
cccagccgcacugggagccauggggagcaagu

SEQ ID NO: 368593 - RNA, 23 nt, Human
cccagccgcagccgcagcagcag

SEQ ID NO: 368594 - RNA, 22 nt, Human
cccagccgccgccaccgcgccg

SEQ ID NO: 368595 - RNA, 32 nt, Human
cccagccgccgcccugcuccaggcucuaggac

SEQ ID NO: 368596 - RNA, 18 nt, Human
cccagccgcgcccagggc

SEQ ID NO: 368597 - RNA, 19 nt, Human
cccagccgcgcccagggcc

SEQ ID NO: 368598 - RNA, 32 nt, Human
cccagccgcugccucuugccgcuccgccuuug

SEQ ID NO: 368599 - RNA, 32 nt, Human
cccagccgcuggcucccagccuggcugaagcg

SEQ ID NO: 368600 - RNA, 19 nt, Human
cccagccgcugugggagga

SEQ ID NO: 368601 - RNA, 21 nt, Human
cccagccggcaagggcuugaa

SEQ ID NO: 368602 - RNA, 32 nt, Human
cccagccggucucucugugcucgguugucuug

SEQ ID NO: 368603 - RNA, 32 nt, Human
cccagccgguuuggauuacaggccugugcugg

SEQ ID NO: 368604 - RNA, 17 nt, Human
cccagccgucccucuca

SEQ ID NO: 368605 - RNA, 32 nt, Human
cccagccguggaacagaaacauuugcuggaug

SEQ ID NO: 368606 - RNA, 32 nt, Human
cccagccuacagaacaauggccauucugagug

SEQ ID NO: 368607 - RNA, 21 nt, Human
cccagccuacauucacuucua

SEQ ID NO: 368608 - RNA, 31 nt, Human
cccagccuagaguuuauuucacuggaucaga

SEQ ID NO: 368609 - RNA, 32 nt, Human
cccagccucaaauccaggacccugccaggcac

SEQ ID NO: 368610 - RNA, 21 nt, Human
cccagccucaccccugaggag

SEQ ID NO: 368611 - RNA, 32 nt, Human
cccagccucacccuccugggguggccccgugu

SEQ ID NO: 368612 - RNA, 32 nt, Human
cccagccucacugaggcucaggacacggccac

SEQ ID NO: 368613 - RNA, 32 nt, Human
cccagccucagaaguuguugugcaauaaaagg

SEQ ID NO: 368614 - RNA, 32 nt, Human
cccagccucagagacaaauaggcuucaucaug

SEQ ID NO: 368615 - RNA, 22 nt, Human
cccagccucagccccagcccca

SEQ ID NO: 368616 - RNA, 32 nt, Human
cccagccucaggucuucugucagagcaacaca

SEQ ID NO: 368617 - RNA, 32 nt, Human
cccagccucaguccuaacuccuggggcugggc

SEQ ID NO: 368618 - RNA, 32 nt, Human
cccagccuccaagggccgucaggcugggcuuu

SEQ ID NO: 368619 - RNA, 22 nt, Human
cccagccuccaccccggcuccc

SEQ ID NO: 368620 - RNA, 21 nt, Human
cccagccuccagaggcucuca

SEQ ID NO: 368621 - RNA, 32 nt, Human
cccagccuccagggcuucucugugugucuugg

SEQ ID NO: 368622 - RNA, 32 nt, Human
cccagccucccaaaucaagucucuccaucacu

SEQ ID NO: 368623 - RNA, 32 nt, Human
cccagccucccaccacgcucacugccuggcuu

SEQ ID NO: 368624 - RNA, 23 nt, Human
cccagccucccacccugguccca

SEQ ID NO: 368625 - RNA, 32 nt, Human
cccagccucccacucgacuuuccucuuaggaa

SEQ ID NO: 368626 - RNA, 32 nt, Human
cccagccucccaggcuggauggcauggacugu

SEQ ID NO: 368627 - RNA, 32 nt, Human
cccagccucccucuucuuccucaggcuuugga

SEQ ID NO: 368628 - RNA, 32 nt, Human
cccagccuccuccaaaacagcacacuuuccgg

SEQ ID NO: 368629 - RNA, 23 nt, Human
cccagccuccucggucuccuguc

SEQ ID NO: 368630 - RNA, 32 nt, Human
cccagccucuacucuucccagccccuaauccc

SEQ ID NO: 368631 - RNA, 20 nt, Human
cccagccucuccaaccccca

SEQ ID NO: 368632 - RNA, 20 nt, Human
cccagccucuccuccaccca

SEQ ID NO: 368633 - RNA, 22 nt, Human
cccagccucuccuccuugggca

SEQ ID NO: 368634 - RNA, 32 nt, Human
cccagccucucuuccaaauuuccucuucaugc

SEQ ID NO: 368635 - RNA, 32 nt, Human
cccagccucugacuugcuguguuguccagagg

SEQ ID NO: 368636 - RNA, 32 nt, Human
cccagccucugccggcuccccuaggcaacccc

SEQ ID NO: 368637 - RNA, 32 nt, Human
cccagccucugccucccgucagccucuacagu

SEQ ID NO: 368638 - RNA, 32 nt, Human
cccagccucugccucccgucggccucuacagu

SEQ ID NO: 368639 - RNA, 32 nt, Human
cccagccucugccucccgucggccucugcagu

SEQ ID NO: 368640 - RNA, 32 nt, Human
cccagccucugcuguccaaggcuggcuagcug

SEQ ID NO: 368641 - RNA, 32 nt, Human
cccagccucuuccucuuccuuuuggauacgcg

SEQ ID NO: 368642 - RNA, 32 nt, Human
cccagccucuugcuuccugggcugaggacaug

SEQ ID NO: 368643 - RNA, 32 nt, Human
cccagccucuuucugagggaaaggacaagaug

SEQ ID NO: 368644 - RNA, 21 nt, Human
cccagccucuuucugcuuuca

SEQ ID NO: 368645 - RNA, 32 nt, Human
cccagccugaacugcucaacucuaaacccaaa

SEQ ID NO: 368646 - RNA, 22 nt, Human
cccagccugaccccacuggcca

SEQ ID NO: 368647 - RNA, 21 nt, Human
cccagccugaccuguguuuug

SEQ ID NO: 368648 - RNA, 32 nt, Human
cccagccugacugcucugucuuccugccuucg

SEQ ID NO: 368649 - RNA, 16 nt, Human
cccagccugacugcug

SEQ ID NO: 368650 - RNA, 20 nt, Human
cccagccugagccaguccca

SEQ ID NO: 368651 - RNA, 32 nt, Human
cccagccugaggaggagggagagggaggaaca

SEQ ID NO: 368652 - RNA, 32 nt, Human
cccagccugagggaagggaggaaggggcgggg

SEQ ID NO: 368653 - RNA, 32 nt, Human
cccagccugauaggcugaggccagcugggaug

SEQ ID NO: 368654 - RNA, 32 nt, Human
cccagccugaugccagaacaaaggacagagaa

SEQ ID NO: 368655 - RNA, 21 nt, Human
cccagccugcaccgccuccca

SEQ ID NO: 368656 - RNA, 32 nt, Human
cccagccugcccacuacauccagccuguggcu

SEQ ID NO: 368657 - RNA, 22 nt, Human
cccagccugccccagccuccca

SEQ ID NO: 368658 - RNA, 23 nt, Human
cccagccugccucccggcgccca

SEQ ID NO: 368659 - RNA, 32 nt, Human
cccagccugccugccgcaccccuguggccucc

SEQ ID NO: 368660 - RNA, 32 nt, Human
cccagccugccuggacaacccuccuuagccgc

SEQ ID NO: 368661 - RNA, 32 nt, Human
cccagccugccuguccuccagcugucugacua

SEQ ID NO: 368662 - RNA, 23 nt, Human
cccagccugcuauggaagcauca

SEQ ID NO: 368663 - RNA, 21 nt, Human
cccagccugcuccuggccccc

SEQ ID NO: 368664 - RNA, 22 nt, Human
cccagccugcucuagcugccca

SEQ ID NO: 368665 - RNA, 17 nt, Human
cccagccugcugcugcu

SEQ ID NO: 368666 - RNA, 18 nt, Human
cccagccugcugcuucug

SEQ ID NO: 368667 - RNA, 20 nt, Human
cccagccuggaaugcagugg

SEQ ID NO: 368668 - RNA, 32 nt, Human
cccagccuggacaacagagugagacuccuucu

SEQ ID NO: 368669 - RNA, 15 nt, Human
cccagccuggacuuc

SEQ ID NO: 368670 - RNA, 23 nt, Human
cccagccuggagccaggcacugg

SEQ ID NO: 368671 - RNA, 20 nt, Human
cccagccuggagugcagugg

SEQ ID NO: 368672 - RNA, 23 nt, Human
cccagccuggagugcaguggugu

SEQ ID NO: 368673 - RNA, 32 nt, Human
cccagccuggauuccugugccugcucgcaggg

SEQ ID NO: 368674 - RNA, 32 nt, Human
cccagccuggcccagaucuucucaccuaggac

SEQ ID NO: 368675 - RNA, 20 nt, Human
cccagccuggcccagcuccc

SEQ ID NO: 368676 - RNA, 18 nt, Human
cccagccuggcccagggc

SEQ ID NO: 368677 - RNA, 21 nt, Human
cccagccuggccccucugcug

SEQ ID NO: 368678 - RNA, 22 nt, Human
cccagccuggcucuggguucaa

SEQ ID NO: 368679 - RNA, 21 nt, Human
cccagccugggaaagccccug

SEQ ID NO: 368680 - RNA, 32 nt, Human
cccagccugggagacagagugagacccugucu

SEQ ID NO: 368681 - RNA, 32 nt, Human
cccagccugggagcaauucaggcccauucuuu

SEQ ID NO: 368682 - RNA, 32 nt, Human
cccagccugggcaacagagcaagacuccaucu

SEQ ID NO: 368683 - RNA, 32 nt, Human
cccagccugggcaacagagcaagacuccguac

SEQ ID NO: 368684 - RNA, 32 nt, Human
cccagccugggccacagugcaagacuccaucu

SEQ ID NO: 368685 - RNA, 32 nt, Human
cccagccugggcgacagagcgagacucugucu

SEQ ID NO: 368686 - RNA, 32 nt, Human
cccagccugggcugcagaaagcagcaguuaaa

SEQ ID NO: 368687 - RNA, 32 nt, Human
cccagccuggggcagaaauggcugcaaguggc

SEQ ID NO: 368688 - RNA, 24 nt, Human
cccagccugggugacagagcgaga

SEQ ID NO: 368689 - RNA, 32 nt, Human
cccagccugggugacagagcgagacuccgucu

SEQ ID NO: 368690 - RNA, 32 nt, Human
cccagccugggugacagagcgagacucugucu

SEQ ID NO: 368691 - RNA, 32 nt, Human
cccagccugggugacagagcgagacuuugucu

SEQ ID NO: 368692 - RNA, 32 nt, Human
cccagccugggugacagcgagauccugucuca

SEQ ID NO: 368693 - RNA, 32 nt, Human
cccagccugguggcagaggaagcagguggcac

SEQ ID NO: 368694 - RNA, 32 nt, Human
cccagccuguauacccagauuacuuuggugaa

SEQ ID NO: 368695 - RNA, 32 nt, Human
cccagccugucaaguccucuucugccucagcu

SEQ ID NO: 368696 - RNA, 32 nt, Human
cccagccuguccaggauacaguggggcugagc

SEQ ID NO: 368697 - RNA, 19 nt, Human
cccagccuguccauccuca

SEQ ID NO: 368698 - RNA, 32 nt, Human
cccagccuguccccauucucauggcccuuugg

SEQ ID NO: 368699 - RNA, 32 nt, Human
cccagccuguuucucuuuuuccacucuucuuu

SEQ ID NO: 368700 - RNA, 22 nt, Human
cccagccuucccaaagcagcag

SEQ ID NO: 368701 - RNA, 32 nt, Human
cccagccuuccuucccugacccugagacucac

SEQ ID NO: 368702 - RNA, 22 nt, Human
cccagccuucucccggcgucuc

SEQ ID NO: 368703 - RNA, 22 nt, Human
cccagccuucuggacccagcca

SEQ ID NO: 368704 - RNA, 20 nt, Human
cccagccuugaggcugcagu

SEQ ID NO: 368705 - RNA, 19 nt, Human
cccagccuugagggaggga

SEQ ID NO: 368706 - RNA, 20 nt, Human
cccagccuugcagggaccag

SEQ ID NO: 368707 - RNA, 32 nt, Human
cccagccuuggcaacagagcaagacuccaucu

SEQ ID NO: 368708 - RNA, 22 nt, Human
cccagccuuucagagacaggga

SEQ ID NO: 368709 - RNA, 32 nt, Human
cccagcgacuuccguccuaccuggcaugcugc

SEQ ID NO: 368710 - RNA, 32 nt, Human
cccagcgagcagcggcggugcccacacgcugg

SEQ ID NO: 368711 - RNA, 25 nt, Human
cccagcgagccccugguggcagugg

SEQ ID NO: 368712 - RNA, 19 nt, Human
cccagcgauucccucuccc

SEQ ID NO: 368713 - RNA, 32 nt, Human
cccagcgauucuccugccucagccucuuccua

SEQ ID NO: 368714 - RNA, 28 nt, Human
cccagcgcacgggcugccuccaucaggg

SEQ ID NO: 368715 - RNA, 20 nt, Human
cccagcgcagccguggcagc

SEQ ID NO: 368716 - RNA, 19 nt, Human
cccagcgcagucccgggag

SEQ ID NO: 368717 - RNA, 32 nt, Human
cccagcgcagugccucaugccuguaaucccag

SEQ ID NO: 368718 - RNA, 32 nt, Human
cccagcgccagccugggccguggagguggggg

SEQ ID NO: 368719 - RNA, 32 nt, Human
cccagcgccauccugaggaucggggugggggu

SEQ ID NO: 368720 - RNA, 32 nt, Human
cccagcgcccaggaguuggggauguccuacaa

SEQ ID NO: 368721 - RNA, 32 nt, Human
cccagcgccuggcuccaggaaaacacgcuugc

SEQ ID NO: 368722 - RNA, 19 nt, Human
cccagcgcggccucaacca

SEQ ID NO: 368723 - RNA, 32 nt, Human
cccagcgcgggccuuugaggaugaggaggagg

SEQ ID NO: 368724 - RNA, 32 nt, Human
cccagcgcgguggcucacaccuguaaucccag

SEQ ID NO: 368725 - RNA, 32 nt, Human
cccagcgcgguuucagcauuuaauuuuaaggg

SEQ ID NO: 368726 - RNA, 25 nt, Human
cccagcgcucgugaccaaggauaca

SEQ ID NO: 368727 - RNA, 32 nt, Human
cccagcgcuggcagacaccgugaggcuggcag

SEQ ID NO: 368728 - RNA, 32 nt, Human
cccagcgcugucugcccgaggauuugccugaa

SEQ ID NO: 368729 - RNA, 32 nt, Human
cccagcgcugugguggggagcgguuugcccuu

SEQ ID NO: 368730 - RNA, 20 nt, Human
cccagcggacaccggcagcg

SEQ ID NO: 368731 - RNA, 32 nt, Human
cccagcggagccaagccccacgcuggccggac

SEQ ID NO: 368732 - RNA, 32 nt, Human
cccagcggccgggcauguagcagcggcagcaa

SEQ ID NO: 368733 - RNA, 32 nt, Human
cccagcggccuuccacccugacugccugaaca

SEQ ID NO: 368734 - RNA, 24 nt, Human
cccagcggcuggagcagcagacgu

SEQ ID NO: 368735 - RNA, 32 nt, Human
cccagcggcuguucccccugccgcaggugggu

SEQ ID NO: 368736 - RNA, 20 nt, Human
cccagcgggaggaggcgcgg

SEQ ID NO: 368737 - RNA, 32 nt, Human
cccagcgggaggugggaugugagacagcccac

SEQ ID NO: 368738 - RNA, 32 nt, Human
cccagcgggcaggcaggcaggaggaggcggag

SEQ ID NO: 368739 - RNA, 22 nt, Human
cccagcggugacagcagcaggg

SEQ ID NO: 368740 - RNA, 32 nt, Human
cccagcggugcuaagaguggucucagugagaa

SEQ ID NO: 368741 - RNA, 32 nt, Human
cccagcgguggcugagcaaugugcgagccugu

SEQ ID NO: 368742 - RNA, 31 nt, Human
cccagcgucacuucugcuaggagggacccgu

SEQ ID NO: 368743 - RNA, 32 nt, Human
cccagcgugaagccagggcccgggaagcaaau

SEQ ID NO: 368744 - RNA, 22 nt, Human
cccagcgugcccuggcucucca

SEQ ID NO: 368745 - RNA, 32 nt, Human
cccagcgugggaccccaagugaagacgaggcc

SEQ ID NO: 368746 - RNA, 32 nt, Human
cccagcgugguggcucaugccuguaaucccag

SEQ ID NO: 368747 - RNA, 21 nt, Human
cccagcgugguggggcagcag

SEQ ID NO: 368748 - RNA, 32 nt, Human
cccagcguggugguucaugccuguaauaccag

SEQ ID NO: 368749 - RNA, 32 nt, Human
cccagcguuuucugagaaguacuucagaaucu

SEQ ID NO: 368750 - RNA, 32 nt, Human
cccagcuaaaccugccucugugccaguggcuc

SEQ ID NO: 368751 - RNA, 32 nt, Human
cccagcuaaagcaguccuccagccucggccuc

SEQ ID NO: 368752 - RNA, 32 nt, Human
cccagcuaaaggaggcugagguugcagugagc

SEQ ID NO: 368753 - RNA, 32 nt, Human
cccagcuaacccacagaauuaugagagauaaa

SEQ ID NO: 368754 - RNA, 21 nt, Human
cccagcuaacuucugcucguc

SEQ ID NO: 368755 - RNA, 16 nt, Human
cccagcuaccugggag

SEQ ID NO: 368756 - RNA, 32 nt, Human
cccagcuacuaaaaauacuuguauuuuuagua

SEQ ID NO: 368757 - RNA, 32 nt, Human
cccagcuacuagggaggcugaggcaggagaau

SEQ ID NO: 368758 - RNA, 32 nt, Human
cccagcuacucaagagguugcagugagcugag

SEQ ID NO: 368759 - RNA, 32 nt, Human
cccagcuacucgggggcugagccaggcggaua

SEQ ID NO: 368760 - RNA, 32 nt, Human
cccagcuacuugaugcgaaggcugaggcaaaa

SEQ ID NO: 368761 - RNA, 32 nt, Human
cccagcuacuuugggagguugaggcaggagga

SEQ ID NO: 368762 - RNA, 18 nt, Human
cccagcuagagucagugg

SEQ ID NO: 368763 - RNA, 32 nt, Human
cccagcuagcucucgccucacugaggccuccc

SEQ ID NO: 368764 - RNA, 32 nt, Human
cccagcuagcuggccagguggggaggggcugg

SEQ ID NO: 368765 - RNA, 20 nt, Human
cccagcuaggagcagcagca

SEQ ID NO: 368766 - RNA, 32 nt, Human
cccagcuaguguuccucagaacaaagauugga

SEQ ID NO: 368767 - RNA, 22 nt, Human
cccagcuaugaagccuaucuug

SEQ ID NO: 368768 - RNA, 32 nt, Human
cccagcucaagcaauccucccaccucagccuc

SEQ ID NO: 368769 - RNA, 32 nt, Human
cccagcucaagccauggcaggcguggcaagca

SEQ ID NO: 368770 - RNA, 32 nt, Human
cccagcucaagugauccucccaccucagccuc

SEQ ID NO: 368771 - RNA, 32 nt, Human
cccagcucaagugauccuccuaccucagccuc

SEQ ID NO: 368772 - RNA, 21 nt, Human
cccagcucacccucaccccag

SEQ ID NO: 368773 - RNA, 18 nt, Human
cccagcucacuccagggc

SEQ ID NO: 368774 - RNA, 32 nt, Human
cccagcucacugcaaccuccgccuccuggguu

SEQ ID NO: 368775 - RNA, 32 nt, Human
cccagcucacugcagccucgaccucccuggcu

SEQ ID NO: 368776 - RNA, 21 nt, Human
cccagcucagagugcccguca

SEQ ID NO: 368777 - RNA, 32 nt, Human
cccagcucagcaccuggugcaaguaagcacaa

SEQ ID NO: 368778 - RNA, 32 nt, Human
cccagcucagcaucuucagcugugcccaggcu

SEQ ID NO: 368779 - RNA, 32 nt, Human
cccagcucagccugcugaccagcugggaugau

SEQ ID NO: 368780 - RNA, 18 nt, Human
cccagcucagcgccggcu

SEQ ID NO: 368781 - RNA, 23 nt, Human
cccagcucagcucgucaagcugc

SEQ ID NO: 368782 - RNA, 20 nt, Human
cccagcucagcucuuacugc

SEQ ID NO: 368783 - RNA, 32 nt, Human
cccagcucagcugccaggcccuucccugugcc

SEQ ID NO: 368784 - RNA, 25 nt, Human
cccagcucagggcagguccagcugu

SEQ ID NO: 368785 - RNA, 32 nt, Human
cccagcucagggugaugccugcugccuuugau

SEQ ID NO: 368786 - RNA, 32 nt, Human
cccagcucagguagggcugagacucucaggug

SEQ ID NO: 368787 - RNA, 22 nt, Human
cccagcucaguucucagcucug

SEQ ID NO: 368788 - RNA, 22 nt, Human
cccagcucauccaugugcuugu

SEQ ID NO: 368789 - RNA, 21 nt, Human
cccagcucaugcccccuuuca

SEQ ID NO: 368790 - RNA, 21 nt, Human
cccagcucaugccucuuggug

SEQ ID NO: 368791 - RNA, 21 nt, Human
cccagcucauuccucuuguca

SEQ ID NO: 368792 - RNA, 32 nt, Human
cccagcucauuucauucgacugcccaggccau

SEQ ID NO: 368793 - RNA, 32 nt, Human
cccagcuccaaugucaucuucucuggaagccg

SEQ ID NO: 368794 - RNA, 21 nt, Human
cccagcuccacccucucguca

SEQ ID NO: 368795 - RNA, 32 nt, Human
cccagcuccacuccagccuggcguccagggcc

SEQ ID NO: 368796 - RNA, 32 nt, Human
cccagcuccagccauccaccccucagcccuuu

SEQ ID NO: 368797 - RNA, 32 nt, Human
cccagcuccagccgccggcucggacucggucu

SEQ ID NO: 368798 - RNA, 32 nt, Human
cccagcuccauuccgcucccaccccagccggc

SEQ ID NO: 368799 - RNA, 32 nt, Human
cccagcucccaaaaugucugggaugccucggg

SEQ ID NO: 368800 - RNA, 32 nt, Human
cccagcucccaccuccccuugggcccacaccu

SEQ ID NO: 368801 - RNA, 20 nt, Human
cccagcucccauggccccca

SEQ ID NO: 368802 - RNA, 32 nt, Human
cccagcuccccuugggucucagugccagugcu

SEQ ID NO: 368803 - RNA, 32 nt, Human
cccagcucccgaccugcacuuccugcuggacu

SEQ ID NO: 368804 - RNA, 32 nt, Human
cccagcucccucuugccccuccaggaagcugc

SEQ ID NO: 368805 - RNA, 23 nt, Human
cccagcuccgccuccccacacuc

SEQ ID NO: 368806 - RNA, 19 nt, Human
cccagcuccgcugcugccg

SEQ ID NO: 368807 - RNA, 32 nt, Human
cccagcuccuaccugccucccacgccucaggu

SEQ ID NO: 368808 - RNA, 32 nt, Human
cccagcuccuauaccucuaccuuuccagccaa

SEQ ID NO: 368809 - RNA, 32 nt, Human
cccagcuccucacuuccgugugccucaugccu

SEQ ID NO: 368810 - RNA, 19 nt, Human
cccagcuccucagacauca

SEQ ID NO: 368811 - RNA, 21 nt, Human
cccagcuccuccugccuccca

SEQ ID NO: 368812 - RNA, 32 nt, Human
cccagcuccucgggaggcaggagaaucgcuug

SEQ ID NO: 368813 - RNA, 32 nt, Human
cccagcuccugcacuucuccccagagcgggac

SEQ ID NO: 368814 - RNA, 32 nt, Human
cccagcuccugccucccaguggccucuguagg

SEQ ID NO: 368815 - RNA, 21 nt, Human
cccagcuccugccuccuguca

SEQ ID NO: 368816 - RNA, 32 nt, Human
cccagcuccugccuccugucagcgucuacagg

SEQ ID NO: 368817 - RNA, 32 nt, Human
cccagcuccugccucuaauggccugguuaggc

SEQ ID NO: 368818 - RNA, 32 nt, Human
cccagcuccuggaggcaguggcuguagcagcc

SEQ ID NO: 368819 - RNA, 32 nt, Human
cccagcuccugggcuuugucccuucccaauaa

SEQ ID NO: 368820 - RNA, 18 nt, Human
cccagcuccuucccgggc

SEQ ID NO: 368821 - RNA, 24 nt, Human
cccagcucgcucuccccacuguca

SEQ ID NO: 368822 - RNA, 32 nt, Human
cccagcucgcugggguuggaggacugucauca

SEQ ID NO: 368823 - RNA, 32 nt, Human
cccagcucgggaccuggugcugaucagagugg

SEQ ID NO: 368824 - RNA, 21 nt, Human
cccagcucgucccggccucca

SEQ ID NO: 368825 - RNA, 32 nt, Human
cccagcucuaauuccauccaucuacccaacug

SEQ ID NO: 368826 - RNA, 32 nt, Human
cccagcucucagggacaagaccagucccccag

SEQ ID NO: 368827 - RNA, 32 nt, Human
cccagcucuccucugccagccacccuaaauuc

SEQ ID NO: 368828 - RNA, 32 nt, Human
cccagcucuccucuguggguuuuaccggaaag

SEQ ID NO: 368829 - RNA, 19 nt, Human
cccagcucuccugccuguc

SEQ ID NO: 368830 - RNA, 32 nt, Human
cccagcucucuuucccuucugggugucuuugc

SEQ ID NO: 368831 - RNA, 23 nt, Human
cccagcucugcccucugggucca

SEQ ID NO: 368832 - RNA, 23 nt, Human
cccagcucugcugcaggcagugg

SEQ ID NO: 368833 - RNA, 32 nt, Human
cccagcucugcuuuccagcgcuugguggaauc

SEQ ID NO: 368834 - RNA, 32 nt, Human
cccagcucuggccacugcuccagacaucccca

SEQ ID NO: 368835 - RNA, 21 nt, Human
cccagcucugucaggcauugg

SEQ ID NO: 368836 - RNA, 32 nt, Human
cccagcucuguucugcccccgcuuuccucugu

SEQ ID NO: 368837 - RNA, 32 nt, Human
cccagcugaaggaggcuggcaggaguuggcaa

SEQ ID NO: 368838 - RNA, 32 nt, Human
cccagcugacagccagcgacuggcagagcccc

SEQ ID NO: 368839 - RNA, 32 nt, Human
cccagcugaccaccccucccagcuccaauucc

SEQ ID NO: 368840 - RNA, 32 nt, Human
cccagcugaccuggaaugaggccuaaccacaa

SEQ ID NO: 368841 - RNA, 32 nt, Human
cccagcugaccuuccacccagaccugcugcag

SEQ ID NO: 368842 - RNA, 32 nt, Human
cccagcugaccuuucuuaagccuucacuguug

SEQ ID NO: 368843 - RNA, 21 nt, Human
cccagcugacgcaucuucuuu

SEQ ID NO: 368844 - RNA, 22 nt, Human
cccagcugacuucugcugauca

SEQ ID NO: 368845 - RNA, 19 nt, Human
cccagcugaggaccaggug

SEQ ID NO: 368846 - RNA, 32 nt, Human
cccagcugaggcacgauaauugcuugaacccg

SEQ ID NO: 368847 - RNA, 32 nt, Human
cccagcugagugucugucagcuucauucucuc

SEQ ID NO: 368848 - RNA, 32 nt, Human
cccagcugcaagugccuuccuuggagcagaga

SEQ ID NO: 368849 - RNA, 32 nt, Human
cccagcugcacugacuccuccuccaggaagcc

SEQ ID NO: 368850 - RNA, 21 nt, Human
cccagcugcagaccuucaucc

SEQ ID NO: 368851 - RNA, 17 nt, Human
cccagcugcagagucag

SEQ ID NO: 368852 - RNA, 31 nt, Human
cccagcugcagcaaggagguggggaaggagg

SEQ ID NO: 368853 - RNA, 32 nt, Human
cccagcugcagcucucugggucccccggugcc

SEQ ID NO: 368854 - RNA, 19 nt, Human
cccagcugccaccucucca

SEQ ID NO: 368855 - RNA, 32 nt, Human
cccagcugccagccuucuguccugggcaaacu

SEQ ID NO: 368856 - RNA, 32 nt, Human
cccagcugccagggaagacagagcaggcuuug

SEQ ID NO: 368857 - RNA, 32 nt, Human
cccagcugcccaggacggggcaagauguccaa

SEQ ID NO: 368858 - RNA, 32 nt, Human
cccagcugcccaggcugaggcaagagaaggcc

SEQ ID NO: 368859 - RNA, 32 nt, Human
cccagcugccucucccugcacccuggcccauc

SEQ ID NO: 368860 - RNA, 31 nt, Human
cccagcugccucugugcccuggccucuuucc

SEQ ID NO: 368861 - RNA, 32 nt, Human
cccagcugcugagaggaguugccugagaguga

SEQ ID NO: 368862 - RNA, 32 nt, Human
cccagcugcugcggaggcaggcugagggcgca

SEQ ID NO: 368863 - RNA, 32 nt, Human
cccagcugcuucuccuuuacuaacacaccugc

SEQ ID NO: 368864 - RNA, 32 nt, Human
cccagcuggaacacaggaaguuggagcaguag

SEQ ID NO: 368865 - RNA, 23 nt, Human
cccagcuggaacagcugaaguca

SEQ ID NO: 368866 - RNA, 22 nt, Human
cccagcuggaaccuggcagagg

SEQ ID NO: 368867 - RNA, 32 nt, Human
cccagcuggaagaggagagggaucagcucauc

SEQ ID NO: 368868 - RNA, 32 nt, Human
cccagcuggagcaauucuccugccucagccuu

SEQ ID NO: 368869 - RNA, 32 nt, Human
cccagcuggagggcccgaggcugcaggguguc

SEQ ID NO: 368870 - RNA, 18 nt, Human
cccagcuggagugcagug

SEQ ID NO: 368871 - RNA, 19 nt, Human
cccagcuggagugcagugg

SEQ ID NO: 368872 - RNA, 21 nt, Human
cccagcuggagugcaguggug

SEQ ID NO: 368873 - RNA, 18 nt, Human
cccagcuggccccagggc

SEQ ID NO: 368874 - RNA, 20 nt, Human
cccagcuggccuggccccca

SEQ ID NO: 368875 - RNA, 32 nt, Human
cccagcuggccuggcccccagcuucaccucug

SEQ ID NO: 368876 - RNA, 21 nt, Human
cccagcuggcuccuggcccca

SEQ ID NO: 368877 - RNA, 20 nt, Human
cccagcuggcugcagcacuu

SEQ ID NO: 368878 - RNA, 32 nt, Human
cccagcugggcugagggcccugaccacagcua

SEQ ID NO: 368879 - RNA, 32 nt, Human
cccagcuggggacugcuccauggccauggaga

SEQ ID NO: 368880 - RNA, 17 nt, Human
cccagcugggugcagug

SEQ ID NO: 368881 - RNA, 18 nt, Human
cccagcugggugcagugg

SEQ ID NO: 368882 - RNA, 32 nt, Human
cccagcugguauaaucucugugccucaguguu

SEQ ID NO: 368883 - RNA, 32 nt, Human
cccagcuggucugcuuggauuuccuacagccc

SEQ ID NO: 368884 - RNA, 25 nt, Human
cccagcuguagugagguugcaguga

SEQ ID NO: 368885 - RNA, 32 nt, Human
cccagcugucacucucucccacccccgggcag

SEQ ID NO: 368886 - RNA, 32 nt, Human
cccagcugucugcaggcaccaggcugggauga

SEQ ID NO: 368887 - RNA, 32 nt, Human
cccagcugucugcaguggcugacagcagggag

SEQ ID NO: 368888 - RNA, 32 nt, Human
cccagcugugcccagaggacagccaggcaggc

SEQ ID NO: 368889 - RNA, 23 nt, Human
cccagcugugccccucccccagg

SEQ ID NO: 368890 - RNA, 16 nt, Human
cccagcugugcugcug

SEQ ID NO: 368891 - RNA, 32 nt, Human
cccagcugugggagguggcgggaacaggggug

SEQ ID NO: 368892 - RNA, 32 nt, Human
cccagcugugggggcaguggggugggggagac

SEQ ID NO: 368893 - RNA, 32 nt, Human
cccagcuguggucccagagaucaggggguguu

SEQ ID NO: 368894 - RNA, 32 nt, Human
cccagcugugugucaccagcagcuuucccagc

SEQ ID NO: 368895 - RNA, 32 nt, Human
cccagcuguugacuuccagucacugucccaga

SEQ ID NO: 368896 - RNA, 32 nt, Human
cccagcuguugccuggcuuuccagaaacagaa

SEQ ID NO: 368897 - RNA, 32 nt, Human
cccagcuguuuagguugcuggaggccgggcua

SEQ ID NO: 368898 - RNA, 24 nt, Human
cccagcuuaaccccugccauccca

SEQ ID NO: 368899 - RNA, 32 nt, Human
cccagcuuagaguucuucuuucuuucuuaagc

SEQ ID NO: 368900 - RNA, 32 nt, Human
cccagcuuagccccaaagaccaaccaaagagc

SEQ ID NO: 368901 - RNA, 32 nt, Human
cccagcuuaggucccugacggggcugcuggug

SEQ ID NO: 368902 - RNA, 24 nt, Human
cccagcuucaccccucacccccag

SEQ ID NO: 368903 - RNA, 16 nt, Human
cccagcuucacuucug

SEQ ID NO: 368904 - RNA, 32 nt, Human
cccagcuucagcccuggcugcagcugcagcgc

SEQ ID NO: 368905 - RNA, 32 nt, Human
cccagcuucagccucaccuucccuguggucuu

SEQ ID NO: 368906 - RNA, 19 nt, Human
cccagcuucccucugcugu

SEQ ID NO: 368907 - RNA, 32 nt, Human
cccagcuucccucugcugugccacggcuguug

SEQ ID NO: 368908 - RNA, 32 nt, Human
cccagcuucuccccugcccuauucugcuucac

SEQ ID NO: 368909 - RNA, 22 nt, Human
cccagcuucucucucccuguca

SEQ ID NO: 368910 - RNA, 32 nt, Human
cccagcuucuucucgucucccaccccagcuuc

SEQ ID NO: 368911 - RNA, 32 nt, Human
cccagcuucuuggcuuggaggcugagguagga

SEQ ID NO: 368912 - RNA, 28 nt, Human
cccagcuucuugggaggccaaggcacaa

SEQ ID NO: 368913 - RNA, 19 nt, Human
cccagcuugagugcagugg

SEQ ID NO: 368914 - RNA, 32 nt, Human
cccagcuugcccaccgcgggcugucugcucuc

SEQ ID NO: 368915 - RNA, 19 nt, Human
cccagcuuggccuccccac

SEQ ID NO: 368916 - RNA, 32 nt, Human
cccagcuugggagcugugggucugccaggucc

SEQ ID NO: 368917 - RNA, 21 nt, Human
cccagcuugguggcaugcaug

SEQ ID NO: 368918 - RNA, 32 nt, Human
cccagcuugguuuggguggcagcugggagaac

SEQ ID NO: 368919 - RNA, 25 nt, Human
cccagcuuguuagucacccacuaua

SEQ ID NO: 368920 - RNA, 20 nt, Human
cccagcuuuauugcugcuau

SEQ ID NO: 368921 - RNA, 32 nt, Human
cccagcuuucaggccagcauugaggacaggag

SEQ ID NO: 368922 - RNA, 32 nt, Human
cccagcuuuccaggaacccuacuggcugccag

SEQ ID NO: 368923 - RNA, 21 nt, Human
cccagcuuuuagguucuuuaa

SEQ ID NO: 368924 - RNA, 21 nt, Human
cccaggaaaaaacggaucucu

SEQ ID NO: 368925 - RNA, 23 nt, Human
cccaggaaaaaaucaaugaucuc

SEQ ID NO: 368926 - RNA, 15 nt, Human
cccaggaaaacuguu

SEQ ID NO: 368927 - RNA, 15 nt, Human
cccaggaaaaguguc

SEQ ID NO: 368928 - RNA, 32 nt, Human
cccaggaaaccagcagaugcccagcuguagcu

SEQ ID NO: 368929 - RNA, 15 nt, Human
cccaggaaagcuguc

SEQ ID NO: 368930 - RNA, 22 nt, Human
cccaggaaaggccagcccaguc

SEQ ID NO: 368931 - RNA, 21 nt, Human
cccaggaaaggggugcaaaga

SEQ ID NO: 368932 - RNA, 15 nt, Human
cccaggaaaguuguc

SEQ ID NO: 368933 - RNA, 22 nt, Human
cccaggaaauagagguugcagu

SEQ ID NO: 368934 - RNA, 24 nt, Human
cccaggaaauagagguugcaguga

SEQ ID NO: 368935 - RNA, 23 nt, Human
cccaggaaauugacuuugcagug

SEQ ID NO: 368936 - RNA, 24 nt, Human
cccaggaaauugaggcugcaguga

SEQ ID NO: 368937 - RNA, 24 nt, Human
cccaggaaauuggggcugcaguga

SEQ ID NO: 368938 - RNA, 18 nt, Human
cccaggaacaacugaugg

SEQ ID NO: 368939 - RNA, 19 nt, Human
cccaggaacagcauccugg

SEQ ID NO: 368940 - RNA, 32 nt, Human
cccaggaaccuacaggggugucagccgcugag

SEQ ID NO: 368941 - RNA, 32 nt, Human
cccaggaacgcuaagacacaggcuccaguagg

SEQ ID NO: 368942 - RNA, 32 nt, Human
cccaggaacuagaagagagcgaggccuccggg

SEQ ID NO: 368943 - RNA, 32 nt, Human
cccaggaacuccucgguccagagaccaagugg

SEQ ID NO: 368944 - RNA, 32 nt, Human
cccaggaacuguuguuuucucaggauucuuuc

SEQ ID NO: 368945 - RNA, 32 nt, Human
cccaggaagaagcuggccagaggggcagcuca

SEQ ID NO: 368946 - RNA, 22 nt, Human
cccaggaagacacugaccugcu

SEQ ID NO: 368947 - RNA, 22 nt, Human
cccaggaagaggagguugcagu

SEQ ID NO: 368948 - RNA, 24 nt, Human
cccaggaagaggagguugcaguga

SEQ ID NO: 368949 - RNA, 32 nt, Human
cccaggaagaggagguugcagugagccgagau

SEQ ID NO: 368950 - RNA, 17 nt, Human
cccaggaagagucuguc

SEQ ID NO: 368951 - RNA, 32 nt, Human
cccaggaagaugaccuggcuucccugaauccc

SEQ ID NO: 368952 - RNA, 22 nt, Human
cccaggaagcagagguugcagu

SEQ ID NO: 368953 - RNA, 24 nt, Human
cccaggaagcagagguugcaguaa

SEQ ID NO: 368954 - RNA, 24 nt, Human
cccaggaagcagagguugcaguga

SEQ ID NO: 368955 - RNA, 32 nt, Human
cccaggaagcagagguugcagugagcagagau

SEQ ID NO: 368956 - RNA, 32 nt, Human
cccaggaagcagugggaggugguggcagauau

SEQ ID NO: 368957 - RNA, 32 nt, Human
cccaggaagccugcugcaucccuucccccgag

SEQ ID NO: 368958 - RNA, 24 nt, Human
cccaggaagcggaggcugcaguga

SEQ ID NO: 368959 - RNA, 20 nt, Human
cccaggaagcggagguugca

SEQ ID NO: 368960 - RNA, 24 nt, Human
cccaggaagcggagguugcaauga

SEQ ID NO: 368961 - RNA, 24 nt, Human
cccaggaagcggagguugcaguga

SEQ ID NO: 368962 - RNA, 32 nt, Human
cccaggaagcggagguugcagugagccaagau

SEQ ID NO: 368963 - RNA, 32 nt, Human
cccaggaagcggagguugcagugagccgagau

SEQ ID NO: 368964 - RNA, 21 nt, Human
cccaggaagcgggguugcagu

SEQ ID NO: 368965 - RNA, 23 nt, Human
cccaggaagcgggguugcaguga

SEQ ID NO: 368966 - RNA, 24 nt, Human
cccaggaagcuuuccagugaucuc

SEQ ID NO: 368967 - RNA, 19 nt, Human
cccaggaagggaggcuguc

SEQ ID NO: 368968 - RNA, 21 nt, Human
cccaggaagggcugcagcuga

SEQ ID NO: 368969 - RNA, 32 nt, Human
cccaggaaggugaccugccugaccaugaagca

SEQ ID NO: 368970 - RNA, 32 nt, Human
cccaggaaguagaagcuacagugagucgagau

SEQ ID NO: 368971 - RNA, 17 nt, Human
cccaggaaguaugcagu

SEQ ID NO: 368972 - RNA, 24 nt, Human
cccaggaagucaaggcugcaguga

SEQ ID NO: 368973 - RNA, 32 nt, Human
cccaggaagugcugggauuacaggcaugagcc

SEQ ID NO: 368974 - RNA, 22 nt, Human
cccaggaaguggagacugcagu

SEQ ID NO: 368975 - RNA, 24 nt, Human
cccaggaaguggagacugcaguga

SEQ ID NO: 368976 - RNA, 32 nt, Human
cccaggaaguggagacugcagugagccgauau

SEQ ID NO: 368977 - RNA, 22 nt, Human
cccaggaaguggagauugcagu

SEQ ID NO: 368978 - RNA, 24 nt, Human
cccaggaaguggagauugcaguga

SEQ ID NO: 368979 - RNA, 24 nt, Human
cccaggaaguggaggcugcaguga

SEQ ID NO: 368980 - RNA, 22 nt, Human
cccaggaaguggagguugcagu

SEQ ID NO: 368981 - RNA, 24 nt, Human
cccaggaaguggagguugcaguga

SEQ ID NO: 368982 - RNA, 32 nt, Human
cccaggaaguggagguugcagugagcagagau

SEQ ID NO: 368983 - RNA, 32 nt, Human
cccaggaaguggagguugcagugagccgagau

SEQ ID NO: 368984 - RNA, 32 nt, Human
cccaggaaguggagguugcagugagcuaagau

SEQ ID NO: 368985 - RNA, 32 nt, Human
cccaggaaguggagguugcagugagcugagau

SEQ ID NO: 368986 - RNA, 32 nt, Human
cccaggaaguggagguugcagugagcugaggu

SEQ ID NO: 368987 - RNA, 22 nt, Human
cccaggaaguggcaguugcagu

SEQ ID NO: 368988 - RNA, 24 nt, Human
cccaggaaguggcaguugcaguga

SEQ ID NO: 368989 - RNA, 32 nt, Human
cccaggaaguggcaguugcagugagccgagac

SEQ ID NO: 368990 - RNA, 24 nt, Human
cccaggaaguugaggcugcaguga

SEQ ID NO: 368991 - RNA, 32 nt, Human
cccaggaaugacagacagggguagaguugcug

SEQ ID NO: 368992 - RNA, 32 nt, Human
cccaggaaugaucauuugcugaagaugguguc

SEQ ID NO: 368993 - RNA, 32 nt, Human
cccaggaauucaagaccagccugggcaacaug

SEQ ID NO: 368994 - RNA, 32 nt, Human
cccaggaauucaagaccagccugggcaacuca

SEQ ID NO: 368995 - RNA, 24 nt, Human
cccaggaauucaaggcugcaguga

SEQ ID NO: 368996 - RNA, 24 nt, Human
cccaggaauucaaggcuucaccga

SEQ ID NO: 368997 - RNA, 21 nt, Human
cccaggaauucaggcugcagu

SEQ ID NO: 368998 - RNA, 23 nt, Human
cccaggaauucaggcugcaguaa

SEQ ID NO: 368999 - RNA, 32 nt, Human
cccaggaauucgaaaucagccuaggcaacaua

SEQ ID NO: 369000 - RNA, 22 nt, Human
cccaggaauugaaggcagcagu

SEQ ID NO: 369001 - RNA, 24 nt, Human
cccaggaauuggaggcugcaguga

SEQ ID NO: 369002 - RNA, 32 nt, Human
cccaggaauuggaggcugcagugagcuaugau

SEQ ID NO: 369003 - RNA, 24 nt, Human
cccaggaauuugaggcugcagcga

SEQ ID NO: 369004 - RNA, 22 nt, Human
cccaggaauuugagguugcagu

SEQ ID NO: 369005 - RNA, 24 nt, Human
cccaggaauuugagguugcaguaa

SEQ ID NO: 369006 - RNA, 24 nt, Human
cccaggaauuugagguuguaguga

SEQ ID NO: 369007 - RNA, 23 nt, Human
cccaggacaagccaaggauccaa

SEQ ID NO: 369008 - RNA, 32 nt, Human
cccaggacaaguucacuugcauuugucagccu

SEQ ID NO: 369009 - RNA, 24 nt, Human
cccaggacacggagauugcaguga

SEQ ID NO: 369010 - RNA, 32 nt, Human
cccaggacacggagauugcagugagccaagau

SEQ ID NO: 369011 - RNA, 25 nt, Human
cccaggacaggauccaggccggcuu

SEQ ID NO: 369012 - RNA, 24 nt, Human
cccaggacaucgaggcugcgguga

SEQ ID NO: 369013 - RNA, 32 nt, Human
cccaggacauguucgacaauggcagcuuucuc

SEQ ID NO: 369014 - RNA, 22 nt, Human
cccaggacauucccugccccuu

SEQ ID NO: 369015 - RNA, 32 nt, Human
cccaggaccacaggcucaggcagggccuccau

SEQ ID NO: 369016 - RNA, 32 nt, Human
cccaggaccacaggcugagacgagacgcaggg

SEQ ID NO: 369017 - RNA, 32 nt, Human
cccaggaccagcuuucuugucaccuugagguc

SEQ ID NO: 369018 - RNA, 32 nt, Human
cccaggacccacccauguuuucacuaucccuu

SEQ ID NO: 369019 - RNA, 20 nt, Human
cccaggacccccuguuccca

SEQ ID NO: 369020 - RNA, 32 nt, Human
cccaggaccccuuuuccacccugggccccaau

SEQ ID NO: 369021 - RNA, 32 nt, Human
cccaggacccuccacucacugcugugagugcg

SEQ ID NO: 369022 - RNA, 32 nt, Human
cccaggacccuccagaggcagccuggccugug

SEQ ID NO: 369023 - RNA, 23 nt, Human
cccaggacccucugagcugggag

SEQ ID NO: 369024 - RNA, 22 nt, Human
cccaggacccuggacccagcca

SEQ ID NO: 369025 - RNA, 25 nt, Human
cccaggacccuucaaagggcuggga

SEQ ID NO: 369026 - RNA, 32 nt, Human
cccaggaccucuggaccucagguucccaagac

SEQ ID NO: 369027 - RNA, 32 nt, Human
cccaggacgagaugccuuguuucuuuuacaau

SEQ ID NO: 369028 - RNA, 24 nt, Human
cccaggacgcagagguugcgguga

SEQ ID NO: 369029 - RNA, 32 nt, Human
cccaggacucacucacaccuauucuccaacuc

SEQ ID NO: 369030 - RNA, 32 nt, Human
cccaggacucacuccucaacccuucccuuccc

SEQ ID NO: 369031 - RNA, 32 nt, Human
cccaggacuccagaugccaggagcccugcugc

SEQ ID NO: 369032 - RNA, 32 nt, Human
cccaggacuccucgcuccuccuggagggccug

SEQ ID NO: 369033 - RNA, 32 nt, Human
cccaggacucuggcuucucuccucagacuucu

SEQ ID NO: 369034 - RNA, 32 nt, Human
cccaggacucuguuuacgugcccagucagccc

SEQ ID NO: 369035 - RNA, 19 nt, Human
cccaggacugcagcggcuu

SEQ ID NO: 369036 - RNA, 22 nt, Human
cccaggacugcgcucugcccca

SEQ ID NO: 369037 - RNA, 32 nt, Human
cccaggacuggagcuuucucuggccaaguuuc

SEQ ID NO: 369038 - RNA, 32 nt, Human
cccaggacuucaagaccagccuaggcaacaug

SEQ ID NO: 369039 - RNA, 32 nt, Human
cccaggacuuccuaaugugcagcuaggguugg

SEQ ID NO: 369040 - RNA, 24 nt, Human
cccaggacuucgaggcugcaauga

SEQ ID NO: 369041 - RNA, 32 nt, Human
cccaggacuuugccucuacagcauuuucuuac

SEQ ID NO: 369042 - RNA, 32 nt, Human
cccaggacuuugggcaagucacccgcacuccc

SEQ ID NO: 369043 - RNA, 32 nt, Human
cccaggagaaccccggugaguccguccaguug

SEQ ID NO: 369044 - RNA, 21 nt, Human
cccaggagaagcuggccggga

SEQ ID NO: 369045 - RNA, 24 nt, Human
cccaggagaagguacagcccuguc

SEQ ID NO: 369046 - RNA, 32 nt, Human
cccaggagaagucaggaagggagcccagcugg

SEQ ID NO: 369047 - RNA, 24 nt, Human
cccaggagacagaggcugcauuga

SEQ ID NO: 369048 - RNA, 24 nt, Human
cccaggagacagagguugcaguga

SEQ ID NO: 369049 - RNA, 24 nt, Human
cccaggagacagagguuguaguga

SEQ ID NO: 369050 - RNA, 23 nt, Human
cccaggagacagagguuguggug

SEQ ID NO: 369051 - RNA, 24 nt, Human
cccaggagacagagguuguggugg

SEQ ID NO: 369052 - RNA, 32 nt, Human
cccaggagacagcacaccaccaggcuccacac

SEQ ID NO: 369053 - RNA, 20 nt, Human
cccaggagacagguugcagu

SEQ ID NO: 369054 - RNA, 22 nt, Human
cccaggagacagguugcaguga

SEQ ID NO: 369055 - RNA, 18 nt, Human
cccaggagaccccuccca

SEQ ID NO: 369056 - RNA, 24 nt, Human
cccaggagacggaaguugcaguga

SEQ ID NO: 369057 - RNA, 32 nt, Human
cccaggagacggaaguugcagugagcugagau

SEQ ID NO: 369058 - RNA, 24 nt, Human
cccaggagacggagcuugcaguga

SEQ ID NO: 369059 - RNA, 32 nt, Human
cccaggagacggagcuugcagugagccgagau

SEQ ID NO: 369060 - RNA, 22 nt, Human
cccaggagacggagguugcagu

SEQ ID NO: 369061 - RNA, 24 nt, Human
cccaggagacggagguugcaguga

SEQ ID NO: 369062 - RNA, 32 nt, Human
cccaggagacggagguugcagugagccgagau

SEQ ID NO: 369063 - RNA, 24 nt, Human
cccaggagacggagguugcgguga

SEQ ID NO: 369064 - RNA, 24 nt, Human
cccaggagacggugguugcaguga

SEQ ID NO: 369065 - RNA, 32 nt, Human
cccaggagacggugguugcagugagcgaagau

SEQ ID NO: 369066 - RNA, 32 nt, Human
cccaggagacucaggcaguggccuggagaggc

SEQ ID NO: 369067 - RNA, 32 nt, Human
cccaggagagaagggaugaaggccuuuggucc

SEQ ID NO: 369068 - RNA, 32 nt, Human
cccaggagagagaagcagggagggagagagcu

SEQ ID NO: 369069 - RNA, 24 nt, Human
cccaggagagcacagcagacccuu

SEQ ID NO: 369070 - RNA, 32 nt, Human
cccaggagagccugugcagccuggggaacgug

SEQ ID NO: 369071 - RNA, 15 nt, Human
cccaggagagcuguc

SEQ ID NO: 369072 - RNA, 22 nt, Human
cccaggagaggaagguugcagu

SEQ ID NO: 369073 - RNA, 24 nt, Human
cccaggagaggaagguugcaguaa

SEQ ID NO: 369074 - RNA, 32 nt, Human
cccaggagaggauccuagggggcaguuaggca

SEQ ID NO: 369075 - RNA, 32 nt, Human
cccaggagaggccauacuuucaggguggcaug

SEQ ID NO: 369076 - RNA, 24 nt, Human
cccaggagagggaccgccuuccca

SEQ ID NO: 369077 - RNA, 22 nt, Human
cccaggagagugggcuacagga

SEQ ID NO: 369078 - RNA, 24 nt, Human
cccaggagauagagguugcaauga

SEQ ID NO: 369079 - RNA, 25 nt, Human
cccaggagaugcaggcuugcaguga

SEQ ID NO: 369080 - RNA, 32 nt, Human
cccaggagaugcaggcuugcagugagccauga

SEQ ID NO: 369081 - RNA, 24 nt, Human
cccaggagauggaaguugcaguga

SEQ ID NO: 369082 - RNA, 21 nt, Human
cccaggagauggagaugccgu

SEQ ID NO: 369083 - RNA, 22 nt, Human
cccaggagauggagauugcagu

SEQ ID NO: 369084 - RNA, 24 nt, Human
cccaggagauggagauugcaguag

SEQ ID NO: 369085 - RNA, 24 nt, Human
cccaggagauggagggccuggugg

SEQ ID NO: 369086 - RNA, 22 nt, Human
cccaggagauggagguugcagu

SEQ ID NO: 369087 - RNA, 24 nt, Human
cccaggagauggagguugcaguga

SEQ ID NO: 369088 - RNA, 32 nt, Human
cccaggagauggagguugcagugagccaagau

SEQ ID NO: 369089 - RNA, 32 nt, Human
cccaggagauggagguugcagugagcugagau

SEQ ID NO: 369090 - RNA, 24 nt, Human
cccaggagauggagguugcgguga

SEQ ID NO: 369091 - RNA, 32 nt, Human
cccaggagauugagaccagccugggcaacaua

SEQ ID NO: 369092 - RNA, 24 nt, Human
cccaggagauugaggcugcaguga

SEQ ID NO: 369093 - RNA, 32 nt, Human
cccaggagauugaggcugcagugagcaugauc

SEQ ID NO: 369094 - RNA, 24 nt, Human
cccaggagcacugacugcaguuga

SEQ ID NO: 369095 - RNA, 32 nt, Human
cccaggagcagaacucaguauccagagcuuac

SEQ ID NO: 369096 - RNA, 32 nt, Human
cccaggagcagcagcaaggaucugccagcugc

SEQ ID NO: 369097 - RNA, 32 nt, Human
cccaggagcaggaccugaaccaggaaggggag

SEQ ID NO: 369098 - RNA, 23 nt, Human
cccaggagcaggcucccaaguga

SEQ ID NO: 369099 - RNA, 22 nt, Human
cccaggagcagugucacaggga

SEQ ID NO: 369100 - RNA, 32 nt, Human
cccaggagcauugcuuuucugugaauucauua

SEQ ID NO: 369101 - RNA, 20 nt, Human
cccaggagccaaacucuuga

SEQ ID NO: 369102 - RNA, 32 nt, Human
cccaggagccaagaaaagagaacuacgaggaa

SEQ ID NO: 369103 - RNA, 32 nt, Human
cccaggagccaccauggagagugagaagcugc

SEQ ID NO: 369104 - RNA, 23 nt, Human
cccaggagccaggacaggcguga

SEQ ID NO: 369105 - RNA, 32 nt, Human
cccaggagccaggcuuccccucagcuggguga

SEQ ID NO: 369106 - RNA, 32 nt, Human
cccaggagccaggucugaacuucugugcacag

SEQ ID NO: 369107 - RNA, 23 nt, Human
cccaggagcccagccucuugaga

SEQ ID NO: 369108 - RNA, 32 nt, Human
cccaggagcccucguccccugccuuguccccc

SEQ ID NO: 369109 - RNA, 24 nt, Human
cccaggagccggagguugugguga

SEQ ID NO: 369110 - RNA, 32 nt, Human
cccaggagccuaguacaauauagugaugccau

SEQ ID NO: 369111 - RNA, 23 nt, Human
cccaggagccucugccucaguga

SEQ ID NO: 369112 - RNA, 20 nt, Human
cccaggagccugagggggug

SEQ ID NO: 369113 - RNA, 32 nt, Human
cccaggagcgaacagcaagcagcaaccgaagg

SEQ ID NO: 369114 - RNA, 22 nt, Human
cccaggagcuaguauccuuaga

SEQ ID NO: 369115 - RNA, 32 nt, Human
cccaggagcuaguggagggugaggucaaugug

SEQ ID NO: 369116 - RNA, 24 nt, Human
cccaggagcucaagauugcaguga

SEQ ID NO: 369117 - RNA, 24 nt, Human
cccaggagcucaaggucagcauga

SEQ ID NO: 369118 - RNA, 32 nt, Human
cccaggagcucaagucccaccugggcaacaua

SEQ ID NO: 369119 - RNA, 24 nt, Human
cccaggagcucuggagguacagga

SEQ ID NO: 369120 - RNA, 24 nt, Human
cccaggagcugaagguggggguga

SEQ ID NO: 369121 - RNA, 32 nt, Human
cccaggagcugaggccggagaaucgcuugaac

SEQ ID NO: 369122 - RNA, 32 nt, Human
cccaggagcugaggggugagggcuggggacca

SEQ ID NO: 369123 - RNA, 21 nt, Human
cccaggagcugcaggcuggga

SEQ ID NO: 369124 - RNA, 32 nt, Human
cccaggagcugcaggcugggagggggcagcca

SEQ ID NO: 369125 - RNA, 24 nt, Human
cccaggagcuggauguugcaguga

SEQ ID NO: 369126 - RNA, 18 nt, Human
cccaggagcugggcccug

SEQ ID NO: 369127 - RNA, 22 nt, Human
cccaggagcuuccacucucaga

SEQ ID NO: 369128 - RNA, 22 nt, Human
cccaggaggaagagguugcagu

SEQ ID NO: 369129 - RNA, 24 nt, Human
cccaggaggaagagguugcaguga

SEQ ID NO: 369130 - RNA, 32 nt, Human
cccaggaggaagagguugcagugagccaagau

SEQ ID NO: 369131 - RNA, 32 nt, Human
cccaggaggaaggauggggcaagagcagacaa

SEQ ID NO: 369132 - RNA, 32 nt, Human
cccaggaggacagagacccugaggcaggaggg

SEQ ID NO: 369133 - RNA, 15 nt, Human
cccaggaggacuguc

SEQ ID NO: 369134 - RNA, 32 nt, Human
cccaggaggagaacaggagggaggaggagaug

SEQ ID NO: 369135 - RNA, 24 nt, Human
cccaggaggaggagcuugcaguga

SEQ ID NO: 369136 - RNA, 32 nt, Human
cccaggaggaggagcuugcagugagccgagau

SEQ ID NO: 369137 - RNA, 32 nt, Human
cccaggaggaggaggaggacgagggccuagug

SEQ ID NO: 369138 - RNA, 24 nt, Human
cccaggaggaggaggcugcaguga

SEQ ID NO: 369139 - RNA, 32 nt, Human
cccaggaggaggaggcugcagugagcuaagau

SEQ ID NO: 369140 - RNA, 24 nt, Human
cccaggaggaggaggucgcaguga

SEQ ID NO: 369141 - RNA, 32 nt, Human
cccaggaggagggagaggacagagccacugca

SEQ ID NO: 369142 - RNA, 32 nt, Human
cccaggaggagguggagaucgcagugagcuga

SEQ ID NO: 369143 - RNA, 32 nt, Human
cccaggaggaguaggagcaggagcagaagcag

SEQ ID NO: 369144 - RNA, 22 nt, Human
cccaggaggagugacggaguga

SEQ ID NO: 369145 - RNA, 20 nt, Human
cccaggaggaguggggccag

SEQ ID NO: 369146 - RNA, 22 nt, Human
cccaggaggaugcugcagguga

SEQ ID NO: 369147 - RNA, 22 nt, Human
cccaggaggcaaaggcugcagu

SEQ ID NO: 369148 - RNA, 24 nt, Human
cccaggaggcaaaggcugcaguga

SEQ ID NO: 369149 - RNA, 32 nt, Human
cccaggaggcaaaggcugcagugagccaagau

SEQ ID NO: 369150 - RNA, 22 nt, Human
cccaggaggcaaagguugcagu

SEQ ID NO: 369151 - RNA, 24 nt, Human
cccaggaggcaaagguugcaguga

SEQ ID NO: 369152 - RNA, 32 nt, Human
cccaggaggcaaagguugcagugagccacgau

SEQ ID NO: 369153 - RNA, 22 nt, Human
cccaggaggcacagauugcagu

SEQ ID NO: 369154 - RNA, 24 nt, Human
cccaggaggcacagauugcaguga

SEQ ID NO: 369155 - RNA, 32 nt, Human
cccaggaggcacagauugcagugagccaagau

SEQ ID NO: 369156 - RNA, 24 nt, Human
cccaggaggcacagcuugcaguga

SEQ ID NO: 369157 - RNA, 32 nt, Human
cccaggaggcacagcuugcagugagcgaagau

SEQ ID NO: 369158 - RNA, 24 nt, Human
cccaggaggcacaggcugcaguga

SEQ ID NO: 369159 - RNA, 32 nt, Human
cccaggaggcacaggcugcagugagcagagau

SEQ ID NO: 369160 - RNA, 32 nt, Human
cccaggaggcacagguugcagugagccaggau

SEQ ID NO: 369161 - RNA, 24 nt, Human
cccaggaggcacaguuugcaguga

SEQ ID NO: 369162 - RNA, 32 nt, Human
cccaggaggcacuggggaaggccaggugccug

SEQ ID NO: 369163 - RNA, 24 nt, Human
cccaggaggcagaaguugcaguga

SEQ ID NO: 369164 - RNA, 32 nt, Human
cccaggaggcagaaguugcagugagcagagau

SEQ ID NO: 369165 - RNA, 32 nt, Human
cccaggaggcagaaguugcagugagccgaauu

SEQ ID NO: 369166 - RNA, 32 nt, Human
cccaggaggcagaaguugcagugagcugagau

SEQ ID NO: 369167 - RNA, 32 nt, Human
cccaggaggcagaauuugcagugagcugagau

SEQ ID NO: 369168 - RNA, 21 nt, Human
cccaggaggcagagaaugagu

SEQ ID NO: 369169 - RNA, 24 nt, Human
cccaggaggcagagaucgcaguga

SEQ ID NO: 369170 - RNA, 24 nt, Human
cccaggaggcagagauggcaguga

SEQ ID NO: 369171 - RNA, 22 nt, Human
cccaggaggcagagauugcagu

SEQ ID NO: 369172 - RNA, 24 nt, Human
cccaggaggcagagauugcaguga

SEQ ID NO: 369173 - RNA, 32 nt, Human
cccaggaggcagagauugcagugagccaagau

SEQ ID NO: 369174 - RNA, 32 nt, Human
cccaggaggcagagauugcagugagcugagau

SEQ ID NO: 369175 - RNA, 24 nt, Human
cccaggaggcagagauugcgguga

SEQ ID NO: 369176 - RNA, 24 nt, Human
cccaggaggcagagcuugcaguga

SEQ ID NO: 369177 - RNA, 32 nt, Human
cccaggaggcagagcuugcagugagccaagau

SEQ ID NO: 369178 - RNA, 32 nt, Human
cccaggaggcagagcuugcagugagccgagac

SEQ ID NO: 369179 - RNA, 32 nt, Human
cccaggaggcagagcuugcagugagccgagau

SEQ ID NO: 369180 - RNA, 32 nt, Human
cccaggaggcagagcuugcagugagccuagau

SEQ ID NO: 369181 - RNA, 32 nt, Human
cccaggaggcagagcuugcagugagcugagau

SEQ ID NO: 369182 - RNA, 21 nt, Human
cccaggaggcagagcuuguag

SEQ ID NO: 369183 - RNA, 24 nt, Human
cccaggaggcagagcuuguaguga

SEQ ID NO: 369184 - RNA, 22 nt, Human
cccaggaggcagaggcuacagu

SEQ ID NO: 369185 - RNA, 24 nt, Human
cccaggaggcagaggcuacaguga

SEQ ID NO: 369186 - RNA, 32 nt, Human
cccaggaggcagaggcuacagugagcugagau

SEQ ID NO: 369187 - RNA, 22 nt, Human
cccaggaggcagaggcugcagu

SEQ ID NO: 369188 - RNA, 24 nt, Human
cccaggaggcagaggcugcaguga

SEQ ID NO: 369189 - RNA, 32 nt, Human
cccaggaggcagaggcugcagugagccaugcu

SEQ ID NO: 369190 - RNA, 32 nt, Human
cccaggaggcagaggcugcagugagccgagau

SEQ ID NO: 369191 - RNA, 32 nt, Human
cccaggaggcagaggguugcagugagccgaga

SEQ ID NO: 369192 - RNA, 24 nt, Human
cccaggaggcagaggucgcaguga

SEQ ID NO: 369193 - RNA, 22 nt, Human
cccaggaggcagagguuacagu

SEQ ID NO: 369194 - RNA, 24 nt, Human
cccaggaggcagagguuacaguaa

SEQ ID NO: 369195 - RNA, 24 nt, Human
cccaggaggcagagguuacaguga

SEQ ID NO: 369196 - RNA, 32 nt, Human
cccaggaggcagagguuacagugagcagagau

SEQ ID NO: 369197 - RNA, 24 nt, Human
cccaggaggcagagguuccaguga

SEQ ID NO: 369198 - RNA, 20 nt, Human
cccaggaggcagagguugca

SEQ ID NO: 369199 - RNA, 24 nt, Human
cccaggaggcagagguugcaauga

SEQ ID NO: 369200 - RNA, 21 nt, Human
cccaggaggcagagguugcag

SEQ ID NO: 369201 - RNA, 24 nt, Human
cccaggaggcagagguugcagcga

SEQ ID NO: 369202 - RNA, 22 nt, Human
cccaggaggcagagguugcagu

SEQ ID NO: 369203 - RNA, 24 nt, Human
cccaggaggcagagguugcaguaa

SEQ ID NO: 369204 - RNA, 23 nt, Human
cccaggaggcagagguugcagug

SEQ ID NO: 369205 - RNA, 24 nt, Human
cccaggaggcagagguugcaguga

SEQ ID NO: 369206 - RNA, 32 nt, Human
cccaggaggcagagguugcagugagccaagac

SEQ ID NO: 369207 - RNA, 32 nt, Human
cccaggaggcagagguugcagugagccaagau

SEQ ID NO: 369208 - RNA, 32 nt, Human
cccaggaggcagagguugcagugagccaaggu

SEQ ID NO: 369209 - RNA, 32 nt, Human
cccaggaggcagagguugcagugagccgagac

SEQ ID NO: 369210 - RNA, 32 nt, Human
cccaggaggcagagguugcagugagccgagau

SEQ ID NO: 369211 - RNA, 32 nt, Human
cccaggaggcagagguugcagugagcuaagac

SEQ ID NO: 369212 - RNA, 32 nt, Human
cccaggaggcagagguugcagugagcuaagau

SEQ ID NO: 369213 - RNA, 32 nt, Human
cccaggaggcagagguugcagugagcugagac

SEQ ID NO: 369214 - RNA, 32 nt, Human
cccaggaggcagagguugcagugagcugagau

SEQ ID NO: 369215 - RNA, 32 nt, Human
cccaggaggcagagguugcagugagcugugau

SEQ ID NO: 369216 - RNA, 32 nt, Human
cccaggaggcagagguugcagugagucaagau

SEQ ID NO: 369217 - RNA, 32 nt, Human
cccaggaggcagagguugcagugagugaagau

SEQ ID NO: 369218 - RNA, 24 nt, Human
cccaggaggcagagguugcagugg

SEQ ID NO: 369219 - RNA, 32 nt, Human
cccaggaggcagagguugcagugggccaagau

SEQ ID NO: 369220 - RNA, 24 nt, Human
cccaggaggcagagguugcauuga

SEQ ID NO: 369221 - RNA, 24 nt, Human
cccaggaggcagagguugcgguga

SEQ ID NO: 369222 - RNA, 24 nt, Human
cccaggaggcagagguugcguuga

SEQ ID NO: 369223 - RNA, 24 nt, Human
cccaggaggcagagguugggguga

SEQ ID NO: 369224 - RNA, 24 nt, Human
cccaggaggcagaguuugcaguga

SEQ ID NO: 369225 - RNA, 32 nt, Human
cccaggaggcagaguuugcagugagccaagau

SEQ ID NO: 369226 - RNA, 32 nt, Human
cccaggaggcagaguuugcagugagcugagau

SEQ ID NO: 369227 - RNA, 32 nt, Human
cccaggaggcagcugcugacagguuugcuaca

SEQ ID NO: 369228 - RNA, 24 nt, Human
cccaggaggcagcuguugcaguga

SEQ ID NO: 369229 - RNA, 32 nt, Human
cccaggaggcagcuguugcagugagccaagau

SEQ ID NO: 369230 - RNA, 23 nt, Human
cccaggaggcaggacaacacuga

SEQ ID NO: 369231 - RNA, 23 nt, Human
cccaggaggcagggaggcagcgg

SEQ ID NO: 369232 - RNA, 24 nt, Human
cccaggaggcagugauugcaguga

SEQ ID NO: 369233 - RNA, 24 nt, Human
cccaggaggccaagucugcaguga

SEQ ID NO: 369234 - RNA, 21 nt, Human
cccaggaggccaccccugaga

SEQ ID NO: 369235 - RNA, 24 nt, Human
cccaggaggccccugcugcagaga

SEQ ID NO: 369236 - RNA, 32 nt, Human
cccaggaggccgagguugcagugagccaagau

SEQ ID NO: 369237 - RNA, 24 nt, Human
cccaggaggcgaagauugcaguga

SEQ ID NO: 369238 - RNA, 32 nt, Human
cccaggaggcgaagauugcagugagcugauau

SEQ ID NO: 369239 - RNA, 24 nt, Human
cccaggaggcgaagauugccguga

SEQ ID NO: 369240 - RNA, 32 nt, Human
cccaggaggcgacugcaugguggagagggagc

SEQ ID NO: 369241 - RNA, 23 nt, Human
cccaggaggcgcuggagcaacag

SEQ ID NO: 369242 - RNA, 24 nt, Human
cccaggaggcggaaguugcaguga

SEQ ID NO: 369243 - RNA, 32 nt, Human
cccaggaggcggaaguugcagugagcugagau

SEQ ID NO: 369244 - RNA, 24 nt, Human
cccaggaggcggaccuuguaguga

SEQ ID NO: 369245 - RNA, 32 nt, Human
cccaggaggcggaccuuguagugagccgagau

SEQ ID NO: 369246 - RNA, 24 nt, Human
cccaggaggcggacguugcaguga

SEQ ID NO: 369247 - RNA, 23 nt, Human
cccaggaggcggagauugcagug

SEQ ID NO: 369248 - RNA, 24 nt, Human
cccaggaggcggagauugcaguga

SEQ ID NO: 369249 - RNA, 32 nt, Human
cccaggaggcggagauugcagugagccgagau

SEQ ID NO: 369250 - RNA, 32 nt, Human
cccaggaggcggagauugcagugagcugagau

SEQ ID NO: 369251 - RNA, 24 nt, Human
cccaggaggcggagcuggcaguga

SEQ ID NO: 369252 - RNA, 32 nt, Human
cccaggaggcggagcuggcagugagcugagau

SEQ ID NO: 369253 - RNA, 24 nt, Human
cccaggaggcggagcuuacaguga

SEQ ID NO: 369254 - RNA, 23 nt, Human
cccaggaggcggagcuugcagug

SEQ ID NO: 369255 - RNA, 24 nt, Human
cccaggaggcggagcuugcaguga

SEQ ID NO: 369256 - RNA, 32 nt, Human
cccaggaggcggagcuugcagugagcagagau

SEQ ID NO: 369257 - RNA, 32 nt, Human
cccaggaggcggagcuugcagugagccaagau

SEQ ID NO: 369258 - RNA, 32 nt, Human
cccaggaggcggagcuugcagugagccaugau

SEQ ID NO: 369259 - RNA, 32 nt, Human
cccaggaggcggagcuugcagugagccgagau

SEQ ID NO: 369260 - RNA, 32 nt, Human
cccaggaggcggagcuugcagugagcugagau

SEQ ID NO: 369261 - RNA, 32 nt, Human
cccaggaggcggagcuugcagugagucgagau

SEQ ID NO: 369262 - RNA, 32 nt, Human
cccaggaggcggaggcagaggcugcagugacc

SEQ ID NO: 369263 - RNA, 22 nt, Human
cccaggaggcggaggcugcagu

SEQ ID NO: 369264 - RNA, 23 nt, Human
cccaggaggcggaggcugcagug

SEQ ID NO: 369265 - RNA, 24 nt, Human
cccaggaggcggaggcugcaguga

SEQ ID NO: 369266 - RNA, 32 nt, Human
cccaggaggcggaggcugcagugagcccagau

SEQ ID NO: 369267 - RNA, 32 nt, Human
cccaggaggcggaggcugcagugagcugagau

SEQ ID NO: 369268 - RNA, 24 nt, Human
cccaggaggcggagguagcaguga

SEQ ID NO: 369269 - RNA, 32 nt, Human
cccaggaggcggagguagcagugagccaagau

SEQ ID NO: 369270 - RNA, 23 nt, Human
cccaggaggcggagguaguggug

SEQ ID NO: 369271 - RNA, 24 nt, Human
cccaggaggcggagguagugguga

SEQ ID NO: 369272 - RNA, 32 nt, Human
cccaggaggcggagguaguggugagcaaagau

SEQ ID NO: 369273 - RNA, 22 nt, Human
cccaggaggcggagguuacagu

SEQ ID NO: 369274 - RNA, 24 nt, Human
cccaggaggcggagguuacaguga

SEQ ID NO: 369275 - RNA, 32 nt, Human
cccaggaggcggagguuacagugagccaagau

SEQ ID NO: 369276 - RNA, 24 nt, Human
cccaggaggcggagguuccaguga

SEQ ID NO: 369277 - RNA, 20 nt, Human
cccaggaggcggagguugca

SEQ ID NO: 369278 - RNA, 24 nt, Human
cccaggaggcggagguugcacuga

SEQ ID NO: 369279 - RNA, 32 nt, Human
cccaggaggcggagguugcacugagccgagau

SEQ ID NO: 369280 - RNA, 21 nt, Human
cccaggaggcggagguugcag

SEQ ID NO: 369281 - RNA, 24 nt, Human
cccaggaggcggagguugcaggga

SEQ ID NO: 369282 - RNA, 22 nt, Human
cccaggaggcggagguugcagu

SEQ ID NO: 369283 - RNA, 24 nt, Human
cccaggaggcggagguugcaguaa

SEQ ID NO: 369284 - RNA, 32 nt, Human
cccaggaggcggagguugcaguaagccaaggu

SEQ ID NO: 369285 - RNA, 23 nt, Human
cccaggaggcggagguugcagug

SEQ ID NO: 369286 - RNA, 24 nt, Human
cccaggaggcggagguugcaguga

SEQ ID NO: 369287 - RNA, 32 nt, Human
cccaggaggcggagguugcagugaaccgagau

SEQ ID NO: 369288 - RNA, 32 nt, Human
cccaggaggcggagguugcagugacccgagau

SEQ ID NO: 369289 - RNA, 32 nt, Human
cccaggaggcggagguugcagugagacgagau

SEQ ID NO: 369290 - RNA, 32 nt, Human
cccaggaggcggagguugcagugagcagagau

SEQ ID NO: 369291 - RNA, 32 nt, Human
cccaggaggcggagguugcagugagccaagau

SEQ ID NO: 369292 - RNA, 32 nt, Human
cccaggaggcggagguugcagugagccaggau

SEQ ID NO: 369293 - RNA, 32 nt, Human
cccaggaggcggagguugcagugagccgagau

SEQ ID NO: 369294 - RNA, 32 nt, Human
cccaggaggcggagguugcagugagcucagau

SEQ ID NO: 369295 - RNA, 32 nt, Human
cccaggaggcggagguugcagugagcugagau

SEQ ID NO: 369296 - RNA, 32 nt, Human
cccaggaggcggagguugcagugagcugaguu

SEQ ID NO: 369297 - RNA, 32 nt, Human
cccaggaggcggagguugcagugaguugagau

SEQ ID NO: 369298 - RNA, 32 nt, Human
cccaggaggcggagguugcagugaguugcagu

SEQ ID NO: 369299 - RNA, 32 nt, Human
cccaggaggcggagguugcagugauccaagau

SEQ ID NO: 369300 - RNA, 23 nt, Human
cccaggaggcggagguugccgug

SEQ ID NO: 369301 - RNA, 24 nt, Human
cccaggaggcggagguugccguga

SEQ ID NO: 369302 - RNA, 32 nt, Human
cccaggaggcggagguugccgugagccaagau

SEQ ID NO: 369303 - RNA, 23 nt, Human
cccaggaggcggagguugcggug

SEQ ID NO: 369304 - RNA, 24 nt, Human
cccaggaggcggagguugcgguga

SEQ ID NO: 369305 - RNA, 32 nt, Human
cccaggaggcggagguugcggugagccaagau

SEQ ID NO: 369306 - RNA, 32 nt, Human
cccaggaggcggagguugcggugagccgagau

SEQ ID NO: 369307 - RNA, 32 nt, Human
cccaggaggcggagguugcggugagcugagau

SEQ ID NO: 369308 - RNA, 32 nt, Human
cccaggaggcggagguugcggugaguugagau

SEQ ID NO: 369309 - RNA, 21 nt, Human
cccaggaggcggagguuguag

SEQ ID NO: 369310 - RNA, 24 nt, Human
cccaggaggcggagguuguaguga

SEQ ID NO: 369311 - RNA, 32 nt, Human
cccaggaggcggagguuguagugagccaagau

SEQ ID NO: 369312 - RNA, 32 nt, Human
cccaggaggcggagguuguagugagcugagau

SEQ ID NO: 369313 - RNA, 23 nt, Human
cccaggaggcggagguuguggug

SEQ ID NO: 369314 - RNA, 24 nt, Human
cccaggaggcggagguugugguga

SEQ ID NO: 369315 - RNA, 32 nt, Human
cccaggaggcggagguuguggugagccaagau

SEQ ID NO: 369316 - RNA, 32 nt, Human
cccaggaggcggaguuugcagugagcugagau

SEQ ID NO: 369317 - RNA, 32 nt, Human
cccaggaggcggcgguugcagugagccaagau

SEQ ID NO: 369318 - RNA, 32 nt, Human
cccaggaggcggggguugcagugagucgagau

SEQ ID NO: 369319 - RNA, 24 nt, Human
cccaggaggcggugcuugcaggga

SEQ ID NO: 369320 - RNA, 32 nt, Human
cccaggaggcggugcuugcagggagccgagau

SEQ ID NO: 369321 - RNA, 24 nt, Human
cccaggaggcguagcuagcaguga

SEQ ID NO: 369322 - RNA, 32 nt, Human
cccaggaggcguagcuagcagugagccaagac

SEQ ID NO: 369323 - RNA, 24 nt, Human
cccaggaggcugaggcugcaauga

SEQ ID NO: 369324 - RNA, 22 nt, Human
cccaggaggcugagguugcagu

SEQ ID NO: 369325 - RNA, 24 nt, Human
cccaggaggcugagguugcaguga

SEQ ID NO: 369326 - RNA, 32 nt, Human
cccaggaggcugagguugcagugagccaggau

SEQ ID NO: 369327 - RNA, 32 nt, Human
cccaggaggcugagguugcagugagcccagau

SEQ ID NO: 369328 - RNA, 21 nt, Human
cccaggaggcugcugcuauga

SEQ ID NO: 369329 - RNA, 32 nt, Human
cccaggaggcugggugaggcgcugagacgguu

SEQ ID NO: 369330 - RNA, 32 nt, Human
cccaggagggcaugggagcugcauuugggggc

SEQ ID NO: 369331 - RNA, 32 nt, Human
cccaggagggcugaaggcaggggccacucaca

SEQ ID NO: 369332 - RNA, 26 nt, Human
cccaggaggggaagggaucauggaga

SEQ ID NO: 369333 - RNA, 24 nt, Human
cccaggagggggaguuugcaguga

SEQ ID NO: 369334 - RNA, 19 nt, Human
cccaggagggucuugcagu

SEQ ID NO: 369335 - RNA, 32 nt, Human
cccaggagggucuugcagucaucuacauacuu

SEQ ID NO: 369336 - RNA, 31 nt, Human
cccaggagguaccagcaccugccucgaucuc

SEQ ID NO: 369337 - RNA, 32 nt, Human
cccaggagguagaagcugcagugagcagggau

SEQ ID NO: 369338 - RNA, 22 nt, Human
cccaggagguagaggcugcagu

SEQ ID NO: 369339 - RNA, 24 nt, Human
cccaggagguagaggcugcaguga

SEQ ID NO: 369340 - RNA, 32 nt, Human
cccaggagguagaggcugcagugagcagggau

SEQ ID NO: 369341 - RNA, 32 nt, Human
cccaggagguagagguugcagugagccaagau

SEQ ID NO: 369342 - RNA, 32 nt, Human
cccaggagguagagguugcagugagccgagau

SEQ ID NO: 369343 - RNA, 32 nt, Human
cccaggagguagcuggcagaguagcugucagg

SEQ ID NO: 369344 - RNA, 21 nt, Human
cccaggaggucaagccugcag

SEQ ID NO: 369345 - RNA, 24 nt, Human
cccaggaggucaagccugcagcga

SEQ ID NO: 369346 - RNA, 24 nt, Human
cccaggaggucaaggcugaaguga

SEQ ID NO: 369347 - RNA, 24 nt, Human
cccaggaggucaaggcugcaguga

SEQ ID NO: 369348 - RNA, 24 nt, Human
cccaggaggucaaggcuucaguga

SEQ ID NO: 369349 - RNA, 32 nt, Human
cccaggaggucaaggcuucagugagccaugau

SEQ ID NO: 369350 - RNA, 24 nt, Human
cccaggaggucaaggguacaguga

SEQ ID NO: 369351 - RNA, 24 nt, Human
cccaggaggucagggcugcaguga

SEQ ID NO: 369352 - RNA, 32 nt, Human
cccaggaggucagggcugcagugagccgagau

SEQ ID NO: 369353 - RNA, 32 nt, Human
cccaggaggucccuccuguagggcacaaggcc

SEQ ID NO: 369354 - RNA, 23 nt, Human
cccaggaggucgaggcugcagug

SEQ ID NO: 369355 - RNA, 24 nt, Human
cccaggaggucgaggcugcaguga

SEQ ID NO: 369356 - RNA, 32 nt, Human
cccaggaggucgaggcugcagugagccaugau

SEQ ID NO: 369357 - RNA, 32 nt, Human
cccaggaggucgaggcugcagugagcccugau

SEQ ID NO: 369358 - RNA, 32 nt, Human
cccaggaggucgaggcugcagugagcuaugau

SEQ ID NO: 369359 - RNA, 32 nt, Human
cccaggaggucgaggcugcagugagcugugau

SEQ ID NO: 369360 - RNA, 32 nt, Human
cccaggaggucgagguugcagugagcaguaau

SEQ ID NO: 369361 - RNA, 24 nt, Human
cccaggaggucuaggcugcaguga

SEQ ID NO: 369362 - RNA, 22 nt, Human
cccaggaggugaagguugcagu

SEQ ID NO: 369363 - RNA, 24 nt, Human
cccaggaggugaagguugcaguga

SEQ ID NO: 369364 - RNA, 32 nt, Human
cccaggaggugaagguugcagugaccggagau

SEQ ID NO: 369365 - RNA, 22 nt, Human
cccaggaggugcagguugcagu

SEQ ID NO: 369366 - RNA, 24 nt, Human
cccaggaggugcagguugcaguga

SEQ ID NO: 369367 - RNA, 32 nt, Human
cccaggaggugcagguugcagugagccgagau

SEQ ID NO: 369368 - RNA, 24 nt, Human
cccaggagguggaaacugcagaga

SEQ ID NO: 369369 - RNA, 24 nt, Human
cccaggagguggaaguugcuuuga

SEQ ID NO: 369370 - RNA, 32 nt, Human
cccaggagguggacauuacagugagcccagau

SEQ ID NO: 369371 - RNA, 32 nt, Human
cccaggagguggacauugcagugagccgagau

SEQ ID NO: 369372 - RNA, 22 nt, Human
cccaggagguggagacugcagu

SEQ ID NO: 369373 - RNA, 24 nt, Human
cccaggagguggagacugcaguga

SEQ ID NO: 369374 - RNA, 32 nt, Human
cccaggagguggagacugcagugagccaagau

SEQ ID NO: 369375 - RNA, 22 nt, Human
cccaggagguggagauugcagu

SEQ ID NO: 369376 - RNA, 24 nt, Human
cccaggagguggagauugcaguga

SEQ ID NO: 369377 - RNA, 32 nt, Human
cccaggagguggagauugcagugagcugagau

SEQ ID NO: 369378 - RNA, 32 nt, Human
cccaggagguggagcuugcaaugagccgagau

SEQ ID NO: 369379 - RNA, 32 nt, Human
cccaggagguggagcuugcagugagccgagau

SEQ ID NO: 369380 - RNA, 22 nt, Human
cccaggagguggaggaugcagu

SEQ ID NO: 369381 - RNA, 23 nt, Human
cccaggagguggaggaugcagug

SEQ ID NO: 369382 - RNA, 24 nt, Human
cccaggagguggaggaugcaguga

SEQ ID NO: 369383 - RNA, 24 nt, Human
cccaggagguggaggcugcaauga

SEQ ID NO: 369384 - RNA, 22 nt, Human
cccaggagguggaggcugcagu

SEQ ID NO: 369385 - RNA, 23 nt, Human
cccaggagguggaggcugcagug

SEQ ID NO: 369386 - RNA, 24 nt, Human
cccaggagguggaggcugcaguga

SEQ ID NO: 369387 - RNA, 32 nt, Human
cccaggagguggaggcugcagugagccaugcc

SEQ ID NO: 369388 - RNA, 32 nt, Human
cccaggagguggaggcugcagugagcugagau

SEQ ID NO: 369389 - RNA, 22 nt, Human
cccaggagguggaggcugcggu

SEQ ID NO: 369390 - RNA, 23 nt, Human
cccaggagguggaggcugcggug

SEQ ID NO: 369391 - RNA, 24 nt, Human
cccaggagguggaggcugcgguga

SEQ ID NO: 369392 - RNA, 24 nt, Human
cccaggagguggagguagcaguga

SEQ ID NO: 369393 - RNA, 32 nt, Human
cccaggagguggagguagcagugagccgagau

SEQ ID NO: 369394 - RNA, 32 nt, Human
cccaggagguggaggucgcagugagccgagau

SEQ ID NO: 369395 - RNA, 22 nt, Human
cccaggagguggagguuacagu

SEQ ID NO: 369396 - RNA, 24 nt, Human
cccaggagguggagguuacaguga

SEQ ID NO: 369397 - RNA, 32 nt, Human
cccaggagguggagguuacagugagccaagau

SEQ ID NO: 369398 - RNA, 32 nt, Human
cccaggagguggagguuacagugagcugagag

SEQ ID NO: 369399 - RNA, 24 nt, Human
cccaggagguggagguuccaguga

SEQ ID NO: 369400 - RNA, 32 nt, Human
cccaggagguggagguuccagugagccaaaau

SEQ ID NO: 369401 - RNA, 24 nt, Human
cccaggagguggagguugaaauga

SEQ ID NO: 369402 - RNA, 20 nt, Human
cccaggagguggagguugca

SEQ ID NO: 369403 - RNA, 24 nt, Human
cccaggagguggagguugcaagug

SEQ ID NO: 369404 - RNA, 24 nt, Human
cccaggagguggagguugcaauga

SEQ ID NO: 369405 - RNA, 24 nt, Human
cccaggagguggagguugcacuga

SEQ ID NO: 369406 - RNA, 21 nt, Human
cccaggagguggagguugcag

SEQ ID NO: 369407 - RNA, 24 nt, Human
cccaggagguggagguugcagcga

SEQ ID NO: 369408 - RNA, 22 nt, Human
cccaggagguggagguugcagu

SEQ ID NO: 369409 - RNA, 24 nt, Human
cccaggagguggagguugcaguaa

SEQ ID NO: 369410 - RNA, 23 nt, Human
cccaggagguggagguugcagug

SEQ ID NO: 369411 - RNA, 24 nt, Human
cccaggagguggagguugcaguga

SEQ ID NO: 369412 - RNA, 32 nt, Human
cccaggagguggagguugcagugagcagagau

SEQ ID NO: 369413 - RNA, 32 nt, Human
cccaggagguggagguugcagugagccaagac

SEQ ID NO: 369414 - RNA, 32 nt, Human
cccaggagguggagguugcagugagccaagau

SEQ ID NO: 369415 - RNA, 32 nt, Human
cccaggagguggagguugcagugagccaaggu

SEQ ID NO: 369416 - RNA, 32 nt, Human
cccaggagguggagguugcagugagccagaga

SEQ ID NO: 369417 - RNA, 32 nt, Human
cccaggagguggagguugcagugagccaugau

SEQ ID NO: 369418 - RNA, 32 nt, Human
cccaggagguggagguugcagugagccgaagu

SEQ ID NO: 369419 - RNA, 32 nt, Human
cccaggagguggagguugcagugagccgagac

SEQ ID NO: 369420 - RNA, 32 nt, Human
cccaggagguggagguugcagugagccgagau

SEQ ID NO: 369421 - RNA, 32 nt, Human
cccaggagguggagguugcagugagccgaguc

SEQ ID NO: 369422 - RNA, 32 nt, Human
cccaggagguggagguugcagugagcggagau

SEQ ID NO: 369423 - RNA, 32 nt, Human
cccaggagguggagguugcagugagcugagac

SEQ ID NO: 369424 - RNA, 32 nt, Human
cccaggagguggagguugcagugagcugagau

SEQ ID NO: 369425 - RNA, 32 nt, Human
cccaggagguggagguugcagugagcugggau

SEQ ID NO: 369426 - RNA, 32 nt, Human
cccaggagguggagguugcagugaggcaagau

SEQ ID NO: 369427 - RNA, 32 nt, Human
cccaggagguggagguugcagugagucaagau

SEQ ID NO: 369428 - RNA, 32 nt, Human
cccaggagguggagguugcagugagucgagau

SEQ ID NO: 369429 - RNA, 24 nt, Human
cccaggagguggagguugcagugg

SEQ ID NO: 369430 - RNA, 32 nt, Human
cccaggagguggagguugcagugggccgagau

SEQ ID NO: 369431 - RNA, 23 nt, Human
cccaggagguggagguugcggug

SEQ ID NO: 369432 - RNA, 24 nt, Human
cccaggagguggagguugcgguga

SEQ ID NO: 369433 - RNA, 24 nt, Human
cccaggagguggagguugcuguga

SEQ ID NO: 369434 - RNA, 24 nt, Human
cccaggagguggagguuguaguga

SEQ ID NO: 369435 - RNA, 24 nt, Human
cccaggagguggagguugugguga

SEQ ID NO: 369436 - RNA, 24 nt, Human
cccaggagguggagguuucagcga

SEQ ID NO: 369437 - RNA, 21 nt, Human
cccaggagguggaguugcagu

SEQ ID NO: 369438 - RNA, 23 nt, Human
cccaggagguggaguugcaguaa

SEQ ID NO: 369439 - RNA, 24 nt, Human
cccaggagguggaguuugcaguga

SEQ ID NO: 369440 - RNA, 32 nt, Human
cccaggagguggaguuugcagugagcugagau

SEQ ID NO: 369441 - RNA, 24 nt, Human
cccaggagguggauguugcaguga

SEQ ID NO: 369442 - RNA, 32 nt, Human
cccaggaggugggcauugcagugagccgagau

SEQ ID NO: 369443 - RNA, 24 nt, Human
cccaggagguggggguugcaccga

SEQ ID NO: 369444 - RNA, 24 nt, Human
cccaggagguggugguugcaguga

SEQ ID NO: 369445 - RNA, 32 nt, Human
cccaggagguggugguugcagugagccuagau

SEQ ID NO: 369446 - RNA, 32 nt, Human
cccaggagguugagaaugcagugagcuuguaa

SEQ ID NO: 369447 - RNA, 22 nt, Human
cccaggagguugaggcugcagu

SEQ ID NO: 369448 - RNA, 24 nt, Human
cccaggagguugaggcugcaguga

SEQ ID NO: 369449 - RNA, 32 nt, Human
cccaggagguugaggcugcagugagcagagcg

SEQ ID NO: 369450 - RNA, 32 nt, Human
cccaggagguugaggcugcagugagccaugau

SEQ ID NO: 369451 - RNA, 32 nt, Human
cccaggagguugaggcugcagugagcuaugau

SEQ ID NO: 369452 - RNA, 24 nt, Human
cccaggagguuguggauacaguga

SEQ ID NO: 369453 - RNA, 24 nt, Human
cccaggagguuguggcugcaguga

SEQ ID NO: 369454 - RNA, 32 nt, Human
cccaggaguaauggaguccaaagagaaacuag

SEQ ID NO: 369455 - RNA, 32 nt, Human
cccaggaguaauuucucagcauugaggguaaa

SEQ ID NO: 369456 - RNA, 32 nt, Human
cccaggaguaguuuucccagaagauuguaaaa

SEQ ID NO: 369457 - RNA, 22 nt, Human
cccaggagucaaaagcugcagu

SEQ ID NO: 369458 - RNA, 24 nt, Human
cccaggagucaaaagcugcaguga

SEQ ID NO: 369459 - RNA, 24 nt, Human
cccaggagucagagguuucaguga

SEQ ID NO: 369460 - RNA, 19 nt, Human
cccaggaguccaagggcag

SEQ ID NO: 369461 - RNA, 24 nt, Human
cccaggaguccaagggcagggugg

SEQ ID NO: 369462 - RNA, 21 nt, Human
cccaggaguccugaccagaga

SEQ ID NO: 369463 - RNA, 32 nt, Human
cccaggagucggagguugcagugaguugagau

SEQ ID NO: 369464 - RNA, 23 nt, Human
cccaggagucuaggugggaguga

SEQ ID NO: 369465 - RNA, 24 nt, Human
cccaggagucugaggcuuuaguga

SEQ ID NO: 369466 - RNA, 32 nt, Human
cccaggagugccugauugucccacaggggugg

SEQ ID NO: 369467 - RNA, 23 nt, Human
cccaggagugugacuggcaguga

SEQ ID NO: 369468 - RNA, 18 nt, Human
cccaggaguguggcugca

SEQ ID NO: 369469 - RNA, 23 nt, Human
cccaggaguuaaaugucuuaaga

SEQ ID NO: 369470 - RNA, 25 nt, Human
cccaggaguuaagaggcugcaguga

SEQ ID NO: 369471 - RNA, 32 nt, Human
cccaggaguuaagaggcugcagugaccgauga

SEQ ID NO: 369472 - RNA, 20 nt, Human
cccaggaguucaaagcugca

SEQ ID NO: 369473 - RNA, 24 nt, Human
cccaggaguucaaagcugcaguga

SEQ ID NO: 369474 - RNA, 24 nt, Human
cccaggaguucaaagcuguaguga

SEQ ID NO: 369475 - RNA, 32 nt, Human
cccaggaguucaaauccugccugggcaacaua

SEQ ID NO: 369476 - RNA, 22 nt, Human
cccaggaguucaaaucugcagu

SEQ ID NO: 369477 - RNA, 23 nt, Human
cccaggaguucaaaucugcagug

SEQ ID NO: 369478 - RNA, 24 nt, Human
cccaggaguucaacgcugcaguga

SEQ ID NO: 369479 - RNA, 24 nt, Human
cccaggaguucaagaccaacaugg

SEQ ID NO: 369480 - RNA, 19 nt, Human
cccaggaguucaagaccag

SEQ ID NO: 369481 - RNA, 24 nt, Human
cccaggaguucaagaccagccuga

SEQ ID NO: 369482 - RNA, 24 nt, Human
cccaggaguucaagaccagcuugg

SEQ ID NO: 369483 - RNA, 20 nt, Human
cccaggaguucaagaccagu

SEQ ID NO: 369484 - RNA, 21 nt, Human
cccaggaguucaagaccagug

SEQ ID NO: 369485 - RNA, 24 nt, Human
cccaggaguucaagaccggccuga

SEQ ID NO: 369486 - RNA, 23 nt, Human
cccaggaguucaagaccugccag

SEQ ID NO: 369487 - RNA, 24 nt, Human
cccaggaguucaaggcugcaauga

SEQ ID NO: 369488 - RNA, 23 nt, Human
cccaggaguucaaggcugcagug

SEQ ID NO: 369489 - RNA, 24 nt, Human
cccaggaguucaaggcuucaguga

SEQ ID NO: 369490 - RNA, 32 nt, Human
cccaggaguucaaggcuucagugagccaugau

SEQ ID NO: 369491 - RNA, 22 nt, Human
cccaggaguucaagucugcagu

SEQ ID NO: 369492 - RNA, 24 nt, Human
cccaggaguucaagucugcaguga

SEQ ID NO: 369493 - RNA, 22 nt, Human
cccaggaguucagggccagcuu

SEQ ID NO: 369494 - RNA, 24 nt, Human
cccaggaguucagggcugcaguga

SEQ ID NO: 369495 - RNA, 23 nt, Human
cccaggaguuccucuggccccca

SEQ ID NO: 369496 - RNA, 24 nt, Human
cccaggaguucgaagcugcaggga

SEQ ID NO: 369497 - RNA, 24 nt, Human
cccaggaguucgaggcugcagcga

SEQ ID NO: 369498 - RNA, 22 nt, Human
cccaggaguucgaggcugcagu

SEQ ID NO: 369499 - RNA, 32 nt, Human
cccaggaguucgaggcugcagucagucaugau

SEQ ID NO: 369500 - RNA, 24 nt, Human
cccaggaguucgaggcugcaguga

SEQ ID NO: 369501 - RNA, 24 nt, Human
cccaggaguucgagguuacaguga

SEQ ID NO: 369502 - RNA, 24 nt, Human
cccaggaguucgggguuacaguga

SEQ ID NO: 369503 - RNA, 24 nt, Human
cccaggaguuggaaguugcaggga

SEQ ID NO: 369504 - RNA, 19 nt, Human
cccaggaguuggagaccag

SEQ ID NO: 369505 - RNA, 32 nt, Human
cccaggaguuggagcuugcagugagccgagau

SEQ ID NO: 369506 - RNA, 19 nt, Human
cccaggaguuggaggccag

SEQ ID NO: 369507 - RNA, 24 nt, Human
cccaggaguuggaggccgcaguga

SEQ ID NO: 369508 - RNA, 24 nt, Human
cccaggaguuggaggcuacaguga

SEQ ID NO: 369509 - RNA, 24 nt, Human
cccaggaguuggaggcugaagaga

SEQ ID NO: 369510 - RNA, 24 nt, Human
cccaggaguuuaagaccagccuga

SEQ ID NO: 369511 - RNA, 24 nt, Human
cccaggaguuuaaggcugcaguga

SEQ ID NO: 369512 - RNA, 23 nt, Human
cccaggaguuuaagguuguagug

SEQ ID NO: 369513 - RNA, 24 nt, Human
cccaggaguuugaagcugcaguga

SEQ ID NO: 369514 - RNA, 24 nt, Human
cccaggaguuugaaguugcaauga

SEQ ID NO: 369515 - RNA, 32 nt, Human
cccaggaguuugacaccagccugggcaacaug

SEQ ID NO: 369516 - RNA, 19 nt, Human
cccaggaguuugagaacag

SEQ ID NO: 369517 - RNA, 19 nt, Human
cccaggaguuugagaccag

SEQ ID NO: 369518 - RNA, 24 nt, Human
cccaggaguuugagaccagcaugg

SEQ ID NO: 369519 - RNA, 24 nt, Human
cccaggaguuugagaccagcgugg

SEQ ID NO: 369520 - RNA, 20 nt, Human
cccaggaguuugagaccagu

SEQ ID NO: 369521 - RNA, 22 nt, Human
cccaggaguuugagacuacagu

SEQ ID NO: 369522 - RNA, 23 nt, Human
cccaggaguuugagacuguagug

SEQ ID NO: 369523 - RNA, 23 nt, Human
cccaggaguuugagaugaucugg

SEQ ID NO: 369524 - RNA, 24 nt, Human
cccaggaguuugagccuucaguga

SEQ ID NO: 369525 - RNA, 20 nt, Human
cccaggaguuugaggccagc

SEQ ID NO: 369526 - RNA, 24 nt, Human
cccaggaguuugaggcuacaguga

SEQ ID NO: 369527 - RNA, 24 nt, Human
cccaggaguuugaggcuauaguga

SEQ ID NO: 369528 - RNA, 24 nt, Human
cccaggaguuugaggcuccaguga

SEQ ID NO: 369529 - RNA, 24 nt, Human
cccaggaguuugaggcugcaauga

SEQ ID NO: 369530 - RNA, 24 nt, Human
cccaggaguuugaggcugcagcga

SEQ ID NO: 369531 - RNA, 22 nt, Human
cccaggaguuugaggcugcagu

SEQ ID NO: 369532 - RNA, 24 nt, Human
cccaggaguuugaggcugcaguaa

SEQ ID NO: 369533 - RNA, 24 nt, Human
cccaggaguuugaggcugcaguga

SEQ ID NO: 369534 - RNA, 24 nt, Human
cccaggaguuugaggcugcgguga

SEQ ID NO: 369535 - RNA, 24 nt, Human
cccaggaguuugaggguggaguga

SEQ ID NO: 369536 - RNA, 23 nt, Human
cccaggaguuugagguugcagug

SEQ ID NO: 369537 - RNA, 24 nt, Human
cccaggaguuugagguugcaguga

SEQ ID NO: 369538 - RNA, 24 nt, Human
cccaggaguuugagguuguaggga

SEQ ID NO: 369539 - RNA, 23 nt, Human
cccaggaguuugagucuguaaug

SEQ ID NO: 369540 - RNA, 32 nt, Human
cccaggaguuuggaccagccugggcaacauaa

SEQ ID NO: 369541 - RNA, 32 nt, Human
cccaggaucucaggguccuugggcucuguggc

SEQ ID NO: 369542 - RNA, 23 nt, Human
cccaggaugaagggaugcaguga

SEQ ID NO: 369543 - RNA, 22 nt, Human
cccaggaugcggagguugcagu

SEQ ID NO: 369544 - RNA, 24 nt, Human
cccaggaugcggagguugcaguga

SEQ ID NO: 369545 - RNA, 32 nt, Human
cccaggaugcggagguugcagugagccgagau

SEQ ID NO: 369546 - RNA, 32 nt, Human
cccaggauggagcaggaguguccugugauuca

SEQ ID NO: 369547 - RNA, 19 nt, Human
cccaggauggagugcagug

SEQ ID NO: 369548 - RNA, 20 nt, Human
cccaggauggagugcaguga

SEQ ID NO: 369549 - RNA, 20 nt, Human
cccaggauggagugcagugg

SEQ ID NO: 369550 - RNA, 32 nt, Human
cccaggauguguacucguucucucacggcccu

SEQ ID NO: 369551 - RNA, 32 nt, Human
cccaggauguguggcgagagccugggccagcc

SEQ ID NO: 369552 - RNA, 32 nt, Human
cccaggauguuuuccaaaauguuccacaggcg

SEQ ID NO: 369553 - RNA, 19 nt, Human
cccaggauugcaacauggg

SEQ ID NO: 369554 - RNA, 21 nt, Human
cccaggauuuccacagcacac

SEQ ID NO: 369555 - RNA, 22 nt, Human
cccaggcaacaaagucagaucc

SEQ ID NO: 369556 - RNA, 22 nt, Human
cccaggcaacacagcaagaccc

SEQ ID NO: 369557 - RNA, 32 nt, Human
cccaggcaacacagcaagaccccaucucuaua

SEQ ID NO: 369558 - RNA, 20 nt, Human
cccaggcaacauggugaccc

SEQ ID NO: 369559 - RNA, 30 nt, Human
cccaggcaacauggugaccccaucucuacc

SEQ ID NO: 369560 - RNA, 20 nt, Human
cccaggcaagagugcagugg

SEQ ID NO: 369561 - RNA, 29 nt, Human
cccaggcaagcagcaccucccugcucucc

SEQ ID NO: 369562 - RNA, 22 nt, Human
cccaggcaagcccuucuuccuc

SEQ ID NO: 369563 - RNA, 32 nt, Human
cccaggcaagcuuuuaauaaacuguugguuau

SEQ ID NO: 369564 - RNA, 32 nt, Human
cccaggcaaggccaccacccccacaccaggcc

SEQ ID NO: 369565 - RNA, 22 nt, Human
cccaggcaauuccccaggcccu

SEQ ID NO: 369566 - RNA, 19 nt, Human
cccaggcacagacaugugg

SEQ ID NO: 369567 - RNA, 32 nt, Human
cccaggcacagccaugggagauucggagaugg

SEQ ID NO: 369568 - RNA, 32 nt, Human
cccaggcacagccccaggcuggcaaagggagg

SEQ ID NO: 369569 - RNA, 32 nt, Human
cccaggcacagcugggugucagaccuggagga

SEQ ID NO: 369570 - RNA, 32 nt, Human
cccaggcacugcacagcaccuuggcugaugcu

SEQ ID NO: 369571 - RNA, 21 nt, Human
cccaggcagagguugcaguga

SEQ ID NO: 369572 - RNA, 22 nt, Human
cccaggcagauccuggcuccca

SEQ ID NO: 369573 - RNA, 32 nt, Human
cccaggcagaucucagacuccugggcucaagc

SEQ ID NO: 369574 - RNA, 21 nt, Human
cccaggcagaucucccccagg

SEQ ID NO: 369575 - RNA, 32 nt, Human
cccaggcagcauggugaggucugcucccggac

SEQ ID NO: 369576 - RNA, 32 nt, Human
cccaggcagccccugaagcugccggguucugc

SEQ ID NO: 369577 - RNA, 32 nt, Human
cccaggcagccgcugcagucgccacaccuuug

SEQ ID NO: 369578 - RNA, 32 nt, Human
cccaggcagccugacagagaucauucaagggg

SEQ ID NO: 369579 - RNA, 23 nt, Human
cccaggcagccuucucccuggcc

SEQ ID NO: 369580 - RNA, 32 nt, Human
cccaggcagcuggacaucuccaggaaaccagg

SEQ ID NO: 369581 - RNA, 17 nt, Human
cccaggcaggagcagca

SEQ ID NO: 369582 - RNA, 31 nt, Human
cccaggcaggagccaagcacagcaggagcuu

SEQ ID NO: 369583 - RNA, 32 nt, Human
cccaggcaggaggcuggggugcuguguggggg

SEQ ID NO: 369584 - RNA, 20 nt, Human
cccaggcaggaguacagugg

SEQ ID NO: 369585 - RNA, 19 nt, Human
cccaggcaggagugcagug

SEQ ID NO: 369586 - RNA, 20 nt, Human
cccaggcaggagugcagugg

SEQ ID NO: 369587 - RNA, 21 nt, Human
cccaggcaggagugcaguggc

SEQ ID NO: 369588 - RNA, 19 nt, Human
cccaggcaggaguuugcug

SEQ ID NO: 369589 - RNA, 32 nt, Human
cccaggcaggcagaucaccugaggucgggagu

SEQ ID NO: 369590 - RNA, 32 nt, Human
cccaggcaggcagaucacuugaggucaggagu

SEQ ID NO: 369591 - RNA, 32 nt, Human
cccaggcagggagaauggggagagggaccucc

SEQ ID NO: 369592 - RNA, 32 nt, Human
cccaggcagguggaucgccugaggucgggagu

SEQ ID NO: 369593 - RNA, 24 nt, Human
cccaggcaguggagguugcaguga

SEQ ID NO: 369594 - RNA, 32 nt, Human
cccaggcaguggagguugcagugagccaagau

SEQ ID NO: 369595 - RNA, 32 nt, Human
cccaggcagugucagcagugaagguucucggg

SEQ ID NO: 369596 - RNA, 32 nt, Human
cccaggcaucugcuuuacucuggaccauagga

SEQ ID NO: 369597 - RNA, 20 nt, Human
cccaggcaucuuggccccca

SEQ ID NO: 369598 - RNA, 32 nt, Human
cccaggcaugcuggagggacuuggggacauug

SEQ ID NO: 369599 - RNA, 32 nt, Human
cccaggcauuugaauccagccugagcaauaua

SEQ ID NO: 369600 - RNA, 32 nt, Human
cccaggccaaaggggaccuggaagggaggugg

SEQ ID NO: 369601 - RNA, 31 nt, Human
cccaggccaaugucugucagccaggugcuca

SEQ ID NO: 369602 - RNA, 17 nt, Human
cccaggccacaaaggca

SEQ ID NO: 369603 - RNA, 25 nt, Human
cccaggccacagugauaccauccca

SEQ ID NO: 369604 - RNA, 18 nt, Human
cccaggccaccaacggca

SEQ ID NO: 369605 - RNA, 21 nt, Human
cccaggccaccagcccccgug

SEQ ID NO: 369606 - RNA, 32 nt, Human
cccaggccaccaggaauucauuuauucaugca

SEQ ID NO: 369607 - RNA, 19 nt, Human
cccaggccacccaccaccc

SEQ ID NO: 369608 - RNA, 32 nt, Human
cccaggccaccugucuucucucccacaugcac

SEQ ID NO: 369609 - RNA, 17 nt, Human
cccaggccagaagccag

SEQ ID NO: 369610 - RNA, 20 nt, Human
cccaggccagagugcagugg

SEQ ID NO: 369611 - RNA, 20 nt, Human
cccaggccagaguguagugg

SEQ ID NO: 369612 - RNA, 21 nt, Human
cccaggccagaguguaguggc

SEQ ID NO: 369613 - RNA, 18 nt, Human
cccaggccagcagagcca

SEQ ID NO: 369614 - RNA, 21 nt, Human
cccaggccaggacucugcagc

SEQ ID NO: 369615 - RNA, 32 nt, Human
cccaggccaggcagccaaaucuugccugugcu

SEQ ID NO: 369616 - RNA, 24 nt, Human
cccaggccagggaaagcccguguc

SEQ ID NO: 369617 - RNA, 32 nt, Human
cccaggccagggacaccccuccccagcuccca

SEQ ID NO: 369618 - RNA, 23 nt, Human
cccaggccaggucgggagcacag

SEQ ID NO: 369619 - RNA, 32 nt, Human
cccaggccagguuugcuggccauagauaccuu

SEQ ID NO: 369620 - RNA, 32 nt, Human
cccaggccagugcuuggcaggugcucagggaa

SEQ ID NO: 369621 - RNA, 23 nt, Human
cccaggccauccagcccugugga

SEQ ID NO: 369622 - RNA, 32 nt, Human
cccaggccaucguggugauggagugccugggg

SEQ ID NO: 369623 - RNA, 32 nt, Human
cccaggccauuucucccaccuuuacucacacc

SEQ ID NO: 369624 - RNA, 32 nt, Human
cccaggcccacggccacaucucugucaagggu

SEQ ID NO: 369625 - RNA, 21 nt, Human
cccaggcccacugugccucag

SEQ ID NO: 369626 - RNA, 32 nt, Human
cccaggcccagccucuuguucuuagggcuugg

SEQ ID NO: 369627 - RNA, 32 nt, Human
cccaggcccaggcucugagaggccguguccua

SEQ ID NO: 369628 - RNA, 24 nt, Human
cccaggccccaaagcaccccaagg

SEQ ID NO: 369629 - RNA, 32 nt, Human
cccaggccccagaagucaccugccuguaugug

SEQ ID NO: 369630 - RNA, 18 nt, Human
cccaggccccaggagcug

SEQ ID NO: 369631 - RNA, 21 nt, Human
cccaggccccaugcaaaggca

SEQ ID NO: 369632 - RNA, 22 nt, Human
cccaggccccaugcaaaggcac

SEQ ID NO: 369633 - RNA, 19 nt, Human
cccaggcccccagagccag

SEQ ID NO: 369634 - RNA, 19 nt, Human
cccaggccccgaauugcug

SEQ ID NO: 369635 - RNA, 23 nt, Human
cccaggccccgccccccgcccgg

SEQ ID NO: 369636 - RNA, 32 nt, Human
cccaggccccgggcugagcacugugaggccug

SEQ ID NO: 369637 - RNA, 32 nt, Human
cccaggccccuagagccccgagagcuccgaga

SEQ ID NO: 369638 - RNA, 23 nt, Human
cccaggccccucgggcuuccaca

SEQ ID NO: 369639 - RNA, 21 nt, Human
cccaggccccugccacagccu

SEQ ID NO: 369640 - RNA, 18 nt, Human
cccaggccccuggcgugu

SEQ ID NO: 369641 - RNA, 26 nt, Human
cccaggccccuguguucagccucagg

SEQ ID NO: 369642 - RNA, 23 nt, Human
cccaggccccuuccucccuuccc

SEQ ID NO: 369643 - RNA, 22 nt, Human
cccaggcccgccgcuccgcagg

SEQ ID NO: 369644 - RNA, 32 nt, Human
cccaggcccgcgucaagagcuguuagccucug

SEQ ID NO: 369645 - RNA, 32 nt, Human
cccaggcccuagacccucccccaccauuccac

SEQ ID NO: 369646 - RNA, 32 nt, Human
cccaggcccuauccugaacaggagacuaaaca

SEQ ID NO: 369647 - RNA, 32 nt, Human
cccaggcccucagaaaccagagccaugagacc

SEQ ID NO: 369648 - RNA, 22 nt, Human
cccaggcccucaucacccucag

SEQ ID NO: 369649 - RNA, 22 nt, Human
cccaggcccucccaccacccca

SEQ ID NO: 369650 - RNA, 23 nt, Human
cccaggcccucucccaccuacag

SEQ ID NO: 369651 - RNA, 22 nt, Human
cccaggcccucuguuucaugug

SEQ ID NO: 369652 - RNA, 32 nt, Human
cccaggcccugagcagcgugucuuuccucggc

SEQ ID NO: 369653 - RNA, 21 nt, Human
cccaggcccugcagcggcagc

SEQ ID NO: 369654 - RNA, 32 nt, Human
cccaggcccugccuaagccucagcagaacuug

SEQ ID NO: 369655 - RNA, 32 nt, Human
cccaggcccugccuccccugccaugccccugu

SEQ ID NO: 369656 - RNA, 32 nt, Human
cccaggcccugccugcuuggcuggggcugggg

SEQ ID NO: 369657 - RNA, 32 nt, Human
cccaggcccuggaggcugcaacauaccucaau

SEQ ID NO: 369658 - RNA, 18 nt, Human
cccaggcccuggggaggg

SEQ ID NO: 369659 - RNA, 23 nt, Human
cccaggccgccagagcccacccg

SEQ ID NO: 369660 - RNA, 32 nt, Human
cccaggccggacugcaguggcagggucucggc

SEQ ID NO: 369661 - RNA, 32 nt, Human
cccaggccggacugcaguggcgcaaucuuggc

SEQ ID NO: 369662 - RNA, 20 nt, Human
cccaggccggagugcaaugg

SEQ ID NO: 369663 - RNA, 19 nt, Human
cccaggccggagugcagug

SEQ ID NO: 369664 - RNA, 20 nt, Human
cccaggccggagugcagugg

SEQ ID NO: 369665 - RNA, 21 nt, Human
cccaggccggagugcaguggc

SEQ ID NO: 369666 - RNA, 21 nt, Human
cccaggccggagugcaguggu

SEQ ID NO: 369667 - RNA, 21 nt, Human
cccaggccggcaaccuggcca

SEQ ID NO: 369668 - RNA, 32 nt, Human
cccaggccggccucagggucaggacgccucca

SEQ ID NO: 369669 - RNA, 26 nt, Human
cccaggccguucagccugaccucagg

SEQ ID NO: 369670 - RNA, 32 nt, Human
cccaggccuagaaucacaaagguccuagaaac

SEQ ID NO: 369671 - RNA, 17 nt, Human
cccaggccuagaugcug

SEQ ID NO: 369672 - RNA, 21 nt, Human
cccaggccuaggaccgcggug

SEQ ID NO: 369673 - RNA, 32 nt, Human
cccaggccuaugggggcucuggaaggaugggc

SEQ ID NO: 369674 - RNA, 32 nt, Human
cccaggccuccaccagccuugaacccuugcaa

SEQ ID NO: 369675 - RNA, 22 nt, Human
cccaggccuccaccuccccagg

SEQ ID NO: 369676 - RNA, 32 nt, Human
cccaggccuccagggacuccgccgcuccagga

SEQ ID NO: 369677 - RNA, 32 nt, Human
cccaggccuccugccgucuccaacagggcaug

SEQ ID NO: 369678 - RNA, 32 nt, Human
cccaggccucuccccaggucaggaggcagcug

SEQ ID NO: 369679 - RNA, 18 nt, Human
cccaggccucucuccagg

SEQ ID NO: 369680 - RNA, 32 nt, Human
cccaggccucucugugggaccugggccugacg

SEQ ID NO: 369681 - RNA, 21 nt, Human
cccaggccucuggcagcagcu

SEQ ID NO: 369682 - RNA, 23 nt, Human
cccaggccucuggggcccgcugg

SEQ ID NO: 369683 - RNA, 24 nt, Human
cccaggccugccccucaccucagg

SEQ ID NO: 369684 - RNA, 21 nt, Human
cccaggccugccucccuuccc

SEQ ID NO: 369685 - RNA, 21 nt, Human
cccaggccugcuggcaucagg

SEQ ID NO: 369686 - RNA, 20 nt, Human
cccaggccuggaaacagcug

SEQ ID NO: 369687 - RNA, 23 nt, Human
cccaggccuggacuccaucucag

SEQ ID NO: 369688 - RNA, 24 nt, Human
cccaggccuggagcguuugcugug

SEQ ID NO: 369689 - RNA, 24 nt, Human
cccaggccuggaggggggucugug

SEQ ID NO: 369690 - RNA, 24 nt, Human
cccaggccuggcugugcgcugcug

SEQ ID NO: 369691 - RNA, 32 nt, Human
cccaggccugggaagagcucggccccgaucag

SEQ ID NO: 369692 - RNA, 21 nt, Human
cccaggccugggaugcaguga

SEQ ID NO: 369693 - RNA, 22 nt, Human
cccaggccugggccuccugcug

SEQ ID NO: 369694 - RNA, 32 nt, Human
cccaggccuggggaccgguaagauccauguca

SEQ ID NO: 369695 - RNA, 32 nt, Human
cccaggccuguaaucccaucacuuugggaggu

SEQ ID NO: 369696 - RNA, 32 nt, Human
cccaggccuguaggcuuccagugagaaaacug

SEQ ID NO: 369697 - RNA, 18 nt, Human
cccaggccuguggugcug

SEQ ID NO: 369698 - RNA, 21 nt, Human
cccaggccuguggugcugcag

SEQ ID NO: 369699 - RNA, 32 nt, Human
cccaggccuucgggauccuccugggaaccucu

SEQ ID NO: 369700 - RNA, 21 nt, Human
cccaggccuucuggaacugcu

SEQ ID NO: 369701 - RNA, 23 nt, Human
cccaggccuugccucccuggccu

SEQ ID NO: 369702 - RNA, 32 nt, Human
cccaggccuuggucuugguccugggccuggag

SEQ ID NO: 369703 - RNA, 32 nt, Human
cccaggccuuucuccaccggaggaccagggaa

SEQ ID NO: 369704 - RNA, 32 nt, Human
cccaggccuuuguucuugccucuucucgcuga

SEQ ID NO: 369705 - RNA, 19 nt, Human
cccaggcgacacuaagcca

SEQ ID NO: 369706 - RNA, 32 nt, Human
cccaggcgaggaggaggaggagaaaauucccc

SEQ ID NO: 369707 - RNA, 32 nt, Human
cccaggcgcagccaaugggaagggucggaggc

SEQ ID NO: 369708 - RNA, 18 nt, Human
cccaggcgcugcuggcug

SEQ ID NO: 369709 - RNA, 32 nt, Human
cccaggcggaguacaauggugggaucucggcu

SEQ ID NO: 369710 - RNA, 24 nt, Human
cccaggcggcagagguugcaguga

SEQ ID NO: 369711 - RNA, 32 nt, Human
cccaggcggcagagguugcagugagccaagau

SEQ ID NO: 369712 - RNA, 32 nt, Human
cccaggcggcagagguugcagugagucgagau

SEQ ID NO: 369713 - RNA, 20 nt, Human
cccaggcgggagugcagugg

SEQ ID NO: 369714 - RNA, 32 nt, Human
cccaggcgggcggaucaccugaggucgggagu

SEQ ID NO: 369715 - RNA, 32 nt, Human
cccaggcgggcggaucacuugaggucaggaau

SEQ ID NO: 369716 - RNA, 32 nt, Human
cccaggcggucaccagcagauuugcccgcgcg

SEQ ID NO: 369717 - RNA, 24 nt, Human
cccaggcgguugaggcugcaguga

SEQ ID NO: 369718 - RNA, 32 nt, Human
cccaggcgguugaggcugcagugagccaugau

SEQ ID NO: 369719 - RNA, 32 nt, Human
cccaggcgucagaaaauggaaaaagagccagg

SEQ ID NO: 369720 - RNA, 20 nt, Human
cccaggcguccgggcuccca

SEQ ID NO: 369721 - RNA, 24 nt, Human
cccaggcguccuccacccacgccc

SEQ ID NO: 369722 - RNA, 32 nt, Human
cccaggcgucuccucuugcucccugguugggg

SEQ ID NO: 369723 - RNA, 19 nt, Human
cccaggcgugcagagccag

SEQ ID NO: 369724 - RNA, 32 nt, Human
cccaggcgugcagagccaggguccugggguuu

SEQ ID NO: 369725 - RNA, 32 nt, Human
cccaggcguguggacccgagcccagccuugcg

SEQ ID NO: 369726 - RNA, 20 nt, Human
cccaggcuacagugcagugg

SEQ ID NO: 369727 - RNA, 20 nt, Human
cccaggcuagaaugcagugg

SEQ ID NO: 369728 - RNA, 21 nt, Human
cccaggcuagaaugcaguggu

SEQ ID NO: 369729 - RNA, 22 nt, Human
cccaggcuagaaugcaguggug

SEQ ID NO: 369730 - RNA, 19 nt, Human
cccaggcuagagcgcaggg

SEQ ID NO: 369731 - RNA, 18 nt, Human
cccaggcuagaggguggu

SEQ ID NO: 369732 - RNA, 19 nt, Human
cccaggcuagaggguggug

SEQ ID NO: 369733 - RNA, 20 nt, Human
cccaggcuagaguacagugg

SEQ ID NO: 369734 - RNA, 20 nt, Human
cccaggcuagaguauagugg

SEQ ID NO: 369735 - RNA, 19 nt, Human
cccaggcuagagugcaaug

SEQ ID NO: 369736 - RNA, 20 nt, Human
cccaggcuagagugcaaugg

SEQ ID NO: 369737 - RNA, 21 nt, Human
cccaggcuagagugcaauggc

SEQ ID NO: 369738 - RNA, 22 nt, Human
cccaggcuagagugcaauggca

SEQ ID NO: 369739 - RNA, 23 nt, Human
cccaggcuagagugcaauggcau

SEQ ID NO: 369740 - RNA, 20 nt, Human
cccaggcuagagugcacugg

SEQ ID NO: 369741 - RNA, 18 nt, Human
cccaggcuagagugcagu

SEQ ID NO: 369742 - RNA, 20 nt, Human
cccaggcuagagugcaguag

SEQ ID NO: 369743 - RNA, 21 nt, Human
cccaggcuagagugcaguagc

SEQ ID NO: 369744 - RNA, 20 nt, Human
cccaggcuagagugcagugg

SEQ ID NO: 369745 - RNA, 21 nt, Human
cccaggcuagagugcaguggc

SEQ ID NO: 369746 - RNA, 23 nt, Human
cccaggcuagagugcaguggugu

SEQ ID NO: 369747 - RNA, 20 nt, Human
cccaggcuagaguguagugg

SEQ ID NO: 369748 - RNA, 21 nt, Human
cccaggcuagaguguaguggc

SEQ ID NO: 369749 - RNA, 21 nt, Human
cccaggcuagggggcuauaga

SEQ ID NO: 369750 - RNA, 32 nt, Human
cccaggcuagucucaaacuccugggcucaagc

SEQ ID NO: 369751 - RNA, 32 nt, Human
cccaggcuagucucaaacuccugggcucaagu

SEQ ID NO: 369752 - RNA, 32 nt, Human
cccaggcuagucuccaacuccugggcucagau

SEQ ID NO: 369753 - RNA, 32 nt, Human
cccaggcuagucuugaacuccugggcucaagc

SEQ ID NO: 369754 - RNA, 32 nt, Human
cccaggcuagucuugaacuccugggcucgaau

SEQ ID NO: 369755 - RNA, 32 nt, Human
cccaggcucaagccaucuuuccaccucagccu

SEQ ID NO: 369756 - RNA, 32 nt, Human
cccaggcucaagugauccuuccaccucagccu

SEQ ID NO: 369757 - RNA, 21 nt, Human
cccaggcucacccacccaagg

SEQ ID NO: 369758 - RNA, 21 nt, Human
cccaggcucaggcccaugagg

SEQ ID NO: 369759 - RNA, 32 nt, Human
cccaggcucaggggcugagaggcugcuuacug

SEQ ID NO: 369760 - RNA, 32 nt, Human
cccaggcucaugcucugaacucuggcugagag

SEQ ID NO: 369761 - RNA, 23 nt, Human
cccaggcuccagugcaguggugu

SEQ ID NO: 369762 - RNA, 32 nt, Human
cccaggcucccaggacccaggguacaucagga

SEQ ID NO: 369763 - RNA, 32 nt, Human
cccaggcucccugcuuucucucuugcccuccc

SEQ ID NO: 369764 - RNA, 32 nt, Human
cccaggcuccuucucaggucucagucucacuc

SEQ ID NO: 369765 - RNA, 32 nt, Human
cccaggcucgggggcucagugggaguucaugc

SEQ ID NO: 369766 - RNA, 31 nt, Human
cccaggcucguccccagcacagcagacacca

SEQ ID NO: 369767 - RNA, 21 nt, Human
cccaggcucucccaacccagg

SEQ ID NO: 369768 - RNA, 18 nt, Human
cccaggcucugacuuuca

SEQ ID NO: 369769 - RNA, 32 nt, Human
cccaggcucuucugacuggcaguggcucugga

SEQ ID NO: 369770 - RNA, 20 nt, Human
cccaggcugaacugcagugg

SEQ ID NO: 369771 - RNA, 23 nt, Human
cccaggcugaacugcaguggugu

SEQ ID NO: 369772 - RNA, 19 nt, Human
cccaggcugaagugcaaug

SEQ ID NO: 369773 - RNA, 20 nt, Human
cccaggcugaagugcagcgg

SEQ ID NO: 369774 - RNA, 32 nt, Human
cccaggcugaagugcaguagugcaaucucagc

SEQ ID NO: 369775 - RNA, 19 nt, Human
cccaggcugaagugcagug

SEQ ID NO: 369776 - RNA, 20 nt, Human
cccaggcugaagugcagugg

SEQ ID NO: 369777 - RNA, 23 nt, Human
cccaggcugaagugcaguggugu

SEQ ID NO: 369778 - RNA, 32 nt, Human
cccaggcugaaguguagagugcaguggcauga

SEQ ID NO: 369779 - RNA, 20 nt, Human
cccaggcugaccaggccagc

SEQ ID NO: 369780 - RNA, 20 nt, Human
cccaggcugagagccagaug

SEQ ID NO: 369781 - RNA, 19 nt, Human
cccaggcugaguacagugg

SEQ ID NO: 369782 - RNA, 18 nt, Human
cccaggcugagugcagug

SEQ ID NO: 369783 - RNA, 19 nt, Human
cccaggcugagugcagugg

SEQ ID NO: 369784 - RNA, 20 nt, Human
cccaggcugagugcaguggc

SEQ ID NO: 369785 - RNA, 32 nt, Human
cccaggcugaucucagauuccugggcugaagu

SEQ ID NO: 369786 - RNA, 32 nt, Human
cccaggcugaucuugaacuccugggcucaaga

SEQ ID NO: 369787 - RNA, 32 nt, Human
cccaggcugaucuugaacuccugggcucaagc

SEQ ID NO: 369788 - RNA, 32 nt, Human
cccaggcugcaacauccaccucccagguucaa

SEQ ID NO: 369789 - RNA, 32 nt, Human
cccaggcugcaacccucuguucccaagggcag

SEQ ID NO: 369790 - RNA, 32 nt, Human
cccaggcugcaaccucgaccucccgggcucaa

SEQ ID NO: 369791 - RNA, 32 nt, Human
cccaggcugcacccucuccgacccccaggccc

SEQ ID NO: 369792 - RNA, 16 nt, Human
cccaggcugcagcagc

SEQ ID NO: 369793 - RNA, 32 nt, Human
cccaggcugcagcugcucagaagcuccaggca

SEQ ID NO: 369794 - RNA, 24 nt, Human
cccaggcugcaggccucccccagg

SEQ ID NO: 369795 - RNA, 19 nt, Human
cccaggcugcagugcaaug

SEQ ID NO: 369796 - RNA, 20 nt, Human
cccaggcugcagugcaaugg

SEQ ID NO: 369797 - RNA, 18 nt, Human
cccaggcugcagugcagu

SEQ ID NO: 369798 - RNA, 19 nt, Human
cccaggcugcagugcagug

SEQ ID NO: 369799 - RNA, 20 nt, Human
cccaggcugcagugcaguga

SEQ ID NO: 369800 - RNA, 20 nt, Human
cccaggcugcagugcagugg

SEQ ID NO: 369801 - RNA, 32 nt, Human
cccaggcugcagugcaguggugccaucucagc

SEQ ID NO: 369802 - RNA, 20 nt, Human
cccaggcugcaguguagugg

SEQ ID NO: 369803 - RNA, 22 nt, Human
cccaggcugcaguguaguggug

SEQ ID NO: 369804 - RNA, 23 nt, Human
cccaggcugcaguucacuggugu

SEQ ID NO: 369805 - RNA, 32 nt, Human
cccaggcugccaggcuggaguggaguggcaug

SEQ ID NO: 369806 - RNA, 32 nt, Human
cccaggcugcccugcacuccugccucccagcc

SEQ ID NO: 369807 - RNA, 32 nt, Human
cccaggcugccuggccggggccacugccuccu

SEQ ID NO: 369808 - RNA, 32 nt, Human
cccaggcugccuggcuggggccacugccuccu

SEQ ID NO: 369809 - RNA, 32 nt, Human
cccaggcugcgucuggaguggcagagcucgca

SEQ ID NO: 369810 - RNA, 32 nt, Human
cccaggcugcuggaguacaguggcacaaucug

SEQ ID NO: 369811 - RNA, 23 nt, Human
cccaggcugcuggagugcagugg

SEQ ID NO: 369812 - RNA, 32 nt, Human
cccaggcugcuggagugcaguggcacaaucuc

SEQ ID NO: 369813 - RNA, 23 nt, Human
cccaggcugcuggagugccgugg

SEQ ID NO: 369814 - RNA, 21 nt, Human
cccaggcuggaauacaguggc

SEQ ID NO: 369815 - RNA, 20 nt, Human
cccaggcuggaauccagugg

SEQ ID NO: 369816 - RNA, 21 nt, Human
cccaggcuggaauccaguggc

SEQ ID NO: 369817 - RNA, 19 nt, Human
cccaggcuggaaugcaaug

SEQ ID NO: 369818 - RNA, 20 nt, Human
cccaggcuggaaugcaaugg

SEQ ID NO: 369819 - RNA, 23 nt, Human
cccaggcuggaaugcaauggcau

SEQ ID NO: 369820 - RNA, 19 nt, Human
cccaggcuggaaugcagug

SEQ ID NO: 369821 - RNA, 20 nt, Human
cccaggcuggaaugcagugg

SEQ ID NO: 369822 - RNA, 21 nt, Human
cccaggcuggaaugcaguggc

SEQ ID NO: 369823 - RNA, 23 nt, Human
cccaggcuggaaugcaguggugu

SEQ ID NO: 369824 - RNA, 19 nt, Human
cccaggcuggacugcaaug

SEQ ID NO: 369825 - RNA, 20 nt, Human
cccaggcuggacugcaauga

SEQ ID NO: 369826 - RNA, 32 nt, Human
cccaggcuggacugcagcagcgcagucucaga

SEQ ID NO: 369827 - RNA, 19 nt, Human
cccaggcuggacugcagug

SEQ ID NO: 369828 - RNA, 20 nt, Human
cccaggcuggacugcaguga

SEQ ID NO: 369829 - RNA, 20 nt, Human
cccaggcuggacugcagugg

SEQ ID NO: 369830 - RNA, 21 nt, Human
cccaggcuggacugcaguggc

SEQ ID NO: 369831 - RNA, 22 nt, Human
cccaggcuggacugcaguggug

SEQ ID NO: 369832 - RNA, 32 nt, Human
cccaggcuggacugcaguggugcgaucucggc

SEQ ID NO: 369833 - RNA, 32 nt, Human
cccaggcuggacugcaguggugcgauucuccu

SEQ ID NO: 369834 - RNA, 32 nt, Human
cccaggcuggacuuugugugagccuguuuagu

SEQ ID NO: 369835 - RNA, 32 nt, Human
cccaggcuggagaaguccaugugugcaugcau

SEQ ID NO: 369836 - RNA, 20 nt, Human
cccaggcuggagagcagugg

SEQ ID NO: 369837 - RNA, 21 nt, Human
cccaggcuggagagcaguggc

SEQ ID NO: 369838 - RNA, 22 nt, Human
cccaggcuggagagcaguggca

SEQ ID NO: 369839 - RNA, 22 nt, Human
cccaggcuggagcacacuggug

SEQ ID NO: 369840 - RNA, 19 nt, Human
cccaggcuggagcgcaaug

SEQ ID NO: 369841 - RNA, 19 nt, Human
cccaggcuggagcgcagug

SEQ ID NO: 369842 - RNA, 20 nt, Human
cccaggcuggagcgcagugg

SEQ ID NO: 369843 - RNA, 21 nt, Human
cccaggcuggagcgcaguggc

SEQ ID NO: 369844 - RNA, 32 nt, Human
cccaggcuggaggaagcagcaggcuagcggaa

SEQ ID NO: 369845 - RNA, 17 nt, Human
cccaggcuggaggacag

SEQ ID NO: 369846 - RNA, 20 nt, Human
cccaggcuggaggacaguga

SEQ ID NO: 369847 - RNA, 23 nt, Human
cccaggcuggaggacagugaugu

SEQ ID NO: 369848 - RNA, 19 nt, Human
cccaggcuggagggcaaug

SEQ ID NO: 369849 - RNA, 20 nt, Human
cccaggcuggagggcaguga

SEQ ID NO: 369850 - RNA, 21 nt, Human
cccaggcuggaguacaauagc

SEQ ID NO: 369851 - RNA, 19 nt, Human
cccaggcuggaguacaaug

SEQ ID NO: 369852 - RNA, 22 nt, Human
cccaggcuggaguacaaugaug

SEQ ID NO: 369853 - RNA, 21 nt, Human
cccaggcuggaguacacuggc

SEQ ID NO: 369854 - RNA, 19 nt, Human
cccaggcuggaguacagug

SEQ ID NO: 369855 - RNA, 20 nt, Human
cccaggcuggaguacaguga

SEQ ID NO: 369856 - RNA, 20 nt, Human
cccaggcuggaguacagugg

SEQ ID NO: 369857 - RNA, 21 nt, Human
cccaggcuggaguacaguggc

SEQ ID NO: 369858 - RNA, 23 nt, Human
cccaggcuggaguacaguggcgu

SEQ ID NO: 369859 - RNA, 22 nt, Human
cccaggcuggaguacagugggu

SEQ ID NO: 369860 - RNA, 21 nt, Human
cccaggcuggaguacaguggu

SEQ ID NO: 369861 - RNA, 22 nt, Human
cccaggcuggaguacaguggug

SEQ ID NO: 369862 - RNA, 23 nt, Human
cccaggcuggaguacaguggugu

SEQ ID NO: 369863 - RNA, 23 nt, Human
cccaggcuggaguaccgguggug

SEQ ID NO: 369864 - RNA, 19 nt, Human
cccaggcuggaguagagug

SEQ ID NO: 369865 - RNA, 20 nt, Human
cccaggcuggaguagaguga

SEQ ID NO: 369866 - RNA, 32 nt, Human
cccaggcuggaguauaguagugcaguggugug

SEQ ID NO: 369867 - RNA, 19 nt, Human
cccaggcuggaguauagug

SEQ ID NO: 369868 - RNA, 20 nt, Human
cccaggcuggaguauaguga

SEQ ID NO: 369869 - RNA, 20 nt, Human
cccaggcuggaguauagugg

SEQ ID NO: 369870 - RNA, 23 nt, Human
cccaggcuggaguauaguggugu

SEQ ID NO: 369871 - RNA, 19 nt, Human
cccaggcuggaguccaaug

SEQ ID NO: 369872 - RNA, 19 nt, Human
cccaggcuggaguccagug

SEQ ID NO: 369873 - RNA, 20 nt, Human
cccaggcuggaguccagugg

SEQ ID NO: 369874 - RNA, 21 nt, Human
cccaggcuggaguccaguggc

SEQ ID NO: 369875 - RNA, 23 nt, Human
cccaggcuggaguccaguggcgu

SEQ ID NO: 369876 - RNA, 22 nt, Human
cccaggcuggaguccaguggug

SEQ ID NO: 369877 - RNA, 23 nt, Human
cccaggcuggaguccaguggugu

SEQ ID NO: 369878 - RNA, 23 nt, Human
cccaggcuggagucuagugucgu

SEQ ID NO: 369879 - RNA, 20 nt, Human
cccaggcuggagugaggugg

SEQ ID NO: 369880 - RNA, 21 nt, Human
cccaggcuggagugagguggu

SEQ ID NO: 369881 - RNA, 20 nt, Human
cccaggcuggagugcaacgg

SEQ ID NO: 369882 - RNA, 19 nt, Human
cccaggcuggagugcaagg

SEQ ID NO: 369883 - RNA, 21 nt, Human
cccaggcuggagugcaaggca

SEQ ID NO: 369884 - RNA, 18 nt, Human
cccaggcuggagugcaau

SEQ ID NO: 369885 - RNA, 19 nt, Human
cccaggcuggagugcaaug

SEQ ID NO: 369886 - RNA, 20 nt, Human
cccaggcuggagugcaauga

SEQ ID NO: 369887 - RNA, 22 nt, Human
cccaggcuggagugcaaugaug

SEQ ID NO: 369888 - RNA, 22 nt, Human
cccaggcuggagugcaaugcug

SEQ ID NO: 369889 - RNA, 20 nt, Human
cccaggcuggagugcaaugg

SEQ ID NO: 369890 - RNA, 23 nt, Human
cccaggcuggagugcaauggagu

SEQ ID NO: 369891 - RNA, 21 nt, Human
cccaggcuggagugcaauggc

SEQ ID NO: 369892 - RNA, 22 nt, Human
cccaggcuggagugcaauggca

SEQ ID NO: 369893 - RNA, 23 nt, Human
cccaggcuggagugcaauggcau

SEQ ID NO: 369894 - RNA, 23 nt, Human
cccaggcuggagugcaauggcgu

SEQ ID NO: 369895 - RNA, 21 nt, Human
cccaggcuggagugcaauggu

SEQ ID NO: 369896 - RNA, 22 nt, Human
cccaggcuggagugcaauggug

SEQ ID NO: 369897 - RNA, 32 nt, Human
cccaggcuggagugcaauggugcaaugaucuc

SEQ ID NO: 369898 - RNA, 32 nt, Human
cccaggcuggagugcaauggugccaucuuggu

SEQ ID NO: 369899 - RNA, 23 nt, Human
cccaggcuggagugcaaugucgu

SEQ ID NO: 369900 - RNA, 22 nt, Human
cccaggcuggagugcaauugug

SEQ ID NO: 369901 - RNA, 32 nt, Human
cccaggcuggagugcacaaacauggcucacua

SEQ ID NO: 369902 - RNA, 19 nt, Human
cccaggcuggagugcacug

SEQ ID NO: 369903 - RNA, 20 nt, Human
cccaggcuggagugcacugg

SEQ ID NO: 369904 - RNA, 32 nt, Human
cccaggcuggagugcacuggcgcaaucucggc

SEQ ID NO: 369905 - RNA, 32 nt, Human
cccaggcuggagugcacuggcgcgaucucggc

SEQ ID NO: 369906 - RNA, 32 nt, Human
cccaggcuggagugcacuggcgugaucucggc

SEQ ID NO: 369907 - RNA, 32 nt, Human
cccaggcuggagugcacuggcuugaucucggc

SEQ ID NO: 369908 - RNA, 32 nt, Human
cccaggcuggagugcacuggcuugaucuuggc

SEQ ID NO: 369909 - RNA, 20 nt, Human
cccaggcuggagugcagagg

SEQ ID NO: 369910 - RNA, 19 nt, Human
cccaggcuggagugcagca

SEQ ID NO: 369911 - RNA, 20 nt, Human
cccaggcuggagugcagcag

SEQ ID NO: 369912 - RNA, 23 nt, Human
cccaggcuggagugcagcaguug

SEQ ID NO: 369913 - RNA, 19 nt, Human
cccaggcuggagugcaggg

SEQ ID NO: 369914 - RNA, 20 nt, Human
cccaggcuggagugcaggga

SEQ ID NO: 369915 - RNA, 18 nt, Human
cccaggcuggagugcagu

SEQ ID NO: 369916 - RNA, 20 nt, Human
cccaggcuggagugcaguag

SEQ ID NO: 369917 - RNA, 21 nt, Human
cccaggcuggagugcaguagc

SEQ ID NO: 369918 - RNA, 22 nt, Human
cccaggcuggagugcaguagca

SEQ ID NO: 369919 - RNA, 23 nt, Human
cccaggcuggagugcaguagcau

SEQ ID NO: 369920 - RNA, 22 nt, Human
cccaggcuggagugcaguagug

SEQ ID NO: 369921 - RNA, 32 nt, Human
cccaggcuggagugcaguagugcaaucagggc

SEQ ID NO: 369922 - RNA, 32 nt, Human
cccaggcuggagugcaguagugcagucguggc

SEQ ID NO: 369923 - RNA, 19 nt, Human
cccaggcuggagugcagug

SEQ ID NO: 369924 - RNA, 20 nt, Human
cccaggcuggagugcaguga

SEQ ID NO: 369925 - RNA, 21 nt, Human
cccaggcuggagugcagugca

SEQ ID NO: 369926 - RNA, 22 nt, Human
cccaggcuggagugcagugcug

SEQ ID NO: 369927 - RNA, 23 nt, Human
cccaggcuggagugcagugcugu

SEQ ID NO: 369928 - RNA, 32 nt, Human
cccaggcuggagugcagugcugugauauuggc

SEQ ID NO: 369929 - RNA, 20 nt, Human
cccaggcuggagugcagugg

SEQ ID NO: 369930 - RNA, 21 nt, Human
cccaggcuggagugcaguggc

SEQ ID NO: 369931 - RNA, 23 nt, Human
cccaggcuggagugcaguggcgu

SEQ ID NO: 369932 - RNA, 22 nt, Human
cccaggcuggagugcagugggu

SEQ ID NO: 369933 - RNA, 21 nt, Human
cccaggcuggagugcaguggu

SEQ ID NO: 369934 - RNA, 22 nt, Human
cccaggcuggagugcaguggug

SEQ ID NO: 369935 - RNA, 32 nt, Human
cccaggcuggagugcaguggugcaguggcucg

SEQ ID NO: 369936 - RNA, 32 nt, Human
cccaggcuggagugcaguggugccaucaccac

SEQ ID NO: 369937 - RNA, 32 nt, Human
cccaggcuggagugcaguggugccaucauagc

SEQ ID NO: 369938 - RNA, 32 nt, Human
cccaggcuggagugcaguggugccaucucggc

SEQ ID NO: 369939 - RNA, 32 nt, Human
cccaggcuggagugcaguggugccaucuuggc

SEQ ID NO: 369940 - RNA, 23 nt, Human
cccaggcuggagugcaguggugu

SEQ ID NO: 369941 - RNA, 23 nt, Human
cccaggcuggagugcagugucgu

SEQ ID NO: 369942 - RNA, 22 nt, Human
cccaggcuggagugcaguguug

SEQ ID NO: 369943 - RNA, 19 nt, Human
cccaggcuggagugcauga

SEQ ID NO: 369944 - RNA, 19 nt, Human
cccaggcuggagugcauug

SEQ ID NO: 369945 - RNA, 20 nt, Human
cccaggcuggagugcauuga

SEQ ID NO: 369946 - RNA, 23 nt, Human
cccaggcuggagugccauagugu

SEQ ID NO: 369947 - RNA, 19 nt, Human
cccaggcuggagugccaug

SEQ ID NO: 369948 - RNA, 20 nt, Human
cccaggcuggagugccaugg

SEQ ID NO: 369949 - RNA, 23 nt, Human
cccaggcuggagugccauggcau

SEQ ID NO: 369950 - RNA, 20 nt, Human
cccaggcuggagugccgugg

SEQ ID NO: 369951 - RNA, 23 nt, Human
cccaggcuggagugccguggcgu

SEQ ID NO: 369952 - RNA, 18 nt, Human
cccaggcuggagugcgau

SEQ ID NO: 369953 - RNA, 19 nt, Human
cccaggcuggagugcgaug

SEQ ID NO: 369954 - RNA, 20 nt, Human
cccaggcuggagugcgaugg

SEQ ID NO: 369955 - RNA, 18 nt, Human
cccaggcuggagugcggu

SEQ ID NO: 369956 - RNA, 20 nt, Human
cccaggcuggagugcggugg

SEQ ID NO: 369957 - RNA, 22 nt, Human
cccaggcuggagugcgguggug

SEQ ID NO: 369958 - RNA, 19 nt, Human
cccaggcuggagugcuaug

SEQ ID NO: 369959 - RNA, 20 nt, Human
cccaggcuggagugcuaugg

SEQ ID NO: 369960 - RNA, 22 nt, Human
cccaggcuggagugcuauggug

SEQ ID NO: 369961 - RNA, 19 nt, Human
cccaggcuggagugcugug

SEQ ID NO: 369962 - RNA, 20 nt, Human
cccaggcuggagugcugugg

SEQ ID NO: 369963 - RNA, 22 nt, Human
cccaggcuggagugcuguggug

SEQ ID NO: 369964 - RNA, 23 nt, Human
cccaggcuggagugcuguggugu

SEQ ID NO: 369965 - RNA, 19 nt, Human
cccaggcuggaguggagug

SEQ ID NO: 369966 - RNA, 20 nt, Human
cccaggcuggaguggagugg

SEQ ID NO: 369967 - RNA, 21 nt, Human
cccaggcuggaguggaguggu

SEQ ID NO: 369968 - RNA, 20 nt, Human
cccaggcuggaguguaagug

SEQ ID NO: 369969 - RNA, 18 nt, Human
cccaggcuggaguguagu

SEQ ID NO: 369970 - RNA, 19 nt, Human
cccaggcuggaguguagug

SEQ ID NO: 369971 - RNA, 20 nt, Human
cccaggcuggaguguagugg

SEQ ID NO: 369972 - RNA, 22 nt, Human
cccaggcuggaguguaguggug

SEQ ID NO: 369973 - RNA, 32 nt, Human
cccaggcuggaguguaguggugccaucucagc

SEQ ID NO: 369974 - RNA, 23 nt, Human
cccaggcuggaguguaguggugu

SEQ ID NO: 369975 - RNA, 20 nt, Human
cccaggcuggaguucagugg

SEQ ID NO: 369976 - RNA, 22 nt, Human
cccaggcuggaguucaguggug

SEQ ID NO: 369977 - RNA, 19 nt, Human
cccaggcuggaugcugcag

SEQ ID NO: 369978 - RNA, 19 nt, Human
cccaggcuggcgugcaaug

SEQ ID NO: 369979 - RNA, 20 nt, Human
cccaggcuggcgugcaaugg

SEQ ID NO: 369980 - RNA, 19 nt, Human
cccaggcuggcgugcagug

SEQ ID NO: 369981 - RNA, 20 nt, Human
cccaggcuggcgugcagugg

SEQ ID NO: 369982 - RNA, 23 nt, Human
cccaggcuggcgugcaguggugu

SEQ ID NO: 369983 - RNA, 22 nt, Human
cccaggcugggaauugcagugg

SEQ ID NO: 369984 - RNA, 32 nt, Human
cccaggcugggagcuugccaggaacccagugg

SEQ ID NO: 369985 - RNA, 20 nt, Human
cccaggcugggaugcagugg

SEQ ID NO: 369986 - RNA, 21 nt, Human
cccaggcugggaugcaguggc

SEQ ID NO: 369987 - RNA, 18 nt, Human
cccaggcugggcaaggcg

SEQ ID NO: 369988 - RNA, 32 nt, Human
cccaggcugggcagaggucaggagacucagcc

SEQ ID NO: 369989 - RNA, 32 nt, Human
cccaggcugggccugcgcugagcuucuggagc

SEQ ID NO: 369990 - RNA, 21 nt, Human
cccaggcugggccugguggug

SEQ ID NO: 369991 - RNA, 32 nt, Human
cccaggcugggccugguggugaagagcagucc

SEQ ID NO: 369992 - RNA, 24 nt, Human
cccaggcuggggccacaacccuga

SEQ ID NO: 369993 - RNA, 20 nt, Human
cccaggcugggggcaggugu

SEQ ID NO: 369994 - RNA, 20 nt, Human
cccaggcugggguacggugg

SEQ ID NO: 369995 - RNA, 21 nt, Human
cccaggcugggguacgguggc

SEQ ID NO: 369996 - RNA, 18 nt, Human
cccaggcuggggugcagu

SEQ ID NO: 369997 - RNA, 19 nt, Human
cccaggcuggggugcagug

SEQ ID NO: 369998 - RNA, 20 nt, Human
cccaggcuggggugcagugg

SEQ ID NO: 369999 - RNA, 21 nt, Human
cccaggcuggggugcaguggc

SEQ ID NO: 370000 - RNA, 23 nt, Human
cccaggcuggggugcaguggcgu

SEQ ID NO: 370001 - RNA, 21 nt, Human
cccaggcuggucucaaacucc

SEQ ID NO: 370002 - RNA, 32 nt, Human
cccaggcuggucucaaacuccugggcucaagc

SEQ ID NO: 370003 - RNA, 32 nt, Human
cccaggcuggucucaaacuccugggcucaagu

SEQ ID NO: 370004 - RNA, 32 nt, Human
cccaggcuggucucaaacuccugggcucaggc

SEQ ID NO: 370005 - RNA, 32 nt, Human
cccaggcuggucucaaauuccugggcccaaac

SEQ ID NO: 370006 - RNA, 32 nt, Human
cccaggcuggucucaaccuccugggcucaagc

SEQ ID NO: 370007 - RNA, 20 nt, Human
cccaggcuggucucaacucc

SEQ ID NO: 370008 - RNA, 32 nt, Human
cccaggcuggucucaggcuccugggcucagau

SEQ ID NO: 370009 - RNA, 32 nt, Human
cccaggcuggucuccaacuccugggcucaagc

SEQ ID NO: 370010 - RNA, 32 nt, Human
cccaggcuggucucgaacuccugggcucaagc

SEQ ID NO: 370011 - RNA, 32 nt, Human
cccaggcuggucucgaacuccugggcucaagu

SEQ ID NO: 370012 - RNA, 32 nt, Human
cccaggcuggucucgaacuccugggcucgggu

SEQ ID NO: 370013 - RNA, 32 nt, Human
cccaggcuggucuuaaacuccugggcucaagu

SEQ ID NO: 370014 - RNA, 32 nt, Human
cccaggcuggucuugaacuccugggccaugcc

SEQ ID NO: 370015 - RNA, 32 nt, Human
cccaggcuggucuugaacuccugggcucaagc

SEQ ID NO: 370016 - RNA, 32 nt, Human
cccaggcuggucuugaacuccugggcucaugc

SEQ ID NO: 370017 - RNA, 32 nt, Human
cccaggcuggucuugaacuccugggcuccagu

SEQ ID NO: 370018 - RNA, 32 nt, Human
cccaggcuggugagcaggagauuuugcucuug

SEQ ID NO: 370019 - RNA, 19 nt, Human
cccaggcuggugugcaaug

SEQ ID NO: 370020 - RNA, 24 nt, Human
cccaggcugguguggaacuccuga

SEQ ID NO: 370021 - RNA, 32 nt, Human
cccaggcugguguggacacaaggaagccccgc

SEQ ID NO: 370022 - RNA, 32 nt, Human
cccaggcugguuucaaccuccuggccucaagu

SEQ ID NO: 370023 - RNA, 32 nt, Human
cccaggcuguaguacaguggugccaucucagc

SEQ ID NO: 370024 - RNA, 19 nt, Human
cccaggcuguagugcaaug

SEQ ID NO: 370025 - RNA, 20 nt, Human
cccaggcuguagugcaaugg

SEQ ID NO: 370026 - RNA, 20 nt, Human
cccaggcuguagugcagugg

SEQ ID NO: 370027 - RNA, 21 nt, Human
cccaggcuguagugcaguggc

SEQ ID NO: 370028 - RNA, 20 nt, Human
cccaggcuguaguggagugg

SEQ ID NO: 370029 - RNA, 23 nt, Human
cccaggcuguaguggaguggugu

SEQ ID NO: 370030 - RNA, 19 nt, Human
cccaggcugucgggccaug

SEQ ID NO: 370031 - RNA, 32 nt, Human
cccaggcugugagcuccuugggggcaggcccu

SEQ ID NO: 370032 - RNA, 32 nt, Human
cccaggcugugcaaggccagcacacagacaua

SEQ ID NO: 370033 - RNA, 22 nt, Human
cccaggcugugccccaccacag

SEQ ID NO: 370034 - RNA, 32 nt, Human
cccaggcuguucucaaacuccugggcugaagu

SEQ ID NO: 370035 - RNA, 32 nt, Human
cccaggcuguucuucaacuccugggcucaagc

SEQ ID NO: 370036 - RNA, 32 nt, Human
cccaggcuuaucuggaacuccugggcucaaga

SEQ ID NO: 370037 - RNA, 32 nt, Human
cccaggcuucauuacacaggcuuuucauguau

SEQ ID NO: 370038 - RNA, 32 nt, Human
cccaggcuuccccucuauccagccuggccucu

SEQ ID NO: 370039 - RNA, 24 nt, Human
cccaggcuucgugcuccccacccu

SEQ ID NO: 370040 - RNA, 32 nt, Human
cccaggcuucuguugucccuugccugccugua

SEQ ID NO: 370041 - RNA, 19 nt, Human
cccaggcuugagugcaaug

SEQ ID NO: 370042 - RNA, 20 nt, Human
cccaggcuugagugcaauga

SEQ ID NO: 370043 - RNA, 19 nt, Human
cccaggcuugagugcagug

SEQ ID NO: 370044 - RNA, 20 nt, Human
cccaggcuugagugcaguga

SEQ ID NO: 370045 - RNA, 20 nt, Human
cccaggcuugagugcagugg

SEQ ID NO: 370046 - RNA, 22 nt, Human
cccaggcuugagugcaguggug

SEQ ID NO: 370047 - RNA, 23 nt, Human
cccaggcuugcagaauaaagcca

SEQ ID NO: 370048 - RNA, 20 nt, Human
cccaggcuuggccucccagg

SEQ ID NO: 370049 - RNA, 18 nt, Human
cccaggcuugggagccag

SEQ ID NO: 370050 - RNA, 25 nt, Human
cccaggcuuucucucccacuucccu

SEQ ID NO: 370051 - RNA, 32 nt, Human
cccaggcuuugcagaaaccacacacacuguug

SEQ ID NO: 370052 - RNA, 32 nt, Human
cccaggcuuugucccaggcuuucuggugugug

SEQ ID NO: 370053 - RNA, 32 nt, Human
cccaggcuuuuaaaaacuuucaucuaggccac

SEQ ID NO: 370054 - RNA, 32 nt, Human
cccaggcuuuuacaaccuggugcucagcuucc

SEQ ID NO: 370055 - RNA, 21 nt, Human
cccagggaaaagcccagagaa

SEQ ID NO: 370056 - RNA, 32 nt, Human
cccagggaaaggacaaggcugagagaauucca

SEQ ID NO: 370057 - RNA, 18 nt, Human
cccagggaagaaacggaa

SEQ ID NO: 370058 - RNA, 32 nt, Human
cccagggaagcagagugcaagagcagaagagc

SEQ ID NO: 370059 - RNA, 19 nt, Human
cccagggaagccugaggug

SEQ ID NO: 370060 - RNA, 32 nt, Human
cccagggaagucccuucuccaaagucagggcc

SEQ ID NO: 370061 - RNA, 32 nt, Human
cccagggaagugguugaccccuccgguggccg

SEQ ID NO: 370062 - RNA, 32 nt, Human
cccagggaaguguccuuucuuucccuuccuua

SEQ ID NO: 370063 - RNA, 24 nt, Human
cccagggaauccucuggaccauca

SEQ ID NO: 370064 - RNA, 32 nt, Human
cccagggaauuuucacccucucaguccucagg

SEQ ID NO: 370065 - RNA, 21 nt, Human
cccagggacacuccuuccauc

SEQ ID NO: 370066 - RNA, 32 nt, Human
cccagggacccaguguacccagccucuggccu

SEQ ID NO: 370067 - RNA, 32 nt, Human
cccagggacccccaucaccagcucuccagcgg

SEQ ID NO: 370068 - RNA, 32 nt, Human
cccagggacccugggacgaggcugcagaagcu

SEQ ID NO: 370069 - RNA, 32 nt, Human
cccagggacucacaguucagugcaguggguga

SEQ ID NO: 370070 - RNA, 32 nt, Human
cccagggacucagagcagcaucuucuuaggag

SEQ ID NO: 370071 - RNA, 32 nt, Human
cccagggacucaggcuggaauagaguggacug

SEQ ID NO: 370072 - RNA, 19 nt, Human
cccagggagaaagcauguc

SEQ ID NO: 370073 - RNA, 18 nt, Human
cccagggagaggagccag

SEQ ID NO: 370074 - RNA, 32 nt, Human
cccagggagagggacagacagccggcugcaug

SEQ ID NO: 370075 - RNA, 32 nt, Human
cccagggagagggggcuggugggugccuaggc

SEQ ID NO: 370076 - RNA, 25 nt, Human
cccagggagauggagguugcaggga

SEQ ID NO: 370077 - RNA, 32 nt, Human
cccagggagccccagcccaagauggccagccu

SEQ ID NO: 370078 - RNA, 32 nt, Human
cccagggagccgggguuaggaacucacuuggg

SEQ ID NO: 370079 - RNA, 32 nt, Human
cccagggaggacccagaccuccacacuccaug

SEQ ID NO: 370080 - RNA, 16 nt, Human
cccagggaggagccgg

SEQ ID NO: 370081 - RNA, 16 nt, Human
cccagggaggagucag

SEQ ID NO: 370082 - RNA, 23 nt, Human
cccagggaggcagagguugcugu

SEQ ID NO: 370083 - RNA, 25 nt, Human
cccagggaggcagagguugcuguaa

SEQ ID NO: 370084 - RNA, 32 nt, Human
cccagggaggcagagguugcuguaaguugaga

SEQ ID NO: 370085 - RNA, 32 nt, Human
cccagggaggccgaagcuaacagggaaggcag

SEQ ID NO: 370086 - RNA, 32 nt, Human
cccagggaggcugaguccugccaggaucauuc

SEQ ID NO: 370087 - RNA, 32 nt, Human
cccagggaggggcaggccgggcggccgacgcc

SEQ ID NO: 370088 - RNA, 32 nt, Human
cccagggagggugggagcuggagggggauguc

SEQ ID NO: 370089 - RNA, 32 nt, Human
cccagggagguagaggcuucagugagcugaga

SEQ ID NO: 370090 - RNA, 32 nt, Human
cccagggaggucaaggcugcagugagcaauga

SEQ ID NO: 370091 - RNA, 32 nt, Human
cccagggaggucgaugcugcagugagcuaugg

SEQ ID NO: 370092 - RNA, 25 nt, Human
cccagggagguugaggcugcaguga

SEQ ID NO: 370093 - RNA, 25 nt, Human
cccagggaguagcagccaggcccuu

SEQ ID NO: 370094 - RNA, 25 nt, Human
cccagggagucaaaggcuguaguga

SEQ ID NO: 370095 - RNA, 20 nt, Human
cccagggagugcagagccag

SEQ ID NO: 370096 - RNA, 32 nt, Human
cccagggaucagugucauuuagggaugugacu

SEQ ID NO: 370097 - RNA, 25 nt, Human
cccagggaugcaaagguugcaguga

SEQ ID NO: 370098 - RNA, 32 nt, Human
cccagggaugcaaagguugcagugaguugagu

SEQ ID NO: 370099 - RNA, 32 nt, Human
cccagggaugccacccuuucgucaccucuucc

SEQ ID NO: 370100 - RNA, 32 nt, Human
cccagggaugggaggcggaggguagagaugaa

SEQ ID NO: 370101 - RNA, 31 nt, Human
cccagggaugguggugcacacuuguaguccc

SEQ ID NO: 370102 - RNA, 32 nt, Human
cccagggauguggccuuggagaaggaccacug

SEQ ID NO: 370103 - RNA, 26 nt, Human
cccagggauguuugaggcugcaguga

SEQ ID NO: 370104 - RNA, 32 nt, Human
cccagggauugcaggccugggcgccgggguug

SEQ ID NO: 370105 - RNA, 19 nt, Human
cccagggauuggaaacgga

SEQ ID NO: 370106 - RNA, 20 nt, Human
cccagggcaaugugguggga

SEQ ID NO: 370107 - RNA, 32 nt, Human
cccagggcacccaaaccucccuucccuuucgu

SEQ ID NO: 370108 - RNA, 32 nt, Human
cccagggcacuacauaauugcuguucugcuga

SEQ ID NO: 370109 - RNA, 32 nt, Human
cccagggcagagcacaacucagccucccaggc

SEQ ID NO: 370110 - RNA, 32 nt, Human
cccagggcagcaucuacugaucacugaccagu

SEQ ID NO: 370111 - RNA, 18 nt, Human
cccagggcagccagcuca

SEQ ID NO: 370112 - RNA, 21 nt, Human
cccagggcagccgaggccagc

SEQ ID NO: 370113 - RNA, 32 nt, Human
cccagggcagccgccccgccgagucgcagugu

SEQ ID NO: 370114 - RNA, 32 nt, Human
cccagggcaguggcuuuccugaggcagcagcc

SEQ ID NO: 370115 - RNA, 20 nt, Human
cccagggcagugugguggga

SEQ ID NO: 370116 - RNA, 32 nt, Human
cccagggcaugcagagguugcaccuagagacg

SEQ ID NO: 370117 - RNA, 32 nt, Human
cccagggcaugcuggggcccuaccagcagcug

SEQ ID NO: 370118 - RNA, 32 nt, Human
cccagggccaacucccccugccggcccucugc

SEQ ID NO: 370119 - RNA, 32 nt, Human
cccagggccacccugcccugagguccuugugu

SEQ ID NO: 370120 - RNA, 32 nt, Human
cccagggccacucugccucugccugcauucug

SEQ ID NO: 370121 - RNA, 20 nt, Human
cccagggccacuggucagga

SEQ ID NO: 370122 - RNA, 22 nt, Human
cccagggccagacccuggcugg

SEQ ID NO: 370123 - RNA, 32 nt, Human
cccagggccagccuggcacucagcccuucgag

SEQ ID NO: 370124 - RNA, 32 nt, Human
cccagggccagccugggucacgagaugcuguc

SEQ ID NO: 370125 - RNA, 21 nt, Human
cccagggccagcuuuuccuca

SEQ ID NO: 370126 - RNA, 32 nt, Human
cccagggccaggcagacuggggcagugacugg

SEQ ID NO: 370127 - RNA, 32 nt, Human
cccagggccaggcagucgugguugcagaagga

SEQ ID NO: 370128 - RNA, 32 nt, Human
cccagggccauggcgaacccgaagcugcuggg

SEQ ID NO: 370129 - RNA, 21 nt, Human
cccagggcccaaggaggagaa

SEQ ID NO: 370130 - RNA, 28 nt, Human
cccagggcccacccccacccgccugccu

SEQ ID NO: 370131 - RNA, 20 nt, Human
cccagggcccaccuuucggg

SEQ ID NO: 370132 - RNA, 22 nt, Human
cccagggcccacgucgguggga

SEQ ID NO: 370133 - RNA, 21 nt, Human
cccagggcccagauugaggga

SEQ ID NO: 370134 - RNA, 22 nt, Human
cccagggcccagauugagggaa

SEQ ID NO: 370135 - RNA, 22 nt, Human
cccagggcccagcaagauggga

SEQ ID NO: 370136 - RNA, 22 nt, Human
cccagggcccagcuucccagga

SEQ ID NO: 370137 - RNA, 23 nt, Human
cccagggcccagcuucccaggag

SEQ ID NO: 370138 - RNA, 32 nt, Human
cccagggcccagcuuuggccuuagcuugacgg

SEQ ID NO: 370139 - RNA, 27 nt, Human
cccagggcccaggccgugugguuggga

SEQ ID NO: 370140 - RNA, 28 nt, Human
cccagggcccaggccgugugguugggaa

SEQ ID NO: 370141 - RNA, 23 nt, Human
cccagggcccaggccugucuggg

SEQ ID NO: 370142 - RNA, 23 nt, Human
cccagggcccauagacagcuggg

SEQ ID NO: 370143 - RNA, 28 nt, Human
cccagggccccaccccauccuccugccu

SEQ ID NO: 370144 - RNA, 22 nt, Human
cccagggccccaggggcgggga

SEQ ID NO: 370145 - RNA, 23 nt, Human
cccagggccccaggggcggggaa

SEQ ID NO: 370146 - RNA, 21 nt, Human
cccagggccccccagcuuaga

SEQ ID NO: 370147 - RNA, 22 nt, Human
cccagggccccccagcuuagaa

SEQ ID NO: 370148 - RNA, 23 nt, Human
cccagggccccggaagcugcgga

SEQ ID NO: 370149 - RNA, 23 nt, Human
cccagggcccgcaggaggcuggg

SEQ ID NO: 370150 - RNA, 32 nt, Human
cccagggcccggcuggagugacaggcucccug

SEQ ID NO: 370151 - RNA, 32 nt, Human
cccagggcccugccucggguccugggccugcu

SEQ ID NO: 370152 - RNA, 23 nt, Human
cccagggcccuggccagccggga

SEQ ID NO: 370153 - RNA, 24 nt, Human
cccagggcccuggccagccgggag

SEQ ID NO: 370154 - RNA, 24 nt, Human
cccagggcccuggggggagggauc

SEQ ID NO: 370155 - RNA, 22 nt, Human
cccagggcccugucuccugccu

SEQ ID NO: 370156 - RNA, 22 nt, Human
cccagggccgccgugagcggga

SEQ ID NO: 370157 - RNA, 21 nt, Human
cccagggccgcugagccgggg

SEQ ID NO: 370158 - RNA, 32 nt, Human
cccagggccgcugcucccucaguugccgccgc

SEQ ID NO: 370159 - RNA, 20 nt, Human
cccagggccuccaaguggga

SEQ ID NO: 370160 - RNA, 21 nt, Human
cccagggccuccuugcuccuu

SEQ ID NO: 370161 - RNA, 23 nt, Human
cccagggccucucucuagcuggg

SEQ ID NO: 370162 - RNA, 21 nt, Human
cccagggccugagccuggcca

SEQ ID NO: 370163 - RNA, 19 nt, Human
cccagggccugagcuaugg

SEQ ID NO: 370164 - RNA, 32 nt, Human
cccagggccugagcucucuuccccagcauugc

SEQ ID NO: 370165 - RNA, 32 nt, Human
cccagggccuggccuucucucccagcagccug

SEQ ID NO: 370166 - RNA, 21 nt, Human
cccagggccuggcugacaugg

SEQ ID NO: 370167 - RNA, 18 nt, Human
cccagggccugggccaug

SEQ ID NO: 370168 - RNA, 32 nt, Human
cccagggccugucucaagcucuuccuuacucc

SEQ ID NO: 370169 - RNA, 32 nt, Human
cccagggccugucuucucaaccccucaccuuu

SEQ ID NO: 370170 - RNA, 32 nt, Human
cccagggccugucuugucaaccccucaccuuu

SEQ ID NO: 370171 - RNA, 28 nt, Human
cccagggccuuccauuuacccccugccu

SEQ ID NO: 370172 - RNA, 32 nt, Human
cccagggccuucgcucccucagcacuggggug

SEQ ID NO: 370173 - RNA, 27 nt, Human
cccagggccuuuccuucaccuccugcc

SEQ ID NO: 370174 - RNA, 22 nt, Human
cccagggcgccauggcugagga

SEQ ID NO: 370175 - RNA, 23 nt, Human
cccagggcgccauggcugaggaa

SEQ ID NO: 370176 - RNA, 23 nt, Human
cccagggcgccgggcggccggga

SEQ ID NO: 370177 - RNA, 32 nt, Human
cccagggcgucagcacccagcacugccacaug

SEQ ID NO: 370178 - RNA, 19 nt, Human
cccagggcuacagccugug

SEQ ID NO: 370179 - RNA, 26 nt, Human
cccagggcuauuuuuaccucccgccu

SEQ ID NO: 370180 - RNA, 32 nt, Human
cccagggcucacccagauucagagguggggaa

SEQ ID NO: 370181 - RNA, 32 nt, Human
cccagggcucagagcagaggccagaaccacug

SEQ ID NO: 370182 - RNA, 28 nt, Human
cccagggcucagcuucugccuccugucu

SEQ ID NO: 370183 - RNA, 32 nt, Human
cccagggcuccacucucaucuaaugucacagc

SEQ ID NO: 370184 - RNA, 32 nt, Human
cccagggcuccagugggcucugccacuggaca

SEQ ID NO: 370185 - RNA, 32 nt, Human
cccagggcuccaucuccgccucaggggcuucu

SEQ ID NO: 370186 - RNA, 21 nt, Human
cccagggcucccccacccagg

SEQ ID NO: 370187 - RNA, 32 nt, Human
cccagggcucccugggagauccugguuuguac

SEQ ID NO: 370188 - RNA, 17 nt, Human
cccagggcucugcccca

SEQ ID NO: 370189 - RNA, 22 nt, Human
cccagggcucugcuuccugccu

SEQ ID NO: 370190 - RNA, 31 nt, Human
cccagggcucuuuucucuaugccaaguugcc

SEQ ID NO: 370191 - RNA, 32 nt, Human
cccagggcugcugcucauccugggcaagcuga

SEQ ID NO: 370192 - RNA, 21 nt, Human
cccagggcugcugugauagga

SEQ ID NO: 370193 - RNA, 22 nt, Human
cccagggcugcugugauaggaa

SEQ ID NO: 370194 - RNA, 19 nt, Human
cccagggcuggagugcagu

SEQ ID NO: 370195 - RNA, 20 nt, Human
cccagggcuggagugcagug

SEQ ID NO: 370196 - RNA, 21 nt, Human
cccagggcuggagugcagugg

SEQ ID NO: 370197 - RNA, 32 nt, Human
cccagggcuggcccuagccacaaaggaacuuu

SEQ ID NO: 370198 - RNA, 32 nt, Human
cccagggcugggacugggcaugagguggucac

SEQ ID NO: 370199 - RNA, 32 nt, Human
cccccaucaccuucucaacugggaaaccccug

SEQ ID NO: 370200 - RNA, 20 nt, Human
cccccaucacugcuuucucc

SEQ ID NO: 370201 - RNA, 18 nt, Human
cccccaucaucccucucc

SEQ ID NO: 370202 - RNA, 17 nt, Human
cccccauccagccucca

SEQ ID NO: 370203 - RNA, 32 nt, Human
cccccaucccagguuguggaggcucgaggaag

SEQ ID NO: 370204 - RNA, 22 nt, Human
cccccauccccccgguuuccuc

SEQ ID NO: 370205 - RNA, 32 nt, Human
cccccauccccgcugugaacgugccacugaau

SEQ ID NO: 370206 - RNA, 32 nt, Human
cccccaucccucccagugcuggcuccaggcuc

SEQ ID NO: 370207 - RNA, 32 nt, Human
cccccaucccuggggaggcucccaccaucucg

SEQ ID NO: 370208 - RNA, 24 nt, Human
cccccauccucacacccacucauc

SEQ ID NO: 370209 - RNA, 32 nt, Human
cccccauccucaccaugucuucgacucaggac

SEQ ID NO: 370210 - RNA, 32 nt, Human
cccccauccucuuccuccucucgcugccagac

SEQ ID NO: 370211 - RNA, 18 nt, Human
cccccauccugcagcugg

SEQ ID NO: 370212 - RNA, 20 nt, Human
cccccauccugucugucucc

SEQ ID NO: 370213 - RNA, 20 nt, Human
cccccaucuccacuuccucc

SEQ ID NO: 370214 - RNA, 32 nt, Human
cccccaucucccccucuccaucuccucugucu

SEQ ID NO: 370215 - RNA, 32 nt, Human
cccccaucuccucuucuagcccaugcccuucc

SEQ ID NO: 370216 - RNA, 19 nt, Human
cccccaucuccugcuuuca

SEQ ID NO: 370217 - RNA, 32 nt, Human
cccccaucucuaggacagccccagccuuguca

SEQ ID NO: 370218 - RNA, 32 nt, Human
cccccaucucucaggcgcgauggcuacgggcg

SEQ ID NO: 370219 - RNA, 32 nt, Human
cccccaucugccacagggcagggguggggcaa

SEQ ID NO: 370220 - RNA, 32 nt, Human
cccccaucuucgggaccaggauuugcacagaa

SEQ ID NO: 370221 - RNA, 20 nt, Human
cccccaucuugucugucucc

SEQ ID NO: 370222 - RNA, 18 nt, Human
cccccaugaaaugccaua

SEQ ID NO: 370223 - RNA, 32 nt, Human
cccccaugaaguacuucaagggccaagcugcc

SEQ ID NO: 370224 - RNA, 32 nt, Human
cccccaugagagaaggaggggagcaggcccgu

SEQ ID NO: 370225 - RNA, 32 nt, Human
cccccaugagagcccuuucuuuucaaugggcu

SEQ ID NO: 370226 - RNA, 23 nt, Human
cccccaugaugaaguccaccuuu

SEQ ID NO: 370227 - RNA, 23 nt, Human
cccccaugaugaccuugagccuc

SEQ ID NO: 370228 - RNA, 21 nt, Human
cccccaugauucaauuaccuc

SEQ ID NO: 370229 - RNA, 32 nt, Human
cccccaugcacaccccugccgcucaugcgcgg

SEQ ID NO: 370230 - RNA, 20 nt, Human
cccccaugcaccccacccuc

SEQ ID NO: 370231 - RNA, 23 nt, Human
cccccaugcauggagcugccaca

SEQ ID NO: 370232 - RNA, 32 nt, Human
cccccaugccaccacccaccccaaacuuccag

SEQ ID NO: 370233 - RNA, 32 nt, Human
cccccaugcccacccuccugccuggaucccaa

SEQ ID NO: 370234 - RNA, 32 nt, Human
cccccaugcccagguguggugaagugaauccc

SEQ ID NO: 370235 - RNA, 23 nt, Human
cccccaugcccccaugccccucu

SEQ ID NO: 370236 - RNA, 19 nt, Human
cccccaugcccugccuacc

SEQ ID NO: 370237 - RNA, 23 nt, Human
cccccaugccugccccuuccccu

SEQ ID NO: 370238 - RNA, 20 nt, Human
cccccaugcucuugugccuu

SEQ ID NO: 370239 - RNA, 22 nt, Human
cccccaugcuggagugcagugg

SEQ ID NO: 370240 - RNA, 32 nt, Human
cccccaugcuguucuugugagaguucucauga

SEQ ID NO: 370241 - RNA, 32 nt, Human
cccccauggagcugaugaggccgagugucagg

SEQ ID NO: 370242 - RNA, 30 nt, Human
cccccauggaggaggaggagggggcggugg

SEQ ID NO: 370243 - RNA, 18 nt, Human
cccccauggaggaggcau

SEQ ID NO: 370244 - RNA, 32 nt, Human
cccccauggaguuuggugugcuugccuuuggc

SEQ ID NO: 370245 - RNA, 17 nt, Human
cccccauggcagagaca

SEQ ID NO: 370246 - RNA, 22 nt, Human
cccccauggcagagacacugca

SEQ ID NO: 370247 - RNA, 32 nt, Human
cccccauggcaggguacacucuccccacagcc

SEQ ID NO: 370248 - RNA, 32 nt, Human
cccccauggcagugcugccucuuguaggugcu

SEQ ID NO: 370249 - RNA, 17 nt, Human
cccccauggcugacaua

SEQ ID NO: 370250 - RNA, 20 nt, Human
cccccaugggacuugaaaua

SEQ ID NO: 370251 - RNA, 16 nt, Human
cccccauguguauaca

SEQ ID NO: 370252 - RNA, 32 nt, Human
cccccauguugcauaucagggugcucaaggau

SEQ ID NO: 370253 - RNA, 19 nt, Human
cccccauuaucccuccuca

SEQ ID NO: 370254 - RNA, 32 nt, Human
cccccauuaugccaccuccaaaguggcugccc

SEQ ID NO: 370255 - RNA, 32 nt, Human
cccccauucacuagaagcacugagagaugcgg

SEQ ID NO: 370256 - RNA, 32 nt, Human
cccccauucccaaguucucucuuuuaucccag

SEQ ID NO: 370257 - RNA, 32 nt, Human
cccccauuccccagccucugcugguagcaugu

SEQ ID NO: 370258 - RNA, 32 nt, Human
cccccauucccugagaauccuguuguuaguaa

SEQ ID NO: 370259 - RNA, 32 nt, Human
cccccauucccugguguccuucuuagagauga

SEQ ID NO: 370260 - RNA, 32 nt, Human
cccccauuccuucauucuagagcuagagugaa

SEQ ID NO: 370261 - RNA, 32 nt, Human
cccccauucgcaugucuucugccuggcaacac

SEQ ID NO: 370262 - RNA, 20 nt, Human
cccccauugaggacaacagc

SEQ ID NO: 370263 - RNA, 32 nt, Human
cccccauugcagcccccacccuguggguaguc

SEQ ID NO: 370264 - RNA, 29 nt, Human
cccccauugucuuuggugccugggcuucc

SEQ ID NO: 370265 - RNA, 23 nt, Human
cccccauuguuagaugaggucuu

SEQ ID NO: 370266 - RNA, 20 nt, Human
ccccccaagcuauuugcuca

SEQ ID NO: 370267 - RNA, 22 nt, Human
ccccccacacccacagcuugcu

SEQ ID NO: 370268 - RNA, 21 nt, Human
ccccccaccccaggcccugcc

SEQ ID NO: 370269 - RNA, 18 nt, Human
ccccccaccccgaucccc

SEQ ID NO: 370270 - RNA, 18 nt, Human
ccccccacccugccagcc

SEQ ID NO: 370271 - RNA, 16 nt, Human
ccccccaccucggguc

SEQ ID NO: 370272 - RNA, 23 nt, Human
ccccccagacccccaggagugga

SEQ ID NO: 370273 - RNA, 19 nt, Human
ccccccagaucuggugccu

SEQ ID NO: 370274 - RNA, 18 nt, Human
ccccccaucccaagggga

SEQ ID NO: 370275 - RNA, 24 nt, Human
ccccccgccccccgcaaaaaagua

SEQ ID NO: 370276 - RNA, 17 nt, Human
ccccccgcccccucccu

SEQ ID NO: 370277 - RNA, 23 nt, Human
ccccccggcccgacuccgcuggu

SEQ ID NO: 370278 - RNA, 21 nt, Human
ccccccggccguggaugcugc

SEQ ID NO: 370279 - RNA, 20 nt, Human
ccccccggcuucucgcgccu

SEQ ID NO: 370280 - RNA, 22 nt, Human
ccccccggcuucucgcgccuca

SEQ ID NO: 370281 - RNA, 23 nt, Human
ccccccgguaccgcagauccccg

SEQ ID NO: 370282 - RNA, 22 nt, Human
ccccccuccuccuccuccucug

SEQ ID NO: 370283 - RNA, 18 nt, Human
ccccccuccuuccucccu

SEQ ID NO: 370284 - RNA, 23 nt, Human
ccccccucuaggagagcuggcuc

SEQ ID NO: 370285 - RNA, 17 nt, Human
ccccccugauccucccu

SEQ ID NO: 370286 - RNA, 22 nt, Human
ccccccuucagcccccacccca

SEQ ID NO: 370287 - RNA, 15 nt, Human
ccccccuuccaggug

SEQ ID NO: 370288 - RNA, 15 nt, Human
ccccccuuccgccca

SEQ ID NO: 370289 - RNA, 20 nt, Human
ccccccuucucaccuccuca

SEQ ID NO: 370290 - RNA, 20 nt, Human
ccccccuuuccccggaugcu

SEQ ID NO: 370291 - RNA, 24 nt, Human
ccccccuuucccuggagcaccugc

SEQ ID NO: 370292 - RNA, 32 nt, Human
cccccgaaaccugggcuggagugagguggaag

SEQ ID NO: 370293 - RNA, 32 nt, Human
cccccgaagggaggggaggccaggaggggagc

SEQ ID NO: 370294 - RNA, 32 nt, Human
cccccgaaguucuggcucggggcacagggcac

SEQ ID NO: 370295 - RNA, 32 nt, Human
cccccgacaccaggaggagggccaggagaguu

SEQ ID NO: 370296 - RNA, 32 nt, Human
cccccgacauccugccucuacacugcaccauc

SEQ ID NO: 370297 - RNA, 32 nt, Human
cccccgacaugccucuuccccuuggcaagcuc

SEQ ID NO: 370298 - RNA, 24 nt, Human
cccccgaccaaaccccaagaccug

SEQ ID NO: 370299 - RNA, 32 nt, Human
cccccgaccacacaaacccagccuggggagga

SEQ ID NO: 370300 - RNA, 32 nt, Human
cccccgaccaccuccuccucugccucaaagac

SEQ ID NO: 370301 - RNA, 32 nt, Human
cccccgaccagccucgggccaggcuagggcgu

SEQ ID NO: 370302 - RNA, 20 nt, Human
cccccgaccccaccccggga

SEQ ID NO: 370303 - RNA, 32 nt, Human
cccccgaccgcacuccagccugggcgacagag

SEQ ID NO: 370304 - RNA, 19 nt, Human
cccccgacucacucagacc

SEQ ID NO: 370305 - RNA, 21 nt, Human
cccccgacucccuggagcuug

SEQ ID NO: 370306 - RNA, 24 nt, Human
cccccgacugccacucuggaccua

SEQ ID NO: 370307 - RNA, 32 nt, Human
cccccgacugugcugcucgcgaaggucccaca

SEQ ID NO: 370308 - RNA, 23 nt, Human
cccccgacuucacacggcggcuu

SEQ ID NO: 370309 - RNA, 20 nt, Human
cccccgacuucgccgacucc

SEQ ID NO: 370310 - RNA, 32 nt, Human
cccccgagaccacccccacccuggggaagcgu

SEQ ID NO: 370311 - RNA, 21 nt, Human
cccccgagaugagcagaucca

SEQ ID NO: 370312 - RNA, 32 nt, Human
cccccgagcauggcagaggccuggcuuugcaa

SEQ ID NO: 370313 - RNA, 32 nt, Human
cccccgagcccgcggcacaggcggcggcggcg

SEQ ID NO: 370314 - RNA, 32 nt, Human
cccccgaggaaggggucgaggagaagcuuggu

SEQ ID NO: 370315 - RNA, 32 nt, Human
cccccgaggaggaggaggaggacgcgggccug

SEQ ID NO: 370316 - RNA, 32 nt, Human
cccccgaggaggaggaggaggaggaggacgcg

SEQ ID NO: 370317 - RNA, 21 nt, Human
cccccgaucccuccgggucua

SEQ ID NO: 370318 - RNA, 32 nt, Human
cccccgaugccaccacagccaucgccacugcc

SEQ ID NO: 370319 - RNA, 22 nt, Human
cccccgauuucccggcgggauc

SEQ ID NO: 370320 - RNA, 32 nt, Human
cccccgcaagccccagccccgaggaccgucca

SEQ ID NO: 370321 - RNA, 32 nt, Human
cccccgcacucccacagggcucagggugggcu

SEQ ID NO: 370322 - RNA, 32 nt, Human
cccccgcagccccugcugucaccccugcacag

SEQ ID NO: 370323 - RNA, 19 nt, Human
cccccgcaggccaccaggc

SEQ ID NO: 370324 - RNA, 32 nt, Human
cccccgcagucagccucuccuugaguguccuu

SEQ ID NO: 370325 - RNA, 32 nt, Human
cccccgccaccuguacucacccucacgcucuu

SEQ ID NO: 370326 - RNA, 32 nt, Human
cccccgccacgaagguugagaacaaagccagg

SEQ ID NO: 370327 - RNA, 32 nt, Human
cccccgccagcauucuggaugucagaggaggg

SEQ ID NO: 370328 - RNA, 20 nt, Human
cccccgcccagccccugccc

SEQ ID NO: 370329 - RNA, 32 nt, Human
cccccgccccacuccagccaguguagggagcu

SEQ ID NO: 370330 - RNA, 21 nt, Human
cccccgccccacucccggggc

SEQ ID NO: 370331 - RNA, 32 nt, Human
cccccgccccagagaaacacacagagcuguuc

SEQ ID NO: 370332 - RNA, 21 nt, Human
cccccgccccaggcccuuccc

SEQ ID NO: 370333 - RNA, 32 nt, Human
cccccgccccucucuucccuggcuggacuugc

SEQ ID NO: 370334 - RNA, 32 nt, Human
cccccgcccgcacuccagagccggcugagaac

SEQ ID NO: 370335 - RNA, 32 nt, Human
cccccgcccucccacccgcucagaccugguug

SEQ ID NO: 370336 - RNA, 18 nt, Human
cccccgcccuccgggaaa

SEQ ID NO: 370337 - RNA, 32 nt, Human
cccccgcccucggggugcgaggcggcagcagg

SEQ ID NO: 370338 - RNA, 32 nt, Human
cccccgccgcugccauggcggcagcuccgccg

SEQ ID NO: 370339 - RNA, 32 nt, Human
cccccgccuaaaggggguacugagccuccugu

SEQ ID NO: 370340 - RNA, 32 nt, Human
cccccgccuccaccacuuuccaccaucagcug

SEQ ID NO: 370341 - RNA, 32 nt, Human
cccccgccuccaggcugggccuggccuauuua

SEQ ID NO: 370342 - RNA, 32 nt, Human
cccccgccuccuccuccccauuuccgggcucc

SEQ ID NO: 370343 - RNA, 32 nt, Human
cccccgccucuucagcaagaccacagccauga

SEQ ID NO: 370344 - RNA, 32 nt, Human
cccccgccugcugugcacccagcuccaguguc

SEQ ID NO: 370345 - RNA, 32 nt, Human
cccccgccuuucuucccuccgcgacccgggcc

SEQ ID NO: 370346 - RNA, 22 nt, Human
cccccgcgagccccagcgcccu

SEQ ID NO: 370347 - RNA, 32 nt, Human
cccccgcgccagcccagccccagccugagugc

SEQ ID NO: 370348 - RNA, 32 nt, Human
cccccgcgcccagccaucaaaaugcuuuuuau

SEQ ID NO: 370349 - RNA, 21 nt, Human
cccccgcgcccuccucggggc

SEQ ID NO: 370350 - RNA, 23 nt, Human
cccccgcgccuucaggcccaccc

SEQ ID NO: 370351 - RNA, 32 nt, Human
cccccgcggccgcccgggccccggcuggcgag

SEQ ID NO: 370352 - RNA, 21 nt, Human
cccccgcgucgggccccgccc

SEQ ID NO: 370353 - RNA, 32 nt, Human
cccccgcuacacuccagccuggucgacagagu

SEQ ID NO: 370354 - RNA, 32 nt, Human
cccccgcucccagguuccccucuggugucaug

SEQ ID NO: 370355 - RNA, 32 nt, Human
cccccgcuccccaggacuucagagauguugca

SEQ ID NO: 370356 - RNA, 32 nt, Human
cccccgcucgccccuucucucccguccucacc

SEQ ID NO: 370357 - RNA, 32 nt, Human
cccccgcucugccaucagccccugcugcuccu

SEQ ID NO: 370358 - RNA, 32 nt, Human
cccccgcugccgcccgggccccggcugccguc

SEQ ID NO: 370359 - RNA, 32 nt, Human
cccccgcugcucccuugaccucuuguaggaau

SEQ ID NO: 370360 - RNA, 32 nt, Human
cccccgcuggucccucugggcaugcugugcuc

SEQ ID NO: 370361 - RNA, 22 nt, Human
cccccgcuuccuccuagcccug

SEQ ID NO: 370362 - RNA, 32 nt, Human
cccccggaccagugaagcuggagccagggugu

SEQ ID NO: 370363 - RNA, 24 nt, Human
cccccggacgccgcccagcuugcu

SEQ ID NO: 370364 - RNA, 25 nt, Human
cccccggacgccgcccagcuugcuu

SEQ ID NO: 370365 - RNA, 32 nt, Human
cccccggagagucaggcccacagagcaugccc

SEQ ID NO: 370366 - RNA, 32 nt, Human
cccccggaggcuguggccuggugucagggcgg

SEQ ID NO: 370367 - RNA, 32 nt, Human
cccccggaguagcugggaccacaggcacacac

SEQ ID NO: 370368 - RNA, 32 nt, Human
cccccggcaacaaaaguaucuucuugcucccu

SEQ ID NO: 370369 - RNA, 22 nt, Human
cccccggcacgaggccccgccc

SEQ ID NO: 370370 - RNA, 22 nt, Human
cccccggcagccagugcuccuu

SEQ ID NO: 370371 - RNA, 32 nt, Human
cccccggcagcucuuugcaaagcugcuugaaa

SEQ ID NO: 370372 - RNA, 32 nt, Human
cccccggccacugucucggggcccaccucucg

SEQ ID NO: 370373 - RNA, 19 nt, Human
cccccggccagugcugcug

SEQ ID NO: 370374 - RNA, 19 nt, Human
cccccggccaucgcucccu

SEQ ID NO: 370375 - RNA, 21 nt, Human
cccccggcccagcccugcagg

SEQ ID NO: 370376 - RNA, 20 nt, Human
cccccggccccacuccgccc

SEQ ID NO: 370377 - RNA, 23 nt, Human
cccccggcccccaaaaccugccc

SEQ ID NO: 370378 - RNA, 24 nt, Human
cccccggcccuggcuuugggaccu

SEQ ID NO: 370379 - RNA, 20 nt, Human
cccccggccugccugccucu

SEQ ID NO: 370380 - RNA, 32 nt, Human
cccccggccuggguggggagagcgagcugggu

SEQ ID NO: 370381 - RNA, 25 nt, Human
cccccggcgcucacgcucucggggc

SEQ ID NO: 370382 - RNA, 20 nt, Human
cccccggcucuacgggggcc

SEQ ID NO: 370383 - RNA, 32 nt, Human
cccccggcugccacuguuugcugguggucucc

SEQ ID NO: 370384 - RNA, 22 nt, Human
cccccggcugguccggggucug

SEQ ID NO: 370385 - RNA, 27 nt, Human
cccccgggaaagcagagguugcaguga

SEQ ID NO: 370386 - RNA, 28 nt, Human
cccccgggaggugcugccucgucuaccc

SEQ ID NO: 370387 - RNA, 22 nt, Human
cccccgggagucagacuggcuu

SEQ ID NO: 370388 - RNA, 27 nt, Human
cccccgggcaagcggagguugcaguga

SEQ ID NO: 370389 - RNA, 15 nt, Human
cccccgggcggccca

SEQ ID NO: 370390 - RNA, 19 nt, Human
cccccgggcugugcugcug

SEQ ID NO: 370391 - RNA, 27 nt, Human
cccccggggaaaucaagguugcaguga

SEQ ID NO: 370392 - RNA, 27 nt, Human
cccccggggaagcacagauugcaguga

SEQ ID NO: 370393 - RNA, 27 nt, Human
cccccggggaagcagagguuguaguga

SEQ ID NO: 370394 - RNA, 27 nt, Human
cccccggggaagcagaguuugcaguga

SEQ ID NO: 370395 - RNA, 27 nt, Human
cccccggggaagcggagguugcaguga

SEQ ID NO: 370396 - RNA, 22 nt, Human
cccccggggcagcaggagccag

SEQ ID NO: 370397 - RNA, 32 nt, Human
cccccggggccaggagccccuugagcagagcu

SEQ ID NO: 370398 - RNA, 23 nt, Human
cccccggggccauggcccugccc

SEQ ID NO: 370399 - RNA, 27 nt, Human
cccccggguagacagagguugcaguga

SEQ ID NO: 370400 - RNA, 32 nt, Human
cccccgggucaccuuuugccuggucauccugu

SEQ ID NO: 370401 - RNA, 32 nt, Human
cccccggguuccuuccuagaaauguggcagcc

SEQ ID NO: 370402 - RNA, 32 nt, Human
cccccggugcuagccgagaaagcccgaguucc

SEQ ID NO: 370403 - RNA, 32 nt, Human
cccccguaaggagcagaguccuuuguacugac

SEQ ID NO: 370404 - RNA, 32 nt, Human
cccccguagagaagauccuagagcagaaggag

SEQ ID NO: 370405 - RNA, 32 nt, Human
cccccguccacuuacugcgugaccucagccug

SEQ ID NO: 370406 - RNA, 32 nt, Human
cccccgucccacgccaacuuuucagacacagc

SEQ ID NO: 370407 - RNA, 32 nt, Human
cccccguccccucccuuccuuauuuauuccug

SEQ ID NO: 370408 - RNA, 16 nt, Human
cccccgucccugcugg

SEQ ID NO: 370409 - RNA, 32 nt, Human
cccccgucgcauaaccaguuccaucauccugg

SEQ ID NO: 370410 - RNA, 32 nt, Human
cccccgucuccccagccuguugcuuucucgug

SEQ ID NO: 370411 - RNA, 32 nt, Human
cccccgucuccuccccuucuccccuuggugcc

SEQ ID NO: 370412 - RNA, 32 nt, Human
cccccgucucggcccagccucuguauucucca

SEQ ID NO: 370413 - RNA, 32 nt, Human
cccccgucuguggguuucugguccaguguccc

SEQ ID NO: 370414 - RNA, 32 nt, Human
cccccgugcccugcacaaaaaccaccaccagc

SEQ ID NO: 370415 - RNA, 32 nt, Human
cccccgugugggaaguuggugucacuuccccu

SEQ ID NO: 370416 - RNA, 32 nt, Human
cccccguuagcccagauucaaaaggugaacau

SEQ ID NO: 370417 - RNA, 22 nt, Human
cccccguuagcuuccugcagga

SEQ ID NO: 370418 - RNA, 32 nt, Human
cccccguucaagguauagucugccuuuaaggg

SEQ ID NO: 370419 - RNA, 32 nt, Human
cccccguucccacucggggucucccucagggc

SEQ ID NO: 370420 - RNA, 32 nt, Human
cccccuaaaaauacaaaaauuagccgggcgug

SEQ ID NO: 370421 - RNA, 21 nt, Human
cccccuaaggcacuuugggga

SEQ ID NO: 370422 - RNA, 32 nt, Human
cccccuaccagugcaugagacacacaccuacc

SEQ ID NO: 370423 - RNA, 19 nt, Human
cccccuacccacccuggaa

SEQ ID NO: 370424 - RNA, 32 nt, Human
cccccuacuacaagagacccagccccuaacag

SEQ ID NO: 370425 - RNA, 19 nt, Human
cccccuacucuggggcuug

SEQ ID NO: 370426 - RNA, 18 nt, Human
cccccuacuugcuggcuc

SEQ ID NO: 370427 - RNA, 32 nt, Human
cccccuagaggaacuuuccuuccuuuccagca

SEQ ID NO: 370428 - RNA, 27 nt, Human
cccccuagccgcagccccccucugcug

SEQ ID NO: 370429 - RNA, 32 nt, Human
cccccuagccucccgcccucgcccucacugcu

SEQ ID NO: 370430 - RNA, 32 nt, Human
cccccuagggcgacaggagccagcgggacgcc

SEQ ID NO: 370431 - RNA, 32 nt, Human
cccccuaggggccaggacaggaccaguuuacc

SEQ ID NO: 370432 - RNA, 32 nt, Human
cccccuagugccugccccacagcccugaggaa

SEQ ID NO: 370433 - RNA, 32 nt, Human
cccccuauccuggaagucaguggggagagguu

SEQ ID NO: 370434 - RNA, 32 nt, Human
cccccuauccuuuuucucuccaccccaucccc

SEQ ID NO: 370435 - RNA, 32 nt, Human
cccccucaaccaggaacuggggauuugggaug

SEQ ID NO: 370436 - RNA, 32 nt, Human
cccccucaagccccagcagcccucaacaggcc

SEQ ID NO: 370437 - RNA, 32 nt, Human
cccccucacaaaccaccccacagauccaaccc

SEQ ID NO: 370438 - RNA, 32 nt, Human
cccccucaccauccuccgaccucacccacccc

SEQ ID NO: 370439 - RNA, 32 nt, Human
cccccucaccccaccacucccugggcacccaa

SEQ ID NO: 370440 - RNA, 32 nt, Human
cccccucacuuuugcucagccuagcagucuac

SEQ ID NO: 370441 - RNA, 32 nt, Human
cccccucagacuccgcugcgucgucucucggc

SEQ ID NO: 370442 - RNA, 32 nt, Human
cccccucagagcccccagcccccaggagagcc

SEQ ID NO: 370443 - RNA, 20 nt, Human
cccccucagcccugugguua

SEQ ID NO: 370444 - RNA, 32 nt, Human
cccccucagccuggcagccucuggacagagag

SEQ ID NO: 370445 - RNA, 21 nt, Human
cccccucagcuccuaucucug

SEQ ID NO: 370446 - RNA, 32 nt, Human
cccccucauccccucaccuccuucucuuuacc

SEQ ID NO: 370447 - RNA, 32 nt, Human
cccccucauggcagcaggugggcagaucaaag

SEQ ID NO: 370448 - RNA, 32 nt, Human
cccccuccaagaagcaaguaccgaaaccaccu

SEQ ID NO: 370449 - RNA, 32 nt, Human
cccccuccacaccucuagaccuggggccuccg

SEQ ID NO: 370450 - RNA, 32 nt, Human
cccccuccacagcaaccaaucacaaccauaaa

SEQ ID NO: 370451 - RNA, 32 nt, Human
cccccuccacagccacagcccccgcccccucc

SEQ ID NO: 370452 - RNA, 32 nt, Human
cccccuccacccaguggccacgcccagcaccc

SEQ ID NO: 370453 - RNA, 26 nt, Human
cccccuccacccccacccugaggcuc

SEQ ID NO: 370454 - RNA, 25 nt, Human
cccccuccaccccccuuccgugccc

SEQ ID NO: 370455 - RNA, 32 nt, Human
cccccuccaccgcgccugccucccaggccuga

SEQ ID NO: 370456 - RNA, 32 nt, Human
cccccuccaccucuccccuuggugccuaaccc

SEQ ID NO: 370457 - RNA, 32 nt, Human
cccccuccagagagugaggagggggccugaga

SEQ ID NO: 370458 - RNA, 32 nt, Human
cccccuccagccccaucucugucucaaggaga

SEQ ID NO: 370459 - RNA, 32 nt, Human
cccccuccaggaugccgccaggugucccucuc

SEQ ID NO: 370460 - RNA, 23 nt, Human
cccccuccaggccugacuggcuc

SEQ ID NO: 370461 - RNA, 32 nt, Human
cccccuccaucccagcccacuggaccagaacu

SEQ ID NO: 370462 - RNA, 32 nt, Human
cccccuccaucucuguguacacaaacagguac

SEQ ID NO: 370463 - RNA, 32 nt, Human
cccccuccaugucccuggacccuuaagauauc

SEQ ID NO: 370464 - RNA, 32 nt, Human
cccccucccagagcucaccuggugccagguaa

SEQ ID NO: 370465 - RNA, 32 nt, Human
cccccucccagcccuugcccagccugggggag

SEQ ID NO: 370466 - RNA, 32 nt, Human
cccccucccaggcaaucuccccacuccagccc

SEQ ID NO: 370467 - RNA, 32 nt, Human
cccccuccccaacucuaaccagaccccauccc

SEQ ID NO: 370468 - RNA, 20 nt, Human
cccccuccccacucuggcuc

SEQ ID NO: 370469 - RNA, 32 nt, Human
cccccuccccauccaggggcuguguauuauug

SEQ ID NO: 370470 - RNA, 32 nt, Human
cccccuccccauccccagcccagccgagggaa

SEQ ID NO: 370471 - RNA, 21 nt, Human
cccccuccccccuagaaccug

SEQ ID NO: 370472 - RNA, 20 nt, Human
cccccuccccccuuugcucu

SEQ ID NO: 370473 - RNA, 18 nt, Human
cccccucccccuccucuc

SEQ ID NO: 370474 - RNA, 32 nt, Human
cccccucccccuccugcugugcuggaauucca

SEQ ID NO: 370475 - RNA, 25 nt, Human
cccccucccccuucucccaccccug

SEQ ID NO: 370476 - RNA, 25 nt, Human
cccccucccccuuugcauccagcuc

SEQ ID NO: 370477 - RNA, 18 nt, Human
cccccuccccuccagggg

SEQ ID NO: 370478 - RNA, 32 nt, Human
cccccuccccucccccagaccuccaccuccuc

SEQ ID NO: 370479 - RNA, 20 nt, Human
cccccuccccucccuuuuug

SEQ ID NO: 370480 - RNA, 32 nt, Human
cccccuccccuccgacaaggcccagccagauu

SEQ ID NO: 370481 - RNA, 32 nt, Human
cccccuccccuccgccgcgccugggccucugc

SEQ ID NO: 370482 - RNA, 32 nt, Human
cccccuccccuccugcagccuccugcgccccg

SEQ ID NO: 370483 - RNA, 23 nt, Human
cccccuccccuccuucucccucu

SEQ ID NO: 370484 - RNA, 23 nt, Human
cccccuccccucugaggagccug

SEQ ID NO: 370485 - RNA, 18 nt, Human
cccccuccccucugccca

SEQ ID NO: 370486 - RNA, 24 nt, Human
cccccuccccucugggugagccug

SEQ ID NO: 370487 - RNA, 32 nt, Human
cccccuccccugcccugcuccagcucacacgu

SEQ ID NO: 370488 - RNA, 32 nt, Human
cccccuccccuucaccccuuccccuccccgcc

SEQ ID NO: 370489 - RNA, 28 nt, Human
cccccuccccuucucccuugccuaucug

SEQ ID NO: 370490 - RNA, 22 nt, Human
cccccuccccuucuccuccucu

SEQ ID NO: 370491 - RNA, 20 nt, Human
cccccuccccuuuagcucug

SEQ ID NO: 370492 - RNA, 32 nt, Human
cccccucccgcccccgcacgcggaccgcccuc

SEQ ID NO: 370493 - RNA, 20 nt, Human
cccccucccuaccucugccu

SEQ ID NO: 370494 - RNA, 32 nt, Human
cccccucccuccccgcccgcacggccaccaac

SEQ ID NO: 370495 - RNA, 32 nt, Human
cccccucccucggguuggguggcccagccagc

SEQ ID NO: 370496 - RNA, 19 nt, Human
cccccucccucuggggccu

SEQ ID NO: 370497 - RNA, 22 nt, Human
cccccucccugcucccagcucu

SEQ ID NO: 370498 - RNA, 32 nt, Human
cccccucccuggaucaugcacagaaacuuucg

SEQ ID NO: 370499 - RNA, 18 nt, Human
cccccucccuuagcucug

SEQ ID NO: 370500 - RNA, 32 nt, Human
cccccucccuuucccgcucuucuugcccaccc

SEQ ID NO: 370501 - RNA, 23 nt, Human
cccccucccuuucccuuaacucu

SEQ ID NO: 370502 - RNA, 20 nt, Human
cccccuccgcccccaugcuc

SEQ ID NO: 370503 - RNA, 32 nt, Human
cccccuccggugugcacacaggccagugagcg

SEQ ID NO: 370504 - RNA, 18 nt, Human
cccccuccguccugcccu

SEQ ID NO: 370505 - RNA, 32 nt, Human
cccccuccuaaacauucguacacacacaaaca

SEQ ID NO: 370506 - RNA, 32 nt, Human
cccccuccucaccgucuucucccggccuauua

SEQ ID NO: 370507 - RNA, 32 nt, Human
cccccuccuccacccaccccuaacucucagcc

SEQ ID NO: 370508 - RNA, 32 nt, Human
cccccuccuccaccccagccugcugcugcuac

SEQ ID NO: 370509 - RNA, 32 nt, Human
cccccuccuccagcaauagcauccaaggggcc

SEQ ID NO: 370510 - RNA, 32 nt, Human
cccccuccuccaggagaacucgcggcugggcu

SEQ ID NO: 370511 - RNA, 32 nt, Human
cccccuccuccccuccuuucuguccucucucu

SEQ ID NO: 370512 - RNA, 20 nt, Human
cccccuccucccugccuucu

SEQ ID NO: 370513 - RNA, 21 nt, Human
cccccuccucccugccuucuu

SEQ ID NO: 370514 - RNA, 20 nt, Human
cccccuccuccuccaaccca

SEQ ID NO: 370515 - RNA, 32 nt, Human
cccccuccucucuccaggcuuuagaucucuga

SEQ ID NO: 370516 - RNA, 32 nt, Human
cccccuccuuaggccccagccugggcccagac

SEQ ID NO: 370517 - RNA, 31 nt, Human
cccccuccuuccccugggccuggucacugca

SEQ ID NO: 370518 - RNA, 17 nt, Human
cccccuccuuccucccu

SEQ ID NO: 370519 - RNA, 32 nt, Human
cccccuccuuucucccccuaaacuuuggccgg

SEQ ID NO: 370520 - RNA, 32 nt, Human
cccccucgcucccauguuuccacccggcaccc

SEQ ID NO: 370521 - RNA, 32 nt, Human
cccccucggccccucaccaccucuuucuacag

SEQ ID NO: 370522 - RNA, 32 nt, Human
cccccucgucccaaaucucucucccaguacac

SEQ ID NO: 370523 - RNA, 22 nt, Human
cccccucguccucgcucaccuu

SEQ ID NO: 370524 - RNA, 21 nt, Human
cccccucuaucccuaacccug

SEQ ID NO: 370525 - RNA, 32 nt, Human
cccccucuccaccuccuggggcccaucaugaa

SEQ ID NO: 370526 - RNA, 32 nt, Human
cccccucucccauuuauucccuugaaggugcc

SEQ ID NO: 370527 - RNA, 22 nt, Human
cccccucucccccuccuuucuu

SEQ ID NO: 370528 - RNA, 23 nt, Human
cccccucucccuccuccccuuug

SEQ ID NO: 370529 - RNA, 18 nt, Human
cccccucucccuccuugc

SEQ ID NO: 370530 - RNA, 21 nt, Human
cccccucucccuuuccuuccu

SEQ ID NO: 370531 - RNA, 22 nt, Human
cccccucucccuuuccuuccuu

SEQ ID NO: 370532 - RNA, 22 nt, Human
cccccucuccucccagccucug

SEQ ID NO: 370533 - RNA, 21 nt, Human
cccccucuccucccagcugcu

SEQ ID NO: 370534 - RNA, 20 nt, Human
cccccucuccuccuuuguuc

SEQ ID NO: 370535 - RNA, 23 nt, Human
cccccucuccugugagacuggcu

SEQ ID NO: 370536 - RNA, 19 nt, Human
cccccucuccuuccgccca

SEQ ID NO: 370537 - RNA, 22 nt, Human
cccccucuccuuuugcucucuu

SEQ ID NO: 370538 - RNA, 18 nt, Human
cccccucucggcugcagc

SEQ ID NO: 370539 - RNA, 21 nt, Human
cccccucucuccccaucucug

SEQ ID NO: 370540 - RNA, 32 nt, Human
cccccucucuccccaucucuggucucaaagcc

SEQ ID NO: 370541 - RNA, 32 nt, Human
cccccucucucccucccuucucucuaauuccc

SEQ ID NO: 370542 - RNA, 32 nt, Human
cccccucucucccuggugucaacucgauuccu

SEQ ID NO: 370543 - RNA, 32 nt, Human
cccccucucugcuugcagacagugccacggcu

SEQ ID NO: 370544 - RNA, 32 nt, Human
cccccucucugugcccugguccccuugccgcc

SEQ ID NO: 370545 - RNA, 32 nt, Human
cccccucugaaagggauggagaugcugaugag

SEQ ID NO: 370546 - RNA, 32 nt, Human
cccccucugcaaccuuucucucugggggcugu

SEQ ID NO: 370547 - RNA, 19 nt, Human
cccccucugcaccucgggc

SEQ ID NO: 370548 - RNA, 32 nt, Human
cccccucugcauuuacacagauuugagucaga

SEQ ID NO: 370549 - RNA, 32 nt, Human
cccccucugccccucuccacucuuggcaugga

SEQ ID NO: 370550 - RNA, 32 nt, Human
cccccucugcccugagccaggagaccugccac

SEQ ID NO: 370551 - RNA, 32 nt, Human
cccccucugcccugccccuugucauggaccau

SEQ ID NO: 370552 - RNA, 32 nt, Human
cccccucugccucuccccaccuucuuuggagc

SEQ ID NO: 370553 - RNA, 32 nt, Human
cccccucugccuggagacuccugcucauccau

SEQ ID NO: 370554 - RNA, 32 nt, Human
cccccucuguucugcugauuguagggaugugc

SEQ ID NO: 370555 - RNA, 21 nt, Human
cccccucuuaguucuucgcgg

SEQ ID NO: 370556 - RNA, 32 nt, Human
cccccucuucaggcugcugcaggaggccaggc

SEQ ID NO: 370557 - RNA, 32 nt, Human
cccccucuuccagaggaggagcagggaucugg

SEQ ID NO: 370558 - RNA, 18 nt, Human
cccccucuuccccgccca

SEQ ID NO: 370559 - RNA, 32 nt, Human
cccccucuucucccagucuucagucuuaaguc

SEQ ID NO: 370560 - RNA, 22 nt, Human
cccccucuucucccuaauccug

SEQ ID NO: 370561 - RNA, 26 nt, Human
cccccucuucucucccucccgcccug

SEQ ID NO: 370562 - RNA, 32 nt, Human
cccccucuucuuccucuguagagaugcaagaa

SEQ ID NO: 370563 - RNA, 32 nt, Human
cccccucuucuuucucuuuuucuugacucuuu

SEQ ID NO: 370564 - RNA, 22 nt, Human
cccccucuugucucccacccug

SEQ ID NO: 370565 - RNA, 23 nt, Human
cccccugaagccugcaaacguug

SEQ ID NO: 370566 - RNA, 32 nt, Human
cccccugaaggugaguaugggaggcaggggcc

SEQ ID NO: 370567 - RNA, 32 nt, Human
cccccugaaggugauagagagugagaaguuag

SEQ ID NO: 370568 - RNA, 32 nt, Human
cccccugaccucagcuuccugccugugcccca

SEQ ID NO: 370569 - RNA, 32 nt, Human
cccccugacucucaggccacagcuccggccac

SEQ ID NO: 370570 - RNA, 32 nt, Human
cccccugagauccagcccuacuucuugcacug

SEQ ID NO: 370571 - RNA, 32 nt, Human
cccccugagcagcugggacuacaggcacacac

SEQ ID NO: 370572 - RNA, 21 nt, Human
cccccugagcgccuggccaca

SEQ ID NO: 370573 - RNA, 32 nt, Human
cccccugaggggccccucacucuuacccaaga

SEQ ID NO: 370574 - RNA, 32 nt, Human
cccccugagguugugcuuucucagggauaugc

SEQ ID NO: 370575 - RNA, 32 nt, Human
cccccugaguagcugggauuacaggugcacca

SEQ ID NO: 370576 - RNA, 32 nt, Human
cccccugaguagcugggauuacaggugccugc

SEQ ID NO: 370577 - RNA, 32 nt, Human
cccccugauaggaccugguuuauucacaggcu

SEQ ID NO: 370578 - RNA, 32 nt, Human
cccccugauugcuggcaucugccucuucuccu

SEQ ID NO: 370579 - RNA, 32 nt, Human
cccccugcacauucggggucucagcccccagg

SEQ ID NO: 370580 - RNA, 32 nt, Human
cccccugcaguuucuugcuuucuucagcacau

SEQ ID NO: 370581 - RNA, 32 nt, Human
cccccugcaucaccaggcaucuuugccgaggc

SEQ ID NO: 370582 - RNA, 32 nt, Human
cccccugcauugauugcugccccugugaagaa

SEQ ID NO: 370583 - RNA, 32 nt, Human
cccccugcauuuuccuucuauccucacuggga

SEQ ID NO: 370584 - RNA, 32 nt, Human
cccccugccacccugcacugccccggcucccc

SEQ ID NO: 370585 - RNA, 32 nt, Human
cccccugccacccuggcacuucccagggccug

SEQ ID NO: 370586 - RNA, 32 nt, Human
cccccugccauccagucuggccccaguaccua

SEQ ID NO: 370587 - RNA, 32 nt, Human
cccccugccauccucugcugcuacccacacag

SEQ ID NO: 370588 - RNA, 32 nt, Human
cccccugcccacugaccugugaugacaucucu

SEQ ID NO: 370589 - RNA, 32 nt, Human
cccccugcccagcugcuccucccaccuggcca

SEQ ID NO: 370590 - RNA, 32 nt, Human
cccccugccccgccaaacacacaauuggccuu

SEQ ID NO: 370591 - RNA, 32 nt, Human
cccccugccccucgggcaccagccugcauaug

SEQ ID NO: 370592 - RNA, 32 nt, Human
cccccugcccguguacauagugcauuguuucu

SEQ ID NO: 370593 - RNA, 32 nt, Human
cccccugcccucuccccucucucccucccccu

SEQ ID NO: 370594 - RNA, 32 nt, Human
cccccugcccucuccccugccucucucuccca

SEQ ID NO: 370595 - RNA, 32 nt, Human
cccccugcccuuuucuugcccugucucugaac

SEQ ID NO: 370596 - RNA, 32 nt, Human
cccccugccgcaucuuugaccugggcagcgac

SEQ ID NO: 370597 - RNA, 32 nt, Human
cccccugccugagcccaggacccacuggagcc

SEQ ID NO: 370598 - RNA, 32 nt, Human
cccccugccuuagagcaccuuccagagaagcu

SEQ ID NO: 370599 - RNA, 32 nt, Human
cccccugcgucacccacucccugcacuucugc

SEQ ID NO: 370600 - RNA, 32 nt, Human
cccccugcguggcaggaguccugggaguuccc

SEQ ID NO: 370601 - RNA, 32 nt, Human
cccccugcucacccucugggcuuugucuccga

SEQ ID NO: 370602 - RNA, 32 nt, Human
cccccugcuccaggacaggccaugggcaagcu

SEQ ID NO: 370603 - RNA, 32 nt, Human
cccccugcuccuguuucagcgccugcuccagc

SEQ ID NO: 370604 - RNA, 32 nt, Human
cccccugcucuagccaagguggccgcagucug

SEQ ID NO: 370605 - RNA, 32 nt, Human
cccccugcuucagucccuucgccaugcuuccc

SEQ ID NO: 370606 - RNA, 32 nt, Human
cccccugcuuccccuucuaccuccccuacccu

SEQ ID NO: 370607 - RNA, 32 nt, Human
cccccugcuuggccaggaggugagagaaggau

SEQ ID NO: 370608 - RNA, 32 nt, Human
cccccugcuugugcggcgaugaucuguuugug

SEQ ID NO: 370609 - RNA, 32 nt, Human
cccccugcuuuuacuuucuucucugucuuuaa

SEQ ID NO: 370610 - RNA, 21 nt, Human
cccccuggacuccuggcccug

SEQ ID NO: 370611 - RNA, 32 nt, Human
cccccuggagcugggagagaggccgggguuag

SEQ ID NO: 370612 - RNA, 32 nt, Human
cccccuggagcuuugauuuugcacugagccaa

SEQ ID NO: 370613 - RNA, 18 nt, Human
cccccuggaguccuuccc

SEQ ID NO: 370614 - RNA, 32 nt, Human
cccccuggcagggugagguagagccggaccgu

SEQ ID NO: 370615 - RNA, 20 nt, Human
cccccuggccccgccugccc

SEQ ID NO: 370616 - RNA, 32 nt, Human
cccccuggccucccccacuuucuuucuuucuu

SEQ ID NO: 370617 - RNA, 22 nt, Human
cccccuggcugagccccugucc

SEQ ID NO: 370618 - RNA, 22 nt, Human
cccccuggcuggagcugaccca

SEQ ID NO: 370619 - RNA, 32 nt, Human
cccccugggaggaaggcuuugcgcuccggggc

SEQ ID NO: 370620 - RNA, 32 nt, Human
cccccugggcaggacccugggcaggaccagag

SEQ ID NO: 370621 - RNA, 32 nt, Human
cccccugggccaggugagguuggggccugugg

SEQ ID NO: 370622 - RNA, 24 nt, Human
cccccugggcucugcccagcucug

SEQ ID NO: 370623 - RNA, 32 nt, Human
cccccuggggagaagguggccucguugcccgg

SEQ ID NO: 370624 - RNA, 32 nt, Human
cccccuggggccugggcugcugcugguucuuc

SEQ ID NO: 370625 - RNA, 32 nt, Human
cccccugggucccaagcaaccucagccaauga

SEQ ID NO: 370626 - RNA, 32 nt, Human
cccccugggucccaagcaaccucagccaguga

SEQ ID NO: 370627 - RNA, 32 nt, Human
cccccugguaaguguggaggaggcgggacacu

SEQ ID NO: 370628 - RNA, 32 nt, Human
cccccuguaaguuaaaggguagagaaagagau

SEQ ID NO: 370629 - RNA, 32 nt, Human
cccccugucacccugagcaaaucaguugcuuc

SEQ ID NO: 370630 - RNA, 32 nt, Human
cccccuguccggccuccacuugccauggggga

SEQ ID NO: 370631 - RNA, 32 nt, Human
cccccugucuucuccccucagcaauuccugca

SEQ ID NO: 370632 - RNA, 25 nt, Human
cccccugugccacucagcuccgccc

SEQ ID NO: 370633 - RNA, 32 nt, Human
cccccugugccagauccuccccuaugcugacc

SEQ ID NO: 370634 - RNA, 32 nt, Human
cccccuguggagagggugacugugggagagca

SEQ ID NO: 370635 - RNA, 32 nt, Human
cccccugugggaugggaggcaggccccagcau

SEQ ID NO: 370636 - RNA, 32 nt, Human
cccccuguucuuccucccaacgaaagcaugga

SEQ ID NO: 370637 - RNA, 32 nt, Human
cccccuguuuugaaucaggccaugucuucccc

SEQ ID NO: 370638 - RNA, 32 nt, Human
cccccuuaccucccccacccccuuuaucacca

SEQ ID NO: 370639 - RNA, 32 nt, Human
cccccuuacuggcuccaggcaucccccucacc

SEQ ID NO: 370640 - RNA, 32 nt, Human
cccccuuauuuuccuuuugucuccuggugauu

SEQ ID NO: 370641 - RNA, 32 nt, Human
cccccuucacacacacaacaaagcguggacac

SEQ ID NO: 370642 - RNA, 20 nt, Human
cccccuucaccaccucuaca

SEQ ID NO: 370643 - RNA, 22 nt, Human
cccccuucaccuugacuggcuu

SEQ ID NO: 370644 - RNA, 32 nt, Human
cccccuucaugcugccccuggcgccuagaacc

SEQ ID NO: 370645 - RNA, 32 nt, Human
cccccuucauuuccuaccuuccuuccuccucu

SEQ ID NO: 370646 - RNA, 19 nt, Human
cccccuuccagacccgcuc

SEQ ID NO: 370647 - RNA, 22 nt, Human
cccccuuccagauuacugucuc

SEQ ID NO: 370648 - RNA, 22 nt, Human
cccccuuccagggccucugcuc

SEQ ID NO: 370649 - RNA, 32 nt, Human
cccccuucccacucagcuucugccagcggguc

SEQ ID NO: 370650 - RNA, 32 nt, Human
cccccuuccccauuccuuuacuguacauaaag

SEQ ID NO: 370651 - RNA, 32 nt, Human
cccccuuccccauuccuuuauuguacauaaag

SEQ ID NO: 370652 - RNA, 32 nt, Human
cccccuuccccauuccuuuauuguacauaacu

SEQ ID NO: 370653 - RNA, 32 nt, Human
cccccuuccccauuccuuuauuguacguaaag

SEQ ID NO: 370654 - RNA, 25 nt, Human
cccccuucccccuuuagugccugcu

SEQ ID NO: 370655 - RNA, 32 nt, Human
cccccuuccccuacccccuccucucugccgca

SEQ ID NO: 370656 - RNA, 22 nt, Human
cccccuuccccugugcucccuu

SEQ ID NO: 370657 - RNA, 19 nt, Human
cccccuucccgccuggcuc

SEQ ID NO: 370658 - RNA, 32 nt, Human
cccccuuccuaagacagguagaaaaauguaau

SEQ ID NO: 370659 - RNA, 32 nt, Human
  misc_feature (17)..(17): n is a, c, g or u
cccccuuccuaggacunucccaccccaaacuc

SEQ ID NO: 370660 - RNA, 32 nt, Human
cccccuuccucucccccuuccucucucccuuc

SEQ ID NO: 370661 - RNA, 21 nt, Human
cccccuuccuggugacugagc

SEQ ID NO: 370662 - RNA, 32 nt, Human
cccccuuccuuuaaaaucaucuggaaagaaac

SEQ ID NO: 370663 - RNA, 32 nt, Human
cccccuuccuuucccuccucuaccacuaaccg

SEQ ID NO: 370664 - RNA, 32 nt, Human
cccccuucuaucuccccuucuguccagggccc

SEQ ID NO: 370665 - RNA, 32 nt, Human
cccccuucucaccuccucauucucucuggcuc

SEQ ID NO: 370666 - RNA, 32 nt, Human
cccccuucuccaggagccagggggugacugga

SEQ ID NO: 370667 - RNA, 18 nt, Human
cccccuucuccccugugc

SEQ ID NO: 370668 - RNA, 21 nt, Human
cccccuucuccuuuccuuucu

SEQ ID NO: 370669 - RNA, 22 nt, Human
cccccuucuccuuuccuuucuu

SEQ ID NO: 370670 - RNA, 32 nt, Human
cccccuucucuagccacagccucuaguacacu

SEQ ID NO: 370671 - RNA, 32 nt, Human
cccccuucucucucccucucccucucucucua

SEQ ID NO: 370672 - RNA, 20 nt, Human
cccccuucugccccuggguc

SEQ ID NO: 370673 - RNA, 32 nt, Human
cccccuucugccuggcuugccugcuucugccc

SEQ ID NO: 370674 - RNA, 32 nt, Human
cccccuucugcgccuagcguuccucuuccccu

SEQ ID NO: 370675 - RNA, 32 nt, Human
cccccuucuuaccugaguaucagcuuacuucc

SEQ ID NO: 370676 - RNA, 23 nt, Human
cccccuucuucucccagacucug

SEQ ID NO: 370677 - RNA, 19 nt, Human
cccccuucuuugcagcugc

SEQ ID NO: 370678 - RNA, 32 nt, Human
cccccuugaaucugcagggagcaacucuccac

SEQ ID NO: 370679 - RNA, 32 nt, Human
cccccuugagcugggaacucaggcuccuggaa

SEQ ID NO: 370680 - RNA, 32 nt, Human
cccccuugcccaggcccuugggggagggggug

SEQ ID NO: 370681 - RNA, 24 nt, Human
cccccuugcuucucuccagcccug

SEQ ID NO: 370682 - RNA, 24 nt, Human
cccccuugggcucaggccccgccc

SEQ ID NO: 370683 - RNA, 32 nt, Human
cccccuuggucgccugcuggucuucuauguca

SEQ ID NO: 370684 - RNA, 32 nt, Human
cccccuugucacagaaaccagggacucuucag

SEQ ID NO: 370685 - RNA, 32 nt, Human
cccccuuguucccaggcacccuguggcugacu

SEQ ID NO: 370686 - RNA, 32 nt, Human
cccccuuuccccacccccucccccgacccuuu

SEQ ID NO: 370687 - RNA, 20 nt, Human
cccccuuucccccaacucug

SEQ ID NO: 370688 - RNA, 18 nt, Human
cccccuuucccgggcugu

SEQ ID NO: 370689 - RNA, 23 nt, Human
cccccuuuccucgacagcuuagu

SEQ ID NO: 370690 - RNA, 24 nt, Human
cccccuuuccucgacagcuuaguu

SEQ ID NO: 370691 - RNA, 32 nt, Human
cccccuuuccuuccuuuccucucuguaccauu

SEQ ID NO: 370692 - RNA, 32 nt, Human
cccccuuucugcucacacaauugcacuccauu

SEQ ID NO: 370693 - RNA, 32 nt, Human
cccccuuucuuuccucccuccccuucucauuu

SEQ ID NO: 370694 - RNA, 24 nt, Human
cccccuuucuuucuaccagcccug

SEQ ID NO: 370695 - RNA, 32 nt, Human
cccccuuugcucucacgcccagccugucccca

SEQ ID NO: 370696 - RNA, 32 nt, Human
cccccuuugguuuggccuccauccucaucucu

SEQ ID NO: 370697 - RNA, 32 nt, Human
cccccuuuuaacuuccucuugguuuuucauua

SEQ ID NO: 370698 - RNA, 21 nt, Human
cccccuuuuaagaugcuugcu

SEQ ID NO: 370699 - RNA, 19 nt, Human
cccccuuuuagaagcuugc

SEQ ID NO: 370700 - RNA, 20 nt, Human
cccccuuuuccccaagcugc

SEQ ID NO: 370701 - RNA, 32 nt, Human
cccccuuuucccucauagccucuagggaggga

SEQ ID NO: 370702 - RNA, 24 nt, Human
cccccuuuucccuccucugucugu

SEQ ID NO: 370703 - RNA, 23 nt, Human
cccccuuuucccucggaguucuu

SEQ ID NO: 370704 - RNA, 22 nt, Human
cccccuuuucccuguacuuugu

SEQ ID NO: 370705 - RNA, 23 nt, Human
cccccuuuucccuucagcuugcu

SEQ ID NO: 370706 - RNA, 24 nt, Human
cccccuuuucccuucagcuugcuu

SEQ ID NO: 370707 - RNA, 23 nt, Human
cccccuuuucccuuugguguugu

SEQ ID NO: 370708 - RNA, 23 nt, Human
cccccuuuucucugggaaccgcu

SEQ ID NO: 370709 - RNA, 32 nt, Human
ccccgaaaccugggcuggagugagguggaagg

SEQ ID NO: 370710 - RNA, 32 nt, Human
ccccgaaccccugaaccuccagccaggggcgc

SEQ ID NO: 370711 - RNA, 32 nt, Human
ccccgaaccuuuccuguuccccuggauuuagu

SEQ ID NO: 370712 - RNA, 32 nt, Human
ccccgaacuuucaugaaccccugguagcugaa

SEQ ID NO: 370713 - RNA, 20 nt, Human
ccccgaaggggcccagaaca

SEQ ID NO: 370714 - RNA, 32 nt, Human
ccccgaaguagccauucccuggagguggggaa

SEQ ID NO: 370715 - RNA, 22 nt, Human
ccccgaagucccgcugcccucg

SEQ ID NO: 370716 - RNA, 19 nt, Human
ccccgaaugucagcaccuu

SEQ ID NO: 370717 - RNA, 32 nt, Human
ccccgacacaucccuucccccaaaaagcaaca

SEQ ID NO: 370718 - RNA, 32 nt, Human
ccccgacaccagaacccuggugcuggugggcc

SEQ ID NO: 370719 - RNA, 21 nt, Human
ccccgacaccaggcccugccc

SEQ ID NO: 370720 - RNA, 22 nt, Human
ccccgacacccaagccccuccc

SEQ ID NO: 370721 - RNA, 32 nt, Human
ccccgacagacaguggcacuccugguccugcu

SEQ ID NO: 370722 - RNA, 32 nt, Human
ccccgacagcacaggccccugucccaggaccc

SEQ ID NO: 370723 - RNA, 32 nt, Human
ccccgacaggacgggcuugggcuuccauuugu

SEQ ID NO: 370724 - RNA, 32 nt, Human
ccccgacaggccuggcuccauccucugaaaau

SEQ ID NO: 370725 - RNA, 32 nt, Human
ccccgacaucuucuggcccucuggccagcacg

SEQ ID NO: 370726 - RNA, 32 nt, Human
ccccgaccaaaccucggggagcccuccugugc

SEQ ID NO: 370727 - RNA, 32 nt, Human
ccccgaccaacugcagcacccaaggacuggca

SEQ ID NO: 370728 - RNA, 22 nt, Human
ccccgacccccacccucacucc

SEQ ID NO: 370729 - RNA, 32 nt, Human
ccccgaccgcacuccagccugggcgacagagu

SEQ ID NO: 370730 - RNA, 25 nt, Human
ccccgaccucauacaaacucaggcc

SEQ ID NO: 370731 - RNA, 24 nt, Human
ccccgaccucccgcacccaggacc

SEQ ID NO: 370732 - RNA, 32 nt, Human
ccccgaccucgcugcccccgccucgccucucu

SEQ ID NO: 370733 - RNA, 24 nt, Human
ccccgaccugaucucccacugcca

SEQ ID NO: 370734 - RNA, 32 nt, Human
ccccgaccuuguagaaaaaccccuacccucac

SEQ ID NO: 370735 - RNA, 25 nt, Human
ccccgacgccugcucccccaggggc

SEQ ID NO: 370736 - RNA, 32 nt, Human
ccccgacgcuguacuccagaccaccuugagug

SEQ ID NO: 370737 - RNA, 32 nt, Human
ccccgacgggagcgccauggcccagccgccgc

SEQ ID NO: 370738 - RNA, 18 nt, Human
ccccgacucacucagacc

SEQ ID NO: 370739 - RNA, 27 nt, Human
ccccgacugcagccugcauucugcaca

SEQ ID NO: 370740 - RNA, 18 nt, Human
ccccgacugccacucugg

SEQ ID NO: 370741 - RNA, 23 nt, Human
ccccgacugccacucuggaccua

SEQ ID NO: 370742 - RNA, 19 nt, Human
ccccgacuguggggccaug

SEQ ID NO: 370743 - RNA, 32 nt, Human
ccccgacuucuaccagggaugccuucacgcca

SEQ ID NO: 370744 - RNA, 32 nt, Human
ccccgacuuuugcaucugaccaaaggacgaau

SEQ ID NO: 370745 - RNA, 32 nt, Human
ccccgagaaaugcuggagcaggcuguucagac

SEQ ID NO: 370746 - RNA, 23 nt, Human
ccccgagacgcgccuggcgcgga

SEQ ID NO: 370747 - RNA, 32 nt, Human
ccccgagacugcugaugucuguaaccacuggg

SEQ ID NO: 370748 - RNA, 21 nt, Human
ccccgagaucaccugcagcug

SEQ ID NO: 370749 - RNA, 21 nt, Human
ccccgagcagcggcgggggca

SEQ ID NO: 370750 - RNA, 25 nt, Human
ccccgagcagcuccccacucugccc

SEQ ID NO: 370751 - RNA, 32 nt, Human
ccccgagcaggagguggagcagcuggacuucc

SEQ ID NO: 370752 - RNA, 32 nt, Human
ccccgagcccugacuccuggacuccggaggac

SEQ ID NO: 370753 - RNA, 20 nt, Human
ccccgagccgccgacuugcc

SEQ ID NO: 370754 - RNA, 22 nt, Human
ccccgagcgcgccgggcgcgga

SEQ ID NO: 370755 - RNA, 32 nt, Human
ccccgagcuaagucccagggcaucugggccuu

SEQ ID NO: 370756 - RNA, 32 nt, Human
ccccgaggaagaagauuucauggcugcauccu

SEQ ID NO: 370757 - RNA, 32 nt, Human
ccccgaggacggacucggcugguucuggaguc

SEQ ID NO: 370758 - RNA, 32 nt, Human
ccccgaggaggaggaggaggacgcgggccugg

SEQ ID NO: 370759 - RNA, 32 nt, Human
ccccgaggaggaggaggaggaggaggaagagg

SEQ ID NO: 370760 - RNA, 32 nt, Human
ccccgaggaggaggaggaggaggaggacgcgg

SEQ ID NO: 370761 - RNA, 18 nt, Human
ccccgaggcagaguuggg

SEQ ID NO: 370762 - RNA, 19 nt, Human
ccccgaggcagggcugggg

SEQ ID NO: 370763 - RNA, 32 nt, Human
ccccgaggccaucacccccuccagcagugaac

SEQ ID NO: 370764 - RNA, 32 nt, Human
ccccgaggccugugccuuucccacuccaccuu

SEQ ID NO: 370765 - RNA, 32 nt, Human
ccccgaggcgggaggccggcugugcugcagga

SEQ ID NO: 370766 - RNA, 32 nt, Human
ccccgaggcugaagauggaaacauugaauaua

SEQ ID NO: 370767 - RNA, 32 nt, Human
ccccgagggucggggaaggaaccgagguccgg

SEQ ID NO: 370768 - RNA, 32 nt, Human
ccccgaggucaucuucuacaccuagcugcccg

SEQ ID NO: 370769 - RNA, 21 nt, Human
ccccgagguccucagugguug

SEQ ID NO: 370770 - RNA, 32 nt, Human
ccccgagguggaugccgcugggccggcugccu

SEQ ID NO: 370771 - RNA, 23 nt, Human
ccccgaggugggguccccuccca

SEQ ID NO: 370772 - RNA, 23 nt, Human
ccccgaguagcugggauuacagg

SEQ ID NO: 370773 - RNA, 32 nt, Human
ccccgaguccccagcugugcaccagcuccccg

SEQ ID NO: 370774 - RNA, 32 nt, Human
ccccgaguccccgacccuccccaagcaagguu

SEQ ID NO: 370775 - RNA, 21 nt, Human
ccccgagucccggcccaggcc

SEQ ID NO: 370776 - RNA, 32 nt, Human
ccccgaguccuggcaaacugcuugccuggggu

SEQ ID NO: 370777 - RNA, 32 nt, Human
ccccgagugccuccccucccucccucuguggg

SEQ ID NO: 370778 - RNA, 32 nt, Human
ccccgaguuagaaaaaguagcuauggaggacu

SEQ ID NO: 370779 - RNA, 32 nt, Human
ccccgaucacagacacuguggccccgcaaugg

SEQ ID NO: 370780 - RNA, 32 nt, Human
ccccgaucagugugugccuguuuacagcacua

SEQ ID NO: 370781 - RNA, 32 nt, Human
ccccgaucccagcuuucucuccuuugaaaaca

SEQ ID NO: 370782 - RNA, 32 nt, Human
ccccgauccgcuuccccuuucucccuccucag

SEQ ID NO: 370783 - RNA, 32 nt, Human
ccccgauccugagcgguugggguggggucccu

SEQ ID NO: 370784 - RNA, 32 nt, Human
ccccgaucuccccagcagcagcaacagcagcg

SEQ ID NO: 370785 - RNA, 32 nt, Human
ccccgaugccaccacagccaucgccacugcca

SEQ ID NO: 370786 - RNA, 19 nt, Human
ccccgaugccacucugccc

SEQ ID NO: 370787 - RNA, 18 nt, Human
ccccgaugcucagaagug

SEQ ID NO: 370788 - RNA, 30 nt, Human
ccccgaugggccagggcaggaggccugcug

SEQ ID NO: 370789 - RNA, 32 nt, Human
ccccgauguggagugggcaggaaggggccugg

SEQ ID NO: 370790 - RNA, 32 nt, Human
ccccgauguuccucuccugaauucuggauuuu

SEQ ID NO: 370791 - RNA, 32 nt, Human
ccccgauuuccucuuggguccccucaagcaga

SEQ ID NO: 370792 - RNA, 32 nt, Human
ccccgcaaaaucaggcuugagugcaguggcgc

SEQ ID NO: 370793 - RNA, 32 nt, Human
ccccgcaaacucgugggcagugcagugcugga

SEQ ID NO: 370794 - RNA, 32 nt, Human
ccccgcaacucgcuuguccuugggucacccug

SEQ ID NO: 370795 - RNA, 32 nt, Human
ccccgcaagccccagccccgaggaccguccau

SEQ ID NO: 370796 - RNA, 32 nt, Human
ccccgcaagccgcgccccuggcgggcuaagug

SEQ ID NO: 370797 - RNA, 23 nt, Human
ccccgcaaggccacugcgggugg

SEQ ID NO: 370798 - RNA, 32 nt, Human
ccccgcaaugcugauggggcugugcauugagg

SEQ ID NO: 370799 - RNA, 32 nt, Human
ccccgcacacgguaagaccucuugcuuucgcu

SEQ ID NO: 370800 - RNA, 17 nt, Human
ccccgcacccccucgca

SEQ ID NO: 370801 - RNA, 32 nt, Human
ccccgcaccccgaggcagaguugggaaagcag

SEQ ID NO: 370802 - RNA, 32 nt, Human
ccccgcaccccucccugggcugaaguucaggc

SEQ ID NO: 370803 - RNA, 32 nt, Human
ccccgcaccucgcucccuucccuuccccgcac

SEQ ID NO: 370804 - RNA, 32 nt, Human
ccccgcaccuggaagcugggaggccgcgagga

SEQ ID NO: 370805 - RNA, 32 nt, Human
ccccgcacgccuguaaucccagcacuugggga

SEQ ID NO: 370806 - RNA, 32 nt, Human
ccccgcacugacugaauaaagcuccucuggcc

SEQ ID NO: 370807 - RNA, 22 nt, Human
ccccgcacugacugucgcgccg

SEQ ID NO: 370808 - RNA, 32 nt, Human
ccccgcagaccuccccagccccuagcccagga

SEQ ID NO: 370809 - RNA, 32 nt, Human
ccccgcagagagaaagcugcagugcacauccu

SEQ ID NO: 370810 - RNA, 22 nt, Human
ccccgcagcccgccccaccgug

SEQ ID NO: 370811 - RNA, 32 nt, Human
ccccgcagcccuucugcacccagcacagccug

SEQ ID NO: 370812 - RNA, 32 nt, Human
ccccgcagccuccuugcuucucucuguccccu

SEQ ID NO: 370813 - RNA, 21 nt, Human
ccccgcagccugcggcgcaga

SEQ ID NO: 370814 - RNA, 21 nt, Human
ccccgcagcuucucuguagug

SEQ ID NO: 370815 - RNA, 32 nt, Human
ccccgcaggcugaggccagggcguggcggcug

SEQ ID NO: 370816 - RNA, 23 nt, Human
ccccgcagggccaaccccugccc

SEQ ID NO: 370817 - RNA, 32 nt, Human
ccccgcaggggagggggcggagagcgcgagaa

SEQ ID NO: 370818 - RNA, 32 nt, Human
ccccgcagguuaugucagcagcucugagacag

SEQ ID NO: 370819 - RNA, 19 nt, Human
ccccgcaugcccugggcca

SEQ ID NO: 370820 - RNA, 32 nt, Human
ccccgccaacagcagcgaggccauguguggug

SEQ ID NO: 370821 - RNA, 18 nt, Human
ccccgccaauacugugaa

SEQ ID NO: 370822 - RNA, 32 nt, Human
ccccgccaccacugcugggcugcgagcugggc

SEQ ID NO: 370823 - RNA, 19 nt, Human
ccccgccacccccuccuca

SEQ ID NO: 370824 - RNA, 32 nt, Human
ccccgccagcccggcgcccagcucuuuguucu

SEQ ID NO: 370825 - RNA, 32 nt, Human
ccccgccagccuugccccguaggaagcuggag

SEQ ID NO: 370826 - RNA, 16 nt, Human
ccccgccagcuguggc

SEQ ID NO: 370827 - RNA, 32 nt, Human
ccccgccaggcucccaugucauggaugccugu

SEQ ID NO: 370828 - RNA, 18 nt, Human
ccccgccaucgugggcca

SEQ ID NO: 370829 - RNA, 19 nt, Human
ccccgcccaccuccccucc

SEQ ID NO: 370830 - RNA, 32 nt, Human
ccccgcccacuuucccaccuccucgguauaaa

SEQ ID NO: 370831 - RNA, 19 nt, Human
ccccgcccagaacugugaa

SEQ ID NO: 370832 - RNA, 19 nt, Human
ccccgcccagccccgcccc

SEQ ID NO: 370833 - RNA, 32 nt, Human
ccccgcccagccccugcccccagccugugugc

SEQ ID NO: 370834 - RNA, 32 nt, Human
ccccgcccagccugcuccuaugcgguacuuga

SEQ ID NO: 370835 - RNA, 19 nt, Human
ccccgcccagcuccccucc

SEQ ID NO: 370836 - RNA, 32 nt, Human
ccccgcccagcugcaccugccagccuggcuuc

SEQ ID NO: 370837 - RNA, 32 nt, Human
ccccgcccaggcuuagucacugagacagcccg

SEQ ID NO: 370838 - RNA, 22 nt, Human
ccccgcccagggagcuccgccc

SEQ ID NO: 370839 - RNA, 20 nt, Human
ccccgccccacccccagccc

SEQ ID NO: 370840 - RNA, 32 nt, Human
ccccgccccagccccugacacacacucggacc

SEQ ID NO: 370841 - RNA, 32 nt, Human
ccccgccccagccguccuccugggguggaccc

SEQ ID NO: 370842 - RNA, 32 nt, Human
ccccgccccaggcuggaaaacaagaguagagg

SEQ ID NO: 370843 - RNA, 32 nt, Human
ccccgccccauucugggccaaugugauuuuau

SEQ ID NO: 370844 - RNA, 20 nt, Human
ccccgcccccaaacccagcc

SEQ ID NO: 370845 - RNA, 32 nt, Human
ccccgcccccgccucuugcgcccugccuggcu

SEQ ID NO: 370846 - RNA, 32 nt, Human
ccccgcccccuccagccccaucucugucucaa

SEQ ID NO: 370847 - RNA, 32 nt, Human
ccccgcccccuccucugcuccugcagcgcccu

SEQ ID NO: 370848 - RNA, 32 nt, Human
ccccgcccccugggcuggagggcugugugugg

SEQ ID NO: 370849 - RNA, 32 nt, Human
ccccgcccccuucuugacuccgcccucucagc

SEQ ID NO: 370850 - RNA, 18 nt, Human
ccccgccccgacugugaa

SEQ ID NO: 370851 - RNA, 32 nt, Human
ccccgccccgccauccccagacuuccccgccu

SEQ ID NO: 370852 - RNA, 21 nt, Human
ccccgccccgcccccgcugcc

SEQ ID NO: 370853 - RNA, 18 nt, Human
ccccgccccgccccgccc

SEQ ID NO: 370854 - RNA, 19 nt, Human
ccccgccccgccgccgccg

SEQ ID NO: 370855 - RNA, 18 nt, Human
ccccgccccgccucgccc

SEQ ID NO: 370856 - RNA, 32 nt, Human
ccccgccccgcuccgcgccccgggcagccgug

SEQ ID NO: 370857 - RNA, 32 nt, Human
ccccgccccuagcucuucuacggaggggaacc

SEQ ID NO: 370858 - RNA, 18 nt, Human
ccccgccccuccccgccc

SEQ ID NO: 370859 - RNA, 32 nt, Human
ccccgccccugcccccgcuccggccagagggg

SEQ ID NO: 370860 - RNA, 32 nt, Human
ccccgccccugccuccucucgcugaccaauug

SEQ ID NO: 370861 - RNA, 22 nt, Human
ccccgccccugccugccauaga

SEQ ID NO: 370862 - RNA, 32 nt, Human
ccccgccccuggcccugaaucucccauguccu

SEQ ID NO: 370863 - RNA, 32 nt, Human
ccccgccccuucuccuccuccuaccugggccu

SEQ ID NO: 370864 - RNA, 32 nt, Human
ccccgcccgcccccaccccacacccacauccu

SEQ ID NO: 370865 - RNA, 19 nt, Human
ccccgcccgcccuccccca

SEQ ID NO: 370866 - RNA, 32 nt, Human
ccccgcccgccuggccuguccugagugcauuu

SEQ ID NO: 370867 - RNA, 19 nt, Human
ccccgcccguccccccucc

SEQ ID NO: 370868 - RNA, 19 nt, Human
ccccgcccuacccccucca

SEQ ID NO: 370869 - RNA, 19 nt, Human
ccccgcccuaccuccgccc

SEQ ID NO: 370870 - RNA, 23 nt, Human
ccccgcccuacugccagcacaga

SEQ ID NO: 370871 - RNA, 32 nt, Human
ccccgcccuccagcaguccugguagggcccgg

SEQ ID NO: 370872 - RNA, 32 nt, Human
ccccgcccuccaggcuucucguuccuggauau

SEQ ID NO: 370873 - RNA, 18 nt, Human
ccccgcccuccccaccca

SEQ ID NO: 370874 - RNA, 32 nt, Human
ccccgcccuccccgcaucccucuccucccucg

SEQ ID NO: 370875 - RNA, 32 nt, Human
ccccgcccuccccucucucauuuuucuuggug

SEQ ID NO: 370876 - RNA, 32 nt, Human
ccccgcccuccugguccaaucuccgaucuguu

SEQ ID NO: 370877 - RNA, 18 nt, Human
ccccgcccugaaggggca

SEQ ID NO: 370878 - RNA, 19 nt, Human
ccccgcccugcccccucca

SEQ ID NO: 370879 - RNA, 32 nt, Human
ccccgcccugcuccagagcguggaccgaggag

SEQ ID NO: 370880 - RNA, 32 nt, Human
ccccgcccuucagccccgcggucuccaggggc

SEQ ID NO: 370881 - RNA, 32 nt, Human
ccccgcccuuggucccuucucucacccagagu

SEQ ID NO: 370882 - RNA, 32 nt, Human
ccccgccgcagcuccagcuggccggcuugguc

SEQ ID NO: 370883 - RNA, 19 nt, Human
ccccgccgccaccgccccg

SEQ ID NO: 370884 - RNA, 32 nt, Human
ccccgccgccaucaccaccaccgucaccuccg

SEQ ID NO: 370885 - RNA, 22 nt, Human
ccccgccgccccgccaccgccg

SEQ ID NO: 370886 - RNA, 18 nt, Human
ccccgccgccgccgccgc

SEQ ID NO: 370887 - RNA, 20 nt, Human
ccccgccgccgccgccgccg

SEQ ID NO: 370888 - RNA, 16 nt, Human
ccccgccgccgcugcc

SEQ ID NO: 370889 - RNA, 17 nt, Human
ccccgccgccgcugccg

SEQ ID NO: 370890 - RNA, 17 nt, Human
ccccgccgccgcugcug

SEQ ID NO: 370891 - RNA, 32 nt, Human
ccccgccgccgcuuccuccacccccaguccgc

SEQ ID NO: 370892 - RNA, 32 nt, Human
ccccgccgcgcacuuccucuggugcaaucucc

SEQ ID NO: 370893 - RNA, 17 nt, Human
ccccgccgcgggccgug

SEQ ID NO: 370894 - RNA, 22 nt, Human
ccccgccgcgggcuaccggcgc

SEQ ID NO: 370895 - RNA, 32 nt, Human
ccccgccggcaccaugcuucccuugucacugc

SEQ ID NO: 370896 - RNA, 20 nt, Human
ccccgccggccgccgcgccg

SEQ ID NO: 370897 - RNA, 32 nt, Human
ccccgccggccuggccaggacugagugcagga

SEQ ID NO: 370898 - RNA, 32 nt, Human
ccccgccggcggcggaggcagcgagcgcgaga

SEQ ID NO: 370899 - RNA, 32 nt, Human
ccccgccgguggagcccgcucuucuggccugu

SEQ ID NO: 370900 - RNA, 24 nt, Human
ccccgccgucgccccgccgcgccg

SEQ ID NO: 370901 - RNA, 32 nt, Human
ccccgccgucgguccugucucagucccucagc

SEQ ID NO: 370902 - RNA, 32 nt, Human
ccccgccgucugcaguccagcauggaggcacc

SEQ ID NO: 370903 - RNA, 21 nt, Human
ccccgccgugagccccgcucc

SEQ ID NO: 370904 - RNA, 32 nt, Human
ccccgccguucccugcgcuucaucucaugagg

SEQ ID NO: 370905 - RNA, 23 nt, Human
ccccgccguucucagcgcugccc

SEQ ID NO: 370906 - RNA, 17 nt, Human
ccccgccucaacgccca

SEQ ID NO: 370907 - RNA, 32 nt, Human
ccccgccucacagcugacagcgccagucccag

SEQ ID NO: 370908 - RNA, 32 nt, Human
ccccgccucauuccucacgccgagcuccagac

SEQ ID NO: 370909 - RNA, 32 nt, Human
ccccgccuccaggacagagccucggucugcau

SEQ ID NO: 370910 - RNA, 22 nt, Human
ccccgccucccagccccagggg

SEQ ID NO: 370911 - RNA, 21 nt, Human
ccccgccuccccacucugccc

SEQ ID NO: 370912 - RNA, 16 nt, Human
ccccgccuccccgccc

SEQ ID NO: 370913 - RNA, 21 nt, Human
ccccgccuccgaccccgcucu

SEQ ID NO: 370914 - RNA, 32 nt, Human
ccccgccuccuccuccugcuuugaccugaugc

SEQ ID NO: 370915 - RNA, 32 nt, Human
ccccgccuccuuggcagccucuggcggcagcg

SEQ ID NO: 370916 - RNA, 25 nt, Human
ccccgccucgggccguccccgccca

SEQ ID NO: 370917 - RNA, 32 nt, Human
ccccgccucucagcacagggcaggggcugcag

SEQ ID NO: 370918 - RNA, 32 nt, Human
ccccgccucugcccucauccucccucucgucu

SEQ ID NO: 370919 - RNA, 22 nt, Human
ccccgccucuguccccuggccu

SEQ ID NO: 370920 - RNA, 21 nt, Human
ccccgccucuucauccgucca

SEQ ID NO: 370921 - RNA, 32 nt, Human
ccccgccucuugcgcccugccuggcucccucu

SEQ ID NO: 370922 - RNA, 32 nt, Human
ccccgccugccugccacccugccccuugccau

SEQ ID NO: 370923 - RNA, 32 nt, Human
ccccgccugccuggacugcgcggcgccgugag

SEQ ID NO: 370924 - RNA, 32 nt, Human
ccccgccugcugcagcuccucccagaaccgcc

SEQ ID NO: 370925 - RNA, 32 nt, Human
ccccgccuggcaccccuggcugugcuguggcc

SEQ ID NO: 370926 - RNA, 32 nt, Human
ccccgccuggcgccugcccuccagggcugggg

SEQ ID NO: 370927 - RNA, 32 nt, Human
ccccgccuggcucuccccucuaaagcgcccgg

SEQ ID NO: 370928 - RNA, 16 nt, Human
ccccgccugggccaug

SEQ ID NO: 370929 - RNA, 32 nt, Human
ccccgccuguccugccucucugcuccagagag

SEQ ID NO: 370930 - RNA, 32 nt, Human
ccccgccuucacccacugccucugccucccug

SEQ ID NO: 370931 - RNA, 32 nt, Human
ccccgccuuccgccccuucccuucccuaaagu

SEQ ID NO: 370932 - RNA, 17 nt, Human
ccccgccuuucccccca

SEQ ID NO: 370933 - RNA, 32 nt, Human
ccccgcgagccccagcgcccuggcagucagca

SEQ ID NO: 370934 - RNA, 32 nt, Human
ccccgcgagucccucaagcgggaaccugccuc

SEQ ID NO: 370935 - RNA, 19 nt, Human
ccccgcgccacuccgcgcc

SEQ ID NO: 370936 - RNA, 21 nt, Human
ccccgcgccccagcccugccc

SEQ ID NO: 370937 - RNA, 17 nt, Human
ccccgcgccccgcgccg

SEQ ID NO: 370938 - RNA, 22 nt, Human
ccccgcgccccgcgccgcgccg

SEQ ID NO: 370939 - RNA, 24 nt, Human
ccccgcgcccugcccuccgcgccg

SEQ ID NO: 370940 - RNA, 22 nt, Human
ccccgcgccgccgccgccgccg

SEQ ID NO: 370941 - RNA, 21 nt, Human
ccccgcgccgccgcggccagg

SEQ ID NO: 370942 - RNA, 18 nt, Human
ccccgcgcgccccggguc

SEQ ID NO: 370943 - RNA, 32 nt, Human
ccccgcgcuccccucccucuccacucggcacc

SEQ ID NO: 370944 - RNA, 32 nt, Human
ccccgcgcucgcccuccgccucgcccgagccc

SEQ ID NO: 370945 - RNA, 25 nt, Human
ccccgcgcugccccacgccgcgccg

SEQ ID NO: 370946 - RNA, 25 nt, Human
ccccgcgcuuccgcugcagcgcaga

SEQ ID NO: 370947 - RNA, 32 nt, Human
ccccgcggacugacagcaccaggaaaccaaau

SEQ ID NO: 370948 - RNA, 20 nt, Human
ccccgcggagccgccgcgcc

SEQ ID NO: 370949 - RNA, 23 nt, Human
ccccgcggcccggaguccauccc

SEQ ID NO: 370950 - RNA, 20 nt, Human
ccccgcggccgucccuccuc

SEQ ID NO: 370951 - RNA, 19 nt, Human
ccccgcggcgcagcacgga

SEQ ID NO: 370952 - RNA, 23 nt, Human
ccccgcggcgcccgcagcgcgga

SEQ ID NO: 370953 - RNA, 32 nt, Human
ccccgcggcucuccucuucuucaucucuguuu

SEQ ID NO: 370954 - RNA, 18 nt, Human
ccccgcggcugggcccug

SEQ ID NO: 370955 - RNA, 26 nt, Human
ccccgcggcugggcccugccgcgccg

SEQ ID NO: 370956 - RNA, 32 nt, Human
ccccgcggugcccucucuccucccucuuugug

SEQ ID NO: 370957 - RNA, 24 nt, Human
ccccgcgguguccuggacugugca

SEQ ID NO: 370958 - RNA, 28 nt, Human
ccccgcguagccgcugccuccuccuacc

SEQ ID NO: 370959 - RNA, 21 nt, Human
ccccgcgucccagcccugccc

SEQ ID NO: 370960 - RNA, 22 nt, Human
ccccgcgucccccgccgcgccg

SEQ ID NO: 370961 - RNA, 21 nt, Human
ccccgcguccccgcgcgcgag

SEQ ID NO: 370962 - RNA, 32 nt, Human
ccccgcguguuucugcccugugacuccuggaa

SEQ ID NO: 370963 - RNA, 32 nt, Human
ccccgcuacacuccagccuggucgacagagug

SEQ ID NO: 370964 - RNA, 18 nt, Human
ccccgcuccccaacaccu

SEQ ID NO: 370965 - RNA, 32 nt, Human
ccccgcuccccaggacuucagagauguugcac

SEQ ID NO: 370966 - RNA, 32 nt, Human
ccccgcucccccucaccagcaguacuccuuug

SEQ ID NO: 370967 - RNA, 32 nt, Human
ccccgcucccuccucccugccuucucugcugg

SEQ ID NO: 370968 - RNA, 32 nt, Human
ccccgcuccgccaccagggcuugggggcgggg

SEQ ID NO: 370969 - RNA, 32 nt, Human
ccccgcuccucggggcccuccaaggugucucc

SEQ ID NO: 370970 - RNA, 32 nt, Human
ccccgcuccugcugcugacggcgcccaggaaa

SEQ ID NO: 370971 - RNA, 32 nt, Human
ccccgcucuccucucugcccccugcccucccc

SEQ ID NO: 370972 - RNA, 32 nt, Human
ccccgcucugcaggaugggcacagugcugucu

SEQ ID NO: 370973 - RNA, 32 nt, Human
ccccgcucugcaggccgcccuucugccagcug

SEQ ID NO: 370974 - RNA, 32 nt, Human
ccccgcucugcccacagacuccgauggcugcg

SEQ ID NO: 370975 - RNA, 32 nt, Human
ccccgcugaacagcagcuguucccagcgccag

SEQ ID NO: 370976 - RNA, 31 nt, Human
ccccgcugacgcuucccuugccguuggcuuu

SEQ ID NO: 370977 - RNA, 32 nt, Human
ccccgcugagccuucacugugggccagcuucc

SEQ ID NO: 370978 - RNA, 32 nt, Human
ccccgcugagcugcugccuggugaagaggaag

SEQ ID NO: 370979 - RNA, 32 nt, Human
ccccgcugcaggaaggccgcggcagagggggc

SEQ ID NO: 370980 - RNA, 32 nt, Human
ccccgcugcauccuuucugugagguaccuuac

SEQ ID NO: 370981 - RNA, 32 nt, Human
ccccgcugcccaggauuagggucuguggugug

SEQ ID NO: 370982 - RNA, 32 nt, Human
ccccgcugccugcccugcuccaggcuccaccu

SEQ ID NO: 370983 - RNA, 16 nt, Human
ccccgcugcucccggg

SEQ ID NO: 370984 - RNA, 32 nt, Human
ccccgcugcucgggcuggagaauagaugguuu

SEQ ID NO: 370985 - RNA, 22 nt, Human
ccccgcugcucugcuccgccca

SEQ ID NO: 370986 - RNA, 15 nt, Human
ccccgcugcuugcca

SEQ ID NO: 370987 - RNA, 24 nt, Human
ccccgcuggcagaugaccaggacc

SEQ ID NO: 370988 - RNA, 32 nt, Human
ccccgcuggcugcugcucacauggugucuggg

SEQ ID NO: 370989 - RNA, 29 nt, Human
ccccgcuggcugcuuucuuccugccccug

SEQ ID NO: 370990 - RNA, 32 nt, Human
ccccgcuguagccucaggccugacggcgacuc

SEQ ID NO: 370991 - RNA, 32 nt, Human
ccccgcugucucccccugccccgagucuggaa

SEQ ID NO: 370992 - RNA, 32 nt, Human
ccccgcuguggaaacaugggcgcucugcucug

SEQ ID NO: 370993 - RNA, 20 nt, Human
ccccgcuguguggacauggg

SEQ ID NO: 370994 - RNA, 32 nt, Human
ccccgcuguuuggcccaggccugggccaugac

SEQ ID NO: 370995 - RNA, 32 nt, Human
ccccgcuuccacccuccaaccucccccaaaua

SEQ ID NO: 370996 - RNA, 32 nt, Human
ccccgcuuccgcccgcuguccugcugcacgaa

SEQ ID NO: 370997 - RNA, 32 nt, Human
ccccgcuuccugcccucaaccugggcaugcgc

SEQ ID NO: 370998 - RNA, 32 nt, Human
ccccgcuucucuggaggggaggcggugcggga

SEQ ID NO: 370999 - RNA, 32 nt, Human
ccccgcuuuugacuuuuggcagccucuucagg

SEQ ID NO: 371000 - RNA, 32 nt, Human
ccccggaaccgagccagccacugaggggagcu

SEQ ID NO: 371001 - RNA, 32 nt, Human
ccccggaaucaccccucuucccaugccccucu

SEQ ID NO: 371002 - RNA, 32 nt, Human
ccccggaauucuuuaauagucaccuucaugau

SEQ ID NO: 371003 - RNA, 20 nt, Human
ccccggacaccugggaccug

SEQ ID NO: 371004 - RNA, 32 nt, Human
ccccggacagaggucugccccacccacuuccu

SEQ ID NO: 371005 - RNA, 32 nt, Human
ccccggacagccgccucaggccccagcucgaa

SEQ ID NO: 371006 - RNA, 32 nt, Human
ccccggaccacccucccugccggcuuugggug

SEQ ID NO: 371007 - RNA, 32 nt, Human
ccccggaccagggagagcagugagcuggagcu

SEQ ID NO: 371008 - RNA, 32 nt, Human
ccccggaccaggggccgcgccgccaccaugcu

SEQ ID NO: 371009 - RNA, 32 nt, Human
ccccggaccccuggcaugcaugcuggcggcgg

SEQ ID NO: 371010 - RNA, 32 nt, Human
ccccggaccuuccccaccgccugggcccgagg

SEQ ID NO: 371011 - RNA, 20 nt, Human
ccccggacuacagcacggaa

SEQ ID NO: 371012 - RNA, 32 nt, Human
ccccggagaagcuccgggaggaguagcuguca

SEQ ID NO: 371013 - RNA, 32 nt, Human
ccccggagaaggcagcgagcgcagugacagcg

SEQ ID NO: 371014 - RNA, 32 nt, Human
ccccggagacggagcuuccugagggcagggag

SEQ ID NO: 371015 - RNA, 32 nt, Human
ccccggagaggcggagggaagggaggcgaggc

SEQ ID NO: 371016 - RNA, 32 nt, Human
ccccggagauggagguugcagugagccaagau

SEQ ID NO: 371017 - RNA, 32 nt, Human
ccccggagccacagcacaaucaucucaguggc

SEQ ID NO: 371018 - RNA, 21 nt, Human
ccccggagccauccuuagggc

SEQ ID NO: 371019 - RNA, 32 nt, Human
ccccggagccgcgcugccucucggguguccug

SEQ ID NO: 371020 - RNA, 20 nt, Human
ccccggagccgucucagguc

SEQ ID NO: 371021 - RNA, 32 nt, Human
ccccggagccuggggcacggcagggagaagac

SEQ ID NO: 371022 - RNA, 32 nt, Human
ccccggaggagaagaaguaggggagaggagag

SEQ ID NO: 371023 - RNA, 32 nt, Human
ccccggaggcggagcuugcagugagccgagau

SEQ ID NO: 371024 - RNA, 23 nt, Human
ccccggaggcggagguugcagug

SEQ ID NO: 371025 - RNA, 32 nt, Human
ccccggaggcggagguugcagugagcugagaa

SEQ ID NO: 371026 - RNA, 32 nt, Human
ccccggagggagggaggaguucccugggcuuc

SEQ ID NO: 371027 - RNA, 32 nt, Human
ccccggagguagagguugcagugagccgagau

SEQ ID NO: 371028 - RNA, 32 nt, Human
ccccggagguagagguugcagugagcugagau

SEQ ID NO: 371029 - RNA, 32 nt, Human
ccccggauccugcuuuuguccagaugggccuc

SEQ ID NO: 371030 - RNA, 32 nt, Human
ccccggaucugcauguggaaguaccuggacgu

SEQ ID NO: 371031 - RNA, 22 nt, Human
ccccggaugccagcaccugcca

SEQ ID NO: 371032 - RNA, 22 nt, Human
ccccggaugccccacuagucca

SEQ ID NO: 371033 - RNA, 19 nt, Human
ccccggaugcugggcccug

SEQ ID NO: 371034 - RNA, 21 nt, Human
ccccggaugggccaccugccu

SEQ ID NO: 371035 - RNA, 22 nt, Human
ccccggauggggacccuuccca

SEQ ID NO: 371036 - RNA, 32 nt, Human
ccccggcaaccuauuugcuuauucugggcauu

SEQ ID NO: 371037 - RNA, 32 nt, Human
ccccggcaagccacaggaaggaggggagagac

SEQ ID NO: 371038 - RNA, 32 nt, Human
ccccggcaagccuacugaaagccagccgaacc

SEQ ID NO: 371039 - RNA, 32 nt, Human
ccccggcacacagcaggggcuuaauagauauu

SEQ ID NO: 371040 - RNA, 32 nt, Human
ccccggcaccccucccccucgggcgccagccc

SEQ ID NO: 371041 - RNA, 32 nt, Human
ccccggcagagcugggguugaagaggcagcuu

SEQ ID NO: 371042 - RNA, 32 nt, Human
ccccggcagaggacacuugucggcacguucuc

SEQ ID NO: 371043 - RNA, 25 nt, Human
ccccggcaggcgaggcgccuggcca

SEQ ID NO: 371044 - RNA, 32 nt, Human
ccccggcaggcgcggcagcaacaguuccugga

SEQ ID NO: 371045 - RNA, 32 nt, Human
ccccggcagugcaguccagcggggaggaggcu

SEQ ID NO: 371046 - RNA, 22 nt, Human
ccccggccaaggcgccuggacc

SEQ ID NO: 371047 - RNA, 32 nt, Human
ccccggccacaucuccuccaaacacacacagg

SEQ ID NO: 371048 - RNA, 32 nt, Human
ccccggccagcugggccccucccaggcacugc

SEQ ID NO: 371049 - RNA, 32 nt, Human
ccccggccaggaggccagaucggugaggugga

SEQ ID NO: 371050 - RNA, 22 nt, Human
ccccggccaggggccaaggagc

SEQ ID NO: 371051 - RNA, 24 nt, Human
ccccggccagggucccuuaacacc

SEQ ID NO: 371052 - RNA, 32 nt, Human
ccccggccagggucccuuaacaccucggcaca

SEQ ID NO: 371053 - RNA, 26 nt, Human
ccccggccaugagagggugcagugag

SEQ ID NO: 371054 - RNA, 22 nt, Human
ccccggccccagacccagagcc

SEQ ID NO: 371055 - RNA, 18 nt, Human
ccccggccccagcugagu

SEQ ID NO: 371056 - RNA, 32 nt, Human
ccccggcccccgugguucccagccgcacagua

SEQ ID NO: 371057 - RNA, 32 nt, Human
ccccggccccuaaaacauucauuaagucuggg

SEQ ID NO: 371058 - RNA, 19 nt, Human
ccccggcccggccuccagg

SEQ ID NO: 371059 - RNA, 32 nt, Human
ccccggcccgugcuguccgcugggugaggcag

SEQ ID NO: 371060 - RNA, 32 nt, Human
ccccggcccucgccucagccccggccccuggu

SEQ ID NO: 371061 - RNA, 32 nt, Human
ccccggcccugccuccccaggcggugccccug

SEQ ID NO: 371062 - RNA, 21 nt, Human
ccccggcccugcuccagaacc

SEQ ID NO: 371063 - RNA, 32 nt, Human
ccccggccgcaggcugugccccggcuguggcg

SEQ ID NO: 371064 - RNA, 19 nt, Human
ccccggccguccccccuca

SEQ ID NO: 371065 - RNA, 20 nt, Human
ccccggccgugacccaggcc

SEQ ID NO: 371066 - RNA, 32 nt, Human
ccccggccuagaccugccuaggacucuguggc

SEQ ID NO: 371067 - RNA, 32 nt, Human
ccccggccucagccuaaccaggaaaggggcuc

SEQ ID NO: 371068 - RNA, 20 nt, Human
ccccggccucauccuccuca

SEQ ID NO: 371069 - RNA, 32 nt, Human
ccccggccuccaccccagcuccccuggccucc

SEQ ID NO: 371070 - RNA, 32 nt, Human
ccccggccuccagggacuccuagcgcggcccg

SEQ ID NO: 371071 - RNA, 32 nt, Human
ccccggccuccccucgccccuuccccuccccc

SEQ ID NO: 371072 - RNA, 32 nt, Human
ccccggccuccuggucggcuguuuagagcuga

SEQ ID NO: 371073 - RNA, 22 nt, Human
ccccggccucugugcccaggcc

SEQ ID NO: 371074 - RNA, 32 nt, Human
ccccggccucuucuccauccugcuuggaccag

SEQ ID NO: 371075 - RNA, 32 nt, Human
ccccggcgaucugucugaguuuucuuccuccu

SEQ ID NO: 371076 - RNA, 22 nt, Human
ccccggcgauggugacacaugc

SEQ ID NO: 371077 - RNA, 22 nt, Human
ccccggcgccccgccccuccuc

SEQ ID NO: 371078 - RNA, 32 nt, Human
ccccggcgcccgcgucuuccacgggcacaggg

SEQ ID NO: 371079 - RNA, 32 nt, Human
ccccggcgcccgcgucuuccacgggcacaggu

SEQ ID NO: 371080 - RNA, 32 nt, Human
ccccggcgccgcccauauccccggcugcgcua

SEQ ID NO: 371081 - RNA, 23 nt, Human
ccccggcgcuccaggccgcgccc

SEQ ID NO: 371082 - RNA, 32 nt, Human
ccccggcgcugaggccccgaggaucggggcgg

SEQ ID NO: 371083 - RNA, 32 nt, Human
ccccggcggccgccaccucuccccagcccagg

SEQ ID NO: 371084 - RNA, 32 nt, Human
ccccggcggcgcgcuccagccgguguaggcga

SEQ ID NO: 371085 - RNA, 32 nt, Human
ccccggcgggcuguggcaggagggcggcggcg

SEQ ID NO: 371086 - RNA, 32 nt, Human
ccccggcguccccgggcaccaugcuguccaac

SEQ ID NO: 371087 - RNA, 32 nt, Human
ccccggcucagcucucuccaucugccuggcuc

SEQ ID NO: 371088 - RNA, 22 nt, Human
ccccggcucagcugagcugggg

SEQ ID NO: 371089 - RNA, 22 nt, Human
ccccggcuccagagcucagggg

SEQ ID NO: 371090 - RNA, 32 nt, Human
ccccggcuccccucggccgccuagcccgccuc

SEQ ID NO: 371091 - RNA, 19 nt, Human
ccccggcucccgacgccag

SEQ ID NO: 371092 - RNA, 32 nt, Human
ccccggcucuccccacgccccugccagagacc

SEQ ID NO: 371093 - RNA, 19 nt, Human
ccccggcucucggcaccug

SEQ ID NO: 371094 - RNA, 32 nt, Human
ccccggcucuggcgucccuggcugccaagccu

SEQ ID NO: 371095 - RNA, 21 nt, Human
ccccggcucuuacccaggacc

SEQ ID NO: 371096 - RNA, 32 nt, Human
ccccggcugcaaccucucccacucaagagacc

SEQ ID NO: 371097 - RNA, 32 nt, Human
ccccggcugcagcugcacucacauguggccac

SEQ ID NO: 371098 - RNA, 32 nt, Human
ccccggcugccaucuccuccuccugggccgcc

SEQ ID NO: 371099 - RNA, 32 nt, Human
ccccggcugggcagcagcggggacgccggggg

SEQ ID NO: 371100 - RNA, 22 nt, Human
ccccggcuucaggauuuacaca

SEQ ID NO: 371101 - RNA, 20 nt, Human
ccccggcuucccucuucugu

SEQ ID NO: 371102 - RNA, 18 nt, Human
ccccggcuucccuggccu

SEQ ID NO: 371103 - RNA, 32 nt, Human
ccccggcuuuauuccuccaccucuugcuccaa

SEQ ID NO: 371104 - RNA, 18 nt, Human
ccccgggaaagcuggugg

SEQ ID NO: 371105 - RNA, 25 nt, Human
ccccgggaagagaaacuugcaguga

SEQ ID NO: 371106 - RNA, 19 nt, Human
ccccgggacccgccggggg

SEQ ID NO: 371107 - RNA, 20 nt, Human
ccccgggacccugccugccu

SEQ ID NO: 371108 - RNA, 32 nt, Human
ccccgggaccguguugcuccaguauuaaccuc

SEQ ID NO: 371109 - RNA, 32 nt, Human
ccccgggacgccugagaguaaugggcgcgagg

SEQ ID NO: 371110 - RNA, 32 nt, Human
ccccgggacuccccaagcccagccucugugug

SEQ ID NO: 371111 - RNA, 32 nt, Human
ccccgggagacaccucagacccccgacagccu

SEQ ID NO: 371112 - RNA, 32 nt, Human
ccccgggagcagccggcagacagaggcaagac

SEQ ID NO: 371113 - RNA, 19 nt, Human
ccccgggagcggggccaug

SEQ ID NO: 371114 - RNA, 20 nt, Human
ccccgggagggcagagccag

SEQ ID NO: 371115 - RNA, 32 nt, Human
ccccgggagguacagcuggcagagggaaaggc

SEQ ID NO: 371116 - RNA, 32 nt, Human
ccccgggagguggaggcugcagugaguuguga

SEQ ID NO: 371117 - RNA, 32 nt, Human
ccccgggcaaauaggcuccgagggccccgggg

SEQ ID NO: 371118 - RNA, 32 nt, Human
ccccgggcaagaugcaccuccuguccaagucu

SEQ ID NO: 371119 - RNA, 32 nt, Human
ccccgggcacugccucacagccaaggcuggac

SEQ ID NO: 371120 - RNA, 32 nt, Human
ccccgggcacugcugcucauagguaccuuucc

SEQ ID NO: 371121 - RNA, 32 nt, Human
ccccgggcagagaaagccgagcagagcugggu

SEQ ID NO: 371122 - RNA, 25 nt, Human
ccccgggcagaggaaauugcaguga

SEQ ID NO: 371123 - RNA, 32 nt, Human
ccccgggcagaggcgcuugcccacgggacguu

SEQ ID NO: 371124 - RNA, 22 nt, Human
ccccgggcagcggcacccgcca

SEQ ID NO: 371125 - RNA, 32 nt, Human
ccccgggcagggcggggccgcucgcagacucc

SEQ ID NO: 371126 - RNA, 25 nt, Human
ccccgggccacggggacugcaguga

SEQ ID NO: 371127 - RNA, 24 nt, Human
ccccgggccagcagggaugggguu

SEQ ID NO: 371128 - RNA, 32 nt, Human
ccccgggccaguguccaucauccaggugcuca

SEQ ID NO: 371129 - RNA, 25 nt, Human
ccccgggcccaagaggaugcgguga

SEQ ID NO: 371130 - RNA, 32 nt, Human
ccccgggccccggagcgcgguggagaagcccc

SEQ ID NO: 371131 - RNA, 32 nt, Human
ccccgggcccggccccugcccugcugccccca

SEQ ID NO: 371132 - RNA, 25 nt, Human
ccccgggcccuaggguuugcaguga

SEQ ID NO: 371133 - RNA, 32 nt, Human
ccccgggcccugauggacugaaugaaggcugc

SEQ ID NO: 371134 - RNA, 25 nt, Human
ccccgggccggccagccuccugccu

SEQ ID NO: 371135 - RNA, 32 nt, Human
ccccgggccuccgccccuuccugggccucucg

SEQ ID NO: 371136 - RNA, 32 nt, Human
ccccgggccuggaggggguggggagggagaag

SEQ ID NO: 371137 - RNA, 18 nt, Human
ccccgggccuggggcaug

SEQ ID NO: 371138 - RNA, 32 nt, Human
ccccgggccuguccaguguccucuggccugcu

SEQ ID NO: 371139 - RNA, 26 nt, Human
ccccgggccuuggaugguugugguga

SEQ ID NO: 371140 - RNA, 18 nt, Human
ccccgggcgcgcccgccg

SEQ ID NO: 371141 - RNA, 22 nt, Human
ccccgggcgcuccuccccaggc

SEQ ID NO: 371142 - RNA, 19 nt, Human
ccccgggcggggauggggc

SEQ ID NO: 371143 - RNA, 32 nt, Human
ccccgggcucgagucucugccugcccaguggc

SEQ ID NO: 371144 - RNA, 32 nt, Human
ccccgggcucggaacuauaggaaaagacucuu

SEQ ID NO: 371145 - RNA, 32 nt, Human
ccccgggcugcaccccuuccucuucucuuucu

SEQ ID NO: 371146 - RNA, 32 nt, Human
ccccgggcugccagcccgugagguccgugagg

SEQ ID NO: 371147 - RNA, 25 nt, Human
ccccgggcugcgucgggaccugcca

SEQ ID NO: 371148 - RNA, 21 nt, Human
ccccgggcuggagugcagugg

SEQ ID NO: 371149 - RNA, 32 nt, Human
ccccgggcuuccccagcagccaccaaggccug

SEQ ID NO: 371150 - RNA, 25 nt, Human
ccccgggcuugggagguuccagugg

SEQ ID NO: 371151 - RNA, 32 nt, Human
ccccggggaggcaggcuggcagguggacaggc

SEQ ID NO: 371152 - RNA, 32 nt, Human
ccccggggaggcaggggcagaggucagaaggg

SEQ ID NO: 371153 - RNA, 21 nt, Human
ccccggggaggcagugcagcc

SEQ ID NO: 371154 - RNA, 32 nt, Human
ccccggggaggguggaaggccaggcguggggc

SEQ ID NO: 371155 - RNA, 20 nt, Human
ccccggggcacccuccuguc

SEQ ID NO: 371156 - RNA, 32 nt, Human
ccccggggcagcuccugccaccaguccucucc

SEQ ID NO: 371157 - RNA, 32 nt, Human
ccccggggcaggcucucucuccccagcagugu

SEQ ID NO: 371158 - RNA, 25 nt, Human
ccccggggcauggacagggccaggg

SEQ ID NO: 371159 - RNA, 32 nt, Human
ccccggggcgcucugcccuggagacuccggac

SEQ ID NO: 371160 - RNA, 32 nt, Human
ccccggggcucacgccuguaaucccaacacuu

SEQ ID NO: 371161 - RNA, 32 nt, Human
ccccggggcugccguuuugcugggcagugguu

SEQ ID NO: 371162 - RNA, 32 nt, Human
ccccgggggcacaucccucagcaggacagcaa

SEQ ID NO: 371163 - RNA, 22 nt, Human
ccccggggggauggcccaggcc

SEQ ID NO: 371164 - RNA, 26 nt, Human
ccccggggucucgccagccccuuccu

SEQ ID NO: 371165 - RNA, 23 nt, Human
ccccggggugaggccuccugccu

SEQ ID NO: 371166 - RNA, 32 nt, Human
ccccgggguuccaggccuggcaugguucaggg

SEQ ID NO: 371167 - RNA, 21 nt, Human
ccccggguacgagcuggcccc

SEQ ID NO: 371168 - RNA, 32 nt, Human
ccccgggugcuucuguggucaggcugggacag

SEQ ID NO: 371169 - RNA, 24 nt, Human
ccccgggugugaagcacagacccc

SEQ ID NO: 371170 - RNA, 32 nt, Human
ccccggguucaaaccauucuccugccucagcc

SEQ ID NO: 371171 - RNA, 32 nt, Human
ccccggguucaagcgauucuccugccucagcc

SEQ ID NO: 371172 - RNA, 32 nt, Human
ccccggguucaagugauucuccugccucagcc

SEQ ID NO: 371173 - RNA, 27 nt, Human
ccccggguucauuggggguugaagugg

SEQ ID NO: 371174 - RNA, 32 nt, Human
ccccggguucgcaccauucuccugccucagcc

SEQ ID NO: 371175 - RNA, 25 nt, Human
ccccggguuugggagguugaagugg

SEQ ID NO: 371176 - RNA, 26 nt, Human
ccccggguuugggggaaguguaguga

SEQ ID NO: 371177 - RNA, 32 nt, Human
ccccggucagcaaggaagacccugagcaggac

SEQ ID NO: 371178 - RNA, 32 nt, Human
ccccggucagcucugcaucagguguuuucuga

SEQ ID NO: 371179 - RNA, 32 nt, Human
ccccggucccucagccccuucucccccgucag

SEQ ID NO: 371180 - RNA, 21 nt, Human
ccccggucccuccccucccca

SEQ ID NO: 371181 - RNA, 32 nt, Human
ccccgguccuccucauuagggugcagggccua

SEQ ID NO: 371182 - RNA, 32 nt, Human
ccccggucgcaggaguccggggagggccggga

SEQ ID NO: 371183 - RNA, 32 nt, Human
ccccggucuaggaucgaaauguuaacaccggg

SEQ ID NO: 371184 - RNA, 32 nt, Human
ccccggugacauggcugugcccugccauccca

SEQ ID NO: 371185 - RNA, 32 nt, Human
ccccggugcagcccuggcgggaccgcagcaac

SEQ ID NO: 371186 - RNA, 32 nt, Human
ccccggugcuaccaccaccgcgcagauuauau

SEQ ID NO: 371187 - RNA, 32 nt, Human
ccccgguggcaguguuggagacuugcuccggc

SEQ ID NO: 371188 - RNA, 32 nt, Human
ccccgguuauuuccucagcuauuuccaccaaa

SEQ ID NO: 371189 - RNA, 32 nt, Human
ccccgguuauuuccucagcuguuuccaccaaa

SEQ ID NO: 371190 - RNA, 23 nt, Human
ccccgguucccuugugggggcuu

SEQ ID NO: 371191 - RNA, 32 nt, Human
ccccgguuucccuccuccuuuuaacuucaacu

SEQ ID NO: 371192 - RNA, 32 nt, Human
ccccguaaagggcugaucuuccaccucgccac

SEQ ID NO: 371193 - RNA, 32 nt, Human
ccccguacaagggcaacccuguuucuuuggug

SEQ ID NO: 371194 - RNA, 18 nt, Human
ccccguagccuagagcag

SEQ ID NO: 371195 - RNA, 32 nt, Human
ccccguaucauccaugggucucuggcuccuga

SEQ ID NO: 371196 - RNA, 32 nt, Human
ccccguauccaucucugugcuggguccugccu

SEQ ID NO: 371197 - RNA, 32 nt, Human
ccccguaugccccuccucgugaaaggccugcc

SEQ ID NO: 371198 - RNA, 32 nt, Human
ccccgucaagcagagggaggcacuuucacccg

SEQ ID NO: 371199 - RNA, 32 nt, Human
ccccgucagacccacugggagauggcugcuug

SEQ ID NO: 371200 - RNA, 32 nt, Human
ccccgucagcggccgccccaggaagaggcuuc

SEQ ID NO: 371201 - RNA, 19 nt, Human
ccccgucccaccccugccu

SEQ ID NO: 371202 - RNA, 19 nt, Human
ccccguccccgccccgccc

SEQ ID NO: 371203 - RNA, 32 nt, Human
ccccguccccucccucagcccccacucgcucc

SEQ ID NO: 371204 - RNA, 20 nt, Human
ccccgucccucuccuaccuc

SEQ ID NO: 371205 - RNA, 32 nt, Human
ccccguccgggaugugaggagcgucucucccu

SEQ ID NO: 371206 - RNA, 32 nt, Human
ccccguccgggaugugaggagcgucucugccc

SEQ ID NO: 371207 - RNA, 32 nt, Human
ccccguccucccaccaccccagggggcaggca

SEQ ID NO: 371208 - RNA, 32 nt, Human
ccccguccucguggagcuuagcaggcagcugg

SEQ ID NO: 371209 - RNA, 22 nt, Human
ccccguccucuuguccuccuca

SEQ ID NO: 371210 - RNA, 32 nt, Human
ccccguccugccucccaccacacuuacacaca

SEQ ID NO: 371211 - RNA, 32 nt, Human
ccccguccuuaccccuuccuuuccuuaccuug

SEQ ID NO: 371212 - RNA, 32 nt, Human
ccccgucgcacaggcuggagugcaguggcaaa

SEQ ID NO: 371213 - RNA, 20 nt, Human
ccccgucgccgccgccgccg

SEQ ID NO: 371214 - RNA, 24 nt, Human
ccccgucgcucucguccauccuca

SEQ ID NO: 371215 - RNA, 20 nt, Human
ccccgucggcacugccggcc

SEQ ID NO: 371216 - RNA, 32 nt, Human
ccccgucuaaccacagcuccuuuuccagagca

SEQ ID NO: 371217 - RNA, 17 nt, Human
ccccgucuaccccucca

SEQ ID NO: 371218 - RNA, 32 nt, Human
ccccgucuccacugaaaauagaaaaauuagcu

SEQ ID NO: 371219 - RNA, 32 nt, Human
ccccgucuccauggucccgaccaggaagggaa

SEQ ID NO: 371220 - RNA, 32 nt, Human
ccccgucucccugcuugguucuccccucccuu

SEQ ID NO: 371221 - RNA, 32 nt, Human
ccccgucuccuccucaggcucggaccauggug

SEQ ID NO: 371222 - RNA, 32 nt, Human
ccccgucuccuccucuugcucccucggccggg

SEQ ID NO: 371223 - RNA, 32 nt, Human
ccccgucucuuucucaccuuucccaccucucu

SEQ ID NO: 371224 - RNA, 19 nt, Human
ccccgucugcccuggguca

SEQ ID NO: 371225 - RNA, 32 nt, Human
ccccgucugcugcuggacacagagccaugaag

SEQ ID NO: 371226 - RNA, 32 nt, Human
ccccgucugucugcuuuccccaccuccucccc

SEQ ID NO: 371227 - RNA, 32 nt, Human
ccccgucuguguuccgaggcuuggugacaaau

SEQ ID NO: 371228 - RNA, 32 nt, Human
ccccgucuucucuucacugaugcacauagaug

SEQ ID NO: 371229 - RNA, 32 nt, Human
ccccgucuucuuugccaaguucuugagggcaa

SEQ ID NO: 371230 - RNA, 32 nt, Human
ccccgucuuugcuucccugccugcugcugccc

SEQ ID NO: 371231 - RNA, 32 nt, Human
ccccgucuuuucuuuccacaccccugugcccg

SEQ ID NO: 371232 - RNA, 32 nt, Human
ccccgugacucagucccucugaagggagcagc

SEQ ID NO: 371233 - RNA, 17 nt, Human
ccccgugacucugccuc

SEQ ID NO: 371234 - RNA, 32 nt, Human
ccccgugagcuacaaccuggccuucagcaccc

SEQ ID NO: 371235 - RNA, 32 nt, Human
ccccgugaggaggcggcggcggcuauggagau

SEQ ID NO: 371236 - RNA, 32 nt, Human
ccccgugauucugcccacgcuccuccaccacg

SEQ ID NO: 371237 - RNA, 32 nt, Human
ccccgugccccaggcauggcaagcgccugccu

SEQ ID NO: 371238 - RNA, 32 nt, Human
ccccgugcccugcacaaaaaccaccaccagca

SEQ ID NO: 371239 - RNA, 32 nt, Human
ccccgugcccugcugauguugacacugacccc

SEQ ID NO: 371240 - RNA, 32 nt, Human
ccccgugcccuuuaaccggcauuugcugcuaa

SEQ ID NO: 371241 - RNA, 19 nt, Human
ccccgugccgccgccgccg

SEQ ID NO: 371242 - RNA, 32 nt, Human
ccccgugccuggccuuuaguuuuuauauuuug

SEQ ID NO: 371243 - RNA, 32 nt, Human
ccccgugcuggugggacugaggagaacgccgu

SEQ ID NO: 371244 - RNA, 32 nt, Human
ccccguggaaguggccccugauauggauugua

SEQ ID NO: 371245 - RNA, 32 nt, Human
ccccguggagucugcagagaggccuuggccag

SEQ ID NO: 371246 - RNA, 32 nt, Human
ccccguggcucacaccuguaauccuagcacau

SEQ ID NO: 371247 - RNA, 32 nt, Human
ccccgugggaacacugggagccugcacuccac

SEQ ID NO: 371248 - RNA, 32 nt, Human
ccccgugggaagagcagagaaaucaucaccac

SEQ ID NO: 371249 - RNA, 32 nt, Human
ccccgugggcugggcacuguggcccuucuucu

SEQ ID NO: 371250 - RNA, 32 nt, Human
ccccguggugccugcacacagagugagggagg

SEQ ID NO: 371251 - RNA, 32 nt, Human
ccccguguagauacugagaggugguggcagua

SEQ ID NO: 371252 - RNA, 32 nt, Human
ccccgugugacccugucccagcauuuucccgc

SEQ ID NO: 371253 - RNA, 32 nt, Human
ccccgugugcaggaucaauuguaggaggaaau

SEQ ID NO: 371254 - RNA, 32 nt, Human
ccccguguuacugccuaucagcauuuuacuac

SEQ ID NO: 371255 - RNA, 18 nt, Human
ccccguguucccuggccu

SEQ ID NO: 371256 - RNA, 32 nt, Human
ccccguuacuccucaaacuuccugccgucagc

SEQ ID NO: 371257 - RNA, 32 nt, Human
ccccguuaggagugagcuuggugagggcucca

SEQ ID NO: 371258 - RNA, 32 nt, Human
ccccguuccucagagaaauuguccucagggag

SEQ ID NO: 371259 - RNA, 32 nt, Human
ccccguucgcaucauggucuccauguguaccg

SEQ ID NO: 371260 - RNA, 18 nt, Human
ccccguucuagggccgug

SEQ ID NO: 371261 - RNA, 17 nt, Human
ccccguucugucaccca

SEQ ID NO: 371262 - RNA, 32 nt, Human
ccccguucuguggggcacugggugauacucag

SEQ ID NO: 371263 - RNA, 32 nt, Human
ccccguugauguccauuccauuccccaggugc

SEQ ID NO: 371264 - RNA, 20 nt, Human
ccccguugccgccgcugccg

SEQ ID NO: 371265 - RNA, 32 nt, Human
ccccguuggagcccucacagaugaggagaaac

SEQ ID NO: 371266 - RNA, 18 nt, Human
ccccguugucccagcuca

SEQ ID NO: 371267 - RNA, 32 nt, Human
ccccguuucucccacagcuucccccgcaucgg

SEQ ID NO: 371268 - RNA, 32 nt, Human
ccccguuugccuccacgagccugcuguuucca

SEQ ID NO: 371269 - RNA, 32 nt, Human
ccccguuugccucuccaaccucuucauccugc

SEQ ID NO: 371270 - RNA, 32 nt, Human
ccccguuuucuggggcccuucuugccuggaau

SEQ ID NO: 371271 - RNA, 32 nt, Human
ccccguuuuucccuuccggcagccucuuggcc

SEQ ID NO: 371272 - RNA, 32 nt, Human
ccccguuuuucccuuccggcagccucuuggcu

SEQ ID NO: 371273 - RNA, 32 nt, Human
ccccguuuuucccuucuggcagccucuuggcc

SEQ ID NO: 371274 - RNA, 32 nt, Human
ccccuaaaaauacaaaaauuagccgggcgugg

SEQ ID NO: 371275 - RNA, 32 nt, Human
ccccuaaaaauaggaacaauuagccaggcaug

SEQ ID NO: 371276 - RNA, 32 nt, Human
ccccuaaaaccagguugauuugcucaaucuca

SEQ ID NO: 371277 - RNA, 32 nt, Human
ccccuaaacgccgccucgucauacgccccucc

SEQ ID NO: 371278 - RNA, 32 nt, Human
ccccuaaacuccaggauuuauaaagcaaauua

SEQ ID NO: 371279 - RNA, 32 nt, Human
ccccuaaagaugggaggagaccagcgguccau

SEQ ID NO: 371280 - RNA, 32 nt, Human
ccccuaaagccaagccuuuucacugggaagcc

SEQ ID NO: 371281 - RNA, 32 nt, Human
ccccuaaagcuuccuuugcccuugcuuucuag

SEQ ID NO: 371282 - RNA, 32 nt, Human
ccccuaaauaaacgucagaaguaaugaagucu

SEQ ID NO: 371283 - RNA, 32 nt, Human
ccccuaaaugauuugaauucuuuaguacuaca

SEQ ID NO: 371284 - RNA, 32 nt, Human
ccccuaaaugcacaucggugggcagggcaaac

SEQ ID NO: 371285 - RNA, 32 nt, Human
ccccuaacccccaauacuugaagggguuuugu

SEQ ID NO: 371286 - RNA, 23 nt, Human
ccccuaacccugaggcugccgcg

SEQ ID NO: 371287 - RNA, 32 nt, Human
ccccuaaccucagcccgagggucuccaggaug

SEQ ID NO: 371288 - RNA, 19 nt, Human
ccccuaacuucucuggugg

SEQ ID NO: 371289 - RNA, 32 nt, Human
ccccuaagaaagaaaguggaggggacacucca

SEQ ID NO: 371290 - RNA, 32 nt, Human
ccccuaagacuccagcuucauagacuccucug

SEQ ID NO: 371291 - RNA, 32 nt, Human
ccccuaagagucagugcgcggaacagaagagc

SEQ ID NO: 371292 - RNA, 32 nt, Human
ccccuaagcacaacuauuuacauuucuuuaua

SEQ ID NO: 371293 - RNA, 22 nt, Human
ccccuaagcccaccccuccuca

SEQ ID NO: 371294 - RNA, 32 nt, Human
ccccuaagccugcacucugggcgcuccugcug

SEQ ID NO: 371295 - RNA, 17 nt, Human
ccccuaagcuccaggug

SEQ ID NO: 371296 - RNA, 32 nt, Human
ccccuaagcugcgggacgaguucuguucuggc

SEQ ID NO: 371297 - RNA, 22 nt, Human
ccccuaaggcccugcccggggc

SEQ ID NO: 371298 - RNA, 26 nt, Human
ccccuaauguacacgcugcagccaga

SEQ ID NO: 371299 - RNA, 32 nt, Human
ccccuaauuaauuugaaaccaaucccagguau

SEQ ID NO: 371300 - RNA, 32 nt, Human
ccccuaauucuucugcucuguuugggaagacg

SEQ ID NO: 371301 - RNA, 32 nt, Human
ccccuacaacacaguauuuuggcaacuauugc

SEQ ID NO: 371302 - RNA, 32 nt, Human
ccccuacacagcaggggcagguuuggcuacug

SEQ ID NO: 371303 - RNA, 32 nt, Human
ccccuacaccugcuuugucagauacagcuggg

SEQ ID NO: 371304 - RNA, 18 nt, Human
ccccuacacugcccgcca

SEQ ID NO: 371305 - RNA, 32 nt, Human
ccccuacacugcccuggccuuugcagaguaug

SEQ ID NO: 371306 - RNA, 32 nt, Human
ccccuacaggcagaggaguagcaauguggguc

SEQ ID NO: 371307 - RNA, 32 nt, Human
ccccuacaggccucugggcccagcuccuggcc

SEQ ID NO: 371308 - RNA, 32 nt, Human
ccccuacaucaggaaggagagcccccugcuca

SEQ ID NO: 371309 - RNA, 32 nt, Human
ccccuaccacacacaccccuguccuccagcac

SEQ ID NO: 371310 - RNA, 32 nt, Human
ccccuaccacacucccccuccuagaccgccgc

SEQ ID NO: 371311 - RNA, 32 nt, Human
ccccuaccagcccggcuauauugggugggauu

SEQ ID NO: 371312 - RNA, 32 nt, Human
ccccuaccaucucccaauggaggggagguugc

SEQ ID NO: 371313 - RNA, 24 nt, Human
ccccuacccauaucccucccgugu

SEQ ID NO: 371314 - RNA, 32 nt, Human
ccccuaccccacggaggauggaagaggcagau

SEQ ID NO: 371315 - RNA, 32 nt, Human
ccccuacccccaccccucuagagacccuccag

SEQ ID NO: 371316 - RNA, 24 nt, Human
ccccuaccccccaaacuacccucu

SEQ ID NO: 371317 - RNA, 32 nt, Human
ccccuacccccuccucucugccgcaauacagg

SEQ ID NO: 371318 - RNA, 32 nt, Human
ccccuaccccuccaaauaccuugcauucucaa

SEQ ID NO: 371319 - RNA, 32 nt, Human
ccccuaccccucucccccagugcagcugaagc

SEQ ID NO: 371320 - RNA, 32 nt, Human
ccccuaccccugcuggccggggauggagacau

SEQ ID NO: 371321 - RNA, 22 nt, Human
ccccuaccccuguccuuccuca

SEQ ID NO: 371322 - RNA, 32 nt, Human
ccccuacccuaagcuguagccugggugacuga

SEQ ID NO: 371323 - RNA, 22 nt, Human
ccccuacccuguucuccggagu

SEQ ID NO: 371324 - RNA, 18 nt, Human
ccccuaccgccagccucc

SEQ ID NO: 371325 - RNA, 32 nt, Human
ccccuaccuaaaguccugcaauaaaaucagca

SEQ ID NO: 371326 - RNA, 32 nt, Human
ccccuaccucccaccaccaccaugaaguuugg

SEQ ID NO: 371327 - RNA, 32 nt, Human
ccccuaccuccuggcccuuuuugguguaguca

SEQ ID NO: 371328 - RNA, 32 nt, Human
ccccuaccucucccaccucuugcucuucaaua

SEQ ID NO: 371329 - RNA, 32 nt, Human
ccccuaccugcaaccucuuccaggcucccuuu

SEQ ID NO: 371330 - RNA, 32 nt, Human
ccccuaccuguucuccccuccaggccaccugu

SEQ ID NO: 371331 - RNA, 32 nt, Human
ccccuaccuucccacacaguauauucuuguga

SEQ ID NO: 371332 - RNA, 32 nt, Human
ccccuacgccacucccaccacacccacacccc

SEQ ID NO: 371333 - RNA, 22 nt, Human
ccccuacgccucaccccuccuc

SEQ ID NO: 371334 - RNA, 32 nt, Human
ccccuacgccucaccccuccucccucucacag

SEQ ID NO: 371335 - RNA, 32 nt, Human
ccccuacuccacccucagcucuuccuugccug

SEQ ID NO: 371336 - RNA, 32 nt, Human
ccccuacucccggagcccccagcagggcccuc

SEQ ID NO: 371337 - RNA, 32 nt, Human
ccccuacugcaggucuuacaguggaggggccu

SEQ ID NO: 371338 - RNA, 32 nt, Human
ccccuacugccagccagaagcugggcugaccc

SEQ ID NO: 371339 - RNA, 19 nt, Human
ccccuacuucccuuuggga

SEQ ID NO: 371340 - RNA, 32 nt, Human
ccccuagaaagaaauccuuggaaaaguugcau

SEQ ID NO: 371341 - RNA, 32 nt, Human
ccccuagaccccgcgccucugaaggggcuugg

SEQ ID NO: 371342 - RNA, 19 nt, Human
ccccuagaccucccccuca

SEQ ID NO: 371343 - RNA, 32 nt, Human
ccccuagagcaggauuugaggccaggccaaag

SEQ ID NO: 371344 - RNA, 32 nt, Human
ccccuagaugauaaccaggaacuccagguucu

SEQ ID NO: 371345 - RNA, 20 nt, Human
ccccuagauuccagccacca

SEQ ID NO: 371346 - RNA, 32 nt, Human
ccccuagcagugcagaacuacaagucccaggg

SEQ ID NO: 371347 - RNA, 32 nt, Human
ccccuagccagccuucccacacugccaggaua

SEQ ID NO: 371348 - RNA, 23 nt, Human
ccccuagcccaccccggcacaga

SEQ ID NO: 371349 - RNA, 32 nt, Human
ccccuagcccggcuguggcuccaccuccagcu

SEQ ID NO: 371350 - RNA, 32 nt, Human
ccccuagcccugcuagguggcuauuagaacag

SEQ ID NO: 371351 - RNA, 32 nt, Human
ccccuagcuaccacugccuccaggcuacugcc

SEQ ID NO: 371352 - RNA, 32 nt, Human
ccccuagcuagacuucauccuccuggacagau

SEQ ID NO: 371353 - RNA, 19 nt, Human
ccccuagcugggccaacuc

SEQ ID NO: 371354 - RNA, 20 nt, Human
ccccuagcugucaguuuggc

SEQ ID NO: 371355 - RNA, 18 nt, Human
ccccuagcuucccucccu

SEQ ID NO: 371356 - RNA, 32 nt, Human
ccccuaggagccuucagucugggagaaacaga

SEQ ID NO: 371357 - RNA, 17 nt, Human
ccccuaggccagacuuc

SEQ ID NO: 371358 - RNA, 20 nt, Human
ccccuaggccugucucuccc

SEQ ID NO: 371359 - RNA, 20 nt, Human
ccccuaggcgugccucuccc

SEQ ID NO: 371360 - RNA, 32 nt, Human
ccccuaggcuugaggguggagagccaggccuc

SEQ ID NO: 371361 - RNA, 32 nt, Human
ccccuagggaauggucccagcacgaguggcca

SEQ ID NO: 371362 - RNA, 28 nt, Human
ccccuagggcaaaagugaccauuguuaa

SEQ ID NO: 371363 - RNA, 21 nt, Human
ccccuaguagugauccuuccu

SEQ ID NO: 371364 - RNA, 32 nt, Human
ccccuaguaucuucagcacaugcucacuguuc

SEQ ID NO: 371365 - RNA, 32 nt, Human
ccccuaguaucuucagcacaugcucacuguuu

SEQ ID NO: 371366 - RNA, 23 nt, Human
ccccuaguccaucaccuggcacg

SEQ ID NO: 371367 - RNA, 18 nt, Human
ccccuagucugcccuccc

SEQ ID NO: 371368 - RNA, 32 nt, Human
ccccuagugaugcauccugccuaggcuggacu

SEQ ID NO: 371369 - RNA, 20 nt, Human
ccccuagugcccccuccuca

SEQ ID NO: 371370 - RNA, 20 nt, Human
ccccuaguucccucugcuca

SEQ ID NO: 371371 - RNA, 32 nt, Human
ccccuaucacacucuaguucaguccugugaac

SEQ ID NO: 371372 - RNA, 32 nt, Human
ccccuauccagaaucacaugcacaaguuuuua

SEQ ID NO: 371373 - RNA, 32 nt, Human
ccccuauccauggcaggggaggggcucagcau

SEQ ID NO: 371374 - RNA, 32 nt, Human
ccccuaucccagagcucagaguggacccuggc

SEQ ID NO: 371375 - RNA, 32 nt, Human
ccccuaucuggcaaggaaaccccauacagaag

SEQ ID NO: 371376 - RNA, 32 nt, Human
ccccuaucuguccuucuucuggaagagcugga

SEQ ID NO: 371377 - RNA, 18 nt, Human
ccccuaugagucaacuca

SEQ ID NO: 371378 - RNA, 32 nt, Human
ccccuauugcucuucuuccuaaagcuaaagga

SEQ ID NO: 371379 - RNA, 32 nt, Human
ccccuauuugcaaucauauucucccucugcuu

SEQ ID NO: 371380 - RNA, 32 nt, Human
ccccuauuuuacugcagcucaggggguaggcu

SEQ ID NO: 371381 - RNA, 21 nt, Human
ccccucaaaggcccccuccuc

SEQ ID NO: 371382 - RNA, 25 nt, Human
ccccucaaauuuucucagcucugcc

SEQ ID NO: 371383 - RNA, 25 nt, Human
ccccucaacccuccguuccuccuca

SEQ ID NO: 371384 - RNA, 32 nt, Human
ccccucaacuaccaccaccuccagucagucuc

SEQ ID NO: 371385 - RNA, 32 nt, Human
ccccucacagaugaacaaagugaggcagagaa

SEQ ID NO: 371386 - RNA, 25 nt, Human
ccccucacagcccucagcucuacuc

SEQ ID NO: 371387 - RNA, 20 nt, Human
ccccucacagcucuucccca

SEQ ID NO: 371388 - RNA, 32 nt, Human
ccccucaccaaaaccugcggggcugcuuggag

SEQ ID NO: 371389 - RNA, 21 nt, Human
ccccucaccagcgccucccca

SEQ ID NO: 371390 - RNA, 20 nt, Human
ccccucaccauccuuccuca

SEQ ID NO: 371391 - RNA, 19 nt, Human
ccccucacccaccuccccg

SEQ ID NO: 371392 - RNA, 20 nt, Human
ccccucacccacgccaacuc

SEQ ID NO: 371393 - RNA, 19 nt, Human
ccccucacccacucccucc

SEQ ID NO: 371394 - RNA, 32 nt, Human
ccccucacccacucuacccccaccuccucauu

SEQ ID NO: 371395 - RNA, 22 nt, Human
ccccucaccccacccccaccuc

SEQ ID NO: 371396 - RNA, 20 nt, Human
ccccucaccccacugcuuca

SEQ ID NO: 371397 - RNA, 22 nt, Human
ccccucaccccauauuccauca

SEQ ID NO: 371398 - RNA, 20 nt, Human
ccccucaccccaucuuguca

SEQ ID NO: 371399 - RNA, 20 nt, Human
ccccucacccccaacucucc

SEQ ID NO: 371400 - RNA, 18 nt, Human
ccccucacccccaccuca

SEQ ID NO: 371401 - RNA, 21 nt, Human
ccccucacccccacuggccca

SEQ ID NO: 371402 - RNA, 18 nt, Human
ccccucaccccccaacuc

SEQ ID NO: 371403 - RNA, 18 nt, Human
ccccucaccccccaccca

SEQ ID NO: 371404 - RNA, 32 nt, Human
ccccucaccccucaccauccuuccucaggacu

SEQ ID NO: 371405 - RNA, 19 nt, Human
ccccucacccucacccucc

SEQ ID NO: 371406 - RNA, 19 nt, Human
ccccucacccuccucccuc

SEQ ID NO: 371407 - RNA, 21 nt, Human
ccccucacccugccuuaucuu

SEQ ID NO: 371408 - RNA, 20 nt, Human
ccccucacccugcucccucu

SEQ ID NO: 371409 - RNA, 20 nt, Human
ccccucacccugcuguccuc

SEQ ID NO: 371410 - RNA, 20 nt, Human
ccccucaccgcgcccccgca

SEQ ID NO: 371411 - RNA, 20 nt, Human
ccccucaccuccacccccuc

SEQ ID NO: 371412 - RNA, 32 nt, Human
ccccucaccuccacccccuccugucaccggcc

SEQ ID NO: 371413 - RNA, 19 nt, Human
ccccucaccuccccccucc

SEQ ID NO: 371414 - RNA, 18 nt, Human
ccccucaccugcuccucc

SEQ ID NO: 371415 - RNA, 23 nt, Human
ccccucaccugcuugccuccuua

SEQ ID NO: 371416 - RNA, 32 nt, Human
ccccucaccuuccugguucccugaggguccuc

SEQ ID NO: 371417 - RNA, 20 nt, Human
ccccucaccuucucucccca

SEQ ID NO: 371418 - RNA, 20 nt, Human
ccccucaccuugcugccuca

SEQ ID NO: 371419 - RNA, 20 nt, Human
ccccucacgcuacccuccca

SEQ ID NO: 371420 - RNA, 20 nt, Human
ccccucacuauccuacccca

SEQ ID NO: 371421 - RNA, 32 nt, Human
ccccucacugcaaaagcaucuccuuaaguagc

SEQ ID NO: 371422 - RNA, 32 nt, Human
ccccucacugcacucugcucaucacgggagga

SEQ ID NO: 371423 - RNA, 18 nt, Human
ccccucacugccucccca

SEQ ID NO: 371424 - RNA, 32 nt, Human
ccccucacuguggggauugaucauucucauga

SEQ ID NO: 371425 - RNA, 20 nt, Human
ccccucacuuaaccacccca

SEQ ID NO: 371426 - RNA, 21 nt, Human
ccccucacuucgcccucccca

SEQ ID NO: 371427 - RNA, 18 nt, Human
ccccucacuugccugcca

SEQ ID NO: 371428 - RNA, 32 nt, Human
ccccucacuuuugcucagccuagcagucuacu

SEQ ID NO: 371429 - RNA, 32 nt, Human
ccccucagacugcugcucagccaggcaccaac

SEQ ID NO: 371430 - RNA, 32 nt, Human
ccccucagaggagcucugugcuauagucugug

SEQ ID NO: 371431 - RNA, 32 nt, Human
ccccucagcaucaagcagcccaaccaaggcgu

SEQ ID NO: 371432 - RNA, 32 nt, Human
ccccucagccaucucagggugaggagcugcca

SEQ ID NO: 371433 - RNA, 32 nt, Human
ccccucagccauguggcacuucugagcuccug

SEQ ID NO: 371434 - RNA, 32 nt, Human
ccccucagcccgugagcagccauguccaaccc

SEQ ID NO: 371435 - RNA, 32 nt, Human
ccccucagccuccugaguagcugagacuacag

SEQ ID NO: 371436 - RNA, 32 nt, Human
ccccucagccucuccccugccugcccugguga

SEQ ID NO: 371437 - RNA, 20 nt, Human
ccccucagccucuucucugc

SEQ ID NO: 371438 - RNA, 32 nt, Human
ccccucagccugagccgggggaagccaggcgg

SEQ ID NO: 371439 - RNA, 32 nt, Human
ccccucagccugggggaagaagagggccucgg

SEQ ID NO: 371440 - RNA, 32 nt, Human
ccccucagccuucucagcauuuccuuauccca

SEQ ID NO: 371441 - RNA, 18 nt, Human
ccccucagcgucagcuca

SEQ ID NO: 371442 - RNA, 32 nt, Human
ccccucagcuccccggcacugcagucugcaga

SEQ ID NO: 371443 - RNA, 22 nt, Human
ccccucagcucugaucucugcc

SEQ ID NO: 371444 - RNA, 18 nt, Human
ccccucagcugcccccuc

SEQ ID NO: 371445 - RNA, 32 nt, Human
ccccucagcugucuccucccucccucuggaaa

SEQ ID NO: 371446 - RNA, 32 nt, Human
ccccucagcugugcccugcugccuggcguccc

SEQ ID NO: 371447 - RNA, 20 nt, Human
ccccucagcuuucccuccuc

SEQ ID NO: 371448 - RNA, 32 nt, Human
ccccucaggaagagaaucgaggccaaguuccu

SEQ ID NO: 371449 - RNA, 32 nt, Human
ccccucaggccaccuccuguccucacuccugu

SEQ ID NO: 371450 - RNA, 22 nt, Human
ccccucaguacuguagcaugga

SEQ ID NO: 371451 - RNA, 19 nt, Human
ccccucagucucccuccuc

SEQ ID NO: 371452 - RNA, 32 nt, Human
ccccucagucuccuccccaucacccuccucag

SEQ ID NO: 371453 - RNA, 32 nt, Human
ccccucagugacuuccuugggugauccugacu

SEQ ID NO: 371454 - RNA, 32 nt, Human
ccccucagugcugcugucaguguagcaaauaa

SEQ ID NO: 371455 - RNA, 32 nt, Human
ccccucaguguaauguagggguugugagcaca

SEQ ID NO: 371456 - RNA, 21 nt, Human
ccccucaguuuccucuccuca

SEQ ID NO: 371457 - RNA, 32 nt, Human
ccccucauagccuguaccuguuaucaauauaa

SEQ ID NO: 371458 - RNA, 21 nt, Human
ccccucauccacgccucccca

SEQ ID NO: 371459 - RNA, 32 nt, Human
ccccucauccagggaacgagugugucucaagg

SEQ ID NO: 371460 - RNA, 32 nt, Human
ccccucaucugugguaguagugaaggcuaggu

SEQ ID NO: 371461 - RNA, 20 nt, Human
ccccucaugccuccuccuca

SEQ ID NO: 371462 - RNA, 32 nt, Human
ccccucaugcuagggccccauggguccgggag

SEQ ID NO: 371463 - RNA, 31 nt, Human
ccccucaugcucucuggcugggccagugggc

SEQ ID NO: 371464 - RNA, 32 nt, Human
ccccucaugcucucuggcugggccagugggca

SEQ ID NO: 371465 - RNA, 32 nt, Human
ccccucaugcuucacagguugacuaguaucug

SEQ ID NO: 371466 - RNA, 32 nt, Human
ccccucaugugaagaacgugucagaaucuuua

SEQ ID NO: 371467 - RNA, 21 nt, Human
ccccuccaaaacacgccccca

SEQ ID NO: 371468 - RNA, 32 nt, Human
ccccuccaaauagccauacuuagccucagcag

SEQ ID NO: 371469 - RNA, 32 nt, Human
ccccuccaacaggugcucacagccaccgaggc

SEQ ID NO: 371470 - RNA, 32 nt, Human
ccccuccaacccccaaaccagguggaaaaagg

SEQ ID NO: 371471 - RNA, 32 nt, Human
ccccuccaagcccagcuggcaccaaagagcuu

SEQ ID NO: 371472 - RNA, 32 nt, Human
ccccuccaagggacaggaaggcugggggaggg

SEQ ID NO: 371473 - RNA, 32 nt, Human
ccccuccaaguuggggacggagauggggagca

SEQ ID NO: 371474 - RNA, 22 nt, Human
ccccuccaccccagccagcuca

SEQ ID NO: 371475 - RNA, 21 nt, Human
ccccuccaccccauuugcuca

SEQ ID NO: 371476 - RNA, 17 nt, Human
ccccuccacccccucca

SEQ ID NO: 371477 - RNA, 32 nt, Human
ccccuccacccugcaacccccaucccccaccg

SEQ ID NO: 371478 - RNA, 24 nt, Human
ccccuccaccucaggccccagccc

SEQ ID NO: 371479 - RNA, 32 nt, Human
ccccuccacucccaucugcuucccuuucagag

SEQ ID NO: 371480 - RNA, 20 nt, Human
ccccuccacuccuccccuca

SEQ ID NO: 371481 - RNA, 32 nt, Human
ccccuccacuccucggccuugcccgacacuga

SEQ ID NO: 371482 - RNA, 32 nt, Human
ccccuccacuggccagccugggggugcccugc

SEQ ID NO: 371483 - RNA, 19 nt, Human
ccccuccacuucagcuugc

SEQ ID NO: 371484 - RNA, 21 nt, Human
ccccuccacuuccugcccucu

SEQ ID NO: 371485 - RNA, 32 nt, Human
ccccuccagaagacuugccugcuagggaccuc

SEQ ID NO: 371486 - RNA, 32 nt, Human
ccccuccagaagcagagcaugaccugggugac

SEQ ID NO: 371487 - RNA, 31 nt, Human
ccccuccagagagugaggagggggccugaga

SEQ ID NO: 371488 - RNA, 32 nt, Human
ccccuccagagcagugggacaucuggggacug

SEQ ID NO: 371489 - RNA, 19 nt, Human
ccccuccagagcccugccc

SEQ ID NO: 371490 - RNA, 32 nt, Human
ccccuccagcacucccuuuugucaucuugagu

SEQ ID NO: 371491 - RNA, 32 nt, Human
ccccuccagcugaugccugcucccucucucug

SEQ ID NO: 371492 - RNA, 32 nt, Human
ccccuccaggccuccuuacuccaucuuccaga

SEQ ID NO: 371493 - RNA, 32 nt, Human
ccccuccaggcuucacccucccugccuaagca

SEQ ID NO: 371494 - RNA, 20 nt, Human
ccccuccaguauccaacuua

SEQ ID NO: 371495 - RNA, 17 nt, Human
ccccuccagucagccca

SEQ ID NO: 371496 - RNA, 32 nt, Human
ccccuccagugcccucuccucgaugccucgcu

SEQ ID NO: 371497 - RNA, 32 nt, Human
ccccuccaguuagucccuaucuggguaagggu

SEQ ID NO: 371498 - RNA, 32 nt, Human
ccccuccaucuucuaccucugaauggccaccc

SEQ ID NO: 371499 - RNA, 32 nt, Human
ccccuccaugcggaguaggcacggggcccaau

SEQ ID NO: 371500 - RNA, 32 nt, Human
ccccuccauucccugugggugcagcccacagg

SEQ ID NO: 371501 - RNA, 32 nt, Human
ccccucccaaccacagcagccagagccaucug

SEQ ID NO: 371502 - RNA, 18 nt, Human
ccccucccaaccccaucc

SEQ ID NO: 371503 - RNA, 18 nt, Human
ccccucccaacccuucuu

SEQ ID NO: 371504 - RNA, 32 nt, Human
ccccucccaagggcccuuaaagcgaccuguca

SEQ ID NO: 371505 - RNA, 28 nt, Human
ccccucccaagugacccuccuccugccu

SEQ ID NO: 371506 - RNA, 22 nt, Human
ccccucccacacaaaccagcca

SEQ ID NO: 371507 - RNA, 22 nt, Human
ccccucccacugaaguuugugu

SEQ ID NO: 371508 - RNA, 20 nt, Human
ccccucccacuuguuugugu

SEQ ID NO: 371509 - RNA, 32 nt, Human
ccccucccacuuguuugugugaucucagaacu

SEQ ID NO: 371510 - RNA, 32 nt, Human
ccccucccagacaggaaggagaagaggcaggu

SEQ ID NO: 371511 - RNA, 32 nt, Human
ccccucccagaggaaagagcugagccacucuc

SEQ ID NO: 371512 - RNA, 32 nt, Human
ccccucccagcaaccuaagaccagucugaacu

SEQ ID NO: 371513 - RNA, 32 nt, Human
ccccucccagcaccagcucugcucaggccccu

SEQ ID NO: 371514 - RNA, 32 nt, Human
ccccucccagcaccuuucuccccaacagggug

SEQ ID NO: 371515 - RNA, 32 nt, Human
ccccucccagcccucagacccugggguccugg

SEQ ID NO: 371516 - RNA, 32 nt, Human
ccccucccagccuaccccuccugcgcugcccc

SEQ ID NO: 371517 - RNA, 32 nt, Human
ccccucccagccugugaccuuugugaccaacu

SEQ ID NO: 371518 - RNA, 19 nt, Human
ccccucccaggcccugucc

SEQ ID NO: 371519 - RNA, 32 nt, Human
ccccucccaggucugguuagggcaguuguuac

SEQ ID NO: 371520 - RNA, 32 nt, Human
ccccucccaucuugaggucguucuccacauuc

SEQ ID NO: 371521 - RNA, 28 nt, Human
ccccucccauggccaaaaaccccacugu

SEQ ID NO: 371522 - RNA, 32 nt, Human
ccccuccccacaccuccaggaacuccacuccc

SEQ ID NO: 371523 - RNA, 32 nt, Human
ccccuccccacagucacauggccacacggucc

SEQ ID NO: 371524 - RNA, 22 nt, Human
ccccuccccaccaccucucaua

SEQ ID NO: 371525 - RNA, 19 nt, Human
ccccuccccaccccugccu

SEQ ID NO: 371526 - RNA, 23 nt, Human
ccccuccccaccuaccccuuccu

SEQ ID NO: 371527 - RNA, 19 nt, Human
ccccuccccacuuugggga

SEQ ID NO: 371528 - RNA, 32 nt, Human
ccccuccccagagggaucccuaacgugcccag

SEQ ID NO: 371529 - RNA, 32 nt, Human
ccccuccccagccacagucugaggagccccug

SEQ ID NO: 371530 - RNA, 32 nt, Human
ccccuccccagccuccugacccuucccagccc

SEQ ID NO: 371531 - RNA, 32 nt, Human
ccccuccccagccuguguccacagugcuguga

SEQ ID NO: 371532 - RNA, 32 nt, Human
ccccuccccaggagaaaaagacccccaagcag

SEQ ID NO: 371533 - RNA, 32 nt, Human
ccccuccccaggaggagggauggccugacuga

SEQ ID NO: 371534 - RNA, 32 nt, Human
ccccuccccagggccccacccugccauaugaa

SEQ ID NO: 371535 - RNA, 32 nt, Human
ccccuccccagugccucuccuggucguggaag

SEQ ID NO: 371536 - RNA, 22 nt, Human
ccccucccccaaauccacccca

SEQ ID NO: 371537 - RNA, 22 nt, Human
ccccucccccacagagccucca

SEQ ID NO: 371538 - RNA, 22 nt, Human
ccccucccccagccacucccca

SEQ ID NO: 371539 - RNA, 32 nt, Human
ccccucccccagcccacccaaauaaaggauua

SEQ ID NO: 371540 - RNA, 24 nt, Human
ccccucccccagcuccggccgcca

SEQ ID NO: 371541 - RNA, 21 nt, Human
ccccucccccaggagcccuca

SEQ ID NO: 371542 - RNA, 23 nt, Human
ccccucccccagggccccaccca

SEQ ID NO: 371543 - RNA, 32 nt, Human
ccccucccccauuuacuucuccaccucccguc

SEQ ID NO: 371544 - RNA, 24 nt, Human
ccccuccccccaaugcacaagcca

SEQ ID NO: 371545 - RNA, 20 nt, Human
ccccuccccccgacccagcc

SEQ ID NO: 371546 - RNA, 23 nt, Human
ccccuccccccucccggaggcca

SEQ ID NO: 371547 - RNA, 23 nt, Human
ccccuccccccucuggcccagcc

SEQ ID NO: 371548 - RNA, 27 nt, Human
ccccucccccgagggcagacccagcca

SEQ ID NO: 371549 - RNA, 22 nt, Human
ccccucccccgccccugcccca

SEQ ID NO: 371550 - RNA, 32 nt, Human
ccccucccccguccgcgcccucccucuuuccc

SEQ ID NO: 371551 - RNA, 20 nt, Human
ccccucccccuagcccagcc

SEQ ID NO: 371552 - RNA, 22 nt, Human
ccccucccccucaaccccacca

SEQ ID NO: 371553 - RNA, 32 nt, Human
ccccucccccucccccucuuucuucuccuccc

SEQ ID NO: 371554 - RNA, 17 nt, Human
ccccucccccuccgccc

SEQ ID NO: 371555 - RNA, 23 nt, Human
ccccucccccucgggcgccagcc

SEQ ID NO: 371556 - RNA, 32 nt, Human
ccccucccccugggggcaaaucaggacacaac

SEQ ID NO: 371557 - RNA, 32 nt, Human
ccccucccccuucaaacacccucccccacauu

SEQ ID NO: 371558 - RNA, 32 nt, Human
ccccucccccuucauuacuucacucagguggg

SEQ ID NO: 371559 - RNA, 32 nt, Human
ccccuccccgggagguacagcuggcagaggga

SEQ ID NO: 371560 - RNA, 22 nt, Human
ccccuccccgggccacccagcc

SEQ ID NO: 371561 - RNA, 32 nt, Human
ccccuccccuaucccuaggcacuuaaccaaga

SEQ ID NO: 371562 - RNA, 22 nt, Human
ccccuccccucaguguccccca

SEQ ID NO: 371563 - RNA, 32 nt, Human
ccccuccccuccaacucucaucccauugagcc

SEQ ID NO: 371564 - RNA, 32 nt, Human
ccccuccccuccaucucucuuccccauagacc

SEQ ID NO: 371565 - RNA, 17 nt, Human
ccccuccccuccccccu

SEQ ID NO: 371566 - RNA, 23 nt, Human
ccccuccccucccccgcgcgcca

SEQ ID NO: 371567 - RNA, 21 nt, Human
ccccuccccuccuccccagcc

SEQ ID NO: 371568 - RNA, 21 nt, Human
ccccuccccucgcauccccca

SEQ ID NO: 371569 - RNA, 32 nt, Human
ccccuccccucgggccgggagcuuccagccca

SEQ ID NO: 371570 - RNA, 32 nt, Human
ccccuccccugccaucccuccccggacuccgg

SEQ ID NO: 371571 - RNA, 32 nt, Human
ccccuccccugccccugccccugccccugccc

SEQ ID NO: 371572 - RNA, 32 nt, Human
ccccuccccugcccugcuccagcucacacgug

SEQ ID NO: 371573 - RNA, 23 nt, Human
ccccuccccuucucccacagcca

SEQ ID NO: 371574 - RNA, 20 nt, Human
ccccucccgccgccuccuca

SEQ ID NO: 371575 - RNA, 32 nt, Human
ccccucccgcuagacucccagccugggcccuc

SEQ ID NO: 371576 - RNA, 32 nt, Human
ccccucccgcugcguguccagguccaaagugg

SEQ ID NO: 371577 - RNA, 32 nt, Human
ccccucccggaggcagcuucaggacaggacac

SEQ ID NO: 371578 - RNA, 32 nt, Human
ccccucccuaucucaccugcccagcccugugc

SEQ ID NO: 371579 - RNA, 32 nt, Human
ccccucccucaaggaggucuggcuuuauccau

SEQ ID NO: 371580 - RNA, 32 nt, Human
ccccucccucaaucuucuccccagccccuccc

SEQ ID NO: 371581 - RNA, 32 nt, Human
ccccucccucaccugaguccuggccucugugg

SEQ ID NO: 371582 - RNA, 32 nt, Human
ccccucccucauccucccaucccaguaaaccc

SEQ ID NO: 371583 - RNA, 32 nt, Human
ccccucccuccaccauuucccccuacucccuc

SEQ ID NO: 371584 - RNA, 32 nt, Human
ccccucccuccacccccucacccaggacgugc

SEQ ID NO: 371585 - RNA, 32 nt, Human
ccccucccuccagccucccuaacuggaaacac

SEQ ID NO: 371586 - RNA, 32 nt, Human
ccccucccuccaggucccgagguggauaaggg

SEQ ID NO: 371587 - RNA, 32 nt, Human
ccccucccucccacuggagcagcuccagagcc

SEQ ID NO: 371588 - RNA, 20 nt, Human
ccccucccuccccacagcca

SEQ ID NO: 371589 - RNA, 22 nt, Human
ccccucccuccccacccaagcc

SEQ ID NO: 371590 - RNA, 25 nt, Human
ccccucccuccccacggcccugcca

SEQ ID NO: 371591 - RNA, 32 nt, Human
ccccucccucccccaucaaacuuccuucauuu

SEQ ID NO: 371592 - RNA, 32 nt, Human
ccccucccucccccuccuccccucuuuuacuc

SEQ ID NO: 371593 - RNA, 26 nt, Human
ccccucccuccccgcccgcacggcca

SEQ ID NO: 371594 - RNA, 32 nt, Human
ccccucccuccccuccccuucuucuccaucuc

SEQ ID NO: 371595 - RNA, 32 nt, Human
ccccucccuccccucccucucgcuccuuccuu

SEQ ID NO: 371596 - RNA, 32 nt, Human
ccccucccuccccuuaugaggucucaggcagu

SEQ ID NO: 371597 - RNA, 32 nt, Human
ccccucccuccuucacuccugccuccucagcu

SEQ ID NO: 371598 - RNA, 21 nt, Human
ccccucccuccuugaaggcua

SEQ ID NO: 371599 - RNA, 25 nt, Human
ccccucccuccuugcuucccaccca

SEQ ID NO: 371600 - RNA, 23 nt, Human
ccccucccucgccaccccaacca

SEQ ID NO: 371601 - RNA, 32 nt, Human
ccccucccucuacugccuucugucagggucuu

SEQ ID NO: 371602 - RNA, 32 nt, Human
ccccucccucucagguguccugagaugcuguu

SEQ ID NO: 371603 - RNA, 22 nt, Human
ccccucccucuguccaccagcc

SEQ ID NO: 371604 - RNA, 26 nt, Human
ccccucccucuucagcuucccagaca

SEQ ID NO: 371605 - RNA, 16 nt, Human
ccccucccucuucugc

SEQ ID NO: 371606 - RNA, 25 nt, Human
ccccucccucuucugcccccuacca

SEQ ID NO: 371607 - RNA, 32 nt, Human
ccccucccucuuuucaguuucucccccuccuc

SEQ ID NO: 371608 - RNA, 32 nt, Human
ccccucccugcauugaggccuuguggaccccu

SEQ ID NO: 371609 - RNA, 32 nt, Human
ccccucccugcucccuuuugaugguggccucu

SEQ ID NO: 371610 - RNA, 32 nt, Human
ccccucccuggccuguucuguuuugccugaag

SEQ ID NO: 371611 - RNA, 32 nt, Human
ccccucccuggguugaccucacagacauugaa

SEQ ID NO: 371612 - RNA, 32 nt, Human
ccccucccuguuugacuucacacacacucaua

SEQ ID NO: 371613 - RNA, 32 nt, Human
ccccucccuucccccuccucguucccuuuuuc

SEQ ID NO: 371614 - RNA, 23 nt, Human
ccccucccuucccgaccccaaca

SEQ ID NO: 371615 - RNA, 24 nt, Human
ccccucccuuccugcccuucacca

SEQ ID NO: 371616 - RNA, 32 nt, Human
ccccucccuucuaaucccccaaaggaccuauu

SEQ ID NO: 371617 - RNA, 20 nt, Human
ccccucccuucuguuugugc

SEQ ID NO: 371618 - RNA, 18 nt, Human
ccccucccuugcaccucc

SEQ ID NO: 371619 - RNA, 32 nt, Human
ccccucccuugcuggccagcaucccccucuuc

SEQ ID NO: 371620 - RNA, 32 nt, Human
ccccucccuuucuccccugcccccaggacugg

SEQ ID NO: 371621 - RNA, 24 nt, Human
ccccucccuuuugcgcacacacca

SEQ ID NO: 371622 - RNA, 26 nt, Human
ccccuccgacgaccucaacucugccc

SEQ ID NO: 371623 - RNA, 32 nt, Human
ccccuccgcaccacugaccucuugucuccuau

SEQ ID NO: 371624 - RNA, 32 nt, Human
ccccuccgcaccacugaccucuugucuccugu

SEQ ID NO: 371625 - RNA, 32 nt, Human
ccccuccgcaccccacacagccuugcuccaag

SEQ ID NO: 371626 - RNA, 20 nt, Human
ccccuccgcagccccauccc

SEQ ID NO: 371627 - RNA, 24 nt, Human
ccccuccgcaggcaggacauccca

SEQ ID NO: 371628 - RNA, 32 nt, Human
ccccuccgcccccucuggaggcugaagaggga

SEQ ID NO: 371629 - RNA, 22 nt, Human
ccccuccgccccugccucccuc

SEQ ID NO: 371630 - RNA, 24 nt, Human
ccccuccgccgguccccacccucu

SEQ ID NO: 371631 - RNA, 21 nt, Human
ccccuccgccuccuagcccuc

SEQ ID NO: 371632 - RNA, 20 nt, Human
ccccuccgccuucuccccuc

SEQ ID NO: 371633 - RNA, 32 nt, Human
ccccuccgcgcucuccgcuuguggauaacuag

SEQ ID NO: 371634 - RNA, 24 nt, Human
ccccuccgcucuugacccugcaua

SEQ ID NO: 371635 - RNA, 22 nt, Human
ccccuccggccucagcucccuc

SEQ ID NO: 371636 - RNA, 24 nt, Human
ccccuccgguagccgccccuccuc

SEQ ID NO: 371637 - RNA, 32 nt, Human
ccccuccguccagccagcaaggcuuucccaag

SEQ ID NO: 371638 - RNA, 22 nt, Human
ccccuccgugucaccuggcaua

SEQ ID NO: 371639 - RNA, 32 nt, Human
ccccuccguucaugccuguaaucccaacauuu

SEQ ID NO: 371640 - RNA, 32 nt, Human
ccccuccguucccagccugcccugcccccgcc

SEQ ID NO: 371641 - RNA, 32 nt, Human
ccccuccuaaacauucguacacacacaaacac

SEQ ID NO: 371642 - RNA, 22 nt, Human
ccccuccuauccauauccccca

SEQ ID NO: 371643 - RNA, 32 nt, Human
ccccuccucaacaagcagagugaugacuggca

SEQ ID NO: 371644 - RNA, 32 nt, Human
ccccuccucaccccuucuuugccuccuacccc

SEQ ID NO: 371645 - RNA, 32 nt, Human
ccccuccucaugggaaugugucuggggucuug

SEQ ID NO: 371646 - RNA, 32 nt, Human
ccccuccuccacuccuacgcccacucccaugc

SEQ ID NO: 371647 - RNA, 21 nt, Human
ccccuccuccagaccacccuc

SEQ ID NO: 371648 - RNA, 32 nt, Human
ccccuccuccaggagaacucgcggcugggcug

SEQ ID NO: 371649 - RNA, 32 nt, Human
ccccuccuccagggaacccugcacccugggca

SEQ ID NO: 371650 - RNA, 32 nt, Human
ccccuccucccaccaucaccucccucaccucg

SEQ ID NO: 371651 - RNA, 32 nt, Human
ccccuccucccagcuccuggaaacccaccaau

SEQ ID NO: 371652 - RNA, 32 nt, Human
ccccuccucccauggccugccuggugacuguc

SEQ ID NO: 371653 - RNA, 15 nt, Human
ccccuccuccccucc

SEQ ID NO: 371654 - RNA, 32 nt, Human
ccccuccuccccucucuccugggcccucauuc

SEQ ID NO: 371655 - RNA, 32 nt, Human
ccccuccucccuggcccucucguucguuucug

SEQ ID NO: 371656 - RNA, 21 nt, Human
ccccuccuccucagcucaccc

SEQ ID NO: 371657 - RNA, 32 nt, Human
ccccuccucucccaucccccugcccucguggc

SEQ ID NO: 371658 - RNA, 19 nt, Human
ccccuccucucccgcucug

SEQ ID NO: 371659 - RNA, 19 nt, Human
ccccuccucucccucauca

SEQ ID NO: 371660 - RNA, 32 nt, Human
ccccuccugacuccaucucccugcaccagccu

SEQ ID NO: 371661 - RNA, 32 nt, Human
ccccuccugagaugaccugauggagcugaugc

SEQ ID NO: 371662 - RNA, 22 nt, Human
ccccuccugagcucagccccca

SEQ ID NO: 371663 - RNA, 32 nt, Human
ccccuccugcagccuccugcgccccgccgagc

SEQ ID NO: 371664 - RNA, 32 nt, Human
ccccuccugcauucaggagagccaugguaggg

SEQ ID NO: 371665 - RNA, 32 nt, Human
ccccuccugccucaccaacccgugcacaacca

SEQ ID NO: 371666 - RNA, 32 nt, Human
ccccuccugccugggucccagcucuguucacc

SEQ ID NO: 371667 - RNA, 32 nt, Human
ccccuccugcuucccuuccccacuuauccccc

SEQ ID NO: 371668 - RNA, 32 nt, Human
ccccuccuggagauggggucaaggcagcagga

SEQ ID NO: 371669 - RNA, 32 nt, Human
ccccuccuggcucaagaauuacuccgaaguca

SEQ ID NO: 371670 - RNA, 32 nt, Human
ccccuccuggggagccaggcucacagguuguu

SEQ ID NO: 371671 - RNA, 32 nt, Human
ccccuccugugcccucugcccugguggaagcg

SEQ ID NO: 371672 - RNA, 18 nt, Human
ccccuccuuaucccccuc

SEQ ID NO: 371673 - RNA, 32 nt, Human
ccccuccuucagaggaggcucuggguggggcc

SEQ ID NO: 371674 - RNA, 16 nt, Human
ccccuccuucaguugc

SEQ ID NO: 371675 - RNA, 32 nt, Human
ccccuccuuccuugaccagcagaucccagcuc

SEQ ID NO: 371676 - RNA, 22 nt, Human
ccccuccuugacggugcuggca

SEQ ID NO: 371677 - RNA, 24 nt, Human
ccccuccuuucccaggcccugccc

SEQ ID NO: 371678 - RNA, 18 nt, Human
ccccuccuuucuuugugc

SEQ ID NO: 371679 - RNA, 22 nt, Human
ccccuccuuuuuccagugccca

SEQ ID NO: 371680 - RNA, 32 nt, Human
ccccucgaauucccugaugguggugggguggg

SEQ ID NO: 371681 - RNA, 32 nt, Human
ccccucgcacuccugugaggcuuuugcagguc

SEQ ID NO: 371682 - RNA, 24 nt, Human
ccccucgcagauaucucccggggc

SEQ ID NO: 371683 - RNA, 20 nt, Human
ccccucgcagccccuugcuc

SEQ ID NO: 371684 - RNA, 32 nt, Human
ccccucgccacaucccugucuuggggcccagc

SEQ ID NO: 371685 - RNA, 18 nt, Human
ccccucgccgcugauuca

SEQ ID NO: 371686 - RNA, 18 nt, Human
ccccucgccgguaccuca

SEQ ID NO: 371687 - RNA, 32 nt, Human
ccccucgccggugaccuuggccgccucggaug

SEQ ID NO: 371688 - RNA, 32 nt, Human
ccccucgccugccugugucucuccccaaaccc

SEQ ID NO: 371689 - RNA, 22 nt, Human
ccccucgcgcacccagcgcaga

SEQ ID NO: 371690 - RNA, 18 nt, Human
ccccucgcgcuccagcca

SEQ ID NO: 371691 - RNA, 32 nt, Human
ccccucgcuggcuuccccaccucucucaggau

SEQ ID NO: 371692 - RNA, 32 nt, Human
ccccucgcuguagucgcggagcugugucuguu

SEQ ID NO: 371693 - RNA, 32 nt, Human
ccccucgcugucuuuagcaagcagguuucacu

SEQ ID NO: 371694 - RNA, 32 nt, Human
ccccucggagccugguagugggccacaagccc

SEQ ID NO: 371695 - RNA, 32 nt, Human
ccccucggaggagccuccagaggaggaaaucc

SEQ ID NO: 371696 - RNA, 32 nt, Human
ccccucggccauucccuccaccuccaagacag

SEQ ID NO: 371697 - RNA, 32 nt, Human
ccccucggcccaggaacccaggggaagcugcu

SEQ ID NO: 371698 - RNA, 24 nt, Human
ccccucggcccugcugcucugccc

SEQ ID NO: 371699 - RNA, 22 nt, Human
ccccucggccguagccaccuca

SEQ ID NO: 371700 - RNA, 32 nt, Human
ccccucggccuccugggcaacuugggguacac

SEQ ID NO: 371701 - RNA, 20 nt, Human
ccccucggcugccccuccuc

SEQ ID NO: 371702 - RNA, 32 nt, Human
ccccucggggauaugacacaugcccaugauga

SEQ ID NO: 371703 - RNA, 32 nt, Human
ccccucgucaccauccuguccuuggcuggccg

SEQ ID NO: 371704 - RNA, 32 nt, Human
ccccucgucccccuaggagcagacccaagcuu

SEQ ID NO: 371705 - RNA, 32 nt, Human
ccccucgucccuuccuccgcccccucuccucg

SEQ ID NO: 371706 - RNA, 32 nt, Human
ccccucgucucacccccuuuacacucacauuu

SEQ ID NO: 371707 - RNA, 32 nt, Human
ccccucguucccuagggagagccccaggggcc

SEQ ID NO: 371708 - RNA, 17 nt, Human
ccccucuaccuccucca

SEQ ID NO: 371709 - RNA, 32 nt, Human
ccccucuagcuccugcucacccacgcccaccc

SEQ ID NO: 371710 - RNA, 19 nt, Human
ccccucuaggcuuccugga

SEQ ID NO: 371711 - RNA, 23 nt, Human
ccccucuagucgaaauauuuugu

SEQ ID NO: 371712 - RNA, 32 nt, Human
ccccucucaaagcugucaccagggccaaagug

SEQ ID NO: 371713 - RNA, 32 nt, Human
ccccucucaaauacccuuauuuuauuuauguu

SEQ ID NO: 371714 - RNA, 32 nt, Human
ccccucucacacuuugucacuggaauuuuauu

SEQ ID NO: 371715 - RNA, 32 nt, Human
ccccucucaccagggcccucgcccgcuggucc

SEQ ID NO: 371716 - RNA, 32 nt, Human
ccccucucagaacauacugauugggaggugcg

SEQ ID NO: 371717 - RNA, 32 nt, Human
ccccucucagcccucaguaggugggaggggcc

SEQ ID NO: 371718 - RNA, 32 nt, Human
ccccucucauuguucagcauucuugucaaguu

SEQ ID NO: 371719 - RNA, 31 nt, Human
ccccucuccagcucggucaccaaagcugucu

SEQ ID NO: 371720 - RNA, 32 nt, Human
ccccucuccaucuccucugucucccccgucuc

SEQ ID NO: 371721 - RNA, 20 nt, Human
ccccucuccccaaacuccuc

SEQ ID NO: 371722 - RNA, 32 nt, Human
ccccucucccccaaaugcagcugaagcauuuu

SEQ ID NO: 371723 - RNA, 24 nt, Human
ccccucuccccgcaguguuugugu

SEQ ID NO: 371724 - RNA, 32 nt, Human
ccccucuccccgcguggacuccugagccugcg

SEQ ID NO: 371725 - RNA, 32 nt, Human
ccccucucccguggaugcuccagcacauugca

SEQ ID NO: 371726 - RNA, 32 nt, Human
ccccucucccuccuacucucccccuuucucuc

SEQ ID NO: 371727 - RNA, 32 nt, Human
ccccucucccugcuuggcagagccgcuggagg

SEQ ID NO: 371728 - RNA, 20 nt, Human
ccccucuccucgcccugcuc

SEQ ID NO: 371729 - RNA, 32 nt, Human
ccccucuccucucccuccuccugguccucauc

SEQ ID NO: 371730 - RNA, 19 nt, Human
ccccucuccucucuuccuc

SEQ ID NO: 371731 - RNA, 18 nt, Human
ccccucuccucugucucc

SEQ ID NO: 371732 - RNA, 32 nt, Human
ccccucuccugaagcccugccgcuguggcagc

SEQ ID NO: 371733 - RNA, 32 nt, Human
ccccucuccugagccugucucucccuacccuc

SEQ ID NO: 371734 - RNA, 24 nt, Human
ccccucuccugccucccuccacca

SEQ ID NO: 371735 - RNA, 18 nt, Human
ccccucuccugucccucc

SEQ ID NO: 371736 - RNA, 32 nt, Human
ccccucucgcagcugcagccccaccugccagu

SEQ ID NO: 371737 - RNA, 32 nt, Human
ccccucucgcagcugcucacgccuuagcuggc

SEQ ID NO: 371738 - RNA, 32 nt, Human
ccccucucuagcucccucacccucucccuuuc

SEQ ID NO: 371739 - RNA, 32 nt, Human
ccccucucucccuccugugucuugcgcuuuau

SEQ ID NO: 371740 - RNA, 32 nt, Human
ccccucucuccuccaugcugccuccccuagcu

SEQ ID NO: 371741 - RNA, 32 nt, Human
ccccucucuccuccucaugccacugccucucc

SEQ ID NO: 371742 - RNA, 32 nt, Human
ccccucucuccucgggaucggguccccagagc

SEQ ID NO: 371743 - RNA, 32 nt, Human
ccccucucuccucuuccuccccucucucuucc

SEQ ID NO: 371744 - RNA, 32 nt, Human
ccccucucucuccaucccuuccuuccucccuc

SEQ ID NO: 371745 - RNA, 21 nt, Human
ccccucucucugccccuccca

SEQ ID NO: 371746 - RNA, 32 nt, Human
ccccucucugcagccucuccugccacucgggg

SEQ ID NO: 371747 - RNA, 32 nt, Human
ccccucucuggcccaugguccugcuucaugcu

SEQ ID NO: 371748 - RNA, 24 nt, Human
ccccucucuuccuacccuuccuca

SEQ ID NO: 371749 - RNA, 32 nt, Human
ccccucugaaaccagaaaugagaagucagcuu

SEQ ID NO: 371750 - RNA, 32 nt, Human
ccccucugacaucacuggcauugcaccugggu

SEQ ID NO: 371751 - RNA, 32 nt, Human
ccccucugagcacuucccuugugacaggccac

SEQ ID NO: 371752 - RNA, 32 nt, Human
ccccucugagcucugggagggaagggaaugga

SEQ ID NO: 371753 - RNA, 32 nt, Human
ccccucugagguuucucagguggcaauguaac

SEQ ID NO: 371754 - RNA, 18 nt, Human
ccccucugcaccagcuca

SEQ ID NO: 371755 - RNA, 24 nt, Human
ccccucugcagaucugaagacaca

SEQ ID NO: 371756 - RNA, 21 nt, Human
ccccucugcaugcagcacaga

SEQ ID NO: 371757 - RNA, 32 nt, Human
ccccucugcauuuacacaccagacacacaaac

SEQ ID NO: 371758 - RNA, 32 nt, Human
ccccucugccaagagauccauaccgaggcagc

SEQ ID NO: 371759 - RNA, 32 nt, Human
ccccucugccacccucccauccguccgcgggu

SEQ ID NO: 371760 - RNA, 32 nt, Human
ccccucugcccaggcugccacgcccuggaugc

SEQ ID NO: 371761 - RNA, 32 nt, Human
ccccucugccccacccucagccgcucuuugcu

SEQ ID NO: 371762 - RNA, 21 nt, Human
ccccucugccccccgccaagu

SEQ ID NO: 371763 - RNA, 18 nt, Human
ccccucugccccuccuca

SEQ ID NO: 371764 - RNA, 32 nt, Human
ccccucugcccuuuccccuucucccccucccc

SEQ ID NO: 371765 - RNA, 32 nt, Human
ccccucugccuccccucccccgacccuccugc

SEQ ID NO: 371766 - RNA, 22 nt, Human
ccccucugcucaucccuccuca

SEQ ID NO: 371767 - RNA, 32 nt, Human
ccccucugcucaucccuccucauucagacauc

SEQ ID NO: 371768 - RNA, 21 nt, Human
ccccucugcugcugucccucc

SEQ ID NO: 371769 - RNA, 22 nt, Human
ccccucugcugggccccuccuc

SEQ ID NO: 371770 - RNA, 32 nt, Human
ccccucugcuggguagagaggcacuuucaggg

SEQ ID NO: 371771 - RNA, 32 nt, Human
ccccucugcuggguguaacugcucugaaauaa

SEQ ID NO: 371772 - RNA, 32 nt, Human
ccccucuggaaaugugguucccagggaugggc

SEQ ID NO: 371773 - RNA, 22 nt, Human
ccccucuggagcagaaccccca

SEQ ID NO: 371774 - RNA, 32 nt, Human
ccccucuggcagccccaggugggagcugggag

SEQ ID NO: 371775 - RNA, 19 nt, Human
ccccucuggccugcuggca

SEQ ID NO: 371776 - RNA, 26 nt, Human
ccccucuggcuucccgaacccggcca

SEQ ID NO: 371777 - RNA, 32 nt, Human
ccccucugggagaggggaggggccggcuuuug

SEQ ID NO: 371778 - RNA, 31 nt, Human
ccccucugguggcaugccaugccaagagcaa

SEQ ID NO: 371779 - RNA, 32 nt, Human
ccccucuggugucaugucaggcauuuugcaag

SEQ ID NO: 371780 - RNA, 20 nt, Human
ccccucuguaccccaacuca

SEQ ID NO: 371781 - RNA, 32 nt, Human
ccccucuguaggaaugagaccaagccacagcu

SEQ ID NO: 371782 - RNA, 32 nt, Human
ccccucuguccgcgccauggccgcccccgacc

SEQ ID NO: 371783 - RNA, 20 nt, Human
ccccucuguccucguucccu

SEQ ID NO: 371784 - RNA, 32 nt, Human
ccccucugugaccucucuccucaggccucuag

SEQ ID NO: 371785 - RNA, 32 nt, Human
ccccucuguucccagccccagccuuucuaagc

SEQ ID NO: 371786 - RNA, 32 nt, Human
ccccucuguucuguggcugagcacuuucccag

SEQ ID NO: 371787 - RNA, 32 nt, Human
ccccucuuagaacuugaccaaaauagaaguaa

SEQ ID NO: 371788 - RNA, 20 nt, Human
ccccucuuccagccagccca

SEQ ID NO: 371789 - RNA, 20 nt, Human
ccccucuucccucccccuca

SEQ ID NO: 371790 - RNA, 32 nt, Human
ccccucuucccugguaagaaaaagcaaaaggc

SEQ ID NO: 371791 - RNA, 19 nt, Human
ccccucuuccuccuccuca

SEQ ID NO: 371792 - RNA, 32 nt, Human
ccccucuuccuccuccucaagggaaagcugcc

SEQ ID NO: 371793 - RNA, 23 nt, Human
ccccucuuccucuugacccugca

SEQ ID NO: 371794 - RNA, 32 nt, Human
ccccucuucucccagucuucagucuuaagucg

SEQ ID NO: 371795 - RNA, 32 nt, Human
ccccucuucuccccgcccucccccagcuccua

SEQ ID NO: 371796 - RNA, 32 nt, Human
ccccucuucugcuccuuagacaccugaaugga

SEQ ID NO: 371797 - RNA, 21 nt, Human
ccccucuucuuccucuguaga

SEQ ID NO: 371798 - RNA, 32 nt, Human
ccccucuugacccuuccucccaccccaauucc

SEQ ID NO: 371799 - RNA, 17 nt, Human
ccccucuugcaguuugu

SEQ ID NO: 371800 - RNA, 32 nt, Human
ccccucuuggccucugucccagcucucugcag

SEQ ID NO: 371801 - RNA, 21 nt, Human
ccccucuuggguccccuccuc

SEQ ID NO: 371802 - RNA, 32 nt, Human
ccccucuuuaaccucaucuacaagcauuugcc

SEQ ID NO: 371803 - RNA, 32 nt, Human
ccccucuuucagcuucuaugugguguuggagg

SEQ ID NO: 371804 - RNA, 32 nt, Human
ccccucuuuccuccaaccuccauauccugcca

SEQ ID NO: 371805 - RNA, 21 nt, Human
ccccucuuucuuucugugcaa

SEQ ID NO: 371806 - RNA, 32 nt, Human
ccccucuuugcucuccucguguccucucccag

SEQ ID NO: 371807 - RNA, 21 nt, Human
ccccucuuuuccaguccuugc

SEQ ID NO: 371808 - RNA, 32 nt, Human
ccccugaaacagcucccggagcccugccuguu

SEQ ID NO: 371809 - RNA, 32 nt, Human
ccccugaaaggugagaaagugacugagagagg

SEQ ID NO: 371810 - RNA, 32 nt, Human
ccccugaacagaacccagcccauaagagacau

SEQ ID NO: 371811 - RNA, 32 nt, Human
ccccugaacuaucagcuuaacuuccagcucua

SEQ ID NO: 371812 - RNA, 32 nt, Human
ccccugaaggugaguaugggaggcaggggccg

SEQ ID NO: 371813 - RNA, 32 nt, Human
ccccugaagucuccaucucagcuguauauucu

SEQ ID NO: 371814 - RNA, 21 nt, Human
ccccugaagucugucugcucc

SEQ ID NO: 371815 - RNA, 21 nt, Human
ccccugaagucuguguucucc

SEQ ID NO: 371816 - RNA, 32 nt, Human
ccccugaagugcugggauuacaggugugagcc

SEQ ID NO: 371817 - RNA, 32 nt, Human
ccccugaagugucuccagcagaagagauggau

SEQ ID NO: 371818 - RNA, 32 nt, Human
ccccugaaguucuggcucagggcacaggguac

SEQ ID NO: 371819 - RNA, 20 nt, Human
ccccugaaucagcucugucc

SEQ ID NO: 371820 - RNA, 32 nt, Human
ccccugacacagaccacuagaagauuccggga

SEQ ID NO: 371821 - RNA, 32 nt, Human
ccccugacagauagcugcuucucuccauuuca

SEQ ID NO: 371822 - RNA, 32 nt, Human
ccccugacagauucucaaguaggacgauguuc

SEQ ID NO: 371823 - RNA, 19 nt, Human
ccccugacagcacuggcuc

SEQ ID NO: 371824 - RNA, 32 nt, Human
ccccugaccaggcccugcuccucugcuggggu

SEQ ID NO: 371825 - RNA, 25 nt, Human
ccccugacgcuggcccuuggggccu

SEQ ID NO: 371826 - RNA, 20 nt, Human
ccccugacuccauguggccu

SEQ ID NO: 371827 - RNA, 20 nt, Human
ccccugacuccgucccggcc

SEQ ID NO: 371828 - RNA, 22 nt, Human
ccccugacuccucacgugccug

SEQ ID NO: 371829 - RNA, 21 nt, Human
ccccugacugcuccucggggc

SEQ ID NO: 371830 - RNA, 24 nt, Human
ccccugacugcuccucggggccug

SEQ ID NO: 371831 - RNA, 32 nt, Human
ccccugacuucugcuucaccuuugaccucugc

SEQ ID NO: 371832 - RNA, 32 nt, Human
ccccugagaacagaggucagacacagcugcgu

SEQ ID NO: 371833 - RNA, 32 nt, Human
ccccugagacaagugagggguagucggugaaa

SEQ ID NO: 371834 - RNA, 32 nt, Human
ccccugagaccaaagaagaggggccaaguacc

SEQ ID NO: 371835 - RNA, 26 nt, Human
ccccugagcagagaccgcagcacaga

SEQ ID NO: 371836 - RNA, 32 nt, Human
ccccugagcagcugggacuacaggcacacacc

SEQ ID NO: 371837 - RNA, 21 nt, Human
ccccugagcccgcggcgcuga

SEQ ID NO: 371838 - RNA, 32 nt, Human
ccccugagccuggguagcggcgcgagggccgg

SEQ ID NO: 371839 - RNA, 18 nt, Human
ccccugagcggcucagca

SEQ ID NO: 371840 - RNA, 32 nt, Human
ccccugagcugauucccagugacagugcagca

SEQ ID NO: 371841 - RNA, 30 nt, Human
ccccugagcuugcagagaugaaggccgcca

SEQ ID NO: 371842 - RNA, 18 nt, Human
ccccugagcuuucaggua

SEQ ID NO: 371843 - RNA, 32 nt, Human
ccccugaggaugggaaaggagcucuucaguug

SEQ ID NO: 371844 - RNA, 32 nt, Human
ccccugaggcucagggaaaggccagugugaac

SEQ ID NO: 371845 - RNA, 32 nt, Human
ccccugagggcugcucuagaggacucaggccc

SEQ ID NO: 371846 - RNA, 32 nt, Human
ccccugaggucuugagagaugugcccacugcc

SEQ ID NO: 371847 - RNA, 32 nt, Human
ccccugaguagcugggauuacaggcacguacc

SEQ ID NO: 371848 - RNA, 32 nt, Human
ccccugaguagcugggauuacaggugcaccac

SEQ ID NO: 371849 - RNA, 32 nt, Human
ccccugaguagcugggauuacaggugccugcc

SEQ ID NO: 371850 - RNA, 32 nt, Human
ccccugagucaacuggagcaagaaggaaggag

SEQ ID NO: 371851 - RNA, 32 nt, Human
ccccugauagcccagagguagggccagagaca

SEQ ID NO: 371852 - RNA, 32 nt, Human
ccccugaugacuggcugccucuacacagacuc

SEQ ID NO: 371853 - RNA, 32 nt, Human
ccccugaugccauaggagaccuaucgucuugg

SEQ ID NO: 371854 - RNA, 32 nt, Human
ccccugaugcccaggcugggugcaggcucuca

SEQ ID NO: 371855 - RNA, 32 nt, Human
ccccugaugcuuucuccuugggugauaguaac

SEQ ID NO: 371856 - RNA, 32 nt, Human
ccccugauugaaugagccuauggaugaagacu

SEQ ID NO: 371857 - RNA, 18 nt, Human
ccccugauuguccaggug

SEQ ID NO: 371858 - RNA, 32 nt, Human
ccccugcaaaccugcuugcugaccucaggcuu

SEQ ID NO: 371859 - RNA, 32 nt, Human
ccccugcaaaggcaggcaaggccaggcgggug

SEQ ID NO: 371860 - RNA, 32 nt, Human
ccccugcaaauggagaccugugcaccugguug

SEQ ID NO: 371861 - RNA, 32 nt, Human
ccccugcaaggguagagucaggugagaguccc

SEQ ID NO: 371862 - RNA, 22 nt, Human
ccccugcaauacccaguuuggc

SEQ ID NO: 371863 - RNA, 32 nt, Human
ccccugcaauccagaccacaagcacccuuuau

SEQ ID NO: 371864 - RNA, 32 nt, Human
ccccugcacaacuaucucacuccugcuuggag

SEQ ID NO: 371865 - RNA, 32 nt, Human
ccccugcacaagcucccucucuugccugccac

SEQ ID NO: 371866 - RNA, 32 nt, Human
ccccugcacauacucucuugcuugcugccaug

SEQ ID NO: 371867 - RNA, 32 nt, Human
ccccugcacaugcauaaacgggcacaccccag

SEQ ID NO: 371868 - RNA, 32 nt, Human
ccccugcacuagcugucccaagcuuacauaca

SEQ ID NO: 371869 - RNA, 32 nt, Human
ccccugcacuccaggcugggcaacaguacgag

SEQ ID NO: 371870 - RNA, 32 nt, Human
ccccugcacugagauuauuuccagauugcacu

SEQ ID NO: 371871 - RNA, 32 nt, Human
ccccugcacugagcccccuuagaucuacugcc

SEQ ID NO: 371872 - RNA, 32 nt, Human
ccccugcagagccagccagggcggagagccau

SEQ ID NO: 371873 - RNA, 32 nt, Human
ccccugcagaugggcagagggaugcaugggga

SEQ ID NO: 371874 - RNA, 32 nt, Human
ccccugcagccagagguuugcaguggguagug

SEQ ID NO: 371875 - RNA, 32 nt, Human
ccccugcagccccagcccugcuuuucaucccc

SEQ ID NO: 371876 - RNA, 18 nt, Human
ccccugcagccccccaca

SEQ ID NO: 371877 - RNA, 32 nt, Human
ccccugcagccggacaccagcuccaggguccc

SEQ ID NO: 371878 - RNA, 32 nt, Human
ccccugcagccucccaggacaggcuggcaagg

SEQ ID NO: 371879 - RNA, 32 nt, Human
ccccugcagcugguuauccugacauuaugcac

SEQ ID NO: 371880 - RNA, 32 nt, Human
ccccugcagggugggggucuguggcagagccg

SEQ ID NO: 371881 - RNA, 32 nt, Human
ccccugcagggugucugcccucagggaacuca

SEQ ID NO: 371882 - RNA, 32 nt, Human
ccccugcagguguggcagagauggggcauggg

SEQ ID NO: 371883 - RNA, 32 nt, Human
ccccugcaguucugccucacacggcucaaguc

SEQ ID NO: 371884 - RNA, 31 nt, Human
ccccugcaguuucuugcuuucuucagcacau

SEQ ID NO: 371885 - RNA, 32 nt, Human
ccccugcauagcaacaguuccuccuagccuca

SEQ ID NO: 371886 - RNA, 32 nt, Human
ccccugcaugcacccagggccacccggcagca

SEQ ID NO: 371887 - RNA, 32 nt, Human
ccccugcaugcagagcuuccagccugagaacc

SEQ ID NO: 371888 - RNA, 32 nt, Human
ccccugcauuugccaagcuccaaagacucccu

SEQ ID NO: 371889 - RNA, 32 nt, Human
ccccugccacaccccagccucugacuugcugu

SEQ ID NO: 371890 - RNA, 19 nt, Human
ccccugccaccccucccca

SEQ ID NO: 371891 - RNA, 32 nt, Human
ccccugccacccuacuccucaccagaauuguc

SEQ ID NO: 371892 - RNA, 32 nt, Human
ccccugccacucagagcagagcagggggcuga

SEQ ID NO: 371893 - RNA, 32 nt, Human
ccccugccagaauggaggccagugcauguaug

SEQ ID NO: 371894 - RNA, 32 nt, Human
ccccugccagccaccugcaccugcugcccucc

SEQ ID NO: 371895 - RNA, 32 nt, Human
ccccugccaugcagagcaggaagccucagcug

SEQ ID NO: 371896 - RNA, 19 nt, Human
ccccugcccacccagcucc

SEQ ID NO: 371897 - RNA, 16 nt, Human
ccccugcccacuccac

SEQ ID NO: 371898 - RNA, 32 nt, Human
ccccugcccagagauucccccuucuccucucc

SEQ ID NO: 371899 - RNA, 32 nt, Human
ccccugcccagccugcucucccuaaccccuug

SEQ ID NO: 371900 - RNA, 32 nt, Human
ccccugcccaggcugccaugugagggugugca

SEQ ID NO: 371901 - RNA, 32 nt, Human
ccccugcccaggugccauggccgcauuguacc

SEQ ID NO: 371902 - RNA, 17 nt, Human
ccccugcccaguuuggc

SEQ ID NO: 371903 - RNA, 20 nt, Human
ccccugccccacccuccuca

SEQ ID NO: 371904 - RNA, 17 nt, Human
ccccugccccauccuca

SEQ ID NO: 371905 - RNA, 32 nt, Human
ccccugccccauggcccuggaugucacacucc

SEQ ID NO: 371906 - RNA, 32 nt, Human
ccccugcccccacuccagggcagccaugaugu

SEQ ID NO: 371907 - RNA, 32 nt, Human
ccccugcccccagagcaaaaggcaacccgaag

SEQ ID NO: 371908 - RNA, 32 nt, Human
ccccugcccccaugcccuccccaggcgaugga

SEQ ID NO: 371909 - RNA, 15 nt, Human
ccccugcccccggug

SEQ ID NO: 371910 - RNA, 27 nt, Human
ccccugcccccuccacuccggggccug

SEQ ID NO: 371911 - RNA, 32 nt, Human
ccccugcccccuuuuccuggugcaugugaagu

SEQ ID NO: 371912 - RNA, 23 nt, Human
ccccugccccgccuuggguccug

SEQ ID NO: 371913 - RNA, 19 nt, Human
ccccugccccuuguuggua

SEQ ID NO: 371914 - RNA, 32 nt, Human
ccccugcccgccgcccccuccccagggcccug

SEQ ID NO: 371915 - RNA, 25 nt, Human
ccccugcccggcuccgcggcgcgga

SEQ ID NO: 371916 - RNA, 32 nt, Human
ccccugcccgggaagggaccuugcagggaccu

SEQ ID NO: 371917 - RNA, 32 nt, Human
ccccugcccgggcuggaguugccacagccugu

SEQ ID NO: 371918 - RNA, 21 nt, Human
ccccugcccuaugcucuggug

SEQ ID NO: 371919 - RNA, 32 nt, Human
ccccugcccugagaguugcccgugcccuggac

SEQ ID NO: 371920 - RNA, 32 nt, Human
ccccugcccugaugucagcugcuuugcacaaa

SEQ ID NO: 371921 - RNA, 32 nt, Human
ccccugcccugccuccccaguauugugaaugc

SEQ ID NO: 371922 - RNA, 32 nt, Human
ccccugcccugccuccccuuucaccauguuuc

SEQ ID NO: 371923 - RNA, 32 nt, Human
ccccugcccugccucuguccuggcucugaacu

SEQ ID NO: 371924 - RNA, 32 nt, Human
ccccugcccugccugagcccugcgcuggccag

SEQ ID NO: 371925 - RNA, 32 nt, Human
ccccugcccugcggcuggucagccugguccuc

SEQ ID NO: 371926 - RNA, 23 nt, Human
ccccugcccugcuccuaagggua

SEQ ID NO: 371927 - RNA, 32 nt, Human
ccccugcccuggaggggaggggcgauaaauac

SEQ ID NO: 371928 - RNA, 32 nt, Human
ccccugcccuggcacagcugcaugcacuucaa

SEQ ID NO: 371929 - RNA, 19 nt, Human
ccccugcccuguccaggug

SEQ ID NO: 371930 - RNA, 32 nt, Human
ccccugcccuuccuccugauggagugugcaga

SEQ ID NO: 371931 - RNA, 32 nt, Human
ccccugccgagagaagaggaguggaugagccu

SEQ ID NO: 371932 - RNA, 27 nt, Human
ccccugccgcagcgcgccgcagccggg

SEQ ID NO: 371933 - RNA, 32 nt, Human
ccccugccgcaucuuugaccugggcagcgaca

SEQ ID NO: 371934 - RNA, 32 nt, Human
ccccugccgcggaggcagcggcggcagcggcu

SEQ ID NO: 371935 - RNA, 32 nt, Human
ccccugccggacccuccacccuucggccccca

SEQ ID NO: 371936 - RNA, 32 nt, Human
ccccugccgucaaucuccaccucaagggagcc

SEQ ID NO: 371937 - RNA, 32 nt, Human
ccccugccuacgccccuaccacugcugaagcc

SEQ ID NO: 371938 - RNA, 21 nt, Human
ccccugccucaagcccugccc

SEQ ID NO: 371939 - RNA, 32 nt, Human
ccccugccucaccaccuccucuccgcucuccc

SEQ ID NO: 371940 - RNA, 21 nt, Human
ccccugccucacgaaaaccca

SEQ ID NO: 371941 - RNA, 18 nt, Human
ccccugccuccaaaccuc

SEQ ID NO: 371942 - RNA, 32 nt, Human
ccccugccuccaccauauccacuaccaggcac

SEQ ID NO: 371943 - RNA, 32 nt, Human
ccccugccuccaggacccuguugcuaugguga

SEQ ID NO: 371944 - RNA, 17 nt, Human
ccccugccuccaguugc

SEQ ID NO: 371945 - RNA, 32 nt, Human
ccccugccuccgaggccugccugcuacccuca

SEQ ID NO: 371946 - RNA, 32 nt, Human
ccccugccuccgaggccugccugcuccccuca

SEQ ID NO: 371947 - RNA, 32 nt, Human
ccccugccuccuccuccuccucuuggcucuau

SEQ ID NO: 371948 - RNA, 24 nt, Human
ccccugccucgguuucccuucugu

SEQ ID NO: 371949 - RNA, 23 nt, Human
ccccugccucuaucuucuucugc

SEQ ID NO: 371950 - RNA, 22 nt, Human
ccccugccucucaccucuaccc

SEQ ID NO: 371951 - RNA, 32 nt, Human
ccccugccucucccugugucccuuccccugag

SEQ ID NO: 371952 - RNA, 32 nt, Human
ccccugccucucggacucgggcugcggcguca

SEQ ID NO: 371953 - RNA, 32 nt, Human
ccccugccucuggggcucugugguguaggcua

SEQ ID NO: 371954 - RNA, 32 nt, Human
ccccugccucuugccccggcuaguuucccugg

SEQ ID NO: 371955 - RNA, 32 nt, Human
ccccugccucuuuccccuacuuagcuccuuag

SEQ ID NO: 371956 - RNA, 32 nt, Human
ccccugccugaccuucauucaaacagaaccuc

SEQ ID NO: 371957 - RNA, 20 nt, Human
ccccugccugcccccaccca

SEQ ID NO: 371958 - RNA, 24 nt, Human
ccccugccugcguccuggggccug

SEQ ID NO: 371959 - RNA, 32 nt, Human
ccccugccugcucugguccaccccguccugac

SEQ ID NO: 371960 - RNA, 32 nt, Human
ccccugccugggaggcucucccaggggcugau

SEQ ID NO: 371961 - RNA, 32 nt, Human
ccccugccuuucucauuccuuccuucgucucc

SEQ ID NO: 371962 - RNA, 32 nt, Human
ccccugccuuucucccccaacccaaggcugac

SEQ ID NO: 371963 - RNA, 32 nt, Human
ccccugccuuucucuuccuccaucaggcccug

SEQ ID NO: 371964 - RNA, 32 nt, Human
ccccugcgacucccuguuuccugggcuagucu

SEQ ID NO: 371965 - RNA, 32 nt, Human
ccccugcgcacggacgccgggaagaagggggu

SEQ ID NO: 371966 - RNA, 32 nt, Human
ccccugcgcagggcccuccugcucugaggguu

SEQ ID NO: 371967 - RNA, 24 nt, Human
ccccugcgccgcacccggggccug

SEQ ID NO: 371968 - RNA, 19 nt, Human
ccccugcggccuuugcuca

SEQ ID NO: 371969 - RNA, 32 nt, Human
ccccugcgucucacccuaggcgggcugggcgg

SEQ ID NO: 371970 - RNA, 32 nt, Human
ccccugcguguugccaagcuccgucuccagcu

SEQ ID NO: 371971 - RNA, 32 nt, Human
ccccugcuacagccacagagcccacucccagc

SEQ ID NO: 371972 - RNA, 18 nt, Human
ccccugcuaucccuccuc

SEQ ID NO: 371973 - RNA, 32 nt, Human
ccccugcuaucucccuuccugcuucgaaggac

SEQ ID NO: 371974 - RNA, 32 nt, Human
ccccugcucaaggucaagacccugcucaagga

SEQ ID NO: 371975 - RNA, 19 nt, Human
ccccugcucacccuccuca

SEQ ID NO: 371976 - RNA, 32 nt, Human
ccccugcucacccucugggcuuugucuccgag

SEQ ID NO: 371977 - RNA, 19 nt, Human
ccccugcuccacagcgccc

SEQ ID NO: 371978 - RNA, 18 nt, Human
ccccugcuccagucgagu

SEQ ID NO: 371979 - RNA, 32 nt, Human
ccccugcucccaucugucccugaggaagcccc

SEQ ID NO: 371980 - RNA, 23 nt, Human
ccccugcuccccaggcccugccc

SEQ ID NO: 371981 - RNA, 22 nt, Human
ccccugcucccgucugucuguc

SEQ ID NO: 371982 - RNA, 23 nt, Human
ccccugcucccuccacucugccc

SEQ ID NO: 371983 - RNA, 23 nt, Human
ccccugcuccggcaggcauccca

SEQ ID NO: 371984 - RNA, 32 nt, Human
ccccugcucugcccucccuggcuccuggacua

SEQ ID NO: 371985 - RNA, 32 nt, Human
ccccugcucugggcuucucuccuguuuucccc

SEQ ID NO: 371986 - RNA, 32 nt, Human
ccccugcucugucugguacaggccccugcuga

SEQ ID NO: 371987 - RNA, 17 nt, Human
ccccugcucuuccaggu

SEQ ID NO: 371988 - RNA, 32 nt, Human
ccccugcucuuccuccugacccugcugcucuu

SEQ ID NO: 371989 - RNA, 32 nt, Human
ccccugcugagauggcugugacccugggcuga

SEQ ID NO: 371990 - RNA, 22 nt, Human
ccccugcugcagccacgagggg

SEQ ID NO: 371991 - RNA, 18 nt, Human
ccccugcugcccagcuca

SEQ ID NO: 371992 - RNA, 19 nt, Human
ccccugcugcccugagcca

SEQ ID NO: 371993 - RNA, 21 nt, Human
ccccugcugcggaugcugagu

SEQ ID NO: 371994 - RNA, 32 nt, Human
ccccugcugcgggcucugccuuggugucaugc

SEQ ID NO: 371995 - RNA, 32 nt, Human
ccccugcugcuggagugcaauugcacaaucuc

SEQ ID NO: 371996 - RNA, 32 nt, Human
ccccugcugcugucuuggugccugucacccac

SEQ ID NO: 371997 - RNA, 32 nt, Human
ccccugcugcugugcccagucugaguaccuug

SEQ ID NO: 371998 - RNA, 32 nt, Human
ccccugcugcuguguuggacacuugcucccau

SEQ ID NO: 371999 - RNA, 32 nt, Human
ccccugcugcuugagaugccagagcuguguug

SEQ ID NO: 372000 - RNA, 32 nt, Human
ccccugcugcuugggacguguacagcacagaa

SEQ ID NO: 372001 - RNA, 32 nt, Human
ccccugcuguagccuggugaagaccaccuggg

SEQ ID NO: 372002 - RNA, 32 nt, Human
ccccugcugugggaaagguggggaagaagggg

SEQ ID NO: 372003 - RNA, 32 nt, Human
ccccugcuuaaaaauggacaaaaagaaacuau

SEQ ID NO: 372004 - RNA, 32 nt, Human
ccccugcuuacauuccagacagacacagacua

SEQ ID NO: 372005 - RNA, 18 nt, Human
ccccugcuugccagcuca

SEQ ID NO: 372006 - RNA, 32 nt, Human
ccccugcuuggaggcccuucucugauggggug

SEQ ID NO: 372007 - RNA, 32 nt, Human
ccccugcuuggcuguaugcacugucuauauug

SEQ ID NO: 372008 - RNA, 20 nt, Human
ccccugcuuguccuggacca

SEQ ID NO: 372009 - RNA, 19 nt, Human
ccccuggaaacccaccucu

SEQ ID NO: 372010 - RNA, 32 nt, Human
ccccuggaaagccaccagauuggaggucacca

SEQ ID NO: 372011 - RNA, 22 nt, Human
ccccuggaaaggucccucccca

SEQ ID NO: 372012 - RNA, 20 nt, Human
ccccuggaacugaaccaggg

SEQ ID NO: 372013 - RNA, 21 nt, Human
ccccuggaagaggcaggcagg

SEQ ID NO: 372014 - RNA, 22 nt, Human
ccccuggaauaugcagcccggg

SEQ ID NO: 372015 - RNA, 23 nt, Human
ccccuggaauugauggguauaga

SEQ ID NO: 372016 - RNA, 24 nt, Human
ccccuggacacacacagcccugga

SEQ ID NO: 372017 - RNA, 22 nt, Human
ccccuggacaguagcaggcagg

SEQ ID NO: 372018 - RNA, 21 nt, Human
ccccuggacagugggcagggg

SEQ ID NO: 372019 - RNA, 32 nt, Human
ccccuggacaugccuuucuccacguccgccuc

SEQ ID NO: 372020 - RNA, 32 nt, Human
ccccuggaccacugccucccucccucccccug

SEQ ID NO: 372021 - RNA, 23 nt, Human
ccccuggacggcagaggcaagga

SEQ ID NO: 372022 - RNA, 23 nt, Human
ccccuggacuuagcggaugcagg

SEQ ID NO: 372023 - RNA, 32 nt, Human
ccccuggagccaagccuauccagcuaacaaga

SEQ ID NO: 372024 - RNA, 32 nt, Human
ccccuggagccagauggcaagagggugacagc

SEQ ID NO: 372025 - RNA, 32 nt, Human
ccccuggagccccagcccugccuucaugcuca

SEQ ID NO: 372026 - RNA, 20 nt, Human
ccccuggagcuauccgggua

SEQ ID NO: 372027 - RNA, 24 nt, Human
ccccuggaggacucgcagugcuga

SEQ ID NO: 372028 - RNA, 32 nt, Human
ccccuggaggcagagcacugagcuggacccug

SEQ ID NO: 372029 - RNA, 32 nt, Human
ccccuggaggggcaauggggaggugaugucuu

SEQ ID NO: 372030 - RNA, 32 nt, Human
ccccuggaggggcuggaguuuauccagcgccu

SEQ ID NO: 372031 - RNA, 32 nt, Human
ccccuggaggugggggcugcuggcugaggagg

SEQ ID NO: 372032 - RNA, 32 nt, Human
ccccuggagucgggccgcugagcccacggcag

SEQ ID NO: 372033 - RNA, 20 nt, Human
ccccuggaucuaccagcaua

SEQ ID NO: 372034 - RNA, 21 nt, Human
ccccuggaugcagccucacag

SEQ ID NO: 372035 - RNA, 24 nt, Human
ccccuggcacccccagaccugccc

SEQ ID NO: 372036 - RNA, 21 nt, Human
ccccuggcacugaggcacaga

SEQ ID NO: 372037 - RNA, 23 nt, Human
ccccuggcagacgguggcguaga

SEQ ID NO: 372038 - RNA, 21 nt, Human
ccccuggcagagccgcagggc

SEQ ID NO: 372039 - RNA, 32 nt, Human
ccccuggcagccaagaacagauaggaagggau

SEQ ID NO: 372040 - RNA, 22 nt, Human
ccccuggcagugcucccggagg

SEQ ID NO: 372041 - RNA, 22 nt, Human
ccccuggccaaguuggguccua

SEQ ID NO: 372042 - RNA, 24 nt, Human
ccccuggccacagacccccagggc

SEQ ID NO: 372043 - RNA, 21 nt, Human
ccccuggccacgugggacggg

SEQ ID NO: 372044 - RNA, 23 nt, Human
ccccuggcccacccuggggucug

SEQ ID NO: 372045 - RNA, 32 nt, Human
ccccuggccccagagcccccagcagggccauc

SEQ ID NO: 372046 - RNA, 32 nt, Human
ccccuggccccagagcccccagcagggcccuc

SEQ ID NO: 372047 - RNA, 27 nt, Human
ccccuggcccucauguccccccggggc

SEQ ID NO: 372048 - RNA, 21 nt, Human
ccccuggcccugccucaucca

SEQ ID NO: 372049 - RNA, 22 nt, Human
ccccuggccgagcugccggggc

SEQ ID NO: 372050 - RNA, 21 nt, Human
ccccuggccucaccuugcucc

SEQ ID NO: 372051 - RNA, 22 nt, Human
ccccuggccuccaggcuccucc

SEQ ID NO: 372052 - RNA, 20 nt, Human
ccccuggccuccugcgcucc

SEQ ID NO: 372053 - RNA, 22 nt, Human
ccccuggccucugugccuucuu

SEQ ID NO: 372054 - RNA, 22 nt, Human
ccccuggccugcccuucccggg

SEQ ID NO: 372055 - RNA, 32 nt, Human
ccccuggccuggacccaggagacccaggagaa

SEQ ID NO: 372056 - RNA, 20 nt, Human
ccccuggccuucagccugcu

SEQ ID NO: 372057 - RNA, 23 nt, Human
ccccuggccuugcuggcacccuu

SEQ ID NO: 372058 - RNA, 32 nt, Human
ccccuggccuuuacuuucuuccuugccuaugc

SEQ ID NO: 372059 - RNA, 32 nt, Human
ccccuggcgcccuguccaccguggcuggcugg

SEQ ID NO: 372060 - RNA, 23 nt, Human
ccccuggcggaauuuugggaccu

SEQ ID NO: 372061 - RNA, 21 nt, Human
ccccuggcuaucaucauccua

SEQ ID NO: 372062 - RNA, 32 nt, Human
ccccuggcucacccccagccgcaggaagccac

SEQ ID NO: 372063 - RNA, 21 nt, Human
ccccuggcucacuggcacagg

SEQ ID NO: 372064 - RNA, 32 nt, Human
ccccuggcucaggcccacaccccuggccaggc

SEQ ID NO: 372065 - RNA, 32 nt, Human
ccccuggcucugccucuccuuguuggcagaga

SEQ ID NO: 372066 - RNA, 23 nt, Human
ccccuggcucugggccgggccug

SEQ ID NO: 372067 - RNA, 22 nt, Human
ccccuggcucuuagggcaccua

SEQ ID NO: 372068 - RNA, 21 nt, Human
ccccuggcucuucugggcuug

SEQ ID NO: 372069 - RNA, 20 nt, Human
ccccuggcuuccuuuaagga

SEQ ID NO: 372070 - RNA, 19 nt, Human
ccccuggcuuuuccgggua

SEQ ID NO: 372071 - RNA, 32 nt, Human
ccccugggacaggcaaguccguggagacagaa

SEQ ID NO: 372072 - RNA, 25 nt, Human
ccccugggacccaccgugggaccug

SEQ ID NO: 372073 - RNA, 32 nt, Human
ccccugggagaaagggcccuggccaggcugga

SEQ ID NO: 372074 - RNA, 32 nt, Human
ccccugggagcaggugccaccuccuuccucuc

SEQ ID NO: 372075 - RNA, 32 nt, Human
ccccugggagcuucuuagaaaugcagaccugu

SEQ ID NO: 372076 - RNA, 32 nt, Human
ccccugggaguggacacagggugcagggagca

SEQ ID NO: 372077 - RNA, 32 nt, Human
ccccugggauggagugcagggagccagcugga

SEQ ID NO: 372078 - RNA, 32 nt, Human
ccccugggauuccaaggcauuggauccagucu

SEQ ID NO: 372079 - RNA, 25 nt, Human
ccccugggcaaaauggcagagcuag

SEQ ID NO: 372080 - RNA, 24 nt, Human
ccccugggcaaaggacagagccag

SEQ ID NO: 372081 - RNA, 21 nt, Human
ccccugggcaaggaagcgagg

SEQ ID NO: 372082 - RNA, 26 nt, Human
ccccugggcacaaguggcagggccag

SEQ ID NO: 372083 - RNA, 23 nt, Human
ccccugggcacacugggcccuga

SEQ ID NO: 372084 - RNA, 24 nt, Human
ccccugggcacaggacagagccag

SEQ ID NO: 372085 - RNA, 32 nt, Human
ccccugggcacaggcugggaucagggcaguga

SEQ ID NO: 372086 - RNA, 26 nt, Human
ccccugggcacccguugcagagccag

SEQ ID NO: 372087 - RNA, 28 nt, Human
ccccugggcacgcaaggaugaguauggg

SEQ ID NO: 372088 - RNA, 24 nt, Human
ccccugggcacgggacagagccag

SEQ ID NO: 372089 - RNA, 24 nt, Human
ccccugggcagaaggcagagccag

SEQ ID NO: 372090 - RNA, 22 nt, Human
ccccugggcagacaggcauuga

SEQ ID NO: 372091 - RNA, 23 nt, Human
ccccugggcagaugguaggcagg

SEQ ID NO: 372092 - RNA, 25 nt, Human
ccccugggcaggacagcggagccag

SEQ ID NO: 372093 - RNA, 24 nt, Human
ccccugggcaggaggcaguggaga

SEQ ID NO: 372094 - RNA, 26 nt, Human
ccccugggcaucaguagcagagccag

SEQ ID NO: 372095 - RNA, 25 nt, Human
ccccugggcaugacagcagagccag

SEQ ID NO: 372096 - RNA, 25 nt, Human
ccccugggcaugauggcagagccag

SEQ ID NO: 372097 - RNA, 32 nt, Human
ccccugggcauuucucuaccucccagguggaa

SEQ ID NO: 372098 - RNA, 22 nt, Human
ccccugggccaggcagagcagg

SEQ ID NO: 372099 - RNA, 18 nt, Human
ccccugggccccaauuca

SEQ ID NO: 372100 - RNA, 24 nt, Human
ccccugggcccuaccgcagcaggg

SEQ ID NO: 372101 - RNA, 23 nt, Human
ccccugggcccugaauggagcua

SEQ ID NO: 372102 - RNA, 25 nt, Human
ccccugggcgaaacggcagagccag

SEQ ID NO: 372103 - RNA, 21 nt, Human
ccccugggcgaagagcgcgga

SEQ ID NO: 372104 - RNA, 24 nt, Human
ccccugggcgagaggcagagccag

SEQ ID NO: 372105 - RNA, 24 nt, Human
ccccugggcgaggagcagagccag

SEQ ID NO: 372106 - RNA, 22 nt, Human
ccccugggcgagugcgggcagg

SEQ ID NO: 372107 - RNA, 25 nt, Human
ccccugggcgcaauggcagggccag

SEQ ID NO: 372108 - RNA, 26 nt, Human
ccccugggcgccaguggcagcgccag

SEQ ID NO: 372109 - RNA, 25 nt, Human
ccccugggcgccauggcggagccag

SEQ ID NO: 372110 - RNA, 25 nt, Human
ccccugggcgccugcgcagagccag

SEQ ID NO: 372111 - RNA, 27 nt, Human
ccccugggcgccuuuucugcagcaugg

SEQ ID NO: 372112 - RNA, 25 nt, Human
ccccugggcggaacugcagagccag

SEQ ID NO: 372113 - RNA, 24 nt, Human
ccccugggcggagagcagagccag

SEQ ID NO: 372114 - RNA, 25 nt, Human
ccccugggcggagcggcagggccag

SEQ ID NO: 372115 - RNA, 21 nt, Human
ccccugggcgggcgggacgga

SEQ ID NO: 372116 - RNA, 32 nt, Human
ccccugggcguaucucuucuuccucuguacua

SEQ ID NO: 372117 - RNA, 26 nt, Human
ccccugggcgugagcaucagagccag

SEQ ID NO: 372118 - RNA, 26 nt, Human
ccccugggcguguguggcagagccag

SEQ ID NO: 372119 - RNA, 32 nt, Human
ccccugggcucugugggcucccccugcuccac

SEQ ID NO: 372120 - RNA, 21 nt, Human
ccccugggcugccccuucuca

SEQ ID NO: 372121 - RNA, 21 nt, Human
ccccugggcuggcugcacaga

SEQ ID NO: 372122 - RNA, 32 nt, Human
ccccugggcuguaggccagggcagccacagcg

SEQ ID NO: 372123 - RNA, 27 nt, Human
ccccuggggaagcggagguugcaguga

SEQ ID NO: 372124 - RNA, 27 nt, Human
ccccuggggaaucagagguugcaguga

SEQ ID NO: 372125 - RNA, 32 nt, Human
ccccuggggaugugccacugucacucagaagg

SEQ ID NO: 372126 - RNA, 22 nt, Human
ccccuggggccugagcugcccc

SEQ ID NO: 372127 - RNA, 22 nt, Human
ccccuggggcuccgcagcagga

SEQ ID NO: 372128 - RNA, 32 nt, Human
ccccuggggcugggcaguguagaccugccacc

SEQ ID NO: 372129 - RNA, 32 nt, Human
ccccuggggcuguggggcucuacguggauccg

SEQ ID NO: 372130 - RNA, 32 nt, Human
ccccugggggauaugacacaugcccaugauga

SEQ ID NO: 372131 - RNA, 32 nt, Human
ccccuggggugaggacacaggcucugcaggcu

SEQ ID NO: 372132 - RNA, 22 nt, Human
ccccuggguacaccugcuggga

SEQ ID NO: 372133 - RNA, 32 nt, Human
ccccugggucccaagcaaccucagccaaugag

SEQ ID NO: 372134 - RNA, 32 nt, Human
ccccugggucccaagcaaccucagccagugag

SEQ ID NO: 372135 - RNA, 32 nt, Human
ccccuggguccccaguguucgcugugugugcg

SEQ ID NO: 372136 - RNA, 29 nt, Human
ccccugggucuguguggucccuggggaug

SEQ ID NO: 372137 - RNA, 24 nt, Human
ccccugggugcuugucugcacaga

SEQ ID NO: 372138 - RNA, 32 nt, Human
ccccuggguggagguugaggccauucuugaag

SEQ ID NO: 372139 - RNA, 22 nt, Human
ccccuggguggcugcggcugga

SEQ ID NO: 372140 - RNA, 32 nt, Human
ccccugggugggggcaucaggagcaggggcag

SEQ ID NO: 372141 - RNA, 32 nt, Human
ccccuggguuucucuuggaaauggucaguuuc

SEQ ID NO: 372142 - RNA, 32 nt, Human
ccccugguaccacauauauucauuugugaguu

SEQ ID NO: 372143 - RNA, 24 nt, Human
ccccugguccagccucggaaccug

SEQ ID NO: 372144 - RNA, 20 nt, Human
ccccugguccuuagcuugcu

SEQ ID NO: 372145 - RNA, 24 nt, Human
ccccuggucgccgccuuccugcga

SEQ ID NO: 372146 - RNA, 26 nt, Human
ccccuggugaugaguuucagcauaga

SEQ ID NO: 372147 - RNA, 21 nt, Human
ccccuggugccucccuagggc

SEQ ID NO: 372148 - RNA, 32 nt, Human
ccccugguggcagugggagcugccuguucagc

SEQ ID NO: 372149 - RNA, 32 nt, Human
ccccugguggugcucauggaacccaccuuugu

SEQ ID NO: 372150 - RNA, 32 nt, Human
ccccuggugguuuuguucacuccuuuccuuuc

SEQ ID NO: 372151 - RNA, 32 nt, Human
ccccugguguauacugggcauuggccagcuac

SEQ ID NO: 372152 - RNA, 23 nt, Human
ccccuggugucacauggggccug

SEQ ID NO: 372153 - RNA, 20 nt, Human
ccccugguuacccccacuca

SEQ ID NO: 372154 - RNA, 24 nt, Human
ccccugguucaggcugggcaugga

SEQ ID NO: 372155 - RNA, 32 nt, Human
ccccugguuuuagcugggcacaugacugcccu

SEQ ID NO: 372156 - RNA, 32 nt, Human
ccccuguaagaugucacugucuggguuccagc

SEQ ID NO: 372157 - RNA, 32 nt, Human
ccccuguaccaccacaucgccgacuugucugg

SEQ ID NO: 372158 - RNA, 32 nt, Human
ccccuguacugcccugccaucucaggccaaag

SEQ ID NO: 372159 - RNA, 32 nt, Human
ccccuguagagugggagcugagugggggauca

SEQ ID NO: 372160 - RNA, 32 nt, Human
ccccuguagcagucuucagccuccucuacccu

SEQ ID NO: 372161 - RNA, 32 nt, Human
ccccugucaagaaggugccgguggugcgaguc

SEQ ID NO: 372162 - RNA, 32 nt, Human
ccccugucacagucagucgucucauuugucca

SEQ ID NO: 372163 - RNA, 32 nt, Human
ccccugucacccugagcaaaucaguugcuucc

SEQ ID NO: 372164 - RNA, 32 nt, Human
ccccugucaguuaugucugccucccaggcucu

SEQ ID NO: 372165 - RNA, 32 nt, Human
ccccugucauuuccagauuucauuaccuccua

SEQ ID NO: 372166 - RNA, 20 nt, Human
ccccuguccaggcccugcuc

SEQ ID NO: 372167 - RNA, 22 nt, Human
ccccugucccaagcugcuuccu

SEQ ID NO: 372168 - RNA, 32 nt, Human
ccccugucccaccacucauucucagcuuugaa

SEQ ID NO: 372169 - RNA, 32 nt, Human
ccccugucccagcucccgaccugcacuuccug

SEQ ID NO: 372170 - RNA, 32 nt, Human
ccccuguccccgcacugggcuuggggaccaga

SEQ ID NO: 372171 - RNA, 19 nt, Human
ccccuguccugcccagggc

SEQ ID NO: 372172 - RNA, 32 nt, Human
ccccugucuccaggaggggcagguggcugagg

SEQ ID NO: 372173 - RNA, 32 nt, Human
ccccugucuccaguuuuucuccaucuccuggg

SEQ ID NO: 372174 - RNA, 20 nt, Human
ccccugucuccccuucaagg

SEQ ID NO: 372175 - RNA, 18 nt, Human
ccccugucucccucucug

SEQ ID NO: 372176 - RNA, 32 nt, Human
ccccugucuccgaggcuggaauacgguggugc

SEQ ID NO: 372177 - RNA, 18 nt, Human
ccccugucuccucuccug

SEQ ID NO: 372178 - RNA, 32 nt, Human
ccccugucuccucuccugauuuccuccaaucu

SEQ ID NO: 372179 - RNA, 32 nt, Human
ccccugucuccuuuccuccuccuggguucaug

SEQ ID NO: 372180 - RNA, 32 nt, Human
ccccugucugaagcucuguccugggucccacc

SEQ ID NO: 372181 - RNA, 32 nt, Human
ccccugucugcucauccucucucccucugucc

SEQ ID NO: 372182 - RNA, 19 nt, Human
ccccugucuggucccagua

SEQ ID NO: 372183 - RNA, 32 nt, Human
ccccugucugucugcauuugucucagaacauu

SEQ ID NO: 372184 - RNA, 20 nt, Human
ccccugucuucuuccccagg

SEQ ID NO: 372185 - RNA, 23 nt, Human
ccccugucuuggagcuccgggua

SEQ ID NO: 372186 - RNA, 32 nt, Human
ccccugucuuucuccuccugacugguggucua

SEQ ID NO: 372187 - RNA, 32 nt, Human
ccccugugaaagcuuguuccugccauauggag

SEQ ID NO: 372188 - RNA, 32 nt, Human
ccccugugaaggagaggguggggagggaggca

SEQ ID NO: 372189 - RNA, 22 nt, Human
ccccugugaauugcaguaaagg

SEQ ID NO: 372190 - RNA, 23 nt, Human
ccccugugacagccgcggcagga

SEQ ID NO: 372191 - RNA, 32 nt, Human
ccccugugauuucaagcccacagucugucacu

SEQ ID NO: 372192 - RNA, 32 nt, Human
ccccugugcaggauccacugggugaaagccag

SEQ ID NO: 372193 - RNA, 32 nt, Human
ccccugugccaccuccacagugggagccagcc

SEQ ID NO: 372194 - RNA, 19 nt, Human
ccccugugccagggaacag

SEQ ID NO: 372195 - RNA, 18 nt, Human
ccccugugcccacuggcc

SEQ ID NO: 372196 - RNA, 32 nt, Human
ccccugugccccuccccuccaggcuaccucug

SEQ ID NO: 372197 - RNA, 32 nt, Human
ccccugugccguaguuugucuccugggacugg

SEQ ID NO: 372198 - RNA, 22 nt, Human
ccccugugccuccccucccggg

SEQ ID NO: 372199 - RNA, 32 nt, Human
ccccugugcucucagaagcaggggucacuggc

SEQ ID NO: 372200 - RNA, 32 nt, Human
ccccugugcuugcuccccgagcucagggauug

SEQ ID NO: 372201 - RNA, 32 nt, Human
ccccuguggagcacuuggagcagugucuguug

SEQ ID NO: 372202 - RNA, 32 nt, Human
ccccugugggaggcggacagcagugaccaccu

SEQ ID NO: 372203 - RNA, 32 nt, Human
ccccuguggggaggggacggggaaggaagaaa

SEQ ID NO: 372204 - RNA, 19 nt, Human
ccccugugggucccuccca

SEQ ID NO: 372205 - RNA, 31 nt, Human
ccccugugggugggguggagggugaaauucu

SEQ ID NO: 372206 - RNA, 32 nt, Human
ccccuguguccuggcauuucagucuagaccuu

SEQ ID NO: 372207 - RNA, 32 nt, Human
ccccugugugggaggcagguucugcaaagcaa

SEQ ID NO: 372208 - RNA, 21 nt, Human
ccccuguguggguccuccuca

SEQ ID NO: 372209 - RNA, 32 nt, Human
ccccuguguguguuuucccuugccuuguuucc

SEQ ID NO: 372210 - RNA, 32 nt, Human
ccccuguguuaccugggcagcuccagaucacu

SEQ ID NO: 372211 - RNA, 32 nt, Human
ccccuguguucugccugccaggccagcugucu

SEQ ID NO: 372212 - RNA, 32 nt, Human
ccccuguguuguuacaggcugugcagugcaac

SEQ ID NO: 372213 - RNA, 19 nt, Human
ccccuguucucccagcuca

SEQ ID NO: 372214 - RNA, 32 nt, Human
ccccuguucucccagcucaucuccuugccuug

SEQ ID NO: 372215 - RNA, 32 nt, Human
ccccuguucuggucccuccuggagcgcccgcg

SEQ ID NO: 372216 - RNA, 32 nt, Human
ccccuguugcccaggcuggagugcagugggau

SEQ ID NO: 372217 - RNA, 32 nt, Human
ccccuguugucauugcuccugcagccuuuucg

SEQ ID NO: 372218 - RNA, 32 nt, Human
ccccuguuuauucuugaacagagggcaaagag

SEQ ID NO: 372219 - RNA, 32 nt, Human
ccccuguuuccucuuugucuugccccuggauu

SEQ ID NO: 372220 - RNA, 16 nt, Human
ccccuguuuccuggua

SEQ ID NO: 372221 - RNA, 21 nt, Human
ccccuguuucucaggggccug

SEQ ID NO: 372222 - RNA, 18 nt, Human
ccccuguuuucucucugc

SEQ ID NO: 372223 - RNA, 32 nt, Human
ccccuguuuucuuccucuguaaccuugggcaa

SEQ ID NO: 372224 - RNA, 32 nt, Human
ccccuuaaacaugcuccuccugcacggaagag

SEQ ID NO: 372225 - RNA, 32 nt, Human
ccccuuaacaccuugggcugcucagacccucc

SEQ ID NO: 372226 - RNA, 32 nt, Human
ccccuuaaccacccccacgguuucugccgucg

SEQ ID NO: 372227 - RNA, 32 nt, Human
ccccuuaacugcucuauagauaacagcuugaa

SEQ ID NO: 372228 - RNA, 32 nt, Human
ccccuuaagccaacaaccacagugccaccaag

SEQ ID NO: 372229 - RNA, 32 nt, Human
ccccuuaauggugcaaccacugaggcaaagua

SEQ ID NO: 372230 - RNA, 21 nt, Human
ccccuuacaucuacucugccg

SEQ ID NO: 372231 - RNA, 32 nt, Human
ccccuuaccaaccuggugaggcugcuccugag

SEQ ID NO: 372232 - RNA, 32 nt, Human
ccccuuaccugcccugcugccugcacacugca

SEQ ID NO: 372233 - RNA, 32 nt, Human
ccccuuacggacaggucccagagauggacaga

SEQ ID NO: 372234 - RNA, 22 nt, Human
ccccuuacuuacaggcauccca

SEQ ID NO: 372235 - RNA, 32 nt, Human
ccccuuagaaggugauguaccagcaagccaga

SEQ ID NO: 372236 - RNA, 32 nt, Human
ccccuuagagcugccccucucuggccuggccg

SEQ ID NO: 372237 - RNA, 32 nt, Human
ccccuuagaggaccugaguuugggagaguggu

SEQ ID NO: 372238 - RNA, 32 nt, Human
ccccuuagcaccuucagggcugaguucugggu

SEQ ID NO: 372239 - RNA, 24 nt, Human
ccccuuagccuccccucccucccg

SEQ ID NO: 372240 - RNA, 32 nt, Human
ccccuuagcuacugaggcauagggagaggaag

SEQ ID NO: 372241 - RNA, 23 nt, Human
ccccuuagggucgccaccccuca

SEQ ID NO: 372242 - RNA, 19 nt, Human
ccccuuaguuuguuuccuu

SEQ ID NO: 372243 - RNA, 32 nt, Human
ccccuuaucaaggguugaaggaagggagccau

SEQ ID NO: 372244 - RNA, 21 nt, Human
ccccuucaacccaguugaugu

SEQ ID NO: 372245 - RNA, 32 nt, Human
ccccuucacacccaccccucugaccccugccu

SEQ ID NO: 372246 - RNA, 32 nt, Human
ccccuucacaccucacuccuagauuuugcuag

SEQ ID NO: 372247 - RNA, 32 nt, Human
ccccuucacagacacugaccucagaggcccca

SEQ ID NO: 372248 - RNA, 32 nt, Human
ccccuucacagcaggcaucggggccuggcauc

SEQ ID NO: 372249 - RNA, 32 nt, Human
ccccuucaccugccaucgagugucccucacca

SEQ ID NO: 372250 - RNA, 21 nt, Human
ccccuucacgagcugcuccuu

SEQ ID NO: 372251 - RNA, 19 nt, Human
ccccuucacucccagcuca

SEQ ID NO: 372252 - RNA, 22 nt, Human
ccccuucagcccagcccagcca

SEQ ID NO: 372253 - RNA, 32 nt, Human
ccccuucagcuucucccuccggaucgaugugc

SEQ ID NO: 372254 - RNA, 32 nt, Human
ccccuucagugcagaaggcuuuggguaggacu

SEQ ID NO: 372255 - RNA, 32 nt, Human
ccccuucaucaccaucuccaucauucagcugg

SEQ ID NO: 372256 - RNA, 32 nt, Human
ccccuucauggagcuucuaugacagugaauaa

SEQ ID NO: 372257 - RNA, 32 nt, Human
ccccuucauggccucugcaccuccacacuccc

SEQ ID NO: 372258 - RNA, 24 nt, Human
ccccuuccacccucagcucuaccc

SEQ ID NO: 372259 - RNA, 32 nt, Human
ccccuuccaccuggaccguggccacacuuuuu

SEQ ID NO: 372260 - RNA, 32 nt, Human
ccccuuccagcccauuccccuuuuccccucag

SEQ ID NO: 372261 - RNA, 32 nt, Human
ccccuuccagcucccuccccugcucagaaucu

SEQ ID NO: 372262 - RNA, 32 nt, Human
ccccuuccaggagaugccaaaaauauuucugg

SEQ ID NO: 372263 - RNA, 32 nt, Human
ccccuuccaggccacucuuggggaaacagagc

SEQ ID NO: 372264 - RNA, 32 nt, Human
ccccuuccaguuuuccccuugcuucccaggcc

SEQ ID NO: 372265 - RNA, 32 nt, Human
  misc_feature (30)..(30): n is a, c, g or u
ccccuuccaucacuuucugucaugccaggnug

SEQ ID NO: 372266 - RNA, 32 nt, Human
ccccuuccaucccggcaccaugcuggauaggg

SEQ ID NO: 372267 - RNA, 26 nt, Human
ccccuuccauggccccagcucugccu

SEQ ID NO: 372268 - RNA, 32 nt, Human
ccccuuccauuuccuggcccugcucugcuucc

SEQ ID NO: 372269 - RNA, 32 nt, Human
ccccuucccacuccagcaccccagccagccug

SEQ ID NO: 372270 - RNA, 32 nt, Human
ccccuucccagacuuuugccccggcucugcug

SEQ ID NO: 372271 - RNA, 32 nt, Human
ccccuucccagcucgucugccugcccccggcc

SEQ ID NO: 372272 - RNA, 32 nt, Human
ccccuucccagucgugacaaccacagauggcc

SEQ ID NO: 372273 - RNA, 32 nt, Human
ccccuuccccacacagccccagaaggguccca

SEQ ID NO: 372274 - RNA, 17 nt, Human
ccccuuccccacugccu

SEQ ID NO: 372275 - RNA, 20 nt, Human
ccccuuccccacugccugcc

SEQ ID NO: 372276 - RNA, 22 nt, Human
ccccuuccccagccucucgccu

SEQ ID NO: 372277 - RNA, 32 nt, Human
ccccuuccccagccucucgccugcacugaugc

SEQ ID NO: 372278 - RNA, 19 nt, Human
ccccuuccccaguuugcgc

SEQ ID NO: 372279 - RNA, 32 nt, Human
ccccuuccccauugccccagcuuagccucuuc

SEQ ID NO: 372280 - RNA, 32 nt, Human
ccccuucccccaggaacacuuccacugggauc

SEQ ID NO: 372281 - RNA, 32 nt, Human
ccccuuccccuaauaccuagcccuguaugauc

SEQ ID NO: 372282 - RNA, 32 nt, Human
ccccuuccccuccccuccucccucuuuucccc

SEQ ID NO: 372283 - RNA, 21 nt, Human
ccccuuccccucuccagcccu

SEQ ID NO: 372284 - RNA, 31 nt, Human
ccccuuccccucucugggccucaguuuccuu

SEQ ID NO: 372285 - RNA, 32 nt, Human
ccccuuccccuuccccuacccuucccuccucu

SEQ ID NO: 372286 - RNA, 21 nt, Human
ccccuuccccuuuucugggga

SEQ ID NO: 372287 - RNA, 32 nt, Human
ccccuucccggagaaccugugcgguguguaga

SEQ ID NO: 372288 - RNA, 32 nt, Human
ccccuucccuacuuccccuuggggcucccugu

SEQ ID NO: 372289 - RNA, 21 nt, Human
ccccuucccuccuccuggggc

SEQ ID NO: 372290 - RNA, 32 nt, Human
ccccuucccugccuauggugucgcuuggcuaa

SEQ ID NO: 372291 - RNA, 20 nt, Human
ccccuucccugccugccugc

SEQ ID NO: 372292 - RNA, 21 nt, Human
ccccuucccuguccuucccca

SEQ ID NO: 372293 - RNA, 17 nt, Human
ccccuucccuguucugc

SEQ ID NO: 372294 - RNA, 23 nt, Human
ccccuucccuucucccaucucug

SEQ ID NO: 372295 - RNA, 32 nt, Human
ccccuucccuuuccuguccuguccuuucuuuc

SEQ ID NO: 372296 - RNA, 32 nt, Human
ccccuuccuacacuguucccuggaccauacac

SEQ ID NO: 372297 - RNA, 17 nt, Human
ccccuuccuacugguuc

SEQ ID NO: 372298 - RNA, 32 nt, Human
ccccuuccucaaccucuucacgcuggcauguc

SEQ ID NO: 372299 - RNA, 32 nt, Human
ccccuuccucaaggacuuaacuugugcaagcu

SEQ ID NO: 372300 - RNA, 32 nt, Human
ccccuuccucaaggacuuaagcugacucccag

SEQ ID NO: 372301 - RNA, 32 nt, Human
ccccuuccucaaggguguuuggguuaaggcug

SEQ ID NO: 372302 - RNA, 32 nt, Human
ccccuuccucaccaguaaauccugcuacauca

SEQ ID NO: 372303 - RNA, 32 nt, Human
ccccuuccucaccccaaucccuacagccuccc

SEQ ID NO: 372304 - RNA, 32 nt, Human
ccccuuccucaccucuuccaccccucagacug

SEQ ID NO: 372305 - RNA, 32 nt, Human
ccccuuccucaccucuuccuuauuccauaggc

SEQ ID NO: 372306 - RNA, 32 nt, Human
ccccuuccucacugcucucuaccuggagaaga

SEQ ID NO: 372307 - RNA, 32 nt, Human
ccccuuccuccaccaacucacgccagggaccu

SEQ ID NO: 372308 - RNA, 32 nt, Human
ccccuuccuccaccucccucucugcagaacuu

SEQ ID NO: 372309 - RNA, 32 nt, Human
ccccuuccuccccuuucucuuucucuugagag

SEQ ID NO: 372310 - RNA, 32 nt, Human
ccccuuccuccuccucccuccuucccaucccu

SEQ ID NO: 372311 - RNA, 32 nt, Human
ccccuuccuccuccucuuccugcuccaacuuc

SEQ ID NO: 372312 - RNA, 32 nt, Human
ccccuuccuccugcaucuccccuucuuuccuu

SEQ ID NO: 372313 - RNA, 32 nt, Human
ccccuuccucucucccuucccuuccaugagac

SEQ ID NO: 372314 - RNA, 32 nt, Human
ccccuuccucucuguggcacacacagaccuga

SEQ ID NO: 372315 - RNA, 19 nt, Human
ccccuuccucuuccugccu

SEQ ID NO: 372316 - RNA, 32 nt, Human
ccccuuccugccccaaaaggcuuucacauacc

SEQ ID NO: 372317 - RNA, 32 nt, Human
ccccuuccuggagcuggcagagcuaacgcccu

SEQ ID NO: 372318 - RNA, 32 nt, Human
ccccuuccuggauggaggcuugagggcccugg

SEQ ID NO: 372319 - RNA, 32 nt, Human
ccccuuccugguaaaucucucucccuccccca

SEQ ID NO: 372320 - RNA, 32 nt, Human
ccccuuccuguagcauauggggagacuaaggc

SEQ ID NO: 372321 - RNA, 23 nt, Human
ccccuuccugucacucccggggc

SEQ ID NO: 372322 - RNA, 20 nt, Human
ccccuuccuuaucacugucu

SEQ ID NO: 372323 - RNA, 32 nt, Human
ccccuuccuucccggccauucucccucuuguu

SEQ ID NO: 372324 - RNA, 32 nt, Human
ccccuuccuucuugccuguagcuccugcugga

SEQ ID NO: 372325 - RNA, 32 nt, Human
ccccuuccuugcugcccucccuucccugccuc

SEQ ID NO: 372326 - RNA, 22 nt, Human
ccccuuccuuuccaucuguagc

SEQ ID NO: 372327 - RNA, 32 nt, Human
ccccuuccuuuccuuaccuuguuucuucccag

SEQ ID NO: 372328 - RNA, 32 nt, Human
ccccuuccuuucucucucuuccagaagucauu

SEQ ID NO: 372329 - RNA, 32 nt, Human
ccccuucgacccucagcccucuggugccgcuc

SEQ ID NO: 372330 - RNA, 32 nt, Human
ccccuucgagcagguggucgccagcuuucucc

SEQ ID NO: 372331 - RNA, 32 nt, Human
ccccuucgcgcugccagccucccccaaccacc

SEQ ID NO: 372332 - RNA, 31 nt, Human
ccccuucgcugcucugggccugcguuucucc

SEQ ID NO: 372333 - RNA, 32 nt, Human
ccccuucguuuuucucuucugauucuucucuu

SEQ ID NO: 372334 - RNA, 18 nt, Human
ccccuucuaucccuccuc

SEQ ID NO: 372335 - RNA, 22 nt, Human
ccccuucucacucauggagccc

SEQ ID NO: 372336 - RNA, 32 nt, Human
ccccuucucagaauccugcucuuccuccagag

SEQ ID NO: 372337 - RNA, 32 nt, Human
ccccuucucaguacauccugugccuccuuucu

SEQ ID NO: 372338 - RNA, 24 nt, Human
ccccuucuccaaugcucucgggga

SEQ ID NO: 372339 - RNA, 32 nt, Human
ccccuucuccacccucuacuucccgcccagug

SEQ ID NO: 372340 - RNA, 22 nt, Human
ccccuucuccaggagccagggg

SEQ ID NO: 372341 - RNA, 32 nt, Human
ccccuucuccagucuuuuccuuuuacucuggu

SEQ ID NO: 372342 - RNA, 19 nt, Human
ccccuucuccagugcucuc

SEQ ID NO: 372343 - RNA, 24 nt, Human
ccccuucuccagugcucucaggga

SEQ ID NO: 372344 - RNA, 24 nt, Human
ccccuucuccagugcucucgggga

SEQ ID NO: 372345 - RNA, 24 nt, Human
ccccuucuccagugcucuggggga

SEQ ID NO: 372346 - RNA, 24 nt, Human
ccccuucuccagugcuuucgggga

SEQ ID NO: 372347 - RNA, 24 nt, Human
ccccuucuccagugcuuuugggga

SEQ ID NO: 372348 - RNA, 19 nt, Human
ccccuucuccauccacaug

SEQ ID NO: 372349 - RNA, 32 nt, Human
ccccuucuccaucgucccaggaaucccagggg

SEQ ID NO: 372350 - RNA, 24 nt, Human
ccccuucucccacaaauaaagccc

SEQ ID NO: 372351 - RNA, 32 nt, Human
ccccuucucccaggguccagagccaggacccc

SEQ ID NO: 372352 - RNA, 22 nt, Human
ccccuucucccggguccgugga

SEQ ID NO: 372353 - RNA, 24 nt, Human
ccccuucucccgugcucucaggga

SEQ ID NO: 372354 - RNA, 27 nt, Human
ccccuucucccucucagcuuucggagg

SEQ ID NO: 372355 - RNA, 23 nt, Human
ccccuucuccuccucuuuggugc

SEQ ID NO: 372356 - RNA, 32 nt, Human
ccccuucuccucucugcaccuuccccaucagc

SEQ ID NO: 372357 - RNA, 23 nt, Human
ccccuucuccucuggcuccgggg

SEQ ID NO: 372358 - RNA, 17 nt, Human
ccccuucuccuugggga

SEQ ID NO: 372359 - RNA, 32 nt, Human
ccccuucucucucccucucccucucucucuaa

SEQ ID NO: 372360 - RNA, 32 nt, Human
ccccuucucugaggccuggacccacccaucuu

SEQ ID NO: 372361 - RNA, 32 nt, Human
ccccuucucugccuucacuucugugacugcua

SEQ ID NO: 372362 - RNA, 22 nt, Human
ccccuucucugcgucccuccca

SEQ ID NO: 372363 - RNA, 23 nt, Human
ccccuucucuucagccccugccc

SEQ ID NO: 372364 - RNA, 32 nt, Human
ccccuucucuuccugagugauucucagccaag

SEQ ID NO: 372365 - RNA, 32 nt, Human
ccccuucugagaucugaggacauggacaccca

SEQ ID NO: 372366 - RNA, 23 nt, Human
ccccuucugccaccgugguagca

SEQ ID NO: 372367 - RNA, 23 nt, Human
ccccuucugcccccacugcccuc

SEQ ID NO: 372368 - RNA, 22 nt, Human
ccccuucugccuccugcaggga

SEQ ID NO: 372369 - RNA, 32 nt, Human
ccccuucugccugcaguccugugugagccccu

SEQ ID NO: 372370 - RNA, 17 nt, Human
ccccuucugccuggcuu

SEQ ID NO: 372371 - RNA, 32 nt, Human
ccccuucugccuggcuugccugcuucugcccu

SEQ ID NO: 372372 - RNA, 32 nt, Human
ccccuucugcgugcccuggccccagccccagc

SEQ ID NO: 372373 - RNA, 32 nt, Human
ccccuucugcuuccacgcccuuuuccucuuug

SEQ ID NO: 372374 - RNA, 32 nt, Human
ccccuucugucacuggucucagacacaggccc

SEQ ID NO: 372375 - RNA, 22 nt, Human
ccccuucuguccagcacuugca

SEQ ID NO: 372376 - RNA, 32 nt, Human
ccccuucugucucucgguuccucuuuccuccc

SEQ ID NO: 372377 - RNA, 21 nt, Human
ccccuucuuaugccccucuca

SEQ ID NO: 372378 - RNA, 32 nt, Human
ccccuucuucauugcucucuccagaaaggguu

SEQ ID NO: 372379 - RNA, 23 nt, Human
ccccuugacacacgcccuccuca

SEQ ID NO: 372380 - RNA, 32 nt, Human
ccccuugaccuucccaucaccuccucaucagg

SEQ ID NO: 372381 - RNA, 20 nt, Human
ccccuugaggacccuccuca

SEQ ID NO: 372382 - RNA, 32 nt, Human
ccccuugagguucccuugugagcuugaaucaa

SEQ ID NO: 372383 - RNA, 32 nt, Human
ccccuugcaaaccaucccagcacugcacccca

SEQ ID NO: 372384 - RNA, 32 nt, Human
ccccuugccaccccauggccccggcugaaagc

SEQ ID NO: 372385 - RNA, 32 nt, Human
ccccuugccaguccuggagacuguggcagggg

SEQ ID NO: 372386 - RNA, 32 nt, Human
ccccuugcccacugggacuccucuuuggcucc

SEQ ID NO: 372387 - RNA, 32 nt, Human
ccccuugcccagggcucagccuggugggccuc

SEQ ID NO: 372388 - RNA, 22 nt, Human
ccccuugcuacagccucugccc

SEQ ID NO: 372389 - RNA, 18 nt, Human
ccccuugcucucaaccca

SEQ ID NO: 372390 - RNA, 17 nt, Human
ccccuugcuuccucccu

SEQ ID NO: 372391 - RNA, 32 nt, Human
ccccuugcuucucaacuaaagaauagugccuc

SEQ ID NO: 372392 - RNA, 18 nt, Human
ccccuugcuugccaccca

SEQ ID NO: 372393 - RNA, 32 nt, Human
ccccuuggaauggcugagggaggcaggagagc

SEQ ID NO: 372394 - RNA, 32 nt, Human
ccccuuggagccaagacgauuggccagacauc

SEQ ID NO: 372395 - RNA, 32 nt, Human
ccccuuggagccaggcgccggggucugaggau

SEQ ID NO: 372396 - RNA, 19 nt, Human
ccccuuggccagggccaug

SEQ ID NO: 372397 - RNA, 21 nt, Human
ccccuuggcccccagguuccc

SEQ ID NO: 372398 - RNA, 23 nt, Human
ccccuuggcccccuccccucccc

SEQ ID NO: 372399 - RNA, 22 nt, Human
ccccuuggcccugccccugucc

SEQ ID NO: 372400 - RNA, 22 nt, Human
ccccuuggcccuuucacucccc

SEQ ID NO: 372401 - RNA, 22 nt, Human
ccccuuggccuccccuccacuc

SEQ ID NO: 372402 - RNA, 22 nt, Human
ccccuuggccuuuccaccuccc

SEQ ID NO: 372403 - RNA, 22 nt, Human
ccccuuggcucuaucccugccc

SEQ ID NO: 372404 - RNA, 32 nt, Human
ccccuuggcucucaaugcuguuuggguuucca

SEQ ID NO: 372405 - RNA, 32 nt, Human
ccccuuggcucugccuuggcccuuccccucac

SEQ ID NO: 372406 - RNA, 32 nt, Human
ccccuuggcugggaacauccuccacugacuuc

SEQ ID NO: 372407 - RNA, 32 nt, Human
ccccuuggcuuccugccuuggggucagcagcc

SEQ ID NO: 372408 - RNA, 20 nt, Human
ccccuuggcuucuccgugcc

SEQ ID NO: 372409 - RNA, 31 nt, Human
ccccuuggcuuugccucuccuguguccuguc

SEQ ID NO: 372410 - RNA, 23 nt, Human
ccccuugggcucaggccccgccc

SEQ ID NO: 372411 - RNA, 32 nt, Human
ccccuuggggauaugacacaugcccaugauga

SEQ ID NO: 372412 - RNA, 23 nt, Human
ccccuuggguacaccccucugcc

SEQ ID NO: 372413 - RNA, 19 nt, Human
ccccuuggucugucaccuc

SEQ ID NO: 372414 - RNA, 32 nt, Human
ccccuuggugccacagagggcugugucuuacu

SEQ ID NO: 372415 - RNA, 32 nt, Human
ccccuuguaagaaagcauuccugggaagucuu

SEQ ID NO: 372416 - RNA, 32 nt, Human
ccccuuguacaauuaugcuguguuuuuaaaaa

SEQ ID NO: 372417 - RNA, 32 nt, Human
ccccuuguccccaugugucauuggagauaaac

SEQ ID NO: 372418 - RNA, 32 nt, Human
ccccuugucccugucaaauaaaccagaacaaa

SEQ ID NO: 372419 - RNA, 19 nt, Human
ccccuuguccugucaccuc

SEQ ID NO: 372420 - RNA, 17 nt, Human
ccccuuguccuuccuca

SEQ ID NO: 372421 - RNA, 22 nt, Human
ccccuugucuuaaaaucacuuc

SEQ ID NO: 372422 - RNA, 32 nt, Human
ccccuugugaaacuguaucauaauuucuucug

SEQ ID NO: 372423 - RNA, 18 nt, Human
ccccuugugcagcuuuga

SEQ ID NO: 372424 - RNA, 32 nt, Human
ccccuuguggucagagggguugccugcaggau

SEQ ID NO: 372425 - RNA, 19 nt, Human
ccccuuguucccggccggc

SEQ ID NO: 372426 - RNA, 32 nt, Human
ccccuuguucccucagcucuaagggccgcgau

SEQ ID NO: 372427 - RNA, 32 nt, Human
ccccuuguucucucugcuucugucuugaggau

SEQ ID NO: 372428 - RNA, 32 nt, Human
ccccuuguuggccauggagcagcaggcccaga

SEQ ID NO: 372429 - RNA, 32 nt, Human
ccccuuguuggggaaguugcaggaggagaggu

SEQ ID NO: 372430 - RNA, 32 nt, Human
ccccuuuaaacuuccuccucggccgggccaag

SEQ ID NO: 372431 - RNA, 24 nt, Human
ccccuuuaaggagcaaaucacuuc

SEQ ID NO: 372432 - RNA, 19 nt, Human
ccccuuuaccuagcugugc

SEQ ID NO: 372433 - RNA, 32 nt, Human
ccccuuuaccuugaguugauagcaauagagca

SEQ ID NO: 372434 - RNA, 32 nt, Human
ccccuuuacuccugggaacuuugcagcugccc

SEQ ID NO: 372435 - RNA, 21 nt, Human
ccccuuuaugaaaaccacuuc

SEQ ID NO: 372436 - RNA, 20 nt, Human
ccccuuucaaguuguuuugc

SEQ ID NO: 372437 - RNA, 32 nt, Human
ccccuuucacucuugaggccugggaggugaaa

SEQ ID NO: 372438 - RNA, 17 nt, Human
ccccuuucacucuuggc

SEQ ID NO: 372439 - RNA, 32 nt, Human
ccccuuucagcccaccagucccucucugcugc

SEQ ID NO: 372440 - RNA, 20 nt, Human
ccccuuucagccucuguugc

SEQ ID NO: 372441 - RNA, 19 nt, Human
ccccuuucagguguggugc

SEQ ID NO: 372442 - RNA, 20 nt, Human
ccccuuucauccuuuggugc

SEQ ID NO: 372443 - RNA, 18 nt, Human
ccccuuucauggcugugc

SEQ ID NO: 372444 - RNA, 22 nt, Human
ccccuuucauuuucaguuuugc

SEQ ID NO: 372445 - RNA, 32 nt, Human
ccccuuuccacucuaauggauaguguacauuc

SEQ ID NO: 372446 - RNA, 28 nt, Human
ccccuuuccacuuccccagcuucugccc

SEQ ID NO: 372447 - RNA, 20 nt, Human
ccccuuuccagauguggugc

SEQ ID NO: 372448 - RNA, 20 nt, Human
ccccuuuccaguccuuuggc

SEQ ID NO: 372449 - RNA, 23 nt, Human
ccccuuucccaaaccuucgggga

SEQ ID NO: 372450 - RNA, 20 nt, Human
ccccuuucccacauccgugc

SEQ ID NO: 372451 - RNA, 32 nt, Human
ccccuuucccagcccacagggcuugaagugaa

SEQ ID NO: 372452 - RNA, 19 nt, Human
ccccuuucccaguggcagc

SEQ ID NO: 372453 - RNA, 19 nt, Human
ccccuuuccccacuccacg

SEQ ID NO: 372454 - RNA, 17 nt, Human
ccccuuucccccuuggc

SEQ ID NO: 372455 - RNA, 32 nt, Human
ccccuuuccccggaugcugggcccugcugcua

SEQ ID NO: 372456 - RNA, 32 nt, Human
ccccuuuccccucccuccuugaaggcuacccc

SEQ ID NO: 372457 - RNA, 32 nt, Human
ccccuuuccccugcagcuucucaagugagacu

SEQ ID NO: 372458 - RNA, 18 nt, Human
ccccuuuccccuugggga

SEQ ID NO: 372459 - RNA, 17 nt, Human
ccccuuucccgggcugu

SEQ ID NO: 372460 - RNA, 18 nt, Human
ccccuuucccgggugagc

SEQ ID NO: 372461 - RNA, 17 nt, Human
ccccuuucccggucugc

SEQ ID NO: 372462 - RNA, 23 nt, Human
ccccuuucccuccucuccgccca

SEQ ID NO: 372463 - RNA, 32 nt, Human
ccccuuucccucucccccucccgcucggcgcu

SEQ ID NO: 372464 - RNA, 32 nt, Human
ccccuuuccguccuccucuguuuggagaggcc

SEQ ID NO: 372465 - RNA, 18 nt, Human
ccccuuuccuaccugugc

SEQ ID NO: 372466 - RNA, 32 nt, Human
ccccuuuccucagccuccaccugcaggacagc

SEQ ID NO: 372467 - RNA, 32 nt, Human
ccccuuuccucuuccuuucccuuccuucucuu

SEQ ID NO: 372468 - RNA, 22 nt, Human
ccccuuuccugcccccuccuca

SEQ ID NO: 372469 - RNA, 32 nt, Human
ccccuuuccugcccccuccucaucuuuaauaa

SEQ ID NO: 372470 - RNA, 21 nt, Human
ccccuuuccugcccuuucugc

SEQ ID NO: 372471 - RNA, 19 nt, Human
ccccuuuccugguuauggc

SEQ ID NO: 372472 - RNA, 32 nt, Human
ccccuuuccuucacugccccacuucuggcaug

SEQ ID NO: 372473 - RNA, 18 nt, Human
ccccuuuccuucuagcuc

SEQ ID NO: 372474 - RNA, 32 nt, Human
ccccuuuccuucuucuuaauccaauaggccuc

SEQ ID NO: 372475 - RNA, 32 nt, Human
ccccuuuccuuuccuucuucccuaccuccccu

SEQ ID NO: 372476 - RNA, 17 nt, Human
ccccuuucuacccugug

SEQ ID NO: 372477 - RNA, 19 nt, Human
ccccuuucuaguucaaugc

SEQ ID NO: 372478 - RNA, 32 nt, Human
ccccuuucuaguuccccuaccucucuaucuuu

SEQ ID NO: 372479 - RNA, 17 nt, Human
ccccuuucuauccaugc

SEQ ID NO: 372480 - RNA, 19 nt, Human
ccccuuucuauguucaugu

SEQ ID NO: 372481 - RNA, 32 nt, Human
ccccuuucucacccucugccucacucccaaug

SEQ ID NO: 372482 - RNA, 18 nt, Human
ccccuuucucagccuugc

SEQ ID NO: 372483 - RNA, 18 nt, Human
ccccuuucuccacccugc

SEQ ID NO: 372484 - RNA, 17 nt, Human
ccccuuucuccaccugc

SEQ ID NO: 372485 - RNA, 20 nt, Human
ccccuuucuccagggcaugu

SEQ ID NO: 372486 - RNA, 19 nt, Human
ccccuuucuccagggcugc

SEQ ID NO: 372487 - RNA, 18 nt, Human
ccccuuucuccauuagug

SEQ ID NO: 372488 - RNA, 32 nt, Human
ccccuuucucccccucgguuaagucccucccc

SEQ ID NO: 372489 - RNA, 32 nt, Human
ccccuuucucccccucuguuaagucccucccc

SEQ ID NO: 372490 - RNA, 20 nt, Human
ccccuuucuccucguaugug

SEQ ID NO: 372491 - RNA, 18 nt, Human
ccccuuucucuacugagc

SEQ ID NO: 372492 - RNA, 18 nt, Human
ccccuuucucugccuggc

SEQ ID NO: 372493 - RNA, 18 nt, Human
ccccuuucucuugaugug

SEQ ID NO: 372494 - RNA, 18 nt, Human
ccccuuucugaagcugug

SEQ ID NO: 372495 - RNA, 17 nt, Human
ccccuuucugcggcugc

SEQ ID NO: 372496 - RNA, 17 nt, Human
ccccuuucugggcuggc

SEQ ID NO: 372497 - RNA, 17 nt, Human
ccccuuucugggugugu

SEQ ID NO: 372498 - RNA, 18 nt, Human
ccccuuucuggguuugug

SEQ ID NO: 372499 - RNA, 18 nt, Human
ccccuuucugucccuggc

SEQ ID NO: 372500 - RNA, 18 nt, Human
ccccuuucuugagguugu

SEQ ID NO: 372501 - RNA, 16 nt, Human
ccccuuucuuguugug

SEQ ID NO: 372502 - RNA, 24 nt, Human
ccccuuucuuucuaccagcccugc

SEQ ID NO: 372503 - RNA, 32 nt, Human
ccccuuucuuucuccucgucggcccgagagca

SEQ ID NO: 372504 - RNA, 32 nt, Human
ccccuuugcucaguaucacucucccuccugcc

SEQ ID NO: 372505 - RNA, 32 nt, Human
ccccuuugcuccaucaguuaucaggaaggaga

SEQ ID NO: 372506 - RNA, 32 nt, Human
ccccuuuggacccauugggaccagcccacccg

SEQ ID NO: 372507 - RNA, 32 nt, Human
ccccuuugucccugcacucagcccuguggccc

SEQ ID NO: 372508 - RNA, 32 nt, Human
ccccuuugucuuugggcuuuugcccuuugaaa

SEQ ID NO: 372509 - RNA, 32 nt, Human
ccccuuugugugcaugggucagucaccauaug

SEQ ID NO: 372510 - RNA, 23 nt, Human
ccccuuuguuccccucccggggc

SEQ ID NO: 372511 - RNA, 32 nt, Human
ccccuuuguuuacagcuccugccuccucccuu

SEQ ID NO: 372512 - RNA, 32 nt, Human
ccccuuuguuugggcaauuuucugccauuugg

SEQ ID NO: 372513 - RNA, 32 nt, Human
ccccuuuuaagugugcaggccugagguuugcc

SEQ ID NO: 372514 - RNA, 20 nt, Human
ccccuuuuauuuccaugugc

SEQ ID NO: 372515 - RNA, 18 nt, Human
ccccuuuucaauuugagc

SEQ ID NO: 372516 - RNA, 18 nt, Human
ccccuuuucagcuucugc

SEQ ID NO: 372517 - RNA, 32 nt, Human
ccccuuuuccacccugggccccaaugccgucc

SEQ ID NO: 372518 - RNA, 16 nt, Human
ccccuuuuccagguga

SEQ ID NO: 372519 - RNA, 19 nt, Human
ccccuuuucccucugcugc

SEQ ID NO: 372520 - RNA, 32 nt, Human
ccccuuuucccucuugcgucugugccagcuca

SEQ ID NO: 372521 - RNA, 32 nt, Human
ccccuuuuccuggcauuucucuuccacgcgac

SEQ ID NO: 372522 - RNA, 18 nt, Human
ccccuuuuccuugagaga

SEQ ID NO: 372523 - RNA, 16 nt, Human
ccccuuuucucuggga

SEQ ID NO: 372524 - RNA, 32 nt, Human
ccccuuuucuuccucuugccuuucuauuaaua

SEQ ID NO: 372525 - RNA, 32 nt, Human
ccccuuuucuucuucugcugggaggguggggu

SEQ ID NO: 372526 - RNA, 32 nt, Human
ccccuuuugcagaugugaagggccagugaacc

SEQ ID NO: 372527 - RNA, 18 nt, Human
ccccuuuugccaaucuca

SEQ ID NO: 372528 - RNA, 19 nt, Human
ccccuuuuguucauuugug

SEQ ID NO: 372529 - RNA, 19 nt, Human
ccccuuuuuacaguucugc

SEQ ID NO: 372530 - RNA, 19 nt, Human
ccccuuuuucacguugugc

SEQ ID NO: 372531 - RNA, 17 nt, Human
ccccuuuuucccauggc

SEQ ID NO: 372532 - RNA, 21 nt, Human
ccccuuuuucgggccccgccc

SEQ ID NO: 372533 - RNA, 19 nt, Human
ccccuuuuuuagcuuuugc

SEQ ID NO: 372534 - RNA, 17 nt, Human
ccccuuuuuuguuugug

SEQ ID NO: 372535 - RNA, 32 nt, Human
cccgaaaauccuuccuugcaggaaaccagucu

SEQ ID NO: 372536 - RNA, 32 nt, Human
cccgaaaccagcugcucacucuuucuuuuugg

SEQ ID NO: 372537 - RNA, 32 nt, Human
cccgaaacccuuguuccuuccucuggucauug

SEQ ID NO: 372538 - RNA, 32 nt, Human
cccgaaaccugggcuggagugagguggaagga

SEQ ID NO: 372539 - RNA, 32 nt, Human
cccgaaacggggaaguugucuuguuuggagag

SEQ ID NO: 372540 - RNA, 32 nt, Human
cccgaaagaacuuccccaguauggugguccug

SEQ ID NO: 372541 - RNA, 32 nt, Human
cccgaaagccgugcucuccagccuggcugcca

SEQ ID NO: 372542 - RNA, 24 nt, Human
cccgaaaugcugggauuacaggca

SEQ ID NO: 372543 - RNA, 32 nt, Human
cccgaaaugcuuugggauuacgggugugagcc

SEQ ID NO: 372544 - RNA, 32 nt, Human
cccgaacaauaugcaguagcuuuaagccauuc

SEQ ID NO: 372545 - RNA, 32 nt, Human
cccgaaccaaaaacugcaaagguggcaggaag

SEQ ID NO: 372546 - RNA, 32 nt, Human
cccgaaccccggggcggcaggaagggggccga

SEQ ID NO: 372547 - RNA, 32 nt, Human
cccgaaccccugaaccuccagccaggggcgcc

SEQ ID NO: 372548 - RNA, 32 nt, Human
cccgaaccuccccugcuucucccuuuccuucu

SEQ ID NO: 372549 - RNA, 19 nt, Human
cccgaaccucugcagcggc

SEQ ID NO: 372550 - RNA, 32 nt, Human
cccgaacucccaccucuccauggccugccuag

SEQ ID NO: 372551 - RNA, 32 nt, Human
cccgaacugugccuucgcuuggagacccacaa

SEQ ID NO: 372552 - RNA, 32 nt, Human
cccgaagaccagcaccuggaucuggaggagcc

SEQ ID NO: 372553 - RNA, 32 nt, Human
cccgaagaccuacaggcaggugcaauggggga

SEQ ID NO: 372554 - RNA, 32 nt, Human
cccgaagaccuccccaggccaccccgccaucu

SEQ ID NO: 372555 - RNA, 32 nt, Human
cccgaagagccugguagcgccuccuggggcag

SEQ ID NO: 372556 - RNA, 25 nt, Human
cccgaagcaauaacaacagcagcag

SEQ ID NO: 372557 - RNA, 32 nt, Human
cccgaagcacacacagcagaguccucuggacu

SEQ ID NO: 372558 - RNA, 32 nt, Human
cccgaagccaggcucugugcuucugccuuuaa

SEQ ID NO: 372559 - RNA, 32 nt, Human
cccgaaggagaaaccauugucuucccaggcuu

SEQ ID NO: 372560 - RNA, 32 nt, Human
cccgaaggauggggaacccugcccucucuguc

SEQ ID NO: 372561 - RNA, 24 nt, Human
cccgaagggagcucuggacccuca

SEQ ID NO: 372562 - RNA, 25 nt, Human
cccgaaggggcuggaggcagggcag

SEQ ID NO: 372563 - RNA, 32 nt, Human
cccgaagggguggggagccaaggguggacuuu

SEQ ID NO: 372564 - RNA, 32 nt, Human
cccgaagguacggggagccaggacgacccccg

SEQ ID NO: 372565 - RNA, 32 nt, Human
cccgaagguauuucuccagauccacagggaga

SEQ ID NO: 372566 - RNA, 23 nt, Human
cccgaagugcuaagauuacaggc

SEQ ID NO: 372567 - RNA, 22 nt, Human
cccgaagugcugggauuacagg

SEQ ID NO: 372568 - RNA, 24 nt, Human
cccgaagugcugggauuacaggca

SEQ ID NO: 372569 - RNA, 22 nt, Human
cccgaagugcugggauuauagg

SEQ ID NO: 372570 - RNA, 32 nt, Human
cccgaaucuccuggguucccacugucagcacc

SEQ ID NO: 372571 - RNA, 32 nt, Human
cccgaaugagagguugaggaaaagacuguggg

SEQ ID NO: 372572 - RNA, 32 nt, Human
cccgaaugcagcccugguucaggcccggagga

SEQ ID NO: 372573 - RNA, 32 nt, Human
cccgaaugcucgcaucucccacuggacggcga

SEQ ID NO: 372574 - RNA, 32 nt, Human
cccgaaugggcgcucagugacaagggcuuuga

SEQ ID NO: 372575 - RNA, 19 nt, Human
cccgaaugucagcaccuuc

SEQ ID NO: 372576 - RNA, 22 nt, Human
cccgacaaucacagccccuguc

SEQ ID NO: 372577 - RNA, 32 nt, Human
cccgacacagcgcagacccaccaggaggaaag

SEQ ID NO: 372578 - RNA, 22 nt, Human
cccgacagcaccuccugagaaa

SEQ ID NO: 372579 - RNA, 32 nt, Human
cccgacagcaggaagucagcugaaagaagcca

SEQ ID NO: 372580 - RNA, 32 nt, Human
cccgacaggccagaggaaucaguuuagacuug

SEQ ID NO: 372581 - RNA, 32 nt, Human
cccgacaugccuggcuuguugcagcuucugug

SEQ ID NO: 372582 - RNA, 19 nt, Human
cccgacauggaacccauga

SEQ ID NO: 372583 - RNA, 32 nt, Human
cccgacaugguggcgcaugccuguaaucccag

SEQ ID NO: 372584 - RNA, 32 nt, Human
cccgaccacacaaacccagccuggggaggaac

SEQ ID NO: 372585 - RNA, 18 nt, Human
cccgaccagccccuucca

SEQ ID NO: 372586 - RNA, 32 nt, Human
cccgaccagccucacccagccucggcugaaug

SEQ ID NO: 372587 - RNA, 32 nt, Human
cccgaccaucuucuccuauuuccuggggagcc

SEQ ID NO: 372588 - RNA, 32 nt, Human
cccgaccauggucacacucaucacugagaagc

SEQ ID NO: 372589 - RNA, 32 nt, Human
cccgacccaaguuuguaaggguucugggugca

SEQ ID NO: 372590 - RNA, 18 nt, Human
cccgacccagcacagacu

SEQ ID NO: 372591 - RNA, 32 nt, Human
cccgaccccagccugucaguccgagcacagug

SEQ ID NO: 372592 - RNA, 32 nt, Human
cccgacccccuggaggugccacgaggaaagga

SEQ ID NO: 372593 - RNA, 24 nt, Human
cccgaccccgccugcggccccuca

SEQ ID NO: 372594 - RNA, 32 nt, Human
cccgaccccgcugcacccucagaagagggguu

SEQ ID NO: 372595 - RNA, 32 nt, Human
cccgaccccucaggcccaccugucacggggaa

SEQ ID NO: 372596 - RNA, 32 nt, Human
cccgacccucaccagucccauuugccucccuc

SEQ ID NO: 372597 - RNA, 32 nt, Human
cccgacccuccagccagccuucugccggcccc

SEQ ID NO: 372598 - RNA, 22 nt, Human
cccgacccucucaggcauucca

SEQ ID NO: 372599 - RNA, 18 nt, Human
cccgacccugcccugggc

SEQ ID NO: 372600 - RNA, 32 nt, Human
cccgaccgagcuuaaccccaggaaaaggucag

SEQ ID NO: 372601 - RNA, 32 nt, Human
cccgaccgcacuccagccugggcgacagaguc

SEQ ID NO: 372602 - RNA, 23 nt, Human
cccgaccgccauggagggggcag

SEQ ID NO: 372603 - RNA, 16 nt, Human
cccgaccgccgcgccg

SEQ ID NO: 372604 - RNA, 16 nt, Human
cccgaccgcgcugccg

SEQ ID NO: 372605 - RNA, 23 nt, Human
cccgaccgcguccugcagcagcu

SEQ ID NO: 372606 - RNA, 20 nt, Human
cccgaccuccuccugcuguc

SEQ ID NO: 372607 - RNA, 24 nt, Human
cccgaccucuauacucuggcuguc

SEQ ID NO: 372608 - RNA, 32 nt, Human
cccgaccugcagcggcugcaggcccagcgccc

SEQ ID NO: 372609 - RNA, 32 nt, Human
cccgacgacggcgacuuccugcgcacgccgcg

SEQ ID NO: 372610 - RNA, 32 nt, Human
cccgacgagaggaggcggggugggggaggcgg

SEQ ID NO: 372611 - RNA, 32 nt, Human
cccgacgcaagccugccccggggaagacccag

SEQ ID NO: 372612 - RNA, 24 nt, Human
cccgacgcagagcagcgcccuggc

SEQ ID NO: 372613 - RNA, 32 nt, Human
cccgacgcgaagcagcgagcugaggcggcggc

SEQ ID NO: 372614 - RNA, 18 nt, Human
cccgacgcugcagcggcu

SEQ ID NO: 372615 - RNA, 21 nt, Human
cccgacggagcugcuucugcu

SEQ ID NO: 372616 - RNA, 32 nt, Human
cccgacgggaugcccgcagccaugcuccccua

SEQ ID NO: 372617 - RNA, 21 nt, Human
cccgacgggccgcggcgcgga

SEQ ID NO: 372618 - RNA, 21 nt, Human
cccgacguccggagggggcag

SEQ ID NO: 372619 - RNA, 32 nt, Human
cccgacgucuccgcgcagguucuugaagcagc

SEQ ID NO: 372620 - RNA, 20 nt, Human
cccgacgugccagggcccag

SEQ ID NO: 372621 - RNA, 32 nt, Human
cccgacgugugccucuucggccccuggggcuc

SEQ ID NO: 372622 - RNA, 32 nt, Human
cccgacuccuuucccagaggugagugcccgaa

SEQ ID NO: 372623 - RNA, 32 nt, Human
cccgacucgcccacagauugaaaaaugccugc

SEQ ID NO: 372624 - RNA, 32 nt, Human
cccgacucgcugucugcugucgucgguggucg

SEQ ID NO: 372625 - RNA, 32 nt, Human
cccgacucucaagccucagcucccaggcuagg

SEQ ID NO: 372626 - RNA, 32 nt, Human
cccgacucuccgcgguuaccugugccuagagg

SEQ ID NO: 372627 - RNA, 20 nt, Human
cccgacucucgcgggguuua

SEQ ID NO: 372628 - RNA, 32 nt, Human
cccgacucuggccacugaccucagggccgaag

SEQ ID NO: 372629 - RNA, 32 nt, Human
cccgacucuguggagucuagcugccagggucg

SEQ ID NO: 372630 - RNA, 32 nt, Human
cccgacugcacccuccccuucugguagucaua

SEQ ID NO: 372631 - RNA, 32 nt, Human
cccgacugugccguggugucuccuucccuaaa

SEQ ID NO: 372632 - RNA, 32 nt, Human
cccgacuguggcuaguugucuguccgguggcu

SEQ ID NO: 372633 - RNA, 32 nt, Human
cccgacuuccuugugaaaccuccuaguagaaa

SEQ ID NO: 372634 - RNA, 32 nt, Human
cccgacuucguaucucccacccugcaccaaga

SEQ ID NO: 372635 - RNA, 32 nt, Human
cccgacuucuaccagggaugccuucacgccaa

SEQ ID NO: 372636 - RNA, 31 nt, Human
cccgacuuugucucugggguccuguuccuuc

SEQ ID NO: 372637 - RNA, 32 nt, Human
cccgagaaacacaggagagcgagcgcaagccc

SEQ ID NO: 372638 - RNA, 32 nt, Human
cccgagaacagcccuggcugucagcgggcacc

SEQ ID NO: 372639 - RNA, 22 nt, Human
cccgagaacgcgcgaccaggca

SEQ ID NO: 372640 - RNA, 22 nt, Human
cccgagaagagaugacuaggca

SEQ ID NO: 372641 - RNA, 32 nt, Human
cccgagaagcagagagcgagagggggaagagg

SEQ ID NO: 372642 - RNA, 32 nt, Human
cccgagaagcuuccucucagugaccacaauau

SEQ ID NO: 372643 - RNA, 32 nt, Human
cccgagaaggaagcucacagggcaagacaugg

SEQ ID NO: 372644 - RNA, 32 nt, Human
cccgagacugggugggagagggggagucucac

SEQ ID NO: 372645 - RNA, 21 nt, Human
cccgagacuucaggcccgccc

SEQ ID NO: 372646 - RNA, 32 nt, Human
cccgagagaacugcugaacauuuguucauugc

SEQ ID NO: 372647 - RNA, 24 nt, Human
cccgagagacggagguugcaguga

SEQ ID NO: 372648 - RNA, 32 nt, Human
cccgagagacggagguugcagugagcugauau

SEQ ID NO: 372649 - RNA, 32 nt, Human
cccgagagcgcacgaugggggccccgcucgcc

SEQ ID NO: 372650 - RNA, 32 nt, Human
cccgagaggagaggagguaacgaggagggcgg

SEQ ID NO: 372651 - RNA, 32 nt, Human
cccgagaggauuccugggugggggugggcgug

SEQ ID NO: 372652 - RNA, 22 nt, Human
cccgagaggcccugcagcagcu

SEQ ID NO: 372653 - RNA, 24 nt, Human
cccgagaggcggaaguugcaguga

SEQ ID NO: 372654 - RNA, 32 nt, Human
cccgagaggcggaaguugcagugagccgagau

SEQ ID NO: 372655 - RNA, 23 nt, Human
cccgagaggcggagagaaugugg

SEQ ID NO: 372656 - RNA, 32 nt, Human
cccgagaggcggagcuugcagugagccaagau

SEQ ID NO: 372657 - RNA, 32 nt, Human
cccgagaggcggagcuugcagugagcugagau

SEQ ID NO: 372658 - RNA, 24 nt, Human
cccgagaggcggagguggcaguga

SEQ ID NO: 372659 - RNA, 24 nt, Human
cccgagaggcggagguugcaguga

SEQ ID NO: 372660 - RNA, 32 nt, Human
cccgagaggcggagguugcagugagcccagau

SEQ ID NO: 372661 - RNA, 32 nt, Human
cccgagaggcggagguugcagugagccgagau

SEQ ID NO: 372662 - RNA, 32 nt, Human
cccgagaggcugucccuggacccuggcuggca

SEQ ID NO: 372663 - RNA, 32 nt, Human
cccgagagguagagcuugcaguaagcagagau

SEQ ID NO: 372664 - RNA, 24 nt, Human
cccgagagguggagguugaaguga

SEQ ID NO: 372665 - RNA, 32 nt, Human
cccgagagguggagguugcagugagccaaaau

SEQ ID NO: 372666 - RNA, 32 nt, Human
cccgagagguggagguugcagugagccgagau

SEQ ID NO: 372667 - RNA, 32 nt, Human
cccgagaguaaucaucuuuccaauccagagga

SEQ ID NO: 372668 - RNA, 31 nt, Human
cccgagaugccggaguuccuggaagaccccu

SEQ ID NO: 372669 - RNA, 23 nt, Human
cccgagaugcuggcccccagggu

SEQ ID NO: 372670 - RNA, 32 nt, Human
cccgagauggcuuuucucccaguggcuucucu

SEQ ID NO: 372671 - RNA, 32 nt, Human
cccgagcaaaacacaggauguuccagcauaag

SEQ ID NO: 372672 - RNA, 32 nt, Human
cccgagcaagacccugcaccucuuugggccuc

SEQ ID NO: 372673 - RNA, 32 nt, Human
cccgagcacccacucccuaccgcccgcucccu

SEQ ID NO: 372674 - RNA, 32 nt, Human
cccgagcaccuccacauccuccacguucugcu

SEQ ID NO: 372675 - RNA, 32 nt, Human
cccgagcagcacuauccugccugguggcccug

SEQ ID NO: 372676 - RNA, 32 nt, Human
cccgagcagccuggaucgucguucccucaguc

SEQ ID NO: 372677 - RNA, 23 nt, Human
cccgagcagcggcagcagcagcg

SEQ ID NO: 372678 - RNA, 32 nt, Human
cccgagccaccugcacuuuucccucacccacc

SEQ ID NO: 372679 - RNA, 18 nt, Human
cccgagcccagggaccag

SEQ ID NO: 372680 - RNA, 21 nt, Human
cccgagccccagucagcccgu

SEQ ID NO: 372681 - RNA, 20 nt, Human
cccgagccccgccgccgggu

SEQ ID NO: 372682 - RNA, 18 nt, Human
cccgagccccgcgccccg

SEQ ID NO: 372683 - RNA, 22 nt, Human
cccgagccccgugggcacucgc

SEQ ID NO: 372684 - RNA, 21 nt, Human
cccgagccccugcccacgccc

SEQ ID NO: 372685 - RNA, 19 nt, Human
cccgagcccgugggcacgc

SEQ ID NO: 372686 - RNA, 18 nt, Human
cccgagcccuagauguuc

SEQ ID NO: 372687 - RNA, 18 nt, Human
cccgagccgccgccgccg

SEQ ID NO: 372688 - RNA, 18 nt, Human
cccgagccgccgccgucg

SEQ ID NO: 372689 - RNA, 22 nt, Human
cccgagccggcggggagccggu

SEQ ID NO: 372690 - RNA, 32 nt, Human
cccgagccggggccauggcgaagcugcugagc

SEQ ID NO: 372691 - RNA, 25 nt, Human
cccgagccgucccagaaaccaaagg

SEQ ID NO: 372692 - RNA, 32 nt, Human
cccgagcgaagugccugacaccggguuggauc

SEQ ID NO: 372693 - RNA, 32 nt, Human
cccgagcgcacucuccagccgccggggaucuu

SEQ ID NO: 372694 - RNA, 32 nt, Human
cccgagcgcagaggcggagcugugcucagcac

SEQ ID NO: 372695 - RNA, 32 nt, Human
cccgagcgccuucuccccaggaccccgguguc

SEQ ID NO: 372696 - RNA, 20 nt, Human
cccgagcggcagcggcagcg

SEQ ID NO: 372697 - RNA, 32 nt, Human
cccgagcgggcagagggcacgggcaggcggac

SEQ ID NO: 372698 - RNA, 23 nt, Human
cccgagcggggggccauggagaa

SEQ ID NO: 372699 - RNA, 32 nt, Human
cccgagcuacucucuugccagcauuuucacau

SEQ ID NO: 372700 - RNA, 32 nt, Human
cccgagcucagggcagcugugcugggugagcu

SEQ ID NO: 372701 - RNA, 32 nt, Human
cccgagcugcaggagggccaggagggcagaug

SEQ ID NO: 372702 - RNA, 32 nt, Human
cccgagcugccgcggcugcgccccggcuccag

SEQ ID NO: 372703 - RNA, 18 nt, Human
cccgagcugccggucuga

SEQ ID NO: 372704 - RNA, 20 nt, Human
cccgagcuggagugcagugg

SEQ ID NO: 372705 - RNA, 22 nt, Human
cccgagcuggagugcaguggug

SEQ ID NO: 372706 - RNA, 32 nt, Human
cccgagcugugccgaccaacccccaggauggc

SEQ ID NO: 372707 - RNA, 32 nt, Human
cccgaggaaaagagagaagaaggggacacgga

SEQ ID NO: 372708 - RNA, 32 nt, Human
cccgaggacacacacgcaaccuccuggaccgc

SEQ ID NO: 372709 - RNA, 21 nt, Human
cccgaggaccagcaggcuggg

SEQ ID NO: 372710 - RNA, 32 nt, Human
cccgaggacccaggcuugacgauucaccgggg

SEQ ID NO: 372711 - RNA, 32 nt, Human
cccgaggacugggagcucuucucugaaauucg

SEQ ID NO: 372712 - RNA, 32 nt, Human
cccgaggagccugcuugcuggaaaggcuuucc

SEQ ID NO: 372713 - RNA, 32 nt, Human
cccgaggagcugaggguuuaccccgugaggug

SEQ ID NO: 372714 - RNA, 32 nt, Human
cccgaggagcugccuuucauauuuuccagguu

SEQ ID NO: 372715 - RNA, 22 nt, Human
cccgaggagcugggauuacagg

SEQ ID NO: 372716 - RNA, 24 nt, Human
cccgaggagcugggauuacaggca

SEQ ID NO: 372717 - RNA, 32 nt, Human
cccgaggaggaggaggaggaggaggaagaggg

SEQ ID NO: 372718 - RNA, 32 nt, Human
cccgaggaggaggaggaggaggaggacgcggg

SEQ ID NO: 372719 - RNA, 32 nt, Human
cccgaggaggcagcggccgcaggcagccgggg

SEQ ID NO: 372720 - RNA, 32 nt, Human
cccgaggaggcaggacuuccuggugugggggu

SEQ ID NO: 372721 - RNA, 18 nt, Human
cccgaggaggcggcagcu

SEQ ID NO: 372722 - RNA, 32 nt, Human
cccgaggaggggcccgguggcggcagggccag

SEQ ID NO: 372723 - RNA, 32 nt, Human
cccgaggaucagucuuggccccaaagcgcgac

SEQ ID NO: 372724 - RNA, 32 nt, Human
cccgaggcagccaggacugggcgggaaggugc

SEQ ID NO: 372725 - RNA, 22 nt, Human
cccgaggccaagcgaggggcug

SEQ ID NO: 372726 - RNA, 23 nt, Human
cccgaggccagggccgccgaagg

SEQ ID NO: 372727 - RNA, 32 nt, Human
cccgaggcccuggagugccgugcgugugaagg

SEQ ID NO: 372728 - RNA, 32 nt, Human
cccgaggccuacagcuggccuggggcucgugu

SEQ ID NO: 372729 - RNA, 22 nt, Human
cccgaggccuccgcugcggcug

SEQ ID NO: 372730 - RNA, 19 nt, Human
cccgaggccuuggccgcgu

SEQ ID NO: 372731 - RNA, 32 nt, Human
cccgaggcgcaagaggaagaugaggacgaaga

SEQ ID NO: 372732 - RNA, 21 nt, Human
cccgaggcgcgggcucuggcg

SEQ ID NO: 372733 - RNA, 22 nt, Human
cccgaggcggagguugcacuga

SEQ ID NO: 372734 - RNA, 32 nt, Human
cccgaggcucaggugauccucccaucucagcc

SEQ ID NO: 372735 - RNA, 32 nt, Human
cccgagggaaguuggcgcaguguuucagcauc

SEQ ID NO: 372736 - RNA, 32 nt, Human
cccgagggaggaagagagggagggaggaacuu

SEQ ID NO: 372737 - RNA, 32 nt, Human
cccgaggggaaggggcggugcccacaccgggg

SEQ ID NO: 372738 - RNA, 21 nt, Human
cccgaggguccgcugggcccg

SEQ ID NO: 372739 - RNA, 32 nt, Human
cccgaggucaaggugcccaagggaccugaagu

SEQ ID NO: 372740 - RNA, 32 nt, Human
cccgaggucacugaggacugguaccucgggaa

SEQ ID NO: 372741 - RNA, 32 nt, Human
cccgaggucuccgcccgcaccaugcggcuggg

SEQ ID NO: 372742 - RNA, 24 nt, Human
cccgaguaacugagauuacaggca

SEQ ID NO: 372743 - RNA, 24 nt, Human
cccgaguagcuaggacuacaggca

SEQ ID NO: 372744 - RNA, 23 nt, Human
cccgaguagcuaggauuacaggc

SEQ ID NO: 372745 - RNA, 24 nt, Human
cccgaguagcuaggauuacaggca

SEQ ID NO: 372746 - RNA, 24 nt, Human
cccgaguagcucagauuacaggca

SEQ ID NO: 372747 - RNA, 24 nt, Human
cccgaguagcugagacuacaggca

SEQ ID NO: 372748 - RNA, 24 nt, Human
cccgaguagcuggaauuacaggca

SEQ ID NO: 372749 - RNA, 24 nt, Human
cccgaguagcugggacuacaggca

SEQ ID NO: 372750 - RNA, 24 nt, Human
cccgaguagcugggauuacagaca

SEQ ID NO: 372751 - RNA, 22 nt, Human
cccgaguagcugggauuacagg

SEQ ID NO: 372752 - RNA, 24 nt, Human
cccgaguagcugggauuacaggca

SEQ ID NO: 372753 - RNA, 32 nt, Human
cccgaguagcugguaaaacaggucaacaucag

SEQ ID NO: 372754 - RNA, 32 nt, Human
cccgaguagggaggaccacaggugugagccac

SEQ ID NO: 372755 - RNA, 31 nt, Human
cccgagucacucagcguuugcgggaaaauaa

SEQ ID NO: 372756 - RNA, 32 nt, Human
cccgagucagggcgacuuccacagcagcagaa

SEQ ID NO: 372757 - RNA, 32 nt, Human
cccgaguccaggaauuagagguugcagugagg

SEQ ID NO: 372758 - RNA, 22 nt, Human
cccgagucccagaaaccaaagg

SEQ ID NO: 372759 - RNA, 32 nt, Human
cccgaguccccagcugugcaccagcuccccgc

SEQ ID NO: 372760 - RNA, 19 nt, Human
cccgagucccgggcccgcg

SEQ ID NO: 372761 - RNA, 21 nt, Human
cccgaguccgcuggcccgcgc

SEQ ID NO: 372762 - RNA, 32 nt, Human
cccgagucggcucuguuguuugaauaaacgug

SEQ ID NO: 372763 - RNA, 23 nt, Human
cccgagugccuggauuacaggca

SEQ ID NO: 372764 - RNA, 32 nt, Human
cccgagugcucaccugccccagccuggcucua

SEQ ID NO: 372765 - RNA, 32 nt, Human
cccgaguggagccgggcugagauucuucucaa

SEQ ID NO: 372766 - RNA, 22 nt, Human
cccgaguugcugggaugacagg

SEQ ID NO: 372767 - RNA, 32 nt, Human
cccgaguuugcagagagguaacucccuuuggc

SEQ ID NO: 372768 - RNA, 32 nt, Human
cccgauaggggucaaguugcucaaaucugcgu

SEQ ID NO: 372769 - RNA, 20 nt, Human
cccgauauauaugcauuuua

SEQ ID NO: 372770 - RNA, 21 nt, Human
cccgaucaagaacauggagaa

SEQ ID NO: 372771 - RNA, 32 nt, Human
cccgaucaagaacauggagaaagcccucuuuc

SEQ ID NO: 372772 - RNA, 32 nt, Human
cccgauccccgguagcugcgcuucccgcgcgg

SEQ ID NO: 372773 - RNA, 32 nt, Human
cccgauccugcagcucuuucuggaccuucagg

SEQ ID NO: 372774 - RNA, 32 nt, Human
cccgauccuuccccugcaaccagacagucuac

SEQ ID NO: 372775 - RNA, 32 nt, Human
cccgaucuucuuugcuucuccaaccaaaacau

SEQ ID NO: 372776 - RNA, 32 nt, Human
cccgaucuugcugcccuucuugacacacugug

SEQ ID NO: 372777 - RNA, 29 nt, Human
cccgaugacucugaaacaugcuuggccuu

SEQ ID NO: 372778 - RNA, 32 nt, Human
cccgaugagaaggggcagggacugggggcucu

SEQ ID NO: 372779 - RNA, 32 nt, Human
cccgaugauauggcagccauagguacagguau

SEQ ID NO: 372780 - RNA, 32 nt, Human
cccgaugcaguggcucaugccuguaaucccag

SEQ ID NO: 372781 - RNA, 29 nt, Human
cccgaugccuccagagucagugggaagga

SEQ ID NO: 372782 - RNA, 20 nt, Human
cccgauggaggcacaggcuu

SEQ ID NO: 372783 - RNA, 32 nt, Human
cccgauggccggcaccuggccugugugagcca

SEQ ID NO: 372784 - RNA, 16 nt, Human
cccgauggcgacagcu

SEQ ID NO: 372785 - RNA, 32 nt, Human
cccgaugggaaacuguuuugccuggcgcugcu

SEQ ID NO: 372786 - RNA, 22 nt, Human
cccgaugggacauaaaaccuca

SEQ ID NO: 372787 - RNA, 19 nt, Human
cccgaugggcugggccgug

SEQ ID NO: 372788 - RNA, 32 nt, Human
cccgaugucugggcugugucccugccgggauu

SEQ ID NO: 372789 - RNA, 32 nt, Human
cccgauguggucugggcugggagcaggcauau

SEQ ID NO: 372790 - RNA, 20 nt, Human
cccgauguguccagccagcu

SEQ ID NO: 372791 - RNA, 32 nt, Human
cccgauuagaugguaaagaagugcacccaaac

SEQ ID NO: 372792 - RNA, 32 nt, Human
cccgauucacgccauucuccugccucagccuc

SEQ ID NO: 372793 - RNA, 32 nt, Human
cccgauuccucccagugcuuagcaugaagaag

SEQ ID NO: 372794 - RNA, 32 nt, Human
cccgauucuuuccugcccuccccaccuuguga

SEQ ID NO: 372795 - RNA, 32 nt, Human
cccgauugaaagaaccagagaggcucugagaa

SEQ ID NO: 372796 - RNA, 32 nt, Human
cccgauugccuccucaagucgcagacacuaug

SEQ ID NO: 372797 - RNA, 32 nt, Human
cccgauuucccaggggcucugggagggacccu

SEQ ID NO: 372798 - RNA, 32 nt, Human
cccgcaaaaucaggcuugagugcaguggcgca

SEQ ID NO: 372799 - RNA, 32 nt, Human
cccgcaaaguacucggauuacaggugugaguc

SEQ ID NO: 372800 - RNA, 18 nt, Human
cccgcaacacccacauca

SEQ ID NO: 372801 - RNA, 32 nt, Human
cccgcaagcagcccggguccgcacugcgccag

SEQ ID NO: 372802 - RNA, 32 nt, Human
cccgcaauccugcuccaagagaucuuaagcug

SEQ ID NO: 372803 - RNA, 22 nt, Human
cccgcaauggccaccagaaaca

SEQ ID NO: 372804 - RNA, 32 nt, Human
cccgcacacaccaugccuccugucucaacacu

SEQ ID NO: 372805 - RNA, 32 nt, Human
cccgcacagcagcaacccagccuccagcucug

SEQ ID NO: 372806 - RNA, 32 nt, Human
cccgcacagcucccggcgggugcucugaggcc

SEQ ID NO: 372807 - RNA, 32 nt, Human
cccgcacaggcagcacugaggccgggacccug

SEQ ID NO: 372808 - RNA, 32 nt, Human
cccgcacaggcaggcuguguugugggguccag

SEQ ID NO: 372809 - RNA, 32 nt, Human
cccgcacaggcuguggcuugcacuccagccgc

SEQ ID NO: 372810 - RNA, 32 nt, Human
cccgcacaucaagucccuccccuacuggaugg

SEQ ID NO: 372811 - RNA, 22 nt, Human
cccgcaccagcagccuccgccg

SEQ ID NO: 372812 - RNA, 20 nt, Human
cccgcacccaccuccugucu

SEQ ID NO: 372813 - RNA, 22 nt, Human
cccgcacccacuaauucugcuu

SEQ ID NO: 372814 - RNA, 32 nt, Human
cccgcaccccaccucuagcggcuuugcucgag

SEQ ID NO: 372815 - RNA, 28 nt, Human
cccgcaccccgacuccugcuccaugcuu

SEQ ID NO: 372816 - RNA, 32 nt, Human
cccgcacccuagcauccugcugccuucccaca

SEQ ID NO: 372817 - RNA, 32 nt, Human
cccgcaccgccccacgcgcacacacuccugcc

SEQ ID NO: 372818 - RNA, 32 nt, Human
cccgcacgccuguaaucccagcacuuggggag

SEQ ID NO: 372819 - RNA, 22 nt, Human
cccgcacggccagcagcagcgg

SEQ ID NO: 372820 - RNA, 21 nt, Human
cccgcacggccgcugcgcacg

SEQ ID NO: 372821 - RNA, 32 nt, Human
cccgcacggcggcuacggccuaggugagcggc

SEQ ID NO: 372822 - RNA, 32 nt, Human
cccgcacggcuuuccuggaaagcgcugccccu

SEQ ID NO: 372823 - RNA, 32 nt, Human
cccgcacugcagucuccagccugagccauggg

SEQ ID NO: 372824 - RNA, 32 nt, Human
cccgcagacacgugccuggacuccgagggcuu

SEQ ID NO: 372825 - RNA, 32 nt, Human
cccgcagagagcacaggaagaggcaggggcgg

SEQ ID NO: 372826 - RNA, 32 nt, Human
cccgcagagggaggggaggggcugagcuguga

SEQ ID NO: 372827 - RNA, 18 nt, Human
cccgcagagggggugcag

SEQ ID NO: 372828 - RNA, 32 nt, Human
cccgcagaugcugggggcugaaggaucccggc

SEQ ID NO: 372829 - RNA, 32 nt, Human
cccgcagcaaaaggcaaacuugccuggcucau

SEQ ID NO: 372830 - RNA, 20 nt, Human
cccgcagcacgccgccgccg

SEQ ID NO: 372831 - RNA, 32 nt, Human
cccgcagcagcagaaauguccauuuccucucu

SEQ ID NO: 372832 - RNA, 32 nt, Human
cccgcagcagccgccgccgcagccgccccagc

SEQ ID NO: 372833 - RNA, 32 nt, Human
cccgcagcccaggcuccugggccagugcucuc

SEQ ID NO: 372834 - RNA, 24 nt, Human
cccgcagccccgcgcgccggccga

SEQ ID NO: 372835 - RNA, 32 nt, Human
cccgcagccccugcuacugagaagcuccggga

SEQ ID NO: 372836 - RNA, 25 nt, Human
cccgcagcccgccggccgcacacgu

SEQ ID NO: 372837 - RNA, 20 nt, Human
cccgcagcccgcucgcggcg

SEQ ID NO: 372838 - RNA, 21 nt, Human
cccgcagcccggccgccgccg

SEQ ID NO: 372839 - RNA, 20 nt, Human
cccgcagcccucuccaccca

SEQ ID NO: 372840 - RNA, 22 nt, Human
cccgcagcccuggcuccauccg

SEQ ID NO: 372841 - RNA, 32 nt, Human
cccgcagccgaaggacaagugagcagcccccu

SEQ ID NO: 372842 - RNA, 19 nt, Human
cccgcagccgccgccgccg

SEQ ID NO: 372843 - RNA, 22 nt, Human
cccgcagccgccgcgcccgggc

SEQ ID NO: 372844 - RNA, 32 nt, Human
cccuccuccauucuugcccucuggagaagugg

SEQ ID NO: 372845 - RNA, 23 nt, Human
cccuccucccaaaaagcagccag

SEQ ID NO: 372846 - RNA, 32 nt, Human
cccuccucccacccucguucagccuguccaga

SEQ ID NO: 372847 - RNA, 32 nt, Human
cccuccucccagccaucuccucuucccuaagg

SEQ ID NO: 372848 - RNA, 32 nt, Human
cccuccuccccaccauccucccuaccuccuua

SEQ ID NO: 372849 - RNA, 32 nt, Human
cccuccuccgcccccacccuccagaagcacuc

SEQ ID NO: 372850 - RNA, 32 nt, Human
cccuccuccuacccggcuuuaaagcuagugag

SEQ ID NO: 372851 - RNA, 32 nt, Human
cccuccuccucaaguuccuuuuugcaccguca

SEQ ID NO: 372852 - RNA, 32 nt, Human
cccuccuccucccccagagggguggguuccuc

SEQ ID NO: 372853 - RNA, 19 nt, Human
cccuccuccucccuccuca

SEQ ID NO: 372854 - RNA, 23 nt, Human
cccuccuccuccugccgggccgg

SEQ ID NO: 372855 - RNA, 21 nt, Human
cccuccuccucugcucugccc

SEQ ID NO: 372856 - RNA, 32 nt, Human
cccuccuccucuuccuccucuuccuucuccuc

SEQ ID NO: 372857 - RNA, 32 nt, Human
cccuccuccucuucuccuucaagacccaacug

SEQ ID NO: 372858 - RNA, 32 nt, Human
cccuccuccucuucuucuuccacacccacagc

SEQ ID NO: 372859 - RNA, 32 nt, Human
cccuccuccugccuccugacccaggacuguug

SEQ ID NO: 372860 - RNA, 32 nt, Human
cccuccuccuguguagcugccaccuccccgcu

SEQ ID NO: 372861 - RNA, 32 nt, Human
cccuccucggggucuguguccuugagacuugg

SEQ ID NO: 372862 - RNA, 32 nt, Human
cccuccucucacccuccacccuccaggagacc

SEQ ID NO: 372863 - RNA, 22 nt, Human
cccuccucucaccugcaggcug

SEQ ID NO: 372864 - RNA, 32 nt, Human
cccuccucucagccucuggccaacacaguccc

SEQ ID NO: 372865 - RNA, 32 nt, Human
cccuccucucaggcugcuucugacaggcccaa

SEQ ID NO: 372866 - RNA, 32 nt, Human
cccuccucucaguugagggcaaggucaagggg

SEQ ID NO: 372867 - RNA, 32 nt, Human
cccuccucuccaccaucgucuucuuggccaug

SEQ ID NO: 372868 - RNA, 32 nt, Human
cccuccucuccaggacccuggaugaauccguu

SEQ ID NO: 372869 - RNA, 32 nt, Human
cccuccucuccccuccacugucuucuucaggu

SEQ ID NO: 372870 - RNA, 32 nt, Human
cccuccucuccccuccccucuccuccgccccc

SEQ ID NO: 372871 - RNA, 32 nt, Human
cccuccucuccccuccuuuuccuuccuuccuu

SEQ ID NO: 372872 - RNA, 17 nt, Human
cccuccucuccuccuca

SEQ ID NO: 372873 - RNA, 32 nt, Human
cccuccucuccuccuuucaccucugcaccuag

SEQ ID NO: 372874 - RNA, 32 nt, Human
cccuccucuccugguauaccccggcuuccccc

SEQ ID NO: 372875 - RNA, 32 nt, Human
cccuccucucggccucuggccaacacaguccc

SEQ ID NO: 372876 - RNA, 32 nt, Human
cccuccucucggucucuggccaacacaguccc

SEQ ID NO: 372877 - RNA, 32 nt, Human
cccuccucucucuuccucuccucucucucuuc

SEQ ID NO: 372878 - RNA, 32 nt, Human
cccuccucucugcugccacucauuccagaaca

SEQ ID NO: 372879 - RNA, 32 nt, Human
cccuccucugaaccccagaggcuuccccagcc

SEQ ID NO: 372880 - RNA, 32 nt, Human
cccuccucugacucaacaaugccaucagcacu

SEQ ID NO: 372881 - RNA, 32 nt, Human
cccuccucugagagugggaugugcagaguuuu

SEQ ID NO: 372882 - RNA, 32 nt, Human
cccuccucugccaagcccccaggggagcccuc

SEQ ID NO: 372883 - RNA, 32 nt, Human
cccuccucugcccugugccacucucagccauu

SEQ ID NO: 372884 - RNA, 32 nt, Human
cccuccucugcucuccaucauaacugcuauua

SEQ ID NO: 372885 - RNA, 32 nt, Human
cccuccucugcucucucccuggagaggacugc

SEQ ID NO: 372886 - RNA, 15 nt, Human
cccuccucugcugcc

SEQ ID NO: 372887 - RNA, 32 nt, Human
cccuccucuggcagagguuuugggccaggagg

SEQ ID NO: 372888 - RNA, 32 nt, Human
cccuccucuggcccaggacgccugcugcaagc

SEQ ID NO: 372889 - RNA, 32 nt, Human
cccuccucuguggggcucaggugauugaaaug

SEQ ID NO: 372890 - RNA, 32 nt, Human
cccuccugaaacacagguuggcaggccagucu

SEQ ID NO: 372891 - RNA, 32 nt, Human
cccuccugaccuugugaucugccugccucggc

SEQ ID NO: 372892 - RNA, 32 nt, Human
cccuccugcaaccucucacccgaacaccagug

SEQ ID NO: 372893 - RNA, 32 nt, Human
cccuccugcacaccuggccuccugggccucca

SEQ ID NO: 372894 - RNA, 32 nt, Human
cccuccugcagccucugcucagaacgcccuuc

SEQ ID NO: 372895 - RNA, 23 nt, Human
cccuccugcauuccguccucaca

SEQ ID NO: 372896 - RNA, 32 nt, Human
cccuccugccacccucucuuugacugcuugug

SEQ ID NO: 372897 - RNA, 32 nt, Human
cccuccugccagcauggauucuggguggacac

SEQ ID NO: 372898 - RNA, 20 nt, Human
cccuccugccaggaaaaucc

SEQ ID NO: 372899 - RNA, 22 nt, Human
cccuccugccccauccacccag

SEQ ID NO: 372900 - RNA, 22 nt, Human
cccuccugccucagccccccaa

SEQ ID NO: 372901 - RNA, 20 nt, Human
cccuccugccucagucuuuc

SEQ ID NO: 372902 - RNA, 24 nt, Human
cccuccugccuccacgcccaccca

SEQ ID NO: 372903 - RNA, 23 nt, Human
cccuccugccugccaagcagcaa

SEQ ID NO: 372904 - RNA, 32 nt, Human
cccuccugccuuccuucucuucccaagcccuc

SEQ ID NO: 372905 - RNA, 32 nt, Human
cccuccugcgcugccccagagccugggaagga

SEQ ID NO: 372906 - RNA, 21 nt, Human
cccuccugcggggguuucaca

SEQ ID NO: 372907 - RNA, 22 nt, Human
cccuccugcuccacccccaucc

SEQ ID NO: 372908 - RNA, 19 nt, Human
cccuccugcugaagauaaa

SEQ ID NO: 372909 - RNA, 32 nt, Human
cccuccugcugcacuccuccgccaccgggcua

SEQ ID NO: 372910 - RNA, 32 nt, Human
cccuccugcuggugccagugggagacugccgc

SEQ ID NO: 372911 - RNA, 32 nt, Human
cccuccuggccauucuugcaggccugucccag

SEQ ID NO: 372912 - RNA, 31 nt, Human
cccuccuggcccagcucagccagcaucacug

SEQ ID NO: 372913 - RNA, 32 nt, Human
cccuccuggcccuggccuugguugguguccuc

SEQ ID NO: 372914 - RNA, 32 nt, Human
cccuccugggagagaaggagaucagggcaacu

SEQ ID NO: 372915 - RNA, 32 nt, Human
cccuccugggcuccuccuccgggacaggcaug

SEQ ID NO: 372916 - RNA, 32 nt, Human
cccuccugggcugggcuugggcacaaaucccc

SEQ ID NO: 372917 - RNA, 32 nt, Human
cccuccuggggagccaggcucacagguuguuc

SEQ ID NO: 372918 - RNA, 32 nt, Human
cccuccuggggcuccugugagguggagccaag

SEQ ID NO: 372919 - RNA, 32 nt, Human
cccuccugggugcaacugugcagccacccagc

SEQ ID NO: 372920 - RNA, 32 nt, Human
cccuccuguagucccagcuacuugggaggcug

SEQ ID NO: 372921 - RNA, 32 nt, Human
cccuccuguccaccucuccaggucucacucuc

SEQ ID NO: 372922 - RNA, 32 nt, Human
cccuccuguccugacaggcucagcucugcauc

SEQ ID NO: 372923 - RNA, 32 nt, Human
cccuccugucuacuggcuccaaauaaccaugu

SEQ ID NO: 372924 - RNA, 32 nt, Human
cccuccugucuucuccccguaccuuguaguua

SEQ ID NO: 372925 - RNA, 32 nt, Human
cccuccuguuucucccuugccuggaagucauu

SEQ ID NO: 372926 - RNA, 32 nt, Human
cccuccuguuuuaguuuaaggaaagguuuccu

SEQ ID NO: 372927 - RNA, 32 nt, Human
cccuccuucagaggaggcucuggguggggccu

SEQ ID NO: 372928 - RNA, 32 nt, Human
cccuccuucccaagccuuagggccuacccugg

SEQ ID NO: 372929 - RNA, 32 nt, Human
cccuccuucccaaggcuggcacuaaccaggua

SEQ ID NO: 372930 - RNA, 21 nt, Human
cccuccuuccccuuccugcuu

SEQ ID NO: 372931 - RNA, 32 nt, Human
cccuccuucccucccucccuccuuccucccuc

SEQ ID NO: 372932 - RNA, 32 nt, Human
cccuccuucccuggaugcugugcuguucuccu

SEQ ID NO: 372933 - RNA, 32 nt, Human
cccuccuuccucaggaucugcagccauaggcc

SEQ ID NO: 372934 - RNA, 32 nt, Human
cccuccuuccucccuccccucucccucccccu

SEQ ID NO: 372935 - RNA, 32 nt, Human
cccuccuuccuugaccagcagaucccagcuca

SEQ ID NO: 372936 - RNA, 32 nt, Human
cccuccuuccuugggccugccucaguucccuu

SEQ ID NO: 372937 - RNA, 32 nt, Human
cccuccuucucccagguuuggucucaggggga

SEQ ID NO: 372938 - RNA, 32 nt, Human
cccuccuucucuccuuccuuccuuccucccuc

SEQ ID NO: 372939 - RNA, 32 nt, Human
cccuccuucucugucucuaccucucugccugu

SEQ ID NO: 372940 - RNA, 22 nt, Human
cccuccuucucuuaagccuuuc

SEQ ID NO: 372941 - RNA, 32 nt, Human
cccuccuucugcaggagcucugcugugauuca

SEQ ID NO: 372942 - RNA, 32 nt, Human
cccuccuucugccuccccaguuccuguucccg

SEQ ID NO: 372943 - RNA, 32 nt, Human
cccuccuucuggcagugggcuggaccagccgg

SEQ ID NO: 372944 - RNA, 32 nt, Human
cccuccuucuucuucuuuuaacguuucucucu

SEQ ID NO: 372945 - RNA, 32 nt, Human
cccuccuugaagcacuuucucucccugcuucc

SEQ ID NO: 372946 - RNA, 32 nt, Human
cccuccuugcccgccuacccucccuccagaau

SEQ ID NO: 372947 - RNA, 21 nt, Human
cccuccuuggaggugcaguga

SEQ ID NO: 372948 - RNA, 32 nt, Human
cccuccuuguccagacugggcuacuugcaguu

SEQ ID NO: 372949 - RNA, 22 nt, Human
cccuccuuuaccccucauccaa

SEQ ID NO: 372950 - RNA, 32 nt, Human
cccuccuuucaggcugcagaagggagaggcaa

SEQ ID NO: 372951 - RNA, 32 nt, Human
cccuccuuuccaccccuccgcgcccugccacu

SEQ ID NO: 372952 - RNA, 32 nt, Human
cccuccuuucuauucugggggcuucugagaga

SEQ ID NO: 372953 - RNA, 32 nt, Human
cccuccuuuuauauccuccucuccuugaguaa

SEQ ID NO: 372954 - RNA, 32 nt, Human
cccucgaaaucguggcaucucacuucugagaa

SEQ ID NO: 372955 - RNA, 32 nt, Human
cccucgaagagccuggccagagagggaagaca

SEQ ID NO: 372956 - RNA, 32 nt, Human
cccucgaagcccaugcagaccugcucucaagg

SEQ ID NO: 372957 - RNA, 18 nt, Human
cccucgaaggaggcuguc

SEQ ID NO: 372958 - RNA, 32 nt, Human
cccucgacccucccccuccuugucccucugcu

SEQ ID NO: 372959 - RNA, 21 nt, Human
cccucgacuggccacagccca

SEQ ID NO: 372960 - RNA, 32 nt, Human
cccucgacugugugugcccacaugugccgaga

SEQ ID NO: 372961 - RNA, 32 nt, Human
cccucgagagaaugugcuagagacagccccug

SEQ ID NO: 372962 - RNA, 32 nt, Human
cccucgagagcucugugcuccacgccgaggau

SEQ ID NO: 372963 - RNA, 32 nt, Human
cccucgaggaaccuggucuccgcauccaguua

SEQ ID NO: 372964 - RNA, 32 nt, Human
cccucgaucucaggcugucggugaggcugcag

SEQ ID NO: 372965 - RNA, 32 nt, Human
cccucgaugccuggcuuggugucuggcaaaca

SEQ ID NO: 372966 - RNA, 32 nt, Human
cccucgcagcaacccugucuuggaggaagguc

SEQ ID NO: 372967 - RNA, 32 nt, Human
cccucgcagccugucccucggccucggcccgg

SEQ ID NO: 372968 - RNA, 24 nt, Human
cccucgcagggcccugccgcgccg

SEQ ID NO: 372969 - RNA, 32 nt, Human
cccucgcagggcccugccgcgccgccuucaga

SEQ ID NO: 372970 - RNA, 32 nt, Human
cccucgccaggugauggcagggccaggguggc

SEQ ID NO: 372971 - RNA, 18 nt, Human
cccucgccauccucccca

SEQ ID NO: 372972 - RNA, 32 nt, Human
cccucgcccagccucagcuccuugcugcuccc

SEQ ID NO: 372973 - RNA, 32 nt, Human
cccucgcccagccugccggccaggcgagcgcg

SEQ ID NO: 372974 - RNA, 18 nt, Human
cccucgccccccucccca

SEQ ID NO: 372975 - RNA, 20 nt, Human
cccucgcccugucccuccca

SEQ ID NO: 372976 - RNA, 19 nt, Human
cccucgccgccccuccccg

SEQ ID NO: 372977 - RNA, 32 nt, Human
cccucgccgcccuccggcagccgcgccgcucc

SEQ ID NO: 372978 - RNA, 32 nt, Human
cccucgccggugccucucuccugggucccagg

SEQ ID NO: 372979 - RNA, 32 nt, Human
cccucgccuccccucccugucgcccuuucccu

SEQ ID NO: 372980 - RNA, 15 nt, Human
cccucgccuguugcc

SEQ ID NO: 372981 - RNA, 22 nt, Human
cccucgccuuccaccuccugcu

SEQ ID NO: 372982 - RNA, 32 nt, Human
cccucgcgccugggcagcucucucccagggcu

SEQ ID NO: 372983 - RNA, 32 nt, Human
cccucgcuccucauggugugccuccaaccccc

SEQ ID NO: 372984 - RNA, 32 nt, Human
cccucgcucucauccagcccgcgaggagugcg

SEQ ID NO: 372985 - RNA, 32 nt, Human
cccucgcucugccuccuguccuugucgcugug

SEQ ID NO: 372986 - RNA, 32 nt, Human
cccucgcugcagccccgcccccgugggucucu

SEQ ID NO: 372987 - RNA, 25 nt, Human
cccucgcugccccugacccgcgccc

SEQ ID NO: 372988 - RNA, 16 nt, Human
cccucgcugccugcca

SEQ ID NO: 372989 - RNA, 29 nt, Human
cccucgcugcugucaucauccccuugccu

SEQ ID NO: 372990 - RNA, 32 nt, Human
cccucgcuggcuuccccaccucucucaggaug

SEQ ID NO: 372991 - RNA, 19 nt, Human
cccucgcugugcugcugcc

SEQ ID NO: 372992 - RNA, 32 nt, Human
cccucgcuucugugaagagaucaaaagaaacc

SEQ ID NO: 372993 - RNA, 32 nt, Human
cccucgcuuuccaggauggguaggguggaaga

SEQ ID NO: 372994 - RNA, 32 nt, Human
cccucggaacacccucuccugguggcaggcca

SEQ ID NO: 372995 - RNA, 32 nt, Human
cccucggaagcauggggcuuuugagcacacuu

SEQ ID NO: 372996 - RNA, 32 nt, Human
cccucggaaguuguuuuaccuacuuuaaaagu

SEQ ID NO: 372997 - RNA, 32 nt, Human
cccucggaaucugauuccacauggacauagga

SEQ ID NO: 372998 - RNA, 32 nt, Human
cccucggaccuccaucuccacccugcugagcc

SEQ ID NO: 372999 - RNA, 32 nt, Human
cccucggacuccugcccuccucggccucccug

SEQ ID NO: 373000 - RNA, 32 nt, Human
cccucggacuugaagaauggccauuccuguac

SEQ ID NO: 373001 - RNA, 32 nt, Human
cccucggagacgcagguugcaguggacauugg

SEQ ID NO: 373002 - RNA, 32 nt, Human
cccucggagcuucacaucacacuguacagagg

SEQ ID NO: 373003 - RNA, 32 nt, Human
cccucggcacccagcagcaucugccucagccc

SEQ ID NO: 373004 - RNA, 32 nt, Human
cccucggccaaagcccgagaucaaagcuggga

SEQ ID NO: 373005 - RNA, 32 nt, Human
cccucggccacugcccacucggggagccuucu

SEQ ID NO: 373006 - RNA, 22 nt, Human
cccucggcccugcccugcagug

SEQ ID NO: 373007 - RNA, 32 nt, Human
cccucggccgauccacagacccugccgacugc

SEQ ID NO: 373008 - RNA, 32 nt, Human
cccucggccucaaggauccucuuucugaccau

SEQ ID NO: 373009 - RNA, 32 nt, Human
cccucggccugcggaagaggcgagggcaagaa

SEQ ID NO: 373010 - RNA, 32 nt, Human
cccucggcgccuggccuggccggugcugcaca

SEQ ID NO: 373011 - RNA, 32 nt, Human
cccucggcgcgaaccggcagcccagccccggg

SEQ ID NO: 373012 - RNA, 32 nt, Human
cccucggcgcucugagcccacagggaagaagg

SEQ ID NO: 373013 - RNA, 32 nt, Human
cccucggcgcucugucugccucugccugccag

SEQ ID NO: 373014 - RNA, 32 nt, Human
cccucggcuagagcagggucugugauggccuc

SEQ ID NO: 373015 - RNA, 26 nt, Human
cccucggcuccagcccccggcgccug

SEQ ID NO: 373016 - RNA, 22 nt, Human
cccucggcuccagguccuaccc

SEQ ID NO: 373017 - RNA, 23 nt, Human
cccucggcuccuggcgcgggccu

SEQ ID NO: 373018 - RNA, 18 nt, Human
cccucggcugagaauaaa

SEQ ID NO: 373019 - RNA, 17 nt, Human
cccucggcugcagcagc

SEQ ID NO: 373020 - RNA, 32 nt, Human
cccucggcugccccuccucccugggccugcug

SEQ ID NO: 373021 - RNA, 23 nt, Human
cccucggcuuccgcggggcgcug

SEQ ID NO: 373022 - RNA, 21 nt, Human
cccucggcuuuguggggcuug

SEQ ID NO: 373023 - RNA, 19 nt, Human
cccucgggaagccuggcca

SEQ ID NO: 373024 - RNA, 32 nt, Human
cccucgggaaggaggagagcgccugacgccga

SEQ ID NO: 373025 - RNA, 32 nt, Human
cccucgggacgagacagccccuggcagugcca

SEQ ID NO: 373026 - RNA, 32 nt, Human
cccucgggacuccaccccuuguggccccgccu

SEQ ID NO: 373027 - RNA, 32 nt, Human
cccucgggacugccuggugcaggugguggcag

SEQ ID NO: 373028 - RNA, 30 nt, Human
cccucgggccucuccgagucuuugucucuu

SEQ ID NO: 373029 - RNA, 32 nt, Human
cccucgggcuguaggccugguccgccauucag

SEQ ID NO: 373030 - RNA, 32 nt, Human
cccucgggggccucucgaggucagccucucca

SEQ ID NO: 373031 - RNA, 17 nt, Human
cccucggggggcacuuu

SEQ ID NO: 373032 - RNA, 18 nt, Human
cccucggguccccuccca

SEQ ID NO: 373033 - RNA, 26 nt, Human
cccucggucucuugccucggcaccug

SEQ ID NO: 373034 - RNA, 32 nt, Human
cccucggugcagccuggcaccccauaaacucu

SEQ ID NO: 373035 - RNA, 32 nt, Human
cccucggugcuggccucuccugccugcuggga

SEQ ID NO: 373036 - RNA, 32 nt, Human
cccucgguggagaucuggccucaggaugcagg

SEQ ID NO: 373037 - RNA, 20 nt, Human
cccucguccccauccaccug

SEQ ID NO: 373038 - RNA, 20 nt, Human
cccucguccccccuccugcc

SEQ ID NO: 373039 - RNA, 32 nt, Human
cccucgucccucuccccaguguuuccaggacc

SEQ ID NO: 373040 - RNA, 20 nt, Human
cccucgucccugcccaggaa

SEQ ID NO: 373041 - RNA, 32 nt, Human
cccucgucccugcccaggucucuugucucuug

SEQ ID NO: 373042 - RNA, 20 nt, Human
cccucguccggcccccgggg

SEQ ID NO: 373043 - RNA, 17 nt, Human
cccucguccucugcgcc

SEQ ID NO: 373044 - RNA, 32 nt, Human
cccucgucguuccuccuccuuccauuugaccc

SEQ ID NO: 373045 - RNA, 32 nt, Human
cccucgucucacccccuuuacacucacauuuu

SEQ ID NO: 373046 - RNA, 32 nt, Human
cccucgucuccucauccccacguccucucguc

SEQ ID NO: 373047 - RNA, 16 nt, Human
cccucgucucgcugcc

SEQ ID NO: 373048 - RNA, 32 nt, Human
cccucgucucuggucccuaccucucugcugug

SEQ ID NO: 373049 - RNA, 32 nt, Human
cccucgucuuccuggccacccuuggccugucc

SEQ ID NO: 373050 - RNA, 32 nt, Human
cccucgugaggcuggcaugcaggauggcagga

SEQ ID NO: 373051 - RNA, 32 nt, Human
cccucgugccaucccucgaauccaccagcacg

SEQ ID NO: 373052 - RNA, 32 nt, Human
cccucgugcccaccccugugccugcagggcac

SEQ ID NO: 373053 - RNA, 32 nt, Human
cccucguggcuggagcaggggugcaccugcug

SEQ ID NO: 373054 - RNA, 32 nt, Human
cccucguggcuucucauuuuccauucccuuca

SEQ ID NO: 373055 - RNA, 32 nt, Human
cccucgugggaacugccaagaccaucgccaag

SEQ ID NO: 373056 - RNA, 32 nt, Human
cccucgugggguuaaggcgagcuguuccuggu

SEQ ID NO: 373057 - RNA, 32 nt, Human
cccucgugugcucugagcuaagccacauacua

SEQ ID NO: 373058 - RNA, 21 nt, Human
cccucguuccauggcccaguc

SEQ ID NO: 373059 - RNA, 32 nt, Human
cccucguugucagggccucuccucacugcugu

SEQ ID NO: 373060 - RNA, 20 nt, Human
cccucguuuucaaagauaaa

SEQ ID NO: 373061 - RNA, 32 nt, Human
cccucuaacucaugugauuucccaugcaugcu

SEQ ID NO: 373062 - RNA, 17 nt, Human
cccucuaagaaaguaaa

SEQ ID NO: 373063 - RNA, 32 nt, Human
cccucuaagccagcaagauuuccucuuugcaa

SEQ ID NO: 373064 - RNA, 32 nt, Human
cccucuaaggccgaagaaggguccuucccucu

SEQ ID NO: 373065 - RNA, 32 nt, Human
cccucuaaguugagcaggaaauccuccaccaa

SEQ ID NO: 373066 - RNA, 32 nt, Human
cccucuacacagacacuguccugggugcacac

SEQ ID NO: 373067 - RNA, 32 nt, Human
cccucuacacaggacaugcacacacaaguaac

SEQ ID NO: 373068 - RNA, 32 nt, Human
cccucuacagccugacuuucucuccagcgguc

SEQ ID NO: 373069 - RNA, 32 nt, Human
cccucuaccaccuugcacagugggcacugguc

SEQ ID NO: 373070 - RNA, 32 nt, Human
cccucuacccugccuugaggccuguuugcagu

SEQ ID NO: 373071 - RNA, 32 nt, Human
cccucuacccuugggccaccugcugcccaagu

SEQ ID NO: 373072 - RNA, 19 nt, Human
cccucuacuccacuuucaa

SEQ ID NO: 373073 - RNA, 18 nt, Human
cccucuacucucauccua

SEQ ID NO: 373074 - RNA, 32 nt, Human
cccucuagauugccucacaguuguuuguuuac

SEQ ID NO: 373075 - RNA, 32 nt, Human
cccucuagccucccucucccugaucccccacc

SEQ ID NO: 373076 - RNA, 32 nt, Human
cccucuagccucuaucacaguaggggaguuuu

SEQ ID NO: 373077 - RNA, 32 nt, Human
cccucuagccuucuccagucgccuccgccaug

SEQ ID NO: 373078 - RNA, 31 nt, Human
cccucuauaaagacuuccuguugaggugaau

SEQ ID NO: 373079 - RNA, 32 nt, Human
cccucuauauuuccucccuuuuuauagucuua

SEQ ID NO: 373080 - RNA, 32 nt, Human
cccucuaucaauugauuucuucuuaccuuuca

SEQ ID NO: 373081 - RNA, 32 nt, Human
cccucuauccccagggacucucuccccucuug

SEQ ID NO: 373082 - RNA, 32 nt, Human
cccucuauccucugcuguaucucccugcaagg

SEQ ID NO: 373083 - RNA, 32 nt, Human
cccucuaucugcagguccccagccuggguaaa

SEQ ID NO: 373084 - RNA, 32 nt, Human
cccucuauugcccaggcuggagugcaguggug

SEQ ID NO: 373085 - RNA, 32 nt, Human
cccucuauuuauuuuuaugucaggugaacugg

SEQ ID NO: 373086 - RNA, 32 nt, Human
cccucucacaccagcugcacucccguggcugc

SEQ ID NO: 373087 - RNA, 32 nt, Human
cccucucaccacccucuucugccuaugagcgg

SEQ ID NO: 373088 - RNA, 19 nt, Human
cccucucaccauccccuug

SEQ ID NO: 373089 - RNA, 32 nt, Human
cccucucacucacuuccgccucuuagagccuu

SEQ ID NO: 373090 - RNA, 32 nt, Human
cccucucacuccugcccuuucuagcucucucu

SEQ ID NO: 373091 - RNA, 32 nt, Human
cccucucagccaugcucuccccaggguggggc

SEQ ID NO: 373092 - RNA, 32 nt, Human
cccucucagcccaccacccacagcucccuucu

SEQ ID NO: 373093 - RNA, 32 nt, Human
cccucucagcccagaagugacacacaccaaac

SEQ ID NO: 373094 - RNA, 22 nt, Human
cccucucagcccccaccucagg

SEQ ID NO: 373095 - RNA, 32 nt, Human
cccucucaggcagagagguugccgagugauuc

SEQ ID NO: 373096 - RNA, 32 nt, Human
cccucucaggcugagggcaccccaggaacucc

SEQ ID NO: 373097 - RNA, 17 nt, Human
cccucucagggugccac

SEQ ID NO: 373098 - RNA, 32 nt, Human
cccucucaguccauuuuccggggcugcucggu

SEQ ID NO: 373099 - RNA, 32 nt, Human
cccucucaguguuuccccaacuucucccuuua

SEQ ID NO: 373100 - RNA, 32 nt, Human
cccucucauaacuucuccccaucccaggagga

SEQ ID NO: 373101 - RNA, 32 nt, Human
cccucucaucagaccuccgcacccucacccca

SEQ ID NO: 373102 - RNA, 18 nt, Human
cccucucauggggguuuu

SEQ ID NO: 373103 - RNA, 21 nt, Human
cccucucauuccuuccgugcc

SEQ ID NO: 373104 - RNA, 32 nt, Human
cccucucauuuuuaucugucuaccuccauucu

SEQ ID NO: 373105 - RNA, 19 nt, Human
cccucuccaaauccagcca

SEQ ID NO: 373106 - RNA, 32 nt, Human
cccucuccaaccacaggacccuucggcucacc

SEQ ID NO: 373107 - RNA, 32 nt, Human
cccucuccaaggcugagacacagggcauggcc

SEQ ID NO: 373108 - RNA, 20 nt, Human
cccucuccacaccccuucca

SEQ ID NO: 373109 - RNA, 17 nt, Human
cccucuccaccagccua

SEQ ID NO: 373110 - RNA, 32 nt, Human
cccucuccaccaggguggguggaauaaguuga

SEQ ID NO: 373111 - RNA, 32 nt, Human
cccucuccacccuucagugcugggaccccagg

SEQ ID NO: 373112 - RNA, 32 nt, Human
cccucuccacuccuacugccagucccaggcuc

SEQ ID NO: 373113 - RNA, 32 nt, Human
cccucuccacuggccuuugccugcuagugcac

SEQ ID NO: 373114 - RNA, 22 nt, Human
cccucuccagcccuggccccca

SEQ ID NO: 373115 - RNA, 32 nt, Human
cccucuccagcugcauucgccucggcuauguu

SEQ ID NO: 373116 - RNA, 32 nt, Human
cccucuccaguaggcauccacuguggaagugc

SEQ ID NO: 373117 - RNA, 32 nt, Human
cccucuccaugccucuugucugucucuagcug

SEQ ID NO: 373118 - RNA, 32 nt, Human
cccucucccagaggacgccaucucccuuacug

SEQ ID NO: 373119 - RNA, 32 nt, Human
cccucucccaguccucacaaaggggccuaguc

SEQ ID NO: 373120 - RNA, 32 nt, Human
cccucucccaucuucucauauccuggcucuuc

SEQ ID NO: 373121 - RNA, 32 nt, Human
cccucuccccacccuccuccuccgcccccucc

SEQ ID NO: 373122 - RNA, 32 nt, Human
cccucuccccucccuccugcaaacaccaccgc

SEQ ID NO: 373123 - RNA, 32 nt, Human
cccucuccccucuccaccaugggcugcaguau

SEQ ID NO: 373124 - RNA, 16 nt, Human
cccucuccccucuuca

SEQ ID NO: 373125 - RNA, 17 nt, Human
cccucuccccugcuguc

SEQ ID NO: 373126 - RNA, 32 nt, Human
cccucuccccuucaucuucugcuccaaaggug

SEQ ID NO: 373127 - RNA, 32 nt, Human
cccucuccccuuccuuucucucucuuccagaa

SEQ ID NO: 373128 - RNA, 23 nt, Human
cccucucccgggggugugcaggc

SEQ ID NO: 373129 - RNA, 32 nt, Human
cccucucccuugccuguaggucacgggaaugu

SEQ ID NO: 373130 - RNA, 18 nt, Human
cccucuccgccgggggcu

SEQ ID NO: 373131 - RNA, 32 nt, Human
cccucuccuaaaguaauuugauccucaggaau

SEQ ID NO: 373132 - RNA, 32 nt, Human
cccucuccucaccccucuauccauuccucccg

SEQ ID NO: 373133 - RNA, 32 nt, Human
cccucuccuccaggcccguggggcuggcccug

SEQ ID NO: 373134 - RNA, 32 nt, Human
cccucuccuccauagccuucugaggcuucacc

SEQ ID NO: 373135 - RNA, 32 nt, Human
cccucuccucccaccucccacccuccaguagg

SEQ ID NO: 373136 - RNA, 32 nt, Human
cccucuccuccccucuccuccccuccccuccc

SEQ ID NO: 373137 - RNA, 32 nt, Human
cccucuccuccccuucccucuguucucuccuc

SEQ ID NO: 373138 - RNA, 32 nt, Human
cccucuccuccuccuuccccagggucccaucu

SEQ ID NO: 373139 - RNA, 32 nt, Human
cccucuccuccuccuuccucuuggucucagca

SEQ ID NO: 373140 - RNA, 32 nt, Human
cccucuccucgagcacgucacacacacaugcc

SEQ ID NO: 373141 - RNA, 32 nt, Human
cccucuccucuccccgcgccccaaacuuugcc

SEQ ID NO: 373142 - RNA, 32 nt, Human
cccucuccucuccuccccuugcccucaaaaua

SEQ ID NO: 373143 - RNA, 16 nt, Human
cccucuccucugccca

SEQ ID NO: 373144 - RNA, 17 nt, Human
cccucuccucugcugcc

SEQ ID NO: 373145 - RNA, 32 nt, Human
cccucuccugaucuaacucccugcugcaucuc

SEQ ID NO: 373146 - RNA, 32 nt, Human
cccucuccugcagguggccgucugcccggccc

SEQ ID NO: 373147 - RNA, 15 nt, Human
cccucuccugcugcu

SEQ ID NO: 373148 - RNA, 32 nt, Human
cccucuccugcugcuggacuucugccuuuguu

SEQ ID NO: 373149 - RNA, 32 nt, Human
cccucuccugcugcuuccucucggugauauuu

SEQ ID NO: 373150 - RNA, 32 nt, Human
cccucuccuggagagaggcucacagcguagcu

SEQ ID NO: 373151 - RNA, 32 nt, Human
cccucuccuggcccaucccuucccuucuuccc

SEQ ID NO: 373152 - RNA, 32 nt, Human
cccucuccuggggcgggggaaggugugucucu

SEQ ID NO: 373153 - RNA, 32 nt, Human
cccucuccuguauuucucagguccaguucaaa

SEQ ID NO: 373154 - RNA, 20 nt, Human
cccucuccuguccugcccca

SEQ ID NO: 373155 - RNA, 15 nt, Human
cccucuccuguugcc

SEQ ID NO: 373156 - RNA, 32 nt, Human
cccucuccuucccaucuuucuauaccacccag

SEQ ID NO: 373157 - RNA, 32 nt, Human
cccucuccuugcuuucagcccuucccacagga

SEQ ID NO: 373158 - RNA, 32 nt, Human
cccucuccuuguauugcuuuccuucuagauuu

SEQ ID NO: 373159 - RNA, 32 nt, Human
cccucuccuuucucccucucagaaccuuccug

SEQ ID NO: 373160 - RNA, 32 nt, Human
cccucuccuuucucucccugccuuucuucccu

SEQ ID NO: 373161 - RNA, 32 nt, Human
cccucuccuuucucucuucucuuccuuccucu

SEQ ID NO: 373162 - RNA, 32 nt, Human
cccucuccuuucuuucaguucucccaugcagc

SEQ ID NO: 373163 - RNA, 32 nt, Human
cccucucgccaggcuggaguguaguggcacaa

SEQ ID NO: 373164 - RNA, 18 nt, Human
cccucucgggcccucgca

SEQ ID NO: 373165 - RNA, 32 nt, Human
cccucucggggaugccuccccaagaggguagu

SEQ ID NO: 373166 - RNA, 32 nt, Human
cccucucgggugggacucugcagcugcuucgc

SEQ ID NO: 373167 - RNA, 32 nt, Human
cccucucguuccccguccucguuuccagcauc

SEQ ID NO: 373168 - RNA, 32 nt, Human
cccucucguuuaggaagggaaggugggacagg

SEQ ID NO: 373169 - RNA, 32 nt, Human
cccucucuacuucugugccuuuguaaaacgug

SEQ ID NO: 373170 - RNA, 32 nt, Human
cccucucuagcaaaguuaugggcugcuuuacu

SEQ ID NO: 373171 - RNA, 32 nt, Human
cccucucucaccacuccuguucaucauagcau

SEQ ID NO: 373172 - RNA, 32 nt, Human
cccucucucagccucagugucccgagggcccc

SEQ ID NO: 373173 - RNA, 32 nt, Human
cccucucuccaccccugggcuaugcaggccag

SEQ ID NO: 373174 - RNA, 32 nt, Human
cccucucuccaccccuguccucuagccacagc

SEQ ID NO: 373175 - RNA, 32 nt, Human
cccucucuccacccuccccacacucugcgcuu

SEQ ID NO: 373176 - RNA, 32 nt, Human
cccucucuccaggacuugucagcuggugguuc

SEQ ID NO: 373177 - RNA, 32 nt, Human
cccucucuccccuaacccagcauccugcaguc

SEQ ID NO: 373178 - RNA, 16 nt, Human
cccucucucccuccuc

SEQ ID NO: 373179 - RNA, 16 nt, Human
cccucucuccuccuca

SEQ ID NO: 373180 - RNA, 32 nt, Human
cccucucuccuccucuuccucucucuggacgc

SEQ ID NO: 373181 - RNA, 32 nt, Human
cccucucuccucuuccuccccucucucuuccu

SEQ ID NO: 373182 - RNA, 32 nt, Human
cccucucucuuucucuccuccccuucucucuu

SEQ ID NO: 373183 - RNA, 32 nt, Human
cccucucugcaaaggccauuuugaagaucuca

SEQ ID NO: 373184 - RNA, 32 nt, Human
cccucucugccccacaguccucaggcuccagc

SEQ ID NO: 373185 - RNA, 32 nt, Human
cccucucugcuaaaaauacaaaauuagccgag

SEQ ID NO: 373186 - RNA, 32 nt, Human
cccucucugcucagucuaguucccagguccuu

SEQ ID NO: 373187 - RNA, 32 nt, Human
cccucucugcucccugugacuucugucccagc

SEQ ID NO: 373188 - RNA, 32 nt, Human
cccucucugcucgcccugccuagcuugaggau

SEQ ID NO: 373189 - RNA, 32 nt, Human
cccucucugcugcuguuuccauggcccagcau

SEQ ID NO: 373190 - RNA, 32 nt, Human
cccucucugcuuccuccuccagccucccuugg

SEQ ID NO: 373191 - RNA, 32 nt, Human
cccucucugcuuccuguugggcacccacugcc

SEQ ID NO: 373192 - RNA, 32 nt, Human
cccucucuggcauucaugcagagcaaagcacu

SEQ ID NO: 373193 - RNA, 32 nt, Human
cccucucuguaucuuaucaaauaugauggauu

SEQ ID NO: 373194 - RNA, 32 nt, Human
cccucucugucaccccugaccccagccauuca

SEQ ID NO: 373195 - RNA, 32 nt, Human
cccucucugucccgagaaggcuuagaguggua

SEQ ID NO: 373196 - RNA, 32 nt, Human
cccucucugugcaaagcugccacuggggccug

SEQ ID NO: 373197 - RNA, 32 nt, Human
cccucucuuagagacugugccuucagcaggac

SEQ ID NO: 373198 - RNA, 22 nt, Human
cccucucuuccagaacugugga

SEQ ID NO: 373199 - RNA, 32 nt, Human
cccucucuucccuuuccucucucccccucggu

SEQ ID NO: 373200 - RNA, 32 nt, Human
cccucucuuccucccuuccuccucuccccacu

SEQ ID NO: 373201 - RNA, 32 nt, Human
cccucucuugacuccagccuagggaaugguua

SEQ ID NO: 373202 - RNA, 32 nt, Human
cccucucuugcugcagaagaagagucuuccug

SEQ ID NO: 373203 - RNA, 32 nt, Human
cccucucuuuugggagcuucucugggcagaau

SEQ ID NO: 373204 - RNA, 32 nt, Human
cccucugaaaacaccugguccucuggcgaucc

SEQ ID NO: 373205 - RNA, 32 nt, Human
cccucugaaaacagccaacuaacagcgccucc

SEQ ID NO: 373206 - RNA, 32 nt, Human
cccucugaagaaaaaugaggcggggaagggga

SEQ ID NO: 373207 - RNA, 32 nt, Human
cccucugaagccacagccagagcuguauguug

SEQ ID NO: 373208 - RNA, 32 nt, Human
cccucugaagccugucacagaaacccgaucca

SEQ ID NO: 373209 - RNA, 32 nt, Human
cccucugaauuucugcaucugcaucuuaacaa

SEQ ID NO: 373210 - RNA, 32 nt, Human
cccucugacugcccucugccccuuuaagggaa

SEQ ID NO: 373211 - RNA, 22 nt, Human
cccucugagagaccacgggaac

SEQ ID NO: 373212 - RNA, 32 nt, Human
cccucugagcaccuggccgccugcuguccccg

SEQ ID NO: 373213 - RNA, 32 nt, Human
cccucugagcagcccccuccuccuucagggca

SEQ ID NO: 373214 - RNA, 32 nt, Human
cccucugagcccaccaguccugggcacagcug

SEQ ID NO: 373215 - RNA, 30 nt, Human
cccucugagccucuucugcuccugcacaac

SEQ ID NO: 373216 - RNA, 19 nt, Human
cccucugagcugccucuga

SEQ ID NO: 373217 - RNA, 32 nt, Human
cccucugaggcagaggcugggcaggacccaca

SEQ ID NO: 373218 - RNA, 32 nt, Human
cccucugaggcagauggggcaggcggcccagg

SEQ ID NO: 373219 - RNA, 32 nt, Human
cccucugaggggucugcaccuccugggagcag

SEQ ID NO: 373220 - RNA, 32 nt, Human
cccucugauccagcccagcggggcuucuccug

SEQ ID NO: 373221 - RNA, 32 nt, Human
cccucugcacacaaagcucucacauugucugc

SEQ ID NO: 373222 - RNA, 32 nt, Human
cccucugcacccccguuuccuccccuguaagg

SEQ ID NO: 373223 - RNA, 32 nt, Human
cccucugcacgcuagggugguccugcaccugu

SEQ ID NO: 373224 - RNA, 32 nt, Human
cccucugcagagccaucugcuccaggcaccca

SEQ ID NO: 373225 - RNA, 32 nt, Human
cccucugcagagcugggcucuaccccaaaagg

SEQ ID NO: 373226 - RNA, 32 nt, Human
cccucugcagcgcaugcugacaaggcaccuca

SEQ ID NO: 373227 - RNA, 32 nt, Human
cccucugcaggagcuucuccugccgccagcca

SEQ ID NO: 373228 - RNA, 32 nt, Human
cccucugcaggcaagaacuggggaagggaaag

SEQ ID NO: 373229 - RNA, 32 nt, Human
cccucugcauuggaugcaggaagcugggaaag

SEQ ID NO: 373230 - RNA, 32 nt, Human
cccucugccacaugcugguccgcagagcccuc

SEQ ID NO: 373231 - RNA, 32 nt, Human
cccucugccagccucuugggggcaguuccggc

SEQ ID NO: 373232 - RNA, 32 nt, Human
cccucugccaggcuggauuguacgggccccac

SEQ ID NO: 373233 - RNA, 32 nt, Human
cccucugccaugagccuggcagugcucaggau

SEQ ID NO: 373234 - RNA, 32 nt, Human
cccucugcccacuuccauuggucuccaggccc

SEQ ID NO: 373235 - RNA, 32 nt, Human
cccucugcccaggauguuaaagguugcuggaa

SEQ ID NO: 373236 - RNA, 32 nt, Human
cccucugccccagccagcgccuccaggcccag

SEQ ID NO: 373237 - RNA, 20 nt, Human
cccucugccccaguuuucuc

SEQ ID NO: 373238 - RNA, 22 nt, Human
cccucugcccccaugccuuucu

SEQ ID NO: 373239 - RNA, 26 nt, Human
cccucugcccccucagauggcuuuuu

SEQ ID NO: 373240 - RNA, 22 nt, Human
cccucugccccuccccacucuc

SEQ ID NO: 373241 - RNA, 21 nt, Human
cccucugccccucucuccucu

SEQ ID NO: 373242 - RNA, 32 nt, Human
cccucugccccuggcaccauuccagaacugcc

SEQ ID NO: 373243 - RNA, 32 nt, Human
cccucugccccuggcaccauuccggaacugcc

SEQ ID NO: 373244 - RNA, 32 nt, Human
cccucugccccuggcccucccggcagcccucg

SEQ ID NO: 373245 - RNA, 20 nt, Human
cccucugccccuuccucucu

SEQ ID NO: 373246 - RNA, 23 nt, Human
cccucugccccuuccuucucucu

SEQ ID NO: 373247 - RNA, 32 nt, Human
cccucugcccgaagcaauaacaacagcagcag

SEQ ID NO: 373248 - RNA, 32 nt, Human
cccucugcccuaggaagaucuuugccuuugac

SEQ ID NO: 373249 - RNA, 32 nt, Human
cccucugcccucacaaccucagccuggccuuc

SEQ ID NO: 373250 - RNA, 32 nt, Human
cccucugcccuucacacucuccuccaaaagag

SEQ ID NO: 373251 - RNA, 28 nt, Human
cccucugccgaugcugccuccuccaugc

SEQ ID NO: 373252 - RNA, 32 nt, Human
cccucugccuacccacgugccugcuuaccugc

SEQ ID NO: 373253 - RNA, 32 nt, Human
cccucugccuccaggcuuucccagcgagagug

SEQ ID NO: 373254 - RNA, 32 nt, Human
cccucugccucuuggguucaagcgauucuccu

SEQ ID NO: 373255 - RNA, 32 nt, Human
cccucugccugaccaacauggugaaaccccgu

SEQ ID NO: 373256 - RNA, 32 nt, Human
cccucugccugccugccugccugcuguccugg

SEQ ID NO: 373257 - RNA, 32 nt, Human
cccucugccugggacgccgucgugcccucucu

SEQ ID NO: 373258 - RNA, 32 nt, Human
cccucugccugggaugcccuucccccuuucuc

SEQ ID NO: 373259 - RNA, 20 nt, Human
cccucugccugucccucuca

SEQ ID NO: 373260 - RNA, 32 nt, Human
cccucugccuuccuccccaauccugacuggcu

SEQ ID NO: 373261 - RNA, 32 nt, Human
cccucugcguaggaauaaccauaauuaucuua

SEQ ID NO: 373262 - RNA, 21 nt, Human
cccucugcuaccagccccagu

SEQ ID NO: 373263 - RNA, 32 nt, Human
cccucugcuacugcugcugaucugaauaugga

SEQ ID NO: 373264 - RNA, 32 nt, Human
cccucugcucagccaagcuuguuaucagcuuu

SEQ ID NO: 373265 - RNA, 32 nt, Human
cccucugcucauuccuacccagguagugggac

SEQ ID NO: 373266 - RNA, 32 nt, Human
cccucugcuccaccccuccugugugucagagc

SEQ ID NO: 373267 - RNA, 32 nt, Human
cccucugcucccaagaucccagccaggaaggc

SEQ ID NO: 373268 - RNA, 23 nt, Human
cccucugcucccaaguacacucu

SEQ ID NO: 373269 - RNA, 24 nt, Human
cccucugcuccccuguggcucucu

SEQ ID NO: 373270 - RNA, 21 nt, Human
cccucugcucccuagagcucu

SEQ ID NO: 373271 - RNA, 32 nt, Human
cccucugcuccuccuucuccuguccuggccca

SEQ ID NO: 373272 - RNA, 32 nt, Human
cccucugcuccuggccuugggcaagggcacuc

SEQ ID NO: 373273 - RNA, 32 nt, Human
cccucugcuccuuggccugccugcccgccagc

SEQ ID NO: 373274 - RNA, 21 nt, Human
cccucugcucuuuguauuucu

SEQ ID NO: 373275 - RNA, 17 nt, Human
cccucugcugagauaaa

SEQ ID NO: 373276 - RNA, 32 nt, Human
cccucugcugcugccuuggcuuccuccuaaug

SEQ ID NO: 373277 - RNA, 32 nt, Human
cccucugcuuuaacucuccucccauauagaag

SEQ ID NO: 373278 - RNA, 26 nt, Human
cccucuggaacccuggcccaauuccu

SEQ ID NO: 373279 - RNA, 32 nt, Human
cccucuggacacacccuccuagcauccucuag

SEQ ID NO: 373280 - RNA, 32 nt, Human
cccucuggacaggacaugcugggcaggggaca

SEQ ID NO: 373281 - RNA, 32 nt, Human
cccucuggacuagaguagaaaugcaggggaaa

SEQ ID NO: 373282 - RNA, 32 nt, Human
cccucuggagcacggagcuccuuccccaaaga

SEQ ID NO: 373283 - RNA, 22 nt, Human
cccucuggaggaccacagcuca

SEQ ID NO: 373284 - RNA, 21 nt, Human
cccucuggcccccacugccca

SEQ ID NO: 373285 - RNA, 32 nt, Human
cccucugggaaccuggacuccuccaagcaucg

SEQ ID NO: 373286 - RNA, 32 nt, Human
cccucugggagggagagaagaguaagcuggag

SEQ ID NO: 373287 - RNA, 32 nt, Human
cccucugggcagggccaacgggaggcucuuug

SEQ ID NO: 373288 - RNA, 25 nt, Human
cccucugggcccgccucuggagcca

SEQ ID NO: 373289 - RNA, 32 nt, Human
cccucugggcuucaguuuccccacuggcacag

SEQ ID NO: 373290 - RNA, 32 nt, Human
cccucugguagccacagacaugcuguguuuac

SEQ ID NO: 373291 - RNA, 32 nt, Human
cccucuggucagacugcugccuggguuagaau

SEQ ID NO: 373292 - RNA, 32 nt, Human
cccucuggucccugucccucuggugguugggg

SEQ ID NO: 373293 - RNA, 23 nt, Human
cccucuggucuccauucucuuca

SEQ ID NO: 373294 - RNA, 32 nt, Human
cccucuggugagccaucuccagccacagccag

SEQ ID NO: 373295 - RNA, 32 nt, Human
cccucugguggccucugggccugcugcaugua

SEQ ID NO: 373296 - RNA, 32 nt, Human
cccucugguucacaccgcacccugcacucacc

SEQ ID NO: 373297 - RNA, 32 nt, Human
cccucuguaauacagauucugcagcccugccc

SEQ ID NO: 373298 - RNA, 32 nt, Human
cccucuguacagauaaucaaaauucaaaguug

SEQ ID NO: 373299 - RNA, 32 nt, Human
cccucuguaccauccccuccccuccgcaccac

SEQ ID NO: 373300 - RNA, 32 nt, Human
cccucuguauacuuccuccuccuucacgugca

SEQ ID NO: 373301 - RNA, 32 nt, Human
cccucugucaaccaggcuggagugcagugacu

SEQ ID NO: 373302 - RNA, 32 nt, Human
cccucugucaccaaggcuggagugcauuggug

SEQ ID NO: 373303 - RNA, 32 nt, Human
cccucugucaccaggcuggagugcaguggugc

SEQ ID NO: 373304 - RNA, 32 nt, Human
cccucugucacccaggcuggagugcaguggug

SEQ ID NO: 373305 - RNA, 32 nt, Human
cccucugucaccuaggcuggagugcaguggca

SEQ ID NO: 373306 - RNA, 31 nt, Human
cccucugucagcuagacaugccauaagcaag

SEQ ID NO: 373307 - RNA, 32 nt, Human
cccucugucauccaggcuggagugcaguggug

SEQ ID NO: 373308 - RNA, 32 nt, Human
cccucugucauccucaggaaccaacaauucgu

SEQ ID NO: 373309 - RNA, 32 nt, Human
cccucugucaugccucuuuaaagagaaaagaa

SEQ ID NO: 373310 - RNA, 32 nt, Human
cccucuguccaugucccugccucaguuuaccu

SEQ ID NO: 373311 - RNA, 19 nt, Human
cccucuguccccacaacca

SEQ ID NO: 373312 - RNA, 32 nt, Human
cccucugucccccaggcuggagugcaguggug

SEQ ID NO: 373313 - RNA, 32 nt, Human
cccucuguccuagcucaggucugggugccauu

SEQ ID NO: 373314 - RNA, 22 nt, Human
cccucuguccucaaauuuuucu

SEQ ID NO: 373315 - RNA, 19 nt, Human
cccucuguccuccucccuc

SEQ ID NO: 373316 - RNA, 32 nt, Human
cccucuguccuccucccuccccucugcccucu

SEQ ID NO: 373317 - RNA, 32 nt, Human
cccucuguccuccuuggcuuggcuuugcugcu

SEQ ID NO: 373318 - RNA, 32 nt, Human
cccucugucgccaaaguuggagugcaguggcg

SEQ ID NO: 373319 - RNA, 32 nt, Human
cccucugucgcccaggcuagagugcaauggcg

SEQ ID NO: 373320 - RNA, 32 nt, Human
cccucugucguccaggcuggagugcaguggca

SEQ ID NO: 373321 - RNA, 32 nt, Human
cccucugucguccugggauggcugucgggagc

SEQ ID NO: 373322 - RNA, 32 nt, Human
cccucugucugccuugugaagguggcaggggc

SEQ ID NO: 373323 - RNA, 32 nt, Human
cccucugucuguccuucugaggacgcaacaag

SEQ ID NO: 373324 - RNA, 23 nt, Human
cccucugucuucaggcucugccc

SEQ ID NO: 373325 - RNA, 32 nt, Human
cccucugucuucuguuaaguacaguugauacu

SEQ ID NO: 373326 - RNA, 32 nt, Human
cccucugugaagccaggccggccgggccgagc

SEQ ID NO: 373327 - RNA, 32 nt, Human
cccucugugaaggcucagcagaggugggaucc

SEQ ID NO: 373328 - RNA, 32 nt, Human
cccucugugagagaaggagcaggcagagagga

SEQ ID NO: 373329 - RNA, 32 nt, Human
cccucugugccaggccagagugcaguggugca

SEQ ID NO: 373330 - RNA, 32 nt, Human
cccucugugccgccgccgccuccugugggaga

SEQ ID NO: 373331 - RNA, 32 nt, Human
cccucugugccuccugcuuccuuucucucucc

SEQ ID NO: 373332 - RNA, 32 nt, Human
cccucuguguguccuuccucauggccugcagg

SEQ ID NO: 373333 - RNA, 20 nt, Human
cccucuguucccagccccag

SEQ ID NO: 373334 - RNA, 32 nt, Human
cccucuguucccgaaggggcggccgucuuucu

SEQ ID NO: 373335 - RNA, 32 nt, Human
cccucuguucuccccuccuaucuuuccaugac

SEQ ID NO: 373336 - RNA, 32 nt, Human
cccucuguucucuccuccucuuccccuccccu

SEQ ID NO: 373337 - RNA, 32 nt, Human
cccucuguucucucuucagcuccacccgccac

SEQ ID NO: 373338 - RNA, 32 nt, Human
cccucuguucuucccucccugcccugguuuuu

SEQ ID NO: 373339 - RNA, 32 nt, Human
cccucuguucuucucuuccuccuucagcacug

SEQ ID NO: 373340 - RNA, 32 nt, Human
cccucuguugccaggcuagagugcaguggcau

SEQ ID NO: 373341 - RNA, 32 nt, Human
cccucuguugcccaggcuggagugcagaggug

SEQ ID NO: 373342 - RNA, 32 nt, Human
cccucuguugcccaggcuggagugcaguggug

SEQ ID NO: 373343 - RNA, 32 nt, Human
cccucuguugggggauggggaggagagcaguc

SEQ ID NO: 373344 - RNA, 32 nt, Human
cccucuguuggggguuugggguccgggucucc

SEQ ID NO: 373345 - RNA, 21 nt, Human
cccucuguuguccccuccuca

SEQ ID NO: 373346 - RNA, 32 nt, Human
cccucuuaaugccuuugcuagugcaguguauu

SEQ ID NO: 373347 - RNA, 32 nt, Human
cccucuuagaaaaaccaccaccaucaccagac

SEQ ID NO: 373348 - RNA, 31 nt, Human
cccucuuagcacaggucuaggagggaaaaau

SEQ ID NO: 373349 - RNA, 32 nt, Human
cccucuucacucccccuaaaccccugucccau

SEQ ID NO: 373350 - RNA, 32 nt, Human
cccucuucauuucuggccuaucuuuuaacauc

SEQ ID NO: 373351 - RNA, 32 nt, Human
cccucuuccagaggaggagcagggaucugggu

SEQ ID NO: 373352 - RNA, 32 nt, Human
cccucuucccaauacuuuuugucauuuagaga

SEQ ID NO: 373353 - RNA, 32 nt, Human
cccucuucccaucccuucccccacccaaagca

SEQ ID NO: 373354 - RNA, 32 nt, Human
cccucuucccccgccccgcccugggccaggug

SEQ ID NO: 373355 - RNA, 32 nt, Human
cccucuuccccuaccccuguccuuccucaguu

SEQ ID NO: 373356 - RNA, 32 nt, Human
cccucuucccugcaaaccauguuugccaaagg

SEQ ID NO: 373357 - RNA, 32 nt, Human
cccucuucccugccagucucccccucuucugc

SEQ ID NO: 373358 - RNA, 32 nt, Human
cccucuuccucucugcugaggcagcugccucc

SEQ ID NO: 373359 - RNA, 32 nt, Human
cccucuuccucuucccaccuucauacagcuuc

SEQ ID NO: 373360 - RNA, 32 nt, Human
cccucuuccucuuuaccuuuccugguccugau

SEQ ID NO: 373361 - RNA, 32 nt, Human
cccucuuccucuuucuuuccguuuccaaagga

SEQ ID NO: 373362 - RNA, 32 nt, Human
cccucuuccuucuuccuucugugacuuaacuu

SEQ ID NO: 373363 - RNA, 32 nt, Human
cccucuuccuugggaccugccacucccugggu

SEQ ID NO: 373364 - RNA, 32 nt, Human
cccucuuccuuuggcggaccuuggaauccacc

SEQ ID NO: 373365 - RNA, 32 nt, Human
cccucuucucaaucuuccuucuccccuggaaa

SEQ ID NO: 373366 - RNA, 32 nt, Human
cccucuucuccccucccccuccucaccgucuu

SEQ ID NO: 373367 - RNA, 32 nt, Human
cccucuucuccucacugucuucuccccgcgcc

SEQ ID NO: 373368 - RNA, 32 nt, Human
cccucuucuccuccguuuucuucucuuccugc

SEQ ID NO: 373369 - RNA, 32 nt, Human
cccucuucucucgccgccuccuggccuccgca

SEQ ID NO: 373370 - RNA, 32 nt, Human
cccucuucugcaggaagucccugagcugagac

SEQ ID NO: 373371 - RNA, 32 nt, Human
cccucuucugccucugccgguuguggaacaaa

SEQ ID NO: 373372 - RNA, 32 nt, Human
cccucuucugcuguccuugaggacagacacca

SEQ ID NO: 373373 - RNA, 32 nt, Human
cccucuucugguccuggcucagggggcuggga

SEQ ID NO: 373374 - RNA, 32 nt, Human
cccucuucuguaccucuccugagugccaacug

SEQ ID NO: 373375 - RNA, 32 nt, Human
cccucuucuucccucaagcagaaaguuucucc

SEQ ID NO: 373376 - RNA, 32 nt, Human
cccucuucuucuccuccauccuuuauucagag

SEQ ID NO: 373377 - RNA, 32 nt, Human
cccucuucuucuuugccuucucuuguccucuu

SEQ ID NO: 373378 - RNA, 32 nt, Human
cccucuucuuucucuuucuuuucccuuugggc

SEQ ID NO: 373379 - RNA, 32 nt, Human
cccucuucuuuuucuuggaacuccucaacacg

SEQ ID NO: 373380 - RNA, 32 nt, Human
cccucuugcacaaaccagccuaaggcagacac

SEQ ID NO: 373381 - RNA, 32 nt, Human
cccucuugcccugccucuuucucuccaccccu

SEQ ID NO: 373382 - RNA, 26 nt, Human
cccucuugggugcacgaccuguacag

SEQ ID NO: 373383 - RNA, 32 nt, Human
cccucuuguauuuccccucugguuguuccuaa

SEQ ID NO: 373384 - RNA, 32 nt, Human
cccucuugucucugcugacuucagccugguca

SEQ ID NO: 373385 - RNA, 32 nt, Human
cccucuuguggcuccaguuauuuggaaacuau

SEQ ID NO: 373386 - RNA, 32 nt, Human
cccucuuguuuccaaugagcagcuuauagguu

SEQ ID NO: 373387 - RNA, 32 nt, Human
cccucuuuaaugcugucuuuguggacuguggg

SEQ ID NO: 373388 - RNA, 32 nt, Human
cccucuuucccugucgccugcagccacccgcc

SEQ ID NO: 373389 - RNA, 32 nt, Human
cccucuuucccuucugagauucuuuccuugug

SEQ ID NO: 373390 - RNA, 32 nt, Human
cccucuuucccuuucucuuuccuuucuuuccu

SEQ ID NO: 373391 - RNA, 32 nt, Human
cccucuuuccuuccuuccuccuggucuguucc

SEQ ID NO: 373392 - RNA, 32 nt, Human
cccucuuucucccaugcugcacuuacuccuuu

SEQ ID NO: 373393 - RNA, 32 nt, Human
cccucuuucuucuuuaggauucccaaguaacu

SEQ ID NO: 373394 - RNA, 18 nt, Human
cccucuuuggggcucuuu

SEQ ID NO: 373395 - RNA, 32 nt, Human
cccucuuuugugaagaaagcggguccagaugu

SEQ ID NO: 373396 - RNA, 32 nt, Human
cccugaaaaaccagaaaguaccuuuuacuguu

SEQ ID NO: 373397 - RNA, 32 nt, Human
cccugaaaacacaaaaggacaguucuguguug

SEQ ID NO: 373398 - RNA, 32 nt, Human
cccugaaaacaccuggccucaauguuggcuug

SEQ ID NO: 373399 - RNA, 19 nt, Human
cccugaaaacccagagagg

SEQ ID NO: 373400 - RNA, 23 nt, Human
cccugaaaaucccacuuccugcc

SEQ ID NO: 373401 - RNA, 32 nt, Human
cccugaaacagccacagccaagguaggcaugc

SEQ ID NO: 373402 - RNA, 18 nt, Human
cccugaaaccccacccuc

SEQ ID NO: 373403 - RNA, 32 nt, Human
cccugaaacuucucccaacagccccagggcca

SEQ ID NO: 373404 - RNA, 32 nt, Human
cccugaaagcaguucuuccugccucugagccu

SEQ ID NO: 373405 - RNA, 32 nt, Human
cccugaaagcccugagcuuucugcuaucaaag

SEQ ID NO: 373406 - RNA, 32 nt, Human
cccugaaagccuucaccugaugccucugcagc

SEQ ID NO: 373407 - RNA, 24 nt, Human
cccugaaagucgagguugcaguga

SEQ ID NO: 373408 - RNA, 32 nt, Human
cccugaaagugauucaugcuucuggcuggcau

SEQ ID NO: 373409 - RNA, 32 nt, Human
cccugaacaccaaauaccgagacagcugauga

SEQ ID NO: 373410 - RNA, 32 nt, Human
cccugaacaccuugggggccaccaacaaggga

SEQ ID NO: 373411 - RNA, 32 nt, Human
cccugaacagaggagguggcggugguggcccu

SEQ ID NO: 373412 - RNA, 32 nt, Human
cccugaacauuucaugguguucaucaacagug

SEQ ID NO: 373413 - RNA, 32 nt, Human
cccugaaccaguagcugggacuauccccaggg

SEQ ID NO: 373414 - RNA, 26 nt, Human
cccugaaccauuucaaucuucugccu

SEQ ID NO: 373415 - RNA, 32 nt, Human
cccugaacccacugcugcccugggcagugagu

SEQ ID NO: 373416 - RNA, 20 nt, Human
cccugaaccccuggcuucca

SEQ ID NO: 373417 - RNA, 32 nt, Human
cccugaacucaagugauccucccgccucagcc

SEQ ID NO: 373418 - RNA, 32 nt, Human
cccugaacuccgaucucucccaccccaccccu

SEQ ID NO: 373419 - RNA, 32 nt, Human
cccugaacucucgcuuucuuuuuaauccccug

SEQ ID NO: 373420 - RNA, 21 nt, Human
cccugaacugauaaagccuca

SEQ ID NO: 373421 - RNA, 23 nt, Human
cccugaacugauguaaaucuuca

SEQ ID NO: 373422 - RNA, 32 nt, Human
cccugaacugcuuuucugccucuguggaaaac

SEQ ID NO: 373423 - RNA, 24 nt, Human
cccugaagccaucgcuggccccca

SEQ ID NO: 373424 - RNA, 32 nt, Human
cccugaagcgucaggcugggggcagucuggua

SEQ ID NO: 373425 - RNA, 32 nt, Human
cccugaagcucaguuauagugcacugaugaac

SEQ ID NO: 373426 - RNA, 32 nt, Human
cccugaagcuggucuacaucucagucucugag

SEQ ID NO: 373427 - RNA, 32 nt, Human
cccugaaggagagaagggaagugaaaaguaga

SEQ ID NO: 373428 - RNA, 32 nt, Human
cccugaaggcagaggccagcugcugcaagaca

SEQ ID NO: 373429 - RNA, 32 nt, Human
cccugaaggcuaccuggcgccuugggggcugu

SEQ ID NO: 373430 - RNA, 32 nt, Human
cccugaauacacccucucuucaucagcccaag

SEQ ID NO: 373431 - RNA, 32 nt, Human
cccugaaucucugcauaugagcauuuuucugg

SEQ ID NO: 373432 - RNA, 32 nt, Human
cccugaaugauacaguuuuguuugaaagacug

SEQ ID NO: 373433 - RNA, 32 nt, Human
cccugaaugcagaagcagagccacugugaagu

SEQ ID NO: 373434 - RNA, 32 nt, Human
cccugaaugccuuuggaggccaguaagcacac

SEQ ID NO: 373435 - RNA, 31 nt, Human
cccugaauggcuggucuccagcgguuggcgu

SEQ ID NO: 373436 - RNA, 32 nt, Human
cccugacaacagugcuuguagcuuugaugugg

SEQ ID NO: 373437 - RNA, 32 nt, Human
cccugacaacccauccacacacggccaggccu

SEQ ID NO: 373438 - RNA, 31 nt, Human
cccugacaaguguccaugaugcugggcccug

SEQ ID NO: 373439 - RNA, 32 nt, Human
cccugacacaguuacauagucacugagagugg

SEQ ID NO: 373440 - RNA, 32 nt, Human
cccugacaccucugcacucccuugggcagaga

SEQ ID NO: 373441 - RNA, 32 nt, Human
cccugacacugcacgugggcguaguggggagc

SEQ ID NO: 373442 - RNA, 32 nt, Human
cccugacacugcacugagcacuuuaugagcuu

SEQ ID NO: 373443 - RNA, 32 nt, Human
cccugacagcacgcuccagcccucugggaacu

SEQ ID NO: 373444 - RNA, 32 nt, Human
cccugacagcucagcauguugucacacuucag

SEQ ID NO: 373445 - RNA, 32 nt, Human
cccugacaucccaaaaccaucuucccacaugu

SEQ ID NO: 373446 - RNA, 22 nt, Human
cccugacaucccuuccaggcaa

SEQ ID NO: 373447 - RNA, 21 nt, Human
cccugacauccuguaaucuaa

SEQ ID NO: 373448 - RNA, 32 nt, Human
cccugacauuucucuccaccuccagaggcuug

SEQ ID NO: 373449 - RNA, 32 nt, Human
cccugaccaacaugaaaccccgucucuacuaa

SEQ ID NO: 373450 - RNA, 18 nt, Human
cccugaccaccacugugc

SEQ ID NO: 373451 - RNA, 22 nt, Human
cccugaccaccgcugccggagc

SEQ ID NO: 373452 - RNA, 16 nt, Human
cccugaccagggacca

SEQ ID NO: 373453 - RNA, 32 nt, Human
cccugaccaguauucauuauuucagauaauuc

SEQ ID NO: 373454 - RNA, 32 nt, Human
cccugaccauccagaauaaucucccaucucaa

SEQ ID NO: 373455 - RNA, 32 nt, Human
cccugaccaugaccugagguugguggacuuuc

SEQ ID NO: 373456 - RNA, 22 nt, Human
cccugacccagagccuagggga

SEQ ID NO: 373457 - RNA, 32 nt, Human
cccugacccagaggaagccucuauuuauuuau

SEQ ID NO: 373458 - RNA, 32 nt, Human
cccugacccaggaggcuggaagugucccccuu

SEQ ID NO: 373459 - RNA, 32 nt, Human
cccugacccaguuucaaacagagccaucuuuu

SEQ ID NO: 373460 - RNA, 19 nt, Human
cccugaccccacggcugcc

SEQ ID NO: 373461 - RNA, 32 nt, Human
cccugacccccuugauccccaaagaagcugcg

SEQ ID NO: 373462 - RNA, 32 nt, Human
cccugacccugcaggcuagggguuagggugac

SEQ ID NO: 373463 - RNA, 32 nt, Human
cccugacccugccuucugccaugaacccaggc

SEQ ID NO: 373464 - RNA, 32 nt, Human
cccugacccugggcugcuuccugggggcucuc

SEQ ID NO: 373465 - RNA, 19 nt, Human
cccugacccugucccuccu

SEQ ID NO: 373466 - RNA, 32 nt, Human
cccugaccgcccuguggggcucagccaguccu

SEQ ID NO: 373467 - RNA, 32 nt, Human
cccugaccuaucuccugcagucagcccugugg

SEQ ID NO: 373468 - RNA, 32 nt, Human
cccugaccucaagugauccacccaccucggcc

SEQ ID NO: 373469 - RNA, 32 nt, Human
cccugaccucaagugauccacccaccucugcc

SEQ ID NO: 373470 - RNA, 32 nt, Human
cccugaccucacugccugccuccucuacccca

SEQ ID NO: 373471 - RNA, 32 nt, Human
cccugaccucagccuccuccccaaaccccgcu

SEQ ID NO: 373472 - RNA, 22 nt, Human
cccugaccucagcuuccugccu

SEQ ID NO: 373473 - RNA, 22 nt, Human
cccugaccucaucaccugugca

SEQ ID NO: 373474 - RNA, 32 nt, Human
cccugaccuccaccaccuccaccaccaccacc

SEQ ID NO: 373475 - RNA, 32 nt, Human
cccugaccuccauccuggacacugccuugaua

SEQ ID NO: 373476 - RNA, 32 nt, Human
cccugaccuccccucccaauucuuucucugcc

SEQ ID NO: 373477 - RNA, 32 nt, Human
cccugaccucuccuuuucacucaggcccuguc

SEQ ID NO: 373478 - RNA, 32 nt, Human
cccugaccucucucuccacauuacccuuacaa

SEQ ID NO: 373479 - RNA, 32 nt, Human
cccugaccuuguccuacuucacugccuuuguc

SEQ ID NO: 373480 - RNA, 32 nt, Human
cccugaccuuucuccuguccuuuucuuggcug

SEQ ID NO: 373481 - RNA, 32 nt, Human
cccugacgaauagaggccugcgcagagugccc

SEQ ID NO: 373482 - RNA, 32 nt, Human
cccugacgacaucagugauacccaaagcugag

SEQ ID NO: 373483 - RNA, 32 nt, Human
cccugacgaccuagagagaucccggcucccag

SEQ ID NO: 373484 - RNA, 32 nt, Human
cccugacgagggaagcugcagcuuucugauga

SEQ ID NO: 373485 - RNA, 18 nt, Human
cccugacgguuuuucuug

SEQ ID NO: 373486 - RNA, 21 nt, Human
cccugacgguuuuucuugccu

SEQ ID NO: 373487 - RNA, 32 nt, Human
cccugacgucgcuacgauuccacacgacagcc

SEQ ID NO: 373488 - RNA, 32 nt, Human
cccugacucaacucucacccuaacccugaugc

SEQ ID NO: 373489 - RNA, 32 nt, Human
cccugacucaauacaaauaaaaaccaaaucua

SEQ ID NO: 373490 - RNA, 32 nt, Human
cccugacucagagggaacccaggcuggaugcu

SEQ ID NO: 373491 - RNA, 32 nt, Human
cccugacuccagccacaaagcucauacccagc

SEQ ID NO: 373492 - RNA, 32 nt, Human
cccugacucccagggccccguaguuagcaauu

SEQ ID NO: 373493 - RNA, 32 nt, Human
cccugacucccucugcuguccuccccucucac

SEQ ID NO: 373494 - RNA, 32 nt, Human
cccugacucccucugcuguccuccccucucag

SEQ ID NO: 373495 - RNA, 20 nt, Human
cccugacuccgucccggcca

SEQ ID NO: 373496 - RNA, 26 nt, Human
cccugacuccgucccggccagggagg

SEQ ID NO: 373497 - RNA, 18 nt, Human
cccugacucggggacuug

SEQ ID NO: 373498 - RNA, 32 nt, Human
cccugacucugccugaggccagccugcccgaa

SEQ ID NO: 373499 - RNA, 32 nt, Human
cccugacucuggaaguggaauauugagugaua

SEQ ID NO: 373500 - RNA, 32 nt, Human
cccugacugaauguguucugucacucagcuuu

SEQ ID NO: 373501 - RNA, 32 nt, Human
cccugacugcaggaggcacagggacuccggga

SEQ ID NO: 373502 - RNA, 32 nt, Human
cccugacuggugcuucaguaaacccacgaaua

SEQ ID NO: 373503 - RNA, 31 nt, Human
cccugacuucagagcccuugccugagggccu

SEQ ID NO: 373504 - RNA, 32 nt, Human
cccugacuucauccucccuucucuguccacac

SEQ ID NO: 373505 - RNA, 18 nt, Human
cccugacuuugggaucug

SEQ ID NO: 373506 - RNA, 32 nt, Human
cccugacuuuuacuccccuuguagauaaacug

SEQ ID NO: 373507 - RNA, 23 nt, Human
cccugagaaagaugcccagaaca

SEQ ID NO: 373508 - RNA, 32 nt, Human
cccugagaaagccacuucuggugguugccagc

SEQ ID NO: 373509 - RNA, 32 nt, Human
cccugagaaugagauagauagcuaagaaauca

SEQ ID NO: 373510 - RNA, 17 nt, Human
cccugagaauucaguga

SEQ ID NO: 373511 - RNA, 32 nt, Human
cccugagaccacacuguugccucccagugacc

SEQ ID NO: 373512 - RNA, 32 nt, Human
cccugagaccuggccucaaagggcugacccag

SEQ ID NO: 373513 - RNA, 32 nt, Human
cccugagacgcugugugcccuuuuucagcuuc

SEQ ID NO: 373514 - RNA, 32 nt, Human
cccugagagcggacaucuccucccgcaggccu

SEQ ID NO: 373515 - RNA, 19 nt, Human
cccugagaggugcagcccu

SEQ ID NO: 373516 - RNA, 32 nt, Human
cccugagaucuuccccacccccaaucaugaug

SEQ ID NO: 373517 - RNA, 32 nt, Human
cccugagaucuuccccaucucaguuuuccuuc

SEQ ID NO: 373518 - RNA, 32 nt, Human
cccugagaugccaccaggaccugaugggccag

SEQ ID NO: 373519 - RNA, 32 nt, Human
cccugagaugggcgucagggagaggggacgcc

SEQ ID NO: 373520 - RNA, 31 nt, Human
cccugagcaaugucugugcuagggaaacucc

SEQ ID NO: 373521 - RNA, 32 nt, Human
cccugagcacagaggagcuuggcugccuggga

SEQ ID NO: 373522 - RNA, 32 nt, Human
cccugagcacuggccuuggaggugaccacaga

SEQ ID NO: 373523 - RNA, 21 nt, Human
cccugagcacuugaaggugca

SEQ ID NO: 373524 - RNA, 32 nt, Human
cccugagcagaauacuggucucaggccaagcc

SEQ ID NO: 373525 - RNA, 32 nt, Human
cccugagcagaggccguagcuugcgccgcacc

SEQ ID NO: 373526 - RNA, 19 nt, Human
cccugagcagcagugggug

SEQ ID NO: 373527 - RNA, 21 nt, Human
cccugagcagcagugggugua

SEQ ID NO: 373528 - RNA, 25 nt, Human
cccugagcagcugggacuacaggca

SEQ ID NO: 373529 - RNA, 32 nt, Human
cccugagcagguaacccagggaagagaaggaa

SEQ ID NO: 373530 - RNA, 32 nt, Human
cccugagcaugcagagagagcagcuuuuaaau

SEQ ID NO: 373531 - RNA, 32 nt, Human
cccugagcauggcaagggggucugucucugcc

SEQ ID NO: 373532 - RNA, 32 nt, Human
cccugagccauggaggcgccuuugcagacaga

SEQ ID NO: 373533 - RNA, 32 nt, Human
cccugagcccaggaguccaagggcaggguggg

SEQ ID NO: 373534 - RNA, 21 nt, Human
cccugagccccacuucugccu

SEQ ID NO: 373535 - RNA, 32 nt, Human
cccugagcccucagguccccagcuccuugagg

SEQ ID NO: 373536 - RNA, 32 nt, Human
cccugagccugagucauuucuaugugaaguca

SEQ ID NO: 373537 - RNA, 22 nt, Human
cccugagccugcccacuccuca

SEQ ID NO: 373538 - RNA, 32 nt, Human
cccugagccuggcuguugugugguauuuaugc

SEQ ID NO: 373539 - RNA, 32 nt, Human
cccugagccuguggcugcccucuccccagccu

SEQ ID NO: 373540 - RNA, 31 nt, Human
cccugagcgcaucuccuuacauucuugucuc

SEQ ID NO: 373541 - RNA, 32 nt, Human
cccugagcuacugcuucuaacaccucuuuucc

SEQ ID NO: 373542 - RNA, 32 nt, Human
cccugagcucccuagagucggccaccacagau

SEQ ID NO: 373543 - RNA, 32 nt, Human
cccugagcugacagauacacugcgcagcugga

SEQ ID NO: 373544 - RNA, 20 nt, Human
cccugagcugccuccugcuu

SEQ ID NO: 373545 - RNA, 32 nt, Human
cccugagcugccuccugcuucucccucaaagu

SEQ ID NO: 373546 - RNA, 32 nt, Human
cccugaggaaccaaucuaugccuuucuugcca

SEQ ID NO: 373547 - RNA, 32 nt, Human
cccugaggaaggaggggaagcugcagcuuggg

SEQ ID NO: 373548 - RNA, 32 nt, Human
cccugaggacccuaguccaacauggcggcgcc

SEQ ID NO: 373549 - RNA, 32 nt, Human
cccugaggacucagugugcauccuggaaggcu

SEQ ID NO: 373550 - RNA, 32 nt, Human
cccugaggagccggaccgauguggaaacugcu

SEQ ID NO: 373551 - RNA, 32 nt, Human
cccugaggaugaggacaagccccucggccagu

SEQ ID NO: 373552 - RNA, 32 nt, Human
cccugaggauucacggcaucaggcggacacug

SEQ ID NO: 373553 - RNA, 23 nt, Human
cccugaggcagagguugcaguga

SEQ ID NO: 373554 - RNA, 32 nt, Human
cccugaggccagaauugacucuuugggccuaa

SEQ ID NO: 373555 - RNA, 32 nt, Human
cccugaggccagaggucaguacccuuugguau

SEQ ID NO: 373556 - RNA, 21 nt, Human
cccugaggccccaggcagcug

SEQ ID NO: 373557 - RNA, 21 nt, Human
cccugaggcccucggcugcug

SEQ ID NO: 373558 - RNA, 32 nt, Human
cccugaggccuagggagcccaagccuggccug

SEQ ID NO: 373559 - RNA, 32 nt, Human
cccugaggccugacacggcagaucagccccau

SEQ ID NO: 373560 - RNA, 32 nt, Human
cccugaggccuguggcugaccucugccccagc

SEQ ID NO: 373561 - RNA, 32 nt, Human
cccugaggccuucugcaguguuugugucccug

SEQ ID NO: 373562 - RNA, 32 nt, Human
cccugaggcggaggaggagcugggacgaacaa

SEQ ID NO: 373563 - RNA, 22 nt, Human
cccugaggcucuauuucugucu

SEQ ID NO: 373564 - RNA, 32 nt, Human
cccugaggcugcagaguugggagcaggacacc

SEQ ID NO: 373565 - RNA, 32 nt, Human
cccugaggcugcugaggucguuaaauuguugu

SEQ ID NO: 373566 - RNA, 24 nt, Human
cccugaggcuuuucuucuccugcc

SEQ ID NO: 373567 - RNA, 32 nt, Human
cccugagggcccagagagguggccaguccugu

SEQ ID NO: 373568 - RNA, 32 nt, Human
cccugagggcccugcaugcuugugccuggggu

SEQ ID NO: 373569 - RNA, 32 nt, Human
cccugagggccugccgggcugccuuugcccca

SEQ ID NO: 373570 - RNA, 32 nt, Human
cccugagggcuggagaggcaggggagcagggu

SEQ ID NO: 373571 - RNA, 32 nt, Human
cccugaggguccugagacuuggaauauggaag

SEQ ID NO: 373572 - RNA, 32 nt, Human
cccugaggguugccugaaauuccuucaugcuu

SEQ ID NO: 373573 - RNA, 32 nt, Human
cccugagguauuugcaaccaccauggcugggu

SEQ ID NO: 373574 - RNA, 22 nt, Human
cccugaggucaccccguggucc

SEQ ID NO: 373575 - RNA, 32 nt, Human
cccugagguccugcauuucucagucggugugu

SEQ ID NO: 373576 - RNA, 32 nt, Human
cccugagguggcucagcaccugcccaggguag

SEQ ID NO: 373577 - RNA, 23 nt, Human
cccugagguuuccaugccucucc

SEQ ID NO: 373578 - RNA, 23 nt, Human
cccugaguagcugggauuacagg

SEQ ID NO: 373579 - RNA, 25 nt, Human
cccugaguagcugggauuacaggca

SEQ ID NO: 373580 - RNA, 32 nt, Human
cccugagucacagauuucugugggacugugga

SEQ ID NO: 373581 - RNA, 32 nt, Human
cccugagucuaagcaaaagcccauggguuggu

SEQ ID NO: 373582 - RNA, 25 nt, Human
cccugagucucagauguuucauuua

SEQ ID NO: 373583 - RNA, 32 nt, Human
cccugagucugccuagaugguugagccucaga

SEQ ID NO: 373584 - RNA, 32 nt, Human
cccugagugacggaaagaggucuggcggcuuc

SEQ ID NO: 373585 - RNA, 32 nt, Human
cccugagugccucccuugccucacucugaucc

SEQ ID NO: 373586 - RNA, 32 nt, Human
cccugagugcugggaggaggcugcaguacucc

SEQ ID NO: 373587 - RNA, 32 nt, Human
cccugaguguccagaucuggccaaggugucua

SEQ ID NO: 373588 - RNA, 32 nt, Human
cccugagugugaacagguuugccuacguuggu

SEQ ID NO: 373589 - RNA, 32 nt, Human
cccugaguucaagugauucaccucccuuggcc

SEQ ID NO: 373590 - RNA, 32 nt, Human
cccugauagcccagagguagggccagagacaa

SEQ ID NO: 373591 - RNA, 32 nt, Human
cccugauauagcagcacacauuuucacguuuc

SEQ ID NO: 373592 - RNA, 25 nt, Human
cccugaucagcacuaccacauccaa

SEQ ID NO: 373593 - RNA, 32 nt, Human
cccugauccaagcugcuugguguccuuguaag

SEQ ID NO: 373594 - RNA, 23 nt, Human
cccugaucccccaccccuugccu

SEQ ID NO: 373595 - RNA, 21 nt, Human
cccugaucccugggggacuca

SEQ ID NO: 373596 - RNA, 32 nt, Human
cccugaucuacauaucuaucucuuuuagaacu

SEQ ID NO: 373597 - RNA, 20 nt, Human
cccugaucucauggcugucu

SEQ ID NO: 373598 - RNA, 32 nt, Human
cccugaucucaugggacuuagguucuggugaa

SEQ ID NO: 373599 - RNA, 32 nt, Human
cccugaucuccaaguagccuaacugggaggca

SEQ ID NO: 373600 - RNA, 32 nt, Human
cccugaucucuagcuucucagccuccagaacu

SEQ ID NO: 373601 - RNA, 32 nt, Human
cccugaugacacccacccugugccaucaccau

SEQ ID NO: 373602 - RNA, 24 nt, Human
cccugaugacuugugggugcuccu

SEQ ID NO: 373603 - RNA, 32 nt, Human
cccugaugcauuuuccuugagagcagggguac

SEQ ID NO: 373604 - RNA, 18 nt, Human
cccugaugccagugguga

SEQ ID NO: 373605 - RNA, 32 nt, Human
cccugaugcccaggcugggugcaggcucucau

SEQ ID NO: 373606 - RNA, 32 nt, Human
cccugaugggagccaggccacagggaggaggc

SEQ ID NO: 373607 - RNA, 32 nt, Human
cccugaugggcccugacucuuccccauaauca

SEQ ID NO: 373608 - RNA, 32 nt, Human
cccugaugucagcugcuuugcacaaagguccu

SEQ ID NO: 373609 - RNA, 22 nt, Human
cccugauuccagcuuucugcuu

SEQ ID NO: 373610 - RNA, 32 nt, Human
cccugauucuaccaaaugcaaacacaucuggg

SEQ ID NO: 373611 - RNA, 31 nt, Human
cccugauucuucucugggcuggugccaguuu

SEQ ID NO: 373612 - RNA, 32 nt, Human
cccugcaaaucccucccacccugggccuugug

SEQ ID NO: 373613 - RNA, 32 nt, Human
cccugcaacacacgucgaagcugcugcagugg

SEQ ID NO: 373614 - RNA, 24 nt, Human
cccugcaacccacccucccagcca

SEQ ID NO: 373615 - RNA, 32 nt, Human
cccugcaacccccaucccccaccgggccuuug

SEQ ID NO: 373616 - RNA, 21 nt, Human
cccugcaagccagccuggcca

SEQ ID NO: 373617 - RNA, 22 nt, Human
cccugcaagcuacauccuacug

SEQ ID NO: 373618 - RNA, 32 nt, Human
cccugcaaggcugugggcuccgaccucaccgg

SEQ ID NO: 373619 - RNA, 32 nt, Human
cccugcaagggaggagccaggagcaagcauuc

SEQ ID NO: 373620 - RNA, 32 nt, Human
cccugcaaguugauucucauugccagauucca

SEQ ID NO: 373621 - RNA, 19 nt, Human
cccugcaaucuacucuuaa

SEQ ID NO: 373622 - RNA, 32 nt, Human
cccugcaauugggcagcuccccuggaagaagc

SEQ ID NO: 373623 - RNA, 32 nt, Human
cccugcacaaagccucagccuggugaaaacau

SEQ ID NO: 373624 - RNA, 32 nt, Human
cccugcacaacuaucucacuccugcuuggagc

SEQ ID NO: 373625 - RNA, 32 nt, Human
cccugcacaagacaacagaauccaucagggcc

SEQ ID NO: 373626 - RNA, 32 nt, Human
cccugcacaaucucccccuccagcuuccucgg

SEQ ID NO: 373627 - RNA, 32 nt, Human
cccugcacacagcucacuccucccucuggccc

SEQ ID NO: 373628 - RNA, 32 nt, Human
cccugcacauggcagcuuugucucuguugaga

SEQ ID NO: 373629 - RNA, 32 nt, Human
cccugcaccagcugagagagacuugccacaaa

SEQ ID NO: 373630 - RNA, 32 nt, Human
cccugcacccuauaugcugcugccucaggcag

SEQ ID NO: 373631 - RNA, 32 nt, Human
cccugcacccucuucccugccucugcuccuug

SEQ ID NO: 373632 - RNA, 23 nt, Human
cccugcacccuuccauuucucca

SEQ ID NO: 373633 - RNA, 32 nt, Human
cccugcacccuuguacagugucugugccaugg

SEQ ID NO: 373634 - RNA, 32 nt, Human
cccugcaccuccagccuccacccucgcauccc

SEQ ID NO: 373635 - RNA, 32 nt, Human
cccugcaccuccuauggcucaggaugagggag

SEQ ID NO: 373636 - RNA, 21 nt, Human
cccugcaccucuuugagccuu

SEQ ID NO: 373637 - RNA, 32 nt, Human
cccugcaccugccucaggcugagagcaggcgg

SEQ ID NO: 373638 - RNA, 18 nt, Human
cccugcaccugccugcca

SEQ ID NO: 373639 - RNA, 32 nt, Human
cccugcaccugccuugucccuggugcagaggu

SEQ ID NO: 373640 - RNA, 32 nt, Human
cccugcacucaggcuugugaaggccccgaguu

SEQ ID NO: 373641 - RNA, 32 nt, Human
cccugcacuccaggcugggcaacaguacgaga

SEQ ID NO: 373642 - RNA, 32 nt, Human
cccugcacuccccucuugcugcguguugauuu

SEQ ID NO: 373643 - RNA, 17 nt, Human
cccugcacucugccuca

SEQ ID NO: 373644 - RNA, 32 nt, Human
cccugcacuugagcucaggggcucaggguugu

SEQ ID NO: 373645 - RNA, 23 nt, Human
cccugcagacucacugcccaccg

SEQ ID NO: 373646 - RNA, 25 nt, Human
cccugcagaggcgcuccacucccag

SEQ ID NO: 373647 - RNA, 32 nt, Human
cccugcagaguggcuggauagagauauggagc

SEQ ID NO: 373648 - RNA, 32 nt, Human
cccugcagauccaggucuccaggccuugccca

SEQ ID NO: 373649 - RNA, 32 nt, Human
cccugcagcaugggugcugggcccuccuugcu

SEQ ID NO: 373650 - RNA, 22 nt, Human
cccugcagccacucucccgccu

SEQ ID NO: 373651 - RNA, 32 nt, Human
cccugcagccagagguuugcaguggguagugu

SEQ ID NO: 373652 - RNA, 22 nt, Human
cccugcagccccccacauccag

SEQ ID NO: 373653 - RNA, 22 nt, Human
cccugcagccccgccuucgccu

SEQ ID NO: 373654 - RNA, 32 nt, Human
cccugcagccucagcccugcagaagaggauuc

SEQ ID NO: 373655 - RNA, 32 nt, Human
cccugcagccucaguuuugaauucuuuuagca

SEQ ID NO: 373656 - RNA, 32 nt, Human
cccugcagccucccgugucccgucuccucccc

SEQ ID NO: 373657 - RNA, 32 nt, Human
cccugcagccuccugauggcuugaugguaucu

SEQ ID NO: 373658 - RNA, 32 nt, Human
cccugcagccugggucuggaugggaggagagc

SEQ ID NO: 373659 - RNA, 32 nt, Human
cccugcagccuuccgcaguguuugugucccug

SEQ ID NO: 373660 - RNA, 32 nt, Human
cccugcagccuuuguaggaagugccuagguga

SEQ ID NO: 373661 - RNA, 32 nt, Human
cccugcagcucacccauucauucacccaacuu

SEQ ID NO: 373662 - RNA, 32 nt, Human
cccugcagcucagcacccccagccuggugcuu

SEQ ID NO: 373663 - RNA, 32 nt, Human
cccugcagcucucuuuccucuggggcauuauc

SEQ ID NO: 373664 - RNA, 32 nt, Human
cccugcagcugccauccugccuggcaggcuag

SEQ ID NO: 373665 - RNA, 32 nt, Human
cccugcagcugugccaguugggccacagccuc

SEQ ID NO: 373666 - RNA, 32 nt, Human
cccugcaggaagcaucacccaggcuggcagau

SEQ ID NO: 373667 - RNA, 32 nt, Human
cccugcaggaauaggugggaagucauugaauu

SEQ ID NO: 373668 - RNA, 32 nt, Human
cccugcaggacaccuccuggcacaacaccacc

SEQ ID NO: 373669 - RNA, 32 nt, Human
cccugcaggagugaggcauggugacagcaguc

SEQ ID NO: 373670 - RNA, 32 nt, Human
cccugcaggcagcauuguggugacguagacca

SEQ ID NO: 373671 - RNA, 32 nt, Human
cccugcaggcagucagcaccagccucagcaac

SEQ ID NO: 373672 - RNA, 32 nt, Human
cccugcaggcgcugugugagcuggcccugccc

SEQ ID NO: 373673 - RNA, 32 nt, Human
cccugcaggcggaguuuucagaggaugcaauu

SEQ ID NO: 373674 - RNA, 32 nt, Human
cccugcaggcugaucagguggggaagcugagg

SEQ ID NO: 373675 - RNA, 32 nt, Human
cccugcagggagcagaguuuggccaggcggaa

SEQ ID NO: 373676 - RNA, 21 nt, Human
cccugcaggggaucuguggga

SEQ ID NO: 373677 - RNA, 25 nt, Human
cccugcaggucuuccuucuguggga

SEQ ID NO: 373678 - RNA, 32 nt, Human
cccugcaggugucugcuggcuuccugcucucc

SEQ ID NO: 373679 - RNA, 32 nt, Human
cccugcaguccucucaggcccggcuuucgggc

SEQ ID NO: 373680 - RNA, 32 nt, Human
cccugcaguccuuccuauagcagugcaccaug

SEQ ID NO: 373681 - RNA, 32 nt, Human
cccugcagugugaagggggacagguauaugag

SEQ ID NO: 373682 - RNA, 32 nt, Human
cccugcaguucccagucucuucuguccugcag

SEQ ID NO: 373683 - RNA, 18 nt, Human
cccugcaguucugccuca

SEQ ID NO: 373684 - RNA, 32 nt, Human
cccugcaguuuucaccaccagcaccaccagca

SEQ ID NO: 373685 - RNA, 32 nt, Human
cccugcauaagaaccacuaaucccaggcaagc

SEQ ID NO: 373686 - RNA, 32 nt, Human
cccugcaucccagucgcccugcagccucacac

SEQ ID NO: 373687 - RNA, 16 nt, Human
cccugcaucccuggcc

SEQ ID NO: 373688 - RNA, 27 nt, Human
cccugcauccuuuccgucucccugcuu

SEQ ID NO: 373689 - RNA, 32 nt, Human
cccugcaucuguggccagagcuggacagccac

SEQ ID NO: 373690 - RNA, 32 nt, Human
cccugcaucuuccucuccuuucccaaggcauc

SEQ ID NO: 373691 - RNA, 32 nt, Human
cccugcaugcccugaaccccuggguggguggc

SEQ ID NO: 373692 - RNA, 32 nt, Human
cccugcaugccuaguguggcaccuggcugugc

SEQ ID NO: 373693 - RNA, 32 nt, Human
cccugcaugcugcccagccacuccaggaggaa

SEQ ID NO: 373694 - RNA, 32 nt, Human
cccugcaugguggcucacgccuguaauccuag

SEQ ID NO: 373695 - RNA, 32 nt, Human
cccugcauguuggagacugagcugggugcacu

SEQ ID NO: 373696 - RNA, 32 nt, Human
cccugcauucugcucugcucuaauacacuacc

SEQ ID NO: 373697 - RNA, 22 nt, Human
cccugcauucuugccccuccuc

SEQ ID NO: 373698 - RNA, 32 nt, Human
cccugcauuucaaagcugcucuuucugguucu

SEQ ID NO: 373699 - RNA, 32 nt, Human
cccugccaaaaccucugcugugagcaauacaa

SEQ ID NO: 373700 - RNA, 32 nt, Human
cccugccaaagcugcagcaugcacagcacagg

SEQ ID NO: 373701 - RNA, 32 nt, Human
cccugccaacacugcggccugcagccuggacc

SEQ ID NO: 373702 - RNA, 32 nt, Human
cccugccaagucuguagacuucagagagcacu

SEQ ID NO: 373703 - RNA, 32 nt, Human
cccugccaaguuucugggcaccacagauugga

SEQ ID NO: 373704 - RNA, 32 nt, Human
cccugccacacccuggacaccugcacuagaga

SEQ ID NO: 373705 - RNA, 32 nt, Human
cccugccacagcccucccucggcacacuuuga

SEQ ID NO: 373706 - RNA, 32 nt, Human
cccugccacaggccuggcugagguggaaggag

SEQ ID NO: 373707 - RNA, 32 nt, Human
cccugccacaggcgcuggaguccucccauggc

SEQ ID NO: 373708 - RNA, 32 nt, Human
cccugccacauuucucucuucucccucacgcc

SEQ ID NO: 373709 - RNA, 32 nt, Human
cccugccaccauccuccuuccugggcuccagg

SEQ ID NO: 373710 - RNA, 32 nt, Human
cccugccacccacuguaaaaagguugaugaga

SEQ ID NO: 373711 - RNA, 22 nt, Human
cccugccaccccaccucuuccu

SEQ ID NO: 373712 - RNA, 21 nt, Human
cccugccaccccuaacucuca

SEQ ID NO: 373713 - RNA, 32 nt, Human
cccugccacccugcacugccccggcucccccg

SEQ ID NO: 373714 - RNA, 32 nt, Human
cccugccaccuccagccucugccagcaaugag

SEQ ID NO: 373715 - RNA, 18 nt, Human
cccugccaccucuccuca

SEQ ID NO: 373716 - RNA, 24 nt, Human
cccugccacgcaggccacccgggc

SEQ ID NO: 373717 - RNA, 19 nt, Human
cccugccacggccaacuca

SEQ ID NO: 373718 - RNA, 19 nt, Human
cccugccacucccuggccu

SEQ ID NO: 373719 - RNA, 32 nt, Human
cccugccacugccucuucuuuucccugcugcc

SEQ ID NO: 373720 - RNA, 32 nt, Human
cccugccacuggcugcagaaauggcucgacgg

SEQ ID NO: 373721 - RNA, 32 nt, Human
cccugccagaaacauauacacagauacacaac

SEQ ID NO: 373722 - RNA, 32 nt, Human
cccugccagaagcagcaagggccauggggugg

SEQ ID NO: 373723 - RNA, 32 nt, Human
cccugccagacccugcucacauucccucugcu

SEQ ID NO: 373724 - RNA, 32 nt, Human
cccugccagaugucccagccuugaucugucug

SEQ ID NO: 373725 - RNA, 32 nt, Human
cccugccagcagcugcuccuucagccaggcca

SEQ ID NO: 373726 - RNA, 23 nt, Human
cccugccagccaaucaccggggc

SEQ ID NO: 373727 - RNA, 23 nt, Human
cccugccagccccacaccagggc

SEQ ID NO: 373728 - RNA, 32 nt, Human
cccugccagcgggcgagcaggacaguccgcgc

SEQ ID NO: 373729 - RNA, 32 nt, Human
cccugccagcuccuagaaauaguuucaaucuu

SEQ ID NO: 373730 - RNA, 32 nt, Human
cccugccaggaucugcaguagggagggaaggc

SEQ ID NO: 373731 - RNA, 32 nt, Human
cccugccagugcaggugaauucuggaaggagg

SEQ ID NO: 373732 - RNA, 32 nt, Human
cccugccaucacugccccacauggacaaaacu

SEQ ID NO: 373733 - RNA, 32 nt, Human
cccugccaucaucugcuauuucugccacuucu

SEQ ID NO: 373734 - RNA, 23 nt, Human
cccugccaucuucccagcagggc

SEQ ID NO: 373735 - RNA, 22 nt, Human
cccugccaugcaggccaggugc

SEQ ID NO: 373736 - RNA, 32 nt, Human
cccugccaugccugagcccccugcacacaagg

SEQ ID NO: 373737 - RNA, 24 nt, Human
cccugccauggaaggaagaacggg

SEQ ID NO: 373738 - RNA, 32 nt, Human
cccugccauuggaacuuggauuacugugaaca

SEQ ID NO: 373739 - RNA, 32 nt, Human
cccugccauuuuucacaccucucuuaauuuua

SEQ ID NO: 373740 - RNA, 17 nt, Human
cccugcccaagguccuc

SEQ ID NO: 373741 - RNA, 32 nt, Human
cccugcccaagugccuaggggcaguagacagc

SEQ ID NO: 373742 - RNA, 32 nt, Human
cccugcccaaguggcucuugggacaacgugcu

SEQ ID NO: 373743 - RNA, 32 nt, Human
cccugcccaaucagagaugccaaaaaugggga

SEQ ID NO: 373744 - RNA, 25 nt, Human
cccugcccacagagcagccccccag

SEQ ID NO: 373745 - RNA, 32 nt, Human
cccugcccacagcauggggagaggccgucgug

SEQ ID NO: 373746 - RNA, 32 nt, Human
cccugcccacaucugcugguuuggggcuucag

SEQ ID NO: 373747 - RNA, 32 nt, Human
cccugcccacauguucccucucucacaguuuu

SEQ ID NO: 373748 - RNA, 32 nt, Human
cccugcccacccucccuccacuccucucaacu

SEQ ID NO: 373749 - RNA, 32 nt, Human
cccugcccaccgacgccagccugcuuggauga

SEQ ID NO: 373750 - RNA, 32 nt, Human
cccugcccaccugagcagcagcgucccaucca

SEQ ID NO: 373751 - RNA, 32 nt, Human
cccugcccagaaaggccagcagcuuggacuuc

SEQ ID NO: 373752 - RNA, 32 nt, Human
cccugcccagaauucccagcugucugugucag

SEQ ID NO: 373753 - RNA, 32 nt, Human
cccugcccagagcccuggcaccagagacgcca

SEQ ID NO: 373754 - RNA, 32 nt, Human
cccugcccagcaccacagcagagaucacacac

SEQ ID NO: 373755 - RNA, 32 nt, Human
cccugcccagcagaauuuguauagagauguga

SEQ ID NO: 373756 - RNA, 24 nt, Human
cccugcccagccagccuccugucu

SEQ ID NO: 373757 - RNA, 32 nt, Human
cccugcccagccagccuccugucuccagagaa

SEQ ID NO: 373758 - RNA, 32 nt, Human
cccugcccagccugggccugggccgcagccgu

SEQ ID NO: 373759 - RNA, 32 nt, Human
cccugcccagcuggaaaccacagggaggggaa

SEQ ID NO: 373760 - RNA, 32 nt, Human
cccugcccaggagucugguugcaaacccugau

SEQ ID NO: 373761 - RNA, 32 nt, Human
cccugcccaggccaccucccacagcccuccac

SEQ ID NO: 373762 - RNA, 20 nt, Human
cccugcccaggccacuguga

SEQ ID NO: 373763 - RNA, 32 nt, Human
cccugcccaucugcugagcuucucacaucucu

SEQ ID NO: 373764 - RNA, 32 nt, Human
cccugcccaugcaaaguguccuguacggugag

SEQ ID NO: 373765 - RNA, 32 nt, Human
cccugccccaccuuuccuuuccuuccuguggg

SEQ ID NO: 373766 - RNA, 32 nt, Human
cccugccccacuuuaccauagagaccagugcc

SEQ ID NO: 373767 - RNA, 32 nt, Human
cccugccccagccucaggacugcaggagccau

SEQ ID NO: 373768 - RNA, 32 nt, Human
cccugccccagccuguguagcucuuccugcau

SEQ ID NO: 373769 - RNA, 32 nt, Human
cccugccccaggagcgggccugagccacgucc

SEQ ID NO: 373770 - RNA, 23 nt, Human
cccugccccauccugaguucuuu

SEQ ID NO: 373771 - RNA, 32 nt, Human
cccugccccauuuccuccucaucuguccccca

SEQ ID NO: 373772 - RNA, 21 nt, Human
cccugcccccaccccaugccc

SEQ ID NO: 373773 - RNA, 24 nt, Human
cccugcccccaccccuuccugucu

SEQ ID NO: 373774 - RNA, 21 nt, Human
cccugcccccacuuccuguuu

SEQ ID NO: 373775 - RNA, 22 nt, Human
cccugccccccaccaccugccu

SEQ ID NO: 373776 - RNA, 32 nt, Human
cccugcccccgaggcuucugugggugcagacu

SEQ ID NO: 373777 - RNA, 23 nt, Human
cccugcccccuccacuuccugcc

SEQ ID NO: 373778 - RNA, 32 nt, Human
cccugcccccucgggcuuccuccuggcucugc

SEQ ID NO: 373779 - RNA, 32 nt, Human
cccugcccccuguccccugccucuuuucccaa

SEQ ID NO: 373780 - RNA, 32 nt, Human
cccugccccgcgcggcccugcccggcccaccg

SEQ ID NO: 373781 - RNA, 21 nt, Human
cccugccccuaacuccugccu

SEQ ID NO: 373782 - RNA, 32 nt, Human
cccugccccuaggagcuggagccggaggagcc

SEQ ID NO: 373783 - RNA, 32 nt, Human
cccugccccucaccuucuccuucuugauucca

SEQ ID NO: 373784 - RNA, 32 nt, Human
cccugccccucggaaaggcagcuaaggcccgg

SEQ ID NO: 373785 - RNA, 32 nt, Human
cccugccccucgggcaccagccugcauaugug

SEQ ID NO: 373786 - RNA, 32 nt, Human
cccugccccucucugucauagcuaacaggaau

SEQ ID NO: 373787 - RNA, 17 nt, Human
cccugccccucugccca

SEQ ID NO: 373788 - RNA, 32 nt, Human
cccugccccugcacucaggcuugugaaggccc

SEQ ID NO: 373789 - RNA, 32 nt, Human
cccugccccugcacucccaugggaaugccgca

SEQ ID NO: 373790 - RNA, 32 nt, Human
cccugccccugccccuaccagcccagcuuugg

SEQ ID NO: 373791 - RNA, 32 nt, Human
cccugccccugccccugcuacugccaaccucg

SEQ ID NO: 373792 - RNA, 32 nt, Human
cccugccccugccuccugcauccagcccccaa

SEQ ID NO: 373793 - RNA, 32 nt, Human
cccugccccuguuaaagaaucagagguugggc

SEQ ID NO: 373794 - RNA, 32 nt, Human
cccugcccuccacccuccccagagccacuucg

SEQ ID NO: 373795 - RNA, 32 nt, Human
cccugcccuccccuccccucccuuccccucca

SEQ ID NO: 373796 - RNA, 32 nt, Human
cccugcccuccccugucccccucucgccgccc

SEQ ID NO: 373797 - RNA, 32 nt, Human
cccugcccuccucccuucccugggugacugcu

SEQ ID NO: 373798 - RNA, 32 nt, Human
cccugcccuccucucccucccagauggacccu

SEQ ID NO: 373799 - RNA, 32 nt, Human
cccugcccuccugcccgcccucccuccugccu

SEQ ID NO: 373800 - RNA, 32 nt, Human
cccugcccuccuuucucagcagcuuuuuguua

SEQ ID NO: 373801 - RNA, 32 nt, Human
cccugcccucgaggagcuuucauucugaugga

SEQ ID NO: 373802 - RNA, 32 nt, Human
cccugcccucuccccucucucccucccccuaa

SEQ ID NO: 373803 - RNA, 32 nt, Human
cccugcccucugcacuaagcacuuuccaggca

SEQ ID NO: 373804 - RNA, 32 nt, Human
cccugcccucuguccuggcucugcaccuggua

SEQ ID NO: 373805 - RNA, 32 nt, Human
cccugcccucuuucccccucugggccucagug

SEQ ID NO: 373806 - RNA, 32 nt, Human
cccugcccugaaggaauguauuucuaaggcaa

SEQ ID NO: 373807 - RNA, 32 nt, Human
cccugcccugcaccagcacccugagauggagc

SEQ ID NO: 373808 - RNA, 19 nt, Human
cccugcccugcccuccuca

SEQ ID NO: 373809 - RNA, 32 nt, Human
cccugcccugcccugcacugcccggcccggca

SEQ ID NO: 373810 - RNA, 32 nt, Human
cccugcccugccuccagccuugguggcuccua

SEQ ID NO: 373811 - RNA, 32 nt, Human
cccugcccugcuccuuuguccacgggcuauug

SEQ ID NO: 373812 - RNA, 32 nt, Human
cccugcccugcucuccuugagggcccucaaca

SEQ ID NO: 373813 - RNA, 32 nt, Human
cccugcccugcucugcuuccugggggcuucag

SEQ ID NO: 373814 - RNA, 17 nt, Human
cccugcccugcugagca

SEQ ID NO: 373815 - RNA, 32 nt, Human
cccugcccugcugguggaauucugugagugcu

SEQ ID NO: 373816 - RNA, 19 nt, Human
cccugcccuggagcagcuu

SEQ ID NO: 373817 - RNA, 32 nt, Human
cccugcccuguucccguuccucccugcugcuc

SEQ ID NO: 373818 - RNA, 32 nt, Human
cccugcccuucaucugccggugagugggaagu

SEQ ID NO: 373819 - RNA, 32 nt, Human
cccugcccuugaggagcuucauuguagggaga

SEQ ID NO: 373820 - RNA, 32 nt, Human
cccugcccuugcugcccugccugucacguggc

SEQ ID NO: 373821 - RNA, 32 nt, Human
cccugcccuuucucagcugccuccccugcccu

SEQ ID NO: 373822 - RNA, 32 nt, Human
cccugccgcccaggcuagagugcaguggcacg

SEQ ID NO: 373823 - RNA, 32 nt, Human
cccugccgccugggcugucagcacuuuggcag

SEQ ID NO: 373824 - RNA, 32 nt, Human
cccugccgcggccccucgggccuguccacauc

SEQ ID NO: 373825 - RNA, 32 nt, Human
cccugccgcuccugccggcagcuccaaccaug

SEQ ID NO: 373826 - RNA, 32 nt, Human
cccugccggagccugagcccaagccuucuagc

SEQ ID NO: 373827 - RNA, 21 nt, Human
cccugccggaugccccgaggc

SEQ ID NO: 373828 - RNA, 32 nt, Human
cccugccgggcagggcuggagcuggacagaag

SEQ ID NO: 373829 - RNA, 32 nt, Human
cccugccgggugguggaggcgcugcacggugc

SEQ ID NO: 373830 - RNA, 32 nt, Human
cccugccgucaaucuccaccucaagggagcca

SEQ ID NO: 373831 - RNA, 32 nt, Human
cccugccguccugcgggagccugcuguccagu

SEQ ID NO: 373832 - RNA, 17 nt, Human
cccugccuaaagauaga

SEQ ID NO: 373833 - RNA, 32 nt, Human
cccugccuacuuccuuccuguuggauaucaua

SEQ ID NO: 373834 - RNA, 32 nt, Human
cccugccuauaacagccacuuccuggcgguca

SEQ ID NO: 373835 - RNA, 20 nt, Human
cccugccuauacucuggugg

SEQ ID NO: 373836 - RNA, 27 nt, Human
cccugccuauccgccccuuagugcuuu

SEQ ID NO: 373837 - RNA, 32 nt, Human
cccugccucacagauaccaauagagagguuuu

SEQ ID NO: 373838 - RNA, 32 nt, Human
cccugccucagccucaugaauagcugggauua

SEQ ID NO: 373839 - RNA, 20 nt, Human
cccugccucagcuucuccca

SEQ ID NO: 373840 - RNA, 32 nt, Human
cccugccucaucucuauucucauuccacuaug

SEQ ID NO: 373841 - RNA, 32 nt, Human
cccugccuccaccccuccagcccauccagcaa

SEQ ID NO: 373842 - RNA, 32 nt, Human
cccugccuccacccucugagcuuugcauguuc

SEQ ID NO: 373843 - RNA, 32 nt, Human
cccugccuccacuugccuugugauauucuauu

SEQ ID NO: 373844 - RNA, 32 nt, Human
cccugccuccagggcuccugggcugccaggga

SEQ ID NO: 373845 - RNA, 32 nt, Human
cccugccuccagggcuuccgccaccagcgucu

SEQ ID NO: 373846 - RNA, 32 nt, Human
cccugccucccaggaaccccggagggccaccc

SEQ ID NO: 373847 - RNA, 22 nt, Human
cccugccuccccacugccccua

SEQ ID NO: 373848 - RNA, 32 nt, Human
cccugccucccgggagacugggauuucuggcc

SEQ ID NO: 373849 - RNA, 17 nt, Human
cccugccucccuagggu

SEQ ID NO: 373850 - RNA, 32 nt, Human
cccugccuccuccuccuccucgucuuaggggg

SEQ ID NO: 373851 - RNA, 22 nt, Human
cccugccuccuccuuccugccu

SEQ ID NO: 373852 - RNA, 32 nt, Human
cccugccuccuugccaggcucuuccuccuguc

SEQ ID NO: 373853 - RNA, 32 nt, Human
cccugccuccuuggucacugccucuugcugca

SEQ ID NO: 373854 - RNA, 22 nt, Human
cccugccuccuuucuucugccu

SEQ ID NO: 373855 - RNA, 25 nt, Human
cccugccucgguuucccuucuguuu

SEQ ID NO: 373856 - RNA, 32 nt, Human
cccugccucuacuaggcgccuuagcucacuau

SEQ ID NO: 373857 - RNA, 32 nt, Human
cccugccucuaggaugcugcagcagagugagc

SEQ ID NO: 373858 - RNA, 32 nt, Human
cccugccucuccucacccucccucucuuccug

SEQ ID NO: 373859 - RNA, 19 nt, Human
cccugccucuccuccaccc

SEQ ID NO: 373860 - RNA, 25 nt, Human
cccugccucuccuccaccccugccu

SEQ ID NO: 373861 - RNA, 32 nt, Human
cccugccucuggggcucugugguguaggcuau

SEQ ID NO: 373862 - RNA, 32 nt, Human
cccugccucuuucauuuccagaccuuggagaa

SEQ ID NO: 373863 - RNA, 18 nt, Human
cccugccugauccugccc

SEQ ID NO: 373864 - RNA, 32 nt, Human
cccugccugcagcacgugcugaucuccaaggg

SEQ ID NO: 373865 - RNA, 32 nt, Human
cccugccugcagcuggcuuccaccuggcacgu

SEQ ID NO: 373866 - RNA, 32 nt, Human
cccugccugccaccccacaggguuacagcaag

SEQ ID NO: 373867 - RNA, 32 nt, Human
cccugccugcccacccuccacccacugccuuc

SEQ ID NO: 373868 - RNA, 32 nt, Human
cccugccugcccacccugccugaggacucuac

SEQ ID NO: 373869 - RNA, 17 nt, Human
cccugccugccccaggg

SEQ ID NO: 373870 - RNA, 17 nt, Human
cccugccugccucccca

SEQ ID NO: 373871 - RNA, 32 nt, Human
cccugccugccuccugcagguuccuuuccugg

SEQ ID NO: 373872 - RNA, 32 nt, Human
cccugccugccugauuccauggcuguugugcu

SEQ ID NO: 373873 - RNA, 32 nt, Human
cccugccugccugcccggcccugcacaacaug

SEQ ID NO: 373874 - RNA, 32 nt, Human
cccugccugccugcccugggcgaugagguacg

SEQ ID NO: 373875 - RNA, 32 nt, Human
cccugccugccugggccgccucuguggccuac

SEQ ID NO: 373876 - RNA, 32 nt, Human
cccugccugccuguggcucugcccagaugcuu

SEQ ID NO: 373877 - RNA, 23 nt, Human
cccugccugcucuuuaggccuuu

SEQ ID NO: 373878 - RNA, 32 nt, Human
cccugccuggaucucaccagcacuuucccucu

SEQ ID NO: 373879 - RNA, 32 nt, Human
cccugccuggaucucacgagcacuuucccucu

SEQ ID NO: 373880 - RNA, 32 nt, Human
cccugccugggcugaaggacugucuucacgaa

SEQ ID NO: 373881 - RNA, 32 nt, Human
cccugccuggggaccaagcugaaggggaauuc

SEQ ID NO: 373882 - RNA, 32 nt, Human
cccugccugugccugccugggaguuuuguauu

SEQ ID NO: 373883 - RNA, 32 nt, Human
cccugccugugguccugagcacugaucagcuu

SEQ ID NO: 373884 - RNA, 32 nt, Human
cccugccuguguucugugcccuguguccgcuc

SEQ ID NO: 373885 - RNA, 32 nt, Human
cccugccuguucugcaugccaguccuuccgug

SEQ ID NO: 373886 - RNA, 23 nt, Human
cccugccuuaaguccaguucuuu

SEQ ID NO: 373887 - RNA, 32 nt, Human
cccugccuuaguaaacagaguauacuggagag

SEQ ID NO: 373888 - RNA, 32 nt, Human
cccugccuucaagagccaguguucuagcgggu

SEQ ID NO: 373889 - RNA, 32 nt, Human
cccugccuucaagccgcuggucuacgugcugg

SEQ ID NO: 373890 - RNA, 32 nt, Human
cccugccuuccaggaagguuggggugggaguu

SEQ ID NO: 373891 - RNA, 22 nt, Human
cccugccuucgaccuccugccu

SEQ ID NO: 373892 - RNA, 32 nt, Human
cccugccuugauuuccccuugucugucaaugg

SEQ ID NO: 373893 - RNA, 21 nt, Human
cccugccuugccccuaccuca

SEQ ID NO: 373894 - RNA, 32 nt, Human
cccugccuugcuggaggagaugggauggggcg

SEQ ID NO: 373895 - RNA, 32 nt, Human
cccugccuuggugugagagugagggaagagga

SEQ ID NO: 373896 - RNA, 19 nt, Human
cccugccuugucccucuca

SEQ ID NO: 373897 - RNA, 23 nt, Human
cccugcgagaccccgggccagcc

SEQ ID NO: 373898 - RNA, 20 nt, Human
cccugcgagagccgcccgcc

SEQ ID NO: 373899 - RNA, 32 nt, Human
cccugcgccaccgcguccugcacuacagcaca

SEQ ID NO: 373900 - RNA, 24 nt, Human
cccugcgcccaaccgccugcgccg

SEQ ID NO: 373901 - RNA, 18 nt, Human
cccugcgcccgccccucu

SEQ ID NO: 373902 - RNA, 23 nt, Human
cccugcgcccgccgccgcugccg

SEQ ID NO: 373903 - RNA, 24 nt, Human
cccugcgcccguugcuacugaggc

SEQ ID NO: 373904 - RNA, 32 nt, Human
cccugcgccgcacccggggccugggugagacu

SEQ ID NO: 373905 - RNA, 32 nt, Human
cccugcgcgaguguccaaggcgggaggagaga

SEQ ID NO: 373906 - RNA, 32 nt, Human
cccugcgcucgcccuuggcccugcugccucug

SEQ ID NO: 373907 - RNA, 32 nt, Human
cccugcggaaccagagccucaggcugggaugg

SEQ ID NO: 373908 - RNA, 30 nt, Human
cccugcggaagccacagggugagcacucug

SEQ ID NO: 373909 - RNA, 32 nt, Human
cccugcggaagccacagggugagcacucuggg

SEQ ID NO: 373910 - RNA, 32 nt, Human
cccugcggagacccugaguccgggaggcaccg

SEQ ID NO: 373911 - RNA, 32 nt, Human
cccugcggcaaugccagcagcuccccaucagg

SEQ ID NO: 373912 - RNA, 21 nt, Human
cccugcggccagccagggagg

SEQ ID NO: 373913 - RNA, 24 nt, Human
cccugcggccccaccagguacuga

SEQ ID NO: 373914 - RNA, 23 nt, Human
cccugcggcucccaccucugccu

SEQ ID NO: 373915 - RNA, 32 nt, Human
cccugcgggaggugggugggguuggguggcug

SEQ ID NO: 373916 - RNA, 32 nt, Human
cccugcgggccuccgugcuccuucggggugcg

SEQ ID NO: 373917 - RNA, 32 nt, Human
cccugcgggcgcaggcccuccauuuugggucg

SEQ ID NO: 373918 - RNA, 32 nt, Human
cccugcggggcccagcccugccucagcuggua

SEQ ID NO: 373919 - RNA, 21 nt, Human
cccugcgggucaccgcccgcc

SEQ ID NO: 373920 - RNA, 32 nt, Human
cccugcgggucgcacgcccuccccagcuucug

SEQ ID NO: 373921 - RNA, 32 nt, Human
cccugcgguacccccaggccaaagcaaguaag

SEQ ID NO: 373922 - RNA, 32 nt, Human
cccugcgguagaugggagggaggcucaggucc

SEQ ID NO: 373923 - RNA, 32 nt, Human
cccugcggucaggcugggcagccccagagaga

SEQ ID NO: 373924 - RNA, 32 nt, Human
cccugcgugguggugccaaugugcccuggcac

SEQ ID NO: 373925 - RNA, 32 nt, Human
cccugcuaccacagcuuucacccaugggcaug

SEQ ID NO: 373926 - RNA, 21 nt, Human
cccugcuacugccccaacagg

SEQ ID NO: 373927 - RNA, 21 nt, Human
cccugcuacugucccuucuca

SEQ ID NO: 373928 - RNA, 32 nt, Human
cccugcuagcaaccaugugccucccauccuga

SEQ ID NO: 373929 - RNA, 23 nt, Human
cccugcuaucucccuuccugcuu

SEQ ID NO: 373930 - RNA, 32 nt, Human
cccugcuaugacuccucucugcagagacgcga

SEQ ID NO: 373931 - RNA, 32 nt, Human
cccugcucaagaagggggccaggcagcuggaa

SEQ ID NO: 373932 - RNA, 32 nt, Human
cccugcucaaugcccgccucuggcggagaccu

SEQ ID NO: 373933 - RNA, 31 nt, Human
cccugcucacccucugggcuuugucuccgag

SEQ ID NO: 373934 - RNA, 19 nt, Human
cccugcucacucccggggc

SEQ ID NO: 373935 - RNA, 32 nt, Human
cccugcucacugcagccuccgcuucccugguu

SEQ ID NO: 373936 - RNA, 32 nt, Human
cccugcucacuugagcaugucgcccaccaagc

SEQ ID NO: 373937 - RNA, 32 nt, Human
cccugcucagcauuuacauuuuugccaccagc

SEQ ID NO: 373938 - RNA, 24 nt, Human
cccugcucagcccauccccugccu

SEQ ID NO: 373939 - RNA, 20 nt, Human
cccugcucauccuguucuuu

SEQ ID NO: 373940 - RNA, 32 nt, Human
cccugcucauuucuuuacugccuuccugccug

SEQ ID NO: 373941 - RNA, 32 nt, Human
cccugcuccacccccucuccccauuccuccgc

SEQ ID NO: 373942 - RNA, 32 nt, Human
cccugcuccagaacccagcccagaucggagga

SEQ ID NO: 373943 - RNA, 32 nt, Human
cccugcuccaggcacccauuggcuccauccuc

SEQ ID NO: 373944 - RNA, 20 nt, Human
cccugcuccaucggcacugg

SEQ ID NO: 373945 - RNA, 32 nt, Human
cccugcuccaucucccucgccaggccugagac

SEQ ID NO: 373946 - RNA, 32 nt, Human
cccugcucccauuccucccuccggccauacug

SEQ ID NO: 373947 - RNA, 20 nt, Human
cccugcucccccaguuuuuu

SEQ ID NO: 373948 - RNA, 22 nt, Human
cccugcucccugccuccugccu

SEQ ID NO: 373949 - RNA, 32 nt, Human
cccugcuccgaggccuuccuggguugcugucc

SEQ ID NO: 373950 - RNA, 24 nt, Human
cccugcuccgccagccuccugcuu

SEQ ID NO: 373951 - RNA, 32 nt, Human
cccugcuccuacccccugacuggcucuugcgu

SEQ ID NO: 373952 - RNA, 32 nt, Human
cccugcuccugccucuccuccucauagucauc

SEQ ID NO: 373953 - RNA, 32 nt, Human
cccugcuccuuucugcggcauguggguggaca

SEQ ID NO: 373954 - RNA, 32 nt, Human
cccugcucgccuuggucauguacagcacugaa

SEQ ID NO: 373955 - RNA, 18 nt, Human
cccugcucuccccgggcu

SEQ ID NO: 373956 - RNA, 32 nt, Human
cccugcucucgaccuccgccccugcggugggg

SEQ ID NO: 373957 - RNA, 32 nt, Human
cccugcucucuaguucuaauucccaggagcca

SEQ ID NO: 373958 - RNA, 32 nt, Human
cccugcucucuauuccagagguggugagggga

SEQ ID NO: 373959 - RNA, 32 nt, Human
cccugcucucugcuugcuguuguuuugacgcu

SEQ ID NO: 373960 - RNA, 32 nt, Human
cccugcucugcggcuccucccaccccaccucu

SEQ ID NO: 373961 - RNA, 32 nt, Human
cccugcucugcucagcugaagcagaaaacaga

SEQ ID NO: 373962 - RNA, 32 nt, Human
cccugcucuggcccagccgcuggcgcccgcac

SEQ ID NO: 373963 - RNA, 32 nt, Human
cccugcucuggcucuugagucucagaauccga

SEQ ID NO: 373964 - RNA, 32 nt, Human
cccugcucuguucugcccggaggagccgccca

SEQ ID NO: 373965 - RNA, 32 nt, Human
cccugcucuuccucaagcuccagaaccucuca

SEQ ID NO: 373966 - RNA, 32 nt, Human
cccugcucuuccuccugacccugcugcucuug

SEQ ID NO: 373967 - RNA, 32 nt, Human
cccugcucuuccugccuuuccugcccaugugu

SEQ ID NO: 373968 - RNA, 32 nt, Human
cccugcucuucucuccccagcccccucccacc

SEQ ID NO: 373969 - RNA, 32 nt, Human
cccugcucuugccucuuagcucccucuccagg

SEQ ID NO: 373970 - RNA, 32 nt, Human
cccugcucuuucuccuucauuccgcagccucc

SEQ ID NO: 373971 - RNA, 32 nt, Human
cccugcucuuucuuccccuccucccuccuauc

SEQ ID NO: 373972 - RNA, 22 nt, Human
cccugcucuuuggcuguucuuu

SEQ ID NO: 373973 - RNA, 32 nt, Human
cccugcugaaaauagcugggccagugucucug

SEQ ID NO: 373974 - RNA, 22 nt, Human
cccugcugaauccuaaagcugu

SEQ ID NO: 373975 - RNA, 32 nt, Human
cccugcugagauuacagguguaagccaccaua

SEQ ID NO: 373976 - RNA, 32 nt, Human
cccugcugagccacccggguugggccaggauc

SEQ ID NO: 373977 - RNA, 24 nt, Human
cccugcugaggcauacagagcuuc

SEQ ID NO: 373978 - RNA, 32 nt, Human
cccugcugaugccacagagaauaagcugaacu

SEQ ID NO: 373979 - RNA, 32 nt, Human
cccugcugcaagaccaccagaguggugccccc

SEQ ID NO: 373980 - RNA, 32 nt, Human
cccugcugcaccuugaggagcuguguccuguc

SEQ ID NO: 373981 - RNA, 32 nt, Human
cccugcugcacucagugguuggcggaaacagc

SEQ ID NO: 373982 - RNA, 32 nt, Human
cccugcugcacuccagccugggcaacagaggg

SEQ ID NO: 373983 - RNA, 32 nt, Human
cccugcugcacuccagccugggugacagaggg

SEQ ID NO: 373984 - RNA, 32 nt, Human
cccugcugcagauucgucaggccaggugaaag

SEQ ID NO: 373985 - RNA, 32 nt, Human
cccugcugcaggcggaggugcuggaucuggac

SEQ ID NO: 373986 - RNA, 32 nt, Human
cccugcugcaucuucagcaucucccauguuca

SEQ ID NO: 373987 - RNA, 32 nt, Human
cccugcugccaggcuuacaucuucccagagaa

SEQ ID NO: 373988 - RNA, 22 nt, Human
cccugcugccccucacuucagg

SEQ ID NO: 373989 - RNA, 32 nt, Human
cccugcugccccugcugccccugcugccccug

SEQ ID NO: 373990 - RNA, 19 nt, Human
cccugcugccucccagagc

SEQ ID NO: 373991 - RNA, 32 nt, Human
cccugcugccuucucuaugcagccugcccucc

SEQ ID NO: 373992 - RNA, 32 nt, Human
cccugcugcuaccucgcgcuaggccagcucca

SEQ ID NO: 373993 - RNA, 32 nt, Human
cccugcugcuccaggacauauaagagacgaag

SEQ ID NO: 373994 - RNA, 32 nt, Human
cccugcugcucuugccuucuaagcuacugugc

SEQ ID NO: 373995 - RNA, 32 nt, Human
cccugcugcugcaggcugcagaagacuccgac

SEQ ID NO: 373996 - RNA, 32 nt, Human
cccugcugcugccaccugcccugcugccaggc

SEQ ID NO: 373997 - RNA, 32 nt, Human
cccugcugcugccucccguccucugcaugggg

SEQ ID NO: 373998 - RNA, 32 nt, Human
cccugcugcugcucccuuccuucuucuguccu

SEQ ID NO: 373999 - RNA, 20 nt, Human
cccugcugcugcuccucccu

SEQ ID NO: 374000 - RNA, 32 nt, Human
cccugcugcuggcugccaggcaggcccucugg

SEQ ID NO: 374001 - RNA, 18 nt, Human
cccugcugcugucaccuc

SEQ ID NO: 374002 - RNA, 32 nt, Human
cccugcuggacugucaccuguuucccaguuaa

SEQ ID NO: 374003 - RNA, 32 nt, Human
cccugcuggcacauucaggcugugcugggaag

SEQ ID NO: 374004 - RNA, 32 nt, Human
cccugcuggccuccgcuuuccucucucccccu

SEQ ID NO: 374005 - RNA, 32 nt, Human
cccugcuggcggauagcaagacucuguggagu

SEQ ID NO: 374006 - RNA, 29 nt, Human
cccugcuggcugccggcaccgcccuccug

SEQ ID NO: 374007 - RNA, 32 nt, Human
cccugcugggagagggaacuggaaugccacac

SEQ ID NO: 374008 - RNA, 32 nt, Human
cccugcugggcugcugaaucugggggacauag

SEQ ID NO: 374009 - RNA, 32 nt, Human
cccugcugggcugggagucgggguggcggcca

SEQ ID NO: 374010 - RNA, 32 nt, Human
cccugcuguccucagaggaggaggaggaggag

SEQ ID NO: 374011 - RNA, 31 nt, Human
cccugcugucucucugggcugcagagucugc

SEQ ID NO: 374012 - RNA, 32 nt, Human
cccugcugucugucugugggagucggacauug

SEQ ID NO: 374013 - RNA, 32 nt, Human
cccugcugugaggaagcucaugcacugcugaa

SEQ ID NO: 374014 - RNA, 32 nt, Human
cccugcuguggcugggccuugugggcagccac

SEQ ID NO: 374015 - RNA, 32 nt, Human
cccugcuguucugggucucaggcugcuggacc

SEQ ID NO: 374016 - RNA, 25 nt, Human
cccugcuguuugccccucagucuuu

SEQ ID NO: 374017 - RNA, 32 nt, Human
cccugcuuaaacaaacuauugaugaguucuuu

SEQ ID NO: 374018 - RNA, 32 nt, Human
cccugcuuaccucccucgcccgugcaaugccu

SEQ ID NO: 374019 - RNA, 22 nt, Human
cccugcuuaccugcaggccuuu

SEQ ID NO: 374020 - RNA, 32 nt, Human
cccugcuucaccgucguccccugggcaccggu

SEQ ID NO: 374021 - RNA, 32 nt, Human
cccugcuucagucccuuccccaugcuuccuug

SEQ ID NO: 374022 - RNA, 32 nt, Human
cccugcuuccagaaagccugggaagaacugcc

SEQ ID NO: 374023 - RNA, 21 nt, Human
cccugcuuccccaagcucucc

SEQ ID NO: 374024 - RNA, 32 nt, Human
cccugcuuccccaagcucuccugggucuugga

SEQ ID NO: 374025 - RNA, 22 nt, Human
cccugcuucccugccuccuccu

SEQ ID NO: 374026 - RNA, 23 nt, Human
cccugcuucuaaucugguucuuu

SEQ ID NO: 374027 - RNA, 32 nt, Human
cccugcuucuccccaguccuccagcccaggag

SEQ ID NO: 374028 - RNA, 32 nt, Human
cccugcuucucccccuccuaccugagaggcug

SEQ ID NO: 374029 - RNA, 32 nt, Human
cccugcuucucccgccauuggccuuaacuggc

SEQ ID NO: 374030 - RNA, 32 nt, Human
cccugcuucucccuuuccuucuguuccgguuu

SEQ ID NO: 374031 - RNA, 21 nt, Human
cccugcuucugccccuccuca

SEQ ID NO: 374032 - RNA, 16 nt, Human
cccugcuucugcugcc

SEQ ID NO: 374033 - RNA, 32 nt, Human
cccugcuucuggaaaccucugccugcugcccu

SEQ ID NO: 374034 - RNA, 32 nt, Human
cccugcuugccaggcccugcagaggggcugcc

SEQ ID NO: 374035 - RNA, 32 nt, Human
cccugcuugcccaggccgcccugcugcugcag

SEQ ID NO: 374036 - RNA, 21 nt, Human
cccugcuugccucugcucucc

SEQ ID NO: 374037 - RNA, 32 nt, Human
cccugcuugccuggccccagaagcuguuuugc

SEQ ID NO: 374038 - RNA, 21 nt, Human
cccugcuuggcagccagggua

SEQ ID NO: 374039 - RNA, 32 nt, Human
cccugcuuggccagaccuuggcugugccuccu

SEQ ID NO: 374040 - RNA, 32 nt, Human
cccugcuuggccagcacugccugcagccucac

SEQ ID NO: 374041 - RNA, 32 nt, Human
cccugcuuucguacaaggaagggggacgaugg

SEQ ID NO: 374042 - RNA, 32 nt, Human
cccugcuuuugacuuuuggcagccucuucagg

SEQ ID NO: 374043 - RNA, 32 nt, Human
cccuggaaaaacaagccaaggaggauuucuuu

SEQ ID NO: 374044 - RNA, 32 nt, Human
cccuggaaaaggaggaggcguggugggacugc

SEQ ID NO: 374045 - RNA, 20 nt, Human
cccuggaaagcacgccggcc

SEQ ID NO: 374046 - RNA, 15 nt, Human
cccuggaaaggguug

SEQ ID NO: 374047 - RNA, 32 nt, Human
cccuggaacagaguuacagauacacaaucaag

SEQ ID NO: 374048 - RNA, 16 nt, Human
cccuggaacgcuggcc

SEQ ID NO: 374049 - RNA, 32 nt, Human
cccuggaacuccucuuucauagaucgugacuu

SEQ ID NO: 374050 - RNA, 32 nt, Human
cccuggaagaagcugagucuucccuggagguu

SEQ ID NO: 374051 - RNA, 19 nt, Human
cccuggaagagcagccgga

SEQ ID NO: 374052 - RNA, 32 nt, Human
cccuggaagauggaucuugccuuguggauguu

SEQ ID NO: 374053 - RNA, 19 nt, Human
cccuggaagcagauacaga

SEQ ID NO: 374054 - RNA, 32 nt, Human
cccuggaaggcaggggacugcgagcugggcug

SEQ ID NO: 374055 - RNA, 32 nt, Human
cccuggaagggagggaaggcaugggaagaagc

SEQ ID NO: 374056 - RNA, 32 nt, Human
cccuggaagggagggaggcccaugggaggcca

SEQ ID NO: 374057 - RNA, 22 nt, Human
cccuggaagggccccucugccu

SEQ ID NO: 374058 - RNA, 32 nt, Human
cccuggaaguggagguugcagugagccuguca

SEQ ID NO: 374059 - RNA, 32 nt, Human
cccuggaaguggcagcagcagugagcagucag

SEQ ID NO: 374060 - RNA, 32 nt, Human
cccuggaauaggguccugcaggguagaauaaa

SEQ ID NO: 374061 - RNA, 32 nt, Human
cccuggaaucucaaccauugucuuccaagaua

SEQ ID NO: 374062 - RNA, 32 nt, Human
cccuggaaugugcagugggccagcugagagua

SEQ ID NO: 374063 - RNA, 32 nt, Human
cccuggaaugugcauuccugccacugguuuca

SEQ ID NO: 374064 - RNA, 22 nt, Human
cccuggaauuccagcuccaccu

SEQ ID NO: 374065 - RNA, 32 nt, Human
cccuggaauuccaugccagccuaugcaacauc

SEQ ID NO: 374066 - RNA, 32 nt, Human
cccuggaauuucugccuuucugucucaagaug

SEQ ID NO: 374067 - RNA, 32 nt, Human
cccuggacagugaucaugccaggccuggaccu

SEQ ID NO: 374068 - RNA, 32 nt, Human
cccuggacaucuccuagagaggaauggaccca

SEQ ID NO: 374069 - RNA, 32 nt, Human
cccuggacauuauguauaaacaugcauaagaa

SEQ ID NO: 374070 - RNA, 32 nt, Human
cccuggaccagaaacuucaggucucucagacg

SEQ ID NO: 374071 - RNA, 32 nt, Human
cccuggaccagccgcccagaucauggcgccac

SEQ ID NO: 374072 - RNA, 32 nt, Human
cccuggaccagccgcccagaucauggcgccgc

SEQ ID NO: 374073 - RNA, 21 nt, Human
cccuggaccagccuccuguuu

SEQ ID NO: 374074 - RNA, 32 nt, Human
cccuggaccagccuggaacacacuagcagagc

SEQ ID NO: 374075 - RNA, 18 nt, Human
cccuggaccauacacagg

SEQ ID NO: 374076 - RNA, 32 nt, Human
cccuggacccuaguacacucuaccuccuuggg

SEQ ID NO: 374077 - RNA, 23 nt, Human
cccuggacgccuugcuccugcuu

SEQ ID NO: 374078 - RNA, 32 nt, Human
cccuggacggcagaggcaaggacggacgggag

SEQ ID NO: 374079 - RNA, 22 nt, Human
cccuggacucccgucuccuccu

SEQ ID NO: 374080 - RNA, 32 nt, Human
cccuggacucuugagaaaauugguacagaaau

SEQ ID NO: 374081 - RNA, 22 nt, Human
cccuggacuugguauaccucca

SEQ ID NO: 374082 - RNA, 32 nt, Human
cccuggacuugucaagugaauucuuugcaugu

SEQ ID NO: 374083 - RNA, 32 nt, Human
cccuggacuugucaagugaguucuuugcaugu

SEQ ID NO: 374084 - RNA, 32 nt, Human
cccuggagaacagcaagcucgucagcugccac

SEQ ID NO: 374085 - RNA, 32 nt, Human
cccuggagaaggacagagcgguggggacucgg

SEQ ID NO: 374086 - RNA, 32 nt, Human
cccuggagaagggagaccuggcaguggaggga

SEQ ID NO: 374087 - RNA, 32 nt, Human
cccuggagagcagcagggggccuucacuccug

SEQ ID NO: 374088 - RNA, 32 nt, Human
cccuggagagcagcagggggucuucacuccug

SEQ ID NO: 374089 - RNA, 32 nt, Human
cccuggagaggaagaggcaagguuuguguauu

SEQ ID NO: 374090 - RNA, 32 nt, Human
cccuggagcagcccaagugcuccugaguccuu

SEQ ID NO: 374091 - RNA, 32 nt, Human
cccuggagcaggagcggcaggagcugcggcug

SEQ ID NO: 374092 - RNA, 25 nt, Human
cccuggagccaccugccucuggcuu

SEQ ID NO: 374093 - RNA, 32 nt, Human
cccuggagccaccugccucuggcuucauguga

SEQ ID NO: 374094 - RNA, 22 nt, Human
cccuggagcccccagcccaucc

SEQ ID NO: 374095 - RNA, 32 nt, Human
cccuggagccuacagagcaggcaggcuaggcc

SEQ ID NO: 374096 - RNA, 20 nt, Human
cccuggagccuccacugccu

SEQ ID NO: 374097 - RNA, 32 nt, Human
cccuggagccugggacacuaccucgcugcggu

SEQ ID NO: 374098 - RNA, 20 nt, Human
cccuggaggaaagucaggug

SEQ ID NO: 374099 - RNA, 32 nt, Human
cccuggaggaaggaagcagggaagaggggcgu

SEQ ID NO: 374100 - RNA, 24 nt, Human
cccuggaggacugccugcuugcuu

SEQ ID NO: 374101 - RNA, 23 nt, Human
cccuggaggauuucaucucuugu

SEQ ID NO: 374102 - RNA, 24 nt, Human
cccuggaggcagagcuugcaguga

SEQ ID NO: 374103 - RNA, 24 nt, Human
cccuggaggcagagguugcaauga

SEQ ID NO: 374104 - RNA, 24 nt, Human
cccuggaggcagagguugcaguga

SEQ ID NO: 374105 - RNA, 32 nt, Human
cccuggaggcagagguugcagugagccaagau

SEQ ID NO: 374106 - RNA, 24 nt, Human
cccuggaggcagagguuguaguga

SEQ ID NO: 374107 - RNA, 32 nt, Human
cccuggaggcagcacaaggaggaugugauaug

SEQ ID NO: 374108 - RNA, 21 nt, Human
cccuggaggcagcuucugccu

SEQ ID NO: 374109 - RNA, 21 nt, Human
cccuggaggccacuucuuccu

SEQ ID NO: 374110 - RNA, 24 nt, Human
cccuggaggcggaaguugcaguga

SEQ ID NO: 374111 - RNA, 32 nt, Human
cccuggaggcggaaguugcagugagccgagac

SEQ ID NO: 374112 - RNA, 32 nt, Human
cccuggaggcggagauugaagugagcugaguu

SEQ ID NO: 374113 - RNA, 32 nt, Human
cccuggaggcggagguuccagugagcugagau

SEQ ID NO: 374114 - RNA, 24 nt, Human
cccuggaggcggagguugcaguga

SEQ ID NO: 374115 - RNA, 32 nt, Human
cccuggaggcggagguugcagugagccgagau

SEQ ID NO: 374116 - RNA, 32 nt, Human
cccuggaggcggagguugcagugaguggagau

SEQ ID NO: 374117 - RNA, 24 nt, Human
cccuggaggcggagguugccguga

SEQ ID NO: 374118 - RNA, 32 nt, Human
cccuggaggcggagguugccgugagccaagau

SEQ ID NO: 374119 - RNA, 21 nt, Human
cccuggaggcugccuccugcc

SEQ ID NO: 374120 - RNA, 21 nt, Human
cccuggaggcuucuggauggg

SEQ ID NO: 374121 - RNA, 32 nt, Human
cccuggagggacaccaggcucauacuaaaauc

SEQ ID NO: 374122 - RNA, 22 nt, Human
cccuggagggagcagcguuggc

SEQ ID NO: 374123 - RNA, 32 nt, Human
cccuggagggagcagcguuggcagggagacag

SEQ ID NO: 374124 - RNA, 32 nt, Human
cccuggaggggcaggcacaggagacagcagug

SEQ ID NO: 374125 - RNA, 32 nt, Human
cccuggaggggcugcugcuccucaguugcauu

SEQ ID NO: 374126 - RNA, 32 nt, Human
cccuggaggguggauugccugaggucaggagu

SEQ ID NO: 374127 - RNA, 32 nt, Human
cccuggaggguggcuucuccugacuggcagga

SEQ ID NO: 374128 - RNA, 24 nt, Human
cccuggagguagaaguugcaguga

SEQ ID NO: 374129 - RNA, 24 nt, Human
cccuggaggucaaggcugcaguga

SEQ ID NO: 374130 - RNA, 32 nt, Human
cccuggagguggagguggagguugcagugagc

SEQ ID NO: 374131 - RNA, 24 nt, Human
cccuggagguggagguugcaguga

SEQ ID NO: 374132 - RNA, 32 nt, Human
cccuggagguggagguugcagugagccgagau

SEQ ID NO: 374133 - RNA, 32 nt, Human
cccuggagguggagguugcagugagcugagau

SEQ ID NO: 374134 - RNA, 24 nt, Human
cccuggagguggcgguugcaguga

SEQ ID NO: 374135 - RNA, 32 nt, Human
cccuggagguggcgguugcagugagcacagau

SEQ ID NO: 374136 - RNA, 21 nt, Human
cccuggagguguuuccugucu

SEQ ID NO: 374137 - RNA, 32 nt, Human
cccuggagguugaggcugcagugagcugggau

SEQ ID NO: 374138 - RNA, 24 nt, Human
cccuggagguugagguugcaguga

SEQ ID NO: 374139 - RNA, 32 nt, Human
cccuggagguugagguugcagugagcugagau

SEQ ID NO: 374140 - RNA, 23 nt, Human
cccuggaguccuggaguuaaggg

SEQ ID NO: 374141 - RNA, 23 nt, Human
cccuggagucuccaccuuuuccu

SEQ ID NO: 374142 - RNA, 23 nt, Human
cccuggagucugccucuccugcc

SEQ ID NO: 374143 - RNA, 32 nt, Human
cccuggagugguuucuuuacaguaauuucaac

SEQ ID NO: 374144 - RNA, 32 nt, Human
cccuggaguguucacuugcaagcugccaaaac

SEQ ID NO: 374145 - RNA, 24 nt, Human
cccuggaguucaaggcugcaguga

SEQ ID NO: 374146 - RNA, 22 nt, Human
cccuggaguucugcuucugucu

SEQ ID NO: 374147 - RNA, 24 nt, Human
cccuggaguuggagguugcaguga

SEQ ID NO: 374148 - RNA, 32 nt, Human
cccuggaguuggagguugcagugagcagagau

SEQ ID NO: 374149 - RNA, 32 nt, Human
cccuggaguuugaguccagccugggugacaua

SEQ ID NO: 374150 - RNA, 32 nt, Human
cccuggauagaacgugcauuuaaagaauauau

SEQ ID NO: 374151 - RNA, 32 nt, Human
cccuggauaucaccaccucauguuuccagagu

SEQ ID NO: 374152 - RNA, 32 nt, Human
cccuggaucugggguugcuggacuuggugcgu

SEQ ID NO: 374153 - RNA, 32 nt, Human
cccuggaugagguuuaggguggggagugccug

SEQ ID NO: 374154 - RNA, 32 nt, Human
cccuggaugccacccagugcagccuggcaccu

SEQ ID NO: 374155 - RNA, 32 nt, Human
cccuggaugggaacuccccuccucaacgccag

SEQ ID NO: 374156 - RNA, 23 nt, Human
cccuggauggggcuuccagcuca

SEQ ID NO: 374157 - RNA, 32 nt, Human
cccuggauuccccuguggccaggugaggcugg

SEQ ID NO: 374158 - RNA, 19 nt, Human
cccuggauuggcagccaga

SEQ ID NO: 374159 - RNA, 32 nt, Human
cccuggauugugaugcagccucgggacagggc

SEQ ID NO: 374160 - RNA, 20 nt, Human
cccuggauuucagggacuug

SEQ ID NO: 374161 - RNA, 32 nt, Human
cccuggauuuuccuccucucuccaucccugac

SEQ ID NO: 374162 - RNA, 31 nt, Human
cccuggcaacauaacaagacccugucucuac

SEQ ID NO: 374163 - RNA, 32 nt, Human
cccuggcaaccaggaauccacucuccauuucu

SEQ ID NO: 374164 - RNA, 32 nt, Human
cccuggcaagugaccaaauccucucugagcca

SEQ ID NO: 374165 - RNA, 32 nt, Human
cccuggcaaucccugggcucucuugcaccccu

SEQ ID NO: 374166 - RNA, 32 nt, Human
cccuggcacacaguaggcauuuaauaaguggc

SEQ ID NO: 374167 - RNA, 25 nt, Human
cccuggcaccugggagcacagugaa

SEQ ID NO: 374168 - RNA, 25 nt, Human
cccuggcacugcgggggccuggcca

SEQ ID NO: 374169 - RNA, 32 nt, Human
cccuggcagaacugaagagcggcaccgggccc

SEQ ID NO: 374170 - RNA, 32 nt, Human
cccuggcagagcuggguggcagcucuuccucc

SEQ ID NO: 374171 - RNA, 32 nt, Human
cccuggcagcagaggaagggguguggaggucc

SEQ ID NO: 374172 - RNA, 22 nt, Human
cccuggcagcaugaaaccccca

SEQ ID NO: 374173 - RNA, 32 nt, Human
cccuggcagccauccaaaauuugccuccaaga

SEQ ID NO: 374174 - RNA, 32 nt, Human
cccuggcagcccauguucuccucuuuucucac

SEQ ID NO: 374175 - RNA, 32 nt, Human
cccuggcagcgaugggucuccaggcaaguccc

SEQ ID NO: 374176 - RNA, 20 nt, Human
cccuggcagcugcagauccc

SEQ ID NO: 374177 - RNA, 32 nt, Human
cccuggcagcuuucuucaagagacuugcauaa

SEQ ID NO: 374178 - RNA, 32 nt, Human
cccuggcaggacacaggcacuuuuccaauggg

SEQ ID NO: 374179 - RNA, 19 nt, Human
cccuggcaggaggugggug

SEQ ID NO: 374180 - RNA, 32 nt, Human
cccuggcaggcaggcugugggcugguggggcu

SEQ ID NO: 374181 - RNA, 32 nt, Human
cccuggcaggcggcuggaaggccaggccuggu

SEQ ID NO: 374182 - RNA, 32 nt, Human
cccuggcagugagguggcaggagcagccuagu

SEQ ID NO: 374183 - RNA, 32 nt, Human
cccuggcagugccaccaccgcagccgccgggc

SEQ ID NO: 374184 - RNA, 32 nt, Human
cccuggcagugccaccaugaggagugcaaccg

SEQ ID NO: 374185 - RNA, 32 nt, Human
cccuggcaucgucuguguccacacagaugcua

SEQ ID NO: 374186 - RNA, 32 nt, Human
cccuggcaugugaaagucagucuuagaggaag

SEQ ID NO: 374187 - RNA, 32 nt, Human
cccuggcauucaacaaauauucacuggccccu

SEQ ID NO: 374188 - RNA, 18 nt, Human
cccuggcauucagagagg

SEQ ID NO: 374189 - RNA, 32 nt, Human
cccuggcauuggagagaagcccacugugguca

SEQ ID NO: 374190 - RNA, 32 nt, Human
cccuggcauuggccccagccuucugaaagccg

SEQ ID NO: 374191 - RNA, 19 nt, Human
cccuggccaaggaucugaa

SEQ ID NO: 374192 - RNA, 32 nt, Human
cccuggccacacagcaccuccuuggccaccuu

SEQ ID NO: 374193 - RNA, 22 nt, Human
cccuggccacccaccuccuacc

SEQ ID NO: 374194 - RNA, 21 nt, Human
cccuggccaccccgugcugcc

SEQ ID NO: 374195 - RNA, 23 nt, Human
cccuggccacccgaauuguucca

SEQ ID NO: 374196 - RNA, 32 nt, Human
cccuggccaccugaacuguaugggcacucuca

SEQ ID NO: 374197 - RNA, 32 nt, Human
cccuggccacugccccugccgcggaggcagcg

SEQ ID NO: 374198 - RNA, 32 nt, Human
cccuggccagcaccugcgggagcugcacuaca

SEQ ID NO: 374199 - RNA, 32 nt, Human
cccuggccagccuccaccugagcccagugagc

SEQ ID NO: 374200 - RNA, 32 nt, Human
cccuggccagcgcauguagguggugugaccug

SEQ ID NO: 374201 - RNA, 25 nt, Human
cccuggccagcgggcgugggacuga

SEQ ID NO: 374202 - RNA, 24 nt, Human
cccuggccagggccaucuccuguc

SEQ ID NO: 374203 - RNA, 32 nt, Human
cccuggccauccacacugaggucguggagcac

SEQ ID NO: 374204 - RNA, 32 nt, Human
cccuggccauccuccuggaauguggucugccc

SEQ ID NO: 374205 - RNA, 32 nt, Human
cccuggccaugggagcuaucucagccuaaugc

SEQ ID NO: 374206 - RNA, 32 nt, Human
cccuggcccaaggguccagccuccucucaccc

SEQ ID NO: 374207 - RNA, 23 nt, Human
cccuggcccacauugcacaugga

SEQ ID NO: 374208 - RNA, 32 nt, Human
cccuggcccagaggacucccguggugggcaca

SEQ ID NO: 374209 - RNA, 20 nt, Human
cccuggcccagccccagcag

SEQ ID NO: 374210 - RNA, 32 nt, Human
cccuggcccagccuguggccucagcaucucau

SEQ ID NO: 374211 - RNA, 32 nt, Human
cccuggcccagcugccucagagccuguccugc

SEQ ID NO: 374212 - RNA, 32 nt, Human
cccuggcccaggaaggcaggagacagaggcca

SEQ ID NO: 374213 - RNA, 32 nt, Human
cccuggcccaggaguugaaugccugaggacgu

SEQ ID NO: 374214 - RNA, 32 nt, Human
cccuggcccaggcuuggggcugcugggguugg

SEQ ID NO: 374215 - RNA, 32 nt, Human
cccuggcccauuccuccagcccuagacuccca

SEQ ID NO: 374216 - RNA, 32 nt, Human
cccuggccccacucugaggggcucagagcuga

SEQ ID NO: 374217 - RNA, 32 nt, Human
cccuggccccagacggagcccagaccuugcug

SEQ ID NO: 374218 - RNA, 25 nt, Human
cccuggccccagcccucuccugccu

SEQ ID NO: 374219 - RNA, 21 nt, Human
cccuggcccccuugagagagg

SEQ ID NO: 374220 - RNA, 32 nt, Human
cccuggccccgcccugcacuccagcucgcccc

SEQ ID NO: 374221 - RNA, 32 nt, Human
cccuggccccuccaauccuccccgcucugccg

SEQ ID NO: 374222 - RNA, 32 nt, Human
cccuggcccggacucuggccucccagaucccc

SEQ ID NO: 374223 - RNA, 32 nt, Human
cccuggcccgggaccuuggcauggcaguggug

SEQ ID NO: 374224 - RNA, 32 nt, Human
cccuggcccucugaguggugguggaggguggg

SEQ ID NO: 374225 - RNA, 32 nt, Human
cccuggcccugccucccgcgccccgcuccccu

SEQ ID NO: 374226 - RNA, 32 nt, Human
cccuggcccuguguucuagcacuuuguccauu

SEQ ID NO: 374227 - RNA, 21 nt, Human
cccuggcccuucaucugggaa

SEQ ID NO: 374228 - RNA, 32 nt, Human
cccuggccgcagcaggccagcacugcagaguu

SEQ ID NO: 374229 - RNA, 32 nt, Human
cccuggccgcggcagagcucccugccaccggc

SEQ ID NO: 374230 - RNA, 21 nt, Human
cccuggccgggcagcccccca

SEQ ID NO: 374231 - RNA, 32 nt, Human
cccuggccgggccugggcugcccuccagucgg

SEQ ID NO: 374232 - RNA, 32 nt, Human
cccuggccuaguauagugugacccugggacaa

SEQ ID NO: 374233 - RNA, 32 nt, Human
cccuggccuaguauagugugacccugggacua

SEQ ID NO: 374234 - RNA, 32 nt, Human
cccuggccuccacccaccccuagccagcagcu

SEQ ID NO: 374235 - RNA, 22 nt, Human
cccuggccuccccaccuccucc

SEQ ID NO: 374236 - RNA, 32 nt, Human
cccuggccuccccucucuucaccuuuagauuu

SEQ ID NO: 374237 - RNA, 22 nt, Human
cccuggccuccugcccuuguca

SEQ ID NO: 374238 - RNA, 20 nt, Human
cccuggccucggcccugccc

SEQ ID NO: 374239 - RNA, 32 nt, Human
cccuggccucugcacuccccugcugggugugg

SEQ ID NO: 374240 - RNA, 20 nt, Human
cccuggccucuuaccuguca

SEQ ID NO: 374241 - RNA, 20 nt, Human
cccuggccucuuccgcuguc

SEQ ID NO: 374242 - RNA, 32 nt, Human
cccuggccugcagguggcacaggacagggcau

SEQ ID NO: 374243 - RNA, 32 nt, Human
cccuggccugcucagagccucaguuuaccccu

SEQ ID NO: 374244 - RNA, 20 nt, Human
cccuggccuggacccaggag

SEQ ID NO: 374245 - RNA, 32 nt, Human
cccuggccugggaggaggucauaccccaccgu

SEQ ID NO: 374246 - RNA, 32 nt, Human
cccuggccugggagucggggucucagagaaac

SEQ ID NO: 374247 - RNA, 32 nt, Human
cccuggccuguggcccagccuggcuggccugc

SEQ ID NO: 374248 - RNA, 18 nt, Human
cccuggccuucugccuca

SEQ ID NO: 374249 - RNA, 20 nt, Human
cccuggccuugccagagugg

SEQ ID NO: 374250 - RNA, 32 nt, Human
cccuggccuugguugguguccucauccuuuuc

SEQ ID NO: 374251 - RNA, 24 nt, Human
cccuggccuugucuaccucuugcc

SEQ ID NO: 374252 - RNA, 32 nt, Human
cccuggccuuucacuccaguucugggugaggc

SEQ ID NO: 374253 - RNA, 32 nt, Human
cccuggccuuucucgccgaccucaugggucac

SEQ ID NO: 374254 - RNA, 22 nt, Human
cccuggccuuugggccaggagg

SEQ ID NO: 374255 - RNA, 32 nt, Human
cccuggcgcagcccuccagccugugcgcucac

SEQ ID NO: 374256 - RNA, 32 nt, Human
cccuggcgcugacccugccuccaugugcaaac

SEQ ID NO: 374257 - RNA, 32 nt, Human
cccuggcgcugccuuuccccacccucaccgaa

SEQ ID NO: 374258 - RNA, 24 nt, Human
cccuggcggcagagguugcaguga

SEQ ID NO: 374259 - RNA, 32 nt, Human
cccuggcggguaccugagcugugcucucaggg

SEQ ID NO: 374260 - RNA, 21 nt, Human
cccuggcguugccgucugcuu

SEQ ID NO: 374261 - RNA, 32 nt, Human
cccuggcuaacauggugaaacauggugaaacc

SEQ ID NO: 374262 - RNA, 32 nt, Human
cccuggcuacuucccuuccucccggggccuuc

SEQ ID NO: 374263 - RNA, 20 nt, Human
cccuggcuauuugggaccua

SEQ ID NO: 374264 - RNA, 32 nt, Human
cccuggcucaaggacuuagcauuucgucucau

SEQ ID NO: 374265 - RNA, 19 nt, Human
cccuggcucaggccugguc

SEQ ID NO: 374266 - RNA, 32 nt, Human
cccuggcuccacugaucaccucucuccuguga

SEQ ID NO: 374267 - RNA, 21 nt, Human
cccuggcucccaccucccgcc

SEQ ID NO: 374268 - RNA, 24 nt, Human
cccuggcuccccucccuccugccu

SEQ ID NO: 374269 - RNA, 32 nt, Human
cccuggcuccugcagguccacacaccuuccag

SEQ ID NO: 374270 - RNA, 32 nt, Human
cccuggcucgcugucccgcagccugggcgggg

SEQ ID NO: 374271 - RNA, 32 nt, Human
cccuggcucucccagagggacauggcacuggc

SEQ ID NO: 374272 - RNA, 32 nt, Human
cccuggcucugccaccacuagccugucaccug

SEQ ID NO: 374273 - RNA, 32 nt, Human
cccuggcucugccuccccacccuggggugggg

SEQ ID NO: 374274 - RNA, 32 nt, Human
cccuggcucuuggggugguccaugccuuuacc

SEQ ID NO: 374275 - RNA, 32 nt, Human
cccuggcugcaacccagacaauggcgagaucu

SEQ ID NO: 374276 - RNA, 22 nt, Human
cccuggcugcacuuccuugccu

SEQ ID NO: 374277 - RNA, 32 nt, Human
cccuggcugcagcugcagcgcgagccaugcgc

SEQ ID NO: 374278 - RNA, 32 nt, Human
cccuggcugcagcuguacaccaccugugcccc

SEQ ID NO: 374279 - RNA, 18 nt, Human
cccuggcugcccagcagc

SEQ ID NO: 374280 - RNA, 32 nt, Human
cccuggcugcccucagcuuucgcugaucugcc

SEQ ID NO: 374281 - RNA, 32 nt, Human
cccuggcugcccuggacugugcagagaugccu

SEQ ID NO: 374282 - RNA, 32 nt, Human
cccuggcugccuggaggacccuggguaggucc

SEQ ID NO: 374283 - RNA, 21 nt, Human
cccuggcugcugaguugcagg

SEQ ID NO: 374284 - RNA, 32 nt, Human
cccuggcugcuggcccuuugcccuugaauaug

SEQ ID NO: 374285 - RNA, 20 nt, Human
cccuggcuggagugcaaugg

SEQ ID NO: 374286 - RNA, 20 nt, Human
cccuggcuggagugcaguag

SEQ ID NO: 374287 - RNA, 22 nt, Human
cccuggcuggagugcaguagug

SEQ ID NO: 374288 - RNA, 19 nt, Human
cccuggcuggcagcgcgga

SEQ ID NO: 374289 - RNA, 32 nt, Human
cccuggcuggcuguucagcugucuacuaagcc

SEQ ID NO: 374290 - RNA, 32 nt, Human
cccuggcugggacugaaccacccagagcggag

SEQ ID NO: 374291 - RNA, 32 nt, Human
cccuggcuggguuaugggggagggcaggguaa

SEQ ID NO: 374292 - RNA, 32 nt, Human
cccuggcuggucucggacuccugggcucaagc

SEQ ID NO: 374293 - RNA, 32 nt, Human
cccuggcuguccccucucccucaguccuuccu

SEQ ID NO: 374294 - RNA, 23 nt, Human
cccuggcugugaaaagaaucuca

SEQ ID NO: 374295 - RNA, 32 nt, Human
cccuggcuuagaugcccagcuguggcugggua

SEQ ID NO: 374296 - RNA, 23 nt, Human
cccuggcuuauucuugggaucua

SEQ ID NO: 374297 - RNA, 32 nt, Human
cccuggcuuccaaggcucccguacugucugug

SEQ ID NO: 374298 - RNA, 20 nt, Human
cccuggcuucucugguucuu

SEQ ID NO: 374299 - RNA, 32 nt, Human
cccuggcuugaaauuuuuccacuuugguuauc

SEQ ID NO: 374300 - RNA, 32 nt, Human
cccuggcuuuggccauuauguagauguuuuua

SEQ ID NO: 374301 - RNA, 32 nt, Human
cccuggcuuuuagaggcacacacacaaaaaga

SEQ ID NO: 374302 - RNA, 32 nt, Human
cccugggaagacagggcaugggcuuacagaga

SEQ ID NO: 374303 - RNA, 18 nt, Human
cccugggaagcagcacag

SEQ ID NO: 374304 - RNA, 22 nt, Human
cccugggaagcuuuucuugacu

SEQ ID NO: 374305 - RNA, 27 nt, Human
cccugggaaggagcgcagcccacccgg

SEQ ID NO: 374306 - RNA, 18 nt, Human
cccugggaaggaggggug

SEQ ID NO: 374307 - RNA, 21 nt, Human
cccugggacacacccuaucca

SEQ ID NO: 374308 - RNA, 32 nt, Human
cccugggacaccuuuguuccagccugguuucc

SEQ ID NO: 374309 - RNA, 32 nt, Human
cccugggacagagaacgguguggcuuuggcug

SEQ ID NO: 374310 - RNA, 32 nt, Human
cccugggacaucugugguggcuuuugucgcgc

SEQ ID NO: 374311 - RNA, 32 nt, Human
cccugggaccaccauucccuggcuacucucuc

SEQ ID NO: 374312 - RNA, 22 nt, Human
cccugggaccaucuuucugccu

SEQ ID NO: 374313 - RNA, 32 nt, Human
cccugggacccuggggccucaggcuucuggga

SEQ ID NO: 374314 - RNA, 32 nt, Human
cccugggaccucccccauccuuuuugccucca

SEQ ID NO: 374315 - RNA, 24 nt, Human
cccugggacgguccguuuccugcc

SEQ ID NO: 374316 - RNA, 22 nt, Human
cccugggagaagaccuagccag

SEQ ID NO: 374317 - RNA, 21 nt, Human
cccugggagacauccuugucu

SEQ ID NO: 374318 - RNA, 32 nt, Human
cccugggagacuccuugugcuauuucccacuc

SEQ ID NO: 374319 - RNA, 32 nt, Human
cccugggagaggggcagugagaguuuguugaa

SEQ ID NO: 374320 - RNA, 32 nt, Human
cccugggagagggggccuuucucccaccauca

SEQ ID NO: 374321 - RNA, 18 nt, Human
cccugggagcacagagag

SEQ ID NO: 374322 - RNA, 20 nt, Human
cccugggagcacagcccauc

SEQ ID NO: 374323 - RNA, 21 nt, Human
cccugggagcagcccgggacc

SEQ ID NO: 374324 - RNA, 32 nt, Human
cccugggagcccagggguuaggaagggaagau

SEQ ID NO: 374325 - RNA, 32 nt, Human
cccugggagccgccaccucccuuuccccaaga

SEQ ID NO: 374326 - RNA, 22 nt, Human
cccugggagccgccugcuucuu

SEQ ID NO: 374327 - RNA, 24 nt, Human
cccugggagcggagauugcaguga

SEQ ID NO: 374328 - RNA, 32 nt, Human
cccugggagcggagauugcagugagcugagau

SEQ ID NO: 374329 - RNA, 17 nt, Human
cccugggagcucuggga

SEQ ID NO: 374330 - RNA, 32 nt, Human
cccugggaggagagaagggggcagagucuucc

SEQ ID NO: 374331 - RNA, 25 nt, Human
cccugggaggcagagguugcaguga

SEQ ID NO: 374332 - RNA, 32 nt, Human
cccugggaggcagagguugcagugagucgaga

SEQ ID NO: 374333 - RNA, 24 nt, Human
cccugggaggcccaaccuccugcc

SEQ ID NO: 374334 - RNA, 32 nt, Human
cccugggaggccccuucucucccugccagagg

SEQ ID NO: 374335 - RNA, 32 nt, Human
cccugggaggcuggagccccaggugcaguggc

SEQ ID NO: 374336 - RNA, 20 nt, Human
cccugggagggacccaucca

SEQ ID NO: 374337 - RNA, 32 nt, Human
cccugggagggugguuccuugggcccuggcag

SEQ ID NO: 374338 - RNA, 32 nt, Human
cccugggaggucaaggcugcagugagcugcaa

SEQ ID NO: 374339 - RNA, 32 nt, Human
cccugggaggucuugugaggucacacagaggu

SEQ ID NO: 374340 - RNA, 32 nt, Human
cccugggagguggagguggcagugagccgaga

SEQ ID NO: 374341 - RNA, 21 nt, Human
cccugggagugagggugggug

SEQ ID NO: 374342 - RNA, 20 nt, Human
cccugggaguuuccugaggg

SEQ ID NO: 374343 - RNA, 32 nt, Human
cccugggauacuccccucccagggugucuggu

SEQ ID NO: 374344 - RNA, 25 nt, Human
cccugggauagauccaucuccuucu

SEQ ID NO: 374345 - RNA, 32 nt, Human
cccugggauccagcacccauggaagcuucugc

SEQ ID NO: 374346 - RNA, 32 nt, Human
cccugggaucuguacccaggaccuggagaaua

SEQ ID NO: 374347 - RNA, 32 nt, Human
cccugggauggcacuggcaggacagcuggaca

SEQ ID NO: 374348 - RNA, 32 nt, Human
cccugggauguugggcuuccucucucaggagc

SEQ ID NO: 374349 - RNA, 22 nt, Human
cccugggcaaggggauggggcu

SEQ ID NO: 374350 - RNA, 32 nt, Human
cccugggcaccgugcucacccugggugcaccu

SEQ ID NO: 374351 - RNA, 32 nt, Human
cccugggcacguaaggcaaaauauugccgguu

SEQ ID NO: 374352 - RNA, 32 nt, Human
cccugggcagagccccuuaaagcugcugucac

SEQ ID NO: 374353 - RNA, 25 nt, Human
cccugggcagaggaaauugcaguga

SEQ ID NO: 374354 - RNA, 32 nt, Human
cccugggcagaggccgcccucgcuccacgcaa

SEQ ID NO: 374355 - RNA, 21 nt, Human
cccugggcagcagccccccag

SEQ ID NO: 374356 - RNA, 19 nt, Human
cccugggcagcagggccag

SEQ ID NO: 374357 - RNA, 25 nt, Human
cccugggcagcggagguugcaguga

SEQ ID NO: 374358 - RNA, 22 nt, Human
cccugggcaggaggucagggga

SEQ ID NO: 374359 - RNA, 32 nt, Human
cccugggcaggcaucggagcuuccagccuggg

SEQ ID NO: 374360 - RNA, 32 nt, Human
cccugggcaggcugaaagauggcggcggcguc

SEQ ID NO: 374361 - RNA, 32 nt, Human
cccugggcaucagaacagccugcccugggcac

SEQ ID NO: 374362 - RNA, 32 nt, Human
cccugggcaucuguccuugccuaggugauuuu

SEQ ID NO: 374363 - RNA, 32 nt, Human
cccugggcauggagcaccuguccaacaaccgc

SEQ ID NO: 374364 - RNA, 32 nt, Human
cccugggccacccuucacgcuggcuuccagcg

SEQ ID NO: 374365 - RNA, 18 nt, Human
cccugggccagacuggaa

SEQ ID NO: 374366 - RNA, 32 nt, Human
cccugggccagcugcaucacugccugugccuu

SEQ ID NO: 374367 - RNA, 23 nt, Human
cccugggcccagauucuuugucu

SEQ ID NO: 374368 - RNA, 32 nt, Human
cccugggcccagcuccccucccugccucuuug

SEQ ID NO: 374369 - RNA, 21 nt, Human
cccugggcccauuuccucucu

SEQ ID NO: 374370 - RNA, 22 nt, Human
cccugggccccagugagagggg

SEQ ID NO: 374371 - RNA, 32 nt, Human
cccugggccccguggaacuccagccugcgcca

SEQ ID NO: 374372 - RNA, 21 nt, Human
cccugggccccuccccgggga

SEQ ID NO: 374373 - RNA, 32 nt, Human
cccugggcccugagccggcagcagaaauauga

SEQ ID NO: 374374 - RNA, 21 nt, Human
cccugggcccugcuccagggg

SEQ ID NO: 374375 - RNA, 22 nt, Human
cccugggcccuggagcuuaggg

SEQ ID NO: 374376 - RNA, 20 nt, Human
cccugggcccuggggacagg

SEQ ID NO: 374377 - RNA, 23 nt, Human
cccugggcccuggucuuccucca

SEQ ID NO: 374378 - RNA, 32 nt, Human
cccugggccgcaacuuccgagccucccagggc

SEQ ID NO: 374379 - RNA, 21 nt, Human
cccugggccucacuuucuucu

SEQ ID NO: 374380 - RNA, 32 nt, Human
cccugggccuccugccuggcacuucauguuuc

SEQ ID NO: 374381 - RNA, 22 nt, Human
cccugggccucucucccgccca

SEQ ID NO: 374382 - RNA, 24 nt, Human
cccugggccucugcucucuugccu

SEQ ID NO: 374383 - RNA, 32 nt, Human
cccugggccugcagagaguccuguuagcagcg

SEQ ID NO: 374384 - RNA, 32 nt, Human
cccugggccugcccaccuuccccagcccccgc

SEQ ID NO: 374385 - RNA, 15 nt, Human
cccugggccugguca

SEQ ID NO: 374386 - RNA, 22 nt, Human
cccugggccuguccuucugccu

SEQ ID NO: 374387 - RNA, 21 nt, Human
cccugggccuugccuucaggg

SEQ ID NO: 374388 - RNA, 25 nt, Human
cccugggccuuuccaucuccuguuu

SEQ ID NO: 374389 - RNA, 32 nt, Human
cccugggcgcccuccugcugcucuggggccca

SEQ ID NO: 374390 - RNA, 25 nt, Human
cccugggcggcaaagguugcaguga

SEQ ID NO: 374391 - RNA, 32 nt, Human
cccugggcgucgagacaggaaggcagggcgca

SEQ ID NO: 374392 - RNA, 32 nt, Human
cccugggcgucugaggcccugauccgggcggg

SEQ ID NO: 374393 - RNA, 22 nt, Human
cccugggcuaggcagugugacc

SEQ ID NO: 374394 - RNA, 32 nt, Human
cccugggcucaagcaagccuccugccuuggcc

SEQ ID NO: 374395 - RNA, 32 nt, Human
cccugggcucaagcaauccucccacuucagcc

SEQ ID NO: 374396 - RNA, 32 nt, Human
cccugggcucaagcaguccucccaccucaguc

SEQ ID NO: 374397 - RNA, 32 nt, Human
cccugggcucaagggauccucccaucucagcu

SEQ ID NO: 374398 - RNA, 32 nt, Human
cccugggcucaagugauccuccugccucagcc

SEQ ID NO: 374399 - RNA, 32 nt, Human
cccugggcucaaguguuccuccugccucaucc

SEQ ID NO: 374400 - RNA, 32 nt, Human
cccugggcucagagccagcccagagggaagca

SEQ ID NO: 374401 - RNA, 32 nt, Human
cccugggcucaguccuagcugcauggggugca

SEQ ID NO: 374402 - RNA, 32 nt, Human
cccugggcucccaggaggcaguagugugugcc

SEQ ID NO: 374403 - RNA, 32 nt, Human
cccugggcucccaucucuucagucuagaggcg

SEQ ID NO: 374404 - RNA, 21 nt, Human
cccugggcuccguuuccuuca

SEQ ID NO: 374405 - RNA, 26 nt, Human
cccugggcucuacccccaaaaccuuc

SEQ ID NO: 374406 - RNA, 22 nt, Human
cccugggcucuccuucuugccu

SEQ ID NO: 374407 - RNA, 23 nt, Human
cccugggcucugauaaaacuuca

SEQ ID NO: 374408 - RNA, 21 nt, Human
cccugggcucugauuuguccu

SEQ ID NO: 374409 - RNA, 32 nt, Human
cccugggcucugcagagaacacacagagagaa

SEQ ID NO: 374410 - RNA, 23 nt, Human
cccugggcucuggccaacccuca

SEQ ID NO: 374411 - RNA, 32 nt, Human
cccugggcucugggcccugcugcucuagcccc

SEQ ID NO: 374412 - RNA, 32 nt, Human
cccugggcugccucucuaggcuucgcuguuca

SEQ ID NO: 374413 - RNA, 23 nt, Human
cccugggcugcuggccuggagga

SEQ ID NO: 374414 - RNA, 23 nt, Human
cccugggcuggcugcacagagga

SEQ ID NO: 374415 - RNA, 22 nt, Human
cccugggcuggggcccacagga

SEQ ID NO: 374416 - RNA, 32 nt, Human
cccugggcuucuccaccaaagugcugaaugcc

SEQ ID NO: 374417 - RNA, 32 nt, Human
cccugggcuugcgcuuucuuucuuugcagcca

SEQ ID NO: 374418 - RNA, 32 nt, Human
cccugggcuuucacgggccccauuccaccgcc

SEQ ID NO: 374419 - RNA, 32 nt, Human
cccugggcuuucauuuucuccucccagccccc

SEQ ID NO: 374420 - RNA, 32 nt, Human
cccugggcuuuccggcccucccuacuuuuccu

SEQ ID NO: 374421 - RNA, 23 nt, Human
cccuggggaaccuacuuucugcu

SEQ ID NO: 374422 - RNA, 32 nt, Human
cccuggggaaggcacaggcucaggagggcucu

SEQ ID NO: 374423 - RNA, 32 nt, Human
cccuggggacagggacuaugaaguggggaaaa

SEQ ID NO: 374424 - RNA, 32 nt, Human
cccuggggaccacccugggacucuaaccaagc

SEQ ID NO: 374425 - RNA, 23 nt, Human
cccuggggaccagucuucuguuu

SEQ ID NO: 374426 - RNA, 32 nt, Human
cccuggggacuaggaggaagggggcagagaga

SEQ ID NO: 374427 - RNA, 32 nt, Human
cccuggggacugcccuccauagccugucccga

SEQ ID NO: 374428 - RNA, 23 nt, Human
cccuggggacuucaccugcugcc

SEQ ID NO: 374429 - RNA, 24 nt, Human
cccuggggagaggcuuuccugccu

SEQ ID NO: 374430 - RNA, 21 nt, Human
cccuggggagcccuucagccu

SEQ ID NO: 374431 - RNA, 28 nt, Human
cccuggggagcuccuccgccuuuuggcu

SEQ ID NO: 374432 - RNA, 32 nt, Human
cccuggggagcuggaccaggagguggaggcuc

SEQ ID NO: 374433 - RNA, 20 nt, Human
cccuggggaggaccccugcc

SEQ ID NO: 374434 - RNA, 32 nt, Human
cccuggggaggcagaggaggaugaugaggaag

SEQ ID NO: 374435 - RNA, 32 nt, Human
cccuggggaggcagaggguacccaggggacug

SEQ ID NO: 374436 - RNA, 32 nt, Human
cccuggggaggggacccagugcagugaugccc

SEQ ID NO: 374437 - RNA, 19 nt, Human
cccuggggcacccucuugu

SEQ ID NO: 374438 - RNA, 22 nt, Human
cccuggggcaggaccccagccu

SEQ ID NO: 374439 - RNA, 24 nt, Human
cccuggggcauccaccuuccugcc

SEQ ID NO: 374440 - RNA, 21 nt, Human
cccuggggcaucccuuugccu

SEQ ID NO: 374441 - RNA, 32 nt, Human
cccuggggccaacggcaacagcaugggccuca

SEQ ID NO: 374442 - RNA, 22 nt, Human
cccuggggccagcaccccagcc

SEQ ID NO: 374443 - RNA, 20 nt, Human
cccuggggccaggcucugcc

SEQ ID NO: 374444 - RNA, 24 nt, Human
cccuggggcccaccagccccugcc

SEQ ID NO: 374445 - RNA, 22 nt, Human
cccuggggcccagccccuguuu

SEQ ID NO: 374446 - RNA, 23 nt, Human
cccuggggccccaggauccaccu

SEQ ID NO: 374447 - RNA, 20 nt, Human
cccuggggcccccaccagcc

SEQ ID NO: 374448 - RNA, 23 nt, Human
cccuggggcccccaccucacccu

SEQ ID NO: 374449 - RNA, 20 nt, Human
cccuggggccccuccccucc

SEQ ID NO: 374450 - RNA, 21 nt, Human
cccuggggcccgacuccugcu

SEQ ID NO: 374451 - RNA, 22 nt, Human
cccuggggcccgugccuggccu

SEQ ID NO: 374452 - RNA, 19 nt, Human
cccuggggcccuccaggua

SEQ ID NO: 374453 - RNA, 20 nt, Human
cccuggggcccucucccgcc

SEQ ID NO: 374454 - RNA, 24 nt, Human
cccuggggcccuggccuucugccu

SEQ ID NO: 374455 - RNA, 24 nt, Human
cccuggggccucccaccccagccu

SEQ ID NO: 374456 - RNA, 24 nt, Human
cccuggggccuccccagucucccu

SEQ ID NO: 374457 - RNA, 19 nt, Human
cccuggggccuccccugcc

SEQ ID NO: 374458 - RNA, 23 nt, Human
cccuggggccucugaccccaccu

SEQ ID NO: 374459 - RNA, 32 nt, Human
cccuggggccugcucuucucuggcagaguggc

SEQ ID NO: 374460 - RNA, 21 nt, Human
cccuggggccuggaccugccu

SEQ ID NO: 374461 - RNA, 28 nt, Human
cccuggggccuggaccugccuccugccu

SEQ ID NO: 374462 - RNA, 32 nt, Human
cccuggggccugggggcaguuugagccuccuc

SEQ ID NO: 374463 - RNA, 24 nt, Human
cccuggggccuguacugccugcuu

SEQ ID NO: 374464 - RNA, 25 nt, Human
cccuggggcgaggccaucucugccu

SEQ ID NO: 374465 - RNA, 21 nt, Human
cccuggggcgcaaacauuccc

SEQ ID NO: 374466 - RNA, 32 nt, Human
cccuggggcuagagguggaggaggcaguccug

SEQ ID NO: 374467 - RNA, 21 nt, Human
cccuggggcucccaauccccu

SEQ ID NO: 374468 - RNA, 21 nt, Human
cccuggggcucccuccuagcc

SEQ ID NO: 374469 - RNA, 21 nt, Human
cccuggggcucggccuccucc

SEQ ID NO: 374470 - RNA, 22 nt, Human
cccuggggcucuacuaccugcu

SEQ ID NO: 374471 - RNA, 23 nt, Human
cccuggggcucucccuccgcgcc

SEQ ID NO: 374472 - RNA, 32 nt, Human
cccuggggcugaagauggcagaagcauucugg

SEQ ID NO: 374473 - RNA, 21 nt, Human
cccuggggcugaggaggcagg

SEQ ID NO: 374474 - RNA, 32 nt, Human
cccuggggcugcugaaaaacucaggccugugg

SEQ ID NO: 374475 - RNA, 19 nt, Human
cccuggggcuggcccugcc

SEQ ID NO: 374476 - RNA, 21 nt, Human
cccuggggcuggcuuaggagg

SEQ ID NO: 374477 - RNA, 22 nt, Human
cccuggggcugggggagggauu

SEQ ID NO: 374478 - RNA, 22 nt, Human
cccuggggcuuccaucccaacc

SEQ ID NO: 374479 - RNA, 25 nt, Human
cccuggggcuuccuuugcucugccu

SEQ ID NO: 374480 - RNA, 20 nt, Human
cccuggggcuucuccugacc

SEQ ID NO: 374481 - RNA, 22 nt, Human
cccuggggcuucugaccccccu

SEQ ID NO: 374482 - RNA, 21 nt, Human
cccuggggcuugccgcugccu

SEQ ID NO: 374483 - RNA, 22 nt, Human
cccuggggcuuggcuccagccu

SEQ ID NO: 374484 - RNA, 22 nt, Human
cccuggggcuuuaacuccugcu

SEQ ID NO: 374485 - RNA, 32 nt, Human
cccugggggaggaagagaggccaaguucagag

SEQ ID NO: 374486 - RNA, 21 nt, Human
cccugggggcaccuuccuccu

SEQ ID NO: 374487 - RNA, 32 nt, Human
cccugggggcagcagaaggcugagaggaguag

SEQ ID NO: 374488 - RNA, 32 nt, Human
cccugggggcagccacccucccgccugucggc

SEQ ID NO: 374489 - RNA, 21 nt, Human
cccugggggcccagcccaccc

SEQ ID NO: 374490 - RNA, 21 nt, Human
cccugggggcucagcugagag

SEQ ID NO: 374491 - RNA, 21 nt, Human
cccugggggcuccucuugccu

SEQ ID NO: 374492 - RNA, 23 nt, Human
cccugggggcugguccuuugccu

SEQ ID NO: 374493 - RNA, 23 nt, Human
cccuggggggcccaccucuugcc

SEQ ID NO: 374494 - RNA, 20 nt, Human
cccuggggggccccuccugu

SEQ ID NO: 374495 - RNA, 24 nt, Human
cccugggggguggucuccaugccu

SEQ ID NO: 374496 - RNA, 32 nt, Human
cccugggggugaggauuccagaggagucaauu

SEQ ID NO: 374497 - RNA, 32 nt, Human
cccugggggugcucagguucacuugauugucu

SEQ ID NO: 374498 - RNA, 24 nt, Human
cccugggguacuacucuccagcuu

SEQ ID NO: 374499 - RNA, 20 nt, Human
cccugggguagccuccuauc

SEQ ID NO: 374500 - RNA, 24 nt, Human
cccugggguccauccccucuugcc

SEQ ID NO: 374501 - RNA, 21 nt, Human
cccugggguccccacagcugc

SEQ ID NO: 374502 - RNA, 23 nt, Human
cccugggguccccacucccuguc

SEQ ID NO: 374503 - RNA, 24 nt, Human
cccugggguccccuuauccucccu

SEQ ID NO: 374504 - RNA, 32 nt, Human
cccuggggucccuguccuccuauccugacucc

SEQ ID NO: 374505 - RNA, 23 nt, Human
cccuggggucuggcucacugccu

SEQ ID NO: 374506 - RNA, 24 nt, Human
cccuggggucugggcacucugccu

SEQ ID NO: 374507 - RNA, 21 nt, Human
cccuggggucugguccucgcc

SEQ ID NO: 374508 - RNA, 25 nt, Human
cccuggggucuguaugccuuugucu

SEQ ID NO: 374509 - RNA, 32 nt, Human
cccuggggugaaggccacugagagccagcaag

SEQ ID NO: 374510 - RNA, 22 nt, Human
cccuggggugaccccccagccu

SEQ ID NO: 374511 - RNA, 20 nt, Human
cccuggggugcccuccuucc

SEQ ID NO: 374512 - RNA, 32 nt, Human
cccuggggugcugcugucuuggagagcacagc

SEQ ID NO: 374513 - RNA, 32 nt, Human
cccugggguggaagugggguaggggaagagga

SEQ ID NO: 374514 - RNA, 26 nt, Human
cccugggguggccccgucccuuguuu

SEQ ID NO: 374515 - RNA, 32 nt, Human
cccuggggugggaacccaggagguggaguggc

SEQ ID NO: 374516 - RNA, 22 nt, Human
cccuggggugggucuccuugcc

SEQ ID NO: 374517 - RNA, 22 nt, Human
cccugggguuuccacacaggcc

SEQ ID NO: 374518 - RNA, 19 nt, Human
cccugggguuuccacaggc

SEQ ID NO: 374519 - RNA, 20 nt, Human
cccugggguuuuccacucuu

SEQ ID NO: 374520 - RNA, 19 nt, Human
cccugggucagcagccagg

SEQ ID NO: 374521 - RNA, 32 nt, Human
cccugggucaugcccacagcgagggcccagcu

SEQ ID NO: 374522 - RNA, 32 nt, Human
cccugggucaugcuguagggaaagggucuuag

SEQ ID NO: 374523 - RNA, 20 nt, Human
cccugggucccacuccugcc

SEQ ID NO: 374524 - RNA, 32 nt, Human
cccuggguccugcacgccgccugguggcaggc

SEQ ID NO: 374525 - RNA, 32 nt, Human
cccugggucucgagccugcgggccuuuggacu

SEQ ID NO: 374526 - RNA, 24 nt, Human
cccugggucucucauuuccuggcu

SEQ ID NO: 374527 - RNA, 32 nt, Human
cccugggucugagggcccuaggucauggagag

SEQ ID NO: 374528 - RNA, 32 nt, Human
cccugggugaagauggggagacagugcgcgua

SEQ ID NO: 374529 - RNA, 32 nt, Human
cccugggugacacccacccuaggcuuccuccu

SEQ ID NO: 374530 - RNA, 32 nt, Human
cccugggugagcuccgccuggcacugggcacc

SEQ ID NO: 374531 - RNA, 32 nt, Human
cccugggugagguggguccucuggccucaggg

SEQ ID NO: 374532 - RNA, 32 nt, Human
cccugggugccaggcuguccggagccaggccu

SEQ ID NO: 374533 - RNA, 32 nt, Human
cccuggguggcggcuuccugugguguuugugg

SEQ ID NO: 374534 - RNA, 25 nt, Human
cccugggugucgucucuuucugccu

SEQ ID NO: 374535 - RNA, 32 nt, Human
cccuggguguucugucucuccuucccucccuu

SEQ ID NO: 374536 - RNA, 27 nt, Human
cccuggguuauaaggaggcuuaggaga

SEQ ID NO: 374537 - RNA, 32 nt, Human
cccuggguucaaaugauccuccugccucagcc

SEQ ID NO: 374538 - RNA, 27 nt, Human
cccuggguucaagccauucuccugucu

SEQ ID NO: 374539 - RNA, 32 nt, Human
cccuggguucaagcgauucuccugccucagcc

SEQ ID NO: 374540 - RNA, 32 nt, Human
cccuggguucaagcgauucuccugccugagcc

SEQ ID NO: 374541 - RNA, 32 nt, Human
cccuggguucaagugauucucuugucucagcc

SEQ ID NO: 374542 - RNA, 32 nt, Human
cccuggguucuagggcagggauacuccugcca

SEQ ID NO: 374543 - RNA, 23 nt, Human
cccuggguucugccgucuugccu

SEQ ID NO: 374544 - RNA, 21 nt, Human
cccuggguucugccuccgccu

SEQ ID NO: 374545 - RNA, 26 nt, Human
cccuggguuucucuuacucaaucccu

SEQ ID NO: 374546 - RNA, 21 nt, Human
cccugguaaccagcccaguca

SEQ ID NO: 374547 - RNA, 32 nt, Human
cccugguacacccuccuuauaguggguauagu

SEQ ID NO: 374548 - RNA, 32 nt, Human
cccugguagauuugacuugcucuugccucacu

SEQ ID NO: 374549 - RNA, 32 nt, Human
cccugguauguaccucuggcaaaugccccacc

SEQ ID NO: 374550 - RNA, 32 nt, Human
cccuggucacuuccaguucaucucucacugcc

SEQ ID NO: 374551 - RNA, 32 nt, Human
cccuggucaggugagguaagagacugaccucc

SEQ ID NO: 374552 - RNA, 32 nt, Human
cccugguccagcccgugcuggccggcaaaggu

SEQ ID NO: 374553 - RNA, 32 nt, Human
cccugguccagccucggaaccugagcgcccuu

SEQ ID NO: 374554 - RNA, 32 nt, Human
cccugguccaggagaaguaucccaaggccacc

SEQ ID NO: 374555 - RNA, 32 nt, Human
cccugguccaggggacaguaagaggcagccgg

SEQ ID NO: 374556 - RNA, 32 nt, Human
cccugguccauccuuucugucuccagcuguuu

SEQ ID NO: 374557 - RNA, 32 nt, Human
cccugguccaugccagguuuuccucuucuggg

SEQ ID NO: 374558 - RNA, 32 nt, Human
cccuggucccugagcccugccucggcugccuc

SEQ ID NO: 374559 - RNA, 32 nt, Human
cccugguccugagcagagaggaagggaugggu

SEQ ID NO: 374560 - RNA, 32 nt, Human
cccugguccugaugcucccuguaaagguggcu

SEQ ID NO: 374561 - RNA, 32 nt, Human
cccuggucuaacuugggaucugggaauggaag

SEQ ID NO: 374562 - RNA, 32 nt, Human
cccuggucucacugcugaccugggcugguccc

SEQ ID NO: 374563 - RNA, 32 nt, Human
cccuggucucagagaacacuuagaugggggug

SEQ ID NO: 374564 - RNA, 22 nt, Human
cccuggucucagcccuauccag

SEQ ID NO: 374565 - RNA, 32 nt, Human
cccuggucuccaccauucuauguccacacuuc

SEQ ID NO: 374566 - RNA, 20 nt, Human
cccuggucucugcccaucca

SEQ ID NO: 374567 - RNA, 32 nt, Human
cccuggucugaaggcaggaggggaggagcagu

SEQ ID NO: 374568 - RNA, 32 nt, Human
cccuggucuucggccggguccccagcccccgc

SEQ ID NO: 374569 - RNA, 23 nt, Human
cccuggucuuggaccaguagagg

SEQ ID NO: 374570 - RNA, 32 nt, Human
cccuggugaagaggaggaagaagaggugugga

SEQ ID NO: 374571 - RNA, 32 nt, Human
cccuggugacagccaccacgccuuggccuagg

SEQ ID NO: 374572 - RNA, 32 nt, Human
cccuggugacaucauauauggaccugggaaug

SEQ ID NO: 374573 - RNA, 32 nt, Human
cccuggugaccaccagccuccuuucagaaacc

SEQ ID NO: 374574 - RNA, 32 nt, Human
cccuggugagagggccgggcagaggggcagau

SEQ ID NO: 374575 - RNA, 32 nt, Human
cccuggugagaugucugaaggucccugaggcc

SEQ ID NO: 374576 - RNA, 32 nt, Human
cccuggugaggucggagccagagggcuggggg

SEQ ID NO: 374577 - RNA, 19 nt, Human
cccuggugcagccagcccu

SEQ ID NO: 374578 - RNA, 32 nt, Human
cccuggugcccagccaggguggucugcaugga

SEQ ID NO: 374579 - RNA, 19 nt, Human
cccuggugcugcagcacuu

SEQ ID NO: 374580 - RNA, 32 nt, Human
cccuggugcugggccuggcaucugcagccucc

SEQ ID NO: 374581 - RNA, 32 nt, Human
cccuggugcuguggaacaaccagcucacgcac

SEQ ID NO: 374582 - RNA, 22 nt, Human
cccugguggauccuuucuguuu

SEQ ID NO: 374583 - RNA, 32 nt, Human
cccugguggauggggaaaagcacuuuccuggu

SEQ ID NO: 374584 - RNA, 32 nt, Human
cccugguggcauggcccuguuuccuguugaua

SEQ ID NO: 374585 - RNA, 32 nt, Human
cccugguggcuggagcaggggugcaccugcug

SEQ ID NO: 374586 - RNA, 20 nt, Human
cccuggugguggccucgcca

SEQ ID NO: 374587 - RNA, 26 nt, Human
cccuggugucacauggggccuggcca

SEQ ID NO: 374588 - RNA, 21 nt, Human
cccuggugucccugccuggcc

SEQ ID NO: 374589 - RNA, 22 nt, Human
cccuggugugccauuuucucuu

SEQ ID NO: 374590 - RNA, 32 nt, Human
cccugguguggacacugccagcggcugcagcc

SEQ ID NO: 374591 - RNA, 32 nt, Human
cccugguuacucuggugcuguccuguuuuacu

SEQ ID NO: 374592 - RNA, 24 nt, Human
cccugguucaaacaauuccugccu

SEQ ID NO: 374593 - RNA, 20 nt, Human
cccugguucaccuccuucca

SEQ ID NO: 374594 - RNA, 32 nt, Human
cccugguucaggagacagacagcggacggauc

SEQ ID NO: 374595 - RNA, 31 nt, Human
cccugguuccgccagcaccuaucccacugau

SEQ ID NO: 374596 - RNA, 32 nt, Human
cccugguuccuaggaagacagaguuguucucc

SEQ ID NO: 374597 - RNA, 32 nt, Human
cccugguugagaaacauugcuuuagacaaauu

SEQ ID NO: 374598 - RNA, 32 nt, Human
cccugguugagugccaucugccuaucuggugg

SEQ ID NO: 374599 - RNA, 21 nt, Human
cccugguugucccuucugccu

SEQ ID NO: 374600 - RNA, 32 nt, Human
cccugguuguucuuccccuuguucagcccauu

SEQ ID NO: 374601 - RNA, 32 nt, Human
cccugguuguugccugugccuggucuguucac

SEQ ID NO: 374602 - RNA, 32 nt, Human
cccugguuuccccucauugcucccugggcuaa

SEQ ID NO: 374603 - RNA, 22 nt, Human
cccugguuugucccucuugucu

SEQ ID NO: 374604 - RNA, 32 nt, Human
cccugguuuuaccccagcuccauccuugcauc

SEQ ID NO: 374605 - RNA, 23 nt, Human
cccugguuuuuaauuuucugucu

SEQ ID NO: 374606 - RNA, 32 nt, Human
cccuguaacccccacucguuagcucuaaacuc

SEQ ID NO: 374607 - RNA, 32 nt, Human
cccuguacaagcucucucucuuugccugcugc

SEQ ID NO: 374608 - RNA, 32 nt, Human
cccuguacacucccucgaagcugcuguucucu

SEQ ID NO: 374609 - RNA, 32 nt, Human
cccuguaccacugagugccuuucacagagaaa

SEQ ID NO: 374610 - RNA, 16 nt, Human
cccuguacccuggccu

SEQ ID NO: 374611 - RNA, 32 nt, Human
cccuguacccuugagcagucaccucucauuuu

SEQ ID NO: 374612 - RNA, 32 nt, Human
cccuguacuaaccugcuugguggacuuggaaa

SEQ ID NO: 374613 - RNA, 32 nt, Human
cccuguacugcccugccaucucaggccaaagg

SEQ ID NO: 374614 - RNA, 19 nt, Human
cccuguagccaccacagca

SEQ ID NO: 374615 - RNA, 32 nt, Human
cccuguagccccggcaggggaggaagggcaga

SEQ ID NO: 374616 - RNA, 32 nt, Human
cccuguagcuccaagccuggucucauuugcuu

SEQ ID NO: 374617 - RNA, 32 nt, Human
cccuguagcucugccaucaucagcaccaggag

SEQ ID NO: 374618 - RNA, 32 nt, Human
cccuguagcucugcuacccacccuccagcuuc

SEQ ID NO: 374619 - RNA, 20 nt, Human
cccuguagcugcagcacagg

SEQ ID NO: 374620 - RNA, 32 nt, Human
cccuguagggccagcuguagcaagaggcacuc

SEQ ID NO: 374621 - RNA, 18 nt, Human
cccuguaggguugagcca

SEQ ID NO: 374622 - RNA, 32 nt, Human
cccuguagucaaugugcaauuucucuaauucu

SEQ ID NO: 374623 - RNA, 32 nt, Human
cccuguaguucacacuguguccccagggauga

SEQ ID NO: 374624 - RNA, 32 nt, Human
cccuguauacgugugacaugcuggccucagag

SEQ ID NO: 374625 - RNA, 32 nt, Human
cccuguauccuuuugaaggacaugacaaugug

SEQ ID NO: 374626 - RNA, 32 nt, Human
cccuguaucugaagucuagcaucucaaggcug

SEQ ID NO: 374627 - RNA, 32 nt, Human
cccuguaucugccucucccuucccucaauuuc

SEQ ID NO: 374628 - RNA, 32 nt, Human
cccugucaccaccccgagcuguguggcuggug

SEQ ID NO: 374629 - RNA, 32 nt, Human
cccugucacccaggcuggaaugcaauggcacg

SEQ ID NO: 374630 - RNA, 32 nt, Human
cccugucacccaggcuggagugcaauggugcg

SEQ ID NO: 374631 - RNA, 32 nt, Human
cccugucacccaggcuggagugcaguggcacg

SEQ ID NO: 374632 - RNA, 32 nt, Human
cccugucacccaggcuggagugcaguggugug

SEQ ID NO: 374633 - RNA, 32 nt, Human
cccugucacccaggcugggguacgguggcaug

SEQ ID NO: 374634 - RNA, 32 nt, Human
cccugucacucaggauggaguucaaugguccu

SEQ ID NO: 374635 - RNA, 32 nt, Human
cccugucacucaggcuggagcacaguggugug

SEQ ID NO: 374636 - RNA, 32 nt, Human
cccugucacuccuccuggggaccucagagauc

SEQ ID NO: 374637 - RNA, 32 nt, Human
cccugucacugcacccagcuuggcauuuacca

SEQ ID NO: 374638 - RNA, 32 nt, Human
cccugucagaugccagccauuccccaggucuu

SEQ ID NO: 374639 - RNA, 32 nt, Human
cccugucagcacugugcuacugaugauacauc

SEQ ID NO: 374640 - RNA, 32 nt, Human
cccugucaggaggcucugccaucgggcuccuu

SEQ ID NO: 374641 - RNA, 32 nt, Human
cccugucaggauaccuuccacaggggagcagc

SEQ ID NO: 374642 - RNA, 32 nt, Human
cccugucaguguagcagaugaaagaaaacacu

SEQ ID NO: 374643 - RNA, 32 nt, Human
cccugucaguuaugucugccucccaggcucug

SEQ ID NO: 374644 - RNA, 32 nt, Human
cccugucauucuaguuuguggaucccaggaug

SEQ ID NO: 374645 - RNA, 32 nt, Human
cccuguccaaaaacagcaggacaucaggccca

SEQ ID NO: 374646 - RNA, 32 nt, Human
cccuguccaaaacauugugcuuuugcauguag

SEQ ID NO: 374647 - RNA, 32 nt, Human
cccuguccaagugccuuggagaacucacagca

SEQ ID NO: 374648 - RNA, 18 nt, Human
cccuguccaaguuugugc

SEQ ID NO: 374649 - RNA, 32 nt, Human
cccuguccaccaccuuuccuggccuugcuaug

SEQ ID NO: 374650 - RNA, 32 nt, Human
cccuguccaggccucagagucccgcucuguuc

SEQ ID NO: 374651 - RNA, 32 nt, Human
cccuguccagggcagugaguccucuacuuugc

SEQ ID NO: 374652 - RNA, 32 nt, Human
cccuguccaucagccaaaaccccacccacagc

SEQ ID NO: 374653 - RNA, 28 nt, Human
cccuguccaugugcagccucaucagagc

SEQ ID NO: 374654 - RNA, 32 nt, Human
cccugucccacugaggucagaguccuacagug

SEQ ID NO: 374655 - RNA, 32 nt, Human
cccugucccagagcaagagauguccccuucca

SEQ ID NO: 374656 - RNA, 20 nt, Human
cccugucccaggcccugccc

SEQ ID NO: 374657 - RNA, 18 nt, Human
cccuguccccagccccca

SEQ ID NO: 374658 - RNA, 18 nt, Human
cccuguccccaucggcca

SEQ ID NO: 374659 - RNA, 22 nt, Human
cccugucccccaaggccagcuu

SEQ ID NO: 374660 - RNA, 32 nt, Human
cccuguccccucccccuucccucacaccgcgu

SEQ ID NO: 374661 - RNA, 32 nt, Human
cccuguccccucccugcagaacccccagggca

SEQ ID NO: 374662 - RNA, 17 nt, Human
cccuguccccugcccac

SEQ ID NO: 374663 - RNA, 32 nt, Human
cccugucccuaucucucacucuggacccaggg

SEQ ID NO: 374664 - RNA, 32 nt, Human
cccugucccugacccacccaggaaaggauggg

SEQ ID NO: 374665 - RNA, 32 nt, Human
cccugucccugcacucccuugguugccaaaaa

SEQ ID NO: 374666 - RNA, 22 nt, Human
cccugucccugcggcugugaga

SEQ ID NO: 374667 - RNA, 32 nt, Human
cccugucccuuucuggcccucuuccuguagcc

SEQ ID NO: 374668 - RNA, 32 nt, Human
cccuguccgauggggaaacugaggcacggagc

SEQ ID NO: 374669 - RNA, 32 nt, Human
cccuguccgucugucugucugucugugguggu

SEQ ID NO: 374670 - RNA, 19 nt, Human
cccuguccuaaacccagcc

SEQ ID NO: 374671 - RNA, 32 nt, Human
cccuguccucaccucugcuuccacucccuuuc

SEQ ID NO: 374672 - RNA, 32 nt, Human
cccuguccucagugguuuugcugcaaucaaac

SEQ ID NO: 374673 - RNA, 32 nt, Human
cccuguccuccacccuggaccccagccggcug

SEQ ID NO: 374674 - RNA, 32 nt, Human
cccuguccuccccugucuccuuuccuccuccu

SEQ ID NO: 374675 - RNA, 25 nt, Human
cccuguccuccuccaccuucuuccu

SEQ ID NO: 374676 - RNA, 32 nt, Human
cccuguccuccugggcccugaggccccugccc

SEQ ID NO: 374677 - RNA, 32 nt, Human
cccuguccucucuguguuccccaaaucagaga

SEQ ID NO: 374678 - RNA, 32 nt, Human
cccuguccugagcaacaccaccacugagccug

SEQ ID NO: 374679 - RNA, 32 nt, Human
cccuguccugaggggagccccgccacggcagc

SEQ ID NO: 374680 - RNA, 32 nt, Human
cccuguccugcuuggguccuccagagaaagaa

SEQ ID NO: 374681 - RNA, 32 nt, Human
cccuguccuggacccagcuuugcuaggucucc

SEQ ID NO: 374682 - RNA, 32 nt, Human
cccuguccuugcugacuuguguugcauuguau

SEQ ID NO: 374683 - RNA, 32 nt, Human
cccuguccuuuaggucuucuccagaaauaccu

SEQ ID NO: 374684 - RNA, 23 nt, Human
cccuguccuuugcuacccagggc

SEQ ID NO: 374685 - RNA, 32 nt, Human
cccugucgccacugcucucccucccagccuuc

SEQ ID NO: 374686 - RNA, 32 nt, Human
cccugucgcccaggcuggagugcaaugccgug

SEQ ID NO: 374687 - RNA, 32 nt, Human
cccugucgcccaggcuggagugccauggcgcg

SEQ ID NO: 374688 - RNA, 16 nt, Human
cccugucgccugagcu

SEQ ID NO: 374689 - RNA, 32 nt, Human
cccugucgccuggcuggaguggaguggcacaa

SEQ ID NO: 374690 - RNA, 32 nt, Human
cccugucuacagccacaguugauuggaccagc

SEQ ID NO: 374691 - RNA, 32 nt, Human
cccugucuacccaucucugcugcuccagcuca

SEQ ID NO: 374692 - RNA, 32 nt, Human
cccugucuaccuccucucacccugccacagau

SEQ ID NO: 374693 - RNA, 24 nt, Human
cccugucuagggcagcccagggcc

SEQ ID NO: 374694 - RNA, 32 nt, Human
cccugucucaaccaccaccaccaccaccaccc

SEQ ID NO: 374695 - RNA, 32 nt, Human
cccugucucacacuucuuuucucccaucccgg

SEQ ID NO: 374696 - RNA, 32 nt, Human
cccugucucagcaagcucugaggucuccccug

SEQ ID NO: 374697 - RNA, 32 nt, Human
cccugucuccaccucuagguuuggccuucccc

SEQ ID NO: 374698 - RNA, 32 nt, Human
cccugucuccagcugcucugcacacauggaca

SEQ ID NO: 374699 - RNA, 20 nt, Human
cccugucuccagggccccca

SEQ ID NO: 374700 - RNA, 32 nt, Human
cccugucuccaucugccccaaccucagcccac

SEQ ID NO: 374701 - RNA, 32 nt, Human
cccugucuccccucagcagucugagugcaacc

SEQ ID NO: 374702 - RNA, 32 nt, Human
cccugucuccccuuguuucucugugccagauc

SEQ ID NO: 374703 - RNA, 32 nt, Human
cccugucuccgaggcuggaauacgguggugcg

SEQ ID NO: 374704 - RNA, 32 nt, Human
cccugucuccuuuccuccuccuggguucaugu

SEQ ID NO: 374705 - RNA, 32 nt, Human
cccugucucuacuaaaaauaaaauuagccagg

SEQ ID NO: 374706 - RNA, 32 nt, Human
cccugucucucccgucucugcacccagcuccu

SEQ ID NO: 374707 - RNA, 32 nt, Human
cccugucucugagaacuugagaccuagcuccg

SEQ ID NO: 374708 - RNA, 32 nt, Human
cccugucucugccucuaccuugcugugccucu

SEQ ID NO: 374709 - RNA, 32 nt, Human
cccugucucugccucucccucccuuccucagg

SEQ ID NO: 374710 - RNA, 32 nt, Human
cccugucugccuccugccccuuccuucugcca

SEQ ID NO: 374711 - RNA, 32 nt, Human
cccugucugccucuguucccuuuguguguguu

SEQ ID NO: 374712 - RNA, 19 nt, Human
cccugucugcucacuucua

SEQ ID NO: 374713 - RNA, 32 nt, Human
cccugucugcucauccucucucccucugucca

SEQ ID NO: 374714 - RNA, 32 nt, Human
cccugucuggaagacguggcucugggugaggu

SEQ ID NO: 374715 - RNA, 32 nt, Human
cccugucuggccagggagauccaugugcucaa

SEQ ID NO: 374716 - RNA, 32 nt, Human
cccugucuguccacacugaccucucucuaacu

SEQ ID NO: 374717 - RNA, 32 nt, Human
cccugucugucuggaccaggugugauccuagg

SEQ ID NO: 374718 - RNA, 32 nt, Human
cccugucuuagagugugaggaaaaugugcccc

SEQ ID NO: 374719 - RNA, 32 nt, Human
cccugucuucuagccccaccucccacuuggcc

SEQ ID NO: 374720 - RNA, 32 nt, Human
cccugucuucuguccccaucuuccugccgaua

SEQ ID NO: 374721 - RNA, 20 nt, Human
cccugucuugcccugggcca

SEQ ID NO: 374722 - RNA, 32 nt, Human
cccugucuugccugcuguccaucaccauggag

SEQ ID NO: 374723 - RNA, 32 nt, Human
cccugugaaauccugcaagggggugccgguga

SEQ ID NO: 374724 - RNA, 32 nt, Human
cccugugaagaagcaagcucucugucaauggg

SEQ ID NO: 374725 - RNA, 32 nt, Human
cccugugaagccagaggagauggacuggucug

SEQ ID NO: 374726 - RNA, 20 nt, Human
cccugugaaucagagugcac

SEQ ID NO: 374727 - RNA, 32 nt, Human
cccugugacacacagcccacccuccauguccc

SEQ ID NO: 374728 - RNA, 32 nt, Human
cccugugaccucagggugugcucuguucucca

SEQ ID NO: 374729 - RNA, 32 nt, Human
cccugugacugcaucccgccucccuggggacc

SEQ ID NO: 374730 - RNA, 32 nt, Human
cccugugacuugcaccuauacgcccagauggc

SEQ ID NO: 374731 - RNA, 32 nt, Human
cccugugagagggaaugggggaagccugauga

SEQ ID NO: 374732 - RNA, 32 nt, Human
cccugugagaucuucugcuacuccagccacag

SEQ ID NO: 374733 - RNA, 32 nt, Human
cccugugagcacauaagcagaggcugcaggaa

SEQ ID NO: 374734 - RNA, 32 nt, Human
cccugugagcugcuuacucaccugccggggaa

SEQ ID NO: 374735 - RNA, 32 nt, Human
cccugugagggcuuugggggcgucagguuggg

SEQ ID NO: 374736 - RNA, 32 nt, Human
cccugugaguugaccugcuccgggccgcgggc

SEQ ID NO: 374737 - RNA, 21 nt, Human
cccugugauagaggaugacuu

SEQ ID NO: 374738 - RNA, 32 nt, Human
cccugugcaauggcucacaccuguaauuccaa

SEQ ID NO: 374739 - RNA, 32 nt, Human
cccugugcacucccccgccacgcccagcccaa

SEQ ID NO: 374740 - RNA, 32 nt, Human
cccugugcagaggaaaaaugaagaauucuccc

SEQ ID NO: 374741 - RNA, 32 nt, Human
cccugugcaugcugggcuuggccccacauuau

SEQ ID NO: 374742 - RNA, 20 nt, Human
cccugugccaccuccugccu

SEQ ID NO: 374743 - RNA, 32 nt, Human
cccugugccacucucagccauuucagcagccc

SEQ ID NO: 374744 - RNA, 32 nt, Human
cccugugcccacucccuucucuacucuucccc

SEQ ID NO: 374745 - RNA, 22 nt, Human
cccugugccccagccccagcca

SEQ ID NO: 374746 - RNA, 19 nt, Human
cccugugccccuccacuug

SEQ ID NO: 374747 - RNA, 32 nt, Human
cccugugcccuccauccuccaucccagcaucc

SEQ ID NO: 374748 - RNA, 32 nt, Human
cccugugccgcugaagacauggaguuuguguc

SEQ ID NO: 374749 - RNA, 32 nt, Human
cccugugccggacuccagccggggcgacgaga

SEQ ID NO: 374750 - RNA, 32 nt, Human
cccugugccuggggaagcagucccggccccca

SEQ ID NO: 374751 - RNA, 32 nt, Human
cccugugcgccuuccucucaggcaggcuugcu

SEQ ID NO: 374752 - RNA, 32 nt, Human
cccugugcucaccucugccuggcucagcgacc

SEQ ID NO: 374753 - RNA, 32 nt, Human
cccugugcucacugcccccacgccuccugcca

SEQ ID NO: 374754 - RNA, 32 nt, Human
cccugugcucagggcuggagagaggguggcgg

SEQ ID NO: 374755 - RNA, 32 nt, Human
cccugugcucccuuucucuccucucuccuuuu

SEQ ID NO: 374756 - RNA, 32 nt, Human
cccugugcuccugccuaugcuccugggauacg

SEQ ID NO: 374757 - RNA, 32 nt, Human
cccugugcuggcaccugcucccugugcucagu

SEQ ID NO: 374758 - RNA, 32 nt, Human
cccugugcuguagcuucuuuccaggccuuucc

SEQ ID NO: 374759 - RNA, 32 nt, Human
cccugugcuuugccuaauucgagcacgugcug

SEQ ID NO: 374760 - RNA, 32 nt, Human
cccuguggaaacacuuggcagcggaguugcuc

SEQ ID NO: 374761 - RNA, 32 nt, Human
cccuguggaaagaagagacagacagagugugg

SEQ ID NO: 374762 - RNA, 32 nt, Human
cccuguggaacgaagagaggcacacagcaugg

SEQ ID NO: 374763 - RNA, 32 nt, Human
cccuguggagaaauucguuguucccacugaaa

SEQ ID NO: 374764 - RNA, 32 nt, Human
cccuguggagaugagucagugccaugacugag

SEQ ID NO: 374765 - RNA, 32 nt, Human
cccuguggagcacuuggagcagugucuguugu

SEQ ID NO: 374766 - RNA, 32 nt, Human
cccuguggaggaggcaguuagggaaacuagga

SEQ ID NO: 374767 - RNA, 32 nt, Human
cccuguggagggccaggcagaggcuguucugg

SEQ ID NO: 374768 - RNA, 26 nt, Human
cccuguggaguuccugucuucuguuu

SEQ ID NO: 374769 - RNA, 32 nt, Human
cccuguggcaaaccaggaaggccaaggcugcg

SEQ ID NO: 374770 - RNA, 32 nt, Human
cccuguggcccccuccccagcaccucugucug

SEQ ID NO: 374771 - RNA, 22 nt, Human
cccuguggcccucgcucugccu

SEQ ID NO: 374772 - RNA, 20 nt, Human
cccugugggaaguggcccca

SEQ ID NO: 374773 - RNA, 32 nt, Human
cccugugggacccgcuucaccaacaggaccca

SEQ ID NO: 374774 - RNA, 32 nt, Human
cccugugggagaggggacacuggaggaguggc

SEQ ID NO: 374775 - RNA, 32 nt, Human
cccugugggaggcggacagcagugaccaccuc

SEQ ID NO: 374776 - RNA, 32 nt, Human
cccugugggcaagcagccgccgccauggccga

SEQ ID NO: 374777 - RNA, 23 nt, Human
cccugugggcuacccucuguaga

SEQ ID NO: 374778 - RNA, 32 nt, Human
cccuguggggagagccacagggccagguggac

SEQ ID NO: 374779 - RNA, 19 nt, Human
cccuguggguccacagcag

SEQ ID NO: 374780 - RNA, 31 nt, Human
cccugugggucccagcaccuaucucaggaag

SEQ ID NO: 374781 - RNA, 20 nt, Human
cccugugguagccccagcag

SEQ ID NO: 374782 - RNA, 24 nt, Human
cccugugguauuccuuuccugcuu

SEQ ID NO: 374783 - RNA, 32 nt, Human
cccuguggugugaggcgcguguucgggcucuu

SEQ ID NO: 374784 - RNA, 32 nt, Human
cccuguguacacacaaucucuguuauucauac

SEQ ID NO: 374785 - RNA, 32 nt, Human
cccuguguacuuuuucuuuuuaugugaaaauu

SEQ ID NO: 374786 - RNA, 32 nt, Human
cccugugucagaugauauguccuugaagcugg

SEQ ID NO: 374787 - RNA, 32 nt, Human
cccuguguccaccuuucucuccucuucccaag

SEQ ID NO: 374788 - RNA, 32 nt, Human
cccuguguccacugcuguaugaucugggggcc

SEQ ID NO: 374789 - RNA, 21 nt, Human
cccuguguccccuuccugcuu

SEQ ID NO: 374790 - RNA, 19 nt, Human
cccugugucccgggaccug

SEQ ID NO: 374791 - RNA, 32 nt, Human
cccugugucccugagggaucugucucacuggc

SEQ ID NO: 374792 - RNA, 25 nt, Human
cccuguguccuuccauuuccugucu

SEQ ID NO: 374793 - RNA, 32 nt, Human
cccugugucuagugaugcucucugugcucacc

SEQ ID NO: 374794 - RNA, 22 nt, Human
cccugugugaccugcccaccca

SEQ ID NO: 374795 - RNA, 21 nt, Human
cccugugugacucaguucuuu

SEQ ID NO: 374796 - RNA, 32 nt, Human
cccugugugcggccucuccaccucucacccac

SEQ ID NO: 374797 - RNA, 32 nt, Human
cccugugugggugagagaagggacuagacucc

SEQ ID NO: 374798 - RNA, 25 nt, Human
cccuguguguggacagccuguggga

SEQ ID NO: 374799 - RNA, 32 nt, Human
cccuguguguucacucuccucccaaagcaaac

SEQ ID NO: 374800 - RNA, 32 nt, Human
cccuguguuacccaggcuggucucaaacuccu

SEQ ID NO: 374801 - RNA, 32 nt, Human
cccuguguuaccugggcagcuccagaucacug

SEQ ID NO: 374802 - RNA, 32 nt, Human
cccuguguucccaauguuuagcucuugccuac

SEQ ID NO: 374803 - RNA, 21 nt, Human
cccuguguugaaguucuuuaa

SEQ ID NO: 374804 - RNA, 32 nt, Human
cccuguguugaucacuugcaggcccggguucu

SEQ ID NO: 374805 - RNA, 32 nt, Human
cccuguguugcucaggcuggagugcaguggug

SEQ ID NO: 374806 - RNA, 32 nt, Human
cccuguguuguuacaggcugugcagugcaaca

SEQ ID NO: 374807 - RNA, 32 nt, Human
cccuguguuugucucuaguguccuccuaaaca

SEQ ID NO: 374808 - RNA, 17 nt, Human
cccuguuaaaagaugaa

SEQ ID NO: 374809 - RNA, 32 nt, Human
cccuguuagagacccucaugggcuaggacuuu

SEQ ID NO: 374810 - RNA, 32 nt, Human
cccuguuaucauuccuccccaacauaauaaua

SEQ ID NO: 374811 - RNA, 24 nt, Human
cccuguuauucugacuuccugcuu

SEQ ID NO: 374812 - RNA, 32 nt, Human
cccuguucacuuugguuccagcauccugucca

SEQ ID NO: 374813 - RNA, 32 nt, Human
cccuguuccaaaacaaaauucaccuccuuucu

SEQ ID NO: 374814 - RNA, 32 nt, Human
cccuguuccagcugcucccucacuggccuccg

SEQ ID NO: 374815 - RNA, 31 nt, Human
cccuguucccucucugucuaggugucauggu

SEQ ID NO: 374816 - RNA, 32 nt, Human
cccuguuccuucaccuccccacuuuggagcuc

SEQ ID NO: 374817 - RNA, 32 nt, Human
cccuguucuccugucccuccaucccagacauu

SEQ ID NO: 374818 - RNA, 32 nt, Human
cccuguucucuaccaagcuauccuggcucuuu

SEQ ID NO: 374819 - RNA, 19 nt, Human
cccuguucugcucugggcu

SEQ ID NO: 374820 - RNA, 32 nt, Human
cccuguucuggcagaguugaagacagagcuac

SEQ ID NO: 374821 - RNA, 32 nt, Human
cccuguucuggcugugugugaaggaugugugu

SEQ ID NO: 374822 - RNA, 24 nt, Human
cccuguugaaguucaucucugccu

SEQ ID NO: 374823 - RNA, 32 nt, Human
cccuguugacuuugcuguuucccaggcuccuu

SEQ ID NO: 374824 - RNA, 21 nt, Human
cccuguugcaggcaaaggaac

SEQ ID NO: 374825 - RNA, 32 nt, Human
cccuguugcccaaguuggagugcaaucuuggc

SEQ ID NO: 374826 - RNA, 32 nt, Human
cccuguugcccaggcuacagugcaauggcaug

SEQ ID NO: 374827 - RNA, 32 nt, Human
cccuguugcccaggcugaagugcaguggugcg

SEQ ID NO: 374828 - RNA, 32 nt, Human
cccuguugcccaggcuggaauacaguggcacg

SEQ ID NO: 374829 - RNA, 32 nt, Human
cccuguugcccaggcuggagagcaguggugca

SEQ ID NO: 374830 - RNA, 32 nt, Human
cccuguugcccaggcuggaguauaguagugca

SEQ ID NO: 374831 - RNA, 32 nt, Human
cccuguugcccaggcuggagugcaauggcgcg

SEQ ID NO: 374832 - RNA, 32 nt, Human
cccuguugcccaggcuggagugcaauggugcg

SEQ ID NO: 374833 - RNA, 32 nt, Human
cccuguugcccaggcuggagugcaguggcacg

SEQ ID NO: 374834 - RNA, 32 nt, Human
cccuguugcccaggcuggagugcagugggaug

SEQ ID NO: 374835 - RNA, 21 nt, Human
cccuguugcccauagcccuuu

SEQ ID NO: 374836 - RNA, 32 nt, Human
cccuguugcccaugcuggagugcaauggcacg

SEQ ID NO: 374837 - RNA, 32 nt, Human
cccuguugcccccaucucuacccccuuuuguu

SEQ ID NO: 374838 - RNA, 22 nt, Human
cccuguugccuucaacauccaa

SEQ ID NO: 374839 - RNA, 32 nt, Human
cccuguugcgcugcccuggccucggcauucga

SEQ ID NO: 374840 - RNA, 32 nt, Human
cccuguugcucacacauugucuggcagccugu

SEQ ID NO: 374841 - RNA, 32 nt, Human
cccuguuggccaggcuggagugcaguaagugg

SEQ ID NO: 374842 - RNA, 32 nt, Human
cccuguuggggaggggaggggagcucaagguu

SEQ ID NO: 374843 - RNA, 32 nt, Human
cccuguuguuccugaauaagucagaagaaguu

SEQ ID NO: 374844 - RNA, 32 nt, Human
cccuguuuaucugcagccaggagacuugcaag

SEQ ID NO: 374845 - RNA, 21 nt, Human
cccuguuucccaccucccgcc

SEQ ID NO: 374846 - RNA, 32 nt, Human
cccuguuucccagguuggaguauaguggugcc

SEQ ID NO: 374847 - RNA, 18 nt, Human
cccuguuuccccccacua

SEQ ID NO: 374848 - RNA, 32 nt, Human
cccuguuucccuucccucccucccuccccucu

SEQ ID NO: 374849 - RNA, 32 nt, Human
cccuguuuccuucccucuuuccuuccuuccuc

SEQ ID NO: 374850 - RNA, 32 nt, Human
cccuguuucuaguugguccaggauuagggaug

SEQ ID NO: 374851 - RNA, 32 nt, Human
cccuguuucucaggcuguagaugaagggguuc

SEQ ID NO: 374852 - RNA, 32 nt, Human
cccuguuucuccugcugaccuugggucacacc

SEQ ID NO: 374853 - RNA, 32 nt, Human
cccuguuuucugcucccuggacugccuagccc

SEQ ID NO: 374854 - RNA, 32 nt, Human
cccuguuuugagauuguuuguucuaauuuauu

SEQ ID NO: 374855 - RNA, 32 nt, Human
cccuguuuuguagcauuuacuaauauuuaugg

SEQ ID NO: 374856 - RNA, 32 nt, Human
cccuguuuuucccuuccggcagccucuuggcc

SEQ ID NO: 374857 - RNA, 32 nt, Human
cccuguuuuugaauaaauauucucagcgacca

SEQ ID NO: 374858 - RNA, 32 nt, Human
cccuuaaaaagcuucuuaagagcucaguuaau

SEQ ID NO: 374859 - RNA, 32 nt, Human
cccuuaaaaauggacucaaaaauuuuggacau

SEQ ID NO: 374860 - RNA, 32 nt, Human
cccuuaaauucucaagacuaaagacuugagau

SEQ ID NO: 374861 - RNA, 21 nt, Human
cccuuaacaccucggcacaga

SEQ ID NO: 374862 - RNA, 32 nt, Human
cccuuaacaguguugaauucaacugaaggcga

SEQ ID NO: 374863 - RNA, 32 nt, Human
cccuuaacuaugagcaggugcuaccuuuuggg

SEQ ID NO: 374864 - RNA, 32 nt, Human
cccuuaagaaaccuuaaagaaauaaguauccu

SEQ ID NO: 374865 - RNA, 32 nt, Human
cccuuaagacaggacugacuugguaacgcaca

SEQ ID NO: 374866 - RNA, 32 nt, Human
cccuuaagcaagaauagaauguaguggaaauu

SEQ ID NO: 374867 - RNA, 32 nt, Human
cccuuaagccaaguacagggauaguugucuca

SEQ ID NO: 374868 - RNA, 32 nt, Human
cccuuaagcucccuccgaccucccagaagccu

SEQ ID NO: 374869 - RNA, 26 nt, Human
cccuuaaguccuuaaugaagagccag

SEQ ID NO: 374870 - RNA, 32 nt, Human
cccuuaauuggcagguguaugugcugacagua

SEQ ID NO: 374871 - RNA, 32 nt, Human
cccuuacaaagcagggcuuugaggacuccgau

SEQ ID NO: 374872 - RNA, 32 nt, Human
cccuuacaagagguggagcaugcagaugagca

SEQ ID NO: 374873 - RNA, 32 nt, Human
cccuuacaagccugggacaagccuggguggaa

SEQ ID NO: 374874 - RNA, 21 nt, Human
cccuuacagaauuaagaaaaa

SEQ ID NO: 374875 - RNA, 32 nt, Human
cccuuaccaaaccugaugccccugacaucauc

SEQ ID NO: 374876 - RNA, 21 nt, Human
cccuuacccacccaccagccc

SEQ ID NO: 374877 - RNA, 32 nt, Human
cccuuacccauguuaucauuuccuuucuaucc

SEQ ID NO: 374878 - RNA, 32 nt, Human
cccuuacccuaucacuggccucaggcccccgc

SEQ ID NO: 374879 - RNA, 32 nt, Human
cccuuacccuccucaggacuaccgaaccuucu

SEQ ID NO: 374880 - RNA, 32 nt, Human
cccuuacccucugcccaaucucucauuacucc

SEQ ID NO: 374881 - RNA, 23 nt, Human
cccuuacguccuuccacuuccaa

SEQ ID NO: 374882 - RNA, 32 nt, Human
cccuuacucaaggaguugagggaccuuggagg

SEQ ID NO: 374883 - RNA, 32 nt, Human
cccuuacuccucccucugcugccuccuccccc

SEQ ID NO: 374884 - RNA, 32 nt, Human
cccuuacugauaagcggccacuuuaggagugu

SEQ ID NO: 374885 - RNA, 32 nt, Human
cccuuacugauaguugggaaaagaagauuggg

SEQ ID NO: 374886 - RNA, 21 nt, Human
cccuuacuggaggcugcagga

SEQ ID NO: 374887 - RNA, 32 nt, Human
cccuuacuucauccucccccucaucuccugaa

SEQ ID NO: 374888 - RNA, 32 nt, Human
cccuuagagacaggguuucacuauguugccca

SEQ ID NO: 374889 - RNA, 24 nt, Human
cccuuagagcccccuaaguuuuuc

SEQ ID NO: 374890 - RNA, 32 nt, Human
cccuuagaggugagcaucagagccagagcagu

SEQ ID NO: 374891 - RNA, 32 nt, Human
cccuuagcaccagcuuagacaccuccaagaac

SEQ ID NO: 374892 - RNA, 32 nt, Human
cccuuagcacuggccucugcguuggaccggau

SEQ ID NO: 374893 - RNA, 20 nt, Human
cccuuagcagggccuggcca

SEQ ID NO: 374894 - RNA, 32 nt, Human
cccuuagcagucaggucauaacagggcacauu

SEQ ID NO: 374895 - RNA, 32 nt, Human
cccuuagcugucaaggaugcugugggaagagu

SEQ ID NO: 374896 - RNA, 32 nt, Human
cccuuagcuugcuuuccuccucccuccuuuuu

SEQ ID NO: 374897 - RNA, 32 nt, Human
cccuuaggauggugaguugaagcaucacccuc

SEQ ID NO: 374898 - RNA, 24 nt, Human
cccuuaggcaaguuuaaaagccag

SEQ ID NO: 374899 - RNA, 17 nt, Human
cccuuagggaaguuguc

SEQ ID NO: 374900 - RNA, 32 nt, Human
cccuuagggaggaggaggcgagaagauggcgg

SEQ ID NO: 374901 - RNA, 32 nt, Human
cccuuagguucaggaagcuucuguguaagcug

SEQ ID NO: 374902 - RNA, 32 nt, Human
cccuuagguuucuaaguacccauuucuuucug

SEQ ID NO: 374903 - RNA, 32 nt, Human
cccuuaguaaagccucugagaccuuccugaac

SEQ ID NO: 374904 - RNA, 32 nt, Human
cccuuaguaauguuuuugaauuaaugaggcau

SEQ ID NO: 374905 - RNA, 32 nt, Human
cccuuaguagaggcacuaaccaugugacccaa

SEQ ID NO: 374906 - RNA, 32 nt, Human
cccuuagucuacucccuuccccucucuggucc

SEQ ID NO: 374907 - RNA, 32 nt, Human
cccuuaguuucuuuucauaaaguaaguuauuu

SEQ ID NO: 374908 - RNA, 32 nt, Human
cccuuauaccucuucgccuuucugugguucca

SEQ ID NO: 374909 - RNA, 32 nt, Human
cccuuauagagcugcaaaacacacacaugcgu

SEQ ID NO: 374910 - RNA, 32 nt, Human
cccuuauaggauuccaaaguuguuaaauaaau

SEQ ID NO: 374911 - RNA, 28 nt, Human
cccuuaucaccagcugccucuucugugg

SEQ ID NO: 374912 - RNA, 32 nt, Human
cccuuaucccuggucacauccagggagacgcg

SEQ ID NO: 374913 - RNA, 32 nt, Human
cccuuaucuaucuccuucucggcuccccagcc

SEQ ID NO: 374914 - RNA, 32 nt, Human
cccuuaucuccucugcacuuauguuaucaaua

SEQ ID NO: 374915 - RNA, 32 nt, Human
cccuuaucugcacugggccagcauccuccggc

SEQ ID NO: 374916 - RNA, 32 nt, Human
cccuuaucuggaggaggaagagaagcaggaga

SEQ ID NO: 374917 - RNA, 32 nt, Human
cccuuaugccagguuccagucuugagaggaaa

SEQ ID NO: 374918 - RNA, 22 nt, Human
cccuuauggccaggugcagugg

SEQ ID NO: 374919 - RNA, 32 nt, Human
cccuuauuagagccaugacagccuacagagug

SEQ ID NO: 374920 - RNA, 18 nt, Human
cccuuauucaguggaaga

SEQ ID NO: 374921 - RNA, 32 nt, Human
cccuuauuccccuucugccccugggcccaguc

SEQ ID NO: 374922 - RNA, 32 nt, Human
cccuuauugcagcugucucacagccugagcug

SEQ ID NO: 374923 - RNA, 20 nt, Human
cccuucaaagaacagcauca

SEQ ID NO: 374924 - RNA, 32 nt, Human
cccuucaaccuccccagucccccaccagaccc

SEQ ID NO: 374925 - RNA, 32 nt, Human
cccuucaagguacacgcagccuggguggguga

SEQ ID NO: 374926 - RNA, 32 nt, Human
cccuucacaagcccucucucucccucucuuug

SEQ ID NO: 374927 - RNA, 32 nt, Human
cccuucacacagggagcucaucagcccgacgc

SEQ ID NO: 374928 - RNA, 32 nt, Human
cccuucacagcaguaaaccagcucuuuggaac

SEQ ID NO: 374929 - RNA, 20 nt, Human
cccuucacauucccaaggaa

SEQ ID NO: 374930 - RNA, 20 nt, Human
cccuucaccaccccgcccca

SEQ ID NO: 374931 - RNA, 25 nt, Human
cccuucaccagcacagcagcagcag

SEQ ID NO: 374932 - RNA, 32 nt, Human
cccuucacccacccggugucuccagcagcagg

SEQ ID NO: 374933 - RNA, 21 nt, Human
cccuucaccccgcccccaggg

SEQ ID NO: 374934 - RNA, 32 nt, Human
cccuucaccccggccugugacacacacagccc

SEQ ID NO: 374935 - RNA, 32 nt, Human
cccuucacccgccucaucacccaagccaggca

SEQ ID NO: 374936 - RNA, 19 nt, Human
cccuucacccugccccucc

SEQ ID NO: 374937 - RNA, 32 nt, Human
cccuucaccgcccucugguguccccucaccuu

SEQ ID NO: 374938 - RNA, 32 nt, Human
cccuucaccggcugccccgcucagaccuaguc

SEQ ID NO: 374939 - RNA, 32 nt, Human
cccuucaccuacugcuggccauugucccuucu

SEQ ID NO: 374940 - RNA, 32 nt, Human
cccuucaccugcaggcccuccucuuugauaaa

SEQ ID NO: 374941 - RNA, 32 nt, Human
cccuucacuggcagugagaaaggugcucauuu

SEQ ID NO: 374942 - RNA, 21 nt, Human
cccuucagaacauggcuccca

SEQ ID NO: 374943 - RNA, 32 nt, Human
cccuucagaccagcagagugaagacagacaga

SEQ ID NO: 374944 - RNA, 32 nt, Human
cccuucagagcaucugccaaacuucgggcauc

SEQ ID NO: 374945 - RNA, 32 nt, Human
cccuucagauugccugccguuacauuaacaca

SEQ ID NO: 374946 - RNA, 32 nt, Human
cccuucagccagguccagaauguggaccuggu

SEQ ID NO: 374947 - RNA, 24 nt, Human
cccuucaggcggagguugcaguga

SEQ ID NO: 374948 - RNA, 32 nt, Human
cccuucaggcggagguugcagugagccgagau

SEQ ID NO: 374949 - RNA, 32 nt, Human
cccuucaggucuucaguggauuacuuaaccac

SEQ ID NO: 374950 - RNA, 32 nt, Human
cccuucaggugaggcccuuuucugccuucuuu

SEQ ID NO: 374951 - RNA, 22 nt, Human
cccuucagguggcaucccugag

SEQ ID NO: 374952 - RNA, 32 nt, Human
cccuucaguauuuaucccuccuuuccccacag

SEQ ID NO: 374953 - RNA, 32 nt, Human
cccuucagucaccacucaguucucacucauug

SEQ ID NO: 374954 - RNA, 32 nt, Human
cccuucagucucugcucuuccuucaucaacca

SEQ ID NO: 374955 - RNA, 32 nt, Human
cccuucagugcaggccagccuggcagcuggaa

SEQ ID NO: 374956 - RNA, 32 nt, Human
cccuucagugcguggugagugcagcgugugug

SEQ ID NO: 374957 - RNA, 23 nt, Human
cccuucagugcugggaccccagg

SEQ ID NO: 374958 - RNA, 16 nt, Human
cccuucaguggcccca

SEQ ID NO: 374959 - RNA, 32 nt, Human
cccuucagugugccacugaagauccugguguc

SEQ ID NO: 374960 - RNA, 32 nt, Human
cccuucaguucuggagaaagccugauaccagg

SEQ ID NO: 374961 - RNA, 32 nt, Human
cccuucauacagggcugcuggggaagacggca

SEQ ID NO: 374962 - RNA, 19 nt, Human
cccuucauaccccuccuca

SEQ ID NO: 374963 - RNA, 32 nt, Human
cccuucaucauccgcccucccacuacaagccc

SEQ ID NO: 374964 - RNA, 32 nt, Human
cccuucauccaccucucucucaccgcgccgcu

SEQ ID NO: 374965 - RNA, 32 nt, Human
cccuucauccauuggcuggaacauggauuggg

SEQ ID NO: 374966 - RNA, 32 nt, Human
cccuucaucccugccgcccagcauccuacugg

SEQ ID NO: 374967 - RNA, 32 nt, Human
cccuucaucuucuccucugccaggggaggacu

SEQ ID NO: 374968 - RNA, 32 nt, Human
cccuucauguuugcuucagcagcugguagcuu

SEQ ID NO: 374969 - RNA, 32 nt, Human
cccuucauuuugggacugaggcugcagcauug

SEQ ID NO: 374970 - RNA, 32 nt, Human
cccuuccaacacagaugcccaggcaccuccag

SEQ ID NO: 374971 - RNA, 32 nt, Human
cccuuccaccaccucugcccuccgucugcaga

SEQ ID NO: 374972 - RNA, 32 nt, Human
cccuuccaccaugugaggacacugugagaagg

SEQ ID NO: 374973 - RNA, 32 nt, Human
cccuuccaccucuguugguuucugccucccuu

SEQ ID NO: 374974 - RNA, 32 nt, Human
cccuuccaccuggaggcucccuugucucccag

SEQ ID NO: 374975 - RNA, 32 nt, Human
cccuuccacuccucacuggcugguucacugug

SEQ ID NO: 374976 - RNA, 32 nt, Human
cccuuccacucuggcuuuacugcagcgaucuu

SEQ ID NO: 374977 - RNA, 18 nt, Human
cccuuccagacccagcca

SEQ ID NO: 374978 - RNA, 21 nt, Human
cccuuccagcaccccauccag

SEQ ID NO: 374979 - RNA, 32 nt, Human
cccuuccagcacuuaaucuugucuuguugaaa

SEQ ID NO: 374980 - RNA, 32 nt, Human
cccuuccagcagccaugagggaaggacaggag

SEQ ID NO: 374981 - RNA, 32 nt, Human
cccuuccagcuccaguucugcccaggucacaa

SEQ ID NO: 374982 - RNA, 32 nt, Human
cccuuccaggagacccuggaguguacugaggg

SEQ ID NO: 374983 - RNA, 32 nt, Human
cccuuccaggaggccaguuuucuagugaagac

SEQ ID NO: 374984 - RNA, 32 nt, Human
cccuuccaggccagccagaguggggauggucu

SEQ ID NO: 374985 - RNA, 32 nt, Human
cccuuccagucaugugugcaucaugucucuuu

SEQ ID NO: 374986 - RNA, 32 nt, Human
cccuuccaucuaucagucuuacuccaaauaua

SEQ ID NO: 374987 - RNA, 32 nt, Human
cccuuccaugaaugaccccucagucuggccuc

SEQ ID NO: 374988 - RNA, 32 nt, Human
cccuuccaugccagcccuuccugcugccuccc

SEQ ID NO: 374989 - RNA, 32 nt, Human
cccuucccacaugccugcgccugcugccugcu

SEQ ID NO: 374990 - RNA, 20 nt, Human
cccuucccaccccucacuca

SEQ ID NO: 374991 - RNA, 32 nt, Human
cccuucccagcaccuugugcccuugccaguga

SEQ ID NO: 374992 - RNA, 32 nt, Human
cccuucccagggcugaggggaggcagggaugu

SEQ ID NO: 374993 - RNA, 32 nt, Human
cccuucccagguuucugaacagccugggcacc

SEQ ID NO: 374994 - RNA, 32 nt, Human
cccuucccaucuugccacacggucuuuuucuu

SEQ ID NO: 374995 - RNA, 32 nt, Human
cccuucccauuuccuccccugccuccuuagaa

SEQ ID NO: 374996 - RNA, 32 nt, Human
cccuucccauuucuccccacuuucaucuaccu

SEQ ID NO: 374997 - RNA, 21 nt, Human
cccuuccccaaccauggcccc

SEQ ID NO: 374998 - RNA, 19 nt, Human
cccuuccccaauuugggga

SEQ ID NO: 374999 - RNA, 32 nt, Human
cccuuccccacaccggggagagcugcucggac

SEQ ID NO: 375000 - RNA, 21 nt, Human
cccuuccccacccccauccca

SEQ ID NO: 375001 - RNA, 24 nt, Human
cccuuccccacccucuggccccca

SEQ ID NO: 375002 - RNA, 17 nt, Human
cccuuccccacugccca

SEQ ID NO: 375003 - RNA, 21 nt, Human
cccuuccccacuuauccccca

SEQ ID NO: 375004 - RNA, 32 nt, Human
cccuuccccagaggaauuguggagacuguccc

SEQ ID NO: 375005 - RNA, 32 nt, Human
cccuuccccagaggcugguguccagaacucag

SEQ ID NO: 375006 - RNA, 32 nt, Human
cccuuccccagccucucgccugcacugaugca

SEQ ID NO: 375007 - RNA, 32 nt, Human
cccuuccccaggagcaaggaccaguuggggcg

SEQ ID NO: 375008 - RNA, 32 nt, Human
cccuuccccaggcugggagaaggggccguugg

SEQ ID NO: 375009 - RNA, 32 nt, Human
cccuuccccauggcugggggcugggguaggac

SEQ ID NO: 375010 - RNA, 22 nt, Human
cccuucccccaaacccuauccc

SEQ ID NO: 375011 - RNA, 22 nt, Human
cccuucccccaacuugacccca

SEQ ID NO: 375012 - RNA, 21 nt, Human
cccuucccccaccccaccccc

SEQ ID NO: 375013 - RNA, 21 nt, Human
cccuucccccauaagccucca

SEQ ID NO: 375014 - RNA, 24 nt, Human
cccuucccccaucauugggcccca

SEQ ID NO: 375015 - RNA, 32 nt, Human
cccuucccccuucccuccuucccuccccucuc

SEQ ID NO: 375016 - RNA, 32 nt, Human
cccuucccccuucuuaugccccucucagacca

SEQ ID NO: 375017 - RNA, 23 nt, Human
cccuucccccuuuuuguccccca

SEQ ID NO: 375018 - RNA, 21 nt, Human
cccuuccccgcccggccucca

SEQ ID NO: 375019 - RNA, 32 nt, Human
cccuuccccguccccugcagccugggucugga

SEQ ID NO: 375020 - RNA, 20 nt, Human
cccuuccccuagugaccccc

SEQ ID NO: 375021 - RNA, 32 nt, Human
cccuuccccucagcaggcggcucucuuugccu

SEQ ID NO: 375022 - RNA, 32 nt, Human
cccuuccccuccccuucuaccuccuccucggc

SEQ ID NO: 375023 - RNA, 22 nt, Human
cccuuccccucccuggcuccca

SEQ ID NO: 375024 - RNA, 22 nt, Human
cccuuccccucucuggcccuca

SEQ ID NO: 375025 - RNA, 32 nt, Human
cccuuccccugccuaguccccgccugagugcc

SEQ ID NO: 375026 - RNA, 32 nt, Human
cccuuccccugccuuuuccuccugagacuucu

SEQ ID NO: 375027 - RNA, 23 nt, Human
cccuuccccugcuuugaccccca

SEQ ID NO: 375028 - RNA, 22 nt, Human
cccuuccccuguguggcuccca

SEQ ID NO: 375029 - RNA, 32 nt, Human
cccuuccccuucaagcauuuuccucuucccuu

SEQ ID NO: 375030 - RNA, 32 nt, Human
cccuuccccuucuccccuguccucaccauaug

SEQ ID NO: 375031 - RNA, 32 nt, Human
cccuuccccuuuccuuaacccuuccuagagcg

SEQ ID NO: 375032 - RNA, 32 nt, Human
cccuuccccuuuucccaaccuggacuuguuuu

SEQ ID NO: 375033 - RNA, 32 nt, Human
cccuucccgagcugaagccacagaguaggaga

SEQ ID NO: 375034 - RNA, 32 nt, Human
cccuucccgccuuccaaaaccugcuuccuuca

SEQ ID NO: 375035 - RNA, 18 nt, Human
cccuucccucaagccagg

SEQ ID NO: 375036 - RNA, 32 nt, Human
cccuucccuccaauacaucuuauagggcugcu

SEQ ID NO: 375037 - RNA, 32 nt, Human
cccuucccuccaggagccagguagggccugag

SEQ ID NO: 375038 - RNA, 32 nt, Human
cccuucccuccccaucuccccuacuucccugg

SEQ ID NO: 375039 - RNA, 32 nt, Human
cccuucccucccccuucacccacucccuccag

SEQ ID NO: 375040 - RNA, 32 nt, Human
cccuucccucccccuuccucucuuccuuccuu

SEQ ID NO: 375041 - RNA, 32 nt, Human
cccuucccuccccguuuuucauggccugcuga

SEQ ID NO: 375042 - RNA, 21 nt, Human
cccuucccucuccucagccca

SEQ ID NO: 375043 - RNA, 32 nt, Human
cccuucccucuucccucucccucucucuggga

SEQ ID NO: 375044 - RNA, 32 nt, Human
cccuucccucuucuccuuacauauuauaggug

SEQ ID NO: 375045 - RNA, 32 nt, Human
cccuucccugccucuugccugugucccagccu

SEQ ID NO: 375046 - RNA, 32 nt, Human
cccuucccugcuccaucccuguggcaccauua

SEQ ID NO: 375047 - RNA, 32 nt, Human
cccuucccugcucccacccaccugacuccaaa

SEQ ID NO: 375048 - RNA, 32 nt, Human
cccuucccugcucugcugcauggggccccaug

SEQ ID NO: 375049 - RNA, 32 nt, Human
cccuucccugcucuuccaccaguaaaggcucc

SEQ ID NO: 375050 - RNA, 22 nt, Human
cccuucccuggcacagccccua

SEQ ID NO: 375051 - RNA, 32 nt, Human
cccuucccugucugcugagcccuggcccccug

SEQ ID NO: 375052 - RNA, 32 nt, Human
cccuucccuuccccucucccuucugccuuucc

SEQ ID NO: 375053 - RNA, 32 nt, Human
cccuucccuucccuggagcugcccugccuuuc

SEQ ID NO: 375054 - RNA, 32 nt, Human
cccuucccuucccuuccaucucuuccuuuccu

SEQ ID NO: 375055 - RNA, 32 nt, Human
cccuucccuucccuucccuuuccuuuucccuu

SEQ ID NO: 375056 - RNA, 32 nt, Human
cccuucccuucccuuuccuuuucccuuucccu

SEQ ID NO: 375057 - RNA, 32 nt, Human
cccuucccuuuccuguccuguccuuucuuucu

SEQ ID NO: 375058 - RNA, 32 nt, Human
cccuucccuuucucccuuggcuguucacccag

SEQ ID NO: 375059 - RNA, 23 nt, Human
cccuuccgauuccaccuccaccu

SEQ ID NO: 375060 - RNA, 23 nt, Human
cccuuccgauuccaccuccgccu

SEQ ID NO: 375061 - RNA, 32 nt, Human
cccuuccgcuccugcccagccugggggaagga

SEQ ID NO: 375062 - RNA, 32 nt, Human
cccuuccgucucuguuguauccuugaaaacca

SEQ ID NO: 375063 - RNA, 32 nt, Human
cccuuccgucuucucccucauccuuuccaaac

SEQ ID NO: 375064 - RNA, 32 nt, Human
cccuuccguucccucccugucagggcguaauu

SEQ ID NO: 375065 - RNA, 32 nt, Human
cccuuccuaagcugugggcacaguggccaggc

SEQ ID NO: 375066 - RNA, 32 nt, Human
cccuuccuauucuccugccaugggugcagacc

SEQ ID NO: 375067 - RNA, 17 nt, Human
cccuuccucacuggcca

SEQ ID NO: 375068 - RNA, 32 nt, Human
cccuuccucagugcccuaguggccacuuucag

SEQ ID NO: 375069 - RNA, 19 nt, Human
cccuuccuccaggggucuu

SEQ ID NO: 375070 - RNA, 32 nt, Human
cccuuccucccucccucccuccuccuccuucc

SEQ ID NO: 375071 - RNA, 32 nt, Human
cccuuccuccuggcaugguggaaagugcacug

SEQ ID NO: 375072 - RNA, 32 nt, Human
cccuuccucucacuccugccuccgcuggcuuu

SEQ ID NO: 375073 - RNA, 32 nt, Human
cccuuccucucagaccaguacgguggccgacg

SEQ ID NO: 375074 - RNA, 22 nt, Human
cccuuccucuccaccuccuccu

SEQ ID NO: 375075 - RNA, 32 nt, Human
cccuuccucuccaucucucccucucuccaaga

SEQ ID NO: 375076 - RNA, 32 nt, Human
cccuuccucucccaccaugcgaugagcauccu

SEQ ID NO: 375077 - RNA, 20 nt, Human
cccuuccucuccucacucug

SEQ ID NO: 375078 - RNA, 32 nt, Human
cccuuccucucugcuucccucccaggccucgc

SEQ ID NO: 375079 - RNA, 32 nt, Human
cccuuccucugggagcucugugccacugaggu

SEQ ID NO: 375080 - RNA, 32 nt, Human
cccuuccucuuuuccauugucuuuggcucuca

SEQ ID NO: 375081 - RNA, 25 nt, Human
cccuuccugagcuacauuaaggcuc

SEQ ID NO: 375082 - RNA, 32 nt, Human
cccuuccugcagccgccgccuccgaaggagcg

SEQ ID NO: 375083 - RNA, 32 nt, Human
cccuuccugcagcuaccuccgcacaaagagcu

SEQ ID NO: 375084 - RNA, 32 nt, Human
cccuuccugcagggaaccucaggcuucagaga

SEQ ID NO: 375085 - RNA, 32 nt, Human
cccuuccugccucccccaggguccuuucagag

SEQ ID NO: 375086 - RNA, 32 nt, Human
cccuuccugccugggccuccccuuggccuacc

SEQ ID NO: 375087 - RNA, 32 nt, Human
cccuuccugccuguaacccuuaccggcuccau

SEQ ID NO: 375088 - RNA, 32 nt, Human
cccuuccugcuuccuguuaccugucuugcucc

SEQ ID NO: 375089 - RNA, 21 nt, Human
cccuuccuggaagaaaacugg

SEQ ID NO: 375090 - RNA, 32 nt, Human
cccuuccuggacagcguaaggccuccacaucu

SEQ ID NO: 375091 - RNA, 32 nt, Human
cccuuccuguucucaccuggcuguggcuggcc

SEQ ID NO: 375092 - RNA, 32 nt, Human
cccuuccuuaauacugggugaugugugaauau

SEQ ID NO: 375093 - RNA, 32 nt, Human
cccuuccuuagguugaugugcuugggaaagcu

SEQ ID NO: 375094 - RNA, 32 nt, Human
cccuuccuuaugcauacugagauagcuuagug

SEQ ID NO: 375095 - RNA, 32 nt, Human
cccuuccuuaugucuccagucuggugccaggu

SEQ ID NO: 375096 - RNA, 21 nt, Human
cccuuccuucacccaccaccc

SEQ ID NO: 375097 - RNA, 32 nt, Human
cccuuccuucccggccauucucccucuuguuu

SEQ ID NO: 375098 - RNA, 32 nt, Human
cccuuccuuccucccuccuucucccucuccuu

SEQ ID NO: 375099 - RNA, 32 nt, Human
cccuuccuuccucccuugcccaaagauccuuu

SEQ ID NO: 375100 - RNA, 32 nt, Human
cccuuccuucuuucucccuccgccucccgagc

SEQ ID NO: 375101 - RNA, 18 nt, Human
cccuuccuuucccucuga

SEQ ID NO: 375102 - RNA, 32 nt, Human
cccuuccuuucugugucuccugccucaucggc

SEQ ID NO: 375103 - RNA, 32 nt, Human
cccuucgaaaaaugaucaacuauugccauaua

SEQ ID NO: 375104 - RNA, 32 nt, Human
cccuucgaguuucuaguuacagacacaaucau

SEQ ID NO: 375105 - RNA, 32 nt, Human
cccuucggcuggcgcccucccaugcucucggc

SEQ ID NO: 375106 - RNA, 32 nt, Human
cccuucggggcagaggagggcggggacucggg

SEQ ID NO: 375107 - RNA, 19 nt, Human
cccuucggugacucccugg

SEQ ID NO: 375108 - RNA, 32 nt, Human
cccuucggugugccacugaagauccugguguc

SEQ ID NO: 375109 - RNA, 32 nt, Human
cccuucggugugccacugaagauccugguguu

SEQ ID NO: 375110 - RNA, 32 nt, Human
cccuucguaccucugguccucucuccagcccu

SEQ ID NO: 375111 - RNA, 21 nt, Human
cccuucguccugccccuccuc

SEQ ID NO: 375112 - RNA, 32 nt, Human
cccuucgugugccccugcccagccucuuggca

SEQ ID NO: 375113 - RNA, 32 nt, Human
cccuucuaccugccacucacacagccaggugc

SEQ ID NO: 375114 - RNA, 32 nt, Human
cccuucuaccuuuugaagugauuugcaguuac

SEQ ID NO: 375115 - RNA, 32 nt, Human
cccuucuacugcacugcccaagguguguguag

SEQ ID NO: 375116 - RNA, 32 nt, Human
cccuucuacuguccucuuccccuuggcugugu

SEQ ID NO: 375117 - RNA, 32 nt, Human
cccuucuagaaauaggaggagccccaggaucu

SEQ ID NO: 375118 - RNA, 32 nt, Human
cccuucuagagcaaggaauugacuuuuaggag

SEQ ID NO: 375119 - RNA, 32 nt, Human
cccuucuaggacaaccccaccagcaaggaggu

SEQ ID NO: 375120 - RNA, 32 nt, Human
cccuucuauaugccaucucugaugggagccuc

SEQ ID NO: 375121 - RNA, 32 nt, Human
cccuucucaagacuuugagcaguuagaagugc

SEQ ID NO: 375122 - RNA, 32 nt, Human
cccuucucaaugaucacgucaggagacacaug

SEQ ID NO: 375123 - RNA, 32 nt, Human
cccuucucacugccacugcucuugccucuugu

SEQ ID NO: 375124 - RNA, 32 nt, Human
cccuucucaggggccccaccugacugaggcuu

SEQ ID NO: 375125 - RNA, 32 nt, Human
cccuucucaucaucuucaucucagcuauuaaa

SEQ ID NO: 375126 - RNA, 32 nt, Human
cccuucucauuucauaggcaucuauuccugcc

SEQ ID NO: 375127 - RNA, 32 nt, Human
cccuucucauuucccuuaaccuuaucuucaaa

SEQ ID NO: 375128 - RNA, 16 nt, Human
cccuucuccaccagau

SEQ ID NO: 375129 - RNA, 32 nt, Human
cccuucuccacugcccccuccugugucugggu

SEQ ID NO: 375130 - RNA, 32 nt, Human
cccuucuccaucgcccucucccagaaagcucc

SEQ ID NO: 375131 - RNA, 32 nt, Human
cccuucuccauuucguaccaucuguguuccac

SEQ ID NO: 375132 - RNA, 32 nt, Human
cccuucucccacacucguuucccuuugcucau

SEQ ID NO: 375133 - RNA, 32 nt, Human
cccuucucccacccucgcucgcguagccaugg

SEQ ID NO: 375134 - RNA, 32 nt, Human
cccuucuccccagccagagguggagccaagug

SEQ ID NO: 375135 - RNA, 32 nt, Human
cccuucucccccucccccucccccacuccccc

SEQ ID NO: 375136 - RNA, 32 nt, Human
cccuucucccggccccagccugccucccuccu

SEQ ID NO: 375137 - RNA, 32 nt, Human
cccuucucccugaggagccucagcuuucccuc

SEQ ID NO: 375138 - RNA, 32 nt, Human
cccuucuccgcagggcccuguggcucuggcag

SEQ ID NO: 375139 - RNA, 32 nt, Human
cccuucuccuccaauacauaaaggacacagac

SEQ ID NO: 375140 - RNA, 32 nt, Human
cccuucuccugccucagccucccgaguagcug

SEQ ID NO: 375141 - RNA, 32 nt, Human
cccuucuccuucccggccccaccaacacucug

SEQ ID NO: 375142 - RNA, 32 nt, Human
cccuucuccuuuccuuucuuuccuucagguca

SEQ ID NO: 375143 - RNA, 32 nt, Human
cccuucucguguuugcccaccgucuaggccau

SEQ ID NO: 375144 - RNA, 32 nt, Human
cccuucucuagaauccagcccagaucugaggc

SEQ ID NO: 375145 - RNA, 32 nt, Human
cccuucucuaugaaccuugugccuucuguccu

SEQ ID NO: 375146 - RNA, 32 nt, Human
cccuucucucuuuucuucucaggauuuaaaau

SEQ ID NO: 375147 - RNA, 32 nt, Human
cccuucucugcccauuccccagccucucuucc

SEQ ID NO: 375148 - RNA, 32 nt, Human
cccuucucugcuuaaagaaugcccuuuaugau

SEQ ID NO: 375149 - RNA, 32 nt, Human
cccuucucuuuuaauggagacagggucuugca

SEQ ID NO: 375150 - RNA, 32 nt, Human
cccuucugaaucagcugggaugacuggcuuug

SEQ ID NO: 375151 - RNA, 32 nt, Human
cccuucugacugccuuccauccacucucaccc

SEQ ID NO: 375152 - RNA, 32 nt, Human
cccuucugagccugugcagcugcuggagcacg

SEQ ID NO: 375153 - RNA, 32 nt, Human
cccuucugagguauggcccauccaagacuuuu

SEQ ID NO: 375154 - RNA, 32 nt, Human
cccuucugaguaccucucuggcugccaaauug

SEQ ID NO: 375155 - RNA, 32 nt, Human
cccuucugaugauuccaauguguuggaaaguu

SEQ ID NO: 375156 - RNA, 32 nt, Human
cccuucugcagcuuuccaaagcuacauugacg

SEQ ID NO: 375157 - RNA, 32 nt, Human
cccuucugcccagggcccaguguucuugauag

SEQ ID NO: 375158 - RNA, 32 nt, Human
cccuucugcccucucuccauugccugcacccc

SEQ ID NO: 375159 - RNA, 32 nt, Human
cccuucugcccuuaaaugcuuccuugggcaag

SEQ ID NO: 375160 - RNA, 32 nt, Human
cccuucugcgcugccccagagccugggaggga

SEQ ID NO: 375161 - RNA, 32 nt, Human
cccuucuggaacccuggaccuggaccugcugu

SEQ ID NO: 375162 - RNA, 32 nt, Human
cccuucuggaggcuggaggggagaggccaagc

SEQ ID NO: 375163 - RNA, 32 nt, Human
cccuucuggcaccagauggggcuugguuaguu

SEQ ID NO: 375164 - RNA, 32 nt, Human
cccuucuggccacuggcugugguggcuguagu

SEQ ID NO: 375165 - RNA, 32 nt, Human
cccuucuggccugcucccuuccuccuuggcuc

SEQ ID NO: 375166 - RNA, 32 nt, Human
cccuucuggccuuggugaucacuuuuucagga

SEQ ID NO: 375167 - RNA, 32 nt, Human
cccuucugggcaacgaagcaaugaaauuucca

SEQ ID NO: 375168 - RNA, 32 nt, Human
cccuucuguaggaaacagcagagaccaggugg

SEQ ID NO: 375169 - RNA, 32 nt, Human
cccuucugugaguagaugcacaccucugaggc

SEQ ID NO: 375170 - RNA, 32 nt, Human
cccuucugugcccauggucaggagcuauucgg

SEQ ID NO: 375171 - RNA, 32 nt, Human
cccuucuguggaauaugacagugucucuauuu

SEQ ID NO: 375172 - RNA, 32 nt, Human
cccuucuguucuguucauguagcacagauaag

SEQ ID NO: 375173 - RNA, 32 nt, Human
cccuucuuaccugaacaaccaugagcgcucca

SEQ ID NO: 375174 - RNA, 32 nt, Human
cccuucuucccaacuuccuacuuccuagcccu

SEQ ID NO: 375175 - RNA, 32 nt, Human
cccuucuucccuuuuauaguucaucagccaca

SEQ ID NO: 375176 - RNA, 32 nt, Human
cccuucuuccuuuccaaccccuuccuuccuuu

SEQ ID NO: 375177 - RNA, 32 nt, Human
cccuucuucuagcagucugugccuccucucug

SEQ ID NO: 375178 - RNA, 32 nt, Human
cccuucuucugaaucucugggcaguccccauu

SEQ ID NO: 375179 - RNA, 32 nt, Human
cccuucuucuuuccuuccucccucccucucuc

SEQ ID NO: 375180 - RNA, 32 nt, Human
cccuucuugcacugccaccucacuuuccacca

SEQ ID NO: 375181 - RNA, 32 nt, Human
cccuucuugcaggucucagcuugcgggguggg

SEQ ID NO: 375182 - RNA, 32 nt, Human
cccuucuugcccaggcuggagugcaagggcgc

SEQ ID NO: 375183 - RNA, 32 nt, Human
cccuucuugccucaccauuccccuaggcaggc

SEQ ID NO: 375184 - RNA, 32 nt, Human
cccuucuuguguccuggcuggcugggaugcug

SEQ ID NO: 375185 - RNA, 22 nt, Human
cccuucuuucugcccuuccuca

SEQ ID NO: 375186 - RNA, 32 nt, Human
cccuucuuucuuuccucuuuccccaggccgcc

SEQ ID NO: 375187 - RNA, 32 nt, Human
cccuucuuugggcucgggggcucccggagcag

SEQ ID NO: 375188 - RNA, 32 nt, Human
cccuugaacccccaugcaaugagcuucuaacu

SEQ ID NO: 375189 - RNA, 32 nt, Human
cccuugaacuucugcccucuguucagggcuga

SEQ ID NO: 375190 - RNA, 32 nt, Human
cccuugaagcacagcagauaagaguguugcug

SEQ ID NO: 375191 - RNA, 32 nt, Human
cccuugaaucuuccgcuuccuccccaccgauu

SEQ ID NO: 375192 - RNA, 28 nt, Human
cccuugacaggcugacuuugguggcuua

SEQ ID NO: 375193 - RNA, 32 nt, Human
cccuugaccaccucugggggccugucagccug

SEQ ID NO: 375194 - RNA, 32 nt, Human
cccuugacccagaacuuccuccccacaaaaau

SEQ ID NO: 375195 - RNA, 32 nt, Human
cccuugaccccaguccacaguggucacaggua

SEQ ID NO: 375196 - RNA, 21 nt, Human
cccuugaccccugggggccug

SEQ ID NO: 375197 - RNA, 22 nt, Human
cccuugacccuggcuggccugc

SEQ ID NO: 375198 - RNA, 32 nt, Human
cccuugacuccucugugcuuugguaauaaauu

SEQ ID NO: 375199 - RNA, 23 nt, Human
cccuugacuucugcuggguccua

SEQ ID NO: 375200 - RNA, 32 nt, Human
cccuugagaagcagauguaauuccuugaguga

SEQ ID NO: 375201 - RNA, 23 nt, Human
cccuugagaccaugcggugcaga

SEQ ID NO: 375202 - RNA, 32 nt, Human
cccuugagaccuggaaccagagccacaggccc

SEQ ID NO: 375203 - RNA, 32 nt, Human
cccuugagagaagaggcagcagcagcggcggc

SEQ ID NO: 375204 - RNA, 21 nt, Human
cccuugagaucgcggcaccgg

SEQ ID NO: 375205 - RNA, 32 nt, Human
cccuugagcccaggaagcagagguugcaguga

SEQ ID NO: 375206 - RNA, 32 nt, Human
cccuugagccuaggagguugaggcugcaguga

SEQ ID NO: 375207 - RNA, 21 nt, Human
cccuugagcugacuguggcug

SEQ ID NO: 375208 - RNA, 25 nt, Human
cccuugagcugcaccgcggcgcagg

SEQ ID NO: 375209 - RNA, 20 nt, Human
cccuugagcugcuucaguga

SEQ ID NO: 375210 - RNA, 32 nt, Human
cccuugaggaagcaagcuccacggccaccaua

SEQ ID NO: 375211 - RNA, 21 nt, Human
cccuugaggcggcggcacaga

SEQ ID NO: 375212 - RNA, 32 nt, Human
cccuugaggcuggggagcuccacuccuuggcu

SEQ ID NO: 375213 - RNA, 32 nt, Human
cccuugaggucucuccuuugagccguggucac

SEQ ID NO: 375214 - RNA, 32 nt, Human
cccuugaggugccuccucuccucugcccaggg

SEQ ID NO: 375215 - RNA, 32 nt, Human
cccuugaguccaggagguugaggcugcaguga

SEQ ID NO: 375216 - RNA, 32 nt, Human
cccuugagucuagacuguggccacagccucug

SEQ ID NO: 375217 - RNA, 32 nt, Human
cccuugaugagggaaaaugucccacugcacug

SEQ ID NO: 375218 - RNA, 32 nt, Human
cccuugauuucagcugaaaauauucaugucug

SEQ ID NO: 375219 - RNA, 32 nt, Human
cccuugcaacuuggcaucauccggagcuucuu

SEQ ID NO: 375220 - RNA, 32 nt, Human
cccuugcagccaucugaaaugguugugacaaa

SEQ ID NO: 375221 - RNA, 32 nt, Human
cccuugcagccugggcuguguaugccugcgga

SEQ ID NO: 375222 - RNA, 32 nt, Human
cccuugcaggagguggagguuguugguggagg

SEQ ID NO: 375223 - RNA, 32 nt, Human
cccuugcagggcagugaugaugacaugaaaug

SEQ ID NO: 375224 - RNA, 32 nt, Human
cccuugcaggguggccaaccaacagaacacca

SEQ ID NO: 375225 - RNA, 32 nt, Human
cccuugcagggugggugagcucucaggccgag

SEQ ID NO: 375226 - RNA, 32 nt, Human
cccuugcaucuuucugaacucuucuugauuuu

SEQ ID NO: 375227 - RNA, 32 nt, Human
cccuugcauuuuuguuuccauccucuucuuug

SEQ ID NO: 375228 - RNA, 32 nt, Human
cccuugccaaaaagauuuucuaauacugcuug

SEQ ID NO: 375229 - RNA, 32 nt, Human
cccuugccaaaauauuuagcaugugaaaaggu

SEQ ID NO: 375230 - RNA, 32 nt, Human
cccuugccacccaaauguuagaaaaauagcug

SEQ ID NO: 375231 - RNA, 32 nt, Human
cccuugccagaacccugcuucuucccagagac

SEQ ID NO: 375232 - RNA, 32 nt, Human
cccuugccagagccacugcagagucagacgca

SEQ ID NO: 375233 - RNA, 32 nt, Human
cccuugccagaucucccucccucucucugugc

SEQ ID NO: 375234 - RNA, 32 nt, Human
cccuugcccaggaggccuugccagccugugug

SEQ ID NO: 375235 - RNA, 19 nt, Human
cccuugcccaucagagagg

SEQ ID NO: 375236 - RNA, 32 nt, Human
cccuugcccauggucugucuaucucuuuccua

SEQ ID NO: 375237 - RNA, 23 nt, Human
cccuugcccauuuuuuaauaaua

SEQ ID NO: 375238 - RNA, 32 nt, Human
cccuugccccacugcaggcugccugggacgcc

SEQ ID NO: 375239 - RNA, 19 nt, Human
cccuugccccaguccugcc

SEQ ID NO: 375240 - RNA, 17 nt, Human
cccuugcccucuccuca

SEQ ID NO: 375241 - RNA, 32 nt, Human
cccuugcccugagcucuguucuccauggugcc

SEQ ID NO: 375242 - RNA, 28 nt, Human
cccuugcccugggcugccuccuccugag

SEQ ID NO: 375243 - RNA, 32 nt, Human
cccuugcccuguuuuucccucuuccagcugac

SEQ ID NO: 375244 - RNA, 32 nt, Human
cccuugccgccucccuccucugcccggccgca

SEQ ID NO: 375245 - RNA, 32 nt, Human
cccuugccggaggccagcuggcagggccuuuc

SEQ ID NO: 375246 - RNA, 32 nt, Human
cccuugccuagggggcagagggugcaguggca

SEQ ID NO: 375247 - RNA, 32 nt, Human
cccuugccucaagugagcuucaaccuuagccu

SEQ ID NO: 375248 - RNA, 32 nt, Human
cccuugccuccaccacccccuggcccugcacu

SEQ ID NO: 375249 - RNA, 32 nt, Human
cccuugccucucccccuccaccaccaccuugu

SEQ ID NO: 375250 - RNA, 32 nt, Human
cccuugccucuccuggauggguugucagcccu

SEQ ID NO: 375251 - RNA, 32 nt, Human
cccuugccucuucccuucccacuggugcauua

SEQ ID NO: 375252 - RNA, 32 nt, Human
cccuugccucuugugccccagcaccuucucuc

SEQ ID NO: 375253 - RNA, 32 nt, Human
cccuugccugccccucccuguggcagggcuaa

SEQ ID NO: 375254 - RNA, 32 nt, Human
cccuugccugggcaggagauaacugagccugu

SEQ ID NO: 375255 - RNA, 32 nt, Human
cccuugccuguagucucagcacuuugggaggc

SEQ ID NO: 375256 - RNA, 32 nt, Human
cccuugccuuccagauaaaguccauguuucuu

SEQ ID NO: 375257 - RNA, 32 nt, Human
cccuugccuuugccugcgcggcucagaaucac

SEQ ID NO: 375258 - RNA, 32 nt, Human
cccuugccuuuuccagcuucuggaggccaccc

SEQ ID NO: 375259 - RNA, 32 nt, Human
cccuugcgccucagcaguuugcagugggguaa

SEQ ID NO: 375260 - RNA, 32 nt, Human
cccuugcgccuucucccacagggcccagcccc

SEQ ID NO: 375261 - RNA, 32 nt, Human
cccuugcggcggugugaacguguguccgcagc

SEQ ID NO: 375262 - RNA, 32 nt, Human
cccuugcuaggagcaguugccagcaagcaucc

SEQ ID NO: 375263 - RNA, 32 nt, Human
cccuugcucccaucccugcagcaugaacaagg

SEQ ID NO: 375264 - RNA, 32 nt, Human
cccuugcuccccacagggagagaagagcucug

SEQ ID NO: 375265 - RNA, 32 nt, Human
cccuugcucgcuagaauaaacugcuuugcgcu

SEQ ID NO: 375266 - RNA, 32 nt, Human
cccuugcuggccccagcccugcuggggauccc

SEQ ID NO: 375267 - RNA, 32 nt, Human
cccuugcuuaccucucagccuuagcucuccca

SEQ ID NO: 375268 - RNA, 32 nt, Human
cccuugcuucuguuuucuaccucuccaggccu

SEQ ID NO: 375269 - RNA, 32 nt, Human
cccuugcuugcaucuuccaaagcuauuucgaa

SEQ ID NO: 375270 - RNA, 32 nt, Human
cccuugcuugccaaauugcaggcaagaagaag

SEQ ID NO: 375271 - RNA, 32 nt, Human
cccuuggaaagaaauguagaugauauguuucg

SEQ ID NO: 375272 - RNA, 32 nt, Human
cccuuggaaucagagcaaugugucuucuuucc

SEQ ID NO: 375273 - RNA, 32 nt, Human
cccuuggaaugagggaggucucaagagauaua

SEQ ID NO: 375274 - RNA, 22 nt, Human
cccuuggacacgcucagugggg

SEQ ID NO: 375275 - RNA, 32 nt, Human
cccuuggacauaugugaaaucuuuuugucuuu

SEQ ID NO: 375276 - RNA, 22 nt, Human
cccuuggacucucagaugcagg

SEQ ID NO: 375277 - RNA, 32 nt, Human
cccuuggacucugccaggaucaacugcccaga

SEQ ID NO: 375278 - RNA, 32 nt, Human
cccuuggacucugccugggcuggagucuaggg

SEQ ID NO: 375279 - RNA, 23 nt, Human
cccuuggagaucuugcagcugga

SEQ ID NO: 375280 - RNA, 32 nt, Human
cccuuggaggaaccaaaggcugugcauuguua

SEQ ID NO: 375281 - RNA, 22 nt, Human
cccuuggaggcaggcagugagg

SEQ ID NO: 375282 - RNA, 32 nt, Human
cccuuggagggugccagguguguggugaccuu

SEQ ID NO: 375283 - RNA, 32 nt, Human
cccuuggaguguugguggagaucagagugccg

SEQ ID NO: 375284 - RNA, 32 nt, Human
cccuuggauagagagggaaacugaggccagca

SEQ ID NO: 375285 - RNA, 32 nt, Human
cccuuggauuucuucagccagcugcugaagua

SEQ ID NO: 375286 - RNA, 32 nt, Human
cccuuggcaaaugaaaguuuuauuuucguuug

SEQ ID NO: 375287 - RNA, 32 nt, Human
cccuuggcaaccacuaaucugccuucuaucuc

SEQ ID NO: 375288 - RNA, 32 nt, Human
cccuuggcagcagagaaaacccacugaaagau

SEQ ID NO: 375289 - RNA, 32 nt, Human
cccuuggcaggcgauacggcagcucugugccc

SEQ ID NO: 375290 - RNA, 26 nt, Human
cccuuggccaaguggaucacuugagg

SEQ ID NO: 375291 - RNA, 22 nt, Human
cccuuggccacucuugggacuu

SEQ ID NO: 375292 - RNA, 32 nt, Human
cccuuggccauccuggcccucccaggagaagc

SEQ ID NO: 375293 - RNA, 32 nt, Human
cccuuggcccaggaggcagagguugcagugag

SEQ ID NO: 375294 - RNA, 32 nt, Human
cccuuggcccccuccccucccccagaccucca

SEQ ID NO: 375295 - RNA, 32 nt, Human
cccuuggccgcagaggccucagcccuggggag

SEQ ID NO: 375296 - RNA, 18 nt, Human
cccuuggccggugaaaga

SEQ ID NO: 375297 - RNA, 32 nt, Human
cccuuggccugaguaaacuuggaaaggggcuc

SEQ ID NO: 375298 - RNA, 24 nt, Human
cccuuggccuggaccuggggccug

SEQ ID NO: 375299 - RNA, 32 nt, Human
cccuuggccuuuccaccucccuccuuggggcu

SEQ ID NO: 375300 - RNA, 20 nt, Human
cccuuggcggccguggagcc

SEQ ID NO: 375301 - RNA, 32 nt, Human
cccuuggcucaccuuucucuccucagcagaac

SEQ ID NO: 375302 - RNA, 32 nt, Human
cccuuggcucagaguguggugcuagaaacugg

SEQ ID NO: 375303 - RNA, 32 nt, Human
cccuuggcuccugcuuucugcuugggcccugc

SEQ ID NO: 375304 - RNA, 25 nt, Human
cccuuggcucuccaccugggauuug

SEQ ID NO: 375305 - RNA, 32 nt, Human
cccuuggcugaugccuccucugggucacauug

SEQ ID NO: 375306 - RNA, 22 nt, Human
cccuuggcuggagaagaccggg

SEQ ID NO: 375307 - RNA, 32 nt, Human
cccuuggcugugaugccccucucccgauuucc

SEQ ID NO: 375308 - RNA, 32 nt, Human
cccuuggcuucccaggaagaccaccugcuuuu

SEQ ID NO: 375309 - RNA, 32 nt, Human
cccuuggcuucuccucccucuacucagccuua

SEQ ID NO: 375310 - RNA, 20 nt, Human
cccuuggcuugcccuccuca

SEQ ID NO: 375311 - RNA, 32 nt, Human
cccuugggacaguaguguuugggugaauguua

SEQ ID NO: 375312 - RNA, 32 nt, Human
cccuugggagacaggaacuggcgaguucaggu

SEQ ID NO: 375313 - RNA, 32 nt, Human
cccuugggagcugacagcccaugggcauuaag

SEQ ID NO: 375314 - RNA, 32 nt, Human
cccuugggaggaacaacaugagcucaggaagc

SEQ ID NO: 375315 - RNA, 32 nt, Human
cccuugggaggcggguggaggagcagcagagg

SEQ ID NO: 375316 - RNA, 25 nt, Human
cccuugggaucuaccuugggucuua

SEQ ID NO: 375317 - RNA, 22 nt, Human
cccuugggcauaucagugacag

SEQ ID NO: 375318 - RNA, 21 nt, Human
cccuugggccccugggagcca

SEQ ID NO: 375319 - RNA, 32 nt, Human
cccuugggcccugccuggagugugugccgccu

SEQ ID NO: 375320 - RNA, 32 nt, Human
cccuugggcucccuccugccuccucucucucc

SEQ ID NO: 375321 - RNA, 22 nt, Human
cccuugggcuguggcagcagga

SEQ ID NO: 375322 - RNA, 32 nt, Human
cccuugggcuucaggcuccugagcuggcagca

SEQ ID NO: 375323 - RNA, 20 nt, Human
cccuugggcuuugaaagcca

SEQ ID NO: 375324 - RNA, 22 nt, Human
cccuuggggccaaaaaacaggg

SEQ ID NO: 375325 - RNA, 22 nt, Human
cccuugggucagacuggagcca

SEQ ID NO: 375326 - RNA, 22 nt, Human
cccuugggucugcaaggagcca

SEQ ID NO: 375327 - RNA, 32 nt, Human
cccuugggugcaugagucacagcauggaucca

SEQ ID NO: 375328 - RNA, 21 nt, Human
cccuugggugccccacacagg

SEQ ID NO: 375329 - RNA, 22 nt, Human
cccuuggguugcugcugagcca

SEQ ID NO: 375330 - RNA, 22 nt, Human
cccuuggguuugggaagaggca

SEQ ID NO: 375331 - RNA, 24 nt, Human
cccuuggguuuucuuuugauacca

SEQ ID NO: 375332 - RNA, 24 nt, Human
cccuuggguuuuuguacgaagcua

SEQ ID NO: 375333 - RNA, 32 nt, Human
cccuugguagaauccauauacaauauggauug

SEQ ID NO: 375334 - RNA, 32 nt, Human
cccuuggugaagcagaggcugaaggaaagggg

SEQ ID NO: 375335 - RNA, 32 nt, Human
cccuuggugaagccgugccagggggcucagcu

SEQ ID NO: 375336 - RNA, 32 nt, Human
cccuuggugagguggucaugcccgggcaaagg

SEQ ID NO: 375337 - RNA, 25 nt, Human
cccuuguaaaaccccgcaguacagg

SEQ ID NO: 375338 - RNA, 32 nt, Human
cccuuguagcaguuuucagccuccucuacccu

SEQ ID NO: 375339 - RNA, 32 nt, Human
cccuuguagcuggagagaagugucacauuuug

SEQ ID NO: 375340 - RNA, 32 nt, Human
cccuuguagucucuuauauaaguagaguccuu

SEQ ID NO: 375341 - RNA, 32 nt, Human
cccuuguauaccacugugcuugcacuacauca

SEQ ID NO: 375342 - RNA, 32 nt, Human
cccuugucaaagugcuugacugcaugcuggaa

SEQ ID NO: 375343 - RNA, 32 nt, Human
cccuugucacacuguucacaccugcccggcug

SEQ ID NO: 375344 - RNA, 32 nt, Human
cccuugucacccacgcagaggcagugucauga

SEQ ID NO: 375345 - RNA, 32 nt, Human
cccuugucacccaggcuguagugcgguggcgc

SEQ ID NO: 375346 - RNA, 32 nt, Human
cccuugucauuucccccagugagcucugauuu

SEQ ID NO: 375347 - RNA, 32 nt, Human
cccuuguccaccccucuccacaccccuuccag

SEQ ID NO: 375348 - RNA, 32 nt, Human
cccuugucccacuugccuaaucuccagcccag

SEQ ID NO: 375349 - RNA, 32 nt, Human
cccuuguccccacucccuucccaaguuccuuu

SEQ ID NO: 375350 - RNA, 32 nt, Human
cccuugucucaccaccaaccuugcuuguguag

SEQ ID NO: 375351 - RNA, 32 nt, Human
cccuugucucccucuucucuccuuugcaaaug

SEQ ID NO: 375352 - RNA, 32 nt, Human
cccuugucuccuagagaaagggacagggaauc

SEQ ID NO: 375353 - RNA, 32 nt, Human
cccuugucucuaccuuugcuuuccagggaagg

SEQ ID NO: 375354 - RNA, 18 nt, Human
cccuugucugggggguuu

SEQ ID NO: 375355 - RNA, 32 nt, Human
cccuugucuuugccaaguucuccacuagcuau

SEQ ID NO: 375356 - RNA, 32 nt, Human
cccuugugaugcuugucaucagucccauccca

SEQ ID NO: 375357 - RNA, 32 nt, Human
cccuugugcagagggagaaaugguuuuguuuu

SEQ ID NO: 375358 - RNA, 23 nt, Human
cccuugugcagauccagcaugga

SEQ ID NO: 375359 - RNA, 32 nt, Human
cccuugugccugauaccugcacuccggcuucc

SEQ ID NO: 375360 - RNA, 32 nt, Human
cccuugugccuuagccucaugggcugccuagg

SEQ ID NO: 375361 - RNA, 32 nt, Human
cccuugugcuccccacccccuaccuccaccug

SEQ ID NO: 375362 - RNA, 32 nt, Human
cccuuguggccaacucccuccccuucucacug

SEQ ID NO: 375363 - RNA, 30 nt, Human
cccuuguggcuuccuuagcuccuguucuug

SEQ ID NO: 375364 - RNA, 21 nt, Human
cccuuguggcuuugggaccua

SEQ ID NO: 375365 - RNA, 31 nt, Human
cccuugugguuucagcacagaaccugaaugc

SEQ ID NO: 375366 - RNA, 23 nt, Human
cccuuguguaaaguuacgaaaaa

SEQ ID NO: 375367 - RNA, 32 nt, Human
cccuugugugggaacaggugcuccccaaacac

SEQ ID NO: 375368 - RNA, 32 nt, Human
cccuuguguguaugugacagcguguauguaac

SEQ ID NO: 375369 - RNA, 32 nt, Human
cccuugugugugucccucugcccagcuccugc

SEQ ID NO: 375370 - RNA, 32 nt, Human
cccuuguguuggggugguauccagcauagcag

SEQ ID NO: 375371 - RNA, 32 nt, Human
cccuuguguuucacuccaccaccaaccccagg

SEQ ID NO: 375372 - RNA, 32 nt, Human
cccuuguuagauucagaggagcggccagaaga

SEQ ID NO: 375373 - RNA, 32 nt, Human
cccuuguucagaaauggccacuguaggaaagc

SEQ ID NO: 375374 - RNA, 32 nt, Human
cccuuguuccaggggugccugagccccuucaa

SEQ ID NO: 375375 - RNA, 32 nt, Human
cccuuguuccaucagaagcugcagugacucuu

SEQ ID NO: 375376 - RNA, 32 nt, Human
cccuuguugcccaggcuggagugcaauggcgc

SEQ ID NO: 375377 - RNA, 32 nt, Human
cccuuguugcccaggcuggagugcaauggcgu

SEQ ID NO: 375378 - RNA, 32 nt, Human
cccuuguugcccaggcuguaguacaauggcau

SEQ ID NO: 375379 - RNA, 32 nt, Human
cccuuguugccuggugaaccugcagggagggu

SEQ ID NO: 375380 - RNA, 32 nt, Human
cccuuguuggagauggaggcagcagacgugca

SEQ ID NO: 375381 - RNA, 20 nt, Human
cccuuguuggggagugggug

SEQ ID NO: 375382 - RNA, 18 nt, Human
cccuuguuuaaagauaaa

SEQ ID NO: 375383 - RNA, 32 nt, Human
cccuuguuuccuccaaaacaaacgacagcaac

SEQ ID NO: 375384 - RNA, 32 nt, Human
cccuuguuugaugagaggaaugagcagagcau

SEQ ID NO: 375385 - RNA, 32 nt, Human
cccuuguuuucccagccucucuuccaaauuuc

SEQ ID NO: 375386 - RNA, 31 nt, Human
cccuuguuuucuuucuguugccaaaggcaga

SEQ ID NO: 375387 - RNA, 32 nt, Human
cccuuuaaaauggaauauuaauuugaaaauua

SEQ ID NO: 375388 - RNA, 32 nt, Human
cccuuuacagcucuccuccagcccugggcaca

SEQ ID NO: 375389 - RNA, 32 nt, Human
cccuuuacauuuucuucuugauuuccuuucau

SEQ ID NO: 375390 - RNA, 32 nt, Human
cccuuuacuccugggaacuuugcagcugcccu

SEQ ID NO: 375391 - RNA, 32 nt, Human
cccuuuacuugucuuucugggguuuuucuguu

SEQ ID NO: 375392 - RNA, 32 nt, Human
cccuuuagaaacucucucccugcuguauauua

SEQ ID NO: 375393 - RNA, 32 nt, Human
cccuuuagaucuugauuuccuggucguuucuc

SEQ ID NO: 375394 - RNA, 32 nt, Human
cccuuuagauuuccaaaacacaauucuuauuu

SEQ ID NO: 375395 - RNA, 21 nt, Human
cccuuuagcccuugguucuuu

SEQ ID NO: 375396 - RNA, 32 nt, Human
cccuuuagccuuccaccuuucccuucuccucu

SEQ ID NO: 375397 - RNA, 23 nt, Human
cccuuuaguaacacuucugaaga

SEQ ID NO: 375398 - RNA, 32 nt, Human
cccuuuagucacccuuccuguggccuaacacu

SEQ ID NO: 375399 - RNA, 32 nt, Human
cccuuuagugcagggcucugcauuuacugugg

SEQ ID NO: 375400 - RNA, 32 nt, Human
cccuuuaucaguggaauggacagagcagcucu

SEQ ID NO: 375401 - RNA, 32 nt, Human
cccuuucacagcugauuauuucuguguccccu

SEQ ID NO: 375402 - RNA, 32 nt, Human
cccuuucacuguauguccucugaccccuuugg

SEQ ID NO: 375403 - RNA, 32 nt, Human
cccuuucacuucuguucucugcugcagaaagc

SEQ ID NO: 375404 - RNA, 32 nt, Human
ccgcugccugccgggcccucucuucugggacc

SEQ ID NO: 375405 - RNA, 19 nt, Human
ccgcugccuggcccgcgcc

SEQ ID NO: 375406 - RNA, 32 nt, Human
ccgcugccuggcguuccccagcacucggugug

SEQ ID NO: 375407 - RNA, 21 nt, Human
ccgcugccuucaccgccccga

SEQ ID NO: 375408 - RNA, 32 nt, Human
ccgcugccuugccugcacuggcauguccaugu

SEQ ID NO: 375409 - RNA, 32 nt, Human
ccgcugcgacccggcccugcaggcuccaggcg

SEQ ID NO: 375410 - RNA, 20 nt, Human
ccgcugcgccgccccugggc

SEQ ID NO: 375411 - RNA, 20 nt, Human
ccgcugcgccuguccgggcc

SEQ ID NO: 375412 - RNA, 23 nt, Human
ccgcugcgcgcggcuccugggcu

SEQ ID NO: 375413 - RNA, 20 nt, Human
ccgcugcgggaguccgagcc

SEQ ID NO: 375414 - RNA, 32 nt, Human
ccgcugcgggcugagggaggugcagggccuuc

SEQ ID NO: 375415 - RNA, 23 nt, Human
ccgcugcguccccuucccgggcu

SEQ ID NO: 375416 - RNA, 18 nt, Human
ccgcugcgucgcucggcu

SEQ ID NO: 375417 - RNA, 21 nt, Human
ccgcugcgucgucccugggcc

SEQ ID NO: 375418 - RNA, 32 nt, Human
ccgcugcguguuuuccucuugaucgggaacuc

SEQ ID NO: 375419 - RNA, 23 nt, Human
ccgcugcuaaucuccccugggcc

SEQ ID NO: 375420 - RNA, 17 nt, Human
ccgcugcuacggcggcc

SEQ ID NO: 375421 - RNA, 19 nt, Human
ccgcugcuaggacccgggc

SEQ ID NO: 375422 - RNA, 18 nt, Human
ccgcugcucaccccggcc

SEQ ID NO: 375423 - RNA, 32 nt, Human
ccgcugcuccacccucuggcccgguauccugc

SEQ ID NO: 375424 - RNA, 18 nt, Human
ccgcugcuccagcagccg

SEQ ID NO: 375425 - RNA, 23 nt, Human
ccgcugcucccaccucugggccg

SEQ ID NO: 375426 - RNA, 21 nt, Human
ccgcugcucccggaccgggcc

SEQ ID NO: 375427 - RNA, 20 nt, Human
ccgcugcucccggaggagcu

SEQ ID NO: 375428 - RNA, 17 nt, Human
ccgcugcuccgccgggc

SEQ ID NO: 375429 - RNA, 32 nt, Human
ccgcugcuccuccgccuggccugggccgucug

SEQ ID NO: 375430 - RNA, 17 nt, Human
ccgcugcuccugaaguu

SEQ ID NO: 375431 - RNA, 18 nt, Human
ccgcugcuccugccgggu

SEQ ID NO: 375432 - RNA, 32 nt, Human
ccgcugcuccuggagucuuggggagggguccg

SEQ ID NO: 375433 - RNA, 18 nt, Human
ccgcugcucgcagggcua

SEQ ID NO: 375434 - RNA, 19 nt, Human
ccgcugcucgcccaccgcc

SEQ ID NO: 375435 - RNA, 18 nt, Human
ccgcugcucgcgccugcc

SEQ ID NO: 375436 - RNA, 32 nt, Human
ccgcugcucgggcuggagaauagaugguuuug

SEQ ID NO: 375437 - RNA, 16 nt, Human
ccgcugcucgggggcc

SEQ ID NO: 375438 - RNA, 19 nt, Human
ccgcugcucguggcccggc

SEQ ID NO: 375439 - RNA, 18 nt, Human
ccgcugcucucacgagcc

SEQ ID NO: 375440 - RNA, 20 nt, Human
ccgcugcucucagcugggcc

SEQ ID NO: 375441 - RNA, 21 nt, Human
ccgcugcucucagcugggccc

SEQ ID NO: 375442 - RNA, 24 nt, Human
ccgcugcugcccugcugccccccu

SEQ ID NO: 375443 - RNA, 18 nt, Human
ccgcugcugccuccagcu

SEQ ID NO: 375444 - RNA, 32 nt, Human
ccgcugcugccuggcagcgccuggcacggcug

SEQ ID NO: 375445 - RNA, 19 nt, Human
ccgcugcugcgcugggccg

SEQ ID NO: 375446 - RNA, 16 nt, Human
ccgcugcugcggggcu

SEQ ID NO: 375447 - RNA, 32 nt, Human
ccgcugcugcugacacucgcucccaggcugca

SEQ ID NO: 375448 - RNA, 32 nt, Human
ccgcugcugcugccgccagccuagagccgccc

SEQ ID NO: 375449 - RNA, 32 nt, Human
ccgcugcuggagcuucuguugcugugaauacu

SEQ ID NO: 375450 - RNA, 32 nt, Human
ccgcugcuguccuggaggccuuggggaggccc

SEQ ID NO: 375451 - RNA, 21 nt, Human
ccgcugcugugcauuggguua

SEQ ID NO: 375452 - RNA, 20 nt, Human
ccgcugcugugccucgggcu

SEQ ID NO: 375453 - RNA, 18 nt, Human
ccgcugcugugcugggcc

SEQ ID NO: 375454 - RNA, 32 nt, Human
ccgcugcuucccucaccugccugccugucucc

SEQ ID NO: 375455 - RNA, 19 nt, Human
ccgcugcuucgcagggaca

SEQ ID NO: 375456 - RNA, 21 nt, Human
ccgcugcuucuuucccgagcu

SEQ ID NO: 375457 - RNA, 17 nt, Human
ccgcugcuugccaagcu

SEQ ID NO: 375458 - RNA, 20 nt, Human
ccgcugcuugccgcccccca

SEQ ID NO: 375459 - RNA, 20 nt, Human
ccgcugcuugcgcagcggcc

SEQ ID NO: 375460 - RNA, 32 nt, Human
ccgcugcuuuacggcugccucucccagacuag

SEQ ID NO: 375461 - RNA, 20 nt, Human
ccgcugcuuuucuccgaguc

SEQ ID NO: 375462 - RNA, 21 nt, Human
ccgcuggaagccaccgggcca

SEQ ID NO: 375463 - RNA, 32 nt, Human
ccgcuggagaaggguggggcuccucugagccu

SEQ ID NO: 375464 - RNA, 20 nt, Human
ccgcuggagagccccgagcu

SEQ ID NO: 375465 - RNA, 32 nt, Human
ccgcuggagcuccuacauggugcacuggaaga

SEQ ID NO: 375466 - RNA, 32 nt, Human
ccgcuggaggucgccgaggagccacagggcug

SEQ ID NO: 375467 - RNA, 21 nt, Human
ccgcuggccagcccugggcca

SEQ ID NO: 375468 - RNA, 32 nt, Human
ccgcuggcccaggucuccucuccagucccccu

SEQ ID NO: 375469 - RNA, 32 nt, Human
ccgcuggccccuccucugaauuuuaggauguc

SEQ ID NO: 375470 - RNA, 20 nt, Human
ccgcuggcgaccgcugagcc

SEQ ID NO: 375471 - RNA, 17 nt, Human
ccgcuggcgccccgggc

SEQ ID NO: 375472 - RNA, 32 nt, Human
ccgcuggcucccgccucauuucagcccagggu

SEQ ID NO: 375473 - RNA, 32 nt, Human
ccgcuggcugcagauggcugaccugcgggcgg

SEQ ID NO: 375474 - RNA, 32 nt, Human
ccgcuggcugggguucucugcagcccaggacu

SEQ ID NO: 375475 - RNA, 32 nt, Human
ccgcugggaagaggggacucgggaggacagcc

SEQ ID NO: 375476 - RNA, 22 nt, Human
ccgcugggagaaaagccagaug

SEQ ID NO: 375477 - RNA, 22 nt, Human
ccgcugggcugcugcucccccu

SEQ ID NO: 375478 - RNA, 32 nt, Human
ccgcugggcuggagaagccacugugggcacca

SEQ ID NO: 375479 - RNA, 32 nt, Human
ccgcuggggacagacaggaugggcagcagcuc

SEQ ID NO: 375480 - RNA, 32 nt, Human
ccgcuggggacugggcccugcucgcaugccgc

SEQ ID NO: 375481 - RNA, 18 nt, Human
ccgcugggucccagcgag

SEQ ID NO: 375482 - RNA, 32 nt, Human
ccgcuggguuccgucucuccuuccgcuucuuu

SEQ ID NO: 375483 - RNA, 17 nt, Human
ccgcuggguucugagcc

SEQ ID NO: 375484 - RNA, 25 nt, Human
ccgcugguacaauuuacccugugga

SEQ ID NO: 375485 - RNA, 32 nt, Human
ccgcuggucccaggcuggauugccguggcaca

SEQ ID NO: 375486 - RNA, 17 nt, Human
ccgcuggugcccugagc

SEQ ID NO: 375487 - RNA, 32 nt, Human
ccgcuggugucacuauggccugggugagaggc

SEQ ID NO: 375488 - RNA, 32 nt, Human
ccgcugguuccaccaagcacagucaaggucuc

SEQ ID NO: 375489 - RNA, 32 nt, Human
ccgcugguucccgaaggcagaucccuucuccc

SEQ ID NO: 375490 - RNA, 20 nt, Human
ccgcugguuccgcuggguca

SEQ ID NO: 375491 - RNA, 24 nt, Human
ccgcugguuccucgcuccggggcg

SEQ ID NO: 375492 - RNA, 32 nt, Human
ccgcuguaugcccuuuuuccuucuaagucaug

SEQ ID NO: 375493 - RNA, 32 nt, Human
ccgcugucaccaaggagcccauguggacacac

SEQ ID NO: 375494 - RNA, 21 nt, Human
ccgcugucaccgcccagagcu

SEQ ID NO: 375495 - RNA, 32 nt, Human
ccgcugucccgcccucucccgcugccgccgcc

SEQ ID NO: 375496 - RNA, 32 nt, Human
ccgcugucccucugcacucccugccuuggugc

SEQ ID NO: 375497 - RNA, 20 nt, Human
ccgcuguccggcccccgagc

SEQ ID NO: 375498 - RNA, 20 nt, Human
ccgcugucggacucugggcc

SEQ ID NO: 375499 - RNA, 22 nt, Human
ccgcugucgugugucugagcca

SEQ ID NO: 375500 - RNA, 32 nt, Human
ccgcugucucugcuauuuccauccuccccaua

SEQ ID NO: 375501 - RNA, 32 nt, Human
ccgcugugaccucaccagccaugccagcgccc

SEQ ID NO: 375502 - RNA, 18 nt, Human
ccgcugugcagugucaug

SEQ ID NO: 375503 - RNA, 21 nt, Human
ccgcugugcccgcccugggcu

SEQ ID NO: 375504 - RNA, 32 nt, Human
ccgcugugcuuccucugcaguaugaagacuuu

SEQ ID NO: 375505 - RNA, 32 nt, Human
ccgcuguggaagcuuuguccuuuugcucuuca

SEQ ID NO: 375506 - RNA, 19 nt, Human
ccgcuguggcacugggcca

SEQ ID NO: 375507 - RNA, 23 nt, Human
ccgcuguguaggcaccugaguua

SEQ ID NO: 375508 - RNA, 19 nt, Human
ccgcugugucgcccugagc

SEQ ID NO: 375509 - RNA, 32 nt, Human
ccgcuguucaugucuggacuccugggggcgcu

SEQ ID NO: 375510 - RNA, 20 nt, Human
ccgcuguuccucagcgggcc

SEQ ID NO: 375511 - RNA, 18 nt, Human
ccgcuguucgacugccca

SEQ ID NO: 375512 - RNA, 32 nt, Human
ccgcuguucgacugcccaaccuggugaguggc

SEQ ID NO: 375513 - RNA, 19 nt, Human
ccgcuguucgccgcgggcu

SEQ ID NO: 375514 - RNA, 19 nt, Human
ccgcuguucgcucucgccg

SEQ ID NO: 375515 - RNA, 19 nt, Human
ccgcuguucuccuagguca

SEQ ID NO: 375516 - RNA, 21 nt, Human
ccgcuguucuuaauccgggcc

SEQ ID NO: 375517 - RNA, 17 nt, Human
ccgcuguugccgcggcu

SEQ ID NO: 375518 - RNA, 22 nt, Human
ccgcuguuuccgcugcugagcc

SEQ ID NO: 375519 - RNA, 32 nt, Human
ccgcuucaacaucagcugccucugcuaugacc

SEQ ID NO: 375520 - RNA, 32 nt, Human
ccgcuucaucccucucaaguauggcucagcua

SEQ ID NO: 375521 - RNA, 32 nt, Human
ccgcuuccaccaacauccagaauccauugagg

SEQ ID NO: 375522 - RNA, 32 nt, Human
ccgcuuccagaggcgcaugcagcggcugauag

SEQ ID NO: 375523 - RNA, 23 nt, Human
ccgcuuccagcuuccucugagcc

SEQ ID NO: 375524 - RNA, 32 nt, Human
ccgcuuccauggucuugcacuauaaacuggaa

SEQ ID NO: 375525 - RNA, 32 nt, Human
ccgcuucccaggcuggggugcaguggugcgau

SEQ ID NO: 375526 - RNA, 32 nt, Human
ccgcuucccucaccuccuuuuccagccuuugc

SEQ ID NO: 375527 - RNA, 15 nt, Human
ccgcuucccucggug

SEQ ID NO: 375528 - RNA, 18 nt, Human
ccgcuucccucuccauga

SEQ ID NO: 375529 - RNA, 32 nt, Human
ccgcuucccuuccauuuccuuucuagaaaacc

SEQ ID NO: 375530 - RNA, 32 nt, Human
ccgcuucccuucccugaacucuuccagcgucg

SEQ ID NO: 375531 - RNA, 32 nt, Human
ccgcuuccggcagcucaccugggaagcgcuca

SEQ ID NO: 375532 - RNA, 15 nt, Human
ccgcuuccucaggug

SEQ ID NO: 375533 - RNA, 32 nt, Human
ccgcuuccuccccuucagucagcucccucugu

SEQ ID NO: 375534 - RNA, 25 nt, Human
ccgcuuccuggagguuugcagugag

SEQ ID NO: 375535 - RNA, 20 nt, Human
ccgcuucucugcccgaguua

SEQ ID NO: 375536 - RNA, 32 nt, Human
ccgcuucugaagcugcugcagcucccuccuca

SEQ ID NO: 375537 - RNA, 32 nt, Human
ccgcuucugcaaccugcgagccugcccagugc

SEQ ID NO: 375538 - RNA, 32 nt, Human
ccgcuucugccuggcuuuccggcuuaauuuuc

SEQ ID NO: 375539 - RNA, 32 nt, Human
ccgcuucugccugggcuccugccauggccccc

SEQ ID NO: 375540 - RNA, 18 nt, Human
ccgcuugccagaggcccu

SEQ ID NO: 375541 - RNA, 20 nt, Human
ccgcuugccccuuguucucc

SEQ ID NO: 375542 - RNA, 32 nt, Human
ccgcuugccugcacuccauccugucugcaacg

SEQ ID NO: 375543 - RNA, 23 nt, Human
ccgcuugcuccccagcccaccca

SEQ ID NO: 375544 - RNA, 32 nt, Human
ccgcuugcugccugucugcuuuccuugguggc

SEQ ID NO: 375545 - RNA, 32 nt, Human
ccgcuuggcuucuucuuuaggauugugauggu

SEQ ID NO: 375546 - RNA, 32 nt, Human
ccgcuugggaggcugagccaggagaauugcuu

SEQ ID NO: 375547 - RNA, 32 nt, Human
ccgcuugguggaggucgagugggugcaagggc

SEQ ID NO: 375548 - RNA, 32 nt, Human
ccgcuuguacccaggagguggagguugcagug

SEQ ID NO: 375549 - RNA, 32 nt, Human
ccgcuugugcugcagccaugucucuagugauc

SEQ ID NO: 375550 - RNA, 32 nt, Human
ccgcuugugcugcugccaugucucuagugauc

SEQ ID NO: 375551 - RNA, 32 nt, Human
ccgcuuguguuuacacaagcugugggguguua

SEQ ID NO: 375552 - RNA, 32 nt, Human
ccgcuuguuuggcugcugccgucaccucaugg

SEQ ID NO: 375553 - RNA, 32 nt, Human
ccgcuuucacaguccuccagauuuuuccaaga

SEQ ID NO: 375554 - RNA, 32 nt, Human
ccgcuuucagcccugugcucuggccccagaag

SEQ ID NO: 375555 - RNA, 32 nt, Human
ccgcuuucauuucuuucacauacaacuuucca

SEQ ID NO: 375556 - RNA, 32 nt, Human
ccgcuuuccccagaggaggagugcaggccugc

SEQ ID NO: 375557 - RNA, 32 nt, Human
ccgcuuucccuccaaggcugacuccccgcuga

SEQ ID NO: 375558 - RNA, 19 nt, Human
ccgcuuucucccgcgagcc

SEQ ID NO: 375559 - RNA, 32 nt, Human
ccgcuuucuggggagugaggugagacauagcg

SEQ ID NO: 375560 - RNA, 32 nt, Human
ccgcuuucugguggggccuuaucagaacguga

SEQ ID NO: 375561 - RNA, 19 nt, Human
ccgcuuucuugccgagcca

SEQ ID NO: 375562 - RNA, 32 nt, Human
ccgcuuugagcccagaggugcggugccgcacg

SEQ ID NO: 375563 - RNA, 32 nt, Human
ccgcuuugcacuccaccccgguagcagcuccg

SEQ ID NO: 375564 - RNA, 32 nt, Human
ccgcuuugcuugcuuguuuaacaaacccaacu

SEQ ID NO: 375565 - RNA, 32 nt, Human
ccggaaaagaggagaagagcaaacaggcacuu

SEQ ID NO: 375566 - RNA, 32 nt, Human
ccggaaaagaugagcuggcccuucccggaguc

SEQ ID NO: 375567 - RNA, 32 nt, Human
ccggaaacacaaccccagggagcggggagggu

SEQ ID NO: 375568 - RNA, 32 nt, Human
ccggaaacaccuggcccaugccuguucagucc

SEQ ID NO: 375569 - RNA, 32 nt, Human
ccggaaaccugagacaugcucaaggaagagca

SEQ ID NO: 375570 - RNA, 32 nt, Human
ccggaaacucagcccguggcagagggagucag

SEQ ID NO: 375571 - RNA, 20 nt, Human
ccggaaagcagcggcggcgu

SEQ ID NO: 375572 - RNA, 32 nt, Human
ccggaaaggagagagauacaugugaaggauau

SEQ ID NO: 375573 - RNA, 32 nt, Human
ccggaaagucccagcacccaagcuuggcugag

SEQ ID NO: 375574 - RNA, 32 nt, Human
ccggaaaugcucuucauagcugacguuuucuu

SEQ ID NO: 375575 - RNA, 32 nt, Human
ccggaacaaaagcggaagaggggccagccuca

SEQ ID NO: 375576 - RNA, 32 nt, Human
ccggaacagggcacuugugugcacacgcccac

SEQ ID NO: 375577 - RNA, 32 nt, Human
ccggaacccgcggcuucccuggcucccgugag

SEQ ID NO: 375578 - RNA, 19 nt, Human
ccggaacccucccugagcc

SEQ ID NO: 375579 - RNA, 32 nt, Human
ccggaaccugggaggggagggaacacuggggu

SEQ ID NO: 375580 - RNA, 32 nt, Human
ccggaaccuuuucaucauucugaggcuuugcc

SEQ ID NO: 375581 - RNA, 32 nt, Human
ccggaacucugccuuuucccagaaggaggagg

SEQ ID NO: 375582 - RNA, 32 nt, Human
ccggaacugccaccccaccagugacuccacag

SEQ ID NO: 375583 - RNA, 20 nt, Human
ccggaacugucagacauguu

SEQ ID NO: 375584 - RNA, 32 nt, Human
ccggaagaaggagaaacauugcaguggcuacu

SEQ ID NO: 375585 - RNA, 32 nt, Human
ccggaagaaggugagucugggagaggggcguc

SEQ ID NO: 375586 - RNA, 32 nt, Human
ccggaagaggggaccugagggagccagccggg

SEQ ID NO: 375587 - RNA, 32 nt, Human
ccggaagaggucuucguggaggccucgccagg

SEQ ID NO: 375588 - RNA, 32 nt, Human
ccggaagaugguggagggucaugaugaaguca

SEQ ID NO: 375589 - RNA, 23 nt, Human
ccggaagcgaagguugcagugag

SEQ ID NO: 375590 - RNA, 32 nt, Human
ccggaagcugcugggggaugucugacuagcuc

SEQ ID NO: 375591 - RNA, 24 nt, Human
ccggaaggcagagcuugcagugag

SEQ ID NO: 375592 - RNA, 24 nt, Human
ccggaaggcagagguucaggugag

SEQ ID NO: 375593 - RNA, 20 nt, Human
ccggaaggcagagguugcag

SEQ ID NO: 375594 - RNA, 23 nt, Human
ccggaaggcagagguugcaguga

SEQ ID NO: 375595 - RNA, 24 nt, Human
ccggaaggcagagguugcagugag

SEQ ID NO: 375596 - RNA, 24 nt, Human
ccggaaggcggagcuugcagugag

SEQ ID NO: 375597 - RNA, 24 nt, Human
ccggaaggcggagguugcagugag

SEQ ID NO: 375598 - RNA, 32 nt, Human
ccggaaggcugaggcaggagaauggcgugaac

SEQ ID NO: 375599 - RNA, 24 nt, Human
ccggaagguggagguugcagugag

SEQ ID NO: 375600 - RNA, 24 nt, Human
ccggaagguggaguuugcagugag

SEQ ID NO: 375601 - RNA, 32 nt, Human
ccggaaguaccugagagagaccccagaaggug

SEQ ID NO: 375602 - RNA, 32 nt, Human
ccggaaguagguccuuugacuuuugcuuccuc

SEQ ID NO: 375603 - RNA, 32 nt, Human
ccggaaguggcaccccucccuccaacucccua

SEQ ID NO: 375604 - RNA, 32 nt, Human
ccggaaugcaagacauccgaugguauacuuac

SEQ ID NO: 375605 - RNA, 32 nt, Human
ccggaaugugggccuaguguugccagaucuuc

SEQ ID NO: 375606 - RNA, 22 nt, Human
ccggaauuacaggcaugugcca

SEQ ID NO: 375607 - RNA, 32 nt, Human
ccggacaaagccccagcagccaaggugcuccg

SEQ ID NO: 375608 - RNA, 32 nt, Human
ccggacaacauggcgaaaccucaucucuauua

SEQ ID NO: 375609 - RNA, 20 nt, Human
ccggacaacccccagccccc

SEQ ID NO: 375610 - RNA, 21 nt, Human
ccggacaacuuagcugggccc

SEQ ID NO: 375611 - RNA, 25 nt, Human
ccggacaagaggagggggcgugcag

SEQ ID NO: 375612 - RNA, 32 nt, Human
ccggacaccucagacggacgguggccagggau

SEQ ID NO: 375613 - RNA, 20 nt, Human
ccggacacggggugcugcca

SEQ ID NO: 375614 - RNA, 32 nt, Human
ccggacacuggauuccuggacccccuucuccu

SEQ ID NO: 375615 - RNA, 32 nt, Human
ccggacagagcugggccuggggaagggguucc

SEQ ID NO: 375616 - RNA, 32 nt, Human
ccggaccaguuacauucguuccuggcaaaagc

SEQ ID NO: 375617 - RNA, 32 nt, Human
ccggaccauugagacauuugccaaggaggaac

SEQ ID NO: 375618 - RNA, 32 nt, Human
ccggacccaggccuuccaggagcaggagcagg

SEQ ID NO: 375619 - RNA, 20 nt, Human
ccggacccccgacgccgccu

SEQ ID NO: 375620 - RNA, 32 nt, Human
ccggaccccucggcccgcagcagcuaccagca

SEQ ID NO: 375621 - RNA, 32 nt, Human
ccggaccccucuuuccccauccagaaauaaaa

SEQ ID NO: 375622 - RNA, 17 nt, Human
ccggaccccugcucuga

SEQ ID NO: 375623 - RNA, 32 nt, Human
ccggacccgagagagagcgccgccgccaucuu

SEQ ID NO: 375624 - RNA, 32 nt, Human
ccggacccucgccaccauguacgugagcuacc

SEQ ID NO: 375625 - RNA, 32 nt, Human
ccggaccgcagauucgcgcaacagggcgaaaa

SEQ ID NO: 375626 - RNA, 32 nt, Human
ccggaccgcagccgccgcccucccaggacccc

SEQ ID NO: 375627 - RNA, 32 nt, Human
ccggaccggcggcgugaaagucgugauaucau

SEQ ID NO: 375628 - RNA, 32 nt, Human
ccggaccgugcgggcaccagugcagugcugcc

SEQ ID NO: 375629 - RNA, 32 nt, Human
ccggaccuccacccccaacuuccuccagccca

SEQ ID NO: 375630 - RNA, 32 nt, Human
ccggaccugagcccgcagcccagacccccucc

SEQ ID NO: 375631 - RNA, 32 nt, Human
ccggaccugcagcgcgcacaagcucgggcgcc

SEQ ID NO: 375632 - RNA, 22 nt, Human
ccggaccugcccaacgccgccu

SEQ ID NO: 375633 - RNA, 18 nt, Human
ccggaccugccucgagcc

SEQ ID NO: 375634 - RNA, 32 nt, Human
ccggaccugccucgagccucaggcugcugaaa

SEQ ID NO: 375635 - RNA, 32 nt, Human
ccggaccuuggagcgucuagagucuggcuacu

SEQ ID NO: 375636 - RNA, 32 nt, Human
ccggacgagccgcggggcccgggugccgcggg

SEQ ID NO: 375637 - RNA, 32 nt, Human
ccggacgcaccucaccucgcagucuccucacu

SEQ ID NO: 375638 - RNA, 32 nt, Human
ccggacgcaguggcucacgccuguaauuccag

SEQ ID NO: 375639 - RNA, 19 nt, Human
ccggacgccguacccgccc

SEQ ID NO: 375640 - RNA, 32 nt, Human
ccggacggaguccaaugcaaagcuguaccaca

SEQ ID NO: 375641 - RNA, 32 nt, Human
ccggacgggagguggcggagguggcggcggag

SEQ ID NO: 375642 - RNA, 32 nt, Human
ccggacggggcggcuggccgggcacaggggcu

SEQ ID NO: 375643 - RNA, 32 nt, Human
ccggacgggguuucuccauguuucccaggcug

SEQ ID NO: 375644 - RNA, 32 nt, Human
ccggacguggugccucacaccuguaauuccag

SEQ ID NO: 375645 - RNA, 32 nt, Human
ccggacgugguggcacaugccuguaaugccag

SEQ ID NO: 375646 - RNA, 32 nt, Human
ccggacgugguggcgcaugccuguaaucccag

SEQ ID NO: 375647 - RNA, 32 nt, Human
ccggacgugguggcgggcgccuguaaucccag

SEQ ID NO: 375648 - RNA, 32 nt, Human
ccggacgugguggcucacgccuguaaucccaa

SEQ ID NO: 375649 - RNA, 32 nt, Human
ccggacgugguggugccugccuguaauccagc

SEQ ID NO: 375650 - RNA, 32 nt, Human
ccggacuacaaggagcugguggagcucuucaa

SEQ ID NO: 375651 - RNA, 32 nt, Human
ccggacuaguuauugagcaucugccucucaua

SEQ ID NO: 375652 - RNA, 32 nt, Human
ccggacuccaaguccaccucccuucagaggca

SEQ ID NO: 375653 - RNA, 32 nt, Human
ccggacuccagugauccucccgccucagccuc

SEQ ID NO: 375654 - RNA, 32 nt, Human
ccggacuccuccuccuccucuucucgccauug

SEQ ID NO: 375655 - RNA, 32 nt, Human
ccggacucugcaguuucuccugcacuguuuuc

SEQ ID NO: 375656 - RNA, 32 nt, Human
ccggacugcccuccugugccugauguccccag

SEQ ID NO: 375657 - RNA, 20 nt, Human
ccggacugcuccuucgggcc

SEQ ID NO: 375658 - RNA, 32 nt, Human
ccggacuguggaccccuucauccuagacguca

SEQ ID NO: 375659 - RNA, 32 nt, Human
ccggacuuucaucuggagaugucagggaaaua

SEQ ID NO: 375660 - RNA, 22 nt, Human
ccggagaacugggauuacaggc

SEQ ID NO: 375661 - RNA, 18 nt, Human
ccggagaagaugcaguga

SEQ ID NO: 375662 - RNA, 32 nt, Human
ccggagaagguggugaccgagccuccaguugu

SEQ ID NO: 375663 - RNA, 32 nt, Human
ccggagacaggguuuggcugugucuaaacugc

SEQ ID NO: 375664 - RNA, 21 nt, Human
ccggagacagguugcagugag

SEQ ID NO: 375665 - RNA, 24 nt, Human
ccggagaccagccuggccaacaug

SEQ ID NO: 375666 - RNA, 32 nt, Human
ccggagaccagccuggccaacauggugaaacc

SEQ ID NO: 375667 - RNA, 32 nt, Human
ccggagaccauucaagcagguagacagucgcu

SEQ ID NO: 375668 - RNA, 18 nt, Human
ccggagagaagcauguug

SEQ ID NO: 375669 - RNA, 32 nt, Human
ccggagagagcuuggcccugcucacaccuuga

SEQ ID NO: 375670 - RNA, 32 nt, Human
ccggagagcgaagggcgggcgggucccggagc

SEQ ID NO: 375671 - RNA, 32 nt, Human
ccggagaggagaaagggcccgacugcccgccg

SEQ ID NO: 375672 - RNA, 32 nt, Human
ccggagaggagaaggaggaagaagaggaggag

SEQ ID NO: 375673 - RNA, 32 nt, Human
ccggagaggcaggaucgcaguggucagaaucc

SEQ ID NO: 375674 - RNA, 32 nt, Human
ccggagaggggucccucaacagucagccucac

SEQ ID NO: 375675 - RNA, 32 nt, Human
ccggagaguggcagauggagagagcuggcggg

SEQ ID NO: 375676 - RNA, 32 nt, Human
ccggagauauuggccucaagguaugagccagc

SEQ ID NO: 375677 - RNA, 23 nt, Human
ccggagauggagguugcagugag

SEQ ID NO: 375678 - RNA, 32 nt, Human
ccggagaugucuuuuuauuuuugugcuguaaa

SEQ ID NO: 375679 - RNA, 32 nt, Human
ccggagcaaagcagcaugauaaggacugcagc

SEQ ID NO: 375680 - RNA, 32 nt, Human
ccggagcagagcagcgcugcuggccuggcagc

SEQ ID NO: 375681 - RNA, 32 nt, Human
ccggagcagcagcagaggcaggaggacuagga

SEQ ID NO: 375682 - RNA, 20 nt, Human
ccggagcagccgcgggcgcc

SEQ ID NO: 375683 - RNA, 32 nt, Human
ccggagcagggaggguggcuggggccaagccc

SEQ ID NO: 375684 - RNA, 32 nt, Human
ccggagcaggguggggaggugcaguggcaccc

SEQ ID NO: 375685 - RNA, 32 nt, Human
ccggagcaggucggccucggcccaggggcgag

SEQ ID NO: 375686 - RNA, 17 nt, Human
ccggagccaagacuugu

SEQ ID NO: 375687 - RNA, 15 nt, Human
ccggagccaagcugu

SEQ ID NO: 375688 - RNA, 20 nt, Human
ccggagccacagccgcagcc

SEQ ID NO: 375689 - RNA, 32 nt, Human
ccggagcccaccugccuuuccccacaacuuuu

SEQ ID NO: 375690 - RNA, 32 nt, Human
ccggagcccgaacugcagcuccagccccagcc

SEQ ID NO: 375691 - RNA, 19 nt, Human
ccggagcccgagccugcug

SEQ ID NO: 375692 - RNA, 20 nt, Human
ccggagcccgcucuggccgc

SEQ ID NO: 375693 - RNA, 32 nt, Human
ccggagcccggccguagaggcugcaaucgcag

SEQ ID NO: 375694 - RNA, 32 nt, Human
ccggagcccgggagagaacccaggagcgccgc

SEQ ID NO: 375695 - RNA, 32 nt, Human
ccggagcccucccagcccucaggccugcgccu

SEQ ID NO: 375696 - RNA, 32 nt, Human
ccggagcccuccugccucauugcuccuguaau

SEQ ID NO: 375697 - RNA, 32 nt, Human
ccggagcccugccugccccugcuccccagcuc

SEQ ID NO: 375698 - RNA, 18 nt, Human
ccggagccgacccgagcc

SEQ ID NO: 375699 - RNA, 18 nt, Human
ccggagccgacggcagug

SEQ ID NO: 375700 - RNA, 17 nt, Human
ccggagccgacugcaga

SEQ ID NO: 375701 - RNA, 21 nt, Human
ccggagccgccuccugcaccu

SEQ ID NO: 375702 - RNA, 20 nt, Human
ccggagccgccugggauguu

SEQ ID NO: 375703 - RNA, 18 nt, Human
ccggagccggagauauug

SEQ ID NO: 375704 - RNA, 32 nt, Human
ccggagccggcagaggggcgcgggcgggacgg

SEQ ID NO: 375705 - RNA, 16 nt, Human
ccggagccggccuguu

SEQ ID NO: 375706 - RNA, 19 nt, Human
ccggagccggcgggacaug

SEQ ID NO: 375707 - RNA, 17 nt, Human
ccggagccggggaaugu

SEQ ID NO: 375708 - RNA, 28 nt, Human
ccggagccgugcccaguccacgccggcc

SEQ ID NO: 375709 - RNA, 32 nt, Human
ccggagccucgccuuccuuucucccucugcag

SEQ ID NO: 375710 - RNA, 20 nt, Human
ccggagccugguggcuguug

SEQ ID NO: 375711 - RNA, 32 nt, Human
ccggagccuuccuucagacccuuccuccacgu

SEQ ID NO: 375712 - RNA, 19 nt, Human
ccggagccuugcccgggcc

SEQ ID NO: 375713 - RNA, 20 nt, Human
ccggagcgccgccgccgccg

SEQ ID NO: 375714 - RNA, 32 nt, Human
ccggagcggagcgcgcccugcccuggcgcagc

SEQ ID NO: 375715 - RNA, 20 nt, Human
ccggagcggagcgggcgcgg

SEQ ID NO: 375716 - RNA, 32 nt, Human
ccggagcggcccugggcucugcagcaaggcgg

SEQ ID NO: 375717 - RNA, 19 nt, Human
ccggagcggcgccccggcc

SEQ ID NO: 375718 - RNA, 32 nt, Human
ccggagcgugagcaacagcuucccggcuggag

SEQ ID NO: 375719 - RNA, 16 nt, Human
ccggagcuccugcccc

SEQ ID NO: 375720 - RNA, 32 nt, Human
ccggagcuccuggcuuccgcaucccccaaggc

SEQ ID NO: 375721 - RNA, 32 nt, Human
ccggagcucucgaaguggaggcgguaggaaac

SEQ ID NO: 375722 - RNA, 32 nt, Human
ccggagcugcaaccgccagugcugcagggggu

SEQ ID NO: 375723 - RNA, 32 nt, Human
ccggagcugcagccaagcggguucccuccaua

SEQ ID NO: 375724 - RNA, 32 nt, Human
ccggagcugccuggcgcggccgggcgggcggc

SEQ ID NO: 375725 - RNA, 19 nt, Human
ccggagcugcgcuggguca

SEQ ID NO: 375726 - RNA, 32 nt, Human
ccggagcuggaagaggaggaggaggagaggcg

SEQ ID NO: 375727 - RNA, 22 nt, Human
ccggagcuggccagcgccauca

SEQ ID NO: 375728 - RNA, 18 nt, Human
ccggagcugucucgagcu

SEQ ID NO: 375729 - RNA, 32 nt, Human
ccggagcuucacaccccacuuccggggucaag

SEQ ID NO: 375730 - RNA, 21 nt, Human
ccggagcuuccgaaacugcug

SEQ ID NO: 375731 - RNA, 18 nt, Human
ccggaggaacaacagugg

SEQ ID NO: 375732 - RNA, 22 nt, Human
ccggaggacuaugccccuagua

SEQ ID NO: 375733 - RNA, 20 nt, Human
ccggaggagccugagccugg

SEQ ID NO: 375734 - RNA, 18 nt, Human
ccggaggaggagauguug

SEQ ID NO: 375735 - RNA, 32 nt, Human
ccggaggaggaggaggaggaggaggaggaggg

SEQ ID NO: 375736 - RNA, 32 nt, Human
ccggaggaggaggaggaggaggaggcaaaguu

SEQ ID NO: 375737 - RNA, 32 nt, Human
ccggaggcaagagugacuucagacaggaaccc

SEQ ID NO: 375738 - RNA, 32 nt, Human
ccggaggcagagaggcuccauggccgugcugc

SEQ ID NO: 375739 - RNA, 32 nt, Human
ccggaggcagaggccaugcugaccgcagcggu

SEQ ID NO: 375740 - RNA, 32 nt, Human
ccggaggcagcccagauauccucggaagagca

SEQ ID NO: 375741 - RNA, 23 nt, Human
ccggaggcagggguugcagugag

SEQ ID NO: 375742 - RNA, 22 nt, Human
ccggaggccaguggagcugccu

SEQ ID NO: 375743 - RNA, 32 nt, Human
ccggaggccccaggguuaugagacuaucacug

SEQ ID NO: 375744 - RNA, 32 nt, Human
ccggaggcccuaggagcuggugcugcccccgc

SEQ ID NO: 375745 - RNA, 32 nt, Human
ccggaggccgaggcagaagcugggcagaagca

SEQ ID NO: 375746 - RNA, 20 nt, Human
ccggaggccuaggagacaug

SEQ ID NO: 375747 - RNA, 23 nt, Human
ccggaggcggagguugcagugag

SEQ ID NO: 375748 - RNA, 20 nt, Human
ccggaggcggagguugcggu

SEQ ID NO: 375749 - RNA, 32 nt, Human
ccggaggcgggacuuccucuuccucggggaca

SEQ ID NO: 375750 - RNA, 20 nt, Human
ccggaggcgggcgugagaca

SEQ ID NO: 375751 - RNA, 32 nt, Human
ccggagggucaccaugaaguucaaucccuucg

SEQ ID NO: 375752 - RNA, 32 nt, Human
ccggagggugagcccggcagaggcagagacac

SEQ ID NO: 375753 - RNA, 32 nt, Human
ccggaggucaccaaggaaugcacagguuucga

SEQ ID NO: 375754 - RNA, 23 nt, Human
ccggaggucgaggcugcaguggg

SEQ ID NO: 375755 - RNA, 32 nt, Human
ccggaggugcucuugugcacacagcaggucaa

SEQ ID NO: 375756 - RNA, 32 nt, Human
ccggagguggacgugguccugccccugcaggu

SEQ ID NO: 375757 - RNA, 18 nt, Human
ccggagguguugcaguga

SEQ ID NO: 375758 - RNA, 23 nt, Human
ccggagguugaagcuacagugag

SEQ ID NO: 375759 - RNA, 24 nt, Human
ccggaguaacuggcauuacaggcg

SEQ ID NO: 375760 - RNA, 23 nt, Human
ccggaguagcugggauuacaggc

SEQ ID NO: 375761 - RNA, 25 nt, Human
ccggaguagcugggauuacaggcgu

SEQ ID NO: 375762 - RNA, 23 nt, Human
ccggaguagcugggauugcaggc

SEQ ID NO: 375763 - RNA, 23 nt, Human
ccggaguagcugggguuacaggc

SEQ ID NO: 375764 - RNA, 32 nt, Human
ccggagucaggaguucgagaccagccugacca

SEQ ID NO: 375765 - RNA, 18 nt, Human
ccggaguccaucauccuu

SEQ ID NO: 375766 - RNA, 32 nt, Human
ccggaguccaucauccuucaccucuggguggg

SEQ ID NO: 375767 - RNA, 32 nt, Human
ccggagucccagugaugcucugugccauagag

SEQ ID NO: 375768 - RNA, 32 nt, Human
ccggagucgauugagggccagagcaggcacug

SEQ ID NO: 375769 - RNA, 18 nt, Human
ccggagucgccaacaugu

SEQ ID NO: 375770 - RNA, 32 nt, Human
ccggagugacaggcacauacaugagaacaggc

SEQ ID NO: 375771 - RNA, 32 nt, Human
ccggagugagggccuugcagaccugcggcggc

SEQ ID NO: 375772 - RNA, 32 nt, Human
ccggagugcagaaagccaggaccaagagacag

SEQ ID NO: 375773 - RNA, 24 nt, Human
ccggauagcugggauuacaggcgu

SEQ ID NO: 375774 - RNA, 32 nt, Human
ccggauaggaggaggaggggacccauaggacg

SEQ ID NO: 375775 - RNA, 32 nt, Human
ccggauauccugcccacccaggggcaaggcaa

SEQ ID NO: 375776 - RNA, 32 nt, Human
ccggauaugguggcgggugccuguaaucucag

SEQ ID NO: 375777 - RNA, 32 nt, Human
ccggauauugagugcagccauugagaaaagcc

SEQ ID NO: 375778 - RNA, 32 nt, Human
ccggaucagagcaggaccucccuuccgacccu

SEQ ID NO: 375779 - RNA, 19 nt, Human
ccggaucagcgugguccaa

SEQ ID NO: 375780 - RNA, 32 nt, Human
ccggaucaggccaagugcaccacacacccuca

SEQ ID NO: 375781 - RNA, 32 nt, Human
ccggaucaguugagagagaaucaagaguagcg

SEQ ID NO: 375782 - RNA, 22 nt, Human
ccggaucccucuguucgggcuc

SEQ ID NO: 375783 - RNA, 32 nt, Human
ccggauccuggacaggcaccccggcuuggcgc

SEQ ID NO: 375784 - RNA, 32 nt, Human
ccggaucgccaccccgcacagccuggguagcg

SEQ ID NO: 375785 - RNA, 32 nt, Human
ccggaucgugggcucccucugcccauggaaac

SEQ ID NO: 375786 - RNA, 32 nt, Human
ccggaucucuggcuccucaucucuccggucuc

SEQ ID NO: 375787 - RNA, 32 nt, Human
ccggaucugcucccaaguuaucuuucuguucc

SEQ ID NO: 375788 - RNA, 25 nt, Human
ccggaugaagcagacuggagacaca

SEQ ID NO: 375789 - RNA, 32 nt, Human
ccggaugaccccgcgucaccacugugaggccu

SEQ ID NO: 375790 - RNA, 18 nt, Human
ccggaugccucugccccu

SEQ ID NO: 375791 - RNA, 32 nt, Human
ccggaugccucugggagccccagcacaagcac

SEQ ID NO: 375792 - RNA, 32 nt, Human
ccggaugcgguggcucacgccuguaaucccag

SEQ ID NO: 375793 - RNA, 32 nt, Human
ccggaugcgguggcucaugccuguaaucccac

SEQ ID NO: 375794 - RNA, 32 nt, Human
ccggaugcgguggcucaugccuguaaucccug

SEQ ID NO: 375795 - RNA, 18 nt, Human
ccggauggagugcaguga

SEQ ID NO: 375796 - RNA, 18 nt, Human
ccggauggccaucugucc

SEQ ID NO: 375797 - RNA, 32 nt, Human
ccggauggggcugagaggcacacaggaggcag

SEQ ID NO: 375798 - RNA, 32 nt, Human
ccggauggucaggguggggagcagggacggcc

SEQ ID NO: 375799 - RNA, 32 nt, Human
ccggaugugauggcacaugccuguaaucccag

SEQ ID NO: 375800 - RNA, 32 nt, Human
ccggauguggugccgcaugccuguaaucccag

SEQ ID NO: 375801 - RNA, 32 nt, Human
ccggaugugguggcucacgccuguaaucccag

SEQ ID NO: 375802 - RNA, 32 nt, Human
ccggaugugguggcucaugccuguaaucccag

SEQ ID NO: 375803 - RNA, 32 nt, Human
ccggauucaagcaauucucccgccucagccuc

SEQ ID NO: 375804 - RNA, 32 nt, Human
ccggauucaagcaauucuccuuccucagccuc

SEQ ID NO: 375805 - RNA, 32 nt, Human
ccggauucaagcaauucuucugccucagcuuc

SEQ ID NO: 375806 - RNA, 32 nt, Human
ccggauucaagcaguuuuccugccucagccuc

SEQ ID NO: 375807 - RNA, 32 nt, Human
ccggauucaagccauucuccugccucagccuc

SEQ ID NO: 375808 - RNA, 32 nt, Human
ccggauucaaggaauucucccugccucagccu

SEQ ID NO: 375809 - RNA, 32 nt, Human
ccggauucgucccauucucguccucauggugg

SEQ ID NO: 375810 - RNA, 32 nt, Human
ccggauuguuacagaauuuucaagaugacaga

SEQ ID NO: 375811 - RNA, 32 nt, Human
ccggcaaaaaguuaagaauuucuuaccaguua

SEQ ID NO: 375812 - RNA, 18 nt, Human
ccggcaaccuugcagagg

SEQ ID NO: 375813 - RNA, 32 nt, Human
ccggcaagaggaagagagaguggcuuccacau

SEQ ID NO: 375814 - RNA, 32 nt, Human
ccggcaagcagagguucgagaaaaugaucaau

SEQ ID NO: 375815 - RNA, 21 nt, Human
ccggcaaggggcuggggacuu

SEQ ID NO: 375816 - RNA, 32 nt, Human
ccggcacauccuggccgccucugacaccugcu

SEQ ID NO: 375817 - RNA, 32 nt, Human
ccggcaccaaagugaccaggaggcagagaaga

SEQ ID NO: 375818 - RNA, 24 nt, Human
ccggcaccacagacacccaccagc

SEQ ID NO: 375819 - RNA, 32 nt, Human
ccggcaccauucucccuucucucuuuucuucu

SEQ ID NO: 375820 - RNA, 32 nt, Human
ccggcacccacccugucuaugcacggggcuug

SEQ ID NO: 375821 - RNA, 32 nt, Human
ccggcacccucagccggggaggccguaggcuc

SEQ ID NO: 375822 - RNA, 20 nt, Human
ccggcacccucgagggccgg

SEQ ID NO: 375823 - RNA, 32 nt, Human
ccggcaccuccuccuccuucugcauuuccuau

SEQ ID NO: 375824 - RNA, 32 nt, Human
ccggcacgcacaccuaguccgcagucccgagg

SEQ ID NO: 375825 - RNA, 18 nt, Human
ccggcacugccgcugccu

SEQ ID NO: 375826 - RNA, 32 nt, Human
ccggcacugggagcugcaucugaggcuuaguc

SEQ ID NO: 375827 - RNA, 32 nt, Human
ccggcacuuaccugccuuucucucugcaccua

SEQ ID NO: 375828 - RNA, 32 nt, Human
ccggcacuuugggaggccugaguggauggauc

SEQ ID NO: 375829 - RNA, 30 nt, Human
ccggcagaaagccacaggagucauuguauu

SEQ ID NO: 375830 - RNA, 32 nt, Human
ccggcagaaagccacaggagucauuguauuag

SEQ ID NO: 375831 - RNA, 21 nt, Human
ccggcagaacagucugaucuc

SEQ ID NO: 375832 - RNA, 32 nt, Human
ccggcagaagcagcugcagcagcaguuccggg

SEQ ID NO: 375833 - RNA, 17 nt, Human
ccggcagacgggugcag

SEQ ID NO: 375834 - RNA, 32 nt, Human
ccggcagacuguucccaggaugcaacacgggc

SEQ ID NO: 375835 - RNA, 22 nt, Human
ccggcagagcaaccagauucug

SEQ ID NO: 375836 - RNA, 25 nt, Human
ccggcagagcaggaguggcuggagg

SEQ ID NO: 375837 - RNA, 24 nt, Human
ccggcagaggaggcgagcaucccg

SEQ ID NO: 375838 - RNA, 32 nt, Human
ccggcagaggcagggcccuggggucucugagc

SEQ ID NO: 375839 - RNA, 32 nt, Human
ccggcagagguguggacuggagaccaggauuc

SEQ ID NO: 375840 - RNA, 22 nt, Human
ccggcagaguuccucuaucucg

SEQ ID NO: 375841 - RNA, 32 nt, Human
ccggcagcaaggaguguuccugggaccucaga

SEQ ID NO: 375842 - RNA, 32 nt, Human
ccggcagcacagaaaaauaaaguuaaacaaga

SEQ ID NO: 375843 - RNA, 32 nt, Human
ccggcagcaccauguugcucauggucaucagc

SEQ ID NO: 375844 - RNA, 32 nt, Human
ccggcagcagaggcaccguguucucucagccc

SEQ ID NO: 375845 - RNA, 32 nt, Human
ccggcagcagcccaggcccggggacuggggug

SEQ ID NO: 375846 - RNA, 32 nt, Human
ccggcagcaucccaucugacccugucuggguc

SEQ ID NO: 375847 - RNA, 32 nt, Human
ccggcagccacccaccccacgugccaacuucc

SEQ ID NO: 375848 - RNA, 21 nt, Human
ccggcagcccagauguucagu

SEQ ID NO: 375849 - RNA, 32 nt, Human
ccggcagccccuuucccugccaccccaggagc

SEQ ID NO: 375850 - RNA, 27 nt, Human
ccggcagcccugaggccucuggucuug

SEQ ID NO: 375851 - RNA, 25 nt, Human
ccggcagcccugggguggcggcggg

SEQ ID NO: 375852 - RNA, 32 nt, Human
ccggcagccgaggccaagacacugcuggcccg

SEQ ID NO: 375853 - RNA, 32 nt, Human
ccggcagccgcuccacggaguccccggcaggg

SEQ ID NO: 375854 - RNA, 22 nt, Human
ccggcagccugcauugcgcugg

SEQ ID NO: 375855 - RNA, 32 nt, Human
ccggcagcuacuggucaugccaggcacacacu

SEQ ID NO: 375856 - RNA, 32 nt, Human
ccggcagcugaggagggagagggggagcguag

SEQ ID NO: 375857 - RNA, 32 nt, Human
ccggcaggacagcuccagaaugaaaaugcggu

SEQ ID NO: 375858 - RNA, 24 nt, Human
ccggcaggcagagguugcagugag

SEQ ID NO: 375859 - RNA, 32 nt, Human
ccggcaggcccaggcccugucugggugcacag

SEQ ID NO: 375860 - RNA, 24 nt, Human
ccggcaggcggagguugcagugag

SEQ ID NO: 375861 - RNA, 32 nt, Human
ccggcagggagaagcugcccuuugaguuuguc

SEQ ID NO: 375862 - RNA, 18 nt, Human
ccggcagggcgggcgcgg

SEQ ID NO: 375863 - RNA, 32 nt, Human
ccggcaggggcccagcccugccuuccacugug

SEQ ID NO: 375864 - RNA, 32 nt, Human
ccggcagggggagcgaggaggaagggaaccgc

SEQ ID NO: 375865 - RNA, 22 nt, Human
ccggcagggugcauccggccug

SEQ ID NO: 375866 - RNA, 32 nt, Human
ccggcagucagccucaggcucuccgcuuugcg

SEQ ID NO: 375867 - RNA, 32 nt, Human
ccggcaguccugggacggcuucccucugcugg

SEQ ID NO: 375868 - RNA, 32 nt, Human
ccggcagugagagugacuugaagaacuaaauu

SEQ ID NO: 375869 - RNA, 32 nt, Human
ccggcagugggagcucagugccaggcuguggg

SEQ ID NO: 375870 - RNA, 32 nt, Human
ccggcagugggggcgccgcgcccagccuuugc

SEQ ID NO: 375871 - RNA, 32 nt, Human
ccggcagugguggcgggggcggcggcggcgcc

SEQ ID NO: 375872 - RNA, 32 nt, Human
ccggcaguuggaggaaggccagaggaacagcu

SEQ ID NO: 375873 - RNA, 32 nt, Human
ccggcaucauuuccccucccgcuuccuccggc

SEQ ID NO: 375874 - RNA, 21 nt, Human
ccggcaucugggcccuggacg

SEQ ID NO: 375875 - RNA, 32 nt, Human
ccggcaucuuccaguucucugccagucugcac

SEQ ID NO: 375876 - RNA, 32 nt, Human
ccggcaugagccacugcgccuggccgacaaag

SEQ ID NO: 375877 - RNA, 32 nt, Human
ccggcauggaggaaaccacuaggugacccuca

SEQ ID NO: 375878 - RNA, 32 nt, Human
ccggcauggaggaugaggaagagcuggagacc

SEQ ID NO: 375879 - RNA, 32 nt, Human
ccggcauggcuaggcugagagcagggaucuac

SEQ ID NO: 375880 - RNA, 32 nt, Human
ccggcauggcugggaacugcagaccuguccuc

SEQ ID NO: 375881 - RNA, 32 nt, Human
ccggcaugucccuguaccgcagcgucgugugg

SEQ ID NO: 375882 - RNA, 30 nt, Human
ccggcaugucggcggaggccucgggcccgg

SEQ ID NO: 375883 - RNA, 32 nt, Human
ccggcauuauggggacagagagcagggggcag

SEQ ID NO: 375884 - RNA, 32 nt, Human
ccggcauugccuucuaccaccugggcgacuac

SEQ ID NO: 375885 - RNA, 32 nt, Human
ccggcauuuucccaucugccuuuucucugguu

SEQ ID NO: 375886 - RNA, 32 nt, Human
ccggccaaaugcugggcucaggccugggugcu

SEQ ID NO: 375887 - RNA, 32 nt, Human
ccggccaacacgagcacucuggguuuuccucc

SEQ ID NO: 375888 - RNA, 24 nt, Human
ccggccaacauagugaaacccugu

SEQ ID NO: 375889 - RNA, 32 nt, Human
ccggccaacauagugaaacccugucucuaaua

SEQ ID NO: 375890 - RNA, 19 nt, Human
ccggccaacaugggcuuga

SEQ ID NO: 375891 - RNA, 18 nt, Human
ccggccaacauggugaaa

SEQ ID NO: 375892 - RNA, 20 nt, Human
ccggccaacauggugaaacc

SEQ ID NO: 375893 - RNA, 32 nt, Human
ccggccaacauggugaaaccccaucucuacua

SEQ ID NO: 375894 - RNA, 22 nt, Human
ccggccaacauggugaaaccuu

SEQ ID NO: 375895 - RNA, 32 nt, Human
ccggccaacgucauuuucuuuucaggaguccc

SEQ ID NO: 375896 - RNA, 32 nt, Human
ccggccaagcaggagggcucuaacuccgugag

SEQ ID NO: 375897 - RNA, 32 nt, Human
ccggccaauccugcuauuucucuacaggacaa

SEQ ID NO: 375898 - RNA, 32 nt, Human
ccggccacaacuuggauaugcaggucaggcuu

SEQ ID NO: 375899 - RNA, 18 nt, Human
ccggccacacccaugccc

SEQ ID NO: 375900 - RNA, 20 nt, Human
ccggccacaccccucugcug

SEQ ID NO: 375901 - RNA, 18 nt, Human
ccggccacacuggcucgc

SEQ ID NO: 375902 - RNA, 32 nt, Human
ccggccacauucccgcccuccugggcagauug

SEQ ID NO: 375903 - RNA, 19 nt, Human
ccggccaccacccaugccc

SEQ ID NO: 375904 - RNA, 16 nt, Human
ccggccacccccgggc

SEQ ID NO: 375905 - RNA, 32 nt, Human
ccggccaccucccagggauccucucauccggu

SEQ ID NO: 375906 - RNA, 20 nt, Human
ccggccacggcccacccugg

SEQ ID NO: 375907 - RNA, 32 nt, Human
ccggccacugcaacccaugagcguccagguga

SEQ ID NO: 375908 - RNA, 19 nt, Human
ccggccacugcucugcuca

SEQ ID NO: 375909 - RNA, 32 nt, Human
ccggccacugcucugcucacaccagccuuggg

SEQ ID NO: 375910 - RNA, 32 nt, Human
ccggccacuucagcaacagcccuuuccccagg

SEQ ID NO: 375911 - RNA, 32 nt, Human
ccggccagagugcggugugcugugcuggagag

SEQ ID NO: 375912 - RNA, 32 nt, Human
ccggccagccagccacucuaccagugcaggcu

SEQ ID NO: 375913 - RNA, 32 nt, Human
ccggccagccuccgccucccgacauccuggga

SEQ ID NO: 375914 - RNA, 23 nt, Human
ccggccagccugaucugggcuca

SEQ ID NO: 375915 - RNA, 32 nt, Human
ccggccagcucaccucaggcccugccagggga

SEQ ID NO: 375916 - RNA, 32 nt, Human
ccggccagcuucauacuugagugugcacaucu

SEQ ID NO: 375917 - RNA, 32 nt, Human
ccggccaggccaccuccagaaacggccauuca

SEQ ID NO: 375918 - RNA, 19 nt, Human
ccggccaggcucuggcacg

SEQ ID NO: 375919 - RNA, 32 nt, Human
ccggccagggccucucccucccucccucccuc

SEQ ID NO: 375920 - RNA, 31 nt, Human
ccggccaugccuggcuggcccugggggcugc

SEQ ID NO: 375921 - RNA, 32 nt, Human
ccggccaugcucuccuccucugccagucuccu

SEQ ID NO: 375922 - RNA, 31 nt, Human
ccggccaugggaagcuuccagcuggaagacu

SEQ ID NO: 375923 - RNA, 23 nt, Human
ccggcccacccacuguucaggcu

SEQ ID NO: 375924 - RNA, 32 nt, Human
ccggcccagaagccagauggucccgggacagg

SEQ ID NO: 375925 - RNA, 25 nt, Human
ccggcccagaggggcuucuguccug

SEQ ID NO: 375926 - RNA, 32 nt, Human
ccggcccagcacagcaagcagcaggaccgcug

SEQ ID NO: 375927 - RNA, 22 nt, Human
ccggcccagcguggcgccacca

SEQ ID NO: 375928 - RNA, 21 nt, Human
ccggcccagcuagacccucca

SEQ ID NO: 375929 - RNA, 32 nt, Human
ccggcccagcugcagccacccuucucaucugg

SEQ ID NO: 375930 - RNA, 32 nt, Human
ccggcccagcuggcgaacccugggccauccuc

SEQ ID NO: 375931 - RNA, 32 nt, Human
ccggcccagggucuagggugugcacugggcaa

SEQ ID NO: 375932 - RNA, 32 nt, Human
ccggccccaacauguuuuucuaaugcuuaagg

SEQ ID NO: 375933 - RNA, 19 nt, Human
ccggccccaauucugcuga

SEQ ID NO: 375934 - RNA, 20 nt, Human
ccggccccaccggggcacuu

SEQ ID NO: 375935 - RNA, 32 nt, Human
ccggccccacugacagaucugaagagcacagu

SEQ ID NO: 375936 - RNA, 19 nt, Human
ccggccccacugguguguc

SEQ ID NO: 375937 - RNA, 32 nt, Human
ccggccccagccugagcggggacggcggccgg

SEQ ID NO: 375938 - RNA, 19 nt, Human
ccggccccagcucuggacg

SEQ ID NO: 375939 - RNA, 32 nt, Human
ccggccccaggccagcuucacugccgucucuu

SEQ ID NO: 375940 - RNA, 32 nt, Human
ccggccccauggacaacagccuggcgaccagc

SEQ ID NO: 375941 - RNA, 20 nt, Human
ccggcccccaccccagccuc

SEQ ID NO: 375942 - RNA, 32 nt, Human
ccggcccccaggaggucuggcagagcugagag

SEQ ID NO: 375943 - RNA, 20 nt, Human
ccggccccccucucgggcuc

SEQ ID NO: 375944 - RNA, 20 nt, Human
ccggcccccgacccgcgcuc

SEQ ID NO: 375945 - RNA, 32 nt, Human
ccggcccccgagagccgccgacaugaagaaag

SEQ ID NO: 375946 - RNA, 22 nt, Human
ccggcccccgcgcgcagugcuu

SEQ ID NO: 375947 - RNA, 22 nt, Human
ccggcccccggccccgggccca

SEQ ID NO: 375948 - RNA, 32 nt, Human
ccggcccccugccccugccccugcuccugcuc

SEQ ID NO: 375949 - RNA, 32 nt, Human
ccggccccgagaggaggaugcggguccggaua

SEQ ID NO: 375950 - RNA, 32 nt, Human
ccggccccgcugcaccuccccagggagccgag

SEQ ID NO: 375951 - RNA, 18 nt, Human
ccggccccggccgcucgc

SEQ ID NO: 375952 - RNA, 20 nt, Human
ccggccccuaaggcccugcc

SEQ ID NO: 375953 - RNA, 32 nt, Human
ccggccccucaaggaguacuccuuccguuccg

SEQ ID NO: 375954 - RNA, 32 nt, Human
ccggccccuccccucgccuccucuccuaggug

SEQ ID NO: 375955 - RNA, 32 nt, Human
ccggccccuccccucucccucccucugucccc

SEQ ID NO: 375956 - RNA, 32 nt, Human
ccggccccuccccuucuuugucuuuugcagau

SEQ ID NO: 375957 - RNA, 24 nt, Human
ccggccccucccugcccuccauuc

SEQ ID NO: 375958 - RNA, 20 nt, Human
ccggccccuccugccucggc

SEQ ID NO: 375959 - RNA, 32 nt, Human
ccggccccucgaggcaccgccuuucaauuagc

SEQ ID NO: 375960 - RNA, 21 nt, Human
ccggccccucgcucgcugcuc

SEQ ID NO: 375961 - RNA, 32 nt, Human
ccggccccucucccgccccacacccacccucc

SEQ ID NO: 375962 - RNA, 21 nt, Human
ccggccccucucugggccuca

SEQ ID NO: 375963 - RNA, 23 nt, Human
ccggccccugccacccagccuca

SEQ ID NO: 375964 - RNA, 32 nt, Human
ccggccccugccccaucuccucaucaucccca

SEQ ID NO: 375965 - RNA, 23 nt, Human
ccggccccugcugguucaggguu

SEQ ID NO: 375966 - RNA, 32 nt, Human
ccggccccugggacucacaggugggagacagg

SEQ ID NO: 375967 - RNA, 32 nt, Human
ccggccccuucacucccccaucuugcuuuucu

SEQ ID NO: 375968 - RNA, 23 nt, Human
ccggccccuuuugagcccugcca

SEQ ID NO: 375969 - RNA, 32 nt, Human
ccggcccgacucgcccucagaaacucacuguu

SEQ ID NO: 375970 - RNA, 32 nt, Human
ccggcccgagcaccuaagcuuuucaagacauu

SEQ ID NO: 375971 - RNA, 21 nt, Human
ccggcccgauccucacucgcc

SEQ ID NO: 375972 - RNA, 18 nt, Human
ccggcccgccaaggggac

SEQ ID NO: 375973 - RNA, 32 nt, Human
ccggcccgcccccgcggugcccucucuccucc

SEQ ID NO: 375974 - RNA, 32 nt, Human
ccggcccgccuucugcaaucaucacucccgca

SEQ ID NO: 375975 - RNA, 18 nt, Human
ccggcccgcugggcccgu

SEQ ID NO: 375976 - RNA, 22 nt, Human
ccggcccggccacacccaugcc

SEQ ID NO: 375977 - RNA, 32 nt, Human
ccggcccggcccugcccugcccugcccugucc

SEQ ID NO: 375978 - RNA, 21 nt, Human
ccggcccggcugagcccugcc

SEQ ID NO: 375979 - RNA, 23 nt, Human
ccggcccgggccagucccugcca

SEQ ID NO: 375980 - RNA, 19 nt, Human
ccggcccgggcucuggagg

SEQ ID NO: 375981 - RNA, 32 nt, Human
ccggcccuccagggccgccuccucuguuugcu

SEQ ID NO: 375982 - RNA, 32 nt, Human
ccggcccuccugggacuuguauuuuucucugg

SEQ ID NO: 375983 - RNA, 32 nt, Human
ccggcccucucugcaucucucucugaucuagc

SEQ ID NO: 375984 - RNA, 32 nt, Human
ccggcccugaacccgcgccccacauuucuguc

SEQ ID NO: 375985 - RNA, 32 nt, Human
ccggcccugcagcaguacagccagacccaaga

SEQ ID NO: 375986 - RNA, 32 nt, Human
ccggcccugcagccucccgugucccgucuccu

SEQ ID NO: 375987 - RNA, 32 nt, Human
ccggcccugcagcugccuucugccccagguuu

SEQ ID NO: 375988 - RNA, 32 nt, Human
ccggcccugcccugcccugcccuguccugccc

SEQ ID NO: 375989 - RNA, 32 nt, Human
ccggcccugccuggugucacuguggccaaaca

SEQ ID NO: 375990 - RNA, 32 nt, Human
ccggcccugcgacgcccuccugggcagcaccg

SEQ ID NO: 375991 - RNA, 32 nt, Human
ccggcccugcuccccuccagacuuccugcugu

SEQ ID NO: 375992 - RNA, 18 nt, Human
ccggcccugcucugggcc

SEQ ID NO: 375993 - RNA, 32 nt, Human
ccggcccugcugccacagcaguaaugaaauaa

SEQ ID NO: 375994 - RNA, 20 nt, Human
ccggcccuggcuggggacuu

SEQ ID NO: 375995 - RNA, 22 nt, Human
ccggcccuuccgccuccagcuc

SEQ ID NO: 375996 - RNA, 23 nt, Human
ccggcccuucugccccgccgccu

SEQ ID NO: 375997 - RNA, 19 nt, Human
ccggcccuugcagcugcag

SEQ ID NO: 375998 - RNA, 19 nt, Human
ccggcccuugccccgggcc

SEQ ID NO: 375999 - RNA, 32 nt, Human
ccggccgaagguggggacaggcaguggcaggc

SEQ ID NO: 376000 - RNA, 32 nt, Human
ccggccgagaaggcgccgaggagcagcgaggc

SEQ ID NO: 376001 - RNA, 32 nt, Human
ccggccgagccgcggcggcagcagcagcagca

SEQ ID NO: 376002 - RNA, 19 nt, Human
ccggccgauaggcaccuga

SEQ ID NO: 376003 - RNA, 32 nt, Human
ccggccgcagcccccgacgccugggugcgccu

SEQ ID NO: 376004 - RNA, 22 nt, Human
ccggccgccacugggcccugcc

SEQ ID NO: 376005 - RNA, 32 nt, Human
ccggccgccagcugcagccccgucgccucggc

SEQ ID NO: 376006 - RNA, 32 nt, Human
ccggccgcccccaccccucuggcuccugaaua

SEQ ID NO: 376007 - RNA, 17 nt, Human
ccggccgccgccgccac

SEQ ID NO: 376008 - RNA, 17 nt, Human
ccggccgcgccugggcu

SEQ ID NO: 376009 - RNA, 32 nt, Human
ccggccggagcggagcgcgcccggccccaugg

SEQ ID NO: 376010 - RNA, 32 nt, Human
ccggccggaggcgggagucacaggaagagccc

SEQ ID NO: 376011 - RNA, 32 nt, Human
ccggccggcaccacaacggggccaaaggcagu

SEQ ID NO: 376012 - RNA, 32 nt, Human
ccggccggcauggaggcggauuugagccagcu

SEQ ID NO: 376013 - RNA, 32 nt, Human
ccggccggccucagcccggcucugccuggugc

SEQ ID NO: 376014 - RNA, 32 nt, Human
ccggccgggccaggagcgagagcgagacucug

SEQ ID NO: 376015 - RNA, 32 nt, Human
ccggccgggcucgcgaugaccugcugagaagc

SEQ ID NO: 376016 - RNA, 32 nt, Human
ccggccgggggacgaguccggagcagcagcca

SEQ ID NO: 376017 - RNA, 21 nt, Human
ccggccggguagggggcgcgg

SEQ ID NO: 376018 - RNA, 32 nt, Human
ccggccgguagucccuggcgcugcugacccag

SEQ ID NO: 376019 - RNA, 32 nt, Human
ccggccguagccgccugcggcgccuccugucg

SEQ ID NO: 376020 - RNA, 23 nt, Human
ccggccguggcugagcucugcca

SEQ ID NO: 376021 - RNA, 32 nt, Human
ccggccuaaccaggcuggagugcagugguggg

SEQ ID NO: 376022 - RNA, 23 nt, Human
ccggccuacagcccgugcugcug

SEQ ID NO: 376023 - RNA, 32 nt, Human
ccggccuacagguugugaauguguuuuuauuc

SEQ ID NO: 376024 - RNA, 32 nt, Human
ccggccuacauggugaaaccccgucucuacua

SEQ ID NO: 376025 - RNA, 32 nt, Human
ccggccuagccccugcucacaucacagcuguc

SEQ ID NO: 376026 - RNA, 32 nt, Human
ccggccuaguuaccgucauaccacgggaggag

SEQ ID NO: 376027 - RNA, 32 nt, Human
ccggccucaagcaguccucccacuucggccuc

SEQ ID NO: 376028 - RNA, 21 nt, Human
ccggccucacaggccuugcca

SEQ ID NO: 376029 - RNA, 32 nt, Human
ccggccucagcuccuucuuucauuccagaccu

SEQ ID NO: 376030 - RNA, 21 nt, Human
ccggccucagcuguccgggcu

SEQ ID NO: 376031 - RNA, 32 nt, Human
ccggccucaucugcugcacacgcccagggcuc

SEQ ID NO: 376032 - RNA, 32 nt, Human
ccggccucauuuccucggaaaaucccugcuuu

SEQ ID NO: 376033 - RNA, 32 nt, Human
ccggccuccaaagccuaaugucuuugaucuua

SEQ ID NO: 376034 - RNA, 32 nt, Human
ccggccuccaggccccuccuggcuggcgagcg

SEQ ID NO: 376035 - RNA, 32 nt, Human
ccggccuccaucugaggauacuaagcgguucc

SEQ ID NO: 376036 - RNA, 32 nt, Human
ccggccucccaaagugccaggauuacaggcgu

SEQ ID NO: 376037 - RNA, 32 nt, Human
ccggccucccaaagugcugggauuacaggugu

SEQ ID NO: 376038 - RNA, 32 nt, Human
ccggccucccaaaguucugggauuacagggug

SEQ ID NO: 376039 - RNA, 19 nt, Human
ccggccucccaauagccgc

SEQ ID NO: 376040 - RNA, 32 nt, Human
ccggccucccagagugcugggauuacaggcgu

SEQ ID NO: 376041 - RNA, 32 nt, Human
ccggccuccccacuggguccuggaccuggcgc

SEQ ID NO: 376042 - RNA, 21 nt, Human
ccggccucccuucaccccucu

SEQ ID NO: 376043 - RNA, 23 nt, Human
ccggccuccuccugccacucuga

SEQ ID NO: 376044 - RNA, 32 nt, Human
ccggccuccugagucaccuucuaucuauacuu

SEQ ID NO: 376045 - RNA, 18 nt, Human
ccggccuccugccucucg

SEQ ID NO: 376046 - RNA, 19 nt, Human
ccggccuccuggcggccgc

SEQ ID NO: 376047 - RNA, 32 nt, Human
ccggccucgagggugaccucccuaccuugccc

SEQ ID NO: 376048 - RNA, 32 nt, Human
ccggccucgcacuccgcuuccggccgcucucg

SEQ ID NO: 376049 - RNA, 20 nt, Human
ccggccucgcuccgccgcuc

SEQ ID NO: 376050 - RNA, 22 nt, Human
ccggccucucccuccaguacuu

SEQ ID NO: 376051 - RNA, 32 nt, Human
ccggccucugcacuauucuacucucaugaacc

SEQ ID NO: 376052 - RNA, 32 nt, Human
ccggccucuggccuggcucaccuggccacugu

SEQ ID NO: 376053 - RNA, 21 nt, Human
ccggccucugugcccaggcca

SEQ ID NO: 376054 - RNA, 32 nt, Human
ccggccucugugggggucugugagcagcuucu

SEQ ID NO: 376055 - RNA, 32 nt, Human
ccggccugaccuuuggaaaagccuugucacuu

SEQ ID NO: 376056 - RNA, 18 nt, Human
ccggccugacgcuguggc

SEQ ID NO: 376057 - RNA, 32 nt, Human
ccggccugagcaacauagugaggaucccaucu

SEQ ID NO: 376058 - RNA, 32 nt, Human
ccggccugagggugcucccgcaggccuucacc

SEQ ID NO: 376059 - RNA, 31 nt, Human
ccggccugccucucuccgcuuugcugcuccu

SEQ ID NO: 376060 - RNA, 17 nt, Human
ccggccugcuccgagcc

SEQ ID NO: 376061 - RNA, 32 nt, Human
ccggccugcuccgagcccuggucccuggagcu

SEQ ID NO: 376062 - RNA, 32 nt, Human
ccggccugcuuccuuguauauccacaggagcu

SEQ ID NO: 376063 - RNA, 32 nt, Human
ccggccuggccaaccuccgccuccuggguuca

SEQ ID NO: 376064 - RNA, 32 nt, Human
ccggccugggauuggucgaaaaggaggggcgu

SEQ ID NO: 376065 - RNA, 20 nt, Human
ccggccugggcaacaagagc

SEQ ID NO: 376066 - RNA, 32 nt, Human
ccggccugggcaacagaggaagacugccucaa

SEQ ID NO: 376067 - RNA, 32 nt, Human
ccggccugggcaacguagugagagacccugua

SEQ ID NO: 376068 - RNA, 32 nt, Human
ccggccugggcagucuugucugccucggcugu

SEQ ID NO: 376069 - RNA, 32 nt, Human
ccggccugggcugcccccgcuccagucaaugc

SEQ ID NO: 376070 - RNA, 32 nt, Human
ccggccuggguggcgccagcaggcuuggacac

SEQ ID NO: 376071 - RNA, 18 nt, Human
ccggccugucugggccgc

SEQ ID NO: 376072 - RNA, 32 nt, Human
ccggccugugccccagcucuccccgagggcuc

SEQ ID NO: 376073 - RNA, 27 nt, Human
ccggccuguggacagccagacccugcc

SEQ ID NO: 376074 - RNA, 23 nt, Human
ccggccuguggaguugugggagg

SEQ ID NO: 376075 - RNA, 32 nt, Human
ccggccugugugacuugggugugaaugguuug

SEQ ID NO: 376076 - RNA, 32 nt, Human
ccggccuuaccucggcuccgccuucagucggc

SEQ ID NO: 376077 - RNA, 32 nt, Human
ccggccuuccaacuugcugugugcacauuaac

SEQ ID NO: 376078 - RNA, 28 nt, Human
ccggccuucgaggcugccuccuccaggc

SEQ ID NO: 376079 - RNA, 32 nt, Human
ccggccuucucacgucagugcaugucacaugc

SEQ ID NO: 376080 - RNA, 32 nt, Human
ccggccuucucccuucaucuugaucugggaag

SEQ ID NO: 376081 - RNA, 22 nt, Human
ccggccuugggugggcccucca

SEQ ID NO: 376082 - RNA, 19 nt, Human
ccggccuugucccgccuca

SEQ ID NO: 376083 - RNA, 32 nt, Human
ccggccuuucccucccucugccaaggacucau

SEQ ID NO: 376084 - RNA, 21 nt, Human
ccggccuuucgcuggugcuca

SEQ ID NO: 376085 - RNA, 19 nt, Human
ccggccuuuguccuggcuc

SEQ ID NO: 376086 - RNA, 23 nt, Human
ccggccuuuuccugcaguucuca

SEQ ID NO: 376087 - RNA, 32 nt, Human
ccggcgaagacgccuuccugggguacugagcc

SEQ ID NO: 376088 - RNA, 26 nt, Human
ccggcgaccccucgcuuccccaguca

SEQ ID NO: 376089 - RNA, 32 nt, Human
ccggcgaccuggcacccgcgccuggauauggg

SEQ ID NO: 376090 - RNA, 20 nt, Human
ccggcgacuggugcuacgca

SEQ ID NO: 376091 - RNA, 28 nt, Human
ccggcgaggggcggggggcuccggcccg

SEQ ID NO: 376092 - RNA, 25 nt, Human
ccggcgagggguggcuuugauuucg

SEQ ID NO: 376093 - RNA, 32 nt, Human
ccggcgcacggacuggccaggccccgcgggcc

SEQ ID NO: 376094 - RNA, 32 nt, Human
ccggcgcagccgcggcgggcgaggccaaugga

SEQ ID NO: 376095 - RNA, 32 nt, Human
ccggcgcagcucauggugagcgcccuuugggg

SEQ ID NO: 376096 - RNA, 19 nt, Human
ccggcgcagcucucgggcc

SEQ ID NO: 376097 - RNA, 32 nt, Human
ccggcgcaggagccaccucccugagccccgcg

SEQ ID NO: 376098 - RNA, 32 nt, Human
ccggcgcaggguggccggggaggggugagcag

SEQ ID NO: 376099 - RNA, 21 nt, Human
ccggcgccaggagggggugca

SEQ ID NO: 376100 - RNA, 18 nt, Human
ccggcgccgccacugccg

SEQ ID NO: 376101 - RNA, 18 nt, Human
ccggcgccgccgccgccg

SEQ ID NO: 376102 - RNA, 18 nt, Human
ccggcgccgccucggcca

SEQ ID NO: 376103 - RNA, 19 nt, Human
ccggcgccguccccgggcu

SEQ ID NO: 376104 - RNA, 20 nt, Human
ccggcgccucgcccugggcu

SEQ ID NO: 376105 - RNA, 32 nt, Human
ccggcgccugggcuugcugucuguucucggca

SEQ ID NO: 376106 - RNA, 32 nt, Human
ccggcgccuguaaucccagcuacuagggaggc

SEQ ID NO: 376107 - RNA, 32 nt, Human
ccggcgccuguaaucccagcuacucgggagac

SEQ ID NO: 376108 - RNA, 32 nt, Human
ccggcgcgcacagcugcacucagcggcuuccu

SEQ ID NO: 376109 - RNA, 17 nt, Human
ccggcgcgcuccgggcc

SEQ ID NO: 376110 - RNA, 32 nt, Human
ccggcgcggaggcaggaggagcagucucauug

SEQ ID NO: 376111 - RNA, 21 nt, Human
ccggcgcggggggcggcgugg

SEQ ID NO: 376112 - RNA, 19 nt, Human
ccggcgcucacucgaccgc

SEQ ID NO: 376113 - RNA, 32 nt, Human
ccggcgcucgcuggcccugcgcgcucggcgcg

SEQ ID NO: 376114 - RNA, 32 nt, Human
ccggcgcucuccccguguccucuccacgacuc

SEQ ID NO: 376115 - RNA, 32 nt, Human
ccggcgcucucgccucccugccgaacacagcg

SEQ ID NO: 376116 - RNA, 18 nt, Human
ccggcgcuggccugggcc

SEQ ID NO: 376117 - RNA, 32 nt, Human
ccggcgcugggaacacaaggagaaagacaaua

SEQ ID NO: 376118 - RNA, 32 nt, Human
ccggcgcuucuuaccuuaccuccgucucaucc

SEQ ID NO: 376119 - RNA, 32 nt, Human
ccggcggaaucuccugagcuccgccgcccagc

SEQ ID NO: 376120 - RNA, 19 nt, Human
ccggcggagagcggaccca

SEQ ID NO: 376121 - RNA, 24 nt, Human
ccggcggagcgaagaugcagugag

SEQ ID NO: 376122 - RNA, 23 nt, Human
ccggcggaggacccgcgagcucg

SEQ ID NO: 376123 - RNA, 24 nt, Human
ccggcggaggagcagcaggauccc

SEQ ID NO: 376124 - RNA, 22 nt, Human
ccggcggaggaggcgggagccc

SEQ ID NO: 376125 - RNA, 22 nt, Human
ccggcggaggcggcuggugccg

SEQ ID NO: 376126 - RNA, 18 nt, Human
ccggcggagggggcggag

SEQ ID NO: 376127 - RNA, 32 nt, Human
ccggcggaguuucuucagaggaacuaccgccc

SEQ ID NO: 376128 - RNA, 26 nt, Human
ccggcggcacgggaggcccgguuuug

SEQ ID NO: 376129 - RNA, 32 nt, Human
ccggcggccauggcaggcacccuggaccugga

SEQ ID NO: 376130 - RNA, 32 nt, Human
ccggcggcccaggauucuaaggaugcaauccu

SEQ ID NO: 376131 - RNA, 32 nt, Human
ccggcggcccccuuccccuccugaccccagau

SEQ ID NO: 376132 - RNA, 32 nt, Human
ccggcggcccccuuccccuccugccccagaug

SEQ ID NO: 376133 - RNA, 19 nt, Human
ccggcggccccgcgcucgc

SEQ ID NO: 376134 - RNA, 24 nt, Human
ccggcggcccggcugcuguuccca

SEQ ID NO: 376135 - RNA, 32 nt, Human
ccggcggccgccaccucuccccagcccaggag

SEQ ID NO: 376136 - RNA, 18 nt, Human
ccggcggccgccccggcc

SEQ ID NO: 376137 - RNA, 32 nt, Human
ccggcggccgcgcugaggccaccaugugacac

SEQ ID NO: 376138 - RNA, 19 nt, Human
ccggcggccgcugcugccg

SEQ ID NO: 376139 - RNA, 32 nt, Human
ccggcggcgcucggggagggagccagcagccu

SEQ ID NO: 376140 - RNA, 32 nt, Human
ccggcggcggcggcggcgcggagcagcacgua

SEQ ID NO: 376141 - RNA, 32 nt, Human
ccggcggcucgcgcccacgcugggccgggagu

SEQ ID NO: 376142 - RNA, 25 nt, Human
ccggcggcucggggcccccgcagca

SEQ ID NO: 376143 - RNA, 18 nt, Human
ccggcggcugccccggcc

SEQ ID NO: 376144 - RNA, 32 nt, Human
ccggcgggaccugcugggaggaauggcgccgc

SEQ ID NO: 376145 - RNA, 18 nt, Human
ccggcgggaggggcgcgg

SEQ ID NO: 376146 - RNA, 21 nt, Human
ccggcgggcagagguugcagu

SEQ ID NO: 376147 - RNA, 21 nt, Human
ccggcgggccgcuugaucccg

SEQ ID NO: 376148 - RNA, 18 nt, Human
ccggcgggcggggcgcag

SEQ ID NO: 376149 - RNA, 32 nt, Human
ccggcggggccagacgucugggcgcgggcagc

SEQ ID NO: 376150 - RNA, 32 nt, Human
ccggcggggccgggauaauaaggucugugggu

SEQ ID NO: 376151 - RNA, 32 nt, Human
ccggcgguggauggggccaggaagcaugcagg

SEQ ID NO: 376152 - RNA, 32 nt, Human
ccggcguacccucccacagauccagcaucacc

SEQ ID NO: 376153 - RNA, 32 nt, Human
ccggcguccggggcuccucuugucggcgacca

SEQ ID NO: 376154 - RNA, 32 nt, Human
ccggcgugagccaccaugcccagccuaucuau

SEQ ID NO: 376155 - RNA, 32 nt, Human
ccggcgugagccaccaugccuggcccggauaa

SEQ ID NO: 376156 - RNA, 20 nt, Human
ccggcgugauugccccgggc

SEQ ID NO: 376157 - RNA, 32 nt, Human
ccggcgugcaccaccaugccaggcuaauuuuu

SEQ ID NO: 376158 - RNA, 19 nt, Human
ccggcgugcgcgccgagcu

SEQ ID NO: 376159 - RNA, 32 nt, Human
ccggcgugucacaggugcgugcgugcuaaugg

SEQ ID NO: 376160 - RNA, 19 nt, Human
ccggcguuccucccuuccc

SEQ ID NO: 376161 - RNA, 32 nt, Human
ccggcuaacacggugaaaccccgucucuacua

SEQ ID NO: 376162 - RNA, 32 nt, Human
ccggcuaacauggugaaacccugccucuacua

SEQ ID NO: 376163 - RNA, 32 nt, Human
ccggcuaagccgcggccacccgcggucugagg

SEQ ID NO: 376164 - RNA, 22 nt, Human
ccggcuacacaguggagcugcc

SEQ ID NO: 376165 - RNA, 18 nt, Human
ccggcuauagccaggccc

SEQ ID NO: 376166 - RNA, 32 nt, Human
ccggcucaacuccagauagaaaaagugggaau

SEQ ID NO: 376167 - RNA, 32 nt, Human
ccggcucaagcaccauucacacugccauccaa

SEQ ID NO: 376168 - RNA, 32 nt, Human
ccggcucaagugcugcucuggcaaagcuccgg

SEQ ID NO: 376169 - RNA, 32 nt, Human
ccggcucaccagaggcagaaccguccuguugu

SEQ ID NO: 376170 - RNA, 24 nt, Human
ccggcucacccaccggccccacca

SEQ ID NO: 376171 - RNA, 31 nt, Human
ccggcucacucgccauggguuggagagggca

SEQ ID NO: 376172 - RNA, 32 nt, Human
ccggcucacugcaaccuccaccucccagguuc

SEQ ID NO: 376173 - RNA, 32 nt, Human
ccggcucacugcaaccuccgccucccugguuc

SEQ ID NO: 376174 - RNA, 32 nt, Human
ccggcucacugcaaccucugucuucuggguuc

SEQ ID NO: 376175 - RNA, 32 nt, Human
ccggcucacugcaguuuugaccucccaggcuc

SEQ ID NO: 376176 - RNA, 22 nt, Human
ccggcucaggaacagcagcagc

SEQ ID NO: 376177 - RNA, 32 nt, Human
ccggcucaguucagggaaaugcuguuccauau

SEQ ID NO: 376178 - RNA, 32 nt, Human
ccggcucaucaaggaggccgucugggaaaaga

SEQ ID NO: 376179 - RNA, 32 nt, Human
ccggcucauggacugaacucagcagggacucu

SEQ ID NO: 376180 - RNA, 32 nt, Human
ccggcuccaggccagacccaggagccaagaga

SEQ ID NO: 376181 - RNA, 23 nt, Human
ccggcuccauggcgaccgggcuc

SEQ ID NO: 376182 - RNA, 32 nt, Human
ccggcucccacaaauagacuccugggcgggcg

SEQ ID NO: 376183 - RNA, 25 nt, Human
ccggcucccacggccucugaggcuc

SEQ ID NO: 376184 - RNA, 32 nt, Human
ccggcucccauuccggcuccagccuccaaucc

SEQ ID NO: 376185 - RNA, 32 nt, Human
ccggcuccccagcccaccgccaugcagggcuc

SEQ ID NO: 376186 - RNA, 22 nt, Human
ccggcuccccggccccuggcuu

SEQ ID NO: 376187 - RNA, 32 nt, Human
ccggcuccccucagccugcuccgugugcucca

SEQ ID NO: 376188 - RNA, 22 nt, Human
ccggcuccccucccaggcugca

SEQ ID NO: 376189 - RNA, 20 nt, Human
ccggcucccggcccaggcuc

SEQ ID NO: 376190 - RNA, 18 nt, Human
ccggcucccggcccgagg

SEQ ID NO: 376191 - RNA, 23 nt, Human
ccggcucccggcgccgggccuca

SEQ ID NO: 376192 - RNA, 17 nt, Human
ccggcucccguccgggc

SEQ ID NO: 376193 - RNA, 22 nt, Human
ccggcucccgucucccuggcuc

SEQ ID NO: 376194 - RNA, 18 nt, Human
ccggcucccuccugagcu

SEQ ID NO: 376195 - RNA, 32 nt, Human
ccggcucccugagaugguccacucuguggcca

SEQ ID NO: 376196 - RNA, 32 nt, Human
ccggcucccugcauugccuggugagagggaag

SEQ ID NO: 376197 - RNA, 20 nt, Human
ccggcucccuucugcugcuc

SEQ ID NO: 376198 - RNA, 17 nt, Human
ccggcuccgcccaccca

SEQ ID NO: 376199 - RNA, 18 nt, Human
ccggcuccgccccgggcc

SEQ ID NO: 376200 - RNA, 32 nt, Human
ccggcuccuacccugaaggugcaccugcaauc

SEQ ID NO: 376201 - RNA, 32 nt, Human
ccggcuccuacccugaaggugcaccugcaguc

SEQ ID NO: 376202 - RNA, 32 nt, Human
ccggcuccuccccuccuccgccccuuccccag

SEQ ID NO: 376203 - RNA, 27 nt, Human
ccggcuccucccucuccuugugccuca

SEQ ID NO: 376204 - RNA, 24 nt, Human
ccggcuccuccucguccggcgcca

SEQ ID NO: 376205 - RNA, 32 nt, Human
ccggcuccucugccacccaccucccggggcug

SEQ ID NO: 376206 - RNA, 32 nt, Human
ccggcuccugcaggaucaugcagcuggggcgc

SEQ ID NO: 376207 - RNA, 32 nt, Human
ccggcuccugcucuccguguagccugaagccu

SEQ ID NO: 376208 - RNA, 32 nt, Human
ccggcuccugggcuucccagcgucgcggguag

SEQ ID NO: 376209 - RNA, 21 nt, Human
ccggcuccuguccccuggcuu

SEQ ID NO: 376210 - RNA, 32 nt, Human
ccggcucgagcucaggcuccagcuucagcccg

SEQ ID NO: 376211 - RNA, 32 nt, Human
ccggcucgcgccgccucgcgcucugccucagu

SEQ ID NO: 376212 - RNA, 32 nt, Human
ccggcucggcccggcccugcucuguucugccc

SEQ ID NO: 376213 - RNA, 21 nt, Human
ccggcucggcccguccggcuc

SEQ ID NO: 376214 - RNA, 32 nt, Human
ccggcucgggcgcgcaccugccggcugcggcc

SEQ ID NO: 376215 - RNA, 32 nt, Human
ccggcucgguacgcgcucugcuccgagccgcu

SEQ ID NO: 376216 - RNA, 32 nt, Human
ccggcucgguucugggauucugaggcucccca

SEQ ID NO: 376217 - RNA, 19 nt, Human
ccggcucucaccgcugcuu

SEQ ID NO: 376218 - RNA, 32 nt, Human
ccggcucucauagcacagucuacugcuuugua

SEQ ID NO: 376219 - RNA, 32 nt, Human
ccggcucucccaucagcggccugaggaccugg

SEQ ID NO: 376220 - RNA, 32 nt, Human
ccggcucuccuucugcagugcaggcgaaggcc

SEQ ID NO: 376221 - RNA, 32 nt, Human
ccggcucugaggugguggaggcggcggaggcg

SEQ ID NO: 376222 - RNA, 32 nt, Human
ccggcucugccuggugcucccugcagugccuu

SEQ ID NO: 376223 - RNA, 32 nt, Human
ccggcucuggaaggcaucccggcucuggguuc

SEQ ID NO: 376224 - RNA, 32 nt, Human
ccggcucugguacacgcuuucuccccagacgg

SEQ ID NO: 376225 - RNA, 32 nt, Human
ccggcucugguguuuuggcuuaugcguuccuu

SEQ ID NO: 376226 - RNA, 32 nt, Human
ccggcucugucgcccaggcuggagugcagugc

SEQ ID NO: 376227 - RNA, 32 nt, Human
ccggcucuucucucggagcugcaggggacagg

SEQ ID NO: 376228 - RNA, 32 nt, Human
ccggcugaccaacauucaaaagcacaaacccu

SEQ ID NO: 376229 - RNA, 32 nt, Human
ccggcugacuccugcccagguuuuccaggaac

SEQ ID NO: 376230 - RNA, 20 nt, Human
ccggcugagaccccugugcu

SEQ ID NO: 376231 - RNA, 23 nt, Human
ccggcugagccgggggagggcuc

SEQ ID NO: 376232 - RNA, 32 nt, Human
ccggcugagcgggccuggaggaagugagcagc

SEQ ID NO: 376233 - RNA, 21 nt, Human
ccggcugaggacccgcggcca

SEQ ID NO: 376234 - RNA, 24 nt, Human
ccggcugaggccacaccugugcca

SEQ ID NO: 376235 - RNA, 19 nt, Human
ccggcugcaaauucgccca

SEQ ID NO: 376236 - RNA, 32 nt, Human
ccggcugcacccagagggagcagugaggcagg

SEQ ID NO: 376237 - RNA, 32 nt, Human
ccggcugcacggccguccuggccaugccucug

SEQ ID NO: 376238 - RNA, 32 nt, Human
ccggcugcacucuagccgccuggguguguggc

SEQ ID NO: 376239 - RNA, 32 nt, Human
ccggcugcacuggccucuaggacucacagcag

SEQ ID NO: 376240 - RNA, 32 nt, Human
ccggcugcagaugggagcccgcggagccgagg

SEQ ID NO: 376241 - RNA, 19 nt, Human
ccggcugcaucuaucacca

SEQ ID NO: 376242 - RNA, 32 nt, Human
ccggcugccaucuccuccuccugggccgccgc

SEQ ID NO: 376243 - RNA, 32 nt, Human
ccggcugcccuaucuucccucacuuuucuuuu

SEQ ID NO: 376244 - RNA, 18 nt, Human
ccggcugccucccuccca

SEQ ID NO: 376245 - RNA, 32 nt, Human
ccggcugccucugcugcaguucagagcaacuu

SEQ ID NO: 376246 - RNA, 17 nt, Human
ccggcugcggcauagca

SEQ ID NO: 376247 - RNA, 25 nt, Human
ccggcugcgggccggcggcgggagg

SEQ ID NO: 376248 - RNA, 21 nt, Human
ccggcugcggggcgcgggggg

SEQ ID NO: 376249 - RNA, 32 nt, Human
ccggcugcugacaugacuucuuugccacucgg

SEQ ID NO: 376250 - RNA, 22 nt, Human
ccggcugcugccuggggcccuu

SEQ ID NO: 376251 - RNA, 22 nt, Human
ccggcugcugcuggcggcacuc

SEQ ID NO: 376252 - RNA, 32 nt, Human
ccggcuggaagagagcguagcacggcucgcac

SEQ ID NO: 376253 - RNA, 32 nt, Human
ccggcuggacccaagcccugcauccccacaug

SEQ ID NO: 376254 - RNA, 32 nt, Human
ccggcuggacugcccucuccuucuuggugauu

SEQ ID NO: 376255 - RNA, 32 nt, Human
ccggcuggaggaggagccgcagaggagugcca

SEQ ID NO: 376256 - RNA, 32 nt, Human
ccggcuggagggugagaucaacacguacuggg

SEQ ID NO: 376257 - RNA, 18 nt, Human
ccggcuggagugcagugg

SEQ ID NO: 376258 - RNA, 32 nt, Human
ccggcuggcacccuuccgcaagugacuggucc

SEQ ID NO: 376259 - RNA, 32 nt, Human
ccggcuggcccaggcccugcagcggcagccuu

SEQ ID NO: 376260 - RNA, 23 nt, Human
ccggcuggcgcuggugacggggg

SEQ ID NO: 376261 - RNA, 32 nt, Human
ccggcuggcggagaaaaggagaagacgguguc

SEQ ID NO: 376262 - RNA, 17 nt, Human
ccggcuggcugccgccu

SEQ ID NO: 376263 - RNA, 32 nt, Human
ccggcuggcugccuccccgugcuguguccagc

SEQ ID NO: 376264 - RNA, 32 nt, Human
ccggcugggacugccagaggaaccuggcuuug

SEQ ID NO: 376265 - RNA, 32 nt, Human
ccggcugggaggcagccgucugugcagcgagc

SEQ ID NO: 376266 - RNA, 32 nt, Human
ccggcugggaucauauguuccacacauguuug

SEQ ID NO: 376267 - RNA, 26 nt, Human
ccggcuggggaggggguggcaggggg

SEQ ID NO: 376268 - RNA, 32 nt, Human
ccggcuggggcagcuggcacucaccaggccug

SEQ ID NO: 376269 - RNA, 32 nt, Human
ccggcugggggacugcccagccucccaccugu

SEQ ID NO: 376270 - RNA, 32 nt, Human
ccggcugggucuccucccgggcucagugggcc

SEQ ID NO: 376271 - RNA, 32 nt, Human
ccggcuggguuugccaucagcccaggauacuc

SEQ ID NO: 376272 - RNA, 32 nt, Human
ccggcuggucaccagggauucaacugccucug

SEQ ID NO: 376273 - RNA, 24 nt, Human
ccggcuggucccaagggucaggaa

SEQ ID NO: 376274 - RNA, 32 nt, Human
ccggcugguguccucagagcaagcccucaaag

SEQ ID NO: 376275 - RNA, 32 nt, Human
ccggcuggugucuugagaccagccugccaggc

SEQ ID NO: 376276 - RNA, 23 nt, Human
ccggcugugcagggugagggagg

SEQ ID NO: 376277 - RNA, 32 nt, Human
ccggcugugcccaguaugccuccuggacccuc

SEQ ID NO: 376278 - RNA, 32 nt, Human
ccggcuguggagaaggaaauagggcccggcgc

SEQ ID NO: 376279 - RNA, 23 nt, Human
ccggcuguggagccccgcccgcc

SEQ ID NO: 376280 - RNA, 22 nt, Human
ccggcuguggcacccagcgcca

SEQ ID NO: 376281 - RNA, 32 nt, Human
ccggcugugggugguucugagcuguuuggcuu

SEQ ID NO: 376282 - RNA, 32 nt, Human
ccggcugugucaaccaggaccugcuggacucc

SEQ ID NO: 376283 - RNA, 32 nt, Human
ccggcuguguguguccuuccgggccuuccaua

SEQ ID NO: 376284 - RNA, 32 nt, Human
ccggcuuagacaccugccucugcuccugccca

SEQ ID NO: 376285 - RNA, 32 nt, Human
ccggcuuagggaggguugaugggggaggcgug

SEQ ID NO: 376286 - RNA, 32 nt, Human
ccggcuucaagccauucugcugccucagccuc

SEQ ID NO: 376287 - RNA, 32 nt, Human
ccggcuucaagugauucuccugccucagccuc

SEQ ID NO: 376288 - RNA, 32 nt, Human
ccggcuucagccucaaguucugaggucagagu

SEQ ID NO: 376289 - RNA, 32 nt, Human
ccggcuuccagcaggacguuuccccaggggau

SEQ ID NO: 376290 - RNA, 21 nt, Human
ccggcuucccgcccaggccca

SEQ ID NO: 376291 - RNA, 32 nt, Human
ccggcuucccgugaggcaggaggcagagccac

SEQ ID NO: 376292 - RNA, 32 nt, Human
ccggcuuccuugguggaggccgucuaggaaac

SEQ ID NO: 376293 - RNA, 32 nt, Human
ccggcuucgcgcggcccugccucccucucgcc

SEQ ID NO: 376294 - RNA, 22 nt, Human
ccggcuucuagcccaggacuca

SEQ ID NO: 376295 - RNA, 22 nt, Human
ccggcuucuccccgggcccuca

SEQ ID NO: 376296 - RNA, 32 nt, Human
ccggcuucucggcuuggauccugggcugggug

SEQ ID NO: 376297 - RNA, 32 nt, Human
ccggcuucucugugaggggucccaccagccca

SEQ ID NO: 376298 - RNA, 32 nt, Human
ccggcuugagccaccacacccggcacaucuuc

SEQ ID NO: 376299 - RNA, 32 nt, Human
ccggcuugccuguaaucccagcacuuugggag

SEQ ID NO: 376300 - RNA, 32 nt, Human
ccggcuuuccucccgugccucucccagcucua

SEQ ID NO: 376301 - RNA, 32 nt, Human
ccggcuuugccuggugaggcuggagggagcac

SEQ ID NO: 376302 - RNA, 32 nt, Human
ccgggaaaaguggcacugaggcucuggaacuu

SEQ ID NO: 376303 - RNA, 32 nt, Human
ccgggaaagagcccagccugccaacaccucga

SEQ ID NO: 376304 - RNA, 32 nt, Human
ccgggaaagcccucugcccacacccacaggcu

SEQ ID NO: 376305 - RNA, 28 nt, Human
ccgggaaagugcugaaaucugcagugag

SEQ ID NO: 376306 - RNA, 32 nt, Human
ccgggaaauacacacagagccaggagcagaag

SEQ ID NO: 376307 - RNA, 32 nt, Human
ccgggaacaaugucaguucuacaugguggucu

SEQ ID NO: 376308 - RNA, 32 nt, Human
ccgggaaccccagaggaggucgcaguucagcc

SEQ ID NO: 376309 - RNA, 20 nt, Human
ccgggaaccggggaccgaga

SEQ ID NO: 376310 - RNA, 32 nt, Human
ccgggaaccugucggcgagcugcgggagcgcg

SEQ ID NO: 376311 - RNA, 23 nt, Human
ccgggaacggaggcggccagcgg

SEQ ID NO: 376312 - RNA, 32 nt, Human
ccgggaacuccucugugggcucagugacaggu

SEQ ID NO: 376313 - RNA, 31 nt, Human
ccgggaacugagagaggaagaagagugaagg

SEQ ID NO: 376314 - RNA, 32 nt, Human
ccgggaacugcccgcagccugcucugagcuuu

SEQ ID NO: 376315 - RNA, 32 nt, Human
ccgggaagagcaggcgggugaaaaugaaagcc

SEQ ID NO: 376316 - RNA, 21 nt, Human
ccgggaagagcgggccugcug

SEQ ID NO: 376317 - RNA, 22 nt, Human
ccgggaagaguagggacugcug

SEQ ID NO: 376318 - RNA, 24 nt, Human
ccgggaagcagagguugcagugag

SEQ ID NO: 376319 - RNA, 24 nt, Human
ccgggaagcagagguugcggugag

SEQ ID NO: 376320 - RNA, 23 nt, Human
ccgggaagcagagguuguaguga

SEQ ID NO: 376321 - RNA, 24 nt, Human
ccgggaagcagagguuguagugag

SEQ ID NO: 376322 - RNA, 24 nt, Human
ccgggaagcagagucugcagugag

SEQ ID NO: 376323 - RNA, 24 nt, Human
ccgggaagcggagcuugcagugag

SEQ ID NO: 376324 - RNA, 24 nt, Human
ccgggaagcggagguugcagggag

SEQ ID NO: 376325 - RNA, 18 nt, Human
ccgggaagcuccggggua

SEQ ID NO: 376326 - RNA, 32 nt, Human
ccgggaaggaagagcggagccggagcgagcca

SEQ ID NO: 376327 - RNA, 32 nt, Human
ccgggaaggaaggcguccaguuucauuacaca

SEQ ID NO: 376328 - RNA, 23 nt, Human
ccgggaaggcaaaaaaugcagug

SEQ ID NO: 376329 - RNA, 32 nt, Human
ccgggaaggcggaaguugcagugagccgagug

SEQ ID NO: 376330 - RNA, 21 nt, Human
ccgggaaggggcccccagcug

SEQ ID NO: 376331 - RNA, 24 nt, Human
ccgggaaguggagguugcagugag

SEQ ID NO: 376332 - RNA, 32 nt, Human
ccgggaaguggcucuugugugugcccaccuca

SEQ ID NO: 376333 - RNA, 32 nt, Human
ccgggaagugggaggacguagagcagagaaga

SEQ ID NO: 376334 - RNA, 32 nt, Human
ccgggaaguuccugggcuuugcuccaaagcug

SEQ ID NO: 376335 - RNA, 32 nt, Human
ccgggaaucuacaguggugacaaggacauggg

SEQ ID NO: 376336 - RNA, 31 nt, Human
ccgggaaugggaaagacagaagagaagggaa

SEQ ID NO: 376337 - RNA, 32 nt, Human
ccgggaaugggaaagacagaagagaagggaaa

SEQ ID NO: 376338 - RNA, 32 nt, Human
ccgggaaugguggcucacgccuguaaucucag

SEQ ID NO: 376339 - RNA, 32 nt, Human
ccgggaauggugguucacgccuguaaucccag

SEQ ID NO: 376340 - RNA, 31 nt, Human
ccgggacaagaccagggcaggagggagccgg

SEQ ID NO: 376341 - RNA, 32 nt, Human
ccgggacagagaccaugagaggaggccgauug

SEQ ID NO: 376342 - RNA, 32 nt, Human
ccgggacaggcccagccccagagcccagagau

SEQ ID NO: 376343 - RNA, 32 nt, Human
ccgggaccacucucccuggcaggagcccgccu

SEQ ID NO: 376344 - RNA, 27 nt, Human
ccgggaccacugugaacccugccgccu

SEQ ID NO: 376345 - RNA, 32 nt, Human
ccgggaccagaggcugcugacacugucgcugg

SEQ ID NO: 376346 - RNA, 32 nt, Human
ccgggaccaugaacggggaggccaucugcagc

SEQ ID NO: 376347 - RNA, 32 nt, Human
ccgggaccaugguggcccaggcugcagccgcc

SEQ ID NO: 376348 - RNA, 32 nt, Human
ccgggaccauguccaaaccuucagaccacauc

SEQ ID NO: 376349 - RNA, 32 nt, Human
ccgggacccacugugcagccagcagccgggcc

SEQ ID NO: 376350 - RNA, 19 nt, Human
ccgggacccagaccugggg

SEQ ID NO: 376351 - RNA, 16 nt, Human
ccgggaccccaccucu

SEQ ID NO: 376352 - RNA, 25 nt, Human
ccgggaccccaccucuaccucccca

SEQ ID NO: 376353 - RNA, 25 nt, Human
ccgggaccccccuccccacccccca

SEQ ID NO: 376354 - RNA, 23 nt, Human
ccgggacccccgcggccuccgca

SEQ ID NO: 376355 - RNA, 21 nt, Human
ccgggacccucgaccuccuca

SEQ ID NO: 376356 - RNA, 21 nt, Human
ccgggacccucugcugcuccc

SEQ ID NO: 376357 - RNA, 26 nt, Human
ccgggaccgcugcccucacgcgccgc

SEQ ID NO: 376358 - RNA, 18 nt, Human
ccgggaccggcccguguc

SEQ ID NO: 376359 - RNA, 24 nt, Human
ccgggaccugccaccagcccccca

SEQ ID NO: 376360 - RNA, 32 nt, Human
ccgggaccugccgccgcugccugcgcgccccg

SEQ ID NO: 376361 - RNA, 32 nt, Human
ccgggaccuucagacccagggaaagggugagg

SEQ ID NO: 376362 - RNA, 23 nt, Human
ccgggacgcagagguuacaguga

SEQ ID NO: 376363 - RNA, 24 nt, Human
ccgggacgcagggguugcagugag

SEQ ID NO: 376364 - RNA, 19 nt, Human
ccgggacgccccgcugccg

SEQ ID NO: 376365 - RNA, 32 nt, Human
ccgggacgccccugcaccucugcuccggugca

SEQ ID NO: 376366 - RNA, 32 nt, Human
ccgggacgcgccgggcuggagugggcgguuau

SEQ ID NO: 376367 - RNA, 18 nt, Human
ccgggacggccccacgga

SEQ ID NO: 376368 - RNA, 32 nt, Human
ccgggacguggauacagaugaaaagaagcaaa

SEQ ID NO: 376369 - RNA, 32 nt, Human
ccgggacguggauacagaugaaaagaagcaag

SEQ ID NO: 376370 - RNA, 32 nt, Human
ccgggacuaaaagaaaagacagcacugcaaau

SEQ ID NO: 376371 - RNA, 22 nt, Human
ccgggacuacaggcaugcacca

SEQ ID NO: 376372 - RNA, 32 nt, Human
ccgggacucuagcagcggucuccgcgaccccc

SEQ ID NO: 376373 - RNA, 22 nt, Human
ccgggacugcaggcacaagcca

SEQ ID NO: 376374 - RNA, 32 nt, Human
ccgggacugcuggucacugcuuagaaccguca

SEQ ID NO: 376375 - RNA, 24 nt, Human
ccgggacuucaaugcugcagugag

SEQ ID NO: 376376 - RNA, 21 nt, Human
ccgggacuuggugaaacuuug

SEQ ID NO: 376377 - RNA, 28 nt, Human
ccgggagaagaugcugccucguuguuau

SEQ ID NO: 376378 - RNA, 32 nt, Human
ccgggagaagggcuggaaggaggggacuggac

SEQ ID NO: 376379 - RNA, 20 nt, Human
ccgggagacagagguugcag

SEQ ID NO: 376380 - RNA, 23 nt, Human
ccgggagacagagguugcaguga

SEQ ID NO: 376381 - RNA, 24 nt, Human
ccgggagacagagguugcagugag

SEQ ID NO: 376382 - RNA, 32 nt, Human
ccgggagacagaugaggcgagaggaggaggag

SEQ ID NO: 376383 - RNA, 17 nt, Human
ccgggagaccuuuucca

SEQ ID NO: 376384 - RNA, 24 nt, Human
ccgggagacggagguugcagugag

SEQ ID NO: 376385 - RNA, 24 nt, Human
ccgggagacggcgcuugcagugag

SEQ ID NO: 376386 - RNA, 20 nt, Human
ccgggagagagggggcgcgg

SEQ ID NO: 376387 - RNA, 24 nt, Human
ccgggagagggagguugcagugag

SEQ ID NO: 376388 - RNA, 19 nt, Human
ccgggagaggggggugcag

SEQ ID NO: 376389 - RNA, 32 nt, Human
ccgggagauaaguaugagaugcgcagccacgg

SEQ ID NO: 376390 - RNA, 24 nt, Human
ccgggagaugcauguugcagugag

SEQ ID NO: 376391 - RNA, 24 nt, Human
ccgggagauugaggcugcggugag

SEQ ID NO: 376392 - RNA, 23 nt, Human
ccgggagcacacgaacccugcca

SEQ ID NO: 376393 - RNA, 23 nt, Human
ccgggagcagagacugcagugag

SEQ ID NO: 376394 - RNA, 32 nt, Human
ccgggagcaggccuccggccucccagacuucu

SEQ ID NO: 376395 - RNA, 32 nt, Human
ccgggagccaggacucggcgacgcgaggcugc

SEQ ID NO: 376396 - RNA, 32 nt, Human
ccgggagcccacggcgguuaauucuuuuuacc

SEQ ID NO: 376397 - RNA, 32 nt, Human
ccgggagcccaggguggcagagcuguggugca

SEQ ID NO: 376398 - RNA, 32 nt, Human
ccgggagcccucucuucuccgcagaggagagc

SEQ ID NO: 376399 - RNA, 23 nt, Human
ccgggagccgagcuugcagcgag

SEQ ID NO: 376400 - RNA, 32 nt, Human
ccgggagccgcacuccagacuggcccgguagu

SEQ ID NO: 376401 - RNA, 30 nt, Human
ccgggagccggcuccaugcgccuggagcgc

SEQ ID NO: 376402 - RNA, 22 nt, Human
ccgggagccgggagccgagcgc

SEQ ID NO: 376403 - RNA, 32 nt, Human
ccgggagccugaggcaggagaauugcuugaac

SEQ ID NO: 376404 - RNA, 32 nt, Human
ccgggagccuguaccguucccugcugguugag

SEQ ID NO: 376405 - RNA, 32 nt, Human
ccgggagcgacguggggaaacugaggcccgga

SEQ ID NO: 376406 - RNA, 23 nt, Human
ccgggagcggagcuugcagugag

SEQ ID NO: 376407 - RNA, 23 nt, Human
ccgggagcggagguugcagugag

SEQ ID NO: 376408 - RNA, 32 nt, Human
ccgggagcggggcccggcgccgcccgggccgc

SEQ ID NO: 376409 - RNA, 32 nt, Human
ccgggagcugcggagcaugcguggaguggcag

SEQ ID NO: 376410 - RNA, 16 nt, Human
ccgggagcugcugccu

SEQ ID NO: 376411 - RNA, 21 nt, Human
ccgggagcugggaacccgcag

SEQ ID NO: 376412 - RNA, 32 nt, Human
ccgggagcuugaggccagagugagugacuugg

SEQ ID NO: 376413 - RNA, 32 nt, Human
ccgggaggacauggacagggaaggagaugcag

SEQ ID NO: 376414 - RNA, 32 nt, Human
ccgggaggagccaaccguggcgcaggcggcgc

SEQ ID NO: 376415 - RNA, 24 nt, Human
ccgggaggaggagcuugcagugag

SEQ ID NO: 376416 - RNA, 24 nt, Human
ccgggaggcaaagguugcagugag

SEQ ID NO: 376417 - RNA, 21 nt, Human
ccgggaggcaaagguugcggu

SEQ ID NO: 376418 - RNA, 24 nt, Human
ccgggaggcaaguaggacagagag

SEQ ID NO: 376419 - RNA, 24 nt, Human
ccgggaggcaccccacccucccca

SEQ ID NO: 376420 - RNA, 24 nt, Human
ccgggaggcagaaccugcagugag

SEQ ID NO: 376421 - RNA, 23 nt, Human
ccgggaggcagaaguugcaguga

SEQ ID NO: 376422 - RNA, 24 nt, Human
ccgggaggcagaaguugcagugag

SEQ ID NO: 376423 - RNA, 24 nt, Human
ccgggaggcagacuuugcagugag

SEQ ID NO: 376424 - RNA, 21 nt, Human
ccgggaggcagagauugcagu

SEQ ID NO: 376425 - RNA, 24 nt, Human
ccgggaggcagagcuugcagugag

SEQ ID NO: 376426 - RNA, 24 nt, Human
ccgggaggcagagcuugcggugag

SEQ ID NO: 376427 - RNA, 19 nt, Human
ccgggaggcagaggcugca

SEQ ID NO: 376428 - RNA, 23 nt, Human
ccgggaggcagaggcugcaguga

SEQ ID NO: 376429 - RNA, 24 nt, Human
ccgggaggcagaggcugcagugag

SEQ ID NO: 376430 - RNA, 32 nt, Human
ccgggaggcagaggcuguagugagccaagaua

SEQ ID NO: 376431 - RNA, 23 nt, Human
ccgggaggcagagggaguaguga

SEQ ID NO: 376432 - RNA, 21 nt, Human
ccgggaggcagagggugcagu

SEQ ID NO: 376433 - RNA, 24 nt, Human
ccgggaggcagagguagcagugag

SEQ ID NO: 376434 - RNA, 24 nt, Human
ccgggaggcagaggucauggugag

SEQ ID NO: 376435 - RNA, 24 nt, Human
ccgggaggcagagguggcugugag

SEQ ID NO: 376436 - RNA, 24 nt, Human
ccgggaggcagagguuacagugag

SEQ ID NO: 376437 - RNA, 24 nt, Human
ccgggaggcagagguuaucgugag

SEQ ID NO: 376438 - RNA, 24 nt, Human
ccgggaggcagagguugaagugag

SEQ ID NO: 376439 - RNA, 24 nt, Human
ccgggaggcagagguugcacugag

SEQ ID NO: 376440 - RNA, 20 nt, Human
ccgggaggcagagguugcag

SEQ ID NO: 376441 - RNA, 22 nt, Human
ccgggaggcagagguugcagga

SEQ ID NO: 376442 - RNA, 23 nt, Human
ccgggaggcagagguugcaggag

SEQ ID NO: 376443 - RNA, 23 nt, Human
ccgggaggcagagguugcaguga

SEQ ID NO: 376444 - RNA, 24 nt, Human
ccgggaggcagagguugcagugag

SEQ ID NO: 376445 - RNA, 24 nt, Human
ccgggaggcagagguugcagugug

SEQ ID NO: 376446 - RNA, 24 nt, Human
ccgggaggcagagguugcggugag

SEQ ID NO: 376447 - RNA, 21 nt, Human
ccgggaggcagagguugcugu

SEQ ID NO: 376448 - RNA, 23 nt, Human
ccgggaggcagagguugcuguga

SEQ ID NO: 376449 - RNA, 24 nt, Human
ccgggaggcagagguugcugugag

SEQ ID NO: 376450 - RNA, 24 nt, Human
ccgggaggcagagguuguagugag

SEQ ID NO: 376451 - RNA, 24 nt, Human
ccgggaggcagagguuguguugag

SEQ ID NO: 376452 - RNA, 24 nt, Human
ccgggaggcagagguuucagugag

SEQ ID NO: 376453 - RNA, 24 nt, Human
ccgggaggcagaguuugcagugag

SEQ ID NO: 376454 - RNA, 24 nt, Human
ccgggaggcagcaguugcagugag

SEQ ID NO: 376455 - RNA, 24 nt, Human
ccgggaggcauagcuugcagugag

SEQ ID NO: 376456 - RNA, 24 nt, Human
ccgggaggcggaacuugcagugag

SEQ ID NO: 376457 - RNA, 24 nt, Human
ccgggaggcggaacuugcggugag

SEQ ID NO: 376458 - RNA, 22 nt, Human
ccgggaggcggaaguugcagug

SEQ ID NO: 376459 - RNA, 23 nt, Human
ccgggaggcggaaguugcaguga

SEQ ID NO: 376460 - RNA, 24 nt, Human
ccgggaggcggaaguugcagugag

SEQ ID NO: 376461 - RNA, 24 nt, Human
ccgggaggcggaaguuguggugag

SEQ ID NO: 376462 - RNA, 23 nt, Human
ccgggaggcggagagucaaguga

SEQ ID NO: 376463 - RNA, 24 nt, Human
ccgggaggcggagauugcggugag

SEQ ID NO: 376464 - RNA, 24 nt, Human
ccgggaggcggagcuuacagugag

SEQ ID NO: 376465 - RNA, 20 nt, Human
ccgggaggcggagcuugcag

SEQ ID NO: 376466 - RNA, 23 nt, Human
ccgggaggcggagcuugcagcga

SEQ ID NO: 376467 - RNA, 24 nt, Human
ccgggaggcggagcuugcagcgag

SEQ ID NO: 376468 - RNA, 23 nt, Human
ccgggaggcggagcuugcaguga

SEQ ID NO: 376469 - RNA, 24 nt, Human
ccgggaggcggagcuugcagugag

SEQ ID NO: 376470 - RNA, 24 nt, Human
ccgggaggcggagcuuguagugag

SEQ ID NO: 376471 - RNA, 24 nt, Human
ccgggaggcggagcuuucagugag

SEQ ID NO: 376472 - RNA, 22 nt, Human
ccgggaggcggaggcgcggggg

SEQ ID NO: 376473 - RNA, 19 nt, Human
ccgggaggcggaggcggga

SEQ ID NO: 376474 - RNA, 20 nt, Human
ccgggaggcggaggcgggag

SEQ ID NO: 376475 - RNA, 24 nt, Human
ccgggaggcggaggcugcagugag

SEQ ID NO: 376476 - RNA, 24 nt, Human
ccgggaggcggagguuacagugag

SEQ ID NO: 376477 - RNA, 24 nt, Human
ccgggaggcggagguuauggagag

SEQ ID NO: 376478 - RNA, 22 nt, Human
ccgggaggcggagguucauggg

SEQ ID NO: 376479 - RNA, 24 nt, Human
ccgggaggcggagguuccagugag

SEQ ID NO: 376480 - RNA, 24 nt, Human
ccgggaggcggagguugaggugag

SEQ ID NO: 376481 - RNA, 21 nt, Human
ccgggaggcggagguugcagu

SEQ ID NO: 376482 - RNA, 22 nt, Human
ccgggaggcggagguugcagug

SEQ ID NO: 376483 - RNA, 23 nt, Human
ccgggaggcggagguugcaguga

SEQ ID NO: 376484 - RNA, 24 nt, Human
ccgggaggcggagguugcagugag

SEQ ID NO: 376485 - RNA, 24 nt, Human
ccgggaggcggagguugcaguuag

SEQ ID NO: 376486 - RNA, 23 nt, Human
ccgggaggcggagguugcaugag

SEQ ID NO: 376487 - RNA, 24 nt, Human
ccgggaggcggagguugccgugag

SEQ ID NO: 376488 - RNA, 23 nt, Human
ccgggaggcggagguugcgguga

SEQ ID NO: 376489 - RNA, 24 nt, Human
ccgggaggcggagguugcggugag

SEQ ID NO: 376490 - RNA, 24 nt, Human
ccgggaggcggagguuguagugag

SEQ ID NO: 376491 - RNA, 24 nt, Human
ccgggaggcggagguuguggugag

SEQ ID NO: 376492 - RNA, 24 nt, Human
ccgggaggcggagguuucagugag

SEQ ID NO: 376493 - RNA, 23 nt, Human
ccgggaggcggaguugcggugag

SEQ ID NO: 376494 - RNA, 24 nt, Human
ccgggaggcggaguuugcagagag

SEQ ID NO: 376495 - RNA, 24 nt, Human
ccgggaggcggaguuugcagugag

SEQ ID NO: 376496 - RNA, 22 nt, Human
ccgggaggcggaguuuugccag

SEQ ID NO: 376497 - RNA, 32 nt, Human
ccgggaggcggcggaggucaccgcggggagag

SEQ ID NO: 376498 - RNA, 24 nt, Human
ccgggaggcggcgguugcagugag

SEQ ID NO: 376499 - RNA, 24 nt, Human
ccgggaggcggggguugcagugag

SEQ ID NO: 376500 - RNA, 24 nt, Human
ccgggaggcgggucuugcagugag

SEQ ID NO: 376501 - RNA, 24 nt, Human
ccgggaggcuaagguugcagugag

SEQ ID NO: 376502 - RNA, 19 nt, Human
ccgggaggcuaaugcagga

SEQ ID NO: 376503 - RNA, 32 nt, Human
ccgggaggcuaaugcaggagaaucgcuugaac

SEQ ID NO: 376504 - RNA, 18 nt, Human
ccgggaggcucgcggugg

SEQ ID NO: 376505 - RNA, 32 nt, Human
ccgggaggcugaggcaggagaaucacuugaac

SEQ ID NO: 376506 - RNA, 32 nt, Human
ccgggaggcugaggcaggagaaucacuuguac

SEQ ID NO: 376507 - RNA, 32 nt, Human
ccgggaggcugaggcaggagaaucgcuugaac

SEQ ID NO: 376508 - RNA, 32 nt, Human
ccgggaggcugaggcaggagaauggcgugaac

SEQ ID NO: 376509 - RNA, 32 nt, Human
ccgggaggcugaggcaggagaauugcuugaac

SEQ ID NO: 376510 - RNA, 32 nt, Human
ccgggaggcugaggcaggagagucacuugaac

SEQ ID NO: 376511 - RNA, 32 nt, Human
ccgggaggcugaggcgggagaaucgcuugaac

SEQ ID NO: 376512 - RNA, 24 nt, Human
ccgggaggcugagguugcagugag

SEQ ID NO: 376513 - RNA, 31 nt, Human
ccgggagggaaacugucuguggcucuaggcu

SEQ ID NO: 376514 - RNA, 32 nt, Human
ccgggagggaaacugucuguggcucuaggcug

SEQ ID NO: 376515 - RNA, 24 nt, Human
ccgggagggagagguugcagugag

SEQ ID NO: 376516 - RNA, 32 nt, Human
ccgggagggaggcaaaugagcauugagaaauu

SEQ ID NO: 376517 - RNA, 21 nt, Human
ccgggagggcccagcagugag

SEQ ID NO: 376518 - RNA, 32 nt, Human
ccgggagguagaggcaggcugaugggggaggg

SEQ ID NO: 376519 - RNA, 24 nt, Human
ccgggagguagaggcugcaauggg

SEQ ID NO: 376520 - RNA, 24 nt, Human
ccgggagguagagguugcagugag

SEQ ID NO: 376521 - RNA, 24 nt, Human
ccgggagguagaguuugcagugag

SEQ ID NO: 376522 - RNA, 24 nt, Human
ccgggaggucaagguugcagugag

SEQ ID NO: 376523 - RNA, 18 nt, Human
ccgggagguccugcagga

SEQ ID NO: 376524 - RNA, 24 nt, Human
ccgggaggucgaggcugcugugag

SEQ ID NO: 376525 - RNA, 24 nt, Human
ccgggagguggagauugcagugag

SEQ ID NO: 376526 - RNA, 24 nt, Human
ccgggagguggagcuugcagugag

SEQ ID NO: 376527 - RNA, 24 nt, Human
ccgggagguggaggcugcaaugag

SEQ ID NO: 376528 - RNA, 24 nt, Human
ccgggagguggaggcugcagugag

SEQ ID NO: 376529 - RNA, 24 nt, Human
ccgggagguggaggcugcggugag

SEQ ID NO: 376530 - RNA, 24 nt, Human
ccgggagguggaggucgcggugag

SEQ ID NO: 376531 - RNA, 24 nt, Human
ccgggagguggagguuacagugag

SEQ ID NO: 376532 - RNA, 20 nt, Human
ccgggagguggagguugcag

SEQ ID NO: 376533 - RNA, 24 nt, Human
ccgggagguggagguugcagggag

SEQ ID NO: 376534 - RNA, 23 nt, Human
ccgggagguggagguugcaguga

SEQ ID NO: 376535 - RNA, 24 nt, Human
ccgggagguggagguugcagugag

SEQ ID NO: 376536 - RNA, 24 nt, Human
ccgggagguggagguugccgugag

SEQ ID NO: 376537 - RNA, 24 nt, Human
ccgggagguggagguugcgaugag

SEQ ID NO: 376538 - RNA, 24 nt, Human
ccgggagguggagguugcggugag

SEQ ID NO: 376539 - RNA, 24 nt, Human
ccgggagguggagguuguagugag

SEQ ID NO: 376540 - RNA, 24 nt, Human
ccgggaggugggaguuguagugag

SEQ ID NO: 376541 - RNA, 24 nt, Human
ccgggagguugaggcugcaguggg

SEQ ID NO: 376542 - RNA, 32 nt, Human
ccgggagucuuuccccacaccccagccaucgc

SEQ ID NO: 376543 - RNA, 23 nt, Human
ccgggaguggagcuugcaaugag

SEQ ID NO: 376544 - RNA, 32 nt, Human
ccgggagugguggcucacgccuguaaugccag

SEQ ID NO: 376545 - RNA, 32 nt, Human
ccgggagugguggugggcaccuguaaucccag

SEQ ID NO: 376546 - RNA, 32 nt, Human
ccgggaguugcuggacugagacaugagccucc

SEQ ID NO: 376547 - RNA, 24 nt, Human
ccgggaguuugaaguugcagugag

SEQ ID NO: 376548 - RNA, 32 nt, Human
ccgggaguuugagaccagccugggcaacaugg

SEQ ID NO: 376549 - RNA, 24 nt, Human
ccgggaguuugagucugcagugag

SEQ ID NO: 376550 - RNA, 24 nt, Human
ccgggauauaggggcggggcgcag

SEQ ID NO: 376551 - RNA, 32 nt, Human
ccgggaucaagcaaucccacuucagccucuug

SEQ ID NO: 376552 - RNA, 32 nt, Human
ccgggaucagccaggggccagcaugagccgga

SEQ ID NO: 376553 - RNA, 32 nt, Human
ccgggauccaugugucuuuccuggugacuagg

SEQ ID NO: 376554 - RNA, 20 nt, Human
ccgggauccucucacuguca

SEQ ID NO: 376555 - RNA, 32 nt, Human
ccgggauccuggaaggugaguguguaugaauu

SEQ ID NO: 376556 - RNA, 22 nt, Human
ccgggaucgccaccuccugccu

SEQ ID NO: 376557 - RNA, 32 nt, Human
ccgggaucuggcuuuccuucccuucccaccac

SEQ ID NO: 376558 - RNA, 22 nt, Human
ccgggaugacaggcaugagcca

SEQ ID NO: 376559 - RNA, 32 nt, Human
ccgggaugcagagcagcuuuugugcacgguuc

SEQ ID NO: 376560 - RNA, 32 nt, Human
ccgggaugccuccggcccugcccagcaggccu

SEQ ID NO: 376561 - RNA, 32 nt, Human
ccgggauggcugcuuccaaguuguuugcaauu

SEQ ID NO: 376562 - RNA, 32 nt, Human
ccgggaugggaucagaugggaagcagaagcuc

SEQ ID NO: 376563 - RNA, 32 nt, Human
ccgggaugggggcgcgcccugccugguccggc

SEQ ID NO: 376564 - RNA, 22 nt, Human
ccgggauuacaggcauaagcca

SEQ ID NO: 376565 - RNA, 22 nt, Human
ccgggauuacaggcaugagcca

SEQ ID NO: 376566 - RNA, 22 nt, Human
ccgggauuacaggcaugagcua

SEQ ID NO: 376567 - RNA, 22 nt, Human
ccgggauuacaggcgugagcca

SEQ ID NO: 376568 - RNA, 23 nt, Human
ccgggauugcuacuucucugcca

SEQ ID NO: 376569 - RNA, 32 nt, Human
ccgggauuuccucugcagcggacgcggcacug

SEQ ID NO: 376570 - RNA, 32 nt, Human
ccgggcaacaagggcuaaacuccaucucaaaa

SEQ ID NO: 376571 - RNA, 20 nt, Human
ccgggcaacauggcaaaacc

SEQ ID NO: 376572 - RNA, 20 nt, Human
ccgggcaacauggugaaacc

SEQ ID NO: 376573 - RNA, 32 nt, Human
ccgggcaacauggugaaaccccgucucuacaa

SEQ ID NO: 376574 - RNA, 32 nt, Human
ccgggcaacuggagagagcugggagucaauac

SEQ ID NO: 376575 - RNA, 32 nt, Human
ccgggcaagcaguuccaccagggccagcacug

SEQ ID NO: 376576 - RNA, 32 nt, Human
ccgggcacaccagcccucagagaccugagcuc

SEQ ID NO: 376577 - RNA, 32 nt, Human
ccgggcacaguggcucaugccuguaaucccag

SEQ ID NO: 376578 - RNA, 32 nt, Human
ccgggcaccaucagacucccaccuccacuguc

SEQ ID NO: 376579 - RNA, 32 nt, Human
ccgggcaccaugggccacuccaggaugggaca

SEQ ID NO: 376580 - RNA, 24 nt, Human
ccgggcaccccuggcaggaagcag

SEQ ID NO: 376581 - RNA, 32 nt, Human
ccgggcaccccuggcaggaagcaggacuccca

SEQ ID NO: 376582 - RNA, 32 nt, Human
ccgggcaccgccaggcgcggagcccagaucgc

SEQ ID NO: 376583 - RNA, 32 nt, Human
ccgggcaccgggaggcgguggcggcggcggcg

SEQ ID NO: 376584 - RNA, 32 nt, Human
ccgggcaccuggccuuggcaagugagccugca

SEQ ID NO: 376585 - RNA, 32 nt, Human
ccgggcaccugggccccugcacaugccaggug

SEQ ID NO: 376586 - RNA, 32 nt, Human
ccgggcacgacuuuggcugggauuggcagacc

SEQ ID NO: 376587 - RNA, 32 nt, Human
ccgggcacggugcuagcccugccuugagacac

SEQ ID NO: 376588 - RNA, 32 nt, Human
ccgggcacuguggcucacgccuguaaucccag

SEQ ID NO: 376589 - RNA, 32 nt, Human
ccgggcacuguggcucaugccuuuaaucccag

SEQ ID NO: 376590 - RNA, 32 nt, Human
ccgggcacuguugcugcugcgggaguccagag

SEQ ID NO: 376591 - RNA, 32 nt, Human
ccgggcagaggggcuccucucuucccaguagg

SEQ ID NO: 376592 - RNA, 20 nt, Human
ccgggcagcccccugggcca

SEQ ID NO: 376593 - RNA, 32 nt, Human
ccgggcagccuccugcucugugaaggacccug

SEQ ID NO: 376594 - RNA, 24 nt, Human
ccgggcagcggagguugcagugag

SEQ ID NO: 376595 - RNA, 32 nt, Human
ccgggcagcuucauccccucccccucugcccc

SEQ ID NO: 376596 - RNA, 32 nt, Human
ccgggcaggaauagaagaugaacaaacccaua

SEQ ID NO: 376597 - RNA, 32 nt, Human
ccgggcaggaauaugagacgugcacugagagu

SEQ ID NO: 376598 - RNA, 19 nt, Human
ccgggcaggcccuggguca

SEQ ID NO: 376599 - RNA, 32 nt, Human
ccgggcaggccuccuggguugcagggacuuga

SEQ ID NO: 376600 - RNA, 32 nt, Human
ccgggcaggcgccucacagagcacagacgugc

SEQ ID NO: 376601 - RNA, 32 nt, Human
ccgggcagggagaagugugcggggccgggaca

SEQ ID NO: 376602 - RNA, 32 nt, Human
ccgggcagggcugcucccuccucugcuccccc

SEQ ID NO: 376603 - RNA, 32 nt, Human
ccgggcaggguccuggccagcagugugggagc

SEQ ID NO: 376604 - RNA, 32 nt, Human
ccgggcaguuaggaucgucuauuggaugugaa

SEQ ID NO: 376605 - RNA, 32 nt, Human
ccgggcauaguggcucacuccuguaaucccag

SEQ ID NO: 376606 - RNA, 32 nt, Human
ccgggcauaguggcucaugccuguaaucccag

SEQ ID NO: 376607 - RNA, 32 nt, Human
ccgggcauauucuuagugugggagaaaaauca

SEQ ID NO: 376608 - RNA, 22 nt, Human
ccgggcauccacccaucagccc

SEQ ID NO: 376609 - RNA, 32 nt, Human
ccgggcaugacggcucaugccuguaaucccag

SEQ ID NO: 376610 - RNA, 32 nt, Human
ccgggcaugauggcgcgugccuguaaucccag

SEQ ID NO: 376611 - RNA, 32 nt, Human
ccgggcaugauggcgggugccuguaaucccag

SEQ ID NO: 376612 - RNA, 32 nt, Human
ccgggcaugauggugcacgccuguaaucucag

SEQ ID NO: 376613 - RNA, 32 nt, Human
ccgggcaugauggugggcaccuguaaucccag

SEQ ID NO: 376614 - RNA, 32 nt, Human
ccgggcaugauggugguggccuguaaucccag

SEQ ID NO: 376615 - RNA, 32 nt, Human
ccgggcaugguagcucacgccuguaaucccag

SEQ ID NO: 376616 - RNA, 32 nt, Human
ccgggcauggugaugcaugccuguaaucccag

SEQ ID NO: 376617 - RNA, 32 nt, Human
ccgggcauggugcugagcccuguuccugcucu

SEQ ID NO: 376618 - RNA, 32 nt, Human
ccgggcaugguggaaugugccuguaaucccac

SEQ ID NO: 376619 - RNA, 32 nt, Human
ccgggcaugguggcaaaugccuguaauaccag

SEQ ID NO: 376620 - RNA, 32 nt, Human
ccgggcaugguggcacauaccuguaaucccag

SEQ ID NO: 376621 - RNA, 32 nt, Human
ccgggcaugguggcacaugccuguaaucccag

SEQ ID NO: 376622 - RNA, 32 nt, Human
ccgggcaugguggcacaugccuguaaucccgg

SEQ ID NO: 376623 - RNA, 32 nt, Human
ccgggcaugguggcacaugccuguaaucucag

SEQ ID NO: 376624 - RNA, 32 nt, Human
ccgggcaugguggcacgcgccuguaaucccag

SEQ ID NO: 376625 - RNA, 32 nt, Human
ccgggcaugguggcacgugccuguaaucccag

SEQ ID NO: 376626 - RNA, 32 nt, Human
ccgggcaugguggcacgugccuguaaucucag

SEQ ID NO: 376627 - RNA, 32 nt, Human
ccgggcaugguggcaggcaccuguaaucccag

SEQ ID NO: 376628 - RNA, 32 nt, Human
ccgggcaugguggcaggugccuguaaucccaa

SEQ ID NO: 376629 - RNA, 32 nt, Human
ccgggcaugguggcaggugccuguaaucccag

SEQ ID NO: 376630 - RNA, 32 nt, Human
ccgggcaugguggcagucaccuguaaucccag

SEQ ID NO: 376631 - RNA, 32 nt, Human
ccgggcaugguggcaugcgccuguaaucccag

SEQ ID NO: 376632 - RNA, 32 nt, Human
ccgggcaugguggcaugugccuguaaucccag

SEQ ID NO: 376633 - RNA, 32 nt, Human
ccgggcaugguggcgcaagccuguaaucccag

SEQ ID NO: 376634 - RNA, 32 nt, Human
ccgggcaugguggcgcacaccuguaauccuag

SEQ ID NO: 376635 - RNA, 32 nt, Human
ccgggcaugguggcgcaugccuguaaucccag

SEQ ID NO: 376636 - RNA, 32 nt, Human
ccgggcaugguggcgcgcaccuguaaucccag

SEQ ID NO: 376637 - RNA, 32 nt, Human
ccgggcaugguggcgcucaccuguaaucccgg

SEQ ID NO: 376638 - RNA, 32 nt, Human
ccgggcaugguggcgugcaccuguaaucccag

SEQ ID NO: 376639 - RNA, 32 nt, Human
ccgggcaugguggcucaagccuguaaucccag

SEQ ID NO: 376640 - RNA, 32 nt, Human
ccgggcaugguggcucacaccuguaaucccag

SEQ ID NO: 376641 - RNA, 32 nt, Human
ccgggcaugguggcucacaccuguaauuccag

SEQ ID NO: 376642 - RNA, 32 nt, Human
ccgggcaugguggcucacgccuguaauccagc

SEQ ID NO: 376643 - RNA, 32 nt, Human
ccgggcaugguggcucacgccuguaaucccag

SEQ ID NO: 376644 - RNA, 32 nt, Human
ccgggcaugguggcucacgccuguaaucucag

SEQ ID NO: 376645 - RNA, 32 nt, Human
ccgggcaugguggcucauaccuguaauccuag

SEQ ID NO: 376646 - RNA, 32 nt, Human
ccgggcaugguggcucaugccuauaaucccaa

SEQ ID NO: 376647 - RNA, 32 nt, Human
ccgggcaugguggcucaugccuauaaucccag

SEQ ID NO: 376648 - RNA, 32 nt, Human
ccgggcaugguggcucaugccuguaaucccaa

SEQ ID NO: 376649 - RNA, 32 nt, Human
ccgggcaugguggcucaugccuguaaucccag

SEQ ID NO: 376650 - RNA, 32 nt, Human
ccgggcaugguggcucaugccuguaauccuag

SEQ ID NO: 376651 - RNA, 32 nt, Human
ccgggcaugguggcucaugccuguaucccagc

SEQ ID NO: 376652 - RNA, 32 nt, Human
ccgggcaugguggcuuacgccuguaaucccag

SEQ ID NO: 376653 - RNA, 32 nt, Human
ccgggcaugguggcuugcaccuguaaucccag

SEQ ID NO: 376654 - RNA, 32 nt, Human
ccgggcauggugguaggugccuguaaucccag

SEQ ID NO: 376655 - RNA, 32 nt, Human
ccgggcaugguggugcaugccuguaaucccag

SEQ ID NO: 376656 - RNA, 32 nt, Human
ccgggcaugguggugcaugccuguaaucucag

SEQ ID NO: 376657 - RNA, 32 nt, Human
ccgggcaugguggugcgugccuguaaucccag

SEQ ID NO: 376658 - RNA, 32 nt, Human
ccgggcauggugguggacgccuguaaucccag

SEQ ID NO: 376659 - RNA, 32 nt, Human
ccgggcaugguggugggcgccuguaaucccag

SEQ ID NO: 376660 - RNA, 32 nt, Human
ccgggcauggugguggguaccuguagucccag

SEQ ID NO: 376661 - RNA, 32 nt, Human
ccgggcaugguggugggugccuguaaucccag

SEQ ID NO: 376662 - RNA, 32 nt, Human
ccgggcaugguggugugcaccuguaaucccag

SEQ ID NO: 376663 - RNA, 32 nt, Human
ccgggcauggugguguguaccuguagucccag

SEQ ID NO: 376664 - RNA, 32 nt, Human
ccgggcauggugguucaugccuguaaucccag

SEQ ID NO: 376665 - RNA, 32 nt, Human
ccgggcaugucugccuggagugcugugcugug

SEQ ID NO: 376666 - RNA, 32 nt, Human
ccgggcaugugaggcccugggcaaggggaugg

SEQ ID NO: 376667 - RNA, 32 nt, Human
ccgggcauguuggcacaugccuguaaucucag

SEQ ID NO: 376668 - RNA, 32 nt, Human
ccgggcauguuggcucccgccuguaaucccag

SEQ ID NO: 376669 - RNA, 24 nt, Human
ccgggcauugccgacaggaugcag

SEQ ID NO: 376670 - RNA, 21 nt, Human
ccgggccaacauggugaaacc

SEQ ID NO: 376671 - RNA, 32 nt, Human
ccgggccacaauagggacagggcagggacagg

SEQ ID NO: 376672 - RNA, 32 nt, Human
ccgggccaccccgcaaccucgcgccucccguc

SEQ ID NO: 376673 - RNA, 32 nt, Human
ccgggccagagggagaggagccgagcgcggcg

SEQ ID NO: 376674 - RNA, 32 nt, Human
ccgggccaggaggaugagguuguccugagggg

SEQ ID NO: 376675 - RNA, 32 nt, Human
ccgggcccaagaggugcaaggaauaugggggu

SEQ ID NO: 376676 - RNA, 32 nt, Human
ccgggcccagcccaggcccaucaggacuaaga

SEQ ID NO: 376677 - RNA, 32 nt, Human
ccgggcccagcccucggagugcugccaagugc

SEQ ID NO: 376678 - RNA, 32 nt, Human
ccgggcccagcuccuccugccucccaguggcc

SEQ ID NO: 376679 - RNA, 32 nt, Human
ccgggcccagguaguccucccaccucagccuc

SEQ ID NO: 376680 - RNA, 32 nt, Human
ccgggcccaguggcucaugccuguaaucccaa

SEQ ID NO: 376681 - RNA, 32 nt, Human
ccgggccccacuguuuagaaucuuagauggaa

SEQ ID NO: 376682 - RNA, 32 nt, Human
ccgggccccagccuuccaccugugcuagcagc

SEQ ID NO: 376683 - RNA, 32 nt, Human
ccgggcccccugcugcgggcucugccuuggug

SEQ ID NO: 376684 - RNA, 32 nt, Human
ccgggcccccuggagucagccagaucccuggu

SEQ ID NO: 376685 - RNA, 32 nt, Human
ccgggccccucccauuccgccuuuucuucagc

SEQ ID NO: 376686 - RNA, 32 nt, Human
ccgggccccucggaaccuccagcuugguccgg

SEQ ID NO: 376687 - RNA, 20 nt, Human
ccgggccccugccacugccu

SEQ ID NO: 376688 - RNA, 32 nt, Human
ccgggccccugcccuaugucccgcaaggcaag

SEQ ID NO: 376689 - RNA, 32 nt, Human
ccgggccccugccuugugccucagcucucgag

SEQ ID NO: 376690 - RNA, 32 nt, Human
ccgggcccuccuccugccuguucuggcuccuc

SEQ ID NO: 376691 - RNA, 32 nt, Human
ccgggcccugcccacacacgguggugcugcau

SEQ ID NO: 376692 - RNA, 32 nt, Human
ccgggcccuggccacaaugaccucuuugcccu

SEQ ID NO: 376693 - RNA, 32 nt, Human
ccgggcccuuuaccuccugugggugaugugcu

SEQ ID NO: 376694 - RNA, 18 nt, Human
ccgggccgagccgggccu

SEQ ID NO: 376695 - RNA, 17 nt, Human
ccgggccgccggcgccu

SEQ ID NO: 376696 - RNA, 32 nt, Human
ccgggccgccucgcucgcucccagcucuguca

SEQ ID NO: 376697 - RNA, 18 nt, Human
ccgggccgcgcgcugccu

SEQ ID NO: 376698 - RNA, 19 nt, Human
ccgggccgcgcgcugugcc

SEQ ID NO: 376699 - RNA, 32 nt, Human
ccgggccggcggcgggcaccaggccgucccga

SEQ ID NO: 376700 - RNA, 32 nt, Human
ccgggccgggccgagcggagcccagggagcgc

SEQ ID NO: 376701 - RNA, 32 nt, Human
ccgggccgggccgcgccucagcagggcggcgg

SEQ ID NO: 376702 - RNA, 21 nt, Human
ccgggccggggcuggccggga

SEQ ID NO: 376703 - RNA, 32 nt, Human
ccgggccguuccccuccccgcucuucuuccaa

SEQ ID NO: 376704 - RNA, 32 nt, Human
ccgggccuauggcgaaacuccgucucuacaaa

SEQ ID NO: 376705 - RNA, 32 nt, Human
ccgggccucacugccgccaccauguccuccuu

SEQ ID NO: 376706 - RNA, 19 nt, Human
ccgggccucaguuuccuca

SEQ ID NO: 376707 - RNA, 32 nt, Human
ccgggccucccuucuguuuccugggcugcagg

SEQ ID NO: 376708 - RNA, 32 nt, Human
ccgggccucuccccacucuccucugcccaguu

SEQ ID NO: 376709 - RNA, 18 nt, Human
ccgggccucuuaacuuca

SEQ ID NO: 376710 - RNA, 18 nt, Human
ccgggccucuucuaccca

SEQ ID NO: 376711 - RNA, 32 nt, Human
ccgggccucuucuacccauccauguuucuacc

SEQ ID NO: 376712 - RNA, 22 nt, Human
ccgggccugcacagauaccuca

SEQ ID NO: 376713 - RNA, 32 nt, Human
ccgggccugcagcgccucagcaccgcuccggg

SEQ ID NO: 376714 - RNA, 32 nt, Human
ccgggccugccucugaguggugccucuccugg

SEQ ID NO: 376715 - RNA, 32 nt, Human
ccgggccugccugcaucucccaccuccucccc

SEQ ID NO: 376716 - RNA, 32 nt, Human
ccgggccugggaacugcuggcucuaagaaccu

SEQ ID NO: 376717 - RNA, 32 nt, Human
ccgggccugguggcgcaucccuguaaucccag

SEQ ID NO: 376718 - RNA, 32 nt, Human
ccgggccugguggcucacaccuguaaucccag

SEQ ID NO: 376719 - RNA, 32 nt, Human
ccgggccuguucuauuuuucuaguuaagggaa

SEQ ID NO: 376720 - RNA, 32 nt, Human
ccgggccuucaggacaucucaagauucagucu

SEQ ID NO: 376721 - RNA, 32 nt, Human
ccgggccuuccuggugggcauguacggccaga

SEQ ID NO: 376722 - RNA, 32 nt, Human
ccgggccuuggagauggagaauucucaguugu

SEQ ID NO: 376723 - RNA, 32 nt, Human
ccgggccuuugucccugccuuggcuuuucucc

SEQ ID NO: 376724 - RNA, 32 nt, Human
ccgggcgcaauggcucaugccuauaaucccag

SEQ ID NO: 376725 - RNA, 32 nt, Human
ccgggcgcacuggcucacgccuguaaucucag

SEQ ID NO: 376726 - RNA, 32 nt, Human
ccgggcgcagcggcucacgccuguaaucccag

SEQ ID NO: 376727 - RNA, 32 nt, Human
ccgggcgcaguggcucacaccuguaaucccaa

SEQ ID NO: 376728 - RNA, 32 nt, Human
ccgggcgcaguggcucacaccuguaaucccag

SEQ ID NO: 376729 - RNA, 32 nt, Human
ccgggcgcaguggcucacgccuguaaucccaa

SEQ ID NO: 376730 - RNA, 32 nt, Human
ccgggcgcaguggcucacgccuguaaucccag

SEQ ID NO: 376731 - RNA, 32 nt, Human
ccgggcgcaguggcucacgccuguaaucccgg

SEQ ID NO: 376732 - RNA, 32 nt, Human
ccgggcgcaguggcucacgccuguaauuccag

SEQ ID NO: 376733 - RNA, 32 nt, Human
ccgggcgcaguggcucaugccuguaaucccag

SEQ ID NO: 376734 - RNA, 32 nt, Human
ccgggcgcaguggcucaugccuguggucccaa

SEQ ID NO: 376735 - RNA, 32 nt, Human
ccgggcgcaguggcuuacaccuguaaucgcag

SEQ ID NO: 376736 - RNA, 17 nt, Human
ccgggcgccgaggccag

SEQ ID NO: 376737 - RNA, 32 nt, Human
ccgggcgcgauggcucacgccuguaaucccag

SEQ ID NO: 376738 - RNA, 23 nt, Human
ccgggcgcgccccagcccaccca

SEQ ID NO: 376739 - RNA, 18 nt, Human
ccgggcgcgccccgggcu

SEQ ID NO: 376740 - RNA, 32 nt, Human
ccgggcgcgcuggcucacgccuguaaucccag

SEQ ID NO: 376741 - RNA, 20 nt, Human
ccgggcgcggggagggggcu

SEQ ID NO: 376742 - RNA, 32 nt, Human
ccgggcgcuccugaagcagcaguuauggagcu

SEQ ID NO: 376743 - RNA, 18 nt, Human
ccgggcgcugcuccggcc

SEQ ID NO: 376744 - RNA, 32 nt, Human
ccgggcgcuguggcucaagccuguaaucccag

SEQ ID NO: 376745 - RNA, 25 nt, Human
ccgggcgcuuccaaaaugcccaggc

SEQ ID NO: 376746 - RNA, 32 nt, Human
ccgggcggacguucacuucuucaacugagaug

SEQ ID NO: 376747 - RNA, 32 nt, Human
ccgggcggaucccgggaaggcggaaggcuucg

SEQ ID NO: 376748 - RNA, 32 nt, Human
ccgggcggcagagaaggagggagcggguacgg

SEQ ID NO: 376749 - RNA, 23 nt, Human
ccgggcggcagagcuugcaguga

SEQ ID NO: 376750 - RNA, 24 nt, Human
ccgggcggcagagcuugcagugag

SEQ ID NO: 376751 - RNA, 32 nt, Human
ccgggcggcaggcgggcgagcagcgaucgggc

SEQ ID NO: 376752 - RNA, 24 nt, Human
ccgggcggcggaaguugcagugag

SEQ ID NO: 376753 - RNA, 24 nt, Human
ccgggcggcggagauugcagugag

SEQ ID NO: 376754 - RNA, 32 nt, Human
ccgggcggcucgugcacaccucaggccucaaa

SEQ ID NO: 376755 - RNA, 32 nt, Human
ccgggcggcugcagccgugagccaccccuguu

SEQ ID NO: 376756 - RNA, 32 nt, Human
ccgggcgggagggauuccaaagagaccgccgg

SEQ ID NO: 376757 - RNA, 32 nt, Human
ccgggcggggcggcuggccgggcagaggggcu

SEQ ID NO: 376758 - RNA, 17 nt, Human
ccgggcggggggcgcgg

SEQ ID NO: 376759 - RNA, 24 nt, Human
ccgggcgguggagcuugcagugag

SEQ ID NO: 376760 - RNA, 24 nt, Human
ccgggcgguggagguuguagugag

SEQ ID NO: 376761 - RNA, 32 nt, Human
ccgggcguaguggcacaugccuguaaucccag

SEQ ID NO: 376762 - RNA, 32 nt, Human
ccgggcguaguggcucacgccuguaaucccgg

SEQ ID NO: 376763 - RNA, 23 nt, Human
ccgggcgucccggaauugugggg

SEQ ID NO: 376764 - RNA, 32 nt, Human
ccgggcguccggagcuguagcagcagcagcag

SEQ ID NO: 376765 - RNA, 32 nt, Human
ccgggcgugauggcucacaccuguaauuccag

SEQ ID NO: 376766 - RNA, 32 nt, Human
ccgggcguggaggcucaugccuguaaucccag

SEQ ID NO: 376767 - RNA, 32 nt, Human
ccgggcguggcggcacaugccuguaaucccag

SEQ ID NO: 376768 - RNA, 32 nt, Human
ccgggcgugguagcucacgccuguaaucccag

SEQ ID NO: 376769 - RNA, 32 nt, Human
ccgggcgugguagcucaugccuguaaucccag

SEQ ID NO: 376770 - RNA, 32 nt, Human
ccgggcguggugaugcgugccuguaaucccag

SEQ ID NO: 376771 - RNA, 32 nt, Human
ccgggcgugguggcaaaugccuguaauaccag

SEQ ID NO: 376772 - RNA, 32 nt, Human
ccgggcgugguggcacacgccuguaaucccag

SEQ ID NO: 376773 - RNA, 32 nt, Human
ccgggcgugguggcacacuccuguaaucccag

SEQ ID NO: 376774 - RNA, 32 nt, Human
ccgggcgugguggcacaugccuguaaucccaa

SEQ ID NO: 376775 - RNA, 32 nt, Human
ccgggcgugguggcacaugccuguaaucccag

SEQ ID NO: 376776 - RNA, 32 nt, Human
ccgggcgugguggcacaugccuguaaucucag

SEQ ID NO: 376777 - RNA, 32 nt, Human
ccgggcgugguggcacauuccuguaaucccag

SEQ ID NO: 376778 - RNA, 32 nt, Human
ccgggcgugguggcaccugccuguaaucccag

SEQ ID NO: 376779 - RNA, 32 nt, Human
ccgggcgugguggcacgcaccuguaaucccag

SEQ ID NO: 376780 - RNA, 32 nt, Human
ccgggcgugguggcacgcgccuguaaucccag

SEQ ID NO: 376781 - RNA, 32 nt, Human
ccgggcgugguggcaggcgccuguaaucccag

SEQ ID NO: 376782 - RNA, 32 nt, Human
ccgggcgugguggcaggugccuguaaucccag

SEQ ID NO: 376783 - RNA, 32 nt, Human
ccgggcgugguggcccacgccuguaaucccag

SEQ ID NO: 376784 - RNA, 32 nt, Human
ccgggcgugguggccugcgccuguaaucccag

SEQ ID NO: 376785 - RNA, 32 nt, Human
ccgggcgugguggcgcaugccuguaaucccag

SEQ ID NO: 376786 - RNA, 32 nt, Human
ccgggcgugguggcgccugccuguaaucccag

SEQ ID NO: 376787 - RNA, 32 nt, Human
ccgggcgugguggcgggcaccuguaauaccaa

SEQ ID NO: 376788 - RNA, 32 nt, Human
ccgggcgugguggcgggccccuguaaucccag

SEQ ID NO: 376789 - RNA, 32 nt, Human
ccgggcgugguggcgggcgccuguaaucccag

SEQ ID NO: 376790 - RNA, 32 nt, Human
ccgggcgugguggcgggcgccuguaauccuag

SEQ ID NO: 376791 - RNA, 32 nt, Human
ccgggcgugguggcgugcaccuguaaucucag

SEQ ID NO: 376792 - RNA, 32 nt, Human
ccgggcgugguggcgugugccuguaaucucag

SEQ ID NO: 376793 - RNA, 32 nt, Human
ccgggcgugguggcucacaccuguaaucccaa

SEQ ID NO: 376794 - RNA, 32 nt, Human
ccgggcgugguggcucacaccuguaaucccag

SEQ ID NO: 376795 - RNA, 32 nt, Human
ccgggcgugguggcucacgccuguaaucccaa

SEQ ID NO: 376796 - RNA, 32 nt, Human
ccgggcgugguggcucacgccuguaaucccag

SEQ ID NO: 376797 - RNA, 32 nt, Human
ccgggcgugguggcucacgccuguaaucccgg

SEQ ID NO: 376798 - RNA, 32 nt, Human
ccgggcgugguggcucacgccuguaauccuag

SEQ ID NO: 376799 - RNA, 32 nt, Human
ccgggcgugguggcucacgccuguaaucucag

SEQ ID NO: 376800 - RNA, 32 nt, Human
ccgggcgugguggcucaugccuauaaucccag

SEQ ID NO: 376801 - RNA, 32 nt, Human
ccgggcgugguggcucaugccuguaaucccag

SEQ ID NO: 376802 - RNA, 32 nt, Human
ccgggcgugguggcucaugccuguaaucucag

SEQ ID NO: 376803 - RNA, 32 nt, Human
ccgggcgugguggcucaugccuguaauuccag

SEQ ID NO: 376804 - RNA, 32 nt, Human
ccgggcgugguggcucaugccuuuaaucccag

SEQ ID NO: 376805 - RNA, 32 nt, Human
ccgggcgugguggcucaugucuguaaugccag

SEQ ID NO: 376806 - RNA, 32 nt, Human
ccgggcgugguggcuccugccuguaaucccag

SEQ ID NO: 376807 - RNA, 32 nt, Human
ccgggcgugguggcucucgccuguaaucucag

SEQ ID NO: 376808 - RNA, 32 nt, Human
ccgggcguggugggucacgccuguaaucccag

SEQ ID NO: 376809 - RNA, 32 nt, Human
ccgggcgugguggugagugccuguaaucacag

SEQ ID NO: 376810 - RNA, 32 nt, Human
ccgggcgugguggugcaggccuguaaucccag

SEQ ID NO: 376811 - RNA, 32 nt, Human
ccgggcgugguggugcaugccuguaauccaag

SEQ ID NO: 376812 - RNA, 32 nt, Human
ccgggcgugguggugcaugccuguaaucccag

SEQ ID NO: 376813 - RNA, 32 nt, Human
ccgggcgugguggugcgcgccuguaaucccag

SEQ ID NO: 376814 - RNA, 32 nt, Human
ccgggcgugguggugcucaccuguaaucccag

SEQ ID NO: 376815 - RNA, 32 nt, Human
ccgggcgugguggugggcaccuguaaucccag

SEQ ID NO: 376816 - RNA, 32 nt, Human
ccgggcgugguggugggugccuguaauccuag

SEQ ID NO: 376817 - RNA, 32 nt, Human
ccgggcguggugguguaugccuguaaucccag

SEQ ID NO: 376818 - RNA, 32 nt, Human
ccgggcgugguuugcuucucucagucacugcu

SEQ ID NO: 376819 - RNA, 32 nt, Human
ccgggcguguuggugugcgccuguaaucccag

SEQ ID NO: 376820 - RNA, 32 nt, Human
ccgggcguucucuccgggcccagcucuucuuc

SEQ ID NO: 376821 - RNA, 32 nt, Human
ccgggcuacgagcggcugagaaaaugaugcau

SEQ ID NO: 376822 - RNA, 32 nt, Human
ccgggcuacuaggagugagaccagcuucuggc

SEQ ID NO: 376823 - RNA, 32 nt, Human
ccgggcuagacccggcgccaucaugcugcuuc

SEQ ID NO: 376824 - RNA, 32 nt, Human
ccgggcucaagcaauccucccaccucagccuc

SEQ ID NO: 376825 - RNA, 32 nt, Human
ccgggcucaagcaauccuccugccucagcucc

SEQ ID NO: 376826 - RNA, 32 nt, Human
ccgggcucaagugacccucccaccucagccuc

SEQ ID NO: 376827 - RNA, 32 nt, Human
ccgggcucaagugauucucccgccucagucuc

SEQ ID NO: 376828 - RNA, 32 nt, Human
ccgggcucacauccacugaggguauagugacc

SEQ ID NO: 376829 - RNA, 32 nt, Human
ccgggcucaccccauucuccugccucagccuc

SEQ ID NO: 376830 - RNA, 32 nt, Human
ccgggcucacgccauucuuccaccucagccuc

SEQ ID NO: 376831 - RNA, 32 nt, Human
ccgggcucaggggccuuugagcuggccugagg

SEQ ID NO: 376832 - RNA, 32 nt, Human
ccgggcucaggugauucucccgccucagcacc

SEQ ID NO: 376833 - RNA, 32 nt, Human
ccgggcuccaacaauccucccaucucagccuc

SEQ ID NO: 376834 - RNA, 32 nt, Human
ccgggcuccagccccagacccucuagcuccug

SEQ ID NO: 376835 - RNA, 32 nt, Human
ccgggcuccagugauccucccgccucagccuc

SEQ ID NO: 376836 - RNA, 18 nt, Human
ccgggcuccggcugcaga

SEQ ID NO: 376837 - RNA, 18 nt, Human
ccgggcucgcgggugaga

SEQ ID NO: 376838 - RNA, 32 nt, Human
ccgggcucuagcuguuucccucaggcggccug

SEQ ID NO: 376839 - RNA, 32 nt, Human
ccgggcucuccaggaagguggcugcggcgaca

SEQ ID NO: 376840 - RNA, 32 nt, Human
ccgggcucuggaggagggucccugcuucuucc

SEQ ID NO: 376841 - RNA, 32 nt, Human
ccgggcugaagcggggagccagacagcugcgg

SEQ ID NO: 376842 - RNA, 32 nt, Human
ccgggcugagggccugcuggaggccucaggug

SEQ ID NO: 376843 - RNA, 32 nt, Human
ccgggcugauagcauuugcccuguggggugca

SEQ ID NO: 376844 - RNA, 32 nt, Human
ccgggcugcccagccgggaaguuccugggcuu

SEQ ID NO: 376845 - RNA, 24 nt, Human
ccgggcugccccacagcccauguc

SEQ ID NO: 376846 - RNA, 32 nt, Human
ccgggcugcccuugaggggccugcugcguuga

SEQ ID NO: 376847 - RNA, 32 nt, Human
ccgggcugccucucccccgcuagggccuggug

SEQ ID NO: 376848 - RNA, 31 nt, Human
ccgggcugccucucgcaucucugucuucccc

SEQ ID NO: 376849 - RNA, 19 nt, Human
ccgggcugcgcucacugcc

SEQ ID NO: 376850 - RNA, 32 nt, Human
ccgggcugcucaccucuccccuucugcugagc

SEQ ID NO: 376851 - RNA, 32 nt, Human
ccgggcugcucuggaucccaggacuccggcuu

SEQ ID NO: 376852 - RNA, 32 nt, Human
ccgggcugcugaggcccgagcggcaggagcgc

SEQ ID NO: 376853 - RNA, 32 nt, Human
ccgggcugcugcagacagacaggaagcacgcc

SEQ ID NO: 376854 - RNA, 21 nt, Human
ccgggcuggagccacgggggc

SEQ ID NO: 376855 - RNA, 32 nt, Human
ccgggcuggagccgaggccggagcagcugucu

SEQ ID NO: 376856 - RNA, 18 nt, Human
ccgggcuggagugcaaug

SEQ ID NO: 376857 - RNA, 18 nt, Human
ccgggcuggagugcagug

SEQ ID NO: 376858 - RNA, 19 nt, Human
ccgggcuggagugcagugg

SEQ ID NO: 376859 - RNA, 21 nt, Human
ccgggcuggagugcaguggug

SEQ ID NO: 376860 - RNA, 32 nt, Human
ccgggcuggagugcaguggugugaucucgguu

SEQ ID NO: 376861 - RNA, 32 nt, Human
ccgggcuggcauuuugugacccuucccuguug

SEQ ID NO: 376862 - RNA, 32 nt, Human
ccgggcuggcccuugcccccacccugcaacuc

SEQ ID NO: 376863 - RNA, 32 nt, Human
ccgggcuggccuuggccucgcgccuuccccug

SEQ ID NO: 376864 - RNA, 32 nt, Human
ccgggcugggaggggcugcacugugagcgcug

SEQ ID NO: 376865 - RNA, 32 nt, Human
ccgggcugggcgggggagaggaaggggcgggg

SEQ ID NO: 376866 - RNA, 32 nt, Human
ccgggcugucccaggcugaggcgguugcuccc

SEQ ID NO: 376867 - RNA, 16 nt, Human
ccgggcugucccggcc

SEQ ID NO: 376868 - RNA, 32 nt, Human
ccgggcuguggucugugggcugugggacgagc

SEQ ID NO: 376869 - RNA, 32 nt, Human
ccgggcuugaggggugauggaggcagguuccc

SEQ ID NO: 376870 - RNA, 32 nt, Human
ccgggcuugcggagugcugggcucccagacaa

SEQ ID NO: 376871 - RNA, 32 nt, Human
ccgggcuugcuuccggcgucauggcucaaagg

SEQ ID NO: 376872 - RNA, 32 nt, Human
ccgggcuugguggcucaugccuguaaucccag

SEQ ID NO: 376873 - RNA, 32 nt, Human
ccgggcuugguggcucaugcuuguaaucucaa

SEQ ID NO: 376874 - RNA, 32 nt, Human
ccgggcuugguggcuuaugccuguaaucccag

SEQ ID NO: 376875 - RNA, 32 nt, Human
ccgggcuuuccucacaccugagccgggugcga

SEQ ID NO: 376876 - RNA, 32 nt, Human
ccgggcuuucgacaguggggagugugacgcgc

SEQ ID NO: 376877 - RNA, 32 nt, Human
ccgggcuuugggccgggcgcccgagucugucc

SEQ ID NO: 376878 - RNA, 32 nt, Human
ccgggcuuuguggcaugugccuguaaucccag

SEQ ID NO: 376879 - RNA, 32 nt, Human
ccggggaagagaagcaaagcgcaacggugugg

SEQ ID NO: 376880 - RNA, 32 nt, Human
ccggggaagaggaggaggaaggaaagaaagaa

SEQ ID NO: 376881 - RNA, 32 nt, Human
ccggggaagaggcgcggcgggagaagcgaccg

SEQ ID NO: 376882 - RNA, 32 nt, Human
ccggggaaggacacccucacucccacaccccg

SEQ ID NO: 376883 - RNA, 32 nt, Human
ccggggaaggccaggguggaagggcggcuuga

SEQ ID NO: 376884 - RNA, 32 nt, Human
ccggggaaucuccagcccguugccuuuuccau

SEQ ID NO: 376885 - RNA, 32 nt, Human
ccggggacaaguccggaagcuggagaagauga

SEQ ID NO: 376886 - RNA, 22 nt, Human
ccggggacggagguugcaguga

SEQ ID NO: 376887 - RNA, 32 nt, Human
ccggggacucccaggcuggagagcacugccag

SEQ ID NO: 376888 - RNA, 32 nt, Human
ccggggagaacaucccucccauucugggaaag

SEQ ID NO: 376889 - RNA, 32 nt, Human
ccggggagacaggaacacgggcaagacagcgc

SEQ ID NO: 376890 - RNA, 24 nt, Human
ccggggagacggagguugcaguga

SEQ ID NO: 376891 - RNA, 25 nt, Human
ccggggagacggagguugcagugag

SEQ ID NO: 376892 - RNA, 32 nt, Human
ccggggagacggagguugcagugagccgaguu

SEQ ID NO: 376893 - RNA, 32 nt, Human
ccggggagaggaacugccagcucccgcuuucu

SEQ ID NO: 376894 - RNA, 32 nt, Human
ccggggagaggaagaggagucggaagggaggc

SEQ ID NO: 376895 - RNA, 32 nt, Human
ccggggagaggaagggugggugcaagagugaa

SEQ ID NO: 376896 - RNA, 32 nt, Human
ccggggagauaaccucucccaugggccacauc

SEQ ID NO: 376897 - RNA, 18 nt, Human
ccggggagcacccuucua

SEQ ID NO: 376898 - RNA, 32 nt, Human
ccggggagcagaugcgucagauggaggagaaa

SEQ ID NO: 376899 - RNA, 32 nt, Human
ccggggagccacagaaucccagaucuugggcg

SEQ ID NO: 376900 - RNA, 32 nt, Human
ccggggagcccaagcguccucuagcuccaucu

SEQ ID NO: 376901 - RNA, 32 nt, Human
ccggggagccugggccugacauggcccaggag

SEQ ID NO: 376902 - RNA, 32 nt, Human
ccggggaggacuugcggggcagaggagggcgu

SEQ ID NO: 376903 - RNA, 32 nt, Human
ccggggaggaggaggaggaggaagaggaggag

SEQ ID NO: 376904 - RNA, 32 nt, Human
ccggggaggaggggguugcagugagccgagau

SEQ ID NO: 376905 - RNA, 22 nt, Human
ccggggaggcagagguugcagu

SEQ ID NO: 376906 - RNA, 24 nt, Human
ccggggaggcagagguugcaguga

SEQ ID NO: 376907 - RNA, 25 nt, Human
ccggggaggcagagguugcagugag

SEQ ID NO: 376908 - RNA, 32 nt, Human
ccggggaggcagagguugcagugagccgagau

SEQ ID NO: 376909 - RNA, 32 nt, Human
ccggggaggcagagguugcagugagcugagag

SEQ ID NO: 376910 - RNA, 23 nt, Human
ccggggaggcggagauugcagug

SEQ ID NO: 376911 - RNA, 24 nt, Human
ccggggaggcggagauugcaguga

SEQ ID NO: 376912 - RNA, 25 nt, Human
ccggggaggcggagauugcagugag

SEQ ID NO: 376913 - RNA, 24 nt, Human
ccggggaggcggagcuugcaguga

SEQ ID NO: 376914 - RNA, 25 nt, Human
ccggggaggcggagcuugcagugag

SEQ ID NO: 376915 - RNA, 32 nt, Human
ccggggaggcggagcuugcagugagccaagac

SEQ ID NO: 376916 - RNA, 32 nt, Human
ccggggaggcggaggguguggugagccgggau

SEQ ID NO: 376917 - RNA, 24 nt, Human
ccggggaggcggagguuacaguga

SEQ ID NO: 376918 - RNA, 25 nt, Human
ccggggaggcggagguuacagugag

SEQ ID NO: 376919 - RNA, 32 nt, Human
ccggggaggcggagguuacagugagccgagau

SEQ ID NO: 376920 - RNA, 25 nt, Human
ccggggaggcggggguugcaaugag

SEQ ID NO: 376921 - RNA, 32 nt, Human
ccggggagguggaaguugcagugggccaagau

SEQ ID NO: 376922 - RNA, 24 nt, Human
ccggggagguggaggcugcaguga

SEQ ID NO: 376923 - RNA, 25 nt, Human
ccggggagguggaggcugcagugag

SEQ ID NO: 376924 - RNA, 32 nt, Human
ccggggagguggaggcugcagugagccgagau

SEQ ID NO: 376925 - RNA, 24 nt, Human
ccggggagguggagguugcaguga

SEQ ID NO: 376926 - RNA, 25 nt, Human
ccggggagguggagguugcagugag

SEQ ID NO: 376927 - RNA, 32 nt, Human
ccggggagguggagguugcagugagcugagau

SEQ ID NO: 376928 - RNA, 24 nt, Human
ccggggaguuggagguugcaguga

SEQ ID NO: 376929 - RNA, 25 nt, Human
ccggggaguuggagguugcagugag

SEQ ID NO: 376930 - RNA, 32 nt, Human
ccggggaguuggagguugcagugagccgagau

SEQ ID NO: 376931 - RNA, 32 nt, Human
ccggggaucacagccucagcggacaggaaaug

SEQ ID NO: 376932 - RNA, 32 nt, Human
ccggggaucuccugggcugggcucuccuugga

SEQ ID NO: 376933 - RNA, 32 nt, Human
ccggggaugcgccauggccauggcccggcugg

SEQ ID NO: 376934 - RNA, 20 nt, Human
ccggggauggagacauguca

SEQ ID NO: 376935 - RNA, 32 nt, Human
ccggggauggcggcagagggggaccagcucag

SEQ ID NO: 376936 - RNA, 32 nt, Human
ccggggcaaaauggguuuccaggucuuggcaa

SEQ ID NO: 376937 - RNA, 28 nt, Human
ccggggcaacagagcaagacucugccuc

SEQ ID NO: 376938 - RNA, 21 nt, Human
ccggggcaacauagugaaacc

SEQ ID NO: 376939 - RNA, 32 nt, Human
ccggggcacuccugggcagcuuuugcucagug

SEQ ID NO: 376940 - RNA, 32 nt, Human
ccggggcagcagcagcccugccccacaccucc

SEQ ID NO: 376941 - RNA, 32 nt, Human
ccggggcagccccuccaccgcaccguccuggg

SEQ ID NO: 376942 - RNA, 32 nt, Human
ccggggcagccuggcuccacggccuguacucg

SEQ ID NO: 376943 - RNA, 32 nt, Human
ccggggcagcuggcaggagagagccuuggccu

SEQ ID NO: 376944 - RNA, 32 nt, Human
ccggggcagcuggugacccaccccuccaggca

SEQ ID NO: 376945 - RNA, 18 nt, Human
ccggggcaggaggcgcag

SEQ ID NO: 376946 - RNA, 32 nt, Human
ccggggcaggucuccuuccaggccaggggccc

SEQ ID NO: 376947 - RNA, 22 nt, Human
ccggggccaagcagcgcguugg

SEQ ID NO: 376948 - RNA, 32 nt, Human
ccggggccacaggacgucuguccuccagucac

SEQ ID NO: 376949 - RNA, 23 nt, Human
ccggggccaccaaacgggccccu

SEQ ID NO: 376950 - RNA, 24 nt, Human
ccggggccaccgaccccacccccu

SEQ ID NO: 376951 - RNA, 20 nt, Human
ccggggccaccgcgcccgcu

SEQ ID NO: 376952 - RNA, 32 nt, Human
ccggggccacggugaccaggaggcagaagccu

SEQ ID NO: 376953 - RNA, 24 nt, Human
ccggggccacuaccgucaccgcuu

SEQ ID NO: 376954 - RNA, 31 nt, Human
ccggggccacuuuucugaggccgaaggaccc

SEQ ID NO: 376955 - RNA, 32 nt, Human
ccggggccagccgcgccaucaugguaauggug

SEQ ID NO: 376956 - RNA, 32 nt, Human
ccggggccaggcgcgcucugcccagcccagcc

SEQ ID NO: 376957 - RNA, 32 nt, Human
ccggggccauuucaacaccacccaccugcugg

SEQ ID NO: 376958 - RNA, 21 nt, Human
ccggggcccagagcucugugg

SEQ ID NO: 376959 - RNA, 32 nt, Human
ccggggcccaggggaggcggcacuccaaccua

SEQ ID NO: 376960 - RNA, 32 nt, Human
ccggggccccaggcuugacuccaccucggggc

SEQ ID NO: 376961 - RNA, 21 nt, Human
ccggggcccccaggcccccca

SEQ ID NO: 376962 - RNA, 22 nt, Human
ccggggccccccagccucgccu

SEQ ID NO: 376963 - RNA, 18 nt, Human
ccggggcccccugggcca

SEQ ID NO: 376964 - RNA, 20 nt, Human
ccggggccccuccacugccu

SEQ ID NO: 376965 - RNA, 18 nt, Human
ccggggcccuccacugcc

SEQ ID NO: 376966 - RNA, 17 nt, Human
ccggggcccuccugcuc

SEQ ID NO: 376967 - RNA, 32 nt, Human
ccggggcccugccugaggccaucgccgcguug

SEQ ID NO: 376968 - RNA, 32 nt, Human
ccggggcccuggaaggagcugccugccugaag

SEQ ID NO: 376969 - RNA, 23 nt, Human
ccggggccgccgccgcggagccu

SEQ ID NO: 376970 - RNA, 24 nt, Human
ccggggccgccgccuccgcccgcc

SEQ ID NO: 376971 - RNA, 22 nt, Human
ccggggccgccgcgggccgucu

SEQ ID NO: 376972 - RNA, 20 nt, Human
ccggggccgccggcuccgcc

SEQ ID NO: 376973 - RNA, 22 nt, Human
ccggggccgcgcaugcgccgcc

SEQ ID NO: 376974 - RNA, 21 nt, Human
ccggggccgcggccaccuccu

SEQ ID NO: 376975 - RNA, 22 nt, Human
ccggggccgcuccaucgcgccu

SEQ ID NO: 376976 - RNA, 17 nt, Human
ccggggccgcuccggcc

SEQ ID NO: 376977 - RNA, 21 nt, Human
ccggggccgcuuggagucgcc

SEQ ID NO: 376978 - RNA, 32 nt, Human
ccggggccggaggaaaaagcucgccacccuga

SEQ ID NO: 376979 - RNA, 32 nt, Human
ccggggccggcaggggguuggggaagaagagg

SEQ ID NO: 376980 - RNA, 20 nt, Human
ccggggccguuacggccgcc

SEQ ID NO: 376981 - RNA, 32 nt, Human
ccggggccucgagccgggaggaagggggcuuc

SEQ ID NO: 376982 - RNA, 17 nt, Human
ccggggccuggacugca

SEQ ID NO: 376983 - RNA, 32 nt, Human
ccggggccugguguugucaguccuccugaaca

SEQ ID NO: 376984 - RNA, 32 nt, Human
ccggggccuuuagagcccgcgaagggcugucu

SEQ ID NO: 376985 - RNA, 23 nt, Human
ccggggcgaacagcagagcuggg

SEQ ID NO: 376986 - RNA, 19 nt, Human
ccggggcgcaccgcugccg

SEQ ID NO: 376987 - RNA, 32 nt, Human
ccggggcgcccacuccgcagcagccagcgagc

SEQ ID NO: 376988 - RNA, 19 nt, Human
ccggggcgccggcucagca

SEQ ID NO: 376989 - RNA, 32 nt, Human
ccggggcgggaggaggaagugaggccgcgcgg

SEQ ID NO: 376990 - RNA, 20 nt, Human
ccggggcggggaaagcggag

SEQ ID NO: 376991 - RNA, 21 nt, Human
ccggggcggggcggggcgcgg

SEQ ID NO: 376992 - RNA, 32 nt, Human
ccggggcggggugggagguaacgggacgggcg

SEQ ID NO: 376993 - RNA, 32 nt, Human
ccggggcgucuggccccaugcccggccgggcg

SEQ ID NO: 376994 - RNA, 32 nt, Human
ccggggcgucuucuccuacgcaggaagggcca

SEQ ID NO: 376995 - RNA, 32 nt, Human
ccggggcuagaggcggccgccgggagggcgcg

SEQ ID NO: 376996 - RNA, 20 nt, Human
ccggggcucagcccugaguu

SEQ ID NO: 376997 - RNA, 32 nt, Human
ccggggcucagcccugaguuggcaucaccugc

SEQ ID NO: 376998 - RNA, 32 nt, Human
ccggggcucccccugccugccucucucuccuc

SEQ ID NO: 376999 - RNA, 32 nt, Human
ccggggcuccggggaaggcgguugcagcuccu

SEQ ID NO: 377000 - RNA, 22 nt, Human
ccggggcuccuccacagcaccu

SEQ ID NO: 377001 - RNA, 32 nt, Human
ccggggcuccugucucugccuccugggccuuc

SEQ ID NO: 377002 - RNA, 18 nt, Human
ccggggcucgccccgagc

SEQ ID NO: 377003 - RNA, 32 nt, Human
ccggggcucgggcacccucuggccccacacug

SEQ ID NO: 377004 - RNA, 32 nt, Human
ccggggcucucaucuuccacucggaucucaga

SEQ ID NO: 377005 - RNA, 32 nt, Human
ccggggcucugccucucgcugaacgcuccugc

SEQ ID NO: 377006 - RNA, 32 nt, Human
ccgggggaaagagaguuaccggaguuuuagca

SEQ ID NO: 377007 - RNA, 32 nt, Human
ccgggggacagccagguuugaacucaccccac

SEQ ID NO: 377008 - RNA, 32 nt, Human
ccgggggacugugcuggucugagccccacgaa

SEQ ID NO: 377009 - RNA, 32 nt, Human
ccgggggagagggaccaggaggggcccgcggc

SEQ ID NO: 377010 - RNA, 32 nt, Human
ccgggggagaggggcaaaugccuccgggacug

SEQ ID NO: 377011 - RNA, 32 nt, Human
ccgggggaggaggaggaggagaagguggagag

SEQ ID NO: 377012 - RNA, 32 nt, Human
ccgggggaggccugaggccgcuggcuugugcg

SEQ ID NO: 377013 - RNA, 32 nt, Human
ccgggggaggcgcgccugcagcgcggccggcg

SEQ ID NO: 377014 - RNA, 32 nt, Human
ccgggggaggcuggcgcuagcgggcgagccgg

SEQ ID NO: 377015 - RNA, 32 nt, Human
ccgggggagggaggaggagggaggcggcgagg

SEQ ID NO: 377016 - RNA, 32 nt, Human
ccgggggauggacggcaaacagguaaggaguu

SEQ ID NO: 377017 - RNA, 32 nt, Human
ccgggggcaauuguuuaaaggcauuuuguucc

SEQ ID NO: 377018 - RNA, 32 nt, Human
ccgggggcagcacggccuggcuuucccacgcu

SEQ ID NO: 377019 - RNA, 24 nt, Human
ccgggggcaggaggcucugguucc

SEQ ID NO: 377020 - RNA, 32 nt, Human
ccgggggcagggcugccuccagccugcacgcu

SEQ ID NO: 377021 - RNA, 32 nt, Human
ccgggggccacugggugacagugggcaccuuc

SEQ ID NO: 377022 - RNA, 32 nt, Human
ccgggggccauccugauucuagaauuaucuug

SEQ ID NO: 377023 - RNA, 32 nt, Human
ccgggggcgcagcuuggagauccaggggcgca

SEQ ID NO: 377024 - RNA, 32 nt, Human
ccgggggcuaccgcguccaggugugguccagc

SEQ ID NO: 377025 - RNA, 32 nt, Human
ccgggggcucacugcuugcacugugcuuaggg

SEQ ID NO: 377026 - RNA, 23 nt, Human
ccgggggcugagguugcugugag

SEQ ID NO: 377027 - RNA, 32 nt, Human
ccgggggcuggaggagaagacaaggaguucuu

SEQ ID NO: 377028 - RNA, 32 nt, Human
ccgggggcuucauccuuccagggaggagaaga

SEQ ID NO: 377029 - RNA, 24 nt, Human
ccggggggcggagguugcagugag

SEQ ID NO: 377030 - RNA, 18 nt, Human
ccggggggcggggcgcgg

SEQ ID NO: 377031 - RNA, 24 nt, Human
ccgggggguggagccugcagugag

SEQ ID NO: 377032 - RNA, 19 nt, Human
ccggggguagggggcgcag

SEQ ID NO: 377033 - RNA, 32 nt, Human
ccgggggucugccugggcgaaugcagugggac

SEQ ID NO: 377034 - RNA, 32 nt, Human
ccgggggugagaguaaagaggcuuggaccugg

SEQ ID NO: 377035 - RNA, 32 nt, Human
ccgggggugcuuuuucugcagggacgaagugc

SEQ ID NO: 377036 - RNA, 22 nt, Human
ccggggguggggccccccugca

SEQ ID NO: 377037 - RNA, 32 nt, Human
ccgggggugugcaggccagggacuggccaggc

SEQ ID NO: 377038 - RNA, 32 nt, Human
ccgggguacacccugcacaaugcugggagcau

SEQ ID NO: 377039 - RNA, 20 nt, Human
ccgggguagagggaaaagag

SEQ ID NO: 377040 - RNA, 32 nt, Human
ccgggguagucuuuaauuccuggccucaagug

SEQ ID NO: 377041 - RNA, 32 nt, Human
ccgggguaugugacugccucugugcugggcac

SEQ ID NO: 377042 - RNA, 21 nt, Human
ccggggucacuccccgccgcc

SEQ ID NO: 377043 - RNA, 32 nt, Human
ccgggguccucaugcugugugcagccuaggga

SEQ ID NO: 377044 - RNA, 32 nt, Human
ccggggucgccggcuucucuccugccuccggu

SEQ ID NO: 377045 - RNA, 32 nt, Human
ccggggucucagaacugggagugcagacguug

SEQ ID NO: 377046 - RNA, 32 nt, Human
ccggggucugccccaggacuccuggguggacc

SEQ ID NO: 377047 - RNA, 32 nt, Human
ccggggugagccccaaaccuuacugggugugc

SEQ ID NO: 377048 - RNA, 32 nt, Human
ccgggguguguaagcaguggagguucuaagac

SEQ ID NO: 377049 - RNA, 32 nt, Human
ccgggguguuuccucugccuacguggagcuaa

SEQ ID NO: 377050 - RNA, 32 nt, Human
ccgggguucugcggacaaacguggggagaacu

SEQ ID NO: 377051 - RNA, 32 nt, Human
ccggguaacaggcagagauuggaacaguuugg

SEQ ID NO: 377052 - RNA, 32 nt, Human
ccggguaacaguggugaccaaugaggcaauac

SEQ ID NO: 377053 - RNA, 32 nt, Human
ccggguaacagugguuaccaaugaggcaauac

SEQ ID NO: 377054 - RNA, 32 nt, Human
ccggguaacggugguuaccaaugagacauuac

SEQ ID NO: 377055 - RNA, 32 nt, Human
ccggguaauccagcacccugaggcuucacugc

SEQ ID NO: 377056 - RNA, 24 nt, Human
ccggguaccaagggugggauccag

SEQ ID NO: 377057 - RNA, 32 nt, Human
ccggguaccaggacuuccuccaaccuggcaag

SEQ ID NO: 377058 - RNA, 21 nt, Human
ccggguacccccaccucccca

SEQ ID NO: 377059 - RNA, 23 nt, Human
ccggguagcugggacuacaggca

SEQ ID NO: 377060 - RNA, 24 nt, Human
ccggguagcugggacuacaggugu

SEQ ID NO: 377061 - RNA, 32 nt, Human
ccggguauagguaacccacaggcccagugcca

SEQ ID NO: 377062 - RNA, 32 nt, Human
ccggguaucuguggucuuuaagaugugguaag

SEQ ID NO: 377063 - RNA, 32 nt, Human
ccggguauggugacucaugccuguaauccuag

SEQ ID NO: 377064 - RNA, 32 nt, Human
ccggguaugguggcucaugccuguaaucccag

SEQ ID NO: 377065 - RNA, 32 nt, Human
ccggguauggugguacaugccuguaaucccag

SEQ ID NO: 377066 - RNA, 32 nt, Human
ccgggucaaggcccggucgagugcaguaccau

SEQ ID NO: 377067 - RNA, 32 nt, Human
ccgggucaagucagagagauaaggcuugcccc

SEQ ID NO: 377068 - RNA, 32 nt, Human
ccgggucacaacucacugcagccuggaccucc

SEQ ID NO: 377069 - RNA, 32 nt, Human
ccgggucacagaaccaauucauuuaccaggcg

SEQ ID NO: 377070 - RNA, 32 nt, Human
ccggguccaagcaauuccccugccucagucuc

SEQ ID NO: 377071 - RNA, 32 nt, Human
ccgggucccaggaggacuuggcauggcugagg

SEQ ID NO: 377072 - RNA, 32 nt, Human
ccgggucccccggggcugcaguagcagcggcg

SEQ ID NO: 377073 - RNA, 32 nt, Human
ccgggucccggacggcuccgggugacaccagc

SEQ ID NO: 377074 - RNA, 32 nt, Human
ccgggucccuccacccuugucuccugugcggc

SEQ ID NO: 377075 - RNA, 32 nt, Human
ccgggucccugugauuuucccaccucagccuc

SEQ ID NO: 377076 - RNA, 32 nt, Human
ccggguccuccaccaucaggaagaucccaucc

SEQ ID NO: 377077 - RNA, 21 nt, Human
ccggguccucucaggcaccca

SEQ ID NO: 377078 - RNA, 32 nt, Human
ccggguccuggagggccaaagccugcgucugg

SEQ ID NO: 377079 - RNA, 32 nt, Human
ccgggucgcgccgcagucuuccucaaguaugc

SEQ ID NO: 377080 - RNA, 21 nt, Human
ccgggucuacgugcccaugac

SEQ ID NO: 377081 - RNA, 20 nt, Human
ccgggucucaccccugugaa

SEQ ID NO: 377082 - RNA, 32 nt, Human
ccgggucucagggcgccuggcugaagugagca

SEQ ID NO: 377083 - RNA, 32 nt, Human
ccgggucuggcagaacucggguguuuugggcu

SEQ ID NO: 377084 - RNA, 18 nt, Human
ccgggucugggcucugga

SEQ ID NO: 377085 - RNA, 32 nt, Human
ccgggucuggugcugaggauacagcucuucuc

SEQ ID NO: 377086 - RNA, 32 nt, Human
ccgggucugguggcucaugccuguaaucccag

SEQ ID NO: 377087 - RNA, 32 nt, Human
ccgggucuugauucagucacauggcaugguuu

SEQ ID NO: 377088 - RNA, 32 nt, Human
ccgggugacgcccaggagaggugguggccuuc

SEQ ID NO: 377089 - RNA, 32 nt, Human
ccgggugacuguggcagugcaggugaagguac

SEQ ID NO: 377090 - RNA, 32 nt, Human
ccgggugagauggacacgcugcgcaaggccuc

SEQ ID NO: 377091 - RNA, 32 nt, Human
ccgggugagccaagggcacuuugcugccaccg

SEQ ID NO: 377092 - RNA, 32 nt, Human
ccgggugagccugucuggcgccuuccucgccc

SEQ ID NO: 377093 - RNA, 32 nt, Human
ccgggugauuacaggcaccagugcagugauga

SEQ ID NO: 377094 - RNA, 32 nt, Human
ccgggugcaaugacucaugccuguaaucccag

SEQ ID NO: 377095 - RNA, 32 nt, Human
ccgggugcaauggcucaugccuguaaucccaa

SEQ ID NO: 377096 - RNA, 32 nt, Human
ccgggugcaauggcucaugccuguaaucccag

SEQ ID NO: 377097 - RNA, 32 nt, Human
ccgggugcaauggcuuacgccuguaaucccag

SEQ ID NO: 377098 - RNA, 32 nt, Human
ccgggugcacuggcucaagccuguaaucccag

SEQ ID NO: 377099 - RNA, 32 nt, Human
ccgggugcacuggcucacgccucuaaucucag

SEQ ID NO: 377100 - RNA, 31 nt, Human
ccgggugcacuuucugcaugagaccgggcug

SEQ ID NO: 377101 - RNA, 32 nt, Human
ccgggugcaguagcucacgccuguaaucccag

SEQ ID NO: 377102 - RNA, 32 nt, Human
ccgggugcaguggcuaaagccuguaaucccag

SEQ ID NO: 377103 - RNA, 32 nt, Human
ccgggugcaguggcucacaccuguaaucccag

SEQ ID NO: 377104 - RNA, 32 nt, Human
ccgggugcaguggcucacgccuguaaucccag

SEQ ID NO: 377105 - RNA, 32 nt, Human
ccgggugcaguggcucaugccuauauucccug

SEQ ID NO: 377106 - RNA, 32 nt, Human
ccgggugcaguggcucaugccuguaauccaag

SEQ ID NO: 377107 - RNA, 32 nt, Human
ccgggugcaguggcucaugccuguaaucccag

SEQ ID NO: 377108 - RNA, 32 nt, Human
ccgggugcaguggcucaugccuguggucccag

SEQ ID NO: 377109 - RNA, 32 nt, Human
ccgggugccaugaagcaggagggcucggcgcg

SEQ ID NO: 377110 - RNA, 32 nt, Human
ccgggugccgguugagguugcuggugggccug

SEQ ID NO: 377111 - RNA, 32 nt, Human
ccgggugccguggcucaugccuguaaucccag

SEQ ID NO: 377112 - RNA, 32 nt, Human
ccgggugccugggcucaaguucucauuccauu

SEQ ID NO: 377113 - RNA, 32 nt, Human
ccgggugcgggggcucacgccuguaaucccag

SEQ ID NO: 377114 - RNA, 32 nt, Human
ccgggugcgguggcacacaccuguaaucccag

SEQ ID NO: 377115 - RNA, 32 nt, Human
ccgggugcgguggcucaagccuguaaucccag

SEQ ID NO: 377116 - RNA, 32 nt, Human
ccgggugcgguggcucacaccuguaaucccag

SEQ ID NO: 377117 - RNA, 32 nt, Human
ccgggugcgguggcucacgccuguaaucacac

SEQ ID NO: 377118 - RNA, 32 nt, Human
ccgggugcgguggcucacgccuguaaucccaa

SEQ ID NO: 377119 - RNA, 32 nt, Human
ccgggugcgguggcucacgccuguaaucccag

SEQ ID NO: 377120 - RNA, 32 nt, Human
ccgggugcgguggcucacgccuguaauccuag

SEQ ID NO: 377121 - RNA, 32 nt, Human
ccgggugcgguggcucaggccuguaaucccag

SEQ ID NO: 377122 - RNA, 32 nt, Human
ccgggugcgguggcucaugccuauaaucccag

SEQ ID NO: 377123 - RNA, 32 nt, Human
ccgggugcgguggcucaugccuguaaucccag

SEQ ID NO: 377124 - RNA, 32 nt, Human
ccgggugcgguggcucaugccuguauucccag

SEQ ID NO: 377125 - RNA, 32 nt, Human
ccgggugcgguggcucccgccuguaauccuag

SEQ ID NO: 377126 - RNA, 32 nt, Human
ccgggugcggugguucacaccuguaauccaag

SEQ ID NO: 377127 - RNA, 32 nt, Human
ccgggugcugcucugugcucugcgugucccac

SEQ ID NO: 377128 - RNA, 32 nt, Human
ccgggugcuguggcucacgccuguaaucccag

SEQ ID NO: 377129 - RNA, 32 nt, Human
ccggguggacugcuccacuaccgcaaaucagg

SEQ ID NO: 377130 - RNA, 24 nt, Human
ccggguggcagagguugcagugag

SEQ ID NO: 377131 - RNA, 24 nt, Human
ccggguggcugggaucacaggcgu

SEQ ID NO: 377132 - RNA, 22 nt, Human
ccggguggcugggauugcaggc

SEQ ID NO: 377133 - RNA, 32 nt, Human
ccgggugggaccugggcuguuugcucuuggag

SEQ ID NO: 377134 - RNA, 32 nt, Human
ccggguggggcagaagacucgccccuugaacc

SEQ ID NO: 377135 - RNA, 19 nt, Human
ccggguggggcgggcgcgg

SEQ ID NO: 377136 - RNA, 22 nt, Human
ccggguggggggugacgggggg

SEQ ID NO: 377137 - RNA, 32 nt, Human
ccgggugguggccggcaccucugcuccucacg

SEQ ID NO: 377138 - RNA, 32 nt, Human
ccggguguaguggcucacaccuguaaucccag

SEQ ID NO: 377139 - RNA, 32 nt, Human
ccggguguaguggcucacgccuguaaucccag

SEQ ID NO: 377140 - RNA, 32 nt, Human
ccggguguaguggcucaugccuguaauccgag

SEQ ID NO: 377141 - RNA, 32 nt, Human
ccgggugucgauccuuuucccuccagucaggg

SEQ ID NO: 377142 - RNA, 32 nt, Human
ccgggugucguggcacacaccuguaaucccag

SEQ ID NO: 377143 - RNA, 21 nt, Human
ccgggugucugcaaaaugcag

SEQ ID NO: 377144 - RNA, 32 nt, Human
ccgggugucugcaaaaugcagaggucaccaga

SEQ ID NO: 377145 - RNA, 32 nt, Human
ccgggugucuucaugggaggcgacaccggcac

SEQ ID NO: 377146 - RNA, 32 nt, Human
ccgggugugccagguguggugccuggaggcag

SEQ ID NO: 377147 - RNA, 32 nt, Human
ccgggugugccgcgacggcucuccagugaggc

SEQ ID NO: 377148 - RNA, 32 nt, Human
ccgggugugcuggugggcgccuguaaucccag

SEQ ID NO: 377149 - RNA, 32 nt, Human
ccgggugugggcccgugucuguccgucccucc

SEQ ID NO: 377150 - RNA, 32 nt, Human
ccgggugugggggcucacgccuguaaucccag

SEQ ID NO: 377151 - RNA, 32 nt, Human
ccgggugugguggcacacaccuguaaucccag

SEQ ID NO: 377152 - RNA, 32 nt, Human
ccgggugugguggcacaugccuguaaucccag

SEQ ID NO: 377153 - RNA, 32 nt, Human
ccgggugugguggcaugugccagcuacucggg

SEQ ID NO: 377154 - RNA, 32 nt, Human
ccgggugugguggcgcaugccuguaaucccaa

SEQ ID NO: 377155 - RNA, 32 nt, Human
ccgggugugguggcgcaugccuguaaucccag

SEQ ID NO: 377156 - RNA, 32 nt, Human
ccgggugugguggcucacaccuguaaucccag

SEQ ID NO: 377157 - RNA, 32 nt, Human
ccgggugugguggcucacaccuguaaucucgg

SEQ ID NO: 377158 - RNA, 32 nt, Human
ccgggugugguggcucacgccuguaaucccag

SEQ ID NO: 377159 - RNA, 32 nt, Human
ccgggugugguggcucacgccuguaaucccug

SEQ ID NO: 377160 - RNA, 32 nt, Human
ccgggugugguggcucacgccuguaauucuag

SEQ ID NO: 377161 - RNA, 32 nt, Human
ccgggugugguggcucaugccuauaaucccag

SEQ ID NO: 377162 - RNA, 32 nt, Human
ccgggugugguggcucaugccuuaaucccagc

SEQ ID NO: 377163 - RNA, 32 nt, Human
ccgggugugguggugcaugccuguaaucccag

SEQ ID NO: 377164 - RNA, 32 nt, Human
ccggguguggugguucacaccuguaauccaag

SEQ ID NO: 377165 - RNA, 32 nt, Human
ccggguguggugucacgcgccuguaaucccag

SEQ ID NO: 377166 - RNA, 32 nt, Human
ccgggugugguguugggcaccuguaaucccag

SEQ ID NO: 377167 - RNA, 32 nt, Human
ccggguguuguggcgggugccuguaaucucag

SEQ ID NO: 377168 - RNA, 32 nt, Human
ccggguuagccuggugacaggcagacacaugc

SEQ ID NO: 377169 - RNA, 32 nt, Human
ccggguucaaaccauucuccugccucagccuc

SEQ ID NO: 377170 - RNA, 32 nt, Human
ccggguucaaacgauucuccugccucagccuc

SEQ ID NO: 377171 - RNA, 32 nt, Human
ccggguucaaacuauucucccgccucaaccuc

SEQ ID NO: 377172 - RNA, 32 nt, Human
ccggguucaaaugauucucgugccucagccuc

SEQ ID NO: 377173 - RNA, 32 nt, Human
ccggguucaagcaacucuccugccucagccuc

SEQ ID NO: 377174 - RNA, 32 nt, Human
ccggguucaagcaauccucccugccucagccu

SEQ ID NO: 377175 - RNA, 32 nt, Human
ccggguucaagcaaugcucccgccucaaccuc

SEQ ID NO: 377176 - RNA, 32 nt, Human
ccggguucaagcaauuaacugccucagcuucc

SEQ ID NO: 377177 - RNA, 32 nt, Human
ccggguucaagcaauuauuugccucagccucc

SEQ ID NO: 377178 - RNA, 32 nt, Human
ccggguucaagcaauucccugccucagccuca

SEQ ID NO: 377179 - RNA, 32 nt, Human
ccggguucaagcaauucucaugcaucagccuc

SEQ ID NO: 377180 - RNA, 32 nt, Human
ccggguucaagcaauucucaugccucagccuc

SEQ ID NO: 377181 - RNA, 32 nt, Human
ccggguucaagcaauucucccaucucagccuc

SEQ ID NO: 377182 - RNA, 32 nt, Human
ccggguucaagcaauucucccgccucagcccc

SEQ ID NO: 377183 - RNA, 32 nt, Human
ccggguucaagcaauucuccugccuaagccuc

SEQ ID NO: 377184 - RNA, 32 nt, Human
ccggguucaagcaauucuccugccucacccuc

SEQ ID NO: 377185 - RNA, 32 nt, Human
ccggguucaagcaauucuccugccucagccuc

SEQ ID NO: 377186 - RNA, 32 nt, Human
ccggguucaagcaauucuccugccucagcucc

SEQ ID NO: 377187 - RNA, 32 nt, Human
ccggguucaagcaauucuccugccucagcuuc

SEQ ID NO: 377188 - RNA, 32 nt, Human
ccggguucaagcaauucuccugccuuagccuc

SEQ ID NO: 377189 - RNA, 32 nt, Human
ccggguucaagcaauucuccugucucagccuc

SEQ ID NO: 377190 - RNA, 32 nt, Human
ccggguucaagcaauucuccuucuucagccuc

SEQ ID NO: 377191 - RNA, 32 nt, Human
ccggguucaagcaauucucugccucagccucc

SEQ ID NO: 377192 - RNA, 32 nt, Human
ccggguucaagcaauucugucucagccucccg

SEQ ID NO: 377193 - RNA, 32 nt, Human
ccggguucaagcaauucuucugccucagccuc

SEQ ID NO: 377194 - RNA, 32 nt, Human
ccggguucaagcaauuuccugccucagccuca

SEQ ID NO: 377195 - RNA, 32 nt, Human
ccggguucaagcaguucuccugccucaaccuc

SEQ ID NO: 377196 - RNA, 32 nt, Human
ccggguucaagcaguucuccugccucagcccc

SEQ ID NO: 377197 - RNA, 32 nt, Human
ccggguucaagcaguucuccugccucagccuc

SEQ ID NO: 377198 - RNA, 32 nt, Human
ccggguucaagcaguucuccugccucagucuc

SEQ ID NO: 377199 - RNA, 32 nt, Human
ccggguucaagcaguucucugccucagccucc

SEQ ID NO: 377200 - RNA, 32 nt, Human
ccggguucaagcaguucugccucagccuccca

SEQ ID NO: 377201 - RNA, 32 nt, Human
ccggguucaagcaguuuccugcuucagacuuc

SEQ ID NO: 377202 - RNA, 32 nt, Human
ccggguucaagcauuucuccugucucagccuc

SEQ ID NO: 377203 - RNA, 32 nt, Human
ccggguucaagccauucuccugccucagucuc

SEQ ID NO: 377204 - RNA, 32 nt, Human
ccggguucaagcgauccuccugccucagucuc

SEQ ID NO: 377205 - RNA, 32 nt, Human
ccggguucaagcgauucucccaucucagccuc

SEQ ID NO: 377206 - RNA, 32 nt, Human
ccggguucaagcgauucucccgccucagccuc

SEQ ID NO: 377207 - RNA, 32 nt, Human
ccggguucaagcgauucuccuaccucagccuc

SEQ ID NO: 377208 - RNA, 32 nt, Human
ccggguucaagcgauucucgugccucagccuc

SEQ ID NO: 377209 - RNA, 32 nt, Human
ccggguucaagcgauucuugugccucggccuc

SEQ ID NO: 377210 - RNA, 32 nt, Human
ccggguucaagcuauucuccugccucagccuu

SEQ ID NO: 377211 - RNA, 32 nt, Human
ccggguucaaguaauucuccugccucaggcuu

SEQ ID NO: 377212 - RNA, 32 nt, Human
ccggguucaagugauuccccuaccucagccuc

SEQ ID NO: 377213 - RNA, 32 nt, Human
ccggguucaaucaauucuccuaccucaacuuc

SEQ ID NO: 377214 - RNA, 32 nt, Human
ccggguucacaccauucucccaccucaacccc

SEQ ID NO: 377215 - RNA, 32 nt, Human
ccggguucacaccauucuccugccucagccuc

SEQ ID NO: 377216 - RNA, 32 nt, Human
ccggguucacgcccuucuccugccucagccuc

SEQ ID NO: 377217 - RNA, 32 nt, Human
ccggguucacggcauucucccgccucagccuc

SEQ ID NO: 377218 - RNA, 24 nt, Human
ccggguucacuccccgccucccca

SEQ ID NO: 377219 - RNA, 32 nt, Human
ccggguucagaacuucaggccuguacgaugcc

SEQ ID NO: 377220 - RNA, 32 nt, Human
ccggguucaggcaauucuccugccucagcuuc

SEQ ID NO: 377221 - RNA, 32 nt, Human
ccggguucaggcaauucucuugcaucagccuc

SEQ ID NO: 377222 - RNA, 32 nt, Human
ccggguucaucccacaccagccgccuccacca

SEQ ID NO: 377223 - RNA, 32 nt, Human
ccggguucaugccauucuccugccucagccuc

SEQ ID NO: 377224 - RNA, 32 nt, Human
ccggguucaugccauucuccugccucagcguc

SEQ ID NO: 377225 - RNA, 32 nt, Human
ccggguuccccaggggaauacauguccccagc

SEQ ID NO: 377226 - RNA, 32 nt, Human
ccggguucgagcaauucuccugccucagccuc

SEQ ID NO: 377227 - RNA, 32 nt, Human
ccggguucgagcgauucuccugccucagccuc

SEQ ID NO: 377228 - RNA, 32 nt, Human
ccggguucgcaccauucuccugccucagccuc

SEQ ID NO: 377229 - RNA, 32 nt, Human
ccggguucucaccauucuccugccucagccuc

SEQ ID NO: 377230 - RNA, 32 nt, Human
ccggguucugcuugaggccgagccaaagagug

SEQ ID NO: 377231 - RNA, 32 nt, Human
ccggguuguaaucaccaucuggcccgccgcuc

SEQ ID NO: 377232 - RNA, 32 nt, Human
ccggguuguccuguucuuucugggcuugcuca

SEQ ID NO: 377233 - RNA, 32 nt, Human
ccggguugugagggguuguugcaaugaaauaa

SEQ ID NO: 377234 - RNA, 32 nt, Human
ccggguuucagcgauucucgugccucagcuuc

SEQ ID NO: 377235 - RNA, 32 nt, Human
ccggguuucuucuugaagcagcuccugcaaaa

SEQ ID NO: 377236 - RNA, 32 nt, Human
ccggguuugagcagaacgggcccagugcccug

SEQ ID NO: 377237 - RNA, 32 nt, Human
ccggguuuguuguccagcaccaauucuggcug

SEQ ID NO: 377238 - RNA, 22 nt, Human
ccgguaagcccgccuccucccu

SEQ ID NO: 377239 - RNA, 32 nt, Human
ccgguaaggcucccccucacccacgccaacuc

SEQ ID NO: 377240 - RNA, 17 nt, Human
ccgguaagggggugcag

SEQ ID NO: 377241 - RNA, 32 nt, Human
ccgguaaucccagcuacucaggaggcugagac

SEQ ID NO: 377242 - RNA, 32 nt, Human
ccgguaccugggaagggggagagugcaggccu

SEQ ID NO: 377243 - RNA, 32 nt, Human
ccgguagaggcggagguugcagugagccgaga

SEQ ID NO: 377244 - RNA, 19 nt, Human
ccgguagcagcuccgcggc

SEQ ID NO: 377245 - RNA, 32 nt, Human
ccgguagcccaggagauggagcagcccagccc

SEQ ID NO: 377246 - RNA, 32 nt, Human
ccgguagccccagcuacucgggaggcugaggu

SEQ ID NO: 377247 - RNA, 32 nt, Human
ccgguagccugacagcaggagcucgagagaag

SEQ ID NO: 377248 - RNA, 32 nt, Human
ccgguaggaagugggggccaggagagcagcgg

SEQ ID NO: 377249 - RNA, 32 nt, Human
ccgguaggagugagguuucaucgguucccucg

SEQ ID NO: 377250 - RNA, 24 nt, Human
ccgguagguggagguugcagugag

SEQ ID NO: 377251 - RNA, 32 nt, Human
ccgguagucccagcuacucaggaggcugaggc

SEQ ID NO: 377252 - RNA, 32 nt, Human
ccgguaucguuucgcauggaaaagccacuuuc

SEQ ID NO: 377253 - RNA, 32 nt, Human
ccgguauuguuugcaaacuuugcugcucuccg

SEQ ID NO: 377254 - RNA, 32 nt, Human
ccggucaacguggugaaaccccaucucuacua

SEQ ID NO: 377255 - RNA, 32 nt, Human
ccggucaagaagcaggagcaggagccggagcc

SEQ ID NO: 377256 - RNA, 32 nt, Human
ccggucaagccuuuaucccagcacucaguugu

SEQ ID NO: 377257 - RNA, 32 nt, Human
ccggucaccacgaggugagaggcugcacccag

SEQ ID NO: 377258 - RNA, 31 nt, Human
ccggucagaacugugugacucacuugaggca

SEQ ID NO: 377259 - RNA, 32 nt, Human
ccggucagacccaggauggggccagaacggac

SEQ ID NO: 377260 - RNA, 32 nt, Human
ccggucaggcccuagggugaagccgggaggaa

SEQ ID NO: 377261 - RNA, 32 nt, Human
ccggucaggcucucagaugcagcugguugcac

SEQ ID NO: 377262 - RNA, 32 nt, Human
ccggucagucauacggguuggaagaugggucu

SEQ ID NO: 377263 - RNA, 32 nt, Human
ccggucaugagaggggugaggucucuguggaa

SEQ ID NO: 377264 - RNA, 32 nt, Human
ccggucaugguggcucacgccuguaaucacag

SEQ ID NO: 377265 - RNA, 32 nt, Human
ccggucaugguggcucaugccuguaaucccaa

SEQ ID NO: 377266 - RNA, 32 nt, Human
ccggucauggugguggacaccuguaaucccag

SEQ ID NO: 377267 - RNA, 32 nt, Human
ccggucauuugugcccuucucuugucaucucu

SEQ ID NO: 377268 - RNA, 32 nt, Human
ccggucauuugugccuuucucuugucaucucu

SEQ ID NO: 377269 - RNA, 32 nt, Human
ccgguccacugcaaccuccacuucccggguuc

SEQ ID NO: 377270 - RNA, 32 nt, Human
ccgguccagaugcacacaguaucauugccaag

SEQ ID NO: 377271 - RNA, 32 nt, Human
ccgguccagccgcggccggcgccuggcuguga

SEQ ID NO: 377272 - RNA, 32 nt, Human
ccgguccauucaagcugacgcacccgcugguu

SEQ ID NO: 377273 - RNA, 32 nt, Human
ccgguccccagacccaagagcuguggcugccu

SEQ ID NO: 377274 - RNA, 21 nt, Human
ccgguccccccacugcugcug

SEQ ID NO: 377275 - RNA, 21 nt, Human
ccgguccccgcaggcccggga

SEQ ID NO: 377276 - RNA, 32 nt, Human
ccgguccccugccuggaacuggcugugaagac

SEQ ID NO: 377277 - RNA, 32 nt, Human
ccgguccccuguccccgguccccagccagcuc

SEQ ID NO: 377278 - RNA, 32 nt, Human
ccggucccggaggucccacagcaaagacaggc

SEQ ID NO: 377279 - RNA, 26 nt, Human
ccggucccuccagcugggggcccuca

SEQ ID NO: 377280 - RNA, 32 nt, Human
ccggucccuccagcugggggcccucaggugga

SEQ ID NO: 377281 - RNA, 32 nt, Human
ccggucccuccaggcucaguguggcuucuccc

SEQ ID NO: 377282 - RNA, 32 nt, Human
ccggucccuucccccaucauccuuccuuagac

SEQ ID NO: 377283 - RNA, 26 nt, Human
ccgguccucagccuugccugggcuca

SEQ ID NO: 377284 - RNA, 32 nt, Human
ccgguccucauaccccagacugugcugauacg

SEQ ID NO: 377285 - RNA, 32 nt, Human
ccgguccugcuggccccuuuuccucuggcccc

SEQ ID NO: 377286 - RNA, 32 nt, Human
ccgguccuggccugggcugggcccagccugag

SEQ ID NO: 377287 - RNA, 23 nt, Human
ccggucggaggggaggcgggagg

SEQ ID NO: 377288 - RNA, 32 nt, Human
ccggucgggcagcgcugcgggagcagccgccg

SEQ ID NO: 377289 - RNA, 32 nt, Human
ccggucgucucaaauucaucugaucucuuauu

SEQ ID NO: 377290 - RNA, 32 nt, Human
ccggucgugguggcucaugccuguaaucccaa

SEQ ID NO: 377291 - RNA, 32 nt, Human
ccggucuaccugucucacuacaugcauaaagu

SEQ ID NO: 377292 - RNA, 32 nt, Human
ccggucuauaggugcauaccaccacaccaggc

SEQ ID NO: 377293 - RNA, 32 nt, Human
ccggucucacagucacagccacguccucccga

SEQ ID NO: 377294 - RNA, 17 nt, Human
ccggucucugcagcagc

SEQ ID NO: 377295 - RNA, 32 nt, Human
ccggucuggaaaggcaggugaucagcuagaag

SEQ ID NO: 377296 - RNA, 32 nt, Human
ccggucuggggugaggaguguggggagcuugg

SEQ ID NO: 377297 - RNA, 32 nt, Human
ccggucuguucuguuccacucugaccaucggu

SEQ ID NO: 377298 - RNA, 32 nt, Human
ccggucuucucccacgcccuaccucagugccg

SEQ ID NO: 377299 - RNA, 32 nt, Human
ccggucuugaugcaggagagucuggaaaagga

SEQ ID NO: 377300 - RNA, 32 nt, Human
ccggugaaagacagagaucacauuucaacuag

SEQ ID NO: 377301 - RNA, 32 nt, Human
ccggugaagagcugcagaugccgagaagccag

SEQ ID NO: 377302 - RNA, 32 nt, Human
ccggugaaugugccucugguggcugcugagaa

SEQ ID NO: 377303 - RNA, 32 nt, Human
ccggugaauguguccacaguugagagguugga

SEQ ID NO: 377304 - RNA, 32 nt, Human
ccggugacaucgucuccuucugaggucugagg

SEQ ID NO: 377305 - RNA, 21 nt, Human
ccggugacuuacuguacagca

SEQ ID NO: 377306 - RNA, 32 nt, Human
ccggugagaagcagagcgcgagagggagcccu

SEQ ID NO: 377307 - RNA, 32 nt, Human
ccggugagauggaccauccugcccccgugggg

SEQ ID NO: 377308 - RNA, 32 nt, Human
ccggugagcgcagccagcaggagcugagcagc

SEQ ID NO: 377309 - RNA, 32 nt, Human
ccggugaggaagggucuccaggcuucacucag

SEQ ID NO: 377310 - RNA, 32 nt, Human
ccggugaggguaagguuggugggggugcagcg

SEQ ID NO: 377311 - RNA, 17 nt, Human
ccggugcacagcagcuu

SEQ ID NO: 377312 - RNA, 32 nt, Human
ccggugcacaggccucugccugcuggggauua

SEQ ID NO: 377313 - RNA, 32 nt, Human
ccggugcagccuguugccagccagccuuugag

SEQ ID NO: 377314 - RNA, 32 nt, Human
ccggugcagguggggaaaauggcggugucuac

SEQ ID NO: 377315 - RNA, 32 nt, Human
ccggugcaggugugaccagagaccaccucugu

SEQ ID NO: 377316 - RNA, 21 nt, Human
ccggugccaauaaauccuugu

SEQ ID NO: 377317 - RNA, 32 nt, Human
ccggugccaccaggagacccccaaggaggaca

SEQ ID NO: 377318 - RNA, 32 nt, Human
ccggugccaucugaagcccccuucccagguuu

SEQ ID NO: 377319 - RNA, 32 nt, Human
ccggugccuguucuccccugaccgagccugug

SEQ ID NO: 377320 - RNA, 32 nt, Human
ccggugccuucccaggcacuggcguuaccgcu

SEQ ID NO: 377321 - RNA, 32 nt, Human
ccggugcgcaucaccaugcgcggccuggcuuc

SEQ ID NO: 377322 - RNA, 32 nt, Human
ccggugcggcgaggcgggcagagccagaggca

SEQ ID NO: 377323 - RNA, 22 nt, Human
ccggugcuagggcagaggcacc

SEQ ID NO: 377324 - RNA, 32 nt, Human
ccggugcuauccuccccucccaccccucacag

SEQ ID NO: 377325 - RNA, 32 nt, Human
ccggugcugccuggcugguugcucuagcgccc

SEQ ID NO: 377326 - RNA, 32 nt, Human
ccggugcugggcuccccgucugccuugagggg

SEQ ID NO: 377327 - RNA, 32 nt, Human
ccggugcuugaacaaggagcuccgcucuacaa

SEQ ID NO: 377328 - RNA, 32 nt, Human
ccggugcuuuugcccaagcuuugaccacacgu

SEQ ID NO: 377329 - RNA, 32 nt, Human
ccgguggacagggagagccugagacgcccuuc

SEQ ID NO: 377330 - RNA, 32 nt, Human
ccgguggagagggacgcggcggacgccggcag

SEQ ID NO: 377331 - RNA, 32 nt, Human
ccgguggaggcagaggcaguccuggggcucug

SEQ ID NO: 377332 - RNA, 32 nt, Human
ccgguggagggagggagcagggagcccucacu

SEQ ID NO: 377333 - RNA, 32 nt, Human
ccgguggcacagacgccuccagggggcagcac

SEQ ID NO: 377334 - RNA, 18 nt, Human
ccgguggcacccgggcua

SEQ ID NO: 377335 - RNA, 22 nt, Human
ccgguggcagcagcagcaucac

SEQ ID NO: 377336 - RNA, 20 nt, Human
ccgguggccagagccagcca

SEQ ID NO: 377337 - RNA, 32 nt, Human
ccgguggccaguuaagcagagacuucacugac

SEQ ID NO: 377338 - RNA, 32 nt, Human
ccgguggcccagccgcucagggccagggccug

SEQ ID NO: 377339 - RNA, 32 nt, Human
ccgguggccccugggguggaagugggguaggg

SEQ ID NO: 377340 - RNA, 32 nt, Human
ccgguggcccuugcuucuugcuuugcagacug

SEQ ID NO: 377341 - RNA, 32 nt, Human
ccgguggccugggagcugcuuucuccccacug

SEQ ID NO: 377342 - RNA, 32 nt, Human
ccgguggcggccccagcaccucagccugcaca

SEQ ID NO: 377343 - RNA, 32 nt, Human
ccgguggcuagccagacaaaagaccuguccgu

SEQ ID NO: 377344 - RNA, 32 nt, Human
ccggugggaagacauccugagcgaugagguca

SEQ ID NO: 377345 - RNA, 32 nt, Human
ccggugggaagcccagacgaggaggacgggga

SEQ ID NO: 377346 - RNA, 32 nt, Human
ccggugggacagugucuccagguagugaggcc

SEQ ID NO: 377347 - RNA, 32 nt, Human
ccgguggggagggcugggagggggagggaacu

SEQ ID NO: 377348 - RNA, 22 nt, Human
ccgguggggguagggggugcgg

SEQ ID NO: 377349 - RNA, 32 nt, Human
ccgguggggugagauggacagaaagcuucaga

SEQ ID NO: 377350 - RNA, 32 nt, Human
ccgguggucaugccaugagcagccuuauggag

SEQ ID NO: 377351 - RNA, 32 nt, Human
ccgguggugaugacuccuacaucuaaguggcc

SEQ ID NO: 377352 - RNA, 32 nt, Human
ccgguggugaugacuccuacaucuaguggccc

SEQ ID NO: 377353 - RNA, 32 nt, Human
ccggugguggcagaugcuuccuccuggccaaa

SEQ ID NO: 377354 - RNA, 32 nt, Human
ccgguguaugcaguggugaugccuaaaggaau

SEQ ID NO: 377355 - RNA, 32 nt, Human
ccgguguccugaggaauagccucugcccccac

SEQ ID NO: 377356 - RNA, 32 nt, Human
ccggugucuccaagcacuucucgacaggcguu

SEQ ID NO: 377357 - RNA, 32 nt, Human
ccggugugaaguuucacacccaaaaggaugaa

SEQ ID NO: 377358 - RNA, 32 nt, Human
ccggugugagccagcgcugcugccagugugag

SEQ ID NO: 377359 - RNA, 32 nt, Human
ccggugugagcugcaggcugugcuccagaucc

SEQ ID NO: 377360 - RNA, 32 nt, Human
ccggugugcaaccgaaggugaagagcgggaag

SEQ ID NO: 377361 - RNA, 32 nt, Human
ccggugugcagcuggagagcgagcggccaccg

SEQ ID NO: 377362 - RNA, 21 nt, Human
ccggugugcucacugauccgc

SEQ ID NO: 377363 - RNA, 32 nt, Human
ccggugugcuguagcuccagccgggaugagga

SEQ ID NO: 377364 - RNA, 32 nt, Human
ccgguguggcugcucgguggccccacacccac

SEQ ID NO: 377365 - RNA, 32 nt, Human
ccgguguguccccauuucauggcauuggggga

SEQ ID NO: 377366 - RNA, 32 nt, Human
ccgguuaacaucuuuuaauuguuuccaggauu

SEQ ID NO: 377367 - RNA, 32 nt, Human
ccgguuccagccugggcuguccaggaagugac

SEQ ID NO: 377368 - RNA, 22 nt, Human
ccgguucccugggagaaggcug

SEQ ID NO: 377369 - RNA, 21 nt, Human
ccgguuccucucuaggcgcca

SEQ ID NO: 377370 - RNA, 23 nt, Human
ccgguuccucuggaggugccuua

SEQ ID NO: 377371 - RNA, 32 nt, Human
ccgguuccugcuacgccccauggaggcuccga

SEQ ID NO: 377372 - RNA, 22 nt, Human
ccgguuccuuccugcuucacuc

SEQ ID NO: 377373 - RNA, 22 nt, Human
ccgguuccuuccuggaggccuc

SEQ ID NO: 377374 - RNA, 32 nt, Human
ccgguuccuuucucucugcuccugacacugcu

SEQ ID NO: 377375 - RNA, 32 nt, Human
ccgguucuacagccccagcccagaucuacuuc

SEQ ID NO: 377376 - RNA, 32 nt, Human
ccgguucucaaagccucagcaccaucuuuuau

SEQ ID NO: 377377 - RNA, 32 nt, Human
ccgguucucaagauguaacacagcagaaaagu

SEQ ID NO: 377378 - RNA, 32 nt, Human
ccgguucuccaccuccccauccgccccaggcc

SEQ ID NO: 377379 - RNA, 32 nt, Human
ccgguugcucucaaacuccugaccucagguga

SEQ ID NO: 377380 - RNA, 32 nt, Human
ccgguuggaacugggacugagcucgggcacgc

SEQ ID NO: 377381 - RNA, 32 nt, Human
ccgguuggacugcucaggcuuuccgaggucaa

SEQ ID NO: 377382 - RNA, 18 nt, Human
ccgguuggccccgggcca

SEQ ID NO: 377383 - RNA, 32 nt, Human
ccgguuggccccgggccagggcacagguaccg

SEQ ID NO: 377384 - RNA, 32 nt, Human
ccgguuggggguccccaggguggggcagggau

SEQ ID NO: 377385 - RNA, 21 nt, Human
ccgguuguguccugugggagg

SEQ ID NO: 377386 - RNA, 32 nt, Human
ccgguuuauaaauauuuuagacuuugcaggcu

SEQ ID NO: 377387 - RNA, 32 nt, Human
ccgguuucaacacacacagacaaacacagcca

SEQ ID NO: 377388 - RNA, 32 nt, Human
ccgguuucaagcaauucuccugccucagccuc

SEQ ID NO: 377389 - RNA, 32 nt, Human
ccgguuucaagcaguucuccagcaucagccuc

SEQ ID NO: 377390 - RNA, 32 nt, Human
ccgguuucaauugugcccuauuacaaaagaaa

SEQ ID NO: 377391 - RNA, 21 nt, Human
ccgguuucccugcugaccugc

SEQ ID NO: 377392 - RNA, 32 nt, Human
ccgguuucggggagguggguggggugcggagc

SEQ ID NO: 377393 - RNA, 32 nt, Human
ccgguuucuaagagucaguucaguggcagagc

SEQ ID NO: 377394 - RNA, 32 nt, Human
ccgguuucuaaucccugcucugucacuaacaa

SEQ ID NO: 377395 - RNA, 32 nt, Human
ccgguuucuugucccagcagguugggggcgcc

SEQ ID NO: 377396 - RNA, 32 nt, Human
ccgguuugcaguacuugcacacauuuuggaga

SEQ ID NO: 377397 - RNA, 32 nt, Human
ccgguuuugaagccgcuucucugcccgaguua

SEQ ID NO: 377398 - RNA, 32 nt, Human
ccguaaaugcgaguuguuuuuguauuugugug

SEQ ID NO: 377399 - RNA, 32 nt, Human
ccguaaaugucugcacugaggauuucuuuuug

SEQ ID NO: 377400 - RNA, 32 nt, Human
ccguaacaagggcacacauccagcacuguguc

SEQ ID NO: 377401 - RNA, 32 nt, Human
ccguaaccacugcacaucaccuccaucucugc

SEQ ID NO: 377402 - RNA, 32 nt, Human
ccguaacuccuaggacccccaaaucauggaau

SEQ ID NO: 377403 - RNA, 32 nt, Human
ccguaacugcccagcccugccccuugcccccg

SEQ ID NO: 377404 - RNA, 32 nt, Human
ccguaagcccagggauguggcagcugcagugg

SEQ ID NO: 377405 - RNA, 32 nt, Human
ccguaaggccugauggaacacagaacugaacu

SEQ ID NO: 377406 - RNA, 32 nt, Human
ccguaaggcugcagagcaagggcagcaggacc

SEQ ID NO: 377407 - RNA, 32 nt, Human
ccguaagggcuggacccagcuccuuucugggc

SEQ ID NO: 377408 - RNA, 32 nt, Human
ccguaauccaguuuuccuaggaaaacuaagcc

SEQ ID NO: 377409 - RNA, 32 nt, Human
ccguacaaacacaagaucagggcugaggguaa

SEQ ID NO: 377410 - RNA, 32 nt, Human
ccguacacugaaagggcagagcaggccuaagg

SEQ ID NO: 377411 - RNA, 32 nt, Human
ccguacacugguuuguugacuguucuuucaau

SEQ ID NO: 377412 - RNA, 32 nt, Human
ccguacagacacagcauccuuggccaccucau

SEQ ID NO: 377413 - RNA, 31 nt, Human
ccguaccaagugucaccgcagcaagaggggg

SEQ ID NO: 377414 - RNA, 32 nt, Human
ccguaccacuggccgcugcuggucuuccugcu

SEQ ID NO: 377415 - RNA, 32 nt, Human
ccguacccacacugggcaccaucagcuaaaga

SEQ ID NO: 377416 - RNA, 32 nt, Human
ccguacccagccagagaagaaaaagaacagug

SEQ ID NO: 377417 - RNA, 32 nt, Human
ccguacccagccuggucccauaucauagugaa

SEQ ID NO: 377418 - RNA, 32 nt, Human
ccguacccuccaggcuagaggcuuccccugau

SEQ ID NO: 377419 - RNA, 32 nt, Human
ccguacccugcuguagugccucuuaucccuuc

SEQ ID NO: 377420 - RNA, 32 nt, Human
ccguaccucaccuggccugcaggaugaagaac

SEQ ID NO: 377421 - RNA, 32 nt, Human
ccguacgagcaucucacuuucccuuccauggu

SEQ ID NO: 377422 - RNA, 32 nt, Human
ccguacuaugaacaccagaacagaagagauuu

SEQ ID NO: 377423 - RNA, 32 nt, Human
ccguacuggaggcuagcucuugucgcggccgc

SEQ ID NO: 377424 - RNA, 32 nt, Human
ccguacugguacuucuugcagugcaaacaccu

SEQ ID NO: 377425 - RNA, 32 nt, Human
ccguacuuccagauuuauuguuauggcuccca

SEQ ID NO: 377426 - RNA, 32 nt, Human
ccguagaaaugucaaucagagcccggagcccc

SEQ ID NO: 377427 - RNA, 19 nt, Human
ccguagaccauuuacucca

SEQ ID NO: 377428 - RNA, 32 nt, Human
ccguagagcacuucuaagcagagauuauuugu

SEQ ID NO: 377429 - RNA, 32 nt, Human
ccguagagccagaucgucaucaugucugcauu

SEQ ID NO: 377430 - RNA, 32 nt, Human
ccguagaggccuuccuugaagaugcaucuaga

SEQ ID NO: 377431 - RNA, 32 nt, Human
ccguagagucucacugauucugagauggcuuu

SEQ ID NO: 377432 - RNA, 32 nt, Human
ccguagauaccuguugcugacugcaaacgaug

SEQ ID NO: 377433 - RNA, 32 nt, Human
ccguagcaacaguguagugagaacagcaccca

SEQ ID NO: 377434 - RNA, 32 nt, Human
ccguagcacugaggacccccggagaagauggg

SEQ ID NO: 377435 - RNA, 32 nt, Human
ccguagcaggguggugaggaggguggcugugg

SEQ ID NO: 377436 - RNA, 32 nt, Human
ccguagcccaggcuggagugcaguggcacagu

SEQ ID NO: 377437 - RNA, 18 nt, Human
ccguagccgccccggcca

SEQ ID NO: 377438 - RNA, 30 nt, Human
ccguagccuccagacaugcuccugauuucu

SEQ ID NO: 377439 - RNA, 32 nt, Human
ccguagcuagagcggcucagagacaggaggcg

SEQ ID NO: 377440 - RNA, 32 nt, Human
ccguagcuaggacugggguggccaggcccagg

SEQ ID NO: 377441 - RNA, 32 nt, Human
ccguaggacccaagcagagaagcucucgggcu

SEQ ID NO: 377442 - RNA, 32 nt, Human
ccguaggacugaggcagacuccacggugagaa

SEQ ID NO: 377443 - RNA, 32 nt, Human
ccguaggaggggcagagauugugcugauaggu

SEQ ID NO: 377444 - RNA, 32 nt, Human
ccguaggcagccggaggaaugcagcccaagca

SEQ ID NO: 377445 - RNA, 32 nt, Human
ccguaggggcuccugagugucaugaagugcac

SEQ ID NO: 377446 - RNA, 32 nt, Human
ccguaggugccuggccaguuuccuguuugugg

SEQ ID NO: 377447 - RNA, 32 nt, Human
ccguaguccauggcuaguuaggaagaaaggag

SEQ ID NO: 377448 - RNA, 32 nt, Human
ccguagucucccaggcucgagcaauccuccca

SEQ ID NO: 377449 - RNA, 20 nt, Human
ccguauacccucucaccauc

SEQ ID NO: 377450 - RNA, 32 nt, Human
ccguauagaagagaagacucaauggaagacag

SEQ ID NO: 377451 - RNA, 23 nt, Human
ccguauagggguuaaaguaucag

SEQ ID NO: 377452 - RNA, 32 nt, Human
ccguaucagccccuucagcaagccauaagaaa

SEQ ID NO: 377453 - RNA, 32 nt, Human
ccguauccagaaggauagugaucaugucuagu

SEQ ID NO: 377454 - RNA, 32 nt, Human
ccguaucuuccccaauccaaucucaaguguga

SEQ ID NO: 377455 - RNA, 32 nt, Human
ccguaugucaugagccuugugcgucaccucac

SEQ ID NO: 377456 - RNA, 32 nt, Human
ccguaugugcuagguaggaguggagggagaua

SEQ ID NO: 377457 - RNA, 32 nt, Human
ccguauuauuagccuggcuccccagguucugg

SEQ ID NO: 377458 - RNA, 32 nt, Human
ccguauuccgaggaguagagaggcagaagaga

SEQ ID NO: 377459 - RNA, 32 nt, Human
ccguauuucccaagcccuccucuuuuagccaa

SEQ ID NO: 377460 - RNA, 32 nt, Human
ccguauuuccugcaccugucagccugcaccga

SEQ ID NO: 377461 - RNA, 32 nt, Human
ccguauuugcagcuggaacugcagcccacggc

SEQ ID NO: 377462 - RNA, 32 nt, Human
ccgucaaagaauaugaggaaguugcuguauga

SEQ ID NO: 377463 - RNA, 32 nt, Human
ccgucaaccaaaaucaguguuuauagagugaa

SEQ ID NO: 377464 - RNA, 32 nt, Human
ccgucaagacucccagcuuagucauuuucuug

SEQ ID NO: 377465 - RNA, 32 nt, Human
ccgucaaggcgcugucccuguacagcaugagc

SEQ ID NO: 377466 - RNA, 32 nt, Human
ccgucacaaggagcuuuuccacaccugccaug

SEQ ID NO: 377467 - RNA, 21 nt, Human
ccgucacagccucaagucacu

SEQ ID NO: 377468 - RNA, 32 nt, Human
ccgucacaggcagugaggaugagaggggguga

SEQ ID NO: 377469 - RNA, 32 nt, Human
ccgucacauucaaccauguggaggcccagguc

SEQ ID NO: 377470 - RNA, 32 nt, Human
ccgucacccaggcuggagugcaguggcaagau

SEQ ID NO: 377471 - RNA, 32 nt, Human
ccgucacccaggcuggagugcaguggcgccau

SEQ ID NO: 377472 - RNA, 32 nt, Human
ccgucacccugccuccccugcgucccgccacc

SEQ ID NO: 377473 - RNA, 32 nt, Human
ccgucaccuccaccucucuccaugacccggcu

SEQ ID NO: 377474 - RNA, 20 nt, Human
ccgucaccucucccuccuca

SEQ ID NO: 377475 - RNA, 32 nt, Human
ccgucacuacagccucaccucccaccccuguc

SEQ ID NO: 377476 - RNA, 19 nt, Human
ccgucacucagcccugggc

SEQ ID NO: 377477 - RNA, 32 nt, Human
ccgucacuccuaggaaacuuuucgcgcagaaa

SEQ ID NO: 377478 - RNA, 32 nt, Human
ccgucacuuaaauuuguucuuuguuuagccug

SEQ ID NO: 377479 - RNA, 32 nt, Human
ccgucacuuauugauguguccaaaggauugug

SEQ ID NO: 377480 - RNA, 18 nt, Human
ccgucacuucucgagcca

SEQ ID NO: 377481 - RNA, 32 nt, Human
ccgucagccggccuuuuccuucagguucguca

SEQ ID NO: 377482 - RNA, 19 nt, Human
ccgucagccgugccgagcc

SEQ ID NO: 377483 - RNA, 22 nt, Human
ccgucagcgcugcccugaguca

SEQ ID NO: 377484 - RNA, 32 nt, Human
ccgucagcuauguaauguuugccaucacccgc

SEQ ID NO: 377485 - RNA, 31 nt, Human
ccgucagcugucccagagccugugucgcgcc

SEQ ID NO: 377486 - RNA, 32 nt, Human
ccgucaggagagaagccgcgucugugggacga

SEQ ID NO: 377487 - RNA, 32 nt, Human
ccgucaggagauccugaagcuggagaauucgg

SEQ ID NO: 377488 - RNA, 32 nt, Human
ccgucaggcaccgugugaaaguuuggaggagg

SEQ ID NO: 377489 - RNA, 23 nt, Human
ccgucaggcugggcuuugggcca

SEQ ID NO: 377490 - RNA, 32 nt, Human
ccgucagguucacaguuuguuuuucuagaaga

SEQ ID NO: 377491 - RNA, 32 nt, Human
ccgucaguauucacuggaccucaggcccugug

SEQ ID NO: 377492 - RNA, 32 nt, Human
ccgucagugucuuuuucucuccucucucucuu

SEQ ID NO: 377493 - RNA, 32 nt, Human
ccgucaguguguggauguauguuuacaguucu

SEQ ID NO: 377494 - RNA, 32 nt, Human
ccgucauccaagcuggagugcaguggugcaau

SEQ ID NO: 377495 - RNA, 30 nt, Human
ccgucaugccggggauaguggagcugccca

SEQ ID NO: 377496 - RNA, 32 nt, Human
ccgucauggaaaugaugagucagaagauucag

SEQ ID NO: 377497 - RNA, 32 nt, Human
ccgucaugugcuugcucuuacagugccugggc

SEQ ID NO: 377498 - RNA, 32 nt, Human
ccgucauugcagaagaaaguuuacacgacguc

SEQ ID NO: 377499 - RNA, 32 nt, Human
ccgucauugccaccccugacaccaucuaaucc

SEQ ID NO: 377500 - RNA, 32 nt, Human
ccgucauugcugcugcuaccagcgccaaaugu

SEQ ID NO: 377501 - RNA, 32 nt, Human
ccguccaacaggcuggaguacaauggcgagau

SEQ ID NO: 377502 - RNA, 32 nt, Human
ccguccaaggcuuaccuguagaugcuguccuu

SEQ ID NO: 377503 - RNA, 21 nt, Human
ccguccacacucucccgguca

SEQ ID NO: 377504 - RNA, 32 nt, Human
ccguccaccacagcagccccagguggagggcu

SEQ ID NO: 377505 - RNA, 32 nt, Human
ccguccacccugugcugcuucccuucacagca

SEQ ID NO: 377506 - RNA, 31 nt, Human
ccguccagcaaagccagcacagcagagauga

SEQ ID NO: 377507 - RNA, 18 nt, Human
ccguccagccccugacca

SEQ ID NO: 377508 - RNA, 32 nt, Human
ccguccagccucaggacacacagggaacggcu

SEQ ID NO: 377509 - RNA, 32 nt, Human
ccguccaggcuagagugcaguagugcgaucuu

SEQ ID NO: 377510 - RNA, 32 nt, Human
ccguccaggcuggagugcaauggcgugaucuc

SEQ ID NO: 377511 - RNA, 32 nt, Human
ccguccagggagcagguagcugcugggcuccg

SEQ ID NO: 377512 - RNA, 32 nt, Human
ccguccaggggcuccaagaccaacaggagcau

SEQ ID NO: 377513 - RNA, 21 nt, Human
ccguccaguggaagggggcag

SEQ ID NO: 377514 - RNA, 32 nt, Human
ccguccaguggggaguggagggcagaggcccu

SEQ ID NO: 377515 - RNA, 21 nt, Human
ccguccaucgccccucgggcc

SEQ ID NO: 377516 - RNA, 32 nt, Human
ccguccaucuccauaggcuucucagcuuguaa

SEQ ID NO: 377517 - RNA, 32 nt, Human
ccguccaugcgucuguccgccugcugccgguc

SEQ ID NO: 377518 - RNA, 32 nt, Human
ccgucccaaacagagggccacacagauacccc

SEQ ID NO: 377519 - RNA, 32 nt, Human
ccgucccacuccacuccaggcugccggcaccu

SEQ ID NO: 377520 - RNA, 32 nt, Human
ccgucccacugaggaccucaguuugggagugc

SEQ ID NO: 377521 - RNA, 32 nt, Human
ccgucccagcuccaaaggcccugcucuuccuc

SEQ ID NO: 377522 - RNA, 32 nt, Human
ccgucccaggguggugugaggauuacccagug

SEQ ID NO: 377523 - RNA, 32 nt, Human
ccguccccaauccagugggcuggccaggccac

SEQ ID NO: 377524 - RNA, 32 nt, Human
ccguccccauuccuccuccucucugagggacu

SEQ ID NO: 377525 - RNA, 32 nt, Human
ccgucccccaggcuggagugccguggcgugau

SEQ ID NO: 377526 - RNA, 32 nt, Human
ccgucccccugccccguucacaaugcagccug

SEQ ID NO: 377527 - RNA, 32 nt, Human
ccgucccccugccgcauucacaaugcagccug

SEQ ID NO: 377528 - RNA, 32 nt, Human
ccgucccccugccucugccuggcggucccucc

SEQ ID NO: 377529 - RNA, 18 nt, Human
ccguccccgccucgggcc

SEQ ID NO: 377530 - RNA, 32 nt, Human
ccguccccucaagagcccccagaacgagaccc

SEQ ID NO: 377531 - RNA, 32 nt, Human
ccguccccugcagccugggucuggaugggagg

SEQ ID NO: 377532 - RNA, 32 nt, Human
ccguccccugcagggccuuuuccugccacuca

SEQ ID NO: 377533 - RNA, 32 nt, Human
ccguccccugcagggcucaguuugcacugcug

SEQ ID NO: 377534 - RNA, 32 nt, Human
ccguccccuggccaggaugguggagucugccc

SEQ ID NO: 377535 - RNA, 32 nt, Human
ccguccccugucucccugggagugcgcagccu

SEQ ID NO: 377536 - RNA, 32 nt, Human
ccguccccuucccaggccucaaccccuuucuc

SEQ ID NO: 377537 - RNA, 32 nt, Human
ccgucccgaggcaccgccgguaagcagggagc

SEQ ID NO: 377538 - RNA, 21 nt, Human
ccgucccgggaaccacuggca

SEQ ID NO: 377539 - RNA, 32 nt, Human
ccgucccggucaaccaaagccugcugagcccc

SEQ ID NO: 377540 - RNA, 32 nt, Human
ccgucccgucccguccccaucggaaccccaag

SEQ ID NO: 377541 - RNA, 32 nt, Human
ccgucccuacuaaaaauacaaaauuagccagg

SEQ ID NO: 377542 - RNA, 19 nt, Human
ccgucccucaccucgaguu

SEQ ID NO: 377543 - RNA, 24 nt, Human
ccgucccucccagccacccucccu

SEQ ID NO: 377544 - RNA, 20 nt, Human
ccgucccucccgaccucucc

SEQ ID NO: 377545 - RNA, 22 nt, Human
ccgucccuccuccccucucucc

SEQ ID NO: 377546 - RNA, 23 nt, Human
ccgucccuccuccuuugcugccu

SEQ ID NO: 377547 - RNA, 24 nt, Human
ccgucccuccucuuccuccccucc

SEQ ID NO: 377548 - RNA, 21 nt, Human
ccgucccuccuuuugccuucc

SEQ ID NO: 377549 - RNA, 20 nt, Human
ccgucccucgcgccucgggc

SEQ ID NO: 377550 - RNA, 21 nt, Human
ccgucccugcucauccucucc

SEQ ID NO: 377551 - RNA, 20 nt, Human
ccgucccuggccauugggac

SEQ ID NO: 377552 - RNA, 32 nt, Human
ccgucccuggugcugacugcugaggagggagc

SEQ ID NO: 377553 - RNA, 32 nt, Human
ccgucccuguagcugcucuguuuagacagcgg

SEQ ID NO: 377554 - RNA, 18 nt, Human
ccgucccugucccuccuc

SEQ ID NO: 377555 - RNA, 32 nt, Human
ccgucccuuccuggucaggcuguucagcuggg

SEQ ID NO: 377556 - RNA, 32 nt, Human
ccgucccuucgcgcccccuccccguccgcccc

SEQ ID NO: 377557 - RNA, 32 nt, Human
ccguccgagaagccgcggaucucaggugccca

SEQ ID NO: 377558 - RNA, 32 nt, Human
ccguccgagaggcagagcugacaaggaagguu

SEQ ID NO: 377559 - RNA, 20 nt, Human
ccguccgccgcucugaguca

SEQ ID NO: 377560 - RNA, 32 nt, Human
ccguccgccgcucugagucaugugcgaguggg

SEQ ID NO: 377561 - RNA, 20 nt, Human
ccguccgcggcgccgcgcuc

SEQ ID NO: 377562 - RNA, 19 nt, Human
ccguccgcgugcuggguca

SEQ ID NO: 377563 - RNA, 32 nt, Human
ccguccggccgcuaccccuccugcucggccgc

SEQ ID NO: 377564 - RNA, 32 nt, Human
ccguccgggcccguccugccuggccgcaggug

SEQ ID NO: 377565 - RNA, 32 nt, Human
ccguccguccuccacucuccagccucucccca

SEQ ID NO: 377566 - RNA, 21 nt, Human
ccguccgugccggcucgggcc

SEQ ID NO: 377567 - RNA, 23 nt, Human
ccguccgugccgucccugggcca

SEQ ID NO: 377568 - RNA, 19 nt, Human
ccguccgugucccccauga

SEQ ID NO: 377569 - RNA, 18 nt, Human
ccguccuaaccucgggcc

SEQ ID NO: 377570 - RNA, 32 nt, Human
ccguccuccccugguccgguguuuguguuccc

SEQ ID NO: 377571 - RNA, 32 nt, Human
ccguccucccuccuagggucuuguguugcaag

SEQ ID NO: 377572 - RNA, 22 nt, Human
ccguccucccugcucugagaca

SEQ ID NO: 377573 - RNA, 23 nt, Human
ccguccuccguccucccgggcca

SEQ ID NO: 377574 - RNA, 32 nt, Human
ccguccuccugccucuguugccaacacgagau

SEQ ID NO: 377575 - RNA, 32 nt, Human
ccguccucgcccggccaggccaugaagguaga

SEQ ID NO: 377576 - RNA, 32 nt, Human
ccguccucuccuccucuucaugcauguuucug

SEQ ID NO: 377577 - RNA, 32 nt, Human
ccguccucucucucccccuccuccucccccgc

SEQ ID NO: 377578 - RNA, 32 nt, Human
ccguccugcccagagcaagaugugucaccagc

SEQ ID NO: 377579 - RNA, 32 nt, Human
ccguccugcuucucuguuuccacacguacaca

SEQ ID NO: 377580 - RNA, 32 nt, Human
ccguccuggcuaacacggugaaaccucgucuc

SEQ ID NO: 377581 - RNA, 32 nt, Human
ccguccugggccggugcccagguccgagucgc

SEQ ID NO: 377582 - RNA, 32 nt, Human
ccguccuggggaugcucagggugcaggcagag

SEQ ID NO: 377583 - RNA, 32 nt, Human
ccguccuucaacaaggaaauucuauuaaagga

SEQ ID NO: 377584 - RNA, 22 nt, Human
ccguccuuccgcagcccaaccg

SEQ ID NO: 377585 - RNA, 32 nt, Human
ccguccuugccucccuuacccacccucaccgg

SEQ ID NO: 377586 - RNA, 32 nt, Human
ccguccuuggcuuucuggguccugggcugccc

SEQ ID NO: 377587 - RNA, 32 nt, Human
ccguccuuuguugguuuccugagacugauaau

SEQ ID NO: 377588 - RNA, 21 nt, Human
ccgucgacggcacccugggcc

SEQ ID NO: 377589 - RNA, 32 nt, Human
ccgucgagagcaucaaaugcuacuguucagca

SEQ ID NO: 377590 - RNA, 21 nt, Human
ccgucgagcccagccccgccg

SEQ ID NO: 377591 - RNA, 20 nt, Human
ccgucgagccccaucgggcc

SEQ ID NO: 377592 - RNA, 32 nt, Human
ccgucgcacaggcuggagugcaguggcaaagu

SEQ ID NO: 377593 - RNA, 32 nt, Human
ccgucgcagcagcagcggcagccccggcagcc

SEQ ID NO: 377594 - RNA, 22 nt, Human
ccgucgcagcagcgccccgagc

SEQ ID NO: 377595 - RNA, 32 nt, Human
ccgucgcagcuuugacaucuugguguacucau

SEQ ID NO: 377596 - RNA, 32 nt, Human
ccgucgcagguugugagaagaagagaaacugc

SEQ ID NO: 377597 - RNA, 19 nt, Human
ccgucgccacuucgggcca

SEQ ID NO: 377598 - RNA, 18 nt, Human
ccgucgccagccccggcc

SEQ ID NO: 377599 - RNA, 32 nt, Human
ccgucgccaucuguuucccuucccucccccau

SEQ ID NO: 377600 - RNA, 32 nt, Human
ccgucgcccaggcuggcaugcaguugcgcgau

SEQ ID NO: 377601 - RNA, 23 nt, Human
ccgucgcccgccauccugagcca

SEQ ID NO: 377602 - RNA, 23 nt, Human
ccgucgcccggauccccugagcu

SEQ ID NO: 377603 - RNA, 32 nt, Human
ccgucgccgcagccuccgccgccgagaagccc

SEQ ID NO: 377604 - RNA, 32 nt, Human
ccgucgccgccaucugucaccuccacuccggc

SEQ ID NO: 377605 - RNA, 18 nt, Human
ccgucgccgccgccgccg

SEQ ID NO: 377606 - RNA, 32 nt, Human
ccgucgccgccgcggagcagaucaauaggcga

SEQ ID NO: 377607 - RNA, 23 nt, Human
ccgucgccuccuccgcccgggcc

SEQ ID NO: 377608 - RNA, 20 nt, Human
ccgucgcgagcgaccgggcc

SEQ ID NO: 377609 - RNA, 16 nt, Human
ccgucgcucacgggcu

SEQ ID NO: 377610 - RNA, 20 nt, Human
ccgucgcucgccugggugcc

SEQ ID NO: 377611 - RNA, 17 nt, Human
ccgucgcucgcgcagcc

SEQ ID NO: 377612 - RNA, 19 nt, Human
ccgucgcugccgccgccac

SEQ ID NO: 377613 - RNA, 20 nt, Human
ccgucgcugccugcuggguc

SEQ ID NO: 377614 - RNA, 20 nt, Human
ccgucgcugcgcugcagcca

SEQ ID NO: 377615 - RNA, 18 nt, Human
ccgucgcuguccagggcc

SEQ ID NO: 377616 - RNA, 18 nt, Human
ccgucgcuugccucccgc

SEQ ID NO: 377617 - RNA, 24 nt, Human
ccgucggcagcugggggaaggguc

SEQ ID NO: 377618 - RNA, 21 nt, Human
ccgucggccgggucccagcga

SEQ ID NO: 377619 - RNA, 32 nt, Human
ccgucgggaguucugcauggcaguucacugca

SEQ ID NO: 377620 - RNA, 17 nt, Human
ccgucgggcgccgggcc

SEQ ID NO: 377621 - RNA, 32 nt, Human
ccgucggugcugcugcuccugcagcugccuuu

SEQ ID NO: 377622 - RNA, 20 nt, Human
ccgucgguugcucucgggcc

SEQ ID NO: 377623 - RNA, 32 nt, Human
ccgucguagggaggcuugcggagcaggagcgc

SEQ ID NO: 377624 - RNA, 32 nt, Human
ccgucguaucccucgguccggcggcggcggcg

SEQ ID NO: 377625 - RNA, 32 nt, Human
ccgucgucacacuauguuaccccacauacaga

SEQ ID NO: 377626 - RNA, 32 nt, Human
ccgucgucuccucugccgccgugccgcagccg

SEQ ID NO: 377627 - RNA, 18 nt, Human
ccgucgucugcccgggcc

SEQ ID NO: 377628 - RNA, 32 nt, Human
ccgucgugaggggucagagauggcgcugaccc

SEQ ID NO: 377629 - RNA, 32 nt, Human
ccgucgugcuccauccuucccugccggggccu

SEQ ID NO: 377630 - RNA, 19 nt, Human
ccgucguucccucccggcu

SEQ ID NO: 377631 - RNA, 22 nt, Human
ccgucguucugcgaagcggcca

SEQ ID NO: 377632 - RNA, 19 nt, Human
ccgucguuugcccucucca

SEQ ID NO: 377633 - RNA, 32 nt, Human
ccgucguuuucucuccccgcguggcuccuuga

SEQ ID NO: 377634 - RNA, 20 nt, Human
ccgucuaaccacagcuccuu

SEQ ID NO: 377635 - RNA, 32 nt, Human
ccgucuacaacaucuuuaggccauaaacaaca

SEQ ID NO: 377636 - RNA, 32 nt, Human
ccgucuaccgggaaagguggccagcagaugug

SEQ ID NO: 377637 - RNA, 32 nt, Human
ccgucucaaccucccucccguccagcauugag

SEQ ID NO: 377638 - RNA, 32 nt, Human
ccgucucaccuccaaagguaucuucacucccg

SEQ ID NO: 377639 - RNA, 32 nt, Human
ccgucucagcugguaucagccccagccugccu

SEQ ID NO: 377640 - RNA, 32 nt, Human
ccgucucaggagacccugguauuucuagagca

SEQ ID NO: 377641 - RNA, 32 nt, Human
ccgucucaucuucucucaucugaucacuucau

SEQ ID NO: 377642 - RNA, 32 nt, Human
ccgucuccacuaaaaauacaaaauuagccggg

SEQ ID NO: 377643 - RNA, 32 nt, Human
ccgucuccacuaaaaauacaaaauuagcuggg

SEQ ID NO: 377644 - RNA, 32 nt, Human
ccgucuccacuaaaauacaaaauuagcugggu

SEQ ID NO: 377645 - RNA, 32 nt, Human
ccgucuccaucccccacccacccaaggaaugg

SEQ ID NO: 377646 - RNA, 32 nt, Human
ccgucucccagccucagacggcucugcgggcu

SEQ ID NO: 377647 - RNA, 22 nt, Human
ccgucucccgcugcuuugguca

SEQ ID NO: 377648 - RNA, 18 nt, Human
ccgucuccgagcugcucc

SEQ ID NO: 377649 - RNA, 32 nt, Human
ccgucuccgugccagcguucacgcucccuccc

SEQ ID NO: 377650 - RNA, 32 nt, Human
ccgucuccuaaaaggccagcaggucccaggag

SEQ ID NO: 377651 - RNA, 32 nt, Human
ccgucuccucccucagcucucugggaccuccu

SEQ ID NO: 377652 - RNA, 32 nt, Human
ccgucuccuucccaagcucccggcuuuuucua

SEQ ID NO: 377653 - RNA, 18 nt, Human
ccgucucgccuggggcca

SEQ ID NO: 377654 - RNA, 32 nt, Human
ccgucucgcucccagccauuugcugggaugac

SEQ ID NO: 377655 - RNA, 32 nt, Human
ccgucucuacaaaaauaagaaaauuagccagg

SEQ ID NO: 377656 - RNA, 32 nt, Human
ccgucucuacaaaaauacaaaaaucagccagg

SEQ ID NO: 377657 - RNA, 32 nt, Human
ccgucucuacaaaaauacaaaaauuagccagg

SEQ ID NO: 377658 - RNA, 32 nt, Human
ccgucucuacaaaaauagaaaaauuagccgag

SEQ ID NO: 377659 - RNA, 32 nt, Human
ccgucucuacaaaaauauggaaauuagcuggg

SEQ ID NO: 377660 - RNA, 32 nt, Human
ccgucucuacaaaaguacaaaaauuagccagg

SEQ ID NO: 377661 - RNA, 32 nt, Human
ccgucucuaccaauauacaaaaauuagccggg

SEQ ID NO: 377662 - RNA, 32 nt, Human
ccgucucuacuaaaaauacaaaauuaacuggg

SEQ ID NO: 377663 - RNA, 32 nt, Human
ccgucucuacuaaaaauacaaaauuagccaga

SEQ ID NO: 377664 - RNA, 32 nt, Human
ccgucucuacuaaaaauacaaaauuagccagg

SEQ ID NO: 377665 - RNA, 32 nt, Human
ccgucucuacuaaaaauacaaaauuagccgag

SEQ ID NO: 377666 - RNA, 32 nt, Human
ccgucucuacuaaaaauacaaaauuagccgga

SEQ ID NO: 377667 - RNA, 32 nt, Human
ccgucucuacuaaaaauacaaaauuagccggg

SEQ ID NO: 377668 - RNA, 32 nt, Human
ccgucucuacuaaaaauacaaaauuagccggu

SEQ ID NO: 377669 - RNA, 32 nt, Human
ccgucucuacuaaaaauacaaaauuagcuggg

SEQ ID NO: 377670 - RNA, 32 nt, Human
ccgucucuacuaaaaauacaaaauuagucggg

SEQ ID NO: 377671 - RNA, 32 nt, Human
ccgucucuacuaaaaauacaaaauuauccggu

SEQ ID NO: 377672 - RNA, 32 nt, Human
ccgucucuacuaaaauacaaaaauuagccaga

SEQ ID NO: 377673 - RNA, 32 nt, Human
ccgucucuacuaaaauacaaaaauuagcuggg

SEQ ID NO: 377674 - RNA, 32 nt, Human
ccgucucuacuaaaauacaaaaauuaggugug

SEQ ID NO: 377675 - RNA, 32 nt, Human
ccgucucuacuaaaauacaaaaauuuagccgg

SEQ ID NO: 377676 - RNA, 32 nt, Human
ccgucucuacuaaaauacauaaauuagccggg

SEQ ID NO: 377677 - RNA, 32 nt, Human
ccgucucuacuaaaauauaaaaauuagccaga

SEQ ID NO: 377678 - RNA, 32 nt, Human
ccgucucuacuaaauauacaaaauuagccggg

SEQ ID NO: 377679 - RNA, 32 nt, Human
ccgucucuacuaacauacaaaauuagcugggc

SEQ ID NO: 377680 - RNA, 32 nt, Human
ccgucucuacugaaaauacaaaauuagccggg

SEQ ID NO: 377681 - RNA, 32 nt, Human
ccgucucuagcacaauauauuucugaauauug

SEQ ID NO: 377682 - RNA, 32 nt, Human
ccgucucuauuaaaaauacaaaauuagccggg

SEQ ID NO: 377683 - RNA, 32 nt, Human
ccgucucuccaccgggggcuucauccuuccag

SEQ ID NO: 377684 - RNA, 32 nt, Human
ccgucucuccaucaguuccuagaacucaagca

SEQ ID NO: 377685 - RNA, 32 nt, Human
ccgucucuccggagcccuccugccucauugcu

SEQ ID NO: 377686 - RNA, 32 nt, Human
ccgucucuccuccccucucucucuucucuguc

SEQ ID NO: 377687 - RNA, 32 nt, Human
ccgucucucuguggagaagcagcuccaccucu

SEQ ID NO: 377688 - RNA, 31 nt, Human
ccgucucugauucucccuuuaugaagcugca

SEQ ID NO: 377689 - RNA, 19 nt, Human
ccgucucugccccggggcg

SEQ ID NO: 377690 - RNA, 18 nt, Human
ccgucucugcccugggcu

SEQ ID NO: 377691 - RNA, 32 nt, Human
ccgucucugcuaaaaauacaaaauuagcuggg

SEQ ID NO: 377692 - RNA, 32 nt, Human
ccgucucugucccgguucaccuugccgagaga

SEQ ID NO: 377693 - RNA, 32 nt, Human
ccgucugagaagugaggagacccuccgccugg

SEQ ID NO: 377694 - RNA, 32 nt, Human
ccgucugagaagugaggagacccucugccugg

SEQ ID NO: 377695 - RNA, 32 nt, Human
ccgucugcaagccgaggagggggccucaggag

SEQ ID NO: 377696 - RNA, 32 nt, Human
ccgucugcccuccaaggacccgcauggaggca

SEQ ID NO: 377697 - RNA, 32 nt, Human
ccgucugccuaaaucacuuuucucgcagaagc

SEQ ID NO: 377698 - RNA, 24 nt, Human
ccgucugcgggcgcuuccgggcca

SEQ ID NO: 377699 - RNA, 32 nt, Human
ccgucugcugcuggacaguaaguccuggcccc

SEQ ID NO: 377700 - RNA, 32 nt, Human
ccgucuggaaccaccugggccccugagggcac

SEQ ID NO: 377701 - RNA, 30 nt, Human
ccgucuggcaaggccggggcacaauuugca

SEQ ID NO: 377702 - RNA, 32 nt, Human
ccgucuggcacgcagcguggucucagguucua

SEQ ID NO: 377703 - RNA, 32 nt, Human
ccgucuggccuaaaggugauguauuugguguu

SEQ ID NO: 377704 - RNA, 21 nt, Human
ccgucuggcugaccugggcca

SEQ ID NO: 377705 - RNA, 32 nt, Human
ccgucuggggcucaggcuggugugggaugcag

SEQ ID NO: 377706 - RNA, 32 nt, Human
ccgucugggguuuuacggugugcacugggugc

SEQ ID NO: 377707 - RNA, 32 nt, Human
ccgucugggugaugcucaugguaaacucgcuc

SEQ ID NO: 377708 - RNA, 32 nt, Human
ccgucuggucacugaaagaacugcugccucgg

SEQ ID NO: 377709 - RNA, 32 nt, Human
ccgucugguguccugauuccagcaguuuucca

SEQ ID NO: 377710 - RNA, 32 nt, Human
ccgucuguccuuuguccacaaggaauuucccu

SEQ ID NO: 377711 - RNA, 32 nt, Human
ccgucugugauugccauuucuucccaaggcca

SEQ ID NO: 377712 - RNA, 32 nt, Human
ccgucuguggcuuucagccucugggucugagu

SEQ ID NO: 377713 - RNA, 19 nt, Human
ccgucugugucccccauga

SEQ ID NO: 377714 - RNA, 32 nt, Human
ccgucugugugugaccccuccuggggccaggc

SEQ ID NO: 377715 - RNA, 20 nt, Human
ccgucuguuucucugggcca

SEQ ID NO: 377716 - RNA, 32 nt, Human
ccgucuuaguaaaaauacaaaauuggccuggc

SEQ ID NO: 377717 - RNA, 32 nt, Human
ccgucuucauagaagacaagugagugaucccc

SEQ ID NO: 377718 - RNA, 32 nt, Human
ccgucuucauuucuucccaucucuucuugcug

SEQ ID NO: 377719 - RNA, 32 nt, Human
ccgucuucccuuccuuaacucucccccuuugc

SEQ ID NO: 377720 - RNA, 32 nt, Human
ccgucuuccuguuggaggcaugugccccugga

SEQ ID NO: 377721 - RNA, 20 nt, Human
ccgucuucuccuccuuguca

SEQ ID NO: 377722 - RNA, 32 nt, Human
ccgucuucuccuccuugucacccgcggucgcu

SEQ ID NO: 377723 - RNA, 21 nt, Human
ccgucuucuuccccccgagcu

SEQ ID NO: 377724 - RNA, 32 nt, Human
ccgucuugcuugcucgccgccugcugacuucc

SEQ ID NO: 377725 - RNA, 32 nt, Human
ccgucuuggaggagaggcugcagccacagcac

SEQ ID NO: 377726 - RNA, 32 nt, Human
ccgucuuggggccucgccacacaugcccuuug

SEQ ID NO: 377727 - RNA, 32 nt, Human
ccgucuuguacaccccuaacuccugaggcucc

SEQ ID NO: 377728 - RNA, 32 nt, Human
ccgucuuuacuaaaaauacaaaauuagccagg

SEQ ID NO: 377729 - RNA, 32 nt, Human
ccgucuuuacuaaaaauacaaaauuagccgga

SEQ ID NO: 377730 - RNA, 32 nt, Human
ccgucuuugugggggcucucaggcuuggcaca

SEQ ID NO: 377731 - RNA, 19 nt, Human
ccgucuuuucccuuagagg

SEQ ID NO: 377732 - RNA, 32 nt, Human
ccgugaaaggccacugcacuccagccugagug

SEQ ID NO: 377733 - RNA, 32 nt, Human
ccgugaaagggugggccagccgggccacgaga

SEQ ID NO: 377734 - RNA, 23 nt, Human
ccgugaacaccugcuuccucccu

SEQ ID NO: 377735 - RNA, 32 nt, Human
ccgugaaccacugcacccagccaaugggugua

SEQ ID NO: 377736 - RNA, 32 nt, Human
ccgugaacccaagaaagaggcggugaagagcu

SEQ ID NO: 377737 - RNA, 32 nt, Human
ccgugaagaaagccaagaagccguggaggccc

SEQ ID NO: 377738 - RNA, 32 nt, Human
ccgugaagaaccugguggacagcagcgucuac

SEQ ID NO: 377739 - RNA, 32 nt, Human
ccgugaagaaggagaauaagacccugcaggag

SEQ ID NO: 377740 - RNA, 32 nt, Human
ccgugaaggugaccucacaguacugguuaauu

SEQ ID NO: 377741 - RNA, 32 nt, Human
ccgugacacagaccucaggagauccugcccaa

SEQ ID NO: 377742 - RNA, 32 nt, Human
ccgugacagaggaggggagggguggugccugg

SEQ ID NO: 377743 - RNA, 32 nt, Human
ccgugacauaaacuguuauuccauugcuuuca

SEQ ID NO: 377744 - RNA, 32 nt, Human
ccgugaccauguccaagucucugaagaaguug

SEQ ID NO: 377745 - RNA, 32 nt, Human
ccgugacccaggcuggaaugcaauggcucacu

SEQ ID NO: 377746 - RNA, 32 nt, Human
ccgugaccgagagcgagagcgagaacgagauc

SEQ ID NO: 377747 - RNA, 32 nt, Human
ccgugacucaacacuuauuauccaccauguaa

SEQ ID NO: 377748 - RNA, 32 nt, Human
ccgugacuguuucugcccuugugccuaguuaa

SEQ ID NO: 377749 - RNA, 32 nt, Human
ccgugacuuugaacucccuacucuccagaauc

SEQ ID NO: 377750 - RNA, 32 nt, Human
ccgugagaagagucgaucucccaggggcuuca

SEQ ID NO: 377751 - RNA, 32 nt, Human
ccgugagaugggugcaaggauucccuaagcag

SEQ ID NO: 377752 - RNA, 32 nt, Human
ccgugagcccgaggcuggaaguggugucugcc

SEQ ID NO: 377753 - RNA, 32 nt, Human
ccgugagcccugccaacagaucuucaguccac

SEQ ID NO: 377754 - RNA, 32 nt, Human
ccgugagcucaagugauccucuugccuuggcc

SEQ ID NO: 377755 - RNA, 22 nt, Human
ccgugagcucugggcccugcca

SEQ ID NO: 377756 - RNA, 32 nt, Human
ccgugagcugagcccaggcugcguagugacca

SEQ ID NO: 377757 - RNA, 23 nt, Human
ccgugaggcagagguugcaguga

SEQ ID NO: 377758 - RNA, 17 nt, Human
ccgugaggcuggaguga

SEQ ID NO: 377759 - RNA, 32 nt, Human
ccgugaggggaggaggccgaggaggacgcggc

SEQ ID NO: 377760 - RNA, 23 nt, Human
ccgugagguggagguuguaguga

SEQ ID NO: 377761 - RNA, 32 nt, Human
ccgugaguacaucucagccccgggggaugcuc

SEQ ID NO: 377762 - RNA, 32 nt, Human
ccgugaucaaaaccaaccugggcaacaugaug

SEQ ID NO: 377763 - RNA, 32 nt, Human
ccgugaucaagaugagcacggaggcucguguc

SEQ ID NO: 377764 - RNA, 32 nt, Human
ccgugaucaagguagcuuagagagauggucag

SEQ ID NO: 377765 - RNA, 32 nt, Human
ccgugauccagcgacggguuuggggcuccggg

SEQ ID NO: 377766 - RNA, 23 nt, Human
ccgugauccaggguugcagugag

SEQ ID NO: 377767 - RNA, 19 nt, Human
ccgugauccauccaucucc

SEQ ID NO: 377768 - RNA, 32 nt, Human
ccgugaucuccgcucacugccaccuccgccuc

SEQ ID NO: 377769 - RNA, 32 nt, Human
ccgugaugcauucugccuuccugucuacuagg

SEQ ID NO: 377770 - RNA, 21 nt, Human
ccgugaugcucaguguucaaa

SEQ ID NO: 377771 - RNA, 32 nt, Human
ccgugauggcagcaggcggugggaugcuugua

SEQ ID NO: 377772 - RNA, 32 nt, Human
ccgugauguugucuauggcccccagccccagc

SEQ ID NO: 377773 - RNA, 32 nt, Human
ccgugauucccuggugaucucucagcaggcca

SEQ ID NO: 377774 - RNA, 32 nt, Human
ccgugauuucaccaccacuccagccuggguga

SEQ ID NO: 377775 - RNA, 32 nt, Human
ccgugcacauuuccucuuuucucaucuccauu

SEQ ID NO: 377776 - RNA, 32 nt, Human
ccgugcaccacugugugccuggcccugugcug

SEQ ID NO: 377777 - RNA, 32 nt, Human
ccgugcacgguggcucacgccuguaaucccag

SEQ ID NO: 377778 - RNA, 32 nt, Human
ccgugcacucccuaagaaaccccagggcaggg

SEQ ID NO: 377779 - RNA, 32 nt, Human
ccgugcagaaaagaugcugguucuggcuggac

SEQ ID NO: 377780 - RNA, 32 nt, Human
ccgugcagagcagaggacagugagugucugca

SEQ ID NO: 377781 - RNA, 32 nt, Human
ccgugcagaggaaacagaaacucccaacuguc

SEQ ID NO: 377782 - RNA, 32 nt, Human
ccgugcagccacacccugcccugccccgcccc

SEQ ID NO: 377783 - RNA, 17 nt, Human
ccgugcagccucgagcu

SEQ ID NO: 377784 - RNA, 32 nt, Human
ccgugcagcugguuccucucgagcgagugucc

SEQ ID NO: 377785 - RNA, 32 nt, Human
ccgugcaggcucugaagggagcucccagucac

SEQ ID NO: 377786 - RNA, 32 nt, Human
ccgugcaucugaauuucaggggucaugcugau

SEQ ID NO: 377787 - RNA, 32 nt, Human
ccgugcaucugucugucauggagggccaugug

SEQ ID NO: 377788 - RNA, 32 nt, Human
ccgugcaugacagcaugugccuguaauuccag

SEQ ID NO: 377789 - RNA, 32 nt, Human
ccgugcaugguggcaugcgccuguaaucccag

SEQ ID NO: 377790 - RNA, 24 nt, Human
ccgugcaugucucaguuacagcug

SEQ ID NO: 377791 - RNA, 32 nt, Human
ccgugccacugcacuccagccuggcaacagag

SEQ ID NO: 377792 - RNA, 32 nt, Human
ccgugccacugcacuccagccugggcaacaca

SEQ ID NO: 377793 - RNA, 32 nt, Human
ccgugccacuguacuccagccugggcagcaga

SEQ ID NO: 377794 - RNA, 32 nt, Human
ccgugccaggccugccccagacgcgucugcag

SEQ ID NO: 377795 - RNA, 27 nt, Human
ccgugcccaagagaaaggcugaagggg

SEQ ID NO: 377796 - RNA, 28 nt, Human
ccgugcccaagugaguccuuaccgccuc

SEQ ID NO: 377797 - RNA, 20 nt, Human
ccgugcccacugcccucccu

SEQ ID NO: 377798 - RNA, 32 nt, Human
ccgugcccacuucacaucuccccuaccagcag

SEQ ID NO: 377799 - RNA, 32 nt, Human
ccgugcccggaaccgcggcuucucccacgcgg

SEQ ID NO: 377800 - RNA, 32 nt, Human
ccgugcccuccagagcccacagcgggcaggac

SEQ ID NO: 377801 - RNA, 32 nt, Human
ccgugcccuccccgccccacuuucccuucuuc

SEQ ID NO: 377802 - RNA, 32 nt, Human
ccgugccggcgguggaggugugaaggcacgcg

SEQ ID NO: 377803 - RNA, 32 nt, Human
ccgugccuagaccuccccaucuguggaauggg

SEQ ID NO: 377804 - RNA, 32 nt, Human
ccgugccucaaucucuauccugaugucauggg

SEQ ID NO: 377805 - RNA, 32 nt, Human
ccgugccucacuuagaggguucugaacccguu

SEQ ID NO: 377806 - RNA, 32 nt, Human
ccgugccucugcggggagaggcuggagaggaa

SEQ ID NO: 377807 - RNA, 20 nt, Human
ccgugccugagaagagccag

SEQ ID NO: 377808 - RNA, 32 nt, Human
ccgugccugcagcacuacuggugccugaaaca

SEQ ID NO: 377809 - RNA, 19 nt, Human
ccgugccugcccugaggca

SEQ ID NO: 377810 - RNA, 32 nt, Human
ccgugccugccugcccugccuacugagaagac

SEQ ID NO: 377811 - RNA, 32 nt, Human
ccgugccugcgccaucuccaucagagcugcau

SEQ ID NO: 377812 - RNA, 32 nt, Human
ccgugccuguguauacaugccuuuauguaagc

SEQ ID NO: 377813 - RNA, 32 nt, Human
ccgugcgccccugcacccuuccaggcucucgc

SEQ ID NO: 377814 - RNA, 32 nt, Human
ccgugcgcgagccgaagcagggcgaggcauug

SEQ ID NO: 377815 - RNA, 20 nt, Human
ccgugcgcgccccgccgccg

SEQ ID NO: 377816 - RNA, 32 nt, Human
ccgugcgcgguggcucaugccuguaaucccag

SEQ ID NO: 377817 - RNA, 32 nt, Human
ccgugcgcuugcucugagccuugugagcaagg

SEQ ID NO: 377818 - RNA, 32 nt, Human
ccgugcggcgcggggagccagcgagcgcgccu

SEQ ID NO: 377819 - RNA, 32 nt, Human
ccgugcggugggucccagccugaggguggagu

SEQ ID NO: 377820 - RNA, 32 nt, Human
ccgugcuacaucuucacaguuccuccgaauaa

SEQ ID NO: 377821 - RNA, 32 nt, Human
ccgugcuaggcacugaggcggugacaggccca

SEQ ID NO: 377822 - RNA, 22 nt, Human
ccgugcuaucccucaccauuca

SEQ ID NO: 377823 - RNA, 20 nt, Human
ccgugcucccacgugcuucc

SEQ ID NO: 377824 - RNA, 32 nt, Human
ccgugcuccgccgggaagauggggaaagugag

SEQ ID NO: 377825 - RNA, 32 nt, Human
ccgugcucuaccaagauccccacgcggggccc

SEQ ID NO: 377826 - RNA, 20 nt, Human
ccgugcucuagaucauggug

SEQ ID NO: 377827 - RNA, 32 nt, Human
ccgugcucucagggagggugcaccaggccugc

SEQ ID NO: 377828 - RNA, 32 nt, Human
ccgugcugcaugcagaugagauguggcuggaa

SEQ ID NO: 377829 - RNA, 20 nt, Human
ccgugcugcccagaaugccc

SEQ ID NO: 377830 - RNA, 32 nt, Human
ccgugcugcgugucacugaaggcccuuucuuc

SEQ ID NO: 377831 - RNA, 32 nt, Human
ccgugcugcugcucugugccugcugucagagc

SEQ ID NO: 377832 - RNA, 32 nt, Human
ccgugcuggaacccgggccucagccgcagccg

SEQ ID NO: 377833 - RNA, 32 nt, Human
ccgugcuggaaguaggaggagagucaggacuc

SEQ ID NO: 377834 - RNA, 32 nt, Human
ccgugcugggguccuggaagaguuggggcccu

SEQ ID NO: 377835 - RNA, 32 nt, Human
ccgugcuggggucgggacgagguugaaggguc

SEQ ID NO: 377836 - RNA, 32 nt, Human
ccgugcugguggcccagguccugcugcucauu

SEQ ID NO: 377837 - RNA, 32 nt, Human
ccgugcuguguuagccacugcagcugggacca

SEQ ID NO: 377838 - RNA, 32 nt, Human
ccgugcuuguacugcuagaagcacuuuauguu

SEQ ID NO: 377839 - RNA, 32 nt, Human
ccguggaagaacacauggaucucucuggcuuu

SEQ ID NO: 377840 - RNA, 32 nt, Human
ccguggaagaauuucgugccauguggaaacuu

SEQ ID NO: 377841 - RNA, 32 nt, Human
ccguggacaaagugccucaugucccugagccc

SEQ ID NO: 377842 - RNA, 24 nt, Human
ccguggacugccucaggggcgccg

SEQ ID NO: 377843 - RNA, 32 nt, Human
ccguggagaggugaggccggauccucagagcc

SEQ ID NO: 377844 - RNA, 32 nt, Human
ccguggagcgcuaugucugcaagugggcccug

SEQ ID NO: 377845 - RNA, 32 nt, Human
ccguggagcugcugugugacugugucaggccu

SEQ ID NO: 377846 - RNA, 32 nt, Human
ccguggaggagaaccagagucuggaggggagg

SEQ ID NO: 377847 - RNA, 21 nt, Human
ccguggaggagagagaggcaa

SEQ ID NO: 377848 - RNA, 32 nt, Human
ccguggagggcuuagagaggggaagccaucuc

SEQ ID NO: 377849 - RNA, 32 nt, Human
ccguggaucuauagcuguggccaaucagucag

SEQ ID NO: 377850 - RNA, 32 nt, Human
ccguggaugacggaugaggacucugggcugcu

SEQ ID NO: 377851 - RNA, 32 nt, Human
ccguggaugccuguguaccucuugccuuuucu

SEQ ID NO: 377852 - RNA, 23 nt, Human
ccguggaugcuuuccugcagcua

SEQ ID NO: 377853 - RNA, 32 nt, Human
ccguggauuccugacaguauggaaaagcaaac

SEQ ID NO: 377854 - RNA, 32 nt, Human
ccguggcaccacucacccugcaugggggcagc

SEQ ID NO: 377855 - RNA, 32 nt, Human
ccguggcagagcccccaucccuugggggcugu

SEQ ID NO: 377856 - RNA, 21 nt, Human
ccguggcagccgcagcgcaga

SEQ ID NO: 377857 - RNA, 32 nt, Human
ccguggccaagcagagagaguggccuugagga

SEQ ID NO: 377858 - RNA, 32 nt, Human
ccguggccacagcccugcuccagcagcacuug

SEQ ID NO: 377859 - RNA, 32 nt, Human
ccguggccaccugagaccugcuccacgacccu

SEQ ID NO: 377860 - RNA, 21 nt, Human
ccguggccacuggagaccuca

SEQ ID NO: 377861 - RNA, 32 nt, Human
ccguggccagcucuccccagggagccagguuc

SEQ ID NO: 377862 - RNA, 32 nt, Human
ccguggcccacacaugcccuucuccacaggug

SEQ ID NO: 377863 - RNA, 32 nt, Human
ccguggcccagccucugcaacagcucugccuc

SEQ ID NO: 377864 - RNA, 23 nt, Human
ccguggcccccacaccccagggg

SEQ ID NO: 377865 - RNA, 32 nt, Human
ccguggcccuaggcaccugggcugcaggaagu

SEQ ID NO: 377866 - RNA, 32 nt, Human
ccguggccucaaggaagcuuguggcuuuggag

SEQ ID NO: 377867 - RNA, 32 nt, Human
ccguggccuccccucccucuggcuuuagcuuc

SEQ ID NO: 377868 - RNA, 32 nt, Human
ccguggccucucccuguuaggcugccacaggc

SEQ ID NO: 377869 - RNA, 32 nt, Human
ccguggcgcauccucacucccagccugcgggu

SEQ ID NO: 377870 - RNA, 32 nt, Human
ccguggcgcccaggcugugggccgugguggau

SEQ ID NO: 377871 - RNA, 32 nt, Human
ccguggcgcuuucugcaguuugcagguuauca

SEQ ID NO: 377872 - RNA, 32 nt, Human
ccguggcggggaggggguuauggagaacgugg

SEQ ID NO: 377873 - RNA, 32 nt, Human
ccguggcggugcuggcaacacaagcaccagcu

SEQ ID NO: 377874 - RNA, 32 nt, Human
ccguggcgucuccucccaggagccagaucagu

SEQ ID NO: 377875 - RNA, 32 nt, Human
ccguggcuacggucaggcucuggccagggcag

SEQ ID NO: 377876 - RNA, 32 nt, Human
ccguggcucacaccuguaaucugaacacuuug

SEQ ID NO: 377877 - RNA, 32 nt, Human
ccguggcucacaccuguaaucugagcacauug

SEQ ID NO: 377878 - RNA, 32 nt, Human
ccguggcucaugccuguauaaucccagcacuu

SEQ ID NO: 377879 - RNA, 32 nt, Human
ccguggcucggcguuguggugccugagggaca

SEQ ID NO: 377880 - RNA, 32 nt, Human
ccguggcucuaccugcccagcaugacaguaau

SEQ ID NO: 377881 - RNA, 29 nt, Human
ccguggcugcugguguccuacuguggcuu

SEQ ID NO: 377882 - RNA, 32 nt, Human
ccguggcuggaaggggacaggagaagcccuuu

SEQ ID NO: 377883 - RNA, 32 nt, Human
ccguggcugggcaggagccgaggacggcaugu

SEQ ID NO: 377884 - RNA, 32 nt, Human
ccguggcugucucaggcuccaggacagugagg

SEQ ID NO: 377885 - RNA, 32 nt, Human
ccguggcugugaggacccuguggcggaccaga

SEQ ID NO: 377886 - RNA, 32 nt, Human
ccgugggaaagaaaugccuagaaaguguuguc

SEQ ID NO: 377887 - RNA, 32 nt, Human
ccgugggaacuaaaggaagugggaacuuagaa

SEQ ID NO: 377888 - RNA, 32 nt, Human
ccgugggacagcgcgcucagcccagccuagga

SEQ ID NO: 377889 - RNA, 32 nt, Human
ccgugggaugggccucaggccaccaggcaaua

SEQ ID NO: 377890 - RNA, 32 nt, Human
ccgugggccauggggaggacuucacucagcag

SEQ ID NO: 377891 - RNA, 32 nt, Human
ccgugggcccccggaacgaggcaaagaugcug

SEQ ID NO: 377892 - RNA, 32 nt, Human
ccgugggccuggggucgggggagcagcagacc

SEQ ID NO: 377893 - RNA, 32 nt, Human
ccgugggcuccuggggagccacuggggagggg

SEQ ID NO: 377894 - RNA, 32 nt, Human
ccgugggcuggaccaggacuagagaagcuuga

SEQ ID NO: 377895 - RNA, 32 nt, Human
ccgugggcuuaggagagagggaccagcgccca

SEQ ID NO: 377896 - RNA, 32 nt, Human
ccgugggcuucugcucccucgcuugucuucuc

SEQ ID NO: 377897 - RNA, 19 nt, Human
ccguggggaaggggugcag

SEQ ID NO: 377898 - RNA, 32 nt, Human
ccguggggacaggagagaagcugagacucucg

SEQ ID NO: 377899 - RNA, 32 nt, Human
ccguggggagccacccuuaccuggggucaggc

SEQ ID NO: 377900 - RNA, 19 nt, Human
ccguggggaggggacggag

SEQ ID NO: 377901 - RNA, 32 nt, Human
ccguggggagucugguuuuucucuucauccug

SEQ ID NO: 377902 - RNA, 32 nt, Human
ccguggggcagguggagggagcagucuucguu

SEQ ID NO: 377903 - RNA, 32 nt, Human
ccguggggcggccagagcccacggucaccugg

SEQ ID NO: 377904 - RNA, 32 nt, Human
ccguggggcugcccuccuccaugcgccuggga

SEQ ID NO: 377905 - RNA, 32 nt, Human
ccguggggcugugggaaucgcucuuauuuaua

SEQ ID NO: 377906 - RNA, 32 nt, Human
ccgugggggaucagugccugcugugugcugau

SEQ ID NO: 377907 - RNA, 32 nt, Human
ccgugggggccugaagagacagugagugccau

SEQ ID NO: 377908 - RNA, 32 nt, Human
ccgugggggcucaguaccugcccagcuaccuc

SEQ ID NO: 377909 - RNA, 32 nt, Human
ccguggguagggaggacagagaggcggcguuc

SEQ ID NO: 377910 - RNA, 32 nt, Human
ccgugggucaugcagcgaaggggcuggauggu

SEQ ID NO: 377911 - RNA, 32 nt, Human
ccgugggugaaaccggccccagaagggugagg

SEQ ID NO: 377912 - RNA, 32 nt, Human
ccguggguucaagcgauucuccugccucagcc

SEQ ID NO: 377913 - RNA, 32 nt, Human
ccgugguaacuugcaauguggccgccccugcg

SEQ ID NO: 377914 - RNA, 32 nt, Human
ccgugguaauucuccccaccuccccggaugcc

SEQ ID NO: 377915 - RNA, 32 nt, Human
ccguggucacacacacgcacugcccugucagu

SEQ ID NO: 377916 - RNA, 32 nt, Human
ccguggucagguguugggggauggggugugga

SEQ ID NO: 377917 - RNA, 32 nt, Human
ccgugguccaggaguuaagggcuugggucugg

SEQ ID NO: 377918 - RNA, 32 nt, Human
ccgugguccugggccagggccugagaugacag

SEQ ID NO: 377919 - RNA, 32 nt, Human
ccguggucucaaggagucagagcagggcuggc

SEQ ID NO: 377920 - RNA, 32 nt, Human
ccguggucuccuugcacuuucucaguucagag

SEQ ID NO: 377921 - RNA, 32 nt, Human
ccguggucucgugcggaacucuaccucuuccc

SEQ ID NO: 377922 - RNA, 32 nt, Human
ccguggugacccuugccucuggggaaggguua

SEQ ID NO: 377923 - RNA, 32 nt, Human
ccguggugagggcuggaaauccaaacucacca

SEQ ID NO: 377924 - RNA, 32 nt, Human
ccguggugcagagaagaugcuucugaggccgc

SEQ ID NO: 377925 - RNA, 22 nt, Human
ccguggugccccucaccauccu

SEQ ID NO: 377926 - RNA, 32 nt, Human
ccgugguggagguggauacagcagucggagac

SEQ ID NO: 377927 - RNA, 32 nt, Human
ccgugguggagugaagucagucagggaagguu

SEQ ID NO: 377928 - RNA, 32 nt, Human
ccgugguggcaucuacccucccuguuuaaaga

SEQ ID NO: 377929 - RNA, 32 nt, Human
ccguggugggcggaucaccugaggucaggagu

SEQ ID NO: 377930 - RNA, 31 nt, Human
ccgugguuacugaggcccuguugaaaagugc

SEQ ID NO: 377931 - RNA, 32 nt, Human
ccgugguucuuuucacagcccucgacuuugca

SEQ ID NO: 377932 - RNA, 32 nt, Human
ccguguaagggaacagguguggggaagaggug

SEQ ID NO: 377933 - RNA, 32 nt, Human
ccguguacauagugcauuguuucugugggcgg

SEQ ID NO: 377934 - RNA, 18 nt, Human
ccguguacugucgcccca

SEQ ID NO: 377935 - RNA, 23 nt, Human
ccguguagcugggacuacaggcg

SEQ ID NO: 377936 - RNA, 32 nt, Human
ccguguagugccugucaccacuguggauucac

SEQ ID NO: 377937 - RNA, 23 nt, Human
ccgugucaagcugcucugagcca

SEQ ID NO: 377938 - RNA, 32 nt, Human
ccgugucacacgugugcuuuaacacaaaacag

SEQ ID NO: 377939 - RNA, 32 nt, Human
ccgugucacuguuuacaugaccuauuugugug

SEQ ID NO: 377940 - RNA, 32 nt, Human
ccgugucauccaggcuggagugcgguggugga

SEQ ID NO: 377941 - RNA, 32 nt, Human
ccguguccagcgcgaaccacacgucguccacg

SEQ ID NO: 377942 - RNA, 32 nt, Human
ccguguccuaccuccgucuucgccaaggcccc

SEQ ID NO: 377943 - RNA, 32 nt, Human
ccguguccuccaccagccucugcccaccuacc

SEQ ID NO: 377944 - RNA, 32 nt, Human
ccguguccugcuuaggggaaggugauuggagc

SEQ ID NO: 377945 - RNA, 32 nt, Human
ccguguccuugucuccccuccucccccaucug

SEQ ID NO: 377946 - RNA, 20 nt, Human
ccgugucgccgccgccgccg

SEQ ID NO: 377947 - RNA, 32 nt, Human
ccgugucucucgggggcggcucgcggggcagg

SEQ ID NO: 377948 - RNA, 32 nt, Human
ccgugucuggcuucaucuaaguggccuggucc

SEQ ID NO: 377949 - RNA, 32 nt, Human
ccgugucuucacucuccagccugaggugguga

SEQ ID NO: 377950 - RNA, 32 nt, Human
ccgugucuugugaacucccaucaccuucaaga

SEQ ID NO: 377951 - RNA, 32 nt, Human
ccgugugcacacucauacacaugugcacacac

SEQ ID NO: 377952 - RNA, 32 nt, Human
ccgugugcacacugcguauguguacgcgcagc

SEQ ID NO: 377953 - RNA, 32 nt, Human
ccgugugcagccagagaggcagcuugcguuuu

SEQ ID NO: 377954 - RNA, 19 nt, Human
ccgugugcaggacuccgcg

SEQ ID NO: 377955 - RNA, 32 nt, Human
ccgugugccagaugagcuugugaucugggaag

SEQ ID NO: 377956 - RNA, 32 nt, Human
ccguguggacugugccucaggccagggcucac

SEQ ID NO: 377957 - RNA, 32 nt, Human
ccguguggccacugacccaucugcacguccgc

SEQ ID NO: 377958 - RNA, 32 nt, Human
ccgugugggccacugguacuggcaagacugca

SEQ ID NO: 377959 - RNA, 32 nt, Human
ccgugugugcaggugucggcacaggcuagcuc

SEQ ID NO: 377960 - RNA, 32 nt, Human
ccgugugugcaucuccccucuccuaccagggg

SEQ ID NO: 377961 - RNA, 32 nt, Human
ccguguuaccucccuggcccucuggcuggccc

SEQ ID NO: 377962 - RNA, 32 nt, Human
ccguguucaagcaauucuccuaccucagccua

SEQ ID NO: 377963 - RNA, 32 nt, Human
ccguguucaagcaguucuccugccucagccuc

SEQ ID NO: 377964 - RNA, 32 nt, Human
ccguguucacaccauucuccugccucagccuc

SEQ ID NO: 377965 - RNA, 32 nt, Human
ccguguuccaaagcgggauggcugguauccug

SEQ ID NO: 377966 - RNA, 19 nt, Human
ccguguuccccucuugucu

SEQ ID NO: 377967 - RNA, 19 nt, Human
ccguguuccgcuuccugcc

SEQ ID NO: 377968 - RNA, 24 nt, Human
ccguguuccgugucucuggauuca

SEQ ID NO: 377969 - RNA, 32 nt, Human
ccguguuccucuuuucuucuuuccggcugcuc

SEQ ID NO: 377970 - RNA, 32 nt, Human
ccguguucuaaaccugggguccacagacaccc

SEQ ID NO: 377971 - RNA, 20 nt, Human
ccguguucucccugcggcuc

SEQ ID NO: 377972 - RNA, 32 nt, Human
ccguguucuucucagagacuguucuacggauu

SEQ ID NO: 377973 - RNA, 32 nt, Human
ccguguugcucccagccgucugcugcugcugc

SEQ ID NO: 377974 - RNA, 32 nt, Human
ccguguuggccaggcuggucuccaacuccuga

SEQ ID NO: 377975 - RNA, 32 nt, Human
ccguguugggggccagccugagccagcagugg

SEQ ID NO: 377976 - RNA, 32 nt, Human
ccguguugucaguuuccugaggccuccccagc

SEQ ID NO: 377977 - RNA, 32 nt, Human
ccguguuuagccuguggcucugugugccccuu

SEQ ID NO: 377978 - RNA, 32 nt, Human
ccguguuugggcugaagaaaagagcaagggaa

SEQ ID NO: 377979 - RNA, 21 nt, Human
ccguguuuugcuuuguguuca

SEQ ID NO: 377980 - RNA, 32 nt, Human
ccguuaaguguccuuaggaugcagugauuaag

SEQ ID NO: 377981 - RNA, 32 nt, Human
ccguuacaacuucaacaaaaucaaguccuacu

SEQ ID NO: 377982 - RNA, 32 nt, Human
ccguuacaggugcgcccacagcgcggccccgc

SEQ ID NO: 377983 - RNA, 32 nt, Human
ccguuacucuaccccgagacugccuucugccc

SEQ ID NO: 377984 - RNA, 32 nt, Human
ccguuacuuccagcaggccacaccagcuguuu

SEQ ID NO: 377985 - RNA, 32 nt, Human
ccguuagcagagcccuaagcugggccagaauu

SEQ ID NO: 377986 - RNA, 32 nt, Human
ccguuaggugcugaaggcuguggcgcgcggcu

SEQ ID NO: 377987 - RNA, 32 nt, Human
ccguuauucuucacuuucacuugacaucguuc

SEQ ID NO: 377988 - RNA, 32 nt, Human
ccguuauuuuccuccccucuugcucagaugaa

SEQ ID NO: 377989 - RNA, 32 nt, Human
ccguucacagccaaaccacugacauuccucca

SEQ ID NO: 377990 - RNA, 21 nt, Human
ccguucacuauuguagaguaa

SEQ ID NO: 377991 - RNA, 32 nt, Human
ccguucacugcaaucucugccuccuggguuua

SEQ ID NO: 377992 - RNA, 32 nt, Human
ccguucacugcagccuccaccuccccgguuca

SEQ ID NO: 377993 - RNA, 32 nt, Human
ccuccaucugcguugaugcucagaaucgccua

SEQ ID NO: 377994 - RNA, 22 nt, Human
ccuccaucuggggauggagaau

SEQ ID NO: 377995 - RNA, 32 nt, Human
ccuccaucuuacucugcccuauuugaaagucu

SEQ ID NO: 377996 - RNA, 32 nt, Human
ccuccaucuuggcucccagagcucuaggaacu

SEQ ID NO: 377997 - RNA, 22 nt, Human
ccuccaugaaggucuccuggau

SEQ ID NO: 377998 - RNA, 32 nt, Human
ccuccaugacucuacucucccaaagguugcuu

SEQ ID NO: 377999 - RNA, 32 nt, Human
ccuccaugagccuggagaccccaggggaggau

SEQ ID NO: 378000 - RNA, 32 nt, Human
ccuccaugagccuucucuuuagaaaaguggca

SEQ ID NO: 378001 - RNA, 32 nt, Human
ccuccaugcagagauccugaggcuuuuccccc

SEQ ID NO: 378002 - RNA, 32 nt, Human
ccuccaugcaggagggagagaagagugugaug

SEQ ID NO: 378003 - RNA, 32 nt, Human
ccuccaugccagggagggcagccccagggaag

SEQ ID NO: 378004 - RNA, 31 nt, Human
ccuccaugccucucuggucagugugccuuag

SEQ ID NO: 378005 - RNA, 32 nt, Human
ccuccaugccuggcuaauuuuguauuuuuagu

SEQ ID NO: 378006 - RNA, 32 nt, Human
ccuccaugcgcaagacuaaagcagcggaagag

SEQ ID NO: 378007 - RNA, 32 nt, Human
ccuccaugcucugcugucuccuggugaucauu

SEQ ID NO: 378008 - RNA, 32 nt, Human
ccuccaugcugccuccagaauggucuuucuaa

SEQ ID NO: 378009 - RNA, 23 nt, Human
ccuccaugcuugagaacugcaca

SEQ ID NO: 378010 - RNA, 24 nt, Human
ccuccauggccucaguuuccccau

SEQ ID NO: 378011 - RNA, 30 nt, Human
ccuccauggcggccccagccgggaaggcga

SEQ ID NO: 378012 - RNA, 32 nt, Human
ccuccauggugggucacuugaggucaggaguu

SEQ ID NO: 378013 - RNA, 32 nt, Human
ccuccauguccugggccagccugaugaugucc

SEQ ID NO: 378014 - RNA, 32 nt, Human
ccuccaugugguuucggagucgaggaagaccu

SEQ ID NO: 378015 - RNA, 32 nt, Human
ccuccauuccucacgccaucuccauccccauc

SEQ ID NO: 378016 - RNA, 32 nt, Human
ccuccauugucaggcacugcugccuuccugcc

SEQ ID NO: 378017 - RNA, 32 nt, Human
ccuccauuguccauggucaacagggaaggggu

SEQ ID NO: 378018 - RNA, 32 nt, Human
ccuccauuuccccgugccucugaggcugccca

SEQ ID NO: 378019 - RNA, 19 nt, Human
ccuccauuucccuggccug

SEQ ID NO: 378020 - RNA, 22 nt, Human
ccuccauuuccuugaaaacuga

SEQ ID NO: 378021 - RNA, 22 nt, Human
ccuccauuuccuuggaaacuga

SEQ ID NO: 378022 - RNA, 22 nt, Human
ccuccauuuggcagcucacuga

SEQ ID NO: 378023 - RNA, 18 nt, Human
ccuccauuuucagcaaca

SEQ ID NO: 378024 - RNA, 32 nt, Human
ccuccauuuuucccuguaaauucuccaacuga

SEQ ID NO: 378025 - RNA, 32 nt, Human
ccucccaaaaccauuagggcucagaggaaggu

SEQ ID NO: 378026 - RNA, 32 nt, Human
ccucccaaaagcugggauuacaggcgugagcc

SEQ ID NO: 378027 - RNA, 17 nt, Human
ccucccaaacccagcca

SEQ ID NO: 378028 - RNA, 23 nt, Human
ccucccaaacuccauuucuguca

SEQ ID NO: 378029 - RNA, 32 nt, Human
ccucccaaagagcugggauuacaggcaugagc

SEQ ID NO: 378030 - RNA, 32 nt, Human
ccucccaaagagcugggauuacaggugugagc

SEQ ID NO: 378031 - RNA, 21 nt, Human
ccucccaaaggacuggagaca

SEQ ID NO: 378032 - RNA, 32 nt, Human
ccucccaaaguacugggauuacaaacauaagc

SEQ ID NO: 378033 - RNA, 32 nt, Human
ccucccaaaguacugggauuacaggcaugaac

SEQ ID NO: 378034 - RNA, 32 nt, Human
ccucccaaaguacugggauuacaggcaugagc

SEQ ID NO: 378035 - RNA, 32 nt, Human
ccucccaaaguacugggauuacaggccugagc

SEQ ID NO: 378036 - RNA, 32 nt, Human
ccucccaaaguacugggauuacaggcgugaac

SEQ ID NO: 378037 - RNA, 32 nt, Human
ccucccaaaguacugggauuacaggcgugagc

SEQ ID NO: 378038 - RNA, 32 nt, Human
ccucccaaaguacugggauuacaggugagagu

SEQ ID NO: 378039 - RNA, 32 nt, Human
ccucccaaaguacugggauuauaggcaugagc

SEQ ID NO: 378040 - RNA, 32 nt, Human
ccucccaaaguacugggauuauaggcgugagc

SEQ ID NO: 378041 - RNA, 32 nt, Human
ccucccaaaguacugggauuuaggcaugagcc

SEQ ID NO: 378042 - RNA, 32 nt, Human
ccucccaaaguccucggauuacaggcaugagc

SEQ ID NO: 378043 - RNA, 32 nt, Human
ccucccaaaguccuggaauuacaggcaugagu

SEQ ID NO: 378044 - RNA, 32 nt, Human
ccucccaaagugaugggauuacaggcaugagc

SEQ ID NO: 378045 - RNA, 32 nt, Human
ccucccaaagugcagggauuacaggcacaagc

SEQ ID NO: 378046 - RNA, 32 nt, Human
ccucccaaagugcagggauuacaggcaugagc

SEQ ID NO: 378047 - RNA, 32 nt, Human
ccucccaaagugccaggauuacaggcaugagc

SEQ ID NO: 378048 - RNA, 32 nt, Human
ccucccaaagugccgggauuacaggcauaagc

SEQ ID NO: 378049 - RNA, 32 nt, Human
ccucccaaagugccgggauuacaggcaugagc

SEQ ID NO: 378050 - RNA, 32 nt, Human
ccucccaaagugcgggauuacaagcgugaacc

SEQ ID NO: 378051 - RNA, 32 nt, Human
ccucccaaagugcuaagauuacaggcaugggu

SEQ ID NO: 378052 - RNA, 32 nt, Human
ccucccaaagugcuagaauuacaggcauuagc

SEQ ID NO: 378053 - RNA, 32 nt, Human
ccucccaaagugcuagauuacaggcgugggcc

SEQ ID NO: 378054 - RNA, 32 nt, Human
ccucccaaagugcuaggauuacagacaugagc

SEQ ID NO: 378055 - RNA, 32 nt, Human
ccucccaaagugcuaggauuacaggcauaagc

SEQ ID NO: 378056 - RNA, 32 nt, Human
ccucccaaagugcuaggauuacaggcaucagc

SEQ ID NO: 378057 - RNA, 32 nt, Human
ccucccaaagugcuaggauuacaggcaugaac

SEQ ID NO: 378058 - RNA, 32 nt, Human
ccucccaaagugcuaggauuacaggcaugagc

SEQ ID NO: 378059 - RNA, 32 nt, Human
ccucccaaagugcuaggauuacaggcaugggc

SEQ ID NO: 378060 - RNA, 32 nt, Human
ccucccaaagugcuaggauuacagguaugagc

SEQ ID NO: 378061 - RNA, 32 nt, Human
ccucccaaagugcucggauuacagacaugagc

SEQ ID NO: 378062 - RNA, 32 nt, Human
ccucccaaagugcugagauuacagacaugagc

SEQ ID NO: 378063 - RNA, 32 nt, Human
ccucccaaagugcugagauuacaggcauaaac

SEQ ID NO: 378064 - RNA, 32 nt, Human
ccucccaaagugcugagauuacaggcauaagc

SEQ ID NO: 378065 - RNA, 32 nt, Human
ccucccaaagugcugagauuacaggcaugacc

SEQ ID NO: 378066 - RNA, 32 nt, Human
ccucccaaagugcugagauuacaggcaugagc

SEQ ID NO: 378067 - RNA, 32 nt, Human
ccucccaaagugcugcgauuacaggcaugagc

SEQ ID NO: 378068 - RNA, 32 nt, Human
ccucccaaagugcuggaauuacaggcaugagc

SEQ ID NO: 378069 - RNA, 32 nt, Human
ccucccaaagugcuggaauuacaggcgaaccu

SEQ ID NO: 378070 - RNA, 32 nt, Human
ccucccaaagugcuggauuacaggcauaggcc

SEQ ID NO: 378071 - RNA, 32 nt, Human
ccucccaaagugcuggauuacaggcgugagcc

SEQ ID NO: 378072 - RNA, 32 nt, Human
ccucccaaagugcuggauuacaggugugagcc

SEQ ID NO: 378073 - RNA, 32 nt, Human
ccucccaaagugcuggcacuacaggcaugagc

SEQ ID NO: 378074 - RNA, 32 nt, Human
ccucccaaagugcuggcauuacagguaugagc

SEQ ID NO: 378075 - RNA, 32 nt, Human
ccucccaaagugcugggacuacaggcaggagc

SEQ ID NO: 378076 - RNA, 32 nt, Human
ccucccaaagugcugggacuacaggcaugagc

SEQ ID NO: 378077 - RNA, 32 nt, Human
ccucccaaagugcugggaucacaggcaugaac

SEQ ID NO: 378078 - RNA, 32 nt, Human
ccucccaaagugcugggaucacaggcaugagc

SEQ ID NO: 378079 - RNA, 32 nt, Human
ccucccaaagugcugggaugacaggcaugaau

SEQ ID NO: 378080 - RNA, 32 nt, Human
ccucccaaagugcugggauuaacagguaugaa

SEQ ID NO: 378081 - RNA, 32 nt, Human
ccucccaaagugcugggauuacaagcaugagc

SEQ ID NO: 378082 - RNA, 32 nt, Human
ccucccaaagugcugggauuacaaguaugagc

SEQ ID NO: 378083 - RNA, 32 nt, Human
ccucccaaagugcugggauuacagacacgagc

SEQ ID NO: 378084 - RNA, 32 nt, Human
ccucccaaagugcugggauuacagacaugaac

SEQ ID NO: 378085 - RNA, 32 nt, Human
ccucccaaagugcugggauuacagacaugagc

SEQ ID NO: 378086 - RNA, 32 nt, Human
ccucccaaagugcugggauuacagccacugca

SEQ ID NO: 378087 - RNA, 32 nt, Human
ccucccaaagugcugggauuacagcgaagagc

SEQ ID NO: 378088 - RNA, 32 nt, Human
ccucccaaagugcugggauuacaggcaacucu

SEQ ID NO: 378089 - RNA, 32 nt, Human
ccucccaaagugcugggauuacaggcaccgag

SEQ ID NO: 378090 - RNA, 32 nt, Human
ccucccaaagugcugggauuacaggcacgagc

SEQ ID NO: 378091 - RNA, 32 nt, Human
ccucccaaagugcugggauuacaggcaggagc

SEQ ID NO: 378092 - RNA, 32 nt, Human
ccucccaaagugcugggauuacaggcauaagc

SEQ ID NO: 378093 - RNA, 32 nt, Human
ccucccaaagugcugggauuacaggcaucagc

SEQ ID NO: 378094 - RNA, 32 nt, Human
ccucccaaagugcugggauuacaggcaugaac

SEQ ID NO: 378095 - RNA, 32 nt, Human
ccucccaaagugcugggauuacaggcaugaau

SEQ ID NO: 378096 - RNA, 32 nt, Human
ccucccaaagugcugggauuacaggcaugacc

SEQ ID NO: 378097 - RNA, 32 nt, Human
ccucccaaagugcugggauuacaggcaugagc

SEQ ID NO: 378098 - RNA, 32 nt, Human
ccucccaaagugcugggauuacaggcaugagu

SEQ ID NO: 378099 - RNA, 32 nt, Human
ccucccaaagugcugggauuacaggcauggag

SEQ ID NO: 378100 - RNA, 32 nt, Human
ccucccaaagugcugggauuacaggccacuac

SEQ ID NO: 378101 - RNA, 32 nt, Human
ccucccaaagugcugggauuacaggccccuug

SEQ ID NO: 378102 - RNA, 32 nt, Human
ccucccaaagugcugggauuacaggccugagc

SEQ ID NO: 378103 - RNA, 32 nt, Human
ccucccaaagugcugggauuacaggccuggcc

SEQ ID NO: 378104 - RNA, 32 nt, Human
ccucccaaagugcugggauuacaggcgcaagc

SEQ ID NO: 378105 - RNA, 32 nt, Human
ccucccaaagugcugggauuacaggcgccacc

SEQ ID NO: 378106 - RNA, 32 nt, Human
ccucccaaagugcugggauuacaggcgcgagc

SEQ ID NO: 378107 - RNA, 32 nt, Human
ccucccaaagugcugggauuacaggcggccag

SEQ ID NO: 378108 - RNA, 32 nt, Human
ccucccaaagugcugggauuacaggcgggagc

SEQ ID NO: 378109 - RNA, 32 nt, Human
ccucccaaagugcugggauuacaggcguaagc

SEQ ID NO: 378110 - RNA, 32 nt, Human
ccucccaaagugcugggauuacaggcgucagc

SEQ ID NO: 378111 - RNA, 32 nt, Human
ccucccaaagugcugggauuacaggcgugaaa

SEQ ID NO: 378112 - RNA, 32 nt, Human
ccucccaaagugcugggauuacaggcgugaac

SEQ ID NO: 378113 - RNA, 32 nt, Human
ccucccaaagugcugggauuacaggcgugacg

SEQ ID NO: 378114 - RNA, 32 nt, Human
ccucccaaagugcugggauuacaggcgugaga

SEQ ID NO: 378115 - RNA, 32 nt, Human
ccucccaaagugcugggauuacaggcgugagc

SEQ ID NO: 378116 - RNA, 32 nt, Human
ccucccaaagugcugggauuacaggcgugagg

SEQ ID NO: 378117 - RNA, 32 nt, Human
ccucccaaagugcugggauuacaggcgugagu

SEQ ID NO: 378118 - RNA, 32 nt, Human
ccucccaaagugcugggauuacaggcgugauc

SEQ ID NO: 378119 - RNA, 32 nt, Human
ccucccaaagugcugggauuacaggcgugaug

SEQ ID NO: 378120 - RNA, 32 nt, Human
ccucccaaagugcugggauuacaggcgugggc

SEQ ID NO: 378121 - RNA, 32 nt, Human
ccucccaaagugcugggauuacaggcgugugc

SEQ ID NO: 378122 - RNA, 32 nt, Human
ccucccaaagugcugggauuacaggcguuagc

SEQ ID NO: 378123 - RNA, 32 nt, Human
ccucccaaagugcugggauuacaggcucaugc

SEQ ID NO: 378124 - RNA, 32 nt, Human
ccucccaaagugcugggauuacaggcuguaaa

SEQ ID NO: 378125 - RNA, 32 nt, Human
ccucccaaagugcugggauuacaggcuuaagc

SEQ ID NO: 378126 - RNA, 32 nt, Human
ccucccaaagugcugggauuacaggcuucagc

SEQ ID NO: 378127 - RNA, 32 nt, Human
ccucccaaagugcugggauuacaggcuugaaa

SEQ ID NO: 378128 - RNA, 32 nt, Human
ccucccaaagugcugggauuacaggcuugagc

SEQ ID NO: 378129 - RNA, 32 nt, Human
ccucccaaagugcugggauuacaggcuugggc

SEQ ID NO: 378130 - RNA, 32 nt, Human
ccucccaaagugcugggauuacagggcacuga

SEQ ID NO: 378131 - RNA, 32 nt, Human
ccucccaaagugcugggauuacagguacgagu

SEQ ID NO: 378132 - RNA, 32 nt, Human
ccucccaaagugcugggauuacagguaucagc

SEQ ID NO: 378133 - RNA, 32 nt, Human
ccucccaaagugcugggauuacagguaugagc

SEQ ID NO: 378134 - RNA, 32 nt, Human
ccucccaaagugcugggauuacaggugcgagc

SEQ ID NO: 378135 - RNA, 32 nt, Human
ccucccaaagugcugggauuacaggugggagc

SEQ ID NO: 378136 - RNA, 32 nt, Human
ccucccaaagugcugggauuacagguguaagc

SEQ ID NO: 378137 - RNA, 32 nt, Human
ccucccaaagugcugggauuacagguguaagu

SEQ ID NO: 378138 - RNA, 32 nt, Human
ccucccaaagugcugggauuacaggugucagc

SEQ ID NO: 378139 - RNA, 32 nt, Human
ccucccaaagugcugggauuacaggugugaac

SEQ ID NO: 378140 - RNA, 32 nt, Human
ccucccaaagugcugggauuacaggugugacc

SEQ ID NO: 378141 - RNA, 32 nt, Human
ccucccaaagugcugggauuacaggugugagc

SEQ ID NO: 378142 - RNA, 32 nt, Human
ccucccaaagugcugggauuacaggugugagg

SEQ ID NO: 378143 - RNA, 32 nt, Human
ccucccaaagugcugggauuacaggugugagu

SEQ ID NO: 378144 - RNA, 32 nt, Human
ccucccaaagugcugggauuacaggugugcgc

SEQ ID NO: 378145 - RNA, 32 nt, Human
ccucccaaagugcugggauuacaggugugcgu

SEQ ID NO: 378146 - RNA, 32 nt, Human
ccucccaaagugcugggauuacagguguggga

SEQ ID NO: 378147 - RNA, 32 nt, Human
ccucccaaagugcugggauuacagguguuccu

SEQ ID NO: 378148 - RNA, 32 nt, Human
ccucccaaagugcugggauuacagguuugagc

SEQ ID NO: 378149 - RNA, 32 nt, Human
ccucccaaagugcugggauuacagucaugagc

SEQ ID NO: 378150 - RNA, 32 nt, Human
ccucccaaagugcugggauuacagucaugagu

SEQ ID NO: 378151 - RNA, 32 nt, Human
ccucccaaagugcugggauuacaguugcgagc

SEQ ID NO: 378152 - RNA, 32 nt, Human
ccucccaaagugcugggauuaccagcauaagc

SEQ ID NO: 378153 - RNA, 32 nt, Human
ccucccaaagugcugggauuaccggcaugagc

SEQ ID NO: 378154 - RNA, 32 nt, Human
ccucccaaagugcugggauuaccgguaugaac

SEQ ID NO: 378155 - RNA, 32 nt, Human
ccucccaaagugcugggauuacgggcaugagc

SEQ ID NO: 378156 - RNA, 32 nt, Human
ccucccaaagugcugggauuacuggcaugagc

SEQ ID NO: 378157 - RNA, 32 nt, Human
ccucccaaagugcugggauuacugguaugaac

SEQ ID NO: 378158 - RNA, 32 nt, Human
ccucccaaagugcugggauuagaggcaugagc

SEQ ID NO: 378159 - RNA, 32 nt, Human
ccucccaaagugcugggauuauacguaugggc

SEQ ID NO: 378160 - RNA, 32 nt, Human
ccucccaaagugcugggauuauaggcacaaga

SEQ ID NO: 378161 - RNA, 32 nt, Human
ccucccaaagugcugggauuauaggcaugaac

SEQ ID NO: 378162 - RNA, 32 nt, Human
ccucccaaagugcugggauuauaggcaugagc

SEQ ID NO: 378163 - RNA, 32 nt, Human
ccucccaaagugcugggauuauaggcaugcgc

SEQ ID NO: 378164 - RNA, 32 nt, Human
ccucccaaagugcugggauuauaggccugagc

SEQ ID NO: 378165 - RNA, 32 nt, Human
ccucccaaagugcugggauuauaggcguaagc

SEQ ID NO: 378166 - RNA, 32 nt, Human
ccucccaaagugcugggauuauaggcgugaga

SEQ ID NO: 378167 - RNA, 32 nt, Human
ccucccaaagugcugggauuauaggcgugagc

SEQ ID NO: 378168 - RNA, 32 nt, Human
ccucccaaagugcugggauuauaggcgugagu

SEQ ID NO: 378169 - RNA, 32 nt, Human
ccucccaaagugcugggauuauaggcgugugc

SEQ ID NO: 378170 - RNA, 32 nt, Human
ccucccaaagugcugggauuauaggcugggug

SEQ ID NO: 378171 - RNA, 32 nt, Human
ccucccaaagugcugggauugcaggcaugagc

SEQ ID NO: 378172 - RNA, 32 nt, Human
ccucccaaagugcugggauugcaggcauggcc

SEQ ID NO: 378173 - RNA, 32 nt, Human
ccucccaaagugcugggauugcaggcgugagc

SEQ ID NO: 378174 - RNA, 32 nt, Human
ccucccaaagugcugggguuacaggcaugagc

SEQ ID NO: 378175 - RNA, 32 nt, Human
ccucccaaagugcugggguuacaggcgugagc

SEQ ID NO: 378176 - RNA, 32 nt, Human
ccucccaaagugcugggguuacaggcgugugu

SEQ ID NO: 378177 - RNA, 32 nt, Human
ccucccaaagugcuguaauuacaggcaugagc

SEQ ID NO: 378178 - RNA, 32 nt, Human
ccucccaaagugcuuggauuacaggcauaagc

SEQ ID NO: 378179 - RNA, 32 nt, Human
ccucccaaagugcuuggauuacaggcaugagc

SEQ ID NO: 378180 - RNA, 32 nt, Human
ccucccaaagugguaggauuacaggcgugagc

SEQ ID NO: 378181 - RNA, 32 nt, Human
ccucccaaaguggugggaucacaggcgugagc

SEQ ID NO: 378182 - RNA, 32 nt, Human
ccucccaaaguggugggauuauaggcaugagc

SEQ ID NO: 378183 - RNA, 32 nt, Human
ccucccaaaguguuaggauuacaggcaugagc

SEQ ID NO: 378184 - RNA, 32 nt, Human
ccucccaaaguguugagauuacaggcaugagc

SEQ ID NO: 378185 - RNA, 32 nt, Human
ccucccaaaguguuggauuacaggugugagcc

SEQ ID NO: 378186 - RNA, 32 nt, Human
ccucccaaaguguugggauuacagacauuagc

SEQ ID NO: 378187 - RNA, 32 nt, Human
ccucccaaaguguugggauuacaggcaagagc

SEQ ID NO: 378188 - RNA, 32 nt, Human
ccucccaaaguguugggauuacaggcauaagc

SEQ ID NO: 378189 - RNA, 32 nt, Human
ccucccaaaguguugggauuacaggcaugaau

SEQ ID NO: 378190 - RNA, 32 nt, Human
ccucccaaaguguugggauuacaggcaugaga

SEQ ID NO: 378191 - RNA, 32 nt, Human
ccucccaaaguguugggauuacaggcaugagc

SEQ ID NO: 378192 - RNA, 32 nt, Human
ccucccaaaguguugggauuacaggcgugagc

SEQ ID NO: 378193 - RNA, 32 nt, Human
ccucccaaaguguugggauuacaggcgugagu

SEQ ID NO: 378194 - RNA, 32 nt, Human
ccucccaaaguguugggauuacaugcaugagc

SEQ ID NO: 378195 - RNA, 32 nt, Human
ccucccaaaguguugggauuauaggcaugagc

SEQ ID NO: 378196 - RNA, 32 nt, Human
ccucccaaaguguugggauuauagguaugagc

SEQ ID NO: 378197 - RNA, 32 nt, Human
ccucccaaaguucugggauuacaggcaugagc

SEQ ID NO: 378198 - RNA, 32 nt, Human
ccucccaaaguucugggauuacagguaugagc

SEQ ID NO: 378199 - RNA, 32 nt, Human
ccucccaaauagcugggacuacaggcacaggc

SEQ ID NO: 378200 - RNA, 32 nt, Human
ccucccaaauagcugggauuacaggcacccac

SEQ ID NO: 378201 - RNA, 32 nt, Human
ccucccaaauaguugggauuacaggcacaugc

SEQ ID NO: 378202 - RNA, 32 nt, Human
ccucccaaaugcugggauuacagacaugaacc

SEQ ID NO: 378203 - RNA, 32 nt, Human
ccucccaacaaacuccagaacagcagaaagcg

SEQ ID NO: 378204 - RNA, 22 nt, Human
ccucccaaccugaacugcuccu

SEQ ID NO: 378205 - RNA, 32 nt, Human
ccucccaacgugcuggaauuacaggcaugagc

SEQ ID NO: 378206 - RNA, 32 nt, Human
ccucccaacgugcugggauuacagccgguggu

SEQ ID NO: 378207 - RNA, 32 nt, Human
ccucccaacuggugacugguuagugaugaggc

SEQ ID NO: 378208 - RNA, 32 nt, Human
ccucccaagaagcugggauuacaggcaugcgc

SEQ ID NO: 378209 - RNA, 32 nt, Human
ccucccaagcagcugggaagauaggcacgugc

SEQ ID NO: 378210 - RNA, 32 nt, Human
ccucccaagcagcugggacuacagacaucuga

SEQ ID NO: 378211 - RNA, 32 nt, Human
ccucccaagcagcugggauuacaggcgcacgc

SEQ ID NO: 378212 - RNA, 32 nt, Human
ccucccaagcagcugggauuauagacacccgc

SEQ ID NO: 378213 - RNA, 32 nt, Human
ccucccaagccaugcagaacugugagucaauu

SEQ ID NO: 378214 - RNA, 21 nt, Human
ccucccaagcugugcugggaa

SEQ ID NO: 378215 - RNA, 32 nt, Human
ccucccaagggcccuuaaagcgaccugucauu

SEQ ID NO: 378216 - RNA, 32 nt, Human
ccucccaaggugcuaggauuacaggcaugagc

SEQ ID NO: 378217 - RNA, 32 nt, Human
ccucccaaggugcuggauuacaggcaugagcc

SEQ ID NO: 378218 - RNA, 32 nt, Human
ccucccaaggugcuggauuacagguguaagcc

SEQ ID NO: 378219 - RNA, 32 nt, Human
ccucccaaggugcugggauuacaggcacgagc

SEQ ID NO: 378220 - RNA, 32 nt, Human
ccucccaaggugcugggauuacaggcauaagc

SEQ ID NO: 378221 - RNA, 32 nt, Human
ccucccaaggugcugggauuacaggcaugagc

SEQ ID NO: 378222 - RNA, 32 nt, Human
ccucccaaggugcugggauuacaggcaugagg

SEQ ID NO: 378223 - RNA, 32 nt, Human
ccucccaaguaacugggauuacaggcaugcgc

SEQ ID NO: 378224 - RNA, 32 nt, Human
ccucccaaguaacugggauuacaggcaugugc

SEQ ID NO: 378225 - RNA, 32 nt, Human
ccucccaaguaacugggauuacaggcaugugu

SEQ ID NO: 378226 - RNA, 32 nt, Human
ccucccaaguaccugggacuacaggcacgcac

SEQ ID NO: 378227 - RNA, 32 nt, Human
ccucccaaguaccugggauuacaggcauguuu

SEQ ID NO: 378228 - RNA, 32 nt, Human
ccucccaaguagccaggauuacaggcacccuc

SEQ ID NO: 378229 - RNA, 32 nt, Human
ccucccaaguagcuaggacuacaggcacucac

SEQ ID NO: 378230 - RNA, 32 nt, Human
ccucccaaguagcuaggauuacagacacccgc

SEQ ID NO: 378231 - RNA, 32 nt, Human
ccucccaaguagcuaggauuacaggcaugugc

SEQ ID NO: 378232 - RNA, 32 nt, Human
ccucccaaguagcuccgauuacaggcacccac

SEQ ID NO: 378233 - RNA, 32 nt, Human
ccucccaaguagcugagacuacaagcacccac

SEQ ID NO: 378234 - RNA, 32 nt, Human
ccucccaaguagcugagacuacaggcacacac

SEQ ID NO: 378235 - RNA, 32 nt, Human
ccucccaaguagcugagacuacaggcacaugc

SEQ ID NO: 378236 - RNA, 32 nt, Human
ccucccaaguagcugagacugcaggcacgagc

SEQ ID NO: 378237 - RNA, 32 nt, Human
ccucccaaguagcugagauuacagaugcaagg

SEQ ID NO: 378238 - RNA, 32 nt, Human
ccucccaaguagcugagauuacaggcacaugc

SEQ ID NO: 378239 - RNA, 32 nt, Human
ccucccaaguagcugagauuacaggcgcacac

SEQ ID NO: 378240 - RNA, 32 nt, Human
ccucccaaguagcuggaacuauaggcacaagc

SEQ ID NO: 378241 - RNA, 32 nt, Human
ccucccaaguagcuggaauuacaggcacauac

SEQ ID NO: 378242 - RNA, 32 nt, Human
ccucccaaguagcuggaauuacaggcaccugc

SEQ ID NO: 378243 - RNA, 32 nt, Human
ccucccaaguagcuggaauuacaggcgugugc

SEQ ID NO: 378244 - RNA, 32 nt, Human
ccucccaaguagcuggauuacaggugcaugcc

SEQ ID NO: 378245 - RNA, 32 nt, Human
ccucccaaguagcuggcacuacagacacgcgc

SEQ ID NO: 378246 - RNA, 32 nt, Human
ccucccaaguagcugggaauacaggcacgcca

SEQ ID NO: 378247 - RNA, 32 nt, Human
ccucccaaguagcugggaccacacgcaugcgc

SEQ ID NO: 378248 - RNA, 32 nt, Human
ccucccaaguagcugggaccacaggcagaugc

SEQ ID NO: 378249 - RNA, 32 nt, Human
ccucccaaguagcugggaccacaggcaugcac

SEQ ID NO: 378250 - RNA, 32 nt, Human
ccucccaaguagcugggaccgcaggcacacau

SEQ ID NO: 378251 - RNA, 32 nt, Human
ccucccaaguagcugggacuacaagugcacgc

SEQ ID NO: 378252 - RNA, 32 nt, Human
ccucccaaguagcugggacuacagaugcacgc

SEQ ID NO: 378253 - RNA, 32 nt, Human
ccucccaaguagcugggacuacaggcacacac

SEQ ID NO: 378254 - RNA, 32 nt, Human
ccucccaaguagcugggacuacaggcacacgc

SEQ ID NO: 378255 - RNA, 32 nt, Human
ccucccaaguagcugggacuacaggcacccac

SEQ ID NO: 378256 - RNA, 32 nt, Human
ccucccaaguagcugggacuacaggcacccgc

SEQ ID NO: 378257 - RNA, 32 nt, Human
ccucccaaguagcugggacuacaggcaccugc

SEQ ID NO: 378258 - RNA, 32 nt, Human
ccucccaaguagcugggacuacaggcacgugc

SEQ ID NO: 378259 - RNA, 32 nt, Human
ccucccaaguagcugggacuacaggcauaugc

SEQ ID NO: 378260 - RNA, 32 nt, Human
ccucccaaguagcugggacuacaggcaugaac

SEQ ID NO: 378261 - RNA, 32 nt, Human
ccucccaaguagcugggacuacaggcaugagc

SEQ ID NO: 378262 - RNA, 32 nt, Human
ccucccaaguagcugggacuacaggcaugcac

SEQ ID NO: 378263 - RNA, 32 nt, Human
ccucccaaguagcugggacuacaggcaugcgc

SEQ ID NO: 378264 - RNA, 32 nt, Human
ccucccaaguagcugggacuacaggcauguaa

SEQ ID NO: 378265 - RNA, 32 nt, Human
ccucccaaguagcugggacuacaggcauguac

SEQ ID NO: 378266 - RNA, 32 nt, Human
ccucccaaguagcugggacuacaggcgcccac

SEQ ID NO: 378267 - RNA, 32 nt, Human
ccucccaaguagcugggacuacaggcgcccgc

SEQ ID NO: 378268 - RNA, 32 nt, Human
ccucccaaguagcugggacuacaggcgccuac

SEQ ID NO: 378269 - RNA, 32 nt, Human
ccucccaaguagcugggacuacaggcgccugc

SEQ ID NO: 378270 - RNA, 32 nt, Human
ccucccaaguagcugggacuacaggcgccugu

SEQ ID NO: 378271 - RNA, 32 nt, Human
ccucccaaguagcugggacuacaggcuuucag

SEQ ID NO: 378272 - RNA, 32 nt, Human
ccucccaaguagcugggacuacagucaugugc

SEQ ID NO: 378273 - RNA, 32 nt, Human
ccucccaaguagcugggacuacaguugugcac

SEQ ID NO: 378274 - RNA, 32 nt, Human
ccucccaaguagcugggacuacaugcacauga

SEQ ID NO: 378275 - RNA, 32 nt, Human
ccucccaaguagcugggacuacccgugcauga

SEQ ID NO: 378276 - RNA, 32 nt, Human
ccucccaaguagcugggacuacgggcacacac

SEQ ID NO: 378277 - RNA, 32 nt, Human
ccucccaaguagcugggacuacgggcacaugc

SEQ ID NO: 378278 - RNA, 32 nt, Human
ccucccaaguagcugggacuacuggcacccac

SEQ ID NO: 378279 - RNA, 32 nt, Human
ccucccaaguagcugggacuauaggcacacau

SEQ ID NO: 378280 - RNA, 32 nt, Human
ccucccaaguagcugggacuauaggcaccuac

SEQ ID NO: 378281 - RNA, 32 nt, Human
ccucccaaguagcugggacuauagucacuugc

SEQ ID NO: 378282 - RNA, 32 nt, Human
ccucccaaguagcugggacugcaggcaugagc

SEQ ID NO: 378283 - RNA, 32 nt, Human
ccucccaaguagcugggagccugggcaugcau

SEQ ID NO: 378284 - RNA, 32 nt, Human
ccucccaaguagcugggauaacaggcgcccac

SEQ ID NO: 378285 - RNA, 32 nt, Human
ccucccaaguagcugggaugacaggcgcacac

SEQ ID NO: 378286 - RNA, 32 nt, Human
ccucccaaguagcugggauuaaaggcacgugc

SEQ ID NO: 378287 - RNA, 32 nt, Human
ccucccaaguagcugggauuaaggcgccugcc

SEQ ID NO: 378288 - RNA, 32 nt, Human
ccucccaaguagcugggauuacagaugccugc

SEQ ID NO: 378289 - RNA, 32 nt, Human
ccucccaaguagcugggauuacagcgauuggu

SEQ ID NO: 378290 - RNA, 32 nt, Human
ccucccaaguagcugggauuacaggcacaaac

SEQ ID NO: 378291 - RNA, 32 nt, Human
ccucccaaguagcugggauuacaggcacaggc

SEQ ID NO: 378292 - RNA, 32 nt, Human
ccucccaaguagcugggauuacaggcacaugc

SEQ ID NO: 378293 - RNA, 32 nt, Human
ccucccaaguagcugggauuacaggcacccac

SEQ ID NO: 378294 - RNA, 32 nt, Human
ccucccaaguagcugggauuacaggcacccgc

SEQ ID NO: 378295 - RNA, 32 nt, Human
ccucccaaguagcugggauuacaggcaccuac

SEQ ID NO: 378296 - RNA, 32 nt, Human
ccucccaaguagcugggauuacaggcaccugc

SEQ ID NO: 378297 - RNA, 32 nt, Human
ccucccaaguagcugggauuacaggcacgcgc

SEQ ID NO: 378298 - RNA, 32 nt, Human
ccucccaaguagcugggauuacaggcacgcuc

SEQ ID NO: 378299 - RNA, 32 nt, Human
ccucccaaguagcugggauuacaggcagacac

SEQ ID NO: 378300 - RNA, 32 nt, Human
ccucccaaguagcugggauuacaggcagcacc

SEQ ID NO: 378301 - RNA, 32 nt, Human
ccucccaaguagcugggauuacaggcauacac

SEQ ID NO: 378302 - RNA, 32 nt, Human
ccucccaaguagcugggauuacaggcaugcac

SEQ ID NO: 378303 - RNA, 32 nt, Human
ccucccaaguagcugggauuacaggcaugcgc

SEQ ID NO: 378304 - RNA, 32 nt, Human
ccucccaaguagcugggauuacaggcaugggc

SEQ ID NO: 378305 - RNA, 32 nt, Human
ccucccaaguagcugggauuacaggcauguac

SEQ ID NO: 378306 - RNA, 32 nt, Human
ccucccaaguagcugggauuacaggcaugugc

SEQ ID NO: 378307 - RNA, 32 nt, Human
ccucccaaguagcugggauuacaggcgcacgc

SEQ ID NO: 378308 - RNA, 32 nt, Human
ccucccaaguagcugggauuacaggcgcauug

SEQ ID NO: 378309 - RNA, 32 nt, Human
ccucccaaguagcugggauuacaggcgccugc

SEQ ID NO: 378310 - RNA, 32 nt, Human
ccucccaaguagcugggauuacaggcgcgugc

SEQ ID NO: 378311 - RNA, 32 nt, Human
ccucccaaguagcugggauuacaggcguccgc

SEQ ID NO: 378312 - RNA, 32 nt, Human
ccucccaaguagcugggauuacaggcgugcac

SEQ ID NO: 378313 - RNA, 32 nt, Human
ccucccaaguagcugggauuacaggcguguac

SEQ ID NO: 378314 - RNA, 32 nt, Human
ccucccaaguagcugggauuacagguaccugc

SEQ ID NO: 378315 - RNA, 32 nt, Human
ccucccaaguagcugggauuacaggugcacac

SEQ ID NO: 378316 - RNA, 32 nt, Human
ccucccaaguagcugggauuacaggugcaggc

SEQ ID NO: 378317 - RNA, 32 nt, Human
ccucccaaguagcugggauuacaggugcccaa

SEQ ID NO: 378318 - RNA, 32 nt, Human
ccucccaaguagcugggauuacaggugcccac

SEQ ID NO: 378319 - RNA, 32 nt, Human
ccucccaaguagcugggauuacaggugcccgc

SEQ ID NO: 378320 - RNA, 32 nt, Human
ccucccaaguagcugggauuacaggugccugc

SEQ ID NO: 378321 - RNA, 32 nt, Human
ccucccaaguagcugggauuacaggugcucac

SEQ ID NO: 378322 - RNA, 32 nt, Human
ccucccaaguagcugggauuacagguguccgc

SEQ ID NO: 378323 - RNA, 32 nt, Human
ccucccaaguagcugggauuacaggugugagc

SEQ ID NO: 378324 - RNA, 32 nt, Human
ccucccaaguagcugggauuacaggugugcac

SEQ ID NO: 378325 - RNA, 32 nt, Human
ccucccaaguagcugggauuacaggugugcgc

SEQ ID NO: 378326 - RNA, 32 nt, Human
ccucccaaguagcugggauuacaggugugugc

SEQ ID NO: 378327 - RNA, 32 nt, Human
ccucccaaguagcugggauuacagucaggcac

SEQ ID NO: 378328 - RNA, 32 nt, Human
ccucccaaguagcugggauuacagugccugcc

SEQ ID NO: 378329 - RNA, 32 nt, Human
ccucccaaguagcugggauuacgggcaugcgc

SEQ ID NO: 378330 - RNA, 32 nt, Human
ccucccaaguagcugggauuauaggcaccugc

SEQ ID NO: 378331 - RNA, 32 nt, Human
ccucccaaguagcugggauuauaggugcccac

SEQ ID NO: 378332 - RNA, 32 nt, Human
ccucccaaguagcugggauuauaggugugugc

SEQ ID NO: 378333 - RNA, 32 nt, Human
ccucccaaguagcugggauugcaggcgcccgc

SEQ ID NO: 378334 - RNA, 32 nt, Human
ccucccaaguagcugggauugcaggugcccac

SEQ ID NO: 378335 - RNA, 32 nt, Human
ccucccaaguagcugggauuguaagaguaugc

SEQ ID NO: 378336 - RNA, 32 nt, Human
ccucccaaguagcuggggcuacaggcacccac

SEQ ID NO: 378337 - RNA, 32 nt, Human
ccucccaaguagcugggguuacaggcauuugc

SEQ ID NO: 378338 - RNA, 32 nt, Human
ccucccaaguaggugggauuacaggcaugcac

SEQ ID NO: 378339 - RNA, 32 nt, Human
ccucccaaguaggugggauuacaggcaugcgc

SEQ ID NO: 378340 - RNA, 32 nt, Human
ccucccaaguaggugggauuacaggcgcccgc

SEQ ID NO: 378341 - RNA, 32 nt, Human
ccucccaaguaguugggacuacaggcaugcgc

SEQ ID NO: 378342 - RNA, 32 nt, Human
ccucccaaguaguugggauuacaggcaccugc

SEQ ID NO: 378343 - RNA, 32 nt, Human
ccucccaaguaguugggauuacaggcaugcau

SEQ ID NO: 378344 - RNA, 32 nt, Human
ccucccaaguaguugggauuacgggcaugcac

SEQ ID NO: 378345 - RNA, 32 nt, Human
ccucccaaguaguugggucuacaggcacgcac

SEQ ID NO: 378346 - RNA, 32 nt, Human
ccucccaaguaucugggacuacaggcaugcgc

SEQ ID NO: 378347 - RNA, 32 nt, Human
ccucccaagugcuaggauuacaggcaucagcc

SEQ ID NO: 378348 - RNA, 32 nt, Human
ccucccaagugcuggaauuacaggugugagcc

SEQ ID NO: 378349 - RNA, 32 nt, Human
ccucccaagugcugggauuacaggcgcgagcc

SEQ ID NO: 378350 - RNA, 32 nt, Human
ccucccaagugcugggauuacaggcgugagcc

SEQ ID NO: 378351 - RNA, 32 nt, Human
ccucccaaguggcugggauuacaggcgcaaac

SEQ ID NO: 378352 - RNA, 32 nt, Human
ccucccaaguggcugggauugcaggcaugagc

SEQ ID NO: 378353 - RNA, 32 nt, Human
ccucccaauaccagcaggagguucugggccuc

SEQ ID NO: 378354 - RNA, 32 nt, Human
ccucccaauagacuacaggcagugccaguugg

SEQ ID NO: 378355 - RNA, 32 nt, Human
ccucccaauccccacagacacacacauugauc

SEQ ID NO: 378356 - RNA, 32 nt, Human
ccucccaaugugcugggauuacaggcaugagc

SEQ ID NO: 378357 - RNA, 32 nt, Human
ccucccaaugugcugggauuacaguugucacg

SEQ ID NO: 378358 - RNA, 32 nt, Human
ccucccacaacacauggugauuauggggauua

SEQ ID NO: 378359 - RNA, 32 nt, Human
ccucccacaagccacguugaucuucacaacga

SEQ ID NO: 378360 - RNA, 21 nt, Human
ccucccacaagucgcgccuca

SEQ ID NO: 378361 - RNA, 28 nt, Human
ccucccacaagucgcgccucaucgagca

SEQ ID NO: 378362 - RNA, 32 nt, Human
ccucccacacacaggccagcugcucacccugc

SEQ ID NO: 378363 - RNA, 32 nt, Human
ccucccacacaccuugcucuggcuucucugug

SEQ ID NO: 378364 - RNA, 21 nt, Human
ccucccacaccucucaccuca

SEQ ID NO: 378365 - RNA, 32 nt, Human
ccucccacaccucucaccucacaggcacauca

SEQ ID NO: 378366 - RNA, 32 nt, Human
ccucccacacucgccaucuccugggccguuac

SEQ ID NO: 378367 - RNA, 32 nt, Human
ccucccacagcccaccuccacuuuugaaagcc

SEQ ID NO: 378368 - RNA, 32 nt, Human
ccucccacagccgaccaggcucaacgcacaca

SEQ ID NO: 378369 - RNA, 15 nt, Human
ccucccacagugcug

SEQ ID NO: 378370 - RNA, 32 nt, Human
ccucccacagugcugggauuacaggcaugggc

SEQ ID NO: 378371 - RNA, 32 nt, Human
ccucccacagugcugggauuacaggccugagc

SEQ ID NO: 378372 - RNA, 32 nt, Human
ccucccacagugcugggauuacaggcgugagc

SEQ ID NO: 378373 - RNA, 32 nt, Human
ccucccacagugcugggauuagaggcaugagc

SEQ ID NO: 378374 - RNA, 32 nt, Human
ccucccacaucuugccauuaccagucugugua

SEQ ID NO: 378375 - RNA, 32 nt, Human
ccucccaccacugucccagcagucccucggca

SEQ ID NO: 378376 - RNA, 32 nt, Human
ccucccaccaguguccaggcaggcaggagccc

SEQ ID NO: 378377 - RNA, 28 nt, Human
ccucccacccagucccucccucuggucc

SEQ ID NO: 378378 - RNA, 32 nt, Human
ccucccaccccagccucccagguagcuaguac

SEQ ID NO: 378379 - RNA, 22 nt, Human
ccucccacccccaaacgaggug

SEQ ID NO: 378380 - RNA, 20 nt, Human
ccucccacccggucuuccug

SEQ ID NO: 378381 - RNA, 24 nt, Human
ccucccacccucauuuucuggucc

SEQ ID NO: 378382 - RNA, 18 nt, Human
ccucccacccugugucug

SEQ ID NO: 378383 - RNA, 32 nt, Human
ccucccacccuucagccccaggcucucugagc

SEQ ID NO: 378384 - RNA, 32 nt, Human
ccucccacccuucuggccaagcauggcggugc

SEQ ID NO: 378385 - RNA, 21 nt, Human
ccucccaccgcaccuuccuga

SEQ ID NO: 378386 - RNA, 23 nt, Human
ccucccaccucagccucuggugu

SEQ ID NO: 378387 - RNA, 21 nt, Human
ccucccaccucagcuuccuga

SEQ ID NO: 378388 - RNA, 32 nt, Human
ccucccaccucuuccuccuccuagcuccccaa

SEQ ID NO: 378389 - RNA, 32 nt, Human
ccucccaccugccccucaauucccaggagacu

SEQ ID NO: 378390 - RNA, 32 nt, Human
ccucccacgacccccaccagacugccuuaggu

SEQ ID NO: 378391 - RNA, 32 nt, Human
ccucccacuacagugauuccagaucucccagc

SEQ ID NO: 378392 - RNA, 32 nt, Human
ccucccacugauuuuaaauaguugguugaaga

SEQ ID NO: 378393 - RNA, 32 nt, Human
ccucccacugcaacuuuucagcucagggguug

SEQ ID NO: 378394 - RNA, 32 nt, Human
ccucccacugcacugccgguuucccuggguua

SEQ ID NO: 378395 - RNA, 32 nt, Human
ccucccacugcagccucugccugcucugccgc

SEQ ID NO: 378396 - RNA, 32 nt, Human
ccucccacugccugacaccugggacaggcugg

SEQ ID NO: 378397 - RNA, 32 nt, Human
ccucccacuggcuccugauaucuugcuguauu

SEQ ID NO: 378398 - RNA, 17 nt, Human
ccucccacugggucccu

SEQ ID NO: 378399 - RNA, 26 nt, Human
ccucccacuugguagcaccuuccuga

SEQ ID NO: 378400 - RNA, 32 nt, Human
ccucccagaaugcugggauuacaggcgugagc

SEQ ID NO: 378401 - RNA, 22 nt, Human
ccucccagaccugucaugagga

SEQ ID NO: 378402 - RNA, 32 nt, Human
ccucccagacuaccugcccucagcuuggauaa

SEQ ID NO: 378403 - RNA, 32 nt, Human
ccucccagacuguugggauuacaggcaugagc

SEQ ID NO: 378404 - RNA, 32 nt, Human
ccucccagacuugcugcuugcuugguccacag

SEQ ID NO: 378405 - RNA, 32 nt, Human
ccucccagagaccuccaagaccugccaagcug

SEQ ID NO: 378406 - RNA, 32 nt, Human
ccucccagagcaucucacccccacccucaugu

SEQ ID NO: 378407 - RNA, 32 nt, Human
ccucccagagcucagcccaugucacccuccag

SEQ ID NO: 378408 - RNA, 32 nt, Human
ccucccagagcuuguugucuccacuuguauau

SEQ ID NO: 378409 - RNA, 32 nt, Human
ccucccagagggcugaacucuuucaacucugc

SEQ ID NO: 378410 - RNA, 32 nt, Human
ccucccagaguacugggauuacaggcucuuuc

SEQ ID NO: 378411 - RNA, 32 nt, Human
ccucccagaguauugggauuacagacaugagc

SEQ ID NO: 378412 - RNA, 32 nt, Human
ccucccagagugcuaggauuacaggcaugagc

SEQ ID NO: 378413 - RNA, 32 nt, Human
ccucccagagugcuaggauuacaggccuuuug

SEQ ID NO: 378414 - RNA, 32 nt, Human
ccucccagagugcugagauuacaggcgugagc

SEQ ID NO: 378415 - RNA, 32 nt, Human
ccucccagagugcugggacuacaggcaucagc

SEQ ID NO: 378416 - RNA, 32 nt, Human
ccucccagagugcugggacuacaggcaugagc

SEQ ID NO: 378417 - RNA, 32 nt, Human
ccucccagagugcugggauuacaggcaugagc

SEQ ID NO: 378418 - RNA, 32 nt, Human
ccucccagagugcugggauuacaggcgucagc

SEQ ID NO: 378419 - RNA, 32 nt, Human
ccucccagagugcugggauuacaggcgugagc

SEQ ID NO: 378420 - RNA, 32 nt, Human
ccucccagagugcugggauuacagggggagcc

SEQ ID NO: 378421 - RNA, 32 nt, Human
ccucccagagugcugggauuacaggugugaau

SEQ ID NO: 378422 - RNA, 32 nt, Human
ccucccagagugcugggauuacaggugugagc

SEQ ID NO: 378423 - RNA, 32 nt, Human
ccucccagagugcugggauuauaggcgugagc

SEQ ID NO: 378424 - RNA, 32 nt, Human
ccucccagagugcugggauuuacaggcaugag

SEQ ID NO: 378425 - RNA, 32 nt, Human
ccucccagauagcugggacuacaggcacacgc

SEQ ID NO: 378426 - RNA, 32 nt, Human
ccucccagauugcuggguuuacaggcaugagc

SEQ ID NO: 378427 - RNA, 19 nt, Human
ccucccagcaaccuucccu

SEQ ID NO: 378428 - RNA, 32 nt, Human
ccucccagcacuggcccugcagggcgcccacc

SEQ ID NO: 378429 - RNA, 32 nt, Human
ccucccagcacugucuccuuccucccacuggc

SEQ ID NO: 378430 - RNA, 32 nt, Human
ccucccagcagacggagccaggacgggcacaa

SEQ ID NO: 378431 - RNA, 19 nt, Human
ccucccagcagcagcagug

SEQ ID NO: 378432 - RNA, 32 nt, Human
ccucccagcaucugggacucgagagugggcag

SEQ ID NO: 378433 - RNA, 32 nt, Human
ccucccagccaguguccagccuaagcacaucg

SEQ ID NO: 378434 - RNA, 32 nt, Human
ccucccagccaugcuuccuguacagccugugg

SEQ ID NO: 378435 - RNA, 17 nt, Human
ccucccagccccuucca

SEQ ID NO: 378436 - RNA, 19 nt, Human
ccucccagcccucuccuca

SEQ ID NO: 378437 - RNA, 32 nt, Human
ccucccagcccuugcccagccugggggagugg

SEQ ID NO: 378438 - RNA, 23 nt, Human
ccucccagccuauuucugcuccu

SEQ ID NO: 378439 - RNA, 32 nt, Human
ccucccagccuccuuagcacuagaaaacugcc

SEQ ID NO: 378440 - RNA, 32 nt, Human
ccucccagccugguggacccaaggagaagguc

SEQ ID NO: 378441 - RNA, 32 nt, Human
ccucccagccuucugcugcccuugcuuaacaa

SEQ ID NO: 378442 - RNA, 32 nt, Human
ccucccagcguccacuggcuccaggcuccuca

SEQ ID NO: 378443 - RNA, 32 nt, Human
ccucccagcuacuuaggaggcugaggcaggag

SEQ ID NO: 378444 - RNA, 20 nt, Human
ccucccagcucccuuagaga

SEQ ID NO: 378445 - RNA, 32 nt, Human
ccucccagcugacccagccuccugggccgcuu

SEQ ID NO: 378446 - RNA, 32 nt, Human
ccucccagcugucucuggaggcuggaggaguu

SEQ ID NO: 378447 - RNA, 32 nt, Human
ccucccagcuuuguuuauuuugugcuuuuaga

SEQ ID NO: 378448 - RNA, 32 nt, Human
ccucccaggaagugcugggauuacaggcauga

SEQ ID NO: 378449 - RNA, 28 nt, Human
ccucccaggaaugcugccuuccuucagc

SEQ ID NO: 378450 - RNA, 32 nt, Human
ccucccaggagggagacgcuggggugcaaaaa

SEQ ID NO: 378451 - RNA, 32 nt, Human
ccucccaggaguaaaagccaagcaagagguug

SEQ ID NO: 378452 - RNA, 21 nt, Human
ccucccaggaucccaccagcc

SEQ ID NO: 378453 - RNA, 18 nt, Human
ccucccaggccaccaacc

SEQ ID NO: 378454 - RNA, 32 nt, Human
ccucccaggccccugccccaacugauucugcc

SEQ ID NO: 378455 - RNA, 32 nt, Human
ccucccaggcgggaucgcugguuucucucgac

SEQ ID NO: 378456 - RNA, 32 nt, Human
ccucccaggcugggcuuuguagcugcagcccc

SEQ ID NO: 378457 - RNA, 32 nt, Human
ccucccaggcuggggcagugggcaugggcagg

SEQ ID NO: 378458 - RNA, 32 nt, Human
ccucccaggcuggugugagugugcgugcguuu

SEQ ID NO: 378459 - RNA, 32 nt, Human
ccucccagggaagccugugcagaugcagucac

SEQ ID NO: 378460 - RNA, 32 nt, Human
ccucccagggccagguuccugacaguguuggu

SEQ ID NO: 378461 - RNA, 32 nt, Human
ccucccagggcugugaggacggaaacaggcag

SEQ ID NO: 378462 - RNA, 21 nt, Human
ccucccaggggacuguuccuu

SEQ ID NO: 378463 - RNA, 32 nt, Human
ccucccagggucuuugccucuaucugugguuu

SEQ ID NO: 378464 - RNA, 32 nt, Human
ccucccagggugcugggauuacaggugugagc

SEQ ID NO: 378465 - RNA, 32 nt, Human
ccucccagguagcugggacuacaggcacacac

SEQ ID NO: 378466 - RNA, 32 nt, Human
ccucccagguagcugggacuauaggcacgugc

SEQ ID NO: 378467 - RNA, 32 nt, Human
ccucccagguagcugggauuacaggcacccac

SEQ ID NO: 378468 - RNA, 32 nt, Human
ccucccagguagcugggauuacaggcaugcaa

SEQ ID NO: 378469 - RNA, 32 nt, Human
ccucccagguagcugggauuacaggcucccgc

SEQ ID NO: 378470 - RNA, 32 nt, Human
ccucccagguagcugggauuauaggcgugugc

SEQ ID NO: 378471 - RNA, 32 nt, Human
ccucccaggucucccuggggagguagaggcac

SEQ ID NO: 378472 - RNA, 32 nt, Human
ccucccaggugcaaagggcucccggcgcccgg

SEQ ID NO: 378473 - RNA, 32 nt, Human
ccucccaggugcugggauuauaggcgugagcc

SEQ ID NO: 378474 - RNA, 32 nt, Human
ccucccagguggcugaaacuacaggcacaugc

SEQ ID NO: 378475 - RNA, 32 nt, Human
ccucccagguggcugggauuacaggcaugcac

SEQ ID NO: 378476 - RNA, 32 nt, Human
ccucccagguggugucaacacaacaucacaca

SEQ ID NO: 378477 - RNA, 20 nt, Human
ccucccaguaaacccugcca

SEQ ID NO: 378478 - RNA, 32 nt, Human
ccucccaguaagggcguggcucugggugggcg

SEQ ID NO: 378479 - RNA, 32 nt, Human
ccucccaguaugcucugugcuuuuggaacaau

SEQ ID NO: 378480 - RNA, 32 nt, Human
ccucccagucaguucaagacccgacaugaggg

SEQ ID NO: 378481 - RNA, 32 nt, Human
ccucccaguccugaacacauugcagauggccc

SEQ ID NO: 378482 - RNA, 32 nt, Human
ccucccagugaagguggaccucugauuuagac

SEQ ID NO: 378483 - RNA, 32 nt, Human
ccucccagugauggucaguauucuuuuggaau

SEQ ID NO: 378484 - RNA, 32 nt, Human
ccucccagugcaaauccuccugcccauaccgu

SEQ ID NO: 378485 - RNA, 32 nt, Human
ccucccagugugcugggauuacaggcaugagc

SEQ ID NO: 378486 - RNA, 32 nt, Human
ccucccaguucugcgccuuggggccagccagu

SEQ ID NO: 378487 - RNA, 32 nt, Human
ccucccaguucuggaggagccagguuccccuu

SEQ ID NO: 378488 - RNA, 32 nt, Human
ccucccaguuuuucuccccuuuugguuuaaua

SEQ ID NO: 378489 - RNA, 32 nt, Human
ccucccauacugugaaucagcaggugccccga

SEQ ID NO: 378490 - RNA, 32 nt, Human
ccucccauagugcugggauuacaggcaugagc

SEQ ID NO: 378491 - RNA, 32 nt, Human
ccucccauagugcugggauuacaggugugagc

SEQ ID NO: 378492 - RNA, 32 nt, Human
ccucccaucaccucaacuccagccagggagga

SEQ ID NO: 378493 - RNA, 32 nt, Human
ccucccaucccaggauucauguuuucauggua

SEQ ID NO: 378494 - RNA, 19 nt, Human
ccucccaucccucuguccu

SEQ ID NO: 378495 - RNA, 24 nt, Human
ccucccaucccugcccuccuccug

SEQ ID NO: 378496 - RNA, 32 nt, Human
ccucccauccgucauuccccugcguucucuuu

SEQ ID NO: 378497 - RNA, 32 nt, Human
ccucccauccuuguccuucucucccucagaag

SEQ ID NO: 378498 - RNA, 24 nt, Human
ccucccaucuauccccauuccuga

SEQ ID NO: 378499 - RNA, 32 nt, Human
ccucccaucucaaggacuuggaaguaagggaa

SEQ ID NO: 378500 - RNA, 21 nt, Human
ccucccaucucagccuccuga

SEQ ID NO: 378501 - RNA, 20 nt, Human
ccucccaucucagccugccu

SEQ ID NO: 378502 - RNA, 23 nt, Human
ccucccaucucuuaucuccuuga

SEQ ID NO: 378503 - RNA, 24 nt, Human
ccucccaucuuaagcaacccccug

SEQ ID NO: 378504 - RNA, 24 nt, Human
ccucccaucuugagcucuuccuga

SEQ ID NO: 378505 - RNA, 19 nt, Human
ccucccaucuuggccuccc

SEQ ID NO: 378506 - RNA, 31 nt, Human
ccucccaugcugaguuucaugauggcuuuca

SEQ ID NO: 378507 - RNA, 27 nt, Human
ccucccauggauaggaacucuuccugg

SEQ ID NO: 378508 - RNA, 32 nt, Human
ccucccaugggaagugcuggaauccacucuug

SEQ ID NO: 378509 - RNA, 32 nt, Human
ccucccauguagcugggauuacagcugccugc

SEQ ID NO: 378510 - RNA, 32 nt, Human
ccucccauucacccaucucugcucccacccuu

SEQ ID NO: 378511 - RNA, 32 nt, Human
ccuccccaaacaucucccucccuaccucccuc

SEQ ID NO: 378512 - RNA, 32 nt, Human
ccuccccaaaccuucagaugcagugagaccug

SEQ ID NO: 378513 - RNA, 23 nt, Human
ccuccccaaagaguugcgcauca

SEQ ID NO: 378514 - RNA, 32 nt, Human
ccuccccaacacagugagaccccagccaccuc

SEQ ID NO: 378515 - RNA, 32 nt, Human
ccuccccaaccacguggaacugugaguccauu

SEQ ID NO: 378516 - RNA, 32 nt, Human
ccuccccaaccuccuccauuuccccagccaga

SEQ ID NO: 378517 - RNA, 32 nt, Human
ccuccccaacuucagcccaugucuucacagca

SEQ ID NO: 378518 - RNA, 32 nt, Human
ccuccccaagccccagggccuaaagagaagac

SEQ ID NO: 378519 - RNA, 22 nt, Human
ccuccccaagcuucuugcuaua

SEQ ID NO: 378520 - RNA, 32 nt, Human
ccuccccaaggcucagcucuaagaccugcacc

SEQ ID NO: 378521 - RNA, 32 nt, Human
ccuccccaagugcugggauuacaggcgugagc

SEQ ID NO: 378522 - RNA, 32 nt, Human
ccuccccaagugcugggauuauaggcaugagc

SEQ ID NO: 378523 - RNA, 32 nt, Human
ccuccccaaguguugggauuacaggcgugagc

SEQ ID NO: 378524 - RNA, 20 nt, Human
ccuccccaaugauuucuuca

SEQ ID NO: 378525 - RNA, 32 nt, Human
ccuccccacacaacaggcuacgaagaaccugg

SEQ ID NO: 378526 - RNA, 32 nt, Human
ccuccccacaggcucuccuuguggggucccag

SEQ ID NO: 378527 - RNA, 32 nt, Human
ccuccccacaguccuggcuggagcagcgaguc

SEQ ID NO: 378528 - RNA, 32 nt, Human
ccuccccacaguuugagucagagauggcucuc

SEQ ID NO: 378529 - RNA, 32 nt, Human
ccuccccacauggugcugaggcucccugcugc

SEQ ID NO: 378530 - RNA, 32 nt, Human
ccuccccaccacagccaucucguuuaucggac

SEQ ID NO: 378531 - RNA, 32 nt, Human
ccuccccaccacauaaacacauggacacacac

SEQ ID NO: 378532 - RNA, 32 nt, Human
ccuccccaccacccuccgccaucagccugccu

SEQ ID NO: 378533 - RNA, 20 nt, Human
ccuccccaccagcccgcuga

SEQ ID NO: 378534 - RNA, 32 nt, Human
ccuccccaccauuccucuucccccacaugugu

SEQ ID NO: 378535 - RNA, 32 nt, Human
ccuccccacccaagccucaccuccccaccccu

SEQ ID NO: 378536 - RNA, 32 nt, Human
ccuccccacccagguuuucggcccagugaaga

SEQ ID NO: 378537 - RNA, 32 nt, Human
ccuccccaccuaccccuuccuuccucuuuauc

SEQ ID NO: 378538 - RNA, 32 nt, Human
ccuccccaccuagcccuccaaccaaggcuagg

SEQ ID NO: 378539 - RNA, 32 nt, Human
ccuccccaccucccaucucuccuuccaggccc

SEQ ID NO: 378540 - RNA, 19 nt, Human
ccuccccaccuccuggaaa

SEQ ID NO: 378541 - RNA, 32 nt, Human
ccuccccacgucgcccccuccugcacagccac

SEQ ID NO: 378542 - RNA, 32 nt, Human
ccuccccacucccuccccacucccuccuggca

SEQ ID NO: 378543 - RNA, 32 nt, Human
ccuccccacucugagcccguguccucaguagu

SEQ ID NO: 378544 - RNA, 32 nt, Human
ccuccccacugaagaaaaagaugaaaaugaug

SEQ ID NO: 378545 - RNA, 32 nt, Human
ccuccccacugauucccuucuuuccauuucug

SEQ ID NO: 378546 - RNA, 32 nt, Human
ccuccccacugcagccagcaugccuggcugug

SEQ ID NO: 378547 - RNA, 22 nt, Human
ccuccccacugcccccacccca

SEQ ID NO: 378548 - RNA, 32 nt, Human
ccuccccacugccuuuucucacucagaugggg

SEQ ID NO: 378549 - RNA, 32 nt, Human
ccuccccacuggcucugucugcucuccugcca

SEQ ID NO: 378550 - RNA, 32 nt, Human
ccuccccacuucaccaacacugccuuccucca

SEQ ID NO: 378551 - RNA, 32 nt, Human
ccuccccacuuucuccuuuuccuuccuuccug

SEQ ID NO: 378552 - RNA, 32 nt, Human
ccuccccagcaauguagaacuguaaguccauu

SEQ ID NO: 378553 - RNA, 32 nt, Human
ccuccccagcacagccagggugaguguccucu

SEQ ID NO: 378554 - RNA, 32 nt, Human
ccuccccagcagcugcucugcucaccagccug

SEQ ID NO: 378555 - RNA, 32 nt, Human
ccuccccagcagcugggacuacaggcacacau

SEQ ID NO: 378556 - RNA, 32 nt, Human
ccuccccagcagcugggacuacaggcacccac

SEQ ID NO: 378557 - RNA, 32 nt, Human
ccuccccagccacgcagaacugugagucaauu

SEQ ID NO: 378558 - RNA, 32 nt, Human
ccuccccagccaugcagagccaugagucaauu

SEQ ID NO: 378559 - RNA, 32 nt, Human
ccuccccagccaugcaggacugugagucaauu

SEQ ID NO: 378560 - RNA, 32 nt, Human
ccuccccagccaugcggaacugugagucaguu

SEQ ID NO: 378561 - RNA, 32 nt, Human
ccuccccagccauguggaacagugagucaauu

SEQ ID NO: 378562 - RNA, 32 nt, Human
ccuccccagccauguggaacucugagaaaccu

SEQ ID NO: 378563 - RNA, 32 nt, Human
ccuccccagccauguggaacucuuguguugug

SEQ ID NO: 378564 - RNA, 32 nt, Human
ccuccccagccauguggaacuguaaguccaau

SEQ ID NO: 378565 - RNA, 32 nt, Human
ccuccccagccauguggaacugugaauccauu

SEQ ID NO: 378566 - RNA, 32 nt, Human
ccuccccagccauguggaacugugagucaauu

SEQ ID NO: 378567 - RNA, 32 nt, Human
ccuccccagccauguggaacugugugugaguu

SEQ ID NO: 378568 - RNA, 32 nt, Human
ccuccccagccauguuaaacuuugaguuaauu

SEQ ID NO: 378569 - RNA, 17 nt, Human
ccuccccagccccacgg

SEQ ID NO: 378570 - RNA, 32 nt, Human
ccuccccagccccagcucacacacccaacacc

SEQ ID NO: 378571 - RNA, 32 nt, Human
ccuccccagcccuuggcacaggcagaguucgg

SEQ ID NO: 378572 - RNA, 32 nt, Human
ccuccccagccguguggaacugugaguccauu

SEQ ID NO: 378573 - RNA, 32 nt, Human
ccuccccagcuacucgggaggcugaggcagga

SEQ ID NO: 378574 - RNA, 32 nt, Human
ccuccccagcuauaaggaacugugagccaauu

SEQ ID NO: 378575 - RNA, 32 nt, Human
ccuccccaggcaggccagggcccagcagcuug

SEQ ID NO: 378576 - RNA, 32 nt, Human
ccuccccaggccccaaagcaccccaaggcugg

SEQ ID NO: 378577 - RNA, 23 nt, Human
ccuccccaggccucuggggcccg

SEQ ID NO: 378578 - RNA, 32 nt, Human
ccuccccaggcuggccccagaggagcgagcac

SEQ ID NO: 378579 - RNA, 32 nt, Human
ccuccccagguggcaggaucuggcuuggggug

SEQ ID NO: 378580 - RNA, 21 nt, Human
ccuccccaggugugcaccaug

SEQ ID NO: 378581 - RNA, 32 nt, Human
ccuccccaguagagcugggacuacagguaugc

SEQ ID NO: 378582 - RNA, 32 nt, Human
ccuccccaguagcugagauugcaggcacaugc

SEQ ID NO: 378583 - RNA, 32 nt, Human
ccuccccaguagcuggaacuacaggcaugcac

SEQ ID NO: 378584 - RNA, 32 nt, Human
ccuccccaguagcugggaauacaggcacccgc

SEQ ID NO: 378585 - RNA, 32 nt, Human
ccuccccaguagcugggacuacaagcacaugc

SEQ ID NO: 378586 - RNA, 32 nt, Human
ccuccccaguagcugggacuacaggcaugugc

SEQ ID NO: 378587 - RNA, 32 nt, Human
ccuccccaguagcugggacuacaggccuccau

SEQ ID NO: 378588 - RNA, 32 nt, Human
ccuccccaguagcugggacuacaggcgcccgc

SEQ ID NO: 378589 - RNA, 32 nt, Human
ccuccccaguagcugggacuacaggcgccugc

SEQ ID NO: 378590 - RNA, 32 nt, Human
ccuccccaguagcugggacuccaggcacccac

SEQ ID NO: 378591 - RNA, 32 nt, Human
ccuccccaguagcugggauuacaggcaccagc

SEQ ID NO: 378592 - RNA, 32 nt, Human
ccuccccaguagcugggauuacaggcacccac

SEQ ID NO: 378593 - RNA, 32 nt, Human
ccuccccaguagcugggauuacaggcacccgc

SEQ ID NO: 378594 - RNA, 32 nt, Human
ccuccccaguagcugggauuacaggcaccuac

SEQ ID NO: 378595 - RNA, 32 nt, Human
ccuccccaguagcugggauuacaggcgcccac

SEQ ID NO: 378596 - RNA, 32 nt, Human
ccuccccaguagcugggauuacaggcgccgau

SEQ ID NO: 378597 - RNA, 32 nt, Human
ccuccccaguagcugggauuacaggcgugggc

SEQ ID NO: 378598 - RNA, 32 nt, Human
ccuccccaguagcugggauuacaggcucaugc

SEQ ID NO: 378599 - RNA, 32 nt, Human
ccuccccaguagcugggauuacaguguuauag

SEQ ID NO: 378600 - RNA, 32 nt, Human
ccuccccagucauacagaacugugaaucaauu

SEQ ID NO: 378601 - RNA, 32 nt, Human
ccuccccaguccccagaacugccugcaggugc

SEQ ID NO: 378602 - RNA, 32 nt, Human
ccuccccagugcagcauggcacucaggagaua

SEQ ID NO: 378603 - RNA, 17 nt, Human
ccuccccaguuuagggg

SEQ ID NO: 378604 - RNA, 32 nt, Human
ccuccccauauuccucacuucuccaucaccuc

SEQ ID NO: 378605 - RNA, 32 nt, Human
ccuccccaucaaugacccccagccuggcucca

SEQ ID NO: 378606 - RNA, 19 nt, Human
ccuccccaucacccagcca

SEQ ID NO: 378607 - RNA, 32 nt, Human
ccuccccaucccugaccuggcgaaaggccuag

SEQ ID NO: 378608 - RNA, 32 nt, Human
ccuccccaugaaggagggaggcugguagcuuu

SEQ ID NO: 378609 - RNA, 32 nt, Human
ccuccccauguucauuaugcucagccugucuu

SEQ ID NO: 378610 - RNA, 32 nt, Human
ccuccccauucuucucuuccccucucuucccu

SEQ ID NO: 378611 - RNA, 18 nt, Human
ccucccccaaaggggcag

SEQ ID NO: 378612 - RNA, 32 nt, Human
ccucccccaaccccuguauccccaccccguac

SEQ ID NO: 378613 - RNA, 18 nt, Human
ccucccccaagccaacca

SEQ ID NO: 378614 - RNA, 32 nt, Human
ccucccccaagucucuucugugcaaggcccgc

SEQ ID NO: 378615 - RNA, 32 nt, Human
ccucccccacccaccucucuggcuuccaugcu

SEQ ID NO: 378616 - RNA, 32 nt, Human
ccucccccacccagucugccaggcugggagcu

SEQ ID NO: 378617 - RNA, 32 nt, Human
ccucccccacgggcuccugccugccugccagg

SEQ ID NO: 378618 - RNA, 32 nt, Human
ccucccccacugcaccccaagagagagagccc

SEQ ID NO: 378619 - RNA, 19 nt, Human
ccucccccagaugguacuu

SEQ ID NO: 378620 - RNA, 32 nt, Human
ccucccccagcacuugcggccgcucagcccuc

SEQ ID NO: 378621 - RNA, 25 nt, Human
ccucccccagccuuccuccggcugg

SEQ ID NO: 378622 - RNA, 28 nt, Human
ccucccccagcugcugccuucauauuga

SEQ ID NO: 378623 - RNA, 32 nt, Human
ccucccccaggccuaagaggagagggaaccag

SEQ ID NO: 378624 - RNA, 32 nt, Human
ccucccccagggccaagggaaauccugagcgc

SEQ ID NO: 378625 - RNA, 18 nt, Human
ccuccccccaaagccccc

SEQ ID NO: 378626 - RNA, 15 nt, Human
ccuccccccacgccc

SEQ ID NO: 378627 - RNA, 16 nt, Human
ccuccccccuuggggg

SEQ ID NO: 378628 - RNA, 32 nt, Human
ccucccccgaccugggcccacacugcugccuu

SEQ ID NO: 378629 - RNA, 32 nt, Human
ccucccccgagaccacccccacccuggggaag

SEQ ID NO: 378630 - RNA, 32 nt, Human
ccucccccgauucugacuaucucccuuucccg

SEQ ID NO: 378631 - RNA, 32 nt, Human
ccucccccgcagguuaugucagcagcucugag

SEQ ID NO: 378632 - RNA, 32 nt, Human
ccucccccgccaugugaaacugugaguccauu

SEQ ID NO: 378633 - RNA, 32 nt, Human
ccucccccgccauguggaacugugagucaauu

SEQ ID NO: 378634 - RNA, 16 nt, Human
ccucccccggcugccg

SEQ ID NO: 378635 - RNA, 32 nt, Human
ccucccccuaauucucaucugucagauccagu

SEQ ID NO: 378636 - RNA, 25 nt, Human
ccucccccuagcccagccccaguca

SEQ ID NO: 378637 - RNA, 32 nt, Human
ccucccccucagagaagacaggaggucgggaa

SEQ ID NO: 378638 - RNA, 32 nt, Human
ccucccccucauccuccauucccuuguuuuca

SEQ ID NO: 378639 - RNA, 32 nt, Human
ccucccccucauggagagucagcagcuugggc

SEQ ID NO: 378640 - RNA, 32 nt, Human
ccucccccuccagccuuugccugggaacuggu

SEQ ID NO: 378641 - RNA, 32 nt, Human
ccucccccucccccacucccccuccccggcgc

SEQ ID NO: 378642 - RNA, 32 nt, Human
ccucccccucccccauucccuccauuuuucuc

SEQ ID NO: 378643 - RNA, 32 nt, Human
ccucccccucccccucccccucuuucuucucc

SEQ ID NO: 378644 - RNA, 32 nt, Human
ccucccccucccccucuuucuucuccucccuc

SEQ ID NO: 378645 - RNA, 32 nt, Human
ccucccccucccccuuagucucucugcucccu

SEQ ID NO: 378646 - RNA, 32 nt, Human
ccucccccuccccuacccccauccccuuguga

SEQ ID NO: 378647 - RNA, 32 nt, Human
ccucccccuccccucccccuccccaacucaga

SEQ ID NO: 378648 - RNA, 32 nt, Human
ccucccccuccccuuccuaaugaucccucgca

SEQ ID NO: 378649 - RNA, 21 nt, Human
ccucccccuccugcugugcug

SEQ ID NO: 378650 - RNA, 16 nt, Human
ccucccccucugggga

SEQ ID NO: 378651 - RNA, 32 nt, Human
ccucccccucuuuuccauuucucccuccauca

SEQ ID NO: 378652 - RNA, 32 nt, Human
ccucccccugaccacauacaaaggcacucuag

SEQ ID NO: 378653 - RNA, 32 nt, Human
ccucccccugagcauucauucucuccaccagg

SEQ ID NO: 378654 - RNA, 32 nt, Human
ccucccccugcauuccugucugggugaagagg

SEQ ID NO: 378655 - RNA, 32 nt, Human
ccucccccugccucuucggcuguguuuucucu

SEQ ID NO: 378656 - RNA, 32 nt, Human
ccucccccugcuccgcuccucugcagggccca

SEQ ID NO: 378657 - RNA, 32 nt, Human
ccucccccuggcuucuuucucuugggaaaacg

SEQ ID NO: 378658 - RNA, 20 nt, Human
ccucccccuguguggcccug

SEQ ID NO: 378659 - RNA, 32 nt, Human
ccucccccuucccuccccuuggggaccaccgg

SEQ ID NO: 378660 - RNA, 32 nt, Human
ccucccccuuccucccccucccaccaccagcu

SEQ ID NO: 378661 - RNA, 32 nt, Human
ccucccccuucucccaccccugcccccacuuc

SEQ ID NO: 378662 - RNA, 19 nt, Human
ccucccccuuuuguaaaua

SEQ ID NO: 378663 - RNA, 20 nt, Human
ccuccccgaggacccgccuc

SEQ ID NO: 378664 - RNA, 32 nt, Human
ccuccccgcagcucuucucuucccucuaugag

SEQ ID NO: 378665 - RNA, 32 nt, Human
ccuccccgcaggcagacagugaagagaaucag

SEQ ID NO: 378666 - RNA, 32 nt, Human
ccuccccgcaucuaaaggccccuucaguucuu

SEQ ID NO: 378667 - RNA, 24 nt, Human
ccuccccgccaccccacgcacuca

SEQ ID NO: 378668 - RNA, 23 nt, Human
ccuccccgcccacccgcggcuca

SEQ ID NO: 378669 - RNA, 24 nt, Human
ccuccccgccccgagccccaguca

SEQ ID NO: 378670 - RNA, 19 nt, Human
ccuccccgcccuggugcug

SEQ ID NO: 378671 - RNA, 24 nt, Human
ccuccccgccgagccggcgcccca

SEQ ID NO: 378672 - RNA, 20 nt, Human
ccuccccgcgacccgcaccg

SEQ ID NO: 378673 - RNA, 32 nt, Human
ccuccccgcugccgccuccuccugggcugggc

SEQ ID NO: 378674 - RNA, 32 nt, Human
ccuccccgcuggacgccuucuuccugccgugg

SEQ ID NO: 378675 - RNA, 23 nt, Human
ccuccccggagcggagcgcaccu

SEQ ID NO: 378676 - RNA, 32 nt, Human
ccuccccggccucagguuugcuucacucuucc

SEQ ID NO: 378677 - RNA, 20 nt, Human
ccuccccgggagacaccuca

SEQ ID NO: 378678 - RNA, 20 nt, Human
ccuccccgggagcugacgcc

SEQ ID NO: 378679 - RNA, 20 nt, Human
ccuccccgggcgccggcgcc

SEQ ID NO: 378680 - RNA, 19 nt, Human
ccuccccgucuccuccuca

SEQ ID NO: 378681 - RNA, 32 nt, Human
ccuccccuaagccgccgccaucaugcugcugc

SEQ ID NO: 378682 - RNA, 32 nt, Human
ccuccccuacuggcccuggugugugauguucc

SEQ ID NO: 378683 - RNA, 31 nt, Human
ccuccccuacuucucccuugcucccaaagcu

SEQ ID NO: 378684 - RNA, 32 nt, Human
ccuccccucaagaguucucaccagccuuaguu

SEQ ID NO: 378685 - RNA, 32 nt, Human
ccuccccucacuuccuccugguggucccguug

SEQ ID NO: 378686 - RNA, 32 nt, Human
ccuccccucagcccccagccuccaggccugcu

SEQ ID NO: 378687 - RNA, 32 nt, Human
ccuccccucagguuguucucugauucuuccuc

SEQ ID NO: 378688 - RNA, 32 nt, Human
ccuccccucagugcccuugccccauccccuca

SEQ ID NO: 378689 - RNA, 32 nt, Human
ccuccccuccacccucacaaggagcugccauc

SEQ ID NO: 378690 - RNA, 32 nt, Human
ccuccccuccacuccagcccaccggugacuca

SEQ ID NO: 378691 - RNA, 32 nt, Human
ccuccccuccacugcauaaucauguauaacua

SEQ ID NO: 378692 - RNA, 32 nt, Human
ccuccccuccaggcugauccugaggccuggac

SEQ ID NO: 378693 - RNA, 32 nt, Human
ccuccccucccccagaccuccaccuccuccag

SEQ ID NO: 378694 - RNA, 32 nt, Human
ccuccccuccccuccucagagcccacccugag

SEQ ID NO: 378695 - RNA, 19 nt, Human
ccuccccucccggcuccca

SEQ ID NO: 378696 - RNA, 32 nt, Human
ccuccccuccuauagccccaugguggggcuag

SEQ ID NO: 378697 - RNA, 22 nt, Human
ccuccccucgugucagcucagg

SEQ ID NO: 378698 - RNA, 32 nt, Human
ccuccccucuaguaggcaggccagguuaguga

SEQ ID NO: 378699 - RNA, 32 nt, Human
ccuccccucucccccaggcucuuucuccagcc

SEQ ID NO: 378700 - RNA, 32 nt, Human
ccuccccucuccccuugacuccucuccgaggc

SEQ ID NO: 378701 - RNA, 32 nt, Human
ccuccccucucccucccccucucccucccauc

SEQ ID NO: 378702 - RNA, 32 nt, Human
ccuccccucugccucccauuucugccccugac

SEQ ID NO: 378703 - RNA, 32 nt, Human
ccuccccucugccuuuuaaacccauccccucc

SEQ ID NO: 378704 - RNA, 32 nt, Human
ccuccccucugggaauugggcagcccugggca

SEQ ID NO: 378705 - RNA, 32 nt, Human
ccuccccucuuuccucacccuuuucuagaugu

SEQ ID NO: 378706 - RNA, 32 nt, Human
ccuccccugagagugaggaccucauccgacca

SEQ ID NO: 378707 - RNA, 18 nt, Human
ccuccccugcaccugggg

SEQ ID NO: 378708 - RNA, 32 nt, Human
ccuccccugcagccccgcccgccauggcccgg

SEQ ID NO: 378709 - RNA, 32 nt, Human
ccuccccugcagcgacucggacccgcuacugc

SEQ ID NO: 378710 - RNA, 32 nt, Human
ccuccccugcccccuccacuccggggccugug

SEQ ID NO: 378711 - RNA, 32 nt, Human
ccuccccugccucaccagcccuggcaacugcu

SEQ ID NO: 378712 - RNA, 32 nt, Human
ccuccccugccucaucagccagccugcaugag

SEQ ID NO: 378713 - RNA, 20 nt, Human
ccuccccugccuccaccaua

SEQ ID NO: 378714 - RNA, 32 nt, Human
ccuccccugccuccccuccuuuuuccugucca

SEQ ID NO: 378715 - RNA, 32 nt, Human
ccuccccugccugccuccugccuccccugccu

SEQ ID NO: 378716 - RNA, 32 nt, Human
ccuccccugccugccuccugccuccugccucc

SEQ ID NO: 378717 - RNA, 32 nt, Human
ccuccccugccugccugauuccauggcuguug

SEQ ID NO: 378718 - RNA, 32 nt, Human
ccuccccugccugcucugcagucguggguggg

SEQ ID NO: 378719 - RNA, 32 nt, Human
ccuccccugccuggcugacugccuugcuagaa

SEQ ID NO: 378720 - RNA, 32 nt, Human
ccuccccugccugggcacucccuccucccugc

SEQ ID NO: 378721 - RNA, 32 nt, Human
ccuccccugcuccaugugacccucccucugcc

SEQ ID NO: 378722 - RNA, 32 nt, Human
ccuccccugcucugacaccagggcggcucagc

SEQ ID NO: 378723 - RNA, 32 nt, Human
ccuccccugcugcagcuaacauggaggacuug

SEQ ID NO: 378724 - RNA, 32 nt, Human
ccuccccugggaacaguggcucugguggggag

SEQ ID NO: 378725 - RNA, 32 nt, Human
ccuccccugggagcagaggcccuucuagugug

SEQ ID NO: 378726 - RNA, 32 nt, Human
ccuccccuggggacgccaaggaggugggccac

SEQ ID NO: 378727 - RNA, 21 nt, Human
ccuccccugguuuuuuaggga

SEQ ID NO: 378728 - RNA, 32 nt, Human
ccuccccuguaccucucguaccacagaggaca

SEQ ID NO: 378729 - RNA, 21 nt, Human
ccuccccuguccccucgggca

SEQ ID NO: 378730 - RNA, 32 nt, Human
ccuccccuguucugcucucucagucaacaugu

SEQ ID NO: 378731 - RNA, 32 nt, Human
ccuccccuuccccuagcaacagccauacuuuu

SEQ ID NO: 378732 - RNA, 19 nt, Human
ccuccccuucccuucugga

SEQ ID NO: 378733 - RNA, 32 nt, Human
ccuccccuucugguagucauaggcaggauuga

SEQ ID NO: 378734 - RNA, 32 nt, Human
ccuccccuucuuucucuuccuucugccucccc

SEQ ID NO: 378735 - RNA, 32 nt, Human
ccucccgaaaugcugggauuacaggcaugagc

SEQ ID NO: 378736 - RNA, 32 nt, Human
ccucccgaaaugcuuugggauuacggguguga

SEQ ID NO: 378737 - RNA, 32 nt, Human
ccucccgaaauguugguauuacaggcaugagc

SEQ ID NO: 378738 - RNA, 32 nt, Human
ccucccgaagagcugggauuacacgcauacaa

SEQ ID NO: 378739 - RNA, 32 nt, Human
ccucccgaagugcuggcauuacaggcaugagc

SEQ ID NO: 378740 - RNA, 32 nt, Human
ccucccgaagugcugggauuacaggcaugagc

SEQ ID NO: 378741 - RNA, 32 nt, Human
ccucccgaagugcugggauuacaggcgggagc

SEQ ID NO: 378742 - RNA, 32 nt, Human
ccucccgaagugcugggauuacaggcguaagc

SEQ ID NO: 378743 - RNA, 32 nt, Human
ccucccgaagugcugggauuacaggcgugagc

SEQ ID NO: 378744 - RNA, 32 nt, Human
ccucccgaagugcugggauugcaggcauaagc

SEQ ID NO: 378745 - RNA, 32 nt, Human
ccucccgaagugcugggauugcaggcgugagc

SEQ ID NO: 378746 - RNA, 32 nt, Human
ccucccgaaguguugggauuacaggcacgagc

SEQ ID NO: 378747 - RNA, 32 nt, Human
ccucccgaauagcagggacuacaggcaugcgc

SEQ ID NO: 378748 - RNA, 32 nt, Human
ccucccgaauagcugggacuacaggugugagu

SEQ ID NO: 378749 - RNA, 32 nt, Human
ccucccgaauagcugggauuacaggcgcccgc

SEQ ID NO: 378750 - RNA, 32 nt, Human
ccucccgaauggcugggacuacaggcacccac

SEQ ID NO: 378751 - RNA, 32 nt, Human
ccucccgaccuuuccgagcccucuuugcgccc

SEQ ID NO: 378752 - RNA, 32 nt, Human
ccucccgacguggugggguuacaggcaugagc

SEQ ID NO: 378753 - RNA, 21 nt, Human
ccucccgacucucugcuccuu

SEQ ID NO: 378754 - RNA, 32 nt, Human
ccucccgagaccccuggugcugggcagagcug

SEQ ID NO: 378755 - RNA, 32 nt, Human
ccucccgagcagcugggacuacaggcgcccgc

SEQ ID NO: 378756 - RNA, 32 nt, Human
ccucccgagcagcugggacuacaggcgugcgc

SEQ ID NO: 378757 - RNA, 32 nt, Human
ccucccgagcagcugggauuacaggcgcccac

SEQ ID NO: 378758 - RNA, 32 nt, Human
ccucccgagccaugcugacugugaguuaauaa

SEQ ID NO: 378759 - RNA, 32 nt, Human
ccucccgagcccggggaggggcggggaggaca

SEQ ID NO: 378760 - RNA, 32 nt, Human
ccucccgagcucccaguaggauguccagacac

SEQ ID NO: 378761 - RNA, 32 nt, Human
ccucccgaggaggaaggaaggagagaccccag

SEQ ID NO: 378762 - RNA, 32 nt, Human
ccucccgaggcccagcccuugccucacaguug

SEQ ID NO: 378763 - RNA, 32 nt, Human
ccucccgaguaacugggauuacaggcgggcgc

SEQ ID NO: 378764 - RNA, 32 nt, Human
ccucccgaguaacugggauuacaggcuugugc

SEQ ID NO: 378765 - RNA, 32 nt, Human
ccucccgaguaacugggauuacaggugugugc

SEQ ID NO: 378766 - RNA, 32 nt, Human
ccucccgaguaacugggauuauaggcaugcac

SEQ ID NO: 378767 - RNA, 32 nt, Human
ccucccgaguaccugggacuacaggcacucgc

SEQ ID NO: 378768 - RNA, 32 nt, Human
ccucccgaguaccugggauuacaggcaugcac

SEQ ID NO: 378769 - RNA, 32 nt, Human
ccucccgaguaccugggauuacaggcaugugc

SEQ ID NO: 378770 - RNA, 32 nt, Human
ccucccgaguagcagggauuaccggugugcac

SEQ ID NO: 378771 - RNA, 32 nt, Human
ccucccgaguagcggggauuacaggcacgcgc

SEQ ID NO: 378772 - RNA, 32 nt, Human
ccucccgaguagcggggauuacaggcgcacac

SEQ ID NO: 378773 - RNA, 32 nt, Human
ccucccgaguagcuaggacuacaggcacgugc

SEQ ID NO: 378774 - RNA, 32 nt, Human
ccucccgaguagcuaggauuacagaagcaugc

SEQ ID NO: 378775 - RNA, 32 nt, Human
ccucccgaguagcuaggauuacaggcgcccgc

SEQ ID NO: 378776 - RNA, 32 nt, Human
ccucccgaguagcucagauuacaggcaugugc

SEQ ID NO: 378777 - RNA, 32 nt, Human
ccucccgaguagcugagacuacaggcaccugc

SEQ ID NO: 378778 - RNA, 32 nt, Human
ccucccgaguagcugagacuacaggcaugcac

SEQ ID NO: 378779 - RNA, 32 nt, Human
ccucccgaguagcugagacuacaggugcaugc

SEQ ID NO: 378780 - RNA, 32 nt, Human
ccucccgaguagcugagauuacaggcgcccgc

SEQ ID NO: 378781 - RNA, 32 nt, Human
ccucccgaguagcugagauuacaggugcacac

SEQ ID NO: 378782 - RNA, 32 nt, Human
ccucccgaguagcugagauuacaggugcgcgc

SEQ ID NO: 378783 - RNA, 32 nt, Human
ccucccgaguagcugagauuacagguuuuucu

SEQ ID NO: 378784 - RNA, 32 nt, Human
ccucccgaguagcugagauuauaggcaccuac

SEQ ID NO: 378785 - RNA, 32 nt, Human
ccucccgaguagcugagauuauaggcgugcac

SEQ ID NO: 378786 - RNA, 32 nt, Human
ccucccgaguagcugcaauuacaggagccugc

SEQ ID NO: 378787 - RNA, 32 nt, Human
ccucccgaguagcugcgacuacaggcgccggc

SEQ ID NO: 378788 - RNA, 32 nt, Human
ccucccgaguagcugcuacuagagaugcacca

SEQ ID NO: 378789 - RNA, 32 nt, Human
ccucccgaguagcuggaacuacaggcacacac

SEQ ID NO: 378790 - RNA, 32 nt, Human
ccucccgaguagcuggaauuacagacgccugc

SEQ ID NO: 378791 - RNA, 32 nt, Human
ccucccgaguagcuggaauuacaggcaccugc

SEQ ID NO: 378792 - RNA, 32 nt, Human
ccucccgaguagcuggaauuacaggcaugcgc

SEQ ID NO: 378793 - RNA, 32 nt, Human
ccucccgaguagcuggaauuauaggcgugcac

SEQ ID NO: 378794 - RNA, 32 nt, Human
ccucccgaguagcuggaauugcagacacccau

SEQ ID NO: 378795 - RNA, 32 nt, Human
ccucccgaguagcuggacuaacaggcacacuc

SEQ ID NO: 378796 - RNA, 32 nt, Human
ccucccgaguagcuggauuuacagaugcaugc

SEQ ID NO: 378797 - RNA, 32 nt, Human
ccucccgaguagcuggcacuacaggcacccgc

SEQ ID NO: 378798 - RNA, 32 nt, Human
ccucccgaguagcuggcauuacaggcaugugu

SEQ ID NO: 378799 - RNA, 32 nt, Human
ccucccgaguagcuggcauuacaggcgcccac

SEQ ID NO: 378800 - RNA, 32 nt, Human
ccucccgaguagcuggcauuacaggcgccugc

SEQ ID NO: 378801 - RNA, 32 nt, Human
ccucccgaguagcugggacaacagguacgcac

SEQ ID NO: 378802 - RNA, 32 nt, Human
ccucccgaguagcugggaccacaggggcccac

SEQ ID NO: 378803 - RNA, 32 nt, Human
ccucccgaguagcugggaccacaggugccuac

SEQ ID NO: 378804 - RNA, 32 nt, Human
ccucccgaguagcugggaccacagguguaugg

SEQ ID NO: 378805 - RNA, 32 nt, Human
ccucccgaguagcugggaccgcgggugugugc

SEQ ID NO: 378806 - RNA, 32 nt, Human
ccucccgaguagcugggacuacaagcggcugc

SEQ ID NO: 378807 - RNA, 32 nt, Human
ccucccgaguagcugggacuacaagugugcac

SEQ ID NO: 378808 - RNA, 32 nt, Human
ccucccgaguagcugggacuacacccagcuaa

SEQ ID NO: 378809 - RNA, 32 nt, Human
ccucccgaguagcugggacuacagaagugcac

SEQ ID NO: 378810 - RNA, 32 nt, Human
ccucccgaguagcugggacuacagacacccgc

SEQ ID NO: 378811 - RNA, 32 nt, Human
ccucccgaguagcugggacuacagagucuugc

SEQ ID NO: 378812 - RNA, 32 nt, Human
ccucccgaguagcugggacuacaggagcgugc

SEQ ID NO: 378813 - RNA, 32 nt, Human
ccucccgaguagcugggacuacaggagcgugu

SEQ ID NO: 378814 - RNA, 32 nt, Human
ccucccgaguagcugggacuacaggcacaagu

SEQ ID NO: 378815 - RNA, 32 nt, Human
ccucccgaguagcugggacuacaggcacccac

SEQ ID NO: 378816 - RNA, 32 nt, Human
ccucccgaguagcugggacuacaggcacccgc

SEQ ID NO: 378817 - RNA, 32 nt, Human
ccucccgaguagcugggacuacaggcaccugc

SEQ ID NO: 378818 - RNA, 32 nt, Human
ccucccgaguagcugggacuacaggcacgugc

SEQ ID NO: 378819 - RNA, 32 nt, Human
ccucccgaguagcugggacuacaggcacgugu

SEQ ID NO: 378820 - RNA, 32 nt, Human
ccucccgaguagcugggacuacaggcaggcgc

SEQ ID NO: 378821 - RNA, 32 nt, Human
ccucccgaguagcugggacuacaggcaugcac

SEQ ID NO: 378822 - RNA, 32 nt, Human
ccucccgaguagcugggacuacaggcaugugc

SEQ ID NO: 378823 - RNA, 32 nt, Human
ccucccgaguagcugggacuacaggcgccacc

SEQ ID NO: 378824 - RNA, 32 nt, Human
ccucccgaguagcugggacuacaggcgcccac

SEQ ID NO: 378825 - RNA, 32 nt, Human
ccucccgaguagcugggacuacaggcgcccgc

SEQ ID NO: 378826 - RNA, 32 nt, Human
ccucccgaguagcugggacuacaggcgcccgg

SEQ ID NO: 378827 - RNA, 32 nt, Human
ccucccgaguagcugggacuacaggcgccuau

SEQ ID NO: 378828 - RNA, 32 nt, Human
ccucccgaguagcugggacuacaggcgccugc

SEQ ID NO: 378829 - RNA, 32 nt, Human
ccucccgaguagcugggacuacaggcgcgugc

SEQ ID NO: 378830 - RNA, 32 nt, Human
ccucccgaguagcugggacuacaggcggccgc

SEQ ID NO: 378831 - RNA, 32 nt, Human
ccucccgaguagcugggacuacaggcguccac

SEQ ID NO: 378832 - RNA, 32 nt, Human
ccucccgaguagcugggacuacaggcgugcau

SEQ ID NO: 378833 - RNA, 32 nt, Human
ccucccgaguagcugggacuacaggcguggcc

SEQ ID NO: 378834 - RNA, 32 nt, Human
ccucccgaguagcugggacuacaggcgugugc

SEQ ID NO: 378835 - RNA, 32 nt, Human
ccucccgaguagcugggacuacaggggcccgc

SEQ ID NO: 378836 - RNA, 32 nt, Human
ccucccgaguagcugggacuacagguacccac

SEQ ID NO: 378837 - RNA, 32 nt, Human
ccucccgaguagcugggacuacaggugcacac

SEQ ID NO: 378838 - RNA, 32 nt, Human
ccucccgaguagcugggacuacaggugcaugc

SEQ ID NO: 378839 - RNA, 32 nt, Human
ccucccgaguagcugggacuacaggugccauc

SEQ ID NO: 378840 - RNA, 32 nt, Human
ccucccgaguagcugggacuacaggugcccac

SEQ ID NO: 378841 - RNA, 32 nt, Human
ccucccgaguagcugggacuacaggugcccgc

SEQ ID NO: 378842 - RNA, 32 nt, Human
ccucccgaguagcugggacuacaggugcccuc

SEQ ID NO: 378843 - RNA, 32 nt, Human
ccucccgaguagcugggacuacaggugccugc

SEQ ID NO: 378844 - RNA, 32 nt, Human
ccucccgaguagcugggacuacagguguccac

SEQ ID NO: 378845 - RNA, 32 nt, Human
ccucccgaguagcugggacuacaggugugcca

SEQ ID NO: 378846 - RNA, 32 nt, Human
ccucccgaguagcugggacuacaggugugcgc

SEQ ID NO: 378847 - RNA, 32 nt, Human
ccucccgaguagcugggacuacaggugugggc

SEQ ID NO: 378848 - RNA, 32 nt, Human
ccucccgaguagcugggacuacgggcacgcac

SEQ ID NO: 378849 - RNA, 32 nt, Human
ccucccgaguagcugggacuacugguacaugc

SEQ ID NO: 378850 - RNA, 32 nt, Human
ccucccgaguagcugggacuauagaugcgcca

SEQ ID NO: 378851 - RNA, 32 nt, Human
ccucccgaguagcugggacuauaggcgcccac

SEQ ID NO: 378852 - RNA, 32 nt, Human
ccucccgaguagcugggacuauaggugggcgc

SEQ ID NO: 378853 - RNA, 32 nt, Human
ccucccgaguagcugggacuauaggugugugc

SEQ ID NO: 378854 - RNA, 32 nt, Human
ccucccgaguagcugggacugcaggcacacac

SEQ ID NO: 378855 - RNA, 32 nt, Human
ccucccgaguagcugggacugcaggugugugc

SEQ ID NO: 378856 - RNA, 32 nt, Human
ccucccgaguagcugggacuggaggcgugugc

SEQ ID NO: 378857 - RNA, 32 nt, Human
ccucccgaguagcugggaguacaggcacacac

SEQ ID NO: 378858 - RNA, 32 nt, Human
ccucccgaguagcugggaguacaggugcacac

SEQ ID NO: 378859 - RNA, 32 nt, Human
ccucccgaguagcugggagugcaggugcacac

SEQ ID NO: 378860 - RNA, 32 nt, Human
ccucccgaguagcugggaucacaggugugcgc

SEQ ID NO: 378861 - RNA, 32 nt, Human
ccucccgaguagcugggauuacaagcacccac

SEQ ID NO: 378862 - RNA, 32 nt, Human
ccucccgaguagcugggauuacaagugcacac

SEQ ID NO: 378863 - RNA, 32 nt, Human
ccucccgaguagcugggauuacaagugcgcac

SEQ ID NO: 378864 - RNA, 32 nt, Human
ccucccgaguagcugggauuacagacaugugc

SEQ ID NO: 378865 - RNA, 32 nt, Human
ccucccgaguagcugggauuacagccugaauu

SEQ ID NO: 378866 - RNA, 32 nt, Human
ccucccgaguagcugggauuacaggaagauaa

SEQ ID NO: 378867 - RNA, 32 nt, Human
ccucccgaguagcugggauuacaggaaucugg

SEQ ID NO: 378868 - RNA, 32 nt, Human
ccucccgaguagcugggauuacaggagcgugc

SEQ ID NO: 378869 - RNA, 32 nt, Human
ccucccgaguagcugggauuacaggaggcuga

SEQ ID NO: 378870 - RNA, 32 nt, Human
ccucccgaguagcugggauuacaggaugacgc

SEQ ID NO: 378871 - RNA, 32 nt, Human
ccucccgaguagcugggauuacaggcacacac

SEQ ID NO: 378872 - RNA, 32 nt, Human
ccucccgaguagcugggauuacaggcacacgc

SEQ ID NO: 378873 - RNA, 32 nt, Human
ccucccgaguagcugggauuacaggcacccac

SEQ ID NO: 378874 - RNA, 32 nt, Human
ccucccgaguagcugggauuacaggcacccgc

SEQ ID NO: 378875 - RNA, 32 nt, Human
ccucccgaguagcugggauuacaggcaccugc

SEQ ID NO: 378876 - RNA, 32 nt, Human
ccucccgaguagcugggauuacaggcaccugu

SEQ ID NO: 378877 - RNA, 32 nt, Human
ccucccgaguagcugggauuacaggcacgcac

SEQ ID NO: 378878 - RNA, 32 nt, Human
ccucccgaguagcugggauuacaggcaucugc

SEQ ID NO: 378879 - RNA, 32 nt, Human
ccucccgaguagcugggauuacaggcaugagc

SEQ ID NO: 378880 - RNA, 32 nt, Human
ccucccgaguagcugggauuacaggcaugcac

SEQ ID NO: 378881 - RNA, 32 nt, Human
ccucccgaguagcugggauuacaggcaugcgc

SEQ ID NO: 378882 - RNA, 32 nt, Human
ccucccgaguagcugggauuacaggcaugcuc

SEQ ID NO: 378883 - RNA, 32 nt, Human
ccucccgaguagcugggauuacaggcaugugc

SEQ ID NO: 378884 - RNA, 32 nt, Human
ccucccgaguagcugggauuacaggcgcacgc

SEQ ID NO: 378885 - RNA, 32 nt, Human
ccucccgaguagcugggauuacaggcgcccac

SEQ ID NO: 378886 - RNA, 32 nt, Human
ccucccgaguagcugggauuacaggcgcccgc

SEQ ID NO: 378887 - RNA, 32 nt, Human
ccucccgaguagcugggauuacaggcgccuga

SEQ ID NO: 378888 - RNA, 32 nt, Human
ccucccgaguagcugggauuacaggcgccugc

SEQ ID NO: 378889 - RNA, 32 nt, Human
ccucccgaguagcugggauuacaggcgugcac

SEQ ID NO: 378890 - RNA, 32 nt, Human
ccucccgaguagcugggauuacaggcgugugc

SEQ ID NO: 378891 - RNA, 32 nt, Human
ccucccgaguagcugggauuacaggcgugugu

SEQ ID NO: 378892 - RNA, 32 nt, Human
ccucccgaguagcugggauuacagggugaaga

SEQ ID NO: 378893 - RNA, 32 nt, Human
ccucccgaguagcugggauuacaggugagcac

SEQ ID NO: 378894 - RNA, 32 nt, Human
ccucccgaguagcugggauuacaggugcaugc

SEQ ID NO: 378895 - RNA, 32 nt, Human
ccucccgaguagcugggauuacaggugcccac

SEQ ID NO: 378896 - RNA, 32 nt, Human
ccucccgaguagcugggauuacaggugccugc

SEQ ID NO: 378897 - RNA, 32 nt, Human
ccucccgaguagcugggauuacaggugcgcac

SEQ ID NO: 378898 - RNA, 32 nt, Human
ccucccgaguagcugggauuacaggugcgccc

SEQ ID NO: 378899 - RNA, 32 nt, Human
ccucccgaguagcugggauuacaggugcgcgc

SEQ ID NO: 378900 - RNA, 32 nt, Human
ccucccgaguagcugggauuacagguggugac

SEQ ID NO: 378901 - RNA, 32 nt, Human
ccucccgaguagcugggauuacaggugugcac

SEQ ID NO: 378902 - RNA, 32 nt, Human
ccucccgaguagcugggauuacaggugugggc

SEQ ID NO: 378903 - RNA, 32 nt, Human
ccucccgaguagcugggauuacgggcauaugc

SEQ ID NO: 378904 - RNA, 32 nt, Human
ccucccgaguagcugggauuacgggcgcccgc

SEQ ID NO: 378905 - RNA, 32 nt, Human
ccucccgaguagcugggauuacuggugcccac

SEQ ID NO: 378906 - RNA, 32 nt, Human
ccucccgaguagcugggauuagaggcgccagc

SEQ ID NO: 378907 - RNA, 32 nt, Human
ccucccgaguagcugggauuagaggcgugugc

SEQ ID NO: 378908 - RNA, 32 nt, Human
ccucccgaguagcugggauuauagacacgugc

SEQ ID NO: 378909 - RNA, 32 nt, Human
ccucccgaguagcugggauuauaggcacccgc

SEQ ID NO: 378910 - RNA, 32 nt, Human
ccucccgaguagcugggauuauaggcaccugc

SEQ ID NO: 378911 - RNA, 32 nt, Human
ccucccgaguagcugggauuauaggcgagugc

SEQ ID NO: 378912 - RNA, 32 nt, Human
ccucccgaguagcugggauuaugggcgcccac

SEQ ID NO: 378913 - RNA, 32 nt, Human
ccucccgaguagcugggauuaugggcgcccgc

SEQ ID NO: 378914 - RNA, 32 nt, Human
ccucccgaguagcugggauuccaggcgcccgc

SEQ ID NO: 378915 - RNA, 32 nt, Human
ccucccgaguagcugggauuccaggugcccgc

SEQ ID NO: 378916 - RNA, 32 nt, Human
ccucccgaguagcugggauugcaggagccugg

SEQ ID NO: 378917 - RNA, 32 nt, Human
ccucccgaguagcugggauugcaggcgcccgc

SEQ ID NO: 378918 - RNA, 32 nt, Human
ccucccgaguagcugggauugcagguacccau

SEQ ID NO: 378919 - RNA, 32 nt, Human
ccucccgaguagcugggauugcaggugcccac

SEQ ID NO: 378920 - RNA, 32 nt, Human
ccucccgaguagcugggcuuacgggcacaugc

SEQ ID NO: 378921 - RNA, 32 nt, Human
ccucccgaguagcuggggcuacaggugugugc

SEQ ID NO: 378922 - RNA, 32 nt, Human
ccucccgaguagcugggguuacaggcaugcac

SEQ ID NO: 378923 - RNA, 32 nt, Human
ccucccgaguagcuggguuuacagguaugcac

SEQ ID NO: 378924 - RNA, 32 nt, Human
ccucccgaguagcugguacuacaggcacacau

SEQ ID NO: 378925 - RNA, 32 nt, Human
ccucccgaguagcuuggacuacaggcgugcac

SEQ ID NO: 378926 - RNA, 32 nt, Human
ccucccgaguaggugggauuauaggagcgugc

SEQ ID NO: 378927 - RNA, 32 nt, Human
ccucccgaguaguggaucuaggauccggcuuc

SEQ ID NO: 378928 - RNA, 32 nt, Human
ccucccgaguaguugggauuacaggcgccugc

SEQ ID NO: 378929 - RNA, 32 nt, Human
ccucccgaguaguugggauuacaggugacugc

SEQ ID NO: 378930 - RNA, 32 nt, Human
ccucccgaguaucugggauuauaagcaagagc

SEQ ID NO: 378931 - RNA, 32 nt, Human
ccucccgaguaucuggggcuacaggcauguac

SEQ ID NO: 378932 - RNA, 32 nt, Human
ccucccgagucacugggauuacaggcgcccac

SEQ ID NO: 378933 - RNA, 32 nt, Human
ccucccgagugacucggauuacaggcaugugc

SEQ ID NO: 378934 - RNA, 32 nt, Human
ccucccgaguggcugggauuagcggcaugcac

SEQ ID NO: 378935 - RNA, 23 nt, Human
ccucccgaguugacccccugggg

SEQ ID NO: 378936 - RNA, 32 nt, Human
ccucccgaguugcugggauugcgggcauggug

SEQ ID NO: 378937 - RNA, 32 nt, Human
ccucccgauuagcugggacuacaggcgcccac

SEQ ID NO: 378938 - RNA, 32 nt, Human
ccucccgauuagcugggaucacaggugugcac

SEQ ID NO: 378939 - RNA, 32 nt, Human
ccucccgcaaagcgguuuucugacccucaggg

SEQ ID NO: 378940 - RNA, 32 nt, Human
ccucccgcagccgccgcgggaccggcccccag

SEQ ID NO: 378941 - RNA, 32 nt, Human
ccucccgcagugcugggauuacaggcaugagc

SEQ ID NO: 378942 - RNA, 32 nt, Human
ccucccgccacacaccucuaaucugaauuaca

SEQ ID NO: 378943 - RNA, 32 nt, Human
ccucccgccagccugcccgccugcucgccggc

SEQ ID NO: 378944 - RNA, 32 nt, Human
ccucccgccccgccccucccacgccucaccag

SEQ ID NO: 378945 - RNA, 32 nt, Human
ccucccgcccuucuggccaagcauggcggugc

SEQ ID NO: 378946 - RNA, 15 nt, Human
ccucccgccgcgccg

SEQ ID NO: 378947 - RNA, 32 nt, Human
ccucccgccucagucucccaaagcgcugggau

SEQ ID NO: 378948 - RNA, 32 nt, Human
ccucccgcgccgccaccaugcccaacuucucu

SEQ ID NO: 378949 - RNA, 21 nt, Human
ccucccgcgccuguugguugg

SEQ ID NO: 378950 - RNA, 18 nt, Human
ccucccgcggcuccuucc

SEQ ID NO: 378951 - RNA, 32 nt, Human
ccucccgcuagacucccagccugggcccucug

SEQ ID NO: 378952 - RNA, 21 nt, Human
ccucccgcucaggccacagcc

SEQ ID NO: 378953 - RNA, 32 nt, Human
ccucccgcuccgccgcgcuccagccucgcucu

SEQ ID NO: 378954 - RNA, 32 nt, Human
ccucccgcucucugcgccucagucucccaagc

SEQ ID NO: 378955 - RNA, 32 nt, Human
ccucccgcugacugccccagagccugaaaguc

SEQ ID NO: 378956 - RNA, 32 nt, Human
ccucccggaacaaaagcggaagaggggccagc

SEQ ID NO: 378957 - RNA, 32 nt, Human
ccucccggaacgaaagcggagaagggggccag

SEQ ID NO: 378958 - RNA, 32 nt, Human
ccucccggauagcugggauuacaggcgugcac

SEQ ID NO: 378959 - RNA, 32 nt, Human
ccucccggcccccaugcucccuucucugccau

SEQ ID NO: 378960 - RNA, 20 nt, Human
ccucccggcccccugcuccu

SEQ ID NO: 378961 - RNA, 18 nt, Human
ccucccggccccuccuca

SEQ ID NO: 378962 - RNA, 22 nt, Human
ccucccggcccuugggcugcuc

SEQ ID NO: 378963 - RNA, 22 nt, Human
ccucccggccuggccugcccuu

SEQ ID NO: 378964 - RNA, 19 nt, Human
ccucccggcucgcugcucc

SEQ ID NO: 378965 - RNA, 32 nt, Human
ccucccggcugggcggccccacagacccgcug

SEQ ID NO: 378966 - RNA, 26 nt, Human
ccucccgggaaaacagaggauacagu

SEQ ID NO: 378967 - RNA, 28 nt, Human
ccucccgggaaagcagagguugcaguga

SEQ ID NO: 378968 - RNA, 28 nt, Human
ccucccgggcaagcggagguugcaguga

SEQ ID NO: 378969 - RNA, 32 nt, Human
ccucccgggcgggccuacagccaugucccggg

SEQ ID NO: 378970 - RNA, 32 nt, Human
ccucccgggcuguccgagggaccccaggguac

SEQ ID NO: 378971 - RNA, 28 nt, Human
ccucccggggaagcagagguugcaguga

SEQ ID NO: 378972 - RNA, 28 nt, Human
ccucccggggaagcggagguugcaguga

SEQ ID NO: 378973 - RNA, 32 nt, Human
ccucccggggagcugggaccacaggcacgugc

SEQ ID NO: 378974 - RNA, 32 nt, Human
ccucccggggugcugggauuauaggcgugagc

SEQ ID NO: 378975 - RNA, 32 nt, Human
ccucccgggguuggggacagagcaggugcaga

SEQ ID NO: 378976 - RNA, 28 nt, Human
ccucccggguagacagagguugcaguga

SEQ ID NO: 378977 - RNA, 32 nt, Human
ccucccggguagcugggacuacaggcgccugc

SEQ ID NO: 378978 - RNA, 32 nt, Human
ccucccggguagcugggauuacaggcaugugc

SEQ ID NO: 378979 - RNA, 32 nt, Human
ccucccggguagcugggauugcagacgugcac

SEQ ID NO: 378980 - RNA, 32 nt, Human
ccucccggguagcugguacuacaggcuccugc

SEQ ID NO: 378981 - RNA, 32 nt, Human
ccucccggguccucgggagaugaagcauccgu

SEQ ID NO: 378982 - RNA, 32 nt, Human
ccucccggguggcugggaucacaggcgugcac

SEQ ID NO: 378983 - RNA, 32 nt, Human
ccucccggguggcugggauugcaggcacccac

SEQ ID NO: 378984 - RNA, 28 nt, Human
ccucccggguuugggagguucucagugg

SEQ ID NO: 378985 - RNA, 32 nt, Human
ccucccggucaccuccaaaucuugcugcuuuu

SEQ ID NO: 378986 - RNA, 20 nt, Human
ccucccggugagcugcugcc

SEQ ID NO: 378987 - RNA, 32 nt, Human
ccucccguagccgccuccucccagcagucccc

SEQ ID NO: 378988 - RNA, 21 nt, Human
ccucccguaggaggggggcag

SEQ ID NO: 378989 - RNA, 32 nt, Human
ccucccgucacuccacgcagcuggcagagagc

SEQ ID NO: 378990 - RNA, 32 nt, Human
ccucccgugcugucugucucccccucucuguu

SEQ ID NO: 378991 - RNA, 32 nt, Human
ccucccguguagcugggacuacaggcacgcgc

SEQ ID NO: 378992 - RNA, 32 nt, Human
ccucccguguagcugggauuacaggcgcgcac

SEQ ID NO: 378993 - RNA, 32 nt, Human
ccucccuaacccccuccucccaaaaagcagcc

SEQ ID NO: 378994 - RNA, 32 nt, Human
ccucccuaacccuuaccuucagucuccaccag

SEQ ID NO: 378995 - RNA, 32 nt, Human
ccucccuaagugcugggauuacaggcaugagc

SEQ ID NO: 378996 - RNA, 32 nt, Human
ccucccuaagugcugggauuauaggcgugagc

SEQ ID NO: 378997 - RNA, 32 nt, Human
ccucccuaagugcugggauugcaggcgugagc

SEQ ID NO: 378998 - RNA, 32 nt, Human
ccucccuaaguguugggauuacaggcaugagc

SEQ ID NO: 378999 - RNA, 32 nt, Human
ccucccuaauagcugggacuacaggcaaccac

SEQ ID NO: 379000 - RNA, 32 nt, Human
ccucccuaauaguugggauuacaggcacccgc

SEQ ID NO: 379001 - RNA, 32 nt, Human
ccucccuacccuggcccagcccccugcagggg

SEQ ID NO: 379002 - RNA, 32 nt, Human
ccucccuaccgcuacucuccccaagccugugu

SEQ ID NO: 379003 - RNA, 32 nt, Human
ccucccuaccuguaauuccagucuuugugcau

SEQ ID NO: 379004 - RNA, 32 nt, Human
ccucccuacuuuccuugcuuccuuccuuccuc

SEQ ID NO: 379005 - RNA, 32 nt, Human
ccucccuagcaaugcagaacugugagucaauu

SEQ ID NO: 379006 - RNA, 32 nt, Human
ccucccuaguagcugggacuacagcacccacc

SEQ ID NO: 379007 - RNA, 32 nt, Human
ccucccuaguagcugggacuacaggcacccac

SEQ ID NO: 379008 - RNA, 32 nt, Human
ccucccuaguagcugggacuacaggcaugcac

SEQ ID NO: 379009 - RNA, 32 nt, Human
ccucccuaguagcugggacuacagguaugcac

SEQ ID NO: 379010 - RNA, 32 nt, Human
ccucccuaguagcugggaugacaagcacacgc

SEQ ID NO: 379011 - RNA, 32 nt, Human
ccucccuaguagcugggaugacaggcgccugc

SEQ ID NO: 379012 - RNA, 32 nt, Human
ccucccuaguagcugggauuacagccaugcac

SEQ ID NO: 379013 - RNA, 32 nt, Human
ccucccuaguagcugggauuacaggcacacac

SEQ ID NO: 379014 - RNA, 32 nt, Human
ccucccuaguagcugggauuacaggcaugcac

SEQ ID NO: 379015 - RNA, 32 nt, Human
ccucccuaguagcugggauuacaggcaugugc

SEQ ID NO: 379016 - RNA, 32 nt, Human
ccucccuaguagcugggauuacaggcgcacac

SEQ ID NO: 379017 - RNA, 32 nt, Human
ccucccuaguagcugggauuacaggcgcccgc

SEQ ID NO: 379018 - RNA, 32 nt, Human
ccucccuaguagcugggauuacaggugcacac

SEQ ID NO: 379019 - RNA, 32 nt, Human
ccucccuaguagcugggauuauaggcgccccc

SEQ ID NO: 379020 - RNA, 32 nt, Human
ccucccuaguaucugugauuacaggcacgugc

SEQ ID NO: 379021 - RNA, 32 nt, Human
ccucccuaguggcugggauuacaggcgccugc

SEQ ID NO: 379022 - RNA, 32 nt, Human
ccucccuaucacugcuacuggcucuugguccc

SEQ ID NO: 379023 - RNA, 32 nt, Human
ccucccuaucucuguguaucuggauggcagcc

SEQ ID NO: 379024 - RNA, 32 nt, Human
ccucccuaugggaggcagagcggcaaggacag

SEQ ID NO: 379025 - RNA, 32 nt, Human
ccucccuauuaagcucaucccaccucauggau

SEQ ID NO: 379026 - RNA, 20 nt, Human
ccucccuauuuucuuaggga

SEQ ID NO: 379027 - RNA, 32 nt, Human
ccucccucaccgcacaacucucuuucaccacg

SEQ ID NO: 379028 - RNA, 22 nt, Human
ccucccucacuacugggugcug

SEQ ID NO: 379029 - RNA, 24 nt, Human
ccucccucagagcuggggcagcug

SEQ ID NO: 379030 - RNA, 20 nt, Human
ccucccucagccccccaguc

SEQ ID NO: 379031 - RNA, 32 nt, Human
ccucccucagccugcaaccucuauccuggaac

SEQ ID NO: 379032 - RNA, 32 nt, Human
ccucccucagcuucagagaugggugaaaucaa

SEQ ID NO: 379033 - RNA, 19 nt, Human
ccucccucaucccuuaggg

SEQ ID NO: 379034 - RNA, 31 nt, Human
ccucccucaucuccucugccugugucugcga

SEQ ID NO: 379035 - RNA, 23 nt, Human
ccucccuccacgcuuagggucug

SEQ ID NO: 379036 - RNA, 16 nt, Human
ccucccuccagaugca

SEQ ID NO: 379037 - RNA, 32 nt, Human
ccucccuccagccacuggaccccagccuuggc

SEQ ID NO: 379038 - RNA, 25 nt, Human
ccucccuccagggcccggggcgcug

SEQ ID NO: 379039 - RNA, 32 nt, Human
ccucccuccagucuccggaucucccucggucc

SEQ ID NO: 379040 - RNA, 32 nt, Human
ccucccucccaagucucuucccuucccacucu

SEQ ID NO: 379041 - RNA, 32 nt, Human
ccucccucccacacucgccaucuccugggccg

SEQ ID NO: 379042 - RNA, 32 nt, Human
ccucccucccacacugccccagcagggcuggc

SEQ ID NO: 379043 - RNA, 32 nt, Human
ccucccucccaccuuccucccaccucaccugu

SEQ ID NO: 379044 - RNA, 32 nt, Human
ccucccucccagcguccacuggcuccaggcuc

SEQ ID NO: 379045 - RNA, 32 nt, Human
ccucccucccagcuccugcaccaggaaacggc

SEQ ID NO: 379046 - RNA, 32 nt, Human
ccucccucccagcuugccagggauuugaugag

SEQ ID NO: 379047 - RNA, 32 nt, Human
ccucccucccaggcacccagcacuuuaagccu

SEQ ID NO: 379048 - RNA, 22 nt, Human
ccucccucccauggaagugcug

SEQ ID NO: 379049 - RNA, 32 nt, Human
ccucccuccccaggcaccacuggaccaauuac

SEQ ID NO: 379050 - RNA, 20 nt, Human
ccucccuccccucccuuccc

SEQ ID NO: 379051 - RNA, 32 nt, Human
ccucccuccccuuccuccucugccacccagug

SEQ ID NO: 379052 - RNA, 32 nt, Human
ccucccucccuagcccuuccagccugggacac

SEQ ID NO: 379053 - RNA, 18 nt, Human
ccucccucccuccagaug

SEQ ID NO: 379054 - RNA, 32 nt, Human
ccucccucccucccuuucuuccuuccuuccuu

SEQ ID NO: 379055 - RNA, 32 nt, Human
ccucccucccugcaauccuuccuucuuauucc

SEQ ID NO: 379056 - RNA, 32 nt, Human
ccucccucccuucaccggcccccucccggcuc

SEQ ID NO: 379057 - RNA, 32 nt, Human
ccucccucccuucaccuuuccucuccuggcgg

SEQ ID NO: 379058 - RNA, 32 nt, Human
ccucccucccuuccuuuccuuuccgcuccucu

SEQ ID NO: 379059 - RNA, 32 nt, Human
ccucccucccuuccuuucuuccuuccuucugu

SEQ ID NO: 379060 - RNA, 32 nt, Human
ccucccucccuuucuuccuuccuuccuugaug

SEQ ID NO: 379061 - RNA, 23 nt, Human
ccucccuccggccugggcugcug

SEQ ID NO: 379062 - RNA, 32 nt, Human
ccucccuccuaggucacacuuuucagaaaaag

SEQ ID NO: 379063 - RNA, 32 nt, Human
ccucccuccucacucccuaggcccaagucucc

SEQ ID NO: 379064 - RNA, 32 nt, Human
ccucccuccucccacccacuggcucccucccc

SEQ ID NO: 379065 - RNA, 32 nt, Human
ccucccuccucccucuggaggugaugugggcc

SEQ ID NO: 379066 - RNA, 21 nt, Human
ccucccuccuccugggugcug

SEQ ID NO: 379067 - RNA, 32 nt, Human
ccucccuccucgucauccucccccuucguccu

SEQ ID NO: 379068 - RNA, 17 nt, Human
ccucccuccucuggugu

SEQ ID NO: 379069 - RNA, 32 nt, Human
ccucccuccugccucuuacucuccagcaccga

SEQ ID NO: 379070 - RNA, 16 nt, Human
ccucccuccugcugcc

SEQ ID NO: 379071 - RNA, 32 nt, Human
ccucccuccuggcuggaguugggagggcccca

SEQ ID NO: 379072 - RNA, 19 nt, Human
ccucccuccuucugccucc

SEQ ID NO: 379073 - RNA, 32 nt, Human
ccucccuccuuuccuguccucccuuucugucc

SEQ ID NO: 379074 - RNA, 32 nt, Human
ccucccuccuuuccuuugcccuuaccugucuc

SEQ ID NO: 379075 - RNA, 32 nt, Human
ccucccucgcaaguagcugggauuacaggcgc

SEQ ID NO: 379076 - RNA, 32 nt, Human
ccucccucucagggcugcgcgcccaggucugc

SEQ ID NO: 379077 - RNA, 32 nt, Human
ccucccucucauucccauccuuccugguacug

SEQ ID NO: 379078 - RNA, 20 nt, Human
ccucccucuccccuccgccc

SEQ ID NO: 379079 - RNA, 32 nt, Human
ccucccucuccccucucuacuuuaauucauug

SEQ ID NO: 379080 - RNA, 32 nt, Human
ccucccucuccuccuccuuccccaggguccca

SEQ ID NO: 379081 - RNA, 32 nt, Human
ccucccucuccuccugaugacuuuucaugcca

SEQ ID NO: 379082 - RNA, 32 nt, Human
ccucccucuccucugcuuccagcaugcucuga

SEQ ID NO: 379083 - RNA, 32 nt, Human
ccucccucuccuuuuugauguuuucuuguccc

SEQ ID NO: 379084 - RNA, 32 nt, Human
ccucccucugacuuccuugucacugcagccag

SEQ ID NO: 379085 - RNA, 22 nt, Human
ccucccucugccccacgguccg

SEQ ID NO: 379086 - RNA, 24 nt, Human
ccucccucugccccccagcagccg

SEQ ID NO: 379087 - RNA, 22 nt, Human
ccucccucugccucuccuuccc

SEQ ID NO: 379088 - RNA, 22 nt, Human
ccucccucugcggugggguccg

SEQ ID NO: 379089 - RNA, 23 nt, Human
ccucccucugcuccagcagugcc

SEQ ID NO: 379090 - RNA, 23 nt, Human
ccucccucugcuccccagcucug

SEQ ID NO: 379091 - RNA, 15 nt, Human
ccucccucugcugcc

SEQ ID NO: 379092 - RNA, 32 nt, Human
ccucccucugcuguguucccacagacagaaac

SEQ ID NO: 379093 - RNA, 23 nt, Human
ccucccucugcuugacggggcug

SEQ ID NO: 379094 - RNA, 32 nt, Human
ccucccucuggccccuucucccauggggacau

SEQ ID NO: 379095 - RNA, 32 nt, Human
ccucccucuggggaugaagugggaguauuugg

SEQ ID NO: 379096 - RNA, 17 nt, Human
ccucccucugucaccca

SEQ ID NO: 379097 - RNA, 32 nt, Human
ccucccucuguccaccagcccaugucccugug

SEQ ID NO: 379098 - RNA, 21 nt, Human
ccucccucuguccccgcgucg

SEQ ID NO: 379099 - RNA, 22 nt, Human
ccucccucuguccuugagguug

SEQ ID NO: 379100 - RNA, 23 nt, Human
ccucccucugucucuggagugcc

SEQ ID NO: 379101 - RNA, 23 nt, Human
ccucccucugucuucaggcucug

SEQ ID NO: 379102 - RNA, 32 nt, Human
ccucccucuguuccccgaccucagacccuggg

SEQ ID NO: 379103 - RNA, 19 nt, Human
ccucccucuguugucugcc

SEQ ID NO: 379104 - RNA, 32 nt, Human
ccucccucuguugucugccugugugacacaca

SEQ ID NO: 379105 - RNA, 32 nt, Human
ccucccucuuccagacugcacucucugucauc

SEQ ID NO: 379106 - RNA, 32 nt, Human
ccucccucuucccucacuccugacucuuccuc

SEQ ID NO: 379107 - RNA, 32 nt, Human
ccucccucuuggggcuuuccucaggccacauu

SEQ ID NO: 379108 - RNA, 32 nt, Human
ccucccucuuucccacccuccaccucucacgg

SEQ ID NO: 379109 - RNA, 32 nt, Human
ccucccucuuucuuccuccgcucuuucucuuc

SEQ ID NO: 379110 - RNA, 32 nt, Human
ccucccugaaaccuccuacaguuucugaagaa

SEQ ID NO: 379111 - RNA, 32 nt, Human
ccucccugaacuguccauugcuuuuauagggu

SEQ ID NO: 379112 - RNA, 32 nt, Human
ccucccugaagggaccaaggaggcagguggau

SEQ ID NO: 379113 - RNA, 32 nt, Human
ccucccugaccuggaacucuggcuacagccau

SEQ ID NO: 379114 - RNA, 21 nt, Human
ccucccugacuuuagaggcug

SEQ ID NO: 379115 - RNA, 32 nt, Human
ccucccugagaguccccucccuucucccacac

SEQ ID NO: 379116 - RNA, 32 nt, Human
ccucccugagccacgaggauggagcagccacc

SEQ ID NO: 379117 - RNA, 32 nt, Human
ccucccugaggaccucagacccucucuuccau

SEQ ID NO: 379118 - RNA, 32 nt, Human
ccucccugagggcuggcacugccucccggauc

SEQ ID NO: 379119 - RNA, 18 nt, Human
ccucccugaggucccuca

SEQ ID NO: 379120 - RNA, 26 nt, Human
ccucccugauccccuucauuucuuca

SEQ ID NO: 379121 - RNA, 20 nt, Human
ccucccugcaacaccgagug

SEQ ID NO: 379122 - RNA, 32 nt, Human
ccucccugcacccaugugccugggcuuccccu

SEQ ID NO: 379123 - RNA, 32 nt, Human
ccucccugcagcaccucgccuccuccaggcaa

SEQ ID NO: 379124 - RNA, 32 nt, Human
ccucccugcauugaggccuuguggaccccugg

SEQ ID NO: 379125 - RNA, 32 nt, Human
ccucccugccaaccuccuccucccugcccagc

SEQ ID NO: 379126 - RNA, 32 nt, Human
ccucccugccaagaaucugagagaggccgagu

SEQ ID NO: 379127 - RNA, 32 nt, Human
ccucccugccaccuccccguguuuccaaguca

SEQ ID NO: 379128 - RNA, 32 nt, Human
ccucccugccaugcugggguccuacccagccu

SEQ ID NO: 379129 - RNA, 32 nt, Human
ccucccugcccuccuccucccugggccuucac

SEQ ID NO: 379130 - RNA, 32 nt, Human
ccucccugccuagguuacaugcaguggucauc

SEQ ID NO: 379131 - RNA, 32 nt, Human
ccucccugccucccuuucuuccuuccuuuuua

SEQ ID NO: 379132 - RNA, 31 nt, Human
ccucccugccucuuuguacuuugcucuuuau

SEQ ID NO: 379133 - RNA, 22 nt, Human
ccucccugccuguccuugggga

SEQ ID NO: 379134 - RNA, 32 nt, Human
ccucccugccuuggucccgccaacacaugcga

SEQ ID NO: 379135 - RNA, 19 nt, Human
ccucccugccuuguguccu

SEQ ID NO: 379136 - RNA, 32 nt, Human
ccucccugcgagcuuuuccucugcagagccca

SEQ ID NO: 379137 - RNA, 19 nt, Human
ccucccugcuccaagugca

SEQ ID NO: 379138 - RNA, 22 nt, Human
ccucccugcucucgggccucca

SEQ ID NO: 379139 - RNA, 32 nt, Human
ccucccugcucugcaaccuuucucuucucacg

SEQ ID NO: 379140 - RNA, 32 nt, Human
ccucccugcuggucuugucccucugccccucc

SEQ ID NO: 379141 - RNA, 32 nt, Human
ccucccugcugucauuggcucucccuccaggc

SEQ ID NO: 379142 - RNA, 32 nt, Human
ccucccugcuucaagcuauucucccaccucau

SEQ ID NO: 379143 - RNA, 32 nt, Human
ccucccugcuuccucuggcggaggcggcagga

SEQ ID NO: 379144 - RNA, 32 nt, Human
ccucccugcuuugcauuaacucaucagcaagc

SEQ ID NO: 379145 - RNA, 32 nt, Human
ccucccuggccagccucccucacuucuuucag

SEQ ID NO: 379146 - RNA, 32 nt, Human
ccucccuggcuacauggucaaaaagcuccuug

SEQ ID NO: 379147 - RNA, 29 nt, Human
ccucccuggcugcuuccucucgcucaucc

SEQ ID NO: 379148 - RNA, 32 nt, Human
ccucccugggggacccucgaaggaggcuguca

SEQ ID NO: 379149 - RNA, 32 nt, Human
ccucccuggguuucacaaacagccuugagguu

SEQ ID NO: 379150 - RNA, 32 nt, Human
ccucccugguagcugggauuacaggugugagc

SEQ ID NO: 379151 - RNA, 20 nt, Human
ccucccuggucccuuggaga

SEQ ID NO: 379152 - RNA, 18 nt, Human
ccucccugucccuccuca

SEQ ID NO: 379153 - RNA, 32 nt, Human
ccucccugucugagagaggaggcaggagcccc

SEQ ID NO: 379154 - RNA, 32 nt, Human
ccucccugucugcacugcccaggccagagggu

SEQ ID NO: 379155 - RNA, 32 nt, Human
ccucccugucuguguccauguguuugcauugu

SEQ ID NO: 379156 - RNA, 32 nt, Human
ccucccugugacccguuccauaucccuuucuc

SEQ ID NO: 379157 - RNA, 19 nt, Human
ccucccugugacuaccuca

SEQ ID NO: 379158 - RNA, 32 nt, Human
ccucccugugccggacuccagccggggcgacg

SEQ ID NO: 379159 - RNA, 32 nt, Human
ccucccugugccuucuccaggcccaguucuuc

SEQ ID NO: 379160 - RNA, 32 nt, Human
ccucccuguggcccaaggcucucuucacacuc

SEQ ID NO: 379161 - RNA, 32 nt, Human
ccucccuguggcugaaguguucugaggacugg

SEQ ID NO: 379162 - RNA, 19 nt, Human
ccucccuguggguuugcug

SEQ ID NO: 379163 - RNA, 32 nt, Human
ccucccugugugaccugcccacccaacuccug

SEQ ID NO: 379164 - RNA, 32 nt, Human
ccucccuguuaucugcuagaucuaguucucaa

SEQ ID NO: 379165 - RNA, 32 nt, Human
ccucccuuauucuucuuacuuaaucucagacc

SEQ ID NO: 379166 - RNA, 16 nt, Human
ccucccuucccagguc

SEQ ID NO: 379167 - RNA, 32 nt, Human
ccucccuucccccacuccccacugaccucccu

SEQ ID NO: 379168 - RNA, 32 nt, Human
ccucccuucccccucgccgccgaccgaguucu

SEQ ID NO: 379169 - RNA, 32 nt, Human
ccucccuucccccuggcagguagagacucuac

SEQ ID NO: 379170 - RNA, 32 nt, Human
ccucccuucccugccucuugccugugucccag

SEQ ID NO: 379171 - RNA, 32 nt, Human
ccucccuucccuggccccuucccucucaguga

SEQ ID NO: 379172 - RNA, 32 nt, Human
ccucccuuccgcuccugcccagccugggggaa

SEQ ID NO: 379173 - RNA, 21 nt, Human
ccucccuuccguaaagugcug

SEQ ID NO: 379174 - RNA, 21 nt, Human
ccucccuuccuggcuugggga

SEQ ID NO: 379175 - RNA, 32 nt, Human
ccucccuuccuuccuuccuuccuuccuuccuu

SEQ ID NO: 379176 - RNA, 32 nt, Human
ccucccuucgucucugucugugcuguuggcga

SEQ ID NO: 379177 - RNA, 32 nt, Human
ccucccuucgugugccccugcccagccucuug

SEQ ID NO: 379178 - RNA, 32 nt, Human
ccucccuucuccgcccccuccccuggcuuuga

SEQ ID NO: 379179 - RNA, 32 nt, Human
ccucccuucugaaucgaaguucaagucccgcg

SEQ ID NO: 379180 - RNA, 32 nt, Human
ccucccuucuguguccccuugaggguacccug

SEQ ID NO: 379181 - RNA, 32 nt, Human
ccucccuucuucccuuccaucucccccuccuc

SEQ ID NO: 379182 - RNA, 32 nt, Human
ccucccuucuuccuuuccaaccccuuccuucc

SEQ ID NO: 379183 - RNA, 20 nt, Human
ccucccuucuuuauugggga

SEQ ID NO: 379184 - RNA, 32 nt, Human
ccucccuugcucagugccuccuggccggggcc

SEQ ID NO: 379185 - RNA, 32 nt, Human
ccucccuuggcguggagccagggagcggccgc

SEQ ID NO: 379186 - RNA, 32 nt, Human
ccucccuuguggaugggaggaggcgggaucug

SEQ ID NO: 379187 - RNA, 32 nt, Human
ccucccuuuagcuaugcccacagaucacugag

SEQ ID NO: 379188 - RNA, 32 nt, Human
ccucccuuucccugcucugccugcgggcacug

SEQ ID NO: 379189 - RNA, 32 nt, Human
ccucccuuuccuggaggagccugcugcauucu

SEQ ID NO: 379190 - RNA, 32 nt, Human
ccucccuuucuuccuuccccugagcgccuugg

SEQ ID NO: 379191 - RNA, 23 nt, Human
ccucccuuugccucuaccuggcc

SEQ ID NO: 379192 - RNA, 19 nt, Human
ccucccuuugccuuugagu

SEQ ID NO: 379193 - RNA, 23 nt, Human
ccucccuuuguaaugcugcuccu

SEQ ID NO: 379194 - RNA, 16 nt, Human
ccucccuuuuagguga

SEQ ID NO: 379195 - RNA, 32 nt, Human
ccucccuuuuuacaaucucuguccagcaccuc

SEQ ID NO: 379196 - RNA, 32 nt, Human
ccuccgaaacccacucgggugcacgggucguc

SEQ ID NO: 379197 - RNA, 24 nt, Human
ccuccgaaaccccaacccugaggg

SEQ ID NO: 379198 - RNA, 32 nt, Human
ccuccgaaagugcugagauuacaguugcgagc

SEQ ID NO: 379199 - RNA, 32 nt, Human
ccuccgaaagugcugggauuacaggcgugagc

SEQ ID NO: 379200 - RNA, 32 nt, Human
ccuccgaagccaugcggaacugugagucaguu

SEQ ID NO: 379201 - RNA, 21 nt, Human
ccuccgaagcugcgcuccugg

SEQ ID NO: 379202 - RNA, 32 nt, Human
ccuccgaaguagcugggaauuacaggcaccca

SEQ ID NO: 379203 - RNA, 32 nt, Human
ccuccgaaguagcugggauuacaggcgcccgc

SEQ ID NO: 379204 - RNA, 32 nt, Human
ccuccgacccccacccuaccccggcuggagua

SEQ ID NO: 379205 - RNA, 32 nt, Human
ccuccgacccucccaugcgggugcacacgaag

SEQ ID NO: 379206 - RNA, 32 nt, Human
ccuccgaccuguguaggguguggacccaguaa

SEQ ID NO: 379207 - RNA, 25 nt, Human
ccuccgacucuaaacaagggacuug

SEQ ID NO: 379208 - RNA, 32 nt, Human
ccuccgacucuuucgcccgccugguggagcug

SEQ ID NO: 379209 - RNA, 32 nt, Human
ccuccgagacccaggcugagcccaguccccuc

SEQ ID NO: 379210 - RNA, 32 nt, Human
ccuccgagcagcccggggauccagcacgcagg

SEQ ID NO: 379211 - RNA, 32 nt, Human
ccuccgagcccgccgccacauccucugagaag

SEQ ID NO: 379212 - RNA, 32 nt, Human
ccuccgagcugcaaggagggugcgcuggagga

SEQ ID NO: 379213 - RNA, 32 nt, Human
ccuccgaggaacugggcgcuugcagugcguug

SEQ ID NO: 379214 - RNA, 32 nt, Human
ccuccgaggaagagaagaauggcagugaagag

SEQ ID NO: 379215 - RNA, 20 nt, Human
ccuccgaggcccccagcugg

SEQ ID NO: 379216 - RNA, 32 nt, Human
ccuccgaugccuggccugccagacacugcgcc

SEQ ID NO: 379217 - RNA, 24 nt, Human
ccuccgauugucccuuggggguua

SEQ ID NO: 379218 - RNA, 24 nt, Human
ccuccgauuucauccucagacgua

SEQ ID NO: 379219 - RNA, 32 nt, Human
ccuccgcacacaccccaccccagccugcuaua

SEQ ID NO: 379220 - RNA, 32 nt, Human
ccuccgcaccacugaccucuugucuccuauug

SEQ ID NO: 379221 - RNA, 32 nt, Human
ccuccgcaccacugaccucuugucuccuguug

SEQ ID NO: 379222 - RNA, 32 nt, Human
ccuccgcacccguuaaguucuccggucgggcg

SEQ ID NO: 379223 - RNA, 32 nt, Human
ccuccgcaccuugagcauuaggccaguucucc

SEQ ID NO: 379224 - RNA, 18 nt, Human
ccuccgcacuguuaccca

SEQ ID NO: 379225 - RNA, 32 nt, Human
ccuccgcagaugagguuccugccccuuccucc

SEQ ID NO: 379226 - RNA, 32 nt, Human
ccuccgcagcagcccggcagacugccucuguc

SEQ ID NO: 379227 - RNA, 32 nt, Human
ccuccgcaguagcugggacuacaggcaugcac

SEQ ID NO: 379228 - RNA, 32 nt, Human
ccuccgccacagccacagccccugccccugcu

SEQ ID NO: 379229 - RNA, 32 nt, Human
ccuccgccacauccuccaccucucuuggucca

SEQ ID NO: 379230 - RNA, 32 nt, Human
ccuccgccacccuccuggaauauggccuaggc

SEQ ID NO: 379231 - RNA, 18 nt, Human
ccuccgccaccgccgccg

SEQ ID NO: 379232 - RNA, 16 nt, Human
ccuccgccaccggccg

SEQ ID NO: 379233 - RNA, 32 nt, Human
ccuccgccagaccucacuggccuggcuggacc

SEQ ID NO: 379234 - RNA, 19 nt, Human
ccuccgccagccgccucca

SEQ ID NO: 379235 - RNA, 19 nt, Human
ccuccgcccaggcccucca

SEQ ID NO: 379236 - RNA, 22 nt, Human
ccuccgcccccucuggaggcug

SEQ ID NO: 379237 - RNA, 16 nt, Human
ccuccgccccuguccu

SEQ ID NO: 379238 - RNA, 32 nt, Human
ccuccgcccgcccgccugccugccugcccgcc

SEQ ID NO: 379239 - RNA, 16 nt, Human
ccuccgcccgcugcug

SEQ ID NO: 379240 - RNA, 32 nt, Human
ccuccgcccucccccauucacacuagccuaua

SEQ ID NO: 379241 - RNA, 32 nt, Human
ccuccgcccuuuccucuccccaccuuccucuc

SEQ ID NO: 379242 - RNA, 32 nt, Human
ccuccgccgaggcgcgagguugcggcgcgcag

SEQ ID NO: 379243 - RNA, 32 nt, Human
ccuccgccuccacccccauccuggaacccugg

SEQ ID NO: 379244 - RNA, 32 nt, Human
ccuccgccuccaccucccccugccacagaggg

SEQ ID NO: 379245 - RNA, 32 nt, Human
ccuccgccuccaggaagaccagacucccaccc

SEQ ID NO: 379246 - RNA, 32 nt, Human
ccuccgccuccccugggguuucccuuucggcg

SEQ ID NO: 379247 - RNA, 21 nt, Human
ccuccgccucccucucgggca

SEQ ID NO: 379248 - RNA, 32 nt, Human
ccuccgccuccuccuccuccucuuccuccucc

SEQ ID NO: 379249 - RNA, 32 nt, Human
ccuccgccuccuggcccugccucuauuuauug

SEQ ID NO: 379250 - RNA, 32 nt, Human
ccuccgccuccuggggucaggcuguucuccug

SEQ ID NO: 379251 - RNA, 32 nt, Human
ccuccgccucugcacuccagccugggugacaa

SEQ ID NO: 379252 - RNA, 32 nt, Human
ccuccgccuuccugaguucaagcgauucuccu

SEQ ID NO: 379253 - RNA, 32 nt, Human
ccuccgccuuccugguucaagugauucuccug

SEQ ID NO: 379254 - RNA, 32 nt, Human
ccuccgcgagccccaaccaguagacgguuccc

SEQ ID NO: 379255 - RNA, 32 nt, Human
ccuccgcgauggcagagguggaggaaaccuua

SEQ ID NO: 379256 - RNA, 32 nt, Human
ccuccgcggcggguuugggugcaguggacccg

SEQ ID NO: 379257 - RNA, 32 nt, Human
ccuccgcggggcagcgucuccgggccggccgc

SEQ ID NO: 379258 - RNA, 32 nt, Human
ccuccgcgucccucgccccagcccccugcccg

SEQ ID NO: 379259 - RNA, 32 nt, Human
ccuccgcguggcucacuccagccucggauguu

SEQ ID NO: 379260 - RNA, 19 nt, Human
ccuccgcucaauuuacuua

SEQ ID NO: 379261 - RNA, 32 nt, Human
ccuccgcuccucucccccgccccucccgggcc

SEQ ID NO: 379262 - RNA, 32 nt, Human
ccuccgcucugcccugguagcccuucacgaag

SEQ ID NO: 379263 - RNA, 32 nt, Human
ccuccgcugcccggcccugcgccccgccgagc

SEQ ID NO: 379264 - RNA, 32 nt, Human
ccuccgcugggaggaaccugaaccugggaacc

SEQ ID NO: 379265 - RNA, 32 nt, Human
ccuccgcuguaaccagcuggucuggguguagc

SEQ ID NO: 379266 - RNA, 32 nt, Human
ccuccgcuguccaguuccuccugcugcggccu

SEQ ID NO: 379267 - RNA, 32 nt, Human
ccuccgcuuccucuccuaggcgacgagaccca

SEQ ID NO: 379268 - RNA, 18 nt, Human
ccuccgcuugccgcugcu

SEQ ID NO: 379269 - RNA, 32 nt, Human
ccuccggaagugcugggauuacaggcgugagc

SEQ ID NO: 379270 - RNA, 32 nt, Human
ccuccggacccgauccugcagcucuuucugga

SEQ ID NO: 379271 - RNA, 32 nt, Human
ccuccggaccuaccucagggagcugagcgugc

SEQ ID NO: 379272 - RNA, 32 nt, Human
ccuccggacuccugcacgaccugcuccuacag

SEQ ID NO: 379273 - RNA, 32 nt, Human
ccuccggaggggccagucugggccugacaccc

SEQ ID NO: 379274 - RNA, 32 nt, Human
ccuccggaggggucuugguguccucugacuuc

SEQ ID NO: 379275 - RNA, 32 nt, Human
ccuccggaguaacuggcauuacaggcgccugc

SEQ ID NO: 379276 - RNA, 32 nt, Human
ccuccggaguagcugcgacuacaggcgcgcac

SEQ ID NO: 379277 - RNA, 32 nt, Human
ccuccggaguagcugggaauacaggugcaggc

SEQ ID NO: 379278 - RNA, 32 nt, Human
ccuccggaguagcugggaccacaggcgcccac

SEQ ID NO: 379279 - RNA, 32 nt, Human
ccuccggaguagcugggaccacagguucaugc

SEQ ID NO: 379280 - RNA, 32 nt, Human
ccuccggaguagcugggauuacaggcacaugc

SEQ ID NO: 379281 - RNA, 32 nt, Human
ccuccggaguagcugggauuacaggcacgugc

SEQ ID NO: 379282 - RNA, 32 nt, Human
ccuccggaguagcugggauuacaggcaugcac

SEQ ID NO: 379283 - RNA, 32 nt, Human
ccuccggaguagcugggauuacaggcgccugc

SEQ ID NO: 379284 - RNA, 32 nt, Human
ccuccggaguagcugggauuacaggcgugcgc

SEQ ID NO: 379285 - RNA, 32 nt, Human
ccuccggaguagcugggauugcaggcacccgc

SEQ ID NO: 379286 - RNA, 32 nt, Human
ccuccggaguagcugggguuacaggcacgggc

SEQ ID NO: 379287 - RNA, 32 nt, Human
ccuccggccagcugccugcccucuugucugug

SEQ ID NO: 379288 - RNA, 32 nt, Human
ccuccggccgguccccagcugcaguggcugcc

SEQ ID NO: 379289 - RNA, 21 nt, Human
ccuccggccucggccccgccc

SEQ ID NO: 379290 - RNA, 32 nt, Human
ccuccggccugcacucccccaguucccgggcc

SEQ ID NO: 379291 - RNA, 32 nt, Human
ccuccggccugggaguggcucaucccgcaccu

SEQ ID NO: 379292 - RNA, 32 nt, Human
ccuccggcgggggcgagggccacccaccucca

SEQ ID NO: 379293 - RNA, 32 nt, Human
ccuccggcucccugcauugccuggugagaggg

SEQ ID NO: 379294 - RNA, 22 nt, Human
ccuccggcuccuauggagccua

SEQ ID NO: 379295 - RNA, 23 nt, Human
ccuccggcugggaggggccguag

SEQ ID NO: 379296 - RNA, 20 nt, Human
ccuccggcuggggggcgcgg

SEQ ID NO: 379297 - RNA, 32 nt, Human
ccuccggcuggguggaggaugccaggaagggg

SEQ ID NO: 379298 - RNA, 23 nt, Human
ccuccggcuuccugucggggcuu

SEQ ID NO: 379299 - RNA, 20 nt, Human
ccuccgggagcggcagcagu

SEQ ID NO: 379300 - RNA, 18 nt, Human
ccuccgggaggggcgcgg

SEQ ID NO: 379301 - RNA, 32 nt, Human
ccuccgggccacacccucagcugccucuucag

SEQ ID NO: 379302 - RNA, 32 nt, Human
ccuccgggcccagcucuuccucccggcugcau

SEQ ID NO: 379303 - RNA, 32 nt, Human
ccuccggggagaaaggacacugccccuccccc

SEQ ID NO: 379304 - RNA, 19 nt, Human
ccuccggggaggggcacag

SEQ ID NO: 379305 - RNA, 24 nt, Human
ccuccggggcacgcucggggccug

SEQ ID NO: 379306 - RNA, 21 nt, Human
ccuccggggcagcagcagcgg

SEQ ID NO: 379307 - RNA, 19 nt, Human
ccuccggggggcggugcag

SEQ ID NO: 379308 - RNA, 32 nt, Human
ccuccgggguagcugggaccacaggcacgcgc

SEQ ID NO: 379309 - RNA, 32 nt, Human
ccuccgguaccugauccauagaacagcagaga

SEQ ID NO: 379310 - RNA, 32 nt, Human
ccuccgguuaucaagcaaaaugucucuugugg

SEQ ID NO: 379311 - RNA, 32 nt, Human
ccuccguaacagcugcccugccuacaccugca

SEQ ID NO: 379312 - RNA, 32 nt, Human
ccuccguacuuaucccugcucucccauuucuc

SEQ ID NO: 379313 - RNA, 16 nt, Human
ccuccguagucaccuc

SEQ ID NO: 379314 - RNA, 24 nt, Human
ccuccgucacaccucugggcgcug

SEQ ID NO: 379315 - RNA, 32 nt, Human
ccuccguccacuugagcucugccucuuccucg

SEQ ID NO: 379316 - RNA, 21 nt, Human
ccuccguccccgcccuccagg

SEQ ID NO: 379317 - RNA, 32 nt, Human
ccuccguccucggccccugccucuugcugcug

SEQ ID NO: 379318 - RNA, 32 nt, Human
ccuccguccugagcagccaccuccagggcccu

SEQ ID NO: 379319 - RNA, 32 nt, Human
ccuccgucgccccuccuguuggguaagggugu

SEQ ID NO: 379320 - RNA, 17 nt, Human
ccuccgucgccgcugcc

SEQ ID NO: 379321 - RNA, 32 nt, Human
ccuccgucucucuccauuguguuccgacccau

SEQ ID NO: 379322 - RNA, 32 nt, Human
ccuccgucugcaaugucccuugcacagcccac

SEQ ID NO: 379323 - RNA, 32 nt, Human
ccuccgucuggccucccuucccuuacaaugug

SEQ ID NO: 379324 - RNA, 32 nt, Human
ccuccgucuuccuguggccuuggggcaucacc

SEQ ID NO: 379325 - RNA, 20 nt, Human
ccuccgugaaaccagccuca

SEQ ID NO: 379326 - RNA, 32 nt, Human
ccuccgugaaaccuggggugggacuguccccu

SEQ ID NO: 379327 - RNA, 19 nt, Human
ccuccgugaccuguccucc

SEQ ID NO: 379328 - RNA, 32 nt, Human
ccuccgugcaccuagcaggagugccaggccac

SEQ ID NO: 379329 - RNA, 32 nt, Human
ccuccgugcauagcucugccuuugggucuugu

SEQ ID NO: 379330 - RNA, 32 nt, Human
ccuccgugcgccgcugccccagaaggcucuua

SEQ ID NO: 379331 - RNA, 20 nt, Human
ccuccguggaauggagcuca

SEQ ID NO: 379332 - RNA, 19 nt, Human
ccuccguggacucacucca

SEQ ID NO: 379333 - RNA, 19 nt, Human
ccuccguggcaucaccuua

SEQ ID NO: 379334 - RNA, 32 nt, Human
ccuccgugggcagcuccucggguggggccugc

SEQ ID NO: 379335 - RNA, 19 nt, Human
ccuccgugggcugcaccca

SEQ ID NO: 379336 - RNA, 32 nt, Human
ccuccgugugaagacauccaacauccacguga

SEQ ID NO: 379337 - RNA, 32 nt, Human
ccuccguguuuggggugggggagcugcuuaga

SEQ ID NO: 379338 - RNA, 32 nt, Human
ccuccguuccccucagccucugagcugaggcc

SEQ ID NO: 379339 - RNA, 32 nt, Human
ccuccguugaaugcaagcucucuucugccuuc

SEQ ID NO: 379340 - RNA, 24 nt, Human
ccuccguuguugcgugagaacccg

SEQ ID NO: 379341 - RNA, 32 nt, Human
ccuccuaaacauucguacacacacaaacacaa

SEQ ID NO: 379342 - RNA, 32 nt, Human
ccuccuaaaguacugggauuuauaggcauaag

SEQ ID NO: 379343 - RNA, 32 nt, Human
ccuccuaaagugccggauuacagguguaagcc

SEQ ID NO: 379344 - RNA, 32 nt, Human
ccuccuaaagugcugcgauuacaggcaugagc

SEQ ID NO: 379345 - RNA, 32 nt, Human
ccuccuaaagugcugggauuacaggcacgcuc

SEQ ID NO: 379346 - RNA, 32 nt, Human
ccuccuaaagugcugggauuacaggcaucugc

SEQ ID NO: 379347 - RNA, 32 nt, Human
ccuccuaaagugcugggauuacaggcaugagc

SEQ ID NO: 379348 - RNA, 32 nt, Human
ccuccuaaagugcugggauuacaggccugagc

SEQ ID NO: 379349 - RNA, 32 nt, Human
ccuccuaaagugcugggauuacaggcgugaac

SEQ ID NO: 379350 - RNA, 32 nt, Human
ccuccuaaagugcugggauuacaggcgugagc

SEQ ID NO: 379351 - RNA, 32 nt, Human
ccuccuaaagugcugggauuacaggugugagc

SEQ ID NO: 379352 - RNA, 32 nt, Human
ccuccuaaagugcugggauuauaggcaugagu

SEQ ID NO: 379353 - RNA, 32 nt, Human
ccuccuaaaugcugggauuacaggcgugagcc

SEQ ID NO: 379354 - RNA, 32 nt, Human
ccuccuaaccauugagccaaugcauugguguc

SEQ ID NO: 379355 - RNA, 32 nt, Human
ccuccuaacccaaagccagcuguuccaggcuc

SEQ ID NO: 379356 - RNA, 32 nt, Human
ccuccuaaccucuuaagagcagucucuucuga

SEQ ID NO: 379357 - RNA, 32 nt, Human
ccuccuaaguaccugggauuacaggcaugugc

SEQ ID NO: 379358 - RNA, 32 nt, Human
ccuccuaaguagcagggauuacaggcaugcac

SEQ ID NO: 379359 - RNA, 32 nt, Human
ccuccuaaguagcugggauuacaagugcccac

SEQ ID NO: 379360 - RNA, 32 nt, Human
ccuccuaaguagcugggauuacaggaaaugag

SEQ ID NO: 379361 - RNA, 32 nt, Human
ccuccuaaguagcugggauuacaggcacccac

SEQ ID NO: 379362 - RNA, 32 nt, Human
ccuccuaaguagcugggauuacaggcaugcgc

SEQ ID NO: 379363 - RNA, 32 nt, Human
ccuccuaaguagcugggauuacaggcgcgugc

SEQ ID NO: 379364 - RNA, 32 nt, Human
ccuccuaaguaucugggauuacaggcaugugc

SEQ ID NO: 379365 - RNA, 32 nt, Human
ccuccuaagugcugggauuacagacgugagcu

SEQ ID NO: 379366 - RNA, 32 nt, Human
ccuccuaagugcugggauuacaggcgugaacc

SEQ ID NO: 379367 - RNA, 32 nt, Human
ccuccuacaagguuuugaguuggcugcugguu

SEQ ID NO: 379368 - RNA, 32 nt, Human
ccuccuacacaucuauaauccccaccccaugg

SEQ ID NO: 379369 - RNA, 32 nt, Human
ccuccuacagcacuccaccuugggaccuguuu

SEQ ID NO: 379370 - RNA, 32 nt, Human
ccuccuacaguuccucccagcagucccucaac

SEQ ID NO: 379371 - RNA, 24 nt, Human
ccuccuacccagcagcucugaugu

SEQ ID NO: 379372 - RNA, 23 nt, Human
ccuccuaccccaacuuccggucc

SEQ ID NO: 379373 - RNA, 32 nt, Human
ccuccuaccccagagcagcuggcuccauuggc

SEQ ID NO: 379374 - RNA, 20 nt, Human
ccuccuacccccuacucugg

SEQ ID NO: 379375 - RNA, 15 nt, Human
ccuccuaccccuucc

SEQ ID NO: 379376 - RNA, 21 nt, Human
ccuccuacccgcagcuccugg

SEQ ID NO: 379377 - RNA, 21 nt, Human
ccuccuacccgggccuccgug

SEQ ID NO: 379378 - RNA, 32 nt, Human
ccuccuacccugcuauuucuuuacaucucucu

SEQ ID NO: 379379 - RNA, 22 nt, Human
ccuccuaccugggccucugcgu

SEQ ID NO: 379380 - RNA, 32 nt, Human
ccuccuacgcaaaaacaguuuggugcagacua

SEQ ID NO: 379381 - RNA, 32 nt, Human
ccuccuacugcucuuccucucucccucucuua

SEQ ID NO: 379382 - RNA, 32 nt, Human
ccuccuacuguaccucgugccugcugcggcug

SEQ ID NO: 379383 - RNA, 32 nt, Human
ccuccuacuucccucacucccuuucuccuuug

SEQ ID NO: 379384 - RNA, 32 nt, Human
ccuccuagacaagauggagaagucaccacugg

SEQ ID NO: 379385 - RNA, 22 nt, Human
ccuccuagagaccaggcugcca

SEQ ID NO: 379386 - RNA, 32 nt, Human
ccuccuagagugcagggauuacaggcgugagc

SEQ ID NO: 379387 - RNA, 32 nt, Human
ccuccuagagugcugggauuacagacaugagc

SEQ ID NO: 379388 - RNA, 32 nt, Human
ccuccuagagugcugggauuacaggugugagc

SEQ ID NO: 379389 - RNA, 32 nt, Human
ccuccuagauaacugggauuacaggugcccac

SEQ ID NO: 379390 - RNA, 21 nt, Human
ccuccuagcucccucuugugu

SEQ ID NO: 379391 - RNA, 32 nt, Human
ccuccuagcucuucgcagagcaaccaggagcc

SEQ ID NO: 379392 - RNA, 32 nt, Human
ccuccuaggaaauaugcaguaagauggauugu

SEQ ID NO: 379393 - RNA, 20 nt, Human
ccuccuaggagggggagcgg

SEQ ID NO: 379394 - RNA, 32 nt, Human
ccuccuagggugcugggauugcaggccugagc

SEQ ID NO: 379395 - RNA, 27 nt, Human
ccuccuaguacuccacaagcugcuccu

SEQ ID NO: 379396 - RNA, 32 nt, Human
ccuccuagugggcucccggggcaccgugggag

SEQ ID NO: 379397 - RNA, 32 nt, Human
ccuccuauaaagcacugggauuacaggcauuu

SEQ ID NO: 379398 - RNA, 32 nt, Human
ccuccuaucaguucaaaacaacacaugaaacc

SEQ ID NO: 379399 - RNA, 32 nt, Human
ccuccuauccccaccuacuccugggucaggag

SEQ ID NO: 379400 - RNA, 32 nt, Human
ccuccuaucuucugguuguuccuugccuucug

SEQ ID NO: 379401 - RNA, 32 nt, Human
ccuccuaugccaccugccugggccccuccugg

SEQ ID NO: 379402 - RNA, 32 nt, Human
ccuccuauuuuaaaaugcugagucgaucccac

SEQ ID NO: 379403 - RNA, 32 nt, Human
ccuccucaaauuaaccucauacccagaaaccc

SEQ ID NO: 379404 - RNA, 32 nt, Human
ccuccucacauggcaggugagcacagacuucu

SEQ ID NO: 379405 - RNA, 32 nt, Human
ccuccucaccacccucauccggcucuucaggg

SEQ ID NO: 379406 - RNA, 32 nt, Human
ccuccucacccaaggaguucugcuguacaaac

SEQ ID NO: 379407 - RNA, 32 nt, Human
ccuccucaccuccaaagccccacccagugcac

SEQ ID NO: 379408 - RNA, 32 nt, Human
ccuccucaccuugcauagcaccuuugcaagcc

SEQ ID NO: 379409 - RNA, 32 nt, Human
ccuccucacugcagcccccacagccucaggcc

SEQ ID NO: 379410 - RNA, 32 nt, Human
ccuccucacugcauccccaauccccuucccag

SEQ ID NO: 379411 - RNA, 32 nt, Human
ccuccucacuggagacuacaagugguggguca

SEQ ID NO: 379412 - RNA, 32 nt, Human
ccuccucagacacucagacaccacuccaggcu

SEQ ID NO: 379413 - RNA, 32 nt, Human
ccuccucagacuccugagaucgccucccuccc

SEQ ID NO: 379414 - RNA, 32 nt, Human
ccuccucagcaacgcacguccaucaggccugg

SEQ ID NO: 379415 - RNA, 32 nt, Human
ccuccucagcaacuggaauuccucaaguuagu

SEQ ID NO: 379416 - RNA, 32 nt, Human
ccuccucagcaugcaggaggcugcccuguagg

SEQ ID NO: 379417 - RNA, 32 nt, Human
ccuccucagccacagagaacugugaguucauu

SEQ ID NO: 379418 - RNA, 32 nt, Human
ccuccucagccauguggaauuguaaguucaau

SEQ ID NO: 379419 - RNA, 32 nt, Human
ccuccucagcucccugccuguuucccguaagg

SEQ ID NO: 379420 - RNA, 22 nt, Human
ccuccucaggcccagcugcucc

SEQ ID NO: 379421 - RNA, 32 nt, Human
ccuccucaggcuuaaaucucaggcuucacauu

SEQ ID NO: 379422 - RNA, 32 nt, Human
ccuccucagggagggcaggagagccugaggag

SEQ ID NO: 379423 - RNA, 32 nt, Human
ccuccucaggggguaggagagcacugccucua

SEQ ID NO: 379424 - RNA, 32 nt, Human
ccuccucaguagcugagauuacaggcaugcac

SEQ ID NO: 379425 - RNA, 32 nt, Human
ccuccucaguagcugggauuacaggcaugugc

SEQ ID NO: 379426 - RNA, 32 nt, Human
ccuccucagucgggaagaguccugcuaaaaau

SEQ ID NO: 379427 - RNA, 32 nt, Human
ccuccucauccagacuugccugugagugcccc

SEQ ID NO: 379428 - RNA, 32 nt, Human
ccuccucauccuccuccuccucuuccuccucc

SEQ ID NO: 379429 - RNA, 32 nt, Human
ccuccucaucuucuuccugcuccuccaccucc

SEQ ID NO: 379430 - RNA, 32 nt, Human
ccuccucauguuucaacauuccaucuucccgu

SEQ ID NO: 379431 - RNA, 32 nt, Human
ccuccuccaaaugccagcugugcccacaagcu

SEQ ID NO: 379432 - RNA, 32 nt, Human
ccuccuccacccccucucccaucacccucccc

SEQ ID NO: 379433 - RNA, 32 nt, Human
ccuccuccaccgacuguacuucaucaaccuuc

SEQ ID NO: 379434 - RNA, 32 nt, Human
ccuccuccaccuccaccucucuucccagagac

SEQ ID NO: 379435 - RNA, 32 nt, Human
ccuccuccaccugcgccucccuugucugaacu

SEQ ID NO: 379436 - RNA, 32 nt, Human
ccuccuccacucacuccagcccaacagaagga

SEQ ID NO: 379437 - RNA, 32 nt, Human
ccuccuccagagagcucaguuggaaaggcccu

SEQ ID NO: 379438 - RNA, 32 nt, Human
ccuccuccagcuccaccucccucccucccucc

SEQ ID NO: 379439 - RNA, 32 nt, Human
ccuccuccagcuuccuggccucccagccacuu

SEQ ID NO: 379440 - RNA, 32 nt, Human
ccuccuccaggccugccucccacuucacugcg

SEQ ID NO: 379441 - RNA, 32 nt, Human
ccuccuccaucuuuauucaucuuugucuuccc

SEQ ID NO: 379442 - RNA, 32 nt, Human
ccuccucccacaccggcuguggagccaagagg

SEQ ID NO: 379443 - RNA, 32 nt, Human
ccuccucccacucacacccaagugggccugga

SEQ ID NO: 379444 - RNA, 19 nt, Human
ccuccucccacugcgacuc

SEQ ID NO: 379445 - RNA, 32 nt, Human
ccuccucccacugucucucaccucccccaccc

SEQ ID NO: 379446 - RNA, 32 nt, Human
ccuccucccacuguguguauguguguauaugu

SEQ ID NO: 379447 - RNA, 32 nt, Human
ccuccucccagaucuuccuuguggccuuccuc

SEQ ID NO: 379448 - RNA, 32 nt, Human
ccuccucccaggcuagugcaaagggcucuuca

SEQ ID NO: 379449 - RNA, 32 nt, Human
ccuccucccaggcuggugugagugugcgugcg

SEQ ID NO: 379450 - RNA, 32 nt, Human
ccuccucccauggcuagaaguggggccugcac

SEQ ID NO: 379451 - RNA, 19 nt, Human
ccuccuccccaaggacuca

SEQ ID NO: 379452 - RNA, 32 nt, Human
ccuccuccccacaaaaucagggauggaggcgc

SEQ ID NO: 379453 - RNA, 32 nt, Human
ccuccuccccaccaccaccaucuccaucaccc

SEQ ID NO: 379454 - RNA, 32 nt, Human
ccuccuccccagggaugccaagcuuggaucau

SEQ ID NO: 379455 - RNA, 32 nt, Human
ccuccuccccaguucagaaugcagcccacagc

SEQ ID NO: 379456 - RNA, 32 nt, Human
ccuccucccccaauucccaggucucacauccc

SEQ ID NO: 379457 - RNA, 32 nt, Human
ccuccucccccuccucucuggcagggaucuca

SEQ ID NO: 379458 - RNA, 32 nt, Human
ccuccucccccucucuccuuccuuccuuuuca

SEQ ID NO: 379459 - RNA, 18 nt, Human
ccuccucccccuuugggg

SEQ ID NO: 379460 - RNA, 32 nt, Human
ccuccuccccuccaccccacacccugugucca

SEQ ID NO: 379461 - RNA, 32 nt, Human
ccuccuccccuccagauccgggccccaggcug

SEQ ID NO: 379462 - RNA, 32 nt, Human
ccuccucccgggcucuuccugcggccuccccu

SEQ ID NO: 379463 - RNA, 32 nt, Human
ccuccucccucacuuauauucuauuaaauccu

SEQ ID NO: 379464 - RNA, 32 nt, Human
ccuccucccucagacccagcgguccaaugcca

SEQ ID NO: 379465 - RNA, 32 nt, Human
ccuccucccucagacccaggaguccagacccc

SEQ ID NO: 379466 - RNA, 32 nt, Human
ccuccucccucagacccaggaguccagccccu

SEQ ID NO: 379467 - RNA, 32 nt, Human
ccuccucccucagacccaggaguccaggcccc

SEQ ID NO: 379468 - RNA, 32 nt, Human
ccuccucccucagacccgggaguccaggcccc

SEQ ID NO: 379469 - RNA, 18 nt, Human
ccuccucccucagacuca

SEQ ID NO: 379470 - RNA, 32 nt, Human
ccuccucccucagacucagagguccaagcccc

SEQ ID NO: 379471 - RNA, 32 nt, Human
ccuccucccucaucucaaaggguccucaaagc

SEQ ID NO: 379472 - RNA, 32 nt, Human
ccuccucccuccaggcagaugcagccccaugc

SEQ ID NO: 379473 - RNA, 32 nt, Human
ccuccucccuccucccccuccucucuggcagg

SEQ ID NO: 379474 - RNA, 32 nt, Human
ccuccucccuccugccgacuccuggguugagc

SEQ ID NO: 379475 - RNA, 32 nt, Human
ccuccucccuccugccucuuacucuccagcac

SEQ ID NO: 379476 - RNA, 32 nt, Human
ccuccucccugccuccucuuggucuagaugga

SEQ ID NO: 379477 - RNA, 16 nt, Human
ccuccucccugcugcc

SEQ ID NO: 379478 - RNA, 32 nt, Human
ccuccucccugucugacucuuccucuuccucc

SEQ ID NO: 379479 - RNA, 19 nt, Human
ccuccucccuucccuuccc

SEQ ID NO: 379480 - RNA, 32 nt, Human
ccuccucccuucugagcacacacacaaccgau

SEQ ID NO: 379481 - RNA, 32 nt, Human
ccuccuccuaagguccuccucagcuucuagac

SEQ ID NO: 379482 - RNA, 32 nt, Human
ccuccuccuaccaucccucacuuggaccuggg

SEQ ID NO: 379483 - RNA, 32 nt, Human
ccuccuccuagccucucucccaaaaaguaaaa

SEQ ID NO: 379484 - RNA, 18 nt, Human
ccuccuccuagguucaag

SEQ ID NO: 379485 - RNA, 32 nt, Human
ccuccuccuauucuguccuuguggacuuaugu

SEQ ID NO: 379486 - RNA, 23 nt, Human
ccuccuccucacugagugccuca

SEQ ID NO: 379487 - RNA, 19 nt, Human
ccuccuccucagccacuca

SEQ ID NO: 379488 - RNA, 24 nt, Human
ccuccuccucaucuuuguggucca

SEQ ID NO: 379489 - RNA, 32 nt, Human
ccuccuccuccaccaccuccugccccaccccu

SEQ ID NO: 379490 - RNA, 32 nt, Human
ccuccuccuccaccuccuccuccuccuccucu

SEQ ID NO: 379491 - RNA, 32 nt, Human
ccuccuccuccaccugcucuccucccuaccca

SEQ ID NO: 379492 - RNA, 32 nt, Human
ccuccuccuccacucccugccucuucucccca

SEQ ID NO: 379493 - RNA, 32 nt, Human
ccuccuccuccaggaagccuucccaguccugg

SEQ ID NO: 379494 - RNA, 32 nt, Human
ccuccuccuccaggggaucuugggaggacucu

SEQ ID NO: 379495 - RNA, 32 nt, Human
ccuccuccuccaggucaggcucggaagccccc

SEQ ID NO: 379496 - RNA, 18 nt, Human
ccuccuccucccaacuca

SEQ ID NO: 379497 - RNA, 32 nt, Human
ccuccuccuccccaccaccaccaucuccauca

SEQ ID NO: 379498 - RNA, 32 nt, Human
ccuccuccucccccucccuuacucccagcucc

SEQ ID NO: 379499 - RNA, 32 nt, Human
ccuccuccucccccucuccgcucugugcucuu

SEQ ID NO: 379500 - RNA, 32 nt, Human
ccuccuccuccccuacaauuccuuuucacaua

SEQ ID NO: 379501 - RNA, 32 nt, Human
ccuccuccuccccucucccucccccucucccu

SEQ ID NO: 379502 - RNA, 32 nt, Human
ccuccuccuccccucuucucuuuuuggcagcc

SEQ ID NO: 379503 - RNA, 32 nt, Human
ccuccuccuccccugccagccucuuccuucuc

SEQ ID NO: 379504 - RNA, 18 nt, Human
ccuccuccucccuccuca

SEQ ID NO: 379505 - RNA, 32 nt, Human
ccuccuccuccuccucaugaccggggugaauu

SEQ ID NO: 379506 - RNA, 32 nt, Human
ccuccuccuccuccucaugucugccucgggcu

SEQ ID NO: 379507 - RNA, 32 nt, Human
ccuccuccuccuccuccucaugucugccucgg

SEQ ID NO: 379508 - RNA, 32 nt, Human
ccuccuccuccuccuccuccggaggugggauc

SEQ ID NO: 379509 - RNA, 32 nt, Human
ccuccuccuccuccuccuccucauccuccucc

SEQ ID NO: 379510 - RNA, 32 nt, Human
ccuccuccuccuccuccuccuccucauccucc

SEQ ID NO: 379511 - RNA, 32 nt, Human
ccuccuccuccuccuccucuccuccuggagca

SEQ ID NO: 379512 - RNA, 32 nt, Human
ccuccuccuccuccuccucuccugcugcuccu

SEQ ID NO: 379513 - RNA, 32 nt, Human
ccuccuccuccuccuccucugguagagcacuc

SEQ ID NO: 379514 - RNA, 32 nt, Human
ccuccuccuccuccucgcccuccccucccgau

SEQ ID NO: 379515 - RNA, 32 nt, Human
ccuccuccuccuccucuccuccuggagcagag

SEQ ID NO: 379516 - RNA, 32 nt, Human
ccuccuccuccuccucuccugcugcuccuggg

SEQ ID NO: 379517 - RNA, 32 nt, Human
ccuccuccuccuccucucuaggcacccccguc

SEQ ID NO: 379518 - RNA, 32 nt, Human
ccuccuccuccuccugcuccccgccgcuuccg

SEQ ID NO: 379519 - RNA, 32 nt, Human
ccuccuccuccuccuucucggcuuccuccuca

SEQ ID NO: 379520 - RNA, 32 nt, Human
ccuccuccuccuccuuggcauccgccucuucu

SEQ ID NO: 379521 - RNA, 32 nt, Human
ccuccuccuccugcuuccccugcucagaguuc

SEQ ID NO: 379522 - RNA, 32 nt, Human
ccuccuccuccuggcccugcugcugcccucgc

SEQ ID NO: 379523 - RNA, 18 nt, Human
ccuccuccuccuugggga

SEQ ID NO: 379524 - RNA, 20 nt, Human
ccuccuccucgucuuagggg

SEQ ID NO: 379525 - RNA, 32 nt, Human
ccuccuccucucuccaccuuaccccagguaca

SEQ ID NO: 379526 - RNA, 32 nt, Human
ccuccuccucuuccucugaggacacagaauug

SEQ ID NO: 379527 - RNA, 32 nt, Human
ccuccuccucuugcuaccuccaccuccaccgc

SEQ ID NO: 379528 - RNA, 32 nt, Human
ccuccuccugcaggcagccacucagccugugc

SEQ ID NO: 379529 - RNA, 32 nt, Human
ccuccuccugggccucagcuugcccagauaca

SEQ ID NO: 379530 - RNA, 21 nt, Human
ccuccuccuggggugccaggg

SEQ ID NO: 379531 - RNA, 32 nt, Human
ccuccuccugugugagucccaccaggagccac

SEQ ID NO: 379532 - RNA, 18 nt, Human
ccuccuccuguuggcugg

SEQ ID NO: 379533 - RNA, 32 nt, Human
ccuccuccuucaccgcccccuucaccaccucu

SEQ ID NO: 379534 - RNA, 32 nt, Human
ccuccuccuuccuuccuccucucccucccucc

SEQ ID NO: 379535 - RNA, 32 nt, Human
ccuccuccuugcaaauuccuuucuucugccuc

SEQ ID NO: 379536 - RNA, 32 nt, Human
ccuccuccuuguccaucuccucuacuccuccu

SEQ ID NO: 379537 - RNA, 32 nt, Human
ccuccucgagugcccugggaccacugggccac

SEQ ID NO: 379538 - RNA, 32 nt, Human
ccuccucgcagugacgucccagggggcggagg

SEQ ID NO: 379539 - RNA, 17 nt, Human
ccuccucgcccugggcu

SEQ ID NO: 379540 - RNA, 32 nt, Human
ccuccucgcgucucucccagaugcagucaccc

SEQ ID NO: 379541 - RNA, 32 nt, Human
ccuccucgcucacccaccccucccucucuucc

SEQ ID NO: 379542 - RNA, 32 nt, Human
ccuccucggacuccugccucacucauuuacac

SEQ ID NO: 379543 - RNA, 32 nt, Human
ccuccucgggcuccacgcgucuugccccgcag

SEQ ID NO: 379544 - RNA, 32 nt, Human
ccuccucgggcugggaaacaggaagcuguguu

SEQ ID NO: 379545 - RNA, 32 nt, Human
ccuccucguccaccccggagaggucagagucc

SEQ ID NO: 379546 - RNA, 32 nt, Human
ccuccucgugccugcccugccucuccacgcac

SEQ ID NO: 379547 - RNA, 22 nt, Human
ccuccucuauuccuuuuaggga

SEQ ID NO: 379548 - RNA, 32 nt, Human
ccuccucucacccuccacccuccaggagaccc

SEQ ID NO: 379549 - RNA, 21 nt, Human
ccuccucucauaaaagagaca

SEQ ID NO: 379550 - RNA, 32 nt, Human
ccuccucuccacccuaccuuccaucaaccagg

SEQ ID NO: 379551 - RNA, 32 nt, Human
ccuccucuccaccucucgcgucgugacaccag

SEQ ID NO: 379552 - RNA, 32 nt, Human
ccuccucuccauccccugaagagcucaggcag

SEQ ID NO: 379553 - RNA, 32 nt, Human
ccuccucucccagggccuccuugcuccuucgu

SEQ ID NO: 379554 - RNA, 32 nt, Human
ccuccucuccccaggccucuggcugcagugau

SEQ ID NO: 379555 - RNA, 18 nt, Human
ccuccucucccuuggaga

SEQ ID NO: 379556 - RNA, 19 nt, Human
ccuccucuccuagcuuccc

SEQ ID NO: 379557 - RNA, 32 nt, Human
ccuccucuccuccucacagcucucaccugucc

SEQ ID NO: 379558 - RNA, 32 nt, Human
ccuccucuccugauccccagcauccagcugag

SEQ ID NO: 379559 - RNA, 32 nt, Human
ccuccucuccuuccacagaccccacaugccca

SEQ ID NO: 379560 - RNA, 19 nt, Human
ccuccucuccuuugagagg

SEQ ID NO: 379561 - RNA, 32 nt, Human
ccuccucucgucccugugccuguggucagcua

SEQ ID NO: 379562 - RNA, 32 nt, Human
ccuccucucucccucacugcucccagcaccuc

SEQ ID NO: 379563 - RNA, 32 nt, Human
ccuccucucucccucccugcucuaguagucca

SEQ ID NO: 379564 - RNA, 32 nt, Human
ccuccucucucccugccucacaucucccuucc

SEQ ID NO: 379565 - RNA, 32 nt, Human
ccuccucucugcucugugcccuaugcaccccc

SEQ ID NO: 379566 - RNA, 32 nt, Human
ccuccucucuuggaagcucacagagcgcuggg

SEQ ID NO: 379567 - RNA, 32 nt, Human
ccuccucucuuuccucacccgguagucccaga

SEQ ID NO: 379568 - RNA, 32 nt, Human
ccuccucugaacuugugguucauucucaggcu

SEQ ID NO: 379569 - RNA, 32 nt, Human
ccuccucugagcgcacagcccauguccucugc

SEQ ID NO: 379570 - RNA, 32 nt, Human
ccuccucugaggauggggcuuguuggugugaa

SEQ ID NO: 379571 - RNA, 20 nt, Human
ccuccucugcacuuugggga

SEQ ID NO: 379572 - RNA, 32 nt, Human
ccuccucugccacccagugccuucuaaagggc

SEQ ID NO: 379573 - RNA, 32 nt, Human
ccuccucugcccugcccaccagccugugauuu

SEQ ID NO: 379574 - RNA, 32 nt, Human
ccuccucugccuccucuuccucauccucgucc

SEQ ID NO: 379575 - RNA, 32 nt, Human
ccuccucugccucuguucgcauaguaagaagg

SEQ ID NO: 379576 - RNA, 32 nt, Human
ccuccucugccuggaagagauuacagggaaau

SEQ ID NO: 379577 - RNA, 32 nt, Human
ccuccucugccuuucaaaaggcuggucaccua

SEQ ID NO: 379578 - RNA, 32 nt, Human
ccuccucugcgucuuccaucuacugaaauggg

SEQ ID NO: 379579 - RNA, 32 nt, Human
ccuccucugcuccuccccacacccugcaggca

SEQ ID NO: 379580 - RNA, 32 nt, Human
ccuccucugcucugcccugcccugcccuggcc

SEQ ID NO: 379581 - RNA, 19 nt, Human
ccuccucugcucuuaggga

SEQ ID NO: 379582 - RNA, 32 nt, Human
ccuccucuggacggcaggcucacugccaggcc

SEQ ID NO: 379583 - RNA, 32 nt, Human
ccuccucuggcccaggacgccugcugcaagcc

SEQ ID NO: 379584 - RNA, 32 nt, Human
ccuccucugggcccucuccuucgucugggaag

SEQ ID NO: 379585 - RNA, 32 nt, Human
ccuccucugucugacugaguuccuuccugugg

SEQ ID NO: 379586 - RNA, 32 nt, Human
ccuccucuguuuagcaaaggagggcagcucac

SEQ ID NO: 379587 - RNA, 32 nt, Human
ccuccucuuagaccaucucuaagaccacuuca

SEQ ID NO: 379588 - RNA, 32 nt, Human
ccuccucuuagagcuccugaauucuggagcau

SEQ ID NO: 379589 - RNA, 32 nt, Human
ccuccucuucacugccuccaccugcucccgcu

SEQ ID NO: 379590 - RNA, 19 nt, Human
ccuccucuucccuuggggg

SEQ ID NO: 379591 - RNA, 32 nt, Human
ccuccucuuccuccuccuccuccaccuccggc

SEQ ID NO: 379592 - RNA, 32 nt, Human
ccuccucuuccuccuccuccuccucucuaggc

SEQ ID NO: 379593 - RNA, 32 nt, Human
ccuccucuuccuccuccucuuccucuucgucu

SEQ ID NO: 379594 - RNA, 32 nt, Human
ccuccucuuccuccuccuggugggugccaugu

SEQ ID NO: 379595 - RNA, 32 nt, Human
ccuccucuuccuucuccuccuccauccccaga

SEQ ID NO: 379596 - RNA, 32 nt, Human
ccuccucuucuuccuguccaugccggccccuc

SEQ ID NO: 379597 - RNA, 17 nt, Human
ccuccucuucuugggga

SEQ ID NO: 379598 - RNA, 32 nt, Human
ccuccucuucuuucuccuuccgaguucgcccu

SEQ ID NO: 379599 - RNA, 32 nt, Human
ccuccucuuucugugagaguccugagucccuc

SEQ ID NO: 379600 - RNA, 32 nt, Human
ccuccucuuuuccucuuuccucccuacuuuuu

SEQ ID NO: 379601 - RNA, 32 nt, Human
ccuccugaaaacagcacugccuuccgcgcugc

SEQ ID NO: 379602 - RNA, 32 nt, Human
ccuccugaaaagcugggauuacagggcccugc

SEQ ID NO: 379603 - RNA, 32 nt, Human
ccuccugaaauccuccaucgcguccuucuggg

SEQ ID NO: 379604 - RNA, 32 nt, Human
ccuccugaacagcugggaccacaggugcacgc

SEQ ID NO: 379605 - RNA, 21 nt, Human
ccuccugaacgucuccuacca

SEQ ID NO: 379606 - RNA, 19 nt, Human
ccuccugaagagccccgcc

SEQ ID NO: 379607 - RNA, 17 nt, Human
ccuccugaagcagaagu

SEQ ID NO: 379608 - RNA, 32 nt, Human
ccuccugaagugcugggauuacaggcaugagc

SEQ ID NO: 379609 - RNA, 32 nt, Human
ccuccugaagugcugggauuacaggcguggcc

SEQ ID NO: 379610 - RNA, 32 nt, Human
ccuccugaaguguugggauuacaggcgugagc

SEQ ID NO: 379611 - RNA, 32 nt, Human
ccuccugaauagcugggaauacaggugcacgc

SEQ ID NO: 379612 - RNA, 32 nt, Human
ccuccugaauagcugggacuacaggcuugcac

SEQ ID NO: 379613 - RNA, 32 nt, Human
ccuccugaauagcugggacuacagguucuauu

SEQ ID NO: 379614 - RNA, 32 nt, Human
ccuccugaauagcugggauuacaggcacccac

SEQ ID NO: 379615 - RNA, 32 nt, Human
ccuccugaauagcugggauuacaggcaccugu

SEQ ID NO: 379616 - RNA, 32 nt, Human
ccuccugaauagcugggauuacaggugcacgc

SEQ ID NO: 379617 - RNA, 32 nt, Human
ccuccugaauaucugggauuacaggugcccgc

SEQ ID NO: 379618 - RNA, 32 nt, Human
ccuccugacacccagagcugugcggggaggca

SEQ ID NO: 379619 - RNA, 21 nt, Human
ccuccugacccugcugcucuu

SEQ ID NO: 379620 - RNA, 32 nt, Human
ccuccugagaagcuaggacuacaggcaugcac

SEQ ID NO: 379621 - RNA, 32 nt, Human
ccuccugagaagcugagauuacaggcaugugc

SEQ ID NO: 379622 - RNA, 32 nt, Human
ccuccugagagccagcccugacgugaacucau

SEQ ID NO: 379623 - RNA, 32 nt, Human
ccuccugagcagcugggacuacagacacaccc

SEQ ID NO: 379624 - RNA, 32 nt, Human
ccuccugagcagcugggacuacaggcacacac

SEQ ID NO: 379625 - RNA, 32 nt, Human
ccuccugagcagcugggacuacaggcgcaugc

SEQ ID NO: 379626 - RNA, 32 nt, Human
ccuccugagcagcugggacuacaggcgccugc

SEQ ID NO: 379627 - RNA, 32 nt, Human
ccuccugagcagcugggauuacaggcgcacau

SEQ ID NO: 379628 - RNA, 32 nt, Human
ccuccugagcagcugggauuacaggcgcuggc

SEQ ID NO: 379629 - RNA, 32 nt, Human
ccuccugagcagcugggauuacaggugcgugc

SEQ ID NO: 379630 - RNA, 22 nt, Human
ccuccugagcucagcccccacc

SEQ ID NO: 379631 - RNA, 21 nt, Human
ccuccugaggaccgcugcucu

SEQ ID NO: 379632 - RNA, 32 nt, Human
ccuccugaggagcugcgauuacagguaaccuc

SEQ ID NO: 379633 - RNA, 32 nt, Human
ccuccugaggagcugggacuacaggugcgugc

SEQ ID NO: 379634 - RNA, 23 nt, Human
ccuccugaggcagcaccacacca

SEQ ID NO: 379635 - RNA, 32 nt, Human
ccuccugaggcccugaggguggcccugacccc

SEQ ID NO: 379636 - RNA, 32 nt, Human
ccuccugagggaggggcaggagagcagugagg

SEQ ID NO: 379637 - RNA, 32 nt, Human
ccuccugaguaacugagauuacaggcacaagc

SEQ ID NO: 379638 - RNA, 32 nt, Human
ccuccugaguaacugggacuacaggcacagcu

SEQ ID NO: 379639 - RNA, 32 nt, Human
ccuccugaguaacugggauuacagagcccagg

SEQ ID NO: 379640 - RNA, 32 nt, Human
ccuccugaguaacugggauuacagucgugugc

SEQ ID NO: 379641 - RNA, 32 nt, Human
ccuccugaguaacugggguuacaggcgcgcga

SEQ ID NO: 379642 - RNA, 32 nt, Human
ccuccugaguaccugagauuacaggcacccac

SEQ ID NO: 379643 - RNA, 32 nt, Human
ccuccugaguaccugggauuacaggcgcgcau

SEQ ID NO: 379644 - RNA, 32 nt, Human
ccuccugaguaccugggauuacaggugcacac

SEQ ID NO: 379645 - RNA, 32 nt, Human
ccuccugaguaccugggauuauaggcacaagu

SEQ ID NO: 379646 - RNA, 32 nt, Human
ccuccugaguagaugggacuacaggcacaggc

SEQ ID NO: 379647 - RNA, 32 nt, Human
ccuccugaguagccaggacuauggcauguacc

SEQ ID NO: 379648 - RNA, 32 nt, Human
ccuccugaguagcuaggaccauaggcacaugu

SEQ ID NO: 379649 - RNA, 32 nt, Human
ccuccugaguagcuaggacuacaggcaugugc

SEQ ID NO: 379650 - RNA, 32 nt, Human
ccuccugaguagcuaggacuacaggugcaugc

SEQ ID NO: 379651 - RNA, 32 nt, Human
ccuccugaguagcuaggacuacaggugugcac

SEQ ID NO: 379652 - RNA, 32 nt, Human
ccuccugaguagcuaggacuauaggcacacag

SEQ ID NO: 379653 - RNA, 32 nt, Human
ccuccugaguagcuaggacuauaggcaugcac

SEQ ID NO: 379654 - RNA, 32 nt, Human
ccuccugaguagcuaggacugcaggugcucca

SEQ ID NO: 379655 - RNA, 32 nt, Human
ccuccugaguagcuaggacuguaggcauguac

SEQ ID NO: 379656 - RNA, 32 nt, Human
ccuccugaguagcuaggauuacaggcaugugc

SEQ ID NO: 379657 - RNA, 32 nt, Human
ccuccugaguagcuaggauuacaggugccugc

SEQ ID NO: 379658 - RNA, 32 nt, Human
ccuccugaguagcuaggauuacaggugugugc

SEQ ID NO: 379659 - RNA, 32 nt, Human
ccuccugaguagcuaugacuacagguaugugc

SEQ ID NO: 379660 - RNA, 32 nt, Human
ccuccugaguagcugagaccacaggcgugugc

SEQ ID NO: 379661 - RNA, 32 nt, Human
ccuccugaguagcugagacuacaggugagugc

SEQ ID NO: 379662 - RNA, 32 nt, Human
ccuccugaguagcugagauuacaggcacacac

SEQ ID NO: 379663 - RNA, 32 nt, Human
ccuccugaguagcugagauuacaggugcccgc

SEQ ID NO: 379664 - RNA, 32 nt, Human
ccuccugaguagcugagauuacaggugugugc

SEQ ID NO: 379665 - RNA, 32 nt, Human
ccuccugaguagcugagauuauaggccuacca

SEQ ID NO: 379666 - RNA, 32 nt, Human
ccuccugaguagcugauacuacaggcacccac

SEQ ID NO: 379667 - RNA, 32 nt, Human
ccuccugaguagcugcgacuacaggugcaugc

SEQ ID NO: 379668 - RNA, 32 nt, Human
ccuccugaguagcuggaaccacaggcaugugc

SEQ ID NO: 379669 - RNA, 32 nt, Human
ccuccugaguagcuggaauuacaggaggauuc

SEQ ID NO: 379670 - RNA, 32 nt, Human
ccuccugaguagcuggaauuacaggcacccac

SEQ ID NO: 379671 - RNA, 32 nt, Human
ccuccugaguagcuggaauuacaggcaugugc

SEQ ID NO: 379672 - RNA, 32 nt, Human
ccuccugaguagcuggaauuacaggcgcccac

SEQ ID NO: 379673 - RNA, 32 nt, Human
ccuccugaguagcuggaauuauaggcacaugc

SEQ ID NO: 379674 - RNA, 32 nt, Human
ccuccugaguagcuggauuacaggcaugugcc

SEQ ID NO: 379675 - RNA, 32 nt, Human
ccuccugaguagcuggauuacagggccuggcc

SEQ ID NO: 379676 - RNA, 32 nt, Human
ccuccugaguagcuggcacuguaggcauguac

SEQ ID NO: 379677 - RNA, 32 nt, Human
ccuccugaguagcuggcauuauaggugcccac

SEQ ID NO: 379678 - RNA, 32 nt, Human
ccuccugaguagcugggaauacagcaugcgcc

SEQ ID NO: 379679 - RNA, 32 nt, Human
ccuccugaguagcugggaccacaggcgacugc

SEQ ID NO: 379680 - RNA, 32 nt, Human
ccuccugaguagcugggaccacaggcgagugu

SEQ ID NO: 379681 - RNA, 32 nt, Human
ccuccugaguagcugggaccacagguaugcac

SEQ ID NO: 379682 - RNA, 32 nt, Human
ccuccugaguagcugggaccacaggugugugc

SEQ ID NO: 379683 - RNA, 32 nt, Human
ccuccugaguagcugggaccauaggcucacaa

SEQ ID NO: 379684 - RNA, 32 nt, Human
ccuccugaguagcugggaccauaggugugagc

SEQ ID NO: 379685 - RNA, 32 nt, Human
ccuccugaguagcugggacgacaggcgugcac

SEQ ID NO: 379686 - RNA, 32 nt, Human
ccuccugaguagcugggacuacaagcaugcac

SEQ ID NO: 379687 - RNA, 32 nt, Human
ccuccugaguagcugggacuacaagugugcac

SEQ ID NO: 379688 - RNA, 32 nt, Human
ccuccugaguagcugggacuacaaguguguac

SEQ ID NO: 379689 - RNA, 32 nt, Human
ccuccugaguagcugggacuacagaugcauuc

SEQ ID NO: 379690 - RNA, 32 nt, Human
ccuccugaguagcugggacuacagauguaggc

SEQ ID NO: 379691 - RNA, 32 nt, Human
ccuccugaguagcugggacuacaggaauuagu

SEQ ID NO: 379692 - RNA, 32 nt, Human
ccuccugaguagcugggacuacaggagcucgc

SEQ ID NO: 379693 - RNA, 32 nt, Human
ccuccugaguagcugggacuacaggcacacac

SEQ ID NO: 379694 - RNA, 32 nt, Human
ccuccugaguagcugggacuacaggcacaugc

SEQ ID NO: 379695 - RNA, 32 nt, Human
ccuccugaguagcugggacuacaggcacccac

SEQ ID NO: 379696 - RNA, 32 nt, Human
ccuccugaguagcugggacuacaggcacccgc

SEQ ID NO: 379697 - RNA, 32 nt, Human
ccuccugaguagcugggacuacaggcaccugc

SEQ ID NO: 379698 - RNA, 32 nt, Human
ccuccugaguagcugggacuacaggcacgcac

SEQ ID NO: 379699 - RNA, 32 nt, Human
ccuccugaguagcugggacuacaggcacgugc

SEQ ID NO: 379700 - RNA, 32 nt, Human
ccuccugaguagcugggacuacaggcaugagc

SEQ ID NO: 379701 - RNA, 32 nt, Human
ccuccugaguagcugggacuacaggcaugcaa

SEQ ID NO: 379702 - RNA, 32 nt, Human
ccuccugaguagcugggacuacaggcaugcac

SEQ ID NO: 379703 - RNA, 32 nt, Human
ccuccugaguagcugggacuacaggcauguac

SEQ ID NO: 379704 - RNA, 32 nt, Human
ccuccugaguagcugggacuacaggcaugugc

SEQ ID NO: 379705 - RNA, 32 nt, Human
ccuccugaguagcugggacuacaggccccugc

SEQ ID NO: 379706 - RNA, 32 nt, Human
ccuccugaguagcugggacuacaggcgcacac

SEQ ID NO: 379707 - RNA, 32 nt, Human
ccuccugaguagcugggacuacaggcgccagc

SEQ ID NO: 379708 - RNA, 32 nt, Human
ccuccugaguagcugggacuacaggcgcccac

SEQ ID NO: 379709 - RNA, 32 nt, Human
ccuccugaguagcugggacuacaggcgcccgc

SEQ ID NO: 379710 - RNA, 32 nt, Human
ccuccugaguagcugggacuacaggcgccugc

SEQ ID NO: 379711 - RNA, 32 nt, Human
ccuccugaguagcugggacuacaggcgcucgc

SEQ ID NO: 379712 - RNA, 32 nt, Human
ccuccugaguagcugggacuacaggcgugugc

SEQ ID NO: 379713 - RNA, 32 nt, Human
ccuccugaguagcugggacuacaggcucaugc

SEQ ID NO: 379714 - RNA, 32 nt, Human
ccuccugaguagcugggacuacaggcuugcgc

SEQ ID NO: 379715 - RNA, 32 nt, Human
ccuccugaguagcugggacuacaggcuugugc

SEQ ID NO: 379716 - RNA, 32 nt, Human
ccuccugaguagcugggacuacagggacuaug

SEQ ID NO: 379717 - RNA, 32 nt, Human
ccuccugaguagcugggacuacagguaugcac

SEQ ID NO: 379718 - RNA, 32 nt, Human
ccuccugaguagcugggacuacaggugcccac

SEQ ID NO: 379719 - RNA, 32 nt, Human
ccuccugaguagcugggacuacaggugcccgc

SEQ ID NO: 379720 - RNA, 32 nt, Human
ccuccugaguagcugggacuacaggugccugc

SEQ ID NO: 379721 - RNA, 32 nt, Human
ccuccugaguagcugggacuacaggugcgugc

SEQ ID NO: 379722 - RNA, 32 nt, Human
ccuccugaguagcugggacuacagguguacac

SEQ ID NO: 379723 - RNA, 32 nt, Human
ccuccugaguagcugggacuacaggugugcac

SEQ ID NO: 379724 - RNA, 32 nt, Human
ccuccugaguagcugggacuacaggugugcgc

SEQ ID NO: 379725 - RNA, 32 nt, Human
ccuccugaguagcugggacuacagguguguga

SEQ ID NO: 379726 - RNA, 32 nt, Human
ccuccugaguagcugggacuacaguugugcac

SEQ ID NO: 379727 - RNA, 32 nt, Human
ccuccugaguagcugggacuacaguugugcca

SEQ ID NO: 379728 - RNA, 32 nt, Human
ccuccugaguagcugggacuacaguugugcuc

SEQ ID NO: 379729 - RNA, 32 nt, Human
ccuccugaguagcugggacuacaguuucgugu

SEQ ID NO: 379730 - RNA, 32 nt, Human
ccuccugaguagcugggacuacaugcgcacac

SEQ ID NO: 379731 - RNA, 32 nt, Human
ccuccugaguagcugggacuagaggcacgcac

SEQ ID NO: 379732 - RNA, 32 nt, Human
ccuccugaguagcugggacuagaggcauguau

SEQ ID NO: 379733 - RNA, 32 nt, Human
ccuccugaguagcugggacuagaggcgugugu

SEQ ID NO: 379734 - RNA, 32 nt, Human
ccuccugaguagcugggacuauaggcaugugc

SEQ ID NO: 379735 - RNA, 32 nt, Human
ccuccugaguagcugggacuauaggccuguac

SEQ ID NO: 379736 - RNA, 32 nt, Human
ccuccugaguagcugggacuauaggcgcgugc

SEQ ID NO: 379737 - RNA, 32 nt, Human
ccuccugaguagcugggacuauaggcucccgc

SEQ ID NO: 379738 - RNA, 32 nt, Human
ccuccugaguagcugggacuauaggugcaugc

SEQ ID NO: 379739 - RNA, 32 nt, Human
ccuccugaguagcugggacuauagguugcuga

SEQ ID NO: 379740 - RNA, 32 nt, Human
ccuccugaguagcugggacugcagaagugcac

SEQ ID NO: 379741 - RNA, 32 nt, Human
ccuccugaguagcugggacugcaggcacccac

SEQ ID NO: 379742 - RNA, 32 nt, Human
ccuccugaguagcugggacugcaggcacgcgc

SEQ ID NO: 379743 - RNA, 32 nt, Human
ccuccugaguagcugggacugcaguuguaagc

SEQ ID NO: 379744 - RNA, 32 nt, Human
ccuccugaguagcugggacuggagacaugcgc

SEQ ID NO: 379745 - RNA, 32 nt, Human
ccuccugaguagcugggaggacaggcauaugc

SEQ ID NO: 379746 - RNA, 32 nt, Human
ccuccugaguagcugggaguacaggcgugcau

SEQ ID NO: 379747 - RNA, 32 nt, Human
ccuccugaguagcugggauaacagacaugcau

SEQ ID NO: 379748 - RNA, 32 nt, Human
ccuccugaguagcugggauaacagguguggug

SEQ ID NO: 379749 - RNA, 32 nt, Human
ccuccugaguagcugggaucacaggcacacac

SEQ ID NO: 379750 - RNA, 32 nt, Human
ccuccugaguagcugggaucacagguguguac

SEQ ID NO: 379751 - RNA, 32 nt, Human
ccuccugaguagcugggaucacaggugugugc

SEQ ID NO: 379752 - RNA, 32 nt, Human
ccuccugaguagcugggaucauagaugccugc

SEQ ID NO: 379753 - RNA, 32 nt, Human
ccuccugaguagcugggaucauaggcacgcgc

SEQ ID NO: 379754 - RNA, 32 nt, Human
ccuccugaguagcugggaugacaggcgugcac

SEQ ID NO: 379755 - RNA, 32 nt, Human
ccuccugaguagcugggaugacaggugcacgc

SEQ ID NO: 379756 - RNA, 32 nt, Human
ccuccugaguagcugggauuacaagggcacac

SEQ ID NO: 379757 - RNA, 32 nt, Human
ccuccugaguagcugggauuacagaaaaucug

SEQ ID NO: 379758 - RNA, 32 nt, Human
ccuccugaguagcugggauuacagacacccac

SEQ ID NO: 379759 - RNA, 32 nt, Human
ccuccugaguagcugggauuacagacacccgc

SEQ ID NO: 379760 - RNA, 32 nt, Human
ccuccugaguagcugggauuacagacaugcac

SEQ ID NO: 379761 - RNA, 32 nt, Human
ccuccugaguagcugggauuacagacgcacgc

SEQ ID NO: 379762 - RNA, 32 nt, Human
ccuccugaguagcugggauuacagacuccagc

SEQ ID NO: 379763 - RNA, 32 nt, Human
ccuccugaguagcugggauuacagauccuggu

SEQ ID NO: 379764 - RNA, 32 nt, Human
ccuccugaguagcugggauuacagauguaugc

SEQ ID NO: 379765 - RNA, 32 nt, Human
ccuccugaguagcugggauuacagaugugcac

SEQ ID NO: 379766 - RNA, 32 nt, Human
ccuccugaguagcugggauuacagcacccgcc

SEQ ID NO: 379767 - RNA, 32 nt, Human
ccuccugaguagcugggauuacagcucuggga

SEQ ID NO: 379768 - RNA, 32 nt, Human
ccuccugaguagcugggauuacaggaccagug

SEQ ID NO: 379769 - RNA, 32 nt, Human
ccuccugaguagcugggauuacaggagugugc

SEQ ID NO: 379770 - RNA, 32 nt, Human
ccuccugaguagcugggauuacaggcaacugc

SEQ ID NO: 379771 - RNA, 32 nt, Human
ccuccugaguagcugggauuacaggcacacac

SEQ ID NO: 379772 - RNA, 32 nt, Human
ccuccugaguagcugggauuacaggcacacgc

SEQ ID NO: 379773 - RNA, 32 nt, Human
ccuccugaguagcugggauuacaggcacaugc

SEQ ID NO: 379774 - RNA, 32 nt, Human
ccuccugaguagcugggauuacaggcacccac

SEQ ID NO: 379775 - RNA, 32 nt, Human
ccuccugaguagcugggauuacaggcacccgc

SEQ ID NO: 379776 - RNA, 32 nt, Human
ccuccugaguagcugggauuacaggcaccugc

SEQ ID NO: 379777 - RNA, 32 nt, Human
ccuccugaguagcugggauuacaggcacgcgc

SEQ ID NO: 379778 - RNA, 32 nt, Human
ccuccugaguagcugggauuacaggcagacac

SEQ ID NO: 379779 - RNA, 32 nt, Human
ccuccugaguagcugggauuacaggcauacac

SEQ ID NO: 379780 - RNA, 32 nt, Human
ccuccugaguagcugggauuacaggcauccgc

SEQ ID NO: 379781 - RNA, 32 nt, Human
ccuccugaguagcugggauuacaggcaugaau

SEQ ID NO: 379782 - RNA, 32 nt, Human
ccuccugaguagcugggauuacaggcaugcac

SEQ ID NO: 379783 - RNA, 32 nt, Human
ccuccugaguagcugggauuacaggcaugcgc

SEQ ID NO: 379784 - RNA, 32 nt, Human
ccuccugaguagcugggauuacaggcauguac

SEQ ID NO: 379785 - RNA, 32 nt, Human
ccuccugaguagcugggauuacaggcauguga

SEQ ID NO: 379786 - RNA, 32 nt, Human
ccuccugaguagcugggauuacaggcaugugc

SEQ ID NO: 379787 - RNA, 32 nt, Human
ccuccugaguagcugggauuacaggcgcacgc

SEQ ID NO: 379788 - RNA, 32 nt, Human
ccuccugaguagcugggauuacaggcgcccgc

SEQ ID NO: 379789 - RNA, 32 nt, Human
ccuccugaguagcugggauuacaggcgcccgu

SEQ ID NO: 379790 - RNA, 32 nt, Human
ccuccugaguagcugggauuacaggcgccugc

SEQ ID NO: 379791 - RNA, 32 nt, Human
ccuccugaguagcugggauuacaggcgcguau

SEQ ID NO: 379792 - RNA, 32 nt, Human
ccuccugaguagcugggauuacaggcgcgugc

SEQ ID NO: 379793 - RNA, 32 nt, Human
ccuccugaguagcugggauuacaggcguccgc

SEQ ID NO: 379794 - RNA, 32 nt, Human
ccuccugaguagcugggauuacaggcgugcac

SEQ ID NO: 379795 - RNA, 32 nt, Human
ccuccugaguagcugggauuacaggcgugcgc

SEQ ID NO: 379796 - RNA, 32 nt, Human
ccuccugaguagcugggauuacaggcgugugc

SEQ ID NO: 379797 - RNA, 32 nt, Human
ccuccugaguagcugggauuacaggcgugugu

SEQ ID NO: 379798 - RNA, 32 nt, Human
ccuccugaguagcugggauuacaggcuccugc

SEQ ID NO: 379799 - RNA, 32 nt, Human
ccuccugaguagcugggauuacagggcgcugg

SEQ ID NO: 379800 - RNA, 32 nt, Human
ccuccugaguagcugggauuacagguaugugc

SEQ ID NO: 379801 - RNA, 32 nt, Human
ccuccugaguagcugggauuacaggugcaugc

SEQ ID NO: 379802 - RNA, 32 nt, Human
ccuccugaguagcugggauuacaggugcccac

SEQ ID NO: 379803 - RNA, 32 nt, Human
ccuccugaguagcugggauuacaggugccugc

SEQ ID NO: 379804 - RNA, 32 nt, Human
ccuccugaguagcugggauuacaggugcgcac

SEQ ID NO: 379805 - RNA, 32 nt, Human
ccuccugaguagcugggauuacaggugcgugc

SEQ ID NO: 379806 - RNA, 32 nt, Human
ccuccugaguagcugggauuacagguguaugc

SEQ ID NO: 379807 - RNA, 32 nt, Human
ccuccugaguagcugggauuacaggugucggc

SEQ ID NO: 379808 - RNA, 32 nt, Human
ccuccugaguagcugggauuacaggugugcac

SEQ ID NO: 379809 - RNA, 32 nt, Human
ccuccugaguagcugggauuacaggugugccc

SEQ ID NO: 379810 - RNA, 32 nt, Human
ccuccugaguagcugggauuacaggugugcgc

SEQ ID NO: 379811 - RNA, 32 nt, Human
ccuccugaguagcugggauuacaggugugugc

SEQ ID NO: 379812 - RNA, 32 nt, Human
ccuccugaguagcugggauuacagguuccugc

SEQ ID NO: 379813 - RNA, 32 nt, Human
ccuccugaguagcugggauuaccagugcacgc

SEQ ID NO: 379814 - RNA, 32 nt, Human
ccuccugaguagcugggauuacgggcaugugc

SEQ ID NO: 379815 - RNA, 32 nt, Human
ccuccugaguagcugggauuacuggcacacac

SEQ ID NO: 379816 - RNA, 32 nt, Human
ccuccugaguagcugggauuauaggcacacac

SEQ ID NO: 379817 - RNA, 32 nt, Human
ccuccugaguagcugggauuauaggcacaugc

SEQ ID NO: 379818 - RNA, 32 nt, Human
ccuccugaguagcugggauuauaggcacgugc

SEQ ID NO: 379819 - RNA, 32 nt, Human
ccuccugaguagcugggauuauaggcaugcac

SEQ ID NO: 379820 - RNA, 32 nt, Human
ccuccugaguagcugggauuauaggcgagagc

SEQ ID NO: 379821 - RNA, 32 nt, Human
ccuccugaguagcugggauuauaggcgucugc

SEQ ID NO: 379822 - RNA, 32 nt, Human
ccuccugaguagcugggauuauaggcgugcac

SEQ ID NO: 379823 - RNA, 32 nt, Human
ccuccugaguagcugggauuauaggcguguac

SEQ ID NO: 379824 - RNA, 32 nt, Human
ccuccugaguagcugggauuauagguacaugc

SEQ ID NO: 379825 - RNA, 32 nt, Human
ccuccugaguagcugggauuauaggugcaugc

SEQ ID NO: 379826 - RNA, 32 nt, Human
ccuccugaguagcugggauuauaggugcgagc

SEQ ID NO: 379827 - RNA, 32 nt, Human
ccuccugaguagcugggauuauggacaaaugc

SEQ ID NO: 379828 - RNA, 32 nt, Human
ccuccugaguagcugggauuaugggcgcccac

SEQ ID NO: 379829 - RNA, 32 nt, Human
ccuccugaguagcugggauuaugggugccugc

SEQ ID NO: 379830 - RNA, 32 nt, Human
ccuccugaguagcugggauugcaggcacccgc

SEQ ID NO: 379831 - RNA, 32 nt, Human
ccuccugaguagcugggauugcagguaugcac

SEQ ID NO: 379832 - RNA, 32 nt, Human
ccuccugaguagcugggauugcaggugcccac

SEQ ID NO: 379833 - RNA, 32 nt, Human
ccuccugaguagcugggauuucaggccaugaa

SEQ ID NO: 379834 - RNA, 32 nt, Human
ccuccugaguagcugggccuauagguucccuc

SEQ ID NO: 379835 - RNA, 32 nt, Human
ccuccugaguagcugggcugacaggcacccac

SEQ ID NO: 379836 - RNA, 32 nt, Human
ccuccugaguagcugggcuuacaggcacccac

SEQ ID NO: 379837 - RNA, 32 nt, Human
ccuccugaguagcuggggcuacaggcgccugc

SEQ ID NO: 379838 - RNA, 32 nt, Human
ccuccugaguagcuggggcuacaggugugugc

SEQ ID NO: 379839 - RNA, 32 nt, Human
ccuccugaguagcugggguuacaggugugugc

SEQ ID NO: 379840 - RNA, 32 nt, Human
ccuccugaguagcugggguugcaggugugcac

SEQ ID NO: 379841 - RNA, 32 nt, Human
ccuccugaguagcuggguuuacaggugccugc

SEQ ID NO: 379842 - RNA, 32 nt, Human
ccuccugaguagcugugacuacaggcgcccaa

SEQ ID NO: 379843 - RNA, 32 nt, Human
ccuccugaguagcugugauuacaggcaugcgc

SEQ ID NO: 379844 - RNA, 32 nt, Human
ccuccugaguagcuuggauuacaggcacaagc

SEQ ID NO: 379845 - RNA, 32 nt, Human
ccuccugaguaggugggauuacagaugcccgc

SEQ ID NO: 379846 - RNA, 32 nt, Human
ccuccugaguaguugggacuacaggcauauac

SEQ ID NO: 379847 - RNA, 32 nt, Human
ccuccugaguaguugggauuacagaugcccgc

SEQ ID NO: 379848 - RNA, 32 nt, Human
ccuccugaguaucugggauuacaggcgugcac

SEQ ID NO: 379849 - RNA, 32 nt, Human
ccuccugaguggcugggauuacaggcaugcac

SEQ ID NO: 379850 - RNA, 32 nt, Human
ccuccugaguggcugggauuacaggcgcccgc

SEQ ID NO: 379851 - RNA, 32 nt, Human
ccuccugaguggcugggauuauaggugugugc

SEQ ID NO: 379852 - RNA, 32 nt, Human
ccuccugaguggcugggauugcaggugugcgc

SEQ ID NO: 379853 - RNA, 32 nt, Human
ccuccugauacuguagccucuugguacccagg

SEQ ID NO: 379854 - RNA, 32 nt, Human
ccuccugauauuccucuucucacuuuugcaau

SEQ ID NO: 379855 - RNA, 32 nt, Human
ccuccugaucugccagggucugcucugggugg

SEQ ID NO: 379856 - RNA, 32 nt, Human
ccuccugauuaccugggauuacaggcaugugc

SEQ ID NO: 379857 - RNA, 32 nt, Human
ccuccugauuagcugggacuacagguucagcu

SEQ ID NO: 379858 - RNA, 32 nt, Human
ccuccugauuagcugggacuauaggcgugugc

SEQ ID NO: 379859 - RNA, 32 nt, Human
ccuccugauuagcugggauuacaggcaugcgc

SEQ ID NO: 379860 - RNA, 32 nt, Human
ccuccugauuagcugggauuacaggcaugugc

SEQ ID NO: 379861 - RNA, 32 nt, Human
ccuccugauuagcugggauuacaggcgugugc

SEQ ID NO: 379862 - RNA, 32 nt, Human
ccuccugcaaagcaucucccaccaaguguauc

SEQ ID NO: 379863 - RNA, 17 nt, Human
ccuccugcaacccagaa

SEQ ID NO: 379864 - RNA, 32 nt, Human
ccuccugcaaggaccugggccucccagcccag

SEQ ID NO: 379865 - RNA, 32 nt, Human
ccuccugcaaggggcucaacccccuaccccga

SEQ ID NO: 379866 - RNA, 32 nt, Human
ccuccugcacacagaaugcucagggucacuga

SEQ ID NO: 379867 - RNA, 22 nt, Human
ccuccugcacagucugcagcuu

SEQ ID NO: 379868 - RNA, 32 nt, Human
ccuccugcacccaaggcagugccugagaagcc

SEQ ID NO: 379869 - RNA, 16 nt, Human
ccuccugcacccagaa

SEQ ID NO: 379870 - RNA, 32 nt, Human
ccuccugcagagccagcgaaggaaagcucuag

SEQ ID NO: 379871 - RNA, 18 nt, Human
ccuccugcagagcugggg

SEQ ID NO: 379872 - RNA, 32 nt, Human
ccuccugcagaugcaagagcuccugggcaggg

SEQ ID NO: 379873 - RNA, 32 nt, Human
ccuccugcagcaucugcacucugggacugccu

SEQ ID NO: 379874 - RNA, 32 nt, Human
ccuccugcagccuucucaagggacagccccac

SEQ ID NO: 379875 - RNA, 32 nt, Human
ccuccugcagcucgguuaaguacccgaggccu

SEQ ID NO: 379876 - RNA, 19 nt, Human
ccuccugcaggaaggggug

SEQ ID NO: 379877 - RNA, 22 nt, Human
ccuccugcagugaaugcuccuu

SEQ ID NO: 379878 - RNA, 32 nt, Human
ccuccugcagugaaugcuccuuccauuccugu

SEQ ID NO: 379879 - RNA, 32 nt, Human
ccuccugcagugcugagaggcagcgaggacgg

SEQ ID NO: 379880 - RNA, 20 nt, Human
ccuccugcaucagcuuccca

SEQ ID NO: 379881 - RNA, 32 nt, Human
ccuccugcauucuccccucuccuaggagcucu

SEQ ID NO: 379882 - RNA, 32 nt, Human
ccuccugccacacacaugcacacauaucuagc

SEQ ID NO: 379883 - RNA, 32 nt, Human
ccuccugccaccacccgcuacccggccacccc

SEQ ID NO: 379884 - RNA, 32 nt, Human
ccuccugccacucugagcacauguccgggggu

SEQ ID NO: 379885 - RNA, 22 nt, Human
ccuccugccagcaguucuugaa

SEQ ID NO: 379886 - RNA, 32 nt, Human
ccuccugccagcucugucacccuggccaccac

SEQ ID NO: 379887 - RNA, 32 nt, Human
ccuccugccagcugcccuggugcuuucuccaa

SEQ ID NO: 379888 - RNA, 32 nt, Human
ccuccugccaugauacugucaguuaccuuagu

SEQ ID NO: 379889 - RNA, 22 nt, Human
ccuccugcccacccccuggcgu

SEQ ID NO: 379890 - RNA, 32 nt, Human
ccuccugcccacugcugucacuucaagccacu

SEQ ID NO: 379891 - RNA, 32 nt, Human
ccuccugcccagcugcucuugucagcccucug

SEQ ID NO: 379892 - RNA, 24 nt, Human
ccuccugccccagcccucuggugu

SEQ ID NO: 379893 - RNA, 22 nt, Human
ccuccugccccaggcccacuga

SEQ ID NO: 379894 - RNA, 18 nt, Human
ccuccugcccccuccaag

SEQ ID NO: 379895 - RNA, 32 nt, Human
ccuccugccccuccccuuccuccagcuuguca

SEQ ID NO: 379896 - RNA, 19 nt, Human
ccuccugccccuucaugca

SEQ ID NO: 379897 - RNA, 32 nt, Human
ccuccugcccgccucugcaccacacaaggagc

SEQ ID NO: 379898 - RNA, 31 nt, Human
ccuccugcccucucugggucucaguugcccc

SEQ ID NO: 379899 - RNA, 32 nt, Human
ccuccugcccugcaccuguccuguuguugggg

SEQ ID NO: 379900 - RNA, 15 nt, Human
ccuccugccgcugcc

SEQ ID NO: 379901 - RNA, 32 nt, Human
ccuccugccuaagcccccaaauagcugggacu

SEQ ID NO: 379902 - RNA, 32 nt, Human
ccuccugccucagcuacucaggagaauugcuu

SEQ ID NO: 379903 - RNA, 32 nt, Human
ccuccugccucagcuccugaguagcuggaacu

SEQ ID NO: 379904 - RNA, 32 nt, Human
ccuccugccuccagcacucccucccagagaac

SEQ ID NO: 379905 - RNA, 32 nt, Human
ccuccugccuccccaucuucucucugcccaga

SEQ ID NO: 379906 - RNA, 19 nt, Human
ccuccugccugcuauccaa

SEQ ID NO: 379907 - RNA, 32 nt, Human
ccuccugccuggugaagacugcccuggguacc

SEQ ID NO: 379908 - RNA, 32 nt, Human
ccuccugccugucugcacuauuccuuugcccg

SEQ ID NO: 379909 - RNA, 32 nt, Human
ccuccugcgcucaggguggcuugcagucccug

SEQ ID NO: 379910 - RNA, 32 nt, Human
ccuccugcggaacaggguuuugcucaaugacu

SEQ ID NO: 379911 - RNA, 32 nt, Human
ccuccugcguagcugggacuacaggcacacgc

SEQ ID NO: 379912 - RNA, 32 nt, Human
ccuccugcgucucaacaagccaugucccgcgg

SEQ ID NO: 379913 - RNA, 22 nt, Human
ccuccugcuaacuaucacuuca

SEQ ID NO: 379914 - RNA, 32 nt, Human
ccuccugcuaugaugccuggacagaucccgga

SEQ ID NO: 379915 - RNA, 32 nt, Human
ccuccugcuauuccucuccugaagaaccucau

SEQ ID NO: 379916 - RNA, 32 nt, Human
ccuccugcucacugccucuccugaguagaaau

SEQ ID NO: 379917 - RNA, 32 nt, Human
ccuccugcucccagaggugaccuccuccucca

SEQ ID NO: 379918 - RNA, 32 nt, Human
ccuccugcucccucccccucgcccaccauugu

SEQ ID NO: 379919 - RNA, 32 nt, Human
ccuccugcuccgggggcagaccagacucugac

SEQ ID NO: 379920 - RNA, 17 nt, Human
ccuccugcuccuuaggg

SEQ ID NO: 379921 - RNA, 32 nt, Human
ccuccugcucuuccugugggcccugcugaacu

SEQ ID NO: 379922 - RNA, 32 nt, Human
ccuccugcugagaaccuuccccuaggcccugu

SEQ ID NO: 379923 - RNA, 32 nt, Human
ccuccugcugcuucggggacccggcuacgaca

SEQ ID NO: 379924 - RNA, 32 nt, Human
ccuccugcugcuucugugcccuguuaaggcuu

SEQ ID NO: 379925 - RNA, 32 nt, Human
ccuccugcuggagaacagagacccuucaagag

SEQ ID NO: 379926 - RNA, 32 nt, Human
ccuccugcugggaacagugucccccagagccu

SEQ ID NO: 379927 - RNA, 30 nt, Human
ccuccugcugugaaaacucagaaugauaac

SEQ ID NO: 379928 - RNA, 32 nt, Human
ccuccugcugugcggcccaguuccuaacaggu

SEQ ID NO: 379929 - RNA, 20 nt, Human
ccuccugcugugggaugcug

SEQ ID NO: 379930 - RNA, 32 nt, Human
ccuccugcuguugccccuuagugaggaaucuu

SEQ ID NO: 379931 - RNA, 32 nt, Human
ccuccugcuguuuccuccuuugugguagccuc

SEQ ID NO: 379932 - RNA, 32 nt, Human
ccuccugcuuagaauaugccuuuugcuagccu

SEQ ID NO: 379933 - RNA, 32 nt, Human
ccuccugcuuccuggguucaagcgauucuccu

SEQ ID NO: 379934 - RNA, 24 nt, Human
ccuccugcuugagcccugcuguau

SEQ ID NO: 379935 - RNA, 32 nt, Human
ccuccugcuuuagugccaccccaaacugcauu

SEQ ID NO: 379936 - RNA, 32 nt, Human
ccuccugcuuuuccaccuauccuuuucccucc

SEQ ID NO: 379937 - RNA, 32 nt, Human
ccuccuggaaucuugaggcacugugaaauuua

SEQ ID NO: 379938 - RNA, 32 nt, Human
ccuccuggacugcuccccuucaucucuuaccc

SEQ ID NO: 379939 - RNA, 32 nt, Human
ccuccuggagcagaggagguuguggcgguggc

SEQ ID NO: 379940 - RNA, 32 nt, Human
ccuccuggauccuggucaggccgaaccaccgc

SEQ ID NO: 379941 - RNA, 20 nt, Human
ccuccuggaugcugcuccuu

SEQ ID NO: 379942 - RNA, 21 nt, Human
ccuccuggcaccaacugcucc

SEQ ID NO: 379943 - RNA, 32 nt, Human
ccuccuggcaggcuuccuucugggacaggggc

SEQ ID NO: 379944 - RNA, 32 nt, Human
ccuccuggcaggguagggaaggaggaccccgg

SEQ ID NO: 379945 - RNA, 32 nt, Human
ccuccuggccaacauggugaaacucugucucu

SEQ ID NO: 379946 - RNA, 22 nt, Human
ccuccuggccaaguccugcccu

SEQ ID NO: 379947 - RNA, 32 nt, Human
ccuccuggccaggccagcagugaagcaguaug

SEQ ID NO: 379948 - RNA, 24 nt, Human
ccuccuggccccacccugccccuu

SEQ ID NO: 379949 - RNA, 32 nt, Human
ccuccuggccccacccugccccuucuuuuugg

SEQ ID NO: 379950 - RNA, 27 nt, Human
ccuccuggccccauccuccugguccuu

SEQ ID NO: 379951 - RNA, 21 nt, Human
ccuccuggcccccgccuucca

SEQ ID NO: 379952 - RNA, 21 nt, Human
ccuccuggccccgcccugccc

SEQ ID NO: 379953 - RNA, 32 nt, Human
ccuccuggcccgcucaccuuccucaccccucc

SEQ ID NO: 379954 - RNA, 20 nt, Human
ccuccuggcccggaccccuu

SEQ ID NO: 379955 - RNA, 21 nt, Human
ccuccuggcccucgaugcuuc

SEQ ID NO: 379956 - RNA, 23 nt, Human
ccuccuggcccugcugcugcccu

SEQ ID NO: 379957 - RNA, 32 nt, Human
ccuccuggcccugucccaauucugagccaagg

SEQ ID NO: 379958 - RNA, 32 nt, Human
ccuccuggccggcagagggcgcaggagcccag

SEQ ID NO: 379959 - RNA, 22 nt, Human
ccuccuggccucaagugauccu

SEQ ID NO: 379960 - RNA, 32 nt, Human
ccuccuggccucaagugauccucuugccucag

SEQ ID NO: 379961 - RNA, 21 nt, Human
ccuccuggccucaggaucucc

SEQ ID NO: 379962 - RNA, 24 nt, Human
ccuccuggccucagggcaugcccu

SEQ ID NO: 379963 - RNA, 32 nt, Human
ccuccuggccuccagcucagccuucucucacc

SEQ ID NO: 379964 - RNA, 21 nt, Human
ccuccuggccucguccugccu

SEQ ID NO: 379965 - RNA, 32 nt, Human
ccuccuggccucguccugccugaccugcucug

SEQ ID NO: 379966 - RNA, 19 nt, Human
ccuccuggccucucccucc

SEQ ID NO: 379967 - RNA, 21 nt, Human
ccuccuggccugccuaguucc

SEQ ID NO: 379968 - RNA, 19 nt, Human
ccuccuggccugccugccc

SEQ ID NO: 379969 - RNA, 32 nt, Human
ccuccuggccuggaauccucagccucucuggc

SEQ ID NO: 379970 - RNA, 32 nt, Human
ccuccuggccuggacgcuguggcuuaagagua

SEQ ID NO: 379971 - RNA, 32 nt, Human
ccuccuggccugggacugcuguggcagaggaa

SEQ ID NO: 379972 - RNA, 32 nt, Human
ccuccuggcgggucuccuccagccucacuucg

SEQ ID NO: 379973 - RNA, 32 nt, Human
ccuccuggcguuuuuguuuuguguucucccuc

SEQ ID NO: 379974 - RNA, 18 nt, Human
ccuccuggcucuuuggga

SEQ ID NO: 379975 - RNA, 22 nt, Human
ccuccuggcugcacagccccuu

SEQ ID NO: 379976 - RNA, 21 nt, Human
ccuccuggcuugcacugcucc

SEQ ID NO: 379977 - RNA, 22 nt, Human
ccuccuggcuuuggcugucccu

SEQ ID NO: 379978 - RNA, 32 nt, Human
ccuccugggaaagaagggcggcagagagacca

SEQ ID NO: 379979 - RNA, 28 nt, Human
ccuccugggaaagcagagguugcaguga

SEQ ID NO: 379980 - RNA, 32 nt, Human
ccuccugggaaagggagaauggcaaagacagg

SEQ ID NO: 379981 - RNA, 32 nt, Human
ccuccugggaacacaucuggcugcacaggcug

SEQ ID NO: 379982 - RNA, 23 nt, Human
ccuccugggaaugcugacuccuu

SEQ ID NO: 379983 - RNA, 32 nt, Human
ccuccugggacccagcuucagccaucgggcca

SEQ ID NO: 379984 - RNA, 32 nt, Human
ccuccugggacccucacccacccuggcagcag

SEQ ID NO: 379985 - RNA, 32 nt, Human
ccuccugggagcccagaacuugcaguaacccu

SEQ ID NO: 379986 - RNA, 22 nt, Human
ccuccugggauaugucaccuca

SEQ ID NO: 379987 - RNA, 28 nt, Human
ccuccugggcaagcggagguugcaguga

SEQ ID NO: 379988 - RNA, 19 nt, Human
ccuccugggccccaugccc

SEQ ID NO: 379989 - RNA, 21 nt, Human
ccuccugggccgccgccuccu

SEQ ID NO: 379990 - RNA, 23 nt, Human
ccuccugggcucaagccauccuu

SEQ ID NO: 379991 - RNA, 18 nt, Human
ccuccugggcuccuuuca

SEQ ID NO: 379992 - RNA, 28 nt, Human
ccuccuggggaagcggagguugcaguga

SEQ ID NO: 379993 - RNA, 32 nt, Human
ccuccuggggcugcgcagggaggaggccuugc

SEQ ID NO: 379994 - RNA, 28 nt, Human
ccuccuggguagacagagguugcaguga

SEQ ID NO: 379995 - RNA, 32 nt, Human
ccuccuggguagcugggacuacaggcuugcac

SEQ ID NO: 379996 - RNA, 32 nt, Human
ccuccuggguagcugggauuacaagcacccaa

SEQ ID NO: 379997 - RNA, 32 nt, Human
ccuccuggguagcugggauuacaggcacgcgc

SEQ ID NO: 379998 - RNA, 32 nt, Human
ccuccuggguagcugggauuacaggugcccac

SEQ ID NO: 379999 - RNA, 32 nt, Human
ccuccugggugagaagggucagauuuuccuau

SEQ ID NO: 380000 - RNA, 32 nt, Human
ccuccugggugcugggauuacagacgugagcc

SEQ ID NO: 380001 - RNA, 32 nt, Human
ccuccugguccucaucgccccucucuccucuu

SEQ ID NO: 380002 - RNA, 23 nt, Human
ccuccuggugcccacucccgcca

SEQ ID NO: 380003 - RNA, 32 nt, Human
ccuccuggugccccuggcacugaggcacagau

SEQ ID NO: 380004 - RNA, 32 nt, Human
ccuccuggugcuggguuugcccucccaauccu

SEQ ID NO: 380005 - RNA, 32 nt, Human
ccuccuggugcuggugcccugaugcugugccu

SEQ ID NO: 380006 - RNA, 32 nt, Human
ccuccugguggagacaguggauugacagguuc

SEQ ID NO: 380007 - RNA, 32 nt, Human
ccuccugguucaagcgauucucaggccucagc

SEQ ID NO: 380008 - RNA, 21 nt, Human
ccuccugguucucaccaggaa

SEQ ID NO: 380009 - RNA, 29 nt, Human
ccuccugguuggaugucaucccccgaccc

SEQ ID NO: 380010 - RNA, 17 nt, Human
ccuccugguuuuagggg

SEQ ID NO: 380011 - RNA, 32 nt, Human
ccuccuguagagccaccggccucagcccugga

SEQ ID NO: 380012 - RNA, 32 nt, Human
ccuccugucacugcaaucugugacauuccaga

SEQ ID NO: 380013 - RNA, 21 nt, Human
ccuccugucacuguggccugc

SEQ ID NO: 380014 - RNA, 32 nt, Human
ccuccugucaucacaucaccggcugucacugg

SEQ ID NO: 380015 - RNA, 32 nt, Human
ccuccugucaucugcugacuucacagaaggcc

SEQ ID NO: 380016 - RNA, 26 nt, Human
ccuccuguccagacccagccuuggca

SEQ ID NO: 380017 - RNA, 32 nt, Human
ccuccuguccagccccuccaacuucaucgacu

SEQ ID NO: 380018 - RNA, 32 nt, Human
ccuccuguccccaccuaagccuggugggggug

SEQ ID NO: 380019 - RNA, 32 nt, Human
ccuccugucuccuuugaugcugaggccugacg

SEQ ID NO: 380020 - RNA, 32 nt, Human
ccuccugucugugucguucucugugccacagc

SEQ ID NO: 380021 - RNA, 32 nt, Human
ccuccugucuuucugcuucgccccuucaucuu

SEQ ID NO: 380022 - RNA, 32 nt, Human
ccuccugugacugcacuguccgccugugggau

SEQ ID NO: 380023 - RNA, 32 nt, Human
ccuccugugcaucccucccucccauccccugg

SEQ ID NO: 380024 - RNA, 32 nt, Human
ccuccugugccuggccccagucugggccaucu

SEQ ID NO: 380025 - RNA, 32 nt, Human
ccuccugugcuccaagguucugaagauaucuu

SEQ ID NO: 380026 - RNA, 32 nt, Human
ccuccugugcugcuggucacuguaacccacua

SEQ ID NO: 380027 - RNA, 32 nt, Human
ccuccugugcuuccuuucucguuccuaacuuu

SEQ ID NO: 380028 - RNA, 31 nt, Human
ccuccuguggaaggaacuggauucaucccuu

SEQ ID NO: 380029 - RNA, 32 nt, Human
ccuccuguguaacugggauuacaggcucccac

SEQ ID NO: 380030 - RNA, 32 nt, Human
ccuccuguguagcugccaccuccccgcugggc

SEQ ID NO: 380031 - RNA, 32 nt, Human
ccuccuguguucccaccuuacuguccaccaac

SEQ ID NO: 380032 - RNA, 32 nt, Human
ccuccuguguuccugcuuccucuccuuugcug

SEQ ID NO: 380033 - RNA, 32 nt, Human
ccuccuguguugaugccacuucccagggugga

SEQ ID NO: 380034 - RNA, 32 nt, Human
ccuccuguucuugagccaguugucucuuuugu

SEQ ID NO: 380035 - RNA, 16 nt, Human
ccuccuguucuuggga

SEQ ID NO: 380036 - RNA, 32 nt, Human
ccuccuguugcagcacaaggccggggucucug

SEQ ID NO: 380037 - RNA, 32 nt, Human
ccuccuguuggcuggggaaccccuaaagucac

SEQ ID NO: 380038 - RNA, 32 nt, Human
ccuccuuaaaggccccuuggaacaugcaggua

SEQ ID NO: 380039 - RNA, 32 nt, Human
ccuccuuagaagauaccuaacaacagcacugu

SEQ ID NO: 380040 - RNA, 19 nt, Human
ccuccuuagccccacuggu

SEQ ID NO: 380041 - RNA, 32 nt, Human
ccuccuuagggagacaggugacccugggugcc

SEQ ID NO: 380042 - RNA, 32 nt, Human
ccuccuuaguagcugggacuaccagugcauac

SEQ ID NO: 380043 - RNA, 32 nt, Human
ccuccuuaguagcugggauuacaggcaugugc

SEQ ID NO: 380044 - RNA, 32 nt, Human
ccuccuuagugucgcuccugugccucaguggg

SEQ ID NO: 380045 - RNA, 32 nt, Human
ccuccuucagcccacuaguagugcgcugguaa

SEQ ID NO: 380046 - RNA, 32 nt, Human
ccuccuucagggacuggccugagaccggggca

SEQ ID NO: 380047 - RNA, 16 nt, Human
ccuccuucauccagau

SEQ ID NO: 380048 - RNA, 32 nt, Human
ccuccuucauucccaaccccugccucuggugg

SEQ ID NO: 380049 - RNA, 32 nt, Human
ccuccuucauuuuucuuccaaaauugcugcug

SEQ ID NO: 380050 - RNA, 32 nt, Human
ccuccuuccacgccugaauuuggcuucaggcu

SEQ ID NO: 380051 - RNA, 21 nt, Human
ccuccuuccaggguuuaggga

SEQ ID NO: 380052 - RNA, 32 nt, Human
ccuccuuccaguagucccauguugcuucacac

SEQ ID NO: 380053 - RNA, 32 nt, Human
ccuccuuccaugucuugagcacuggcucaccc

SEQ ID NO: 380054 - RNA, 32 nt, Human
ccuccuuccauuccuucuucccccucucugca

SEQ ID NO: 380055 - RNA, 21 nt, Human
ccuccuucccaagccuuaggg

SEQ ID NO: 380056 - RNA, 32 nt, Human
ccuccuucccacggggcuucugagcuugcucc

SEQ ID NO: 380057 - RNA, 32 nt, Human
ccuccuucccauuggcuuucucuccuuggccu

SEQ ID NO: 380058 - RNA, 32 nt, Human
ccuccuuccccaccuccuucccaaacccucuu

SEQ ID NO: 380059 - RNA, 32 nt, Human
ccuccuucccccucaucuccccuuccugggac

SEQ ID NO: 380060 - RNA, 32 nt, Human
ccuccuuccccucacuccuccccuccuucgcu

SEQ ID NO: 380061 - RNA, 32 nt, Human
ccuccuuccccucauuccuccccuccuucgcu

SEQ ID NO: 380062 - RNA, 32 nt, Human
ccuccuuccccucccugaaccccacaguccgc

SEQ ID NO: 380063 - RNA, 21 nt, Human
ccuccuuccccuuggagccug

SEQ ID NO: 380064 - RNA, 32 nt, Human
ccuccuucccgagaaauaagacaggacaauaa

SEQ ID NO: 380065 - RNA, 32 nt, Human
ccuccuucccgccuaugugagccauccugaga

SEQ ID NO: 380066 - RNA, 32 nt, Human
ccuccuucccucucuucugccugauagaggga

SEQ ID NO: 380067 - RNA, 32 nt, Human
ccuccuucccuuccacacuuccuuccugggua

SEQ ID NO: 380068 - RNA, 19 nt, Human
ccuccuucccuucuuggga

SEQ ID NO: 380069 - RNA, 32 nt, Human
ccuccuuccgaaugccaaccccgggagggcag

SEQ ID NO: 380070 - RNA, 32 nt, Human
ccuccuuccuaaccugaggccugggguuccuc

SEQ ID NO: 380071 - RNA, 32 nt, Human
ccuccuuccuacaggggcuccucuguggguga

SEQ ID NO: 380072 - RNA, 32 nt, Human
ccuccuuccuaucuuucccuugccuacagaaa

SEQ ID NO: 380073 - RNA, 32 nt, Human
ccuccuuccucuuccccuuucuaguuccccua

SEQ ID NO: 380074 - RNA, 32 nt, Human
ccuccuuccugaugucugccauuagcauugga

SEQ ID NO: 380075 - RNA, 32 nt, Human
ccuccuuccugcccuucugccugccugugucu

SEQ ID NO: 380076 - RNA, 32 nt, Human
ccuccuuccuucuccccuggcuguucgcgauc

SEQ ID NO: 380077 - RNA, 17 nt, Human
ccuccuuccuucuucca

SEQ ID NO: 380078 - RNA, 32 nt, Human
ccuccuucgccacuccaccagccuggaccucc

SEQ ID NO: 380079 - RNA, 32 nt, Human
ccuccuucgccuucugccaugacuguaagcuu

SEQ ID NO: 380080 - RNA, 20 nt, Human
ccuccuucgcgccugcagcu

SEQ ID NO: 380081 - RNA, 32 nt, Human
ccuccuucgcucgcucaaucucuuuuauucag

SEQ ID NO: 380082 - RNA, 24 nt, Human
ccuccuucuaccacuggggugcug

SEQ ID NO: 380083 - RNA, 32 nt, Human
ccuccuucuaccacuggggugcugcuguacca

SEQ ID NO: 380084 - RNA, 32 nt, Human
ccuccuucuccaaccucuaccccaccauuagu

SEQ ID NO: 380085 - RNA, 32 nt, Human
ccuccuucuccacuucuacaaucucauucucu

SEQ ID NO: 380086 - RNA, 32 nt, Human
ccuccuucuccagccucuucucccgggaacuc

SEQ ID NO: 380087 - RNA, 23 nt, Human
ccuccuucuccccgucuugggga

SEQ ID NO: 380088 - RNA, 32 nt, Human
ccuccuucuccuccuccuccuucucuuccuuu

SEQ ID NO: 380089 - RNA, 32 nt, Human
ccuccuucuccuccuucucggcuuccuccuca

SEQ ID NO: 380090 - RNA, 32 nt, Human
ccuccuucucucuccgcagcuuucaagaauug

SEQ ID NO: 380091 - RNA, 19 nt, Human
ccuccuucucucuuggcga

SEQ ID NO: 380092 - RNA, 32 nt, Human
ccuccuucucucuuucuuuucuucuauucucc

SEQ ID NO: 380093 - RNA, 23 nt, Human
ccuccuucucugcacccuuggca

SEQ ID NO: 380094 - RNA, 32 nt, Human
ccuccuucucugcuuugggucccuucucucac

SEQ ID NO: 380095 - RNA, 32 nt, Human
ccuccuucucugugagcugucagucuagguua

SEQ ID NO: 380096 - RNA, 32 nt, Human
ccuccuucucuuuccuccuccuccucaccaag

SEQ ID NO: 380097 - RNA, 21 nt, Human
ccuccuucugcaggagcucug

SEQ ID NO: 380098 - RNA, 22 nt, Human
ccuccuucugcuucggugcguu

SEQ ID NO: 380099 - RNA, 23 nt, Human
ccuccuucuggggcugggcucug

SEQ ID NO: 380100 - RNA, 32 nt, Human
ccuccuucuggguccagacucuggguggagug

SEQ ID NO: 380101 - RNA, 21 nt, Human
ccuccuucuguagagggcgcc

SEQ ID NO: 380102 - RNA, 22 nt, Human
ccuccuucuguuucccagaccg

SEQ ID NO: 380103 - RNA, 21 nt, Human
ccuccuucuucgacugcuccu

SEQ ID NO: 380104 - RNA, 32 nt, Human
ccuccuugaagcugcccuugaagacuucccga

SEQ ID NO: 380105 - RNA, 32 nt, Human
ccuccuugaaguuuacacuuugccacugcugg

SEQ ID NO: 380106 - RNA, 32 nt, Human
ccuccuugacaccuccccguggcuccagcaag

SEQ ID NO: 380107 - RNA, 32 nt, Human
ccuccuugagccacaguuagcugccaacuggg

SEQ ID NO: 380108 - RNA, 32 nt, Human
ccuccuugagcuccgccacccuucccgaaguu

SEQ ID NO: 380109 - RNA, 32 nt, Human
ccuccuugaggcaaacagccugggcuucucac

SEQ ID NO: 380110 - RNA, 32 nt, Human
ccuccuugaguugcccccuccuuguggguuua

SEQ ID NO: 380111 - RNA, 21 nt, Human
ccuccuugcaaugggcugcca

SEQ ID NO: 380112 - RNA, 32 nt, Human
ccuccuugcaccggugaaacucaggccacacu

SEQ ID NO: 380113 - RNA, 32 nt, Human
ccuccuugcccaggcaggaggcuggggugcug

SEQ ID NO: 380114 - RNA, 32 nt, Human
ccuccuugcccaucccaccacccggccuuucc

SEQ ID NO: 380115 - RNA, 32 nt, Human
ccuccuugcuaucugggcugaguggccagggc

SEQ ID NO: 380116 - RNA, 19 nt, Human
ccuccuugcuugucaccca

SEQ ID NO: 380117 - RNA, 17 nt, Human
ccuccuugcuuugggga

SEQ ID NO: 380118 - RNA, 24 nt, Human
ccuccuuggacacggccauccugg

SEQ ID NO: 380119 - RNA, 32 nt, Human
ccuccuuggagccucagacuccaagcuaggcu

SEQ ID NO: 380120 - RNA, 32 nt, Human
ccuccuuggccauuuucauguucucugccaau

SEQ ID NO: 380121 - RNA, 32 nt, Human
ccuccuuggggcuggagaucguuggggauagu

SEQ ID NO: 380122 - RNA, 32 nt, Human
ccuccuuggggguccuuccagccugaggggcu

SEQ ID NO: 380123 - RNA, 32 nt, Human
ccuccuuggguagaaagagggagcgagggcaa

SEQ ID NO: 380124 - RNA, 32 nt, Human
ccuccuugucaauguccccauccugggaagcc

SEQ ID NO: 380125 - RNA, 32 nt, Human
ccuccuuguccacccaccuaugugccaacugu

SEQ ID NO: 380126 - RNA, 19 nt, Human
ccuccuugucccuccuaca

SEQ ID NO: 380127 - RNA, 31 nt, Human
ccuccuugucuggaaagagggugggucaucu

SEQ ID NO: 380128 - RNA, 21 nt, Human
ccuccuugugucugaugcaca

SEQ ID NO: 380129 - RNA, 32 nt, Human
ccuccuuguuucagcugggccugcuguccagc

SEQ ID NO: 380130 - RNA, 20 nt, Human
ccuccuuuaagaggacuugg

SEQ ID NO: 380131 - RNA, 18 nt, Human
ccuccuuuaauuuaggga

SEQ ID NO: 380132 - RNA, 17 nt, Human
ccuccuuuacuuaaggg

SEQ ID NO: 380133 - RNA, 21 nt, Human
ccuccuuuagagguuugggga

SEQ ID NO: 380134 - RNA, 32 nt, Human
ccuccuuuauccucaucuuucuucuaugcaga

SEQ ID NO: 380135 - RNA, 18 nt, Human
ccuccuuuauuugagggg

SEQ ID NO: 380136 - RNA, 32 nt, Human
ccuccuuucagcccucuccaggugucuuuggg

SEQ ID NO: 380137 - RNA, 17 nt, Human
ccuccuuucauaggaga

SEQ ID NO: 380138 - RNA, 32 nt, Human
ccuccuuuccaaauaagugcauuuauugccuc

SEQ ID NO: 380139 - RNA, 20 nt, Human
ccuccuuuccagcuauuuug

SEQ ID NO: 380140 - RNA, 16 nt, Human
ccuccuuuccccuggg

SEQ ID NO: 380141 - RNA, 18 nt, Human
ccuccuuuccccuggggg

SEQ ID NO: 380142 - RNA, 18 nt, Human
ccuccuuucccgcagggg

SEQ ID NO: 380143 - RNA, 18 nt, Human
ccuccuuucccggugggg

SEQ ID NO: 380144 - RNA, 19 nt, Human
ccuccuuucccuaccaggg

SEQ ID NO: 380145 - RNA, 32 nt, Human
ccuccuuucccucacccagagcuggauuucca

SEQ ID NO: 380146 - RNA, 32 nt, Human
ccuccuuucccucucuccaucuuccaaucccu

SEQ ID NO: 380147 - RNA, 32 nt, Human
ccuccuuuccucagccccuuguucuucccugu

SEQ ID NO: 380148 - RNA, 15 nt, Human
ccuccuuuccugggg

SEQ ID NO: 380149 - RNA, 19 nt, Human
ccuccuuuccuggggguga

SEQ ID NO: 380150 - RNA, 32 nt, Human
ccuccuuucucccaaagccagaugugagaacg

SEQ ID NO: 380151 - RNA, 32 nt, Human
ccuccuuucucccacguccuaucugccucucg

SEQ ID NO: 380152 - RNA, 32 nt, Human
ccuccuuucugagcuccagccccagccccucg

SEQ ID NO: 380153 - RNA, 23 nt, Human
ccuccuuucugggacucccggca

SEQ ID NO: 380154 - RNA, 32 nt, Human
ccuccuuucuucuucucugccucuccugccuc

SEQ ID NO: 380155 - RNA, 17 nt, Human
ccuccuuucuuggcggg

SEQ ID NO: 380156 - RNA, 18 nt, Human
ccuccuuucuuuugggga

SEQ ID NO: 380157 - RNA, 32 nt, Human
ccuccuuugccucugaaugacccagccuggag

SEQ ID NO: 380158 - RNA, 32 nt, Human
ccuccuuugcgcugggcugagcccagagccga

SEQ ID NO: 380159 - RNA, 32 nt, Human
ccuccuuugcuccugcugcuucucccaacagc

SEQ ID NO: 380160 - RNA, 23 nt, Human
ccuccuuugcuucacucccagca

SEQ ID NO: 380161 - RNA, 17 nt, Human
ccuccuuugguucggga

SEQ ID NO: 380162 - RNA, 18 nt, Human
ccuccuuuguguuagggg

SEQ ID NO: 380163 - RNA, 17 nt, Human
ccuccuuuguugcugga

SEQ ID NO: 380164 - RNA, 19 nt, Human
ccuccuuuuaaaaugggga

SEQ ID NO: 380165 - RNA, 19 nt, Human
ccuccuuuucagguaagga

SEQ ID NO: 380166 - RNA, 18 nt, Human
ccuccuuuuccaaaguga

SEQ ID NO: 380167 - RNA, 18 nt, Human
ccuccuuuuccagcggga

SEQ ID NO: 380168 - RNA, 19 nt, Human
ccuccuuuucccacaggga

SEQ ID NO: 380169 - RNA, 21 nt, Human
ccuccuuuucccaucccgcca

SEQ ID NO: 380170 - RNA, 32 nt, Human
ccuccuuuucccuccaucacucagagguaggg

SEQ ID NO: 380171 - RNA, 19 nt, Human
ccuccuuuucuagaugggg

SEQ ID NO: 380172 - RNA, 19 nt, Human
ccuccuuuucucucaguga

SEQ ID NO: 380173 - RNA, 32 nt, Human
ccuccuuuucuuucucuccucuuugccugucu

SEQ ID NO: 380174 - RNA, 24 nt, Human
ccuccuuuuguuuugaggguuuug

SEQ ID NO: 380175 - RNA, 32 nt, Human
ccuccuuuuucagacuuguuuguaaaguacag

SEQ ID NO: 380176 - RNA, 18 nt, Human
ccuccuuuuuccaaggga

SEQ ID NO: 380177 - RNA, 19 nt, Human
ccuccuuuuucugagugga

SEQ ID NO: 380178 - RNA, 16 nt, Human
ccuccuuuuuggggga

SEQ ID NO: 380179 - RNA, 32 nt, Human
ccucgaaaagugcugggauuacaggcgugagc

SEQ ID NO: 380180 - RNA, 32 nt, Human
ccucgaaccaacaacagaagcugacaaaugcc

SEQ ID NO: 380181 - RNA, 32 nt, Human
ccucgaaccagccacaccaaacucugcugcag

SEQ ID NO: 380182 - RNA, 32 nt, Human
ccucgaacucuugggcuucaagcaauccuccu

SEQ ID NO: 380183 - RNA, 32 nt, Human
ccucgaaggaagcacaaacccuccauccacuu

SEQ ID NO: 380184 - RNA, 32 nt, Human
ccucgacagugaugcaaggacacagagaguac

SEQ ID NO: 380185 - RNA, 32 nt, Human
ccucgacaucuuccuccucuacugguaaccaa

SEQ ID NO: 380186 - RNA, 32 nt, Human
ccucgaccaggggcaccucuacucgaccaggg

SEQ ID NO: 380187 - RNA, 32 nt, Human
ccucgaccccacccuucuuuccuaccagccca

SEQ ID NO: 380188 - RNA, 22 nt, Human
ccucgaccccgugacacccugg

SEQ ID NO: 380189 - RNA, 32 nt, Human
ccucgaccccucacccccuccucccgggcucu

SEQ ID NO: 380190 - RNA, 32 nt, Human
ccucgaccccucucccccuugacuauccaaag

SEQ ID NO: 380191 - RNA, 32 nt, Human
ccucgacccuuccuccuccuuugccuaggagg

SEQ ID NO: 380192 - RNA, 22 nt, Human
ccucgaccgcccacacauuccu

SEQ ID NO: 380193 - RNA, 20 nt, Human
ccucgaccucucucuucuca

SEQ ID NO: 380194 - RNA, 32 nt, Human
ccucgacguucucuccccuucucuccguggcc

SEQ ID NO: 380195 - RNA, 32 nt, Human
ccucgagacucugcaaagcauuacugcugcuu

SEQ ID NO: 380196 - RNA, 32 nt, Human
ccucgagauccucuacccuucucugggccuug

SEQ ID NO: 380197 - RNA, 20 nt, Human
ccucgagaugggugcugguc

SEQ ID NO: 380198 - RNA, 32 nt, Human
ccucgagcaaauggaaugugacuuugaaaacc

SEQ ID NO: 380199 - RNA, 32 nt, Human
ccucgagcaccaugggccugagggguucccgg

SEQ ID NO: 380200 - RNA, 22 nt, Human
ccucgagcagcgugagagaugc

SEQ ID NO: 380201 - RNA, 32 nt, Human
ccucgagcccuagcagugaagaagauuccauu

SEQ ID NO: 380202 - RNA, 22 nt, Human
ccucgagcucgcgaacucggug

SEQ ID NO: 380203 - RNA, 32 nt, Human
ccucgaggaaccuggucuccgcauccaguuac

SEQ ID NO: 380204 - RNA, 32 nt, Human
ccucgaggacauccacaugagccuggagaagg

SEQ ID NO: 380205 - RNA, 32 nt, Human
ccucgaggcagaugcaccugcuugcugcuauu

SEQ ID NO: 380206 - RNA, 20 nt, Human
ccucgaggccagccugcucc

SEQ ID NO: 380207 - RNA, 22 nt, Human
ccucgaggcgggaggggggcag

SEQ ID NO: 380208 - RNA, 32 nt, Human
ccucgaggcucccucugacugaaggcgcgcug

SEQ ID NO: 380209 - RNA, 17 nt, Human
ccucgagguucaccuca

SEQ ID NO: 380210 - RNA, 32 nt, Human
ccucgaucaugacaggcucaucagccugugcc

SEQ ID NO: 380211 - RNA, 22 nt, Human
ccucgaucgucaucucugguua

SEQ ID NO: 380212 - RNA, 32 nt, Human
ccucgaucuauuuccuucuuccuucugaccuc

SEQ ID NO: 380213 - RNA, 32 nt, Human
ccucgaucucccaggcucuuucugcagucaua

SEQ ID NO: 380214 - RNA, 32 nt, Human
ccucgaucucgcucccccuucggucuuucgac

SEQ ID NO: 380215 - RNA, 32 nt, Human
ccucgaugaggugaguugggagcacguuccug

SEQ ID NO: 380216 - RNA, 19 nt, Human
ccucgauucaauugccuua

SEQ ID NO: 380217 - RNA, 32 nt, Human
ccucgcaaccacugcuuugucucugaagugag

SEQ ID NO: 380218 - RNA, 32 nt, Human
ccucgcaagaagcacaggaaagagaaguuucu

SEQ ID NO: 380219 - RNA, 32 nt, Human
ccucgcaaguagcugggacuacagccgugcac

SEQ ID NO: 380220 - RNA, 32 nt, Human
ccucgcaaguagcugggauuacaggcgccugc

SEQ ID NO: 380221 - RNA, 32 nt, Human
ccucgcaccagcugcaccugccuagcauuaga

SEQ ID NO: 380222 - RNA, 22 nt, Human
ccucgcagaggccagcacccca

SEQ ID NO: 380223 - RNA, 24 nt, Human
ccucgcagcaccaucugccucuug

SEQ ID NO: 380224 - RNA, 19 nt, Human
ccucgcagccccuugcucc

SEQ ID NO: 380225 - RNA, 20 nt, Human
ccucgcaggagccgcccccc

SEQ ID NO: 380226 - RNA, 21 nt, Human
ccucgcaggagcucuucuucc

SEQ ID NO: 380227 - RNA, 18 nt, Human
ccucgcagggcccugccg

SEQ ID NO: 380228 - RNA, 32 nt, Human
ccucgcaggggcugagcuggaggcagcgaggc

SEQ ID NO: 380229 - RNA, 32 nt, Human
ccucgcagguggucaucaugcccagggaagga

SEQ ID NO: 380230 - RNA, 21 nt, Human
ccucgcagucaccgccaccca

SEQ ID NO: 380231 - RNA, 32 nt, Human
ccucgcaucuucaccagcauuggagaggacua

SEQ ID NO: 380232 - RNA, 32 nt, Human
ccucgccaacauggugagacccugucucuacu

SEQ ID NO: 380233 - RNA, 32 nt, Human
ccucgccaccauguacgugagcuaccuccugg

SEQ ID NO: 380234 - RNA, 23 nt, Human
ccucgccacuaccgccgccgccg

SEQ ID NO: 380235 - RNA, 32 nt, Human
ccucgccacuccugcucuuucuccacugcaug

SEQ ID NO: 380236 - RNA, 32 nt, Human
ccucgccacugcaccucggcauaugccaccuc

SEQ ID NO: 380237 - RNA, 32 nt, Human
ccucgccagacccuggccagcaugguuguccu

SEQ ID NO: 380238 - RNA, 19 nt, Human
ccucgccagagaagcucuu

SEQ ID NO: 380239 - RNA, 32 nt, Human
ccucgccagccauguggaacuguaaguccauu

SEQ ID NO: 380240 - RNA, 32 nt, Human
ccucgccagcccugcuggaguuugcugugggc

SEQ ID NO: 380241 - RNA, 32 nt, Human
ccucgccaggcacagaggacauggacagucua

SEQ ID NO: 380242 - RNA, 32 nt, Human
ccucgccaggcucucccuggauccagacggga

SEQ ID NO: 380243 - RNA, 32 nt, Human
ccucgccaggcuggcucugccugcgccucacu

SEQ ID NO: 380244 - RNA, 32 nt, Human
ccucgccaucuucuucucacagccggaccgga

SEQ ID NO: 380245 - RNA, 21 nt, Human
ccucgcccaccagcugggccc

SEQ ID NO: 380246 - RNA, 32 nt, Human
ccucgcccaugugggucagugggagcugcagg

SEQ ID NO: 380247 - RNA, 19 nt, Human
ccucgccccaagcaagcca

SEQ ID NO: 380248 - RNA, 32 nt, Human
ccucgccccacagggaccuggacacgcccggc

SEQ ID NO: 380249 - RNA, 22 nt, Human
ccucgccccauccacuccggug

SEQ ID NO: 380250 - RNA, 32 nt, Human
ccucgccccauccuuugcuuccuuccuuccuu

SEQ ID NO: 380251 - RNA, 21 nt, Human
ccucgcccccuccccucgggc

SEQ ID NO: 380252 - RNA, 32 nt, Human
ccucgccccuccaguguugccuccucccaucc

SEQ ID NO: 380253 - RNA, 21 nt, Human
ccucgcccgcggacacccugg

SEQ ID NO: 380254 - RNA, 19 nt, Human
ccucgcccgcugccucccu

SEQ ID NO: 380255 - RNA, 32 nt, Human
ccucgcccucacugcugacuccucuuccagau

SEQ ID NO: 380256 - RNA, 32 nt, Human
ccucgcccuccccucccgauccucauccccuu

SEQ ID NO: 380257 - RNA, 32 nt, Human
ccucgcccuccuccuccuccucgcccuccccu

SEQ ID NO: 380258 - RNA, 32 nt, Human
ccucgcccugcugcauuugcucuugucuggau

SEQ ID NO: 380259 - RNA, 32 nt, Human
ccucgcccuggcccuggcugggcggggaagcu

SEQ ID NO: 380260 - RNA, 32 nt, Human
ccucgcccuguauuucuccaucuccaguucug

SEQ ID NO: 380261 - RNA, 17 nt, Human
ccucgcccuucuccucg

SEQ ID NO: 380262 - RNA, 32 nt, Human
ccucgccgaagccgucaagguggcugcucggg

SEQ ID NO: 380263 - RNA, 22 nt, Human
ccucgccgccagccuuccaggu

SEQ ID NO: 380264 - RNA, 17 nt, Human
ccucgccgccgcccccg

SEQ ID NO: 380265 - RNA, 20 nt, Human
ccucgccgccgccgccgccg

SEQ ID NO: 380266 - RNA, 19 nt, Human
ccucgccgccgccgcugcc

SEQ ID NO: 380267 - RNA, 22 nt, Human
ccucgccgcgcguccguccucc

SEQ ID NO: 380268 - RNA, 32 nt, Human
ccucgccgcgugccuccgcaggagucgggcuc

SEQ ID NO: 380269 - RNA, 26 nt, Human
ccucgccgcuggccaccagccuucca

SEQ ID NO: 380270 - RNA, 20 nt, Human
ccucgccgcuuccccucguc

SEQ ID NO: 380271 - RNA, 32 nt, Human
ccucgccgugcuggcccugaccuggcucagcu

SEQ ID NO: 380272 - RNA, 32 nt, Human
ccucgccucccgcggcugccagcgugcacugg

SEQ ID NO: 380273 - RNA, 32 nt, Human
ccucgccucuuccauccacgucuuccaaggcc

SEQ ID NO: 380274 - RNA, 32 nt, Human
ccucgccugaagccagccucucugccaaguca

SEQ ID NO: 380275 - RNA, 32 nt, Human
ccucgccugagcgggcgccucugaaguggagg

SEQ ID NO: 380276 - RNA, 32 nt, Human
ccucgccugcucccugccuccuuuucagggcu

SEQ ID NO: 380277 - RNA, 32 nt, Human
ccucgccuuccuccuccucgucaggcucgacc

SEQ ID NO: 380278 - RNA, 32 nt, Human
ccucgcgacauccugaucucuccugcaauaac

SEQ ID NO: 380279 - RNA, 32 nt, Human
ccucgcgaccacaagcccucagguccggcgcg

SEQ ID NO: 380280 - RNA, 32 nt, Human
ccucgcgagcagcugggacuacaggugcccgc

SEQ ID NO: 380281 - RNA, 32 nt, Human
ccucgcgaguagcuaggacuacaggcgcaugu

SEQ ID NO: 380282 - RNA, 32 nt, Human
ccucgcgaguagcuggaauuacaggaagcuaa

SEQ ID NO: 380283 - RNA, 32 nt, Human
ccucgcgccugggcagcucucucccagggcuu

SEQ ID NO: 380284 - RNA, 32 nt, Human
ccucgcgccuucugcagacuccguggcuggcg

SEQ ID NO: 380285 - RNA, 32 nt, Human
ccucgcggaaggcguggucuggugacucagaa

SEQ ID NO: 380286 - RNA, 32 nt, Human
ccucgcggacacacccagaugccccagggacc

SEQ ID NO: 380287 - RNA, 32 nt, Human
ccucgcgggaccccacccucucccagccugcc

SEQ ID NO: 380288 - RNA, 22 nt, Human
ccucgcgggaggccggcucaga

SEQ ID NO: 380289 - RNA, 31 nt, Human
ccucgcgggugcagcagcacagcagggagug

SEQ ID NO: 380290 - RNA, 32 nt, Human
ccucgcggugagaggaaggcggaggagcggga

SEQ ID NO: 380291 - RNA, 32 nt, Human
ccucgcuaauggaacaggcaucuugcuggacu

SEQ ID NO: 380292 - RNA, 21 nt, Human
ccucgcuccacgcccuccagg

SEQ ID NO: 380293 - RNA, 32 nt, Human
ccucgcuccccacucugcucugaugcaucaga

SEQ ID NO: 380294 - RNA, 21 nt, Human
ccucgcucccgccccucgagg

SEQ ID NO: 380295 - RNA, 32 nt, Human
ccucgcucccggaccccacggcugcaaacuga

SEQ ID NO: 380296 - RNA, 32 nt, Human
ccucgcucccuccccgcucgcuuccuccccca

SEQ ID NO: 380297 - RNA, 32 nt, Human
ccucgcucccuucaagacgaggggcagggaag

SEQ ID NO: 380298 - RNA, 32 nt, Human
ccucgcuccugagaccuggcccugccacacgc

SEQ ID NO: 380299 - RNA, 32 nt, Human
ccucgcucgaggccucuucuccccagcaccgc

SEQ ID NO: 380300 - RNA, 32 nt, Human
ccucgcucucccuccuccuccuccuccgagcu

SEQ ID NO: 380301 - RNA, 32 nt, Human
ccucgcucucugucuccagcaguucucucgaa

SEQ ID NO: 380302 - RNA, 32 nt, Human
ccucgcucuggccgcucuugcugcuccugucu

SEQ ID NO: 380303 - RNA, 23 nt, Human
ccucgcugaacaccaucccgcca

SEQ ID NO: 380304 - RNA, 32 nt, Human
ccucgcugaggagagaaagggaggcgugccug

SEQ ID NO: 380305 - RNA, 32 nt, Human
ccucgcugccauucucugggcuggaaugugaa

SEQ ID NO: 380306 - RNA, 32 nt, Human
ccucgcugccuagauuccgaggaaaaggagau

SEQ ID NO: 380307 - RNA, 19 nt, Human
ccucgcugcugucauccca

SEQ ID NO: 380308 - RNA, 32 nt, Human
ccucgcuggaacauguccugccaccaagugcc

SEQ ID NO: 380309 - RNA, 20 nt, Human
ccucgcuggcgccccagagc

SEQ ID NO: 380310 - RNA, 32 nt, Human
ccucgcuguccggcccccaccccagccucgcc

SEQ ID NO: 380311 - RNA, 32 nt, Human
ccucgcugugccaccaccccucccucugcucu

SEQ ID NO: 380312 - RNA, 32 nt, Human
ccucgcuucagggucagaguccaaguacagau

SEQ ID NO: 380313 - RNA, 19 nt, Human
ccucgcuuccccugaguca

SEQ ID NO: 380314 - RNA, 32 nt, Human
ccucggaaaagcuucaaguagagcuggagacc

SEQ ID NO: 380315 - RNA, 32 nt, Human
ccucggaacgcuugccuuuccucccuccacaa

SEQ ID NO: 380316 - RNA, 32 nt, Human
ccucggaacugcggucuccugccugugcuuca

SEQ ID NO: 380317 - RNA, 19 nt, Human
ccucggacagucccugcuc

SEQ ID NO: 380318 - RNA, 32 nt, Human
ccucggaccagagccauguaagaaaaggccug

SEQ ID NO: 380319 - RNA, 32 nt, Human
ccucggacucaagugauccaccagccuccacc

SEQ ID NO: 380320 - RNA, 23 nt, Human
ccucggacucugguuaccucuga

SEQ ID NO: 380321 - RNA, 32 nt, Human
ccucggacugaagcaagagacagggaaggaau

SEQ ID NO: 380322 - RNA, 32 nt, Human
ccucggagagccugagcaguccaaugggggcu

SEQ ID NO: 380323 - RNA, 32 nt, Human
ccucggagcaccagucacuuacuccaagaagu

SEQ ID NO: 380324 - RNA, 32 nt, Human
ccucggagcccaggcagcuguguccagugaga

SEQ ID NO: 380325 - RNA, 18 nt, Human
ccucggagcuccacagua

SEQ ID NO: 380326 - RNA, 32 nt, Human
ccucggaggcagaggaaggaaaauggggaugg

SEQ ID NO: 380327 - RNA, 23 nt, Human
ccucggaggcggagguugcagug

SEQ ID NO: 380328 - RNA, 24 nt, Human
ccucggaggcggagguugcaguga

SEQ ID NO: 380329 - RNA, 32 nt, Human
ccucggaggcggagguugcagugagccaagau

SEQ ID NO: 380330 - RNA, 32 nt, Human
ccucggaggcggagguugcagugagcugagau

SEQ ID NO: 380331 - RNA, 32 nt, Human
ccucggaggcguucagcugcuucaagaugaag

SEQ ID NO: 380332 - RNA, 32 nt, Human
ccucggaggcugaaguugcagugagccaagau

SEQ ID NO: 380333 - RNA, 32 nt, Human
ccucggcaacuggccgcacugacccgucaacu

SEQ ID NO: 380334 - RNA, 32 nt, Human
ccucggcacagcugccacgggcucuccugggc

SEQ ID NO: 380335 - RNA, 32 nt, Human
ccucggcagcagcgggaggcagaggaaggcgg

SEQ ID NO: 380336 - RNA, 32 nt, Human
ccucggcagccacagccgcugcagccggggca

SEQ ID NO: 380337 - RNA, 20 nt, Human
ccucggcagccuugggaagc

SEQ ID NO: 380338 - RNA, 32 nt, Human
ccucggcaggcauggcuggugccugaagaccc

SEQ ID NO: 380339 - RNA, 20 nt, Human
ccucggccaucggcugcucc

SEQ ID NO: 380340 - RNA, 20 nt, Human
ccucggcccagaccucggug

SEQ ID NO: 380341 - RNA, 32 nt, Human
ccucggccccgcugcacuccaccuccgccccc

SEQ ID NO: 380342 - RNA, 32 nt, Human
ccucggccccuuccucucuacacagaguggug

SEQ ID NO: 380343 - RNA, 32 nt, Human
ccucggcccucgggcggucgaugggacggggc

SEQ ID NO: 380344 - RNA, 32 nt, Human
ccucggcccuggagcugaagguggaggagcug

SEQ ID NO: 380345 - RNA, 32 nt, Human
ccucggccgcccccaccgccucccagauguac

SEQ ID NO: 380346 - RNA, 15 nt, Human
ccucggccgcugccg

SEQ ID NO: 380347 - RNA, 32 nt, Human
ccucggccgugaggaggaggagggaugcaagc

SEQ ID NO: 380348 - RNA, 32 nt, Human
ccucggccuccaggagugggaguuggaguuga

SEQ ID NO: 380349 - RNA, 32 nt, Human
ccucggccucgacgccagcccaggcgccgacc

SEQ ID NO: 380350 - RNA, 19 nt, Human
ccucggccucggccuccga

SEQ ID NO: 380351 - RNA, 32 nt, Human
ccucggccucucaaacugcugggauuacaggc

SEQ ID NO: 380352 - RNA, 32 nt, Human
ccucggccuggacuacuauagcggggacagca

SEQ ID NO: 380353 - RNA, 21 nt, Human
ccucggcgaagggacagcgaa

SEQ ID NO: 380354 - RNA, 32 nt, Human
ccucggcgcccagggucugaggcugcagcccc

SEQ ID NO: 380355 - RNA, 32 nt, Human
ccucggcggcaccccucgucccgcgacuacuu

SEQ ID NO: 380356 - RNA, 32 nt, Human
ccucggcgguucccaucaccacugcaguucca

SEQ ID NO: 380357 - RNA, 23 nt, Human
ccucggcgucccuuccccucccc

SEQ ID NO: 380358 - RNA, 32 nt, Human
ccucggcucacugcaaccuccgccucccaggu

SEQ ID NO: 380359 - RNA, 32 nt, Human
ccucggcucacugcaaccucugucuccugggu

SEQ ID NO: 380360 - RNA, 32 nt, Human
ccucggcucacugcaaccuuugccuccuaggu

SEQ ID NO: 380361 - RNA, 32 nt, Human
ccucggcucacugcagccuccuucuccugggu

SEQ ID NO: 380362 - RNA, 32 nt, Human
ccucggcucacugcauccucugccuccugggu

SEQ ID NO: 380363 - RNA, 32 nt, Human
ccucggcucacuguaaccuucaccuuccgugu

SEQ ID NO: 380364 - RNA, 32 nt, Human
ccucggcuccacugcuucaggucacuucccau

SEQ ID NO: 380365 - RNA, 32 nt, Human
ccucggcuccagaagcuggggcucaggguccg

SEQ ID NO: 380366 - RNA, 18 nt, Human
ccucggcuccagguccua

SEQ ID NO: 380367 - RNA, 32 nt, Human
ccucggcuccccucacuggggccuugggcagg

SEQ ID NO: 380368 - RNA, 21 nt, Human
ccucggcucucuccucuuccc

SEQ ID NO: 380369 - RNA, 32 nt, Human
ccucggcucuuccuccuccuucuccgggaccc

SEQ ID NO: 380370 - RNA, 32 nt, Human
ccucggcuggacucccuguggcccaguccgga

SEQ ID NO: 380371 - RNA, 32 nt, Human
ccucggcugugugguguggccugcugcuucca

SEQ ID NO: 380372 - RNA, 32 nt, Human
ccucggcuuacugcaaccuccaccucccgggu

SEQ ID NO: 380373 - RNA, 32 nt, Human
ccucggcuuacugcaaccuccgccuucccaga

SEQ ID NO: 380374 - RNA, 32 nt, Human
ccucggcuugggcugcacucuacccuguacac

SEQ ID NO: 380375 - RNA, 32 nt, Human
ccucgggaaccaccuccaucuccagcagaagu

SEQ ID NO: 380376 - RNA, 32 nt, Human
ccucgggacagucaccugccacugaguggcca

SEQ ID NO: 380377 - RNA, 32 nt, Human
ccucgggagcaccccaccucugugugugaugu

SEQ ID NO: 380378 - RNA, 32 nt, Human
ccucgggagcccaggugcagagcgaggccgug

SEQ ID NO: 380379 - RNA, 32 nt, Human
ccucgggagccccugcgguggagcucugagug

SEQ ID NO: 380380 - RNA, 32 nt, Human
ccucgggaggcugaggcaggagaaucgcuuga

SEQ ID NO: 380381 - RNA, 32 nt, Human
ccucgggaggguggcagguuggagggcccgua

SEQ ID NO: 380382 - RNA, 32 nt, Human
ccucgggaugcagugacugagauaggggcccu

SEQ ID NO: 380383 - RNA, 32 nt, Human
ccucgggauguggcguuguuuggagaaagggu

SEQ ID NO: 380384 - RNA, 21 nt, Human
ccucgggcaacuccugccacc

SEQ ID NO: 380385 - RNA, 32 nt, Human
ccucgggcaccugucauuuccaauaugguagg

SEQ ID NO: 380386 - RNA, 32 nt, Human
ccucgggcacucccaagucugccucuuggcuc

SEQ ID NO: 380387 - RNA, 32 nt, Human
ccucgggcacucggaagagaacggcggagaca

SEQ ID NO: 380388 - RNA, 22 nt, Human
ccucgggcagcccaaagcuccu

SEQ ID NO: 380389 - RNA, 25 nt, Human
ccucgggcagccccuccagcuuccu

SEQ ID NO: 380390 - RNA, 20 nt, Human
ccucgggcagcccugagccu

SEQ ID NO: 380391 - RNA, 19 nt, Human
ccucgggccacccugcucc

SEQ ID NO: 380392 - RNA, 32 nt, Human
ccucgggccacuaguguuagcccaaggugggc

SEQ ID NO: 380393 - RNA, 32 nt, Human
ccucgggccauccagcccaguguuuucuuuag

SEQ ID NO: 380394 - RNA, 32 nt, Human
ccucgggccauggugcucucccaggaggagcc

SEQ ID NO: 380395 - RNA, 21 nt, Human
ccucgggcccggccugcgccu

SEQ ID NO: 380396 - RNA, 32 nt, Human
ccucgggcccuccugccugcaggaucaugccc

SEQ ID NO: 380397 - RNA, 32 nt, Human
ccucgggcccucucuccgccccggacagggug

SEQ ID NO: 380398 - RNA, 20 nt, Human
ccucgggccgccugccgccg

SEQ ID NO: 380399 - RNA, 24 nt, Human
ccucgggccgcuccccugcgccuu

SEQ ID NO: 380400 - RNA, 20 nt, Human
ccucgggccucccuucuccu

SEQ ID NO: 380401 - RNA, 21 nt, Human
ccucgggcgcccccgccgccg

SEQ ID NO: 380402 - RNA, 32 nt, Human
ccucgggcucucacccuccucuccugcagcuc

SEQ ID NO: 380403 - RNA, 24 nt, Human
ccucgggcucugcucaccucuggu

SEQ ID NO: 380404 - RNA, 32 nt, Human
ccucgggcugcggacucugccuccugggucug

SEQ ID NO: 380405 - RNA, 32 nt, Human
ccucgggcuggcuggcucagugggcagcaggg

SEQ ID NO: 380406 - RNA, 32 nt, Human
ccucgggcuuaccacccuccccaggacccgug

SEQ ID NO: 380407 - RNA, 20 nt, Human
ccucggggaccccugcugcu

SEQ ID NO: 380408 - RNA, 32 nt, Human
ccucggggagagaagaaaggagggggcaaggg

SEQ ID NO: 380409 - RNA, 19 nt, Human
ccucggggagagggcgcgg

SEQ ID NO: 380410 - RNA, 32 nt, Human
ccucggggagcagcaccccgccucccuccagc

SEQ ID NO: 380411 - RNA, 32 nt, Human
ccucggggagugggaaguggaggcaggagccu

SEQ ID NO: 380412 - RNA, 32 nt, Human
ccucggggcaccguugcugggcggcgccggcg

SEQ ID NO: 380413 - RNA, 32 nt, Human
ccucggggccgcaggaaggaagaggaggcagc

SEQ ID NO: 380414 - RNA, 18 nt, Human
ccucgggucagccagaua

SEQ ID NO: 380415 - RNA, 32 nt, Human
ccucggguccccaagccgcugggagauguccc

SEQ ID NO: 380416 - RNA, 32 nt, Human
ccucgguauccaggaggauugucagcaggacu

SEQ ID NO: 380417 - RNA, 32 nt, Human
ccucgguauggaggggacagugaugugacagc

SEQ ID NO: 380418 - RNA, 32 nt, Human
ccucgguaugugucauccucugccuuuacugc

SEQ ID NO: 380419 - RNA, 32 nt, Human
ccucggucacccacagagccaccaaagauucc

SEQ ID NO: 380420 - RNA, 32 nt, Human
ccucgguccuacagcacuguguaggcugcauc

SEQ ID NO: 380421 - RNA, 32 nt, Human
ccucggugccccgccgggugcaucaccagguc

SEQ ID NO: 380422 - RNA, 32 nt, Human
ccucggugccuuccucuuuuuauuuaguuccu

SEQ ID NO: 380423 - RNA, 32 nt, Human
ccucggugcuucccagcugccgucugcaccag

SEQ ID NO: 380424 - RNA, 32 nt, Human
ccucgguggcgggcauggaggcuucgcgcugc

SEQ ID NO: 380425 - RNA, 32 nt, Human
ccucgguggugaauacauucuuggguggugaa

SEQ ID NO: 380426 - RNA, 32 nt, Human
ccucgguggugaggacuggaugcuagacugcu

SEQ ID NO: 380427 - RNA, 32 nt, Human
ccucgguucacuacaaccuccgccuccugggu

SEQ ID NO: 380428 - RNA, 32 nt, Human
ccucgguuccucuuacccucuucuuggacccu

SEQ ID NO: 380429 - RNA, 32 nt, Human
ccucgguucuccagcucacccccagccugccg

SEQ ID NO: 380430 - RNA, 32 nt, Human
ccucgguuugaacaagcgcaaaaagaaggacg

SEQ ID NO: 380431 - RNA, 24 nt, Human
ccucguaauccaccugccguggcc

SEQ ID NO: 380432 - RNA, 32 nt, Human
ccucguaauuuuggacugccacacauugguac

SEQ ID NO: 380433 - RNA, 32 nt, Human
ccucguacuguugucacuaugagcuuaagaaa

SEQ ID NO: 380434 - RNA, 22 nt, Human
ccucguagaggcagugcuggcc

SEQ ID NO: 380435 - RNA, 32 nt, Human
ccucguaggguggucacggagccccugcgccu

SEQ ID NO: 380436 - RNA, 32 nt, Human
ccucguagugucccaagaaauggccuugacac

SEQ ID NO: 380437 - RNA, 32 nt, Human
ccucgucaauccaucagcaaugcuucucucau

SEQ ID NO: 380438 - RNA, 22 nt, Human
ccucgucacacugcggcacagg

SEQ ID NO: 380439 - RNA, 32 nt, Human
ccucgucacccugacaucucuccgggaagacu

SEQ ID NO: 380440 - RNA, 32 nt, Human
ccucgucagacuccugugcucuuccaggggcu

SEQ ID NO: 380441 - RNA, 32 nt, Human
ccucgucagaugcucauccccuaaaagguuaa

SEQ ID NO: 380442 - RNA, 32 nt, Human
ccucgucagggcccugcagugcggcgccccgg

SEQ ID NO: 380443 - RNA, 17 nt, Human
ccucgucagucaccuca

SEQ ID NO: 380444 - RNA, 32 nt, Human
ccucgucauuuucuuucccagaagcgcccugu

SEQ ID NO: 380445 - RNA, 18 nt, Human
ccucguccaccgcugccg

SEQ ID NO: 380446 - RNA, 32 nt, Human
ccucguccaggcugccccgcagcuccucacgu

SEQ ID NO: 380447 - RNA, 32 nt, Human
ccucgucccaggaggccaccccugagaaagag

SEQ ID NO: 380448 - RNA, 32 nt, Human
ccucguccccagccugcacuccugggcgaagg

SEQ ID NO: 380449 - RNA, 32 nt, Human
ccucguccucaaacuaaaggccacagaaaugg

SEQ ID NO: 380450 - RNA, 32 nt, Human
ccucguccugcccugcgggcucaggcggaacc

SEQ ID NO: 380451 - RNA, 32 nt, Human
ccucgucguuccuccuccuuccauuugaccca

SEQ ID NO: 380452 - RNA, 32 nt, Human
ccucgucguucuuucuccccugccucucaccu

SEQ ID NO: 380453 - RNA, 32 nt, Human
ccucgucuaagcugccacuuacagacaucugc

SEQ ID NO: 380454 - RNA, 32 nt, Human
ccucgucucccaucuacaaaacgugaagauug

SEQ ID NO: 380455 - RNA, 32 nt, Human
ccucgucuccccugccccaucuggugcuuaca

SEQ ID NO: 380456 - RNA, 32 nt, Human
ccucgucugcucuccucucucuuccaacacag

SEQ ID NO: 380457 - RNA, 32 nt, Human
ccucgugagccaccacgcccagccucuuuugc

SEQ ID NO: 380458 - RNA, 32 nt, Human
ccucgugaguagcugagauuacaggcgcccgc

SEQ ID NO: 380459 - RNA, 32 nt, Human
ccucgugauccgcccaccucagccucucaaag

SEQ ID NO: 380460 - RNA, 32 nt, Human
ccucgugauccgcccaucuccaccucccgcag

SEQ ID NO: 380461 - RNA, 32 nt, Human
ccucgugaucuaccggccucagccucucaaag

SEQ ID NO: 380462 - RNA, 32 nt, Human
ccucgugaucugccugccucagccucucaaag

SEQ ID NO: 380463 - RNA, 32 nt, Human
ccucgugauucacccaccuugggcucccaaag

SEQ ID NO: 380464 - RNA, 32 nt, Human
ccucgugcagagcuggggcugccagccugagc

SEQ ID NO: 380465 - RNA, 32 nt, Human
ccucgugccaacgugucuuguaaggugcggcu

SEQ ID NO: 380466 - RNA, 32 nt, Human
ccucgugccagcugcuggugcagccucuccug

SEQ ID NO: 380467 - RNA, 20 nt, Human
ccucgugccccugcccagcc

SEQ ID NO: 380468 - RNA, 32 nt, Human
ccucgugccugugaucccagcacuuugggagg

SEQ ID NO: 380469 - RNA, 32 nt, Human
ccucgugcugggcucugcccugggcagacagg

SEQ ID NO: 380470 - RNA, 32 nt, Human
ccucguggccacucuaggccucacggaggagg

SEQ ID NO: 380471 - RNA, 32 nt, Human
ccucgugggcccugaccuucucucugagagcc

SEQ ID NO: 380472 - RNA, 32 nt, Human
ccucgugggguuuucacccugcuuggcgccag

SEQ ID NO: 380473 - RNA, 32 nt, Human
ccucgugucaucuccgggguggccacaggcua

SEQ ID NO: 380474 - RNA, 18 nt, Human
ccucgugucguuaccuca

SEQ ID NO: 380475 - RNA, 32 nt, Human
ccucgugucucccaggagccauggaggcugug

SEQ ID NO: 380476 - RNA, 32 nt, Human
ccucgugugacggcgggggucggugaagaccc

SEQ ID NO: 380477 - RNA, 32 nt, Human
ccucgugugucaccccacagagcugucugugg

SEQ ID NO: 380478 - RNA, 32 nt, Human
ccucguguucccagcugccucuugccuugaua

SEQ ID NO: 380479 - RNA, 32 nt, Human
ccucguguugccauugccucucucggauccuc

SEQ ID NO: 380480 - RNA, 32 nt, Human
ccucguuaguauagugguugguugggaugagu

SEQ ID NO: 380481 - RNA, 28 nt, Human
ccucguuauccggcugccuccuccuccc

SEQ ID NO: 380482 - RNA, 32 nt, Human
ccucguuauucguccuccucggguccauccgg

SEQ ID NO: 380483 - RNA, 32 nt, Human
ccucguuccugggucaguaucagucuacugug

SEQ ID NO: 380484 - RNA, 32 nt, Human
ccucguucuccucgcaguggcccuggcuccca

SEQ ID NO: 380485 - RNA, 32 nt, Human
ccucguucugaccccacuacaacaaggcccau

SEQ ID NO: 380486 - RNA, 32 nt, Human
ccucguuuccaggccucuccccaggcuugcca

SEQ ID NO: 380487 - RNA, 32 nt, Human
ccucguuuugacuggcucuaucaggauaaauu

SEQ ID NO: 380488 - RNA, 32 nt, Human
ccucuaaaaauaccaaaauuagcugggacugg

SEQ ID NO: 380489 - RNA, 32 nt, Human
ccucuaaaaugcugggauuacaggcgugagcc

SEQ ID NO: 380490 - RNA, 32 nt, Human
ccucuaaacucugugcugggcagccacacgug

SEQ ID NO: 380491 - RNA, 32 nt, Human
ccucuaaagcagcgugagaugggaaugaucua

SEQ ID NO: 380492 - RNA, 32 nt, Human
ccucuaacaauauaauaauuagccaggcgugg

SEQ ID NO: 380493 - RNA, 32 nt, Human
ccucuaacacuuccaacuccagccaccacuuu

SEQ ID NO: 380494 - RNA, 32 nt, Human
ccucuaacauccucgcaccagacaggacaggu

SEQ ID NO: 380495 - RNA, 32 nt, Human
ccucuaacccccagugccacagagaagacggg

SEQ ID NO: 380496 - RNA, 32 nt, Human
ccucuaacccucauugcugucuugccccaguu

SEQ ID NO: 380497 - RNA, 32 nt, Human
ccucuaaccuauaaacugacaacucuaacucu

SEQ ID NO: 380498 - RNA, 32 nt, Human
ccucuaacucccuccucacacuccagaauuac

SEQ ID NO: 380499 - RNA, 32 nt, Human
ccucuaacuguacugcucacucgacaucccau

SEQ ID NO: 380500 - RNA, 32 nt, Human
ccucuaagaaccacagccacagagucaggcuc

SEQ ID NO: 380501 - RNA, 32 nt, Human
ccucuaagccauuagaauaucuugccugauaa

SEQ ID NO: 380502 - RNA, 17 nt, Human
ccucuaagccucugaca

SEQ ID NO: 380503 - RNA, 32 nt, Human
ccucuaagcuguuccugcuucugcucuccuca

SEQ ID NO: 380504 - RNA, 32 nt, Human
ccucuaagcuguucucucccaccccaccuuuc

SEQ ID NO: 380505 - RNA, 23 nt, Human
ccucuaagucugcuugauagagu

SEQ ID NO: 380506 - RNA, 32 nt, Human
ccucuaaucccagcuacucaggaggcuaaggc

SEQ ID NO: 380507 - RNA, 23 nt, Human
ccucuaaucccagcuacuuggga

SEQ ID NO: 380508 - RNA, 32 nt, Human
ccucuaaucccagcuacuugggaggcugaggg

SEQ ID NO: 380509 - RNA, 32 nt, Human
ccucuaaugaagcacagagagaggaagagagc

SEQ ID NO: 380510 - RNA, 23 nt, Human
ccucuacaaaccaccagcuucau

SEQ ID NO: 380511 - RNA, 32 nt, Human
ccucuacaaggaggugaugcuggagaacuaua

SEQ ID NO: 380512 - RNA, 25 nt, Human
ccucuacacggccccuuggggccug

SEQ ID NO: 380513 - RNA, 21 nt, Human
ccugcccagaacccuuccuga

SEQ ID NO: 380514 - RNA, 22 nt, Human
ccugcccagaccccacaccccu

SEQ ID NO: 380515 - RNA, 32 nt, Human
ccugcccagacuagcugcaccuccucauuccc

SEQ ID NO: 380516 - RNA, 20 nt, Human
ccugcccagagcccccuccg

SEQ ID NO: 380517 - RNA, 32 nt, Human
ccugcccagcaaccugccagcuacaggagccc

SEQ ID NO: 380518 - RNA, 32 nt, Human
ccugcccagcauugccaacgaccucauguaca

SEQ ID NO: 380519 - RNA, 32 nt, Human
ccugcccagcccucccuuccuuccucugccgg

SEQ ID NO: 380520 - RNA, 32 nt, Human
ccugcccagcccucgucaccacagggacuccu

SEQ ID NO: 380521 - RNA, 22 nt, Human
ccugcccagcugccgcccccgg

SEQ ID NO: 380522 - RNA, 32 nt, Human
ccugcccagcugggaggagucagagcuggcuu

SEQ ID NO: 380523 - RNA, 32 nt, Human
ccugcccaggaaggugccugcacaugagagga

SEQ ID NO: 380524 - RNA, 32 nt, Human
ccugcccaggagaugccacccaggaggagccc

SEQ ID NO: 380525 - RNA, 21 nt, Human
ccugcccaggccacugugagg

SEQ ID NO: 380526 - RNA, 32 nt, Human
ccugcccagggacccccaucaccagcucucca

SEQ ID NO: 380527 - RNA, 32 nt, Human
ccugcccagggagagagagggaguggagccca

SEQ ID NO: 380528 - RNA, 32 nt, Human
ccugcccagggcacccacgccucggcgaccac

SEQ ID NO: 380529 - RNA, 32 nt, Human
ccugcccagggggagagcggagcgguccgcag

SEQ ID NO: 380530 - RNA, 32 nt, Human
ccugcccagggggagagcggagcuccgcagcc

SEQ ID NO: 380531 - RNA, 32 nt, Human
ccugcccagguguggagcgaggggcacagggg

SEQ ID NO: 380532 - RNA, 32 nt, Human
ccugcccaguggccccagccuacagggacugg

SEQ ID NO: 380533 - RNA, 32 nt, Human
ccugcccauaucuuacucugcuuccaucucuc

SEQ ID NO: 380534 - RNA, 21 nt, Human
ccugcccaucagcgucaggaa

SEQ ID NO: 380535 - RNA, 32 nt, Human
ccugcccauccucccuuuuaccuccucucuuu

SEQ ID NO: 380536 - RNA, 32 nt, Human
ccugcccaucuguucucccagcugagccaagg

SEQ ID NO: 380537 - RNA, 32 nt, Human
ccugcccaugcccacacuacaggccagggcug

SEQ ID NO: 380538 - RNA, 32 nt, Human
ccugcccaugcugcuugcaucccuggagaauc

SEQ ID NO: 380539 - RNA, 32 nt, Human
ccugcccaugucucaaaacaaacacauguaca

SEQ ID NO: 380540 - RNA, 32 nt, Human
ccugcccauguuguugagaggucuuggugagg

SEQ ID NO: 380541 - RNA, 32 nt, Human
ccugccccaacucuccccugaccugugagccc

SEQ ID NO: 380542 - RNA, 32 nt, Human
ccugccccaagagugaggcaaggagguccagc

SEQ ID NO: 380543 - RNA, 32 nt, Human
ccugccccaagugccuugcuuuuacaguggac

SEQ ID NO: 380544 - RNA, 20 nt, Human
ccugccccacccacccagug

SEQ ID NO: 380545 - RNA, 19 nt, Human
ccugccccacccccugccu

SEQ ID NO: 380546 - RNA, 19 nt, Human
ccugccccaccgcaccccc

SEQ ID NO: 380547 - RNA, 32 nt, Human
ccugccccacugcugucucaguaccaagaaaa

SEQ ID NO: 380548 - RNA, 32 nt, Human
ccugccccagcccaaguccaaauguuuacggg

SEQ ID NO: 380549 - RNA, 32 nt, Human
ccugccccagcccuggcucuuuccuaaccccc

SEQ ID NO: 380550 - RNA, 32 nt, Human
ccugccccagccugcccuggcugcagcaaggg

SEQ ID NO: 380551 - RNA, 32 nt, Human
ccugccccagccugugccuucugcuggggcag

SEQ ID NO: 380552 - RNA, 32 nt, Human
ccugccccaggcgggcuagagugcaguggcau

SEQ ID NO: 380553 - RNA, 18 nt, Human
ccugccccaggugccgcu

SEQ ID NO: 380554 - RNA, 18 nt, Human
ccugccccaucccuuccc

SEQ ID NO: 380555 - RNA, 32 nt, Human
ccugcccccaaaauauuuucaucuuuccccca

SEQ ID NO: 380556 - RNA, 23 nt, Human
ccugcccccaaaggugguuugcu

SEQ ID NO: 380557 - RNA, 32 nt, Human
ccugcccccacacccacuccacaccaguaaua

SEQ ID NO: 380558 - RNA, 32 nt, Human
ccugcccccacaccugcacccaaacagacaca

SEQ ID NO: 380559 - RNA, 32 nt, Human
ccugcccccacccccagcaucgcaguaagccu

SEQ ID NO: 380560 - RNA, 32 nt, Human
ccugcccccacugucuggccucucccuguucc

SEQ ID NO: 380561 - RNA, 32 nt, Human
ccugcccccagaggagccaggagucugggagg

SEQ ID NO: 380562 - RNA, 20 nt, Human
ccugcccccagccugugugc

SEQ ID NO: 380563 - RNA, 18 nt, Human
ccugccccccucccuucc

SEQ ID NO: 380564 - RNA, 19 nt, Human
ccugcccccgggcacugca

SEQ ID NO: 380565 - RNA, 32 nt, Human
ccugcccccucccccuucuccugggacccucg

SEQ ID NO: 380566 - RNA, 25 nt, Human
ccugcccccucccgccuguuuuucc

SEQ ID NO: 380567 - RNA, 20 nt, Human
ccugcccccucuccuuuccc

SEQ ID NO: 380568 - RNA, 32 nt, Human
ccugcccccugccccauuucccaugagcacac

SEQ ID NO: 380569 - RNA, 32 nt, Human
ccugcccccugccccugcuggcacauuuaacc

SEQ ID NO: 380570 - RNA, 32 nt, Human
ccugcccccugcccucuguccuggcucugcac

SEQ ID NO: 380571 - RNA, 32 nt, Human
ccugcccccuguccccugccucuuuucccaau

SEQ ID NO: 380572 - RNA, 23 nt, Human
ccugcccccuucccccacccccg

SEQ ID NO: 380573 - RNA, 32 nt, Human
ccugccccgacaccucgggcacaucgcaugca

SEQ ID NO: 380574 - RNA, 32 nt, Human
ccugccccgcagccagugccccugccagcugc

SEQ ID NO: 380575 - RNA, 32 nt, Human
ccugccccggcuuccccagccucccagcaggg

SEQ ID NO: 380576 - RNA, 32 nt, Human
ccugccccguccacuuucccaucuccucggua

SEQ ID NO: 380577 - RNA, 32 nt, Human
ccugccccuccaccacccccgccuccaaugau

SEQ ID NO: 380578 - RNA, 32 nt, Human
ccugccccuccacccccucagaucaggcauag

SEQ ID NO: 380579 - RNA, 32 nt, Human
ccugccccuccagaguccagagccaggaaggg

SEQ ID NO: 380580 - RNA, 32 nt, Human
ccugccccuccaggccacugaguguuuuggcc

SEQ ID NO: 380581 - RNA, 21 nt, Human
ccugccccuccaguuccuugg

SEQ ID NO: 380582 - RNA, 32 nt, Human
ccugccccucccccauuggcugacuuccguca

SEQ ID NO: 380583 - RNA, 32 nt, Human
ccugccccuccugucgggaacaauuugaggaa

SEQ ID NO: 380584 - RNA, 21 nt, Human
ccugccccucgguucugcucg

SEQ ID NO: 380585 - RNA, 31 nt, Human
ccugccccucucucugggagcucugucccgu

SEQ ID NO: 380586 - RNA, 32 nt, Human
ccugccccugcacucaggcuugugaaggcccc

SEQ ID NO: 380587 - RNA, 32 nt, Human
ccugccccugcauuuguccugggaaacacggu

SEQ ID NO: 380588 - RNA, 32 nt, Human
ccugccccugcccccaccuccuggagggccug

SEQ ID NO: 380589 - RNA, 32 nt, Human
ccugccccugcucacuaagcugggcagccucc

SEQ ID NO: 380590 - RNA, 32 nt, Human
ccugccccugcuccauguccuuguguggcugc

SEQ ID NO: 380591 - RNA, 32 nt, Human
ccugccccugcucguggugugaggcccagccc

SEQ ID NO: 380592 - RNA, 32 nt, Human
ccugccccugggaacugaaugucuccguauaa

SEQ ID NO: 380593 - RNA, 32 nt, Human
ccugccccuuccaagccuaucggggugggguc

SEQ ID NO: 380594 - RNA, 32 nt, Human
ccugccccuucuacacucuccugggccccucc

SEQ ID NO: 380595 - RNA, 32 nt, Human
ccugccccuucucuccccuguaaccuguuuau

SEQ ID NO: 380596 - RNA, 23 nt, Human
ccugccccuugcacaccacccgg

SEQ ID NO: 380597 - RNA, 32 nt, Human
ccugccccuuggcugcucucggacucccuacc

SEQ ID NO: 380598 - RNA, 32 nt, Human
ccugccccuuucugcagccuaggcggcccagg

SEQ ID NO: 380599 - RNA, 32 nt, Human
ccugccccuuucugucccauccuucccaagaa

SEQ ID NO: 380600 - RNA, 32 nt, Human
ccugcccgagagagcucuggccccgcuagcgg

SEQ ID NO: 380601 - RNA, 20 nt, Human
ccugcccgaggcccagucgg

SEQ ID NO: 380602 - RNA, 32 nt, Human
ccugcccgauccaccguccugaggcagagugu

SEQ ID NO: 380603 - RNA, 19 nt, Human
ccugcccgcacuccugccu

SEQ ID NO: 380604 - RNA, 16 nt, Human
ccugcccgccgcugcc

SEQ ID NO: 380605 - RNA, 32 nt, Human
ccugcccgccggcccgcggcuccugggccucc

SEQ ID NO: 380606 - RNA, 32 nt, Human
ccugcccgcgagagacugucgggaaguugacc

SEQ ID NO: 380607 - RNA, 32 nt, Human
ccugcccgcuacucccacucucagacacccag

SEQ ID NO: 380608 - RNA, 23 nt, Human
ccugcccggacuuccagccccgg

SEQ ID NO: 380609 - RNA, 21 nt, Human
ccugcccggcagccacacccc

SEQ ID NO: 380610 - RNA, 32 nt, Human
ccugcccggccucgcccccacccgcgagcgcc

SEQ ID NO: 380611 - RNA, 32 nt, Human
ccugcccggccuggccccgccccugcccggcc

SEQ ID NO: 380612 - RNA, 32 nt, Human
ccugcccggcguggacgugagccggccucagc

SEQ ID NO: 380613 - RNA, 21 nt, Human
ccugcccgggaccuccgccgg

SEQ ID NO: 380614 - RNA, 32 nt, Human
ccugcccgggagaacccugccugaagcucugg

SEQ ID NO: 380615 - RNA, 21 nt, Human
ccugcccggggagcugcagag

SEQ ID NO: 380616 - RNA, 19 nt, Human
ccugcccggggcaaccccg

SEQ ID NO: 380617 - RNA, 32 nt, Human
ccugcccggugcccacccugcugguaggagcc

SEQ ID NO: 380618 - RNA, 32 nt, Human
ccugcccguccccucaccagcgccuccccacc

SEQ ID NO: 380619 - RNA, 32 nt, Human
ccugcccuacagccagaaucagccagcaaaug

SEQ ID NO: 380620 - RNA, 16 nt, Human
ccugcccuaccggggc

SEQ ID NO: 380621 - RNA, 32 nt, Human
ccugcccuacuuccguuacccugagagucggc

SEQ ID NO: 380622 - RNA, 32 nt, Human
ccugcccuagugcaacaggcauugcugagguc

SEQ ID NO: 380623 - RNA, 32 nt, Human
ccugcccucacccagcccgcuguuccccaagc

SEQ ID NO: 380624 - RNA, 32 nt, Human
ccugcccucacugcauucccucaccucuaccu

SEQ ID NO: 380625 - RNA, 17 nt, Human
ccugcccucacuggcca

SEQ ID NO: 380626 - RNA, 32 nt, Human
ccugcccucacuuuuaaaaagcauccuagcuc

SEQ ID NO: 380627 - RNA, 32 nt, Human
ccugcccucagacugcaggaccagaaccccug

SEQ ID NO: 380628 - RNA, 32 nt, Human
ccugcccucagagagguuccagucuagaugag

SEQ ID NO: 380629 - RNA, 19 nt, Human
ccugcccucagcacagacu

SEQ ID NO: 380630 - RNA, 32 nt, Human
ccugcccucagccuguugcccugccucccaaa

SEQ ID NO: 380631 - RNA, 32 nt, Human
ccugcccucagguugccuauguauuuuaccuu

SEQ ID NO: 380632 - RNA, 22 nt, Human
ccugcccucauggccccucuga

SEQ ID NO: 380633 - RNA, 32 nt, Human
ccugcccuccacccacaccugcccgcucccca

SEQ ID NO: 380634 - RNA, 32 nt, Human
ccugcccuccacccagccuccuggacucggcc

SEQ ID NO: 380635 - RNA, 32 nt, Human
ccugcccuccacccuccccagagccacuucgg

SEQ ID NO: 380636 - RNA, 32 nt, Human
ccugcccuccagccccaucaccagcuucuugc

SEQ ID NO: 380637 - RNA, 24 nt, Human
ccugcccucccaccaaagccuccu

SEQ ID NO: 380638 - RNA, 32 nt, Human
ccugcccucccagcaauaaccaccucccugga

SEQ ID NO: 380639 - RNA, 32 nt, Human
ccugcccucccauccagcacucucuauggaaa

SEQ ID NO: 380640 - RNA, 21 nt, Human
ccugcccuccccuccccuccc

SEQ ID NO: 380641 - RNA, 32 nt, Human
ccugcccuccuacccugcuauuucuuuacauc

SEQ ID NO: 380642 - RNA, 21 nt, Human
ccugcccuccuaggucuuccc

SEQ ID NO: 380643 - RNA, 19 nt, Human
ccugcccuccucccuuccc

SEQ ID NO: 380644 - RNA, 32 nt, Human
ccugcccucuaauuugggggcagcaguuugug

SEQ ID NO: 380645 - RNA, 32 nt, Human
ccugcccucuacugacuggaggcaggccucug

SEQ ID NO: 380646 - RNA, 32 nt, Human
ccugcccucuacugauuucagcccagccccug

SEQ ID NO: 380647 - RNA, 32 nt, Human
ccugcccucuagccucuacucuuccaguugcg

SEQ ID NO: 380648 - RNA, 22 nt, Human
ccugcccucuauuuauuagcca

SEQ ID NO: 380649 - RNA, 23 nt, Human
ccugcccucuccacagugcugcu

SEQ ID NO: 380650 - RNA, 32 nt, Human
ccugcccucuccccugccucucucucccauua

SEQ ID NO: 380651 - RNA, 32 nt, Human
ccugcccucugccugggccucggucccuccug

SEQ ID NO: 380652 - RNA, 32 nt, Human
ccugcccucuuucccuggcaacccugauugau

SEQ ID NO: 380653 - RNA, 32 nt, Human
ccugcccugacacucaaggaccugugcuccuu

SEQ ID NO: 380654 - RNA, 32 nt, Human
ccugcccugaggggcuguccaggccuucuccc

SEQ ID NO: 380655 - RNA, 32 nt, Human
ccugcccugagugucugucccucuucagccaa

SEQ ID NO: 380656 - RNA, 19 nt, Human
ccugcccugcacccugggg

SEQ ID NO: 380657 - RNA, 32 nt, Human
ccugcccugcagcaugugccuaaaggcucaag

SEQ ID NO: 380658 - RNA, 32 nt, Human
ccugcccugccccugccccauuuccuccucau

SEQ ID NO: 380659 - RNA, 18 nt, Human
ccugcccugcccugagcu

SEQ ID NO: 380660 - RNA, 32 nt, Human
ccugcccugcccugcccugcccugcacugccc

SEQ ID NO: 380661 - RNA, 32 nt, Human
ccugcccugcccugcccugcccugcccugcac

SEQ ID NO: 380662 - RNA, 32 nt, Human
ccugcccugcccugcccugcccugcccugccc

SEQ ID NO: 380663 - RNA, 32 nt, Human
ccugcccugcccugcccugcccugcccugcgc

SEQ ID NO: 380664 - RNA, 32 nt, Human
ccugcccugcccugcccugcccuguuccgcau

SEQ ID NO: 380665 - RNA, 32 nt, Human
ccugcccugccuccagccuugguggcuccuac

SEQ ID NO: 380666 - RNA, 32 nt, Human
ccugcccugccuccuccaucagauccuuuggg

SEQ ID NO: 380667 - RNA, 32 nt, Human
ccugcccugccucuguccuggcucugaacuag

SEQ ID NO: 380668 - RNA, 32 nt, Human
ccugcccugccugagcccugcgcuggccagac

SEQ ID NO: 380669 - RNA, 32 nt, Human
ccugcccugccugccugcugccccucccagcc

SEQ ID NO: 380670 - RNA, 32 nt, Human
ccugcccugccugcuccucguuuucccacaug

SEQ ID NO: 380671 - RNA, 32 nt, Human
ccugcccugccugggacccacagggagacuau

SEQ ID NO: 380672 - RNA, 32 nt, Human
ccugcccugcuggcuuccugacuggagagaca

SEQ ID NO: 380673 - RNA, 32 nt, Human
ccugcccugcuuccugugaucgagccggcccu

SEQ ID NO: 380674 - RNA, 32 nt, Human
ccugcccuggccacguuuccagaagagacucg

SEQ ID NO: 380675 - RNA, 32 nt, Human
ccugcccugggccaaguggccuaucugggaua

SEQ ID NO: 380676 - RNA, 32 nt, Human
ccugcccuguccugcccugcccugcccugccc

SEQ ID NO: 380677 - RNA, 32 nt, Human
ccugcccuguccuguccuguccugacuucauc

SEQ ID NO: 380678 - RNA, 32 nt, Human
ccugcccugugauaugucuguugaguuggccu

SEQ ID NO: 380679 - RNA, 32 nt, Human
ccugcccuguucagccccacagcucccaacua

SEQ ID NO: 380680 - RNA, 32 nt, Human
ccugcccuguucuguuucucucugaccacugg

SEQ ID NO: 380681 - RNA, 20 nt, Human
ccugcccuucccguauccca

SEQ ID NO: 380682 - RNA, 32 nt, Human
ccugcccuuccucuuugaauucuuccggggga

SEQ ID NO: 380683 - RNA, 32 nt, Human
ccugcccuucuugagaguucccccucuuucug

SEQ ID NO: 380684 - RNA, 20 nt, Human
ccugcccuugcccccuuccc

SEQ ID NO: 380685 - RNA, 32 nt, Human
ccugcccuugcucucccuuaguguucccuggc

SEQ ID NO: 380686 - RNA, 20 nt, Human
ccugcccuuggccugcagug

SEQ ID NO: 380687 - RNA, 32 nt, Human
ccugcccuugggaucucggcagcaucucagcc

SEQ ID NO: 380688 - RNA, 20 nt, Human
ccugcccuuuuuucauacca

SEQ ID NO: 380689 - RNA, 32 nt, Human
ccugccgacuccuggguugagcuguugccuca

SEQ ID NO: 380690 - RNA, 32 nt, Human
ccugccgaguagcugggacuacaggucuaauu

SEQ ID NO: 380691 - RNA, 32 nt, Human
ccugccgagugcuguguucuuccucagucugg

SEQ ID NO: 380692 - RNA, 20 nt, Human
ccugccgaucagacaugugg

SEQ ID NO: 380693 - RNA, 32 nt, Human
ccugccgaugcugagaugggggcccgacaugg

SEQ ID NO: 380694 - RNA, 32 nt, Human
ccugccgcacacacguucgcacgcggcggccg

SEQ ID NO: 380695 - RNA, 31 nt, Human
ccugccgcacagcccagcaggagggaggcgg

SEQ ID NO: 380696 - RNA, 18 nt, Human
ccugccgcaugcugcaca

SEQ ID NO: 380697 - RNA, 32 nt, Human
ccugccgcccucugcccugccggagacagacc

SEQ ID NO: 380698 - RNA, 32 nt, Human
ccugccgcccugacgcccgccagccugagcca

SEQ ID NO: 380699 - RNA, 15 nt, Human
ccugccgcccugccg

SEQ ID NO: 380700 - RNA, 20 nt, Human
ccugccgcccugccgcugcc

SEQ ID NO: 380701 - RNA, 16 nt, Human
ccugccgccgccgccg

SEQ ID NO: 380702 - RNA, 19 nt, Human
ccugccgccgccgccgccg

SEQ ID NO: 380703 - RNA, 23 nt, Human
ccugccgccgcgcucgucccucc

SEQ ID NO: 380704 - RNA, 16 nt, Human
ccugccgccgcugccg

SEQ ID NO: 380705 - RNA, 32 nt, Human
ccugccgccugccaguuggcugaccccacucc

SEQ ID NO: 380706 - RNA, 32 nt, Human
ccugccgccugggcugucagcacuuuggcagc

SEQ ID NO: 380707 - RNA, 32 nt, Human
ccugccgcggaggcagcggcggcagcggcucu

SEQ ID NO: 380708 - RNA, 32 nt, Human
ccugccgcuggccuuguccuccuugggccuca

SEQ ID NO: 380709 - RNA, 32 nt, Human
ccugccggacacagcaccgugccaaccccacc

SEQ ID NO: 380710 - RNA, 32 nt, Human
ccugccggaccucagccccagcccgcuccccc

SEQ ID NO: 380711 - RNA, 32 nt, Human
ccugccggaggacccccaccugagagauggau

SEQ ID NO: 380712 - RNA, 32 nt, Human
ccugccggcaaucagccaugacugccuuugca

SEQ ID NO: 380713 - RNA, 32 nt, Human
ccugccggccuccugcaagauccucauugagc

SEQ ID NO: 380714 - RNA, 32 nt, Human
ccugccggccugagagcgggaccauggaugaa

SEQ ID NO: 380715 - RNA, 32 nt, Human
ccugccggccuggcugccucuggggucgaggg

SEQ ID NO: 380716 - RNA, 32 nt, Human
ccugccggcgccugagugccucugccugaaca

SEQ ID NO: 380717 - RNA, 32 nt, Human
ccugccggcgugccucuagggacgggcgacgc

SEQ ID NO: 380718 - RNA, 22 nt, Human
ccugccggcucgguucgguucg

SEQ ID NO: 380719 - RNA, 32 nt, Human
ccugccggcugucuggcggccugggugccggc

SEQ ID NO: 380720 - RNA, 19 nt, Human
ccugccgggcaacauguca

SEQ ID NO: 380721 - RNA, 32 nt, Human
ccugccgggcugcaagccugaggucugugcug

SEQ ID NO: 380722 - RNA, 32 nt, Human
ccugccgggguggcagagugaguugucucagg

SEQ ID NO: 380723 - RNA, 27 nt, Human
ccugccggguagcugggacuacaggca

SEQ ID NO: 380724 - RNA, 32 nt, Human
ccugccgggugguggaggcgcugcacggugcc

SEQ ID NO: 380725 - RNA, 22 nt, Human
ccugccgucaaucuccaccuca

SEQ ID NO: 380726 - RNA, 16 nt, Human
ccugccgucgcugccg

SEQ ID NO: 380727 - RNA, 32 nt, Human
ccugccgucuauccacccaucuguuccucguc

SEQ ID NO: 380728 - RNA, 32 nt, Human
ccugccgugccaggcccugcagggaugaugau

SEQ ID NO: 380729 - RNA, 32 nt, Human
ccugccgugguaccagccuccagccugccccc

SEQ ID NO: 380730 - RNA, 20 nt, Human
ccugccgugucuccucguca

SEQ ID NO: 380731 - RNA, 32 nt, Human
ccugccguugcuuccuauccugggcuuggaag

SEQ ID NO: 380732 - RNA, 32 nt, Human
ccugccuaaaaaggaaaucuuauggaaugaca

SEQ ID NO: 380733 - RNA, 32 nt, Human
ccugccuagaaaaagacuugugucuagcaucc

SEQ ID NO: 380734 - RNA, 32 nt, Human
ccugccuauaaucccagcuauuugggaggcug

SEQ ID NO: 380735 - RNA, 32 nt, Human
ccugccucacagucaucagucuuuuuaaaucu

SEQ ID NO: 380736 - RNA, 32 nt, Human
ccugccucacaucucccuuccaccucacaacu

SEQ ID NO: 380737 - RNA, 31 nt, Human
ccugccucaccagggaagguuggaggggccu

SEQ ID NO: 380738 - RNA, 32 nt, Human
ccugccucaccuuccaauucguuugccgccgc

SEQ ID NO: 380739 - RNA, 32 nt, Human
ccugccucagauacaagaggcaucauuggcuc

SEQ ID NO: 380740 - RNA, 32 nt, Human
ccugccucagcccgccaagguagccaucccau

SEQ ID NO: 380741 - RNA, 32 nt, Human
ccugccucagcugcaucugauaaaguugagag

SEQ ID NO: 380742 - RNA, 32 nt, Human
ccugccucagcuuaauuuuagaggauauuggg

SEQ ID NO: 380743 - RNA, 32 nt, Human
ccugccucagcuucccaaagugcugagauuac

SEQ ID NO: 380744 - RNA, 32 nt, Human
ccugccucagcuucucaggugugaccuacugu

SEQ ID NO: 380745 - RNA, 32 nt, Human
ccugccucaugucuguaacaugugacaguaau

SEQ ID NO: 380746 - RNA, 32 nt, Human
ccugccuccacccucccgaauggugcuccucc

SEQ ID NO: 380747 - RNA, 20 nt, Human
ccugccuccaccuucugccu

SEQ ID NO: 380748 - RNA, 19 nt, Human
ccugccuccacuccugccu

SEQ ID NO: 380749 - RNA, 32 nt, Human
ccugccuccagccuugguggcuccuacugccc

SEQ ID NO: 380750 - RNA, 32 nt, Human
ccugccuccagggcuccugggcugccagggac

SEQ ID NO: 380751 - RNA, 20 nt, Human
ccugccuccagugucaggga

SEQ ID NO: 380752 - RNA, 32 nt, Human
ccugccucccacaguuccuccccuaaucuggu

SEQ ID NO: 380753 - RNA, 32 nt, Human
ccugccucccacccucccucccugcccccugu

SEQ ID NO: 380754 - RNA, 32 nt, Human
ccugccuccccucugcuggugcaccucgccca

SEQ ID NO: 380755 - RNA, 32 nt, Human
ccugccucccggauaccugcgccccauggcug

SEQ ID NO: 380756 - RNA, 32 nt, Human
ccugccucccgggagacugggauuucuggccu

SEQ ID NO: 380757 - RNA, 19 nt, Human
ccugccucccucgcucgcc

SEQ ID NO: 380758 - RNA, 32 nt, Human
ccugccucccuuaccccuccccuccacuucgc

SEQ ID NO: 380759 - RNA, 32 nt, Human
ccugccucccuuccucacccugucucuggauu

SEQ ID NO: 380760 - RNA, 32 nt, Human
ccugccuccggccugcacucccccaguucccg

SEQ ID NO: 380761 - RNA, 32 nt, Human
ccugccuccuaauccccuuacuucucugucca

SEQ ID NO: 380762 - RNA, 19 nt, Human
ccugccuccuccaaguguc

SEQ ID NO: 380763 - RNA, 32 nt, Human
ccugccuccucccagggcucugccagggccuu

SEQ ID NO: 380764 - RNA, 32 nt, Human
ccugccuccugccuccccugccugccuccugc

SEQ ID NO: 380765 - RNA, 32 nt, Human
ccugccuccugccuccugccuccccugccugc

SEQ ID NO: 380766 - RNA, 32 nt, Human
ccugccuccugccuccugcggcuguuggauuu

SEQ ID NO: 380767 - RNA, 32 nt, Human
ccugccuccuuuccuuucccuuuccucugcca

SEQ ID NO: 380768 - RNA, 32 nt, Human
ccugccuccuuugagggacugggggacuuggg

SEQ ID NO: 380769 - RNA, 32 nt, Human
ccugccucggccuccugagcagcugggacuac

SEQ ID NO: 380770 - RNA, 32 nt, Human
ccugccucggggaaguccuggcgcagaugggc

SEQ ID NO: 380771 - RNA, 32 nt, Human
ccugccucucaccucuaccccaaauaccucug

SEQ ID NO: 380772 - RNA, 32 nt, Human
ccugccucuccaaggacuccacgccugacgaa

SEQ ID NO: 380773 - RNA, 32 nt, Human
ccugccucuccccucccccaguuucuccuccc

SEQ ID NO: 380774 - RNA, 32 nt, Human
ccugccucuccccuccccuuccccucucgcaa

SEQ ID NO: 380775 - RNA, 32 nt, Human
ccugccucuccucccugacccagggcugguga

SEQ ID NO: 380776 - RNA, 32 nt, Human
ccugccucuccucugccccuguccagugccug

SEQ ID NO: 380777 - RNA, 32 nt, Human
ccugccucuccucugcuccccaucccacuuuc

SEQ ID NO: 380778 - RNA, 32 nt, Human
ccugccucucuccucucuccccagaacaucca

SEQ ID NO: 380779 - RNA, 23 nt, Human
ccugccucugagccugucuuucc

SEQ ID NO: 380780 - RNA, 24 nt, Human
ccugccucugccagaaggagccag

SEQ ID NO: 380781 - RNA, 21 nt, Human
ccugccucugccuguucuucu

SEQ ID NO: 380782 - RNA, 32 nt, Human
ccugccucuggccccaguucguuuccucugcc

SEQ ID NO: 380783 - RNA, 32 nt, Human
ccugccucugggugcccggcagcuccacuaga

SEQ ID NO: 380784 - RNA, 32 nt, Human
ccugccucuguaggcuccaccucugggggcag

SEQ ID NO: 380785 - RNA, 32 nt, Human
ccugccucuguucacccuccauggcccugcua

SEQ ID NO: 380786 - RNA, 32 nt, Human
ccugccucuguugccaacacgagaucaaucag

SEQ ID NO: 380787 - RNA, 25 nt, Human
ccugccucuucccaggcuuccuggg

SEQ ID NO: 380788 - RNA, 20 nt, Human
ccugccucuucucccaauca

SEQ ID NO: 380789 - RNA, 32 nt, Human
ccugccugaccaacaugcugaaacccagucuc

SEQ ID NO: 380790 - RNA, 32 nt, Human
ccugccugaggcuucucuccuggggcaggccc

SEQ ID NO: 380791 - RNA, 32 nt, Human
ccugccugagggccccucugcccagcuugggc

SEQ ID NO: 380792 - RNA, 28 nt, Human
ccugccugaggugcugccuccucccagg

SEQ ID NO: 380793 - RNA, 32 nt, Human
ccugccugagucuugcauaucugugaaucagc

SEQ ID NO: 380794 - RNA, 32 nt, Human
ccugccugcacuauugccccagaggagggcac

SEQ ID NO: 380795 - RNA, 32 nt, Human
ccugccugcauggcggguacuucugucucugu

SEQ ID NO: 380796 - RNA, 20 nt, Human
ccugccugccaccucucgga

SEQ ID NO: 380797 - RNA, 32 nt, Human
ccugccugcccaccccuccaugcuccacgcag

SEQ ID NO: 380798 - RNA, 21 nt, Human
ccugccugccccuacccugga

SEQ ID NO: 380799 - RNA, 24 nt, Human
ccugccugccccugagaugcggaa

SEQ ID NO: 380800 - RNA, 21 nt, Human
ccugccugccccugucuuuuc

SEQ ID NO: 380801 - RNA, 32 nt, Human
ccugccugcccgccugcuugcucucuggcugu

SEQ ID NO: 380802 - RNA, 32 nt, Human
ccugccugcccugagccacuguucccagcuca

SEQ ID NO: 380803 - RNA, 32 nt, Human
ccugccugcccuggcccugaggcuccaccacu

SEQ ID NO: 380804 - RNA, 32 nt, Human
ccugccugcccuuucucccaaaaggacaaaga

SEQ ID NO: 380805 - RNA, 31 nt, Human
ccugccugccucugccguccucaguuuccuu

SEQ ID NO: 380806 - RNA, 32 nt, Human
ccugccugccugccugccugagguccccgcug

SEQ ID NO: 380807 - RNA, 22 nt, Human
ccugccugccugcucuugagaa

SEQ ID NO: 380808 - RNA, 32 nt, Human
ccugccugccuggguccagggccugagggagc

SEQ ID NO: 380809 - RNA, 22 nt, Human
ccugccugccuucuuucuggaa

SEQ ID NO: 380810 - RNA, 19 nt, Human
ccugccugcgguguucuug

SEQ ID NO: 380811 - RNA, 32 nt, Human
ccugccugcguccugccaggggagacagcccc

SEQ ID NO: 380812 - RNA, 31 nt, Human
ccugccugcguccuggggccugugcacuguu

SEQ ID NO: 380813 - RNA, 19 nt, Human
ccugccugcguucucccca

SEQ ID NO: 380814 - RNA, 32 nt, Human
ccugccugcuccacuuuuucuaccuuggaacu

SEQ ID NO: 380815 - RNA, 32 nt, Human
ccugccugcucuggccaagaggaccagccagc

SEQ ID NO: 380816 - RNA, 32 nt, Human
ccugccugcuucucagcucauuuggaaaaaua

SEQ ID NO: 380817 - RNA, 32 nt, Human
ccugccuggaaaugcugugggcucagggcaau

SEQ ID NO: 380818 - RNA, 32 nt, Human
ccugccuggacucuguggccaagagugcgugg

SEQ ID NO: 380819 - RNA, 19 nt, Human
ccugccuggagcaggggga

SEQ ID NO: 380820 - RNA, 32 nt, Human
ccugccuggagcuguuuaauuuggagcuuccc

SEQ ID NO: 380821 - RNA, 18 nt, Human
ccugccuggaggcugccu

SEQ ID NO: 380822 - RNA, 32 nt, Human
ccugccuggccaacaugaugaaacccugucuc

SEQ ID NO: 380823 - RNA, 32 nt, Human
ccugccuggcccccggaccguucugcagcguc

SEQ ID NO: 380824 - RNA, 32 nt, Human
ccugccuggccuccccucucauggcccagcca

SEQ ID NO: 380825 - RNA, 32 nt, Human
ccugccuggcugacugccuugcuagaaacaua

SEQ ID NO: 380826 - RNA, 32 nt, Human
ccugccugggcaaaauggugaaaccaugucuc

SEQ ID NO: 380827 - RNA, 32 nt, Human
ccugccugggcaacaagagcaaaauuucaucu

SEQ ID NO: 380828 - RNA, 32 nt, Human
ccugccugggcaacaagagugaaacuccaucu

SEQ ID NO: 380829 - RNA, 32 nt, Human
ccugccugggcaacauaaugaaacuuccuuuc

SEQ ID NO: 380830 - RNA, 32 nt, Human
ccugccugggcaacauagugagaccccaucuc

SEQ ID NO: 380831 - RNA, 32 nt, Human
ccugccugggcaacauggcaaaacuuugucuc

SEQ ID NO: 380832 - RNA, 32 nt, Human
ccugccugggcaacugagcaugaacccuccuc

SEQ ID NO: 380833 - RNA, 32 nt, Human
ccugccugggcaauagagccagaccuugccuc

SEQ ID NO: 380834 - RNA, 32 nt, Human
ccugccugggcccugacacccagaccaggcag

SEQ ID NO: 380835 - RNA, 32 nt, Human
ccugccuggggaccaagcugaaggggaauucu

SEQ ID NO: 380836 - RNA, 21 nt, Human
ccugccugggggaagagccag

SEQ ID NO: 380837 - RNA, 32 nt, Human
ccugccuggguggguguccugugacuugacag

SEQ ID NO: 380838 - RNA, 31 nt, Human
ccugccugguacauagcuggcauucagaaaa

SEQ ID NO: 380839 - RNA, 32 nt, Human
ccugccuguaaucccagcuacuugggaggcug

SEQ ID NO: 380840 - RNA, 32 nt, Human
ccugccuguagucccaccugugugggagaauc

SEQ ID NO: 380841 - RNA, 32 nt, Human
ccugccuguagucccagcuacucgggaggcug

SEQ ID NO: 380842 - RNA, 32 nt, Human
ccugccugucauggccuuggggcucucagccc

SEQ ID NO: 380843 - RNA, 32 nt, Human
ccugccugucugccccagcccagauuccccug

SEQ ID NO: 380844 - RNA, 32 nt, Human
ccugccugugagccacaccuccuagcucuggg

SEQ ID NO: 380845 - RNA, 32 nt, Human
ccugccugugccuagaucagagcccagagggc

SEQ ID NO: 380846 - RNA, 31 nt, Human
ccugccuguggcucugcccagaugcuucaga

SEQ ID NO: 380847 - RNA, 32 nt, Human
ccugccugugggcauccaccucccaggugagg

SEQ ID NO: 380848 - RNA, 32 nt, Human
ccugccuguggucaggcauuccucacucccac

SEQ ID NO: 380849 - RNA, 18 nt, Human
ccugccugugucuccaca

SEQ ID NO: 380850 - RNA, 32 nt, Human
ccugccugugugacgcugggcgagucucuucc

SEQ ID NO: 380851 - RNA, 32 nt, Human
ccugccugugugugugcaagugugcagguucc

SEQ ID NO: 380852 - RNA, 32 nt, Human
ccugccuguguguuugaaaaggccaguucucc

SEQ ID NO: 380853 - RNA, 31 nt, Human
ccugccuguguucugugcccuguguccgcuc

SEQ ID NO: 380854 - RNA, 32 nt, Human
ccugccuguguucugugcccuguguccgcucu

SEQ ID NO: 380855 - RNA, 32 nt, Human
ccugccuguuaguacagagcuuuccugaugau

SEQ ID NO: 380856 - RNA, 32 nt, Human
ccugccuuacaagaggucccagaaggagugcu

SEQ ID NO: 380857 - RNA, 32 nt, Human
ccugccuuaccgcgcuuggaaacucugacuug

SEQ ID NO: 380858 - RNA, 32 nt, Human
ccugccuuagccuccuguccauguuuaauuuu

SEQ ID NO: 380859 - RNA, 32 nt, Human
ccugccuuccacagccucucguuucuccucca

SEQ ID NO: 380860 - RNA, 32 nt, Human
ccugccuuccaccaacuccaucaugcaucuga

SEQ ID NO: 380861 - RNA, 32 nt, Human
ccugccuucccuccagaccucucccucuguuu

SEQ ID NO: 380862 - RNA, 32 nt, Human
ccugccuucccucccuccuccccaccgggccg

SEQ ID NO: 380863 - RNA, 17 nt, Human
ccugccuucccuccuca

SEQ ID NO: 380864 - RNA, 32 nt, Human
ccugccuucccucuugccuggaaagggcagca

SEQ ID NO: 380865 - RNA, 32 nt, Human
ccugccuucccugagacugucucuucuccugu

SEQ ID NO: 380866 - RNA, 21 nt, Human
ccugccuucccuuguccuucc

SEQ ID NO: 380867 - RNA, 24 nt, Human
ccugccuuccugauccucuguaga

SEQ ID NO: 380868 - RNA, 32 nt, Human
ccugccuuccugcagccacacacccacccggg

SEQ ID NO: 380869 - RNA, 32 nt, Human
ccugccuuccugggccagcuuccugcuugcag

SEQ ID NO: 380870 - RNA, 32 nt, Human
ccugccuuccuuguggcugucagcccaauguc

SEQ ID NO: 380871 - RNA, 32 nt, Human
ccugccuucgucucgcuccaucaccgccucaa

SEQ ID NO: 380872 - RNA, 22 nt, Human
ccugccuucuagaugccucuga

SEQ ID NO: 380873 - RNA, 32 nt, Human
ccugccuucuccccaucuauccccaaggccuc

SEQ ID NO: 380874 - RNA, 32 nt, Human
ccugccuucucccuuccucugguugaauguca

SEQ ID NO: 380875 - RNA, 32 nt, Human
ccugccuucucuaggaacccuggcuuuuaucu

SEQ ID NO: 380876 - RNA, 32 nt, Human
ccugccuucugccugcucuccugcacugaccc

SEQ ID NO: 380877 - RNA, 32 nt, Human
ccugccuucugcugugagcccugagauccucc

SEQ ID NO: 380878 - RNA, 32 nt, Human
ccugccuugaagaccacccaagcggccuccag

SEQ ID NO: 380879 - RNA, 32 nt, Human
ccugccuugcaaauucuguuucccaggggaau

SEQ ID NO: 380880 - RNA, 32 nt, Human
ccugccuugcccacuccugcucugcucgccuc

SEQ ID NO: 380881 - RNA, 32 nt, Human
ccugccuugccgcuccccuuggaccuccaggg

SEQ ID NO: 380882 - RNA, 32 nt, Human
ccugccuuguguccugagccauagugacucuu

SEQ ID NO: 380883 - RNA, 32 nt, Human
ccugccuuguuauuguaagugccuucaauacu

SEQ ID NO: 380884 - RNA, 32 nt, Human
ccugccuuuauucugucuucucuuguccuauc

SEQ ID NO: 380885 - RNA, 32 nt, Human
ccugccuuucccugacacuuuuggggucugcc

SEQ ID NO: 380886 - RNA, 32 nt, Human
ccugccuuuccucccuuaucaguuucucuuua

SEQ ID NO: 380887 - RNA, 32 nt, Human
ccugccuuuccucugccuccuccccugccagc

SEQ ID NO: 380888 - RNA, 32 nt, Human
ccugccuuugagcccccgucacguugggcacu

SEQ ID NO: 380889 - RNA, 32 nt, Human
ccugccuuugauugucauucuccugggaagcc

SEQ ID NO: 380890 - RNA, 20 nt, Human
ccugccuuuggucucucaga

SEQ ID NO: 380891 - RNA, 32 nt, Human
ccugccuuuuauaguaugcccaccucaggcag

SEQ ID NO: 380892 - RNA, 32 nt, Human
ccugccuuuuuguucccuaucuccacucccug

SEQ ID NO: 380893 - RNA, 32 nt, Human
ccugcgaacccacaaucucugccagcagaacu

SEQ ID NO: 380894 - RNA, 32 nt, Human
ccugcgaaugcuguauagaaggugcuaaugaa

SEQ ID NO: 380895 - RNA, 18 nt, Human
ccugcgacuucccccgga

SEQ ID NO: 380896 - RNA, 32 nt, Human
ccugcgagagaaggggguucaucauggcggau

SEQ ID NO: 380897 - RNA, 32 nt, Human
ccugcgagagccacagcaaggagcucagccag

SEQ ID NO: 380898 - RNA, 32 nt, Human
ccugcgagcuccguccugccugcagcagcaca

SEQ ID NO: 380899 - RNA, 32 nt, Human
ccugcgaggaagguggggucucagugcuuucg

SEQ ID NO: 380900 - RNA, 32 nt, Human
ccugcgaggacggcgggggcggcccugugagg

SEQ ID NO: 380901 - RNA, 21 nt, Human
ccugcgaggagcguggucccc

SEQ ID NO: 380902 - RNA, 24 nt, Human
ccugcgaggcagagauugcaguga

SEQ ID NO: 380903 - RNA, 32 nt, Human
ccugcgaggcagagauugcagugagccaagau

SEQ ID NO: 380904 - RNA, 22 nt, Human
ccugcgaggggaggaggcccag

SEQ ID NO: 380905 - RNA, 21 nt, Human
ccugcgaggggcggggcgcgg

SEQ ID NO: 380906 - RNA, 32 nt, Human
ccugcgaggggugaggagagacuuugcugacu

SEQ ID NO: 380907 - RNA, 23 nt, Human
ccugcgaggucaagcugcagaga

SEQ ID NO: 380908 - RNA, 32 nt, Human
ccugcgaggucagucaaggcuuugggggcucu

SEQ ID NO: 380909 - RNA, 32 nt, Human
ccugcgaguggcgcagguaacagaccgcaggg

SEQ ID NO: 380910 - RNA, 31 nt, Human
ccugcgaugaauccggcccuaggcaaccaga

SEQ ID NO: 380911 - RNA, 32 nt, Human
ccugcgaugagcuuuucuuucagcuggugaaa

SEQ ID NO: 380912 - RNA, 31 nt, Human
ccugcgaugauggacucaacaccuuccguga

SEQ ID NO: 380913 - RNA, 32 nt, Human
ccugcgauggcagaagaaacucgacaaaguaa

SEQ ID NO: 380914 - RNA, 32 nt, Human
ccugcgcaauaggaguacgcugccugggaggc

SEQ ID NO: 380915 - RNA, 32 nt, Human
ccugcgcagauggggacuguggugccaucuuu

SEQ ID NO: 380916 - RNA, 32 nt, Human
ccugcgcagggccguaugcauccugccaagcu

SEQ ID NO: 380917 - RNA, 18 nt, Human
ccugcgcaucccacccga

SEQ ID NO: 380918 - RNA, 22 nt, Human
ccugcgccaccacaaccaggac

SEQ ID NO: 380919 - RNA, 18 nt, Human
ccugcgccaccgccgccg

SEQ ID NO: 380920 - RNA, 32 nt, Human
ccugcgcccagccgugcccuggacuguggcac

SEQ ID NO: 380921 - RNA, 24 nt, Human
ccugcgccccgcccacacccucgg

SEQ ID NO: 380922 - RNA, 32 nt, Human
ccugcgccccgccccgagguuggggcuuugaa

SEQ ID NO: 380923 - RNA, 18 nt, Human
ccugcgccccuccugccu

SEQ ID NO: 380924 - RNA, 32 nt, Human
ccugcgcccugagagguugccuuuccuuuucc

SEQ ID NO: 380925 - RNA, 32 nt, Human
ccugcgccgcacccggggccugggugagacug

SEQ ID NO: 380926 - RNA, 32 nt, Human
ccugcgccgucccucguuccauggcccagucc

SEQ ID NO: 380927 - RNA, 32 nt, Human
ccugcgccuccucucugcuucucccuccuccu

SEQ ID NO: 380928 - RNA, 32 nt, Human
ccugcgccuggggugagcugagcccgggacuc

SEQ ID NO: 380929 - RNA, 32 nt, Human
ccugcgccuguaaucccagcacuuugggaggc

SEQ ID NO: 380930 - RNA, 23 nt, Human
ccugcgccuugucucugcugcuc

SEQ ID NO: 380931 - RNA, 31 nt, Human
ccugcgcgaguguccaaggcgggaggagaga

SEQ ID NO: 380932 - RNA, 32 nt, Human
ccugcgcgccuggacagcgccugcugcccgcc

SEQ ID NO: 380933 - RNA, 20 nt, Human
ccugcgcgcuuuccugcucc

SEQ ID NO: 380934 - RNA, 22 nt, Human
ccugcgcggcgacggggcgugg

SEQ ID NO: 380935 - RNA, 19 nt, Human
ccugcgcgggaggccacag

SEQ ID NO: 380936 - RNA, 32 nt, Human
ccugcgcgggccugaauggccuucaggagcac

SEQ ID NO: 380937 - RNA, 22 nt, Human
ccugcgcucagcugcucuggca

SEQ ID NO: 380938 - RNA, 32 nt, Human
ccugcgcuccaccgcacaccucccgggcccgc

SEQ ID NO: 380939 - RNA, 32 nt, Human
ccugcgcuccuucuccccgcugcaacccgggc

SEQ ID NO: 380940 - RNA, 32 nt, Human
ccugcgcugcagcuccgcaccuuagcagcccg

SEQ ID NO: 380941 - RNA, 32 nt, Human
ccugcgcuguccgcccuuccccuagcguuacu

SEQ ID NO: 380942 - RNA, 32 nt, Human
ccugcgcugucuggguggccacacagagcccg

SEQ ID NO: 380943 - RNA, 32 nt, Human
ccugcgcugugauuuuagccuccugagauugg

SEQ ID NO: 380944 - RNA, 32 nt, Human
ccugcgcuucaucucaugaggauuucuuuaug

SEQ ID NO: 380945 - RNA, 21 nt, Human
ccugcggaagaggaggugcgg

SEQ ID NO: 380946 - RNA, 32 nt, Human
ccugcggaagcaucuuguaauggaacacauua

SEQ ID NO: 380947 - RNA, 32 nt, Human
ccugcggaaugacagccugggguccuugugcc

SEQ ID NO: 380948 - RNA, 20 nt, Human
ccugcggaccgcuuccuucc

SEQ ID NO: 380949 - RNA, 32 nt, Human
ccugcggagagaaaccccagcccaucggucug

SEQ ID NO: 380950 - RNA, 32 nt, Human
ccugcggagaggggaugaggcccggggcgccc

SEQ ID NO: 380951 - RNA, 32 nt, Human
ccugcggagcccagugagaacaggcggccccu

SEQ ID NO: 380952 - RNA, 32 nt, Human
ccugcggaggcuucugaacugggaggaguuug

SEQ ID NO: 380953 - RNA, 32 nt, Human
ccugcggagggaggggacagcuggacccgcag

SEQ ID NO: 380954 - RNA, 32 nt, Human
ccugcggaggggcgaggacgaggcagaaguca

SEQ ID NO: 380955 - RNA, 32 nt, Human
ccugcggaggggcgauccggccccuccauguc

SEQ ID NO: 380956 - RNA, 32 nt, Human
ccugcggagucgauaaauuagcagaaccacau

SEQ ID NO: 380957 - RNA, 32 nt, Human
ccugcggauccuucacuccgggugggucggcc

SEQ ID NO: 380958 - RNA, 32 nt, Human
ccugcggcaauggagaaaaugcuaauacagac

SEQ ID NO: 380959 - RNA, 32 nt, Human
ccugcggcagagcccaggcuggggaagugaac

SEQ ID NO: 380960 - RNA, 32 nt, Human
ccugcggcagaggugugcagaggcagaaugug

SEQ ID NO: 380961 - RNA, 32 nt, Human
ccugcggcagccacaggcuuggugguuucaag

SEQ ID NO: 380962 - RNA, 32 nt, Human
ccugcggccuccaagccuuccuggcccaggca

SEQ ID NO: 380963 - RNA, 32 nt, Human
ccugcggcuacaagucccuccuggggccuggg

SEQ ID NO: 380964 - RNA, 32 nt, Human
ccugcggcugcuccgggcugggcgcggggcga

SEQ ID NO: 380965 - RNA, 32 nt, Human
ccugcggcugggccuccgggaggcagaagaga

SEQ ID NO: 380966 - RNA, 32 nt, Human
ccugcggcuggucagccugguccuccugggcu

SEQ ID NO: 380967 - RNA, 32 nt, Human
ccugcggcugugccuggacugaagcugucccg

SEQ ID NO: 380968 - RNA, 32 nt, Human
ccugcggcuuuggugacagugugcagacagca

SEQ ID NO: 380969 - RNA, 32 nt, Human
ccugcgggaagagcagggagaggagguggacu

SEQ ID NO: 380970 - RNA, 18 nt, Human
ccugcgggaggggcgaca

SEQ ID NO: 380971 - RNA, 22 nt, Human
ccugcgggcacagcugccuucc

SEQ ID NO: 380972 - RNA, 22 nt, Human
ccugcgggccaccuccucuucc

SEQ ID NO: 380973 - RNA, 22 nt, Human
ccugcgggccuccgugcuccuu

SEQ ID NO: 380974 - RNA, 22 nt, Human
ccugcgggcggccguccguucc

SEQ ID NO: 380975 - RNA, 21 nt, Human
ccugcgggcgggcgggcgcgg

SEQ ID NO: 380976 - RNA, 32 nt, Human
ccugcggggaggcgcaggauggacgcguuggc

SEQ ID NO: 380977 - RNA, 32 nt, Human
ccugcgggggcucucccuucccucucuucccc

SEQ ID NO: 380978 - RNA, 18 nt, Human
ccugcgggguggcccugg

SEQ ID NO: 380979 - RNA, 26 nt, Human
ccugcggggugugccccuguccuucc

SEQ ID NO: 380980 - RNA, 32 nt, Human
ccugcggguaauagacaagaaggucacccugg

SEQ ID NO: 380981 - RNA, 32 nt, Human
ccugcgguccagccuccaacuuugguugccag

SEQ ID NO: 380982 - RNA, 32 nt, Human
ccugcggucccagcuacuuagggaggcuaaga

SEQ ID NO: 380983 - RNA, 32 nt, Human
ccugcggucccagcuacuugggaggcugaggc

SEQ ID NO: 380984 - RNA, 32 nt, Human
ccugcggugagcucgcgcugggcgggcuguuc

SEQ ID NO: 380985 - RNA, 22 nt, Human
ccugcgguguguacacgaacuc

SEQ ID NO: 380986 - RNA, 23 nt, Human
ccugcgguuccagcuacucaaga

SEQ ID NO: 380987 - RNA, 32 nt, Human
ccugcgguuccagcuacucaagaggcugaggc

SEQ ID NO: 380988 - RNA, 32 nt, Human
ccugcgguucgcaaagugggguccccagccag

SEQ ID NO: 380989 - RNA, 32 nt, Human
ccugcguaacuuucucccuugauccgggaguc

SEQ ID NO: 380990 - RNA, 32 nt, Human
ccugcguacauucacaugcacacauggaagaa

SEQ ID NO: 380991 - RNA, 22 nt, Human
ccugcguaggaggcgggugcag

SEQ ID NO: 380992 - RNA, 32 nt, Human
ccugcguaguuguuaaauuggugaccuugcgg

SEQ ID NO: 380993 - RNA, 32 nt, Human
ccugcguauuuaugucccaggagcucaccuuc

SEQ ID NO: 380994 - RNA, 32 nt, Human
ccugcgucccugccccuucuuccugcuccccc

SEQ ID NO: 380995 - RNA, 32 nt, Human
ccugcguccucgaaaagccagaggguucaccu

SEQ ID NO: 380996 - RNA, 21 nt, Human
ccugcgucguucuguccuucc

SEQ ID NO: 380997 - RNA, 32 nt, Human
ccugcgucuccucgucccgagggcgccugggu

SEQ ID NO: 380998 - RNA, 32 nt, Human
ccugcgucuccucugugcgccugugagugucc

SEQ ID NO: 380999 - RNA, 32 nt, Human
ccugcgucuuccgccccugccugccauguacc

SEQ ID NO: 381000 - RNA, 19 nt, Human
ccugcgugccauucuucua

SEQ ID NO: 381001 - RNA, 21 nt, Human
ccugcgugccccgccacugcc

SEQ ID NO: 381002 - RNA, 28 nt, Human
ccugcgugcugccccguucagugugccg

SEQ ID NO: 381003 - RNA, 32 nt, Human
ccugcguggaaaguugcugggcccccgccccc

SEQ ID NO: 381004 - RNA, 32 nt, Human
ccugcgugggggccagucaggcugcagaggca

SEQ ID NO: 381005 - RNA, 22 nt, Human
ccugcguggguagcccucggcc

SEQ ID NO: 381006 - RNA, 32 nt, Human
ccugcgugucaucugccuggucaucucagacc

SEQ ID NO: 381007 - RNA, 32 nt, Human
ccugcguguccuccccuccacugccugcaugg

SEQ ID NO: 381008 - RNA, 32 nt, Human
ccugcgugugggacucaagguugcccagggcu

SEQ ID NO: 381009 - RNA, 23 nt, Human
ccugcguucccagcuacuuggga

SEQ ID NO: 381010 - RNA, 22 nt, Human
ccugcguucuccccaugaacuu

SEQ ID NO: 381011 - RNA, 32 nt, Human
ccugcuaaaugccacugacaauguuaugagau

SEQ ID NO: 381012 - RNA, 32 nt, Human
ccugcuaacagcaugaucucuccucacccuuu

SEQ ID NO: 381013 - RNA, 32 nt, Human
ccugcuaacuuggagcuucagagccauggcaa

SEQ ID NO: 381014 - RNA, 32 nt, Human
ccugcuaagagggagaccaggucaaggcagcc

SEQ ID NO: 381015 - RNA, 32 nt, Human
ccugcuaaguguccugcaaggccuuucacggu

SEQ ID NO: 381016 - RNA, 32 nt, Human
ccugcuaccaacagcccuccccuugggcuggc

SEQ ID NO: 381017 - RNA, 32 nt, Human
ccugcuaccuugacccuucccuuuccucugcu

SEQ ID NO: 381018 - RNA, 32 nt, Human
ccugcuacuccaguuuccucagccucugcaag

SEQ ID NO: 381019 - RNA, 32 nt, Human
ccugcuacugcugaccaaauucccaggaaucu

SEQ ID NO: 381020 - RNA, 32 nt, Human
ccugcuagcacaguaugcuacagggaacaaag

SEQ ID NO: 381021 - RNA, 18 nt, Human
ccugcuagcucuuccuga

SEQ ID NO: 381022 - RNA, 32 nt, Human
ccugcuagcugagcacuuccacaagggcauac

SEQ ID NO: 381023 - RNA, 22 nt, Human
ccugcuaggaccggccggggcc

SEQ ID NO: 381024 - RNA, 32 nt, Human
ccugcuagggucguuuguuucuuucugcugug

SEQ ID NO: 381025 - RNA, 21 nt, Human
ccugcuaggucuuaagagcca

SEQ ID NO: 381026 - RNA, 32 nt, Human
ccugcuaugaaaggaauaaaaccuacacacaa

SEQ ID NO: 381027 - RNA, 32 nt, Human
ccugcucaagcagcacagaggaaggggcaaga

SEQ ID NO: 381028 - RNA, 32 nt, Human
ccugcucaagcuaaacgcaccacgccggcuuu

SEQ ID NO: 381029 - RNA, 25 nt, Human
ccugcucaagcuccuccugcuccuu

SEQ ID NO: 381030 - RNA, 32 nt, Human
ccugcucaauggugaauacgaccuaaguguua

SEQ ID NO: 381031 - RNA, 32 nt, Human
ccugcucacagcccauggguggacucggcccc

SEQ ID NO: 381032 - RNA, 32 nt, Human
ccugcucacauucucuggaagugggccaguuu

SEQ ID NO: 381033 - RNA, 32 nt, Human
ccugcucaccagccgccagcugcccaucuucu

SEQ ID NO: 381034 - RNA, 22 nt, Human
ccugcucacccacgcccaccca

SEQ ID NO: 381035 - RNA, 32 nt, Human
ccugcucacgcucucccuggaccucuucuaca

SEQ ID NO: 381036 - RNA, 32 nt, Human
ccugcucacuggcuggguauucuucguaaaaa

SEQ ID NO: 381037 - RNA, 32 nt, Human
ccugcucagccccugaugagcacaucaucaaa

SEQ ID NO: 381038 - RNA, 32 nt, Human
ccugcucaggccccaucucugggguguuuggg

SEQ ID NO: 381039 - RNA, 32 nt, Human
ccugcucagguggcacagacugcgagcugggc

SEQ ID NO: 381040 - RNA, 22 nt, Human
ccugcucagugcuuguccugcc

SEQ ID NO: 381041 - RNA, 32 nt, Human
ccugcucaguguccagcccccgcugaguucag

SEQ ID NO: 381042 - RNA, 32 nt, Human
ccugcucaguguccggaaagaagucagucauc

SEQ ID NO: 381043 - RNA, 32 nt, Human
ccugcucaucaccuacggggugagugggccug

SEQ ID NO: 381044 - RNA, 32 nt, Human
ccugcucaucugcuugagcagcggcugucagg

SEQ ID NO: 381045 - RNA, 32 nt, Human
ccugcucaugaggagccuuaguggagauucca

SEQ ID NO: 381046 - RNA, 32 nt, Human
ccugcucaugccacuaacagcaugcugccaaa

SEQ ID NO: 381047 - RNA, 32 nt, Human
ccugcuccaagcucugcuuuuccuuccucuga

SEQ ID NO: 381048 - RNA, 32 nt, Human
ccugcuccacaccccuauuuuccucuuaauaa

SEQ ID NO: 381049 - RNA, 32 nt, Human
ccugcuccacccccucuccccauuccuccgcc

SEQ ID NO: 381050 - RNA, 32 nt, Human
ccugcuccagccagggaggacugagggagugc

SEQ ID NO: 381051 - RNA, 32 nt, Human
ccugcuccagcuucccuguccuggccccaccu

SEQ ID NO: 381052 - RNA, 32 nt, Human
ccugcuccaggccuugcuucucccucugcagg

SEQ ID NO: 381053 - RNA, 21 nt, Human
ccugcuccaucggcacuggug

SEQ ID NO: 381054 - RNA, 32 nt, Human
ccugcuccaugagggacacucagcauucuuuu

SEQ ID NO: 381055 - RNA, 32 nt, Human
ccugcucccaagugcaaccucugucugacccu

SEQ ID NO: 381056 - RNA, 32 nt, Human
ccugcucccacacugucacuggaugucauggg

SEQ ID NO: 381057 - RNA, 32 nt, Human
ccugcucccacugucuguguucuccucacugu

SEQ ID NO: 381058 - RNA, 32 nt, Human
ccugcucccagaggaaaagugaauugcaccau

SEQ ID NO: 381059 - RNA, 32 nt, Human
ccugcucccagauguaaacagagcaaccugca

SEQ ID NO: 381060 - RNA, 32 nt, Human
ccugcucccagccaugguggccuggcgcucgg

SEQ ID NO: 381061 - RNA, 32 nt, Human
ccugcucccagccucuugcucagagcuaggcc

SEQ ID NO: 381062 - RNA, 32 nt, Human
  misc_feature (30)..(30): n is a, c, g or u
ccugcucccaggguuagaccugagaugaancu

SEQ ID NO: 381063 - RNA, 32 nt, Human
ccugcucccaucuccaccucuaaugcuucuug

SEQ ID NO: 381064 - RNA, 32 nt, Human
ccugcuccccaagcuccagcagcuggacgauc

SEQ ID NO: 381065 - RNA, 32 nt, Human
ccugcuccccagcuccuccugccugcacccga

SEQ ID NO: 381066 - RNA, 24 nt, Human
ccugcucccccuguccccacccca

SEQ ID NO: 381067 - RNA, 22 nt, Human
ccugcucccccugucccuuccc

SEQ ID NO: 381068 - RNA, 23 nt, Human
ccugcuccccuccuaccacuguc

SEQ ID NO: 381069 - RNA, 31 nt, Human
ccugcuccccucucuggcccaugguccugcu

SEQ ID NO: 381070 - RNA, 32 nt, Human
ccugcuccccugugccuccacaggggagggcc

SEQ ID NO: 381071 - RNA, 32 nt, Human
ccugcucccgcccgaggacuccugcgggcacu

SEQ ID NO: 381072 - RNA, 32 nt, Human
ccugcucccgcccgcccucuggcccggccgcc

SEQ ID NO: 381073 - RNA, 32 nt, Human
ccugcucccguccuguugacucugccuugcuc

SEQ ID NO: 381074 - RNA, 21 nt, Human
ccugcucccgucugucugucc

SEQ ID NO: 381075 - RNA, 23 nt, Human
ccugcucccucccaucccuuccc

SEQ ID NO: 381076 - RNA, 32 nt, Human
ccugcucccucugcccuuccucccucuuucuu

SEQ ID NO: 381077 - RNA, 32 nt, Human
ccugcucccugccuccuuuucagggcugcccu

SEQ ID NO: 381078 - RNA, 32 nt, Human
ccugcucccuggaagguagacuauggcauaag

SEQ ID NO: 381079 - RNA, 25 nt, Human
ccugcuccgcccgcgccuuucuucu

SEQ ID NO: 381080 - RNA, 32 nt, Human
ccugcuccggggcccuuccagaaauaaagacc

SEQ ID NO: 381081 - RNA, 32 nt, Human
ccugcuccgugccucccgcgccuguugguugg

SEQ ID NO: 381082 - RNA, 32 nt, Human
ccugcuccguucugcuaccuugucaaacccac

SEQ ID NO: 381083 - RNA, 32 nt, Human
ccugcuccucaccuccuggcccugcuccuuac

SEQ ID NO: 381084 - RNA, 32 nt, Human
ccugcuccuccaccuccuccucuccuuguccu

SEQ ID NO: 381085 - RNA, 32 nt, Human
ccugcuccuccaggaauucccagcaggcucuc

SEQ ID NO: 381086 - RNA, 32 nt, Human
ccugcuccuccaugcugugagcugcuuuggca

SEQ ID NO: 381087 - RNA, 32 nt, Human
ccugcuccuccccuucgggcccccuccuccug

SEQ ID NO: 381088 - RNA, 32 nt, Human
ccugcuccucucggccccuccuccugggccgc

SEQ ID NO: 381089 - RNA, 32 nt, Human
ccugcuccucucugccucaucucccaaagccc

SEQ ID NO: 381090 - RNA, 32 nt, Human
ccugcuccucucuguccugccucaggccuaag

SEQ ID NO: 381091 - RNA, 32 nt, Human
ccugcuccucugggccaccucucuccaccugc

SEQ ID NO: 381092 - RNA, 32 nt, Human
ccugcuccucuguggccuuccugggcugcccu

SEQ ID NO: 381093 - RNA, 32 nt, Human
ccugcuccuggaccucuuuaugauauugugau

SEQ ID NO: 381094 - RNA, 32 nt, Human
ccugcuccuguaguacagaaggugcaguacau

SEQ ID NO: 381095 - RNA, 32 nt, Human
ccugcuccuguuucagcgccugcuccagcuug

SEQ ID NO: 381096 - RNA, 32 nt, Human
ccugcuccuuagagaagggaagaugagugagu

SEQ ID NO: 381097 - RNA, 32 nt, Human
ccugcuccuucccaggaguggaggaggccugg

SEQ ID NO: 381098 - RNA, 32 nt, Human
ccugcucggaagcagaugaugugaaauguucc

SEQ ID NO: 381099 - RNA, 32 nt, Human
ccugcucggcggcuccaccacaguugcaaccu

SEQ ID NO: 381100 - RNA, 32 nt, Human
ccugcucggucacauuggagcuggcagaggcc

SEQ ID NO: 381101 - RNA, 32 nt, Human
ccugcucuaggccagcccugucaccaccucca

SEQ ID NO: 381102 - RNA, 32 nt, Human
ccugcucuaguccuugccacacaugcccuggg

SEQ ID NO: 381103 - RNA, 32 nt, Human
ccugcucuauccccugcccucuuccagcccca

SEQ ID NO: 381104 - RNA, 32 nt, Human
ccugcucucaugaggcuuucaggcguuugggg

SEQ ID NO: 381105 - RNA, 32 nt, Human
ccugcucuccaccuggacucaggccgggcugg

SEQ ID NO: 381106 - RNA, 24 nt, Human
ccugcucuccucuugccacugccu

SEQ ID NO: 381107 - RNA, 32 nt, Human
ccugcucucucaccugccaucguacagaccag

SEQ ID NO: 381108 - RNA, 32 nt, Human
ccugcucucuccacuucucugcuuauauuguc

SEQ ID NO: 381109 - RNA, 20 nt, Human
ccugcucucucccucuuccc

SEQ ID NO: 381110 - RNA, 32 nt, Human
ccugcucucucuccacccuccuguucugucug

SEQ ID NO: 381111 - RNA, 32 nt, Human
ccugcucucuggucuuuucaguuugccucuuu

SEQ ID NO: 381112 - RNA, 22 nt, Human
ccugcucucuuagaaagagcca

SEQ ID NO: 381113 - RNA, 30 nt, Human
ccugcucucuucagcuccugugguaugugg

SEQ ID NO: 381114 - RNA, 32 nt, Human
ccugcucugaagauguggauacagaauuaguc

SEQ ID NO: 381115 - RNA, 32 nt, Human
ccugcucugagcugccccuuguugugaccugg

SEQ ID NO: 381116 - RNA, 32 nt, Human
ccugcucugcaaccuuucucuucucacggguc

SEQ ID NO: 381117 - RNA, 32 nt, Human
ccugcucugcagcugcuauaaauagccucccu

SEQ ID NO: 381118 - RNA, 32 nt, Human
ccugcucugcccaggagguggcguccagcagu

SEQ ID NO: 381119 - RNA, 32 nt, Human
ccugcucugcccucccuggcuccuggacuaga

SEQ ID NO: 381120 - RNA, 32 nt, Human
ccugcucugccucaagcaccccuucuuugcug

SEQ ID NO: 381121 - RNA, 32 nt, Human
ccugcucugccuggcucgaugucugcuucuuc

SEQ ID NO: 381122 - RNA, 32 nt, Human
ccugcucugcgaugggcauccugacugucugg

SEQ ID NO: 381123 - RNA, 32 nt, Human
ccugcucuggacuugcccucucccuuccuggc

SEQ ID NO: 381124 - RNA, 32 nt, Human
ccugcucuggcaggcaggcaaagcuaggcaga

SEQ ID NO: 381125 - RNA, 32 nt, Human
ccugcucugggagcauugcuagccuucuaccc

SEQ ID NO: 381126 - RNA, 32 nt, Human
ccugcucugucacccaggcuggagugcagugg

SEQ ID NO: 381127 - RNA, 32 nt, Human
ccugcucugucccuaauuuuuguuuuuauuuu

SEQ ID NO: 381128 - RNA, 32 nt, Human
ccugcucuguccuuagucauccuuagacaccu

SEQ ID NO: 381129 - RNA, 32 nt, Human
ccugcucugucgcccaggcuggagugcagugg

SEQ ID NO: 381130 - RNA, 32 nt, Human
ccugcucuguugcccaggcuggaguacauugg

SEQ ID NO: 381131 - RNA, 32 nt, Human
ccugcucuguugcuggcucuccuugaagacaa

SEQ ID NO: 381132 - RNA, 32 nt, Human
ccugcucuuaggaagccugggaaggaccggug

SEQ ID NO: 381133 - RNA, 17 nt, Human
ccugcucuucagcguca

SEQ ID NO: 381134 - RNA, 32 nt, Human
ccugcucuucagugugaaagagaaagagggga

SEQ ID NO: 381135 - RNA, 32 nt, Human
ccugcucuuccucggcccuccgccuccucccc

SEQ ID NO: 381136 - RNA, 32 nt, Human
ccugcucuugcucgcucugucuugccugccgc

SEQ ID NO: 381137 - RNA, 32 nt, Human
ccugcugaaacaccucccaggggcuccaccug

SEQ ID NO: 381138 - RNA, 32 nt, Human
ccugcugaaauaugugugugaagaauuauuua

SEQ ID NO: 381139 - RNA, 32 nt, Human
ccugcugaacucagaggagaaagccugaguga

SEQ ID NO: 381140 - RNA, 32 nt, Human
ccugcugaagacauuuacuuucaaugaucuac

SEQ ID NO: 381141 - RNA, 31 nt, Human
ccugcugaagcuuuggagcacuugugauugc

SEQ ID NO: 381142 - RNA, 32 nt, Human
ccugcugaccagcugggaugauaggcaggcac

SEQ ID NO: 381143 - RNA, 32 nt, Human
ccugcugaccccgugucaccacugccggcgcc

SEQ ID NO: 381144 - RNA, 32 nt, Human
ccugcugacugcacucugccaggcuucccaau

SEQ ID NO: 381145 - RNA, 24 nt, Human
ccugcugacugcgccugucuucuc

SEQ ID NO: 381146 - RNA, 32 nt, Human
ccugcugagacgggaccaaggacggcugcagg

SEQ ID NO: 381147 - RNA, 32 nt, Human
ccugcugagagcugugaggggagcuucugcuc

SEQ ID NO: 381148 - RNA, 32 nt, Human
ccugcugagaguccucccuccugggcucccug

SEQ ID NO: 381149 - RNA, 32 nt, Human
ccugcugagcccagggcgacagaggggcacug

SEQ ID NO: 381150 - RNA, 32 nt, Human
ccugcugagcuccagacugcagcccgugcuga

SEQ ID NO: 381151 - RNA, 32 nt, Human
ccugcugagcucugauucaagugccugccucu

SEQ ID NO: 381152 - RNA, 32 nt, Human
ccugcugagcugacuacacagacuuagucuuc

SEQ ID NO: 381153 - RNA, 32 nt, Human
ccugcugagcuuugugaaaauccacaggcguu

SEQ ID NO: 381154 - RNA, 32 nt, Human
ccugcugaggcggagacugcagugagcugaga

SEQ ID NO: 381155 - RNA, 32 nt, Human
ccugcugagguggagacugcagugagcugaga

SEQ ID NO: 381156 - RNA, 32 nt, Human
ccugcugagguggagauugcagugaacuaaga

SEQ ID NO: 381157 - RNA, 32 nt, Human
ccugcugaguagcugggacuacaggcacaugc

SEQ ID NO: 381158 - RNA, 32 nt, Human
ccugcugaguagcugggauugcagguguguac

SEQ ID NO: 381159 - RNA, 32 nt, Human
ccugcugcaacaucuucuccuccaggaaggcu

SEQ ID NO: 381160 - RNA, 32 nt, Human
ccugcugcacacacaagcaucucacucggccc

SEQ ID NO: 381161 - RNA, 32 nt, Human
ccugcugcacaccaaucuguggcccuucauca

SEQ ID NO: 381162 - RNA, 32 nt, Human
ccugcugcaccacugcccugccuucgggcugc

SEQ ID NO: 381163 - RNA, 32 nt, Human
ccugcugcacuccagccugggugacagaggga

SEQ ID NO: 381164 - RNA, 32 nt, Human
ccugcugcagagccagugaacucaggucgggc

SEQ ID NO: 381165 - RNA, 32 nt, Human
ccugcugcagcuggcccuggguccuggcuuuc

SEQ ID NO: 381166 - RNA, 32 nt, Human
ccugcugcaggggagcuccuucaggagcccca

SEQ ID NO: 381167 - RNA, 32 nt, Human
ccugcugcaugaggcccucgucuucaguuucu

SEQ ID NO: 381168 - RNA, 32 nt, Human
ccugcugcaugcccucucaggccggcagcccc

SEQ ID NO: 381169 - RNA, 32 nt, Human
ccugcugccacuaaggggaaaaugcagaccag

SEQ ID NO: 381170 - RNA, 20 nt, Human
ccugcugccagaacaggccu

SEQ ID NO: 381171 - RNA, 32 nt, Human
ccugcugccagccugugucugugcaguccccc

SEQ ID NO: 381172 - RNA, 25 nt, Human
ccugcugccaucuccaggccccuua

SEQ ID NO: 381173 - RNA, 23 nt, Human
ccugcugcccagugagggcuccu

SEQ ID NO: 381174 - RNA, 32 nt, Human
ccugcugccccagccaggguuggagucuuagc

SEQ ID NO: 381175 - RNA, 21 nt, Human
ccugcugcccccacacccccg

SEQ ID NO: 381176 - RNA, 22 nt, Human
ccugcugccccgccccguccuu

SEQ ID NO: 381177 - RNA, 24 nt, Human
ccugcugccccgccccguccuucc

SEQ ID NO: 381178 - RNA, 32 nt, Human
ccugcugccccucccucucucucccucucucu

SEQ ID NO: 381179 - RNA, 20 nt, Human
ccugcugcccggaagagccu

SEQ ID NO: 381180 - RNA, 31 nt, Human
ccugcugcccucucuggugccuguggagaug

SEQ ID NO: 381181 - RNA, 21 nt, Human
ccugcugcccuuccccuuccc

SEQ ID NO: 381182 - RNA, 20 nt, Human
ccugcugcccuucgauccuu

SEQ ID NO: 381183 - RNA, 32 nt, Human
ccugcugcccuuggucgccuagacuggauagu

SEQ ID NO: 381184 - RNA, 32 nt, Human
ccugcugcccuuucuaggcagccuccuugggg

SEQ ID NO: 381185 - RNA, 32 nt, Human
ccugcugccggaccugagccuccuggcuccca

SEQ ID NO: 381186 - RNA, 22 nt, Human
ccugcugccuccacuccugccu

SEQ ID NO: 381187 - RNA, 20 nt, Human
ccugcugccucccucggcca

SEQ ID NO: 381188 - RNA, 32 nt, Human
ccugcugccucucaggcaccagugccauuaac

SEQ ID NO: 381189 - RNA, 32 nt, Human
ccugcugccugcccaaacaccccaccauuggc

SEQ ID NO: 381190 - RNA, 32 nt, Human
ccugcugccuggguccuggcccuccuccccca

SEQ ID NO: 381191 - RNA, 22 nt, Human
ccugcugcggccccacccccgg

SEQ ID NO: 381192 - RNA, 32 nt, Human
ccugcugcuccuccugagccucggggaggagg

SEQ ID NO: 381193 - RNA, 32 nt, Human
ccugcugcucuugccuucuaagcuacugugcu

SEQ ID NO: 381194 - RNA, 32 nt, Human
ccugcugcugaaggcccugcugcuacugcugc

SEQ ID NO: 381195 - RNA, 32 nt, Human
ccugcugcugaccuccccuugaggacccuccu

SEQ ID NO: 381196 - RNA, 20 nt, Human
ccugcugcugcaggagcccc

SEQ ID NO: 381197 - RNA, 20 nt, Human
ccugcugcugcugcugcaca

SEQ ID NO: 381198 - RNA, 23 nt, Human
ccugcugcugcugcugcugccuc

SEQ ID NO: 381199 - RNA, 32 nt, Human
ccugcugcuggcaaggaaugggaacaguggcu

SEQ ID NO: 381200 - RNA, 20 nt, Human
ccugcugcugugcugccauc

SEQ ID NO: 381201 - RNA, 32 nt, Human
ccugcugcuuccaggcugcaaaccugacagca

SEQ ID NO: 381202 - RNA, 32 nt, Human
ccugcugcuucgcaucccuccuguggccucca

SEQ ID NO: 381203 - RNA, 32 nt, Human
ccugcugcuuuccugguauagcaccuaagaga

SEQ ID NO: 381204 - RNA, 21 nt, Human
ccugcugcuuucucuaccuca

SEQ ID NO: 381205 - RNA, 21 nt, Human
ccugcuggaacgcaguggugu

SEQ ID NO: 381206 - RNA, 32 nt, Human
ccugcuggagaugaaugaggccaaggugaagg

SEQ ID NO: 381207 - RNA, 32 nt, Human
ccugcuggagcugcucaagaucacgcgggaag

SEQ ID NO: 381208 - RNA, 32 nt, Human
ccugcuggaggaacucggcuuccagcuauucu

SEQ ID NO: 381209 - RNA, 32 nt, Human
ccugcuggagugaaggggccaaggagggugag

SEQ ID NO: 381210 - RNA, 32 nt, Human
ccugcuggaguuuucugccugagauguuagga

SEQ ID NO: 381211 - RNA, 32 nt, Human
ccugcuggaugcagcuccuugugggccuacca

SEQ ID NO: 381212 - RNA, 32 nt, Human
ccugcuggccccaggacuucugaucucagucc

SEQ ID NO: 381213 - RNA, 20 nt, Human
ccugcuggcccuccaggggg

SEQ ID NO: 381214 - RNA, 23 nt, Human
ccugcuggcccugaggcugcaga

SEQ ID NO: 381215 - RNA, 32 nt, Human
ccugcuggccucccuuccccagaggcuggugu

SEQ ID NO: 381216 - RNA, 20 nt, Human
ccugcuggcgccccagcaca

SEQ ID NO: 381217 - RNA, 21 nt, Human
ccugcuggcgcucccugucca

SEQ ID NO: 381218 - RNA, 32 nt, Human
ccugcuggcuuaguggguuuauuucauaaguu

SEQ ID NO: 381219 - RNA, 32 nt, Human
ccugcuggcuuuccuguugacuggcccggagc

SEQ ID NO: 381220 - RNA, 32 nt, Human
ccugcugggaggaauggcgccgccggguucaa

SEQ ID NO: 381221 - RNA, 32 nt, Human
ccugcugggaggaggagggggaagaggaggag

SEQ ID NO: 381222 - RNA, 32 nt, Human
ccugcugggagguguguuugcaggacaggggu

SEQ ID NO: 381223 - RNA, 32 nt, Human
ccugcugggcaauccugggaaggucuggaggu

SEQ ID NO: 381224 - RNA, 32 nt, Human
ccugcugggcccagccaccaggacagcaggaa

SEQ ID NO: 381225 - RNA, 32 nt, Human
ccugcugggcugcuuccacuccuccacuccag

SEQ ID NO: 381226 - RNA, 32 nt, Human
ccugcuggggugaugcagggaggaggggaggu

SEQ ID NO: 381227 - RNA, 32 nt, Human
ccugcugggguucuccuuucugcuguuccgag

SEQ ID NO: 381228 - RNA, 32 nt, Human
ccugcuggguagagaacacagaggacagggca

SEQ ID NO: 381229 - RNA, 32 nt, Human
ccugcugggugaggaugagugcugguuccgcc

SEQ ID NO: 381230 - RNA, 19 nt, Human
ccugcuggguggucccuca

SEQ ID NO: 381231 - RNA, 32 nt, Human
ccugcuggguuacuggcccacccugugggcac

SEQ ID NO: 381232 - RNA, 19 nt, Human
ccugcugguccacaggucc

SEQ ID NO: 381233 - RNA, 32 nt, Human
ccugcugguccugaccaagaucgcggcugccg

SEQ ID NO: 381234 - RNA, 32 nt, Human
ccugcuggugugggauggugcugcgggcgagc

SEQ ID NO: 381235 - RNA, 32 nt, Human
ccugcugguuccccagcccuuuucccugcccu

SEQ ID NO: 381236 - RNA, 31 nt, Human
ccugcuguaauaaauguauuaacugaaaccu

SEQ ID NO: 381237 - RNA, 32 nt, Human
ccugcuguagccacugggcucagcccuggagc

SEQ ID NO: 381238 - RNA, 32 nt, Human
ccugcugucaacacccaggacacccaggauau

SEQ ID NO: 381239 - RNA, 32 nt, Human
ccugcugucaccccgaccucuggcaggagccg

SEQ ID NO: 381240 - RNA, 22 nt, Human
ccugcugucaggagcaggcaga

SEQ ID NO: 381241 - RNA, 32 nt, Human
ccugcugucauugcuucuucugaggccugaau

SEQ ID NO: 381242 - RNA, 32 nt, Human
ccugcugucauuggcucucccuccaggcugcu

SEQ ID NO: 381243 - RNA, 32 nt, Human
ccugcuguccagcuucccaggugcaguggguu

SEQ ID NO: 381244 - RNA, 32 nt, Human
ccugcugucccagggagaguugcaucgcccuc

SEQ ID NO: 381245 - RNA, 32 nt, Human
ccugcuguccuccagaaagcaccaaggaaaaa

SEQ ID NO: 381246 - RNA, 32 nt, Human
ccugcuguccuccuugccuucucccucuucuc

SEQ ID NO: 381247 - RNA, 23 nt, Human
ccugcuguccucgauagaccgga

SEQ ID NO: 381248 - RNA, 23 nt, Human
ccugcuguccugucuaggguagg

SEQ ID NO: 381249 - RNA, 32 nt, Human
ccugcuguccugugaacugccugcugcccugu

SEQ ID NO: 381250 - RNA, 32 nt, Human
ccugcugucuccuccagguacccccuaagccu

SEQ ID NO: 381251 - RNA, 32 nt, Human
ccugcugucucuuggggcucucuccccuccgc

SEQ ID NO: 381252 - RNA, 22 nt, Human
ccugcugucuuacaccagugga

SEQ ID NO: 381253 - RNA, 21 nt, Human
ccugcugugagaacaagugga

SEQ ID NO: 381254 - RNA, 24 nt, Human
ccugcugugcccccgagcugcucc

SEQ ID NO: 381255 - RNA, 32 nt, Human
ccugcugugcugcugccauggcgcaugcuccu

SEQ ID NO: 381256 - RNA, 32 nt, Human
ccugcuguggaggugagaucgccaugggucau

SEQ ID NO: 381257 - RNA, 32 nt, Human
ccugcuguggaugucccuauucugccauggga

SEQ ID NO: 381258 - RNA, 32 nt, Human
ccugcuguggccaggacaugacaaugacggcu

SEQ ID NO: 381259 - RNA, 32 nt, Human
ccugcuguggcuggcacauucuucugauuaac

SEQ ID NO: 381260 - RNA, 32 nt, Human
ccugcugugggaaagguggggaagaaggggau

SEQ ID NO: 381261 - RNA, 32 nt, Human
ccugcugugggaugcugagcacagagcccaca

SEQ ID NO: 381262 - RNA, 32 nt, Human
ccugcugugguccugcccucuguccugcagac

SEQ ID NO: 381263 - RNA, 17 nt, Human
ccugcuguguccacagu

SEQ ID NO: 381264 - RNA, 32 nt, Human
ccugcuguguguccccugucauguccccaggu

SEQ ID NO: 381265 - RNA, 32 nt, Human
ccugcuguguguccuguuccauguuccgguuc

SEQ ID NO: 381266 - RNA, 32 nt, Human
ccugcuguucccgugggagccaugaagcugaa

SEQ ID NO: 381267 - RNA, 32 nt, Human
ccugcuguuccucucccugccuguucugcaug

SEQ ID NO: 381268 - RNA, 32 nt, Human
ccugcuguucuagguacuggccugggugacag

SEQ ID NO: 381269 - RNA, 32 nt, Human
ccugcuguucugggucucaggcugcuggaccc

SEQ ID NO: 381270 - RNA, 32 nt, Human
ccugcuguugcucucaugccucuugccaacag

SEQ ID NO: 381271 - RNA, 32 nt, Human
ccugcuguugcuucagccuggccugggcagcc

SEQ ID NO: 381272 - RNA, 32 nt, Human
ccugcuguuggaggcaacaucuccucuuuuua

SEQ ID NO: 381273 - RNA, 32 nt, Human
ccugcuguuuccugcccaucagagaggccuga

SEQ ID NO: 381274 - RNA, 32 nt, Human
ccugcuuaacccaaauaagaacagugaucuua

SEQ ID NO: 381275 - RNA, 32 nt, Human
ccugcuuagaugccuggugacucucaucuugc

SEQ ID NO: 381276 - RNA, 32 nt, Human
ccugcuuaggauucuguucccugggcugaaac

SEQ ID NO: 381277 - RNA, 19 nt, Human
ccugcuuauccguauuuca

SEQ ID NO: 381278 - RNA, 32 nt, Human
ccugcuuaugugggguguggccgauuccuccc

SEQ ID NO: 381279 - RNA, 32 nt, Human
ccugcuuauugccucuuucucagaauccucuu

SEQ ID NO: 381280 - RNA, 32 nt, Human
ccugcuucaagccagugccucuucccagcucc

SEQ ID NO: 381281 - RNA, 32 nt, Human
ccugcuucaagcuauucucccaccucauccuc

SEQ ID NO: 381282 - RNA, 21 nt, Human
ccugcuucacagccccaugga

SEQ ID NO: 381283 - RNA, 32 nt, Human
ccugcuucaccaucuucucauaccaucacauu

SEQ ID NO: 381284 - RNA, 23 nt, Human
ccugcuucagagccuguucuucu

SEQ ID NO: 381285 - RNA, 32 nt, Human
ccugcuucaguaaaauccaguaauggguaugc

SEQ ID NO: 381286 - RNA, 32 nt, Human
ccugcuucauccucccuggcaucugggagagu

SEQ ID NO: 381287 - RNA, 32 nt, Human
ccugcuucauucuugccccacacucauaaucc

SEQ ID NO: 381288 - RNA, 32 nt, Human
ccugcuuccacccauggucaggacagucagcc

SEQ ID NO: 381289 - RNA, 32 nt, Human
ccugcuuccacuucgccuucugccaugacugu

SEQ ID NO: 381290 - RNA, 32 nt, Human
ccugcuuccagcccuucucucugcaccucucu

SEQ ID NO: 381291 - RNA, 32 nt, Human
ccugcuuccagcugcugcagcgcgccuucgcc

SEQ ID NO: 381292 - RNA, 24 nt, Human
ccugcuucccacgcugccaucucu

SEQ ID NO: 381293 - RNA, 32 nt, Human
ccugcuucccagaggacuggcccuacgugcuc

SEQ ID NO: 381294 - RNA, 21 nt, Human
ccugcuucccagcuucacaau

SEQ ID NO: 381295 - RNA, 32 nt, Human
ccugcuuccccagcuaagcaggagucuuuugu

SEQ ID NO: 381296 - RNA, 32 nt, Human
ccugcuucccccucccccuccugcugugcugg

SEQ ID NO: 381297 - RNA, 32 nt, Human
ccugcuuccuccguguccccugcuccucaccc

SEQ ID NO: 381298 - RNA, 32 nt, Human
ccugcuuccuccuccgcugccugccgccgccg

SEQ ID NO: 381299 - RNA, 20 nt, Human
ccugcuuccucuccaucuca

SEQ ID NO: 381300 - RNA, 32 nt, Human
ccugcuuccucuucuuccucuucuuuucacag

SEQ ID NO: 381301 - RNA, 32 nt, Human
ccugcuuccucuuuuccugcucccuaaccuuu

SEQ ID NO: 381302 - RNA, 18 nt, Human
ccugcuuccugcuugcca

SEQ ID NO: 381303 - RNA, 32 nt, Human
ccugcuuccuucagucccucugccucccuuug

SEQ ID NO: 381304 - RNA, 32 nt, Human
ccugcuuccuuggggagcugcagccaugggca

SEQ ID NO: 381305 - RNA, 22 nt, Human
ccugcuucucaagcugcagaga

SEQ ID NO: 381306 - RNA, 32 nt, Human
ccugcuucucacuugacauugcauuaugagua

SEQ ID NO: 381307 - RNA, 32 nt, Human
ccugcuucucauuuugcccucugagaaaaggc

SEQ ID NO: 381308 - RNA, 32 nt, Human
ccugcuucucucugcacgucucccucauucuu

SEQ ID NO: 381309 - RNA, 32 nt, Human
ccugcuucucugcuccccugggugaugggugg

SEQ ID NO: 381310 - RNA, 19 nt, Human
ccugcuucugccagcagcu

SEQ ID NO: 381311 - RNA, 32 nt, Human
ccugcuucugcccaccugcucuccuuccaugg

SEQ ID NO: 381312 - RNA, 32 nt, Human
ccugcuucugcugcccugaugcgucuacccag

SEQ ID NO: 381313 - RNA, 20 nt, Human
ccugcuucugggggcaguga

SEQ ID NO: 381314 - RNA, 32 nt, Human
ccugcuucuguaauccuagcuaguugggaggc

SEQ ID NO: 381315 - RNA, 32 nt, Human
ccugcuucuucaagcaccugcagauucugauu

SEQ ID NO: 381316 - RNA, 32 nt, Human
ccugcuucuucccagagacagagcuguguacc

SEQ ID NO: 381317 - RNA, 32 nt, Human
ccugcuucuugcccugcuguguguggcugccu

SEQ ID NO: 381318 - RNA, 32 nt, Human
ccugcuucuuuccuuucccuuccagagguaau

SEQ ID NO: 381319 - RNA, 32 nt, Human
ccugcuugaacccugagaggcaggugguaggc

SEQ ID NO: 381320 - RNA, 23 nt, Human
ccugcuugaacugcugccaacuc

SEQ ID NO: 381321 - RNA, 32 nt, Human
ccugcuugaaugucaugaacaggugugcuggg

SEQ ID NO: 381322 - RNA, 32 nt, Human
ccugcuugagcugcucccaaauuauugaucca

SEQ ID NO: 381323 - RNA, 32 nt, Human
ccugcuugcacauguuaucuuugcuucugccg

SEQ ID NO: 381324 - RNA, 32 nt, Human
ccugcuugcacucccuucauccggccacccug

SEQ ID NO: 381325 - RNA, 32 nt, Human
ccugcuugcagucugcaaggacaccuuugcag

SEQ ID NO: 381326 - RNA, 17 nt, Human
ccugcuugccagcucuu

SEQ ID NO: 381327 - RNA, 32 nt, Human
ccugcuugcgggggccgccuguccucacugcc

SEQ ID NO: 381328 - RNA, 27 nt, Human
ccugcuugcucucauaaaaagagccag

SEQ ID NO: 381329 - RNA, 32 nt, Human
ccugcuugcuuacucauauucucccucccucu

SEQ ID NO: 381330 - RNA, 32 nt, Human
ccugcuugcuuccaaagugauggacaggaagg

SEQ ID NO: 381331 - RNA, 32 nt, Human
ccugcuugggagccccuggccccagccuccau

SEQ ID NO: 381332 - RNA, 32 nt, Human
ccugcuugggcaacguagcaagaccuugccuc

SEQ ID NO: 381333 - RNA, 32 nt, Human
ccugcuugguggggucccccuuguaacaauaa

SEQ ID NO: 381334 - RNA, 32 nt, Human
ccugcuugguucuccccucccuucccuggccg

SEQ ID NO: 381335 - RNA, 32 nt, Human
ccugcuuguaaagccuccccucccucugacca

SEQ ID NO: 381336 - RNA, 32 nt, Human
ccugcuuuaaguaauauguagccacauuugaa

SEQ ID NO: 381337 - RNA, 32 nt, Human
ccugcuuucauuuugugcuuuuccuuguguuu

SEQ ID NO: 381338 - RNA, 20 nt, Human
ccugcuuuccauuucgagaa

SEQ ID NO: 381339 - RNA, 19 nt, Human
ccugcuuucccaguuggaa

SEQ ID NO: 381340 - RNA, 32 nt, Human
ccugcuuuccucaauguguucuucacccguga

SEQ ID NO: 381341 - RNA, 24 nt, Human
ccugcuuucucgcggccaccccgg

SEQ ID NO: 381342 - RNA, 32 nt, Human
ccugcuuucuuugaacacauacuugaucaaaa

SEQ ID NO: 381343 - RNA, 32 nt, Human
ccugcuuugaagaaacauacuguccauuuguc

SEQ ID NO: 381344 - RNA, 32 nt, Human
ccugcuuugaggacaaagagaauaaagacuuc

SEQ ID NO: 381345 - RNA, 32 nt, Human
ccugcuuugcagagaaggagccggggaccagc

SEQ ID NO: 381346 - RNA, 32 nt, Human
ccugcuuugcaguaggucacccugccaaacaa

SEQ ID NO: 381347 - RNA, 32 nt, Human
ccugcuuugccuacucucuagcaacugacuug

SEQ ID NO: 381348 - RNA, 32 nt, Human
ccugcuuugucuccucuauccugggcuuuugu

SEQ ID NO: 381349 - RNA, 32 nt, Human
ccugcuuuucugaagcccccaaggagggcucu

SEQ ID NO: 381350 - RNA, 27 nt, Human
ccugcuuuugcagccaggggucaggag

SEQ ID NO: 381351 - RNA, 32 nt, Human
ccugcuuuugcagccaggggucaggagguggc

SEQ ID NO: 381352 - RNA, 32 nt, Human
ccuggaaaaauuauuuuguuucccucuuccuu

SEQ ID NO: 381353 - RNA, 22 nt, Human
ccuggaaaacggagcauggugg

SEQ ID NO: 381354 - RNA, 32 nt, Human
ccuggaaaagagcaucccgaacaguggagagg

SEQ ID NO: 381355 - RNA, 20 nt, Human
ccuggaaaagguugcaguga

SEQ ID NO: 381356 - RNA, 21 nt, Human
ccuggaaaagguugcagugag

SEQ ID NO: 381357 - RNA, 32 nt, Human
ccuggaaaccaccacuuugagcuguccugccu

SEQ ID NO: 381358 - RNA, 32 nt, Human
ccuggaaaccagaagaaaaauaugagacgggg

SEQ ID NO: 381359 - RNA, 32 nt, Human
ccuggaaaccuacagacaaggaggaguuccac

SEQ ID NO: 381360 - RNA, 22 nt, Human
ccuggaaaccugguucucuucu

SEQ ID NO: 381361 - RNA, 32 nt, Human
ccuggaaaccuguacaaaagguugagauuggg

SEQ ID NO: 381362 - RNA, 32 nt, Human
ccuggaaagaugagaacacuguugcacaaccc

SEQ ID NO: 381363 - RNA, 18 nt, Human
ccuggaaaguaugugugg

SEQ ID NO: 381364 - RNA, 22 nt, Human
ccuggaaauaggucuguccacu

SEQ ID NO: 381365 - RNA, 32 nt, Human
ccuggaaauauuuuguaacacuuuaaaggauu

SEQ ID NO: 381366 - RNA, 32 nt, Human
ccuggaaauguccuugcauucguggccuccuu

SEQ ID NO: 381367 - RNA, 32 nt, Human
ccuggaacacagagcugcggccucggugcuga

SEQ ID NO: 381368 - RNA, 32 nt, Human
ccuggaacacccugggguuggcccagaaggag

SEQ ID NO: 381369 - RNA, 23 nt, Human
ccuggaacaccuguccucgggca

SEQ ID NO: 381370 - RNA, 32 nt, Human
ccuggaacagauuuuaauaauuaucagaguaa

SEQ ID NO: 381371 - RNA, 21 nt, Human
ccuggaacagggaggguguag

SEQ ID NO: 381372 - RNA, 32 nt, Human
ccuggaacauaaaaauuguuugggucaaauuu

SEQ ID NO: 381373 - RNA, 21 nt, Human
ccuggaacaugacauuguuaa

SEQ ID NO: 381374 - RNA, 32 nt, Human
ccuggaacaugccagcacacacugccaugucc

SEQ ID NO: 381375 - RNA, 32 nt, Human
ccuggaacauuucuauuucagcagaauauauu

SEQ ID NO: 381376 - RNA, 22 nt, Human
ccuggaaccucaaacaaugugg

SEQ ID NO: 381377 - RNA, 32 nt, Human
ccuggaaccugacagcagaaaggacccuucac

SEQ ID NO: 381378 - RNA, 20 nt, Human
ccuggaacgcugcagugugg

SEQ ID NO: 381379 - RNA, 32 nt, Human
ccuggaacugcuggauuucucagauauccagg

SEQ ID NO: 381380 - RNA, 32 nt, Human
ccuggaacuucugccuccuuccuccgugaucu

SEQ ID NO: 381381 - RNA, 32 nt, Human
ccuggaagaaggaggaacauggagaggagagc

SEQ ID NO: 381382 - RNA, 32 nt, Human
ccuggaagaaucaggucacacacagacuugaa

SEQ ID NO: 381383 - RNA, 32 nt, Human
ccuggaagacccucgcccacacccagcgugga

SEQ ID NO: 381384 - RNA, 32 nt, Human
ccuggaagagcaacucuaucugaucucaaaau

SEQ ID NO: 381385 - RNA, 25 nt, Human
ccuggaagaggcaggcagggggcug

SEQ ID NO: 381386 - RNA, 32 nt, Human
ccuggaagagggaggucccacuaugccuuugg

SEQ ID NO: 381387 - RNA, 22 nt, Human
ccuggaagaguccuccacccca

SEQ ID NO: 381388 - RNA, 32 nt, Human
ccuggaagcaccugcuuggcccugccaccuuc

SEQ ID NO: 381389 - RNA, 32 nt, Human
ccuggaagccagugaaaaaugauggcaacacu

SEQ ID NO: 381390 - RNA, 32 nt, Human
ccuggaagccgcugccccuugcaccuccucgg

SEQ ID NO: 381391 - RNA, 32 nt, Human
ccuggaagcugaggcugagaaggguggagcuu

SEQ ID NO: 381392 - RNA, 22 nt, Human
ccuggaagcugccuguccuucu

SEQ ID NO: 381393 - RNA, 32 nt, Human
ccuggaaggaagagaaggaauacaguuagcau

SEQ ID NO: 381394 - RNA, 24 nt, Human
ccuggaaggaagagguugcaguga

SEQ ID NO: 381395 - RNA, 32 nt, Human
ccuggaaggaagagguugcagugagccaagau

SEQ ID NO: 381396 - RNA, 32 nt, Human
ccuggaaggaagcaggauggcagccggaacag

SEQ ID NO: 381397 - RNA, 32 nt, Human
ccuggaaggagagggcacagaagcagcuguuu

SEQ ID NO: 381398 - RNA, 32 nt, Human
ccuggaaggagagggugagugggggauggcuu

SEQ ID NO: 381399 - RNA, 32 nt, Human
ccuggaaggagggagagcaggcagcccuucac

SEQ ID NO: 381400 - RNA, 24 nt, Human
ccuggaaggcagaaguugcaguga

SEQ ID NO: 381401 - RNA, 32 nt, Human
ccuggaaggcagaaguugcagugagcugagau

SEQ ID NO: 381402 - RNA, 24 nt, Human
ccuggaaggcagagauugcaguga

SEQ ID NO: 381403 - RNA, 32 nt, Human
ccuggaaggcagagauugcagugagcugagac

SEQ ID NO: 381404 - RNA, 24 nt, Human
ccuggaaggcagagguggcaguga

SEQ ID NO: 381405 - RNA, 23 nt, Human
ccuggaaggcggagcuugcagug

SEQ ID NO: 381406 - RNA, 24 nt, Human
ccuggaaggcggagcuugcaguga

SEQ ID NO: 381407 - RNA, 25 nt, Human
ccuggaaggcggagcuugcagugag

SEQ ID NO: 381408 - RNA, 32 nt, Human
ccuggaaggcggagcuugcagugagcugagau

SEQ ID NO: 381409 - RNA, 23 nt, Human
ccuggaaggcggagguugcagug

SEQ ID NO: 381410 - RNA, 24 nt, Human
ccuggaaggcggagguugcaguga

SEQ ID NO: 381411 - RNA, 32 nt, Human
ccuggaaggcggagguugcagugagcagagau

SEQ ID NO: 381412 - RNA, 32 nt, Human
ccuggaaggcggagguugcagugagccaagau

SEQ ID NO: 381413 - RNA, 32 nt, Human
ccuggaaggcggagguugcagugagccgagau

SEQ ID NO: 381414 - RNA, 32 nt, Human
ccuggaagggaaaggaaggaaccuggggucau

SEQ ID NO: 381415 - RNA, 32 nt, Human
ccuggaagggccugugccagcaccaggcagag

SEQ ID NO: 381416 - RNA, 32 nt, Human
ccuggaaggggaagaauucgggaaaagcaacg

SEQ ID NO: 381417 - RNA, 24 nt, Human
ccuggaagguggaaguugcaguga

SEQ ID NO: 381418 - RNA, 32 nt, Human
ccuggaagguggaaguugcagugagucgagau

SEQ ID NO: 381419 - RNA, 24 nt, Human
ccuggaagguggagcuugcaguga

SEQ ID NO: 381420 - RNA, 25 nt, Human
ccuggaagguggagcuugcagugag

SEQ ID NO: 381421 - RNA, 32 nt, Human
ccuggaagguggagcuugcagugagcugagau

SEQ ID NO: 381422 - RNA, 32 nt, Human
ccuggaaguauuucacuguuggaagaaguaaa

SEQ ID NO: 381423 - RNA, 20 nt, Human
ccuggaagucccgacucccc

SEQ ID NO: 381424 - RNA, 32 nt, Human
ccuggaagugagaaguucuuugcagauuuggg

SEQ ID NO: 381425 - RNA, 32 nt, Human
ccuggaagugauuuccaugagaacaaaggcuu

SEQ ID NO: 381426 - RNA, 23 nt, Human
ccuggaaguggagguugcgguga

SEQ ID NO: 381427 - RNA, 32 nt, Human
ccuggaauacaugacacauucuuacugagguc

SEQ ID NO: 381428 - RNA, 32 nt, Human
ccuggaauauuuuugcccuuuauccuucaagg

SEQ ID NO: 381429 - RNA, 19 nt, Human
ccuggaaucccagcacuuu

SEQ ID NO: 381430 - RNA, 32 nt, Human
ccuggaaucccagcuacuugagaggcugaggc

SEQ ID NO: 381431 - RNA, 32 nt, Human
ccuggaauccucagccucucuggccgccagua

SEQ ID NO: 381432 - RNA, 32 nt, Human
ccuggaauggaaggcagggcuguggcucagag

SEQ ID NO: 381433 - RNA, 32 nt, Human
ccuggaauuccaugccagccuaugcaacauca

SEQ ID NO: 381434 - RNA, 32 nt, Human
ccuggaauuucugccuuucugucucaagaugc

SEQ ID NO: 381435 - RNA, 32 nt, Human
ccuggacaacaacguggagccugcaccaggag

SEQ ID NO: 381436 - RNA, 32 nt, Human
ccuggacaacacagcagaccccgucuuuauaa

SEQ ID NO: 381437 - RNA, 28 nt, Human
ccuggacaacacagcgagauuccgucuc

SEQ ID NO: 381438 - RNA, 28 nt, Human
ccuggacaacacagugagacucugucuc

SEQ ID NO: 381439 - RNA, 28 nt, Human
ccuggacaacagagcaagaccuucucuc

SEQ ID NO: 381440 - RNA, 32 nt, Human
ccuggacaacagagcaagacuccuucucaaaa

SEQ ID NO: 381441 - RNA, 32 nt, Human
ccuggacaacauagcaagaccccaucucuuaa

SEQ ID NO: 381442 - RNA, 32 nt, Human
ccuggacaacauaguaagacccuaucucuacc

SEQ ID NO: 381443 - RNA, 32 nt, Human
ccuggacaacauggugaacccgucucuacuaa

SEQ ID NO: 381444 - RNA, 32 nt, Human
ccuggacaauaccugcuccgugugugcaucuc

SEQ ID NO: 381445 - RNA, 32 nt, Human
ccuggacaauacggugagacccugucuguacc

SEQ ID NO: 381446 - RNA, 32 nt, Human
ccuggacacagauccucuguguggacccagga

SEQ ID NO: 381447 - RNA, 25 nt, Human
ccuggacaccaacaggagccgccug

SEQ ID NO: 381448 - RNA, 32 nt, Human
ccuggacacccuaccuuucuaucaggagcagu

SEQ ID NO: 381449 - RNA, 32 nt, Human
ccuggacaccgaggggccagugugugaucauu

SEQ ID NO: 381450 - RNA, 25 nt, Human
ccuggacacgcugguggugcugcac

SEQ ID NO: 381451 - RNA, 32 nt, Human
ccuggacacugaaccucuaaagggaaaagguc

SEQ ID NO: 381452 - RNA, 32 nt, Human
ccuggacagaaacauauccccaaacaccucca

SEQ ID NO: 381453 - RNA, 31 nt, Human
ccuggacagagaccuguuugaagggaagguc

SEQ ID NO: 381454 - RNA, 32 nt, Human
ccuggacagagcaaggagagggcuccccacuc

SEQ ID NO: 381455 - RNA, 32 nt, Human
ccuggacagauggcccaagggauggcaccacu

SEQ ID NO: 381456 - RNA, 32 nt, Human
ccuggacagggacccuuuucuguccaucagag

SEQ ID NO: 381457 - RNA, 32 nt, Human
ccuggacagugaagggagagaaguggauuugg

SEQ ID NO: 381458 - RNA, 27 nt, Human
ccuggacaugaccguaucccucugcca

SEQ ID NO: 381459 - RNA, 32 nt, Human
ccuggaccaaugcaucuucccaccaccuuaaa

SEQ ID NO: 381460 - RNA, 32 nt, Human
ccuggaccacacacaucacugugugcagaugc

SEQ ID NO: 381461 - RNA, 17 nt, Human
ccuggaccacuccugcc

SEQ ID NO: 381462 - RNA, 32 nt, Human
ccuggaccagaagacagagggcaagaggagca

SEQ ID NO: 381463 - RNA, 32 nt, Human
ccuggaccagcugcucagcugucugaagaccu

SEQ ID NO: 381464 - RNA, 32 nt, Human
ccuggaccaggcaccaggcuccugggcucugg

SEQ ID NO: 381465 - RNA, 32 nt, Human
ccuggaccaggccauggaugaaggacaaagac

SEQ ID NO: 381466 - RNA, 32 nt, Human
ccuggaccccaggccagcuaugaggcugacug

SEQ ID NO: 381467 - RNA, 32 nt, Human
ccuggacccccgaggcucucggaugauagagu

SEQ ID NO: 381468 - RNA, 32 nt, Human
ccuggaccccucugcacgucuagcugggagua

SEQ ID NO: 381469 - RNA, 32 nt, Human
ccuggacccucagagcaagugguuuggucggg

SEQ ID NO: 381470 - RNA, 32 nt, Human
ccuggacccugagguugucuccagaaacgguc

SEQ ID NO: 381471 - RNA, 32 nt, Human
ccuggacccuggaagcagggacugguugaggg

SEQ ID NO: 381472 - RNA, 32 nt, Human
ccuggaccggcacaagaaacugcuuucuucuc

SEQ ID NO: 381473 - RNA, 19 nt, Human
ccuggaccggggggcgcgg

SEQ ID NO: 381474 - RNA, 32 nt, Human
ccuggaccuaauauggugauaaaauuuuaggc

SEQ ID NO: 381475 - RNA, 32 nt, Human
ccuggaccucaagugaucuacccgccuuggcc

SEQ ID NO: 381476 - RNA, 32 nt, Human
ccuggaccucagggaggaagacggggaugaaa

SEQ ID NO: 381477 - RNA, 32 nt, Human
ccuggaccugccggcccucccuccaggaccga

SEQ ID NO: 381478 - RNA, 32 nt, Human
ccuggaccuggcugggcuccaugagaaugagu

SEQ ID NO: 381479 - RNA, 32 nt, Human
ccuggaccugggaggaagcuggagaaaagaug

SEQ ID NO: 381480 - RNA, 19 nt, Human
ccuggaccuggggggccag

SEQ ID NO: 381481 - RNA, 32 nt, Human
ccuggaccuugggccauaauuucugagccucg

SEQ ID NO: 381482 - RNA, 32 nt, Human
ccuggacgacagagcaagacucugucucaaaa

SEQ ID NO: 381483 - RNA, 32 nt, Human
ccuggacgauauagccagacccugucuguaaa

SEQ ID NO: 381484 - RNA, 32 nt, Human
ccuggacgcagaggcccugcccuugccagacg

SEQ ID NO: 381485 - RNA, 32 nt, Human
ccuggacgccguccuggcugcgcaggaggggc

SEQ ID NO: 381486 - RNA, 23 nt, Human
ccuggacggcaucaaggugcuga

SEQ ID NO: 381487 - RNA, 22 nt, Human
ccuggacgugugcagcaugugg

SEQ ID NO: 381488 - RNA, 32 nt, Human
ccuggacuaucaguaaccccacugcacaggca

SEQ ID NO: 381489 - RNA, 32 nt, Human
ccuggacuauccauugcauuuuugccucuaaa

SEQ ID NO: 381490 - RNA, 32 nt, Human
ccuggacucaacaacacgaacuucuacucacc

SEQ ID NO: 381491 - RNA, 32 nt, Human
ccuggacucaugcaaucuuccugccucaggcu

SEQ ID NO: 381492 - RNA, 32 nt, Human
ccuggacuccagccaaggcuguucagguggga

SEQ ID NO: 381493 - RNA, 22 nt, Human
ccuggacuccccagccuuccca

SEQ ID NO: 381494 - RNA, 32 nt, Human
ccuggacuccccagccuucccaccccauaccu

SEQ ID NO: 381495 - RNA, 25 nt, Human
ccuggacuccucuucccaacuuccu

SEQ ID NO: 381496 - RNA, 32 nt, Human
ccuggacuccugggaccccacguccugcaccc

SEQ ID NO: 381497 - RNA, 32 nt, Human
ccuggacuccuugaugccggagcugcuggugu

SEQ ID NO: 381498 - RNA, 32 nt, Human
ccuggacucggccagcugccuccagggaccgc

SEQ ID NO: 381499 - RNA, 32 nt, Human
ccuggacucugccuuagcucccaccucucagc

SEQ ID NO: 381500 - RNA, 32 nt, Human
ccuggacugaagagagggagaauagaagccaa

SEQ ID NO: 381501 - RNA, 32 nt, Human
ccuggacugaagagagggagaauagaagccca

SEQ ID NO: 381502 - RNA, 32 nt, Human
ccuggacugaauucuggggaugagggcugaca

SEQ ID NO: 381503 - RNA, 32 nt, Human
ccuggacugagaauaguugaacaccgggggcu

SEQ ID NO: 381504 - RNA, 22 nt, Human
ccuggacugagagguuaccagg

SEQ ID NO: 381505 - RNA, 20 nt, Human
ccuggacugaugggcacagg

SEQ ID NO: 381506 - RNA, 22 nt, Human
ccuggacugcagagggggucag

SEQ ID NO: 381507 - RNA, 32 nt, Human
ccuggacugccucucgccucaguaggccuggg

SEQ ID NO: 381508 - RNA, 32 nt, Human
ccuggacugccucucggcugugcuccguggac

SEQ ID NO: 381509 - RNA, 32 nt, Human
ccuggacugguagcugcuggaggccuucuugu

SEQ ID NO: 381510 - RNA, 32 nt, Human
ccuggacugguucucucuaucucuggaguaau

SEQ ID NO: 381511 - RNA, 22 nt, Human
ccuggacuugagacccuucaca

SEQ ID NO: 381512 - RNA, 32 nt, Human
ccuggacuugccucugcacacccuccagagac

SEQ ID NO: 381513 - RNA, 32 nt, Human
ccuggacuuggagagaugggaggcagaccccc

SEQ ID NO: 381514 - RNA, 32 nt, Human
ccuggacuuucccaugagccuccuggaacugc

SEQ ID NO: 381515 - RNA, 32 nt, Human
ccuggacuuuccugcaacucaaggacuuugca

SEQ ID NO: 381516 - RNA, 20 nt, Human
ccuggagaagacauaugugg

SEQ ID NO: 381517 - RNA, 27 nt, Human
ccuggagaagacuacagcuccucgucc

SEQ ID NO: 381518 - RNA, 19 nt, Human
ccuggagaagggacauggg

SEQ ID NO: 381519 - RNA, 21 nt, Human
ccuggagaagggacaugggaa

SEQ ID NO: 381520 - RNA, 32 nt, Human
ccuggagaaguggucacagaagauggagcucu

SEQ ID NO: 381521 - RNA, 27 nt, Human
ccuggagacagaggaugacagggcucu

SEQ ID NO: 381522 - RNA, 23 nt, Human
ccuggagacagagguugcaguga

SEQ ID NO: 381523 - RNA, 24 nt, Human
ccuggagacagagguugcagugag

SEQ ID NO: 381524 - RNA, 19 nt, Human
ccuggagacagccaggugc

SEQ ID NO: 381525 - RNA, 32 nt, Human
ccuggagacagcugccugagacuccuugagga

SEQ ID NO: 381526 - RNA, 23 nt, Human
ccuggagaccaagaacagggcgc

SEQ ID NO: 381527 - RNA, 18 nt, Human
ccuggagaccagaagcug

SEQ ID NO: 381528 - RNA, 32 nt, Human
ccuggagacgcugguggcuguggacuccccag

SEQ ID NO: 381529 - RNA, 32 nt, Human
ccuggagacggaaggcaccgaugggcuuggag

SEQ ID NO: 381530 - RNA, 32 nt, Human
ccuggagacuaccaccucgcacaugccaaggu

SEQ ID NO: 381531 - RNA, 32 nt, Human
ccuggagacuggugcccugagcuccaaccagc

SEQ ID NO: 381532 - RNA, 19 nt, Human
ccuggagacuuugggucug

SEQ ID NO: 381533 - RNA, 32 nt, Human
ccuggagagaauuuccucuuccccagcuaaau

SEQ ID NO: 381534 - RNA, 32 nt, Human
ccuggagagacacuucaugcuccaaggcuuuu

SEQ ID NO: 381535 - RNA, 32 nt, Human
ccuggagagagaagaaugcaggcagcauuuuc

SEQ ID NO: 381536 - RNA, 32 nt, Human
ccuggagagagggaggugaaagcuggugugag

SEQ ID NO: 381537 - RNA, 32 nt, Human
ccuggagagcccaacucccagagcagauggca

SEQ ID NO: 381538 - RNA, 32 nt, Human
ccuggagagcccaggagcgggcgggacaugga

SEQ ID NO: 381539 - RNA, 32 nt, Human
ccuggagagcugggggaagguaggaagaggag

SEQ ID NO: 381540 - RNA, 21 nt, Human
ccuggagaggacggcccugcc

SEQ ID NO: 381541 - RNA, 32 nt, Human
ccuggagaggacugagccuacggaaaggggau

SEQ ID NO: 381542 - RNA, 32 nt, Human
ccuggagaggcccucuggaguggccacuaagc

SEQ ID NO: 381543 - RNA, 18 nt, Human
ccuggagaggggaggcag

SEQ ID NO: 381544 - RNA, 32 nt, Human
ccuggagauaugaaggauuacucuccauaucc

SEQ ID NO: 381545 - RNA, 32 nt, Human
ccuggagauauuaauggaauacagucaugucc

SEQ ID NO: 381546 - RNA, 18 nt, Human
ccuggagauccuacagua

SEQ ID NO: 381547 - RNA, 32 nt, Human
ccuggagauguagaggcugcagugagcuguga

SEQ ID NO: 381548 - RNA, 32 nt, Human
ccuggagcaaccaucagagcaguggcuggggc

SEQ ID NO: 381549 - RNA, 32 nt, Human
ccuggagcaagcccuggucaauggcuaccugg

SEQ ID NO: 381550 - RNA, 19 nt, Human
ccuggagcacaacaugugg

SEQ ID NO: 381551 - RNA, 32 nt, Human
ccuggagcagaaaaauccugucuucauugcua

SEQ ID NO: 381552 - RNA, 32 nt, Human
ccuggagcagcccuccagaccuggguggaauu

SEQ ID NO: 381553 - RNA, 19 nt, Human
ccuggagcaggcagugugg

SEQ ID NO: 381554 - RNA, 18 nt, Human
ccuggagcaggggcgcag

SEQ ID NO: 381555 - RNA, 32 nt, Human
ccuggagcaggggcgcaggaauucugauguga

SEQ ID NO: 381556 - RNA, 32 nt, Human
ccuggagcagguggucagcuguggugggcugc

SEQ ID NO: 381557 - RNA, 32 nt, Human
ccuggagcaguaugagcagaugcugaagacca

SEQ ID NO: 381558 - RNA, 32 nt, Human
ccuggagcaguaugcgcagaugcugagaccaa

SEQ ID NO: 381559 - RNA, 32 nt, Human
ccuggagcagugggcaagacaguccuuguggc

SEQ ID NO: 381560 - RNA, 32 nt, Human
ccuggagcaguuuugugaggcuuuugugcucc

SEQ ID NO: 381561 - RNA, 32 nt, Human
ccuggagcauccagccgcuggagcugcgaggg

SEQ ID NO: 381562 - RNA, 32 nt, Human
ccuggagcaucucgcccaggcuuuuuauaccu

SEQ ID NO: 381563 - RNA, 21 nt, Human
ccuggagcauggacagugugg

SEQ ID NO: 381564 - RNA, 32 nt, Human
ccuggagcaugugagcagcggcuggucucuuc

SEQ ID NO: 381565 - RNA, 32 nt, Human
ccuggagccaaccuggagaugcagccugagaa

SEQ ID NO: 381566 - RNA, 32 nt, Human
ccuggagccacuggucggccuggagucccugc

SEQ ID NO: 381567 - RNA, 32 nt, Human
ccuggagccagcaccccugccuccugguccug

SEQ ID NO: 381568 - RNA, 23 nt, Human
ccuggagccagcccuaucuggca

SEQ ID NO: 381569 - RNA, 32 nt, Human
ccuggagccagcccuaucuggcaguccugcuu

SEQ ID NO: 381570 - RNA, 32 nt, Human
ccuggagccagcugcuggggucccucagccuc

SEQ ID NO: 381571 - RNA, 18 nt, Human
ccuggagccaggaguggg

SEQ ID NO: 381572 - RNA, 21 nt, Human
ccuggagcccaggcucuuuuc

SEQ ID NO: 381573 - RNA, 32 nt, Human
ccuggagcccagguugcagguggugagcugcu

SEQ ID NO: 381574 - RNA, 32 nt, Human
ccuggagccccacuccagcccugggacaacuu

SEQ ID NO: 381575 - RNA, 24 nt, Human
ccuggagccucacgcugcucugca

SEQ ID NO: 381576 - RNA, 32 nt, Human
ccuggagccuccacugccucuggaauugcuca

SEQ ID NO: 381577 - RNA, 32 nt, Human
ccuggagccucuggaggaagaggagggacaaa

SEQ ID NO: 381578 - RNA, 32 nt, Human
ccuggagccugccugcagcccgaggucccacu

SEQ ID NO: 381579 - RNA, 32 nt, Human
ccuggagccuggaagggggagacggcccgagc

SEQ ID NO: 381580 - RNA, 32 nt, Human
ccuggagccuuucaaagaaggucuaagguaga

SEQ ID NO: 381581 - RNA, 32 nt, Human
ccuggagcuacaccuuucuuuguaaaacugua

SEQ ID NO: 381582 - RNA, 32 nt, Human
ccuggagcuaucuccaucuucagcuccagagu

SEQ ID NO: 381583 - RNA, 32 nt, Human
ccuggagcucacugagcuccuugccucccaca

SEQ ID NO: 381584 - RNA, 32 nt, Human
ccuggagcucaggaggccgaggcugccuugag

SEQ ID NO: 381585 - RNA, 32 nt, Human
ccuggagcucagugucaggaaagggggugaua

SEQ ID NO: 381586 - RNA, 31 nt, Human
ccuggagcuccaaccucagccagcaccagcg

SEQ ID NO: 381587 - RNA, 22 nt, Human
ccuggagcucuggaaagaccag

SEQ ID NO: 381588 - RNA, 26 nt, Human
ccuggagcugacaugauaaggucaaa

SEQ ID NO: 381589 - RNA, 32 nt, Human
ccuggagcugagugccuggggguccagaagcu

SEQ ID NO: 381590 - RNA, 21 nt, Human
ccuggagcugccgccgucucu

SEQ ID NO: 381591 - RNA, 32 nt, Human
ccuggagcuggacuccagcgaugaggagggcc

SEQ ID NO: 381592 - RNA, 32 nt, Human
ccuggagcugguguuuuuccugccuaggcgga

SEQ ID NO: 381593 - RNA, 32 nt, Human
ccuggagcugugccucagugaaggggcccagc

SEQ ID NO: 381594 - RNA, 32 nt, Human
ccuggagcugugcuguggcuugaggagauccg

SEQ ID NO: 381595 - RNA, 32 nt, Human
ccuggagcuguggccuggcuguggagggccgg

SEQ ID NO: 381596 - RNA, 32 nt, Human
ccuggagcuguucaccagccagggcucagccc

SEQ ID NO: 381597 - RNA, 32 nt, Human
ccuggagcuugccagagcagagcgagaaaguc

SEQ ID NO: 381598 - RNA, 32 nt, Human
ccuggaggaagaggaagaggaacccaagagga

SEQ ID NO: 381599 - RNA, 32 nt, Human
ccuggaggaagaggaggaggaggaggaggaag

SEQ ID NO: 381600 - RNA, 21 nt, Human
ccuggaggaaggggccaggcc

SEQ ID NO: 381601 - RNA, 22 nt, Human
ccuggaggacacgccuguagca

SEQ ID NO: 381602 - RNA, 18 nt, Human
ccuggaggacagcaccgg

SEQ ID NO: 381603 - RNA, 20 nt, Human
ccuggaggacagcagcaugg

SEQ ID NO: 381604 - RNA, 23 nt, Human
ccuggaggacagcagugcuggca

SEQ ID NO: 381605 - RNA, 32 nt, Human
ccuggaggacaggagucccaggagaacccaga

SEQ ID NO: 381606 - RNA, 21 nt, Human
ccuggaggacuggcccaggca

SEQ ID NO: 381607 - RNA, 21 nt, Human
ccuggaggagaaggaggaacc

SEQ ID NO: 381608 - RNA, 32 nt, Human
ccuggaggagagaaggauggacuccagagccc

SEQ ID NO: 381609 - RNA, 24 nt, Human
ccuggaggagaugaauccugggcc

SEQ ID NO: 381610 - RNA, 24 nt, Human
ccuggaggaggcagccugucagcu

SEQ ID NO: 381611 - RNA, 23 nt, Human
ccuggaggaggcaggcccaagcc

SEQ ID NO: 381612 - RNA, 21 nt, Human
ccuggaggagggaguccggcc

SEQ ID NO: 381613 - RNA, 32 nt, Human
ccuggaggagguggagcugcagcugggacugu

SEQ ID NO: 381614 - RNA, 19 nt, Human
ccuggaggagguggugcag

SEQ ID NO: 381615 - RNA, 32 nt, Human
ccuggaggaguccaggucugaauggucagaag

SEQ ID NO: 381616 - RNA, 32 nt, Human
ccuggaggaguggacccaggagaccagaagag

SEQ ID NO: 381617 - RNA, 23 nt, Human
ccuggaggaguuccgucccagcc

SEQ ID NO: 381618 - RNA, 24 nt, Human
ccuggaggaguucucugcucagca

SEQ ID NO: 381619 - RNA, 19 nt, Human
ccuggaggaucacugagca

SEQ ID NO: 381620 - RNA, 22 nt, Human
ccuggaggauggggacuuggca

SEQ ID NO: 381621 - RNA, 18 nt, Human
ccuggaggcaacgugcug

SEQ ID NO: 381622 - RNA, 32 nt, Human
ccuggaggcacugggcccugagaacgggugcc

SEQ ID NO: 381623 - RNA, 23 nt, Human
ccuggaggcagagauugcaguga

SEQ ID NO: 381624 - RNA, 24 nt, Human
ccuggaggcagagauugcagugag

SEQ ID NO: 381625 - RNA, 24 nt, Human
ccuggaggcagagcuugcagugag

SEQ ID NO: 381626 - RNA, 24 nt, Human
ccuggaggcagagguugcaaugag

SEQ ID NO: 381627 - RNA, 23 nt, Human
ccuggaggcagagguugcaguga

SEQ ID NO: 381628 - RNA, 24 nt, Human
ccuggaggcagagguugcagugag

SEQ ID NO: 381629 - RNA, 32 nt, Human
ccuggaggcagccugcagccccaucccaucuc

SEQ ID NO: 381630 - RNA, 32 nt, Human
ccuggaggcaggcugucucucaagguggucuu

SEQ ID NO: 381631 - RNA, 32 nt, Human
ccuggaggccacccuggaggaggcaggcccaa

SEQ ID NO: 381632 - RNA, 32 nt, Human
ccuggaggccacggggacagagaggccagaga

SEQ ID NO: 381633 - RNA, 32 nt, Human
ccuggaggccagagugagacuccgucucaaaa

SEQ ID NO: 381634 - RNA, 32 nt, Human
ccuggaggccaggaguucgacacuguauaaca

SEQ ID NO: 381635 - RNA, 32 nt, Human
ccuggaggccauuugugccugccucugugcug

SEQ ID NO: 381636 - RNA, 32 nt, Human
ccuggaggcccagguugggagucagucgagga

SEQ ID NO: 381637 - RNA, 32 nt, Human
ccuggaggcccugcucccaaaaccgcuggaag

SEQ ID NO: 381638 - RNA, 22 nt, Human
ccuggaggcggaaguugcagug

SEQ ID NO: 381639 - RNA, 24 nt, Human
ccuggaggcggaaguugcagugag

SEQ ID NO: 381640 - RNA, 22 nt, Human
ccuggaggcggagguugcagug

SEQ ID NO: 381641 - RNA, 24 nt, Human
ccuggaggcggagguugcagugag

SEQ ID NO: 381642 - RNA, 24 nt, Human
ccuggaggcggagguugccgugag

SEQ ID NO: 381643 - RNA, 23 nt, Human
ccuggaggcgggccccccuggca

SEQ ID NO: 381644 - RNA, 32 nt, Human
ccuggaggcgguggcugggauaaacgugcacc

SEQ ID NO: 381645 - RNA, 32 nt, Human
ccuggaggcugaggcagaagaaucacuugaac

SEQ ID NO: 381646 - RNA, 32 nt, Human
ccuggaggcugcagaggggguggaggacucuc

SEQ ID NO: 381647 - RNA, 32 nt, Human
ccuggaggcugcaguccgcgcggccggggagg

SEQ ID NO: 381648 - RNA, 32 nt, Human
ccuggaggcugugagagaugaggcaugacuac

SEQ ID NO: 381649 - RNA, 32 nt, Human
ccuggagggaaaggccgaggccgggagcgccc

SEQ ID NO: 381650 - RNA, 21 nt, Human
ccuggagggaacauucuggca

SEQ ID NO: 381651 - RNA, 32 nt, Human
ccuggagggaagccuccuaaggccagguaagg

SEQ ID NO: 381652 - RNA, 22 nt, Human
ccuggagggaagggcucuggcc

SEQ ID NO: 381653 - RNA, 23 nt, Human
ccuggagggaaguugccgcagcc

SEQ ID NO: 381654 - RNA, 24 nt, Human
ccuggagggaaguugccugcagcc

SEQ ID NO: 381655 - RNA, 23 nt, Human
ccuggagggaauccauaucagcu

SEQ ID NO: 381656 - RNA, 32 nt, Human
ccuggagggaaugaaccuggagggcuagaacc

SEQ ID NO: 381657 - RNA, 32 nt, Human
ccuggagggagaaaggagccugugcccccuga

SEQ ID NO: 381658 - RNA, 23 nt, Human
ccuggagggagaggccccacgcc

SEQ ID NO: 381659 - RNA, 21 nt, Human
ccuggagggagcagcguuggc

SEQ ID NO: 381660 - RNA, 21 nt, Human
ccuggagggagcuggguggcc

SEQ ID NO: 381661 - RNA, 21 nt, Human
ccuggagggagguccccugcc

SEQ ID NO: 381662 - RNA, 32 nt, Human
ccuggagggaguuguagccacuuugaggucug

SEQ ID NO: 381663 - RNA, 18 nt, Human
ccuggagggcagcaaugg

SEQ ID NO: 381664 - RNA, 32 nt, Human
ccuggagggcagcaauggaccauacacguguc

SEQ ID NO: 381665 - RNA, 24 nt, Human
ccuggagggcagggcugccugaug

SEQ ID NO: 381666 - RNA, 20 nt, Human
ccuggagggccugcuggcug

SEQ ID NO: 381667 - RNA, 26 nt, Human
ccuggagggccuucagcuccucaguc

SEQ ID NO: 381668 - RNA, 32 nt, Human
ccuggagggcuagaaccuggagaaugagaaaa

SEQ ID NO: 381669 - RNA, 32 nt, Human
ccuggagggcugccugggggaggcagacaugg

SEQ ID NO: 381670 - RNA, 23 nt, Human
ccuggaggggaaggacccugacc

SEQ ID NO: 381671 - RNA, 32 nt, Human
ccuggaggggacaucagggaagaggcuuccgg

SEQ ID NO: 381672 - RNA, 20 nt, Human
ccuggaggggagacugcaga

SEQ ID NO: 381673 - RNA, 24 nt, Human
ccuggagggggcagaggccaggcc

SEQ ID NO: 381674 - RNA, 23 nt, Human
ccuggagggggccugccucggcc

SEQ ID NO: 381675 - RNA, 32 nt, Human
ccuggaggggugagccacugucgggaggggag

SEQ ID NO: 381676 - RNA, 24 nt, Human
ccuggaggggugugcacgcuggca

SEQ ID NO: 381677 - RNA, 24 nt, Human
ccuggaggguggaaguuguaguga

SEQ ID NO: 381678 - RNA, 32 nt, Human
ccuggagguagaagugcucuuuuagcauuuuu

SEQ ID NO: 381679 - RNA, 24 nt, Human
ccuggagguagaaguugcagugag

SEQ ID NO: 381680 - RNA, 23 nt, Human
ccuggaggucaaggcugcaguga

SEQ ID NO: 381681 - RNA, 32 nt, Human
ccuggaggugaagggaagagccugugccugcu

SEQ ID NO: 381682 - RNA, 26 nt, Human
ccuggaggugaccuggagggagacag

SEQ ID NO: 381683 - RNA, 32 nt, Human
ccuggagguggaccccaauauccaggccaugc

SEQ ID NO: 381684 - RNA, 32 nt, Human
ccuggagguggaccccaauauccaggcugugc

SEQ ID NO: 381685 - RNA, 22 nt, Human
ccuggagguggagguugcagug

SEQ ID NO: 381686 - RNA, 23 nt, Human
ccuggagguggagguugcaguga

SEQ ID NO: 381687 - RNA, 24 nt, Human
ccuggagguggagguugcagugag

SEQ ID NO: 381688 - RNA, 19 nt, Human
ccuggaggugggagggcag

SEQ ID NO: 381689 - RNA, 32 nt, Human
ccuggagguguaguggagagcaguggaaaugc

SEQ ID NO: 381690 - RNA, 32 nt, Human
ccuggaggugugaggugcuguaucccggaaau

SEQ ID NO: 381691 - RNA, 23 nt, Human
ccuggagguugagguugcaguga

SEQ ID NO: 381692 - RNA, 32 nt, Human
ccuggaguaggcaguuugggggcgguagaggg

SEQ ID NO: 381693 - RNA, 18 nt, Human
ccuggaguagggggccag

SEQ ID NO: 381694 - RNA, 32 nt, Human
ccuggagucccagcuacucaggaggcugaggu

SEQ ID NO: 381695 - RNA, 32 nt, Human
ccuggagucccagcuacuccggaggcugaggg

SEQ ID NO: 381696 - RNA, 23 nt, Human
ccuggagucccagcuacucggga

SEQ ID NO: 381697 - RNA, 32 nt, Human
ccuggagucccagcuacucgggaggcugaggc

SEQ ID NO: 381698 - RNA, 32 nt, Human
ccuggagucccuggcccgggcagcagcgcuag

SEQ ID NO: 381699 - RNA, 32 nt, Human
ccuggagucuaugcuaggaagcugagauauuu

SEQ ID NO: 381700 - RNA, 24 nt, Human
ccuggagucugcccccacuucccu

SEQ ID NO: 381701 - RNA, 32 nt, Human
ccuggagucuguuucuuuaggcggaugaacug

SEQ ID NO: 381702 - RNA, 32 nt, Human
ccuggagucuugaggcccauugagugcagugu

SEQ ID NO: 381703 - RNA, 32 nt, Human
ccuggagugaagagguagaacugugguauuau

SEQ ID NO: 381704 - RNA, 32 nt, Human
ccuggagugcagaagaagcauuaggcauugac

SEQ ID NO: 381705 - RNA, 17 nt, Human
ccuggagugccccgaga

SEQ ID NO: 381706 - RNA, 32 nt, Human
ccuggagugccuggcccggagugccugcuggu

SEQ ID NO: 381707 - RNA, 32 nt, Human
ccuggaguggacugcagguggcaggggcuccu

SEQ ID NO: 381708 - RNA, 19 nt, Human
ccuggaguggcccaguacc

SEQ ID NO: 381709 - RNA, 32 nt, Human
ccuggaguggccggcccugcuugugccaugug

SEQ ID NO: 381710 - RNA, 20 nt, Human
ccuggaguggcucacgggca

SEQ ID NO: 381711 - RNA, 32 nt, Human
ccuggagugggcccugugcaccucaccuggcg

SEQ ID NO: 381712 - RNA, 16 nt, Human
ccuggagugggggcgc

SEQ ID NO: 381713 - RNA, 32 nt, Human
ccuggagugugggaacaacagucucuccuguc

SEQ ID NO: 381714 - RNA, 32 nt, Human
ccuggaguucacagacauggguggcaaugugu

SEQ ID NO: 381715 - RNA, 21 nt, Human
ccuggaguucagugggugcag

SEQ ID NO: 381716 - RNA, 32 nt, Human
ccuggaguucccaaccauacuucuucugaccc

SEQ ID NO: 381717 - RNA, 32 nt, Human
ccuggaguugcauagguugaauaguugaauag

SEQ ID NO: 381718 - RNA, 32 nt, Human
ccuggaguuggccagucaccaccaccauccua

SEQ ID NO: 381719 - RNA, 32 nt, Human
ccuggaguuggcugugucuguguuugugacug

SEQ ID NO: 381720 - RNA, 26 nt, Human
ccuggaguuguugggcaaggaugcug

SEQ ID NO: 381721 - RNA, 20 nt, Human
ccuggaguuuacacucacca

SEQ ID NO: 381722 - RNA, 32 nt, Human
ccuggaguuucugagugugcagguguggaaua

SEQ ID NO: 381723 - RNA, 32 nt, Human
ccuggaguuugaguccagccugggugacauag

SEQ ID NO: 381724 - RNA, 32 nt, Human
ccuggauaaaaugacacccauuuuucuuagga

SEQ ID NO: 381725 - RNA, 32 nt, Human
ccuggauaacagagcgagacccugucucaaaa

SEQ ID NO: 381726 - RNA, 32 nt, Human
ccuggauacagccuuuuuaugacuuuuacuuc

SEQ ID NO: 381727 - RNA, 31 nt, Human
ccuggauacagcuagagagcaggacuucacc

SEQ ID NO: 381728 - RNA, 26 nt, Human
ccuggauagucgccgucaggcacuga

SEQ ID NO: 381729 - RNA, 32 nt, Human
ccuggauagugaggcccuggcugguccagggg

SEQ ID NO: 381730 - RNA, 32 nt, Human
ccuggauaucaccaccucauguuuccagaguc

SEQ ID NO: 381731 - RNA, 32 nt, Human
ccuggauaugaaccaguggcuucaagguacau

SEQ ID NO: 381732 - RNA, 32 nt, Human
ccuggauauuguuugcaccauccauugucccu

SEQ ID NO: 381733 - RNA, 32 nt, Human
ccuggaucaucucuccccaucacuugccuugg

SEQ ID NO: 381734 - RNA, 32 nt, Human
ccuggauccagaaccacuuuuauuuccaagag

SEQ ID NO: 381735 - RNA, 32 nt, Human
ccuggauccccagaccaaagagacacagucac

SEQ ID NO: 381736 - RNA, 32 nt, Human
ccuggaucccgcuccaccuucuagaagcuccc

SEQ ID NO: 381737 - RNA, 19 nt, Human
ccuggauccgcuccugccu

SEQ ID NO: 381738 - RNA, 32 nt, Human
ccuggauccggaguucgaggccagccugacca

SEQ ID NO: 381739 - RNA, 32 nt, Human
ccuggauccugccuccgccaggccggcugccu

SEQ ID NO: 381740 - RNA, 32 nt, Human
ccuggauccuggggccugggugggcuggggga

SEQ ID NO: 381741 - RNA, 22 nt, Human
ccuggauccuggucaggccgaa

SEQ ID NO: 381742 - RNA, 32 nt, Human
ccuggaucuauccaccuccccauguucauuau

SEQ ID NO: 381743 - RNA, 32 nt, Human
ccuggaucucaaacuuccugccuccagaauga

SEQ ID NO: 381744 - RNA, 32 nt, Human
ccuggaucucacuccaccuuucaaucaaagcu

SEQ ID NO: 381745 - RNA, 18 nt, Human
ccuggaucucagaugcua

SEQ ID NO: 381746 - RNA, 32 nt, Human
ccuggaucuccucccuuacccuccucugcugg

SEQ ID NO: 381747 - RNA, 32 nt, Human
ccuggaucugaggccuuucccuugccauagaa

SEQ ID NO: 381748 - RNA, 32 nt, Human
ccuggaucuggaguggagcugcucugagauuu

SEQ ID NO: 381749 - RNA, 32 nt, Human
ccuggaucuuauuccuguacuuccuagggaau

SEQ ID NO: 381750 - RNA, 32 nt, Human
ccuggaucuucccagggauucccucuacgcuc

SEQ ID NO: 381751 - RNA, 32 nt, Human
ccuggaucuugccucugcuccgacgccguucc

SEQ ID NO: 381752 - RNA, 32 nt, Human
ccuggaugaacugucuggaauuacauaaauau

SEQ ID NO: 381753 - RNA, 32 nt, Human
ccuggaugacaaagcaagacccugucucaaaa

SEQ ID NO: 381754 - RNA, 19 nt, Human
ccuggaugacagagcaaga

SEQ ID NO: 381755 - RNA, 32 nt, Human
ccuggaugacgguggcauucacagaccacagc

SEQ ID NO: 381756 - RNA, 32 nt, Human
ccuggaugacuguuacccugaggccuccacgg

SEQ ID NO: 381757 - RNA, 18 nt, Human
ccuggaugagggggccag

SEQ ID NO: 381758 - RNA, 25 nt, Human
ccuggaugaguuccgucggcgcugg

SEQ ID NO: 381759 - RNA, 22 nt, Human
ccuggaugccaaggagccccug

SEQ ID NO: 381760 - RNA, 32 nt, Human
ccuggaugcccaccccugcugccgccacuggc

SEQ ID NO: 381761 - RNA, 32 nt, Human
ccuggaugcugaggcacgagaaucacuugaac

SEQ ID NO: 381762 - RNA, 31 nt, Human
ccuggauggagaccugagcuggagaaggaga

SEQ ID NO: 381763 - RNA, 32 nt, Human
ccuggauggagcagguggaggugcagagggga

SEQ ID NO: 381764 - RNA, 32 nt, Human
ccuggauggagcuccagggcuggggaacgucc

SEQ ID NO: 381765 - RNA, 22 nt, Human
ccuggauggccgcuguccggca

SEQ ID NO: 381766 - RNA, 32 nt, Human
ccuggaugggagagagagggaggaguaaaacu

SEQ ID NO: 381767 - RNA, 32 nt, Human
ccuggauggggaggggguaggaggggcuacaa

SEQ ID NO: 381768 - RNA, 32 nt, Human
ccuggauggguaugcaccuguccccaccaccg

SEQ ID NO: 381769 - RNA, 32 nt, Human
ccuggauggucucgauuuucugaucuuaugau

SEQ ID NO: 381770 - RNA, 32 nt, Human
ccuggaugguggcccuuccagugacauggagg

SEQ ID NO: 381771 - RNA, 32 nt, Human
ccuggauguacuauccaaucugugaugacauu

SEQ ID NO: 381772 - RNA, 32 nt, Human
ccuggaugugggcuucccagccgcucacgguu

SEQ ID NO: 381773 - RNA, 24 nt, Human
ccuggauguucggggacccccaca

SEQ ID NO: 381774 - RNA, 32 nt, Human
ccuggauucauuuccugcccuuccucaguuua

SEQ ID NO: 381775 - RNA, 23 nt, Human
ccuggauuccccagcuacuugga

SEQ ID NO: 381776 - RNA, 19 nt, Human
ccuggauucccuguucuuu

SEQ ID NO: 381777 - RNA, 32 nt, Human
ccuggauucuggcaaaucuccgucuaguaaca

SEQ ID NO: 381778 - RNA, 24 nt, Human
ccuggauugagaaccaccacccga

SEQ ID NO: 381779 - RNA, 32 nt, Human
ccuggauugcuacuuuacccccaugaagcccg

SEQ ID NO: 381780 - RNA, 32 nt, Human
ccuggauuguugaggaaaaagccagacuaacc

SEQ ID NO: 381781 - RNA, 32 nt, Human
ccuggauuuccuucggagagagcuagauucua

SEQ ID NO: 381782 - RNA, 23 nt, Human
ccuggauuucucucacacugccu

SEQ ID NO: 381783 - RNA, 32 nt, Human
ccuggauuucuucuggacauuuccucaagaug

SEQ ID NO: 381784 - RNA, 32 nt, Human
ccuggauuugaaguuucgucugggcuugugcu

SEQ ID NO: 381785 - RNA, 32 nt, Human
ccuggauuuggaggcagaguugucaggcuuuu

SEQ ID NO: 381786 - RNA, 23 nt, Human
ccuggauuugggccauccugaua

SEQ ID NO: 381787 - RNA, 32 nt, Human
ccuggauuugugaaugacguacagguauucau

SEQ ID NO: 381788 - RNA, 32 nt, Human
ccuggauuuugcccucuccuuagcucuuaguc

SEQ ID NO: 381789 - RNA, 18 nt, Human
ccuggcaaaacauaugug

SEQ ID NO: 381790 - RNA, 21 nt, Human
ccuggcaaaauaaaacauguu

SEQ ID NO: 381791 - RNA, 19 nt, Human
ccuggcaaacauggugaaa

SEQ ID NO: 381792 - RNA, 32 nt, Human
ccuggcaaauccugccacuuguuuccacucuu

SEQ ID NO: 381793 - RNA, 23 nt, Human
ccuggcaacauggcaagacccug

SEQ ID NO: 381794 - RNA, 32 nt, Human
ccuggcaacauggcaagacccugccucuuuga

SEQ ID NO: 381795 - RNA, 32 nt, Human
ccuggcaacauugugagacccaucucuauaaa

SEQ ID NO: 381796 - RNA, 32 nt, Human
ccuggcaaccaccauccuacuuucuaucucug

SEQ ID NO: 381797 - RNA, 32 nt, Human
ccuggcaacugcuuaccagccuggcuggccgu

SEQ ID NO: 381798 - RNA, 32 nt, Human
ccuggcaagcuagaaccuggagggaaugaacc

SEQ ID NO: 381799 - RNA, 20 nt, Human
ccuggcaagcuccccacguc

SEQ ID NO: 381800 - RNA, 20 nt, Human
ccuggcaaggauccaauuuc

SEQ ID NO: 381801 - RNA, 18 nt, Human
ccuggcaaggggaggcag

SEQ ID NO: 381802 - RNA, 18 nt, Human
ccuggcaaggggggugca

SEQ ID NO: 381803 - RNA, 32 nt, Human
ccuggcacaagaagaucuacaucuuccaggga

SEQ ID NO: 381804 - RNA, 32 nt, Human
ccuggcacaccauacuagaauucacacuggag

SEQ ID NO: 381805 - RNA, 32 nt, Human
ccuggcacacccuucacgguugcuacccaggc

SEQ ID NO: 381806 - RNA, 32 nt, Human
ccuggcacacgggccaagguacccacaggauc

SEQ ID NO: 381807 - RNA, 32 nt, Human
ccuggcacagacucacccuucuuucuggcacc

SEQ ID NO: 381808 - RNA, 32 nt, Human
ccuggcacagccgccuggaaugcaggacuguc

SEQ ID NO: 381809 - RNA, 18 nt, Human
ccuggcacagcggggcgu

SEQ ID NO: 381810 - RNA, 32 nt, Human
ccuggcacagggaggagcagcucuguaaaucu

SEQ ID NO: 381811 - RNA, 32 nt, Human
ccuggcacaguccguccugucggacacagagc

SEQ ID NO: 381812 - RNA, 32 nt, Human
ccuggcacaguggcucaugccuguaaucucaa

SEQ ID NO: 381813 - RNA, 20 nt, Human
ccuggcaccagcccagggug

SEQ ID NO: 381814 - RNA, 20 nt, Human
ccuggcacccacugcccgug

SEQ ID NO: 381815 - RNA, 32 nt, Human
ccuggcacccagagaaaaggagcauccuuacc

SEQ ID NO: 381816 - RNA, 32 nt, Human
ccuggcaccuagcaaggcacaccaagaacagc

SEQ ID NO: 381817 - RNA, 32 nt, Human
ccuggcacgccggucugugccugcccgccccg

SEQ ID NO: 381818 - RNA, 32 nt, Human
ccuggcacgggcucagcccaggaagaggagaa

SEQ ID NO: 381819 - RNA, 32 nt, Human
ccuggcacguggccaccaucaugucuaggccu

SEQ ID NO: 381820 - RNA, 32 nt, Human
ccuggcacgugugccacuugcccagcuucuug

SEQ ID NO: 381821 - RNA, 32 nt, Human
ccuggcacucaauccccgccaugugggggcuc

SEQ ID NO: 381822 - RNA, 22 nt, Human
ccuggcacuccagagggcgcgg

SEQ ID NO: 381823 - RNA, 20 nt, Human
ccuggcacugaggcccugac

SEQ ID NO: 381824 - RNA, 32 nt, Human
ccuggcacugccucagcauggccaugucauca

SEQ ID NO: 381825 - RNA, 32 nt, Human
ccuggcacugcuuccuccaccguuuucacagg

SEQ ID NO: 381826 - RNA, 32 nt, Human
ccuggcacuggcagcauucaguggggaccccc

SEQ ID NO: 381827 - RNA, 32 nt, Human
ccuggcacugguuuguucccugugucauuuca

SEQ ID NO: 381828 - RNA, 20 nt, Human
ccuggcagaaagauggccag

SEQ ID NO: 381829 - RNA, 32 nt, Human
ccuggcagaagaacccacauaaggaagugucc

SEQ ID NO: 381830 - RNA, 20 nt, Human
ccuggcagaagaagcgguag

SEQ ID NO: 381831 - RNA, 20 nt, Human
ccuggcagaagaucaugcag

SEQ ID NO: 381832 - RNA, 20 nt, Human
ccuggcagaagggagcagca

SEQ ID NO: 381833 - RNA, 19 nt, Human
ccuggcagaaggggcacgg

SEQ ID NO: 381834 - RNA, 18 nt, Human
ccuggcagaaguuugcag

SEQ ID NO: 381835 - RNA, 32 nt, Human
ccuggcagaaucuugacccagggaaagggaag

SEQ ID NO: 381836 - RNA, 23 nt, Human
ccuggcagacaggcagggcucug

SEQ ID NO: 381837 - RNA, 32 nt, Human
ccuggcagaccccagaccgagcagaggcgacc

SEQ ID NO: 381838 - RNA, 32 nt, Human
ccuggcagaccccagagucaggccugcuguua

SEQ ID NO: 381839 - RNA, 20 nt, Human
ccuggcagacgguggcguag

SEQ ID NO: 381840 - RNA, 30 nt, Human
ccuggcagagaacgacgcaaggcuccagca

SEQ ID NO: 381841 - RNA, 32 nt, Human
ccuggcagagaacgacgcaaggcuccagcagg

SEQ ID NO: 381842 - RNA, 19 nt, Human
ccuggcagagaugggggcg

SEQ ID NO: 381843 - RNA, 32 nt, Human
ccuggcagagcagaaaaggcaguugaaggagg

SEQ ID NO: 381844 - RNA, 20 nt, Human
ccuggcagagcagggcguag

SEQ ID NO: 381845 - RNA, 20 nt, Human
ccuggcagagccaguugcag

SEQ ID NO: 381846 - RNA, 20 nt, Human
ccuggcagagccuggugugg

SEQ ID NO: 381847 - RNA, 17 nt, Human
ccuggcagagcgcgcag

SEQ ID NO: 381848 - RNA, 17 nt, Human
ccuggcagaggagccca

SEQ ID NO: 381849 - RNA, 18 nt, Human
ccuggcagaggaggagca

SEQ ID NO: 381850 - RNA, 20 nt, Human
ccuggcagaggccccgacag

SEQ ID NO: 381851 - RNA, 18 nt, Human
ccuggcagagggagcaca

SEQ ID NO: 381852 - RNA, 24 nt, Human
ccuggcagagggagguugcaguga

SEQ ID NO: 381853 - RNA, 19 nt, Human
ccuggcagagggugccgca

SEQ ID NO: 381854 - RNA, 18 nt, Human
ccuggcagagguggccag

SEQ ID NO: 381855 - RNA, 19 nt, Human
ccuggcagaguagggguag

SEQ ID NO: 381856 - RNA, 32 nt, Human
ccuggcagaguccugugccacccucucacagg

SEQ ID NO: 381857 - RNA, 20 nt, Human
ccuggcagcagcaggagcag

SEQ ID NO: 381858 - RNA, 20 nt, Human
ccuggcagcagcaggugugg

SEQ ID NO: 381859 - RNA, 20 nt, Human
ccuggcagcaggaggcccag

SEQ ID NO: 381860 - RNA, 32 nt, Human
ccuggcagccacacccucaguaaucccgcaca

SEQ ID NO: 381861 - RNA, 32 nt, Human
ccuggcagccaucugcuuuaccagucucauuu

SEQ ID NO: 381862 - RNA, 19 nt, Human
ccuggcagcccggagcccc

SEQ ID NO: 381863 - RNA, 18 nt, Human
ccuggcagccggguccag

SEQ ID NO: 381864 - RNA, 32 nt, Human
ccuggcagccuccugcaucauccucgucuuca

SEQ ID NO: 381865 - RNA, 32 nt, Human
ccuggcagccucuuccuggcuagggggccaga

SEQ ID NO: 381866 - RNA, 21 nt, Human
ccuggcagccuggcucccucu

SEQ ID NO: 381867 - RNA, 19 nt, Human
ccuggcagcggaggagcag

SEQ ID NO: 381868 - RNA, 17 nt, Human
ccuggcagcggcggcgc

SEQ ID NO: 381869 - RNA, 25 nt, Human
ccuggcagcugugcuuguccguuuc

SEQ ID NO: 381870 - RNA, 24 nt, Human
ccuggcaggaaagagggggugcgg

SEQ ID NO: 381871 - RNA, 32 nt, Human
ccuggcaggaacagauuccaguccugcuuacu

SEQ ID NO: 381872 - RNA, 20 nt, Human
ccuggcaggaaccuucgcag

SEQ ID NO: 381873 - RNA, 32 nt, Human
ccuggcaggaagcacacugcacagggagccug

SEQ ID NO: 381874 - RNA, 20 nt, Human
ccuggcaggaaggccggcca

SEQ ID NO: 381875 - RNA, 18 nt, Human
ccuggcaggaaugggcca

SEQ ID NO: 381876 - RNA, 20 nt, Human
ccuggcaggaccucugccgg

SEQ ID NO: 381877 - RNA, 19 nt, Human
ccuggcaggaccuguggag

SEQ ID NO: 381878 - RNA, 32 nt, Human
ccuggcaggagaaaggagggugguuuccgugg

SEQ ID NO: 381879 - RNA, 20 nt, Human
ccuggcaggagaaccuggag

SEQ ID NO: 381880 - RNA, 18 nt, Human
ccuggcaggagagcgcgg

SEQ ID NO: 381881 - RNA, 19 nt, Human
ccuggcaggagcaggacag

SEQ ID NO: 381882 - RNA, 20 nt, Human
ccuggcaggaggaccuggag

SEQ ID NO: 381883 - RNA, 20 nt, Human
ccuggcaggaggagcggcgu

SEQ ID NO: 381884 - RNA, 19 nt, Human
ccuggcaggaggccaccgu

SEQ ID NO: 381885 - RNA, 19 nt, Human
ccuggcaggaggcgggugu

SEQ ID NO: 381886 - RNA, 32 nt, Human
ccuggcaggaggcgggugugugaauagcauau

SEQ ID NO: 381887 - RNA, 20 nt, Human
ccuggcaggaggcuggugua

SEQ ID NO: 381888 - RNA, 18 nt, Human
ccuggcaggaggguuggc

SEQ ID NO: 381889 - RNA, 18 nt, Human
ccuggcaggaggugggug

SEQ ID NO: 381890 - RNA, 17 nt, Human
ccuggcaggagguguag

SEQ ID NO: 381891 - RNA, 19 nt, Human
ccuggcaggagugggcagc

SEQ ID NO: 381892 - RNA, 18 nt, Human
ccuggcaggagugugugg

SEQ ID NO: 381893 - RNA, 18 nt, Human
ccuggcaggaucugccgg

SEQ ID NO: 381894 - RNA, 20 nt, Human
ccuggcaggaugagccgcgg

SEQ ID NO: 381895 - RNA, 32 nt, Human
ccuggcaggauggcgccaccaccagcuagagu

SEQ ID NO: 381896 - RNA, 18 nt, Human
ccuggcaggcagaagcag

SEQ ID NO: 381897 - RNA, 24 nt, Human
ccuggcaggcagagguugcaguga

SEQ ID NO: 381898 - RNA, 32 nt, Human
ccuggcaggcagagguugcagugagccaagau

SEQ ID NO: 381899 - RNA, 32 nt, Human
ccuggcaggccagcaacaugugccccagaucu

SEQ ID NO: 381900 - RNA, 23 nt, Human
ccuggcaggcggagguugcagug

SEQ ID NO: 381901 - RNA, 32 nt, Human
ccuggcaggcggagguugcagugagccgagau

SEQ ID NO: 381902 - RNA, 19 nt, Human
ccuggcaggcggcgcgcgg

SEQ ID NO: 381903 - RNA, 32 nt, Human
ccuggcaggcuggagggcaggagcuggggcca

SEQ ID NO: 381904 - RNA, 18 nt, Human
ccuggcagggacggccgg

SEQ ID NO: 381905 - RNA, 20 nt, Human
ccuggcagggacggguggag

SEQ ID NO: 381906 - RNA, 18 nt, Human
ccuggcagggagaaggcg

SEQ ID NO: 381907 - RNA, 22 nt, Human
ccuggcagggagccuggugggg

SEQ ID NO: 381908 - RNA, 32 nt, Human
ccuggcagggcagauccaggggcaguucucug

SEQ ID NO: 381909 - RNA, 20 nt, Human
ccuggcagggccaccugcag

SEQ ID NO: 381910 - RNA, 32 nt, Human
ccuggcagggccuggagaagucuggaggcuuu

SEQ ID NO: 381911 - RNA, 19 nt, Human
ccuggcagggcucgcccgg

SEQ ID NO: 381912 - RNA, 32 nt, Human
ccuggcagggcugagcacacgcuaggccucag

SEQ ID NO: 381913 - RNA, 16 nt, Human
ccuggcaggggagcgc

SEQ ID NO: 381914 - RNA, 18 nt, Human
ccuggcaggggagggggg

SEQ ID NO: 381915 - RNA, 18 nt, Human
ccuggcaggggaguccag

SEQ ID NO: 381916 - RNA, 20 nt, Human
ccuggcagggggccucgcgg

SEQ ID NO: 381917 - RNA, 20 nt, Human
ccuggcagggggccucgggc

SEQ ID NO: 381918 - RNA, 32 nt, Human
ccuggcaggguggccagagaggcuuggacaag

SEQ ID NO: 381919 - RNA, 32 nt, Human
ccuggcaggucacuugcuugugguguuuucgu

SEQ ID NO: 381920 - RNA, 19 nt, Human
ccuggcaggucugggcgca

SEQ ID NO: 381921 - RNA, 24 nt, Human
ccuggcagguggagguuacaguga

SEQ ID NO: 381922 - RNA, 32 nt, Human
ccuggcagguggagguuacagugagccaagau

SEQ ID NO: 381923 - RNA, 32 nt, Human
ccuggcagguggagguugcagugaguggagau

SEQ ID NO: 381924 - RNA, 18 nt, Human
ccuggcagguggggccag

SEQ ID NO: 381925 - RNA, 21 nt, Human
ccuggcaggugggggcagcag

SEQ ID NO: 381926 - RNA, 32 nt, Human
ccuggcaggugugggagggaagcccauggcca

SEQ ID NO: 381927 - RNA, 20 nt, Human
ccuggcaguacuugggucgg

SEQ ID NO: 381928 - RNA, 18 nt, Human
ccuggcagucagaggcgc

SEQ ID NO: 381929 - RNA, 32 nt, Human
ccuggcagucccggaagacaccaggaaaacaa

SEQ ID NO: 381930 - RNA, 32 nt, Human
ccuggcagucuggcugcugcagaagaguuuuu

SEQ ID NO: 381931 - RNA, 20 nt, Human
ccuggcagugagaggugugg

SEQ ID NO: 381932 - RNA, 18 nt, Human
ccuggcagugcacuggua

SEQ ID NO: 381933 - RNA, 32 nt, Human
ccuggcaguugaaaucucuggaagagggaaca

SEQ ID NO: 381934 - RNA, 18 nt, Human
ccuggcaguuggcugcag

SEQ ID NO: 381935 - RNA, 32 nt, Human
ccuggcauaacugaggcaggagcuggccgggc

SEQ ID NO: 381936 - RNA, 32 nt, Human
ccuggcauccacccucuacuuucugucucucu

SEQ ID NO: 381937 - RNA, 32 nt, Human
ccuggcauccacccuucuagcuuucugucucu

SEQ ID NO: 381938 - RNA, 22 nt, Human
ccuggcauccagacagccccug

SEQ ID NO: 381939 - RNA, 32 nt, Human
ccuggcaucccagcuacuccaggggcugaggu

SEQ ID NO: 381940 - RNA, 32 nt, Human
ccuggcaucccucuaacccaggaggagcgugg

SEQ ID NO: 381941 - RNA, 21 nt, Human
ccuggcauccgcugggggcgc

SEQ ID NO: 381942 - RNA, 32 nt, Human
ccuggcaucucuccacucccagaguccacucc

SEQ ID NO: 381943 - RNA, 32 nt, Human
ccuggcaucugggcuccugaucagcugaugga

SEQ ID NO: 381944 - RNA, 32 nt, Human
ccuggcaucugucuccccuuguuccugagugg

SEQ ID NO: 381945 - RNA, 32 nt, Human
ccuggcaucuuccuguucuaccuccucauuca

SEQ ID NO: 381946 - RNA, 32 nt, Human
ccuggcaugaaccuggccucccggggagcuga

SEQ ID NO: 381947 - RNA, 20 nt, Human
ccuggcaugaggagugggug

SEQ ID NO: 381948 - RNA, 32 nt, Human
ccuggcauggcggcucacgccuguaaucccag

SEQ ID NO: 381949 - RNA, 32 nt, Human
ccuggcaugggcagauuccagccuuugggcug

SEQ ID NO: 381950 - RNA, 18 nt, Human
ccuggcaugggggcgcag

SEQ ID NO: 381951 - RNA, 32 nt, Human
ccuggcaugguggcaugcaccuguaaucccaa

SEQ ID NO: 381952 - RNA, 32 nt, Human
ccuggcauggugguguacgccuguaaucccag

SEQ ID NO: 381953 - RNA, 32 nt, Human
ccuggcaugugccaguuauagacuguccagca

SEQ ID NO: 381954 - RNA, 25 nt, Human
ccuggcaugugccuucauguaguag

SEQ ID NO: 381955 - RNA, 23 nt, Human
ccuggcaugugguaggagcucag

SEQ ID NO: 381956 - RNA, 32 nt, Human
ccuggcauucuguacauauauguauuacauuu

SEQ ID NO: 381957 - RNA, 32 nt, Human
ccuggcauugaccaacauagguggugagccug

SEQ ID NO: 381958 - RNA, 32 nt, Human
ccuggccaaauggugaaaccccaucucuacga

SEQ ID NO: 381959 - RNA, 32 nt, Human
ccuggccaacacaguaaacccugucuccacaa

SEQ ID NO: 381960 - RNA, 32 nt, Human
ccuggccaacacagugagacccugucucuacu

SEQ ID NO: 381961 - RNA, 19 nt, Human
ccuggccaacacggugaaa

SEQ ID NO: 381962 - RNA, 24 nt, Human
ccuggccaacacggugaaacccca

SEQ ID NO: 381963 - RNA, 32 nt, Human
ccuggccaacacggugagacccugucuuuacu

SEQ ID NO: 381964 - RNA, 19 nt, Human
ccuggccaacauagugaaa

SEQ ID NO: 381965 - RNA, 24 nt, Human
ccuggccaacauagugaaacccca

SEQ ID NO: 381966 - RNA, 21 nt, Human
ccuggccaacaucucacugca

SEQ ID NO: 381967 - RNA, 32 nt, Human
ccuggccaacaugagguuucuccaucaagacg

SEQ ID NO: 381968 - RNA, 19 nt, Human
ccuggccaacaugaugaaa

SEQ ID NO: 381969 - RNA, 24 nt, Human
ccuggccaacaugaugaaacccca

SEQ ID NO: 381970 - RNA, 24 nt, Human
ccuggccaacauggagaaacccca

SEQ ID NO: 381971 - RNA, 32 nt, Human
ccuggccaacauggcaaaaccaucucuacuaa

SEQ ID NO: 381972 - RNA, 31 nt, Human
ccuggccaacauggcaaaacccugccucuac

SEQ ID NO: 381973 - RNA, 19 nt, Human
ccuggccaacauggcgaaa

SEQ ID NO: 381974 - RNA, 24 nt, Human
ccuggccaacauggcgaaacccca

SEQ ID NO: 381975 - RNA, 24 nt, Human
ccuggccaacauggcgaaauucca

SEQ ID NO: 381976 - RNA, 24 nt, Human
ccuggccaacauggcgagacccca

SEQ ID NO: 381977 - RNA, 19 nt, Human
ccuggccaacauggggaaa

SEQ ID NO: 381978 - RNA, 24 nt, Human
ccuggccaacaugguaaaacccca

SEQ ID NO: 381979 - RNA, 24 nt, Human
ccuggccaacaugguaaaacucca

SEQ ID NO: 381980 - RNA, 24 nt, Human
ccuggccaacauggucccagcugc

SEQ ID NO: 381981 - RNA, 19 nt, Human
ccuggccaacauggugaaa

SEQ ID NO: 381982 - RNA, 23 nt, Human
ccuggccaacauggugaaacacu

SEQ ID NO: 381983 - RNA, 24 nt, Human
ccuggccaacauggugaaacccca

SEQ ID NO: 381984 - RNA, 24 nt, Human
ccuggccaacauggugaaacccgc

SEQ ID NO: 381985 - RNA, 23 nt, Human
ccuggccaacauggugaaaccug

SEQ ID NO: 381986 - RNA, 22 nt, Human
ccuggccaacauggugaaacgc

SEQ ID NO: 381987 - RNA, 21 nt, Human
ccuggccaacauggugaaacu

SEQ ID NO: 381988 - RNA, 24 nt, Human
ccuggccaacauggugaaacucca

SEQ ID NO: 381989 - RNA, 24 nt, Human
ccuggccaacauggugaaacuccg

SEQ ID NO: 381990 - RNA, 19 nt, Human
ccuggccaacauggugaag

SEQ ID NO: 381991 - RNA, 24 nt, Human
ccuggccaacauggugaagcuccg

SEQ ID NO: 381992 - RNA, 20 nt, Human
ccuggccaacauggugacac

SEQ ID NO: 381993 - RNA, 20 nt, Human
ccuggccaacauggugagac

SEQ ID NO: 381994 - RNA, 24 nt, Human
ccuggccaacauggugagacccca

SEQ ID NO: 381995 - RNA, 32 nt, Human
ccuggccaacauggugagacccugucucugcu

SEQ ID NO: 381996 - RNA, 20 nt, Human
ccuggccaacauggugauac

SEQ ID NO: 381997 - RNA, 32 nt, Human
ccuggccaacaugugaaaccccgucuccacug

SEQ ID NO: 381998 - RNA, 19 nt, Human
ccuggccaacauguugaaa

SEQ ID NO: 381999 - RNA, 19 nt, Human
ccuggccaacauugugaaa

SEQ ID NO: 382000 - RNA, 32 nt, Human
ccuggccaaccaacauggugaaaccucguguc

SEQ ID NO: 382001 - RNA, 19 nt, Human
ccuggccaaccuggugaaa

SEQ ID NO: 382002 - RNA, 19 nt, Human
ccuggccaacguggugaaa

SEQ ID NO: 382003 - RNA, 18 nt, Human
ccuggccaagcagggugc

SEQ ID NO: 382004 - RNA, 32 nt, Human
ccuggccaagcccagcuuccgaagcaggaacc

SEQ ID NO: 382005 - RNA, 32 nt, Human
ccuggccaaggagagacagaagugccuccuuc

SEQ ID NO: 382006 - RNA, 32 nt, Human
ccuggccaaggaggacucgaggccugucccac

SEQ ID NO: 382007 - RNA, 23 nt, Human
ccuggccaauaugguaaacccca

SEQ ID NO: 382008 - RNA, 22 nt, Human
ccuggccaauauggucuuucug

SEQ ID NO: 382009 - RNA, 19 nt, Human
ccuggccaauauggugaaa

SEQ ID NO: 382010 - RNA, 20 nt, Human
ccuggccaauauggugaaac

SEQ ID NO: 382011 - RNA, 23 nt, Human
ccuggccaauauggugaaaccac

SEQ ID NO: 382012 - RNA, 24 nt, Human
ccuggccaauauggugaaacccca

SEQ ID NO: 382013 - RNA, 24 nt, Human
ccuggccaauauggugaaacuccg

SEQ ID NO: 382014 - RNA, 24 nt, Human
ccuggccaauauggugagacccca

SEQ ID NO: 382015 - RNA, 32 nt, Human
ccuggccaaucaggcgagacgccuuugugagc

SEQ ID NO: 382016 - RNA, 32 nt, Human
ccuggccacaaaccugcugcuguggguucugg

SEQ ID NO: 382017 - RNA, 32 nt, Human
ccuggccacaauagccucaucaacauggcugc

SEQ ID NO: 382018 - RNA, 21 nt, Human
ccuggccacagcucacccugg

SEQ ID NO: 382019 - RNA, 32 nt, Human
ccuggccacauccuuccccugaucucauggcu

SEQ ID NO: 382020 - RNA, 21 nt, Human
ccuggccacauggggcacugg

SEQ ID NO: 382021 - RNA, 32 nt, Human
ccuggccacauggugaaacccugucucuacua

SEQ ID NO: 382022 - RNA, 32 nt, Human
ccuggccaccucugugcuucuugugaagucuc

SEQ ID NO: 382023 - RNA, 23 nt, Human
ccuggccaccuuuaaagccccug

SEQ ID NO: 382024 - RNA, 32 nt, Human
ccuggccacgugugcgccaccuuacuuuggaa

SEQ ID NO: 382025 - RNA, 32 nt, Human
ccuggccacuaugccaguucugaccucgcauc

SEQ ID NO: 382026 - RNA, 22 nt, Human
ccuggccacucuagacauauga

SEQ ID NO: 382027 - RNA, 32 nt, Human
ccuggccacuggcccuguuucuccccacaccc

SEQ ID NO: 382028 - RNA, 22 nt, Human
ccuggccacuuaggagagcuga

SEQ ID NO: 382029 - RNA, 32 nt, Human
ccuggccagaacuugggggaggacacaaaucc

SEQ ID NO: 382030 - RNA, 32 nt, Human
ccuggccagaagcaggagugugaggaggagac

SEQ ID NO: 382031 - RNA, 32 nt, Human
ccuggccagaagcuggagggggcuuggccaaa

SEQ ID NO: 382032 - RNA, 26 nt, Human
ccuggccagaggccacugacagggug

SEQ ID NO: 382033 - RNA, 32 nt, Human
ccuggccagcacucggggaccucccugccccu

SEQ ID NO: 382034 - RNA, 25 nt, Human
ccuggccagcagaguggggcacugg

SEQ ID NO: 382035 - RNA, 19 nt, Human
ccuggccagcauggugaaa

SEQ ID NO: 382036 - RNA, 32 nt, Human
ccuggccagcccacccuccugcaaccucucac

SEQ ID NO: 382037 - RNA, 22 nt, Human
ccuggccagccuggggcacuga

SEQ ID NO: 382038 - RNA, 22 nt, Human
ccuggccagcggcgggcgcuga

SEQ ID NO: 382039 - RNA, 32 nt, Human
ccuggccagcucuucgccccucaccucuuuga

SEQ ID NO: 382040 - RNA, 19 nt, Human
ccuggccaggagggcccag

SEQ ID NO: 382041 - RNA, 32 nt, Human
ccuggccagggaaaucagaagcucuucuuggg

SEQ ID NO: 382042 - RNA, 32 nt, Human
ccuggccagguuguccucgaccagucccgugc

SEQ ID NO: 382043 - RNA, 32 nt, Human
ccuggccagucugccaccacccucucucuacc

SEQ ID NO: 382044 - RNA, 31 nt, Human
ccuggccaguuucacaaucuagcucgacaga

SEQ ID NO: 382045 - RNA, 23 nt, Human
ccuggccauccugugggcucuga

SEQ ID NO: 382046 - RNA, 32 nt, Human
ccuggccaucugccuccugucuucccaguacc

SEQ ID NO: 382047 - RNA, 32 nt, Human
ccuggccaugaccaccacauuucugcaaacuu

SEQ ID NO: 382048 - RNA, 32 nt, Human
ccuggccauugguauuuugaaaaaucccucca

SEQ ID NO: 382049 - RNA, 21 nt, Human
ccuggccauuuucuugccuga

SEQ ID NO: 382050 - RNA, 19 nt, Human
ccuggcccaaaccugcccc

SEQ ID NO: 382051 - RNA, 24 nt, Human
ccuggcccaaauggugaaacccug

SEQ ID NO: 382052 - RNA, 23 nt, Human
ccuggcccaacagaaaaacccug

SEQ ID NO: 382053 - RNA, 20 nt, Human
ccuggcccaagacaggggcc

SEQ ID NO: 382054 - RNA, 19 nt, Human
ccuggcccaaggugccacc

SEQ ID NO: 382055 - RNA, 32 nt, Human
ccuggcccaaguaggggauuccaugccuuccc

SEQ ID NO: 382056 - RNA, 22 nt, Human
ccuggcccacagcaggugcuga

SEQ ID NO: 382057 - RNA, 24 nt, Human
ccuggcccacauggugaaacccug

SEQ ID NO: 382058 - RNA, 20 nt, Human
ccuggcccaccggcgagccc

SEQ ID NO: 382059 - RNA, 32 nt, Human
ccuggcccaccucaucccuccagccugggauc

SEQ ID NO: 382060 - RNA, 24 nt, Human
ccuggcccacuccacaggccccug

SEQ ID NO: 382061 - RNA, 32 nt, Human
ccuggcccacugcaccuguccccacaggagcc

SEQ ID NO: 382062 - RNA, 32 nt, Human
ccuggcccacugcacugggaaucuaggauggg

SEQ ID NO: 382063 - RNA, 22 nt, Human
ccuggcccagaagaccagcccu

SEQ ID NO: 382064 - RNA, 22 nt, Human
ccuggcccagacugccagcccu

SEQ ID NO: 382065 - RNA, 32 nt, Human
ccuggcccagaggcuccugaagaugcugggcg

SEQ ID NO: 382066 - RNA, 32 nt, Human
ccuggcccagaucuucucaccuaggacuuuuu

SEQ ID NO: 382067 - RNA, 23 nt, Human
ccuggcccagccagagcccacug

SEQ ID NO: 382068 - RNA, 21 nt, Human
ccuggcccagcccccagcccc

SEQ ID NO: 382069 - RNA, 21 nt, Human
ccuggcccagccucagcaccc

SEQ ID NO: 382070 - RNA, 32 nt, Human
ccuggcccagccucagcacccagggccaguga

SEQ ID NO: 382071 - RNA, 22 nt, Human
ccuggcccagccugcaccccug

SEQ ID NO: 382072 - RNA, 19 nt, Human
ccuggcccagcuacuccuu

SEQ ID NO: 382073 - RNA, 32 nt, Human
ccuggcccagcucuggagugcaugugugugug

SEQ ID NO: 382074 - RNA, 21 nt, Human
ccuggcccaggaccccaccug

SEQ ID NO: 382075 - RNA, 20 nt, Human
ccuggcccaggaccucccug

SEQ ID NO: 382076 - RNA, 32 nt, Human
ccuggcccaggagcaggggcuuggaguggggc

SEQ ID NO: 382077 - RNA, 24 nt, Human
ccuggcccaggccucugcccucug

SEQ ID NO: 382078 - RNA, 21 nt, Human
ccuggcccagggaccccucac

SEQ ID NO: 382079 - RNA, 20 nt, Human
ccuggcccagggaggagccc

SEQ ID NO: 382080 - RNA, 32 nt, Human
ccuggcccaggucugggcagaugucuucacuu

SEQ ID NO: 382081 - RNA, 32 nt, Human
ccuggcccauaaagcccacuaguuggagagua

SEQ ID NO: 382082 - RNA, 32 nt, Human
ccuggcccaucuucccuggcguccucucccuc

SEQ ID NO: 382083 - RNA, 22 nt, Human
ccuggccccaaagagcccucga

SEQ ID NO: 382084 - RNA, 32 nt, Human
ccuggccccaaagguuucucuuucuuccuccu

SEQ ID NO: 382085 - RNA, 22 nt, Human
ccuggccccaacuauuaaagug

SEQ ID NO: 382086 - RNA, 19 nt, Human
ccuggccccaaggggccug

SEQ ID NO: 382087 - RNA, 32 nt, Human
ccuggccccacacucccaaaucugccacucca

SEQ ID NO: 382088 - RNA, 19 nt, Human
ccuggccccacagcccgug

SEQ ID NO: 382089 - RNA, 23 nt, Human
ccuggccccacugcccugugagg

SEQ ID NO: 382090 - RNA, 32 nt, Human
ccuggccccagaagcuguuuugcucagagcug

SEQ ID NO: 382091 - RNA, 32 nt, Human
ccuggccccaggagaaugaaccagccgcagag

SEQ ID NO: 382092 - RNA, 32 nt, Human
ccuggccccaggagcacugcagcccgagacuu

SEQ ID NO: 382093 - RNA, 28 nt, Human
ccuggccccagugcugcguccuuaucag

SEQ ID NO: 382094 - RNA, 32 nt, Human
ccuggcccccaagcagaggaggcugcaccucc

SEQ ID NO: 382095 - RNA, 32 nt, Human
ccuggcccccaccacauccugauguccuucua

SEQ ID NO: 382096 - RNA, 32 nt, Human
ccuggcccccagcccaugccucccugggauga

SEQ ID NO: 382097 - RNA, 27 nt, Human
ccuggcccccucagccaucucagggug

SEQ ID NO: 382098 - RNA, 32 nt, Human
ccuggcccccucccgcugcaggagacucgggg

SEQ ID NO: 382099 - RNA, 32 nt, Human
ccuggcccccuucgagaccucugccccgcugg

SEQ ID NO: 382100 - RNA, 19 nt, Human
ccuggccccgcccaccuca

SEQ ID NO: 382101 - RNA, 32 nt, Human
ccuggccccgcccugcacuccagcucgccccu

SEQ ID NO: 382102 - RNA, 20 nt, Human
ccuggccccucacgggcccc

SEQ ID NO: 382103 - RNA, 32 nt, Human
ccuggccccucagacucacuccugccaagagg

SEQ ID NO: 382104 - RNA, 32 nt, Human
ccuggccccuccaaaucucauguccucacuau

SEQ ID NO: 382105 - RNA, 32 nt, Human
ccuggccccuccacugcuucucuccccaucca

SEQ ID NO: 382106 - RNA, 32 nt, Human
ccuggccccuccauccuuucuucucugguccc

SEQ ID NO: 382107 - RNA, 20 nt, Human
ccuggccccuccugccccca

SEQ ID NO: 382108 - RNA, 32 nt, Human
ccuggccccucgggugacccuucccacacacc

SEQ ID NO: 382109 - RNA, 32 nt, Human
ccuggccccuggcagcuucuguccucacccua

SEQ ID NO: 382110 - RNA, 24 nt, Human
ccuggccccuggccgggcgggcgg

SEQ ID NO: 382111 - RNA, 32 nt, Human
ccuggccccuggccuuggcugcauuugugcac

SEQ ID NO: 382112 - RNA, 18 nt, Human
ccuggccccugggagccc

SEQ ID NO: 382113 - RNA, 32 nt, Human
ccuggccccuggggauucuguggugugggugg

SEQ ID NO: 382114 - RNA, 32 nt, Human
ccuggcccgccuggcccuagccauggagcuga

SEQ ID NO: 382115 - RNA, 32 nt, Human
ccuggcccggagcugggagcugauggaguccg

SEQ ID NO: 382116 - RNA, 22 nt, Human
ccuggcccgggccucggcgccc

SEQ ID NO: 382117 - RNA, 20 nt, Human
ccuggcccggguggggcccc

SEQ ID NO: 382118 - RNA, 32 nt, Human
ccuggcccggguuguggaggggaccggggaug

SEQ ID NO: 382119 - RNA, 32 nt, Human
ccuggcccgucauaggcucggggcccgucgac

SEQ ID NO: 382120 - RNA, 32 nt, Human
ccuggcccuagccauggagcugagccggcgcg

SEQ ID NO: 382121 - RNA, 32 nt, Human
ccuggcccuccaccugccuccaggccacgaaa

SEQ ID NO: 382122 - RNA, 32 nt, Human
ccuggcccuccccuccuuggcauucauggggg

SEQ ID NO: 382123 - RNA, 20 nt, Human
ccuggcccuccucccuuccc

SEQ ID NO: 382124 - RNA, 32 nt, Human
ccuggcccuccuggaacccaggcucuaaacaa

SEQ ID NO: 382125 - RNA, 32 nt, Human
ccuggcccucugaguggugguggagggugggg

SEQ ID NO: 382126 - RNA, 23 nt, Human
ccuggcccugagacucugugagg

SEQ ID NO: 382127 - RNA, 32 nt, Human
ccuggcccugccccugcacucaggcuugugaa

SEQ ID NO: 382128 - RNA, 32 nt, Human
ccuggcccugcucaccccuacgccucgcccuu

SEQ ID NO: 382129 - RNA, 32 nt, Human
ccuggcccugcucugcuuccugucuaccucau

SEQ ID NO: 382130 - RNA, 32 nt, Human
ccuggcccugcucuggcccuucccgggccgug

SEQ ID NO: 382131 - RNA, 32 nt, Human
ccuggcccugcucugggcuucaguggagccgu

SEQ ID NO: 382132 - RNA, 32 nt, Human
ccuggcccuggaccugggcagcccagcagccc

SEQ ID NO: 382133 - RNA, 32 nt, Human
ccuggcccugggaggaagcuggcugugguagc

SEQ ID NO: 382134 - RNA, 21 nt, Human
ccuggcccuguccuggaccca

SEQ ID NO: 382135 - RNA, 23 nt, Human
ccuggcccugugcugggcacugg

SEQ ID NO: 382136 - RNA, 20 nt, Human
ccuggcccuuuccccuuccc

SEQ ID NO: 382137 - RNA, 32 nt, Human
ccuggcccuuucuggggccacccugggauaug

SEQ ID NO: 382138 - RNA, 20 nt, Human
ccuggccgagcaggaggcgc

SEQ ID NO: 382139 - RNA, 32 nt, Human
ccuggccgaugccauggagcaagugguccagc

SEQ ID NO: 382140 - RNA, 23 nt, Human
ccuggccgcagugaggcgauuga

SEQ ID NO: 382141 - RNA, 16 nt, Human
ccuggccgccgcugcc

SEQ ID NO: 382142 - RNA, 21 nt, Human
ccuggccgcucccggcccugg

SEQ ID NO: 382143 - RNA, 32 nt, Human
ccuggccggagccacuagacagagccgggccu

SEQ ID NO: 382144 - RNA, 32 nt, Human
ccuggccggcugccauggccaggagcuaagug

SEQ ID NO: 382145 - RNA, 32 nt, Human
ccuggccgggccugggcugcccuccagucggu

SEQ ID NO: 382146 - RNA, 32 nt, Human
ccuggccguccuccuccucuucaaauuggcuu

SEQ ID NO: 382147 - RNA, 32 nt, Human
ccuggccgugcuggauguggucaugagcuucg

SEQ ID NO: 382148 - RNA, 20 nt, Human
ccuggccuaaaauguguucu

SEQ ID NO: 382149 - RNA, 32 nt, Human
ccuggccuacuucuuccugugguuccugcccc

SEQ ID NO: 382150 - RNA, 19 nt, Human
ccuggccuagaaccauuca

SEQ ID NO: 382151 - RNA, 32 nt, Human
ccuggccuagaccagcagacagagccaggaga

SEQ ID NO: 382152 - RNA, 32 nt, Human
ccuggccuagcccccucauuucacaagaagaa

SEQ ID NO: 382153 - RNA, 23 nt, Human
ccuggccuauccuggcccuucuc

SEQ ID NO: 382154 - RNA, 21 nt, Human
ccuggccucaaagggcugacc

SEQ ID NO: 382155 - RNA, 18 nt, Human
ccuggccucaagccacca

SEQ ID NO: 382156 - RNA, 19 nt, Human
ccuggccucaagcuguccu

SEQ ID NO: 382157 - RNA, 25 nt, Human
ccuggccucaccucaucaggcacug

SEQ ID NO: 382158 - RNA, 32 nt, Human
ccuggccucacugccagcccaccuccccuaca

SEQ ID NO: 382159 - RNA, 32 nt, Human
ccuggccucagaaaggagcggggacccacccu

SEQ ID NO: 382160 - RNA, 32 nt, Human
ccuggccucagaggagggaggccauggugaaa

SEQ ID NO: 382161 - RNA, 19 nt, Human
ccuggccucagcaaccuga

SEQ ID NO: 382162 - RNA, 18 nt, Human
ccuggccucagccuggca

SEQ ID NO: 382163 - RNA, 19 nt, Human
ccuggccucaggugaucca

SEQ ID NO: 382164 - RNA, 32 nt, Human
ccuggccuccacugugcccaccacugcccucc

SEQ ID NO: 382165 - RNA, 32 nt, Human
ccuggccucccaggccaccaaggacggcaaga

SEQ ID NO: 382166 - RNA, 32 nt, Human
ccuggccucccaggcugcacagaacaacagaa

SEQ ID NO: 382167 - RNA, 32 nt, Human
ccuggccuccccacucccagcucucuugcacu

SEQ ID NO: 382168 - RNA, 32 nt, Human
ccuggccuccccacucuguccugggugcuggc

SEQ ID NO: 382169 - RNA, 32 nt, Human
ccuggccuccgagggcuuuccugucuauggcg

SEQ ID NO: 382170 - RNA, 32 nt, Human
ccuggccuccuuggauuuaucgcaaaaacuga

SEQ ID NO: 382171 - RNA, 32 nt, Human
ccuggccucgcacaggcccuccugccugccaa

SEQ ID NO: 382172 - RNA, 32 nt, Human
ccuggccucgcacaggcgcacacacaccgcca

SEQ ID NO: 382173 - RNA, 25 nt, Human
ccuggccucgucaugacucuuuucu

SEQ ID NO: 382174 - RNA, 21 nt, Human
ccuggccucuaggccgccuga

SEQ ID NO: 382175 - RNA, 32 nt, Human
ccuggccucucuguucccagccauacagcagu

SEQ ID NO: 382176 - RNA, 32 nt, Human
ccuggccucugcacuccccugcuggguguggc

SEQ ID NO: 382177 - RNA, 32 nt, Human
ccuggccucugccugccucccgccugugcacu

SEQ ID NO: 382178 - RNA, 32 nt, Human
ccuggccucugcuccaccucaacagcucccac

SEQ ID NO: 382179 - RNA, 21 nt, Human
ccuggccucuggggucaggaa

SEQ ID NO: 382180 - RNA, 32 nt, Human
ccuggccucuucuccccucucuucccagcagc

SEQ ID NO: 382181 - RNA, 22 nt, Human
ccuggccucuucugggcuacug

SEQ ID NO: 382182 - RNA, 22 nt, Human
ccuggccugaaaggggaugcag

SEQ ID NO: 382183 - RNA, 32 nt, Human
ccuggccugagacaggacaggaaggggccaca

SEQ ID NO: 382184 - RNA, 32 nt, Human
ccuggccugcagcucuucccagccccgagaga

SEQ ID NO: 382185 - RNA, 32 nt, Human
ccuggccugcagcuggcuuccaccuggcacgu

SEQ ID NO: 382186 - RNA, 32 nt, Human
ccuggccugccugguggcugcccuggaguugu

SEQ ID NO: 382187 - RNA, 32 nt, Human
ccuggccugcuggggaugucuccuggggacuu

SEQ ID NO: 382188 - RNA, 32 nt, Human
ccuggccuggcccgggugcaggcugcauggcc

SEQ ID NO: 382189 - RNA, 32 nt, Human
ccuggccugggacaccuccucucugccaggag

SEQ ID NO: 382190 - RNA, 32 nt, Human
ccuggccugggcaacagagcaagacccugucu

SEQ ID NO: 382191 - RNA, 32 nt, Human
ccuggccugggcagcccuggaagcucggagga

SEQ ID NO: 382192 - RNA, 21 nt, Human
ccuggccugggccacaccuga

SEQ ID NO: 382193 - RNA, 32 nt, Human
ccuggccuggggccagcucagauauaccucuc

SEQ ID NO: 382194 - RNA, 19 nt, Human
ccuggccuggggggcgggg

SEQ ID NO: 382195 - RNA, 32 nt, Human
ccuggccugggugaguuggggguggggcacca

SEQ ID NO: 382196 - RNA, 32 nt, Human
ccuggccuggugcucugggcucugccuucugg

SEQ ID NO: 382197 - RNA, 21 nt, Human
ccuggccuguacagguacugg

SEQ ID NO: 382198 - RNA, 31 nt, Human
ccuggccuguggagagaaagccaaggcugcg

SEQ ID NO: 382199 - RNA, 24 nt, Human
ccuggccuguggcgguucuuuccu

SEQ ID NO: 382200 - RNA, 32 nt, Human
ccuggccuguucugucucugagcucugugucc

SEQ ID NO: 382201 - RNA, 32 nt, Human
ccuggccuuccagaugcgaacuggguugcuuc

SEQ ID NO: 382202 - RNA, 32 nt, Human
ccuggccuucgagguccgucccccucagacgu

SEQ ID NO: 382203 - RNA, 32 nt, Human
ccuggccuucucuucgcuucuugacaaaguua

SEQ ID NO: 382204 - RNA, 32 nt, Human
ccuggccuugccaagggccuggggcaaggugu

SEQ ID NO: 382205 - RNA, 32 nt, Human
ccuggccuuucacuccaguucugggugaggca

SEQ ID NO: 382206 - RNA, 32 nt, Human
ccuggccuuuccugguuuucaucaggaaggaa

SEQ ID NO: 382207 - RNA, 22 nt, Human
ccuggcgaacauccuccgggaa

SEQ ID NO: 382208 - RNA, 19 nt, Human
ccuggcgaacauggugaaa

SEQ ID NO: 382209 - RNA, 32 nt, Human
ccuggcgaccacugcccauuccauucaccccu

SEQ ID NO: 382210 - RNA, 23 nt, Human
ccuggcgaccagcaacacugcca

SEQ ID NO: 382211 - RNA, 32 nt, Human
ccuggcgaggcugaaggcgagggguggaggag

SEQ ID NO: 382212 - RNA, 32 nt, Human
ccuggcgagguucacugugccugcugagucag

SEQ ID NO: 382213 - RNA, 19 nt, Human
ccuggcgagugacaaugug

SEQ ID NO: 382214 - RNA, 32 nt, Human
ccuggcgauucugccaagaaggcagguguuuu

SEQ ID NO: 382215 - RNA, 32 nt, Human
ccuggcgcagcaucugcuucuucuggggugug

SEQ ID NO: 382216 - RNA, 19 nt, Human
ccuggcgcagcuccgggaa

SEQ ID NO: 382217 - RNA, 32 nt, Human
ccuggcgcaguggcucaugcuuguaaucccag

SEQ ID NO: 382218 - RNA, 19 nt, Human
ccuggcgccccccugcucc

SEQ ID NO: 382219 - RNA, 19 nt, Human
ccuggcgccgccgcggccg

SEQ ID NO: 382220 - RNA, 32 nt, Human
ccuggcgccgcucuccccuccuguggaucccu

SEQ ID NO: 382221 - RNA, 19 nt, Human
ccuggcgccggacgugugg

SEQ ID NO: 382222 - RNA, 32 nt, Human
ccuggcgcgguggcucacaccuguaaucccag

SEQ ID NO: 382223 - RNA, 32 nt, Human
ccuggcgcgguggcucaggccuguaaucccag

SEQ ID NO: 382224 - RNA, 32 nt, Human
ccuggcgcgguggcucaugccuguaaucauag

SEQ ID NO: 382225 - RNA, 21 nt, Human
ccuggcgcguacggccugcca

SEQ ID NO: 382226 - RNA, 22 nt, Human
ccuggcgcugagucacaggagc

SEQ ID NO: 382227 - RNA, 18 nt, Human
ccuggcggaacacacugg

SEQ ID NO: 382228 - RNA, 18 nt, Human
ccuggcggaagggugcgg

SEQ ID NO: 382229 - RNA, 32 nt, Human
ccuggcggacagcucccuucugaagcagagaa

SEQ ID NO: 382230 - RNA, 19 nt, Human
ccuggcggacgggacccag

SEQ ID NO: 382231 - RNA, 20 nt, Human
ccuggcggagacggcggcag

SEQ ID NO: 382232 - RNA, 32 nt, Human
ccuggcggagacggcggcaggagcugggccca

SEQ ID NO: 382233 - RNA, 18 nt, Human
ccuggcggagcaggucag

SEQ ID NO: 382234 - RNA, 18 nt, Human
ccuggcggagggaugcag

SEQ ID NO: 382235 - RNA, 20 nt, Human
ccuggcggagucggcggcgg

SEQ ID NO: 382236 - RNA, 18 nt, Human
ccuggcggaucuggucag

SEQ ID NO: 382237 - RNA, 20 nt, Human
ccuggcggcagagguugcag

SEQ ID NO: 382238 - RNA, 23 nt, Human
ccuggcggcagagguugcaguga

SEQ ID NO: 382239 - RNA, 32 nt, Human
ccuggcggcaggaagccaaagagacugggccu

SEQ ID NO: 382240 - RNA, 19 nt, Human
ccuggcggcaggggcgggg

SEQ ID NO: 382241 - RNA, 32 nt, Human
ccuggcggccacccccucuuccucacuucccu

SEQ ID NO: 382242 - RNA, 32 nt, Human
ccuggcggcgcaucccuccucucccaccuccu

SEQ ID NO: 382243 - RNA, 19 nt, Human
ccuggcggcgccuccuucu

SEQ ID NO: 382244 - RNA, 19 nt, Human
ccuggcggcggcggcgcgg

SEQ ID NO: 382245 - RNA, 18 nt, Human
ccuggcgggaaucgacgg

SEQ ID NO: 382246 - RNA, 18 nt, Human
ccuggcgggaccccgcag

SEQ ID NO: 382247 - RNA, 18 nt, Human
ccuggcgggacgucgcgg

SEQ ID NO: 382248 - RNA, 18 nt, Human
ccuggcgggagcgcgcgg

SEQ ID NO: 382249 - RNA, 19 nt, Human
ccuggcgggaggaagccca

SEQ ID NO: 382250 - RNA, 18 nt, Human
ccuggcgggaggcagcgc

SEQ ID NO: 382251 - RNA, 18 nt, Human
ccuggcgggcaagggggc

SEQ ID NO: 382252 - RNA, 25 nt, Human
ccuggcgggcccucuccccaccuca

SEQ ID NO: 382253 - RNA, 20 nt, Human
ccuggcgggccugggggcgc

SEQ ID NO: 382254 - RNA, 19 nt, Human
ccuggcggggacggugcag

SEQ ID NO: 382255 - RNA, 32 nt, Human
ccuggcggggcugaaauuggaaccugggccuc

SEQ ID NO: 382256 - RNA, 19 nt, Human
ccuggcggggguccagcag

SEQ ID NO: 382257 - RNA, 20 nt, Human
ccuggcgggguggggugggg

SEQ ID NO: 382258 - RNA, 19 nt, Human
ccuggcgggucgcggccgg

SEQ ID NO: 382259 - RNA, 20 nt, Human
ccuggcgggugagagugcag

SEQ ID NO: 382260 - RNA, 32 nt, Human
ccuggcggucucccccuuagauccgcgcuauc

SEQ ID NO: 382261 - RNA, 18 nt, Human
ccuggcggugcgggucag

SEQ ID NO: 382262 - RNA, 19 nt, Human
ccuggcgucgcggggcgua

SEQ ID NO: 382263 - RNA, 32 nt, Human
ccuggcgucuguccucaccaugccuagccuuu

SEQ ID NO: 382264 - RNA, 32 nt, Human
ccuggcgugaggaggugugggauuucugcuac

SEQ ID NO: 382265 - RNA, 32 nt, Human
ccuggcgugauccagucagaucaagccuccug

SEQ ID NO: 382266 - RNA, 32 nt, Human
ccuggcguggagucuugaggccugcugagggc

SEQ ID NO: 382267 - RNA, 20 nt, Human
ccuggcguggcaggaagcgc

SEQ ID NO: 382268 - RNA, 32 nt, Human
ccuggcgugguggcaggugccuguaaucccag

SEQ ID NO: 382269 - RNA, 32 nt, Human
ccuggcgugguggcgcaugccuguaaucccag

SEQ ID NO: 382270 - RNA, 32 nt, Human
ccuggcgugguggcucaugccuguaaucccag

SEQ ID NO: 382271 - RNA, 32 nt, Human
ccuggcgugguggugcacaccuguaaucccag

SEQ ID NO: 382272 - RNA, 32 nt, Human
ccuggcguuaucaaagcaaaucaaagccuuuc

SEQ ID NO: 382273 - RNA, 32 nt, Human
ccuggcguugagcucggccggcccggagcgcg

SEQ ID NO: 382274 - RNA, 19 nt, Human
ccuggcuaacauggugaaa

SEQ ID NO: 382275 - RNA, 19 nt, Human
ccuggcuaagcaggggcug

SEQ ID NO: 382276 - RNA, 24 nt, Human
ccuggcuaauugccuguucuuuuc

SEQ ID NO: 382277 - RNA, 32 nt, Human
ccuggcuacauggugaaaccccgucucuauaa

SEQ ID NO: 382278 - RNA, 32 nt, Human
ccuggcuacggggaguggaggcucccacgagg

SEQ ID NO: 382279 - RNA, 32 nt, Human
ccuggcuacucaggaggccgaggcagaagaau

SEQ ID NO: 382280 - RNA, 27 nt, Human
ccuggcuacuccgagccaaggcacuga

SEQ ID NO: 382281 - RNA, 21 nt, Human
ccuggcuacucgggaggcuga

SEQ ID NO: 382282 - RNA, 21 nt, Human
ccuggcuacuugggaggcuga

SEQ ID NO: 382283 - RNA, 23 nt, Human
ccuggcuagcagaggccuggcca

SEQ ID NO: 382284 - RNA, 29 nt, Human
ccuggcuauggugaaaccccgucucuacu

SEQ ID NO: 382285 - RNA, 22 nt, Human
ccuggcuauuccaugcucaugg

SEQ ID NO: 382286 - RNA, 32 nt, Human
ccuggcucaagcaauucuccuaugucagccuc

SEQ ID NO: 382287 - RNA, 32 nt, Human
ccuggcucaagugauccucccaccucagccuu

SEQ ID NO: 382288 - RNA, 32 nt, Human
ccuggcucacccaccugguggagagaguagaa

SEQ ID NO: 382289 - RNA, 32 nt, Human
ccuggcucacccaggauggaaaacggcuuaaa

SEQ ID NO: 382290 - RNA, 32 nt, Human
ccuggcucaccuugugcuggggacagguccuc

SEQ ID NO: 382291 - RNA, 32 nt, Human
ccuggcucacugcaaacucugccucccagguu

SEQ ID NO: 382292 - RNA, 32 nt, Human
ccuggcucacugcaaccuccaccucccggguu

SEQ ID NO: 382293 - RNA, 32 nt, Human
ccuggcucacugcaacugcagccucccggguu

SEQ ID NO: 382294 - RNA, 32 nt, Human
ccuggcucacugcaaucuccaucucccggguu

SEQ ID NO: 382295 - RNA, 32 nt, Human
ccuggcucacugcaaucuccgccuccccaguu

SEQ ID NO: 382296 - RNA, 32 nt, Human
ccuggcucagccaaccuccuuccucccccggu

SEQ ID NO: 382297 - RNA, 20 nt, Human
ccuggcucaggccuggcgag

SEQ ID NO: 382298 - RNA, 22 nt, Human
ccuggcucaggcgggagugcgg

SEQ ID NO: 382299 - RNA, 32 nt, Human
ccuggcucagggaggaccucaggguuccugga

SEQ ID NO: 382300 - RNA, 24 nt, Human
ccuggcucaucucauugggacugg

SEQ ID NO: 382301 - RNA, 21 nt, Human
ccuggcuccaaacccucgagg

SEQ ID NO: 382302 - RNA, 32 nt, Human
ccuggcuccaccacuccuccagccagaggguc

SEQ ID NO: 382303 - RNA, 32 nt, Human
ccuggcuccagaaaacccgcgccccacauacc

SEQ ID NO: 382304 - RNA, 16 nt, Human
ccuggcuccagccucc

SEQ ID NO: 382305 - RNA, 32 nt, Human
ccuggcuccagccuccccuacccagggucucu

SEQ ID NO: 382306 - RNA, 32 nt, Human
ccuggcuccagccugaagugugggcacggcau

SEQ ID NO: 382307 - RNA, 18 nt, Human
ccuggcuccagggccaug

SEQ ID NO: 382308 - RNA, 32 nt, Human
ccuggcuccauggcauaaggaaagggagaugc

SEQ ID NO: 382309 - RNA, 22 nt, Human
ccuggcucccaagucuucaagg

SEQ ID NO: 382310 - RNA, 23 nt, Human
ccuggcucccaccagcucugagg

SEQ ID NO: 382311 - RNA, 22 nt, Human
ccuggcucccacgggauggagg

SEQ ID NO: 382312 - RNA, 32 nt, Human
ccuggcucccaucuccuccucaccuuuuguug

SEQ ID NO: 382313 - RNA, 24 nt, Human
ccuggcucccauucccugacaagg

SEQ ID NO: 382314 - RNA, 21 nt, Human
ccuggcuccccaggacacuca

SEQ ID NO: 382315 - RNA, 19 nt, Human
ccuggcuccccuccugccu

SEQ ID NO: 382316 - RNA, 21 nt, Human
ccuggcuccccuccugggagg

SEQ ID NO: 382317 - RNA, 32 nt, Human
ccuggcuccccucuucguuccuucccuggcug

SEQ ID NO: 382318 - RNA, 21 nt, Human
ccuggcuccccuggggugcag

SEQ ID NO: 382319 - RNA, 23 nt, Human
ccuggcucccggcggcccggagg

SEQ ID NO: 382320 - RNA, 32 nt, Human
ccuggcucccucacuccuggguuccaggucac

SEQ ID NO: 382321 - RNA, 21 nt, Human
ccuggcucccucccuaggagg

SEQ ID NO: 382322 - RNA, 32 nt, Human
ccuggcucccugcacugugcacgcuccucuuc

SEQ ID NO: 382323 - RNA, 22 nt, Human
ccuggcuccgcaccugcagagg

SEQ ID NO: 382324 - RNA, 32 nt, Human
ccuggcuccgcacggaggcuccugggucccgc

SEQ ID NO: 382325 - RNA, 23 nt, Human
ccuggcuccguggguccagugag

SEQ ID NO: 382326 - RNA, 32 nt, Human
ccuggcuccuaccuggaggacucaguuguucu

SEQ ID NO: 382327 - RNA, 32 nt, Human
ccuggcuccucacaucccagggguuggcuucu

SEQ ID NO: 382328 - RNA, 20 nt, Human
ccuggcuccuccuugcuccc

SEQ ID NO: 382329 - RNA, 24 nt, Human
ccuggcuccugacucucagagagg

SEQ ID NO: 382330 - RNA, 24 nt, Human
ccuggcuccuggcccgagccuggg

SEQ ID NO: 382331 - RNA, 24 nt, Human
ccuggcuccuggccgucugugagg

SEQ ID NO: 382332 - RNA, 20 nt, Human
ccuggcuccuggccugugag

SEQ ID NO: 382333 - RNA, 21 nt, Human
ccuggcuccugggcagugggg

SEQ ID NO: 382334 - RNA, 20 nt, Human
ccuggcuccugggggcgggg

SEQ ID NO: 382335 - RNA, 21 nt, Human
ccuggcuccuggucgggaagg

SEQ ID NO: 382336 - RNA, 32 nt, Human
ccuggcuccuuccagcguaaaccaguagugaa

SEQ ID NO: 382337 - RNA, 19 nt, Human
ccuggcuccuuucuacucc

SEQ ID NO: 382338 - RNA, 32 nt, Human
ccuggcucgaugucugcuucuucccagccugg

SEQ ID NO: 382339 - RNA, 22 nt, Human
ccuggcucggaccacugcaagg

SEQ ID NO: 382340 - RNA, 32 nt, Human
ccuggcucggccucccucacacugaccaaggg

SEQ ID NO: 382341 - RNA, 21 nt, Human
ccuggcucgggacgucugaga

SEQ ID NO: 382342 - RNA, 32 nt, Human
ccuggcucggggugggagugcagaggcaacca

SEQ ID NO: 382343 - RNA, 32 nt, Human
ccuggcucucagggugacgccacccacagaga

SEQ ID NO: 382344 - RNA, 32 nt, Human
ccuggcucuccccugggcacagugccacuccc

SEQ ID NO: 382345 - RNA, 32 nt, Human
ccuggcucuccucgugcagucaccccagugcc

SEQ ID NO: 382346 - RNA, 32 nt, Human
ccuggcucucucuuccccuccuuaccuggcca

SEQ ID NO: 382347 - RNA, 23 nt, Human
ccuggcucugcaaugggcacugg

SEQ ID NO: 382348 - RNA, 32 nt, Human
ccuggcucugcacuuuuccuccggggagaaag

SEQ ID NO: 382349 - RNA, 32 nt, Human
ccuggcucugccuuuuagauagcaggagcaaa

SEQ ID NO: 382350 - RNA, 32 nt, Human
ccuggcucugcugcucugaagcaccggagucg

SEQ ID NO: 382351 - RNA, 32 nt, Human
ccuggcucugcuguccccuuggcagguccugg

SEQ ID NO: 382352 - RNA, 20 nt, Human
ccuggcucugggggguggag

SEQ ID NO: 382353 - RNA, 32 nt, Human
ccuggcucuuggagaaaggcuucugggcccag

SEQ ID NO: 382354 - RNA, 32 nt, Human
ccuggcucuuucugauggugccuuugcuucug

SEQ ID NO: 382355 - RNA, 23 nt, Human
ccuggcugaccuuucuaucuucu

SEQ ID NO: 382356 - RNA, 32 nt, Human
ccuggcugacuggccaguugcccagagcacuu

SEQ ID NO: 382357 - RNA, 21 nt, Human
ccuggcugagaggaccaggga

SEQ ID NO: 382358 - RNA, 19 nt, Human
ccuggcugcacaggagccc

SEQ ID NO: 382359 - RNA, 17 nt, Human
ccuggcugcagaugcuu

SEQ ID NO: 382360 - RNA, 21 nt, Human
ccuggcugcaggcgggcgugg

SEQ ID NO: 382361 - RNA, 19 nt, Human
ccuggcugcauaacauggg

SEQ ID NO: 382362 - RNA, 32 nt, Human
ccuggcugcauauccagccucgagaaaauguc

SEQ ID NO: 382363 - RNA, 32 nt, Human
ccuggcugccaagccaugguaacuggaguuaa

SEQ ID NO: 382364 - RNA, 32 nt, Human
ccuggcugcccaggaaguagugucuucuuuug

SEQ ID NO: 382365 - RNA, 32 nt, Human
ccuggcugcccaggcggagcugccucuucucc

SEQ ID NO: 382366 - RNA, 31 nt, Human
ccuggcugccucuggggucgagggucugggu

SEQ ID NO: 382367 - RNA, 32 nt, Human
ccuggcugccugacaucagugaagaccugcug

SEQ ID NO: 382368 - RNA, 21 nt, Human
ccuggcugcuccagcuccuga

SEQ ID NO: 382369 - RNA, 24 nt, Human
ccuggcugcucgcaucugcaggaa

SEQ ID NO: 382370 - RNA, 21 nt, Human
ccuggcugcuggaaaaaccag

SEQ ID NO: 382371 - RNA, 22 nt, Human
ccuggcugcuugcugucuguga

SEQ ID NO: 382372 - RNA, 18 nt, Human
ccuggcuggaaagcuuug

SEQ ID NO: 382373 - RNA, 21 nt, Human
ccuggcuggaagcucuuuucu

SEQ ID NO: 382374 - RNA, 19 nt, Human
ccuggcuggagugcagugg

SEQ ID NO: 382375 - RNA, 32 nt, Human
ccuggcuggaugcuuccugucccuggaacucu

SEQ ID NO: 382376 - RNA, 20 nt, Human
ccuggcuggcaggggugcug

SEQ ID NO: 382377 - RNA, 32 nt, Human
ccuggcuggcauggaaauacagugggaaaacc

SEQ ID NO: 382378 - RNA, 32 nt, Human
ccuggcuggccaggacacacugaaaagcagcc

SEQ ID NO: 382379 - RNA, 20 nt, Human
ccuggcuggcggggacgcgg

SEQ ID NO: 382380 - RNA, 18 nt, Human
ccuggcuggcgggggcgc

SEQ ID NO: 382381 - RNA, 23 nt, Human
ccuggcugggaaagggggugugg

SEQ ID NO: 382382 - RNA, 17 nt, Human
ccuggcugggagggcag

SEQ ID NO: 382383 - RNA, 32 nt, Human
ccuggcugggcaugggauggugaccucagcug

SEQ ID NO: 382384 - RNA, 32 nt, Human
ccuggcugggccagaccccaggaagguggggu

SEQ ID NO: 382385 - RNA, 21 nt, Human
ccuggcugggccgggcacuga

SEQ ID NO: 382386 - RNA, 32 nt, Human
ccuggcugggcugagucaggaccuugccggga

SEQ ID NO: 382387 - RNA, 21 nt, Human
ccuggcuggggagggggccag

SEQ ID NO: 382388 - RNA, 32 nt, Human
ccuggcuggggaugguggcucacaccugugau

SEQ ID NO: 382389 - RNA, 32 nt, Human
ccuggcugggugaggcggcucacaccuguaau

SEQ ID NO: 382390 - RNA, 32 nt, Human
ccuggcuggucugucuuuucuccauuuguuua

SEQ ID NO: 382391 - RNA, 32 nt, Human
ccuggcuguagccuaggucuugagugaacccc

SEQ ID NO: 382392 - RNA, 32 nt, Human
ccuggcugucaccuuuuuaauuuccagaacug

SEQ ID NO: 382393 - RNA, 31 nt, Human
ccuggcugucugagugggcacuugucuggcu

SEQ ID NO: 382394 - RNA, 32 nt, Human
ccuggcugucugucugucugucuaaccuggca

SEQ ID NO: 382395 - RNA, 32 nt, Human
ccuggcugugaaggcagcugcacagggcuagg

SEQ ID NO: 382396 - RNA, 32 nt, Human
ccuggcugugagcagccuccacuguguccaga

SEQ ID NO: 382397 - RNA, 32 nt, Human
ccuggcugugccaggaccacaccuaccaaggc

SEQ ID NO: 382398 - RNA, 32 nt, Human
ccuggcugugccugugacuccagaguccuauc

SEQ ID NO: 382399 - RNA, 21 nt, Human
ccuggcuguggcgucugugag

SEQ ID NO: 382400 - RNA, 21 nt, Human
ccuggcugugguugcuucucu

SEQ ID NO: 382401 - RNA, 32 nt, Human
ccuggcuguguacgugggugugcagugcacgu

SEQ ID NO: 382402 - RNA, 32 nt, Human
ccuggcuguucacuucccugccauucaguaug

SEQ ID NO: 382403 - RNA, 32 nt, Human
ccuggcuguuuaucugccccaaaggagaagcc

SEQ ID NO: 382404 - RNA, 32 nt, Human
ccuggcuuacccacuuagacugccuccguuuc

SEQ ID NO: 382405 - RNA, 32 nt, Human
ccuggcuuagugccuggcaacgcccaguuccu

SEQ ID NO: 382406 - RNA, 32 nt, Human
ccuggcuucagagcuggagugccuggggccac

SEQ ID NO: 382407 - RNA, 23 nt, Human
ccuggcuucaggagggagcggag

SEQ ID NO: 382408 - RNA, 32 nt, Human
ccuggcuucaggagggagcggagcagccauuc

SEQ ID NO: 382409 - RNA, 24 nt, Human
ccuggcuucagugcaacucuuuuc

SEQ ID NO: 382410 - RNA, 32 nt, Human
ccuggcuucaugccaggggcugcucugguugc

SEQ ID NO: 382411 - RNA, 32 nt, Human
ccuggcuuccacccuccccagcuccugcacuu

SEQ ID NO: 382412 - RNA, 32 nt, Human
ccuggcuuccuggguggcggugcggacugaug

SEQ ID NO: 382413 - RNA, 23 nt, Human
ccuggcuucucugguucuucccu

SEQ ID NO: 382414 - RNA, 32 nt, Human
ccuggcuucuguggccugggcguguuguggac

SEQ ID NO: 382415 - RNA, 32 nt, Human
ccuggcuucuuacugcggcuucauacugaggg

SEQ ID NO: 382416 - RNA, 32 nt, Human
ccuggcuucuucacugcgugccugugugcugg

SEQ ID NO: 382417 - RNA, 32 nt, Human
ccuggcuucuucuaucuggaaguguccguggu

SEQ ID NO: 382418 - RNA, 32 nt, Human
ccuggcuugaagcugcucacugcucacacgcu

SEQ ID NO: 382419 - RNA, 32 nt, Human
ccuggcuugacaggcuuggucucugcaagugg

SEQ ID NO: 382420 - RNA, 32 nt, Human
ccuggcuugcacucccuguccugcugcccugu

SEQ ID NO: 382421 - RNA, 31 nt, Human
ccuggcuugcccucugggccuuugcuccccc

SEQ ID NO: 382422 - RNA, 32 nt, Human
ccuggcuuggggugucauucugccuggcggcc

SEQ ID NO: 382423 - RNA, 32 nt, Human
ccuggcuuuaaugugagaguuauguggaaugg

SEQ ID NO: 382424 - RNA, 32 nt, Human
ccuggcuuuccuucuggcguggggccagcucc

SEQ ID NO: 382425 - RNA, 32 nt, Human
ccuggcuuucuagccacauucugcaccuccuu

SEQ ID NO: 382426 - RNA, 32 nt, Human
ccuggcuuucuccuuauuguuuacagauguag

SEQ ID NO: 382427 - RNA, 32 nt, Human
ccuggcuuugaaguggagucugugacugcucu

SEQ ID NO: 382428 - RNA, 32 nt, Human
ccuggcuuugcaccugguggcuauuacaaagc

SEQ ID NO: 382429 - RNA, 32 nt, Human
ccuggcuuuggggcaagacugagccacggggg

SEQ ID NO: 382430 - RNA, 32 nt, Human
ccugggaaaacuaaccaucucagucuuuccug

SEQ ID NO: 382431 - RNA, 32 nt, Human
ccugggaaaaggaacacagcugugccuggaac

SEQ ID NO: 382432 - RNA, 32 nt, Human
ccugggaaacauagcaagacccugucucuaca

SEQ ID NO: 382433 - RNA, 32 nt, Human
ccugggaaaccagcuggggcugcacagggcca

SEQ ID NO: 382434 - RNA, 17 nt, Human
ccugggaaaccauccag

SEQ ID NO: 382435 - RNA, 21 nt, Human
ccugggaaagcguccaugcuu

SEQ ID NO: 382436 - RNA, 32 nt, Human
ccugggaaaugaggauaaagaaaaucgagagu

SEQ ID NO: 382437 - RNA, 32 nt, Human
ccugggaaauguuuuccugaugaauuucuccu

SEQ ID NO: 382438 - RNA, 18 nt, Human
ccugggaacacaaacgug

SEQ ID NO: 382439 - RNA, 32 nt, Human
ccugggaacagcccuggcuugguucaggccgc

SEQ ID NO: 382440 - RNA, 18 nt, Human
ccugggaacaggcagagg

SEQ ID NO: 382441 - RNA, 32 nt, Human
ccugggaacauguaggguggggaguaugagca

SEQ ID NO: 382442 - RNA, 20 nt, Human
ccugggaaccacaauuaugg

SEQ ID NO: 382443 - RNA, 32 nt, Human
ccugggaacccaucccacacaccagcugugug

SEQ ID NO: 382444 - RNA, 18 nt, Human
ccugggaaccgcuugugg

SEQ ID NO: 382445 - RNA, 32 nt, Human
ccugggaaccuaacgaggagagcccaggccua

SEQ ID NO: 382446 - RNA, 18 nt, Human
ccugggaacguuauaugg

SEQ ID NO: 382447 - RNA, 18 nt, Human
ccugggaacuaacacgug

SEQ ID NO: 382448 - RNA, 24 nt, Human
ccugggaacucaaggcugcaguga

SEQ ID NO: 382449 - RNA, 18 nt, Human
ccugggaacugacagagg

SEQ ID NO: 382450 - RNA, 18 nt, Human
ccugggaacuggcaaugg

SEQ ID NO: 382451 - RNA, 20 nt, Human
ccugggaacugggggugcgg

SEQ ID NO: 382452 - RNA, 18 nt, Human
ccugggaagacguucugg

SEQ ID NO: 382453 - RNA, 18 nt, Human
ccugggaagacugugugg

SEQ ID NO: 382454 - RNA, 19 nt, Human
ccugggaagaggcucagca

SEQ ID NO: 382455 - RNA, 24 nt, Human
ccugggaagcagagguugcaguga

SEQ ID NO: 382456 - RNA, 24 nt, Human
ccugggaagcagaguuugcaguga

SEQ ID NO: 382457 - RNA, 32 nt, Human
ccugggaagcagaguuugcagugagccaagau

SEQ ID NO: 382458 - RNA, 32 nt, Human
ccugggaagcggagcucgcagugagccgagau

SEQ ID NO: 382459 - RNA, 32 nt, Human
ccugggaaggagagacgaggaggcaugccuuc

SEQ ID NO: 382460 - RNA, 18 nt, Human
ccugggaaggcucugugg

SEQ ID NO: 382461 - RNA, 18 nt, Human
ccugggaagggcagcugg

SEQ ID NO: 382462 - RNA, 32 nt, Human
ccugggaaggucuggagguuccuguggaccuc

SEQ ID NO: 382463 - RNA, 32 nt, Human
ccugggaagugaggggacgaagccuuagaggg

SEQ ID NO: 382464 - RNA, 24 nt, Human
ccugggaaguggaagcugcaguga

SEQ ID NO: 382465 - RNA, 32 nt, Human
ccugggaaguggaagcugcagugagccgagau

SEQ ID NO: 382466 - RNA, 24 nt, Human
ccugggaaguggaaguugcaguga

SEQ ID NO: 382467 - RNA, 32 nt, Human
ccugggaaguggaggcugcagugagcccagau

SEQ ID NO: 382468 - RNA, 32 nt, Human
ccugggaaguggaggcugcagugagccgagau

SEQ ID NO: 382469 - RNA, 32 nt, Human
ccugggaaguggaggcugcagugagccuaggu

SEQ ID NO: 382470 - RNA, 24 nt, Human
ccugggaaguggagguuacaguga

SEQ ID NO: 382471 - RNA, 22 nt, Human
ccugggaaguggagguugcagu

SEQ ID NO: 382472 - RNA, 24 nt, Human
ccugggaaguugaggcugcaguga

SEQ ID NO: 382473 - RNA, 18 nt, Human
ccugggaaucagcauggg

SEQ ID NO: 382474 - RNA, 18 nt, Human
ccugggaaucccggugug

SEQ ID NO: 382475 - RNA, 21 nt, Human
ccugggaaucggagguugcag

SEQ ID NO: 382476 - RNA, 32 nt, Human
ccugggaaugagauuaaaggaggcagggaggu

SEQ ID NO: 382477 - RNA, 19 nt, Human
ccugggaauggcacagugg

SEQ ID NO: 382478 - RNA, 32 nt, Human
ccugggaaugugacuuuaauuuggaaauagug

SEQ ID NO: 382479 - RNA, 20 nt, Human
ccugggaaugugauaugagg

SEQ ID NO: 382480 - RNA, 18 nt, Human
ccugggaauuuaccuggg

SEQ ID NO: 382481 - RNA, 22 nt, Human
ccugggacaacagguguagugg

SEQ ID NO: 382482 - RNA, 32 nt, Human
ccugggacaagccuggguggaauucuauauug

SEQ ID NO: 382483 - RNA, 32 nt, Human
ccugggacaauagugugcaugccacccggggu

SEQ ID NO: 382484 - RNA, 32 nt, Human
ccugggacaccuuuguuccagccugguuuccu

SEQ ID NO: 382485 - RNA, 32 nt, Human
ccugggacaggcuggggccaggaggcagaaac

SEQ ID NO: 382486 - RNA, 19 nt, Human
ccugggacaggggcaggug

SEQ ID NO: 382487 - RNA, 32 nt, Human
ccugggacagggucaguacaagucaggacagg

SEQ ID NO: 382488 - RNA, 24 nt, Human
ccugggacauugaggcugcaguga

SEQ ID NO: 382489 - RNA, 32 nt, Human
ccugggaccacagagggcaggagcuugcacga

SEQ ID NO: 382490 - RNA, 32 nt, Human
ccugggaccacagauuuggacaggaagggcuc

SEQ ID NO: 382491 - RNA, 19 nt, Human
ccugggaccagcagagugg

SEQ ID NO: 382492 - RNA, 32 nt, Human
ccugggaccagccugguaccccugggcgggag

SEQ ID NO: 382493 - RNA, 24 nt, Human
ccugggacccccuccccacugccu

SEQ ID NO: 382494 - RNA, 23 nt, Human
ccugggaccccucggccacugcc

SEQ ID NO: 382495 - RNA, 32 nt, Human
ccugggacccugaggaauucaccaggaguaaa

SEQ ID NO: 382496 - RNA, 20 nt, Human
ccugggacccuugcccugcc

SEQ ID NO: 382497 - RNA, 18 nt, Human
ccugggaccuacaugugg

SEQ ID NO: 382498 - RNA, 32 nt, Human
ccugggaccuccccagcccaggaaaaacugga

SEQ ID NO: 382499 - RNA, 32 nt, Human
ccugggaccugcaggcggcggcgcaggugggc

SEQ ID NO: 382500 - RNA, 20 nt, Human
ccugggaccugccacugugg

SEQ ID NO: 382501 - RNA, 32 nt, Human
ccugggaccuggggcaucuuugcccaccuuag

SEQ ID NO: 382502 - RNA, 32 nt, Human
ccugggaccuugcccaaguucaaagcggaggc

SEQ ID NO: 382503 - RNA, 32 nt, Human
ccugggacggcaucaacgcacugugagcacuc

SEQ ID NO: 382504 - RNA, 32 nt, Human
ccugggacgugagacuuagcuuccagccagug

SEQ ID NO: 382505 - RNA, 32 nt, Human
ccugggacuagugggaugagagacugagaaaa

SEQ ID NO: 382506 - RNA, 32 nt, Human
ccugggacugaggaggcaggggagggauaagg

SEQ ID NO: 382507 - RNA, 20 nt, Human
ccugggacugagggggccag

SEQ ID NO: 382508 - RNA, 32 nt, Human
ccugggacugcacgaugaacuauuggagcaua

SEQ ID NO: 382509 - RNA, 32 nt, Human
ccugggacugcacugcaugcaugugaagcccu

SEQ ID NO: 382510 - RNA, 32 nt, Human
ccugggacuuggguggcugagccgagguacuc

SEQ ID NO: 382511 - RNA, 32 nt, Human
ccugggagaaaagacccuggguucugagguaa

SEQ ID NO: 382512 - RNA, 32 nt, Human
ccugggagaagacguaucaaaagggauggcaa

SEQ ID NO: 382513 - RNA, 32 nt, Human
ccugggagaagaggaaaaaggagcuaauauuu

SEQ ID NO: 382514 - RNA, 21 nt, Human
ccugggagacagaagccucug

SEQ ID NO: 382515 - RNA, 18 nt, Human
ccugggagacagaaugug

SEQ ID NO: 382516 - RNA, 24 nt, Human
ccugggagacagagguugcaauga

SEQ ID NO: 382517 - RNA, 22 nt, Human
ccugggagacagagguugcagu

SEQ ID NO: 382518 - RNA, 24 nt, Human
ccugggagacagagguugcaguaa

SEQ ID NO: 382519 - RNA, 23 nt, Human
ccugggagacagagguugcagug

SEQ ID NO: 382520 - RNA, 24 nt, Human
ccugggagacagagguugcaguga

SEQ ID NO: 382521 - RNA, 18 nt, Human
ccugggagacagaugagg

SEQ ID NO: 382522 - RNA, 32 nt, Human
ccugggagacauccuugucuuugcaacuccaa

SEQ ID NO: 382523 - RNA, 18 nt, Human
ccugggagaccccuccag

SEQ ID NO: 382524 - RNA, 32 nt, Human
ccugggagacgagugaaggagccccagagucg

SEQ ID NO: 382525 - RNA, 32 nt, Human
ccugggagacggagcuugcagugagcugagau

SEQ ID NO: 382526 - RNA, 23 nt, Human
ccugggagacggagguugcagug

SEQ ID NO: 382527 - RNA, 24 nt, Human
ccugggagacggagguugcaguga

SEQ ID NO: 382528 - RNA, 32 nt, Human
ccugggagacggagguugcagugagccaagau

SEQ ID NO: 382529 - RNA, 32 nt, Human
ccugggagacggagguugcagugagccaugau

SEQ ID NO: 382530 - RNA, 32 nt, Human
ccugggagacuuuuccucccugccucagcucc

SEQ ID NO: 382531 - RNA, 32 nt, Human
ccugggagagaagaggaggaucucaucucuca

SEQ ID NO: 382532 - RNA, 18 nt, Human
ccugggagagacagaugg

SEQ ID NO: 382533 - RNA, 32 nt, Human
ccugggagagaggaagugaucgcucccggaga

SEQ ID NO: 382534 - RNA, 24 nt, Human
ccugggagaucaaggcuacaguga

SEQ ID NO: 382535 - RNA, 32 nt, Human
ccugggagaugaaccaagcaucaguugaggcu

SEQ ID NO: 382536 - RNA, 32 nt, Human
ccugggagaugagacaggguuagaggaaacag

SEQ ID NO: 382537 - RNA, 24 nt, Human
ccugggagauggaaguugcaguga

SEQ ID NO: 382538 - RNA, 23 nt, Human
ccugggagauggagauugcagug

SEQ ID NO: 382539 - RNA, 24 nt, Human
ccugggagauggagauugcaguga

SEQ ID NO: 382540 - RNA, 32 nt, Human
ccugggagauggagauugcagugagcagagau

SEQ ID NO: 382541 - RNA, 22 nt, Human
ccugggagauggaggcugcagu

SEQ ID NO: 382542 - RNA, 23 nt, Human
ccugggagauggagguugcagug

SEQ ID NO: 382543 - RNA, 24 nt, Human
ccugggagauggagguugcaguga

SEQ ID NO: 382544 - RNA, 32 nt, Human
ccugggagauggagguugcagugagccgagau

SEQ ID NO: 382545 - RNA, 32 nt, Human
ccugggagauggagguugcagugagcugagau

SEQ ID NO: 382546 - RNA, 24 nt, Human
ccugggagauggggguuguaguga

SEQ ID NO: 382547 - RNA, 32 nt, Human
ccugggagaugguggaggaugaagcccugauc

SEQ ID NO: 382548 - RNA, 24 nt, Human
ccugggagauugaggcugcaguga

SEQ ID NO: 382549 - RNA, 32 nt, Human
ccugggagcaggaagcccuaggaagaggggac

SEQ ID NO: 382550 - RNA, 23 nt, Human
ccugggagcaggagguugcagug

SEQ ID NO: 382551 - RNA, 24 nt, Human
ccugggagcaggagguugcaguga

SEQ ID NO: 382552 - RNA, 32 nt, Human
ccugggagcaggagguugcagugagccgaggu

SEQ ID NO: 382553 - RNA, 32 nt, Human
ccugggagcaucguccuguaaucaagggcaga

SEQ ID NO: 382554 - RNA, 32 nt, Human
ccugggagccacaggugccugcuucucccauc

SEQ ID NO: 382555 - RNA, 27 nt, Human
ccugggagccacugugccugugcuucu

SEQ ID NO: 382556 - RNA, 32 nt, Human
ccugggagccagcucuggaggguggucugggg

SEQ ID NO: 382557 - RNA, 23 nt, Human
ccugggagcccagggguuaggaa

SEQ ID NO: 382558 - RNA, 32 nt, Human
ccugggagcccagggguuaggaagggaagaua

SEQ ID NO: 382559 - RNA, 32 nt, Human
ccugggagccgccaccucccuuuccccaagac

SEQ ID NO: 382560 - RNA, 32 nt, Human
ccugggagccggaggcugcagugagccaagau

SEQ ID NO: 382561 - RNA, 18 nt, Human
ccugggagccugcgugug

SEQ ID NO: 382562 - RNA, 32 nt, Human
ccugggagcgcuaugggagacuggggcuuauu

SEQ ID NO: 382563 - RNA, 22 nt, Human
ccugggagcggagauugcagug

SEQ ID NO: 382564 - RNA, 23 nt, Human
ccugggagcggagauugcaguga

SEQ ID NO: 382565 - RNA, 32 nt, Human
ccugggagcuccugguuagcaagugagaucuc

SEQ ID NO: 382566 - RNA, 32 nt, Human
ccugggagcugaauuccaagcccaggguuugg

SEQ ID NO: 382567 - RNA, 32 nt, Human
ccugggagcugaugaagcaggugccagggcug

SEQ ID NO: 382568 - RNA, 32 nt, Human
ccugggagcugaugacccagugugcaaggcgc

SEQ ID NO: 382569 - RNA, 18 nt, Human
ccugggagcugggccaug

SEQ ID NO: 382570 - RNA, 22 nt, Human
ccugggagcugucugucuuucc

SEQ ID NO: 382571 - RNA, 32 nt, Human
ccugggagcuugcugggagccaccucccaggu

SEQ ID NO: 382572 - RNA, 22 nt, Human
ccugggaggaaagugggcgcag

SEQ ID NO: 382573 - RNA, 24 nt, Human
ccugggaggaagagguugcaguga

SEQ ID NO: 382574 - RNA, 32 nt, Human
ccugggaggaagagguugcagugagccgagau

SEQ ID NO: 382575 - RNA, 32 nt, Human
ccugggaggaaggcuccaaauucucacuacuu

SEQ ID NO: 382576 - RNA, 32 nt, Human
ccugggaggacccugagggagggucagggaug

SEQ ID NO: 382577 - RNA, 32 nt, Human
ccugggaggaccucagaccuccccagcccugg

SEQ ID NO: 382578 - RNA, 23 nt, Human
ccugggaggagaagguugcagug

SEQ ID NO: 382579 - RNA, 24 nt, Human
ccugggaggagaagguugcaguga

SEQ ID NO: 382580 - RNA, 32 nt, Human
ccugggaggagaagguuggaauggcgggggca

SEQ ID NO: 382581 - RNA, 32 nt, Human
ccugggaggagagaguagugacacucaggauc

SEQ ID NO: 382582 - RNA, 32 nt, Human
ccugggaggaggagcugagaccucaggggagg

SEQ ID NO: 382583 - RNA, 23 nt, Human
ccugggaggaggagguugcagug

SEQ ID NO: 382584 - RNA, 24 nt, Human
ccugggaggaggagguugcaguga

SEQ ID NO: 382585 - RNA, 32 nt, Human
ccugggaggaggagguugcagugagcugagau

SEQ ID NO: 382586 - RNA, 32 nt, Human
ccugggaggagguugagccuggggaaggaaaa

SEQ ID NO: 382587 - RNA, 32 nt, Human
ccugggaggaugugacgucaggugagaaggga

SEQ ID NO: 382588 - RNA, 23 nt, Human
ccugggaggcaaagguugcagug

SEQ ID NO: 382589 - RNA, 24 nt, Human
ccugggaggcaaagguugcaguga

SEQ ID NO: 382590 - RNA, 32 nt, Human
ccugggaggcaaagguugcagugagcugagau

SEQ ID NO: 382591 - RNA, 23 nt, Human
ccugggaggcaaagguugcggug

SEQ ID NO: 382592 - RNA, 24 nt, Human
ccugggaggcaaagguugcgguga

SEQ ID NO: 382593 - RNA, 23 nt, Human
ccugggaggcagaaguugcagug

SEQ ID NO: 382594 - RNA, 24 nt, Human
ccugggaggcagaaguugcaguga

SEQ ID NO: 382595 - RNA, 32 nt, Human
ccugggaggcagaaguugcagugagccgagau

SEQ ID NO: 382596 - RNA, 32 nt, Human
ccugggaggcagaaguugcagugagcugagau

SEQ ID NO: 382597 - RNA, 23 nt, Human
ccugggaggcagaaguuguggug

SEQ ID NO: 382598 - RNA, 24 nt, Human
ccugggaggcagaaguugugguga

SEQ ID NO: 382599 - RNA, 24 nt, Human
ccugggaggcagagauugcacuga

SEQ ID NO: 382600 - RNA, 23 nt, Human
ccugggaggcagagauugcagug

SEQ ID NO: 382601 - RNA, 24 nt, Human
ccugggaggcagagauugcaguga

SEQ ID NO: 382602 - RNA, 32 nt, Human
ccugggaggcagagauugcagugagccaagac

SEQ ID NO: 382603 - RNA, 32 nt, Human
ccugggaggcagagauugcagugagccgagau

SEQ ID NO: 382604 - RNA, 32 nt, Human
ccugggaggcagagauugcagugagcugagau

SEQ ID NO: 382605 - RNA, 32 nt, Human
ccugggaggcagagcuugcaguaagccgagau

SEQ ID NO: 382606 - RNA, 23 nt, Human
ccugggaggcagagcuugcagug

SEQ ID NO: 382607 - RNA, 24 nt, Human
ccugggaggcagagcuugcaguga

SEQ ID NO: 382608 - RNA, 32 nt, Human
ccugggaggcagagcuugcagugagccaagau

SEQ ID NO: 382609 - RNA, 32 nt, Human
ccugggaggcagagcuugcagugagccgagau

SEQ ID NO: 382610 - RNA, 32 nt, Human
ccugggaggcagagcuugcagugagccuagau

SEQ ID NO: 382611 - RNA, 32 nt, Human
ccugggaggcagagcuugcagugagcugagau

SEQ ID NO: 382612 - RNA, 32 nt, Human
ccugggaggcagagcuugcagugaguggagau

SEQ ID NO: 382613 - RNA, 32 nt, Human
ccugggaggcagaggcugcagugagccgagau

SEQ ID NO: 382614 - RNA, 21 nt, Human
ccugggaggcagagggugcag

SEQ ID NO: 382615 - RNA, 22 nt, Human
ccugggaggcagagggugcagu

SEQ ID NO: 382616 - RNA, 24 nt, Human
ccugggaggcagagggugcaguaa

SEQ ID NO: 382617 - RNA, 24 nt, Human
ccugggaggcagagguuacaauga

SEQ ID NO: 382618 - RNA, 24 nt, Human
ccugggaggcagagguuacaguga

SEQ ID NO: 382619 - RNA, 22 nt, Human
ccugggaggcagagguugcagu

SEQ ID NO: 382620 - RNA, 24 nt, Human
ccugggaggcagagguugcaguaa

SEQ ID NO: 382621 - RNA, 23 nt, Human
ccugggaggcagagguugcagug

SEQ ID NO: 382622 - RNA, 24 nt, Human
ccugggaggcagagguugcaguga

SEQ ID NO: 382623 - RNA, 32 nt, Human
ccugggaggcagagguugcagugaacagagau

SEQ ID NO: 382624 - RNA, 32 nt, Human
ccugggaggcagagguugcagugagccaagau

SEQ ID NO: 382625 - RNA, 32 nt, Human
ccugggaggcagagguugcagugagccaauau

SEQ ID NO: 382626 - RNA, 32 nt, Human
ccugggaggcagagguugcagugagccgagau

SEQ ID NO: 382627 - RNA, 32 nt, Human
ccugggaggcagagguugcagugagccgauau

SEQ ID NO: 382628 - RNA, 32 nt, Human
ccugggaggcagagguugcagugagcuaagac

SEQ ID NO: 382629 - RNA, 32 nt, Human
ccugggaggcagagguugcagugagcucagau

SEQ ID NO: 382630 - RNA, 32 nt, Human
ccugggaggcagagguugcagugagcugagac

SEQ ID NO: 382631 - RNA, 32 nt, Human
ccugggaggcagagguugcagugagcugagau

SEQ ID NO: 382632 - RNA, 32 nt, Human
ccugggaggcagagguugcagugagucgagau

SEQ ID NO: 382633 - RNA, 24 nt, Human
ccugggaggcagagguugcuguga

SEQ ID NO: 382634 - RNA, 24 nt, Human
ccugggaggcagagguuguagcga

SEQ ID NO: 382635 - RNA, 23 nt, Human
ccugggaggcagagguuguagug

SEQ ID NO: 382636 - RNA, 24 nt, Human
ccugggaggcagagguuguaguga

SEQ ID NO: 382637 - RNA, 23 nt, Human
ccugggaggcagagguuguggug

SEQ ID NO: 382638 - RNA, 24 nt, Human
ccugggaggcagagguugugguga

SEQ ID NO: 382639 - RNA, 24 nt, Human
ccugggaggcagagguuucaguga

SEQ ID NO: 382640 - RNA, 23 nt, Human
ccugggaggcagagucugcagug

SEQ ID NO: 382641 - RNA, 24 nt, Human
ccugggaggcagagucugcaguga

SEQ ID NO: 382642 - RNA, 32 nt, Human
ccugggaggcagagucugcagugagccgagau

SEQ ID NO: 382643 - RNA, 32 nt, Human
ccugggaggcagaguuuacagugagccgagau

SEQ ID NO: 382644 - RNA, 23 nt, Human
ccugggaggcagaguuugcagug

SEQ ID NO: 382645 - RNA, 24 nt, Human
ccugggaggcagaguuugcaguga

SEQ ID NO: 382646 - RNA, 32 nt, Human
ccugggaggcagaguuugcagugagccgagag

SEQ ID NO: 382647 - RNA, 32 nt, Human
ccugggaggcagaguuugcagugagcggagau

SEQ ID NO: 382648 - RNA, 23 nt, Human
ccugggaggcagauguugcagug

SEQ ID NO: 382649 - RNA, 24 nt, Human
ccugggaggcagauguugcaguga

SEQ ID NO: 382650 - RNA, 32 nt, Human
ccugggaggcagauguugcagugagccgagau

SEQ ID NO: 382651 - RNA, 20 nt, Human
ccugggaggcagauguugug

SEQ ID NO: 382652 - RNA, 24 nt, Human
ccugggaggcagauguugugguga

SEQ ID NO: 382653 - RNA, 19 nt, Human
ccugggaggcagcaucugg

SEQ ID NO: 382654 - RNA, 32 nt, Human
ccugggaggcagcaucugggggcaguggauag

SEQ ID NO: 382655 - RNA, 22 nt, Human
ccugggaggcagcgguugcagu

SEQ ID NO: 382656 - RNA, 19 nt, Human
ccugggaggcaggaggcgg

SEQ ID NO: 382657 - RNA, 21 nt, Human
ccugggaggcagggguugcag

SEQ ID NO: 382658 - RNA, 23 nt, Human
ccugggaggcagggguugcagug

SEQ ID NO: 382659 - RNA, 24 nt, Human
ccugggaggcagggguugcaguga

SEQ ID NO: 382660 - RNA, 32 nt, Human
ccugggaggcagggguugcagugagcugagac

SEQ ID NO: 382661 - RNA, 32 nt, Human
ccugggaggcauagguugcagugagccgagau

SEQ ID NO: 382662 - RNA, 26 nt, Human
ccugggaggcauuugggguugcagga

SEQ ID NO: 382663 - RNA, 32 nt, Human
ccugggaggccaagguugcagugagccgagau

SEQ ID NO: 382664 - RNA, 22 nt, Human
ccugggaggccucugcuuguca

SEQ ID NO: 382665 - RNA, 23 nt, Human
ccugggaggcgaagauugcagug

SEQ ID NO: 382666 - RNA, 24 nt, Human
ccugggaggcgaagauugcaguga

SEQ ID NO: 382667 - RNA, 32 nt, Human
ccugggaggcgaagauugcagugagcugaaau

SEQ ID NO: 382668 - RNA, 23 nt, Human
ccugggaggcgaagguugcagug

SEQ ID NO: 382669 - RNA, 24 nt, Human
ccugggaggcgaagguugcaguga

SEQ ID NO: 382670 - RNA, 32 nt, Human
ccugggaggcgaagguugcagugagccaagau

SEQ ID NO: 382671 - RNA, 32 nt, Human
ccugggaggcgaagguugcagugagcugagau

SEQ ID NO: 382672 - RNA, 24 nt, Human
ccugggaggcgcagguugcaggga

SEQ ID NO: 382673 - RNA, 23 nt, Human
ccugggaggcggaaguugcagug

SEQ ID NO: 382674 - RNA, 24 nt, Human
ccugggaggcggaaguugcaguga

SEQ ID NO: 382675 - RNA, 32 nt, Human
ccugggaggcggaaguugcagugagccaagau

SEQ ID NO: 382676 - RNA, 32 nt, Human
ccugggaggcggaaguugcagugagccgagau

SEQ ID NO: 382677 - RNA, 32 nt, Human
ccugggaggcggaaguugcagugagcugagau

SEQ ID NO: 382678 - RNA, 23 nt, Human
ccugggaggcggagaguacagug

SEQ ID NO: 382679 - RNA, 24 nt, Human
ccugggaggcggagaguacaguga

SEQ ID NO: 382680 - RNA, 32 nt, Human
ccugggaggcggagaguacagugagccaagau

SEQ ID NO: 382681 - RNA, 23 nt, Human
ccugggaggcggagauugcagug

SEQ ID NO: 382682 - RNA, 24 nt, Human
ccugggaggcggagauugcaguga

SEQ ID NO: 382683 - RNA, 32 nt, Human
ccugggaggcggagauugcagugaaccaagau

SEQ ID NO: 382684 - RNA, 32 nt, Human
ccugggaggcggagauugcagugagccgagau

SEQ ID NO: 382685 - RNA, 32 nt, Human
ccugggaggcggagauugcggugagccuagau

SEQ ID NO: 382686 - RNA, 23 nt, Human
ccugggaggcggagcuuacagug

SEQ ID NO: 382687 - RNA, 24 nt, Human
ccugggaggcggagcuuacaguga

SEQ ID NO: 382688 - RNA, 32 nt, Human
ccugggaggcggagcuuacagugaaccgagau

SEQ ID NO: 382689 - RNA, 24 nt, Human
ccugggaggcggagcuugcaauga

SEQ ID NO: 382690 - RNA, 22 nt, Human
ccugggaggcggagcuugcagu

SEQ ID NO: 382691 - RNA, 24 nt, Human
ccugggaggcggagcuugcaguaa

SEQ ID NO: 382692 - RNA, 32 nt, Human
ccugggaggcggagcuugcaguaagccgagac

SEQ ID NO: 382693 - RNA, 23 nt, Human
ccugggaggcggagcuugcagug

SEQ ID NO: 382694 - RNA, 24 nt, Human
ccugggaggcggagcuugcaguga

SEQ ID NO: 382695 - RNA, 32 nt, Human
ccugggaggcggagcuugcagugagccaaggu

SEQ ID NO: 382696 - RNA, 32 nt, Human
ccugggaggcggagcuugcagugagcccagau

SEQ ID NO: 382697 - RNA, 32 nt, Human
ccugggaggcggagcuugcagugagccgagac

SEQ ID NO: 382698 - RNA, 32 nt, Human
ccugggaggcggagcuugcagugagccgagau

SEQ ID NO: 382699 - RNA, 32 nt, Human
ccugggaggcggagcuugcagugagcugaaau

SEQ ID NO: 382700 - RNA, 32 nt, Human
ccugggaggcggagcuugcagugagcugagau

SEQ ID NO: 382701 - RNA, 23 nt, Human
ccugggaggcggagcuugcggug

SEQ ID NO: 382702 - RNA, 24 nt, Human
ccugggaggcggagcuugcgguga

SEQ ID NO: 382703 - RNA, 32 nt, Human
ccugggaggcggaggagguugcagugaacuga

SEQ ID NO: 382704 - RNA, 23 nt, Human
ccugggaggcggaggcugcagug

SEQ ID NO: 382705 - RNA, 24 nt, Human
ccugggaggcggaggcugcaguga

SEQ ID NO: 382706 - RNA, 32 nt, Human
ccugggaggcggaggcugcagugagccgagau

SEQ ID NO: 382707 - RNA, 32 nt, Human
ccugggaggcggaggcugcagugagcugggau

SEQ ID NO: 382708 - RNA, 21 nt, Human
ccugggaggcggagggugcgg

SEQ ID NO: 382709 - RNA, 23 nt, Human
ccugggaggcggagggugcggug

SEQ ID NO: 382710 - RNA, 24 nt, Human
ccugggaggcggagggugcgguga

SEQ ID NO: 382711 - RNA, 18 nt, Human
ccugggaggcggaggugg

SEQ ID NO: 382712 - RNA, 23 nt, Human
ccugggaggcggagguggcagug

SEQ ID NO: 382713 - RNA, 24 nt, Human
ccugggaggcggagguggcaguga

SEQ ID NO: 382714 - RNA, 32 nt, Human
ccugggaggcggagguuccagagagccaagau

SEQ ID NO: 382715 - RNA, 24 nt, Human
ccugggaggcggagguugcaauga

SEQ ID NO: 382716 - RNA, 32 nt, Human
ccugggaggcggagguugcaaugagccgagau

SEQ ID NO: 382717 - RNA, 24 nt, Human
ccugggaggcggagguugcagcga

SEQ ID NO: 382718 - RNA, 32 nt, Human
ccugggaggcggagguugcagggagcugagau

SEQ ID NO: 382719 - RNA, 22 nt, Human
ccugggaggcggagguugcagu

SEQ ID NO: 382720 - RNA, 32 nt, Human
ccugggaggcggagguugcaguaagcccagau

SEQ ID NO: 382721 - RNA, 32 nt, Human
ccugggaggcggagguugcagucagccaagau

SEQ ID NO: 382722 - RNA, 23 nt, Human
ccugggaggcggagguugcagug

SEQ ID NO: 382723 - RNA, 24 nt, Human
ccugggaggcggagguugcaguga

SEQ ID NO: 382724 - RNA, 32 nt, Human
ccugggaggcggagguugcagugaaccaagau

SEQ ID NO: 382725 - RNA, 32 nt, Human
ccugggaggcggagguugcagugagccaaaau

SEQ ID NO: 382726 - RNA, 32 nt, Human
ccugggaggcggagguugcagugagccaagau

SEQ ID NO: 382727 - RNA, 32 nt, Human
ccugggaggcggagguugcagugagccacugc

SEQ ID NO: 382728 - RNA, 32 nt, Human
ccugggaggcggagguugcagugagccgagac

SEQ ID NO: 382729 - RNA, 32 nt, Human
ccugggaggcggagguugcagugagccgagag

SEQ ID NO: 382730 - RNA, 32 nt, Human
ccugggaggcggagguugcagugagccgagau

SEQ ID NO: 382731 - RNA, 32 nt, Human
ccugggaggcggagguugcagugagccgaggu

SEQ ID NO: 382732 - RNA, 32 nt, Human
ccugggaggcggagguugcagugagccgcgau

SEQ ID NO: 382733 - RNA, 32 nt, Human
ccugggaggcggagguugcagugagcgagauc

SEQ ID NO: 382734 - RNA, 32 nt, Human
ccugggaggcggagguugcagugagcggagau

SEQ ID NO: 382735 - RNA, 32 nt, Human
ccugggaggcggagguugcagugagcuaagau

SEQ ID NO: 382736 - RNA, 32 nt, Human
ccugggaggcggagguugcagugagcugaaau

SEQ ID NO: 382737 - RNA, 32 nt, Human
ccugggaggcggagguugcagugagcugagac

SEQ ID NO: 382738 - RNA, 32 nt, Human
ccugggaggcggagguugcagugagcugagau

SEQ ID NO: 382739 - RNA, 32 nt, Human
ccugggaggcggagguugcagugagcuuagau

SEQ ID NO: 382740 - RNA, 32 nt, Human
ccugggaggcggagguugcagugagucgagau

SEQ ID NO: 382741 - RNA, 32 nt, Human
ccugggaggcggagguugcagugaguugagau

SEQ ID NO: 382742 - RNA, 32 nt, Human
ccugggaggcggagguugcaguggccgagauc

SEQ ID NO: 382743 - RNA, 23 nt, Human
ccugggaggcggagguugccgug

SEQ ID NO: 382744 - RNA, 24 nt, Human
ccugggaggcggagguugccguga

SEQ ID NO: 382745 - RNA, 32 nt, Human
ccugggaggcggagguugccgugagccgagau

SEQ ID NO: 382746 - RNA, 22 nt, Human
ccugggaggcggagguugcggu

SEQ ID NO: 382747 - RNA, 32 nt, Human
ccugggaggcggagguugcggucagcugagau

SEQ ID NO: 382748 - RNA, 23 nt, Human
ccugggaggcggagguugcggug

SEQ ID NO: 382749 - RNA, 24 nt, Human
ccugggaggcggagguugcgguga

SEQ ID NO: 382750 - RNA, 32 nt, Human
ccugggaggcggagguugcggugagcugagau

SEQ ID NO: 382751 - RNA, 23 nt, Human
ccugggaggcggagguugcugug

SEQ ID NO: 382752 - RNA, 24 nt, Human
ccugggaggcggagguugcuguga

SEQ ID NO: 382753 - RNA, 32 nt, Human
ccugggaggcggagguugcugugagcugagau

SEQ ID NO: 382754 - RNA, 23 nt, Human
ccugggaggcggagguuguagug

SEQ ID NO: 382755 - RNA, 32 nt, Human
ccugggaggcggagguuguagugagccaagau

SEQ ID NO: 382756 - RNA, 32 nt, Human
ccugggaggcggagguuguagugagccaaggu

SEQ ID NO: 382757 - RNA, 32 nt, Human
ccugggaggcggagguuguagugagccgagau

SEQ ID NO: 382758 - RNA, 20 nt, Human
ccugggaggcggagguugug

SEQ ID NO: 382759 - RNA, 24 nt, Human
ccugggaggcggagguugugauga

SEQ ID NO: 382760 - RNA, 32 nt, Human
ccugggaggcggagguugugaugagccaagau

SEQ ID NO: 382761 - RNA, 23 nt, Human
ccugggaggcggagguuguggug

SEQ ID NO: 382762 - RNA, 32 nt, Human
ccugggaggcggagguuguggugagccaagau

SEQ ID NO: 382763 - RNA, 32 nt, Human
ccugggaggcggagguuguggugagccgagau

SEQ ID NO: 382764 - RNA, 23 nt, Human
ccugggaggcggaguuugcagug

SEQ ID NO: 382765 - RNA, 24 nt, Human
ccugggaggcggaguuugcaguga

SEQ ID NO: 382766 - RNA, 22 nt, Human
ccugggaggcggaugacggugg

SEQ ID NO: 382767 - RNA, 23 nt, Human
ccugggaggcggauguugaagug

SEQ ID NO: 382768 - RNA, 24 nt, Human
ccugggaggcggauguugaaguga

SEQ ID NO: 382769 - RNA, 32 nt, Human
ccugggaggcggauguugaagugagcugagau

SEQ ID NO: 382770 - RNA, 23 nt, Human
ccugggaggcgggcgcggcagga

SEQ ID NO: 382771 - RNA, 24 nt, Human
ccugggaggcgggggccggcggga

SEQ ID NO: 382772 - RNA, 22 nt, Human
ccugggaggcgggggguugcag

SEQ ID NO: 382773 - RNA, 25 nt, Human
ccugggaggcgggggguugcaguga

SEQ ID NO: 382774 - RNA, 23 nt, Human
ccugggaggcugaaguugcagug

SEQ ID NO: 382775 - RNA, 24 nt, Human
ccugggaggcugaaguugcaguga

SEQ ID NO: 382776 - RNA, 32 nt, Human
ccugggaggcugaaguugcagugagccgagau

SEQ ID NO: 382777 - RNA, 32 nt, Human
ccugggaggcugagcuugcagugagcugagau

SEQ ID NO: 382778 - RNA, 23 nt, Human
ccugggaggcuggugggaggcag

SEQ ID NO: 382779 - RNA, 32 nt, Human
ccugggagggagaaggaguuggagcucaaguu

SEQ ID NO: 382780 - RNA, 32 nt, Human
ccugggagggagaaggggcuggagagggccug

SEQ ID NO: 382781 - RNA, 18 nt, Human
ccugggagggagugaugg

SEQ ID NO: 382782 - RNA, 24 nt, Human
ccugggagggcggagguugcagug

SEQ ID NO: 382783 - RNA, 25 nt, Human
ccugggagggcggagguugcaguga

SEQ ID NO: 382784 - RNA, 32 nt, Human
ccugggagggcggagguugcagugagccagga

SEQ ID NO: 382785 - RNA, 23 nt, Human
ccugggagggggagguugcagug

SEQ ID NO: 382786 - RNA, 24 nt, Human
ccugggagggggagguugcaguga

SEQ ID NO: 382787 - RNA, 24 nt, Human
ccugggagggggagguugccguga

SEQ ID NO: 382788 - RNA, 23 nt, Human
ccugggagguacagguugcagug

SEQ ID NO: 382789 - RNA, 24 nt, Human
ccugggagguacagguugcaguga

SEQ ID NO: 382790 - RNA, 24 nt, Human
ccugggagguagaaguugcaguga

SEQ ID NO: 382791 - RNA, 23 nt, Human
ccugggagguagagguugcagug

SEQ ID NO: 382792 - RNA, 24 nt, Human
ccugggagguagagguugcaguga

SEQ ID NO: 382793 - RNA, 32 nt, Human
ccugggagguagagguugcagugagccaauau

SEQ ID NO: 382794 - RNA, 32 nt, Human
ccugggagguagagguugcagugagccgagac

SEQ ID NO: 382795 - RNA, 32 nt, Human
ccugggagguagagguugcagugagccgagau

SEQ ID NO: 382796 - RNA, 22 nt, Human
ccugggaggucaaagcugcagu

SEQ ID NO: 382797 - RNA, 24 nt, Human
ccugggaggucaagauugcaguga

SEQ ID NO: 382798 - RNA, 22 nt, Human
ccugggaggucaaggcugcagu

SEQ ID NO: 382799 - RNA, 24 nt, Human
ccugggaggucaaggcugcaguga

SEQ ID NO: 382800 - RNA, 24 nt, Human
ccugggaggucgaggcugcaguga

SEQ ID NO: 382801 - RNA, 32 nt, Human
ccugggaggucgaggcugcagugagcugugau

SEQ ID NO: 382802 - RNA, 24 nt, Human
ccugggaggucgaggcuguaguga

SEQ ID NO: 382803 - RNA, 24 nt, Human
ccugggaggugaagguugcugugg

SEQ ID NO: 382804 - RNA, 23 nt, Human
ccugggaggugagguguguguga

SEQ ID NO: 382805 - RNA, 32 nt, Human
ccugggagguggaagcugcagugagccaagau

SEQ ID NO: 382806 - RNA, 23 nt, Human
ccugggagguggaaguugcagug

SEQ ID NO: 382807 - RNA, 24 nt, Human
ccugggagguggaaguugcaguga

SEQ ID NO: 382808 - RNA, 32 nt, Human
ccugggagguggaaguugcagugagccaagau

SEQ ID NO: 382809 - RNA, 32 nt, Human
ccugggagguggaaguugcagugagccgagau

SEQ ID NO: 382810 - RNA, 32 nt, Human
ccugggagguggaaguugcagugagcugagau

SEQ ID NO: 382811 - RNA, 32 nt, Human
ccugggagguggagacugcagugagccgagau

SEQ ID NO: 382812 - RNA, 23 nt, Human
ccugggagguggagauugcagug

SEQ ID NO: 382813 - RNA, 24 nt, Human
ccugggagguggagauugcaguga

SEQ ID NO: 382814 - RNA, 32 nt, Human
ccugggagguggagauugcagugagcccagau

SEQ ID NO: 382815 - RNA, 32 nt, Human
ccugggagguggagauugcagugagucaagau

SEQ ID NO: 382816 - RNA, 24 nt, Human
ccugggagguggagcuugcaguga

SEQ ID NO: 382817 - RNA, 32 nt, Human
ccugggagguggagcuugcagugaaccgagau

SEQ ID NO: 382818 - RNA, 32 nt, Human
ccugggagguggagcuugcagugagccgagau

SEQ ID NO: 382819 - RNA, 32 nt, Human
ccugggagguggagcuugcagugagcggacau

SEQ ID NO: 382820 - RNA, 32 nt, Human
ccugggagguggagcuugcagugagcugagau

SEQ ID NO: 382821 - RNA, 32 nt, Human
  misc_feature (21)..(21): n is a, c, g or u
ccugggagguggagcuugcanugagccaaggu

SEQ ID NO: 382822 - RNA, 32 nt, Human
ccugggagguggaggcagugagcugagaucgu

SEQ ID NO: 382823 - RNA, 23 nt, Human
ccugggagguggaggcuacagug

SEQ ID NO: 382824 - RNA, 24 nt, Human
ccugggagguggaggcuacaguga

SEQ ID NO: 382825 - RNA, 32 nt, Human
ccugggagguggaggcuacagugagcugagau

SEQ ID NO: 382826 - RNA, 24 nt, Human
ccugggagguggagggagacagga

SEQ ID NO: 382827 - RNA, 32 nt, Human
ccugggagguggagguggcagugagccgagau

SEQ ID NO: 382828 - RNA, 32 nt, Human
ccugggagguggagguuacagugagccgagau

SEQ ID NO: 382829 - RNA, 20 nt, Human
ccugggagguggagguugca

SEQ ID NO: 382830 - RNA, 24 nt, Human
ccugggagguggagguugcaauga

SEQ ID NO: 382831 - RNA, 24 nt, Human
ccugggagguggagguugcagcga

SEQ ID NO: 382832 - RNA, 22 nt, Human
ccugggagguggagguugcagu

SEQ ID NO: 382833 - RNA, 23 nt, Human
ccugggagguggagguugcagug

SEQ ID NO: 382834 - RNA, 24 nt, Human
ccugggagguggagguugcaguga

SEQ ID NO: 382835 - RNA, 32 nt, Human
ccugggagguggagguugcagugagcagagac

SEQ ID NO: 382836 - RNA, 32 nt, Human
ccugggagguggagguugcagugagcagagau

SEQ ID NO: 382837 - RNA, 32 nt, Human
ccugggagguggagguugcagugagccaagau

SEQ ID NO: 382838 - RNA, 32 nt, Human
ccugggagguggagguugcagugagccgagaa

SEQ ID NO: 382839 - RNA, 32 nt, Human
ccugggagguggagguugcagugagccgagau

SEQ ID NO: 382840 - RNA, 32 nt, Human
ccugggagguggagguugcagugagccgagcu

SEQ ID NO: 382841 - RNA, 32 nt, Human
ccugggagguggagguugcagugagcuaagau

SEQ ID NO: 382842 - RNA, 32 nt, Human
ccugggagguggagguugcagugagcugagau

SEQ ID NO: 382843 - RNA, 32 nt, Human
ccugggagguggagguugcagugagcugagcu

SEQ ID NO: 382844 - RNA, 32 nt, Human
ccugggagguggagguugcagugagcugaggu

SEQ ID NO: 382845 - RNA, 32 nt, Human
ccugggagguggagguugcagugagcugugau

SEQ ID NO: 382846 - RNA, 32 nt, Human
ccugggagguggagguugcagugagucgagau

SEQ ID NO: 382847 - RNA, 32 nt, Human
ccugggagguggagguugcagugaguggagau

SEQ ID NO: 382848 - RNA, 32 nt, Human
ccugggagguggagguugcagugaguugagau

SEQ ID NO: 382849 - RNA, 24 nt, Human
ccugggagguggagguugcagugg

SEQ ID NO: 382850 - RNA, 32 nt, Human
ccugggagguggagguugcagugggccaagau

SEQ ID NO: 382851 - RNA, 32 nt, Human
ccugggagguggagguugcagugggcuaagau

SEQ ID NO: 382852 - RNA, 32 nt, Human
ccugggagguggagguugcagugggcugagau

SEQ ID NO: 382853 - RNA, 24 nt, Human
ccugggagguggagguugccagug

SEQ ID NO: 382854 - RNA, 32 nt, Human
ccugggagguggagguugccagugagucgaga

SEQ ID NO: 382855 - RNA, 23 nt, Human
ccugggagguggagguugcggug

SEQ ID NO: 382856 - RNA, 24 nt, Human
ccugggagguggagguugcgguga

SEQ ID NO: 382857 - RNA, 24 nt, Human
ccugggagguggagguugcuguga

SEQ ID NO: 382858 - RNA, 24 nt, Human
ccugggagguggagguuucaguga

SEQ ID NO: 382859 - RNA, 32 nt, Human
ccugggagguggagguuucagugagccaagau

SEQ ID NO: 382860 - RNA, 32 nt, Human
ccugggagguggagguuucagugagcugggau

SEQ ID NO: 382861 - RNA, 22 nt, Human
ccugggagguggaguugcagug

SEQ ID NO: 382862 - RNA, 32 nt, Human
ccugggagguggaguuugcagugagcuaagau

SEQ ID NO: 382863 - RNA, 24 nt, Human
ccugggagguggauguugcaguga

SEQ ID NO: 382864 - RNA, 32 nt, Human
ccugggagguggauguugcagugagcugagac

SEQ ID NO: 382865 - RNA, 32 nt, Human
ccugggagguggauguugcagugagcugagau

SEQ ID NO: 382866 - RNA, 21 nt, Human
ccugggagguggggguugcag

SEQ ID NO: 382867 - RNA, 24 nt, Human
ccugggagguggggguugcaggga

SEQ ID NO: 382868 - RNA, 32 nt, Human
ccugggagguggggguuucagugagcugagau

SEQ ID NO: 382869 - RNA, 32 nt, Human
ccugggaggugggucuccuaagccucaggcac

SEQ ID NO: 382870 - RNA, 23 nt, Human
ccugggagguggugguugcagug

SEQ ID NO: 382871 - RNA, 24 nt, Human
ccugggagguggugguugcaguga

SEQ ID NO: 382872 - RNA, 32 nt, Human
ccugggagguggugguugcagugagcugagau

SEQ ID NO: 382873 - RNA, 23 nt, Human
ccugggagguugaggcugcagug

SEQ ID NO: 382874 - RNA, 24 nt, Human
ccugggagguugaggcugcaguga

SEQ ID NO: 382875 - RNA, 32 nt, Human
ccugggagguugaggcugcagugagccaugau

SEQ ID NO: 382876 - RNA, 32 nt, Human
ccugggagguugaggcugcagugagcuguguu

SEQ ID NO: 382877 - RNA, 24 nt, Human
ccugggagguugugguugcaguga

SEQ ID NO: 382878 - RNA, 18 nt, Human
ccugggaguagaaggugg

SEQ ID NO: 382879 - RNA, 32 nt, Human
ccugggaguagacagucuucuacuuucuaaaa

SEQ ID NO: 382880 - RNA, 24 nt, Human
ccugggagucaaagguugcaguga

SEQ ID NO: 382881 - RNA, 32 nt, Human
ccugggagucagcucuggaggguggccugggg

SEQ ID NO: 382882 - RNA, 32 nt, Human
ccugggagucccggaggccaggcugcacaccu

SEQ ID NO: 382883 - RNA, 23 nt, Human
ccugggagugagggugggugugg

SEQ ID NO: 382884 - RNA, 32 nt, Human
ccugggagugcuaugggagacuggggucuauu

SEQ ID NO: 382885 - RNA, 25 nt, Human
ccugggaguggaacagcagcaguua

SEQ ID NO: 382886 - RNA, 19 nt, Human
ccugggagugggggugcag

SEQ ID NO: 382887 - RNA, 18 nt, Human
ccugggaguguaauaugu

SEQ ID NO: 382888 - RNA, 23 nt, Human
ccugggaguuagagguugcagug

SEQ ID NO: 382889 - RNA, 24 nt, Human
ccugggaguuagagguugcaguga

SEQ ID NO: 382890 - RNA, 24 nt, Human
ccugggaguucgaggcugcaguga

SEQ ID NO: 382891 - RNA, 32 nt, Human
ccugggaguucgaggcugcagugagcaaugau

SEQ ID NO: 382892 - RNA, 23 nt, Human
ccugggaguuggagguugcagug

SEQ ID NO: 382893 - RNA, 24 nt, Human
ccugggaguuggagguugcaguga

SEQ ID NO: 382894 - RNA, 24 nt, Human
ccugggaguuugaggcugcaguga

SEQ ID NO: 382895 - RNA, 32 nt, Human
ccugggauacacuggauuuagcaaagaucguu

SEQ ID NO: 382896 - RNA, 18 nt, Human
ccugggauaugaugugug

SEQ ID NO: 382897 - RNA, 32 nt, Human
ccugggaucacacugagcuugccacaucccca

SEQ ID NO: 382898 - RNA, 19 nt, Human
ccugggaucagccugacca

SEQ ID NO: 382899 - RNA, 32 nt, Human
ccugggaucaggaguccaagaucagccuggcc

SEQ ID NO: 382900 - RNA, 32 nt, Human
ccugggaucccucugucaaccccacgccuuuu

SEQ ID NO: 382901 - RNA, 32 nt, Human
ccugggaucugaguuucugcaggucauuugua

SEQ ID NO: 382902 - RNA, 32 nt, Human
ccugggauggaaggugaagucuugccaaagaa

SEQ ID NO: 382903 - RNA, 32 nt, Human
ccugggauggagcccaucucuccaguuccucc

SEQ ID NO: 382904 - RNA, 32 nt, Human
ccugggauggggaagagaguuauacagcaggg

SEQ ID NO: 382905 - RNA, 19 nt, Human
ccugggauggggcaugugg

SEQ ID NO: 382906 - RNA, 32 nt, Human
ccugggaugguggaguucuuuccaaggauacc

SEQ ID NO: 382907 - RNA, 32 nt, Human
ccugggauguaggcgcuggagcuccaguuccc

SEQ ID NO: 382908 - RNA, 24 nt, Human
ccugggauguggagguugcaguga

SEQ ID NO: 382909 - RNA, 32 nt, Human
ccugggauguggagguugcagugagccaagau

SEQ ID NO: 382910 - RNA, 32 nt, Human
ccugggauuaggugaaaaaugucuagcaaaag

SEQ ID NO: 382911 - RNA, 32 nt, Human
ccugggauucauggccaccacccggcucgacg

SEQ ID NO: 382912 - RNA, 22 nt, Human
ccugggauucccaacaggugga

SEQ ID NO: 382913 - RNA, 32 nt, Human
ccugggauuccuagccgaggccagucugcugc

SEQ ID NO: 382914 - RNA, 20 nt, Human
ccugggauugggcagugugg

SEQ ID NO: 382915 - RNA, 32 nt, Human
ccugggcaaaauagcaagaccgugccucuaga

SEQ ID NO: 382916 - RNA, 32 nt, Human
ccugggcaaaauagcaagaccuugccucuaga

SEQ ID NO: 382917 - RNA, 32 nt, Human
ccugggcaaagaccaagagagcaggggcagaa

SEQ ID NO: 382918 - RNA, 32 nt, Human
ccugggcaacaaagcaagacccugucucuuga

SEQ ID NO: 382919 - RNA, 32 nt, Human
ccugggcaacaaagcgagacccugucucaaaa

SEQ ID NO: 382920 - RNA, 29 nt, Human
ccugggcaacaacagugaaacuccgucuc

SEQ ID NO: 382921 - RNA, 28 nt, Human
ccugggcaacaagagugaaacuccgucu

SEQ ID NO: 382922 - RNA, 32 nt, Human
ccugggcaacaagagugaaacuccgucuuaaa

SEQ ID NO: 382923 - RNA, 32 nt, Human
ccugggcaacaagagugaaacucugucuuaaa

SEQ ID NO: 382924 - RNA, 32 nt, Human
ccugggcaacacaagacccugucucuacaaau

SEQ ID NO: 382925 - RNA, 32 nt, Human
ccugggcaacacagagagacccugucucaaaa

SEQ ID NO: 382926 - RNA, 31 nt, Human
ccugggcaacacagaggacccucaccucuac

SEQ ID NO: 382927 - RNA, 32 nt, Human
ccugggcaacacagcaagacaccgcaucuaca

SEQ ID NO: 382928 - RNA, 32 nt, Human
ccugggcaacacagcaagaccccaucuaagaa

SEQ ID NO: 382929 - RNA, 32 nt, Human
ccugggcaacacagcaagacccugucauuacc

SEQ ID NO: 382930 - RNA, 32 nt, Human
ccugggcaacacagcaagacccugugucaaaa

SEQ ID NO: 382931 - RNA, 28 nt, Human
ccugggcaacacagcaagacucugucgc

SEQ ID NO: 382932 - RNA, 27 nt, Human
ccugggcaacacagcaagacucugucu

SEQ ID NO: 382933 - RNA, 32 nt, Human
ccugggcaacacagcaagacucugucucaaaa

SEQ ID NO: 382934 - RNA, 32 nt, Human
ccugggcaacacagcaagauccugucuaaaaa

SEQ ID NO: 382935 - RNA, 32 nt, Human
ccugggcaacacagcaagauccugucuuugua

SEQ ID NO: 382936 - RNA, 32 nt, Human
ccugggcaacacagcgagaacuugucucuauu

SEQ ID NO: 382937 - RNA, 32 nt, Human
ccugggcaacacagcgagaccccaucucuuaa

SEQ ID NO: 382938 - RNA, 32 nt, Human
ccugggcaacacagcgagacuccgucucaaaa

SEQ ID NO: 382939 - RNA, 32 nt, Human
ccugggcaacacagcgagacuccgucucaagg

SEQ ID NO: 382940 - RNA, 32 nt, Human
ccugggcaacacagcgagacuccgucucgagg

SEQ ID NO: 382941 - RNA, 32 nt, Human
ccugggcaacacagcgggaccccgacuccauu

SEQ ID NO: 382942 - RNA, 32 nt, Human
ccugggcaacacaggaagaccccgucucuacc

SEQ ID NO: 382943 - RNA, 32 nt, Human
ccugggcaacacagggagaccccgucucuaua

SEQ ID NO: 382944 - RNA, 32 nt, Human
ccugggcaacacagggagacucugucucuaca

SEQ ID NO: 382945 - RNA, 32 nt, Human
ccugggcaacacaguaagacccuguuucuaca

SEQ ID NO: 382946 - RNA, 26 nt, Human
ccugggcaacacagugagacccuguc

SEQ ID NO: 382947 - RNA, 26 nt, Human
ccugggcaacacagugagacucuguc

SEQ ID NO: 382948 - RNA, 32 nt, Human
ccugggcaacacagugagacucugucucaaaa

SEQ ID NO: 382949 - RNA, 32 nt, Human
ccugggcaacacagugagacuucaucuccaca

SEQ ID NO: 382950 - RNA, 32 nt, Human
ccugggcaacacagugaggcccccuacccaca

SEQ ID NO: 382951 - RNA, 32 nt, Human
ccugggcaacacagugagugagacccugucuc

SEQ ID NO: 382952 - RNA, 32 nt, Human
ccugggcaacagagcaagacaccgucuuaaaa

SEQ ID NO: 382953 - RNA, 32 nt, Human
ccugggcaacagagcaagaccccauccuccac

SEQ ID NO: 382954 - RNA, 28 nt, Human
ccugggcaacagagcaagacccugucuc

SEQ ID NO: 382955 - RNA, 32 nt, Human
ccugggcaacagagcaagacccugucucaaaa

SEQ ID NO: 382956 - RNA, 32 nt, Human
ccugggcaacagagcaagacccugucucagag

SEQ ID NO: 382957 - RNA, 32 nt, Human
ccugggcaacagagcaagacccugucucucaa

SEQ ID NO: 382958 - RNA, 32 nt, Human
ccugggcaacagagcaagacccugucugucuc

SEQ ID NO: 382959 - RNA, 28 nt, Human
ccugggcaacagagcaagaccucgucuc

SEQ ID NO: 382960 - RNA, 32 nt, Human
ccugggcaacagagcaagaccuugucucaaaa

SEQ ID NO: 382961 - RNA, 32 nt, Human
ccugggcaacagagcaagacuccaugucaagg

SEQ ID NO: 382962 - RNA, 28 nt, Human
ccugggcaacagagcaagacuccgucuc

SEQ ID NO: 382963 - RNA, 28 nt, Human
ccugggcaacagagcaagacucggucuc

SEQ ID NO: 382964 - RNA, 32 nt, Human
ccugggcaacagagcaagacucugccucaaaa

SEQ ID NO: 382965 - RNA, 28 nt, Human
ccugggcaacagagcaagacucugucuc

SEQ ID NO: 382966 - RNA, 32 nt, Human
ccugggcaacagagcaagacucugucucaaaa

SEQ ID NO: 382967 - RNA, 32 nt, Human
ccugggcaacagagcaagacucugucucagga

SEQ ID NO: 382968 - RNA, 32 nt, Human
ccugggcaacagagcaagacucugucuccaaa

SEQ ID NO: 382969 - RNA, 32 nt, Human
ccugggcaacagagcaagacucugucuucaaa

SEQ ID NO: 382970 - RNA, 32 nt, Human
ccugggcaacagagcaagacugccucaaaaca

SEQ ID NO: 382971 - RNA, 32 nt, Human
ccugggcaacagagccagacccugccucaaaa

SEQ ID NO: 382972 - RNA, 32 nt, Human
ccugggcaacagagccagacccugucuaaaaa

SEQ ID NO: 382973 - RNA, 32 nt, Human
ccugggcaacagagcgagaccaucucuuaaaa

SEQ ID NO: 382974 - RNA, 28 nt, Human
ccugggcaacagagcgagacccugucuc

SEQ ID NO: 382975 - RNA, 32 nt, Human
ccugggcaacagagcgagacccugucuccaaa

SEQ ID NO: 382976 - RNA, 32 nt, Human
ccugggcaacagaggaagacugccucaaacaa

SEQ ID NO: 382977 - RNA, 32 nt, Human
ccugggcaacagagugagacccugccucaaaa

SEQ ID NO: 382978 - RNA, 32 nt, Human
ccugggcaacagagugagacccugucuaaaaa

SEQ ID NO: 382979 - RNA, 32 nt, Human
ccugggcaacagagugagacccugucucaaaa

SEQ ID NO: 382980 - RNA, 32 nt, Human
ccugggcaacagagugagacccugucucaaac

SEQ ID NO: 382981 - RNA, 32 nt, Human
ccugggcaacagagugagacccugucuccaaa

SEQ ID NO: 382982 - RNA, 29 nt, Human
ccugggcaacagagugagacccugucucu

SEQ ID NO: 382983 - RNA, 32 nt, Human
ccugggcaacagagugagacccugucucuaua

SEQ ID NO: 382984 - RNA, 32 nt, Human
ccugggcaacagagugagacccugucucugaa

SEQ ID NO: 382985 - RNA, 32 nt, Human
ccugggcaacagaucaagacccugucucaaaa

SEQ ID NO: 382986 - RNA, 32 nt, Human
ccugggcaacagcaagaccucaucucuacaaa

SEQ ID NO: 382987 - RNA, 32 nt, Human
ccugggcaacagcagcgaaacuccaucucaaa

SEQ ID NO: 382988 - RNA, 29 nt, Human
ccugggcaacagcguaagacccugucucc

SEQ ID NO: 382989 - RNA, 31 nt, Human
ccugggcaacauagagagacccugucucugu

SEQ ID NO: 382990 - RNA, 22 nt, Human
ccugggcaacauagcaagaccc

SEQ ID NO: 382991 - RNA, 32 nt, Human
ccugggcaacauagcaagaccccaucucuaca

SEQ ID NO: 382992 - RNA, 32 nt, Human
ccugggcaacauagcaagaccccaucucuacc

SEQ ID NO: 382993 - RNA, 32 nt, Human
ccugggcaacauagcaagaccccaucucuaua

SEQ ID NO: 382994 - RNA, 32 nt, Human
ccugggcaacauagcaagacccccaccaucuc

SEQ ID NO: 382995 - RNA, 32 nt, Human
ccugggcaacauagcaagacccccaucucugc

SEQ ID NO: 382996 - RNA, 32 nt, Human
ccugggcaacauagcaagaccccgucucuuaa

SEQ ID NO: 382997 - RNA, 32 nt, Human
ccugggcaacauagcaagacccugucucuaaa

SEQ ID NO: 382998 - RNA, 32 nt, Human
ccugggcaacauagcaagacccugucucuaca

SEQ ID NO: 382999 - RNA, 32 nt, Human
ccugggcaacauagcaagacccugucucuauu

SEQ ID NO: 383000 - RNA, 32 nt, Human
ccugggcaacauagcaagacccugucucuuaa

SEQ ID NO: 383001 - RNA, 28 nt, Human
ccugggcaacauagcaagacccugucuu

SEQ ID NO: 383002 - RNA, 32 nt, Human
ccugggcaacauagcaagacucugucucaaaa

SEQ ID NO: 383003 - RNA, 32 nt, Human
ccugggcaacauagcaagacucugucucugua

SEQ ID NO: 383004 - RNA, 22 nt, Human
ccugggcaacauagcgagaccc

SEQ ID NO: 383005 - RNA, 32 nt, Human
ccugggcaacauaggaagacccugucucuaca

SEQ ID NO: 383006 - RNA, 32 nt, Human
ccugggcaacauaguaagacccugucucuauu

SEQ ID NO: 383007 - RNA, 32 nt, Human
ccugggcaacauagugagacccugccucaugg

SEQ ID NO: 383008 - RNA, 31 nt, Human
ccugggcaacauagugagacccugucucuac

SEQ ID NO: 383009 - RNA, 32 nt, Human
ccugggcaacauggcaagacccugucucuacu

SEQ ID NO: 383010 - RNA, 32 nt, Human
ccugggcaacauggcaagacccugucucuuua

SEQ ID NO: 383011 - RNA, 32 nt, Human
ccugggcaacauggcgagacccugucucuaca

SEQ ID NO: 383012 - RNA, 19 nt, Human
ccugggcaacauggugaaa

SEQ ID NO: 383013 - RNA, 32 nt, Human
ccugggcaacggagcaagacccugucucaaag

SEQ ID NO: 383014 - RNA, 32 nt, Human
ccugggcaacguagcaagaccuugccucuaga

SEQ ID NO: 383015 - RNA, 32 nt, Human
ccugggcaagaacuugaccucccuggacgcag

SEQ ID NO: 383016 - RNA, 32 nt, Human
ccugggcaagauagcaagaccuugccucuaga

SEQ ID NO: 383017 - RNA, 19 nt, Human
ccugggcaagcagggugcu

SEQ ID NO: 383018 - RNA, 30 nt, Human
ccugggcaauaaagugagacccugucacua

SEQ ID NO: 383019 - RNA, 32 nt, Human
ccugggcaauaaagugagacccugucacuaac

SEQ ID NO: 383020 - RNA, 32 nt, Human
ccugggcaauacagugagacccugucucaaaa

SEQ ID NO: 383021 - RNA, 32 nt, Human
ccugggcaauagagcgagacccugucucuuaa

SEQ ID NO: 383022 - RNA, 32 nt, Human
ccugggcaauagaguaagacccugucuaaaaa

SEQ ID NO: 383023 - RNA, 32 nt, Human
ccugggcaauauagcaagaccccauccuuuaa

SEQ ID NO: 383024 - RNA, 27 nt, Human
ccugggcaauauagcaagaccccucac

SEQ ID NO: 383025 - RNA, 32 nt, Human
ccugggcaaucagacacccucuccuuaaaaac

SEQ ID NO: 383026 - RNA, 16 nt, Human
ccugggcacacggcca

SEQ ID NO: 383027 - RNA, 32 nt, Human
ccugggcacacgugcucacucaggcccagcaa

SEQ ID NO: 383028 - RNA, 32 nt, Human
ccugggcacagaagagagcacaggggcaucug

SEQ ID NO: 383029 - RNA, 32 nt, Human
ccugggcacagagagaaaagaauugagacuca

SEQ ID NO: 383030 - RNA, 32 nt, Human
ccugggcacagcugcccuacaugucuguccug

SEQ ID NO: 383031 - RNA, 21 nt, Human
ccugggcacaggcaugggcca

SEQ ID NO: 383032 - RNA, 32 nt, Human
ccugggcacaucugggacuggaauacagaacg

SEQ ID NO: 383033 - RNA, 18 nt, Human
ccugggcacccuccugcc

SEQ ID NO: 383034 - RNA, 32 nt, Human
ccugggcaccgagcuucacccugggugggucu

SEQ ID NO: 383035 - RNA, 32 nt, Human
ccugggcaccuugcagcccugcaccugccugc

SEQ ID NO: 383036 - RNA, 23 nt, Human
ccugggcacgggagggggugggg

SEQ ID NO: 383037 - RNA, 26 nt, Human
ccugggcacucugugccccuccuucc

SEQ ID NO: 383038 - RNA, 32 nt, Human
ccugggcacugccugagcagggcacagucugc

SEQ ID NO: 383039 - RNA, 32 nt, Human
ccugggcagacacucguccaaaccacuggagu

SEQ ID NO: 383040 - RNA, 32 nt, Human
ccugggcagacaggaacacagucucuuucugu

SEQ ID NO: 383041 - RNA, 19 nt, Human
ccugggcagagagaugcag

SEQ ID NO: 383042 - RNA, 32 nt, Human
ccugggcagagcaggcaugagcugggcugugg

SEQ ID NO: 383043 - RNA, 24 nt, Human
ccugggcagaggaaauugcaguga

SEQ ID NO: 383044 - RNA, 32 nt, Human
ccugggcagagguggaggagacacugaagcga

SEQ ID NO: 383045 - RNA, 32 nt, Human
ccugggcagcaccuccgggacugaccuucggc

SEQ ID NO: 383046 - RNA, 28 nt, Human
ccugggcagcagagcaagacucugucuc

SEQ ID NO: 383047 - RNA, 32 nt, Human
ccugggcagcagagcaagacucugucucaaaa

SEQ ID NO: 383048 - RNA, 32 nt, Human
ccugggcagcauacugagacccugccuuuaaa

SEQ ID NO: 383049 - RNA, 32 nt, Human
ccugggcagcauagcaagacacaucccuacaa

SEQ ID NO: 383050 - RNA, 32 nt, Human
ccugggcagcauagugugagacccugucucuu

SEQ ID NO: 383051 - RNA, 18 nt, Human
ccugggcagcccacagua

SEQ ID NO: 383052 - RNA, 32 nt, Human
ccugggcagccugcugggugggccacacucag

SEQ ID NO: 383053 - RNA, 32 nt, Human
ccugggcagcugggugggccugggcagcuggg

SEQ ID NO: 383054 - RNA, 32 nt, Human
ccugggcaggaagcuggcugagccccaagacc

SEQ ID NO: 383055 - RNA, 18 nt, Human
ccugggcaggaggcacag

SEQ ID NO: 383056 - RNA, 19 nt, Human
ccugggcaggaggcuacag

SEQ ID NO: 383057 - RNA, 32 nt, Human
ccugggcagggaccaggccagcgcugcaaccu

SEQ ID NO: 383058 - RNA, 18 nt, Human
ccugggcagggggcgaca

SEQ ID NO: 383059 - RNA, 18 nt, Human
ccugggcaggggguccag

SEQ ID NO: 383060 - RNA, 32 nt, Human
ccugggcagguggcgggaacguugcuggggug

SEQ ID NO: 383061 - RNA, 32 nt, Human
ccugggcagguuuccaacuccugggcucaagu

SEQ ID NO: 383062 - RNA, 32 nt, Human
ccugggcaguauagcaagaccccaucuccauu

SEQ ID NO: 383063 - RNA, 32 nt, Human
ccugggcauagccauggaacccugccaggcug

SEQ ID NO: 383064 - RNA, 22 nt, Human
ccugggcaucaugggaggcaga

SEQ ID NO: 383065 - RNA, 32 nt, Human
ccugggcauccagccccuggaccaugacugcc

SEQ ID NO: 383066 - RNA, 32 nt, Human
ccugggcaucuucuacuaauggccucggcuuc

SEQ ID NO: 383067 - RNA, 32 nt, Human
ccugggcauggugcugggcauggcuggcauag

SEQ ID NO: 383068 - RNA, 32 nt, Human
ccugggcauugaggcauuuccauacaucuucu

SEQ ID NO: 383069 - RNA, 32 nt, Human
ccugggccaacagacccacacacuuagccauu

SEQ ID NO: 383070 - RNA, 23 nt, Human
ccugggccaagacaagcuucccu

SEQ ID NO: 383071 - RNA, 32 nt, Human
ccugggccacaggaaagguaucagcccuuggu

SEQ ID NO: 383072 - RNA, 32 nt, Human
ccugggccacagugcaagacuccaucucaaaa

SEQ ID NO: 383073 - RNA, 32 nt, Human
ccugggccacauagcaagacccugucuccaaa

SEQ ID NO: 383074 - RNA, 32 nt, Human
ccugggccacccucaccgucugccucagacuu

SEQ ID NO: 383075 - RNA, 32 nt, Human
ccugggccaccuggggcaccuuaccaccggag

SEQ ID NO: 383076 - RNA, 21 nt, Human
ccugggccacggcagacaggg

SEQ ID NO: 383077 - RNA, 32 nt, Human
ccugggccacugccauuggguuagucaagaug

SEQ ID NO: 383078 - RNA, 32 nt, Human
ccugggccacugccugcuccagagaguggacc

SEQ ID NO: 383079 - RNA, 32 nt, Human
ccugggccacuggcaucucuggaguguguggg

SEQ ID NO: 383080 - RNA, 27 nt, Human
ccugggccagaaucccggaccccucac

SEQ ID NO: 383081 - RNA, 32 nt, Human
ccugggccaggaggagcugaggcugcagaccc

SEQ ID NO: 383082 - RNA, 32 nt, Human
ccugggccaggccagccagggagaagacaagg

SEQ ID NO: 383083 - RNA, 32 nt, Human
ccugggccaggccaggaaagagacuauuuaag

SEQ ID NO: 383084 - RNA, 19 nt, Human
ccugggccagggacggugg

SEQ ID NO: 383085 - RNA, 32 nt, Human
ccugggccagugucaggccagcaggugcaggg

SEQ ID NO: 383086 - RNA, 31 nt, Human
ccugggccaguguccaucagccaggugcuca

SEQ ID NO: 383087 - RNA, 32 nt, Human
ccugggccauccauuccauuuuguuccacauu

SEQ ID NO: 383088 - RNA, 32 nt, Human
ccugggcccaagugauccuuccaccucagucu

SEQ ID NO: 383089 - RNA, 32 nt, Human
ccugggcccagacagucccccuugaccccagg

SEQ ID NO: 383090 - RNA, 32 nt, Human
ccugggcccaggaguugcaagucucugcuucu

SEQ ID NO: 383091 - RNA, 19 nt, Human
ccugggcccaggcugggga

SEQ ID NO: 383092 - RNA, 32 nt, Human
ccugggcccaggcuggggacagagcccuuguu

SEQ ID NO: 383093 - RNA, 32 nt, Human
ccugggcccagucagcccugcugcucagagug

SEQ ID NO: 383094 - RNA, 32 nt, Human
ccugggcccauccugcccuuguggcccccggc

SEQ ID NO: 383095 - RNA, 32 nt, Human
ccugggcccaucucccugcuuuggucuugccc

SEQ ID NO: 383096 - RNA, 21 nt, Human
ccugggccccagagcucaggg

SEQ ID NO: 383097 - RNA, 19 nt, Human
ccugggcccccuugcuccu

SEQ ID NO: 383098 - RNA, 32 nt, Human
ccugggccccuccacgccuccuggccagacgc

SEQ ID NO: 383099 - RNA, 32 nt, Human
ccugggccccucugggcuucaguuuccccacu

SEQ ID NO: 383100 - RNA, 32 nt, Human
ccugggccccugggcccugcuucucugcuccc

SEQ ID NO: 383101 - RNA, 19 nt, Human
ccugggccccugucgucag

SEQ ID NO: 383102 - RNA, 32 nt, Human
ccugggcccgggacggccgaggcagcagaagc

SEQ ID NO: 383103 - RNA, 32 nt, Human
ccugggcccguccucccuccugauacuguagc

SEQ ID NO: 383104 - RNA, 21 nt, Human
ccugggcccuacacccccaca

SEQ ID NO: 383105 - RNA, 32 nt, Human
ccugggcccugaggccccugcccuagugcaac

SEQ ID NO: 383106 - RNA, 32 nt, Human
ccugggcccugccucuccaugccuguaggagc

SEQ ID NO: 383107 - RNA, 22 nt, Human
ccugggccgaguuuguuuuucc

SEQ ID NO: 383108 - RNA, 32 nt, Human
ccugggccgccuaggcaagacagucgacgcgc

SEQ ID NO: 383109 - RNA, 32 nt, Human
ccugggccgcggugaggccaccagaggcagga

SEQ ID NO: 383110 - RNA, 22 nt, Human
ccugggccggcagggaccccca

SEQ ID NO: 383111 - RNA, 32 nt, Human
ccugggccgggagaggauggccuggucugaau

SEQ ID NO: 383112 - RNA, 32 nt, Human
ccugggccgggcuguagaucagguuugcccac

SEQ ID NO: 383113 - RNA, 22 nt, Human
ccugggccggugaagucacaca

SEQ ID NO: 383114 - RNA, 32 nt, Human
ccugggccguggcugcucacugcguucggacc

SEQ ID NO: 383115 - RNA, 24 nt, Human
ccugggccuaaagcaagaaucuca

SEQ ID NO: 383116 - RNA, 32 nt, Human
ccugggccucacucuugagagauucucauuua

SEQ ID NO: 383117 - RNA, 32 nt, Human
ccugggccuccaccucugugcagggcacagaa

SEQ ID NO: 383118 - RNA, 32 nt, Human
ccugggccuccagggagaugcagcuggcagga

SEQ ID NO: 383119 - RNA, 32 nt, Human
ccugggccuggccagaccagagggcagguuga

SEQ ID NO: 383120 - RNA, 32 nt, Human
ccugggccugggccuugguucuccccaugaca

SEQ ID NO: 383121 - RNA, 32 nt, Human
ccugggccugguccuagcccugccucggccac

SEQ ID NO: 383122 - RNA, 32 nt, Human
ccugggccuguggccgccagagcugcugcggc

SEQ ID NO: 383123 - RNA, 32 nt, Human
ccugggccuguugacccaccagcuuaggagca

SEQ ID NO: 383124 - RNA, 32 nt, Human
ccugggccuucuuuaucuccccaagccauaug

SEQ ID NO: 383125 - RNA, 19 nt, Human
ccugggccuugccuucagg

SEQ ID NO: 383126 - RNA, 32 nt, Human
ccugggccuuucugccuccugauguacaccca

SEQ ID NO: 383127 - RNA, 32 nt, Human
ccugggccuuucuggcucugggaaugaagcgu

SEQ ID NO: 383128 - RNA, 23 nt, Human
ccugggcgaaguggcagagccag

SEQ ID NO: 383129 - RNA, 30 nt, Human
ccuucaggaagccauaauggauggcacaga

SEQ ID NO: 383130 - RNA, 24 nt, Human
ccuucaggaagccccagaacaccc

SEQ ID NO: 383131 - RNA, 26 nt, Human
ccuucaggaagccugugaaaaacgug

SEQ ID NO: 383132 - RNA, 32 nt, Human
ccuucaggaagcugguuccugccaccaacuua

SEQ ID NO: 383133 - RNA, 24 nt, Human
ccuucaggacucaccuggggccug

SEQ ID NO: 383134 - RNA, 32 nt, Human
ccuucaggacucugcgggaggcuggggcccca

SEQ ID NO: 383135 - RNA, 32 nt, Human
ccuucaggacugcccuuuucugccuucucaau

SEQ ID NO: 383136 - RNA, 32 nt, Human
ccuucaggcacaaguaaguuucaagagcaagu

SEQ ID NO: 383137 - RNA, 32 nt, Human
ccuucaggcagcugaaauucaccaagaacagc

SEQ ID NO: 383138 - RNA, 32 nt, Human
ccuucaggccugaauguggcggcugccucugc

SEQ ID NO: 383139 - RNA, 32 nt, Human
ccuucagggagcagagcagagcagguggugga

SEQ ID NO: 383140 - RNA, 32 nt, Human
ccuucagggccugagguuugugguuggcacug

SEQ ID NO: 383141 - RNA, 32 nt, Human
ccuucaggggugcugggauuacaggcaucagc

SEQ ID NO: 383142 - RNA, 32 nt, Human
ccuucaggucugugaugagaaacggaguggcc

SEQ ID NO: 383143 - RNA, 18 nt, Human
ccuucaguccauucccuu

SEQ ID NO: 383144 - RNA, 32 nt, Human
ccuucagucuucuagaaacagagacaagaaag

SEQ ID NO: 383145 - RNA, 32 nt, Human
ccuucagugagguggggacgccuggacccugg

SEQ ID NO: 383146 - RNA, 32 nt, Human
ccuucagugauaucaccacuugcucagucacc

SEQ ID NO: 383147 - RNA, 32 nt, Human
ccuucagugaugugcuuuuggugaaagaauua

SEQ ID NO: 383148 - RNA, 32 nt, Human
ccuucaguggcucucaucaccuucaggaaaag

SEQ ID NO: 383149 - RNA, 32 nt, Human
ccuucaguuccaccugccacuccucaaaccac

SEQ ID NO: 383150 - RNA, 21 nt, Human
ccuucaguuccccaggcuccu

SEQ ID NO: 383151 - RNA, 32 nt, Human
ccuucauacaaccagaagcacacuaauccuua

SEQ ID NO: 383152 - RNA, 32 nt, Human
ccuucaucaaaucccuaucucauuucauuucu

SEQ ID NO: 383153 - RNA, 32 nt, Human
ccuucaucauacaaccucuccuaaccucccug

SEQ ID NO: 383154 - RNA, 32 nt, Human
ccuucaucauuuccugcacucgcugaccacaa

SEQ ID NO: 383155 - RNA, 18 nt, Human
ccuucauccacccacuca

SEQ ID NO: 383156 - RNA, 24 nt, Human
ccuucauccacccacucaccggca

SEQ ID NO: 383157 - RNA, 32 nt, Human
ccuucauccaggcugggcgagguggcucacgc

SEQ ID NO: 383158 - RNA, 32 nt, Human
ccuucauccccagcugcuccuaggacuggccc

SEQ ID NO: 383159 - RNA, 32 nt, Human
ccuucaucccccaagaggaugcggugaaguuu

SEQ ID NO: 383160 - RNA, 32 nt, Human
ccuucauccuguccuugaagaccaccacucua

SEQ ID NO: 383161 - RNA, 32 nt, Human
ccuucauccuguggccaaaggcugcagagccc

SEQ ID NO: 383162 - RNA, 32 nt, Human
ccuucaucucuccucccuccccaaacucacuu

SEQ ID NO: 383163 - RNA, 32 nt, Human
ccuucaucugggaaucauauacuccacucuag

SEQ ID NO: 383164 - RNA, 32 nt, Human
ccuucaugaagaaaagacagaggcagaaagga

SEQ ID NO: 383165 - RNA, 32 nt, Human
ccuucaugagacaggauucaguacugagcuag

SEQ ID NO: 383166 - RNA, 32 nt, Human
ccuucaugagcuguuuugcacugugagguaag

SEQ ID NO: 383167 - RNA, 32 nt, Human
ccuucaugcauggucucggggaagaagcuucc

SEQ ID NO: 383168 - RNA, 20 nt, Human
ccuucaugccauaucccaca

SEQ ID NO: 383169 - RNA, 32 nt, Human
ccuucaugcccucccucccuuuccuaccacug

SEQ ID NO: 383170 - RNA, 32 nt, Human
ccuucaugccucaguuucccagccuggcacca

SEQ ID NO: 383171 - RNA, 32 nt, Human
ccuucaugccucugcugugagacccagcaaag

SEQ ID NO: 383172 - RNA, 32 nt, Human
ccuucaugccuguaaucccagcacuuugggag

SEQ ID NO: 383173 - RNA, 32 nt, Human
ccuucaugccuguaauccgagugcuuuaggag

SEQ ID NO: 383174 - RNA, 20 nt, Human
ccuucaugggacucccaaca

SEQ ID NO: 383175 - RNA, 32 nt, Human
ccuucaugguugacuucagccaaggccaucau

SEQ ID NO: 383176 - RNA, 32 nt, Human
ccuucauuaccugaaccccauguucacacguc

SEQ ID NO: 383177 - RNA, 32 nt, Human
ccuucauuacuuuugcaaaaacauacugacuc

SEQ ID NO: 383178 - RNA, 32 nt, Human
ccuucauuccuucuuccagaacaucugggucc

SEQ ID NO: 383179 - RNA, 32 nt, Human
ccuucauucgggccucacaccuuagucaacau

SEQ ID NO: 383180 - RNA, 32 nt, Human
ccuucauucuagagcuagagugaaugagcccc

SEQ ID NO: 383181 - RNA, 32 nt, Human
ccuucauucucacccugucugcuuuuacuuuu

SEQ ID NO: 383182 - RNA, 32 nt, Human
ccuucauucugaugccucccuggggaacaagg

SEQ ID NO: 383183 - RNA, 21 nt, Human
ccuucauugccucuccucgca

SEQ ID NO: 383184 - RNA, 32 nt, Human
ccuucauugggucuccuaagagcaccaauuuu

SEQ ID NO: 383185 - RNA, 23 nt, Human
ccuucauuucauccuguuggcug

SEQ ID NO: 383186 - RNA, 32 nt, Human
ccuuccaaaccagcaccaacagagccaaggcc

SEQ ID NO: 383187 - RNA, 32 nt, Human
ccuuccaaagugcugggauaucaggcacugag

SEQ ID NO: 383188 - RNA, 32 nt, Human
ccuuccaaagugcugggauuacaggcaugagc

SEQ ID NO: 383189 - RNA, 32 nt, Human
ccuuccaaagugcugggauuacaggccugagc

SEQ ID NO: 383190 - RNA, 32 nt, Human
ccuuccaaagugcugggauuacaggcgucagc

SEQ ID NO: 383191 - RNA, 32 nt, Human
ccuuccaaagugcugggauuacaggcgugagc

SEQ ID NO: 383192 - RNA, 32 nt, Human
ccuuccaaagugcugggauuacaggcgugagu

SEQ ID NO: 383193 - RNA, 32 nt, Human
ccuuccaaagugcugggauuacaggugucagc

SEQ ID NO: 383194 - RNA, 32 nt, Human
ccuuccaaagugcugggauuacaggugugagg

SEQ ID NO: 383195 - RNA, 32 nt, Human
ccuuccaaagugcugggauuacuggcaggaac

SEQ ID NO: 383196 - RNA, 32 nt, Human
ccuuccaaagugcugggauuccagaugcgagc

SEQ ID NO: 383197 - RNA, 32 nt, Human
ccuuccaaaguguugggauuacaggcaugagc

SEQ ID NO: 383198 - RNA, 32 nt, Human
ccuuccaaaguguugggauuacaggcgugagc

SEQ ID NO: 383199 - RNA, 32 nt, Human
ccuuccaaccccaagguucugauguccugguu

SEQ ID NO: 383200 - RNA, 32 nt, Human
ccuuccaacccuccugcuaccaugaagauugc

SEQ ID NO: 383201 - RNA, 32 nt, Human
ccuuccaacuccuggguucaagggaucgucuu

SEQ ID NO: 383202 - RNA, 32 nt, Human
ccuuccaaguaacuaggacuacaggcaugugc

SEQ ID NO: 383203 - RNA, 32 nt, Human
ccuuccaaguagcugggacuacaggcaugcac

SEQ ID NO: 383204 - RNA, 32 nt, Human
ccuuccaaguagcugggaguacaagcauaugc

SEQ ID NO: 383205 - RNA, 32 nt, Human
ccuuccaaguagcugggauuacaagugcccac

SEQ ID NO: 383206 - RNA, 32 nt, Human
ccuuccaaguagcugggauuacaggaguuaga

SEQ ID NO: 383207 - RNA, 32 nt, Human
ccuuccaaguagcugggauuacaggugugcgc

SEQ ID NO: 383208 - RNA, 32 nt, Human
ccuuccaagugcuaggauuacaggcgugagcc

SEQ ID NO: 383209 - RNA, 31 nt, Human
ccuuccaauguaaucucugccaacaccauga

SEQ ID NO: 383210 - RNA, 21 nt, Human
ccuuccacacauggccaggac

SEQ ID NO: 383211 - RNA, 21 nt, Human
ccuuccacagcuccuccuaca

SEQ ID NO: 383212 - RNA, 20 nt, Human
ccuuccacagucccccuaca

SEQ ID NO: 383213 - RNA, 22 nt, Human
ccuuccacagugaccucauaca

SEQ ID NO: 383214 - RNA, 32 nt, Human
ccuuccaccauccaggaagugcagccccuucu

SEQ ID NO: 383215 - RNA, 32 nt, Human
ccuuccaccaugggaugacgcaguaagaaggc

SEQ ID NO: 383216 - RNA, 32 nt, Human
ccuuccaccccgacccgcacacacacccacac

SEQ ID NO: 383217 - RNA, 32 nt, Human
ccuuccaccccucccuccuugcuucccaccca

SEQ ID NO: 383218 - RNA, 32 nt, Human
ccuuccacccuguggccugcacuugagccaca

SEQ ID NO: 383219 - RNA, 32 nt, Human
ccuuccacccuuuagcacagagcuugguguuc

SEQ ID NO: 383220 - RNA, 32 nt, Human
ccuuccaccugggauucuccagccuccaccca

SEQ ID NO: 383221 - RNA, 32 nt, Human
ccuuccaccuuucccuucuccucucucgcauu

SEQ ID NO: 383222 - RNA, 32 nt, Human
ccuuccacuacuccccagccuagaagauccag

SEQ ID NO: 383223 - RNA, 32 nt, Human
ccuuccacuagcaacagucuccccaggcacaa

SEQ ID NO: 383224 - RNA, 32 nt, Human
ccuuccacugcccaauguggagacagggguua

SEQ ID NO: 383225 - RNA, 32 nt, Human
ccuuccacuguugucaggagaagaagggggcc

SEQ ID NO: 383226 - RNA, 32 nt, Human
ccuuccacuucuagagcagggaggcuugggga

SEQ ID NO: 383227 - RNA, 32 nt, Human
ccuuccacuucucauuccccgugucgcucauu

SEQ ID NO: 383228 - RNA, 32 nt, Human
ccuuccacuucugcacgucuuccuuuccccau

SEQ ID NO: 383229 - RNA, 32 nt, Human
ccuuccagacugcugcccaguugccugauguc

SEQ ID NO: 383230 - RNA, 32 nt, Human
ccuuccagagacaaggcugcaggcccugugaa

SEQ ID NO: 383231 - RNA, 32 nt, Human
ccuuccagagcagugcugaucacuggauccug

SEQ ID NO: 383232 - RNA, 32 nt, Human
ccuuccagagugcugggauuacaggcgugagc

SEQ ID NO: 383233 - RNA, 32 nt, Human
ccuuccagagugcugggauuauaggcgugagc

SEQ ID NO: 383234 - RNA, 32 nt, Human
ccuuccagcaccuccucucuucuccuuuugcc

SEQ ID NO: 383235 - RNA, 32 nt, Human
ccuuccagcuacucaggaggcugaggcaggag

SEQ ID NO: 383236 - RNA, 32 nt, Human
ccuuccagcugaggcaggugaagacuucauaa

SEQ ID NO: 383237 - RNA, 32 nt, Human
ccuuccagcugccucuggaaccuaggccgagc

SEQ ID NO: 383238 - RNA, 32 nt, Human
ccuuccagcugucacugaauggcuuuauucgu

SEQ ID NO: 383239 - RNA, 32 nt, Human
ccuuccagcuguuccauucucuccaccaccag

SEQ ID NO: 383240 - RNA, 32 nt, Human
ccuuccagcuguuccugcuuccacucuugcuc

SEQ ID NO: 383241 - RNA, 32 nt, Human
ccuuccaggaaggggcuggccucugcugagcu

SEQ ID NO: 383242 - RNA, 21 nt, Human
ccuuccaggaucuggagcccg

SEQ ID NO: 383243 - RNA, 32 nt, Human
ccuuccaggcagcaggcuggcauggggacuuc

SEQ ID NO: 383244 - RNA, 18 nt, Human
ccuuccaggccgcugccg

SEQ ID NO: 383245 - RNA, 32 nt, Human
ccuuccaggccuacgagcagauucucgggauc

SEQ ID NO: 383246 - RNA, 32 nt, Human
ccuuccaggccugagccccaaccccucuucag

SEQ ID NO: 383247 - RNA, 32 nt, Human
ccuuccaggccuggccuggccuggaaccugga

SEQ ID NO: 383248 - RNA, 32 nt, Human
ccuuccagggaaauuguggucuccggccuggg

SEQ ID NO: 383249 - RNA, 32 nt, Human
ccuuccagggccugagcagcuggaucugguac

SEQ ID NO: 383250 - RNA, 32 nt, Human
ccuuccagggccugggaccauuggcugggacc

SEQ ID NO: 383251 - RNA, 32 nt, Human
ccuuccaggguuuagggagugcagugaugucg

SEQ ID NO: 383252 - RNA, 32 nt, Human
ccuuccagucagaacaguugagcaguuuacaa

SEQ ID NO: 383253 - RNA, 31 nt, Human
ccuuccagugagagaaaaauagaaugguaag

SEQ ID NO: 383254 - RNA, 31 nt, Human
ccuuccagugagagauucaagaauugaugug

SEQ ID NO: 383255 - RNA, 32 nt, Human
ccuuccagugcugugcucugugucaccaucag

SEQ ID NO: 383256 - RNA, 20 nt, Human
ccuuccagugguaccagcuc

SEQ ID NO: 383257 - RNA, 32 nt, Human
ccuuccagugguaccagcucacucccugggaa

SEQ ID NO: 383258 - RNA, 32 nt, Human
ccuuccaguuuauuccagagcugccagugggg

SEQ ID NO: 383259 - RNA, 32 nt, Human
ccuuccauaaccuaauuuagucauuugggccu

SEQ ID NO: 383260 - RNA, 32 nt, Human
ccuuccaucagugucuuccagccugcaugggg

SEQ ID NO: 383261 - RNA, 32 nt, Human
ccuuccaucccugaauacaaggcucuaggcaa

SEQ ID NO: 383262 - RNA, 32 nt, Human
ccuuccaugaacacaugugcuggagacguguu

SEQ ID NO: 383263 - RNA, 18 nt, Human
ccuuccaugauguugcca

SEQ ID NO: 383264 - RNA, 32 nt, Human
ccuuccaugucugacccugccucaugucuugg

SEQ ID NO: 383265 - RNA, 32 nt, Human
ccuuccauuucugccuuuuguucauuucaucc

SEQ ID NO: 383266 - RNA, 32 nt, Human
ccuucccaaacagucacagauuccauugaaag

SEQ ID NO: 383267 - RNA, 32 nt, Human
ccuucccaacccagugccguuuauuucagaag

SEQ ID NO: 383268 - RNA, 32 nt, Human
ccuucccaagcccccuuccuucauccuugggg

SEQ ID NO: 383269 - RNA, 32 nt, Human
ccuucccaagugcugggauuacaggugugagc

SEQ ID NO: 383270 - RNA, 32 nt, Human
ccuucccacagggcugcaguccuggccucucc

SEQ ID NO: 383271 - RNA, 21 nt, Human
ccuucccacccacccagucca

SEQ ID NO: 383272 - RNA, 32 nt, Human
ccuucccacugcacuccccaguggcuggcgug

SEQ ID NO: 383273 - RNA, 19 nt, Human
ccuucccagaacccagcca

SEQ ID NO: 383274 - RNA, 32 nt, Human
ccuucccagaaucuccuucagugguugcucuc

SEQ ID NO: 383275 - RNA, 32 nt, Human
ccuucccagcaagucauagcucagggaggagg

SEQ ID NO: 383276 - RNA, 32 nt, Human
ccuucccagcacccccagcccugaaaccugac

SEQ ID NO: 383277 - RNA, 32 nt, Human
ccuucccagccauguggaacugugagucgaaa

SEQ ID NO: 383278 - RNA, 32 nt, Human
ccuucccagccccagcccuggagacagcagcc

SEQ ID NO: 383279 - RNA, 32 nt, Human
ccuucccagcugggaagagcucagagcugaca

SEQ ID NO: 383280 - RNA, 32 nt, Human
ccuucccaguagcugggauuacaggcacauac

SEQ ID NO: 383281 - RNA, 32 nt, Human
ccuucccaguuucuccccaaccuccccuuuuc

SEQ ID NO: 383282 - RNA, 19 nt, Human
ccuucccaucaccuccuca

SEQ ID NO: 383283 - RNA, 32 nt, Human
ccuucccaucaggucugcuccagccuggcuac

SEQ ID NO: 383284 - RNA, 32 nt, Human
ccuucccauccccaaggagcccuucagcgcgc

SEQ ID NO: 383285 - RNA, 32 nt, Human
ccuucccaugacccaggcugggcaaggaggcc

SEQ ID NO: 383286 - RNA, 32 nt, Human
ccuucccauuagcugggauuacaggcaugcgc

SEQ ID NO: 383287 - RNA, 32 nt, Human
ccuuccccaagagaggaaccagaaggaggacc

SEQ ID NO: 383288 - RNA, 32 nt, Human
ccuuccccaagugagcucagcagcaugugcua

SEQ ID NO: 383289 - RNA, 18 nt, Human
ccuuccccaccccugccc

SEQ ID NO: 383290 - RNA, 32 nt, Human
ccuuccccacugcacacaccucagaggcuguu

SEQ ID NO: 383291 - RNA, 32 nt, Human
ccuuccccagagagauggcuuuaggggcuuua

SEQ ID NO: 383292 - RNA, 32 nt, Human
ccuuccccagaugaacugaggugagagcggcu

SEQ ID NO: 383293 - RNA, 32 nt, Human
ccuuccccagccugggccuugaccguccagca

SEQ ID NO: 383294 - RNA, 32 nt, Human
ccuuccccauaacacugagcugcucugcuggg

SEQ ID NO: 383295 - RNA, 32 nt, Human
ccuuccccaucaccaguggcaggaugaagcau

SEQ ID NO: 383296 - RNA, 32 nt, Human
ccuuccccauccugagcccccuucccuguccu

SEQ ID NO: 383297 - RNA, 32 nt, Human
ccuuccccaucuuuccagccccuggcccugcu

SEQ ID NO: 383298 - RNA, 32 nt, Human
ccuuccccauuuccucuuccuucucuacucau

SEQ ID NO: 383299 - RNA, 32 nt, Human
ccuuccccauuuucauauccuuucuucaaaaa

SEQ ID NO: 383300 - RNA, 32 nt, Human
ccuucccccaccuuccuccucacucucuaccu

SEQ ID NO: 383301 - RNA, 32 nt, Human
ccuucccccacugucccgguccucuuccccug

SEQ ID NO: 383302 - RNA, 32 nt, Human
ccuucccccacuguggugaccuguggccacuu

SEQ ID NO: 383303 - RNA, 32 nt, Human
ccuucccccagccagccagcuguccuggggcc

SEQ ID NO: 383304 - RNA, 32 nt, Human
ccuucccccagcccuggcugggcccagcgccu

SEQ ID NO: 383305 - RNA, 32 nt, Human
ccuucccccagcucuauccaucugccaggccc

SEQ ID NO: 383306 - RNA, 32 nt, Human
ccuucccccaggaaagcuaggagacaagacaa

SEQ ID NO: 383307 - RNA, 32 nt, Human
ccuucccccaggagucacugugccagccccac

SEQ ID NO: 383308 - RNA, 32 nt, Human
ccuucccccaucauccuuccuuagacugaugc

SEQ ID NO: 383309 - RNA, 32 nt, Human
ccuucccccggagacgcccacccggccaccgu

SEQ ID NO: 383310 - RNA, 32 nt, Human
ccuucccccgucgcauaaccaguuccaucauc

SEQ ID NO: 383311 - RNA, 32 nt, Human
ccuucccccuacaagauuaugagaccccagag

SEQ ID NO: 383312 - RNA, 32 nt, Human
ccuucccccucagagaaccaaauagccugagg

SEQ ID NO: 383313 - RNA, 32 nt, Human
ccuucccccuccucccccuccuuuccgucuuc

SEQ ID NO: 383314 - RNA, 32 nt, Human
ccuucccccucuucucuugcucaggccugcac

SEQ ID NO: 383315 - RNA, 32 nt, Human
ccuucccccugccccugccccuaccagcccag

SEQ ID NO: 383316 - RNA, 32 nt, Human
ccuucccccuuuccuuucccuuucuuuccuuu

SEQ ID NO: 383317 - RNA, 32 nt, Human
ccuuccccgaggcugagcugagccuuuuccag

SEQ ID NO: 383318 - RNA, 32 nt, Human
ccuuccccgcucccaaaccagaaaggaaucca

SEQ ID NO: 383319 - RNA, 32 nt, Human
ccuuccccgguggagggagggagcagggagcc

SEQ ID NO: 383320 - RNA, 32 nt, Human
ccuuccccuauagggcccucacuagggccagu

SEQ ID NO: 383321 - RNA, 19 nt, Human
ccuuccccuccacccccca

SEQ ID NO: 383322 - RNA, 32 nt, Human
ccuuccccuccacccgcccuaacccccucuca

SEQ ID NO: 383323 - RNA, 32 nt, Human
ccuuccccuccagaacaccagccagggagggg

SEQ ID NO: 383324 - RNA, 32 nt, Human
ccuuccccuccaggggugcaguggggugggug

SEQ ID NO: 383325 - RNA, 32 nt, Human
ccuuccccuccccacucuucuccuucccuccc

SEQ ID NO: 383326 - RNA, 32 nt, Human
ccuuccccucccccuccccucccccuccccaa

SEQ ID NO: 383327 - RNA, 19 nt, Human
ccuuccccucccccuuccc

SEQ ID NO: 383328 - RNA, 32 nt, Human
ccuuccccuccccuccccucgcccgccuucgc

SEQ ID NO: 383329 - RNA, 32 nt, Human
ccuuccccuccccuccccuuccccucaucuuc

SEQ ID NO: 383330 - RNA, 32 nt, Human
ccuuccccuccccuccucccucuuuuccccuc

SEQ ID NO: 383331 - RNA, 32 nt, Human
ccuuccccuccccucgccuguccucgccaucu

SEQ ID NO: 383332 - RNA, 32 nt, Human
ccuuccccuccccuuccccucccccuccccaa

SEQ ID NO: 383333 - RNA, 32 nt, Human
ccuuccccuccccuucuaccuccuccucggcc

SEQ ID NO: 383334 - RNA, 32 nt, Human
ccuuccccuccucagauguggggaguugccgc

SEQ ID NO: 383335 - RNA, 32 nt, Human
ccuuccccuccucuccccuccuuuuccuuccu

SEQ ID NO: 383336 - RNA, 32 nt, Human
ccuuccccucugcagcuuccaggcuggcgugc

SEQ ID NO: 383337 - RNA, 32 nt, Human
ccuuccccugcuccuccugccuugucugccug

SEQ ID NO: 383338 - RNA, 32 nt, Human
ccuuccccuuauccucccuguaacuugaucca

SEQ ID NO: 383339 - RNA, 23 nt, Human
ccuuccccuucaagcauuuuccu

SEQ ID NO: 383340 - RNA, 19 nt, Human
ccuuccccuuccccuuccc

SEQ ID NO: 383341 - RNA, 32 nt, Human
ccuuccccuugccucacucucucagcuuucuu

SEQ ID NO: 383342 - RNA, 32 nt, Human
ccuuccccuuucucugucuccaacacucuuuc

SEQ ID NO: 383343 - RNA, 32 nt, Human
ccuucccgcagcuggcccugugguguuccgaa

SEQ ID NO: 383344 - RNA, 32 nt, Human
ccuucccgcuccccgucuuccucucucacaca

SEQ ID NO: 383345 - RNA, 19 nt, Human
ccuucccggccaccagcuc

SEQ ID NO: 383346 - RNA, 32 nt, Human
ccuucccguccacccagugcagcucccagugc

SEQ ID NO: 383347 - RNA, 32 nt, Human
ccuucccgugucugagccuggaagaggcucgg

SEQ ID NO: 383348 - RNA, 32 nt, Human
ccuucccuaaaauguugccagcauguaaagga

SEQ ID NO: 383349 - RNA, 32 nt, Human
ccuucccuauaggaacagcccagcacagguau

SEQ ID NO: 383350 - RNA, 32 nt, Human
ccuucccuauccugagcccccuucccuguccu

SEQ ID NO: 383351 - RNA, 32 nt, Human
ccuucccucacaccaucuccuuccaggggaug

SEQ ID NO: 383352 - RNA, 32 nt, Human
ccuucccucacacccugccucgcccccacuuu

SEQ ID NO: 383353 - RNA, 32 nt, Human
ccuucccucacuacugacgagaccauguguaa

SEQ ID NO: 383354 - RNA, 32 nt, Human
ccuucccucacucuuccucauccugcuucucu

SEQ ID NO: 383355 - RNA, 32 nt, Human
ccuucccucacugucucaggugccgagagggg

SEQ ID NO: 383356 - RNA, 32 nt, Human
ccuucccuccacccaggccagcagccgucaga

SEQ ID NO: 383357 - RNA, 32 nt, Human
ccuucccuccauguguuucucaguuucccguu

SEQ ID NO: 383358 - RNA, 32 nt, Human
ccuucccucccccauucuccagaucucccucu

SEQ ID NO: 383359 - RNA, 32 nt, Human
ccuucccuccccucccccucugccuuuuguac

SEQ ID NO: 383360 - RNA, 32 nt, Human
ccuucccucccucccucccucccucccuuucu

SEQ ID NO: 383361 - RNA, 31 nt, Human
ccuucccuccucucuggcccucccuccuccc

SEQ ID NO: 383362 - RNA, 32 nt, Human
ccuucccuccuucccuccuuccuuccuuuuug

SEQ ID NO: 383363 - RNA, 32 nt, Human
ccuucccuccuuccuuccuuuuugucuuuguu

SEQ ID NO: 383364 - RNA, 32 nt, Human
ccuucccucgcaguuccccuguccugagggga

SEQ ID NO: 383365 - RNA, 32 nt, Human
ccuucccucggugugggggauguggcccucuc

SEQ ID NO: 383366 - RNA, 32 nt, Human
ccuucccucucccaucuucucauauccuggcu

SEQ ID NO: 383367 - RNA, 19 nt, Human
ccuucccucuccuccccca

SEQ ID NO: 383368 - RNA, 32 nt, Human
ccuucccucuccuuuucugucaccuuuccccc

SEQ ID NO: 383369 - RNA, 32 nt, Human
ccuucccucuuuccuuccuuccuccuggucug

SEQ ID NO: 383370 - RNA, 32 nt, Human
ccuucccucuuucucaccaccgccuucccucc

SEQ ID NO: 383371 - RNA, 32 nt, Human
ccuucccugagacugucucuucuccugugaaa

SEQ ID NO: 383372 - RNA, 32 nt, Human
ccuucccugaggagcugggacaugcugggcag

SEQ ID NO: 383373 - RNA, 32 nt, Human
ccuucccugcaagaccccuuguggauguuuuu

SEQ ID NO: 383374 - RNA, 32 nt, Human
ccuucccugcagccccuccccaacaggcuugg

SEQ ID NO: 383375 - RNA, 32 nt, Human
ccuucccugccaccccucgcaugucacagcug

SEQ ID NO: 383376 - RNA, 32 nt, Human
ccuucccugccucuugccugugucccagccug

SEQ ID NO: 383377 - RNA, 32 nt, Human
ccuucccugccugaacuuugaagcuguuuugu

SEQ ID NO: 383378 - RNA, 32 nt, Human
ccuucccugccugacccacuguugcagaauga

SEQ ID NO: 383379 - RNA, 32 nt, Human
ccuucccugccugcccaccccuccaugcucca

SEQ ID NO: 383380 - RNA, 32 nt, Human
ccuucccugccugcgcuugugcccccucuccu

SEQ ID NO: 383381 - RNA, 32 nt, Human
ccuucccugccugugggggucaugcugccacu

SEQ ID NO: 383382 - RNA, 32 nt, Human
ccuucccugccuucucugggcugugcggcccc

SEQ ID NO: 383383 - RNA, 32 nt, Human
ccuucccugcucccacccaccugacuccaaau

SEQ ID NO: 383384 - RNA, 32 nt, Human
ccuucccugggccccuucucuccugggcagcc

SEQ ID NO: 383385 - RNA, 32 nt, Human
ccuucccuguacuucccaccucgccaggccug

SEQ ID NO: 383386 - RNA, 32 nt, Human
ccuucccugucaccccaaacugugcgguggcu

SEQ ID NO: 383387 - RNA, 32 nt, Human
ccuucccuuaucaccccugcagccugggaugc

SEQ ID NO: 383388 - RNA, 32 nt, Human
ccuucccuucaaggaguaugucauaugucaca

SEQ ID NO: 383389 - RNA, 20 nt, Human
ccuucccuucaucccuuccc

SEQ ID NO: 383390 - RNA, 32 nt, Human
ccuucccuucaugauaagccagugccagcauc

SEQ ID NO: 383391 - RNA, 32 nt, Human
ccuucccuuccaguggggccugaccuggcuac

SEQ ID NO: 383392 - RNA, 32 nt, Human
ccuucccuucccuccuccuuccuuccuccucu

SEQ ID NO: 383393 - RNA, 32 nt, Human
ccuucccuucugacucagguuggcagauaaac

SEQ ID NO: 383394 - RNA, 32 nt, Human
ccuucccuuguccuucccugaguuccuccagg

SEQ ID NO: 383395 - RNA, 32 nt, Human
ccuucccuuuccaacucuaccucccucacuca

SEQ ID NO: 383396 - RNA, 32 nt, Human
ccuucccuuugauacaguccaggauuuguaag

SEQ ID NO: 383397 - RNA, 20 nt, Human
ccuucccuuuuucccuuccc

SEQ ID NO: 383398 - RNA, 32 nt, Human
ccuuccgaaauacauuugcucaaucauuugca

SEQ ID NO: 383399 - RNA, 32 nt, Human
ccuuccgaauagcugggacuacaggcgcacgc

SEQ ID NO: 383400 - RNA, 32 nt, Human
ccuuccgaaucccagcccuggggcgucagccc

SEQ ID NO: 383401 - RNA, 32 nt, Human
ccuuccgacgccuugucucaggaacaugcuuu

SEQ ID NO: 383402 - RNA, 32 nt, Human
ccuuccgaguagcugggaccacaggcaugcac

SEQ ID NO: 383403 - RNA, 32 nt, Human
ccuuccgaguagcugggacuacaggcgcaugc

SEQ ID NO: 383404 - RNA, 32 nt, Human
ccuuccgaguagcugggacuacagugcuuccu

SEQ ID NO: 383405 - RNA, 32 nt, Human
ccuuccgaguagcugggaucgcaggcgccugc

SEQ ID NO: 383406 - RNA, 32 nt, Human
ccuuccgaguagcugggauuacaggcacccac

SEQ ID NO: 383407 - RNA, 32 nt, Human
ccuuccgaguagcugggauuacaggcaccugc

SEQ ID NO: 383408 - RNA, 32 nt, Human
ccuuccgaguagcugggauuacaggcgcccgc

SEQ ID NO: 383409 - RNA, 32 nt, Human
ccuuccgaguagcugggauuacaggcuccugc

SEQ ID NO: 383410 - RNA, 32 nt, Human
ccuuccgaguagcugggauuacagggauguag

SEQ ID NO: 383411 - RNA, 32 nt, Human
ccuuccgaguagcugggauuacaggugcccgc

SEQ ID NO: 383412 - RNA, 32 nt, Human
ccuuccgaguagcugggauuacaggugugugc

SEQ ID NO: 383413 - RNA, 32 nt, Human
ccuuccgaguagcugggauugcaggcgugugc

SEQ ID NO: 383414 - RNA, 22 nt, Human
ccuuccgauuccaccuccgccu

SEQ ID NO: 383415 - RNA, 32 nt, Human
ccuuccgcccucccuucuuuccuuccuuccuu

SEQ ID NO: 383416 - RNA, 32 nt, Human
ccuuccgccgcucugagcccuuccuggcaccc

SEQ ID NO: 383417 - RNA, 32 nt, Human
ccuuccgccuggggcccugccgacccccugcc

SEQ ID NO: 383418 - RNA, 32 nt, Human
ccuuccgccuggggcucccugugaccucucag

SEQ ID NO: 383419 - RNA, 32 nt, Human
ccuuccgcuccugcccagccugggggaaggag

SEQ ID NO: 383420 - RNA, 32 nt, Human
ccuuccgcuccuggcugccacaggguccuccg

SEQ ID NO: 383421 - RNA, 32 nt, Human
ccuuccgcuugcagcuucccugggauuuuugu

SEQ ID NO: 383422 - RNA, 32 nt, Human
ccuuccggauccagagcugugcagcccaggcc

SEQ ID NO: 383423 - RNA, 32 nt, Human
ccuuccggaucggaagaagcugacuuccucuc

SEQ ID NO: 383424 - RNA, 32 nt, Human
ccuuccggcagccucuuggccucuaauuuguu

SEQ ID NO: 383425 - RNA, 32 nt, Human
ccuuccggccgguuuccagacgcccagguggc

SEQ ID NO: 383426 - RNA, 32 nt, Human
ccuuccggcucacacccccgcccacacuccug

SEQ ID NO: 383427 - RNA, 20 nt, Human
ccuuccggcuccggcacggg

SEQ ID NO: 383428 - RNA, 21 nt, Human
ccuuccgggcagagaccagag

SEQ ID NO: 383429 - RNA, 32 nt, Human
ccuuccgggccccgugccccugacugggaugc

SEQ ID NO: 383430 - RNA, 32 nt, Human
ccuuccgggccuccugggcuucugcuggggac

SEQ ID NO: 383431 - RNA, 32 nt, Human
ccuuccggguucccagggcugcugugggaaca

SEQ ID NO: 383432 - RNA, 32 nt, Human
ccuuccggucuacaagagcucucaaggcuggg

SEQ ID NO: 383433 - RNA, 32 nt, Human
ccuuccggugcucacacgcccacgccgugcca

SEQ ID NO: 383434 - RNA, 28 nt, Human
ccuuccgguggagcugccucguuccuuu

SEQ ID NO: 383435 - RNA, 32 nt, Human
ccuuccguuucuucuuccagggugggguggcc

SEQ ID NO: 383436 - RNA, 32 nt, Human
ccuuccuacauacucuugcgaccauuaggcuc

SEQ ID NO: 383437 - RNA, 32 nt, Human
  misc_feature (29)..(29): n is a, c, g or u
ccuuccuacucccauucaucgcucucaanauu

SEQ ID NO: 383438 - RNA, 32 nt, Human
ccuuccuacugguuuagacuacacuuacaaca

SEQ ID NO: 383439 - RNA, 32 nt, Human
ccuuccuacuuuccuucauucucucuuccuuc

SEQ ID NO: 383440 - RNA, 32 nt, Human
ccuuccuagcagccuggugagcucacuccuuc

SEQ ID NO: 383441 - RNA, 32 nt, Human
ccuuccuaguagcugggacuacagguaugcac

SEQ ID NO: 383442 - RNA, 32 nt, Human
ccuuccuagugcuaugguuucugccauuggcc

SEQ ID NO: 383443 - RNA, 25 nt, Human
ccuuccucaauaguccuguuggugg

SEQ ID NO: 383444 - RNA, 32 nt, Human
ccuuccucaccacuucccucagucccaacucc

SEQ ID NO: 383445 - RNA, 32 nt, Human
ccuuccucaccgcagauguuucugccucuuaa

SEQ ID NO: 383446 - RNA, 32 nt, Human
ccuuccucacuggcccccuccaccugcccaua

SEQ ID NO: 383447 - RNA, 32 nt, Human
ccuuccucacugguacugccugcuguuuucua

SEQ ID NO: 383448 - RNA, 22 nt, Human
ccuuccucacuuuggacugcug

SEQ ID NO: 383449 - RNA, 32 nt, Human
ccuuccucagcuucaccuugauacugggccuc

SEQ ID NO: 383450 - RNA, 21 nt, Human
ccuuccucaguucccagcugg

SEQ ID NO: 383451 - RNA, 32 nt, Human
ccuuccucaucucucccugccugugcagaccu

SEQ ID NO: 383452 - RNA, 32 nt, Human
ccuuccucauucuccaagcucaucaacagguc

SEQ ID NO: 383453 - RNA, 32 nt, Human
ccuuccucauucucuuuaccaguauccuggca

SEQ ID NO: 383454 - RNA, 32 nt, Human
ccuuccuccacucccucccuuccccuccccuu

SEQ ID NO: 383455 - RNA, 32 nt, Human
ccuuccuccagccucacaaccuuucugcuggg

SEQ ID NO: 383456 - RNA, 32 nt, Human
ccuuccuccagccugugcgcaccugcccuccu

SEQ ID NO: 383457 - RNA, 32 nt, Human
ccuuccuccaggagaaggggcccaaggucccc

SEQ ID NO: 383458 - RNA, 20 nt, Human
ccuuccuccagugccugcug

SEQ ID NO: 383459 - RNA, 23 nt, Human
ccuuccuccauccuauccacugg

SEQ ID NO: 383460 - RNA, 21 nt, Human
ccuuccucccaaguuagcagg

SEQ ID NO: 383461 - RNA, 22 nt, Human
ccuuccucccaccccugguggu

SEQ ID NO: 383462 - RNA, 21 nt, Human
ccuuccucccacuggacaugg

SEQ ID NO: 383463 - RNA, 32 nt, Human
ccuuccucccacuggcaugccugcugcaacgg

SEQ ID NO: 383464 - RNA, 32 nt, Human
ccuuccucccagaaccuguggucccugauuuu

SEQ ID NO: 383465 - RNA, 32 nt, Human
ccuuccucccaucacuagacccuggcagcagc

SEQ ID NO: 383466 - RNA, 21 nt, Human
ccuuccucccaucccccuugg

SEQ ID NO: 383467 - RNA, 19 nt, Human
ccuuccucccauccucugc

SEQ ID NO: 383468 - RNA, 24 nt, Human
ccuuccuccccaauccugacuggc

SEQ ID NO: 383469 - RNA, 20 nt, Human
ccuuccuccccggauuggcu

SEQ ID NO: 383470 - RNA, 32 nt, Human
ccuuccuccccucucccccagugacuuuaucc

SEQ ID NO: 383471 - RNA, 24 nt, Human
ccuuccuccccugccugcagcugg

SEQ ID NO: 383472 - RNA, 24 nt, Human
ccuuccuccccuggcacuggcugg

SEQ ID NO: 383473 - RNA, 21 nt, Human
ccuuccuccccuuccaggcgg

SEQ ID NO: 383474 - RNA, 23 nt, Human
ccuuccucccgggggucagcugg

SEQ ID NO: 383475 - RNA, 32 nt, Human
ccuuccucccgucuugccuucucccucgaguu

SEQ ID NO: 383476 - RNA, 32 nt, Human
ccuuccucccuccugcaucugagcuuugucuc

SEQ ID NO: 383477 - RNA, 22 nt, Human
ccuuccucccugcgcgggcugg

SEQ ID NO: 383478 - RNA, 24 nt, Human
ccuuccucccuggaguuuggcuua

SEQ ID NO: 383479 - RNA, 32 nt, Human
ccuuccucccuuccuuccuuccuuccuuccuu

SEQ ID NO: 383480 - RNA, 23 nt, Human
ccuuccuccgacaccucggcugg

SEQ ID NO: 383481 - RNA, 32 nt, Human
ccuuccuccgugcgcccugccgggcggcgagc

SEQ ID NO: 383482 - RNA, 32 nt, Human
ccuuccuccucccaugggucccucccaguagg

SEQ ID NO: 383483 - RNA, 32 nt, Human
ccuuccuccucuauagcuucuggguguccccc

SEQ ID NO: 383484 - RNA, 32 nt, Human
ccuuccuccucuccucccuguccugagccuua

SEQ ID NO: 383485 - RNA, 32 nt, Human
ccuuccuccucuuccuccuccuccuccaccuc

SEQ ID NO: 383486 - RNA, 23 nt, Human
ccuuccuccuggccuggacgcug

SEQ ID NO: 383487 - RNA, 32 nt, Human
ccuuccuccuuucaaaagaguucuuaacccaa

SEQ ID NO: 383488 - RNA, 32 nt, Human
ccuuccuccuuuccuaucuuccuuccucucuc

SEQ ID NO: 383489 - RNA, 23 nt, Human
ccuuccucggaccugggcugucg

SEQ ID NO: 383490 - RNA, 24 nt, Human
ccuuccucuagcagacugugcagg

SEQ ID NO: 383491 - RNA, 32 nt, Human
ccuuccucucccaccaugcgaugagcauccuu

SEQ ID NO: 383492 - RNA, 21 nt, Human
ccuuccucucccaggucgcug

SEQ ID NO: 383493 - RNA, 32 nt, Human
ccuuccucuccccuccucccaucccucauagg

SEQ ID NO: 383494 - RNA, 32 nt, Human
ccuuccucuccccuccucccauccuucauagg

SEQ ID NO: 383495 - RNA, 32 nt, Human
ccuuccucuccucccugaucauccuauccacc

SEQ ID NO: 383496 - RNA, 32 nt, Human
ccuuccucuccuccuccuccccuccagccgcu

SEQ ID NO: 383497 - RNA, 32 nt, Human
ccuuccucuccuccuucccucucccucucugc

SEQ ID NO: 383498 - RNA, 32 nt, Human
ccuuccucucuccuccccuccuuccucucucc

SEQ ID NO: 383499 - RNA, 32 nt, Human
ccuuccucucucucaccuucaccacccaacac

SEQ ID NO: 383500 - RNA, 32 nt, Human
ccuuccucugcauguggccacaggggaccuuu

SEQ ID NO: 383501 - RNA, 22 nt, Human
ccuuccucugccuccugagcgc

SEQ ID NO: 383502 - RNA, 22 nt, Human
ccuuccucugcugaaaaggcug

SEQ ID NO: 383503 - RNA, 32 nt, Human
ccuuccucugcuuccuccuuuugacuuauuug

SEQ ID NO: 383504 - RNA, 20 nt, Human
ccuuccucugucucugcucc

SEQ ID NO: 383505 - RNA, 32 nt, Human
ccuuccucugucugacaggaaucuccccguuu

SEQ ID NO: 383506 - RNA, 24 nt, Human
ccuuccucuguuccuucuggccgg

SEQ ID NO: 383507 - RNA, 32 nt, Human
ccuuccucuucacacugagcccucucugauuc

SEQ ID NO: 383508 - RNA, 32 nt, Human
ccuuccucuucccccuuccacccucacauccc

SEQ ID NO: 383509 - RNA, 32 nt, Human
ccuuccucuuccugccuccucaucucccuuaa

SEQ ID NO: 383510 - RNA, 32 nt, Human
ccuuccucuuucuccuccuaccucugcccugu

SEQ ID NO: 383511 - RNA, 32 nt, Human
ccuuccugaagauccuccacugcugcucugcu

SEQ ID NO: 383512 - RNA, 32 nt, Human
ccuuccugaagugcuggcagcccaguggcacc

SEQ ID NO: 383513 - RNA, 32 nt, Human
ccuuccugaccccugugcucagccuggaauug

SEQ ID NO: 383514 - RNA, 32 nt, Human
ccuuccugaccuuccucagucugcagcucuuu

SEQ ID NO: 383515 - RNA, 32 nt, Human
ccuuccugagccagggcuuugcuguaguugug

SEQ ID NO: 383516 - RNA, 32 nt, Human
ccuuccugaggcugaguuuacucucuaggagg

SEQ ID NO: 383517 - RNA, 32 nt, Human
ccuuccugcacgccauucuccaccucaguauc

SEQ ID NO: 383518 - RNA, 32 nt, Human
ccuuccugcacucauucucaaacauacugaug

SEQ ID NO: 383519 - RNA, 32 nt, Human
ccuuccugcagaccuggcugggccugggcuuc

SEQ ID NO: 383520 - RNA, 22 nt, Human
ccuuccugcagauggcuucuca

SEQ ID NO: 383521 - RNA, 32 nt, Human
ccuuccugcaguucccagcccucggagccccc

SEQ ID NO: 383522 - RNA, 32 nt, Human
ccuuccugccaaaaauaaacaugugaaacugc

SEQ ID NO: 383523 - RNA, 32 nt, Human
ccuuccugccaaggcuggaggccgccaggugu

SEQ ID NO: 383524 - RNA, 32 nt, Human
ccuuccugccacugccccacccugccccacug

SEQ ID NO: 383525 - RNA, 32 nt, Human
ccuuccugccaggagcucuccacccacucaca

SEQ ID NO: 383526 - RNA, 32 nt, Human
ccuuccugccaggcuccguuguagggguuaca

SEQ ID NO: 383527 - RNA, 32 nt, Human
ccuuccugccccaacuccuuccagcuagugac

SEQ ID NO: 383528 - RNA, 32 nt, Human
ccuuccugcccucugcccagcuugccucugcc

SEQ ID NO: 383529 - RNA, 32 nt, Human
ccuuccugcccuucugccugccugugucugcu

SEQ ID NO: 383530 - RNA, 32 nt, Human
ccuuccugccuaguaauguuccagcuuuaccc

SEQ ID NO: 383531 - RNA, 32 nt, Human
ccuuccugccugacacccaguguugagagugc

SEQ ID NO: 383532 - RNA, 32 nt, Human
ccuuccugcuccccaguccuggcagugccgug

SEQ ID NO: 383533 - RNA, 32 nt, Human
ccuuccugcuccgucuuugggguccucaaggc

SEQ ID NO: 383534 - RNA, 20 nt, Human
ccuuccugcugagccucaca

SEQ ID NO: 383535 - RNA, 21 nt, Human
ccuuccugcugagcuuccaca

SEQ ID NO: 383536 - RNA, 32 nt, Human
ccuuccuggagagagggaggugaaagcuggug

SEQ ID NO: 383537 - RNA, 32 nt, Human
ccuuccuggaucuccagugccugggccaggaa

SEQ ID NO: 383538 - RNA, 32 nt, Human
ccuuccuggauuucacgcaucccauccucugg

SEQ ID NO: 383539 - RNA, 31 nt, Human
ccuuccuggcagggaaagugggugaacagag

SEQ ID NO: 383540 - RNA, 20 nt, Human
ccuuccuggcgccugugcag

SEQ ID NO: 383541 - RNA, 32 nt, Human
ccuuccugggccuucuuuaucuccccaagcca

SEQ ID NO: 383542 - RNA, 32 nt, Human
ccuuccuggguaccccaaacucuuagcccuag

SEQ ID NO: 383543 - RNA, 32 nt, Human
ccuuccugguacugcagucaaccaaagauggc

SEQ ID NO: 383544 - RNA, 32 nt, Human
ccuuccuggucaggcuguucagcugggcgcug

SEQ ID NO: 383545 - RNA, 32 nt, Human
ccuuccuggucucuggccgccugcugccaggg

SEQ ID NO: 383546 - RNA, 32 nt, Human
ccuuccuggucugagacuagcucugggggugg

SEQ ID NO: 383547 - RNA, 32 nt, Human
ccuuccuggugcccuucagccagguccagaau

SEQ ID NO: 383548 - RNA, 32 nt, Human
ccuuccugguuggcuguguucuuaggggugug

SEQ ID NO: 383549 - RNA, 32 nt, Human
ccuuccugucucucauuuucaccaucugacug

SEQ ID NO: 383550 - RNA, 32 nt, Human
ccuuccuguggaaggcagaggcagugagggag

SEQ ID NO: 383551 - RNA, 32 nt, Human
ccuuccugugucccuuugcaagcuuccaggcg

SEQ ID NO: 383552 - RNA, 32 nt, Human
ccuuccuguuggaaugaaaacauuucgauuuu

SEQ ID NO: 383553 - RNA, 32 nt, Human
ccuuccuuaagaaaauacaaaauuaggaacag

SEQ ID NO: 383554 - RNA, 32 nt, Human
ccuuccuuagacagaggccagcagggacugug

SEQ ID NO: 383555 - RNA, 32 nt, Human
ccuuccuuauuuccuuuaguuuccuuccuuag

SEQ ID NO: 383556 - RNA, 32 nt, Human
ccuuccuucaagccuucagccccuccagcucc

SEQ ID NO: 383557 - RNA, 32 nt, Human
ccuuccuucacacccccucacagacuccuugu

SEQ ID NO: 383558 - RNA, 32 nt, Human
ccuuccuucagagucccugcgagcccucagga

SEQ ID NO: 383559 - RNA, 32 nt, Human
ccuuccuucauuccuucauuccuuccuuuguu

SEQ ID NO: 383560 - RNA, 32 nt, Human
ccuuccuuccagccugggcucuggcguguucu

SEQ ID NO: 383561 - RNA, 32 nt, Human
ccuuccuucccaaucucccugccagggcccac

SEQ ID NO: 383562 - RNA, 32 nt, Human
ccuuccuucccauuuacccauuuccuuccagu

SEQ ID NO: 383563 - RNA, 32 nt, Human
ccuuccuuccccucccagguugcugggagaaa

SEQ ID NO: 383564 - RNA, 32 nt, Human
ccuuccuucccucccuuccuccuucucuccuu

SEQ ID NO: 383565 - RNA, 32 nt, Human
ccuuccuucccuggcccuuggcugugacacaa

SEQ ID NO: 383566 - RNA, 32 nt, Human
ccuuccuucccuuuucuuuucuuuucuuucua

SEQ ID NO: 383567 - RNA, 32 nt, Human
ccuuccuuccgaggagcuuucuggcugccuaa

SEQ ID NO: 383568 - RNA, 32 nt, Human
ccuuccuuccuacccccuucucccucucccuu

SEQ ID NO: 383569 - RNA, 32 nt, Human
ccuuccuuccuuccuuccuuccuuccucucuc

SEQ ID NO: 383570 - RNA, 32 nt, Human
ccuuccuuccuuccuuccuuccuuccuucauu

SEQ ID NO: 383571 - RNA, 32 nt, Human
ccuuccuuccuuccuuccuuccuuccuucccu

SEQ ID NO: 383572 - RNA, 32 nt, Human
ccuuccuuccuuccuuccuuccuuccuuccuc

SEQ ID NO: 383573 - RNA, 32 nt, Human
ccuuccuuccuuccuuccuuccuuccuuccuu

SEQ ID NO: 383574 - RNA, 32 nt, Human
ccuuccuuccuuccuuccuuccuuccuucgag

SEQ ID NO: 383575 - RNA, 32 nt, Human
ccuuccuuccuuccuuccuuccuuccuucuuu

SEQ ID NO: 383576 - RNA, 32 nt, Human
ccuuccuuccuuccuucguuccuuccuuccuu

SEQ ID NO: 383577 - RNA, 32 nt, Human
ccuuccuuccuuccuucuuuccuuccuuccuu

SEQ ID NO: 383578 - RNA, 32 nt, Human
ccuuccuuccuucguuccuuccuuccuucauu

SEQ ID NO: 383579 - RNA, 32 nt, Human
ccuuccuuccuucuuuccuuccuuccuuccuu

SEQ ID NO: 383580 - RNA, 32 nt, Human
ccuuccuucucagggucuccccagcccagucc

SEQ ID NO: 383581 - RNA, 19 nt, Human
ccuuccuucugcuucuccc

SEQ ID NO: 383582 - RNA, 32 nt, Human
ccuuccuucugguggcagagccagucuucugg

SEQ ID NO: 383583 - RNA, 32 nt, Human
ccuuccuucuucuccccuuccgccaucuccac

SEQ ID NO: 383584 - RNA, 32 nt, Human
ccuuccuucuuuccuuccuuccuuccuuccuu

SEQ ID NO: 383585 - RNA, 32 nt, Human
ccuuccuucuuuccuuucucuucuuuuaucuc

SEQ ID NO: 383586 - RNA, 24 nt, Human
ccuuccuugaaaugcuggacgccg

SEQ ID NO: 383587 - RNA, 32 nt, Human
ccuuccuugacugucuagccacucccucccag

SEQ ID NO: 383588 - RNA, 32 nt, Human
ccuuccuugagcugucgcuguacucugaaguu

SEQ ID NO: 383589 - RNA, 32 nt, Human
ccuuccuugugugucugcucuggaccacuucc

SEQ ID NO: 383590 - RNA, 32 nt, Human
ccuuccuuuagcccacagcccagagucccagc

SEQ ID NO: 383591 - RNA, 32 nt, Human
ccuuccuuucacuccauucauuguccucucug

SEQ ID NO: 383592 - RNA, 32 nt, Human
ccuuccuuuccagagcaauugucuccuccucu

SEQ ID NO: 383593 - RNA, 32 nt, Human
ccuuccuuucccuagucacaggaucgcaguuu

SEQ ID NO: 383594 - RNA, 32 nt, Human
ccuuccuuucccucccauucugagggccucag

SEQ ID NO: 383595 - RNA, 32 nt, Human
ccuuccuuucccuccuccucccccucuccgcu

SEQ ID NO: 383596 - RNA, 32 nt, Human
ccuuccuuucuuccauucauccuuccuugccu

SEQ ID NO: 383597 - RNA, 32 nt, Human
ccuuccuuucuucccuccucccccucauccuu

SEQ ID NO: 383598 - RNA, 22 nt, Human
ccuuccuuugccucugucugcc

SEQ ID NO: 383599 - RNA, 21 nt, Human
ccuuccuuugucacuugcccg

SEQ ID NO: 383600 - RNA, 23 nt, Human
ccuuccuuuguccugcccgcugg

SEQ ID NO: 383601 - RNA, 32 nt, Human
ccuuccuuuguuccuuuguuccuuccuuccuu

SEQ ID NO: 383602 - RNA, 32 nt, Human
ccuuccuuuuauuccuguggggccagacaggg

SEQ ID NO: 383603 - RNA, 32 nt, Human
ccuucgaaaugaggguccugggugggcgcugc

SEQ ID NO: 383604 - RNA, 16 nt, Human
ccuucgaauuugguca

SEQ ID NO: 383605 - RNA, 32 nt, Human
ccuucgacagcugagagacaaaaagaagcccg

SEQ ID NO: 383606 - RNA, 32 nt, Human
ccuucgauccccaucagagaggucacaugagc

SEQ ID NO: 383607 - RNA, 32 nt, Human
ccuucgcagucgcgcaccgacgcucaaacgcg

SEQ ID NO: 383608 - RNA, 32 nt, Human
ccuucgcaucuccuccucgcgcgucuuggaca

SEQ ID NO: 383609 - RNA, 32 nt, Human
ccuucgccaggacccgacacaccaggcuucgc

SEQ ID NO: 383610 - RNA, 19 nt, Human
ccuucgcccuguggccugc

SEQ ID NO: 383611 - RNA, 32 nt, Human
ccuucgccgaagaaguacuuguugcgcagugg

SEQ ID NO: 383612 - RNA, 32 nt, Human
ccuucgccgagggccgcagggagccagagacu

SEQ ID NO: 383613 - RNA, 32 nt, Human
ccuucgccucccagguucaagugauuguccca

SEQ ID NO: 383614 - RNA, 32 nt, Human
ccuucgccuccuggguucaaguguuuccggcu

SEQ ID NO: 383615 - RNA, 32 nt, Human
ccuucgccuuuauuuuuacucucccucuucug

SEQ ID NO: 383616 - RNA, 32 nt, Human
ccuucgcuaugacuuccugauagcggaaaagg

SEQ ID NO: 383617 - RNA, 32 nt, Human
ccuucgcuccccgaccuccugcugcagcucug

SEQ ID NO: 383618 - RNA, 32 nt, Human
ccuucggaaacgcgcugacaccaggcgaagcc

SEQ ID NO: 383619 - RNA, 32 nt, Human
ccuucggagaaagagcuggauuggcuggggau

SEQ ID NO: 383620 - RNA, 32 nt, Human
ccuucggaguagcugggaucacagcugcaggc

SEQ ID NO: 383621 - RNA, 32 nt, Human
ccuucggaguagcugggauuacaggcaggugc

SEQ ID NO: 383622 - RNA, 32 nt, Human
ccuucggaguggcugggauuacaggugugcgc

SEQ ID NO: 383623 - RNA, 32 nt, Human
ccuucggaguuucuuagucauuacuguccuuu

SEQ ID NO: 383624 - RNA, 32 nt, Human
ccuucggcacagaggcccuccuccuggcccac

SEQ ID NO: 383625 - RNA, 24 nt, Human
ccuucggcccacucugggggccug

SEQ ID NO: 383626 - RNA, 22 nt, Human
ccuucggcccuguuccccaagg

SEQ ID NO: 383627 - RNA, 17 nt, Human
ccuucggccuccuugua

SEQ ID NO: 383628 - RNA, 32 nt, Human
ccuucggggugagcccccagagcuggaccuga

SEQ ID NO: 383629 - RNA, 25 nt, Human
ccuucggucgggcgugauuucagca

SEQ ID NO: 383630 - RNA, 32 nt, Human
ccuucggugcacagggaacagcagggaccuga

SEQ ID NO: 383631 - RNA, 32 nt, Human
ccuucggugguggcggcggcagcugcugccgg

SEQ ID NO: 383632 - RNA, 32 nt, Human
ccuucgguuccuucucugcuggccccagaagc

SEQ ID NO: 383633 - RNA, 32 nt, Human
ccuucgguuguuccagcuccuucugaauacac

SEQ ID NO: 383634 - RNA, 32 nt, Human
ccuucguauguaggugagaaacuuagcuggaa

SEQ ID NO: 383635 - RNA, 32 nt, Human
ccuucgucucuucaucugucaccaaagacaaa

SEQ ID NO: 383636 - RNA, 28 nt, Human
ccuucgucugggagugggguggggaggc

SEQ ID NO: 383637 - RNA, 32 nt, Human
ccuucgucuuucucccaugcuggaugcuuccu

SEQ ID NO: 383638 - RNA, 32 nt, Human
ccuucgugcagcuucuugccccuguugacgug

SEQ ID NO: 383639 - RNA, 32 nt, Human
ccuucguggacagaagccagaguucagagagg

SEQ ID NO: 383640 - RNA, 32 nt, Human
ccuucgugugagccaaccccacccgcuccacc

SEQ ID NO: 383641 - RNA, 21 nt, Human
ccuucguucaagggucaggaa

SEQ ID NO: 383642 - RNA, 32 nt, Human
ccuucguuuucaucuucuaguuugucuauuuu

SEQ ID NO: 383643 - RNA, 32 nt, Human
ccuucuaaagugcugggauuacaggcgugagc

SEQ ID NO: 383644 - RNA, 32 nt, Human
ccuucuaaagugcugggauuacaggcgugagu

SEQ ID NO: 383645 - RNA, 32 nt, Human
ccuucuaaagugcugggauuacaggugugagc

SEQ ID NO: 383646 - RNA, 32 nt, Human
ccuucuaagaagagaagacagggacacacagg

SEQ ID NO: 383647 - RNA, 32 nt, Human
ccuucuaauaaaagagacuuuccucuucccuu

SEQ ID NO: 383648 - RNA, 32 nt, Human
ccuucuacagcuuagcuccgucuuuucaacca

SEQ ID NO: 383649 - RNA, 32 nt, Human
ccuucuacauaacuccaauaccaaaauagaaa

SEQ ID NO: 383650 - RNA, 32 nt, Human
ccuucuaccaggccacucucaggcucaccuua

SEQ ID NO: 383651 - RNA, 32 nt, Human
ccuucuaccagguccccauccugcugccagcu

SEQ ID NO: 383652 - RNA, 32 nt, Human
ccuucuacccugcaccugaccucaugaucccc

SEQ ID NO: 383653 - RNA, 32 nt, Human
ccuucuacuaccugugugaucuuggggaaauu

SEQ ID NO: 383654 - RNA, 32 nt, Human
ccuucuacuuggggaucaugcagagagcuuca

SEQ ID NO: 383655 - RNA, 32 nt, Human
ccuucuacuuguguccauuugaagcaggaggg

SEQ ID NO: 383656 - RNA, 32 nt, Human
ccuucuagaaaaucaguguucacagagacugc

SEQ ID NO: 383657 - RNA, 32 nt, Human
ccuucuagaagagaugauggugggagagugcu

SEQ ID NO: 383658 - RNA, 32 nt, Human
ccuucuagagcagaaaagggagagaaguguug

SEQ ID NO: 383659 - RNA, 32 nt, Human
ccuucuagccuucuccugcccuccugugucuc

SEQ ID NO: 383660 - RNA, 32 nt, Human
ccuucuaggaauggggaacaggggaggggagg

SEQ ID NO: 383661 - RNA, 32 nt, Human
ccuucuaggaaugggggacagggggaggggag

SEQ ID NO: 383662 - RNA, 32 nt, Human
ccuucuagucagaagcgagcuauagaguuggc

SEQ ID NO: 383663 - RNA, 32 nt, Human
ccuucuauccugaauaacuagcauggaaaagu

SEQ ID NO: 383664 - RNA, 32 nt, Human
ccuucuaucugccucccaacuccucaagguca

SEQ ID NO: 383665 - RNA, 32 nt, Human
ccuucuaugguaucauacacuucuuuuccugg

SEQ ID NO: 383666 - RNA, 22 nt, Human
ccuucuauuuucuauaauugua

SEQ ID NO: 383667 - RNA, 32 nt, Human
ccuucucaaaacugagucagcaagagaaaauc

SEQ ID NO: 383668 - RNA, 21 nt, Human
ccuucucaaugcaugugcagg

SEQ ID NO: 383669 - RNA, 32 nt, Human
ccuucucaauuucucauagauuuuaccuuaaa

SEQ ID NO: 383670 - RNA, 32 nt, Human
ccuucucaccagcccccuccucccuuuucauc

SEQ ID NO: 383671 - RNA, 32 nt, Human
ccuucucaccccuugcaguguugcaggcucag

SEQ ID NO: 383672 - RNA, 32 nt, Human
ccuucucacuucagacacauacaucacuuuca

SEQ ID NO: 383673 - RNA, 32 nt, Human
ccuucucacuucugccugaaucacacaggcua

SEQ ID NO: 383674 - RNA, 32 nt, Human
ccuucucagaaaacuucucuucugagccucuu

SEQ ID NO: 383675 - RNA, 32 nt, Human
ccuucucagaaccaguccccugcugaccucaa

SEQ ID NO: 383676 - RNA, 32 nt, Human
ccuucucagaagcaaggaguggacaagccucu

SEQ ID NO: 383677 - RNA, 21 nt, Human
ccuucucagauaccugugcau

SEQ ID NO: 383678 - RNA, 32 nt, Human
ccuucucagccacacuucccaccccagggggu

SEQ ID NO: 383679 - RNA, 32 nt, Human
ccuucucagccucugaggauccaggcucagga

SEQ ID NO: 383680 - RNA, 32 nt, Human
ccuucucagcggugugauggcagauggacacu

SEQ ID NO: 383681 - RNA, 32 nt, Human
ccuucucagcgugaccccagacauccugcaac

SEQ ID NO: 383682 - RNA, 32 nt, Human
ccuucucaggaaccuagaaacaacaccgcuug

SEQ ID NO: 383683 - RNA, 32 nt, Human
ccuucucaguaugccagcugucucaauggcuc

SEQ ID NO: 383684 - RNA, 32 nt, Human
ccuucucaguccagcuggaggcuggagggaga

SEQ ID NO: 383685 - RNA, 32 nt, Human
ccuucucaguuauucuggaauaaggcaaggag

SEQ ID NO: 383686 - RNA, 32 nt, Human
ccuucucaguuucuccccaaccuccccuuuuc

SEQ ID NO: 383687 - RNA, 32 nt, Human
ccuucucauaacuauguccacccucuacgucu

SEQ ID NO: 383688 - RNA, 32 nt, Human
ccuucucauccgggcauucgggucccugcgag

SEQ ID NO: 383689 - RNA, 32 nt, Human
ccuucucauggugcuacuuccucugucagcua

SEQ ID NO: 383690 - RNA, 32 nt, Human
ccuucucauucccagcgcguccuucugagcuc

SEQ ID NO: 383691 - RNA, 32 nt, Human
ccuucucauuuuuguuaguuugcccuuucggc

SEQ ID NO: 383692 - RNA, 32 nt, Human
ccuucuccaagcucuggagcccucgcguccca

SEQ ID NO: 383693 - RNA, 32 nt, Human
ccuucuccaccccagcccccaaagcagcccuu

SEQ ID NO: 383694 - RNA, 32 nt, Human
ccuucuccacggcagcgaccuccgucucaagu

SEQ ID NO: 383695 - RNA, 32 nt, Human
ccuucuccagccucucuuucucugcuugauga

SEQ ID NO: 383696 - RNA, 32 nt, Human
ccuucuccagcuucaucaucucacaguggucu

SEQ ID NO: 383697 - RNA, 18 nt, Human
ccuucuccagcuuccugg

SEQ ID NO: 383698 - RNA, 32 nt, Human
ccuucuccaggauggcagaggcggaauugcac

SEQ ID NO: 383699 - RNA, 32 nt, Human
ccuucuccagugcucucggggagguugcacca

SEQ ID NO: 383700 - RNA, 32 nt, Human
ccuucuccauaccccucuccccagcaucauga

SEQ ID NO: 383701 - RNA, 32 nt, Human
ccuucuccauaggaagaggaggcgaguccccu

SEQ ID NO: 383702 - RNA, 32 nt, Human
ccuucuccauucucccaaccucuugggccugg

SEQ ID NO: 383703 - RNA, 32 nt, Human
ccuucuccauuuucucaguuaucucuaccagu

SEQ ID NO: 383704 - RNA, 32 nt, Human
ccuucucccaccccuccuggaccuagccaccc

SEQ ID NO: 383705 - RNA, 32 nt, Human
ccuucucccagaugcaggauguuuucaaccag

SEQ ID NO: 383706 - RNA, 21 nt, Human
ccuucucccauggagcauggc

SEQ ID NO: 383707 - RNA, 22 nt, Human
ccuucuccccacccugccgagg

SEQ ID NO: 383708 - RNA, 32 nt, Human
ccuucuccccuccagaccccuacccuuuccca

SEQ ID NO: 383709 - RNA, 32 nt, Human
ccuucuccccucuaaaccuucucccaucucuu

SEQ ID NO: 383710 - RNA, 32 nt, Human
ccuucuccccuucagaauucccgcccccaccc

SEQ ID NO: 383711 - RNA, 19 nt, Human
ccuucucccgcccuccuca

SEQ ID NO: 383712 - RNA, 22 nt, Human
ccuucucccgcccuccucaccu

SEQ ID NO: 383713 - RNA, 32 nt, Human
ccuucucccucagaccagggaccgucaucauc

SEQ ID NO: 383714 - RNA, 31 nt, Human
ccuucucccucccacaggccuguguucuugg

SEQ ID NO: 383715 - RNA, 20 nt, Human
ccuucucccucucccuuccc

SEQ ID NO: 383716 - RNA, 32 nt, Human
ccuucucccuuuacccuucuccagaaauaaag

SEQ ID NO: 383717 - RNA, 32 nt, Human
ccuucucccuuuccaaccccuuccuuccuuuu

SEQ ID NO: 383718 - RNA, 32 nt, Human
ccuucucccuuuccuucuuuaccucccucccu

SEQ ID NO: 383719 - RNA, 32 nt, Human
ccuucuccucagccuucuccuuagccgguggc

SEQ ID NO: 383720 - RNA, 32 nt, Human
ccuucuccuccaccaguuccccagagcagagc

SEQ ID NO: 383721 - RNA, 32 nt, Human
ccuucuccuccaccugcuaccuaacagccaaa

SEQ ID NO: 383722 - RNA, 22 nt, Human
ccuucuccuccccgcagcuugc

SEQ ID NO: 383723 - RNA, 32 nt, Human
ccuucuccuccuccuccuccucuucccuuggg

SEQ ID NO: 383724 - RNA, 32 nt, Human
ccuucuccuccuccuccuucucuuccuuuccu

SEQ ID NO: 383725 - RNA, 32 nt, Human
ccuucuccucuuccugacccucccuccccugg

SEQ ID NO: 383726 - RNA, 32 nt, Human
ccuucuccugggagguccugcugcaacucaag

SEQ ID NO: 383727 - RNA, 32 nt, Human
ccuucuccuuucucccauucuucccugccucu

SEQ ID NO: 383728 - RNA, 32 nt, Human
ccuucuccuuuuccuuuguggccuuaacccuu

SEQ ID NO: 383729 - RNA, 32 nt, Human
ccuucuccuuuuuccuccucuuccuccuuccu

SEQ ID NO: 383730 - RNA, 20 nt, Human
ccuucucgccacucuucuca

SEQ ID NO: 383731 - RNA, 32 nt, Human
ccuucucgcgccugaccaugcaccccugcauc

SEQ ID NO: 383732 - RNA, 21 nt, Human
ccuucucuaaaaaacaggaag

SEQ ID NO: 383733 - RNA, 32 nt, Human
ccuucucuacccacccucuucucucuucucuu

SEQ ID NO: 383734 - RNA, 32 nt, Human
ccuucucuacuaaaauacacaaauuagcuagg

SEQ ID NO: 383735 - RNA, 32 nt, Human
ccuucucucacucccuuucuucaugcuuccac

SEQ ID NO: 383736 - RNA, 32 nt, Human
ccuucucucacucccuuucuucaugcuucccc

SEQ ID NO: 383737 - RNA, 21 nt, Human
ccuucucuccaccaccauaga

SEQ ID NO: 383738 - RNA, 32 nt, Human
ccuucucuccacccaauugugccaguaaaugg

SEQ ID NO: 383739 - RNA, 32 nt, Human
ccuucucucccaccccuuccuucugagccggg

SEQ ID NO: 383740 - RNA, 32 nt, Human
ccuucucuccuccccuccccucccuucucauu

SEQ ID NO: 383741 - RNA, 32 nt, Human
ccuucucuccuuccucuuccucaugaaugggc

SEQ ID NO: 383742 - RNA, 32 nt, Human
ccuucucuccuucucuccuccucucuccucuc

SEQ ID NO: 383743 - RNA, 32 nt, Human
ccuucucucugaaauccucccugcuuugacaa

SEQ ID NO: 383744 - RNA, 32 nt, Human
ccuucucucuuacuccugcucucacuauguga

SEQ ID NO: 383745 - RNA, 32 nt, Human
ccuucucugaguagcacggauuugaggagaag

SEQ ID NO: 383746 - RNA, 32 nt, Human
ccuucucugaugcucaccccucccaggcccug

SEQ ID NO: 383747 - RNA, 32 nt, Human
ccuucucugcaccucagagugcagaaccacag

SEQ ID NO: 383748 - RNA, 18 nt, Human
ccuucucugccacccgaa

SEQ ID NO: 383749 - RNA, 32 nt, Human
ccuucucugcccgccccagugccuuauggguc

SEQ ID NO: 383750 - RNA, 32 nt, Human
ccuucucugccucuucucauccuuucucgcuc

SEQ ID NO: 383751 - RNA, 32 nt, Human
ccuucucuggacugcacuguagggccuggaga

SEQ ID NO: 383752 - RNA, 32 nt, Human
ccuucucuggccaucuccuucccuccuuccag

SEQ ID NO: 383753 - RNA, 32 nt, Human
ccuucucugggguccaucagagucuagaggau

SEQ ID NO: 383754 - RNA, 32 nt, Human
ccuucucuguccacccccuccuaagcuagaca

SEQ ID NO: 383755 - RNA, 32 nt, Human
ccuucucuuccuccuccuccgucuucuucccu

SEQ ID NO: 383756 - RNA, 32 nt, Human
ccuucucuucugcuguuuaauuccagacuggu

SEQ ID NO: 383757 - RNA, 32 nt, Human
ccuucucuuuccuccuccuccucaccaagggc

SEQ ID NO: 383758 - RNA, 19 nt, Human
ccuucucuuuggagcccuu

SEQ ID NO: 383759 - RNA, 32 nt, Human
ccuucugaagaagcccacagggcuccuaaggu

SEQ ID NO: 383760 - RNA, 32 nt, Human
ccuucugaagacaggaagaaagucaauaauau

SEQ ID NO: 383761 - RNA, 32 nt, Human
ccuucugaaucucuccagcagccagaggcacg

SEQ ID NO: 383762 - RNA, 32 nt, Human
ccuucugacacuaaguuccacucuccagagga

SEQ ID NO: 383763 - RNA, 32 nt, Human
ccuucugagcagcugggauuaugaaggggugg

SEQ ID NO: 383764 - RNA, 21 nt, Human
ccuucugagcccauguuuucu

SEQ ID NO: 383765 - RNA, 32 nt, Human
ccuucugagcccccgacccgaggcgccgagcc

SEQ ID NO: 383766 - RNA, 32 nt, Human
ccuucugaguagcuggaauuacaggcugucua

SEQ ID NO: 383767 - RNA, 32 nt, Human
ccuucugaguagcugggaccacaggcgugcac

SEQ ID NO: 383768 - RNA, 32 nt, Human
ccuucugaguagcugggacuacaggcacacgc

SEQ ID NO: 383769 - RNA, 32 nt, Human
ccuucugaguagcugggacuacaggcacaugu

SEQ ID NO: 383770 - RNA, 32 nt, Human
ccuucugaguagcugggacuacaggugugcac

SEQ ID NO: 383771 - RNA, 32 nt, Human
ccuucugaguagcugggacuacaguugguucu

SEQ ID NO: 383772 - RNA, 32 nt, Human
ccuucugaguagcugggaguacaggcgcccgc

SEQ ID NO: 383773 - RNA, 32 nt, Human
ccuucugaguagcugggauuacacgcgugugc

SEQ ID NO: 383774 - RNA, 32 nt, Human
ccuucugaguagcugggauuacaggcaagcac

SEQ ID NO: 383775 - RNA, 32 nt, Human
ccuucugaguagcugggauuacaggcaugcgc

SEQ ID NO: 383776 - RNA, 32 nt, Human
ccuucugaguccccaccccaaccuguucaaac

SEQ ID NO: 383777 - RNA, 32 nt, Human
ccuucugagugucagaggaacggccagacccc

SEQ ID NO: 383778 - RNA, 32 nt, Human
ccuucugcaacguggacaucuccuuggggcug

SEQ ID NO: 383779 - RNA, 32 nt, Human
ccuucugcaaugugugaucacagcuagaaggc

SEQ ID NO: 383780 - RNA, 32 nt, Human
ccuucugcacccagaguagggguggaguauac

SEQ ID NO: 383781 - RNA, 32 nt, Human
ccuucugcagagcuagugcagacuaggauggc

SEQ ID NO: 383782 - RNA, 32 nt, Human
ccuucugccagccugcauccucuccucaggcc

SEQ ID NO: 383783 - RNA, 32 nt, Human
ccuucugccaugccacaacucucuccacucuc

SEQ ID NO: 383784 - RNA, 32 nt, Human
ccuucugccccagguuuuuggcuacugauguu

SEQ ID NO: 383785 - RNA, 17 nt, Human
ccuucugccccuccuca

SEQ ID NO: 383786 - RNA, 32 nt, Human
ccuucugccccucucuaccucuuccacucaug

SEQ ID NO: 383787 - RNA, 32 nt, Human
ccuucugcccucuccccucccugccccugugu

SEQ ID NO: 383788 - RNA, 32 nt, Human
ccuucugcccucucuccauugccugcacccca

SEQ ID NO: 383789 - RNA, 32 nt, Human
ccuucugcccugccugccucccugcaccugcg

SEQ ID NO: 383790 - RNA, 32 nt, Human
ccuucugcccugccuugccccugcacuaugcu

SEQ ID NO: 383791 - RNA, 23 nt, Human
ccuucugcccuuaaaugcuuccu

SEQ ID NO: 383792 - RNA, 32 nt, Human
ccuucugcccuuguaagcccaucccagcuacu

SEQ ID NO: 383793 - RNA, 32 nt, Human
ccuucugccuacacuccugccugcugugccua

SEQ ID NO: 383794 - RNA, 21 nt, Human
ccuucugccugccacuggggc

SEQ ID NO: 383795 - RNA, 32 nt, Human
ccuucugccuggaauacucucuccccagauuu

SEQ ID NO: 383796 - RNA, 32 nt, Human
ccuucugccuuccaccaugggaugaugcagca

SEQ ID NO: 383797 - RNA, 32 nt, Human
ccuucugccuuccccuuccuucuuuccuuauu

SEQ ID NO: 383798 - RNA, 32 nt, Human
ccuucugcggcggcagaagugaagugccugag

SEQ ID NO: 383799 - RNA, 32 nt, Human
ccuucugcguuuccucacucucacauaccagc

SEQ ID NO: 383800 - RNA, 32 nt, Human
ccuucugcuccaccuucucucucugcccucac

SEQ ID NO: 383801 - RNA, 32 nt, Human
ccuucugcucuuuaucuuuucagcuaugacug

SEQ ID NO: 383802 - RNA, 32 nt, Human
ccuucugcugacacuccugccugcuguuccug

SEQ ID NO: 383803 - RNA, 32 nt, Human
ccuucugcugcagcuuccugagucggcggagg

SEQ ID NO: 383804 - RNA, 32 nt, Human
ccuucugcugcuccugcuucuccugagguguu

SEQ ID NO: 383805 - RNA, 23 nt, Human
ccuucugcugcuccuguuggcug

SEQ ID NO: 383806 - RNA, 32 nt, Human
ccuucugcugcucucguggcccccucgcgaug

SEQ ID NO: 383807 - RNA, 21 nt, Human
ccuucugcugcugccauccuc

SEQ ID NO: 383808 - RNA, 24 nt, Human
ccuucugcugcugcccccaccucu

SEQ ID NO: 383809 - RNA, 31 nt, Human
ccuucugcugucucuggggcgagucuuggag

SEQ ID NO: 383810 - RNA, 32 nt, Human
ccuucugcuguugccgcagcaacccagaaagc

SEQ ID NO: 383811 - RNA, 23 nt, Human
ccuucugcuucccccauucccuu

SEQ ID NO: 383812 - RNA, 32 nt, Human
ccuucuggaagccugcacuccagcuucgagug

SEQ ID NO: 383813 - RNA, 32 nt, Human
ccuucuggacagucacaccagggacuucccag

SEQ ID NO: 383814 - RNA, 32 nt, Human
ccuucuggagccagcucaucagcucagagccc

SEQ ID NO: 383815 - RNA, 32 nt, Human
ccuucuggcccgagaagagaucagagauuggu

SEQ ID NO: 383816 - RNA, 30 nt, Human
ccuucuggccucuccugcugcugaccugau

SEQ ID NO: 383817 - RNA, 32 nt, Human
ccuucuggcuuccucugucccacguggcugag

SEQ ID NO: 383818 - RNA, 18 nt, Human
ccuucugggagcuccucc

SEQ ID NO: 383819 - RNA, 32 nt, Human
ccuucuggggagaagaaauggguuuuggcccc

SEQ ID NO: 383820 - RNA, 32 nt, Human
ccuucugggucagaggagagagacugaauugg

SEQ ID NO: 383821 - RNA, 32 nt, Human
ccuucuggguugacuccaagagccaaggagau

SEQ ID NO: 383822 - RNA, 32 nt, Human
ccuucuggguuuucuuuuugacaauucuugga

SEQ ID NO: 383823 - RNA, 32 nt, Human
ccuucugguuuggaggaaguggagccuccacg

SEQ ID NO: 383824 - RNA, 32 nt, Human
ccuucuguaaccacagugcccaaacgaagagg

SEQ ID NO: 383825 - RNA, 32 nt, Human
ccuucuguaggggauuacugagacagggaaga

SEQ ID NO: 383826 - RNA, 32 nt, Human
ccuucuguccagggccucuccaccccaacccc

SEQ ID NO: 383827 - RNA, 19 nt, Human
ccuucugucccccuuggag

SEQ ID NO: 383828 - RNA, 32 nt, Human
ccuucuguccuccuccuguucuugccuuggac

SEQ ID NO: 383829 - RNA, 32 nt, Human
ccuucugucgcccaggcuggagugcaguggcg

SEQ ID NO: 383830 - RNA, 32 nt, Human
ccuucugucuccucucagucucucuuccgccu

SEQ ID NO: 383831 - RNA, 32 nt, Human
ccuucugugaagccuccaguggagaacugggc

SEQ ID NO: 383832 - RNA, 32 nt, Human
ccuucugugcaaaagccuuccucccagggaga

SEQ ID NO: 383833 - RNA, 32 nt, Human
ccuucugugcaggacgcucagccucagggcuc

SEQ ID NO: 383834 - RNA, 32 nt, Human
ccuucugugcaggccagcagggccccaucucu

SEQ ID NO: 383835 - RNA, 32 nt, Human
ccuucugugccuccuaccauguucccuuuaac

SEQ ID NO: 383836 - RNA, 32 nt, Human
ccuucuguggaucacagcugaaagggguagcc

SEQ ID NO: 383837 - RNA, 32 nt, Human
ccuucuguggggacuccggcugugcugggaga

SEQ ID NO: 383838 - RNA, 32 nt, Human
ccuucugugugcuucaccucacucucuacuuc

SEQ ID NO: 383839 - RNA, 32 nt, Human
ccuucugugugggcugcacauggugacuuccu

SEQ ID NO: 383840 - RNA, 32 nt, Human
ccuucuguuaccacaucucucugacaccagug

SEQ ID NO: 383841 - RNA, 32 nt, Human
ccuucuguuacccagcuccuggaggcaguggc

SEQ ID NO: 383842 - RNA, 32 nt, Human
ccuucuguuaucgcugacagcuuucuugcguc

SEQ ID NO: 383843 - RNA, 18 nt, Human
ccuucuguuccauccucu

SEQ ID NO: 383844 - RNA, 32 nt, Human
ccuucuguucucucuuuccccguccuuccucu

SEQ ID NO: 383845 - RNA, 32 nt, Human
ccuucuguucuuccacaacacaggguuugugg

SEQ ID NO: 383846 - RNA, 32 nt, Human
ccuucuguugcccaugccccugccugaaagug

SEQ ID NO: 383847 - RNA, 32 nt, Human
ccuucuguuuccaugucacagcuccaccauau

SEQ ID NO: 383848 - RNA, 32 nt, Human
ccuucuuaacaaaagucuuugauaacuuaaga

SEQ ID NO: 383849 - RNA, 32 nt, Human
ccuucuuaauggagagcucccgauggagggcu

SEQ ID NO: 383850 - RNA, 32 nt, Human
ccuucuuacugcccuguccucugccuuggaag

SEQ ID NO: 383851 - RNA, 32 nt, Human
ccuucuuaugggaggucgacccagacugccac

SEQ ID NO: 383852 - RNA, 32 nt, Human
ccuucuuauuguccuccuccuccuggcucggc

SEQ ID NO: 383853 - RNA, 32 nt, Human
ccuucuuauuuaagacuucccaccuuacuaaa

SEQ ID NO: 383854 - RNA, 22 nt, Human
ccuucuucaagagagcuuucuu

SEQ ID NO: 383855 - RNA, 28 nt, Human
ccuucuucaagugcugccugcucacuga

SEQ ID NO: 383856 - RNA, 22 nt, Human
ccuucuucaaguuuauuuuccu

SEQ ID NO: 383857 - RNA, 32 nt, Human
ccuucuucacuaccucagaucuaaucaauuag

SEQ ID NO: 383858 - RNA, 32 nt, Human
ccuucuucagaauguucugcgggacccccugg

SEQ ID NO: 383859 - RNA, 32 nt, Human
ccuucuucaggccuugaaucaaaagccacuuu

SEQ ID NO: 383860 - RNA, 22 nt, Human
ccuucuucaguuaguucuuccu

SEQ ID NO: 383861 - RNA, 32 nt, Human
ccuucuucauacugcugcucuguugccagaga

SEQ ID NO: 383862 - RNA, 32 nt, Human
ccuucuucaucauuugaugugaugccagauac

SEQ ID NO: 383863 - RNA, 32 nt, Human
ccuucuucauucuacaccacccccaacacaua

SEQ ID NO: 383864 - RNA, 32 nt, Human
ccuucuucauuuccacccacgcucccagccuc

SEQ ID NO: 383865 - RNA, 22 nt, Human
ccuucuuccaaagcuagcuugg

SEQ ID NO: 383866 - RNA, 32 nt, Human
ccuucuuccagggccugggaggauagggcuaa

SEQ ID NO: 383867 - RNA, 24 nt, Human
ccuucuuccaguugcacuauucug

SEQ ID NO: 383868 - RNA, 32 nt, Human
ccuucuuccccaaaaccagcagugccauaccu

SEQ ID NO: 383869 - RNA, 32 nt, Human
ccuucuuccccacaacagaagagaccagcgac

SEQ ID NO: 383870 - RNA, 32 nt, Human
ccuucuuccccaggcugggagugggugagacg

SEQ ID NO: 383871 - RNA, 32 nt, Human
ccuucuucccuuccaucucccccuccucccug

SEQ ID NO: 383872 - RNA, 32 nt, Human
ccuucuucccuuucccuuccucuccccuaccc

SEQ ID NO: 383873 - RNA, 32 nt, Human
ccuucuuccggcggggagugggagccucucgc

SEQ ID NO: 383874 - RNA, 32 nt, Human
ccuucuuccucagccagaaaggaucuuucccu

SEQ ID NO: 383875 - RNA, 32 nt, Human
ccuucuuccuccacuugugucagcuugcauuu

SEQ ID NO: 383876 - RNA, 32 nt, Human
ccuucuuccucccaccauggcagguggggagc

SEQ ID NO: 383877 - RNA, 32 nt, Human
ccuucuuccucuuggaguccccagugucuauu

SEQ ID NO: 383878 - RNA, 32 nt, Human
ccuucuuccugccguggccagcgcggccggcg

SEQ ID NO: 383879 - RNA, 32 nt, Human
ccuucuuccugcucccccuccuagccuagggu

SEQ ID NO: 383880 - RNA, 32 nt, Human
ccuucuuccuuuccuuguuauucaccucccug

SEQ ID NO: 383881 - RNA, 32 nt, Human
ccuucuucuccaaccucuaccccaccauuagu

SEQ ID NO: 383882 - RNA, 32 nt, Human
ccuucuucuccaccaccuguccagcuucuucc

SEQ ID NO: 383883 - RNA, 32 nt, Human
ccuucuucucccccuuccccugugcucccuuu

SEQ ID NO: 383884 - RNA, 19 nt, Human
ccuucuucucccuuagaga

SEQ ID NO: 383885 - RNA, 32 nt, Human
ccuucuucugcagcuccuggugcugcuugugu

SEQ ID NO: 383886 - RNA, 32 nt, Human
ccuucuucugccgcuucuggugcugcuugugu

SEQ ID NO: 383887 - RNA, 32 nt, Human
ccuucuugaacugucguuuccucaggaacugg

SEQ ID NO: 383888 - RNA, 32 nt, Human
ccuucuugacccucucuccaucauucagcugc

SEQ ID NO: 383889 - RNA, 32 nt, Human
ccuucuugacgccagcccccacccucugucug

SEQ ID NO: 383890 - RNA, 32 nt, Human
ccuucuugagguggccgggcgcaguggcucac

SEQ ID NO: 383891 - RNA, 32 nt, Human
ccuucuugcccaggcuggagugcaagggcgca

SEQ ID NO: 383892 - RNA, 32 nt, Human
ccuucuugccucaccauuccccuaggcaggcc

SEQ ID NO: 383893 - RNA, 18 nt, Human
ccuucuugcucccccuca

SEQ ID NO: 383894 - RNA, 32 nt, Human
ccuucuugcuuugcuuugcuguggaccucucc

SEQ ID NO: 383895 - RNA, 32 nt, Human
ccuucuuggaaccuaaauugaacugccaagua

SEQ ID NO: 383896 - RNA, 32 nt, Human
ccuucuuggcucugcugacacucgagcccaca

SEQ ID NO: 383897 - RNA, 32 nt, Human
ccuucuugguagaagcuaaggugugagcuggg

SEQ ID NO: 383898 - RNA, 32 nt, Human
ccuucuugguugcugcagccuggguggauguu

SEQ ID NO: 383899 - RNA, 22 nt, Human
ccuucuuguuuggagcacaggg

SEQ ID NO: 383900 - RNA, 32 nt, Human
ccuucuuguuuguuccucuguguucugugugc

SEQ ID NO: 383901 - RNA, 22 nt, Human
ccuucuuuaacccauguuuucu

SEQ ID NO: 383902 - RNA, 32 nt, Human
ccuucuuuaccaccucuuccucccccucaaag

SEQ ID NO: 383903 - RNA, 32 nt, Human
ccuucuuuaccucugagcuuucugccuucuga

SEQ ID NO: 383904 - RNA, 32 nt, Human
ccuucuuuaccuucauuucauccuguuggcug

SEQ ID NO: 383905 - RNA, 32 nt, Human
ccuucuuuccacgcuuuccagccugugggagc

SEQ ID NO: 383906 - RNA, 32 nt, Human
ccuucuuuccccuuuugucuugcccacuccug

SEQ ID NO: 383907 - RNA, 19 nt, Human
ccuucuuucccuucagaga

SEQ ID NO: 383908 - RNA, 32 nt, Human
ccuucuuuccucacgcccuuccaaggcuccgg

SEQ ID NO: 383909 - RNA, 32 nt, Human
ccuucuuuccucacugcuccucuccacccagc

SEQ ID NO: 383910 - RNA, 32 nt, Human
ccuucuuuccuggaacucaggguguggggacu

SEQ ID NO: 383911 - RNA, 32 nt, Human
ccuucuuuccuuccuuccuuccuuccuuccuu

SEQ ID NO: 383912 - RNA, 32 nt, Human
ccuucuuucucaucucugucuuuaccauacuu

SEQ ID NO: 383913 - RNA, 32 nt, Human
ccuucuuucucuucaacccccuccccaccuuc

SEQ ID NO: 383914 - RNA, 22 nt, Human
ccuucuuucuuuguauuuuccu

SEQ ID NO: 383915 - RNA, 32 nt, Human
ccuucuuugcagcugcccagccccuccucccu

SEQ ID NO: 383916 - RNA, 32 nt, Human
ccuucuuugccuccuggggcggccgccaccca

SEQ ID NO: 383917 - RNA, 32 nt, Human
ccuucuuugccuucuugccacaggguccuuac

SEQ ID NO: 383918 - RNA, 32 nt, Human
ccuucuuugcuuuuugugggggagaggggagg

SEQ ID NO: 383919 - RNA, 32 nt, Human
ccuucuuugggcucagggcagagcagguguuu

SEQ ID NO: 383920 - RNA, 32 nt, Human
ccuucuuuguucugguagauccuggccugggg

SEQ ID NO: 383921 - RNA, 32 nt, Human
ccuucuuuuaucugcaaugugugaagggacuc

SEQ ID NO: 383922 - RNA, 32 nt, Human
ccuucuuuuaucugcacugugugaagggacuc

SEQ ID NO: 383923 - RNA, 32 nt, Human
ccuucuuuucucccuuuuaauccuggcugucg

SEQ ID NO: 383924 - RNA, 32 nt, Human
ccuucuuuucuuuuggacaagauaauacugug

SEQ ID NO: 383925 - RNA, 31 nt, Human
ccuugaaaagucagagagugauuuguuuugu

SEQ ID NO: 383926 - RNA, 32 nt, Human
ccuugaaacuucuuuuuguuugaggggguucu

SEQ ID NO: 383927 - RNA, 32 nt, Human
ccuugaaagucaccugaggaaguuuccccacu

SEQ ID NO: 383928 - RNA, 32 nt, Human
ccuugaacauggcacugcccuccucuggcacu

SEQ ID NO: 383929 - RNA, 32 nt, Human
ccuugaaccaggauggggagguugcagugagc

SEQ ID NO: 383930 - RNA, 32 nt, Human
ccuugaacccaggaggcagaaguugcagugag

SEQ ID NO: 383931 - RNA, 32 nt, Human
ccuugaacccaggaggcagagguugcaaugag

SEQ ID NO: 383932 - RNA, 32 nt, Human
ccuugaacccaggagguggagguugcagugag

SEQ ID NO: 383933 - RNA, 32 nt, Human
ccuugaaccuuaaauuuuaagucauguucauu

SEQ ID NO: 383934 - RNA, 32 nt, Human
ccuugaacugcagcgucaccucuucccugggc

SEQ ID NO: 383935 - RNA, 32 nt, Human
ccuugaacuugacuccagcgugacaggaguga

SEQ ID NO: 383936 - RNA, 32 nt, Human
ccuugaagaagaggaagaggaaagaaagacaa

SEQ ID NO: 383937 - RNA, 32 nt, Human
ccuugaagaggaagacggggcggaagaccaag

SEQ ID NO: 383938 - RNA, 32 nt, Human
ccuugaagagugagaaacaccuagggggacag

SEQ ID NO: 383939 - RNA, 32 nt, Human
ccuugaagauacgugcaaaaggugcuacccca

SEQ ID NO: 383940 - RNA, 32 nt, Human
ccuugaagcccaggcugaugcuugaaguaacu

SEQ ID NO: 383941 - RNA, 32 nt, Human
ccuugaagcccuggacacuggccacauucccu

SEQ ID NO: 383942 - RNA, 32 nt, Human
ccuugaagccucucuccuucucugccuacaaa

SEQ ID NO: 383943 - RNA, 32 nt, Human
ccuugaaggagaggagggcggggaaguuugcg

SEQ ID NO: 383944 - RNA, 32 nt, Human
ccuugaaggcagcagggugcccaggugaagcu

SEQ ID NO: 383945 - RNA, 32 nt, Human
ccuugaagggaaccucacaggcuuagccaggg

SEQ ID NO: 383946 - RNA, 32 nt, Human
ccuugaaggggaaaaagcuauuuucaauuggu

SEQ ID NO: 383947 - RNA, 32 nt, Human
ccuugaagggggaccuucuucuaaucuccucc

SEQ ID NO: 383948 - RNA, 32 nt, Human
ccuugaaggggguugaggguacaggcaaccuu

SEQ ID NO: 383949 - RNA, 20 nt, Human
ccuugaauagugcuuuucuc

SEQ ID NO: 383950 - RNA, 21 nt, Human
ccuugaauccaccucuuguuu

SEQ ID NO: 383951 - RNA, 23 nt, Human
ccuugaauccuggggacgggaag

SEQ ID NO: 383952 - RNA, 24 nt, Human
ccuugaauccuguuuacaacgaag

SEQ ID NO: 383953 - RNA, 32 nt, Human
ccuugaaugcuacugcuuggagagaggagagu

SEQ ID NO: 383954 - RNA, 32 nt, Human
ccuugaaugggaagaagccccacguuguccuu

SEQ ID NO: 383955 - RNA, 32 nt, Human
ccuugacaagggcugagcucucgggcacugcg

SEQ ID NO: 383956 - RNA, 23 nt, Human
ccuugacacuuuugaacauuucc

SEQ ID NO: 383957 - RNA, 32 nt, Human
ccuugacagauggccaagucaaaaccccucau

SEQ ID NO: 383958 - RNA, 32 nt, Human
ccuugacagcagcgcuggugcaaaaugaauug

SEQ ID NO: 383959 - RNA, 32 nt, Human
ccuugacaggcagggagggcuaggcugugcau

SEQ ID NO: 383960 - RNA, 32 nt, Human
ccuugacaggccuugucagagcagagggcagg

SEQ ID NO: 383961 - RNA, 32 nt, Human
ccuugacauucagcaaaagcccugacaguggu

SEQ ID NO: 383962 - RNA, 32 nt, Human
ccuugacauuuugcguuuuaauauuucucuua

SEQ ID NO: 383963 - RNA, 32 nt, Human
ccuugaccacuuuuucuuucuccggucgcucg

SEQ ID NO: 383964 - RNA, 21 nt, Human
ccuugaccaggcccagugccc

SEQ ID NO: 383965 - RNA, 32 nt, Human
ccuugacccagcccgguggcucuuacucucgc

SEQ ID NO: 383966 - RNA, 22 nt, Human
ccuugacccugaaaacagugaa

SEQ ID NO: 383967 - RNA, 32 nt, Human
ccuugaccugcgagggagagagaggacaccga

SEQ ID NO: 383968 - RNA, 32 nt, Human
ccuugaccugcugcauccuccucggcaauuuu

SEQ ID NO: 383969 - RNA, 32 nt, Human
ccuugacgcaaaaacucaaaccacaaauguuu

SEQ ID NO: 383970 - RNA, 21 nt, Human
ccuugacgccuguguacuucc

SEQ ID NO: 383971 - RNA, 32 nt, Human
ccuugacgucacucaaagacaggccccaaucc

SEQ ID NO: 383972 - RNA, 32 nt, Human
ccuugacguuuacuuucaaguaacacaaacuc

SEQ ID NO: 383973 - RNA, 32 nt, Human
ccuugacuacguaacaucuuguccucacagcc

SEQ ID NO: 383974 - RNA, 32 nt, Human
ccuugacuagccccuggccaucucuaggggag

SEQ ID NO: 383975 - RNA, 32 nt, Human
ccuugacuauaagagaaaagugaccugaagua

SEQ ID NO: 383976 - RNA, 32 nt, Human
ccuugacucaccucagcuuugccugcuugucc

SEQ ID NO: 383977 - RNA, 32 nt, Human
ccuugacuccaaaggccagccugggucagcca

SEQ ID NO: 383978 - RNA, 32 nt, Human
ccuugacucccagccucgucuucugcaccugu

SEQ ID NO: 383979 - RNA, 32 nt, Human
ccuugacuccccucugccucugagggcuucag

SEQ ID NO: 383980 - RNA, 32 nt, Human
ccuugacucucuuaagaauaacagugaaauau

SEQ ID NO: 383981 - RNA, 32 nt, Human
ccuugacucuuuccuggcuccagagcucaagc

SEQ ID NO: 383982 - RNA, 32 nt, Human
ccuugacuguucuguucugucuucucugucca

SEQ ID NO: 383983 - RNA, 32 nt, Human
ccuugacuucagaucccuugaaaauccaacau

SEQ ID NO: 383984 - RNA, 25 nt, Human
ccuugacuuccaccaggacagugaa

SEQ ID NO: 383985 - RNA, 32 nt, Human
ccuugagaaaacgggcaucucacguaccccca

SEQ ID NO: 383986 - RNA, 32 nt, Human
ccuugagaaaucccagcuuagcaccuuugaca

SEQ ID NO: 383987 - RNA, 32 nt, Human
ccuugagaagucagguugagaaaguaguugau

SEQ ID NO: 383988 - RNA, 32 nt, Human
ccuugagaaugaugcaugugcucgggaaaaau

SEQ ID NO: 383989 - RNA, 32 nt, Human
ccuugagacaaacugagggacaaggacacccu

SEQ ID NO: 383990 - RNA, 32 nt, Human
ccuugagacagcuucgguuucuaacuuggagc

SEQ ID NO: 383991 - RNA, 32 nt, Human
ccuugagacagugcuugccuugagagagugag

SEQ ID NO: 383992 - RNA, 32 nt, Human
ccuugagacuacaacauagaaacccuaucuga

SEQ ID NO: 383993 - RNA, 32 nt, Human
ccuugagagaaaaggaaucaugggagcaaugg

SEQ ID NO: 383994 - RNA, 32 nt, Human
ccuugagagccaggaauggcucuuagcagugg

SEQ ID NO: 383995 - RNA, 32 nt, Human
ccuugagaggucagaggggccucugugggugc

SEQ ID NO: 383996 - RNA, 19 nt, Human
ccuugagcaaaacugcaca

SEQ ID NO: 383997 - RNA, 32 nt, Human
ccuugagcaaguggaagagaggccagggucca

SEQ ID NO: 383998 - RNA, 32 nt, Human
ccuugagcaaguugucucucuucucugacccu

SEQ ID NO: 383999 - RNA, 32 nt, Human
ccuugagcagagcuucuagugggugaagcagu

SEQ ID NO: 384000 - RNA, 32 nt, Human
ccuugagcagcagccugagcguggagggcaag

SEQ ID NO: 384001 - RNA, 32 nt, Human
ccuugagcagggaagaguucuucccuuagccc

SEQ ID NO: 384002 - RNA, 32 nt, Human
ccuugagcagugggcccaggccuggcccucca

SEQ ID NO: 384003 - RNA, 32 nt, Human
ccuugagccacccuucccaccccagcccuugc

SEQ ID NO: 384004 - RNA, 32 nt, Human
ccuugagccagggagguggaggcuacagugag

SEQ ID NO: 384005 - RNA, 32 nt, Human
ccuugagcccaagagguccaggcugcagccug

SEQ ID NO: 384006 - RNA, 32 nt, Human
ccuugagcccaggaagcagagguugcagugag

SEQ ID NO: 384007 - RNA, 32 nt, Human
ccuugagcccaggagcuggaggcugcagugaa

SEQ ID NO: 384008 - RNA, 32 nt, Human
ccuugagcccaggaggucgaggcugcagugag

SEQ ID NO: 384009 - RNA, 32 nt, Human
ccuugagcccaggagguugaggcugcagugag

SEQ ID NO: 384010 - RNA, 32 nt, Human
ccuugagcccaggagugcaaggcugcaaugag

SEQ ID NO: 384011 - RNA, 32 nt, Human
ccuugagcccaggaguucgagacaagccuggg

SEQ ID NO: 384012 - RNA, 32 nt, Human
ccuugagcccaggaguucgaggcugcagcgag

SEQ ID NO: 384013 - RNA, 32 nt, Human
ccuugagccccucagccagccuggugugcguu

SEQ ID NO: 384014 - RNA, 32 nt, Human
ccuugagccuaggagguugaggcugcagugag

SEQ ID NO: 384015 - RNA, 32 nt, Human
ccuugagcuacacacacuggcuguagugcaag

SEQ ID NO: 384016 - RNA, 32 nt, Human
ccuugagcucaagugaucuucccacaccagcc

SEQ ID NO: 384017 - RNA, 32 nt, Human
ccuugagcucaggaguuugaggccaggcuggg

SEQ ID NO: 384018 - RNA, 32 nt, Human
ccuugagcucuagccgaugcauuugucaggaa

SEQ ID NO: 384019 - RNA, 32 nt, Human
ccuugagcuggggagauggaggcugcagugag

SEQ ID NO: 384020 - RNA, 32 nt, Human
ccuugagcuucagcccauuucucuccauuucc

SEQ ID NO: 384021 - RNA, 32 nt, Human
ccuugaggacaugcccuagggaacagugcucu

SEQ ID NO: 384022 - RNA, 31 nt, Human
ccuugaggagccggccaccagaugcugaauc

SEQ ID NO: 384023 - RNA, 32 nt, Human
ccuugaggcaacauuggauauuauugagacau

SEQ ID NO: 384024 - RNA, 32 nt, Human
ccuugaggccaggagguugaggcugcagugag

SEQ ID NO: 384025 - RNA, 32 nt, Human
ccuugagggcucucagccacugcuccaacaca

SEQ ID NO: 384026 - RNA, 32 nt, Human
ccuugagggucugaggucccagcccuguugcc

SEQ ID NO: 384027 - RNA, 32 nt, Human
ccuugagguaggcagaguggguuguggcgccu

SEQ ID NO: 384028 - RNA, 32 nt, Human
ccuugagguuaccagguagaaaacugguguca

SEQ ID NO: 384029 - RNA, 32 nt, Human
ccuugaguccaggagguugaggcugcagugag

SEQ ID NO: 384030 - RNA, 32 nt, Human
ccuugagucugggagguggaggcugcagugag

SEQ ID NO: 384031 - RNA, 31 nt, Human
ccuugagugugggggauuugggugaaugagg

SEQ ID NO: 384032 - RNA, 32 nt, Human
ccuugauaaaagcagaaaagcaaagagguaau

SEQ ID NO: 384033 - RNA, 32 nt, Human
ccuugauauauguauauggauguaugcauaaa

SEQ ID NO: 384034 - RNA, 32 nt, Human
ccuugaucauaaugauuucauuagcagugugu

SEQ ID NO: 384035 - RNA, 22 nt, Human
ccuugaucccaaaacccagcca

SEQ ID NO: 384036 - RNA, 32 nt, Human
ccuugaucucagacuucagccuccagaacugc

SEQ ID NO: 384037 - RNA, 32 nt, Human
ccuugaucuccucuccuuccucuggccagucc

SEQ ID NO: 384038 - RNA, 32 nt, Human
ccuugaucuuucuccuugucucucccgcugcc

SEQ ID NO: 384039 - RNA, 32 nt, Human
ccuugaugacaccugccgcugccccucggggc

SEQ ID NO: 384040 - RNA, 32 nt, Human
ccuugaugcuccugaacugggugcuuaugagu

SEQ ID NO: 384041 - RNA, 32 nt, Human
ccuugauggaggagggagggcuucaggacggg

SEQ ID NO: 384042 - RNA, 32 nt, Human
ccuugauggcacugggcugugcucaggugaag

SEQ ID NO: 384043 - RNA, 32 nt, Human
ccuugaugggaauguggagcagacccucgucc

SEQ ID NO: 384044 - RNA, 32 nt, Human
ccuugauggggcucaguggggccaggccaaag

SEQ ID NO: 384045 - RNA, 32 nt, Human
ccuugauguccaggcugggucauuuaaaauag

SEQ ID NO: 384046 - RNA, 32 nt, Human
ccuugauuacuuccacugaggugggagcaucu

SEQ ID NO: 384047 - RNA, 32 nt, Human
ccuugauuauuuccucugugcuuucucagcuu

SEQ ID NO: 384048 - RNA, 32 nt, Human
ccuugauucagccuuggugccugcacucuggg

SEQ ID NO: 384049 - RNA, 32 nt, Human
ccuugauugcccacguucucuccguuccuucu

SEQ ID NO: 384050 - RNA, 32 nt, Human
ccuugauugucccuggauggagugcagucacc

SEQ ID NO: 384051 - RNA, 32 nt, Human
ccuugauuguguaaggaacuugcuggacgcac

SEQ ID NO: 384052 - RNA, 32 nt, Human
ccuugauuuauucaaaagaacugggaaagaug

SEQ ID NO: 384053 - RNA, 32 nt, Human
ccuugauuucuauggagaccucagagcugguu

SEQ ID NO: 384054 - RNA, 32 nt, Human
ccuugcaaaccugcagacugcuuuuugcccaa

SEQ ID NO: 384055 - RNA, 32 nt, Human
ccuugcaaauccagcucaguacugcuagauaa

SEQ ID NO: 384056 - RNA, 32 nt, Human
ccuugcaacagcucugcagggccccgcagaug

SEQ ID NO: 384057 - RNA, 32 nt, Human
ccuugcacaagaaccacuaaccccaggcaagc

SEQ ID NO: 384058 - RNA, 32 nt, Human
ccuugcacacacccugagcuuuugccacuucu

SEQ ID NO: 384059 - RNA, 32 nt, Human
ccuugcacacucaccuccaccuucacaggcca

SEQ ID NO: 384060 - RNA, 32 nt, Human
ccuugcaccauggacagcucccauuaagccac

SEQ ID NO: 384061 - RNA, 32 nt, Human
ccuugcacccgaggcccucgcagcagggagcu

SEQ ID NO: 384062 - RNA, 32 nt, Human
ccuugcaccgcacugccgccuccugacugccc

SEQ ID NO: 384063 - RNA, 32 nt, Human
ccuugcaccuuccugaggguuuugugggagaa

SEQ ID NO: 384064 - RNA, 32 nt, Human
ccuugcacucaggaagcccugauguuuaaagg

SEQ ID NO: 384065 - RNA, 32 nt, Human
ccuugcacugugcugcucucacagaucggugu

SEQ ID NO: 384066 - RNA, 32 nt, Human
ccuugcacuuggaacagggcucaggugggugg

SEQ ID NO: 384067 - RNA, 23 nt, Human
ccuugcagaaccaccgcauucca

SEQ ID NO: 384068 - RNA, 32 nt, Human
ccuugcagaacugccauuauuuucugucagau

SEQ ID NO: 384069 - RNA, 27 nt, Human
ccuugcagaacuucuacuugccugccu

SEQ ID NO: 384070 - RNA, 32 nt, Human
ccuugcagacuggaaugagucaucaugcagac

SEQ ID NO: 384071 - RNA, 32 nt, Human
ccuugcagaguccucaguauccagucagcacu

SEQ ID NO: 384072 - RNA, 32 nt, Human
ccuugcagcaccugagacugaagcuccuccca

SEQ ID NO: 384073 - RNA, 32 nt, Human
ccuugcagcagagcagggcugaggggaagggg

SEQ ID NO: 384074 - RNA, 32 nt, Human
ccuugcagcccugcaccugccugccacuuccc

SEQ ID NO: 384075 - RNA, 32 nt, Human
ccuugcagccugauaccacugggagugagggu

SEQ ID NO: 384076 - RNA, 32 nt, Human
ccuugcaggagaagagggaagugaaaagaucu

SEQ ID NO: 384077 - RNA, 32 nt, Human
ccuugcaggagguggagguuguugguggagga

SEQ ID NO: 384078 - RNA, 32 nt, Human
ccuugcaggcuggagggcggcuggagagcggc

SEQ ID NO: 384079 - RNA, 32 nt, Human
ccuugcaguccugagguccugcagccccggcc

SEQ ID NO: 384080 - RNA, 32 nt, Human
ccuugcagugacaucaguccaggagagcucuc

SEQ ID NO: 384081 - RNA, 32 nt, Human
ccuugcaguggaggagagagccagaguggaua

SEQ ID NO: 384082 - RNA, 32 nt, Human
ccuugcaguguggcuggccaugggccacagcu

SEQ ID NO: 384083 - RNA, 32 nt, Human
ccuugcaguuaacugugcaaaauuggcuggcu

SEQ ID NO: 384084 - RNA, 32 nt, Human
ccuugcauauucuccuuucauccuggcuugcc

SEQ ID NO: 384085 - RNA, 32 nt, Human
ccuugcaucccagggaugaagccaacucgauc

SEQ ID NO: 384086 - RNA, 22 nt, Human
ccuugcaucguuucccucguca

SEQ ID NO: 384087 - RNA, 32 nt, Human
ccuugcaucuucugcuacagacugcuuuucga

SEQ ID NO: 384088 - RNA, 32 nt, Human
ccuugcaugccuuucaugccugaugccguaga

SEQ ID NO: 384089 - RNA, 32 nt, Human
ccuugcauggauacaugggagggagacguuau

SEQ ID NO: 384090 - RNA, 32 nt, Human
ccuugcauggaugcauguccucccucuguccc

SEQ ID NO: 384091 - RNA, 32 nt, Human
ccuugcaugggcccugcccacaagcacacccu

SEQ ID NO: 384092 - RNA, 32 nt, Human
ccuugcauguacuggaguauuuauuucaucua

SEQ ID NO: 384093 - RNA, 32 nt, Human
ccuugcauuggcaccccuccagccuggaggcc

SEQ ID NO: 384094 - RNA, 32 nt, Human
ccuugcauuucuugguaucucucagcuuuucc

SEQ ID NO: 384095 - RNA, 32 nt, Human
ccuugcauuugcacauccagaaugacuaaaac

SEQ ID NO: 384096 - RNA, 32 nt, Human
ccuugccaacacagugaaacccugucucuacu

SEQ ID NO: 384097 - RNA, 32 nt, Human
ccuugccaacuaguaaaagcuggaccuucgga

SEQ ID NO: 384098 - RNA, 32 nt, Human
ccuugccaagagucucaucccuacccuggggc

SEQ ID NO: 384099 - RNA, 32 nt, Human
ccuugccaagccccaggaagaaaaugaugcag

SEQ ID NO: 384100 - RNA, 32 nt, Human
ccuugccaaguuguucgagguggaauuaaaca

SEQ ID NO: 384101 - RNA, 32 nt, Human
ccuugccaauccagcuccaagaugcugagccu

SEQ ID NO: 384102 - RNA, 32 nt, Human
ccuugccaauccagguagacagaggcccugcc

SEQ ID NO: 384103 - RNA, 32 nt, Human
ccuugccacggugccagcaggcagcccugggc

SEQ ID NO: 384104 - RNA, 32 nt, Human
ccuugccacugucuccuggcccucucucugau

SEQ ID NO: 384105 - RNA, 32 nt, Human
ccuugccagcacuggauauuaucccggcuugg

SEQ ID NO: 384106 - RNA, 30 nt, Human
ccuugccagccucugcugcuccugcuccug

SEQ ID NO: 384107 - RNA, 32 nt, Human
ccuugccagcgcuguccugucuuucuggccca

SEQ ID NO: 384108 - RNA, 32 nt, Human
ccuugccaggaaaauuccacccagugcacaga

SEQ ID NO: 384109 - RNA, 32 nt, Human
ccuugccaggaccugcucccagcuccacgacg

SEQ ID NO: 384110 - RNA, 32 nt, Human
ccuugccaggagcaugucugugcagcaguguu

SEQ ID NO: 384111 - RNA, 32 nt, Human
ccuugccaggaggggaguggcagugaggaggg

SEQ ID NO: 384112 - RNA, 32 nt, Human
ccuugccaggccuccccaaccccuggccucaa

SEQ ID NO: 384113 - RNA, 32 nt, Human
ccuugccagugagcuguucagcagguagccac

SEQ ID NO: 384114 - RNA, 32 nt, Human
ccuugccauagaaaugguugcugguagcagua

SEQ ID NO: 384115 - RNA, 32 nt, Human
ccuugcccaaaccaacugaggucuuaaagucc

SEQ ID NO: 384116 - RNA, 32 nt, Human
ccuugcccaagaguuugagaccagccuggaca

SEQ ID NO: 384117 - RNA, 32 nt, Human
ccuugcccacgggcccccagccccagccccuc

SEQ ID NO: 384118 - RNA, 32 nt, Human
ccuugcccagaacuuuggucaccugcuuguuc

SEQ ID NO: 384119 - RNA, 32 nt, Human
ccuugcccagccgugguggcccccaggccugg

SEQ ID NO: 384120 - RNA, 32 nt, Human
ccuugcccaggcccuugggggagggggugcau

SEQ ID NO: 384121 - RNA, 32 nt, Human
ccuugcccagggcacuuggagcacacgcagcc

SEQ ID NO: 384122 - RNA, 32 nt, Human
ccuugcccaucuucacucuagccuucguauuu

SEQ ID NO: 384123 - RNA, 32 nt, Human
ccuugccccaacccuucuucauguucaauuau

SEQ ID NO: 384124 - RNA, 19 nt, Human
ccuugccccaccccugccu

SEQ ID NO: 384125 - RNA, 32 nt, Human
ccuugccccaccccuugcuuccagaaaggguu

SEQ ID NO: 384126 - RNA, 32 nt, Human
ccuugccccacgccuucucuguggaccauuca

SEQ ID NO: 384127 - RNA, 32 nt, Human
ccuugccccacugcaggcugccugggacgccu

SEQ ID NO: 384128 - RNA, 21 nt, Human
ccuugcccccaccuccugucu

SEQ ID NO: 384129 - RNA, 21 nt, Human
ccuugccccggcccccaggcc

SEQ ID NO: 384130 - RNA, 32 nt, Human
ccuugccccucagaccugccaugaaaggaaug

SEQ ID NO: 384131 - RNA, 32 nt, Human
ccuugccccucucugucauagcuaacaggaau

SEQ ID NO: 384132 - RNA, 32 nt, Human
ccuugcccgcagcccaggcuccugggccagug

SEQ ID NO: 384133 - RNA, 32 nt, Human
ccuugcccgccaugcccugagccacgucccuc

SEQ ID NO: 384134 - RNA, 32 nt, Human
ccuugcccucacugcccacucugcccacacuu

SEQ ID NO: 384135 - RNA, 32 nt, Human
ccuugcccucacuucagugccugggugcucag

SEQ ID NO: 384136 - RNA, 32 nt, Human
ccuugcccuccacgcccugcccccugcauccc

SEQ ID NO: 384137 - RNA, 32 nt, Human
ccuugcccuccaguccucuaccucuggccugc

SEQ ID NO: 384138 - RNA, 20 nt, Human
ccuugcccucccaagacacu

SEQ ID NO: 384139 - RNA, 32 nt, Human
ccuugcccugccuccaguauguuuccaagucc

SEQ ID NO: 384140 - RNA, 32 nt, Human
ccuugcccugcucacccuauguggucccaccu

SEQ ID NO: 384141 - RNA, 32 nt, Human
ccuugcccugcucccccggggacccccaggcu

SEQ ID NO: 384142 - RNA, 32 nt, Human
ccuugcccugcucucuccuguugcucugggau

SEQ ID NO: 384143 - RNA, 32 nt, Human
ccuugcccugggcugccuccuccugagagcug

SEQ ID NO: 384144 - RNA, 32 nt, Human
ccuugcccuggugucuuuuuccagauuucaau

SEQ ID NO: 384145 - RNA, 22 nt, Human
ccuugcccuuccaccuccuccu

SEQ ID NO: 384146 - RNA, 19 nt, Human
ccuugcccuugccucuggu

SEQ ID NO: 384147 - RNA, 32 nt, Human
ccuugcccuuugggcuggagaugcuuugccag

SEQ ID NO: 384148 - RNA, 32 nt, Human
ccuugccgcccgugguccuggccacgcaguac

SEQ ID NO: 384149 - RNA, 32 nt, Human
ccuugccgggagggguacucaccccaccuaag

SEQ ID NO: 384150 - RNA, 32 nt, Human
ccuugccuagauuuaaggccacugugaggaga

SEQ ID NO: 384151 - RNA, 32 nt, Human
ccuugccucaagugagcuucaaccuuagccuc

SEQ ID NO: 384152 - RNA, 32 nt, Human
ccuugccucaggccuggugaguggggcaggca

SEQ ID NO: 384153 - RNA, 32 nt, Human
ccuugccucagugaaauaugcauauguauauc

SEQ ID NO: 384154 - RNA, 21 nt, Human
ccuugccucccccuccucuca

SEQ ID NO: 384155 - RNA, 32 nt, Human
ccuugccuccuuuaggggaaagguaggacagg

SEQ ID NO: 384156 - RNA, 32 nt, Human
ccuugccucugcggccuccacuuggaaaguuc

SEQ ID NO: 384157 - RNA, 32 nt, Human
ccuugccuggacugccuuugacaaggcagaaa

SEQ ID NO: 384158 - RNA, 32 nt, Human
ccuugccuguucugccuuguaugucuauuuua

SEQ ID NO: 384159 - RNA, 32 nt, Human
ccuugccuguuuccgaagcccccacacugccu

SEQ ID NO: 384160 - RNA, 32 nt, Human
ccuugccuucagcugcuucacggagcucauga

SEQ ID NO: 384161 - RNA, 32 nt, Human
ccuugccuuccucccuucuuccucuuggaguc

SEQ ID NO: 384162 - RNA, 32 nt, Human
ccuugccuuggggcagggagagagggaaccug

SEQ ID NO: 384163 - RNA, 32 nt, Human
ccuugcgaggguuggucucgaggcagagguca

SEQ ID NO: 384164 - RNA, 32 nt, Human
ccuugcgcccgggcguagcccagcacaugcgc

SEQ ID NO: 384165 - RNA, 20 nt, Human
ccuugcgccuggugcugcca

SEQ ID NO: 384166 - RNA, 32 nt, Human
ccuugcgcggcagaggaagcgcagggacagag

SEQ ID NO: 384167 - RNA, 32 nt, Human
ccuugcgcuguugcguaacuggcuguguucug

SEQ ID NO: 384168 - RNA, 32 nt, Human
ccuugcggccuuucuaacguuggcccugcucu

SEQ ID NO: 384169 - RNA, 32 nt, Human
ccuugcgggaccccaccuggaacccgaccucc

SEQ ID NO: 384170 - RNA, 32 nt, Human
ccuugcggggcugaguguaacuuuaggaaauu

SEQ ID NO: 384171 - RNA, 32 nt, Human
ccuugcgguggugggauccugaugucuuucau

SEQ ID NO: 384172 - RNA, 32 nt, Human
ccuugcguccuugggcaucuccgggcaucaga

SEQ ID NO: 384173 - RNA, 32 nt, Human
ccuugcgucucccauucccaagauugucccgc

SEQ ID NO: 384174 - RNA, 32 nt, Human
ccuugcuacaaccuggugucucagcuuauuau

SEQ ID NO: 384175 - RNA, 19 nt, Human
ccuugcucacaugcugcca

SEQ ID NO: 384176 - RNA, 32 nt, Human
ccuugcucagaagaaagaucggguaacucaga

SEQ ID NO: 384177 - RNA, 19 nt, Human
ccuugcucagcacuggaca

SEQ ID NO: 384178 - RNA, 32 nt, Human
ccuugcucagccaucccgucuucuccaacacc

SEQ ID NO: 384179 - RNA, 32 nt, Human
ccuugcuccccaccccuugcgaacaggaccag

SEQ ID NO: 384180 - RNA, 23 nt, Human
ccuugcuccucucccuccugccu

SEQ ID NO: 384181 - RNA, 32 nt, Human
ccuugcuccucuuccuccuuucuuggcgggug

SEQ ID NO: 384182 - RNA, 32 nt, Human
ccuugcuccugaggccaaagccagagacucga

SEQ ID NO: 384183 - RNA, 32 nt, Human
ccuugcuccuuagccaggucuccagguccucc

SEQ ID NO: 384184 - RNA, 32 nt, Human
ccuugcuccuuuggggugauuuaugguauaga

SEQ ID NO: 384185 - RNA, 32 nt, Human
ccuugcucgccugcucccuccugcuugccuga

SEQ ID NO: 384186 - RNA, 32 nt, Human
ccuugcucuccagcaaaagcaccaaggaucgg

SEQ ID NO: 384187 - RNA, 32 nt, Human
ccuugcucugagaccccuaccucugccaugag

SEQ ID NO: 384188 - RNA, 32 nt, Human
ccuugcucuguggcuuuucccaacacaaucag

SEQ ID NO: 384189 - RNA, 32 nt, Human
ccuugcucuucucaccucucccuuaccccguu

SEQ ID NO: 384190 - RNA, 32 nt, Human
ccuugcucuucucuggcuaccucugcagggag

SEQ ID NO: 384191 - RNA, 32 nt, Human
ccuugcugacaccugggccuugccuccauguc

SEQ ID NO: 384192 - RNA, 32 nt, Human
ccuugcugacaugccuggaggagcugcuacac

SEQ ID NO: 384193 - RNA, 31 nt, Human
ccuugcugacuucucccuauaagaguaaagc

SEQ ID NO: 384194 - RNA, 32 nt, Human
ccuugcugaugaguaggaugugauuuggcucu

SEQ ID NO: 384195 - RNA, 32 nt, Human
ccuugcugcaggcuagggagcugcagucccca

SEQ ID NO: 384196 - RNA, 32 nt, Human
ccuugcugcuguccucugagacugccuguucc

SEQ ID NO: 384197 - RNA, 32 nt, Human
ccuugcuggacaagugguuuguuugugugcaa

SEQ ID NO: 384198 - RNA, 32 nt, Human
ccuugcuggagucaugugccucuguccuuagg

SEQ ID NO: 384199 - RNA, 32 nt, Human
ccuugcuggaguuuuguuuuguugcuccaauu

SEQ ID NO: 384200 - RNA, 32 nt, Human
ccuugcugggccccaguagggguggggaggga

SEQ ID NO: 384201 - RNA, 32 nt, Human
ccuugcugggcugggaaguggggaaagcaggg

SEQ ID NO: 384202 - RNA, 18 nt, Human
ccuugcuggggacgugaa

SEQ ID NO: 384203 - RNA, 32 nt, Human
ccuugcugguagcuaaggaaaugccuucuguu

SEQ ID NO: 384204 - RNA, 32 nt, Human
ccuugcugugcucacaggcucaccuuuguguu

SEQ ID NO: 384205 - RNA, 24 nt, Human
ccuugcugugucccccaggcggga

SEQ ID NO: 384206 - RNA, 32 nt, Human
ccuugcuucauaucaaauauuuaaccaauuau

SEQ ID NO: 384207 - RNA, 32 nt, Human
ccuugcuuccugcugucccuccaccuccugua

SEQ ID NO: 384208 - RNA, 32 nt, Human
ccuugcuucggcuccucccuugcugaccugcc

SEQ ID NO: 384209 - RNA, 32 nt, Human
ccuugcuucgucuucgcuuuucuuucuacuua

SEQ ID NO: 384210 - RNA, 32 nt, Human
ccuugcuucucaaauaaccuagcaugaagggc

SEQ ID NO: 384211 - RNA, 32 nt, Human
ccuugcuucucccaucaacgagucuuggccca

SEQ ID NO: 384212 - RNA, 32 nt, Human
ccuugcuucucccugcucugcccaucaugacu

SEQ ID NO: 384213 - RNA, 32 nt, Human
ccuugcuucucuccagcccuguccagcaagug

SEQ ID NO: 384214 - RNA, 32 nt, Human
ccuugcuucuugcuuugcagacugccugcagc

SEQ ID NO: 384215 - RNA, 32 nt, Human
ccuugcuuuggacccuacacacuucggcucuc

SEQ ID NO: 384216 - RNA, 32 nt, Human
ccuugcuuugggcccugcagggggagggguga

SEQ ID NO: 384217 - RNA, 32 nt, Human
ccuugcuuuucuuccucuucccccaaccuaac

SEQ ID NO: 384218 - RNA, 20 nt, Human
ccuuggaaaacaugcuggcc

SEQ ID NO: 384219 - RNA, 32 nt, Human
ccuuggaaacagcaaucccaaauaaugucggc

SEQ ID NO: 384220 - RNA, 32 nt, Human
ccuuggaaacaguucuggcacacaggcagaac

SEQ ID NO: 384221 - RNA, 22 nt, Human
ccuuggaaauagaaagaagcca

SEQ ID NO: 384222 - RNA, 32 nt, Human
ccuuggaaaucuguaugugguggagaaguauu

SEQ ID NO: 384223 - RNA, 32 nt, Human
ccuuggaaauggagagcacugcagugaauucu

SEQ ID NO: 384224 - RNA, 32 nt, Human
ccuuggaacaagagacuuuccuaaguggauca

SEQ ID NO: 384225 - RNA, 32 nt, Human
ccuuggaacuccugccuccacagccccuccag

SEQ ID NO: 384226 - RNA, 32 nt, Human
ccuuggaagaagaugucugcagaggagcugga

SEQ ID NO: 384227 - RNA, 20 nt, Human
ccuuggaaggccgcagugag

SEQ ID NO: 384228 - RNA, 32 nt, Human
ccuuggaaggcucucccuuguggaaccaaguu

SEQ ID NO: 384229 - RNA, 32 nt, Human
ccuuggaaugguguugccaucacuguucuggc

SEQ ID NO: 384230 - RNA, 25 nt, Human
ccuuggaauuucucaucuucugccu

SEQ ID NO: 384231 - RNA, 24 nt, Human
ccuuggaauuuucuggcacuuccu

SEQ ID NO: 384232 - RNA, 32 nt, Human
ccuuggacaagccacacaaucaguggggcagc

SEQ ID NO: 384233 - RNA, 19 nt, Human
ccuuggacaagcuuuucuu

SEQ ID NO: 384234 - RNA, 32 nt, Human
ccuuggacauccuccucccacccggcugcaga

SEQ ID NO: 384235 - RNA, 32 nt, Human
ccuuggacaugccuggacucuccagggacagg

SEQ ID NO: 384236 - RNA, 32 nt, Human
ccuuggacauguccaauaaaacaggugggaaa

SEQ ID NO: 384237 - RNA, 32 nt, Human
ccuuggacccccagucugggaacgguggacau

SEQ ID NO: 384238 - RNA, 32 nt, Human
ccuuggacccucggcuguagggggcaccuguc

SEQ ID NO: 384239 - RNA, 32 nt, Human
ccuuggaccugcuugguuaaggagggaguggg

SEQ ID NO: 384240 - RNA, 32 nt, Human
ccuuggaccuguuaggcgcauggcaggagucc

SEQ ID NO: 384241 - RNA, 32 nt, Human
ccuuggacggcugucaguuuugcacaugaugu

SEQ ID NO: 384242 - RNA, 21 nt, Human
ccuuggacucucauucccuuu

SEQ ID NO: 384243 - RNA, 32 nt, Human
ccuuggagaaggacagagcgguggggacuugg

SEQ ID NO: 384244 - RNA, 32 nt, Human
ccuuggagacaggcuagccuggccacagaauu

SEQ ID NO: 384245 - RNA, 32 nt, Human
ccuuggagacaggggagacccuaugucaaaaa

SEQ ID NO: 384246 - RNA, 32 nt, Human
ccuuggagacccaggcaaggacaaguacacgu

SEQ ID NO: 384247 - RNA, 32 nt, Human
ccuuggagacccaggcaaggacaaguacaugu

SEQ ID NO: 384248 - RNA, 32 nt, Human
ccuuggagagcuuucuggaauauuuauaccac

SEQ ID NO: 384249 - RNA, 24 nt, Human
ccuuggagcacccccacccucccc

SEQ ID NO: 384250 - RNA, 32 nt, Human
ccuuggagcuaguggagagggagaggaaaggg

SEQ ID NO: 384251 - RNA, 32 nt, Human
ccuuggagcucugcugccugcaccacaaugaa

SEQ ID NO: 384252 - RNA, 32 nt, Human
ccuuggaggacacuaagaggaggcaggaggag

SEQ ID NO: 384253 - RNA, 32 nt, Human
ccuuggaggagagagacauacaaggacagugg

SEQ ID NO: 384254 - RNA, 32 nt, Human
ccuuggaggaggaggaagaggaggccacugug

SEQ ID NO: 384255 - RNA, 32 nt, Human
ccuuggaggcagagguugcagugagcugagau

SEQ ID NO: 384256 - RNA, 32 nt, Human
ccuuggaggccgggaggaagugggguuggaaa

SEQ ID NO: 384257 - RNA, 32 nt, Human
ccuuggaggcggagguugcagugagcugagau

SEQ ID NO: 384258 - RNA, 32 nt, Human
ccuuggaggcggagguugcauugagcugagau

SEQ ID NO: 384259 - RNA, 32 nt, Human
ccuuggagggaaagcggcgccgcccgaagcag

SEQ ID NO: 384260 - RNA, 32 nt, Human
ccuuggagggacuggccugaggugggcccugg

SEQ ID NO: 384261 - RNA, 32 nt, Human
ccuuggagggccuggaacucugaguccuccua

SEQ ID NO: 384262 - RNA, 32 nt, Human
ccuuggagguacugcugccuggggccgggggu

SEQ ID NO: 384263 - RNA, 24 nt, Human
ccuuggaggucaaaacugcaguga

SEQ ID NO: 384264 - RNA, 20 nt, Human
ccuuggaggugaacuucuca

SEQ ID NO: 384265 - RNA, 32 nt, Human
ccuuggaggugaccagggccacugcaggcaug

SEQ ID NO: 384266 - RNA, 32 nt, Human
ccuuggaggugcgagucugggaaaggcgcgcu

SEQ ID NO: 384267 - RNA, 32 nt, Human
ccuuggagucaagacuucaacacuccauggca

SEQ ID NO: 384268 - RNA, 32 nt, Human
ccuuggaguugaugccuuggcucagauccagc

SEQ ID NO: 384269 - RNA, 32 nt, Human
ccuuggaguugcagaggaggccugauuggcca

SEQ ID NO: 384270 - RNA, 32 nt, Human
ccuuggaucccaaauaaaugaguaguuccucu

SEQ ID NO: 384271 - RNA, 32 nt, Human
ccuuggauccucaggugggcucugcugugugc

SEQ ID NO: 384272 - RNA, 32 nt, Human
ccuuggaucugcagaugcaggaggcagauauc

SEQ ID NO: 384273 - RNA, 32 nt, Human
ccuuggaugaggaugaccuagguccuagaagg

SEQ ID NO: 384274 - RNA, 18 nt, Human
ccuuggaugauggagcca

SEQ ID NO: 384275 - RNA, 32 nt, Human
ccuuggaugggacuugcaggccuaaaugagag

SEQ ID NO: 384276 - RNA, 31 nt, Human
ccuuggauggggaagggccagaugcugggug

SEQ ID NO: 384277 - RNA, 32 nt, Human
ccuuggaugucauugaggaggaaaggcgguug

SEQ ID NO: 384278 - RNA, 32 nt, Human
ccuuggcaacaaagcaagacccugucuccaaa

SEQ ID NO: 384279 - RNA, 32 nt, Human
ccuuggcaacacagugagacccugucuuuaaa

SEQ ID NO: 384280 - RNA, 32 nt, Human
ccuuggcaacacagugugagacccugucucaa

SEQ ID NO: 384281 - RNA, 32 nt, Human
ccuuggcaacagagugagacccugucuucaaa

SEQ ID NO: 384282 - RNA, 32 nt, Human
ccuuggcacaccaguguucuccugccaaauga

SEQ ID NO: 384283 - RNA, 32 nt, Human
ccuuggcaccagcaccaccacugccaucgauu

SEQ ID NO: 384284 - RNA, 32 nt, Human
ccuuggcagcagggaggaagcaggagugcccc

SEQ ID NO: 384285 - RNA, 32 nt, Human
ccuuggcagcccccuguaguugacagguaagc

SEQ ID NO: 384286 - RNA, 22 nt, Human
ccuuggcagccugucaccgccc

SEQ ID NO: 384287 - RNA, 32 nt, Human
ccuuggcagcgccgccccugcccacacugacc

SEQ ID NO: 384288 - RNA, 32 nt, Human
ccuuggcaggaggguuuggggcuuccacauau

SEQ ID NO: 384289 - RNA, 32 nt, Human
ccuuggcaggcucugggcaguagccacagaga

SEQ ID NO: 384290 - RNA, 32 nt, Human
ccuuggcagggugagcccacaaggagcaaugg

SEQ ID NO: 384291 - RNA, 32 nt, Human
ccuuggcaggguguuggagcccucggucugcc

SEQ ID NO: 384292 - RNA, 24 nt, Human
ccuuggcagguggaucaccugaga

SEQ ID NO: 384293 - RNA, 32 nt, Human
ccuuggcaggugugagaucgaggccaguagug

SEQ ID NO: 384294 - RNA, 32 nt, Human
ccuuggcaggugugggauccagaccacuagca

SEQ ID NO: 384295 - RNA, 21 nt, Human
ccuuggcauccgccucuucuu

SEQ ID NO: 384296 - RNA, 32 nt, Human
ccuuggccaaaguguugggauuacaggcauaa

SEQ ID NO: 384297 - RNA, 32 nt, Human
ccuuggccacaugccugcaggcauuuguuuuc

SEQ ID NO: 384298 - RNA, 32 nt, Human
ccuuggccaccugucugccauauacguacacu

SEQ ID NO: 384299 - RNA, 32 nt, Human
ccuuggccacugugcguuacagccuggagggg

SEQ ID NO: 384300 - RNA, 22 nt, Human
ccuuggccaugcucccugguca

SEQ ID NO: 384301 - RNA, 32 nt, Human
ccuuggcccaagaacacagucauguggagccc

SEQ ID NO: 384302 - RNA, 32 nt, Human
ccuuggcccaggaggcagagguugcagugagc

SEQ ID NO: 384303 - RNA, 19 nt, Human
ccuuggccccauccucuca

SEQ ID NO: 384304 - RNA, 32 nt, Human
ccuuggcccccagcuacaaugaaaaagaagaa

SEQ ID NO: 384305 - RNA, 20 nt, Human
ccuuggccccucccucuuca

SEQ ID NO: 384306 - RNA, 18 nt, Human
ccuuggccccuccugguc

SEQ ID NO: 384307 - RNA, 32 nt, Human
ccuuggcccucaggaagcaucagaucucaaac

SEQ ID NO: 384308 - RNA, 17 nt, Human
ccuuggcccuuccccuc

SEQ ID NO: 384309 - RNA, 18 nt, Human
ccuuggccgaagcauaga

SEQ ID NO: 384310 - RNA, 17 nt, Human
ccuuggccgccgcgccg

SEQ ID NO: 384311 - RNA, 32 nt, Human
ccuuggccgccuugcccugccgccgcucucgc

SEQ ID NO: 384312 - RNA, 32 nt, Human
ccuuggccgccuugcccugccgcugcucucac

SEQ ID NO: 384313 - RNA, 19 nt, Human
ccuuggccuaucccucuca

SEQ ID NO: 384314 - RNA, 21 nt, Human
ccuuggccucagcuccucuca

SEQ ID NO: 384315 - RNA, 23 nt, Human
ccuuggccuccaccaagcacgug

SEQ ID NO: 384316 - RNA, 20 nt, Human
ccuuggccuccagcucccgu

SEQ ID NO: 384317 - RNA, 21 nt, Human
ccuuggccuccauuucugucu

SEQ ID NO: 384318 - RNA, 18 nt, Human
ccuuggccucccagaguc

SEQ ID NO: 384319 - RNA, 17 nt, Human
ccuuggccucccguguu

SEQ ID NO: 384320 - RNA, 21 nt, Human
ccuuggccuccucucagcucg

SEQ ID NO: 384321 - RNA, 24 nt, Human
ccuuggccuccugccucccugucu

SEQ ID NO: 384322 - RNA, 20 nt, Human
ccuuggccucucaggcucgu

SEQ ID NO: 384323 - RNA, 20 nt, Human
ccuuggccucuccugauguc

SEQ ID NO: 384324 - RNA, 19 nt, Human
ccuuggccuggaccugggg

SEQ ID NO: 384325 - RNA, 21 nt, Human
ccuuggccuggccuccucuca

SEQ ID NO: 384326 - RNA, 32 nt, Human
ccuuggccuggucucgagaagcuucccaugcu

SEQ ID NO: 384327 - RNA, 26 nt, Human
ccuuggccuguugcuucuaggggucg

SEQ ID NO: 384328 - RNA, 26 nt, Human
ccuuggccuguugcuucuagggguug

SEQ ID NO: 384329 - RNA, 32 nt, Human
ccuuggccuuagaguuaagugaagaguuaaca

SEQ ID NO: 384330 - RNA, 32 nt, Human
ccuuggccuucugcaagccaagugguucugca

SEQ ID NO: 384331 - RNA, 32 nt, Human
ccuuggccuugccuccccuuccugccacgugc

SEQ ID NO: 384332 - RNA, 29 nt, Human
ccuuggcgacaaaccaagacccugucucg

SEQ ID NO: 384333 - RNA, 32 nt, Human
ccuuggcgccaccaccuggcccuggugguuaa

SEQ ID NO: 384334 - RNA, 21 nt, Human
ccuuggcggaggucggcguga

SEQ ID NO: 384335 - RNA, 28 nt, Human
ccuuggcggcuauuuuugccaccugccu

SEQ ID NO: 384336 - RNA, 32 nt, Human
ccuuggcgucuccgcagccugggaagcucgga

SEQ ID NO: 384337 - RNA, 32 nt, Human
ccuuggcguggagucuuccucccuucucccaa

SEQ ID NO: 384338 - RNA, 24 nt, Human
ccuuggcuaaacagggacagugaa

SEQ ID NO: 384339 - RNA, 23 nt, Human
ccuuggcuaaauggagcagcgaa

SEQ ID NO: 384340 - RNA, 24 nt, Human
ccuuggcuaagaagagacaacgga

SEQ ID NO: 384341 - RNA, 32 nt, Human
ccuuggcucacugcaaccuccaccucccaggu

SEQ ID NO: 384342 - RNA, 32 nt, Human
ccuuggcucacugcaaccuccaggccagccuc

SEQ ID NO: 384343 - RNA, 32 nt, Human
ccuuggcucacugcaaccuccaucuccggggc

SEQ ID NO: 384344 - RNA, 32 nt, Human
ccuuggcucacugcaaccuccgccucccgggu

SEQ ID NO: 384345 - RNA, 32 nt, Human
ccuuggcucacugcaaccucugccucccuggu

SEQ ID NO: 384346 - RNA, 32 nt, Human
ccuuggcucacuguccccuucugccgccagcc

SEQ ID NO: 384347 - RNA, 32 nt, Human
ccuuggcuccacuggucaccuacuuuucaucu

SEQ ID NO: 384348 - RNA, 32 nt, Human
ccuuggcuccaggagcccacaggcuggggagg

SEQ ID NO: 384349 - RNA, 32 nt, Human
ccuuggcucugccuuggcccuuccccucacca

SEQ ID NO: 384350 - RNA, 32 nt, Human
ccuuggcucuuggcccccuccuccaucuucag

SEQ ID NO: 384351 - RNA, 32 nt, Human
ccuuggcucuuuggcucccuuuugcuuaauua

SEQ ID NO: 384352 - RNA, 32 nt, Human
ccuuggcugauaggagaauggauguuagcuga

SEQ ID NO: 384353 - RNA, 32 nt, Human
ccuuggcugcaagcucugcugccuccuugccu

SEQ ID NO: 384354 - RNA, 32 nt, Human
ccuuggcugcacggaccccaugggagcugcga

SEQ ID NO: 384355 - RNA, 32 nt, Human
ccuuggcuggugacggcaccaugccauccucu

SEQ ID NO: 384356 - RNA, 32 nt, Human
ccuuggcugucagugcugcccagauucagaag

SEQ ID NO: 384357 - RNA, 32 nt, Human
ccuuggcuguccuaacagggccaaucaccagu

SEQ ID NO: 384358 - RNA, 20 nt, Human
ccuuggcugugccuccugcu

SEQ ID NO: 384359 - RNA, 32 nt, Human
ccuuggcugugccuccugcucucuucaagagc

SEQ ID NO: 384360 - RNA, 32 nt, Human
ccuuggcuuacagcauuugccugcugaauacu

SEQ ID NO: 384361 - RNA, 32 nt, Human
ccuuggcuuccaauauggcaagagggugcugg

SEQ ID NO: 384362 - RNA, 32 nt, Human
ccuuggcuuccagccaugcuguccucacauac

SEQ ID NO: 384363 - RNA, 32 nt, Human
ccuuggcuuccucugcugggugggauuggggg

SEQ ID NO: 384364 - RNA, 32 nt, Human
ccuuggcuuccuggcccagucccugccucucc

SEQ ID NO: 384365 - RNA, 32 nt, Human
ccuuggcuugcaccuacugauucuccacgugu

SEQ ID NO: 384366 - RNA, 32 nt, Human
ccuuggcuuggaaggcuggagcuucgggccaa

SEQ ID NO: 384367 - RNA, 32 nt, Human
ccuuggcuuuucuccccuucucauucuccucu

SEQ ID NO: 384368 - RNA, 32 nt, Human
ccuugggaaacuuuacauagaggggaacaugc

SEQ ID NO: 384369 - RNA, 32 nt, Human
ccuugggaacagaucugugaucugaggagguu

SEQ ID NO: 384370 - RNA, 32 nt, Human
ccuugggaaggucagaaaaaucucucagggcc

SEQ ID NO: 384371 - RNA, 32 nt, Human
ccuugggaagugagacuagaagaggggagcag

SEQ ID NO: 384372 - RNA, 32 nt, Human
ccuugggacaaaaagggaaaccuaguaaugcc

SEQ ID NO: 384373 - RNA, 22 nt, Human
ccuugggacacgguuuuccacu

SEQ ID NO: 384374 - RNA, 32 nt, Human
ccuugggacccgcuucccaccugcugcgguca

SEQ ID NO: 384375 - RNA, 32 nt, Human
ccuugggacgucuggucuucuggcuuccccgg

SEQ ID NO: 384376 - RNA, 17 nt, Human
ccuugggacguggagcc

SEQ ID NO: 384377 - RNA, 23 nt, Human
ccuugggacuggauucucuuccu

SEQ ID NO: 384378 - RNA, 23 nt, Human
ccuugggagcagucucucugucu

SEQ ID NO: 384379 - RNA, 32 nt, Human
ccuugggaggccaaggcaggcagaucacgaca

SEQ ID NO: 384380 - RNA, 32 nt, Human
ccuugggaggccaaggugggaggaucacugga

SEQ ID NO: 384381 - RNA, 32 nt, Human
ccuugggaggccacuguaggaggaucaauuga

SEQ ID NO: 384382 - RNA, 32 nt, Human
ccuugggaggcccaggcaggcagaucaccuga

SEQ ID NO: 384383 - RNA, 32 nt, Human
ccuugggaggccgaggcaggcagaucaccuua

SEQ ID NO: 384384 - RNA, 32 nt, Human
ccuugggaggccggggcaggaggaucaccuua

SEQ ID NO: 384385 - RNA, 23 nt, Human
ccuugggaggcuaagacaggaag

SEQ ID NO: 384386 - RNA, 32 nt, Human
ccuugggaggcugaggcagguggaucaccuaa

SEQ ID NO: 384387 - RNA, 32 nt, Human
ccuugggaggcugaggcgggcagaucaugagg

SEQ ID NO: 384388 - RNA, 32 nt, Human
ccuugggaggcugaggugggaggaucauuuga

SEQ ID NO: 384389 - RNA, 32 nt, Human
ccuugggaggcugccuuagcugcuggacuuga

SEQ ID NO: 384390 - RNA, 32 nt, Human
ccuugggagggacuucaggcccuggcugaucg

SEQ ID NO: 384391 - RNA, 32 nt, Human
ccuugggaguagcugagggggcagacuaggga

SEQ ID NO: 384392 - RNA, 32 nt, Human
ccuugggaguagcugggugaauggacgauggu

SEQ ID NO: 384393 - RNA, 32 nt, Human
ccuugggaguggccugugcaccccagggccag

SEQ ID NO: 384394 - RNA, 32 nt, Human
ccuugggaguuuuugugucuguuagcggcaca

SEQ ID NO: 384395 - RNA, 21 nt, Human
ccuugggaucugcccuccgcu

SEQ ID NO: 384396 - RNA, 21 nt, Human
ccuugggaugcggcccuucau

SEQ ID NO: 384397 - RNA, 24 nt, Human
ccuugggauguaccuuucuucacu

SEQ ID NO: 384398 - RNA, 21 nt, Human
ccuugggauuagccucuuccu

SEQ ID NO: 384399 - RNA, 21 nt, Human
ccuugggauuuccuucucccu

SEQ ID NO: 384400 - RNA, 18 nt, Human
ccuugggcaagcuccuca

SEQ ID NO: 384401 - RNA, 32 nt, Human
ccuugggcaagucccuggggcuggcuaggccu

SEQ ID NO: 384402 - RNA, 32 nt, Human
ccuugggcaagugucuuuacugcucagaaccu

SEQ ID NO: 384403 - RNA, 32 nt, Human
ccuugggcacagcagguccugaacacccugcu

SEQ ID NO: 384404 - RNA, 32 nt, Human
ccuugggcaccuccugguaugugcacacccca

SEQ ID NO: 384405 - RNA, 32 nt, Human
ccuugggcaggggcagggagagcugcugagcc

SEQ ID NO: 384406 - RNA, 25 nt, Human
ccuugggcagguuccauuucugcuu

SEQ ID NO: 384407 - RNA, 21 nt, Human
ccuugggcagugccuccuccu

SEQ ID NO: 384408 - RNA, 32 nt, Human
ccuugggcccagcacacccucgcugcuggugg

SEQ ID NO: 384409 - RNA, 25 nt, Human
ccuugggcccauuucccuccugucu

SEQ ID NO: 384410 - RNA, 22 nt, Human
ccuugggccccagccuccugcu

SEQ ID NO: 384411 - RNA, 26 nt, Human
ccuugggccgagccugccuccugcuu

SEQ ID NO: 384412 - RNA, 32 nt, Human
ccuugggccugggauaaguccacucuccacac

SEQ ID NO: 384413 - RNA, 31 nt, Human
ccuugggcgggccauuucacauuccugaccc

SEQ ID NO: 384414 - RNA, 32 nt, Human
ccuugggcgucccuccugguccugcgcucgcg

SEQ ID NO: 384415 - RNA, 32 nt, Human
ccuugggcucaagcuauccucccaccucagcc

SEQ ID NO: 384416 - RNA, 32 nt, Human
ccuugggcuccaggggagggugcgugggggcg

SEQ ID NO: 384417 - RNA, 32 nt, Human
ccuugggcucccuguaaccucuucagaggccc

SEQ ID NO: 384418 - RNA, 32 nt, Human
ccuugggcucuccccagggucuaacgguuaag

SEQ ID NO: 384419 - RNA, 22 nt, Human
ccuugggcugccucuucugucu

SEQ ID NO: 384420 - RNA, 32 nt, Human
ccuugggcuggcucgagccugggguccauguc

SEQ ID NO: 384421 - RNA, 32 nt, Human
ccuugggcuggcugugugaucuugggcaaguu

SEQ ID NO: 384422 - RNA, 32 nt, Human
ccuugggcugggugggaagagggguggccgcc

SEQ ID NO: 384423 - RNA, 32 nt, Human
ccuugggcuucugagggcaucauagggggacc

SEQ ID NO: 384424 - RNA, 32 nt, Human
ccuugggcuuggcuccagcaguggcaccaaua

SEQ ID NO: 384425 - RNA, 32 nt, Human
ccuugggcuuucugucuccucaacaagagugc

SEQ ID NO: 384426 - RNA, 32 nt, Human
ccuugggcuuugaacccacccuucuuagaagg

SEQ ID NO: 384427 - RNA, 32 nt, Human
ccuugggcuuuucaacucuugcaccuggaguu

SEQ ID NO: 384428 - RNA, 32 nt, Human
ccuuggggaaguuggcccauaucuuacuaagu

SEQ ID NO: 384429 - RNA, 22 nt, Human
ccuuggggacuccugucugucu

SEQ ID NO: 384430 - RNA, 32 nt, Human
ccuuggggagaaauggcccguggugggcugac

SEQ ID NO: 384431 - RNA, 32 nt, Human
ccuuggggaggaaccauaucucccucugggcc

SEQ ID NO: 384432 - RNA, 32 nt, Human
ccuuggggaucugggagcugagcacuugucua

SEQ ID NO: 384433 - RNA, 32 nt, Human
ccuuggggaugguggaggugcuaaugcuuugc

SEQ ID NO: 384434 - RNA, 23 nt, Human
ccuuggggauucuacuucuuccu

SEQ ID NO: 384435 - RNA, 32 nt, Human
ccuuggggcacagucauucacaucacugauug

SEQ ID NO: 384436 - RNA, 32 nt, Human
ccuuggggcagcucccacauucccagggauuu

SEQ ID NO: 384437 - RNA, 32 nt, Human
ccuuggggcagggagagagggaaccugcucac

SEQ ID NO: 384438 - RNA, 32 nt, Human
ccuuggggccagcaucucccacugccuccaaa

SEQ ID NO: 384439 - RNA, 24 nt, Human
ccuuggggcccaaggccucuuccu

SEQ ID NO: 384440 - RNA, 32 nt, Human
ccuuggggcccugggagaucugggacuucaga

SEQ ID NO: 384441 - RNA, 22 nt, Human
ccuuggggcgcggcagcgcagg

SEQ ID NO: 384442 - RNA, 32 nt, Human
ccuuggggcggggugguugcaguagugucauc

SEQ ID NO: 384443 - RNA, 32 nt, Human
ccuuggggcuaaggggacagcggugugguuug

SEQ ID NO: 384444 - RNA, 18 nt, Human
ccuuggggcugggcccug

SEQ ID NO: 384445 - RNA, 32 nt, Human
ccuuggggcugguggcugggggaguggguagc

SEQ ID NO: 384446 - RNA, 32 nt, Human
ccuugggggaaaggaaggaagugcauguuugg

SEQ ID NO: 384447 - RNA, 32 nt, Human
ccuugggggccaccaacaagggaggaagucag

SEQ ID NO: 384448 - RNA, 23 nt, Human
ccuuggggggcacaugucuucgu

SEQ ID NO: 384449 - RNA, 19 nt, Human
ccuuggggguguugagcca

SEQ ID NO: 384450 - RNA, 23 nt, Human
ccuuggggguuccgcuuccuguu

SEQ ID NO: 384451 - RNA, 21 nt, Human
ccuugggguaccccuuuuccu

SEQ ID NO: 384452 - RNA, 26 nt, Human
ccuugggguagcaccuccuucugcuu

SEQ ID NO: 384453 - RNA, 18 nt, Human
ccuuggggucgccuccca

SEQ ID NO: 384454 - RNA, 22 nt, Human
ccuugggguggcgcgccugccu

SEQ ID NO: 384455 - RNA, 23 nt, Human
ccuugggguuaagucuccugucu

SEQ ID NO: 384456 - RNA, 32 nt, Human
ccuugggguuugagagcgcuguauuugggaga

SEQ ID NO: 384457 - RNA, 24 nt, Human
ccuugggguuugggggcuugaccu

SEQ ID NO: 384458 - RNA, 32 nt, Human
ccuuggguaggguacgguggggugggguguug

SEQ ID NO: 384459 - RNA, 22 nt, Human
ccuuggguauuaagugcaguca

SEQ ID NO: 384460 - RNA, 32 nt, Human
ccuuggguccccauccucuggaaccaggggga

SEQ ID NO: 384461 - RNA, 32 nt, Human
ccuuggguccuuccagcucagugccgcggaca

SEQ ID NO: 384462 - RNA, 32 nt, Human
ccuugggucuguuucauucuaaaacgaagugg

SEQ ID NO: 384463 - RNA, 32 nt, Human
ccuugggugacaccuccgagaggcagccagac

SEQ ID NO: 384464 - RNA, 23 nt, Human
ccuugggugucccucuccugccu

SEQ ID NO: 384465 - RNA, 32 nt, Human
ccuuggguguggccaucuucuauggucgagac

SEQ ID NO: 384466 - RNA, 22 nt, Human
ccuuggguucaagguuacagga

SEQ ID NO: 384467 - RNA, 32 nt, Human
ccuuggguuccaggcuggaggaaugcaggcag

SEQ ID NO: 384468 - RNA, 23 nt, Human
ccuuggguuugcucuuucuucac

SEQ ID NO: 384469 - RNA, 32 nt, Human
ccuugguaauuuugaauuuggccauaguauac

SEQ ID NO: 384470 - RNA, 32 nt, Human
ccuugguagaaggagagaaggggaguggagga

SEQ ID NO: 384471 - RNA, 32 nt, Human
ccuugguagcuugcaggagcaucugaugaaug

SEQ ID NO: 384472 - RNA, 18 nt, Human
ccuugguagcuuuuucuc

SEQ ID NO: 384473 - RNA, 24 nt, Human
ccuugguaucgccucucccuuccc

SEQ ID NO: 384474 - RNA, 32 nt, Human
ccuugguauguaccucuggcaaaugcccuggu

SEQ ID NO: 384475 - RNA, 21 nt, Human
ccuugguauuucuccuggggc

SEQ ID NO: 384476 - RNA, 21 nt, Human
ccuuggucauggccaaacccu

SEQ ID NO: 384477 - RNA, 21 nt, Human
ccuugguccccaaccccagca

SEQ ID NO: 384478 - RNA, 16 nt, Human
ccuugguccucaggug

SEQ ID NO: 384479 - RNA, 32 nt, Human
ccuugguccucaucuuggucccuuccaaucug

SEQ ID NO: 384480 - RNA, 32 nt, Human
ccuuggucgccuagacuggauagugggggugg

SEQ ID NO: 384481 - RNA, 32 nt, Human
ccuuggucucaccuauccugcccucacaucuu

SEQ ID NO: 384482 - RNA, 32 nt, Human
ccuuggucuccaccacgacaucucaguaccaa

SEQ ID NO: 384483 - RNA, 32 nt, Human
ccuuggucugagacaguguccucaggucgcag

SEQ ID NO: 384484 - RNA, 22 nt, Human
ccuuggucugucacuccugcuu

SEQ ID NO: 384485 - RNA, 20 nt, Human
ccuuggucuucccugccccu

SEQ ID NO: 384486 - RNA, 32 nt, Human
ccuuggucuuggcuuguccucacccagucgga

SEQ ID NO: 384487 - RNA, 32 nt, Human
ccuugguggcaggucccagagccuagguggua

SEQ ID NO: 384488 - RNA, 32 nt, Human
ccuugguggcugcuggaaagggagagguucuc

SEQ ID NO: 384489 - RNA, 32 nt, Human
ccuugguguucucugcuguuaucugccaaaug

SEQ ID NO: 384490 - RNA, 32 nt, Human
ccuugguuaaagaaauccacuugugaagugug

SEQ ID NO: 384491 - RNA, 32 nt, Human
ccuugguuccagcaauucuucugccucagccu

SEQ ID NO: 384492 - RNA, 32 nt, Human
ccuugguucuccccaugacaccaccugaacgu

SEQ ID NO: 384493 - RNA, 32 nt, Human
ccuugguugguugaaucuacagaugcagaacc

SEQ ID NO: 384494 - RNA, 18 nt, Human
ccuugguuguuuuucucu

SEQ ID NO: 384495 - RNA, 32 nt, Human
ccuugguuuccugagccaccuuuacucugcuc

SEQ ID NO: 384496 - RNA, 32 nt, Human
ccuugguuucuaggaugguuuuguguggaggg

SEQ ID NO: 384497 - RNA, 32 nt, Human
ccuuguaaagacagagugaauuucaguauaaa

SEQ ID NO: 384498 - RNA, 24 nt, Human
ccuuguaacccuuuucugcccagc

SEQ ID NO: 384499 - RNA, 32 nt, Human
ccuuguaacggauguuuccaccuccuucucca

SEQ ID NO: 384500 - RNA, 32 nt, Human
ccuuguaacggauguuuccaccuucuucucca

SEQ ID NO: 384501 - RNA, 32 nt, Human
ccuuguaaguaaauccaugauaugaauuagaa

SEQ ID NO: 384502 - RNA, 32 nt, Human
ccuuguaaguucuggggagcauuccaaagcag

SEQ ID NO: 384503 - RNA, 32 nt, Human
ccuuguaaucuaacuuugucacugugacuaca

SEQ ID NO: 384504 - RNA, 32 nt, Human
ccuuguacagaggcauagguuaccacccccac

SEQ ID NO: 384505 - RNA, 32 nt, Human
ccuuguacaugaaaacagcggcccacccaaag

SEQ ID NO: 384506 - RNA, 32 nt, Human
ccuuguaccccaucccuuccuccccagucuac

SEQ ID NO: 384507 - RNA, 32 nt, Human
ccuuguaccugcuccgugcccaacacaugccc

SEQ ID NO: 384508 - RNA, 32 nt, Human
ccuuguagagacauggucucacuauguugcug

SEQ ID NO: 384509 - RNA, 32 nt, Human
ccuuguaggaauaguugaaggagauucgauuu

SEQ ID NO: 384510 - RNA, 32 nt, Human
ccuuguaguacaaggugcuuuaaugggauaga

SEQ ID NO: 384511 - RNA, 23 nt, Human
ccuuguaguacagguacagugaa

SEQ ID NO: 384512 - RNA, 32 nt, Human
ccuuguauaacugaauuuauggugcuauuuaa

SEQ ID NO: 384513 - RNA, 19 nt, Human
ccuuguauccuccuuguca

SEQ ID NO: 384514 - RNA, 32 nt, Human
ccuuguaucuucuccccuucugagccugucca

SEQ ID NO: 384515 - RNA, 32 nt, Human
ccuugucacccaggcuagagugcaguggcacg

SEQ ID NO: 384516 - RNA, 32 nt, Human
ccuugucacccaggcuggaguccaguggcaca

SEQ ID NO: 384517 - RNA, 32 nt, Human
ccuugucacccaggcuguagugcgguggcgcg

SEQ ID NO: 384518 - RNA, 32 nt, Human
ccuugucacuacuuuaggcccauuccacaaag

SEQ ID NO: 384519 - RNA, 32 nt, Human
ccuugucacuccuugcuccucucccuccugcc

SEQ ID NO: 384520 - RNA, 19 nt, Human
ccuugucacugcagccaga

SEQ ID NO: 384521 - RNA, 32 nt, Human
ccuugucagcucccuaagucuuccuguuuccc

SEQ ID NO: 384522 - RNA, 32 nt, Human
ccuugucaggaucuccccuccuuggcccaggc

SEQ ID NO: 384523 - RNA, 32 nt, Human
ccuugucauuuuaccccaucccugcaugacug

SEQ ID NO: 384524 - RNA, 32 nt, Human
ccuuguccaagaagaacuugcuacacagccua

SEQ ID NO: 384525 - RNA, 32 nt, Human
ccuuguccaagaaggcuggacgagagaccuuc

SEQ ID NO: 384526 - RNA, 32 nt, Human
ccuuguccacuaacugcacuuccuucccacug

SEQ ID NO: 384527 - RNA, 32 nt, Human
ccuuguccacugcccugcuccagcccauuucc

SEQ ID NO: 384528 - RNA, 18 nt, Human
ccuuguccacugcugccg

SEQ ID NO: 384529 - RNA, 32 nt, Human
ccuuguccagccugaccaacauggugaaaccc

SEQ ID NO: 384530 - RNA, 32 nt, Human
ccuugucccagccucugccccagcccacuggc

SEQ ID NO: 384531 - RNA, 32 nt, Human
ccuugucccagcuucuacaggcugaggaagcu

SEQ ID NO: 384532 - RNA, 21 nt, Human
ccuuguccccacucccuuccc

SEQ ID NO: 384533 - RNA, 32 nt, Human
ccuuguccccgagggccaugggccgggucuca

SEQ ID NO: 384534 - RNA, 32 nt, Human
ccuuguccccucuuccccaaaaccucuguaaa

SEQ ID NO: 384535 - RNA, 29 nt, Human
ccuuguccccugccugugccugccuggga

SEQ ID NO: 384536 - RNA, 32 nt, Human
ccuuguccccuuuuuauuuauugggcaggggg

SEQ ID NO: 384537 - RNA, 32 nt, Human
ccuugucccucuuccucuuucuuuccguuucc

SEQ ID NO: 384538 - RNA, 32 nt, Human
ccuugucccuguuuaucugcagccaggagacu

SEQ ID NO: 384539 - RNA, 32 nt, Human
ccuugucccuuagcguccaccuaggggacauu

SEQ ID NO: 384540 - RNA, 32 nt, Human
ccuuguccucaagauuuuuaguuuggcccaag

SEQ ID NO: 384541 - RNA, 32 nt, Human
ccuuguccucaccuuacuccccucaggacccu

SEQ ID NO: 384542 - RNA, 32 nt, Human
ccuuguccucagcucccaucuccuggacugcc

SEQ ID NO: 384543 - RNA, 32 nt, Human
ccuuguccugaguggccuuaggaagcugcagu

SEQ ID NO: 384544 - RNA, 32 nt, Human
ccuuguccuguggccucugcuccaggggcagu

SEQ ID NO: 384545 - RNA, 32 nt, Human
ccuuguccuucuccucuuuguccuccugcuuu

SEQ ID NO: 384546 - RNA, 32 nt, Human
ccuugucucccacucuuucuucauauacggug

SEQ ID NO: 384547 - RNA, 32 nt, Human
ccuugucuccuccagcaccacagggaagacaa

SEQ ID NO: 384548 - RNA, 32 nt, Human
ccuugucucuaccaaaauaaaaauuagcuggg

SEQ ID NO: 384549 - RNA, 32 nt, Human
ccuugucucuaugccagcucagucccaucaga

SEQ ID NO: 384550 - RNA, 32 nt, Human
ccuugucuggaggcuuuguucaucucgaagga

SEQ ID NO: 384551 - RNA, 32 nt, Human
ccuugucuguaucugggcagcagguguuccau

SEQ ID NO: 384552 - RNA, 32 nt, Human
ccuugucuucagaugagaauggagucugaaug

SEQ ID NO: 384553 - RNA, 32 nt, Human
ccuugucuuccaguuccuuucucccauuccca

SEQ ID NO: 384554 - RNA, 32 nt, Human
ccuugucuucuuuccuuuugcgacuugguuuu

SEQ ID NO: 384555 - RNA, 22 nt, Human
ccuugucuuucaaaagaacuca

SEQ ID NO: 384556 - RNA, 23 nt, Human
ccuugucuuucaaaagacaccug

SEQ ID NO: 384557 - RNA, 32 nt, Human
ccuugucuuugccucugauuuuuacacagugu

SEQ ID NO: 384558 - RNA, 31 nt, Human
ccuugucuuugcucuuacccugugucuucca

SEQ ID NO: 384559 - RNA, 32 nt, Human
ccuugucuuugucuuucuucccuucccccugc

SEQ ID NO: 384560 - RNA, 32 nt, Human
ccuugucuuuuccucucucugccucaguuucu

SEQ ID NO: 384561 - RNA, 32 nt, Human
ccuugugaaagaagaaaagauaacugaaugaa

SEQ ID NO: 384562 - RNA, 32 nt, Human
ccuugugaaaguuaccacagugcuccauguga

SEQ ID NO: 384563 - RNA, 32 nt, Human
ccuugugaacugcucaguaaacucuacauugu

SEQ ID NO: 384564 - RNA, 21 nt, Human
ccuugugaagguggcaggggc

SEQ ID NO: 384565 - RNA, 32 nt, Human
ccuugugaaugcucaccuaaaccaaagaucac

SEQ ID NO: 384566 - RNA, 22 nt, Human
ccuugugaaugucccuuaggga

SEQ ID NO: 384567 - RNA, 32 nt, Human
ccuugugacaucucugaucagguuggggugcc

SEQ ID NO: 384568 - RNA, 23 nt, Human
ccuugugaguuauagucugcuua

SEQ ID NO: 384569 - RNA, 21 nt, Human
ccuugugauccacccaccuca

SEQ ID NO: 384570 - RNA, 21 nt, Human
ccuugugauccgcccaccuca

SEQ ID NO: 384571 - RNA, 21 nt, Human
ccuugugauccucccgccuca

SEQ ID NO: 384572 - RNA, 32 nt, Human
ccuugugauccucccgccucagccucucaaag

SEQ ID NO: 384573 - RNA, 32 nt, Human
ccuugugaucugccugccucagccucucaaag

SEQ ID NO: 384574 - RNA, 32 nt, Human
ccuugugauucuguccccuccccaagacccca

SEQ ID NO: 384575 - RNA, 31 nt, Human
ccuugugcacuuuuccccuggcaguggacau

SEQ ID NO: 384576 - RNA, 32 nt, Human
ccuugugcagaagacuaguuacacuuaauggg

SEQ ID NO: 384577 - RNA, 32 nt, Human
ccuugugcagagccaggggucugagggcaccu

SEQ ID NO: 384578 - RNA, 32 nt, Human
ccuugugcagggcugaagacauguggacuucc

SEQ ID NO: 384579 - RNA, 32 nt, Human
ccuugugcauuugggcugaagacaaagaugac

SEQ ID NO: 384580 - RNA, 32 nt, Human
ccuugugccaggucaaggugggggcaggcugg

SEQ ID NO: 384581 - RNA, 32 nt, Human
ccuugugccccaggcauccucagccucuggug

SEQ ID NO: 384582 - RNA, 32 nt, Human
ccuugugccuccugugggaggcugaggacugc

SEQ ID NO: 384583 - RNA, 32 nt, Human
ccuugugccuggguaaaaagucuccuccuggg

SEQ ID NO: 384584 - RNA, 32 nt, Human
ccuugugcuagagcccuccaucaccuucacgc

SEQ ID NO: 384585 - RNA, 32 nt, Human
ccuugugcucaggccagugucuucccauuaac

SEQ ID NO: 384586 - RNA, 32 nt, Human
ccuugugcugaccccgcuggggugcagggguu

SEQ ID NO: 384587 - RNA, 32 nt, Human
ccuugugcugugcagcccgguuccuaacagac

SEQ ID NO: 384588 - RNA, 30 nt, Human
ccuuguggccacuccaugcauuuuucuugg

SEQ ID NO: 384589 - RNA, 32 nt, Human
ccuuguggggcucuugggaugggcgggcaccc

SEQ ID NO: 384590 - RNA, 32 nt, Human
ccuugugggugaagccagggagggagacagga

SEQ ID NO: 384591 - RNA, 32 nt, Human
ccuuguggguuauuauggcaguacauuuaucg

SEQ ID NO: 384592 - RNA, 32 nt, Human
ccuugugguggaggaggccugggggcagccag

SEQ ID NO: 384593 - RNA, 32 nt, Human
ccuuguguauccugacagcgccauguguguca

SEQ ID NO: 384594 - RNA, 32 nt, Human
ccuugugucuucaagcauugaccaaguuaagu

SEQ ID NO: 384595 - RNA, 21 nt, Human
ccuugugugacccuccccaua

SEQ ID NO: 384596 - RNA, 32 nt, Human
ccuugugugcugacagccuggcugcugcagga

SEQ ID NO: 384597 - RNA, 32 nt, Human
ccuuguguggccugcucagagcuggaugccac

SEQ ID NO: 384598 - RNA, 32 nt, Human
ccuugugugucaggcccucugccugcacuccc

SEQ ID NO: 384599 - RNA, 32 nt, Human
ccuuguguuugagauugggagcugagccagaa

SEQ ID NO: 384600 - RNA, 32 nt, Human
ccuuguuacucaggaaccucaccuuggacgga

SEQ ID NO: 384601 - RNA, 32 nt, Human
ccuuguuacuggcuccuuccaucaagcagaca

SEQ ID NO: 384602 - RNA, 32 nt, Human
ccuuguuagacagaacuugggccuuugccagc

SEQ ID NO: 384603 - RNA, 32 nt, Human
ccuuguuauaucuauuucuguauuggaguaau

SEQ ID NO: 384604 - RNA, 18 nt, Human
ccuuguuaucucuugccu

SEQ ID NO: 384605 - RNA, 32 nt, Human
ccuuguucaacucuguuuacugaggccccuac

SEQ ID NO: 384606 - RNA, 32 nt, Human
ccuuguucacagcugcugcucuugccucugug

SEQ ID NO: 384607 - RNA, 32 nt, Human
ccuuguucacauacccuccuugugauuuuguc

SEQ ID NO: 384608 - RNA, 32 nt, Human
ccuuguucaccuucugucaugaguaaaagcuu

SEQ ID NO: 384609 - RNA, 32 nt, Human
ccuuguuccagggaacagcugcuucucugggg

SEQ ID NO: 384610 - RNA, 32 nt, Human
ccuuguucccucccuggcccucaggcccuccu

SEQ ID NO: 384611 - RNA, 32 nt, Human
ccuuguuccuucaucaucccccuuccuugugc

SEQ ID NO: 384612 - RNA, 32 nt, Human
ccuuguucuacccuaaacuuuguaucaccuga

SEQ ID NO: 384613 - RNA, 32 nt, Human
ccuuguucuccaagaacuuacuguccaaucau

SEQ ID NO: 384614 - RNA, 32 nt, Human
ccuuguucucccacuuccugaagaugcuaaac

SEQ ID NO: 384615 - RNA, 32 nt, Human
ccuuguucuccuccagguggagcugcugggug

SEQ ID NO: 384616 - RNA, 32 nt, Human
ccuuguucucucucccuggcacccacccccag

SEQ ID NO: 384617 - RNA, 32 nt, Human
ccuuguucuuguuccccaccucccaggaaagg

SEQ ID NO: 384618 - RNA, 32 nt, Human
ccuuguugaacagauccacacugcucuaauaa

SEQ ID NO: 384619 - RNA, 32 nt, Human
ccuuguugaggcuuuuuccuuucagaugagcu

SEQ ID NO: 384620 - RNA, 32 nt, Human
ccuuguugcccaggcuggagugcaauggcgcg

SEQ ID NO: 384621 - RNA, 32 nt, Human
ccuuguugcccaggcuggagugcaauggcgua

SEQ ID NO: 384622 - RNA, 32 nt, Human
ccuuguugcccaggcuggucuugaacugggcu

SEQ ID NO: 384623 - RNA, 32 nt, Human
ccuuguugcccaggcuguaguacaauggcaug

SEQ ID NO: 384624 - RNA, 32 nt, Human
ccuuguugccuccccgucccugucuccccuga

SEQ ID NO: 384625 - RNA, 19 nt, Human
ccuuguuggagggggccag

SEQ ID NO: 384626 - RNA, 32 nt, Human
ccuuguugugugaccuugggcaggugguucug

SEQ ID NO: 384627 - RNA, 32 nt, Human
ccuuguuguugggagcauuuccaggcaucuuu

SEQ ID NO: 384628 - RNA, 32 nt, Human
ccuuguuucuccuuucuacaugacauugcagu

SEQ ID NO: 384629 - RNA, 32 nt, Human
ccuuguuugaguauuucugucucugaaauaac

SEQ ID NO: 384630 - RNA, 32 nt, Human
ccuuguuuuauucaaagacagagaagaccaaa

SEQ ID NO: 384631 - RNA, 32 nt, Human
ccuuguuuucacccucuguccucugcccguca

SEQ ID NO: 384632 - RNA, 32 nt, Human
ccuuuaaaaauucuuuuaauagaucauguuau

SEQ ID NO: 384633 - RNA, 32 nt, Human
ccuuuaaaauccuaagccugacuaggacagcc

SEQ ID NO: 384634 - RNA, 32 nt, Human
ccuuuaaagggagggggagaagccagggugau

SEQ ID NO: 384635 - RNA, 32 nt, Human
ccuuuaaaugcacauuguguggauggcucuca

SEQ ID NO: 384636 - RNA, 32 nt, Human
ccuuuaaauggaaucccagcacuuugggaggc

SEQ ID NO: 384637 - RNA, 32 nt, Human
ccuuuaaauuuucagauuuaccuucauucugu

SEQ ID NO: 384638 - RNA, 23 nt, Human
ccuuuaacaacauguuuccagca

SEQ ID NO: 384639 - RNA, 32 nt, Human
ccuuuaaccacagugucaacauaguaucggaa

SEQ ID NO: 384640 - RNA, 32 nt, Human
ccuuuaacucaacccgcuucccagcacagcgg

SEQ ID NO: 384641 - RNA, 32 nt, Human
ccuuuaacucaugaggagggaaaagagugccu

SEQ ID NO: 384642 - RNA, 32 nt, Human
ccuuuaagaagcuuccagagcagaagugacug

SEQ ID NO: 384643 - RNA, 32 nt, Human
ccuuuaagaccaaggagauaaggguggaggag

SEQ ID NO: 384644 - RNA, 32 nt, Human
ccuuuaaucccaauuuccccugcucacucuuc

SEQ ID NO: 384645 - RNA, 32 nt, Human
ccuuuaaucccagcuacucgggaggcugaggc

SEQ ID NO: 384646 - RNA, 32 nt, Human
ccuuuaaucccagcuacucgggagguugaggc

SEQ ID NO: 384647 - RNA, 23 nt, Human
ccuuuaaucccagcuacuuggga

SEQ ID NO: 384648 - RNA, 32 nt, Human
ccuuuaaucccagcuacuugggaggcugaggu

SEQ ID NO: 384649 - RNA, 32 nt, Human
ccuuuaaucccaguuacucaggaggcugaggc

SEQ ID NO: 384650 - RNA, 32 nt, Human
ccuuuaaugaucugguggucuccucgucaauc

SEQ ID NO: 384651 - RNA, 32 nt, Human
ccuuuacaaucaggaugacaaucaccaggaau

SEQ ID NO: 384652 - RNA, 32 nt, Human
ccuuuacacaugcccaggcagcaccucaggcc

SEQ ID NO: 384653 - RNA, 32 nt, Human
ccuuuacagagcagcccuuagccuggggccau

SEQ ID NO: 384654 - RNA, 32 nt, Human
ccuuuacagcacagaugccauuagaaugugaa

SEQ ID NO: 384655 - RNA, 32 nt, Human
ccuuuacaugaauacgucuugaucagacauuc

SEQ ID NO: 384656 - RNA, 32 nt, Human
ccuuuacauuuguacacaaaugugacuauguc

SEQ ID NO: 384657 - RNA, 32 nt, Human
ccuuuaccagagaagguuugcugacccucucc

SEQ ID NO: 384658 - RNA, 32 nt, Human
ccuuuaccuggaccuuguagggucuccugccu

SEQ ID NO: 384659 - RNA, 32 nt, Human
ccuuuaccuguauuccuggacaaggccuagag

SEQ ID NO: 384660 - RNA, 24 nt, Human
ccuuuaccuuuucuauaaguugua

SEQ ID NO: 384661 - RNA, 22 nt, Human
ccuuuaccuuuuuuguuguugu

SEQ ID NO: 384662 - RNA, 32 nt, Human
ccuuuacuaaguagcugguuuuguuuguuugu

SEQ ID NO: 384663 - RNA, 32 nt, Human
ccuuuacuacaggacagaaaccacuuaguuuu

SEQ ID NO: 384664 - RNA, 32 nt, Human
ccuuuacucaaaacaaaacaauuuuuagcaca

SEQ ID NO: 384665 - RNA, 32 nt, Human
ccuuuacucacacccuucuucugaccagcucc

SEQ ID NO: 384666 - RNA, 23 nt, Human
ccuuuacuccuggcucaagcccu

SEQ ID NO: 384667 - RNA, 32 nt, Human
ccuuuacucuagauucauucagcuuuuccaga

SEQ ID NO: 384668 - RNA, 32 nt, Human
ccuuuacucucuucucccuccagaccuuccuc

SEQ ID NO: 384669 - RNA, 32 nt, Human
ccuuuacucuuuccucaacccuugucucuauc

SEQ ID NO: 384670 - RNA, 32 nt, Human
ccuuuacugacaccuugugcucaggccugugu

SEQ ID NO: 384671 - RNA, 32 nt, Human
ccuuuacuuagaagauuuagaccuaagcagca

SEQ ID NO: 384672 - RNA, 23 nt, Human
ccuuuagaaacacacagcuccau

SEQ ID NO: 384673 - RNA, 32 nt, Human
ccuuuagagaucuggauauuuuucaaagacuu

SEQ ID NO: 384674 - RNA, 32 nt, Human
ccuuuagcacaauccuggcccacucccuaccc

SEQ ID NO: 384675 - RNA, 32 nt, Human
ccuuuagccuggaggucaaggcugcagugagc

SEQ ID NO: 384676 - RNA, 19 nt, Human
ccuuuaggaugucaccuca

SEQ ID NO: 384677 - RNA, 32 nt, Human
ccuuuaggcucuacagagugaagguuuaaauc

SEQ ID NO: 384678 - RNA, 32 nt, Human
ccuuuagggcaaauaacacagcagaaccacgu

SEQ ID NO: 384679 - RNA, 32 nt, Human
ccuuuaggguucccggagcuccgggaagaccc

SEQ ID NO: 384680 - RNA, 32 nt, Human
ccuuuaguacaguguuuccacucuuucugccc

SEQ ID NO: 384681 - RNA, 32 nt, Human
ccuuuaguagcugauuucuuguccucaaccac

SEQ ID NO: 384682 - RNA, 32 nt, Human
ccuuuagucccagcuacucuggaggcugaagu

SEQ ID NO: 384683 - RNA, 32 nt, Human
ccuuuagucgcagcuacuggggaggcugaggc

SEQ ID NO: 384684 - RNA, 32 nt, Human
ccuuuagugaagcccccgagguuguguccagg

SEQ ID NO: 384685 - RNA, 32 nt, Human
ccuuuagugaccagucugccucuugggucuuc

SEQ ID NO: 384686 - RNA, 31 nt, Human
ccuuuagugccagcagggccuguguccuggg

SEQ ID NO: 384687 - RNA, 32 nt, Human
ccuuuagugugcucuuccacuuuggaaggcca

SEQ ID NO: 384688 - RNA, 32 nt, Human
ccuuuaguuaccaaacauuaaauguuuuuaaa

SEQ ID NO: 384689 - RNA, 32 nt, Human
ccuuuaguuccagcuacucaggaggcuaaggc

SEQ ID NO: 384690 - RNA, 32 nt, Human
ccuuuaguucucacuucugucuccacgucaag

SEQ ID NO: 384691 - RNA, 32 nt, Human
ccuuuaguuuuacaaguaaagcagguuguaaa

SEQ ID NO: 384692 - RNA, 21 nt, Human
ccuuuauaagaauaugacaua

SEQ ID NO: 384693 - RNA, 32 nt, Human
ccuuuauaaugaauuuguuuuuauuucucaua

SEQ ID NO: 384694 - RNA, 32 nt, Human
ccuuuauagagugucucagggugcagagguca

SEQ ID NO: 384695 - RNA, 22 nt, Human
ccuuuauagauugauuccagca

SEQ ID NO: 384696 - RNA, 32 nt, Human
ccuuuauauaaauguuaaaugccuuuauaacu

SEQ ID NO: 384697 - RNA, 32 nt, Human
ccuuuauauccagaagagucucuguguggugc

SEQ ID NO: 384698 - RNA, 32 nt, Human
ccuuuauaugugaauuaccaucuuguuucuuu

SEQ ID NO: 384699 - RNA, 32 nt, Human
ccuuuaucgaggggugcugcuuuuucucccuc

SEQ ID NO: 384700 - RNA, 32 nt, Human
ccuuuaucuccaacaauauccaccucaccaaa

SEQ ID NO: 384701 - RNA, 32 nt, Human
ccuuuaucuccuccuuccccucuggcagcgag

SEQ ID NO: 384702 - RNA, 32 nt, Human
ccuuuaucuugcaaaccccugccccugcuguc

SEQ ID NO: 384703 - RNA, 32 nt, Human
ccuuuaugaagcugcaggcugacgagagaugg

SEQ ID NO: 384704 - RNA, 32 nt, Human
ccuuuaugagcuguaacacucacccugaaggu

SEQ ID NO: 384705 - RNA, 32 nt, Human
ccuuuaugcuugcugucucucagaauuguuuu

SEQ ID NO: 384706 - RNA, 30 nt, Human
ccuuuauggacaacuacagcacaggcuacg

SEQ ID NO: 384707 - RNA, 32 nt, Human
ccuuuauggcugcugggcugagugacacaagc

SEQ ID NO: 384708 - RNA, 22 nt, Human
ccuuuauuaaugaacugugaca

SEQ ID NO: 384709 - RNA, 32 nt, Human
ccuuuauuaccuuuacucccucccucucccau

SEQ ID NO: 384710 - RNA, 32 nt, Human
ccuuuauuccacgucgcguggucuccaagacc

SEQ ID NO: 384711 - RNA, 32 nt, Human
ccuuuauuccagcugccugccaccccagaccc

SEQ ID NO: 384712 - RNA, 32 nt, Human
ccuuuauuccuucauuucaucuaccauuuucu

SEQ ID NO: 384713 - RNA, 32 nt, Human
ccuuuauucuucuuuugcugcuuucugauagu

SEQ ID NO: 384714 - RNA, 32 nt, Human
ccuuuauugcccuguccucaaacuggucauag

SEQ ID NO: 384715 - RNA, 32 nt, Human
ccuuuauuuaacuccauuuauugcuuuuggua

SEQ ID NO: 384716 - RNA, 32 nt, Human
ccuuuauuucccaauauuucugaucuacaaau

SEQ ID NO: 384717 - RNA, 23 nt, Human
ccuuuauuugaucucaaguugua

SEQ ID NO: 384718 - RNA, 32 nt, Human
ccuuuauuuguacccaccuuccagucagcaag

SEQ ID NO: 384719 - RNA, 32 nt, Human
ccuuuauuuucagauacucuucuauacuuacc

SEQ ID NO: 384720 - RNA, 32 nt, Human
ccuuucaaaaucaugaaauaucucacacugga

SEQ ID NO: 384721 - RNA, 32 nt, Human
ccuuucaaaaucaugagacaacucacacugga

SEQ ID NO: 384722 - RNA, 32 nt, Human
ccuuucaaaccuguauuccuucuuuauacuca

SEQ ID NO: 384723 - RNA, 32 nt, Human
ccuuucaaagugcugggauuacagacaugagc

SEQ ID NO: 384724 - RNA, 32 nt, Human
ccuuucaaagugcugggauuacaggcaugagc

SEQ ID NO: 384725 - RNA, 32 nt, Human
ccuuucaaccagauaacuuccuaaguggagau

SEQ ID NO: 384726 - RNA, 32 nt, Human
ccuuucaagacagaaagagacaggagacauga

SEQ ID NO: 384727 - RNA, 32 nt, Human
ccuuucaagccccaguguucaagcucagagag

SEQ ID NO: 384728 - RNA, 32 nt, Human
ccuuucaaguagcugggauuacagguaccucu

SEQ ID NO: 384729 - RNA, 32 nt, Human
ccuuucaaguggcugggaugacuacaggcaug

SEQ ID NO: 384730 - RNA, 32 nt, Human
ccuuucacaagcaacagacucucacagggcaa

SEQ ID NO: 384731 - RNA, 32 nt, Human
ccuuucacaagggcaaacuuuuuccuuuuccc

SEQ ID NO: 384732 - RNA, 32 nt, Human
ccuuucacagccggucucucugccaggaaaug

SEQ ID NO: 384733 - RNA, 22 nt, Human
ccuuucaccaguggagcugccu

SEQ ID NO: 384734 - RNA, 22 nt, Human
ccuuucacccugucccuccuca

SEQ ID NO: 384735 - RNA, 32 nt, Human
ccuuucacuccacacccucuggccuucugccu

SEQ ID NO: 384736 - RNA, 32 nt, Human
ccuuucacugaauuuucugagggcagagucuu

SEQ ID NO: 384737 - RNA, 32 nt, Human
ccuuucacuugagcuucaacaugggaaaggga

SEQ ID NO: 384738 - RNA, 32 nt, Human
ccuuucagaacacacucacauuuucuauagga

SEQ ID NO: 384739 - RNA, 32 nt, Human
ccuuucagagacggagcaccugagauguggga

SEQ ID NO: 384740 - RNA, 32 nt, Human
ccuuucagcaagacuucucuuugccucaaaua

SEQ ID NO: 384741 - RNA, 32 nt, Human
ccuuucagccacacccucccaaaaggcuuuua

SEQ ID NO: 384742 - RNA, 32 nt, Human
ccuuucagccauggcuggagcagcugggacac

SEQ ID NO: 384743 - RNA, 22 nt, Human
ccuuucagcccccaggcugccu

SEQ ID NO: 384744 - RNA, 32 nt, Human
ccuuucagccucuuuacaaccuccuggaucca

SEQ ID NO: 384745 - RNA, 32 nt, Human
ccuuucaggaagggagggagcaggucugaagg

SEQ ID NO: 384746 - RNA, 32 nt, Human
ccuuucaggaagguggagcugcauugguuuga

SEQ ID NO: 384747 - RNA, 32 nt, Human
ccuuucaggauggaggaaugugggcaguuuga

SEQ ID NO: 384748 - RNA, 32 nt, Human
ccuuucagggccugugaggaugcccaugagcu

SEQ ID NO: 384749 - RNA, 32 nt, Human
ccuuucaucagagcccaggagggaaggcagga

SEQ ID NO: 384750 - RNA, 20 nt, Human
ccuuucauccuaugcagcuu

SEQ ID NO: 384751 - RNA, 32 nt, Human
ccuuucaucuuucuccccgcuuccccagucuu

SEQ ID NO: 384752 - RNA, 19 nt, Human
ccuuucaugcuagcaggaa

SEQ ID NO: 384753 - RNA, 32 nt, Human
ccuuucaugcuguuuguugccugcuuguugca

SEQ ID NO: 384754 - RNA, 32 nt, Human
ccuuucauguauauuuccacauuuuugugcuu

SEQ ID NO: 384755 - RNA, 32 nt, Human
ccuuuccaaauuugguccuauggauguugagc

SEQ ID NO: 384756 - RNA, 32 nt, Human
ccuuuccaacagcaucucucugucgaagaaag

SEQ ID NO: 384757 - RNA, 32 nt, Human
ccuuuccacagcuguuagcagcaucugcccca

SEQ ID NO: 384758 - RNA, 32 nt, Human
ccuuuccaccacauuccccaaccaaggacagu

SEQ ID NO: 384759 - RNA, 32 nt, Human
ccuuuccaccucggcagggagggaaggagggg

SEQ ID NO: 384760 - RNA, 32 nt, Human
ccuuuccaccucucacccauugcccaccauua

SEQ ID NO: 384761 - RNA, 32 nt, Human
ccuuuccacgcccuccagccccgggggagaua

SEQ ID NO: 384762 - RNA, 32 nt, Human
ccuuuccacucuaauggauaguguacauucuu

SEQ ID NO: 384763 - RNA, 32 nt, Human
ccuuuccagacggcacagggaaaugcaucuuc

SEQ ID NO: 384764 - RNA, 32 nt, Human
ccuuuccagacuccagggcuccccgggcugcu

SEQ ID NO: 384765 - RNA, 32 nt, Human
ccuuuccagagcaaccagaaggagguuauacc

SEQ ID NO: 384766 - RNA, 32 nt, Human
ccuuuccagcagcugcagcugccguuucucuc

SEQ ID NO: 384767 - RNA, 32 nt, Human
ccuuuccaggcagggccagcauguguagaaua

SEQ ID NO: 384768 - RNA, 32 nt, Human
ccuuuccagggaguggcucuguucaucuuauu

SEQ ID NO: 384769 - RNA, 32 nt, Human
ccuuuccagugcuguggcauucuguggcagcu

SEQ ID NO: 384770 - RNA, 32 nt, Human
ccuuuccaucaaggaggcguccuucucagaca

SEQ ID NO: 384771 - RNA, 32 nt, Human
ccuuucccaauuagacuuccucuccuuccacc

SEQ ID NO: 384772 - RNA, 32 nt, Human
ccuuucccaccaccccacaggcuuuacccuuu

SEQ ID NO: 384773 - RNA, 32 nt, Human
ccuuucccacccgucgggcuccuggguucccg

SEQ ID NO: 384774 - RNA, 18 nt, Human
ccuuucccagagccccug

SEQ ID NO: 384775 - RNA, 32 nt, Human
ccuuucccaggcaaucccuccugugcugaacu

SEQ ID NO: 384776 - RNA, 32 nt, Human
ccuuucccaguaaagaagguaaagaagauaua

SEQ ID NO: 384777 - RNA, 32 nt, Human
ccuuuccccaagaagcugugggagacagauga

SEQ ID NO: 384778 - RNA, 32 nt, Human
ccuuuccccagccucagcccugagcggcauaa

SEQ ID NO: 384779 - RNA, 32 nt, Human
ccuuuccccagccucuccuccuugggcagggu

SEQ ID NO: 384780 - RNA, 32 nt, Human
ccuuucccccacccuguccaguuucccuguca

SEQ ID NO: 384781 - RNA, 21 nt, Human
ccuuucccccucucccuuucc

SEQ ID NO: 384782 - RNA, 32 nt, Human
ccuuucccccuucagaauccugucucgccucg

SEQ ID NO: 384783 - RNA, 18 nt, Human
ccuuuccccucccuuccc

SEQ ID NO: 384784 - RNA, 32 nt, Human
ccuuuccccugcccuuguccugaugccucaag

SEQ ID NO: 384785 - RNA, 32 nt, Human
ccuuuccccugccuugcugcugccgcacacuu

SEQ ID NO: 384786 - RNA, 32 nt, Human
ccuuuccccuucucccccucccccucccccac

SEQ ID NO: 384787 - RNA, 32 nt, Human
ccuuuccccuugcuucuuucugaggccauaua

SEQ ID NO: 384788 - RNA, 32 nt, Human
ccuuucccgccuggaaacuuccggacaagccu

SEQ ID NO: 384789 - RNA, 32 nt, Human
ccuuucccgcucuucuugcccacccggccggc

SEQ ID NO: 384790 - RNA, 32 nt, Human
ccuuucccucauucccucucuuggagcagcag

SEQ ID NO: 384791 - RNA, 32 nt, Human
ccuuucccuccaccuccuccaggaaccauguu

SEQ ID NO: 384792 - RNA, 21 nt, Human
ccuuucccucccucccuuccc

SEQ ID NO: 384793 - RNA, 32 nt, Human
ccuuucccucugucuucucuucauuaccuuuu

SEQ ID NO: 384794 - RNA, 32 nt, Human
ccuuucccugacugucaaggacaacugacucc

SEQ ID NO: 384795 - RNA, 32 nt, Human
ccuuucccugcagagcaugguuuguauaccac

SEQ ID NO: 384796 - RNA, 32 nt, Human
ccuuucccugcaggaguguggucuauauucuu

SEQ ID NO: 384797 - RNA, 21 nt, Human
ccuuucccugucccagcccca

SEQ ID NO: 384798 - RNA, 32 nt, Human
ccuuucccuuccccucuccagcccuuuucucc

SEQ ID NO: 384799 - RNA, 32 nt, Human
ccuuucccuuguccaagguccuucuagcucua

SEQ ID NO: 384800 - RNA, 20 nt, Human
ccuuucccuuuccccuuccc

SEQ ID NO: 384801 - RNA, 32 nt, Human
ccuuucccuuucccugggguccaaaccacaug

SEQ ID NO: 384802 - RNA, 32 nt, Human
ccuuuccgaagcuguggucccuuggggcugag

SEQ ID NO: 384803 - RNA, 32 nt, Human
ccuuuccgggucuggaugcugccgcucaggag

SEQ ID NO: 384804 - RNA, 32 nt, Human
ccuuuccuaccaauuuccucccccuccucacu

SEQ ID NO: 384805 - RNA, 23 nt, Human
ccuuuccuagccucagaucuguu

SEQ ID NO: 384806 - RNA, 25 nt, Human
ccuuuccuagcugaugauuuguuca

SEQ ID NO: 384807 - RNA, 32 nt, Human
ccuuuccuagucucauccuccccuggcugcag

SEQ ID NO: 384808 - RNA, 32 nt, Human
ccuuuccuaucuucacaccugccaccucaugu

SEQ ID NO: 384809 - RNA, 22 nt, Human
ccuuuccuauuguaaucauuca

SEQ ID NO: 384810 - RNA, 32 nt, Human
ccuuuccuauuucccuuccugcugugucaucc

SEQ ID NO: 384811 - RNA, 32 nt, Human
ccuuuccuccaauggugaaaugaucaaaagug

SEQ ID NO: 384812 - RNA, 32 nt, Human
ccuuuccuccacuucuccaguaacauauuccu

SEQ ID NO: 384813 - RNA, 32 nt, Human
ccuuuccuccagggcccagucuggcucccgag

SEQ ID NO: 384814 - RNA, 21 nt, Human
ccuuuccucuccccacugccu

SEQ ID NO: 384815 - RNA, 20 nt, Human
ccuuuccucucuccccuccc

SEQ ID NO: 384816 - RNA, 32 nt, Human
ccuuuccucucuccuguuucccuucccuucca

SEQ ID NO: 384817 - RNA, 32 nt, Human
ccuuuccucucuccuguuuuccuuccucugcu

SEQ ID NO: 384818 - RNA, 32 nt, Human
ccuuuccucucuguagagugggaagagaugga

SEQ ID NO: 384819 - RNA, 32 nt, Human
ccuuuccucugccuccuccccugccagcccua

SEQ ID NO: 384820 - RNA, 32 nt, Human
ccuuuccucuuccaucucucugucaccucccu

SEQ ID NO: 384821 - RNA, 32 nt, Human
ccuuuccugaccauuccucgugccccauucuc

SEQ ID NO: 384822 - RNA, 32 nt, Human
ccuuuccugaugucuccucccuugucuuauug

SEQ ID NO: 384823 - RNA, 32 nt, Human
ccuuuccugcccugccuuucggugcaaccaug

SEQ ID NO: 384824 - RNA, 32 nt, Human
ccuuuccugccucugugccccugccucucccu

SEQ ID NO: 384825 - RNA, 32 nt, Human
ccuuuccugcgccccagacuccaggccgccug

SEQ ID NO: 384826 - RNA, 32 nt, Human
ccuuuccuggacugcucucuccagaaacagca

SEQ ID NO: 384827 - RNA, 32 nt, Human
ccuuuccuggcagggcugguggagucuucccu

SEQ ID NO: 384828 - RNA, 32 nt, Human
ccuuuccuggcucccucuguuuucucucacug

SEQ ID NO: 384829 - RNA, 32 nt, Human
ccuuuccuggcuucauggugcucaucauacug

SEQ ID NO: 384830 - RNA, 32 nt, Human
ccuuuccuggcuucggacauuggagcacuaaa

SEQ ID NO: 384831 - RNA, 32 nt, Human
ccuuuccuguaaccugcacuuugggaugguag

SEQ ID NO: 384832 - RNA, 32 nt, Human
ccuuuccugugagucuuucucagaauugauau

SEQ ID NO: 384833 - RNA, 24 nt, Human
ccuuuccuguguguacucugucca

SEQ ID NO: 384834 - RNA, 32 nt, Human
ccuuuccuguuacccucuccccacauguacca

SEQ ID NO: 384835 - RNA, 32 nt, Human
ccuuuccuuaucuacauuagcuuagacuauac

SEQ ID NO: 384836 - RNA, 32 nt, Human
ccuuuccuucaucaucacucccugcauucuua

SEQ ID NO: 384837 - RNA, 32 nt, Human
ccuuuccuuccagauccuggguacugaaagcc

SEQ ID NO: 384838 - RNA, 32 nt, Human
ccuuuccuuuaugaaccuccauccucccagcc

SEQ ID NO: 384839 - RNA, 32 nt, Human
ccuuuccuuuccugacuuaugccuguaguuuu

SEQ ID NO: 384840 - RNA, 32 nt, Human
ccuuuccuuuccuucuucccuaccuccccuuu

SEQ ID NO: 384841 - RNA, 32 nt, Human
ccuuuccuuucuccagcuucugcucugcccca

SEQ ID NO: 384842 - RNA, 32 nt, Human
ccuuuccuuuuuccuuuccuuuccuuucuuuc

SEQ ID NO: 384843 - RNA, 25 nt, Human
ccuuucgaauuuuaugauuuuuuca

SEQ ID NO: 384844 - RNA, 22 nt, Human
ccuuucgacccacccauucuca

SEQ ID NO: 384845 - RNA, 32 nt, Human
ccuuucgacccacccauucucaccaccuguuu

SEQ ID NO: 384846 - RNA, 32 nt, Human
ccuuucgaguagcuggaaugacuacaggcaug

SEQ ID NO: 384847 - RNA, 32 nt, Human
ccuuucgaguagcugggacuacaggugugugc

SEQ ID NO: 384848 - RNA, 32 nt, Human
ccuuucgggaggcugagacaggagaaucgcuu

SEQ ID NO: 384849 - RNA, 32 nt, Human
ccuuucgguuacuaagcucugccuucuugacu

SEQ ID NO: 384850 - RNA, 32 nt, Human
ccuuucguccccgucgucuccucugccgccgu

SEQ ID NO: 384851 - RNA, 32 nt, Human
ccuuucgucuuccucuuuccucuguggaagau

SEQ ID NO: 384852 - RNA, 32 nt, Human
ccuuucguggcagucuaaccucaggccauucu

SEQ ID NO: 384853 - RNA, 32 nt, Human
ccuuucuaaacccaguuaagcauggaagagag

SEQ ID NO: 384854 - RNA, 32 nt, Human
ccuuucuaacuggauccagccuguuggagggg

SEQ ID NO: 384855 - RNA, 32 nt, Human
ccuuucuaagauacuccuccagccgggcgcgg

SEQ ID NO: 384856 - RNA, 32 nt, Human
ccuuucuaagccauugggaauagaauggcccc

SEQ ID NO: 384857 - RNA, 32 nt, Human
ccuuucuaaggguuggagcugcuccuugcagg

SEQ ID NO: 384858 - RNA, 32 nt, Human
ccuuucuaccugugaucaacacaugccuaucu

SEQ ID NO: 384859 - RNA, 32 nt, Human
ccuuucuacuuaucuauuuugugaauucuaaa

SEQ ID NO: 384860 - RNA, 32 nt, Human
ccuuucuacuucucaaucugauuucuaugagg

SEQ ID NO: 384861 - RNA, 32 nt, Human
ccuuucuagccgcugucccaaggguuggucuc

SEQ ID NO: 384862 - RNA, 22 nt, Human
ccuuucuaggacaggagccgcu

SEQ ID NO: 384863 - RNA, 32 nt, Human
ccuuucuauauacugcugaucuugcaugucua

SEQ ID NO: 384864 - RNA, 31 nt, Human
ccuuucucaauaaauucaucugcgguggaga

SEQ ID NO: 384865 - RNA, 32 nt, Human
ccuuucucauaagaaagggacacuccuacagg

SEQ ID NO: 384866 - RNA, 32 nt, Human
ccuuucucauccucuuugccaugugaggagcc

SEQ ID NO: 384867 - RNA, 32 nt, Human
ccuuucucauuucucccacaccuccuccccau

SEQ ID NO: 384868 - RNA, 32 nt, Human
ccuuucuccacugcacuggagcuuugaagacc

SEQ ID NO: 384869 - RNA, 18 nt, Human
ccuuucuccagcuucugc

SEQ ID NO: 384870 - RNA, 32 nt, Human
ccuuucuccaggugggagugcaguggcaugau

SEQ ID NO: 384871 - RNA, 32 nt, Human
ccuuucuccaguuugugcuggaagaggagcug

SEQ ID NO: 384872 - RNA, 18 nt, Human
ccuuucuccaucauccuu

SEQ ID NO: 384873 - RNA, 32 nt, Human
ccuuucuccaucuucaagagugacaccucuuc

SEQ ID NO: 384874 - RNA, 32 nt, Human
ccuuucuccccacuucuucuggcuccucauuu

SEQ ID NO: 384875 - RNA, 32 nt, Human
ccuuucuccccaugccugccuucugcucccuc

SEQ ID NO: 384876 - RNA, 32 nt, Human
ccuuucuccgugugaccuaaagccacucaaug

SEQ ID NO: 384877 - RNA, 32 nt, Human
ccuuucuccuaccaggagaguacuguggcuua

SEQ ID NO: 384878 - RNA, 32 nt, Human
ccuuucuccuagagaucugugccuccuggcga

SEQ ID NO: 384879 - RNA, 32 nt, Human
ccuuucuccuucuccccuccuucuuuuucaga

SEQ ID NO: 384880 - RNA, 32 nt, Human
ccuuucucguuccccggccaucuuagcggcug

SEQ ID NO: 384881 - RNA, 32 nt, Human
ccuuucucuacccccucgcuguugugugugug

SEQ ID NO: 384882 - RNA, 25 nt, Human
ccuuucucucaccccuggagccccg

SEQ ID NO: 384883 - RNA, 32 nt, Human
ccuuucucuccucagcagaacaugucucuccu

SEQ ID NO: 384884 - RNA, 32 nt, Human
ccuuucucuccucagucccugcuccucauguu

SEQ ID NO: 384885 - RNA, 32 nt, Human
ccuuucucuccucccaugcugaguuucaugau

SEQ ID NO: 384886 - RNA, 32 nt, Human
ccuuucucuccucucuccuuuucuagccuguu

SEQ ID NO: 384887 - RNA, 32 nt, Human
ccuuucucucuucccuuccccucucucauugc

SEQ ID NO: 384888 - RNA, 32 nt, Human
ccuuucucugcaggcaucuguuuguuuguguc

SEQ ID NO: 384889 - RNA, 32 nt, Human
ccuuucucugccaucgugguguguucuugacu

SEQ ID NO: 384890 - RNA, 32 nt, Human
ccuuucucugccugcccugcccuuggggccac

SEQ ID NO: 384891 - RNA, 24 nt, Human
ccuuucucugccuucugagcaccg

SEQ ID NO: 384892 - RNA, 32 nt, Human
ccuuucucugucuccaacacucuuuccccaug

SEQ ID NO: 384893 - RNA, 32 nt, Human
ccuuucucugucuuucucuucauuccaucccc

SEQ ID NO: 384894 - RNA, 19 nt, Human
ccuuucucuguggcaguga

SEQ ID NO: 384895 - RNA, 32 nt, Human
ccuuucucuguucuucagcagaaggcagggug

SEQ ID NO: 384896 - RNA, 32 nt, Human
ccuuucucuuccugcugaccacaagcucugug

SEQ ID NO: 384897 - RNA, 32 nt, Human
ccuuucucuuuuucucuuucucucucccuuuc

SEQ ID NO: 384898 - RNA, 32 nt, Human
ccuuucugaacaaacgcagcaaagcaagccac

SEQ ID NO: 384899 - RNA, 32 nt, Human
ccuuucugaccagcaggccuggagggcagggg

SEQ ID NO: 384900 - RNA, 32 nt, Human
ccuuucugagcuccagccccagccccucgaac

SEQ ID NO: 384901 - RNA, 32 nt, Human
ccuuucugcacuccgugggcccugggugcgcu

SEQ ID NO: 384902 - RNA, 32 nt, Human
ccuuucugcacugcaacugugugauugaaaaa

SEQ ID NO: 384903 - RNA, 32 nt, Human
ccuuucugcccaguggaugugagcuucugaag

SEQ ID NO: 384904 - RNA, 32 nt, Human
ccuuucugcgcccgcgggcaccaugagcagcc

SEQ ID NO: 384905 - RNA, 32 nt, Human
ccuuucugcugauuugcuggaagcacuacaag

SEQ ID NO: 384906 - RNA, 32 nt, Human
ccuuucugcugcccucuucaugcaggccuacu

SEQ ID NO: 384907 - RNA, 32 nt, Human
ccuuucugcuucugaaguaugaaaaucuaguc

SEQ ID NO: 384908 - RNA, 32 nt, Human
ccuuucuggaccagauccuacucuuccuuucu

SEQ ID NO: 384909 - RNA, 32 nt, Human
ccuuucugggagggcggggugggggugacuga

SEQ ID NO: 384910 - RNA, 32 nt, Human
ccuuucugggcuggccaaggccagagcaggcu

SEQ ID NO: 384911 - RNA, 32 nt, Human
ccuuucuggggagugaggaaugugggagagag

SEQ ID NO: 384912 - RNA, 32 nt, Human
ccuuucugguccugcugcucccuaugggaugu

SEQ ID NO: 384913 - RNA, 25 nt, Human
ccuuucugucacccagguuagagua

SEQ ID NO: 384914 - RNA, 32 nt, Human
ccuuucuguccugguucccugaagcaucgaga

SEQ ID NO: 384915 - RNA, 31 nt, Human
ccuuucugucucucugggcuguggcugggca

SEQ ID NO: 384916 - RNA, 32 nt, Human
ccuuucugucucugcugagcuguggcugcggu

SEQ ID NO: 384917 - RNA, 32 nt, Human
ccuuucugugagauuuuuccaacaagcaugug

SEQ ID NO: 384918 - RNA, 32 nt, Human
ccuuucugugccuugcccuuugcccacucccc

SEQ ID NO: 384919 - RNA, 32 nt, Human
ccuuucuguguccuacuccuugcaggugacau

SEQ ID NO: 384920 - RNA, 32 nt, Human
ccuuucuguucaaggcuguuugucuacccaga

SEQ ID NO: 384921 - RNA, 32 nt, Human
ccuuucuguuuuccucaccuugcugcuccccu

SEQ ID NO: 384922 - RNA, 32 nt, Human
ccuuucuuaccucucuggccccgucggcauuu

SEQ ID NO: 384923 - RNA, 32 nt, Human
ccuuucuucccauagcuuccagccuggugggg

SEQ ID NO: 384924 - RNA, 32 nt, Human
ccuuucuuccccacccuggaggcucucucugc

SEQ ID NO: 384925 - RNA, 32 nt, Human
ccuuucuucucccacaucugcccacugaagau

SEQ ID NO: 384926 - RNA, 32 nt, Human
ccuuucuucuucucugccucuccugccucucg

SEQ ID NO: 384927 - RNA, 32 nt, Human
ccuuucuucuucuucuucuuccucuuccauag

SEQ ID NO: 384928 - RNA, 32 nt, Human
ccuuucuucuuuccuuauucaucccagaguaa

SEQ ID NO: 384929 - RNA, 32 nt, Human
ccuuucuucuuugucuuauuucugccuucauc

SEQ ID NO: 384930 - RNA, 22 nt, Human
ccuuucuugacucugagugcug

SEQ ID NO: 384931 - RNA, 32 nt, Human
ccuuucuuguaauaaaugauaaaauuccgagu

SEQ ID NO: 384932 - RNA, 32 nt, Human
ccuuucuuguaccucagcacuccuggggguca

SEQ ID NO: 384933 - RNA, 32 nt, Human
ccuuucuugugaccaucuccccaugaaagugc

SEQ ID NO: 384934 - RNA, 32 nt, Human
ccuuucuuucccuaacgaagugagugaugaga

SEQ ID NO: 384935 - RNA, 32 nt, Human
ccuuucuuucccucccugcagcucugagggag

SEQ ID NO: 384936 - RNA, 32 nt, Human
ccuuucuuucucugucucuuccuuccuuuuag

SEQ ID NO: 384937 - RNA, 32 nt, Human
ccuuucuuucugcuuuuuauuuauuuugccuu

SEQ ID NO: 384938 - RNA, 32 nt, Human
ccuuucuuucuugagccaacauuuuguacuuc

SEQ ID NO: 384939 - RNA, 32 nt, Human
ccuuucuuucuuucucucucugauugagaggc

SEQ ID NO: 384940 - RNA, 32 nt, Human
ccuuucuuugcaacuucccagcaacaauaaug

SEQ ID NO: 384941 - RNA, 32 nt, Human
ccuuucuuugccauaaaacugccaucacacag

SEQ ID NO: 384942 - RNA, 32 nt, Human
ccuuugaacacaucuucuugcugaacauuaug

SEQ ID NO: 384943 - RNA, 32 nt, Human
ccuuugaacccccuuccugcccuguguuagga

SEQ ID NO: 384944 - RNA, 32 nt, Human
ccuuugaagagagguucugauucuacuuccac

SEQ ID NO: 384945 - RNA, 32 nt, Human
ccuuugaagaucucaguagcugagggagaugg

SEQ ID NO: 384946 - RNA, 32 nt, Human
ccuuugaauguagcaacugugguaaggccuuc

SEQ ID NO: 384947 - RNA, 18 nt, Human
ccuuugacaauuuacuua

SEQ ID NO: 384948 - RNA, 18 nt, Human
ccuuugacaccucugcau

SEQ ID NO: 384949 - RNA, 18 nt, Human
ccuuugacaccugugcau

SEQ ID NO: 384950 - RNA, 32 nt, Human
ccuuugacacuacccuccaaucuugcaacacu

SEQ ID NO: 384951 - RNA, 32 nt, Human
ccuuugacagcugaauguuccuaaagaacugc

SEQ ID NO: 384952 - RNA, 32 nt, Human
ccuuugacauuaugucaguccugagagucugg

SEQ ID NO: 384953 - RNA, 21 nt, Human
ccuuugaccaacaugguacua

SEQ ID NO: 384954 - RNA, 21 nt, Human
ccuuugaccagaacugcaaca

SEQ ID NO: 384955 - RNA, 32 nt, Human
ccuuugaccccaccuuguggaaacccagcugu

SEQ ID NO: 384956 - RNA, 32 nt, Human
ccuuugaccccuggugugaucuugggcccggg

SEQ ID NO: 384957 - RNA, 32 nt, Human
ccuuugacccugcuuauuugucucacugguua

SEQ ID NO: 384958 - RNA, 32 nt, Human
ccuuugaccgagguccugcagguggacaagau

SEQ ID NO: 384959 - RNA, 32 nt, Human
ccuuugaccucaccaggccucaugcuucccuu

SEQ ID NO: 384960 - RNA, 32 nt, Human
ccuuugacugguuuucuucuucauccugagaa

SEQ ID NO: 384961 - RNA, 27 nt, Human
ccuuugacuuccccuuccugggaucug

SEQ ID NO: 384962 - RNA, 32 nt, Human
ccuuugacuucuacagaaaucugggccugaga

SEQ ID NO: 384963 - RNA, 32 nt, Human
ccuuugagaaaagcuugggacgauuucugggg

SEQ ID NO: 384964 - RNA, 32 nt, Human
ccuuugagagugaagguggguggaguugacca

SEQ ID NO: 384965 - RNA, 32 nt, Human
ccuuugagauugcauuaaagagaagggauaaa

SEQ ID NO: 384966 - RNA, 32 nt, Human
ccuuugaggaagggagaggaggugaaugaacu

SEQ ID NO: 384967 - RNA, 32 nt, Human
ccuuugaggagagauggggacagggcaguggg

SEQ ID NO: 384968 - RNA, 32 nt, Human
ccuuugaggccugguaaccauuccaggugaug

SEQ ID NO: 384969 - RNA, 32 nt, Human
ccuuugagggcaagacauuuuaagcugggcaa

SEQ ID NO: 384970 - RNA, 32 nt, Human
ccuuugagucaggaaaccagggccaguucuuu

SEQ ID NO: 384971 - RNA, 32 nt, Human
ccuuugagugacuccagcacaggcuaccuagc

SEQ ID NO: 384972 - RNA, 21 nt, Human
ccuuugaguggauuccccaua

SEQ ID NO: 384973 - RNA, 23 nt, Human
ccuuugaguuugcuauuuucuca

SEQ ID NO: 384974 - RNA, 32 nt, Human
ccuuugaucauuuugcaucugugcauagcguu

SEQ ID NO: 384975 - RNA, 32 nt, Human
ccuuugaucucucuucugaauugcagaaauca

SEQ ID NO: 384976 - RNA, 32 nt, Human
ccuuugauggaaaaugcagaggcccuuccucu

SEQ ID NO: 384977 - RNA, 32 nt, Human
ccuuugauuugccucccuaaccuuuucuaggg

SEQ ID NO: 384978 - RNA, 32 nt, Human
ccuuugcaaaccugccuguuggcauauugaag

SEQ ID NO: 384979 - RNA, 32 nt, Human
ccuuugcacugaggacacagaucccggggagc

SEQ ID NO: 384980 - RNA, 32 nt, Human
ccuuugcacugcaacaucaugccucugaagaa

SEQ ID NO: 384981 - RNA, 32 nt, Human
ccuuugcacugcuucugugaacagucuuuguc

SEQ ID NO: 384982 - RNA, 32 nt, Human
ccuuugcacuggcuguuuccucugccuggaac

SEQ ID NO: 384983 - RNA, 32 nt, Human
ccuuugcagagagcaaagaaacguggaaucca

SEQ ID NO: 384984 - RNA, 32 nt, Human
ccuuugcagcagccccgcuaucuugagauuag

SEQ ID NO: 384985 - RNA, 32 nt, Human
ccuuugcagccgcuggccuacccggcccgcgg

SEQ ID NO: 384986 - RNA, 32 nt, Human
ccuuugcagggaggggaggauaagugggaucu

SEQ ID NO: 384987 - RNA, 32 nt, Human
ccuuugcagguagaaugucaagauuugauuau

SEQ ID NO: 384988 - RNA, 32 nt, Human
ccuuugcagugcccuccacccuuccugguguc

SEQ ID NO: 384989 - RNA, 32 nt, Human
ccuuugcaguuugccagccauauucccaugug

SEQ ID NO: 384990 - RNA, 32 nt, Human
ccuuugcauauacucucucaguauuaacuccc

SEQ ID NO: 384991 - RNA, 32 nt, Human
ccuuugcaucccugcacuccuggacgugugcg

SEQ ID NO: 384992 - RNA, 32 nt, Human
ccuuugcauggguuuugggaaagauuaaguca

SEQ ID NO: 384993 - RNA, 32 nt, Human
ccuuugcauguuccaucucuucucuuucuccc

SEQ ID NO: 384994 - RNA, 32 nt, Human
ccuuugcauuucugcaaccucuguucuuucug

SEQ ID NO: 384995 - RNA, 32 nt, Human
ccuuugcauuuuggagaguuuccugaaacaac

SEQ ID NO: 384996 - RNA, 21 nt, Human
ccuuugccacauccccucaca

SEQ ID NO: 384997 - RNA, 32 nt, Human
ccuuugccagacagcucugucuccccaugucc

SEQ ID NO: 384998 - RNA, 32 nt, Human
ccuuugcccagcccugggccuccaaucugcau

SEQ ID NO: 384999 - RNA, 32 nt, Human
ccuuugcccauucugucaggcuggacgggagg

SEQ ID NO: 385000 - RNA, 32 nt, Human
ccuuugccccuccacacugccucgcgccuuuc

SEQ ID NO: 385001 - RNA, 32 nt, Human
ccuuugcccuagagcuagagucaugauagcug

SEQ ID NO: 385002 - RNA, 32 nt, Human
ccuuugcccucagcccuuucuccugggaucuc

SEQ ID NO: 385003 - RNA, 32 nt, Human
ccuuugcccugaugucuccccauugccccuca

SEQ ID NO: 385004 - RNA, 18 nt, Human
ccuuugcccugugaccug

SEQ ID NO: 385005 - RNA, 32 nt, Human
ccuuugccgcccucgucaggcccagcucuccu

SEQ ID NO: 385006 - RNA, 32 nt, Human
ccuuugccuaggaaaaaggaauccaagugugu

SEQ ID NO: 385007 - RNA, 32 nt, Human
ccuuugccucaaagccaucccccaccagacug

SEQ ID NO: 385008 - RNA, 32 nt, Human
ccuuugccuccaccauucccacccacccuccc

SEQ ID NO: 385009 - RNA, 32 nt, Human
ccuuugccucugaaugacccagccuggagucu

SEQ ID NO: 385010 - RNA, 32 nt, Human
ccuuugccugggaacugguccuuguuugccgg

SEQ ID NO: 385011 - RNA, 32 nt, Human
ccuuugccuuacaugaucccauggcccugaau

SEQ ID NO: 385012 - RNA, 32 nt, Human
ccuuugccuuccuucagcaccaaggagaaugg

SEQ ID NO: 385013 - RNA, 32 nt, Human
ccuuugccuucgcagccgccuccagggcaauu

SEQ ID NO: 385014 - RNA, 32 nt, Human
ccuuugccuuucuucugcccuuuccuaggccc

SEQ ID NO: 385015 - RNA, 32 nt, Human
ccuuugcgcugggcugagcccagagccgagag

SEQ ID NO: 385016 - RNA, 18 nt, Human
ccuuugcuacauucccuu

SEQ ID NO: 385017 - RNA, 19 nt, Human
ccuuugcuacccguucccc

SEQ ID NO: 385018 - RNA, 32 nt, Human
ccuuugcuauugagccaacaucaggaauaauu

SEQ ID NO: 385019 - RNA, 18 nt, Human
ccuuugcucaaugcugga

SEQ ID NO: 385020 - RNA, 32 nt, Human
ccuuugcucaguugccccaggaaggcuucccu

SEQ ID NO: 385021 - RNA, 32 nt, Human
ccuuugcucccccuuauccuccuuccucuucc

SEQ ID NO: 385022 - RNA, 32 nt, Human
ccuuugcucugggcuuccugagcaccagcagu

SEQ ID NO: 385023 - RNA, 32 nt, Human
ccuuugcucuuuucagggaaaauaacaaccac

SEQ ID NO: 385024 - RNA, 32 nt, Human
ccuuugcugacgcccagagcucuggcugcagg

SEQ ID NO: 385025 - RNA, 32 nt, Human
ccuuugcugcugcugccagccauucugacucc

SEQ ID NO: 385026 - RNA, 32 nt, Human
ccuuugcugggccucuggauggcccugcccug

SEQ ID NO: 385027 - RNA, 32 nt, Human
ccuuugcuggggacaaugcccucaagucaugu

SEQ ID NO: 385028 - RNA, 32 nt, Human
ccuuugcugucugaggggccucagcucugacc

SEQ ID NO: 385029 - RNA, 32 nt, Human
ccuuugcugugacacuucuucaucucaccccc

SEQ ID NO: 385030 - RNA, 32 nt, Human
ccuuugcuuccagaguucaagcuauucuccug

SEQ ID NO: 385031 - RNA, 32 nt, Human
ccuuugcuuccagguggcaggauuacuacuuu

SEQ ID NO: 385032 - RNA, 32 nt, Human
ccuuugcuuggacuccaagucuccucucuggg

SEQ ID NO: 385033 - RNA, 32 nt, Human
ccuuugcuuggcacuucuuccugcugccaugu

SEQ ID NO: 385034 - RNA, 32 nt, Human
ccuuugcuuucccuuucugcucccucucuuuc

SEQ ID NO: 385035 - RNA, 32 nt, Human
ccuuugcuuucucuacccuccugggcugggcu

SEQ ID NO: 385036 - RNA, 32 nt, Human
ccuuugcuuugcuagugcugcuuuguguguau

SEQ ID NO: 385037 - RNA, 32 nt, Human
ccuuuggaaaaauaugugacaagugaauguaa

SEQ ID NO: 385038 - RNA, 32 nt, Human
ccuuuggaaaacuugugaacaugugaauacac

SEQ ID NO: 385039 - RNA, 32 nt, Human
ccuuuggaaggugagagcagggcccugagaaa

SEQ ID NO: 385040 - RNA, 22 nt, Human
ccuuuggacacuggagcucaga

SEQ ID NO: 385041 - RNA, 22 nt, Human
ccuuuggacauacaugcuacag

SEQ ID NO: 385042 - RNA, 32 nt, Human
ccuuuggacauacaugcuacagucccacaaug

SEQ ID NO: 385043 - RNA, 32 nt, Human
ccuuuggagaggggagugcagggcaccaccug

SEQ ID NO: 385044 - RNA, 22 nt, Human
ccuuuggagccggcagcccagg

SEQ ID NO: 385045 - RNA, 32 nt, Human
ccuuuggagcucgcuuuaccucuggcuacuuc

SEQ ID NO: 385046 - RNA, 32 nt, Human
ccuuuggaggaggaggaggaggaggagagggg

SEQ ID NO: 385047 - RNA, 32 nt, Human
ccuuuggagguggagaugguggaggugguggu

SEQ ID NO: 385048 - RNA, 32 nt, Human
ccuuuggauucaacauugugucuggaaaggca

SEQ ID NO: 385049 - RNA, 32 nt, Human
ccuuuggauuccuuaucuuuggcuccaccuua

SEQ ID NO: 385050 - RNA, 24 nt, Human
ccuuuggcaaaaaauauuuccaca

SEQ ID NO: 385051 - RNA, 32 nt, Human
ccuuuggcaaaacucgaauguuugguuagcaa

SEQ ID NO: 385052 - RNA, 32 nt, Human
ccuuuggcaaagcccccauccacaccuggcac

SEQ ID NO: 385053 - RNA, 23 nt, Human
ccuuuggcagagggaccccagca

SEQ ID NO: 385054 - RNA, 32 nt, Human
ccuuuggcauuuucccaggcccucgguaaaag

SEQ ID NO: 385055 - RNA, 32 nt, Human
ccuuuggccacauccaccucgaggggacccug

SEQ ID NO: 385056 - RNA, 22 nt, Human
ccuuuggccaugauucucaaca

SEQ ID NO: 385057 - RNA, 32 nt, Human
ccuuuggccucaucgcugaccugggccgucag

SEQ ID NO: 385058 - RNA, 32 nt, Human
ccuuuggccuccagcuugucccucucucacuu

SEQ ID NO: 385059 - RNA, 27 nt, Human
ccuuuggccucggaggcucgggaccua

SEQ ID NO: 385060 - RNA, 32 nt, Human
ccuuuggccugggagguccaggcugcaaugag

SEQ ID NO: 385061 - RNA, 32 nt, Human
ccuuuggccuuccucucuacauuuaagaguag

SEQ ID NO: 385062 - RNA, 32 nt, Human
ccuuuggccuugugguuccucaggagagguug

SEQ ID NO: 385063 - RNA, 32 nt, Human
ccuuuggcgauguucuggacauggcugaagau

SEQ ID NO: 385064 - RNA, 32 nt, Human
ccuuuggcuuagugacuuugaggucccaagau

SEQ ID NO: 385065 - RNA, 22 nt, Human
ccuuuggcuucacacucgccug

SEQ ID NO: 385066 - RNA, 32 nt, Human
ccuuugggaagaaaugucuucuguaaaaagaa

SEQ ID NO: 385067 - RNA, 32 nt, Human
ccuuugggaagaauuccucuccagaccuggca

SEQ ID NO: 385068 - RNA, 19 nt, Human
ccuuugggaccuccuugua

SEQ ID NO: 385069 - RNA, 21 nt, Human
ccuuugggaggcagcaucagg

SEQ ID NO: 385070 - RNA, 32 nt, Human
ccuuugggaugugggcagggagggaagcaggc

SEQ ID NO: 385071 - RNA, 30 nt, Human
ccuuugggccucucccugcuccucucggcc

SEQ ID NO: 385072 - RNA, 32 nt, Human
ccuuugggccuggggcugugcuuggcuugaaa

SEQ ID NO: 385073 - RNA, 26 nt, Human
ccuuugggcgccucacccgggaucua

SEQ ID NO: 385074 - RNA, 32 nt, Human
ccuuugggcucagugaagagucuggaguuuau

SEQ ID NO: 385075 - RNA, 32 nt, Human
ccuuugggcugcagaaacuccgcugagcagaa

SEQ ID NO: 385076 - RNA, 32 nt, Human
ccuuuggggagggagagacagacgggcgguuu

SEQ ID NO: 385077 - RNA, 25 nt, Human
ccuuuggggggccacccggggccug

SEQ ID NO: 385078 - RNA, 32 nt, Human
ccuuugggguucgaaguggcccuggagccagc

SEQ ID NO: 385079 - RNA, 32 nt, Human
ccuuuggguucugcauguguuccuggcagcug

SEQ ID NO: 385080 - RNA, 32 nt, Human
ccuuugguaccaagcccacccuugggguuccu

SEQ ID NO: 385081 - RNA, 32 nt, Human
ccuuuggucaaucauaacaugcuguuuaaagc

SEQ ID NO: 385082 - RNA, 32 nt, Human
ccuuugguguggaggugcuggcauucagucug

SEQ ID NO: 385083 - RNA, 32 nt, Human
ccuuugguuaaaggagcugccgucagguggga

SEQ ID NO: 385084 - RNA, 32 nt, Human
ccuuugguuauauggccaguucuuucuuaauu

SEQ ID NO: 385085 - RNA, 32 nt, Human
ccuuugguugagaguuguggauccaagucuca

SEQ ID NO: 385086 - RNA, 32 nt, Human
ccuuuguaacacccuccuucaaagguugggag

SEQ ID NO: 385087 - RNA, 32 nt, Human
ccuuuguaauaccuuuaaaaauccagaguauu

SEQ ID NO: 385088 - RNA, 32 nt, Human
ccuuuguacuuuuccaagcucaggucuuuauu

SEQ ID NO: 385089 - RNA, 32 nt, Human
ccuuuguaguccuucagccacugugggcccug

SEQ ID NO: 385090 - RNA, 32 nt, Human
ccuuuguaugacagacccauguauuuuuggca

SEQ ID NO: 385091 - RNA, 32 nt, Human
ccuuugucacccaggccggagugcaguggcau

SEQ ID NO: 385092 - RNA, 32 nt, Human
ccuuugucacuagucuuugaggagguuugcuc

SEQ ID NO: 385093 - RNA, 32 nt, Human
ccuuugucagccaggcuggagugcaaugugca

SEQ ID NO: 385094 - RNA, 32 nt, Human
ccuuugucauucuagcugccugcugccuccgc

SEQ ID NO: 385095 - RNA, 32 nt, Human
ccuuuguccaucucagcccccagaguauaucu

SEQ ID NO: 385096 - RNA, 23 nt, Human
ccuuuguccccaccgcagacagg

SEQ ID NO: 385097 - RNA, 32 nt, Human
ccuuuguccuggcuccguagcagaacacugua

SEQ ID NO: 385098 - RNA, 24 nt, Human
ccuuuguccuucccuuggggcuug

SEQ ID NO: 385099 - RNA, 23 nt, Human
ccuuugucgcccaggcuggagug

SEQ ID NO: 385100 - RNA, 32 nt, Human
ccuuugucgcccaggcuggagugcaauggcgu

SEQ ID NO: 385101 - RNA, 32 nt, Human
ccuuugucucacucccuguagccccgucacgu

SEQ ID NO: 385102 - RNA, 32 nt, Human
ccuuugucucagagaagcaggagauguugaug

SEQ ID NO: 385103 - RNA, 32 nt, Human
ccuuugucuccucuuccccaucuaugucccuu

SEQ ID NO: 385104 - RNA, 32 nt, Human
ccuuugucuggaugcacucuucugaccuugcu

SEQ ID NO: 385105 - RNA, 32 nt, Human
ccuuugugaagguuuuuaucuguguagaaugg

SEQ ID NO: 385106 - RNA, 32 nt, Human
ccuuugugcagggacaguuggcuuccagaggu

SEQ ID NO: 385107 - RNA, 32 nt, Human
ccuuugugccuuaaaugcauguugaggacuuu

SEQ ID NO: 385108 - RNA, 32 nt, Human
ccuuugugcgguuccuggaggacaacgucugc

SEQ ID NO: 385109 - RNA, 32 nt, Human
ccuuugugcuuugcacaaaccugaauccccca

SEQ ID NO: 385110 - RNA, 32 nt, Human
ccuuuguggaaacuguuucagcaaagguucuu

SEQ ID NO: 385111 - RNA, 18 nt, Human
ccuuuguggcucacggcc

SEQ ID NO: 385112 - RNA, 32 nt, Human
ccuuuguggucuucugugauuauuuaugcugc

SEQ ID NO: 385113 - RNA, 32 nt, Human
ccuuuguguccaguagugggguccaccggagg

SEQ ID NO: 385114 - RNA, 32 nt, Human
ccuuuguguguccugcucacauugucuccagg

SEQ ID NO: 385115 - RNA, 32 nt, Human
ccuuuguguuucccccagugcuggcagccuag

SEQ ID NO: 385116 - RNA, 32 nt, Human
ccuuuguuaucuagcugaaaacaaaugacaac

SEQ ID NO: 385117 - RNA, 32 nt, Human
ccuuuguucagaaauggccacuguagaaagcc

SEQ ID NO: 385118 - RNA, 32 nt, Human
ccuuuguuccagccugguuuccugggcugggc

SEQ ID NO: 385119 - RNA, 32 nt, Human
ccuuuguuccuuuguuccuuccuuccuucuuu

SEQ ID NO: 385120 - RNA, 32 nt, Human
ccuuuguucugaggccuuuagccucugaauga

SEQ ID NO: 385121 - RNA, 32 nt, Human
ccuuuguucugcauucagcagcuauuuaucga

SEQ ID NO: 385122 - RNA, 32 nt, Human
ccuuuguucuuuuccugccacagggucuuugc

SEQ ID NO: 385123 - RNA, 32 nt, Human
ccuuuguugcuggcccgccucucuggaccuug

SEQ ID NO: 385124 - RNA, 24 nt, Human
ccuuuguugugaaggcgccggggc

SEQ ID NO: 385125 - RNA, 32 nt, Human
ccuuuguuuacaagaugacuaauucuagaauc

SEQ ID NO: 385126 - RNA, 32 nt, Human
ccuuuguuucauaaaguaaaugcauaguuggu

SEQ ID NO: 385127 - RNA, 32 nt, Human
ccuuuguuucauuucaccucagcacguaccau

SEQ ID NO: 385128 - RNA, 32 nt, Human
ccuuuguuuccaccauccauccaaccuggcuc

SEQ ID NO: 385129 - RNA, 32 nt, Human
ccuuuguuugagagucagccagccugcucagg

SEQ ID NO: 385130 - RNA, 32 nt, Human
ccuuuuaacuaccuuucuuugcuccaagugaa

SEQ ID NO: 385131 - RNA, 32 nt, Human
ccuuuuaaggagaaaaucuaaaaugaaaagug

SEQ ID NO: 385132 - RNA, 32 nt, Human
ccuuuuaccaucuuugcuauacuauaagcaaa

SEQ ID NO: 385133 - RNA, 23 nt, Human
ccuuuuaccuuuucagucuggca

SEQ ID NO: 385134 - RNA, 32 nt, Human
ccuuuuacucagccacagccuccggagccguu

SEQ ID NO: 385135 - RNA, 32 nt, Human
ccuuuuacucagccugcacagagccaucucuu

SEQ ID NO: 385136 - RNA, 23 nt, Human
ccuuuuacucccaacgucuggca

SEQ ID NO: 385137 - RNA, 21 nt, Human
ccuuuuacuccuuuucuucca

SEQ ID NO: 385138 - RNA, 32 nt, Human
ccuuuuacuuccugaauucaauucaguuugau

SEQ ID NO: 385139 - RNA, 32 nt, Human
ccuuuuagauuucauaaagugcaguguauaua

SEQ ID NO: 385140 - RNA, 32 nt, Human
ccuuuuagcaaagaugcaggccaguuuguuua

SEQ ID NO: 385141 - RNA, 32 nt, Human
ccuuuuaggggagaaaggagggcagauuugua

SEQ ID NO: 385142 - RNA, 32 nt, Human
ccuuuuaguauuaguuuucuguauaugauaua

SEQ ID NO: 385143 - RNA, 32 nt, Human
ccuuuuaguggagaagagaggaagucagaggg

SEQ ID NO: 385144 - RNA, 32 nt, Human
ccuuuuauaccuugguacggugcagugauauc

SEQ ID NO: 385145 - RNA, 32 nt, Human
ccuuuuaugccgagaagaucucagcuggaugc

SEQ ID NO: 385146 - RNA, 32 nt, Human
ccuuuuauggaccaaauuuuucugguacugua

SEQ ID NO: 385147 - RNA, 32 nt, Human
ccuuuuauuaacucaccucucaguugaaagau

SEQ ID NO: 385148 - RNA, 32 nt, Human
ccuuuuauugaauauguucuuauagggcaaaa

SEQ ID NO: 385149 - RNA, 32 nt, Human
ccuuuuauuuguccuuaaacuaccuccuuaga

SEQ ID NO: 385150 - RNA, 32 nt, Human
ccuuuuauuuugcucuacccaguaacugcgcu

SEQ ID NO: 385151 - RNA, 32 nt, Human
ccuuuucaaaacugugcagcuuccugaaccuu

SEQ ID NO: 385152 - RNA, 32 nt, Human
ccuuuucaauauucuaaucuuugcuuugcuga

SEQ ID NO: 385153 - RNA, 32 nt, Human
ccuuuucacagcccucuucuggaacagucacc

SEQ ID NO: 385154 - RNA, 32 nt, Human
ccuuuucagcagaaggcacagaacaguagcgg

SEQ ID NO: 385155 - RNA, 32 nt, Human
ccuuuucagcagacgcuucccuucccuucccc

SEQ ID NO: 385156 - RNA, 32 nt, Human
ccuuuucaggauuugagacuguucucaaaggg

SEQ ID NO: 385157 - RNA, 32 nt, Human
ccuuuucaggcaaggacaagccagcuucagag

SEQ ID NO: 385158 - RNA, 32 nt, Human
ccuuuucaggggagagaccaggagaccaccau

SEQ ID NO: 385159 - RNA, 32 nt, Human
ccuuuucagggugaagcucuuccuucaagagu

SEQ ID NO: 385160 - RNA, 32 nt, Human
ccuuuucaucuauuuaauuauugcccauguca

SEQ ID NO: 385161 - RNA, 32 nt, Human
ccuuuucaugucuauacaggaugcuucuagug

SEQ ID NO: 385162 - RNA, 32 nt, Human
ccuuuucauuuaauggggauuccacuaucuca

SEQ ID NO: 385163 - RNA, 32 nt, Human
ccuuuuccaaggaagugaagguuaagaggucc

SEQ ID NO: 385164 - RNA, 32 nt, Human
ccuuuuccagcauauuccccugggccuuuagu

SEQ ID NO: 385165 - RNA, 32 nt, Human
ccuuuuccaggaguucugaagcugacagcacu

SEQ ID NO: 385166 - RNA, 20 nt, Human
ccuuuuccagugacuggcuc

SEQ ID NO: 385167 - RNA, 32 nt, Human
ccuuuuccaugacuccaggcugugccucucuc

SEQ ID NO: 385168 - RNA, 32 nt, Human
ccuuuucccaggagaagacaccucugggagcc

SEQ ID NO: 385169 - RNA, 32 nt, Human
ccuuuuccccacccucaccuucgcccaucacu

SEQ ID NO: 385170 - RNA, 32 nt, Human
ccuuuuccccuaauaccgcccccucagugcuc

SEQ ID NO: 385171 - RNA, 32 nt, Human
ccuuuucccugccucgcuccagguuuuaguga

SEQ ID NO: 385172 - RNA, 32 nt, Human
ccuuuucccugucaugcucaucagcuuauggc

SEQ ID NO: 385173 - RNA, 32 nt, Human
ccuuuucccuguucauggcaggccauggcccg

SEQ ID NO: 385174 - RNA, 32 nt, Human
ccuuuucccuuuaccaugucccaguaagaagg

SEQ ID NO: 385175 - RNA, 32 nt, Human
ccuuuucccuuucaaccucuccuccgcuguca

SEQ ID NO: 385176 - RNA, 32 nt, Human
ccuuuucccuuucccuuuccccuuccccuucc

SEQ ID NO: 385177 - RNA, 32 nt, Human
ccuuuucccuuuccuuuccuuuccucuugacc

SEQ ID NO: 385178 - RNA, 32 nt, Human
ccuuuuccucaagggagcaacguuagcuuucc

SEQ ID NO: 385179 - RNA, 32 nt, Human
ccuuuuccucaccugcucaaccauuauucaca

SEQ ID NO: 385180 - RNA, 32 nt, Human
ccuuuuccuccccacuccuucccaccagcgcc

SEQ ID NO: 385181 - RNA, 22 nt, Human
ccuuuuccucuugcucacugcc

SEQ ID NO: 385182 - RNA, 32 nt, Human
ccuuuuccugacccaucucccccuuccuacca

SEQ ID NO: 385183 - RNA, 32 nt, Human
ccuuuuccugcgcaacagagcugggccucccu

SEQ ID NO: 385184 - RNA, 22 nt, Human
ccuuuuccugggcugccucuga

SEQ ID NO: 385185 - RNA, 32 nt, Human
ccuuuuccugggcuucagcuccccuacuucuu

SEQ ID NO: 385186 - RNA, 32 nt, Human
ccuuuuccuggugugcuuauuaucccuuuugc

SEQ ID NO: 385187 - RNA, 32 nt, Human
ccuuuuccuuccagccucucuuuuccaggaac

SEQ ID NO: 385188 - RNA, 32 nt, Human
ccuuuuccuucuaauuuguuuuuaacuucauu

SEQ ID NO: 385189 - RNA, 21 nt, Human
ccuuuucgcccaggcugagua

SEQ ID NO: 385190 - RNA, 32 nt, Human
ccuuuucgcccaggcugaguacaguggugcaa

SEQ ID NO: 385191 - RNA, 32 nt, Human
ccuuuucggucugucuucauccugccuggcuc

SEQ ID NO: 385192 - RNA, 32 nt, Human
ccuuuucuaagugcuucacaugauauuaacuc

SEQ ID NO: 385193 - RNA, 32 nt, Human
ccuuuucuacaaauaucagagccauggcucag

SEQ ID NO: 385194 - RNA, 18 nt, Human
ccuuuucucaacuugugc

SEQ ID NO: 385195 - RNA, 32 nt, Human
ccuuuucucacuguagcugcuggcagcccugu

SEQ ID NO: 385196 - RNA, 32 nt, Human
ccuuuucucacuucugucagucuguaagcuuu

SEQ ID NO: 385197 - RNA, 32 nt, Human
ccuuuucucagcuucugaggcugcgaugccuc

SEQ ID NO: 385198 - RNA, 32 nt, Human
ccuuuucuccaaucccccuuccccagguuccu

SEQ ID NO: 385199 - RNA, 32 nt, Human
ccuuuucuccaccucucucaacacacuccuca

SEQ ID NO: 385200 - RNA, 32 nt, Human
ccuuuucuccacugucauaaucucuuuccauc

SEQ ID NO: 385201 - RNA, 22 nt, Human
ccuuuucucccaucacaacuac

SEQ ID NO: 385202 - RNA, 32 nt, Human
ccuuuucucccaucacaacuacgaagaccuug

SEQ ID NO: 385203 - RNA, 18 nt, Human
ccuuuucuccccacgaug

SEQ ID NO: 385204 - RNA, 32 nt, Human
ccuuuucucccuucccauuucuccccacuuuc

SEQ ID NO: 385205 - RNA, 32 nt, Human
ccuuuucuccuccaaauauuucuccucucacc

SEQ ID NO: 385206 - RNA, 32 nt, Human
ccuuuucucugcaaccuagcccgcaucuguca

SEQ ID NO: 385207 - RNA, 32 nt, Human
ccuuuucucugccugcaugucccugugcagag

SEQ ID NO: 385208 - RNA, 32 nt, Human
ccuuuucugaaccucuuagacucuuagaaaua

SEQ ID NO: 385209 - RNA, 32 nt, Human
ccuuuucugcagucacucagggacccagacuu

SEQ ID NO: 385210 - RNA, 32 nt, Human
ccuuuucugccagacuacauuuuguggggagc

SEQ ID NO: 385211 - RNA, 32 nt, Human
ccuuuucugguucaguucccuuguccugaucu

SEQ ID NO: 385212 - RNA, 32 nt, Human
ccuuuucuuaacaaaaucugugcaaaagaugc

SEQ ID NO: 385213 - RNA, 32 nt, Human
ccuuuucuuccuaucucuguggcuuucagcuc

SEQ ID NO: 385214 - RNA, 32 nt, Human
ccuuuucuuccuccuccugaccuuauuuugcu

SEQ ID NO: 385215 - RNA, 32 nt, Human
ccuuuucuuccucuucuugauagaugaggcca

SEQ ID NO: 385216 - RNA, 32 nt, Human
ccuuuucuuuaaaagacacaauaggacucgca

SEQ ID NO: 385217 - RNA, 32 nt, Human
ccuuuucuuuucuccccuugggucuuauuaua

SEQ ID NO: 385218 - RNA, 32 nt, Human
ccuuuucuuuuucuuuccuuccuuccuuuucu

SEQ ID NO: 385219 - RNA, 32 nt, Human
ccuuuugaaauguuugccugucugaacuguga

SEQ ID NO: 385220 - RNA, 21 nt, Human
ccuuuugaauuaucuuuuuca

SEQ ID NO: 385221 - RNA, 32 nt, Human
ccuuuugacauggcccaucauucuuuaaacac

SEQ ID NO: 385222 - RNA, 32 nt, Human
ccuuuugagacagggccucacucuguucccca

SEQ ID NO: 385223 - RNA, 32 nt, Human
ccuuuugaugaccccaggcuugaguuuuuaaa

SEQ ID NO: 385224 - RNA, 32 nt, Human
ccuuuugauugagccuccaccucugggauuuu

SEQ ID NO: 385225 - RNA, 32 nt, Human
ccuuuugcaaagcucuaagcaacucgauuguu

SEQ ID NO: 385226 - RNA, 32 nt, Human
ccuuuugcacaucggucucugccacacgcagu

SEQ ID NO: 385227 - RNA, 32 nt, Human
ccuuuugcagaagggaaauggaggacaugugu

SEQ ID NO: 385228 - RNA, 32 nt, Human
ccuuuugcaggauguggaggcguccucaggag

SEQ ID NO: 385229 - RNA, 32 nt, Human
ccuuuugcccccucccccuccuucuguccccu

SEQ ID NO: 385230 - RNA, 32 nt, Human
ccuuuugccuggcaguucugcauugcaucuca

SEQ ID NO: 385231 - RNA, 32 nt, Human
ccuuuugccuguaguaguaaauugcuuuuaaa

SEQ ID NO: 385232 - RNA, 32 nt, Human
ccuuuugccuuggcuuagaggcugcagcacuu

SEQ ID NO: 385233 - RNA, 32 nt, Human
ccuuuugcugccucuaaaaggccugucccugc

SEQ ID NO: 385234 - RNA, 20 nt, Human
ccuuuugcuucccugcccuu

SEQ ID NO: 385235 - RNA, 32 nt, Human
ccuuuuggaacacugccuuccuuacugugccu

SEQ ID NO: 385236 - RNA, 32 nt, Human
ccuuuuggaggcaccaugggaacagaaggaaa

SEQ ID NO: 385237 - RNA, 24 nt, Human
ccuuuuggaggguuagaagaucag

SEQ ID NO: 385238 - RNA, 32 nt, Human
ccuuuuggccgagguccgcuguauccauggcu

SEQ ID NO: 385239 - RNA, 32 nt, Human
ccuuuuggcucaacgaaccucacuuuguaggc

SEQ ID NO: 385240 - RNA, 32 nt, Human
ccuuuuggcuggguuacagaagaguuucuaag

SEQ ID NO: 385241 - RNA, 32 nt, Human
ccuuuugggaagcaggacagaaaccucuuucu

SEQ ID NO: 385242 - RNA, 32 nt, Human
ccuuuugggauuauauguuuggaugcagguga

SEQ ID NO: 385243 - RNA, 32 nt, Human
ccuuuuggguucugugcugucaaugguauguc

SEQ ID NO: 385244 - RNA, 32 nt, Human
ccuuuugguggccucuccaggugcaaaacuuc

SEQ ID NO: 385245 - RNA, 24 nt, Human
ccuuuugguuguguaucuuuuuca

SEQ ID NO: 385246 - RNA, 32 nt, Human
ccuuuugucacccaggcuggagugccauggca

SEQ ID NO: 385247 - RNA, 32 nt, Human
ccuuuugucaucuguaccagaucaguaguugg

SEQ ID NO: 385248 - RNA, 23 nt, Human
ccuuuuguccccaccucucuggu

SEQ ID NO: 385249 - RNA, 31 nt, Human
ccuuuugucuauuucugacacagaugcauuu

SEQ ID NO: 385250 - RNA, 32 nt, Human
ccuuuugucugccucuuagacuucugcuuucc

SEQ ID NO: 385251 - RNA, 32 nt, Human
ccuuuugucuggcugauucuguccucaaauaa

SEQ ID NO: 385252 - RNA, 32 nt, Human
ccuuuugugagccuguguuuguuagauaccca

SEQ ID NO: 385253 - RNA, 32 nt, Human
ccuuuuguguuccugcucacuucaagcuucuu

SEQ ID NO: 385254 - RNA, 32 nt, Human
ccuuuuguucucuccauuggaagccuccuugu

SEQ ID NO: 385255 - RNA, 32 nt, Human
ccuuuuuaaaaagcaccuauuugggaucauuu

SEQ ID NO: 385256 - RNA, 32 nt, Human
ccuuuuuaaaaauuacgugugcacagagaggu

SEQ ID NO: 385257 - RNA, 32 nt, Human
ccuuuuuaaauacuuguucuuaauucacuggu

SEQ ID NO: 385258 - RNA, 19 nt, Human
ccuuuuuaacagcaugugg

SEQ ID NO: 385259 - RNA, 31 nt, Human
ccuuuuuaauggauuugucuguugaacuuca

SEQ ID NO: 385260 - RNA, 18 nt, Human
ccuuuuuaccaucuacuu

SEQ ID NO: 385261 - RNA, 32 nt, Human
ccuuuuuacucuuaaaacaaugcugcaguuaa

SEQ ID NO: 385262 - RNA, 32 nt, Human
ccuuuuuagucccuuuccaaagcugcccccac

SEQ ID NO: 385263 - RNA, 32 nt, Human
ccuuuuuaucuaggagaugaaaagaggauaau

SEQ ID NO: 385264 - RNA, 32 nt, Human
ccuuuuuaugucaauuaccaucuuguuucuuu

SEQ ID NO: 385265 - RNA, 32 nt, Human
ccuuuuucaaaaugagagaaguaugagacauc

SEQ ID NO: 385266 - RNA, 32 nt, Human
ccuuuuucaaagaaauguaauugauuuugaag

SEQ ID NO: 385267 - RNA, 32 nt, Human
ccuuuuucacacagcuaggucuuuucagaagu

SEQ ID NO: 385268 - RNA, 32 nt, Human
ccuuuuucagaaugugagguaguugggaguca

SEQ ID NO: 385269 - RNA, 32 nt, Human
ccuuuuucauuuccuuaaguuuugaucuccgu

SEQ ID NO: 385270 - RNA, 32 nt, Human
ccuuuuucauuucugauuguauuuauuugggu

SEQ ID NO: 385271 - RNA, 18 nt, Human
ccuuuuuccaauuucuua

SEQ ID NO: 385272 - RNA, 32 nt, Human
ccuuuuuccacuuugcacuaccuggugccauu

SEQ ID NO: 385273 - RNA, 32 nt, Human
ccuuuuuccauggcaaugagguggggcccagc

SEQ ID NO: 385274 - RNA, 32 nt, Human
ccuuuuucccugccucccuuuuucaucaauug

SEQ ID NO: 385275 - RNA, 32 nt, Human
ccuuuuucccuucccuccuuuguuuacuuaua

SEQ ID NO: 385276 - RNA, 32 nt, Human
ccuuuuucccuucuaaguucugcuaaaucaca

SEQ ID NO: 385277 - RNA, 32 nt, Human
ccuuuuuccuacuuguuaugguuguuuggacc

SEQ ID NO: 385278 - RNA, 23 nt, Human
ccuuuuuccuggucccagcagca

SEQ ID NO: 385279 - RNA, 32 nt, Human
ccuuuuuccuucuccccaauuacuccccugaa

SEQ ID NO: 385280 - RNA, 32 nt, Human
ccuuuuuccuuuccuuuccuuucuuucuuccu

SEQ ID NO: 385281 - RNA, 32 nt, Human
ccuuuuucuccccucuccgucuucuccccucc

SEQ ID NO: 385282 - RNA, 32 nt, Human
ccuuuuucucucuuacugcuucauguaauuuu

SEQ ID NO: 385283 - RNA, 32 nt, Human
ccuuuuucucuucacaucucccccauagcacc

SEQ ID NO: 385284 - RNA, 21 nt, Human
ccuuuuucuggcuggggccug

SEQ ID NO: 385285 - RNA, 32 nt, Human
ccuuuuucuucaaauugcucccccuccccagg

SEQ ID NO: 385286 - RNA, 32 nt, Human
ccuuuuucuucuuccucccccaaaaaccuuuu

SEQ ID NO: 385287 - RNA, 32 nt, Human
ccuuuuugacuuuauagaucacugcagcauua

SEQ ID NO: 385288 - RNA, 32 nt, Human
ccuuuuugaugacaccacaaaauuguugaaca

SEQ ID NO: 385289 - RNA, 32 nt, Human
ccuuuuugcaugguugucuaggguuucuggac

SEQ ID NO: 385290 - RNA, 32 nt, Human
ccuuuuugccaguaaaccaaaaagcagauccu

SEQ ID NO: 385291 - RNA, 32 nt, Human
ccuuuuugccucuuugccauuuccuuggaaag

SEQ ID NO: 385292 - RNA, 32 nt, Human
ccuuuuuggacuagccagaauucuacccugga

SEQ ID NO: 385293 - RNA, 32 nt, Human
ccuuuuuggcaaaggcaucaagcauucaaaga

SEQ ID NO: 385294 - RNA, 32 nt, Human
ccuuuuugguaccaaaccugaggucuuuugga

SEQ ID NO: 385295 - RNA, 32 nt, Human
ccuuuuugguucuuucagcuaccauaaauaac

SEQ ID NO: 385296 - RNA, 32 nt, Human
ccuuuuugucagugggaggcugggcugggaga

SEQ ID NO: 385297 - RNA, 32 nt, Human
ccuuuuugugagauggggucucgcacuguccc

SEQ ID NO: 385298 - RNA, 32 nt, Human
ccuuuuuguguuuagagaauuaugggaaaccu

SEQ ID NO: 385299 - RNA, 22 nt, Human
ccuuuuuuccuucuuccuuccc

SEQ ID NO: 385300 - RNA, 32 nt, Human
cgaaaaacaaaccgcuggucgcgcagcucgcc

SEQ ID NO: 385301 - RNA, 32 nt, Human
cgaaaaacacagaaagauuagccaggcauagu

SEQ ID NO: 385302 - RNA, 32 nt, Human
cgaaaaacugauugacugggcuggcguuaacu

SEQ ID NO: 385303 - RNA, 32 nt, Human
cgaaaaagcccucagcagggccaucugugugc

SEQ ID NO: 385304 - RNA, 32 nt, Human
cgaaaaauaaauagcugggauuacaggugccu

SEQ ID NO: 385305 - RNA, 32 nt, Human
cgaaaaauacaaaaauuagcugggcauagugg

SEQ ID NO: 385306 - RNA, 32 nt, Human
cgaaaacagucaaccaaccccaucgccaacua

SEQ ID NO: 385307 - RNA, 32 nt, Human
cgaaaacauggauaagaucccaggaagacaag

SEQ ID NO: 385308 - RNA, 32 nt, Human
cgaaaacccacauuccaagacuugguauaagg

SEQ ID NO: 385309 - RNA, 32 nt, Human
cgaaaaccuccaagauauuuuucacaaaauag

SEQ ID NO: 385310 - RNA, 32 nt, Human
cgaaaacgcaagcaggaaaaacaaguggaaac

SEQ ID NO: 385311 - RNA, 32 nt, Human
cgaaaacuccugcugcaguagacggugguuug

SEQ ID NO: 385312 - RNA, 32 nt, Human
cgaaaagaccuccggccugaaugaucuccaug

SEQ ID NO: 385313 - RNA, 32 nt, Human
cgaaaagagaagagaaucgcaugaguagcaag

SEQ ID NO: 385314 - RNA, 32 nt, Human
cgaaaagguaaauaagguauaaauagauuuaa

SEQ ID NO: 385315 - RNA, 32 nt, Human
cgaaaaguucccucaugccaacugcagugauc

SEQ ID NO: 385316 - RNA, 32 nt, Human
cgaaaaugcaccacugcacuccagcaugggca

SEQ ID NO: 385317 - RNA, 32 nt, Human
cgaaaauggcaaacuacuacuacuacuguuca

SEQ ID NO: 385318 - RNA, 32 nt, Human
cgaaaauuagccuggugugguggugcacgcuu

SEQ ID NO: 385319 - RNA, 32 nt, Human
cgaaacaccuuaaagacuucugucauuuuaaa

SEQ ID NO: 385320 - RNA, 32 nt, Human
cgaaacagaggaggaggagggaggggagugcg

SEQ ID NO: 385321 - RNA, 32 nt, Human
cgaaacaggaggaaacucagugaccucugccu

SEQ ID NO: 385322 - RNA, 32 nt, Human
cgaaacaggaggauccuuugagccuaggaguu

SEQ ID NO: 385323 - RNA, 32 nt, Human
cgaaacaggcgaaucacuugagcccaggaguu

SEQ ID NO: 385324 - RNA, 32 nt, Human
cgaaaccaacagcaguccaagcucagucagca

SEQ ID NO: 385325 - RNA, 32 nt, Human
cgaaaccaauguggguguuagaaaaauuacca

SEQ ID NO: 385326 - RNA, 32 nt, Human
cgaaaccacaccacuuaguuucucccaggggu

SEQ ID NO: 385327 - RNA, 32 nt, Human
cgaaaccacagcuuccuuggcucuuuuugccc

SEQ ID NO: 385328 - RNA, 32 nt, Human
cgaaaccacgcgcaccuggccuuagagagcgg

SEQ ID NO: 385329 - RNA, 32 nt, Human
cgaaaccagaagguggagguggcagugagccg

SEQ ID NO: 385330 - RNA, 32 nt, Human
cgaaacccucauccaguuuucucuccaucucu

SEQ ID NO: 385331 - RNA, 32 nt, Human
cgaaaccucacaggaaaaaugguaaguucuaa

SEQ ID NO: 385332 - RNA, 30 nt, Human
cgaaaccucuuugguuguccuuuccuuccu

SEQ ID NO: 385333 - RNA, 32 nt, Human
cgaaaccugcacccucucuucuggucacgccu

SEQ ID NO: 385334 - RNA, 32 nt, Human
cgaaaccugucucucugccucucuuucuccug

SEQ ID NO: 385335 - RNA, 32 nt, Human
cgaaacuaugccacagucuggauguguuuacu

SEQ ID NO: 385336 - RNA, 32 nt, Human
cgaaacuauuuuuauagagaaaaagggucuuu

SEQ ID NO: 385337 - RNA, 32 nt, Human
cgaaacucagcccauuggagaccauggauaag

SEQ ID NO: 385338 - RNA, 32 nt, Human
cgaaacuccaucuucaaaacaaaacaaaacaa

SEQ ID NO: 385339 - RNA, 32 nt, Human
cgaaacuccgucucaaaaacaaagaaggauau

SEQ ID NO: 385340 - RNA, 32 nt, Human
cgaaacuccgucucaaaaacaacaaaaacaaa

SEQ ID NO: 385341 - RNA, 32 nt, Human
cgaaacugacuugcucaccuggaacaccugau

SEQ ID NO: 385342 - RNA, 32 nt, Human
cgaaagaagagagguaaauccuauucuuuucc

SEQ ID NO: 385343 - RNA, 32 nt, Human
cgaaagagaggguggucacagauggguccauc

SEQ ID NO: 385344 - RNA, 32 nt, Human
cgaaagaggacgaggaggaggacuagcucagg

SEQ ID NO: 385345 - RNA, 32 nt, Human
cgaaagcaccuugaggccuuucuuacccagag

SEQ ID NO: 385346 - RNA, 32 nt, Human
cgaaagcagaggaggaggaagggccggccaga

SEQ ID NO: 385347 - RNA, 32 nt, Human
cgaaagcaggauguggcaguugcagugagaaa

SEQ ID NO: 385348 - RNA, 32 nt, Human
cgaaagcaucuucuccuuccguucacggauuu

SEQ ID NO: 385349 - RNA, 32 nt, Human
cgaaagcccaggagugaaggggguuccuggag

SEQ ID NO: 385350 - RNA, 32 nt, Human
cgaaagcccucuggauugaggcagcaggaucu

SEQ ID NO: 385351 - RNA, 32 nt, Human
cgaaagccgugcucuccagccuggcugccagg

SEQ ID NO: 385352 - RNA, 32 nt, Human
cgaaagccuaguaguuaguugcacuggguugu

SEQ ID NO: 385353 - RNA, 32 nt, Human
cgaaagcucuuugcuuuagccaaaggagagug

SEQ ID NO: 385354 - RNA, 32 nt, Human
cgaaaggagagagggagggaaggguggguaag

SEQ ID NO: 385355 - RNA, 32 nt, Human
cgaaaggcaggcaggcaggcaugugucagagc

SEQ ID NO: 385356 - RNA, 32 nt, Human
cgaaaggcaggcgggcuguguacugggcccug

SEQ ID NO: 385357 - RNA, 28 nt, Human
cgaaaggcauuuucccaggagagcucug

SEQ ID NO: 385358 - RNA, 32 nt, Human
cgaaagggagagcagagauggcagcugaaacu

SEQ ID NO: 385359 - RNA, 32 nt, Human
cgaaaggggaaacugaggaugaccuggcgggg

SEQ ID NO: 385360 - RNA, 32 nt, Human
cgaaaggucuggucgcagagacaggaacgugu

SEQ ID NO: 385361 - RNA, 32 nt, Human
cgaaaguggccucaugaaggggaagccgaggg

SEQ ID NO: 385362 - RNA, 32 nt, Human
cgaaagugucuggagaagcuggacacugacau

SEQ ID NO: 385363 - RNA, 32 nt, Human
cgaaaguugccucugugucugagaaaguaucu

SEQ ID NO: 385364 - RNA, 32 nt, Human
cgaaauaagugguacuauuuccauuuagccuu

SEQ ID NO: 385365 - RNA, 32 nt, Human
cgaaauaggagaauagaacauauuuaacuauu

SEQ ID NO: 385366 - RNA, 32 nt, Human
cgaaauauucagcagucuugccagcuuaccag

SEQ ID NO: 385367 - RNA, 32 nt, Human
cgaaaucaauguuauucucccucccaccacuu

SEQ ID NO: 385368 - RNA, 32 nt, Human
cgaaaucacaccacuguacuccagccugguga

SEQ ID NO: 385369 - RNA, 32 nt, Human
cgaaaucacaccauugcacuccagcuugggca

SEQ ID NO: 385370 - RNA, 32 nt, Human
cgaaaucacgccacuacacuccagccugggca

SEQ ID NO: 385371 - RNA, 32 nt, Human
cgaaaucagugcgcuccagcugaucucguucc

SEQ ID NO: 385372 - RNA, 32 nt, Human
cgaaaucgcaccacugcacuccagccugggcg

SEQ ID NO: 385373 - RNA, 32 nt, Human
cgaaaucgcaccgcugcacuccagccuggcaa

SEQ ID NO: 385374 - RNA, 32 nt, Human
cgaaaucgcgccacugcacuccagccugggug

SEQ ID NO: 385375 - RNA, 32 nt, Human
cgaaaugccaucacuccuacugcggcugcuau

SEQ ID NO: 385376 - RNA, 23 nt, Human
cgaaaugcugggauuacaggcau

SEQ ID NO: 385377 - RNA, 32 nt, Human
cgaaauggcgacacugcacugcaggcugggcu

SEQ ID NO: 385378 - RNA, 32 nt, Human
cgaaauguaaguuuuauucuuccuauuuacug

SEQ ID NO: 385379 - RNA, 32 nt, Human
cgaaauuaugccacugcacuccagccugggca

SEQ ID NO: 385380 - RNA, 32 nt, Human
cgaaauucccaaugaugcuaauuuuaagucug

SEQ ID NO: 385381 - RNA, 32 nt, Human
cgaaauucccuccucugcuuucaaaagucaaa

SEQ ID NO: 385382 - RNA, 32 nt, Human
cgaaauugcaccauugcacuccagccugggca

SEQ ID NO: 385383 - RNA, 32 nt, Human
cgaaauugugcaaaugaaagaaaugucauggu

SEQ ID NO: 385384 - RNA, 32 nt, Human
cgaaauugugccacuaguacuccagccugggu

SEQ ID NO: 385385 - RNA, 32 nt, Human
cgaacaaagaggaggagccgaggcgcgagagc

SEQ ID NO: 385386 - RNA, 25 nt, Human
cgaacaaagcagccacgaggugcaa

SEQ ID NO: 385387 - RNA, 32 nt, Human
cgaacacaaauggacacacauaccuggccacg

SEQ ID NO: 385388 - RNA, 32 nt, Human
cgaacacaauugcuccagccacaggcgaggcc

SEQ ID NO: 385389 - RNA, 32 nt, Human
cgaacacagaagugggaaggagaggggugggc

SEQ ID NO: 385390 - RNA, 20 nt, Human
cgaacacccaaugaguuuaa

SEQ ID NO: 385391 - RNA, 32 nt, Human
cgaacacccgccccucugcuccaggcuagcuu

SEQ ID NO: 385392 - RNA, 28 nt, Human
cgaacacugccucggccuccugguauag

SEQ ID NO: 385393 - RNA, 32 nt, Human
cgaacagacguucuuucuccuccaugcaguua

SEQ ID NO: 385394 - RNA, 28 nt, Human
cgaacagcaguucgcagaacuccagcga

SEQ ID NO: 385395 - RNA, 32 nt, Human
cgaacagccauugcacuccagccugggcaaca

SEQ ID NO: 385396 - RNA, 32 nt, Human
cgaacaggaagaggacggaaaagauaaccguc

SEQ ID NO: 385397 - RNA, 32 nt, Human
cgaacaggcuugcaauuaagaucaauaaggcu

SEQ ID NO: 385398 - RNA, 32 nt, Human
cgaacagggugaggcucagugcuggaucuuag

SEQ ID NO: 385399 - RNA, 32 nt, Human
cgaacaguauucaccuaguuacccugacacaa

SEQ ID NO: 385400 - RNA, 32 nt, Human
cgaacagugaccacuaaccuucccucuggcug

SEQ ID NO: 385401 - RNA, 32 nt, Human
cgaacaucagcuuacagaugaugaggacuuaa

SEQ ID NO: 385402 - RNA, 32 nt, Human
cgaacaugggaggcguagcuugcagugagcug

SEQ ID NO: 385403 - RNA, 32 nt, Human
cgaacauucacagaugccaaaguaggcacucg

SEQ ID NO: 385404 - RNA, 32 nt, Human
cgaaccaccuguaaucuaggcaccuuugccaa

SEQ ID NO: 385405 - RNA, 32 nt, Human
cgaaccagauggugccagggaguacgugacac

SEQ ID NO: 385406 - RNA, 32 nt, Human
cgaaccagggaaacccagguucccugggcccu

SEQ ID NO: 385407 - RNA, 32 nt, Human
cgaaccaggugcagggucccagcuggagaccc

SEQ ID NO: 385408 - RNA, 32 nt, Human
cgaaccagugggggaaagauggaucuugaagc

SEQ ID NO: 385409 - RNA, 32 nt, Human
cgaaccauggugaacuccaccuccguggaaua

SEQ ID NO: 385410 - RNA, 32 nt, Human
cgaaccauuguacuccagccugggugacagag

SEQ ID NO: 385411 - RNA, 32 nt, Human
cgaaccauuucucugguucccugcagacagga

SEQ ID NO: 385412 - RNA, 32 nt, Human
cgaacccaagaaguggagguugcagugagcca

SEQ ID NO: 385413 - RNA, 32 nt, Human
cgaacccacaucccuacaaagcaggaaaguau

SEQ ID NO: 385414 - RNA, 32 nt, Human
cgaacccaggaggcagagguugcagugagcca

SEQ ID NO: 385415 - RNA, 31 nt, Human
cgaacccaggaggcggaggcagaggcugcag

SEQ ID NO: 385416 - RNA, 32 nt, Human
cgaacccaggagguggagguugcagugagccg

SEQ ID NO: 385417 - RNA, 23 nt, Human
cgaacccaggccacuagucucuu

SEQ ID NO: 385418 - RNA, 32 nt, Human
cgaaccccagcacguggccaguaucaucagcu

SEQ ID NO: 385419 - RNA, 32 nt, Human
cgaaccccugaaccuccagccaggggcgcccc

SEQ ID NO: 385420 - RNA, 31 nt, Human
cgaacccgggaggaggaggaggagguugcag

SEQ ID NO: 385421 - RNA, 32 nt, Human
cgaacccgggaggcagagguugcagugagccg

SEQ ID NO: 385422 - RNA, 32 nt, Human
cgaacccgggaggcggagcuugcagugagccc

SEQ ID NO: 385423 - RNA, 32 nt, Human
cgaacccuuuugugguuuugaacaccaacaua

SEQ ID NO: 385424 - RNA, 32 nt, Human
cgaaccgagucuggaccauuuagaagacgccg

SEQ ID NO: 385425 - RNA, 32 nt, Human
cgaaccgccaagcagaaaccggaccucacagc

SEQ ID NO: 385426 - RNA, 32 nt, Human
cgaaccgcuaccuggaccccuagccucacggg

SEQ ID NO: 385427 - RNA, 32 nt, Human
cgaaccuaggaggcagaguuugcagugagcug

SEQ ID NO: 385428 - RNA, 32 nt, Human
cgaaccucaggugauccacccaccucagccuc

SEQ ID NO: 385429 - RNA, 32 nt, Human
cgaaccugagggagcauuugcugagggaauag

SEQ ID NO: 385430 - RNA, 32 nt, Human
cgaaccugggaggcagagguugcaguaagcug

SEQ ID NO: 385431 - RNA, 32 nt, Human
cgaaccugggagguggagguugcgagaucaca

SEQ ID NO: 385432 - RNA, 32 nt, Human
cgaaccuuggagguggagguuguggugagcca

SEQ ID NO: 385433 - RNA, 32 nt, Human
cgaaccuuugggcucuccagguccgagauccu

SEQ ID NO: 385434 - RNA, 31 nt, Human
cgaacgaaggaccagccucagaggcuagaag

SEQ ID NO: 385435 - RNA, 32 nt, Human
cgaacgcaggcagaucacuugaggucaggaau

SEQ ID NO: 385436 - RNA, 18 nt, Human
cgaacgcggcggcggcgg

SEQ ID NO: 385437 - RNA, 32 nt, Human
cgaacggcaguuucccuuccccaguggacguc

SEQ ID NO: 385438 - RNA, 32 nt, Human
cgaacggccagggagaggagguggccuagcgc

SEQ ID NO: 385439 - RNA, 32 nt, Human
cgaacggcucagaaaccccggaaugguugagg

SEQ ID NO: 385440 - RNA, 22 nt, Human
cgaacgggcagacccccucgag

SEQ ID NO: 385441 - RNA, 32 nt, Human
cgaacuaaacccaggcaacaggcgaggcagga

SEQ ID NO: 385442 - RNA, 31 nt, Human
cgaacuaggaaagagccuaggagggagccuc

SEQ ID NO: 385443 - RNA, 32 nt, Human
cgaacucagccaccugcuaccucugccuucug

SEQ ID NO: 385444 - RNA, 32 nt, Human
cgaacucagggcacuccacauggggcaaacug

SEQ ID NO: 385445 - RNA, 31 nt, Human
cgaacucaggggguggagguugcagugaguu

SEQ ID NO: 385446 - RNA, 32 nt, Human
cgaacucaggggguggagguugcagugaguug

SEQ ID NO: 385447 - RNA, 22 nt, Human
cgaacuccugaccucaagugau

SEQ ID NO: 385448 - RNA, 24 nt, Human
cgaacuccugaccucaugauccac

SEQ ID NO: 385449 - RNA, 24 nt, Human
cgaacuccugaccucgugauccac

SEQ ID NO: 385450 - RNA, 24 nt, Human
cgaacuccugaccuugugauccac

SEQ ID NO: 385451 - RNA, 32 nt, Human
cgaacuccugcauuccaaccagccugggugac

SEQ ID NO: 385452 - RNA, 32 nt, Human
cgaacucuguaaucccagcacuuugggaggcc

SEQ ID NO: 385453 - RNA, 32 nt, Human
cgaacucuucuuugcugcauuccuuuuucuuc

SEQ ID NO: 385454 - RNA, 32 nt, Human
cgaacugcucaaaggcuuggagcgggucuagu

SEQ ID NO: 385455 - RNA, 32 nt, Human
cgaacuggaugcauuaggaagcugcugucuga

SEQ ID NO: 385456 - RNA, 32 nt, Human
cgaacuggcugcaaaggguaucaggugcugcc

SEQ ID NO: 385457 - RNA, 32 nt, Human
cgaacuggugaccuguaggccauguuagcacu

SEQ ID NO: 385458 - RNA, 19 nt, Human
cgaacugugauggcggcgg

SEQ ID NO: 385459 - RNA, 32 nt, Human
cgaacugugcagcuccugcggcaccauuugua

SEQ ID NO: 385460 - RNA, 32 nt, Human
cgaacuguguuuugaagauuugagggaagggc

SEQ ID NO: 385461 - RNA, 32 nt, Human
cgaacuucucuuccucacaugagguuacuguu

SEQ ID NO: 385462 - RNA, 32 nt, Human
cgaacuugugaccuucucugagguugcagcgg

SEQ ID NO: 385463 - RNA, 32 nt, Human
cgaacuuucucaucuguucuaccaugccacga

SEQ ID NO: 385464 - RNA, 32 nt, Human
cgaacuuuugucauucagccugggagaccacg

SEQ ID NO: 385465 - RNA, 32 nt, Human
cgaagaaaaggcugcugacaaggcugagggag

SEQ ID NO: 385466 - RNA, 32 nt, Human
cgaagaaagaggagugaggcaggggagcgagg

SEQ ID NO: 385467 - RNA, 32 nt, Human
cgaagaaauccaggaguggccaaccuggaggu

SEQ ID NO: 385468 - RNA, 32 nt, Human
cgaagaacaugcugcaucucuaaggccugcaa

SEQ ID NO: 385469 - RNA, 32 nt, Human
cgaagaagccaauuugagacucagccuagucc

SEQ ID NO: 385470 - RNA, 31 nt, Human
cgaagaagccauuggcuccucacuuagccau

SEQ ID NO: 385471 - RNA, 32 nt, Human
cgaagaaggcucaucccucaccccagacgccu

SEQ ID NO: 385472 - RNA, 32 nt, Human
cgaagaauacugggggagggugugguggguuc

SEQ ID NO: 385473 - RNA, 32 nt, Human
cgaagacaagcagacagauggacacuuuggau

SEQ ID NO: 385474 - RNA, 32 nt, Human
cgaagacauacagcuagugacgaauggacuga

SEQ ID NO: 385475 - RNA, 32 nt, Human
cgaagacauggcccuuucucuguaguugauuu

SEQ ID NO: 385476 - RNA, 32 nt, Human
cgaagaccaaagugaagagcaaggagcugaac

SEQ ID NO: 385477 - RNA, 32 nt, Human
cgaagaccacgugggcagaggcgcagggccac

SEQ ID NO: 385478 - RNA, 32 nt, Human
cgaagaccccugggcaugauuuugcuuguauu

SEQ ID NO: 385479 - RNA, 32 nt, Human
cgaagacgagaugagggagcugacgggagggg

SEQ ID NO: 385480 - RNA, 32 nt, Human
cgaagacucgcccucgccagugguguuacaca

SEQ ID NO: 385481 - RNA, 32 nt, Human
cgaagacugugagacuuccuccccacagugag

SEQ ID NO: 385482 - RNA, 32 nt, Human
cgaagagaagugaaagguucaaggacacuggc

SEQ ID NO: 385483 - RNA, 32 nt, Human
cgaagagacucugccgcagcuuuucuucuuuu

SEQ ID NO: 385484 - RNA, 32 nt, Human
cgaagagaggagagaccugggagugggagcuc

SEQ ID NO: 385485 - RNA, 32 nt, Human
cgaagagcaggaagagguugcugagauuguug

SEQ ID NO: 385486 - RNA, 32 nt, Human
cgaagaggaauguauggagaacuccacgugga

SEQ ID NO: 385487 - RNA, 32 nt, Human
cgaagaggacauguggauauccagccagaaug

SEQ ID NO: 385488 - RNA, 32 nt, Human
cgaagaggacuacagcuccacggaggggucug

SEQ ID NO: 385489 - RNA, 32 nt, Human
cgaagaggcaccuccagcagccuuggaagcaa

SEQ ID NO: 385490 - RNA, 32 nt, Human
cgaagagguggacugagccgcucgggacagcg

SEQ ID NO: 385491 - RNA, 32 nt, Human
cgaagaguguguuggggcaaaggggcucgguu

SEQ ID NO: 385492 - RNA, 32 nt, Human
cgaagauacaauauuuauuccuugucuccugg

SEQ ID NO: 385493 - RNA, 32 nt, Human
cgaagauaggagagaggaagacaagaaggaga

SEQ ID NO: 385494 - RNA, 32 nt, Human
cgaagaugcgaugaggaugacaccccagugaa

SEQ ID NO: 385495 - RNA, 32 nt, Human
cgaagaugcuuggaugagucagcugggaauau

SEQ ID NO: 385496 - RNA, 30 nt, Human
cgaagauggcugcuggcugccugcuggccu

SEQ ID NO: 385497 - RNA, 32 nt, Human
cgaagauggugggcgggccauugaaagagguc

SEQ ID NO: 385498 - RNA, 32 nt, Human
cgaagauuaccgcuggccuacugugaagguag

SEQ ID NO: 385499 - RNA, 32 nt, Human
cgaagcacguggucccgcugcgccacagccag

SEQ ID NO: 385500 - RNA, 32 nt, Human
cgaagcagaagcugcauuuugccaagauccca

SEQ ID NO: 385501 - RNA, 32 nt, Human
cgaagcagagcggaacgaaacagaacagagga

SEQ ID NO: 385502 - RNA, 32 nt, Human
cgaagcagccucccaccagcgaucccuugggg

SEQ ID NO: 385503 - RNA, 32 nt, Human
cgaagcaggaggaucacuggaggccaagaguu

SEQ ID NO: 385504 - RNA, 32 nt, Human
cgaagcaggcggaucacuugaggucaggaguu

SEQ ID NO: 385505 - RNA, 32 nt, Human
cgaagcaggcuggcgacucagugcugcagcaa

SEQ ID NO: 385506 - RNA, 32 nt, Human
cgaagcagguggaucacuugaggccaggaguu

SEQ ID NO: 385507 - RNA, 32 nt, Human
cgaagcagugccucugcgcaaucuccgggcaa

SEQ ID NO: 385508 - RNA, 32 nt, Human
cgaagcauacugggggagggugugguggguuc

SEQ ID NO: 385509 - RNA, 32 nt, Human
cgaagccaaggcaggcaucaaaagccaaagug

SEQ ID NO: 385510 - RNA, 32 nt, Human
cgaagccaccuugcuuauucccauaggcuuac

SEQ ID NO: 385511 - RNA, 32 nt, Human
cgaagccagugcuugggcucugcugcugggag

SEQ ID NO: 385512 - RNA, 32 nt, Human
cgaagccauccaucaacauuuucuaacagcac

SEQ ID NO: 385513 - RNA, 32 nt, Human
cgaagccauugccauccacugcagacgccugg

SEQ ID NO: 385514 - RNA, 21 nt, Human
cgaagcccauuggggcggcgg

SEQ ID NO: 385515 - RNA, 32 nt, Human
cgaagccccagccaguggcagaacugggucuc

SEQ ID NO: 385516 - RNA, 23 nt, Human
cgaagccccugcgcgcucaggga

SEQ ID NO: 385517 - RNA, 32 nt, Human
cgaagccgagacuggaguucacggcugggccg

SEQ ID NO: 385518 - RNA, 22 nt, Human
cgaagccgggagcucgcaggga

SEQ ID NO: 385519 - RNA, 32 nt, Human
cgaagccuaggauaugagggcugaggaggacu

SEQ ID NO: 385520 - RNA, 32 nt, Human
cgaagccugagacccggaaggcccuggcaccc

SEQ ID NO: 385521 - RNA, 32 nt, Human
cgaagccuggggacucccagccccagagcucc

SEQ ID NO: 385522 - RNA, 32 nt, Human
cgaagccuguagucccagcuacucgggaggcu

SEQ ID NO: 385523 - RNA, 32 nt, Human
cgaagccuuccccucacaucucucucacuccc

SEQ ID NO: 385524 - RNA, 32 nt, Human
cgaagccuuccgggggcucuuuaccaggaacc

SEQ ID NO: 385525 - RNA, 32 nt, Human
cgaagccuugcugcuaacacugagguagcucu

SEQ ID NO: 385526 - RNA, 23 nt, Human
cgaagcgcagcccgccgcccgca

SEQ ID NO: 385527 - RNA, 32 nt, Human
cgaagcgccauccacgucuccugggccguggg

SEQ ID NO: 385528 - RNA, 18 nt, Human
cgaagcgcgcgugcgcgg

SEQ ID NO: 385529 - RNA, 22 nt, Human
cgaagcgcugcgcucgcgcccg

SEQ ID NO: 385530 - RNA, 32 nt, Human
cgaagcggccucucuccgccucaggcugccag

SEQ ID NO: 385531 - RNA, 19 nt, Human
cgaagcgggcgagcggugg

SEQ ID NO: 385532 - RNA, 19 nt, Human
cgaagcggggcgggaccgg

SEQ ID NO: 385533 - RNA, 32 nt, Human
cgaagcuagagagagagccagaggagggaaga

SEQ ID NO: 385534 - RNA, 32 nt, Human
cgaagcuauuucaguuccaggaauucugucug

SEQ ID NO: 385535 - RNA, 32 nt, Human
cgaagcucagccuaaucacugcuuccuccaaa

SEQ ID NO: 385536 - RNA, 32 nt, Human
cgaagcucagcuucgaagaugugaacaagaau

SEQ ID NO: 385537 - RNA, 32 nt, Human
cgaagcuccucccagccggucucucugugcuc

SEQ ID NO: 385538 - RNA, 32 nt, Human
cgaagcuccugccuuucugcagccucuacagg

SEQ ID NO: 385539 - RNA, 32 nt, Human
cgaagcucuaauugcccugaaggagaccgcgc

SEQ ID NO: 385540 - RNA, 32 nt, Human
cgaagcucuccccuuguugaaauaacacaaau

SEQ ID NO: 385541 - RNA, 32 nt, Human
cgaagcucugaccucaugaaacaucagcgagu

SEQ ID NO: 385542 - RNA, 32 nt, Human
cgaagcucugugguccgaucugcgguccgcuu

SEQ ID NO: 385543 - RNA, 32 nt, Human
cgaagcugacauuccucuggcaguccaguuca

SEQ ID NO: 385544 - RNA, 25 nt, Human
cgaagcugaggaagcuguugggggg

SEQ ID NO: 385545 - RNA, 32 nt, Human
cgaagcugaugaaguuccaaaaguaguucagu

SEQ ID NO: 385546 - RNA, 21 nt, Human
cgaagcugccgcgugcugcug

SEQ ID NO: 385547 - RNA, 32 nt, Human
cgaagcugccuuucuggccauccuugagaaaa

SEQ ID NO: 385548 - RNA, 21 nt, Human
cgaagcugcgcccggcgcccg

SEQ ID NO: 385549 - RNA, 21 nt, Human
cgaagcuggacgguacugcug

SEQ ID NO: 385550 - RNA, 32 nt, Human
cgaagcuggagcugcuagggcagcagcggcuc

SEQ ID NO: 385551 - RNA, 18 nt, Human
cgaagcuggggguggcgg

SEQ ID NO: 385552 - RNA, 23 nt, Human
cgaagcuggggucaggugagguc

SEQ ID NO: 385553 - RNA, 32 nt, Human
cgaagcuucaggaaguagaggauccagugaug

SEQ ID NO: 385554 - RNA, 32 nt, Human
cgaaggaagcacaaacccuccauccacuuccc

SEQ ID NO: 385555 - RNA, 32 nt, Human
cgaaggagaaggaggaagaggagaaggcggcg

SEQ ID NO: 385556 - RNA, 32 nt, Human
cgaaggaggagaagaagaagggaggggaaggc

SEQ ID NO: 385557 - RNA, 19 nt, Human
cgaaggaggccaucgggga

SEQ ID NO: 385558 - RNA, 32 nt, Human
cgaaggaguggaagaggagacaauuugaauga

SEQ ID NO: 385559 - RNA, 32 nt, Human
cgaaggaugccucacuaacuaguuuuaucccu

SEQ ID NO: 385560 - RNA, 32 nt, Human
cgaaggcacucccauuccccucugcauauggu

SEQ ID NO: 385561 - RNA, 32 nt, Human
cgaaggcagcacaggaccuggaaaaauuacau

SEQ ID NO: 385562 - RNA, 27 nt, Human
cgaaggcaggagauggcuugagcccua

SEQ ID NO: 385563 - RNA, 32 nt, Human
cgaaggcaggguguccggagagcggugggcug

SEQ ID NO: 385564 - RNA, 32 nt, Human
cgaaggcaucaacauuucuggcaauuucuaca

SEQ ID NO: 385565 - RNA, 32 nt, Human
cgaaggccacguggcuuccguugacucagugc

SEQ ID NO: 385566 - RNA, 31 nt, Human
cgaaggcccaauaaauauuuguagaauaaag

SEQ ID NO: 385567 - RNA, 32 nt, Human
cgaaggcccagcccuggcccuggccgcggucu

SEQ ID NO: 385568 - RNA, 18 nt, Human
cgaaggcggcgcggccgg

SEQ ID NO: 385569 - RNA, 18 nt, Human
cgaaggcggcggcgaagg

SEQ ID NO: 385570 - RNA, 17 nt, Human
cgaaggcgggcugagcc

SEQ ID NO: 385571 - RNA, 22 nt, Human
cgaaggcugagagcuggcgcug

SEQ ID NO: 385572 - RNA, 21 nt, Human
cgaaggcugagguggcagcgg

SEQ ID NO: 385573 - RNA, 32 nt, Human
cgaaggcugcccagagagguggagucgguagc

SEQ ID NO: 385574 - RNA, 21 nt, Human
cgaaggcugcggcgcggcgcu

SEQ ID NO: 385575 - RNA, 18 nt, Human
cgaagggagaaguuggga

SEQ ID NO: 385576 - RNA, 32 nt, Human
cgaagggagagggaccuuaggggagcagagaa

SEQ ID NO: 385577 - RNA, 32 nt, Human
cgaagggaggggaggccaggaggggagcugcu

SEQ ID NO: 385578 - RNA, 32 nt, Human
cgaagggcagagccaagaagucagcccugacu

SEQ ID NO: 385579 - RNA, 32 nt, Human
cgaagggcagccccugccgacuccagguccua

SEQ ID NO: 385580 - RNA, 21 nt, Human
cgaagggcguuuggguacugc

SEQ ID NO: 385581 - RNA, 32 nt, Human
cgaaggggaggcacacuuucugcaaacguuuc

SEQ ID NO: 385582 - RNA, 32 nt, Human
cgaaggggauaucaccaccaaucccacagaaa

SEQ ID NO: 385583 - RNA, 32 nt, Human
cgaaggggccuaguguucccagcacugugccu

SEQ ID NO: 385584 - RNA, 32 nt, Human
cgaaggggcucccagccauggaaagcccugga

SEQ ID NO: 385585 - RNA, 32 nt, Human
cgaaggggcuucuuccagagccaaggaggaag

SEQ ID NO: 385586 - RNA, 32 nt, Human
cgaagggggaggaucgcuugagcccaggaguu

SEQ ID NO: 385587 - RNA, 32 nt, Human
cgaagggggcacaggagaggagaggggcugug

SEQ ID NO: 385588 - RNA, 32 nt, Human
cgaagggggcaggccagggagaggcgcaggag

SEQ ID NO: 385589 - RNA, 32 nt, Human
cgaagggggcgugacagauaagaguggcauuu

SEQ ID NO: 385590 - RNA, 32 nt, Human
cgaagggugguauguggagcuggaaggucuug

SEQ ID NO: 385591 - RNA, 32 nt, Human
cgaaggucugcaacuucacuccuggggccagc

SEQ ID NO: 385592 - RNA, 32 nt, Human
cgaaggucugcagcuucacuccugaagccagc

SEQ ID NO: 385593 - RNA, 32 nt, Human
cgaaggucugcagcuucacuccugagccagcc

SEQ ID NO: 385594 - RNA, 32 nt, Human
cgaaggucugcagcuucacuccugagccagcg

SEQ ID NO: 385595 - RNA, 32 nt, Human
cgaaggucugcagcuucacuccugagccaggg

SEQ ID NO: 385596 - RNA, 32 nt, Human
cgaaggugagugaagauggcagagaggacgug

SEQ ID NO: 385597 - RNA, 32 nt, Human
cgaagguggggugggaccaggcugccccucgc

SEQ ID NO: 385598 - RNA, 32 nt, Human
cgaaguaaagggaguaggggagacugagacug

SEQ ID NO: 385599 - RNA, 30 nt, Human
cgaaguacauugcaaucacgauggccuuuu

SEQ ID NO: 385600 - RNA, 32 nt, Human
cgaaguacccuaggaaucucucucccucacuc

SEQ ID NO: 385601 - RNA, 21 nt, Human
cgaaguagcugggauuacagg

SEQ ID NO: 385602 - RNA, 32 nt, Human
cgaaguauuuucugaguguugagaagaaugag

SEQ ID NO: 385603 - RNA, 32 nt, Human
cgaagucaagacgucuggaaagaauuacccag

SEQ ID NO: 385604 - RNA, 32 nt, Human
cgaagucaagaguucaagaccagccuggccaa

SEQ ID NO: 385605 - RNA, 32 nt, Human
cgaagucacacgcacacaugcacgcacacaca

SEQ ID NO: 385606 - RNA, 32 nt, Human
cgaagucagcagacacuagacacuccaaagac

SEQ ID NO: 385607 - RNA, 32 nt, Human
cgaagucaggagaucaagaccaucuggcuaac

SEQ ID NO: 385608 - RNA, 32 nt, Human
cgaagucaggagaucgagaccaaccuggcuaa

SEQ ID NO: 385609 - RNA, 32 nt, Human
cgaagucauacucuugcucccaccccacccuu

SEQ ID NO: 385610 - RNA, 32 nt, Human
cgaagucaucugcacaaggcuaccaacugcaa

SEQ ID NO: 385611 - RNA, 22 nt, Human
cgaagucccgcugccucuaagc

SEQ ID NO: 385612 - RNA, 32 nt, Human
cgaaguccggaacuggucuucugugauuuuca

SEQ ID NO: 385613 - RNA, 32 nt, Human
cgaagucucauggcagucccaaaggaggcuua

SEQ ID NO: 385614 - RNA, 22 nt, Human
cgaagucuucaacuuccugcug

SEQ ID NO: 385615 - RNA, 32 nt, Human
cgaagugaagaacaaggcuggccacacaccac

SEQ ID NO: 385616 - RNA, 32 nt, Human
cgaagugacucacaccugcaaucccagcacuu

SEQ ID NO: 385617 - RNA, 32 nt, Human
cgaagugcaaggccacggccagagcucgagcc

SEQ ID NO: 385618 - RNA, 32 nt, Human
cgaagugcaguggcucaugccuguaaucucag

SEQ ID NO: 385619 - RNA, 22 nt, Human
cgaagugcucccggugcccgca

SEQ ID NO: 385620 - RNA, 32 nt, Human
cgaagugcucgagugcuuagaaacccccucug

SEQ ID NO: 385621 - RNA, 20 nt, Human
cgaagugcugggauuacagg

SEQ ID NO: 385622 - RNA, 22 nt, Human
cgaagugcugggauuacaggug

SEQ ID NO: 385623 - RNA, 20 nt, Human
cgaagugcugggauuauagg

SEQ ID NO: 385624 - RNA, 22 nt, Human
cgaagugcugggauuauaggug

SEQ ID NO: 385625 - RNA, 20 nt, Human
cgaagugcugggauugcagg

SEQ ID NO: 385626 - RNA, 19 nt, Human
cgaagugcuguggcggugg

SEQ ID NO: 385627 - RNA, 22 nt, Human
cgaagugcuuggauuacaggug

SEQ ID NO: 385628 - RNA, 32 nt, Human
cgaaguggcccaugccuguaaucucagcacuc

SEQ ID NO: 385629 - RNA, 32 nt, Human
cgaagugggcagaucacuugaggucaagaguu

SEQ ID NO: 385630 - RNA, 32 nt, Human
cgaagugggcggaucacuugaggucagcaguu

SEQ ID NO: 385631 - RNA, 32 nt, Human
cgaaguggguggaucacuugaggccaggaguu

SEQ ID NO: 385632 - RNA, 20 nt, Human
cgcagcacugguccgggaca

SEQ ID NO: 385633 - RNA, 32 nt, Human
cgcagcacuguacuccagccugggcgauggag

SEQ ID NO: 385634 - RNA, 20 nt, Human
cgcagcagagagccugggag

SEQ ID NO: 385635 - RNA, 32 nt, Human
cgcagcagagguuucccuugaagugcaagagg

SEQ ID NO: 385636 - RNA, 22 nt, Human
cgcagcagcagcagccagggca

SEQ ID NO: 385637 - RNA, 32 nt, Human
cgcagcagccaucuuagacuugagggcucugu

SEQ ID NO: 385638 - RNA, 16 nt, Human
cgcagcagccggagca

SEQ ID NO: 385639 - RNA, 32 nt, Human
cgcagcagccucccucccucucagcagcuaga

SEQ ID NO: 385640 - RNA, 32 nt, Human
cgcagcagccugacgcuagaggacaucugcgg

SEQ ID NO: 385641 - RNA, 26 nt, Human
cgcagcagcggcggcagcagcagcgg

SEQ ID NO: 385642 - RNA, 32 nt, Human
cgcagcagcuggagaggaaggggugaggcgug

SEQ ID NO: 385643 - RNA, 26 nt, Human
cgcagcaggaaccaggcuccaggcgc

SEQ ID NO: 385644 - RNA, 19 nt, Human
cgcagcaggagcagccagc

SEQ ID NO: 385645 - RNA, 19 nt, Human
cgcagcaggcugccugcug

SEQ ID NO: 385646 - RNA, 32 nt, Human
cgcagcagguucucacaaaauaacuggugcua

SEQ ID NO: 385647 - RNA, 32 nt, Human
cgcagcauggcugugguggacgcgggaaacaa

SEQ ID NO: 385648 - RNA, 19 nt, Human
cgcagccaacggcucgggc

SEQ ID NO: 385649 - RNA, 32 nt, Human
cgcagccaaggucuguguucagcacuuggucu

SEQ ID NO: 385650 - RNA, 27 nt, Human
cgcagccaccugggccgcuaccuggcg

SEQ ID NO: 385651 - RNA, 32 nt, Human
cgcagccagaagcccuggccagugaggagcuc

SEQ ID NO: 385652 - RNA, 32 nt, Human
cgcagccagcgccaugcaaaacuacaaguacg

SEQ ID NO: 385653 - RNA, 32 nt, Human
cgcagccaggagaccgaggugcuguaccagcu

SEQ ID NO: 385654 - RNA, 21 nt, Human
cgcagccaggccucugcugcc

SEQ ID NO: 385655 - RNA, 32 nt, Human
cgcagcccaaaaacaaaugguuaggcugcaga

SEQ ID NO: 385656 - RNA, 32 nt, Human
cgcagcccacccgggaagccacggugaccagc

SEQ ID NO: 385657 - RNA, 32 nt, Human
cgcagcccacccugcgccacucagccucugcg

SEQ ID NO: 385658 - RNA, 32 nt, Human
cgcagcccaucucuagaugaaagggggaaugu

SEQ ID NO: 385659 - RNA, 21 nt, Human
cgcagccccaggcagccgggg

SEQ ID NO: 385660 - RNA, 21 nt, Human
cgcagccccccggcccugaga

SEQ ID NO: 385661 - RNA, 32 nt, Human
cgcagcccccuucucaucuccacccaagaagu

SEQ ID NO: 385662 - RNA, 19 nt, Human
cgcagccccggccgccagg

SEQ ID NO: 385663 - RNA, 32 nt, Human
cgcagccccggcgcggccgccugguggcgaug

SEQ ID NO: 385664 - RNA, 32 nt, Human
cgcagccccucagaccucacgcuacagucacc

SEQ ID NO: 385665 - RNA, 32 nt, Human
cgcagccccuccugccccuccugccaggcccu

SEQ ID NO: 385666 - RNA, 32 nt, Human
cgcagcccgccuggccggagcugugggagucc

SEQ ID NO: 385667 - RNA, 19 nt, Human
cgcagcccggcggcgcagg

SEQ ID NO: 385668 - RNA, 32 nt, Human
cgcagcccucauuuaugauuccugccagauuu

SEQ ID NO: 385669 - RNA, 32 nt, Human
cgcagcccuccagucccuacuucaggcugagc

SEQ ID NO: 385670 - RNA, 32 nt, Human
cgcagcccuccaguguggcugcaggcgguggu

SEQ ID NO: 385671 - RNA, 20 nt, Human
cgcagcccucgggcgcgagg

SEQ ID NO: 385672 - RNA, 32 nt, Human
cgcagcccuuuccugggacauggauguacaug

SEQ ID NO: 385673 - RNA, 32 nt, Human
cgcagccgagcagcggcucuuucagcauuggc

SEQ ID NO: 385674 - RNA, 32 nt, Human
cgcagccgaggggcucuggagugccuuagagc

SEQ ID NO: 385675 - RNA, 32 nt, Human
cgcagccgaggugggagcacgggcaggcucag

SEQ ID NO: 385676 - RNA, 21 nt, Human
cgcagccgccgccgccgccgc

SEQ ID NO: 385677 - RNA, 32 nt, Human
cgcagccgcugggagcccccggcagagcuggg

SEQ ID NO: 385678 - RNA, 32 nt, Human
cgcagccggcgccuuguugagggaacggaccc

SEQ ID NO: 385679 - RNA, 32 nt, Human
cgcagccgucuguccuugaucugcccgcggcg

SEQ ID NO: 385680 - RNA, 32 nt, Human
cgcagccgugcgauguuguccucuacagccau

SEQ ID NO: 385681 - RNA, 19 nt, Human
cgcagccucagccagggag

SEQ ID NO: 385682 - RNA, 32 nt, Human
cgcagccucccaucccaggauucauguuuuca

SEQ ID NO: 385683 - RNA, 32 nt, Human
cgcagccuccuccagccgcgagcccagcugca

SEQ ID NO: 385684 - RNA, 32 nt, Human
cgcagccuccuugagccuggcaucccaggccu

SEQ ID NO: 385685 - RNA, 32 nt, Human
cgcagccucggggaaaccuaccugcacacaga

SEQ ID NO: 385686 - RNA, 32 nt, Human
cgcagccucucugauucucucucccucuccgc

SEQ ID NO: 385687 - RNA, 32 nt, Human
cgcagccuggagagucgggaccaccugcaccg

SEQ ID NO: 385688 - RNA, 32 nt, Human
cgcagccugggugggugaggggagagacggua

SEQ ID NO: 385689 - RNA, 32 nt, Human
cgcagcgacauggagggagcugcuuugcugaa

SEQ ID NO: 385690 - RNA, 32 nt, Human
cgcagcgagccgcggcccgggcgggcugcucg

SEQ ID NO: 385691 - RNA, 32 nt, Human
cgcagcgagcgagagcgcggcggccgcgggcu

SEQ ID NO: 385692 - RNA, 32 nt, Human
cgcagcgagcuacagacgggggcgcggcacuc

SEQ ID NO: 385693 - RNA, 32 nt, Human
cgcagcgaggaggcggcggggaagaagcgcag

SEQ ID NO: 385694 - RNA, 32 nt, Human
cgcagcgcaggcggagcggcagcggggccucg

SEQ ID NO: 385695 - RNA, 23 nt, Human
cgcagcgccagccucgagcuccu

SEQ ID NO: 385696 - RNA, 32 nt, Human
cgcagcgccagccucgagcuccucgguagccc

SEQ ID NO: 385697 - RNA, 23 nt, Human
cgcagcgccgccgcccggccccu

SEQ ID NO: 385698 - RNA, 32 nt, Human
cgcagcgccgcggucucuccagccucuggucc

SEQ ID NO: 385699 - RNA, 21 nt, Human
cgcagcgccuucuccagccgc

SEQ ID NO: 385700 - RNA, 32 nt, Human
cgcagcgcgccgcgauucaccagccugguccc

SEQ ID NO: 385701 - RNA, 32 nt, Human
cgcagcgcggcagaggaaggcgaggcgagcuu

SEQ ID NO: 385702 - RNA, 32 nt, Human
cgcagcgcgggugggaggcggggaggagcagc

SEQ ID NO: 385703 - RNA, 32 nt, Human
cgcagcgcuacccuuuuccgcuccacggugac

SEQ ID NO: 385704 - RNA, 32 nt, Human
cgcagcgcuccaggauucugcggcucggaacu

SEQ ID NO: 385705 - RNA, 32 nt, Human
cgcagcggagaggcacuagucaccgacagcgg

SEQ ID NO: 385706 - RNA, 32 nt, Human
cgcagcggcgagugcacagagcagggaaaggc

SEQ ID NO: 385707 - RNA, 32 nt, Human
cgcagcggcucacgccuguaaucccagcacuu

SEQ ID NO: 385708 - RNA, 32 nt, Human
cgcagcggcucaugccuguaaucccagcacuu

SEQ ID NO: 385709 - RNA, 32 nt, Human
cgcagcggggagugggaccggcuuccagccug

SEQ ID NO: 385710 - RNA, 32 nt, Human
cgcagcgggggcgggaagguuguagugccgcg

SEQ ID NO: 385711 - RNA, 32 nt, Human
cgcagcggugcucuggggccaggugccaccgg

SEQ ID NO: 385712 - RNA, 24 nt, Human
cgcagcguaacugcaggccucuca

SEQ ID NO: 385713 - RNA, 32 nt, Human
cgcagcguccagggguuggaggagggccccgg

SEQ ID NO: 385714 - RNA, 32 nt, Human
cgcagcgugagggugugucuucccuggauagc

SEQ ID NO: 385715 - RNA, 22 nt, Human
cgcagcguggggccccgagcgc

SEQ ID NO: 385716 - RNA, 32 nt, Human
cgcagcuaucagacagagacccugcccaugau

SEQ ID NO: 385717 - RNA, 32 nt, Human
cgcagcuauggagccgcaggaggagagagaaa

SEQ ID NO: 385718 - RNA, 32 nt, Human
cgcagcucacugcaaucucugccuccuggguu

SEQ ID NO: 385719 - RNA, 32 nt, Human
cgcagcucagugcucuagccggggcaagcccg

SEQ ID NO: 385720 - RNA, 32 nt, Human
cgcagcucuggugggaggaaggcgagcccuca

SEQ ID NO: 385721 - RNA, 23 nt, Human
cgcagcugaagccgccccggagc

SEQ ID NO: 385722 - RNA, 24 nt, Human
cgcagcugaccaugaacauccccu

SEQ ID NO: 385723 - RNA, 32 nt, Human
cgcagcugacugcagccucaaccuuccaggcu

SEQ ID NO: 385724 - RNA, 32 nt, Human
cgcagcugagucgggcuggagaagcugggcag

SEQ ID NO: 385725 - RNA, 32 nt, Human
cgcagcugccagccaggggucugggugggcac

SEQ ID NO: 385726 - RNA, 32 nt, Human
cgcagcugccgccgccgccagggcccggacuc

SEQ ID NO: 385727 - RNA, 31 nt, Human
cgcagcugccucuccgucuuugugucugucu

SEQ ID NO: 385728 - RNA, 32 nt, Human
cgcagcugcucagggacagcagucuccccggg

SEQ ID NO: 385729 - RNA, 32 nt, Human
cgcagcuggacucugugcaacugggaguggag

SEQ ID NO: 385730 - RNA, 32 nt, Human
cgcagcuggagcagggcugagcccaggagcau

SEQ ID NO: 385731 - RNA, 32 nt, Human
cgcagcuggagugagaggcagguggcggccgg

SEQ ID NO: 385732 - RNA, 32 nt, Human
cgcagcugggcuggcgggaggcauggaggcug

SEQ ID NO: 385733 - RNA, 32 nt, Human
cgcagcuggggccuggcacacagggucccugu

SEQ ID NO: 385734 - RNA, 32 nt, Human
cgcagcugguuugcacagccucccgacugugc

SEQ ID NO: 385735 - RNA, 32 nt, Human
cgcagcuguuccugaauggauuucuugcucag

SEQ ID NO: 385736 - RNA, 32 nt, Human
cgcagcuucugagacuggaagucuggaggaag

SEQ ID NO: 385737 - RNA, 16 nt, Human
cgcagcuuggccugca

SEQ ID NO: 385738 - RNA, 32 nt, Human
cgcaggaacagccccguggcgcccucucuggc

SEQ ID NO: 385739 - RNA, 32 nt, Human
cgcaggaaccagggauaccaucugguccagug

SEQ ID NO: 385740 - RNA, 32 nt, Human
cgcaggaagggccuacagcccauuucuccaua

SEQ ID NO: 385741 - RNA, 32 nt, Human
cgcaggacaaaaggacucuggccacccagcag

SEQ ID NO: 385742 - RNA, 32 nt, Human
cgcaggacaggcaggagagauucuuccuaaag

SEQ ID NO: 385743 - RNA, 25 nt, Human
cgcaggaccggcgggcgcgcgcggg

SEQ ID NO: 385744 - RNA, 32 nt, Human
cgcaggacggcaccgaggugguggugaaagag

SEQ ID NO: 385745 - RNA, 32 nt, Human
cgcaggagccaagagcaagggacgccgccacg

SEQ ID NO: 385746 - RNA, 32 nt, Human
cgcaggagccccgggaaucuggaggggccgug

SEQ ID NO: 385747 - RNA, 32 nt, Human
cgcaggagccgagucaggcucucuccacugcc

SEQ ID NO: 385748 - RNA, 32 nt, Human
cgcaggagccuauccugaauuuuguaaaauau

SEQ ID NO: 385749 - RNA, 32 nt, Human
cgcaggaggaaggagguugugcagggucugga

SEQ ID NO: 385750 - RNA, 32 nt, Human
cgcaggaggcugaggcugcagugaguugugau

SEQ ID NO: 385751 - RNA, 32 nt, Human
cgcaggaggugaaaaugcuuucuuggccaggg

SEQ ID NO: 385752 - RNA, 32 nt, Human
cgcaggaguagaauugcggaggcuugggccau

SEQ ID NO: 385753 - RNA, 32 nt, Human
cgcaggaucggaggguucggaggacucggagg

SEQ ID NO: 385754 - RNA, 32 nt, Human
cgcaggaucucacagcugcagucuaauaguaa

SEQ ID NO: 385755 - RNA, 32 nt, Human
cgcaggcaaauuugaagcuuugcuugucauuc

SEQ ID NO: 385756 - RNA, 21 nt, Human
cgcaggcaacaguaacucuga

SEQ ID NO: 385757 - RNA, 32 nt, Human
cgcaggcacacaggccagagcuucguggauac

SEQ ID NO: 385758 - RNA, 22 nt, Human
cgcaggcacuccaggcucugca

SEQ ID NO: 385759 - RNA, 32 nt, Human
cgcaggcagagaagcugcaggagcugcugcgg

SEQ ID NO: 385760 - RNA, 32 nt, Human
cgcaggcagggugagcaaggauggcguggaac

SEQ ID NO: 385761 - RNA, 32 nt, Human
cgcaggcagggugugcugccugagauggcacc

SEQ ID NO: 385762 - RNA, 32 nt, Human
cgcaggcaguucuucuuagguuccgucucacg

SEQ ID NO: 385763 - RNA, 23 nt, Human
cgcaggccagggccgcccggcgc

SEQ ID NO: 385764 - RNA, 32 nt, Human
cgcaggccagugugugcgcgcaccgugcgcga

SEQ ID NO: 385765 - RNA, 32 nt, Human
cgcaggccaugaggacccacugggcagcuccu

SEQ ID NO: 385766 - RNA, 32 nt, Human
cgcaggcccacagccaggagcaguagacagcg

SEQ ID NO: 385767 - RNA, 32 nt, Human
cgcaggcccacugugcagcccccaagucacca

SEQ ID NO: 385768 - RNA, 32 nt, Human
cgcaggcccggagaauguggccccagacugaa

SEQ ID NO: 385769 - RNA, 32 nt, Human
cgcaggcccgggaggacgcggcggcgggaacc

SEQ ID NO: 385770 - RNA, 18 nt, Human
cgcaggcccucacgcgua

SEQ ID NO: 385771 - RNA, 32 nt, Human
cgcaggccgaguuccagaccagccugggaaac

SEQ ID NO: 385772 - RNA, 32 nt, Human
cgcaggccugggaggaaagugggcgcagagcc

SEQ ID NO: 385773 - RNA, 32 nt, Human
cgcaggcgaguagggccagacaugguggcuca

SEQ ID NO: 385774 - RNA, 32 nt, Human
cgcaggcgcagagagacaggaggcugaugggg

SEQ ID NO: 385775 - RNA, 32 nt, Human
cgcaggcggcggggcgcuggggaaucuuccuc

SEQ ID NO: 385776 - RNA, 23 nt, Human
cgcaggcggugacgcagcugcuc

SEQ ID NO: 385777 - RNA, 20 nt, Human
cgcaggcuagagugcagugg

SEQ ID NO: 385778 - RNA, 25 nt, Human
cgcaggcucagggcccuggauuccc

SEQ ID NO: 385779 - RNA, 32 nt, Human
cgcaggcucagggcccuggauucccgcuuucu

SEQ ID NO: 385780 - RNA, 32 nt, Human
cgcaggcucccaggaauccuaaugucacgauc

SEQ ID NO: 385781 - RNA, 32 nt, Human
cgcaggcucccugcgggagcaggcugggcuca

SEQ ID NO: 385782 - RNA, 32 nt, Human
cgcaggcucugcccccgggcuccgguggugcg

SEQ ID NO: 385783 - RNA, 32 nt, Human
cgcaggcugcaacccuggugugcugggcgaaa

SEQ ID NO: 385784 - RNA, 32 nt, Human
cgcaggcugccaggcuggcguacaguggcgca

SEQ ID NO: 385785 - RNA, 20 nt, Human
cgcaggcuggagugcagugg

SEQ ID NO: 385786 - RNA, 32 nt, Human
cgcaggcugggcugcaggcucucggcugcagc

SEQ ID NO: 385787 - RNA, 23 nt, Human
cgcaggcuuaguaacgccgugga

SEQ ID NO: 385788 - RNA, 32 nt, Human
cgcagggaaaggcugcgcgggagaagccgcug

SEQ ID NO: 385789 - RNA, 27 nt, Human
cgcagggaccggccaggcgggcugcag

SEQ ID NO: 385790 - RNA, 32 nt, Human
cgcagggagagggagggcacgggcgcgggccg

SEQ ID NO: 385791 - RNA, 32 nt, Human
cgcagggagcagcuccagcugccuggcagugc

SEQ ID NO: 385792 - RNA, 32 nt, Human
cgcagggaggcagggauggcaaggcgugaagc

SEQ ID NO: 385793 - RNA, 32 nt, Human
cgcagggagucugccaucugccuccaggcccg

SEQ ID NO: 385794 - RNA, 25 nt, Human
cgcagggcacacucaaggccgcugc

SEQ ID NO: 385795 - RNA, 32 nt, Human
cgcagggcagacggcggcaggagaagcaagau

SEQ ID NO: 385796 - RNA, 22 nt, Human
cgcagggcagcggcgucgcggg

SEQ ID NO: 385797 - RNA, 32 nt, Human
cgcagggcagggggacugggcggugguggcug

SEQ ID NO: 385798 - RNA, 25 nt, Human
cgcagggccaagccgaggcagccgc

SEQ ID NO: 385799 - RNA, 32 nt, Human
cgcagggcccgaguccuccucgguaaugaguc

SEQ ID NO: 385800 - RNA, 19 nt, Human
cgcagggccgugcaccugc

SEQ ID NO: 385801 - RNA, 21 nt, Human
cgcagggccugccgccacugc

SEQ ID NO: 385802 - RNA, 32 nt, Human
cgcagggccugcucuucuuccggcaggaccag

SEQ ID NO: 385803 - RNA, 18 nt, Human
cgcagggcucugccacau

SEQ ID NO: 385804 - RNA, 32 nt, Human
cgcaggggaagagaaagcaggagccguccagc

SEQ ID NO: 385805 - RNA, 32 nt, Human
cgcaggggagccggcuggagugagcuggcugg

SEQ ID NO: 385806 - RNA, 32 nt, Human
cgcaggggcaugcgccuagaaucccagcuacu

SEQ ID NO: 385807 - RNA, 32 nt, Human
cgcaggggcccaggaaugucccagaaucaagg

SEQ ID NO: 385808 - RNA, 24 nt, Human
cgcaggggccccuccuccagagcc

SEQ ID NO: 385809 - RNA, 32 nt, Human
cgcaggggcucacaccuguaaucccagcaccu

SEQ ID NO: 385810 - RNA, 21 nt, Human
cgcaggggcugggcagcugcc

SEQ ID NO: 385811 - RNA, 32 nt, Human
cgcaggggcuguagggaggugaucucauccau

SEQ ID NO: 385812 - RNA, 23 nt, Human
cgcagggggauggcccccggcgc

SEQ ID NO: 385813 - RNA, 32 nt, Human
cgcaggggguucccccugcugaggagagacca

SEQ ID NO: 385814 - RNA, 32 nt, Human
cgcaggguggcugucuuuguuccagcacuguu

SEQ ID NO: 385815 - RNA, 32 nt, Human
cgcaggguuagagugggcuccuuucuuuuugg

SEQ ID NO: 385816 - RNA, 32 nt, Human
  misc_feature (7)..(7): n is a, c, g or u
cgcaggngcucacaccuguaauccuagcacuu

SEQ ID NO: 385817 - RNA, 32 nt, Human
cgcagguccgugccauggggaaguucuucaga

SEQ ID NO: 385818 - RNA, 32 nt, Human
cgcaggucucugagccgggugcggaaggaggg

SEQ ID NO: 385819 - RNA, 15 nt, Human
cgcaggucugagcug

SEQ ID NO: 385820 - RNA, 32 nt, Human
cgcaggucugaggagcugagaagggaggcuua

SEQ ID NO: 385821 - RNA, 32 nt, Human
cgcaggucuuucuucuucuagcuuccacccac

SEQ ID NO: 385822 - RNA, 32 nt, Human
cgcaggugcagagagacaggaggcugaugggg

SEQ ID NO: 385823 - RNA, 22 nt, Human
cgcaggugggcagcgcgcacgg

SEQ ID NO: 385824 - RNA, 32 nt, Human
cgcaggugguucccucauucgagugcuccggc

SEQ ID NO: 385825 - RNA, 32 nt, Human
cgcaggugugagccaccacacccggcccugau

SEQ ID NO: 385826 - RNA, 32 nt, Human
cgcaggugugugccaccauuucuggcuaguuu

SEQ ID NO: 385827 - RNA, 32 nt, Human
cgcagguugaagcaagcugcucugcaagguga

SEQ ID NO: 385828 - RNA, 32 nt, Human
cgcagguugcuuucccacccugggcaaugcag

SEQ ID NO: 385829 - RNA, 21 nt, Human
cgcaguagcugggacuacagg

SEQ ID NO: 385830 - RNA, 32 nt, Human
cgcaguaggaggugggggcgaagagagggcug

SEQ ID NO: 385831 - RNA, 32 nt, Human
cgcagucacccagguccagaggcggcgguauc

SEQ ID NO: 385832 - RNA, 32 nt, Human
cgcagucagggaacaggugaggaaagaaauaa

SEQ ID NO: 385833 - RNA, 32 nt, Human
cgcagucccaggagccgagcuccagcacuaga

SEQ ID NO: 385834 - RNA, 32 nt, Human
cgcaguccuaacagggugagaaagcacaagag

SEQ ID NO: 385835 - RNA, 32 nt, Human
cgcaguccugggagccagcggccaccugcggg

SEQ ID NO: 385836 - RNA, 32 nt, Human
cgcaguccugugggaagcauucaggcucagaa

SEQ ID NO: 385837 - RNA, 32 nt, Human
cgcagucggcggugggggaugggcaggcagug

SEQ ID NO: 385838 - RNA, 32 nt, Human
cgcagucggugaagcacaggagacugaagcag

SEQ ID NO: 385839 - RNA, 32 nt, Human
cgcagucucagcucccugcucuacggcuccau

SEQ ID NO: 385840 - RNA, 24 nt, Human
cgcagucuggccugggcgacagag

SEQ ID NO: 385841 - RNA, 32 nt, Human
cgcagucuugguggaggagguggugaccacca

SEQ ID NO: 385842 - RNA, 32 nt, Human
cgcagugaacuuaaagcaaagaccucuuagua

SEQ ID NO: 385843 - RNA, 32 nt, Human
cgcagugacagcgccucaccgccaccagcucc

SEQ ID NO: 385844 - RNA, 32 nt, Human
cgcagugacucacgccuguaaucccagcacuu

SEQ ID NO: 385845 - RNA, 32 nt, Human
cgcagugacucugaggagaaggagccgccugu

SEQ ID NO: 385846 - RNA, 32 nt, Human
cgcagugacuuacgccuguaaucucagcacuu

SEQ ID NO: 385847 - RNA, 32 nt, Human
cgcagugagcaugcucggccuccugcgggaag

SEQ ID NO: 385848 - RNA, 19 nt, Human
cgcagugaggcccugggug

SEQ ID NO: 385849 - RNA, 32 nt, Human
cgcagugaguccugccuggcucuaagcaccac

SEQ ID NO: 385850 - RNA, 21 nt, Human
cgcagugcagagccccaaagc

SEQ ID NO: 385851 - RNA, 32 nt, Human
cgcagugcagagccccaaagcucaggcuauug

SEQ ID NO: 385852 - RNA, 32 nt, Human
cgcagugcagugaguucaugcaccuucuugcc

SEQ ID NO: 385853 - RNA, 32 nt, Human
cgcagugcaugcugggugcaugaagggcagcc

SEQ ID NO: 385854 - RNA, 32 nt, Human
cgcagugccucaugccuguaaucccagcacuu

SEQ ID NO: 385855 - RNA, 32 nt, Human
cgcagugccuggcaguccagaggcagugggau

SEQ ID NO: 385856 - RNA, 20 nt, Human
cgcagugcugggauuacagg

SEQ ID NO: 385857 - RNA, 32 nt, Human
cgcagugcuugggaacauacuguauccucgaa

SEQ ID NO: 385858 - RNA, 32 nt, Human
cgcaguggagccagcacagcggauguuuucac

SEQ ID NO: 385859 - RNA, 32 nt, Human
cgcaguggaucgcaccuguaaucccagucacu

SEQ ID NO: 385860 - RNA, 32 nt, Human
cgcaguggcacgcgccuguaaucccagcuacu

SEQ ID NO: 385861 - RNA, 30 nt, Human
cgcaguggcaggaucucagcucaacacauc

SEQ ID NO: 385862 - RNA, 32 nt, Human
cgcaguggcuaacgccuguaaucccagcacuu

SEQ ID NO: 385863 - RNA, 32 nt, Human
cgcaguggcucaagccuguaaucccagcauuu

SEQ ID NO: 385864 - RNA, 32 nt, Human
cgcaguggcucacaccuauaaccccagcuaug

SEQ ID NO: 385865 - RNA, 32 nt, Human
cgcaguggcucacaccucuaaucccagcacuu

SEQ ID NO: 385866 - RNA, 32 nt, Human
cgcaguggcucacaccuguaaucccaacacuu

SEQ ID NO: 385867 - RNA, 32 nt, Human
cgcaguggcucacaccuguaaucccagaacuu

SEQ ID NO: 385868 - RNA, 32 nt, Human
cgcaguggcucacaccuguaaucccagcacuu

SEQ ID NO: 385869 - RNA, 32 nt, Human
cgcaguggcucacaccuguaauccuagcacuu

SEQ ID NO: 385870 - RNA, 32 nt, Human
cgcaguggcucacaccuguaauccugcacuuu

SEQ ID NO: 385871 - RNA, 32 nt, Human
cgcaguggcucacaccuguaaucucagcacuu

SEQ ID NO: 385872 - RNA, 32 nt, Human
cgcaguggcucacaccuguagucccagcacuu

SEQ ID NO: 385873 - RNA, 32 nt, Human
cgcaguggcucacaucuguaaucucagcauuu

SEQ ID NO: 385874 - RNA, 32 nt, Human
cgcaguggcucaccccuguaaucucagcacuu

SEQ ID NO: 385875 - RNA, 32 nt, Human
cgcaguggcucaccucuguaaucccagcacuu

SEQ ID NO: 385876 - RNA, 32 nt, Human
cgcaguggcucacgccuauaaucccaacacuu

SEQ ID NO: 385877 - RNA, 32 nt, Human
cgcaguggcucacgccuauaaucccagaggcu

SEQ ID NO: 385878 - RNA, 32 nt, Human
cgcaguggcucacgccuauaaucccagcacuu

SEQ ID NO: 385879 - RNA, 32 nt, Human
cgcaguggcucacgccuguaaucccaacaaca

SEQ ID NO: 385880 - RNA, 32 nt, Human
cgcaguggcucacgccuguaaucccaacaccu

SEQ ID NO: 385881 - RNA, 32 nt, Human
cgcaguggcucacgccuguaaucccaacacuu

SEQ ID NO: 385882 - RNA, 32 nt, Human
cgcaguggcucacgccuguaaucccaacauuu

SEQ ID NO: 385883 - RNA, 32 nt, Human
cgcaguggcucacgccuguaaucccagcacug

SEQ ID NO: 385884 - RNA, 32 nt, Human
cgcaguggcucacgccuguaaucccagcacuu

SEQ ID NO: 385885 - RNA, 32 nt, Human
cgcaguggcucacgccuguaaucccagcccuu

SEQ ID NO: 385886 - RNA, 32 nt, Human
cgcaguggcucacgccuguaaucccagcgcuu

SEQ ID NO: 385887 - RNA, 32 nt, Human
cgcaguggcucacgccuguaaucccggcacug

SEQ ID NO: 385888 - RNA, 32 nt, Human
cgcaguggcucacgccuguaaucccgguauuu

SEQ ID NO: 385889 - RNA, 32 nt, Human
cgcaguggcucacgccuguaauuccagcacuu

SEQ ID NO: 385890 - RNA, 32 nt, Human
cgcaguggcucacgccuguaauuccagcaugu

SEQ ID NO: 385891 - RNA, 32 nt, Human
cgcaguggcucacgcuuguaaucccagcacuu

SEQ ID NO: 385892 - RNA, 32 nt, Human
cgcaguggcucacuccuguaaucccagcacuu

SEQ ID NO: 385893 - RNA, 32 nt, Human
cgcaguggcucaugcccauaaucccagcacuu

SEQ ID NO: 385894 - RNA, 32 nt, Human
cgcaguggcucaugccuauaaucccagcacuu

SEQ ID NO: 385895 - RNA, 32 nt, Human
cgcaguggcucaugccuggaaucccagcacuu

SEQ ID NO: 385896 - RNA, 32 nt, Human
cgcaguggcucaugccuguaaucccagaacuu

SEQ ID NO: 385897 - RNA, 32 nt, Human
cgcaguggcucaugccuguaaucccagcacuc

SEQ ID NO: 385898 - RNA, 32 nt, Human
cgcaguggcucaugccuguaaucccagcacuu

SEQ ID NO: 385899 - RNA, 32 nt, Human
cgcaguggcucaugccuguaaucccagcauuu

SEQ ID NO: 385900 - RNA, 32 nt, Human
cgcaguggcucaugccuguaaucccaggacuu

SEQ ID NO: 385901 - RNA, 32 nt, Human
cgcaguggcucaugccuguaauccuagcacuu

SEQ ID NO: 385902 - RNA, 32 nt, Human
cgcaguggcucaugccuguaaucguagcacuu

SEQ ID NO: 385903 - RNA, 32 nt, Human
cgcaguggcucaugccuguaaucucaguacuu

SEQ ID NO: 385904 - RNA, 32 nt, Human
cgcaguggcucaugccuguaauuccagcacuu

SEQ ID NO: 385905 - RNA, 32 nt, Human
cgcaguggcucaugccuguaauuucaguacuu

SEQ ID NO: 385906 - RNA, 32 nt, Human
cgcaguggcucaugcuuguaaucccagcacuu

SEQ ID NO: 385907 - RNA, 32 nt, Human
cgcaguggcucaugcuuguaauccuagcacuu

SEQ ID NO: 385908 - RNA, 32 nt, Human
cgcaguggcucauguguguaaucccagcacuc

SEQ ID NO: 385909 - RNA, 32 nt, Human
cgcaguggcucccaccuguaaucucagcccuu

SEQ ID NO: 385910 - RNA, 32 nt, Human
cgcaguggcucuugccuguaaucccagcacuu

SEQ ID NO: 385911 - RNA, 32 nt, Human
cgcaguggcugaugccuguaaucccagcacuu

SEQ ID NO: 385912 - RNA, 32 nt, Human
cgcaguggcuguaaucccagcacuuugggagg

SEQ ID NO: 385913 - RNA, 32 nt, Human
cgcaguggcuuacaccuguaaccccagcacuu

SEQ ID NO: 385914 - RNA, 32 nt, Human
cgcaguggcuuacaccuguaaucccaguacuu

SEQ ID NO: 385915 - RNA, 32 nt, Human
cgcaguggcuuacaccuguaaucgcagcauuu

SEQ ID NO: 385916 - RNA, 32 nt, Human
cgcaguggcuuacgccuguaaucccagcacuu

SEQ ID NO: 385917 - RNA, 32 nt, Human
cgcaguggcuuaugccuguaaucccagcacuu

SEQ ID NO: 385918 - RNA, 32 nt, Human
cgcagugggcccacccuuucccuugcuauggc

SEQ ID NO: 385919 - RNA, 32 nt, Human
cgcagugggcuacaaacuuucgcagcgcgagu

SEQ ID NO: 385920 - RNA, 32 nt, Human
cgcaguggggucuucccgcugcccagcagccu

SEQ ID NO: 385921 - RNA, 32 nt, Human
cgcagugggguggagggggcagggcgugguga

SEQ ID NO: 385922 - RNA, 20 nt, Human
cgcaguggugaugacccuca

SEQ ID NO: 385923 - RNA, 32 nt, Human
cgcaguggugcgcaccuguaaucccagcuacu

SEQ ID NO: 385924 - RNA, 32 nt, Human
cgcagugguucaugccaguaaucccagcacuu

SEQ ID NO: 385925 - RNA, 32 nt, Human
cgcagugguucaugucuguaaucccagcacuu

SEQ ID NO: 385926 - RNA, 32 nt, Human
cgcagugucagcaacgcccuguccucagugcc

SEQ ID NO: 385927 - RNA, 32 nt, Human
cgcaguguggaugccacuggccuaguguccug

SEQ ID NO: 385928 - RNA, 32 nt, Human
cgcaguguugcccaggcuggucucgaacuccu

SEQ ID NO: 385929 - RNA, 23 nt, Human
cgcaguucccaggcgucugcggg

SEQ ID NO: 385930 - RNA, 32 nt, Human
cgcaguuugcuucauagcucugugaagcagcu

SEQ ID NO: 385931 - RNA, 32 nt, Human
cgcaguuugucguguuuccaaaccaguugugc

SEQ ID NO: 385932 - RNA, 32 nt, Human
cgcauaaaaaccauuaagaugucuucugggga

SEQ ID NO: 385933 - RNA, 32 nt, Human
cgcauaacucuagcuguaucauccucucaccu

SEQ ID NO: 385934 - RNA, 32 nt, Human
cgcauaaggaagggaguggagcuauguugacu

SEQ ID NO: 385935 - RNA, 32 nt, Human
cgcauaccuguaaucccagcuacuugggaggc

SEQ ID NO: 385936 - RNA, 32 nt, Human
cgcauacugccuggaaccagacuguuugcuua

SEQ ID NO: 385937 - RNA, 32 nt, Human
cgcauagaggagagaaggaaaccugaggagua

SEQ ID NO: 385938 - RNA, 32 nt, Human
cgcauaucuggcagauggugcaggaagaaacc

SEQ ID NO: 385939 - RNA, 32 nt, Human
cgcauaugagugugugugcgugugaacggcuu

SEQ ID NO: 385940 - RNA, 32 nt, Human
cgcauaugcaugccaggcugggcacggcuccg

SEQ ID NO: 385941 - RNA, 32 nt, Human
cgcauaugcuccagaggagccacucgggacaa

SEQ ID NO: 385942 - RNA, 32 nt, Human
cgcauauggaguagaugcucaccagaggcugg

SEQ ID NO: 385943 - RNA, 32 nt, Human
cgcaucacugcaguccagccuggaugacagag

SEQ ID NO: 385944 - RNA, 32 nt, Human
cgcaucauugcacucuagccugggccacaggg

SEQ ID NO: 385945 - RNA, 32 nt, Human
cgcauccagagcagcgacgaccggcgcaugac

SEQ ID NO: 385946 - RNA, 32 nt, Human
cgcauccagccagcccagcccugugaaagaug

SEQ ID NO: 385947 - RNA, 32 nt, Human
cgcauccauguucgacaccacaccccacucug

SEQ ID NO: 385948 - RNA, 32 nt, Human
cgcaucccccaacagcagccccugccaguccc

SEQ ID NO: 385949 - RNA, 32 nt, Human
cgcaucccgugcaacuuugggguaguggccgc

SEQ ID NO: 385950 - RNA, 32 nt, Human
cgcauccucccuuccuccuuucggagaacugu

SEQ ID NO: 385951 - RNA, 32 nt, Human
cgcauccucuuccauccccaggcacagaucaa

SEQ ID NO: 385952 - RNA, 32 nt, Human
cgcauccugcagcccaugcuugaugccagcaa

SEQ ID NO: 385953 - RNA, 32 nt, Human
cgcauccugcgugccuccuccuucucccgcuc

SEQ ID NO: 385954 - RNA, 32 nt, Human
cgcauccuuguucuccccuggguccguaacau

SEQ ID NO: 385955 - RNA, 32 nt, Human
cgcauccuuugcaggugaaggaauggcaugga

SEQ ID NO: 385956 - RNA, 32 nt, Human
cgcaucgaaguaacaugcaaccaugguacaaa

SEQ ID NO: 385957 - RNA, 20 nt, Human
cgcaucgcagcggccgggca

SEQ ID NO: 385958 - RNA, 32 nt, Human
cgcaucgcauucccuccucuccaucuugaugc

SEQ ID NO: 385959 - RNA, 32 nt, Human
cgcaucgguggaagaacugaauuucaggaugc

SEQ ID NO: 385960 - RNA, 32 nt, Human
cgcaucguggaaguggccgugcaccaagugga

SEQ ID NO: 385961 - RNA, 32 nt, Human
cgcaucguggugcuggaggccgugagcgggcu

SEQ ID NO: 385962 - RNA, 31 nt, Human
cgcaucuacuaaaauacaaaaauuagccggg

SEQ ID NO: 385963 - RNA, 32 nt, Human
cgcaucucagccaccuuccucaggcucacucc

SEQ ID NO: 385964 - RNA, 32 nt, Human
cgcaucucagcccucucaggagcagucuucca

SEQ ID NO: 385965 - RNA, 32 nt, Human
cgcaucucucagacucacucugccaggcuaca

SEQ ID NO: 385966 - RNA, 32 nt, Human
cgcaucucuuuuccaggcaccccaccaugggc

SEQ ID NO: 385967 - RNA, 32 nt, Human
cgcaucuguagucccagcuacucaggaggcug

SEQ ID NO: 385968 - RNA, 32 nt, Human
cgcaucuguaguuccagcuauacaggaaggug

SEQ ID NO: 385969 - RNA, 32 nt, Human
cgcaucuguggucccagcuacucgggagacuc

SEQ ID NO: 385970 - RNA, 32 nt, Human
cgcaucuuccacccucgccgccgccgcagcuc

SEQ ID NO: 385971 - RNA, 32 nt, Human
cgcaucuucucagcagcuucugaccacugcuc

SEQ ID NO: 385972 - RNA, 28 nt, Human
cgcaugaaaaguucccuacugaaggaac

SEQ ID NO: 385973 - RNA, 32 nt, Human
cgcaugaacccgcccaaguucagcaaggccga

SEQ ID NO: 385974 - RNA, 31 nt, Human
cgcaugaauuacugaauauuuuacugugcuu

SEQ ID NO: 385975 - RNA, 32 nt, Human
cgcaugcacacacgugcgcacgcacacacaca

SEQ ID NO: 385976 - RNA, 32 nt, Human
cgcaugcaccuggccggccaccugccacuggg

SEQ ID NO: 385977 - RNA, 32 nt, Human
cgcaugcacugcacuucuucguuuucuucuug

SEQ ID NO: 385978 - RNA, 32 nt, Human
cgcaugcacugcacuucuuuguuuucuucuug

SEQ ID NO: 385979 - RNA, 32 nt, Human
cgcaugccacugcacuccagccugggcgacag

SEQ ID NO: 385980 - RNA, 32 nt, Human
cgcaugcccuccugcaguugcuggauggauag

SEQ ID NO: 385981 - RNA, 32 nt, Human
cgcaugcccuuccacucugccucccaggacag

SEQ ID NO: 385982 - RNA, 32 nt, Human
cgcaugccugcccgcccgccagccugccgggu

SEQ ID NO: 385983 - RNA, 32 nt, Human
cgcaugccuguaaucccagaacuuugggaggc

SEQ ID NO: 385984 - RNA, 32 nt, Human
cgcaugccuguaaucccagcacuuugggaggc

SEQ ID NO: 385985 - RNA, 32 nt, Human
cgcaugccuguaaucccagcuacugggaaggc

SEQ ID NO: 385986 - RNA, 32 nt, Human
cgcaugccuguaaucccagcuacuuaggaggc

SEQ ID NO: 385987 - RNA, 32 nt, Human
cgcaugccuguaaucccagcuacuugggagac

SEQ ID NO: 385988 - RNA, 32 nt, Human
cgcaugccuguaaucccagcuacuugggagcc

SEQ ID NO: 385989 - RNA, 32 nt, Human
cgcaugccuguaaucccagcuacuugggaggc

SEQ ID NO: 385990 - RNA, 32 nt, Human
cgcaugccuguaaucccagcuacuuggguggc

SEQ ID NO: 385991 - RNA, 32 nt, Human
cgcaugccuguaaucccagcugcuugggaggc

SEQ ID NO: 385992 - RNA, 32 nt, Human
cgcaugccuguaauccuagcuacucaggaggc

SEQ ID NO: 385993 - RNA, 32 nt, Human
cgcaugccuguaauccuagcuacucgggaggc

SEQ ID NO: 385994 - RNA, 32 nt, Human
cgcaugccuguaauccuagcuauucgggaggc

SEQ ID NO: 385995 - RNA, 32 nt, Human
cgcaugccuuuccacggauucccucauuaaaa

SEQ ID NO: 385996 - RNA, 32 nt, Human
cgcaugcggaagcucaaguacaagcaccuggc

SEQ ID NO: 385997 - RNA, 32 nt, Human
cgcaugcuacugcacuccagccugggagacag

SEQ ID NO: 385998 - RNA, 32 nt, Human
cgcaugcugcagcugcucccgggugcccccgc

SEQ ID NO: 385999 - RNA, 21 nt, Human
cgcaugcugggcgcccgggug

SEQ ID NO: 386000 - RNA, 32 nt, Human
cgcaugcuuguaaucccagcuacucgggaggc

SEQ ID NO: 386001 - RNA, 21 nt, Human
cgcauggaaaacccagaggaa

SEQ ID NO: 386002 - RNA, 28 nt, Human
cgcauggagccagaggaggaggaugaac

SEQ ID NO: 386003 - RNA, 32 nt, Human
cgcauggaggcagugggcuggcagcuuccugc

SEQ ID NO: 386004 - RNA, 32 nt, Human
cgcauggcgagcgccucccacgcccauccgua

SEQ ID NO: 386005 - RNA, 26 nt, Human
cgcauggcuaaucuuuuuguguuuuu

SEQ ID NO: 386006 - RNA, 32 nt, Human
cgcauggcuguaauccuggcuacucaggaggc

SEQ ID NO: 386007 - RNA, 32 nt, Human
cgcaugggagugaagacaguagaaggggaaga

SEQ ID NO: 386008 - RNA, 32 nt, Human
cgcaugggcugggggccagggauaauggacag

SEQ ID NO: 386009 - RNA, 32 nt, Human
cgcaugggugugagccagcuugagaacacuaa

SEQ ID NO: 386010 - RNA, 32 nt, Human
cgcaugguagcuggagcagcaaacaacugcuu

SEQ ID NO: 386011 - RNA, 32 nt, Human
cgcauggucucuucaccgcugcccucgaguuc

SEQ ID NO: 386012 - RNA, 32 nt, Human
cgcauguaccagaaucucacauggaccccaua

SEQ ID NO: 386013 - RNA, 32 nt, Human
cgcauguccauggcgagucagguggggagcac

SEQ ID NO: 386014 - RNA, 32 nt, Human
cgcaugucccccagggcagguuagggggcugg

SEQ ID NO: 386015 - RNA, 32 nt, Human
cgcaugucugcaccuccgcuugccagaggccc

SEQ ID NO: 386016 - RNA, 32 nt, Human
cgcaugucuguaaucccagcuacuggggaagc

SEQ ID NO: 386017 - RNA, 32 nt, Human
cgcaugucuguaaucccagcuacuggggaggc

SEQ ID NO: 386018 - RNA, 32 nt, Human
cgcaugugcaccacagagugcacucgagggga

SEQ ID NO: 386019 - RNA, 32 nt, Human
cgcaugugcgcgcacacaccacacaugcacac

SEQ ID NO: 386020 - RNA, 32 nt, Human
cgcaugugcuguucccucugccuagaacacuc

SEQ ID NO: 386021 - RNA, 32 nt, Human
cgcauguggcccaggauggcuuuaaguacagc

SEQ ID NO: 386022 - RNA, 32 nt, Human
cgcauguggugucugagcagggcccgagaccu

SEQ ID NO: 386023 - RNA, 32 nt, Human
cgcauguguggacaucaguaggcaaguaacca

SEQ ID NO: 386024 - RNA, 32 nt, Human
cgcauguucaaacccaaaggcucuuuucagag

SEQ ID NO: 386025 - RNA, 32 nt, Human
cgcauuaccgcaugagcucugccuccugucag

SEQ ID NO: 386026 - RNA, 32 nt, Human
cgcauuacugcacuccagccuggguaacagag

SEQ ID NO: 386027 - RNA, 32 nt, Human
cgcauuagcauuagcagcaccuaaguccucau

SEQ ID NO: 386028 - RNA, 32 nt, Human
cgcauucccacacuccagucuggauccagguc

SEQ ID NO: 386029 - RNA, 32 nt, Human
cgcauucuagguagaggagacagccuggacaa

SEQ ID NO: 386030 - RNA, 32 nt, Human
cgcauucucuacuggacucuggccugcuugga

SEQ ID NO: 386031 - RNA, 32 nt, Human
cgcauucugcucccacagugccuuuuccagaa

SEQ ID NO: 386032 - RNA, 32 nt, Human
cgcauugaagcaggaacaaauugccucuuuuu

SEQ ID NO: 386033 - RNA, 32 nt, Human
cgcauuggcucaugucuguaaucccagcacuu

SEQ ID NO: 386034 - RNA, 32 nt, Human
cgcauuuauauaacauucuugaggugacaaaa

SEQ ID NO: 386035 - RNA, 28 nt, Human
cgcauuucaagugcuggauccuuuuugu

SEQ ID NO: 386036 - RNA, 24 nt, Human
cgcauuucacagacugcuuuuuca

SEQ ID NO: 386037 - RNA, 32 nt, Human
cgcauuucuguguuuucagccacccagucugu

SEQ ID NO: 386038 - RNA, 32 nt, Human
cgcauuugagccuuguucuggggcccagccca

SEQ ID NO: 386039 - RNA, 32 nt, Human
cgcauuuucaauaaaaugucucuaauacaaua

SEQ ID NO: 386040 - RNA, 32 nt, Human
cgccaaacacugcagcaucuuccccagcguug

SEQ ID NO: 386041 - RNA, 32 nt, Human
cgccaaagcagcugccauggacucuggccugu

SEQ ID NO: 386042 - RNA, 32 nt, Human
cgccaaaggaaaagccccuuggaugagaggca

SEQ ID NO: 386043 - RNA, 32 nt, Human
cgccaacagagcugugcccugaggacccggcc

SEQ ID NO: 386044 - RNA, 32 nt, Human
cgccaacaggcaucugccaugcuggcaucucu

SEQ ID NO: 386045 - RNA, 32 nt, Human
cgccaacagggugaaaccccaccucuauuaaa

SEQ ID NO: 386046 - RNA, 25 nt, Human
cgccaacaguccaggucacacagca

SEQ ID NO: 386047 - RNA, 32 nt, Human
cgccaacauccuccuccacaggcaguggcagg

SEQ ID NO: 386048 - RNA, 32 nt, Human
cgccaacauggcgaaaccccaucucuacuaaa

SEQ ID NO: 386049 - RNA, 32 nt, Human
cgccaacauggugaaaccccaucucuacuaaa

SEQ ID NO: 386050 - RNA, 32 nt, Human
cgccaacauggugaaaccguaucucuaauaaa

SEQ ID NO: 386051 - RNA, 32 nt, Human
cgccaacauggugagacccugucucuacuaaa

SEQ ID NO: 386052 - RNA, 32 nt, Human
cgccaacccacacuugccccagacagagcugg

SEQ ID NO: 386053 - RNA, 32 nt, Human
cgccaacccugccugccgcugcaccugccugc

SEQ ID NO: 386054 - RNA, 32 nt, Human
cgccaacggccuggccuucccugccggcccgc

SEQ ID NO: 386055 - RNA, 32 nt, Human
cgccaacugcagccgggcugaggccgagagca

SEQ ID NO: 386056 - RNA, 32 nt, Human
cgccaacugcagcuccuggccuugugcggagg

SEQ ID NO: 386057 - RNA, 32 nt, Human
cgccaacugcauuuaaaacaaaacaaaacaga

SEQ ID NO: 386058 - RNA, 32 nt, Human
cgccaagaacaaggugcuaggcaucuguuuuu

SEQ ID NO: 386059 - RNA, 32 nt, Human
cgccaagaugcccgagagcgcuuggaaguuuc

SEQ ID NO: 386060 - RNA, 32 nt, Human
cgccaagcaucuguccccuccucccccggccg

SEQ ID NO: 386061 - RNA, 32 nt, Human
cgccaagcggcugggcccaggcuguggcauga

SEQ ID NO: 386062 - RNA, 32 nt, Human
cgccaagcuuugagagaaggcugugacugcug

SEQ ID NO: 386063 - RNA, 32 nt, Human
cgccaaggccacuccucgcucucuaggccgag

SEQ ID NO: 386064 - RNA, 32 nt, Human
cgccaaggccgacggcccucagccucugccau

SEQ ID NO: 386065 - RNA, 32 nt, Human
cgccaaggcgccuccuuccugggcauccugga

SEQ ID NO: 386066 - RNA, 32 nt, Human
cgccaaggcugcagggagcaccaccaggagcc

SEQ ID NO: 386067 - RNA, 21 nt, Human
cgccaaggcuggagugcagug

SEQ ID NO: 386068 - RNA, 32 nt, Human
cgccaagggguucgugcgcuguggagacgcgg

SEQ ID NO: 386069 - RNA, 32 nt, Human
cgccaaggucaccuagaaauucgugucaccgc

SEQ ID NO: 386070 - RNA, 32 nt, Human
cgccaagguuuucucucccagaacccacagug

SEQ ID NO: 386071 - RNA, 32 nt, Human
cgccaagucauccucccaccucagccuccuga

SEQ ID NO: 386072 - RNA, 32 nt, Human
cgccaagugagugaggaggaggaggaggagaa

SEQ ID NO: 386073 - RNA, 32 nt, Human
cgccaaguugggggcccaggaggcggggaggg

SEQ ID NO: 386074 - RNA, 32 nt, Human
cgccaaucaauacuuggggcucuaaguuuuac

SEQ ID NO: 386075 - RNA, 32 nt, Human
cgccaaucacgagacugggggaccggccgggc

SEQ ID NO: 386076 - RNA, 32 nt, Human
cgccaaugcacuccagccugggcgacagagaa

SEQ ID NO: 386077 - RNA, 32 nt, Human
cgccacacacaaccucuccacaugccucagcg

SEQ ID NO: 386078 - RNA, 32 nt, Human
cgccacacacggcuaauuuuguauuuuuagug

SEQ ID NO: 386079 - RNA, 32 nt, Human
cgccacaccacuguuugugcuggaucgcagcg

SEQ ID NO: 386080 - RNA, 24 nt, Human
cgccacacccacgaggcggugcug

SEQ ID NO: 386081 - RNA, 32 nt, Human
cgccacacccagcuaauuuuguauuuuuagua

SEQ ID NO: 386082 - RNA, 22 nt, Human
cgccacaccccgcgcucaacug

SEQ ID NO: 386083 - RNA, 32 nt, Human
cgccacacccggcuaauuuuuaguauuuuuag

SEQ ID NO: 386084 - RNA, 32 nt, Human
cgccacacugcuggcugcuguagugcugggug

SEQ ID NO: 386085 - RNA, 32 nt, Human
cgccacacugucuuccacaaugguugaacuaa

SEQ ID NO: 386086 - RNA, 32 nt, Human
cgccacagcacccaccaccugccgccuucaga

SEQ ID NO: 386087 - RNA, 32 nt, Human
cgccacagcacuccagccugggcgacagagug

SEQ ID NO: 386088 - RNA, 32 nt, Human
cgccacagcauuccagccugggcgauggagug

SEQ ID NO: 386089 - RNA, 32 nt, Human
cgccacagccaaccugcccagucuuuccucug

SEQ ID NO: 386090 - RNA, 32 nt, Human
cgccacagccgccgccuccaccaccaccaccg

SEQ ID NO: 386091 - RNA, 32 nt, Human
cgccacagccgccgccuccacccccggcccca

SEQ ID NO: 386092 - RNA, 32 nt, Human
cgccacagccucccaaaguucugggauuacaa

SEQ ID NO: 386093 - RNA, 32 nt, Human
cgccacagccucucgggagacgugggcccucg

SEQ ID NO: 386094 - RNA, 32 nt, Human
cgccacagcuacuaccugacacugagcucaug

SEQ ID NO: 386095 - RNA, 32 nt, Human
cgccacauccaccccugucugcacaugaguug

SEQ ID NO: 386096 - RNA, 32 nt, Human
cgccacaucccccaauccaucagugccaaacu

SEQ ID NO: 386097 - RNA, 32 nt, Human
cgccacaucgcggcccuccagccuggccuaac

SEQ ID NO: 386098 - RNA, 32 nt, Human
cgccacaucugcagugccgcacacagacagga

SEQ ID NO: 386099 - RNA, 32 nt, Human
cgccaccacacuccagccugggcaacagagac

SEQ ID NO: 386100 - RNA, 32 nt, Human
cgccaccaccaccaccacccacugccugcagc

SEQ ID NO: 386101 - RNA, 18 nt, Human
cgccaccaccccacccca

SEQ ID NO: 386102 - RNA, 19 nt, Human
cgccaccaccccagccccc

SEQ ID NO: 386103 - RNA, 32 nt, Human
cgccaccaccgccaccaccaccaccaucauca

SEQ ID NO: 386104 - RNA, 32 nt, Human
cgccaccaccgcgccuccgccucggccgccgc

SEQ ID NO: 386105 - RNA, 32 nt, Human
cgccaccacucaggggcucuggaggggucagc

SEQ ID NO: 386106 - RNA, 32 nt, Human
cgccaccacugcacuccagccugggcaacaga

SEQ ID NO: 386107 - RNA, 32 nt, Human
cgccaccacugccaccacggucgccugccaca

SEQ ID NO: 386108 - RNA, 32 nt, Human
cgccaccagcccagagagcaucggccccuguc

SEQ ID NO: 386109 - RNA, 32 nt, Human
cgccaccagcggccuccgccgccccggaagcc

SEQ ID NO: 386110 - RNA, 32 nt, Human
cgccaccagcucccagccuccugcucagaccc

SEQ ID NO: 386111 - RNA, 32 nt, Human
cgccaccaugaagaaauucuuucaggaguuca

SEQ ID NO: 386112 - RNA, 32 nt, Human
cgccaccaugaccaccaccauccaccaguuca

SEQ ID NO: 386113 - RNA, 32 nt, Human
cgccaccaugcccagcuaauuguauuuuagua

SEQ ID NO: 386114 - RNA, 32 nt, Human
cgccaccauggugcuggagucgguggucgcgg

SEQ ID NO: 386115 - RNA, 32 nt, Human
cgccacccaagugccaagacacagcagggcca

SEQ ID NO: 386116 - RNA, 32 nt, Human
cgccacccagcuguuuuugugcucacaagcuc

SEQ ID NO: 386117 - RNA, 32 nt, Human
cgccaccccagaggggugccagaugccccagu

SEQ ID NO: 386118 - RNA, 32 nt, Human
cgccaccccaggccagcuuccacagcagcugu

SEQ ID NO: 386119 - RNA, 32 nt, Human
cgccacccccucccccugucucccucucugaa

SEQ ID NO: 386120 - RNA, 32 nt, Human
cgccaccccuggcaggcguauccuucagcagg

SEQ ID NO: 386121 - RNA, 32 nt, Human
cgccacccgcagccacagccacagccacagcc

SEQ ID NO: 386122 - RNA, 19 nt, Human
cgccacccgcccacuggcc

SEQ ID NO: 386123 - RNA, 24 nt, Human
cgccacccgccccccaccacccca

SEQ ID NO: 386124 - RNA, 32 nt, Human
cgccacccuaucuccagcugccuuuaaagggu

SEQ ID NO: 386125 - RNA, 18 nt, Human
cgccacccucagcagcca

SEQ ID NO: 386126 - RNA, 32 nt, Human
cgccacccuccacccuucuccccagcgugcug

SEQ ID NO: 386127 - RNA, 32 nt, Human
cgccacccucuguuuucccucacucgccagcc

SEQ ID NO: 386128 - RNA, 32 nt, Human
cgccaccgcacuccagccucgccgacaaagcg

SEQ ID NO: 386129 - RNA, 32 nt, Human
cgccaccgcacuccagccugggcgacagagcg

SEQ ID NO: 386130 - RNA, 32 nt, Human
cgccaccgcauuccagccugggcgacagagca

SEQ ID NO: 386131 - RNA, 32 nt, Human
cgccaccgccaccaccaccuccaccgccgccu

SEQ ID NO: 386132 - RNA, 32 nt, Human
cgccaccgcccuccagccugggcgacagagca

SEQ ID NO: 386133 - RNA, 32 nt, Human
cgccaccgcgcuccagccugggugacagagcg

SEQ ID NO: 386134 - RNA, 32 nt, Human
cgccaccgcugccucuuuccggcugugacccu

SEQ ID NO: 386135 - RNA, 18 nt, Human
cgccaccggaucugcucu

SEQ ID NO: 386136 - RNA, 32 nt, Human
cgccaccgggcugacuuccaccucccaguggu

SEQ ID NO: 386137 - RNA, 32 nt, Human
cgccaccguggcugcccugcccugcaggguga

SEQ ID NO: 386138 - RNA, 32 nt, Human
cgccaccuccaccccuguugugaccuguccuu

SEQ ID NO: 386139 - RNA, 32 nt, Human
cgccaccucccgcucgugcccagcacaaguga

SEQ ID NO: 386140 - RNA, 31 nt, Human
cgccaccuccucucugagccugucucccacu

SEQ ID NO: 386141 - RNA, 32 nt, Human
cgccaccucgugggccucaucgagcgcagccg

SEQ ID NO: 386142 - RNA, 32 nt, Human
cgccaccucugcuacuuccugccugugucacc

SEQ ID NO: 386143 - RNA, 32 nt, Human
cgccaccugccugucaccucgucuucugugga

SEQ ID NO: 386144 - RNA, 32 nt, Human
cgccaccuggacagcgugaccucagggguugu

SEQ ID NO: 386145 - RNA, 21 nt, Human
cgccaccuggccccaccccca

SEQ ID NO: 386146 - RNA, 32 nt, Human
cgccaccuucaacugcagcaccggcuccuacc

SEQ ID NO: 386147 - RNA, 32 nt, Human
cgccaccuuccaccccugcgcugugcugaccc

SEQ ID NO: 386148 - RNA, 32 nt, Human
cgccaccuucuccuggaaggugagccuuuucc

SEQ ID NO: 386149 - RNA, 25 nt, Human
cgccacgagguggaaagggcuccug

SEQ ID NO: 386150 - RNA, 32 nt, Human
cgccacgcccagggccaggagccagacaaacc

SEQ ID NO: 386151 - RNA, 32 nt, Human
cgccacgcccggcuaauuuuuauauuuuuagu

SEQ ID NO: 386152 - RNA, 32 nt, Human
cgccacgcccggcuaauuuuuguauuuuuagu

SEQ ID NO: 386153 - RNA, 32 nt, Human
cgccacggagggcuggggaugcgccugcgucc

SEQ ID NO: 386154 - RNA, 32 nt, Human
cgccacggcacuccagccugggcgacagagca

SEQ ID NO: 386155 - RNA, 32 nt, Human
cgccacggccacaagcccuggcauccccugca

SEQ ID NO: 386156 - RNA, 32 nt, Human
cgccacggccgcaagcccuggcauccccugca

SEQ ID NO: 386157 - RNA, 32 nt, Human
cgccacggggacugcagugaccccggcuugcc

SEQ ID NO: 386158 - RNA, 32 nt, Human
cgccacguccuuggccagcuuaauggccuucc

SEQ ID NO: 386159 - RNA, 32 nt, Human
cgccacgucgggcuccucagccccaggggaaa

SEQ ID NO: 386160 - RNA, 32 nt, Human
cgccacuacacuccagccugagcaacagagug

SEQ ID NO: 386161 - RNA, 32 nt, Human
cgccacuacacuccagccugggcaacagaggg

SEQ ID NO: 386162 - RNA, 32 nt, Human
cgccacuacacuccagccugggcgacagagca

SEQ ID NO: 386163 - RNA, 32 nt, Human
cgccacuacacuccagccugggcgacagagcg

SEQ ID NO: 386164 - RNA, 32 nt, Human
cgccacuacacuccagccugggugacagagug

SEQ ID NO: 386165 - RNA, 19 nt, Human
cgccacuagaccacgcucc

SEQ ID NO: 386166 - RNA, 32 nt, Human
cgccacuauacuccagccugggcaacagacau

SEQ ID NO: 386167 - RNA, 25 nt, Human
cgccacuauuuccaggcucugcggg

SEQ ID NO: 386168 - RNA, 32 nt, Human
cgccacucacugccuccuuccuccugguguug

SEQ ID NO: 386169 - RNA, 32 nt, Human
cgccacucccaccacacccacacccccuucug

SEQ ID NO: 386170 - RNA, 32 nt, Human
cgccacugaacuccagccugggagacagcaag

SEQ ID NO: 386171 - RNA, 32 nt, Human
cgccacugaacuccagccugggugacagagug

SEQ ID NO: 386172 - RNA, 32 nt, Human
cgccacugcaaaccagccugggcaauagagug

SEQ ID NO: 386173 - RNA, 32 nt, Human
cgccacugcaacccagccugggugacagagcg

SEQ ID NO: 386174 - RNA, 32 nt, Human
cgccacugcaacuccagcuugggugacagagu

SEQ ID NO: 386175 - RNA, 32 nt, Human
cgccacugcacaccagccugggugacagugug

SEQ ID NO: 386176 - RNA, 32 nt, Human
cgccacugcaccccagccugggcgacagagca

SEQ ID NO: 386177 - RNA, 32 nt, Human
cgccacugcaccccagccugggugacagagcg

SEQ ID NO: 386178 - RNA, 32 nt, Human
cgccacugcacgccagccugggcgacagagcg

SEQ ID NO: 386179 - RNA, 32 nt, Human
cgccacugcacuaaugucuggugacagaguug

SEQ ID NO: 386180 - RNA, 32 nt, Human
cgccacugcacuacagccuggacgacagagca

SEQ ID NO: 386181 - RNA, 32 nt, Human
cgccacugcacucaagccugggcaacaccugg

SEQ ID NO: 386182 - RNA, 32 nt, Human
cgccacugcacucaagccugggcgacagagcg

SEQ ID NO: 386183 - RNA, 32 nt, Human
cgccacugcacucaagucugggcgacagggug

SEQ ID NO: 386184 - RNA, 32 nt, Human
cgccacugcacuccaaccugggcaauagagga

SEQ ID NO: 386185 - RNA, 32 nt, Human
cgccacugcacuccaaccugggugacagacuc

SEQ ID NO: 386186 - RNA, 32 nt, Human
cgccacugcacuccaaccugggugacagagcg

SEQ ID NO: 386187 - RNA, 32 nt, Human
cgccacugcacuccaacuugggcaacagacag

SEQ ID NO: 386188 - RNA, 32 nt, Human
cgccacugcacuccacccugggugacagagug

SEQ ID NO: 386189 - RNA, 32 nt, Human
cgccacugcacuccaccugggcaacaagaacg

SEQ ID NO: 386190 - RNA, 32 nt, Human
cgccacugcacuccagacugggcgacagaguc

SEQ ID NO: 386191 - RNA, 32 nt, Human
cgccacugcacuccagcacccugggcgacaga

SEQ ID NO: 386192 - RNA, 32 nt, Human
cgccacugcacuccagcagucugggcgacaga

SEQ ID NO: 386193 - RNA, 32 nt, Human
cgccacugcacuccagcccaggugacagagcg

SEQ ID NO: 386194 - RNA, 32 nt, Human
cgccacugcacuccagcccgggcgacagagcg

SEQ ID NO: 386195 - RNA, 32 nt, Human
cgccacugcacuccagcccgggcgacaguuca

SEQ ID NO: 386196 - RNA, 32 nt, Human
cgccacugcacuccagcccgggcggcagaggg

SEQ ID NO: 386197 - RNA, 32 nt, Human
cgccacugcacuccagcccggggacagagcaa

SEQ ID NO: 386198 - RNA, 32 nt, Human
cgccacugcacuccagcccgggugacagagca

SEQ ID NO: 386199 - RNA, 32 nt, Human
cgccacugcacuccagcccgggugacagagcg

SEQ ID NO: 386200 - RNA, 32 nt, Human
cgccacugcacuccagccuagacgacagagca

SEQ ID NO: 386201 - RNA, 32 nt, Human
cgccacugcacuccagccuaggcaacagagca

SEQ ID NO: 386202 - RNA, 32 nt, Human
cgccacugcacuccagccuaggggacaguuag

SEQ ID NO: 386203 - RNA, 32 nt, Human
cgccacugcacuccagccuaggugacagaggg

SEQ ID NO: 386204 - RNA, 32 nt, Human
cgccacugcacuccagccuaggugauagagca

SEQ ID NO: 386205 - RNA, 32 nt, Human
cgccacugcacuccagccucggcaacagagca

SEQ ID NO: 386206 - RNA, 32 nt, Human
cgccacugcacuccagccucggugacagagca

SEQ ID NO: 386207 - RNA, 32 nt, Human
cgccacugcacuccagccugacgacaaagcga

SEQ ID NO: 386208 - RNA, 32 nt, Human
cgccacugcacuccagccugagugacagagcg

SEQ ID NO: 386209 - RNA, 32 nt, Human
cgccacugcacuccagccugcggacagaccaa

SEQ ID NO: 386210 - RNA, 32 nt, Human
cgccacugcacuccagccuggacgacagagcg

SEQ ID NO: 386211 - RNA, 32 nt, Human
cgccacugcacuccagccuggacgacagagug

SEQ ID NO: 386212 - RNA, 32 nt, Human
cgccacugcacuccagccuggaggccagagug

SEQ ID NO: 386213 - RNA, 32 nt, Human
cgccacugcacuccagccuggaugacagagcg

SEQ ID NO: 386214 - RNA, 32 nt, Human
cgccacugcacuccagccuggcaacagaguga

SEQ ID NO: 386215 - RNA, 32 nt, Human
cgccacugcacuccagccugggagaaagacuc

SEQ ID NO: 386216 - RNA, 32 nt, Human
cgccacugcacuccagccugggagacagagcc

SEQ ID NO: 386217 - RNA, 32 nt, Human
cgccacugcacuccagccugggagacagagcg

SEQ ID NO: 386218 - RNA, 32 nt, Human
cgccacugcacuccagccugggagacagagug

SEQ ID NO: 386219 - RNA, 32 nt, Human
cgccacugcacuccagccugggagacagaguu

SEQ ID NO: 386220 - RNA, 32 nt, Human
cgccacugcacuccagccugggcaacaagaac

SEQ ID NO: 386221 - RNA, 32 nt, Human
cgccacugcacuccagccugggcaacaagagc

SEQ ID NO: 386222 - RNA, 32 nt, Human
cgccacugcacuccagccugggcaacaagagu

SEQ ID NO: 386223 - RNA, 32 nt, Human
cgccacugcacuccagccugggcaacagaaca

SEQ ID NO: 386224 - RNA, 32 nt, Human
cgccacugcacuccagccugggcaacagagag

SEQ ID NO: 386225 - RNA, 32 nt, Human
cgccacugcacuccagccugggcaacagaggg

SEQ ID NO: 386226 - RNA, 32 nt, Human
cgccacugcacuccagccugggcaacagagug

SEQ ID NO: 386227 - RNA, 32 nt, Human
cgccacugcacuccagccugggcaacaggcuc

SEQ ID NO: 386228 - RNA, 32 nt, Human
cgccacugcacuccagccugggcaacagugag

SEQ ID NO: 386229 - RNA, 32 nt, Human
cgccacugcacuccagccugggcaacggauug

SEQ ID NO: 386230 - RNA, 32 nt, Human
cgccacugcacuccagccugggcaauagagug

SEQ ID NO: 386231 - RNA, 32 nt, Human
cgccacugcacuccagccugggcagcagagca

SEQ ID NO: 386232 - RNA, 32 nt, Human
cgccacugcacuccagccugggcagcagagga

SEQ ID NO: 386233 - RNA, 32 nt, Human
cgccacugcacuccagccugggcgacacagca

SEQ ID NO: 386234 - RNA, 29 nt, Human
cgccacugcacuccagccugggcgacaga

SEQ ID NO: 386235 - RNA, 32 nt, Human
cgccacugcacuccagccugggcgacagaaug

SEQ ID NO: 386236 - RNA, 32 nt, Human
cgccacugcacuccagccugggcgacagagag

SEQ ID NO: 386237 - RNA, 32 nt, Human
cgccacugcacuccagccugggcgacagagca

SEQ ID NO: 386238 - RNA, 32 nt, Human
cgccacugcacuccagccugggcgacagagcc

SEQ ID NO: 386239 - RNA, 32 nt, Human
cgccacugcacuccagccugggcgacagagcg

SEQ ID NO: 386240 - RNA, 32 nt, Human
cgccacugcacuccagccugggcgacagagcu

SEQ ID NO: 386241 - RNA, 32 nt, Human
cgccacugcacuccagccugggcgacagagug

SEQ ID NO: 386242 - RNA, 32 nt, Human
cgccacugcacuccagccugggcgacagcaag

SEQ ID NO: 386243 - RNA, 32 nt, Human
cgccacugcacuccagccugggcgacagcgag

SEQ ID NO: 386244 - RNA, 32 nt, Human
cgccacugcacuccagccugggcgacagggca

SEQ ID NO: 386245 - RNA, 32 nt, Human
cgccacugcacuccagccugggcgacagugag

SEQ ID NO: 386246 - RNA, 32 nt, Human
cgccacugcacuccagccugggcgacggagcg

SEQ ID NO: 386247 - RNA, 32 nt, Human
cgccacugcacuccagccugggcgagagaaug

SEQ ID NO: 386248 - RNA, 32 nt, Human
cgccacugcacuccagccugggcgauagagca

SEQ ID NO: 386249 - RNA, 32 nt, Human
cgccacugcacuccagccugggcgauggagcg

SEQ ID NO: 386250 - RNA, 32 nt, Human
cgccacugcacuccagccugggcgucagagug

SEQ ID NO: 386251 - RNA, 32 nt, Human
cgccacugcacuccagccugggcugcagggug

SEQ ID NO: 386252 - RNA, 32 nt, Human
cgccacugcacuccagccugggggacagagca

SEQ ID NO: 386253 - RNA, 32 nt, Human
cgccacugcacuccagccugggugacacagcg

SEQ ID NO: 386254 - RNA, 32 nt, Human
cgccacugcacuccagccugggugacagaaca

SEQ ID NO: 386255 - RNA, 32 nt, Human
cgccacugcacuccagccugggugacagaacg

SEQ ID NO: 386256 - RNA, 32 nt, Human
cgccacugcacuccagccugggugacagaaug

SEQ ID NO: 386257 - RNA, 32 nt, Human
cgccacugcacuccagccugggugacagagac

SEQ ID NO: 386258 - RNA, 32 nt, Human
cgccacugcacuccagccugggugacagagag

SEQ ID NO: 386259 - RNA, 32 nt, Human
cgccacugcacuccagccugggugacagagca

SEQ ID NO: 386260 - RNA, 32 nt, Human
cgccacugcacuccagccugggugacagagcc

SEQ ID NO: 386261 - RNA, 32 nt, Human
cgccacugcacuccagccugggugacagagcg

SEQ ID NO: 386262 - RNA, 32 nt, Human
cgccacugcacuccagccugggugacagaggg

SEQ ID NO: 386263 - RNA, 32 nt, Human
cgccacugcacuccagccugggugacagagug

SEQ ID NO: 386264 - RNA, 32 nt, Human
cgccacugcacuccagccugggugacagugag

SEQ ID NO: 386265 - RNA, 32 nt, Human
cgccacugcacuccagccugggugacggagcg

SEQ ID NO: 386266 - RNA, 32 nt, Human
cgccacugcacuccagccugggugacugaggg

SEQ ID NO: 386267 - RNA, 32 nt, Human
cgccacugcacuccagccugggugagagagug

SEQ ID NO: 386268 - RNA, 32 nt, Human
cgccacugcacuccagccugggugauagagcu

SEQ ID NO: 386269 - RNA, 32 nt, Human
cgccacugcacuccagccugggugauagagug

SEQ ID NO: 386270 - RNA, 32 nt, Human
cgccacugcacuccagccuggucaacagagug

SEQ ID NO: 386271 - RNA, 32 nt, Human
cgccacugcacuccagccuggugacagagcaa

SEQ ID NO: 386272 - RNA, 32 nt, Human
cgccacugcacuccagccuggugacagagcga

SEQ ID NO: 386273 - RNA, 32 nt, Human
cgccacugcacuccagccuggugacagcguga

SEQ ID NO: 386274 - RNA, 32 nt, Human
cgccacugcacuccagccugguugacagagca

SEQ ID NO: 386275 - RNA, 32 nt, Human
cgccacugcacuccagccuguugacaaagcaa

SEQ ID NO: 386276 - RNA, 32 nt, Human
cgccacugcacuccagcgugggcaacagagcg

SEQ ID NO: 386277 - RNA, 32 nt, Human
cgccacugcacuccagcuggagugacagagcc

SEQ ID NO: 386278 - RNA, 32 nt, Human
cgccacugcacuccagcuugggugacaaagua

SEQ ID NO: 386279 - RNA, 32 nt, Human
cgccacugcacuccaggccugggugacagugc

SEQ ID NO: 386280 - RNA, 32 nt, Human
cgccacugcacuccaggcugggcaacggagug

SEQ ID NO: 386281 - RNA, 32 nt, Human
cgccacugcacuccaggcugggcgacagagcg

SEQ ID NO: 386282 - RNA, 32 nt, Human
cgccacugcacuccaggcugggcgacagagug

SEQ ID NO: 386283 - RNA, 32 nt, Human
cgccacugcacuccagucugggcaacagagug

SEQ ID NO: 386284 - RNA, 32 nt, Human
cgccacugcacuccagucugggcgacagagcg

SEQ ID NO: 386285 - RNA, 32 nt, Human
cgccacugcacuccagucugggcgauagagcu

SEQ ID NO: 386286 - RNA, 32 nt, Human
cgccacugcacuccagucugggugacagagag

SEQ ID NO: 386287 - RNA, 32 nt, Human
cgccacugcacuccagucuggucggcaagagu

SEQ ID NO: 386288 - RNA, 32 nt, Human
cgccacugcacuccaguguaggcaacagagug

SEQ ID NO: 386289 - RNA, 32 nt, Human
cgccacugcacuccaguuugggcaacagaaug

SEQ ID NO: 386290 - RNA, 32 nt, Human
cgccacugcacuccauccagccugggugacag

SEQ ID NO: 386291 - RNA, 32 nt, Human
cgccacugcacuccggccugaugacagagcga

SEQ ID NO: 386292 - RNA, 32 nt, Human
cgccacugcacuccugccugggcaacugagca

SEQ ID NO: 386293 - RNA, 32 nt, Human
cgccacugcacucuagccggagugacagagua

SEQ ID NO: 386294 - RNA, 32 nt, Human
cgccacugcacucuagccugagugacagagca

SEQ ID NO: 386295 - RNA, 32 nt, Human
cgccacugcacucuagccugggauacagagcu

SEQ ID NO: 386296 - RNA, 32 nt, Human
cgccacugcacucuagccugggcaacaagagu

SEQ ID NO: 386297 - RNA, 32 nt, Human
cgccacugcacucuagccugggcaauaagagc

SEQ ID NO: 386298 - RNA, 32 nt, Human
cgccacugcacucuagccugggccauagagcg

SEQ ID NO: 386299 - RNA, 32 nt, Human
cgccacugcacucuagccugggcuacagagcg

SEQ ID NO: 386300 - RNA, 32 nt, Human
cgccacugcacucuagccugggugacagagca

SEQ ID NO: 386301 - RNA, 32 nt, Human
cgccacugcacucuagccugggugacagagug

SEQ ID NO: 386302 - RNA, 32 nt, Human
cgccacugcacucuagccugggugacagauaa

SEQ ID NO: 386303 - RNA, 32 nt, Human
cgccacugcacugcacgccagccuaggcgaca

SEQ ID NO: 386304 - RNA, 32 nt, Human
cgccacugcacuucagccuggaugacagagcg

SEQ ID NO: 386305 - RNA, 32 nt, Human
cgccacugcacuucagccugggugacagagcu

SEQ ID NO: 386306 - RNA, 32 nt, Human
cgccacugcaguccagccugggcaacaagagc

SEQ ID NO: 386307 - RNA, 32 nt, Human
cgccacugcaguccgcaguccagccugggcga

SEQ ID NO: 386308 - RNA, 32 nt, Human
cgccacugcaguccggccugggugaaagagcg

SEQ ID NO: 386309 - RNA, 32 nt, Human
cgccacugcauuacagccuggugcagagcaag

SEQ ID NO: 386310 - RNA, 32 nt, Human
cgccacugcauuccagccuggacgacagagcg

SEQ ID NO: 386311 - RNA, 32 nt, Human
cgccacugcauuccagccugggcgacagagca

SEQ ID NO: 386312 - RNA, 32 nt, Human
cgccacugcauuccagccugggugacugagcg

SEQ ID NO: 386313 - RNA, 32 nt, Human
cgccacugcauuccagccuggugacagagcga

SEQ ID NO: 386314 - RNA, 32 nt, Human
cgccacugcauucuagccuggaugacagagca

SEQ ID NO: 386315 - RNA, 32 nt, Human
cgccacugcauuguagccugggcaacagagca

SEQ ID NO: 386316 - RNA, 32 nt, Human
cgccacugccccuccuacucuccagggguugg

SEQ ID NO: 386317 - RNA, 32 nt, Human
cgccacugcccuccagccugggcgacagaaug

SEQ ID NO: 386318 - RNA, 32 nt, Human
cgccacugccuacaucuucucucuuccccauc

SEQ ID NO: 386319 - RNA, 32 nt, Human
cgccacugcgaugccgccacugggcgacagag

SEQ ID NO: 386320 - RNA, 32 nt, Human
cgccacugcgcuacagccugggcgacacagua

SEQ ID NO: 386321 - RNA, 32 nt, Human
cgccacugcgcuccagccugggcaacagagug

SEQ ID NO: 386322 - RNA, 32 nt, Human
cgccacugcgcuccagccugggcgaaagagug

SEQ ID NO: 386323 - RNA, 32 nt, Human
cgccacugcucuccagccuggguggcagagcg

SEQ ID NO: 386324 - RNA, 32 nt, Human
cgccacugcugccaccacuacagccccuccac

SEQ ID NO: 386325 - RNA, 32 nt, Human
cgccacuggacacaugaggaagaggcugcucu

SEQ ID NO: 386326 - RNA, 32 nt, Human
cgccacuggacuccagccuggacaacagagca

SEQ ID NO: 386327 - RNA, 32 nt, Human
cgccacuggaggagcagcaaauuuguaacaca

SEQ ID NO: 386328 - RNA, 32 nt, Human
cgccacugggcuccagccugggcgacagagug

SEQ ID NO: 386329 - RNA, 32 nt, Human
cgccacuguacuccagccuggacaacagcgag

SEQ ID NO: 386330 - RNA, 32 nt, Human
cgccacuguacuccagccuggaugacacagcg

SEQ ID NO: 386331 - RNA, 32 nt, Human
cgccacuguacuccagccuggcaacagaguga

SEQ ID NO: 386332 - RNA, 32 nt, Human
cgccacuguacuccagccugggagacacagug

SEQ ID NO: 386333 - RNA, 32 nt, Human
cgccacuguacuccagccugggugacagagcg

SEQ ID NO: 386334 - RNA, 32 nt, Human
cgccacuguacuccagccugggugacgagcga

SEQ ID NO: 386335 - RNA, 32 nt, Human
cgccacuguacuccagccugggugaggagagc

SEQ ID NO: 386336 - RNA, 32 nt, Human
cgccacuguacuccauccugggugauggagcg

SEQ ID NO: 386337 - RNA, 32 nt, Human
cgccacugucccgcuagugccugcuaggugca

SEQ ID NO: 386338 - RNA, 32 nt, Human
cgccacuguccugcugcccuccagacaugcug

SEQ ID NO: 386339 - RNA, 32 nt, Human
cgccacugugacgcgcugacaguggaugcgaa

SEQ ID NO: 386340 - RNA, 32 nt, Human
cgccacugugcuccagccugggcaacaaagug

SEQ ID NO: 386341 - RNA, 32 nt, Human
cgccacugugcuccagccugggcaacagagug

SEQ ID NO: 386342 - RNA, 32 nt, Human
cgccacuucacuccagccugggcaacagagug

SEQ ID NO: 386343 - RNA, 32 nt, Human
cgccacuucacuccagccugggugacagagac

SEQ ID NO: 386344 - RNA, 32 nt, Human
cgccacuucacugcagccuggguggcagagug

SEQ ID NO: 386345 - RNA, 32 nt, Human
cgccacuuggccaggagcagagcugccuguaa

SEQ ID NO: 386346 - RNA, 32 nt, Human
cgccacuuugacuuauuuucucuaauaguuua

SEQ ID NO: 386347 - RNA, 32 nt, Human
cgccagaaaggcuccugaggucccagguuggc

SEQ ID NO: 386348 - RNA, 32 nt, Human
cgccagaagcacacuugaggcugcagucgcag

SEQ ID NO: 386349 - RNA, 25 nt, Human
cgccagaagggcaggccgcagagca

SEQ ID NO: 386350 - RNA, 32 nt, Human
cgccagaaguagaccugucuaggcacuaaggg

SEQ ID NO: 386351 - RNA, 32 nt, Human
cgccagacagccgcccgcccacccguucgccc

SEQ ID NO: 386352 - RNA, 32 nt, Human
cgccagacuccuggacacuugccgccugcguu

SEQ ID NO: 386353 - RNA, 32 nt, Human
cgccagagcagccccgcaccacccucgagcuu

SEQ ID NO: 386354 - RNA, 32 nt, Human
cgccagaggaagcacgugcacuaacuggguuu

SEQ ID NO: 386355 - RNA, 32 nt, Human
cgccagaggagaaaauugagauucuugacccu

SEQ ID NO: 386356 - RNA, 32 nt, Human
cgccagaggagaaaugucugaaguaagacccc

SEQ ID NO: 386357 - RNA, 32 nt, Human
cgccagaggccuugccuuucagaagaacccug

SEQ ID NO: 386358 - RNA, 22 nt, Human
cgccagaugccaggacgcccuc

SEQ ID NO: 386359 - RNA, 23 nt, Human
cgccagaugcugccagucauuag

SEQ ID NO: 386360 - RNA, 32 nt, Human
cgccagcaaaacuuagaugugagaaaaccccu

SEQ ID NO: 386361 - RNA, 32 nt, Human
cgccagcaacagcuccagcccagccaguccag

SEQ ID NO: 386362 - RNA, 32 nt, Human
cgccagcaauagauacucccacccccucaaaa

SEQ ID NO: 386363 - RNA, 32 nt, Human
cgccagcacagcuucaguuggggaagauauua

SEQ ID NO: 386364 - RNA, 32 nt, Human
cgccagcagccccucgccgcgcguccagcguu

SEQ ID NO: 386365 - RNA, 32 nt, Human
cgccagcagcccugcacuccacgcuggccaag

SEQ ID NO: 386366 - RNA, 32 nt, Human
cgccagcagguggagcuugacgugacgucuua

SEQ ID NO: 386367 - RNA, 32 nt, Human
cgccagcauggccaccaccgccaccugcaccc

SEQ ID NO: 386368 - RNA, 32 nt, Human
cgccagccaagcccagccugagccagcacuug

SEQ ID NO: 386369 - RNA, 32 nt, Human
cgccagccccggccccagccauggaagagcuc

SEQ ID NO: 386370 - RNA, 32 nt, Human
cgccagcccugccucugggcccugggggcugg

SEQ ID NO: 386371 - RNA, 32 nt, Human
cgccagcccuggaagcugagccugacccagca

SEQ ID NO: 386372 - RNA, 32 nt, Human
cgccagccgagaucgcagcccaacccauggcc

SEQ ID NO: 386373 - RNA, 32 nt, Human
cgccagccgcagccaggcugggcugagagcau

SEQ ID NO: 386374 - RNA, 32 nt, Human
cgccagccgccuuccccagcagccgcaggugg

SEQ ID NO: 386375 - RNA, 32 nt, Human
cgccagccuccuccuggaccucuuggccccca

SEQ ID NO: 386376 - RNA, 32 nt, Human
cgccagccuggagugagggagcaggaucuggg

SEQ ID NO: 386377 - RNA, 22 nt, Human
cgccagcgagcugugccgagag

SEQ ID NO: 386378 - RNA, 21 nt, Human
cgccagcgcccagccagggag

SEQ ID NO: 386379 - RNA, 32 nt, Human
cgccagcgccgagcccagcccugaagucguuu

SEQ ID NO: 386380 - RNA, 23 nt, Human
cgccagcgccucagcucugugga

SEQ ID NO: 386381 - RNA, 32 nt, Human
cgccagcgccugucccugucacggaccccagc

SEQ ID NO: 386382 - RNA, 32 nt, Human
cgccagcucccagguccccacuccuguaccgg

SEQ ID NO: 386383 - RNA, 32 nt, Human
cgccagcuccccucagccgaggcugcuccgcg

SEQ ID NO: 386384 - RNA, 32 nt, Human
cgccagcuccugugcuggacauggccccggcc

SEQ ID NO: 386385 - RNA, 22 nt, Human
cgccagcucugcagagcccaga

SEQ ID NO: 386386 - RNA, 32 nt, Human
cgccagcugcaucagaucccuccagggccuca

SEQ ID NO: 386387 - RNA, 32 nt, Human
cgccagcugccuguagccacguggcauccugc

SEQ ID NO: 386388 - RNA, 22 nt, Human
cgccagcugcggcggcgcgucg

SEQ ID NO: 386389 - RNA, 24 nt, Human
cgccagcugcggcggcgcgucggg

SEQ ID NO: 386390 - RNA, 19 nt, Human
cgccagcuggagugcagug

SEQ ID NO: 386391 - RNA, 32 nt, Human
cgccagcugggagcacuggugugaacucaccc

SEQ ID NO: 386392 - RNA, 18 nt, Human
cgccagcuucaacgggua

SEQ ID NO: 386393 - RNA, 32 nt, Human
cgccagcuuggcccugcagccagcacaggaac

SEQ ID NO: 386394 - RNA, 32 nt, Human
cgccaggaacagcuugagguaccugagcccug

SEQ ID NO: 386395 - RNA, 17 nt, Human
cgccaggaaggagcaug

SEQ ID NO: 386396 - RNA, 19 nt, Human
cgccaggacgcagcgcucc

SEQ ID NO: 386397 - RNA, 19 nt, Human
cgccaggacuaugcuccca

SEQ ID NO: 386398 - RNA, 31 nt, Human
cgccaggacuucucugggcuguguuuaaacg

SEQ ID NO: 386399 - RNA, 22 nt, Human
cgccaggagccccgcagcuccu

SEQ ID NO: 386400 - RNA, 32 nt, Human
cgccaggagcugcuacagcagaggcggagguu

SEQ ID NO: 386401 - RNA, 32 nt, Human
cgccaggauccccugagggucugggauggggg

SEQ ID NO: 386402 - RNA, 22 nt, Human
cgccaggcaaagcgccagcagc

SEQ ID NO: 386403 - RNA, 32 nt, Human
cgccaggcaaagcgccagcagcccugcacucc

SEQ ID NO: 386404 - RNA, 32 nt, Human
cgccaggcaagugcccuuagaaaccgggcccc

SEQ ID NO: 386405 - RNA, 20 nt, Human
cgccaggcagaaggcgcagc

SEQ ID NO: 386406 - RNA, 23 nt, Human
cgccaggcagucgccuagcaaca

SEQ ID NO: 386407 - RNA, 32 nt, Human
cgccaggcccaggaggcgacugcaugguggag

SEQ ID NO: 386408 - RNA, 32 nt, Human
cgccaggccggggaagguuggagcagccccca

SEQ ID NO: 386409 - RNA, 32 nt, Human
cgccaggccuuaguggguucccuuuccugucc

SEQ ID NO: 386410 - RNA, 32 nt, Human
cgccaggcgcucgcaggcaugcagcccgggag

SEQ ID NO: 386411 - RNA, 21 nt, Human
cgccaggcuggagugcagugg

SEQ ID NO: 386412 - RNA, 32 nt, Human
cgccaggcuggucucuaacuccugggcucagu

SEQ ID NO: 386413 - RNA, 32 nt, Human
cgccagggagagaaggggagugcggagccccg

SEQ ID NO: 386414 - RNA, 31 nt, Human
cgccagggcaaaggagcugagcagccauccc

SEQ ID NO: 386415 - RNA, 32 nt, Human
cgccagggcugcgccugggcauggaagagggg

SEQ ID NO: 386416 - RNA, 31 nt, Human
cgccaggggaaacuggcauaagaugcugcuc

SEQ ID NO: 386417 - RNA, 32 nt, Human
cgccaggggaaaggaggaacaucccucccagg

SEQ ID NO: 386418 - RNA, 32 nt, Human
cgccaggggcaggcagcuaggcagggaggggg

SEQ ID NO: 386419 - RNA, 32 nt, Human
cgccaggggcgcgccgcagccacccacccucc

SEQ ID NO: 386420 - RNA, 32 nt, Human
cgccaggggucugccccaauccuggccugcau

SEQ ID NO: 386421 - RNA, 32 nt, Human
cgccagggucaccaggugagcaaggcugggga

SEQ ID NO: 386422 - RNA, 32 nt, Human
cgccagguccugaguguucccugcucggacug

SEQ ID NO: 386423 - RNA, 32 nt, Human
cgccaggucuaugaaaacaccugcucugauau

SEQ ID NO: 386424 - RNA, 32 nt, Human
cgccaggucugacuaggaaggaggauggggag

SEQ ID NO: 386425 - RNA, 32 nt, Human
cgccagguuuauucagucaccaugaagcugcu

SEQ ID NO: 386426 - RNA, 32 nt, Human
cgccagguuuccuggagcucuuggcuucagcc

SEQ ID NO: 386427 - RNA, 32 nt, Human
cgccagucagccccaaggagguggccacccug

SEQ ID NO: 386428 - RNA, 32 nt, Human
cgccagucucucuucccacuugcugacccuuu

SEQ ID NO: 386429 - RNA, 32 nt, Human
cgccagucugcccagcugcaguacucacgccc

SEQ ID NO: 386430 - RNA, 32 nt, Human
cgccagugagccuccuggaagggcagcaaguu

SEQ ID NO: 386431 - RNA, 32 nt, Human
cgccagugcaagaccgagacugagggaaagca

SEQ ID NO: 386432 - RNA, 32 nt, Human
cgccagugcacuccagccugggcaagaagagc

SEQ ID NO: 386433 - RNA, 32 nt, Human
cgccagugcacuccagcugggcgacagagcga

SEQ ID NO: 386434 - RNA, 32 nt, Human
cgccagugccuugccagugugcacggucccac

SEQ ID NO: 386435 - RNA, 32 nt, Human
cgccagugucccuguaaugcuuucugguguga

SEQ ID NO: 386436 - RNA, 32 nt, Human
cgccaguuuccuggguccucuucagaggccag

SEQ ID NO: 386437 - RNA, 32 nt, Human
cgccaguuucuaacgcccucaccauuuuuauu

SEQ ID NO: 386438 - RNA, 32 nt, Human
cgccauagcaauugcacuccggccugggcaac

SEQ ID NO: 386439 - RNA, 32 nt, Human
cgccauagcacuccagccuuagccugggcgac

SEQ ID NO: 386440 - RNA, 32 nt, Human
cgccauaggccuagcauugucaccaacggagc

SEQ ID NO: 386441 - RNA, 32 nt, Human
cgccauaucccacuccaaaccagcacaacuau

SEQ ID NO: 386442 - RNA, 32 nt, Human
cgccaucauccuggcugucaucaacaguggga

SEQ ID NO: 386443 - RNA, 32 nt, Human
cgccaucaucgagcgcacggccagcuucgugu

SEQ ID NO: 386444 - RNA, 32 nt, Human
cgccaucaugccggccguguccaagggcgaug

SEQ ID NO: 386445 - RNA, 32 nt, Human
cgccauccacaucugcucggcaaagaaggaag

SEQ ID NO: 386446 - RNA, 32 nt, Human
cgccauccagcacccagacuccagcaccggcc

SEQ ID NO: 386447 - RNA, 32 nt, Human
cgccaucccagagggcucaggaugccccagga

SEQ ID NO: 386448 - RNA, 32 nt, Human
cgccaucccugcaggccagggcacacggugcg

SEQ ID NO: 386449 - RNA, 32 nt, Human
cgccaucccuucgaucacgugcaccugcugcc

SEQ ID NO: 386450 - RNA, 32 nt, Human
cgccaucccuuuccacaguauccuucuucccu

SEQ ID NO: 386451 - RNA, 32 nt, Human
cgccauccgcagagcaaggcugccucggggcg

SEQ ID NO: 386452 - RNA, 32 nt, Human
cgccauccuagagugaggcucuguccaauaca

SEQ ID NO: 386453 - RNA, 32 nt, Human
cgccaucgcacuccagccugggcaacaagagc

SEQ ID NO: 386454 - RNA, 32 nt, Human
cgccaucgcacuccagccugggugacaagagc

SEQ ID NO: 386455 - RNA, 32 nt, Human
cgccaucgucccggcugaagugcaguggcacg

SEQ ID NO: 386456 - RNA, 32 nt, Human
cgccaucgugguguguucuugacuccgcugcu

SEQ ID NO: 386457 - RNA, 32 nt, Human
cgccaucucccaggcucaagggauccuccugc

SEQ ID NO: 386458 - RNA, 32 nt, Human
cgccaucuuggcuccggaucgugcgugaggcg

SEQ ID NO: 386459 - RNA, 32 nt, Human
cgccaugaacuugccaagagcugagcgccuuc

SEQ ID NO: 386460 - RNA, 32 nt, Human
cgccaugacgaccgcguccaccucacaggugc

SEQ ID NO: 386461 - RNA, 29 nt, Human
cgccaugacgaccgcguccaccucgcagg

SEQ ID NO: 386462 - RNA, 29 nt, Human
cgccaugagggcucugcugcuccuggggu

SEQ ID NO: 386463 - RNA, 32 nt, Human
cgccaugcagagcugcucucacuucuccucgg

SEQ ID NO: 386464 - RNA, 32 nt, Human
cgccaugccaggcuaauuuuuguguuuuuagu

SEQ ID NO: 386465 - RNA, 32 nt, Human
cgccaugcccggcuaauuuuuguauuuuuagu

SEQ ID NO: 386466 - RNA, 29 nt, Human
cgccauggagcagcgccgcgucaccgacu

SEQ ID NO: 386467 - RNA, 29 nt, Human
cgccauggaggugcuggagagcggggagc

SEQ ID NO: 386468 - RNA, 32 nt, Human
cgccauggcacucacuccagccugggcaacaa

SEQ ID NO: 386469 - RNA, 29 nt, Human
cgccauggcuauggcuaguguuaaauugc

SEQ ID NO: 386470 - RNA, 32 nt, Human
cgccauggcucacaccuguaucccaacacuuu

SEQ ID NO: 386471 - RNA, 32 nt, Human
cgccauggcucacgucuguaaucccagcacuu

SEQ ID NO: 386472 - RNA, 29 nt, Human
cgccauggcugaaaacacagagggggauc

SEQ ID NO: 386473 - RNA, 29 nt, Human
cgccaugggccuagagcuguuucuugacc

SEQ ID NO: 386474 - RNA, 32 nt, Human
cgccauggggacaucaggcaaggucuggagac

SEQ ID NO: 386475 - RNA, 32 nt, Human
cgccauggugggcgccacagaccuugucagaa

SEQ ID NO: 386476 - RNA, 32 nt, Human
cgccauguaugacaaguguuacugcaagaaau

SEQ ID NO: 386477 - RNA, 32 nt, Human
cgccaugucucacuccuguaauaccagcacuu

SEQ ID NO: 386478 - RNA, 32 nt, Human
cgccaugugauggacacuccagggacacacag

SEQ ID NO: 386479 - RNA, 32 nt, Human
cgccauguggaugcuguugugauugcuguuug

SEQ ID NO: 386480 - RNA, 32 nt, Human
cgccauguuauccaggcuggccucaaacuccu

SEQ ID NO: 386481 - RNA, 32 nt, Human
cgccauguugcacaggcuggucucaaacucuu

SEQ ID NO: 386482 - RNA, 32 nt, Human
cgccauguugcccaggcuggucucaaacaccu

SEQ ID NO: 386483 - RNA, 32 nt, Human
cgccauguugcccaggcuggucucaaacuugu

SEQ ID NO: 386484 - RNA, 32 nt, Human
cgccauguugcccaggcuggucucgaacaucu

SEQ ID NO: 386485 - RNA, 32 nt, Human
cgccauguugcccaggcuggucucgaacuucu

SEQ ID NO: 386486 - RNA, 32 nt, Human
cgccauguuggccaggcuggucucaaacuccu

SEQ ID NO: 386487 - RNA, 32 nt, Human
cgccauguuggccaggcuggucucgaacaccu

SEQ ID NO: 386488 - RNA, 32 nt, Human
cgccauguuggccaggcuggucucgaaccccu

SEQ ID NO: 386489 - RNA, 32 nt, Human
cgccauguuggccaggcuggucucgaacuccu

SEQ ID NO: 386490 - RNA, 32 nt, Human
cgccauguuggccaggcuggucucgaacucuu

SEQ ID NO: 386491 - RNA, 32 nt, Human
cgccauguuggccaggcugguuucaaacuccu

SEQ ID NO: 386492 - RNA, 32 nt, Human
cgccauguuucccaggcugguguggaacuccu

SEQ ID NO: 386493 - RNA, 32 nt, Human
cgccauuacacuccagccuggcugacagugca

SEQ ID NO: 386494 - RNA, 32 nt, Human
cgccauuacacuccagccugggugacagagca

SEQ ID NO: 386495 - RNA, 32 nt, Human
cgccauuacacuucagccugggcaacaagagc

SEQ ID NO: 386496 - RNA, 32 nt, Human
cgccauucaccugaacucugcagcucaucggc

SEQ ID NO: 386497 - RNA, 17 nt, Human
cgccauucuaacaggua

SEQ ID NO: 386498 - RNA, 32 nt, Human
cgccauucuacuccagccugggccacaaggca

SEQ ID NO: 386499 - RNA, 32 nt, Human
cgccauucuggaacgcagucuucaccauuucu

SEQ ID NO: 386500 - RNA, 31 nt, Human
cgccauugcaccccagccugggcaaugagug

SEQ ID NO: 386501 - RNA, 32 nt, Human
cgccauugcacuacagccugggugacagagca

SEQ ID NO: 386502 - RNA, 32 nt, Human
cgccauugcacucaagccugggcaauaagaau

SEQ ID NO: 386503 - RNA, 32 nt, Human
cgccauugcacuccaaccuggacgacagagca

SEQ ID NO: 386504 - RNA, 32 nt, Human
cgccauugcacuccaaccugggugacaagagc

SEQ ID NO: 386505 - RNA, 32 nt, Human
cgccauugcacuccacacuccagccugagcaa

SEQ ID NO: 386506 - RNA, 32 nt, Human
cgccauugcacuccagccuaggcaauaagagc

SEQ ID NO: 386507 - RNA, 32 nt, Human
cgccauugcacuccagccuagguaacaagagg

SEQ ID NO: 386508 - RNA, 32 nt, Human
cgccauugcacuccagccuggcugacagagcg

SEQ ID NO: 386509 - RNA, 32 nt, Human
cgccauugcacuccagccugggcaaaaagagc

SEQ ID NO: 386510 - RNA, 32 nt, Human
cgccauugcacuccagccugggcaaaaagagu

SEQ ID NO: 386511 - RNA, 32 nt, Human
cgccauugcacuccagccugggcaacaacagu

SEQ ID NO: 386512 - RNA, 32 nt, Human
cgccauugcacuccagccugggcaacaagaga

SEQ ID NO: 386513 - RNA, 32 nt, Human
cgccauugcacuccagccugggcaacaagagc

SEQ ID NO: 386514 - RNA, 32 nt, Human
cgccauugcacuccagccugggcaacaagagu

SEQ ID NO: 386515 - RNA, 32 nt, Human
cgccauugcacuccagccugggcaacaagcga

SEQ ID NO: 386516 - RNA, 32 nt, Human
cgccauugcacuccagccugggcaacagagug

SEQ ID NO: 386517 - RNA, 32 nt, Human
cgccauugcacuccagccugggcaacaguguu

SEQ ID NO: 386518 - RNA, 32 nt, Human
cgccauugcacuccagccugggcaacgaaaag

SEQ ID NO: 386519 - RNA, 32 nt, Human
cgccauugcacuccagccugggcaacgagagg

SEQ ID NO: 386520 - RNA, 32 nt, Human
cgccauugcacuccagccugggcaacgaguga

SEQ ID NO: 386521 - RNA, 32 nt, Human
cgccauugcacuccagccugggcaacuccguc

SEQ ID NO: 386522 - RNA, 32 nt, Human
cgccauugcacuccagccugggcaauaagagc

SEQ ID NO: 386523 - RNA, 32 nt, Human
cgccauugcacuccagccugggcgacaagagc

SEQ ID NO: 386524 - RNA, 32 nt, Human
cgccauugcacuccagccugggcgacagagcg

SEQ ID NO: 386525 - RNA, 32 nt, Human
cgccauugcacuccagccugggcgacagagug

SEQ ID NO: 386526 - RNA, 32 nt, Human
cgccauugcacuccagccugggcgacugaaua

SEQ ID NO: 386527 - RNA, 32 nt, Human
cgccauugcacuccagccugggcggcagagca

SEQ ID NO: 386528 - RNA, 32 nt, Human
cgccauugcacuccagccuggggacaaagcaa

SEQ ID NO: 386529 - RNA, 32 nt, Human
cgccauugcacuccagccugggggacaagagu

SEQ ID NO: 386530 - RNA, 32 nt, Human
cgccauugcacuccagccugggggacagagca

SEQ ID NO: 386531 - RNA, 32 nt, Human
cgccauugcacuccagccugggugacaagagu

SEQ ID NO: 386532 - RNA, 32 nt, Human
cgccauugcacuccagccugggugacacagug

SEQ ID NO: 386533 - RNA, 32 nt, Human
cgccauugcacuccagccugggugacagaacg

SEQ ID NO: 386534 - RNA, 32 nt, Human
cgccauugcacuccagccugggugacagagca

SEQ ID NO: 386535 - RNA, 32 nt, Human
cgccauugcacuccagccugggugacagagug

SEQ ID NO: 386536 - RNA, 32 nt, Human
cgccauugcacuccagccugggugacgaguga

SEQ ID NO: 386537 - RNA, 32 nt, Human
cgccauugcacuccagccugggugagaagagc

SEQ ID NO: 386538 - RNA, 32 nt, Human
cgccauugcacuccagcuugggcaauaagaau

SEQ ID NO: 386539 - RNA, 32 nt, Human
cgccauugcacuccagucugggugacagagca

SEQ ID NO: 386540 - RNA, 32 nt, Human
cgccauugcacuccagucugguugacagagug

SEQ ID NO: 386541 - RNA, 32 nt, Human
cgccauugcacuccauucugggcaacaagagc

SEQ ID NO: 386542 - RNA, 32 nt, Human
cgccauugcacuccggccuggggacaagagca

SEQ ID NO: 386543 - RNA, 32 nt, Human
cgccauugcagcuuguuuucacuugcuuuuua

SEQ ID NO: 386544 - RNA, 32 nt, Human
cgccauugcagggcagccugguuacagaguga

SEQ ID NO: 386545 - RNA, 32 nt, Human
cgccauugcauuccagccugggcaacaagagc

SEQ ID NO: 386546 - RNA, 32 nt, Human
cgccauugcauuccagccugggugacagagcg

SEQ ID NO: 386547 - RNA, 32 nt, Human
cgccauugcccaggcuugcuuagguaaacaaa

SEQ ID NO: 386548 - RNA, 32 nt, Human
cgccauugccuagcuugccguaaugauucuau

SEQ ID NO: 386549 - RNA, 32 nt, Human
cgccauugggcagagggauuggcaagcuugcg

SEQ ID NO: 386550 - RNA, 32 nt, Human
cgccauuguacuccagccuggcaacagagcga

SEQ ID NO: 386551 - RNA, 32 nt, Human
cgccauuguacuccagccugggcaacaagagc

SEQ ID NO: 386552 - RNA, 32 nt, Human
cgccauuguacuccagccugggcaacaagagu

SEQ ID NO: 386553 - RNA, 32 nt, Human
cgccauuguacuccagccugggcgacagagca

SEQ ID NO: 386554 - RNA, 32 nt, Human
cgccauuguacuccagccugggcgaugagcaa

SEQ ID NO: 386555 - RNA, 32 nt, Human
cgccauuguacuccagccugggggacaggagc

SEQ ID NO: 386556 - RNA, 32 nt, Human
cgccauuguccgcggcugagguugggauuugc

SEQ ID NO: 386557 - RNA, 32 nt, Human
cgccauugugcuccagccugggugacaaagca

SEQ ID NO: 386558 - RNA, 32 nt, Human
cgccauuucacuccagccugggcgacagagca

SEQ ID NO: 386559 - RNA, 32 nt, Human
cgccauuuccuggaaaaauuggggcugggacu

SEQ ID NO: 386560 - RNA, 32 nt, Human
cgccauuucggacugggagcgagcgcggcgca

SEQ ID NO: 386561 - RNA, 32 nt, Human
cgccauuugggaggggagcagagccaggccgg

SEQ ID NO: 386562 - RNA, 24 nt, Human
cgcccaaaauaaagcaccacuuca

SEQ ID NO: 386563 - RNA, 25 nt, Human
cgcccaaaauagcccccggcgccag

SEQ ID NO: 386564 - RNA, 22 nt, Human
cgcccaaacuggagugcagugg

SEQ ID NO: 386565 - RNA, 32 nt, Human
cgcccaaagcgcugggauuacaggcgugagcc

SEQ ID NO: 386566 - RNA, 32 nt, Human
cgcccaaaguguugggauuacaggcaugagcc

SEQ ID NO: 386567 - RNA, 16 nt, Human
cgcccaacgacgagug

SEQ ID NO: 386568 - RNA, 32 nt, Human
cgcccaagagccuuccucccgggggaaugaga

SEQ ID NO: 386569 - RNA, 32 nt, Human
cgcccaagccagugcaaggcccaggggccuga

SEQ ID NO: 386570 - RNA, 28 nt, Human
cgcccaaggaagucaacaggagagccag

SEQ ID NO: 386571 - RNA, 32 nt, Human
cgcccaaggccuuccccuggcacuggcaaaca

SEQ ID NO: 386572 - RNA, 28 nt, Human
cgcccaagggagguccccacagagccag

SEQ ID NO: 386573 - RNA, 32 nt, Human
cgcccaauagcccaggcuggagugcaguggca

SEQ ID NO: 386574 - RNA, 32 nt, Human
cgcccaauauggugaaaccccgucucuccuga

SEQ ID NO: 386575 - RNA, 32 nt, Human
cgcccaauguuaggaaucaagccucauuuaca

SEQ ID NO: 386576 - RNA, 32 nt, Human
cgcccacacagcccacuuguuuggguggggcc

SEQ ID NO: 386577 - RNA, 32 nt, Human
cgcccacaccccuccuucccagucccaugauc

SEQ ID NO: 386578 - RNA, 32 nt, Human
cgcccacagcagagggcgguauuagggagggg

SEQ ID NO: 386579 - RNA, 32 nt, Human
cgcccacagccagccccaaccuccagggcugu

SEQ ID NO: 386580 - RNA, 16 nt, Human
cgcccacaggacucca

SEQ ID NO: 386581 - RNA, 32 nt, Human
cgcccacaggcagggcacacugggcagccagc

SEQ ID NO: 386582 - RNA, 32 nt, Human
cgcccaccaugcgcggcugccugcggcucgcg

SEQ ID NO: 386583 - RNA, 32 nt, Human
cgcccacccaccucccuccaccccgugccacg

SEQ ID NO: 386584 - RNA, 32 nt, Human
cgcccacccagcuguguguccuccgccgaggg

SEQ ID NO: 386585 - RNA, 32 nt, Human
cgcccacccaggcuggaguacaguggcacgau

SEQ ID NO: 386586 - RNA, 21 nt, Human
cgcccacccccggcuccagga

SEQ ID NO: 386587 - RNA, 18 nt, Human
cgcccacccgccuuguga

SEQ ID NO: 386588 - RNA, 32 nt, Human
cgcccacccugcggcccugccagugguagcac

SEQ ID NO: 386589 - RNA, 32 nt, Human
cgcccacccugcucccuuccggacaaugaaga

SEQ ID NO: 386590 - RNA, 32 nt, Human
cgcccacccugugcccuggcgccgcugcaaca

SEQ ID NO: 386591 - RNA, 32 nt, Human
cgcccaccgcagaggaggggcgaugggggugg

SEQ ID NO: 386592 - RNA, 32 nt, Human
cgcccaccuguaauccuagcugcucagggggc

SEQ ID NO: 386593 - RNA, 32 nt, Human
cgcccaccuucgggaggaucaggcugcuucug

SEQ ID NO: 386594 - RNA, 21 nt, Human
cgcccacgaccgcagcagccu

SEQ ID NO: 386595 - RNA, 32 nt, Human
cgcccacgcuuaacaggaagcuccuaggccuc

SEQ ID NO: 386596 - RNA, 32 nt, Human
cgcccacggaagcacccgagcgaccggagaaa

SEQ ID NO: 386597 - RNA, 20 nt, Human
cgcccacggcccgagcgccc

SEQ ID NO: 386598 - RNA, 32 nt, Human
cgcccacucuagacaucagccuccagguugac

SEQ ID NO: 386599 - RNA, 32 nt, Human
cgcccacugcacuccagguugggcuacagagu

SEQ ID NO: 386600 - RNA, 32 nt, Human
cgcccagaccccuccuucccagucccaugauc

SEQ ID NO: 386601 - RNA, 21 nt, Human
cgcccagacuggaguccagug

SEQ ID NO: 386602 - RNA, 21 nt, Human
cgcccagacuggagugcugug

SEQ ID NO: 386603 - RNA, 32 nt, Human
cgcccagagaagcacagcaugcgugccugcac

SEQ ID NO: 386604 - RNA, 32 nt, Human
cgcccagagaucaugcagagugaacagaacug

SEQ ID NO: 386605 - RNA, 32 nt, Human
cgcccagagaugaccgcgaccgaagcccuccu

SEQ ID NO: 386606 - RNA, 32 nt, Human
cgcccagagcagcagcaacagcgaagaugcga

SEQ ID NO: 386607 - RNA, 32 nt, Human
cgcccagagcccagauagagagacacggccuc

SEQ ID NO: 386608 - RNA, 32 nt, Human
cgcccagaugcugaaggaucacuugguaacug

SEQ ID NO: 386609 - RNA, 32 nt, Human
cgcccagcagaggcguacuacccagcucuguc

SEQ ID NO: 386610 - RNA, 32 nt, Human
cgcccagcagccgccgccgccgcccggccggc

SEQ ID NO: 386611 - RNA, 32 nt, Human
cgcccagcaguguccugcccucugccugggcc

SEQ ID NO: 386612 - RNA, 32 nt, Human
cgcccagcaugcagaacaaaagcacaacgcac

SEQ ID NO: 386613 - RNA, 32 nt, Human
cgcccagccagcugccuggccucccuccugug

SEQ ID NO: 386614 - RNA, 32 nt, Human
cgcccagccaugcgcgccgccugcugaguccg

SEQ ID NO: 386615 - RNA, 21 nt, Human
cgcccagccccggccccugga

SEQ ID NO: 386616 - RNA, 21 nt, Human
cgcccagccuggagugcagug

SEQ ID NO: 386617 - RNA, 32 nt, Human
cgcccagcuaauuuuuguauuuuugguagaga

SEQ ID NO: 386618 - RNA, 32 nt, Human
cgcccagcugcagacccuccaggcuggaggac

SEQ ID NO: 386619 - RNA, 32 nt, Human
cgcccagcuggcugcagcacuuguagcaugca

SEQ ID NO: 386620 - RNA, 32 nt, Human
cgcccaggaccagucugcccacugccuaaaug

SEQ ID NO: 386621 - RNA, 32 nt, Human
cgcccaggagcugggcccugccacccaggccg

SEQ ID NO: 386622 - RNA, 21 nt, Human
cgcccaggauggagugcagug

SEQ ID NO: 386623 - RNA, 32 nt, Human
cgcccaggcaaggccgcccugccuugggcgca

SEQ ID NO: 386624 - RNA, 32 nt, Human
cgcccaggcagcggaauagagugcagugcuug

SEQ ID NO: 386625 - RNA, 20 nt, Human
cgcccaggccaggccugugg

SEQ ID NO: 386626 - RNA, 32 nt, Human
cgcccaggcccagcggccguagcuagcgucug

SEQ ID NO: 386627 - RNA, 19 nt, Human
cgcccaggccccugcgugg

SEQ ID NO: 386628 - RNA, 20 nt, Human
cgcccaggcgggagugcagu

SEQ ID NO: 386629 - RNA, 21 nt, Human
cgcccaggcgggagugcagug

SEQ ID NO: 386630 - RNA, 22 nt, Human
cgcccaggcgggagugcagugg

SEQ ID NO: 386631 - RNA, 22 nt, Human
cgcccaggcuagagugcagugg

SEQ ID NO: 386632 - RNA, 20 nt, Human
cgcccaggcugaguacagug

SEQ ID NO: 386633 - RNA, 32 nt, Human
cgcccaggcugcaaccucgaccucccgggcuc

SEQ ID NO: 386634 - RNA, 20 nt, Human
cgcccaggcugcagugcagu

SEQ ID NO: 386635 - RNA, 21 nt, Human
cgcccaggcugcagugcagug

SEQ ID NO: 386636 - RNA, 32 nt, Human
cgcccaggcugcugccagugcacacuuuuaca

SEQ ID NO: 386637 - RNA, 20 nt, Human
cgcccaggcuggacugcagu

SEQ ID NO: 386638 - RNA, 21 nt, Human
cgcccaggcuggacugcagug

SEQ ID NO: 386639 - RNA, 21 nt, Human
cgcccaggcuggaguacagug

SEQ ID NO: 386640 - RNA, 22 nt, Human
cgcccaggcuggaguacagugg

SEQ ID NO: 386641 - RNA, 24 nt, Human
cgcccaggcuggagugcaacggug

SEQ ID NO: 386642 - RNA, 21 nt, Human
cgcccaggcuggagugcaaug

SEQ ID NO: 386643 - RNA, 24 nt, Human
cgcccaggcuggagugcaauggug

SEQ ID NO: 386644 - RNA, 19 nt, Human
cgcccaggcuggagugcag

SEQ ID NO: 386645 - RNA, 20 nt, Human
cgcccaggcuggagugcagu

SEQ ID NO: 386646 - RNA, 24 nt, Human
cgcccaggcuggagugcaguagug

SEQ ID NO: 386647 - RNA, 21 nt, Human
cgcccaggcuggagugcagug

SEQ ID NO: 386648 - RNA, 22 nt, Human
cgcccaggcuggagugcagugg

SEQ ID NO: 386649 - RNA, 24 nt, Human
cgcccaggcuggagugcaguggug

SEQ ID NO: 386650 - RNA, 21 nt, Human
cgcccaggcuggagugcgaug

SEQ ID NO: 386651 - RNA, 21 nt, Human
cgcccaggcuggagugcggug

SEQ ID NO: 386652 - RNA, 21 nt, Human
cgcccaggcuggcgugcagug

SEQ ID NO: 386653 - RNA, 18 nt, Human
cgcccaggcugggugcag

SEQ ID NO: 386654 - RNA, 21 nt, Human
cgcccaggcuguagugcaaug

SEQ ID NO: 386655 - RNA, 21 nt, Human
cgcccaggcuguagugcagug

SEQ ID NO: 386656 - RNA, 32 nt, Human
cgcccagggaagagaguggccuggcccaagcc

SEQ ID NO: 386657 - RNA, 28 nt, Human
cgcccagggagcggcuuccgggagccgg

SEQ ID NO: 386658 - RNA, 32 nt, Human
cgcccagggcucugagacugagccugccaucc

SEQ ID NO: 386659 - RNA, 22 nt, Human
cgcccagggcuggagugcagug

SEQ ID NO: 386660 - RNA, 32 nt, Human
cgcccagggcuggagugcaguggcgcgaucau

SEQ ID NO: 386661 - RNA, 21 nt, Human
cgcccagggcugggacagugg

SEQ ID NO: 386662 - RNA, 32 nt, Human
cgcccagggcugggugcaguggcucacgccug

SEQ ID NO: 386663 - RNA, 27 nt, Human
cgcccagggucuggggcagcagagcca

SEQ ID NO: 386664 - RNA, 21 nt, Human
cgcccaggguggagugcagug

SEQ ID NO: 386665 - RNA, 32 nt, Human
cgcccagguaagggaaagccucagcuccuucc

SEQ ID NO: 386666 - RNA, 32 nt, Human
cgcccaggucugggagccccaggcuggccuca

SEQ ID NO: 386667 - RNA, 32 nt, Human
cgcccagguguaaucagagccaaccugguggg

SEQ ID NO: 386668 - RNA, 32 nt, Human
cgcccagucucuccccacguucuugaacucgg

SEQ ID NO: 386669 - RNA, 23 nt, Human
cgcccaguuccuuuuuugucuuu

SEQ ID NO: 386670 - RNA, 19 nt, Human
cgcccaucccaggacucca

SEQ ID NO: 386671 - RNA, 32 nt, Human
cgcccauccucugacucugcagugccagcuug

SEQ ID NO: 386672 - RNA, 32 nt, Human
cgcccauccucuuccccucuguuucccacuag

SEQ ID NO: 386673 - RNA, 32 nt, Human
cgcccauccuuaggccaaacaguacccaaggc

SEQ ID NO: 386674 - RNA, 32 nt, Human
cgcccaugcucagcuugugagcuucuucccgg

SEQ ID NO: 386675 - RNA, 32 nt, Human
cgcccaugcucucagccuuucucccucccccg

SEQ ID NO: 386676 - RNA, 32 nt, Human
cgcccaugcugcugccccuagccugccugcac

SEQ ID NO: 386677 - RNA, 21 nt, Human
cgcccaugcuggagugcagug

SEQ ID NO: 386678 - RNA, 32 nt, Human
cgcccauuccagacugggaaccagcuuucagu

SEQ ID NO: 386679 - RNA, 32 nt, Human
cgcccauucccgaccuccaccuagggugccug

SEQ ID NO: 386680 - RNA, 32 nt, Human
cgcccauugcagcaugucguauccugggggcu

SEQ ID NO: 386681 - RNA, 20 nt, Human
cgccccaacacuguccuucc

SEQ ID NO: 386682 - RNA, 19 nt, Human
cgccccaaccugcuccucc

SEQ ID NO: 386683 - RNA, 32 nt, Human
cgccccacaccucuccccuuugggcuggacgg

SEQ ID NO: 386684 - RNA, 32 nt, Human
cgccccacagcccgagccggagagggagcgcg

SEQ ID NO: 386685 - RNA, 32 nt, Human
cgccccacagccggcgccgcgccaugcuccac

SEQ ID NO: 386686 - RNA, 32 nt, Human
cgccccacauuccuccuucucagugaggguga

SEQ ID NO: 386687 - RNA, 32 nt, Human
cgccccaccccgccagcuccagagccacgacu

SEQ ID NO: 386688 - RNA, 32 nt, Human
cgccccaccggcugggacucuuccaugcaguu

SEQ ID NO: 386689 - RNA, 32 nt, Human
cgccccaccuguguccccaucucggccggccc

SEQ ID NO: 386690 - RNA, 32 nt, Human
cgccccacgcuucucccgcuccgggccccgca

SEQ ID NO: 386691 - RNA, 32 nt, Human
cgccccacuacacuccagccuggucaacagag

SEQ ID NO: 386692 - RNA, 19 nt, Human
cgccccacuccccggcgcc

SEQ ID NO: 386693 - RNA, 32 nt, Human
cgccccacugcacuccagccuggcaauagacc

SEQ ID NO: 386694 - RNA, 32 nt, Human
cgccccacugcacuccagccugggcgacagaa

SEQ ID NO: 386695 - RNA, 32 nt, Human
cgccccacugcacuccagccuggugacuccgu

SEQ ID NO: 386696 - RNA, 32 nt, Human
cgccccacugcuuuucaaccugggugacagaa

SEQ ID NO: 386697 - RNA, 32 nt, Human
cgccccagaaaugcugcuuccauaucagcugc

SEQ ID NO: 386698 - RNA, 32 nt, Human
cgccccagcacuaccgugagagcacaggcaga

SEQ ID NO: 386699 - RNA, 19 nt, Human
cgccccagccacccuccuu

SEQ ID NO: 386700 - RNA, 18 nt, Human
cgccccagccaccucccu

SEQ ID NO: 386701 - RNA, 17 nt, Human
cgccccagccuagcccc

SEQ ID NO: 386702 - RNA, 32 nt, Human
cgccccagccuccugaguagcugggacuagag

SEQ ID NO: 386703 - RNA, 18 nt, Human
cgccccagccuucugcuc

SEQ ID NO: 386704 - RNA, 18 nt, Human
cgccccagcgaccucccu

SEQ ID NO: 386705 - RNA, 32 nt, Human
cgccccaggaggaggaagaaaccagggccccg

SEQ ID NO: 386706 - RNA, 32 nt, Human
cgccccaggcaccgccagaguguccugcuacc

SEQ ID NO: 386707 - RNA, 32 nt, Human
cgccccaggcagccccagcgguuaguggaagc

SEQ ID NO: 386708 - RNA, 17 nt, Human
cgccccaggcccuuccc

SEQ ID NO: 386709 - RNA, 31 nt, Human
cgccccagggagagagaaaaagcugagacuc

SEQ ID NO: 386710 - RNA, 32 nt, Human
cgccccagggccuggggcuguugggagccaag

SEQ ID NO: 386711 - RNA, 20 nt, Human
cgccccaggucgugcagccc

SEQ ID NO: 386712 - RNA, 21 nt, Human
cgccccauaaaaccagcagaa

SEQ ID NO: 386713 - RNA, 32 nt, Human
cgccccauccccaggcugugugcucaaagcgg

SEQ ID NO: 386714 - RNA, 32 nt, Human
cgccccaucugccuccugcccugccgcacucc

SEQ ID NO: 386715 - RNA, 32 nt, Human
cgccccauucugucccccucauggccaccuug

SEQ ID NO: 386716 - RNA, 32 nt, Human
cgccccauuguacuccagccuggggaacaaga

SEQ ID NO: 386717 - RNA, 23 nt, Human
cgcccccaaccccccaccucccu

SEQ ID NO: 386718 - RNA, 32 nt, Human
cgcccccaaguaugucccgcugccuggagaga

SEQ ID NO: 386719 - RNA, 21 nt, Human
cgcccccaccccacccuaccc

SEQ ID NO: 386720 - RNA, 20 nt, Human
cgcccccacccccgcccccc

SEQ ID NO: 386721 - RNA, 19 nt, Human
cgcccccaccccugccccc

SEQ ID NO: 386722 - RNA, 18 nt, Human
cgcccccacccuguccag

SEQ ID NO: 386723 - RNA, 32 nt, Human
cgcccccaccgccacccaaccaagcaucaccc

SEQ ID NO: 386724 - RNA, 22 nt, Human
cgcccccacgcccacccuccuu

SEQ ID NO: 386725 - RNA, 22 nt, Human
cgcccccacugcccggccuccc

SEQ ID NO: 386726 - RNA, 32 nt, Human
cgcccccagcaccacggaaacuaccuacaugc

SEQ ID NO: 386727 - RNA, 22 nt, Human
cgcccccagcacccccucuccu

SEQ ID NO: 386728 - RNA, 23 nt, Human
cgcccccagcccagcccacuccc

SEQ ID NO: 386729 - RNA, 19 nt, Human
cgcccccagccccagcccc

SEQ ID NO: 386730 - RNA, 21 nt, Human
cgcccccagccccccuucccu

SEQ ID NO: 386731 - RNA, 25 nt, Human
cgcccccagcccccgcccccguccc

SEQ ID NO: 386732 - RNA, 22 nt, Human
cgcccccagccccugcugcccc

SEQ ID NO: 386733 - RNA, 22 nt, Human
cgcccccagcccggcgccgccc

SEQ ID NO: 386734 - RNA, 24 nt, Human
cgcccccagcccucgccccacccu

SEQ ID NO: 386735 - RNA, 22 nt, Human
cgcccccagccugccccagccc

SEQ ID NO: 386736 - RNA, 22 nt, Human
cgcccccagccuggcggacgag

SEQ ID NO: 386737 - RNA, 21 nt, Human
cgcccccagcguggcgccccc

SEQ ID NO: 386738 - RNA, 22 nt, Human
cgcccccagcuucucucucccu

SEQ ID NO: 386739 - RNA, 32 nt, Human
cgcccccaggcugugccccaccacagauucug

SEQ ID NO: 386740 - RNA, 32 nt, Human
cgcccccagugagauucaaaucacgcaucucu

SEQ ID NO: 386741 - RNA, 23 nt, Human
cgcccccagugcugcguucuccc

SEQ ID NO: 386742 - RNA, 32 nt, Human
cgcccccauagcaaucugacuuugaguuggag

SEQ ID NO: 386743 - RNA, 32 nt, Human
cgcccccaucugucuucagcacauuccacggc

SEQ ID NO: 386744 - RNA, 22 nt, Human
cgccccccagacucacacgggg

SEQ ID NO: 386745 - RNA, 22 nt, Human
cgccccccaguaccucccuccc

SEQ ID NO: 386746 - RNA, 18 nt, Human
cgccccccgccccgggug

SEQ ID NO: 386747 - RNA, 18 nt, Human
cgccccccggagcugcca

SEQ ID NO: 386748 - RNA, 19 nt, Human
cgccccccggcuguccucc

SEQ ID NO: 386749 - RNA, 17 nt, Human
cgccccccuccagcgcc

SEQ ID NO: 386750 - RNA, 32 nt, Human
cgcccccgccacaggauccagagcaagcaccg

SEQ ID NO: 386751 - RNA, 32 nt, Human
cgcccccgccacaggauccagagcaagcagcg

SEQ ID NO: 386752 - RNA, 21 nt, Human
cgcccccgcccaggccccgcc

SEQ ID NO: 386753 - RNA, 32 nt, Human
cgcccccgcccccugccacccugcacugcccc

SEQ ID NO: 386754 - RNA, 20 nt, Human
cgcccccgccccgaccuccc

SEQ ID NO: 386755 - RNA, 22 nt, Human
cgcccccgccccggccccgaga

SEQ ID NO: 386756 - RNA, 19 nt, Human
cgcccccgcccgcccuccc

SEQ ID NO: 386757 - RNA, 20 nt, Human
cgcccccgcccugccccagg

SEQ ID NO: 386758 - RNA, 25 nt, Human
cgcccccgcccugucccuccgaagg

SEQ ID NO: 386759 - RNA, 17 nt, Human
cgcccccgccuccuccc

SEQ ID NO: 386760 - RNA, 32 nt, Human
cgcccccgccucugagcucccuucccauggcg

SEQ ID NO: 386761 - RNA, 32 nt, Human
cgcccccgcuccagcuccagccggguccucgc

SEQ ID NO: 386762 - RNA, 21 nt, Human
cgcccccgcugcccgccuucc

SEQ ID NO: 386763 - RNA, 32 nt, Human
cgcccccggcccagcccugccuugcgccaccc

SEQ ID NO: 386764 - RNA, 22 nt, Human
cgcccccggcccgccgccuccc

SEQ ID NO: 386765 - RNA, 20 nt, Human
cgcccccggccguccccccu

SEQ ID NO: 386766 - RNA, 20 nt, Human
cgcccccggcgcccccuccc

SEQ ID NO: 386767 - RNA, 25 nt, Human
cgcccccgggccccgcuguccuccc

SEQ ID NO: 386768 - RNA, 32 nt, Human
cgcccccggucuccucuuuugcucuggccccg

SEQ ID NO: 386769 - RNA, 22 nt, Human
cgcccccguugcaggccuggca

SEQ ID NO: 386770 - RNA, 18 nt, Human
cgcccccuccccagggug

SEQ ID NO: 386771 - RNA, 19 nt, Human
cgcccccucccugcuccca

SEQ ID NO: 386772 - RNA, 32 nt, Human
cgcccccucccuggcccugccccuagccccgc

SEQ ID NO: 386773 - RNA, 27 nt, Human
cgcccccuccuccccaccauccucccu

SEQ ID NO: 386774 - RNA, 18 nt, Human
cgcccccuccucgcucca

SEQ ID NO: 386775 - RNA, 32 nt, Human
cgcccccucggagcuuuuucuccaguuaacug

SEQ ID NO: 386776 - RNA, 25 nt, Human
cgcccccucuccugcugucccuccu

SEQ ID NO: 386777 - RNA, 32 nt, Human
cgcccccugaaacaugugccccugccaaggcc

SEQ ID NO: 386778 - RNA, 32 nt, Human
cgcccccugacucucaggccacagcuccggcc

SEQ ID NO: 386779 - RNA, 32 nt, Human
cgcccccugcacuccagccugggcuucagagc

SEQ ID NO: 386780 - RNA, 32 nt, Human
cgcccccugccccuguaacaguuacauugucu

SEQ ID NO: 386781 - RNA, 21 nt, Human
cgcccccugcgcccaaccgcc

SEQ ID NO: 386782 - RNA, 24 nt, Human
cgcccccugcgcgcuguccuaccc

SEQ ID NO: 386783 - RNA, 32 nt, Human
cgcccccugcugaggagcagccccaggagggg

SEQ ID NO: 386784 - RNA, 32 nt, Human
cgcccccugcuugugcggcgaugaucuguuug

SEQ ID NO: 386785 - RNA, 32 nt, Human
cgcccccuggagggaggaaggggaacugcauc

SEQ ID NO: 386786 - RNA, 32 nt, Human
cgcccccuggagggaggaaggggaacuguauc

SEQ ID NO: 386787 - RNA, 19 nt, Human
cgcccccuucaccaccucu

SEQ ID NO: 386788 - RNA, 32 nt, Human
cgcccccuucaccaccucuacacguucuaggc

SEQ ID NO: 386789 - RNA, 32 nt, Human
cgcccccuucagccacuccgacugccugggaa

SEQ ID NO: 386790 - RNA, 32 nt, Human
cgcccccuucccacucagcuucugccagcggg

SEQ ID NO: 386791 - RNA, 32 nt, Human
cgcccccuucucauggugcuacuuccucuguc

SEQ ID NO: 386792 - RNA, 19 nt, Human
cgcccccuugcuggcccca

SEQ ID NO: 386793 - RNA, 32 nt, Human
cgcccccuuuucugugcuucgaagucccucuc

SEQ ID NO: 386794 - RNA, 32 nt, Human
cgccccgaacccagguagugaggccagugauu

SEQ ID NO: 386795 - RNA, 32 nt, Human
cgccccgacacacaugcuuuucuccaugacac

SEQ ID NO: 386796 - RNA, 32 nt, Human
cgccccgacaccagcucuccagccugcucguc

SEQ ID NO: 386797 - RNA, 21 nt, Human
cgccccgaccucgcugccccc

SEQ ID NO: 386798 - RNA, 32 nt, Human
cgccccgagauggagagcaaagcccugcucgu

SEQ ID NO: 386799 - RNA, 32 nt, Human
cgccccgagggucggggaaggaaccgaggucc

SEQ ID NO: 386800 - RNA, 32 nt, Human
cgccccgcaccaugcccuagccccaggucuag

SEQ ID NO: 386801 - RNA, 32 nt, Human
cgccccgcaccuccagccuucccgacucgcag

SEQ ID NO: 386802 - RNA, 31 nt, Human
cgccccgcacuuuucugagcagacguccaga

SEQ ID NO: 386803 - RNA, 21 nt, Human
cgccccgccccgcuaaccgcc

SEQ ID NO: 386804 - RNA, 19 nt, Human
cgccccgccccuccucccu

SEQ ID NO: 386805 - RNA, 32 nt, Human
cgccccgcccuuccagcugaggacaggcuggc

SEQ ID NO: 386806 - RNA, 19 nt, Human
cgccccgcgcuccacggcg

SEQ ID NO: 386807 - RNA, 22 nt, Human
cgccccgcggccgccagcagaa

SEQ ID NO: 386808 - RNA, 24 nt, Human
cgccccgcggcggugcgcgcguga

SEQ ID NO: 386809 - RNA, 32 nt, Human
cgccccgcuccuccuccuccucuuccuccucc

SEQ ID NO: 386810 - RNA, 32 nt, Human
cgccccgcugacgcgcucucuccuggguccgg

SEQ ID NO: 386811 - RNA, 32 nt, Human
cgccccgcuggcugggguucucugcagcccag

SEQ ID NO: 386812 - RNA, 32 nt, Human
cgccccggacaguggcaccugggaagccuggg

SEQ ID NO: 386813 - RNA, 32 nt, Human
cgccccggaccacccucccugccggcuuuggg

SEQ ID NO: 386814 - RNA, 32 nt, Human
cgccccggagccaagcagcaacugagcgggga

SEQ ID NO: 386815 - RNA, 32 nt, Human
cgccccggccuccgggagacuggcgcaugcca

SEQ ID NO: 386816 - RNA, 32 nt, Human
cgccccggccucucgggagccguggggcagag

SEQ ID NO: 386817 - RNA, 32 nt, Human
cgccccggcgcucucccagggccccuagcuuu

SEQ ID NO: 386818 - RNA, 32 nt, Human
cgccccgggacccguuagugcccagccugcgg

SEQ ID NO: 386819 - RNA, 32 nt, Human
cgccccgggauagggacccugcagcuccaggu

SEQ ID NO: 386820 - RNA, 32 nt, Human
cgccccgggcccugauggacugaaugaaggcu

SEQ ID NO: 386821 - RNA, 32 nt, Human
cgccccgugcaggagacguagguaggacgucg

SEQ ID NO: 386822 - RNA, 32 nt, Human
cgccccuaacacccgcgccuccugcagacccg

SEQ ID NO: 386823 - RNA, 32 nt, Human
cgccccuagcucuucuacggaggggaaccgca

SEQ ID NO: 386824 - RNA, 22 nt, Human
cgccccuaggccgccgcccccu

SEQ ID NO: 386825 - RNA, 32 nt, Human
cgccccuauccagcaggaaguagcuagagcag

SEQ ID NO: 386826 - RNA, 32 nt, Human
cgccccucagcagggcagggccaguccuggcg

SEQ ID NO: 386827 - RNA, 19 nt, Human
cgccccuccccagccccca

SEQ ID NO: 386828 - RNA, 23 nt, Human
cgccccuccccccacuccaggcc

SEQ ID NO: 386829 - RNA, 32 nt, Human
cgccccucccucccuguuucccuucccucccu

SEQ ID NO: 386830 - RNA, 32 nt, Human
cgccccuccgagcaacuuuucccggugccugc

SEQ ID NO: 386831 - RNA, 32 nt, Human
cgccccucgggggcggcuguggcggaggaacg

SEQ ID NO: 386832 - RNA, 18 nt, Human
cgccccucggguggcccc

SEQ ID NO: 386833 - RNA, 32 nt, Human
cgccccucucugagagaagccgcgaggggagg

SEQ ID NO: 386834 - RNA, 32 nt, Human
cgccccugacuguggcaggaauccaagugcau

SEQ ID NO: 386835 - RNA, 32 nt, Human
cgccccugagcccacugugcguggggcucccg

SEQ ID NO: 386836 - RNA, 32 nt, Human
cgccccugcacuccagccugggugacagagcc

SEQ ID NO: 386837 - RNA, 32 nt, Human
cgccccugcagauccaggucuccaggccuugc

SEQ ID NO: 386838 - RNA, 32 nt, Human
cgccccugcauucccagcuacuugggaggcug

SEQ ID NO: 386839 - RNA, 19 nt, Human
cgccccugcucucucccca

SEQ ID NO: 386840 - RNA, 32 nt, Human
cgccccuggcugggaggaaggacugggggccc

SEQ ID NO: 386841 - RNA, 32 nt, Human
cgccccugguggacaggaugguucggcaaagc

SEQ ID NO: 386842 - RNA, 32 nt, Human
cgccccuguccucgcccugccuccugccauuc

SEQ ID NO: 386843 - RNA, 32 nt, Human
cgccccuuccucaccucuuccuuauuccauag

SEQ ID NO: 386844 - RNA, 32 nt, Human
cgccccuuccucagaucccuaucaucuuggga

SEQ ID NO: 386845 - RNA, 32 nt, Human
cgccccuucuccccgucgcuguccgcagccau

SEQ ID NO: 386846 - RNA, 32 nt, Human
cgccccuucuugccaggcuucuccucucuccu

SEQ ID NO: 386847 - RNA, 32 nt, Human
cgccccuugccugacccucagggagucagccu

SEQ ID NO: 386848 - RNA, 32 nt, Human
cgcccgaagcggcggucgguggcagggguggu

SEQ ID NO: 386849 - RNA, 32 nt, Human
cgcccgacagccgccgcgugcuggucacaguc

SEQ ID NO: 386850 - RNA, 32 nt, Human
cgcccgacccuccagccagccuucugccggcc

SEQ ID NO: 386851 - RNA, 22 nt, Human
cgcccgagcccccagccccggg

SEQ ID NO: 386852 - RNA, 32 nt, Human
cgcccgagccccgggagagaggagcgaagauc

SEQ ID NO: 386853 - RNA, 32 nt, Human
cgcccgagccuccucggccuuggagagcagcg

SEQ ID NO: 386854 - RNA, 32 nt, Human
cgcccgcaacacgccccugcuggaccacucgg

SEQ ID NO: 386855 - RNA, 32 nt, Human
cgcccgcacggcuccaggucuggggucugcgc

SEQ ID NO: 386856 - RNA, 19 nt, Human
cgcccgcaucccagcgcca

SEQ ID NO: 386857 - RNA, 32 nt, Human
cgcccgccaccugggauuacgggcgcccgcca

SEQ ID NO: 386858 - RNA, 32 nt, Human
cgcccgccauguccgagauccugcccuacagc

SEQ ID NO: 386859 - RNA, 32 nt, Human
cgcccgcccagaggaguccccgcgcccgccaa

SEQ ID NO: 386860 - RNA, 21 nt, Human
cgcccgcccccgcccggcacc

SEQ ID NO: 386861 - RNA, 32 nt, Human
cgcccgcccccucccucccuccccucccuucc

SEQ ID NO: 386862 - RNA, 32 nt, Human
cgcccgcccgcauagcacuugcagaccugccu

SEQ ID NO: 386863 - RNA, 32 nt, Human
cgcccgcccggcguccgaccccuucagcggcg

SEQ ID NO: 386864 - RNA, 32 nt, Human
cgcccgcccucacugcuguucuugccuuacag

SEQ ID NO: 386865 - RNA, 28 nt, Human
cgcccgccgagugcugcuggguugggca

SEQ ID NO: 386866 - RNA, 32 nt, Human
cgcccgccgccccgagcuccccaagccuucga

SEQ ID NO: 386867 - RNA, 21 nt, Human
cgcccgccgccgcccgucccc

SEQ ID NO: 386868 - RNA, 32 nt, Human
cgcccgccgccuggcccuccccuaccaggcug

SEQ ID NO: 386869 - RNA, 32 nt, Human
cgcccgccgcgguccccaccuccauggacgcc

SEQ ID NO: 386870 - RNA, 23 nt, Human
cgcccgccgguaccccggcgcca

SEQ ID NO: 386871 - RNA, 32 nt, Human
cgcccgccgugccaugggguucccggccgcgg

SEQ ID NO: 386872 - RNA, 32 nt, Human
cgcccgccuaucugccugccggccuggugggg

SEQ ID NO: 386873 - RNA, 32 nt, Human
cgcccgccugcucggcgaccagcggggauccu

SEQ ID NO: 386874 - RNA, 32 nt, Human
cgcccgccuggcauggccaacuggguguucug

SEQ ID NO: 386875 - RNA, 20 nt, Human
cgcccgcggaaccagaccag

SEQ ID NO: 386876 - RNA, 20 nt, Human
cgcccgcggcccagcgccgg

SEQ ID NO: 386877 - RNA, 21 nt, Human
cgcccgcggcgcgacccuccc

SEQ ID NO: 386878 - RNA, 23 nt, Human
cgcccgcggcuccccagccccag

SEQ ID NO: 386879 - RNA, 32 nt, Human
cgcccgcgucccggaagcuccagccugaacca

SEQ ID NO: 386880 - RNA, 32 nt, Human
cgcccgcucgccgccucgucucccagcggcgg

SEQ ID NO: 386881 - RNA, 24 nt, Human
cgcccgcucgccgccuuccucccu

SEQ ID NO: 386882 - RNA, 19 nt, Human
cgcccgcucggcugggucc

SEQ ID NO: 386883 - RNA, 21 nt, Human
cgcccgcugagccccggcgcc

SEQ ID NO: 386884 - RNA, 20 nt, Human
cgcccgcugcccuacccgcc

SEQ ID NO: 386885 - RNA, 32 nt, Human
cgcccgcugcugcugcucgcuuacuucagucg

SEQ ID NO: 386886 - RNA, 32 nt, Human
cgcccgcugggaaugaugaagaagaacaauuc

SEQ ID NO: 386887 - RNA, 32 nt, Human
cgcccggagccagccgcgcagcaugcacuggg

SEQ ID NO: 386888 - RNA, 32 nt, Human
cgcccggaugcagagugggggucugugucucu

SEQ ID NO: 386889 - RNA, 32 nt, Human
cgcccggcagccgccccgucugagaagugagg

SEQ ID NO: 386890 - RNA, 19 nt, Human
cgcccggcagcggcuggca

SEQ ID NO: 386891 - RNA, 32 nt, Human
cgcccggccagccugagguggggucggugccc

SEQ ID NO: 386892 - RNA, 30 nt, Human
cgcccggccccuuuugagcccugccaguga

SEQ ID NO: 386893 - RNA, 32 nt, Human
cgcccggcccggacacagggaggacgcucccg

SEQ ID NO: 386894 - RNA, 32 nt, Human
cgcccggcccuccagccagccuucugccggcc

SEQ ID NO: 386895 - RNA, 23 nt, Human
cgcccggccgcuccgggccccug

SEQ ID NO: 386896 - RNA, 18 nt, Human
cgcccggccgucacccca

SEQ ID NO: 386897 - RNA, 32 nt, Human
cgcccggccugauccugccugaagauggugcc

SEQ ID NO: 386898 - RNA, 32 nt, Human
cgcccggcugcuccucacuugcucugagacag

SEQ ID NO: 386899 - RNA, 32 nt, Human
cgcccggcuggucagcagcacagccagagucu

SEQ ID NO: 386900 - RNA, 32 nt, Human
cgcccggcugucagagggaagcagggaaugca

SEQ ID NO: 386901 - RNA, 32 nt, Human
cgcccggcuuugaacccgcccugcacugcugu

SEQ ID NO: 386902 - RNA, 32 nt, Human
cgcccgggcaggucucccuucaaacguggcgu

SEQ ID NO: 386903 - RNA, 32 nt, Human
cgcccgggcaggucuggaagcugcagggcucu

SEQ ID NO: 386904 - RNA, 32 nt, Human
cgcccgggcaggucuuuauuuuauuuaugcua

SEQ ID NO: 386905 - RNA, 19 nt, Human
cgcccgggccuuggccagc

SEQ ID NO: 386906 - RNA, 19 nt, Human
cgcccgggcugggcacuaa

SEQ ID NO: 386907 - RNA, 32 nt, Human
cgcccggggaaggcuccagugggcuagcgcgc

SEQ ID NO: 386908 - RNA, 32 nt, Human
cgcccggggcuccaccagggcagggauggugg

SEQ ID NO: 386909 - RNA, 32 nt, Human
cgcccggggugaggggacccgaaguccugagg

SEQ ID NO: 386910 - RNA, 21 nt, Human
cgcccgggucccaaacgccag

SEQ ID NO: 386911 - RNA, 32 nt, Human
cgcccggucggaggcggaaggaagugauauuu

SEQ ID NO: 386912 - RNA, 32 nt, Human
cgcccgucuccucucccugaggauuucagguc

SEQ ID NO: 386913 - RNA, 32 nt, Human
cgcccgucugcccaccaugaggaagauccgcg

SEQ ID NO: 386914 - RNA, 32 nt, Human
cgcccgugccucucccuccacaccucccugca

SEQ ID NO: 386915 - RNA, 32 nt, Human
cgcccguucuuggucuaauccccagucgugau

SEQ ID NO: 386916 - RNA, 32 nt, Human
cgcccuacaucggcagcuccccaacccugugc

SEQ ID NO: 386917 - RNA, 32 nt, Human
cgcccuagcagaugcacgugucugucgaaucg

SEQ ID NO: 386918 - RNA, 32 nt, Human
cgcccuagcauccaggcuucaggcugccgccg

SEQ ID NO: 386919 - RNA, 32 nt, Human
cgcccuagcuggaucuacuacagggaagggaa

SEQ ID NO: 386920 - RNA, 32 nt, Human
cgcccuaggcgccaccaugucgggagacaaac

SEQ ID NO: 386921 - RNA, 32 nt, Human
cgcccuagggaccaagacugaauccuccucac

SEQ ID NO: 386922 - RNA, 32 nt, Human
cgcccuaucuuccucccuguccuccuucuugg

SEQ ID NO: 386923 - RNA, 32 nt, Human
cgcccuaugcaguucugagaagguggaggcac

SEQ ID NO: 386924 - RNA, 32 nt, Human
cgcccucaccacccuccccuuccagccaccac

SEQ ID NO: 386925 - RNA, 21 nt, Human
cgcccucacccccaaccucca

SEQ ID NO: 386926 - RNA, 32 nt, Human
cgcccucaccgacggguccagaccugguggga

SEQ ID NO: 386927 - RNA, 32 nt, Human
cgcccucacugcaggcuccccuccucggcuuc

SEQ ID NO: 386928 - RNA, 21 nt, Human
cgcccuccagcugcccucccu

SEQ ID NO: 386929 - RNA, 32 nt, Human
cgcccuccagcuucugcccugccugcugugug

SEQ ID NO: 386930 - RNA, 32 nt, Human
cgcccucccagccucaacaccucagggcagga

SEQ ID NO: 386931 - RNA, 22 nt, Human
cgcccuccccaccaggcccacc

SEQ ID NO: 386932 - RNA, 32 nt, Human
cgcccuccccuccccggcccuccacagcugcu

SEQ ID NO: 386933 - RNA, 32 nt, Human
cgcccuccccucucucuugggacuggccucuu

SEQ ID NO: 386934 - RNA, 32 nt, Human
cgcccucccucugcuccugagaugcugaccca

SEQ ID NO: 386935 - RNA, 32 nt, Human
cgcccucccuuuccuucccuucgucuucccua

SEQ ID NO: 386936 - RNA, 32 nt, Human
cgcccuccgcgaggguggaggcggcggcugug

SEQ ID NO: 386937 - RNA, 32 nt, Human
cgcccuccgugcgcucugccaccgggcgcuca

SEQ ID NO: 386938 - RNA, 32 nt, Human
cgcccuccucaccaacguguccucaguggcac

SEQ ID NO: 386939 - RNA, 32 nt, Human
cgcccuccucacugcugagcuccucaccugga

SEQ ID NO: 386940 - RNA, 32 nt, Human
cgcccuccuccacccccucucccaucacccuc

SEQ ID NO: 386941 - RNA, 32 nt, Human
cgcccuccuccuccuccucgcccuccccuccc

SEQ ID NO: 386942 - RNA, 24 nt, Human
cgcccuccuuccccagggcuccuu

SEQ ID NO: 386943 - RNA, 32 nt, Human
cgcccucggccuuccgcgccagccgcagccac

SEQ ID NO: 386944 - RNA, 32 nt, Human
cgcccucucagccuguggccucugcgccuccu

SEQ ID NO: 386945 - RNA, 19 nt, Human
cgcccucucccaguccuca

SEQ ID NO: 386946 - RNA, 32 nt, Human
cgcccucucuacugucugaaccccuugucccu

SEQ ID NO: 386947 - RNA, 32 nt, Human
cgcccucucucuuuggccauccuuccuuuccc

SEQ ID NO: 386948 - RNA, 32 nt, Human
cgcccucugcccaccucccccgcuguguguca

SEQ ID NO: 386949 - RNA, 32 nt, Human
cgcccucugcuuucucuuuccuagacucgcgg

SEQ ID NO: 386950 - RNA, 32 nt, Human
cgcccucuggcugcaaauaaacuguuacaggc

SEQ ID NO: 386951 - RNA, 32 nt, Human
cgcccugaaggcagaguccagggaccuugacc

SEQ ID NO: 386952 - RNA, 32 nt, Human
cgcccugaccaccagcucuacuucccaacccc

SEQ ID NO: 386953 - RNA, 32 nt, Human
cgcccugcacacacagaaagccaaagcgaucg

SEQ ID NO: 386954 - RNA, 32 nt, Human
cgcccugcccaguuuccaguugcccuguccac

SEQ ID NO: 386955 - RNA, 32 nt, Human
cgcccugcccccugcauccccuagagacagcu

SEQ ID NO: 386956 - RNA, 32 nt, Human
cgcccugccccgcuacagaagccagacugggu

SEQ ID NO: 386957 - RNA, 19 nt, Human
cgcccugccccggcgccag

SEQ ID NO: 386958 - RNA, 16 nt, Human
cgcccugccccgggug

SEQ ID NO: 386959 - RNA, 32 nt, Human
cgcccugccuccauuuaccuugugauaucuua

SEQ ID NO: 386960 - RNA, 32 nt, Human
cgcccugccucggccuugcgccuguguagggg

SEQ ID NO: 386961 - RNA, 32 nt, Human
cgcccugccucuguggcucugccuguggaucg

SEQ ID NO: 386962 - RNA, 32 nt, Human
cgcccugccuggccucauccuuguauuuaauu

SEQ ID NO: 386963 - RNA, 18 nt, Human
cgcccugcggcccucccu

SEQ ID NO: 386964 - RNA, 32 nt, Human
cgcccugcggucccgccgccuccggggccucc

SEQ ID NO: 386965 - RNA, 32 nt, Human
cgcccugcucagcgcguccucccgcggcggcc

SEQ ID NO: 386966 - RNA, 32 nt, Human
cgcccugcuccugcugcgucgugaggacccgg

SEQ ID NO: 386967 - RNA, 32 nt, Human
cgcccugcugcacuccagccugggcaacagag

SEQ ID NO: 386968 - RNA, 32 nt, Human
cgcccugcugcacuccagccugggugacagag

SEQ ID NO: 386969 - RNA, 32 nt, Human
cgcccugcuguaaccucugucuuggcagggcu

SEQ ID NO: 386970 - RNA, 17 nt, Human
cgcccugcuuggcccca

SEQ ID NO: 386971 - RNA, 32 nt, Human
cgcccuggacccacuuucucucucaaacuguc

SEQ ID NO: 386972 - RNA, 32 nt, Human
cgcccuggauccucugccugcccccucccccg

SEQ ID NO: 386973 - RNA, 32 nt, Human
cgcccuggaugccacccagugcagccuggcac

SEQ ID NO: 386974 - RNA, 22 nt, Human
cgcccuggcuaacauggugaaa

SEQ ID NO: 386975 - RNA, 32 nt, Human
cgcccuggcucacaccuguaaucccagcacuc

SEQ ID NO: 386976 - RNA, 21 nt, Human
cgcccuggcuggagugcaaug

SEQ ID NO: 386977 - RNA, 32 nt, Human
cgcccugggaggaggaugagauccgcagggac

SEQ ID NO: 386978 - RNA, 32 nt, Human
cgcccugggcagcuagagugucucagcccggu

SEQ ID NO: 386979 - RNA, 32 nt, Human
cgcccuggguguccucaccccuucccuggccu

SEQ ID NO: 386980 - RNA, 32 nt, Human
cgcccuggugcuggcugaccacccccugcccu

SEQ ID NO: 386981 - RNA, 32 nt, Human
cgcccuguaggcuggggaugggcugcugugug

SEQ ID NO: 386982 - RNA, 32 nt, Human
cgcccugucacccaggcuggagugcaguggca

SEQ ID NO: 386983 - RNA, 32 nt, Human
cgcccugucacccaggcuggagugcaguggug

SEQ ID NO: 386984 - RNA, 32 nt, Human
cgcccugucgccaggcuggaguguaguggcau

SEQ ID NO: 386985 - RNA, 32 nt, Human
cgcccugucucagagcugaugaccucaccguu

SEQ ID NO: 386986 - RNA, 32 nt, Human
cgcccugucugggaauggggccgcccccgggc

SEQ ID NO: 386987 - RNA, 32 nt, Human
cgcccugugcccaccccacaucccuuuccgaa

SEQ ID NO: 386988 - RNA, 32 nt, Human
cgcccugugcucaccucugccuggcucagcga

SEQ ID NO: 386989 - RNA, 32 nt, Human
cgcccuguggggacccggaccaggagggaccc

SEQ ID NO: 386990 - RNA, 31 nt, Human
cgcccuguugcagcucucaugccaagaccug

SEQ ID NO: 386991 - RNA, 32 nt, Human
cgcccuguugcccaggcugaagugcaguggug

SEQ ID NO: 386992 - RNA, 32 nt, Human
cgcccuuccagcccuuccccagccccuccucu

SEQ ID NO: 386993 - RNA, 32 nt, Human
cgcccuucccucuucuccuuacauauuauagg

SEQ ID NO: 386994 - RNA, 32 nt, Human
cgcccuucugucuggccagcugcccacgaccu

SEQ ID NO: 386995 - RNA, 32 nt, Human
cgcccuucuuccccaucucucccccgggccug

SEQ ID NO: 386996 - RNA, 32 nt, Human
cgcccuuguugccuccccgucccugucucccc

SEQ ID NO: 386997 - RNA, 32 nt, Human
cgcccuuucucagagcagagggccagguaggg

SEQ ID NO: 386998 - RNA, 32 nt, Human
cgcccuuugcaccuccuaucuccaggguccgc

SEQ ID NO: 386999 - RNA, 19 nt, Human
cgcccuuugcagcagcccc

SEQ ID NO: 387000 - RNA, 32 nt, Human
cgcccuuugcagcauuucacgugugggcuaug

SEQ ID NO: 387001 - RNA, 32 nt, Human
cgcccuuuggguugugggcagcucccugaaca

SEQ ID NO: 387002 - RNA, 19 nt, Human
cgcccuuuguugagcccca

SEQ ID NO: 387003 - RNA, 32 nt, Human
cgccgaagcagcccgggacugcgcagcgcccc

SEQ ID NO: 387004 - RNA, 32 nt, Human
cgccgacaaccacauucccccggcuauucuga

SEQ ID NO: 387005 - RNA, 32 nt, Human
cgccgacacccaccccagcacugcaggcagcg

SEQ ID NO: 387006 - RNA, 32 nt, Human
cgccgaccaauggcugcuucauccccgacguu

SEQ ID NO: 387007 - RNA, 22 nt, Human
cgccgaccgccccggaccccug

SEQ ID NO: 387008 - RNA, 32 nt, Human
cgccgacgagaccauggaagagccaucugucc

SEQ ID NO: 387009 - RNA, 32 nt, Human
cgccgacucucuuccuccuugcaagcccuucg

SEQ ID NO: 387010 - RNA, 32 nt, Human
cgccgagaaauccuggaucuucccagggauuc

SEQ ID NO: 387011 - RNA, 32 nt, Human
cgccgagaagugcagaagucacaguugccccu

SEQ ID NO: 387012 - RNA, 32 nt, Human
cgccgagacggcccuggcagaggucgggcccc

SEQ ID NO: 387013 - RNA, 32 nt, Human
cgccgagagccaccagcagcugugcugccaac

SEQ ID NO: 387014 - RNA, 32 nt, Human
cgccgagcaaagccgggcugggcuuggagcug

SEQ ID NO: 387015 - RNA, 32 nt, Human
cgccgagccagcugccagaaugccgaacuggg

SEQ ID NO: 387016 - RNA, 32 nt, Human
cgccgagcccaccgucgcccccuagacccuga

SEQ ID NO: 387017 - RNA, 32 nt, Human
cgccgagccccgcaccuggaagcugggaggcc

SEQ ID NO: 387018 - RNA, 32 nt, Human
cgccgagccuccccugccuccuggccgccucu

SEQ ID NO: 387019 - RNA, 32 nt, Human
cgccgagccucggagagcaggggcuuugcuuu

SEQ ID NO: 387020 - RNA, 32 nt, Human
cgccgaggaacaagucggucaggaagcccgcg

SEQ ID NO: 387021 - RNA, 32 nt, Human
cgccgaggauacacagugcugaggcagaacgc

SEQ ID NO: 387022 - RNA, 32 nt, Human
cgccgaggcacccggggcugggccagcgcccc

SEQ ID NO: 387023 - RNA, 32 nt, Human
cgccgaggcgggcggaucaugaggucaggaga

SEQ ID NO: 387024 - RNA, 32 nt, Human
cgccgaggcuaucuccaacuguucaccgaaga

SEQ ID NO: 387025 - RNA, 32 nt, Human
cgccgaggcuuagagagcucgaccuccucaag

SEQ ID NO: 387026 - RNA, 22 nt, Human
cgccgagggccccgggacccug

SEQ ID NO: 387027 - RNA, 22 nt, Human
cgccgagggccugagugcucca

SEQ ID NO: 387028 - RNA, 32 nt, Human
cgccgaggucgagucugguggcgccucgguau

SEQ ID NO: 387029 - RNA, 22 nt, Human
cgccgaguaguggcaacggcgu

SEQ ID NO: 387030 - RNA, 32 nt, Human
cgccgaguaguggcaacggcgugguugcgucg

SEQ ID NO: 387031 - RNA, 32 nt, Human
cgccgagucggaggggguggcagugagcggcg

SEQ ID NO: 387032 - RNA, 32 nt, Human
cgccgcacacacacauuaacacacuugagcca

SEQ ID NO: 387033 - RNA, 32 nt, Human
cgccgcaccgaggccugggcccugccaaagug

SEQ ID NO: 387034 - RNA, 32 nt, Human
cgccgcaccgggccugcugggcuccgcuuccg

SEQ ID NO: 387035 - RNA, 24 nt, Human
cgccgcacgcugugcuccagggag

SEQ ID NO: 387036 - RNA, 32 nt, Human
cgccgcacgggggaggcuccaccccacaauug

SEQ ID NO: 387037 - RNA, 32 nt, Human
cgccgcagagccggauuaacugugcugauaag

SEQ ID NO: 387038 - RNA, 23 nt, Human
cgccgcagccaccaccgccgcca

SEQ ID NO: 387039 - RNA, 32 nt, Human
cgccgcagccccgggcucgccaugcuccuggc

SEQ ID NO: 387040 - RNA, 21 nt, Human
cgccgcagcccgcagccgcca

SEQ ID NO: 387041 - RNA, 24 nt, Human
cgccgcagcgcccucaggccgcca

SEQ ID NO: 387042 - RNA, 32 nt, Human
cgccgcagcgcucgcuuucccuucccuccucu

SEQ ID NO: 387043 - RNA, 32 nt, Human
cgccgcauccaccuccuccgccgccugcgacc

SEQ ID NO: 387044 - RNA, 32 nt, Human
cgccgcaucuuccccuccucuuuggguggauu

SEQ ID NO: 387045 - RNA, 32 nt, Human
cgccgcaugccuguagucccagcuacucggga

SEQ ID NO: 387046 - RNA, 32 nt, Human
cgccgcaugcuggccggcucuguggugaucgu

SEQ ID NO: 387047 - RNA, 32 nt, Human
cgccgccacagccauggccgagaguggugaaa

SEQ ID NO: 387048 - RNA, 32 nt, Human
cgccgccaccccgggaccagaccuaaagggag

SEQ ID NO: 387049 - RNA, 32 nt, Human
cgccgccaccgccaccaccaccuccaccgccg

SEQ ID NO: 387050 - RNA, 32 nt, Human
cgccgccacucccaugccugcugcugggaccg

SEQ ID NO: 387051 - RNA, 32 nt, Human
cgccgccacugcugcugccaccucuuauaugu

SEQ ID NO: 387052 - RNA, 32 nt, Human
cgccgccagccgcggcggcccgggcgccggcc

SEQ ID NO: 387053 - RNA, 32 nt, Human
cgccgccaugaagaagcaguucaaccgcauga

SEQ ID NO: 387054 - RNA, 32 nt, Human
cgccgcccagaaucccagcccagaaucccgac

SEQ ID NO: 387055 - RNA, 32 nt, Human
cgccgcccccucccccgcaccaugagcaaccu

SEQ ID NO: 387056 - RNA, 32 nt, Human
cgccgcccccuucuccagugcucuccagcccg

SEQ ID NO: 387057 - RNA, 32 nt, Human
cgccgccccucggagaccacuccagcucggac

SEQ ID NO: 387058 - RNA, 32 nt, Human
cgccgcccgcaccuccugaucccuucaagagc

SEQ ID NO: 387059 - RNA, 32 nt, Human
cgccgcccgccucagcccaacauggcgaugca

SEQ ID NO: 387060 - RNA, 23 nt, Human
cgccgcccgcgccgcgcuggccc

SEQ ID NO: 387061 - RNA, 25 nt, Human
cgccgcccgcgcgcccccgggcccc

SEQ ID NO: 387062 - RNA, 32 nt, Human
cgccgcccgcuccccugcgcccucuccucucc

SEQ ID NO: 387063 - RNA, 21 nt, Human
cgccgcccggucgccagggag

SEQ ID NO: 387064 - RNA, 32 nt, Human
cgccgcccuccagugagcagagcugggcucag

SEQ ID NO: 387065 - RNA, 32 nt, Human
cgccgcccuccccgcucuccuuccugggcgag

SEQ ID NO: 387066 - RNA, 32 nt, Human
cgccgcccucgaggcucccucugacugaaggc

SEQ ID NO: 387067 - RNA, 19 nt, Human
cgccgcccugcagccccca

SEQ ID NO: 387068 - RNA, 32 nt, Human
cgccgcccugcuccaggcucuaggacugcgcg

SEQ ID NO: 387069 - RNA, 32 nt, Human
cgccgcccuguaguucuuggcugggucuggag

SEQ ID NO: 387070 - RNA, 32 nt, Human
cgccgccgagccaccaucaugccugggcacuu

SEQ ID NO: 387071 - RNA, 32 nt, Human
cgccgccgcaaucucaccucucccaggcccaa

SEQ ID NO: 387072 - RNA, 32 nt, Human
cgccgccgcagccaccaccgccgccaccgcag

SEQ ID NO: 387073 - RNA, 23 nt, Human
cgccgccgcagcuccccgcgcuc

SEQ ID NO: 387074 - RNA, 32 nt, Human
cgccgccgccaccaccaccgccauagauacac

SEQ ID NO: 387075 - RNA, 32 nt, Human
cgccgccgccgccaccaccaccgccauagaua

SEQ ID NO: 387076 - RNA, 32 nt, Human
cgccgccgccgccaccaccgcugccacugccg

SEQ ID NO: 387077 - RNA, 32 nt, Human
cgccgccgccgccaccacugccaccacggucg

SEQ ID NO: 387078 - RNA, 18 nt, Human
cgccgccgccgccgccgc

SEQ ID NO: 387079 - RNA, 21 nt, Human
cgccgccgccgccgccgccgc

SEQ ID NO: 387080 - RNA, 32 nt, Human
cgccgccgccgccgccuccagccgggccgccg

SEQ ID NO: 387081 - RNA, 32 nt, Human
cgccgccgccgccgccuccucagcuucagccu

SEQ ID NO: 387082 - RNA, 20 nt, Human
cgccgccgccgccgcugcca

SEQ ID NO: 387083 - RNA, 32 nt, Human
cgccgccgccgcugcugacccggcggccggcc

SEQ ID NO: 387084 - RNA, 32 nt, Human
cgccgccgccuccucagcuucagccuccgcgc

SEQ ID NO: 387085 - RNA, 19 nt, Human
cgccgccgcgacagcagca

SEQ ID NO: 387086 - RNA, 32 nt, Human
cgccgccgcugcugggcaccgugucgucgccc

SEQ ID NO: 387087 - RNA, 32 nt, Human
cgccgccggagggagaggggagcugcgggcca

SEQ ID NO: 387088 - RNA, 32 nt, Human
cgccgccggcggcggagggagcgugacugcgc

SEQ ID NO: 387089 - RNA, 32 nt, Human
cgccgccggcugccccagcccugcgugaaggc

SEQ ID NO: 387090 - RNA, 32 nt, Human
cgccgccggggaaacgccgccacgggcugcau

SEQ ID NO: 387091 - RNA, 32 nt, Human
cgccgccggggaggggacgagcaccaugucga

SEQ ID NO: 387092 - RNA, 32 nt, Human
cgccgccguagcugccccaggcuccccgcccc

SEQ ID NO: 387093 - RNA, 32 nt, Human
cgccgccguuuccugcgagccagccugagcgc

SEQ ID NO: 387094 - RNA, 32 nt, Human
cgccgccuaagcugcagccgccggagccgcag

SEQ ID NO: 387095 - RNA, 32 nt, Human
cgccgccucacugcagccagcgugguccuagg

SEQ ID NO: 387096 - RNA, 32 nt, Human
cgccgccuccaccaccaccaccgccgccgccu

SEQ ID NO: 387097 - RNA, 20 nt, Human
cgccgccucccgcgcggcca

SEQ ID NO: 387098 - RNA, 32 nt, Human
cgccgccucccgguuuugggcagcccuggcca

SEQ ID NO: 387099 - RNA, 32 nt, Human
cgccgccucccucccuuccuuuccuuuccgcu

SEQ ID NO: 387100 - RNA, 32 nt, Human
cgccgccuccgagccgggcagcaacagccccg

SEQ ID NO: 387101 - RNA, 32 nt, Human
cgccgccugcagccucuuccaagcccugcguc

SEQ ID NO: 387102 - RNA, 32 nt, Human
cgccgccugccuggcaccuaggagcgcagcgg

SEQ ID NO: 387103 - RNA, 32 nt, Human
cgccgccugccugggccgggccgaggaugcgg

SEQ ID NO: 387104 - RNA, 32 nt, Human
cgccgccuggcaggcccugcgcaccaggaacc

SEQ ID NO: 387105 - RNA, 32 nt, Human
cgccgccuggcguagggagggcugcgggcgcu

SEQ ID NO: 387106 - RNA, 32 nt, Human
cgccgccugggcagcgugugcggguccguggc

SEQ ID NO: 387107 - RNA, 32 nt, Human
cgccgccugggucccuuugauaguuucagaaa

SEQ ID NO: 387108 - RNA, 32 nt, Human
cgccgccugguaauuauuugcauuacaaaccg

SEQ ID NO: 387109 - RNA, 32 nt, Human
cgccgccuguuuccucaccuucucuccccuuu

SEQ ID NO: 387110 - RNA, 32 nt, Human
cgccgccuugcaccaucgcaucauguccgggc

SEQ ID NO: 387111 - RNA, 32 nt, Human
cgccgccuugccccauuggccugggccaguuc

SEQ ID NO: 387112 - RNA, 32 nt, Human
cgccgcgacuugccccaucugcugcagaggag

SEQ ID NO: 387113 - RNA, 32 nt, Human
cgccgcgagccaguaucucagagagcgcgggg

SEQ ID NO: 387114 - RNA, 22 nt, Human
cgccgcgcagccccggccgcca

SEQ ID NO: 387115 - RNA, 32 nt, Human
cgccgcgcagccccuccaucuuccugcucggc

SEQ ID NO: 387116 - RNA, 32 nt, Human
cgccgcgccagacccucgcccagacauggggg

SEQ ID NO: 387117 - RNA, 32 nt, Human
cgccgcgccauggccaccuccccgcagaaguc

SEQ ID NO: 387118 - RNA, 32 nt, Human
cgccgcgcccaggaguuggggauguccuacaa

SEQ ID NO: 387119 - RNA, 32 nt, Human
cgccgcgccccaggaaucagugacauucaaag

SEQ ID NO: 387120 - RNA, 32 nt, Human
cgccgcgccccuucccccucccgccuccccgg

SEQ ID NO: 387121 - RNA, 22 nt, Human
cgccgcgccgccguccucgccu

SEQ ID NO: 387122 - RNA, 23 nt, Human
cgccgcgccuccccgggccacug

SEQ ID NO: 387123 - RNA, 15 nt, Human
cgccgcgccucggcu

SEQ ID NO: 387124 - RNA, 19 nt, Human
cgccgcgcgccgccgccac

SEQ ID NO: 387125 - RNA, 20 nt, Human
cgccgcgcgguccugcagcc

SEQ ID NO: 387126 - RNA, 32 nt, Human
cgccgcgcucagcuuccaucgcugggcgguca

SEQ ID NO: 387127 - RNA, 32 nt, Human
cgccgcggacacaccguccgucuccgggacgc

SEQ ID NO: 387128 - RNA, 20 nt, Human
cgccgcggaccgcagcuccu

SEQ ID NO: 387129 - RNA, 32 nt, Human
cgccgcggagggggugcugggccgcgcugugc

SEQ ID NO: 387130 - RNA, 23 nt, Human
cgccgcggccucgccccggcccc

SEQ ID NO: 387131 - RNA, 22 nt, Human
cgccgcggcgcgcccgggcucc

SEQ ID NO: 387132 - RNA, 32 nt, Human
cgccgcggcggggaccagcccagagagacccc

SEQ ID NO: 387133 - RNA, 32 nt, Human
cgccgcggcugagccaugcggcucccugaccu

SEQ ID NO: 387134 - RNA, 23 nt, Human
cgccgcgggauuuggagcugccu

SEQ ID NO: 387135 - RNA, 20 nt, Human
cgccgcgggcacuucuccug

SEQ ID NO: 387136 - RNA, 21 nt, Human
cgccgcgggcccggggccucc

SEQ ID NO: 387137 - RNA, 22 nt, Human
cgccgcgggccugcugagcucc

SEQ ID NO: 387138 - RNA, 21 nt, Human
cgccgcgggcgccuucggcuc

SEQ ID NO: 387139 - RNA, 24 nt, Human
cgccgcgggcgcugggccgcucug

SEQ ID NO: 387140 - RNA, 19 nt, Human
cgccgcggggcacacgcug

SEQ ID NO: 387141 - RNA, 32 nt, Human
cgccgcgggguccccgccagcccagggcacuc

SEQ ID NO: 387142 - RNA, 24 nt, Human
cgccgcggggugucacggccgcca

SEQ ID NO: 387143 - RNA, 32 nt, Human
cgccgcgguugaugugguugggccggggcuga

SEQ ID NO: 387144 - RNA, 32 nt, Human
cgccgcgugaccacaugggcagcucuguucac

SEQ ID NO: 387145 - RNA, 32 nt, Human
cgccgcgugccuggccccgcucgcccgugccg

SEQ ID NO: 387146 - RNA, 32 nt, Human
cgccgcgugcgcgagccgggguugcagcccag

SEQ ID NO: 387147 - RNA, 32 nt, Human
cgccgcguucuccuuuagccucccgggccucu

SEQ ID NO: 387148 - RNA, 32 nt, Human
cgccgcuacauuccagccugggcaacacgagc

SEQ ID NO: 387149 - RNA, 32 nt, Human
cgccgcuagguagagucugagggcuuguaguu

SEQ ID NO: 387150 - RNA, 32 nt, Human
cgccgcucagcucucuggaaacuagcgccuca

SEQ ID NO: 387151 - RNA, 32 nt, Human
cgccgcucaucaacaggaaagcuugggaaaga

SEQ ID NO: 387152 - RNA, 32 nt, Human
cgccgcuccugcccgggccccugcugcugcug

SEQ ID NO: 387153 - RNA, 32 nt, Human
cgccgcucuccccuccuguggaucccuccgca

SEQ ID NO: 387154 - RNA, 21 nt, Human
cgccgcucucucccgggccag

SEQ ID NO: 387155 - RNA, 22 nt, Human
cgccgcugagccucugcggccu

SEQ ID NO: 387156 - RNA, 32 nt, Human
cgccgcugcacuccagccugagcacagagcaa

SEQ ID NO: 387157 - RNA, 32 nt, Human
cgccgcugcacuccagccugggcaacagagua

SEQ ID NO: 387158 - RNA, 32 nt, Human
cgccgcugcacuccagccugggcgacagagcg

SEQ ID NO: 387159 - RNA, 32 nt, Human
cgccgcugcacuccagccugggcgacagagug

SEQ ID NO: 387160 - RNA, 32 nt, Human
cgccgcugcacuccagccugggcggcagagcg

SEQ ID NO: 387161 - RNA, 32 nt, Human
cgccgcugcacuccagccugggugacagagug

SEQ ID NO: 387162 - RNA, 32 nt, Human
cgccgcugcacuccagcuugaaugacagaggg

SEQ ID NO: 387163 - RNA, 32 nt, Human
cgccgcugcauuccagccugggugacagagcg

SEQ ID NO: 387164 - RNA, 21 nt, Human
cgccgcugccgccguccuccc

SEQ ID NO: 387165 - RNA, 31 nt, Human
cgccgcugcgcgcaugggccuguuccuggcc

SEQ ID NO: 387166 - RNA, 31 nt, Human
cgccgcugcgcugguaagccuguguuuuggu

SEQ ID NO: 387167 - RNA, 32 nt, Human
cgccgcugcgcugguaagccuguguuuugguu

SEQ ID NO: 387168 - RNA, 32 nt, Human
cgccgcugcuccuccgccuggccugggccguc

SEQ ID NO: 387169 - RNA, 32 nt, Human
cgccgcuggcugcugcucacauggugucuggg

SEQ ID NO: 387170 - RNA, 32 nt, Human
cgccgcugggcagaggagccggagacgcgagc

SEQ ID NO: 387171 - RNA, 32 nt, Human
cgccgcuggugccggguccuugaggagagcgc

SEQ ID NO: 387172 - RNA, 32 nt, Human
cgccgcuguugcugcugacuccaaggucugcu

SEQ ID NO: 387173 - RNA, 32 nt, Human
cgccgcuguugcugcugacuccaaggucuucu

SEQ ID NO: 387174 - RNA, 32 nt, Human
cgccgcuuacucucagcggaugcagcugcuca

SEQ ID NO: 387175 - RNA, 32 nt, Human
cgccggacccuccucugcacuuuggggaggcg

SEQ ID NO: 387176 - RNA, 32 nt, Human
cgccggaccugccaggaggugggcuggcgcgg

SEQ ID NO: 387177 - RNA, 32 nt, Human
cgccggacgaagaagagaagggcaguugggcc

SEQ ID NO: 387178 - RNA, 32 nt, Human
cgccggagaggaaggccggcuggcuguggcgc

SEQ ID NO: 387179 - RNA, 32 nt, Human
cgccggaggaggcauuaacgagaccggguaag

SEQ ID NO: 387180 - RNA, 32 nt, Human
cgccggaggaggcggagguggcgcggcaggag

SEQ ID NO: 387181 - RNA, 32 nt, Human
cgccggaggagguggcggcggcugggagaggc

SEQ ID NO: 387182 - RNA, 32 nt, Human
cgccggaggcucccccuccucuccucuccccu

SEQ ID NO: 387183 - RNA, 32 nt, Human
cgccggaggggccuggagugcggcggcggcgg

SEQ ID NO: 387184 - RNA, 32 nt, Human
cgccggaugcacuagcccugaagagggguguc

SEQ ID NO: 387185 - RNA, 32 nt, Human
cgccggcaccccuugcuuccucccucuguugu

SEQ ID NO: 387186 - RNA, 32 nt, Human
cgccggcaccgccugcaccgcccuuccgcccg

SEQ ID NO: 387187 - RNA, 32 nt, Human
cgccggcagcauggacaaaggucuccaugcag

SEQ ID NO: 387188 - RNA, 32 nt, Human
cgccggcagcuuccagcccugccgcagaagug

SEQ ID NO: 387189 - RNA, 32 nt, Human
cgccggcauccagcagugcaucgcugaaguug

SEQ ID NO: 387190 - RNA, 32 nt, Human
cgccggccacacuggucacaggcaaaguccag

SEQ ID NO: 387191 - RNA, 32 nt, Human
cgccggcccagccugauggaacccacuguacc

SEQ ID NO: 387192 - RNA, 32 nt, Human
cgccggcccggagagcgcgcggcggcggcggc

SEQ ID NO: 387193 - RNA, 32 nt, Human
cgccggcccugccugcugcucugcccagggca

SEQ ID NO: 387194 - RNA, 32 nt, Human
cgccggcccuggggcagcagagccaggaugga

SEQ ID NO: 387195 - RNA, 32 nt, Human
cgccggccgaggaggagggguggggguagcgg

SEQ ID NO: 387196 - RNA, 32 nt, Human
cgccggccuccaggccccuccuggcuggcgag

SEQ ID NO: 387197 - RNA, 32 nt, Human
cgccggccuccagggcgcgcaggcuguuguug

SEQ ID NO: 387198 - RNA, 16 nt, Human
cgccggccucucccca

SEQ ID NO: 387199 - RNA, 32 nt, Human
cgccggccugucagagcaaaucagccucaggc

SEQ ID NO: 387200 - RNA, 32 nt, Human
cgccggccuuagugaccccaucuaugcugcug

SEQ ID NO: 387201 - RNA, 32 nt, Human
cgccggcgacugccugccccagccccucagug

SEQ ID NO: 387202 - RNA, 32 nt, Human
cgccggcucugccuccucccccuucccgaccc

SEQ ID NO: 387203 - RNA, 32 nt, Human
cgccggcuucaggacaugcacggacacagccg

SEQ ID NO: 387204 - RNA, 32 nt, Human
cgccgggaaacugggaaggcuggugagcgaga

SEQ ID NO: 387205 - RNA, 32 nt, Human
cgccgggaacccuggggcauggagaggucuga

SEQ ID NO: 387206 - RNA, 32 nt, Human
cgccgggacccugccugugacucuccaggacu

SEQ ID NO: 387207 - RNA, 32 nt, Human
cgccgggaccugccucaugcaggaggaggagg

SEQ ID NO: 387208 - RNA, 32 nt, Human
cgccgggacugacaguugccggaagugaggcu

SEQ ID NO: 387209 - RNA, 32 nt, Human
cgccgggacuuuaaccccuugugggcucugcg

SEQ ID NO: 387210 - RNA, 32 nt, Human
cgccgggagaguugagaauuauggcugcagga

SEQ ID NO: 387211 - RNA, 32 nt, Human
cgccgggagggagccagaucccagcgaucuuc

SEQ ID NO: 387212 - RNA, 32 nt, Human
cgccgggaggggcaaccaggccucccagcgag

SEQ ID NO: 387213 - RNA, 32 nt, Human
cgccgggcagggcggcgggcgcgcucagucug

SEQ ID NO: 387214 - RNA, 32 nt, Human
cgccgggcccgcaguuauugccgcugccuggu

SEQ ID NO: 387215 - RNA, 32 nt, Human
cgccgggccggugggagccagcggcgcgcggu

SEQ ID NO: 387216 - RNA, 32 nt, Human
cgccgggccucaggcuccuuccuacuguccga

SEQ ID NO: 387217 - RNA, 29 nt, Human
cgccgggcgacaccacgaguuauuuccca

SEQ ID NO: 387218 - RNA, 32 nt, Human
cgccgggcugcgugcacguccagccugaccgg

SEQ ID NO: 387219 - RNA, 32 nt, Human
cgccggggaagaggacacgcagaggagcagcu

SEQ ID NO: 387220 - RNA, 32 nt, Human
cgccggggaagaggaggaggaaggaaagaaag

SEQ ID NO: 387221 - RNA, 32 nt, Human
cgccggggaccaggaaccuccagcgcugagau

SEQ ID NO: 387222 - RNA, 17 nt, Human
cgccggggcccugagcc

SEQ ID NO: 387223 - RNA, 32 nt, Human
cgccggggccgcggguggaggucggggaugag

SEQ ID NO: 387224 - RNA, 32 nt, Human
cgccggucccgguccugagcuggaccagagcc

SEQ ID NO: 387225 - RNA, 21 nt, Human
cgccggucugggcugugcgga

SEQ ID NO: 387226 - RNA, 32 nt, Human
cgccggugagagaagagaacgcgagaagggaa

SEQ ID NO: 387227 - RNA, 32 nt, Human
cgccggugagcacgggcucccucucgcguggc

SEQ ID NO: 387228 - RNA, 32 nt, Human
cgccgguguccccagagaccaggcuguguccc

SEQ ID NO: 387229 - RNA, 32 nt, Human
cgccgguucauuuugcaccuuauucagaaaau

SEQ ID NO: 387230 - RNA, 32 nt, Human
cgccgucccagugcccucagaggcaccuagac

SEQ ID NO: 387231 - RNA, 32 nt, Human
cgccguccccacccccuccauuuggcagcuca

SEQ ID NO: 387232 - RNA, 32 nt, Human
cgccgucccccuucaucuccccacggacugua

SEQ ID NO: 387233 - RNA, 32 nt, Human
cgccgucccugcggcaccugccccagagcccg

SEQ ID NO: 387234 - RNA, 32 nt, Human
cgccgucccugugcagcugggcucagacgugu

SEQ ID NO: 387235 - RNA, 23 nt, Human
cgccguccgccccagccccgggg

SEQ ID NO: 387236 - RNA, 32 nt, Human
cgccgucgccacucgggagaggcugggugagg

SEQ ID NO: 387237 - RNA, 32 nt, Human
cgccgucgcccaggcgccccgcaauguagcug

SEQ ID NO: 387238 - RNA, 32 nt, Human
cgccgucgcuuccugcuaaccccacauccuca

SEQ ID NO: 387239 - RNA, 32 nt, Human
cgccgucuccuccucuugcccgcgcaggcacc

SEQ ID NO: 387240 - RNA, 32 nt, Human
cgccgucugcccacuccucuagccggaaccug

SEQ ID NO: 387241 - RNA, 32 nt, Human
cgccgucugcucccucuccacucucuucucaa

SEQ ID NO: 387242 - RNA, 19 nt, Human
cgccgugccgcuccucccu

SEQ ID NO: 387243 - RNA, 32 nt, Human
cgccgugccugccucgcgcucccuguuacggc

SEQ ID NO: 387244 - RNA, 32 nt, Human
cgccguggcagggauccuggagcacugcguga

SEQ ID NO: 387245 - RNA, 32 nt, Human
cgccguggcucacaccuguaauccuagcgcuu

SEQ ID NO: 387246 - RNA, 32 nt, Human
cgccguggcucacgccuguaaucccagcacuu

SEQ ID NO: 387247 - RNA, 32 nt, Human
cgccguggcucacucuuguaaucccaaaacuu

SEQ ID NO: 387248 - RNA, 32 nt, Human
cgccgugucauccaggcuggagugcgguggug

SEQ ID NO: 387249 - RNA, 32 nt, Human
cgccguguuggccaggcuggucucgaacuccu

SEQ ID NO: 387250 - RNA, 32 nt, Human
cgccguuccggaaaagucauggaagacagccc

SEQ ID NO: 387251 - RNA, 32 nt, Human
cgccguugcacuccagccugggcaacaagagu

SEQ ID NO: 387252 - RNA, 32 nt, Human
cgccguugcccaggcuggagugcgguggcaug

SEQ ID NO: 387253 - RNA, 32 nt, Human
cgccguugggggaagagcugugucacagccag

SEQ ID NO: 387254 - RNA, 32 nt, Human
cgccguuuccucugaagaaacagaaccagaga

SEQ ID NO: 387255 - RNA, 32 nt, Human
cgccuaaagugggcugcuggggagacaagauc

SEQ ID NO: 387256 - RNA, 32 nt, Human
cgccuacagccccucugaaaucaaagagaucu

SEQ ID NO: 387257 - RNA, 32 nt, Human
cgccuaccagagguggaagagacagugugggc

SEQ ID NO: 387258 - RNA, 16 nt, Human
cgccuacgcgggaacc

SEQ ID NO: 387259 - RNA, 21 nt, Human
cgccuacgcuggagugcagug

SEQ ID NO: 387260 - RNA, 32 nt, Human
cgccuacugggugggagcccugguuuccaucu

SEQ ID NO: 387261 - RNA, 32 nt, Human
cgccuagaaaacuugcucucaaacuucagggu

SEQ ID NO: 387262 - RNA, 32 nt, Human
cgccuagcccucugggaauuguguucuggguc

SEQ ID NO: 387263 - RNA, 32 nt, Human
cgccuagccgcgccggucccagaaguggcgaa

SEQ ID NO: 387264 - RNA, 18 nt, Human
cgccuagcuccucggcuc

SEQ ID NO: 387265 - RNA, 32 nt, Human
cgccuaggcacacaggccagccccagucucac

SEQ ID NO: 387266 - RNA, 32 nt, Human
cgccuaggccaucugggugcugggcauggauu

SEQ ID NO: 387267 - RNA, 32 nt, Human
cgccuaggcugcagugcaguggcgggaucucg

SEQ ID NO: 387268 - RNA, 32 nt, Human
cgccuaggcuggagcgccgugguacagucuug

SEQ ID NO: 387269 - RNA, 21 nt, Human
cgccuaggcuggagugcagug

SEQ ID NO: 387270 - RNA, 32 nt, Human
cgccuagggaccccugcucccagccugcugag

SEQ ID NO: 387271 - RNA, 32 nt, Human
cgccuagugagggcaggagagaggaggacgca

SEQ ID NO: 387272 - RNA, 32 nt, Human
cgccuagugcagccgugagaaaagggccaccc

SEQ ID NO: 387273 - RNA, 32 nt, Human
cgccuauacacacgcacacacgcacacacaca

SEQ ID NO: 387274 - RNA, 32 nt, Human
cgccucaaaugagagacugguguggggaggag

SEQ ID NO: 387275 - RNA, 30 nt, Human
cgccucaacucaagcaauccucccaccuca

SEQ ID NO: 387276 - RNA, 32 nt, Human
cgccucaccccggcuccugggcuuugaugguc

SEQ ID NO: 387277 - RNA, 22 nt, Human
cgccucaccugccaccagggag

SEQ ID NO: 387278 - RNA, 32 nt, Human
cgccucacgguggaagaugauguggauaugcu

SEQ ID NO: 387279 - RNA, 32 nt, Human
cgccucacugcaaccuccgccucccagguuca

SEQ ID NO: 387280 - RNA, 32 nt, Human
cgccucacugcaaccuucaccuaccgaguuca

SEQ ID NO: 387281 - RNA, 32 nt, Human
cgccucacugcaacuugcgccucccggguuca

SEQ ID NO: 387282 - RNA, 32 nt, Human
cgccucacuucuggcgccuccugcugccuccu

SEQ ID NO: 387283 - RNA, 32 nt, Human
cgccucagaaaaucacuugucugaugcucagg

SEQ ID NO: 387284 - RNA, 32 nt, Human
cgccucagagccucucagggcaggccaacuuc

SEQ ID NO: 387285 - RNA, 32 nt, Human
cgccucagaguuggagcacacagcuguauuaa

SEQ ID NO: 387286 - RNA, 23 nt, Human
cgccucagcaccgcuccgggaca

SEQ ID NO: 387287 - RNA, 32 nt, Human
cgccucagcccacccuucccgccacccuggcc

SEQ ID NO: 387288 - RNA, 32 nt, Human
cgccucagccccucaaguagcugggacuacag

SEQ ID NO: 387289 - RNA, 32 nt, Human
cgccucagccgauccuggcacagccauuuugc

SEQ ID NO: 387290 - RNA, 32 nt, Human
cgccucagccucccaaaguucugggauuacaa

SEQ ID NO: 387291 - RNA, 32 nt, Human
cgccucagccucccgaggcaugagccaccacg

SEQ ID NO: 387292 - RNA, 32 nt, Human
cgccucagccuccugagcagcugggauuacag

SEQ ID NO: 387293 - RNA, 32 nt, Human
cgccucagccuccugaguagauggaacuacag

SEQ ID NO: 387294 - RNA, 32 nt, Human
cgccucagccuccugaguagcugggauuacag

SEQ ID NO: 387295 - RNA, 32 nt, Human
cgccucagccucggcccugcgcugcgcgcccg

SEQ ID NO: 387296 - RNA, 32 nt, Human
cgccucagccuucugcgcucgccgccgccgcc

SEQ ID NO: 387297 - RNA, 32 nt, Human
cgccucagucucccaaagugcugguauuacag

SEQ ID NO: 387298 - RNA, 32 nt, Human
cgccucagugugacagagagguguggggaggc

SEQ ID NO: 387299 - RNA, 32 nt, Human
cgccucaucaggagcauucgagggugcuugga

SEQ ID NO: 387300 - RNA, 32 nt, Human
cgccuccaaccucacagccucguagagcuuca

SEQ ID NO: 387301 - RNA, 32 nt, Human
cgccuccaacuugcggccgccgggcuuggcug

SEQ ID NO: 387302 - RNA, 32 nt, Human
cgccuccaagguuucacggcuuccucagcaga

SEQ ID NO: 387303 - RNA, 32 nt, Human
cgccuccaauccagacccaccacagcuggagg

SEQ ID NO: 387304 - RNA, 32 nt, Human
cgccuccaccaccaccaccgccgccgccucca

SEQ ID NO: 387305 - RNA, 21 nt, Human
cgccuccaccagcgccuccca

SEQ ID NO: 387306 - RNA, 18 nt, Human
cgccuccacccagccucc

SEQ ID NO: 387307 - RNA, 32 nt, Human
cgccuccagagggagcgagggaagcggcuaga

SEQ ID NO: 387308 - RNA, 23 nt, Human
cgccuccagcccagcgcucggag

SEQ ID NO: 387309 - RNA, 22 nt, Human
cgccuccagccccucgguguuc

SEQ ID NO: 387310 - RNA, 32 nt, Human
cgccuccagccucuccccucuggcaggcgcac

SEQ ID NO: 387311 - RNA, 20 nt, Human
cgccuccagccugaccagca

SEQ ID NO: 387312 - RNA, 32 nt, Human
cgccuccaggcuggaccagcaguuccaggcgg

SEQ ID NO: 387313 - RNA, 32 nt, Human
cgccuccaguaggaaaagaggaaaacugcgau

SEQ ID NO: 387314 - RNA, 32 nt, Human
cgccuccaugaagcggaaaagcgagcggcggu

SEQ ID NO: 387315 - RNA, 32 nt, Human
cgccuccauguuucagcaucuaugucaugggc

SEQ ID NO: 387316 - RNA, 32 nt, Human
cgccucccaaagcgcuggcauuacaggcgaca

SEQ ID NO: 387317 - RNA, 32 nt, Human
cgccucccaaagugcuaggauuacagguauga

SEQ ID NO: 387318 - RNA, 32 nt, Human
cgccucccaaagugcuggaauuacaggcauga

SEQ ID NO: 387319 - RNA, 32 nt, Human
cgccucccaaagugcugggaugacaggcguga

SEQ ID NO: 387320 - RNA, 32 nt, Human
cgccucccaaagugcugggauuacaggcguga

SEQ ID NO: 387321 - RNA, 32 nt, Human
cgccucccaaagugcugggauuacagguauca

SEQ ID NO: 387322 - RNA, 32 nt, Human
cgccucccaaagugcugggauuacagguguga

SEQ ID NO: 387323 - RNA, 32 nt, Human
cgccucccaaagugcugggauuacagguguuc

SEQ ID NO: 387324 - RNA, 32 nt, Human
cgccucccaaagugcugggauugcaggcauga

SEQ ID NO: 387325 - RNA, 32 nt, Human
cgccucccaaaguguugggauuacaagcguga

SEQ ID NO: 387326 - RNA, 32 nt, Human
cgccucccaaguagcugggauuacaggcaugc

SEQ ID NO: 387327 - RNA, 32 nt, Human
cgccucccaaguagcugggauuacagguaccu

SEQ ID NO: 387328 - RNA, 32 nt, Human
cgccucccagaguucagacccaggaagcggcc

SEQ ID NO: 387329 - RNA, 32 nt, Human
cgccucccaggcgauucuccugccucagccuc

SEQ ID NO: 387330 - RNA, 32 nt, Human
cgccucccagguucgagcacuuuucaugccuc

SEQ ID NO: 387331 - RNA, 32 nt, Human
cgccucccaucccgcuuagcgcucuggacaga

SEQ ID NO: 387332 - RNA, 32 nt, Human
cgccucccaugucuuugaagcaccccuccagg

SEQ ID NO: 387333 - RNA, 32 nt, Human
cgccuccccaagcgcugagauuacagguguga

SEQ ID NO: 387334 - RNA, 32 nt, Human
cgccuccccgucuccuccucaggcucggacca

SEQ ID NO: 387335 - RNA, 21 nt, Human
cgccuccccucccggcuccca

SEQ ID NO: 387336 - RNA, 32 nt, Human
cgccucccgaagugcugggauuacagauguaa

SEQ ID NO: 387337 - RNA, 32 nt, Human
cgccucccgaguagcuggaauuacagacgccu

SEQ ID NO: 387338 - RNA, 32 nt, Human
cgccucccgaguagcugggauuacaggcaugu

SEQ ID NO: 387339 - RNA, 23 nt, Human
cgccucccgccgggcucugccgg

SEQ ID NO: 387340 - RNA, 32 nt, Human
cgccucccggagguccuccugaugcccuagga

SEQ ID NO: 387341 - RNA, 32 nt, Human
cgccucccuaagugcugggauuacaggcauga

SEQ ID NO: 387342 - RNA, 32 nt, Human
cgccucccuccaggacuccaccccggcucccg

SEQ ID NO: 387343 - RNA, 32 nt, Human
cgccucccuccuggccaggcuguucgagcacc

SEQ ID NO: 387344 - RNA, 32 nt, Human
cgccucccugcagccccaucuccuugggcgcc

SEQ ID NO: 387345 - RNA, 32 nt, Human
cgccucccugccuccagcccuggcugcaaugu

SEQ ID NO: 387346 - RNA, 32 nt, Human
cgccucccugcuccucaggggacccgcacucu

SEQ ID NO: 387347 - RNA, 32 nt, Human
cgccucccugcucuuggccacugugcucccau

SEQ ID NO: 387348 - RNA, 32 nt, Human
cgccucccuuucccugcucugccugcgggcac

SEQ ID NO: 387349 - RNA, 23 nt, Human
cgccuccgcccaccuuccucgcc

SEQ ID NO: 387350 - RNA, 32 nt, Human
cgccuccgccccgcccccucccgggacgccgg

SEQ ID NO: 387351 - RNA, 22 nt, Human
cgccuccgcccggcugcccgcc

SEQ ID NO: 387352 - RNA, 20 nt, Human
cgccuccgccucugcccgcc

SEQ ID NO: 387353 - RNA, 17 nt, Human
cgccuccgcucucccca

SEQ ID NO: 387354 - RNA, 24 nt, Human
cgccuccggcuauccgcugcucca

SEQ ID NO: 387355 - RNA, 32 nt, Human
cgccuccggcuccguccuccucuggcccccuc

SEQ ID NO: 387356 - RNA, 18 nt, Human
cgccuccgucgccgccgu

SEQ ID NO: 387357 - RNA, 32 nt, Human
cgccuccuccacccccugcccugccaggccca

SEQ ID NO: 387358 - RNA, 32 nt, Human
cgccuccuccaggccaugcuccuugaacuugg

SEQ ID NO: 387359 - RNA, 32 nt, Human
cgccuccuccuccaccuccuccuccuccuccu

SEQ ID NO: 387360 - RNA, 32 nt, Human
cgccuccuccuccccucugcccuuuccccuuc

SEQ ID NO: 387361 - RNA, 26 nt, Human
cgccuccuccuccuccgccgccgcca

SEQ ID NO: 387362 - RNA, 21 nt, Human
cgccuccucggccaguggcgu

SEQ ID NO: 387363 - RNA, 22 nt, Human
cgccuccucgggcuccacgcgu

SEQ ID NO: 387364 - RNA, 32 nt, Human
cgccuccugccagcuuccuuagaccaggcagg

SEQ ID NO: 387365 - RNA, 32 nt, Human
cgccuccugccuggagugacccugggcgggga

SEQ ID NO: 387366 - RNA, 25 nt, Human
cgccuccugcuagcaagaacagagu

SEQ ID NO: 387367 - RNA, 32 nt, Human
cgccuccuggguucaggagauucuccucuguc

SEQ ID NO: 387368 - RNA, 32 nt, Human
cgccuccuucaaaaagcaaucuggaagaaagc

SEQ ID NO: 387369 - RNA, 25 nt, Human
cgccuccuucugcggacucugcggg

SEQ ID NO: 387370 - RNA, 22 nt, Human
cgccuccuuuucuagaugggga

SEQ ID NO: 387371 - RNA, 21 nt, Human
cgccucgcccgagccccggga

SEQ ID NO: 387372 - RNA, 32 nt, Human
cgccucgccuaccaaucucugcucucuaugua

SEQ ID NO: 387373 - RNA, 32 nt, Human
cgccucgcgggcuccccgccugggucgggaca

SEQ ID NO: 387374 - RNA, 32 nt, Human
cgccucggcuccaggaggucacacagcagguu

SEQ ID NO: 387375 - RNA, 32 nt, Human
cgccucgggcagcagagagcagaugaaacccc

SEQ ID NO: 387376 - RNA, 32 nt, Human
cgccucgggucguggagccaggagcgacguca

SEQ ID NO: 387377 - RNA, 32 nt, Human
cgccucggucacccugcacagcaggccacaga

SEQ ID NO: 387378 - RNA, 32 nt, Human
cgccucgucgaucuccccuucuaccccggucc

SEQ ID NO: 387379 - RNA, 21 nt, Human
cgccucgugccccugccuccu

SEQ ID NO: 387380 - RNA, 32 nt, Human
cgccucuaaugucugucuggaugggauguguu

SEQ ID NO: 387381 - RNA, 32 nt, Human
cgccucuacuaaaaauacaaaaauuagccagg

SEQ ID NO: 387382 - RNA, 32 nt, Human
cgccucuacuaaaaauacaaaaauuagccggg

SEQ ID NO: 387383 - RNA, 32 nt, Human
cgccucuacuaaaaauacaaaaauugcccagg

SEQ ID NO: 387384 - RNA, 32 nt, Human
cgccucuacuccccaucacucccagccgagag

SEQ ID NO: 387385 - RNA, 32 nt, Human
cgccucucagccgcccgccgcacagacgcacg

SEQ ID NO: 387386 - RNA, 32 nt, Human
cgccucucauucagagaggugaggucaggaaa

SEQ ID NO: 387387 - RNA, 32 nt, Human
cgccucuccagggccccuuuccugggcgucua

SEQ ID NO: 387388 - RNA, 32 nt, Human
cgccucuccaucuccgacgacugggcaagagg

SEQ ID NO: 387389 - RNA, 32 nt, Human
cgccucucccacaugccacccccuucccuguc

SEQ ID NO: 387390 - RNA, 32 nt, Human
cgccucucccugcacucccuccuggagcucug

SEQ ID NO: 387391 - RNA, 32 nt, Human
cgccucucggcaagauuucgcgcugcccaucc

SEQ ID NO: 387392 - RNA, 32 nt, Human
cgccucucugcagccuuucacuucagugccca

SEQ ID NO: 387393 - RNA, 32 nt, Human
cgccucugacaugaguccagggagaggcaaga

SEQ ID NO: 387394 - RNA, 31 nt, Human
cgccucugacuucucuguccgaagucgggac

SEQ ID NO: 387395 - RNA, 32 nt, Human
cgccucugcacuccagccugggcaacaagagu

SEQ ID NO: 387396 - RNA, 32 nt, Human
cgccucugcacuccagccugggugacaagagu

SEQ ID NO: 387397 - RNA, 32 nt, Human
cgccucugccaauccccgccguccuuccagcc

SEQ ID NO: 387398 - RNA, 32 nt, Human
cgccucuggccuugggggcucguucuugaggg

SEQ ID NO: 387399 - RNA, 26 nt, Human
cgccucugggaagccugggcagcaga

SEQ ID NO: 387400 - RNA, 32 nt, Human
cgccucuucucacucccuggucaucaauaaau

SEQ ID NO: 387401 - RNA, 32 nt, Human
cgccucuucucccagcucccuccagccaucag

SEQ ID NO: 387402 - RNA, 32 nt, Human
cgccucuugcggucccagaguggaguggaagg

SEQ ID NO: 387403 - RNA, 32 nt, Human
cgccucuuggaguucaagaagccaacgcugag

SEQ ID NO: 387404 - RNA, 32 nt, Human
cgccugaccaggaguucgaggcugcagugagc

SEQ ID NO: 387405 - RNA, 32 nt, Human
cgccugaccccaugucucaggcugccagagga

SEQ ID NO: 387406 - RNA, 32 nt, Human
cgccugacucggccugccccagccucugcuuc

SEQ ID NO: 387407 - RNA, 32 nt, Human
cgccugacugcuguucaggcccgcacaauguc

SEQ ID NO: 387408 - RNA, 31 nt, Human
cgccugagcagcuagagccggggcggcgcgg

SEQ ID NO: 387409 - RNA, 32 nt, Human
cgccugagccuccugaguaucugggacuacag

SEQ ID NO: 387410 - RNA, 32 nt, Human
cgccugagccugacagaggagaagcagcggcu

SEQ ID NO: 387411 - RNA, 32 nt, Human
cgccugagcguggagagcacgaguuaguugua

SEQ ID NO: 387412 - RNA, 32 nt, Human
cgccugaggaggaggaggagaagcggaugaga

SEQ ID NO: 387413 - RNA, 32 nt, Human
cgccugaggaggaggaggaggcgggggcggcc

SEQ ID NO: 387414 - RNA, 32 nt, Human
cgccugagugagugugugugcuugaaugugag

SEQ ID NO: 387415 - RNA, 32 nt, Human
cgccugaugcaauccuucugugccucauggcc

SEQ ID NO: 387416 - RNA, 32 nt, Human
cgccugauggugcugcucaggcccaugcuaug

SEQ ID NO: 387417 - RNA, 32 nt, Human
cgccugcacacccagagaaauggacuuggcuu

SEQ ID NO: 387418 - RNA, 32 nt, Human
cgccugcacagcacauuaacugugcugaaugc

SEQ ID NO: 387419 - RNA, 32 nt, Human
cgccugcaccgccucugcguccuggguagucu

SEQ ID NO: 387420 - RNA, 22 nt, Human
cgccugcaccuucgccagggag

SEQ ID NO: 387421 - RNA, 32 nt, Human
cgccugcacugcacugaggacccggugccgga

SEQ ID NO: 387422 - RNA, 32 nt, Human
cgccugcagccugccccugugaucccuucggc

SEQ ID NO: 387423 - RNA, 32 nt, Human
cgccugcagucuccucucugggugauugcgcg

SEQ ID NO: 387424 - RNA, 32 nt, Human
cgccugcaucugugugggggcagccacacccc

SEQ ID NO: 387425 - RNA, 32 nt, Human
cgccugcaugcagcaggcguguguuccagugg

SEQ ID NO: 387426 - RNA, 19 nt, Human
cgccugccaccucccccca

SEQ ID NO: 387427 - RNA, 32 nt, Human
cgccugccagcccagagcccuggaggagccgg

SEQ ID NO: 387428 - RNA, 32 nt, Human
cgccugccaggagugaguccaugcguugucug

SEQ ID NO: 387429 - RNA, 23 nt, Human
cgccugccccucucguguuugau

SEQ ID NO: 387430 - RNA, 32 nt, Human
cgccugccccuuucugcagccuaggcggccca

SEQ ID NO: 387431 - RNA, 20 nt, Human
cgccugcccgcccuccccca

SEQ ID NO: 387432 - RNA, 32 nt, Human
cgccugcccgccugccccuccugccgaccaca

SEQ ID NO: 387433 - RNA, 32 nt, Human
cgccugcccugaguccggagcccuuugccucc

SEQ ID NO: 387434 - RNA, 32 nt, Human
cgccugcccugccugggccuuggcugggccuc

SEQ ID NO: 387435 - RNA, 32 nt, Human
cgccugcccuggggcacccagggcugugcugg

SEQ ID NO: 387436 - RNA, 32 nt, Human
cgccugccuccacccugcucuccaucucccgc

SEQ ID NO: 387437 - RNA, 32 nt, Human
cgccugccuccucuaacuugggugaugccagu

SEQ ID NO: 387438 - RNA, 30 nt, Human
cgccugccuccugcagguuccuuuccuggg

SEQ ID NO: 387439 - RNA, 32 nt, Human
cgccugccuccuggcucaggcccagcuuauug

SEQ ID NO: 387440 - RNA, 32 nt, Human
cgccugccucggccuccugaaguguugggauu

SEQ ID NO: 387441 - RNA, 32 nt, Human
cgccugccugccagcaguugcuggugagcagc

SEQ ID NO: 387442 - RNA, 22 nt, Human
cgccugccugcuggcucucccc

SEQ ID NO: 387443 - RNA, 32 nt, Human
cgccugccugcuggggcugccugcaugccucc

SEQ ID NO: 387444 - RNA, 18 nt, Human
cgccugccuggcugccca

SEQ ID NO: 387445 - RNA, 18 nt, Human
cgccugccugucccgcca

SEQ ID NO: 387446 - RNA, 28 nt, Human
cgccugccuucugaccaaccucucccca

SEQ ID NO: 387447 - RNA, 32 nt, Human
cgccugccuucuggccacgcuggcggcagcca

SEQ ID NO: 387448 - RNA, 25 nt, Human
cgccugcgccguucucccggccgcc

SEQ ID NO: 387449 - RNA, 32 nt, Human
cgccugcgccuccauccaucuguccguccaga

SEQ ID NO: 387450 - RNA, 32 nt, Human
cgccugcgccuguaaucccagcacuuugggag

SEQ ID NO: 387451 - RNA, 19 nt, Human
cgccugcgccuuccucccu

SEQ ID NO: 387452 - RNA, 24 nt, Human
cgccugcgcggguggcuuugcggg

SEQ ID NO: 387453 - RNA, 32 nt, Human
cgccugcgcucccggcccuggagaccaugagg

SEQ ID NO: 387454 - RNA, 32 nt, Human
cgccugcgcuuccuccugauggucgccagagg

SEQ ID NO: 387455 - RNA, 32 nt, Human
cgccugcggcgccgcgggcgggucgccucccc

SEQ ID NO: 387456 - RNA, 32 nt, Human
cgccugcuacacaggcaggaaugcgguuggga

SEQ ID NO: 387457 - RNA, 32 nt, Human
cgccugcucccucugcugcauuucaagcugac

SEQ ID NO: 387458 - RNA, 32 nt, Human
cgccugcugccuggcuugccuggucggcggcg

SEQ ID NO: 387459 - RNA, 32 nt, Human
cgccugcuuccccuccagcuccugggcucugc

SEQ ID NO: 387460 - RNA, 32 nt, Human
cgccugcuugucccugcccagaauucccagcu

SEQ ID NO: 387461 - RNA, 25 nt, Human
cgccuggaaguucggacugugugga

SEQ ID NO: 387462 - RNA, 32 nt, Human
cgccuggagaaguaugcuuucagcgagaacac

SEQ ID NO: 387463 - RNA, 32 nt, Human
cgccuggagccacacagggauccggagccugg

SEQ ID NO: 387464 - RNA, 32 nt, Human
cgccuggauccgggagcauggcccagagagug

SEQ ID NO: 387465 - RNA, 31 nt, Human
cgccuggaugagagaguggaacacugucauc

SEQ ID NO: 387466 - RNA, 32 nt, Human
cgccuggcacucccaguaggugcucaauaagu

SEQ ID NO: 387467 - RNA, 26 nt, Human
cgccuggcacuucugagcucggcgga

SEQ ID NO: 387468 - RNA, 32 nt, Human
cgccuggcacuucugagcucggcggacgagag

SEQ ID NO: 387469 - RNA, 32 nt, Human
cgccuggcagaacugagcuccucugggcagga

SEQ ID NO: 387470 - RNA, 32 nt, Human
cgccuggcaggcagaaggagcugcaguccuac

SEQ ID NO: 387471 - RNA, 32 nt, Human
cgccuggcaggcaugcggggccucuaaggcuu

SEQ ID NO: 387472 - RNA, 20 nt, Human
cgccuggcaucccaccugga

SEQ ID NO: 387473 - RNA, 21 nt, Human
cgccuggccacacucuucgga

SEQ ID NO: 387474 - RNA, 32 nt, Human
cgccuggccaccccaggcucaggcugcagaac

SEQ ID NO: 387475 - RNA, 32 nt, Human
cgccuggccagggcagggccaccccacucuac

SEQ ID NO: 387476 - RNA, 32 nt, Human
cgccuggcccucucccccaacgcccaggucuu

SEQ ID NO: 387477 - RNA, 32 nt, Human
cgccuggcccugagcugucaccaccgacacuc

SEQ ID NO: 387478 - RNA, 21 nt, Human
cgccuggccgccuccccgggc

SEQ ID NO: 387479 - RNA, 32 nt, Human
cgccuggccugaugccugugugucauucucuu

SEQ ID NO: 387480 - RNA, 32 nt, Human
cgccuggccugggagagccucuuccagguuuu

SEQ ID NO: 387481 - RNA, 32 nt, Human
cgccuggccugggagucccucccugguuuuua

SEQ ID NO: 387482 - RNA, 24 nt, Human
cgccuggcgcuccacacuggugga

SEQ ID NO: 387483 - RNA, 23 nt, Human
cgccuggcgcugcugcugccggg

SEQ ID NO: 387484 - RNA, 21 nt, Human
cgccuggcgcuuccuuccggg

SEQ ID NO: 387485 - RNA, 23 nt, Human
cgccuggcguugccgcggcgcug

SEQ ID NO: 387486 - RNA, 32 nt, Human
cgccuggcuaauuuuguuuuuguauuuuuagu

SEQ ID NO: 387487 - RNA, 25 nt, Human
cgccuggcucaguggcuucugcggg

SEQ ID NO: 387488 - RNA, 32 nt, Human
cgccuggcugcugccgcugccuccuccugggu

SEQ ID NO: 387489 - RNA, 20 nt, Human
cgccuggcuggagugcagug

SEQ ID NO: 387490 - RNA, 20 nt, Human
cgccuggcuggaguggagug

SEQ ID NO: 387491 - RNA, 32 nt, Human
cgccuggcuggcucaggccaaugcagaagucu

SEQ ID NO: 387492 - RNA, 32 nt, Human
cgccuggcuggcugcugcuccaccacgggccc

SEQ ID NO: 387493 - RNA, 32 nt, Human
cgccuggcugugcacacaugcagcacgaccca

SEQ ID NO: 387494 - RNA, 32 nt, Human
cgccuggcuucuuggaaagagcaggaaggagc

SEQ ID NO: 387495 - RNA, 32 nt, Human
cgccugggaaguggggacuggcccugguaccu

SEQ ID NO: 387496 - RNA, 32 nt, Human
cgccugggacagcggcgcgcugggcaggcgcc

SEQ ID NO: 387497 - RNA, 32 nt, Human
cgccugggagggugggcgcccaggcgucccug

SEQ ID NO: 387498 - RNA, 32 nt, Human
cgccugggcaggggccccaaagcuagcucuga

SEQ ID NO: 387499 - RNA, 32 nt, Human
cgccugggcugcagaagccagggugcaugacc

SEQ ID NO: 387500 - RNA, 32 nt, Human
cgccugggcuggggcuuacugggggcugaagg

SEQ ID NO: 387501 - RNA, 32 nt, Human
cgccugggucuucugcagacucaugcagcccu

SEQ ID NO: 387502 - RNA, 32 nt, Human
cgccugggugccuggagcugagcugcggcaag

SEQ ID NO: 387503 - RNA, 32 nt, Human
cgccuggguggaggcaggguagggcagggccc

SEQ ID NO: 387504 - RNA, 32 nt, Human
cgccuggugcugucccaggcccugggggugag

SEQ ID NO: 387505 - RNA, 24 nt, Human
cgccuguaaucccagacuuuggga

SEQ ID NO: 387506 - RNA, 26 nt, Human
cgccuguaaucccagcacuuugcggg

SEQ ID NO: 387507 - RNA, 32 nt, Human
cgccuguaaucccagcagugggagaccgaggu

SEQ ID NO: 387508 - RNA, 32 nt, Human
cgccuguaaucccggcuacucgggaggcugag

SEQ ID NO: 387509 - RNA, 26 nt, Human
cgccugucaauaaauguugaaaaguc

SEQ ID NO: 387510 - RNA, 18 nt, Human
cgccugucacugcagcug

SEQ ID NO: 387511 - RNA, 32 nt, Human
cgccuguccaguucggaggagaacuagcugcu

SEQ ID NO: 387512 - RNA, 22 nt, Human
cgccugucccugcucccucccu

SEQ ID NO: 387513 - RNA, 32 nt, Human
cgccugucccugcuucuuuucugaccgggaaa

SEQ ID NO: 387514 - RNA, 32 nt, Human
cgccuguccuucagaccaucucccugcugcgg

SEQ ID NO: 387515 - RNA, 32 nt, Human
cgccuguccuugguggccgggggugggggccu

SEQ ID NO: 387516 - RNA, 32 nt, Human
cgccugucucagccucuccaagugcugggauu

SEQ ID NO: 387517 - RNA, 32 nt, Human
cgccugucugcucuccucuaacuaggacccag

SEQ ID NO: 387518 - RNA, 32 nt, Human
cgccugugaacugucuguucuccagcgcccgg

SEQ ID NO: 387519 - RNA, 32 nt, Human
cgccugugcagcccucccagguggaguacacg

SEQ ID NO: 387520 - RNA, 32 nt, Human
cgccugugcuugccucccagguaccccagugu

SEQ ID NO: 387521 - RNA, 32 nt, Human
cgccuguggaugcugcgccucuccgaacgcaa

SEQ ID NO: 387522 - RNA, 32 nt, Human
cgccugugggauccaccaugccacaugacagc

SEQ ID NO: 387523 - RNA, 32 nt, Human
cgccuguggguucaccaccuccuaggaggguc

SEQ ID NO: 387524 - RNA, 32 nt, Human
cgccugugucaucugggcugggccccacaaac

SEQ ID NO: 387525 - RNA, 29 nt, Human
cgccuguguccgugugugcuugggugugu

SEQ ID NO: 387526 - RNA, 21 nt, Human
cgccuuaaccgagcucgugga

SEQ ID NO: 387527 - RNA, 32 nt, Human
cgccuuagaacuagcagccaaguccaucuaaa

SEQ ID NO: 387528 - RNA, 32 nt, Human
cgccuuaggacggggccaggaggccaggcgcu

SEQ ID NO: 387529 - RNA, 32 nt, Human
cgccuuaucaacccuuuucucccuuuagcaaa

SEQ ID NO: 387530 - RNA, 32 nt, Human
cgccuucacacuaggaugacagacucagcuaa

SEQ ID NO: 387531 - RNA, 32 nt, Human
cgccuucacccacugccucugccucccugggg

SEQ ID NO: 387532 - RNA, 32 nt, Human
cgccuucaccuggaugcugcuggagggugugc

SEQ ID NO: 387533 - RNA, 32 nt, Human
cgccuucacugcccuguguccucugcucgcag

SEQ ID NO: 387534 - RNA, 32 nt, Human
cgccuucagccaugauugugaguccuccccaa

SEQ ID NO: 387535 - RNA, 32 nt, Human
cgccuucagccuggcccugcgcuccaugcaga

SEQ ID NO: 387536 - RNA, 32 nt, Human
cgccuuccaccugaauccccacccaggacugu

SEQ ID NO: 387537 - RNA, 32 nt, Human
cgccuuccaguccaaaaaucccgccaagagag

SEQ ID NO: 387538 - RNA, 32 nt, Human
cgccuucccacccagcgucuuccccagguucc

SEQ ID NO: 387539 - RNA, 32 nt, Human
cgccuucccaugcccccacacccggcuccugc

SEQ ID NO: 387540 - RNA, 32 nt, Human
cgccuucccugccucuccaggacagagcagcc

SEQ ID NO: 387541 - RNA, 32 nt, Human
cgccuucccuuucuccccuuuggggucugucc

SEQ ID NO: 387542 - RNA, 32 nt, Human
cgccuuccgcuuggcccugccuucugccgcau

SEQ ID NO: 387543 - RNA, 32 nt, Human
cgccuuccucaagcucuggaucgagcugcuca

SEQ ID NO: 387544 - RNA, 32 nt, Human
cgccuuccuccuccucgucaggcucgacccag

SEQ ID NO: 387545 - RNA, 32 nt, Human
cgccuuccucugcugaaaaggcugcuuuucca

SEQ ID NO: 387546 - RNA, 22 nt, Human
cgccuucgccgccucccucccu

SEQ ID NO: 387547 - RNA, 25 nt, Human
cgccuucggcgccugcugccucccu

SEQ ID NO: 387548 - RNA, 32 nt, Human
cgccuucguuuugccauucucuacagcagacc

SEQ ID NO: 387549 - RNA, 31 nt, Human
cgccuucucagcuagaccaggguaggcauca

SEQ ID NO: 387550 - RNA, 32 nt, Human
cgccuucuccauagucuuuccccaccuggagc

SEQ ID NO: 387551 - RNA, 32 nt, Human
cgccuucucugccucuucucauccuuucucgc

SEQ ID NO: 387552 - RNA, 32 nt, Human
cgccuucucuuccuccuccuccgucuucuucc

SEQ ID NO: 387553 - RNA, 32 nt, Human
cgccuucuucccucguggacaggagucagcca

SEQ ID NO: 387554 - RNA, 32 nt, Human
cgccuucuuguccuccuccucauugucgcugc

SEQ ID NO: 387555 - RNA, 32 nt, Human
cgccuugacgaccgcguccaccucgcaggugc

SEQ ID NO: 387556 - RNA, 32 nt, Human
cgccuugcacacugccuggcacacaguaggcg

SEQ ID NO: 387557 - RNA, 32 nt, Human
cgccuugcagaacugucagccuguggaguugu

SEQ ID NO: 387558 - RNA, 32 nt, Human
cgccuugcccccagaucccacugggguccauu

SEQ ID NO: 387559 - RNA, 32 nt, Human
cgccuugcccggcccccgccgccuccugcucg

SEQ ID NO: 387560 - RNA, 32 nt, Human
cgccuugccucgcgcugggaggggagauccag

SEQ ID NO: 387561 - RNA, 20 nt, Human
cgccuugcgcccccggcacc

SEQ ID NO: 387562 - RNA, 31 nt, Human
cgccuuggcuuucucccucacccaaguuucc

SEQ ID NO: 387563 - RNA, 32 nt, Human
cgccuugggcaggccuacgugguggugcaggc

SEQ ID NO: 387564 - RNA, 32 nt, Human
cgccuugucacccaggcuggaguccaguggca

SEQ ID NO: 387565 - RNA, 32 nt, Human
cgccuugucucugcugcuccucuccuuggaaa

SEQ ID NO: 387566 - RNA, 23 nt, Human
cgccuugugaccccgggccccug

SEQ ID NO: 387567 - RNA, 22 nt, Human
cgccuuguggcggcuuugcgga

SEQ ID NO: 387568 - RNA, 32 nt, Human
cgccuugugguuuuguuuuguuuuguuuuguu

SEQ ID NO: 387569 - RNA, 32 nt, Human
cgccuuguucccucuucucucucuucaugaac

SEQ ID NO: 387570 - RNA, 30 nt, Human
cgccuuguuuccugagucugaucuguuugg

SEQ ID NO: 387571 - RNA, 32 nt, Human
cgccuuuacuguaagcuuccugaggcccucac

SEQ ID NO: 387572 - RNA, 32 nt, Human
cgccuuuacuuucacagccucugcagcaaacu

SEQ ID NO: 387573 - RNA, 32 nt, Human
cgccuuuccagcucccccugguucccgugcuc

SEQ ID NO: 387574 - RNA, 24 nt, Human
cgccuuucuccgcuggcaacggcg

SEQ ID NO: 387575 - RNA, 32 nt, Human
cgccuuugcugaaaauacaaaauuagccaggc

SEQ ID NO: 387576 - RNA, 32 nt, Human
cgccuuugggccgagcacugaaugucuuguac

SEQ ID NO: 387577 - RNA, 32 nt, Human
cgccuuuguaacucccaucuguggacccaucg

SEQ ID NO: 387578 - RNA, 32 nt, Human
cgccuuugugaaccccaaauaucugagaccag

SEQ ID NO: 387579 - RNA, 32 nt, Human
cgcgaaagacuugcuugcugugggcgagguau

SEQ ID NO: 387580 - RNA, 32 nt, Human
cgcgaacacugcuugucgccugggcaaccgga

SEQ ID NO: 387581 - RNA, 32 nt, Human
cgcgaacaugggaggcguagcuugcagugagc

SEQ ID NO: 387582 - RNA, 32 nt, Human
cgcgaacccuagcagaggacucagccaccgcc

SEQ ID NO: 387583 - RNA, 32 nt, Human
cgcgaacccucgggaguuaaagaccagccggc

SEQ ID NO: 387584 - RNA, 32 nt, Human
cgcgaagguggaggcggggccgcgccggaagc

SEQ ID NO: 387585 - RNA, 32 nt, Human
cgcgacacugcacuccagccugggcaacagag

SEQ ID NO: 387586 - RNA, 32 nt, Human
cgcgacacugcacuccagccugggugacggug

SEQ ID NO: 387587 - RNA, 32 nt, Human
cgcgacacugcgcuccagccugggcaacaaga

SEQ ID NO: 387588 - RNA, 18 nt, Human
cgcgaccagaucugggug

SEQ ID NO: 387589 - RNA, 19 nt, Human
cgcgacccccuuccagacc

SEQ ID NO: 387590 - RNA, 32 nt, Human
cgcgaccccggagccacgugccaggccgggcu

SEQ ID NO: 387591 - RNA, 32 nt, Human
cgcgacccggaggcggugggggugcggcugag

SEQ ID NO: 387592 - RNA, 20 nt, Human
cgcgacggggguucagggaa

SEQ ID NO: 387593 - RNA, 20 nt, Human
cgcgacgguucggccgggug

SEQ ID NO: 387594 - RNA, 32 nt, Human
cgcgacgugaagccggacgaggaccuggcgag

SEQ ID NO: 387595 - RNA, 32 nt, Human
cgcgacugcacuccagccugggcgagagagca

SEQ ID NO: 387596 - RNA, 32 nt, Human
cgcgacugccagacccucagggagucagggca

SEQ ID NO: 387597 - RNA, 32 nt, Human
cgcgacugcgcucaguucucuccucucggaag

SEQ ID NO: 387598 - RNA, 32 nt, Human
cgcgacugcuacaccaggcacuccugggcccg

SEQ ID NO: 387599 - RNA, 32 nt, Human
cgcgacuuacccaggccuuuuugcagugggag

SEQ ID NO: 387600 - RNA, 32 nt, Human
cgcgacuucggggaccugcucaucuacucggg

SEQ ID NO: 387601 - RNA, 32 nt, Human
cgcgagaaguagucucccgaagagguucggac

SEQ ID NO: 387602 - RNA, 32 nt, Human
cgcgagaccagccugaccaacauggagaaacc

SEQ ID NO: 387603 - RNA, 32 nt, Human
cgcgagauggucuaagucagcuuacaucccug

SEQ ID NO: 387604 - RNA, 32 nt, Human
cgcgagcagcagcagaggcggcggcggccccc

SEQ ID NO: 387605 - RNA, 32 nt, Human
cgcgagcagccaagggcuuccugagcaagcca

SEQ ID NO: 387606 - RNA, 32 nt, Human
cgcgagcauucccauguacccuggggcacccu

SEQ ID NO: 387607 - RNA, 32 nt, Human
cgcgagccacugcguccggccggcgggacuua

SEQ ID NO: 387608 - RNA, 32 nt, Human
cgcgagccgggguugcagcccagccgggacuu

SEQ ID NO: 387609 - RNA, 32 nt, Human
cgcgagcggcaggugugcacagagguucucca

SEQ ID NO: 387610 - RNA, 23 nt, Human
cgcgagcgggaggaccggggagg

SEQ ID NO: 387611 - RNA, 32 nt, Human
cgcgagcgggaggagcagagacccgcagccgg

SEQ ID NO: 387612 - RNA, 32 nt, Human
cgcgagcgucgggucccagagccgggcgcggc

SEQ ID NO: 387613 - RNA, 32 nt, Human
cgcgagcuccuggaggcggcgggauggaggcg

SEQ ID NO: 387614 - RNA, 32 nt, Human
cgcgaggaggugaggcuggagcgcggcccccu

SEQ ID NO: 387615 - RNA, 32 nt, Human
cgcgaggaugccuuuucucuucugccuugcga

SEQ ID NO: 387616 - RNA, 32 nt, Human
cgcgaggccgggagguccgggggucgggaggu

SEQ ID NO: 387617 - RNA, 32 nt, Human
cgcgaggcgacuucucaagcuuuugaaugggu

SEQ ID NO: 387618 - RNA, 22 nt, Human
cgcgaggcggcgagggcggcgg

SEQ ID NO: 387619 - RNA, 19 nt, Human
cgcgaggcuucuccgggug

SEQ ID NO: 387620 - RNA, 32 nt, Human
cgcgagggacggggcaggaugaaccgggccaa

SEQ ID NO: 387621 - RNA, 32 nt, Human
cgcgagggaggcgggagugagcagaaaggcuu

SEQ ID NO: 387622 - RNA, 32 nt, Human
cgcgaggggagggguccucccgcugaacagug

SEQ ID NO: 387623 - RNA, 32 nt, Human
cgcgagggggaggcacguggccccgcucagcc

SEQ ID NO: 387624 - RNA, 32 nt, Human
cgcgaggguagagcacaagauggaaauggagc

SEQ ID NO: 387625 - RNA, 32 nt, Human
cgcgaggugcaggagacgcaggcauggccggu

SEQ ID NO: 387626 - RNA, 22 nt, Human
cgcgaguccuccuccccgggug

SEQ ID NO: 387627 - RNA, 32 nt, Human
cgcgaguguucccguacauggagggggaccgg

SEQ ID NO: 387628 - RNA, 32 nt, Human
cgcgauaaauaugcagagcggaggcuucgcgc

SEQ ID NO: 387629 - RNA, 32 nt, Human
cgcgaucccgggagcuggaggcgcaugcgcau

SEQ ID NO: 387630 - RNA, 32 nt, Human
cgcgaucgacgcugcggagcgagcccacccgc

SEQ ID NO: 387631 - RNA, 32 nt, Human
cgcgaucuuggcugacugcagucugugccucc

SEQ ID NO: 387632 - RNA, 19 nt, Human
cgcgaugccgccggcgagu

SEQ ID NO: 387633 - RNA, 17 nt, Human
cgcgaugcuccugcgug

SEQ ID NO: 387634 - RNA, 32 nt, Human
cgcgauggcucacaccuguaaucccagagcuu

SEQ ID NO: 387635 - RNA, 32 nt, Human
cgcgauggcucacgccuguaaucccagcacuu

SEQ ID NO: 387636 - RNA, 32 nt, Human
cgcgauggcucauaccuguaaucccagcacuu

SEQ ID NO: 387637 - RNA, 32 nt, Human
cgcgauggcugucgccuguaaugccagcgcuu

SEQ ID NO: 387638 - RNA, 19 nt, Human
cgcgaugucaggcgcggug

SEQ ID NO: 387639 - RNA, 32 nt, Human
cgcgauugcaccaccacacuccagccugcgcg

SEQ ID NO: 387640 - RNA, 32 nt, Human
cgcgauuguaaguuuccugaggccuccuagcc

SEQ ID NO: 387641 - RNA, 32 nt, Human
cgcgcaacuuuguaaucccaacacuuucuauu

SEQ ID NO: 387642 - RNA, 32 nt, Human
cgcgcaagagugacacacagguguucaaagac

SEQ ID NO: 387643 - RNA, 31 nt, Human
cgcgcaaggggcccuguuuccggggagacug

SEQ ID NO: 387644 - RNA, 32 nt, Human
cgcgcaauugcgcuccagccugggcgacaaga

SEQ ID NO: 387645 - RNA, 32 nt, Human
cgcgcacaccaaagagaaagcggcuguggcgg

SEQ ID NO: 387646 - RNA, 32 nt, Human
cgcgcacaggcaggagguugcaguugggcgcu

SEQ ID NO: 387647 - RNA, 32 nt, Human
cgcgcaccagucgcguaagacaacagcagugu

SEQ ID NO: 387648 - RNA, 32 nt, Human
cgcgcaccucgcucccccucccggccggcgcu

SEQ ID NO: 387649 - RNA, 32 nt, Human
cgcgcaccuggcgccgcccgagcugcugcugc

SEQ ID NO: 387650 - RNA, 22 nt, Human
cgcgcaccuguaaucccagcua

SEQ ID NO: 387651 - RNA, 32 nt, Human
cgcgcaccuguaaucccagcuacuugggaggc

SEQ ID NO: 387652 - RNA, 22 nt, Human
cgcgcaccuguagucccagcua

SEQ ID NO: 387653 - RNA, 32 nt, Human
cgcgcacggacccccauuacacucgcguccca

SEQ ID NO: 387654 - RNA, 32 nt, Human
cgcgcacuagcccucgcgccgcacgggacacg

SEQ ID NO: 387655 - RNA, 32 nt, Human
cgcgcacuccaccgccagccucucgggaguca

SEQ ID NO: 387656 - RNA, 32 nt, Human
cgcgcacuugaggaggcugugguggugaggag

SEQ ID NO: 387657 - RNA, 18 nt, Human
cgcgcagaccgagucccc

SEQ ID NO: 387658 - RNA, 32 nt, Human
cgcgcagagccaaggcacugauguuugaacug

SEQ ID NO: 387659 - RNA, 21 nt, Human
cgcgcagagcccaggcccagg

SEQ ID NO: 387660 - RNA, 32 nt, Human
cgcgcagcaacggccucaauagcgccaggccc

SEQ ID NO: 387661 - RNA, 21 nt, Human
cgcgcagcacgaagcucgagc

SEQ ID NO: 387662 - RNA, 24 nt, Human
cgcgcagcagcagcagcagcagca

SEQ ID NO: 387663 - RNA, 32 nt, Human
cgcgcagcagccgccccgcugcgcccaccucc

SEQ ID NO: 387664 - RNA, 18 nt, Human
cgcgcagccagggcgccu

SEQ ID NO: 387665 - RNA, 32 nt, Human
cgcgcagccauacaacuuuagagcuggccuug

SEQ ID NO: 387666 - RNA, 21 nt, Human
cgcgcagccccgagcugggca

SEQ ID NO: 387667 - RNA, 23 nt, Human
cgcgcagcccgcggcccagcgca

SEQ ID NO: 387668 - RNA, 32 nt, Human
cgcgcagcccucuuuggacacacacgcgccgc

SEQ ID NO: 387669 - RNA, 32 nt, Human
cgcgcagccguguuucccucuggaccagacgc

SEQ ID NO: 387670 - RNA, 32 nt, Human
cgcgcagcucccucagcuucgcagcgccgccc

SEQ ID NO: 387671 - RNA, 32 nt, Human
cgcgcagcugcacuccagccugggcaacagag

SEQ ID NO: 387672 - RNA, 32 nt, Human
cgcgcagcugguguuccagaccugcgacauca

SEQ ID NO: 387673 - RNA, 32 nt, Human
cgcgcagcugguucccgcucugcagcgcaacg

SEQ ID NO: 387674 - RNA, 32 nt, Human
cgcgcaggagcugccaaggccaugucuguucc

SEQ ID NO: 387675 - RNA, 32 nt, Human
cgcgcaggcugugaucguaguggugcgaucuc

SEQ ID NO: 387676 - RNA, 32 nt, Human
cgcgcagguccacuucuccaucccugcucucg

SEQ ID NO: 387677 - RNA, 32 nt, Human
cgcgcaggugcggcgccuggguccccauggcg

SEQ ID NO: 387678 - RNA, 32 nt, Human
cgcgcaguccgcgagguccccacgccgggcga

SEQ ID NO: 387679 - RNA, 32 nt, Human
cgcgcauccuuucccagcuccccacccuccuu

SEQ ID NO: 387680 - RNA, 32 nt, Human
cgcgcaugcaugcacacacacgcacgcacaca

SEQ ID NO: 387681 - RNA, 32 nt, Human
cgcgcaugguggcucacccccuguaaucccag

SEQ ID NO: 387682 - RNA, 32 nt, Human
cgcgccaaugcacuccagccugggcgacagag

SEQ ID NO: 387683 - RNA, 20 nt, Human
cgcgccacagccccaccgcc

SEQ ID NO: 387684 - RNA, 32 nt, Human
cgcgccaccacacuccagccugagcgacagag

SEQ ID NO: 387685 - RNA, 32 nt, Human
cgcgccacccacccucgcuuucuccggcuucc

SEQ ID NO: 387686 - RNA, 32 nt, Human
cgcgccaccgcacuccagccucgccgacaaag

SEQ ID NO: 387687 - RNA, 32 nt, Human
cgcgccaccgcauuccagccugggcgacagag

SEQ ID NO: 387688 - RNA, 32 nt, Human
cgcgccaccgcccuccagccugggcgacagag

SEQ ID NO: 387689 - RNA, 32 nt, Human
cgcgccacggcacuccagccugggagacagag

SEQ ID NO: 387690 - RNA, 32 nt, Human
cgcgccacuacacuccagccugagcaacagag

SEQ ID NO: 387691 - RNA, 32 nt, Human
cgcgccacuauacuccagccugggcaacagac

SEQ ID NO: 387692 - RNA, 32 nt, Human
cgcgccacugaacucgggucugggcaacagau

SEQ ID NO: 387693 - RNA, 32 nt, Human
cgcgccacugcaacccagccugggugacagag

SEQ ID NO: 387694 - RNA, 32 nt, Human
cgcgccacugcacagccagggcgacggugcaa

SEQ ID NO: 387695 - RNA, 32 nt, Human
cgcgccacugcacucaagccugggcaacaccu

SEQ ID NO: 387696 - RNA, 32 nt, Human
cgcgccacugcacuccaaccugggugacagac

SEQ ID NO: 387697 - RNA, 32 nt, Human
cgcgccacugcacuccacccuggguaacggaa

SEQ ID NO: 387698 - RNA, 32 nt, Human
cgcgccacugcacuccagcagucugggcgaca

SEQ ID NO: 387699 - RNA, 32 nt, Human
cgcgccacugcacuccagcccgggugacagag

SEQ ID NO: 387700 - RNA, 32 nt, Human
cgcgccacugcacuccagccuagacgacagag

SEQ ID NO: 387701 - RNA, 32 nt, Human
cgcgccacugcacuccagccuaggggacaguu

SEQ ID NO: 387702 - RNA, 32 nt, Human
cgcgccacugcacuccagccuaggugacagag

SEQ ID NO: 387703 - RNA, 32 nt, Human
cgcgccacugcacuccagccucagcaauagag

SEQ ID NO: 387704 - RNA, 32 nt, Human
cgcgccacugcacuccagccucggcaacagag

SEQ ID NO: 387705 - RNA, 32 nt, Human
cgcgccacugcacuccagccucggugacagag

SEQ ID NO: 387706 - RNA, 32 nt, Human
cgcgccacugcacuccagccuggacgacagag

SEQ ID NO: 387707 - RNA, 32 nt, Human
cgcgccacugcacuccagccuggcaacagagu

SEQ ID NO: 387708 - RNA, 32 nt, Human
cgcgccacugcacuccagccuggcgacaaagc

SEQ ID NO: 387709 - RNA, 32 nt, Human
cgcgccacugcacuccagccuggcgacagagc

SEQ ID NO: 387710 - RNA, 32 nt, Human
cgcgccacugcacuccagccugggagaaagac

SEQ ID NO: 387711 - RNA, 32 nt, Human
cgcgccacugcacuccagccugggcaacaaga

SEQ ID NO: 387712 - RNA, 32 nt, Human
cgcgccacugcacuccagccugggcaacagaa

SEQ ID NO: 387713 - RNA, 32 nt, Human
cgcgccacugcacuccagccugggcaacagag

SEQ ID NO: 387714 - RNA, 32 nt, Human
cgcgccacugcacuccagccugggcaacaggc

SEQ ID NO: 387715 - RNA, 32 nt, Human
cgcgccacugcacuccagccugggcagcaaga

SEQ ID NO: 387716 - RNA, 32 nt, Human
cgcgccacugcacuccagccugggcgacacag

SEQ ID NO: 387717 - RNA, 31 nt, Human
cgcgccacugcacuccagccugggcgacaga

SEQ ID NO: 387718 - RNA, 32 nt, Human
cgcgccacugcacuccagccugggcgacagag

SEQ ID NO: 387719 - RNA, 32 nt, Human
cgcgccacugcacuccagccugggcgacagca

SEQ ID NO: 387720 - RNA, 32 nt, Human
cgcgccacugcacuccagccugggcgacagcg

SEQ ID NO: 387721 - RNA, 32 nt, Human
cgcgccacugcacuccagccugggcgacaggg

SEQ ID NO: 387722 - RNA, 32 nt, Human
cgcgccacugcacuccagccugggcgacggag

SEQ ID NO: 387723 - RNA, 32 nt, Human
cgcgccacugcacuccagccugggcgagagaa

SEQ ID NO: 387724 - RNA, 32 nt, Human
cgcgccacugcacuccagccugggcgauagag

SEQ ID NO: 387725 - RNA, 32 nt, Human
cgcgccacugcacuccagccuggguaacagag

SEQ ID NO: 387726 - RNA, 32 nt, Human
cgcgccacugcacuccagccugggugacacag

SEQ ID NO: 387727 - RNA, 32 nt, Human
cgcgccacugcacuccagccugggugacagaa

SEQ ID NO: 387728 - RNA, 32 nt, Human
cgcgccacugcacuccagccugggugacagag

SEQ ID NO: 387729 - RNA, 32 nt, Human
cgcgccacugcacuccagccugggugauagag

SEQ ID NO: 387730 - RNA, 32 nt, Human
cgcgccacugcacuccagccuggugacagagc

SEQ ID NO: 387731 - RNA, 32 nt, Human
cgcgccacugcacuccagcuugggcaacagag

SEQ ID NO: 387732 - RNA, 32 nt, Human
cgcgccacugcacuccaggccugggugacagu

SEQ ID NO: 387733 - RNA, 32 nt, Human
cgcgccacugcacuccaggcugggcaacggag

SEQ ID NO: 387734 - RNA, 32 nt, Human
cgcgccacugcacuccaggcugggcgacagag

SEQ ID NO: 387735 - RNA, 32 nt, Human
cgcgccacugcacuccagucugggcaacagag

SEQ ID NO: 387736 - RNA, 32 nt, Human
cgcgccacugcacuccaguuugggcaacagaa

SEQ ID NO: 387737 - RNA, 32 nt, Human
cgcgccacugcacuccggccugaugacagagc

SEQ ID NO: 387738 - RNA, 32 nt, Human
cgcgccacugcacuccugccugggacacaaug

SEQ ID NO: 387739 - RNA, 32 nt, Human
cgcgccacugcacuccugccugggcaacugag

SEQ ID NO: 387740 - RNA, 32 nt, Human
cgcgccacugcacucuagccggagugacagag

SEQ ID NO: 387741 - RNA, 32 nt, Human
cgcgccacugcacucuagccugagugacagag

SEQ ID NO: 387742 - RNA, 32 nt, Human
cgcgccacugcacucuagccugggccauagag

SEQ ID NO: 387743 - RNA, 32 nt, Human
cgcgccacugcacucuagccugggugacagag

SEQ ID NO: 387744 - RNA, 32 nt, Human
cgcgccacugcacuucagccuggacaacagag

SEQ ID NO: 387745 - RNA, 32 nt, Human
cgcgccacugcacuucagccugggugacagag

SEQ ID NO: 387746 - RNA, 32 nt, Human
cgcgccacugcaguccagccugggcaacaaga

SEQ ID NO: 387747 - RNA, 32 nt, Human
cgcgccacugcauuccagccuggacgacagag

SEQ ID NO: 387748 - RNA, 32 nt, Human
cgcgccacugcccuccagccugggcgacagaa

SEQ ID NO: 387749 - RNA, 32 nt, Human
cgcgccacugcgcuccagccuggacaacacag

SEQ ID NO: 387750 - RNA, 32 nt, Human
cgcgccacugcgcuucagccugggagacagag

SEQ ID NO: 387751 - RNA, 32 nt, Human
cgcgccacugcucuccagccuggguggcagag

SEQ ID NO: 387752 - RNA, 32 nt, Human
cgcgccacuggacuccagccuggacaacagag

SEQ ID NO: 387753 - RNA, 32 nt, Human
cgcgccacugggcuccagccugggcgacagag

SEQ ID NO: 387754 - RNA, 32 nt, Human
cgcgccacuguacuccagccuggacaacagcg

SEQ ID NO: 387755 - RNA, 32 nt, Human
cgcgccacuguacuccagccugggcaacagag

SEQ ID NO: 387756 - RNA, 32 nt, Human
cgcgccacuguacuccagccugggugacagag

SEQ ID NO: 387757 - RNA, 32 nt, Human
cgcgccacuguacuccauccugggugauggag

SEQ ID NO: 387758 - RNA, 32 nt, Human
cgcgccacugugcuccagccugggcaacagag

SEQ ID NO: 387759 - RNA, 25 nt, Human
cgcgccaggcaggacgacagcagca

SEQ ID NO: 387760 - RNA, 25 nt, Human
cgcgccaggcaggacgacggcagca

SEQ ID NO: 387761 - RNA, 32 nt, Human
cgcgccagggagguugucgggaggggccggcg

SEQ ID NO: 387762 - RNA, 32 nt, Human
cgcgccaguacacuccagccuggguaacagag

SEQ ID NO: 387763 - RNA, 32 nt, Human
cgcgccagugcacuccagccugggcaagaaga

SEQ ID NO: 387764 - RNA, 32 nt, Human
cgcgccagugcugugcggucuccacacccuua

SEQ ID NO: 387765 - RNA, 32 nt, Human
cgcgccauagcacuccagccuuagccugggcg

SEQ ID NO: 387766 - RNA, 32 nt, Human
cgcgccaucacacuccagccuaggcgacagag

SEQ ID NO: 387767 - RNA, 32 nt, Human
cgcgccauccuuucucuuccuccucucuguaa

SEQ ID NO: 387768 - RNA, 32 nt, Human
cgcgccaucgcacuccagccugggcaacaaga

SEQ ID NO: 387769 - RNA, 32 nt, Human
cgcgccaucgcacuccagccugggugacaaga

SEQ ID NO: 387770 - RNA, 31 nt, Human
cgcgccaugcuggccaaguugcugugcgacc

SEQ ID NO: 387771 - RNA, 32 nt, Human
cgcgccauggcacucacuccagccugggcaac

SEQ ID NO: 387772 - RNA, 32 nt, Human
cgcgccauuacacuucagccugggcaacaaga

SEQ ID NO: 387773 - RNA, 32 nt, Human
cgcgccauugcacuccaaccuaggugacaaag

SEQ ID NO: 387774 - RNA, 32 nt, Human
cgcgccauugcacuccaaccuggacgacagag

SEQ ID NO: 387775 - RNA, 32 nt, Human
cgcgccauugcacuccagccuggacaacaaga

SEQ ID NO: 387776 - RNA, 32 nt, Human
cgcgccauugcacuccagccuggccuauaaga

SEQ ID NO: 387777 - RNA, 32 nt, Human
cgcgccauugcacuccagccuggcugacagag

SEQ ID NO: 387778 - RNA, 32 nt, Human
cgcgccauugcacuccagccugggcaacaaca

SEQ ID NO: 387779 - RNA, 32 nt, Human
cgcgccauugcacuccagccugggcaacaaga

SEQ ID NO: 387780 - RNA, 32 nt, Human
cgcgccauugcacuccagccugggcaacgaaa

SEQ ID NO: 387781 - RNA, 32 nt, Human
cgcgccauugcacuccagccugggcaacuccg

SEQ ID NO: 387782 - RNA, 32 nt, Human
cgcgccauugcacuccagccugggcgacaaga

SEQ ID NO: 387783 - RNA, 32 nt, Human
cgcgccauugcacuccagccugggcgacagag

SEQ ID NO: 387784 - RNA, 32 nt, Human
cgcgccauugcacuccagccugggcggcagag

SEQ ID NO: 387785 - RNA, 32 nt, Human
cgcgccauugcacuccagccugggggacaaga

SEQ ID NO: 387786 - RNA, 32 nt, Human
cgcgccauugcacuccagccuggguaacaaga

SEQ ID NO: 387787 - RNA, 32 nt, Human
cgcgccauugcacuccagccugggugacagag

SEQ ID NO: 387788 - RNA, 32 nt, Human
cgcgccauugcacuccagccugggugacgagu

SEQ ID NO: 387789 - RNA, 32 nt, Human
cgcgccauugcacuccagccuuggaacaagag

SEQ ID NO: 387790 - RNA, 32 nt, Human
cgcgccauugcacuccauccuggacaacagga

SEQ ID NO: 387791 - RNA, 32 nt, Human
cgcgccauugcacucccgccugggcgacucca

SEQ ID NO: 387792 - RNA, 32 nt, Human
cgcgccauugcacuccggccuggggacaagag

SEQ ID NO: 387793 - RNA, 32 nt, Human
cgcgccauugcacucuagccuaggugacagag

SEQ ID NO: 387794 - RNA, 32 nt, Human
cgcgccauugcacucuagccugggcaacaaga

SEQ ID NO: 387795 - RNA, 32 nt, Human
cgcgccauugcauuccaaccugggggacaaca

SEQ ID NO: 387796 - RNA, 32 nt, Human
cgcgccauuguacuccagccugggcgaugagc

SEQ ID NO: 387797 - RNA, 32 nt, Human
cgcgcccacuggccggucucuccucuuccccg

SEQ ID NO: 387798 - RNA, 32 nt, Human
cgcgcccauccagcagccucgccggagccaca

SEQ ID NO: 387799 - RNA, 32 nt, Human
cgcgcccaugcaggccaucaagugcguggugg

SEQ ID NO: 387800 - RNA, 32 nt, Human
cgcgccccaggugggcagcuguggcagagcag

SEQ ID NO: 387801 - RNA, 32 nt, Human
cgcgcccccagcugcccuuuccaacugccugu

SEQ ID NO: 387802 - RNA, 32 nt, Human
cgcgcccccaggagaccuggaccagaccacga

SEQ ID NO: 387803 - RNA, 32 nt, Human
cgcgcccccgugcccccaggcccagccgccgc

SEQ ID NO: 387804 - RNA, 19 nt, Human
cgcgcccccuuggcccgcg

SEQ ID NO: 387805 - RNA, 32 nt, Human
cgcgccccgagugagcaguccuggcccggagc

SEQ ID NO: 387806 - RNA, 32 nt, Human
cgcgccccgcuccccuucucucucuuacucgg

SEQ ID NO: 387807 - RNA, 22 nt, Human
cgcgccccggcggcgucauggg

SEQ ID NO: 387808 - RNA, 32 nt, Human
cgcgccccuccccucacgggcucuggccuuaa

SEQ ID NO: 387809 - RNA, 32 nt, Human
cgcgccccugcacuccagccugggugacagag

SEQ ID NO: 387810 - RNA, 32 nt, Human
cgcgccccugcuccccuggguggccuuccggg

SEQ ID NO: 387811 - RNA, 32 nt, Human
cgcgcccgaucccggcgacagggcgggcggac

SEQ ID NO: 387812 - RNA, 18 nt, Human
cgcgcccgcgccugcuca

SEQ ID NO: 387813 - RNA, 22 nt, Human
cgcgcccguuccugccuggccg

SEQ ID NO: 387814 - RNA, 32 nt, Human
cgcgcccuccccucuccuuucucccucucaga

SEQ ID NO: 387815 - RNA, 32 nt, Human
cgcgcccucggcuccguuucugcucccuccac

SEQ ID NO: 387816 - RNA, 32 nt, Human
cgcgcccucucccaguccucacaaaggggccu

SEQ ID NO: 387817 - RNA, 32 nt, Human
cgcgcccucuccuucuugugccuugaguggca

SEQ ID NO: 387818 - RNA, 32 nt, Human
cgcgcccugcaugcgaguugggccgcgggcgg

SEQ ID NO: 387819 - RNA, 32 nt, Human
cgcgcccugccucuguggcucugccuguggau

SEQ ID NO: 387820 - RNA, 32 nt, Human
cgcgcccugccugguccggcacuucuuccgcg

SEQ ID NO: 387821 - RNA, 32 nt, Human
cgcgcccuuggaccaggggagcggugcgauuc

SEQ ID NO: 387822 - RNA, 32 nt, Human
cgcgccgagccgcggccgagcuggcccgcccg

SEQ ID NO: 387823 - RNA, 17 nt, Human
cgcgccgcccgggcccu

SEQ ID NO: 387824 - RNA, 32 nt, Human
cgcgccgcccucucaccccucccuucacccac

SEQ ID NO: 387825 - RNA, 22 nt, Human
cgcgccgccgccgccgccgccg

SEQ ID NO: 387826 - RNA, 32 nt, Human
cgcgccgccgccgccucccgcccgccccggag

SEQ ID NO: 387827 - RNA, 32 nt, Human
cgcgccgccggccucugccgcgaacaaacccu

SEQ ID NO: 387828 - RNA, 32 nt, Human
cgcgccgccuacuccggcaucagcuccguggc

SEQ ID NO: 387829 - RNA, 32 nt, Human
cgcgccgccucgcuagccgaaaccugcccagc

SEQ ID NO: 387830 - RNA, 32 nt, Human
cgcgccgcgccgccugaaccugggcgggggcu

SEQ ID NO: 387831 - RNA, 32 nt, Human
cgcgccgcggccgccuccuccuccccggcucc

SEQ ID NO: 387832 - RNA, 18 nt, Human
cgcgccgcucaggcgucu

SEQ ID NO: 387833 - RNA, 18 nt, Human
cgcgccgcuccgcuccgg

SEQ ID NO: 387834 - RNA, 32 nt, Human
cgcgccgcugcacuccagccugggccacacag

SEQ ID NO: 387835 - RNA, 32 nt, Human
cgcgccgcugcacuccagccugggcgacagag

SEQ ID NO: 387836 - RNA, 32 nt, Human
cgcgccgcugcacuccagccugggcggcagag

SEQ ID NO: 387837 - RNA, 32 nt, Human
cgcgccgcugcacuccagccugggugacagag

SEQ ID NO: 387838 - RNA, 32 nt, Human
cgcgccgcugcauuccagccugggugacagag

SEQ ID NO: 387839 - RNA, 22 nt, Human
cgcgccgcuugccgccgggcua

SEQ ID NO: 387840 - RNA, 19 nt, Human
cgcgccggccccccagggg

SEQ ID NO: 387841 - RNA, 32 nt, Human
cgcgccggcccgcgcccugcccagugcggccu

SEQ ID NO: 387842 - RNA, 32 nt, Human
cgcgccgggagguggugaccgccugacagaca

SEQ ID NO: 387843 - RNA, 32 nt, Human
cgcgccgggccaguguccucugugcugcuggc

SEQ ID NO: 387844 - RNA, 32 nt, Human
cgcgccgggcuucuccaugacagcugcggccc

SEQ ID NO: 387845 - RNA, 24 nt, Human
cgcgccggggacccucuccaggcc

SEQ ID NO: 387846 - RNA, 32 nt, Human
cgcgccggggcucugggugugugcgcuuggcg

SEQ ID NO: 387847 - RNA, 26 nt, Human
cgcgccggucuuccccugacaugcgu

SEQ ID NO: 387848 - RNA, 25 nt, Human
cgcgccgucucccuccuccagggcc

SEQ ID NO: 387849 - RNA, 32 nt, Human
cgcgccgugauaucuugguggcucccugccac

SEQ ID NO: 387850 - RNA, 20 nt, Human
cgcgccguggugcgcacgga

SEQ ID NO: 387851 - RNA, 32 nt, Human
cgcgccguugcacuccagccugggcaacaaga

SEQ ID NO: 387852 - RNA, 32 nt, Human
cgcgccucaaacuguugacucacuggagggac

SEQ ID NO: 387853 - RNA, 17 nt, Human
cgcgccuccccugggug

SEQ ID NO: 387854 - RNA, 32 nt, Human
cgcgccucccugcacacgcacacacacgcaca

SEQ ID NO: 387855 - RNA, 32 nt, Human
cgcgccuccuggccaggcagggcgccugggag

SEQ ID NO: 387856 - RNA, 32 nt, Human
cgcgccucucugaggcggaggaugcgggagcg

SEQ ID NO: 387857 - RNA, 32 nt, Human
cgcgccugaaggagcaggaaggggaaggaggc

SEQ ID NO: 387858 - RNA, 32 nt, Human
cgcgccugaggaggaggaggaggcgggggcgg

SEQ ID NO: 387859 - RNA, 22 nt, Human
cgcgccugcaacggugcgcgga

SEQ ID NO: 387860 - RNA, 32 nt, Human
cgcgccugccaaggaggccaccagagggcagu

SEQ ID NO: 387861 - RNA, 32 nt, Human
cgcgccugccuguucccuccagcccggacccc

SEQ ID NO: 387862 - RNA, 32 nt, Human
cgcgccugcggggcggagaugggcagggggcg

SEQ ID NO: 387863 - RNA, 32 nt, Human
cgcgccuggcacaaccucacugugcuggcuac

SEQ ID NO: 387864 - RNA, 32 nt, Human
cgcgccuggccgccgccucccuuuaccuccgg

SEQ ID NO: 387865 - RNA, 32 nt, Human
cgcgccugggagggagaaagaagucgggggcc

SEQ ID NO: 387866 - RNA, 32 nt, Human
cgcgccuggggaggaggcggaggcagcggcug

SEQ ID NO: 387867 - RNA, 32 nt, Human
cgcgccuguaaucccagcuacucgggaagcug

SEQ ID NO: 387868 - RNA, 32 nt, Human
cgcgccuguaaucccagcuacucgggaggcug

SEQ ID NO: 387869 - RNA, 32 nt, Human
cgcgccuguaaucccagcuacuugggaagcug

SEQ ID NO: 387870 - RNA, 32 nt, Human
cgcgccuguaaucccagcuacuugggaggcug

SEQ ID NO: 387871 - RNA, 32 nt, Human
cgcgccuguaaucccagcuauucgggaggcug

SEQ ID NO: 387872 - RNA, 32 nt, Human
cgcgccuguagcugggacuacaagagugcgcc

SEQ ID NO: 387873 - RNA, 32 nt, Human
cgcgccuguagucccagcuacacgggaggcug

SEQ ID NO: 387874 - RNA, 32 nt, Human
cgcgccuguagucccagcuacucaggaggcug

SEQ ID NO: 387875 - RNA, 32 nt, Human
cgcgccuguagucccagcuacucgggaggcug

SEQ ID NO: 387876 - RNA, 32 nt, Human
cgcgccuguagucccagcuacuugggaggcug

SEQ ID NO: 387877 - RNA, 32 nt, Human
cgcgccuguagucccagcuccucaggaggcug

SEQ ID NO: 387878 - RNA, 32 nt, Human
cgcgccuguagucccagcugcucaggaggcug

SEQ ID NO: 387879 - RNA, 32 nt, Human
cgcgccuguggucccagcuacucgggaggcug

SEQ ID NO: 387880 - RNA, 32 nt, Human
cgcgccuucuccaggaauaggcgagaaucuca

SEQ ID NO: 387881 - RNA, 32 nt, Human
cgcgccuuucgcacugccaccauuccauccug

SEQ ID NO: 387882 - RNA, 32 nt, Human
cgcgccuuugcacuccagccuggaagacaaaa

SEQ ID NO: 387883 - RNA, 32 nt, Human
cgcgcgaggucccuccucuccgggcguccgug

SEQ ID NO: 387884 - RNA, 17 nt, Human
cgcgcgcccaggcgccu

SEQ ID NO: 387885 - RNA, 17 nt, Human
cgcgcgcccccgggccc

SEQ ID NO: 387886 - RNA, 18 nt, Human
cgcgcgccccgggagccu

SEQ ID NO: 387887 - RNA, 32 nt, Human
cgcgcggacuccugccccgaggguccggacgc

SEQ ID NO: 387888 - RNA, 32 nt, Human
cgcgcggagagggguggcgggcccgacagcgg

SEQ ID NO: 387889 - RNA, 32 nt, Human
cgcgcggaggggcgggggaggcgccgggaagu

SEQ ID NO: 387890 - RNA, 32 nt, Human
cgcgcggagucacccagucacacucccggcac

SEQ ID NO: 387891 - RNA, 32 nt, Human
cgcgcggcacagccaugaacaccaacgaugcc

SEQ ID NO: 387892 - RNA, 32 nt, Human
cgcgcggcagccgccugaagccccggccuggc

SEQ ID NO: 387893 - RNA, 24 nt, Human
cgcgcggccaagaauuuauuuggg

SEQ ID NO: 387894 - RNA, 27 nt, Human
cgcgcggccacaccccucccccagggg

SEQ ID NO: 387895 - RNA, 32 nt, Human
cgcgcggccccuguccuccggcccgagaugaa

SEQ ID NO: 387896 - RNA, 26 nt, Human
cgcgcggccucacccuuuccccaggg

SEQ ID NO: 387897 - RNA, 20 nt, Human
cgcgcggcuuccuccagacc

SEQ ID NO: 387898 - RNA, 32 nt, Human
cgcgcgggcaucaucccuaccagauugagugu

SEQ ID NO: 387899 - RNA, 32 nt, Human
cgcgcgggccguggccagagucuggcggcggc

SEQ ID NO: 387900 - RNA, 32 nt, Human
cgcgcggggaagggaagaagaggacgaggugg

SEQ ID NO: 387901 - RNA, 24 nt, Human
cgcgcgguaaugaauuuauuugga

SEQ ID NO: 387902 - RNA, 32 nt, Human
cgcgcgguugcuguuucuucucuggcuccggg

SEQ ID NO: 387903 - RNA, 19 nt, Human
cgcgcguacucggccgccu

SEQ ID NO: 387904 - RNA, 32 nt, Human
cgcgcguccggggcacguuccagggcgcgcgg

SEQ ID NO: 387905 - RNA, 32 nt, Human
cgcgcgucggagaggcuccugggaaacuccca

SEQ ID NO: 387906 - RNA, 32 nt, Human
cgcgcgucugcugcagagaccaugucugccga

SEQ ID NO: 387907 - RNA, 32 nt, Human
cgcgcgugucuucucuucuuuccagagauggc

SEQ ID NO: 387908 - RNA, 32 nt, Human
cgcgcuacugcacuccagccugggcgacagag

SEQ ID NO: 387909 - RNA, 32 nt, Human
cgcgcuacugcacuccagccugggugacagug

SEQ ID NO: 387910 - RNA, 32 nt, Human
cgcgcuacugcagcuuucuuccgccuuaggaa

SEQ ID NO: 387911 - RNA, 32 nt, Human
cgcgcuacugcauuccagccugggcgccgaga

SEQ ID NO: 387912 - RNA, 32 nt, Human
cgcgcuauugcacuccagccugggugacagag

SEQ ID NO: 387913 - RNA, 32 nt, Human
cgcgcucaggaggucaagaccagccugggcaa

SEQ ID NO: 387914 - RNA, 32 nt, Human
cgcgcucccaggagaguggaggcugcaggaag

SEQ ID NO: 387915 - RNA, 20 nt, Human
cgcgcuccgccccugcugcc

SEQ ID NO: 387916 - RNA, 32 nt, Human
cgcgcucgccucaguguggaaucaccuccgcg

SEQ ID NO: 387917 - RNA, 32 nt, Human
cgcgcucucacugcagccugugcccaaccccg

SEQ ID NO: 387918 - RNA, 32 nt, Human
cgcgcucuccaccacccaacccaaaccaugag

SEQ ID NO: 387919 - RNA, 32 nt, Human
cgcgcucuccggccuagacuggcugaaggagg

SEQ ID NO: 387920 - RNA, 32 nt, Human
cgcgcucugcaugcuccucugccugugcccgc

SEQ ID NO: 387921 - RNA, 32 nt, Human
cgcgcucugcucccugccuuugccucacuuua

SEQ ID NO: 387922 - RNA, 32 nt, Human
cgcgcugccggggcgagguugcgaggggcggu

SEQ ID NO: 387923 - RNA, 32 nt, Human
cgcgcugcgccuggggcugcugggcagccugg

SEQ ID NO: 387924 - RNA, 32 nt, Human
cgcgcugcucagcaggacacgugaacacccag

SEQ ID NO: 387925 - RNA, 32 nt, Human
cgcgcugcugcacuccagccugggugacagag

SEQ ID NO: 387926 - RNA, 32 nt, Human
cgcgcugcugcuccagccgcccggcagcucug

SEQ ID NO: 387927 - RNA, 32 nt, Human
cgcgcugcugcugcccguguacgcgcugggcu

SEQ ID NO: 387928 - RNA, 32 nt, Human
cgcgcugcuucuggcccugcagguuguguucc

SEQ ID NO: 387929 - RNA, 20 nt, Human
cgcgcugcuugccuuggcca

SEQ ID NO: 387930 - RNA, 20 nt, Human
cgcgcuggacccggcuaugc

SEQ ID NO: 387931 - RNA, 32 nt, Human
cgcgcuggagcuugcgaggagcgcagggugga

SEQ ID NO: 387932 - RNA, 32 nt, Human
cgcgcuggcccugccacuccagccuggccuca

SEQ ID NO: 387933 - RNA, 32 nt, Human
cgcgcuggcucacgccuguaaucccagcacuu

SEQ ID NO: 387934 - RNA, 17 nt, Human
cgcgcuggcuccgggug

SEQ ID NO: 387935 - RNA, 32 nt, Human
cgcgcugggcggggcuggaugggcuguggugg

SEQ ID NO: 387936 - RNA, 32 nt, Human
cgcgcugucgcccaggcuggagcgcaauggcg

SEQ ID NO: 387937 - RNA, 32 nt, Human
cgcgcugugcugccugucuucgcgccacuguu

SEQ ID NO: 387938 - RNA, 32 nt, Human
cgcgcuguugcccaggcuggagugcaguggcg

SEQ ID NO: 387939 - RNA, 32 nt, Human
cgcgcuuaggcaggcgguggcgcggcuggagu

SEQ ID NO: 387940 - RNA, 32 nt, Human
cgcgcuuccugcguccccaacccggucccuga

SEQ ID NO: 387941 - RNA, 32 nt, Human
cgcgcuucugggcucuaaccugggagacucgc

SEQ ID NO: 387942 - RNA, 32 nt, Human
cgcgcuuggcugcuuauaacuguacuagggcg

SEQ ID NO: 387943 - RNA, 32 nt, Human
cgcgcuuuccaaauuucuuaggcauuuauuuu

SEQ ID NO: 387944 - RNA, 32 nt, Human
cgcgcuuugcaccuccuauccccaggguccgc

SEQ ID NO: 387945 - RNA, 32 nt, Human
cgcgcuuugggaacaggaagguugagagagag

SEQ ID NO: 387946 - RNA, 32 nt, Human
cgcggaaaagccugaugaaguccuccgauauu

SEQ ID NO: 387947 - RNA, 32 nt, Human
cgcggaaagcagccucggggaaggaggaggaa

SEQ ID NO: 387948 - RNA, 32 nt, Human
cgcggaaagccgauggccuacucucguccggc

SEQ ID NO: 387949 - RNA, 18 nt, Human
cgcggaaagcggcucccc

SEQ ID NO: 387950 - RNA, 32 nt, Human
cgcggaacucggcggccgccauggcguccaac

SEQ ID NO: 387951 - RNA, 23 nt, Human
cgcggaagacgggcggcgcgugg

SEQ ID NO: 387952 - RNA, 32 nt, Human
cgcggaagagcagaacguuugggagugugcag

SEQ ID NO: 387953 - RNA, 32 nt, Human
cgcggaaggaccgggaaggaagagcggagccg

SEQ ID NO: 387954 - RNA, 32 nt, Human
cgcggaauauugaaggauguuuguuccaagau

SEQ ID NO: 387955 - RNA, 32 nt, Human
cgcggacaguaccgccuuccuccccucugucc

SEQ ID NO: 387956 - RNA, 32 nt, Human
cgcggacccacgcuuugucgggcugcucugcu

SEQ ID NO: 387957 - RNA, 23 nt, Human
cgcggacccgccuucugcccuca

SEQ ID NO: 387958 - RNA, 32 nt, Human
cgcggacccgcgugccccaggccucgcgcugc

SEQ ID NO: 387959 - RNA, 32 nt, Human
cgcggaccgcuucccugcagugccccgagucc

SEQ ID NO: 387960 - RNA, 32 nt, Human
cgcggacgaaggggugccugagcuguggagag

SEQ ID NO: 387961 - RNA, 32 nt, Human
cgcggacuaugacugcaggcuggguccugauc

SEQ ID NO: 387962 - RNA, 32 nt, Human
cgcggacucugccagccccagcuucagccccg

SEQ ID NO: 387963 - RNA, 32 nt, Human
cgcggacugccugggcuuagccagcgagcuac

SEQ ID NO: 387964 - RNA, 32 nt, Human
cgcggagaacagugggguuacagggagucauc

SEQ ID NO: 387965 - RNA, 32 nt, Human
cgcggagaacuccuaaggaggagauuggacag

SEQ ID NO: 387966 - RNA, 32 nt, Human
cgcggagaggagcggcgggagagccaggaggg

SEQ ID NO: 387967 - RNA, 32 nt, Human
cgcggagcagggagagaaaaagcagguaggga

SEQ ID NO: 387968 - RNA, 32 nt, Human
cgcggagccccggccgcugccucccgggacag

SEQ ID NO: 387969 - RNA, 32 nt, Human
cgcggagcccgcagcuggccagcuucagccac

SEQ ID NO: 387970 - RNA, 19 nt, Human
cgcggagcgggagagcggc

SEQ ID NO: 387971 - RNA, 32 nt, Human
cgcggaggagacugcauuucccaguagcagau

SEQ ID NO: 387972 - RNA, 32 nt, Human
cgcggaggaggaagaggguagacaggggcgac

SEQ ID NO: 387973 - RNA, 32 nt, Human
cgcggaggaggaggaucugggggaagaggagg

SEQ ID NO: 387974 - RNA, 32 nt, Human
cgcggaggcggaugggcgcggcucccuccccc

SEQ ID NO: 387975 - RNA, 32 nt, Human
cgcggaggcucacgccuguaaucccagcccuu

SEQ ID NO: 387976 - RNA, 32 nt, Human
cgcggaggcuggagccgcaauggugcugaugg

SEQ ID NO: 387977 - RNA, 32 nt, Human
cgcggaggcuuggugugccagguccgagccuc

SEQ ID NO: 387978 - RNA, 32 nt, Human
cgcggagggaggcggaggcugugagggacucc

SEQ ID NO: 387979 - RNA, 32 nt, Human
cgcggagggagggagagucugggccgcgcggg

SEQ ID NO: 387980 - RNA, 32 nt, Human
cgcggagggcgcgggcccgggagccagggagc

SEQ ID NO: 387981 - RNA, 20 nt, Human
cgcggaggucgcccggggug

SEQ ID NO: 387982 - RNA, 32 nt, Human
cgcggaguccacccugccgucuccgccuuggc

SEQ ID NO: 387983 - RNA, 32 nt, Human
cgcggaguucagugccacgugccugaauuuca

SEQ ID NO: 387984 - RNA, 32 nt, Human
cgcggaucaaccaggcagaguucuguggcgcc

SEQ ID NO: 387985 - RNA, 32 nt, Human
cgcggaucucagaacagucuuugucagauggg

SEQ ID NO: 387986 - RNA, 32 nt, Human
cgcggauuguagaugaagaaacucagcagcgc

SEQ ID NO: 387987 - RNA, 32 nt, Human
cgcggcagaaaccucuguagaggagcaggaug

SEQ ID NO: 387988 - RNA, 19 nt, Human
cgcggcagcacccggggca

SEQ ID NO: 387989 - RNA, 32 nt, Human
cgcggcagcagauguguguggggucagcccac

SEQ ID NO: 387990 - RNA, 32 nt, Human
cgcggcagccgaacaaaggagcaggggcgccg

SEQ ID NO: 387991 - RNA, 17 nt, Human
cgcggcagccuccgggu

SEQ ID NO: 387992 - RNA, 32 nt, Human
cgcggcaggaggacgaggcagggcgggcgggc

SEQ ID NO: 387993 - RNA, 32 nt, Human
cgcggcaucccccugcccauccagaccuuccu

SEQ ID NO: 387994 - RNA, 32 nt, Human
cgcggcauugcacuucagccugggcgauagag

SEQ ID NO: 387995 - RNA, 32 nt, Human
cgcggccaccggcgggagugcagcggccacug

SEQ ID NO: 387996 - RNA, 23 nt, Human
cgcggccacgccggcgcggcggg

SEQ ID NO: 387997 - RNA, 32 nt, Human
cgcggccacucgggggagacgguaguacacgg

SEQ ID NO: 387998 - RNA, 32 nt, Human
cgcggccacugcagucacuucgccaguuagcc

SEQ ID NO: 387999 - RNA, 18 nt, Human
cgcggccagccccacgug

SEQ ID NO: 388000 - RNA, 32 nt, Human
cgcggccauggacugagcgccgccggccaggc

SEQ ID NO: 388001 - RNA, 32 nt, Human
cgcggccauggcgggcccugagggcuuccagu

SEQ ID NO: 388002 - RNA, 32 nt, Human
cgcggccaugucugggccaggcaacaaacgcg

SEQ ID NO: 388003 - RNA, 32 nt, Human
cgcggccauuucagccccaucuuggcccagcg

SEQ ID NO: 388004 - RNA, 20 nt, Human
cgcggcccacaagcaucccc

SEQ ID NO: 388005 - RNA, 21 nt, Human
cgcggcccagcucccuggagc

SEQ ID NO: 388006 - RNA, 18 nt, Human
cgcggccccagcgccagg

SEQ ID NO: 388007 - RNA, 20 nt, Human
cgcggccccaggcggggcgg

SEQ ID NO: 388008 - RNA, 18 nt, Human
cgcggccccggcugcgag

SEQ ID NO: 388009 - RNA, 32 nt, Human
cgcggccccuacucccugucaggucguagagg

SEQ ID NO: 388010 - RNA, 24 nt, Human
cgcggcccgaggaggcggcggagg

SEQ ID NO: 388011 - RNA, 23 nt, Human
cgcggcccgccgaggcucggagc

SEQ ID NO: 388012 - RNA, 20 nt, Human
cgcggcccggaggcgcgggg

SEQ ID NO: 388013 - RNA, 32 nt, Human
cgcggcccggccggcaguugcaguguagacag

SEQ ID NO: 388014 - RNA, 19 nt, Human
cgcggcccgggcgcgcgcg

SEQ ID NO: 388015 - RNA, 23 nt, Human
cgcggcccggggacuugcacggg

SEQ ID NO: 388016 - RNA, 26 nt, Human
cgcggcccggugagggcgcgcgcggg

SEQ ID NO: 388017 - RNA, 32 nt, Human
cgcggcccuccccucgcucaugcccucccgcc

SEQ ID NO: 388018 - RNA, 32 nt, Human
cgcggcccugcugccaccuugaucucagacuu

SEQ ID NO: 388019 - RNA, 32 nt, Human
cgcggcccugggagcuggaggaaccgcgacuc

SEQ ID NO: 388020 - RNA, 32 nt, Human
cgcggcccuguuccagccugucucggcaccca

SEQ ID NO: 388021 - RNA, 20 nt, Human
cgcggcccuucucggcgagg

SEQ ID NO: 388022 - RNA, 20 nt, Human
cgcggccgagccggcgcggg

SEQ ID NO: 388023 - RNA, 32 nt, Human
cgcggccgagcugccaucagucaugcucuuaa

SEQ ID NO: 388024 - RNA, 32 nt, Human
cgcggccgcaaugaacugggagcugcugcugu

SEQ ID NO: 388025 - RNA, 24 nt, Human
cgcggccgcagcagcaccgggcgg

SEQ ID NO: 388026 - RNA, 21 nt, Human
cgcggccgcagcccgcgugga

SEQ ID NO: 388027 - RNA, 24 nt, Human
cgcggccgcagcgucggggcugga

SEQ ID NO: 388028 - RNA, 22 nt, Human
cgcggccgcagggagcgccgga

SEQ ID NO: 388029 - RNA, 22 nt, Human
cgcggccgcccgggccugcggg

SEQ ID NO: 388030 - RNA, 19 nt, Human
cgcggccgccgcgugcgcg

SEQ ID NO: 388031 - RNA, 24 nt, Human
cgcggccgccggacgcagcgcggg

SEQ ID NO: 388032 - RNA, 21 nt, Human
cgcggccgcggaugagccggg

SEQ ID NO: 388033 - RNA, 22 nt, Human
cgcggccgcggcgcgagccggg

SEQ ID NO: 388034 - RNA, 24 nt, Human
cgcggccgcggcggcggcgggcgg

SEQ ID NO: 388035 - RNA, 24 nt, Human
cgcggccgcgggucacccggcggg

SEQ ID NO: 388036 - RNA, 24 nt, Human
cgcggccgcggucccagcagcgga

SEQ ID NO: 388037 - RNA, 24 nt, Human
cgcggccgcggugggcacgcacgg

SEQ ID NO: 388038 - RNA, 32 nt, Human
cgcggccggaggcagaggccaggcgagacacc

SEQ ID NO: 388039 - RNA, 23 nt, Human
cgcggccggcgggcggcgggagg

SEQ ID NO: 388040 - RNA, 20 nt, Human
cgcggccgggccagcggagg

SEQ ID NO: 388041 - RNA, 19 nt, Human
cgcggccggggcagcgagg

SEQ ID NO: 388042 - RNA, 21 nt, Human
cgcggccggggcgcgcggggg

SEQ ID NO: 388043 - RNA, 24 nt, Human
cgcggccggggggcggugcgcgga

SEQ ID NO: 388044 - RNA, 21 nt, Human
cgcggccguggcaccgcugga

SEQ ID NO: 388045 - RNA, 32 nt, Human
cgcggccucuggagcugggauuugggaggaca

SEQ ID NO: 388046 - RNA, 32 nt, Human
cgcggccugagccccuccaccugcugcaauca

SEQ ID NO: 388047 - RNA, 32 nt, Human
cgcggccugagcccggcgaggguggggagggc

SEQ ID NO: 388048 - RNA, 32 nt, Human
cgcggccugcagcccucgcccgcguccccggc

SEQ ID NO: 388049 - RNA, 32 nt, Human
cgcggccugcgaugacagcccagggccgcuga

SEQ ID NO: 388050 - RNA, 32 nt, Human
cgcggccuggaggacgaggaggacggggugcc

SEQ ID NO: 388051 - RNA, 32 nt, Human
cgcggccuuccuccucccugcuccagaauucu

SEQ ID NO: 388052 - RNA, 32 nt, Human
cgcggccuuccuggugacggagcugcuccccc

SEQ ID NO: 388053 - RNA, 32 nt, Human
cgcggccuugggagcaugucacuguguacagc

SEQ ID NO: 388054 - RNA, 32 nt, Human
cgcggcgaaaccagccuugucauuucagcauu

SEQ ID NO: 388055 - RNA, 32 nt, Human
cgcggcgaggccgucggagaaaacuuaagcgu

SEQ ID NO: 388056 - RNA, 32 nt, Human
cgcggcgaugaggugguccugaggcagaagcc

SEQ ID NO: 388057 - RNA, 22 nt, Human
cgcggcgcagcggcccgaggca

SEQ ID NO: 388058 - RNA, 18 nt, Human
cgcggcgccgcccgggug

SEQ ID NO: 388059 - RNA, 23 nt, Human
cgcggcgccgcgccuccccgggc

SEQ ID NO: 388060 - RNA, 32 nt, Human
cgcggcgccuccucagagagcccgggucagcu

SEQ ID NO: 388061 - RNA, 32 nt, Human
cgcggcgcugcacucuagccugggugacagag

SEQ ID NO: 388062 - RNA, 32 nt, Human
cgcggcgcuggcucggcagccucggccgggcg

SEQ ID NO: 388063 - RNA, 20 nt, Human
cgcggcggcagagcgcgagg

SEQ ID NO: 388064 - RNA, 32 nt, Human
cgcggcggcaggcacagguguaauggauaggu

SEQ ID NO: 388065 - RNA, 21 nt, Human
cgcggcggccagcggcgcggg

SEQ ID NO: 388066 - RNA, 22 nt, Human
cgcggcggccagcggcgcgggg

SEQ ID NO: 388067 - RNA, 32 nt, Human
cgcggcggccccgggaccaaggagaacuggcg

SEQ ID NO: 388068 - RNA, 16 nt, Human
cgcggcggcccggaca

SEQ ID NO: 388069 - RNA, 19 nt, Human
cgcggcggccgccgcgagg

SEQ ID NO: 388070 - RNA, 21 nt, Human
cgcggcggccggcgcgcugga

SEQ ID NO: 388071 - RNA, 22 nt, Human
cgcggcggcgcggcggcgcgag

SEQ ID NO: 388072 - RNA, 32 nt, Human
cgcggcggcggaggcagcagcggcggcggcag

SEQ ID NO: 388073 - RNA, 17 nt, Human
cgcggcggcggcgcgag

SEQ ID NO: 388074 - RNA, 20 nt, Human
cgcggcggcggcggcgcggg

SEQ ID NO: 388075 - RNA, 21 nt, Human
cgcggcggcggcggcgcgggg

SEQ ID NO: 388076 - RNA, 20 nt, Human
cgcggcggcgggcggccgag

SEQ ID NO: 388077 - RNA, 32 nt, Human
cgcggcggcucacgccuguaauccuagcgguu

SEQ ID NO: 388078 - RNA, 32 nt, Human
cgcggcggcucacuccuguaaucccagcacuu

SEQ ID NO: 388079 - RNA, 32 nt, Human
cgcggcggcucaugccuguaaucccagcacuu

SEQ ID NO: 388080 - RNA, 32 nt, Human
cgcggcggcugcagcuccagggagggggucug

SEQ ID NO: 388081 - RNA, 32 nt, Human
cgcggcggcugggaacgccgcuccccgacgca

SEQ ID NO: 388082 - RNA, 16 nt, Human
cgcggcgggccgagcc

SEQ ID NO: 388083 - RNA, 32 nt, Human
cgcggcggggccugagggacggaggccgggau

SEQ ID NO: 388084 - RNA, 20 nt, Human
cgcggcggggcggcgagagg

SEQ ID NO: 388085 - RNA, 32 nt, Human
cgcggcggguuugggugcaguggacccgcagu

SEQ ID NO: 388086 - RNA, 32 nt, Human
cgcggcgguggccagggccagagcaggcggcc

SEQ ID NO: 388087 - RNA, 32 nt, Human
cgcggcgucuuugaaaguuaacagacacuaag

SEQ ID NO: 388088 - RNA, 32 nt, Human
cgcggcgugccgcggcggccgcgggcuccggc

SEQ ID NO: 388089 - RNA, 32 nt, Human
cgcggcgugccggcgcugcagcgcggcagggg

SEQ ID NO: 388090 - RNA, 32 nt, Human
cgcggcguggaggcagggagaaugcgacucuc

SEQ ID NO: 388091 - RNA, 23 nt, Human
cgcggcuaccgcggcggcgcagg

SEQ ID NO: 388092 - RNA, 32 nt, Human
cgcggcucacugcaaccuccaccucccagguu

SEQ ID NO: 388093 - RNA, 32 nt, Human
cgcggcucacugcaaccuccaccucccgggcu

SEQ ID NO: 388094 - RNA, 32 nt, Human
cgcggcucacugcaaccuggaacuccugggcu

SEQ ID NO: 388095 - RNA, 19 nt, Human
cgcggcucagaaccggagc

SEQ ID NO: 388096 - RNA, 32 nt, Human
cgcggcucagccaagcuguuguuuuaaaagag

SEQ ID NO: 388097 - RNA, 32 nt, Human
cgcggcucagcgcgcaccggcgggcuucgaaa

SEQ ID NO: 388098 - RNA, 32 nt, Human
cgcggcuccagcccucuccagccuccggcuca

SEQ ID NO: 388099 - RNA, 21 nt, Human
cgcggcucgcggggccggagc

SEQ ID NO: 388100 - RNA, 22 nt, Human
cgcggcucggugacgccgcggg

SEQ ID NO: 388101 - RNA, 32 nt, Human
cgcggcucuccuccugucgguccugcaguucu

SEQ ID NO: 388102 - RNA, 32 nt, Human
cgcggcucuccucuucuucaucucuguuuucc

SEQ ID NO: 388103 - RNA, 32 nt, Human
cgcggcucuggagcuugacaggccugacgucg

SEQ ID NO: 388104 - RNA, 21 nt, Human
cgcggcugcagcgcgggcggg

SEQ ID NO: 388105 - RNA, 23 nt, Human
cgcggcugcccagcagcaugagg

SEQ ID NO: 388106 - RNA, 32 nt, Human
cgcggcugcccagcagcaugagguggugcugg

SEQ ID NO: 388107 - RNA, 20 nt, Human
cgcggcugccugcgcgcacg

SEQ ID NO: 388108 - RNA, 21 nt, Human
cgcggcugcggaacgggcgga

SEQ ID NO: 388109 - RNA, 20 nt, Human
cgcggcugcggcggcggccg

SEQ ID NO: 388110 - RNA, 21 nt, Human
cgcggcugcucacggcgcacg

SEQ ID NO: 388111 - RNA, 23 nt, Human
cgcggcugcuccggugcgccggg

SEQ ID NO: 388112 - RNA, 27 nt, Human
cgcggcuggcgccgcugcgcgcauggg

SEQ ID NO: 388113 - RNA, 18 nt, Human
cgcggcugggcccugccg

SEQ ID NO: 388114 - RNA, 20 nt, Human
cgcggcugggccgucggaga

SEQ ID NO: 388115 - RNA, 32 nt, Human
cgcggcuggggccucgcgccuccuggagcgcc

SEQ ID NO: 388116 - RNA, 21 nt, Human
cgcggcugugagccugcggga

SEQ ID NO: 388117 - RNA, 24 nt, Human
cgcggcuguggcggcgccggcgga

SEQ ID NO: 388118 - RNA, 32 nt, Human
cgcggcuugccuggcucuugcuguauccucac

SEQ ID NO: 388119 - RNA, 32 nt, Human
cgcgggaagccgcggaacugcgccggaaaguc

SEQ ID NO: 388120 - RNA, 32 nt, Human
cgcgggaccagagggagggaggcugcggacga

SEQ ID NO: 388121 - RNA, 32 nt, Human
cgcgggaccucgguggagaucuccagugaggc

SEQ ID NO: 388122 - RNA, 32 nt, Human
cgcgggagagggaggagaaggagcagccgcca

SEQ ID NO: 388123 - RNA, 24 nt, Human
cgcgggagcaguaacccgcgcggg

SEQ ID NO: 388124 - RNA, 32 nt, Human
cgcgggagccugggcggcgagccgggugugag

SEQ ID NO: 388125 - RNA, 32 nt, Human
cgcgggaggaggacgcgggugcggucuaggaa

SEQ ID NO: 388126 - RNA, 32 nt, Human
cgcgggaggcagagacugcagugagccgagau

SEQ ID NO: 388127 - RNA, 32 nt, Human
cgcgggagggguggaggcugcggggagccggg

SEQ ID NO: 388128 - RNA, 32 nt, Human
cgcgggaguccaggggcagacgggaugggucu

SEQ ID NO: 388129 - RNA, 32 nt, Human
cgcgggagugagagagggugagucagccacug

SEQ ID NO: 388130 - RNA, 23 nt, Human
cgcgggaugcgcccgggagccac

SEQ ID NO: 388131 - RNA, 32 nt, Human
cgcgggaugcugucuguccccuugcucagggc

SEQ ID NO: 388132 - RNA, 32 nt, Human
cgcgggcaccuugcuugcaugccucuuccucc

SEQ ID NO: 388133 - RNA, 32 nt, Human
cgcgggcagcagcuggagcuaaaggaagggca

SEQ ID NO: 388134 - RNA, 32 nt, Human
cgcgggcagcagggaagagggagcaaggcauu

SEQ ID NO: 388135 - RNA, 21 nt, Human
cgcgggcagcccaggcuccug

SEQ ID NO: 388136 - RNA, 20 nt, Human
cgcgggcagcggcgcgagca

SEQ ID NO: 388137 - RNA, 32 nt, Human
cgcgggcaucgggcaggagcucggccggggcg

SEQ ID NO: 388138 - RNA, 32 nt, Human
cgcgggccagaggcugagccuggguguggcug

SEQ ID NO: 388139 - RNA, 32 nt, Human
cgcgggcccagaggcuggaggcagcggggagc

SEQ ID NO: 388140 - RNA, 24 nt, Human
cgcgggccccggcggcggcgcgga

SEQ ID NO: 388141 - RNA, 32 nt, Human
cgcgggccgagggcuccugcagcugcucgcgc

SEQ ID NO: 388142 - RNA, 32 nt, Human
cgcgggccgcaugacuccucucugccucaauu

SEQ ID NO: 388143 - RNA, 32 nt, Human
cgcgggccgggagggggcacggcggaggccac

SEQ ID NO: 388144 - RNA, 25 nt, Human
cgcgggcgacgggcgggugcgcggg

SEQ ID NO: 388145 - RNA, 32 nt, Human
cgcgggcgagccggagcagaagaaggagggag

SEQ ID NO: 388146 - RNA, 22 nt, Human
cgcgggcgccccaagccugcca

SEQ ID NO: 388147 - RNA, 22 nt, Human
cgcgggcgcgggcgcgugcggg

SEQ ID NO: 388148 - RNA, 32 nt, Human
cgcgggcggcggcggaggcugcgggagucgcu

SEQ ID NO: 388149 - RNA, 32 nt, Human
cgcgggcgggcggacccaagcagugagggccu

SEQ ID NO: 388150 - RNA, 32 nt, Human
cgcgggcuacagccgcaccgccuauuccagcc

SEQ ID NO: 388151 - RNA, 32 nt, Human
cgcgggcuagaggcacuuuaccgcccggcggg

SEQ ID NO: 388152 - RNA, 32 nt, Human
cgcgggcuccugacaaccuccuccccucggcg

SEQ ID NO: 388153 - RNA, 32 nt, Human
cgcgggcugagaggucagaggcugcgaguguc

SEQ ID NO: 388154 - RNA, 18 nt, Human
cgcgggcugcgcccuggg

SEQ ID NO: 388155 - RNA, 32 nt, Human
cgcgggcugcggcagcaugaaaaagaagcaga

SEQ ID NO: 388156 - RNA, 22 nt, Human
cgcgggcugcggugcgagcggg

SEQ ID NO: 388157 - RNA, 18 nt, Human
cgcgggcuuccgcuccca

SEQ ID NO: 388158 - RNA, 32 nt, Human
cggccuggagcagcgacgccaccgcugggcaa

SEQ ID NO: 388159 - RNA, 32 nt, Human
cggccuggaggagggagguugugguuggaugg

SEQ ID NO: 388160 - RNA, 22 nt, Human
cggccuggaggugugugggcca

SEQ ID NO: 388161 - RNA, 32 nt, Human
cggccuggaguugggguugcagggacgccacg

SEQ ID NO: 388162 - RNA, 32 nt, Human
cggccuggcagauagcagaggcagcaggccgu

SEQ ID NO: 388163 - RNA, 32 nt, Human
cggccuggccaacauggugaaaccccaucucu

SEQ ID NO: 388164 - RNA, 32 nt, Human
cggccuggccaacauggugaaaccccgucucu

SEQ ID NO: 388165 - RNA, 32 nt, Human
cggccuggccaacauggugaaacccugucucu

SEQ ID NO: 388166 - RNA, 32 nt, Human
cggccuggccaaccuccgccuccuggguucaa

SEQ ID NO: 388167 - RNA, 32 nt, Human
cggccuggccaauauggugaaaccccaucucu

SEQ ID NO: 388168 - RNA, 32 nt, Human
cggccuggcccaggcugccgcuguacggugag

SEQ ID NO: 388169 - RNA, 32 nt, Human
cggccuggccgccaccaccgccaccgagagcc

SEQ ID NO: 388170 - RNA, 32 nt, Human
cggccuggcggcaggcugaagcuguucuuuug

SEQ ID NO: 388171 - RNA, 32 nt, Human
cggccuggcugcagcugggcagcagggguagg

SEQ ID NO: 388172 - RNA, 32 nt, Human
cggccuggcugcaggcgcaggagcagugucgg

SEQ ID NO: 388173 - RNA, 32 nt, Human
cggccuggcuuggagagagggggcucccggca

SEQ ID NO: 388174 - RNA, 32 nt, Human
cggccugggaggagccgagcucggacaacggc

SEQ ID NO: 388175 - RNA, 32 nt, Human
cggccugggaugcgggccaggcugcaggcggc

SEQ ID NO: 388176 - RNA, 22 nt, Human
cggccugggcaacagagcaaga

SEQ ID NO: 388177 - RNA, 32 nt, Human
cggccugggcagcgccccagaagccucauaga

SEQ ID NO: 388178 - RNA, 32 nt, Human
cggccugggcaggggguccaggugggccacac

SEQ ID NO: 388179 - RNA, 32 nt, Human
cggccugggcccugucacuucucugauagcuc

SEQ ID NO: 388180 - RNA, 22 nt, Human
cggccugggcgacagagcgaga

SEQ ID NO: 388181 - RNA, 32 nt, Human
cggccugggcggacccaggggagggcggccca

SEQ ID NO: 388182 - RNA, 32 nt, Human
cggccugggcucugccagaggcugaggugccc

SEQ ID NO: 388183 - RNA, 22 nt, Human
cggccugggugacagagugaga

SEQ ID NO: 388184 - RNA, 32 nt, Human
cggccuggguguggcuggaaugguggcaggag

SEQ ID NO: 388185 - RNA, 32 nt, Human
cggccuggugcaguuuggccugggcgacaguc

SEQ ID NO: 388186 - RNA, 32 nt, Human
cggccugguucugcagcuggaccgaccucauu

SEQ ID NO: 388187 - RNA, 22 nt, Human
cggccugugccggccggcgcgg

SEQ ID NO: 388188 - RNA, 32 nt, Human
cggccuguggacagccagacccugccaucccu

SEQ ID NO: 388189 - RNA, 32 nt, Human
cggccuucagcccaggcugggaagcgccuucu

SEQ ID NO: 388190 - RNA, 32 nt, Human
cggccuuccaaagugcauuacaggcgugagcc

SEQ ID NO: 388191 - RNA, 31 nt, Human
cggccuucccaagucugagcuauuucuucca

SEQ ID NO: 388192 - RNA, 32 nt, Human
cggccuucucccgcuccugagggcuguggcgg

SEQ ID NO: 388193 - RNA, 32 nt, Human
cggccuucucccuucaucuugaucugggaaga

SEQ ID NO: 388194 - RNA, 32 nt, Human
cggccuucucgagaagcgacggcggagggccc

SEQ ID NO: 388195 - RNA, 18 nt, Human
cggccuugagcccugaca

SEQ ID NO: 388196 - RNA, 32 nt, Human
cggccuugcgccgugcauuccgaugcgcggca

SEQ ID NO: 388197 - RNA, 18 nt, Human
cggccuugcuuuuccccg

SEQ ID NO: 388198 - RNA, 19 nt, Human
cggccuuggcuaacuuuuc

SEQ ID NO: 388199 - RNA, 18 nt, Human
cggccuugucagcucaca

SEQ ID NO: 388200 - RNA, 18 nt, Human
cggccuugucuuucggca

SEQ ID NO: 388201 - RNA, 21 nt, Human
cggccuuucagguccaggcca

SEQ ID NO: 388202 - RNA, 20 nt, Human
cggccuuucccucccuccgc

SEQ ID NO: 388203 - RNA, 22 nt, Human
cggccuuucccucccucugcca

SEQ ID NO: 388204 - RNA, 31 nt, Human
cggccuuuccucucugccucuggcuuuaugu

SEQ ID NO: 388205 - RNA, 32 nt, Human
cggccuuugcaggcccggccuccugcgucucg

SEQ ID NO: 388206 - RNA, 32 nt, Human
cggccuuugcuguggcuggagcuggacagugc

SEQ ID NO: 388207 - RNA, 19 nt, Human
cggccuuuguuccuccaua

SEQ ID NO: 388208 - RNA, 20 nt, Human
cggccuuuuccucuggcuca

SEQ ID NO: 388209 - RNA, 32 nt, Human
cggcgaagaggacccgcaggcugcaaggagca

SEQ ID NO: 388210 - RNA, 32 nt, Human
cggcgaaggaggugguggcugcguugggcucc

SEQ ID NO: 388211 - RNA, 17 nt, Human
cggcgaaguggccuccc

SEQ ID NO: 388212 - RNA, 32 nt, Human
cggcgacacccgaggccuggugguggcggcgg

SEQ ID NO: 388213 - RNA, 32 nt, Human
cggcgacacugcacccaucccggcugcuuuug

SEQ ID NO: 388214 - RNA, 32 nt, Human
cggcgacagguauggccccuugccaggguagg

SEQ ID NO: 388215 - RNA, 32 nt, Human
cggcgacauggcuucggagcaggacgugcgcg

SEQ ID NO: 388216 - RNA, 32 nt, Human
cggcgaccaccaggggccugaggaugaagcca

SEQ ID NO: 388217 - RNA, 32 nt, Human
cggcgaccccgccagccccggucucuuucccu

SEQ ID NO: 388218 - RNA, 19 nt, Human
cggcgacccugcccucccg

SEQ ID NO: 388219 - RNA, 31 nt, Human
cggcgacccuuuccagggccuguugucuggc

SEQ ID NO: 388220 - RNA, 32 nt, Human
cggcgacucccaggauccuggccaugagagcu

SEQ ID NO: 388221 - RNA, 32 nt, Human
cggcgacuccccucagccuccgccgccucgcc

SEQ ID NO: 388222 - RNA, 32 nt, Human
cggcgacugcagcugcacggcguccagcagcg

SEQ ID NO: 388223 - RNA, 32 nt, Human
cggcgacuuggagagagggaagaggggcguuu

SEQ ID NO: 388224 - RNA, 24 nt, Human
cggcgagacccggcccccacgccc

SEQ ID NO: 388225 - RNA, 19 nt, Human
cggcgagaccuggccaggg

SEQ ID NO: 388226 - RNA, 32 nt, Human
cggcgagagcgguucagguguucuccgaagcc

SEQ ID NO: 388227 - RNA, 31 nt, Human
cggcgagauggcccucggccugugccgcugc

SEQ ID NO: 388228 - RNA, 32 nt, Human
cggcgagccagagcuggaccucaccagcaagc

SEQ ID NO: 388229 - RNA, 28 nt, Human
cggcgagccgggugugagcugccugaaa

SEQ ID NO: 388230 - RNA, 32 nt, Human
cggcgagcgggagugaaagaagaaaagcuaga

SEQ ID NO: 388231 - RNA, 21 nt, Human
cggcgaggcacuggccagccc

SEQ ID NO: 388232 - RNA, 32 nt, Human
cggcgaggcaggcggacgaggcgcagagacag

SEQ ID NO: 388233 - RNA, 32 nt, Human
cggcgaggcccuggugggcgcgaggcaggggg

SEQ ID NO: 388234 - RNA, 32 nt, Human
cggcgaggcuugagcuugcagcgcgcggcuuc

SEQ ID NO: 388235 - RNA, 32 nt, Human
cggcgagggaggacgggggcgcagacggccgg

SEQ ID NO: 388236 - RNA, 32 nt, Human
cggcgauggcauccuuccuuuccauccuaaga

SEQ ID NO: 388237 - RNA, 32 nt, Human
cggcgcaccgcaagcccugccuccuggguuca

SEQ ID NO: 388238 - RNA, 32 nt, Human
cggcgcacuccuggcccuggguucuugcugcu

SEQ ID NO: 388239 - RNA, 32 nt, Human
cggcgcagccgugggagcugaggaucuggcac

SEQ ID NO: 388240 - RNA, 32 nt, Human
cggcgcagcgcuccagccaugucgcgcggccu

SEQ ID NO: 388241 - RNA, 32 nt, Human
cggcgcagcugcucccgcugccacagccgcca

SEQ ID NO: 388242 - RNA, 17 nt, Human
cggcgcaggcgcgcgga

SEQ ID NO: 388243 - RNA, 32 nt, Human
cggcgcaucccuccucucccaccuccuggcac

SEQ ID NO: 388244 - RNA, 32 nt, Human
cggcgcaugccugcaaucccagcuacuuggaa

SEQ ID NO: 388245 - RNA, 32 nt, Human
cggcgccaaccaccgcgggccucccagccagc

SEQ ID NO: 388246 - RNA, 32 nt, Human
cggcgccacccugccccagccugaggaggagg

SEQ ID NO: 388247 - RNA, 32 nt, Human
cggcgccacggcuugcugacagcugggagggu

SEQ ID NO: 388248 - RNA, 32 nt, Human
cggcgccacugccaccaccgcagacgccgccu

SEQ ID NO: 388249 - RNA, 32 nt, Human
cggcgccagcaacugcgggacgccucagcucg

SEQ ID NO: 388250 - RNA, 23 nt, Human
cggcgccagcagcccgcgccccg

SEQ ID NO: 388251 - RNA, 32 nt, Human
cggcgccauccugcaaucuaagccacaauggu

SEQ ID NO: 388252 - RNA, 32 nt, Human
cggcgcccagcccaggaagaguuuuuaaauua

SEQ ID NO: 388253 - RNA, 32 nt, Human
cggcgccccugccaccucccugacccgucuaa

SEQ ID NO: 388254 - RNA, 32 nt, Human
cggcgcccgcagcggaggagguuuucaguggc

SEQ ID NO: 388255 - RNA, 32 nt, Human
cggcgcccggccuugcucaacgcccagcaguc

SEQ ID NO: 388256 - RNA, 32 nt, Human
cggcgccgcagccauggagggaggcggcggcg

SEQ ID NO: 388257 - RNA, 20 nt, Human
cggcgccgccaccgccgcac

SEQ ID NO: 388258 - RNA, 32 nt, Human
cggcgccgcgcacuccaacccggcgggcaccu

SEQ ID NO: 388259 - RNA, 32 nt, Human
cggcgccgcugcuguaggggaccagcgcgggu

SEQ ID NO: 388260 - RNA, 32 nt, Human
cggcgccggcuugugggcucgccgccugcagc

SEQ ID NO: 388261 - RNA, 19 nt, Human
cggcgccgggggcgggagg

SEQ ID NO: 388262 - RNA, 32 nt, Human
cggcgccuagcccucugggaauuguguucugg

SEQ ID NO: 388263 - RNA, 32 nt, Human
cggcgccucacggauggcaaagcucuccucac

SEQ ID NO: 388264 - RNA, 32 nt, Human
cggcgccugagaugcaggcuugugugcggggc

SEQ ID NO: 388265 - RNA, 32 nt, Human
cggcgccuguaaucccagcuacuagggaggcu

SEQ ID NO: 388266 - RNA, 32 nt, Human
cggcgccuguaaucccagcuacucgggagacu

SEQ ID NO: 388267 - RNA, 27 nt, Human
cggcgccuguaaucccagcuacuuggg

SEQ ID NO: 388268 - RNA, 32 nt, Human
cggcgccuguucugggggcuuucuguuccagc

SEQ ID NO: 388269 - RNA, 32 nt, Human
cggcgcgaacccugcugggccuccagucaccc

SEQ ID NO: 388270 - RNA, 32 nt, Human
cggcgcgcacacugcucgcugggccgcggcuc

SEQ ID NO: 388271 - RNA, 32 nt, Human
cggcgcgcacagcugcacucagcggcuuccuu

SEQ ID NO: 388272 - RNA, 21 nt, Human
cggcgcgccaccggcgcccgc

SEQ ID NO: 388273 - RNA, 32 nt, Human
cggcgcgccugaaggagcaggaaggggaagga

SEQ ID NO: 388274 - RNA, 25 nt, Human
cggcgcgcuucugccugcguuccau

SEQ ID NO: 388275 - RNA, 32 nt, Human
cggcgcggagggccccagcccagucaggggug

SEQ ID NO: 388276 - RNA, 21 nt, Human
cggcgcggccggccccagucg

SEQ ID NO: 388277 - RNA, 18 nt, Human
cggcgcggccggggcagg

SEQ ID NO: 388278 - RNA, 20 nt, Human
cggcgcggcgcgacaccggg

SEQ ID NO: 388279 - RNA, 32 nt, Human
cggcgcggcggcggagggggcgggcaggccgg

SEQ ID NO: 388280 - RNA, 22 nt, Human
cggcgcggcggggcggggccgg

SEQ ID NO: 388281 - RNA, 32 nt, Human
cggcgcgggaggaggagcgggagccagcccug

SEQ ID NO: 388282 - RNA, 21 nt, Human
cggcgcgggccacgccagggu

SEQ ID NO: 388283 - RNA, 32 nt, Human
cggcgcgggcuggggcggcucugcgccuccgc

SEQ ID NO: 388284 - RNA, 32 nt, Human
cggcgcggguuccugccucucuggguggguga

SEQ ID NO: 388285 - RNA, 32 nt, Human
cggcgcguccggcggaggguugaggggagcgg

SEQ ID NO: 388286 - RNA, 32 nt, Human
cggcgcuagggugggcgaacccagagggacgc

SEQ ID NO: 388287 - RNA, 24 nt, Human
cggcgcucacugcucuccacgccg

SEQ ID NO: 388288 - RNA, 32 nt, Human
cggcgcucucccugccuccccugccgggcugc

SEQ ID NO: 388289 - RNA, 32 nt, Human
cggcgcucugggcugcuccucccauccccgca

SEQ ID NO: 388290 - RNA, 32 nt, Human
cggcgcugacccuuccaggucagcuggaguug

SEQ ID NO: 388291 - RNA, 32 nt, Human
cggcgcugaugcugggaggccuccagggaugg

SEQ ID NO: 388292 - RNA, 32 nt, Human
cggcgcugcacucuagccugggugacagaguc

SEQ ID NO: 388293 - RNA, 32 nt, Human
cggcgcugcggugggagccggagggcgacagu

SEQ ID NO: 388294 - RNA, 32 nt, Human
cggcgcuggcagcagggcccgcggggugaagg

SEQ ID NO: 388295 - RNA, 32 nt, Human
cggcgcugggagagggcggagggggaggcggc

SEQ ID NO: 388296 - RNA, 32 nt, Human
cggcgcugggagguggagucguugcuguugcu

SEQ ID NO: 388297 - RNA, 32 nt, Human
cggcgcuuugggaggccgaggugggcagauca

SEQ ID NO: 388298 - RNA, 32 nt, Human
cggcggaaggguguccaggcagaggaaacagg

SEQ ID NO: 388299 - RNA, 32 nt, Human
cggcggacaguguaauguugggugggagugcg

SEQ ID NO: 388300 - RNA, 32 nt, Human
cggcggagagacugauggagaggcagaaacgg

SEQ ID NO: 388301 - RNA, 32 nt, Human
cggcggagcaggcauuuccagcagugaggaga

SEQ ID NO: 388302 - RNA, 32 nt, Human
cggcggagccgcaggccagggaccugcaguga

SEQ ID NO: 388303 - RNA, 32 nt, Human
cggcggaggaggaggaggagcgggaggagcgc

SEQ ID NO: 388304 - RNA, 32 nt, Human
cggcggaggcagcagcggcggcggcaguggcg

SEQ ID NO: 388305 - RNA, 32 nt, Human
cggcggaugccuguaaucccagcuacuuggga

SEQ ID NO: 388306 - RNA, 32 nt, Human
cggcggcaccagcaccaccaugucgcgcucag

SEQ ID NO: 388307 - RNA, 32 nt, Human
cggcggcagaaaaggcagcgggcgcugggaga

SEQ ID NO: 388308 - RNA, 32 nt, Human
cggcggcagcagccccagcccucagagagaca

SEQ ID NO: 388309 - RNA, 32 nt, Human
cggcggcagcagcgauggcaggaauagaguug

SEQ ID NO: 388310 - RNA, 32 nt, Human
cggcggcagcagcggcgacagcagaggaggaa

SEQ ID NO: 388311 - RNA, 20 nt, Human
cggcggcagcccucccggcg

SEQ ID NO: 388312 - RNA, 32 nt, Human
cggcggcagccgcggcggccgccggcucuucc

SEQ ID NO: 388313 - RNA, 32 nt, Human
cggcggcagccugccuugcucugccaggaacc

SEQ ID NO: 388314 - RNA, 32 nt, Human
cggcggcagcggcggagccaggcagccccgcg

SEQ ID NO: 388315 - RNA, 32 nt, Human
cggcggcaggacuccggcacuaugagcggcuu

SEQ ID NO: 388316 - RNA, 32 nt, Human
cggcggcaggagcugaggggaguuguagggaa

SEQ ID NO: 388317 - RNA, 32 nt, Human
cggcggcaggguggcggacggagcgggggacc

SEQ ID NO: 388318 - RNA, 32 nt, Human
cggcggcaggguguggacccagcuggccgcug

SEQ ID NO: 388319 - RNA, 32 nt, Human
cggcggccacugcgcgccgcccugaggagcgc

SEQ ID NO: 388320 - RNA, 32 nt, Human
cggcggccagggaggugcggagcagccucggc

SEQ ID NO: 388321 - RNA, 21 nt, Human
cggcggcccagcgcccggcgu

SEQ ID NO: 388322 - RNA, 20 nt, Human
cggcggccccaaccagccgg

SEQ ID NO: 388323 - RNA, 23 nt, Human
cggcggcccccagcccagcccgg

SEQ ID NO: 388324 - RNA, 32 nt, Human
cggcggccccuccggcucccacugccuccccc

SEQ ID NO: 388325 - RNA, 21 nt, Human
cggcggccccugcggucccgg

SEQ ID NO: 388326 - RNA, 32 nt, Human
cggcggccgggugggagcgcagcgaggacgcg

SEQ ID NO: 388327 - RNA, 23 nt, Human
cggcggccguccucaucccggcg

SEQ ID NO: 388328 - RNA, 21 nt, Human
cggcggccuccaaagccuccc

SEQ ID NO: 388329 - RNA, 32 nt, Human
cggcggccuccaaagccucccaccccacccca

SEQ ID NO: 388330 - RNA, 32 nt, Human
cggcggccuccggcggcgcucuccagucaugg

SEQ ID NO: 388331 - RNA, 32 nt, Human
cggcggccugcagggaggucccagaaucuagg

SEQ ID NO: 388332 - RNA, 18 nt, Human
cggcggccugugcugcug

SEQ ID NO: 388333 - RNA, 19 nt, Human
cggcggcgaccccgcggcg

SEQ ID NO: 388334 - RNA, 23 nt, Human
cggcggcgaccccggggccuggc

SEQ ID NO: 388335 - RNA, 22 nt, Human
cggcggcgacccggcgccgcgu

SEQ ID NO: 388336 - RNA, 32 nt, Human
cggcggcgagccagcacccgggccggcuaagc

SEQ ID NO: 388337 - RNA, 18 nt, Human
cggcggcgaucucccggc

SEQ ID NO: 388338 - RNA, 32 nt, Human
cggcggcgaugcggcggccccgcugaguccgc

SEQ ID NO: 388339 - RNA, 21 nt, Human
cggcggcgaugugcccgagcg

SEQ ID NO: 388340 - RNA, 20 nt, Human
cggcggcgcccagucccggc

SEQ ID NO: 388341 - RNA, 23 nt, Human
cggcggcgcccgcggcggugccc

SEQ ID NO: 388342 - RNA, 32 nt, Human
cggcggcgccucgggcgcgggugcaggcgcgc

SEQ ID NO: 388343 - RNA, 32 nt, Human
cggcggcgcgcuccagccgguguaggcgaggc

SEQ ID NO: 388344 - RNA, 24 nt, Human
cggcggcgcugaaggccgcggcgu

SEQ ID NO: 388345 - RNA, 20 nt, Human
cggcggcgcuggacccgacg

SEQ ID NO: 388346 - RNA, 32 nt, Human
cggcggcgcuggggccagaggggccggacggg

SEQ ID NO: 388347 - RNA, 32 nt, Human
cggcggcggagcgggcggcagagcagggcggc

SEQ ID NO: 388348 - RNA, 32 nt, Human
cggcggcggaggaggagaaaggaaagaggaag

SEQ ID NO: 388349 - RNA, 32 nt, Human
cggcggcggaggaggaggaggagcgggaggag

SEQ ID NO: 388350 - RNA, 32 nt, Human
cggcggcggcaacauggcagagaccgcggccg

SEQ ID NO: 388351 - RNA, 20 nt, Human
cggcggcggcaccccagcgu

SEQ ID NO: 388352 - RNA, 20 nt, Human
cggcggcggcaccccgggcg

SEQ ID NO: 388353 - RNA, 32 nt, Human
cggcggcggcagaggagugggagcagcggccc

SEQ ID NO: 388354 - RNA, 32 nt, Human
cggcggcggcagcagcggcagcagcgacuuca

SEQ ID NO: 388355 - RNA, 32 nt, Human
cggcggcggcagcgguuggagguuguaggacc

SEQ ID NO: 388356 - RNA, 19 nt, Human
cggcggcggccccucgggc

SEQ ID NO: 388357 - RNA, 21 nt, Human
cggcggcggcccgagcccagc

SEQ ID NO: 388358 - RNA, 21 nt, Human
cggcggcggcccgggcccagc

SEQ ID NO: 388359 - RNA, 18 nt, Human
cggcggcggcccgggcgg

SEQ ID NO: 388360 - RNA, 22 nt, Human
cggcggcggccgaggcccagcg

SEQ ID NO: 388361 - RNA, 21 nt, Human
cggcggcggccgaggcggcgu

SEQ ID NO: 388362 - RNA, 20 nt, Human
cggcggcggccgcggcccgg

SEQ ID NO: 388363 - RNA, 20 nt, Human
cggcggcggccggagccggc

SEQ ID NO: 388364 - RNA, 22 nt, Human
cggcggcggccgggacccagcg

SEQ ID NO: 388365 - RNA, 19 nt, Human
cggcggcggccgggccggg

SEQ ID NO: 388366 - RNA, 32 nt, Human
cggcggcggcgacagagcgagcgcggcgcggg

SEQ ID NO: 388367 - RNA, 21 nt, Human
cggcggcggcgaggcucggcg

SEQ ID NO: 388368 - RNA, 24 nt, Human
cggcggcggcgcggaccccgagcg

SEQ ID NO: 388369 - RNA, 19 nt, Human
cggcggcggcgcugcccgg

SEQ ID NO: 388370 - RNA, 22 nt, Human
cggcggcggcgcuuccccggcg

SEQ ID NO: 388371 - RNA, 32 nt, Human
cggcggcggcggagcgggcggcagagcagggc

SEQ ID NO: 388372 - RNA, 22 nt, Human
cggcggcggcggauuccccgcg

SEQ ID NO: 388373 - RNA, 20 nt, Human
cggcggcggcggcgcgcgga

SEQ ID NO: 388374 - RNA, 32 nt, Human
cggcggcggcggcggaggaggaggcgaccgag

SEQ ID NO: 388375 - RNA, 32 nt, Human
cggcggcggcggcggaggcggcggcggcggcg

SEQ ID NO: 388376 - RNA, 32 nt, Human
cggcggcggcggcggcggcaggagaauggcau

SEQ ID NO: 388377 - RNA, 32 nt, Human
cggcggcggcggcggcggcgggcagaucgcgg

SEQ ID NO: 388378 - RNA, 32 nt, Human
cggcggcggcggcgguuccagcaugaagagga

SEQ ID NO: 388379 - RNA, 19 nt, Human
cggcggcggcgggacccgg

SEQ ID NO: 388380 - RNA, 32 nt, Human
cggcggcggcgggcaguugcaguggugcagaa

SEQ ID NO: 388381 - RNA, 32 nt, Human
cggcggcggcugcugcagcugcaggaggagcc

SEQ ID NO: 388382 - RNA, 23 nt, Human
cggcggcgggacggccccgagcg

SEQ ID NO: 388383 - RNA, 32 nt, Human
cggcggcgggagagaggaggaggcggcggcgg

SEQ ID NO: 388384 - RNA, 22 nt, Human
cggcggcgggcagaucgcggcg

SEQ ID NO: 388385 - RNA, 23 nt, Human
cggcggcggggagggucgcggcg

SEQ ID NO: 388386 - RNA, 32 nt, Human
cggcggcggggcagaggcggcccaggggcggc

SEQ ID NO: 388387 - RNA, 32 nt, Human
cggcggcgggggaggcagaggcggaggcggag

SEQ ID NO: 388388 - RNA, 21 nt, Human
cggcggcgggugccccgcgcg

SEQ ID NO: 388389 - RNA, 32 nt, Human
cggcggcggguggaucaccugagaucaggagu

SEQ ID NO: 388390 - RNA, 19 nt, Human
cggcggcgguggcgggggg

SEQ ID NO: 388391 - RNA, 32 nt, Human
cggcggcguccugguagcggccuccugggugc

SEQ ID NO: 388392 - RNA, 25 nt, Human
cggcggcgucggcgcgguccuagcg

SEQ ID NO: 388393 - RNA, 22 nt, Human
cggcggcgucuagcggccccgg

SEQ ID NO: 388394 - RNA, 21 nt, Human
cggcggcguggaauccggcgu

SEQ ID NO: 388395 - RNA, 21 nt, Human
cggcggcucacgccuguaauc

SEQ ID NO: 388396 - RNA, 24 nt, Human
cggcggcucacgccuguaauccca

SEQ ID NO: 388397 - RNA, 32 nt, Human
cggcggcucacggagcuccugggggcgcagga

SEQ ID NO: 388398 - RNA, 24 nt, Human
cggcggcucacuccuguaauccca

SEQ ID NO: 388399 - RNA, 32 nt, Human
cggcggcucaggggaaacgaggcugcaguggu

SEQ ID NO: 388400 - RNA, 24 nt, Human
cggcggcucaugccuguaauccca

SEQ ID NO: 388401 - RNA, 32 nt, Human
cggcggcucuggacugcagccucccaaggcuc

SEQ ID NO: 388402 - RNA, 32 nt, Human
cggcggcugccugggcuuuaauggcugcuccg

SEQ ID NO: 388403 - RNA, 32 nt, Human
cggcggcugccugguccucagcagugcagccc

SEQ ID NO: 388404 - RNA, 32 nt, Human
cggcggcugcugugcugggugcagugaggaag

SEQ ID NO: 388405 - RNA, 18 nt, Human
cggcgggaccgcgaggag

SEQ ID NO: 388406 - RNA, 32 nt, Human
cggcgggaccugcugggaggaauggcgccgcc

SEQ ID NO: 388407 - RNA, 32 nt, Human
cggcgggacugucaauggaggcagggguucca

SEQ ID NO: 388408 - RNA, 32 nt, Human
cggcgggaggggcggcggcgccccgcgcacau

SEQ ID NO: 388409 - RNA, 32 nt, Human
cggcgggaggggcgggugggaggccgcggcca

SEQ ID NO: 388410 - RNA, 32 nt, Human
cggcgggaggugggggaacaaggggucuuccg

SEQ ID NO: 388411 - RNA, 32 nt, Human
cggcgggcagcggcccaggaggcgcguggcgg

SEQ ID NO: 388412 - RNA, 32 nt, Human
cggcgggcaggcggcgggcgcggcgggcgagg

SEQ ID NO: 388413 - RNA, 32 nt, Human
cggcgggcgcgagcacgaccccacucuccugc

SEQ ID NO: 388414 - RNA, 32 nt, Human
cggcgggcggaggcggcgggagcgguggugcc

SEQ ID NO: 388415 - RNA, 32 nt, Human
cggcgggcgggugggaggugggaguggcugca

SEQ ID NO: 388416 - RNA, 24 nt, Human
cggcgggcuaagcccagggccggg

SEQ ID NO: 388417 - RNA, 32 nt, Human
cggcgggcugcucacccagccugugggaagag

SEQ ID NO: 388418 - RNA, 32 nt, Human
cggcggggagagccacagaggagcaggagggg

SEQ ID NO: 388419 - RNA, 32 nt, Human
cggcggggaggaggagaaggaggaggguggcg

SEQ ID NO: 388420 - RNA, 32 nt, Human
cggcggggaggcagcaggcgcgggagcgggcg

SEQ ID NO: 388421 - RNA, 32 nt, Human
cggcggggaggcagggaugucgagggccccuc

SEQ ID NO: 388422 - RNA, 32 nt, Human
cggcggggccagcccagcccacagcagucuca

SEQ ID NO: 388423 - RNA, 32 nt, Human
cggcggggcucgcgcaaccucccucgccuccc

SEQ ID NO: 388424 - RNA, 32 nt, Human
cggcgggggagguggaggugcgaguauaaaug

SEQ ID NO: 388425 - RNA, 32 nt, Human
cggcgggggcagcagcagcugaggcagcagcu

SEQ ID NO: 388426 - RNA, 32 nt, Human
cggcgggggcagcggcaaccccggcgccgcgg

SEQ ID NO: 388427 - RNA, 32 nt, Human
cggcgggggccccagcccagcuugcaggccac

SEQ ID NO: 388428 - RNA, 32 nt, Human
cggcgggggcgggccagcuggacgggcugccg

SEQ ID NO: 388429 - RNA, 32 nt, Human
cggcgggggcgggcccgugccugcugugcccc

SEQ ID NO: 388430 - RNA, 32 nt, Human
cggcgggucggggccggccucugccuugccgc

SEQ ID NO: 388431 - RNA, 32 nt, Human
cggcgggucggggcugaagauguggcagcgcc

SEQ ID NO: 388432 - RNA, 32 nt, Human
cggcgggugccuguaaccccagcuacuuggga

SEQ ID NO: 388433 - RNA, 32 nt, Human
cggcggguggguggaggaugcggugcgcggga

SEQ ID NO: 388434 - RNA, 32 nt, Human
cggcgguccgcggcggagguucaugugggggu

SEQ ID NO: 388435 - RNA, 32 nt, Human
cggcggucguguagcugagcaggccuggggcu

SEQ ID NO: 388436 - RNA, 32 nt, Human
cggcgguggagccgagcggggagccaggaaag

SEQ ID NO: 388437 - RNA, 32 nt, Human
cggcgguggaggaggaggcagagaggagugga

SEQ ID NO: 388438 - RNA, 32 nt, Human
cggcgguggugaggaagauacuuugguuagug

SEQ ID NO: 388439 - RNA, 32 nt, Human
cggcgguuagggcuguguagggcgaggccucc

SEQ ID NO: 388440 - RNA, 17 nt, Human
cggcgguugcuugcuca

SEQ ID NO: 388441 - RNA, 32 nt, Human
cggcguagccgcugccccaacuccugccccau

SEQ ID NO: 388442 - RNA, 32 nt, Human
cggcgucacugcacccuccgccaggcuccgcg

SEQ ID NO: 388443 - RNA, 32 nt, Human
cggcgucagacuuuucuuugcgauguccucgg

SEQ ID NO: 388444 - RNA, 32 nt, Human
cggcgucagagggagggcgggcgccgcguugg

SEQ ID NO: 388445 - RNA, 32 nt, Human
cggcguccacaccuaagaacagcagcuccacc

SEQ ID NO: 388446 - RNA, 32 nt, Human
cggcguccccgcccucuccccgccucggccag

SEQ ID NO: 388447 - RNA, 32 nt, Human
cggcguccgcucggcccugcuuuuugcgaccu

SEQ ID NO: 388448 - RNA, 32 nt, Human
cggcguccuccacauaggcaguggcugugguu

SEQ ID NO: 388449 - RNA, 32 nt, Human
cggcguccugaacccaaaggcucuuuucagag

SEQ ID NO: 388450 - RNA, 32 nt, Human
cggcguccugguagcggccuccugggugcuca

SEQ ID NO: 388451 - RNA, 32 nt, Human
cggcgucgagacuggaggcugagugcuaaacu

SEQ ID NO: 388452 - RNA, 32 nt, Human
cggcgucugcagcucgcuucaagauggccgcu

SEQ ID NO: 388453 - RNA, 32 nt, Human
cggcgucuggaacucuauuuuaagaaccucuc

SEQ ID NO: 388454 - RNA, 32 nt, Human
cggcgucugggcaucucggccucggcagaaag

SEQ ID NO: 388455 - RNA, 32 nt, Human
cggcgugaggccugggcugguuggagaagguc

SEQ ID NO: 388456 - RNA, 32 nt, Human
cggcgugcccugcuugucacaggcugaaaaac

SEQ ID NO: 388457 - RNA, 32 nt, Human
cggcguggagaugaacgcgccgcuggacggcc

SEQ ID NO: 388458 - RNA, 19 nt, Human
cggcguggccgugcgcgcg

SEQ ID NO: 388459 - RNA, 32 nt, Human
cggcgugggaagagaauggcuucugcaaggaa

SEQ ID NO: 388460 - RNA, 32 nt, Human
cggcgugggaggcugggccgcagugagugggg

SEQ ID NO: 388461 - RNA, 22 nt, Human
cggcguguucauccccacaccg

SEQ ID NO: 388462 - RNA, 32 nt, Human
cggcguugaaggaggcacgugggggaggcggg

SEQ ID NO: 388463 - RNA, 32 nt, Human
cggcguuugcccagccucaaccccugggaugc

SEQ ID NO: 388464 - RNA, 32 nt, Human
cggcuaaacuauucagaguuaacacuccagaa

SEQ ID NO: 388465 - RNA, 32 nt, Human
cggcuaaagagacugaugcaucaacaccaggc

SEQ ID NO: 388466 - RNA, 32 nt, Human
cggcuaacacggugaaaccccgucucuacuaa

SEQ ID NO: 388467 - RNA, 20 nt, Human
cggcuaagaccugccaggga

SEQ ID NO: 388468 - RNA, 32 nt, Human
cggcuaagcucuggcaucaucaucccagaaca

SEQ ID NO: 388469 - RNA, 32 nt, Human
cggcuaaggcagaauuaggauuugaacccaga

SEQ ID NO: 388470 - RNA, 32 nt, Human
cggcuaaguucaaggaggaucgcuugagcagg

SEQ ID NO: 388471 - RNA, 32 nt, Human
cggcuacauccagccaaugccaagacagugga

SEQ ID NO: 388472 - RNA, 32 nt, Human
cggcuacccaggcaggaacgucagggaggcuu

SEQ ID NO: 388473 - RNA, 32 nt, Human
cggcuacuggggccgccuccuccaggcggggc

SEQ ID NO: 388474 - RNA, 32 nt, Human
cggcuacuuccuggagcuucugccgccuccug

SEQ ID NO: 388475 - RNA, 32 nt, Human
cggcuacuugggaggcugaggugggagggauu

SEQ ID NO: 388476 - RNA, 32 nt, Human
cggcuagugucgaucuccugaccucaugaucu

SEQ ID NO: 388477 - RNA, 25 nt, Human
cggcucaaaugauccucccaccuca

SEQ ID NO: 388478 - RNA, 32 nt, Human
cggcucaacgcaaccuccgccucccagguuca

SEQ ID NO: 388479 - RNA, 32 nt, Human
cggcucaagccuguaaucccagcacuuugggu

SEQ ID NO: 388480 - RNA, 32 nt, Human
cggcucaaugaacccaucagcagccagguucu

SEQ ID NO: 388481 - RNA, 20 nt, Human
cggcucaauugaucuuccca

SEQ ID NO: 388482 - RNA, 21 nt, Human
cggcucacaccuguaauccca

SEQ ID NO: 388483 - RNA, 32 nt, Human
cggcucacaccuguaaucccagcacuuuggga

SEQ ID NO: 388484 - RNA, 32 nt, Human
cggcucacagcaaccucucugccuccagaaau

SEQ ID NO: 388485 - RNA, 32 nt, Human
cggcucacagcaaccucugccucccggauuua

SEQ ID NO: 388486 - RNA, 32 nt, Human
cggcucaccacaaccuccaccucccagguuca

SEQ ID NO: 388487 - RNA, 32 nt, Human
cggcucaccacaaccuccgccuccuggguuca

SEQ ID NO: 388488 - RNA, 32 nt, Human
cggcucaccacaaccuccuccucuuggguuca

SEQ ID NO: 388489 - RNA, 32 nt, Human
cggcucaccccaaccuccgccuccuggguuca

SEQ ID NO: 388490 - RNA, 32 nt, Human
cggcucacccugagagcagaggccgugcaggg

SEQ ID NO: 388491 - RNA, 32 nt, Human
cggcucaccgcaaaguccgccucccaggcgau

SEQ ID NO: 388492 - RNA, 32 nt, Human
cggcucaccgcaaccuccaccuuccugguuca

SEQ ID NO: 388493 - RNA, 32 nt, Human
cggcucaccgcaaccuccgcccccuggguuca

SEQ ID NO: 388494 - RNA, 32 nt, Human
cggcucaccgcaaccuccgccucccagguuca

SEQ ID NO: 388495 - RNA, 32 nt, Human
cggcucaccgcaaccuccgccucccggauuca

SEQ ID NO: 388496 - RNA, 32 nt, Human
cggcucaccgcaaccuccgccucccggguuca

SEQ ID NO: 388497 - RNA, 32 nt, Human
cggcucaccgcaaccuccgccuccuggguuca

SEQ ID NO: 388498 - RNA, 32 nt, Human
cggcucaccgcaaccuccucuucuggguuaaa

SEQ ID NO: 388499 - RNA, 32 nt, Human
cggcucaccgcaaccucugccucccaggugca

SEQ ID NO: 388500 - RNA, 32 nt, Human
cggcucaccgcaaccucugccucccggguuca

SEQ ID NO: 388501 - RNA, 32 nt, Human
cggcucaccgcaaccucugccuccuggguuca

SEQ ID NO: 388502 - RNA, 32 nt, Human
cggcucaccgcaaccucugcuuccuggcuuaa

SEQ ID NO: 388503 - RNA, 32 nt, Human
cggcucacgcauguaaucccagcacuuuggga

SEQ ID NO: 388504 - RNA, 32 nt, Human
cggcucacgccuguaacuccagcacuuuggga

SEQ ID NO: 388505 - RNA, 21 nt, Human
cggcucacgccuguaauccca

SEQ ID NO: 388506 - RNA, 32 nt, Human
cggcucacgccuguaaucccagaacuuuggga

SEQ ID NO: 388507 - RNA, 32 nt, Human
cggcucacgccuguaaucccagcacuuucgga

SEQ ID NO: 388508 - RNA, 32 nt, Human
cggcucacgccuguaaucccagcacuuuggga

SEQ ID NO: 388509 - RNA, 32 nt, Human
cggcucacgccuguaucccagcacuuuggaag

SEQ ID NO: 388510 - RNA, 32 nt, Human
cggcucacggcaaccuccaccucccggguuca

SEQ ID NO: 388511 - RNA, 32 nt, Human
cggcucacgguaaccucugccucccagguuca

SEQ ID NO: 388512 - RNA, 32 nt, Human
cggcucacgucuguaaucccagcacuuuggga

SEQ ID NO: 388513 - RNA, 32 nt, Human
cggcucacuacaaccaccaccuccugggucca

SEQ ID NO: 388514 - RNA, 32 nt, Human
cggcucacuacaaccuccaccuccuggguucc

SEQ ID NO: 388515 - RNA, 32 nt, Human
cggcucacuacaaccuccgccucccagguuca

SEQ ID NO: 388516 - RNA, 32 nt, Human
cggcucacuacaaccucugccucccagguuca

SEQ ID NO: 388517 - RNA, 32 nt, Human
cggcucacuacaagcucugccucccggguuca

SEQ ID NO: 388518 - RNA, 32 nt, Human
cggcucacuauaaccuccaccucccagguuca

SEQ ID NO: 388519 - RNA, 32 nt, Human
cggcucacuccaaccuccaccuacuagguuca

SEQ ID NO: 388520 - RNA, 32 nt, Human
cggcucacuccaaucuccaccucccggauuca

SEQ ID NO: 388521 - RNA, 32 nt, Human
cggcucacuccaccuccaccucccagguucaa

SEQ ID NO: 388522 - RNA, 32 nt, Human
cggcucacuccuguaaucccagcacuuuggga

SEQ ID NO: 388523 - RNA, 32 nt, Human
cggcucacugaaaccucugccucccggguuca

SEQ ID NO: 388524 - RNA, 32 nt, Human
cggcucacugaaaccucugccuuccagguuca

SEQ ID NO: 388525 - RNA, 32 nt, Human
cggcucacugaaaccugugccuccccgguucg

SEQ ID NO: 388526 - RNA, 32 nt, Human
cggcucacugaaacuucugccucccggguaca

SEQ ID NO: 388527 - RNA, 32 nt, Human
cggcucacugaaccuccgccucccagguucaa

SEQ ID NO: 388528 - RNA, 32 nt, Human
cggcucacugaaccuccgccucucagguucaa

SEQ ID NO: 388529 - RNA, 32 nt, Human
cggcucacugcaaaccgccucccggguucacg

SEQ ID NO: 388530 - RNA, 32 nt, Human
cggcucacugcaaacuccgccucccagguuca

SEQ ID NO: 388531 - RNA, 32 nt, Human
cggcucacugcaaacuccgccucccggguuca

SEQ ID NO: 388532 - RNA, 32 nt, Human
cggcucacugcaaacuccgccuuccagguuca

SEQ ID NO: 388533 - RNA, 32 nt, Human
cggcucacugcaaacucugccucccagguuca

SEQ ID NO: 388534 - RNA, 32 nt, Human
cggcucacugcaaacucugccucccggguuca

SEQ ID NO: 388535 - RNA, 32 nt, Human
cggcucacugcaaacucugccuccuggauuca

SEQ ID NO: 388536 - RNA, 32 nt, Human
cggcucacugcaaaucuccgccucccagguuc

SEQ ID NO: 388537 - RNA, 32 nt, Human
cggcucacugcaacauccaccuccuggguuca

SEQ ID NO: 388538 - RNA, 32 nt, Human
cggcucacugcaacauccagcuccuggguuuc

SEQ ID NO: 388539 - RNA, 32 nt, Human
cggcucacugcaaccaccaucucccaggagag

SEQ ID NO: 388540 - RNA, 32 nt, Human
cggcucacugcaaccacugccucccagguuca

SEQ ID NO: 388541 - RNA, 32 nt, Human
cggcucacugcaacccccacaucccggguuca

SEQ ID NO: 388542 - RNA, 32 nt, Human
cggcucacugcaacccccaucucccagguuca

SEQ ID NO: 388543 - RNA, 32 nt, Human
cggcucacugcaacccccgucucccggguuca

SEQ ID NO: 388544 - RNA, 32 nt, Human
cggcucacugcaaccucaccucccggguucaa

SEQ ID NO: 388545 - RNA, 18 nt, Human
cggcucacugcaaccucc

SEQ ID NO: 388546 - RNA, 32 nt, Human
cggcucacugcaaccuccaacucccagguuca

SEQ ID NO: 388547 - RNA, 32 nt, Human
cggcucacugcaaccuccaacucccugguuua

SEQ ID NO: 388548 - RNA, 32 nt, Human
cggcucacugcaaccuccacccccggggauca

SEQ ID NO: 388549 - RNA, 22 nt, Human
cggcucacugcaaccuccaccu

SEQ ID NO: 388550 - RNA, 32 nt, Human
cggcucacugcaaccuccaccucacagguuca

SEQ ID NO: 388551 - RNA, 32 nt, Human
cggcucacugcaaccuccaccucccagaagga

SEQ ID NO: 388552 - RNA, 32 nt, Human
cggcucacugcaaccuccaccucccagauuca

SEQ ID NO: 388553 - RNA, 32 nt, Human
cggcucacugcaaccuccaccucccaggucag

SEQ ID NO: 388554 - RNA, 32 nt, Human
cggcucacugcaaccuccaccucccagguuca

SEQ ID NO: 388555 - RNA, 32 nt, Human
cggcucacugcaaccuccaccuccccaguuca

SEQ ID NO: 388556 - RNA, 32 nt, Human
cggcucacugcaaccuccaccuccccggguuc

SEQ ID NO: 388557 - RNA, 32 nt, Human
cggcucacugcaaccuccaccucccgaguuca

SEQ ID NO: 388558 - RNA, 32 nt, Human
cggcucacugcaaccuccaccucccggauuca

SEQ ID NO: 388559 - RNA, 32 nt, Human
cggcucacugcaaccuccaccucccgggcuca

SEQ ID NO: 388560 - RNA, 32 nt, Human
cggcucacugcaaccuccaccucccggguuca

SEQ ID NO: 388561 - RNA, 32 nt, Human
cggcucacugcaaccuccaccucccggguucc

SEQ ID NO: 388562 - RNA, 32 nt, Human
cggcucacugcaaccuccaccuccuagguuca

SEQ ID NO: 388563 - RNA, 32 nt, Human
cggcucacugcaaccuccaccuccugaguuca

SEQ ID NO: 388564 - RNA, 32 nt, Human
cggcucacugcaaccuccaccuccuggauuca

SEQ ID NO: 388565 - RNA, 32 nt, Human
cggcucacugcaaccuccaccuccuggcuuca

SEQ ID NO: 388566 - RNA, 32 nt, Human
cggcucacugcaaccuccaccuccugggcuca

SEQ ID NO: 388567 - RNA, 32 nt, Human
cggcucacugcaaccuccaccuccuggguuca

SEQ ID NO: 388568 - RNA, 32 nt, Human
cggcucacugcaaccuccaccuccuggguuua

SEQ ID NO: 388569 - RNA, 32 nt, Human
cggcucacugcaaccuccaccuccugguucaa

SEQ ID NO: 388570 - RNA, 32 nt, Human
cggcucacugcaaccuccaccucucggcuuca

SEQ ID NO: 388571 - RNA, 32 nt, Human
cggcucacugcaaccuccaccuucaggguguc

SEQ ID NO: 388572 - RNA, 32 nt, Human
cggcucacugcaaccuccacuucuuggguuca

SEQ ID NO: 388573 - RNA, 32 nt, Human
cggcucacugcaaccuccagcucccagguuga

SEQ ID NO: 388574 - RNA, 32 nt, Human
cggcucacugcaaccuccgacuccuggguuca

SEQ ID NO: 388575 - RNA, 32 nt, Human
cggcucacugcaaccuccgcaucccggguuca

SEQ ID NO: 388576 - RNA, 32 nt, Human
cggcucacugcaaccuccgcccccuggguuua

SEQ ID NO: 388577 - RNA, 32 nt, Human
cggcucacugcaaccuccgccuaccggguuca

SEQ ID NO: 388578 - RNA, 32 nt, Human
cggcucacugcaaccuccgccucccaaguuca

SEQ ID NO: 388579 - RNA, 32 nt, Human
cggcucacugcaaccuccgccucccagguuca

SEQ ID NO: 388580 - RNA, 32 nt, Human
cggcucacugcaaccuccgccucccagguuga

SEQ ID NO: 388581 - RNA, 32 nt, Human
cggcucacugcaaccuccgccucccagguuua

SEQ ID NO: 388582 - RNA, 32 nt, Human
cggcucacugcaaccuccgccucccaguuuca

SEQ ID NO: 388583 - RNA, 32 nt, Human
cggcucacugcaaccuccgccucccggcuuca

SEQ ID NO: 388584 - RNA, 32 nt, Human
cggcucacugcaaccuccgccucccgggcuga

SEQ ID NO: 388585 - RNA, 32 nt, Human
cggcucacugcaaccuccgccucccggguuaa

SEQ ID NO: 388586 - RNA, 32 nt, Human
cggcucacugcaaccuccgccucccggguuca

SEQ ID NO: 388587 - RNA, 32 nt, Human
cggcucacugcaaccuccgccucccggguucg

SEQ ID NO: 388588 - RNA, 32 nt, Human
cggcucacugcaaccuccgccucccgguucaa

SEQ ID NO: 388589 - RNA, 32 nt, Human
cggcucacugcaaccuccgccucccugguuca

SEQ ID NO: 388590 - RNA, 32 nt, Human
cggcucacugcaaccuccgccuccugaguuca

SEQ ID NO: 388591 - RNA, 32 nt, Human
cggcucacugcaaccuccgccuccugggcuca

SEQ ID NO: 388592 - RNA, 32 nt, Human
cggcucacugcaaccuccgccuccuggguuca

SEQ ID NO: 388593 - RNA, 32 nt, Human
cggcucacugcaaccuccgccuccuugguucc

SEQ ID NO: 388594 - RNA, 32 nt, Human
cggcucacugcaaccuccgccuuccugaguuc

SEQ ID NO: 388595 - RNA, 32 nt, Human
cggcucacugcaaccuccgccuugcugguuga

SEQ ID NO: 388596 - RNA, 32 nt, Human
cggcucacugcaaccuccgccuuuccaccuuc

SEQ ID NO: 388597 - RNA, 32 nt, Human
cggcucacugcaaccuccgcucccuggguuca

SEQ ID NO: 388598 - RNA, 32 nt, Human
cggcucacugcaaccuccgucucccagguuca

SEQ ID NO: 388599 - RNA, 32 nt, Human
cggcucacugcaaccuccuccucccagaggua

SEQ ID NO: 388600 - RNA, 32 nt, Human
cggcucacugcaaccuccuccucccggguuca

SEQ ID NO: 388601 - RNA, 32 nt, Human
cggcucacugcaaccucgccucccugguucaa

SEQ ID NO: 388602 - RNA, 32 nt, Human
cggcucacugcaaccucuaccucccagguuca

SEQ ID NO: 388603 - RNA, 32 nt, Human
cggcucacugcaaccucuaccuccuggauuca

SEQ ID NO: 388604 - RNA, 32 nt, Human
cggcucacugcaaccucuaccuccuggguuca

SEQ ID NO: 388605 - RNA, 32 nt, Human
cggcucacugcaaccucugccacacggguuca

SEQ ID NO: 388606 - RNA, 32 nt, Human
cggcucacugcaaccucugccaucaggauuaa

SEQ ID NO: 388607 - RNA, 32 nt, Human
cggcucacugcaaccucugccucacggguuca

SEQ ID NO: 388608 - RNA, 32 nt, Human
cggcucacugcaaccucugccucccaaguuca

SEQ ID NO: 388609 - RNA, 32 nt, Human
cggcucacugcaaccucugccucccagguuca

SEQ ID NO: 388610 - RNA, 32 nt, Human
cggcucacugcaaccucugccucccagguucc

SEQ ID NO: 388611 - RNA, 32 nt, Human
cggcucacugcaaccucugccucccgaguuca

SEQ ID NO: 388612 - RNA, 32 nt, Human
cggcucacugcaaccucugccucccgcauuca

SEQ ID NO: 388613 - RNA, 32 nt, Human
cggcucacugcaaccucugccucccggauuca

SEQ ID NO: 388614 - RNA, 32 nt, Human
cggcucacugcaaccucugccucccggguuca

SEQ ID NO: 388615 - RNA, 32 nt, Human
cggcucacugcaaccucugccucccggguucg

SEQ ID NO: 388616 - RNA, 32 nt, Human
cggcucacugcaaccucugccucccguguuca

SEQ ID NO: 388617 - RNA, 32 nt, Human
cggcucacugcaaccucugccuccuagguuga

SEQ ID NO: 388618 - RNA, 32 nt, Human
cggcucacugcaaccucugccuccugagcuca

SEQ ID NO: 388619 - RNA, 32 nt, Human
cggcucacugcaaccucugccuccugaguuca

SEQ ID NO: 388620 - RNA, 32 nt, Human
cggcucacugcaaccucugccuccuggauuca

SEQ ID NO: 388621 - RNA, 32 nt, Human
cggcucacugcaaccucugccuccugggcuca

SEQ ID NO: 388622 - RNA, 32 nt, Human
cggcucacugcaaccucugccuccugggguuc

SEQ ID NO: 388623 - RNA, 32 nt, Human
cggcucacugcaaccucugccuccugggugca

SEQ ID NO: 388624 - RNA, 32 nt, Human
cggcucacugcaaccucugccuccuggguuca

SEQ ID NO: 388625 - RNA, 32 nt, Human
cggcucacugcaaccucugccuccuggguuua

SEQ ID NO: 388626 - RNA, 32 nt, Human
cggcucacugcaaccucugccucuuggguuca

SEQ ID NO: 388627 - RNA, 32 nt, Human
cggcucacugcaaccucugcuucccggguuca

SEQ ID NO: 388628 - RNA, 32 nt, Human
cggcucacugcaaccucugucuccugaguuca

SEQ ID NO: 388629 - RNA, 32 nt, Human
cggcucacugcaaccucugucuccuggguuca

SEQ ID NO: 388630 - RNA, 32 nt, Human
cggcucacugcaaccucugucuccuggguuua

SEQ ID NO: 388631 - RNA, 32 nt, Human
cggcucacugcaaccucugucuucuggguuca

SEQ ID NO: 388632 - RNA, 32 nt, Human
cggcucacugcaaccucuugccucccagguuc

SEQ ID NO: 388633 - RNA, 32 nt, Human
cggcucacugcaaccuggaacuccugggcuca

SEQ ID NO: 388634 - RNA, 32 nt, Human
cggcucacugcaaccugucucucagguugaag

SEQ ID NO: 388635 - RNA, 32 nt, Human
cggcucacugcaaccuucgccucuggguucaa

SEQ ID NO: 388636 - RNA, 32 nt, Human
cggcucacugcaaccuuugccuccuagguuca

SEQ ID NO: 388637 - RNA, 32 nt, Human
cggcucacugcaacguccgccucccggguuga

SEQ ID NO: 388638 - RNA, 32 nt, Human
cggcucacugcaacguccgccuccuggguuca

SEQ ID NO: 388639 - RNA, 32 nt, Human
cggcucacugcaacuaccaccuccuggguuca

SEQ ID NO: 388640 - RNA, 32 nt, Human
cggcucacugcaacuccaccucccggguucac

SEQ ID NO: 388641 - RNA, 32 nt, Human
cggcucacugcaacucugccucccggguucaa

SEQ ID NO: 388642 - RNA, 32 nt, Human
cggcucacugcaacuuccaccucccggguuca

SEQ ID NO: 388643 - RNA, 32 nt, Human
cggcucacugcaacuuccgccucccgguuuca

SEQ ID NO: 388644 - RNA, 32 nt, Human
cggcucacugcaacuuccgccuccugggauca

SEQ ID NO: 388645 - RNA, 32 nt, Human
cggcucacugcaacuucuaccaccuagguuca

SEQ ID NO: 388646 - RNA, 32 nt, Human
cggcucacugcaacuucugccucccggguuca

SEQ ID NO: 388647 - RNA, 32 nt, Human
cggcucacugcaacuucugccuccuagguuca

SEQ ID NO: 388648 - RNA, 32 nt, Human
cggcucacugcaagauccgccucccggguuca

SEQ ID NO: 388649 - RNA, 32 nt, Human
cggcucacugcaagcccugccuccuggguuca

SEQ ID NO: 388650 - RNA, 32 nt, Human
cggcucacugcaagcucagccuccccgauuca

SEQ ID NO: 388651 - RNA, 32 nt, Human
cggcucacugcaagcuccaccucccagguuca

SEQ ID NO: 388652 - RNA, 32 nt, Human
cggcucacugcaagcuccaccucccggguuca

SEQ ID NO: 388653 - RNA, 32 nt, Human
cggcucacugcaagcuccaccuccuggguuca

SEQ ID NO: 388654 - RNA, 32 nt, Human
cggcucacugcaagcuccaucucccagguuca

SEQ ID NO: 388655 - RNA, 32 nt, Human
cggcucacugcaagcuccgccucccagauuca

SEQ ID NO: 388656 - RNA, 32 nt, Human
cggcucacugcaagcuccgccucccaggauca

SEQ ID NO: 388657 - RNA, 32 nt, Human
cggcucacugcaagcuccgccucccagguuca

SEQ ID NO: 388658 - RNA, 32 nt, Human
cggcucacugcaagcuccgccucccggauuca

SEQ ID NO: 388659 - RNA, 32 nt, Human
cggcucacugcaagcuccgccucccggguuca

SEQ ID NO: 388660 - RNA, 32 nt, Human
cggcucacugcaagcuccgccucccggguucu

SEQ ID NO: 388661 - RNA, 32 nt, Human
cggcucacugcaagcuccgccuccuggguuca

SEQ ID NO: 388662 - RNA, 32 nt, Human
cggcucacugcaagcuccgccuccuggguuga

SEQ ID NO: 388663 - RNA, 32 nt, Human
cggcucacugcaagcuccgccucucggguuca

SEQ ID NO: 388664 - RNA, 32 nt, Human
cggcucacugcaagcuccggcucccagguuca

SEQ ID NO: 388665 - RNA, 32 nt, Human
cggcucacugcaagcucggccuccuggguuca

SEQ ID NO: 388666 - RNA, 32 nt, Human
cggcucacugcaagcucugccucccagguuca

SEQ ID NO: 388667 - RNA, 32 nt, Human
cggcucacugcaagcucugccucccgggcuca

SEQ ID NO: 388668 - RNA, 32 nt, Human
cggcucacugcaagcucugccucccggguuca

SEQ ID NO: 388669 - RNA, 32 nt, Human
cggcucacugcaagcucugccucccggguucc

SEQ ID NO: 388670 - RNA, 32 nt, Human
cggcucacugcaagcucugccucccgguugcu

SEQ ID NO: 388671 - RNA, 32 nt, Human
cggcucacugcaagcucugccucccguguuca

SEQ ID NO: 388672 - RNA, 32 nt, Human
cggcucacugcaagcucugccuccuggguuca

SEQ ID NO: 388673 - RNA, 32 nt, Human
cggcucacugcaagcucugccucucggguuca

SEQ ID NO: 388674 - RNA, 32 nt, Human
cggcucacugcaagcucugcguccuggguuga

SEQ ID NO: 388675 - RNA, 32 nt, Human
cggcucacugcaagcucugcuucccagguuca

SEQ ID NO: 388676 - RNA, 32 nt, Human
cggcucacugcaagcuucgccucccggguuca

SEQ ID NO: 388677 - RNA, 32 nt, Human
cggcucacugcaaguuccgccucccggguuca

SEQ ID NO: 388678 - RNA, 32 nt, Human
cggcucacugcaaucuccgccucccagguuca

SEQ ID NO: 388679 - RNA, 32 nt, Human
cggcucacugcaaucucugccucccaagcaau

SEQ ID NO: 388680 - RNA, 32 nt, Human
cggcucacugcaaucucugccucccagguuca

SEQ ID NO: 388681 - RNA, 32 nt, Human
cggcucacugcaaucucugccucccggauuca

SEQ ID NO: 388682 - RNA, 32 nt, Human
cggcucacugcaaucucugccucccggguuca

SEQ ID NO: 388683 - RNA, 32 nt, Human
cggcucacugcaaucucugccuccuggguuca

SEQ ID NO: 388684 - RNA, 32 nt, Human
cggcucacugcaauuugcgucucccaaguuca

SEQ ID NO: 388685 - RNA, 32 nt, Human
cggcucacugcacccucugccucuuggguuca

SEQ ID NO: 388686 - RNA, 32 nt, Human
cggcucacugcaccuccgccucccagguucaa

SEQ ID NO: 388687 - RNA, 32 nt, Human
cggcucacugcaccucugccuccuggauucac

SEQ ID NO: 388688 - RNA, 32 nt, Human
cggcucacugcaccuucugccuaccgaguuca

SEQ ID NO: 388689 - RNA, 32 nt, Human
cggcucacugcagccccugccucccaggcuca

SEQ ID NO: 388690 - RNA, 32 nt, Human
cggcucacugcagccucaaccuccuggacuca

SEQ ID NO: 388691 - RNA, 32 nt, Human
cggcucacugcagccucaaccuccugggcuaa

SEQ ID NO: 388692 - RNA, 32 nt, Human
cggcucacugcagccucaaccuccugggcuca

SEQ ID NO: 388693 - RNA, 32 nt, Human
cggcucacugcagccuccgccucccagguuca

SEQ ID NO: 388694 - RNA, 32 nt, Human
cggcucacugcagccucugccucccggguuca

SEQ ID NO: 388695 - RNA, 32 nt, Human
cggcucacugcagccugcgccucccagcgucc

SEQ ID NO: 388696 - RNA, 32 nt, Human
cggcucacugcagccuuugccucccggguuca

SEQ ID NO: 388697 - RNA, 32 nt, Human
cggcucacugcagcuucaaacuccugggcuca

SEQ ID NO: 388698 - RNA, 32 nt, Human
cggcucacugcaggcucugccuccuggguuca

SEQ ID NO: 388699 - RNA, 32 nt, Human
cggcucacugcagucucugccucccagaugga

SEQ ID NO: 388700 - RNA, 32 nt, Human
cggcucacugcaguuuugaccucccaggcuca

SEQ ID NO: 388701 - RNA, 32 nt, Human
cggcucacugcauccucaaccuccuggguuca

SEQ ID NO: 388702 - RNA, 20 nt, Human
cggcucacugcauccuccac

SEQ ID NO: 388703 - RNA, 32 nt, Human
cggcucacugcauccuccaccuccuggguuca

SEQ ID NO: 388704 - RNA, 32 nt, Human
cggcucacugcauccucugccucccggguuca

SEQ ID NO: 388705 - RNA, 32 nt, Human
cggcucacugcauccucugccuccuggguuca

SEQ ID NO: 388706 - RNA, 32 nt, Human
cggcucacugccaccucugccucccagguuca

SEQ ID NO: 388707 - RNA, 32 nt, Human
cggcucacugccgccucaaccucuccuggguu

SEQ ID NO: 388708 - RNA, 32 nt, Human
cggcucacugcgaccucugccucccagguuca

SEQ ID NO: 388709 - RNA, 32 nt, Human
cggcucacugcgagcuccaccucucggguuca

SEQ ID NO: 388710 - RNA, 32 nt, Human
cggcucacugcgagcucugccuccuggguuca

SEQ ID NO: 388711 - RNA, 32 nt, Human
cggcucacuguaaccuccaccuccuggguuca

SEQ ID NO: 388712 - RNA, 32 nt, Human
cggcucacuguaaccucugccuccugccuccc

SEQ ID NO: 388713 - RNA, 32 nt, Human
cggcucacuguagccucaaccugccagguuga

SEQ ID NO: 388714 - RNA, 32 nt, Human
cggcucacuguagccuccaccucccccaauca

SEQ ID NO: 388715 - RNA, 32 nt, Human
cggcucacuguagucucaaccuccugggcuca

SEQ ID NO: 388716 - RNA, 32 nt, Human
cggcucacuguagucucgaccucccaggcuca

SEQ ID NO: 388717 - RNA, 32 nt, Human
cggcucacugugaccucugccuccuggguuua

SEQ ID NO: 388718 - RNA, 32 nt, Human
cggcucagacauggcagagaucagcagagaau

SEQ ID NO: 388719 - RNA, 32 nt, Human
cggcucagaggcagcugcuccaugcagaacug

SEQ ID NO: 388720 - RNA, 32 nt, Human
cggcucagcagccuccaacuucucccgaaucc

SEQ ID NO: 388721 - RNA, 32 nt, Human
cggcucagccaaggacaaaggggccucgcaga

SEQ ID NO: 388722 - RNA, 21 nt, Human
cggcucagcccacagcacugu

SEQ ID NO: 388723 - RNA, 21 nt, Human
cggcucagccuccaagcccaa

SEQ ID NO: 388724 - RNA, 32 nt, Human
cggcucagcugaggcugucacaggaggagcug

SEQ ID NO: 388725 - RNA, 32 nt, Human
cggcucaggcccugcuugccccuucugccauc

SEQ ID NO: 388726 - RNA, 32 nt, Human
cggcucaggcucugcugguggaaagcgauuca

SEQ ID NO: 388727 - RNA, 32 nt, Human
cggcucagggcaucccucccauuccggcccuc

SEQ ID NO: 388728 - RNA, 32 nt, Human
cggcucaguaccgcuccagcagccugggcccc

SEQ ID NO: 388729 - RNA, 27 nt, Human
cggcucagugacagcaagagcaggaag

SEQ ID NO: 388730 - RNA, 32 nt, Human
cggcucagugcaaccucugccucccagguuga

SEQ ID NO: 388731 - RNA, 32 nt, Human
cggcucagugcaaccuugaccuccugggcuca

SEQ ID NO: 388732 - RNA, 32 nt, Human
cggcucaugccuguaaccucagcacuuuggga

SEQ ID NO: 388733 - RNA, 32 nt, Human
cggcucaugccuguaagcccaacacuuuggga

SEQ ID NO: 388734 - RNA, 32 nt, Human
cggcucaugccuguaaucccagcacuuuggca

SEQ ID NO: 388735 - RNA, 32 nt, Human
cggcucaugccuguaaucccagcacuuuggga

SEQ ID NO: 388736 - RNA, 32 nt, Human
cggcucaugccuguaaucccaggacuuuggua

SEQ ID NO: 388737 - RNA, 32 nt, Human
cggcucauggguugccauagagucuaggaaca

SEQ ID NO: 388738 - RNA, 32 nt, Human
cggcucauuacaaccuccaccucccggguuca

SEQ ID NO: 388739 - RNA, 32 nt, Human
cggcucauugcaaccuccaccuuccagauucu

SEQ ID NO: 388740 - RNA, 32 nt, Human
cggcucauugcaaccuccgccucccggguuca

SEQ ID NO: 388741 - RNA, 32 nt, Human
cggcucauugcaaccuccgccuccuggguuca

SEQ ID NO: 388742 - RNA, 32 nt, Human
cggcucauugcaaccuccgccuuccggguuca

SEQ ID NO: 388743 - RNA, 32 nt, Human
cggcucauugcaaccucugcuuccugggcuca

SEQ ID NO: 388744 - RNA, 32 nt, Human
cggcucauugcaagcuccgccucccagguuca

SEQ ID NO: 388745 - RNA, 32 nt, Human
cggcucauugcagccucgaccucccaggugau

SEQ ID NO: 388746 - RNA, 20 nt, Human
cggcuccacagcagguggug

SEQ ID NO: 388747 - RNA, 32 nt, Human
cggcuccaccaccauuucccucccgggccggg

SEQ ID NO: 388748 - RNA, 32 nt, Human
cggcuccacuacagacccagccccagguucaa

SEQ ID NO: 388749 - RNA, 32 nt, Human
cggcuccagcaacucuccucuggcgugacagc

SEQ ID NO: 388750 - RNA, 32 nt, Human
cggcuccaggagcuggaccccagugaccgugu

SEQ ID NO: 388751 - RNA, 32 nt, Human
cggcuccaggaggucacacagcagguuucugc

SEQ ID NO: 388752 - RNA, 32 nt, Human
cggcuccagggacucuuggggcgcagugggga

SEQ ID NO: 388753 - RNA, 32 nt, Human
cggcuccaggugggaggaaggcgggcgaagga

SEQ ID NO: 388754 - RNA, 32 nt, Human
cggcuccagucuccuaugugggggcuggggag

SEQ ID NO: 388755 - RNA, 32 nt, Human
cggcucccaacacccaugccaugggaccucag

SEQ ID NO: 388756 - RNA, 32 nt, Human
cggcucccacgcggggcugggccucggaguuu

SEQ ID NO: 388757 - RNA, 19 nt, Human
cggcucccaggcccugccc

SEQ ID NO: 388758 - RNA, 32 nt, Human
cggcucccccuuccuggucucccuucucccgc

SEQ ID NO: 388759 - RNA, 32 nt, Human
cggcuccccggccgccuccacccggggaacgc

SEQ ID NO: 388760 - RNA, 32 nt, Human
cggcucccugcaaccuccaccucccggguuca

SEQ ID NO: 388761 - RNA, 32 nt, Human
cggcucccugcaaccuccaccuccuggguuca

SEQ ID NO: 388762 - RNA, 32 nt, Human
cggcucccugcaaccuucgccucccggguuca

SEQ ID NO: 388763 - RNA, 32 nt, Human
cggcucccugcaaucuccaccucccagguuca

SEQ ID NO: 388764 - RNA, 23 nt, Human
cggcucccuuucagcagcugcgg

SEQ ID NO: 388765 - RNA, 29 nt, Human
cggcuccgcaaguggaacgagacaagcag

SEQ ID NO: 388766 - RNA, 32 nt, Human
cggcuccgcgcugcugugccugugaucccuac

SEQ ID NO: 388767 - RNA, 32 nt, Human
cggcuccgcuuccucaggcccugccggguccc

SEQ ID NO: 388768 - RNA, 20 nt, Human
cggcuccggcgcugcuccca

SEQ ID NO: 388769 - RNA, 22 nt, Human
cggcuccgggugacaccagccc

SEQ ID NO: 388770 - RNA, 22 nt, Human
cggcuccgugggaaccuccaac

SEQ ID NO: 388771 - RNA, 20 nt, Human
cggcuccuaagauccagccc

SEQ ID NO: 388772 - RNA, 32 nt, Human
cggcuccucaagguggugguugaggagacaga

SEQ ID NO: 388773 - RNA, 32 nt, Human
cggcuccucacuucccaguaggggcggccggg

SEQ ID NO: 388774 - RNA, 32 nt, Human
cggcuccucccuugcugaccugccccuugcuu

SEQ ID NO: 388775 - RNA, 32 nt, Human
cggcuccucccuugcugaccugcccguugcuu

SEQ ID NO: 388776 - RNA, 32 nt, Human
cggcuccucgccgcgucucugcccccacucca

SEQ ID NO: 388777 - RNA, 32 nt, Human
cggcuccucuccaggguaggccagcuugagga

SEQ ID NO: 388778 - RNA, 32 nt, Human
cggcuccucugccacccaccucccggggcugg

SEQ ID NO: 388779 - RNA, 32 nt, Human
cggcuccugaauugugcccacucccccaccuc

SEQ ID NO: 388780 - RNA, 32 nt, Human
cggcuccugcauucuggcaccacuugaacacg

SEQ ID NO: 388781 - RNA, 32 nt, Human
cggcuccugcugucuguccuuccccgucaugu

SEQ ID NO: 388782 - RNA, 32 nt, Human
cggcuccuggauccgcuccugccugcgcccgc

SEQ ID NO: 388783 - RNA, 32 nt, Human
cggcucgagagggaugucuggucagcccccag

SEQ ID NO: 388784 - RNA, 32 nt, Human
cggcucgaggacuccgcuuccuucccuccccu

SEQ ID NO: 388785 - RNA, 32 nt, Human
cggcucgcaggcacagauccuagaagucuguu

SEQ ID NO: 388786 - RNA, 32 nt, Human
cggcucgcuacaaccuccaccucccagcaacc

SEQ ID NO: 388787 - RNA, 32 nt, Human
cggcucgcugcaaacucugccucccagguuca

SEQ ID NO: 388788 - RNA, 32 nt, Human
cggcucgcugcaaccuccgccucccggguuca

SEQ ID NO: 388789 - RNA, 32 nt, Human
cggcucgcugcaaccuccuccuccuggguuca

SEQ ID NO: 388790 - RNA, 32 nt, Human
cggcucgcugcaaccucugacucccugguuca

SEQ ID NO: 388791 - RNA, 32 nt, Human
cggcucgcugcagccacugccuccuggguuca

SEQ ID NO: 388792 - RNA, 32 nt, Human
cggcucgcugcagccucugccuccuggguuca

SEQ ID NO: 388793 - RNA, 32 nt, Human
cggcucgcugcccgccuuccucaagcucugga

SEQ ID NO: 388794 - RNA, 32 nt, Human
cggcucgcugguaccggcagugccauggcggc

SEQ ID NO: 388795 - RNA, 32 nt, Human
cggcucgcuucagaugcucugaugcagagggc

SEQ ID NO: 388796 - RNA, 32 nt, Human
cggcucggcucugcgcugcuccggacggcugu

SEQ ID NO: 388797 - RNA, 32 nt, Human
cggcucuacugaaaaugcaaaaauuagccagg

SEQ ID NO: 388798 - RNA, 32 nt, Human
cggcucuaugcaaccuccaccuccuggguuca

SEQ ID NO: 388799 - RNA, 32 nt, Human
cggcucucaccucuccccugugcacccgcauc

SEQ ID NO: 388800 - RNA, 32 nt, Human
cggcucucaccuggcccugcuuccugcuugcc

SEQ ID NO: 388801 - RNA, 32 nt, Human
cggcucuccuggugggaagggauguugcucug

SEQ ID NO: 388802 - RNA, 32 nt, Human
cggcucucgccuguaaucccagcacuuuggga

SEQ ID NO: 388803 - RNA, 32 nt, Human
cggcucucuaggccguggagcuugccguccca

SEQ ID NO: 388804 - RNA, 32 nt, Human
cggcucucucugagacccaaggcugcaguccc

SEQ ID NO: 388805 - RNA, 32 nt, Human
cggcucucugacccucucugugcccucccccg

SEQ ID NO: 388806 - RNA, 19 nt, Human
cggcucucugauccagccc

SEQ ID NO: 388807 - RNA, 32 nt, Human
cggcucucugcaaccuccgccucccagguuca

SEQ ID NO: 388808 - RNA, 32 nt, Human
cggcucucugcaaccucugccucccggguuca

SEQ ID NO: 388809 - RNA, 32 nt, Human
cggcucucugcaaccucugucucccggguuca

SEQ ID NO: 388810 - RNA, 32 nt, Human
cggcucucugcaacuuccgccuccuggguuca

SEQ ID NO: 388811 - RNA, 32 nt, Human
cggcucucugcgcaggccgagugggcccagag

SEQ ID NO: 388812 - RNA, 31 nt, Human
cggcucugacacgucccuugcaaagucuccg

SEQ ID NO: 388813 - RNA, 32 nt, Human
cggcucugagccuggcccaucuuccuauuccc

SEQ ID NO: 388814 - RNA, 32 nt, Human
cggcucugagccuuauuucucuggaagcggcu

SEQ ID NO: 388815 - RNA, 32 nt, Human
cggcucugcaccaucccucacccagaccguag

SEQ ID NO: 388816 - RNA, 32 nt, Human
cggcucugcaccugucgccauccccggcuccc

SEQ ID NO: 388817 - RNA, 32 nt, Human
cggcucugcaggaagcugaagugagaggcccg

SEQ ID NO: 388818 - RNA, 32 nt, Human
cggcucugcgggcgccgccaggcccagaccaa

SEQ ID NO: 388819 - RNA, 32 nt, Human
cggcucuggggaauccuggugaauauagugcu

SEQ ID NO: 388820 - RNA, 32 nt, Human
cggcucugggggugggaaguggggcuaggucu

SEQ ID NO: 388821 - RNA, 32 nt, Human
cggcucuucacucccaacaauggcggcuccga

SEQ ID NO: 388822 - RNA, 32 nt, Human
cggcucuuccuguguggaggugaugguaccug

SEQ ID NO: 388823 - RNA, 32 nt, Human
cggcucuucucccggucccugaaacucggcug

SEQ ID NO: 388824 - RNA, 32 nt, Human
cggcucuucucgcuuccccggcggcggcaagg

SEQ ID NO: 388825 - RNA, 32 nt, Human
cggcucuugccuguaaucuuagcacuuuggga

SEQ ID NO: 388826 - RNA, 32 nt, Human
cggcucuuggagaaagcgugagcagggggcca

SEQ ID NO: 388827 - RNA, 32 nt, Human
cggcugaagaagaccuguuggacuggaucuuc

SEQ ID NO: 388828 - RNA, 18 nt, Human
cggcugaaggaccugcca

SEQ ID NO: 388829 - RNA, 19 nt, Human
cggcugaaggagcugucca

SEQ ID NO: 388830 - RNA, 32 nt, Human
cggcugaaggauuucuccccagcuggugcagu

SEQ ID NO: 388831 - RNA, 32 nt, Human
cggcugaccacaguggcuuggacugugagggu

SEQ ID NO: 388832 - RNA, 32 nt, Human
cggcugacugcaaacucugccucccagguuua

SEQ ID NO: 388833 - RNA, 32 nt, Human
cggcugacugcaaccacugccuccaggguuca

SEQ ID NO: 388834 - RNA, 32 nt, Human
cggcugacugcaaccuccaccucccgggugca

SEQ ID NO: 388835 - RNA, 32 nt, Human
cggcugacugcaaccuccaccuccuggguuca

SEQ ID NO: 388836 - RNA, 32 nt, Human
cggcugacugccuggagcugguguuuuuccug

SEQ ID NO: 388837 - RNA, 32 nt, Human
cggcugagaaggagguucuuccgcgagagaag

SEQ ID NO: 388838 - RNA, 32 nt, Human
cggcugagagugacagagaauccagaauagcu

SEQ ID NO: 388839 - RNA, 32 nt, Human
cggcugagauggcgccaucacacuccagccug

SEQ ID NO: 388840 - RNA, 32 nt, Human
cggcugagcuaacuccccagagccaaagugga

SEQ ID NO: 388841 - RNA, 32 nt, Human
cggcugaggaggcgggaaggcggcagugguug

SEQ ID NO: 388842 - RNA, 32 nt, Human
cggcugagggagcgggacagggucagcggcga

SEQ ID NO: 388843 - RNA, 32 nt, Human
cggcugaggggcugaggggcugaggggcgggc

SEQ ID NO: 388844 - RNA, 18 nt, Human
cggcugaggucugcauug

SEQ ID NO: 388845 - RNA, 32 nt, Human
cggcugaguuaccagagccucugccucuuccu

SEQ ID NO: 388846 - RNA, 32 nt, Human
cggcugauuagcaaccuucauuccaucugccu

SEQ ID NO: 388847 - RNA, 32 nt, Human
cggcugcacccaggcugugaccucagcugacg

SEQ ID NO: 388848 - RNA, 19 nt, Human
cggcugcagaccaccagac

SEQ ID NO: 388849 - RNA, 32 nt, Human
cggcugcagagcagagaugugcagcccucugg

SEQ ID NO: 388850 - RNA, 32 nt, Human
cggcugcagagccugggcucagccccagggag

SEQ ID NO: 388851 - RNA, 32 nt, Human
cggcugcagagggagcacuguggcugccaucc

SEQ ID NO: 388852 - RNA, 32 nt, Human
cggcugcagccugagguguguccugggcuccu

SEQ ID NO: 388853 - RNA, 32 nt, Human
cggcugcaggggcaggagaggaagggaccggc

SEQ ID NO: 388854 - RNA, 32 nt, Human
cggcugcaggggccaacaagaggucagcuuug

SEQ ID NO: 388855 - RNA, 32 nt, Human
cggcugccagaggcacaauccggaaccgcccc

SEQ ID NO: 388856 - RNA, 32 nt, Human
cggcugccagcacuagguccugggcagcuuug

SEQ ID NO: 388857 - RNA, 26 nt, Human
cggcugccagcagcacagcugccaag

SEQ ID NO: 388858 - RNA, 32 nt, Human
cggcugccagccucgggccaucagccuaggag

SEQ ID NO: 388859 - RNA, 19 nt, Human
cggcugccaggcccagccc

SEQ ID NO: 388860 - RNA, 32 nt, Human
cggcugccagucugcacggccucggcacggcg

SEQ ID NO: 388861 - RNA, 20 nt, Human
cggcugccggcuccacgccc

SEQ ID NO: 388862 - RNA, 23 nt, Human
cggcugccucaccuggccacagc

SEQ ID NO: 388863 - RNA, 23 nt, Human
cggcugccuccagaccacaggac

SEQ ID NO: 388864 - RNA, 32 nt, Human
cggcugccuccuccucuuccuggcugcaggga

SEQ ID NO: 388865 - RNA, 24 nt, Human
cggcugccucugcccccacagcac

SEQ ID NO: 388866 - RNA, 32 nt, Human
cggcugccugugacaguuucucagccaggcag

SEQ ID NO: 388867 - RNA, 32 nt, Human
cggcugcgcauguccagaagcauuuccuuccu

SEQ ID NO: 388868 - RNA, 21 nt, Human
cggcugcgugaccucgggagg

SEQ ID NO: 388869 - RNA, 32 nt, Human
cggcugcuaaccccucuccucgcccugcuccc

SEQ ID NO: 388870 - RNA, 19 nt, Human
cggcugcuacaacaccaaa

SEQ ID NO: 388871 - RNA, 23 nt, Human
cggcugcuacagcuuuuucacuc

SEQ ID NO: 388872 - RNA, 32 nt, Human
cggcugcuccaguucauggccucccaggggug

SEQ ID NO: 388873 - RNA, 32 nt, Human
cggcugcuccucucacagacccucuuuggccc

SEQ ID NO: 388874 - RNA, 21 nt, Human
cggcugcucgugccugagcua

SEQ ID NO: 388875 - RNA, 32 nt, Human
cggcugcugcagcugcugaacaaggccuugcc

SEQ ID NO: 388876 - RNA, 23 nt, Human
cggcugcugcccuucucugggca

SEQ ID NO: 388877 - RNA, 32 nt, Human
cggcugcugccuggggcccuuuccugcucucc

SEQ ID NO: 388878 - RNA, 24 nt, Human
cggcugcuggcugacaucacgcac

SEQ ID NO: 388879 - RNA, 32 nt, Human
cggcugcuggugccuuucuucccaccucgcuu

SEQ ID NO: 388880 - RNA, 32 nt, Human
cggcugcuguaacuugugccuccuagcggauc

SEQ ID NO: 388881 - RNA, 32 nt, Human
cggcugcugucacuuggcucucuggcuggagc

SEQ ID NO: 388882 - RNA, 32 nt, Human
cggcugcugugaucagcacaaggaccgccgca

SEQ ID NO: 388883 - RNA, 32 nt, Human
cggcugcuuccagaguaagcagucuuuauggg

SEQ ID NO: 388884 - RNA, 25 nt, Human
cggcugcuucugagugguucuuuca

SEQ ID NO: 388885 - RNA, 22 nt, Human
cggcugcuucuguuuuuucauu

SEQ ID NO: 388886 - RNA, 32 nt, Human
cggcugcuuuuauguaguuuaggcuggaaaug

SEQ ID NO: 388887 - RNA, 32 nt, Human
cggcuggaaaaggauugcugugugcuagacuu

SEQ ID NO: 388888 - RNA, 32 nt, Human
cggcuggaaagaggagaaggagagggaguaca

SEQ ID NO: 388889 - RNA, 32 nt, Human
cggcuggaaggguaggcuucauucaccgcucg

SEQ ID NO: 388890 - RNA, 32 nt, Human
cggcuggacagaauuuuauacccacaucuggg

SEQ ID NO: 388891 - RNA, 32 nt, Human
cggcuggacaguuuuacaucucagggaagggc

SEQ ID NO: 388892 - RNA, 32 nt, Human
cggcuggagcaaagucaaagucaugcagcaaa

SEQ ID NO: 388893 - RNA, 32 nt, Human
cggcuggaggagcaucgguccgggaggucucu

SEQ ID NO: 388894 - RNA, 32 nt, Human
cggcuggaggccggaaggucaccccguccccg

SEQ ID NO: 388895 - RNA, 32 nt, Human
cggcuggcacccacuccugggcugcucagagc

SEQ ID NO: 388896 - RNA, 32 nt, Human
cggcuggccauggagaaagcugacuuggcugg

SEQ ID NO: 388897 - RNA, 32 nt, Human
cggcuggcggcuggcuagccugggcggccuga

SEQ ID NO: 388898 - RNA, 32 nt, Human
cggcuggcucacugucuccaguucucaauggc

SEQ ID NO: 388899 - RNA, 32 nt, Human
cggcuggcugggacuuggcugugggugggaug

SEQ ID NO: 388900 - RNA, 32 nt, Human
cggcugggacgggaaccuuccacccacagcua

SEQ ID NO: 388901 - RNA, 32 nt, Human
cggcugggacucuuccaugcaguugaaacugg

SEQ ID NO: 388902 - RNA, 32 nt, Human
cggcugggaggcagccgucugugcagcgagca

SEQ ID NO: 388903 - RNA, 19 nt, Human
cggcugggagggugggguc

SEQ ID NO: 388904 - RNA, 32 nt, Human
cggcugggcccaggcuguggcaugauggccgg

SEQ ID NO: 388905 - RNA, 32 nt, Human
cggcugggcgggcgggggcgggcaggcggacg

SEQ ID NO: 388906 - RNA, 32 nt, Human
cggcugggcggggagagccgacggccgcggcg

SEQ ID NO: 388907 - RNA, 32 nt, Human
cggcugggcuccugggcugccuucagugucuu

SEQ ID NO: 388908 - RNA, 32 nt, Human
cggcugggcuuggucccaggagcagggagagu

SEQ ID NO: 388909 - RNA, 32 nt, Human
cggcuggggaaaagggaggaguuagacucugg

SEQ ID NO: 388910 - RNA, 32 nt, Human
cggcuggggcugaccacacuagcaccggggga

SEQ ID NO: 388911 - RNA, 32 nt, Human
cggcugggggcaggccagaggccuccacagug

SEQ ID NO: 388912 - RNA, 32 nt, Human
cggcugggucuggggcucgggcucaggcucgc

SEQ ID NO: 388913 - RNA, 32 nt, Human
cggcuggucagccugguccuccugggcucccu

SEQ ID NO: 388914 - RNA, 32 nt, Human
cggcuggucccaagggucaggaagauggauuc

SEQ ID NO: 388915 - RNA, 32 nt, Human
cggcuggugaaugacacauacagcuguacaaa

SEQ ID NO: 388916 - RNA, 32 nt, Human
cggcuggugacugauggauggguagugggcug

SEQ ID NO: 388917 - RNA, 32 nt, Human
cggcuguaaagauggcggcuuccuagugaguc

SEQ ID NO: 388918 - RNA, 32 nt, Human
cggcuguaacugugaggaaggcugcagagugg

SEQ ID NO: 388919 - RNA, 20 nt, Human
cggcuguaaucccagcacuu

SEQ ID NO: 388920 - RNA, 32 nt, Human
cggcuguaauggcugcccccagcuggcgcggg

SEQ ID NO: 388921 - RNA, 32 nt, Human
cggcuguaaugguuccaugggcgggggugggg

SEQ ID NO: 388922 - RNA, 32 nt, Human
cggcuguaggggucgagcaggaugcgcacgca

SEQ ID NO: 388923 - RNA, 23 nt, Human
cggcugucccaaccaagcugcca

SEQ ID NO: 388924 - RNA, 32 nt, Human
cggcugucuugccucuugucauugucuguccc

SEQ ID NO: 388925 - RNA, 32 nt, Human
cggcugugagccaagagccgcggagcacgccg

SEQ ID NO: 388926 - RNA, 32 nt, Human
cggcugugagcugcgcucuccacgccggcucc

SEQ ID NO: 388927 - RNA, 32 nt, Human
cggcugugaucuggggaaggagggaaacccaa

SEQ ID NO: 388928 - RNA, 24 nt, Human
cggcugugccccgucugaccaaag

SEQ ID NO: 388929 - RNA, 32 nt, Human
cggcugugcgcucccugcucccacgggccggu

SEQ ID NO: 388930 - RNA, 32 nt, Human
cggcugugcucuucugggagguucccgcuugc

SEQ ID NO: 388931 - RNA, 32 nt, Human
cggcugugggcagaggcugcggggccuaaaau

SEQ ID NO: 388932 - RNA, 32 nt, Human
cggcugugggccugcugggggugggggcccga

SEQ ID NO: 388933 - RNA, 32 nt, Human
cggcugugucagaggcaagcaaacaaguauua

SEQ ID NO: 388934 - RNA, 21 nt, Human
cggcuguguggcagcgggggg

SEQ ID NO: 388935 - RNA, 24 nt, Human
cggcuguuacaguucuuucauuca

SEQ ID NO: 388936 - RNA, 30 nt, Human
cggcuguugaccaccagacaccugaccgca

SEQ ID NO: 388937 - RNA, 32 nt, Human
cggcuguugaugccaugaaugaaauggcuggu

SEQ ID NO: 388938 - RNA, 32 nt, Human
cggcuguugcagcugcugcggagaugcuccaa

SEQ ID NO: 388939 - RNA, 19 nt, Human
cggcuguuucuuuuuauuu

SEQ ID NO: 388940 - RNA, 32 nt, Human
cggcuguuuucguugucugcacacagagcagu

SEQ ID NO: 388941 - RNA, 32 nt, Human
cggcuuaacuccgccucaccgagcccagucca

SEQ ID NO: 388942 - RNA, 32 nt, Human
cggcuuacuacgaccucugccuccuggguuca

SEQ ID NO: 388943 - RNA, 32 nt, Human
cggcuuacugaaaccucugccucccagguuca

SEQ ID NO: 388944 - RNA, 32 nt, Human
cggcuuacugcaaccuccaccucccaggugca

SEQ ID NO: 388945 - RNA, 32 nt, Human
cggcuuacugcaaccuccaccucccggguuca

SEQ ID NO: 388946 - RNA, 32 nt, Human
cggcuuacugcaaccuccgccuacuggguuca

SEQ ID NO: 388947 - RNA, 32 nt, Human
cggcuuacugcaaccuccgccuucccagauuc

SEQ ID NO: 388948 - RNA, 32 nt, Human
cggcuuacugcaaccuuugccucccagguuua

SEQ ID NO: 388949 - RNA, 32 nt, Human
cggcuuacugcaacuuccagcuccuggguucg

SEQ ID NO: 388950 - RNA, 32 nt, Human
cggcuuacugcaagcuccgccucccagguuca

SEQ ID NO: 388951 - RNA, 32 nt, Human
cggcuuauggcaaccuccgccucccggguuca

SEQ ID NO: 388952 - RNA, 32 nt, Human
cggcuuauugcaaccuccgcuuccuggguuca

SEQ ID NO: 388953 - RNA, 20 nt, Human
cggcuucaccggcucagccc

SEQ ID NO: 388954 - RNA, 32 nt, Human
cggcuucacuaauaagaaggaacucacacuua

SEQ ID NO: 388955 - RNA, 32 nt, Human
cggcuucagcacuccgggcugcaguaagaagu

SEQ ID NO: 388956 - RNA, 32 nt, Human
cggcuucaugccauucucguccuucagccucc

SEQ ID NO: 388957 - RNA, 32 nt, Human
cggcuuccacaucugcacaucugggagacaaa

SEQ ID NO: 388958 - RNA, 32 nt, Human
cggcuuccccagaagccugggcuuagggugga

SEQ ID NO: 388959 - RNA, 32 nt, Human
cggcuuccuagacucuggcccugccacaccaa

SEQ ID NO: 388960 - RNA, 32 nt, Human
cggcuuccucacccuauguccuuuauuuacaa

SEQ ID NO: 388961 - RNA, 32 nt, Human
cggcuuccuccacauggaggucccaggaagac

SEQ ID NO: 388962 - RNA, 32 nt, Human
cggcuuccuccaccagcgccugccucggcccc

SEQ ID NO: 388963 - RNA, 32 nt, Human
cggcuuccugguagcugggacuagagaugugu

SEQ ID NO: 388964 - RNA, 32 nt, Human
cggcuucgcccaccaucucccuaccauggacc

SEQ ID NO: 388965 - RNA, 32 nt, Human
cggcuucggaaggugggcucugcagcgggacc

SEQ ID NO: 388966 - RNA, 32 nt, Human
cggcuucucaugcuauuucuaccucacuuugg

SEQ ID NO: 388967 - RNA, 32 nt, Human
cggcuucuccaucuuccucgucuggacggugg

SEQ ID NO: 388968 - RNA, 18 nt, Human
cggcuucucccuggacuc

SEQ ID NO: 388969 - RNA, 19 nt, Human
cggcuucucugauucucca

SEQ ID NO: 388970 - RNA, 32 nt, Human
cggcuucugcuaggaccccaccgggugugguu

SEQ ID NO: 388971 - RNA, 32 nt, Human
cggcuucugucccaggcaucucaggccuuggc

SEQ ID NO: 388972 - RNA, 32 nt, Human
cggcuucuuccucugugcuggucaugaaaguu

SEQ ID NO: 388973 - RNA, 32 nt, Human
cggcuugaggcccgcggggagcgcggcgcaau

SEQ ID NO: 388974 - RNA, 32 nt, Human
cggcuugaguggcugcuucuccucacugcuca

SEQ ID NO: 388975 - RNA, 32 nt, Human
cggcuugccucucucccuccucccucgcucuc

SEQ ID NO: 388976 - RNA, 32 nt, Human
cggcuugccuguaaucccagcacuuugggagg

SEQ ID NO: 388977 - RNA, 22 nt, Human
cggcuugcuaaucuccacgccc

SEQ ID NO: 388978 - RNA, 32 nt, Human
cggcuuguaggaccucacaggaacccaagccu

SEQ ID NO: 388979 - RNA, 32 nt, Human
cggcuuguauuuuuaugagggaauucugcagc

SEQ ID NO: 388980 - RNA, 32 nt, Human
cggcuuguccuccucuggcgcucagcucccuc

SEQ ID NO: 388981 - RNA, 32 nt, Human
cggcuugugcugcucugcgcucuccgcuucgc

SEQ ID NO: 388982 - RNA, 32 nt, Human
cggcuuugccgucugcgcuccagccuucgccu

SEQ ID NO: 388983 - RNA, 31 nt, Human
cggcuuuggugagggcgccuccauuugugaa

SEQ ID NO: 388984 - RNA, 32 nt, Human
cggcuuuguccaguucaaaauggcagaaaagg

SEQ ID NO: 388985 - RNA, 32 nt, Human
cggcuuuucagccucagugcugcggcagaggc

SEQ ID NO: 388986 - RNA, 32 nt, Human
cggcuuuuccucacuccugguaaccaauacaa

SEQ ID NO: 388987 - RNA, 32 nt, Human
cggcuuuugcagcauuagccuacaagcuuugu

SEQ ID NO: 388988 - RNA, 32 nt, Human
cggcuuuuguugucuccgccuccucggccgcc

SEQ ID NO: 388989 - RNA, 32 nt, Human
cgggaaaacagaccagccacacacaaggggca

SEQ ID NO: 388990 - RNA, 32 nt, Human
cgggaaaacagcuuucagaagcuugaggccga

SEQ ID NO: 388991 - RNA, 32 nt, Human
cgggaaaagugaggggacggaggcgcccaagc

SEQ ID NO: 388992 - RNA, 32 nt, Human
cgggaaagaggugagaggaugggaaggagcag

SEQ ID NO: 388993 - RNA, 32 nt, Human
cgggaaagaugccauauauucacuggguggca

SEQ ID NO: 388994 - RNA, 32 nt, Human
cgggaaagcagccagcacaaagggcccaggaa

SEQ ID NO: 388995 - RNA, 32 nt, Human
cgggaaaggagcugcuuucuucccucacuuuu

SEQ ID NO: 388996 - RNA, 32 nt, Human
cgggaaaggggaagaaugcaggagggguagga

SEQ ID NO: 388997 - RNA, 28 nt, Human
cgggaaauggaugaaaagaggcugcugg

SEQ ID NO: 388998 - RNA, 20 nt, Human
cgggaaauggcgacuggcug

SEQ ID NO: 388999 - RNA, 32 nt, Human
cgggaaaugguguggagguuccggggagcccu

SEQ ID NO: 389000 - RNA, 32 nt, Human
cgggaacacacguguguggcucaggaggaaaa

SEQ ID NO: 389001 - RNA, 32 nt, Human
cgggaacacggaggggaaggaggaggagcuua

SEQ ID NO: 389002 - RNA, 32 nt, Human
cgggaacagagaaguguggggaagagauagga

SEQ ID NO: 389003 - RNA, 20 nt, Human
cgggaacagcaggcagcugc

SEQ ID NO: 389004 - RNA, 32 nt, Human
cgggaacauccaaggcaagacuggcacccagc

SEQ ID NO: 389005 - RNA, 32 nt, Human
cgggaacccaggaggcagagguugcagugagc

SEQ ID NO: 389006 - RNA, 32 nt, Human
cgggaacccaggcggagacccgaggcucucgc

SEQ ID NO: 389007 - RNA, 32 nt, Human
cgggaacccaggcugcagcccccacccccgcg

SEQ ID NO: 389008 - RNA, 25 nt, Human
cgggaacccccgacaggggucgcug

SEQ ID NO: 389009 - RNA, 32 nt, Human
cgggaacccuuaggauccccucuguccacgag

SEQ ID NO: 389010 - RNA, 32 nt, Human
cgggaaccggggaccgagaggagcagcagcgg

SEQ ID NO: 389011 - RNA, 32 nt, Human
cgggaaccucagcaaccucugccggcuccucg

SEQ ID NO: 389012 - RNA, 32 nt, Human
cgggaaccucauucucaguagcuacagauuuc

SEQ ID NO: 389013 - RNA, 32 nt, Human
cgggaaccugggaggcggagcuuacagugaac

SEQ ID NO: 389014 - RNA, 32 nt, Human
cgggaacgagaaagacagagcagggaaacgug

SEQ ID NO: 389015 - RNA, 18 nt, Human
cgggaacggcggcggggg

SEQ ID NO: 389016 - RNA, 32 nt, Human
cgggaacgucagcaaccucugccggcuccucg

SEQ ID NO: 389017 - RNA, 32 nt, Human
cgggaagaagcaguggcagcuaccuccagaga

SEQ ID NO: 389018 - RNA, 22 nt, Human
cgggaagaccgcagaggccucg

SEQ ID NO: 389019 - RNA, 23 nt, Human
cgggaagacgccagaggccagcu

SEQ ID NO: 389020 - RNA, 32 nt, Human
cgggaagaggcagagggaggcagccagcgggg

SEQ ID NO: 389021 - RNA, 32 nt, Human
cgggaagagggugggagagccagagcaaagag

SEQ ID NO: 389022 - RNA, 24 nt, Human
cgggaagaggucugauggcuggga

SEQ ID NO: 389023 - RNA, 32 nt, Human
cgggaagcagaggccgccgccggccacagucg

SEQ ID NO: 389024 - RNA, 20 nt, Human
cgggaagccagccucaggga

SEQ ID NO: 389025 - RNA, 32 nt, Human
cgggaagccagccuccgcagccaccgugaaga

SEQ ID NO: 389026 - RNA, 32 nt, Human
cgggaagcugagguaggagaaucucucuuuuu

SEQ ID NO: 389027 - RNA, 32 nt, Human
cgggaaggaacagccagagcuuccaugugcca

SEQ ID NO: 389028 - RNA, 32 nt, Human
cgggaaggagagaaggagaagaguugcgacaa

SEQ ID NO: 389029 - RNA, 32 nt, Human
cgggaaggaggagagcgccugacgccgacccg

SEQ ID NO: 389030 - RNA, 32 nt, Human
cgggaaggaggcaggugcaggugcaggaggga

SEQ ID NO: 389031 - RNA, 32 nt, Human
cgggaaggcaugccagccugggcgaugcugca

SEQ ID NO: 389032 - RNA, 32 nt, Human
cgggaaggcggcagugguugaaggggugauug

SEQ ID NO: 389033 - RNA, 32 nt, Human
cgggaaggcuugcuuuuucuccaugucuccca

SEQ ID NO: 389034 - RNA, 32 nt, Human
cgggaagggagcgcgguggccgccaccgccac

SEQ ID NO: 389035 - RNA, 32 nt, Human
cgggaagggccgacgccgccugacuggcuugg

SEQ ID NO: 389036 - RNA, 32 nt, Human
cgggaagggcuggggccagcuucuuccuccua

SEQ ID NO: 389037 - RNA, 32 nt, Human
cgggaaggggagcaagauggacaagacuggcc

SEQ ID NO: 389038 - RNA, 23 nt, Human
cgggaaggggaggcuugauccug

SEQ ID NO: 389039 - RNA, 32 nt, Human
cgggaaggggcagaggccgugagcucucagcu

SEQ ID NO: 389040 - RNA, 22 nt, Human
cgggaaguggagguugcaguga

SEQ ID NO: 389041 - RNA, 23 nt, Human
cgggaaguggagguugcagugag

SEQ ID NO: 389042 - RNA, 32 nt, Human
cgggaaguggccaguucaggaggcggaccccc

SEQ ID NO: 389043 - RNA, 32 nt, Human
cgggaaucaccccagggauucguaggcuaggu

SEQ ID NO: 389044 - RNA, 32 nt, Human
cgggaaucaggaaagggugggguccagcugca

SEQ ID NO: 389045 - RNA, 32 nt, Human
cgggaaucugggaggcgagcagcucugcaguu

SEQ ID NO: 389046 - RNA, 31 nt, Human
cgggaauggguggaggccgggggaauaaaaa

SEQ ID NO: 389047 - RNA, 32 nt, Human
cgggacaaagagacuguugguaacuguggauu

SEQ ID NO: 389048 - RNA, 32 nt, Human
cgggacaagccuggccacccucgcugugauga

SEQ ID NO: 389049 - RNA, 32 nt, Human
cgggacaaucaaaauauauacacccuucaccu

SEQ ID NO: 389050 - RNA, 32 nt, Human
cgggacacaaucagcuuuaaccaauggaugag

SEQ ID NO: 389051 - RNA, 32 nt, Human
cgggacacagaauuauagaugucugagcacgg

SEQ ID NO: 389052 - RNA, 32 nt, Human
cgggacacuuuugugcguuccucuccagagcg

SEQ ID NO: 389053 - RNA, 32 nt, Human
cgggacagaaggaucaccuugaggccaggagu

SEQ ID NO: 389054 - RNA, 20 nt, Human
cgggacagagaagggacagg

SEQ ID NO: 389055 - RNA, 32 nt, Human
cgggacagaggaccauuacaacuagaucaagg

SEQ ID NO: 389056 - RNA, 32 nt, Human
cgggacagccaaguugcugggcccagcugaac

SEQ ID NO: 389057 - RNA, 32 nt, Human
cgggacagcuguuccuuugggcugcagaaacu

SEQ ID NO: 389058 - RNA, 32 nt, Human
cgggacaggagaagggggcugagcuccuguuc

SEQ ID NO: 389059 - RNA, 32 nt, Human
cgggacaggagccuggaaucagcuggagaaca

SEQ ID NO: 389060 - RNA, 32 nt, Human
cgggacaggcacacaggcccagguguguaggc

SEQ ID NO: 389061 - RNA, 32 nt, Human
cgggacaggcccagccccagagcccagagaug

SEQ ID NO: 389062 - RNA, 32 nt, Human
cgggacaggccuccuuggcaagaggaaugacc

SEQ ID NO: 389063 - RNA, 32 nt, Human
cgggacaggccugggcuggggcaguuggaggu

SEQ ID NO: 389064 - RNA, 32 nt, Human
cgggacagggcugaggccugcgggggaagacc

SEQ ID NO: 389065 - RNA, 32 nt, Human
cgggacaggugggcaggacugacccugaggag

SEQ ID NO: 389066 - RNA, 32 nt, Human
cgggaccaaauuucugcagaggccuugccgga

SEQ ID NO: 389067 - RNA, 32 nt, Human
cgggaccaaggacggcugcaggaugugguguc

SEQ ID NO: 389068 - RNA, 32 nt, Human
cgggaccaagggacaacaagagcucaggagaa

SEQ ID NO: 389069 - RNA, 32 nt, Human
cgggaccaggaggaggaggaggaggaggagga

SEQ ID NO: 389070 - RNA, 32 nt, Human
cgggaccaucuucucggccaucuccugcuucu

SEQ ID NO: 389071 - RNA, 32 nt, Human
cgggacccaagaggagcaggcagggacggggg

SEQ ID NO: 389072 - RNA, 32 nt, Human
cgggacccagcuguagugagguugcagugauu

SEQ ID NO: 389073 - RNA, 32 nt, Human
cgggacccgccagcuucagccuccagggccug

SEQ ID NO: 389074 - RNA, 32 nt, Human
cgggacccggucucugccuccuggcugcccuc

SEQ ID NO: 389075 - RNA, 32 nt, Human
cgggacccguuggcagagguggcggcggcggc

SEQ ID NO: 389076 - RNA, 32 nt, Human
cgggacccucuucauucucugaucucauccug

SEQ ID NO: 389077 - RNA, 32 nt, Human
cgggacccugcacuccgucgccggaagugcca

SEQ ID NO: 389078 - RNA, 32 nt, Human
cgggacccugccugugacucuccaggacucug

SEQ ID NO: 389079 - RNA, 18 nt, Human
cgggacccugcuggaccc

SEQ ID NO: 389080 - RNA, 32 nt, Human
cgggaccgcuuugcagagaccagaggcauauc

SEQ ID NO: 389081 - RNA, 21 nt, Human
cgggaccggcagcagcagcag

SEQ ID NO: 389082 - RNA, 32 nt, Human
cgggaccgugucccccuucaucccccuagaac

SEQ ID NO: 389083 - RNA, 32 nt, Human
cgggaccugagcgcgaggagccugagugcggg

SEQ ID NO: 389084 - RNA, 32 nt, Human
cgggaccugcagcccgccaugccugagccucc

SEQ ID NO: 389085 - RNA, 32 nt, Human
cgggaccugcagcccuccaugccugacccucc

SEQ ID NO: 389086 - RNA, 32 nt, Human
cgggaccugcagccgccgccguccccggagca

SEQ ID NO: 389087 - RNA, 32 nt, Human
cgggaccugccacucgcaucugggcaauguug

SEQ ID NO: 389088 - RNA, 32 nt, Human
cgggaccugccugagggcucccugcugcaguu

SEQ ID NO: 389089 - RNA, 32 nt, Human
cgggaccugcugcugcuccagccauguccaug

SEQ ID NO: 389090 - RNA, 32 nt, Human
cgggaccugcuggccucaggaggcaggcagag

SEQ ID NO: 389091 - RNA, 32 nt, Human
cgggaccuggugcugaucagaguggcugcugc

SEQ ID NO: 389092 - RNA, 32 nt, Human
cgggaccuuccaccucuccaacauuguccccu

SEQ ID NO: 389093 - RNA, 32 nt, Human
cgggaccuugagugcggcgaggcguggcuguu

SEQ ID NO: 389094 - RNA, 32 nt, Human
cgggaccuugcaagccucuccauccagcaucu

SEQ ID NO: 389095 - RNA, 32 nt, Human
cgggacgaaggcgaggaggaggcggaggugga

SEQ ID NO: 389096 - RNA, 32 nt, Human
cgggacgaggaggaggaggaggaagaggggau

SEQ ID NO: 389097 - RNA, 32 nt, Human
cgggacgcgccgggcuggagugggcgguuaua

SEQ ID NO: 389098 - RNA, 32 nt, Human
cgggacgcggcaggcuucucagucucuguccg

SEQ ID NO: 389099 - RNA, 32 nt, Human
cgggacgcucccuucucccacccaggacugcc

SEQ ID NO: 389100 - RNA, 32 nt, Human
cgggacggauuccacagacgggagccucauuc

SEQ ID NO: 389101 - RNA, 32 nt, Human
cgggacggugcagucaggcucugggugccaca

SEQ ID NO: 389102 - RNA, 32 nt, Human
cgggacgugagcugugaggcuuguugaugacg

SEQ ID NO: 389103 - RNA, 32 nt, Human
cgggacgugggacggagcgaggaugugguggg

SEQ ID NO: 389104 - RNA, 32 nt, Human
cgggacguguuggugagcaccuguaaucccug

SEQ ID NO: 389105 - RNA, 32 nt, Human
cgggacuaggguggggagcaaacaggccagcg

SEQ ID NO: 389106 - RNA, 32 nt, Human
cgggacuccagccccaggcuguggcucugcag

SEQ ID NO: 389107 - RNA, 32 nt, Human
cgggacucgggguuugcucagugagccguuca

SEQ ID NO: 389108 - RNA, 32 nt, Human
cgggacugccagcugcuccccaaaagccacuu

SEQ ID NO: 389109 - RNA, 21 nt, Human
cgggacugccccggguggaag

SEQ ID NO: 389110 - RNA, 32 nt, Human
cgggacuggcgaguacgcagcccaggggguua

SEQ ID NO: 389111 - RNA, 27 nt, Human
cgggacugggccucacgggguggggug

SEQ ID NO: 389112 - RNA, 32 nt, Human
cgggacugggcugggccugcggugagcaucag

SEQ ID NO: 389113 - RNA, 32 nt, Human
cgggacugugcagucugaaccugcaacuguaa

SEQ ID NO: 389114 - RNA, 32 nt, Human
cgggacuguggacuccacgacccuguccucgg

SEQ ID NO: 389115 - RNA, 32 nt, Human
cgggacuuccuucuaagagaagcgaucuugag

SEQ ID NO: 389116 - RNA, 26 nt, Human
cgggagaaagagagagaggagagaga

SEQ ID NO: 389117 - RNA, 32 nt, Human
cgggagaacagggagcuccuggagcgcagccu

SEQ ID NO: 389118 - RNA, 32 nt, Human
cgggagaaccguucgcggaggaaaggcgaacu

SEQ ID NO: 389119 - RNA, 22 nt, Human
cgggagaagguggaggaggagg

SEQ ID NO: 389120 - RNA, 18 nt, Human
cgggagaaucgcuugaac

SEQ ID NO: 389121 - RNA, 32 nt, Human
cgggagaaucgcuugaaccugggagacggagg

SEQ ID NO: 389122 - RNA, 32 nt, Human
cgggagacccccagccccugcaggggcggggc

SEQ ID NO: 389123 - RNA, 32 nt, Human
cgggagagagaaugagccagagggacacgcug

SEQ ID NO: 389124 - RNA, 23 nt, Human
cgggagagagacuuccgguucug

SEQ ID NO: 389125 - RNA, 32 nt, Human
cgggagagaggaagagaggggagcgcgguggc

SEQ ID NO: 389126 - RNA, 32 nt, Human
cgggagaggacaaaagcaugucuucccuuccu

SEQ ID NO: 389127 - RNA, 32 nt, Human
cgggagaggagaagagggagacccgccgccuc

SEQ ID NO: 389128 - RNA, 32 nt, Human
cgggagaggagaauggauuuauagagaacauc

SEQ ID NO: 389129 - RNA, 32 nt, Human
cgggagaggcugcuguggaggcugaggaggcg

SEQ ID NO: 389130 - RNA, 32 nt, Human
cgggagcaaauacagagccuccaggcagugcu

SEQ ID NO: 389131 - RNA, 32 nt, Human
cgggagcagaggaggcgagggaggagggccag

SEQ ID NO: 389132 - RNA, 32 nt, Human
cgggagcagcauggauuggggcacugagcugu

SEQ ID NO: 389133 - RNA, 27 nt, Human
cgggagcagccuccuugggccucagga

SEQ ID NO: 389134 - RNA, 23 nt, Human
cgggagcagggcgcggggcggga

SEQ ID NO: 389135 - RNA, 24 nt, Human
cgggagcauccugcugcuuagggg

SEQ ID NO: 389136 - RNA, 32 nt, Human
cgggagccacauagagacagacuuggcaaggg

SEQ ID NO: 389137 - RNA, 20 nt, Human
cgggagccaccaugauggcc

SEQ ID NO: 389138 - RNA, 22 nt, Human
cgggagccagacuguccaggga

SEQ ID NO: 389139 - RNA, 32 nt, Human
cgggagccagcuggguguuauuucucaaacuc

SEQ ID NO: 389140 - RNA, 32 nt, Human
cgggagccaggcgcuguggacagggucugucc

SEQ ID NO: 389141 - RNA, 24 nt, Human
cgggagcccaucugcccccagggg

SEQ ID NO: 389142 - RNA, 20 nt, Human
cgggagcccccacccgggga

SEQ ID NO: 389143 - RNA, 20 nt, Human
cgggagcccccgcccggaga

SEQ ID NO: 389144 - RNA, 32 nt, Human
cgggagcccccuggucaccuugguagcaggag

SEQ ID NO: 389145 - RNA, 22 nt, Human
cgggagccccggcaguccgggg

SEQ ID NO: 389146 - RNA, 22 nt, Human
cgggagccccgggacgggccgg

SEQ ID NO: 389147 - RNA, 20 nt, Human
cgggagccccuccccgggga

SEQ ID NO: 389148 - RNA, 32 nt, Human
cgggagccccugcacacuuuccaccucugcug

SEQ ID NO: 389149 - RNA, 21 nt, Human
cgggagcccgccgucugcgga

SEQ ID NO: 389150 - RNA, 21 nt, Human
cgggagcccgcggcgcgaggg

SEQ ID NO: 389151 - RNA, 32 nt, Human
cgggagcccuuugggaggaagggaggcguuag

SEQ ID NO: 389152 - RNA, 32 nt, Human
cgggagccgagaggaggcggaggagauggcgu

SEQ ID NO: 389153 - RNA, 32 nt, Human
cgggagccgccaggccuggccuggccggggcu

SEQ ID NO: 389154 - RNA, 32 nt, Human
cgggagccggacccgucggcagaggagcgggc

SEQ ID NO: 389155 - RNA, 32 nt, Human
cgggagccgucgcagacccguuucaugcagcg

SEQ ID NO: 389156 - RNA, 25 nt, Human
cgggagccucagguucucucagggg

SEQ ID NO: 389157 - RNA, 21 nt, Human
cgggagccugaggcaggagaa

SEQ ID NO: 389158 - RNA, 20 nt, Human
cgggagccugcguccaggga

SEQ ID NO: 389159 - RNA, 21 nt, Human
cgggagccuggguccccgggg

SEQ ID NO: 389160 - RNA, 32 nt, Human
cgggagcgaaagugcgcugagcugcagugucu

SEQ ID NO: 389161 - RNA, 32 nt, Human
cgggagcgaguauguccgcucugacucggcug

SEQ ID NO: 389162 - RNA, 32 nt, Human
cgggagcggcacggcagccacugcuuggggua

SEQ ID NO: 389163 - RNA, 32 nt, Human
cgggagcggcaguccuuccaguacaggcucgc

SEQ ID NO: 389164 - RNA, 18 nt, Human
cgggagcggcggcagcgg

SEQ ID NO: 389165 - RNA, 18 nt, Human
cgggagcggcggcggcgg

SEQ ID NO: 389166 - RNA, 18 nt, Human
cgggagcgguggcggcgg

SEQ ID NO: 389167 - RNA, 32 nt, Human
cgggagcuccucuccagccagagcuacacuug

SEQ ID NO: 389168 - RNA, 24 nt, Human
cgggagcucgccgcggcccgggga

SEQ ID NO: 389169 - RNA, 32 nt, Human
cgggagcucgcugguccuggccccagaagccu

SEQ ID NO: 389170 - RNA, 32 nt, Human
cgggagcucugccuccaagucuacccuucccu

SEQ ID NO: 389171 - RNA, 22 nt, Human
cgggagcugcacuggccagggg

SEQ ID NO: 389172 - RNA, 22 nt, Human
cgggagcugcgcagcgcuccac

SEQ ID NO: 389173 - RNA, 21 nt, Human
cgggagcugugcggcccaggg

SEQ ID NO: 389174 - RNA, 32 nt, Human
cgggagcuucagggcugcgccacccacccccu

SEQ ID NO: 389175 - RNA, 23 nt, Human
cgggagcuucuugagaccgagga

SEQ ID NO: 389176 - RNA, 19 nt, Human
cgggagcuuuacacaccuu

SEQ ID NO: 389177 - RNA, 25 nt, Human
cgggaggaaaggcagaagcugggag

SEQ ID NO: 389178 - RNA, 25 nt, Human
cgggaggaaagggggugcuggaaga

SEQ ID NO: 389179 - RNA, 21 nt, Human
cgggaggaacgcccagggccc

SEQ ID NO: 389180 - RNA, 32 nt, Human
cgggaggaagaggaggaggaggaggaggcugg

SEQ ID NO: 389181 - RNA, 22 nt, Human
cgggaggaagagguugcaguga

SEQ ID NO: 389182 - RNA, 21 nt, Human
cgggaggaaggacaagagcuc

SEQ ID NO: 389183 - RNA, 32 nt, Human
cgggaggaagggagcuggaaagggggcggaaa

SEQ ID NO: 389184 - RNA, 32 nt, Human
cgggaggaagggcacagcaggagcggucaggg

SEQ ID NO: 389185 - RNA, 18 nt, Human
cgggaggacccgggcgca

SEQ ID NO: 389186 - RNA, 21 nt, Human
cgggaggacccgggcgcagua

SEQ ID NO: 389187 - RNA, 22 nt, Human
cgggaggacgacgguggagccg

SEQ ID NO: 389188 - RNA, 32 nt, Human
cgggaggacgcggaagaggagccccgggggua

SEQ ID NO: 389189 - RNA, 25 nt, Human
cgggaggacgcugucgucccgggga

SEQ ID NO: 389190 - RNA, 21 nt, Human
cgggaggacugcuugaggcca

SEQ ID NO: 389191 - RNA, 32 nt, Human
cgggaggagcagcguguggaaauggugaccuu

SEQ ID NO: 389192 - RNA, 24 nt, Human
cgggaggagccggguagccgccug

SEQ ID NO: 389193 - RNA, 32 nt, Human
cgggaggaggaggaggagguugcagugagccg

SEQ ID NO: 389194 - RNA, 32 nt, Human
cgggaggagggaguggagagacugacuggccg

SEQ ID NO: 389195 - RNA, 22 nt, Human
cgggaggagguggaggaggagg

SEQ ID NO: 389196 - RNA, 19 nt, Human
cgggaggaguggcagcggc

SEQ ID NO: 389197 - RNA, 32 nt, Human
cgggaggaucacaccucgacacccaaccccug

SEQ ID NO: 389198 - RNA, 21 nt, Human
cgggaggaucacuugaggcca

SEQ ID NO: 389199 - RNA, 32 nt, Human
cgggaggaucacuugaguccaggaguuugaga

SEQ ID NO: 389200 - RNA, 21 nt, Human
cgggaggaucgcuugagacca

SEQ ID NO: 389201 - RNA, 20 nt, Human
cgggaggaucgcuugagcca

SEQ ID NO: 389202 - RNA, 24 nt, Human
cgggaggauggacacgaugagcuc

SEQ ID NO: 389203 - RNA, 19 nt, Human
cgggaggauuccagaacag

SEQ ID NO: 389204 - RNA, 21 nt, Human
cgggaggauugcuugaggcca

SEQ ID NO: 389205 - RNA, 32 nt, Human
cgggaggcagagccggcucagagcagguccac

SEQ ID NO: 389206 - RNA, 32 nt, Human
cgggaggcagaggcugcacucuagccugggca

SEQ ID NO: 389207 - RNA, 19 nt, Human
cgggaggcagagguugcag

SEQ ID NO: 389208 - RNA, 22 nt, Human
cgggaggcagagguugcaguga

SEQ ID NO: 389209 - RNA, 23 nt, Human
cgggaggcagagguugcagugag

SEQ ID NO: 389210 - RNA, 32 nt, Human
cgggaggcagagguuucagggagccaagaaug

SEQ ID NO: 389211 - RNA, 32 nt, Human
cgggaggcagcaacgaggcgggcggcgacgcg

SEQ ID NO: 389212 - RNA, 31 nt, Human
cgggaggccaacgccgaggcgggcggaucau

SEQ ID NO: 389213 - RNA, 32 nt, Human
cgggaggccaaggcaggagaauugcucgaacu

SEQ ID NO: 389214 - RNA, 18 nt, Human
cgggaggccgcuggcugc

SEQ ID NO: 389215 - RNA, 22 nt, Human
cgggaggcgaagguugcaguga

SEQ ID NO: 389216 - RNA, 23 nt, Human
cgggaggcgaagguugcagugag

SEQ ID NO: 389217 - RNA, 32 nt, Human
cgggaggcggcagcggcugcagcguugguagc

SEQ ID NO: 389218 - RNA, 32 nt, Human
cgggaggcggggguuggcgugccugaggguga

SEQ ID NO: 389219 - RNA, 32 nt, Human
cgggaggcugaggcaggagaaucucuuucuua

SEQ ID NO: 389220 - RNA, 32 nt, Human
cgggaggcugaggcaggagaauuguuugaacc

SEQ ID NO: 389221 - RNA, 32 nt, Human
cgggaggcugaggcagggagaaucgcuugaac

SEQ ID NO: 389222 - RNA, 32 nt, Human
cgggaggcugagguagagaaucgcuugaaccu

SEQ ID NO: 389223 - RNA, 32 nt, Human
cgggaggcugcagggaugccagcugggagaug

SEQ ID NO: 389224 - RNA, 32 nt, Human
cgggaggcugcccugagcaggagcauggagcu

SEQ ID NO: 389225 - RNA, 32 nt, Human
cgggaggcugccgccucgggacaccccacuca

SEQ ID NO: 389226 - RNA, 32 nt, Human
cgggaggcuguaauccuagcuacucgggaggc

SEQ ID NO: 389227 - RNA, 32 nt, Human
cgggagggaacuccaggggaagugaggggaga

SEQ ID NO: 389228 - RNA, 32 nt, Human
cgggagggagagacagagacagagccgauggg

SEQ ID NO: 389229 - RNA, 32 nt, Human
cgggagggagagauucuagggaacaaggaagc

SEQ ID NO: 389230 - RNA, 32 nt, Human
cgggagggaggcaaaugagcauugagaaauuc

SEQ ID NO: 389231 - RNA, 32 nt, Human
cgggagggaggcacccggccggcuggaccuaa

SEQ ID NO: 389232 - RNA, 32 nt, Human
cgggagggaggcgggagucgggggaagacgcg

SEQ ID NO: 389233 - RNA, 32 nt, Human
cgggagggaggggugugcaggagccgcagggc

SEQ ID NO: 389234 - RNA, 32 nt, Human
cgggagggaguggagaaggaggugagggggcc

SEQ ID NO: 389235 - RNA, 32 nt, Human
cgggagggauggagggaggcaggcuggggaga

SEQ ID NO: 389236 - RNA, 20 nt, Human
cgggaggggaagggcugcuc

SEQ ID NO: 389237 - RNA, 32 nt, Human
cgggaggggaggcuccucuccaugguccagaa

SEQ ID NO: 389238 - RNA, 32 nt, Human
cgggaggggaggugacggcuggugacugaugg

SEQ ID NO: 389239 - RNA, 32 nt, Human
cgggaggggguagaguuggcagguuugacucc

SEQ ID NO: 389240 - RNA, 32 nt, Human
cgggaggggucuccuccucucugcugcccagu

SEQ ID NO: 389241 - RNA, 32 nt, Human
cgggagggugcaggcaggagagggaaaggcag

SEQ ID NO: 389242 - RNA, 22 nt, Human
cgggagguagagguugcaguga

SEQ ID NO: 389243 - RNA, 23 nt, Human
cgggagguagagguugcagugag

SEQ ID NO: 389244 - RNA, 18 nt, Human
cgggagguccugcaggag

SEQ ID NO: 389245 - RNA, 22 nt, Human
cgggaggucgaggcuacaguga

SEQ ID NO: 389246 - RNA, 32 nt, Human
cgggagguggagguggagguugcagugagccg

SEQ ID NO: 389247 - RNA, 32 nt, Human
cgggagguggagguggcagugagccgagauca

SEQ ID NO: 389248 - RNA, 32 nt, Human
cgggagguggagguggcagugagccgagauug

SEQ ID NO: 389249 - RNA, 21 nt, Human
cgggagguggagguuacagug

SEQ ID NO: 389250 - RNA, 20 nt, Human
cgggagguggagguugcagu

SEQ ID NO: 389251 - RNA, 22 nt, Human
cgggagguggagguugcaguga

SEQ ID NO: 389252 - RNA, 23 nt, Human
cgggagguggagguugcagugag

SEQ ID NO: 389253 - RNA, 32 nt, Human
cgggagguucuggagaccugggugacggaaga

SEQ ID NO: 389254 - RNA, 32 nt, Human
cgggaguacugccucccaggcccugugcucug

SEQ ID NO: 389255 - RNA, 32 nt, Human
cgggaguagagcagccucgccucccagcugga

SEQ ID NO: 389256 - RNA, 21 nt, Human
cgggaguccagccccaaggga

SEQ ID NO: 389257 - RNA, 32 nt, Human
cgggaguccauggcaaaugauguggauaaaga

SEQ ID NO: 389258 - RNA, 20 nt, Human
cgggagucccuugcucaggg

SEQ ID NO: 389259 - RNA, 32 nt, Human
cgggagucgggugggaucccaggcugggcccc

SEQ ID NO: 389260 - RNA, 32 nt, Human
cgggagugaggcuggugcaggagcaguucugc

SEQ ID NO: 389261 - RNA, 32 nt, Human
cgggagugagucacucucucucugugccaggc

SEQ ID NO: 389262 - RNA, 18 nt, Human
cgggagugccccaccacg

SEQ ID NO: 389263 - RNA, 19 nt, Human
cgggagugcccuuggcuca

SEQ ID NO: 389264 - RNA, 32 nt, Human
cgggagugcucaccuccagcuacuguguccau

SEQ ID NO: 389265 - RNA, 32 nt, Human
cgggagugguuaaauguuaaauuuaacgaugu

SEQ ID NO: 389266 - RNA, 32 nt, Human
cgggaguugcagugaacccagccacccgcucg

SEQ ID NO: 389267 - RNA, 32 nt, Human
cgggaguuggggaagggaaggagccaggaagc

SEQ ID NO: 389268 - RNA, 32 nt, Human
cgggaguuggucccccuuccucccacuggaca

SEQ ID NO: 389269 - RNA, 32 nt, Human
cgggaguugucagcugaugccugcugagaggc

SEQ ID NO: 389270 - RNA, 32 nt, Human
cgggauaacaauaguagguaacaccgagugcu

SEQ ID NO: 389271 - RNA, 32 nt, Human
cgggaucacuggggcucuuugugagugagggu

SEQ ID NO: 389272 - RNA, 32 nt, Human
cgggaucagagcacugagaaacuccagaggcu

SEQ ID NO: 389273 - RNA, 32 nt, Human
cgggaucagaugggaagcagaagcucaucaug

SEQ ID NO: 389274 - RNA, 24 nt, Human
cgggaucagcaacccuuccugcug

SEQ ID NO: 389275 - RNA, 32 nt, Human
cgggauccucugccgcccucucugccacgcgg

SEQ ID NO: 389276 - RNA, 32 nt, Human
cgggaucgcaccacugcacuccagccugggcu

SEQ ID NO: 389277 - RNA, 32 nt, Human
cgggaucgcaccacugcacuccagccuggguu

SEQ ID NO: 389278 - RNA, 32 nt, Human
cgggaucgcaccgcugcacuccagccugggug

SEQ ID NO: 389279 - RNA, 32 nt, Human
cgggaucgcagguagagcaggacgcugcagcg

SEQ ID NO: 389280 - RNA, 21 nt, Human
cgggaucgccaccuccugccu

SEQ ID NO: 389281 - RNA, 32 nt, Human
cgggaucgcgccacugcauuccagccuggacg

SEQ ID NO: 389282 - RNA, 32 nt, Human
cgggaucggcugggugaggcugggcaggccug

SEQ ID NO: 389283 - RNA, 32 nt, Human
cgggaucucuggagauaaaggcaguugagaau

SEQ ID NO: 389284 - RNA, 32 nt, Human
cgggaugaaaggagggaacgcaggugagaaag

SEQ ID NO: 389285 - RNA, 29 nt, Human
cgggaugagagggagccaucgggccgcgc

SEQ ID NO: 389286 - RNA, 32 nt, Human
cgggaugaggucagaggccccaccugauuuuc

SEQ ID NO: 389287 - RNA, 29 nt, Human
cgggaugcagccgccggugcccgggcccc

SEQ ID NO: 389288 - RNA, 32 nt, Human
cgggaugcuuugggcauguccucuggagcccc

SEQ ID NO: 389289 - RNA, 29 nt, Human
cgggauggccuucauggagaagccgccag

SEQ ID NO: 389290 - RNA, 32 nt, Human
cgggaugggagaccccacuuuagaaagggucg

SEQ ID NO: 389291 - RNA, 32 nt, Human
cgggaugggaggcggcccuggccgcaagcccc

SEQ ID NO: 389292 - RNA, 29 nt, Human
cgggaugggcggggaggcugggugcgcgg

SEQ ID NO: 389293 - RNA, 32 nt, Human
cgggauggucucaaucuccugaccucgugauc

SEQ ID NO: 389294 - RNA, 32 nt, Human
cgggaugucgcaccuguggacuccaggggcca

SEQ ID NO: 389295 - RNA, 32 nt, Human
cgggauuagagcccuccagaauacccaucaua

SEQ ID NO: 389296 - RNA, 32 nt, Human
cgggauucagcaaugguggaauggaagacaga

SEQ ID NO: 389297 - RNA, 32 nt, Human
cgggauucagcaccaggcucuucccaguaccc

SEQ ID NO: 389298 - RNA, 32 nt, Human
cgggauucaggcaucccucccugacauggaga

SEQ ID NO: 389299 - RNA, 32 nt, Human
cgggauuccagccuuggucuuccgggguaagc

SEQ ID NO: 389300 - RNA, 32 nt, Human
cgggauuccuggaagagacggggauuuggggg

SEQ ID NO: 389301 - RNA, 32 nt, Human
cgggauucuccuccgcuuccuuuucucggucu

SEQ ID NO: 389302 - RNA, 32 nt, Human
cgggauugagcagcugagggcaggugccacgu

SEQ ID NO: 389303 - RNA, 23 nt, Human
cgggauugcaaagaugacuguca

SEQ ID NO: 389304 - RNA, 32 nt, Human
cgggauugcaccacugcacuccagccugggcu

SEQ ID NO: 389305 - RNA, 32 nt, Human
cgggauugcgccacugcacuccagccugggug

SEQ ID NO: 389306 - RNA, 32 nt, Human
cgggauugcgccagugcacuccagcugggcga

SEQ ID NO: 389307 - RNA, 32 nt, Human
cgggauugcuugaguccagccugggcaguaua

SEQ ID NO: 389308 - RNA, 32 nt, Human
cgggauuggaugacugauuauuggacagaaug

SEQ ID NO: 389309 - RNA, 32 nt, Human
cgggauugggaauccgcccaucugggggccuc

SEQ ID NO: 389310 - RNA, 18 nt, Human
cgggauuggggcgcgagg

SEQ ID NO: 389311 - RNA, 32 nt, Human
cgggauuuauucagccuuggucagagcagaaa

SEQ ID NO: 389312 - RNA, 32 nt, Human
cgggauuuucagaaguuagccugaauuuaacu

SEQ ID NO: 389313 - RNA, 22 nt, Human
cgggauuuuuguugauggcuga

SEQ ID NO: 389314 - RNA, 32 nt, Human
cgggcaaagauggcggcggccagguguuggag

SEQ ID NO: 389315 - RNA, 32 nt, Human
cgggcaacacccuucucgcagccugggccucu

SEQ ID NO: 389316 - RNA, 32 nt, Human
cgggcaacauggugaaaccccgucucuacaaa

SEQ ID NO: 389317 - RNA, 32 nt, Human
cgggcaacgagguuucucugucauucacagaa

SEQ ID NO: 389318 - RNA, 32 nt, Human
cgggcaagcaguuggcuucgcccacacggugu

SEQ ID NO: 389319 - RNA, 32 nt, Human
cgggcaagcaugccucuucccuucccuggaga

SEQ ID NO: 389320 - RNA, 32 nt, Human
cgggcaagccccgguggaaguccaaggaaaag

SEQ ID NO: 389321 - RNA, 32 nt, Human
cgggcaagguggaggcagaguuugagcugcug

SEQ ID NO: 389322 - RNA, 20 nt, Human
cgggcacaccuucucccggg

SEQ ID NO: 389323 - RNA, 32 nt, Human
cgggcacaguuggcucaugccugugaucccaa

SEQ ID NO: 389324 - RNA, 32 nt, Human
cgggcacauccuggcccacuucaagaggggcu

SEQ ID NO: 389325 - RNA, 32 nt, Human
cgggcaccagccgcuuccugugcccaucgcac

SEQ ID NO: 389326 - RNA, 32 nt, Human
cgggcaccaugggccacuccaggaugggacac

SEQ ID NO: 389327 - RNA, 32 nt, Human
cgggcacccaggcugcagugugugagggggcu

SEQ ID NO: 389328 - RNA, 32 nt, Human
cgggcaccgcggaggcuggagccgcaauggug

SEQ ID NO: 389329 - RNA, 32 nt, Human
cgggcaccgucccacagcaucuccuagaagca

SEQ ID NO: 389330 - RNA, 32 nt, Human
cgggcaccugcagcugcugcuguggcugccag

SEQ ID NO: 389331 - RNA, 32 nt, Human
cgggcaccuguaaucccagccacuugggaggc

SEQ ID NO: 389332 - RNA, 32 nt, Human
cgggcaccuguaaucccagcuacucaggaggc

SEQ ID NO: 389333 - RNA, 32 nt, Human
cgggcaccuguaaucccagcuacucgggaggc

SEQ ID NO: 389334 - RNA, 32 nt, Human
cgggcaccuguaaucccagcuacuugggaggc

SEQ ID NO: 389335 - RNA, 32 nt, Human
cgggcaccuguaaucccagcuacuuggguggc

SEQ ID NO: 389336 - RNA, 32 nt, Human
cgggcaccuguaauccuggcuacucgggaggc

SEQ ID NO: 389337 - RNA, 32 nt, Human
cgggcaccuuggcagcccccagcuggguggcu

SEQ ID NO: 389338 - RNA, 18 nt, Human
cgggcacgcagggccuga

SEQ ID NO: 389339 - RNA, 32 nt, Human
cgggcacggagguaacguggaccuggacggug

SEQ ID NO: 389340 - RNA, 32 nt, Human
cgggcacucucaggcaaccccaccucccccuc

SEQ ID NO: 389341 - RNA, 32 nt, Human
cgggcagaaggagcgugagcccaaugauuggg

SEQ ID NO: 389342 - RNA, 32 nt, Human
cgggcagaaugagauuguccacacuggcccca

SEQ ID NO: 389343 - RNA, 32 nt, Human
cgggcagagaaaugccagcugcaccagggcuc

SEQ ID NO: 389344 - RNA, 32 nt, Human
cgggcagagagggaaggagggaggaggcaucu

SEQ ID NO: 389345 - RNA, 23 nt, Human
cgggcagaucaccugagaucagg

SEQ ID NO: 389346 - RNA, 32 nt, Human
cgggcagaucacgaggccaggaguucgagacc

SEQ ID NO: 389347 - RNA, 23 nt, Human
cgggcagaucacuugaggucagg

SEQ ID NO: 389348 - RNA, 32 nt, Human
cgggcagcacggugcagcggugcaguggcaag

SEQ ID NO: 389349 - RNA, 32 nt, Human
cgggcagcagagacgcaccucacuuccuagac

SEQ ID NO: 389350 - RNA, 18 nt, Human
cgggcagcagcgacagga

SEQ ID NO: 389351 - RNA, 32 nt, Human
cgggcagcaugguucacuccagcaugggggcu

SEQ ID NO: 389352 - RNA, 32 nt, Human
cgggcagccaggcugggccgcaagggccugga

SEQ ID NO: 389353 - RNA, 22 nt, Human
cgggcagccccagcccccgucc

SEQ ID NO: 389354 - RNA, 32 nt, Human
cgggcagccgagaagaacagacgcucuuuaag

SEQ ID NO: 389355 - RNA, 32 nt, Human
cgggcagccuggagcuuccugcagccuccuac

SEQ ID NO: 389356 - RNA, 32 nt, Human
cgggcagcggcgcagacccagcaaggaccggc

SEQ ID NO: 389357 - RNA, 16 nt, Human
cgggcagcggcgcgag

SEQ ID NO: 389358 - RNA, 32 nt, Human
cgggcagcuccagggauguggccucauugcug

SEQ ID NO: 389359 - RNA, 32 nt, Human
cgggcagcucuccccucacucuccuccaccug

SEQ ID NO: 389360 - RNA, 25 nt, Human
cgggcagcuggaaaguccuccucca

SEQ ID NO: 389361 - RNA, 32 nt, Human
cgggcagcuguuccuucccccgacucaagaau

SEQ ID NO: 389362 - RNA, 32 nt, Human
cgggcaggacaguuggguguggccugggcuca

SEQ ID NO: 389363 - RNA, 32 nt, Human
cgggcaggagcaacccagaagcaccggugagg

SEQ ID NO: 389364 - RNA, 32 nt, Human
cgggcaggaggcggcggcagcagcgggaccga

SEQ ID NO: 389365 - RNA, 32 nt, Human
cgggcaggcccagggagcaggcagcaguguuc

SEQ ID NO: 389366 - RNA, 32 nt, Human
cgggcaggccccauccugcuucugcugcugug

SEQ ID NO: 389367 - RNA, 32 nt, Human
cgggcaggcggguggggcaggcugggggcugg

SEQ ID NO: 389368 - RNA, 32 nt, Human
cgggcagggaccugcaggaggcuuucccagca

SEQ ID NO: 389369 - RNA, 21 nt, Human
cgggcagggcugccuccucac

SEQ ID NO: 389370 - RNA, 32 nt, Human
cgggcagguacacgacauucuugggcauacgc

SEQ ID NO: 389371 - RNA, 32 nt, Human
cgggcaggugggaggcacgggguugcggaucc

SEQ ID NO: 389372 - RNA, 32 nt, Human
cgggcagucgacuucggggcccagggaccaac

SEQ ID NO: 389373 - RNA, 32 nt, Human
cgggcagucugcccaagugucuuaggaaccaa

SEQ ID NO: 389374 - RNA, 32 nt, Human
cgggcagugucacacccugccugcucaguccu

SEQ ID NO: 389375 - RNA, 32 nt, Human
cgggcaguguuagaggaggagaugggagcggu

SEQ ID NO: 389376 - RNA, 32 nt, Human
cgggcaucaggagccagccacagggaugucug

SEQ ID NO: 389377 - RNA, 32 nt, Human
cgggcaucugguugaccccagccuggggagga

SEQ ID NO: 389378 - RNA, 32 nt, Human
cgggcaugaaggaggauggaagggcaggacga

SEQ ID NO: 389379 - RNA, 32 nt, Human
cgggcaugagcugagagcaccacgccgaggcc

SEQ ID NO: 389380 - RNA, 32 nt, Human
cgggcauugugguggugcaugccuguaacccc

SEQ ID NO: 389381 - RNA, 32 nt, Human
cgggccaacauggugaaaccccaucucuacaa

SEQ ID NO: 389382 - RNA, 32 nt, Human
cgggccaacauggugaaaccccaucucugcua

SEQ ID NO: 389383 - RNA, 32 nt, Human
cgggccaacauggugcaaccucgucuuuacua

SEQ ID NO: 389384 - RNA, 32 nt, Human
cgggccaagacgcugcaacagcucagcgcggc

SEQ ID NO: 389385 - RNA, 32 nt, Human
cgggccaaggacaggcagggagggaggccagg

SEQ ID NO: 389386 - RNA, 18 nt, Human
cgggccacagagaaagua

SEQ ID NO: 389387 - RNA, 32 nt, Human
cgggccacagccgggucacguggccggcggcc

SEQ ID NO: 389388 - RNA, 32 nt, Human
cgggccacaggcagggucagauugagaagaag

SEQ ID NO: 389389 - RNA, 32 nt, Human
cgggccaccaaguucuggaaaccacguggugu

SEQ ID NO: 389390 - RNA, 18 nt, Human
cgggccacccaccccagu

SEQ ID NO: 389391 - RNA, 17 nt, Human
cgggccacccggcucag

SEQ ID NO: 389392 - RNA, 17 nt, Human
cgggccaccgccggcag

SEQ ID NO: 389393 - RNA, 19 nt, Human
cgggccaccugccgcagug

SEQ ID NO: 389394 - RNA, 17 nt, Human
cgggccaccuguaacag

SEQ ID NO: 389395 - RNA, 32 nt, Human
cgggccacggcacuccagccugggugacagag

SEQ ID NO: 389396 - RNA, 32 nt, Human
cgggccacugcacuccagcuugggugacagag

SEQ ID NO: 389397 - RNA, 32 nt, Human
cgggccacugcccuuuagacugggcaacagag

SEQ ID NO: 389398 - RNA, 18 nt, Human
cgggccagacgcgcugca

SEQ ID NO: 389399 - RNA, 19 nt, Human
cgggccagaggcagagccc

SEQ ID NO: 389400 - RNA, 32 nt, Human
cgggccagcauggugaaaccccgucucuacua

SEQ ID NO: 389401 - RNA, 32 nt, Human
cgggccagccaagauggcggccucaugcuugg

SEQ ID NO: 389402 - RNA, 18 nt, Human
cgggccagccuuggugca

SEQ ID NO: 389403 - RNA, 22 nt, Human
cgggccagccuuucccuuaagg

SEQ ID NO: 389404 - RNA, 15 nt, Human
cgggccagcggugca

SEQ ID NO: 389405 - RNA, 32 nt, Human
cgggccagcucuuaaggaguucaggagugaga

SEQ ID NO: 389406 - RNA, 16 nt, Human
cgggccagggggcgca

SEQ ID NO: 389407 - RNA, 20 nt, Human
cgggccagguaggaggcaag

SEQ ID NO: 389408 - RNA, 20 nt, Human
cgggccaggucuggcgccag

SEQ ID NO: 389409 - RNA, 32 nt, Human
cgggccagucucaaacuccugacgucaaguga

SEQ ID NO: 389410 - RNA, 32 nt, Human
cgggccaguuucucccucuucaccccugcgcc

SEQ ID NO: 389411 - RNA, 32 nt, Human
cgggccaugucgacgucacacauauuaauguc

SEQ ID NO: 389412 - RNA, 32 nt, Human
cgggccauugacacauggacucugccugggca

SEQ ID NO: 389413 - RNA, 32 nt, Human
cgggcccaagcccugccccuccagaguccaga

SEQ ID NO: 389414 - RNA, 23 nt, Human
cgggcccacuccccguucuccca

SEQ ID NO: 389415 - RNA, 32 nt, Human
cgggcccagaggagcugggagccgggccgcag

SEQ ID NO: 389416 - RNA, 32 nt, Human
cgggcccaggcagagagcgaccagcaggcucc

SEQ ID NO: 389417 - RNA, 32 nt, Human
cgggcccagguaguccucccaccucagccucc

SEQ ID NO: 389418 - RNA, 20 nt, Human
cgggcccaggucacacagca

SEQ ID NO: 389419 - RNA, 17 nt, Human
cgggcccagugcccugg

SEQ ID NO: 389420 - RNA, 32 nt, Human
cgggcccauccccucccuguuggcggccucua

SEQ ID NO: 389421 - RNA, 32 nt, Human
cgggccccagcccuggagcugcaggaguuggg

SEQ ID NO: 389422 - RNA, 18 nt, Human
cgggcccccaacccccca

SEQ ID NO: 389423 - RNA, 19 nt, Human
cgggcccccgccgccccgc

SEQ ID NO: 389424 - RNA, 32 nt, Human
cgggcccccggcaugcagccccggcugcggag

SEQ ID NO: 389425 - RNA, 21 nt, Human
cgggcccccguagucccagcu

SEQ ID NO: 389426 - RNA, 32 nt, Human
cgggcccccugccuccgccauguuccgcaggg

SEQ ID NO: 389427 - RNA, 20 nt, Human
cgggcccccuuccccaggcc

SEQ ID NO: 389428 - RNA, 24 nt, Human
cgggccccgcgcggggauccggcu

SEQ ID NO: 389429 - RNA, 20 nt, Human
cgggccccgcgucccagccc

SEQ ID NO: 389430 - RNA, 18 nt, Human
cgggccccgcguccuccc

SEQ ID NO: 389431 - RNA, 19 nt, Human
cgggccccgcuguccuccc

SEQ ID NO: 389432 - RNA, 18 nt, Human
cgggccccguccuggggu

SEQ ID NO: 389433 - RNA, 32 nt, Human
cgggccccuaggggagauggugcagugggcgg

SEQ ID NO: 389434 - RNA, 21 nt, Human
cgggccccucaccccagcuga

SEQ ID NO: 389435 - RNA, 20 nt, Human
cgggccccucagcccucugg

SEQ ID NO: 389436 - RNA, 27 nt, Human
cgggccccuggaccacgggguccaccu

SEQ ID NO: 389437 - RNA, 20 nt, Human
cgggccccuggggguggcug

SEQ ID NO: 389438 - RNA, 24 nt, Human
cgggccccuggucaagugcuggcu

SEQ ID NO: 389439 - RNA, 21 nt, Human
cgggccccuguaaucccagcu

SEQ ID NO: 389440 - RNA, 32 nt, Human
cgggccccuguaaucccagcuacucgggaggc

SEQ ID NO: 389441 - RNA, 32 nt, Human
cgggccccuguagauggcauuuuugcaggcug

SEQ ID NO: 389442 - RNA, 21 nt, Human
cgggccccuguagucccagcu

SEQ ID NO: 389443 - RNA, 19 nt, Human
cgggccccuucuuuccccg

SEQ ID NO: 389444 - RNA, 32 nt, Human
cgggcccgagcgcagaccaggcuccagccgcg

SEQ ID NO: 389445 - RNA, 22 nt, Human
cgggcccgaucucgggcgggaa

SEQ ID NO: 389446 - RNA, 32 nt, Human
cgggcccgcacucaggagcacagccauagcag

SEQ ID NO: 389447 - RNA, 32 nt, Human
cgggcccgcgcaggcccccaccccuugagcac

SEQ ID NO: 389448 - RNA, 22 nt, Human
cgggcccggcgcgcgcgggaag

SEQ ID NO: 389449 - RNA, 32 nt, Human
cgggcccgggcacuggugggugacagucauac

SEQ ID NO: 389450 - RNA, 32 nt, Human
cgggcccgguggaggcugcagugagacgagau

SEQ ID NO: 389451 - RNA, 32 nt, Human
cgggcccguucccuccugcucucuggugcucc

SEQ ID NO: 389452 - RNA, 19 nt, Human
cgggcccuacaggagccug

SEQ ID NO: 389453 - RNA, 21 nt, Human
cgggcccucagccagcuggcu

SEQ ID NO: 389454 - RNA, 25 nt, Human
cgggcccuccuggaggaguccuguu

SEQ ID NO: 389455 - RNA, 20 nt, Human
cgggcccucgccggcccggc

SEQ ID NO: 389456 - RNA, 32 nt, Human
cgggcccucucauccuucauuccauuaaaucc

SEQ ID NO: 389457 - RNA, 21 nt, Human
cgggcccucugcgaccugggg

SEQ ID NO: 389458 - RNA, 32 nt, Human
cgggcccugcgcugccugucauggcucaugag

SEQ ID NO: 389459 - RNA, 24 nt, Human
cgggcccugcgucagguugcaguu

SEQ ID NO: 389460 - RNA, 32 nt, Human
cgggcccuucauuccucuccaugcugcaauca

SEQ ID NO: 389461 - RNA, 32 nt, Human
cgggccgagcccacaacuuugcagccucgggc

SEQ ID NO: 389462 - RNA, 19 nt, Human
cgggccgagccccgggcgc

SEQ ID NO: 389463 - RNA, 32 nt, Human
cgggccgagccgcggggcggggccgccccucc

SEQ ID NO: 389464 - RNA, 32 nt, Human
cgggccgcagagcccaugagggcgcgggcacc

SEQ ID NO: 389465 - RNA, 32 nt, Human
cgggccgcagggccaugaaacuacaggccgug

SEQ ID NO: 389466 - RNA, 22 nt, Human
cgggccgccacagccgccggcc

SEQ ID NO: 389467 - RNA, 18 nt, Human
cgggccgcggcccgggag

SEQ ID NO: 389468 - RNA, 32 nt, Human
cgggccgcggccgccuccaugaagcggaaaag

SEQ ID NO: 389469 - RNA, 32 nt, Human
cgggccgcugcacuccagccugggggacagag

SEQ ID NO: 389470 - RNA, 21 nt, Human
cgggccgcugcagcuccagga

SEQ ID NO: 389471 - RNA, 32 nt, Human
cgggccggaccacccugacaucccgagaaguc

SEQ ID NO: 389472 - RNA, 32 nt, Human
cgggccggacgggccggggcagaggaggcgag

SEQ ID NO: 389473 - RNA, 32 nt, Human
cgggccggagagcugggagcacaggucccggc

SEQ ID NO: 389474 - RNA, 32 nt, Human
cgggccggagcgggcuccagagacaugggguc

SEQ ID NO: 389475 - RNA, 32 nt, Human
cgggccggagggcugcagucucccucgcggug

SEQ ID NO: 389476 - RNA, 32 nt, Human
cgggccgggaagcagagccuggucgugaggaa

SEQ ID NO: 389477 - RNA, 32 nt, Human
cgggccgggccgggcccaggagcgcgcggaug

SEQ ID NO: 389478 - RNA, 32 nt, Human
cgggccggggacccacucugcccagccggagg

SEQ ID NO: 389479 - RNA, 32 nt, Human
cgggccggggcccugccugaggccaucgccgc

SEQ ID NO: 389480 - RNA, 32 nt, Human
cgggccgggggugggagcgggggccggagccg

SEQ ID NO: 389481 - RNA, 32 nt, Human
cgggccgggucugaagcgccgccgggacggcg

SEQ ID NO: 389482 - RNA, 19 nt, Human
cgggccgguggggcguaag

SEQ ID NO: 389483 - RNA, 32 nt, Human
cgggccgugagaggggacgggucaggagccuu

SEQ ID NO: 389484 - RNA, 17 nt, Human
cgggccgugcagagcag

SEQ ID NO: 389485 - RNA, 32 nt, Human
cgggccgugcgcucugcacuccggagcgguuc

SEQ ID NO: 389486 - RNA, 32 nt, Human
cgggccuacgcgcucaccugacgccccggccg

SEQ ID NO: 389487 - RNA, 32 nt, Human
cgggccuaggcucaucuccacaggggagaaca

SEQ ID NO: 389488 - RNA, 32 nt, Human
cgggccuagggaggaggagcgagaaucagccu

SEQ ID NO: 389489 - RNA, 32 nt, Human
cgggccucagcugcggccacagcuccagaucg

SEQ ID NO: 389490 - RNA, 31 nt, Human
cgggccucagggccggccuggcagccgggga

SEQ ID NO: 389491 - RNA, 32 nt, Human
cgggccuccagccacagccugcuggcaugggg

SEQ ID NO: 389492 - RNA, 32 nt, Human
cgggccuccagccuggacuucccagccccucu

SEQ ID NO: 389493 - RNA, 18 nt, Human
cgggccuccaggugcagg

SEQ ID NO: 389494 - RNA, 21 nt, Human
cgggccuccgccgccgccacu

SEQ ID NO: 389495 - RNA, 22 nt, Human
cgggccuccgcguccuccugcu

SEQ ID NO: 389496 - RNA, 25 nt, Human
cgggccuccggaggcagguucggcu

SEQ ID NO: 389497 - RNA, 21 nt, Human
cgggccuccggcggcccggcu

SEQ ID NO: 389498 - RNA, 18 nt, Human
cgggccucgcuuccccca

SEQ ID NO: 389499 - RNA, 22 nt, Human
cgggccucugagcaggugcagg

SEQ ID NO: 389500 - RNA, 22 nt, Human
cgggccucugccauagcccggc

SEQ ID NO: 389501 - RNA, 32 nt, Human
cgggccucugggcagaggaugcaauggcacgg

SEQ ID NO: 389502 - RNA, 32 nt, Human
cgggccugagccugagagcucagaggauuccu

SEQ ID NO: 389503 - RNA, 32 nt, Human
cgggccugccccugcccccucucuggagcccu

SEQ ID NO: 389504 - RNA, 21 nt, Human
cgggccuggcgcggagccuga

SEQ ID NO: 389505 - RNA, 32 nt, Human
cgggccuggcugaggcggagguuguugcggau

SEQ ID NO: 389506 - RNA, 32 nt, Human
cgggccuggggucaccgaggggugcggggcuc

SEQ ID NO: 389507 - RNA, 32 nt, Human
cgggccuguggaagaagccccgccacggacuu

SEQ ID NO: 389508 - RNA, 32 nt, Human
cgggccuguggucccagcugcucgggagguug

SEQ ID NO: 389509 - RNA, 21 nt, Human
cgggccuucggcagaugcagg

SEQ ID NO: 389510 - RNA, 32 nt, Human
cgggccuuucagcuuggucuuuccgggccucg

SEQ ID NO: 389511 - RNA, 32 nt, Human
cgggcgagccggccggggcugaauggagggaa

SEQ ID NO: 389512 - RNA, 32 nt, Human
cgggcgaggaagaaaaauaagcuuuuccaauc

SEQ ID NO: 389513 - RNA, 32 nt, Human
cgggcgagugggcggaggcggcugcggggaag

SEQ ID NO: 389514 - RNA, 32 nt, Human
cgggcgauggcugugguccuucugcuaaugca

SEQ ID NO: 389515 - RNA, 32 nt, Human
cgggcgauucuccugccccagccucuugagug

SEQ ID NO: 389516 - RNA, 31 nt, Human
cgggcgcacagcuaugcuggagcucugcagg

SEQ ID NO: 389517 - RNA, 32 nt, Human
cgggcgcacugaggucuuggccauggggcugc

SEQ ID NO: 389518 - RNA, 32 nt, Human
cgggcgcaguggugccuguaaucccagcaguu

SEQ ID NO: 389519 - RNA, 32 nt, Human
cgggcgccaccaaagccaggcccugaggccug

SEQ ID NO: 389520 - RNA, 32 nt, Human
cgggcgccaggcauuguccagaccuggucggg

SEQ ID NO: 389521 - RNA, 32 nt, Human
cgggcgcccaggacccuggccugcagagacgc

SEQ ID NO: 389522 - RNA, 32 nt, Human
cgggcgcccgggccuuugcuaucucgccgucg

SEQ ID NO: 389523 - RNA, 32 nt, Human
cgggcgccgcgcagauggccugggcgagccag

SEQ ID NO: 389524 - RNA, 19 nt, Human
cgggcgccgggccggaagg

SEQ ID NO: 389525 - RNA, 32 nt, Human
cgggcgccucugaaguggagggcgggccgccu

SEQ ID NO: 389526 - RNA, 25 nt, Human
cgggcgccugcccagcaggagcuga

SEQ ID NO: 389527 - RNA, 32 nt, Human
cgggcgccuggagccacacagggauccggagc

SEQ ID NO: 389528 - RNA, 32 nt, Human
cgggcgccuguaaucacagcuacuugggaggc

SEQ ID NO: 389529 - RNA, 32 nt, Human
cgggcgccuguaauccaagcuacuggggaggc

SEQ ID NO: 389530 - RNA, 32 nt, Human
cgggcgccuguaaucccagauacucaggaggc

SEQ ID NO: 389531 - RNA, 32 nt, Human
cgggcgccuguaaucccagcuacucaggaggc

SEQ ID NO: 389532 - RNA, 32 nt, Human
cgggcgccuguaaucccagcuacucgggaagc

SEQ ID NO: 389533 - RNA, 32 nt, Human
cgggcgccuguaaucccagcuacucgggaggc

SEQ ID NO: 389534 - RNA, 32 nt, Human
cgggcgccuguaaucccagcuacugagggggc

SEQ ID NO: 389535 - RNA, 32 nt, Human
cgggcgccuguaaucccagcuacuugggaagc

SEQ ID NO: 389536 - RNA, 32 nt, Human
cgggcgccuguaaucccagcuacuugggaggc

SEQ ID NO: 389537 - RNA, 32 nt, Human
cgggcgccuguaaucccagcuacuuggguggc

SEQ ID NO: 389538 - RNA, 32 nt, Human
cgggcgccuguaaucccagcugcuggggaagc

SEQ ID NO: 389539 - RNA, 32 nt, Human
cgggcgccuguaaucccagguacucaggaggc

SEQ ID NO: 389540 - RNA, 32 nt, Human
cgggcgccuguaauccuagcugcuugggaggc

SEQ ID NO: 389541 - RNA, 32 nt, Human
cgggcgccuguaguucuagcuacucuggaggc

SEQ ID NO: 389542 - RNA, 32 nt, Human
cgggcgccuguaucccagcuacucgggaggcu

SEQ ID NO: 389543 - RNA, 32 nt, Human
cgggcgcgagaaggaggagcuggaggagcgcg

SEQ ID NO: 389544 - RNA, 32 nt, Human
cgggcgcggcgcccaccaugcgcggcugccug

SEQ ID NO: 389545 - RNA, 32 nt, Human
cgggcgcgggcagagcgcggcggcgcggagac

SEQ ID NO: 389546 - RNA, 25 nt, Human
cgggcgcugaggacaagggccgcug

SEQ ID NO: 389547 - RNA, 32 nt, Human
cgggcgcugccuggacaggccugccugcgugc

SEQ ID NO: 389548 - RNA, 32 nt, Human
cgggcgcuggaggccgugaggcugcagaacag

SEQ ID NO: 389549 - RNA, 32 nt, Human
cgggcgcuuuucucuccuccaauucagaguag

SEQ ID NO: 389550 - RNA, 32 nt, Human
cgggcggaaccgcagaagcauccccggccgug

SEQ ID NO: 389551 - RNA, 32 nt, Human
cgggcggaagagggaggagaggcgcggggagc

SEQ ID NO: 389552 - RNA, 21 nt, Human
cgggcggagcgggcagcggcc

SEQ ID NO: 389553 - RNA, 32 nt, Human
cgggcggagcuggcccugccucugccuggccg

SEQ ID NO: 389554 - RNA, 32 nt, Human
cgggcggaggggaaggugucuuucaagucggu

SEQ ID NO: 389555 - RNA, 32 nt, Human
cgggcggagggggagagcgcgggccgcgcggg

SEQ ID NO: 389556 - RNA, 32 nt, Human
cgggcggaucacgaggccaggagaucaagacc

SEQ ID NO: 389557 - RNA, 32 nt, Human
cgggcggaucacgaggucaggagaccgagauc

SEQ ID NO: 389558 - RNA, 32 nt, Human
cgggcggaucacgaggucaggagacugagacc

SEQ ID NO: 389559 - RNA, 32 nt, Human
cgggcggaucccgggaaggcggaaggcuucgg

SEQ ID NO: 389560 - RNA, 32 nt, Human
cgggcggcagccgccucugcgcggaccggggc

SEQ ID NO: 389561 - RNA, 32 nt, Human
cgggcggccaggagucaguggcaggcgcggcc

SEQ ID NO: 389562 - RNA, 32 nt, Human
cgggcggccauggagcgagccuagggcccgac

SEQ ID NO: 389563 - RNA, 32 nt, Human
cgggcggcccagguccucuacugugaaggagc

SEQ ID NO: 389564 - RNA, 32 nt, Human
cgggcggccgacgcuccucuucggcggcggcg

SEQ ID NO: 389565 - RNA, 24 nt, Human
cgggcggccgugucgcuccaggga

SEQ ID NO: 389566 - RNA, 32 nt, Human
cgggcggcgcggacgaugagggcccagugagg

SEQ ID NO: 389567 - RNA, 32 nt, Human
cgggcggcgggcgcaccaugcccuccuucgac

SEQ ID NO: 389568 - RNA, 32 nt, Human
cgggcggcggucgccaggucucagggccgggg

SEQ ID NO: 389569 - RNA, 32 nt, Human
cgggcggcugaaggaggggcugagccucagga

SEQ ID NO: 389570 - RNA, 32 nt, Human
cgggcggcugcugaggugagggccgggccaga

SEQ ID NO: 389571 - RNA, 32 nt, Human
cgggcgggacccgcuccucccuuggggucuag

SEQ ID NO: 389572 - RNA, 32 nt, Human
cgggcgggagagagaggccgcggccgccagcg

SEQ ID NO: 389573 - RNA, 32 nt, Human
cgggcgggagagaggaagagaggggagcgcgg

SEQ ID NO: 389574 - RNA, 32 nt, Human
cgggcgggaggaaggccgcugcucgcagggcu

SEQ ID NO: 389575 - RNA, 32 nt, Human
cgggcgggaggcggugguccugggagcggccc

SEQ ID NO: 389576 - RNA, 32 nt, Human
cgggcgggcgccucucggccaggaagcgccuc

SEQ ID NO: 389577 - RNA, 32 nt, Human
cgggcgggcgggacggaggccgggaggccggg

SEQ ID NO: 389578 - RNA, 32 nt, Human
cgggcgggcugggaggaugaggacggcugccc

SEQ ID NO: 389579 - RNA, 32 nt, Human
cgggcggggaggacggcgggggacauggccug

SEQ ID NO: 389580 - RNA, 32 nt, Human
cgggcggggcggccgcugccuccccgggacgg

SEQ ID NO: 389581 - RNA, 32 nt, Human
cgggcggggguacgagggaggaaggggagcaa

SEQ ID NO: 389582 - RNA, 32 nt, Human
cgggcgggugagcgagcagaggcgugggcggc

SEQ ID NO: 389583 - RNA, 32 nt, Human
cgggcggguggacgugaggaccagcccucucc

SEQ ID NO: 389584 - RNA, 32 nt, Human
cgggcggguguggccaggggugugggucugug

SEQ ID NO: 389585 - RNA, 32 nt, Human
cgggcgguaggcagcagcaggcugaagggauc

SEQ ID NO: 389586 - RNA, 32 nt, Human
cgggcgucaccaccggaguggagggcgaggcc

SEQ ID NO: 389587 - RNA, 23 nt, Human
cgggcgucacgccuguaauccca

SEQ ID NO: 389588 - RNA, 32 nt, Human
cgggcguccuuuccccgcuucuucccaccucg

SEQ ID NO: 389589 - RNA, 32 nt, Human
cgggcgucuugguugaaucuuuugcuacaaac

SEQ ID NO: 389590 - RNA, 31 nt, Human
cgggcgugacuucauuggccagaggacgcug

SEQ ID NO: 389591 - RNA, 32 nt, Human
cgggcgugagccaccgcgccuggccaggauuu

SEQ ID NO: 389592 - RNA, 32 nt, Human
cgggcgugaugaucucucugagccgcauccuc

SEQ ID NO: 389593 - RNA, 32 nt, Human
cgggcguggacucuggcgcacucuaguggaca

SEQ ID NO: 389594 - RNA, 31 nt, Human
cgggcguggguggaacagagcggccaggagu

SEQ ID NO: 389595 - RNA, 32 nt, Human
cgggcgugguggcucacgcugaggucaggagu

SEQ ID NO: 389596 - RNA, 32 nt, Human
cgggcgugguggcuucacgccuguaauucuag

SEQ ID NO: 389597 - RNA, 32 nt, Human
cgggcgugguuggcucaugccuguaaucccac

SEQ ID NO: 389598 - RNA, 32 nt, Human
cgggcguucgcuugcugugaauuccuguccuc

SEQ ID NO: 389599 - RNA, 32 nt, Human
cgggcuagaggagcagguacaugugaagauuu

SEQ ID NO: 389600 - RNA, 32 nt, Human
cgggcuaggcccagagacuuggguugcugguc

SEQ ID NO: 389601 - RNA, 32 nt, Human
cgggcuagucauggcguccccgucucggagac

SEQ ID NO: 389602 - RNA, 32 nt, Human
cgggcuauacucuuugaaacugccuuugugag

SEQ ID NO: 389603 - RNA, 32 nt, Human
cgggcucaagcaauccucccaccucagccucc

SEQ ID NO: 389604 - RNA, 24 nt, Human
cgggcucaagcaauccuccugccu

SEQ ID NO: 389605 - RNA, 24 nt, Human
cgggcucaagcgauucuccagccu

SEQ ID NO: 389606 - RNA, 24 nt, Human
cgggcucaagcgauucucucaccu

SEQ ID NO: 389607 - RNA, 24 nt, Human
cgggcucaagcgauucucuugccu

SEQ ID NO: 389608 - RNA, 32 nt, Human
cgggcucaagugacccucccaccucagccucc

SEQ ID NO: 389609 - RNA, 24 nt, Human
cgggcucaagugauucuccucccu

SEQ ID NO: 389610 - RNA, 24 nt, Human
cgggcucaagugguccuccugccu

SEQ ID NO: 389611 - RNA, 24 nt, Human
cgggcucacgccauucuccugccu

SEQ ID NO: 389612 - RNA, 32 nt, Human
cgggcucacugcaagcuccggcucccggguuc

SEQ ID NO: 389613 - RNA, 32 nt, Human
cgggcucacugugcagaccaaugauugacagu

SEQ ID NO: 389614 - RNA, 32 nt, Human
cgggcucagccugggagcccagcgacuacgcu

SEQ ID NO: 389615 - RNA, 32 nt, Human
cgggcucaggccacugcccacccuggccugga

SEQ ID NO: 389616 - RNA, 24 nt, Human
cgggcucaggugauucucccgccu

SEQ ID NO: 389617 - RNA, 24 nt, Human
cgggcuccagcgauucuccugccu

SEQ ID NO: 389618 - RNA, 32 nt, Human
cgggcucccagcugcccaccucauagcgcucc

SEQ ID NO: 389619 - RNA, 32 nt, Human
cgggcuccccauuccucuuugucaggccagcg

SEQ ID NO: 389620 - RNA, 32 nt, Human
cgggcucccccggcuccucuggccuccaugcc

SEQ ID NO: 389621 - RNA, 22 nt, Human
cgggcuccccgcugcuccagcu

SEQ ID NO: 389622 - RNA, 32 nt, Human
cgggcuccccuggcuccucuggccuccaugcc

SEQ ID NO: 389623 - RNA, 19 nt, Human
cgggcuccccuuucgccca

SEQ ID NO: 389624 - RNA, 22 nt, Human
cgggcucccgcccucagccgcu

SEQ ID NO: 389625 - RNA, 24 nt, Human
cgggcucccgcuccgucuccaccu

SEQ ID NO: 389626 - RNA, 22 nt, Human
cgggcucccgucccguccgucu

SEQ ID NO: 389627 - RNA, 32 nt, Human
cgggcucccucggguaccggcgcugccgcacc

SEQ ID NO: 389628 - RNA, 20 nt, Human
cgggcuccgccuuuccccca

SEQ ID NO: 389629 - RNA, 32 nt, Human
cgggcuccuaaugaggugggaaagccacggca

SEQ ID NO: 389630 - RNA, 32 nt, Human
cgggcuccuccacauuaccucgcagccccugc

SEQ ID NO: 389631 - RNA, 32 nt, Human
cgggcuccugacaaccuccuccccucggcgga

SEQ ID NO: 389632 - RNA, 32 nt, Human
cgggcuccugcagccgaagggaauucuccccu

SEQ ID NO: 389633 - RNA, 21 nt, Human
cgggcuccuguagucccagcu

SEQ ID NO: 389634 - RNA, 19 nt, Human
cgggcuccuucuuccuccc

SEQ ID NO: 389635 - RNA, 32 nt, Human
cgggcucgcgcggcgccgccuccugggcucag

SEQ ID NO: 389636 - RNA, 32 nt, Human
cgggcucgcgucauccugcccccgcugcgaug

SEQ ID NO: 389637 - RNA, 24 nt, Human
cgggcucggcagcggggggcccga

SEQ ID NO: 389638 - RNA, 32 nt, Human
cgggcucggcccuguccuccucacaggcuggu

SEQ ID NO: 389639 - RNA, 26 nt, Human
cgggcucggggugccgagguccggcu

SEQ ID NO: 389640 - RNA, 32 nt, Human
cgggcucgucgcuuucuccaucccgacccacg

SEQ ID NO: 389641 - RNA, 32 nt, Human
cgggcucgucgcuuucuccaucccgacccagc

SEQ ID NO: 389642 - RNA, 32 nt, Human
cgggcucucaccggagaccacagggaggagcu

SEQ ID NO: 389643 - RNA, 32 nt, Human
cgggcucucuggaaggccggggagaggccagu

SEQ ID NO: 389644 - RNA, 32 nt, Human
cgggcucugagcuggauugauggggccagucu

SEQ ID NO: 389645 - RNA, 32 nt, Human
cgggcucugggcugacgagagaacaccuggua

SEQ ID NO: 389646 - RNA, 32 nt, Human
cgggcucuucaggagacugagacagagaagac

SEQ ID NO: 389647 - RNA, 24 nt, Human
cgggcucuugacgcucagccagcu

SEQ ID NO: 389648 - RNA, 32 nt, Human
cgggcucuuggagccacuuuccccagcggaac

SEQ ID NO: 389649 - RNA, 32 nt, Human
cgggcugaaccagcuuuguucccaggguggcg

SEQ ID NO: 389650 - RNA, 32 nt, Human
cgggcugaagcgauccucccaccccagccucc

SEQ ID NO: 389651 - RNA, 32 nt, Human
cgggcugacagugagaggaugcagcccggugu

SEQ ID NO: 389652 - RNA, 32 nt, Human
cgggcugagagggaccuggggagcugcggccu

SEQ ID NO: 389653 - RNA, 32 nt, Human
cgggcugaggagaaggaggucagugcucaggg

SEQ ID NO: 389654 - RNA, 32 nt, Human
cgggcugcacuccucaacucugcuccaaagca

SEQ ID NO: 389655 - RNA, 32 nt, Human
cgggcugcauucccaggaguuuaggcauucua

SEQ ID NO: 389656 - RNA, 32 nt, Human
cgggcugccaacugcacucggguacuggugug

SEQ ID NO: 389657 - RNA, 32 nt, Human
cgggcugccagccuguggcacuguccucggug

SEQ ID NO: 389658 - RNA, 20 nt, Human
cgggcugcccccucccgcca

SEQ ID NO: 389659 - RNA, 32 nt, Human
cgggcugcccugcuuugcugccauggagucca

SEQ ID NO: 389660 - RNA, 32 nt, Human
cgggcugcggacucugccuccugggucugagc

SEQ ID NO: 389661 - RNA, 32 nt, Human
cgggcugcgggaauucagccuccggcgggggc

SEQ ID NO: 389662 - RNA, 32 nt, Human
cgggcugcgggaggggaggagagcagagaacg

SEQ ID NO: 389663 - RNA, 32 nt, Human
cgggcugcuccugggcacguggggcgcccagg

SEQ ID NO: 389664 - RNA, 32 nt, Human
cgggcugcucggaggcagaggcagcaagaggc

SEQ ID NO: 389665 - RNA, 32 nt, Human
cgggcugcugcugcccaugcaggagaaaaccu

SEQ ID NO: 389666 - RNA, 32 nt, Human
cgggcugcugggagguaggcagggacuugggc

SEQ ID NO: 389667 - RNA, 32 nt, Human
cgggcuggaagaggcggcggcgugaugcggcc

SEQ ID NO: 389668 - RNA, 32 nt, Human
cgggcuggacagugagccucgagaggagacgc

SEQ ID NO: 389669 - RNA, 32 nt, Human
cgggcuggagacauagcauucauuccuguuca

SEQ ID NO: 389670 - RNA, 32 nt, Human
cgggcuggcaggcgggggaggcugcaggcuca

SEQ ID NO: 389671 - RNA, 32 nt, Human
cgggcuggcagggacuggcaggaggcaggugc

SEQ ID NO: 389672 - RNA, 32 nt, Human
cgggcuggcauuuugugacccuucccuguugc

SEQ ID NO: 389673 - RNA, 32 nt, Human
cgggcuggccugacacaaugguagcucugaag

SEQ ID NO: 389674 - RNA, 32 nt, Human
cgggcuggcucuccuuucugugguuuuauuua

SEQ ID NO: 389675 - RNA, 32 nt, Human
cgggcuggcugcagagaaaccgcagggagagc

SEQ ID NO: 389676 - RNA, 32 nt, Human
cgggcugggcaggcagcucggggcagggagca

SEQ ID NO: 389677 - RNA, 18 nt, Human
cgggcugggccagaacag

SEQ ID NO: 389678 - RNA, 32 nt, Human
cgggcugggccgccaaggcaagaugguggacu

SEQ ID NO: 389679 - RNA, 32 nt, Human
cgggcugggcgccgguaguggaaagcgacggc

SEQ ID NO: 389680 - RNA, 32 nt, Human
cgggcugggcgguggagcaggagcuggcgucu

SEQ ID NO: 389681 - RNA, 32 nt, Human
cgggcugggcugggaccccucugccuccaggg

SEQ ID NO: 389682 - RNA, 32 nt, Human
cgggcuggguaccugaggucaccagcucggcu

SEQ ID NO: 389683 - RNA, 32 nt, Human
cgggcuggucucaaacuccuaaggucauccac

SEQ ID NO: 389684 - RNA, 32 nt, Human
cgggcuggucucaaacuccugaccuccgguga

SEQ ID NO: 389685 - RNA, 32 nt, Human
cgggcuggucucaaacuccugaccucuugauc

SEQ ID NO: 389686 - RNA, 32 nt, Human
cgggcuggucucaaacuccuggguucaaguga

SEQ ID NO: 389687 - RNA, 32 nt, Human
cgggcuggucucaaacuuguggcuucaaguua

SEQ ID NO: 389688 - RNA, 32 nt, Human
cgggcugguuugugcuuauuucugccauuguc

SEQ ID NO: 389689 - RNA, 32 nt, Human
cgggcugugcaggggcgaggggagcagggcgg

SEQ ID NO: 389690 - RNA, 32 nt, Human
cgggcugugccagcccucccagccccaggccc

SEQ ID NO: 389691 - RNA, 32 nt, Human
cgggcuguggggcugggcugugcugcacacug

SEQ ID NO: 389692 - RNA, 32 nt, Human
cgggcuguuuugcuccagccacuuuucuugua

SEQ ID NO: 389693 - RNA, 23 nt, Human
cgggcuuaauugaucuccugccu

SEQ ID NO: 389694 - RNA, 32 nt, Human
cgggcuuaggcaggcuguugaggagcuguggg

SEQ ID NO: 389695 - RNA, 32 nt, Human
cgggcuuaucaggcagccuccccaccagcucg

SEQ ID NO: 389696 - RNA, 32 nt, Human
cgggcuuauggguggagguugggaagaggaug

SEQ ID NO: 389697 - RNA, 32 nt, Human
cgggcuucagcccagucccagcugaggaacaa

SEQ ID NO: 389698 - RNA, 32 nt, Human
cgggcuucaucuuuacgcagcgggcccggcuc

SEQ ID NO: 389699 - RNA, 32 nt, Human
cgggcuuccaggcuggauggagugcccuggcg

SEQ ID NO: 389700 - RNA, 19 nt, Human
cgggcuuccgccagaagcc

SEQ ID NO: 389701 - RNA, 21 nt, Human
cgggcuuccuggaguccugcu

SEQ ID NO: 389702 - RNA, 22 nt, Human
cgggcuucucggaggguucacu

SEQ ID NO: 389703 - RNA, 32 nt, Human
cgggcuucuggcccucuccagugcucuaggag

SEQ ID NO: 389704 - RNA, 32 nt, Human
cgggcuugagccagaggcuggggagcugaguc

SEQ ID NO: 389705 - RNA, 32 nt, Human
cgggcuugcaccacugcggucucccacccagg

SEQ ID NO: 389706 - RNA, 32 nt, Human
cgggcuuggccggaacugaauugguagaggua

SEQ ID NO: 389707 - RNA, 32 nt, Human
cgggcuuggucaagagcaggaggcggaggugg

SEQ ID NO: 389708 - RNA, 32 nt, Human
cgggcuugucuuccucuuccauguccccgcau

SEQ ID NO: 389709 - RNA, 32 nt, Human
cggggaaaccgugaaauguuguguacacacgu

SEQ ID NO: 389710 - RNA, 32 nt, Human
cggggaaagcagcuggugugggaggaaaggcu

SEQ ID NO: 389711 - RNA, 32 nt, Human
cggggaaaggcucgaggagagcgcggcucacg

SEQ ID NO: 389712 - RNA, 22 nt, Human
cggggaacagaugaauauuuca

SEQ ID NO: 389713 - RNA, 32 nt, Human
cggggaacagcauccuaugaacugaaagagca

SEQ ID NO: 389714 - RNA, 20 nt, Human
cggggaacccguuucuccca

SEQ ID NO: 389715 - RNA, 32 nt, Human
cggggaagaagcgcagucuccggguugggggc

SEQ ID NO: 389716 - RNA, 32 nt, Human
cggggaagagauggcggcggagcggggagccc

SEQ ID NO: 389717 - RNA, 30 nt, Human
cggggaagccucuccaacuccuccuagccc

SEQ ID NO: 389718 - RNA, 32 nt, Human
cggggaagcuccagaagguggggagaggggac

SEQ ID NO: 389719 - RNA, 32 nt, Human
cggggaaggaacuuccucugggaaccuuuggg

SEQ ID NO: 389720 - RNA, 32 nt, Human
cggggaaggaggaggaagaggggcagguguag

SEQ ID NO: 389721 - RNA, 32 nt, Human
cggggaagggagcaaaucccugagaggagugc

SEQ ID NO: 389722 - RNA, 32 nt, Human
cggggaaguggaggcagagggagcgggcacgg

SEQ ID NO: 389723 - RNA, 32 nt, Human
cggggaaucucuccaggacauuggagugggca

SEQ ID NO: 389724 - RNA, 32 nt, Human
cggggaaugccucccuggaauguuccagagac

SEQ ID NO: 389725 - RNA, 21 nt, Human
cggggacaaaggacaaacaga

SEQ ID NO: 389726 - RNA, 32 nt, Human
cggggacaacugccuggugacacugcugccgc

SEQ ID NO: 389727 - RNA, 20 nt, Human
cggggacaccagcacugagc

SEQ ID NO: 389728 - RNA, 32 nt, Human
cggggacagagcagugaccauggccaggcugg

SEQ ID NO: 389729 - RNA, 32 nt, Human
cggggacagagcugcccccgaggguccuggcu

SEQ ID NO: 389730 - RNA, 22 nt, Human
cggggacagccaccuccugcug

SEQ ID NO: 389731 - RNA, 32 nt, Human
cggggacaggaaagggaauuccaaggggcagg

SEQ ID NO: 389732 - RNA, 21 nt, Human
cggggaccagccgcccaggga

SEQ ID NO: 389733 - RNA, 26 nt, Human
cggggaccaggagggagcggggucgg

SEQ ID NO: 389734 - RNA, 24 nt, Human
cggggacccacgccguggccacug

SEQ ID NO: 389735 - RNA, 20 nt, Human
cggggacccccagggccgcu

SEQ ID NO: 389736 - RNA, 19 nt, Human
cggggaccccgggggccgc

SEQ ID NO: 389737 - RNA, 19 nt, Human
cggggacccgcgcgagggg

SEQ ID NO: 389738 - RNA, 20 nt, Human
cggggacccgggcucaggga

SEQ ID NO: 389739 - RNA, 32 nt, Human
cggggacccugauccaccagggacccagggca

SEQ ID NO: 389740 - RNA, 32 nt, Human
cggggaccgcugcggcagcagaggcggcuggc

SEQ ID NO: 389741 - RNA, 21 nt, Human
cggggaccggcaggggcccgg

SEQ ID NO: 389742 - RNA, 32 nt, Human
cggggaccugcucgcuguccgcucgggugcag

SEQ ID NO: 389743 - RNA, 32 nt, Human
cggggaccugcucucccuggggcucuacuacc

SEQ ID NO: 389744 - RNA, 18 nt, Human
cggggacggcggcggcgg

SEQ ID NO: 389745 - RNA, 31 nt, Human
cggggacggugcagcaggcggcgggaugcgg

SEQ ID NO: 389746 - RNA, 32 nt, Human
cggggacucaagaggaaucuguuucucugcug

SEQ ID NO: 389747 - RNA, 32 nt, Human
cggggacucccaggccucaguguggcagggug

SEQ ID NO: 389748 - RNA, 32 nt, Human
cggggacucccaggcuggagagcacugccagg

SEQ ID NO: 389749 - RNA, 32 nt, Human
cggggacugaagauggcgccgcgaggugagau

SEQ ID NO: 389750 - RNA, 32 nt, Human
cggggacugcaaccucaguccacagacggccc

SEQ ID NO: 389751 - RNA, 32 nt, Human
cggggacuggccucucugcacggcuguguaca

SEQ ID NO: 389752 - RNA, 32 nt, Human
cggggacuguggaccccacccugcugcacgga

SEQ ID NO: 389753 - RNA, 32 nt, Human
cggggacuguugugggguagggggauggggga

SEQ ID NO: 389754 - RNA, 32 nt, Human
cggggagaaauguugcccaggaaggacaggug

SEQ ID NO: 389755 - RNA, 32 nt, Human
cggggagaacagacauggaggaagcgcaggcc

SEQ ID NO: 389756 - RNA, 32 nt, Human
cggggagaacauacaaacucugccuucgguca

SEQ ID NO: 389757 - RNA, 32 nt, Human
cggggagaagccagcagccaugcugaacucuc

SEQ ID NO: 389758 - RNA, 32 nt, Human
cggggagaagcggaguuucuucuuuguggcau

SEQ ID NO: 389759 - RNA, 32 nt, Human
cggggagaagggcgacuuucaggccugaggag

SEQ ID NO: 389760 - RNA, 23 nt, Human
cggggagagcgaggcggggccgc

SEQ ID NO: 389761 - RNA, 32 nt, Human
cggggagagcgugggucacugccccuccugcc

SEQ ID NO: 389762 - RNA, 32 nt, Human
cggggagaggccagugugggaggaccuggugg

SEQ ID NO: 389763 - RNA, 32 nt, Human
cggggagaugcuggugagggguccguacaggg

SEQ ID NO: 389764 - RNA, 32 nt, Human
cggggagcaauggaaucagauggcucauucuc

SEQ ID NO: 389765 - RNA, 32 nt, Human
cggggagcacugaagacaccugggacccgcag

SEQ ID NO: 389766 - RNA, 32 nt, Human
cggggagccaaagagugugguguguggcgcua

SEQ ID NO: 389767 - RNA, 32 nt, Human
cggggagccagcgauuggaggcucagaaggag

SEQ ID NO: 389768 - RNA, 32 nt, Human
cggggagcccaggguaaaggcagcaguaaugc

SEQ ID NO: 389769 - RNA, 32 nt, Human
cggggagccgaguccagaucuuccugcaagug

SEQ ID NO: 389770 - RNA, 32 nt, Human
cggggagccugcaaagccucucagauucaaac

SEQ ID NO: 389771 - RNA, 32 nt, Human
cggggagccuggggcugagauucugggcacag

SEQ ID NO: 389772 - RNA, 32 nt, Human
cggggagcgcggccuccgcccuuggggcccuc

SEQ ID NO: 389773 - RNA, 32 nt, Human
cggggagcgggcgggaaauggaacugugacgg

SEQ ID NO: 389774 - RNA, 32 nt, Human
cggggagcgggcggggcagccaugcuccuguc

SEQ ID NO: 389775 - RNA, 32 nt, Human
cggggagcugcaggaaccagacugggggcgag

SEQ ID NO: 389776 - RNA, 32 nt, Human
cggggaggaagugcaccuagaaagauuaauga

SEQ ID NO: 389777 - RNA, 22 nt, Human
cggggaggacaccuaccugcug

SEQ ID NO: 389778 - RNA, 19 nt, Human
cggggaggacagcggggcc

SEQ ID NO: 389779 - RNA, 32 nt, Human
cggggaggagaaaguggcgaguuccggauccc

SEQ ID NO: 389780 - RNA, 32 nt, Human
cggggaggagaggcggcggcggcaguguccaa

SEQ ID NO: 389781 - RNA, 32 nt, Human
cggggaggaggaacccgagcagcagcggcggc

SEQ ID NO: 389782 - RNA, 32 nt, Human
cggggaggaggaggaggaggaagaggaggaga

SEQ ID NO: 389783 - RNA, 23 nt, Human
cggggaggccaaacuuccugcug

SEQ ID NO: 389784 - RNA, 32 nt, Human
cggggaggccagggcgacagaggacucgggag

SEQ ID NO: 389785 - RNA, 32 nt, Human
cggggaggcugaggcaggagaaucgcuagaac

SEQ ID NO: 389786 - RNA, 32 nt, Human
cggggaggcugaggcaggagaauugcuugaac

SEQ ID NO: 389787 - RNA, 32 nt, Human
cggggaggcugagguaggagaauagcgugaac

SEQ ID NO: 389788 - RNA, 32 nt, Human
cggggaggcugcaaacaugggcccaggaaaca

SEQ ID NO: 389789 - RNA, 32 nt, Human
cggggaggcugcagaggaggagcagggugggg

SEQ ID NO: 389790 - RNA, 32 nt, Human
cggggaggcugcagcgcagagcagcggggcug

SEQ ID NO: 389791 - RNA, 32 nt, Human
cggggagggaaagggaaaacggggcucggcau

SEQ ID NO: 389792 - RNA, 32 nt, Human
cggggagggaagccucggggcugcggggugag

SEQ ID NO: 389793 - RNA, 32 nt, Human
cggggagggaggaggaggagaagaugcgcagu

SEQ ID NO: 389794 - RNA, 32 nt, Human
cggggaggggauguuaguaggacugaucaugg

SEQ ID NO: 389795 - RNA, 32 nt, Human
cggggaggggcggauggaggggccuggguugc

SEQ ID NO: 389796 - RNA, 32 nt, Human
cggggaggguugggaagggggugcaggaagcu

SEQ ID NO: 389797 - RNA, 32 nt, Human
cggggagguguggaggugagggguuagaggag

SEQ ID NO: 389798 - RNA, 32 nt, Human
cggggaguggugguggcugccuguaaucccag

SEQ ID NO: 389799 - RNA, 32 nt, Human
cggggaguuagcagagggucagacuccuacag

SEQ ID NO: 389800 - RNA, 25 nt, Human
cggggaucaagcaacucuccugccu

SEQ ID NO: 389801 - RNA, 32 nt, Human
cggggaucaagcaacucuccugccucagccuc

SEQ ID NO: 389802 - RNA, 21 nt, Human
cggggaucgcggcggaggcgg

SEQ ID NO: 389803 - RNA, 32 nt, Human
cggggaucucugcuggccccauccuacauccu

SEQ ID NO: 389804 - RNA, 32 nt, Human
cggggaucugggagggucgggggagcaaaagg

SEQ ID NO: 389805 - RNA, 32 nt, Human
cggggaugaaaggaagagaggggccaauuggg

SEQ ID NO: 389806 - RNA, 18 nt, Human
cggggaugcaggaugcag

SEQ ID NO: 389807 - RNA, 32 nt, Human
cggggauucaaagccgccguuccccagguccc

SEQ ID NO: 389808 - RNA, 32 nt, Human
cggggauucucagucgaguuuccagagcagga

SEQ ID NO: 389809 - RNA, 32 nt, Human
cggggauugcucauggcaugggccucuuacgu

SEQ ID NO: 389810 - RNA, 32 nt, Human
cggggauuguggguguuauacauacauuuagg

SEQ ID NO: 389811 - RNA, 32 nt, Human
cggggauuucuuuccaggguaggggaggggcc

SEQ ID NO: 389812 - RNA, 32 nt, Human
cggggcaacauggcaaaacccugucucuacua

SEQ ID NO: 389813 - RNA, 32 nt, Human
cggggcaagaggagggagaaggcagggccgug

SEQ ID NO: 389814 - RNA, 32 nt, Human
cggggcaaggagcacguggcagcgcaggaaac

SEQ ID NO: 389815 - RNA, 22 nt, Human
cggggcacaggaaagggccgcu

SEQ ID NO: 389816 - RNA, 32 nt, Human
cggggcacuggcagaggucgccaagaagagcc

SEQ ID NO: 389817 - RNA, 32 nt, Human
cggggcagaucuuuccucuugucugugguaag

SEQ ID NO: 389818 - RNA, 32 nt, Human
cggggcagccugaguguggggagagcaagcug

SEQ ID NO: 389819 - RNA, 32 nt, Human
cggggcagcguggaggugagggucgggugagg

SEQ ID NO: 389820 - RNA, 21 nt, Human
cggggcagcuccgcugcucug

SEQ ID NO: 389821 - RNA, 32 nt, Human
cggggcagcugcugcacuggcccagggagggc

SEQ ID NO: 389822 - RNA, 20 nt, Human
cggggcaggaagggaggcgg

SEQ ID NO: 389823 - RNA, 32 nt, Human
cggggcaggacgcugcagcucucuccagcccu

SEQ ID NO: 389824 - RNA, 32 nt, Human
cggggcaggaggaucaccuuaggucaggaguu

SEQ ID NO: 389825 - RNA, 32 nt, Human
cggggcaggcaggagucugggaggcggguccg

SEQ ID NO: 389826 - RNA, 32 nt, Human
cggggcaggccugacgggcagcugaggauugc

SEQ ID NO: 389827 - RNA, 32 nt, Human
cggggcaggcuugugaaggcuuggugggaccu

SEQ ID NO: 389828 - RNA, 32 nt, Human
cggggcagggagaacucucuucugcuaaaucg

SEQ ID NO: 389829 - RNA, 32 nt, Human
cggggcaggggcggaggcggaggcagaggugg

SEQ ID NO: 389830 - RNA, 32 nt, Human
cggggcagguuagagucccgaucuuggccagg

SEQ ID NO: 389831 - RNA, 32 nt, Human
cggggcaguucacucugucucccaggcuggag

SEQ ID NO: 389832 - RNA, 32 nt, Human
cggggcaguucuggaacaguucaggauggcca

SEQ ID NO: 389833 - RNA, 32 nt, Human
cggggcauagaaccuguccuggugcugggcaa

SEQ ID NO: 389834 - RNA, 22 nt, Human
cggggcauggaagcagccuccu

SEQ ID NO: 389835 - RNA, 32 nt, Human
cggggcaugguggcucacaccuguaaucccaa

SEQ ID NO: 389836 - RNA, 32 nt, Human
cggggcaugguggcucaugccuguaaucccag

SEQ ID NO: 389837 - RNA, 32 nt, Human
cggggcauuccagcugagacacugugauuuua

SEQ ID NO: 389838 - RNA, 24 nt, Human
cggggccaagcgauccuccugccu

SEQ ID NO: 389839 - RNA, 32 nt, Human
cggggccaccacccucuccuugcuuucagccc

SEQ ID NO: 389840 - RNA, 22 nt, Human
cggggccaccagcacaugccug

SEQ ID NO: 389841 - RNA, 21 nt, Human
cggggccaccagcacugcugc

SEQ ID NO: 389842 - RNA, 22 nt, Human
cggggccacccccuuccuguca

SEQ ID NO: 389843 - RNA, 17 nt, Human
cggggccagcagccgcc

SEQ ID NO: 389844 - RNA, 32 nt, Human
cggggccagcugcguucugagccugggcgcag

SEQ ID NO: 389845 - RNA, 32 nt, Human
cggggccaggaggccaggcgcuugccuuagga

SEQ ID NO: 389846 - RNA, 32 nt, Human
cggggccagggcggcggcccccagggaguugg

SEQ ID NO: 389847 - RNA, 32 nt, Human
cggggccagggugagaggagagaugaugaguu

SEQ ID NO: 389848 - RNA, 32 nt, Human
cggggcccacccugcccagcucagggauuggc

SEQ ID NO: 389849 - RNA, 32 nt, Human
cggggcccagaacgaagcggggaggcgccccu

SEQ ID NO: 389850 - RNA, 32 nt, Human
cggggccccagcccacuccacccugccagcag

SEQ ID NO: 389851 - RNA, 18 nt, Human
cggggccccagcccccca

SEQ ID NO: 389852 - RNA, 32 nt, Human
cggggccccucagaucaggaauaccagauaaa

SEQ ID NO: 389853 - RNA, 22 nt, Human
cggggcccgcggcgcgcgggga

SEQ ID NO: 389854 - RNA, 18 nt, Human
cggggcccgcuccagccc

SEQ ID NO: 389855 - RNA, 21 nt, Human
cggggcccuccuggccgggga

SEQ ID NO: 389856 - RNA, 18 nt, Human
cggggccgccacucuccu

SEQ ID NO: 389857 - RNA, 32 nt, Human
cggggccgcccagacccugggcucagccucgc

SEQ ID NO: 389858 - RNA, 22 nt, Human
cggggccgcccugccccgguca

SEQ ID NO: 389859 - RNA, 19 nt, Human
cggggccgcgccgcggccu

SEQ ID NO: 389860 - RNA, 32 nt, Human
cggggccgcgcugcacgugcucuugucccagc

SEQ ID NO: 389861 - RNA, 32 nt, Human
cggggccgcgggaugagccaggugagcgcgga

SEQ ID NO: 389862 - RNA, 32 nt, Human
cggggccgcggggcccaggaauggcguaaggg

SEQ ID NO: 389863 - RNA, 32 nt, Human
cggggccgcggguggaggucggggaugaggca

SEQ ID NO: 389864 - RNA, 21 nt, Human
cggggccggcaucugcucccc

SEQ ID NO: 389865 - RNA, 32 nt, Human
cggggccggcgcgggccuuuccuuccaucgga

SEQ ID NO: 389866 - RNA, 32 nt, Human
cggggccgggccugaagggucccccgccagcc

SEQ ID NO: 389867 - RNA, 32 nt, Human
cggggccucuggggcauggcuacagcuguggc

SEQ ID NO: 389868 - RNA, 32 nt, Human
cggggccucuuuauuucucuccacccuaacuc

SEQ ID NO: 389869 - RNA, 32 nt, Human
cggggccugcagcaggcuuggaggcuucgcgc

SEQ ID NO: 389870 - RNA, 32 nt, Human
cggggccuggacugcacaggcagcaaggucau

SEQ ID NO: 389871 - RNA, 32 nt, Human
cggggccuggacuugccuaggauuucccgacc

SEQ ID NO: 389872 - RNA, 32 nt, Human
cggggccugggagcugagggcgucucaucucc

SEQ ID NO: 389873 - RNA, 32 nt, Human
cggggccugggugaccgccaauacuugaccac

SEQ ID NO: 389874 - RNA, 32 nt, Human
cggggccuguugagggguagggggcuagagga

SEQ ID NO: 389875 - RNA, 32 nt, Human
cggggccuguugugggggcgggggagggaaag

SEQ ID NO: 389876 - RNA, 32 nt, Human
cggggccuuccugcaaccuuugcggcuccaac

SEQ ID NO: 389877 - RNA, 32 nt, Human
cggggcgacgugccugagucaccccgucccgc

SEQ ID NO: 389878 - RNA, 32 nt, Human
cggggcgaggagaaggugggaagccguggccg

SEQ ID NO: 389879 - RNA, 32 nt, Human
cggggcgagggaggaggaagaagcggaggagg

SEQ ID NO: 389880 - RNA, 32 nt, Human
cggggcgcaguggcucacgccuguaaucccag

SEQ ID NO: 389881 - RNA, 32 nt, Human
cggggcgcccccagucuauggagcgggguaag

SEQ ID NO: 389882 - RNA, 32 nt, Human
cggggcgcccucagcucccugcuuggcucugu

SEQ ID NO: 389883 - RNA, 32 nt, Human
cggggcgccggaggaagaggaggacccacggg

SEQ ID NO: 389884 - RNA, 32 nt, Human
cggggcgcgcugcauugugggguggcggcggc

SEQ ID NO: 389885 - RNA, 32 nt, Human
cggggcgcgggaggaggaaguagagcccggga

SEQ ID NO: 389886 - RNA, 32 nt, Human
cggggcgcgggcggcccagcagagcuggccug

SEQ ID NO: 389887 - RNA, 32 nt, Human
cggggcgcugccgaagugcaaggccacggcca

SEQ ID NO: 389888 - RNA, 32 nt, Human
cggggcgcuggccuaccuccugaggaccucag

SEQ ID NO: 389889 - RNA, 32 nt, Human
cggggcgcugggccgccagccucggcaccguc

SEQ ID NO: 389890 - RNA, 32 nt, Human
cggggcggaagaggaggaggaggaggaggaag

SEQ ID NO: 389891 - RNA, 32 nt, Human
cggggcggaugcugcauccucugccucccugg

SEQ ID NO: 389892 - RNA, 32 nt, Human
cggggcggcauccccagcugguucgggccgug

SEQ ID NO: 389893 - RNA, 32 nt, Human
cggggcggccggcggaggagcagcaggauccc

SEQ ID NO: 389894 - RNA, 32 nt, Human
cggggcggccggcggaggcccauguggcgcuc

SEQ ID NO: 389895 - RNA, 32 nt, Human
cggggcggcuggccaggcagaggggcuccuca

SEQ ID NO: 389896 - RNA, 32 nt, Human
cggggcggcuggccgggcagagcggcuccuca

SEQ ID NO: 389897 - RNA, 32 nt, Human
cggggcgggaccgggggcgggagcagcgcggg

SEQ ID NO: 389898 - RNA, 32 nt, Human
cggggcgggaggcggugaccagcagcaggagg

SEQ ID NO: 389899 - RNA, 32 nt, Human
cggggcgggcaggcccagcugagaggugcgcg

SEQ ID NO: 389900 - RNA, 32 nt, Human
cggggcggggcagaggugagggcugggcccag

SEQ ID NO: 389901 - RNA, 32 nt, Human
cggggcggggcgcgcagcaggagcgagugggg

SEQ ID NO: 389902 - RNA, 32 nt, Human
cggggcgggggcggggcggcagugagcucggc

SEQ ID NO: 389903 - RNA, 20 nt, Human
cggggcggggggaagcgcuc

SEQ ID NO: 389904 - RNA, 32 nt, Human
cggggcggggugggagguaacgggacgggcgc

SEQ ID NO: 389905 - RNA, 32 nt, Human
cggggcgucgggcacgaggccaggggucacua

SEQ ID NO: 389906 - RNA, 32 nt, Human
cggggcguggcagggcccucucugugccucuc

SEQ ID NO: 389907 - RNA, 32 nt, Human
cggggcuaaagcggaggaggggaccagccuca

SEQ ID NO: 389908 - RNA, 32 nt, Human
cggggcuagaggcagauggaagggaggcauuu

SEQ ID NO: 389909 - RNA, 32 nt, Human
cggggcucaagcgauccucccgcuucagccuc

SEQ ID NO: 389910 - RNA, 32 nt, Human
cggggcucagcauucacauucacugcacugcc

SEQ ID NO: 389911 - RNA, 32 nt, Human
cggggcucaggaguuggggguccuccacgugu

SEQ ID NO: 389912 - RNA, 32 nt, Human
cggggcucaggugauuuucccaccucagcuuu

SEQ ID NO: 389913 - RNA, 32 nt, Human
cggggcucaggugggaggauugcuugaggcca

SEQ ID NO: 389914 - RNA, 32 nt, Human
cggggcuccacauugcuguacgcacagagaug

SEQ ID NO: 389915 - RNA, 32 nt, Human
cggggcuccagccugcaccugcaccaggcaca

SEQ ID NO: 389916 - RNA, 19 nt, Human
cggggcucccaagggccug

SEQ ID NO: 389917 - RNA, 32 nt, Human
cggggcuccccucucugcuccacgccauucag

SEQ ID NO: 389918 - RNA, 32 nt, Human
cggggcuccugagggagcuccaacucagaagg

SEQ ID NO: 389919 - RNA, 24 nt, Human
cggggcuccuggaggggggcccug

SEQ ID NO: 389920 - RNA, 32 nt, Human
cggggcuccugucucugccuccugggccuuca

SEQ ID NO: 389921 - RNA, 20 nt, Human
cggggcucgccagcgcuuca

SEQ ID NO: 389922 - RNA, 20 nt, Human
cggggcucggccccgggcca

SEQ ID NO: 389923 - RNA, 18 nt, Human
cggggcucuccacccgcc

SEQ ID NO: 389924 - RNA, 32 nt, Human
cggggcucuccaggacucagugguuucggaga

SEQ ID NO: 389925 - RNA, 32 nt, Human
cggggcucucugaacaccuccagcagaggguc

SEQ ID NO: 389926 - RNA, 32 nt, Human
cggggcucuucagcccuccugggagcucagug

SEQ ID NO: 389927 - RNA, 32 nt, Human
cggggcugaagugcaggcuccuggaggagcgg

SEQ ID NO: 389928 - RNA, 32 nt, Human
cggggcugaccaggcuggggguccagugaaac

SEQ ID NO: 389929 - RNA, 20 nt, Human
cggggcugacccgucacuuu

SEQ ID NO: 389930 - RNA, 21 nt, Human
cggggcugagacgcacgccuu

SEQ ID NO: 389931 - RNA, 32 nt, Human
cggggcugagagaauuuugagcucuagccauc

SEQ ID NO: 389932 - RNA, 32 nt, Human
cggggcugaguguuugugaaagauguugccac

SEQ ID NO: 389933 - RNA, 32 nt, Human
cggggcugcaccugccgggugggcugcuccug

SEQ ID NO: 389934 - RNA, 32 nt, Human
cggggcugcaggcuggagugcagugggacagc

SEQ ID NO: 389935 - RNA, 32 nt, Human
cggggcugccgaggccacggccgcccccaccc

SEQ ID NO: 389936 - RNA, 32 nt, Human
cggggcugcgcggccgccgcugugcuggcuuu

SEQ ID NO: 389937 - RNA, 25 nt, Human
cggggcugcuucucuacacagccuc

SEQ ID NO: 389938 - RNA, 19 nt, Human
cggggcuggagaccaccuu

SEQ ID NO: 389939 - RNA, 19 nt, Human
cggggcuggauggcaccuc

SEQ ID NO: 389940 - RNA, 19 nt, Human
cggggcuggcaggagcucu

SEQ ID NO: 389941 - RNA, 20 nt, Human
cggggcuggcagggaccucu

SEQ ID NO: 389942 - RNA, 20 nt, Human
cggggcuggccccaugcccu

SEQ ID NO: 389943 - RNA, 21 nt, Human
cggggcuggccuggcagcgcu

SEQ ID NO: 389944 - RNA, 18 nt, Human
cggggcuggccuggccuc

SEQ ID NO: 389945 - RNA, 32 nt, Human
cggggcuggcugcaguguaccguggacagccu

SEQ ID NO: 389946 - RNA, 17 nt, Human
cggggcugggacaccuc

SEQ ID NO: 389947 - RNA, 18 nt, Human
cggggcugggacccacuc

SEQ ID NO: 389948 - RNA, 19 nt, Human
cggggcugggacucacucu

SEQ ID NO: 389949 - RNA, 32 nt, Human
cggggcugggcaggcuggauguggugguguac

SEQ ID NO: 389950 - RNA, 21 nt, Human
cggggcugggcgcggggccgg

SEQ ID NO: 389951 - RNA, 32 nt, Human
cggggcuggggagagacauguggacacguggc

SEQ ID NO: 389952 - RNA, 21 nt, Human
cggggcuggggaggacacucu

SEQ ID NO: 389953 - RNA, 32 nt, Human
cggggcuggggucggggccaggaggaauuuug

SEQ ID NO: 389954 - RNA, 22 nt, Human
cggggcuggguuggcgcacccu

SEQ ID NO: 389955 - RNA, 20 nt, Human
cggggcugguucaucaccuc

SEQ ID NO: 389956 - RNA, 32 nt, Human
cggggcuguagggagggcagggggaggagagu

SEQ ID NO: 389957 - RNA, 32 nt, Human
cggggcugucacugcagaagucuuccacaggc

SEQ ID NO: 389958 - RNA, 32 nt, Human
cggggcuguggcuggcagcuuggugggcccca

SEQ ID NO: 389959 - RNA, 32 nt, Human
cggggcuuccauccuuccuuugacugauuuuu

SEQ ID NO: 389960 - RNA, 20 nt, Human
cggggcuucgccggggccgg

SEQ ID NO: 389961 - RNA, 32 nt, Human
cggggcuucuccugccuccaucacaucacaga

SEQ ID NO: 389962 - RNA, 32 nt, Human
cggggcuugccuugguuuucagucuucucucu

SEQ ID NO: 389963 - RNA, 32 nt, Human
cggggcuuucuggcugccccuucaccaccccg

SEQ ID NO: 389964 - RNA, 22 nt, Human
cggggcuuugcgcguggcggcc

SEQ ID NO: 389965 - RNA, 32 nt, Human
cggggcuuuggaggugaaagaggcccagagua

SEQ ID NO: 389966 - RNA, 32 nt, Human
cgggggaaagagagagcuccuuucgccauguu

SEQ ID NO: 389967 - RNA, 22 nt, Human
cgggggaaaggaggcggcagcc

SEQ ID NO: 389968 - RNA, 32 nt, Human
cgggggaagaaagagaaacuagugcugguuuu

SEQ ID NO: 389969 - RNA, 23 nt, Human
cgggggaagcagcgugagcagcc

SEQ ID NO: 389970 - RNA, 23 nt, Human
cgggggaagcgucuccagcugcc

SEQ ID NO: 389971 - RNA, 21 nt, Human
cgggggaagcuggcagcaggc

SEQ ID NO: 389972 - RNA, 22 nt, Human
cgggggacgccugcccugccca

SEQ ID NO: 389973 - RNA, 32 nt, Human
cgggggacgggugggugcaguggcucacaucu

SEQ ID NO: 389974 - RNA, 32 nt, Human
cgggggacugcgccagguuccccagccgccca

SEQ ID NO: 389975 - RNA, 26 nt, Human
cgggggagcagcagcgcacggcggcc

SEQ ID NO: 389976 - RNA, 32 nt, Human
cgggggagccccgggagccgcacggagaugga

SEQ ID NO: 389977 - RNA, 19 nt, Human
cgggggagccggggcucag

SEQ ID NO: 389978 - RNA, 32 nt, Human
cgggggagccugagucaggaggucagugggcc

SEQ ID NO: 389979 - RNA, 32 nt, Human
cgggggagcuccugccaggagccgaauaacug

SEQ ID NO: 389980 - RNA, 32 nt, Human
cgggggaggagaaaaggggaguccagucguca

SEQ ID NO: 389981 - RNA, 32 nt, Human
cgggggaggagaaagggagacagcagaagaaa

SEQ ID NO: 389982 - RNA, 32 nt, Human
cgggggaggaggaggaggagaagguggagagg

SEQ ID NO: 389983 - RNA, 23 nt, Human
cgggggaggcagcgugagcagcc

SEQ ID NO: 389984 - RNA, 19 nt, Human
cgggggaggcggcggcgcc

SEQ ID NO: 389985 - RNA, 32 nt, Human
cgggggaggcugggagcugggccuccugcgug

SEQ ID NO: 389986 - RNA, 32 nt, Human
cgggggagggaggaggagggaggcggcgagga

SEQ ID NO: 389987 - RNA, 26 nt, Human
cgggggaggggaaggaagggccgcug

SEQ ID NO: 389988 - RNA, 32 nt, Human
cgggggaggggcaggagagggauauggagagc

SEQ ID NO: 389989 - RNA, 23 nt, Human
cgggggaggggccgcgcagcagc

SEQ ID NO: 389990 - RNA, 32 nt, Human
cgggggaucuuaguugcuuauuuguuuugacu

SEQ ID NO: 389991 - RNA, 32 nt, Human
cgggggaugaaggcgggagcugagggcuggag

SEQ ID NO: 389992 - RNA, 32 nt, Human
cgggggaugaaugauuccagacagugggaagg

SEQ ID NO: 389993 - RNA, 32 nt, Human
cgggggaugaggauauggcagggaagcuuuca

SEQ ID NO: 389994 - RNA, 32 nt, Human
cgggggcaaggagucaaggcuugggggcgggu

SEQ ID NO: 389995 - RNA, 21 nt, Human
cgggggcacuuggaggaccug

SEQ ID NO: 389996 - RNA, 22 nt, Human
cgggggcagagcggagccgcag

SEQ ID NO: 389997 - RNA, 32 nt, Human
cgggggcagaggcugcagugagccgagauugu

SEQ ID NO: 389998 - RNA, 32 nt, Human
cgggggcaggagacggagcugagcggcggggg

SEQ ID NO: 389999 - RNA, 21 nt, Human
cgggggcaggagggaccaagg

SEQ ID NO: 390000 - RNA, 23 nt, Human
cgggggcagggcauucccucgga

SEQ ID NO: 390001 - RNA, 32 nt, Human
cgggggcagggugcgugggaggacggagccug

SEQ ID NO: 390002 - RNA, 27 nt, Human
cgggggcaggucguuggagacugaaga

SEQ ID NO: 390003 - RNA, 32 nt, Human
cgggggcauguguggacauccacacacagcgc

SEQ ID NO: 390004 - RNA, 32 nt, Human
cgggggcauuggggacacagggaagggaaagc

SEQ ID NO: 390005 - RNA, 22 nt, Human
cgggggccacgucagcggggcc

SEQ ID NO: 390006 - RNA, 32 nt, Human
cgggggccagcccaggagggcgggugguuugu

SEQ ID NO: 390007 - RNA, 32 nt, Human
cgggggccauggggccuccugagguacaccuu

SEQ ID NO: 390008 - RNA, 32 nt, Human
cgggggcccacaccccucacacgcaaaacugg

SEQ ID NO: 390009 - RNA, 21 nt, Human
cgggggccgcgcgagggccgg

SEQ ID NO: 390010 - RNA, 22 nt, Human
cgggggccggcgcggcggccgg

SEQ ID NO: 390011 - RNA, 22 nt, Human
cgggggccgggccgggggcggg

SEQ ID NO: 390012 - RNA, 22 nt, Human
cgggggccgggcgggagccugg

SEQ ID NO: 390013 - RNA, 20 nt, Human
cgggggccgggcggggccgg

SEQ ID NO: 390014 - RNA, 25 nt, Human
cgggggccggggagugaggggccgg

SEQ ID NO: 390015 - RNA, 22 nt, Human
cgggggccuaccuuccccaggg

SEQ ID NO: 390016 - RNA, 32 nt, Human
cgggggccucgggagggugaaaggagggagga

SEQ ID NO: 390017 - RNA, 32 nt, Human
cgggggccucugcaccuggucugcagggccag

SEQ ID NO: 390018 - RNA, 32 nt, Human
cgggggccucuggcugcugaaggauucggucu

SEQ ID NO: 390019 - RNA, 23 nt, Human
cgggggccugacggccgggccgg

SEQ ID NO: 390020 - RNA, 32 nt, Human
cgggggccuguaaucccagcuacucaggaggc

SEQ ID NO: 390021 - RNA, 32 nt, Human
cgggggccuguaauccuagcuacuuggggugc

SEQ ID NO: 390022 - RNA, 32 nt, Human
cgggggccuugaagacucccugaucccagacc

SEQ ID NO: 390023 - RNA, 32 nt, Human
cgggggcgagggcugcccccuccuccccuccc

SEQ ID NO: 390024 - RNA, 32 nt, Human
cgggggcgccccugagucacugggcagaggca

SEQ ID NO: 390025 - RNA, 19 nt, Human
cgggggcgcccgaggcccg

SEQ ID NO: 390026 - RNA, 22 nt, Human
cgggggcgcccggcugggccca

SEQ ID NO: 390027 - RNA, 32 nt, Human
cgggggcgcuuggccucagcgggccaugggag

SEQ ID NO: 390028 - RNA, 32 nt, Human
cgggggcggaggcagcugaggcgcuucuuucc

SEQ ID NO: 390029 - RNA, 32 nt, Human
cgggggcggcaccgcuccccugugacugcauc

SEQ ID NO: 390030 - RNA, 18 nt, Human
cgggggcggccccgggug

SEQ ID NO: 390031 - RNA, 23 nt, Human
cgggggcggcggcgcgagcggcc

SEQ ID NO: 390032 - RNA, 15 nt, Human
cgggggcggcugcag

SEQ ID NO: 390033 - RNA, 32 nt, Human
cgggggcggggagguggaguggagaggcccgc

SEQ ID NO: 390034 - RNA, 32 nt, Human
cgggggcggggccggggccagagcagaucucc

SEQ ID NO: 390035 - RNA, 17 nt, Human
cgggggcucaagcugca

SEQ ID NO: 390036 - RNA, 24 nt, Human
cgggggcucacgccuguaauccca

SEQ ID NO: 390037 - RNA, 32 nt, Human
cgggggcucauaccuguaaucccggcacuuug

SEQ ID NO: 390038 - RNA, 32 nt, Human
cgggggcuccgaggcggggucuggguguugag

SEQ ID NO: 390039 - RNA, 24 nt, Human
cgggggcuccuagcaacgggccgg

SEQ ID NO: 390040 - RNA, 19 nt, Human
cgggggcugcacgcggcug

SEQ ID NO: 390041 - RNA, 32 nt, Human
cgggggcugccuggucacgcgcggcaccaagu

SEQ ID NO: 390042 - RNA, 32 nt, Human
cgggggcugcucccugcuuaccucccucgccc

SEQ ID NO: 390043 - RNA, 32 nt, Human
cgggggcuggggaaggaagacagggacugcag

SEQ ID NO: 390044 - RNA, 18 nt, Human
cggggggaagaccgcaga

SEQ ID NO: 390045 - RNA, 22 nt, Human
cggggggcagagguugcaguga

SEQ ID NO: 390046 - RNA, 20 nt, Human
cggggggcgcacagagccag

SEQ ID NO: 390047 - RNA, 18 nt, Human
cgggggguauggcugcag

SEQ ID NO: 390048 - RNA, 32 nt, Human
cggggguacgagggaggaaggggagcaagacu

SEQ ID NO: 390049 - RNA, 32 nt, Human
cggggguagcggcggcgcgagcaggggcgcgg

SEQ ID NO: 390050 - RNA, 32 nt, Human
cgggggucaugaugggcagcaagauggcgucu

SEQ ID NO: 390051 - RNA, 23 nt, Human
cgggggucccggcgcugagccgg

SEQ ID NO: 390052 - RNA, 24 nt, Human
cgggggucgcuauggaggagccgg

SEQ ID NO: 390053 - RNA, 21 nt, Human
cgggggucggcagggggccgg

SEQ ID NO: 390054 - RNA, 32 nt, Human
cgggggucuccucuccugcccguccuggccgg

SEQ ID NO: 390055 - RNA, 32 nt, Human
cgggggucuccucuccugcuggucccugccgg

SEQ ID NO: 390056 - RNA, 25 nt, Human
cgggggucuggggagcgcagcagcc

SEQ ID NO: 390057 - RNA, 32 nt, Human
cgggggugcaggaaggaaguggggcccaagca

SEQ ID NO: 390058 - RNA, 32 nt, Human
cggggguggaggaggaagaaggggcacagcac

SEQ ID NO: 390059 - RNA, 32 nt, Human
cggggguggagguggugccucuggcagugacg

SEQ ID NO: 390060 - RNA, 32 nt, Human
cggggguggcgguggagggaacgaaaauugaa

SEQ ID NO: 390061 - RNA, 29 nt, Human
cggggguggcuucguuugccuggaguggc

SEQ ID NO: 390062 - RNA, 22 nt, Human
cgggggugggagcgggggccgg

SEQ ID NO: 390063 - RNA, 22 nt, Human
cgggggugggaggcggaggcgg

SEQ ID NO: 390064 - RNA, 32 nt, Human
cggggguggggcugggguggcaauggcgguuu

SEQ ID NO: 390065 - RNA, 32 nt, Human
cggggguggggucaguggugaagaguguguca

SEQ ID NO: 390066 - RNA, 32 nt, Human
cgggggugggguccagcccagagcaggcacug

SEQ ID NO: 390067 - RNA, 31 nt, Human
cggggguggguggggugaagagaucuuguga

SEQ ID NO: 390068 - RNA, 32 nt, Human
cggggguucagcggggccucugucuuuugugg

SEQ ID NO: 390069 - RNA, 32 nt, Human
cggggguuggggcggagggagcagcggcccca

SEQ ID NO: 390070 - RNA, 32 nt, Human
cggggguuucaccaugccauccaggcugguuu

SEQ ID NO: 390071 - RNA, 32 nt, Human
cgggguaccaacauggcccagaagcguccugc

SEQ ID NO: 390072 - RNA, 31 nt, Human
cgggguaggagaccuggagcuggagaacccg

SEQ ID NO: 390073 - RNA, 32 nt, Human
cgggguaggaggaucaccagaggccagcaggu

SEQ ID NO: 390074 - RNA, 32 nt, Human
cgggguaggcagcuagaggcgcaggagcgaau

SEQ ID NO: 390075 - RNA, 32 nt, Human
cgggguagugcaugccuguaaucccagcuacu

SEQ ID NO: 390076 - RNA, 31 nt, Human
cgggguaugugacugccucugugcugggcac

SEQ ID NO: 390077 - RNA, 32 nt, Human
cggggucaacuguacccagccuagagccaaga

SEQ ID NO: 390078 - RNA, 24 nt, Human
cggggucacguccagccuccacug

SEQ ID NO: 390079 - RNA, 32 nt, Human
cggggucagagagagcgcgcgggcgugcgagc

SEQ ID NO: 390080 - RNA, 32 nt, Human
cggggucagauaccuggggguggggaggggcc

SEQ ID NO: 390081 - RNA, 32 nt, Human
cggggucaggagaucaagaccauccuggcuaa

SEQ ID NO: 390082 - RNA, 32 nt, Human
cggggucagggaggggcagggggcaccuggca

SEQ ID NO: 390083 - RNA, 32 nt, Human
cggggucaucgccuccugcuuccggggucauc

SEQ ID NO: 390084 - RNA, 22 nt, Human
cggggucaucuucucucugcug

SEQ ID NO: 390085 - RNA, 32 nt, Human
cggggucauguugccagccauguugcccaggc

SEQ ID NO: 390086 - RNA, 20 nt, Human
cgggguccccggucccgcgu

SEQ ID NO: 390087 - RNA, 32 nt, Human
cgggguccgcaccgggccugagucgguccgag

SEQ ID NO: 390088 - RNA, 32 nt, Human
cgggguccggaggcagagacggccaugaacag

SEQ ID NO: 390089 - RNA, 18 nt, Human
cgggguccuggccggaga

SEQ ID NO: 390090 - RNA, 32 nt, Human
cggggucgaccuuugugcggggcgggucccug

SEQ ID NO: 390091 - RNA, 32 nt, Human
cggggucgccacugcacccagccugugucuuc

SEQ ID NO: 390092 - RNA, 32 nt, Human
cggggucgggcaucugcugucgcugccucggc

SEQ ID NO: 390093 - RNA, 22 nt, Human
cggggucgggcggccgcgcggg

SEQ ID NO: 390094 - RNA, 18 nt, Human
cggggucucacucuguua

SEQ ID NO: 390095 - RNA, 32 nt, Human
cggggucucaugcuuugcccacugacccggca

SEQ ID NO: 390096 - RNA, 18 nt, Human
cggggucucgcucuguca

SEQ ID NO: 390097 - RNA, 32 nt, Human
cggggucucugcucuuaugcaucaggacgacc

SEQ ID NO: 390098 - RNA, 32 nt, Human
cggggucucugucacccaggcuggagugcagu

SEQ ID NO: 390099 - RNA, 32 nt, Human
cggggucugccuggccuguggguucugccggu

SEQ ID NO: 390100 - RNA, 32 nt, Human
cggggugaaaccucccauuggccaaaggacac

SEQ ID NO: 390101 - RNA, 32 nt, Human
cggggugacugcugagggcccauaccaacggc

SEQ ID NO: 390102 - RNA, 32 nt, Human
cggggugagacagcaggaaggggcccugcacg

SEQ ID NO: 390103 - RNA, 32 nt, Human
cggggugagcccccagagcuggaccugagcua

SEQ ID NO: 390104 - RNA, 32 nt, Human
cggggugaggggagggagagcauuaggaaaaa

SEQ ID NO: 390105 - RNA, 32 nt, Human
cggggugcagaaccuccucucagggagggucc

SEQ ID NO: 390106 - RNA, 32 nt, Human
cggggugcgggggaggaggaggaggacgccgc

SEQ ID NO: 390107 - RNA, 32 nt, Human
cggggugcugccucucccucccuguuugaauc

SEQ ID NO: 390108 - RNA, 32 nt, Human
cgggguggcacacaccuguagucccagcuacu

SEQ ID NO: 390109 - RNA, 32 nt, Human
cgggguggcgcgcaccuguaaucccagcugcu

SEQ ID NO: 390110 - RNA, 32 nt, Human
cgggguggcucacaccuguaaugcagcucguu

SEQ ID NO: 390111 - RNA, 32 nt, Human
cgggguggcucacgccuguaaucccagcacuu

SEQ ID NO: 390112 - RNA, 32 nt, Human
cgggguggcucacgccuguaauccuagcacuu

SEQ ID NO: 390113 - RNA, 32 nt, Human
cgggguggcucagaccuguaaucccagaacuu

SEQ ID NO: 390114 - RNA, 32 nt, Human
cgggguggcucaugccuguaauuccagcacuu

SEQ ID NO: 390115 - RNA, 32 nt, Human
cgggguggcuuacgccuguaaucccaauacuu

SEQ ID NO: 390116 - RNA, 32 nt, Human
cggggugggaagaguuucucuccaucggcccc

SEQ ID NO: 390117 - RNA, 19 nt, Human
cggggugggccuucgggga

SEQ ID NO: 390118 - RNA, 32 nt, Human
cgggguggggaaggggcugggagccaggguac

SEQ ID NO: 390119 - RNA, 32 nt, Human
cggggugggggagggggagccuuauuucugua

SEQ ID NO: 390120 - RNA, 32 nt, Human
cggggugggggcgggggugaggguaggugcuu

SEQ ID NO: 390121 - RNA, 32 nt, Human
cggggugucaggagggagagacagccugggua

SEQ ID NO: 390122 - RNA, 21 nt, Human
cggggugugccccuccugcug

SEQ ID NO: 390123 - RNA, 32 nt, Human
cggggugugguggcucacaccuguaaucccag

SEQ ID NO: 390124 - RNA, 32 nt, Human
cgggguguguguggcucagcuuccacggcgug

SEQ ID NO: 390125 - RNA, 32 nt, Human
cgggguuccaggacagggaagggagcaggagc

SEQ ID NO: 390126 - RNA, 24 nt, Human
cgggguuccucaucaucaauacca

SEQ ID NO: 390127 - RNA, 32 nt, Human
cgggguugaacaaacggaaagugccaggauuu

SEQ ID NO: 390128 - RNA, 32 nt, Human
cgggguuggaggaucauuugagcccaggaauu

SEQ ID NO: 390129 - RNA, 32 nt, Human
cgggguuggggugggagggcgucaggcagagg

SEQ ID NO: 390130 - RNA, 18 nt, Human
cgggguuucacucuguca

SEQ ID NO: 390131 - RNA, 32 nt, Human
cgggguuucuucguugcauugccugagaggag

SEQ ID NO: 390132 - RNA, 32 nt, Human
cgggguuugugguuggcugagguggaggaaua

SEQ ID NO: 390133 - RNA, 32 nt, Human
cggguaacucugagggacacagcuccacucac

SEQ ID NO: 390134 - RNA, 32 nt, Human
cggguaauggcugcuuccaagacccagggggc

SEQ ID NO: 390135 - RNA, 32 nt, Human
cggguaccgaaaggagggcaauucauggaaga

SEQ ID NO: 390136 - RNA, 32 nt, Human
cggguaccguaauccuagcuacucgggagacu

SEQ ID NO: 390137 - RNA, 32 nt, Human
cggguacgagcuggccccagacaagcgccgcu

SEQ ID NO: 390138 - RNA, 32 nt, Human
cggguacuacauuuccaucccuucccuauuuu

SEQ ID NO: 390139 - RNA, 32 nt, Human
cggguacugugaugauggcugcaguccaguuu

SEQ ID NO: 390140 - RNA, 32 nt, Human
cggguagcaaaaagguugggaaccacuggugu

SEQ ID NO: 390141 - RNA, 32 nt, Human
cggguagccccagggcuggggcugccagaagu

SEQ ID NO: 390142 - RNA, 32 nt, Human
cggguagcugcacugggcauggggugguggug

SEQ ID NO: 390143 - RNA, 20 nt, Human
cggguagcugggacuacagg

SEQ ID NO: 390144 - RNA, 22 nt, Human
cggguagcugggacuacaggug

SEQ ID NO: 390145 - RNA, 32 nt, Human
cggguagggucagagacauuggaggaucucuc

SEQ ID NO: 390146 - RNA, 32 nt, Human
cggguauauugagagaaauaaaggugagagca

SEQ ID NO: 390147 - RNA, 32 nt, Human
cgggucaaagugcaccaccagccaccaacagc

SEQ ID NO: 390148 - RNA, 32 nt, Human
cgggucaacccuguaauuccagcacuuuggga

SEQ ID NO: 390149 - RNA, 23 nt, Human
cgggucaagcaauucuccugccu

SEQ ID NO: 390150 - RNA, 32 nt, Human
cgggucaaggcccggucgagugcaguaccaug

SEQ ID NO: 390151 - RNA, 32 nt, Human
cgggucacaggcauugguaguuuugaagcucu

SEQ ID NO: 390152 - RNA, 32 nt, Human
cgggucaccacaaccuccgccucccggauuca

SEQ ID NO: 390153 - RNA, 32 nt, Human
cgggucacccaccuuucgcacucugcgggccg

SEQ ID NO: 390154 - RNA, 32 nt, Human
cgggucaccucagcugcccacacccacacucu

SEQ ID NO: 390155 - RNA, 32 nt, Human
cgggucacugcaaccuccgccucccggguuca

SEQ ID NO: 390156 - RNA, 32 nt, Human
cgggucacugcaaccucuaccuccaggguuca

SEQ ID NO: 390157 - RNA, 32 nt, Human
cgggucacugcaagcucugccucccaaguuca

SEQ ID NO: 390158 - RNA, 32 nt, Human
cgggucagagggcaagacgugacccagggccg

SEQ ID NO: 390159 - RNA, 32 nt, Human
cgggucagccacaagggccacagccaugaaug

SEQ ID NO: 390160 - RNA, 32 nt, Human
cgggucagcuuugcagucgcugccuucucgcg

SEQ ID NO: 390161 - RNA, 32 nt, Human
cgggucagugcugcucgggggcuucuccaucc

SEQ ID NO: 390162 - RNA, 24 nt, Human
cggguccaagugauucuccugccu

SEQ ID NO: 390163 - RNA, 16 nt, Human
cggguccacccugggu

SEQ ID NO: 390164 - RNA, 22 nt, Human
cggguccagaccuggugggaag

SEQ ID NO: 390165 - RNA, 32 nt, Human
cggguccagaugagggccaggaaggggaggag

SEQ ID NO: 390166 - RNA, 32 nt, Human
cggguccagcuacucgggaggcugaggcagga

SEQ ID NO: 390167 - RNA, 32 nt, Human
cggguccauaagccuuuauuucauacaguccu

SEQ ID NO: 390168 - RNA, 32 nt, Human
cggguccauuaacgaagguggggaagggcgga

SEQ ID NO: 390169 - RNA, 32 nt, Human
cgggucccacccccaaacccccagagguggcc

SEQ ID NO: 390170 - RNA, 32 nt, Human
cgggucccaccgcgcaggacgccccuuccugc

SEQ ID NO: 390171 - RNA, 32 nt, Human
cgggucccuccacccacaucccccugguccua

SEQ ID NO: 390172 - RNA, 19 nt, Human
cgggucccugccacgucca

SEQ ID NO: 390173 - RNA, 24 nt, Human
cgggucccugccgaaggcucggcu

SEQ ID NO: 390174 - RNA, 22 nt, Human
cggguccgaggcagcggcggga

SEQ ID NO: 390175 - RNA, 32 nt, Human
cggguccggccucucccugccuguggccccuc

SEQ ID NO: 390176 - RNA, 32 nt, Human
cggguccggcugggacugccagaggaaccugg

SEQ ID NO: 390177 - RNA, 22 nt, Human
cggguccgggugaagcgggagg

SEQ ID NO: 390178 - RNA, 32 nt, Human
cggguccucacaccccuccuuggcccuucugg

SEQ ID NO: 390179 - RNA, 32 nt, Human
cggguccucucuuuaccugccagggcuuuucc

SEQ ID NO: 390180 - RNA, 32 nt, Human
cggguccugagcaccugcuucaugaaggaaga

SEQ ID NO: 390181 - RNA, 32 nt, Human
cggguccugcagcguuucucgccgccuagcca

SEQ ID NO: 390182 - RNA, 32 nt, Human
cggguccuggggaggcagagagaggccaauuu

SEQ ID NO: 390183 - RNA, 32 nt, Human
cgggucgcagaggcacuugaccaccccgcccu

SEQ ID NO: 390184 - RNA, 25 nt, Human
cgggucgccgccggcagcagccucc

SEQ ID NO: 390185 - RNA, 32 nt, Human
cgggucgccugcccugucucccuacuuagacc

SEQ ID NO: 390186 - RNA, 32 nt, Human
cgggucgccuguuccccugcaaccgcaaugug

SEQ ID NO: 390187 - RNA, 32 nt, Human
cgggucgcggaggcgggcgccgccggaacgcg

SEQ ID NO: 390188 - RNA, 32 nt, Human
cgggucggccgcaauccagccugggcggagcc

SEQ ID NO: 390189 - RNA, 32 nt, Human
cgggucgggaggcugugcuggcugcacuggcc

SEQ ID NO: 390190 - RNA, 32 nt, Human
cgggucguuguggugcgcugucuucccgcuug

SEQ ID NO: 390191 - RNA, 32 nt, Human
cgggucucagcggacuugugcauguuagcugu

SEQ ID NO: 390192 - RNA, 32 nt, Human
cgggucucaggacccaaagauccuuuagucag

SEQ ID NO: 390193 - RNA, 32 nt, Human
cgggucuccagccccaguccagaguugggcac

SEQ ID NO: 390194 - RNA, 32 nt, Human
cgggucuccagccuccgaccccucgccccaug

SEQ ID NO: 390195 - RNA, 23 nt, Human
cgggucuccuuuuggccuggggu

SEQ ID NO: 390196 - RNA, 21 nt, Human
cgggucucucaacguccaguu

SEQ ID NO: 390197 - RNA, 20 nt, Human
cgggucucuggcccuucuug

SEQ ID NO: 390198 - RNA, 32 nt, Human
cgggucucuggcccuucuugccuacuaugcca

SEQ ID NO: 390199 - RNA, 32 nt, Human
cgggucugccuaaacucagugucucuccuaga

SEQ ID NO: 390200 - RNA, 32 nt, Human
cgggucuucgggccuaggcgagcgccaggucu

SEQ ID NO: 390201 - RNA, 32 nt, Human
cgggucuugcucucucacccaggcuggaguag

SEQ ID NO: 390202 - RNA, 32 nt, Human
cgggucuuugccucccccuccuucccuagcag

SEQ ID NO: 390203 - RNA, 32 nt, Human
cgggucuuuggaugggaggaggacgaggacuu

SEQ ID NO: 390204 - RNA, 32 nt, Human
cgggugaaaugggguuguggggcagagcaggg

SEQ ID NO: 390205 - RNA, 32 nt, Human
cgggugacagcacuaaccagaccuccagccac

SEQ ID NO: 390206 - RNA, 32 nt, Human
cgggugacugcaaccacugccucccagguuca

SEQ ID NO: 390207 - RNA, 32 nt, Human
cgggugagaagcaggaaggaggcugaugauag

SEQ ID NO: 390208 - RNA, 17 nt, Human
cgggugagcccuguaac

SEQ ID NO: 390209 - RNA, 32 nt, Human
cgggugaggugccucccuucucugggcagagu

SEQ ID NO: 390210 - RNA, 32 nt, Human
cgggugagucucauggcugacccuggagggag

SEQ ID NO: 390211 - RNA, 32 nt, Human
cgggugagugauacuucucagucuucucuacu

SEQ ID NO: 390212 - RNA, 32 nt, Human
cgggugagugugugugcaugcacgugugugca

SEQ ID NO: 390213 - RNA, 32 nt, Human
cgggugaucguagcucggaaauggcgggauuu

SEQ ID NO: 390214 - RNA, 32 nt, Human
cgggugaugcuagauggauguguaccuggugg

SEQ ID NO: 390215 - RNA, 32 nt, Human
cgggugauggccucauccagggccacguucuc

SEQ ID NO: 390216 - RNA, 32 nt, Human
cgggugauuacaggcaccagugcagugaugau

SEQ ID NO: 390217 - RNA, 32 nt, Human
cgggugcacccaggcugcagggugaggccagg

SEQ ID NO: 390218 - RNA, 32 nt, Human
cgggugcagcucuguuccgcggaggcacgccc

SEQ ID NO: 390219 - RNA, 32 nt, Human
cgggugcagggcgugacucaccgcugggugcu

SEQ ID NO: 390220 - RNA, 32 nt, Human
cgggugcauagauacagguaaccaccaccaca

SEQ ID NO: 390221 - RNA, 32 nt, Human
cgggugccccggggcguucccucugccgcugc

SEQ ID NO: 390222 - RNA, 32 nt, Human
cgggugccuauaaucccgcuacucgggaggcu

SEQ ID NO: 390223 - RNA, 32 nt, Human
cgggugccuguaaucccagcuacuggggaggc

SEQ ID NO: 390224 - RNA, 32 nt, Human
cgggugccuguaaucccagcuacuugggaggc

SEQ ID NO: 390225 - RNA, 32 nt, Human
cgggugccuuaaacccacacuuccagggaccc

SEQ ID NO: 390226 - RNA, 32 nt, Human
cgggugccuuucugucuugcuuccagggggcu

SEQ ID NO: 390227 - RNA, 32 nt, Human
cgggugcgccuccuguuuggguuucuucgggg

SEQ ID NO: 390228 - RNA, 22 nt, Human
cgggugcgucugcagcuccucc

SEQ ID NO: 390229 - RNA, 31 nt, Human
cgggugcucaauaaauauuugucgaaugaau

SEQ ID NO: 390230 - RNA, 22 nt, Human
cgggugcugcgcaggcaggaag

SEQ ID NO: 390231 - RNA, 32 nt, Human
cgggugcugcugguuagugugcucugagggag

SEQ ID NO: 390232 - RNA, 32 nt, Human
cgggugcugcuugcugcaggcucuggggaguc

SEQ ID NO: 390233 - RNA, 32 nt, Human
cgggugcuucaaaguacaugauaagggaacac

SEQ ID NO: 390234 - RNA, 32 nt, Human
cgggugcuuuccuguccugccagagcauggau

SEQ ID NO: 390235 - RNA, 32 nt, Human
cggguggacacacaggaccacucaguggggcc

SEQ ID NO: 390236 - RNA, 32 nt, Human
cggguggagagggcggcggcguugaaugugug

SEQ ID NO: 390237 - RNA, 32 nt, Human
cggguggagagggugcgccaaggagagguaac

SEQ ID NO: 390238 - RNA, 32 nt, Human
cggguggagggcccugagguggcagcaggggu

SEQ ID NO: 390239 - RNA, 32 nt, Human
cggguggcaggggcugucugugaaauuaggca

SEQ ID NO: 390240 - RNA, 32 nt, Human
cggguggcccccaguccugcuggaccagcuga

SEQ ID NO: 390241 - RNA, 32 nt, Human
cggguggcggcccuggggauggggaaggagca

SEQ ID NO: 390242 - RNA, 32 nt, Human
cggguggcgggauggggagcagcuugguccau

SEQ ID NO: 390243 - RNA, 32 nt, Human
cggguggcggggagaucaacuccgagcuguuu

SEQ ID NO: 390244 - RNA, 20 nt, Human
cggguggcugggaucacagg

SEQ ID NO: 390245 - RNA, 20 nt, Human
cggguggcugggauugcagg

SEQ ID NO: 390246 - RNA, 32 nt, Human
cgggugggaacgcugugucuguuggucuggug

SEQ ID NO: 390247 - RNA, 32 nt, Human
cgggugggagcgagcuugcgggcaggugccgc

SEQ ID NO: 390248 - RNA, 32 nt, Human
cgggugggaggcggggaggagcagcgggaaga

SEQ ID NO: 390249 - RNA, 32 nt, Human
cgggugggaggugagauugauagugcaauaau

SEQ ID NO: 390250 - RNA, 32 nt, Human
cgggugggcaggaacaacaagguccuguggcc

SEQ ID NO: 390251 - RNA, 32 nt, Human
cggguggggagguggccaaggaugcuggagcu

SEQ ID NO: 390252 - RNA, 32 nt, Human
cggguggggcgcagaagagaggggagcccuuc

SEQ ID NO: 390253 - RNA, 22 nt, Human
cgggugggggagguugcaauga

SEQ ID NO: 390254 - RNA, 32 nt, Human
cggguggggugguggaggagcugcagagaugu

SEQ ID NO: 390255 - RNA, 32 nt, Human
cggguggguggaggaugcggugcgcgggaauu

SEQ ID NO: 390256 - RNA, 32 nt, Human
cgggugggugugagcuguugggcuuccagguc

SEQ ID NO: 390257 - RNA, 32 nt, Human
cggguggucugccuguguauuuuggucauggg

SEQ ID NO: 390258 - RNA, 32 nt, Human
cgggugguugccauguuuucuaaugcugggga

SEQ ID NO: 390259 - RNA, 18 nt, Human
cgggugucagcuccagga

SEQ ID NO: 390260 - RNA, 32 nt, Human
cgggugucaguucguccggcuuccucacagcc

SEQ ID NO: 390261 - RNA, 32 nt, Human
cgggugucaguugugucuuuucaccucgauuu

SEQ ID NO: 390262 - RNA, 32 nt, Human
cggguguccgcccucagccuccuggggacucg

SEQ ID NO: 390263 - RNA, 32 nt, Human
cgggugucgauccuuuucccuccagucagggc

SEQ ID NO: 390264 - RNA, 32 nt, Human
cgggugucuggaggcuguggccguuuuguuuu

SEQ ID NO: 390265 - RNA, 32 nt, Human
cgggugugagccaccacgccuggcuaauuuuu

SEQ ID NO: 390266 - RNA, 32 nt, Human
cgggugugagccaccgcgcccagcuagcuccu

SEQ ID NO: 390267 - RNA, 31 nt, Human
cggguguuccugggaagaugggcagaaaauc

SEQ ID NO: 390268 - RNA, 32 nt, Human
cggguguugguggugugcaccuguaaucccgg

SEQ ID NO: 390269 - RNA, 24 nt, Human
cggguuaaagcgauucucuuaccu

SEQ ID NO: 390270 - RNA, 32 nt, Human
cggguuacagccgccuccucggcgccacagag

SEQ ID NO: 390271 - RNA, 26 nt, Human
cggguuaccccacaagggggccgcug

SEQ ID NO: 390272 - RNA, 24 nt, Human
cggguucaaaccauucuccugccu

SEQ ID NO: 390273 - RNA, 24 nt, Human
cggguucaaacgauucuccuaccu

SEQ ID NO: 390274 - RNA, 23 nt, Human
cggguucaaacgauucuccugcc

SEQ ID NO: 390275 - RNA, 24 nt, Human
cggguucaaaugauacuccugccu

SEQ ID NO: 390276 - RNA, 24 nt, Human
cggguucaaaugauucuccugccu

SEQ ID NO: 390277 - RNA, 24 nt, Human
cggguucaagagauccuccugccu

SEQ ID NO: 390278 - RNA, 24 nt, Human
cggguucaagagauuccccugccu

SEQ ID NO: 390279 - RNA, 24 nt, Human
cggguucaagagauucuccugccu

SEQ ID NO: 390280 - RNA, 21 nt, Human
cggguucaagagauucugccu

SEQ ID NO: 390281 - RNA, 24 nt, Human
cggguucaagcaauccuccugccu

SEQ ID NO: 390282 - RNA, 24 nt, Human
cggguucaagcaauucucccaucu

SEQ ID NO: 390283 - RNA, 22 nt, Human
cggguucaagcaauucuccugc

SEQ ID NO: 390284 - RNA, 24 nt, Human
cggguucaagcaauucuccugccu

SEQ ID NO: 390285 - RNA, 24 nt, Human
cggguucaagcaauucuccugucu

SEQ ID NO: 390286 - RNA, 24 nt, Human
cggguucaagcaauucuccuucuu

SEQ ID NO: 390287 - RNA, 24 nt, Human
cggguucaagcaauucuucugccu

SEQ ID NO: 390288 - RNA, 23 nt, Human
cggguucaagcaauuuccugccu

SEQ ID NO: 390289 - RNA, 24 nt, Human
cggguucaagcaguucuccugccu

SEQ ID NO: 390290 - RNA, 21 nt, Human
cggguucaagcaguucugccu

SEQ ID NO: 390291 - RNA, 23 nt, Human
cggguucaagcaguuuccugcuu

SEQ ID NO: 390292 - RNA, 24 nt, Human
cggguucaagcauuucuccugucu

SEQ ID NO: 390293 - RNA, 24 nt, Human
cggguucaagccauucuccucccu

SEQ ID NO: 390294 - RNA, 24 nt, Human
cggguucaagccauucuccugccu

SEQ ID NO: 390295 - RNA, 24 nt, Human
cggguucaagccauucuccugucu

SEQ ID NO: 390296 - RNA, 21 nt, Human
cggguucaagccauucugccu

SEQ ID NO: 390297 - RNA, 24 nt, Human
cggguucaagcgaaucuccugccu

SEQ ID NO: 390298 - RNA, 24 nt, Human
cggguucaagcgacucuccugccu

SEQ ID NO: 390299 - RNA, 24 nt, Human
cggguucaagcgauccuccugccu

SEQ ID NO: 390300 - RNA, 21 nt, Human
cggguucaagcgauccugccu

SEQ ID NO: 390301 - RNA, 24 nt, Human
cggguucaagcgaugcuccugccu

SEQ ID NO: 390302 - RNA, 24 nt, Human
cggguucaagcgauuacucccacu

SEQ ID NO: 390303 - RNA, 24 nt, Human
cggguucaagcgauucaccugccu

SEQ ID NO: 390304 - RNA, 24 nt, Human
cggguucaagcgauucuccagccu

SEQ ID NO: 390305 - RNA, 24 nt, Human
cggguucaagcgauucucccgccu

SEQ ID NO: 390306 - RNA, 24 nt, Human
cggguucaagcgauucuccuaccu

SEQ ID NO: 390307 - RNA, 22 nt, Human
cggguucaagcgauucuccugc

SEQ ID NO: 390308 - RNA, 24 nt, Human
cggguucaagcgauucuccugccu

SEQ ID NO: 390309 - RNA, 24 nt, Human
cggguucaagcgauucuccugcuu

SEQ ID NO: 390310 - RNA, 24 nt, Human
cggguucaagcgauucuccugucu

SEQ ID NO: 390311 - RNA, 24 nt, Human
cggguucaagcgauucucgugccu

SEQ ID NO: 390312 - RNA, 24 nt, Human
cggguucaagcgauucugcugccu

SEQ ID NO: 390313 - RNA, 24 nt, Human
cggguucaagcgauucuucugccu

SEQ ID NO: 390314 - RNA, 24 nt, Human
cggguucaagcgauucuucugcuu

SEQ ID NO: 390315 - RNA, 24 nt, Human
cggguucaagcgauucuugugccu

SEQ ID NO: 390316 - RNA, 23 nt, Human
cggguucaagcgauuuucccgcc

SEQ ID NO: 390317 - RNA, 24 nt, Human
cggguucaagcgguucuacugccu

SEQ ID NO: 390318 - RNA, 24 nt, Human
cggguucaagcuauucuccugccu

SEQ ID NO: 390319 - RNA, 21 nt, Human
cggguucaagggauucugccu

SEQ ID NO: 390320 - RNA, 24 nt, Human
cggguucaaguaauucuccugccu

SEQ ID NO: 390321 - RNA, 24 nt, Human
cggguucaagugaucguccugccu

SEQ ID NO: 390322 - RNA, 24 nt, Human
cggguucaagugaugcuccugccu

SEQ ID NO: 390323 - RNA, 24 nt, Human
cggguucaagugauucaccugccu

SEQ ID NO: 390324 - RNA, 24 nt, Human
cggguucaagugauuccccuaccu

SEQ ID NO: 390325 - RNA, 23 nt, Human
cggguucaagugauucccugccu

SEQ ID NO: 390326 - RNA, 24 nt, Human
cggguucaagugauucucaugccu

SEQ ID NO: 390327 - RNA, 24 nt, Human
cggguucaagugauucuccugccu

SEQ ID NO: 390328 - RNA, 24 nt, Human
cggguucaagugauucuccugcuu

SEQ ID NO: 390329 - RNA, 24 nt, Human
cggguucaagugauucuccugucu

SEQ ID NO: 390330 - RNA, 24 nt, Human
cggguucaagugauucucgugccu

SEQ ID NO: 390331 - RNA, 24 nt, Human
cggguucaagugauucuucugccu

SEQ ID NO: 390332 - RNA, 24 nt, Human
cggguucaagugguucuccugccu

SEQ ID NO: 390333 - RNA, 24 nt, Human
cggguucaauagauucuccagccu

SEQ ID NO: 390334 - RNA, 24 nt, Human
cggguucaaucaauucuccuaccu

SEQ ID NO: 390335 - RNA, 32 nt, Human
cggguucacaccauucucccaccucaaccccc

SEQ ID NO: 390336 - RNA, 32 nt, Human
cggguucacaccauucuccggccucagucucc

SEQ ID NO: 390337 - RNA, 24 nt, Human
cggguucacaccauucuccuaccu

SEQ ID NO: 390338 - RNA, 24 nt, Human
cggguucacaccauucuccugccu

SEQ ID NO: 390339 - RNA, 32 nt, Human
cggguucacaccauucuccugccucagccucc

SEQ ID NO: 390340 - RNA, 32 nt, Human
cggguucacacguguguucacagagcuacggc

SEQ ID NO: 390341 - RNA, 24 nt, Human
cggguucacgccauccuccugccu

SEQ ID NO: 390342 - RNA, 24 nt, Human
cggguucacgccauucuccugccu

SEQ ID NO: 390343 - RNA, 24 nt, Human
cggguucacgccauucucuugccu

SEQ ID NO: 390344 - RNA, 24 nt, Human
cggguucacgcccuucuccugccu

SEQ ID NO: 390345 - RNA, 24 nt, Human
cggguucacgucauucuccugccu

SEQ ID NO: 390346 - RNA, 24 nt, Human
cggguucaggcaauucuccugccu

SEQ ID NO: 390347 - RNA, 24 nt, Human
cggguucaggccauucuccugccu

SEQ ID NO: 390348 - RNA, 24 nt, Human
cggguucaggcuauucuccugccu

SEQ ID NO: 390349 - RNA, 24 nt, Human
cggguucaggugauucuccugccu

SEQ ID NO: 390350 - RNA, 24 nt, Human
cggguucaggugauucucuugccu

SEQ ID NO: 390351 - RNA, 24 nt, Human
cggguucaugccauucuccugccu

SEQ ID NO: 390352 - RNA, 32 nt, Human
cggguucaugccauucuccugccucagccucc

SEQ ID NO: 390353 - RNA, 32 nt, Human
cggguucaugccauucugccucagccuccuga

SEQ ID NO: 390354 - RNA, 24 nt, Human
cggguucauggcauucuccugccu

SEQ ID NO: 390355 - RNA, 24 nt, Human
cggguucaugugauucuccugccu

SEQ ID NO: 390356 - RNA, 32 nt, Human
cggguuccagcaaauucuccugccucagccuc

SEQ ID NO: 390357 - RNA, 24 nt, Human
cggguuccagcaauucuccugccu

SEQ ID NO: 390358 - RNA, 24 nt, Human
cggguuccagcgauucuccugccu

SEQ ID NO: 390359 - RNA, 17 nt, Human
cggguuccagcgcgggg

SEQ ID NO: 390360 - RNA, 32 nt, Human
cggguuccgcagaugcagagguugagguggcu

SEQ ID NO: 390361 - RNA, 32 nt, Human
cggguuccgggcuccgggcucuggguggcggc

SEQ ID NO: 390362 - RNA, 24 nt, Human
cggguucgagcaauucuccugccu

SEQ ID NO: 390363 - RNA, 24 nt, Human
cggguucgagcgauucuccugccu

SEQ ID NO: 390364 - RNA, 32 nt, Human
cggguucgcacacccauucaagcggcaggacg

SEQ ID NO: 390365 - RNA, 24 nt, Human
cggguucgcaccauucuccugccu

SEQ ID NO: 390366 - RNA, 24 nt, Human
cggguucgggcaguucuccugccu

SEQ ID NO: 390367 - RNA, 24 nt, Human
cggguucgggugguucuccugccu

SEQ ID NO: 390368 - RNA, 23 nt, Human
cggguucggugauucuccugccu

SEQ ID NO: 390369 - RNA, 24 nt, Human
cggguucucaccauucuccugccu

SEQ ID NO: 390370 - RNA, 32 nt, Human
cggguucugaggcacagcuugucacaccgagg

SEQ ID NO: 390371 - RNA, 32 nt, Human
cggguucugggauccugcuggaagaggggagc

SEQ ID NO: 390372 - RNA, 32 nt, Human
cggguucuuuccaacucagaaucaucucugau

SEQ ID NO: 390373 - RNA, 32 nt, Human
cggguugacaccauuuuccugccucagccucc

SEQ ID NO: 390374 - RNA, 32 nt, Human
cggguugccacugccggcuugcagccugcuuu

SEQ ID NO: 390375 - RNA, 32 nt, Human
cggguugcccuggugaccccagccucugucca

SEQ ID NO: 390376 - RNA, 32 nt, Human
cggguuggcucccagccuggaggucccagaug

SEQ ID NO: 390377 - RNA, 32 nt, Human
cggguugguggggguggagcagcacuucaucg

SEQ ID NO: 390378 - RNA, 24 nt, Human
cggguugucacgccuguaauccca

SEQ ID NO: 390379 - RNA, 20 nt, Human
cggguuuaagaguccuggcc

SEQ ID NO: 390380 - RNA, 24 nt, Human
cggguuuaagcaguucuccugccu

SEQ ID NO: 390381 - RNA, 24 nt, Human
cggguuuaagcgauucuucugccu

SEQ ID NO: 390382 - RNA, 32 nt, Human
cggguuuaccuuaagcuucucuagugaggcau

SEQ ID NO: 390383 - RNA, 24 nt, Human
cggguuuaugccauucuccugucu

SEQ ID NO: 390384 - RNA, 22 nt, Human
cggguuucccgcgguccgagcu

SEQ ID NO: 390385 - RNA, 32 nt, Human
cggguuucucccugcggcuccuggguuguuga

SEQ ID NO: 390386 - RNA, 32 nt, Human
cggguuucugcucuccgcccguguggaguggu

SEQ ID NO: 390387 - RNA, 24 nt, Human
cggguuugcaccauucuccugccu

SEQ ID NO: 390388 - RNA, 32 nt, Human
cggguuuggcugcugcuuccccgccgggugcc

SEQ ID NO: 390389 - RNA, 32 nt, Human
cggguuuggggucggggacagagcagugacca

SEQ ID NO: 390390 - RNA, 32 nt, Human
cggguuuguacacauacacaaaauguaccauu

SEQ ID NO: 390391 - RNA, 32 nt, Human
cggguuuucaccauguugccccgguugcucuc

SEQ ID NO: 390392 - RNA, 32 nt, Human
cggguuuuguuucauagggaguccugaguggg

SEQ ID NO: 390393 - RNA, 32 nt, Human
cgguaacacauuaccuuccucaccuccuguuu

SEQ ID NO: 390394 - RNA, 32 nt, Human
cgguaacccguccaccuggccgaggcagccca

SEQ ID NO: 390395 - RNA, 32 nt, Human
cgguaaccuuggaggucagcuugagaugacug

SEQ ID NO: 390396 - RNA, 32 nt, Human
cgguaacuacagccuuacuaccccacuacuca

SEQ ID NO: 390397 - RNA, 32 nt, Human
cgguaacuuucccagggucacccagccagcau

SEQ ID NO: 390398 - RNA, 32 nt, Human
cgguaauacacaaauaaauccauguuuuagca

SEQ ID NO: 390399 - RNA, 32 nt, Human
cgguaauaguuucagacagacaggaggaauag

SEQ ID NO: 390400 - RNA, 32 nt, Human
cgguaaugagccagacccuuguccuagugguc

SEQ ID NO: 390401 - RNA, 30 nt, Human
cgguaauggcggagcuggugcaggggcaga

SEQ ID NO: 390402 - RNA, 32 nt, Human
cgguaauggcggagcuggugcaggggcagagc

SEQ ID NO: 390403 - RNA, 32 nt, Human
cgguacacacacccuuccucuagccaggaucu

SEQ ID NO: 390404 - RNA, 32 nt, Human
cgguacagcacacuagcccuggcuccaagggc

SEQ ID NO: 390405 - RNA, 32 nt, Human
cgguacagcugcaggccguggucagggauggc

SEQ ID NO: 390406 - RNA, 32 nt, Human
cgguacauuugcacuguguccuagagagccuc

SEQ ID NO: 390407 - RNA, 20 nt, Human
cgguaccauucgucuaggga

SEQ ID NO: 390408 - RNA, 23 nt, Human
cgguacccacugccggccuccgc

SEQ ID NO: 390409 - RNA, 23 nt, Human
cgguaccccccagcaguaccagc

SEQ ID NO: 390410 - RNA, 32 nt, Human
cgguaccuagagucugugcgccccuuguugga

SEQ ID NO: 390411 - RNA, 24 nt, Human
cgguaccucacaccuguaauccca

SEQ ID NO: 390412 - RNA, 32 nt, Human
cgguaccuccagaacacuucagcuccacagcc

SEQ ID NO: 390413 - RNA, 32 nt, Human
cgguaccucuacugcguagaggccguagccag

SEQ ID NO: 390414 - RNA, 32 nt, Human
cgguaccucuacugcguagaggccguagcugg

SEQ ID NO: 390415 - RNA, 32 nt, Human
cgguacgccgccgccucgcacccgcagccucg

SEQ ID NO: 390416 - RNA, 32 nt, Human
cgguacggagagugcagaugcaggaaggcccg

SEQ ID NO: 390417 - RNA, 32 nt, Human
cgguacggcgcagacucaacaucaaccucuug

SEQ ID NO: 390418 - RNA, 23 nt, Human
cgguacucacugccggccuccgc

SEQ ID NO: 390419 - RNA, 32 nt, Human
cgguacucuuggaggcucugcaaccacaguuu

SEQ ID NO: 390420 - RNA, 32 nt, Human
cgguacugagauaucucggcuuccgcucagcc

SEQ ID NO: 390421 - RNA, 32 nt, Human
cgguacuuugggaggcugaggugggaggacug

SEQ ID NO: 390422 - RNA, 32 nt, Human
cgguagaaucacgugaguccaggaguuugaga

SEQ ID NO: 390423 - RNA, 32 nt, Human
cgguagacgaggacgccaacagcagcggagaa

SEQ ID NO: 390424 - RNA, 32 nt, Human
cgguagacggagccaugaagaagaccucgggc

SEQ ID NO: 390425 - RNA, 32 nt, Human
cgguagagaaugguggucuuuccuucauuguc

SEQ ID NO: 390426 - RNA, 32 nt, Human
cgguagagacgggauuucaccauguuggccag

SEQ ID NO: 390427 - RNA, 32 nt, Human
cgguagagagccugagaaucugguccaagguc

SEQ ID NO: 390428 - RNA, 32 nt, Human
cgguagagaugggguuucaccacguuggccag

SEQ ID NO: 390429 - RNA, 32 nt, Human
cgguagaggagaagucgagguuagagggaacu

SEQ ID NO: 390430 - RNA, 32 nt, Human
cgguagaggcggagguugcagugagccgagau

SEQ ID NO: 390431 - RNA, 32 nt, Human
cgguagagugcuuggcugggcgcaguggcuca

SEQ ID NO: 390432 - RNA, 32 nt, Human
cgguagcauaaauaugcacaucaauaaaauaa

SEQ ID NO: 390433 - RNA, 32 nt, Human
cgguagcgaaggcagcagcagcgguggcgaca

SEQ ID NO: 390434 - RNA, 24 nt, Human
cgguagcucacaccuguaauccca

SEQ ID NO: 390435 - RNA, 24 nt, Human
cgguagcucacgccuguaauccca

SEQ ID NO: 390436 - RNA, 32 nt, Human
cgguagcucuuugauuacacaaaagccaauuu

SEQ ID NO: 390437 - RNA, 32 nt, Human
cgguaggugcaggugcaguaggacgugggacu

SEQ ID NO: 390438 - RNA, 32 nt, Human
cgguaggugcauacuucugcccuccccagccc

SEQ ID NO: 390439 - RNA, 23 nt, Human
cgguagucacgccuguaauccca

SEQ ID NO: 390440 - RNA, 32 nt, Human
cgguagucgagaaaagcagagugaagacacaa

SEQ ID NO: 390441 - RNA, 32 nt, Human
cgguaguggcugcuguggcugccccaucccag

SEQ ID NO: 390442 - RNA, 21 nt, Human
cgguaucgcguugcucagggg

SEQ ID NO: 390443 - RNA, 24 nt, Human
cgguaucucaugccuauaauccca

SEQ ID NO: 390444 - RNA, 21 nt, Human
cgguaucuuuaaguucuccac

SEQ ID NO: 390445 - RNA, 32 nt, Human
cgguaugaaacuguauuuaaaugaguguacau

SEQ ID NO: 390446 - RNA, 32 nt, Human
cgguauggaaggcaggcuguacugguugagug

SEQ ID NO: 390447 - RNA, 32 nt, Human
cgguauggggccugcaugauuggcgcaggaau

SEQ ID NO: 390448 - RNA, 32 nt, Human
cgguaugucauuaucagcagugugaaaaugga

SEQ ID NO: 390449 - RNA, 32 nt, Human
cgguauuagggagggguuaggagcaggaagga

SEQ ID NO: 390450 - RNA, 32 nt, Human
cggucaacguggugaaaccccaucucuacuaa

SEQ ID NO: 390451 - RNA, 32 nt, Human
cggucaaguguggaggagagggguggaggcug

SEQ ID NO: 390452 - RNA, 27 nt, Human
cggucacaagggagauguccgccccca

SEQ ID NO: 390453 - RNA, 32 nt, Human
cggucacagcucacugccuccugggcucagcu

SEQ ID NO: 390454 - RNA, 32 nt, Human
cggucacagugccaccaacacggguucacucc

SEQ ID NO: 390455 - RNA, 32 nt, Human
cggucaccaguucugccgugcgauggggccuc

SEQ ID NO: 390456 - RNA, 32 nt, Human
cggucaccauuccugagugugugcacauucca

SEQ ID NO: 390457 - RNA, 32 nt, Human
cggucaccgcggccaggcccaggcugguacug

SEQ ID NO: 390458 - RNA, 32 nt, Human
cggucaccuaggcuggaguguaguggcgcaau

SEQ ID NO: 390459 - RNA, 32 nt, Human
cggucacgggucuccuucaaaaccacucuguu

SEQ ID NO: 390460 - RNA, 32 nt, Human
cggucagaauguguggcaauucugaucugcau

SEQ ID NO: 390461 - RNA, 32 nt, Human
cggucagacuggaggugggggcagcagcuccc

SEQ ID NO: 390462 - RNA, 32 nt, Human
cggucagaggccaggauuggagagggggcacc

SEQ ID NO: 390463 - RNA, 32 nt, Human
cggucagagucacacggggcucaguggacugc

SEQ ID NO: 390464 - RNA, 32 nt, Human
cggucagcucauuccugccuccuuccugagcc

SEQ ID NO: 390465 - RNA, 32 nt, Human
cggucaggcucucagaugcagcugguugcacc

SEQ ID NO: 390466 - RNA, 32 nt, Human
cggucagucucggcccacaccccaaaggcucu

SEQ ID NO: 390467 - RNA, 32 nt, Human
cggucauaaagaauguaagggcuauaaguaga

SEQ ID NO: 390468 - RNA, 32 nt, Human
cggucauaugguagaaucacuguggacugaga

SEQ ID NO: 390469 - RNA, 32 nt, Human
cggucaucacccagccucugagagcaguuacu

SEQ ID NO: 390470 - RNA, 32 nt, Human
cggucaucccuaagccuuugccaccuccugag

SEQ ID NO: 390471 - RNA, 32 nt, Human
cggucaugccacugcacuccagccugggugac

SEQ ID NO: 390472 - RNA, 32 nt, Human
cggucauuuucuccuucuuucucccucuugag

SEQ ID NO: 390473 - RNA, 32 nt, Human
cgguccaaccuagacaaccaagaccgcuauac

SEQ ID NO: 390474 - RNA, 32 nt, Human
cgguccaaccucugcauucaguuaggagcucu

SEQ ID NO: 390475 - RNA, 32 nt, Human
cgguccacugcaaccuccacuucccggguuca

SEQ ID NO: 390476 - RNA, 32 nt, Human
cgguccagagccaagcggcggcagagcgaggg

SEQ ID NO: 390477 - RNA, 20 nt, Human
cgguccagcucagggaugcu

SEQ ID NO: 390478 - RNA, 32 nt, Human
cgguccaggaggcggcucgagcuguucguaaa

SEQ ID NO: 390479 - RNA, 32 nt, Human
cgguccaggcccugugcaccuuaccccagaga

SEQ ID NO: 390480 - RNA, 32 nt, Human
cgguccagggcaaugacacacagggucucgau

SEQ ID NO: 390481 - RNA, 32 nt, Human
cgguccauaagaauggggacagugggcucugc

SEQ ID NO: 390482 - RNA, 32 nt, Human
cgguccauucugcccauggccacagggugcag

SEQ ID NO: 390483 - RNA, 31 nt, Human
cgguccauuggcaugaagcacuuguacugcu

SEQ ID NO: 390484 - RNA, 32 nt, Human
cggucccagaucucugaccacaccacucaccc

SEQ ID NO: 390485 - RNA, 32 nt, Human
cggucccagcuacuugggaggcugaggcggga

SEQ ID NO: 390486 - RNA, 32 nt, Human
cggucccagguguggagcagagcucgggaacu

SEQ ID NO: 390487 - RNA, 32 nt, Human
cgguccccaggcccuuugggacaggaagagaa

SEQ ID NO: 390488 - RNA, 32 nt, Human
cgguccccaucagcacugugcagugguaccgg

SEQ ID NO: 390489 - RNA, 32 nt, Human
cgguccccauggaggagauggaagaggaguug

SEQ ID NO: 390490 - RNA, 32 nt, Human
cgguccccugggucugugccugggggucagga

SEQ ID NO: 390491 - RNA, 32 nt, Human
cggucccgcacuggugcagccauguccucuuc

SEQ ID NO: 390492 - RNA, 32 nt, Human
cggucccgcucaggccagacgcagaggcaguc

SEQ ID NO: 390493 - RNA, 32 nt, Human
cggucccucccccucacguucucucuuccucu

SEQ ID NO: 390494 - RNA, 32 nt, Human
cggucccucuggugucugccaucccccucccu

SEQ ID NO: 390495 - RNA, 32 nt, Human
cggucccugcagcggcgcguagucgagggcag

SEQ ID NO: 390496 - RNA, 32 nt, Human
cggucccugggcagguguggguggaaugcauc

SEQ ID NO: 390497 - RNA, 32 nt, Human
cgguccgagccgcggcagucggcgacgccuca

SEQ ID NO: 390498 - RNA, 23 nt, Human
cgguccgcccaccgccgccgccg

SEQ ID NO: 390499 - RNA, 32 nt, Human
cgguccgcugaagcucugaauccucagggagg

SEQ ID NO: 390500 - RNA, 32 nt, Human
cgguccggcuccaggagauucagucacuccuc

SEQ ID NO: 390501 - RNA, 31 nt, Human
cgguccggcuucucugggagacugucuacaa

SEQ ID NO: 390502 - RNA, 22 nt, Human
cgguccgggaggucucuaggcu

SEQ ID NO: 390503 - RNA, 32 nt, Human
cgguccgggcccagagugcagcagagcucugg

SEQ ID NO: 390504 - RNA, 32 nt, Human
cgguccgggccgcggcgguggcggcgccacuu

SEQ ID NO: 390505 - RNA, 32 nt, Human
cgguccucaccacccucugccccaccaugauc

SEQ ID NO: 390506 - RNA, 32 nt, Human
cgguccucucagcccugccugcccuggccugg

SEQ ID NO: 390507 - RNA, 32 nt, Human
cgguccucuccaucucucuccucggcagcagc

SEQ ID NO: 390508 - RNA, 32 nt, Human
cgguccucucucugacgggguggcauuuggcc

SEQ ID NO: 390509 - RNA, 32 nt, Human
cgguccugaaauuuucaucuugaaugucuuug

SEQ ID NO: 390510 - RNA, 21 nt, Human
cgguccugaggauccuccuca

SEQ ID NO: 390511 - RNA, 32 nt, Human
cgguccugguagggagugcguagcagggugga

SEQ ID NO: 390512 - RNA, 32 nt, Human
cgguccuguagauggcaguaacuugaucauca

SEQ ID NO: 390513 - RNA, 32 nt, Human
cggucgacuccgccccagccucagagggugga

SEQ ID NO: 390514 - RNA, 32 nt, Human
cggucgagaacagcagcgccauggaggagcuc

SEQ ID NO: 390515 - RNA, 32 nt, Human
cggucgcaggaggugccgucugccucccaggu

SEQ ID NO: 390516 - RNA, 25 nt, Human
cggucgccacgguaacgcgcgcggg

SEQ ID NO: 390517 - RNA, 22 nt, Human
cggucgcccacccugggaagug

SEQ ID NO: 390518 - RNA, 32 nt, Human
cggucggagaggggguacgagagcugcuggug

SEQ ID NO: 390519 - RNA, 32 nt, Human
cggucggagauggagccgggugcggcuguacc

SEQ ID NO: 390520 - RNA, 32 nt, Human
cggucggagguggggcguuugggggugugcgg

SEQ ID NO: 390521 - RNA, 32 nt, Human
cggucggcccucgcccccucccccaggcccag

SEQ ID NO: 390522 - RNA, 32 nt, Human
cggucgggagggaggaagguggcaagauggug

SEQ ID NO: 390523 - RNA, 32 nt, Human
cggucggggccaggccaggccaggccagcucc

SEQ ID NO: 390524 - RNA, 32 nt, Human
cggucggggcugggcccuacgcacuuugcgua

SEQ ID NO: 390525 - RNA, 32 nt, Human
cggucgguaaagacgucuucuaagccuuugau

SEQ ID NO: 390526 - RNA, 32 nt, Human
cggucgucaccugcacucaucuuggguuuucc

SEQ ID NO: 390527 - RNA, 32 nt, Human
cggucguucccguucaggagcagaauuuuccc

SEQ ID NO: 390528 - RNA, 32 nt, Human
cggucuagaggagucccaggagcagccaggac

SEQ ID NO: 390529 - RNA, 32 nt, Human
cggucuagggcaauaggagagcagagaauggg

SEQ ID NO: 390530 - RNA, 32 nt, Human
cggucucaacacagaagacuucugugagcaaa

SEQ ID NO: 390531 - RNA, 32 nt, Human
cggucuccaaacucccuguuggcuuuuuaaug

SEQ ID NO: 390532 - RNA, 32 nt, Human
cggucuccaagugccccugguuacagcuccug

SEQ ID NO: 390533 - RNA, 32 nt, Human
cggucuccccaaagugcugggauuacaggcgu

SEQ ID NO: 390534 - RNA, 32 nt, Human
cggucuccgcgucugccagccuggcuggcagu

SEQ ID NO: 390535 - RNA, 25 nt, Human
cggucucgaucuccugaccuccuga

SEQ ID NO: 390536 - RNA, 25 nt, Human
cggucucgaucuccugaccucuuga

SEQ ID NO: 390537 - RNA, 25 nt, Human
cggucucgaucuccugaccuucuga

SEQ ID NO: 390538 - RNA, 32 nt, Human
cggucucgccuccgcuuccuccucacuccgcc

SEQ ID NO: 390539 - RNA, 22 nt, Human
cggucucgccuugucgccagcu

SEQ ID NO: 390540 - RNA, 32 nt, Human
cggucucuagccccucagcccccgcugggcac

SEQ ID NO: 390541 - RNA, 32 nt, Human
cggucucugagguuccaccaaaauauggaacu

SEQ ID NO: 390542 - RNA, 32 nt, Human
cggucugaaaguaggaggugggggaagaggca

SEQ ID NO: 390543 - RNA, 32 nt, Human
cggucugacacugucuucucucaccaugcuca

SEQ ID NO: 390544 - RNA, 25 nt, Human
cggucugacuagaauuuaccaggcu

SEQ ID NO: 390545 - RNA, 24 nt, Human
cggucugacucugucacccaggcu

SEQ ID NO: 390546 - RNA, 32 nt, Human
cggucugagccuuuuuggauaauuaauaaaua

SEQ ID NO: 390547 - RNA, 32 nt, Human
cggucugaggcagacgguuacagccaccggca

SEQ ID NO: 390548 - RNA, 17 nt, Human
cggucugcauccgggga

SEQ ID NO: 390549 - RNA, 32 nt, Human
cggucugcuguugagauguugcuuuuugguuu

SEQ ID NO: 390550 - RNA, 32 nt, Human
cggucuggagccucugggcuucugccuacaga

SEQ ID NO: 390551 - RNA, 32 nt, Human
cggucuggccaacauggugaaaccccaucucu

SEQ ID NO: 390552 - RNA, 32 nt, Human
cggucuggcugcagcuagaggacaggcaagcc

SEQ ID NO: 390553 - RNA, 32 nt, Human
cggucugggacuuaugucaccgggaggaaaag

SEQ ID NO: 390554 - RNA, 32 nt, Human
cggucugggccgccgaaucuccggccgaagag

SEQ ID NO: 390555 - RNA, 32 nt, Human
cggucugucacccaggcuggagugcaguggug

SEQ ID NO: 390556 - RNA, 32 nt, Human
cggucuguugcccagguuggagugcaguggcg

SEQ ID NO: 390557 - RNA, 32 nt, Human
cggucuguuuugacaaaacuucaggggcuucu

SEQ ID NO: 390558 - RNA, 20 nt, Human
cggucuucggcuccucugca

SEQ ID NO: 390559 - RNA, 32 nt, Human
cggucuucucucgaucucugcagggagucacu

SEQ ID NO: 390560 - RNA, 32 nt, Human
cggucuugcccagaggaucacagugcugagac

SEQ ID NO: 390561 - RNA, 20 nt, Human
cggucuugucaucuuuuaca

SEQ ID NO: 390562 - RNA, 19 nt, Human
cggucuuugcuccuuuaca

SEQ ID NO: 390563 - RNA, 32 nt, Human
cggugaaaucauagcgcacugcagccuugaac

SEQ ID NO: 390564 - RNA, 32 nt, Human
cggugaacaguacugccuccugccaggagcug

SEQ ID NO: 390565 - RNA, 32 nt, Human
cggugaaccuauaaaucagcagucucuugggc

SEQ ID NO: 390566 - RNA, 32 nt, Human
cggugaaguggaaacuccuccugcaggaagag

SEQ ID NO: 390567 - RNA, 32 nt, Human
cggugaaguucuccgccaugaaccugaggggc

SEQ ID NO: 390568 - RNA, 32 nt, Human
cggugaaucuuuggcagacucugugugugccc

SEQ ID NO: 390569 - RNA, 32 nt, Human
cggugaaugaaccacugucauuuucuguugag

SEQ ID NO: 390570 - RNA, 32 nt, Human
cggugaaugcccucugcugggguggggaaggg

SEQ ID NO: 390571 - RNA, 32 nt, Human
cggugacagaaacuccauuugcaccagcuuac

SEQ ID NO: 390572 - RNA, 18 nt, Human
cggugacaggcccagccc

SEQ ID NO: 390573 - RNA, 32 nt, Human
cggugaccagcagcacacagcaaccagucucu

SEQ ID NO: 390574 - RNA, 32 nt, Human
cggugaccagccaccaggugugccaucgugga

SEQ ID NO: 390575 - RNA, 32 nt, Human
cggugacccaugcugcccagccuggagguaaa

SEQ ID NO: 390576 - RNA, 32 nt, Human
cggugacccugccuagaauuuucuagagucug

SEQ ID NO: 390577 - RNA, 32 nt, Human
cggugaccuccguccucuccccagccuggcac

SEQ ID NO: 390578 - RNA, 32 nt, Human
cggugaccugaggacuccacucacacuggcga

SEQ ID NO: 390579 - RNA, 32 nt, Human
cggugaccuucauucaggggaaccuggaggcu

SEQ ID NO: 390580 - RNA, 24 nt, Human
cggugacucacaccuguaauccca

SEQ ID NO: 390581 - RNA, 24 nt, Human
cggugacucacacuuguaauccca

SEQ ID NO: 390582 - RNA, 24 nt, Human
cggugacucacgccuauaauccca

SEQ ID NO: 390583 - RNA, 24 nt, Human
cggugacucacgccuauaaucuca

SEQ ID NO: 390584 - RNA, 24 nt, Human
cggugacucaugccuguaauccca

SEQ ID NO: 390585 - RNA, 24 nt, Human
cggugacucaugcuuguaauccca

SEQ ID NO: 390586 - RNA, 24 nt, Human
cggugacucgcaccuguaauccca

SEQ ID NO: 390587 - RNA, 32 nt, Human
cggugagaaaggagggccagccaguugggugg

SEQ ID NO: 390588 - RNA, 32 nt, Human
cggugagaagcagagaaggcacuugcauccua

SEQ ID NO: 390589 - RNA, 32 nt, Human
cggugagagcagaggcgcucugcugcaguuuu

SEQ ID NO: 390590 - RNA, 32 nt, Human
cggugagaggcagugggcaagugaucuuggag

SEQ ID NO: 390591 - RNA, 32 nt, Human
cggugagauggagugggucacaccuggcaagc

SEQ ID NO: 390592 - RNA, 32 nt, Human
cggugagcacacacgcccucccugucucucgc

SEQ ID NO: 390593 - RNA, 32 nt, Human
cggugagccucaguuccugggcuggacgcugg

SEQ ID NO: 390594 - RNA, 32 nt, Human
cggugagcgaagagcggucacucuccaagccc

SEQ ID NO: 390595 - RNA, 32 nt, Human
cggugagcgcagccccgcucuccgggccgggc

SEQ ID NO: 390596 - RNA, 32 nt, Human
cggugagcgugucagcauccucugguuccauc

SEQ ID NO: 390597 - RNA, 21 nt, Human
cggugaggagagguguuucca

SEQ ID NO: 390598 - RNA, 32 nt, Human
cggugaggaggcagagaguggugcaggcuggg

SEQ ID NO: 390599 - RNA, 32 nt, Human
cggugaggauguugugcucagaaaugucacug

SEQ ID NO: 390600 - RNA, 32 nt, Human
cggugaggcacgguagucuucacuuugaaaca

SEQ ID NO: 390601 - RNA, 21 nt, Human
cggugaggccaagguuuccca

SEQ ID NO: 390602 - RNA, 32 nt, Human
cggugaggccaagguuucccagugagccucug

SEQ ID NO: 390603 - RNA, 32 nt, Human
cggugaggccugacauccuggggaagggcaac

SEQ ID NO: 390604 - RNA, 32 nt, Human
cggugaggcugcagcagugguuaaggaguaac

SEQ ID NO: 390605 - RNA, 32 nt, Human
cggugagggaaagaugagcgaggagacggcga

SEQ ID NO: 390606 - RNA, 32 nt, Human
cggugagggggagggggagccucucuccaggc

SEQ ID NO: 390607 - RNA, 31 nt, Human
cggugaggugagagagaugcaucugcacguu

SEQ ID NO: 390608 - RNA, 32 nt, Human
cggugaggugcugguguccgugaaccccuacc

SEQ ID NO: 390609 - RNA, 32 nt, Human
cggugagguggccuggggagggcagaggcaag

SEQ ID NO: 390610 - RNA, 32 nt, Human
cggugaguccccucagcuggccaggacaguac

SEQ ID NO: 390611 - RNA, 32 nt, Human
cggugauccagaggagauccggaugcucaucc

SEQ ID NO: 390612 - RNA, 32 nt, Human
cggugaucucaagcugccugacuucuggugcu

SEQ ID NO: 390613 - RNA, 32 nt, Human
cggugaugagcacacaauuaaagugguuugug

SEQ ID NO: 390614 - RNA, 24 nt, Human
cggugaugcauaccuauaauccca

SEQ ID NO: 390615 - RNA, 24 nt, Human
cggugauucacgccuguaauccca

SEQ ID NO: 390616 - RNA, 32 nt, Human
cggugauucagccacagccucugccucccguu

SEQ ID NO: 390617 - RNA, 32 nt, Human
cggugcaagagagcugagggaggcgcgagggc

SEQ ID NO: 390618 - RNA, 32 nt, Human
cggugcaaucaugagucaaugcagccuccagc

SEQ ID NO: 390619 - RNA, 32 nt, Human
cggugcacaguaauaugaaagccacacuuuga

SEQ ID NO: 390620 - RNA, 21 nt, Human
cggugcaccuggguuauggua

SEQ ID NO: 390621 - RNA, 32 nt, Human
cggugcacuuucuccaccuccugcagccuccc

SEQ ID NO: 390622 - RNA, 32 nt, Human
cggugcagccaagccacacagagagacaacuu

SEQ ID NO: 390623 - RNA, 32 nt, Human
cggugcaggaggcugagugagcaggggagcac

SEQ ID NO: 390624 - RNA, 32 nt, Human
cggugcaggcuguccuggcugcucuggggaag

SEQ ID NO: 390625 - RNA, 32 nt, Human
cggugcaggguuguaaaccugcuuuaucuuuu

SEQ ID NO: 390626 - RNA, 32 nt, Human
cggugcaguucagaaagccugagguuuaaggg

SEQ ID NO: 390627 - RNA, 32 nt, Human
cggugcaugcacugugcacccuccugguuaac

SEQ ID NO: 390628 - RNA, 32 nt, Human
cggugcaugccuguaaucccagcuacucggga

SEQ ID NO: 390629 - RNA, 32 nt, Human
cggugccacccacugcacuggggccagcuggg

SEQ ID NO: 390630 - RNA, 32 nt, Human
cggugccacugcacuccagcuugggugacaga

SEQ ID NO: 390631 - RNA, 32 nt, Human
cggugccauugcucuccagccugggcgacaag

SEQ ID NO: 390632 - RNA, 32 nt, Human
cggugcccaaacuccgcccacccucuagggag

SEQ ID NO: 390633 - RNA, 32 nt, Human
cggugcccacagugccccggacacauuucaca

SEQ ID NO: 390634 - RNA, 32 nt, Human
cggugcccagagccaggaagccgcccuccugg

SEQ ID NO: 390635 - RNA, 32 nt, Human
cggugcccggcagccuuggugaaggcccugcc

SEQ ID NO: 390636 - RNA, 32 nt, Human
cggugcccguggcugaggauaagcugcugagg

SEQ ID NO: 390637 - RNA, 32 nt, Human
cggugcccguggugaugccaugccccgccacc

SEQ ID NO: 390638 - RNA, 24 nt, Human
cggugccucaugccuguaauccca

SEQ ID NO: 390639 - RNA, 32 nt, Human
cggugccugagagccucgcugucuguccuccg

SEQ ID NO: 390640 - RNA, 24 nt, Human
cggugccugcugcccagugcccau

SEQ ID NO: 390641 - RNA, 32 nt, Human
cggugccuguucuccccugaccgagccuguga

SEQ ID NO: 390642 - RNA, 20 nt, Human
cggugccuuccacccugccc

SEQ ID NO: 390643 - RNA, 32 nt, Human
cggugcgcucgcucagcaccuacucggccgcc

SEQ ID NO: 390644 - RNA, 32 nt, Human
cggugcggagagcuuggacugggagcccaaag

SEQ ID NO: 390645 - RNA, 18 nt, Human
cggugcggccggggccag

SEQ ID NO: 390646 - RNA, 32 nt, Human
cggugcggcgaggcgggcagagccagaggcac

SEQ ID NO: 390647 - RNA, 32 nt, Human
cggugcgggcggggguccgggagaagcggcgg

SEQ ID NO: 390648 - RNA, 18 nt, Human
cggugcggguccuccaca

SEQ ID NO: 390649 - RNA, 32 nt, Human
cggugcgucccccaggcugguggccgagcugc

SEQ ID NO: 390650 - RNA, 32 nt, Human
cggugcuacccuccaccucccaccucccugcg

SEQ ID NO: 390651 - RNA, 32 nt, Human
cggugcuaggcugagauggauccucucagggc

SEQ ID NO: 390652 - RNA, 23 nt, Human
cggugcucacgccuguaauccca

SEQ ID NO: 390653 - RNA, 19 nt, Human
cggugcucguccuaggcca

SEQ ID NO: 390654 - RNA, 31 nt, Human
cggugcugacuucuccccauugagagucagc

SEQ ID NO: 390655 - RNA, 32 nt, Human
cggugcugagucucuaucgggcucuguugcgc

SEQ ID NO: 390656 - RNA, 32 nt, Human
cggugcugcugcaggcugaggcugcggcagag

SEQ ID NO: 390657 - RNA, 32 nt, Human
cggugcuggcugugauucagagccagaaggag

SEQ ID NO: 390658 - RNA, 32 nt, Human
cggugcugggccaggggaaggaagggacacgg

SEQ ID NO: 390659 - RNA, 32 nt, Human
cggugcugggggcacagcugucugccaggcac

SEQ ID NO: 390660 - RNA, 32 nt, Human
cggugcugucucuaccauugcccucacuuuaa

SEQ ID NO: 390661 - RNA, 32 nt, Human
cggugcuguggcuguaaagcuguaggacccuu

SEQ ID NO: 390662 - RNA, 32 nt, Human
cggugcuucuacugcugcacgggcuguggaaa

SEQ ID NO: 390663 - RNA, 32 nt, Human
cggugcuuuccccucauauccccuagaagcaa

SEQ ID NO: 390664 - RNA, 32 nt, Human
cgguggaaggaggagcuuucuccucuggcuga

SEQ ID NO: 390665 - RNA, 32 nt, Human
cgguggacccacgagcgcgugccaccauggag

SEQ ID NO: 390666 - RNA, 32 nt, Human
cgguggaccugccgccaugcaggacgguaacu

SEQ ID NO: 390667 - RNA, 20 nt, Human
cgguggaccuggagaagcug

SEQ ID NO: 390668 - RNA, 32 nt, Human
cgguggagaaguuaaugguaaaaaccuucuug

SEQ ID NO: 390669 - RNA, 32 nt, Human
cgguggagaugaggacagagggaaccaagacu

SEQ ID NO: 390670 - RNA, 32 nt, Human
cgguggagccaccacacagccgacucucuccu

SEQ ID NO: 390671 - RNA, 32 nt, Human
cgguggagccugggugacggcgccugggccgg

SEQ ID NO: 390672 - RNA, 32 nt, Human
cgguggagggagggagcagggagcccucacuc

SEQ ID NO: 390673 - RNA, 32 nt, Human
cgguggaguaguggaccagagcaggggaguuu

SEQ ID NO: 390674 - RNA, 24 nt, Human
cgguggaucacgccuguaauccca

SEQ ID NO: 390675 - RNA, 32 nt, Human
cgguggaucaggcagguccacacuugcuaagu

SEQ ID NO: 390676 - RNA, 32 nt, Human
cgguggauguccggcucuggaccucaguuuca

SEQ ID NO: 390677 - RNA, 32 nt, Human
cgguggcaagaggcagacaugccuuugauguc

SEQ ID NO: 390678 - RNA, 32 nt, Human
cgguggcacugcacuccuagaaccuucaguuu

SEQ ID NO: 390679 - RNA, 18 nt, Human
cgguggcagcggcggcgg

SEQ ID NO: 390680 - RNA, 32 nt, Human
cgguggcagggugagcggagcggggccccgca

SEQ ID NO: 390681 - RNA, 32 nt, Human
cgguggcagucccugccugccaccccacaggg

SEQ ID NO: 390682 - RNA, 32 nt, Human
cgguggcaugaacaggcccagcuuugacuuga

SEQ ID NO: 390683 - RNA, 32 nt, Human
cgguggcaugacugucaggaggugcuggcauu

SEQ ID NO: 390684 - RNA, 21 nt, Human
cgguggcccaugccuguaauc

SEQ ID NO: 390685 - RNA, 24 nt, Human
cgguggcccaugccuguaauccca

SEQ ID NO: 390686 - RNA, 21 nt, Human
cgguggcccaugccuguuauc

SEQ ID NO: 390687 - RNA, 24 nt, Human
cgguggcccaugccuguuauccca

SEQ ID NO: 390688 - RNA, 32 nt, Human
cgguggcccugccucuccccgcucauagaagc

SEQ ID NO: 390689 - RNA, 18 nt, Human
cgguggccuccccaggcc

SEQ ID NO: 390690 - RNA, 18 nt, Human
cgguggccucuccaggcc

SEQ ID NO: 390691 - RNA, 32 nt, Human
cgguggccucuccaggcucagcuccugcccuc

SEQ ID NO: 390692 - RNA, 32 nt, Human
cgguggccucuccaggcucagcuccuggcccu

SEQ ID NO: 390693 - RNA, 32 nt, Human
cgguggccucucggggcuucugacgccaaaug

SEQ ID NO: 390694 - RNA, 18 nt, Human
cgguggccugcagagcuu

SEQ ID NO: 390695 - RNA, 32 nt, Human
cgguggccugggagcugcuuucuccccacugg

SEQ ID NO: 390696 - RNA, 32 nt, Human
cgguggcgcccggcacagagggguuaaggggg

SEQ ID NO: 390697 - RNA, 18 nt, Human
cgguggcggaggcggcgg

SEQ ID NO: 390698 - RNA, 18 nt, Human
cgguggcggcagcggcgg

SEQ ID NO: 390699 - RNA, 18 nt, Human
cgguggcggcggcagcgg

SEQ ID NO: 390700 - RNA, 18 nt, Human
cgguggcggcggcggcgg

SEQ ID NO: 390701 - RNA, 18 nt, Human
cgguggcgguggcggcgg

SEQ ID NO: 390702 - RNA, 21 nt, Human
cgguggcuaacgccuguaauc

SEQ ID NO: 390703 - RNA, 24 nt, Human
cgguggcucaagcccauaauccca

SEQ ID NO: 390704 - RNA, 21 nt, Human
cgguggcucaagccuguaauc

SEQ ID NO: 390705 - RNA, 24 nt, Human
cgguggcucacacccguaauccca

SEQ ID NO: 390706 - RNA, 24 nt, Human
cgguggcucacaccuauaauccca

SEQ ID NO: 390707 - RNA, 24 nt, Human
cgguggcucacaccuguaacccca

SEQ ID NO: 390708 - RNA, 21 nt, Human
cgguggcucacaccuguaauc

SEQ ID NO: 390709 - RNA, 32 nt, Human
cguuacucuaccccgagacugccuucugcccu

SEQ ID NO: 390710 - RNA, 32 nt, Human
cguuacucuacuuuaaaaauguaagacaagcu

SEQ ID NO: 390711 - RNA, 32 nt, Human
cguuacugacucuggugccuuaucucgaaggg

SEQ ID NO: 390712 - RNA, 32 nt, Human
cguuacugcuaaggauuaguccuggcucuucu

SEQ ID NO: 390713 - RNA, 32 nt, Human
cguuagagaauagaaucagcgaucuucacucc

SEQ ID NO: 390714 - RNA, 32 nt, Human
cguuagagacagggauucaccauguuggccug

SEQ ID NO: 390715 - RNA, 32 nt, Human
cguuagccaccuggguccacauccugcuaaga

SEQ ID NO: 390716 - RNA, 32 nt, Human
cguuagccacugcgcccggcccgagaaaauac

SEQ ID NO: 390717 - RNA, 32 nt, Human
cguuagccguggggaaagauggcggaaaauuu

SEQ ID NO: 390718 - RNA, 32 nt, Human
cguuagccugggaaaaucauucuuuuaaacaa

SEQ ID NO: 390719 - RNA, 32 nt, Human
cguuagccuuucugccuccucccucaucccau

SEQ ID NO: 390720 - RNA, 32 nt, Human
cguuaggagaagaagagaggcagggaagacaa

SEQ ID NO: 390721 - RNA, 32 nt, Human
cguuaggauggugaagugagacaaugugaaug

SEQ ID NO: 390722 - RNA, 32 nt, Human
cguuaggauguugcuuucuuuuuccauuaguu

SEQ ID NO: 390723 - RNA, 32 nt, Human
cguuaggcagagagaggaagggauuccuagca

SEQ ID NO: 390724 - RNA, 32 nt, Human
cguuaggcgggcccugagacagcugggaccgc

SEQ ID NO: 390725 - RNA, 32 nt, Human
cguuaggcucucaacaugacuauagagacccc

SEQ ID NO: 390726 - RNA, 32 nt, Human
cguuagggagagaggcccaggguggggacugg

SEQ ID NO: 390727 - RNA, 26 nt, Human
cguuagggcugcccaaacacugugga

SEQ ID NO: 390728 - RNA, 32 nt, Human
cguuaggggccugucucugcaccugucugucc

SEQ ID NO: 390729 - RNA, 32 nt, Human
cguuagguaaggggguucaagggucauggucc

SEQ ID NO: 390730 - RNA, 23 nt, Human
cguuagguuuucuuuucuuggug

SEQ ID NO: 390731 - RNA, 32 nt, Human
cguuaguaauguucaacuuuucacaaagaugg

SEQ ID NO: 390732 - RNA, 21 nt, Human
cguuagucuguucucaugcug

SEQ ID NO: 390733 - RNA, 32 nt, Human
cguuagugcucuucuuguccaggcuugccgac

SEQ ID NO: 390734 - RNA, 32 nt, Human
cguuagugcuuccggguugccgccaggaagcc

SEQ ID NO: 390735 - RNA, 32 nt, Human
cguuagugggcagguggccacagcaggacuga

SEQ ID NO: 390736 - RNA, 32 nt, Human
cguuagugucacccccuccucccugaucuguc

SEQ ID NO: 390737 - RNA, 32 nt, Human
cguuauaaacacaucaaagguucauucugacu

SEQ ID NO: 390738 - RNA, 32 nt, Human
cguuauaacacuucucagcaugcaagugagag

SEQ ID NO: 390739 - RNA, 32 nt, Human
cguuauacacagaguuugggcacacacugccc

SEQ ID NO: 390740 - RNA, 32 nt, Human
cguuaucacccaggccugauucacuggccugg

SEQ ID NO: 390741 - RNA, 32 nt, Human
cguuaucagugcaguuccguucucgggggaaa

SEQ ID NO: 390742 - RNA, 32 nt, Human
cguuauccuucaugccuguaaucccagcacuu

SEQ ID NO: 390743 - RNA, 32 nt, Human
cguuaucuccauccuuaaucucaguuguuugc

SEQ ID NO: 390744 - RNA, 32 nt, Human
cguuaucuucaugguaguugugaauacuggua

SEQ ID NO: 390745 - RNA, 32 nt, Human
cguuaugacaggaagcagaguggcuaucccuu

SEQ ID NO: 390746 - RNA, 29 nt, Human
cguuaugcuggaagaacaugucaggaaga

SEQ ID NO: 390747 - RNA, 32 nt, Human
cguuauggcgggcgccuguaaucccagcuacu

SEQ ID NO: 390748 - RNA, 32 nt, Human
cguuauguauguagucuguugcugcugaaaga

SEQ ID NO: 390749 - RNA, 32 nt, Human
cguuauucaccccaacugcucugcaucugccu

SEQ ID NO: 390750 - RNA, 32 nt, Human
cguuauugauuugagaccuuuccucuuuucua

SEQ ID NO: 390751 - RNA, 32 nt, Human
cguucaacaaugcugcaugggucacagcggca

SEQ ID NO: 390752 - RNA, 32 nt, Human
cguucaagaaaggguagggaaugaaguacccu

SEQ ID NO: 390753 - RNA, 32 nt, Human
cguucaagaccagccugggcaacagaacaaga

SEQ ID NO: 390754 - RNA, 32 nt, Human
cguucaagucuacgagcacagccguguucuaa

SEQ ID NO: 390755 - RNA, 32 nt, Human
cguucaagugugagcugcggcugagcccagcg

SEQ ID NO: 390756 - RNA, 32 nt, Human
cguucacaaugggcagcucccggcugaggguc

SEQ ID NO: 390757 - RNA, 32 nt, Human
cguucaccagccugugucucugaagcagcggu

SEQ ID NO: 390758 - RNA, 32 nt, Human
cguucacccccaggaugcuguugcuguaggac

SEQ ID NO: 390759 - RNA, 32 nt, Human
cguucaccuccccuuaucccuguuccccucuu

SEQ ID NO: 390760 - RNA, 32 nt, Human
cguucaccugagucucgcuggagcucuucucg

SEQ ID NO: 390761 - RNA, 32 nt, Human
cguucacguguucgguccuccuuagcugacuc

SEQ ID NO: 390762 - RNA, 32 nt, Human
cguucacugcaaccugacagaugagacacaug

SEQ ID NO: 390763 - RNA, 32 nt, Human
cguucacugcaaucucugccuccuggguuuaa

SEQ ID NO: 390764 - RNA, 32 nt, Human
cguucacugcagccuccaccuccccgguucaa

SEQ ID NO: 390765 - RNA, 19 nt, Human
cguucagacugacagcaga

SEQ ID NO: 390766 - RNA, 32 nt, Human
cguucagagacuuacaggugcuugccugcauu

SEQ ID NO: 390767 - RNA, 32 nt, Human
cguucagagcaucagaugaagacuucauuggg

SEQ ID NO: 390768 - RNA, 32 nt, Human
cguucagcaaguggagacuggcauucagauuc

SEQ ID NO: 390769 - RNA, 23 nt, Human
cguucagcacgugguggagaaca

SEQ ID NO: 390770 - RNA, 32 nt, Human
cguucaggccgccagccccacauucuggguug

SEQ ID NO: 390771 - RNA, 32 nt, Human
cguucaggcuuuccuaacccugccuuuuuagu

SEQ ID NO: 390772 - RNA, 32 nt, Human
cguucagggcccugccacuggugacggccacu

SEQ ID NO: 390773 - RNA, 32 nt, Human
cguucaguguuuagagaguggggagauggguc

SEQ ID NO: 390774 - RNA, 32 nt, Human
cguucaucagccccauaacccaggaaggaaca

SEQ ID NO: 390775 - RNA, 32 nt, Human
cguucaugccuguaaucccaacauuuugggag

SEQ ID NO: 390776 - RNA, 30 nt, Human
cguucaugcuuccuccccagccuucugcag

SEQ ID NO: 390777 - RNA, 32 nt, Human
cguucauggagcuggucauuucuugaaaugag

SEQ ID NO: 390778 - RNA, 30 nt, Human
cguucauggaggcauaugaccagaagaucg

SEQ ID NO: 390779 - RNA, 31 nt, Human
cguucauguugcucucggccucggugaauuc

SEQ ID NO: 390780 - RNA, 32 nt, Human
cguucauguugcucucggccucggugaauucc

SEQ ID NO: 390781 - RNA, 32 nt, Human
cguucauugagcaccuacuaugugccaggcca

SEQ ID NO: 390782 - RNA, 32 nt, Human
cguucauuuguccacuguuucuugucaucacg

SEQ ID NO: 390783 - RNA, 32 nt, Human
cguuccaauauauaaucuccuccuuuacaaga

SEQ ID NO: 390784 - RNA, 32 nt, Human
cguuccaccggguccguaucccucccgauucc

SEQ ID NO: 390785 - RNA, 22 nt, Human
cguuccaccuggggagauccca

SEQ ID NO: 390786 - RNA, 32 nt, Human
cguuccagcuugggcgacagagcaagacuguc

SEQ ID NO: 390787 - RNA, 32 nt, Human
cguucccagacaccuucccaggcgcugccagc

SEQ ID NO: 390788 - RNA, 32 nt, Human
cguucccagagccaaaugacacuaacuuauag

SEQ ID NO: 390789 - RNA, 32 nt, Human
cguucccagcagaacagcggagccuggacuga

SEQ ID NO: 390790 - RNA, 32 nt, Human
cguuccccagcucucccuacgcugcucgggcc

SEQ ID NO: 390791 - RNA, 32 nt, Human
cguucccccucgcgcagcuccaaccaaagaga

SEQ ID NO: 390792 - RNA, 32 nt, Human
cguuccccgucucggagcucacacagagaauc

SEQ ID NO: 390793 - RNA, 32 nt, Human
cguuccccuccagccuggugcugggcuccucg

SEQ ID NO: 390794 - RNA, 32 nt, Human
cguuccccuucaucuccgucccccucuuugaa

SEQ ID NO: 390795 - RNA, 32 nt, Human
cguucccgacuccggcaagaggguggcgccug

SEQ ID NO: 390796 - RNA, 32 nt, Human
cguucccuggggacauugggaaggugggcagg

SEQ ID NO: 390797 - RNA, 17 nt, Human
cguucccuguccauguc

SEQ ID NO: 390798 - RNA, 23 nt, Human
cguuccgcccggugccugggacg

SEQ ID NO: 390799 - RNA, 32 nt, Human
cguuccgcucccagcagccacacccaccgggc

SEQ ID NO: 390800 - RNA, 32 nt, Human
cguuccggccaggaguuugccgacugcagacg

SEQ ID NO: 390801 - RNA, 32 nt, Human
cguuccucagugugagcaagauuugggucucu

SEQ ID NO: 390802 - RNA, 32 nt, Human
cguuccucccaggacacccuugcugcgcucuc

SEQ ID NO: 390803 - RNA, 32 nt, Human
cguuccugcuaaaaauacaaaaauuagcuggg

SEQ ID NO: 390804 - RNA, 32 nt, Human
cguuccuggccagagcucuaccucuuugccuc

SEQ ID NO: 390805 - RNA, 32 nt, Human
cguuccugucucuguugaguucggacuggcag

SEQ ID NO: 390806 - RNA, 32 nt, Human
cguuccuuccucuuccucucuccucuccggcc

SEQ ID NO: 390807 - RNA, 32 nt, Human
cguuccuucuacucuggcaccacucuccaggc

SEQ ID NO: 390808 - RNA, 32 nt, Human
cguuccuugaagagaagcggcuucugguuccu

SEQ ID NO: 390809 - RNA, 32 nt, Human
cguuccuuuaaucccagcuacucgggagguug

SEQ ID NO: 390810 - RNA, 32 nt, Human
cguuccuuugaguggugacauccagguggcag

SEQ ID NO: 390811 - RNA, 32 nt, Human
cguuccuuuugggacuguggaagcaucagaug

SEQ ID NO: 390812 - RNA, 32 nt, Human
cguucgagggucagaggagccuggaugcuaau

SEQ ID NO: 390813 - RNA, 32 nt, Human
cguucgcgaaacagcuuuccacacaauggagc

SEQ ID NO: 390814 - RNA, 19 nt, Human
cguucgcuugucccgacca

SEQ ID NO: 390815 - RNA, 32 nt, Human
cguucggggcgcaguccucuccccggcuggcc

SEQ ID NO: 390816 - RNA, 32 nt, Human
cguucgggguaacccagaggcugaugagugug

SEQ ID NO: 390817 - RNA, 32 nt, Human
cguucuauucugcacuacaaucauuuugacaa

SEQ ID NO: 390818 - RNA, 32 nt, Human
cguucucaccaucugcuuccugucacacaagc

SEQ ID NO: 390819 - RNA, 32 nt, Human
cguucucagcacuuaauggccuugugauuaag

SEQ ID NO: 390820 - RNA, 32 nt, Human
cguucuccauuuuccugucauugggucauguu

SEQ ID NO: 390821 - RNA, 32 nt, Human
cguucuccugcguggucgcugccuccugcaga

SEQ ID NO: 390822 - RNA, 32 nt, Human
cguucucucccagagcaagucagucugagcag

SEQ ID NO: 390823 - RNA, 32 nt, Human
cguucucuccccuucucuccguggccccagag

SEQ ID NO: 390824 - RNA, 32 nt, Human
cguucucuccuggccacucuuccugcugccuc

SEQ ID NO: 390825 - RNA, 32 nt, Human
cguucucugccuggccugaggcucccugagcc

SEQ ID NO: 390826 - RNA, 32 nt, Human
cguucucuuguauuccuguugcuugagcuaca

SEQ ID NO: 390827 - RNA, 32 nt, Human
cguucugaggggccuuuggaagugaccggucu

SEQ ID NO: 390828 - RNA, 32 nt, Human
cguucugaguagcugggauuagaggcgugugc

SEQ ID NO: 390829 - RNA, 32 nt, Human
cguucugcacugccccuuggccugugugugag

SEQ ID NO: 390830 - RNA, 23 nt, Human
cguucugggcucaccuggccugg

SEQ ID NO: 390831 - RNA, 32 nt, Human
cguucugucacccaggcuggagugcagugacu

SEQ ID NO: 390832 - RNA, 32 nt, Human
cguucugucacccaggcuggcgugcaauaguu

SEQ ID NO: 390833 - RNA, 32 nt, Human
cguucugucgcccaggcuggagugcaggggca

SEQ ID NO: 390834 - RNA, 32 nt, Human
cguucugucgcccuggcuggaguggaaugccg

SEQ ID NO: 390835 - RNA, 32 nt, Human
cguucugucgcuuagcuggagugcgguggcgu

SEQ ID NO: 390836 - RNA, 32 nt, Human
cguucugucguccaggcuggagugcaguggug

SEQ ID NO: 390837 - RNA, 32 nt, Human
cguucugucguccaggcuggagugcgguggcg

SEQ ID NO: 390838 - RNA, 32 nt, Human
cguucuguggcccuggcuggaguucaguggug

SEQ ID NO: 390839 - RNA, 32 nt, Human
cguucuguuacccagggcucugcagcaccuca

SEQ ID NO: 390840 - RNA, 32 nt, Human
cguucuguuguccaggauggagugcagugguu

SEQ ID NO: 390841 - RNA, 32 nt, Human
cguucuucucugggugcuuuauucucuucuuu

SEQ ID NO: 390842 - RNA, 32 nt, Human
cguucuucugcugccaccgcugucggcaccau

SEQ ID NO: 390843 - RNA, 32 nt, Human
cguucuugccgcggcuugccugggcagguaaa

SEQ ID NO: 390844 - RNA, 32 nt, Human
cguucuuggaacuuacacccucuuggguuugc

SEQ ID NO: 390845 - RNA, 32 nt, Human
cguucuuggucagagaaaagugaagacuccac

SEQ ID NO: 390846 - RNA, 32 nt, Human
cguucuugguguggccacugaggacggcgcug

SEQ ID NO: 390847 - RNA, 32 nt, Human
cguucuugucuuucucccuccugcuuccccgg

SEQ ID NO: 390848 - RNA, 32 nt, Human
cguucuuuauuaugaaacuuuaucacauucga

SEQ ID NO: 390849 - RNA, 32 nt, Human
cguucuuugccuuucccuccccuuagcgaugu

SEQ ID NO: 390850 - RNA, 32 nt, Human
cguugaacgucacaucuuuaacccacuaacug

SEQ ID NO: 390851 - RNA, 32 nt, Human
cguugaaguuuuaagggucucagucccguuga

SEQ ID NO: 390852 - RNA, 30 nt, Human
cguugaauuuauuauguauauuauuucuaa

SEQ ID NO: 390853 - RNA, 32 nt, Human
cguugagaucacuguguagaaggauccgccug

SEQ ID NO: 390854 - RNA, 32 nt, Human
cguugagcugugcagcugcgcccugggcucca

SEQ ID NO: 390855 - RNA, 32 nt, Human
cguugaggccaaggaaugauccauacugaaaa

SEQ ID NO: 390856 - RNA, 32 nt, Human
cguugagggggaaauaccucaccagaacacaa

SEQ ID NO: 390857 - RNA, 32 nt, Human
cguugagguucacuuccuggauccuuacugcu

SEQ ID NO: 390858 - RNA, 32 nt, Human
cguugagguugcuuccuuccuggucguuugcu

SEQ ID NO: 390859 - RNA, 32 nt, Human
cguugaguguuucaaaugguucauuguuugug

SEQ ID NO: 390860 - RNA, 32 nt, Human
cguugauccauccagcccuaaaguucauugac

SEQ ID NO: 390861 - RNA, 32 nt, Human
cguugaugaggccauaaacagaaacaaugugc

SEQ ID NO: 390862 - RNA, 21 nt, Human
cguugcacuccagccugggca

SEQ ID NO: 390863 - RNA, 32 nt, Human
cguugcagaccccagaggguccugugugggug

SEQ ID NO: 390864 - RNA, 32 nt, Human
cguugcagugauguggguacugcuuucauaaa

SEQ ID NO: 390865 - RNA, 32 nt, Human
cguugcaucuccaguauugaucuuuggaaacu

SEQ ID NO: 390866 - RNA, 32 nt, Human
cguugcauugaggcaggcaggagcggcagggu

SEQ ID NO: 390867 - RNA, 32 nt, Human
cguugcauuugcagcgucuguggagugugcag

SEQ ID NO: 390868 - RNA, 32 nt, Human
cguugccagccugucucugcgcucgccauucc

SEQ ID NO: 390869 - RNA, 32 nt, Human
cguugcccagccaccaccgucucuccaaaaac

SEQ ID NO: 390870 - RNA, 25 nt, Human
cguugcccaggcuggagugcaacgg

SEQ ID NO: 390871 - RNA, 25 nt, Human
cguugcccaggcuggagugcaaugg

SEQ ID NO: 390872 - RNA, 23 nt, Human
cguugcccaggcuggagugcagu

SEQ ID NO: 390873 - RNA, 32 nt, Human
cguugcccaugccucugguccuggguggagca

SEQ ID NO: 390874 - RNA, 32 nt, Human
cguugccccagcuucacucucucccucagcac

SEQ ID NO: 390875 - RNA, 32 nt, Human
cguugccccauuaacagauuuccucuggaaug

SEQ ID NO: 390876 - RNA, 32 nt, Human
cguugcccugagcugcagccucggccccagga

SEQ ID NO: 390877 - RNA, 32 nt, Human
cguugccgcuguucccugcgcggcauggaggg

SEQ ID NO: 390878 - RNA, 32 nt, Human
cguugccggccccugaaguggagcgagaggga

SEQ ID NO: 390879 - RNA, 32 nt, Human
cguugccgggcagaggaagcugggugagugug

SEQ ID NO: 390880 - RNA, 32 nt, Human
cguugccguggggccucgagccccaggaugug

SEQ ID NO: 390881 - RNA, 32 nt, Human
cguugccucagccugcccucacccucaggacu

SEQ ID NO: 390882 - RNA, 32 nt, Human
cguugccugccacccagccuugcugccuuugc

SEQ ID NO: 390883 - RNA, 32 nt, Human
cguugcgauggauccuuggacccacuuuuguu

SEQ ID NO: 390884 - RNA, 32 nt, Human
cguugcgggaaagaggaagagagagugugagu

SEQ ID NO: 390885 - RNA, 22 nt, Human
cguugcguggaguggugggagg

SEQ ID NO: 390886 - RNA, 32 nt, Human
cguugcucaugggcuagauuggguaucaccuu

SEQ ID NO: 390887 - RNA, 32 nt, Human
cguugcugccgucaccgccuccugggucgucc

SEQ ID NO: 390888 - RNA, 32 nt, Human
cguugcuguggacacccaagucgcuggagcca

SEQ ID NO: 390889 - RNA, 32 nt, Human
cguugcuucgcgggcugggaggcccggggucc

SEQ ID NO: 390890 - RNA, 32 nt, Human
cguugcuuguucugcagcccugucuacuuggg

SEQ ID NO: 390891 - RNA, 32 nt, Human
cguuggaagggccaggguacgcagcuccccuu

SEQ ID NO: 390892 - RNA, 32 nt, Human
cguuggacugcacuugccucuccaugugaucu

SEQ ID NO: 390893 - RNA, 32 nt, Human
cguuggaggcuggagcgcaauggcccugccgu

SEQ ID NO: 390894 - RNA, 32 nt, Human
cguuggccagguuggucucgaucucuugacgu

SEQ ID NO: 390895 - RNA, 32 nt, Human
cguuggccuaacacugggcugcagagacugga

SEQ ID NO: 390896 - RNA, 21 nt, Human
cguuggccucucaggauucca

SEQ ID NO: 390897 - RNA, 32 nt, Human
cguuggccugccucuguucacccuccauggcc

SEQ ID NO: 390898 - RNA, 32 nt, Human
cguuggccuuucugucugccucuccuuccucu

SEQ ID NO: 390899 - RNA, 32 nt, Human
cguuggcgcguggccucaaucaggacuucuug

SEQ ID NO: 390900 - RNA, 32 nt, Human
cguuggcugauucagcucccagaagagacgag

SEQ ID NO: 390901 - RNA, 32 nt, Human
cguuggcuuccucuuggacugggucucaauca

SEQ ID NO: 390902 - RNA, 32 nt, Human
cguugggagaggguugggaggcagcagagcau

SEQ ID NO: 390903 - RNA, 32 nt, Human
cguugggaggagcagagccagggagccaucua

SEQ ID NO: 390904 - RNA, 32 nt, Human
cguugggaggcugaggcgggcggaucgguuga

SEQ ID NO: 390905 - RNA, 32 nt, Human
cguugggaggcugaggcgguagaaucacguga

SEQ ID NO: 390906 - RNA, 32 nt, Human
cguugggauuacaggcaugagccaccucaacg

SEQ ID NO: 390907 - RNA, 32 nt, Human
cguugggcacagcagguccugaacacccugcu

SEQ ID NO: 390908 - RNA, 32 nt, Human
cguugggccccacauucccccacugccucaca

SEQ ID NO: 390909 - RNA, 32 nt, Human
cguugggccgcgaacgcagccgccacgccggg

SEQ ID NO: 390910 - RNA, 31 nt, Human
cguugggcgaggggagccaugccaagggucc

SEQ ID NO: 390911 - RNA, 32 nt, Human
cguuggggcccagggcuggcgggccauguaac

SEQ ID NO: 390912 - RNA, 32 nt, Human
cguugggggacagagagagggacuccagaguc

SEQ ID NO: 390913 - RNA, 32 nt, Human
cguugggugaggaaaguauugugaagacaggc

SEQ ID NO: 390914 - RNA, 32 nt, Human
cguugggugguguuugguagguuucccuccag

SEQ ID NO: 390915 - RNA, 32 nt, Human
cguugguacagcuguuuguuuuacuugcacau

SEQ ID NO: 390916 - RNA, 32 nt, Human
cguuggucagggggcccugaaaacacugguaa

SEQ ID NO: 390917 - RNA, 32 nt, Human
cguuggucucagaaagaacgugaaugcuuaag

SEQ ID NO: 390918 - RNA, 32 nt, Human
cguuggucucauuggaaucugccuccuaauga

SEQ ID NO: 390919 - RNA, 32 nt, Human
cguuggucuuugauuguucuguccucacagca

SEQ ID NO: 390920 - RNA, 32 nt, Human
cguugguguuuacgaugaacaucggcaugaug

SEQ ID NO: 390921 - RNA, 32 nt, Human
cguuguagccuuuugcugugucuucgcugugu

SEQ ID NO: 390922 - RNA, 32 nt, Human
cguuguauacauguacugcaauauugcugucc

SEQ ID NO: 390923 - RNA, 32 nt, Human
cguuguauucacacaaaccugaacaaagcaaa

SEQ ID NO: 390924 - RNA, 32 nt, Human
cguugucacuuuucucuuguucuugaaacauu

SEQ ID NO: 390925 - RNA, 32 nt, Human
cguugucaugccuuacgguuuccaaugcgccg

SEQ ID NO: 390926 - RNA, 32 nt, Human
cguugucaugccuuacgguuuccaaugcggcg

SEQ ID NO: 390927 - RNA, 32 nt, Human
cguugucauguggauugagaugauauguauga

SEQ ID NO: 390928 - RNA, 32 nt, Human
cguuguccuccaccagcauuucccuuacucug

SEQ ID NO: 390929 - RNA, 32 nt, Human
cguugucuacugaccauuuccacuacaugccu

SEQ ID NO: 390930 - RNA, 32 nt, Human
cguugucuauccugggaggguguggugcuucg

SEQ ID NO: 390931 - RNA, 32 nt, Human
cguugucucugcugaaucagagcugagaacgg

SEQ ID NO: 390932 - RNA, 32 nt, Human
cguugucugccugggcucagcguggaccugcc

SEQ ID NO: 390933 - RNA, 32 nt, Human
cguugucugguugcuaaugacagccuugcaac

SEQ ID NO: 390934 - RNA, 32 nt, Human
cguugugccccgagaugagauccggaagcuga

SEQ ID NO: 390935 - RNA, 32 nt, Human
cguuguggccacugucuugcacaugccggacg

SEQ ID NO: 390936 - RNA, 19 nt, Human
cguuguggcccugcagccg

SEQ ID NO: 390937 - RNA, 32 nt, Human
cguuguggcucaugccuguaaucccagcacuu

SEQ ID NO: 390938 - RNA, 32 nt, Human
cguuguggcuggcaccuguaaucccagcauuu

SEQ ID NO: 390939 - RNA, 32 nt, Human
cguuguggugaauaugcaggaaucauucauga

SEQ ID NO: 390940 - RNA, 32 nt, Human
cguugugugcgguuaccugcuugagugauccu

SEQ ID NO: 390941 - RNA, 32 nt, Human
cguuguguuuccucagccauuuucccucugcu

SEQ ID NO: 390942 - RNA, 32 nt, Human
cguuguuggaaugacuagggacaacuagacuu

SEQ ID NO: 390943 - RNA, 32 nt, Human
cguuuaaaacagggggagcggaagggagccac

SEQ ID NO: 390944 - RNA, 32 nt, Human
cguuuaacccagacagaaguguucuuguuugu

SEQ ID NO: 390945 - RNA, 32 nt, Human
cguuuaccgugcuauaaucugcucugagcagu

SEQ ID NO: 390946 - RNA, 32 nt, Human
cguuuaccucuccugagaucagcccuaauccc

SEQ ID NO: 390947 - RNA, 32 nt, Human
cguuuagaccuuuaauucuagcacuuugaauu

SEQ ID NO: 390948 - RNA, 32 nt, Human
cguuuagcaaacaccaaaacuaauaaaucauc

SEQ ID NO: 390949 - RNA, 32 nt, Human
cguuuagcauuuuuaccaaccucacaucaugu

SEQ ID NO: 390950 - RNA, 32 nt, Human
cguuuagggaaagagaaggugggcaggagcaa

SEQ ID NO: 390951 - RNA, 32 nt, Human
cguuuagugagggcuggacugaaggagagccu

SEQ ID NO: 390952 - RNA, 32 nt, Human
cguuuagugagggcuggauugaaggaaagccu

SEQ ID NO: 390953 - RNA, 32 nt, Human
cguuuauaacuaccuucuuucgcuacccguuu

SEQ ID NO: 390954 - RNA, 32 nt, Human
cguuuauggugcuuccuucucccuccucuguc

SEQ ID NO: 390955 - RNA, 32 nt, Human
cguuuauugcuagcaguuucaaagugucaugu

SEQ ID NO: 390956 - RNA, 32 nt, Human
cguuuauuggcaaucugugaucacaagguuga

SEQ ID NO: 390957 - RNA, 32 nt, Human
cguuuauugugcauugauuaugugccagggac

SEQ ID NO: 390958 - RNA, 32 nt, Human
cguuucaaaacugaaaggaaagaaggaacaau

SEQ ID NO: 390959 - RNA, 32 nt, Human
cguuucacaacaaauucuucuuuuuggguugg

SEQ ID NO: 390960 - RNA, 32 nt, Human
cguuucaccauguuggccaggcuggucucaaa

SEQ ID NO: 390961 - RNA, 32 nt, Human
cguuucacuauguuggccaggcuggucucaaa

SEQ ID NO: 390962 - RNA, 32 nt, Human
cguuucacuguggcugcauuuuaauucuuauu

SEQ ID NO: 390963 - RNA, 32 nt, Human
cguuucagaccagcuucugggggaaggcaguc

SEQ ID NO: 390964 - RNA, 32 nt, Human
cguuucagagagaaaauuccuguuccaagaga

SEQ ID NO: 390965 - RNA, 27 nt, Human
cguuucaggcugcccaggcuuugcuga

SEQ ID NO: 390966 - RNA, 32 nt, Human
cguuucauaaaauuaagguuuaacagacugaa

SEQ ID NO: 390967 - RNA, 32 nt, Human
cguuucaucauguuggcuaggcuggucuugaa

SEQ ID NO: 390968 - RNA, 32 nt, Human
cguuucaucuuucuaggucuucacauccucac

SEQ ID NO: 390969 - RNA, 32 nt, Human
cguuuccacauccugcucugcugcaggagagg

SEQ ID NO: 390970 - RNA, 32 nt, Human
cguuuccacuggcuuuuuguacccaccgagcc

SEQ ID NO: 390971 - RNA, 32 nt, Human
cguuuccagggcauccgcagcccaggguaggg

SEQ ID NO: 390972 - RNA, 32 nt, Human
cguuuccagugaauuagugucaugucagcauc

SEQ ID NO: 390973 - RNA, 32 nt, Human
cguuuccaguuggcagcagagaucagggguua

SEQ ID NO: 390974 - RNA, 32 nt, Human
cguuucccgcuagccuggccugggcaaaugga

SEQ ID NO: 390975 - RNA, 31 nt, Human
cguuucccuagcccugggccugugccgcugu

SEQ ID NO: 390976 - RNA, 32 nt, Human
cguuucccucucccuucuuccccaccaacaaa

SEQ ID NO: 390977 - RNA, 32 nt, Human
cguuuccgggcccucagggcuggggagcucag

SEQ ID NO: 390978 - RNA, 32 nt, Human
cguuuccuccacccuacuuugauuuccuggug

SEQ ID NO: 390979 - RNA, 32 nt, Human
cguuuccucuccauccuucauccuccauuggu

SEQ ID NO: 390980 - RNA, 32 nt, Human
cguuuccugacacuaccagccugggaggccca

SEQ ID NO: 390981 - RNA, 32 nt, Human
cguuuccugagccgggaucuggggcgagaugg

SEQ ID NO: 390982 - RNA, 32 nt, Human
cguuuccuucaagaguuuucauggauucuaau

SEQ ID NO: 390983 - RNA, 32 nt, Human
cguuucgucauccucacagcaaggaccggacg

SEQ ID NO: 390984 - RNA, 32 nt, Human
cguuucuaccaaaaauacaaaaauuagccggg

SEQ ID NO: 390985 - RNA, 32 nt, Human
cguuucuacuaaaaauaacaacaauuagcuag

SEQ ID NO: 390986 - RNA, 32 nt, Human
cguuucuacuaaaaauaacaacaguuagcuag

SEQ ID NO: 390987 - RNA, 32 nt, Human
cguuucuacuaaaaauacaaaaauuagccagg

SEQ ID NO: 390988 - RNA, 32 nt, Human
cguuucuacuaaaaauacaaaaauuagccggg

SEQ ID NO: 390989 - RNA, 32 nt, Human
cguuucuacuaaaaauacaaaaauuagcuggg

SEQ ID NO: 390990 - RNA, 32 nt, Human
cguuucuacuaaaaauacaaaaauuagucagg

SEQ ID NO: 390991 - RNA, 32 nt, Human
cguuucuacuaaaaauacaaaauuagcugggc

SEQ ID NO: 390992 - RNA, 32 nt, Human
cguuucuacuaaaaaugcaaaaauuagcuggg

SEQ ID NO: 390993 - RNA, 32 nt, Human
cguuucuacucaccuccgccuccaggaagacc

SEQ ID NO: 390994 - RNA, 32 nt, Human
cguuucucagaagcagacccacccuuaaguug

SEQ ID NO: 390995 - RNA, 32 nt, Human
cguuucucuguguugaucaggcuggucucgaa

SEQ ID NO: 390996 - RNA, 32 nt, Human
cguuucucuuucuccuucucuuucccuugagg

SEQ ID NO: 390997 - RNA, 32 nt, Human
cguuucugugccucugcacucacagguuccuu

SEQ ID NO: 390998 - RNA, 32 nt, Human
cguuucuuaggaaaccaggaauccagggaagg

SEQ ID NO: 390999 - RNA, 32 nt, Human
cguuucuuccuccugcaguagaucuuagcuac

SEQ ID NO: 391000 - RNA, 32 nt, Human
cguuugaaaauacaaaaggccgggcguggugg

SEQ ID NO: 391001 - RNA, 32 nt, Human
cguuugaagucaguuuaaaacuucugaagugc

SEQ ID NO: 391002 - RNA, 32 nt, Human
cguuugacagguccucccucugcagggccugg

SEQ ID NO: 391003 - RNA, 32 nt, Human
cguuugagaggcugucaggcagcagcgaaagc

SEQ ID NO: 391004 - RNA, 32 nt, Human
cguuugaggagaaaggagaaaauacagaaaua

SEQ ID NO: 391005 - RNA, 32 nt, Human
cguuugcaccucgcugcuccagccucuggggc

SEQ ID NO: 391006 - RNA, 32 nt, Human
cguuugcagacacaggugcagcuuuggagaac

SEQ ID NO: 391007 - RNA, 32 nt, Human
cguuugcagcacaacaccauugcccggaggcu

SEQ ID NO: 391008 - RNA, 21 nt, Human
cguuugcagccaaugaagcug

SEQ ID NO: 391009 - RNA, 32 nt, Human
cguuugcauagagagaaaugauugacaguaag

SEQ ID NO: 391010 - RNA, 32 nt, Human
cguuugccacucuccagcaucuggcccagccu

SEQ ID NO: 391011 - RNA, 32 nt, Human
cguuugcggauggccgcagcaggccugugggg

SEQ ID NO: 391012 - RNA, 32 nt, Human
cguuugcuaucuugaaagcugcagcccccgua

SEQ ID NO: 391013 - RNA, 32 nt, Human
cguuugcugggaaggagaggacuuggggcaug

SEQ ID NO: 391014 - RNA, 32 nt, Human
cguuugcugggcuauuccccugcagugcagac

SEQ ID NO: 391015 - RNA, 32 nt, Human
cguuugcuuaaugccagaaguugggggaaagu

SEQ ID NO: 391016 - RNA, 32 nt, Human
cguuuggaaaggauuaaucgagaacuggguuc

SEQ ID NO: 391017 - RNA, 31 nt, Human
cguuuggauggggaagggaaagacuggggag

SEQ ID NO: 391018 - RNA, 32 nt, Human
cguuuggccaaaaagaaucugcauuuagcaca

SEQ ID NO: 391019 - RNA, 32 nt, Human
cguuuggcuguuuaagcugccaauuguagcac

SEQ ID NO: 391020 - RNA, 32 nt, Human
cguuuggguuugcagcuccuugccagagccca

SEQ ID NO: 391021 - RNA, 28 nt, Human
cguuuggugagucccggauucugguggg

SEQ ID NO: 391022 - RNA, 22 nt, Human
cguuuggugcaagauucucggg

SEQ ID NO: 391023 - RNA, 32 nt, Human
cguuuguaggcggugacccgccccuucucugg

SEQ ID NO: 391024 - RNA, 31 nt, Human
cguuugucacuuuucugauaaaagauggcca

SEQ ID NO: 391025 - RNA, 32 nt, Human
cguuugucccuccgccucccaccagcacgcgc

SEQ ID NO: 391026 - RNA, 32 nt, Human
cguuugucgccaggcuggagugcaguggugcc

SEQ ID NO: 391027 - RNA, 32 nt, Human
cguuugugugugugcguguauguauguguaua

SEQ ID NO: 391028 - RNA, 32 nt, Human
cguuuguguucuguuuuguuucgcucuuugag

SEQ ID NO: 391029 - RNA, 32 nt, Human
cguuuguuccccaagacauucuagguuugcaa

SEQ ID NO: 391030 - RNA, 32 nt, Human
cguuuguuuucacagcuuagggauuggugggu

SEQ ID NO: 391031 - RNA, 32 nt, Human
cguuuuaauuuccaggacuugaacugccaugu

SEQ ID NO: 391032 - RNA, 32 nt, Human
cguuuuacagcaguccuggaacagggcuguuu

SEQ ID NO: 391033 - RNA, 32 nt, Human
cguuuuagaaucugguaaaugucuugagaagg

SEQ ID NO: 391034 - RNA, 32 nt, Human
cguuuuaggaagaaggaggaaggaagaaggua

SEQ ID NO: 391035 - RNA, 32 nt, Human
cguuuuaggacucugugccacuuugagagacu

SEQ ID NO: 391036 - RNA, 32 nt, Human
cguuuuaggagagagaggucguaaggaagugu

SEQ ID NO: 391037 - RNA, 32 nt, Human
cguuuuaucuugaucucucucugacaaagaaa

SEQ ID NO: 391038 - RNA, 32 nt, Human
cguuuuauuuuucccaacauuaauguuucuua

SEQ ID NO: 391039 - RNA, 32 nt, Human
cguuuucaauaugccacaauuuaggacacauu

SEQ ID NO: 391040 - RNA, 32 nt, Human
cguuuucacaugcacauauguguaugcaugua

SEQ ID NO: 391041 - RNA, 24 nt, Human
cguuuucagaguucauccauguug

SEQ ID NO: 391042 - RNA, 32 nt, Human
cguuuucagaugggcaaggcacugccugucag

SEQ ID NO: 391043 - RNA, 32 nt, Human
cguuuuccagaacuuuaguauaugcaaaugca

SEQ ID NO: 391044 - RNA, 32 nt, Human
cguuuuccuucucuuuuucgacaaugguagac

SEQ ID NO: 391045 - RNA, 32 nt, Human
cguuuuccuuggcugagggaaguggccucucc

SEQ ID NO: 391046 - RNA, 32 nt, Human
cguuuucucacuguuggacucuaccucacugg

SEQ ID NO: 391047 - RNA, 32 nt, Human
cguuuucuccacccggcuccaucugcuggguc

SEQ ID NO: 391048 - RNA, 32 nt, Human
cguuuucucuccccuuucuucucucuucgcgg

SEQ ID NO: 391049 - RNA, 27 nt, Human
cguuuucucugacuucugcugacagug

SEQ ID NO: 391050 - RNA, 32 nt, Human
cguuuucugccacccaggcuggaguacagugg

SEQ ID NO: 391051 - RNA, 32 nt, Human
cguuuucugguuuugcucuugccuuguauucc

SEQ ID NO: 391052 - RNA, 32 nt, Human
cguuuucuguuugagauuuuuaucucuugauu

SEQ ID NO: 391053 - RNA, 32 nt, Human
cguuuucuuccccucacaccguuuucuuccca

SEQ ID NO: 391054 - RNA, 32 nt, Human
cguuuucuuccugcaugauccugggcccuccc

SEQ ID NO: 391055 - RNA, 32 nt, Human
cguuuucuugcucaaagggaacagugaauuag

SEQ ID NO: 391056 - RNA, 24 nt, Human
cguuuugacuguuuaaaguuuaug

SEQ ID NO: 391057 - RNA, 32 nt, Human
cguuuugauuuucaaagaagcagguucuggug

SEQ ID NO: 391058 - RNA, 32 nt, Human
cguuuugcacacaacauucaaaacacuucaua

SEQ ID NO: 391059 - RNA, 32 nt, Human
cguuuugccuuccaccaugcugugaggccucu

SEQ ID NO: 391060 - RNA, 32 nt, Human
cguuuuggaaccugcgucuggggcuccagucg

SEQ ID NO: 391061 - RNA, 32 nt, Human
cguuuuguagagaaaacuauucacaagauaaa

SEQ ID NO: 391062 - RNA, 32 nt, Human
cguuuugucgcccaggcuggagugcaguggca

SEQ ID NO: 391063 - RNA, 32 nt, Human
cguuuuguguccgauucaguguguaaacguug

SEQ ID NO: 391064 - RNA, 32 nt, Human
cguuuugugucugagcucugcgcucugcacgg

SEQ ID NO: 391065 - RNA, 32 nt, Human
cguuuuguucuuguuuaccagaaucuccuuua

SEQ ID NO: 391066 - RNA, 32 nt, Human
cguuuuguuuucucuucuugggagacaucugu

SEQ ID NO: 391067 - RNA, 32 nt, Human
cguuuuucccccagagcccuguguuuuuguga

SEQ ID NO: 391068 - RNA, 32 nt, Human
cguuuuucuaggacucugugcaacugucguau

SEQ ID NO: 391069 - RNA, 32 nt, Human
cguuuuucugcaggcuguuuucccagguuccc

SEQ ID NO: 391070 - RNA, 32 nt, Human
cguuuuucugcucucuucuggcccuccaugga

SEQ ID NO: 391071 - RNA, 32 nt, Human
cguuuuuguuucuuauuucaccaauucuggua

SEQ ID NO: 391072 - RNA, 32 nt, Human
  misc_feature (2)..(2): n is a, c, g or u
  misc_feature (27)..(27): n is a, c, g or u
cnugaaccugggagguggagcuugcanugagc

SEQ ID NO: 391073 - RNA, 32 nt, Human
cuaaaaacaacaaacauaauuuuucuaagugu

SEQ ID NO: 391074 - RNA, 32 nt, Human
cuaaaaacaacaaacauucauucucucacaca

SEQ ID NO: 391075 - RNA, 32 nt, Human
cuaaaaaccaaacacaccaccuuccuugaucc

SEQ ID NO: 391076 - RNA, 32 nt, Human
cuaaaaaccuucaaagacccagucuagccaaa

SEQ ID NO: 391077 - RNA, 32 nt, Human
cuaaaaacgcacagaaaaauuagccaggcaug

SEQ ID NO: 391078 - RNA, 32 nt, Human
cuaaaaacuaaaacaaaaacauucauagcaaa

SEQ ID NO: 391079 - RNA, 32 nt, Human
cuaaaaacuuaccccauaccaggaacccagag

SEQ ID NO: 391080 - RNA, 32 nt, Human
cuaaaaacuucugccccacucuugccauuucc

SEQ ID NO: 391081 - RNA, 32 nt, Human
cuaaaaagagaauuacacaugccaaauggacc

SEQ ID NO: 391082 - RNA, 32 nt, Human
cuaaaaagccacgacaugaaaaugacaauccc

SEQ ID NO: 391083 - RNA, 32 nt, Human
cuaaaaagccagugcuuuauuuggggaauuca

SEQ ID NO: 391084 - RNA, 19 nt, Human
cuaaaaagccugaacagcu

SEQ ID NO: 391085 - RNA, 20 nt, Human
cuaaaaaggcugaacauuua

SEQ ID NO: 391086 - RNA, 32 nt, Human
cuaaaaaguuugagauuugugauaacuuugua

SEQ ID NO: 391087 - RNA, 32 nt, Human
cuaaaaauacaaaaacuagcugggcauggugg

SEQ ID NO: 391088 - RNA, 32 nt, Human
cuaaaaauacaaaaaguuagcugggcauggug

SEQ ID NO: 391089 - RNA, 32 nt, Human
cuaaaaauacaaaaauagcugggcgugguggu

SEQ ID NO: 391090 - RNA, 32 nt, Human
cuaaaaauacaaaaaucagcugggcauggugg

SEQ ID NO: 391091 - RNA, 32 nt, Human
cuaaaaauacaaaaaugagcugggcauggugg

SEQ ID NO: 391092 - RNA, 32 nt, Human
cuaaaaauacaaaaaugagcugggcguggugg

SEQ ID NO: 391093 - RNA, 32 nt, Human
cuaaaaauacaaaaaugagcugggcuuggugg

SEQ ID NO: 391094 - RNA, 32 nt, Human
cuaaaaauacaaaaauuaacugggcuuggugg

SEQ ID NO: 391095 - RNA, 32 nt, Human
cuaaaaauacaaaaauuacccgggcuuggugg

SEQ ID NO: 391096 - RNA, 32 nt, Human
cuaaaaauacaaaaauuagccaggacugaugg

SEQ ID NO: 391097 - RNA, 32 nt, Human
cuaaaaauacaaaaauuagccaggcuuagugg

SEQ ID NO: 391098 - RNA, 32 nt, Human
cuaaaaauacaaaaauuagccggacgcagugg

SEQ ID NO: 391099 - RNA, 32 nt, Human
cuaaaaauacaaaaauuagccggacgugguag

SEQ ID NO: 391100 - RNA, 32 nt, Human
cuaaaaauacaaaaauuagccggacguggugg

SEQ ID NO: 391101 - RNA, 32 nt, Human
cuaaaaauacaaaaauuagcgggcguaguggc

SEQ ID NO: 391102 - RNA, 32 nt, Human
cuaaaaauacaaaaauuagcugagcucugaug

SEQ ID NO: 391103 - RNA, 32 nt, Human
cuaaaaauacaaaaauuagcugcacaugguug

SEQ ID NO: 391104 - RNA, 32 nt, Human
cuaaaaauacaaaaauuagcuggacaucaugg

SEQ ID NO: 391105 - RNA, 32 nt, Human
cuaaaaauacaaaaauuagcuggacauggugg

SEQ ID NO: 391106 - RNA, 32 nt, Human
cuaaaaauacaaaaauuagcuggacguggugg

SEQ ID NO: 391107 - RNA, 32 nt, Human
cuaaaaauacaaaaauuagcuggaugcgauag

SEQ ID NO: 391108 - RNA, 32 nt, Human
cuaaaaauacaaaaauuagcuggauguggugg

SEQ ID NO: 391109 - RNA, 32 nt, Human
cuaaaaauacaaaaauuagcugggcacggugg

SEQ ID NO: 391110 - RNA, 32 nt, Human
cuaaaaauacaaaaauuagcugggcaugaugg

SEQ ID NO: 391111 - RNA, 32 nt, Human
cuaaaaauacaaaaauuagcugggcauggcgg

SEQ ID NO: 391112 - RNA, 32 nt, Human
cuaaaaauacaaaaauuagcugggcauggugg

SEQ ID NO: 391113 - RNA, 32 nt, Human
cuaaaaauacaaaaauuagcugggcauggugu

SEQ ID NO: 391114 - RNA, 32 nt, Human
cuaaaaauacaaaaauuagcugggcgcaguag

SEQ ID NO: 391115 - RNA, 32 nt, Human
cuaaaaauacaaaaauuagcugggcgcggugg

SEQ ID NO: 391116 - RNA, 32 nt, Human
cuaaaaauacaaaaauuagcugggcggggugg

SEQ ID NO: 391117 - RNA, 32 nt, Human
cuaaaaauacaaaaauuagcugggcgugaugg

SEQ ID NO: 391118 - RNA, 32 nt, Human
cuaaaaauacaaaaauuagcugggcgugaugu

SEQ ID NO: 391119 - RNA, 32 nt, Human
cuaaaaauacaaaaauuagcugggcgugcugg

SEQ ID NO: 391120 - RNA, 32 nt, Human
cuaaaaauacaaaaauuagcugggcgugguag

SEQ ID NO: 391121 - RNA, 32 nt, Human
cuaaaaauacaaaaauuagcugggcguggugg

SEQ ID NO: 391122 - RNA, 32 nt, Human
cuaaaaauacaaaaauuagcugggcguguugg

SEQ ID NO: 391123 - RNA, 32 nt, Human
cuaaaaauacaaaaauuagcugggcguuaugg

SEQ ID NO: 391124 - RNA, 32 nt, Human
cuaaaaauacaaaaauuagcugggcuuggugg

SEQ ID NO: 391125 - RNA, 32 nt, Human
cuaaaaauacaaaaauuagcuggggcgagggg

SEQ ID NO: 391126 - RNA, 32 nt, Human
cuaaaaauacaaaaauuagcuggggguggugg

SEQ ID NO: 391127 - RNA, 32 nt, Human
cuaaaaauacaaaaauuagcugggugcagugg

SEQ ID NO: 391128 - RNA, 32 nt, Human
cuaaaaauacaaaaauuagcugggugcggugg

SEQ ID NO: 391129 - RNA, 32 nt, Human
cuaaaaauacaaaaauuagcuggguguagugg

SEQ ID NO: 391130 - RNA, 32 nt, Human
cuaaaaauacaaaaauuagcuggguguauggc

SEQ ID NO: 391131 - RNA, 32 nt, Human
cuaaaaauacaaaaauuagcugggugugaugg

SEQ ID NO: 391132 - RNA, 32 nt, Human
cuaaaaauacaaaaauuagcugggugugguga

SEQ ID NO: 391133 - RNA, 32 nt, Human
cuaaaaauacaaaaauuagcuggguguggugg

SEQ ID NO: 391134 - RNA, 32 nt, Human
cuaaaaauacaaaaauuagcuggguguguugg

SEQ ID NO: 391135 - RNA, 32 nt, Human
cuaaaaauacaaaaauuagcuggucuuggugg

SEQ ID NO: 391136 - RNA, 32 nt, Human
cuaaaaauacaaaaauuagguggacauggugg

SEQ ID NO: 391137 - RNA, 32 nt, Human
cuaaaaauacaaaaauuaggugggucuggugg

SEQ ID NO: 391138 - RNA, 32 nt, Human
cuaaaaauacaaaaauuaguugggcauggugg

SEQ ID NO: 391139 - RNA, 32 nt, Human
cuaaaaauacaaaaauuaucugggcuuggugg

SEQ ID NO: 391140 - RNA, 32 nt, Human
cuaaaaauacaaaaauuggcugggcauggugg

SEQ ID NO: 391141 - RNA, 32 nt, Human
cuaaaaauacaaaaauuugcugggcauggugg

SEQ ID NO: 391142 - RNA, 32 nt, Human
cuaaaaauacaaaaauuugcugggcuuggugg

SEQ ID NO: 391143 - RNA, 32 nt, Human
cuaaaaauacaaaaguuagcuggggcuggugg

SEQ ID NO: 391144 - RNA, 32 nt, Human
cuaaaaauacaaaauauuagcugggcguggug

SEQ ID NO: 391145 - RNA, 32 nt, Human
cuaaaaauacaaaauccaggcgugguggcaca

SEQ ID NO: 391146 - RNA, 32 nt, Human
cuaaaaauacaaaauuagcugggcaugguggc

SEQ ID NO: 391147 - RNA, 32 nt, Human
cuaaaaauacaaaauuagcugggcguggugga

SEQ ID NO: 391148 - RNA, 32 nt, Human
cuaaaaauacaaaauuagcugggcgugguggc

SEQ ID NO: 391149 - RNA, 32 nt, Human
cuaaaaauacaaaauuagcugggcgugguggu

SEQ ID NO: 391150 - RNA, 32 nt, Human
cuaaaaauacaaaauuagcuggguuugguggc

SEQ ID NO: 391151 - RNA, 32 nt, Human
cuaaaaauacaaaauuuagcugggcauggugg

SEQ ID NO: 391152 - RNA, 32 nt, Human
cuaaaaauacaaacaaaauuagcugggcaugg

SEQ ID NO: 391153 - RNA, 32 nt, Human
cuaaaaauacaaacuuggcugggcuuaguggu

SEQ ID NO: 391154 - RNA, 32 nt, Human
cuaaaaauacaaauauuagcuggauauggugg

SEQ ID NO: 391155 - RNA, 32 nt, Human
cuaaaaauacaaauauuagcugggcguggugg

SEQ ID NO: 391156 - RNA, 32 nt, Human
cuaaaaauacaacaacaacaaaauuagcuggg

SEQ ID NO: 391157 - RNA, 32 nt, Human
cuaaaaauacaagaauuagcugggcguggugg

SEQ ID NO: 391158 - RNA, 32 nt, Human
cuaaaaauacaaggauuagcugggcauggugg

SEQ ID NO: 391159 - RNA, 32 nt, Human
cuaaaaauaccaaaauuagcugggacuggugg

SEQ ID NO: 391160 - RNA, 32 nt, Human
cuaaaaauagaaacaaauuuagccaggcaugg

SEQ ID NO: 391161 - RNA, 32 nt, Human
cuaaaaauaugaaaauuagcugggcuuggugg

SEQ ID NO: 391162 - RNA, 32 nt, Human
cuaaaaaugcaaaaauuagcuggacguggugg

SEQ ID NO: 391163 - RNA, 32 nt, Human
cuaaaaaugcaaaaauuagcugggcguggugg

SEQ ID NO: 391164 - RNA, 24 nt, Human
cuaaaaaugguaaaucugaucaua

SEQ ID NO: 391165 - RNA, 32 nt, Human
cuaaaacaaauacaaaacuucgcugggaaaaa

SEQ ID NO: 391166 - RNA, 32 nt, Human
cuaaaacagacccugaguuaauuggguugaaa

SEQ ID NO: 391167 - RNA, 32 nt, Human
cuaaaacauaaauauuuauauuacagacucaa

SEQ ID NO: 391168 - RNA, 32 nt, Human
cuaaaacauccagcaaacucaaguugaaggac

SEQ ID NO: 391169 - RNA, 32 nt, Human
cuaaaacaucccugaguucaccaccuuggcca

SEQ ID NO: 391170 - RNA, 32 nt, Human
cuaaaaccaaaaacaacagugacaauagaguc

SEQ ID NO: 391171 - RNA, 32 nt, Human
cuaaaaccaaaccagaugaugaccuuucuagu

SEQ ID NO: 391172 - RNA, 32 nt, Human
cuaaaaccagcgucggaagcugugcuguagcc

SEQ ID NO: 391173 - RNA, 32 nt, Human
cuaaaaccagugagagcacacacuaagagaaa

SEQ ID NO: 391174 - RNA, 32 nt, Human
cuaaaacccaggaugaggaggaacaggcagaa

SEQ ID NO: 391175 - RNA, 32 nt, Human
cuaaaaccuuccuuggcucccugcugcccuca

SEQ ID NO: 391176 - RNA, 32 nt, Human
cuaaaacuauguucaucugccucucucugcca

SEQ ID NO: 391177 - RNA, 32 nt, Human
cuaaaacuauuuucucuuugcccuuaccacuc

SEQ ID NO: 391178 - RNA, 32 nt, Human
cuaaaacugcccccagcacguccucaagacgc

SEQ ID NO: 391179 - RNA, 32 nt, Human
cuaaaagacagaaacaauacacugccaaaaug

SEQ ID NO: 391180 - RNA, 32 nt, Human
cuaaaagagggccagaaggccugcugagggcu

SEQ ID NO: 391181 - RNA, 32 nt, Human
cuaaaagaguaggaagagagaaaugguagccu

SEQ ID NO: 391182 - RNA, 32 nt, Human
cuaaaagaugcugguccucccaaccucacucu

SEQ ID NO: 391183 - RNA, 32 nt, Human
cuaaaagauuuugauuuccuggaaugacaauu

SEQ ID NO: 391184 - RNA, 32 nt, Human
cuaaaagcuucugcuccuuccuucccaauuuc

SEQ ID NO: 391185 - RNA, 32 nt, Human
cuaaaagcuuugccacauucuucacauuugua

SEQ ID NO: 391186 - RNA, 32 nt, Human
cuaaaaggaggggucccugaagcuuucccacu

SEQ ID NO: 391187 - RNA, 32 nt, Human
cuaaaaggccuuggggcuggagcccagagagg

SEQ ID NO: 391188 - RNA, 32 nt, Human
cuaaaaguacaaaaauuagcuggauguggugg

SEQ ID NO: 391189 - RNA, 32 nt, Human
cuaaaaguacaaaaauuagcuggcgugcacca

SEQ ID NO: 391190 - RNA, 32 nt, Human
cuaaaaguacaaaaauuagcugggcaugaugg

SEQ ID NO: 391191 - RNA, 32 nt, Human
cuaaaaguacaaaaauuagcugggcguggugg

SEQ ID NO: 391192 - RNA, 32 nt, Human
cuaaaaguauuuuuaaauguuucucaugugau

SEQ ID NO: 391193 - RNA, 23 nt, Human
cuaaaagucuauaaagaaucaga

SEQ ID NO: 391194 - RNA, 26 nt, Human
cuaaaagucucaggcaauaggacaga

SEQ ID NO: 391195 - RNA, 32 nt, Human
cuaaaagucuucauacagaguacaagugcagc

SEQ ID NO: 391196 - RNA, 23 nt, Human
cuaaaagugcuacagaggacaga

SEQ ID NO: 391197 - RNA, 21 nt, Human
cuaaaaguguacagaaaacag

SEQ ID NO: 391198 - RNA, 21 nt, Human
cuaaaaguuaagaaggaaaga

SEQ ID NO: 391199 - RNA, 32 nt, Human
cuaaaauacaaaaaguuagcugggcuuggcgg

SEQ ID NO: 391200 - RNA, 32 nt, Human
cuaaaauagagaauguugucuuuugccgacca

SEQ ID NO: 391201 - RNA, 32 nt, Human
cuaaaaucauccagacuguuggugguggugcu

SEQ ID NO: 391202 - RNA, 32 nt, Human
cuaaaaucauggacuggcuuucugguuggauu

SEQ ID NO: 391203 - RNA, 32 nt, Human
cuaaaaucuauaauuuaauucaagagaaugcu

SEQ ID NO: 391204 - RNA, 32 nt, Human
cuaaaaugaaucugagcaauauggaauauuuu

SEQ ID NO: 391205 - RNA, 24 nt, Human
cuaaaaugcugggauuacaggcgu

SEQ ID NO: 391206 - RNA, 32 nt, Human
cuaaaauggaauagacaggaaaagauuguguu

SEQ ID NO: 391207 - RNA, 32 nt, Human
cuaaaaugggcaagggagagcggguggagggc

SEQ ID NO: 391208 - RNA, 32 nt, Human
cuaaaaugugaaccguugggugaucuguccuu

SEQ ID NO: 391209 - RNA, 32 nt, Human
cuaaaauguuaacugccaguuugucuuaucug

SEQ ID NO: 391210 - RNA, 32 nt, Human
cuaaaauuaucugaaguuggaagcacuuuguu

SEQ ID NO: 391211 - RNA, 32 nt, Human
cuaaaauucaaaaacaaaauuagccgggcaug

SEQ ID NO: 391212 - RNA, 32 nt, Human
cuaaaauucugucucuuccugcuuuagacagc

SEQ ID NO: 391213 - RNA, 32 nt, Human
cuaaaauugaucuauggauuuaauaccauuuu

SEQ ID NO: 391214 - RNA, 32 nt, Human
cuaaaauugcagcauuuccccagcugggcugu

SEQ ID NO: 391215 - RNA, 32 nt, Human
cuaaaauuuauaugaaaugaaaaggaaccaga

SEQ ID NO: 391216 - RNA, 32 nt, Human
cuaaacaaaacaaaugaugggagaguaaguag

SEQ ID NO: 391217 - RNA, 32 nt, Human
cuaaacaaacuuauauuucaauaaaagggagu

SEQ ID NO: 391218 - RNA, 32 nt, Human
cuaaacaaagaauguuuuugaaaagcccaaau

SEQ ID NO: 391219 - RNA, 32 nt, Human
cuaaacaaaguucagucuucugcucgccccuu

SEQ ID NO: 391220 - RNA, 32 nt, Human
cuaaacaacauagugaaacccugucucuauua

SEQ ID NO: 391221 - RNA, 32 nt, Human
cuaaacaagagaaacuaccaucuuggccagug

SEQ ID NO: 391222 - RNA, 32 nt, Human
cuaaacaagcaugcucuaacccaaugcaagga

SEQ ID NO: 391223 - RNA, 32 nt, Human
cuaaacaagggacuuggguucaguuaguguac

SEQ ID NO: 391224 - RNA, 21 nt, Human
cuaaacaaugaacucuguuca

SEQ ID NO: 391225 - RNA, 32 nt, Human
cuaaacacacacuugaggcauucaugugacua

SEQ ID NO: 391226 - RNA, 32 nt, Human
cuaaacaccuucacuaccuucuaccucgcacu

SEQ ID NO: 391227 - RNA, 32 nt, Human
cuaaacacgcaacuggcaucucauuucgccua

SEQ ID NO: 391228 - RNA, 32 nt, Human
cuaaacagagacuuaguccaaagagaaccaac

SEQ ID NO: 391229 - RNA, 32 nt, Human
cuaaacagccaagacuggagcagucucucacc

SEQ ID NO: 391230 - RNA, 32 nt, Human
cuaaacagccugacacugaggggaggcaguga

SEQ ID NO: 391231 - RNA, 32 nt, Human
cuaaacaggauuucuggucuggggucugggac

SEQ ID NO: 391232 - RNA, 32 nt, Human
cuaaacaguacuagaaauuacagugccaagag

SEQ ID NO: 391233 - RNA, 32 nt, Human
cuaaacauacaaaaauuagcugggcauggugg

SEQ ID NO: 391234 - RNA, 32 nt, Human
cuaaacaugcaaaaauuagcugggcacggugg

SEQ ID NO: 391235 - RNA, 32 nt, Human
cuaaacaugucacuuuucuguuaagaaaacug

SEQ ID NO: 391236 - RNA, 32 nt, Human
cuaaacaugugucucucccacaggucauucuc

SEQ ID NO: 391237 - RNA, 32 nt, Human
cuaaacauuugacuaacauucuguuugaauuu

SEQ ID NO: 391238 - RNA, 32 nt, Human
cuaaacauuuuugagugugaacuggggauugg

SEQ ID NO: 391239 - RNA, 32 nt, Human
cuaaaccaaguggcagagggguuggaaugugc

SEQ ID NO: 391240 - RNA, 21 nt, Human
cuaaaccacugagaaaacguu

SEQ ID NO: 391241 - RNA, 24 nt, Human
cuaaaccagccugggcaacauagu

SEQ ID NO: 391242 - RNA, 32 nt, Human
cuaaaccagcgucgguggaggaagggguauaa

SEQ ID NO: 391243 - RNA, 32 nt, Human
cuaaaccaucuuucaagagaaaggacaaaaua

SEQ ID NO: 391244 - RNA, 32 nt, Human
cuaaaccauuagggaaguucaaaggaaugugc

SEQ ID NO: 391245 - RNA, 32 nt, Human
cuaaacccagaagagaggggugggcuggggca

SEQ ID NO: 391246 - RNA, 32 nt, Human
cuaaacccagauaacuuuugaaacccaaguuc

SEQ ID NO: 391247 - RNA, 32 nt, Human
cuaaacccagugcugcucucccaucucccauc

SEQ ID NO: 391248 - RNA, 32 nt, Human
cuaaacccaucaccugcugucuucacucaaau

SEQ ID NO: 391249 - RNA, 32 nt, Human
cuaaaccccacugucuuccagggucagguugg

SEQ ID NO: 391250 - RNA, 32 nt, Human
cuaaaccccagccuugaacuucacuccucccu

SEQ ID NO: 391251 - RNA, 32 nt, Human
cuaaacccugugccuugagugugcaagcugac

SEQ ID NO: 391252 - RNA, 32 nt, Human
cuaaaccugguuuaaaugaaacaucuaauuuu

SEQ ID NO: 391253 - RNA, 32 nt, Human
cuaaaccugugcaagaugggagaccggggugg

SEQ ID NO: 391254 - RNA, 32 nt, Human
cuaaaccuucucccaucucuuucaaaaucuuu

SEQ ID NO: 391255 - RNA, 32 nt, Human
cuaaaccuugagggggagggugcucuggguuu

SEQ ID NO: 391256 - RNA, 32 nt, Human
cuaaacgaggagcugggccagguggaguacau

SEQ ID NO: 391257 - RNA, 32 nt, Human
cuaaacgccacccucacuaagucucccugggc

SEQ ID NO: 391258 - RNA, 32 nt, Human
cuaaacgugaguugcugugaacuggggauuaa

SEQ ID NO: 391259 - RNA, 32 nt, Human
cuaaacuacagaugucaacuccuuggggugcu

SEQ ID NO: 391260 - RNA, 32 nt, Human
cuaaacuaccgugaacaccuuauucucaaagg

SEQ ID NO: 391261 - RNA, 32 nt, Human
cuaaacuaccugcuguuaaaagaauagauggu

SEQ ID NO: 391262 - RNA, 32 nt, Human
cuaaacuccaaacauccucuuccauauggauc

SEQ ID NO: 391263 - RNA, 32 nt, Human
cuaaacucccuucccucucucccauuucagga

SEQ ID NO: 391264 - RNA, 32 nt, Human
cuaaacucgggggcccccugcccgcacccgga

SEQ ID NO: 391265 - RNA, 32 nt, Human
cuaaacucugaggauaaaguugccaguccuuu

SEQ ID NO: 391266 - RNA, 32 nt, Human
cuaaacucuggaaaguggaguugggggaaggg

SEQ ID NO: 391267 - RNA, 32 nt, Human
cuaaacucuggaagcuccucaucccaggcuug

SEQ ID NO: 391268 - RNA, 32 nt, Human
cuaaacucuucauguggcagagucuucuaugu

SEQ ID NO: 391269 - RNA, 32 nt, Human
cuaaacugagcagucucauaccauggagagau

SEQ ID NO: 391270 - RNA, 32 nt, Human
cuaaacugagguauggagccuccaucaucaug

SEQ ID NO: 391271 - RNA, 32 nt, Human
cuaaacugcaacuucuaaauuccauguggcau

SEQ ID NO: 391272 - RNA, 31 nt, Human
cuaaacugccucugcucucuugucuucagac

SEQ ID NO: 391273 - RNA, 32 nt, Human
cuaaacugugaguucucaugguguuuuuguaa

SEQ ID NO: 391274 - RNA, 32 nt, Human
cuaaacuucccugaauuggcuuagucaaugcc

SEQ ID NO: 391275 - RNA, 32 nt, Human
cuaaacuucccugaauuggcuuggucaaugcc

SEQ ID NO: 391276 - RNA, 32 nt, Human
cuaaacuucucccagccucuucaggaaagaaa

SEQ ID NO: 391277 - RNA, 32 nt, Human
cuaaacuugaagcaaaaucuccugucaagggu

SEQ ID NO: 391278 - RNA, 32 nt, Human
cuaaacuuucuccuuuguucucaggccuucca

SEQ ID NO: 391279 - RNA, 32 nt, Human
cuaaagaaaccagcuuuuugcacuaaagccaa

SEQ ID NO: 391280 - RNA, 32 nt, Human
cuaaagaaagaaagacaaaaguagucguccgc

SEQ ID NO: 391281 - RNA, 32 nt, Human
cuaaagaaagcacauuuuaccauugcuguugg

SEQ ID NO: 391282 - RNA, 32 nt, Human
cuaaagaaccaacccaggacagagccacaauc

SEQ ID NO: 391283 - RNA, 32 nt, Human
cuaaagaaugaacuucugucugccucguggag

SEQ ID NO: 391284 - RNA, 32 nt, Human
cuaaagaaugugccaccagacuuuaagugaua

SEQ ID NO: 391285 - RNA, 32 nt, Human
cuaaagacacaaauggcguucugcaaggggac

SEQ ID NO: 391286 - RNA, 32 nt, Human
cuaaagacauacugcaguuuguucauaaaugu

SEQ ID NO: 391287 - RNA, 32 nt, Human
cuaaagacauguggaggaagucacuguuaaau

SEQ ID NO: 391288 - RNA, 32 nt, Human
cuaaagacauugucaccgagugugugugacuc

SEQ ID NO: 391289 - RNA, 32 nt, Human
cuaaagacccaggaaggucucugggugggaua

SEQ ID NO: 391290 - RNA, 32 nt, Human
cuaaagacuguucuggccccagacacagggua

SEQ ID NO: 391291 - RNA, 32 nt, Human
cuaaagagaaccuucucacaagaauuaaaaac

SEQ ID NO: 391292 - RNA, 32 nt, Human
cuaaagagcacuaguugugaauuuaggguguu

SEQ ID NO: 391293 - RNA, 18 nt, Human
cuaaagagcugcacagca

SEQ ID NO: 391294 - RNA, 32 nt, Human
cuaaagagucaagcaucuagcccaggacauga

SEQ ID NO: 391295 - RNA, 32 nt, Human
cuaaagaguguccuccuuucuuugccaacacu

SEQ ID NO: 391296 - RNA, 32 nt, Human
cuaaagagugucuugcuauguugcccaggcug

SEQ ID NO: 391297 - RNA, 32 nt, Human
cuaaagauaaauaauaucaaaauagugucauu

SEQ ID NO: 391298 - RNA, 32 nt, Human
cuaaagauauaaaaauuagcuggauguggugg

SEQ ID NO: 391299 - RNA, 32 nt, Human
cuaaagaugaagcuacaagaaauaaguugggg

SEQ ID NO: 391300 - RNA, 32 nt, Human
cuaaagauggaguacacugaugcugaaguacu

SEQ ID NO: 391301 - RNA, 32 nt, Human
cuaaagauguuuuaagcuaaagccugaauuug

SEQ ID NO: 391302 - RNA, 32 nt, Human
cuaaagcaaaaacagaguugaaugaaggacac

SEQ ID NO: 391303 - RNA, 32 nt, Human
cuaaagcaaagucauuggaugggaggaggaag

SEQ ID NO: 391304 - RNA, 32 nt, Human
cuaaagcaauccucccaccucugccucccgag

SEQ ID NO: 391305 - RNA, 32 nt, Human
cuaaagcacuuuucauugaacauguuagccua

SEQ ID NO: 391306 - RNA, 24 nt, Human
cuaaagcagauuuaauuuuugcca

SEQ ID NO: 391307 - RNA, 32 nt, Human
cuaaagcagguaaauugucgggggagagaguu

SEQ ID NO: 391308 - RNA, 32 nt, Human
cuaaagcagguaaauuguugggggagagaguu

SEQ ID NO: 391309 - RNA, 22 nt, Human
cuaaagccaacagagauuugua

SEQ ID NO: 391310 - RNA, 32 nt, Human
cuaaagccauuugucuguguuuucuucuugug

SEQ ID NO: 391311 - RNA, 32 nt, Human
cuaaagccuccucagccuucugagucagccug

SEQ ID NO: 391312 - RNA, 32 nt, Human
cuaaagccuccuguuccaccucagguuuucac

SEQ ID NO: 391313 - RNA, 32 nt, Human
cuaaagccuguaaucccagcacuuugggaggc

SEQ ID NO: 391314 - RNA, 32 nt, Human
cuaaagcuauacuaacagcagucaccuuuagu

SEQ ID NO: 391315 - RNA, 32 nt, Human
cuaaagcuaugugaaaguugagcucaaaguag

SEQ ID NO: 391316 - RNA, 32 nt, Human
cuaaagcucaaaaacaugaaaccacaacgagg

SEQ ID NO: 391317 - RNA, 32 nt, Human
cuaaagcucagcuggaccugaccaggccucug

SEQ ID NO: 391318 - RNA, 20 nt, Human
cuaaagcugagauuacaggc

SEQ ID NO: 391319 - RNA, 32 nt, Human
cuaaagcugcagcuagcucccagcccugcaga

SEQ ID NO: 391320 - RNA, 32 nt, Human
cuaaaggaaggaggguaucaagaggcuguucu

SEQ ID NO: 391321 - RNA, 32 nt, Human
cuaaaggaaucucuugagauugucugagugga

SEQ ID NO: 391322 - RNA, 32 nt, Human
cuaaaggacuccugagucacuaccacagccac

SEQ ID NO: 391323 - RNA, 32 nt, Human
cuaaaggaggcugagguugcagugagcugaga

SEQ ID NO: 391324 - RNA, 32 nt, Human
cuaaaggauaacaucaccccaucuucagaaac

SEQ ID NO: 391325 - RNA, 32 nt, Human
cuaaaggauuugacuuucucucaacugcaguu

SEQ ID NO: 391326 - RNA, 32 nt, Human
cuaaaggcaaagcauuccggggcgcggcgcau

SEQ ID NO: 391327 - RNA, 32 nt, Human
cuaaaggcaacccuggcccacacccgcaugcg

SEQ ID NO: 391328 - RNA, 32 nt, Human
cuaaaggcacacaccaccacaccuagcuaauu

SEQ ID NO: 391329 - RNA, 31 nt, Human
cuaaaggcacuuuuauugagaaugagaagaa

SEQ ID NO: 391330 - RNA, 32 nt, Human
cuaaaggcagagccccagccucagagacaaau

SEQ ID NO: 391331 - RNA, 32 nt, Human
cuaaaggcagaggcaccuaacugcuccccgca

SEQ ID NO: 391332 - RNA, 32 nt, Human
cuaaaggccagugucugcuguauaucucucau

SEQ ID NO: 391333 - RNA, 32 nt, Human
cuaaaggcugguagccacugagcaaaacccaa

SEQ ID NO: 391334 - RNA, 32 nt, Human
cuaaaggcuugucuuuccccugcccgaccgaa

SEQ ID NO: 391335 - RNA, 32 nt, Human
cuaaaggcuuugccacauucagcacauauaua

SEQ ID NO: 391336 - RNA, 32 nt, Human
cuaaaggcuuugccacauucuucacaugugua

SEQ ID NO: 391337 - RNA, 32 nt, Human
cuaaaggcuuugccacauuguucacauuugua

SEQ ID NO: 391338 - RNA, 32 nt, Human
cuaaagggaagugggcgcuggauuuauuagau

SEQ ID NO: 391339 - RNA, 32 nt, Human
cuaaagggaagugggugcuggauuuauuagau

SEQ ID NO: 391340 - RNA, 32 nt, Human
cuaaagggcaacauauagacuuuagauccuaa

SEQ ID NO: 391341 - RNA, 32 nt, Human
cuaaaggguaacuucaggugugcagcccugag

SEQ ID NO: 391342 - RNA, 32 nt, Human
cuaaagggugugggucagggaggggucuagag

SEQ ID NO: 391343 - RNA, 32 nt, Human
cuaaaggucagaauccgggaucaggaacuguu

SEQ ID NO: 391344 - RNA, 32 nt, Human
cuaaaggucucccaggccuucccagucaaaau

SEQ ID NO: 391345 - RNA, 32 nt, Human
cuaaagguuuucuaaaaauuaaccucacaucc

SEQ ID NO: 391346 - RNA, 24 nt, Human
cuaaaguacugggauuacaggcgu

SEQ ID NO: 391347 - RNA, 32 nt, Human
cuaaaguagagcccuuugagaauacaagauau

SEQ ID NO: 391348 - RNA, 20 nt, Human
cuaaaguagcaggacucgga

SEQ ID NO: 391349 - RNA, 32 nt, Human
cuaaagucaagcaaauguucuagcccuucagg

SEQ ID NO: 391350 - RNA, 32 nt, Human
cuaaagucacauauaaaaguuaaacuacuugu

SEQ ID NO: 391351 - RNA, 32 nt, Human
cuaaagucaggaguucgagaccagccugacca

SEQ ID NO: 391352 - RNA, 32 nt, Human
cuaaagucuagugaccuuaaacugaaugauuu

SEQ ID NO: 391353 - RNA, 32 nt, Human
cuaaagucuccaaggaggucgggauggggcuu

SEQ ID NO: 391354 - RNA, 31 nt, Human
cuaaagugacucucuggguugccugcuucca

SEQ ID NO: 391355 - RNA, 32 nt, Human
cuaaagugagcccagaggccacugagaaugca

SEQ ID NO: 391356 - RNA, 32 nt, Human
cuaaagugaguugaugaaaauauuugcaaaaa

SEQ ID NO: 391357 - RNA, 22 nt, Human
cuaaagugcuaggauuacaggc

SEQ ID NO: 391358 - RNA, 24 nt, Human
cuaaagugcugggaucacaggcgu

SEQ ID NO: 391359 - RNA, 21 nt, Human
cuaaagugcugggauuacagg

SEQ ID NO: 391360 - RNA, 22 nt, Human
cuaaagugcugggauuacaggc

SEQ ID NO: 391361 - RNA, 23 nt, Human
cuaaagugcugggauuacaggca

SEQ ID NO: 391362 - RNA, 24 nt, Human
cuaaagugcugggauuacaggcgu

SEQ ID NO: 391363 - RNA, 32 nt, Human
cuaaagugcugggauuacaugagccaccacau

SEQ ID NO: 391364 - RNA, 21 nt, Human
cuaaagugcugggauugcagg

SEQ ID NO: 391365 - RNA, 22 nt, Human
cuaaagugcugggauugcaggc

SEQ ID NO: 391366 - RNA, 24 nt, Human
cuaaagugcugggauugcaggcgu

SEQ ID NO: 391367 - RNA, 21 nt, Human
cuaaagugcugggauuucagg

SEQ ID NO: 391368 - RNA, 32 nt, Human
cuaaagugucugcaaguggaaauccagagaaa

SEQ ID NO: 391369 - RNA, 32 nt, Human
cuaaagugucugcaaguggaaauccagaggaa

SEQ ID NO: 391370 - RNA, 22 nt, Human
cuaaaguuaucuccccauucua

SEQ ID NO: 391371 - RNA, 32 nt, Human
cuaaaguucauucuguagugcacagcauucag

SEQ ID NO: 391372 - RNA, 32 nt, Human
cuaaaguuguuuuguaagguuccaaacuaaua

SEQ ID NO: 391373 - RNA, 32 nt, Human
cuaaaguuuucugcuuuccuucuguccugaug

SEQ ID NO: 391374 - RNA, 32 nt, Human
cuaaauaacuaaaaguauguaaagguaaaagg

SEQ ID NO: 391375 - RNA, 32 nt, Human
cuaaauaaugcccagucuucuccccaaaguca

SEQ ID NO: 391376 - RNA, 32 nt, Human
cuaaauaauguuccauucuauagauacauauu

SEQ ID NO: 391377 - RNA, 32 nt, Human
cuaaauaccaguuaucacagacuucacuggcc

SEQ ID NO: 391378 - RNA, 32 nt, Human
cuaaauacugaacaauaugaagauucuuuucu

SEQ ID NO: 391379 - RNA, 32 nt, Human
cuaaauaggaguuacagaaaacuguuaaauag

SEQ ID NO: 391380 - RNA, 32 nt, Human
cuaaauagggcugaggcuugggcaagggcauu

SEQ ID NO: 391381 - RNA, 32 nt, Human
cuaaauagguuccccagaguccugccccucua

SEQ ID NO: 391382 - RNA, 32 nt, Human
cuaaauauaauuguuuuagucuuauggcauga

SEQ ID NO: 391383 - RNA, 21 nt, Human
cuaaauauucagcugauugua

SEQ ID NO: 391384 - RNA, 32 nt, Human
cuaaauauugcucaggcugguugcaaacuccu

SEQ ID NO: 391385 - RNA, 32 nt, Human
cuaaauauuuugcugaagaagcaguuucucag

SEQ ID NO: 391386 - RNA, 32 nt, Human
cuaaaucaauuccucaaagugugcacaaaacu

SEQ ID NO: 391387 - RNA, 32 nt, Human
cuaaaucacuuugagccugggaaauaagcccc

SEQ ID NO: 391388 - RNA, 32 nt, Human
cuaaaucaggccaggaaggaggggaaaagagu

SEQ ID NO: 391389 - RNA, 32 nt, Human
cuaaaucauugcucucuauacuaggauagacu

SEQ ID NO: 391390 - RNA, 32 nt, Human
cuaaauccagcucucccuggaacuauauacca

SEQ ID NO: 391391 - RNA, 32 nt, Human
cuaaauccaguccuccccuuggaucugccuuu

SEQ ID NO: 391392 - RNA, 32 nt, Human
cuaaauccagugugagggauguucuacaagau

SEQ ID NO: 391393 - RNA, 32 nt, Human
cuaaauccucaucugucauaucaagaaaucac

SEQ ID NO: 391394 - RNA, 20 nt, Human
cuaaauccugcuucucccua

SEQ ID NO: 391395 - RNA, 32 nt, Human
cuaaaucuccaaaauaaaacuuuuuaaaauaa

SEQ ID NO: 391396 - RNA, 32 nt, Human
cuaaaucugccucacuaaggaacgagcuuguu

SEQ ID NO: 391397 - RNA, 32 nt, Human
cuaaaucugggacagggaggugacaguggaac

SEQ ID NO: 391398 - RNA, 32 nt, Human
cuaaaucugggauuuaaaaucuuuagacaaua

SEQ ID NO: 391399 - RNA, 32 nt, Human
cuaaaucugggcuggucagaaugcugcagcga

SEQ ID NO: 391400 - RNA, 32 nt, Human
cuaaaucuguggaaugcauugugaacuguaaa

SEQ ID NO: 391401 - RNA, 32 nt, Human
cuaaaucuuuuuccuuucugaauucuugcuug

SEQ ID NO: 391402 - RNA, 32 nt, Human
cuaaaugagauauuguguggcuuuuuaguaac

SEQ ID NO: 391403 - RNA, 32 nt, Human
cuaaaugagguccucagcugaaugaggaaccc

SEQ ID NO: 391404 - RNA, 32 nt, Human
cuaaaugaugccagagaaggcuugggaaauug

SEQ ID NO: 391405 - RNA, 32 nt, Human
cuaaaugcacuccccucuccccaaagaccgug

SEQ ID NO: 391406 - RNA, 32 nt, Human
cuaaaugcagaauuaauggagacuucaaugac

SEQ ID NO: 391407 - RNA, 32 nt, Human
cuaaaugcuugauuagaaaugaucucaaaacc

SEQ ID NO: 391408 - RNA, 32 nt, Human
cuaaauggagaaagcugugcagaggaaacuua

SEQ ID NO: 391409 - RNA, 32 nt, Human
cuaaauggcagggcuagccacaacggaggcuu

SEQ ID NO: 391410 - RNA, 32 nt, Human
cuaaaugggugggcggugggggagaccgacuc

SEQ ID NO: 391411 - RNA, 32 nt, Human
cuaaauggugucaggacauuucaguacuucug

SEQ ID NO: 391412 - RNA, 32 nt, Human
cuaaauguaaaacacaagacugucauuagaau

SEQ ID NO: 391413 - RNA, 32 nt, Human
cuaaauguacuacugagcuucgcugaguuaag

SEQ ID NO: 391414 - RNA, 32 nt, Human
cuaaauguaugaaaccaagcugugccugacaa

SEQ ID NO: 391415 - RNA, 32 nt, Human
cuaaauguauucacaaacagagaagcaacauu

SEQ ID NO: 391416 - RNA, 32 nt, Human
cuaaauguccccaaccucagagggaccuagag

SEQ ID NO: 391417 - RNA, 32 nt, Human
cuaaauguguaaaagaaaaaugcagagguuau

SEQ ID NO: 391418 - RNA, 32 nt, Human
cuaaauguucugauggaugccagugccaaauu

SEQ ID NO: 391419 - RNA, 20 nt, Human
cuaaauuaccaauccacuug

SEQ ID NO: 391420 - RNA, 32 nt, Human
cuaaauuagucuaccauugagugagaauaauc

SEQ ID NO: 391421 - RNA, 32 nt, Human
cuaaauuauaaauauacaaauacauauauuau

SEQ ID NO: 391422 - RNA, 32 nt, Human
cuaaauucaguagaaucuuuugugcuucagua

SEQ ID NO: 391423 - RNA, 32 nt, Human
cuaaauucauuccugaugccagaucugaucga

SEQ ID NO: 391424 - RNA, 32 nt, Human
cuaaauuccaacucuaugucuggaccuguguu

SEQ ID NO: 391425 - RNA, 32 nt, Human
cuaaauucucagcagcaguugccuccugauau

SEQ ID NO: 391426 - RNA, 32 nt, Human
cuaaauugggaucucagccugcccuaaucuuu

SEQ ID NO: 391427 - RNA, 32 nt, Human
cuaaauuguagccauaaguauuggauaguuga

SEQ ID NO: 391428 - RNA, 32 nt, Human
cuaaauuguagggagaggaauaugguaaagcc

SEQ ID NO: 391429 - RNA, 32 nt, Human
cuaaauugugccucgugugccaaagaaacaua

SEQ ID NO: 391430 - RNA, 32 nt, Human
cuaaauuuauuccagccacccuacugaaggga

SEQ ID NO: 391431 - RNA, 32 nt, Human
cuaaauuucaaaggaaauggacccugcuuuua

SEQ ID NO: 391432 - RNA, 32 nt, Human
cuaaauuuccuacuuuguaaacaucaguagug

SEQ ID NO: 391433 - RNA, 32 nt, Human
cuaaauuuuagguguuaacuguauuuaaguaa

SEQ ID NO: 391434 - RNA, 32 nt, Human
cuaacaaaaccagcaccacaucgcuagguggu

SEQ ID NO: 391435 - RNA, 17 nt, Human
cuaacaaaaugagauga

SEQ ID NO: 391436 - RNA, 32 nt, Human
cuaacaaacacagugaaaccccgucucuacua

SEQ ID NO: 391437 - RNA, 32 nt, Human
cuaacaaacagcccuucacuuccucucccacu

SEQ ID NO: 391438 - RNA, 32 nt, Human
cuaacaaagcagguguguggcagaaauauuac

SEQ ID NO: 391439 - RNA, 32 nt, Human
cuaacaaaugaagaagcaggcugcagccugca

SEQ ID NO: 391440 - RNA, 32 nt, Human
cuaacaacauugcuuccuaaacuuucaagucc

SEQ ID NO: 391441 - RNA, 32 nt, Human
cuaacaaccaaccaaccaaccaaccaaccaca

SEQ ID NO: 391442 - RNA, 32 nt, Human
cuaacaacucacugcagugcucuucauagaca

SEQ ID NO: 391443 - RNA, 32 nt, Human
cuaacaagaaagcagggggaccugccaccccc

SEQ ID NO: 391444 - RNA, 32 nt, Human
cuaacaagcaacaacaacaacaaaauaaauag

SEQ ID NO: 391445 - RNA, 18 nt, Human
cuaacaaggcagauauga

SEQ ID NO: 391446 - RNA, 20 nt, Human
cuaacaaggugaaaccccgu

SEQ ID NO: 391447 - RNA, 32 nt, Human
cuaacaauguuuacuucuaaacuuuguugaau

SEQ ID NO: 391448 - RNA, 32 nt, Human
cuaacacaacaaagugggaccaucucuauucc

SEQ ID NO: 391449 - RNA, 32 nt, Human
cuaacacaauaugccuaggauuuaacugucgg

SEQ ID NO: 391450 - RNA, 32 nt, Human
cuaacacacccagcuaauuuuguauuuuuagu

SEQ ID NO: 391451 - RNA, 20 nt, Human
cuaacacagugaaaccccgu

SEQ ID NO: 391452 - RNA, 32 nt, Human
cuaacaccacggcacuucagccugggugacag

SEQ ID NO: 391453 - RNA, 32 nt, Human
cuaacaccaguauuggcuugcaaauaacacug

SEQ ID NO: 391454 - RNA, 32 nt, Human
cuaacaccauggaucugguugugcauaggaug

SEQ ID NO: 391455 - RNA, 32 nt, Human
cuaacacccaggcuggccgccagcuggcaccu

SEQ ID NO: 391456 - RNA, 32 nt, Human
cuaacacccauguucuguaacucuccucguau

SEQ ID NO: 391457 - RNA, 32 nt, Human
cuaacacccuuaucuacaccuucaacaagcuu

SEQ ID NO: 391458 - RNA, 32 nt, Human
cuaacaccuauaauucccagcacuuugggagg

SEQ ID NO: 391459 - RNA, 32 nt, Human
cuaacaccuccuagaggccaaggcuuaaacag

SEQ ID NO: 391460 - RNA, 32 nt, Human
cuaacaccuguaaucccagcacuuugggaggc

SEQ ID NO: 391461 - RNA, 32 nt, Human
cuaacacgcgguaaaacaucaucucuacuaaa

SEQ ID NO: 391462 - RNA, 32 nt, Human
cuaacacggccaggcugggcucugggauucug

SEQ ID NO: 391463 - RNA, 21 nt, Human
cuaacacgggugaaaccccgu

SEQ ID NO: 391464 - RNA, 20 nt, Human
cuaacacggugaaaccccgu

SEQ ID NO: 391465 - RNA, 20 nt, Human
cuaacacggugaaacccguc

SEQ ID NO: 391466 - RNA, 20 nt, Human
cuaacacggugaaacccugu

SEQ ID NO: 391467 - RNA, 20 nt, Human
cuaacacggugaaaccucgu

SEQ ID NO: 391468 - RNA, 20 nt, Human
cuaacacggugaaacuccgu

SEQ ID NO: 391469 - RNA, 20 nt, Human
cuaacacggugaaaucccgu

SEQ ID NO: 391470 - RNA, 20 nt, Human
cuaacacggugagaccccgu

SEQ ID NO: 391471 - RNA, 32 nt, Human
cuaacacucguuugcugcugcugcagugugga

SEQ ID NO: 391472 - RNA, 32 nt, Human
cuaacacugcucaggagaccccugcccucuag

SEQ ID NO: 391473 - RNA, 32 nt, Human
cuaacacuucuuuccaccuucuuaugaauaau

SEQ ID NO: 391474 - RNA, 32 nt, Human
cuaacacuugaaaauucuaugcaagagcacca

SEQ ID NO: 391475 - RNA, 32 nt, Human
cuaacacuugccuccccacugcagccugcggu

SEQ ID NO: 391476 - RNA, 32 nt, Human
cuaacacuuuugcucugcaggcagccuugccc

SEQ ID NO: 391477 - RNA, 32 nt, Human
cuaacagaaaucucagauuucucucuaagcga

SEQ ID NO: 391478 - RNA, 32 nt, Human
cuaacagaagcuuauacacauaugcaugggcu

SEQ ID NO: 391479 - RNA, 32 nt, Human
cuaacagaggcagcagcaguccuucggcuuca

SEQ ID NO: 391480 - RNA, 32 nt, Human
cuaacagaucaccauccaucuucaagaagcua

SEQ ID NO: 391481 - RNA, 17 nt, Human
cuaacagaucagcaaga

SEQ ID NO: 391482 - RNA, 32 nt, Human
cuaacagauucugcuuuaugcucugacaacua

SEQ ID NO: 391483 - RNA, 32 nt, Human
cuaacagcugugggaaggagcuacccacuucc

SEQ ID NO: 391484 - RNA, 32 nt, Human
cuaacagcuuuuccaguuguuagaugacuuug

SEQ ID NO: 391485 - RNA, 32 nt, Human
cuaacaggagaaaggacaaccaggaugaggau

SEQ ID NO: 391486 - RNA, 32 nt, Human
cuaacaggauuagacagucaaggaguggcuua

SEQ ID NO: 391487 - RNA, 32 nt, Human
cuaacaggcucaauauuccugaaugaaauauc

SEQ ID NO: 391488 - RNA, 32 nt, Human
cuaacaggcugcagaauggcaggaaggacucg

SEQ ID NO: 391489 - RNA, 32 nt, Human
cuaacagggcggcuucccagggcugcaggcgg

SEQ ID NO: 391490 - RNA, 20 nt, Human
cuaacagggugaaaccccgu

SEQ ID NO: 391491 - RNA, 20 nt, Human
cuaacagggugaaacccugu

SEQ ID NO: 391492 - RNA, 32 nt, Human
cuaacaguacccacccaaaaggaaaaucuuac

SEQ ID NO: 391493 - RNA, 32 nt, Human
cuaacaguacugagcuauuugucugucaaaau

SEQ ID NO: 391494 - RNA, 32 nt, Human
cuaacagucagaggucaguaucucagcgugug

SEQ ID NO: 391495 - RNA, 32 nt, Human
cuaacagugccucacaaggcuugggggcugga

SEQ ID NO: 391496 - RNA, 32 nt, Human
cuaacauaauccaacuccucagagccagagug

SEQ ID NO: 391497 - RNA, 32 nt, Human
cuaacauacaaaauuagcugggcacaguggca

SEQ ID NO: 391498 - RNA, 20 nt, Human
cuaacauagugaaacccugu

SEQ ID NO: 391499 - RNA, 32 nt, Human
cuaacauauccauuaaaaguaucaacuggcca

SEQ ID NO: 391500 - RNA, 32 nt, Human
cuaacauccagaaucucauaccacagacuggu

SEQ ID NO: 391501 - RNA, 32 nt, Human
cuaacauccuacucuggaaacugaucucggag

SEQ ID NO: 391502 - RNA, 32 nt, Human
cuaacaucucuagugaucccuuugucaguggu

SEQ ID NO: 391503 - RNA, 32 nt, Human
cuaacaucugaauagaugcagaaaagucacag

SEQ ID NO: 391504 - RNA, 32 nt, Human
cuaacaucuuuguccaggucccagugcccucu

SEQ ID NO: 391505 - RNA, 32 nt, Human
cuaacaugcccuguucagcuacucccacuccc

SEQ ID NO: 391506 - RNA, 32 nt, Human
cuaacauggaauccagucugugcaguguuuuu

SEQ ID NO: 391507 - RNA, 20 nt, Human
cuaacauggcgaaaccccgu

SEQ ID NO: 391508 - RNA, 20 nt, Human
cuaacaugguaaaaccccgu

SEQ ID NO: 391509 - RNA, 32 nt, Human
cuaacauggugaaaccccaugucuacuaaaaa

SEQ ID NO: 391510 - RNA, 19 nt, Human
cuaacauggugaaaccccg

SEQ ID NO: 391511 - RNA, 20 nt, Human
cuaacauggugaaaccccgu

SEQ ID NO: 391512 - RNA, 20 nt, Human
cuaacauggugaaacccugu

SEQ ID NO: 391513 - RNA, 32 nt, Human
cuaacauggugaaauccuaucucuaccaaaaa

SEQ ID NO: 391514 - RNA, 31 nt, Human
cuaacauucaauaaauagcuauaugaaauca

SEQ ID NO: 391515 - RNA, 32 nt, Human
cuaacauuccaucuucugaaauucugagauuc

SEQ ID NO: 391516 - RNA, 32 nt, Human
cuaacauugaagucuuccagaaaccucgagga

SEQ ID NO: 391517 - RNA, 32 nt, Human
cuaacauuuccacuucuaagcaucaggcuccg

SEQ ID NO: 391518 - RNA, 32 nt, Human
cuaacauuuggaaacauuuagagaacaaacaa

SEQ ID NO: 391519 - RNA, 19 nt, Human
cuaaccaaacaagcugcaa

SEQ ID NO: 391520 - RNA, 32 nt, Human
cuaaccaacauggagaaacccugucucuacua

SEQ ID NO: 391521 - RNA, 32 nt, Human
cuaaccaacauggugaaaccccgucucuacaa

SEQ ID NO: 391522 - RNA, 32 nt, Human
cuaaccaaccuccaccuccuccuuccauuuug

SEQ ID NO: 391523 - RNA, 32 nt, Human
cuaaccacauguggcuguuaagcccuugaaau

SEQ ID NO: 391524 - RNA, 32 nt, Human
cuaaccacuuccuccuccacccgaccaucacc

SEQ ID NO: 391525 - RNA, 32 nt, Human
cuaaccagccacugcagcccuccagcucuggc

SEQ ID NO: 391526 - RNA, 32 nt, Human
cuaaccagccaucauaucauauccuaucaggc

SEQ ID NO: 391527 - RNA, 32 nt, Human
cuaaccagcuguucagaaccuucuguuuuuac

SEQ ID NO: 391528 - RNA, 32 nt, Human
cuaaccaggaauaaaggcaagacagccuggaa

SEQ ID NO: 391529 - RNA, 32 nt, Human
cuaaccaggaggcugaggcaggagaaucacuu

SEQ ID NO: 391530 - RNA, 32 nt, Human
cuaaccaggcuggagugcaguggugggaucuc

SEQ ID NO: 391531 - RNA, 32 nt, Human
cuaaccaguaagguuauaacuguggcuaauuc

SEQ ID NO: 391532 - RNA, 32 nt, Human
cuaaccaucugacagagacucggccuggacac

SEQ ID NO: 391533 - RNA, 32 nt, Human
cuaaccaugaggaaauaaucagacaaauccac

SEQ ID NO: 391534 - RNA, 32 nt, Human
cuaaccaugcccugugaagauggucuucgggg

SEQ ID NO: 391535 - RNA, 32 nt, Human
cuaacccacaggaucauuuggaaccuugaaua

SEQ ID NO: 391536 - RNA, 32 nt, Human
cuaacccaccugccagcuacaguucugagcau

SEQ ID NO: 391537 - RNA, 32 nt, Human
cuaacccacucccagcucccagccuggcauga

SEQ ID NO: 391538 - RNA, 32 nt, Human
cuaacccacugcuuuuccccagcucucugccu

SEQ ID NO: 391539 - RNA, 32 nt, Human
cuaacccagaagcagcucugggcugccaggau

SEQ ID NO: 391540 - RNA, 32 nt, Human
cuaacccagcaacccucagcauacaaguggga

SEQ ID NO: 391541 - RNA, 32 nt, Human
cuaacccuccagcccugguccccagccccugc

SEQ ID NO: 391542 - RNA, 32 nt, Human
cuaacccuggagagcccaggagcgggcgggac

SEQ ID NO: 391543 - RNA, 32 nt, Human
cuaaccgggcuccagccccagacccucuagcu

SEQ ID NO: 391544 - RNA, 32 nt, Human
cuaaccuacuauuggcugaaggaaggagaaaa

SEQ ID NO: 391545 - RNA, 32 nt, Human
cuaaccuagaagcaagaaauucagggccaaga

SEQ ID NO: 391546 - RNA, 32 nt, Human
cuaaccucaacugauccaccugccucagccuc

SEQ ID NO: 391547 - RNA, 32 nt, Human
cuaaccucaggugauccgcccaccucggccuc

SEQ ID NO: 391548 - RNA, 32 nt, Human
cuaaccuccgucccagccuccuggcucaccac

SEQ ID NO: 391549 - RNA, 32 nt, Human
cuaaccucgggugauccacccaccucagccuu

SEQ ID NO: 391550 - RNA, 32 nt, Human
cuaaccucuugaucugcccuccuuggccuccc

SEQ ID NO: 391551 - RNA, 21 nt, Human
cuaaccucuuuccuuacuccu

SEQ ID NO: 391552 - RNA, 32 nt, Human
cuaaccugaccagccgcucaggacaggacccu

SEQ ID NO: 391553 - RNA, 32 nt, Human
cuaaccugaggccaacaugucccacugccccu

SEQ ID NO: 391554 - RNA, 32 nt, Human
cuaaccugcaucccauuuccagccucuuuuca

SEQ ID NO: 391555 - RNA, 32 nt, Human
cuaaccugccucucccuguacacuggcuaccc

SEQ ID NO: 391556 - RNA, 32 nt, Human
cuaaccugcggggaaggucucuccuggacacg

SEQ ID NO: 391557 - RNA, 32 nt, Human
cuaaccugcugucccuucccagccuuugagga

SEQ ID NO: 391558 - RNA, 32 nt, Human
cuaaccugcuugguggacuuggaaaagacuug

SEQ ID NO: 391559 - RNA, 32 nt, Human
cuaaccugggagacggaagaagcacgccaugg

SEQ ID NO: 391560 - RNA, 32 nt, Human
cuaaccuguaaucccagcuacuugggaggcug

SEQ ID NO: 391561 - RNA, 32 nt, Human
cuaaccuguagcuucagaggccagucugggcc

SEQ ID NO: 391562 - RNA, 32 nt, Human
cuaaccuguccagccagagcaugcgucucagc

SEQ ID NO: 391563 - RNA, 32 nt, Human
cuaaccuguuguccuccacauucuauuguccu

SEQ ID NO: 391564 - RNA, 32 nt, Human
cuaaccuugacagaaucaucaccagagacacc

SEQ ID NO: 391565 - RNA, 32 nt, Human
cuaaccuugggaaucuugcagguuauacuuaa

SEQ ID NO: 391566 - RNA, 25 nt, Human
cuaaccuugugauccgcccuccuua

SEQ ID NO: 391567 - RNA, 32 nt, Human
cuaacgagaucugaugguuuuauaggggcuuc

SEQ ID NO: 391568 - RNA, 32 nt, Human
cuaacgccuguaaucccagaacuuugggaagc

SEQ ID NO: 391569 - RNA, 32 nt, Human
cuaacgccuguaaucccagcacuugggaggcc

SEQ ID NO: 391570 - RNA, 32 nt, Human
cuaacgccuguaaucccagcacuuugagaugc

SEQ ID NO: 391571 - RNA, 32 nt, Human
cuaacgcgaggugaaugguauuaauaacagug

SEQ ID NO: 391572 - RNA, 32 nt, Human
cuaacgcucccuggcccggccggggccgcgca

SEQ ID NO: 391573 - RNA, 32 nt, Human
cuaacgcucucagugcaguugccuccuuugaa

SEQ ID NO: 391574 - RNA, 32 nt, Human
cuaacgcuuguaaucccagcgcuuugggaggc

SEQ ID NO: 391575 - RNA, 32 nt, Human
cuaacggaacuaucaucuguguuuguauugga

SEQ ID NO: 391576 - RNA, 32 nt, Human
cuaacggccagugaguuggagucucagggcag

SEQ ID NO: 391577 - RNA, 32 nt, Human
cuaacgggcccaggucacacagcagaacagug

SEQ ID NO: 391578 - RNA, 32 nt, Human
cuaacggucgcugaguguccugcucucauacg

SEQ ID NO: 391579 - RNA, 20 nt, Human
cuaacguggugaaaccccgu

SEQ ID NO: 391580 - RNA, 20 nt, Human
cuaacguggugaaacccugu

SEQ ID NO: 391581 - RNA, 32 nt, Human
cuaacuaagggcuauucauucugccauuuuua

SEQ ID NO: 391582 - RNA, 32 nt, Human
cuaacuagccugacacaagcaggugccacuau

SEQ ID NO: 391583 - RNA, 32 nt, Human
cuaacuagcuuggaaacuggaugaggucauag

SEQ ID NO: 391584 - RNA, 32 nt, Human
cuaacuaggcuucuuaauuguuuucucaucca

SEQ ID NO: 391585 - RNA, 32 nt, Human
cuaacuaucaaauuguguuuaguaacuugagu

SEQ ID NO: 391586 - RNA, 32 nt, Human
cuaacuauccccucagcuccgugugccauaag

SEQ ID NO: 391587 - RNA, 32 nt, Human
cuaacucaaacacucaucagaaauuaagugca

SEQ ID NO: 391588 - RNA, 32 nt, Human
cuaacucaacauacaggaauucaugcuggaga

SEQ ID NO: 391589 - RNA, 32 nt, Human
cuaacucagcacacacugccagucuuccccaa

SEQ ID NO: 391590 - RNA, 32 nt, Human
cuaacucagcacuucagaagccuuuuugaguu

SEQ ID NO: 391591 - RNA, 32 nt, Human
cuaacucaggcagaguaguuggcgaaggcccc

SEQ ID NO: 391592 - RNA, 32 nt, Human
cuaacuccccaccccaacaucucccucccaca

SEQ ID NO: 391593 - RNA, 32 nt, Human
cuaacuccuagacacacacagagcacugcugc

SEQ ID NO: 391594 - RNA, 32 nt, Human
cuaacuccuccuggggccugggcaguuuugau

SEQ ID NO: 391595 - RNA, 32 nt, Human
cuaacuccuuuccauuccccugggugucucau

SEQ ID NO: 391596 - RNA, 32 nt, Human
cuaacucgucuggccuuugagcucuuugcuga

SEQ ID NO: 391597 - RNA, 32 nt, Human
cuaacucuccccuuuccuucuuauggccaccc

SEQ ID NO: 391598 - RNA, 32 nt, Human
cuaacucugcagauggggcuaggacugugggc

SEQ ID NO: 391599 - RNA, 32 nt, Human
cuaacucugcccacccuccuguaccgucgaca

SEQ ID NO: 391600 - RNA, 32 nt, Human
cuaacucuucuuucauuucuucuacaacucau

SEQ ID NO: 391601 - RNA, 32 nt, Human
cuaacucuuuauuccuuagacuugaugaugca

SEQ ID NO: 391602 - RNA, 32 nt, Human
cuaacugcaacuuccaccuccuggguucaagc

SEQ ID NO: 391603 - RNA, 32 nt, Human
cuaacugcuuccugaaagcuggaaaaggagaa

SEQ ID NO: 391604 - RNA, 32 nt, Human
cuaacuggcccaggcacuggaguggaauagaa

SEQ ID NO: 391605 - RNA, 32 nt, Human
cuaacugggaggcugaggcaggaggaucacuu

SEQ ID NO: 391606 - RNA, 32 nt, Human
cuaacugggcggagguggaggugcagggucaa

SEQ ID NO: 391607 - RNA, 32 nt, Human
cuaacugggcugggccucuuuccugugguuca

SEQ ID NO: 391608 - RNA, 32 nt, Human
cuaacugggucaaguccuccuagcucugaagc

SEQ ID NO: 391609 - RNA, 32 nt, Human
cuaacugguguuauuuuguauguacccugugc

SEQ ID NO: 391610 - RNA, 32 nt, Human
cuaacuguaggaucuuccacacccuaaggcuu

SEQ ID NO: 391611 - RNA, 32 nt, Human
cuaacugucaagacaaacacaaaggcccagag

SEQ ID NO: 391612 - RNA, 32 nt, Human
cuaacugucccuaacacagcaugugggaaugc

SEQ ID NO: 391613 - RNA, 32 nt, Human
cuaacuguggugagagcaacaggccuccaaag

SEQ ID NO: 391614 - RNA, 32 nt, Human
cuaacuguucccagacagcagagcaaguauuc

SEQ ID NO: 391615 - RNA, 32 nt, Human
cuaacuguugccacucuccuccccagacuaug

SEQ ID NO: 391616 - RNA, 32 nt, Human
cuaacuuagagucugcagcccagagccacaug

SEQ ID NO: 391617 - RNA, 19 nt, Human
cuaacuucagagacaggga

SEQ ID NO: 391618 - RNA, 32 nt, Human
cuaacuuccacuuucgugucaccacuguaauu

SEQ ID NO: 391619 - RNA, 32 nt, Human
cuaacuucccaggugacaguagcaggaacaag

SEQ ID NO: 391620 - RNA, 32 nt, Human
cuaacuucuaaaccagccaaucaauaacauaa

SEQ ID NO: 391621 - RNA, 32 nt, Human
cuaacuucucucuuacucauguacuuacauuc

SEQ ID NO: 391622 - RNA, 32 nt, Human
cuaacuucuuuauccucuucucccagaggcuu

SEQ ID NO: 391623 - RNA, 32 nt, Human
cuaacuugcuucugccgaggacucauuaggaa

SEQ ID NO: 391624 - RNA, 32 nt, Human
cuaacuuggaauaaauauuuugcaucaguaaa

SEQ ID NO: 391625 - RNA, 20 nt, Human
cuaacuuggugaaacccugu

SEQ ID NO: 391626 - RNA, 32 nt, Human
cuaacuuucucccagggaucuaacuggcuagu

SEQ ID NO: 391627 - RNA, 32 nt, Human
cuaacuuuugagauagauuuggcucuaguaag

SEQ ID NO: 391628 - RNA, 32 nt, Human
cuaagaaaaacacagcagcaaacacaggaaau

SEQ ID NO: 391629 - RNA, 32 nt, Human
cuaagaaacaccauuugaugcaccuuagagaa

SEQ ID NO: 391630 - RNA, 32 nt, Human
cuaagaaacuaaaggcaagccagcaagugucu

SEQ ID NO: 391631 - RNA, 32 nt, Human
cuaagaaaucauaugaccaauauuucacuuau

SEQ ID NO: 391632 - RNA, 32 nt, Human
cuaagaaauguccucuuuuggagacucuuccu

SEQ ID NO: 391633 - RNA, 32 nt, Human
cuaagaaccugcaagguggaagugaccuguuc

SEQ ID NO: 391634 - RNA, 32 nt, Human
cuaagaagaaguaagaaagaaaaagccuguug

SEQ ID NO: 391635 - RNA, 32 nt, Human
cuaagaagcagagccaaguccacccauguccu

SEQ ID NO: 391636 - RNA, 32 nt, Human
cuaagaagccaucaacuggccuaaagaaagag

SEQ ID NO: 391637 - RNA, 32 nt, Human
cuaagaagccuccuggggguuugagcgaaucg

SEQ ID NO: 391638 - RNA, 32 nt, Human
cuaagaaggaaggggagcgugucugcuuccug

SEQ ID NO: 391639 - RNA, 32 nt, Human
cuaagaaggccgagaggguggaggccgagaag

SEQ ID NO: 391640 - RNA, 32 nt, Human
cuaagaagggaagagaaagccgggaggcaagu

SEQ ID NO: 391641 - RNA, 32 nt, Human
cuaagaagggaauccuuccuccaucccuuuga

SEQ ID NO: 391642 - RNA, 32 nt, Human
cuaagaauacaaaauuagcugggcaugguggu

SEQ ID NO: 391643 - RNA, 32 nt, Human
cuaagaauaucaaguauuucucuggcucuuga

SEQ ID NO: 391644 - RNA, 32 nt, Human
cuaagaauggugcuacauaagcguugcuguua

SEQ ID NO: 391645 - RNA, 32 nt, Human
cuaagaauuucaggauuauuguauuuacguuc

SEQ ID NO: 391646 - RNA, 32 nt, Human
cuaagacaagcaucuccugcccucucuccuuc

SEQ ID NO: 391647 - RNA, 32 nt, Human
cuaagacacaaacacauuagccuagguacaca

SEQ ID NO: 391648 - RNA, 32 nt, Human
cuaagacacagaaggcagacugggugaggaga

SEQ ID NO: 391649 - RNA, 32 nt, Human
cuaagacaccgggaccuccuggaagccaaaaa

SEQ ID NO: 391650 - RNA, 32 nt, Human
cuaagacccuucugugguagucggugagggag

SEQ ID NO: 391651 - RNA, 32 nt, Human
cuaagaccuccccuucucucuuacuccugcuc

SEQ ID NO: 391652 - RNA, 32 nt, Human
cuaagaccugcuggaaugucaccagaauagaa

SEQ ID NO: 391653 - RNA, 32 nt, Human
cuaagacugaguaaacuucuuauuuuuagaaa

SEQ ID NO: 391654 - RNA, 32 nt, Human
cuaagacuuccuucucagcuucucccauaaag

SEQ ID NO: 391655 - RNA, 32 nt, Human
cuaagagaaaaauaacuuuguugccaaaaggu

SEQ ID NO: 391656 - RNA, 32 nt, Human
cuaagagacaacaggcugccugacucuccaga

SEQ ID NO: 391657 - RNA, 32 nt, Human
cuaagagacagagauuaaaauggcuuccagag

SEQ ID NO: 391658 - RNA, 32 nt, Human
cuaagagagcaauggaaaauauguagcugcuu

SEQ ID NO: 391659 - RNA, 32 nt, Human
cuaagagauccugaaaccucugucauggaaaa

SEQ ID NO: 391660 - RNA, 32 nt, Human
cuaagagcaaacuugaagguauggauaaggcc

SEQ ID NO: 391661 - RNA, 32 nt, Human
cuaagagcaaagcauccucugcacaaaagaaa

SEQ ID NO: 391662 - RNA, 32 nt, Human
cuaagagccacaccuggugaauacucaguaaa

SEQ ID NO: 391663 - RNA, 32 nt, Human
cuaagagccccagcugcagacaggccucuggc

SEQ ID NO: 391664 - RNA, 32 nt, Human
cuaagagcccucaauugccugccuguauuaau

SEQ ID NO: 391665 - RNA, 32 nt, Human
cuaagagcugagagacagccggcagggaaucg

SEQ ID NO: 391666 - RNA, 32 nt, Human
cuaagaggaauuuuuagaugucaguuuggagg

SEQ ID NO: 391667 - RNA, 32 nt, Human
cuaagaggcaaaagagaaaagacucaagaaac

SEQ ID NO: 391668 - RNA, 32 nt, Human
cuaagagggggaggaaaggcuguucugugucu

SEQ ID NO: 391669 - RNA, 32 nt, Human
cuaagagggggcagaaaugaaugaccagguua

SEQ ID NO: 391670 - RNA, 32 nt, Human
cuaagaguaaagcaacucaaguuauaggaaag

SEQ ID NO: 391671 - RNA, 32 nt, Human
cuaagaguucuaaaggaagguaggcaucuguu

SEQ ID NO: 391672 - RNA, 32 nt, Human
cuaagaguuuaguugcuaccucagguccacag

SEQ ID NO: 391673 - RNA, 32 nt, Human
cuaagaguuugagaccagccugggcaacaugg

SEQ ID NO: 391674 - RNA, 32 nt, Human
cuaagauccuaccuuaguuuaccucucagugu

SEQ ID NO: 391675 - RNA, 32 nt, Human
cuaagaucggaagaugagugagcuugaccagu

SEQ ID NO: 391676 - RNA, 31 nt, Human
cuaagaugccucucuccagcccugucucaac

SEQ ID NO: 391677 - RNA, 32 nt, Human
cuaagauggguggaucacuugaggucaggagu

SEQ ID NO: 391678 - RNA, 22 nt, Human
cuaagauuacaggcgugagcca

SEQ ID NO: 391679 - RNA, 32 nt, Human
cuaagauucuuaagaacuggauccucgugauu

SEQ ID NO: 391680 - RNA, 32 nt, Human
cuaagauuguguuggucgcucucugaagcaga

SEQ ID NO: 391681 - RNA, 32 nt, Human
cuaagcaaaugagaguccaggaggcuggaucc

SEQ ID NO: 391682 - RNA, 27 nt, Human
cuaagcaacagcacugagauccggggc

SEQ ID NO: 391683 - RNA, 32 nt, Human
cuaagcaacauagugaaaccccaucuccaaaa

SEQ ID NO: 391684 - RNA, 32 nt, Human
cuaagcaagggagggguguuggagagccagug

SEQ ID NO: 391685 - RNA, 21 nt, Human
cuaagcaaucacgugcacaca

SEQ ID NO: 391686 - RNA, 32 nt, Human
cuaagcaaugccugcauugccugcuaugugca

SEQ ID NO: 391687 - RNA, 32 nt, Human
cuaagcacaggcagcacuucgaggcuucguga

SEQ ID NO: 391688 - RNA, 32 nt, Human
cuaagcaccauuuaaagccacuggaaauuugu

SEQ ID NO: 391689 - RNA, 32 nt, Human
cuaagcaccuguuccuggccaggcucuaggcc

SEQ ID NO: 391690 - RNA, 32 nt, Human
cuaagcaccuuauuuuauuuuugaggcagagu

SEQ ID NO: 391691 - RNA, 32 nt, Human
cuaagcacugccacuggggaaaacuccaccuu

SEQ ID NO: 391692 - RNA, 32 nt, Human
cuaagcagccucuuuguuccagaagcugcccu

SEQ ID NO: 391693 - RNA, 32 nt, Human
cuaagcaggggaggggacaggacagaaagccu

SEQ ID NO: 391694 - RNA, 32 nt, Human
cuaagcaggggcugacaggguggcaggugacu

SEQ ID NO: 391695 - RNA, 32 nt, Human
cuaagcagugcuguccuuuuguucucuccauu

SEQ ID NO: 391696 - RNA, 32 nt, Human
cuaagcaguuucaucagcauuacuugggaaaa

SEQ ID NO: 391697 - RNA, 32 nt, Human
cuaagcaucccagcugucuccucuuuucuauu

SEQ ID NO: 391698 - RNA, 32 nt, Human
cuaagcaucuaaguuauaagacucucacacuc

SEQ ID NO: 391699 - RNA, 32 nt, Human
cuaagcaugguagcucucgccuguaaucccag

SEQ ID NO: 391700 - RNA, 32 nt, Human
cuaagcauuuacacaucaaaauacugcacaca

SEQ ID NO: 391701 - RNA, 32 nt, Human
cuaagccaaccuccucucacagccucuguauc

SEQ ID NO: 391702 - RNA, 32 nt, Human
cuaagccaacuuguuaaaccucuucacggcug

SEQ ID NO: 391703 - RNA, 32 nt, Human
cuaagccagaugggauaguggaggagcgcugg

SEQ ID NO: 391704 - RNA, 32 nt, Human
cuaagccagcacugcugcucccuggagcccgg

SEQ ID NO: 391705 - RNA, 32 nt, Human
cuaagccagguaaaccaggagacacagaagac

SEQ ID NO: 391706 - RNA, 32 nt, Human
cuaagccagguggggcaacagcgguggcaggg

SEQ ID NO: 391707 - RNA, 32 nt, Human
cuaagcccaaagauuaacuagagucccuccaa

SEQ ID NO: 391708 - RNA, 32 nt, Human
cuaagcccaggaggccaagucugcagugagcu

SEQ ID NO: 391709 - RNA, 32 nt, Human
cuaagccccaggaggucgaggcugcagugagc

SEQ ID NO: 391710 - RNA, 32 nt, Human
cuaagcccgggagguggagguugcagugagcc

SEQ ID NO: 391711 - RNA, 18 nt, Human
cuaagcccuagguuucuu

SEQ ID NO: 391712 - RNA, 32 nt, Human
cuaagcccugcguacauucacaugcacacaug

SEQ ID NO: 391713 - RNA, 32 nt, Human
cuaagccuuccugguggguguggagagggagg

SEQ ID NO: 391714 - RNA, 32 nt, Human
cuaagccuugugacccaucaggccagugagug

SEQ ID NO: 391715 - RNA, 32 nt, Human
cuaagcgccauggacgaaggcacuggacugca

SEQ ID NO: 391716 - RNA, 32 nt, Human
cuaagcgccgguacccugggcccacugcuguu

SEQ ID NO: 391717 - RNA, 26 nt, Human
cuaagcggggagaugcggacauccua

SEQ ID NO: 391718 - RNA, 32 nt, Human
cuaagcuaacacagcaaguugguggcagaccu

SEQ ID NO: 391719 - RNA, 32 nt, Human
cuaagcuacaaaccauucuccaaaggaaaaga

SEQ ID NO: 391720 - RNA, 32 nt, Human
cuaagcuagcacacagcacuugggccagcaaa

SEQ ID NO: 391721 - RNA, 32 nt, Human
cuaagcuagcauugaagagagggauaaaauuc

SEQ ID NO: 391722 - RNA, 32 nt, Human
cuaagcuaggucuaggucuacacuccuaggac

SEQ ID NO: 391723 - RNA, 32 nt, Human
cuaagcuauuugggaaaguucuccccaccgcc

SEQ ID NO: 391724 - RNA, 32 nt, Human
cuaagcucaagugauccucccaccucagccuc

SEQ ID NO: 391725 - RNA, 32 nt, Human
cuaagcuccuccuuuacuuccucucuccucuu

SEQ ID NO: 391726 - RNA, 32 nt, Human
cuaagcucuaguguccccaucuguaaaauggg

SEQ ID NO: 391727 - RNA, 32 nt, Human
cuaagcucucacccgcucugcagccaccuggc

SEQ ID NO: 391728 - RNA, 32 nt, Human
cuaagcugagaagggagagcgagcuuaggacc

SEQ ID NO: 391729 - RNA, 32 nt, Human
cuaagcugagcagugcagugugaacagggccc

SEQ ID NO: 391730 - RNA, 32 nt, Human
cuaagcugcuccaaccuccuuuuugucuuuug

SEQ ID NO: 391731 - RNA, 32 nt, Human
cuaagcugcugacaucauccacugccuucugc

SEQ ID NO: 391732 - RNA, 32 nt, Human
cuaagcuuaaguagacuauacaguuguaugaa

SEQ ID NO: 391733 - RNA, 32 nt, Human
cuaaggaaagaguugauccuuaugagggagau

SEQ ID NO: 391734 - RNA, 32 nt, Human
cuaaggaaauacuuauaccaaaaauagaggug

SEQ ID NO: 391735 - RNA, 32 nt, Human
cuaaggaacaccuucaaauaaagcuuagacac

SEQ ID NO: 391736 - RNA, 32 nt, Human
cuaaggaauuuuuaucaccaaaaugaauguua

SEQ ID NO: 391737 - RNA, 32 nt, Human
cuaaggaccugcgagcuggagcucuucucggg

SEQ ID NO: 391738 - RNA, 32 nt, Human
cuaaggacucaaauccaaaagcaugagcaaca

SEQ ID NO: 391739 - RNA, 32 nt, Human
cuaaggacucaaauccagaagcaugagcaaca

SEQ ID NO: 391740 - RNA, 32 nt, Human
cuaaggacuccuggucacuggguaggguggcu

SEQ ID NO: 391741 - RNA, 32 nt, Human
cuaaggagaagcagcaggaaugaugcuuugau

SEQ ID NO: 391742 - RNA, 32 nt, Human
cuaaggagaggagagauuaugucauaugcaac

SEQ ID NO: 391743 - RNA, 32 nt, Human
cuaaggagaugggaauaaagaggccagagagc

SEQ ID NO: 391744 - RNA, 32 nt, Human
cuaaggagcacuagaaugagaaaucauguugu

SEQ ID NO: 391745 - RNA, 32 nt, Human
cuaaggaggaagaggaaggcagcccuggagug

SEQ ID NO: 391746 - RNA, 32 nt, Human
cuaaggagguaggaaguauggggaggguuaga

SEQ ID NO: 391747 - RNA, 18 nt, Human
cuaaggaguccccaggag

SEQ ID NO: 391748 - RNA, 32 nt, Human
cuaaggagugaugagguuagaggaucacuucu

SEQ ID NO: 391749 - RNA, 32 nt, Human
cuaaggauacuugacuuagaacucagucauuc

SEQ ID NO: 391750 - RNA, 32 nt, Human
cuaaggaucucucaggagcacaggcagcugga

SEQ ID NO: 391751 - RNA, 32 nt, Human
cuaaggaugaaagcaaaggagggccuugagga

SEQ ID NO: 391752 - RNA, 32 nt, Human
cuaaggauggcugauuccccaagggcacccgc

SEQ ID NO: 391753 - RNA, 32 nt, Human
cuaaggcaccgagcccaaaaggccccaggcac

SEQ ID NO: 391754 - RNA, 32 nt, Human
cuaaggcaggcagaucaccugaggucaggagu

SEQ ID NO: 391755 - RNA, 24 nt, Human
cuaaggcaggcagaucacuugaga

SEQ ID NO: 391756 - RNA, 32 nt, Human
cuaaggcaggcagaucauuugaggucaggagu

SEQ ID NO: 391757 - RNA, 32 nt, Human
cuaaggcaggcggaucacuugaggucaggagu

SEQ ID NO: 391758 - RNA, 32 nt, Human
cuaaggcaggcugaucacuugaggucaggaau

SEQ ID NO: 391759 - RNA, 32 nt, Human
cuaaggcagugucuuuaaugggcaccagcacg

SEQ ID NO: 391760 - RNA, 32 nt, Human
cuaaggcaucucuacucccuccagaggagccg

SEQ ID NO: 391761 - RNA, 32 nt, Human
cuaaggccacugcuuccugcuuugugaagccu

SEQ ID NO: 391762 - RNA, 32 nt, Human
cuaaggcccgagcgccuggugcugagugcacc

SEQ ID NO: 391763 - RNA, 32 nt, Human
cuaaggccgggaguucaagaccagccugacca

SEQ ID NO: 391764 - RNA, 32 nt, Human
cuaaggccuccgcuucccuccugaggucucau

SEQ ID NO: 391765 - RNA, 32 nt, Human
cuaaggcggguggaucaccugaggccaggagu

SEQ ID NO: 391766 - RNA, 32 nt, Human
cuaaggcguucuguuacagcagcacaaaggaa

SEQ ID NO: 391767 - RNA, 32 nt, Human
cuaaggcucggccuccccuacuggccugguug

SEQ ID NO: 391768 - RNA, 32 nt, Human
cuaaggcucuuuuugcuuucauggcccugucc

SEQ ID NO: 391769 - RNA, 32 nt, Human
cuaaggcugaggcacggagaagaaaaggaauc

SEQ ID NO: 391770 - RNA, 31 nt, Human
cuaaggcuuguguccaucaacagaugaaugg

SEQ ID NO: 391771 - RNA, 32 nt, Human
cuaagggaacaguuagagcagagaugaagaaa

SEQ ID NO: 391772 - RNA, 32 nt, Human
cuaagggacccccauccuagggaucuugucag

SEQ ID NO: 391773 - RNA, 32 nt, Human
cuaagggagauggggcugaggacagcucaaaa

SEQ ID NO: 391774 - RNA, 32 nt, Human
cuaagggauuugaucugcucaucuucaguuga

SEQ ID NO: 391775 - RNA, 32 nt, Human
cuaagggcacggcaggaaggaggugucguccu

SEQ ID NO: 391776 - RNA, 32 nt, Human
cuaaggggagacuucaggggaggaucaagcuu

SEQ ID NO: 391777 - RNA, 32 nt, Human
cuaaggggcagaacagucuuuuuggguaaggg

SEQ ID NO: 391778 - RNA, 32 nt, Human
cuaagggggcucagcagacucugguugacugu

SEQ ID NO: 391779 - RNA, 32 nt, Human
cuaagggguccccaaagaacuaaagagucagc

SEQ ID NO: 391780 - RNA, 32 nt, Human
cuaagggguggggugaggggauggagagggag

SEQ ID NO: 391781 - RNA, 32 nt, Human
cuaaggguaagggagagggagggagccgggag

SEQ ID NO: 391782 - RNA, 32 nt, Human
cuaaggguaugaaggaccuguauuggggucga

SEQ ID NO: 391783 - RNA, 32 nt, Human
cuaagggucaacucaguuucucagccauggac

SEQ ID NO: 391784 - RNA, 32 nt, Human
cuaagggucccaccccucaccccacccccacc

SEQ ID NO: 391785 - RNA, 32 nt, Human
cuaagggugugaaccucaccuccuggggcuuc

SEQ ID NO: 391786 - RNA, 32 nt, Human
cuaagguacagagaggucaaguaacuugccca

SEQ ID NO: 391787 - RNA, 32 nt, Human
cuaagguacuaauuuguagcugcucugaagua

SEQ ID NO: 391788 - RNA, 32 nt, Human
cuaagguagaggccucacagcccuugaguaaa

SEQ ID NO: 391789 - RNA, 32 nt, Human
cuaagguagcagugccuguguguuggagcuca

SEQ ID NO: 391790 - RNA, 32 nt, Human
cuaagguagggaggaggaagaugcccccaauu

SEQ ID NO: 391791 - RNA, 32 nt, Human
cuaaggucaaaguucaaacgcacuccacacgg

SEQ ID NO: 391792 - RNA, 32 nt, Human
cuaaggucacccaagcagugguuggauuuuau

SEQ ID NO: 391793 - RNA, 32 nt, Human
cuaaggucacccagcuguuugguaauaguguu

SEQ ID NO: 391794 - RNA, 32 nt, Human
cuaaggucagcuguuaccucagcugggccugg

SEQ ID NO: 391795 - RNA, 32 nt, Human
cuaaggucaggaguucaagaccagccuggcca

SEQ ID NO: 391796 - RNA, 32 nt, Human
cuaaggucaggaguucaagaccagccugguca

SEQ ID NO: 391797 - RNA, 32 nt, Human
cuaaggucaggaguucaagaccagcuuggcca

SEQ ID NO: 391798 - RNA, 32 nt, Human
cuaaggucaggaguuccagaccagccugguca

SEQ ID NO: 391799 - RNA, 32 nt, Human
cuaaggucaggaguucgagaccagcccagcca

SEQ ID NO: 391800 - RNA, 32 nt, Human
cuaaggucaggaguucgagaccagccuagcca

SEQ ID NO: 391801 - RNA, 32 nt, Human
cuaaggucaggaguucgagaccagccuggcca

SEQ ID NO: 391802 - RNA, 32 nt, Human
cuaaggucaggaguugaagaccagccuggcca

SEQ ID NO: 391803 - RNA, 32 nt, Human
cuaaggucaggaguuugagaccagccugagca

SEQ ID NO: 391804 - RNA, 32 nt, Human
cuaaggucaggaguuugagaccagccuggcca

SEQ ID NO: 391805 - RNA, 32 nt, Human
cuaagguccuccucagcuucuagaccuagaag

SEQ ID NO: 391806 - RNA, 32 nt, Human
cuaaggucuggaguucgagaccagccuggcca

SEQ ID NO: 391807 - RNA, 32 nt, Human
cuaaggugacauuucaagaaacacauguguug

SEQ ID NO: 391808 - RNA, 32 nt, Human
cuaaggugaugugguuuuaaucuuucauucug

SEQ ID NO: 391809 - RNA, 32 nt, Human
cuaaggugcugcaggaccuggggccagggaca

SEQ ID NO: 391810 - RNA, 32 nt, Human
cuaaggugggaggaucaccugagcucaagagg

SEQ ID NO: 391811 - RNA, 32 nt, Human
cuaaggugggcggaucaccugaugucaggagu

SEQ ID NO: 391812 - RNA, 32 nt, Human
cuaagguggguggaucaccugaggucaagagu

SEQ ID NO: 391813 - RNA, 32 nt, Human
cuaagguggugaugccauuuuguucugccaaa

SEQ ID NO: 391814 - RNA, 32 nt, Human
cuaagguuacauacagguuuggagauuaggac

SEQ ID NO: 391815 - RNA, 32 nt, Human
cuaagguuaggaguuugagaccagccuggcca

SEQ ID NO: 391816 - RNA, 23 nt, Human
cuaagguuaucuacuuuuacuca

SEQ ID NO: 391817 - RNA, 32 nt, Human
cuaagguuucuuucuacucugcuugacuccuu

SEQ ID NO: 391818 - RNA, 32 nt, Human
cuaagguuuuauuguuuguauuucaagccauu

SEQ ID NO: 391819 - RNA, 32 nt, Human
cuaaguaaacuuuguugucaagcaauuugucc

SEQ ID NO: 391820 - RNA, 32 nt, Human
cuaaguaaaggcaauuugcaggccauucuaau

SEQ ID NO: 391821 - RNA, 32 nt, Human
cuaaguaacauacucaagacuuuguaucugug

SEQ ID NO: 391822 - RNA, 32 nt, Human
cuaaguaacuguguaaaucugugcaaagguac

SEQ ID NO: 391823 - RNA, 32 nt, Human
cuaaguaagcuucagugaaaacuguucacggu

SEQ ID NO: 391824 - RNA, 32 nt, Human
cuaaguacaacuuuuggaaugauaccugaaga

SEQ ID NO: 391825 - RNA, 32 nt, Human
cuaaguacauggcaacacaucugucucucccu

SEQ ID NO: 391826 - RNA, 32 nt, Human
cuaaguacccucugaauggccaugccuguuac

SEQ ID NO: 391827 - RNA, 32 nt, Human
cuaaguagaaccagguaauugucucuuuuucu

SEQ ID NO: 391828 - RNA, 32 nt, Human
cuaaguagacuuuauaauauuguguuuuaucu

SEQ ID NO: 391829 - RNA, 32 nt, Human
cuaaguagcaggcagugccacuguggacagug

SEQ ID NO: 391830 - RNA, 32 nt, Human
cuaaguagcucccauucccucaccuuuucaau

SEQ ID NO: 391831 - RNA, 20 nt, Human
cuaaguagcugggacuacag

SEQ ID NO: 391832 - RNA, 21 nt, Human
cuaaguagcugggacuacagg

SEQ ID NO: 391833 - RNA, 21 nt, Human
cuaaguagcugggaguacagg

SEQ ID NO: 391834 - RNA, 21 nt, Human
cuaaguagcugggauuacagg

SEQ ID NO: 391835 - RNA, 32 nt, Human
cuaaguaggagaaagggagaccuuuuuauuuu

SEQ ID NO: 391836 - RNA, 32 nt, Human
cuaaguaggauugugacagucacgcccccggc

SEQ ID NO: 391837 - RNA, 32 nt, Human
cuaaguauagaugaagaugaagaggcagaauu

SEQ ID NO: 391838 - RNA, 32 nt, Human
cuaaguaugcucagugcugugaaaguggauua

SEQ ID NO: 391839 - RNA, 32 nt, Human
cuaaguauugcccuccccaauucuucaucgua

SEQ ID NO: 391840 - RNA, 32 nt, Human
cuaagucaaggccgaacuccagccugguggcu

SEQ ID NO: 391841 - RNA, 32 nt, Human
cuaagucacugaggcuggaguacaguggcaug

SEQ ID NO: 391842 - RNA, 32 nt, Human
cuaagucaggcccugaucuagugcaguaaagg

SEQ ID NO: 391843 - RNA, 32 nt, Human
cuaagucaggugcagagguucugagggaccca

SEQ ID NO: 391844 - RNA, 32 nt, Human
cuaaguccaaaaacuauagagcagaagaauug

SEQ ID NO: 391845 - RNA, 32 nt, Human
cuaaguccagagccaggagaguuggaccauug

SEQ ID NO: 391846 - RNA, 32 nt, Human
cuaaguccagcucuccccugcgcaggcccucc

SEQ ID NO: 391847 - RNA, 32 nt, Human
cuaaguccauuuucagacaaaguuucugugga

SEQ ID NO: 391848 - RNA, 32 nt, Human
cuaagucccagccucugcaauacacaguuacc

SEQ ID NO: 391849 - RNA, 32 nt, Human
cuaaguccccaggccugaccuggagcuggccu

SEQ ID NO: 391850 - RNA, 32 nt, Human
cuaagucccuauucacugugcuuaguagugac

SEQ ID NO: 391851 - RNA, 32 nt, Human
cuaagucccuucaucucccuggacccugccuu

SEQ ID NO: 391852 - RNA, 32 nt, Human
cuaaguccucccucccccuucuccuucacccc

SEQ ID NO: 391853 - RNA, 32 nt, Human
cuaaguccucuccagguugguccugggauauc

SEQ ID NO: 391854 - RNA, 17 nt, Human
cuaagucggcuccggga

SEQ ID NO: 391855 - RNA, 32 nt, Human
cuaagucuaggaggucgaggcuucagugagcg

SEQ ID NO: 391856 - RNA, 32 nt, Human
cuaagucuuugucccaccagggguugcagugg

SEQ ID NO: 391857 - RNA, 32 nt, Human
cuaagugaccacacaggagagcagugaggcca

SEQ ID NO: 391858 - RNA, 32 nt, Human
cuaagugaugaccaccuacggugcuuucggca

SEQ ID NO: 391859 - RNA, 32 nt, Human
cuaagugccuuuuggaggauuucuuggaagag

SEQ ID NO: 391860 - RNA, 32 nt, Human
cuaaguggaagaguguuuccuccucuggccgu

SEQ ID NO: 391861 - RNA, 32 nt, Human
cuaaguggcaacauuuuuauucuucagaguca

SEQ ID NO: 391862 - RNA, 32 nt, Human
cuaaguggcuuuucuucuguccucuucucaaa

SEQ ID NO: 391863 - RNA, 32 nt, Human
cuaagugggaagugaagccccuuguccucucc

SEQ ID NO: 391864 - RNA, 32 nt, Human
cuaaguggggauguguauauuucaggaacuuu

SEQ ID NO: 391865 - RNA, 32 nt, Human
cuaaguggggcccaccauggccauagccccuc

SEQ ID NO: 391866 - RNA, 32 nt, Human
cuaagugugguggcucaugccuguagucccag

SEQ ID NO: 391867 - RNA, 32 nt, Human
cuaaguguguguacucauacacacagauaaac

SEQ ID NO: 391868 - RNA, 32 nt, Human
cuaaguuaguugcacuuacaugauuauuguua

SEQ ID NO: 391869 - RNA, 32 nt, Human
cuaaguucagccccaaacccacaugaagaacu

SEQ ID NO: 391870 - RNA, 32 nt, Human
cuaaguugaacccggcaguaugcaugauugcc

SEQ ID NO: 391871 - RNA, 32 nt, Human
cuaaguugcauccuuuauauuaaagcaauaau

SEQ ID NO: 391872 - RNA, 32 nt, Human
cuaaguugcuuuggcugaggggagaggaaaac

SEQ ID NO: 391873 - RNA, 32 nt, Human
cuaaguuggggaguucaagaccagccugacca

SEQ ID NO: 391874 - RNA, 32 nt, Human
cuaaguuuuucaugcauuucccagacuacuua

SEQ ID NO: 391875 - RNA, 32 nt, Human
cuaauaaaaauacaaaaauuagccaggcaugg

SEQ ID NO: 391876 - RNA, 32 nt, Human
cuaauaaaaauacaaaaauuagccaggcgugg

SEQ ID NO: 391877 - RNA, 32 nt, Human
cuaauaaaaauacaaaaauuagccgggcgugg

SEQ ID NO: 391878 - RNA, 32 nt, Human
cuaauaaaaauacaaaaauuagcugggcaugg

SEQ ID NO: 391879 - RNA, 32 nt, Human
cuaauaaaaauacaaaacuuagcugggcgugg

SEQ ID NO: 391880 - RNA, 32 nt, Human
cuaauaaaaauacgaaaaauuagccaggcgug

SEQ ID NO: 391881 - RNA, 32 nt, Human
cuaauaaaaauauaaaaauuagccuggcaugg

SEQ ID NO: 391882 - RNA, 32 nt, Human
cuaauaaaaaucaagacuccugggacgccuuc

SEQ ID NO: 391883 - RNA, 29 nt, Human
cuaauaaaagagacuuuccucuucccuuc

SEQ ID NO: 391884 - RNA, 32 nt, Human
cuaauaaagcuucuguuccgugcuugucccug

SEQ ID NO: 391885 - RNA, 32 nt, Human
cuaauaaagggaagaauuauauugaauggaau

SEQ ID NO: 391886 - RNA, 32 nt, Human
cuaauaaaguacuagguugcaauaugugaaau

SEQ ID NO: 391887 - RNA, 32 nt, Human
cuaauaaauucuaggguuugagucuagaagcc

SEQ ID NO: 391888 - RNA, 32 nt, Human
cuaauaacaacaauguaauuuuugcagacagc

SEQ ID NO: 391889 - RNA, 32 nt, Human
cuaauaacacucauuccucaagugauauuaga

SEQ ID NO: 391890 - RNA, 32 nt, Human
cuaauaacccuaggaggcguagaugccuccca

SEQ ID NO: 391891 - RNA, 32 nt, Human
cuaauaagaacgugcccuucucacuugcaccc

SEQ ID NO: 391892 - RNA, 32 nt, Human
cuaauaagcugcucugccccuugugcucagag

SEQ ID NO: 391893 - RNA, 32 nt, Human
cuaauaaggagcgaauccuacauccaccaagg

SEQ ID NO: 391894 - RNA, 32 nt, Human
cuaauaaggauaaugcugaauuuugaaaggac

SEQ ID NO: 391895 - RNA, 32 nt, Human
cuaauaaggcuuuggcgccucucccagaacuc

SEQ ID NO: 391896 - RNA, 32 nt, Human
cuaauaagguuuaugguuuagcuuaaagagca

SEQ ID NO: 391897 - RNA, 32 nt, Human
cuaauaaguuguugguuuuccaagagaaaacu

SEQ ID NO: 391898 - RNA, 32 nt, Human
cuaauaauaagcuaaccuuugugcacaaauaa

SEQ ID NO: 391899 - RNA, 32 nt, Human
cuaauaauaauacaaaaauuagcugggcgugg

SEQ ID NO: 391900 - RNA, 32 nt, Human
cuaauaauacaaaaauuagcugggcauggugg

SEQ ID NO: 391901 - RNA, 32 nt, Human
cuaauaauacaaaaauuagcugggcauguugg

SEQ ID NO: 391902 - RNA, 32 nt, Human
cuaauaaugcccuuucuuuaucugagaugucu

SEQ ID NO: 391903 - RNA, 32 nt, Human
cuaauaauggaaauagaagagcagaagcaaaa

SEQ ID NO: 391904 - RNA, 32 nt, Human
cuaauacagacuucugcagccauuaccaccgu

SEQ ID NO: 391905 - RNA, 32 nt, Human
cuaauacaucaucucacacuuucauguucuuc

SEQ ID NO: 391906 - RNA, 32 nt, Human
cuaauacaugauacaugugggccuguuagucu

SEQ ID NO: 391907 - RNA, 32 nt, Human
cuaauacccacugcuucaguguuaacacagca

SEQ ID NO: 391908 - RNA, 32 nt, Human
cuaauaccuauucuucaaccaccucgguuacu

SEQ ID NO: 391909 - RNA, 32 nt, Human
cuaauaccuugccucuuauuccugcuacagca

SEQ ID NO: 391910 - RNA, 32 nt, Human
cuaauacgugaagaaaauaguuugaguagcag

SEQ ID NO: 391911 - RNA, 32 nt, Human
cuaauacuaagugcccaaccugacaacagaga

SEQ ID NO: 391912 - RNA, 32 nt, Human
cuaauacuaaugagaggaucaccugagcccag

SEQ ID NO: 391913 - RNA, 32 nt, Human
cuaauacuacagaaauacaaaauaucaucaga

SEQ ID NO: 391914 - RNA, 32 nt, Human
cuaauagagcacacuaguuagcagaacagaac

SEQ ID NO: 391915 - RNA, 32 nt, Human
cuaauagcuccccguucuuccucucucaacau

SEQ ID NO: 391916 - RNA, 20 nt, Human
cuaauagcugggacuacagg

SEQ ID NO: 391917 - RNA, 32 nt, Human
cuaauaggaaggcagaucucagcgauaaacaa

SEQ ID NO: 391918 - RNA, 32 nt, Human
cuaauaggacucaggcuuggaaggaacuaaag

SEQ ID NO: 391919 - RNA, 30 nt, Human
cuaauaggggaccugagggcacaguccuca

SEQ ID NO: 391920 - RNA, 32 nt, Human
cuaauaggggcagagcucagauaugagucaag

SEQ ID NO: 391921 - RNA, 32 nt, Human
cuaauaguaagaagguggaggaagacuuaaag

SEQ ID NO: 391922 - RNA, 32 nt, Human
cuaauagucacucaagcaguaccauuuauuuu

SEQ ID NO: 391923 - RNA, 32 nt, Human
cuaauagucuguuccuuguggaaaaauguuga

SEQ ID NO: 391924 - RNA, 32 nt, Human
cuaauagugguuuuccuugcguuuccuuaaug

SEQ ID NO: 391925 - RNA, 32 nt, Human
cuaauaguuacuucccugguucaucaauuuaa

SEQ ID NO: 391926 - RNA, 32 nt, Human
cuaauauaucuacaguaaauguuacacuagag

SEQ ID NO: 391927 - RNA, 18 nt, Human
cuaauaugaugcauuuua

SEQ ID NO: 391928 - RNA, 32 nt, Human
cuaauauggaaaucacugccagagacagucua

SEQ ID NO: 391929 - RNA, 20 nt, Human
cuaauauggugaaaccccgu

SEQ ID NO: 391930 - RNA, 20 nt, Human
cuaauauggugaaacccugu

SEQ ID NO: 391931 - RNA, 20 nt, Human
cuaauauggugaaaccucgu

SEQ ID NO: 391932 - RNA, 32 nt, Human
cuaauauucucagcacggguguauggggaccu

SEQ ID NO: 391933 - RNA, 32 nt, Human
cuaauauuuuuaucuagaaagaagagugagug

SEQ ID NO: 391934 - RNA, 32 nt, Human
cuaauauuuuucuacucucuuacccucuuaac

SEQ ID NO: 391935 - RNA, 32 nt, Human
cuaaucaaacuaaccucaaaacaaaugauaac

SEQ ID NO: 391936 - RNA, 32 nt, Human
cuaaucacacacaggaagaguguguagaagug

SEQ ID NO: 391937 - RNA, 32 nt, Human
cuaaucacaccacugcacuccagccugggcaa

SEQ ID NO: 391938 - RNA, 32 nt, Human
cuaaucacccaaaaagaaaccccacgcccauu

SEQ ID NO: 391939 - RNA, 32 nt, Human
cuaaucagagucagaccaguagagaaauuaaa

SEQ ID NO: 391940 - RNA, 32 nt, Human
cuaaucagauccaccaauguuucaaauaggac

SEQ ID NO: 391941 - RNA, 32 nt, Human
cuaaucagcaucuggccaacauaguggagaga

SEQ ID NO: 391942 - RNA, 32 nt, Human
cuaaucaggaggcugaggcaggagaauggugu

SEQ ID NO: 391943 - RNA, 32 nt, Human
cuaaucaggcucaccagggggaucauuaccgu

SEQ ID NO: 391944 - RNA, 32 nt, Human
cuaaucauucagacuucauugagcucugcaaa

SEQ ID NO: 391945 - RNA, 32 nt, Human
cuaauccaacagcaaauccccuugaugcuacc

SEQ ID NO: 391946 - RNA, 32 nt, Human
cuaauccacauccuuauugauuagcuacacug

SEQ ID NO: 391947 - RNA, 32 nt, Human
cuaauccagauguauuaaaaauauauaaaagu

SEQ ID NO: 391948 - RNA, 32 nt, Human
cuaauccaucgagagaaagaggcuuacgaaaa

SEQ ID NO: 391949 - RNA, 32 nt, Human
cuaauccaugccggguuggaggcugcugacgc

SEQ ID NO: 391950 - RNA, 32 nt, Human
cuaaucccagcacuuugggagacugagguggg

SEQ ID NO: 391951 - RNA, 32 nt, Human
cuaaucccagcacuuugggaggcugaggcagg

SEQ ID NO: 391952 - RNA, 32 nt, Human
cuaaucccagcacuuugggaggcugaggcugg

SEQ ID NO: 391953 - RNA, 32 nt, Human
cuaaucccagcacuuugggaggcugagguagg

SEQ ID NO: 391954 - RNA, 32 nt, Human
cuaauccuaccugaucuuuaacaaagcauuaa

SEQ ID NO: 391955 - RNA, 32 nt, Human
cuaauccuagugagaggugaagccaguuggac

SEQ ID NO: 391956 - RNA, 32 nt, Human
cuaauccuaucugccaaaauggcuuagacaca

SEQ ID NO: 391957 - RNA, 32 nt, Human
cuaauccucaucuuuuucucucuguauaucac

SEQ ID NO: 391958 - RNA, 32 nt, Human
cuaauccugccugauuguguuuacagaagcuu

SEQ ID NO: 391959 - RNA, 32 nt, Human
cuaauccugcuugccugguaaauguucucuuc

SEQ ID NO: 391960 - RNA, 32 nt, Human
cuaaucucacccucuccuccagugugggcuug

SEQ ID NO: 391961 - RNA, 32 nt, Human
cuaaucucuacaggggcccaguacaguuguuu

SEQ ID NO: 391962 - RNA, 31 nt, Human
cuaaucugccucugccucuguuuaauaagga

SEQ ID NO: 391963 - RNA, 32 nt, Human
cuaaucugguagcaauccaucuccccagugaa

SEQ ID NO: 391964 - RNA, 32 nt, Human
cuaaucuguuauagggaguuguuuucucuugc

SEQ ID NO: 391965 - RNA, 32 nt, Human
cuaaucuucagccucaaaguccucagaagggc

SEQ ID NO: 391966 - RNA, 32 nt, Human
cuaaucuuuuugccucagaauaccaaaacaac

SEQ ID NO: 391967 - RNA, 32 nt, Human
cuaaugaaaaagacauggaggccaggugcggu

SEQ ID NO: 391968 - RNA, 32 nt, Human
cuaaugaaaagagagaaaagaagaauggggaa

SEQ ID NO: 391969 - RNA, 32 nt, Human
cuaaugaaaauacauacuucuucauucggaga

SEQ ID NO: 391970 - RNA, 24 nt, Human
cuaaugaaagaaaaugcccuuuaa

SEQ ID NO: 391971 - RNA, 31 nt, Human
cuaaugaaggagggagaaaaacuguugauuu

SEQ ID NO: 391972 - RNA, 32 nt, Human
cuaaugaaucaucacaggaauguguugcuccu

SEQ ID NO: 391973 - RNA, 32 nt, Human
cuaaugacaacaaaagccaucuucacaaaagg

SEQ ID NO: 391974 - RNA, 32 nt, Human
cuaaugacaagcuguucgaaguauggcaaaau

SEQ ID NO: 391975 - RNA, 32 nt, Human
cuaaugacagggagcccacuaccucauaagcu

SEQ ID NO: 391976 - RNA, 32 nt, Human
cuaaugacuuccuuauugucccugauauuuug

SEQ ID NO: 391977 - RNA, 32 nt, Human
cuaaugagagugcacugcucccugggguucuc

SEQ ID NO: 391978 - RNA, 32 nt, Human
cuaaugaggggcccugccgaggcaucagcugc

SEQ ID NO: 391979 - RNA, 32 nt, Human
cuaaugaguauaauuggccacugccuuauuua

SEQ ID NO: 391980 - RNA, 32 nt, Human
cuaaugagucacagagagaugcugcccagguc

SEQ ID NO: 391981 - RNA, 32 nt, Human
cuaaugauccacucccugcucuucuucuucau

SEQ ID NO: 391982 - RNA, 32 nt, Human
cuaaugauuguuuucuaagcauuguggcuucu

SEQ ID NO: 391983 - RNA, 32 nt, Human
cuaaugcaacagcaacaaagccacugauaccu

SEQ ID NO: 391984 - RNA, 32 nt, Human
cuaaugcacccaccagcucaaacacaccaaua

SEQ ID NO: 391985 - RNA, 32 nt, Human
cuaaugcaggcugcuuucucucauguaaccaa

SEQ ID NO: 391986 - RNA, 32 nt, Human
cuaaugcauccacugaugaacaugcaaacuuu

SEQ ID NO: 391987 - RNA, 32 nt, Human
cuaaugcauuugguauguaacuuuaaauuuga

SEQ ID NO: 391988 - RNA, 32 nt, Human
cuaaugccagcuguuuauacugcucuuucaag

SEQ ID NO: 391989 - RNA, 32 nt, Human
cuaaugcccuauguguauaguaccagaagcaa

SEQ ID NO: 391990 - RNA, 32 nt, Human
cuaaugcggaggcugcuugcugugcuggcuuu

SEQ ID NO: 391991 - RNA, 32 nt, Human
cuaaugcuuccagaugugcacugcuucugucu

SEQ ID NO: 391992 - RNA, 32 nt, Human
cuaauggagagggauugaaaggggaagagccc

SEQ ID NO: 391993 - RNA, 32 nt, Human
cuaauggagcuucaugacccacggucagcccc

SEQ ID NO: 391994 - RNA, 31 nt, Human
cuaauggcaauguuuguccuuaccaggauuu

SEQ ID NO: 391995 - RNA, 32 nt, Human
cuaaugggaagaggaaaaugggaaacaaugca

SEQ ID NO: 391996 - RNA, 32 nt, Human
cuaauggggcagagacaggaagagcaauaaua

SEQ ID NO: 391997 - RNA, 32 nt, Human
cuaaugggggagcaggaggagggcaaggaccu

SEQ ID NO: 391998 - RNA, 32 nt, Human
cuaauguaaaauuguacugggcuggucggaug

SEQ ID NO: 391999 - RNA, 32 nt, Human
cuaauguaguuucuuugauuaccgacuacaca

SEQ ID NO: 392000 - RNA, 32 nt, Human
cuaauguauccagaagauuggaagagggauaa

SEQ ID NO: 392001 - RNA, 32 nt, Human
cuaaugucacaacauggugcuacuucuucuuc

SEQ ID NO: 392002 - RNA, 32 nt, Human
cuaaugucacggggguguacacccugugauag

SEQ ID NO: 392003 - RNA, 32 nt, Human
cuaaugucauuggaaacaaaagcuugaaagaa

SEQ ID NO: 392004 - RNA, 32 nt, Human
cuaaugucugcagauguggaucccgaauccug

SEQ ID NO: 392005 - RNA, 32 nt, Human
cuaaugucuggugacagaguuggacucugucu

SEQ ID NO: 392006 - RNA, 32 nt, Human
cuaauguggucugccugugaaucuccccaugu

SEQ ID NO: 392007 - RNA, 20 nt, Human
cuaauguggugaaaccccgu

SEQ ID NO: 392008 - RNA, 32 nt, Human
cuaaugugugacugagaagcagccugggugug

SEQ ID NO: 392009 - RNA, 32 nt, Human
cuaauguguggcuaaggaguuaccugggggaa

SEQ ID NO: 392010 - RNA, 32 nt, Human
cuaauguuacuguugauucauuucccaaauuc

SEQ ID NO: 392011 - RNA, 32 nt, Human
cuaauguucauucuucugaaauucugggauua

SEQ ID NO: 392012 - RNA, 32 nt, Human
cuaauguugaacaccuauuuugcgccagaccu

SEQ ID NO: 392013 - RNA, 32 nt, Human
cuaauguugauugaaccucccuuuccccauaa

SEQ ID NO: 392014 - RNA, 32 nt, Human
cuaauguuuauaggagaaagcaaaauacauca

SEQ ID NO: 392015 - RNA, 32 nt, Human
cuaauguuuuccacaagacugaacaacgugua

SEQ ID NO: 392016 - RNA, 32 nt, Human
cuaauuaacucuagauuaaaagcuacucugga

SEQ ID NO: 392017 - RNA, 32 nt, Human
cuaauuaagcaggcccagagacagagaggggg

SEQ ID NO: 392018 - RNA, 32 nt, Human
cuaauuaagggagggagcagcggggagcuugc

SEQ ID NO: 392019 - RNA, 32 nt, Human
cuaauuaagguuugcccugccugcagccuccc

SEQ ID NO: 392020 - RNA, 32 nt, Human
cuaauuacagaaaauugugcagauacuaguga

SEQ ID NO: 392021 - RNA, 19 nt, Human
cuaauuacagcccccaacc

SEQ ID NO: 392022 - RNA, 32 nt, Human
cuaauuagagaaugccuguaaauguaggcuga

SEQ ID NO: 392023 - RNA, 32 nt, Human
cuaauuagcuugcuugaagauguggccuuggc

SEQ ID NO: 392024 - RNA, 32 nt, Human
cuaauuaggaauagacauggacacugauaugg

SEQ ID NO: 392025 - RNA, 32 nt, Human
cuaauuaucuguguaauuuuauaacauacuuu

SEQ ID NO: 392026 - RNA, 32 nt, Human
cuaauuaugcacacagaaaaucuguggagccu

SEQ ID NO: 392027 - RNA, 32 nt, Human
cuaauucaaaguugcauguucuaugacaucug

SEQ ID NO: 392028 - RNA, 32 nt, Human
cuaauucacagaaugcacuuucuacccugugu

SEQ ID NO: 392029 - RNA, 32 nt, Human
cuaauucacuauacagagagucugaaccuuag

SEQ ID NO: 392030 - RNA, 32 nt, Human
cuaauucagucaugucuuuccacagaugggga

SEQ ID NO: 392031 - RNA, 32 nt, Human
cuaauucccuucuucaugaaaccagggcccuc

SEQ ID NO: 392032 - RNA, 32 nt, Human
cuaauuccgagucaccaccacagcggccuccu

SEQ ID NO: 392033 - RNA, 32 nt, Human
cuaauucuaauucugaugaugacuccuacucc

SEQ ID NO: 392034 - RNA, 32 nt, Human
cuaauucuacaccccugucgccuccuaggggc

SEQ ID NO: 392035 - RNA, 32 nt, Human
cuaauucuaguauagcuugagaaaaauaugaa

SEQ ID NO: 392036 - RNA, 32 nt, Human
cuaauucucaaaagcaaaacaagagcacacaa

SEQ ID NO: 392037 - RNA, 21 nt, Human
cuaauucucaaaggugcuuau

SEQ ID NO: 392038 - RNA, 32 nt, Human
cuaauucuccugacuguucuucccaggggagu

SEQ ID NO: 392039 - RNA, 32 nt, Human
cuaauucucuucgcugugaugcaugagcuccc

SEQ ID NO: 392040 - RNA, 32 nt, Human
cuaauucugcagguggagguugcuagucuagu

SEQ ID NO: 392041 - RNA, 32 nt, Human
cuaauucugcaucugggcaggaugacuuuacu

SEQ ID NO: 392042 - RNA, 23 nt, Human
cuaauucugcauuaaagugcaag

SEQ ID NO: 392043 - RNA, 32 nt, Human
cuaauucugcccauggucaucugcaccugcac

SEQ ID NO: 392044 - RNA, 32 nt, Human
cuaauugaaagaaaaaucauagaaauaaguaa

SEQ ID NO: 392045 - RNA, 32 nt, Human
cuaauugaagaaaaauguaaacuacuugaaaa

SEQ ID NO: 392046 - RNA, 32 nt, Human
cuaauugaagaagaaagggagggcagagagga

SEQ ID NO: 392047 - RNA, 32 nt, Human
cuaauugcaaauaguauuaggcucacuggaaa

SEQ ID NO: 392048 - RNA, 32 nt, Human
cuaauugcaaggauuucucaggugacugguua

SEQ ID NO: 392049 - RNA, 32 nt, Human
cuaauugcccugcuguuuuacugguguauagg

SEQ ID NO: 392050 - RNA, 32 nt, Human
cuaauugcgccacugcacuccagccugagcga

SEQ ID NO: 392051 - RNA, 32 nt, Human
cuaauugcuaacuguuuauacuuuucugaaua

SEQ ID NO: 392052 - RNA, 32 nt, Human
cuaauugcuguggccaagcgccugugugccga

SEQ ID NO: 392053 - RNA, 32 nt, Human
cuaauugcuucuuuauuuugggccacaacguu

SEQ ID NO: 392054 - RNA, 32 nt, Human
cuaauuggaagggugaggcgggaggaucgcuu

SEQ ID NO: 392055 - RNA, 32 nt, Human
cuaauuggacauagaaaccaccuucacucaua

SEQ ID NO: 392056 - RNA, 32 nt, Human
cuaauuggauauaguuacuaugaguccaugaa

SEQ ID NO: 392057 - RNA, 32 nt, Human
cuaauuguaagugcccuuacuaagggcacaug

SEQ ID NO: 392058 - RNA, 32 nt, Human
cuaauuguuuuuauaaaaauuauucccuauug

SEQ ID NO: 392059 - RNA, 32 nt, Human
cuaauuuauugccgugcguccugcugcuguga

SEQ ID NO: 392060 - RNA, 32 nt, Human
cuaauuuauuuuuagcagagaugggguuucac

SEQ ID NO: 392061 - RNA, 32 nt, Human
cuaauuucacuaccuauccaggaguggaacug

SEQ ID NO: 392062 - RNA, 32 nt, Human
cuaauuucauugagagaaacccagccagacuu

SEQ ID NO: 392063 - RNA, 32 nt, Human
cuaauuucauugucuuucuucccacgcucauu

SEQ ID NO: 392064 - RNA, 32 nt, Human
cuaauuuccucuucgcucuauuuuagcaguug

SEQ ID NO: 392065 - RNA, 32 nt, Human
cuaauuucuccucccuuccuuuucccugcuuc

SEQ ID NO: 392066 - RNA, 32 nt, Human
cuaauuugaacuggacuggucucagugugagc

SEQ ID NO: 392067 - RNA, 32 nt, Human
cuaauuugaagagagccgccacguaccucucu

SEQ ID NO: 392068 - RNA, 32 nt, Human
cuaauuugcuauaacagcucacaaacacuuau

SEQ ID NO: 392069 - RNA, 32 nt, Human
cuaauuuggucagucacaaauuccuuuuuagc

SEQ ID NO: 392070 - RNA, 32 nt, Human
cuaauuuuaaaauguuuuguaggcggggcucg

SEQ ID NO: 392071 - RNA, 32 nt, Human
cuaauuuuagucagagguuagcacuugauaau

SEQ ID NO: 392072 - RNA, 32 nt, Human
cuaauuuucuguauuuuuaguagagacggggu

SEQ ID NO: 392073 - RNA, 32 nt, Human
cuaauuuugagugcuuucuacaauuucaaccc

SEQ ID NO: 392074 - RNA, 32 nt, Human
cuaauuuuguuauuucaagaaugcuauuaaaa

SEQ ID NO: 392075 - RNA, 32 nt, Human
cuaauuuuucuuccucuccagccagucuccug

SEQ ID NO: 392076 - RNA, 32 nt, Human
cuacaaaaacuacaaaaauuagccgggugugg

SEQ ID NO: 392077 - RNA, 32 nt, Human
cuacaaaaagacacaaaaauuagacaggugug

SEQ ID NO: 392078 - RNA, 32 nt, Human
cuacaaaaagaguguuucaaagcugcucaauc

SEQ ID NO: 392079 - RNA, 32 nt, Human
cuacaaaaaguacaaaaauuagccgggcaugu

SEQ ID NO: 392080 - RNA, 32 nt, Human
cuacaaaaaguacaaaaauuagccgggugugg

SEQ ID NO: 392081 - RNA, 32 nt, Human
cuacaaaaaguacaaaaauuagucgggcguga

SEQ ID NO: 392082 - RNA, 32 nt, Human
cuacaaaaaguguguuucaaagcugcucaauc

SEQ ID NO: 392083 - RNA, 32 nt, Human
cuacaaaaauuagccaggcaugguggcgcaug

SEQ ID NO: 392084 - RNA, 32 nt, Human
cuacaaaaauuagcugggcgugguggcgcgcg

SEQ ID NO: 392085 - RNA, 32 nt, Human
cuacaaaacaugcaaaaauuagcugggcaugg

SEQ ID NO: 392086 - RNA, 32 nt, Human
cuacaaaacuagccuggaguugggcugucggg

SEQ ID NO: 392087 - RNA, 32 nt, Human
cuacaaaacuuagccgggcaugguggugcgug

SEQ ID NO: 392088 - RNA, 32 nt, Human
cuacaaaaggacuacauuuccccaaaugcccg

SEQ ID NO: 392089 - RNA, 32 nt, Human
cuacaaaauauacaaaaauuagccaggcaugg

SEQ ID NO: 392090 - RNA, 32 nt, Human
cuacaaaauauacaaaauauuagccagccauc

SEQ ID NO: 392091 - RNA, 32 nt, Human
cuacaaaauauuuaaaaauuagccaggcauga

SEQ ID NO: 392092 - RNA, 32 nt, Human
cuacaaacaauacaaaaauuagccaggcaugg

SEQ ID NO: 392093 - RNA, 32 nt, Human
cuacaaacauuuccugagccccucccaugugc

SEQ ID NO: 392094 - RNA, 32 nt, Human
cuacaaaccaccaucuaccaucugccaggccc

SEQ ID NO: 392095 - RNA, 32 nt, Human
cuacaaaccagcaacaugaaauggacaaacca

SEQ ID NO: 392096 - RNA, 32 nt, Human
cuacaaaccccacaguuuaucaaggaaaaucu

SEQ ID NO: 392097 - RNA, 32 nt, Human
cuacaaacccuugugcuuucacuguauagcca

SEQ ID NO: 392098 - RNA, 32 nt, Human
cuacaaagagguggacagagaagacagcagag

SEQ ID NO: 392099 - RNA, 32 nt, Human
cuacaaagcagaccagccuggggcagauauac

SEQ ID NO: 392100 - RNA, 32 nt, Human
cuacaaaggacacaaucucucuucuucaaauu

SEQ ID NO: 392101 - RNA, 32 nt, Human
cuacaaaggagagagauguaaggguuauuuag

SEQ ID NO: 392102 - RNA, 32 nt, Human
cuacaaaguccugcagcuucccccuccuuccc

SEQ ID NO: 392103 - RNA, 32 nt, Human
cuacaaauacaaaaauuagcuggacguggugg

SEQ ID NO: 392104 - RNA, 32 nt, Human
cuacaaauacaaaaauuagcuggguguggugc

SEQ ID NO: 392105 - RNA, 32 nt, Human
cuacaaauacgaaaauuagcugggcguggugg

SEQ ID NO: 392106 - RNA, 32 nt, Human
cuacaaauaggcugggauucaauguggagugg

SEQ ID NO: 392107 - RNA, 32 nt, Human
cuacaaauaugaagaauguggcaaacacugua

SEQ ID NO: 392108 - RNA, 32 nt, Human
cuacaaauccaaauugccuggauacuguaaac

SEQ ID NO: 392109 - RNA, 32 nt, Human
cuacaaaugccaccuggugcugcgccccaucc

SEQ ID NO: 392110 - RNA, 32 nt, Human
cuacaaauuuaucuuagcacuaguuucacuac

SEQ ID NO: 392111 - RNA, 32 nt, Human
cuacaacaaaaauacaaaaauuagccaagugc

SEQ ID NO: 392112 - RNA, 19 nt, Human
cuacaacagaugcuugaug

SEQ ID NO: 392113 - RNA, 32 nt, Human
cuacaacaggcugcugugcagccuggggcccu

SEQ ID NO: 392114 - RNA, 32 nt, Human
cuacaacagugaucaucacagaggacuucuuu

SEQ ID NO: 392115 - RNA, 32 nt, Human
cuacaaccaagcucucugcaucuacucccaag

SEQ ID NO: 392116 - RNA, 32 nt, Human
cuacaaccuccaccuccuggguuugaggaauu

SEQ ID NO: 392117 - RNA, 32 nt, Human
cuacaaccuuccacagcagcccaggcuccacu

SEQ ID NO: 392118 - RNA, 32 nt, Human
cuacaacucccaggaggcauugaggcggcgcc

SEQ ID NO: 392119 - RNA, 32 nt, Human
cuacaacugcaauuuaccuuugagggcccaug

SEQ ID NO: 392120 - RNA, 32 nt, Human
cuacaacuucguccuguuccccgacaccaaga

SEQ ID NO: 392121 - RNA, 32 nt, Human
cuacaacuuugcgacauaaauuuuggggucuc

SEQ ID NO: 392122 - RNA, 32 nt, Human
cuacaagaaauuuaaaaacuagccaggcgugg

SEQ ID NO: 392123 - RNA, 32 nt, Human
cuacaagaaccugcuaaggcugccucagaccu

SEQ ID NO: 392124 - RNA, 25 nt, Human
cuacaagaagaaaacuagaacuuua

SEQ ID NO: 392125 - RNA, 32 nt, Human
cuacaagauuaauggcucuguuguauauacug

SEQ ID NO: 392126 - RNA, 32 nt, Human
cuacaagcagaggcugaacaccugcggaagga

SEQ ID NO: 392127 - RNA, 22 nt, Human
cuacaagcagccuaucugcuua

SEQ ID NO: 392128 - RNA, 32 nt, Human
cuacaagcaguuggacaguucuggaggcugga

SEQ ID NO: 392129 - RNA, 32 nt, Human
cuacaagcauggagaaaaugaagaauaggccu

SEQ ID NO: 392130 - RNA, 32 nt, Human
cuacaagccauuuugaacuucugcccucaccg

SEQ ID NO: 392131 - RNA, 32 nt, Human
cuacaagcuccccuucccagguucaagcaauu

SEQ ID NO: 392132 - RNA, 32 nt, Human
cuacaaggcucugaguguuugucccucacaua

SEQ ID NO: 392133 - RNA, 32 nt, Human
cuacaaggggcagaccacgcugauucaguaca

SEQ ID NO: 392134 - RNA, 32 nt, Human
cuacaaguuguccucaaggucauccuggagau

SEQ ID NO: 392135 - RNA, 31 nt, Human
cuacaauagaagacauuuucacuggaauuac

SEQ ID NO: 392136 - RNA, 32 nt, Human
cuacaauaucauuuguggauggucccaggucc

SEQ ID NO: 392137 - RNA, 32 nt, Human
cuacaaucaccagucucaaaugcgcuauuguu

SEQ ID NO: 392138 - RNA, 32 nt, Human
cuacaaucagaauaugcuuucuuggaccaugu

SEQ ID NO: 392139 - RNA, 32 nt, Human
cuacaaucccaggaugcaucgggaucaaagca

SEQ ID NO: 392140 - RNA, 32 nt, Human
cuacaaucuccaccauccacuagauugucucc

SEQ ID NO: 392141 - RNA, 32 nt, Human
cuacaaucugcucagggauuuauacucaaugc

SEQ ID NO: 392142 - RNA, 32 nt, Human
cuacaaugaauccugcucucaacccaaccagg

SEQ ID NO: 392143 - RNA, 32 nt, Human
cuacaauggccuccucuccaucagugccuuug

SEQ ID NO: 392144 - RNA, 32 nt, Human
cuacaauguccaguuucuccccuagacucagg

SEQ ID NO: 392145 - RNA, 32 nt, Human
cuacaaugugccagauacauguuuccuaugcc

SEQ ID NO: 392146 - RNA, 32 nt, Human
cuacaauuggaagagaaaaggauauggaacau

SEQ ID NO: 392147 - RNA, 32 nt, Human
cuacaauugugagccaccaugccaggcucauu

SEQ ID NO: 392148 - RNA, 32 nt, Human
cuacaauuugccauuguuucuccuggguuagg

SEQ ID NO: 392149 - RNA, 32 nt, Human
cuacaauuugcccucauacacacugcuuccac

SEQ ID NO: 392150 - RNA, 32 nt, Human
cuacaauuuuagauggaagcugagaugauuuc

SEQ ID NO: 392151 - RNA, 32 nt, Human
cuacaauuuuaguauaaugacauuugagucua

SEQ ID NO: 392152 - RNA, 32 nt, Human
cuacacaagccuuagccucaguggagcugugg

SEQ ID NO: 392153 - RNA, 32 nt, Human
cuacacaccuccugcauggauggccagagcgc

SEQ ID NO: 392154 - RNA, 32 nt, Human
cuacacacggacgugugauacacacaugcaug

SEQ ID NO: 392155 - RNA, 32 nt, Human
cuacacacucaggagcuugcaaagugaccaca

SEQ ID NO: 392156 - RNA, 32 nt, Human
cuacacagaaaacuacaagauguguggcguug

SEQ ID NO: 392157 - RNA, 32 nt, Human
cuacacagacauuaagaagagcagagcuggca

SEQ ID NO: 392158 - RNA, 32 nt, Human
cuacacagagagugcauuuucucuccagagau

SEQ ID NO: 392159 - RNA, 32 nt, Human
cuacacagagauuucucagccuacaaauugug

SEQ ID NO: 392160 - RNA, 32 nt, Human
cuacacagaguguuacuguuacaucaguaacu

SEQ ID NO: 392161 - RNA, 32 nt, Human
cuacacagcucugaaccuucuuuguuaaagaa

SEQ ID NO: 392162 - RNA, 32 nt, Human
cuacacaggaggcugaggcaggagaaucacuu

SEQ ID NO: 392163 - RNA, 32 nt, Human
cuacacaggaggcugaggcaggagaauugcuu

SEQ ID NO: 392164 - RNA, 32 nt, Human
cuacacaguaauccaugccuguuaguuuggag

SEQ ID NO: 392165 - RNA, 32 nt, Human
cuacacaguggagcugccccuccugggcugga

SEQ ID NO: 392166 - RNA, 32 nt, Human
cuacacaucaaaaggucauuucaggacacaaa

SEQ ID NO: 392167 - RNA, 32 nt, Human
cuacacaucccaauagaagccccuucuuaugc

SEQ ID NO: 392168 - RNA, 23 nt, Human
cuacacaucugauuuugugaacc

SEQ ID NO: 392169 - RNA, 32 nt, Human
cuacacaucuuucuuccaaagcauuuuuccug

SEQ ID NO: 392170 - RNA, 32 nt, Human
cuacaccaacagcaauuacauugaagccgagg

SEQ ID NO: 392171 - RNA, 32 nt, Human
cuacaccaccacagguaugcaccaccauaccu

SEQ ID NO: 392172 - RNA, 32 nt, Human
cuacaccaccaggcuucagccuccaaagagac

SEQ ID NO: 392173 - RNA, 24 nt, Human
cuacaccacgcagcugaccaugaa

SEQ ID NO: 392174 - RNA, 32 nt, Human
cuacaccagggcugccucaggccaggccccca

SEQ ID NO: 392175 - RNA, 32 nt, Human
cuacaccagugaggagaagaugagcgcaaggg

SEQ ID NO: 392176 - RNA, 32 nt, Human
cuacaccauuuuauguucccaccaacggugua

SEQ ID NO: 392177 - RNA, 32 nt, Human
cuacacccagcagagucccggugcccucuguc

SEQ ID NO: 392178 - RNA, 32 nt, Human
cuacacccaucccccuuccucuagcccucccu

SEQ ID NO: 392179 - RNA, 32 nt, Human
cuacaccgaagacacggagcugauggagucag

SEQ ID NO: 392180 - RNA, 32 nt, Human
cuacaccgaagccuggugagcucccagcucaa

SEQ ID NO: 392181 - RNA, 32 nt, Human
cuacaccgcccaggccagaguaggguggagcu

SEQ ID NO: 392182 - RNA, 32 nt, Human
cuacaccuaagaaaauuacucccaauguuacu

SEQ ID NO: 392183 - RNA, 32 nt, Human
cuacaccuagccugcaucuucacuuucuugau

SEQ ID NO: 392184 - RNA, 32 nt, Human
cuacaccuauuuucugcugcaggaugaggcua

SEQ ID NO: 392185 - RNA, 32 nt, Human
cuacaccugcaagggcugguucccaggcccug

SEQ ID NO: 392186 - RNA, 32 nt, Human
cuacaccugccuggcugagaaugccuuggggc

SEQ ID NO: 392187 - RNA, 32 nt, Human
cuacacggcaggggcagacacugugaguauaa

SEQ ID NO: 392188 - RNA, 32 nt, Human
cuacacgggaggcugaggcaggagaauggcau

SEQ ID NO: 392189 - RNA, 32 nt, Human
cuacacgggaggcugaggcaggagaauggcgu

SEQ ID NO: 392190 - RNA, 32 nt, Human
cuacacgggaggcuuaggcaggagaauuccuu

SEQ ID NO: 392191 - RNA, 32 nt, Human
cuacacgugugcacuccaccacucuggccauu

SEQ ID NO: 392192 - RNA, 32 nt, Human
cuacacuacuccugaggaugcuacucccgagc

SEQ ID NO: 392193 - RNA, 31 nt, Human
cuacacuauuaaagauauaaaguucuuggca

SEQ ID NO: 392194 - RNA, 32 nt, Human
cuacacuauugacuccaaccaggugggacucu

SEQ ID NO: 392195 - RNA, 32 nt, Human
cuacacuccagccugagcaacagagugagacc

SEQ ID NO: 392196 - RNA, 32 nt, Human
cuacacuccagccuggaugacagagugagacu

SEQ ID NO: 392197 - RNA, 32 nt, Human
cuacacuccagccuggccacagagcgagacuc

SEQ ID NO: 392198 - RNA, 32 nt, Human
cuacacuccagccuggcgacagagcgagacuu

SEQ ID NO: 392199 - RNA, 32 nt, Human
cuacacuccagccugggagacagagcgagacu

SEQ ID NO: 392200 - RNA, 32 nt, Human
cuacacuccagccugggcaacagagagcgacu

SEQ ID NO: 392201 - RNA, 32 nt, Human
cuacacuccagccugggcaacagagcgagacu

SEQ ID NO: 392202 - RNA, 32 nt, Human
cuacacuccagccugggcaacagagggagacu

SEQ ID NO: 392203 - RNA, 32 nt, Human
cuacacuccagccugggcaacagagugagacu

SEQ ID NO: 392204 - RNA, 32 nt, Human
cuacacuccagccugggcgacagagcgagacu

SEQ ID NO: 392205 - RNA, 32 nt, Human
cuacacuccagccugggcgacagagugacccu

SEQ ID NO: 392206 - RNA, 32 nt, Human
cuacacuccagccugggugacaaagcgagacu

SEQ ID NO: 392207 - RNA, 32 nt, Human
cuacacuccagccugggugacagagugagacu

SEQ ID NO: 392208 - RNA, 32 nt, Human
cuacacuccagccugggugacagagugagauc

SEQ ID NO: 392209 - RNA, 32 nt, Human
cuacacuccagccuggucaacagagugagacu

SEQ ID NO: 392210 - RNA, 32 nt, Human
cuacacuccagccuggucgacagagugaacuc

SEQ ID NO: 392211 - RNA, 32 nt, Human
cuacacuccagccuggugacagagugagacuc

SEQ ID NO: 392212 - RNA, 31 nt, Human
cuacacucccucucugagccuccgucgcccc

SEQ ID NO: 392213 - RNA, 32 nt, Human
cuacacucggaauucccugaagcaacacugcc

SEQ ID NO: 392214 - RNA, 32 nt, Human
cuacacucucagagaguaguagaaagagagua

SEQ ID NO: 392215 - RNA, 32 nt, Human
cuacacucugggagguagaggugggaggacug

SEQ ID NO: 392216 - RNA, 32 nt, Human
cuacacugaacaguaccuuccuuucuagaaac

SEQ ID NO: 392217 - RNA, 32 nt, Human
cuacacugagacaaggaaguuggaaaagccga

SEQ ID NO: 392218 - RNA, 32 nt, Human
cuacacugcugcccacuccucucuccagcucc

SEQ ID NO: 392219 - RNA, 32 nt, Human
cuacacuucccaagccuuacccuggcaucuuu

SEQ ID NO: 392220 - RNA, 32 nt, Human
cuacacuuccuucugugcccugccagugaccc

SEQ ID NO: 392221 - RNA, 32 nt, Human
cuacacuugaagcauuuaaagauaucccuuac

SEQ ID NO: 392222 - RNA, 32 nt, Human
cuacagaaaacccaaggagugaagggacagga

SEQ ID NO: 392223 - RNA, 32 nt, Human
cuacagaaaccaggucauuugugcacagcccg

SEQ ID NO: 392224 - RNA, 32 nt, Human
cuacagaaacuaccaaaauuagccaggugugg

SEQ ID NO: 392225 - RNA, 32 nt, Human
cuacagaaagaguguuucaaagcugcucaaug

SEQ ID NO: 392226 - RNA, 32 nt, Human
cuacagaaaguuuuaaaauuagccagguguag

SEQ ID NO: 392227 - RNA, 32 nt, Human
cuacagaacagcccuggcacugcauucaaauc

SEQ ID NO: 392228 - RNA, 32 nt, Human
cuacagaacccgaacagucucauuccaauaca

SEQ ID NO: 392229 - RNA, 32 nt, Human
cuacagaagauacaaaaauuggcugggcguug

SEQ ID NO: 392230 - RNA, 32 nt, Human
cuacagacaccuucuggaagcugcggugggga

SEQ ID NO: 392231 - RNA, 32 nt, Human
cuacagacccacaaacacuacaugcagcauca

SEQ ID NO: 392232 - RNA, 32 nt, Human
cuacagacccuucugucacagcacccaggagc

SEQ ID NO: 392233 - RNA, 32 nt, Human
cuacagagaacugcagcccuuauucagaauug

SEQ ID NO: 392234 - RNA, 32 nt, Human
cuacagagagcuaugauugcaccacugcacuc

SEQ ID NO: 392235 - RNA, 32 nt, Human
cuacagagaggaaauucuccacugugcacacc

SEQ ID NO: 392236 - RNA, 32 nt, Human
cuacagaggaaggagagguagagccaggauuu

SEQ ID NO: 392237 - RNA, 32 nt, Human
cuacagaggacccucagccagagcagaaagcu

SEQ ID NO: 392238 - RNA, 32 nt, Human
cuacagagucugagauuugauacuacuugcag

SEQ ID NO: 392239 - RNA, 32 nt, Human
cuacagaguguuucgugaucucuccuucucca

SEQ ID NO: 392240 - RNA, 32 nt, Human
cuacagaguuccugggaccggggugaaggcau

SEQ ID NO: 392241 - RNA, 32 nt, Human
cuacagaucaaagacuccuccaaaaagcacaa

SEQ ID NO: 392242 - RNA, 32 nt, Human
cuacagaugaggaaccuggacccaguuggcuc

SEQ ID NO: 392243 - RNA, 32 nt, Human
cuacagauguuacuguuucugagugagccgaa

SEQ ID NO: 392244 - RNA, 32 nt, Human
cuacagauguuaggauauguccacauaagaaa

SEQ ID NO: 392245 - RNA, 32 nt, Human
cuacagcaagacacagaaaggugugagcucug

SEQ ID NO: 392246 - RNA, 31 nt, Human
cuacagcaaucggucaguugugggagugcuu

SEQ ID NO: 392247 - RNA, 32 nt, Human
cuacagcaaugccauucccacuugccccagag

SEQ ID NO: 392248 - RNA, 32 nt, Human
cuacagcacagaaccugcuucucagacuuaca

SEQ ID NO: 392249 - RNA, 32 nt, Human
cuacagcacccagcacugugcuguuguugucu

SEQ ID NO: 392250 - RNA, 32 nt, Human
cuacagcacccaggaggugcgaguguggcugc

SEQ ID NO: 392251 - RNA, 32 nt, Human
cuacagcaccccagucucagcacucuuuggug

SEQ ID NO: 392252 - RNA, 32 nt, Human
cuacagcaggagaaaguugagguucuucaccu

SEQ ID NO: 392253 - RNA, 15 nt, Human
cuacagcauauucua

SEQ ID NO: 392254 - RNA, 32 nt, Human
cuacagcauccacugcagcucugggcuccauu

SEQ ID NO: 392255 - RNA, 20 nt, Human
cuacagcccacccccuccca

SEQ ID NO: 392256 - RNA, 19 nt, Human
cuacagcccacccuacccc

SEQ ID NO: 392257 - RNA, 32 nt, Human
cuacagcccaggcugugugcaggggcucccau

SEQ ID NO: 392258 - RNA, 32 nt, Human
cuacagccuccaacucuugggcucaagcauca

SEQ ID NO: 392259 - RNA, 32 nt, Human
cuacagccuccacggcaggagugaagcuggac

SEQ ID NO: 392260 - RNA, 32 nt, Human
cuacagccugcagcaugucugcacgugugcau

SEQ ID NO: 392261 - RNA, 32 nt, Human
cuacagccugcucucuucugcuguccccacug

SEQ ID NO: 392262 - RNA, 32 nt, Human
cuacagccuggaugacaagcaagacccucccu

SEQ ID NO: 392263 - RNA, 32 nt, Human
cuacagccuugaacuccugggcucaagagguu

SEQ ID NO: 392264 - RNA, 32 nt, Human
cuacagcgaugggccaacuggcaccagugugg

SEQ ID NO: 392265 - RNA, 32 nt, Human
cuacagcggagguggcuguggcgguggcgcug

SEQ ID NO: 392266 - RNA, 15 nt, Human
cuacagcguuuucua

SEQ ID NO: 392267 - RNA, 32 nt, Human
cuacagcuacagaaagcaggacuaggaacugg

SEQ ID NO: 392268 - RNA, 32 nt, Human
cuacagcuaugggacccuuucuuaggcaagag

SEQ ID NO: 392269 - RNA, 32 nt, Human
cuacagcuccacacccuacccacccaucggca

SEQ ID NO: 392270 - RNA, 32 nt, Human
cuacagcucucccccagcuaguaugaugaucc

SEQ ID NO: 392271 - RNA, 25 nt, Human
cuacagcugcgccggaucugggcga

SEQ ID NO: 392272 - RNA, 32 nt, Human
cuacagcugcuccccacuuucucggacccggu

SEQ ID NO: 392273 - RNA, 23 nt, Human
cuacagcugcuccccucccgcca

SEQ ID NO: 392274 - RNA, 32 nt, Human
cuacagcuggcccugcaggccacccggacugg

SEQ ID NO: 392275 - RNA, 32 nt, Human
cuacagcuguauccaaaagguaccauguaucu

SEQ ID NO: 392276 - RNA, 31 nt, Human
cuacagcuucaucaacaccuaccccauggcc

SEQ ID NO: 392277 - RNA, 32 nt, Human
cuacagcuucucuuugccauuuguggauuuca

SEQ ID NO: 392278 - RNA, 32 nt, Human
cuacagcuuugccuguaacaugggcacaggcu

SEQ ID NO: 392279 - RNA, 32 nt, Human
cuacaggaacaacagauguugaguacuucuag

SEQ ID NO: 392280 - RNA, 32 nt, Human
cuacaggaagcuuuguccgucauuccacagaa

SEQ ID NO: 392281 - RNA, 32 nt, Human
cuacaggaaggaagacaugcuuuugcccuuuc

SEQ ID NO: 392282 - RNA, 32 nt, Human
cuacaggacagcaaggagaugccaccuaaaaa

SEQ ID NO: 392283 - RNA, 32 nt, Human
cuacaggacucggccaagucucugccuacucu

SEQ ID NO: 392284 - RNA, 32 nt, Human
cuacaggagagcaagagccaauguggucagac

SEQ ID NO: 392285 - RNA, 32 nt, Human
cuacaggagcucgccaccacacccagcuaauu

SEQ ID NO: 392286 - RNA, 32 nt, Human
cuacaggaggcugaggcaagaggauugcuuga

SEQ ID NO: 392287 - RNA, 32 nt, Human
cuacaggagugaagccaccacacagauggaaa

SEQ ID NO: 392288 - RNA, 32 nt, Human
cuacaggauagggaaguggugguggaauaaaa

SEQ ID NO: 392289 - RNA, 32 nt, Human
cuacaggcaaaagggcuccuucccguggcugc

SEQ ID NO: 392290 - RNA, 31 nt, Human
cuacaggcaaaguguccuggcauuuaaaacc

SEQ ID NO: 392291 - RNA, 32 nt, Human
cuacaggcacacaccacaacaccuggcuaauu

SEQ ID NO: 392292 - RNA, 32 nt, Human
cuacaggcacacaccacaacacuuggcuaauu

SEQ ID NO: 392293 - RNA, 32 nt, Human
cuacaggcacacaccaccacaccuggcuaagu

SEQ ID NO: 392294 - RNA, 32 nt, Human
cuacaggcacacaccaccacgcccagcuaauu

SEQ ID NO: 392295 - RNA, 32 nt, Human
cuacaggcacacaccaccacgcccagcucuac

SEQ ID NO: 392296 - RNA, 32 nt, Human
cuacaggcacacaccaccacgccuggcuaauu

SEQ ID NO: 392297 - RNA, 32 nt, Human
cuacaggcacacacugccgcgcccagcuaauu

SEQ ID NO: 392298 - RNA, 32 nt, Human
cuacaggcacacgccaccacacccaacuaauu

SEQ ID NO: 392299 - RNA, 32 nt, Human
cuacaggcacccaccaccacacccagcuaauu

SEQ ID NO: 392300 - RNA, 32 nt, Human
cuacaggcacccaccaccacacccagcuaguu

SEQ ID NO: 392301 - RNA, 31 nt, Human
cuacaggcacgugugaccaugccaggcuaau

SEQ ID NO: 392302 - RNA, 32 nt, Human
cuacaggcagaggccccaccuaccugauguuu

SEQ ID NO: 392303 - RNA, 32 nt, Human
cuacaggcaguuaacaugcaugggcugguuug

SEQ ID NO: 392304 - RNA, 32 nt, Human
cuacaggcaugcaucacuaugcucugcuaauu

SEQ ID NO: 392305 - RNA, 25 nt, Human
cuacaggccagcagcuagccaugaa

SEQ ID NO: 392306 - RNA, 32 nt, Human
cuacaggccaucucccuccuguaggccucuga

SEQ ID NO: 392307 - RNA, 32 nt, Human
cuacaggccauggacagguccaugaccuguua

SEQ ID NO: 392308 - RNA, 32 nt, Human
cuacaggcccaaccucugccucaugggggcuu

SEQ ID NO: 392309 - RNA, 32 nt, Human
cuacaggcgcacaccaccacacuggcuaauuu

SEQ ID NO: 392310 - RNA, 32 nt, Human
cuacaggcgcccaccaccacaccaggcuaauu

SEQ ID NO: 392311 - RNA, 32 nt, Human
cuacaggcgccugccaccacacccagcuaacu

SEQ ID NO: 392312 - RNA, 32 nt, Human
cuacaggcucaaaacuccucuuugauaucaga

SEQ ID NO: 392313 - RNA, 32 nt, Human
cuacaggcucaugccaucaugcccagcuaaua

SEQ ID NO: 392314 - RNA, 32 nt, Human
cuacaggcucuuccaucucucaugacuucaug

SEQ ID NO: 392315 - RNA, 32 nt, Human
cuacaggcuucccgacccacaggccagcuacg

SEQ ID NO: 392316 - RNA, 32 nt, Human
cuacagggacauguacugguuccuucagauca

SEQ ID NO: 392317 - RNA, 32 nt, Human
cuacagggagagggaugguggggaaggggugg

SEQ ID NO: 392318 - RNA, 32 nt, Human
cuacagggcaggguaccgggaggcaggcggga

SEQ ID NO: 392319 - RNA, 32 nt, Human
cuacaggggaaggcaggagcuaugggagcaag

SEQ ID NO: 392320 - RNA, 32 nt, Human
cuacaggggaggcugaggcaggagaaucgcuu

SEQ ID NO: 392321 - RNA, 32 nt, Human
cuacaggggagggagagccugaggcucugcuc

SEQ ID NO: 392322 - RNA, 32 nt, Human
cuacaggggcugggugaccucuuuuugcuaau

SEQ ID NO: 392323 - RNA, 32 nt, Human
cuacagggggucuggcugguguuaacagaagg

SEQ ID NO: 392324 - RNA, 32 nt, Human
cuacagggugaucucauuugaaagcuaugaug

SEQ ID NO: 392325 - RNA, 32 nt, Human
cuacaggugagcauuuuacccauuguuggaua

SEQ ID NO: 392326 - RNA, 31 nt, Human
cuacaggugcaugccaccaugccaggcuaau

SEQ ID NO: 392327 - RNA, 32 nt, Human
cuacaggugcccgccaccacaccagcuaauuu

SEQ ID NO: 392328 - RNA, 32 nt, Human
cuacaggugcccgccaccacacccagcuaauu

SEQ ID NO: 392329 - RNA, 32 nt, Human
cuacaggugccugccaccacacccagcuaauu

SEQ ID NO: 392330 - RNA, 32 nt, Human
cuacagguggugccaccauaccuagcuaauuu

SEQ ID NO: 392331 - RNA, 32 nt, Human
cuacagguguacaccaccaugccuagcuaauu

SEQ ID NO: 392332 - RNA, 32 nt, Human
cuacaggugugcaccaccacaccaggcuaauu

SEQ ID NO: 392333 - RNA, 32 nt, Human
cuacaggugugcaccaccaugcccagcuaguu

SEQ ID NO: 392334 - RNA, 32 nt, Human
cuacaggugugcaccaccaugcccagguaauu

SEQ ID NO: 392335 - RNA, 32 nt, Human
cuacagguucgagaguuaugggugcuacaugu

SEQ ID NO: 392336 - RNA, 32 nt, Human
cuacaguaaagaaaagaggugguucucugcag

SEQ ID NO: 392337 - RNA, 18 nt, Human
cuacaguacuguguaauu

SEQ ID NO: 392338 - RNA, 32 nt, Human
cuacaguauuuuuacaggguaaaacuaguuau

SEQ ID NO: 392339 - RNA, 32 nt, Human
cuacagucacccagcuuagagcuccagucccc

SEQ ID NO: 392340 - RNA, 32 nt, Human
cuacagucccuugagcagggauuugcacacag

SEQ ID NO: 392341 - RNA, 32 nt, Human
cuacagucucagauuccugggcuuaagcaguc

SEQ ID NO: 392342 - RNA, 32 nt, Human
cuacagucugcaucuguagugccuuguggggu

SEQ ID NO: 392343 - RNA, 32 nt, Human
cuacagucuggccaagugugguggcucacgcc

SEQ ID NO: 392344 - RNA, 32 nt, Human
cuacagugacaucucucaguguuuccaacaca

SEQ ID NO: 392345 - RNA, 32 nt, Human
cuacagugagaggcagcuucuaggcagaguug

SEQ ID NO: 392346 - RNA, 32 nt, Human
cuacagugauucaugucccagguccaggaaau

SEQ ID NO: 392347 - RNA, 32 nt, Human
cuacagugcaccacggccuuggaacaccgcac

SEQ ID NO: 392348 - RNA, 32 nt, Human
cuacaguggcugaauagcuucuccaaaggcuc

SEQ ID NO: 392349 - RNA, 32 nt, Human
cuacagugucccugauucuuggaaaagccugg

SEQ ID NO: 392350 - RNA, 32 nt, Human
cuacaguguguacaaaagacuugcuguuuuaa

SEQ ID NO: 392351 - RNA, 32 nt, Human
cuacaguuauguucagucacacacacauacaa

SEQ ID NO: 392352 - RNA, 32 nt, Human
cuacaguucugagcaugacacuagccuucucu

SEQ ID NO: 392353 - RNA, 32 nt, Human
cuacaguugugcaccaccacaccaaacaagaa

SEQ ID NO: 392354 - RNA, 32 nt, Human
cuacauaaaauacaaaaauuagcugggcgugg

SEQ ID NO: 392355 - RNA, 32 nt, Human
cuacauaaguggacauagaaaaagaggcuggc

SEQ ID NO: 392356 - RNA, 32 nt, Human
cuacauaccaccacagcagcccagcuucugug

SEQ ID NO: 392357 - RNA, 32 nt, Human
cuacauaggcagcaaacuaagcugcagugaug

SEQ ID NO: 392358 - RNA, 32 nt, Human
cuacauagggguguuuauuugugucacaaaga

SEQ ID NO: 392359 - RNA, 32 nt, Human
cuacauagucaccguccgcuuuuccugaguuc

SEQ ID NO: 392360 - RNA, 22 nt, Human
cuacauauccuugccugucuag

SEQ ID NO: 392361 - RNA, 32 nt, Human
cuacauauccuuuccuagcugugugacuuugc

SEQ ID NO: 392362 - RNA, 32 nt, Human
cuacauaugaauggcaaaggcacuuuugauau

SEQ ID NO: 392363 - RNA, 32 nt, Human
cuacauauggcugcauuccauaccucagugaa

SEQ ID NO: 392364 - RNA, 32 nt, Human
cuacauaugggucuggaaaaacuguacacugu

SEQ ID NO: 392365 - RNA, 32 nt, Human
cuacauauugccagugagaaacuggguuggac

SEQ ID NO: 392366 - RNA, 32 nt, Human
cuacaucaagcuguugacagggcugcuuuucu

SEQ ID NO: 392367 - RNA, 32 nt, Human
cuacaucaauuugaaaggagcuucuggcugaa

SEQ ID NO: 392368 - RNA, 32 nt, Human
cuacaucacagcaagugacuucucagagggga

SEQ ID NO: 392369 - RNA, 32 nt, Human
cuacaucacuggcugcucuucaucaaaccuac

SEQ ID NO: 392370 - RNA, 32 nt, Human
cuacaucagaugcagaaaccagggcgcagagu

SEQ ID NO: 392371 - RNA, 32 nt, Human
cuacaucaggguggguccuaagaaacauggca

SEQ ID NO: 392372 - RNA, 32 nt, Human
cuacaucaugguuguggcugagcugcugcugc

SEQ ID NO: 392373 - RNA, 32 nt, Human
cuacauccagcuguagaaauuugucagaaauu

SEQ ID NO: 392374 - RNA, 32 nt, Human
cuacauccagguccuaaaacuauaucaucaga

SEQ ID NO: 392375 - RNA, 18 nt, Human
cuacauccaucuaugcca

SEQ ID NO: 392376 - RNA, 32 nt, Human
cuacaucccaggagaggacacagucugucauc

SEQ ID NO: 392377 - RNA, 32 nt, Human
cuacaucccaggaggaugcaccaaguugcuca

SEQ ID NO: 392378 - RNA, 32 nt, Human
cuacaucccaggguuucuggcugcaagugaga

SEQ ID NO: 392379 - RNA, 32 nt, Human
cuacaucccuuucucccuucccuccucuugcu

SEQ ID NO: 392380 - RNA, 32 nt, Human
cuacauccgccucacccaguacaucgacgggc

SEQ ID NO: 392381 - RNA, 32 nt, Human
cuacauccucaucaacacuugcuauuaucugu

SEQ ID NO: 392382 - RNA, 32 nt, Human
cuacauccucuuguuccagucucagcuggcug

SEQ ID NO: 392383 - RNA, 32 nt, Human
cuacauccugccuuuugaaccuaaaugaguuu

SEQ ID NO: 392384 - RNA, 32 nt, Human
cuacaucgaguauacugcuagaaaaaucuacc

SEQ ID NO: 392385 - RNA, 32 nt, Human
cuacaucuccaaugugcuuucuaaucuccugc

SEQ ID NO: 392386 - RNA, 24 nt, Human
cuacaucucccggcgugccuggca

SEQ ID NO: 392387 - RNA, 32 nt, Human
cuacaucugcaaccucgcgcccaaggacagcg

SEQ ID NO: 392388 - RNA, 32 nt, Human
cuacaucugcccucagcuggguccaucaugca

SEQ ID NO: 392389 - RNA, 32 nt, Human
cuacaucuuccgugguucccagcacagcccaa

SEQ ID NO: 392390 - RNA, 32 nt, Human
cuacaugaggucugcgggguccuggccgggca

SEQ ID NO: 392391 - RNA, 32 nt, Human
cuacaugaucacugcaggaugauccuccuccc

SEQ ID NO: 392392 - RNA, 32 nt, Human
cuacaugauucccuuggggcucagcaucgggg

SEQ ID NO: 392393 - RNA, 32 nt, Human
cuacaugcagagccauaagagcagcugcacua

SEQ ID NO: 392394 - RNA, 32 nt, Human
cuacaugcuacugccuagagcuugucucaaug

SEQ ID NO: 392395 - RNA, 32 nt, Human
cuacaugcuucucaugaaaauucaacggcuac

SEQ ID NO: 392396 - RNA, 32 nt, Human
cuacauggaacagcaaauaggcccagugaugc

SEQ ID NO: 392397 - RNA, 32 nt, Human
cuacaugggaagcugaggcaggagaaucaccu

SEQ ID NO: 392398 - RNA, 32 nt, Human
cuacaugggaggauuugcuugagccugggagg

SEQ ID NO: 392399 - RNA, 32 nt, Human
cuacaugggaggcuaaggugggaggaucacuu

SEQ ID NO: 392400 - RNA, 32 nt, Human
cuacaugggaggcugaggcaggagaagggcgu

SEQ ID NO: 392401 - RNA, 32 nt, Human
cuacaugggaggcugaggcaggagaaucgcuu

SEQ ID NO: 392402 - RNA, 32 nt, Human
cuacaugggaggcugaggcaggaggaucacuu

SEQ ID NO: 392403 - RNA, 32 nt, Human
cuacaugggaggcugaggcgggauugcuugag

SEQ ID NO: 392404 - RNA, 32 nt, Human
cuacaugggaggcugaggugggaggaucacuu

SEQ ID NO: 392405 - RNA, 32 nt, Human
cuacaugggauaagccaaggcuugccuucagg

SEQ ID NO: 392406 - RNA, 32 nt, Human
cuacaugggggcggauggcaggaacagaaauu

SEQ ID NO: 392407 - RNA, 32 nt, Human
cuacaugguugaugcgggcagugugggacccu

SEQ ID NO: 392408 - RNA, 32 nt, Human
cuacaugguuuuggaagaacauacuuuagaaa

SEQ ID NO: 392409 - RNA, 32 nt, Human
cuacauguauuuuucacaugaagaucuccuua

SEQ ID NO: 392410 - RNA, 32 nt, Human
cuacaugucuguggguaucacacugaguguga

SEQ ID NO: 392411 - RNA, 32 nt, Human
cuacaugucuuucuguagccucugcauacuac

SEQ ID NO: 392412 - RNA, 32 nt, Human
cuacaugugacugauagcuuuucccaaaggcc

SEQ ID NO: 392413 - RNA, 15 nt, Human
cuacauguuauucua

SEQ ID NO: 392414 - RNA, 32 nt, Human
cuacauuaguaucccacuagcccaggggagca

SEQ ID NO: 392415 - RNA, 32 nt, Human
cuacauucaaaaccaccacuaagagccacgau

SEQ ID NO: 392416 - RNA, 32 nt, Human
cuacauucacaguguccaguuuagccaccaug

SEQ ID NO: 392417 - RNA, 32 nt, Human
cuacauucagcaggaacuuuucucgaggagug

SEQ ID NO: 392418 - RNA, 32 nt, Human
cuacauuccagccugggcaacacgagcgaaac

SEQ ID NO: 392419 - RNA, 20 nt, Human
cuacauucccucggcccgug

SEQ ID NO: 392420 - RNA, 32 nt, Human
cuacauucccuggccuggcucuccuguagcuc

SEQ ID NO: 392421 - RNA, 32 nt, Human
cuacauuccuaaguguucaccaguggaacaga

SEQ ID NO: 392422 - RNA, 32 nt, Human
cuacauuccucuccucuucacuagccucucug

SEQ ID NO: 392423 - RNA, 32 nt, Human
cuacauucuaccaagcugcucuuuuaaaaguc

SEQ ID NO: 392424 - RNA, 32 nt, Human
cuacauucugauuuuuauuuucuacuuuuauu

SEQ ID NO: 392425 - RNA, 32 nt, Human
cuacauugagacugcuuugagaaguuucuagc

SEQ ID NO: 392426 - RNA, 23 nt, Human
cuacauugcccaggcuggucuca

SEQ ID NO: 392427 - RNA, 32 nt, Human
cuacauugccuaaauccauuuguuucuuugga

SEQ ID NO: 392428 - RNA, 32 nt, Human
cuacauuguaaguuccuugagggcagggccau

SEQ ID NO: 392429 - RNA, 32 nt, Human
cuacauuuaguucuccccacucugauccccug

SEQ ID NO: 392430 - RNA, 32 nt, Human
cuacauuucuguccucccugcguucucagcuu

SEQ ID NO: 392431 - RNA, 32 nt, Human
cuacauuuuccccaaaacauuuauuuugccau

SEQ ID NO: 392432 - RNA, 32 nt, Human
cuaccaaaaauacaaaaauuagccagacgugg

SEQ ID NO: 392433 - RNA, 32 nt, Human
cuaccaaaaauacaaaaauuagccaggcauag

SEQ ID NO: 392434 - RNA, 32 nt, Human
cuaccaaaaauacaaaaauuagccaggcgugg

SEQ ID NO: 392435 - RNA, 32 nt, Human
cuaccaaaaauacaaaaauuagccgggcgugg

SEQ ID NO: 392436 - RNA, 32 nt, Human
cuaccaaaaauacaaaaauuagccgggugugg

SEQ ID NO: 392437 - RNA, 32 nt, Human
cuaccaaaaauacaaaaauuagcuagacauag

SEQ ID NO: 392438 - RNA, 32 nt, Human
cuaccaaaaauacaaaaauuagcugggcgugg

SEQ ID NO: 392439 - RNA, 32 nt, Human
cuaccaaaaauacaaaaauuagcugggcuugg

SEQ ID NO: 392440 - RNA, 32 nt, Human
cuaccaaaaauacaaaaauuagcugggugcga

SEQ ID NO: 392441 - RNA, 32 nt, Human
cuaccaaaaauacaaaaauucaccaggcaugg

SEQ ID NO: 392442 - RNA, 21 nt, Human
cuaccaaaacauagaugacag

SEQ ID NO: 392443 - RNA, 32 nt, Human
cuaccaaaacuacaaaaauuagccgggcucac

SEQ ID NO: 392444 - RNA, 32 nt, Human
cuaccaaacagcuuaaauucuucaagaaagaa

SEQ ID NO: 392445 - RNA, 32 nt, Human
cuaccaaagacaaaaagaaaguaaaacauuuc

SEQ ID NO: 392446 - RNA, 20 nt, Human
cuaccaaagcaguguuuaca

SEQ ID NO: 392447 - RNA, 32 nt, Human
cuaccaaagugcugggauuacaggcgugaacc

SEQ ID NO: 392448 - RNA, 32 nt, Human
cuaccaaagugcugggauuacaggcgugagcc

SEQ ID NO: 392449 - RNA, 32 nt, Human
cuaccaaaugugggccacugacugcuaacaga

SEQ ID NO: 392450 - RNA, 32 nt, Human
cuaccaacagaucugcacuuugaagucaaugg

SEQ ID NO: 392451 - RNA, 32 nt, Human
cuaccaaccacugucccagagucaccaaacua

SEQ ID NO: 392452 - RNA, 24 nt, Human
cuaccaaccacuuuaaaccaacca

SEQ ID NO: 392453 - RNA, 32 nt, Human
cuaccaaccccagauaaguaagaguacuauua

SEQ ID NO: 392454 - RNA, 22 nt, Human
cuaccaaccuaaauuucugcca

SEQ ID NO: 392455 - RNA, 32 nt, Human
cuaccaagaaacacaggaagguauuccagugu

SEQ ID NO: 392456 - RNA, 32 nt, Human
cuaccaagacuccacuuccgucuuacccacuu

SEQ ID NO: 392457 - RNA, 32 nt, Human
cuaccaagcagcugggacuacaggucugcacc

SEQ ID NO: 392458 - RNA, 32 nt, Human
cuaccaaggccuucucuuccuucccacccaag

SEQ ID NO: 392459 - RNA, 32 nt, Human
cuaccaaguagcugggauuacagguguguggc

SEQ ID NO: 392460 - RNA, 32 nt, Human
cuaccaaucugaauucgaggcccauaugagag

SEQ ID NO: 392461 - RNA, 32 nt, Human
cuaccaaugcaugcagccacugugcugaauuc

SEQ ID NO: 392462 - RNA, 32 nt, Human
cuaccaaugcuuaaaaccacacccagggagcc

SEQ ID NO: 392463 - RNA, 18 nt, Human
cuaccacaaucuguuguc

SEQ ID NO: 392464 - RNA, 32 nt, Human
cuaccacacacaguaacacugcgucuuccaga

SEQ ID NO: 392465 - RNA, 32 nt, Human
cuaccacacagccgugucugggacacaguugg

SEQ ID NO: 392466 - RNA, 32 nt, Human
cuaccacacccagcuaauuuuguauuucuagu

SEQ ID NO: 392467 - RNA, 32 nt, Human
cuaccacacuccugcagacccugagccagcag

SEQ ID NO: 392468 - RNA, 22 nt, Human
cuaccacagggagacagaggga

SEQ ID NO: 392469 - RNA, 32 nt, Human
cuaccacagggagacagagggagguaagccau

SEQ ID NO: 392470 - RNA, 32 nt, Human
cuaccacaugccaagcacugugcucagggcua

SEQ ID NO: 392471 - RNA, 32 nt, Human
cuaccacauucuguccccaaaauguggaaugc

SEQ ID NO: 392472 - RNA, 27 nt, Human
cuaccaccaccagugagcuccagccug

SEQ ID NO: 392473 - RNA, 18 nt, Human
cuaccaccagggccagcu

SEQ ID NO: 392474 - RNA, 24 nt, Human
cuaccacccacuccguuccugcca

SEQ ID NO: 392475 - RNA, 32 nt, Human
cuaccacccaggacacuggugugaaugacaca

SEQ ID NO: 392476 - RNA, 32 nt, Human
cuaccacccaggcuggagugcaguggugugau

SEQ ID NO: 392477 - RNA, 32 nt, Human
cuaccaccccgcuccaucaucacuauguccag

SEQ ID NO: 392478 - RNA, 20 nt, Human
cuaccacccuauaaccuccc

SEQ ID NO: 392479 - RNA, 31 nt, Human
cuaccacccuuauuggagcacuuuguacucu

SEQ ID NO: 392480 - RNA, 32 nt, Human
cuaccaccuccagggcuggggcuggcgccucc

SEQ ID NO: 392481 - RNA, 32 nt, Human
cuaccaccuucccacuuggcuagcuguccuuu

SEQ ID NO: 392482 - RNA, 32 nt, Human
cuaccaccuuccuccuaccucuucccauauug

SEQ ID NO: 392483 - RNA, 32 nt, Human
cuaccaccuucugaacacuccuacucaucauc

SEQ ID NO: 392484 - RNA, 32 nt, Human
cuaccaccuuggaagguaagagguuaguaccu

SEQ ID NO: 392485 - RNA, 32 nt, Human
cuaccacguccggcugauuuuguauuuuuggu

SEQ ID NO: 392486 - RNA, 32 nt, Human
cuaccacuaacucugcucagacugcuuaggaa

SEQ ID NO: 392487 - RNA, 32 nt, Human
cuaccacuccugccaaggaggauuccauuugg

SEQ ID NO: 392488 - RNA, 32 nt, Human
cuaccacugaagcagaaaggagucugggagca

SEQ ID NO: 392489 - RNA, 32 nt, Human
cuaccacugcacuucagccuaggugacauagc

SEQ ID NO: 392490 - RNA, 32 nt, Human
cuaccacugguccacucuggaccucagacucu

SEQ ID NO: 392491 - RNA, 32 nt, Human
cuaccacugugggcugaagugcucugaggucc

SEQ ID NO: 392492 - RNA, 32 nt, Human
cuaccagaagugaaugucaaccagcuggaacg

SEQ ID NO: 392493 - RNA, 32 nt, Human
cuaccagagagggaggacugaacagcaagggg

SEQ ID NO: 392494 - RNA, 32 nt, Human
cuaccagagcagagaagggcaggagaggaaga

SEQ ID NO: 392495 - RNA, 32 nt, Human
cuaccagaugaaacuggauauaaucugagaca

SEQ ID NO: 392496 - RNA, 32 nt, Human
cuaccagaugagccacugguuccacuggagcu

SEQ ID NO: 392497 - RNA, 31 nt, Human
cuaccagcagcuaucccuaggagggagucuc

SEQ ID NO: 392498 - RNA, 32 nt, Human
cuaccagccucagaguuccggaaagguagagc

SEQ ID NO: 392499 - RNA, 32 nt, Human
cuaccagccucggccuucugaagugcugggau

SEQ ID NO: 392500 - RNA, 32 nt, Human
cuaccagcuaacuccagucuccugacauuaag

SEQ ID NO: 392501 - RNA, 32 nt, Human
cuaccagcuauacaacccugacuucagaguuu

SEQ ID NO: 392502 - RNA, 32 nt, Human
cuaccagcuguccugagggcugaaggaucaug

SEQ ID NO: 392503 - RNA, 32 nt, Human
cuaccaggaggagaccagguugcaguggcgua

SEQ ID NO: 392504 - RNA, 32 nt, Human
cuaccaggccacaacaacgacacccaccucac

SEQ ID NO: 392505 - RNA, 32 nt, Human
cuaccaggccuucagguccucauaaagaaaag

SEQ ID NO: 392506 - RNA, 32 nt, Human
cuaccaggcugaaugcuggagaaaacuggcua

SEQ ID NO: 392507 - RNA, 32 nt, Human
cuaccagggggaccuggaccuggagcuggacu

SEQ ID NO: 392508 - RNA, 32 nt, Human
cuaccagguagagagacacagagcuguguaca

SEQ ID NO: 392509 - RNA, 20 nt, Human
cuaccagguagcaguugaca

SEQ ID NO: 392510 - RNA, 32 nt, Human
cuaccagguggggaguggaaauucagccugcu

SEQ ID NO: 392511 - RNA, 32 nt, Human
cuaccaguccccaguuccccagcccugcugug

SEQ ID NO: 392512 - RNA, 32 nt, Human
cuaccaguggcccugugauaccacagacugug

SEQ ID NO: 392513 - RNA, 32 nt, Human
cuaccauaaccaguuugcgagucaaauggcau

SEQ ID NO: 392514 - RNA, 32 nt, Human
cuaccaucagaaaagaggccaaacuucuauca

SEQ ID NO: 392515 - RNA, 32 nt, Human
cuaccaucagggacaggaugaccuggagaacu

SEQ ID NO: 392516 - RNA, 32 nt, Human
cuaccauccacuguccauauucagucccagcc

SEQ ID NO: 392517 - RNA, 32 nt, Human
cuaccaucucucucuuaaaacgagaucagguu

SEQ ID NO: 392518 - RNA, 32 nt, Human
cuaccaugaaaagaagaggaaaagugagggaa

SEQ ID NO: 392519 - RNA, 32 nt, Human
cuaccaugacauauauuugaaauugcuuugga

SEQ ID NO: 392520 - RNA, 32 nt, Human
cuaccaugcauucaugucaaugccacauaucu

SEQ ID NO: 392521 - RNA, 32 nt, Human
cuaccaugcuccuuccuucaucccgagaggcu

SEQ ID NO: 392522 - RNA, 32 nt, Human
cuaccauugcagauuucuucugaccccaaaug

SEQ ID NO: 392523 - RNA, 32 nt, Human
cuaccauugccuccucaccuuccuccacuacg

SEQ ID NO: 392524 - RNA, 32 nt, Human
cuacccaaauguguauuuuggcaauuuggugg

SEQ ID NO: 392525 - RNA, 22 nt, Human
cuacccaacauggugaaacccc

SEQ ID NO: 392526 - RNA, 32 nt, Human
cuacccaacauggugaaaccccaucucuucua

SEQ ID NO: 392527 - RNA, 32 nt, Human
cuacccaacauucauuccccaccuucuugcug

SEQ ID NO: 392528 - RNA, 32 nt, Human
cuacccaagaaacaugaacacagggagucaug

SEQ ID NO: 392529 - RNA, 32 nt, Human
cuacccaaugcucugcucccagccuggacuag

SEQ ID NO: 392530 - RNA, 32 nt, Human
cuacccacccucccccagacccccguuuccuc

SEQ ID NO: 392531 - RNA, 32 nt, Human
cuacccacccucuucucucuucucuucucccu

SEQ ID NO: 392532 - RNA, 32 nt, Human
cuacccacuuccauucccguggucuccuugca

SEQ ID NO: 392533 - RNA, 32 nt, Human
cuacccacuucuucuuucuucccuuuccuucc

SEQ ID NO: 392534 - RNA, 32 nt, Human
cuacccagacaaggagcugacuugucaggaag

SEQ ID NO: 392535 - RNA, 32 nt, Human
cuacccagaccagugcugguggaaggaggacc

SEQ ID NO: 392536 - RNA, 32 nt, Human
cuacccagagagcagcugcuguucuuuauuuu

SEQ ID NO: 392537 - RNA, 32 nt, Human
cuacccagagggcugccgccgccucuccaagu

SEQ ID NO: 392538 - RNA, 32 nt, Human
cuacccagcugugugugaggaggaccugaugc

SEQ ID NO: 392539 - RNA, 32 nt, Human
cuacccaggaggcugagacaggagaaucgcuu

SEQ ID NO: 392540 - RNA, 32 nt, Human
cuacccaggaggcugaggcaggagaaucgcug

SEQ ID NO: 392541 - RNA, 32 nt, Human
cuacccaggaggcugaggcaggagaaucgcuu

SEQ ID NO: 392542 - RNA, 32 nt, Human
cuacccaggaggcugaggcaggagaauugcug

SEQ ID NO: 392543 - RNA, 32 nt, Human
cuacccaggagggagagcgcagcugcugcagg

SEQ ID NO: 392544 - RNA, 32 nt, Human
cuacccagucgaguccucuuguggagcccaca

SEQ ID NO: 392545 - RNA, 32 nt, Human
cuacccauccccaacauucagcucagcugccu

SEQ ID NO: 392546 - RNA, 32 nt, Human
cuacccauuagaugcaggcucuaccucaagua

SEQ ID NO: 392547 - RNA, 32 nt, Human
cuacccauuuucugccaagauucaagcagucg

SEQ ID NO: 392548 - RNA, 22 nt, Human
cuaccccaaaauuguuuucuca

SEQ ID NO: 392549 - RNA, 32 nt, Human
cuaccccaagagcagggauauuagcugugucc

SEQ ID NO: 392550 - RNA, 21 nt, Human
cuaccccaagucacuaccuca

SEQ ID NO: 392551 - RNA, 32 nt, Human
cuaccccacauccugucuuagccgcagucucc

SEQ ID NO: 392552 - RNA, 32 nt, Human
cuaccccagaaauaagaaucaagagcagcuau

SEQ ID NO: 392553 - RNA, 32 nt, Human
cuaccccagacacacccucucuccucggauga

SEQ ID NO: 392554 - RNA, 32 nt, Human
cuaccccagcacacacacucccugccacuguu

SEQ ID NO: 392555 - RNA, 23 nt, Human
cuaccccagccaucauuuucuca

SEQ ID NO: 392556 - RNA, 32 nt, Human
cuaccccagcuaaccucuucuggaccaggaga

SEQ ID NO: 392557 - RNA, 32 nt, Human
cuaccccagcuccgugugaugcccaguaaagc

SEQ ID NO: 392558 - RNA, 32 nt, Human
cuaccccaggaggcucuuaucuccccagcccc

SEQ ID NO: 392559 - RNA, 22 nt, Human
cuaccccagguuccuuuccuua

SEQ ID NO: 392560 - RNA, 32 nt, Human
cuacccccaaguuucuccucugacccaucagc

SEQ ID NO: 392561 - RNA, 32 nt, Human
cuacccccacagaccugcucuggacacuugcu

SEQ ID NO: 392562 - RNA, 32 nt, Human
cuacccccaccugaacuucagcauucccauca

SEQ ID NO: 392563 - RNA, 18 nt, Human
cuacccccacugccccga

SEQ ID NO: 392564 - RNA, 32 nt, Human
cuacccccaggagauauucacuguaaugaaua

SEQ ID NO: 392565 - RNA, 22 nt, Human
cuacccccaguuucugcuguua

SEQ ID NO: 392566 - RNA, 32 nt, Human
cuacccccggagccauggccucugcuggggug

SEQ ID NO: 392567 - RNA, 32 nt, Human
cuacccccugggcuggagggaggcagggcacc

SEQ ID NO: 392568 - RNA, 32 nt, Human
cuacccccuuccuucuuugucuugccccuagg

SEQ ID NO: 392569 - RNA, 32 nt, Human
cuaccccgacuggccggccccgccccgugccc

SEQ ID NO: 392570 - RNA, 32 nt, Human
cuaccccggucccucccuuucugggguggggc

SEQ ID NO: 392571 - RNA, 32 nt, Human
cuaccccuauguccaaauuuucagccaccaca

SEQ ID NO: 392572 - RNA, 32 nt, Human
cuaccccugcucccauuccucccuccggccau

SEQ ID NO: 392573 - RNA, 32 nt, Human
cuaccccugcugcccagcuccccagccuguuc

SEQ ID NO: 392574 - RNA, 32 nt, Human
cuaccccuguagcugugaaccuccgggcucau

SEQ ID NO: 392575 - RNA, 32 nt, Human
cuaccccugucuccccuucaaggacuucuccc

SEQ ID NO: 392576 - RNA, 32 nt, Human
cuacccgagacagggcaucacuguguugccaa

SEQ ID NO: 392577 - RNA, 32 nt, Human
cuacccgauccuggcccuccaccugccuccag

SEQ ID NO: 392578 - RNA, 32 nt, Human
cuacccgccacugcauuccacagccuguagaa

SEQ ID NO: 392579 - RNA, 32 nt, Human
cuacccgcgcccgucugcucucucucuucauu

SEQ ID NO: 392580 - RNA, 32 nt, Human
cuacccgcuuccuggagcaaacaguugggggu

SEQ ID NO: 392581 - RNA, 32 nt, Human
cuacccggaaggcugaggcaggagaauggcgu

SEQ ID NO: 392582 - RNA, 32 nt, Human
cuacccggaggcaccaugagcguggaggcgua

SEQ ID NO: 392583 - RNA, 32 nt, Human
cuacccggaugaagagguuggaggugggcagc

SEQ ID NO: 392584 - RNA, 32 nt, Human
cuacccgggaggcaguggcugcagugagcuga

SEQ ID NO: 392585 - RNA, 32 nt, Human
cuacccgggaggcgaagagaagcacagaagaa

SEQ ID NO: 392586 - RNA, 32 nt, Human
cuacccgggaggcugaggcaggagaaucacuu

SEQ ID NO: 392587 - RNA, 32 nt, Human
cuacccgggaggcugaggcaggagaaucgcuu

SEQ ID NO: 392588 - RNA, 32 nt, Human
cuacccgggaggcugaggcaggagaauggcgu

SEQ ID NO: 392589 - RNA, 32 nt, Human
cuacccgggaggcugaggcaggagaauugcuu

SEQ ID NO: 392590 - RNA, 32 nt, Human
cuacccuaagccagccaccccucuucacagug

SEQ ID NO: 392591 - RNA, 32 nt, Human
cuacccuaauccccacuucccugcagaaucaa

SEQ ID NO: 392592 - RNA, 32 nt, Human
cuacccuacaugcucccucuggcaccauuuca

SEQ ID NO: 392593 - RNA, 32 nt, Human
cuacccuacccucauuccccgacacccucugg

SEQ ID NO: 392594 - RNA, 32 nt, Human
cuacccuagggaggccaggaggagcuucggag

SEQ ID NO: 392595 - RNA, 32 nt, Human
cuacccuagggaggccuccaucuggaaauggg

SEQ ID NO: 392596 - RNA, 32 nt, Human
cuacccuaucccugcccugggagaccuggggu

SEQ ID NO: 392597 - RNA, 32 nt, Human
cuacccucacugcucuccugugcccagguuau

SEQ ID NO: 392598 - RNA, 32 nt, Human
cuacccucagucucccugucugugguuccaga

SEQ ID NO: 392599 - RNA, 32 nt, Human
cuacccuccucucuccccagaugugacuacug

SEQ ID NO: 392600 - RNA, 32 nt, Human
cuacccuccucucuucccagaugugaccacug

SEQ ID NO: 392601 - RNA, 32 nt, Human
cuacccucucccaccacacaguacugauugcu

SEQ ID NO: 392602 - RNA, 32 nt, Human
cuacccucucccugccuggcacaugccugcca

SEQ ID NO: 392603 - RNA, 32 nt, Human
cuacccucugcacccucaagaaacccccagug

SEQ ID NO: 392604 - RNA, 32 nt, Human
cuacccucuuccugggaaaguaauugcugagc

SEQ ID NO: 392605 - RNA, 32 nt, Human
cuacccugaaccuauguguccucuaagucagg

SEQ ID NO: 392606 - RNA, 32 nt, Human
cuacccugagccaccacccucagccuuggugu

SEQ ID NO: 392607 - RNA, 32 nt, Human
cuacccugcaacuucuauccuuucuuccgcac

SEQ ID NO: 392608 - RNA, 32 nt, Human
cuacccugcaccugaccucaugauccccucca

SEQ ID NO: 392609 - RNA, 32 nt, Human
cuacccuggaaucucacuggugccccaggaga

SEQ ID NO: 392610 - RNA, 32 nt, Human
cuacccuggagccaggagcaucaggguuggcu

SEQ ID NO: 392611 - RNA, 32 nt, Human
cuacccuggagugcugcagugugugagagcug

SEQ ID NO: 392612 - RNA, 32 nt, Human
cuacccuggugggauggaugguucuguaaaug

SEQ ID NO: 392613 - RNA, 32 nt, Human
cuacccuguccuuuuaauguaagucacucccc

SEQ ID NO: 392614 - RNA, 32 nt, Human
cuacccuguggaggcugaggggucgggggaag

SEQ ID NO: 392615 - RNA, 32 nt, Human
cuacccuuaguagugugaccagucagacaacu

SEQ ID NO: 392616 - RNA, 32 nt, Human
cuacccuucucuuccucuuuuaagcccucucu

SEQ ID NO: 392617 - RNA, 32 nt, Human
cuacccuuuccucgcuccgggccggcagugug

SEQ ID NO: 392618 - RNA, 32 nt, Human
cuacccuuugaucaccagugugaacagaaucc

SEQ ID NO: 392619 - RNA, 32 nt, Human
cuaccgaagugcuaggauuacagacguaagcc

SEQ ID NO: 392620 - RNA, 32 nt, Human
cuaccgaguagcugggacuacaggcacgcgcc

SEQ ID NO: 392621 - RNA, 32 nt, Human
cuaccgaugcacagcaaccagccaauccugcu

SEQ ID NO: 392622 - RNA, 32 nt, Human
cuaccgcaggcaaagguucccaccuuacuaca

SEQ ID NO: 392623 - RNA, 32 nt, Human
cuaccgcaggcgaagguucccaccuuacuaca

SEQ ID NO: 392624 - RNA, 21 nt, Human
cuaccgccgccgccgccgccg

SEQ ID NO: 392625 - RNA, 32 nt, Human
cuaccgccuccuggaccucuuugcucguccuu

SEQ ID NO: 392626 - RNA, 32 nt, Human
cuaccgcuacucuccccaagccuguguugcag

SEQ ID NO: 392627 - RNA, 32 nt, Human
cuaccgcucccucugcugaacuauuccggaug

SEQ ID NO: 392628 - RNA, 32 nt, Human
cuaccggagccuaagaccagaaggcaggugag

SEQ ID NO: 392629 - RNA, 32 nt, Human
cuaccggccuccuauucuccugcuccaccccc

SEQ ID NO: 392630 - RNA, 32 nt, Human
cuaccggggaggcugaggcaggagaaucgcua

SEQ ID NO: 392631 - RNA, 32 nt, Human
cuaccgguaauuucccaguagcuuugaauauu

SEQ ID NO: 392632 - RNA, 23 nt, Human
cuaccggugcaggagcacaggga

SEQ ID NO: 392633 - RNA, 32 nt, Human
cuaccggugcaggagcacagggaucaguuguc

SEQ ID NO: 392634 - RNA, 32 nt, Human
cuaccgucgcucagcaacaccaaaaagagaaa

SEQ ID NO: 392635 - RNA, 32 nt, Human
cuaccuaagcacaugucugugacaaggucuua

SEQ ID NO: 392636 - RNA, 32 nt, Human
cuaccuaaggacaagacacugaggagauacug

SEQ ID NO: 392637 - RNA, 32 nt, Human
cuaccuacacauaggaaggccaagguugaucc

SEQ ID NO: 392638 - RNA, 32 nt, Human
cuaccuacuccgaguguccuccccugccccac

SEQ ID NO: 392639 - RNA, 32 nt, Human
cuaccuacugcccccauucauccuggcuuucc

SEQ ID NO: 392640 - RNA, 32 nt, Human
cuaccuacugggugguggggagggaagcuucu

SEQ ID NO: 392641 - RNA, 32 nt, Human
cuaccuagaaaaucacagccuccuuauaaugc

SEQ ID NO: 392642 - RNA, 32 nt, Human
cuaccuaggaggcugaggcaggagaauagcug

SEQ ID NO: 392643 - RNA, 32 nt, Human
cuaccuagugcuuuuucaaucaugccugauua

SEQ ID NO: 392644 - RNA, 32 nt, Human
cuaccuaguuucucccucuuguccugcacaag

SEQ ID NO: 392645 - RNA, 32 nt, Human
cuaccuauacauacgugcacacacacauacau

SEQ ID NO: 392646 - RNA, 32 nt, Human
cuaccuauaguuguuggccuuuuugcauauaa

SEQ ID NO: 392647 - RNA, 32 nt, Human
cuaccuaugcagauaaccuggaguggacuuca

SEQ ID NO: 392648 - RNA, 32 nt, Human
cuaccuauuccugcacuuauuacccucauucu

SEQ ID NO: 392649 - RNA, 32 nt, Human
cuaccucacaacaaccauuugccuccuuuaag

SEQ ID NO: 392650 - RNA, 32 nt, Human
cuaccucacagaacucugaacccuacagaaau

SEQ ID NO: 392651 - RNA, 32 nt, Human
cuaccucacaggacuguugugaggcuuggcaa

SEQ ID NO: 392652 - RNA, 32 nt, Human
cuaccucacagggguguugugaggcuuuaacu

SEQ ID NO: 392653 - RNA, 32 nt, Human
cuaccucacuccugaggggagauguuucugca

SEQ ID NO: 392654 - RNA, 32 nt, Human
cuaccucacugagagggaacagaaggauauug

SEQ ID NO: 392655 - RNA, 32 nt, Human
cuaccucacugcauugcacuggaccugggaug

SEQ ID NO: 392656 - RNA, 32 nt, Human
cuaccucacuggucuggaaguccuccgaagac

SEQ ID NO: 392657 - RNA, 32 nt, Human
cuaccucagaaacugcagcuugguucugauga

SEQ ID NO: 392658 - RNA, 32 nt, Human
cuaccucagcacaacuucauuaucacaaaaga

SEQ ID NO: 392659 - RNA, 32 nt, Human
cuaccucauggaguauucucccagaaacugca

SEQ ID NO: 392660 - RNA, 32 nt, Human
cuaccuccaaaguguugggauuacaggcaaug

SEQ ID NO: 392661 - RNA, 32 nt, Human
cuaccuccaccugagccucacccugcuguuga

SEQ ID NO: 392662 - RNA, 32 nt, Human
cuaccuccacuuccuuucccuugcucacucug

SEQ ID NO: 392663 - RNA, 32 nt, Human
cuaccucccaaagcagccugaccugcguggga

SEQ ID NO: 392664 - RNA, 32 nt, Human
cuaccucccacugcacugccgguuucccuggg

SEQ ID NO: 392665 - RNA, 32 nt, Human
cuaccucccagcucuguuuuccauccccuuca

SEQ ID NO: 392666 - RNA, 32 nt, Human
cuaccuccccucccaggaccccgagacacccc

SEQ ID NO: 392667 - RNA, 32 nt, Human
cuaccuccccuccccaggacacucccaggcuu

SEQ ID NO: 392668 - RNA, 32 nt, Human
cuaccucccuaaaaguaaauacaaagagaacu

SEQ ID NO: 392669 - RNA, 32 nt, Human
cuaccucccugccuuggucccgccaacacaug

SEQ ID NO: 392670 - RNA, 32 nt, Human
cuaccuccuccuccucaccaccuuggggcuuc

SEQ ID NO: 392671 - RNA, 32 nt, Human
cuaccuccuuuagagccuucugugggggcaca

SEQ ID NO: 392672 - RNA, 32 nt, Human
cuaccucuaccaggaaucucugcugcucagca

SEQ ID NO: 392673 - RNA, 32 nt, Human
cuaccucucacgaaagcugacugugugaugaa

SEQ ID NO: 392674 - RNA, 32 nt, Human
cuaccucucaggaguucauuugucucucuguc

SEQ ID NO: 392675 - RNA, 32 nt, Human
cuaccucucaugauuacuauggagauugaaua

SEQ ID NO: 392676 - RNA, 32 nt, Human
cuaccucuccacacuuccccagaagggaaaag

SEQ ID NO: 392677 - RNA, 32 nt, Human
cuaccucucccagacagaguuggggucaaauu

SEQ ID NO: 392678 - RNA, 32 nt, Human
cuaccucucccucugcugacuuaaugucguga

SEQ ID NO: 392679 - RNA, 32 nt, Human
cuaccucucucuucccuagggccuuuugugga

SEQ ID NO: 392680 - RNA, 32 nt, Human
cuaccucucugaguccguuugcuuuauucaaa

SEQ ID NO: 392681 - RNA, 32 nt, Human
cuaccucugcccugcccuccagccugggacaa

SEQ ID NO: 392682 - RNA, 32 nt, Human
cuaccucugcucuuggaggagauggggacagg

SEQ ID NO: 392683 - RNA, 32 nt, Human
cuaccucuuccaggaagcacaggccaggggau

SEQ ID NO: 392684 - RNA, 32 nt, Human
cuaccucuuuggccaggacccuugccagccag

SEQ ID NO: 392685 - RNA, 32 nt, Human
cuaccugaaccccucuugccacugccuucuac

SEQ ID NO: 392686 - RNA, 32 nt, Human
cuaccugauggaaacuuuucuuacccuuauag

SEQ ID NO: 392687 - RNA, 32 nt, Human
cuaccugauggaccuccuucgcuggaaggucu

SEQ ID NO: 392688 - RNA, 32 nt, Human
cuaccugauucugccacuuacccacacugucu

SEQ ID NO: 392689 - RNA, 32 nt, Human
cuaccugcacacagaagcccauugucgccggc

SEQ ID NO: 392690 - RNA, 32 nt, Human
cuaccugcacacuguccuauuauauucauucu

SEQ ID NO: 392691 - RNA, 32 nt, Human
cuaccugcacccgagcccuggggcucagcccc

SEQ ID NO: 392692 - RNA, 32 nt, Human
cuaccugcaccucacagugcaaggcuuuugcc

SEQ ID NO: 392693 - RNA, 32 nt, Human
cuaccugcacucccgcccugaggcccggagcc

SEQ ID NO: 392694 - RNA, 32 nt, Human
cuaccugcagugaguuccagaccugcccgucc

SEQ ID NO: 392695 - RNA, 18 nt, Human
cuaccugcccugccugcc

SEQ ID NO: 392696 - RNA, 20 nt, Human
cuaccugccuggugcugguc

SEQ ID NO: 392697 - RNA, 32 nt, Human
cuaccugcggccgagccagggagcgagagggc

SEQ ID NO: 392698 - RNA, 32 nt, Human
cuaccugcucuguccucuuccuugccagauga

SEQ ID NO: 392699 - RNA, 32 nt, Human
cuaccugcuuuuccucucucucccaaggccug

SEQ ID NO: 392700 - RNA, 32 nt, Human
cuaccuggaacagcacaggaucuggcagaccc

SEQ ID NO: 392701 - RNA, 32 nt, Human
cuaccuggacgggcccaggcuuggggacucug

SEQ ID NO: 392702 - RNA, 31 nt, Human
cuaccuggcaaagcuuuuggauuucaaagcu

SEQ ID NO: 392703 - RNA, 32 nt, Human
cuaccuggcuacccccuuccauggccccagcu

SEQ ID NO: 392704 - RNA, 32 nt, Human
cuaccugggagaugguggaggaugaagcccug

SEQ ID NO: 392705 - RNA, 32 nt, Human
cuaccugggaggcugaggaaggagaaucgcuu

SEQ ID NO: 392706 - RNA, 32 nt, Human
cuaccugggaggcugaggcaggagaaucacuu

SEQ ID NO: 392707 - RNA, 32 nt, Human
cuaccugggaggcugaggcaggagaaucgcuu

SEQ ID NO: 392708 - RNA, 32 nt, Human
cuaccugggaggcugaggcgggagaaucaccu

SEQ ID NO: 392709 - RNA, 32 nt, Human
cuaccugggaggcugagguaugaggauugcuu

SEQ ID NO: 392710 - RNA, 32 nt, Human
cuaccugggaggcugaggugggaggaucgcuu

SEQ ID NO: 392711 - RNA, 32 nt, Human
cuaccugggagguggagggagacaggagagaa

SEQ ID NO: 392712 - RNA, 32 nt, Human
cuaccugggaucaaacuauggccccacccuua

SEQ ID NO: 392713 - RNA, 32 nt, Human
cuaccuggggaagcggggguuggguguuuuag

SEQ ID NO: 392714 - RNA, 32 nt, Human
cuaccuguaaaggaaaguagaccuggauucau

SEQ ID NO: 392715 - RNA, 18 nt, Human
cuaccugucucccacaga

SEQ ID NO: 392716 - RNA, 32 nt, Human
cuaccugugauuuccagcaagauuacuguuau

SEQ ID NO: 392717 - RNA, 32 nt, Human
cuaccugugccaccccugcccugauuccacgg

SEQ ID NO: 392718 - RNA, 32 nt, Human
cuaccugugggagcgcuacccgggaggcgaag

SEQ ID NO: 392719 - RNA, 32 nt, Human
cuaccugugguguugggaccaagccuccaaua

SEQ ID NO: 392720 - RNA, 32 nt, Human
cuaccuguuagacaaugguugcucuugggcuc

SEQ ID NO: 392721 - RNA, 32 nt, Human
cuaccuguucuguguuggcaagggagagugcc

SEQ ID NO: 392722 - RNA, 32 nt, Human
cuaccuguugcagagucaagggacuugcaugu

SEQ ID NO: 392723 - RNA, 32 nt, Human
cuaccuguuuauagccugcugcuccuggugaa

SEQ ID NO: 392724 - RNA, 32 nt, Human
cuaccuuaagucucccccucuuuuauccuugc

SEQ ID NO: 392725 - RNA, 32 nt, Human
cuaccuuagaagaagaaagaaagagggaaaga

SEQ ID NO: 392726 - RNA, 32 nt, Human
cuaccuuaguuuccuuuucuguuuccuguccu

SEQ ID NO: 392727 - RNA, 32 nt, Human
cuaccuucacuucuccccagcucugcccucug

SEQ ID NO: 392728 - RNA, 32 nt, Human
cuaccuucagaggcaugccuccccagccaccc

SEQ ID NO: 392729 - RNA, 32 nt, Human
cuaccuucagccagagccagagagcuggauau

SEQ ID NO: 392730 - RNA, 32 nt, Human
cuaccuucauuuucuaauucucuuuucaaaca

SEQ ID NO: 392731 - RNA, 32 nt, Human
cuaccuuccagaguuacuucagugcauaaagu

SEQ ID NO: 392732 - RNA, 32 nt, Human
cuaccuucccacucaccuuccccagcuacaaa

SEQ ID NO: 392733 - RNA, 32 nt, Human
cuaccuuccucucuccccacaugugacuacug

SEQ ID NO: 392734 - RNA, 32 nt, Human
cuaccuuccuuccuccucuguuuagcaaagga

SEQ ID NO: 392735 - RNA, 32 nt, Human
cuaccuucucagaauuaacaggggauguuaau

SEQ ID NO: 392736 - RNA, 32 nt, Human
cuaccuucugcacuuacuccccaucagaagau

SEQ ID NO: 392737 - RNA, 16 nt, Human
cuaccuucuucacaga

SEQ ID NO: 392738 - RNA, 32 nt, Human
cuaccuucuuuucuuccucauuuccuucuuuu

SEQ ID NO: 392739 - RNA, 32 nt, Human
cuaccuuguuuuugguuggcuuuuguuguugu

SEQ ID NO: 392740 - RNA, 32 nt, Human
cuaccuuuaagaucagccugacuuaucaaacg

SEQ ID NO: 392741 - RNA, 32 nt, Human
cuaccuuuacucccucuccuucaauuccacuu

SEQ ID NO: 392742 - RNA, 32 nt, Human
cuaccuuuccucaccucuaucucucucaacca

SEQ ID NO: 392743 - RNA, 32 nt, Human
cuaccuuucucccucuccuucccuucaucaca

SEQ ID NO: 392744 - RNA, 32 nt, Human
cuaccuuugcagauuugcuccuuucccauugc

SEQ ID NO: 392745 - RNA, 32 nt, Human
cuaccuuugcugggaucccccuccuccauccu

SEQ ID NO: 392746 - RNA, 32 nt, Human
cuaccuuuggaucugugagaaggugaauacaa

SEQ ID NO: 392747 - RNA, 32 nt, Human
cuaccuuuucacuguuucuuccuuccuuuaug

SEQ ID NO: 392748 - RNA, 32 nt, Human
cuacgaaaaauacaaaaauuagcugggcauag

SEQ ID NO: 392749 - RNA, 32 nt, Human
cuacgaaaaauacaaaauuuagccgggcaugg

SEQ ID NO: 392750 - RNA, 32 nt, Human
cuacgaagagucgggguugagccccagcugag

SEQ ID NO: 392751 - RNA, 32 nt, Human
cuacgaagcuugaaggauggcuggagcuuagg

SEQ ID NO: 392752 - RNA, 32 nt, Human
cuacgaauagccacugcauaccaaccugggca

SEQ ID NO: 392753 - RNA, 32 nt, Human
cuacgaccuaccacagcagcccgggcucaacu

SEQ ID NO: 392754 - RNA, 32 nt, Human
cuacgagaagcacagucucugccugaggcucc

SEQ ID NO: 392755 - RNA, 32 nt, Human
cuacgagaaucagucuaacagagaugccgaug

SEQ ID NO: 392756 - RNA, 32 nt, Human
cuacgagauuagccuggauauuaacuugucuu

SEQ ID NO: 392757 - RNA, 32 nt, Human
cuacgagcuccucaaguaucccagagcauccc

SEQ ID NO: 392758 - RNA, 32 nt, Human
cuacgaggcuuauccuggcaaugggguaguca

SEQ ID NO: 392759 - RNA, 32 nt, Human
cuacgagugcuacagugaggccuggacacaug

SEQ ID NO: 392760 - RNA, 32 nt, Human
cuacgaguuuuccagauuuaggagacuucaga

SEQ ID NO: 392761 - RNA, 32 nt, Human
cuacgaucacuuccgcuccugccugcacgcgc

SEQ ID NO: 392762 - RNA, 32 nt, Human
cuacgauccaggcuggaguugcgcucggccgg

SEQ ID NO: 392763 - RNA, 32 nt, Human
cuacgaugaucuguuucucagacaugcagcac

SEQ ID NO: 392764 - RNA, 32 nt, Human
cuacgauggguggaucaccugaggucaggagu

SEQ ID NO: 392765 - RNA, 32 nt, Human
cuacgauuccuugaguguuuuuccagcuaccu

SEQ ID NO: 392766 - RNA, 32 nt, Human
cuacgcaggaggccaaggcaggagaaucacuu

SEQ ID NO: 392767 - RNA, 32 nt, Human
cuacgccaaugaggccucaucugugcucucgc

SEQ ID NO: 392768 - RNA, 32 nt, Human
cuacgccaccuugcccagcccuggccaagccc

SEQ ID NO: 392769 - RNA, 32 nt, Human
cuacgccacugcacuccagccuggaggccaga

SEQ ID NO: 392770 - RNA, 32 nt, Human
cuacgccaggcacaaggcaucuuguugccuug

SEQ ID NO: 392771 - RNA, 32 nt, Human
cuacgcccgaggcucccuucccuuccccagcc

SEQ ID NO: 392772 - RNA, 32 nt, Human
cuacgcccuccccuccccagccuuuuccagaa

SEQ ID NO: 392773 - RNA, 32 nt, Human
cuacgcccuccccuccccggcccuccacagcu

SEQ ID NO: 392774 - RNA, 32 nt, Human
cuacgccuggauccgggagcauggcccagaga

SEQ ID NO: 392775 - RNA, 32 nt, Human
cuacgccuguaaucccagcacuuugggaggcc

SEQ ID NO: 392776 - RNA, 20 nt, Human
cuacgcggccuuccacgccc

SEQ ID NO: 392777 - RNA, 32 nt, Human
cuacgcucaaaggcaucucuauaaggauguga

SEQ ID NO: 392778 - RNA, 32 nt, Human
cuacgcucacugcaggcuccgccuccuggguu

SEQ ID NO: 392779 - RNA, 32 nt, Human
cuacgcucucagggaaauacaaauaucacguu

SEQ ID NO: 392780 - RNA, 32 nt, Human
cuacgcugaagauggcauccugugaaguccuu

SEQ ID NO: 392781 - RNA, 32 nt, Human
cuacgcugcucgggccauugcccagccagaug

SEQ ID NO: 392782 - RNA, 32 nt, Human
cuacggaaaaucacauccacagaggccagggc

SEQ ID NO: 392783 - RNA, 32 nt, Human
cuacggagagggguggacggcucugcacgggc

SEQ ID NO: 392784 - RNA, 32 nt, Human
cuacggagaugagacaggcgugcagugugcgc

SEQ ID NO: 392785 - RNA, 32 nt, Human
cuacggaggcuucuccauugucccugcuggag

SEQ ID NO: 392786 - RNA, 32 nt, Human
cuacggagggucuuccugaaacccgcagagga

SEQ ID NO: 392787 - RNA, 32 nt, Human
cuacggaguccaccccucccucucuagaaccc

SEQ ID NO: 392788 - RNA, 32 nt, Human
cuacggcagcaaauugcuacaugugcuggaua

SEQ ID NO: 392789 - RNA, 32 nt, Human
cuacggccagaagaacaaguaccgagcacccc

SEQ ID NO: 392790 - RNA, 32 nt, Human
cuacggcccaccuccuggugcugguguuuuca

SEQ ID NO: 392791 - RNA, 32 nt, Human
cuacggcccuggaacggggccauggagaagcu

SEQ ID NO: 392792 - RNA, 32 nt, Human
cuacggcgccuggagcagggucugcagcggcc

SEQ ID NO: 392793 - RNA, 32 nt, Human
cuacggcuguugccaugaggcgaggcuaggga

SEQ ID NO: 392794 - RNA, 32 nt, Human
cuacgggcacacacagaaaacagcagccugcg

SEQ ID NO: 392795 - RNA, 32 nt, Human
cuacggggccgcggccacuagcgcggcgccgc

SEQ ID NO: 392796 - RNA, 32 nt, Human
cuacguauuuuauuuuacauagaucauauugu

SEQ ID NO: 392797 - RNA, 32 nt, Human
cuacgucuuggacgggaaucacuggggcagag

SEQ ID NO: 392798 - RNA, 32 nt, Human
cuacgugacccaggcuggaguguaguagcuau

SEQ ID NO: 392799 - RNA, 32 nt, Human
cuacgugcacaucugggcacaguaccuuuccu

SEQ ID NO: 392800 - RNA, 32 nt, Human
cuacgugcuauugaacacuaaaaauuuuucug

SEQ ID NO: 392801 - RNA, 32 nt, Human
cuacgugggaggcagaggcaggagaaucauuu

SEQ ID NO: 392802 - RNA, 32 nt, Human
cuacgugggaggcugaggcaggagaaucacuu

SEQ ID NO: 392803 - RNA, 32 nt, Human
cuacguguacaucauuaauccccauugccaag

SEQ ID NO: 392804 - RNA, 32 nt, Human
cuacguuaaauacacuggauuagucugucuuc

SEQ ID NO: 392805 - RNA, 32 nt, Human
cuacguucuccagcccacaccccuccaaagcc

SEQ ID NO: 392806 - RNA, 32 nt, Human
cuacguuuaggcaccccuuuccccagccucuc

SEQ ID NO: 392807 - RNA, 32 nt, Human
cuacguuucccaggacucuccccaucuccaga

SEQ ID NO: 392808 - RNA, 32 nt, Human
cuacuaaaaacacaaaaauuagccaggcaugg

SEQ ID NO: 392809 - RNA, 32 nt, Human
cuacuaaaaacacaaaaauuagccaggcgugg

SEQ ID NO: 392810 - RNA, 32 nt, Human
cuacuaaaaacacaaaaauuagccgggcgggg

SEQ ID NO: 392811 - RNA, 32 nt, Human
cuacuaaaaacacaaaaauuagccggguguac

SEQ ID NO: 392812 - RNA, 32 nt, Human
cuacuaaaaacacaaaaauuagcuaggcaugg

SEQ ID NO: 392813 - RNA, 32 nt, Human
cuacuaaaaacacaaaaauuagcugggcaugg

SEQ ID NO: 392814 - RNA, 32 nt, Human
cuacuaaaaacacaaaaauuagcugggcgugg

SEQ ID NO: 392815 - RNA, 32 nt, Human
cuacuaaaaacacaaaaauuagcugggugugg

SEQ ID NO: 392816 - RNA, 32 nt, Human
cuacuaaaaagcgcacgacaaugguagaagca

SEQ ID NO: 392817 - RNA, 32 nt, Human
cuacuaaaaauaaagaaagauuagcugggaca

SEQ ID NO: 392818 - RNA, 32 nt, Human
cuacuaaaaauaacaaaauuagccgggcgugg

SEQ ID NO: 392819 - RNA, 32 nt, Human
cuacuaaaaauacaaaaacuagccaggcaugg

SEQ ID NO: 392820 - RNA, 32 nt, Human
cuacuaaaaauacaaaaacuagccaggugugg

SEQ ID NO: 392821 - RNA, 32 nt, Human
cuacuaaaaauacaaaaacuagccuggcaagg

SEQ ID NO: 392822 - RNA, 32 nt, Human
cuacuaaaaauacaaaaacuagcugggcaugg

SEQ ID NO: 392823 - RNA, 32 nt, Human
cuacuaaaaauacaaaaacuuagccgggcaug

SEQ ID NO: 392824 - RNA, 32 nt, Human
cuacuaaaaauacaaaaacuuagcugggugua

SEQ ID NO: 392825 - RNA, 32 nt, Human
cuacuaaaaauacaaaaagauuagccaggcau

SEQ ID NO: 392826 - RNA, 32 nt, Human
cuacuaaaaauacaaaaagccagguguggugg

SEQ ID NO: 392827 - RNA, 32 nt, Human
cuacuaaaaauacaaaaagccgggcguggugg

SEQ ID NO: 392828 - RNA, 32 nt, Human
cuacuaaaaauacaaaaaguagccaggcaugg

SEQ ID NO: 392829 - RNA, 32 nt, Human
cuacuaaaaauacaaaaaguagcuaggugugg

SEQ ID NO: 392830 - RNA, 32 nt, Human
cuacuaaaaauacaaaaaguuagcugggcaug

SEQ ID NO: 392831 - RNA, 32 nt, Human
cuacuaaaaauacaaaaauagccaggcauggu

SEQ ID NO: 392832 - RNA, 32 nt, Human
cuacuaaaaauacaaaaauagccgggcauggu

SEQ ID NO: 392833 - RNA, 32 nt, Human
cuacuaaaaauacaaaaaucaaccaggcauga

SEQ ID NO: 392834 - RNA, 32 nt, Human
cuacuaaaaauacaaaaaucagccaggcaugg

SEQ ID NO: 392835 - RNA, 32 nt, Human
cuacuaaaaauacaaaaaucagccgggucuca

SEQ ID NO: 392836 - RNA, 32 nt, Human
cuacuaaaaauacaaaaaucagccgggugugg

SEQ ID NO: 392837 - RNA, 32 nt, Human
cuacuaaaaauacaaaaaucagcggggagugg

SEQ ID NO: 392838 - RNA, 32 nt, Human
cuacuaaaaauacaaaaaucagcugggcaugg

SEQ ID NO: 392839 - RNA, 32 nt, Human
cuacuaaaaauacaaaaaugagcaaggcaugg

SEQ ID NO: 392840 - RNA, 32 nt, Human
cuacuaaaaauacaaaaaugagccgggcaugg

SEQ ID NO: 392841 - RNA, 32 nt, Human
cuacuaaaaauacaaaaaugagcuaggcaugg

SEQ ID NO: 392842 - RNA, 32 nt, Human
cuacuaaaaauacaaaaaugagcugggcaugg

SEQ ID NO: 392843 - RNA, 32 nt, Human
cuacuaaaaauacaaaaaugagcugggcgugg

SEQ ID NO: 392844 - RNA, 32 nt, Human
cuacuaaaaauacaaaaaugagcugggcuugg

SEQ ID NO: 392845 - RNA, 32 nt, Human
cuacuaaaaauacaaaaaugagcuggguguga

SEQ ID NO: 392846 - RNA, 32 nt, Human
cuacuaaaaauacaaaaaugagcugggugugg

SEQ ID NO: 392847 - RNA, 32 nt, Human
cuacuaaaaauacaaaaauuaaccaggcguag

SEQ ID NO: 392848 - RNA, 32 nt, Human
cuacuaaaaauacaaaaauuaaccaggcuuga

SEQ ID NO: 392849 - RNA, 32 nt, Human
cuacuaaaaauacaaaaauuaaccaggugugg

SEQ ID NO: 392850 - RNA, 32 nt, Human
cuacuaaaaauacaaaaauuacccaggcauag

SEQ ID NO: 392851 - RNA, 32 nt, Human
cuacuaaaaauacaaaaauuacccgggcuugg

SEQ ID NO: 392852 - RNA, 32 nt, Human
cuacuaaaaauacaaaaauuaccgugguggca

SEQ ID NO: 392853 - RNA, 32 nt, Human
cuacuaaaaauacaaaaauuagaugggcgugg

SEQ ID NO: 392854 - RNA, 32 nt, Human
cuacuaaaaauacaaaaauuagauggguguag

SEQ ID NO: 392855 - RNA, 32 nt, Human
cuacuaaaaauacaaaaauuagauggguguuu

SEQ ID NO: 392856 - RNA, 32 nt, Human
cuacuaaaaauacaaaaauuagcagggcaugg

SEQ ID NO: 392857 - RNA, 32 nt, Human
cuacuaaaaauacaaaaauuagccagacgugg

SEQ ID NO: 392858 - RNA, 32 nt, Human
cuacuaaaaauacaaaaauuagccaggacuga

SEQ ID NO: 392859 - RNA, 32 nt, Human
cuacuaaaaauacaaaaauuagccaggcacgg

SEQ ID NO: 392860 - RNA, 32 nt, Human
cuacuaaaaauacaaaaauuagccaggcaucg

SEQ ID NO: 392861 - RNA, 32 nt, Human
cuacuaaaaauacaaaaauuagccaggcauga

SEQ ID NO: 392862 - RNA, 32 nt, Human
cuacuaaaaauacaaaaauuagccaggcaugc

SEQ ID NO: 392863 - RNA, 32 nt, Human
cuacuaaaaauacaaaaauuagccaggcaugg

SEQ ID NO: 392864 - RNA, 32 nt, Human
cuacuaaaaauacaaaaauuagccaggcgugg

SEQ ID NO: 392865 - RNA, 32 nt, Human
cuacuaaaaauacaaaaauuagccaggcuuag

SEQ ID NO: 392866 - RNA, 32 nt, Human
cuacuaaaaauacaaaaauuagccaggggugg

SEQ ID NO: 392867 - RNA, 32 nt, Human
cuacuaaaaauacaaaaauuagccagguaugg

SEQ ID NO: 392868 - RNA, 32 nt, Human
cuacuaaaaauacaaaaauuagccagguggug

SEQ ID NO: 392869 - RNA, 32 nt, Human
cuacuaaaaauacaaaaauuagccagguguga

SEQ ID NO: 392870 - RNA, 32 nt, Human
cuacuaaaaauacaaaaauuagccaggugugg

SEQ ID NO: 392871 - RNA, 32 nt, Human
cuacuaaaaauacaaaaauuagccaggugugu

SEQ ID NO: 392872 - RNA, 32 nt, Human
cuacuaaaaauacaaaaauuagccagguguug

SEQ ID NO: 392873 - RNA, 32 nt, Human
cuacuaaaaauacaaaaauuagccagucacgg

SEQ ID NO: 392874 - RNA, 32 nt, Human
cuacuaaaaauacaaaaauuagcccggcaugu

SEQ ID NO: 392875 - RNA, 32 nt, Human
cuacuaaaaauacaaaaauuagcccggcgugg

SEQ ID NO: 392876 - RNA, 32 nt, Human
cuacuaaaaauacaaaaauuagcccggugugg

SEQ ID NO: 392877 - RNA, 32 nt, Human
cuacuaaaaauacaaaaauuagccggacgcag

SEQ ID NO: 392878 - RNA, 32 nt, Human
cuacuaaaaauacaaaaauuagccggacgugg

SEQ ID NO: 392879 - RNA, 32 nt, Human
cuacuaaaaauacaaaaauuagccggcagggu

SEQ ID NO: 392880 - RNA, 32 nt, Human
cuacuaaaaauacaaaaauuagccgggcaugg

SEQ ID NO: 392881 - RNA, 32 nt, Human
cuacuaaaaauacaaaaauuagccgggccugg

SEQ ID NO: 392882 - RNA, 32 nt, Human
cuacuaaaaauacaaaaauuagccgggcguag

SEQ ID NO: 392883 - RNA, 32 nt, Human
cuacuaaaaauacaaaaauuagccgggcgugg

SEQ ID NO: 392884 - RNA, 32 nt, Human
cuacuaaaaauacaaaaauuagccggguagua

SEQ ID NO: 392885 - RNA, 32 nt, Human
cuacuaaaaauacaaaaauuagccgggugugg

SEQ ID NO: 392886 - RNA, 32 nt, Human
cuacuaaaaauacaaaaauuagccgguggugg

SEQ ID NO: 392887 - RNA, 32 nt, Human
cuacuaaaaauacaaaaauuagccuggcaugg

SEQ ID NO: 392888 - RNA, 32 nt, Human
cuacuaaaaauacaaaaauuagccuggcgugg

SEQ ID NO: 392889 - RNA, 32 nt, Human
cuacuaaaaauacaaaaauuagccuggggugg

SEQ ID NO: 392890 - RNA, 32 nt, Human
cuacuaaaaauacaaaaauuagccuggugugg

SEQ ID NO: 392891 - RNA, 32 nt, Human
cuacuaaaaauacaaaaauuagcggccgggug

SEQ ID NO: 392892 - RNA, 32 nt, Human
cuacuaaaaauacaaaaauuagcggggcggcg

SEQ ID NO: 392893 - RNA, 32 nt, Human
cuacuaaaaauacaaaaauuagcuaggcauga

SEQ ID NO: 392894 - RNA, 32 nt, Human
cuacuaaaaauacaaaaauuagcuaggcaugg

SEQ ID NO: 392895 - RNA, 32 nt, Human
cuacuaaaaauacaaaaauuagcuaggccugg

SEQ ID NO: 392896 - RNA, 32 nt, Human
cuacuaaaaauacaaaaauuagcuaggcgggg

SEQ ID NO: 392897 - RNA, 32 nt, Human
cuacuaaaaauacaaaaauuagcuaggcgugg

SEQ ID NO: 392898 - RNA, 32 nt, Human
cuacuaaaaauacaaaaauuagcuagguaugg

SEQ ID NO: 392899 - RNA, 27 nt, Human
cuacuaaaaauacaaaaauuagcuggg

SEQ ID NO: 392900 - RNA, 32 nt, Human
cuacuaaaaauacaaaaauuagcugggcacgg

SEQ ID NO: 392901 - RNA, 32 nt, Human
cuacuaaaaauacaaaaauuagcugggcauga

SEQ ID NO: 392902 - RNA, 32 nt, Human
cuacuaaaaauacaaaaauuagcugggcaugg

SEQ ID NO: 392903 - RNA, 32 nt, Human
cuacuaaaaauacaaaaauuagcugggcgcag

SEQ ID NO: 392904 - RNA, 32 nt, Human
cuacuaaaaauacaaaaauuagcugggcgcgg

SEQ ID NO: 392905 - RNA, 32 nt, Human
cuacuaaaaauacaaaaauuagcugggcgggg

SEQ ID NO: 392906 - RNA, 32 nt, Human
cuacuaaaaauacaaaaauuagcugggcguga

SEQ ID NO: 392907 - RNA, 32 nt, Human
cuacuaaaaauacaaaaauuagcugggcgugc

SEQ ID NO: 392908 - RNA, 32 nt, Human
cuacuaaaaauacaaaaauuagcugggcgugg

SEQ ID NO: 392909 - RNA, 32 nt, Human
cuacuaaaaauacaaaaauuagcugggcgugu

SEQ ID NO: 392910 - RNA, 32 nt, Human
cuacuaaaaauacaaaaauuagcugggcguua

SEQ ID NO: 392911 - RNA, 32 nt, Human
cuacuaaaaauacaaaaauuagcuggggcgag

SEQ ID NO: 392912 - RNA, 32 nt, Human
cuacuaaaaauacaaaaauuagcugggggugg

SEQ ID NO: 392913 - RNA, 32 nt, Human
cuacuaaaaauacaaaaauuagcugggugcgg

SEQ ID NO: 392914 - RNA, 32 nt, Human
cuacuaaaaauacaaaaauuagcuggguguag

SEQ ID NO: 392915 - RNA, 32 nt, Human
cuacuaaaaauacaaaaauuagcuggguguau

SEQ ID NO: 392916 - RNA, 32 nt, Human
cuacuaaaaauacaaaaauuagcuggguguga

SEQ ID NO: 392917 - RNA, 32 nt, Human
cuacuaaaaauacaaaaauuagcugggugugg

SEQ ID NO: 392918 - RNA, 32 nt, Human
cuacuaaaaauacaaaaauuagcugggugugu

SEQ ID NO: 392919 - RNA, 32 nt, Human
cuacuaaaaauacaaaaauuagcuuggugugg

SEQ ID NO: 392920 - RNA, 32 nt, Human
cuacuaaaaauacaaaaauuaggcaugguggu

SEQ ID NO: 392921 - RNA, 32 nt, Human
cuacuaaaaauacaaaaauuaggccaggugcg

SEQ ID NO: 392922 - RNA, 32 nt, Human
cuacuaaaaauacaaaaauuaggccgggcgca

SEQ ID NO: 392923 - RNA, 32 nt, Human
cuacuaaaaauacaaaaauuaggccggguaca

SEQ ID NO: 392924 - RNA, 32 nt, Human
cuacuaaaaauacaaaaauuagggccgggcgc

SEQ ID NO: 392925 - RNA, 32 nt, Human
cuacuaaaaauacaaaaauuaggugggucugg

SEQ ID NO: 392926 - RNA, 32 nt, Human
cuacuaaaaauacaaaaauuagucaggcaugg

SEQ ID NO: 392927 - RNA, 32 nt, Human
cuacuaaaaauacaaaaauuagucaggcgcgg

SEQ ID NO: 392928 - RNA, 32 nt, Human
cuacuaaaaauacaaaaauuagucaggcgugg

SEQ ID NO: 392929 - RNA, 32 nt, Human
cuacuaaaaauacaaaaauuagucaggugugg

SEQ ID NO: 392930 - RNA, 32 nt, Human
cuacuaaaaauacaaaaauuagucgggcgugc

SEQ ID NO: 392931 - RNA, 32 nt, Human
cuacuaaaaauacaaaaauuagucgggcgugg

SEQ ID NO: 392932 - RNA, 32 nt, Human
cuacuaaaaauacaaaaauuaguucggcaugg

SEQ ID NO: 392933 - RNA, 32 nt, Human
cuacuaaaaauacaaaaauuaguugggcaugg

SEQ ID NO: 392934 - RNA, 32 nt, Human
cuacuaaaaauacaaaaauuauccaggcgugg

SEQ ID NO: 392935 - RNA, 32 nt, Human
cuacuaaaaauacaaaaauuauccgggcaugg

SEQ ID NO: 392936 - RNA, 32 nt, Human
cuacuaaaaauacaaaaauuaucggggugcaa

SEQ ID NO: 392937 - RNA, 32 nt, Human
cuacuaaaaauacaaaaauucaccaggcaugg

SEQ ID NO: 392938 - RNA, 32 nt, Human
cuacuaaaaauacaaaaauugcccaggcaugg

SEQ ID NO: 392939 - RNA, 32 nt, Human
cuacuaaaaauacaaaaauuggccgggugugg

SEQ ID NO: 392940 - RNA, 32 nt, Human
cuacuaaaaauacaaaaauuggcugggcaugg

SEQ ID NO: 392941 - RNA, 32 nt, Human
cuacuaaaaauacaaaaauuggcugggugugg

SEQ ID NO: 392942 - RNA, 32 nt, Human
cuacuaaaaauacaaaaauuggucgggcaugg

SEQ ID NO: 392943 - RNA, 32 nt, Human
cuacuaaaaauacaaaaauuguccgggugugg

SEQ ID NO: 392944 - RNA, 32 nt, Human
cuacuaaaaauacaaaaauuuagccaggcaug

SEQ ID NO: 392945 - RNA, 32 nt, Human
cuacuaaaaauacaaaaauuugccaggcgugg

SEQ ID NO: 392946 - RNA, 32 nt, Human
cuacuaaaaauacaaaaauuugccgggugugg

SEQ ID NO: 392947 - RNA, 32 nt, Human
cuacuaaaaauacaaaaauuugcugggcaugg

SEQ ID NO: 392948 - RNA, 32 nt, Human
cuacuaaaaauacaaaaauuugcugggcuugg

SEQ ID NO: 392949 - RNA, 32 nt, Human
cuacuaaaaauacaaaacaauuagccgggcgu

SEQ ID NO: 392950 - RNA, 32 nt, Human
cuacuaaaaauacaaaacauuagccgggcgug

SEQ ID NO: 392951 - RNA, 32 nt, Human
cuacuaaaaauacaaaacuagccaggaauggu

SEQ ID NO: 392952 - RNA, 32 nt, Human
cuacuaaaaauacaaaacuagccaggcgcggu

SEQ ID NO: 392953 - RNA, 32 nt, Human
cuacuaaaaauacaaaacuagccggguauggu

SEQ ID NO: 392954 - RNA, 32 nt, Human
cuacuaaaaauacaaaacuuagccaggcaugg

SEQ ID NO: 392955 - RNA, 32 nt, Human
cuacuaaaaauacaaaacuuagccaggugugg

SEQ ID NO: 392956 - RNA, 32 nt, Human
cuacuaaaaauacaaaagaaaauuagccgggu

SEQ ID NO: 392957 - RNA, 32 nt, Human
cuacuaaaaauacaaaaguagccgggcguggu

SEQ ID NO: 392958 - RNA, 32 nt, Human
cuacuaaaaauacaaaaguuagcagggcgugg

SEQ ID NO: 392959 - RNA, 32 nt, Human
cuacuaaaaauacaaaaguuagccgggugugg

SEQ ID NO: 392960 - RNA, 32 nt, Human
cuacuaaaaauacaaaaguuagcuggggcugg

SEQ ID NO: 392961 - RNA, 32 nt, Human
cuacuaaaaauacaaaaguuagcugggugugg

SEQ ID NO: 392962 - RNA, 32 nt, Human
cuacuaaaaauacaaaauauuagcugggcgug

SEQ ID NO: 392963 - RNA, 32 nt, Human
cuacuaaaaauacaaaaucagccaggcguggu

SEQ ID NO: 392964 - RNA, 32 nt, Human
cuacuaaaaauacaaaauuagcagggcauggu

SEQ ID NO: 392965 - RNA, 32 nt, Human
cuacuaaaaauacaaaauuagccaggcaugau

SEQ ID NO: 392966 - RNA, 32 nt, Human
cuacuaaaaauacaaaauuagccaggcauggu

SEQ ID NO: 392967 - RNA, 32 nt, Human
cuacuaaaaauacaaaauuagccaggcguagu

SEQ ID NO: 392968 - RNA, 32 nt, Human
cuacuaaaaauacaaaauuagccaggcgugau

SEQ ID NO: 392969 - RNA, 32 nt, Human
cuacuaaaaauacaaaauuagccaggcguggu

SEQ ID NO: 392970 - RNA, 32 nt, Human
cuacuaaaaauacaaaauuagccagguauggu

SEQ ID NO: 392971 - RNA, 32 nt, Human
cuacuaaaaauacaaaauuagccagguguggu

SEQ ID NO: 392972 - RNA, 32 nt, Human
cuacuaaaaauacaaaauuagccgggcaugau

SEQ ID NO: 392973 - RNA, 32 nt, Human
cuacuaaaaauacaaaauuagccgggcauggg

SEQ ID NO: 392974 - RNA, 32 nt, Human
cuacuaaaaauacaaaauuagccgggcauggu

SEQ ID NO: 392975 - RNA, 32 nt, Human
cuacuaaaaauacaaaauuagccgggcguggu

SEQ ID NO: 392976 - RNA, 32 nt, Human
cuacuaaaaauacaaaauuagccggguggugu

SEQ ID NO: 392977 - RNA, 32 nt, Human
cuacuaaaaauacaaaauuagccggguguggu

SEQ ID NO: 392978 - RNA, 32 nt, Human
cuacuaaaaauacaaaauuagcugggcauggu

SEQ ID NO: 392979 - RNA, 32 nt, Human
cuacuaaaaauacaaaauuagcugggcguggu

SEQ ID NO: 392980 - RNA, 32 nt, Human
cuacuaaaaauacaaaauuagcuggguggggu

SEQ ID NO: 392981 - RNA, 32 nt, Human
cuacuaaaaauacaaaauuagcugggugugcu

SEQ ID NO: 392982 - RNA, 32 nt, Human
cuacuaaaaauacaaaauuagcuggguguggu

SEQ ID NO: 392983 - RNA, 32 nt, Human
cuacuaaaaauacaaaauuagucaggcauugu

SEQ ID NO: 392984 - RNA, 32 nt, Human
cuacuaaaaauacaaaauuagucgggcguagu

SEQ ID NO: 392985 - RNA, 32 nt, Human
cuacuaaaaauacaaaauuagucggguauggu

SEQ ID NO: 392986 - RNA, 32 nt, Human
cuacuaaaaauacaaaauucagccagguaugg

SEQ ID NO: 392987 - RNA, 32 nt, Human
cuacuaaaaauacaaaauuggcaggguguggu

SEQ ID NO: 392988 - RNA, 32 nt, Human
cuacuaaaaauacaaaauuggccgggcauguu

SEQ ID NO: 392989 - RNA, 32 nt, Human
cuacuaaaaauacaaaauuuagccaggcaugg

SEQ ID NO: 392990 - RNA, 32 nt, Human
cuacuaaaaauacaaacaaaauuagcugggca

SEQ ID NO: 392991 - RNA, 32 nt, Human
cuacuaaaaauacaaacaaauuagccgggcgu

SEQ ID NO: 392992 - RNA, 32 nt, Human
cuacuaaaaauacaaacauuagccaggugugg

SEQ ID NO: 392993 - RNA, 32 nt, Human
cuacuaaaaauacaaacauuagcccggcgugg

SEQ ID NO: 392994 - RNA, 32 nt, Human
cuacuaaaaauacaaacguuagccgggcgugg

SEQ ID NO: 392995 - RNA, 32 nt, Human
cuacuaaaaauacaaaguuaaccggguguggu

SEQ ID NO: 392996 - RNA, 32 nt, Human
cuacuaaaaauacaaaguuagccaggcauagu

SEQ ID NO: 392997 - RNA, 32 nt, Human
cuacuaaaaauacaaaguuagccaggcauggu

SEQ ID NO: 392998 - RNA, 32 nt, Human
cuacuaaaaauacaaauauauuagccgggcgu

SEQ ID NO: 392999 - RNA, 32 nt, Human
cuacuaaaaauacaaauauuagccgggcaugg

SEQ ID NO: 393000 - RNA, 32 nt, Human
cuacuaaaaauacaaauuuagccgggcguggu

SEQ ID NO: 393001 - RNA, 32 nt, Human
cuacuaaaaauacaacaaaguuagccgggcgu

SEQ ID NO: 393002 - RNA, 32 nt, Human
cuacuaaaaauacaagaauuagccaggugugg

SEQ ID NO: 393003 - RNA, 32 nt, Human
cuacuaaaaauacaagaauuagcugggcgugg

SEQ ID NO: 393004 - RNA, 32 nt, Human
cuacuaaaaauacaagaauuagcugggugugg

SEQ ID NO: 393005 - RNA, 32 nt, Human
cuacuaaaaauacaaggauuagcugggcaugg

SEQ ID NO: 393006 - RNA, 32 nt, Human
cuacuaaaaauacaauaaauuagcugggcaug

SEQ ID NO: 393007 - RNA, 32 nt, Human
cuacuaaaaauacaauaauuagccaggcaugg

SEQ ID NO: 393008 - RNA, 32 nt, Human
cuacuaaaaauacaauaauuagcugggcgugg

SEQ ID NO: 393009 - RNA, 32 nt, Human
cuacuaaaaauacaauauuagccgggcguggu

SEQ ID NO: 393010 - RNA, 32 nt, Human
cuacuaaaaauacaauuagccagguguggcgg

SEQ ID NO: 393011 - RNA, 32 nt, Human
cuacuaaaaauacacaaauuagcuaggcaugg

SEQ ID NO: 393012 - RNA, 32 nt, Human
cuacuaaaaauacagaaaauuagcugggcgca

SEQ ID NO: 393013 - RNA, 32 nt, Human
cuacuaaaaauacagaaauuagccgggcaugg

SEQ ID NO: 393014 - RNA, 32 nt, Human
cuacuaaaaauacagaaauuagccgggcgugg

SEQ ID NO: 393015 - RNA, 32 nt, Human
cuacuaaaaauacagaaauuagccggucaugg

SEQ ID NO: 393016 - RNA, 32 nt, Human
cuacuaaaaauacagaaauuagcugggugugg

SEQ ID NO: 393017 - RNA, 32 nt, Human
cuacuaaaaauaccaaaauuagccaggcguga

SEQ ID NO: 393018 - RNA, 32 nt, Human
cuacuaaaaauaccaaaauuagccaggugugu

SEQ ID NO: 393019 - RNA, 32 nt, Human
cuacuaaaaauaccaaaauuagccgggcaugg

SEQ ID NO: 393020 - RNA, 32 nt, Human
cuacuaaaaauaccaaaauuagcugggcaugg

SEQ ID NO: 393021 - RNA, 32 nt, Human
cuacuaaaaauacgaaaauuagccuggcgugg

SEQ ID NO: 393022 - RNA, 32 nt, Human
cuacuaaaaauacgaaaauuagcuggguguga

SEQ ID NO: 393023 - RNA, 32 nt, Human
cuacuaaaaauagaaaaauuagccaggcacgu

SEQ ID NO: 393024 - RNA, 32 nt, Human
cuacuaaaaauagaaaaauuagccagguguag

SEQ ID NO: 393025 - RNA, 32 nt, Human
cuacuaaaaauagaaaaauuagcuaggcaugg

SEQ ID NO: 393026 - RNA, 32 nt, Human
cuacuaaaaauagaaaaauuagcugggcaugg

SEQ ID NO: 393027 - RNA, 32 nt, Human
cuacuaaaaauagaaaccuuagccaggcgugg

SEQ ID NO: 393028 - RNA, 32 nt, Human
cuacuaaaaauagagaaaauuagccaggcaua

SEQ ID NO: 393029 - RNA, 32 nt, Human
cuacuaaaaauauaaaaaguagccaggcgugg

SEQ ID NO: 393030 - RNA, 32 nt, Human
cuacuaaaaauauaaaaauuagcagggcaugg

SEQ ID NO: 393031 - RNA, 32 nt, Human
cuacuaaaaauauaaaaauuagccaggcauga

SEQ ID NO: 393032 - RNA, 32 nt, Human
cuacuaaaaauauaaaaauuagccaggcgugg

SEQ ID NO: 393033 - RNA, 32 nt, Human
cuacuaaaaauauaaaaauuagccgggcaugg

SEQ ID NO: 393034 - RNA, 32 nt, Human
cuacuaaaaauauaaaaauuagccgggcguga

SEQ ID NO: 393035 - RNA, 32 nt, Human
cuacuaaaaauauaaaaauuagcugggugugg

SEQ ID NO: 393036 - RNA, 32 nt, Human
cuacuaaaaauauaaaaauuaggccaggcaca

SEQ ID NO: 393037 - RNA, 32 nt, Human
cuacuaaaaauauaaaaauuagucgggcauga

SEQ ID NO: 393038 - RNA, 32 nt, Human
cuacuaaaaauauaaaaauuagugaggcaugg

SEQ ID NO: 393039 - RNA, 32 nt, Human
cuacuaaaaauauaagaaauuagccggacaug

SEQ ID NO: 393040 - RNA, 32 nt, Human
cuacuaaaaaugcaaaaaguuagccaggcaug

SEQ ID NO: 393041 - RNA, 32 nt, Human
cuacuaaaaaugcaaaaauuaacagggcacgg

SEQ ID NO: 393042 - RNA, 32 nt, Human
cuacuaaaaaugcaaaaauuaccgggacgugu

SEQ ID NO: 393043 - RNA, 32 nt, Human
cuacuaaaaaugcaaaaauuagccaggcguag

SEQ ID NO: 393044 - RNA, 32 nt, Human
cuacuaaaaaugcaaaaauuagccgggcgugg

SEQ ID NO: 393045 - RNA, 32 nt, Human
cuacuaaaaaugcaaaaauuagcugggugugg

SEQ ID NO: 393046 - RNA, 32 nt, Human
cuacuaaaaaugcaaaaauuaguccggcgugg

SEQ ID NO: 393047 - RNA, 32 nt, Human
cuacuaaaacauacaaaaauuagccgggcaug

SEQ ID NO: 393048 - RNA, 32 nt, Human
cuacuaaaaguacaaaaauuagccaggcggua

SEQ ID NO: 393049 - RNA, 32 nt, Human
cuacuaaaaguacaaaaauuagccaggcguga

SEQ ID NO: 393050 - RNA, 32 nt, Human
cuacuaaaaguacaaaaauuagccagguggua

SEQ ID NO: 393051 - RNA, 32 nt, Human
cuacuaaaaguacaaaaauuagccgggcgugg

SEQ ID NO: 393052 - RNA, 32 nt, Human
cuacuaaaaguacaaaaauuagcugggcauga

SEQ ID NO: 393053 - RNA, 32 nt, Human
cuacuaaaaguacaaaaauuagucagguaugg

SEQ ID NO: 393054 - RNA, 32 nt, Human
cuacuaaaaguacagaaauuagcuggguguga

SEQ ID NO: 393055 - RNA, 32 nt, Human
cuacuaaaauauacaaaaauuagccaggugug

SEQ ID NO: 393056 - RNA, 32 nt, Human
cuacuaaacauacaaaaauuagcuaggcgugg

SEQ ID NO: 393057 - RNA, 32 nt, Human
cuacuaaagauacaaaaagauuagcugggcau

SEQ ID NO: 393058 - RNA, 32 nt, Human
cuacuaaagauacaaaaauuagccgggcaugg

SEQ ID NO: 393059 - RNA, 32 nt, Human
cuacuaaagauacaaaaauuagcugggugugg

SEQ ID NO: 393060 - RNA, 32 nt, Human
cuacuaaagauauaaaaauuagccgggcgugg

SEQ ID NO: 393061 - RNA, 32 nt, Human
cuacuaaagcagcuugagugcuguaaggagag

SEQ ID NO: 393062 - RNA, 32 nt, Human
cuacuaaagugcugggauuacaggcgugagcu

SEQ ID NO: 393063 - RNA, 32 nt, Human
cuacuaaauacuguaggcaguuguaaaaggau

SEQ ID NO: 393064 - RNA, 32 nt, Human
cuacuaaauauacaaaauuagccgggcguggu

SEQ ID NO: 393065 - RNA, 24 nt, Human
cuacuaaaucaugaacagcuuuaa

SEQ ID NO: 393066 - RNA, 32 nt, Human
cuacuaagaaaaucucucuugauucugcacag

SEQ ID NO: 393067 - RNA, 32 nt, Human
cuacuaagaacucuuucuuaaaugugguuugu

SEQ ID NO: 393068 - RNA, 32 nt, Human
cuacuaagaauacaaaaauuagccaggagugg

SEQ ID NO: 393069 - RNA, 32 nt, Human
cuacuaagaauacaaaaauuagccgggugugg

SEQ ID NO: 393070 - RNA, 32 nt, Human
cuacuaagaauacaaaauuagcugggcauggu

SEQ ID NO: 393071 - RNA, 32 nt, Human
cuacuaagaauauaaaaauuagcuggguaugg

SEQ ID NO: 393072 - RNA, 25 nt, Human
cuacuaagagaaggggugcagagug

SEQ ID NO: 393073 - RNA, 32 nt, Human
cuacuaaggaggcggcccugcgcgggcugucc

SEQ ID NO: 393074 - RNA, 32 nt, Human
cuacuaaggauacaaaaauuggccgggugcgg

SEQ ID NO: 393075 - RNA, 32 nt, Human
cuacuaaggauacaaaauuagccgggcauggu

SEQ ID NO: 393076 - RNA, 32 nt, Human
cuacuaauaauacaaaaauuagccaggugugg

SEQ ID NO: 393077 - RNA, 32 nt, Human
cuacuaauaauacaaaaauuagcugggcaugg

SEQ ID NO: 393078 - RNA, 32 nt, Human
cuacuaauaauacaacaauuagccaggcgugg

SEQ ID NO: 393079 - RNA, 32 nt, Human
cuacuaaucuacaugauuauauaguaaggaaa

SEQ ID NO: 393080 - RNA, 32 nt, Human
cuacuaauuucaguacuaagguggugaugcca

SEQ ID NO: 393081 - RNA, 32 nt, Human
cuacuacaaauacaaaaauuagccaggcgugg

SEQ ID NO: 393082 - RNA, 32 nt, Human
cuacuacaaauacaaaaauuagccgggugugg

SEQ ID NO: 393083 - RNA, 32 nt, Human
cuacuacaaauacaaaaauuagcuggacgugg

SEQ ID NO: 393084 - RNA, 32 nt, Human
cuacuacaaauacaaaaauuagcugggugugg

SEQ ID NO: 393085 - RNA, 32 nt, Human
cuacuacaaauacgaaaauuagcugggcgugg

SEQ ID NO: 393086 - RNA, 32 nt, Human
cuacuacaagcauuaccuaacauggugaucug

SEQ ID NO: 393087 - RNA, 22 nt, Human
cuacuacacuguggaugaaccu

SEQ ID NO: 393088 - RNA, 31 nt, Human
cuacuacaguuucacagaauaccugagaaga

SEQ ID NO: 393089 - RNA, 32 nt, Human
cuacuacccagaggagagcacauggcuguucu

SEQ ID NO: 393090 - RNA, 32 nt, Human
cuacuaccugcggcucugccucaagcgguuca

SEQ ID NO: 393091 - RNA, 32 nt, Human
cuacuaccugcuggagaaaggcgcagaccuca

SEQ ID NO: 393092 - RNA, 32 nt, Human
cuacuacgcagcuucagcgccagugugaauuu

SEQ ID NO: 393093 - RNA, 32 nt, Human
cuacuacgucacuaccuggaagcaauugccuu

SEQ ID NO: 393094 - RNA, 32 nt, Human
cuacuacuaaugucacaaugcguguacaccuu

SEQ ID NO: 393095 - RNA, 32 nt, Human
cuacuacucagcccucuccugcggccacauca

SEQ ID NO: 393096 - RNA, 31 nt, Human
cuacuagaaaaaggaacuggcaugcacacgu

SEQ ID NO: 393097 - RNA, 32 nt, Human
cuacuagaaauacaaaaauuagccaggugugg

SEQ ID NO: 393098 - RNA, 32 nt, Human
cuacuagaaauacaaaacaauuagcugggugu

SEQ ID NO: 393099 - RNA, 32 nt, Human
cuacuagaaauacagaaaaauuagcugggugu

SEQ ID NO: 393100 - RNA, 32 nt, Human
cuacuagagacaccccuaagccaugaugaacu

SEQ ID NO: 393101 - RNA, 32 nt, Human
cuacuagauaaauggccuucaggcagugcucc

SEQ ID NO: 393102 - RNA, 32 nt, Human
cuacuagcaaaugacccuaccauuuauuucug

SEQ ID NO: 393103 - RNA, 32 nt, Human
cuacuagcagcaccagccuuguuuuaaauguu

SEQ ID NO: 393104 - RNA, 32 nt, Human
cuacuagcugcacccgauuccucccagugcuu

SEQ ID NO: 393105 - RNA, 32 nt, Human
cuacuaggaagagagugggcugcagaugaauc

SEQ ID NO: 393106 - RNA, 32 nt, Human
cuacuaggaaggcugaggcaggagaaucgcuu

SEQ ID NO: 393107 - RNA, 32 nt, Human
cuacuaggccuacaccucuccccacgcagagg

SEQ ID NO: 393108 - RNA, 32 nt, Human
cuacuagggacgcugaggcaggagaaucgcuu

SEQ ID NO: 393109 - RNA, 32 nt, Human
cuacuagggagacugaggcaggagaauugcuu

SEQ ID NO: 393110 - RNA, 32 nt, Human
cuacuagggaggaugaggcaggagaauugcuu

SEQ ID NO: 393111 - RNA, 32 nt, Human
cuacuagggaggcugagccaggaagaacgcuc

SEQ ID NO: 393112 - RNA, 32 nt, Human
cuacuagggaggcugagccaggaggaucacuu

SEQ ID NO: 393113 - RNA, 32 nt, Human
cuacuagggaggcugaggcaggagaaucacuu

SEQ ID NO: 393114 - RNA, 32 nt, Human
cuacuagggaggcugaggcaggagaaucgcuu

SEQ ID NO: 393115 - RNA, 32 nt, Human
cuacuagggaggcugaggcaggagaaucucuu

SEQ ID NO: 393116 - RNA, 32 nt, Human
cuacuagggaggcugaggcaggagaauggcca

SEQ ID NO: 393117 - RNA, 32 nt, Human
cuacuagggaggcugaggcaggagaauggcgu

SEQ ID NO: 393118 - RNA, 32 nt, Human
cuacuagggaggcugaggcaggagaauggugu

SEQ ID NO: 393119 - RNA, 32 nt, Human
cuacuagggaggcugaggcaggagaauugcuu

SEQ ID NO: 393120 - RNA, 32 nt, Human
cuacuagggaggcugcggcaggagaauugcuu

SEQ ID NO: 393121 - RNA, 32 nt, Human
cuacuagggcuuacacaucugcuuccaagcuc

SEQ ID NO: 393122 - RNA, 32 nt, Human
cuacuauaaauacaaaaauuagccaggcucgu

SEQ ID NO: 393123 - RNA, 32 nt, Human
cuacuauaugucaagugcugugcaagguauua

SEQ ID NO: 393124 - RNA, 32 nt, Human
cuacuaucccagacaguuaguaccagauacuu

SEQ ID NO: 393125 - RNA, 30 nt, Human
cuacuaugcgaagaaaaguggaacaggagg

SEQ ID NO: 393126 - RNA, 32 nt, Human
cuacuauggcuuaagacccagggccagggucc

SEQ ID NO: 393127 - RNA, 32 nt, Human
cuacuaugugcagugcaguuacuccaaucuua

SEQ ID NO: 393128 - RNA, 32 nt, Human
cuacuaugugccaggcacuguguaggugcuga

SEQ ID NO: 393129 - RNA, 32 nt, Human
cuacuaugugccaggccaauugcugaguccgc

SEQ ID NO: 393130 - RNA, 32 nt, Human
cuacucaaccucucugugccucggguccuccu

SEQ ID NO: 393131 - RNA, 32 nt, Human
cuacucacagauaggaauugaagccaccacaa

SEQ ID NO: 393132 - RNA, 32 nt, Human
cuacucacagcugaagaaaaugagcacacccu

SEQ ID NO: 393133 - RNA, 32 nt, Human
cuacucacccgcuauuagaguauggaggaagg

SEQ ID NO: 393134 - RNA, 32 nt, Human
cuacucacccuuugaaagcugugugacugccu

SEQ ID NO: 393135 - RNA, 32 nt, Human
cuacucacugcaaccuccaccucccggguuca

SEQ ID NO: 393136 - RNA, 32 nt, Human
cuacucacuuucuccuagccagccuggacuuu

SEQ ID NO: 393137 - RNA, 32 nt, Human
cuacucagaacuggggaaggaguggaacuuau

SEQ ID NO: 393138 - RNA, 32 nt, Human
cuacucagagucaggcacucacaguagacaga

SEQ ID NO: 393139 - RNA, 32 nt, Human
cuacucagauggcugaggcaggagaacuacuu

SEQ ID NO: 393140 - RNA, 32 nt, Human
cuacucagcaaugccuuccuggaccacaaccc

SEQ ID NO: 393141 - RNA, 32 nt, Human
cuacucagccuccuguagugucgagaauauag

SEQ ID NO: 393142 - RNA, 32 nt, Human
cuacucagccuucaauguaccuguguguccau

SEQ ID NO: 393143 - RNA, 32 nt, Human
cuacucaggaagcugaggcaggagaaucacuu

SEQ ID NO: 393144 - RNA, 32 nt, Human
cuacucaggagacugaggcaggagaaucgcuu

SEQ ID NO: 393145 - RNA, 32 nt, Human
cuacucaggagccugaggcaggagaauugcuu

SEQ ID NO: 393146 - RNA, 32 nt, Human
cuacucaggaggaugaggcaggagaaucacuu

SEQ ID NO: 393147 - RNA, 32 nt, Human
cuacucaggaggccgaggcaagagaaucgcuu

SEQ ID NO: 393148 - RNA, 32 nt, Human
cuacucaggaggccgaggcaggagaaugguuu

SEQ ID NO: 393149 - RNA, 32 nt, Human
cuacucaggaggccgaggcaggagaauugcug

SEQ ID NO: 393150 - RNA, 32 nt, Human
cuacucaggaggccgaggcaggagaauugcuu

SEQ ID NO: 393151 - RNA, 32 nt, Human
cuacucaggaggccgaggcgggaggaucccca

SEQ ID NO: 393152 - RNA, 32 nt, Human
cuacucaggaggcuaaggcaggagaaucacuu

SEQ ID NO: 393153 - RNA, 32 nt, Human
cuacucaggaggcuaaggcaggagaaucgcuu

SEQ ID NO: 393154 - RNA, 32 nt, Human
cuacucaggaggcugaaacaggagaaucacuu

SEQ ID NO: 393155 - RNA, 32 nt, Human
cuacucaggaggcugaagcaggagaaucacuu

SEQ ID NO: 393156 - RNA, 32 nt, Human
cuacucaggaggcugaagcaggagaaucgcug

SEQ ID NO: 393157 - RNA, 32 nt, Human
cuacucaggaggcugaagcaggagaaucgcuu

SEQ ID NO: 393158 - RNA, 32 nt, Human
cuacucaggaggcugagacaggagaaucaccu

SEQ ID NO: 393159 - RNA, 32 nt, Human
cuacucaggaggcugagacaggagaaucacuu

SEQ ID NO: 393160 - RNA, 32 nt, Human
cuacucaggaggcugagacaggagaaucgcuu

SEQ ID NO: 393161 - RNA, 32 nt, Human
cuacucaggaggcugaggcaggagaacugcuu

SEQ ID NO: 393162 - RNA, 32 nt, Human
cuacucaggaggcugaggcaggagaaucaauu

SEQ ID NO: 393163 - RNA, 32 nt, Human
cucaaaaggaugagcaagucuguuccagcauu

SEQ ID NO: 393164 - RNA, 32 nt, Human
cucaaaagugaguuugcuuaaugaagacauuu

SEQ ID NO: 393165 - RNA, 32 nt, Human
cucaaaauaaaauaaaauaggccaggcguggu

SEQ ID NO: 393166 - RNA, 32 nt, Human
cucaaaauaccuguaaucccagcacuuuggga

SEQ ID NO: 393167 - RNA, 32 nt, Human
cucaaaauacuguaaucucagcauuuugggag

SEQ ID NO: 393168 - RNA, 32 nt, Human
cucaaaaucaaagaaagguucagcaaggcugu

SEQ ID NO: 393169 - RNA, 23 nt, Human
cucaaaaucaacuaucagugaug

SEQ ID NO: 393170 - RNA, 32 nt, Human
cucaaaaucuggaacugggaggcuggagaaag

SEQ ID NO: 393171 - RNA, 32 nt, Human
cucaaaaugagauacugacaccaccuuugccc

SEQ ID NO: 393172 - RNA, 32 nt, Human
cucaaacaccccagaagaauucuagcagugau

SEQ ID NO: 393173 - RNA, 32 nt, Human
cucaaacaucagcccugaguucuugaguccac

SEQ ID NO: 393174 - RNA, 32 nt, Human
cucaaacaugaauggagagagacagagaggaa

SEQ ID NO: 393175 - RNA, 32 nt, Human
cucaaaccagagacuauuucaagcccuggaua

SEQ ID NO: 393176 - RNA, 32 nt, Human
cucaaacccagcucuguggaucauguuccuaa

SEQ ID NO: 393177 - RNA, 32 nt, Human
cucaaaccccuccaccaucccacacccuccuc

SEQ ID NO: 393178 - RNA, 32 nt, Human
cucaaacccgggaggcagagguugcagugacc

SEQ ID NO: 393179 - RNA, 32 nt, Human
cucaaacccgggaggcggagauugcagugagc

SEQ ID NO: 393180 - RNA, 23 nt, Human
cucaaacccucagggaccuggua

SEQ ID NO: 393181 - RNA, 32 nt, Human
cucaaaccuacuucuuauuuacuccaaagccu

SEQ ID NO: 393182 - RNA, 32 nt, Human
cucaaaccuauaaucccagcacuuugggaggc

SEQ ID NO: 393183 - RNA, 32 nt, Human
cucaaaccucucccaucucccaacaacugcac

SEQ ID NO: 393184 - RNA, 16 nt, Human
cucaaaccugaaucca

SEQ ID NO: 393185 - RNA, 17 nt, Human
cucaaaccuggauucca

SEQ ID NO: 393186 - RNA, 32 nt, Human
cucaaaccugggaggcgaagauugcagugagc

SEQ ID NO: 393187 - RNA, 32 nt, Human
cucaaaccugggaguuugaagcugcagugagc

SEQ ID NO: 393188 - RNA, 32 nt, Human
cucaaaccuguaaucccagcacuuugggagac

SEQ ID NO: 393189 - RNA, 32 nt, Human
cucaaaccuguaaucccagcacuuugggaggc

SEQ ID NO: 393190 - RNA, 32 nt, Human
cucaaacgcggagggcugcgugcagugggagc

SEQ ID NO: 393191 - RNA, 32 nt, Human
cucaaacucccagccucaagcgaugcucccac

SEQ ID NO: 393192 - RNA, 32 nt, Human
cucaaacucccaggcucaagggauccuccugc

SEQ ID NO: 393193 - RNA, 32 nt, Human
cucaaacuccuaggcucaggugauccuccugc

SEQ ID NO: 393194 - RNA, 21 nt, Human
cucaaacuccugaccuuguga

SEQ ID NO: 393195 - RNA, 32 nt, Human
cucaaacugcaaaugacuauucaagagcuuuu

SEQ ID NO: 393196 - RNA, 20 nt, Human
cucaaacuggggacuguucc

SEQ ID NO: 393197 - RNA, 32 nt, Human
cucaaacuguaugccugcuccagccuggacug

SEQ ID NO: 393198 - RNA, 32 nt, Human
cucaaagaaagaaagaaagaaaagaaagaaag

SEQ ID NO: 393199 - RNA, 32 nt, Human
cucaaagaaagccggacccaagagcagccccc

SEQ ID NO: 393200 - RNA, 32 nt, Human
cucaaagaaauggcacaaccauguucuucggc

SEQ ID NO: 393201 - RNA, 32 nt, Human
cucaaagaacuccaugaaaucaggaacugcuu

SEQ ID NO: 393202 - RNA, 24 nt, Human
cucaaagacacugguuaucagagg

SEQ ID NO: 393203 - RNA, 32 nt, Human
cucaaagacuguggccucuucugggugccuga

SEQ ID NO: 393204 - RNA, 32 nt, Human
cucaaagagaucuggguacaugccaguugaac

SEQ ID NO: 393205 - RNA, 32 nt, Human
cucaaagaguuggguuucugcguccaugugaa

SEQ ID NO: 393206 - RNA, 22 nt, Human
cucaaagauuugaaguguccca

SEQ ID NO: 393207 - RNA, 32 nt, Human
cucaaagcaagcucuucuccucagcuuggggc

SEQ ID NO: 393208 - RNA, 21 nt, Human
cucaaagcaggauuucaggca

SEQ ID NO: 393209 - RNA, 32 nt, Human
cucaaagccaagcagaggccggcaguggaggc

SEQ ID NO: 393210 - RNA, 32 nt, Human
cucaaagccaccucccccucuggagaccucac

SEQ ID NO: 393211 - RNA, 32 nt, Human
cucaaagccauuuccacucagcucuuuccaga

SEQ ID NO: 393212 - RNA, 32 nt, Human
cucaaagcccccacuucucuccaggcuguuuc

SEQ ID NO: 393213 - RNA, 32 nt, Human
cucaaagcgugcauuaucacagccugagggga

SEQ ID NO: 393214 - RNA, 32 nt, Human
cucaaagcuuaaagauuuacgcuaucgcagcu

SEQ ID NO: 393215 - RNA, 32 nt, Human
cucaaagcuuaucagcgcagagcccauaauuu

SEQ ID NO: 393216 - RNA, 32 nt, Human
cucaaagcuuauggaagacauaccugcaaugg

SEQ ID NO: 393217 - RNA, 18 nt, Human
cucaaagcuuccauucca

SEQ ID NO: 393218 - RNA, 32 nt, Human
cucaaaggaagcaggggauucagugaguguga

SEQ ID NO: 393219 - RNA, 30 nt, Human
cucaaaggaagccacaaggcgcgggggcca

SEQ ID NO: 393220 - RNA, 32 nt, Human
cucaaaggaagccacaaggcgcgggggccacu

SEQ ID NO: 393221 - RNA, 32 nt, Human
cucaaaggcccugguuacacagucuucugggg

SEQ ID NO: 393222 - RNA, 32 nt, Human
cucaaaggcugagaguaucccacccacuucac

SEQ ID NO: 393223 - RNA, 32 nt, Human
cucaaagggacagaggacagauucauaauugu

SEQ ID NO: 393224 - RNA, 32 nt, Human
cucaaaggggagacagaggcagugcucccugu

SEQ ID NO: 393225 - RNA, 32 nt, Human
cucaaaggguaacaggucuaacagaaagaacu

SEQ ID NO: 393226 - RNA, 32 nt, Human
cucaaaggucaugauuuccacccuggggcugg

SEQ ID NO: 393227 - RNA, 32 nt, Human
cucaaaggucuggucugugggccucugaggag

SEQ ID NO: 393228 - RNA, 32 nt, Human
cucaaagucccucuggaggaccacagcucaac

SEQ ID NO: 393229 - RNA, 32 nt, Human
cucaaagugauccucccaugucagccuccuga

SEQ ID NO: 393230 - RNA, 22 nt, Human
cucaaagugcugggauuacagg

SEQ ID NO: 393231 - RNA, 22 nt, Human
cucaaagugcugggauuacggg

SEQ ID NO: 393232 - RNA, 22 nt, Human
cucaaagugcugggauuagagg

SEQ ID NO: 393233 - RNA, 22 nt, Human
cucaaagugcugggauuauagg

SEQ ID NO: 393234 - RNA, 32 nt, Human
cucaaaguggggguggagacucugauuuuccc

SEQ ID NO: 393235 - RNA, 32 nt, Human
cucaaagugugggcccuggaccaguggcagca

SEQ ID NO: 393236 - RNA, 22 nt, Human
cucaaaguguugggauugcagg

SEQ ID NO: 393237 - RNA, 32 nt, Human
cucaaauaaggcagacuuuaaccaucugauaa

SEQ ID NO: 393238 - RNA, 32 nt, Human
cucaaauacaugcacagucauacaagucaugg

SEQ ID NO: 393239 - RNA, 31 nt, Human
cucaaauagagaccuguugguugcuagggua

SEQ ID NO: 393240 - RNA, 32 nt, Human
cucaaauagagcccugggggcagagcuccugg

SEQ ID NO: 393241 - RNA, 32 nt, Human
cucaaauccugaguuauugcugcaugcuuuaa

SEQ ID NO: 393242 - RNA, 32 nt, Human
cucaaauccuuuucucuuucccuuacuucauc

SEQ ID NO: 393243 - RNA, 23 nt, Human
cucaaaucucagaauaggaucaa

SEQ ID NO: 393244 - RNA, 32 nt, Human
cucaaaucuguuguguuucugagucuaggguc

SEQ ID NO: 393245 - RNA, 24 nt, Human
cucaaaucuugaacccuggaccaa

SEQ ID NO: 393246 - RNA, 32 nt, Human
cucaaaucuuggugaacccugagagcuaccca

SEQ ID NO: 393247 - RNA, 32 nt, Human
cucaaaugaaaauucuuuaucugaaauuuuaa

SEQ ID NO: 393248 - RNA, 22 nt, Human
cucaaaugauccucccaccuca

SEQ ID NO: 393249 - RNA, 32 nt, Human
cucaaaugaucugcccaccucuaccuccaaag

SEQ ID NO: 393250 - RNA, 32 nt, Human
cucaaaugccuguaaucccaguacuuugggag

SEQ ID NO: 393251 - RNA, 32 nt, Human
cucaaauggacccugaggaaauggauaccuga

SEQ ID NO: 393252 - RNA, 32 nt, Human
cucaaauggcacccuggcuggcugcaagcagc

SEQ ID NO: 393253 - RNA, 32 nt, Human
cucaaauggugcuucugcccaugaugguacca

SEQ ID NO: 393254 - RNA, 32 nt, Human
cucaaauguaauaaaauugaggcuccacggag

SEQ ID NO: 393255 - RNA, 32 nt, Human
cucaaauguauuuuccuaauugcccacuugag

SEQ ID NO: 393256 - RNA, 21 nt, Human
cucaaauuccaacugaaauca

SEQ ID NO: 393257 - RNA, 32 nt, Human
cucaaauuccagaaguggaggcuccagccucc

SEQ ID NO: 393258 - RNA, 32 nt, Human
cucaaauuguaauccccaugugucaagggagg

SEQ ID NO: 393259 - RNA, 32 nt, Human
cucaaauuuuauuuagguucaggggguacaug

SEQ ID NO: 393260 - RNA, 19 nt, Human
cucaaauuuucuaacuugu

SEQ ID NO: 393261 - RNA, 32 nt, Human
cucaacaaaugucaucaaauauguugaauuga

SEQ ID NO: 393262 - RNA, 32 nt, Human
cucaacaacccuaggaggguucuugaagcuuu

SEQ ID NO: 393263 - RNA, 21 nt, Human
cucaacaaccugaauguccca

SEQ ID NO: 393264 - RNA, 22 nt, Human
cucaacaaugccccccaucgcc

SEQ ID NO: 393265 - RNA, 32 nt, Human
cucaacacacagaucuccuacuccauccaguc

SEQ ID NO: 393266 - RNA, 22 nt, Human
cucaacacacuccuccuccccu

SEQ ID NO: 393267 - RNA, 22 nt, Human
cucaacacccuccaccuucccc

SEQ ID NO: 393268 - RNA, 26 nt, Human
cucaacaccuuuugcccuccuccccu

SEQ ID NO: 393269 - RNA, 32 nt, Human
cucaacacgcugauucuccuccugccucuccc

SEQ ID NO: 393270 - RNA, 32 nt, Human
cucaacacgguguugcucuucagucauaccgg

SEQ ID NO: 393271 - RNA, 32 nt, Human
cucaacacuaccugugggaugccuuaguuacc

SEQ ID NO: 393272 - RNA, 22 nt, Human
cucaacacugugcuccacauca

SEQ ID NO: 393273 - RNA, 32 nt, Human
cucaacacuuccuuccccaaagccagaagaug

SEQ ID NO: 393274 - RNA, 32 nt, Human
cucaacagacaccuccagcacagcuucaccag

SEQ ID NO: 393275 - RNA, 32 nt, Human
cucaacagacccaucaagucacgcuguuggac

SEQ ID NO: 393276 - RNA, 32 nt, Human
cucaacagauuauuccuccucuccuuagaaua

SEQ ID NO: 393277 - RNA, 22 nt, Human
cucaacagccccuuccaccccu

SEQ ID NO: 393278 - RNA, 32 nt, Human
cucaacagccuccaccucccuuucuacccuca

SEQ ID NO: 393279 - RNA, 32 nt, Human
cucaacaggccucagggcuccuugugggccug

SEQ ID NO: 393280 - RNA, 32 nt, Human
cucaacaggcugagguugggaggaucaccuga

SEQ ID NO: 393281 - RNA, 32 nt, Human
cucaacaggguccauugccucuugccuccaga

SEQ ID NO: 393282 - RNA, 32 nt, Human
cucaacagggucucccucuguugcccaggcug

SEQ ID NO: 393283 - RNA, 22 nt, Human
cucaacagugguccucaucccu

SEQ ID NO: 393284 - RNA, 32 nt, Human
cucaacaguguuaaaagaggaagugaccucac

SEQ ID NO: 393285 - RNA, 24 nt, Human
cucaacaucauuggucaucagaga

SEQ ID NO: 393286 - RNA, 32 nt, Human
cucaacaucugauuguuuuccaccucagccug

SEQ ID NO: 393287 - RNA, 31 nt, Human
cucaacaugagcuauugguugggucugguga

SEQ ID NO: 393288 - RNA, 32 nt, Human
cucaacaugccugcuaaccuagccuucuagaa

SEQ ID NO: 393289 - RNA, 24 nt, Human
cucaacauuacugaucauuagaga

SEQ ID NO: 393290 - RNA, 32 nt, Human
cucaacauucacgugccucuugcuuucuuucu

SEQ ID NO: 393291 - RNA, 32 nt, Human
cucaaccaaaacaagucuuuuggcuuucuuuu

SEQ ID NO: 393292 - RNA, 21 nt, Human
cucaaccaacuccuuuagcau

SEQ ID NO: 393293 - RNA, 32 nt, Human
cucaaccaaucacauggcugucaacaaugcca

SEQ ID NO: 393294 - RNA, 32 nt, Human
cucaaccaccaccaccaccaccaccccuacua

SEQ ID NO: 393295 - RNA, 32 nt, Human
cucaaccagcuacucaggaggcugggcaggag

SEQ ID NO: 393296 - RNA, 32 nt, Human
cucaaccauagcaugcaggaacagcgaagcca

SEQ ID NO: 393297 - RNA, 24 nt, Human
cucaaccauccugccaaugcccag

SEQ ID NO: 393298 - RNA, 32 nt, Human
cucaacccaagaaccuguuuccuggaccagug

SEQ ID NO: 393299 - RNA, 32 nt, Human
cucaacccaccugcaugcaucucccccagagg

SEQ ID NO: 393300 - RNA, 18 nt, Human
cucaacccaucuuccuag

SEQ ID NO: 393301 - RNA, 20 nt, Human
cucaacccaugauucaggga

SEQ ID NO: 393302 - RNA, 32 nt, Human
cucaaccccagccuggggcuuugugcugcacc

SEQ ID NO: 393303 - RNA, 32 nt, Human
cucaaccccaucauccugccccuguggcaugu

SEQ ID NO: 393304 - RNA, 32 nt, Human
cucaaccccguccccuucgcacugaccacacc

SEQ ID NO: 393305 - RNA, 23 nt, Human
cucaaccccuccccuccaucccu

SEQ ID NO: 393306 - RNA, 32 nt, Human
cucaaccccuuccuccucccucuggggaugaa

SEQ ID NO: 393307 - RNA, 32 nt, Human
cucaacccuaaucugcagccccgccuuugccu

SEQ ID NO: 393308 - RNA, 21 nt, Human
cucaacccucaccuccauccc

SEQ ID NO: 393309 - RNA, 32 nt, Human
cucaacccuccaggggucaggagugguaccag

SEQ ID NO: 393310 - RNA, 32 nt, Human
cucaacccugcacccacccuccuccagggauc

SEQ ID NO: 393311 - RNA, 32 nt, Human
cucaacccugcuccucccgguaggccagcugc

SEQ ID NO: 393312 - RNA, 32 nt, Human
cucaacccuucaagaaaguacaugucaggaac

SEQ ID NO: 393313 - RNA, 32 nt, Human
cucaaccuaccuggcauauuuauuuugcaguc

SEQ ID NO: 393314 - RNA, 32 nt, Human
cucaaccucagacuucucagccugccuaacug

SEQ ID NO: 393315 - RNA, 32 nt, Human
cucaaccuccacccugucccauggcccaagga

SEQ ID NO: 393316 - RNA, 32 nt, Human
cucaaccucccaggcucaaucgauccuuccaa

SEQ ID NO: 393317 - RNA, 32 nt, Human
cucaaccucuaggauuuugcaugcagagcgga

SEQ ID NO: 393318 - RNA, 32 nt, Human
cucaaccucuccagauucaagugauccuccca

SEQ ID NO: 393319 - RNA, 32 nt, Human
cucaaccugcagcccucaucuccgccggcgag

SEQ ID NO: 393320 - RNA, 32 nt, Human
cucaaccugccugccccucacccgccguggga

SEQ ID NO: 393321 - RNA, 32 nt, Human
cucaaccuggacucaaguuacuguggugagaa

SEQ ID NO: 393322 - RNA, 32 nt, Human
cucaaccuggcccgcggaccucaggccaucgc

SEQ ID NO: 393323 - RNA, 32 nt, Human
cucaaccuguauuggacagcacugccucuuuu

SEQ ID NO: 393324 - RNA, 32 nt, Human
cucaaccuugaccaucuccaucugcccuuaaa

SEQ ID NO: 393325 - RNA, 32 nt, Human
cucaaccuugcaaagccauccaccucauugug

SEQ ID NO: 393326 - RNA, 32 nt, Human
cucaaccuuggggccagcaucucccacugccu

SEQ ID NO: 393327 - RNA, 32 nt, Human
cucaacgaguuucuuuggucuuuacugaaaga

SEQ ID NO: 393328 - RNA, 20 nt, Human
cucaacgcccugcugguggc

SEQ ID NO: 393329 - RNA, 32 nt, Human
cucaacgcccugcugguggcugcugaacaccu

SEQ ID NO: 393330 - RNA, 32 nt, Human
cucaacgcgcugcugcugcugcucuaucggcc

SEQ ID NO: 393331 - RNA, 32 nt, Human
cucaacggguguagccacuggugcuuugaagc

SEQ ID NO: 393332 - RNA, 32 nt, Human
cucaacguauauccuucccaucuauugccuuc

SEQ ID NO: 393333 - RNA, 32 nt, Human
cucaacguggguguggccgaggugaagaaauc

SEQ ID NO: 393334 - RNA, 32 nt, Human
cucaacuaaaaauacaaaaauuagccaggugu

SEQ ID NO: 393335 - RNA, 32 nt, Human
cucaacuaaaaauauaaaaauuagccaggcgu

SEQ ID NO: 393336 - RNA, 32 nt, Human
cucaacucaagcaauccucccaccucagccac

SEQ ID NO: 393337 - RNA, 32 nt, Human
cucaacucacucuagccugggugacagagcga

SEQ ID NO: 393338 - RNA, 23 nt, Human
cucaacucacugcaaccuccgcu

SEQ ID NO: 393339 - RNA, 32 nt, Human
cucaacucacugcaaccucugcccuucagguu

SEQ ID NO: 393340 - RNA, 32 nt, Human
cucaacucacugcaagcuccgccuccuggguu

SEQ ID NO: 393341 - RNA, 24 nt, Human
cucaacucacuguaaccuccgccu

SEQ ID NO: 393342 - RNA, 32 nt, Human
cucaacucagagccauggaggcaaguaccuua

SEQ ID NO: 393343 - RNA, 32 nt, Human
cucaacuccaacccuugcuugucucaaggcac

SEQ ID NO: 393344 - RNA, 20 nt, Human
cucaacuccaccccauccca

SEQ ID NO: 393345 - RNA, 18 nt, Human
cucaacuccccucgggca

SEQ ID NO: 393346 - RNA, 32 nt, Human
cucaacucuccccaggaaaguuuccccuguuu

SEQ ID NO: 393347 - RNA, 32 nt, Human
cucaacugauccucgcaucucagccuccugag

SEQ ID NO: 393348 - RNA, 32 nt, Human
cucaacugccccuuuccucucccucagaauuu

SEQ ID NO: 393349 - RNA, 32 nt, Human
cucaacuggcagcugcuccucggcugggcgcc

SEQ ID NO: 393350 - RNA, 32 nt, Human
cucaacuggccucugcugccaggccacugccu

SEQ ID NO: 393351 - RNA, 32 nt, Human
cucaacugugugguaacagaaagcuucuuacc

SEQ ID NO: 393352 - RNA, 32 nt, Human
cucaacuuaugacgcaguugugaugggguuau

SEQ ID NO: 393353 - RNA, 23 nt, Human
cucaacuuccuacugcaagcuua

SEQ ID NO: 393354 - RNA, 32 nt, Human
cucaacuucucccauccucucaccuccuauuu

SEQ ID NO: 393355 - RNA, 18 nt, Human
cucaacuugcacuguaua

SEQ ID NO: 393356 - RNA, 32 nt, Human
cucaacuugccaguugcugggugcugggcccu

SEQ ID NO: 393357 - RNA, 32 nt, Human
cucaacuugcugggacacugacaggcguuccu

SEQ ID NO: 393358 - RNA, 22 nt, Human
cucaagaaaauucacuauguga

SEQ ID NO: 393359 - RNA, 20 nt, Human
cucaagaaagcugguccagg

SEQ ID NO: 393360 - RNA, 32 nt, Human
cucaagaaaguggagaaggaaacgcugggaaa

SEQ ID NO: 393361 - RNA, 32 nt, Human
cucaagaacaccuuuguuuugcacugacaaga

SEQ ID NO: 393362 - RNA, 32 nt, Human
cucaagaacgggcucaucagcaaccgcagcgu

SEQ ID NO: 393363 - RNA, 32 nt, Human
cucaagaacugaucuucgguuuuacaauagug

SEQ ID NO: 393364 - RNA, 32 nt, Human
cucaagaacugggaguauguuccuucagggag

SEQ ID NO: 393365 - RNA, 23 nt, Human
cucaagaaggaccaagaaguuuu

SEQ ID NO: 393366 - RNA, 32 nt, Human
cucaagaauguucacuuacugauuacuacaau

SEQ ID NO: 393367 - RNA, 32 nt, Human
cucaagaauugcuuguuacaggcacaguagcc

SEQ ID NO: 393368 - RNA, 32 nt, Human
cucaagacaagaaacugcuccuucacuaccca

SEQ ID NO: 393369 - RNA, 32 nt, Human
cucaagacaagccuggccaacauggugaaacc

SEQ ID NO: 393370 - RNA, 32 nt, Human
cucaagacaagugugggcaacacagcaagacc

SEQ ID NO: 393371 - RNA, 21 nt, Human
cucaagacacauugacacugu

SEQ ID NO: 393372 - RNA, 32 nt, Human
cucaagaccagccugaccaacauggugaaauc

SEQ ID NO: 393373 - RNA, 32 nt, Human
cucaagaccagccugaccaauauagugaaaca

SEQ ID NO: 393374 - RNA, 32 nt, Human
cucaagaccagccuggacaacauggcaagacc

SEQ ID NO: 393375 - RNA, 32 nt, Human
cucaagaccagccuggccaacuuggugaaacc

SEQ ID NO: 393376 - RNA, 32 nt, Human
cucaagaccagccuggcuaacauggugaaacc

SEQ ID NO: 393377 - RNA, 32 nt, Human
cucaagaccagccuggguaacaaagugagacc

SEQ ID NO: 393378 - RNA, 32 nt, Human
cucaagaccagccuggucaacauggugaaacc

SEQ ID NO: 393379 - RNA, 32 nt, Human
cucaagaccaggcugcagccuccacuucccuc

SEQ ID NO: 393380 - RNA, 32 nt, Human
cucaagaccauccuggaugcccaggaccugga

SEQ ID NO: 393381 - RNA, 32 nt, Human
cucaagaccucuucccccuugccuuuaaccuu

SEQ ID NO: 393382 - RNA, 32 nt, Human
cucaagacugacuuacagaccaaccaaccacc

SEQ ID NO: 393383 - RNA, 24 nt, Human
cucaagacuggcgcuaaaaguuuu

SEQ ID NO: 393384 - RNA, 32 nt, Human
cucaagagcaaagguuaauuuaaggacaaaga

SEQ ID NO: 393385 - RNA, 24 nt, Human
cucaagaggccgagguugcaguga

SEQ ID NO: 393386 - RNA, 32 nt, Human
cucaagaggccgagguugcagugagccgugau

SEQ ID NO: 393387 - RNA, 32 nt, Human
cucaagagguccuuccaucucagucucccaag

SEQ ID NO: 393388 - RNA, 32 nt, Human
cucaagagguugaggcugcagugagcccugau

SEQ ID NO: 393389 - RNA, 21 nt, Human
cucaagauaauauaacuuuga

SEQ ID NO: 393390 - RNA, 32 nt, Human
cucaagaucacuccuaggcuucucccaaaccc

SEQ ID NO: 393391 - RNA, 32 nt, Human
cucaagaucagccugggcaacauggugaaacc

SEQ ID NO: 393392 - RNA, 32 nt, Human
cucaagauccaguugaagaugcagucuuuggc

SEQ ID NO: 393393 - RNA, 32 nt, Human
cucaagauccaugccagggagcucuuugacuc

SEQ ID NO: 393394 - RNA, 28 nt, Human
cucaagaucugugcugccuccucaggag

SEQ ID NO: 393395 - RNA, 32 nt, Human
cucaagauguacugguucccuggcaccuuaag

SEQ ID NO: 393396 - RNA, 32 nt, Human
cucaagaugugccugcuccacccccaguugac

SEQ ID NO: 393397 - RNA, 32 nt, Human
cucaagcaaccaggucuuccugccauuccccu

SEQ ID NO: 393398 - RNA, 22 nt, Human
cucaagcaacccucccaccuua

SEQ ID NO: 393399 - RNA, 32 nt, Human
cucaagcaaucagcccaccucugccucccaaa

SEQ ID NO: 393400 - RNA, 22 nt, Human
cucaagcaauccucccaccuca

SEQ ID NO: 393401 - RNA, 22 nt, Human
cucaagcaauccucccacuuca

SEQ ID NO: 393402 - RNA, 32 nt, Human
cucaagcaauccucccaucucagccucuuaaa

SEQ ID NO: 393403 - RNA, 22 nt, Human
cucaagcaauccucccccuuca

SEQ ID NO: 393404 - RNA, 22 nt, Human
cucaagcaauccucccgccuca

SEQ ID NO: 393405 - RNA, 32 nt, Human
cucaagcaauccuccugccucugccucccaag

SEQ ID NO: 393406 - RNA, 22 nt, Human
cucaagcaauccucucaccuca

SEQ ID NO: 393407 - RNA, 32 nt, Human
cucaagcaauucgacaucucaagugagacaug

SEQ ID NO: 393408 - RNA, 22 nt, Human
cucaagcaauucucccaccuca

SEQ ID NO: 393409 - RNA, 32 nt, Human
cucaagcagaccuacaagaugggguacuaaca

SEQ ID NO: 393410 - RNA, 32 nt, Human
cucaagcagcacagaggaaggggcaagacgug

SEQ ID NO: 393411 - RNA, 32 nt, Human
cucaagcagcugagacagggaagacagcauaa

SEQ ID NO: 393412 - RNA, 32 nt, Human
cucaagcaggguggcgcgcaugagcggcgaag

SEQ ID NO: 393413 - RNA, 32 nt, Human
cucaagcagggugggcagugagagcugcuaug

SEQ ID NO: 393414 - RNA, 32 nt, Human
cucaagcaguaggaaaggaccugcucuuacau

SEQ ID NO: 393415 - RNA, 22 nt, Human
cucaagcaguccucccacccca

SEQ ID NO: 393416 - RNA, 22 nt, Human
cucaagcaguccucccaccuca

SEQ ID NO: 393417 - RNA, 22 nt, Human
cucaagcaguucucccaccuca

SEQ ID NO: 393418 - RNA, 32 nt, Human
cucaagccaccugcgaacacugcugcuaccau

SEQ ID NO: 393419 - RNA, 32 nt, Human
cucaagccacugaagagcaucuccccacccag

SEQ ID NO: 393420 - RNA, 32 nt, Human
cucaagccaguucuucucuuccagaagaauuc

SEQ ID NO: 393421 - RNA, 22 nt, Human
cucaagccauccucccaccuca

SEQ ID NO: 393422 - RNA, 32 nt, Human
cucaagccaucuuuccaccucagccugccagu

SEQ ID NO: 393423 - RNA, 24 nt, Human
cucaagcccauaaucccagcacuu

SEQ ID NO: 393424 - RNA, 32 nt, Human
cucaagcccauaaucccagcacuuugggaggc

SEQ ID NO: 393425 - RNA, 25 nt, Human
cucaagccccuccccacaccuggug

SEQ ID NO: 393426 - RNA, 32 nt, Human
cucaagcccugccuuccgguacaggauaagga

SEQ ID NO: 393427 - RNA, 32 nt, Human
cucaagcccugggaggucaaggcugcagugag

SEQ ID NO: 393428 - RNA, 32 nt, Human
cucaagccuauaaucccagcacuuugggaggc

SEQ ID NO: 393429 - RNA, 32 nt, Human
cucaagccucuucagccuuucucagcagucuc

SEQ ID NO: 393430 - RNA, 32 nt, Human
cucaagccuggcgacagagcgagacuccgucu

SEQ ID NO: 393431 - RNA, 32 nt, Human
cucaagccugggaagucacaggaagcagcagc

SEQ ID NO: 393432 - RNA, 21 nt, Human
cucaagccugggcaacagagc

SEQ ID NO: 393433 - RNA, 32 nt, Human
cucaagccuggugacagagcgaaacuccgucu

SEQ ID NO: 393434 - RNA, 32 nt, Human
cucaagccuguaaucccagcacguugggaggc

SEQ ID NO: 393435 - RNA, 32 nt, Human
cucaagccuguaaucccagcacuuuagguggc

SEQ ID NO: 393436 - RNA, 32 nt, Human
cucaagccuguaaucccagcacuuugggaggc

SEQ ID NO: 393437 - RNA, 32 nt, Human
cucaagccuguaaucccagcacuuuggguggc

SEQ ID NO: 393438 - RNA, 32 nt, Human
cucaagccuguaaucccagcauuuugggaggc

SEQ ID NO: 393439 - RNA, 32 nt, Human
cucaagccuguaauccuagcacuuugggaggc

SEQ ID NO: 393440 - RNA, 32 nt, Human
cucaagccuguacucccagcacuuuuggaggc

SEQ ID NO: 393441 - RNA, 32 nt, Human
cucaagccuguaucccagcacuuugggaggca

SEQ ID NO: 393442 - RNA, 32 nt, Human
cucaagccuuucuccaccaggccccucaucug

SEQ ID NO: 393443 - RNA, 22 nt, Human
cucaagcgauccaccccccuca

SEQ ID NO: 393444 - RNA, 22 nt, Human
cucaagcgauccucccaccuca

SEQ ID NO: 393445 - RNA, 32 nt, Human
cucaagcgauccucccaucucagccucccaaa

SEQ ID NO: 393446 - RNA, 32 nt, Human
cucaagcgauccucccaucucagccucccaga

SEQ ID NO: 393447 - RNA, 32 nt, Human
cucaagcgauccucccaucucagccucccuga

SEQ ID NO: 393448 - RNA, 32 nt, Human
cucaagcgauccuccuuccucauccuucuaaa

SEQ ID NO: 393449 - RNA, 32 nt, Human
cucaagcgauccucucaucucagccuccugag

SEQ ID NO: 393450 - RNA, 32 nt, Human
cucaagcgcaguuucaagucucaggccguggg

SEQ ID NO: 393451 - RNA, 32 nt, Human
cucaagcgcuggagcuugucgguggccgguaa

SEQ ID NO: 393452 - RNA, 30 nt, Human
cucaagcggggccacagggccaaggugugc

SEQ ID NO: 393453 - RNA, 32 nt, Human
cucaagcuaguucaucaaacaggccaguuagg

SEQ ID NO: 393454 - RNA, 32 nt, Human
cucaagcucccuuccccucucuggcugcccuc

SEQ ID NO: 393455 - RNA, 32 nt, Human
cucaagcucuucugcuagugcccugccccugu

SEQ ID NO: 393456 - RNA, 32 nt, Human
cucaagcugcagcuggacugcaggcuuauuuu

SEQ ID NO: 393457 - RNA, 32 nt, Human
cucaagcugggcucugugugaggccuggcccc

SEQ ID NO: 393458 - RNA, 32 nt, Human
cucaagcuggucucaagcuccugggcucaagc

SEQ ID NO: 393459 - RNA, 32 nt, Human
cucaagcuguagugcaguggugccaucuuggc

SEQ ID NO: 393460 - RNA, 32 nt, Human
cucaagcuguuuggacgccacagccaggacca

SEQ ID NO: 393461 - RNA, 32 nt, Human
cucaagcuuaaucuccucuucucuccaacucu

SEQ ID NO: 393462 - RNA, 32 nt, Human
cucaagcuuguauuaccagcacuuuaggaggu

SEQ ID NO: 393463 - RNA, 32 nt, Human
cucaaggaaaagguuuucaugauaacuuuguu

SEQ ID NO: 393464 - RNA, 18 nt, Human
cucaaggaagcauagcca

SEQ ID NO: 393465 - RNA, 32 nt, Human
cucaaggaaggcauguaaacagcaaccucggg

SEQ ID NO: 393466 - RNA, 17 nt, Human
cucaaggaauccuguca

SEQ ID NO: 393467 - RNA, 32 nt, Human
cucaaggaccacagccucugcccaccagcaug

SEQ ID NO: 393468 - RNA, 16 nt, Human
cucaaggaccauggcc

SEQ ID NO: 393469 - RNA, 32 nt, Human
cucaaggacucauguauaccauauguuccacu

SEQ ID NO: 393470 - RNA, 16 nt, Human
cucaaggacuccagcc

SEQ ID NO: 393471 - RNA, 32 nt, Human
cucaaggagcacaguccugggaaaggccuagg

SEQ ID NO: 393472 - RNA, 32 nt, Human
cucaaggaggaacuggcaaaugcugaauauuc

SEQ ID NO: 393473 - RNA, 32 nt, Human
cucaaggaguggccuugucucuggccuguccc

SEQ ID NO: 393474 - RNA, 19 nt, Human
cucaaggaucaauaaucca

SEQ ID NO: 393475 - RNA, 15 nt, Human
cucaaggaucaccca

SEQ ID NO: 393476 - RNA, 18 nt, Human
cucaaggaucuagaacca

SEQ ID NO: 393477 - RNA, 32 nt, Human
cucaaggcaaagcugcacaacauaacaagacc

SEQ ID NO: 393478 - RNA, 32 nt, Human
cucaaggcaccuggauggugacccugggccgu

SEQ ID NO: 393479 - RNA, 20 nt, Human
cucaaggcaggcagcccagg

SEQ ID NO: 393480 - RNA, 19 nt, Human
cucaaggcagggcucuggg

SEQ ID NO: 393481 - RNA, 32 nt, Human
cucaaggccaauuccaauuggaucgaguuuuu

SEQ ID NO: 393482 - RNA, 32 nt, Human
cucaaggccccuggcccuuacugagccugcag

SEQ ID NO: 393483 - RNA, 32 nt, Human
cucaaggccuauagccugucacuccuugaagc

SEQ ID NO: 393484 - RNA, 32 nt, Human
cucaaggccuccuccaccuccaccuccacccc

SEQ ID NO: 393485 - RNA, 32 nt, Human
cucaaggccugggaagguuuucuaaucugugc

SEQ ID NO: 393486 - RNA, 32 nt, Human
cucaagggaagacaucaagacuggacuugaac

SEQ ID NO: 393487 - RNA, 32 nt, Human
cucaagggauccucccaucucagccucccaag

SEQ ID NO: 393488 - RNA, 32 nt, Human
cucaagggauccucccaucucagcuuccugag

SEQ ID NO: 393489 - RNA, 32 nt, Human
cucaagggauccugccaucucagcuucccaag

SEQ ID NO: 393490 - RNA, 32 nt, Human
cucaagggauuccuggcuggcuaugugguggc

SEQ ID NO: 393491 - RNA, 17 nt, Human
cucaagggcacaugcca

SEQ ID NO: 393492 - RNA, 32 nt, Human
cucaagggcagggauucucccacccaccuaag

SEQ ID NO: 393493 - RNA, 32 nt, Human
cucaagggcuguagauguucccuuuccacccc

SEQ ID NO: 393494 - RNA, 32 nt, Human
cucaagggcuugcagccccacugcuccuucua

SEQ ID NO: 393495 - RNA, 32 nt, Human
cucaaggggacagcugcuguggcagauauuug

SEQ ID NO: 393496 - RNA, 32 nt, Human
cucaaggggaccugccccagccuccucuugua

SEQ ID NO: 393497 - RNA, 17 nt, Human
cucaaggggcccagcca

SEQ ID NO: 393498 - RNA, 32 nt, Human
cucaaggucacaggucacgcuggcacgccugg

SEQ ID NO: 393499 - RNA, 32 nt, Human
cucaaggucagccuucagauuugggagcaaac

SEQ ID NO: 393500 - RNA, 32 nt, Human
cucaaggugagagugagcuacaagaugaggcu

SEQ ID NO: 393501 - RNA, 32 nt, Human
cucaagguguagcagaggaauuuguaggagag

SEQ ID NO: 393502 - RNA, 32 nt, Human
cucaaggugucacccuaacagaccuucaagaa

SEQ ID NO: 393503 - RNA, 32 nt, Human
cucaaggugucacccuaacagaccuucaagag

SEQ ID NO: 393504 - RNA, 32 nt, Human
cucaagguuauuauucugacaccagcuugcug

SEQ ID NO: 393505 - RNA, 20 nt, Human
cucaagguugaggccgccau

SEQ ID NO: 393506 - RNA, 32 nt, Human
cucaagguuuaaugauggugugcauggaaggc

SEQ ID NO: 393507 - RNA, 32 nt, Human
cucaagguuucuguucauuaugaaacaucaau

SEQ ID NO: 393508 - RNA, 32 nt, Human
cucaagguuugaagacuuccuagcuuguccua

SEQ ID NO: 393509 - RNA, 32 nt, Human
cucaaguaaacuaucucugccuucaaggagcu

SEQ ID NO: 393510 - RNA, 32 nt, Human
cucaaguaccccaguuucacacauaccaaacc

SEQ ID NO: 393511 - RNA, 32 nt, Human
cucaaguagcagagacaggugugcaaaggcuc

SEQ ID NO: 393512 - RNA, 32 nt, Human
cucaaguagcagggacaggugugcaaaagcuc

SEQ ID NO: 393513 - RNA, 31 nt, Human
cucaaguauaucugugcuucacuggaagagu

SEQ ID NO: 393514 - RNA, 32 nt, Human
cucaaguauggugaggacagagugucauguga

SEQ ID NO: 393515 - RNA, 32 nt, Human
cucaagucacauaauaucagcacuuugugcug

SEQ ID NO: 393516 - RNA, 32 nt, Human
cucaagucaggaguucgagaccagccuggcca

SEQ ID NO: 393517 - RNA, 32 nt, Human
cucaaguccacugucacaaucccuuucagaaa

SEQ ID NO: 393518 - RNA, 32 nt, Human
cucaaguccaggaguucgagaccagccugggc

SEQ ID NO: 393519 - RNA, 32 nt, Human
cucaagucccccaagaccuaaggguuuuaucu

SEQ ID NO: 393520 - RNA, 31 nt, Human
cucaaguccucuuggaggccuguguuuucuu

SEQ ID NO: 393521 - RNA, 32 nt, Human
cucaaguccugacugaggucuccaauuaccuu

SEQ ID NO: 393522 - RNA, 32 nt, Human
cucaagucggccucuccaugcccagccuccug

SEQ ID NO: 393523 - RNA, 32 nt, Human
cucaagucucucucccccuccuuucucccccu

SEQ ID NO: 393524 - RNA, 32 nt, Human
cucaagucuguaaucccagcgcuuugggaggc

SEQ ID NO: 393525 - RNA, 32 nt, Human
cucaagugaacugcaggaauccuccaacaacc

SEQ ID NO: 393526 - RNA, 32 nt, Human
cucaagugacaacugggaccuggaccucuggg

SEQ ID NO: 393527 - RNA, 22 nt, Human
cucaagugacccucccaccuca

SEQ ID NO: 393528 - RNA, 31 nt, Human
cucaagugacucagccugguuggagaacugc

SEQ ID NO: 393529 - RNA, 32 nt, Human
cucaagugagccacaucugccucagccucccg

SEQ ID NO: 393530 - RNA, 22 nt, Human
cucaagugauccacccaccuca

SEQ ID NO: 393531 - RNA, 32 nt, Human
cucaagugauccacccaccucugccucccaaa

SEQ ID NO: 393532 - RNA, 22 nt, Human
cucaagugauccacccacuuca

SEQ ID NO: 393533 - RNA, 22 nt, Human
cucaagugauccgcccaccuca

SEQ ID NO: 393534 - RNA, 32 nt, Human
cucaagugauccgccugccucuaccucccaaa

SEQ ID NO: 393535 - RNA, 22 nt, Human
cucaagugauccucacaccuca

SEQ ID NO: 393536 - RNA, 22 nt, Human
cucaagugauccucccaccuca

SEQ ID NO: 393537 - RNA, 32 nt, Human
cucaagugauccucccaccucugccucccaaa

SEQ ID NO: 393538 - RNA, 22 nt, Human
cucaagugauccuccugccuca

SEQ ID NO: 393539 - RNA, 22 nt, Human
cucaagugauccuccugucuca

SEQ ID NO: 393540 - RNA, 32 nt, Human
cucaagugauccuuccaucucagccucccaaa

SEQ ID NO: 393541 - RNA, 32 nt, Human
cucaagugauccuuccaucucagccucccgag

SEQ ID NO: 393542 - RNA, 32 nt, Human
cucaagugaucuaccugccucugccucccaaa

SEQ ID NO: 393543 - RNA, 32 nt, Human
cucaagugaucuaccugccucugccucccgaa

SEQ ID NO: 393544 - RNA, 32 nt, Human
cucaagugauucuaucgccucugccucccaaa

SEQ ID NO: 393545 - RNA, 32 nt, Human
cucaagugauucucccaucucagccucccaaa

SEQ ID NO: 393546 - RNA, 32 nt, Human
cucaagugccugccccugacacuccuggcccu

SEQ ID NO: 393547 - RNA, 32 nt, Human
cucaaguggaaagaaaugcaaagagaaaauga

SEQ ID NO: 393548 - RNA, 32 nt, Human
cucaaguggacauaccuuaucuugucagcucu

SEQ ID NO: 393549 - RNA, 32 nt, Human
cucaaguggggugggauuggggugggguccua

SEQ ID NO: 393550 - RNA, 32 nt, Human
cucaaguguuaggcagggucucaggccuuuga

SEQ ID NO: 393551 - RNA, 32 nt, Human
cucaaguguucauucauuuaauucuuaccaca

SEQ ID NO: 393552 - RNA, 32 nt, Human
cucaaguucauuuuucucuguuucugagauuc

SEQ ID NO: 393553 - RNA, 32 nt, Human
cucaaguucugaggucagaguggaccccguca

SEQ ID NO: 393554 - RNA, 32 nt, Human
cucaaguuuuagcaacucaccaacuaaggcgu

SEQ ID NO: 393555 - RNA, 32 nt, Human
cucaauaaaagcuuguuaauugauggaccaca

SEQ ID NO: 393556 - RNA, 32 nt, Human
cucaauaaaauuauagcucuaauguuugcaua

SEQ ID NO: 393557 - RNA, 32 nt, Human
cucaauaacucaguguagcacuuuaaagucug

SEQ ID NO: 393558 - RNA, 32 nt, Human
cucaauaaguugagcccagguguccucuuucc

SEQ ID NO: 393559 - RNA, 22 nt, Human
cucaauacaauuugucacauca

SEQ ID NO: 393560 - RNA, 32 nt, Human
cucaauaccaucaucucuuaucucuauacagg

SEQ ID NO: 393561 - RNA, 32 nt, Human
cucaauaccuggccucauuuaaaacaagacuu

SEQ ID NO: 393562 - RNA, 32 nt, Human
cucaauacucucaucaaaaucaggguauuaac

SEQ ID NO: 393563 - RNA, 31 nt, Human
cucaauacugugagagaaagacuguacucca

SEQ ID NO: 393564 - RNA, 32 nt, Human
cucaauagaagaggaggaaaacauguuuuuaa

SEQ ID NO: 393565 - RNA, 32 nt, Human
cucaauagccuagggagagucgaugaaggaua

SEQ ID NO: 393566 - RNA, 32 nt, Human
cucaaucaagaaaauucugagacuauuaauaa

SEQ ID NO: 393567 - RNA, 32 nt, Human
cucaaucaucuucuccuggccaaggcucugac

SEQ ID NO: 393568 - RNA, 32 nt, Human
cucaauccaccagaaccaugggcugcuguggc

SEQ ID NO: 393569 - RNA, 22 nt, Human
cucaauccacucagcacuuggc

SEQ ID NO: 393570 - RNA, 32 nt, Human
cucaauccagaaggaggccuaagugggcauca

SEQ ID NO: 393571 - RNA, 32 nt, Human
cucaauccagccuuagcugagcaccugucccc

SEQ ID NO: 393572 - RNA, 32 nt, Human
cucaauccaguuuugaccagucugacuuggug

SEQ ID NO: 393573 - RNA, 32 nt, Human
cucaauccccaaaggcaagguggacgcaguua

SEQ ID NO: 393574 - RNA, 32 nt, Human
cucaauccccaaaggcaagguggaugcaguua

SEQ ID NO: 393575 - RNA, 32 nt, Human
cucaauccccucccaucuuccccagaccuacc

SEQ ID NO: 393576 - RNA, 32 nt, Human
cucaauccucaagguugcucacugcaaauaua

SEQ ID NO: 393577 - RNA, 32 nt, Human
cucaauccucauucucugccuccuggacccuc

SEQ ID NO: 393578 - RNA, 32 nt, Human
cucaauccugcucucaccaugagccuccgccu

SEQ ID NO: 393579 - RNA, 32 nt, Human
cucaaucucagguaaagccuggagucuggggu

SEQ ID NO: 393580 - RNA, 21 nt, Human
cucaaucuccugaccucguga

SEQ ID NO: 393581 - RNA, 32 nt, Human
cucaaucugauacuguggagguuguuaauuua

SEQ ID NO: 393582 - RNA, 32 nt, Human
cucaaucugcugccguccaagccuggggccca

SEQ ID NO: 393583 - RNA, 32 nt, Human
cucaaucugucacccaggcuggagcgcagugg

SEQ ID NO: 393584 - RNA, 32 nt, Human
cucaaucuguuacccaggcuggagugcagugg

SEQ ID NO: 393585 - RNA, 32 nt, Human
cucaaucuucucaaagcuucugacuccagaca

SEQ ID NO: 393586 - RNA, 32 nt, Human
cucaaucuugugucugccucagucuuuucuga

SEQ ID NO: 393587 - RNA, 32 nt, Human
cucaaugaaagccaagccagaauggaacaucc

SEQ ID NO: 393588 - RNA, 32 nt, Human
cucaaugaagggacccaggguguaucugagug

SEQ ID NO: 393589 - RNA, 32 nt, Human
cucaaugauuuaaggaaagaaaaugcucacaa

SEQ ID NO: 393590 - RNA, 32 nt, Human
cucaaugcaaagugucauucucuggaauugca

SEQ ID NO: 393591 - RNA, 32 nt, Human
cucaaugcagugagaagagggacagggacaag

SEQ ID NO: 393592 - RNA, 32 nt, Human
cucaaugcagugaguuauagauucucuaguuu

SEQ ID NO: 393593 - RNA, 29 nt, Human
cucaaugccacccugcagcugugccagau

SEQ ID NO: 393594 - RNA, 23 nt, Human
cucaaugccagcccaugaaagca

SEQ ID NO: 393595 - RNA, 32 nt, Human
cucaaugcccauuaaauacucuugccugccuc

SEQ ID NO: 393596 - RNA, 21 nt, Human
cucaaugcccugccuuggaca

SEQ ID NO: 393597 - RNA, 32 nt, Human
cucaaugccucaccuuucccguucgccagaug

SEQ ID NO: 393598 - RNA, 32 nt, Human
cucaaugccuccauuccaaacuguugucugcu

SEQ ID NO: 393599 - RNA, 32 nt, Human
cucaaugccugggacuggagguugauaguuua

SEQ ID NO: 393600 - RNA, 21 nt, Human
cucaaugccugugucucuccc

SEQ ID NO: 393601 - RNA, 32 nt, Human
cucaaugcgauggaauacauucaugccauugu

SEQ ID NO: 393602 - RNA, 32 nt, Human
cucaauggcuucgggaaacacacauauacaca

SEQ ID NO: 393603 - RNA, 32 nt, Human
cucaaugggcuggaaggaaggagagaaaaaga

SEQ ID NO: 393604 - RNA, 32 nt, Human
cucaauggucugggaguggacacuccuggugu

SEQ ID NO: 393605 - RNA, 32 nt, Human
cucaauggugcccaggcuggagugcaguggcg

SEQ ID NO: 393606 - RNA, 32 nt, Human
cucaaugguguccaggcuggagugcaguggcg

SEQ ID NO: 393607 - RNA, 22 nt, Human
cucaauguggucaaagcuucag

SEQ ID NO: 393608 - RNA, 32 nt, Human
cucaaugugucaccuccuuucuaguuuccucc

SEQ ID NO: 393609 - RNA, 32 nt, Human
cucaauguugcccaggcuggagugcaguggcg

SEQ ID NO: 393610 - RNA, 32 nt, Human
cucaauguuucuagccuucacucuccauuguc

SEQ ID NO: 393611 - RNA, 32 nt, Human
cucaauuaaaaagaaguaauuuagaaguuacu

SEQ ID NO: 393612 - RNA, 32 nt, Human
cucaauuagccaccuuuucacaguugugugga

SEQ ID NO: 393613 - RNA, 32 nt, Human
cucaauucacaacuuagcauuuugccaucuga

SEQ ID NO: 393614 - RNA, 32 nt, Human
cucaauucauuccuccucuuccucucaaaggc

SEQ ID NO: 393615 - RNA, 32 nt, Human
cucaauucccuugguccccagugcaguguuug

SEQ ID NO: 393616 - RNA, 32 nt, Human
cucaauucugaaggucgccaagaaggagagaa

SEQ ID NO: 393617 - RNA, 26 nt, Human
cucaauuguaccugcagcuccugcca

SEQ ID NO: 393618 - RNA, 32 nt, Human
cucaauuguccucuguguccugccugacaugg

SEQ ID NO: 393619 - RNA, 32 nt, Human
cucaauuucccagaaauuggguucuaugcugg

SEQ ID NO: 393620 - RNA, 32 nt, Human
cucaauuucuuaggcuggagugcaguggcacg

SEQ ID NO: 393621 - RNA, 32 nt, Human
cucaauuuguucugcauuaaugccacaguggg

SEQ ID NO: 393622 - RNA, 32 nt, Human
cucaauuuugagucugacauuuccaggaccag

SEQ ID NO: 393623 - RNA, 31 nt, Human
cucaauuuugugagagaaagacuguacucca

SEQ ID NO: 393624 - RNA, 32 nt, Human
cucacaaaagagaguccucaaguuguggcugu

SEQ ID NO: 393625 - RNA, 32 nt, Human
cucacaaaaucucucugaagcuuaaagucuua

SEQ ID NO: 393626 - RNA, 32 nt, Human
cucacaaaccuacagcccagaaaccagaagcc

SEQ ID NO: 393627 - RNA, 32 nt, Human
cucacaaaccuacagcccagaaacccagaagc

SEQ ID NO: 393628 - RNA, 32 nt, Human
cucacaaagugccgggauuacaggcgugagcc

SEQ ID NO: 393629 - RNA, 32 nt, Human
cucacaaagugcuaggauuacaggcaugagcc

SEQ ID NO: 393630 - RNA, 24 nt, Human
cucacaaagugcugggauuacagg

SEQ ID NO: 393631 - RNA, 32 nt, Human
cucacaaagugcugggauuacaggcaugaacc

SEQ ID NO: 393632 - RNA, 32 nt, Human
cucacaaagugcugggauuacaggcgugagcc

SEQ ID NO: 393633 - RNA, 32 nt, Human
cucacaaagugcugggauuacagguguaagcc

SEQ ID NO: 393634 - RNA, 32 nt, Human
cucacaaagugcugggauuauaggcaagagcg

SEQ ID NO: 393635 - RNA, 32 nt, Human
cucacaaaguguugagacuacaggcaugagcc

SEQ ID NO: 393636 - RNA, 32 nt, Human
cucacaacacagauugacugcucugacuuuga

SEQ ID NO: 393637 - RNA, 32 nt, Human
cucacaacaggcuggaugggugggugguaaaa

SEQ ID NO: 393638 - RNA, 32 nt, Human
cucacaacauggcaaguacaguacuuugaauu

SEQ ID NO: 393639 - RNA, 32 nt, Human
cucacaacccugcuuacauugaaaagucuuuu

SEQ ID NO: 393640 - RNA, 32 nt, Human
cucacaacuaccugccuggaugaauuuaggaa

SEQ ID NO: 393641 - RNA, 32 nt, Human
cucacaacugcaaccuccgucucccggguuca

SEQ ID NO: 393642 - RNA, 32 nt, Human
cucacaacuguaaccucaagcacuuugggagg

SEQ ID NO: 393643 - RNA, 32 nt, Human
cucacaacuguaauccucgcacuuugggaggc

SEQ ID NO: 393644 - RNA, 32 nt, Human
cucacaagcugguuguacagauugaauaacaa

SEQ ID NO: 393645 - RNA, 21 nt, Human
cucacaaggugcacacugcug

SEQ ID NO: 393646 - RNA, 24 nt, Human
cucacaaguagcugggauuacagg

SEQ ID NO: 393647 - RNA, 32 nt, Human
cucacaaguagcugggauuacaggugcccgcc

SEQ ID NO: 393648 - RNA, 32 nt, Human
cucacaauguguucaaccugaucaagaauauc

SEQ ID NO: 393649 - RNA, 32 nt, Human
cucacacaaagaaggaagagaacaguaccaac

SEQ ID NO: 393650 - RNA, 17 nt, Human
cucacacaaagucacac

SEQ ID NO: 393651 - RNA, 32 nt, Human
cucacacaaggauucuuuaaaagaggaagaga

SEQ ID NO: 393652 - RNA, 32 nt, Human
cucacacacagccucguggguagggucagcag

SEQ ID NO: 393653 - RNA, 32 nt, Human
cucacacacauccacacacaagcauaugcaua

SEQ ID NO: 393654 - RNA, 32 nt, Human
cucacacacaugcaaugguauaugugcaucug

SEQ ID NO: 393655 - RNA, 32 nt, Human
cucacacacaugcacacauccguacgugugug

SEQ ID NO: 393656 - RNA, 32 nt, Human
cucacacacccaggugagugguguucaggugg

SEQ ID NO: 393657 - RNA, 32 nt, Human
cucacacacucauccucacacccagcuauacc

SEQ ID NO: 393658 - RNA, 32 nt, Human
cucacacacucuuuuucccuucugccuucacc

SEQ ID NO: 393659 - RNA, 32 nt, Human
cucacacacuggcuggcccucucauucucacu

SEQ ID NO: 393660 - RNA, 32 nt, Human
cucacacagacacacccagcugcacacaugag

SEQ ID NO: 393661 - RNA, 32 nt, Human
cucacacaggacuugggcucuucuacugccag

SEQ ID NO: 393662 - RNA, 32 nt, Human
cucacacaucccucgccacucugcacauggcu

SEQ ID NO: 393663 - RNA, 32 nt, Human
cucacacaugcagacacaccugggcgucccga

SEQ ID NO: 393664 - RNA, 32 nt, Human
cucacacaugccacaacauggaugagccuuga

SEQ ID NO: 393665 - RNA, 32 nt, Human
cucacacaugccacauccauugcagagaugcu

SEQ ID NO: 393666 - RNA, 32 nt, Human
cucacaccaagagaguuugaaaagcuuugggc

SEQ ID NO: 393667 - RNA, 32 nt, Human
cucacaccaaggggagaugcaccccacggaca

SEQ ID NO: 393668 - RNA, 32 nt, Human
cucacaccacugcacuccagccugggugacag

SEQ ID NO: 393669 - RNA, 32 nt, Human
cucacaccacugcacuccauccugggcaacag

SEQ ID NO: 393670 - RNA, 32 nt, Human
cucacaccagcugugcgaugcccgcuuuuaca

SEQ ID NO: 393671 - RNA, 32 nt, Human
cucacaccauccaccuccacacugccuccugg

SEQ ID NO: 393672 - RNA, 32 nt, Human
cucacaccauuucacuuccucuuccucuccuc

SEQ ID NO: 393673 - RNA, 32 nt, Human
cucacacccaggcuggagugcagucucaacuc

SEQ ID NO: 393674 - RNA, 24 nt, Human
cucacacccauaaucccaacacuu

SEQ ID NO: 393675 - RNA, 24 nt, Human
cucacacccauaaucccagcacuu

SEQ ID NO: 393676 - RNA, 20 nt, Human
cucacacccccgcccacacu

SEQ ID NO: 393677 - RNA, 32 nt, Human
cucacaccccuuccucccagucugggaguaua

SEQ ID NO: 393678 - RNA, 24 nt, Human
cucacacccguaaucccagcacuu

SEQ ID NO: 393679 - RNA, 30 nt, Human
cucacacccguaaucccagcacuuugggag

SEQ ID NO: 393680 - RNA, 25 nt, Human
cucacacccuguaaucccagcacuu

SEQ ID NO: 393681 - RNA, 32 nt, Human
cucacacccuguaaucccagcacuuugggagg

SEQ ID NO: 393682 - RNA, 24 nt, Human
cucacaccgguaaucccaacacuu

SEQ ID NO: 393683 - RNA, 24 nt, Human
cucacaccgguaaucccagcacuu

SEQ ID NO: 393684 - RNA, 32 nt, Human
cucacaccgguaaucccagcacuuugggaggc

SEQ ID NO: 393685 - RNA, 24 nt, Human
cucacaccuacgaucacagcacuu

SEQ ID NO: 393686 - RNA, 24 nt, Human
cucacaccuauaaucccaacacuu

SEQ ID NO: 393687 - RNA, 24 nt, Human
cucacaccuauaaucccaauacuu

SEQ ID NO: 393688 - RNA, 23 nt, Human
cucacaccuauaaucccagcacu

SEQ ID NO: 393689 - RNA, 24 nt, Human
cucacaccuauaaucccagcacuu

SEQ ID NO: 393690 - RNA, 32 nt, Human
cucacaccuauaaucccagcacuuuaggaggc

SEQ ID NO: 393691 - RNA, 32 nt, Human
cucacaccuauaaucccagcacuuugggaagc

SEQ ID NO: 393692 - RNA, 32 nt, Human
cucacaccuauaaucccagcacuuugggaggc

SEQ ID NO: 393693 - RNA, 32 nt, Human
cucacaccuauaaucccagcacuuugggaggg

SEQ ID NO: 393694 - RNA, 32 nt, Human
cucacaccuauaaucccagcacuuugggaggu

SEQ ID NO: 393695 - RNA, 24 nt, Human
cucacaccuauaaucccagcccuu

SEQ ID NO: 393696 - RNA, 24 nt, Human
cucacaccuauaaucccagcgcuu

SEQ ID NO: 393697 - RNA, 24 nt, Human
cucacaccuauaauccuagcgcuu

SEQ ID NO: 393698 - RNA, 24 nt, Human
cucacaccuauaauccuaggacuu

SEQ ID NO: 393699 - RNA, 32 nt, Human
cucacaccuauaauccuaggacuuugggaggc

SEQ ID NO: 393700 - RNA, 24 nt, Human
cucacaccuauaauccuggcacuu

SEQ ID NO: 393701 - RNA, 23 nt, Human
cucacaccuauaaucgagcacuu

SEQ ID NO: 393702 - RNA, 32 nt, Human
cucacaccuauaaucucagcacuuugggaggc

SEQ ID NO: 393703 - RNA, 24 nt, Human
cucacaccuauaauuccagcacuu

SEQ ID NO: 393704 - RNA, 23 nt, Human
cucacaccuauagucccagcacu

SEQ ID NO: 393705 - RNA, 22 nt, Human
cucacaccuaugaucucagcac

SEQ ID NO: 393706 - RNA, 17 nt, Human
cucacaccucagccucc

SEQ ID NO: 393707 - RNA, 24 nt, Human
cucacaccucuaaucccagcacuu

SEQ ID NO: 393708 - RNA, 32 nt, Human
cucacaccucuaaucccagcacuuugggaggc

SEQ ID NO: 393709 - RNA, 32 nt, Human
cucacaccucuccugggacuggaacccuucag

SEQ ID NO: 393710 - RNA, 24 nt, Human
cucacaccugaaaucccagcacuu

SEQ ID NO: 393711 - RNA, 32 nt, Human
cucacaccugaaaucccagcacuuugggaggc

SEQ ID NO: 393712 - RNA, 32 nt, Human
cucacaccugaaaucuuagcacuucgggaggc

SEQ ID NO: 393713 - RNA, 24 nt, Human
cucacaccugcaaucccaccacuu

SEQ ID NO: 393714 - RNA, 24 nt, Human
cucacaccugcaaucccagcacuu

SEQ ID NO: 393715 - RNA, 32 nt, Human
cucacaccugcaaucccagcacuuuggaaggc

SEQ ID NO: 393716 - RNA, 32 nt, Human
cucacaccugcaaucccagcacuuugggagac

SEQ ID NO: 393717 - RNA, 32 nt, Human
cucacaccugcaaucccagcacuuugggaggc

SEQ ID NO: 393718 - RNA, 32 nt, Human
cucacaccugcacuuaccagcauccagaauau

SEQ ID NO: 393719 - RNA, 32 nt, Human
cucacaccugggaaggggcucucuaaaucccg

SEQ ID NO: 393720 - RNA, 32 nt, Human
cucacaccuguaaacccaacacuuugggaggc

SEQ ID NO: 393721 - RNA, 24 nt, Human
cucacaccuguaaacccagcacuu

SEQ ID NO: 393722 - RNA, 32 nt, Human
cucacaccuguaaacccagcacuuugggagac

SEQ ID NO: 393723 - RNA, 32 nt, Human
cucacaccuguaaaccuaacacuuugggaggc

SEQ ID NO: 393724 - RNA, 24 nt, Human
cucacaccuguaaccccaacacuu

SEQ ID NO: 393725 - RNA, 23 nt, Human
cucacaccuguaaccccagcacu

SEQ ID NO: 393726 - RNA, 24 nt, Human
cucacaccuguaaccccagcacuu

SEQ ID NO: 393727 - RNA, 32 nt, Human
cucacaccuguaaccccagcacuuugggacgc

SEQ ID NO: 393728 - RNA, 32 nt, Human
cucacaccuguaaccccagcacuuugggaggc

SEQ ID NO: 393729 - RNA, 32 nt, Human
cucacaccuguaacccccagcacuuugggagg

SEQ ID NO: 393730 - RNA, 24 nt, Human
cucacaccuguaacccuagcacuu

SEQ ID NO: 393731 - RNA, 32 nt, Human
cucacaccuguaacccuagcacuuugggaggc

SEQ ID NO: 393732 - RNA, 32 nt, Human
cucacaccuguaauaccagcacuuugggaagu

SEQ ID NO: 393733 - RNA, 32 nt, Human
cucacaccuguaaucaaaacacuuugggaggc

SEQ ID NO: 393734 - RNA, 32 nt, Human
cucacaccuguaaucacagcacuuugggaggc

SEQ ID NO: 393735 - RNA, 32 nt, Human
cucacaccuguaauccaagcacuuugggaggc

SEQ ID NO: 393736 - RNA, 18 nt, Human
cucacaccuguaauccca

SEQ ID NO: 393737 - RNA, 24 nt, Human
cucacaccuguaaucccaacacuu

SEQ ID NO: 393738 - RNA, 32 nt, Human
cucacaccuguaaucccaacacuuuggaaggc

SEQ ID NO: 393739 - RNA, 32 nt, Human
cucacaccuguaaucccaacacuuugggaagc

SEQ ID NO: 393740 - RNA, 32 nt, Human
cucacaccuguaaucccaacacuuugggaauc

SEQ ID NO: 393741 - RNA, 32 nt, Human
cucacaccuguaaucccaacacuuugggacgu

SEQ ID NO: 393742 - RNA, 32 nt, Human
cucacaccuguaaucccaacacuuugggagcc

SEQ ID NO: 393743 - RNA, 32 nt, Human
cucacaccuguaaucccaacacuuugggaggc

SEQ ID NO: 393744 - RNA, 32 nt, Human
cucacaccuguaaucccaacacuuugggaugc

SEQ ID NO: 393745 - RNA, 24 nt, Human
cucacaccuguaaucccaacaguu

SEQ ID NO: 393746 - RNA, 24 nt, Human
cucacaccuguaaucccaacauuu

SEQ ID NO: 393747 - RNA, 32 nt, Human
cucacaccuguaaucccaacauuuugggaacc

SEQ ID NO: 393748 - RNA, 32 nt, Human
cucacaccuguaaucccaacauuuugggaggc

SEQ ID NO: 393749 - RNA, 23 nt, Human
cucacaccuguaaucccaauacu

SEQ ID NO: 393750 - RNA, 32 nt, Human
cucacaccuguaaucccaauacuuuggguggc

SEQ ID NO: 393751 - RNA, 24 nt, Human
cucacaccuguaaucccagaacuu

SEQ ID NO: 393752 - RNA, 32 nt, Human
cucacaccuguaaucccagaacuuugggaggc

SEQ ID NO: 393753 - RNA, 20 nt, Human
cucacaccuguaaucccagc

SEQ ID NO: 393754 - RNA, 21 nt, Human
cucacaccuguaaucccagca

SEQ ID NO: 393755 - RNA, 32 nt, Human
cucacaccuguaaucccagcaauuugggagac

SEQ ID NO: 393756 - RNA, 22 nt, Human
cucacaccuguaaucccagcac

SEQ ID NO: 393757 - RNA, 32 nt, Human
cucacaccuguaaucccagcacacugggaggc

SEQ ID NO: 393758 - RNA, 32 nt, Human
cucacaccuguaaucccagcaccuugggaggc

SEQ ID NO: 393759 - RNA, 23 nt, Human
cucacaccuguaaucccagcacu

SEQ ID NO: 393760 - RNA, 32 nt, Human
cucacaccuguaaucccagcacuaugggaggc

SEQ ID NO: 393761 - RNA, 32 nt, Human
cucacaccuguaaucccagcacucugggaggc

SEQ ID NO: 393762 - RNA, 32 nt, Human
cucacaccuguaaucccagcacucugggaggg

SEQ ID NO: 393763 - RNA, 32 nt, Human
cucacaccuguaaucccagcacuguggaaaga

SEQ ID NO: 393764 - RNA, 24 nt, Human
cucacaccuguaaucccagcacuu

SEQ ID NO: 393765 - RNA, 32 nt, Human
cucacaccuguaaucccagcacuuagggaaga

SEQ ID NO: 393766 - RNA, 32 nt, Human
cucacaccuguaaucccagcacuuagggaggc

SEQ ID NO: 393767 - RNA, 32 nt, Human
cucacaccuguaaucccagcacuuagguaggc

SEQ ID NO: 393768 - RNA, 32 nt, Human
cucacaccuguaaucccagcacuucgggaagc

SEQ ID NO: 393769 - RNA, 32 nt, Human
cucacaccuguaaucccagcacuucgggaggc

SEQ ID NO: 393770 - RNA, 32 nt, Human
cucacaccuguaaucccagcacuucgggaggu

SEQ ID NO: 393771 - RNA, 32 nt, Human
cucacaccuguaaucccagcacuugggaagcc

SEQ ID NO: 393772 - RNA, 32 nt, Human
cucacaccuguaaucccagcacuuggggaagc

SEQ ID NO: 393773 - RNA, 32 nt, Human
cucacaccuguaaucccagcacuuggggaggc

SEQ ID NO: 393774 - RNA, 32 nt, Human
cucacaccuguaaucccagcacuuuaggaggu

SEQ ID NO: 393775 - RNA, 32 nt, Human
cucacaccuguaaucccagcacuuucggaggc

SEQ ID NO: 393776 - RNA, 32 nt, Human
cucacaccuguaaucccagcacuuugagagga

SEQ ID NO: 393777 - RNA, 32 nt, Human
cucacaccuguaaucccagcacuuugagaggc

SEQ ID NO: 393778 - RNA, 32 nt, Human
cucacaccuguaaucccagcacuuugcggggc

SEQ ID NO: 393779 - RNA, 32 nt, Human
cucacaccuguaaucccagcacuuuggcaggc

SEQ ID NO: 393780 - RNA, 32 nt, Human
cucacaccuguaaucccagcacuuugggaacc

SEQ ID NO: 393781 - RNA, 32 nt, Human
cucacaccuguaaucccagcacuuugggaagc

SEQ ID NO: 393782 - RNA, 32 nt, Human
cucacaccuguaaucccagcacuuugggaagu

SEQ ID NO: 393783 - RNA, 32 nt, Human
cucacaccuguaaucccagcacuuugggacac

SEQ ID NO: 393784 - RNA, 32 nt, Human
cucacaccuguaaucccagcacuuugggagac

SEQ ID NO: 393785 - RNA, 32 nt, Human
cucacaccuguaaucccagcacuuugggagcc

SEQ ID NO: 393786 - RNA, 32 nt, Human
cucacaccuguaaucccagcacuuugggaggc

SEQ ID NO: 393787 - RNA, 32 nt, Human
cucacaccuguaaucccagcacuuugggaggg

SEQ ID NO: 393788 - RNA, 32 nt, Human
cucacaccuguaaucccagcacuuugggaggu

SEQ ID NO: 393789 - RNA, 32 nt, Human
cucacaccuguaaucccagcacuuugggaguc

SEQ ID NO: 393790 - RNA, 32 nt, Human
cucacaccuguaaucccagcacuuugggauua

SEQ ID NO: 393791 - RNA, 32 nt, Human
cucacaccuguaaucccagcacuuugggauuc

SEQ ID NO: 393792 - RNA, 32 nt, Human
cucacaccuguaaucccagcacuuuggggagc

SEQ ID NO: 393793 - RNA, 32 nt, Human
cucacaccuguaaucccagcacuuuggguggc

SEQ ID NO: 393794 - RNA, 32 nt, Human
cucacaccuguaaucccagcacuuugguaggc

SEQ ID NO: 393795 - RNA, 32 nt, Human
cucacaccuguaaucccagcacuuuuggaggc

SEQ ID NO: 393796 - RNA, 24 nt, Human
cucacaccuguaaucccagcaguu

SEQ ID NO: 393797 - RNA, 32 nt, Human
cucacaccuguaaucccagcaguuuggaaggc

SEQ ID NO: 393798 - RNA, 32 nt, Human
cucacaccuguaaucccagcaguuugggaggc

SEQ ID NO: 393799 - RNA, 24 nt, Human
cucacaccuguaaucccagcauuu

SEQ ID NO: 393800 - RNA, 32 nt, Human
cucacaccuguaaucccagcauuuugggaagc

SEQ ID NO: 393801 - RNA, 32 nt, Human
cucacaccuguaaucccagcauuuugggaggc

SEQ ID NO: 393802 - RNA, 32 nt, Human
cucacaccuguaaucccagcccuuugggaggc

SEQ ID NO: 393803 - RNA, 22 nt, Human
cucacaccuguaaucccagccu

SEQ ID NO: 393804 - RNA, 24 nt, Human
cucacaccuguaaucccagcgcuu

SEQ ID NO: 393805 - RNA, 32 nt, Human
cucacaccuguaaucccagcgcuuugggaggc

SEQ ID NO: 393806 - RNA, 24 nt, Human
cucacaccuguaaucccagcuacu

SEQ ID NO: 393807 - RNA, 32 nt, Human
cucacaccuguaaucccagcuacuugggaggc

SEQ ID NO: 393808 - RNA, 24 nt, Human
cucacaccuguaaucccagcucuu

SEQ ID NO: 393809 - RNA, 32 nt, Human
cucacaccuguaaucccagcucuuuggaggcc

SEQ ID NO: 393810 - RNA, 32 nt, Human
cucacaccuguaaucccagcucuuugggaggc

SEQ ID NO: 393811 - RNA, 32 nt, Human
cucacaccuguaaucccagcuguuugggaggc

SEQ ID NO: 393812 - RNA, 24 nt, Human
cucacaccuguaaucccaggacuu

SEQ ID NO: 393813 - RNA, 32 nt, Human
cucacaccuguaaucccaggacuuugggaggc

SEQ ID NO: 393814 - RNA, 22 nt, Human
cucacaccuguaaucccaguac

SEQ ID NO: 393815 - RNA, 32 nt, Human
cucacaccuguaaucccaguaccuugggaggc

SEQ ID NO: 393816 - RNA, 24 nt, Human
cucacaccuguaaucccaguacuu

SEQ ID NO: 393817 - RNA, 32 nt, Human
cucacaccuguaaucccaguacuuugggaggc

SEQ ID NO: 393818 - RNA, 32 nt, Human
cucacaccuguaaucccagugcuuugggaggc

SEQ ID NO: 393819 - RNA, 25 nt, Human
cucacaccuguaauccccagcacuu

SEQ ID NO: 393820 - RNA, 32 nt, Human
cucacaccuguaauccccagcacuuugggagg

SEQ ID NO: 393821 - RNA, 23 nt, Human
cucacaccuguaaucccgcacuu

SEQ ID NO: 393822 - RNA, 24 nt, Human
cucacaccuguaaucccggcacuu

SEQ ID NO: 393823 - RNA, 24 nt, Human
cucacaccuguaaucccugcacuu

SEQ ID NO: 393824 - RNA, 32 nt, Human
cucacaccuguaaucccugcacuuugggaggc

SEQ ID NO: 393825 - RNA, 24 nt, Human
cucacaccuguaaucccugcauuu

SEQ ID NO: 393826 - RNA, 24 nt, Human
cucacaccuguaauccgaguacuu

SEQ ID NO: 393827 - RNA, 32 nt, Human
cucacaccuguaauccgaguacuuugcggggc

SEQ ID NO: 393828 - RNA, 24 nt, Human
cucacaccuguaauccuaacacuu

SEQ ID NO: 393829 - RNA, 32 nt, Human
cucacaccuguaauccuaacacuuggggaggc

SEQ ID NO: 393830 - RNA, 32 nt, Human
cucacaccuguaauccuaacacuuugggaggc

SEQ ID NO: 393831 - RNA, 28 nt, Human
cucacaccuguaauccuaaguaacacuu

SEQ ID NO: 393832 - RNA, 22 nt, Human
cucacaccuguaauccuagcac

SEQ ID NO: 393833 - RNA, 32 nt, Human
cucacaccuguaauccuagcacauugggaggc

SEQ ID NO: 393834 - RNA, 32 nt, Human
cucacaccuguaauccuagcacguggggaggc

SEQ ID NO: 393835 - RNA, 24 nt, Human
cucacaccuguaauccuagcacuu

SEQ ID NO: 393836 - RNA, 32 nt, Human
cucacaccuguaauccuagcacuuugggaggc

SEQ ID NO: 393837 - RNA, 32 nt, Human
cucacaccuguaauccuagcacuuugggaggu

SEQ ID NO: 393838 - RNA, 22 nt, Human
cucacaccuguaauccuagcau

SEQ ID NO: 393839 - RNA, 32 nt, Human
cucacaccuguaauccuagcaucuugggaggc

SEQ ID NO: 393840 - RNA, 24 nt, Human
cucacaccuguaauccuagcgcuu

SEQ ID NO: 393841 - RNA, 32 nt, Human
cucacaccuguaauccuagcgcuuugggaggc

SEQ ID NO: 393842 - RNA, 32 nt, Human
cucacaccuguaauccugcacuuugggagucu

SEQ ID NO: 393843 - RNA, 32 nt, Human
cucacaccuguaauccuugcauuuuggaaggc

SEQ ID NO: 393844 - RNA, 32 nt, Human
cucacaccuguaaucucaacacuuugggaggc

SEQ ID NO: 393845 - RNA, 24 nt, Human
cucacaccuguaaucucaacgcuu

SEQ ID NO: 393846 - RNA, 32 nt, Human
cucacaccuguaaucucaacgcuuugggaggg

SEQ ID NO: 393847 - RNA, 21 nt, Human
cucacaccuguaaucucagca

SEQ ID NO: 393848 - RNA, 22 nt, Human
cucacaccuguaaucucagcac

SEQ ID NO: 393849 - RNA, 32 nt, Human
cucacaccuguaaucucagcacguugggaagu

SEQ ID NO: 393850 - RNA, 32 nt, Human
cucacaccuguaaucucagcacucugggaggc

SEQ ID NO: 393851 - RNA, 24 nt, Human
cucacaccuguaaucucagcacuu

SEQ ID NO: 393852 - RNA, 32 nt, Human
cucacaccuguaaucucagcacuuugggaagu

SEQ ID NO: 393853 - RNA, 32 nt, Human
cucacaccuguaaucucagcacuuugggaggc

SEQ ID NO: 393854 - RNA, 32 nt, Human
cucacaccuguaaucucagcacuuuggguggu

SEQ ID NO: 393855 - RNA, 24 nt, Human
cucacaccuguaaucucagcauuu

SEQ ID NO: 393856 - RNA, 32 nt, Human
cucacaccuguaaucucagcauuuugggaggc

SEQ ID NO: 393857 - RNA, 22 nt, Human
cucacaccuguaaucucagccu

SEQ ID NO: 393858 - RNA, 32 nt, Human
cucacaccuguaaucucagccucccagacggc

SEQ ID NO: 393859 - RNA, 24 nt, Human
cucacaccuguaaucugaacacuu

SEQ ID NO: 393860 - RNA, 32 nt, Human
cucacaccuguaaucugaacacuuugggaggc

SEQ ID NO: 393861 - RNA, 22 nt, Human
cucacaccuguaaucugagcac

SEQ ID NO: 393862 - RNA, 32 nt, Human
cucacaccuguaaucugagcacauugggaggc

SEQ ID NO: 393863 - RNA, 32 nt, Human
cucacaccuguaaucugagcauucugggaggc

SEQ ID NO: 393864 - RNA, 23 nt, Human
cucacaccuguaaucuuaacacu

SEQ ID NO: 393865 - RNA, 32 nt, Human
cucacaccuguaaucuuaacacugugggaggc

SEQ ID NO: 393866 - RNA, 20 nt, Human
cucacaccuguaaugccagc

SEQ ID NO: 393867 - RNA, 32 nt, Human
cucacaccuguaaugccagcacuuugggcagc

SEQ ID NO: 393868 - RNA, 24 nt, Human
cucacaccuguaauuccaacacuu

SEQ ID NO: 393869 - RNA, 32 nt, Human
cucacaccuguaauuccaacacuuugggaggc

SEQ ID NO: 393870 - RNA, 24 nt, Human
cucacaccuguaauuccagcacuu

SEQ ID NO: 393871 - RNA, 32 nt, Human
cucacaccuguaauuccagcacuuugggagac

SEQ ID NO: 393872 - RNA, 32 nt, Human
cucacaccuguaauuccagcacuuugggaggc

SEQ ID NO: 393873 - RNA, 32 nt, Human
cucacaccuguaauuccagcacuuugggaggu

SEQ ID NO: 393874 - RNA, 32 nt, Human
cucacaccuguaauucuagcacuuugggaggc

SEQ ID NO: 393875 - RNA, 24 nt, Human
cucacaccuguaauugcagcacuu

SEQ ID NO: 393876 - RNA, 22 nt, Human
cucacaccuguaauuucagcac

SEQ ID NO: 393877 - RNA, 24 nt, Human
cucacaccuguacucccagcacuu

SEQ ID NO: 393878 - RNA, 20 nt, Human
cucacaccuguaggacacac

SEQ ID NO: 393879 - RNA, 32 nt, Human
cucacaccuguagucccagagcuuugggaggc

SEQ ID NO: 393880 - RNA, 24 nt, Human
cucacaccuguagucccagcacuu

SEQ ID NO: 393881 - RNA, 32 nt, Human
cucacaccuguagucccagcacuuuaggaggc

SEQ ID NO: 393882 - RNA, 32 nt, Human
cucacaccuguaucccagcacuuugggaggcc

SEQ ID NO: 393883 - RNA, 24 nt, Human
cucacaccuguauucccaacacuu

SEQ ID NO: 393884 - RNA, 24 nt, Human
cucacaccuguauucccagcacuu

SEQ ID NO: 393885 - RNA, 32 nt, Human
cucacaccuguauucccagcacuuugggaggc

SEQ ID NO: 393886 - RNA, 24 nt, Human
cucacaccugucaucccagcacuu

SEQ ID NO: 393887 - RNA, 32 nt, Human
cucacaccugucaucccagcacuuugggaggc

SEQ ID NO: 393888 - RNA, 32 nt, Human
cucacaccuguccuucucaggcuggcaucucc

SEQ ID NO: 393889 - RNA, 24 nt, Human
cucacaccugugaucccaacauuu

SEQ ID NO: 393890 - RNA, 24 nt, Human
cucacaccugugaucccagcacuu

SEQ ID NO: 393891 - RNA, 32 nt, Human
cucacaccugugaucccagcacuuugggaggc

SEQ ID NO: 393892 - RNA, 27 nt, Human
cucacaccugugauccccccagcacuu

SEQ ID NO: 393893 - RNA, 22 nt, Human
cucacaccugugaucucagcac

SEQ ID NO: 393894 - RNA, 32 nt, Human
cucacaccugugcucccagcacuuugggaggc

SEQ ID NO: 393895 - RNA, 26 nt, Human
cucacaccuguggaaucccagcacuu

SEQ ID NO: 393896 - RNA, 22 nt, Human
cucacaccuguguucucagcac

SEQ ID NO: 393897 - RNA, 25 nt, Human
cucacaccuguuaaucccagcacuu

SEQ ID NO: 393898 - RNA, 32 nt, Human
cucacaccuguuaaucccagcacuucgggagg

SEQ ID NO: 393899 - RNA, 24 nt, Human
cucacaccuguuaucccagcacuu

SEQ ID NO: 393900 - RNA, 23 nt, Human
cucacaccuuaaucccagcacuu

SEQ ID NO: 393901 - RNA, 32 nt, Human
cucacaccuuaaucccagcacuuugggaggcu

SEQ ID NO: 393902 - RNA, 32 nt, Human
cucacaccuugggacccuucucuccccugugc

SEQ ID NO: 393903 - RNA, 25 nt, Human
cucacaccuuguaaucccagcacuu

SEQ ID NO: 393904 - RNA, 24 nt, Human
cucacaccuuuaaucccagcacuu

SEQ ID NO: 393905 - RNA, 32 nt, Human
cucacaccuuuaaucccagcacuuugggaagc

SEQ ID NO: 393906 - RNA, 32 nt, Human
cucacaccuuuaaucccagcacuuugggagac

SEQ ID NO: 393907 - RNA, 32 nt, Human
cucacacgccuguaaucccagcacuuugggag

SEQ ID NO: 393908 - RNA, 32 nt, Human
cucacacggaacagacagggagccggagguga

SEQ ID NO: 393909 - RNA, 32 nt, Human
cucacacggucaucaucccuacccacacacag

SEQ ID NO: 393910 - RNA, 24 nt, Human
cucacacguguaaucccaacacuu

SEQ ID NO: 393911 - RNA, 32 nt, Human
cucacacguguaaucccaacacuuugggaggc

SEQ ID NO: 393912 - RNA, 24 nt, Human
cucacacguuuaaucccagcacuu

SEQ ID NO: 393913 - RNA, 32 nt, Human
cucacacguuuaaucccagcacuuugggaggc

SEQ ID NO: 393914 - RNA, 32 nt, Human
cucacacuauaaucccagcaauuugggaggcu

SEQ ID NO: 393915 - RNA, 32 nt, Human
cucacacucagaaccucauaccccagagcaaa

SEQ ID NO: 393916 - RNA, 32 nt, Human
cucacacucagcuucagcauaagcugugaggc

SEQ ID NO: 393917 - RNA, 32 nt, Human
cucacacucagggacuucgagagugaaucaac

SEQ ID NO: 393918 - RNA, 32 nt, Human
cucacacuccaugcccagaagcagaaaugagu

SEQ ID NO: 393919 - RNA, 32 nt, Human
cucacacuccccuccauccucugagcucccug

SEQ ID NO: 393920 - RNA, 32 nt, Human
cucacacuccucucccugucuuccggcuccuu

SEQ ID NO: 393921 - RNA, 32 nt, Human
cucacacucuccucagcucucucaucuccugg

SEQ ID NO: 393922 - RNA, 32 nt, Human
cucacacucugccugcccaucucagugcugag

SEQ ID NO: 393923 - RNA, 32 nt, Human
cucacacugcaaccgcacgugcuuggaggacu

SEQ ID NO: 393924 - RNA, 32 nt, Human
cucacacugcaagcucccuggcaugggcaaag

SEQ ID NO: 393925 - RNA, 32 nt, Human
cucacacugcccaggcuggagcauaguggcaa

SEQ ID NO: 393926 - RNA, 32 nt, Human
cucacacugcuaacucuguuacugacaaaagc

SEQ ID NO: 393927 - RNA, 32 nt, Human
cucacacuggacagggcaggaggagggggccg

SEQ ID NO: 393928 - RNA, 32 nt, Human
cucacacuggccucucuaggccgagguccuuu

SEQ ID NO: 393929 - RNA, 32 nt, Human
cucacacuguaaucacagugacucaggaggcu

SEQ ID NO: 393930 - RNA, 32 nt, Human
cucacacuguaaucccagcacuuugggaggcc

SEQ ID NO: 393931 - RNA, 32 nt, Human
cucacacuguaauccccacuggagcccaggaa

SEQ ID NO: 393932 - RNA, 32 nt, Human
cucacacugucacccaggcuggagugcagugu

SEQ ID NO: 393933 - RNA, 32 nt, Human
cucacacugugacccuguugugcuccaagaac

SEQ ID NO: 393934 - RNA, 32 nt, Human
cucacacuguggcccaggcuggacuccagcac

SEQ ID NO: 393935 - RNA, 32 nt, Human
cucacacuguugcccaggcuggagugcagugg

SEQ ID NO: 393936 - RNA, 32 nt, Human
cucacacuuagucccgggagcugcaggucuua

SEQ ID NO: 393937 - RNA, 24 nt, Human
cucacacuuauaaucccagcacuu

SEQ ID NO: 393938 - RNA, 32 nt, Human
cucacacuuccaagcaccccacaccaaggaca

SEQ ID NO: 393939 - RNA, 32 nt, Human
cucacacuugccaaaaguuguggguuaggguu

SEQ ID NO: 393940 - RNA, 32 nt, Human
cucacacuugggacucaaaaauguggagucag

SEQ ID NO: 393941 - RNA, 32 nt, Human
cucacacuuguaaucacugcacuuugggaagc

SEQ ID NO: 393942 - RNA, 32 nt, Human
cucacacuuguaaucauagcacuuugggaggc

SEQ ID NO: 393943 - RNA, 24 nt, Human
cucacacuuguaaucccaacacuu

SEQ ID NO: 393944 - RNA, 32 nt, Human
cucacacuuguaaucccaacacuuuggaaggc

SEQ ID NO: 393945 - RNA, 32 nt, Human
cucacacuuguaaucccagcaauuugggaggc

SEQ ID NO: 393946 - RNA, 24 nt, Human
cucacacuuguaaucccagcacuu

SEQ ID NO: 393947 - RNA, 32 nt, Human
cucacacuuguaaucccagcacuuugggaagc

SEQ ID NO: 393948 - RNA, 32 nt, Human
cucacacuuguaaucccagcacuuugggaggc

SEQ ID NO: 393949 - RNA, 32 nt, Human
cucacacuuguaaucccagcacuuugggaugc

SEQ ID NO: 393950 - RNA, 32 nt, Human
cucacacuuguaaucccagcauuuugggaggc

SEQ ID NO: 393951 - RNA, 32 nt, Human
cucacacuuguaaucccgacacuuugggaggc

SEQ ID NO: 393952 - RNA, 32 nt, Human
cucacacuuguaauccuaguacuuugggaggc

SEQ ID NO: 393953 - RNA, 32 nt, Human
cucacacuuugucacuggaauuuuauuuauuu

SEQ ID NO: 393954 - RNA, 32 nt, Human
cucacacuuuuuauuugccguaaugaaccguc

SEQ ID NO: 393955 - RNA, 32 nt, Human
cucacagaaaaauaggcacuuugggccaaaag

SEQ ID NO: 393956 - RNA, 32 nt, Human
cucacagaaagaaacgaaagaaagcaaagcaa

SEQ ID NO: 393957 - RNA, 32 nt, Human
cucacagaaaguuggauucagagucuggaaag

SEQ ID NO: 393958 - RNA, 32 nt, Human
cucacagacccacacacauacacacugucaug

SEQ ID NO: 393959 - RNA, 32 nt, Human
cucacagagcacguguuucgcggccugggcag

SEQ ID NO: 393960 - RNA, 32 nt, Human
cucacagagcccagacugcuggaacagccaag

SEQ ID NO: 393961 - RNA, 21 nt, Human
cucacagaggaagggcaggug

SEQ ID NO: 393962 - RNA, 32 nt, Human
cucacagaggcaguuucucuuuauuuuaugua

SEQ ID NO: 393963 - RNA, 32 nt, Human
cucacagauaagacagaggcccaggggauuuu

SEQ ID NO: 393964 - RNA, 20 nt, Human
cucacagauacccccuccca

SEQ ID NO: 393965 - RNA, 22 nt, Human
cucacagcaaccuccgccuccu

SEQ ID NO: 393966 - RNA, 32 nt, Human
cucacagcaaccucugccuccuggguucaagc

SEQ ID NO: 393967 - RNA, 23 nt, Human
cucacagcaaggauggagcugaa

SEQ ID NO: 393968 - RNA, 32 nt, Human
cucacagcacagaaccuagaagcaccugcuga

SEQ ID NO: 393969 - RNA, 32 nt, Human
cucacagcacaugcuggccagccuggggccug

SEQ ID NO: 393970 - RNA, 32 nt, Human
cucacagcaccucacgacugugccucaaagcc

SEQ ID NO: 393971 - RNA, 32 nt, Human
cucacagcaggcuccaccucucaggcucaagc

SEQ ID NO: 393972 - RNA, 32 nt, Human
cucacagccacuaucagccuguccucaagggu

SEQ ID NO: 393973 - RNA, 32 nt, Human
cucacagccagccgggcugcccauucacgcag

SEQ ID NO: 393974 - RNA, 32 nt, Human
cucacagccauccugcacugucuaguuuucca

SEQ ID NO: 393975 - RNA, 32 nt, Human
cucacagcccugagugacagagaggaaggagg

SEQ ID NO: 393976 - RNA, 32 nt, Human
cucacagcccuggccacuggcagaucagcaga

SEQ ID NO: 393977 - RNA, 26 nt, Human
cucacagccuagcacgaaggcaggua

SEQ ID NO: 393978 - RNA, 32 nt, Human
cucacagcuauaaucucagcacuuugggaggc

SEQ ID NO: 393979 - RNA, 32 nt, Human
cucacagcucacuuguauucuguugacuuuua

SEQ ID NO: 393980 - RNA, 19 nt, Human
cucacagcuccucaugcca

SEQ ID NO: 393981 - RNA, 24 nt, Human
cucacagcuguaaucccagcacuu

SEQ ID NO: 393982 - RNA, 32 nt, Human
cucacagcuguaaucccagcacuuagggaggu

SEQ ID NO: 393983 - RNA, 32 nt, Human
cucacagcuguaaucccagcacuuugagguug

SEQ ID NO: 393984 - RNA, 32 nt, Human
cucacagcuguggcugcuucacuuagaugcag

SEQ ID NO: 393985 - RNA, 21 nt, Human
cucacaggaacauggagcagg

SEQ ID NO: 393986 - RNA, 32 nt, Human
cucacaggacaggagggagugagggaaagggg

SEQ ID NO: 393987 - RNA, 32 nt, Human
cucacaggaccagccacuagcgcagccucgag

SEQ ID NO: 393988 - RNA, 32 nt, Human
cucacaggagcagggagcaggagcacucuaag

SEQ ID NO: 393989 - RNA, 32 nt, Human
cucacaggagggugugagucagcucuguccgu

SEQ ID NO: 393990 - RNA, 32 nt, Human
cucacaggagggugugagucagcucugucugu

SEQ ID NO: 393991 - RNA, 32 nt, Human
cucacaggagggugugagucagcucugugugg

SEQ ID NO: 393992 - RNA, 32 nt, Human
cucacaggagggugugagucagcucugugugu

SEQ ID NO: 393993 - RNA, 32 nt, Human
cucacaggagggugugugucagcucugucucu

SEQ ID NO: 393994 - RNA, 32 nt, Human
cucacaggagggugugugucagcucugucugu

SEQ ID NO: 393995 - RNA, 32 nt, Human
cucacaggccaaagcaucagcaccagaacgca

SEQ ID NO: 393996 - RNA, 32 nt, Human
cucacaggccugcagccccacugaucaucuuc

SEQ ID NO: 393997 - RNA, 32 nt, Human
cucacaggcucugcuguucuccacuucucacc

SEQ ID NO: 393998 - RNA, 21 nt, Human
cucacagggaacacgggacag

SEQ ID NO: 393999 - RNA, 21 nt, Human
cucacagggaggaggaggcgg

SEQ ID NO: 394000 - RNA, 32 nt, Human
cucacagggagguccagccauguucucugggc

SEQ ID NO: 394001 - RNA, 32 nt, Human
cucacagggcucccucagccuggggaacauua

SEQ ID NO: 394002 - RNA, 32 nt, Human
cucacagggcuggggccugcgucccuccucgu

SEQ ID NO: 394003 - RNA, 22 nt, Human
cucacaggggccuuucucacca

SEQ ID NO: 394004 - RNA, 32 nt, Human
cucacagguacgcgguggugucggguuccugg

SEQ ID NO: 394005 - RNA, 32 nt, Human
cucacaggugcaugaggaucggacuccgccuc

SEQ ID NO: 394006 - RNA, 32 nt, Human
cucacaguauccuauaaucuuugugcucucac

SEQ ID NO: 394007 - RNA, 24 nt, Human
cucacagucacgccgcagcaugga

SEQ ID NO: 394008 - RNA, 21 nt, Human
cucacagucccugcuguggga

SEQ ID NO: 394009 - RNA, 32 nt, Human
cucacagucccugcuuuugggauuacuuaugc

SEQ ID NO: 394010 - RNA, 32 nt, Human
cucacagucuaaggcuggaaguuuaaugaacu

SEQ ID NO: 394011 - RNA, 32 nt, Human
cucacagugaggcccucagaccugccacaggg

SEQ ID NO: 394012 - RNA, 32 nt, Human
cucacagugcaaccucugcuucccagguucaa

SEQ ID NO: 394013 - RNA, 32 nt, Human
cucacaguuaggggacugggcguggcugauug

SEQ ID NO: 394014 - RNA, 32 nt, Human
cucacauacagacacacacauauauguacaga

SEQ ID NO: 394015 - RNA, 32 nt, Human
cucacauaccaaggccccuccccaccaucggu

SEQ ID NO: 394016 - RNA, 32 nt, Human
cucacauaggauuccagaacauucaugcuggg

SEQ ID NO: 394017 - RNA, 32 nt, Human
cucacauauagggaaugcagaauaaaucccau

SEQ ID NO: 394018 - RNA, 32 nt, Human
cucacauaucuaagacuuuuccauuuuucuuc

SEQ ID NO: 394019 - RNA, 32 nt, Human
cucacauaucucacauauaauguaauuucccu

SEQ ID NO: 394020 - RNA, 32 nt, Human
cucacauccagccuuggaaucuaacgggcauu

SEQ ID NO: 394021 - RNA, 18 nt, Human
cucacauccuccugccca

SEQ ID NO: 394022 - RNA, 32 nt, Human
cucacauccuuugaagaugaccaccuugaaga

SEQ ID NO: 394023 - RNA, 32 nt, Human
cucacaucucucucacucccuccaauccucac

SEQ ID NO: 394024 - RNA, 26 nt, Human
cucacaucucuugacaguuaaagccu

SEQ ID NO: 394025 - RNA, 24 nt, Human
cucacaucuguaaccccagcacuu

SEQ ID NO: 394026 - RNA, 32 nt, Human
cucacaucuguaaccccagcacuuugggaggc

SEQ ID NO: 394027 - RNA, 32 nt, Human
cucacaucuguaauccaagcacuuugggaggu

SEQ ID NO: 394028 - RNA, 24 nt, Human
cucacaucuguaaucccaacacuu

SEQ ID NO: 394029 - RNA, 32 nt, Human
cucacaucuguaaucccaacacuuugggaggc

SEQ ID NO: 394030 - RNA, 24 nt, Human
cucacaucuguaaucccagcacuu

SEQ ID NO: 394031 - RNA, 32 nt, Human
cucacaucuguaaucccagcacuuuggaaggc

SEQ ID NO: 394032 - RNA, 32 nt, Human
cucacaucuguaaucccagcacuuugggagac

SEQ ID NO: 394033 - RNA, 32 nt, Human
cucacaucuguaaucccagcacuuugggaggc

SEQ ID NO: 394034 - RNA, 32 nt, Human
cucacaucuguaaucccagcacuuugggaguc

SEQ ID NO: 394035 - RNA, 32 nt, Human
cucacaucuguaaucccagcacuuuuggaggc

SEQ ID NO: 394036 - RNA, 24 nt, Human
cucacaucuguaaucucaacacuu

SEQ ID NO: 394037 - RNA, 32 nt, Human
cucacaucuguaaucucaacacuuugggaggc

SEQ ID NO: 394038 - RNA, 32 nt, Human
cucacaucuguaaucucagcauuuugggaggc

SEQ ID NO: 394039 - RNA, 32 nt, Human
cucacaucuguaaugccagcacuuugggaggc

SEQ ID NO: 394040 - RNA, 32 nt, Human
cucacaucuuguacuccauccugggcccccug

SEQ ID NO: 394041 - RNA, 32 nt, Human
cucacaucuuuacucuguccuaccucucauuu

SEQ ID NO: 394042 - RNA, 32 nt, Human
cucacaugcauacauacacauauauacacaca

SEQ ID NO: 394043 - RNA, 32 nt, Human
cucacauggaagcagaagcugugacaaguuua

SEQ ID NO: 394044 - RNA, 32 nt, Human
cucacauggacaccuaaacaccugccgaugau

SEQ ID NO: 394045 - RNA, 32 nt, Human
cucacauggauugaggcccaguuccugggaga

SEQ ID NO: 394046 - RNA, 31 nt, Human
cucacauggcuucuccccacgaaggucccag

SEQ ID NO: 394047 - RNA, 32 nt, Human
cucacauggcuucuccccacgaaggucccagg

SEQ ID NO: 394048 - RNA, 32 nt, Human
cucacauggcuugcacucagugacaccaaauc

SEQ ID NO: 394049 - RNA, 32 nt, Human
cucacauguuccugauagugcugcaguugcuu

SEQ ID NO: 394050 - RNA, 32 nt, Human
cucacauucagaggaaguccagaucuccugag

SEQ ID NO: 394051 - RNA, 32 nt, Human
cucacauucccucugcuggucugugcuggucu

SEQ ID NO: 394052 - RNA, 24 nt, Human
cucacauucguaaucccagcacuu

SEQ ID NO: 394053 - RNA, 32 nt, Human
cucacauucuucucuucucuccucucaaaaag

SEQ ID NO: 394054 - RNA, 22 nt, Human
cucacauugucccuacaaggac

SEQ ID NO: 394055 - RNA, 32 nt, Human
cucacauuugugaacucaaacgaugugcaaua

SEQ ID NO: 394056 - RNA, 32 nt, Human
cucaccaaagcccacugccauggggccaucug

SEQ ID NO: 394057 - RNA, 32 nt, Human
cucaccaacagcaauaugacugcuaaagaacc

SEQ ID NO: 394058 - RNA, 32 nt, Human
cucaccaacauggagaaaccccgucuccacua

SEQ ID NO: 394059 - RNA, 32 nt, Human
cucaccaacauggagaaaucccaucucuacua

SEQ ID NO: 394060 - RNA, 32 nt, Human
cucaccaaccuccaacccagagccccagugag

SEQ ID NO: 394061 - RNA, 17 nt, Human
cucaccaagcuguucca

SEQ ID NO: 394062 - RNA, 32 nt, Human
cucaccaagggaaagaaagagaaaaggacucu

SEQ ID NO: 394063 - RNA, 32 nt, Human
cucaccaagggaggggaccucugggagcucuc

SEQ ID NO: 394064 - RNA, 19 nt, Human
cucaccacagcccaccugg

SEQ ID NO: 394065 - RNA, 32 nt, Human
cucaccaccauggucgggcuccuuuuguuuuu

SEQ ID NO: 394066 - RNA, 32 nt, Human
cucaccaccuccacuuuucucucacucugccc

SEQ ID NO: 394067 - RNA, 32 nt, Human
cucaccaccugccucuaaucugagcugcagcc

SEQ ID NO: 394068 - RNA, 32 nt, Human
cucaccaccugcugagcucugugugauuucug

SEQ ID NO: 394069 - RNA, 32 nt, Human
cucaccacgagggucuguggcuucauuccuua

SEQ ID NO: 394070 - RNA, 32 nt, Human
cucaccacuacacuccagccugggugacagca

SEQ ID NO: 394071 - RNA, 32 nt, Human
cucaccacucacaagcugugugacuucaaaca

SEQ ID NO: 394072 - RNA, 32 nt, Human
cucaccacugaacuccagccugggcgacagag

SEQ ID NO: 394073 - RNA, 32 nt, Human
cucaccacugcacuccagccugggcagcagag

SEQ ID NO: 394074 - RNA, 32 nt, Human
cucaccacugcugccaccucucuggccaaugg

SEQ ID NO: 394075 - RNA, 32 nt, Human
cucaccacuguacuccagccugggugacagag

SEQ ID NO: 394076 - RNA, 22 nt, Human
cucaccacuguccaguccagca

SEQ ID NO: 394077 - RNA, 32 nt, Human
cucaccacuuaagauagaagcagcagcugcau

SEQ ID NO: 394078 - RNA, 32 nt, Human
cucaccagcaaggaagagugggguauggaagu

SEQ ID NO: 394079 - RNA, 32 nt, Human
cucaccagccucucccugaagucuuggcccgg

SEQ ID NO: 394080 - RNA, 32 nt, Human
cucaccagccugggcagcagcaagaacuauuu

SEQ ID NO: 394081 - RNA, 32 nt, Human
cucaccaggaaaccuguucuucugcucauucu

SEQ ID NO: 394082 - RNA, 32 nt, Human
cucaccaggaacauucgcuucucucaccagga

SEQ ID NO: 394083 - RNA, 32 nt, Human
cucaccaggaaccgcaucccugugcugccucc

SEQ ID NO: 394084 - RNA, 32 nt, Human
cucaccaggagaaagagccacauccccacguu

SEQ ID NO: 394085 - RNA, 32 nt, Human
cucaccaggaggaagaagcaugcagggcacuc

SEQ ID NO: 394086 - RNA, 32 nt, Human
cucaccaggccugggucagguggggaggggac

SEQ ID NO: 394087 - RNA, 32 nt, Human
cucaccaggcuggagugugguagcacgaucuc

SEQ ID NO: 394088 - RNA, 32 nt, Human
cucaccagggucugaggggcagcucuggccag

SEQ ID NO: 394089 - RNA, 32 nt, Human
cucaccagugguugauuuuccaagaaauauaa

SEQ ID NO: 394090 - RNA, 18 nt, Human
cucaccauccagcugcag

SEQ ID NO: 394091 - RNA, 32 nt, Human
cucaccaugcacuccagccuagacaacagggc

SEQ ID NO: 394092 - RNA, 32 nt, Human
cucaccauuacacuccagccugggcgacaaga

SEQ ID NO: 394093 - RNA, 32 nt, Human
cucaccauuccaagucuccaccccuuucuaga

SEQ ID NO: 394094 - RNA, 21 nt, Human
cucaccauugaugaccuuugu

SEQ ID NO: 394095 - RNA, 32 nt, Human
cucaccauugcacuccagccuggaugacagag

SEQ ID NO: 394096 - RNA, 32 nt, Human
cucaccauugcacuccagccugggcgacugag

SEQ ID NO: 394097 - RNA, 32 nt, Human
cucaccauuucccagcgcuccuggggcucagu

SEQ ID NO: 394098 - RNA, 32 nt, Human
cucacccaaacagcaacauuucuaaggaacuu

SEQ ID NO: 394099 - RNA, 32 nt, Human
cucacccaaaggaaccgcuccuugucccuccu

SEQ ID NO: 394100 - RNA, 32 nt, Human
cucacccaaauuucaucucgaauuguaauccc

SEQ ID NO: 394101 - RNA, 32 nt, Human
cucacccaaccugugaugggaaucaaggggua

SEQ ID NO: 394102 - RNA, 21 nt, Human
cucacccacaaaacaauguaa

SEQ ID NO: 394103 - RNA, 32 nt, Human
cucacccacacugccugugccugcugggccca

SEQ ID NO: 394104 - RNA, 32 nt, Human
cucacccacagcaggagccccuugucuuucag

SEQ ID NO: 394105 - RNA, 32 nt, Human
cucacccacagccccugcugggcccaccaccu

SEQ ID NO: 394106 - RNA, 32 nt, Human
cucacccacccucucccucucccuucagcucu

SEQ ID NO: 394107 - RNA, 32 nt, Human
cucacccacuccaagagacugcagcccucaaa

SEQ ID NO: 394108 - RNA, 23 nt, Human
cucacccacuccauggaccucaa

SEQ ID NO: 394109 - RNA, 32 nt, Human
cucacccacuccucgcucaguuugaccacugu

SEQ ID NO: 394110 - RNA, 32 nt, Human
cucacccacuccugcguuccuguccaggcagu

SEQ ID NO: 394111 - RNA, 32 nt, Human
cucacccagacuccaggcugucuuucacugaa

SEQ ID NO: 394112 - RNA, 32 nt, Human
cucacccagccucggcugaauguggccugaga

SEQ ID NO: 394113 - RNA, 32 nt, Human
cucacccagccuggccccucugcugagcacuu

SEQ ID NO: 394114 - RNA, 32 nt, Human
cucacccaggaucuuccucaauacugcuccuc

SEQ ID NO: 394115 - RNA, 32 nt, Human
cucacccaggccugccauggguccuuagcccu

SEQ ID NO: 394116 - RNA, 22 nt, Human
cucacccaggcuggaaugcagu

SEQ ID NO: 394117 - RNA, 24 nt, Human
cucacccaggcuggaaugcagugg

SEQ ID NO: 394118 - RNA, 23 nt, Human
cucacccaggcuggagugcagug

SEQ ID NO: 394119 - RNA, 32 nt, Human
cucacccaggcuggggucugagugucacuguc

SEQ ID NO: 394120 - RNA, 32 nt, Human
cucacccaguauaccagccucuuccuggugau

SEQ ID NO: 394121 - RNA, 21 nt, Human
cucacccagugcccucucccc

SEQ ID NO: 394122 - RNA, 32 nt, Human
cucacccaguucagguguauagggaauuuuca

SEQ ID NO: 394123 - RNA, 32 nt, Human
cucacccauagucccagcuauucaggaggcua

SEQ ID NO: 394124 - RNA, 32 nt, Human
cucacccaucccacugacaccaugaagccugu

SEQ ID NO: 394125 - RNA, 32 nt, Human
cucaccccaaccuccgccuccuggguucaggc

SEQ ID NO: 394126 - RNA, 20 nt, Human
cucaccccaagaacuccagg

SEQ ID NO: 394127 - RNA, 19 nt, Human
cucaccccacaccucaaga

SEQ ID NO: 394128 - RNA, 32 nt, Human
cucaccccacaccugacacagagcaggcacuc

SEQ ID NO: 394129 - RNA, 31 nt, Human
cucaccccacccuccuguccugugucuugga

SEQ ID NO: 394130 - RNA, 21 nt, Human
cucaccccacucccaccuuug

SEQ ID NO: 394131 - RNA, 32 nt, Human
cucaccccagaacccucgggacugcgacgagg

SEQ ID NO: 394132 - RNA, 32 nt, Human
cucaccccagauugcugccagcucuuuuguuu

SEQ ID NO: 394133 - RNA, 32 nt, Human
cucaccccagcacuuccuaugggacucacgcc

SEQ ID NO: 394134 - RNA, 32 nt, Human
cucaccccagcccuccccacucccagguuaac

SEQ ID NO: 394135 - RNA, 16 nt, Human
cucacccccacccuca

SEQ ID NO: 394136 - RNA, 32 nt, Human
cucacccccacccucauguucaggguggaugu

SEQ ID NO: 394137 - RNA, 32 nt, Human
cucacccccaccucaaggucaggaugcgaaca

SEQ ID NO: 394138 - RNA, 32 nt, Human
cucacccccaggagggugcagaccucagccaa

SEQ ID NO: 394139 - RNA, 32 nt, Human
cucacccccgggcugucucacucucuggagcc

SEQ ID NO: 394140 - RNA, 32 nt, Human
cucacccccugccagugccacuccuagccagc

SEQ ID NO: 394141 - RNA, 32 nt, Human
cucacccccugcccccgcaccaaccacccaua

SEQ ID NO: 394142 - RNA, 32 nt, Human
cucacccccuggcuucugcaucucccuaaggg

SEQ ID NO: 394143 - RNA, 32 nt, Human
cucacccccuguaaucccagcacuuugggaag

SEQ ID NO: 394144 - RNA, 32 nt, Human
cucaccccgggcuaccuccugucacuacucac

SEQ ID NO: 394145 - RNA, 18 nt, Human
cucaccccuacucgggca

SEQ ID NO: 394146 - RNA, 20 nt, Human
cucaccccucaccauccuuc

SEQ ID NO: 394147 - RNA, 32 nt, Human
cucaccccucagcuccccuuggggcccagcug

SEQ ID NO: 394148 - RNA, 32 nt, Human
cucaccccucauucuguccuccggacuuagga

SEQ ID NO: 394149 - RNA, 32 nt, Human
cucaccccuccuggcccaggccuugcugacuc

SEQ ID NO: 394150 - RNA, 22 nt, Human
cucaccccucuauccauuccuc

SEQ ID NO: 394151 - RNA, 32 nt, Human
cucaccccugcacuccagccugggcaacagag

SEQ ID NO: 394152 - RNA, 32 nt, Human
cucaccccugcacugagcccccuuagaucuac

SEQ ID NO: 394153 - RNA, 32 nt, Human
cucaccccugcccucuugcacucucccugccc

SEQ ID NO: 394154 - RNA, 32 nt, Human
cucaccccugcucugcccucugcccuaggaag

SEQ ID NO: 394155 - RNA, 32 nt, Human
cucaccccugcucuggccaugugccgcgccug

SEQ ID NO: 394156 - RNA, 32 nt, Human
cucaccccuggaaucccagcacuuugggaggc

SEQ ID NO: 394157 - RNA, 32 nt, Human
cucaccccuguaacccuagcacuuuaggaaau

SEQ ID NO: 394158 - RNA, 18 nt, Human
cucaccccuguaauccca

SEQ ID NO: 394159 - RNA, 32 nt, Human
cucaccccuguaaucccagcacuuugggaggc

SEQ ID NO: 394160 - RNA, 32 nt, Human
cucaccccuguaaucccagcacuuuggguggg

SEQ ID NO: 394161 - RNA, 32 nt, Human
cucaccccuguaaucccagcacuuugugaggc

SEQ ID NO: 394162 - RNA, 32 nt, Human
cucaccccuguaaucccaguacuuugggaggc

SEQ ID NO: 394163 - RNA, 32 nt, Human
cucaccccuguaauccuagcacuuugggaggc

SEQ ID NO: 394164 - RNA, 32 nt, Human
cucaccccuguaaucgcagcacuuugggaggc

SEQ ID NO: 394165 - RNA, 32 nt, Human
cucaccccuguaaucucagcacuuuggguggc

SEQ ID NO: 394166 - RNA, 32 nt, Human
cucaccccuguaaucucagcauuuugggaggc

SEQ ID NO: 394167 - RNA, 32 nt, Human
cucaccccuucccuggccucugggccucacug

SEQ ID NO: 394168 - RNA, 32 nt, Human
cucaccccuuuaaucccagcacuuuggaaggc

SEQ ID NO: 394169 - RNA, 32 nt, Human
cucaccccuuuuugccccuccugccccuucca

SEQ ID NO: 394170 - RNA, 28 nt, Human
cucacccgaagggcugccucacucugug

SEQ ID NO: 394171 - RNA, 32 nt, Human
cucacccgcacaccguccgcgcacgccugagg

SEQ ID NO: 394172 - RNA, 32 nt, Human
cucacccgcuccacgcccuccugggccgagug

SEQ ID NO: 394173 - RNA, 32 nt, Human
cucacccgggcuugcaccaccagucuucaccu

SEQ ID NO: 394174 - RNA, 32 nt, Human
cucacccuagaugaguccuuugguucgguggu

SEQ ID NO: 394175 - RNA, 32 nt, Human
cucacccuauuccagggacacagucugcuugg

SEQ ID NO: 394176 - RNA, 32 nt, Human
cucacccuauugcccaggcuggagugcaaugg

SEQ ID NO: 394177 - RNA, 21 nt, Human
cucacccucaccccauccuuc

SEQ ID NO: 394178 - RNA, 32 nt, Human
cucacccucaguagcugggauuauuggcaugc

SEQ ID NO: 394179 - RNA, 32 nt, Human
cucacccuccaccccugcuauucugccauguc

SEQ ID NO: 394180 - RNA, 32 nt, Human
cucacccuccacccucugccuugcaauacgca

SEQ ID NO: 394181 - RNA, 32 nt, Human
cucacccucccaaagugcugggauuauaggca

SEQ ID NO: 394182 - RNA, 32 nt, Human
cucacccuccucccucucccuccuccucccuc

SEQ ID NO: 394183 - RNA, 32 nt, Human
cucacccuccugagcugggauuacaggcgccu

SEQ ID NO: 394184 - RNA, 18 nt, Human
cucacccucuaccucccu

SEQ ID NO: 394185 - RNA, 22 nt, Human
cucacccucuccgcacaccucu

SEQ ID NO: 394186 - RNA, 32 nt, Human
cucacccucucuggaccucaucuguaagagga

SEQ ID NO: 394187 - RNA, 18 nt, Human
cucacccucugcccuucu

SEQ ID NO: 394188 - RNA, 32 nt, Human
cucacccucugccucacucccaaugucuccuu

SEQ ID NO: 394189 - RNA, 32 nt, Human
cucacccucugccugcccuguccuuccccugg

SEQ ID NO: 394190 - RNA, 32 nt, Human
cucacccugcagcucccgcaccugugccugcc

SEQ ID NO: 394191 - RNA, 32 nt, Human
cucacccugccagagcagcuguaggagaugga

SEQ ID NO: 394192 - RNA, 32 nt, Human
cucacccugcccuccuccccagccuggaaucg

SEQ ID NO: 394193 - RNA, 20 nt, Human
cucacccugcuccccagaca

SEQ ID NO: 394194 - RNA, 32 nt, Human
cucacccugcucccucucgccccuucucuccc

SEQ ID NO: 394195 - RNA, 24 nt, Human
cucacccugcuuucguacaaggaa

SEQ ID NO: 394196 - RNA, 19 nt, Human
cucacccugggcacccucu

SEQ ID NO: 394197 - RNA, 22 nt, Human
cucacccugggcacccucuuca

SEQ ID NO: 394198 - RNA, 32 nt, Human
cucacccuggggacaugccuguugauaacaug

SEQ ID NO: 394199 - RNA, 32 nt, Human
cucacccugucacccaggcuggaaugcaaugg

SEQ ID NO: 394200 - RNA, 32 nt, Human
cucacccugucgcccaggcuggagugcaaugc

SEQ ID NO: 394201 - RNA, 32 nt, Human
cucacccuguugcccaggcuacagugcaaugg

SEQ ID NO: 394202 - RNA, 32 nt, Human
cucacccuguugcccaggcuggagugcaaugg

SEQ ID NO: 394203 - RNA, 18 nt, Human
cucacccuuccacuuuca

SEQ ID NO: 394204 - RNA, 19 nt, Human
cucacccuucuuucuggca

SEQ ID NO: 394205 - RNA, 24 nt, Human
cucacccuuguaaucccagcacuu

SEQ ID NO: 394206 - RNA, 32 nt, Human
cucacccuuguaaucccagcacuuugggaggc

SEQ ID NO: 394207 - RNA, 32 nt, Human
cucacccuuuccaaacuccagaaaucuugucu

SEQ ID NO: 394208 - RNA, 32 nt, Human
cucaccgacacagcaggagagcagcuuggaac

SEQ ID NO: 394209 - RNA, 32 nt, Human
cucaccgagcccucuuccccagcuccucugaa

SEQ ID NO: 394210 - RNA, 32 nt, Human
cucaccgagguggguacccugcccaccgccag

SEQ ID NO: 394211 - RNA, 32 nt, Human
cucaccgcaaccuccaccuccuggguucaagu

SEQ ID NO: 394212 - RNA, 32 nt, Human
cucaccgcaaccuccgccuccuggguucaagc

SEQ ID NO: 394213 - RNA, 32 nt, Human
cucaccgcaaccuccgucuccuggguucaagc

SEQ ID NO: 394214 - RNA, 32 nt, Human
cucaccgcaaccucugccuccuggguucaagc

SEQ ID NO: 394215 - RNA, 32 nt, Human
cucaccgcagccucaaacuccccagcucgggu

SEQ ID NO: 394216 - RNA, 32 nt, Human
cucaccgcagccuccgccuccuggggucaggc

SEQ ID NO: 394217 - RNA, 32 nt, Human
cucaccgcaggaagcaguuuggguuuugaaag

SEQ ID NO: 394218 - RNA, 32 nt, Human
cucaccgccagguuccagcccaggaagcgcuc

SEQ ID NO: 394219 - RNA, 22 nt, Human
cucaccgccuccucuucgggca

SEQ ID NO: 394220 - RNA, 32 nt, Human
cucaccgcgaagguccacggcuucauucuuua

SEQ ID NO: 394221 - RNA, 32 nt, Human
cucaccgcgaggguccguggcuucauucuuga

SEQ ID NO: 394222 - RNA, 32 nt, Human
cucaccgcguccaggcgucagugaggggcuau

SEQ ID NO: 394223 - RNA, 32 nt, Human
cucaccgcuguagcuguggcggcuggggcugc

SEQ ID NO: 394224 - RNA, 32 nt, Human
cucaccggaaggcaugggguggcguguagacc

SEQ ID NO: 394225 - RNA, 32 nt, Human
cucaccggaauacccagccaaagaaaaagguc

SEQ ID NO: 394226 - RNA, 32 nt, Human
cucaccggagcuugucuuuaaaaaugagcagg

SEQ ID NO: 394227 - RNA, 32 nt, Human
cucaccggcuuccuauuugaugcacccaggcc

SEQ ID NO: 394228 - RNA, 32 nt, Human
cucaccgggaucuggcuuuccuucccuuccca

SEQ ID NO: 394229 - RNA, 32 nt, Human
cucaccgucccccaggcuggagugccguggcg

SEQ ID NO: 394230 - RNA, 32 nt, Human
cucaccgucuuccuccuccuggucuucuacac

SEQ ID NO: 394231 - RNA, 19 nt, Human
cucaccguuucacuggaua

SEQ ID NO: 394232 - RNA, 24 nt, Human
cucaccuagagcucacucucugga

SEQ ID NO: 394233 - RNA, 32 nt, Human
cucaccuagauacuuccagaaccuucucuggg

SEQ ID NO: 394234 - RNA, 32 nt, Human
cucaccuaucuucucucuugcuccaucuacca

SEQ ID NO: 394235 - RNA, 28 nt, Human
cucaccucaacugcugccuucuguccag

SEQ ID NO: 394236 - RNA, 24 nt, Human
cucaccucacugcaaccuccaccu

SEQ ID NO: 394237 - RNA, 32 nt, Human
cucaccucacugcaaccuccaccuccuagguu

SEQ ID NO: 394238 - RNA, 32 nt, Human
cucaccucacugcaaccuccgccuccuggguu

SEQ ID NO: 394239 - RNA, 32 nt, Human
cucaccucacugcaaccucugccucccggguc

SEQ ID NO: 394240 - RNA, 32 nt, Human
cucaccucacugcaagcucugccucccgggcu

SEQ ID NO: 394241 - RNA, 32 nt, Human
cucaccuccaccuguaaugcaggagggagaau

SEQ ID NO: 394242 - RNA, 32 nt, Human
cucaccuccaucuuucaaaauauggcaagcug

SEQ ID NO: 394243 - RNA, 32 nt, Human
cucaccucccacccucugccuuugcuggugcc

SEQ ID NO: 394244 - RNA, 32 nt, Human
cucaccucccuccuggggccuuuuguuuugga

SEQ ID NO: 394245 - RNA, 32 nt, Human
cucaccuccgugugaauggaaggggcucugcu

SEQ ID NO: 394246 - RNA, 32 nt, Human
cucaccuccguguucucguucucaucucugcc

SEQ ID NO: 394247 - RNA, 32 nt, Human
cucaccucgacauucagagaacuggccuggga

SEQ ID NO: 394248 - RNA, 32 nt, Human
cucaccucgggcucccgcuccgucuccaccuc

SEQ ID NO: 394249 - RNA, 32 nt, Human
cucaccucguuccacagcuccaccuucaucuu

SEQ ID NO: 394250 - RNA, 32 nt, Human
cucaccucuacauggcgaaaaccaaggguuca

SEQ ID NO: 394251 - RNA, 32 nt, Human
cucaccucuaccuccuguccucaggccgugcg

SEQ ID NO: 394252 - RNA, 32 nt, Human
cucaccucucacccuccuccagucccacuuca

SEQ ID NO: 394253 - RNA, 32 nt, Human
cucaccucucccccgaaaacccccuauuuagc

SEQ ID NO: 394254 - RNA, 32 nt, Human
cucaccucucccugggguccccaaauccaggc

SEQ ID NO: 394255 - RNA, 32 nt, Human
cucaccucuccuccgcuagaguguuccauggc

SEQ ID NO: 394256 - RNA, 32 nt, Human
cucaccucucugaccucagcuuccucaacugg

SEQ ID NO: 394257 - RNA, 32 nt, Human
cucaccucucugcuucuugggcuccaucccaa

SEQ ID NO: 394258 - RNA, 32 nt, Human
cucaccucugcagguccugggcgcagacuuca

SEQ ID NO: 394259 - RNA, 24 nt, Human
cucaccucuguaaucccagcacuu

SEQ ID NO: 394260 - RNA, 32 nt, Human
cucaccucuguaaucccagcacuuugggaggc

SEQ ID NO: 394261 - RNA, 32 nt, Human
cucaccucuucuuuaccagaacgguucuuuga

SEQ ID NO: 394262 - RNA, 28 nt, Human
cucaccugagugggggccucaucuaccu

SEQ ID NO: 394263 - RNA, 20 nt, Human
cucaccugcauccucucccc

SEQ ID NO: 394264 - RNA, 32 nt, Human
cucaccugccacagagcccacacccaugccca

SEQ ID NO: 394265 - RNA, 32 nt, Human
cucaccugccauuuauggcucuugccguuuau

SEQ ID NO: 394266 - RNA, 26 nt, Human
cucaccugccccucuguucucucccc

SEQ ID NO: 394267 - RNA, 22 nt, Human
cucaccugccugaccugcccca

SEQ ID NO: 394268 - RNA, 25 nt, Human
cucaccugccugcccuccccucccc

SEQ ID NO: 394269 - RNA, 32 nt, Human
cucaccugcucgggcccugccugcugggcccu

SEQ ID NO: 394270 - RNA, 32 nt, Human
cucaccugcuggccccucaccugggcaccugg

SEQ ID NO: 394271 - RNA, 32 nt, Human
cucaccuggcagcugccgucucugcccccugg

SEQ ID NO: 394272 - RNA, 32 nt, Human
cucaccuggcuugcuugggcccaguguggggg

SEQ ID NO: 394273 - RNA, 32 nt, Human
cucaccugggcuccccuccugaggcagugcag

SEQ ID NO: 394274 - RNA, 22 nt, Human
cucaccugguucucucucccca

SEQ ID NO: 394275 - RNA, 32 nt, Human
cucaccugucucuauucuuucaacagguugau

SEQ ID NO: 394276 - RNA, 23 nt, Human
cucaccugucuguucucucccca

SEQ ID NO: 394277 - RNA, 32 nt, Human
cucaccugugacaccaagacccaccccaaucc

SEQ ID NO: 394278 - RNA, 32 nt, Human
cucaccugugcuggggacccugugggagcagc

SEQ ID NO: 394279 - RNA, 32 nt, Human
cucaccuguggaauuuggugucagcuaaaagg

SEQ ID NO: 394280 - RNA, 32 nt, Human
cucaccuguguuuccucaguggcuccaccucu

SEQ ID NO: 394281 - RNA, 32 nt, Human
cucaccuuaccccauagcaucuugcggcccag

SEQ ID NO: 394282 - RNA, 32 nt, Human
cucaccuucccucccccugcuuuuuaauuucu

SEQ ID NO: 394283 - RNA, 32 nt, Human
cucaccuucccucccuuaccccaagcaaggcc

SEQ ID NO: 394284 - RNA, 32 nt, Human
cucaccuuccucaccccuccucugacccaccc

SEQ ID NO: 394285 - RNA, 32 nt, Human
cucaccuucgccucugcugaagucuccccgca

SEQ ID NO: 394286 - RNA, 32 nt, Human
cucaccuucuccccacccuaccucaccucuuc

SEQ ID NO: 394287 - RNA, 32 nt, Human
cucaccuugucacccaggcuagagugcagugg

SEQ ID NO: 394288 - RNA, 25 nt, Human
cucaccuuucccaccucucucccca

SEQ ID NO: 394289 - RNA, 32 nt, Human
cucaccuuugguugugcuuccuuuccaacccu

SEQ ID NO: 394290 - RNA, 32 nt, Human
cucacgaaauaugcucucuccuuuuccaguaa

SEQ ID NO: 394291 - RNA, 32 nt, Human
cucacgaagcagaggcugggcgugguggcucu

SEQ ID NO: 394292 - RNA, 32 nt, Human
cucacgaagccggggaaacacuucagccgcag

SEQ ID NO: 394293 - RNA, 32 nt, Human
cucacgaaucagcugcaggucucuguuuugaa

SEQ ID NO: 394294 - RNA, 32 nt, Human
cucacgaauggcuccaaccuccugggugcgau

SEQ ID NO: 394295 - RNA, 23 nt, Human
cucacgacggcaccacuaggcca

SEQ ID NO: 394296 - RNA, 24 nt, Human
cucacgaggagcugggauugcagg

SEQ ID NO: 394297 - RNA, 32 nt, Human
cucacgaguagcuggaauuacaggcaggcgcc

SEQ ID NO: 394298 - RNA, 32 nt, Human
cucacgaguagcugggacuacaggcaugcacc

SEQ ID NO: 394299 - RNA, 24 nt, Human
cucacgaguagcugggauuacagg

SEQ ID NO: 394300 - RNA, 32 nt, Human
cucacgaguagcugggauuacaggcaugcgcc

SEQ ID NO: 394301 - RNA, 31 nt, Human
cucacgaugaccaggugugcucugcuguugc

SEQ ID NO: 394302 - RNA, 32 nt, Human
cucacgcaccaacauggagaaaccccgucucu

SEQ ID NO: 394303 - RNA, 32 nt, Human
cucacgcagcuccagcccaucuugcugaccua

SEQ ID NO: 394304 - RNA, 19 nt, Human
cucacgcaggagacucagu

SEQ ID NO: 394305 - RNA, 23 nt, Human
cucacgcauguaaucccagcacu

SEQ ID NO: 394306 - RNA, 32 nt, Human
cucacgcauguaaucccagcacucugggaggc

SEQ ID NO: 394307 - RNA, 24 nt, Human
cucacgcauguaaucccagcacuu

SEQ ID NO: 394308 - RNA, 32 nt, Human
cucacgcauguaaucccagcacuuugggaggc

SEQ ID NO: 394309 - RNA, 32 nt, Human
cucacgcauguaaucccugcacuuugggaggc

SEQ ID NO: 394310 - RNA, 24 nt, Human
cucacgcauguaauccuaacacuu

SEQ ID NO: 394311 - RNA, 32 nt, Human
cucacgcauguaauccuaacacuuugggaggc

SEQ ID NO: 394312 - RNA, 32 nt, Human
cucacgccaggaaucccagcacuuugggaggc

SEQ ID NO: 394313 - RNA, 24 nt, Human
cucacgccaguaaucccagcacuu

SEQ ID NO: 394314 - RNA, 32 nt, Human
cucacgccaguaaucccagcacuuuggagggc

SEQ ID NO: 394315 - RNA, 32 nt, Human
cucacgccaguaaucccagcacuuugggaggc

SEQ ID NO: 394316 - RNA, 32 nt, Human
cucacgcccauaaucccagcacuuugggaggc

SEQ ID NO: 394317 - RNA, 32 nt, Human
cucacgcccccaggaaugcaagugguuuccug

SEQ ID NO: 394318 - RNA, 32 nt, Human
cucacgcccuucaaugcugcaggauggacugg

SEQ ID NO: 394319 - RNA, 24 nt, Human
cucacgccgguaaucccagcacuu

SEQ ID NO: 394320 - RNA, 32 nt, Human
cucacgccgguaaucccagcacuuugggaggc

SEQ ID NO: 394321 - RNA, 23 nt, Human
cucacgccguaaugccaacacuu

SEQ ID NO: 394322 - RNA, 32 nt, Human
cucacgccuauaauccaagcacuuugggaggc

SEQ ID NO: 394323 - RNA, 32 nt, Human
cucacgccuauaaucccaacacuuugggaagc

SEQ ID NO: 394324 - RNA, 24 nt, Human
cucacgccuauaaucccaacaguu

SEQ ID NO: 394325 - RNA, 24 nt, Human
cucacgccuauaaucccagcacuu

SEQ ID NO: 394326 - RNA, 32 nt, Human
cucacgccuauaaucccagcacuuuaggaggc

SEQ ID NO: 394327 - RNA, 32 nt, Human
cucacgccuauaaucccagcacuuugggaggc

SEQ ID NO: 394328 - RNA, 32 nt, Human
cucacgccuauaauccuaucacuuugggaggc

SEQ ID NO: 394329 - RNA, 32 nt, Human
cucacgccuauaucccagcacuuugggaggcc

SEQ ID NO: 394330 - RNA, 32 nt, Human
cucacgccuaugaucccagcacuuugggaggc

SEQ ID NO: 394331 - RNA, 32 nt, Human
cucacgccuauuaucuuagcacuuugggaggc

SEQ ID NO: 394332 - RNA, 32 nt, Human
cucacgccucuaaucccagcacuuugggaggu

SEQ ID NO: 394333 - RNA, 32 nt, Human
cucacgccucuaaucgcagcacuuugggaggc

SEQ ID NO: 394334 - RNA, 32 nt, Human
cucacgccucuaaucucagcacuuugggaggc

SEQ ID NO: 394335 - RNA, 32 nt, Human
cucacgccugaaaucccagcacuuugggagac

SEQ ID NO: 394336 - RNA, 32 nt, Human
cucacgccugaaaucccagcacuuugggaggc

SEQ ID NO: 394337 - RNA, 32 nt, Human
cucacgccugaaaucucagcacuuugguaggc

SEQ ID NO: 394338 - RNA, 24 nt, Human
cucacgccugcaaucccagcacuu

SEQ ID NO: 394339 - RNA, 32 nt, Human
cucacgccugcaaucccagcacuuugggagac

SEQ ID NO: 394340 - RNA, 32 nt, Human
cucacgccugcaaucccagcacuuugggaggc

SEQ ID NO: 394341 - RNA, 32 nt, Human
cucacgccugcagucccagcacuuugggaggc

SEQ ID NO: 394342 - RNA, 32 nt, Human
cucacgccuggaaucccagcacuuugggaagc

SEQ ID NO: 394343 - RNA, 32 nt, Human
cucacgccuggaaucccagcacuuugggaggc

SEQ ID NO: 394344 - RNA, 32 nt, Human
cucacgccuguaaacccagcacuuuaggagcc

SEQ ID NO: 394345 - RNA, 32 nt, Human
cucacgccuguaaccccaacacuuugggaggc

SEQ ID NO: 394346 - RNA, 24 nt, Human
cucacgccuguaaccccagcacuu

SEQ ID NO: 394347 - RNA, 32 nt, Human
cucacgccuguaaccccagcacuuugggaggc

SEQ ID NO: 394348 - RNA, 24 nt, Human
cucacgccuguaaccccaucacuu

SEQ ID NO: 394349 - RNA, 32 nt, Human
cucacgccuguaaccccaucacuuugggaggc

SEQ ID NO: 394350 - RNA, 32 nt, Human
cucacgccuguaacccuagcacuuugggaguc

SEQ ID NO: 394351 - RNA, 32 nt, Human
cucacgccuguaaccucagcacuuugggaggc

SEQ ID NO: 394352 - RNA, 32 nt, Human
cucacgccuguaacuccagcacuuugggaggc

SEQ ID NO: 394353 - RNA, 32 nt, Human
cucacgccuguaauaccagcacuuugggaggc

SEQ ID NO: 394354 - RNA, 32 nt, Human
cucacgccuguaaucacaacacuuugggaggc

SEQ ID NO: 394355 - RNA, 32 nt, Human
cucacgccuguaaucacagcacuuugggaggc

SEQ ID NO: 394356 - RNA, 23 nt, Human
cucacgccuguaauccaacacuu

SEQ ID NO: 394357 - RNA, 32 nt, Human
cucacgccuguaauccaagcacuuggggaggc

SEQ ID NO: 394358 - RNA, 32 nt, Human
cucacgccuguaauccagcaauuugggaggcc

SEQ ID NO: 394359 - RNA, 32 nt, Human
cucacgccuguaauccagcacuuugggagacc

SEQ ID NO: 394360 - RNA, 32 nt, Human
cucacgccuguaauccagcacuuugggaggcc

SEQ ID NO: 394361 - RNA, 18 nt, Human
cucacgccuguaauccca

SEQ ID NO: 394362 - RNA, 22 nt, Human
cucacgccuguaaucccaacac

SEQ ID NO: 394363 - RNA, 24 nt, Human
cucacgccuguaaucccaacacuu

SEQ ID NO: 394364 - RNA, 32 nt, Human
cucacgccuguaaucccaacacuuuaggagac

SEQ ID NO: 394365 - RNA, 32 nt, Human
cucacgccuguaaucccaacacuuuaggaguc

SEQ ID NO: 394366 - RNA, 32 nt, Human
cucacgccuguaaucccaacacuuugggagcc

SEQ ID NO: 394367 - RNA, 32 nt, Human
cucacgccuguaaucccaacacuuugggaggc

SEQ ID NO: 394368 - RNA, 32 nt, Human
cucacgccuguaaucccaacacuuugggaggu

SEQ ID NO: 394369 - RNA, 24 nt, Human
cucacgccuguaaucccaacauuu

SEQ ID NO: 394370 - RNA, 32 nt, Human
cucacgccuguaaucccaacauuuugggaggc

SEQ ID NO: 394371 - RNA, 24 nt, Human
cucacgccuguaaucccaccacuu

SEQ ID NO: 394372 - RNA, 32 nt, Human
cucacgccuguaaucccaccacuuuggaaagc

SEQ ID NO: 394373 - RNA, 32 nt, Human
cucacgccuguaaucccaccacuuugggagac

SEQ ID NO: 394374 - RNA, 32 nt, Human
cucacgccuguaaucccaccacuuugggagga

SEQ ID NO: 394375 - RNA, 32 nt, Human
cucacgccuguaaucccagaacuuuaggaggc

SEQ ID NO: 394376 - RNA, 32 nt, Human
cucacgccuguaaucccagaacuuugggaagc

SEQ ID NO: 394377 - RNA, 32 nt, Human
cucacgccuguaaucccagaacuuugggaggc

SEQ ID NO: 394378 - RNA, 32 nt, Human
cucacgccuguaaucccagaauuuuaggaggc

SEQ ID NO: 394379 - RNA, 32 nt, Human
cucacgccuguaaucccagacuuugggaggcc

SEQ ID NO: 394380 - RNA, 32 nt, Human
cucacgccuguaaucccagcaaguugggaggc

SEQ ID NO: 394381 - RNA, 32 nt, Human
cucacgccuguaaucccagcaauugggaaggc

SEQ ID NO: 394382 - RNA, 32 nt, Human
cucacgccuguaaucccagcaauuugggaggc

SEQ ID NO: 394383 - RNA, 32 nt, Human
cucacgccuguaaucccagcaauuugggaggu

SEQ ID NO: 394384 - RNA, 32 nt, Human
cucacgccuguaaucccagcaauuugggaguc

SEQ ID NO: 394385 - RNA, 22 nt, Human
cucacgccuguaaucccagcac

SEQ ID NO: 394386 - RNA, 32 nt, Human
cucacgccuguaaucccagcacacugggaggc

SEQ ID NO: 394387 - RNA, 32 nt, Human
cucacgccuguaaucccagcacauugggaggc

SEQ ID NO: 394388 - RNA, 32 nt, Human
cucacgccuguaaucccagcaccuugggaggc

SEQ ID NO: 394389 - RNA, 32 nt, Human
cucacgccuguaaucccagcacgcugggaggc

SEQ ID NO: 394390 - RNA, 23 nt, Human
cucacgccuguaaucccagcacu

SEQ ID NO: 394391 - RNA, 32 nt, Human
cucacgccuguaaucccagcacuaggaggccg

SEQ ID NO: 394392 - RNA, 32 nt, Human
cucacgccuguaaucccagcacucugggaggc

SEQ ID NO: 394393 - RNA, 32 nt, Human
cucacgccuguaaucccagcacugagaggccg

SEQ ID NO: 394394 - RNA, 32 nt, Human
cucacgccuguaaucccagcacuggaaggcca

SEQ ID NO: 394395 - RNA, 32 nt, Human
cucacgccuguaaucccagcacugggaggccg

SEQ ID NO: 394396 - RNA, 32 nt, Human
cucacgccuguaaucccagcacugugggaggc

SEQ ID NO: 394397 - RNA, 24 nt, Human
cucacgccuguaaucccagcacuu

SEQ ID NO: 394398 - RNA, 32 nt, Human
cucacgccuguaaucccagcacuuaggaagac

SEQ ID NO: 394399 - RNA, 32 nt, Human
cucacgccuguaaucccagcacuuaggguggg

SEQ ID NO: 394400 - RNA, 32 nt, Human
cucacgccuguaaucccagcacuucgggaggc

SEQ ID NO: 394401 - RNA, 32 nt, Human
cucacgccuguaaucccagcacuugggaggcc

SEQ ID NO: 394402 - RNA, 32 nt, Human
cucacgccuguaaucccagcacuuggggagga

SEQ ID NO: 394403 - RNA, 32 nt, Human
cucacgccuguaaucccagcacuuggggaggc

SEQ ID NO: 394404 - RNA, 32 nt, Human
cucacgccuguaaucccagcacuuuaggaggc

SEQ ID NO: 394405 - RNA, 32 nt, Human
cucacgccuguaaucccagcacuuucggaggc

SEQ ID NO: 394406 - RNA, 32 nt, Human
cucacgccuguaaucccagcacuuugagaagc

SEQ ID NO: 394407 - RNA, 32 nt, Human
cucacgccuguaaucccagcacuuugagagac

SEQ ID NO: 394408 - RNA, 32 nt, Human
cucacgccuguaaucccagcacuuugagaggc

SEQ ID NO: 394409 - RNA, 32 nt, Human
cucacgccuguaaucccagcacuuugagaugc

SEQ ID NO: 394410 - RNA, 32 nt, Human
cucacgccuguaaucccagcacuuugcgauac

SEQ ID NO: 394411 - RNA, 32 nt, Human
cucacgccuguaaucccagcacuuugcggggc

SEQ ID NO: 394412 - RNA, 32 nt, Human
cucacgccuguaaucccagcacuuuggaaggc

SEQ ID NO: 394413 - RNA, 32 nt, Human
cucacgccuguaaucccagcacuuuggaggcc

SEQ ID NO: 394414 - RNA, 32 nt, Human
cucacgccuguaaucccagcacuuuggcaggc

SEQ ID NO: 394415 - RNA, 32 nt, Human
cucacgccuguaaucccagcacuuugggaagc

SEQ ID NO: 394416 - RNA, 32 nt, Human
cucacgccuguaaucccagcacuuugggacac

SEQ ID NO: 394417 - RNA, 32 nt, Human
cucacgccuguaaucccagcacuuugggagac

SEQ ID NO: 394418 - RNA, 32 nt, Human
cucacgccuguaaucccagcacuuugggagcc

SEQ ID NO: 394419 - RNA, 32 nt, Human
cucacgccuguaaucccagcacuuugggagga

SEQ ID NO: 394420 - RNA, 32 nt, Human
cucacgccuguaaucccagcacuuugggaggc

SEQ ID NO: 394421 - RNA, 32 nt, Human
cucacgccuguaaucccagcacuuugggaggg

SEQ ID NO: 394422 - RNA, 32 nt, Human
cucacgccuguaaucccagcacuuugggaggu

SEQ ID NO: 394423 - RNA, 32 nt, Human
cucacgccuguaaucccagcacuuugggaguc

SEQ ID NO: 394424 - RNA, 32 nt, Human
cucacgccuguaaucccagcacuuuggggagc

SEQ ID NO: 394425 - RNA, 32 nt, Human
cucacgccuguaaucccagcacuuugguaggc

SEQ ID NO: 394426 - RNA, 32 nt, Human
cucacgccuguaaucccagcacuuugguuggg

SEQ ID NO: 394427 - RNA, 32 nt, Human
cucacgccuguaaucccagcacuuuguggggc

SEQ ID NO: 394428 - RNA, 32 nt, Human
cucacgccuguaaucccagcacuuuucagagg

SEQ ID NO: 394429 - RNA, 32 nt, Human
cucacgccuguaaucccagcacuuuuggaggc

SEQ ID NO: 394430 - RNA, 32 nt, Human
cucacgccuguaaucccagcacuuuugggagg

SEQ ID NO: 394431 - RNA, 32 nt, Human
cucacgccuguaaucccagcaguuugggaagc

SEQ ID NO: 394432 - RNA, 32 nt, Human
cucacgccuguaaucccagcaguuugggaggu

SEQ ID NO: 394433 - RNA, 32 nt, Human
cucacgccuguaaucccagcauuugggaggcu

SEQ ID NO: 394434 - RNA, 32 nt, Human
cucacgccuguaaucccagcauuuugggagcu

SEQ ID NO: 394435 - RNA, 32 nt, Human
cucacgccuguaaucccagcauuuugggaggc

SEQ ID NO: 394436 - RNA, 32 nt, Human
cucacgccuguaaucccagcccuuugggaggc

SEQ ID NO: 394437 - RNA, 32 nt, Human
cucacgccuguaaucccagcgcuuugggagag

SEQ ID NO: 394438 - RNA, 32 nt, Human
cucacgccuguaaucccagcgcuuugggaggc

SEQ ID NO: 394439 - RNA, 32 nt, Human
cucacgccuguaaucccagcucuuugggaggc

SEQ ID NO: 394440 - RNA, 32 nt, Human
cucacgccuguaaucccaggacuuuaggaggc

SEQ ID NO: 394441 - RNA, 32 nt, Human
cucacgccuguaaucccaggacuuugggaggc

SEQ ID NO: 394442 - RNA, 32 nt, Human
cucacgccuguaaucccaguacugugggaggc

SEQ ID NO: 394443 - RNA, 32 nt, Human
cucacgccuguaaucccaguacuugggaggcc

SEQ ID NO: 394444 - RNA, 32 nt, Human
cucacgccuguaaucccaguacuuugggagcc

SEQ ID NO: 394445 - RNA, 32 nt, Human
cucacgccuguaaucccaguacuuugggaggc

SEQ ID NO: 394446 - RNA, 32 nt, Human
cucacgccuguaaucccaguaguuugggaggc

SEQ ID NO: 394447 - RNA, 32 nt, Human
cucacgccuguaaucccaguauuuugggaguc

SEQ ID NO: 394448 - RNA, 24 nt, Human
cucacgccuguaaucccaucacuu

SEQ ID NO: 394449 - RNA, 32 nt, Human
cucacgccuguaaucccaucacuuugggaggc

SEQ ID NO: 394450 - RNA, 24 nt, Human
cucacgccuguaauccccacacuu

SEQ ID NO: 394451 - RNA, 32 nt, Human
cucacgccuguaaucccccagcaauuugggag

SEQ ID NO: 394452 - RNA, 32 nt, Human
cucacgccuguaauccccgcacuuugggaggc

SEQ ID NO: 394453 - RNA, 32 nt, Human
cucacgccuguaaucccggcacugugggaggc

SEQ ID NO: 394454 - RNA, 32 nt, Human
cucacgccuguaaucccggcacuuugggaggc

SEQ ID NO: 394455 - RNA, 32 nt, Human
cucacgccuguaaucccggcaguuugggaggc

SEQ ID NO: 394456 - RNA, 32 nt, Human
cucacgccuguaaucccgguauuuugggaggc

SEQ ID NO: 394457 - RNA, 24 nt, Human
cucacgccuguaaucccuacacuu

SEQ ID NO: 394458 - RNA, 32 nt, Human
cucacgccuguaaucccuacacuuugggaggc

SEQ ID NO: 394459 - RNA, 24 nt, Human
cucacgccuguaauccuaacacuu

SEQ ID NO: 394460 - RNA, 32 nt, Human
cucacgccuguaauccuaacacuuugggaggc

SEQ ID NO: 394461 - RNA, 32 nt, Human
cucacgccuguaauccuagcaauuugggaggc

SEQ ID NO: 394462 - RNA, 32 nt, Human
cucacgccuguaauccuagcaccuugggaggc

SEQ ID NO: 394463 - RNA, 32 nt, Human
cucacgccuguaauccuagcaccuuggggguc

SEQ ID NO: 394464 - RNA, 32 nt, Human
cucacgccuguaauccuagcacuugggaggca

SEQ ID NO: 394465 - RNA, 32 nt, Human
cucacgccuguaauccuagcacuuuggaaggc

SEQ ID NO: 394466 - RNA, 32 nt, Human
cucacgccuguaauccuagcacuuugggaggc

SEQ ID NO: 394467 - RNA, 32 nt, Human
cucacgccuguaauccuagcacuuuguaaggc

SEQ ID NO: 394468 - RNA, 32 nt, Human
cucacgccuguaauccuagcacuuuugggagg

SEQ ID NO: 394469 - RNA, 32 nt, Human
cucacgccuguaauccuagcaguuugggaggc

SEQ ID NO: 394470 - RNA, 32 nt, Human
cucacgccuguaauccuagcauuuugggaggc

SEQ ID NO: 394471 - RNA, 32 nt, Human
cucacgccuguaauccuagcauuuugggugac

SEQ ID NO: 394472 - RNA, 32 nt, Human
cucacgccuguaauccuagcauuuuuggaggc

SEQ ID NO: 394473 - RNA, 32 nt, Human
cucacgccuguaauccuagcccuuuggaaggc

SEQ ID NO: 394474 - RNA, 32 nt, Human
cucacgccuguaauccuauccuuuaggaggcc

SEQ ID NO: 394475 - RNA, 32 nt, Human
cucacgccuguaauccugacacuuugggaggc

SEQ ID NO: 394476 - RNA, 32 nt, Human
cucacgccuguaauccuggcacuuugggagga

SEQ ID NO: 394477 - RNA, 32 nt, Human
cucacgccuguaauccuggcacuuugggaggc

SEQ ID NO: 394478 - RNA, 32 nt, Human
cucacgccuguaaucgcagcacuuugggaggc

SEQ ID NO: 394479 - RNA, 32 nt, Human
cucacgccuguaaucgcggcacuuugggaggc

SEQ ID NO: 394480 - RNA, 24 nt, Human
cucacgccuguaaucucaacacuu

SEQ ID NO: 394481 - RNA, 32 nt, Human
cucacgccuguaaucucaacacuuugggaggc

SEQ ID NO: 394482 - RNA, 32 nt, Human
cucacgccuguaaucucagcacauugggaggc

SEQ ID NO: 394483 - RNA, 32 nt, Human
cucacgccuguaaucucagcacuuugggaggc

SEQ ID NO: 394484 - RNA, 32 nt, Human
cucacgccuguaaucucagcacuuuggguggc

SEQ ID NO: 394485 - RNA, 32 nt, Human
cucacgccuguaaucucagcauuuugggaggc

SEQ ID NO: 394486 - RNA, 32 nt, Human
cucacgccuguaaucucggcacuuugggagac

SEQ ID NO: 394487 - RNA, 32 nt, Human
cucacgccuguaaugccagcacuuugggaggg

SEQ ID NO: 394488 - RNA, 32 nt, Human
cucacgccuguaauuccagcacuuugggagac

SEQ ID NO: 394489 - RNA, 32 nt, Human
cucacgccuguaauuccagcacuuugggaggc

SEQ ID NO: 394490 - RNA, 32 nt, Human
cucacgccuguaauucuagcacuuugggagac

SEQ ID NO: 394491 - RNA, 32 nt, Human
cucacgccuguaauucuagcacuuugggaggc

SEQ ID NO: 394492 - RNA, 24 nt, Human
cucacgccuguagucccaacacuu

SEQ ID NO: 394493 - RNA, 32 nt, Human
cucacgccuguagucccaacacuuugggaggc

SEQ ID NO: 394494 - RNA, 32 nt, Human
cucacgccuguagucccagagcuuugggaggc

SEQ ID NO: 394495 - RNA, 32 nt, Human
cucacgccuguagucccagcacuuugggagcc

SEQ ID NO: 394496 - RNA, 32 nt, Human
cucacgccuguagucccagcacuuugggaggc

SEQ ID NO: 394497 - RNA, 32 nt, Human
cucacgccuguaguguccgcacuuugggaggc

SEQ ID NO: 394498 - RNA, 32 nt, Human
cucacgccuguaucccagcacuuuggaaggcu

SEQ ID NO: 394499 - RNA, 32 nt, Human
cucacgccuguaucccagcacuuugggaggcc

SEQ ID NO: 394500 - RNA, 32 nt, Human
cucacgccugucaucccagcacuuugggaggc

SEQ ID NO: 394501 - RNA, 32 nt, Human
cucacgccugucauccuagcacuuugggaggc

SEQ ID NO: 394502 - RNA, 32 nt, Human
cucacgccugucaucucagcacuuugggaggc

SEQ ID NO: 394503 - RNA, 32 nt, Human
cucacgccugugauaccagcacuuuugggagg

SEQ ID NO: 394504 - RNA, 32 nt, Human
cucacgccugugaucccagcacuuugggaggc

SEQ ID NO: 394505 - RNA, 32 nt, Human
cucacgccugugauccuagcacuuugggaggc

SEQ ID NO: 394506 - RNA, 32 nt, Human
cucacgccugugauuccagcacuuugggaggc

SEQ ID NO: 394507 - RNA, 32 nt, Human
cucacgccuguggucccagcacuuuggcaggu

SEQ ID NO: 394508 - RNA, 32 nt, Human
cucacgccuguggucccagcacuuugggaggc

SEQ ID NO: 394509 - RNA, 32 nt, Human
cucacgccuguggucucagcacuuugggaggc

SEQ ID NO: 394510 - RNA, 32 nt, Human
cucacgccuguuaaguccagcacuuugggagg

SEQ ID NO: 394511 - RNA, 24 nt, Human
cucacgccuguuaucccaacacuu

SEQ ID NO: 394512 - RNA, 32 nt, Human
cucacgccuguuaucccagcacuuugggaggc

SEQ ID NO: 394513 - RNA, 32 nt, Human
cucacgccuuguaaucccagcacuuugggagg

SEQ ID NO: 394514 - RNA, 32 nt, Human
cucacgccuuucuguuccuuguccucaccuua

SEQ ID NO: 394515 - RNA, 32 nt, Human
cucacgcucaaacccccacuuccugccccagg

SEQ ID NO: 394516 - RNA, 32 nt, Human
cucacgcucggugcaggaccucagggcugucg

SEQ ID NO: 394517 - RNA, 32 nt, Human
cucacgcugacacugcagccagcuccucaaug

SEQ ID NO: 394518 - RNA, 32 nt, Human
cucacgcuggagcuggagugcgagguucuuag

SEQ ID NO: 394519 - RNA, 32 nt, Human
cucacgcuguccaccugccagguggaguguau

SEQ ID NO: 394520 - RNA, 24 nt, Human
cucacgcuuauaaucccagcacuu

SEQ ID NO: 394521 - RNA, 32 nt, Human
cucacgcuuauaaucccagcacuuugggaggc

SEQ ID NO: 394522 - RNA, 32 nt, Human
cucacgcuuguaaucccaacacuuugggaggc

SEQ ID NO: 394523 - RNA, 24 nt, Human
cucacgcuuguaaucccagcacuu

SEQ ID NO: 394524 - RNA, 32 nt, Human
cucacgcuuguaaucccagcacuuugggaagc

SEQ ID NO: 394525 - RNA, 32 nt, Human
cucacgcuuguaaucccagcacuuugggaggc

SEQ ID NO: 394526 - RNA, 32 nt, Human
cucacgcuuguaaucccagcuacucuggaggc

SEQ ID NO: 394527 - RNA, 32 nt, Human
cucacgcuuguaaucccaguacuuugggaggc

SEQ ID NO: 394528 - RNA, 32 nt, Human
cucacgcuuguaaucccggcacuuuaggaggg

SEQ ID NO: 394529 - RNA, 32 nt, Human
cucacgcuuguaaucgcagcacuuugggaggc

SEQ ID NO: 394530 - RNA, 32 nt, Human
cucacgcuuguaaucucagcacuuugggaggc

SEQ ID NO: 394531 - RNA, 32 nt, Human
cucacgcuuguaauuccagcacuuugggaggc

SEQ ID NO: 394532 - RNA, 32 nt, Human
cucacggacuccugguugccagucuugccagg

SEQ ID NO: 394533 - RNA, 32 nt, Human
cucacggagaggaagggaaggaaggagaggga

SEQ ID NO: 394534 - RNA, 32 nt, Human
cucacggagccagcggccggguaggaugcaga

SEQ ID NO: 394535 - RNA, 32 nt, Human
cucacggcaaccugggauggccgccgguugcc

SEQ ID NO: 394536 - RNA, 32 nt, Human
cucacggccaggccucucuccugcugcuguuu

SEQ ID NO: 394537 - RNA, 32 nt, Human
cucacggcuguaaucccagcacuuugggaggc

SEQ ID NO: 394538 - RNA, 32 nt, Human
cucacggcuugucucaugcagucguguggcuu

SEQ ID NO: 394539 - RNA, 32 nt, Human
cucacgggagggugugagucagcucugucugu

SEQ ID NO: 394540 - RNA, 32 nt, Human
cucacggggcggcagaggcaacuucagugucc

SEQ ID NO: 394541 - RNA, 32 nt, Human
cucacgguccuccuuccugggaccugagcagg

SEQ ID NO: 394542 - RNA, 32 nt, Human
cucacgguggaacucucagaugacagcaugca

SEQ ID NO: 394543 - RNA, 32 nt, Human
cucacgguggcaggggaaggggagcaggugug

SEQ ID NO: 394544 - RNA, 32 nt, Human
cucacguaccuggcugacagagugcagauggu

SEQ ID NO: 394545 - RNA, 24 nt, Human
cucacguauguaaucccagcacuu

SEQ ID NO: 394546 - RNA, 32 nt, Human
cucacguauguaaucccagcacuuugggaagc

SEQ ID NO: 394547 - RNA, 32 nt, Human
cucacgucaggccuuugagaauucuuuccccc

SEQ ID NO: 394548 - RNA, 32 nt, Human
cucacgucugcugcaaccugaagcuugcaucu

SEQ ID NO: 394549 - RNA, 32 nt, Human
cucacgucuguaaucccagcaauuugggaggc

SEQ ID NO: 394550 - RNA, 22 nt, Human
cucacgucuguaaucccagcac

SEQ ID NO: 394551 - RNA, 32 nt, Human
cucacgucuguaaucccagcaccuugggaggc

SEQ ID NO: 394552 - RNA, 24 nt, Human
cucacgucuguaaucccagcacuu

SEQ ID NO: 394553 - RNA, 32 nt, Human
cucacgucuguaaucccagcacuuuggaaggc

SEQ ID NO: 394554 - RNA, 32 nt, Human
cucacgucuguaaucccagcacuuugggagcc

SEQ ID NO: 394555 - RNA, 32 nt, Human
cucacgucuguaaucccagcacuuugggaggc

SEQ ID NO: 394556 - RNA, 32 nt, Human
cucacgucuguaaucccagcacuuugggaggg

SEQ ID NO: 394557 - RNA, 32 nt, Human
cucacgucuguaaucccagcaguuugggaggc

SEQ ID NO: 394558 - RNA, 32 nt, Human
cucacgucuguaaucccagcgcuuugggaggc

SEQ ID NO: 394559 - RNA, 32 nt, Human
cucacgucuguaaucccaggacuuugggaggc

SEQ ID NO: 394560 - RNA, 32 nt, Human
cucacgucuguaaucucagcacuuagggaggc

SEQ ID NO: 394561 - RNA, 32 nt, Human
cucacgucuguaaucuuugggagcacuuuggg

SEQ ID NO: 394562 - RNA, 32 nt, Human
cucacgugccugcagggccaggaaagggaaau

SEQ ID NO: 394563 - RNA, 32 nt, Human
cucacguuucccaccagcucagacaugcacgc

SEQ ID NO: 394564 - RNA, 24 nt, Human
cucacguuuguaaucccagcacuu

SEQ ID NO: 394565 - RNA, 32 nt, Human
cucacguuuguaaucccagcacuuugggaggc

SEQ ID NO: 394566 - RNA, 32 nt, Human
cucacguuuugguaucacgaugccgugggcac

SEQ ID NO: 394567 - RNA, 32 nt, Human
cucacuaaauagauuaaacagagcaggcuugu

SEQ ID NO: 394568 - RNA, 32 nt, Human
cucacuaacauggugaaacccccaucuacacu

SEQ ID NO: 394569 - RNA, 32 nt, Human
cucacuaaccacccaccccuaccuggaaugga

SEQ ID NO: 394570 - RNA, 32 nt, Human
cucacuaagcucuuaaucagcaaacgcaguga

SEQ ID NO: 394571 - RNA, 32 nt, Human
cucacuaccugccaugcauacaugcugcgcau

SEQ ID NO: 394572 - RNA, 21 nt, Human
cucacuaccuuguaccuuuau

SEQ ID NO: 394573 - RNA, 32 nt, Human
cucacuacuguaauuccagcacuuugggaggc

SEQ ID NO: 394574 - RNA, 32 nt, Human
cucacuacuuuuuccuccucugugagugacca

SEQ ID NO: 394575 - RNA, 32 nt, Human
cucacuagaauauuccuuauguugacauggau

SEQ ID NO: 394576 - RNA, 32 nt, Human
cucacuagagugagcugggaaguagauacccu

SEQ ID NO: 394577 - RNA, 31 nt, Human
cucacuagccucuaacucccugugucugcau

SEQ ID NO: 394578 - RNA, 32 nt, Human
cucacuaggagaaaacacaucccucagccgug

SEQ ID NO: 394579 - RNA, 32 nt, Human
cucacuagucuugaggcccagccuaggauggu

SEQ ID NO: 394580 - RNA, 32 nt, Human
cucacuaucaugagaacagcaccaagaagcug

SEQ ID NO: 394581 - RNA, 32 nt, Human
cucacuaugucacccagguucgucucaaacuc

SEQ ID NO: 394582 - RNA, 32 nt, Human
cucacuauguugaccaggcuggucuugaacuc

SEQ ID NO: 394583 - RNA, 32 nt, Human
cucacuauguugaccaggcuggucuugaacuu

SEQ ID NO: 394584 - RNA, 32 nt, Human
cucacuauguugcccaggcuggagugcagugg

SEQ ID NO: 394585 - RNA, 32 nt, Human
cucacuauuacuguauucucuacuucuaaaua

SEQ ID NO: 394586 - RNA, 32 nt, Human
cucacuauuuugcccaggcuggucucaaacuc

SEQ ID NO: 394587 - RNA, 32 nt, Human
cucacucaaacaguaaacgagucacuguauau

SEQ ID NO: 394588 - RNA, 32 nt, Human
cucacucacucuccaccagccugggaaaugaa

SEQ ID NO: 394589 - RNA, 32 nt, Human
cucacucacugcaauugcuucuacucugggca

SEQ ID NO: 394590 - RNA, 32 nt, Human
cucacucacuggcuuugugcuucucuucccga

SEQ ID NO: 394591 - RNA, 32 nt, Human
cucacucagauggggacaccgagguccagagg

SEQ ID NO: 394592 - RNA, 32 nt, Human
cucacucagauggggacacugagguccagagg

SEQ ID NO: 394593 - RNA, 32 nt, Human
cucacucagccuguugcggaucuucauggccu

SEQ ID NO: 394594 - RNA, 32 nt, Human
cucacucaggcaucuucuuucucuaaauacca

SEQ ID NO: 394595 - RNA, 32 nt, Human
cucacucaggguggggucaggaaucugcauuu

SEQ ID NO: 394596 - RNA, 32 nt, Human
cucacucaucccuuuggcccacagguacaugu

SEQ ID NO: 394597 - RNA, 32 nt, Human
cucacucauggggucugaggggagagaagcac

SEQ ID NO: 394598 - RNA, 32 nt, Human
cucacucauucauucguucccacacacacuaa

SEQ ID NO: 394599 - RNA, 22 nt, Human
cucacuccaaaguccugcugga

SEQ ID NO: 394600 - RNA, 32 nt, Human
cucacuccaaccuccgccuccuggguucaagu

SEQ ID NO: 394601 - RNA, 32 nt, Human
cucacuccaagaggggagucagccuggggaca

SEQ ID NO: 394602 - RNA, 31 nt, Human
cucacuccaagcccaguuacagcagaaaguu

SEQ ID NO: 394603 - RNA, 19 nt, Human
cucacuccaccagcuuccu

SEQ ID NO: 394604 - RNA, 32 nt, Human
cucacuccagaagaacugagacacagcagcac

SEQ ID NO: 394605 - RNA, 32 nt, Human
cucacuccagccuccaacuccugggcucaagc

SEQ ID NO: 394606 - RNA, 32 nt, Human
cucacuccagccugggcaacauagugagaccc

SEQ ID NO: 394607 - RNA, 32 nt, Human
cucacuccagccugggugacagcguaagacuc

SEQ ID NO: 394608 - RNA, 32 nt, Human
cucacucccacacacacccccuggcucugcug

SEQ ID NO: 394609 - RNA, 32 nt, Human
cucacucccagaggaucugaucuacaugugug

SEQ ID NO: 394610 - RNA, 32 nt, Human
cucacucccagccugcggguaaccugccgccc

SEQ ID NO: 394611 - RNA, 32 nt, Human
cucacuccccaaaaugagaacagggaagagga

SEQ ID NO: 394612 - RNA, 23 nt, Human
cucacuccccagccuccucugga

SEQ ID NO: 394613 - RNA, 32 nt, Human
cucacucccccaaaaugacacccaccgucguc

SEQ ID NO: 394614 - RNA, 32 nt, Human
cucacucccccaggaagccuucccugccuucu

SEQ ID NO: 394615 - RNA, 32 nt, Human
cucacuccccuacaaaagauggagcuuaaugg

SEQ ID NO: 394616 - RNA, 32 nt, Human
cucacuccccuccccagggagccugcacagcu

SEQ ID NO: 394617 - RNA, 23 nt, Human
cucacuccccucugaccuccaga

SEQ ID NO: 394618 - RNA, 32 nt, Human
cucacuccuagaaaacaggaaaaagaaggucu

SEQ ID NO: 394619 - RNA, 32 nt, Human
cucacuccuccaggaaccaggccaagggcugg

SEQ ID NO: 394620 - RNA, 32 nt, Human
cucacuccuccagggcacuuuuaggaaagggu

SEQ ID NO: 394621 - RNA, 32 nt, Human
cucacuccuccccuccuucgcucgcucaaccu

SEQ ID NO: 394622 - RNA, 19 nt, Human
cucacuccucccucccucu

SEQ ID NO: 394623 - RNA, 32 nt, Human
cucacuccuggguuccaggucacugcaucugu

SEQ ID NO: 394624 - RNA, 32 nt, Human
cucacuccuguaauaccagcacuuugggaggc

SEQ ID NO: 394625 - RNA, 32 nt, Human
cucacuccuguaaucccaccacuuugggaggc

SEQ ID NO: 394626 - RNA, 32 nt, Human
cucacuccuguaaucccagcacuuuggaggcc

SEQ ID NO: 394627 - RNA, 32 nt, Human
cucacuccuguaaucccagcacuuugggaagc

SEQ ID NO: 394628 - RNA, 32 nt, Human
cucacuccuguaaucccagcacuuugggaggc

SEQ ID NO: 394629 - RNA, 32 nt, Human
cucacuccuguaaucccagcacuuugggaggu

SEQ ID NO: 394630 - RNA, 32 nt, Human
cucacuccuguaaucccagcauuuugggaggc

SEQ ID NO: 394631 - RNA, 32 nt, Human
cucacuccuguaaucccggcacuuuggaaugc

SEQ ID NO: 394632 - RNA, 32 nt, Human
cucacuccuguaauccgagcaauuugggaggc

SEQ ID NO: 394633 - RNA, 32 nt, Human
cucacuccuguaauccuagcaguuuggaaggc

SEQ ID NO: 394634 - RNA, 32 nt, Human
cucacuccuguaaucucagaacuuugggaggc

SEQ ID NO: 394635 - RNA, 32 nt, Human
cucacuccuguaauuccagcacuuugggaggc

SEQ ID NO: 394636 - RNA, 32 nt, Human
cucacuccuguagucccagcacuuugggaggc

SEQ ID NO: 394637 - RNA, 32 nt, Human
cucacucuauugcccaggcuggagugcacugg

SEQ ID NO: 394638 - RNA, 32 nt, Human
cucacucucacacccaggcuggagugcagucu

SEQ ID NO: 394639 - RNA, 32 nt, Human
cucacucucacccaggcuggagugcaguggca

SEQ ID NO: 394640 - RNA, 32 nt, Human
cucacucucaccccuucugccugccaggucuu

SEQ ID NO: 394641 - RNA, 32 nt, Human
cucacucucacugcauuucccaccuuccugug

SEQ ID NO: 394642 - RNA, 32 nt, Human
cucacucuccacuggcuuuccucucucccuuu

SEQ ID NO: 394643 - RNA, 32 nt, Human
cucacucuccccugaaguuuagggucccaucu

SEQ ID NO: 394644 - RNA, 32 nt, Human
cucacucucucccucaugaacacccacccacc

SEQ ID NO: 394645 - RNA, 32 nt, Human
cucacucucuccucucgcccaggcuggagugc

SEQ ID NO: 394646 - RNA, 32 nt, Human
cucacucucucgcccaggcuggagugcaacgg

SEQ ID NO: 394647 - RNA, 32 nt, Human
cucacucucucgcccaggcuggagugcagugg

SEQ ID NO: 394648 - RNA, 32 nt, Human
cucacucucuggagaagaggaaaaggaagaag

SEQ ID NO: 394649 - RNA, 32 nt, Human
cucacucugaccacuucucugccugcccagca

SEQ ID NO: 394650 - RNA, 32 nt, Human
cucacucugcaaccuccacuucccagguucaa

SEQ ID NO: 394651 - RNA, 32 nt, Human
cucacucugccgcccaggcuggacugcaguga

SEQ ID NO: 394652 - RNA, 32 nt, Human
cucacucugcuagcaccuccucccuuucccca

SEQ ID NO: 394653 - RNA, 32 nt, Human
cucacucugcugcccaggcuggaguacagugg

SEQ ID NO: 394654 - RNA, 32 nt, Human
cucacucuggcgcucuggagugcaguggugug

SEQ ID NO: 394655 - RNA, 32 nt, Human
cucacucuguaacccaggcuggagugcagugg

SEQ ID NO: 394656 - RNA, 32 nt, Human
cucacucugucacccaggcgggaguggugcaa

SEQ ID NO: 394657 - RNA, 32 nt, Human
cucacucugucacccaggcgggaguuaggugg

SEQ ID NO: 394658 - RNA, 32 nt, Human
cucacucugucacccaggcugaagugcagugg

SEQ ID NO: 394659 - RNA, 32 nt, Human
cucacucugucacccaggcugcagugcaaugg

SEQ ID NO: 394660 - RNA, 32 nt, Human
cucacucugucacccaggcugcaguguagugg

SEQ ID NO: 394661 - RNA, 32 nt, Human
cucacucugucacccaggcuggaaugcagugg

SEQ ID NO: 394662 - RNA, 32 nt, Human
cucacucugucacccaggcuggacugcaauga

SEQ ID NO: 394663 - RNA, 32 nt, Human
cucacucugucacccaggcuggagagcaauug

SEQ ID NO: 394664 - RNA, 32 nt, Human
cucacucugucacccaggcuggaguacaaugg

SEQ ID NO: 394665 - RNA, 32 nt, Human
cucacucugucacccaggcuggaguacaguga

SEQ ID NO: 394666 - RNA, 32 nt, Human
cucacucugucacccaggcuggaguacagugg

SEQ ID NO: 394667 - RNA, 32 nt, Human
cucacucugucacccaggcuggagugcaaugc

SEQ ID NO: 394668 - RNA, 32 nt, Human
cucacucugucacccaggcuggagugcaaugg

SEQ ID NO: 394669 - RNA, 32 nt, Human
cucacucugucacccaggcuggagugcaguag

SEQ ID NO: 394670 - RNA, 32 nt, Human
cucacucugucacccaggcuggagugcagugg

SEQ ID NO: 394671 - RNA, 32 nt, Human
cucacucugucacccaggcuggagugcagugu

SEQ ID NO: 394672 - RNA, 32 nt, Human
cucacucugucacccaggcuggagugcggugg

SEQ ID NO: 394673 - RNA, 32 nt, Human
cucacucugucacccaggcuggaguguagugg

SEQ ID NO: 394674 - RNA, 32 nt, Human
cucacucugucacccaggcugggaugcagugg

SEQ ID NO: 394675 - RNA, 32 nt, Human
cucacucugucagcagguccccagggaccugc

SEQ ID NO: 394676 - RNA, 32 nt, Human
cucacucugucccccaggcuggagugcagugg

SEQ ID NO: 394677 - RNA, 32 nt, Human
cucacucugucgcccaggcuagagugcagugg

SEQ ID NO: 394678 - RNA, 32 nt, Human
cucacucugucgcccaggcuagaguggauugg

SEQ ID NO: 394679 - RNA, 32 nt, Human
cucacucugucgcccaggcuggaaugcagugg

SEQ ID NO: 394680 - RNA, 32 nt, Human
cucacucugucgcccaggcuggagggcagugg

SEQ ID NO: 394681 - RNA, 32 nt, Human
cucacucugucgcccaggcuggagugcaguag

SEQ ID NO: 394682 - RNA, 31 nt, Human
cucacucugucgcccaggcuggagugcagug

SEQ ID NO: 394683 - RNA, 32 nt, Human
cucacucugucgcccaggcuggagugcagugg

SEQ ID NO: 394684 - RNA, 32 nt, Human
cucacucugucgcccaggcuggagugcagugu

SEQ ID NO: 394685 - RNA, 32 nt, Human
cucacucugucgcccaggcuggggugcagugg

SEQ ID NO: 394686 - RNA, 32 nt, Human
cucacucugucucccaggcuagagugcagugg

SEQ ID NO: 394687 - RNA, 32 nt, Human
cucacucugucucccaggcugcaacauccacc

SEQ ID NO: 394688 - RNA, 32 nt, Human
cucacucugucucccaggcuggacugcagugg

SEQ ID NO: 394689 - RNA, 32 nt, Human
cucacucugucucccaggcuggagugcagugg

SEQ ID NO: 394690 - RNA, 32 nt, Human
cucacucugucucccaggcuggagugugaugg

SEQ ID NO: 394691 - RNA, 32 nt, Human
cucacucugucucccaggcuggaguugcagug

SEQ ID NO: 394692 - RNA, 32 nt, Human
cucacucuguggcccaggcuggagugcagugg

SEQ ID NO: 394693 - RNA, 32 nt, Human
cucacucugugucccaggcuggagugcagugg

SEQ ID NO: 394694 - RNA, 32 nt, Human
cucacucuguuacccaggccggagugcagugg

SEQ ID NO: 394695 - RNA, 32 nt, Human
cucacucuguuacccaggcuagagugcagugg

SEQ ID NO: 394696 - RNA, 32 nt, Human
cucacucuguuacccaggcuagaguguagugg

SEQ ID NO: 394697 - RNA, 32 nt, Human
cucacucuguuacccaggcuggaaugcagugg

SEQ ID NO: 394698 - RNA, 32 nt, Human
cucacucuguuacccaggcuggagugcaaugg

SEQ ID NO: 394699 - RNA, 32 nt, Human
cucacucuguugcccaggcugaagugcagugg

SEQ ID NO: 394700 - RNA, 32 nt, Human
cucacucuguugcccaggcugagguacagugg

SEQ ID NO: 394701 - RNA, 32 nt, Human
cucacucuguugcccaggcugcagugcagugg

SEQ ID NO: 394702 - RNA, 32 nt, Human
cucacucuguugcccaggcuggaaugcaguga

SEQ ID NO: 394703 - RNA, 32 nt, Human
cucacucuguugcccaggcuggaaugcagugg

SEQ ID NO: 394704 - RNA, 32 nt, Human
cucacucuguugcccaggcuggaguacagugg

SEQ ID NO: 394705 - RNA, 32 nt, Human
cucacucuguugcccaggcuggagugcaaugg

SEQ ID NO: 394706 - RNA, 32 nt, Human
cucacucuguugcccaggcuggagugcaguga

SEQ ID NO: 394707 - RNA, 32 nt, Human
cucacucuguugcccaggcuggagugcagugg

SEQ ID NO: 394708 - RNA, 32 nt, Human
cucacucuguugcccaggcuggagugcagugu

SEQ ID NO: 394709 - RNA, 32 nt, Human
cucacucuguugcccaggcuggagugccucuu

SEQ ID NO: 394710 - RNA, 32 nt, Human
cucacucuguugcccaggcuggagugcgaugg

SEQ ID NO: 394711 - RNA, 32 nt, Human
cucacucuguugcccaggcuggaguguagugg

SEQ ID NO: 394712 - RNA, 32 nt, Human
cucacucuguugcccaggcuggaguucagcgg

SEQ ID NO: 394713 - RNA, 32 nt, Human
cucacucuguugcccaugcuggagggcagugg

SEQ ID NO: 394714 - RNA, 32 nt, Human
cucacucuuaagguugcugcuauauacagucu

SEQ ID NO: 394715 - RNA, 32 nt, Human
cucacucuucaaggaggcccacugugucuagg

SEQ ID NO: 394716 - RNA, 32 nt, Human
cucacucuucaaggaggcccacuugugucuua

SEQ ID NO: 394717 - RNA, 32 nt, Human
cucacucuucacucaggcugcagugcaguggc

SEQ ID NO: 394718 - RNA, 32 nt, Human
cucacucuuccgcccaggcugcagugcagugg

SEQ ID NO: 394719 - RNA, 32 nt, Human
cucacucuugcccaggcuggagugcaguggug

SEQ ID NO: 394720 - RNA, 24 nt, Human
cucacucuuguaaucccaaaacuu

SEQ ID NO: 394721 - RNA, 32 nt, Human
cucacucuuucacccaggcuggagugcagugg

SEQ ID NO: 394722 - RNA, 32 nt, Human
cucacucuuucgcccaggcuggagugcagugg

SEQ ID NO: 394723 - RNA, 32 nt, Human
cucacucuuugauuuggaauucagucuuuauc

SEQ ID NO: 394724 - RNA, 32 nt, Human
cucacucuuuuacacccagagguggagcaggu

SEQ ID NO: 394725 - RNA, 32 nt, Human
cucacugaacccugcacguugaguaacagcag

SEQ ID NO: 394726 - RNA, 32 nt, Human
cucacugaagccucaaccucccuggguuugag

SEQ ID NO: 394727 - RNA, 32 nt, Human
cucacugacauccugacaucucaggauccuac

SEQ ID NO: 394728 - RNA, 32 nt, Human
cucacugacccucagcuggacacugcccaacc

SEQ ID NO: 394729 - RNA, 32 nt, Human
cucacugaccuccugaccccugaccucaucac

SEQ ID NO: 394730 - RNA, 32 nt, Human
cucacugagacaacaaucuauacuguuuuggc

SEQ ID NO: 394731 - RNA, 32 nt, Human
cucacugagcacuggccauagccccgggaggg

SEQ ID NO: 394732 - RNA, 32 nt, Human
cucacugagccaccuccauuucuucaucugug

SEQ ID NO: 394733 - RNA, 22 nt, Human
cucacugauguuuugcacuuua

SEQ ID NO: 394734 - RNA, 32 nt, Human
cucacugauuccuggcacucugcucccucucg

SEQ ID NO: 394735 - RNA, 32 nt, Human
cucacugauucugagauggcuuuugcugcucu

SEQ ID NO: 394736 - RNA, 21 nt, Human
cucacugcaaaaucugccucc

SEQ ID NO: 394737 - RNA, 32 nt, Human
cucacugcaaaggucuacagcuucauuccuga

SEQ ID NO: 394738 - RNA, 21 nt, Human
cucacugcaacaucugccucc

SEQ ID NO: 394739 - RNA, 32 nt, Human
cucacugcaaccacugccucccaggcucaagu

SEQ ID NO: 394740 - RNA, 32 nt, Human
cucacugcaaccacugccucccagguucaagc

SEQ ID NO: 394741 - RNA, 32 nt, Human
cucacugcaaccacugcuuccuggguucaagu

SEQ ID NO: 394742 - RNA, 32 nt, Human
cucacugcaaccucagccuccugggcucaagc

SEQ ID NO: 394743 - RNA, 22 nt, Human
cucacugcaaccuccacccccu

SEQ ID NO: 394744 - RNA, 21 nt, Human
cucacugcaaccuccaccucc

SEQ ID NO: 394745 - RNA, 22 nt, Human
cucacugcaaccuccaccuccu

SEQ ID NO: 394746 - RNA, 32 nt, Human
cucacugcaaccuccaccuccugggcucaagc

SEQ ID NO: 394747 - RNA, 32 nt, Human
cucacugcaaccuccaccuccugggucaagcc

SEQ ID NO: 394748 - RNA, 32 nt, Human
cucacugcaaccuccaccuccuggguucaagc

SEQ ID NO: 394749 - RNA, 32 nt, Human
cucacugcaaccuccaccuccuggguucaagu

SEQ ID NO: 394750 - RNA, 32 nt, Human
cucacugcaaccuccaccuccuggguucaggc

SEQ ID NO: 394751 - RNA, 32 nt, Human
cucacugcaaccuccaccuccuggguugaagu

SEQ ID NO: 394752 - RNA, 32 nt, Human
cucacugcaaccuccaccuccuggguuuaagc

SEQ ID NO: 394753 - RNA, 32 nt, Human
cucacugcaaccucccccuccuggguucaagc

SEQ ID NO: 394754 - RNA, 20 nt, Human
cucacugcaaccuccgccuc

SEQ ID NO: 394755 - RNA, 21 nt, Human
cucacugcaaccuccgccucc

SEQ ID NO: 394756 - RNA, 22 nt, Human
cucacugcaaccuccgccuccu

SEQ ID NO: 394757 - RNA, 32 nt, Human
cucacugcaaccuccgccuccugggaucaagu

SEQ ID NO: 394758 - RNA, 32 nt, Human
cucacugcaaccuccgccuccugggcucaagc

SEQ ID NO: 394759 - RNA, 32 nt, Human
cucacugcaaccuccgccuccuggguuaaagu

SEQ ID NO: 394760 - RNA, 32 nt, Human
cucacugcaaccuccgccuccuggguucaaac

SEQ ID NO: 394761 - RNA, 32 nt, Human
cucacugcaaccuccgccuccuggguucaaga

SEQ ID NO: 394762 - RNA, 32 nt, Human
cucacugcaaccuccgccuccuggguucaagc

SEQ ID NO: 394763 - RNA, 32 nt, Human
cucacugcaaccuccgccuccuggguucaagg

SEQ ID NO: 394764 - RNA, 32 nt, Human
cucacugcaaccuccgccuccuggguucaagu

SEQ ID NO: 394765 - RNA, 32 nt, Human
cucacugcaaccuccgccuccuggguucacau

SEQ ID NO: 394766 - RNA, 32 nt, Human
cucacugcaaccuccgccuccuggguucagga

SEQ ID NO: 394767 - RNA, 32 nt, Human
cucacugcaaccuccgccuccuggguucaggc

SEQ ID NO: 394768 - RNA, 32 nt, Human
cucacugcaaccuccgccuccuggguuccaac

SEQ ID NO: 394769 - RNA, 32 nt, Human
cucacugcaaccuccgccuccuggguucgggc

SEQ ID NO: 394770 - RNA, 32 nt, Human
cucacugcaaccuccgccuccuggguucgggu

SEQ ID NO: 394771 - RNA, 21 nt, Human
cucacugcaaccuccgcuccc

SEQ ID NO: 394772 - RNA, 32 nt, Human
cucacugcaaccuccgucuccuggguucaagu

SEQ ID NO: 394773 - RNA, 32 nt, Human
cucacugcaaccuccugcuuccuggguucaag

SEQ ID NO: 394774 - RNA, 21 nt, Human
cucacugcaaccucuaccucc

SEQ ID NO: 394775 - RNA, 22 nt, Human
cucacugcaaccucugcccucc

SEQ ID NO: 394776 - RNA, 21 nt, Human
cucacugcaaccucugccucc

SEQ ID NO: 394777 - RNA, 22 nt, Human
cucacugcaaccucugccuccu

SEQ ID NO: 394778 - RNA, 32 nt, Human
cucacugcaaccucugccuccugggcucaacg

SEQ ID NO: 394779 - RNA, 32 nt, Human
cucacugcaaccucugccuccugggcucaaga

SEQ ID NO: 394780 - RNA, 32 nt, Human
cucacugcaaccucugccuccugggcucaagc

SEQ ID NO: 394781 - RNA, 32 nt, Human
cucacugcaaccucugccuccuggguucaaga

SEQ ID NO: 394782 - RNA, 32 nt, Human
cucacugcaaccucugccuccuggguucaagc

SEQ ID NO: 394783 - RNA, 32 nt, Human
cucacugcaaccucugccuccuggguucaagu

SEQ ID NO: 394784 - RNA, 32 nt, Human
cucacugcaaccucugccuccuggguucaggc

SEQ ID NO: 394785 - RNA, 32 nt, Human
cucacugcaaccucugccuccuggguucaggu

SEQ ID NO: 394786 - RNA, 32 nt, Human
cucacugcaaccucugccuccuggguucuccu

SEQ ID NO: 394787 - RNA, 32 nt, Human
cucacugcaaccucugccuccuggguuuaaau

SEQ ID NO: 394788 - RNA, 32 nt, Human
cucacugcaaccucugccuccuggguuuaagc

SEQ ID NO: 394789 - RNA, 21 nt, Human
cucacugcaaccucugccucu

SEQ ID NO: 394790 - RNA, 32 nt, Human
cucacugcaaccucugucuccugggcucaagc

SEQ ID NO: 394791 - RNA, 21 nt, Human
cucacugcaaccucuuccucc

SEQ ID NO: 394792 - RNA, 21 nt, Human
cucacugcaaccuucgccucc

SEQ ID NO: 394793 - RNA, 22 nt, Human
cucacugcaacuuccaccuccu

SEQ ID NO: 394794 - RNA, 20 nt, Human
cucacugcaacuuccgcccc

SEQ ID NO: 394795 - RNA, 32 nt, Human
cucacugcaacuuccgccuccugggaucaagu

SEQ ID NO: 394796 - RNA, 32 nt, Human
cucacugcaacuuccgccuccuggggucaagc

SEQ ID NO: 394797 - RNA, 32 nt, Human
cucacugcaagcuccaccuccuggguucaagc

SEQ ID NO: 394798 - RNA, 32 nt, Human
cucacugcaagcuccaccuccuggguucacgc

SEQ ID NO: 394799 - RNA, 32 nt, Human
cucacugcaagcuccaccuccuggguucaugc

SEQ ID NO: 394800 - RNA, 21 nt, Human
cucacugcaagcuccgccucc

SEQ ID NO: 394801 - RNA, 22 nt, Human
cucacugcaagcuccgccuccu

SEQ ID NO: 394802 - RNA, 32 nt, Human
cucacugcaagcuccgccuccuggguucaagc

SEQ ID NO: 394803 - RNA, 32 nt, Human
cucacugcaagcuccgccuccuggguucacac

SEQ ID NO: 394804 - RNA, 32 nt, Human
cucacugcaagcuccgccuccuggguucacgc

SEQ ID NO: 394805 - RNA, 32 nt, Human
cucacugcaagcuccgccuccuggguucacgu

SEQ ID NO: 394806 - RNA, 32 nt, Human
cucacugcaagcuccgccuccuggguucaugc

SEQ ID NO: 394807 - RNA, 32 nt, Human
cucacugcaagcuccgccuccuggguugacac

SEQ ID NO: 394808 - RNA, 32 nt, Human
cucacugcaagcucugccuccugggcucacac

SEQ ID NO: 394809 - RNA, 32 nt, Human
cucacugcaagcucugccuccuggguucaagu

SEQ ID NO: 394810 - RNA, 32 nt, Human
cucacugcaagcucugccuccuggguucacgc

SEQ ID NO: 394811 - RNA, 32 nt, Human
cucacugcaaggggccguggcuucauucuuga

SEQ ID NO: 394812 - RNA, 21 nt, Human
cucacugcaaucuccaccucc

SEQ ID NO: 394813 - RNA, 32 nt, Human
cucacugcaaucuccaccuccuggguucaagc

SEQ ID NO: 394814 - RNA, 32 nt, Human
cucacugcaaucucugccuccuggguucaagu

SEQ ID NO: 394815 - RNA, 32 nt, Human
cucacugcaaucucugccuccuggguucagau

SEQ ID NO: 394816 - RNA, 32 nt, Human
cucacugcacagaacccaccccuucugugugg

SEQ ID NO: 394817 - RNA, 32 nt, Human
cucacugcacauugcccaugugggcagcgagg

SEQ ID NO: 394818 - RNA, 32 nt, Human
cucacugcaccagugucuuugaugguggugag

SEQ ID NO: 394819 - RNA, 32 nt, Human
cucacugcacccucaaccuccuggguucaagc

SEQ ID NO: 394820 - RNA, 32 nt, Human
cucacugcacccuccgccuccugggcucaagc

SEQ ID NO: 394821 - RNA, 32 nt, Human
cucacugcacucaggcuggagugcagugguac

SEQ ID NO: 394822 - RNA, 32 nt, Human
cucacugcagagcuggaaaagcuucagacaga

SEQ ID NO: 394823 - RNA, 32 nt, Human
cucacugcagccucaaccucccaggcucaagu

SEQ ID NO: 394824 - RNA, 32 nt, Human
cucacugcagccucaaccucccagguucaagc

SEQ ID NO: 394825 - RNA, 32 nt, Human
cucacugcagccucaaccuccugagcucaagc

SEQ ID NO: 394826 - RNA, 32 nt, Human
cucacugcagccucaaccuccuggacucagag

SEQ ID NO: 394827 - RNA, 32 nt, Human
cucacugcagccucaaccuccugggcuaagug

SEQ ID NO: 394828 - RNA, 32 nt, Human
cucacugcagccucaaccuccugggcucaagc

SEQ ID NO: 394829 - RNA, 32 nt, Human
cucacugcagccucaaccuccuggggccaagu

SEQ ID NO: 394830 - RNA, 32 nt, Human
cucacugcagccucaaccuccuggguucaagu

SEQ ID NO: 394831 - RNA, 32 nt, Human
cucacugcagccuccaccuccugggcucaaag

SEQ ID NO: 394832 - RNA, 32 nt, Human
cucacugcagccuccaccuccugggcucaagc

SEQ ID NO: 394833 - RNA, 32 nt, Human
cucacugcagccuccaccuccugggcucaugu

SEQ ID NO: 394834 - RNA, 32 nt, Human
cucacugcagccuccaccuccugggcucucca

SEQ ID NO: 394835 - RNA, 32 nt, Human
cucacugcagccuccaccuccuggguucaagc

SEQ ID NO: 394836 - RNA, 32 nt, Human
cucacugcagccuccgccuccuggguucaagc

SEQ ID NO: 394837 - RNA, 32 nt, Human
cucacugcagccuccgccuccuggguucaagu

SEQ ID NO: 394838 - RNA, 32 nt, Human
cucacugcagccuccuucuccuggguccaagc

SEQ ID NO: 394839 - RNA, 32 nt, Human
cucacugcagccucgaccuccccagcucaagc

SEQ ID NO: 394840 - RNA, 32 nt, Human
cucacugcagccucgaccuccugggcucaacu

SEQ ID NO: 394841 - RNA, 32 nt, Human
cucacugcagccucgaccuccugggcucaagc

SEQ ID NO: 394842 - RNA, 32 nt, Human
cucacugcagccucugccuccuggguucaagc

SEQ ID NO: 394843 - RNA, 32 nt, Human
cucacugcagccucugccuccuggguuccaag

SEQ ID NO: 394844 - RNA, 32 nt, Human
cucacugcagccucugucucccgggcucaagc

SEQ ID NO: 394845 - RNA, 32 nt, Human
cucacugcagccuugaacugugcugaagcgau

SEQ ID NO: 394846 - RNA, 32 nt, Human
cucacugcagccuugaccuccugggcugaagc

SEQ ID NO: 394847 - RNA, 32 nt, Human
cucacugcaggcuccgccuccuggguucacgc

SEQ ID NO: 394848 - RNA, 32 nt, Human
cucacugcaggcucugccuccuggguucacgc

SEQ ID NO: 394849 - RNA, 32 nt, Human
cucacugcaggcucugccuccuggguuccagc

SEQ ID NO: 394850 - RNA, 32 nt, Human
cucacugcaguagcacgcccuccugggccguc

SEQ ID NO: 394851 - RNA, 32 nt, Human
cucacugcagucucaaucucucuggcucaagc

SEQ ID NO: 394852 - RNA, 32 nt, Human
cucacugcaguuucaaccucccagauuccagu

SEQ ID NO: 394853 - RNA, 32 nt, Human
cucacugcaguuucaaguuccugggcucaaag

SEQ ID NO: 394854 - RNA, 32 nt, Human
cucacugcauccucaaccuccuggguucagau

SEQ ID NO: 394855 - RNA, 32 nt, Human
cucacugcauccuccaccuccuggguucaagu

SEQ ID NO: 394856 - RNA, 32 nt, Human
cucacugcauccucugccuccuggguucaaac

SEQ ID NO: 394857 - RNA, 32 nt, Human
cucacugcauccucugccuccuggguucaagu

SEQ ID NO: 394858 - RNA, 32 nt, Human
cucacugcauuccagccugggcaacagagaac

SEQ ID NO: 394859 - RNA, 32 nt, Human
cucacugcauucccucaccucuaccuuuuuau

SEQ ID NO: 394860 - RNA, 32 nt, Human
cucacugcauuccggccugggcaacagagacc

SEQ ID NO: 394861 - RNA, 32 nt, Human
cucacugcauuuuccauacaaauguuucuauu

SEQ ID NO: 394862 - RNA, 32 nt, Human
cucacugccacacgcagcucagccugggcggc

SEQ ID NO: 394863 - RNA, 32 nt, Human
cucacugccaccuuugccuccuggguucaagc

SEQ ID NO: 394864 - RNA, 32 nt, Human
cucacugcccagccccgccuguccucagccag

SEQ ID NO: 394865 - RNA, 32 nt, Human
cucacugccccacugugcuccugggccuguga

SEQ ID NO: 394866 - RNA, 32 nt, Human
cucacugccccagggaccaacuuccuacccuc

SEQ ID NO: 394867 - RNA, 32 nt, Human
cucacugcccucccucccuccugggcuccagg

SEQ ID NO: 394868 - RNA, 32 nt, Human
cucacugcccuggaaucaacaggcugguugcu

SEQ ID NO: 394869 - RNA, 32 nt, Human
cucacugccgccucaaccucuccuggguucag

SEQ ID NO: 394870 - RNA, 32 nt, Human
cucacugccucuuugcaguaggggagagagca

SEQ ID NO: 394871 - RNA, 32 nt, Human
cucacugccugagaccccuuccuuagagagca

SEQ ID NO: 394872 - RNA, 32 nt, Human
cucacugccugcuuauugccucuuucucagaa

SEQ ID NO: 394873 - RNA, 20 nt, Human
cucacugcgccaggcccagg

SEQ ID NO: 394874 - RNA, 32 nt, Human
cucacugcggccuuuguaacaaaaccaguugu

SEQ ID NO: 394875 - RNA, 32 nt, Human
cucacugcuaagcuacaaacucggacaggguc

SEQ ID NO: 394876 - RNA, 32 nt, Human
cucacugcucacugacaucuuaauugccugca

SEQ ID NO: 394877 - RNA, 20 nt, Human
cucacugcucagcccaggug

SEQ ID NO: 394878 - RNA, 32 nt, Human
cucacugcugaccugggcuggucccagccugg

SEQ ID NO: 394879 - RNA, 32 nt, Human
cucacugcugcaaccucccccuccuggguuca

SEQ ID NO: 394880 - RNA, 32 nt, Human
cucacugcugccucaaccucccaggcucaagu

SEQ ID NO: 394881 - RNA, 32 nt, Human
cucacugcugccucaacuuccugggcucaagu

SEQ ID NO: 394882 - RNA, 32 nt, Human
cucacuggaaucuccagccuuccagauuuucu

SEQ ID NO: 394883 - RNA, 32 nt, Human
cucacuggagaaaccugugcacggccccacaa

SEQ ID NO: 394884 - RNA, 18 nt, Human
cucacuggagcuguucca

SEQ ID NO: 394885 - RNA, 32 nt, Human
cucacuggauccaccacggccuggguggacgg

SEQ ID NO: 394886 - RNA, 32 nt, Human
cucacuggccaguagcugccaaaaagaacacc

SEQ ID NO: 394887 - RNA, 32 nt, Human
cucacuggcccagugguguucuaccuccuacc

SEQ ID NO: 394888 - RNA, 28 nt, Human
cucacuggcccugcugccucuucaaguu

SEQ ID NO: 394889 - RNA, 32 nt, Human
cucacuggcucugagggcaggacaggguauca

SEQ ID NO: 394890 - RNA, 32 nt, Human
cucacugggaaucuucguuugucaugagccag

SEQ ID NO: 394891 - RNA, 32 nt, Human
cucacugggagcaaugggguugcagcugaagu

SEQ ID NO: 394892 - RNA, 32 nt, Human
cucacugggauccccuuccugccuccucccag

SEQ ID NO: 394893 - RNA, 31 nt, Human
cucacugggcccugugucccugugucccugu

SEQ ID NO: 394894 - RNA, 32 nt, Human
cucacugggccuuagcugccuuccugcggggc

SEQ ID NO: 394895 - RNA, 32 nt, Human
cucacugggcuccccagacucugugugugaga

SEQ ID NO: 394896 - RNA, 32 nt, Human
cucacuggggucuguguggugcccaugaccac

SEQ ID NO: 394897 - RNA, 32 nt, Human
cucacuggugacuucaucccucaggcuccagc

SEQ ID NO: 394898 - RNA, 32 nt, Human
cucacugguucacgccuguaaucccagcacuu

SEQ ID NO: 394899 - RNA, 19 nt, Human
cucacuguaaccuccgacu

SEQ ID NO: 394900 - RNA, 21 nt, Human
cucacuguaaccuccgccucc

SEQ ID NO: 394901 - RNA, 32 nt, Human
cucacuguaagagucagaacaccccacaggcc

SEQ ID NO: 394902 - RNA, 32 nt, Human
cucacuguagccuugaucuccugggcucaagc

SEQ ID NO: 394903 - RNA, 32 nt, Human
cucacuguagucucaaccuccugggcucaaga

SEQ ID NO: 394904 - RNA, 32 nt, Human
cucacuguaucacccaggccagaguguagugg

SEQ ID NO: 394905 - RNA, 32 nt, Human
cucacugucaccaggcuggagugcaguggugc

SEQ ID NO: 394906 - RNA, 32 nt, Human
cucacugucacccaggccggagugcaguggca

SEQ ID NO: 394907 - RNA, 32 nt, Human
cucacugucacccaggcugaacugcaguggug

SEQ ID NO: 394908 - RNA, 32 nt, Human
cucacugucacccaggcuggagugcaguggca

SEQ ID NO: 394909 - RNA, 32 nt, Human
cucacugucacccagucuggaguggaguggca

SEQ ID NO: 394910 - RNA, 32 nt, Human
cucacugucaccuaggcuggagugcaguggua

SEQ ID NO: 394911 - RNA, 32 nt, Human
cucacugucccucucugucugucucucagccu

SEQ ID NO: 394912 - RNA, 32 nt, Human
cucacugucgcccaggcuggagugcaguggcg

SEQ ID NO: 394913 - RNA, 32 nt, Human
cucacugucgcccaggcuggagugcgguggug

SEQ ID NO: 394914 - RNA, 32 nt, Human
cucacugucuaaaucagugucucuacuccacc

SEQ ID NO: 394915 - RNA, 32 nt, Human
cucacugucuccauccuccaccucugagaugg

SEQ ID NO: 394916 - RNA, 32 nt, Human
cucacugucucccaggcuggaauguagggugu

SEQ ID NO: 394917 - RNA, 32 nt, Human
cucacugucuccuaggcuggagugcaguggug

SEQ ID NO: 394918 - RNA, 32 nt, Human
cucacugucucuaguauuuuagcuaccacuug

SEQ ID NO: 394919 - RNA, 32 nt, Human
cucacugucuugcccaggcuggagugcagugg

SEQ ID NO: 394920 - RNA, 32 nt, Human
cucacugugaaacgucgcgaccugugacgucu

SEQ ID NO: 394921 - RNA, 32 nt, Human
cucacugugcacauuauacaagcacaacagga

SEQ ID NO: 394922 - RNA, 32 nt, Human
cucacugugcugcuuuuccaugagcucuugga

SEQ ID NO: 394923 - RNA, 32 nt, Human
cucacuguggaggucauaaggaagcuacuuuu

SEQ ID NO: 394924 - RNA, 32 nt, Human
cucacugugggaaggccagcugccccagccag

SEQ ID NO: 394925 - RNA, 32 nt, Human
cucacugugucacccaggcuggagugcagugg

SEQ ID NO: 394926 - RNA, 32 nt, Human
cucacugugucccccaggcuggagugcagugg

SEQ ID NO: 394927 - RNA, 32 nt, Human
cucacugugucgcccaggcuggagugcaagug

SEQ ID NO: 394928 - RNA, 32 nt, Human
cucacugugucgcccaggcuggagugcagugg

SEQ ID NO: 394929 - RNA, 32 nt, Human
cucacuguguugcccaggcuggagugcaaaug

SEQ ID NO: 394930 - RNA, 32 nt, Human
cucacuguguugcccaggcuggagugcaguag

SEQ ID NO: 394931 - RNA, 32 nt, Human
cucacuguguugcccaggcuggucugaaacuu

SEQ ID NO: 394932 - RNA, 32 nt, Human
cucacuguuauccaggcuggagugcagaggca

SEQ ID NO: 394933 - RNA, 32 nt, Human
cucacuguuccaggaauucuugcaguguagag

SEQ ID NO: 394934 - RNA, 32 nt, Human
cucacuguuccccaugcgcacacacauacaca

SEQ ID NO: 394935 - RNA, 32 nt, Human
cucacuguucucucuuucagccuagaccugcu

SEQ ID NO: 394936 - RNA, 32 nt, Human
cucacuguugccaggcuggagugcaguggcac

SEQ ID NO: 394937 - RNA, 32 nt, Human
cucacuguugcccaggcuggagugcaguggug

SEQ ID NO: 394938 - RNA, 32 nt, Human
cucacuguugcccaggcuggagugcauugaug

SEQ ID NO: 394939 - RNA, 32 nt, Human
cucacuguugcccaggcuggcgugcaguggug

SEQ ID NO: 394940 - RNA, 32 nt, Human
cucacuguugccucgcugucugccaggaggcc

SEQ ID NO: 394941 - RNA, 32 nt, Human
cucacuguugccuggcuggagcacuuugguuu

SEQ ID NO: 394942 - RNA, 32 nt, Human
cucacuguuguccaggcuggucucaaacuccu

SEQ ID NO: 394943 - RNA, 21 nt, Human
cucacuguuucuaagccuccu

SEQ ID NO: 394944 - RNA, 32 nt, Human
cucacuguuucuaagccuccuggaccauggcc

SEQ ID NO: 394945 - RNA, 20 nt, Human
cucacuuaacuugcaaggaa

SEQ ID NO: 394946 - RNA, 32 nt, Human
cucacuuagcguggaggaaggaacaggaagag

SEQ ID NO: 394947 - RNA, 32 nt, Human
cucacuuauacuuccuuccucccaaguaauca

SEQ ID NO: 394948 - RNA, 32 nt, Human
cucacuuaugagaugccugaagccaggccaug

SEQ ID NO: 394949 - RNA, 32 nt, Human
cucacuuauuaaagcacaaaauguuuuaccua

SEQ ID NO: 394950 - RNA, 32 nt, Human
cucacuucacugcacuccagucugggugacag

SEQ ID NO: 394951 - RNA, 17 nt, Human
cucacuucacuguucca

SEQ ID NO: 394952 - RNA, 28 nt, Human
cucacuuccaaugcugccuugaucucug

SEQ ID NO: 394953 - RNA, 32 nt, Human
cucacuuccugccucugcugccaccaucacug

SEQ ID NO: 394954 - RNA, 32 nt, Human
cucacuuccuuggcaucuccccacugcuccuc

SEQ ID NO: 394955 - RNA, 32 nt, Human
cucacuucgcaggucacaugccuauacaucac

SEQ ID NO: 394956 - RNA, 32 nt, Human
cucacuucucagacggggcgguugccaggcag

SEQ ID NO: 394957 - RNA, 32 nt, Human
cucacuucucagacggggugguugccaggcag

SEQ ID NO: 394958 - RNA, 32 nt, Human
cucacuucucagauggggcgguugccaggcag

SEQ ID NO: 394959 - RNA, 32 nt, Human
cucacuucucuuucccuucaaaaugcuuuuca

SEQ ID NO: 394960 - RNA, 32 nt, Human
cucacuugaauccagcucagugcucugggugg

SEQ ID NO: 394961 - RNA, 32 nt, Human
cucacuugagccacugaaaccagccaggucuu

SEQ ID NO: 394962 - RNA, 31 nt, Human
cucacuugagcccaggagguugaggcugcag

SEQ ID NO: 394963 - RNA, 32 nt, Human
cucacuugagcccaggagguugaggcugcagu

SEQ ID NO: 394964 - RNA, 32 nt, Human
cucacuugaucacccaggcuagagugcagugg

SEQ ID NO: 394965 - RNA, 32 nt, Human
cucacuugcacaccacgggauacuccuccuga

SEQ ID NO: 394966 - RNA, 32 nt, Human
cucacuugccauuccagggccaaaggaccgga

SEQ ID NO: 394967 - RNA, 32 nt, Human
cucacuuggcaaagcagcucggcgucucagcc

SEQ ID NO: 394968 - RNA, 32 nt, Human
cucacuuggccuuucccugcaggaugagugaa

SEQ ID NO: 394969 - RNA, 32 nt, Human
cucacuuggcuccccucuccuccuuagccaga

SEQ ID NO: 394970 - RNA, 32 nt, Human
cucacuuguaauugugccucagacuuuuugaa

SEQ ID NO: 394971 - RNA, 32 nt, Human
cucacuuguaccccacccuguuccuguguccc

SEQ ID NO: 394972 - RNA, 32 nt, Human
cucacuuguggccuauuucucugcuucuucca

SEQ ID NO: 394973 - RNA, 32 nt, Human
cucacuuguguugcugucagugccaguagggc

SEQ ID NO: 394974 - RNA, 32 nt, Human
cucacuuguuuuguguucugucauccuuguuu

SEQ ID NO: 394975 - RNA, 32 nt, Human
cucacuuuauucaagucccugcucagguguca

SEQ ID NO: 394976 - RNA, 32 nt, Human
cucacuuucauguaagguuauccacuuuugcu

SEQ ID NO: 394977 - RNA, 32 nt, Human
cucacuuuccaccacugucagccuggaaagag

SEQ ID NO: 394978 - RNA, 32 nt, Human
cucacuuuccacccucucuccaccugccucug

SEQ ID NO: 394979 - RNA, 32 nt, Human
cucacuuucccccuacaggacucagaucuggg

SEQ ID NO: 394980 - RNA, 22 nt, Human
cucacuuucccugcaccuuuau

SEQ ID NO: 394981 - RNA, 32 nt, Human
cucacuuugaaccuucuuguuuacagauuuuu

SEQ ID NO: 394982 - RNA, 32 nt, Human
cucacuuugacacccaggcuggagugcagugg

SEQ ID NO: 394983 - RNA, 24 nt, Human
cucacuuugccucucgccucugga

SEQ ID NO: 394984 - RNA, 32 nt, Human
cucacuuugcugccccaccaucuugcugacaa

SEQ ID NO: 394985 - RNA, 32 nt, Human
cucacuuugcuucccaggcuggagugcagugg

SEQ ID NO: 394986 - RNA, 32 nt, Human
cucacuuuggggacuguucccaucacccaccu

SEQ ID NO: 394987 - RNA, 32 nt, Human
cucacuuuggggcugggcugguucuccacccu

SEQ ID NO: 394988 - RNA, 32 nt, Human
cucacuuuguaacccaggcuggaaugcaaugg

SEQ ID NO: 394989 - RNA, 32 nt, Human
cucacuuugucacccaggcuagagugcagugg

SEQ ID NO: 394990 - RNA, 32 nt, Human
cucacuuugucacccaggcuggaaugcagugg

SEQ ID NO: 394991 - RNA, 32 nt, Human
cucacuuugucacccaggcuggagugcagugg

SEQ ID NO: 394992 - RNA, 32 nt, Human
cucacuuugucgcccaggcuggaguacagugg

SEQ ID NO: 394993 - RNA, 32 nt, Human
cucacuuugucgcccaggcuggagugcagugg

SEQ ID NO: 394994 - RNA, 32 nt, Human
cucacuuuguuacccaggcuggagugcagugg

SEQ ID NO: 394995 - RNA, 32 nt, Human
cucacuuuguugcccaggcuggagcgcagugg

SEQ ID NO: 394996 - RNA, 32 nt, Human
cucacuuuguugcccaggcuggagugcagugg

SEQ ID NO: 394997 - RNA, 32 nt, Human
cucacuuuguugcccaggcuggagugcggugg

SEQ ID NO: 394998 - RNA, 32 nt, Human
cucacuuuuccuggggccccucuccccaaccc

SEQ ID NO: 394999 - RNA, 18 nt, Human
cucacuuuucuucuggca

SEQ ID NO: 395000 - RNA, 32 nt, Human
cucacuuuugggaggcagaaggguaggcucag

SEQ ID NO: 395001 - RNA, 21 nt, Human
cucagaaaacauuuugugucu

SEQ ID NO: 395002 - RNA, 32 nt, Human
cucagaaacagcugucgccucagucugcgcac

SEQ ID NO: 395003 - RNA, 32 nt, Human
cucagaaaccccugcccuuucccuucagaaaa

SEQ ID NO: 395004 - RNA, 32 nt, Human
cucagaaacuauacucuucuguguaacagacc

SEQ ID NO: 395005 - RNA, 32 nt, Human
cucagaaagaggaaauaaugccuccaccauuu

SEQ ID NO: 395006 - RNA, 32 nt, Human
cucagaaagcucugcgcuuuccagaaagcgcu

SEQ ID NO: 395007 - RNA, 32 nt, Human
cucagaaaugugugaaagaaccucacacaaca

SEQ ID NO: 395008 - RNA, 32 nt, Human
cucagaacaccccagccuugagcuuagcugca

SEQ ID NO: 395009 - RNA, 32 nt, Human
cucagaaccagcuccacccaaaucacucuucg

SEQ ID NO: 395010 - RNA, 32 nt, Human
cucagaacccagcaaauaugucaaaguaccag

SEQ ID NO: 395011 - RNA, 32 nt, Human
cucagaacggacgagauaaugugaacuagcug

SEQ ID NO: 395012 - RNA, 32 nt, Human
cucagaacucacaagccauugcuccccagcug

SEQ ID NO: 395013 - RNA, 32 nt, Human
cucagaacuuggccuacguuucccaggacucu

SEQ ID NO: 395014 - RNA, 32 nt, Human
cucagaacuuugugugguugagcccaggccuc

SEQ ID NO: 395015 - RNA, 32 nt, Human
cucagaagaacaaagugaggaggcagaaggag

SEQ ID NO: 395016 - RNA, 32 nt, Human
cucagaagacacccagcugggcccuucauggg

SEQ ID NO: 395017 - RNA, 22 nt, Human
cucagaagacucuuguguuuug

SEQ ID NO: 395018 - RNA, 24 nt, Human
cucagaaggcagagguugcagugg

SEQ ID NO: 395019 - RNA, 24 nt, Human
cucagaaggcggaggcugcaguga

SEQ ID NO: 395020 - RNA, 32 nt, Human
cucagaaggcggaggcugcagugagccgagau

SEQ ID NO: 395021 - RNA, 32 nt, Human
cucagaaggcggagguuccagugagccaucgc

SEQ ID NO: 395022 - RNA, 32 nt, Human
cucagaaggcugagaggguuugcaguggagcc

SEQ ID NO: 395023 - RNA, 32 nt, Human
cucagaaggcuuucucuguguaaagaaguaua

SEQ ID NO: 395024 - RNA, 32 nt, Human
cucagaagguggagguugcagugaggcgagau

SEQ ID NO: 395025 - RNA, 32 nt, Human
cucagaaguucagaaacuaagaccagaaaaga

SEQ ID NO: 395026 - RNA, 32 nt, Human
cucagaaguucagcuguugaaacgaaaacugu

SEQ ID NO: 395027 - RNA, 32 nt, Human
cucagaaguuccacugcacuccagccuggguu

SEQ ID NO: 395028 - RNA, 32 nt, Human
cucagaaguugcagagcagccugggcaacaug

SEQ ID NO: 395029 - RNA, 32 nt, Human
cucagaaguuucugagacuugguggucgucuu

SEQ ID NO: 395030 - RNA, 32 nt, Human
cucagaaucacuuuucccaucuguaaaauuga

SEQ ID NO: 395031 - RNA, 32 nt, Human
cucagaauccaccccgugccugcaggggaaag

SEQ ID NO: 395032 - RNA, 32 nt, Human
cucagaauccugcucuuccuccagagagauuc

SEQ ID NO: 395033 - RNA, 32 nt, Human
cucagaaucuaaggaugaauguucaccguggc

SEQ ID NO: 395034 - RNA, 32 nt, Human
cucagaaucugaaguaguucccuccucagcaa

SEQ ID NO: 395035 - RNA, 32 nt, Human
cucagaaucuuuccuuccucucauccuuuucu

SEQ ID NO: 395036 - RNA, 32 nt, Human
cucagaauguuggccgggcaugguggcucaca

SEQ ID NO: 395037 - RNA, 32 nt, Human
cucagaauguuuuuggcuuuucugcuaaagau

SEQ ID NO: 395038 - RNA, 32 nt, Human
cucagaauucuuccagccuccaccuacugccc

SEQ ID NO: 395039 - RNA, 32 nt, Human
cucagacacaccauuucaccucccuugccaag

SEQ ID NO: 395040 - RNA, 32 nt, Human
cucagacacaggugagaagaugcagcaccuuc

SEQ ID NO: 395041 - RNA, 32 nt, Human
cucagacaccagcaacagccucuugggaugcc

SEQ ID NO: 395042 - RNA, 32 nt, Human
cucagacagaaaucagaugcuuccauguauuc

SEQ ID NO: 395043 - RNA, 32 nt, Human
cucagacagccauuugcuuuggguuuugcuuc

SEQ ID NO: 395044 - RNA, 32 nt, Human
cucagacagggcugagugccuccacccugauu

SEQ ID NO: 395045 - RNA, 32 nt, Human
cucagacagucaugcaccacccucaaucccag

SEQ ID NO: 395046 - RNA, 32 nt, Human
cucagacagugccaccauggccaugcagcagg

SEQ ID NO: 395047 - RNA, 32 nt, Human
cucagacauccugugugguccaccucacuucu

SEQ ID NO: 395048 - RNA, 32 nt, Human
cucagacaucuuuucccucccucucucuuuca

SEQ ID NO: 395049 - RNA, 32 nt, Human
cucagacaugucuguccucacagcagaaugua

SEQ ID NO: 395050 - RNA, 32 nt, Human
cucagaccaccagccaagagccuucccuugaa

SEQ ID NO: 395051 - RNA, 18 nt, Human
cucagaccacuugcuucc

SEQ ID NO: 395052 - RNA, 17 nt, Human
cucagaccagagugcca

SEQ ID NO: 395053 - RNA, 18 nt, Human
cucagaccagcucacuga

SEQ ID NO: 395054 - RNA, 17 nt, Human
cucagacccacugacca

SEQ ID NO: 395055 - RNA, 18 nt, Human
cucagacccagcggucca

SEQ ID NO: 395056 - RNA, 32 nt, Human
cucagacccaggaguccagccccuccucccuc

SEQ ID NO: 395057 - RNA, 32 nt, Human
cucagacccaggaguccaggcccccagccccu

SEQ ID NO: 395058 - RNA, 19 nt, Human
cucagacccagugaaccca

SEQ ID NO: 395059 - RNA, 18 nt, Human
cucagaccccacugucca

SEQ ID NO: 395060 - RNA, 17 nt, Human
cucagacccgcucuucc

SEQ ID NO: 395061 - RNA, 17 nt, Human
cucagacccggaaucca

SEQ ID NO: 395062 - RNA, 18 nt, Human
cucagacccgggagucca

SEQ ID NO: 395063 - RNA, 18 nt, Human
cucagacccgggcuccca

SEQ ID NO: 395064 - RNA, 32 nt, Human
cucagacccgggcucucgguccgccgcuucag

SEQ ID NO: 395065 - RNA, 19 nt, Human
cucagacccucgccuucca

SEQ ID NO: 395066 - RNA, 18 nt, Human
cucagacccucucuucca

SEQ ID NO: 395067 - RNA, 32 nt, Human
cucagacccugccugaugcuauaugcagaggc

SEQ ID NO: 395068 - RNA, 19 nt, Human
cucagacccugggcuuccg

SEQ ID NO: 395069 - RNA, 20 nt, Human
cucagacccuuccugguucc

SEQ ID NO: 395070 - RNA, 25 nt, Human
cucagaccgacccccacuccauccc

SEQ ID NO: 395071 - RNA, 20 nt, Human
cucagaccgagcgugugcca

SEQ ID NO: 395072 - RNA, 18 nt, Human
cucagaccuacugaauca

SEQ ID NO: 395073 - RNA, 32 nt, Human
cucagaccuaggacgggagcucacaucccauc

SEQ ID NO: 395074 - RNA, 17 nt, Human
cucagaccuagugcucc

SEQ ID NO: 395075 - RNA, 32 nt, Human
cucagaccuauaaucccagcacuuugggaguc

SEQ ID NO: 395076 - RNA, 18 nt, Human
cucagaccuauccuuucc

SEQ ID NO: 395077 - RNA, 32 nt, Human
cucagaccucaccuuccucccacccaccccug

SEQ ID NO: 395078 - RNA, 32 nt, Human
cucagaccuccucaucucaugagcuucuuggg

SEQ ID NO: 395079 - RNA, 20 nt, Human
cucagaccugaaugcacucc

SEQ ID NO: 395080 - RNA, 17 nt, Human
cucagaccugacaccca

SEQ ID NO: 395081 - RNA, 17 nt, Human
cucagaccugaccaucc

SEQ ID NO: 395082 - RNA, 18 nt, Human
cucagaccugauccuucc

SEQ ID NO: 395083 - RNA, 16 nt, Human
cucagaccugauuucc

SEQ ID NO: 395084 - RNA, 16 nt, Human
cucagaccugcaccca

SEQ ID NO: 395085 - RNA, 19 nt, Human
cucagaccugcagacuccc

SEQ ID NO: 395086 - RNA, 19 nt, Human
cucagaccugcgcacucca

SEQ ID NO: 395087 - RNA, 32 nt, Human
cucagaccugcgcacuccaucucccucccuuu

SEQ ID NO: 395088 - RNA, 18 nt, Human
cucagaccugcuacacca

SEQ ID NO: 395089 - RNA, 19 nt, Human
cucagaccuggaagacucc

SEQ ID NO: 395090 - RNA, 18 nt, Human
cucagaccuggaccccca

SEQ ID NO: 395091 - RNA, 32 nt, Human
cucagaccuggacccccaccagccucacuccc

SEQ ID NO: 395092 - RNA, 19 nt, Human
cucagaccuggcuuuuucc

SEQ ID NO: 395093 - RNA, 32 nt, Human
cucagaccuggcuuuuuccucagucccuguuc

SEQ ID NO: 395094 - RNA, 18 nt, Human
cucagaccuggugcucua

SEQ ID NO: 395095 - RNA, 32 nt, Human
cucagaccuguaaucccagaacuuugggagcc

SEQ ID NO: 395096 - RNA, 16 nt, Human
cucagaccugugaucc

SEQ ID NO: 395097 - RNA, 32 nt, Human
cucagaccuucauagccucucuugucauucuu

SEQ ID NO: 395098 - RNA, 32 nt, Human
cucagaccuucccaucucccuggcuuuccaug

SEQ ID NO: 395099 - RNA, 17 nt, Human
cucagaccuugcaucca

SEQ ID NO: 395100 - RNA, 18 nt, Human
cucagaccuuggagccca

SEQ ID NO: 395101 - RNA, 21 nt, Human
cucagaccuuggauucauucc

SEQ ID NO: 395102 - RNA, 32 nt, Human
cucagaccuuucucgcuucugagcuugguggc

SEQ ID NO: 395103 - RNA, 32 nt, Human
cucagacgacucuggaagcuucccucuaccac

SEQ ID NO: 395104 - RNA, 32 nt, Human
cucagacgccggccucggccugggcgaugaga

SEQ ID NO: 395105 - RNA, 32 nt, Human
cucagacuagaccccaaccccaauaggggagg

SEQ ID NO: 395106 - RNA, 32 nt, Human
cucagacucaacugcuaugugugacugccgcu

SEQ ID NO: 395107 - RNA, 32 nt, Human
cucagacuccaauggcaguguccuguuugagc

SEQ ID NO: 395108 - RNA, 32 nt, Human
cucagacucccaaagugcugggauuauaggga

SEQ ID NO: 395109 - RNA, 32 nt, Human
cucagacuccuaaguagcugggauuacaggca

SEQ ID NO: 395110 - RNA, 32 nt, Human
cucagacuccuggguuuuuguuguugcuguug

SEQ ID NO: 395111 - RNA, 18 nt, Human
cucagacucuauguucca

SEQ ID NO: 395112 - RNA, 18 nt, Human
cucagacucugacuucca

SEQ ID NO: 395113 - RNA, 32 nt, Human
cucagacucugaggaccccuuucuggaugagu

SEQ ID NO: 395114 - RNA, 32 nt, Human
cucagacucuuagagccagcuguggcuucgga

SEQ ID NO: 395115 - RNA, 32 nt, Human
cucagacucuucccccacccccucucuuuucc

SEQ ID NO: 395116 - RNA, 32 nt, Human
cucagacugagugguggccuggggaaguuggg

SEQ ID NO: 395117 - RNA, 32 nt, Human
cucagacugcaagcugucuggcugcuccgggu

SEQ ID NO: 395118 - RNA, 32 nt, Human
cucagacuggcauccaggcuuugcuccaccaa

SEQ ID NO: 395119 - RNA, 32 nt, Human
cucagacuggcccgggagguucucccagacau

SEQ ID NO: 395120 - RNA, 32 nt, Human
cucagacuggggcucccugaggacggggcugu

SEQ ID NO: 395121 - RNA, 32 nt, Human
cucagacuguaagaggccgggaggggaaggac

SEQ ID NO: 395122 - RNA, 32 nt, Human
cucagacuguagagcucggucucuccaaguuu

SEQ ID NO: 395123 - RNA, 32 nt, Human
cucagacugucagauaaaucggcgggccgggc

SEQ ID NO: 395124 - RNA, 19 nt, Human
cucagacuugaccugucca

SEQ ID NO: 395125 - RNA, 32 nt, Human
cucagacuugcaguugauagaggcuguggugu

SEQ ID NO: 395126 - RNA, 18 nt, Human
cucagacuuguuauuuca

SEQ ID NO: 395127 - RNA, 32 nt, Human
cucagagaaaucagguaacuucccaaaugacc

SEQ ID NO: 395128 - RNA, 31 nt, Human
cucagagaacaaugagcacuugaagauuuuu

SEQ ID NO: 395129 - RNA, 32 nt, Human
cucagagaagccccagaguagaaagaagacaa

SEQ ID NO: 395130 - RNA, 32 nt, Human
cucagagaagugagcagagacuccacagacac

SEQ ID NO: 395131 - RNA, 32 nt, Human
cucagagacagagcagaagacagaaccugguc

SEQ ID NO: 395132 - RNA, 32 nt, Human
cucagagaccacucauccucuggaaucaaccu

SEQ ID NO: 395133 - RNA, 32 nt, Human
cucagagaccucccuuuccaagccugccuggg

SEQ ID NO: 395134 - RNA, 32 nt, Human
cucagagagagggagggagaagagagauagug

SEQ ID NO: 395135 - RNA, 32 nt, Human
cucagagagauguggugacuugcucaaauagu

SEQ ID NO: 395136 - RNA, 32 nt, Human
cucagagagcaaccuccucccucguagaggga

SEQ ID NO: 395137 - RNA, 32 nt, Human
cucagagagcaagcgguaccagagguaccagc

SEQ ID NO: 395138 - RNA, 32 nt, Human
cucagagagcacagguuuccagccuggaaccu

SEQ ID NO: 395139 - RNA, 32 nt, Human
cucagagagcaguuaugaaggaaaaccagguc

SEQ ID NO: 395140 - RNA, 23 nt, Human
cucagagagccucuuuaacuuaa

SEQ ID NO: 395141 - RNA, 32 nt, Human
cucagagaguccacagucccuccucucaguuc

SEQ ID NO: 395142 - RNA, 32 nt, Human
cucagagaguugucuguccaggcccuuaggga

SEQ ID NO: 395143 - RNA, 32 nt, Human
cucagagauguuccuccccucaucugcccggg

SEQ ID NO: 395144 - RNA, 32 nt, Human
cucagagauucacacagaagucuggacacaau

SEQ ID NO: 395145 - RNA, 32 nt, Human
cucagagcaaaguggcuguguguuccgagccg

SEQ ID NO: 395146 - RNA, 32 nt, Human
cucagagcacagaaaccuucagcuuugcuguc

SEQ ID NO: 395147 - RNA, 32 nt, Human
cucagagcaccaauaucuccuccaucacuucc

SEQ ID NO: 395148 - RNA, 16 nt, Human
cucagagcagagccag

SEQ ID NO: 395149 - RNA, 32 nt, Human
cucagagcagaggagguggggagcagguggcu

SEQ ID NO: 395150 - RNA, 32 nt, Human
cucagagcccuaagcccugccucccgguccug

SEQ ID NO: 395151 - RNA, 32 nt, Human
cucagagcccucagcccuuccugcuuucaggc

SEQ ID NO: 395152 - RNA, 32 nt, Human
cucagagcccugcucuuugccuggaugguuca

SEQ ID NO: 395153 - RNA, 22 nt, Human
cucagagccgcccaaacugccg

SEQ ID NO: 395154 - RNA, 32 nt, Human
cucagagccguuucagacaguggaaauccaug

SEQ ID NO: 395155 - RNA, 32 nt, Human
cucagagccuccgccucggccucucucucgcg

SEQ ID NO: 395156 - RNA, 32 nt, Human
cucagagcggagcccacagagcagggcaccgg

SEQ ID NO: 395157 - RNA, 32 nt, Human
cucagagcuaugccuccagacgcaucauuccu

SEQ ID NO: 395158 - RNA, 32 nt, Human
cucagagcucacugcauccuugaccucccaga

SEQ ID NO: 395159 - RNA, 32 nt, Human
cucagagcuggggcagcugccucccaggggug

SEQ ID NO: 395160 - RNA, 32 nt, Human
cucagaggaagaggaaagaaagaagaggaggg

SEQ ID NO: 395161 - RNA, 23 nt, Human
cucagaggaagcccgugcaguca

SEQ ID NO: 395162 - RNA, 32 nt, Human
cucagaggaaguguggacucacaggugggcaa

SEQ ID NO: 395163 - RNA, 32 nt, Human
cucagaggagcccucugaggaugcgccccugg

SEQ ID NO: 395164 - RNA, 32 nt, Human
cucagaggagcucuacccugcucccugcuuug

SEQ ID NO: 395165 - RNA, 32 nt, Human
cucagaggaggugagaggagaggaaggagaaa

SEQ ID NO: 395166 - RNA, 20 nt, Human
cucagaggauuacuguuuca

SEQ ID NO: 395167 - RNA, 32 nt, Human
cucagaggcagagacugaguuaagucauaggu

SEQ ID NO: 395168 - RNA, 23 nt, Human
cucagaggcagagguugcaauga

SEQ ID NO: 395169 - RNA, 32 nt, Human
cucagaggcccagggcggcgggcucagccauu

SEQ ID NO: 395170 - RNA, 32 nt, Human
cucagaggcccccugaguguuccccuuggccu

SEQ ID NO: 395171 - RNA, 32 nt, Human
cucagaggcgaccauaaugucguuacguguac

SEQ ID NO: 395172 - RNA, 32 nt, Human
cucagaggcggcccuuugccucugccugccgg

SEQ ID NO: 395173 - RNA, 32 nt, Human
cucagaggcgugcugguccccuccucagugac

SEQ ID NO: 395174 - RNA, 32 nt, Human
cucagaggcuaaggcgggagaaucacuugaac

SEQ ID NO: 395175 - RNA, 32 nt, Human
cucagaggcugaggcaggaggaucgcuugaac

SEQ ID NO: 395176 - RNA, 32 nt, Human
cucagaggcugcagggagggcccaggagccgg

SEQ ID NO: 395177 - RNA, 32 nt, Human
cucagagggaaaaggaaaagagccucaaacau

SEQ ID NO: 395178 - RNA, 32 nt, Human
cucagagggaacauugcagagacucaggagau

SEQ ID NO: 395179 - RNA, 32 nt, Human
cucagagggaaggcucucuggucuaccugaga

SEQ ID NO: 395180 - RNA, 32 nt, Human
cucagagggcccagagaauggcugagcaggac

SEQ ID NO: 395181 - RNA, 32 nt, Human
cucagagggcucuucugccaucccuugucucc

SEQ ID NO: 395182 - RNA, 32 nt, Human
cucagagggcucuuggucgcucagggaggugg

SEQ ID NO: 395183 - RNA, 32 nt, Human
cucagagggucugagguccgagcacccugcug

SEQ ID NO: 395184 - RNA, 32 nt, Human
cucagagggucuggggcaccagguggagacca

SEQ ID NO: 395185 - RNA, 32 nt, Human
cucagagggucuguccagcccugggaagcgac

SEQ ID NO: 395186 - RNA, 32 nt, Human
cucagagguggaagagcaaggcuggaaguucu

SEQ ID NO: 395187 - RNA, 32 nt, Human
cucagagguggaggugaggggaaagugaagug

SEQ ID NO: 395188 - RNA, 32 nt, Human
cucagagguggccuccuccuccaggcauggag

SEQ ID NO: 395189 - RNA, 32 nt, Human
cucagagguuuaggcuggaggcuuggugagaa

SEQ ID NO: 395190 - RNA, 32 nt, Human
cucagagucaguuuucagaagcagguuucagu

SEQ ID NO: 395191 - RNA, 32 nt, Human
cucagaguccaaguaggacacgcagguggacg

SEQ ID NO: 395192 - RNA, 32 nt, Human
cucagaguguggcuguaccacauucgguguau

SEQ ID NO: 395193 - RNA, 32 nt, Human
cucagaguucaggaaguauugguaaauggagg

SEQ ID NO: 395194 - RNA, 32 nt, Human
cucagaguugcuguuucuccuugagaugcuuu

SEQ ID NO: 395195 - RNA, 32 nt, Human
cucagaguuguggcuguuaucucuucaggaau

SEQ ID NO: 395196 - RNA, 32 nt, Human
cucagaguuuaauguaaaugaaucuagaugau

SEQ ID NO: 395197 - RNA, 32 nt, Human
cucagaguuuggcuccugcacucucauuucag

SEQ ID NO: 395198 - RNA, 32 nt, Human
cucagaguuuucuaacaggagaaaaguccugu

SEQ ID NO: 395199 - RNA, 32 nt, Human
cucagauaaacacauagaggccagcuuaaaau

SEQ ID NO: 395200 - RNA, 32 nt, Human
cucagauaacucaguacagauagcaauuaguc

SEQ ID NO: 395201 - RNA, 32 nt, Human
cucagauauacuccugggagagagcaugaaug

SEQ ID NO: 395202 - RNA, 32 nt, Human
cucagauauacuugguucucuccaccagguuc

SEQ ID NO: 395203 - RNA, 32 nt, Human
cucagauauagagguuaugucauuuuauaaag

SEQ ID NO: 395204 - RNA, 20 nt, Human
cucagaucaaagcagcucug

SEQ ID NO: 395205 - RNA, 18 nt, Human
cucagaucaacuacucua

SEQ ID NO: 395206 - RNA, 24 nt, Human
cucagaucacugcaaccuccaccu

SEQ ID NO: 395207 - RNA, 32 nt, Human
cucagaucacugcaaccuccaccucccagguu

SEQ ID NO: 395208 - RNA, 32 nt, Human
cucagaucacugcaaccuccgccuccuggguu

SEQ ID NO: 395209 - RNA, 32 nt, Human
cucagaucacugcaaccucugccucccggguu

SEQ ID NO: 395210 - RNA, 32 nt, Human
cucagaucacugcaaccucugccuccuggguu

SEQ ID NO: 395211 - RNA, 32 nt, Human
cucagaucauuucuagcaccaacucaaccuuu

SEQ ID NO: 395212 - RNA, 32 nt, Human
cucagaucccagagggaugcaggagcccuaua

SEQ ID NO: 395213 - RNA, 32 nt, Human
cucagaucccaggcucauuccucaaaucacuu

SEQ ID NO: 395214 - RNA, 32 nt, Human
cucagaucccugcucuuccugccuuuccugcc

SEQ ID NO: 395215 - RNA, 32 nt, Human
cucagauccuaccuguucagacacagccaucc

SEQ ID NO: 395216 - RNA, 17 nt, Human
cucagaucucuauuuca

SEQ ID NO: 395217 - RNA, 22 nt, Human
cucagaucucuucaugccgcug

SEQ ID NO: 395218 - RNA, 32 nt, Human
cucagaucucuuguacccaccaccccaucaag

SEQ ID NO: 395219 - RNA, 32 nt, Human
cucagaucugaucaagagucuggauuucuaac

SEQ ID NO: 395220 - RNA, 32 nt, Human
cucagaucugcacuccugucucuugggaagca

SEQ ID NO: 395221 - RNA, 17 nt, Human
cucagaucugccuccca

SEQ ID NO: 395222 - RNA, 20 nt, Human
cucagaucuuaacaauucca

SEQ ID NO: 395223 - RNA, 18 nt, Human
cucagaucuucugucuca

SEQ ID NO: 395224 - RNA, 19 nt, Human
cucagaugagucuguugca

SEQ ID NO: 395225 - RNA, 19 nt, Human
cucagaugccacuguguga

SEQ ID NO: 395226 - RNA, 21 nt, Human
cucagaugcugcauauugcug

SEQ ID NO: 395227 - RNA, 31 nt, Human
cucagauggacaagauuaccccaccuugccc

SEQ ID NO: 395228 - RNA, 32 nt, Human
cucagauggagugcugucuggaagugggagua

SEQ ID NO: 395229 - RNA, 32 nt, Human
cucagauggcuacauuuucaugauauuguuca

SEQ ID NO: 395230 - RNA, 32 nt, Human
cucagaugggagagagccagagagaggaguga

SEQ ID NO: 395231 - RNA, 32 nt, Human
cucagauggggaccccaaagaagcagaagcug

SEQ ID NO: 395232 - RNA, 32 nt, Human
cucagaugggugggacacaugccuuccucccc

SEQ ID NO: 395233 - RNA, 32 nt, Human
cucagauggucaccaucauuccugugcucaga

SEQ ID NO: 395234 - RNA, 32 nt, Human
cucagauguggcuagaccaaccagugggaaac

SEQ ID NO: 395235 - RNA, 32 nt, Human
cucagauuaaagacaggaguguggugagcucu

SEQ ID NO: 395236 - RNA, 32 nt, Human
cucagauuauuccuuucuggagcuuugagauc

SEQ ID NO: 395237 - RNA, 32 nt, Human
cucagauuauucuucucauugacaaugccagg

SEQ ID NO: 395238 - RNA, 32 nt, Human
cucagauucuccccugggcuucucccacgcag

SEQ ID NO: 395239 - RNA, 32 nt, Human
cucagauugauaccugccauggcuguaccuug

SEQ ID NO: 395240 - RNA, 32 nt, Human
cucagauugcgucacugcacuccaaccugggu

SEQ ID NO: 395241 - RNA, 32 nt, Human
cucagauugugcaguccauccccagucaaugg

SEQ ID NO: 395242 - RNA, 32 nt, Human
cucagauuucagugaaaaguucagaggaggcc

SEQ ID NO: 395243 - RNA, 17 nt, Human
cucagauuucugucuca

SEQ ID NO: 395244 - RNA, 32 nt, Human
cucagauuuucucacagacccuucccaauucc

SEQ ID NO: 395245 - RNA, 32 nt, Human
cucagcaaacucccuuucaaagcugugugacc

SEQ ID NO: 395246 - RNA, 32 nt, Human
cucagcaacacagugaaaccccgucucuacua

SEQ ID NO: 395247 - RNA, 19 nt, Human
cucagcaagcccagaagca

SEQ ID NO: 395248 - RNA, 32 nt, Human
cucagcaaguaggauacuucucauguuuuuga

SEQ ID NO: 395249 - RNA, 32 nt, Human
cucagcaauggcucuccuccagcuuuggcuuu

SEQ ID NO: 395250 - RNA, 20 nt, Human
cucagcaauucaaauucuag

SEQ ID NO: 395251 - RNA, 32 nt, Human
cucagcacaacaggcuggcgccaauggcauua

SEQ ID NO: 395252 - RNA, 32 nt, Human
cucagcacaauugagcagcuugcccagcuagg

SEQ ID NO: 395253 - RNA, 32 nt, Human
cucagcacacgcugugugaagggaucugagcu

SEQ ID NO: 395254 - RNA, 17 nt, Human
cucagcacacuguucca

SEQ ID NO: 395255 - RNA, 32 nt, Human
cucagcacagaguaggaagaacagugacauca

SEQ ID NO: 395256 - RNA, 32 nt, Human
cucagcacaggcagcucgcggucaugggcggc

SEQ ID NO: 395257 - RNA, 32 nt, Human
cucagcacauggacaguaguguuuugauuugu

SEQ ID NO: 395258 - RNA, 32 nt, Human
cucagcaccauccagucugauuccccguuucu

SEQ ID NO: 395259 - RNA, 32 nt, Human
cucagcacccaccccugccauucacuagucaa

SEQ ID NO: 395260 - RNA, 32 nt, Human
cucagcaccccugucucuagccacuuuggucc

SEQ ID NO: 395261 - RNA, 32 nt, Human
cucagcaccuggugcaaguaagcacaaucugg

SEQ ID NO: 395262 - RNA, 32 nt, Human
cucagcacguggugcaugcgccgcaucucguu

SEQ ID NO: 395263 - RNA, 31 nt, Human
cucagcacuagcuagaaaccucaagcccuug

SEQ ID NO: 395264 - RNA, 32 nt, Human
cucagcacugccugcucccauccuguguguua

SEQ ID NO: 395265 - RNA, 32 nt, Human
cucagcacuggggagcgcacuggugaggcaaa

SEQ ID NO: 395266 - RNA, 32 nt, Human
cucagcacuugcucaguaguuuugugaaaguc

SEQ ID NO: 395267 - RNA, 32 nt, Human
cucagcacuuuggugaggcagaaggaucucuu

SEQ ID NO: 395268 - RNA, 32 nt, Human
cucagcacuuuguugacgugguggugagagca

SEQ ID NO: 395269 - RNA, 32 nt, Human
cucagcagaucuuuacaagcaguuuccuuaua

SEQ ID NO: 395270 - RNA, 32 nt, Human
cucagcagaugacugaucuggcucuggaggac

SEQ ID NO: 395271 - RNA, 32 nt, Human
cucagcagauggcaaggagcaguaugaaaggc

SEQ ID NO: 395272 - RNA, 32 nt, Human
cucagcagccuguguguugugugaaauaaauu

SEQ ID NO: 395273 - RNA, 32 nt, Human
cucagcagcucugguggggcggguggggccau

SEQ ID NO: 395274 - RNA, 32 nt, Human
cucagcagcugcagaccgccccucaccaaccc

SEQ ID NO: 395275 - RNA, 32 nt, Human
cucagcaggaacagccuugaguugcuuuggac

SEQ ID NO: 395276 - RNA, 32 nt, Human
cucagcaggaagacagaggugccuggguggcc

SEQ ID NO: 395277 - RNA, 32 nt, Human
cucagcaggaagggaaggagaggugucugugc

SEQ ID NO: 395278 - RNA, 32 nt, Human
cucagcaggaauacucauaaagagacugagcc

SEQ ID NO: 395279 - RNA, 32 nt, Human
cucagcaggagaaaggcaaggggcucguucau

SEQ ID NO: 395280 - RNA, 32 nt, Human
cucagcagggcucugggaaugugccuuccuua

SEQ ID NO: 395281 - RNA, 32 nt, Human
cucagcagggugacuugccucagaggcuauau

SEQ ID NO: 395282 - RNA, 32 nt, Human
cucagcaguaggccuugccucagauccaaggu

SEQ ID NO: 395283 - RNA, 32 nt, Human
cucagcagugcccugaggaugggcuuccuugu

SEQ ID NO: 395284 - RNA, 22 nt, Human
cucagcaguucagcuccuucca

SEQ ID NO: 395285 - RNA, 32 nt, Human
cucagcaguugacauccaaaucuagccagagc

SEQ ID NO: 395286 - RNA, 32 nt, Human
cucagcauaaucagaggaggugaccccaagca

SEQ ID NO: 395287 - RNA, 32 nt, Human
cucagcauacggaggaccagcacuggcaccgg

SEQ ID NO: 395288 - RNA, 31 nt, Human
cucagcaucaacacaauuuccaggggaccuc

SEQ ID NO: 395289 - RNA, 32 nt, Human
cucagcaucaggauugauaaacaaauguagau

SEQ ID NO: 395290 - RNA, 32 nt, Human
cucagcaucauggaugcaggggcuugucugaa

SEQ ID NO: 395291 - RNA, 19 nt, Human
cucagcauccaccccguga

SEQ ID NO: 395292 - RNA, 23 nt, Human
cucagcauccccaccccaccccu

SEQ ID NO: 395293 - RNA, 32 nt, Human
cucagcaugguggcaugcgccuguaaucccag

SEQ ID NO: 395294 - RNA, 20 nt, Human
cucagcauuccugcccugga

SEQ ID NO: 395295 - RNA, 22 nt, Human
cucagcauuccuuacuauguga

SEQ ID NO: 395296 - RNA, 32 nt, Human
cucagcauuuccugaugacagaacagugccgu

SEQ ID NO: 395297 - RNA, 32 nt, Human
cucagccaacagcccuaacauuugccaagucu

SEQ ID NO: 395298 - RNA, 32 nt, Human
cucagccaagcuuguuuccugcucugaggcuu

SEQ ID NO: 395299 - RNA, 32 nt, Human
cucagccaaugcugcccagccugagggucccu

SEQ ID NO: 395300 - RNA, 32 nt, Human
cucagccaaugcuugaaccagcaggugggugg

SEQ ID NO: 395301 - RNA, 32 nt, Human
cucagccacaaaccucaguuuccaaauauuug

SEQ ID NO: 395302 - RNA, 32 nt, Human
cucagccacagcuguaagcagcucucugccag

SEQ ID NO: 395303 - RNA, 19 nt, Human
cucagccaccugcccgcca

SEQ ID NO: 395304 - RNA, 32 nt, Human
cucagccaccugcuaccucugccuucuggguu

SEQ ID NO: 395305 - RNA, 32 nt, Human
cucagccacgccucucucagcccaggucuccu

SEQ ID NO: 395306 - RNA, 32 nt, Human
cucagccacugagcaggcuguuccgggccuuu

SEQ ID NO: 395307 - RNA, 32 nt, Human
cucagccagcacuuuaggacaucugguuggau

SEQ ID NO: 395308 - RNA, 32 nt, Human
cucagccagcagaggcccagggcaagggacag

SEQ ID NO: 395309 - RNA, 18 nt, Human
cucagccagcagcccccu

SEQ ID NO: 395310 - RNA, 32 nt, Human
cucagccagcagcuccagcucagagcagugcc

SEQ ID NO: 395311 - RNA, 19 nt, Human
cucagccagcccagaagca

SEQ ID NO: 395312 - RNA, 32 nt, Human
cucagccagcuggccugugccgcucugacgug

SEQ ID NO: 395313 - RNA, 32 nt, Human
cucagccagcuggcugcaugaggagcagcuuu

SEQ ID NO: 395314 - RNA, 32 nt, Human
cucagccaggaauucaagaccagccugggcaa

SEQ ID NO: 395315 - RNA, 32 nt, Human
cucagccaggagaagagggugguguuuucacg

SEQ ID NO: 395316 - RNA, 19 nt, Human
cucagccaggagccagugg

SEQ ID NO: 395317 - RNA, 32 nt, Human
cucagccauccuuagagaacuguggugccugu

SEQ ID NO: 395318 - RNA, 27 nt, Human
cucagccaugccguguguaggcuuagc

SEQ ID NO: 395319 - RNA, 32 nt, Human
cucagccaugcucuccccaggguggggcuaug

SEQ ID NO: 395320 - RNA, 32 nt, Human
cucagcccaaguaccuggggcuagcagggcag

SEQ ID NO: 395321 - RNA, 32 nt, Human
cucagcccacacagugcugaaccaucuucccu

SEQ ID NO: 395322 - RNA, 32 nt, Human
cucagcccacccuucccgccacccuggccucc

SEQ ID NO: 395323 - RNA, 23 nt, Human
cucagcccacucauaccuagaga

SEQ ID NO: 395324 - RNA, 32 nt, Human
cucagcccacucucccuguuacacacugccca

SEQ ID NO: 395325 - RNA, 32 nt, Human
cucagcccacugacuucauugaucucuaaucu

SEQ ID NO: 395326 - RNA, 32 nt, Human
cucagcccagacaggcuccaccaggagaucaa

SEQ ID NO: 395327 - RNA, 24 nt, Human
cucagcccagccaggcccccuccc

SEQ ID NO: 395328 - RNA, 19 nt, Human
cucagcccagcccagccca

SEQ ID NO: 395329 - RNA, 22 nt, Human
cucagcccaggagagccagggg

SEQ ID NO: 395330 - RNA, 32 nt, Human
cucagcccaggcccagcuggggagaaggcgcu

SEQ ID NO: 395331 - RNA, 32 nt, Human
cucagccccaagccucuagucuggguguguac

SEQ ID NO: 395332 - RNA, 32 nt, Human
cucagccccagccuggccuuccuggugcccac

SEQ ID NO: 395333 - RNA, 32 nt, Human
cucagccccagcucugccaucuuggagccagc

SEQ ID NO: 395334 - RNA, 32 nt, Human
cucagccccaggagaagggacaaaagguacug

SEQ ID NO: 395335 - RNA, 32 nt, Human
cucagccccagucccagccacauguccuccau

SEQ ID NO: 395336 - RNA, 21 nt, Human
cucagcccccucagcccucaa

SEQ ID NO: 395337 - RNA, 32 nt, Human
cucagccccucuuuucccacauucauagccug

SEQ ID NO: 395338 - RNA, 32 nt, Human
cucagccccugcccaggcuagagggaaacagc

SEQ ID NO: 395339 - RNA, 32 nt, Human
cucagccccuucucccccgucagcccugcucu

SEQ ID NO: 395340 - RNA, 32 nt, Human
cucagccccuucuucacuaucugggccuccca

SEQ ID NO: 395341 - RNA, 32 nt, Human
cucagccccuucuucuuuccugccucaccuuc

SEQ ID NO: 395342 - RNA, 32 nt, Human
cucagccccuuguguuuacagacaaggacaug

SEQ ID NO: 395343 - RNA, 32 nt, Human
cucagcccgaguugcugggaugacaggcacac

SEQ ID NO: 395344 - RNA, 32 nt, Human
cucagcccuaucuccauuucccuaucuggcuc

SEQ ID NO: 395345 - RNA, 32 nt, Human
cucagcccucccagcccacuucugccuguuuu

SEQ ID NO: 395346 - RNA, 32 nt, Human
cucagcccuccccacccuggcucuccuugcau

SEQ ID NO: 395347 - RNA, 32 nt, Human
cucagcccuccuggcccuucagucuuggugcc

SEQ ID NO: 395348 - RNA, 32 nt, Human
cucagcccucucuugccaaaaagcacaagaug

SEQ ID NO: 395349 - RNA, 32 nt, Human
cucagcccugcucccaucuggcaccuucaagu

SEQ ID NO: 395350 - RNA, 32 nt, Human
cucagcccugcuucaucuagucuuccaguugg

SEQ ID NO: 395351 - RNA, 32 nt, Human
cucagcccuuccccuggcaccuuuacucuucg

SEQ ID NO: 395352 - RNA, 32 nt, Human
cucagccgccuugccagcgcccccagccgcgc

SEQ ID NO: 395353 - RNA, 32 nt, Human
cucagccgcuucucaaacugggucucagaaaa

SEQ ID NO: 395354 - RNA, 32 nt, Human
cucagccgggaggcccagaguguucugcagag

SEQ ID NO: 395355 - RNA, 23 nt, Human
cucagccuacaaucccaacacuu

SEQ ID NO: 395356 - RNA, 22 nt, Human
cucagccuacuccgcucacuga

SEQ ID NO: 395357 - RNA, 32 nt, Human
cucagccuauuccuuguucccugguggggucu

SEQ ID NO: 395358 - RNA, 32 nt, Human
cucagccucaccccaccucucgcugcucagcu

SEQ ID NO: 395359 - RNA, 32 nt, Human
cucagccucagggcucagaaggugccaguccg

SEQ ID NO: 395360 - RNA, 32 nt, Human
cucagccucauccuccccaggaccccugucca

SEQ ID NO: 395361 - RNA, 32 nt, Human
cucagccuccacucccugucugaaaccagaag

SEQ ID NO: 395362 - RNA, 32 nt, Human
cucagccuccacuuccccagaguaaauucaaa

SEQ ID NO: 395363 - RNA, 32 nt, Human
cucagccuccacuucuuauuuugauucuuuuc

SEQ ID NO: 395364 - RNA, 32 nt, Human
cucagccuccaggcuucagucuucccaacuuc

SEQ ID NO: 395365 - RNA, 32 nt, Human
cucagccucccaaaagcugggauuacaggcgu

SEQ ID NO: 395366 - RNA, 32 nt, Human
cucagccucccaaaguccugggauuacaggcg

SEQ ID NO: 395367 - RNA, 32 nt, Human
cucagccucccaaaguccugggauuacaggcu

SEQ ID NO: 395368 - RNA, 32 nt, Human
cucagccucccaagcuuucaccaucauggacc

SEQ ID NO: 395369 - RNA, 32 nt, Human
cucagccucccaaguacugggauuacagcuuc

SEQ ID NO: 395370 - RNA, 32 nt, Human
cucagccucccaaguacugggauuacaggugc

SEQ ID NO: 395371 - RNA, 32 nt, Human
cucagccucccaagucacugggauuauagaca

SEQ ID NO: 395372 - RNA, 32 nt, Human
cucagccucccaagugcugggauuacaggcgu

SEQ ID NO: 395373 - RNA, 32 nt, Human
cucagccucccaaguggcugggauuauaggug

SEQ ID NO: 395374 - RNA, 32 nt, Human
cucagccucccagcuacuuaggaggcugaggc

SEQ ID NO: 395375 - RNA, 32 nt, Human
cucagccucccaggugcugggauuauaggcgu

SEQ ID NO: 395376 - RNA, 32 nt, Human
cucagccucccuaguagcugggauuauaggcg

SEQ ID NO: 395377 - RNA, 21 nt, Human
cucagccuccgacccaggugg

SEQ ID NO: 395378 - RNA, 32 nt, Human
cucagccuccggagaacugggauuacaggcau

SEQ ID NO: 395379 - RNA, 32 nt, Human
cucagccuccuaaagugcugggauuauagcug

SEQ ID NO: 395380 - RNA, 32 nt, Human
cucagccuccuaaaugcugggauuacaggcgu

SEQ ID NO: 395381 - RNA, 32 nt, Human
cucagccuccuaagggcugggauuacaggaau

SEQ ID NO: 395382 - RNA, 32 nt, Human
cucagccuccuaagugcugggauuacagacgu

SEQ ID NO: 395383 - RNA, 32 nt, Human
cucagccuccugaguagcaauuacagggagca

SEQ ID NO: 395384 - RNA, 32 nt, Human
cucagccuccugaguagcugggauuauaggca

SEQ ID NO: 395385 - RNA, 32 nt, Human
cucagccuccugaguagcugggauuauaggcg

SEQ ID NO: 395386 - RNA, 32 nt, Human
cucagccuccugaguagcugggauuauaggua

SEQ ID NO: 395387 - RNA, 32 nt, Human
cucagccuccugaguagcugggauuauaggug

SEQ ID NO: 395388 - RNA, 32 nt, Human
cucagccuccugaguagcugggauuauggaca

SEQ ID NO: 395389 - RNA, 32 nt, Human
cucagccuccugaguagcugggauuaugggcg

SEQ ID NO: 395390 - RNA, 32 nt, Human
cucagccuccugaguagcugggauuaugggug

SEQ ID NO: 395391 - RNA, 32 nt, Human
cucagccuccugaguggcugggauuauaggug

SEQ ID NO: 395392 - RNA, 32 nt, Human
cucagccuccugaguggggauuacaggccaca

SEQ ID NO: 395393 - RNA, 32 nt, Human
cucagccuccugauucauggguccccuaguua

SEQ ID NO: 395394 - RNA, 32 nt, Human
cucagccuccugccauggugcagcccuccucu

SEQ ID NO: 395395 - RNA, 32 nt, Human
cucagccuccuguaaucccagcuacuugggag

SEQ ID NO: 395396 - RNA, 32 nt, Human
cucagccucgcucuccccgggacucucacgcu

SEQ ID NO: 395397 - RNA, 32 nt, Human
cucagccucucccagucucucccugcaguccu

SEQ ID NO: 395398 - RNA, 32 nt, Human
cucagccucucugcccacagacugcccccacg

SEQ ID NO: 395399 - RNA, 32 nt, Human
cucagccucucuggccgccaguagccugaggc

SEQ ID NO: 395400 - RNA, 32 nt, Human
cucagccucugccucccagccucuuucugagg

SEQ ID NO: 395401 - RNA, 32 nt, Human
cucagccucugcuauuuccuuugaggaaggua

SEQ ID NO: 395402 - RNA, 32 nt, Human
cucagccucuggcccucuuggcucagauucaa

SEQ ID NO: 395403 - RNA, 32 nt, Human
cucagccucuggguccagagccucagcuccua

SEQ ID NO: 395404 - RNA, 32 nt, Human
cucagccucuuuagcugggauuacaggcaccc

SEQ ID NO: 395405 - RNA, 32 nt, Human
cucagccugaguagcugggacuacaggugugu

SEQ ID NO: 395406 - RNA, 32 nt, Human
cucagccugaguagcugggaugggacuacaga

SEQ ID NO: 395407 - RNA, 32 nt, Human
cucagccugagugggcccuggggacacuguca

SEQ ID NO: 395408 - RNA, 32 nt, Human
cucagccugcaaccucuauccuggaaccuguc

SEQ ID NO: 395409 - RNA, 18 nt, Human
cucagccugcacugggcc

SEQ ID NO: 395410 - RNA, 21 nt, Human
cucagccugcagacacaggga

SEQ ID NO: 395411 - RNA, 32 nt, Human
cucagccugcagagaagaaagugaggccggga

SEQ ID NO: 395412 - RNA, 32 nt, Human
cucagccugcagcucuacuacauccccgugcu

SEQ ID NO: 395413 - RNA, 32 nt, Human
cucagccugccaggaagccaagcccuacagug

SEQ ID NO: 395414 - RNA, 20 nt, Human
cucagccugcccagcaggga

SEQ ID NO: 395415 - RNA, 22 nt, Human
cucagccugccuccccaaggga

SEQ ID NO: 395416 - RNA, 32 nt, Human
cucagccugcugcccaggcugugcagcgcagc

SEQ ID NO: 395417 - RNA, 32 nt, Human
cucagccuggaauccccaccuugcccacccca

SEQ ID NO: 395418 - RNA, 20 nt, Human
cucagccuggagugcaguga

SEQ ID NO: 395419 - RNA, 18 nt, Human
cucagccuggcgcugcug

SEQ ID NO: 395420 - RNA, 32 nt, Human
cucagccuggcgguucuaccuccgaggguucg

SEQ ID NO: 395421 - RNA, 32 nt, Human
cucagccugggcucccagccccucucuccuuu

SEQ ID NO: 395422 - RNA, 32 nt, Human
cucagccuggggcucccugagucagggcugug

SEQ ID NO: 395423 - RNA, 32 nt, Human
cucagccugggugacagagcaagacuccgucu

SEQ ID NO: 395424 - RNA, 32 nt, Human
cucagccugguaucagggaaauugagacuuau

SEQ ID NO: 395425 - RNA, 32 nt, Human
cucagccuggugaaccacacaggccagcgcuc

SEQ ID NO: 395426 - RNA, 22 nt, Human
cucagccuguaagcaaagcagg

SEQ ID NO: 395427 - RNA, 32 nt, Human
cucagccuuccaaagggagggauuacuggcgu

SEQ ID NO: 395428 - RNA, 32 nt, Human
cucagccuucccgguucgggaaaggggaagaa

SEQ ID NO: 395429 - RNA, 32 nt, Human
cucagccuucucugccccuccugggaaucugu

SEQ ID NO: 395430 - RNA, 32 nt, Human
cucagccuucuggcuagcucuuagcuuccagc

SEQ ID NO: 395431 - RNA, 32 nt, Human
cucagccuucuguguggaggauuugcacuugg

SEQ ID NO: 395432 - RNA, 32 nt, Human
cucagccuugcaccccagcacugagaagcuac

SEQ ID NO: 395433 - RNA, 23 nt, Human
cucagccuugggccaagccugga

SEQ ID NO: 395434 - RNA, 24 nt, Human
cucagccuuguaaucccagcacuu

SEQ ID NO: 395435 - RNA, 32 nt, Human
cucagccuuuuucauaaucagaagaaugcaaa

SEQ ID NO: 395436 - RNA, 32 nt, Human
cucagcgaaauugugcccagauuccugaccua

SEQ ID NO: 395437 - RNA, 32 nt, Human
cucagcgacacugucauuucugcuucauuacu

SEQ ID NO: 395438 - RNA, 32 nt, Human
cucagcgaccgggcccuucuccaccuccugcc

SEQ ID NO: 395439 - RNA, 32 nt, Human
cucagcgaggcagaggguggggcugcacagag

SEQ ID NO: 395440 - RNA, 32 nt, Human
cucagcgauuacaggaaugcaccaccacgccc

SEQ ID NO: 395441 - RNA, 32 nt, Human
cucagcgcagcccuggcccaggaaggcaggag

SEQ ID NO: 395442 - RNA, 32 nt, Human
cucagcgcagccgccgcccgcggagccagcac

SEQ ID NO: 395443 - RNA, 24 nt, Human
cucagcgccacucccacccccggc

SEQ ID NO: 395444 - RNA, 32 nt, Human
cucagcgccagccugucccauggacacuccag

SEQ ID NO: 395445 - RNA, 21 nt, Human
cucagcgcccugccgccgccg

SEQ ID NO: 395446 - RNA, 32 nt, Human
cucagcgccucaaaugagagacuggugugggg

SEQ ID NO: 395447 - RNA, 32 nt, Human
cucagcggacucgauaaucugccugcugaugu

SEQ ID NO: 395448 - RNA, 32 nt, Human
cucagcggaggugagaggagaggaggagaaaa

SEQ ID NO: 395449 - RNA, 21 nt, Human
cucagcggccagcuccucgcc

SEQ ID NO: 395450 - RNA, 32 nt, Human
cucagcgggcagugcuuagagcacaggccccu

SEQ ID NO: 395451 - RNA, 32 nt, Human
cucagcgucccccagucacacuguccccauug

SEQ ID NO: 395452 - RNA, 32 nt, Human
cucagcgucugccuccccagcacacccucauu

SEQ ID NO: 395453 - RNA, 32 nt, Human
cucagcuacaugugaccuccagcuuggugagg

SEQ ID NO: 395454 - RNA, 32 nt, Human
cucagcuaccccucagcuccgguagucgccag

SEQ ID NO: 395455 - RNA, 20 nt, Human
cucagcuaccgccgcugccg

SEQ ID NO: 395456 - RNA, 23 nt, Human
cucagcuacuccuaaccuccacu

SEQ ID NO: 395457 - RNA, 32 nt, Human
cucagcuagauuggaagagaggaugggaagac

SEQ ID NO: 395458 - RNA, 32 nt, Human
cucagcuauccuucuaauuucucucuaauuuc

SEQ ID NO: 395459 - RNA, 32 nt, Human
cucagcuauggccugggcucuagcuuuggcuc

SEQ ID NO: 395460 - RNA, 32 nt, Human
cucagcucaacauggcuugacauggugggcac

SEQ ID NO: 395461 - RNA, 32 nt, Human
cucagcucacagcaaccucugccuccuggguu

SEQ ID NO: 395462 - RNA, 24 nt, Human
cucagcucaccacaaccuccaccu

SEQ ID NO: 395463 - RNA, 24 nt, Human
cucagcucaccacaaccuccgccu

SEQ ID NO: 395464 - RNA, 32 nt, Human
cucagcucaccacaaccucugccuccccgguu

SEQ ID NO: 395465 - RNA, 24 nt, Human
cucagcucaccgcaaccuccaccu

SEQ ID NO: 395466 - RNA, 24 nt, Human
cucagcucaccgcaaccuccgccu

SEQ ID NO: 395467 - RNA, 32 nt, Human
cucagcucaccgcaaccucugccucccagauu

SEQ ID NO: 395468 - RNA, 32 nt, Human
cucagcucaccgcaaucuccgccucccagauu

SEQ ID NO: 395469 - RNA, 32 nt, Human
cucagcucaccgccacuuucuccugccuuccu

SEQ ID NO: 395470 - RNA, 24 nt, Human
cucagcucacuacaaccuccgccu

SEQ ID NO: 395471 - RNA, 24 nt, Human
cucagcucacuacaaccucugccu

SEQ ID NO: 395472 - RNA, 32 nt, Human
cucagcucacuacaaccucugccucccagguu

SEQ ID NO: 395473 - RNA, 32 nt, Human
cucagcucacuacaaccucugccuucugguuu

SEQ ID NO: 395474 - RNA, 25 nt, Human
cucagcucacucugcaaccuccacu

SEQ ID NO: 395475 - RNA, 32 nt, Human
cucagcucacucugcaaccuccacuucccagg

SEQ ID NO: 395476 - RNA, 32 nt, Human
cucagcucacugaaaccucugccucccggguu

SEQ ID NO: 395477 - RNA, 32 nt, Human
cucagcucacugcaaacuccaccucccagguu

SEQ ID NO: 395478 - RNA, 32 nt, Human
cucagcucacugcaaacucugccucccgaauu

SEQ ID NO: 395479 - RNA, 32 nt, Human
cucagcucacugcaacauccaccuccuggguu

SEQ ID NO: 395480 - RNA, 32 nt, Human
cucagcucacugcaacauccgccucugggguu

SEQ ID NO: 395481 - RNA, 24 nt, Human
cucagcucacugcaaccaacaccu

SEQ ID NO: 395482 - RNA, 32 nt, Human
cucagcucacugcaaccacugccucccaggcu

SEQ ID NO: 395483 - RNA, 32 nt, Human
cucagcucacugcaacccccgccuccuggguu

SEQ ID NO: 395484 - RNA, 32 nt, Human
cucagcucacugcaaccuacgccuucuggguu

SEQ ID NO: 395485 - RNA, 21 nt, Human
cucagcucacugcaaccucca

SEQ ID NO: 395486 - RNA, 24 nt, Human
cucagcucacugcaaccuccaccu

SEQ ID NO: 395487 - RNA, 32 nt, Human
cucagcucacugcaaccuccaccucccagacu

SEQ ID NO: 395488 - RNA, 32 nt, Human
cucagcucacugcaaccuccaccucccaggau

SEQ ID NO: 395489 - RNA, 32 nt, Human
cucagcucacugcaaccuccaccucccaggcu

SEQ ID NO: 395490 - RNA, 32 nt, Human
cucagcucacugcaaccuccaccucccagguu

SEQ ID NO: 395491 - RNA, 32 nt, Human
cucagcucacugcaaccuccaccucccggguc

SEQ ID NO: 395492 - RNA, 32 nt, Human
cucagcucacugcaaccuccaccucccggguu

SEQ ID NO: 395493 - RNA, 32 nt, Human
cucagcucacugcaaccuccaccucccugguu

SEQ ID NO: 395494 - RNA, 32 nt, Human
cucagcucacugcaaccuccaccuccggguuc

SEQ ID NO: 395495 - RNA, 32 nt, Human
cucagcucacugcaaccuccaccuccuggguu

SEQ ID NO: 395496 - RNA, 32 nt, Human
cucagcucacugcaaccuccaccucuuauguu

SEQ ID NO: 395497 - RNA, 24 nt, Human
cucagcucacugcaaccuccaucu

SEQ ID NO: 395498 - RNA, 32 nt, Human
cucagcucacugcaaccuccaucuccuggauu

SEQ ID NO: 395499 - RNA, 32 nt, Human
cucagcucacugcaaccucccccuccuggguu

SEQ ID NO: 395500 - RNA, 32 nt, Human
cucagcucacugcaaccuccgcccccuggguu

SEQ ID NO: 395501 - RNA, 24 nt, Human
cucagcucacugcaaccuccgccu

SEQ ID NO: 395502 - RNA, 32 nt, Human
cucagcucacugcaaccuccgccucccaaguu

SEQ ID NO: 395503 - RNA, 32 nt, Human
cucagcucacugcaaccuccgccucccagguu

SEQ ID NO: 395504 - RNA, 32 nt, Human
cucagcucacugcaaccuccgccucccggguu

SEQ ID NO: 395505 - RNA, 32 nt, Human
cucagcucacugcaaccuccgccuccugaggu

SEQ ID NO: 395506 - RNA, 32 nt, Human
cucagcucacugcaaccuccgccuccugggau

SEQ ID NO: 395507 - RNA, 32 nt, Human
cucagcucacugcaaccuccgccuccuggguu

SEQ ID NO: 395508 - RNA, 32 nt, Human
cucagcucacugcaaccuccgccucuuggguu

SEQ ID NO: 395509 - RNA, 32 nt, Human
cucagcucacugcaaccuccgccugcuggguu

SEQ ID NO: 395510 - RNA, 32 nt, Human
cucagcucacugcaaccuccgccuucuggguu

SEQ ID NO: 395511 - RNA, 23 nt, Human
cucagcucacugcaaccuccgcu

SEQ ID NO: 395512 - RNA, 24 nt, Human
cucagcucacugcaaccuccgucu

SEQ ID NO: 395513 - RNA, 32 nt, Human
cucagcucacugcaaccuccgucuccaggguu

SEQ ID NO: 395514 - RNA, 32 nt, Human
cucagcucacugcaaccuccgucucuacuaaa

SEQ ID NO: 395515 - RNA, 32 nt, Human
cucagcucacugcaaccuccguuuccuggguu

SEQ ID NO: 395516 - RNA, 24 nt, Human
cucagcucacugcaaccuccuccu

SEQ ID NO: 395517 - RNA, 32 nt, Human
cucagcucacugcaaccuccuccucccggguu

SEQ ID NO: 395518 - RNA, 32 nt, Human
cucagcucacugcaaccuccuccuucuggguu

SEQ ID NO: 395519 - RNA, 32 nt, Human
cucagcucacugcaaccucgaccucuuggguu

SEQ ID NO: 395520 - RNA, 24 nt, Human
cucagcucacugcaaccucuaccu

SEQ ID NO: 395521 - RNA, 32 nt, Human
cucagcucacugcaaccucuaccuccuggguu

SEQ ID NO: 395522 - RNA, 24 nt, Human
cucagcucacugcaaccucucucu

SEQ ID NO: 395523 - RNA, 32 nt, Human
cucagcucacugcaaccucucucucccggguu

SEQ ID NO: 395524 - RNA, 24 nt, Human
cucagcucacugcaaccucugacu

SEQ ID NO: 395525 - RNA, 22 nt, Human
cucagcucacugcaaccucugc

SEQ ID NO: 395526 - RNA, 24 nt, Human
cucagcucacugcaaccucugccu

SEQ ID NO: 395527 - RNA, 32 nt, Human
cucagcucacugcaaccucugccuccagaguu

SEQ ID NO: 395528 - RNA, 32 nt, Human
cucagcucacugcaaccucugccucccagguu

SEQ ID NO: 395529 - RNA, 32 nt, Human
cucagcucacugcaaccucugccucccaguuc

SEQ ID NO: 395530 - RNA, 32 nt, Human
cucagcucacugcaaccucugccucccggauu

SEQ ID NO: 395531 - RNA, 32 nt, Human
cucagcucacugcaaccucugccucccggguu

SEQ ID NO: 395532 - RNA, 32 nt, Human
cucagcucacugcaaccucugccucccugguu

SEQ ID NO: 395533 - RNA, 32 nt, Human
cucagcucacugcaaccucugccuccugaguu

SEQ ID NO: 395534 - RNA, 32 nt, Human
cucagcucacugcaaccucugccuccuggauu

SEQ ID NO: 395535 - RNA, 32 nt, Human
cucagcucacugcaaccucugccuccugggcu

SEQ ID NO: 395536 - RNA, 32 nt, Human
cucagcucacugcaaccucugccuccuggguu

SEQ ID NO: 395537 - RNA, 32 nt, Human
cucagcucacugcaaccucugccuccugguuc

SEQ ID NO: 395538 - RNA, 32 nt, Human
cucagcucacugcaaccucugccuucuggauu

SEQ ID NO: 395539 - RNA, 32 nt, Human
cucagcucacugcaaccucugcuucccggguu

SEQ ID NO: 395540 - RNA, 24 nt, Human
cucagcucacugcaaccucugucu

SEQ ID NO: 395541 - RNA, 32 nt, Human
cucagcucacugcaaccucugucucccggguu

SEQ ID NO: 395542 - RNA, 32 nt, Human
cucagcucacugcaaccucugucuccuggguu

SEQ ID NO: 395543 - RNA, 32 nt, Human
cucagcucacugcaaccugugccucccggcuu

SEQ ID NO: 395544 - RNA, 32 nt, Human
cucagcucacugcaaccuuggccucccguguu

SEQ ID NO: 395545 - RNA, 32 nt, Human
cucagcucacugcaaccuuugucucccgggcu

SEQ ID NO: 395546 - RNA, 24 nt, Human
cucagcucacugcaacguccaccu

SEQ ID NO: 395547 - RNA, 32 nt, Human
cucagcucacugcaacguccaccuccuggguu

SEQ ID NO: 395548 - RNA, 32 nt, Human
cucagcucacugcaacguccaccucuugaguu

SEQ ID NO: 395549 - RNA, 32 nt, Human
cucagcucacugcaacgucugccucccggguu

SEQ ID NO: 395550 - RNA, 24 nt, Human
cucagcucacugcaacuuccaccu

SEQ ID NO: 395551 - RNA, 32 nt, Human
cucagcucacugcaacuucugccucccagguu

SEQ ID NO: 395552 - RNA, 32 nt, Human
cucagcucacugcaacuucugccuccuggguu

SEQ ID NO: 395553 - RNA, 32 nt, Human
cucagcucacugcaacuucugccuccugguau

SEQ ID NO: 395554 - RNA, 24 nt, Human
cucagcucacugcaagcuccaacu

SEQ ID NO: 395555 - RNA, 24 nt, Human
cucagcucacugcaagcuccaccu

SEQ ID NO: 395556 - RNA, 32 nt, Human
cucagcucacugcaagcuccaccucccggguu

SEQ ID NO: 395557 - RNA, 32 nt, Human
cucagcucacugcaagcuccgccucccagguu

SEQ ID NO: 395558 - RNA, 32 nt, Human
cucagcucacugcaagcuccgccucccgggua

SEQ ID NO: 395559 - RNA, 32 nt, Human
cucagcucacugcaagcuccgccuccucccgg

SEQ ID NO: 395560 - RNA, 32 nt, Human
cucagcucacugcaagcuccgccuccuggguu

SEQ ID NO: 395561 - RNA, 32 nt, Human
cucagcucacugcaagcucuaccucuugguuc

SEQ ID NO: 395562 - RNA, 32 nt, Human
cucagcucacugcaagcucugccucccggguu

SEQ ID NO: 395563 - RNA, 32 nt, Human
cucagcucacugcaagcucugccucccguguu

SEQ ID NO: 395564 - RNA, 32 nt, Human
cucagcucacugcaagcucugccucucagguu

SEQ ID NO: 395565 - RNA, 24 nt, Human
cucagcucacugcaaucuccaccu

SEQ ID NO: 395566 - RNA, 32 nt, Human
cucagcucacugcaaucuccaccuccuggguu

SEQ ID NO: 395567 - RNA, 32 nt, Human
cucagcucacugcaaucuucaccuccuaggcu

SEQ ID NO: 395568 - RNA, 32 nt, Human
cucagcucacugcacccuccgccucucggguu

SEQ ID NO: 395569 - RNA, 32 nt, Human
cucagcucacugcacccucugugucccggauu

SEQ ID NO: 395570 - RNA, 32 nt, Human
cucagcucacugcagccacugccucccagguu

SEQ ID NO: 395571 - RNA, 32 nt, Human
cucagcucacugcagcccugacugccuaggcu

SEQ ID NO: 395572 - RNA, 24 nt, Human
cucagcucacugcagccucaaacu

SEQ ID NO: 395573 - RNA, 32 nt, Human
cucagcucacugcagccucaacugccccaggu

SEQ ID NO: 395574 - RNA, 24 nt, Human
cucagcucacugcagccuccaacu

SEQ ID NO: 395575 - RNA, 24 nt, Human
cucagcucacugcagccuccaccu

SEQ ID NO: 395576 - RNA, 32 nt, Human
cucagcucacugcagccuccaccucccagguu

SEQ ID NO: 395577 - RNA, 32 nt, Human
cucagcucacugcagccuccaccuccuggguu

SEQ ID NO: 395578 - RNA, 23 nt, Human
cucagcucacugcagccuccacu

SEQ ID NO: 395579 - RNA, 32 nt, Human
cucagcucacugcagccuccacuuccuggguu

SEQ ID NO: 395580 - RNA, 32 nt, Human
cucagcucacugcagccuccgucucccagguu

SEQ ID NO: 395581 - RNA, 32 nt, Human
cucagcucacugcagccucugccacccagauu

SEQ ID NO: 395582 - RNA, 32 nt, Human
cucagcucacugcagccucugccucccggguu

SEQ ID NO: 395583 - RNA, 32 nt, Human
cucagcucacugcagccucugccuccugaguu

SEQ ID NO: 395584 - RNA, 32 nt, Human
cucagcucacugcagccucugucucccgggcu

SEQ ID NO: 395585 - RNA, 32 nt, Human
cucagcucacugcagccuugaccuccuggguu

SEQ ID NO: 395586 - RNA, 32 nt, Human
cucagcucacugcagcuuugaccuugccgggc

SEQ ID NO: 395587 - RNA, 32 nt, Human
cucagcucacugcaggcucugccuccuggguu

SEQ ID NO: 395588 - RNA, 32 nt, Human
cucagcucacugcagucucugccucccggguu

SEQ ID NO: 395589 - RNA, 32 nt, Human
cucagcucacugcauccucugccucccggguu

SEQ ID NO: 395590 - RNA, 32 nt, Human
cucagcucacugccaccucugccucccagguu

SEQ ID NO: 395591 - RNA, 32 nt, Human
cucagcucacugccaccuuugccuccuggguu

SEQ ID NO: 395592 - RNA, 24 nt, Human
cucagcucacugcgaccuccaccu

SEQ ID NO: 395593 - RNA, 32 nt, Human
cucagcucacugcgaccuccaccuccuggguu

SEQ ID NO: 395594 - RNA, 32 nt, Human
cucagcucacugcgaccugcaccuccuggguu

SEQ ID NO: 395595 - RNA, 32 nt, Human
cucagcucacugcggccuugaacuccugggcu

SEQ ID NO: 395596 - RNA, 32 nt, Human
cucagcucacuggagccucugccuuccagguu

SEQ ID NO: 395597 - RNA, 24 nt, Human
cucagcucacuguaaccuccaccu

SEQ ID NO: 395598 - RNA, 24 nt, Human
cucagcucacuguaaccucugccu

SEQ ID NO: 395599 - RNA, 32 nt, Human
cucagcucacuguaaccucugccucccugcuu

SEQ ID NO: 395600 - RNA, 21 nt, Human
cucagcucacuguacuccagc

SEQ ID NO: 395601 - RNA, 32 nt, Human
cucagcucacuguacuccagcccggguucaag

SEQ ID NO: 395602 - RNA, 32 nt, Human
cucagcucagcaucuucagcugugcccgggcu

SEQ ID NO: 395603 - RNA, 32 nt, Human
cucagcucagcccucaggugcaguggcccuac

SEQ ID NO: 395604 - RNA, 32 nt, Human
cucagcucagcgccagccugucccauggacac

SEQ ID NO: 395605 - RNA, 32 nt, Human
cucagcucagcuuuuguagauccuuaugacac

SEQ ID NO: 395606 - RNA, 32 nt, Human
cucagcucagucuccccucucucccuguccug

SEQ ID NO: 395607 - RNA, 32 nt, Human
cucagcucauagacccucccucccugcaugug

SEQ ID NO: 395608 - RNA, 32 nt, Human
cucagcuccagcauaccccaccaccuucuccu

SEQ ID NO: 395609 - RNA, 32 nt, Human
cucagcuccagccucacacugaccucagcagu

SEQ ID NO: 395610 - RNA, 32 nt, Human
cucagcuccaugcaaccucugccuccuggguu

SEQ ID NO: 395611 - RNA, 32 nt, Human
cucagcuccaugucuuguacacacagaaacau

SEQ ID NO: 395612 - RNA, 32 nt, Human
cucagcucccaaagugcugggauuacaggcau

SEQ ID NO: 395613 - RNA, 32 nt, Human
cucagcucccaaguagcugggauuacaggcau

SEQ ID NO: 395614 - RNA, 32 nt, Human
cucagcucccacaaaugacagccccuuaagca

SEQ ID NO: 395615 - RNA, 24 nt, Human
cucagcucccugcaaccuccaccu

SEQ ID NO: 395616 - RNA, 32 nt, Human
cucagcucccuuuaaccuccagcuccuggguu

SEQ ID NO: 395617 - RNA, 32 nt, Human
cucagcuccgugugcccacauggccccaggcc

SEQ ID NO: 395618 - RNA, 32 nt, Human
cucagcuccguucacucucugccuucugcccc

SEQ ID NO: 395619 - RNA, 32 nt, Human
cucagcuccuucuuucauuccagaccugcccc

SEQ ID NO: 395620 - RNA, 32 nt, Human
cucagcuccuuggaagucuugggguggggauc

SEQ ID NO: 395621 - RNA, 20 nt, Human
cucagcucgccgcagccccg

SEQ ID NO: 395622 - RNA, 24 nt, Human
cucagcucgcugcaacccccaccu

SEQ ID NO: 395623 - RNA, 32 nt, Human
cucagcucuagggugaaaggcgagagguugca

SEQ ID NO: 395624 - RNA, 32 nt, Human
cucagcucucccucacaccucccuucauccca

SEQ ID NO: 395625 - RNA, 32 nt, Human
cucagcucuccucugcgccggcccgcucacuc

SEQ ID NO: 395626 - RNA, 32 nt, Human
cucagcucucgaaacagaaggcagcagcccau

SEQ ID NO: 395627 - RNA, 32 nt, Human
cucagcucugacagccccuccuccaggaaggc

SEQ ID NO: 395628 - RNA, 32 nt, Human
cucagcucugagccauucacacaucuucaccc

SEQ ID NO: 395629 - RNA, 32 nt, Human
cucagcucuggaguucagcagcaacagcagca

SEQ ID NO: 395630 - RNA, 19 nt, Human
cucagcucugucugcucaa

SEQ ID NO: 395631 - RNA, 32 nt, Human
cucagcucuuugacaaucacuguggcuguugg

SEQ ID NO: 395632 - RNA, 32 nt, Human
cucagcucuuuuucuugcacuuccuuggagga

SEQ ID NO: 395633 - RNA, 32 nt, Human
cucagcugagagagcuggacagacuccauuuu

SEQ ID NO: 395634 - RNA, 32 nt, Human
cucagcugagcugaagcuggauuauuaaagug

SEQ ID NO: 395635 - RNA, 32 nt, Human
cucagcugaggccacccgagccccagggagga

SEQ ID NO: 395636 - RNA, 32 nt, Human
cucagcugcacugcggccugguggcagugugg

SEQ ID NO: 395637 - RNA, 32 nt, Human
cucagcugcagaggaggaaagggaaaggguag

SEQ ID NO: 395638 - RNA, 32 nt, Human
cucagcugcccaggcuggagugugguggcgcc

SEQ ID NO: 395639 - RNA, 32 nt, Human
cucagcugcccgucucuggccugggccccugc

SEQ ID NO: 395640 - RNA, 32 nt, Human
cucagcugcccuuuggaauaaagcugccugau

SEQ ID NO: 395641 - RNA, 32 nt, Human
cucagcugccuccccugcccuuucucagcugc

SEQ ID NO: 395642 - RNA, 31 nt, Human
cucagcugccucucagggacugcacuguucc

SEQ ID NO: 395643 - RNA, 32 nt, Human
cucagcugcugcaaccuccaccucccggguuc

SEQ ID NO: 395644 - RNA, 32 nt, Human
cucagcuggaacaguggggacaggaggaggca

SEQ ID NO: 395645 - RNA, 32 nt, Human
cucagcuggcuguccugguucacucagaagau

SEQ ID NO: 395646 - RNA, 32 nt, Human
cucagcugggaaggagguggucucaagcagcc

SEQ ID NO: 395647 - RNA, 32 nt, Human
cucagcuggggguggaggggcaauuggaaggc

SEQ ID NO: 395648 - RNA, 15 nt, Human
cucagcuggguccag

SEQ ID NO: 395649 - RNA, 21 nt, Human
cucagcugguaaauuguucca

SEQ ID NO: 395650 - RNA, 32 nt, Human
cucagcuguacuuuugugggccugucaucuug

SEQ ID NO: 395651 - RNA, 32 nt, Human
cucagcugucgguuuaaagagacacugagggg

SEQ ID NO: 395652 - RNA, 22 nt, Human
cucagcuguggccaccaacaca

SEQ ID NO: 395653 - RNA, 32 nt, Human
cucagcugugggcucagaaacugcuagguaaa

SEQ ID NO: 395654 - RNA, 32 nt, Human
cucagcuguguauccuaucuguucuagcuucu

SEQ ID NO: 395655 - RNA, 32 nt, Human
cucagcugugucccauccccacugccuggucc

SEQ ID NO: 395656 - RNA, 32 nt, Human
cucagcugugugugcacaugcacacccacccc

SEQ ID NO: 395657 - RNA, 24 nt, Human
cucagcuuaccacaaccuccaccu

SEQ ID NO: 395658 - RNA, 32 nt, Human
cucagcuuacggcaaucucugcuucccggguu

SEQ ID NO: 395659 - RNA, 32 nt, Human
cucagcuuacugcaaccucugccucccggguu

SEQ ID NO: 395660 - RNA, 32 nt, Human
cucagcuuacugcacccucugccucccgguuu

SEQ ID NO: 395661 - RNA, 32 nt, Human
cucagcuuacuguaaccucugccuccuggauu

SEQ ID NO: 395662 - RNA, 32 nt, Human
cucagcuuauuacaaccucugccuccugggcu

SEQ ID NO: 395663 - RNA, 32 nt, Human
cucagcuucaaggagaaagaguucagaggccc

SEQ ID NO: 395664 - RNA, 32 nt, Human
cucagcuuccacugccgucuccacaggaaacc

SEQ ID NO: 395665 - RNA, 32 nt, Human
cucagcuuccaucaccccuagcaauauguauu

SEQ ID NO: 395666 - RNA, 32 nt, Human
cucagcuucccaaggagcugggacugcaggca

SEQ ID NO: 395667 - RNA, 32 nt, Human
cucagcuucccagauagcugggccacaggcgu

SEQ ID NO: 395668 - RNA, 32 nt, Human
cucagcuucccaggacccuaagcugcuccugg

SEQ ID NO: 395669 - RNA, 32 nt, Human
cucagcuucccuugcguuuaaggccugcccua

SEQ ID NO: 395670 - RNA, 32 nt, Human
cucagcuuccugaggagcugggauuauaggug

SEQ ID NO: 395671 - RNA, 32 nt, Human
cucagcuucgagccgaggugcagugagcuggu

SEQ ID NO: 395672 - RNA, 23 nt, Human
cucagcuucuaaucccagcacuu

SEQ ID NO: 395673 - RNA, 32 nt, Human
cucagcuucuaaucccagcacuuugguaggca

SEQ ID NO: 395674 - RNA, 32 nt, Human
cucagcuucucaaaguacugggauuauauagg

SEQ ID NO: 395675 - RNA, 32 nt, Human
cucagcuucugccuccugucuccugggacccu

SEQ ID NO: 395676 - RNA, 32 nt, Human
cucagcuugaagcagggccucgugccccggcg

SEQ ID NO: 395677 - RNA, 32 nt, Human
cucagcuugaauacaguuccuggugcaucaaa

SEQ ID NO: 395678 - RNA, 32 nt, Human
cucagcuugacuucugucaugaaucagugcuc

SEQ ID NO: 395679 - RNA, 23 nt, Human
cucagcuugcuccccuccucccu

SEQ ID NO: 395680 - RNA, 32 nt, Human
cucagcuugggucagggcagagccuguuaccu

SEQ ID NO: 395681 - RNA, 32 nt, Human
cucagcuugucuggacaguguuuuucaaaucc

SEQ ID NO: 395682 - RNA, 32 nt, Human
cucagcuugugagcuucuucccgggagagcag

SEQ ID NO: 395683 - RNA, 32 nt, Human
cucccaaaaugcugggauuacaggugugagcc

SEQ ID NO: 395684 - RNA, 32 nt, Human
cucccaaaaugcugggauuacaugcaugagcc

SEQ ID NO: 395685 - RNA, 32 nt, Human
cucccaaaaugcugggauuaccggugugagcc

SEQ ID NO: 395686 - RNA, 24 nt, Human
cucccaaaaugcugggauuagagg

SEQ ID NO: 395687 - RNA, 32 nt, Human
cucccaaaaugcugggauuagaggugugagcc

SEQ ID NO: 395688 - RNA, 32 nt, Human
cucccaaaaugcugggauuauaggcaugagcc

SEQ ID NO: 395689 - RNA, 32 nt, Human
cucccaaaaugcugggauugcagacauggacc

SEQ ID NO: 395690 - RNA, 32 nt, Human
cucccaaaaugcugggguuacaggcaugagcc

SEQ ID NO: 395691 - RNA, 32 nt, Human
cucccaaaaugcuucgauugcaggcaugagcc

SEQ ID NO: 395692 - RNA, 32 nt, Human
cucccaaaaugcuuggauuacaggcaugaacc

SEQ ID NO: 395693 - RNA, 32 nt, Human
cucccaaaauggugggauuacagguguguggg

SEQ ID NO: 395694 - RNA, 24 nt, Human
cucccaaaauguugagauugcagg

SEQ ID NO: 395695 - RNA, 32 nt, Human
cucccaaaauguugcaauuacaggcaugagca

SEQ ID NO: 395696 - RNA, 23 nt, Human
cucccaaaauguugggauuacag

SEQ ID NO: 395697 - RNA, 32 nt, Human
cucccaaaauguugggauuacaggcaugagcc

SEQ ID NO: 395698 - RNA, 24 nt, Human
cucccaaaauucugggauuacagg

SEQ ID NO: 395699 - RNA, 32 nt, Human
cucccaaaauucugggauuacaggcauaagcc

SEQ ID NO: 395700 - RNA, 32 nt, Human
cucccaaaauucugggauuacaggcaugagcc

SEQ ID NO: 395701 - RNA, 32 nt, Human
cucccaaaccagagucauaugcugcuaguaga

SEQ ID NO: 395702 - RNA, 21 nt, Human
cucccaaaccagccugccugg

SEQ ID NO: 395703 - RNA, 32 nt, Human
cucccaaacccagcacuccagacucgagggaa

SEQ ID NO: 395704 - RNA, 32 nt, Human
cucccaaacuaccugucaccauggcccaccga

SEQ ID NO: 395705 - RNA, 20 nt, Human
cucccaaacuccugccugcc

SEQ ID NO: 395706 - RNA, 32 nt, Human
cucccaaacuccugccugcccuccagacuguc

SEQ ID NO: 395707 - RNA, 24 nt, Human
cucccaaacugcugggauuacagg

SEQ ID NO: 395708 - RNA, 32 nt, Human
cucccaaacugcugggauuacaggcgugaacc

SEQ ID NO: 395709 - RNA, 32 nt, Human
cucccaaacugcugggauuacaggcgugagcc

SEQ ID NO: 395710 - RNA, 32 nt, Human
cucccaaacugcugggauuacaggcgugugcc

SEQ ID NO: 395711 - RNA, 32 nt, Human
cucccaaacugcugggauuacaggugugagcc

SEQ ID NO: 395712 - RNA, 24 nt, Human
cucccaaacuucugggauuacagg

SEQ ID NO: 395713 - RNA, 24 nt, Human
cucccaaagaacugggauuacagg

SEQ ID NO: 395714 - RNA, 24 nt, Human
cucccaaagagcugggauuacagg

SEQ ID NO: 395715 - RNA, 32 nt, Human
cucccaaagagcugggauuacaggcaugagcc

SEQ ID NO: 395716 - RNA, 32 nt, Human
cucccaaagagcugggauuacaggcgugagac

SEQ ID NO: 395717 - RNA, 24 nt, Human
cucccaaagcacugggauuacagg

SEQ ID NO: 395718 - RNA, 32 nt, Human
cucccaaagcccuugucccacagccauuuaaa

SEQ ID NO: 395719 - RNA, 24 nt, Human
cucccaaagcgcugggauuacagg

SEQ ID NO: 395720 - RNA, 32 nt, Human
cucccaaagcgcugggauuacaggcaugagcc

SEQ ID NO: 395721 - RNA, 32 nt, Human
cucccaaagcgcugggauuacaggcgugagcc

SEQ ID NO: 395722 - RNA, 24 nt, Human
cucccaaagcgcugggauuauagg

SEQ ID NO: 395723 - RNA, 24 nt, Human
cucccaaagcguugggauuauagg

SEQ ID NO: 395724 - RNA, 24 nt, Human
cucccaaagggcugggauuacagg

SEQ ID NO: 395725 - RNA, 24 nt, Human
cucccaaaggguugggauuacagg

SEQ ID NO: 395726 - RNA, 22 nt, Human
cucccaaaguacugggauuaca

SEQ ID NO: 395727 - RNA, 32 nt, Human
cucccaaaguacugggauuacaaacauaagcc

SEQ ID NO: 395728 - RNA, 24 nt, Human
cucccaaaguacugggauuacagg

SEQ ID NO: 395729 - RNA, 32 nt, Human
cucccaaaguacugggauuacaggcaugaacc

SEQ ID NO: 395730 - RNA, 32 nt, Human
cucccaaaguacugggauuacaggcaugagca

SEQ ID NO: 395731 - RNA, 32 nt, Human
cucccaaaguacugggauuacaggcaugagcc

SEQ ID NO: 395732 - RNA, 32 nt, Human
cucccaaaguacugggauuacaggccugagcc

SEQ ID NO: 395733 - RNA, 32 nt, Human
cucccaaaguacugggauuacaggcgugaacc

SEQ ID NO: 395734 - RNA, 32 nt, Human
cucccaaaguacugggauuacaggcgugagcc

SEQ ID NO: 395735 - RNA, 24 nt, Human
cucccaaaguacugggauuauagg

SEQ ID NO: 395736 - RNA, 32 nt, Human
cucccaaaguacugggauuauaggcaugagcc

SEQ ID NO: 395737 - RNA, 32 nt, Human
cucccaaaguacugggauuauaggcgugagcc

SEQ ID NO: 395738 - RNA, 32 nt, Human
cucccaaaguacugggauuauaggugugaacc

SEQ ID NO: 395739 - RNA, 32 nt, Human
cucccaaaguacugggauuauaggugugagcu

SEQ ID NO: 395740 - RNA, 32 nt, Human
cucccaaaguacugggauuuaggcaugagcca

SEQ ID NO: 395741 - RNA, 32 nt, Human
cucccaaaguauugggauuacccgcgugagcc

SEQ ID NO: 395742 - RNA, 32 nt, Human
cucccaaaguccucggauuacaggcaugagcc

SEQ ID NO: 395743 - RNA, 32 nt, Human
cucccaaaguccuggaauuacaggcaugaguc

SEQ ID NO: 395744 - RNA, 24 nt, Human
cucccaaaguccugggauuacagg

SEQ ID NO: 395745 - RNA, 32 nt, Human
cucccaaaguccugggauuacaggcgugagcc

SEQ ID NO: 395746 - RNA, 32 nt, Human
cucccaaaguccugggauuacaggcugagcca

SEQ ID NO: 395747 - RNA, 32 nt, Human
cucccaaagugauggaauuacaggugugaauc

SEQ ID NO: 395748 - RNA, 32 nt, Human
cucccaaagugaugggauuacaggcaugagcc

SEQ ID NO: 395749 - RNA, 32 nt, Human
cucccaaagugaugggauuacaggcgugagcc

SEQ ID NO: 395750 - RNA, 32 nt, Human
cucccaaagugcagggauuacaggcacaagcc

SEQ ID NO: 395751 - RNA, 32 nt, Human
cucccaaagugcagggauuacaggcaugagcc

SEQ ID NO: 395752 - RNA, 32 nt, Human
cucccaaagugccaggauuacaggcaugagcc

SEQ ID NO: 395753 - RNA, 32 nt, Human
cucccaaagugccaggauuacaggcgugagcc

SEQ ID NO: 395754 - RNA, 32 nt, Human
cucccaaagugccgagauuacaggugugagcc

SEQ ID NO: 395755 - RNA, 23 nt, Human
cucccaaagugccgagauugcag

SEQ ID NO: 395756 - RNA, 32 nt, Human
cucccaaagugccgccgggauuacaggcguga

SEQ ID NO: 395757 - RNA, 32 nt, Human
cucccaaagugccgggaugacaggcaugagcc

SEQ ID NO: 395758 - RNA, 32 nt, Human
cucccaaagugccgggauuacaggcauaagcc

SEQ ID NO: 395759 - RNA, 32 nt, Human
cucccaaagugccgggauuacaggcaugagcc

SEQ ID NO: 395760 - RNA, 32 nt, Human
cucccaaagugccgggauuacaggcgugagcc

SEQ ID NO: 395761 - RNA, 32 nt, Human
cucccaaagugcuaagauuacaggcauggguc

SEQ ID NO: 395762 - RNA, 32 nt, Human
cucccaaagugcuaagauuacaggcgugagcc

SEQ ID NO: 395763 - RNA, 32 nt, Human
cucccaaagugcuagaauuacaggcauuagcc

SEQ ID NO: 395764 - RNA, 32 nt, Human
cucccaaagugcuagaauuacaggugugagcc

SEQ ID NO: 395765 - RNA, 32 nt, Human
cucccaaagugcuaggaccacaggcaugagcc

SEQ ID NO: 395766 - RNA, 32 nt, Human
cucccaaagugcuaggauuacagacaugagcc

SEQ ID NO: 395767 - RNA, 32 nt, Human
cucccaaagugcuaggauuacagcgugaucua

SEQ ID NO: 395768 - RNA, 32 nt, Human
cucccaaagugcuaggauuacaggcauaagcc

SEQ ID NO: 395769 - RNA, 32 nt, Human
cucccaaagugcuaggauuacaggcaucagcc

SEQ ID NO: 395770 - RNA, 32 nt, Human
cucccaaagugcuaggauuacaggcaugaacc

SEQ ID NO: 395771 - RNA, 32 nt, Human
cucccaaagugcuaggauuacaggcaugagca

SEQ ID NO: 395772 - RNA, 32 nt, Human
cucccaaagugcuaggauuacaggcaugagcc

SEQ ID NO: 395773 - RNA, 32 nt, Human
cucccaaagugcuaggauuacaggcaugggcc

SEQ ID NO: 395774 - RNA, 32 nt, Human
cucccaaagugcuaggauuacaggcccgugcc

SEQ ID NO: 395775 - RNA, 32 nt, Human
cucccaaagugcuaggauuacaggccugagac

SEQ ID NO: 395776 - RNA, 32 nt, Human
cucccaaagugcuaggauuacaggcgugagcc

SEQ ID NO: 395777 - RNA, 32 nt, Human
cucccaaagugcuaggauuacaggcgugugcc

SEQ ID NO: 395778 - RNA, 32 nt, Human
cucccaaagugcuaggauuacaggcuggagcu

SEQ ID NO: 395779 - RNA, 32 nt, Human
cucccaaagugcuaggauuacagguaugagcc

SEQ ID NO: 395780 - RNA, 32 nt, Human
cucccaaagugcuaggauuacagguguaagcc

SEQ ID NO: 395781 - RNA, 32 nt, Human
cucccaaagugcuaggauuacaggugugagcc

SEQ ID NO: 395782 - RNA, 32 nt, Human
cucccaaagugcuaugauuacagacgugagcc

SEQ ID NO: 395783 - RNA, 32 nt, Human
cucccaaagugcucggauuacagacaugagcc

SEQ ID NO: 395784 - RNA, 24 nt, Human
cucccaaagugcugaaauuacagg

SEQ ID NO: 395785 - RNA, 32 nt, Human
cucccaaagugcugaaauuacaggcaugagcc

SEQ ID NO: 395786 - RNA, 24 nt, Human
cucccaaagugcugacauuacagg

SEQ ID NO: 395787 - RNA, 32 nt, Human
cucccaaagugcugacauuacaggugugagcc

SEQ ID NO: 395788 - RNA, 22 nt, Human
cucccaaagugcugagauuaca

SEQ ID NO: 395789 - RNA, 23 nt, Human
cucccaaagugcugagauuacag

SEQ ID NO: 395790 - RNA, 32 nt, Human
cucccaaagugcugagauuacagacaugagcc

SEQ ID NO: 395791 - RNA, 32 nt, Human
cucccaaagugcugagauuacagacgugagcc

SEQ ID NO: 395792 - RNA, 24 nt, Human
cucccaaagugcugagauuacagg

SEQ ID NO: 395793 - RNA, 32 nt, Human
cucccaaagugcugagauuacaggcauaaacc

SEQ ID NO: 395794 - RNA, 32 nt, Human
cucccaaagugcugagauuacaggcauaagcc

SEQ ID NO: 395795 - RNA, 32 nt, Human
cucccaaagugcugagauuacaggcaugaacc

SEQ ID NO: 395796 - RNA, 32 nt, Human
cucccaaagugcugagauuacaggcaugaccc

SEQ ID NO: 395797 - RNA, 32 nt, Human
cucccaaagugcugagauuacaggcaugagcc

SEQ ID NO: 395798 - RNA, 32 nt, Human
cucccaaagugcugagauuacaggcaugaguc

SEQ ID NO: 395799 - RNA, 32 nt, Human
cucccaaagugcugagauuacaggccugagcc

SEQ ID NO: 395800 - RNA, 32 nt, Human
cucccaaagugcugagauuacaggcgugagcc

SEQ ID NO: 395801 - RNA, 32 nt, Human
cucccaaagugcugagauuacaggcgugagcu

SEQ ID NO: 395802 - RNA, 32 nt, Human
cucccaaagugcugagauuacaggcgugaggc

SEQ ID NO: 395803 - RNA, 32 nt, Human
cucccaaagugcugagauuacaggcuugaacc

SEQ ID NO: 395804 - RNA, 32 nt, Human
cucccaaagugcugagauuacaggcuugagcc

SEQ ID NO: 395805 - RNA, 32 nt, Human
cucccaaagugcugagauuacaggggugaguc

SEQ ID NO: 395806 - RNA, 32 nt, Human
cucccaaagugcugagauuacagguguaagcc

SEQ ID NO: 395807 - RNA, 32 nt, Human
cucccaaagugcugagauuacaggugugagcc

SEQ ID NO: 395808 - RNA, 32 nt, Human
cucccaaagugcugagauuacaggugugagcu

SEQ ID NO: 395809 - RNA, 24 nt, Human
cucccaaagugcugagauuacugg

SEQ ID NO: 395810 - RNA, 24 nt, Human
cucccaaagugcugagauuauagg

SEQ ID NO: 395811 - RNA, 23 nt, Human
cucccaaagugcugagauugcag

SEQ ID NO: 395812 - RNA, 32 nt, Human
cucccaaagugcugauauuacaggcgugagcc

SEQ ID NO: 395813 - RNA, 32 nt, Human
cucccaaagugcugccauuacaggcgugagcc

SEQ ID NO: 395814 - RNA, 23 nt, Human
cucccaaagugcugcgauuacag

SEQ ID NO: 395815 - RNA, 24 nt, Human
cucccaaagugcugcgauuacagg

SEQ ID NO: 395816 - RNA, 32 nt, Human
cucccaaagugcugcgauuacaggcaugagcc

SEQ ID NO: 395817 - RNA, 32 nt, Human
cucccaaagugcugcgauuacaggcgugagcc

SEQ ID NO: 395818 - RNA, 32 nt, Human
cucccaaagugcugcugggauuacaggcguga

SEQ ID NO: 395819 - RNA, 24 nt, Human
cucccaaagugcuggaaccacagg

SEQ ID NO: 395820 - RNA, 24 nt, Human
cucccaaagugcuggaauaacagg

SEQ ID NO: 395821 - RNA, 24 nt, Human
cucccaaagugcuggaaucacagg

SEQ ID NO: 395822 - RNA, 23 nt, Human
cucccaaagugcuggaauuacag

SEQ ID NO: 395823 - RNA, 32 nt, Human
cucccaaagugcuggaauuacagcuuacaggg

SEQ ID NO: 395824 - RNA, 24 nt, Human
cucccaaagugcuggaauuacagg

SEQ ID NO: 395825 - RNA, 32 nt, Human
cucccaaagugcuggaauuacaggcaugagcc

SEQ ID NO: 395826 - RNA, 32 nt, Human
cucccaaagugcuggaauuacaggcauuagcc

SEQ ID NO: 395827 - RNA, 32 nt, Human
cucccaaagugcuggaauuacaggcgaaccuu

SEQ ID NO: 395828 - RNA, 32 nt, Human
cucccaaagugcuggaauuacaggcgugagcc

SEQ ID NO: 395829 - RNA, 24 nt, Human
cucccaaagugcuggaauuacugg

SEQ ID NO: 395830 - RNA, 24 nt, Human
cucccaaagugcuggaauuagagg

SEQ ID NO: 395831 - RNA, 24 nt, Human
cucccaaagugcuggaauuauagg

SEQ ID NO: 395832 - RNA, 23 nt, Human
cucccaaagugcuggaauugcag

SEQ ID NO: 395833 - RNA, 23 nt, Human
cucccaaagugcuggauuacagg

SEQ ID NO: 395834 - RNA, 24 nt, Human
cucccaaagugcuggcacuacagg

SEQ ID NO: 395835 - RNA, 32 nt, Human
cucccaaagugcuggcacuacaggcaugagcc

SEQ ID NO: 395836 - RNA, 24 nt, Human
cucccaaagugcuggcauuacagg

SEQ ID NO: 395837 - RNA, 32 nt, Human
cucccaaagugcuggcauuacaggcgugagcc

SEQ ID NO: 395838 - RNA, 32 nt, Human
cucccaaagugcuggcauuacaggcgugugcc

SEQ ID NO: 395839 - RNA, 32 nt, Human
cucccaaagugcuggcauuacagguaugagcc

SEQ ID NO: 395840 - RNA, 32 nt, Human
cucccaaagugcuggcauuacaggugugagcc

SEQ ID NO: 395841 - RNA, 24 nt, Human
cucccaaagugcugggaauacagg

SEQ ID NO: 395842 - RNA, 32 nt, Human
cucccaaagugcugggaauacaggcaugagcc

SEQ ID NO: 395843 - RNA, 32 nt, Human
cucccaaagugcugggacuacagacaugagcc

SEQ ID NO: 395844 - RNA, 32 nt, Human
cucccaaagugcugggacuacaggcaggagcc

SEQ ID NO: 395845 - RNA, 32 nt, Human
cucccaaagugcugggacuacaggcaugagcc

SEQ ID NO: 395846 - RNA, 32 nt, Human
cucccaaagugcugggacuacaggcgugagcc

SEQ ID NO: 395847 - RNA, 32 nt, Human
cucccaaagugcugggacuacaggugcaugca

SEQ ID NO: 395848 - RNA, 32 nt, Human
cucccaaagugcugggacuauaagugugagcc

SEQ ID NO: 395849 - RNA, 32 nt, Human
cucccaaagugcugggacugcaggcgugagcc

SEQ ID NO: 395850 - RNA, 24 nt, Human
cucccaaagugcugggauaauagg

SEQ ID NO: 395851 - RNA, 32 nt, Human
cucccaaagugcugggauaauaggugucagcc

SEQ ID NO: 395852 - RNA, 23 nt, Human
cucccaaagugcugggaucacag

SEQ ID NO: 395853 - RNA, 32 nt, Human
cucccaaagugcugggaucacagacgugagcc

SEQ ID NO: 395854 - RNA, 24 nt, Human
cucccaaagugcugggaucacagg

SEQ ID NO: 395855 - RNA, 32 nt, Human
cucccaaagugcugggaucacaggcaugaacc

SEQ ID NO: 395856 - RNA, 32 nt, Human
cucccaaagugcugggaucacaggcaugagcc

SEQ ID NO: 395857 - RNA, 32 nt, Human
cucccaaagugcugggaucacaggcgccagcc

SEQ ID NO: 395858 - RNA, 32 nt, Human
cucccaaagugcugggaucacaggcgugagcu

SEQ ID NO: 395859 - RNA, 24 nt, Human
cucccaaagugcugggaugacagg

SEQ ID NO: 395860 - RNA, 32 nt, Human
cucccaaagugcugggaugacaggcaugaauc

SEQ ID NO: 395861 - RNA, 32 nt, Human
cucccaaagugcugggaugacaggcgugagcc

SEQ ID NO: 395862 - RNA, 32 nt, Human
cucccaaagugcugggaugacaggcgugaucc

SEQ ID NO: 395863 - RNA, 32 nt, Human
cucccaaagugcugggaugacaggcgugcgcc

SEQ ID NO: 395864 - RNA, 32 nt, Human
cucccaaagugcugggaugacaggugugagcc

SEQ ID NO: 395865 - RNA, 32 nt, Human
cucccaaagugcugggaugacaguugugagcc

SEQ ID NO: 395866 - RNA, 32 nt, Human
cucccaaagugcugggaugaccagcaucagcc

SEQ ID NO: 395867 - RNA, 24 nt, Human
cucccaaagugcugggaugauagg

SEQ ID NO: 395868 - RNA, 32 nt, Human
cucccaaagugcugggaugauaggcgugagcc

SEQ ID NO: 395869 - RNA, 32 nt, Human
cucccaaagugcugggaugccaggcgugaguc

SEQ ID NO: 395870 - RNA, 19 nt, Human
cucccaaagugcugggauu

SEQ ID NO: 395871 - RNA, 23 nt, Human
cucccaaagugcugggauuaaag

SEQ ID NO: 395872 - RNA, 24 nt, Human
cucccaaagugcugggauuaaagg

SEQ ID NO: 395873 - RNA, 32 nt, Human
cucccaaagugcugggauuaaaggcgugagcc

SEQ ID NO: 395874 - RNA, 32 nt, Human
cucccaaagugcugggauuaaaggugugagcc

SEQ ID NO: 395875 - RNA, 32 nt, Human
cucccaaagugcugggauuaacagguaugaac

SEQ ID NO: 395876 - RNA, 23 nt, Human
cucccaaagugcugggauuaagg

SEQ ID NO: 395877 - RNA, 32 nt, Human
cucccaaagugcugggauuaauggcgugagcc

SEQ ID NO: 395878 - RNA, 22 nt, Human
cucccaaagugcugggauuaca

SEQ ID NO: 395879 - RNA, 32 nt, Human
cucccaaagugcugggauuacaagcaugagcc

SEQ ID NO: 395880 - RNA, 32 nt, Human
cucccaaagugcugggauuacaagggugagcc

SEQ ID NO: 395881 - RNA, 32 nt, Human
cucccaaagugcugggauuacaaguaugagcc

SEQ ID NO: 395882 - RNA, 32 nt, Human
cucccaaagugcugggauuacaagugugagcc

SEQ ID NO: 395883 - RNA, 23 nt, Human
cucccaaagugcugggauuacag

SEQ ID NO: 395884 - RNA, 32 nt, Human
cucccaaagugcugggauuacagacacgagcc

SEQ ID NO: 395885 - RNA, 32 nt, Human
cucccaaagugcugggauuacagacaugaacu

SEQ ID NO: 395886 - RNA, 32 nt, Human
cucccaaagugcugggauuacagacaugagca

SEQ ID NO: 395887 - RNA, 32 nt, Human
cucccaaagugcugggauuacagacaugagcc

SEQ ID NO: 395888 - RNA, 32 nt, Human
cucccaaagugcugggauuacagacgugagcc

SEQ ID NO: 395889 - RNA, 32 nt, Human
cucccaaagugcugggauuacagacgugagcg

SEQ ID NO: 395890 - RNA, 32 nt, Human
cucccaaagugcugggauuacagacgugagcu

SEQ ID NO: 395891 - RNA, 32 nt, Human
cucccaaagugcugggauuacagacgugaggc

SEQ ID NO: 395892 - RNA, 32 nt, Human
cucccaaagugcugggauuacagacgugaucc

SEQ ID NO: 395893 - RNA, 32 nt, Human
cucccaaagugcugggauuacagagugugagc

SEQ ID NO: 395894 - RNA, 32 nt, Human
cucccaaagugcugggauuacagccacugcac

SEQ ID NO: 395895 - RNA, 32 nt, Human
cucccaaagugcugggauuacagcccugagcg

SEQ ID NO: 395896 - RNA, 32 nt, Human
cucccaaagugcugggauuacagccgugagcc

SEQ ID NO: 395897 - RNA, 32 nt, Human
cucccaaagugcugggauuacagcgaagagcc

SEQ ID NO: 395898 - RNA, 32 nt, Human
cucccaaagugcugggauuacagcugugagcc

SEQ ID NO: 395899 - RNA, 24 nt, Human
cucccaaagugcugggauuacagg

SEQ ID NO: 395900 - RNA, 32 nt, Human
cucccaaagugcugggauuacaggaauuuagu

SEQ ID NO: 395901 - RNA, 32 nt, Human
cucccaaagugcugggauuacaggagugaacc

SEQ ID NO: 395902 - RNA, 32 nt, Human
cucccaaagugcugggauuacaggagugagca

SEQ ID NO: 395903 - RNA, 32 nt, Human
cucccaaagugcugggauuacaggagugagcc

SEQ ID NO: 395904 - RNA, 32 nt, Human
cucccaaagugcugggauuacaggagugugcc

SEQ ID NO: 395905 - RNA, 32 nt, Human
cucccaaagugcugggauuacaggaugagcca

SEQ ID NO: 395906 - RNA, 32 nt, Human
cucccaaagugcugggauuacaggcaacucug

SEQ ID NO: 395907 - RNA, 32 nt, Human
cucccaaagugcugggauuacaggcaccgaga

SEQ ID NO: 395908 - RNA, 32 nt, Human
cucccaaagugcugggauuacaggcacgagcc

SEQ ID NO: 395909 - RNA, 32 nt, Human
cucccaaagugcugggauuacaggcaggagcc

SEQ ID NO: 395910 - RNA, 32 nt, Human
cucccaaagugcugggauuacaggcauaagcc

SEQ ID NO: 395911 - RNA, 32 nt, Human
cucccaaagugcugggauuacaggcaucagcc

SEQ ID NO: 395912 - RNA, 32 nt, Human
cucccaaagugcugggauuacaggcaugaacc

SEQ ID NO: 395913 - RNA, 32 nt, Human
cucccaaagugcugggauuacaggcaugaauc

SEQ ID NO: 395914 - RNA, 32 nt, Human
cucccaaagugcugggauuacaggcaugaaug

SEQ ID NO: 395915 - RNA, 32 nt, Human
cucccaaagugcugggauuacaggcaugaccc

SEQ ID NO: 395916 - RNA, 32 nt, Human
cucccaaagugcugggauuacaggcaugagcc

SEQ ID NO: 395917 - RNA, 32 nt, Human
cucccaaagugcugggauuacaggcaugagcu

SEQ ID NO: 395918 - RNA, 32 nt, Human
cucccaaagugcugggauuacaggcaugaguc

SEQ ID NO: 395919 - RNA, 32 nt, Human
cucccaaagugcugggauuacaggcauggagc

SEQ ID NO: 395920 - RNA, 32 nt, Human
cucccaaagugcugggauuacaggccacuaca

SEQ ID NO: 395921 - RNA, 32 nt, Human
cucccaaagugcugggauuacaggccccuugu

SEQ ID NO: 395922 - RNA, 32 nt, Human
cucccaaagugcugggauuacaggccugagcc

SEQ ID NO: 395923 - RNA, 32 nt, Human
cucccaaagugcugggauuacaggccuggccc

SEQ ID NO: 395924 - RNA, 32 nt, Human
cucccaaagugcugggauuacaggcgcaagcc

SEQ ID NO: 395925 - RNA, 32 nt, Human
cucccaaagugcugggauuacaggcgccaccg

SEQ ID NO: 395926 - RNA, 32 nt, Human
cucccaaagugcugggauuacaggcgcgagcc

SEQ ID NO: 395927 - RNA, 32 nt, Human
cucccaaagugcugggauuacaggcggccagg

SEQ ID NO: 395928 - RNA, 32 nt, Human
cucccaaagugcugggauuacaggcgggagcc

SEQ ID NO: 395929 - RNA, 32 nt, Human
cucccaaagugcugggauuacaggcguaagcc

SEQ ID NO: 395930 - RNA, 32 nt, Human
cucccaaagugcugggauuacaggcgucagcc

SEQ ID NO: 395931 - RNA, 32 nt, Human
cucccaaagugcugggauuacaggcgugaaac

SEQ ID NO: 395932 - RNA, 32 nt, Human
cucccaaagugcugggauuacaggcgugaacc

SEQ ID NO: 395933 - RNA, 32 nt, Human
cucccaaagugcugggauuacaggcgugacga

SEQ ID NO: 395934 - RNA, 32 nt, Human
cucccaaagugcugggauuacaggcgugagac

SEQ ID NO: 395935 - RNA, 32 nt, Human
cucccaaagugcugggauuacaggcgugagca

SEQ ID NO: 395936 - RNA, 32 nt, Human
cucccaaagugcugggauuacaggcgugagcc

SEQ ID NO: 395937 - RNA, 32 nt, Human
cucccaaagugcugggauuacaggcgugagcu

SEQ ID NO: 395938 - RNA, 32 nt, Human
cucccaaagugcugggauuacaggcgugaggc

SEQ ID NO: 395939 - RNA, 32 nt, Human
cucccaaagugcugggauuacaggcgugaguc

SEQ ID NO: 395940 - RNA, 32 nt, Human
cucccaaagugcugggauuacaggcgugaucc

SEQ ID NO: 395941 - RNA, 32 nt, Human
cucccaaagugcugggauuacaggcgugaugc

SEQ ID NO: 395942 - RNA, 32 nt, Human
cucccaaagugcugggauuacaggcgugggcc

SEQ ID NO: 395943 - RNA, 32 nt, Human
cucccaaagugcugggauuacaggcgugugcc

SEQ ID NO: 395944 - RNA, 32 nt, Human
cucccaaagugcugggauuacaggcguuagcc

SEQ ID NO: 395945 - RNA, 32 nt, Human
cucccaaagugcugggauuacaggcucaugcc

SEQ ID NO: 395946 - RNA, 32 nt, Human
cucccaaagugcugggauuacaggcuguaaag

SEQ ID NO: 395947 - RNA, 32 nt, Human
cucccaaagugcugggauuacaggcuuaagcc

SEQ ID NO: 395948 - RNA, 32 nt, Human
cucccaaagugcugggauuacaggcuucagcc

SEQ ID NO: 395949 - RNA, 32 nt, Human
cucccaaagugcugggauuacaggcuugaaag

SEQ ID NO: 395950 - RNA, 32 nt, Human
cucccaaagugcugggauuacaggcuugaccc

SEQ ID NO: 395951 - RNA, 32 nt, Human
cucccaaagugcugggauuacaggcuugagcc

SEQ ID NO: 395952 - RNA, 32 nt, Human
cucccaaagugcugggauuacaggcuugggcc

SEQ ID NO: 395953 - RNA, 32 nt, Human
cucccaaagugcugggauuacagggauaagcc

SEQ ID NO: 395954 - RNA, 32 nt, Human
cucccaaagugcugggauuacagggaugagcc

SEQ ID NO: 395955 - RNA, 32 nt, Human
cucccaaagugcugggauuacagggcacugaa

SEQ ID NO: 395956 - RNA, 32 nt, Human
cucccaaagugcugggauuacaggggagagcu

SEQ ID NO: 395957 - RNA, 32 nt, Human
cucccaaagugcugggauuacaggggagccac

SEQ ID NO: 395958 - RNA, 32 nt, Human
cucccaaagugcugggauuacagguacgaguc

SEQ ID NO: 395959 - RNA, 32 nt, Human
cucccaaagugcugggauuacagguaucagcc

SEQ ID NO: 395960 - RNA, 32 nt, Human
cucccaaagugcugggauuacagguaugagcc

SEQ ID NO: 395961 - RNA, 32 nt, Human
cucccaaagugcugggauuacaggugcgagcc

SEQ ID NO: 395962 - RNA, 32 nt, Human
cucccaaagugcugggauuacaggugggagcc

SEQ ID NO: 395963 - RNA, 32 nt, Human
cucccaaagugcugggauuacagguguaagcc

SEQ ID NO: 395964 - RNA, 32 nt, Human
cucccaaagugcugggauuacagguguaaguc

SEQ ID NO: 395965 - RNA, 32 nt, Human
cucccaaagugcugggauuacaggugucagcc

SEQ ID NO: 395966 - RNA, 32 nt, Human
cucccaaagugcugggauuacaggugugaacc

SEQ ID NO: 395967 - RNA, 32 nt, Human
cucccaaagugcugggauuacaggugugaccc

SEQ ID NO: 395968 - RNA, 32 nt, Human
cucccaaagugcugggauuacaggugugagca

SEQ ID NO: 395969 - RNA, 32 nt, Human
cucccaaagugcugggauuacaggugugagcc

SEQ ID NO: 395970 - RNA, 32 nt, Human
cucccaaagugcugggauuacaggugugagcu

SEQ ID NO: 395971 - RNA, 32 nt, Human
cucccaaagugcugggauuacaggugugaggc

SEQ ID NO: 395972 - RNA, 32 nt, Human
cucccaaagugcugggauuacaggugugaguc

SEQ ID NO: 395973 - RNA, 32 nt, Human
cucccaaagugcugggauuacaggugugcgcc

SEQ ID NO: 395974 - RNA, 32 nt, Human
cucccaaagugcugggauuacaggugugcguc

SEQ ID NO: 395975 - RNA, 32 nt, Human
cucccaaagugcugggauuacaggugugggag

SEQ ID NO: 395976 - RNA, 32 nt, Human
cucccaaagugcugggauuacagguguuccug

SEQ ID NO: 395977 - RNA, 32 nt, Human
cucccaaagugcugggauuacagguuugagcc

SEQ ID NO: 395978 - RNA, 32 nt, Human
cucccaaagugcugggauuacagucaugagcc

SEQ ID NO: 395979 - RNA, 32 nt, Human
cucccaaagugcugggauuacagucaugaguc

SEQ ID NO: 395980 - RNA, 32 nt, Human
cucccaaagugcugggauuacagucgugagcc

SEQ ID NO: 395981 - RNA, 32 nt, Human
cucccaaagugcugggauuacaguugcgagcc

SEQ ID NO: 395982 - RNA, 24 nt, Human
cucccaaagugcugggauuaccag

SEQ ID NO: 395983 - RNA, 32 nt, Human
cucccaaagugcugggauuaccagcauaagcc

SEQ ID NO: 395984 - RNA, 32 nt, Human
cucccaaagugcugggauuacccacauccuag

SEQ ID NO: 395985 - RNA, 24 nt, Human
cucccaaagugcugggauuaccgg

SEQ ID NO: 395986 - RNA, 32 nt, Human
cucccaaagugcugggauuaccggcaugagcc

SEQ ID NO: 395987 - RNA, 32 nt, Human
cucccaaagugcugggauuaccggcuugagcc

SEQ ID NO: 395988 - RNA, 32 nt, Human
cucccaaagugcugggauuaccgguaugaacc

SEQ ID NO: 395989 - RNA, 24 nt, Human
cucccaaagugcugggauuacggg

SEQ ID NO: 395990 - RNA, 32 nt, Human
cucccaaagugcugggauuacgggcaugagcc

SEQ ID NO: 395991 - RNA, 32 nt, Human
cucccaaagugcugggauuacgggugugagcc

SEQ ID NO: 395992 - RNA, 32 nt, Human
cucccaaagugcugggauuacgguguuagcca

SEQ ID NO: 395993 - RNA, 32 nt, Human
cucccaaagugcugggauuacuagacguaagc

SEQ ID NO: 395994 - RNA, 24 nt, Human
cucccaaagugcugggauuacugg

SEQ ID NO: 395995 - RNA, 32 nt, Human
cucccaaagugcugggauuacuggcaugagcc

SEQ ID NO: 395996 - RNA, 32 nt, Human
cucccaaagugcugggauuacugguaugaacc

SEQ ID NO: 395997 - RNA, 32 nt, Human
cucccaaagugcugggauuacuggugugagcc

SEQ ID NO: 395998 - RNA, 32 nt, Human
cucccaaagugcugggauuacuuuacaggcgu

SEQ ID NO: 395999 - RNA, 24 nt, Human
cucccaaagugcugggauuagagg

SEQ ID NO: 396000 - RNA, 32 nt, Human
cucccaaagugcugggauuagaggcaugagcc

SEQ ID NO: 396001 - RNA, 32 nt, Human
cucccaaagugcugggauuagaggcgugagcc

SEQ ID NO: 396002 - RNA, 32 nt, Human
cucccaaagugcugggauuagaggcuugagcc

SEQ ID NO: 396003 - RNA, 32 nt, Human
cucccaaagugcugggauuaggugugagccac

SEQ ID NO: 396004 - RNA, 32 nt, Human
cucccaaagugcugggauuauacaugugagcc

SEQ ID NO: 396005 - RNA, 32 nt, Human
cucccaaagugcugggauuauacguaugggcc

SEQ ID NO: 396006 - RNA, 23 nt, Human
cucccaaagugcugggauuauag

SEQ ID NO: 396007 - RNA, 32 nt, Human
cucccaaagugcugggauuauagaugugagcc

SEQ ID NO: 396008 - RNA, 24 nt, Human
cucccaaagugcugggauuauagg

SEQ ID NO: 396009 - RNA, 32 nt, Human
cucccaaagugcugggauuauaggagugagcc

SEQ ID NO: 396010 - RNA, 32 nt, Human
cucccaaagugcugggauuauaggcacaagac

SEQ ID NO: 396011 - RNA, 32 nt, Human
cucccaaagugcugggauuauaggcaugaacc

SEQ ID NO: 396012 - RNA, 32 nt, Human
cucccaaagugcugggauuauaggcaugagcc

SEQ ID NO: 396013 - RNA, 32 nt, Human
cucccaaagugcugggauuauaggcaugcgcc

SEQ ID NO: 396014 - RNA, 32 nt, Human
cucccaaagugcugggauuauaggccugagcc

SEQ ID NO: 396015 - RNA, 32 nt, Human
cucccaaagugcugggauuauaggcguaagcc

SEQ ID NO: 396016 - RNA, 32 nt, Human
cucccaaagugcugggauuauaggcgugagac

SEQ ID NO: 396017 - RNA, 32 nt, Human
cucccaaagugcugggauuauaggcgugagcc

SEQ ID NO: 396018 - RNA, 32 nt, Human
cucccaaagugcugggauuauaggcgugaguc

SEQ ID NO: 396019 - RNA, 32 nt, Human
cucccaaagugcugggauuauaggcgugugcc

SEQ ID NO: 396020 - RNA, 32 nt, Human
cucccaaagugcugggauuauaggcugggugu

SEQ ID NO: 396021 - RNA, 32 nt, Human
cucccaaagugcugggauuauagggaugaguc

SEQ ID NO: 396022 - RNA, 32 nt, Human
cucccaaagugcugggauuauaggugugagcc

SEQ ID NO: 396023 - RNA, 32 nt, Human
cucccaaagugcugggauuauggacgugagcc

SEQ ID NO: 396024 - RNA, 24 nt, Human
cucccaaagugcugggauuauggg

SEQ ID NO: 396025 - RNA, 32 nt, Human
cucccaaagugcugggauuccaggcgugagcc

SEQ ID NO: 396026 - RNA, 32 nt, Human
cucccaaagugcugggauucccggcgugagcc

SEQ ID NO: 396027 - RNA, 32 nt, Human
cucccaaagugcugggauugaaggcgugaguc

SEQ ID NO: 396028 - RNA, 32 nt, Human
cucccaaagugcugggauugcagccgugaacc

SEQ ID NO: 396029 - RNA, 24 nt, Human
cucccaaagugcugggauugcagg

SEQ ID NO: 396030 - RNA, 32 nt, Human
cucccaaagugcugggauugcaggcaugagcc

SEQ ID NO: 396031 - RNA, 32 nt, Human
cucccaaagugcugggauugcaggcauggccc

SEQ ID NO: 396032 - RNA, 32 nt, Human
cucccaaagugcugggauugcaggcgugagcc

SEQ ID NO: 396033 - RNA, 32 nt, Human
cucccaaagugcugggauugcaggugcgagcc

SEQ ID NO: 396034 - RNA, 32 nt, Human
cucccaaagugcugggauugcaggugugaacu

SEQ ID NO: 396035 - RNA, 32 nt, Human
cucccaaagugcugggauugcaggugugagcc

SEQ ID NO: 396036 - RNA, 23 nt, Human
cucccaaagugcugggauuguag

SEQ ID NO: 396037 - RNA, 32 nt, Human
cucccaaagugcugggauugugggugugagcc

SEQ ID NO: 396038 - RNA, 32 nt, Human
cucccaaagugcugggauuucaggcgugagcc

SEQ ID NO: 396039 - RNA, 24 nt, Human
cucccaaagugcugggcuuacagg

SEQ ID NO: 396040 - RNA, 32 nt, Human
cucccaaagugcugggguuacaggcaugagcc

SEQ ID NO: 396041 - RNA, 32 nt, Human
cucccaaagugcugggguuacaggcgugagcc

SEQ ID NO: 396042 - RNA, 32 nt, Human
cucccaaagugcugggguuacaggcguguguc

SEQ ID NO: 396043 - RNA, 32 nt, Human
cucccaaagugcuggguuaacaggcaugagcc

SEQ ID NO: 396044 - RNA, 23 nt, Human
cucccaaagugcugguauuacag

SEQ ID NO: 396045 - RNA, 24 nt, Human
cucccaaagugcugguauuacagg

SEQ ID NO: 396046 - RNA, 32 nt, Human
cucccaaagugcugguauuacaggcgugagcc

SEQ ID NO: 396047 - RNA, 24 nt, Human
cucccaaagugcuguaauuacagg

SEQ ID NO: 396048 - RNA, 32 nt, Human
cucccaaagugcuguaauuacaggcaugagcc

SEQ ID NO: 396049 - RNA, 24 nt, Human
cucccaaagugcugugauuacagg

SEQ ID NO: 396050 - RNA, 32 nt, Human
cucccaaagugcugugauuacaggccucagcc

SEQ ID NO: 396051 - RNA, 32 nt, Human
cucccaaagugcugugauuacaggugugaacc

SEQ ID NO: 396052 - RNA, 32 nt, Human
cucccaaagugcugugauuacaggugugagcc

SEQ ID NO: 396053 - RNA, 32 nt, Human
cucccaaagugcuuggauuacaggcauaagcc

SEQ ID NO: 396054 - RNA, 32 nt, Human
cucccaaagugcuuggauuacaggcaugagcc

SEQ ID NO: 396055 - RNA, 32 nt, Human
cucccaaagugcuuggauuacagguguaagcc

SEQ ID NO: 396056 - RNA, 32 nt, Human
cucccaaagugguaggauuacaggcgugagcc

SEQ ID NO: 396057 - RNA, 32 nt, Human
cucccaaaguggugggauuacagacgugagcc

SEQ ID NO: 396058 - RNA, 32 nt, Human
cucccaaaguggugggauuacaggugugagcc

SEQ ID NO: 396059 - RNA, 32 nt, Human
cucccaaaguggugggauuauaggcaugagcc

SEQ ID NO: 396060 - RNA, 32 nt, Human
cucccaaaguguagggauuacaggcgugagcc

SEQ ID NO: 396061 - RNA, 32 nt, Human
cucccaaaguguggggauuacgggugugagcc

SEQ ID NO: 396062 - RNA, 32 nt, Human
cucccaaaguguuaggauuacaggcaugagcc

SEQ ID NO: 396063 - RNA, 32 nt, Human
cucccaaaguguuaggauuacaggcgugagcc

SEQ ID NO: 396064 - RNA, 32 nt, Human
cucccaaaguguucggauuacaaacgugagcc

SEQ ID NO: 396065 - RNA, 24 nt, Human
cucccaaaguguugagauuacagg

SEQ ID NO: 396066 - RNA, 32 nt, Human
cucccaaaguguugagauuacaggcaugagcc

SEQ ID NO: 396067 - RNA, 24 nt, Human
cucccaaaguguuggaauugcagg

SEQ ID NO: 396068 - RNA, 23 nt, Human
cucccaaaguguugggauuacag

SEQ ID NO: 396069 - RNA, 32 nt, Human
cucccaaaguguugggauuacagacauuagcc

SEQ ID NO: 396070 - RNA, 24 nt, Human
cucccaaaguguugggauuacagg

SEQ ID NO: 396071 - RNA, 32 nt, Human
cucccaaaguguugggauuacaggcaagagcc

SEQ ID NO: 396072 - RNA, 32 nt, Human
cucccaaaguguugggauuacaggcauaagca

SEQ ID NO: 396073 - RNA, 32 nt, Human
cucccaaaguguugggauuacaggcaugaauc

SEQ ID NO: 396074 - RNA, 32 nt, Human
cucccaaaguguugggauuacaggcaugagac

SEQ ID NO: 396075 - RNA, 32 nt, Human
cucccaaaguguugggauuacaggcaugagcc

SEQ ID NO: 396076 - RNA, 32 nt, Human
cucccaaaguguugggauuacaggcgugagcc

SEQ ID NO: 396077 - RNA, 32 nt, Human
cucccaaaguguugggauuacaggcgugaguc

SEQ ID NO: 396078 - RNA, 32 nt, Human
cucccaaaguguugggauuacaggcgugagug

SEQ ID NO: 396079 - RNA, 32 nt, Human
cucccaaaguguugggauuacaggugugaacc

SEQ ID NO: 396080 - RNA, 32 nt, Human
cucccaaaguguugggauuacaggugugagcc

SEQ ID NO: 396081 - RNA, 32 nt, Human
cucccaaaguguugggauuacagguguguguc

SEQ ID NO: 396082 - RNA, 32 nt, Human
cucccaaaguguugggauuacaugcaugagcc

SEQ ID NO: 396083 - RNA, 24 nt, Human
cucccaaaguguugggauuauagg

SEQ ID NO: 396084 - RNA, 32 nt, Human
cucccaaaguguugggauuauaggcaugagcc

SEQ ID NO: 396085 - RNA, 32 nt, Human
cucccaaaguguugggauuauaggcgugagcc

SEQ ID NO: 396086 - RNA, 32 nt, Human
cucccaaaguguugggauuauagguaugagcc

SEQ ID NO: 396087 - RNA, 24 nt, Human
cucccaaaguguugggauuauggg

SEQ ID NO: 396088 - RNA, 23 nt, Human
cucccaaaguguugggauugcag

SEQ ID NO: 396089 - RNA, 24 nt, Human
cucccaaaguguugggauugcagg

SEQ ID NO: 396090 - RNA, 24 nt, Human
cucccaaaguguugggauuucagg

SEQ ID NO: 396091 - RNA, 32 nt, Human
cucccaaaguguugugauuacaggcgugagcc

SEQ ID NO: 396092 - RNA, 32 nt, Human
cucccaaaguucuaggauuacaggugugagcc

SEQ ID NO: 396093 - RNA, 32 nt, Human
cucccaaaguucucggauuacaggcgugagcc

SEQ ID NO: 396094 - RNA, 22 nt, Human
cucccaaaguucugggauuaca

SEQ ID NO: 396095 - RNA, 32 nt, Human
cucccaaaguucugggauuacaagugugaacc

SEQ ID NO: 396096 - RNA, 32 nt, Human
cucccaaaguucugggauuacaagugugagcc

SEQ ID NO: 396097 - RNA, 24 nt, Human
cucccaaaguucugggauuacagg

SEQ ID NO: 396098 - RNA, 32 nt, Human
cucccaaaguucugggauuacaggcaugagcc

SEQ ID NO: 396099 - RNA, 32 nt, Human
cucccaaaguucugggauuacaggcgugagcc

SEQ ID NO: 396100 - RNA, 32 nt, Human
cucccaaaguucugggauuacaggcuugagcc

SEQ ID NO: 396101 - RNA, 32 nt, Human
cucccaaaguucugggauuacagguaugagcc

SEQ ID NO: 396102 - RNA, 32 nt, Human
cucccaaaguucugggauuacaggugugagcc

SEQ ID NO: 396103 - RNA, 32 nt, Human
cucccaaaguucugggauuacgggcgugagcc

SEQ ID NO: 396104 - RNA, 24 nt, Human
cucccaaaguucugggauuauggg

SEQ ID NO: 396105 - RNA, 32 nt, Human
cucccaaaguucugggauuaugggugugagcc

SEQ ID NO: 396106 - RNA, 32 nt, Human
cucccaaaguuuugggauuacaagugugggcc

SEQ ID NO: 396107 - RNA, 32 nt, Human
cucccaaauagcuaugauuacaggcacccgcc

SEQ ID NO: 396108 - RNA, 32 nt, Human
cucccaaauagcugggacuacaggcacaggcc

SEQ ID NO: 396109 - RNA, 24 nt, Human
cucccaaauagcugggauuacagg

SEQ ID NO: 396110 - RNA, 32 nt, Human
cucccaaauagcugggauuacaggcacccacc

SEQ ID NO: 396111 - RNA, 32 nt, Human
cucccaaauagcugggauuacaggugcaugcc

SEQ ID NO: 396112 - RNA, 32 nt, Human
cucccaaauagcugggauuacaguugccugcc

SEQ ID NO: 396113 - RNA, 32 nt, Human
cucccaaauagcugugauuacaggcgugcacc

SEQ ID NO: 396114 - RNA, 24 nt, Human
cucccaaauaguugggauuacagg

SEQ ID NO: 396115 - RNA, 32 nt, Human
cucccaaauaguugggauuacaggcacaugcc

SEQ ID NO: 396116 - RNA, 22 nt, Human
cucccaaaugcugggauuacag

SEQ ID NO: 396117 - RNA, 32 nt, Human
cucccaaauugccgggauuacaggcaugagcc

SEQ ID NO: 396118 - RNA, 32 nt, Human
cucccaaauugcuccccaccucccaucccugu

SEQ ID NO: 396119 - RNA, 24 nt, Human
cucccaaauugcugggauuacagg

SEQ ID NO: 396120 - RNA, 32 nt, Human
cucccaaauugcugggauuacaggcaugagcc

SEQ ID NO: 396121 - RNA, 32 nt, Human
cucccaaauugcugggauuacaggcgugagcc

SEQ ID NO: 396122 - RNA, 32 nt, Human
cucccaaauugcugggauuacaggugugagcc

SEQ ID NO: 396123 - RNA, 24 nt, Human
cucccaaauugcugggauuccagg

SEQ ID NO: 396124 - RNA, 32 nt, Human
cucccaaauugcugggauuuacaggcaugagc

SEQ ID NO: 396125 - RNA, 32 nt, Human
cucccaaauugucagccuucuuaccuggccaa

SEQ ID NO: 396126 - RNA, 24 nt, Human
cucccaaauuguugggauuauagg

SEQ ID NO: 396127 - RNA, 32 nt, Human
cucccaaauuguugggauuauaggcgugagcc

SEQ ID NO: 396128 - RNA, 31 nt, Human
cucccaacaaacuccagaacagcagaaagcg

SEQ ID NO: 396129 - RNA, 23 nt, Human
cucccaacaacuacaacccugga

SEQ ID NO: 396130 - RNA, 22 nt, Human
cucccaacaagugcucuuucca

SEQ ID NO: 396131 - RNA, 32 nt, Human
cucccaacaguugcuguuccucaggccaaagu

SEQ ID NO: 396132 - RNA, 32 nt, Human
cucccaacaugcuggcauuacagguaugagcc

SEQ ID NO: 396133 - RNA, 32 nt, Human
cucccaacaugcugggauuacaggcgugagcc

SEQ ID NO: 396134 - RNA, 32 nt, Human
cucccaacaugcugggauuauagacauuagcc

SEQ ID NO: 396135 - RNA, 32 nt, Human
cucccaacccacccauucuuuuuccuggcacu

SEQ ID NO: 396136 - RNA, 21 nt, Human
cucccaacccagaggaggcag

SEQ ID NO: 396137 - RNA, 32 nt, Human
cucccaaccccugcuccagccacgccaacccu

SEQ ID NO: 396138 - RNA, 32 nt, Human
cucccaaccuacacccucaaguagaccccagu

SEQ ID NO: 396139 - RNA, 23 nt, Human
cucccaaccuauguccccauucc

SEQ ID NO: 396140 - RNA, 32 nt, Human
cucccaaccucgggggaccuagccaagcuagg

SEQ ID NO: 396141 - RNA, 32 nt, Human
cucccaaccucuugcucuggauuugcagaaga

SEQ ID NO: 396142 - RNA, 32 nt, Human
cucccaaccuggcaguccccagccucccagca

SEQ ID NO: 396143 - RNA, 22 nt, Human
cucccaacgcccggcgccgccg

SEQ ID NO: 396144 - RNA, 32 nt, Human
cucccaacgugcuggaauuacaggcaugagcc

SEQ ID NO: 396145 - RNA, 23 nt, Human
cucccaacgugcugggauuacag

SEQ ID NO: 396146 - RNA, 32 nt, Human
cucccaacgugcugggauuacagccggugguc

SEQ ID NO: 396147 - RNA, 24 nt, Human
cucccaacgugcugggauuacagg

SEQ ID NO: 396148 - RNA, 32 nt, Human
cucccaacgugcugggauuacaggcaugagcc

SEQ ID NO: 396149 - RNA, 32 nt, Human
cucccaacgugcugggauuacaggugugagcc

SEQ ID NO: 396150 - RNA, 24 nt, Human
cucccaacgugcugggauuauagg

SEQ ID NO: 396151 - RNA, 32 nt, Human
cucccaacgugcugggauuauaggcgugagcc

SEQ ID NO: 396152 - RNA, 32 nt, Human
cucccaacuagcugggauuacaggcgugcgcc

SEQ ID NO: 396153 - RNA, 32 nt, Human
cucccaacucagccuguuccuuccugcagacc

SEQ ID NO: 396154 - RNA, 32 nt, Human
cucccaacucauuagcuccugggcagcauccu

SEQ ID NO: 396155 - RNA, 32 nt, Human
cucccaacuugcugggauuacaggugugagcc

SEQ ID NO: 396156 - RNA, 32 nt, Human
cucccaagaagcuagaaccacauguacacacc

SEQ ID NO: 396157 - RNA, 24 nt, Human
cucccaagaagcugggauuacagg

SEQ ID NO: 396158 - RNA, 32 nt, Human
cucccaagaagcugggauuacaggcaugcgcc

SEQ ID NO: 396159 - RNA, 32 nt, Human
cucccaagaauacaaaaauuagccaggcaugg

SEQ ID NO: 396160 - RNA, 21 nt, Human
cucccaagacaucugccugcc

SEQ ID NO: 396161 - RNA, 32 nt, Human
cucccaagaccacagaggauaagggcuggugg

SEQ ID NO: 396162 - RNA, 32 nt, Human
cucccaagagccuccaaggcgccauuggcuuc

SEQ ID NO: 396163 - RNA, 32 nt, Human
cucccaagcagcugcaacuacaggcacacucc

SEQ ID NO: 396164 - RNA, 23 nt, Human
cucccaagcagcugggauuauag

SEQ ID NO: 396165 - RNA, 24 nt, Human
cucccaagcagcugggauuauagg

SEQ ID NO: 396166 - RNA, 24 nt, Human
cucccaagcagcugggauuguagg

SEQ ID NO: 396167 - RNA, 32 nt, Human
cucccaagcccaggcuuuggcacucagaaugg

SEQ ID NO: 396168 - RNA, 32 nt, Human
cucccaagccccgcccucagaaagccaaguac

SEQ ID NO: 396169 - RNA, 22 nt, Human
cucccaagcuggaguccagugg

SEQ ID NO: 396170 - RNA, 32 nt, Human
cucccaaggaagcacaaauaguuuuugucgcu

SEQ ID NO: 396171 - RNA, 24 nt, Human
cucccaaggagcugggauuacagg

SEQ ID NO: 396172 - RNA, 24 nt, Human
cucccaaggagcugggguuacagg

SEQ ID NO: 396173 - RNA, 32 nt, Human
cucccaaggauguggaggggcagugaggccug

SEQ ID NO: 396174 - RNA, 32 nt, Human
cucccaaggugcuaggauuacaggcaugagcc

SEQ ID NO: 396175 - RNA, 32 nt, Human
cucccaaggugcugagauuacaggcgugagcc

SEQ ID NO: 396176 - RNA, 32 nt, Human
cucccaaggugcugauaguacaggcaugaacc

SEQ ID NO: 396177 - RNA, 24 nt, Human
cucccaaggugcuggaauuacagg

SEQ ID NO: 396178 - RNA, 32 nt, Human
cucccaaggugcuggaauuacaggugugagcc

SEQ ID NO: 396179 - RNA, 23 nt, Human
cucccaaggugcuggauuacagg

SEQ ID NO: 396180 - RNA, 24 nt, Human
cucccaaggugcugggacuacagg

SEQ ID NO: 396181 - RNA, 32 nt, Human
cucccaaggugcugggacuacaggcguggguc

SEQ ID NO: 396182 - RNA, 22 nt, Human
cucccaaggugcugggauuaca

SEQ ID NO: 396183 - RNA, 24 nt, Human
cucccaaggugcugggauuacagg

SEQ ID NO: 396184 - RNA, 32 nt, Human
cucccaaggugcugggauuacaggcacgagcc

SEQ ID NO: 396185 - RNA, 32 nt, Human
cucccaaggugcugggauuacaggcauaagcu

SEQ ID NO: 396186 - RNA, 32 nt, Human
cucccaaggugcugggauuacaggcaugagcc

SEQ ID NO: 396187 - RNA, 32 nt, Human
cucccaaggugcugggauuacaggcaugaggg

SEQ ID NO: 396188 - RNA, 32 nt, Human
cucccaaggugcugggauuacaggugugagcc

SEQ ID NO: 396189 - RNA, 24 nt, Human
cucccaaggugcugggauuauagg

SEQ ID NO: 396190 - RNA, 23 nt, Human
cucccaaggugcugggauugcag

SEQ ID NO: 396191 - RNA, 32 nt, Human
cucccaaggugcugggauugcagacgugagcc

SEQ ID NO: 396192 - RNA, 24 nt, Human
cucccaaggugcugggauugcagg

SEQ ID NO: 396193 - RNA, 32 nt, Human
cucccaaggugcugggauugcaggccggccuu

SEQ ID NO: 396194 - RNA, 32 nt, Human
cucccaaggugcugggauugcaggcgugagcc

SEQ ID NO: 396195 - RNA, 32 nt, Human
cucccaagguggcagugguggcagcagugauc

SEQ ID NO: 396196 - RNA, 24 nt, Human
cucccaagguguugggaccacagg

SEQ ID NO: 396197 - RNA, 23 nt, Human
cucccaagguguugggauuacag

SEQ ID NO: 396198 - RNA, 32 nt, Human
cucccaagguguugggauuacaggcgugagcc

SEQ ID NO: 396199 - RNA, 24 nt, Human
cucccaagguguugggauugcagg

SEQ ID NO: 396200 - RNA, 24 nt, Human
cucccaaguaacugggauuacagg

SEQ ID NO: 396201 - RNA, 32 nt, Human
cucccaaguagauuacaggauuacaggagccc

SEQ ID NO: 396202 - RNA, 32 nt, Human
cucccaaguagcagggauuacaggcaugcacc

SEQ ID NO: 396203 - RNA, 32 nt, Human
cucccaaguagccgggacuacaggugccugcc

SEQ ID NO: 396204 - RNA, 32 nt, Human
cucccaaguagcuaggauuacaggcaugugcc

SEQ ID NO: 396205 - RNA, 32 nt, Human
cucccaaguagcugagacuacaagcacccacc

SEQ ID NO: 396206 - RNA, 32 nt, Human
cucccaaguagcugagauuacaggcacaugcc

SEQ ID NO: 396207 - RNA, 32 nt, Human
cucccaaguagcugagauuacaggcauccgcc

SEQ ID NO: 396208 - RNA, 32 nt, Human
cucccaaguagcugagauuacaggcgcacacc

SEQ ID NO: 396209 - RNA, 32 nt, Human
cucccaaguagcugagauuacaggugugcacc

SEQ ID NO: 396210 - RNA, 32 nt, Human
cucccaaguagcuggaacuacaggcaugcacc

SEQ ID NO: 396211 - RNA, 32 nt, Human
cucccaaguagcuggaauuacaggcacauacc

SEQ ID NO: 396212 - RNA, 32 nt, Human
cucccaaguagcuggaauuacaggcaccugcc

SEQ ID NO: 396213 - RNA, 32 nt, Human
cucccaaguagcuggaauuacaggcgugugcc

SEQ ID NO: 396214 - RNA, 32 nt, Human
cucccaaguagcugggaauacaggcacgccac

SEQ ID NO: 396215 - RNA, 32 nt, Human
cucccaaguagcugggaccacaggcaugcacc

SEQ ID NO: 396216 - RNA, 32 nt, Human
cucccaaguagcugggacuacaggcacacacc

SEQ ID NO: 396217 - RNA, 32 nt, Human
cucccaaguagcugggacuacaggcacacacu

SEQ ID NO: 396218 - RNA, 32 nt, Human
cucccaaguagcugggacuacaggcacacgcc

SEQ ID NO: 396219 - RNA, 32 nt, Human
cucccaaguagcugggacuacaggcacccacc

SEQ ID NO: 396220 - RNA, 32 nt, Human
cucccaaguagcugggacuacaggcacccgcc

SEQ ID NO: 396221 - RNA, 32 nt, Human
cucccaaguagcugggacuacaggcaccugcc

SEQ ID NO: 396222 - RNA, 32 nt, Human
cucccaaguagcugggacuacaggcacgugcc

SEQ ID NO: 396223 - RNA, 32 nt, Human
cucccaaguagcugggacuacaggcaggugcc

SEQ ID NO: 396224 - RNA, 32 nt, Human
cucccaaguagcugggacuacaggcauaugcc

SEQ ID NO: 396225 - RNA, 32 nt, Human
cucccaaguagcugggacuacaggcaugaacc

SEQ ID NO: 396226 - RNA, 32 nt, Human
cucccaaguagcugggacuacaggcaugagcc

SEQ ID NO: 396227 - RNA, 32 nt, Human
cucccaaguagcugggacuacaggcaugcacc

SEQ ID NO: 396228 - RNA, 32 nt, Human
cucccaaguagcugggacuacaggcaugcacu

SEQ ID NO: 396229 - RNA, 32 nt, Human
cucccaaguagcugggacuacaggcaugcgcc

SEQ ID NO: 396230 - RNA, 32 nt, Human
cucccaaguagcugggacuacaggcauguaac

SEQ ID NO: 396231 - RNA, 32 nt, Human
cucccaaguagcugggacuacaggcauguacc

SEQ ID NO: 396232 - RNA, 24 nt, Human
cucccaaguagcugggauaacagg

SEQ ID NO: 396233 - RNA, 32 nt, Human
cucccaaguagcugggauaacaggcgcccacc

SEQ ID NO: 396234 - RNA, 24 nt, Human
cucccaaguagcugggaucacagg

SEQ ID NO: 396235 - RNA, 32 nt, Human
cucccaaguagcugggaugacaggcgcacacc

SEQ ID NO: 396236 - RNA, 24 nt, Human
cucccaaguagcugggauuaaagg

SEQ ID NO: 396237 - RNA, 32 nt, Human
cucccaaguagcugggauuaaaggcacgugcc

SEQ ID NO: 396238 - RNA, 23 nt, Human
cucccaaguagcugggauuaagg

SEQ ID NO: 396239 - RNA, 32 nt, Human
cucccaaguagcugggauuaaggcgccugcca

SEQ ID NO: 396240 - RNA, 23 nt, Human
cucccaaguagcugggauuacag

SEQ ID NO: 396241 - RNA, 32 nt, Human
cucccaaguagcugggauuacagaugccugcc

SEQ ID NO: 396242 - RNA, 32 nt, Human
cucccaaguagcugggauuacagcgauugguu

SEQ ID NO: 396243 - RNA, 24 nt, Human
cucccaaguagcugggauuacagg

SEQ ID NO: 396244 - RNA, 32 nt, Human
cucccaaguagcugggauuacaggcacaaacc

SEQ ID NO: 396245 - RNA, 32 nt, Human
cucccaaguagcugggauuacaggcacaggcc

SEQ ID NO: 396246 - RNA, 32 nt, Human
cucccaaguagcugggauuacaggcacaugcc

SEQ ID NO: 396247 - RNA, 32 nt, Human
cucccaaguagcugggauuacaggcacccacc

SEQ ID NO: 396248 - RNA, 32 nt, Human
cucccaaguagcugggauuacaggcacccacg

SEQ ID NO: 396249 - RNA, 32 nt, Human
cucccaaguagcugggauuacaggcacccgcc

SEQ ID NO: 396250 - RNA, 32 nt, Human
cucccaaguagcugggauuacaggcaccuacc

SEQ ID NO: 396251 - RNA, 32 nt, Human
cucccaaguagcugggauuacaggcaccugcc

SEQ ID NO: 396252 - RNA, 32 nt, Human
cucccaaguagcugggauuacaggcacgcgcc

SEQ ID NO: 396253 - RNA, 32 nt, Human
cucccaaguagcugggauuacaggcacgcucc

SEQ ID NO: 396254 - RNA, 32 nt, Human
cucccaaguagcugggauuacaggcagacacg

SEQ ID NO: 396255 - RNA, 32 nt, Human
cucccaaguagcugggauuacaggcagcacca

SEQ ID NO: 396256 - RNA, 32 nt, Human
cucccaaguagcugggauuacaggcauacacc

SEQ ID NO: 396257 - RNA, 32 nt, Human
cucccaaguagcugggauuacaggcaugcacc

SEQ ID NO: 396258 - RNA, 32 nt, Human
cucccaaguagcugggauuacaggcaugcacu

SEQ ID NO: 396259 - RNA, 32 nt, Human
cucccaaguagcugggauuacaggcaugcgcc

SEQ ID NO: 396260 - RNA, 32 nt, Human
cucccaaguagcugggauuacaggcaugggcc

SEQ ID NO: 396261 - RNA, 32 nt, Human
cucccaaguagcugggauuacaggcauguacc

SEQ ID NO: 396262 - RNA, 32 nt, Human
cucccaaguagcugggauuacaggcauguacu

SEQ ID NO: 396263 - RNA, 32 nt, Human
cucccaaguagcugggauuacaggcaugugcc

SEQ ID NO: 396264 - RNA, 32 nt, Human
cucccaaguagcugggauuacaggcgcacgcc

SEQ ID NO: 396265 - RNA, 32 nt, Human
cucccaaguagcugggauuacaggcgcauugg

SEQ ID NO: 396266 - RNA, 32 nt, Human
cucccaaguagcugggauuacaggcgccugcc

SEQ ID NO: 396267 - RNA, 32 nt, Human
cucccaaguagcugggauuacaggcgcgugcc

SEQ ID NO: 396268 - RNA, 32 nt, Human
cucccaaguagcugggauuacaggcguccgcc

SEQ ID NO: 396269 - RNA, 32 nt, Human
cucccaaguagcugggauuacaggcgugcacc

SEQ ID NO: 396270 - RNA, 32 nt, Human
cucccaaguagcugggauuacaggcguguacc

SEQ ID NO: 396271 - RNA, 32 nt, Human
cucccaaguagcugggauuacagguaccugcc

SEQ ID NO: 396272 - RNA, 32 nt, Human
cucccaaguagcugggauuacaggugcacacc

SEQ ID NO: 396273 - RNA, 32 nt, Human
cucccaaguagcugggauuacaggugcaggcc

SEQ ID NO: 396274 - RNA, 32 nt, Human
cucccaaguagcugggauuacaggugcccaac

SEQ ID NO: 396275 - RNA, 32 nt, Human
cucccaaguagcugggauuacaggugcccacc

SEQ ID NO: 396276 - RNA, 32 nt, Human
cucccaaguagcugggauuacaggugcccgcc

SEQ ID NO: 396277 - RNA, 32 nt, Human
cucccaaguagcugggauuacaggugccugcc

SEQ ID NO: 396278 - RNA, 32 nt, Human
cucccaaguagcugggauuacaggugcucacc

SEQ ID NO: 396279 - RNA, 32 nt, Human
cucccaaguagcugggauuacagguguccgcc

SEQ ID NO: 396280 - RNA, 32 nt, Human
cucccaaguagcugggauuacaggugugagcc

SEQ ID NO: 396281 - RNA, 32 nt, Human
cucccaaguagcugggauuacaggugugcacc

SEQ ID NO: 396282 - RNA, 32 nt, Human
cucccaaguagcugggauuacaggugugcacu

SEQ ID NO: 396283 - RNA, 32 nt, Human
cucccaaguagcugggauuacaggugugcgcc

SEQ ID NO: 396284 - RNA, 32 nt, Human
cucccaaguagcugggauuacaggugugugcc

SEQ ID NO: 396285 - RNA, 32 nt, Human
cucccaaguagcugggauuacagucaggcacc

SEQ ID NO: 396286 - RNA, 32 nt, Human
cucccaaguagcugggauuacagugccugcca

SEQ ID NO: 396287 - RNA, 32 nt, Human
cucccaaguagcugggauuacaugugugugcc

SEQ ID NO: 396288 - RNA, 24 nt, Human
cucccaaguagcugggauuacggg

SEQ ID NO: 396289 - RNA, 32 nt, Human
cucccaaguagcugggauuacgggcaugcgcc

SEQ ID NO: 396290 - RNA, 32 nt, Human
cucccaaguagcugggauuauaggcaccugcc

SEQ ID NO: 396291 - RNA, 32 nt, Human
cucccaaguagcugggauuauaggcauccacu

SEQ ID NO: 396292 - RNA, 32 nt, Human
cucccaaguagcugggauuauaggugugugcc

SEQ ID NO: 396293 - RNA, 32 nt, Human
cucccaaguagcugggauugcaggcgcccgcc

SEQ ID NO: 396294 - RNA, 32 nt, Human
cucccaaguagcugggauugcaggugcccacc

SEQ ID NO: 396295 - RNA, 22 nt, Human
cucccaaguagcugggauugua

SEQ ID NO: 396296 - RNA, 32 nt, Human
cucccaaguagcugggauuguaagaguaugcc

SEQ ID NO: 396297 - RNA, 32 nt, Human
cucccaaguagcuggggcuacaggcacccacc

SEQ ID NO: 396298 - RNA, 24 nt, Human
cucccaaguagcugggguuacagg

SEQ ID NO: 396299 - RNA, 32 nt, Human
cucccaaguagcugggguuacaggcauuugcc

SEQ ID NO: 396300 - RNA, 32 nt, Human
cucccaaguaguugggacuacaggcaugcgcc

SEQ ID NO: 396301 - RNA, 24 nt, Human
cucccaaguaguugggauuacagg

SEQ ID NO: 396302 - RNA, 32 nt, Human
cucccaaguaguugggauuacaggcaccugcc

SEQ ID NO: 396303 - RNA, 32 nt, Human
cucccaaguaguugggauuacaggcaugcauc

SEQ ID NO: 396304 - RNA, 32 nt, Human
cucccaaguaguugggauuacgggcaugcacc

SEQ ID NO: 396305 - RNA, 24 nt, Human
cucccaaguaguugggauugcagg

SEQ ID NO: 396306 - RNA, 18 nt, Human
cucccaagucagacaccu

SEQ ID NO: 396307 - RNA, 23 nt, Human
cucccaagugcuggaauuacagg

SEQ ID NO: 396308 - RNA, 23 nt, Human
cucccaagugcugggauuacagg

SEQ ID NO: 396309 - RNA, 24 nt, Human
cucccaaguggcugggauuacagg

SEQ ID NO: 396310 - RNA, 32 nt, Human
cucccaaguggcugggauuacaggcgcaaacc

SEQ ID NO: 396311 - RNA, 24 nt, Human
cucccaaguggcugggauuauagg

SEQ ID NO: 396312 - RNA, 24 nt, Human
cucccaaguggcugggauugcagg

SEQ ID NO: 396313 - RNA, 32 nt, Human
cucccaaguggcugggauugcaggcaugagcu

SEQ ID NO: 396314 - RNA, 24 nt, Human
cucccaaguugcugggacuacagg

SEQ ID NO: 396315 - RNA, 19 nt, Human
cucccaauacagacgggug

SEQ ID NO: 396316 - RNA, 32 nt, Human
cucccaauacccacccuucucucucgagggau

SEQ ID NO: 396317 - RNA, 20 nt, Human
cucccaauagccgccgcccg

SEQ ID NO: 396318 - RNA, 32 nt, Human
cucccaauauuccuucucaaacuuggagaggg

SEQ ID NO: 396319 - RNA, 32 nt, Human
cucccaauccugcauaagaggucauagaaaca

SEQ ID NO: 396320 - RNA, 32 nt, Human
cucccaaucucuuuccuuucucucuucaguuc

SEQ ID NO: 396321 - RNA, 32 nt, Human
cucccaauggaggggagguugcaggggagagc

SEQ ID NO: 396322 - RNA, 32 nt, Human
cucccaaugugcuaggauuacaggcgugggcc

SEQ ID NO: 396323 - RNA, 23 nt, Human
cucccaaugugcugggauuacag

SEQ ID NO: 396324 - RNA, 24 nt, Human
cucccaaugugcugggauuacagg

SEQ ID NO: 396325 - RNA, 32 nt, Human
cucccaaugugcugggauuacaggcaugagcc

SEQ ID NO: 396326 - RNA, 32 nt, Human
cucccaauguguugggauuacaggcgugaacc

SEQ ID NO: 396327 - RNA, 18 nt, Human
cucccaauuacuauuuuc

SEQ ID NO: 396328 - RNA, 32 nt, Human
cucccaauuacuauuuucuuccuucccagcuc

SEQ ID NO: 396329 - RNA, 24 nt, Human
cucccaauuucagacucccauucc

SEQ ID NO: 396330 - RNA, 32 nt, Human
cucccacaaaggagagcuagcagcagggaggg

SEQ ID NO: 396331 - RNA, 32 nt, Human
cucccacaaccuuggacuccagcuggcagcug

SEQ ID NO: 396332 - RNA, 32 nt, Human
cucccacaagcaccugcucaacauaggccugc

SEQ ID NO: 396333 - RNA, 32 nt, Human
cucccacaauaacugcgugaagaaggaauuuu

SEQ ID NO: 396334 - RNA, 32 nt, Human
cucccacaaugcuggaauuacagguguuagcc

SEQ ID NO: 396335 - RNA, 32 nt, Human
cucccacacacacccacacacucgcccgccca

SEQ ID NO: 396336 - RNA, 32 nt, Human
cucccacacagcccuucccugaggcagcagga

SEQ ID NO: 396337 - RNA, 32 nt, Human
cucccacacccacagccccaggcuuucuucuu

SEQ ID NO: 396338 - RNA, 32 nt, Human
cucccacacccagccacuaccucccagcuugg

SEQ ID NO: 396339 - RNA, 32 nt, Human
cucccacacccccaaucuaccuggugaugauu

SEQ ID NO: 396340 - RNA, 32 nt, Human
cucccacaccgucagguacuccugccagggaa

SEQ ID NO: 396341 - RNA, 32 nt, Human
cucccacacguacacaugcacauguacgcacc

SEQ ID NO: 396342 - RNA, 32 nt, Human
cucccacacgugcucacccacccgcagccuag

SEQ ID NO: 396343 - RNA, 32 nt, Human
cucccacacugcucccaguccugggcacagug

SEQ ID NO: 396344 - RNA, 32 nt, Human
cucccacagagcccuggaaggccccagcccug

SEQ ID NO: 396345 - RNA, 32 nt, Human
cucccacagcacauccuacccggaagaccagc

SEQ ID NO: 396346 - RNA, 32 nt, Human
cucccacagcucuugaccaauguggccaaagc

SEQ ID NO: 396347 - RNA, 20 nt, Human
cucccacagcuugugcccuc

SEQ ID NO: 396348 - RNA, 32 nt, Human
cucccacagggcacgucaggugccucugaggg

SEQ ID NO: 396349 - RNA, 32 nt, Human
cucccacaggguggcaggacugggagaaucuc

SEQ ID NO: 396350 - RNA, 32 nt, Human
cucccacaguaaggagcucacagcugucauga

SEQ ID NO: 396351 - RNA, 24 nt, Human
cucccacagugcugggauuacagg

SEQ ID NO: 396352 - RNA, 32 nt, Human
cucccacagugcugggauuacaggagugagcc

SEQ ID NO: 396353 - RNA, 32 nt, Human
cucccacagugcugggauuacaggcaugggcc

SEQ ID NO: 396354 - RNA, 32 nt, Human
cucccacagugcugggauuacaggccugagcc

SEQ ID NO: 396355 - RNA, 32 nt, Human
cucccacagugcugggauuacaggcgugagcc

SEQ ID NO: 396356 - RNA, 24 nt, Human
cucccacagugcugggauuaccgg

SEQ ID NO: 396357 - RNA, 32 nt, Human
cucccacagugcugggauuaccggcgugagcc

SEQ ID NO: 396358 - RNA, 24 nt, Human
cucccacagugcugggauuagagg

SEQ ID NO: 396359 - RNA, 32 nt, Human
cucccacagugcugggauuagaggcaugagcc

SEQ ID NO: 396360 - RNA, 32 nt, Human
cucccacauccuggccucuccucuccacgguc

SEQ ID NO: 396361 - RNA, 32 nt, Human
cucccacauucccagggauuuuccccaucagu

SEQ ID NO: 396362 - RNA, 22 nt, Human
cucccaccaccccugccugcca

SEQ ID NO: 396363 - RNA, 32 nt, Human
cucccaccacccuccaccuagagcucacccaa

SEQ ID NO: 396364 - RNA, 32 nt, Human
cucccaccacggggucugcagcaaugaaggga

SEQ ID NO: 396365 - RNA, 32 nt, Human
cucccaccacugcacuccagccugggaagcag

SEQ ID NO: 396366 - RNA, 32 nt, Human
cucccaccacugcacuccagccugggcgacac

SEQ ID NO: 396367 - RNA, 21 nt, Human
cucccaccagggccccuccca

SEQ ID NO: 396368 - RNA, 31 nt, Human
cucccaccaguguccaggcaggcaggagccc

SEQ ID NO: 396369 - RNA, 32 nt, Human
cucccaccaucauuuuaaccuuccucagguuu

SEQ ID NO: 396370 - RNA, 18 nt, Human
cucccacccaacgcucca

SEQ ID NO: 396371 - RNA, 18 nt, Human
cucccacccaccccugcc

SEQ ID NO: 396372 - RNA, 32 nt, Human
cucccacccaccgccacugccaaccaagacau

SEQ ID NO: 396373 - RNA, 25 nt, Human
cucccacccaccuagcuccccccag

SEQ ID NO: 396374 - RNA, 32 nt, Human
cucccacccacugacucagggcucagacucag

SEQ ID NO: 396375 - RNA, 32 nt, Human
cucccacccacugagggcaggagggcuugugg

SEQ ID NO: 396376 - RNA, 32 nt, Human
cucccacccacuggcucccucccccagcgcuc

SEQ ID NO: 396377 - RNA, 32 nt, Human
cucccacccacuguagugcucccaccccugga

SEQ ID NO: 396378 - RNA, 18 nt, Human
cucccacccagcccugcc

SEQ ID NO: 396379 - RNA, 18 nt, Human
cucccaccccacccugcu

SEQ ID NO: 396380 - RNA, 32 nt, Human
cucccaccccaccuaccucacaggguuguugu

SEQ ID NO: 396381 - RNA, 32 nt, Human
cucccaccccaucccucuccccagucuuggau

SEQ ID NO: 396382 - RNA, 32 nt, Human
cucccaccccuccaagacccauucugcacagu

SEQ ID NO: 396383 - RNA, 18 nt, Human
cucccaccccugccccca

SEQ ID NO: 396384 - RNA, 32 nt, Human
cucccacccgagaacaggggccagguugcucc

SEQ ID NO: 396385 - RNA, 32 nt, Human
cucccacccgggacuacuugcuggugacuuuu

SEQ ID NO: 396386 - RNA, 32 nt, Human
cucccacccucccccugcuccccaccauucuc

SEQ ID NO: 396387 - RNA, 32 nt, Human
cucccacccucugagccucuucugcuccugca

SEQ ID NO: 396388 - RNA, 32 nt, Human
cucccacccugcccuggccuggguggaggaac

SEQ ID NO: 396389 - RNA, 32 nt, Human
cucccacccuucucuauugucuggacccagug

SEQ ID NO: 396390 - RNA, 19 nt, Human
cucccacccuucugucucc

SEQ ID NO: 396391 - RNA, 18 nt, Human
cucccacccuugccugcc

SEQ ID NO: 396392 - RNA, 32 nt, Human
cucccacccuuguguuucacuccaccaccaac

SEQ ID NO: 396393 - RNA, 20 nt, Human
cucccaccgagcugccugcc

SEQ ID NO: 396394 - RNA, 32 nt, Human
cucccaccgcaccuuccugaauagcugagacu

SEQ ID NO: 396395 - RNA, 20 nt, Human
cucccaccgccgccgccccg

SEQ ID NO: 396396 - RNA, 32 nt, Human
cucccaccgccgcggcaacggccccggcccac

SEQ ID NO: 396397 - RNA, 32 nt, Human
cucccaccgucuuccuccuacacaccaaugau

SEQ ID NO: 396398 - RNA, 32 nt, Human
cucccaccuacuguaguggagcugcucaacca

SEQ ID NO: 396399 - RNA, 32 nt, Human
cucccaccuauaauccuagcacuuugggaggc

SEQ ID NO: 396400 - RNA, 32 nt, Human
cucccaccucaaccucuagaauagcugggacu

SEQ ID NO: 396401 - RNA, 32 nt, Human
cucccaccucaaccucuuaaauagcugagacu

SEQ ID NO: 396402 - RNA, 32 nt, Human
cucccaccucagcaucccaaagcacugcuacu

SEQ ID NO: 396403 - RNA, 32 nt, Human
cucccaccucagccauccaaauagcugggacc

SEQ ID NO: 396404 - RNA, 32 nt, Human
cucccaccucagccucccaaauagcugggauc

SEQ ID NO: 396405 - RNA, 32 nt, Human
cucccaccucagccucccaaauagcugggauu

SEQ ID NO: 396406 - RNA, 32 nt, Human
cucccaccucagccucccgaauagcugggacu

SEQ ID NO: 396407 - RNA, 32 nt, Human
cucccaccucagccuccugaauagcugggacu

SEQ ID NO: 396408 - RNA, 32 nt, Human
cucccaccucagccucucaaauagcugggacu

SEQ ID NO: 396409 - RNA, 19 nt, Human
cucccaccucagccugcca

SEQ ID NO: 396410 - RNA, 32 nt, Human
cucccaccucagucuccugaaagcugggauga

SEQ ID NO: 396411 - RNA, 32 nt, Human
cucccaccuccaccucccaaacugcugggauu

SEQ ID NO: 396412 - RNA, 32 nt, Human
cucccaccuccaccucccaaagugcugggauu

SEQ ID NO: 396413 - RNA, 18 nt, Human
cucccaccucccgcccca

SEQ ID NO: 396414 - RNA, 18 nt, Human
cucccaccuccugauuca

SEQ ID NO: 396415 - RNA, 32 nt, Human
cucccaccucggcuucccaaagugcagagauu

SEQ ID NO: 396416 - RNA, 32 nt, Human
cucccaccucugagauuaggacaggaaaaaug

SEQ ID NO: 396417 - RNA, 18 nt, Human
cucccaccucugucugcc

SEQ ID NO: 396418 - RNA, 32 nt, Human
cucccaccucuucuacccucccccucuucuuu

SEQ ID NO: 396419 - RNA, 32 nt, Human
cucccaccugcacaugucacacugaccacauc

SEQ ID NO: 396420 - RNA, 32 nt, Human
cucccaccugcacaugucacacugaccccauc

SEQ ID NO: 396421 - RNA, 32 nt, Human
cucccaccugcaggguguucacuuuguggcuc

SEQ ID NO: 396422 - RNA, 32 nt, Human
cucccaccugcucaaucugacaggaagcuucu

SEQ ID NO: 396423 - RNA, 32 nt, Human
cucccaccugcucuucaugaggaguccuuuau

SEQ ID NO: 396424 - RNA, 18 nt, Human
cucccaccugcugccugc

SEQ ID NO: 396425 - RNA, 32 nt, Human
cucccaccuguagucccagcacuuugggaggc

SEQ ID NO: 396426 - RNA, 32 nt, Human
cucccaccuucaacucuuuucucccauuauuu

SEQ ID NO: 396427 - RNA, 32 nt, Human
cucccaccuucccagagucuccugggcagugc

SEQ ID NO: 396428 - RNA, 32 nt, Human
cucccaccuucccagaugguuccuuucugccc

SEQ ID NO: 396429 - RNA, 32 nt, Human
cucccaccuucucuccccuccucucugcuuua

SEQ ID NO: 396430 - RNA, 32 nt, Human
cucccaccuugcagccgugggaauguucuaug

SEQ ID NO: 396431 - RNA, 20 nt, Human
cucccacgcgacccugcagg

SEQ ID NO: 396432 - RNA, 32 nt, Human
cucccacgcugccccuaguccugggcauggag

SEQ ID NO: 396433 - RNA, 32 nt, Human
cucccacgcugcccuccugccugcagccauga

SEQ ID NO: 396434 - RNA, 17 nt, Human
cucccacuaaccccgcc

SEQ ID NO: 396435 - RNA, 20 nt, Human
cucccacuacagaccugcca

SEQ ID NO: 396436 - RNA, 21 nt, Human
cucccacuacugccacuacca

SEQ ID NO: 396437 - RNA, 19 nt, Human
cucccacuagggcccugcc

SEQ ID NO: 396438 - RNA, 32 nt, Human
cucccacucaaggcaccccauggagccuccug

SEQ ID NO: 396439 - RNA, 19 nt, Human
cucccacucaccacugcca

SEQ ID NO: 396440 - RNA, 19 nt, Human
cucccacucacccccagca

SEQ ID NO: 396441 - RNA, 20 nt, Human
cucccacucagaacucucca

SEQ ID NO: 396442 - RNA, 32 nt, Human
cucccacucaggaaguggguggggaagggaaa

SEQ ID NO: 396443 - RNA, 32 nt, Human
cucccacucagugugcucugcagcugugagga

SEQ ID NO: 396444 - RNA, 18 nt, Human
cucccacucauacccgcc

SEQ ID NO: 396445 - RNA, 21 nt, Human
cucccacuccauaccccgcca

SEQ ID NO: 396446 - RNA, 17 nt, Human
cucccacuccccuacca

SEQ ID NO: 396447 - RNA, 20 nt, Human
cucccacucccggccuguca

SEQ ID NO: 396448 - RNA, 18 nt, Human
cucccacucccguuucca

SEQ ID NO: 396449 - RNA, 17 nt, Human
cucccacucucccugcc

SEQ ID NO: 396450 - RNA, 32 nt, Human
cucccacucuccuaggcauucuggaccucugg

SEQ ID NO: 396451 - RNA, 21 nt, Human
cucccacugaaugcacuucua

SEQ ID NO: 396452 - RNA, 32 nt, Human
cucccacugcaacuuuucagcucagggguugu

SEQ ID NO: 396453 - RNA, 32 nt, Human
cucccacugcacuccagccugggcgacagagc

SEQ ID NO: 396454 - RNA, 32 nt, Human
cucccacugcacuccagcucggggaacagagc

SEQ ID NO: 396455 - RNA, 32 nt, Human
cucccacugcagccucugccugcucugccgcc

SEQ ID NO: 396456 - RNA, 32 nt, Human
cucccacugcaugcccggcccccagcccaccu

SEQ ID NO: 396457 - RNA, 21 nt, Human
cucccacugccaccaccgcca

SEQ ID NO: 396458 - RNA, 18 nt, Human
cucccacugcccccucca

SEQ ID NO: 396459 - RNA, 32 nt, Human
cucccacugccccucucugccucccacugauu

SEQ ID NO: 396460 - RNA, 20 nt, Human
cucccacugcccgccuguca

SEQ ID NO: 396461 - RNA, 18 nt, Human
cucccacugcccuagcca

SEQ ID NO: 396462 - RNA, 21 nt, Human
cucccacugcccugcacacca

SEQ ID NO: 396463 - RNA, 32 nt, Human
cucccacugccgaccgcacagcucccucucug

SEQ ID NO: 396464 - RNA, 19 nt, Human
cucccacugcucccuguca

SEQ ID NO: 396465 - RNA, 17 nt, Human
cucccacugcuuccugc

SEQ ID NO: 396466 - RNA, 21 nt, Human
cucccacuggagaagccgcca

SEQ ID NO: 396467 - RNA, 32 nt, Human
cucccacuggcaacaucuuguagcuucuguuu

SEQ ID NO: 396468 - RNA, 20 nt, Human
cucccacuggcauccuggca

SEQ ID NO: 396469 - RNA, 32 nt, Human
cucccacugggcggcuccagccccagacaaca

SEQ ID NO: 396470 - RNA, 19 nt, Human
cucccacuguggccuccca

SEQ ID NO: 396471 - RNA, 22 nt, Human
cucccacuguugcugccugcca

SEQ ID NO: 396472 - RNA, 32 nt, Human
cucccacuuaccugcucuugugcaauguuucu

SEQ ID NO: 396473 - RNA, 32 nt, Human
cucccacuuaggaagcucguguuuccagaucu

SEQ ID NO: 396474 - RNA, 32 nt, Human
cucccacuuauaagugaggacaugcaguauuu

SEQ ID NO: 396475 - RNA, 20 nt, Human
cucccacuucacccuccugc

SEQ ID NO: 396476 - RNA, 32 nt, Human
cucccacuucacccucuugauaacccagagcc

SEQ ID NO: 396477 - RNA, 19 nt, Human
cucccacuucacccuucua

SEQ ID NO: 396478 - RNA, 19 nt, Human
cucccacuucagccuccca

SEQ ID NO: 396479 - RNA, 32 nt, Human
cucccacuucagccucccaaauagcuggggcu

SEQ ID NO: 396480 - RNA, 32 nt, Human
cucccacuucagugcuguccuccugggcgugu

SEQ ID NO: 396481 - RNA, 19 nt, Human
cucccacuucauaacuaca

SEQ ID NO: 396482 - RNA, 21 nt, Human
cucccacuucauacauuacca

SEQ ID NO: 396483 - RNA, 19 nt, Human
cucccacuuccaucuggca

SEQ ID NO: 396484 - RNA, 19 nt, Human
cucccacuucccaacucca

SEQ ID NO: 396485 - RNA, 18 nt, Human
cucccacuucccagccgc

SEQ ID NO: 396486 - RNA, 21 nt, Human
cucccacuuccccuucugcca

SEQ ID NO: 396487 - RNA, 18 nt, Human
cucccacuuccuccuacc

SEQ ID NO: 396488 - RNA, 32 nt, Human
cucccacuuccuugacgcuauuuccugggagg

SEQ ID NO: 396489 - RNA, 18 nt, Human
cucccacuucggcagcca

SEQ ID NO: 396490 - RNA, 20 nt, Human
cucccacuucguggcaucca

SEQ ID NO: 396491 - RNA, 19 nt, Human
cucccacuucucaacucca

SEQ ID NO: 396492 - RNA, 19 nt, Human
cucccacuucucuacucca

SEQ ID NO: 396493 - RNA, 32 nt, Human
cucccacuucuucuccccucccccaccgcauc

SEQ ID NO: 396494 - RNA, 18 nt, Human
cucccacuucuuucucca

SEQ ID NO: 396495 - RNA, 20 nt, Human
cucccacuugcacgccacca

SEQ ID NO: 396496 - RNA, 20 nt, Human
cucccacuugcaugcuucca

SEQ ID NO: 396497 - RNA, 18 nt, Human
cucccacuuggaccugcu

SEQ ID NO: 396498 - RNA, 21 nt, Human
cucccacuugguagcaccuuc

SEQ ID NO: 396499 - RNA, 19 nt, Human
cucccacuuuagccuccca

SEQ ID NO: 396500 - RNA, 18 nt, Human
cucccacuuuccccugcc

SEQ ID NO: 396501 - RNA, 19 nt, Human
cucccacuuuggccuucca

SEQ ID NO: 396502 - RNA, 32 nt, Human
cucccacuuugucccgagccuccuucuccccc

SEQ ID NO: 396503 - RNA, 32 nt, Human
cucccagaaaccugaaagcaccugccaaugac

SEQ ID NO: 396504 - RNA, 32 nt, Human
cucccagaacaacaacuauccugacuucuaau

SEQ ID NO: 396505 - RNA, 25 nt, Human
cucccagaacaggcaccccuuccca

SEQ ID NO: 396506 - RNA, 32 nt, Human
cucccagaagcaccugcuuaauaaaucaaaga

SEQ ID NO: 396507 - RNA, 32 nt, Human
cucccagaaucugccuuuuaaguuuccaucag

SEQ ID NO: 396508 - RNA, 24 nt, Human
cucccagaaugcugggauuacagg

SEQ ID NO: 396509 - RNA, 32 nt, Human
cucccagaaugcugggauuacaggcgugagca

SEQ ID NO: 396510 - RNA, 32 nt, Human
cucccagaauguacuuaucuuaccucggcaug

SEQ ID NO: 396511 - RNA, 32 nt, Human
cucccagaccaggaguuggggcaggcugccug

SEQ ID NO: 396512 - RNA, 32 nt, Human
cucccagaccucccucauucuuuuugucucuu

SEQ ID NO: 396513 - RNA, 32 nt, Human
cucccagaccuccugaccugggugguugaggc

SEQ ID NO: 396514 - RNA, 24 nt, Human
cucccagacggcugggauuccagg

SEQ ID NO: 396515 - RNA, 32 nt, Human
cucccagacugcugagauuacaggcgugagcc

SEQ ID NO: 396516 - RNA, 24 nt, Human
cucccagacuguugggauuacagg

SEQ ID NO: 396517 - RNA, 32 nt, Human
cucccagacuguugggauuacaggcaugagcc

SEQ ID NO: 396518 - RNA, 32 nt, Human
cucccagagccccaggacugggccagagcacu

SEQ ID NO: 396519 - RNA, 32 nt, Human
cucccagaggggcauggacugccaccaggacu

SEQ ID NO: 396520 - RNA, 24 nt, Human
cucccagaguacugggauuacagg

SEQ ID NO: 396521 - RNA, 23 nt, Human
cucccagaguauugggauuacag

SEQ ID NO: 396522 - RNA, 32 nt, Human
cucccagaguauugggauuacagacaugagcc

SEQ ID NO: 396523 - RNA, 32 nt, Human
cucccagagugcuaggauuacaggcaugagcc

SEQ ID NO: 396524 - RNA, 32 nt, Human
cucccagagugcuaggauuacaggccuuuuga

SEQ ID NO: 396525 - RNA, 32 nt, Human
cucccagagugcugagauuacagacgugaacc

SEQ ID NO: 396526 - RNA, 24 nt, Human
cucccagagugcugagauuacagg

SEQ ID NO: 396527 - RNA, 32 nt, Human
cucccagagugcugagauuacaggcgugagcc

SEQ ID NO: 396528 - RNA, 32 nt, Human
cucccagagugcugagauuuacaggcgugagc

SEQ ID NO: 396529 - RNA, 32 nt, Human
cucccagagugcugggacuacaggcaucagcc

SEQ ID NO: 396530 - RNA, 32 nt, Human
cucccagagugcugggacuacaggcaugagcc

SEQ ID NO: 396531 - RNA, 22 nt, Human
cucccagagugcugggauuaca

SEQ ID NO: 396532 - RNA, 24 nt, Human
cucccagagugcugggauuacagg

SEQ ID NO: 396533 - RNA, 32 nt, Human
cucccagagugcugggauuacaggcaugagcc

SEQ ID NO: 396534 - RNA, 32 nt, Human
cucccagagugcugggauuacaggcgucagcc

SEQ ID NO: 396535 - RNA, 32 nt, Human
cucccagagugcugggauuacaggcgugagcc

SEQ ID NO: 396536 - RNA, 32 nt, Human
cucccagagugcugggauuacagggggagcca

SEQ ID NO: 396537 - RNA, 32 nt, Human
cucccagagugcugggauuacaggugugaauc

SEQ ID NO: 396538 - RNA, 32 nt, Human
cucccagagugcugggauuacaggugugagcc

SEQ ID NO: 396539 - RNA, 32 nt, Human
cucccagagugcugggauuacaggugugagcu

SEQ ID NO: 396540 - RNA, 32 nt, Human
cucccagagugcugggauuauaggcgugagcc

SEQ ID NO: 396541 - RNA, 32 nt, Human
cucccagagugcugggauuuacaggcaugagc

SEQ ID NO: 396542 - RNA, 24 nt, Human
cucccagagugcuuggauugcagg

SEQ ID NO: 396543 - RNA, 32 nt, Human
cucccagaguguuaggauuacaggcgugagcc

SEQ ID NO: 396544 - RNA, 32 nt, Human
cucccagauagcugggacuacaggcacacgcu

SEQ ID NO: 396545 - RNA, 32 nt, Human
cucccagauauaaguaucaugguccagcagua

SEQ ID NO: 396546 - RNA, 32 nt, Human
cucccagauuccccguaaagcagcccugcagc

SEQ ID NO: 396547 - RNA, 32 nt, Human
cucccagauugcuggguuuacaggcaugagcc

SEQ ID NO: 396548 - RNA, 22 nt, Human
cucccagcacugacucacuccu

SEQ ID NO: 396549 - RNA, 32 nt, Human
cucccagcagaacauacuagggagaugcaccc

SEQ ID NO: 396550 - RNA, 32 nt, Human
cucccagcagccacaccggcuuugugcucagc

SEQ ID NO: 396551 - RNA, 21 nt, Human
cucccagcaggcugccugcca

SEQ ID NO: 396552 - RNA, 32 nt, Human
cucccagcaugcuggacuaugauacagagaac

SEQ ID NO: 396553 - RNA, 18 nt, Human
cucccagcauuucacuuc

SEQ ID NO: 396554 - RNA, 32 nt, Human
cucccagccaagaucugucuuccuucauggug

SEQ ID NO: 396555 - RNA, 32 nt, Human
cucccagccacaccugccccugcucuggggcc

SEQ ID NO: 396556 - RNA, 21 nt, Human
cucccagccaccagccugccu

SEQ ID NO: 396557 - RNA, 20 nt, Human
cucccagccaccgccugcca

SEQ ID NO: 396558 - RNA, 24 nt, Human
cucccagccccaccccgggaucug

SEQ ID NO: 396559 - RNA, 32 nt, Human
cucccagccccacuccccgcagucucccugaa

SEQ ID NO: 396560 - RNA, 32 nt, Human
cucccagccccacucuggggcagaucaaaugu

SEQ ID NO: 396561 - RNA, 20 nt, Human
cucccagcccccuccuccug

SEQ ID NO: 396562 - RNA, 20 nt, Human
cucccagccccgccgcgccg

SEQ ID NO: 396563 - RNA, 21 nt, Human
cucccagccccuauuccucua

SEQ ID NO: 396564 - RNA, 18 nt, Human
cucccagccccuccuucu

SEQ ID NO: 396565 - RNA, 21 nt, Human
cucccagccccucgccuucua

SEQ ID NO: 396566 - RNA, 32 nt, Human
cucccagccccuggugggcugcggugaugggu

SEQ ID NO: 396567 - RNA, 16 nt, Human
cucccagcccuccuuc

SEQ ID NO: 396568 - RNA, 32 nt, Human
cucccagcccucuccucauucucugaacccac

SEQ ID NO: 396569 - RNA, 20 nt, Human
cucccagcccucuccuccug

SEQ ID NO: 396570 - RNA, 32 nt, Human
cucccagcccucuuugccggacgagcucuggg

SEQ ID NO: 396571 - RNA, 21 nt, Human
cucccagcccuguaaauucua

SEQ ID NO: 396572 - RNA, 19 nt, Human
cucccagcccuuccuccug

SEQ ID NO: 396573 - RNA, 32 nt, Human
cucccagcccuugcccagccugggggaguggg

SEQ ID NO: 396574 - RNA, 18 nt, Human
cucccagccgcgacuucu

SEQ ID NO: 396575 - RNA, 32 nt, Human
cucccagccucaguuucccccacagcagcacg

SEQ ID NO: 396576 - RNA, 17 nt, Human
cucccagccuccacuuu

SEQ ID NO: 396577 - RNA, 32 nt, Human
cucccagccuccacuuucagagugaaauucaa

SEQ ID NO: 396578 - RNA, 32 nt, Human
cucccagccuccagaacucugagagaccuggc

SEQ ID NO: 396579 - RNA, 21 nt, Human
cucccagccuccagggcuucu

SEQ ID NO: 396580 - RNA, 32 nt, Human
cucccagccuccagggcuucucugugugucuu

SEQ ID NO: 396581 - RNA, 22 nt, Human
cucccagccugaauucugucua

SEQ ID NO: 396582 - RNA, 16 nt, Human
cucccagccugcacuu

SEQ ID NO: 396583 - RNA, 20 nt, Human
cucccagccugccccuucug

SEQ ID NO: 396584 - RNA, 16 nt, Human
cucccagccugccuuc

SEQ ID NO: 396585 - RNA, 20 nt, Human
cucccagccugggcccucug

SEQ ID NO: 396586 - RNA, 20 nt, Human
cucccagccuggggcaucuc

SEQ ID NO: 396587 - RNA, 18 nt, Human
cucccagccugugucuuc

SEQ ID NO: 396588 - RNA, 32 nt, Human
cucccagcgaccauugcucuccuggcugagga

SEQ ID NO: 396589 - RNA, 20 nt, Human
cucccagcgaguccugcagg

SEQ ID NO: 396590 - RNA, 20 nt, Human
cucccagcgcagcgccgccg

SEQ ID NO: 396591 - RNA, 32 nt, Human
cucccagcgcaguucccagcugucucccugcu

SEQ ID NO: 396592 - RNA, 24 nt, Human
cucccagcgugcugggauuauagg

SEQ ID NO: 396593 - RNA, 32 nt, Human
cucccagcuauauuucuccagacuugcauuuu

SEQ ID NO: 396594 - RNA, 18 nt, Human
cucccagcuccacuucua

SEQ ID NO: 396595 - RNA, 22 nt, Human
cucccagcuccagcccugcagg

SEQ ID NO: 396596 - RNA, 21 nt, Human
cucccagcucuggucccggca

SEQ ID NO: 396597 - RNA, 32 nt, Human
cucccagcucugucaguggcccgcggggcccg

SEQ ID NO: 396598 - RNA, 22 nt, Human
cucccagcugaggccacaggac

SEQ ID NO: 396599 - RNA, 32 nt, Human
cucccagcugcacuuuaacccuagaagguggg

SEQ ID NO: 396600 - RNA, 20 nt, Human
cucccagcugccacgcucua

SEQ ID NO: 396601 - RNA, 32 nt, Human
cucccagcugcccuccccuacuucucccuugc

SEQ ID NO: 396602 - RNA, 32 nt, Human
cucccagcugugguaggcucacauagccagug

SEQ ID NO: 396603 - RNA, 32 nt, Human
cucccagcuuaugauccaugaagagaacgucu

SEQ ID NO: 396604 - RNA, 32 nt, Human
cucccagcuuggguguggccuccugggcucac

SEQ ID NO: 396605 - RNA, 32 nt, Human
cucccagcuuugaaggucuugcggugaagcau

SEQ ID NO: 396606 - RNA, 32 nt, Human
cucccagcuuugaaggucuugcgguggugcgu

SEQ ID NO: 396607 - RNA, 21 nt, Human
cucccaggaagagugcugugg

SEQ ID NO: 396608 - RNA, 32 nt, Human
cucccaggacaaggguugagaggcucaacccc

SEQ ID NO: 396609 - RNA, 32 nt, Human
cucccaggacccccacccucugggacaggccc

SEQ ID NO: 396610 - RNA, 32 nt, Human
cucccaggacucugcugccucagccagagccu

SEQ ID NO: 396611 - RNA, 32 nt, Human
cucccaggagagaacggagagccagugugcug

SEQ ID NO: 396612 - RNA, 32 nt, Human
cucccaggaucauccuuccucuguucucuuuc

SEQ ID NO: 396613 - RNA, 18 nt, Human
cucccaggaugcuagugg

SEQ ID NO: 396614 - RNA, 19 nt, Human
cucccaggcaagcagcugg

SEQ ID NO: 396615 - RNA, 22 nt, Human
cucccaggcacucuuacuucua

SEQ ID NO: 396616 - RNA, 32 nt, Human
cucccaggcaggcagaugccagugucugcucu

SEQ ID NO: 396617 - RNA, 32 nt, Human
cucccaggcauaagcauucugccugucucagc

SEQ ID NO: 396618 - RNA, 32 nt, Human
cucccaggcccagcaccgagcagaacagacca

SEQ ID NO: 396619 - RNA, 32 nt, Human
cucccaggccccuggcuguccaugucccacac

SEQ ID NO: 396620 - RNA, 22 nt, Human
cucccaggccggagugcagugg

SEQ ID NO: 396621 - RNA, 18 nt, Human
cucccaggccugcugugg

SEQ ID NO: 396622 - RNA, 22 nt, Human
cucccaggcgccgccgcagccg

SEQ ID NO: 396623 - RNA, 22 nt, Human
cucccaggcuagaguaccgugg

SEQ ID NO: 396624 - RNA, 22 nt, Human
cucccaggcuagagugcaaugg

SEQ ID NO: 396625 - RNA, 32 nt, Human
cucccaggcucaaucgauccuuccaacugagc

SEQ ID NO: 396626 - RNA, 32 nt, Human
cucccaggcuccucuucugcagugccagcuga

SEQ ID NO: 396627 - RNA, 32 nt, Human
cucccaggcuccuggaacuucugccuccaccu

SEQ ID NO: 396628 - RNA, 21 nt, Human
cucccaggcugaagugcagug

SEQ ID NO: 396629 - RNA, 22 nt, Human
cucccaggcugaagugcagugg

SEQ ID NO: 396630 - RNA, 32 nt, Human
cucccaggcugcaacauccaccucccagguuc

SEQ ID NO: 396631 - RNA, 32 nt, Human
cucccaggcugcagacucugaccuguggcauc

SEQ ID NO: 396632 - RNA, 25 nt, Human
cucccaggcugcuggagugcagugg

SEQ ID NO: 396633 - RNA, 22 nt, Human
cucccaggcuggaaugcagugg

SEQ ID NO: 396634 - RNA, 22 nt, Human
cucccaggcuggaguacagugg

SEQ ID NO: 396635 - RNA, 22 nt, Human
cucccaggcuggagugcaaugg

SEQ ID NO: 396636 - RNA, 21 nt, Human
cucccaggcuggagugcagug

SEQ ID NO: 396637 - RNA, 22 nt, Human
cucccaggcuggagugcagugg

SEQ ID NO: 396638 - RNA, 32 nt, Human
cucccaggcuggaguugcaguggugcaaugac

SEQ ID NO: 396639 - RNA, 21 nt, Human
cucccaggcuggauggcaugg

SEQ ID NO: 396640 - RNA, 20 nt, Human
cucccaggcuggggcagugg

SEQ ID NO: 396641 - RNA, 32 nt, Human
cucccaggcugucccccuccucccagggccuc

SEQ ID NO: 396642 - RNA, 32 nt, Human
cucccaggcugucuucuccucaucacagggac

SEQ ID NO: 396643 - RNA, 32 nt, Human
cucccagggagcaugagaggaggcagcaggac

SEQ ID NO: 396644 - RNA, 32 nt, Human
cucccagggaggcgcuugucacccucauucua

SEQ ID NO: 396645 - RNA, 20 nt, Human
cucccagggagguucacuuc

SEQ ID NO: 396646 - RNA, 32 nt, Human
cucccagggccagacagcccuuccuggcuccc

SEQ ID NO: 396647 - RNA, 32 nt, Human
cucccagggcccuggcgucugggucaagcagc

SEQ ID NO: 396648 - RNA, 20 nt, Human
cucccagggccgccgcuccg

SEQ ID NO: 396649 - RNA, 32 nt, Human
cucccagggccugucucaagcucuuccuuacu

SEQ ID NO: 396650 - RNA, 23 nt, Human
cucccagggcuccuugccuuagg

SEQ ID NO: 396651 - RNA, 18 nt, Human
cucccagggcuuugcagc

SEQ ID NO: 396652 - RNA, 32 nt, Human
cucccaggggccuuugcagcgucuuuuuaacc

SEQ ID NO: 396653 - RNA, 32 nt, Human
cucccaggggucccucccucccuccuucccaa

SEQ ID NO: 396654 - RNA, 32 nt, Human
cucccaggggugccaggagccacugggacagg

SEQ ID NO: 396655 - RNA, 19 nt, Human
cucccagggucccagggag

SEQ ID NO: 396656 - RNA, 32 nt, Human
cucccagggugaggauaggucuccagaccaag

SEQ ID NO: 396657 - RNA, 32 nt, Human
cucccagggugcugggacugcaggcaugaguc

SEQ ID NO: 396658 - RNA, 24 nt, Human
cucccagggugcugggauuacagg

SEQ ID NO: 396659 - RNA, 32 nt, Human
cucccagggugcugggauuacaggugugagcc

SEQ ID NO: 396660 - RNA, 32 nt, Human
cucccagguaaggcggaggcugcuggugugag

SEQ ID NO: 396661 - RNA, 24 nt, Human
cucccagguagcugggauuacagg

SEQ ID NO: 396662 - RNA, 32 nt, Human
cucccagguagcugggauuacaggcaugcaac

SEQ ID NO: 396663 - RNA, 32 nt, Human
cucccagguagcugggauuacaggcaugugcc

SEQ ID NO: 396664 - RNA, 32 nt, Human
cucccaggucaagugauucuccugccucagcc

SEQ ID NO: 396665 - RNA, 20 nt, Human
cucccaggugagggcagugg

SEQ ID NO: 396666 - RNA, 23 nt, Human
cucccaggugcugggauuauagg

SEQ ID NO: 396667 - RNA, 32 nt, Human
cucccagguggcugggauuacaggcaugcacc

SEQ ID NO: 396668 - RNA, 32 nt, Human
cucccagguucaagcauucuucugccucagcc

SEQ ID NO: 396669 - RNA, 24 nt, Human
cucccagguugcugggguuacagg

SEQ ID NO: 396670 - RNA, 22 nt, Human
cucccagguuggagugcagugg

SEQ ID NO: 396671 - RNA, 32 nt, Human
cucccaguaaagcuuuucuucucccgacugcu

SEQ ID NO: 396672 - RNA, 32 nt, Human
cucccaguacuuccuggacucuaccucggaaa

SEQ ID NO: 396673 - RNA, 23 nt, Human
cucccaguagcugggauuagagg

SEQ ID NO: 396674 - RNA, 22 nt, Human
cucccaguauugggauuacagg

SEQ ID NO: 396675 - RNA, 32 nt, Human
cucccaguccacauggaaaacaucagggagug

SEQ ID NO: 396676 - RNA, 32 nt, Human
cucccaguccauucauuucuucauucauuugu

SEQ ID NO: 396677 - RNA, 32 nt, Human
cucccaguccuacccuuuacucagggaguaau

SEQ ID NO: 396678 - RNA, 32 nt, Human
cucccagucucucgcucugccugccugcucag

SEQ ID NO: 396679 - RNA, 20 nt, Human
cucccagucugccaguucua

SEQ ID NO: 396680 - RNA, 32 nt, Human
cucccagucuuguccuuacccauuccaagugc

SEQ ID NO: 396681 - RNA, 32 nt, Human
cucccagugacgcccgagaucuuucuccagau

SEQ ID NO: 396682 - RNA, 32 nt, Human
cucccagugagcugguguccccgugugucuuu

SEQ ID NO: 396683 - RNA, 32 nt, Human
cucccagugcagcugccaccccagcccaaaug

SEQ ID NO: 396684 - RNA, 32 nt, Human
cucccagugcugcugcugaccuucacugacag

SEQ ID NO: 396685 - RNA, 32 nt, Human
cucccagugcugcuguccucugauccacccuc

SEQ ID NO: 396686 - RNA, 22 nt, Human
cucccagugcugggauuauagg

SEQ ID NO: 396687 - RNA, 32 nt, Human
cucccaguggagcucugcaggccaggccauau

SEQ ID NO: 396688 - RNA, 24 nt, Human
cucccagugggcugggauuauagg

SEQ ID NO: 396689 - RNA, 24 nt, Human
cucccagugugcugggauuacagg

SEQ ID NO: 396690 - RNA, 32 nt, Human
cucccagugugcugggauuacaggcaugagcu

SEQ ID NO: 396691 - RNA, 32 nt, Human
cucccaguuagaauaacuaauauagagaagug

SEQ ID NO: 396692 - RNA, 32 nt, Human
cucccaguucaagugauuccccugccucagcc

SEQ ID NO: 396693 - RNA, 32 nt, Human
cucccaguucauuccuggaaccagccaggcca

SEQ ID NO: 396694 - RNA, 32 nt, Human
cucccauaaagaggaggaaaaggaagauacag

SEQ ID NO: 396695 - RNA, 32 nt, Human
cucccauaaugcugggauuacaggcgugagca

SEQ ID NO: 396696 - RNA, 24 nt, Human
cucccauagugcugggauuacagg

SEQ ID NO: 396697 - RNA, 32 nt, Human
cucccauagugcugggauuacaggcaugagcc

SEQ ID NO: 396698 - RNA, 32 nt, Human
cucccauagugcugggauuacaggugugagcc

SEQ ID NO: 396699 - RNA, 32 nt, Human
cucccaucaacgagucuuggcccaggggacac

SEQ ID NO: 396700 - RNA, 32 nt, Human
cucccaucacacccuucagcccauccaugcgg

SEQ ID NO: 396701 - RNA, 32 nt, Human
cucccaucaccaccucuaggacucgggggcuc

SEQ ID NO: 396702 - RNA, 32 nt, Human
cucccaucaccucaacuccagccagggaggaa

SEQ ID NO: 396703 - RNA, 24 nt, Human
cucccauccaacaucacccagugg

SEQ ID NO: 396704 - RNA, 32 nt, Human
cucccauccaaguacuaaccaggcccgacccu

SEQ ID NO: 396705 - RNA, 32 nt, Human
cucccaucccacccuugccccgccucccugcc

SEQ ID NO: 396706 - RNA, 32 nt, Human
cucccaucccccaggcugguaccaguucugua

SEQ ID NO: 396707 - RNA, 21 nt, Human
cucccauccccgccgccggcc

SEQ ID NO: 396708 - RNA, 32 nt, Human
cucccauccccucccuccuucacuccugccuc

SEQ ID NO: 396709 - RNA, 32 nt, Human
cucccaucccucagauccccacauuguuccuc

SEQ ID NO: 396710 - RNA, 19 nt, Human
cucccaucucagccucuga

SEQ ID NO: 396711 - RNA, 32 nt, Human
cucccaucucugcccaugagccacagggaaca

SEQ ID NO: 396712 - RNA, 32 nt, Human
cucccaucugcugcccauggaugcucuggcug

SEQ ID NO: 396713 - RNA, 23 nt, Human
cucccaucuucaccucgggccug

SEQ ID NO: 396714 - RNA, 25 nt, Human
cucccaugacacccagaaggggcag

SEQ ID NO: 396715 - RNA, 32 nt, Human
cucccaugaccauacugagggaccaacugggc

SEQ ID NO: 396716 - RNA, 32 nt, Human
cucccaugacugcccagcucugaggcccgauc

SEQ ID NO: 396717 - RNA, 32 nt, Human
cucccaugaugcagugugauaaggauuggccu

SEQ ID NO: 396718 - RNA, 32 nt, Human
cucccaugcccacagucacccauuccagacuc

SEQ ID NO: 396719 - RNA, 32 nt, Human
cucccaugcccguucugaccucagccuuggaa

SEQ ID NO: 396720 - RNA, 23 nt, Human
cucccaugccuuccugccugcca

SEQ ID NO: 396721 - RNA, 32 nt, Human
cucccaugcuccuuggcuucugaaggcugaag

SEQ ID NO: 396722 - RNA, 32 nt, Human
cucccauggcccgaggacccacugugagcacu

SEQ ID NO: 396723 - RNA, 23 nt, Human
cucccauguagcugggauuacag

SEQ ID NO: 396724 - RNA, 32 nt, Human
cucccauguccucagacccagcaaaagcguag

SEQ ID NO: 396725 - RNA, 18 nt, Human
cucccauucacgcccgcc

SEQ ID NO: 396726 - RNA, 19 nt, Human
cucccauucaugcccacca

SEQ ID NO: 396727 - RNA, 24 nt, Human
cucccauuccaaccuuagaaugga

SEQ ID NO: 396728 - RNA, 32 nt, Human
cucccauucuggcuccaccugcagccucccug

SEQ ID NO: 396729 - RNA, 32 nt, Human
cucccauucugugguugugguggugguaagaa

SEQ ID NO: 396730 - RNA, 31 nt, Human
cucccauuggccucuccuugccaaaucuaaa

SEQ ID NO: 396731 - RNA, 32 nt, Human
cucccauuuaaguuaugcuucugaccuuguau

SEQ ID NO: 396732 - RNA, 32 nt, Human
cucccauuucaggacauuugcacugacuguuu

SEQ ID NO: 396733 - RNA, 18 nt, Human
cucccauuucgccggcca

SEQ ID NO: 396734 - RNA, 32 nt, Human
cucccauuuucucugcuggcguuucugcugug

SEQ ID NO: 396735 - RNA, 19 nt, Human
cuccccaaaagugaccaca

SEQ ID NO: 396736 - RNA, 32 nt, Human
cuccccaaacacaccaagaagcauuuuuaacg

SEQ ID NO: 396737 - RNA, 32 nt, Human
cuccccaaacacccacagccacugacccaucc

SEQ ID NO: 396738 - RNA, 25 nt, Human
cuccccaaagugcugggaugacagg

SEQ ID NO: 396739 - RNA, 32 nt, Human
cuccccaaagugcugggaugacaggcaugagc

SEQ ID NO: 396740 - RNA, 25 nt, Human
cuccccaaagugcugggauuacagg

SEQ ID NO: 396741 - RNA, 32 nt, Human
cuccccaaagugcugggauuacaggcaugagc

SEQ ID NO: 396742 - RNA, 32 nt, Human
cuccccaaagugcugggauuacaggcgugagc

SEQ ID NO: 396743 - RNA, 32 nt, Human
cuccccaaagugcugggauuacagguacaaug

SEQ ID NO: 396744 - RNA, 25 nt, Human
cuccccaaagugcugggauugcagg

SEQ ID NO: 396745 - RNA, 32 nt, Human
cuccccaaagugcugggauugcaggcgugagc

SEQ ID NO: 396746 - RNA, 32 nt, Human
cuccccaaccagcccagcuucuccuuaccugc

SEQ ID NO: 396747 - RNA, 32 nt, Human
cuccccaacccuucaggaacccuuuaguuuau

SEQ ID NO: 396748 - RNA, 32 nt, Human
cuccccaaccggcuugccccggucccccuggg

SEQ ID NO: 396749 - RNA, 32 nt, Human
cuccccaacucauucuaugaggccaacaucau

SEQ ID NO: 396750 - RNA, 21 nt, Human
cuccccaacuccagcagccuu

SEQ ID NO: 396751 - RNA, 21 nt, Human
cuccccaagaaaaagggccuu

SEQ ID NO: 396752 - RNA, 20 nt, Human
cuccccaagaggccaaccca

SEQ ID NO: 396753 - RNA, 32 nt, Human
cuccccaagcccuucccagucacugcauggcc

SEQ ID NO: 396754 - RNA, 22 nt, Human
cuccccaagccuguguugcagg

SEQ ID NO: 396755 - RNA, 32 nt, Human
cuccccaagcuggcagaggggccguggcagga

SEQ ID NO: 396756 - RNA, 20 nt, Human
cuccccaaggacaagcuccu

SEQ ID NO: 396757 - RNA, 32 nt, Human
cuccccaaggagaucggucaccaggagagcag

SEQ ID NO: 396758 - RNA, 19 nt, Human
cuccccaaggaugaccaca

SEQ ID NO: 396759 - RNA, 19 nt, Human
cuccccaaggcaggccaua

SEQ ID NO: 396760 - RNA, 20 nt, Human
cuccccaaggcuggcaaccu

SEQ ID NO: 396761 - RNA, 24 nt, Human
cuccccaagggugaguucagcacc

SEQ ID NO: 396762 - RNA, 32 nt, Human
cuccccaaguagcugggacuagaggcaugcgc

SEQ ID NO: 396763 - RNA, 24 nt, Human
cuccccaagugcuggaauuacagg

SEQ ID NO: 396764 - RNA, 32 nt, Human
cuccccaagugcuggaauuacaggcgugagcu

SEQ ID NO: 396765 - RNA, 32 nt, Human
cuccccaagugcugggauuacaggcgugagcc

SEQ ID NO: 396766 - RNA, 24 nt, Human
cuccccaagugcugggauuauagg

SEQ ID NO: 396767 - RNA, 32 nt, Human
cuccccaagugcugggauuauaggcaugagcc

SEQ ID NO: 396768 - RNA, 24 nt, Human
cuccccaaguguugggauuacagg

SEQ ID NO: 396769 - RNA, 32 nt, Human
cuccccaaguguugggauuacaggcgugagcc

SEQ ID NO: 396770 - RNA, 32 nt, Human
cuccccaauaccuaauaaggcaugcgaaaugu

SEQ ID NO: 396771 - RNA, 19 nt, Human
cuccccaauuccagcccuu

SEQ ID NO: 396772 - RNA, 25 nt, Human
cuccccacaccuacccacccagugg

SEQ ID NO: 396773 - RNA, 32 nt, Human
cuccccacagccacccucccucuucagagagc

SEQ ID NO: 396774 - RNA, 19 nt, Human
cuccccacagccagucccc

SEQ ID NO: 396775 - RNA, 19 nt, Human
cuccccacagccuuccuca

SEQ ID NO: 396776 - RNA, 20 nt, Human
cuccccacagcgucccuggc

SEQ ID NO: 396777 - RNA, 21 nt, Human
cuccccacaggagcccugcag

SEQ ID NO: 396778 - RNA, 32 nt, Human
cuccccacaggcaccccucaugcucugauugu

SEQ ID NO: 396779 - RNA, 25 nt, Human
cuccccacagugcugggauuacagg

SEQ ID NO: 396780 - RNA, 22 nt, Human
cuccccaccaaauaaucucaua

SEQ ID NO: 396781 - RNA, 32 nt, Human
cuccccaccaagcccucuaucuccuucuaauc

SEQ ID NO: 396782 - RNA, 32 nt, Human
cuccccaccacagccccagcugccucagagca

SEQ ID NO: 396783 - RNA, 18 nt, Human
cuccccaccacccccgca

SEQ ID NO: 396784 - RNA, 32 nt, Human
cuccccaccacccuccgccaucagccugccug

SEQ ID NO: 396785 - RNA, 32 nt, Human
cuccccaccaccugugccccagagagcagggc

SEQ ID NO: 396786 - RNA, 32 nt, Human
cuccccaccacgucugugcccugcacuguccc

SEQ ID NO: 396787 - RNA, 32 nt, Human
cuccccacccaggagggagguggcacuucuua

SEQ ID NO: 396788 - RNA, 24 nt, Human
cuccccaccccaagccacagggac

SEQ ID NO: 396789 - RNA, 24 nt, Human
cuccccaccccaccccaccccagg

SEQ ID NO: 396790 - RNA, 24 nt, Human
cuccccaccccaccgcaccccagg

SEQ ID NO: 396791 - RNA, 32 nt, Human
cuccccacccccaguucugggcugggauccug

SEQ ID NO: 396792 - RNA, 22 nt, Human
cuccccaccccccagcccuagg

SEQ ID NO: 396793 - RNA, 32 nt, Human
cuccccacccccuccugcuccuggggccggcc

SEQ ID NO: 396794 - RNA, 32 nt, Human
cuccccacccccuggcaaaaggcuggccaugc

SEQ ID NO: 396795 - RNA, 27 nt, Human
cuccccaccccugagccaggaccccag

SEQ ID NO: 396796 - RNA, 21 nt, Human
cuccccacccgucccugggcu

SEQ ID NO: 396797 - RNA, 28 nt, Human
cuccccacccuaccugccccccuggcuu

SEQ ID NO: 396798 - RNA, 19 nt, Human
cuccccacccuggaacccc

SEQ ID NO: 396799 - RNA, 22 nt, Human
cuccccacccuggaaccccuga

SEQ ID NO: 396800 - RNA, 20 nt, Human
cuccccaccgagaacuccag

SEQ ID NO: 396801 - RNA, 32 nt, Human
cuccccaccuccacuccacauuucuuucauuu

SEQ ID NO: 396802 - RNA, 32 nt, Human
cuccccaccuccaguucugccugccggaccuc

SEQ ID NO: 396803 - RNA, 32 nt, Human
cuccccaccucccacgccccagccccucccuc

SEQ ID NO: 396804 - RNA, 32 nt, Human
cuccccaccucccuggccaggauggggauggg

SEQ ID NO: 396805 - RNA, 32 nt, Human
cuccccaccucugcaggacagacaugggaggg

SEQ ID NO: 396806 - RNA, 32 nt, Human
cuccccaccugcacuccauccagcuacaggag

SEQ ID NO: 396807 - RNA, 32 nt, Human
cuccccaccugcuaccccaucugcuugggccc

SEQ ID NO: 396808 - RNA, 24 nt, Human
cuccccaccuucaauuccugggcc

SEQ ID NO: 396809 - RNA, 19 nt, Human
cuccccacgcuggcugcug

SEQ ID NO: 396810 - RNA, 32 nt, Human
cuccccacgguucacaggucucggucuucgga

SEQ ID NO: 396811 - RNA, 32 nt, Human
cuccccacgugccaccaccgggccaccgcggc

SEQ ID NO: 396812 - RNA, 21 nt, Human
cuccccacucaucccuggucu

SEQ ID NO: 396813 - RNA, 32 nt, Human
cuccccacuccccacucucagccugggagacu

SEQ ID NO: 396814 - RNA, 24 nt, Human
cuccccacuccgcugcccuggccu

SEQ ID NO: 396815 - RNA, 21 nt, Human
cuccccacuccucucccacag

SEQ ID NO: 396816 - RNA, 32 nt, Human
cuccccacucucucuuucuccugcuuuggcca

SEQ ID NO: 396817 - RNA, 32 nt, Human
cuccccacugaauguuucauaaggaagcacug

SEQ ID NO: 396818 - RNA, 32 nt, Human
cuccccacugcccuuuuugagccacuuccgag

SEQ ID NO: 396819 - RNA, 19 nt, Human
cuccccacugccgcugcug

SEQ ID NO: 396820 - RNA, 15 nt, Human
cuccccacugccugc

SEQ ID NO: 396821 - RNA, 32 nt, Human
cuccccacugcggcuaggacuccagggagccu

SEQ ID NO: 396822 - RNA, 32 nt, Human
cuccccacuuccgacuggcucccuucgggggc

SEQ ID NO: 396823 - RNA, 32 nt, Human
cuccccacuuccuccugacaacccaggcacag

SEQ ID NO: 396824 - RNA, 32 nt, Human
cuccccacuuccuccugcaccaccacggggaa

SEQ ID NO: 396825 - RNA, 32 nt, Human
cuccccacuucucuggaaccucaggacccgcc

SEQ ID NO: 396826 - RNA, 32 nt, Human
cuccccagacacaacucccuuccccaugcaca

SEQ ID NO: 396827 - RNA, 32 nt, Human
cuccccagacacacccacugcacgcugcagca

SEQ ID NO: 396828 - RNA, 22 nt, Human
cuccccagacagcacuucaggc

SEQ ID NO: 396829 - RNA, 32 nt, Human
cuccccagaccaccccggcagccugagcagcu

SEQ ID NO: 396830 - RNA, 19 nt, Human
cuccccagaccagcagccu

SEQ ID NO: 396831 - RNA, 18 nt, Human
cuccccagagcccugcag

SEQ ID NO: 396832 - RNA, 23 nt, Human
cuccccagagccuccuccugccc

SEQ ID NO: 396833 - RNA, 32 nt, Human
cuccccagagggcacagggcucugcugugccu

SEQ ID NO: 396834 - RNA, 32 nt, Human
cuccccagaguugcuguucccaccucuggcug

SEQ ID NO: 396835 - RNA, 22 nt, Human
cuccccagaucucuccaaguga

SEQ ID NO: 396836 - RNA, 32 nt, Human
cuccccagcagcugggacuacaggcacacauc

SEQ ID NO: 396837 - RNA, 32 nt, Human
cuccccagcagcugggacuacaggcacccacc

SEQ ID NO: 396838 - RNA, 32 nt, Human
cuccccagcagcugggacuacaggugcacgcc

SEQ ID NO: 396839 - RNA, 32 nt, Human
cuccccagcaggcauccacuaccccagggccc

SEQ ID NO: 396840 - RNA, 32 nt, Human
cuccccagccaugcuuccuguacagccugcaa

SEQ ID NO: 396841 - RNA, 32 nt, Human
cuccccagccaugggccacccuugccagugac

SEQ ID NO: 396842 - RNA, 17 nt, Human
cuccccagccccacggg

SEQ ID NO: 396843 - RNA, 32 nt, Human
cuccccagccucccucuccaccucccugcccc

SEQ ID NO: 396844 - RNA, 32 nt, Human
cuccccagccucuaccugucaggaugacucca

SEQ ID NO: 396845 - RNA, 32 nt, Human
cuccccagccuggcacaggccgaggcaggagg

SEQ ID NO: 396846 - RNA, 32 nt, Human
cuccccagccuuccaccuccuguucuuccuac

SEQ ID NO: 396847 - RNA, 32 nt, Human
cuccccagccuucucauuuccgccucuccaga

SEQ ID NO: 396848 - RNA, 32 nt, Human
cuccccagccuucuucagccuucuucagccuu

SEQ ID NO: 396849 - RNA, 32 nt, Human
cuccccagccuucuucagccuucuucagcuca

SEQ ID NO: 396850 - RNA, 32 nt, Human
cuccccagccuucuuucucucccagaagccuc

SEQ ID NO: 396851 - RNA, 32 nt, Human
cuccccagcgcagccugagcccccaggccccu

SEQ ID NO: 396852 - RNA, 32 nt, Human
cuccccagcuacucgggaggcugaggcaggag

SEQ ID NO: 396853 - RNA, 32 nt, Human
cuccccagcucagugccuuucugcaccccuuc

SEQ ID NO: 396854 - RNA, 32 nt, Human
cuccccagcucugucaugcaggccuguccucc

SEQ ID NO: 396855 - RNA, 18 nt, Human
cuccccagcugcgcugcc

SEQ ID NO: 396856 - RNA, 32 nt, Human
cuccccagcugggaucugcucccaggcaacug

SEQ ID NO: 396857 - RNA, 32 nt, Human
cuccccaggaccugagcaggaaccuggaguuu

SEQ ID NO: 396858 - RNA, 32 nt, Human
cuccccaggagaaaaagacccccaagcagaaa

SEQ ID NO: 396859 - RNA, 32 nt, Human
cuccccaggagccaggucugcccacgccuuga

SEQ ID NO: 396860 - RNA, 23 nt, Human
cuccccaggccccgccgcugccg

SEQ ID NO: 396861 - RNA, 32 nt, Human
cuccccaggcucaugugccaccaccuucccuc

SEQ ID NO: 396862 - RNA, 32 nt, Human
cuccccaggcugcuuacagcucauucugcugg

SEQ ID NO: 396863 - RNA, 32 nt, Human
cuccccaggggugaaauguaggaugaaucaca

SEQ ID NO: 396864 - RNA, 32 nt, Human
cuccccaggguggcaggagcugaggaagggcc

SEQ ID NO: 396865 - RNA, 32 nt, Human
cuccccaggucccacauuguuacaagaucuuu

SEQ ID NO: 396866 - RNA, 32 nt, Human
cuccccagguucugaaaaacaccugcauuugu

SEQ ID NO: 396867 - RNA, 24 nt, Human
cuccccaguaccugggauuacagg

SEQ ID NO: 396868 - RNA, 24 nt, Human
cuccccaguagcugagauugcagg

SEQ ID NO: 396869 - RNA, 32 nt, Human
cuccccaguagcugggacuacaagcacaugcc

SEQ ID NO: 396870 - RNA, 23 nt, Human
cuccccaguagcugggauuacag

SEQ ID NO: 396871 - RNA, 24 nt, Human
cuccccaguagcugggauuacagg

SEQ ID NO: 396872 - RNA, 32 nt, Human
cuccccaguagcugggauuacaggcgugggcc

SEQ ID NO: 396873 - RNA, 32 nt, Human
cuccccagugcaaaugcaugcuucuucucaaa

SEQ ID NO: 396874 - RNA, 32 nt, Human
cuccccagugccugccacucucugggacucuc

SEQ ID NO: 396875 - RNA, 32 nt, Human
cuccccagugggcuccuaagggggcaggcgug

SEQ ID NO: 396876 - RNA, 32 nt, Human
cuccccaguucugguccuggccaggccaugcu

SEQ ID NO: 396877 - RNA, 32 nt, Human
cuccccauacccuucagugcaguguaccaggg

SEQ ID NO: 396878 - RNA, 32 nt, Human
cuccccauccacccuucccucccugucuucac

SEQ ID NO: 396879 - RNA, 32 nt, Human
cuccccauccacccuuuacaugauguagggac

SEQ ID NO: 396880 - RNA, 32 nt, Human
cuccccaucccccuuccugcugugccaacuca

SEQ ID NO: 396881 - RNA, 32 nt, Human
cuccccaucucccugaagcuuccaggguagca

SEQ ID NO: 396882 - RNA, 32 nt, Human
cuccccaucugugcuccugccugccggccauc

SEQ ID NO: 396883 - RNA, 32 nt, Human
cuccccaucuuccugcuauaaaugugggugug

SEQ ID NO: 396884 - RNA, 32 nt, Human
cuccccaucuucuccuuacugcaucucagccc

SEQ ID NO: 396885 - RNA, 24 nt, Human
cuccccaugcaaggggcucauccu

SEQ ID NO: 396886 - RNA, 32 nt, Human
cuccccaugcaggacgggccaggcugggagug

SEQ ID NO: 396887 - RNA, 32 nt, Human
cuccccaugccacuggucggcacuuugccacu

SEQ ID NO: 396888 - RNA, 32 nt, Human
cuccccaugccuccugcccugcagcccgccgc

SEQ ID NO: 396889 - RNA, 32 nt, Human
cuccccaugcugcagugcacagguggguugca

SEQ ID NO: 396890 - RNA, 32 nt, Human
cuccccaugggcaccaucucugccauucuuuc

SEQ ID NO: 396891 - RNA, 32 nt, Human
cuccccauggggcagaguggucuccuuacgug

SEQ ID NO: 396892 - RNA, 32 nt, Human
cuccccaugguggcagaggucaauuccacagu

SEQ ID NO: 396893 - RNA, 32 nt, Human
cuccccaugguguuguaaaauggccuaaaagu

SEQ ID NO: 396894 - RNA, 32 nt, Human
cuccccauguccucuggaacagcugggcaugg

SEQ ID NO: 396895 - RNA, 25 nt, Human
cuccccauguccuggugcgcacagc

SEQ ID NO: 396896 - RNA, 24 nt, Human
cuccccaugugcugggauuacagg

SEQ ID NO: 396897 - RNA, 32 nt, Human
cuccccaugugcugggauuacaggcgugagcc

SEQ ID NO: 396898 - RNA, 32 nt, Human
cuccccauguucugcucacuccugucuccagg

SEQ ID NO: 396899 - RNA, 32 nt, Human
cuccccauguuucuccccacuagaagccuccg

SEQ ID NO: 396900 - RNA, 20 nt, Human
cuccccauuccaaaggggca

SEQ ID NO: 396901 - RNA, 32 nt, Human
cuccccauucuuuuccaugcaggaggauuggc

SEQ ID NO: 396902 - RNA, 32 nt, Human
cuccccauugagugugucaugguacaaaucac

SEQ ID NO: 396903 - RNA, 26 nt, Human
cuccccauugcuggaggcucuuccca

SEQ ID NO: 396904 - RNA, 32 nt, Human
cuccccauuggcaaaccggacccggccgccgc

SEQ ID NO: 396905 - RNA, 32 nt, Human
cucccccaaaaccagagccaccugccagccuc

SEQ ID NO: 396906 - RNA, 32 nt, Human
cucccccaacagcagggaugggucagguggca

SEQ ID NO: 396907 - RNA, 32 nt, Human
cucccccaagcccaacccaggcggacaaaagg

SEQ ID NO: 396908 - RNA, 20 nt, Human
cucccccaagcuggaggcgg

SEQ ID NO: 396909 - RNA, 32 nt, Human
cucccccaaugcccugccuuccacucccaccu

SEQ ID NO: 396910 - RNA, 32 nt, Human
cucccccacaaaauucaagggaaaguaaaggg

SEQ ID NO: 396911 - RNA, 21 nt, Human
cucccccacaagagggcagug

SEQ ID NO: 396912 - RNA, 32 nt, Human
cucccccacccaggacggcugugaugaggugg

SEQ ID NO: 396913 - RNA, 32 nt, Human
cucccccaccugccaaauaaccuguucaaaac

SEQ ID NO: 396914 - RNA, 19 nt, Human
cucccccagacugcucguc

SEQ ID NO: 396915 - RNA, 20 nt, Human
cucccccagacuggacaggg

SEQ ID NO: 396916 - RNA, 23 nt, Human
cucccccagagagcucgaagugg

SEQ ID NO: 396917 - RNA, 32 nt, Human
cucccccagagaucuggcuggagcccagaaaa

SEQ ID NO: 396918 - RNA, 18 nt, Human
cucccccagaggcugcag

SEQ ID NO: 396919 - RNA, 20 nt, Human
cucccccagaggcuguucag

SEQ ID NO: 396920 - RNA, 32 nt, Human
cucccccagaguacuccccacugugaaaagag

SEQ ID NO: 396921 - RNA, 32 nt, Human
cucccccagcagaauggaggcaggggacaagg

SEQ ID NO: 396922 - RNA, 32 nt, Human
cucccccagcccgagcgugccucugcccucug

SEQ ID NO: 396923 - RNA, 18 nt, Human
cucccccagccucaguca

SEQ ID NO: 396924 - RNA, 24 nt, Human
cucccccagcugccuggaggggca

SEQ ID NO: 396925 - RNA, 32 nt, Human
cucccccaggagaucaggauuccacugacguc

SEQ ID NO: 396926 - RNA, 25 nt, Human
cucccccaggagccuccaggaugga

SEQ ID NO: 396927 - RNA, 22 nt, Human
cucccccaggcauggcacaggg

SEQ ID NO: 396928 - RNA, 22 nt, Human
cucccccaggcccugccauugg

SEQ ID NO: 396929 - RNA, 32 nt, Human
cucccccaggguggaagccguggggucccuca

SEQ ID NO: 396930 - RNA, 32 nt, Human
cucccccaguagcugggacuacaggcgcgugc

SEQ ID NO: 396931 - RNA, 24 nt, Human
cucccccauagcacccugcccuca

SEQ ID NO: 396932 - RNA, 22 nt, Human
cucccccauagcucugcugcgu

SEQ ID NO: 396933 - RNA, 32 nt, Human
cucccccaucaaugcuccaucuugucggucug

SEQ ID NO: 396934 - RNA, 32 nt, Human
cucccccauccaccauccacaaaucaguaaag

SEQ ID NO: 396935 - RNA, 32 nt, Human
cucccccauggaggaggaggagggggcggugg

SEQ ID NO: 396936 - RNA, 21 nt, Human
cuccccccaacgcaaggagga

SEQ ID NO: 396937 - RNA, 23 nt, Human
cuccccccaagcccucccuccua

SEQ ID NO: 396938 - RNA, 20 nt, Human
cuccccccacccuguguguu

SEQ ID NO: 396939 - RNA, 23 nt, Human
cuccccccaggucuaccccuccc

SEQ ID NO: 396940 - RNA, 21 nt, Human
cuccccccggccucccuccca

SEQ ID NO: 396941 - RNA, 32 nt, Human
cucccccgaaaccaguagcuuucugaguccug

SEQ ID NO: 396942 - RNA, 22 nt, Human
cucccccgaacgccgcccgccg

SEQ ID NO: 396943 - RNA, 32 nt, Human
cucccccgaaugcauuuggaaccaaagucuaa

SEQ ID NO: 396944 - RNA, 32 nt, Human
cucccccgagaccacccccacccuggggaagc

SEQ ID NO: 396945 - RNA, 32 nt, Human
cucccccgaucccagcuuucucuccuuugaaa

SEQ ID NO: 396946 - RNA, 32 nt, Human
cucccccgccacgcccagcccaagagggcugc

SEQ ID NO: 396947 - RNA, 18 nt, Human
cucccccgccccaucccc

SEQ ID NO: 396948 - RNA, 21 nt, Human
cucccccgcccgccgccgccg

SEQ ID NO: 396949 - RNA, 32 nt, Human
cucccccgcggccggagccagggaaccgagcc

SEQ ID NO: 396950 - RNA, 21 nt, Human
cucccccggcugccgccgucg

SEQ ID NO: 396951 - RNA, 21 nt, Human
cucccccgggccgccgccgcc

SEQ ID NO: 396952 - RNA, 22 nt, Human
cucccccgggccgccgccgccg

SEQ ID NO: 396953 - RNA, 24 nt, Human
cucccccguaucugccgccuguca

SEQ ID NO: 396954 - RNA, 30 nt, Human
cucccccuaguucuuccgcuccugugagga

SEQ ID NO: 396955 - RNA, 32 nt, Human
cucccccuccacccccucccccaccccggagg

SEQ ID NO: 396956 - RNA, 32 nt, Human
cucccccuccagccuuugccugggaacugguc

SEQ ID NO: 396957 - RNA, 32 nt, Human
cucccccuccaggccaucucauuggcugcuug

SEQ ID NO: 396958 - RNA, 23 nt, Human
cucccccuccugggugcaacugu

SEQ ID NO: 396959 - RNA, 32 nt, Human
cucccccuccuugugccuucuuuguauauagg

SEQ ID NO: 396960 - RNA, 32 nt, Human
cucccccugcaacuuccgcugaggggucucgg

SEQ ID NO: 396961 - RNA, 32 nt, Human
cucccccugcagccuccuguacccgccucaug

SEQ ID NO: 396962 - RNA, 32 nt, Human
cucccccugccuggcccugagagcggcucugc

SEQ ID NO: 396963 - RNA, 32 nt, Human
cucccccugcuccccaccauucucccuuggca

SEQ ID NO: 396964 - RNA, 32 nt, Human
cucccccugcuccccuacuucucaguccccuu

SEQ ID NO: 396965 - RNA, 31 nt, Human
cucccccugcucucuggguauuugaaauguc

SEQ ID NO: 396966 - RNA, 32 nt, Human
cucccccuggagacccuggaagugguguguuc

SEQ ID NO: 396967 - RNA, 32 nt, Human
cucccccuguucuguuggggagggguagccau

SEQ ID NO: 396968 - RNA, 32 nt, Human
cucccccuucgacugcagccucgcuccgugcc

SEQ ID NO: 396969 - RNA, 32 nt, Human
cucccccuugggcuagcauccccagcccuuaa

SEQ ID NO: 396970 - RNA, 17 nt, Human
cucccccuuggguccag

SEQ ID NO: 396971 - RNA, 32 nt, Human
cuccccgaaagccaugaacugcagcgagagcc

SEQ ID NO: 396972 - RNA, 32 nt, Human
cuccccgaaaugcagauggucaagucaggagc

SEQ ID NO: 396973 - RNA, 32 nt, Human
cuccccgaagacacuccuuccccaaguaauug

SEQ ID NO: 396974 - RNA, 20 nt, Human
cuccccgaagucccgcugcc

SEQ ID NO: 396975 - RNA, 32 nt, Human
cuccccgaagugugauggaggaaaggccggaa

SEQ ID NO: 396976 - RNA, 32 nt, Human
cuccccgaagugugcuggaggaaaggccagaa

SEQ ID NO: 396977 - RNA, 32 nt, Human
cuccccgacccccacggcagagcccggcggcu

SEQ ID NO: 396978 - RNA, 32 nt, Human
cuccccgacccccagcccggacaccucauucc

SEQ ID NO: 396979 - RNA, 32 nt, Human
cuccccgaccugcagccccagacucugcucuc

SEQ ID NO: 396980 - RNA, 32 nt, Human
cuccccgagacccucacuaucuccugcagggu

SEQ ID NO: 396981 - RNA, 18 nt, Human
cuccccgagccgccgcug

SEQ ID NO: 396982 - RNA, 32 nt, Human
cuccccgagugccuggauuacaggcaugagcc

SEQ ID NO: 396983 - RNA, 23 nt, Human
cuccccgagugcugggauuaaag

SEQ ID NO: 396984 - RNA, 32 nt, Human
cuccccgagugcugggauuaaagacgugagcc

SEQ ID NO: 396985 - RNA, 32 nt, Human
cuccccgcaacccugagacuccaggcuccccu

SEQ ID NO: 396986 - RNA, 32 nt, Human
cuccccgcacacugaccuauaccucaggaugg

SEQ ID NO: 396987 - RNA, 25 nt, Human
cuccccgcaccgcccgcgcugcgcg

SEQ ID NO: 396988 - RNA, 19 nt, Human
cuccccgcacuccgcugcu

SEQ ID NO: 396989 - RNA, 20 nt, Human
cuccccgcagcccccuggcu

SEQ ID NO: 396990 - RNA, 32 nt, Human
cuccccgcaggugaucauccuccugcaggugu

SEQ ID NO: 396991 - RNA, 32 nt, Human
cuccccgccacgaucgucgcugugcuuggugu

SEQ ID NO: 396992 - RNA, 32 nt, Human
cuccccgccacucagaccuggguggugauaac

SEQ ID NO: 396993 - RNA, 19 nt, Human
cuccccgccagccccggcc

SEQ ID NO: 396994 - RNA, 21 nt, Human
cuccccgccagccccggcccc

SEQ ID NO: 396995 - RNA, 18 nt, Human
cuccccgccagcccgccc

SEQ ID NO: 396996 - RNA, 22 nt, Human
cuccccgccaguggagaucucc

SEQ ID NO: 396997 - RNA, 32 nt, Human
cuccccgccaugagcuccuacguagccaauuc

SEQ ID NO: 396998 - RNA, 19 nt, Human
cuccccgcccacccugguc

SEQ ID NO: 396999 - RNA, 19 nt, Human
cuccccgcccagcagcccc

SEQ ID NO: 397000 - RNA, 18 nt, Human
cuccccgcccagggaccc

SEQ ID NO: 397001 - RNA, 23 nt, Human
cuccccgcccagggaccccuccc

SEQ ID NO: 397002 - RNA, 26 nt, Human
cuccccgccccaacucacucuggccu

SEQ ID NO: 397003 - RNA, 22 nt, Human
cuccccgccccaccccacgccu

SEQ ID NO: 397004 - RNA, 20 nt, Human
cuccccgccccacccgcccc

SEQ ID NO: 397005 - RNA, 32 nt, Human
cuccccgcccccgcgggacacgcccagauucu

SEQ ID NO: 397006 - RNA, 22 nt, Human
cuccccgcccccucccgcggcc

SEQ ID NO: 397007 - RNA, 18 nt, Human
cuccccgccccgcaccgg

SEQ ID NO: 397008 - RNA, 21 nt, Human
cuccccgccccgcaccggccu

SEQ ID NO: 397009 - RNA, 18 nt, Human
cuccccgccccgcugccg

SEQ ID NO: 397010 - RNA, 24 nt, Human
cuccccgccccuguggcccuggcc

SEQ ID NO: 397011 - RNA, 22 nt, Human
cuccccgccccuucccugagcc

SEQ ID NO: 397012 - RNA, 19 nt, Human
cuccccgcccgccccgccg

SEQ ID NO: 397013 - RNA, 18 nt, Human
cuccccgcccgcgccgcc

SEQ ID NO: 397014 - RNA, 21 nt, Human
cuccccgcccggcccugcccu

SEQ ID NO: 397015 - RNA, 20 nt, Human
cuccccgcccgugucccgcc

SEQ ID NO: 397016 - RNA, 23 nt, Human
cuccccgcccucagcccuggccu

SEQ ID NO: 397017 - RNA, 21 nt, Human
cuccccgcccucgccgcgccg

SEQ ID NO: 397018 - RNA, 20 nt, Human
cuccccgcccucucccggcc

SEQ ID NO: 397019 - RNA, 23 nt, Human
cuccccgcccucucucacucccc

SEQ ID NO: 397020 - RNA, 19 nt, Human
cuccccgcccucugcugcc

SEQ ID NO: 397021 - RNA, 21 nt, Human
cuccccgcccucuucccggcc

SEQ ID NO: 397022 - RNA, 19 nt, Human
cuccccgcccugccuggcc

SEQ ID NO: 397023 - RNA, 18 nt, Human
cuccccgccgccgccccg

SEQ ID NO: 397024 - RNA, 19 nt, Human
cuccccgccgccgccgcgc

SEQ ID NO: 397025 - RNA, 18 nt, Human
cuccccgccgccgccucc

SEQ ID NO: 397026 - RNA, 17 nt, Human
cuccccgccgccgcugc

SEQ ID NO: 397027 - RNA, 32 nt, Human
cuccccgccgccgcuuccuccacccccagucc

SEQ ID NO: 397028 - RNA, 32 nt, Human
cuccccgccgccuguuuccucaccuucucucc

SEQ ID NO: 397029 - RNA, 20 nt, Human
cuccccgccgcgccccugcc

SEQ ID NO: 397030 - RNA, 20 nt, Human
cuccccgccuccucccggcc

SEQ ID NO: 397031 - RNA, 19 nt, Human
cuccccgccucgcgcugcu

SEQ ID NO: 397032 - RNA, 21 nt, Human
cuccccgccucucugcagccu

SEQ ID NO: 397033 - RNA, 19 nt, Human
cuccccgccugacccggcc

SEQ ID NO: 397034 - RNA, 19 nt, Human
cuccccgccuggccuggcc

SEQ ID NO: 397035 - RNA, 32 nt, Human
cuccccgccugggagcucagcuuuccucagaa

SEQ ID NO: 397036 - RNA, 24 nt, Human
cuccccgccugugucccccuggcu

SEQ ID NO: 397037 - RNA, 19 nt, Human
cuccccgcgccgccccgcc

SEQ ID NO: 397038 - RNA, 20 nt, Human
cuccccgcgccgccgagacc

SEQ ID NO: 397039 - RNA, 20 nt, Human
cuccccgcgccgccgccgcc

SEQ ID NO: 397040 - RNA, 21 nt, Human
cuccccgcgccgccuccucug

SEQ ID NO: 397041 - RNA, 20 nt, Human
cuccccgcgccgcgaggccg

SEQ ID NO: 397042 - RNA, 19 nt, Human
cuccccgcgccgcucgcgc

SEQ ID NO: 397043 - RNA, 23 nt, Human
cuccccgcgccucccggucgccg

SEQ ID NO: 397044 - RNA, 32 nt, Human
cuccccgcgcgagagcggccccugccaccggg

SEQ ID NO: 397045 - RNA, 21 nt, Human
cuccccgcgcgccccgccgcu

SEQ ID NO: 397046 - RNA, 20 nt, Human
cuccccgcgcggucccggcc

SEQ ID NO: 397047 - RNA, 32 nt, Human
cuccccgcucauagaagccuggucccucuguc

SEQ ID NO: 397048 - RNA, 22 nt, Human
cuccccgcuccccggcccggcc

SEQ ID NO: 397049 - RNA, 22 nt, Human
cuccccgcuccgucucuguccu

SEQ ID NO: 397050 - RNA, 32 nt, Human
cuccccgcuccuccuccccagccauggcguuc

SEQ ID NO: 397051 - RNA, 24 nt, Human
cuccccgcucguccuccccgggcc

SEQ ID NO: 397052 - RNA, 20 nt, Human
cuccccgcucugccgccgcc

SEQ ID NO: 397053 - RNA, 18 nt, Human
cuccccgcugagcugcug

SEQ ID NO: 397054 - RNA, 22 nt, Human
cuccccgcugccgccaccgccg

SEQ ID NO: 397055 - RNA, 32 nt, Human
cuccccgcugccgccuccuccugggcugggcc

SEQ ID NO: 397056 - RNA, 23 nt, Human
cuccccgcugccugcccugaccu

SEQ ID NO: 397057 - RNA, 22 nt, Human
cuccccgcugucucccccugcc

SEQ ID NO: 397058 - RNA, 32 nt, Human
cuccccgcugugguuggcagccacccacccca

SEQ ID NO: 397059 - RNA, 19 nt, Human
cuccccgcuuccacccucc

SEQ ID NO: 397060 - RNA, 21 nt, Human
cuccccgcuucugccugcacc

SEQ ID NO: 397061 - RNA, 32 nt, Human
cuccccgcuucugcuuggcuuuccggcuuaau

SEQ ID NO: 397062 - RNA, 21 nt, Human
cuccccggacuaagccucccu

SEQ ID NO: 397063 - RNA, 22 nt, Human
cuccccggcagccgccgccgcc

SEQ ID NO: 397064 - RNA, 32 nt, Human
cuccccggcaggccugagaaugagugggaauc

SEQ ID NO: 397065 - RNA, 32 nt, Human
cuccccggccacggcagcacagaacgggcccg

SEQ ID NO: 397066 - RNA, 32 nt, Human
cuccccggccaggcacguggcaccgucgccuu

SEQ ID NO: 397067 - RNA, 32 nt, Human
cuccccggccugacagacccagggagcugcag

SEQ ID NO: 397068 - RNA, 32 nt, Human
cuccccggccugcucagacuccuccacgcucg

SEQ ID NO: 397069 - RNA, 32 nt, Human
cuccccggccuggguuggagggagcggauggg

SEQ ID NO: 397070 - RNA, 21 nt, Human
cuccccggcucgcgccgcucc

SEQ ID NO: 397071 - RNA, 32 nt, Human
cuccccggcugauuugcgcaucaggaggagga

SEQ ID NO: 397072 - RNA, 32 nt, Human
cuccccggcugcaggcggcgugcaggaccagc

SEQ ID NO: 397073 - RNA, 23 nt, Human
cuccccggcugccgccgccgccg

SEQ ID NO: 397074 - RNA, 32 nt, Human
cuccccgggacagccacgggggccaagugaaa

SEQ ID NO: 397075 - RNA, 24 nt, Human
cuccccgggcggcugcaucccggg

SEQ ID NO: 397076 - RNA, 22 nt, Human
cuccccgggcuccccgccgccg

SEQ ID NO: 397077 - RNA, 19 nt, Human
cuccccggggcagcgaccu

SEQ ID NO: 397078 - RNA, 32 nt, Human
cuccccggucagagggccggagcgagaagaug

SEQ ID NO: 397079 - RNA, 21 nt, Human
cuccccgugccagcacugccg

SEQ ID NO: 397080 - RNA, 32 nt, Human
cuccccguggucacauggagguugugggccga

SEQ ID NO: 397081 - RNA, 32 nt, Human
cuccccguuucucuccccaucuuggcugcugu

SEQ ID NO: 397082 - RNA, 32 nt, Human
cuccccuaaagaaaaaggauauuagauugcac

SEQ ID NO: 397083 - RNA, 32 nt, Human
cuccccuacaaagcagaccagccuggggcaga

SEQ ID NO: 397084 - RNA, 32 nt, Human
cuccccuacaucuguuuucuucuguauuucuu

SEQ ID NO: 397085 - RNA, 32 nt, Human
cuccccuacuggaggcaaaggaaggggagggu

SEQ ID NO: 397086 - RNA, 32 nt, Human
cuccccuacuggccccuggcucaggcccacac

SEQ ID NO: 397087 - RNA, 32 nt, Human
cuccccuagacccuggaaauucuuuccuuccu

SEQ ID NO: 397088 - RNA, 21 nt, Human
cuccccuagcccuccaucccc

SEQ ID NO: 397089 - RNA, 32 nt, Human
cuccccuaugccucagccccaucucugcuccu

SEQ ID NO: 397090 - RNA, 17 nt, Human
cuccccucaccaggaga

SEQ ID NO: 397091 - RNA, 32 nt, Human
cuccccucacccuccucaccuuccucacaucc

SEQ ID NO: 397092 - RNA, 22 nt, Human
cuccccucaccgccucccaggu

SEQ ID NO: 397093 - RNA, 32 nt, Human
cuccccucagacacccucagagaguucacacu

SEQ ID NO: 397094 - RNA, 32 nt, Human
cuccccucagacuagcuuucagucuucuguca

SEQ ID NO: 397095 - RNA, 32 nt, Human
cuccccucagccauggacaugcuucauccauc

SEQ ID NO: 397096 - RNA, 32 nt, Human
cuccccucagcccaucuugcucccucuucagc

SEQ ID NO: 397097 - RNA, 32 nt, Human
cuccccucagcuuaacgaugaagaggagaacu

SEQ ID NO: 397098 - RNA, 32 nt, Human
cuccccucauccgauuccccuguaucagucac

SEQ ID NO: 397099 - RNA, 32 nt, Human
cuccccucauuucaccuucagcauauauucua

SEQ ID NO: 397100 - RNA, 32 nt, Human
cuccccucauuuccaucucccagcccccaggg

SEQ ID NO: 397101 - RNA, 32 nt, Human
cuccccucauuuccucuucuccuuacuaaggu

SEQ ID NO: 397102 - RNA, 21 nt, Human
cuccccuccacccuccucucu

SEQ ID NO: 397103 - RNA, 32 nt, Human
cuccccuccagccugggcgacagagugagacu

SEQ ID NO: 397104 - RNA, 32 nt, Human
cuccccuccagccuuuggccuuggcuuuucua

SEQ ID NO: 397105 - RNA, 26 nt, Human
cuccccucccagcccucgcucucucg

SEQ ID NO: 397106 - RNA, 32 nt, Human
cuccccucccauccuuuuguaagcaaggaggg

SEQ ID NO: 397107 - RNA, 32 nt, Human
cuccccucccaucugugccucuguaaggggcu

SEQ ID NO: 397108 - RNA, 32 nt, Human
cuccccuccccaccucgcuucuucccaauuua

SEQ ID NO: 397109 - RNA, 32 nt, Human
cuccccucccccugcaggucccccuccccucu

SEQ ID NO: 397110 - RNA, 32 nt, Human
cuccccuccccucccucuuuuuaguuuuaauu

SEQ ID NO: 397111 - RNA, 32 nt, Human
cuccccuccccucuccccuugacuccucuccg

SEQ ID NO: 397112 - RNA, 32 nt, Human
cuccccuccccuuuuucauuccuuccuccccc

SEQ ID NO: 397113 - RNA, 32 nt, Human
cuccccucccuauauacccccaccccacaaag

SEQ ID NO: 397114 - RNA, 25 nt, Human
cuccccuccggagcugggauccagg

SEQ ID NO: 397115 - RNA, 32 nt, Human
cuccccuccggcccucuccacugcuuuccaga

SEQ ID NO: 397116 - RNA, 32 nt, Human
cuccccuccugaggcagugcaggaggccugug

SEQ ID NO: 397117 - RNA, 32 nt, Human
cuccccuccugcccuucgcuccuggguugguu

SEQ ID NO: 397118 - RNA, 32 nt, Human
cuccccucgguguggcuggugggugagccgug

SEQ ID NO: 397119 - RNA, 32 nt, Human
cuccccucguuuuugaccuuuguccccaaaug

SEQ ID NO: 397120 - RNA, 32 nt, Human
cuccccucuauucuuugucucaggugaugucu

SEQ ID NO: 397121 - RNA, 32 nt, Human
cuccccucucaggggaauaaagugucaagcaa

SEQ ID NO: 397122 - RNA, 32 nt, Human
cuccccucuccccucucccguucuuccuccca

SEQ ID NO: 397123 - RNA, 32 nt, Human
cuccccucucccucccccucccccgccggugg

SEQ ID NO: 397124 - RNA, 24 nt, Human
cuccccucuccgccuaagccugcc

SEQ ID NO: 397125 - RNA, 32 nt, Human
cuccccucuccguugugcccuggaccucgggc

SEQ ID NO: 397126 - RNA, 32 nt, Human
cuccccucuccucuaacugcuggauuugucuu

SEQ ID NO: 397127 - RNA, 25 nt, Human
cuccccucucucucuucucugucuc

SEQ ID NO: 397128 - RNA, 32 nt, Human
cuccccucucuggguugacugcauuucuagac

SEQ ID NO: 397129 - RNA, 23 nt, Human
cuccccucucuugcacccgccuc

SEQ ID NO: 397130 - RNA, 32 nt, Human
cuccccucugcacuuuguuuacuuguuuugca

SEQ ID NO: 397131 - RNA, 32 nt, Human
cuccccucugucucccuccugcucuggccaua

SEQ ID NO: 397132 - RNA, 32 nt, Human
cuccccucuugcacuuucucuccagucaccau

SEQ ID NO: 397133 - RNA, 32 nt, Human
cuccccucuuuucccucccucuccuccccuuc

SEQ ID NO: 397134 - RNA, 31 nt, Human
cuccccugaaaucaagacaggggccacccga

SEQ ID NO: 397135 - RNA, 32 nt, Human
cuccccugaacagcagcugcagcagccauggc

SEQ ID NO: 397136 - RNA, 32 nt, Human
cuccccugaaggaggaucgagagccggugaau

SEQ ID NO: 397137 - RNA, 32 nt, Human
cuccccugacacugaagaggauccacaacucc

SEQ ID NO: 397138 - RNA, 32 nt, Human
cuccccugagaacacaggacaggccugcugac

SEQ ID NO: 397139 - RNA, 32 nt, Human
cuccccugcacuccagacugaucugccugggg

SEQ ID NO: 397140 - RNA, 32 nt, Human
cuccccugcagcuuccucugcuucuggaauga

SEQ ID NO: 397141 - RNA, 32 nt, Human
cuccccugccaaaggccaggccgccacagagc

SEQ ID NO: 397142 - RNA, 32 nt, Human
cuccccugccacccagccucugaggccggcuc

SEQ ID NO: 397143 - RNA, 32 nt, Human
cuccccugccagccuaggauuuugggcgucau

SEQ ID NO: 397144 - RNA, 32 nt, Human
cuccccugcccaggcagcugguggugggcgcu

SEQ ID NO: 397145 - RNA, 32 nt, Human
cuccccugcccucagaaggaaaggagagggcu

SEQ ID NO: 397146 - RNA, 32 nt, Human
cuccccugcccucuggcuuccugcugagguca

SEQ ID NO: 397147 - RNA, 19 nt, Human
cuccccugcccugcugccg

SEQ ID NO: 397148 - RNA, 32 nt, Human
cuccccugcccugguccagggaagcuggccga

SEQ ID NO: 397149 - RNA, 19 nt, Human
cuccccugccgccgcugcu

SEQ ID NO: 397150 - RNA, 20 nt, Human
cuccccugccgccgcugcuc

SEQ ID NO: 397151 - RNA, 20 nt, Human
cuccccugccgggcugcaag

SEQ ID NO: 397152 - RNA, 32 nt, Human
cuccccugccuccccagggccucugcucuccu

SEQ ID NO: 397153 - RNA, 21 nt, Human
cuccccugccuggucuuccaa

SEQ ID NO: 397154 - RNA, 32 nt, Human
cuccccugcgucgcuaagacugucauaaaaug

SEQ ID NO: 397155 - RNA, 32 nt, Human
cuccccugcuacugcugaccaaauucccagga

SEQ ID NO: 397156 - RNA, 22 nt, Human
cuccccugcucccucccagguc

SEQ ID NO: 397157 - RNA, 32 nt, Human
cuccccugcugguugauguggaauacgccagc

SEQ ID NO: 397158 - RNA, 32 nt, Human
cuccccugcuguguggccuuaggcaacggcuu

SEQ ID NO: 397159 - RNA, 32 nt, Human
cuccccugcuucucccccuccuaccugagagg

SEQ ID NO: 397160 - RNA, 32 nt, Human
cuccccuggcacuggcugggaccauggugggc

SEQ ID NO: 397161 - RNA, 32 nt, Human
cuccccuggcagcagaagugggugcaggaagg

SEQ ID NO: 397162 - RNA, 32 nt, Human
cuccccuggcugcaaaugcuuuucugaaagua

SEQ ID NO: 397163 - RNA, 32 nt, Human
cuccccugggcaacugcagccaccuccaaacu

SEQ ID NO: 397164 - RNA, 32 nt, Human
cuccccuggggucaggagaggccgagccccag

SEQ ID NO: 397165 - RNA, 32 nt, Human
cuccccugguauagccucgcagggcugggguc

SEQ ID NO: 397166 - RNA, 32 nt, Human
cuccccuguaguuuaggacacaaaacagcuac

SEQ ID NO: 397167 - RNA, 19 nt, Human
cuccccuguaucugcagca

SEQ ID NO: 397168 - RNA, 32 nt, Human
cuccccuguauuauuuccuauaacuccaugug

SEQ ID NO: 397169 - RNA, 32 nt, Human
cuccccuguccuccuccaccuucuuccucugg

SEQ ID NO: 397170 - RNA, 32 nt, Human
cuccccugucuccuuuccuccuccuggguuca

SEQ ID NO: 397171 - RNA, 32 nt, Human
cuccccugugccagugccaccugggugccucc

SEQ ID NO: 397172 - RNA, 32 nt, Human
cuccccuguggaaaggucuauaugacgggccg

SEQ ID NO: 397173 - RNA, 32 nt, Human
cuccccuguggaaauuggggucuguugguggg

SEQ ID NO: 397174 - RNA, 32 nt, Human
cuccccugugugugagcaagaccacagcucuc

SEQ ID NO: 397175 - RNA, 32 nt, Human
cuccccuguuccuucuccuccccgucccuucu

SEQ ID NO: 397176 - RNA, 32 nt, Human
cuccccuguuugggacaggccgugcucccacc

SEQ ID NO: 397177 - RNA, 21 nt, Human
cuccccuguuuuucugccugc

SEQ ID NO: 397178 - RNA, 32 nt, Human
cuccccuuaagaaaccuuaaagaaauaaguau

SEQ ID NO: 397179 - RNA, 32 nt, Human
cuccccuuacccaggcuuaggcuuaauuaccu

SEQ ID NO: 397180 - RNA, 32 nt, Human
cuccccuuaugauuacuaaauauuuuauuuug

SEQ ID NO: 397181 - RNA, 19 nt, Human
cuccccuucaaggacuucu

SEQ ID NO: 397182 - RNA, 32 nt, Human
cuccccuucacucaggcccugggaaaccagcc

SEQ ID NO: 397183 - RNA, 32 nt, Human
cuccccuucacucccaccgcaggauuugggcu

SEQ ID NO: 397184 - RNA, 32 nt, Human
cuccccuuccacccucacccccaggucccagc

SEQ ID NO: 397185 - RNA, 32 nt, Human
cuccccuuccacccucagcuccacccucaggc

SEQ ID NO: 397186 - RNA, 32 nt, Human
cuccccuucccacucccugcucucagcauucu

SEQ ID NO: 397187 - RNA, 18 nt, Human
cuccccuuccccgucccc

SEQ ID NO: 397188 - RNA, 32 nt, Human
cuccccuuccccucccccuccccucccccucc

SEQ ID NO: 397189 - RNA, 27 nt, Human
cuccccuuccuaccgcacccucagguc

SEQ ID NO: 397190 - RNA, 32 nt, Human
cuccccuuccuuucccccuccuccgggggcca

SEQ ID NO: 397191 - RNA, 32 nt, Human
cuccccuucuccccacuuucaccuccccaccc

SEQ ID NO: 397192 - RNA, 32 nt, Human
cuccccuucucccggccuuccucugccugggg

SEQ ID NO: 397193 - RNA, 32 nt, Human
cuccccuucuuucucuuccuucugccuccccc

SEQ ID NO: 397194 - RNA, 32 nt, Human
cuccccuugcagcugaugacacaucugaggaa

SEQ ID NO: 397195 - RNA, 32 nt, Human
cuccccuugcccacugggacuccucuuuggcu

SEQ ID NO: 397196 - RNA, 32 nt, Human
cuccccuuggagcucuugccaaaggaggagac

SEQ ID NO: 397197 - RNA, 32 nt, Human
cuccccuuggccaggacaugcugcugcuacug

SEQ ID NO: 397198 - RNA, 32 nt, Human
cuccccuuggccggggcaacaccaguuacugu

SEQ ID NO: 397199 - RNA, 32 nt, Human
cuccccuuggcuugaucucucauacaaagguu

SEQ ID NO: 397200 - RNA, 32 nt, Human
cuccccuugggcccugccuggagugugugccg

SEQ ID NO: 397201 - RNA, 32 nt, Human
cuccccuuggggaccuagccuggagucaggac

SEQ ID NO: 397202 - RNA, 32 nt, Human
cuccccuugguauaacugauuuccuuuuuagu

SEQ ID NO: 397203 - RNA, 32 nt, Human
cuccccuuuagcucugugaugccugccuguua

SEQ ID NO: 397204 - RNA, 32 nt, Human
cucccgaaaauacaaaauuagccaggcguggu

SEQ ID NO: 397205 - RNA, 32 nt, Human
cucccgaaagccgugcucuccagccuggcugc

SEQ ID NO: 397206 - RNA, 32 nt, Human
cucccgaaagugcugggauuacagucaugagc

SEQ ID NO: 397207 - RNA, 24 nt, Human
cucccgaaaugcugggauuacagg

SEQ ID NO: 397208 - RNA, 32 nt, Human
cucccgaaaugcugggauuacaggcaugagcc

SEQ ID NO: 397209 - RNA, 32 nt, Human
cucccgaaauguugguauuacaggcaugagcc

SEQ ID NO: 397210 - RNA, 22 nt, Human
cucccgaacuacugacuuugaa

SEQ ID NO: 397211 - RNA, 27 nt, Human
cucccgaaggcucgcacagccucccca

SEQ ID NO: 397212 - RNA, 32 nt, Human
cucccgaagugcuaagauuacaggcgugagcc

SEQ ID NO: 397213 - RNA, 24 nt, Human
cucccgaagugcuggaauuacagg

SEQ ID NO: 397214 - RNA, 32 nt, Human
cucccgaagugcuggaauuacaggcgugagcc

SEQ ID NO: 397215 - RNA, 32 nt, Human
cucccgaagugcuggcauuacaggcaugagcc

SEQ ID NO: 397216 - RNA, 23 nt, Human
cucccgaagugcugggauuacag

SEQ ID NO: 397217 - RNA, 24 nt, Human
cucccgaagugcugggauuacagg

SEQ ID NO: 397218 - RNA, 32 nt, Human
cucccgaagugcugggauuacaggcaugagcc

SEQ ID NO: 397219 - RNA, 32 nt, Human
cucccgaagugcugggauuacaggcgggagcc

SEQ ID NO: 397220 - RNA, 32 nt, Human
cucccgaagugcugggauuacaggcguaagcc

SEQ ID NO: 397221 - RNA, 32 nt, Human
cucccgaagugcugggauuacaggcgugagcc

SEQ ID NO: 397222 - RNA, 32 nt, Human
cucccgaagugcugggauuacaggugugagcc

SEQ ID NO: 397223 - RNA, 32 nt, Human
cucccgaagugcugggauuacugacaugagcc

SEQ ID NO: 397224 - RNA, 24 nt, Human
cucccgaagugcugggauuauagg

SEQ ID NO: 397225 - RNA, 32 nt, Human
cucccgaagugcugggauuauaggugugagcc

SEQ ID NO: 397226 - RNA, 24 nt, Human
cucccgaagugcugggauugcagg

SEQ ID NO: 397227 - RNA, 32 nt, Human
cucccgaagugcugggauugcaggcauaagcu

SEQ ID NO: 397228 - RNA, 32 nt, Human
cucccgaagugcugggauugcaggcgugagcc

SEQ ID NO: 397229 - RNA, 32 nt, Human
cucccgaagugcuuggauuacaggugugagcc

SEQ ID NO: 397230 - RNA, 24 nt, Human
cucccgaaguguugggauuacagg

SEQ ID NO: 397231 - RNA, 32 nt, Human
cucccgaaguguugggauuacaggcacgagcc

SEQ ID NO: 397232 - RNA, 32 nt, Human
cucccgaauagcagggacuacaggcaugcgcc

SEQ ID NO: 397233 - RNA, 32 nt, Human
cucccgaauagcugggauuacagacaggcacc

SEQ ID NO: 397234 - RNA, 24 nt, Human
cucccgaauagcugggauuacagg

SEQ ID NO: 397235 - RNA, 32 nt, Human
cucccgaauagcugggauuacaggcgcccgcc

SEQ ID NO: 397236 - RNA, 32 nt, Human
cucccgaauggcugggacuacaggcacccacc

SEQ ID NO: 397237 - RNA, 22 nt, Human
cucccgacaauggcgccuccca

SEQ ID NO: 397238 - RNA, 22 nt, Human
cucccgacaggggacacuccca

SEQ ID NO: 397239 - RNA, 32 nt, Human
cucccgaccagccccagcgcggugggcccagg

SEQ ID NO: 397240 - RNA, 28 nt, Human
cucccgaccagugcugcccuguuugccc

SEQ ID NO: 397241 - RNA, 22 nt, Human
cucccgacgggccucgggccug

SEQ ID NO: 397242 - RNA, 32 nt, Human
cucccgacguggugggguuacaggcaugagcc

SEQ ID NO: 397243 - RNA, 32 nt, Human
cucccgacuagcugggacuacaggcgcccgcc

SEQ ID NO: 397244 - RNA, 32 nt, Human
cucccgagagaagacagacaaugagcaaguaa

SEQ ID NO: 397245 - RNA, 32 nt, Human
cucccgagcagcugggacuacaggcgcccgcc

SEQ ID NO: 397246 - RNA, 32 nt, Human
cucccgagcagcugggacuacaggcgcccgcu

SEQ ID NO: 397247 - RNA, 32 nt, Human
cucccgagcagcugggacuacaggcgugcgcc

SEQ ID NO: 397248 - RNA, 24 nt, Human
cucccgagcagcugggauuacagg

SEQ ID NO: 397249 - RNA, 18 nt, Human
cucccgagccgccugcua

SEQ ID NO: 397250 - RNA, 32 nt, Human
cucccgagcuccgacagcauuaccucacccgg

SEQ ID NO: 397251 - RNA, 32 nt, Human
cucccgagcugccccuccuuucccaggcccug

SEQ ID NO: 397252 - RNA, 20 nt, Human
cucccgagcugcccuucagg

SEQ ID NO: 397253 - RNA, 32 nt, Human
cucccgaggaacaggcgucuuccccgaacccu

SEQ ID NO: 397254 - RNA, 23 nt, Human
cucccgaggugccgggauugcag

SEQ ID NO: 397255 - RNA, 32 nt, Human
cucccgagguugccuuucuuagucccaaacua

SEQ ID NO: 397256 - RNA, 32 nt, Human
cucccgaguaaaaggcaugcaucaccacaccu

SEQ ID NO: 397257 - RNA, 24 nt, Human
cucccgaguaccugggauuacagg

SEQ ID NO: 397258 - RNA, 32 nt, Human
cucccgaguaccugggauuacaggcaugcacc

SEQ ID NO: 397259 - RNA, 32 nt, Human
cucccgaguaccugggauuacaggcaugugcc

SEQ ID NO: 397260 - RNA, 32 nt, Human
cucccgaguagcagggauuaccggugugcacc

SEQ ID NO: 397261 - RNA, 32 nt, Human
cucccgaguagcggggauuacaggcacgcgcu

SEQ ID NO: 397262 - RNA, 32 nt, Human
cucccgaguagcuaggauuacagaugugcauc

SEQ ID NO: 397263 - RNA, 32 nt, Human
cucccgaguagcucagauuacaggcaugugcc

SEQ ID NO: 397264 - RNA, 32 nt, Human
cucccgaguagcugagacuacaggcaugcacc

SEQ ID NO: 397265 - RNA, 32 nt, Human
cucccgaguagcugcuacuagagaugcaccac

SEQ ID NO: 397266 - RNA, 32 nt, Human
cucccgaguagcuggaauuacaggcaccugcc

SEQ ID NO: 397267 - RNA, 32 nt, Human
cucccgaguagcuggaauuacaggcaugcgcc

SEQ ID NO: 397268 - RNA, 32 nt, Human
cucccgaguagcuggcauuacaggcauguguc

SEQ ID NO: 397269 - RNA, 32 nt, Human
cucccgaguagcugggacuacaggcacaaguc

SEQ ID NO: 397270 - RNA, 32 nt, Human
cucccgaguagcugggacuacaggcacacagu

SEQ ID NO: 397271 - RNA, 32 nt, Human
cucccgaguagcugggacuacaggcacccacc

SEQ ID NO: 397272 - RNA, 32 nt, Human
cucccgaguagcugggacuacaggcacccgcc

SEQ ID NO: 397273 - RNA, 32 nt, Human
cucccgaguagcugggacuacaggcaccugcc

SEQ ID NO: 397274 - RNA, 32 nt, Human
cucccgaguagcugggacuacaggcacgugcu

SEQ ID NO: 397275 - RNA, 32 nt, Human
cucccgaguagcugggacuacaggcacgugug

SEQ ID NO: 397276 - RNA, 32 nt, Human
cucccgaguagcugggacuacaggcaggcgcc

SEQ ID NO: 397277 - RNA, 32 nt, Human
cucccgaguagcugggacuacaggcaugcacc

SEQ ID NO: 397278 - RNA, 32 nt, Human
cucccgaguagcugggacuacaggcaugugcc

SEQ ID NO: 397279 - RNA, 32 nt, Human
cucccgaguagcugggaguacaggcacacacc

SEQ ID NO: 397280 - RNA, 32 nt, Human
cucccgaguagcugggaucacaggugugcgcc

SEQ ID NO: 397281 - RNA, 22 nt, Human
cucccgaguagcugggauuaca

SEQ ID NO: 397282 - RNA, 32 nt, Human
cucccgaguagcugggauuacaagcacccacc

SEQ ID NO: 397283 - RNA, 32 nt, Human
cucccgaguagcugggauuacaagugcacacu

SEQ ID NO: 397284 - RNA, 32 nt, Human
cucccgaguagcugggauuacaagugcgcacu

SEQ ID NO: 397285 - RNA, 23 nt, Human
cucccgaguagcugggauuacag

SEQ ID NO: 397286 - RNA, 32 nt, Human
cucccgaguagcugggauuacagacaugugcc

SEQ ID NO: 397287 - RNA, 24 nt, Human
cucccgaguagcugggauuacagg

SEQ ID NO: 397288 - RNA, 32 nt, Human
cucccgaguagcugggauuacaggcacacacc

SEQ ID NO: 397289 - RNA, 32 nt, Human
cucccgaguagcugggauuacaggcacacgcc

SEQ ID NO: 397290 - RNA, 32 nt, Human
cucccgaguagcugggauuacaggcacaugcc

SEQ ID NO: 397291 - RNA, 32 nt, Human
cucccgaguagcugggauuacaggcacccacc

SEQ ID NO: 397292 - RNA, 32 nt, Human
cucccgaguagcugggauuacaggcacccgcc

SEQ ID NO: 397293 - RNA, 32 nt, Human
cucccgaguagcugggauuacaggcaccugcc

SEQ ID NO: 397294 - RNA, 32 nt, Human
cucccgaguagcugggauuacaggcaccuguc

SEQ ID NO: 397295 - RNA, 32 nt, Human
cucccgaguagcugggauuacaggcacgcacc

SEQ ID NO: 397296 - RNA, 32 nt, Human
cucccgaguagcugggauuacaggcacuugcc

SEQ ID NO: 397297 - RNA, 32 nt, Human
cucccgaguagcugggauuacaggcaucugcc

SEQ ID NO: 397298 - RNA, 32 nt, Human
cucccgaguagcugggauuacaggcaucugcu

SEQ ID NO: 397299 - RNA, 32 nt, Human
cucccgaguagcugggauuacaggcaugagcc

SEQ ID NO: 397300 - RNA, 32 nt, Human
cucccgaguagcugggauuacaggcaugcacc

SEQ ID NO: 397301 - RNA, 32 nt, Human
cucccgaguagcugggauuacaggcaugcgcc

SEQ ID NO: 397302 - RNA, 32 nt, Human
cucccgaguagcugggauuacaggcaugcgcu

SEQ ID NO: 397303 - RNA, 32 nt, Human
cucccgaguagcugggauuacaggcaugcucc

SEQ ID NO: 397304 - RNA, 32 nt, Human
cucccgaguagcugggauuacaggcaugugca

SEQ ID NO: 397305 - RNA, 32 nt, Human
cucccgaguagcugggauuacaggcaugugcc

SEQ ID NO: 397306 - RNA, 32 nt, Human
cucccgaguagcugggauuacaggcgcacgcc

SEQ ID NO: 397307 - RNA, 32 nt, Human
cucccgaguagcugggauuacaggcgcccacc

SEQ ID NO: 397308 - RNA, 32 nt, Human
cucccgaguagcugggauuacaggcgcccgcc

SEQ ID NO: 397309 - RNA, 32 nt, Human
cucccgaguagcugggauuacaggcgccugac

SEQ ID NO: 397310 - RNA, 32 nt, Human
cucccgaguagcugggauuacaggcgccugcc

SEQ ID NO: 397311 - RNA, 32 nt, Human
cucccgaguagcugggauuacaggcgugcacu

SEQ ID NO: 397312 - RNA, 32 nt, Human
cucccgaguagcugggauuacaggcgugcgcc

SEQ ID NO: 397313 - RNA, 32 nt, Human
cucccgaguagcugggauuacaggcgugugcc

SEQ ID NO: 397314 - RNA, 32 nt, Human
cucccgaguagcugggauuacaggcguguguc

SEQ ID NO: 397315 - RNA, 32 nt, Human
cucccgaguagcugggauuacaggugagcacc

SEQ ID NO: 397316 - RNA, 32 nt, Human
cucccgaguagcugggauuacaggugcaugcc

SEQ ID NO: 397317 - RNA, 32 nt, Human
cucccgaguagcugggauuacaggugcccacc

SEQ ID NO: 397318 - RNA, 32 nt, Human
cucccgaguagcugggauuacaggugccugcc

SEQ ID NO: 397319 - RNA, 32 nt, Human
cucccgaguagcugggauuacaggugcgcacu

SEQ ID NO: 397320 - RNA, 32 nt, Human
cucccgaguagcugggauuacaggugcgcccc

SEQ ID NO: 397321 - RNA, 32 nt, Human
cucccgaguagcugggauuacaggugcgcgcc

SEQ ID NO: 397322 - RNA, 32 nt, Human
cucccgaguagcugggauuacagguggugacu

SEQ ID NO: 397323 - RNA, 32 nt, Human
cucccgaguagcugggauuacaggugugcacc

SEQ ID NO: 397324 - RNA, 32 nt, Human
cucccgaguagcugggauuacaggugugggcc

SEQ ID NO: 397325 - RNA, 24 nt, Human
cucccgaguagcugggauuacggg

SEQ ID NO: 397326 - RNA, 32 nt, Human
cucccgaguagcugggauuacgggcauaugcc

SEQ ID NO: 397327 - RNA, 32 nt, Human
cucccgaguagcugggauuacgggcgcccgcc

SEQ ID NO: 397328 - RNA, 24 nt, Human
cucccgaguagcugggauuacugg

SEQ ID NO: 397329 - RNA, 24 nt, Human
cucccgaguagcugggauuagagg

SEQ ID NO: 397330 - RNA, 32 nt, Human
cucccgaguagcugggauuagaggcgugugcc

SEQ ID NO: 397331 - RNA, 23 nt, Human
cucccgaguagcugggauuauag

SEQ ID NO: 397332 - RNA, 24 nt, Human
cucccgaguagcugggauuauagg

SEQ ID NO: 397333 - RNA, 32 nt, Human
cucccgaguagcugggauuauaggcacccgcc

SEQ ID NO: 397334 - RNA, 32 nt, Human
cucccgaguagcugggauuauaggcaccugcc

SEQ ID NO: 397335 - RNA, 32 nt, Human
cucccgaguagcugggauuauaggcgagugcc

SEQ ID NO: 397336 - RNA, 32 nt, Human
cucccgaguagcugggauuauaggcgcccgcc

SEQ ID NO: 397337 - RNA, 24 nt, Human
cucccgaguagcugggauuauggg

SEQ ID NO: 397338 - RNA, 32 nt, Human
cucccgaguagcugggauuaugggcgcccacc

SEQ ID NO: 397339 - RNA, 32 nt, Human
cucccgaguagcugggauuaugggcgcccgcc

SEQ ID NO: 397340 - RNA, 24 nt, Human
cucccgaguagcugggauuccagg

SEQ ID NO: 397341 - RNA, 24 nt, Human
cucccgaguagcugggauugcagg

SEQ ID NO: 397342 - RNA, 32 nt, Human
cucccgaguagcugggauugcaggcgcccgcc

SEQ ID NO: 397343 - RNA, 32 nt, Human
cucccgaguagcugggauugcagguacccauc

SEQ ID NO: 397344 - RNA, 24 nt, Human
cucccgaguagcugggguuacagg

SEQ ID NO: 397345 - RNA, 32 nt, Human
cucccgaguagcugggguuacaggcaugcacc

SEQ ID NO: 397346 - RNA, 24 nt, Human
cucccgaguaguugggauuacagg

SEQ ID NO: 397347 - RNA, 32 nt, Human
cucccgaguaguugggauuacaggcgccugcc

SEQ ID NO: 397348 - RNA, 32 nt, Human
cucccgaguaucuggggcuacaggcauguacc

SEQ ID NO: 397349 - RNA, 24 nt, Human
cucccgagucacugggauuacagg

SEQ ID NO: 397350 - RNA, 32 nt, Human
cucccgagucucccuucuccgcucuccgagac

SEQ ID NO: 397351 - RNA, 32 nt, Human
cucccgagugacucggauuacaggcaugugcc

SEQ ID NO: 397352 - RNA, 32 nt, Human
cucccgaguggcugggauuagcggcaugcacc

SEQ ID NO: 397353 - RNA, 24 nt, Human
cucccgaguggcugggauuauagg

SEQ ID NO: 397354 - RNA, 32 nt, Human
cucccgaguggcugggauuauaggcgugcacc

SEQ ID NO: 397355 - RNA, 24 nt, Human
cucccgaguugcugggacuauagg

SEQ ID NO: 397356 - RNA, 24 nt, Human
cucccgaguugcugggauugcggg

SEQ ID NO: 397357 - RNA, 32 nt, Human
cucccgaguugcugggauugcgggcauggugg

SEQ ID NO: 397358 - RNA, 32 nt, Human
cucccgauccuguaguuaaccccacacaagau

SEQ ID NO: 397359 - RNA, 32 nt, Human
cucccgauuacuuccuuuacgucuagcaguau

SEQ ID NO: 397360 - RNA, 24 nt, Human
cucccgauuagcugggaucacagg

SEQ ID NO: 397361 - RNA, 25 nt, Human
cucccgauucuacagucuggcucua

SEQ ID NO: 397362 - RNA, 23 nt, Human
cucccgauuucccaggggcucug

SEQ ID NO: 397363 - RNA, 32 nt, Human
cucccgcaaggcaggucauagaaaccagaacc

SEQ ID NO: 397364 - RNA, 32 nt, Human
cucccgcaaugcugcaauuacagguguuagcc

SEQ ID NO: 397365 - RNA, 32 nt, Human
cucccgcacagcagccgccagcgcggccuccu

SEQ ID NO: 397366 - RNA, 32 nt, Human
cucccgcacccaaacuuggagcacuugaccuu

SEQ ID NO: 397367 - RNA, 32 nt, Human
cucccgcaccgcccggugcuccccaucugccu

SEQ ID NO: 397368 - RNA, 32 nt, Human
cucccgcagacugagccacagccugggccucc

SEQ ID NO: 397369 - RNA, 32 nt, Human
cucccgcagccccuguccaccauugacucucc

SEQ ID NO: 397370 - RNA, 21 nt, Human
cucccgcagccgcagccgccg

SEQ ID NO: 397371 - RNA, 32 nt, Human
cucccgcagccggugaggguuuggaaaccagg

SEQ ID NO: 397372 - RNA, 32 nt, Human
cucccgcaggcagauggacagacgauggcccc

SEQ ID NO: 397373 - RNA, 32 nt, Human
cucccgcagugaaggccuucuauaaccaaauu

SEQ ID NO: 397374 - RNA, 24 nt, Human
cucccgcagugcugggauuacagg

SEQ ID NO: 397375 - RNA, 32 nt, Human
cucccgcagugcugggauuacaggcaugagcc

SEQ ID NO: 397376 - RNA, 32 nt, Human
cucccgcaucccucgccugcacagugggcagu

SEQ ID NO: 397377 - RNA, 21 nt, Human
cucccgccaccgccgccgccg

SEQ ID NO: 397378 - RNA, 32 nt, Human
cucccgccaguccucggcuccugcugcaaagu

SEQ ID NO: 397379 - RNA, 18 nt, Human
cucccgcccaccuccagg

SEQ ID NO: 397380 - RNA, 32 nt, Human
cucccgcccaccuccaggucccaguccucugu

SEQ ID NO: 397381 - RNA, 23 nt, Human
cucccgccccucgccgccgcucg

SEQ ID NO: 397382 - RNA, 19 nt, Human
cucccgccgcccuggggcg

SEQ ID NO: 397383 - RNA, 16 nt, Human
cucccgccgccgcccg

SEQ ID NO: 397384 - RNA, 21 nt, Human
cucccgccgccgccgccgccg

SEQ ID NO: 397385 - RNA, 21 nt, Human
cucccgccgccgccgccgcug

SEQ ID NO: 397386 - RNA, 21 nt, Human
cucccgccgccuccgccgccg

SEQ ID NO: 397387 - RNA, 17 nt, Human
cucccgccgccuccggg

SEQ ID NO: 397388 - RNA, 15 nt, Human
cucccgccgcugcug

SEQ ID NO: 397389 - RNA, 32 nt, Human
cucccgccuccccucacccucaacucucaaug

SEQ ID NO: 397390 - RNA, 32 nt, Human
cucccgccucccugccuccagcccuggcugca

SEQ ID NO: 397391 - RNA, 32 nt, Human
cucccgccucccugcugagauuacagguguaa

SEQ ID NO: 397392 - RNA, 32 nt, Human
cucccgccuccuccucuugcuccuccucggcg

SEQ ID NO: 397393 - RNA, 22 nt, Human
cucccgccucuccccuccccau

SEQ ID NO: 397394 - RNA, 32 nt, Human
cucccgccuggaaucccagcacuuugggaggc

SEQ ID NO: 397395 - RNA, 32 nt, Human
cucccgccugggguugcugcuuuugcucagag

SEQ ID NO: 397396 - RNA, 32 nt, Human
cucccgccuguaaucccagaacuuugggaggc

SEQ ID NO: 397397 - RNA, 32 nt, Human
cucccgccuguaaucccagcacuuugggaagc

SEQ ID NO: 397398 - RNA, 32 nt, Human
cucccgccuguaaucccagcacuuugggaggc

SEQ ID NO: 397399 - RNA, 32 nt, Human
cucccgccuguaaucccaguacuuugggaagc

SEQ ID NO: 397400 - RNA, 32 nt, Human
cucccgccuguaaucccauuacuuugggaggc

SEQ ID NO: 397401 - RNA, 32 nt, Human
cucccgccuguaauccuagcacuuugggaggc

SEQ ID NO: 397402 - RNA, 32 nt, Human
cucccgccugugaucccggcacuuugggaggc

SEQ ID NO: 397403 - RNA, 32 nt, Human
cucccgcgacuagaagugugaggucccagggc

SEQ ID NO: 397404 - RNA, 32 nt, Human
cucccgcgcagccugcccccuccuggacgugc

SEQ ID NO: 397405 - RNA, 32 nt, Human
cucccgcgcagcugggacugcagggguguucc

SEQ ID NO: 397406 - RNA, 24 nt, Human
cucccgcgccccaccacccccggc

SEQ ID NO: 397407 - RNA, 32 nt, Human
cucccgcgccgcaaccuccuccucggcgaagu

SEQ ID NO: 397408 - RNA, 20 nt, Human
cucccgcgccgccgccgccg

SEQ ID NO: 397409 - RNA, 24 nt, Human
cucccgcgcugccacccgccgccg

SEQ ID NO: 397410 - RNA, 32 nt, Human
cucccgcgcugccucugcuguggucacagccc

SEQ ID NO: 397411 - RNA, 32 nt, Human
cucccgcggccagcccuucccucccagucggc

SEQ ID NO: 397412 - RNA, 20 nt, Human
cucccgcggccgccgccgcc

SEQ ID NO: 397413 - RNA, 21 nt, Human
cucccgcggggaccccccuca

SEQ ID NO: 397414 - RNA, 32 nt, Human
cucccgcgugggccucacagggccgguccaca

SEQ ID NO: 397415 - RNA, 32 nt, Human
cucccgcuccacccugcccgugcugcugcucu

SEQ ID NO: 397416 - RNA, 32 nt, Human
cucccgcuccaggcacaucccaccuuaccucu

SEQ ID NO: 397417 - RNA, 32 nt, Human
cucccgcuccggugaccccauccuugcacacc

SEQ ID NO: 397418 - RNA, 32 nt, Human
cucccgcucuauccuguucccugaccggcaug

SEQ ID NO: 397419 - RNA, 32 nt, Human
cucccgcugaagagaaaagaccagucugaaau

SEQ ID NO: 397420 - RNA, 19 nt, Human
cucccgcugacugcccaca

SEQ ID NO: 397421 - RNA, 32 nt, Human
cucccgcugccaugcacccugcagccuucccg

SEQ ID NO: 397422 - RNA, 32 nt, Human
cucccgcugccccagaaguuucuaucauucca

SEQ ID NO: 397423 - RNA, 21 nt, Human
cucccgcugccgccgccgccg

SEQ ID NO: 397424 - RNA, 32 nt, Human
cucccgcugcuccuggagucuuggggaggggu

SEQ ID NO: 397425 - RNA, 18 nt, Human
cucccgcugcugcugccg

SEQ ID NO: 397426 - RNA, 32 nt, Human
cucccgcuggcccaggucuccucuccaguccc

SEQ ID NO: 397427 - RNA, 32 nt, Human
cucccgcugguggaaguauaaagugguacaaa

SEQ ID NO: 397428 - RNA, 32 nt, Human
cucccgcuuccaucagaaccacugacuuccac

SEQ ID NO: 397429 - RNA, 26 nt, Human
cucccggacccuccacuuuggggcuu

SEQ ID NO: 397430 - RNA, 32 nt, Human
cucccggagaggggagcuggagggcgcgcccu

SEQ ID NO: 397431 - RNA, 32 nt, Human
cucccggagccgcggaacucggcggccgccau

SEQ ID NO: 397432 - RNA, 25 nt, Human
cucccggaggccugugggcugccag

SEQ ID NO: 397433 - RNA, 32 nt, Human
cucccggagggcccugagcugagggcauugcu

SEQ ID NO: 397434 - RNA, 32 nt, Human
cucccggaguagccacgacuccagccaccacc

SEQ ID NO: 397435 - RNA, 24 nt, Human
cucccggauagcugggauuacagg

SEQ ID NO: 397436 - RNA, 32 nt, Human
cucccggauagcugggauuacaggcgugcacc

SEQ ID NO: 397437 - RNA, 32 nt, Human
cucccggcaaggaggaggggaguuucuucugc

SEQ ID NO: 397438 - RNA, 20 nt, Human
cucccggcaagucgccgccg

SEQ ID NO: 397439 - RNA, 32 nt, Human
cucccggcaccaucccuuccuucaucugacuu

SEQ ID NO: 397440 - RNA, 21 nt, Human
cucccggcaccgccgccgucg

SEQ ID NO: 397441 - RNA, 32 nt, Human
cucccggcaccuaggucuccagcugcugggug

SEQ ID NO: 397442 - RNA, 32 nt, Human
cucccggcagccagggcuuccuggaggcgaug

SEQ ID NO: 397443 - RNA, 32 nt, Human
cucccggcagcccgggcucuggggcggaagga

SEQ ID NO: 397444 - RNA, 32 nt, Human
cucccggcagcccucggcauguaccuuuguug

SEQ ID NO: 397445 - RNA, 32 nt, Human
cucccggccccggccccguccucugcugcugg

SEQ ID NO: 397446 - RNA, 19 nt, Human
cucccggcccgccccgccg

SEQ ID NO: 397447 - RNA, 19 nt, Human
cucccggcccgcugccgcc

SEQ ID NO: 397448 - RNA, 32 nt, Human
cucccggcccugaugcguguacacucugcggg

SEQ ID NO: 397449 - RNA, 32 nt, Human
cucccggcccugccucccagcaaguaagcaag

SEQ ID NO: 397450 - RNA, 18 nt, Human
cucccggccgccgccuua

SEQ ID NO: 397451 - RNA, 32 nt, Human
cucccggccggccugcacgaugcacacgccgg

SEQ ID NO: 397452 - RNA, 32 nt, Human
cucccggccuccccucgcucugaggcucgggg

SEQ ID NO: 397453 - RNA, 22 nt, Human
cucccggccuggagugcagugg

SEQ ID NO: 397454 - RNA, 32 nt, Human
cucccggccuggcuugcugccugcaggccucu

SEQ ID NO: 397455 - RNA, 32 nt, Human
cucccggcgagcugcccuugucuuuggcacag

SEQ ID NO: 397456 - RNA, 20 nt, Human
cucccggcgccgccgccgcc

SEQ ID NO: 397457 - RNA, 21 nt, Human
cucccggcgcggccgccgccg

SEQ ID NO: 397458 - RNA, 32 nt, Human
cucccggcgcuagcagggcugaagagaagaug

SEQ ID NO: 397459 - RNA, 21 nt, Human
cucccggcggccgccgcugcc

SEQ ID NO: 397460 - RNA, 24 nt, Human
cucccggcuccacccaucacacua

SEQ ID NO: 397461 - RNA, 32 nt, Human
cucccggcucggcuucuuccccacagcaggcu

SEQ ID NO: 397462 - RNA, 22 nt, Human
cucccggcugccgcugcugccg

SEQ ID NO: 397463 - RNA, 32 nt, Human
cucccggcugcuggugggcacggaggaaccag

SEQ ID NO: 397464 - RNA, 32 nt, Human
cucccggcuguaucagucuuaacugaaccagc

SEQ ID NO: 397465 - RNA, 21 nt, Human
cucccggcuuccgccgccgcc

SEQ ID NO: 397466 - RNA, 32 nt, Human
cucccgggaaggagggcugagcaucgagaaac

SEQ ID NO: 397467 - RNA, 20 nt, Human
cucccgggaguaaaaccaca

SEQ ID NO: 397468 - RNA, 32 nt, Human
cucccgggagucuucugccuacucccagaaga

SEQ ID NO: 397469 - RNA, 32 nt, Human
cucccgggccuggccagcauccccagccuagg

SEQ ID NO: 397470 - RNA, 32 nt, Human
cucccgggcucacuggagugcaaacugcuuuc

SEQ ID NO: 397471 - RNA, 32 nt, Human
cucccgggcuuaauugaucuccugccucagcc

SEQ ID NO: 397472 - RNA, 32 nt, Human
cucccggggagcuauugggauccagagaauca

SEQ ID NO: 397473 - RNA, 32 nt, Human
cucccggggcugagucccugcccggacuccga

SEQ ID NO: 397474 - RNA, 32 nt, Human
cucccgggggaggagccaaggaaggggcgugg

SEQ ID NO: 397475 - RNA, 32 nt, Human
cucccggggugagugaggaggcgggauuggac

SEQ ID NO: 397476 - RNA, 32 nt, Human
cucccggggugcugggauuauaggcgugagcc

SEQ ID NO: 397477 - RNA, 32 nt, Human
cucccggguagcugggauuacaggcaugugcc

SEQ ID NO: 397478 - RNA, 32 nt, Human
cucccgggucgugagccaguagccuccugggg

SEQ ID NO: 397479 - RNA, 24 nt, Human
cucccggguggcugggaucacagg

SEQ ID NO: 397480 - RNA, 24 nt, Human
cucccggguggcugggauugcagg

SEQ ID NO: 397481 - RNA, 24 nt, Human
cucccggguggcugggauuguagg

SEQ ID NO: 397482 - RNA, 32 nt, Human
cucccggugagaggugagccagcuggacuucc

SEQ ID NO: 397483 - RNA, 32 nt, Human
cucccgguucaagcgauucuccugccucagcc

SEQ ID NO: 397484 - RNA, 19 nt, Human
cucccguccgccgccgccg

SEQ ID NO: 397485 - RNA, 21 nt, Human
cucccguccuccccgccgccg

SEQ ID NO: 397486 - RNA, 32 nt, Human
cucccgucuccaagccuucaugcacauaugua

SEQ ID NO: 397487 - RNA, 32 nt, Human
cucccgugacagccggcaggcccagcccaucc

SEQ ID NO: 397488 - RNA, 32 nt, Human
cucccgugcccucuccccgugugccccagggg

SEQ ID NO: 397489 - RNA, 32 nt, Human
cucccgugcggaucgcaaaaucucggagcuga

SEQ ID NO: 397490 - RNA, 32 nt, Human
cucccguggccuggacacgcuggggagcuucu

SEQ ID NO: 397491 - RNA, 18 nt, Human
cucccgugguggcccagg

SEQ ID NO: 397492 - RNA, 32 nt, Human
cucccguguccgagcugggauaccaaagaagu

SEQ ID NO: 397493 - RNA, 32 nt, Human
cucccguucccuccucuucucucugggaggca

SEQ ID NO: 397494 - RNA, 32 nt, Human
cucccguucuguccauuugucuugucugccga

SEQ ID NO: 397495 - RNA, 32 nt, Human
cucccguugcaugucuggcuucugccugugcu

SEQ ID NO: 397496 - RNA, 32 nt, Human
cucccguugcggccgcucccugccuuagaggc

SEQ ID NO: 397497 - RNA, 32 nt, Human
cucccuaaaugccgggauuacaggcaugagcc

SEQ ID NO: 397498 - RNA, 32 nt, Human
cucccuaacacagccacccucccuucauuacc

SEQ ID NO: 397499 - RNA, 24 nt, Human
cucccuaacagcugggauuacagg

SEQ ID NO: 397500 - RNA, 32 nt, Human
cucccuaacagcugggauuacaggcgugagcc

SEQ ID NO: 397501 - RNA, 32 nt, Human
cucccuaaccaccccugcaucaucucguuugu

SEQ ID NO: 397502 - RNA, 32 nt, Human
cucccuaaccuucagaccaguaaaccagaugc

SEQ ID NO: 397503 - RNA, 19 nt, Human
cucccuaagaaaccccagg

SEQ ID NO: 397504 - RNA, 32 nt, Human
cucccuaagaccuugagagccaugacaggucc

SEQ ID NO: 397505 - RNA, 22 nt, Human
cucccuaagagcuaauggcacc

SEQ ID NO: 397506 - RNA, 32 nt, Human
cucccuaagugcggggauuacaggcuugagcc

SEQ ID NO: 397507 - RNA, 24 nt, Human
cucccuaagugcugagauuacagg

SEQ ID NO: 397508 - RNA, 32 nt, Human
cucccuaagugcugggauuacagacgugaacc

SEQ ID NO: 397509 - RNA, 32 nt, Human
cucccuaagugcugggauuacaggcaugagcc

SEQ ID NO: 397510 - RNA, 24 nt, Human
cucccuaagugcugggauuauagg

SEQ ID NO: 397511 - RNA, 32 nt, Human
cucccuaagugcugggauuauaggcgugagcc

SEQ ID NO: 397512 - RNA, 24 nt, Human
cucccuaagugcugggauugcagg

SEQ ID NO: 397513 - RNA, 32 nt, Human
cucccuaagugcugggauugcaggcgugagcc

SEQ ID NO: 397514 - RNA, 28 nt, Human
cucccuaagugcuucuuuggaucucagg

SEQ ID NO: 397515 - RNA, 32 nt, Human
cucccuaaguguugggauuacaggcaugagcc

SEQ ID NO: 397516 - RNA, 32 nt, Human
cucccuaaguguugggauuauaggugugagcc

SEQ ID NO: 397517 - RNA, 25 nt, Human
cucccuaaguugcugggauuacagg

SEQ ID NO: 397518 - RNA, 32 nt, Human
cucccuaaguuuaaaggacugauuuggugccu

SEQ ID NO: 397519 - RNA, 32 nt, Human
cucccuaauaagucuucuuuccuuccaacuaa

SEQ ID NO: 397520 - RNA, 24 nt, Human
cucccuaauagcugggacuacagg

SEQ ID NO: 397521 - RNA, 32 nt, Human
cucccuaccaucccugaggcucgcuggaaggc

SEQ ID NO: 397522 - RNA, 32 nt, Human
cucccuaccccacgccuucucccuuccucguu

SEQ ID NO: 397523 - RNA, 32 nt, Human
cucccuaccucccucacuuucuuccucucucc

SEQ ID NO: 397524 - RNA, 32 nt, Human
cucccuaccuguaauuccagucuuugugcauu

SEQ ID NO: 397525 - RNA, 32 nt, Human
cucccuacgggagaggaugccccgcaggaaca

SEQ ID NO: 397526 - RNA, 32 nt, Human
cucccuacucaggccuccucggcgauggcuuu

SEQ ID NO: 397527 - RNA, 32 nt, Human
cucccuacuguuggauguaugugugacaagug

SEQ ID NO: 397528 - RNA, 32 nt, Human
cucccuagcagcugggacuauuagugcacacc

SEQ ID NO: 397529 - RNA, 24 nt, Human
cucccuagcagcugggauuacagg

SEQ ID NO: 397530 - RNA, 32 nt, Human
cucccuagcucaacgauccucucaccucagcc

SEQ ID NO: 397531 - RNA, 32 nt, Human
cucccuaggagaagaguugaggaacuguacag

SEQ ID NO: 397532 - RNA, 32 nt, Human
cucccuaggcuucuacccucccuccugauguc

SEQ ID NO: 397533 - RNA, 24 nt, Human
cucccuagguguugggauuacagg

SEQ ID NO: 397534 - RNA, 32 nt, Human
cucccuagguguugggauuacaggcgugagcc

SEQ ID NO: 397535 - RNA, 23 nt, Human
cucccuaguagcugggacuacag

SEQ ID NO: 397536 - RNA, 24 nt, Human
cucccuaguagcugggacuacagg

SEQ ID NO: 397537 - RNA, 32 nt, Human
cucccuaguagcugggaugacaagcacacgcc

SEQ ID NO: 397538 - RNA, 24 nt, Human
cucccuaguagcugggaugacagg

SEQ ID NO: 397539 - RNA, 32 nt, Human
cucccuaguagcugggauuacagccaugcacc

SEQ ID NO: 397540 - RNA, 24 nt, Human
cucccuaguagcugggauuacagg

SEQ ID NO: 397541 - RNA, 32 nt, Human
cucccuaguagcugggauuacaggcaugcacu

SEQ ID NO: 397542 - RNA, 32 nt, Human
cucccuaguagcugggauuacaggcaugugcc

SEQ ID NO: 397543 - RNA, 24 nt, Human
cucccuaguagcugggauuauagg

SEQ ID NO: 397544 - RNA, 24 nt, Human
cucccuaguggcugggauuacagg

SEQ ID NO: 397545 - RNA, 32 nt, Human
cucccuagugucccuucagccugggcugacca

SEQ ID NO: 397546 - RNA, 32 nt, Human
cucccuauacuccucaggcuccuggguggccu

SEQ ID NO: 397547 - RNA, 32 nt, Human
cucccuaugccaacaugucaccuguguuuaug

SEQ ID NO: 397548 - RNA, 21 nt, Human
cucccuaugcccaggccugcc

SEQ ID NO: 397549 - RNA, 32 nt, Human
cucccuaugucacccaggcuguggugcaguaa

SEQ ID NO: 397550 - RNA, 32 nt, Human
cucccuauuauggcaugcauuacacuguacug

SEQ ID NO: 397551 - RNA, 32 nt, Human
cucccucaagacuaagggcuacaguaguuugu

SEQ ID NO: 397552 - RNA, 32 nt, Human
cucccucaagcucuggauggcugcaguguugu

SEQ ID NO: 397553 - RNA, 32 nt, Human
cucccucaaggccuccuccaccuccaccucca

SEQ ID NO: 397554 - RNA, 32 nt, Human
cucccucaaugaaaacagacaccagaaccauc

SEQ ID NO: 397555 - RNA, 32 nt, Human
cucccucaaugccacccugaccccacggcugg

SEQ ID NO: 397556 - RNA, 32 nt, Human
cucccucacagcccuuggcuggggcuccucca

SEQ ID NO: 397557 - RNA, 21 nt, Human
cucccucacagugcgcagugg

SEQ ID NO: 397558 - RNA, 32 nt, Human
cucccucaccaccacgccucccugccuaccau

SEQ ID NO: 397559 - RNA, 22 nt, Human
cucccucaccagcucugcaccc

SEQ ID NO: 397560 - RNA, 32 nt, Human
cucccucacccaggcacugggcaagugaagag

SEQ ID NO: 397561 - RNA, 32 nt, Human
cucccucacccaggcugcagugccaugcagac

SEQ ID NO: 397562 - RNA, 32 nt, Human
cucccucaccucuuuggcuuaccagcucccau

SEQ ID NO: 397563 - RNA, 32 nt, Human
cucccucaccugcccagguguaugauccuaca

SEQ ID NO: 397564 - RNA, 32 nt, Human
cucccucacugcaacugaacacauuucuuagu

SEQ ID NO: 397565 - RNA, 18 nt, Human
cucccucagacccaggag

SEQ ID NO: 397566 - RNA, 19 nt, Human
cucccucagacccaggagu

SEQ ID NO: 397567 - RNA, 19 nt, Human
cucccucagacccaggggu

SEQ ID NO: 397568 - RNA, 19 nt, Human
cucccucagacccgggagu

SEQ ID NO: 397569 - RNA, 25 nt, Human
cucccucagcacccaaaaggggcag

SEQ ID NO: 397570 - RNA, 32 nt, Human
cucccucagccaaguccuuccuuacaaugaau

SEQ ID NO: 397571 - RNA, 32 nt, Human
cucccucagccauccaauucuugaguuuucuc

SEQ ID NO: 397572 - RNA, 21 nt, Human
cucccucagccugcaaccucu

SEQ ID NO: 397573 - RNA, 32 nt, Human
cucccucagccugcaaccucuauccuggaacc

SEQ ID NO: 397574 - RNA, 32 nt, Human
cucccucagcucacuccgagccuggagaacug

SEQ ID NO: 397575 - RNA, 21 nt, Human
cucccucagcuuguccugagu

SEQ ID NO: 397576 - RNA, 32 nt, Human
cucccucaggaucaggugcccugcagacccag

SEQ ID NO: 397577 - RNA, 32 nt, Human
cucccucaggcagagcagggaggaggcugaca

SEQ ID NO: 397578 - RNA, 32 nt, Human
cucccucaggggaggugggccaugcagcuaac

SEQ ID NO: 397579 - RNA, 32 nt, Human
cucccucagucuccucuccaugcccaagucgg

SEQ ID NO: 397580 - RNA, 32 nt, Human
cucccucagucuggcacccacugcuacacuca

SEQ ID NO: 397581 - RNA, 32 nt, Human
cucccucagucuggcccuuccuuuucgcagga

SEQ ID NO: 397582 - RNA, 32 nt, Human
cucccucauuguaaagacagcucuucccccug

SEQ ID NO: 397583 - RNA, 32 nt, Human
cucccucauuugagcaauacucucauuuccuc

SEQ ID NO: 397584 - RNA, 21 nt, Human
cucccuccaaccucccuccca

SEQ ID NO: 397585 - RNA, 23 nt, Human
cucccuccaaggaccaggucuca

SEQ ID NO: 397586 - RNA, 32 nt, Human
cucccuccacacagccacacugccucaugcag

SEQ ID NO: 397587 - RNA, 32 nt, Human
cucccuccacagucuccuuggcauuccaugac

SEQ ID NO: 397588 - RNA, 32 nt, Human
cucccuccaccaggauggcagccaggagcggc

SEQ ID NO: 397589 - RNA, 32 nt, Human
cucccuccaccuccucuccaccugcuggugag

SEQ ID NO: 397590 - RNA, 32 nt, Human
cucccuccacggucaccuucaacgcccagaca

SEQ ID NO: 397591 - RNA, 32 nt, Human
cucccuccagaacacaaaucagagggaaaggg

SEQ ID NO: 397592 - RNA, 32 nt, Human
cucccuccagcccagcuccauucuuuggcaua

SEQ ID NO: 397593 - RNA, 32 nt, Human
cucccuccagcccucgcuaugugccucugcca

SEQ ID NO: 397594 - RNA, 32 nt, Human
cucccuccagccugucccuggccaagccgccu

SEQ ID NO: 397595 - RNA, 32 nt, Human
cucccuccagcucugcuuaggcauuuugcccc

SEQ ID NO: 397596 - RNA, 19 nt, Human
cucccuccagcuguuuuca

SEQ ID NO: 397597 - RNA, 32 nt, Human
cucccuccagcuguuuucacucauuagcuccu

SEQ ID NO: 397598 - RNA, 32 nt, Human
cucccuccaucuuccuccccuuucccuuccag

SEQ ID NO: 397599 - RNA, 32 nt, Human
cucccuccaucuuccuccccuuuuccuuccag

SEQ ID NO: 397600 - RNA, 32 nt, Human
cucccuccaucuuugcauaguuucuggccccu

SEQ ID NO: 397601 - RNA, 32 nt, Human
cucccucccacacccagccuacuggguggacu

SEQ ID NO: 397602 - RNA, 32 nt, Human
cucccucccacaugggcauacaugcuguguau

SEQ ID NO: 397603 - RNA, 32 nt, Human
cucccucccagagcaccugcugucuggguggc

SEQ ID NO: 397604 - RNA, 32 nt, Human
cucccucccaggccgcacagguccugccaagc

SEQ ID NO: 397605 - RNA, 32 nt, Human
cucccuccccacuccuagcugcuccaggggca

SEQ ID NO: 397606 - RNA, 21 nt, Human
cucccuccccgcccgcacggc

SEQ ID NO: 397607 - RNA, 32 nt, Human
cucccuccccuagagcuauucuccuuuggguu

SEQ ID NO: 397608 - RNA, 32 nt, Human
cucccuccccuccuacuucucucacacucacc

SEQ ID NO: 397609 - RNA, 32 nt, Human
cucccuccccucuccacccuucagugcuggga

SEQ ID NO: 397610 - RNA, 31 nt, Human
cucccuccccucucugcugggucugugcgcu

SEQ ID NO: 397611 - RNA, 32 nt, Human
cucccuccccugccaccucuguccucaccuug

SEQ ID NO: 397612 - RNA, 32 nt, Human
cucccuccccuggcccccgggauuuccucugc

SEQ ID NO: 397613 - RNA, 32 nt, Human
cucccucccgccucaguggaucaugcccaggg

SEQ ID NO: 397614 - RNA, 21 nt, Human
cucccucccgccucccggguc

SEQ ID NO: 397615 - RNA, 22 nt, Human
cucccucccgggagugcgcacg

SEQ ID NO: 397616 - RNA, 32 nt, Human
cucccucccgggcugcucucuccacaucuccu

SEQ ID NO: 397617 - RNA, 18 nt, Human
cucccucccgucccccaa

SEQ ID NO: 397618 - RNA, 32 nt, Human
cucccucccuacugcuuccuaggagcuuccuc

SEQ ID NO: 397619 - RNA, 32 nt, Human
cucccucccuagcccuuccagccugggacaca

SEQ ID NO: 397620 - RNA, 32 nt, Human
cucccucccuccagcaucccucgggaaccuca

SEQ ID NO: 397621 - RNA, 32 nt, Human
cucccucccucccuccuccuccuuccucguuc

SEQ ID NO: 397622 - RNA, 32 nt, Human
cucccucccucccucuauccauucaucgugag

SEQ ID NO: 397623 - RNA, 32 nt, Human
cucccucccuccggauccccgcucucuccccg

SEQ ID NO: 397624 - RNA, 32 nt, Human
cucccucccucucuccccagcugccuccuccu

SEQ ID NO: 397625 - RNA, 18 nt, Human
cucccucccugccugcca

SEQ ID NO: 397626 - RNA, 32 nt, Human
cucccucccugccuucacuccccguccugccg

SEQ ID NO: 397627 - RNA, 32 nt, Human
cucccucccuguucucugccucuuguaccccu

SEQ ID NO: 397628 - RNA, 32 nt, Human
cucccucccuuccccgacggcuucuggcggcc

SEQ ID NO: 397629 - RNA, 32 nt, Human
cucccucccuuucccucccucgucgacuguuu

SEQ ID NO: 397630 - RNA, 32 nt, Human
cucccucccuuuccuccccucccugccucccu

SEQ ID NO: 397631 - RNA, 32 nt, Human
cucccucccuuucuaucguucucucuuugcau

SEQ ID NO: 397632 - RNA, 32 nt, Human
cucccucccuuucugucuuccucucuuuccuc

SEQ ID NO: 397633 - RNA, 32 nt, Human
cucccucccuuucuuccuuccuuccuugaugg

SEQ ID NO: 397634 - RNA, 32 nt, Human
cucccucccuuucuuucuuucuuucuaucucu

SEQ ID NO: 397635 - RNA, 32 nt, Human
cucccuccgagaggaggccagagggagaggag

SEQ ID NO: 397636 - RNA, 22 nt, Human
cucccuccgauccuuccuccca

SEQ ID NO: 397637 - RNA, 32 nt, Human
cucccuccggcuuggcagacucagccugucac

SEQ ID NO: 397638 - RNA, 32 nt, Human
cucccuccgugccuccccgccuuuucugcaga

SEQ ID NO: 397639 - RNA, 32 nt, Human
cucccuccuaacccucuccuugccugacaggg

SEQ ID NO: 397640 - RNA, 32 nt, Human
cucccuccuaguucugccccaggcucuucuuu

SEQ ID NO: 397641 - RNA, 21 nt, Human
cucccuccucaagcuguccuc

SEQ ID NO: 397642 - RNA, 32 nt, Human
cucccuccucaccuguccugugcuucucuuuc

SEQ ID NO: 397643 - RNA, 23 nt, Human
cucccuccuccacaccuugagug

SEQ ID NO: 397644 - RNA, 32 nt, Human
cucccuccuccaccgccacucccuuggccucg

SEQ ID NO: 397645 - RNA, 32 nt, Human
cucccuccuccacugacuccaacccugccuug

SEQ ID NO: 397646 - RNA, 32 nt, Human
cucccuccuccaggaagccuuccccuaccccu

SEQ ID NO: 397647 - RNA, 32 nt, Human
cucccuccuccaggcagccuuccuggucuacc

SEQ ID NO: 397648 - RNA, 21 nt, Human
cucccuccuccaggccugccu

SEQ ID NO: 397649 - RNA, 32 nt, Human
cucccuccucccaaccuccacccucaaguagg

SEQ ID NO: 397650 - RNA, 32 nt, Human
cucccuccucccaggcuggugugagugugcgu

SEQ ID NO: 397651 - RNA, 32 nt, Human
cucccuccuccccucccuccagucuccggauc

SEQ ID NO: 397652 - RNA, 32 nt, Human
cucccuccuccccuccuacucccuuuucucac

SEQ ID NO: 397653 - RNA, 32 nt, Human
cucccuccuccucauucccuuccaucucccuc

SEQ ID NO: 397654 - RNA, 32 nt, Human
cucccuccuccuuuuccccucucccuccuacu

SEQ ID NO: 397655 - RNA, 32 nt, Human
cucccuccucuccuuugagaggcccauguguc

SEQ ID NO: 397656 - RNA, 32 nt, Human
cucccuccucugguguuaaggcugcuuugggg

SEQ ID NO: 397657 - RNA, 32 nt, Human
cucccuccugcucuguccagguggucuggacc

SEQ ID NO: 397658 - RNA, 32 nt, Human
cucccuccugggaggccuuagcucuagaguga

SEQ ID NO: 397659 - RNA, 32 nt, Human
cucccuccuugcaguuggaucccuggcgggug

SEQ ID NO: 397660 - RNA, 22 nt, Human
cucccuccuuuauucccuggcc

SEQ ID NO: 397661 - RNA, 32 nt, Human
cucccuccuuucucccuuccuuccuuucuucc

SEQ ID NO: 397662 - RNA, 32 nt, Human
cucccucgaagcugcuguucucuugucugucu

SEQ ID NO: 397663 - RNA, 32 nt, Human
cucccucgacccucccccuccuugucccucug

SEQ ID NO: 397664 - RNA, 32 nt, Human
cucccucgagacuggccagcccaccucucccg

SEQ ID NO: 397665 - RNA, 32 nt, Human
cucccucgauccccagcaccccuccaggccca

SEQ ID NO: 397666 - RNA, 32 nt, Human
cucccucgccuaaagugcagcagcagcuccuc

SEQ ID NO: 397667 - RNA, 32 nt, Human
cucccucgcgcaucuccagccuaaggguuguc

SEQ ID NO: 397668 - RNA, 32 nt, Human
cucccucgcuucuucucucuuucuuacuucuu

SEQ ID NO: 397669 - RNA, 32 nt, Human
cucccucggagacgcagguugcaguggacauu

SEQ ID NO: 397670 - RNA, 22 nt, Human
cucccucggccugggauuucag

SEQ ID NO: 397671 - RNA, 32 nt, Human
cucccucgggcaggcccagagagccagagugg

SEQ ID NO: 397672 - RNA, 21 nt, Human
cucccucggguuugccuugag

SEQ ID NO: 397673 - RNA, 32 nt, Human
cucccucuauugcccaggcuggagugcagugg

SEQ ID NO: 397674 - RNA, 21 nt, Human
cucccucucacaggccugccu

SEQ ID NO: 397675 - RNA, 32 nt, Human
cucccucucagcagcuguucugcccaggcagg

SEQ ID NO: 397676 - RNA, 32 nt, Human
cucccucucaggcagagagguugccgagugau

SEQ ID NO: 397677 - RNA, 32 nt, Human
cucccucucagggguagcagagacaggguugc

SEQ ID NO: 397678 - RNA, 32 nt, Human
cucccucucauggcuaguaggagagacuggug

SEQ ID NO: 397679 - RNA, 32 nt, Human
cucccucuccacccccacuuucucuucuuccu

SEQ ID NO: 397680 - RNA, 32 nt, Human
cucccucuccaccuccuuuccucccccaucca

SEQ ID NO: 397681 - RNA, 32 nt, Human
cucccucuccagcccccgauguggacccgggg

SEQ ID NO: 397682 - RNA, 32 nt, Human
cucccucucccagaccagcuaguuuggggcug

SEQ ID NO: 397683 - RNA, 32 nt, Human
cucccucuccccuucaucuucugcuccaaagg

SEQ ID NO: 397684 - RNA, 32 nt, Human
cucccucuccccuuuuggagucuccuguaucu

SEQ ID NO: 397685 - RNA, 32 nt, Human
cucccucucccucucccacucucccucucuuu

SEQ ID NO: 397686 - RNA, 32 nt, Human
cucccucuccuccccucuccuccccuccccuc

SEQ ID NO: 397687 - RNA, 20 nt, Human
cucccucuccucuccucucu

SEQ ID NO: 397688 - RNA, 32 nt, Human
cucccucucuccauucuucucucagcuuuccu

SEQ ID NO: 397689 - RNA, 32 nt, Human
cucccucucucccucuuccucucccuuccagg

SEQ ID NO: 397690 - RNA, 32 nt, Human
cucccucucucucccucucucucccucucucu

SEQ ID NO: 397691 - RNA, 32 nt, Human
cucccucucucucccucucugccuccuccugc

SEQ ID NO: 397692 - RNA, 32 nt, Human
cucccucucugccuccuccugccugucugcac

SEQ ID NO: 397693 - RNA, 21 nt, Human
cucccucucugucccuuggca

SEQ ID NO: 397694 - RNA, 32 nt, Human
cucccucucuuccucccuuccuccucucccca

SEQ ID NO: 397695 - RNA, 32 nt, Human
cucccucucuuucaggggcugccugggccucu

SEQ ID NO: 397696 - RNA, 32 nt, Human
cucccucugcaagcucuguccucauugcaugu

SEQ ID NO: 397697 - RNA, 18 nt, Human
cucccucugccaagccug

SEQ ID NO: 397698 - RNA, 32 nt, Human
cucccucugccaaggacucauggccaagccag

SEQ ID NO: 397699 - RNA, 18 nt, Human
cucccucugccggcucug

SEQ ID NO: 397700 - RNA, 32 nt, Human
cucccucugccuccuccaugaaggucuccugg

SEQ ID NO: 397701 - RNA, 32 nt, Human
cucccucugcgggcuucucuugcucugagccu

SEQ ID NO: 397702 - RNA, 32 nt, Human
cucccucugcugucuguucuauucaaguucuu

SEQ ID NO: 397703 - RNA, 32 nt, Human
cucccucugggcuggagcucagugagggacaa

SEQ ID NO: 397704 - RNA, 32 nt, Human
cucccucugucacccaggcuagagggugguga

SEQ ID NO: 397705 - RNA, 32 nt, Human
cucccucugucacccaggcuggagugcagugg

SEQ ID NO: 397706 - RNA, 32 nt, Human
cucccucugucccccaggcuggagugcagugg

SEQ ID NO: 397707 - RNA, 32 nt, Human
cucccucuguugcccaggcuggagugcagagg

SEQ ID NO: 397708 - RNA, 32 nt, Human
cucccucuguugcccaggcuggagugcagugg

SEQ ID NO: 397709 - RNA, 32 nt, Human
cucccucuguuguccccuccucaggcuucugu

SEQ ID NO: 397710 - RNA, 32 nt, Human
cucccucuuacuaaaaacaauaguaguuucug

SEQ ID NO: 397711 - RNA, 32 nt, Human
cucccucuucuccccucccccuccucaccguc

SEQ ID NO: 397712 - RNA, 32 nt, Human
cucccucuuggcacuccaggcaaggcaggugc

SEQ ID NO: 397713 - RNA, 32 nt, Human
cucccucuuuacccuccccuccagugaauguu

SEQ ID NO: 397714 - RNA, 32 nt, Human
cucccucuuuggcuacucaccugcugcggcua

SEQ ID NO: 397715 - RNA, 32 nt, Human
cucccucuuuucaguuucucccccuccucucc

SEQ ID NO: 397716 - RNA, 23 nt, Human
cucccucuuuugccacugucugg

SEQ ID NO: 397717 - RNA, 16 nt, Human
cucccugaacccagcc

SEQ ID NO: 397718 - RNA, 32 nt, Human
cucccugacaacacaaaacuagagccaggggc

SEQ ID NO: 397719 - RNA, 32 nt, Human
cucccugacaauguggccuggccaagcugacg

SEQ ID NO: 397720 - RNA, 32 nt, Human
cucccugacaugcucacacacugucacacuca

SEQ ID NO: 397721 - RNA, 32 nt, Human
cucccugacccuuaacacuccuguccugccca

SEQ ID NO: 397722 - RNA, 32 nt, Human
cucccugaccucuucgccgcagcucaccggcc

SEQ ID NO: 397723 - RNA, 32 nt, Human
cucccugaccugcguuauaucuucccacuggg

SEQ ID NO: 397724 - RNA, 32 nt, Human
cucccugacuccaaagccugugcucuuaacca

SEQ ID NO: 397725 - RNA, 23 nt, Human
cucccugacucucaucucccucu

SEQ ID NO: 397726 - RNA, 24 nt, Human
cucccugagaagcugggaccacag

SEQ ID NO: 397727 - RNA, 32 nt, Human
cucccugagaagcugggaccacaggccuggcu

SEQ ID NO: 397728 - RNA, 32 nt, Human
cucccugagcagcugggaauacaagcauacac

SEQ ID NO: 397729 - RNA, 21 nt, Human
cucccugagcgggacggcagg

SEQ ID NO: 397730 - RNA, 32 nt, Human
cucccugagcuuccuguacccugacccucucc

SEQ ID NO: 397731 - RNA, 32 nt, Human
cucccugaggaccaccuccuacacuauugacc

SEQ ID NO: 397732 - RNA, 32 nt, Human
cucccugaguagcugggacuacaggcacacac

SEQ ID NO: 397733 - RNA, 32 nt, Human
cucccugaguggcagggauuacaggaacccac

SEQ ID NO: 397734 - RNA, 21 nt, Human
cucccugaucccagaccuguc

SEQ ID NO: 397735 - RNA, 32 nt, Human
cucccugaucccgugugccaccaggagggagu

SEQ ID NO: 397736 - RNA, 32 nt, Human
cucccugauugucaagaccuacucugaagauc

SEQ ID NO: 397737 - RNA, 32 nt, Human
cucccugauuuuccuuucguuucuucuuuauu

SEQ ID NO: 397738 - RNA, 32 nt, Human
cucccugcaaagcagcucaacaagagaaaaag

SEQ ID NO: 397739 - RNA, 32 nt, Human
cucccugcaaccuccaccuccuggguucaaac

SEQ ID NO: 397740 - RNA, 32 nt, Human
cucccugcaaccuccaccuccuggguucaagc

SEQ ID NO: 397741 - RNA, 32 nt, Human
cucccugcaaccuccgccuccuggauuccagc

SEQ ID NO: 397742 - RNA, 32 nt, Human
cucccugcaaccuccgccuccuggguucaagc

SEQ ID NO: 397743 - RNA, 32 nt, Human
cucccugcaaccuccgccuccuggguugaagc

SEQ ID NO: 397744 - RNA, 32 nt, Human
cucccugcaagacagaugggaauguguauaau

SEQ ID NO: 397745 - RNA, 32 nt, Human
cucccugcaagcugagccccugugugcccaga

SEQ ID NO: 397746 - RNA, 32 nt, Human
cucccugcacacaccagaacccacacgcuggu

SEQ ID NO: 397747 - RNA, 32 nt, Human
cucccugcacugccacagcccagaugcaguuc

SEQ ID NO: 397748 - RNA, 32 nt, Human
cucccugcacugcugaagcccagaugccucgc

SEQ ID NO: 397749 - RNA, 32 nt, Human
cucccugcacuucccguucucagcacuuaaug

SEQ ID NO: 397750 - RNA, 32 nt, Human
cucccugcagagccgagggccuuggcccagcc

SEQ ID NO: 397751 - RNA, 32 nt, Human
cucccugcagccaccagacuuggccuccagcu

SEQ ID NO: 397752 - RNA, 32 nt, Human
cucccugcagcucagcgcagcccagggcucca

SEQ ID NO: 397753 - RNA, 19 nt, Human
cucccugccaccguugccg

SEQ ID NO: 397754 - RNA, 32 nt, Human
cucccugccagcaugccugccugcccaccuca

SEQ ID NO: 397755 - RNA, 32 nt, Human
cucccugccagcugcccccaccgccuuccccu

SEQ ID NO: 397756 - RNA, 32 nt, Human
cucccugccagcugcccuauguagcuccuaac

SEQ ID NO: 397757 - RNA, 32 nt, Human
cucccugccaggccaagccagguguccucuug

SEQ ID NO: 397758 - RNA, 31 nt, Human
cucccugcccacucugggccuugcugacacc

SEQ ID NO: 397759 - RNA, 32 nt, Human
cucccugcccagccagggacuucuacucugca

SEQ ID NO: 397760 - RNA, 32 nt, Human
cucccugccccaggacuucaucggagcaggca

SEQ ID NO: 397761 - RNA, 32 nt, Human
cucccugccccagggagcucacgccaggcagg

SEQ ID NO: 397762 - RNA, 32 nt, Human
cucccugcccccgacauggcucaggagaagau

SEQ ID NO: 397763 - RNA, 31 nt, Human
cucccugcccucucuggccucuggggucaua

SEQ ID NO: 397764 - RNA, 32 nt, Human
cucccugcccucugcacuaagcacuuuccagg

SEQ ID NO: 397765 - RNA, 21 nt, Human
cucccugccgccgccgccgcc

SEQ ID NO: 397766 - RNA, 22 nt, Human
cucccugccgcgccgccgccgc

SEQ ID NO: 397767 - RNA, 32 nt, Human
cucccugccgggaggcgcaaaaagcaacuccc

SEQ ID NO: 397768 - RNA, 32 nt, Human
cucccugccucagcucccugcccagccagccu

SEQ ID NO: 397769 - RNA, 32 nt, Human
cucccugccuccaagccuggugccacaggccu

SEQ ID NO: 397770 - RNA, 32 nt, Human
cucccugccuccgcgcugcagccccugccgua

SEQ ID NO: 397771 - RNA, 20 nt, Human
cucccugccuccuccucucu

SEQ ID NO: 397772 - RNA, 32 nt, Human
cucccugccuccuccuuccugccugugaugcu

SEQ ID NO: 397773 - RNA, 23 nt, Human
cucccugccuccuggagggacag

SEQ ID NO: 397774 - RNA, 22 nt, Human
cucccugccucgcucgcugccg

SEQ ID NO: 397775 - RNA, 32 nt, Human
cucccugccucuccucacccucccucucuucc

SEQ ID NO: 397776 - RNA, 21 nt, Human
cucccugccugcuccuuggca

SEQ ID NO: 397777 - RNA, 21 nt, Human
cucccugccuggcccccaacc

SEQ ID NO: 397778 - RNA, 32 nt, Human
cucccugccugggaccacacaccccugggaua

SEQ ID NO: 397779 - RNA, 32 nt, Human
cucccugccuugugaguggccugcugccucac

SEQ ID NO: 397780 - RNA, 32 nt, Human
cucccugccuuucaaagcucucucccccauga

SEQ ID NO: 397781 - RNA, 32 nt, Human
cucccugccuuuccucugccuccuccccugcc

SEQ ID NO: 397782 - RNA, 32 nt, Human
cucccugcgcccagccucuccccagcauguaa

SEQ ID NO: 397783 - RNA, 21 nt, Human
cucccugcgccgccgccgccg

SEQ ID NO: 397784 - RNA, 22 nt, Human
cucccugcgccgccuccuccca

SEQ ID NO: 397785 - RNA, 22 nt, Human
cucccugcgucgccagccaccg

SEQ ID NO: 397786 - RNA, 32 nt, Human
cucccugcuaccauuauauuuugggguuaugu

SEQ ID NO: 397787 - RNA, 32 nt, Human
cucccugcuaccuccugcugggcugcuccugg

SEQ ID NO: 397788 - RNA, 32 nt, Human
cucccugcuauaauccuagcacuuugggaggc

SEQ ID NO: 397789 - RNA, 32 nt, Human
cucccugcuccagggaugugagcacccacucc

SEQ ID NO: 397790 - RNA, 32 nt, Human
cucccugcucccagcugcuuuacuaaggggaa

SEQ ID NO: 397791 - RNA, 32 nt, Human
cucccugcucccucccuccaccggggaagggc

SEQ ID NO: 397792 - RNA, 20 nt, Human
cucccugcucgcuccggguc

SEQ ID NO: 397793 - RNA, 21 nt, Human
cucccugcugcuuggauugca

SEQ ID NO: 397794 - RNA, 19 nt, Human
cucccugcugggagugcug

SEQ ID NO: 397795 - RNA, 32 nt, Human
cucccugcuggugccuuauagcuccccuccca

SEQ ID NO: 397796 - RNA, 32 nt, Human
cucccugcuguucaccagcugcaugaccuuga

SEQ ID NO: 397797 - RNA, 32 nt, Human
cucccugcuuccuucugcauucccaagccggc

SEQ ID NO: 397798 - RNA, 32 nt, Human
cucccugcuuggcucugucucuccacacccgg

SEQ ID NO: 397799 - RNA, 32 nt, Human
cucccuggacacucaaggcucuuguggugaca

SEQ ID NO: 397800 - RNA, 32 nt, Human
cucccuggacagagaggaaggagguggagcag

SEQ ID NO: 397801 - RNA, 32 nt, Human
cucccuggacugaagagagggagaauagaagc

SEQ ID NO: 397802 - RNA, 32 nt, Human
cucccuggagcaccgagacuccuggggcugug

SEQ ID NO: 397803 - RNA, 32 nt, Human
cucccuggagcugggggagcucagggaccccc

SEQ ID NO: 397804 - RNA, 32 nt, Human
cucccuggaggaaaaugcucauuauuucugcu

SEQ ID NO: 397805 - RNA, 32 nt, Human
cucccuggaggacucuagaagcucagguuccc

SEQ ID NO: 397806 - RNA, 32 nt, Human
cucccuggagugcaguuuccaaucccauagau

SEQ ID NO: 397807 - RNA, 32 nt, Human
cucccuggauccuccccgugacuggccgggcc

SEQ ID NO: 397808 - RNA, 32 nt, Human
cucccuggcacgcucuucucacccucaacuuc

SEQ ID NO: 397809 - RNA, 19 nt, Human
cucccuggcagcucaaggg

SEQ ID NO: 397810 - RNA, 32 nt, Human
cucccuggcaggcaggcugugggcuggugggg

SEQ ID NO: 397811 - RNA, 32 nt, Human
cucccuggcaucaccaugccuggcugcagcca

SEQ ID NO: 397812 - RNA, 32 nt, Human
cucccuggcauugggagagccccacacggccu

SEQ ID NO: 397813 - RNA, 32 nt, Human
cucccuggccuacucaguuggccaaggugcag

SEQ ID NO: 397814 - RNA, 32 nt, Human
cucccuggccuccagagguggcgugggcuggc

SEQ ID NO: 397815 - RNA, 32 nt, Human
cucccuggccugugcuuccucccuccaugcuc

SEQ ID NO: 397816 - RNA, 32 nt, Human
cucccuggcucugcccuucuuacugcaaacca

SEQ ID NO: 397817 - RNA, 32 nt, Human
cucccuggcugaaccccugccacccuacuccu

SEQ ID NO: 397818 - RNA, 32 nt, Human
cucccuggcugcacuuggcuggguuugcaguc

SEQ ID NO: 397819 - RNA, 32 nt, Human
cucccuggcugcagccuccgggguucagccuc

SEQ ID NO: 397820 - RNA, 32 nt, Human
cucccuggcuguguugugcacgcacaguuccc

SEQ ID NO: 397821 - RNA, 32 nt, Human
cucccuggcuuacaccuccugcuccuuccugc

SEQ ID NO: 397822 - RNA, 32 nt, Human
cucccuggcuucuucccuuuacccagggcggg

SEQ ID NO: 397823 - RNA, 32 nt, Human
cucccugggaaaagucuguugcuuugguucuc

SEQ ID NO: 397824 - RNA, 32 nt, Human
cucccugggaacccuggcccagaggaacagcu

SEQ ID NO: 397825 - RNA, 32 nt, Human
cucccugggaagccuccgggugauaggggugu

SEQ ID NO: 397826 - RNA, 32 nt, Human
cucccugggaggaugagcuggggcccuuuuuc

SEQ ID NO: 397827 - RNA, 32 nt, Human
cucccugggaguggguggaggcagccagggcu

SEQ ID NO: 397828 - RNA, 17 nt, Human
cucccugggcacagagu

SEQ ID NO: 397829 - RNA, 32 nt, Human
cucccugggcaggaagacugaggaggaaggga

SEQ ID NO: 397830 - RNA, 32 nt, Human
cucccugggcaggggaguucugaggcuccugc

SEQ ID NO: 397831 - RNA, 32 nt, Human
cucccugggccuggccccacugcccugugagg

SEQ ID NO: 397832 - RNA, 32 nt, Human
cucccugggcugggacccuuucuugccucccc

SEQ ID NO: 397833 - RNA, 32 nt, Human
cucccugggcuucaccucuucaccugugggcu

SEQ ID NO: 397834 - RNA, 32 nt, Human
cucccuggggagaagagaauauucagaacagc

SEQ ID NO: 397835 - RNA, 32 nt, Human
cucccuggggcagcagccaccauguucucgug

SEQ ID NO: 397836 - RNA, 32 nt, Human
cucccuggggcggaaccuggaggugcuguuuc

SEQ ID NO: 397837 - RNA, 32 nt, Human
cucccuggggcugaggggcugcaaggagaagu

SEQ ID NO: 397838 - RNA, 24 nt, Human
cucccuggguccuggauccuccaa

SEQ ID NO: 397839 - RNA, 32 nt, Human
cucccugggugagguggguccucuggccucag

SEQ ID NO: 397840 - RNA, 24 nt, Human
cucccugggugcugggauugcagg

SEQ ID NO: 397841 - RNA, 32 nt, Human
cucccuggguuugacuguaugugcagacuuug

SEQ ID NO: 397842 - RNA, 24 nt, Human
cucccugguagcugggauuacagg

SEQ ID NO: 397843 - RNA, 32 nt, Human
cucccuggucuggcccccuccuccggguuagg

SEQ ID NO: 397844 - RNA, 32 nt, Human
cucccuggugagccacugugggccacucgcca

SEQ ID NO: 397845 - RNA, 32 nt, Human
cucccuggugcuggguuucuggccuuugguga

SEQ ID NO: 397846 - RNA, 32 nt, Human
cucccugguggccacucuuugcucugaagccc

SEQ ID NO: 397847 - RNA, 32 nt, Human
cucccugguucugcagagggccagaagaauga

SEQ ID NO: 397848 - RNA, 32 nt, Human
cucccuguccacugcacuccucccaccucauu

SEQ ID NO: 397849 - RNA, 32 nt, Human
cucccuguccccaccaccccugccccacccag

SEQ ID NO: 397850 - RNA, 32 nt, Human
cucccugucccugggcaggagugcuggugagg

SEQ ID NO: 397851 - RNA, 32 nt, Human
cucccugucccugucaaauaaaccagaacaaa

SEQ ID NO: 397852 - RNA, 32 nt, Human
cucccuguccuccuucuuggucucacacuugg

SEQ ID NO: 397853 - RNA, 32 nt, Human
cucccugucuacaccugagcacugcaggagau

SEQ ID NO: 397854 - RNA, 32 nt, Human
cucccugucuacccaucucugcugcuccagcu

SEQ ID NO: 397855 - RNA, 32 nt, Human
cucccugucuccacuuaucucucaugauuggg

SEQ ID NO: 397856 - RNA, 17 nt, Human
cucccugucucuccuca

SEQ ID NO: 397857 - RNA, 32 nt, Human
cucccugucugcuuccgcagaugaaauucucu

SEQ ID NO: 397858 - RNA, 32 nt, Human
cucccugucuucauucuccacgcagccuggug

SEQ ID NO: 397859 - RNA, 32 nt, Human
cucccugugccuguaauaccaugucuucccau

SEQ ID NO: 397860 - RNA, 18 nt, Human
cucccugugcuccugcca

SEQ ID NO: 397861 - RNA, 32 nt, Human
cucccugugcugcuuguagacaguucccauaa

SEQ ID NO: 397862 - RNA, 32 nt, Human
cucccuguggagaucagugaagacugggagga

SEQ ID NO: 397863 - RNA, 32 nt, Human
cucccuguggccuucugagauugcaggagaug

SEQ ID NO: 397864 - RNA, 32 nt, Human
cucccuguggugggggauggcagaggcuuccc

SEQ ID NO: 397865 - RNA, 31 nt, Human
cucccuguguucccugggccucagcuguucc

SEQ ID NO: 397866 - RNA, 32 nt, Human
cucccuguucacggugacacaggucagggcuc

SEQ ID NO: 397867 - RNA, 32 nt, Human
cucccuguuccucuccccgccaccccagggcc

SEQ ID NO: 397868 - RNA, 32 nt, Human
cucccuguugcccaaguuggagugcaaucuug

SEQ ID NO: 397869 - RNA, 32 nt, Human
cucccuuacuccccucucgcucccucuacccu

SEQ ID NO: 397870 - RNA, 24 nt, Human
cucccuuacucuguauccccggcu

SEQ ID NO: 397871 - RNA, 22 nt, Human
cucccuuagccuuuauccugcc

SEQ ID NO: 397872 - RNA, 24 nt, Human
cucccuuagcugcuaagccugccu

SEQ ID NO: 397873 - RNA, 18 nt, Human
cucccuuaggccugugug

SEQ ID NO: 397874 - RNA, 32 nt, Human
cucccuuagugcuuuuugucccuucccgaaca

SEQ ID NO: 397875 - RNA, 22 nt, Human
cucccuuaguguucccuggccu

SEQ ID NO: 397876 - RNA, 32 nt, Human
cucccuuaucucuucauauucuuuauucccua

SEQ ID NO: 397877 - RNA, 32 nt, Human
cucccuuauuuacucuaaacaguguuaugccu

SEQ ID NO: 397878 - RNA, 32 nt, Human
cucccuucagaugaccauugcuagcaagaaac

SEQ ID NO: 397879 - RNA, 32 nt, Human
cucccuucaggcggagguugcagugagccgag

SEQ ID NO: 397880 - RNA, 32 nt, Human
cucccuucaugggccucccagggaaggaggaa

SEQ ID NO: 397881 - RNA, 32 nt, Human
cucccuuccaccugcagcaccaggaagccauu

SEQ ID NO: 397882 - RNA, 32 nt, Human
cucccuuccagcuguggcaaagcuauauuucu

SEQ ID NO: 397883 - RNA, 32 nt, Human
cucccuucccaggucaccagcuugggaccucc

SEQ ID NO: 397884 - RNA, 32 nt, Human
cucccuuccccacuccauggcgccagccuccu

SEQ ID NO: 397885 - RNA, 32 nt, Human
cucccuucccccaccccaucaggaugauauga

SEQ ID NO: 397886 - RNA, 24 nt, Human
cucccuuccccccucccugucugg

SEQ ID NO: 397887 - RNA, 32 nt, Human
cucccuucccccugcuucaggcugcugagcac

SEQ ID NO: 397888 - RNA, 23 nt, Human
cucccuuccccugccugcugcug

SEQ ID NO: 397889 - RNA, 32 nt, Human
cucccuucccuccaccggacgggugacugacu

SEQ ID NO: 397890 - RNA, 32 nt, Human
cucccuucccuccagcccaugccaggagcuug

SEQ ID NO: 397891 - RNA, 32 nt, Human
cucccuuccgcuccugcccagccugggggaag

SEQ ID NO: 397892 - RNA, 32 nt, Human
cucccuuccggaagaugcugaggaugacagcu

SEQ ID NO: 397893 - RNA, 32 nt, Human
cucccuuccuacaguccuuggguagacugaga

SEQ ID NO: 397894 - RNA, 21 nt, Human
cucccuuccuccaagcuucuc

SEQ ID NO: 397895 - RNA, 22 nt, Human
cucccuuccucccaacuccuca

SEQ ID NO: 397896 - RNA, 32 nt, Human
cucccuuccucccuuucuuaccacagauggga

SEQ ID NO: 397897 - RNA, 20 nt, Human
cucccuuccuccucugcuca

SEQ ID NO: 397898 - RNA, 32 nt, Human
cucccuuccucuccaucucucccucucuccaa

SEQ ID NO: 397899 - RNA, 32 nt, Human
cucccuuccugccucauuucaucccccgcagc

SEQ ID NO: 397900 - RNA, 32 nt, Human
cucccuuccuuguccuuguccucugcccuuuu

SEQ ID NO: 397901 - RNA, 22 nt, Human
cucccuuccuuuaucgugucuc

SEQ ID NO: 397902 - RNA, 32 nt, Human
cucccuuccuuuccuuuccgcuccucuuccga

SEQ ID NO: 397903 - RNA, 19 nt, Human
cucccuucgcugggugccg

SEQ ID NO: 397904 - RNA, 32 nt, Human
cucccuucucacugccacugcucuugccucuu

SEQ ID NO: 397905 - RNA, 18 nt, Human
cucccuucucagccucgu

SEQ ID NO: 397906 - RNA, 32 nt, Human
cucccuucuccccaaagcgcuccaagagaaag

SEQ ID NO: 397907 - RNA, 32 nt, Human
cucccuucuccccucuuuccuucugccggucc

SEQ ID NO: 397908 - RNA, 18 nt, Human
cucccuucuccuucccgg

SEQ ID NO: 397909 - RNA, 21 nt, Human
cucccuucucuauccuguuuc

SEQ ID NO: 397910 - RNA, 22 nt, Human
cucccuucucucacucucacuc

SEQ ID NO: 397911 - RNA, 22 nt, Human
cucccuucucuccacgagcucg

SEQ ID NO: 397912 - RNA, 22 nt, Human
cucccuucucucuuuucuucuc

SEQ ID NO: 397913 - RNA, 32 nt, Human
cucccuucugccagccugcauccucuccucag

SEQ ID NO: 397914 - RNA, 18 nt, Human
cucccuucugcucugcca

SEQ ID NO: 397915 - RNA, 32 nt, Human
cucccuucuucugagugaauguuaacaugcgc

SEQ ID NO: 397916 - RNA, 24 nt, Human
cucccuucuuucggccgccgucuc

SEQ ID NO: 397917 - RNA, 32 nt, Human
cucccuugagauacacuaccaucuuaacuucu

SEQ ID NO: 397918 - RNA, 32 nt, Human
cucccuugaggcuuauaaugggccaaguugaa

SEQ ID NO: 397919 - RNA, 20 nt, Human
cucccuugaguuguuguaaa

SEQ ID NO: 397920 - RNA, 32 nt, Human
cucccuugcagcacgcaugggaagaaaggcca

SEQ ID NO: 397921 - RNA, 32 nt, Human
cucccuugcaggacccauccaggauuuccuuc

SEQ ID NO: 397922 - RNA, 32 nt, Human
cucccuugcaggagguggagguuguuggugga

SEQ ID NO: 397923 - RNA, 22 nt, Human
cucccuugcccccaagccuguc

SEQ ID NO: 397924 - RNA, 32 nt, Human
cucccuugccccuuuccugggcccagaaguug

SEQ ID NO: 397925 - RNA, 32 nt, Human
cucccuugccucucccccuccaccaccaccuu

SEQ ID NO: 397926 - RNA, 20 nt, Human
cucccuugcuccugaggcca

SEQ ID NO: 397927 - RNA, 29 nt, Human
cucccuugcuggccagcaucccccucuuc

SEQ ID NO: 397928 - RNA, 30 nt, Human
cucccuuggaucuccauguuucuccagaug

SEQ ID NO: 397929 - RNA, 32 nt, Human
cucccuuggcuccugcuuucugcuugggcccu

SEQ ID NO: 397930 - RNA, 32 nt, Human
cucccuugggaagacgauugacuggggaaugg

SEQ ID NO: 397931 - RNA, 32 nt, Human
cucccuugggcuguggcagcaggaggcggggg

SEQ ID NO: 397932 - RNA, 32 nt, Human
cucccuugggguccaagagggaaaugcugguc

SEQ ID NO: 397933 - RNA, 32 nt, Human
cucccuuggggucuagaggagacccccggaga

SEQ ID NO: 397934 - RNA, 32 nt, Human
cucccuuggucuuccaugggaugguuagugug

SEQ ID NO: 397935 - RNA, 32 nt, Human
cucccuuguggacaggcagggagaugcaugcg

SEQ ID NO: 397936 - RNA, 32 nt, Human
cucccuuuaaccuccagcuccuggguucaagc

SEQ ID NO: 397937 - RNA, 32 nt, Human
cucccuuuauccaaggagguggcugugcaggu

SEQ ID NO: 397938 - RNA, 32 nt, Human
cucccuuucaccaacaccgacacccacauuga

SEQ ID NO: 397939 - RNA, 32 nt, Human
cucccuuuccaaccccuuccuuccuuuuccuc

SEQ ID NO: 397940 - RNA, 22 nt, Human
cucccuuuccaagccugccugg

SEQ ID NO: 397941 - RNA, 23 nt, Human
cucccuuuccaagccugccuggg

SEQ ID NO: 397942 - RNA, 18 nt, Human
cucccuuuccacuugcca

SEQ ID NO: 397943 - RNA, 32 nt, Human
cucccuuuccaucaugggacucuggaugccgg

SEQ ID NO: 397944 - RNA, 32 nt, Human
cucccuuucccccuccccacccccuccccaac

SEQ ID NO: 397945 - RNA, 19 nt, Human
cucccuuucccgcuucugc

SEQ ID NO: 397946 - RNA, 19 nt, Human
cucccuuucccggccucgu

SEQ ID NO: 397947 - RNA, 32 nt, Human
cucccuuuccuugagcucucuggacacugcag

SEQ ID NO: 397948 - RNA, 20 nt, Human
cucccuuucuauguggcaua

SEQ ID NO: 397949 - RNA, 32 nt, Human
cucccuuucucagcagcuuugcuuguggcagg

SEQ ID NO: 397950 - RNA, 32 nt, Human
cucccuuucuccugcagccauggaugccgcuc

SEQ ID NO: 397951 - RNA, 19 nt, Human
cucccuuucucucuucugc

SEQ ID NO: 397952 - RNA, 32 nt, Human
cucccuuucucuuuucucuaccccuguguccu

SEQ ID NO: 397953 - RNA, 32 nt, Human
cucccuuucuucaugcuuccacaguuuuccuc

SEQ ID NO: 397954 - RNA, 32 nt, Human
cucccuuucuuuccuucucuccuccuuuauuu

SEQ ID NO: 397955 - RNA, 32 nt, Human
cucccuuugggcaaggaccugagacccuugug

SEQ ID NO: 397956 - RNA, 21 nt, Human
cucccuuugguaaaucugccu

SEQ ID NO: 397957 - RNA, 32 nt, Human
cucccuuuggugaccugaagucacugugacag

SEQ ID NO: 397958 - RNA, 32 nt, Human
cucccuuugucacccaggccggagugcagugg

SEQ ID NO: 397959 - RNA, 21 nt, Human
cucccuuuugucaucuugagu

SEQ ID NO: 397960 - RNA, 32 nt, Human
cucccuuuuugaaagaucuuuccuuuugaugc

SEQ ID NO: 397961 - RNA, 24 nt, Human
cuccgaaaaugcugggauuacagg

SEQ ID NO: 397962 - RNA, 32 nt, Human
cuccgaaaaugcugggauuacaggcgugagcc

SEQ ID NO: 397963 - RNA, 32 nt, Human
cuccgaaaaugcugggauuacaggugugagcc

SEQ ID NO: 397964 - RNA, 32 nt, Human
cuccgaaagugcuaggauuacaggugugagcc

SEQ ID NO: 397965 - RNA, 32 nt, Human
cuccgaaagugcugagauuacaguugcgagcc

SEQ ID NO: 397966 - RNA, 24 nt, Human
cuccgaaagugcugggaucacagg

SEQ ID NO: 397967 - RNA, 32 nt, Human
cuccgaaagugcugggaucacaggugggagcc

SEQ ID NO: 397968 - RNA, 23 nt, Human
cuccgaaagugcugggauuacag

SEQ ID NO: 397969 - RNA, 24 nt, Human
cuccgaaagugcugggauuacagg

SEQ ID NO: 397970 - RNA, 32 nt, Human
cuccgaaagugcugggauuacaggcgugagcc

SEQ ID NO: 397971 - RNA, 32 nt, Human
cuccgaaagugcugggauuacaggcgugagcu

SEQ ID NO: 397972 - RNA, 32 nt, Human
cuccgaaagugcugggauuacaguugugaguc

SEQ ID NO: 397973 - RNA, 32 nt, Human
cuccgaacauaaauaagcagccggguucagug

SEQ ID NO: 397974 - RNA, 20 nt, Human
cuccgaagccgccgccgccg

SEQ ID NO: 397975 - RNA, 32 nt, Human
cuccgaagcggggaagugggacaagaugguuu

SEQ ID NO: 397976 - RNA, 32 nt, Human
cuccgaaggcuccacuccccacuuuuacuacu

SEQ ID NO: 397977 - RNA, 32 nt, Human
cuccgaaguagcugggaauuacaggcacccac

SEQ ID NO: 397978 - RNA, 24 nt, Human
cuccgaaguagcugggauuacagg

SEQ ID NO: 397979 - RNA, 32 nt, Human
cuccgaaguagcugggauuacaggcgcccgcc

SEQ ID NO: 397980 - RNA, 32 nt, Human
cuccgaagucaauacugagaucccagaugugu

SEQ ID NO: 397981 - RNA, 32 nt, Human
cuccgaaucuggcaucaguggcugccagcggg

SEQ ID NO: 397982 - RNA, 32 nt, Human
cuccgacacccgagacugcacugaccucccuc

SEQ ID NO: 397983 - RNA, 32 nt, Human
cuccgacccauaccuucuccccacagccucug

SEQ ID NO: 397984 - RNA, 32 nt, Human
cuccgacccggccucccucccuggggccagcg

SEQ ID NO: 397985 - RNA, 32 nt, Human
cuccgacccuggcuccccuuugagcccuaauu

SEQ ID NO: 397986 - RNA, 32 nt, Human
cuccgacggcuucucauuuccccaauaccaca

SEQ ID NO: 397987 - RNA, 21 nt, Human
cuccgacugccgucgccgccg

SEQ ID NO: 397988 - RNA, 32 nt, Human
cuccgacuggggcucccugaggacagggcugu

SEQ ID NO: 397989 - RNA, 32 nt, Human
cuccgagaaaagcucucacaaagcuuuugagc

SEQ ID NO: 397990 - RNA, 32 nt, Human
cuccgagaaaugcagcugcucaaaggccuucu

SEQ ID NO: 397991 - RNA, 32 nt, Human
cuccgagagagccauggaaaagcugcugcggc

SEQ ID NO: 397992 - RNA, 32 nt, Human
cuccgagaggaggccagagggagaggaggauc

SEQ ID NO: 397993 - RNA, 32 nt, Human
cuccgagagggaccagcaccaccugggaagcc

SEQ ID NO: 397994 - RNA, 32 nt, Human
cuccgagcaugagguccgccuccugggcgaga

SEQ ID NO: 397995 - RNA, 21 nt, Human
cuccgagcccuggaggagcag

SEQ ID NO: 397996 - RNA, 32 nt, Human
cuccgagccgggcagcaacagccccggcagcg

SEQ ID NO: 397997 - RNA, 31 nt, Human
cuccgaggccagagagaaaagacugcgaggu

SEQ ID NO: 397998 - RNA, 22 nt, Human
cuccgagggccgaccgcugccg

SEQ ID NO: 397999 - RNA, 22 nt, Human
cuccgagggccgcgccaggcca

SEQ ID NO: 398000 - RNA, 32 nt, Human
cuccgaggggguggaagggggugggcacacuc

SEQ ID NO: 398001 - RNA, 32 nt, Human
cuccgaguggaacugcagccuggggacuugau

SEQ ID NO: 398002 - RNA, 17 nt, Human
cuccgauaacuguucca

SEQ ID NO: 398003 - RNA, 32 nt, Human
cuccgaucaaagccggccgugcugcuggccgg

SEQ ID NO: 398004 - RNA, 32 nt, Human
cuccgaucucacagccugucaugcugcucagu

SEQ ID NO: 398005 - RNA, 32 nt, Human
cuccgaugaaaaugccauuucuucguugccaa

SEQ ID NO: 398006 - RNA, 32 nt, Human
cuccgaugacaucugaaguugugacuucauca

SEQ ID NO: 398007 - RNA, 32 nt, Human
cuccgaugaccagcuucuuuugcucgacucua

SEQ ID NO: 398008 - RNA, 32 nt, Human
cuccgauggcugccaggagcugagcucagggu

SEQ ID NO: 398009 - RNA, 32 nt, Human
cuccgauucacuucuguucuuaggguguagcc

SEQ ID NO: 398010 - RNA, 32 nt, Human
cuccgauuugagccucuccggcugccagccag

SEQ ID NO: 398011 - RNA, 32 nt, Human
cuccgcaaaaugucagccuccaccuccucgca

SEQ ID NO: 398012 - RNA, 32 nt, Human
cuccgcaagcuggaacgugagccaggaggccc

SEQ ID NO: 398013 - RNA, 32 nt, Human
cuccgcacaauacuugaacauucaucuguacu

SEQ ID NO: 398014 - RNA, 32 nt, Human
cuccgcacacaccccaccccagccugcuauag

SEQ ID NO: 398015 - RNA, 32 nt, Human
cuccgcacuugcagguccccucccucuccgcc

SEQ ID NO: 398016 - RNA, 32 nt, Human
cuccgcagcccacacagccucugcagcccaag

SEQ ID NO: 398017 - RNA, 32 nt, Human
cuccgcagccccagcuaggagaacucgggagc

SEQ ID NO: 398018 - RNA, 32 nt, Human
cuccgcagccccagucccuggccacgcccaag

SEQ ID NO: 398019 - RNA, 32 nt, Human
cuccgcagccgcugccccggacccugacgacc

SEQ ID NO: 398020 - RNA, 30 nt, Human
cuccgcagccucuccaucugcuggcacucc

SEQ ID NO: 398021 - RNA, 20 nt, Human
cuccgcagcucugguuccug

SEQ ID NO: 398022 - RNA, 21 nt, Human
cuccgcagcuucugacacaac

SEQ ID NO: 398023 - RNA, 32 nt, Human
cuccgcaggcagagaagccgggagcgggcgag

SEQ ID NO: 398024 - RNA, 32 nt, Human
cuccgcaggccuuccuuuaggcccaggagaac

SEQ ID NO: 398025 - RNA, 22 nt, Human
cuccgcagugccgccgccgucg

SEQ ID NO: 398026 - RNA, 20 nt, Human
cuccgcaucccgggcuccug

SEQ ID NO: 398027 - RNA, 32 nt, Human
cuccgcaucuaucagcagguugccccggaugg

SEQ ID NO: 398028 - RNA, 32 nt, Human
cuccgcaucucaucuuucucuuuucaaucagg

SEQ ID NO: 398029 - RNA, 32 nt, Human
cuccgcaugccccucccuccccacggcccugc

SEQ ID NO: 398030 - RNA, 32 nt, Human
cuccgccaccgagaguccugugcuucggaaug

SEQ ID NO: 398031 - RNA, 32 nt, Human
cuccgccacugcaugcucccgccggaccgagc

SEQ ID NO: 398032 - RNA, 32 nt, Human
cuccgccagaggccacgggcgcccuuguuccc

SEQ ID NO: 398033 - RNA, 32 nt, Human
cuccgccagcagcaaccgaacuuggaccaagu

SEQ ID NO: 398034 - RNA, 32 nt, Human
cuccgccagccccuccaccccagccugccugc

SEQ ID NO: 398035 - RNA, 17 nt, Human
cuccgccagcgcugccg

SEQ ID NO: 398036 - RNA, 32 nt, Human
cuccgccaggcacuaaccugccauaacccuuu

SEQ ID NO: 398037 - RNA, 32 nt, Human
cuccgccaugcuugccaccucuugcuucugag

SEQ ID NO: 398038 - RNA, 32 nt, Human
cuccgcccaccugccccugccucucagccucc

SEQ ID NO: 398039 - RNA, 24 nt, Human
cuccgcccagucaccaucaggcca

SEQ ID NO: 398040 - RNA, 32 nt, Human
cuccgccccaccacagcacucucaggaaagga

SEQ ID NO: 398041 - RNA, 32 nt, Human
cuccgccccaccacuuucauccuaaaccuacu

SEQ ID NO: 398042 - RNA, 20 nt, Human
cuccgccccagccccagcca

SEQ ID NO: 398043 - RNA, 23 nt, Human
cuccgccccaggagcuggagcca

SEQ ID NO: 398044 - RNA, 32 nt, Human
cuccgcccccucacgcgcucucgccgggaccc

SEQ ID NO: 398045 - RNA, 18 nt, Human
cuccgccccgugguuccu

SEQ ID NO: 398046 - RNA, 32 nt, Human
cuccgccccgugugugcgcccugcacuuaggg

SEQ ID NO: 398047 - RNA, 32 nt, Human
cuccgccccugccucccuccugccccugcucc

SEQ ID NO: 398048 - RNA, 32 nt, Human
cuccgcccgccucccuccucuggcccccuccg

SEQ ID NO: 398049 - RNA, 32 nt, Human
cuccgcccucccccucucccccauccgccugc

SEQ ID NO: 398050 - RNA, 20 nt, Human
cuccgcccuccgcuggcucc

SEQ ID NO: 398051 - RNA, 32 nt, Human
cuccgcccugacccuccugcugccuucccacc

SEQ ID NO: 398052 - RNA, 32 nt, Human
cuccgcccuggcuuucugcagcuuugagaugc

SEQ ID NO: 398053 - RNA, 32 nt, Human
cuccgcccugugcccuuucccugcugcuggcu

SEQ ID NO: 398054 - RNA, 17 nt, Human
cuccgccgccacugcug

SEQ ID NO: 398055 - RNA, 17 nt, Human
cuccgccgccgccgccg

SEQ ID NO: 398056 - RNA, 20 nt, Human
cuccgccgccgccgccgccg

SEQ ID NO: 398057 - RNA, 17 nt, Human
cuccgccgccgcucccg

SEQ ID NO: 398058 - RNA, 20 nt, Human
cuccgccgccgcugcugccg

SEQ ID NO: 398059 - RNA, 32 nt, Human
cuccgccgcuccaggacucggcgcggagggaa

SEQ ID NO: 398060 - RNA, 20 nt, Human
cuccgccgcugccgccgccg

SEQ ID NO: 398061 - RNA, 17 nt, Human
cuccgccgcugcugccg

SEQ ID NO: 398062 - RNA, 32 nt, Human
cuccgccguggcuccccagcgagcccacgggg

SEQ ID NO: 398063 - RNA, 32 nt, Human
cuccgccucacccuuggcgcuggaccagugag

SEQ ID NO: 398064 - RNA, 19 nt, Human
cuccgccucagcccuucug

SEQ ID NO: 398065 - RNA, 32 nt, Human
cuccgccucagccucuggaguagcugggaccu

SEQ ID NO: 398066 - RNA, 32 nt, Human
cuccgccucccggauacuccugccucagccuc

SEQ ID NO: 398067 - RNA, 17 nt, Human
cuccgccuccgcugccg

SEQ ID NO: 398068 - RNA, 32 nt, Human
cuccgccuccuccccuccuccuucucgucuuc

SEQ ID NO: 398069 - RNA, 32 nt, Human
cuccgccuccuccucugcuccgccaccggcuu

SEQ ID NO: 398070 - RNA, 32 nt, Human
cuccgccuccugccaaccccugcucuuccagg

SEQ ID NO: 398071 - RNA, 32 nt, Human
cuccgccuccuggguccaagugauucuccugc

SEQ ID NO: 398072 - RNA, 19 nt, Human
cuccgccucguccccgggg

SEQ ID NO: 398073 - RNA, 18 nt, Human
cuccgccucguugcccug

SEQ ID NO: 398074 - RNA, 21 nt, Human
cuccgccucucugagccucug

SEQ ID NO: 398075 - RNA, 32 nt, Human
cuccgccucugcacuccagccugggugacaag

SEQ ID NO: 398076 - RNA, 32 nt, Human
cuccgccugcagcugcgggacgacgcgccccu

SEQ ID NO: 398077 - RNA, 32 nt, Human
cuccgccugccagcccaccccagccuggggag

SEQ ID NO: 398078 - RNA, 20 nt, Human
cuccgccugccccgccgccg

SEQ ID NO: 398079 - RNA, 32 nt, Human
cuccgccugccuggggccuucggcugcgggga

SEQ ID NO: 398080 - RNA, 32 nt, Human
cuccgccugcugccuggacugcucagugaggu

SEQ ID NO: 398081 - RNA, 32 nt, Human
cuccgccuggcuuacgaacacacacauguguu

SEQ ID NO: 398082 - RNA, 32 nt, Human
cuccgccuucacuccggugugccugcagcccc

SEQ ID NO: 398083 - RNA, 32 nt, Human
cuccgccuuccagguuuaagcuauucuccugc

SEQ ID NO: 398084 - RNA, 32 nt, Human
cuccgcgauguccucucaacagagcgccguuu

SEQ ID NO: 398085 - RNA, 32 nt, Human
cuccgcgcccuccccucuccuuucucccucuc

SEQ ID NO: 398086 - RNA, 18 nt, Human
cuccgcgccgccgcugcc

SEQ ID NO: 398087 - RNA, 15 nt, Human
cuccgcgccgcgccg

SEQ ID NO: 398088 - RNA, 20 nt, Human
cuccgcgcgcgccgcagccg

SEQ ID NO: 398089 - RNA, 22 nt, Human
cuccgcgcggcugcagcgcggg

SEQ ID NO: 398090 - RNA, 32 nt, Human
cuccgcgcuggcgcgcuuuguccuccucgcgc

SEQ ID NO: 398091 - RNA, 32 nt, Human
cuccgcggccuggaguggcucugccggggcau

SEQ ID NO: 398092 - RNA, 32 nt, Human
cuccgcggcgccgccucccagcccagagccca

SEQ ID NO: 398093 - RNA, 24 nt, Human
cuccgcggcgggaccggggcgcag

SEQ ID NO: 398094 - RNA, 32 nt, Human
cuccgcgggcugggaccaugggcugcuucuuc

SEQ ID NO: 398095 - RNA, 32 nt, Human
cuccgcggugcccagcucuccagccuggggau

SEQ ID NO: 398096 - RNA, 21 nt, Human
cuccgcguccgauggcuccug

SEQ ID NO: 398097 - RNA, 32 nt, Human
cuccgcgucuacugcgagucaggccgugaugg

SEQ ID NO: 398098 - RNA, 32 nt, Human
cuccgcguggcucacuccagccucggauguuu

SEQ ID NO: 398099 - RNA, 32 nt, Human
cuccgcuaaaaaugcaaaaauuagccaggcgu

SEQ ID NO: 398100 - RNA, 21 nt, Human
cuccgcuacucgggaggcuga

SEQ ID NO: 398101 - RNA, 32 nt, Human
cuccgcucacugcaacauccgccucccggacu

SEQ ID NO: 398102 - RNA, 24 nt, Human
cuccgcucacugcaaccuccaccu

SEQ ID NO: 398103 - RNA, 32 nt, Human
cuccgcucacugcaaccuccaccuccuggcuu

SEQ ID NO: 398104 - RNA, 23 nt, Human
cuccgcucacugcaaccuccacu

SEQ ID NO: 398105 - RNA, 32 nt, Human
cuccgcucacugcaaccucugccucccgguuc

SEQ ID NO: 398106 - RNA, 32 nt, Human
cuccgcucacugcaagcuccgccucccggguu

SEQ ID NO: 398107 - RNA, 32 nt, Human
cuccgcucacugcaagcuccgccucgcgaguu

SEQ ID NO: 398108 - RNA, 32 nt, Human
cuccgcucacugcaagcucugccuccugggcu

SEQ ID NO: 398109 - RNA, 32 nt, Human
cuccgcucacugcagccuccgccuccuggguu

SEQ ID NO: 398110 - RNA, 32 nt, Human
cuccgcucauacaggaaugaagccuuagccag

SEQ ID NO: 398111 - RNA, 32 nt, Human
cuccgcuccaccacugaggcccaggcucccag

SEQ ID NO: 398112 - RNA, 32 nt, Human
cuccgcuccuccugcgcggggugcugaaacag

SEQ ID NO: 398113 - RNA, 32 nt, Human
cuccgcucgcagcaaccucugccucccagguu

SEQ ID NO: 398114 - RNA, 32 nt, Human
cuccgcucgccuggcccggaccggaagcggcg

SEQ ID NO: 398115 - RNA, 32 nt, Human
cuccgcucgcugccuucucuccuggcaggcgc

SEQ ID NO: 398116 - RNA, 32 nt, Human
cuccgcucgucccgcucgucauggccuacccg

SEQ ID NO: 398117 - RNA, 32 nt, Human
cuccgcucucccggcgccugggccuacccagc

SEQ ID NO: 398118 - RNA, 32 nt, Human
cuccgcucuccuaguuccuucucccuccucua

SEQ ID NO: 398119 - RNA, 32 nt, Human
cuccgcugaccaguccuuggacacaacgcgga

SEQ ID NO: 398120 - RNA, 32 nt, Human
cuccgcugagccacuccugugccucccuggcc

SEQ ID NO: 398121 - RNA, 20 nt, Human
cuccgcugcagcccaaagca

SEQ ID NO: 398122 - RNA, 20 nt, Human
cuccgcugccgccgccgccg

SEQ ID NO: 398123 - RNA, 32 nt, Human
cuccgcugcgccucagcugugggggccucagg

SEQ ID NO: 398124 - RNA, 32 nt, Human
cuccgcuggccccagccgcggggccaccgcca

SEQ ID NO: 398125 - RNA, 17 nt, Human
cuccgcuggccgcgccg

SEQ ID NO: 398126 - RNA, 30 nt, Human
cuccgcuggcucugccugcuccugcaacag

SEQ ID NO: 398127 - RNA, 32 nt, Human
cuccgcugggcccagacagcagcguuugguuu

SEQ ID NO: 398128 - RNA, 32 nt, Human
cuccgcuggggcuucucucggccgcggaagga

SEQ ID NO: 398129 - RNA, 32 nt, Human
cuccgcuggucugucugugcauccacugugcc

SEQ ID NO: 398130 - RNA, 32 nt, Human
cuccgcuucccaggcuggggugcaguggugcg

SEQ ID NO: 398131 - RNA, 22 nt, Human
cuccgcuucgccgccgccgccg

SEQ ID NO: 398132 - RNA, 21 nt, Human
cuccgcuucuaggccccaacc

SEQ ID NO: 398133 - RNA, 32 nt, Human
cuccgcuucuccccauccccuacuuuccuccc

SEQ ID NO: 398134 - RNA, 32 nt, Human
cuccgcuucucccugcagcccugccuuugcug

SEQ ID NO: 398135 - RNA, 32 nt, Human
cuccggaaagcugcggcccagcgcggacuagu

SEQ ID NO: 398136 - RNA, 32 nt, Human
cuccggaaccacugcacgacggggcuggacug

SEQ ID NO: 398137 - RNA, 32 nt, Human
cuccggaagugcugggauuacaggcgugagcc

SEQ ID NO: 398138 - RNA, 22 nt, Human
cuccggacacgcgccugcaccu

SEQ ID NO: 398139 - RNA, 32 nt, Human
cuccggacagagcugggccuggggaagggguu

SEQ ID NO: 398140 - RNA, 32 nt, Human
cuccggacaucgggggccagggcacaacaucu

SEQ ID NO: 398141 - RNA, 32 nt, Human
cuccggaccgacacucccucagccucucagug

SEQ ID NO: 398142 - RNA, 24 nt, Human
cuccggaccucgcugcagcgcgga

SEQ ID NO: 398143 - RNA, 32 nt, Human
cuccggaccugccucgagccucaggcugcuga

SEQ ID NO: 398144 - RNA, 32 nt, Human
cuccggacgcugccaaccuguucuccaccguc

SEQ ID NO: 398145 - RNA, 17 nt, Human
cuccggacucgccgcuc

SEQ ID NO: 398146 - RNA, 23 nt, Human
cuccggagaacugggauuacagg

SEQ ID NO: 398147 - RNA, 32 nt, Human
cuccggagacaugucugucuucccucucauuc

SEQ ID NO: 398148 - RNA, 32 nt, Human
cuccggagcccaggcggcggcgaguacucggg

SEQ ID NO: 398149 - RNA, 32 nt, Human
cuccggagccucgucccucccuuccccuuccc

SEQ ID NO: 398150 - RNA, 32 nt, Human
cuccggagccugcugaaaacucucaagaccug

SEQ ID NO: 398151 - RNA, 32 nt, Human
cuccggaggagccggcccugcuggccacgcag

SEQ ID NO: 398152 - RNA, 24 nt, Human
cuccggaggcaccuucuccuggua

SEQ ID NO: 398153 - RNA, 32 nt, Human
cuccggaggccaugggcuacccggagguggag

SEQ ID NO: 398154 - RNA, 24 nt, Human
cuccggaguagcugggauuacagg

SEQ ID NO: 398155 - RNA, 32 nt, Human
cuccggaguagcugggauuacaggcacaugcc

SEQ ID NO: 398156 - RNA, 32 nt, Human
cuccggaguagcugggauuacaggcacgugcc

SEQ ID NO: 398157 - RNA, 32 nt, Human
cuccggaguagcugggauuacaggcaugcacc

SEQ ID NO: 398158 - RNA, 32 nt, Human
cuccggaguagcugggauuacaggcgccugcc

SEQ ID NO: 398159 - RNA, 32 nt, Human
cuccggaguagcugggauuacaggcgugcgcc

SEQ ID NO: 398160 - RNA, 24 nt, Human
cuccggaguagcugggauugcagg

SEQ ID NO: 398161 - RNA, 32 nt, Human
cuccggaguagcugggauugcaggcacccgcc

SEQ ID NO: 398162 - RNA, 32 nt, Human
cuccggaguagcugggguuacaggcacgggcc

SEQ ID NO: 398163 - RNA, 20 nt, Human
cuccggagucgccgcugccg

SEQ ID NO: 398164 - RNA, 31 nt, Human
cuccggaugcuggugcugccaucccccugcc

SEQ ID NO: 398165 - RNA, 32 nt, Human
cuccggcaacacaauggccccuccaucuuugu

SEQ ID NO: 398166 - RNA, 20 nt, Human
cuccggcaccgagcccucca

SEQ ID NO: 398167 - RNA, 32 nt, Human
cuccggcaccuccaaaccuaccccacagucag

SEQ ID NO: 398168 - RNA, 32 nt, Human
cuccggcagcagguccucgcugggcagaugcu

SEQ ID NO: 398169 - RNA, 19 nt, Human
cuccggccaacccggagga

SEQ ID NO: 398170 - RNA, 32 nt, Human
cuccggccaccugggcuccaccagcccagccc

SEQ ID NO: 398171 - RNA, 32 nt, Human
cuccggccaccuguacuguaucagccccaagc

SEQ ID NO: 398172 - RNA, 32 nt, Human
cuccggccagcugccugcccucuugucugugc

SEQ ID NO: 398173 - RNA, 32 nt, Human
cuccggccauucuccccucacccuccucaccu

SEQ ID NO: 398174 - RNA, 32 nt, Human
cuccggcccacugucuguggcccauugucauu

SEQ ID NO: 398175 - RNA, 32 nt, Human
cuccggccccugaagcauggccagcagcggca

SEQ ID NO: 398176 - RNA, 24 nt, Human
cuccggcccuacccacggucucca

SEQ ID NO: 398177 - RNA, 32 nt, Human
cuccggcccuccuccuccuccugguccuugcu

SEQ ID NO: 398178 - RNA, 22 nt, Human
cuccggccgcccgccucugccg

SEQ ID NO: 398179 - RNA, 20 nt, Human
cuccggccgccgccgccccg

SEQ ID NO: 398180 - RNA, 17 nt, Human
cuccggccgccgcgccg

SEQ ID NO: 398181 - RNA, 32 nt, Human
cuccggccucacgguggccucuccaggcucag

SEQ ID NO: 398182 - RNA, 32 nt, Human
cuccggccucagcucccuccccaaagugccug

SEQ ID NO: 398183 - RNA, 32 nt, Human
cuccggccucuccagccucagcccccugcuuc

SEQ ID NO: 398184 - RNA, 32 nt, Human
cuccggccugaugacagagcgagauuccgucu

SEQ ID NO: 398185 - RNA, 22 nt, Human
cuccggccugggcaacaagagc

SEQ ID NO: 398186 - RNA, 18 nt, Human
cuccggccuguccuccaa

SEQ ID NO: 398187 - RNA, 32 nt, Human
cuccggccuuuccuuguacagguucuauguag

SEQ ID NO: 398188 - RNA, 22 nt, Human
cuccggcgacuggugcuacgca

SEQ ID NO: 398189 - RNA, 32 nt, Human
cuccggcgcacacccaaaccgcgcugcgcccg

SEQ ID NO: 398190 - RNA, 17 nt, Human
cuccggcgccgcccgcc

SEQ ID NO: 398191 - RNA, 24 nt, Human
cuccggcgcgagccgccgccaccg

SEQ ID NO: 398192 - RNA, 32 nt, Human
cuccggcggccgagaggagggagcgcggcgca

SEQ ID NO: 398193 - RNA, 32 nt, Human
cuccggcggcgcucuccagucauggacuaccg

SEQ ID NO: 398194 - RNA, 32 nt, Human
cuccggcucacugcccagcccccaucuaccuc

SEQ ID NO: 398195 - RNA, 19 nt, Human
cuccggcucccgcgcccuc

SEQ ID NO: 398196 - RNA, 18 nt, Human
cuccggcucuggcucuug

SEQ ID NO: 398197 - RNA, 32 nt, Human
cuccggcucuugccucccagugccaugcaggu

SEQ ID NO: 398198 - RNA, 19 nt, Human
cuccggcugcagggacccu

SEQ ID NO: 398199 - RNA, 32 nt, Human
cuccggcuggugucuugagaccagccugccag

SEQ ID NO: 398200 - RNA, 32 nt, Human
cuccggcuugcagacgggcuucucccaccccc

SEQ ID NO: 398201 - RNA, 32 nt, Human
cuccgggaaagagaaggggcuuuuugccuuuu

SEQ ID NO: 398202 - RNA, 32 nt, Human
cuccgggaagaggccaggugggggagaacaua

SEQ ID NO: 398203 - RNA, 32 nt, Human
cuccgggacuccucgccaccugcucuguuucu

SEQ ID NO: 398204 - RNA, 32 nt, Human
cuccgggacugcucuggacugacauugcucag

SEQ ID NO: 398205 - RNA, 32 nt, Human
cuccgggagagggggagugcgcggcggccgca

SEQ ID NO: 398206 - RNA, 19 nt, Human
cuccgggagcccacuucua

SEQ ID NO: 398207 - RNA, 32 nt, Human
cuccgggagccugaaccuccugacugaggaac

SEQ ID NO: 398208 - RNA, 32 nt, Human
cuccgggaggccgcggugaggggccgggccca

SEQ ID NO: 398209 - RNA, 32 nt, Human
cuccgggaggccucggugauucagccacagcc

SEQ ID NO: 398210 - RNA, 32 nt, Human
cuccgggaggcugaggcaggagagucacuuga

SEQ ID NO: 398211 - RNA, 32 nt, Human
cuccgggauucugcuguuauuauccaaaggcg

SEQ ID NO: 398212 - RNA, 32 nt, Human
cuccgggcacggcuucccaggggaacgaggag

SEQ ID NO: 398213 - RNA, 32 nt, Human
cuccgggcacgugcugcagcuguggcugaggc

SEQ ID NO: 398214 - RNA, 32 nt, Human
cuccgggcagcccagcgccaggccagagauug

SEQ ID NO: 398215 - RNA, 32 nt, Human
cuccgggcagggaagaggagguuguccccuuu

SEQ ID NO: 398216 - RNA, 32 nt, Human
cuccgggcagggcugggaaggaaaggaaauac

SEQ ID NO: 398217 - RNA, 21 nt, Human
cuccgggccccaccugcaccc

SEQ ID NO: 398218 - RNA, 20 nt, Human
cuccgggcccggcgccgccg

SEQ ID NO: 398219 - RNA, 19 nt, Human
cuccgggccgccgccgcug

SEQ ID NO: 398220 - RNA, 32 nt, Human
cuccgggccgcuccgcucugggcgucagggcg

SEQ ID NO: 398221 - RNA, 32 nt, Human
cuccgggcgcgagaagaggggagccaggccga

SEQ ID NO: 398222 - RNA, 22 nt, Human
cuccgggcugcuccguccuucc

SEQ ID NO: 398223 - RNA, 20 nt, Human
cuccgggcuugggccaggcc

SEQ ID NO: 398224 - RNA, 32 nt, Human
cuccggggagaaaggacacugccccucccccg

SEQ ID NO: 398225 - RNA, 32 nt, Human
cuccggggagcuagaacuggcguuagaggagg

SEQ ID NO: 398226 - RNA, 32 nt, Human
cuccggggcccacuccacugggcccacccugg

SEQ ID NO: 398227 - RNA, 32 nt, Human
cuccggggccgaggugggccugcucauuggaa

SEQ ID NO: 398228 - RNA, 32 nt, Human
cuccggggcuccugccagccccaacccccggc

SEQ ID NO: 398229 - RNA, 32 nt, Human
cuccggggcugggggaucacaggcuggugaac

SEQ ID NO: 398230 - RNA, 17 nt, Human
cuccgggggcugacccu

SEQ ID NO: 398231 - RNA, 32 nt, Human
cuccgggggugacagugaugaggaacugggug

SEQ ID NO: 398232 - RNA, 32 nt, Human
cuccggguaaaggcaagagcaagaccaaguga

SEQ ID NO: 398233 - RNA, 32 nt, Human
cuccgggucacugcuguauauaacuccccucc

SEQ ID NO: 398234 - RNA, 18 nt, Human
cuccggguucaagugauu

SEQ ID NO: 398235 - RNA, 32 nt, Human
cuccggguucacaguguaagggaaauaaaccc

SEQ ID NO: 398236 - RNA, 32 nt, Human
cuccggguucacaguguaggggaaauaaaccc

SEQ ID NO: 398237 - RNA, 32 nt, Human
cuccggguugagauccacagagcuaaacguuu

SEQ ID NO: 398238 - RNA, 22 nt, Human
cuccggguugccgccgccgccg

SEQ ID NO: 398239 - RNA, 23 nt, Human
cuccgguagccucucccaccuaa

SEQ ID NO: 398240 - RNA, 32 nt, Human
cuccggucacagcagcucaguccuccaaagcu

SEQ ID NO: 398241 - RNA, 20 nt, Human
cuccggucccgccgcucccg

SEQ ID NO: 398242 - RNA, 32 nt, Human
cuccgguccugggucgggaggggugggggcca

SEQ ID NO: 398243 - RNA, 32 nt, Human
cuccggugagccacagccuggccaccugucuu

SEQ ID NO: 398244 - RNA, 32 nt, Human
cuccggugcacaaaugcuuucucuucaaggca

SEQ ID NO: 398245 - RNA, 19 nt, Human
cuccggugccgccgcugcc

SEQ ID NO: 398246 - RNA, 24 nt, Human
cuccgguggacgccccggcacggg

SEQ ID NO: 398247 - RNA, 22 nt, Human
cuccggugugccugcagccccg

SEQ ID NO: 398248 - RNA, 18 nt, Human
cuccguaaugagagcccg

SEQ ID NO: 398249 - RNA, 32 nt, Human
cuccguagcccaggcuggagugcaguggcaca

SEQ ID NO: 398250 - RNA, 32 nt, Human
cuccguagucucgcggacagcucucuuuccug

SEQ ID NO: 398251 - RNA, 32 nt, Human
cuccguaucagaaagaaaaagaggaacugaau

SEQ ID NO: 398252 - RNA, 32 nt, Human
cuccguaugcugccugcgccagaagagcuuug

SEQ ID NO: 398253 - RNA, 32 nt, Human
cuccgucaacaucugcugcuccaagcugguga

SEQ ID NO: 398254 - RNA, 21 nt, Human
cuccgucaagcugguugucca

SEQ ID NO: 398255 - RNA, 32 nt, Human
cuccgucacaacaacaacaacaaaaagcuucc

SEQ ID NO: 398256 - RNA, 26 nt, Human
cuccgucacccaggcuggagugcagu

SEQ ID NO: 398257 - RNA, 32 nt, Human
cuccgucacccaggcuggagugcaguggcaag

SEQ ID NO: 398258 - RNA, 32 nt, Human
cuccgucacccaggcuggagugcaguggcgcc

SEQ ID NO: 398259 - RNA, 32 nt, Human
cuccgucagacuguugcaguagaagaaugauu

SEQ ID NO: 398260 - RNA, 32 nt, Human
cuccgucagccugucggugcucugacccucug

SEQ ID NO: 398261 - RNA, 32 nt, Human
cucgguggcuuccccugcgcccugggaguuug

SEQ ID NO: 398262 - RNA, 32 nt, Human
cucgguguccccacagcaccuagcacagucuc

SEQ ID NO: 398263 - RNA, 32 nt, Human
cucggugugggcagugggaggcaagagugaag

SEQ ID NO: 398264 - RNA, 32 nt, Human
cucgguucaagcaauucgcccaccuuggccuc

SEQ ID NO: 398265 - RNA, 22 nt, Human
cucgguucacuacaaccuccgc

SEQ ID NO: 398266 - RNA, 24 nt, Human
cucgguucacugcaaccuccaccu

SEQ ID NO: 398267 - RNA, 32 nt, Human
cucgguucacugcaaccuccgccuccagguuc

SEQ ID NO: 398268 - RNA, 32 nt, Human
cucgguucacugcaaccuccgccucccgguuc

SEQ ID NO: 398269 - RNA, 32 nt, Human
cucgguucacugcaaccucugccacccauguu

SEQ ID NO: 398270 - RNA, 32 nt, Human
cucgguucacugcaaccucugccucccaggau

SEQ ID NO: 398271 - RNA, 32 nt, Human
cucgguucacugcaaccucugccucccagguu

SEQ ID NO: 398272 - RNA, 32 nt, Human
cucgguucacugcaaccucugccuccuggguu

SEQ ID NO: 398273 - RNA, 32 nt, Human
cucgguucacugcaaccucugccucucagguu

SEQ ID NO: 398274 - RNA, 32 nt, Human
cucgguucacugcaaccuuggccuccuagguu

SEQ ID NO: 398275 - RNA, 32 nt, Human
cucgguucacugcagccucugccuucugggcu

SEQ ID NO: 398276 - RNA, 32 nt, Human
cucgguucccacccucagcaagcaggccucca

SEQ ID NO: 398277 - RNA, 18 nt, Human
cucgguuccccgcugccg

SEQ ID NO: 398278 - RNA, 32 nt, Human
cucgguuccucuuacccucuucuuggacccua

SEQ ID NO: 398279 - RNA, 32 nt, Human
cucgguugcaccugacauucucuccccaguaa

SEQ ID NO: 398280 - RNA, 32 nt, Human
cucgguuggcuccucuggaacagggaguagug

SEQ ID NO: 398281 - RNA, 32 nt, Human
cucgguuguaacggggcugggaagaaaagcag

SEQ ID NO: 398282 - RNA, 32 nt, Human
cucgguuuggccugcacuguccuccggccuca

SEQ ID NO: 398283 - RNA, 32 nt, Human
cucguaaaggagagaguaagagucaccaaaca

SEQ ID NO: 398284 - RNA, 24 nt, Human
cucguaaagugcugggauuacagg

SEQ ID NO: 398285 - RNA, 32 nt, Human
cucguaaauggcacguuuagguggugagaggu

SEQ ID NO: 398286 - RNA, 32 nt, Human
cucguaaauugcugggauuacaggcaugagcc

SEQ ID NO: 398287 - RNA, 32 nt, Human
cucguaaccagagaccagcacaugucagggaa

SEQ ID NO: 398288 - RNA, 32 nt, Human
cucguaaccuccauauuuucaggauuuuugaa

SEQ ID NO: 398289 - RNA, 32 nt, Human
cucguaauucacaacccuaaaguuccauuuac

SEQ ID NO: 398290 - RNA, 32 nt, Human
cucguacacacacgcaguuuuaagggugaugu

SEQ ID NO: 398291 - RNA, 32 nt, Human
cucguacagcacaggaaccugacacauaguag

SEQ ID NO: 398292 - RNA, 32 nt, Human
cucguacauaugugcuucauaauaugucacuc

SEQ ID NO: 398293 - RNA, 32 nt, Human
cucguacaugcacaaauacacacucaugcaca

SEQ ID NO: 398294 - RNA, 32 nt, Human
cucguacccuucuacgugaucugcaccuuuaa

SEQ ID NO: 398295 - RNA, 32 nt, Human
cucguaccucagacucccgaauagcugggauu

SEQ ID NO: 398296 - RNA, 32 nt, Human
cucguaccuguaauccagcacuuugggaagcc

SEQ ID NO: 398297 - RNA, 32 nt, Human
cucguagaggagagaaaacaagaguggacugg

SEQ ID NO: 398298 - RNA, 32 nt, Human
cucguagcuccacucugcagccucaaacuccu

SEQ ID NO: 398299 - RNA, 32 nt, Human
cucguagggggugaguugaguguggcugggag

SEQ ID NO: 398300 - RNA, 32 nt, Human
cucguaucuguaaucccagcacuuugagaggc

SEQ ID NO: 398301 - RNA, 32 nt, Human
cucguaugcuuccuggccuggaaugcacuugc

SEQ ID NO: 398302 - RNA, 32 nt, Human
cucgucacccagccucaaaaauauaugugucu

SEQ ID NO: 398303 - RNA, 23 nt, Human
cucgucacccaggcuggagugca

SEQ ID NO: 398304 - RNA, 16 nt, Human
cucgucacugccugcc

SEQ ID NO: 398305 - RNA, 32 nt, Human
cucgucagccucccgccggccgucuccuuaac

SEQ ID NO: 398306 - RNA, 32 nt, Human
cucgucagccuuccucuuccagaagcuguugg

SEQ ID NO: 398307 - RNA, 32 nt, Human
cucgucaucaggugcauagcaagugaaagcaa

SEQ ID NO: 398308 - RNA, 32 nt, Human
cucguccacccaccccuggcuggcagccuccc

SEQ ID NO: 398309 - RNA, 32 nt, Human
cucgucccagguaaggagaguccuggucuuug

SEQ ID NO: 398310 - RNA, 32 nt, Human
cucgucccaugccuccugccucuccccucccu

SEQ ID NO: 398311 - RNA, 32 nt, Human
cucguccccucuuccacaccuucccagcauca

SEQ ID NO: 398312 - RNA, 32 nt, Human
cucgucccgggcugaauucucucuccacucuu

SEQ ID NO: 398313 - RNA, 32 nt, Human
cucguccuagcaacaggagaccugacagaugc

SEQ ID NO: 398314 - RNA, 21 nt, Human
cucguccuccgugggcacuga

SEQ ID NO: 398315 - RNA, 32 nt, Human
cucguccuccuggaagcugaggcugagaaggg

SEQ ID NO: 398316 - RNA, 32 nt, Human
cucgucgccauggaggagcuccaggagccucu

SEQ ID NO: 398317 - RNA, 32 nt, Human
cucgucuaaaaauacaaaaauuagccgggcgu

SEQ ID NO: 398318 - RNA, 32 nt, Human
cucgucucacugcaaccuccgccucccagauu

SEQ ID NO: 398319 - RNA, 32 nt, Human
cucgucucacugcaaccucugccuccuggguu

SEQ ID NO: 398320 - RNA, 32 nt, Human
cucgucucccccgagagccacagggagugcug

SEQ ID NO: 398321 - RNA, 32 nt, Human
cucgucucucccuggaaagggagggaggcuuc

SEQ ID NO: 398322 - RNA, 32 nt, Human
cucgucucucuucuccaggacuccugcacuga

SEQ ID NO: 398323 - RNA, 32 nt, Human
cucgucugcacuccacuccauccugcugcugg

SEQ ID NO: 398324 - RNA, 20 nt, Human
cucgucugccgccgccgucg

SEQ ID NO: 398325 - RNA, 32 nt, Human
cucgucugcuucuuguuuggcagaaauagaug

SEQ ID NO: 398326 - RNA, 32 nt, Human
cucgucugugcacgaacagguggccgacucug

SEQ ID NO: 398327 - RNA, 32 nt, Human
cucgucuucagcugcauuucacaugccuugca

SEQ ID NO: 398328 - RNA, 32 nt, Human
cucgucuucauuaagcccucuuccaucauguc

SEQ ID NO: 398329 - RNA, 32 nt, Human
cucgucuuccuugggccgagauuuuccacugc

SEQ ID NO: 398330 - RNA, 32 nt, Human
cucgucuugucuacccacccucccucccccau

SEQ ID NO: 398331 - RNA, 32 nt, Human
cucgucuuucucccgggaaccuugacgacgcc

SEQ ID NO: 398332 - RNA, 32 nt, Human
cucgugaaauguugaggguggggagaaaagac

SEQ ID NO: 398333 - RNA, 32 nt, Human
cucgugacaagugccuucacacagaccccucg

SEQ ID NO: 398334 - RNA, 32 nt, Human
cucgugaccgcagugauccucccgccucggcc

SEQ ID NO: 398335 - RNA, 32 nt, Human
cucgugagacacgucccacugccuuguugcag

SEQ ID NO: 398336 - RNA, 32 nt, Human
cucgugagccccgggauggaggagaaauacgg

SEQ ID NO: 398337 - RNA, 32 nt, Human
cucgugagcuaaagcuacucgcccaccuggau

SEQ ID NO: 398338 - RNA, 32 nt, Human
cucgugaugagaaacucacuucuggcaccugu

SEQ ID NO: 398339 - RNA, 32 nt, Human
cucgugcauguaauccuagcacuuugggaggc

SEQ ID NO: 398340 - RNA, 18 nt, Human
cucgugccaccgccgccg

SEQ ID NO: 398341 - RNA, 18 nt, Human
cucgugccuguaauccca

SEQ ID NO: 398342 - RNA, 32 nt, Human
cucgugccuguaaucccagcacuuugggaggc

SEQ ID NO: 398343 - RNA, 32 nt, Human
cucgugccuguaaucccagcacuuugggaggu

SEQ ID NO: 398344 - RNA, 32 nt, Human
cucgugccuguacucccagcacuuugggaggc

SEQ ID NO: 398345 - RNA, 32 nt, Human
cucgugccuguagucccagcacuuugggaggc

SEQ ID NO: 398346 - RNA, 32 nt, Human
cucgugccugucaucccagcacuuugggaggc

SEQ ID NO: 398347 - RNA, 32 nt, Human
cucgugccugugaucccagcacuuugggaggc

SEQ ID NO: 398348 - RNA, 32 nt, Human
cucgugcugcccagcgccccaggcuggacuga

SEQ ID NO: 398349 - RNA, 32 nt, Human
cucgugcugcugcccaggcuggagugcagugg

SEQ ID NO: 398350 - RNA, 32 nt, Human
cucgugcuuguaaucccagcacuuugggaggc

SEQ ID NO: 398351 - RNA, 32 nt, Human
cucguggacaccugcccugcccugccaccugu

SEQ ID NO: 398352 - RNA, 32 nt, Human
cucguggacacugcgugguacugugugcacac

SEQ ID NO: 398353 - RNA, 32 nt, Human
cucguggagcugccaacucggccaaaggagaa

SEQ ID NO: 398354 - RNA, 32 nt, Human
cucguggaggcaucuacacccacccacagcag

SEQ ID NO: 398355 - RNA, 32 nt, Human
cucguggagguggugguugaaaggugagaauu

SEQ ID NO: 398356 - RNA, 32 nt, Human
cucguggcccggcggggccccugcugccuccc

SEQ ID NO: 398357 - RNA, 24 nt, Human
cucguggcuguaaucccagcacuu

SEQ ID NO: 398358 - RNA, 32 nt, Human
cucguggcuuaaccccuccuacccucuaccuc

SEQ ID NO: 398359 - RNA, 32 nt, Human
cucgugggagggagcaugcaggugagaggaug

SEQ ID NO: 398360 - RNA, 32 nt, Human
cucgugggccagugaaaauagacuguaggucc

SEQ ID NO: 398361 - RNA, 32 nt, Human
cucguggguggacugagucccacucagcuuca

SEQ ID NO: 398362 - RNA, 32 nt, Human
cucguggguggagccugguaaaaagaggaaag

SEQ ID NO: 398363 - RNA, 32 nt, Human
cucgugguuccccgcuaggucuccgcuggggc

SEQ ID NO: 398364 - RNA, 32 nt, Human
cucgugguuccgcgcuaggucuccgcuggggc

SEQ ID NO: 398365 - RNA, 32 nt, Human
cucguguacccaucuucccacccucuauguuc

SEQ ID NO: 398366 - RNA, 32 nt, Human
cucguguccucugccaccccugcccacugucc

SEQ ID NO: 398367 - RNA, 32 nt, Human
cucgugucucucagugaaaggcugcuuaaaca

SEQ ID NO: 398368 - RNA, 32 nt, Human
cucgugugcauggccccugccucuucaggcuc

SEQ ID NO: 398369 - RNA, 32 nt, Human
cucguguguucugccaagagcugcuucuguca

SEQ ID NO: 398370 - RNA, 32 nt, Human
cucguguugccccggcuggagugcaguggcgc

SEQ ID NO: 398371 - RNA, 32 nt, Human
cucguguugugagccucaaaccaggcaccagg

SEQ ID NO: 398372 - RNA, 32 nt, Human
cucguuaaagcacagauaucacacaagugauu

SEQ ID NO: 398373 - RNA, 32 nt, Human
cucguuaagcuccgggaugaccuuguaggaga

SEQ ID NO: 398374 - RNA, 32 nt, Human
cucguuacacauuccacagcugugacugagaa

SEQ ID NO: 398375 - RNA, 32 nt, Human
cucguuaggacaaugccuuccaggugccacug

SEQ ID NO: 398376 - RNA, 32 nt, Human
cucguuccccuccaucugauccccacacaggc

SEQ ID NO: 398377 - RNA, 32 nt, Human
cucguuccgggcuaguccugcagccacacaga

SEQ ID NO: 398378 - RNA, 32 nt, Human
cucguuccucaagguuuagccgagacacugcc

SEQ ID NO: 398379 - RNA, 32 nt, Human
cucguucugaaccaauuuucuccuaucuucuc

SEQ ID NO: 398380 - RNA, 32 nt, Human
cucguucugucacccaggcuggagugcaguga

SEQ ID NO: 398381 - RNA, 32 nt, Human
cucguucugucacccaggcuggcgugcaauag

SEQ ID NO: 398382 - RNA, 32 nt, Human
cucguucugucgcccaggcuggagugcagggg

SEQ ID NO: 398383 - RNA, 32 nt, Human
cucguugaguuauuuguaaaauaaacauuuag

SEQ ID NO: 398384 - RNA, 32 nt, Human
cucguugccaugggacaccuccgagagagugg

SEQ ID NO: 398385 - RNA, 23 nt, Human
cucguugcccaaccuggagugca

SEQ ID NO: 398386 - RNA, 23 nt, Human
cucguugcccaggcuggagugca

SEQ ID NO: 398387 - RNA, 25 nt, Human
cucguugcccaggcuggagugcagu

SEQ ID NO: 398388 - RNA, 32 nt, Human
cucguugcccaggcuggagugcaguggcgcaa

SEQ ID NO: 398389 - RNA, 32 nt, Human
cucguuggcuuccucuuggacugggucucaau

SEQ ID NO: 398390 - RNA, 32 nt, Human
cucguugguggaggggagggagagagcuucag

SEQ ID NO: 398391 - RNA, 24 nt, Human
cucguugucucagccucccagguc

SEQ ID NO: 398392 - RNA, 22 nt, Human
cucguuuccaggccucucccca

SEQ ID NO: 398393 - RNA, 32 nt, Human
cucguuuccaucaagcauuccaguacccccac

SEQ ID NO: 398394 - RNA, 32 nt, Human
cucguuucuccucuuuccuccugcuucauggg

SEQ ID NO: 398395 - RNA, 32 nt, Human
cucguuugccuuucuauuuccuuccaaauucu

SEQ ID NO: 398396 - RNA, 32 nt, Human
cucguuuggggaaaacgacccgggaggagagc

SEQ ID NO: 398397 - RNA, 32 nt, Human
cucguuuguggacaaagcagcacguaucaccu

SEQ ID NO: 398398 - RNA, 32 nt, Human
cucguuuucuggguuuuggugauguuggagga

SEQ ID NO: 398399 - RNA, 32 nt, Human
cucguuuugcagcccaguccccgccuuuucag

SEQ ID NO: 398400 - RNA, 32 nt, Human
cucguuuuuauuccuccucucccagauuggcu

SEQ ID NO: 398401 - RNA, 32 nt, Human
cucguuuuucuuucucucuuucccccguccau

SEQ ID NO: 398402 - RNA, 32 nt, Human
cucuaaaaauagauucagagaaaggguggaca

SEQ ID NO: 398403 - RNA, 32 nt, Human
cucuaaaaccacacuaaaguuuucugacuucu

SEQ ID NO: 398404 - RNA, 32 nt, Human
cucuaaaagaagcuggagggaggaagcccauu

SEQ ID NO: 398405 - RNA, 32 nt, Human
cucuaaaaggguccauauuugccugcauucua

SEQ ID NO: 398406 - RNA, 32 nt, Human
cucuaaaaguuuuguaaucaugaguuagauau

SEQ ID NO: 398407 - RNA, 32 nt, Human
cucuaaaauggaauuucccacuucacuccaaa

SEQ ID NO: 398408 - RNA, 32 nt, Human
cucuaaacauuucauauaaauggaauuacaca

SEQ ID NO: 398409 - RNA, 32 nt, Human
cucuaaaccccuggaccaucugaauggagcag

SEQ ID NO: 398410 - RNA, 32 nt, Human
cucuaaaccucaaccuccuccuaccuggcagu

SEQ ID NO: 398411 - RNA, 32 nt, Human
cucuaaagaaggcugaaaauuuuuguccaaau

SEQ ID NO: 398412 - RNA, 32 nt, Human
cucuaaagcuuguuugaugaaacugguugguc

SEQ ID NO: 398413 - RNA, 32 nt, Human
cucuaaagggaaaaggucuacccuggagccag

SEQ ID NO: 398414 - RNA, 32 nt, Human
cucuaaagucccugcucugaggagacucugcc

SEQ ID NO: 398415 - RNA, 32 nt, Human
cucuaaaucaaggaucaugugugcacaauacu

SEQ ID NO: 398416 - RNA, 32 nt, Human
cucuaaauuguauauaaguuguguauauagag

SEQ ID NO: 398417 - RNA, 32 nt, Human
cucuaacaccacacuccagcuacuguguagug

SEQ ID NO: 398418 - RNA, 32 nt, Human
cucuaacagaucccuccucuucucggagaccu

SEQ ID NO: 398419 - RNA, 32 nt, Human
cucuaacaggcagauauagacaaagcagugca

SEQ ID NO: 398420 - RNA, 32 nt, Human
cucuaacauuugcaaaauggaaauguaauaau

SEQ ID NO: 398421 - RNA, 32 nt, Human
cucuaaccgaggaagcauugauugggagcuac

SEQ ID NO: 398422 - RNA, 21 nt, Human
cucuaaccugggcgacagagu

SEQ ID NO: 398423 - RNA, 32 nt, Human
cucuaaccuguagcuucagaggccagucuggg

SEQ ID NO: 398424 - RNA, 32 nt, Human
cucuaaccuuucucucacuccuacaaggcccu

SEQ ID NO: 398425 - RNA, 32 nt, Human
cucuaaccuuucucugccucucccacacucuc

SEQ ID NO: 398426 - RNA, 32 nt, Human
cucuaacuccuccuccuccucucuucuccucu

SEQ ID NO: 398427 - RNA, 32 nt, Human
cucuaacugaggcucugcuaugugccaugucc

SEQ ID NO: 398428 - RNA, 32 nt, Human
cucuaacugucaagacaaacacaaaggcccag

SEQ ID NO: 398429 - RNA, 19 nt, Human
cucuaacuucccuggcuuc

SEQ ID NO: 398430 - RNA, 21 nt, Human
cucuaacuugggcaacaaagc

SEQ ID NO: 398431 - RNA, 32 nt, Human
cucuaagaaaaaguuaagacaccuagucuaau

SEQ ID NO: 398432 - RNA, 32 nt, Human
cucuaagaaaugcugaaguaucggcauuacau

SEQ ID NO: 398433 - RNA, 32 nt, Human
cucuaagaaccccucacugauucacucaauag

SEQ ID NO: 398434 - RNA, 32 nt, Human
cucuaagaacugcucucuaaggcugcgguagc

SEQ ID NO: 398435 - RNA, 32 nt, Human
cucuaagaaggcugcuguacugguugaauugu

SEQ ID NO: 398436 - RNA, 24 nt, Human
cucuaagacagcuccuguguacag

SEQ ID NO: 398437 - RNA, 32 nt, Human
cucuaagacauccacaggugugcaguguuaaa

SEQ ID NO: 398438 - RNA, 22 nt, Human
cucuaagacgaaauuuggccag

SEQ ID NO: 398439 - RNA, 32 nt, Human
cucuaagagaacagccagaugguuuauaugaa

SEQ ID NO: 398440 - RNA, 32 nt, Human
cucuaagagagguugggaccaggcuagguucc

SEQ ID NO: 398441 - RNA, 32 nt, Human
cucuaagauacugauggcucugcagaggaccc

SEQ ID NO: 398442 - RNA, 32 nt, Human
cucuaagauauuagcuacuuucuguaugcaca

SEQ ID NO: 398443 - RNA, 22 nt, Human
cucuaagaugaaccuggggaca

SEQ ID NO: 398444 - RNA, 32 nt, Human
cucuaagcaaugacaucaugacauauauucaa

SEQ ID NO: 398445 - RNA, 32 nt, Human
cucuaagcacagauugcuuuuugcugccucuc

SEQ ID NO: 398446 - RNA, 32 nt, Human
cucuaagcacuaagggcugugccugagaaugg

SEQ ID NO: 398447 - RNA, 31 nt, Human
cucuaagcugguguucccaugcacagggcca

SEQ ID NO: 398448 - RNA, 32 nt, Human
cucuaaggaaggcagagaccuggguugagcag

SEQ ID NO: 398449 - RNA, 32 nt, Human
cucuaaggccugaaaaggaacaaggcccaccg

SEQ ID NO: 398450 - RNA, 32 nt, Human
cucuaagggagguggcagcaucaaaggcuccc

SEQ ID NO: 398451 - RNA, 32 nt, Human
cucuaaggguucugcucugacuccagguuggg

SEQ ID NO: 398452 - RNA, 32 nt, Human
cucuaaggucuggacaucaucaucccagcuag

SEQ ID NO: 398453 - RNA, 32 nt, Human
cucuaagguugggcagggugacccugaaguga

SEQ ID NO: 398454 - RNA, 25 nt, Human
cucuaagguuuucaucugcuuguuu

SEQ ID NO: 398455 - RNA, 32 nt, Human
cucuaaguucuugucucuggccagaggugugg

SEQ ID NO: 398456 - RNA, 32 nt, Human
cucuaauaaaaauacaaaaauuagccaggcau

SEQ ID NO: 398457 - RNA, 32 nt, Human
cucuaauaaaaauacaaaaauuagccaggcgu

SEQ ID NO: 398458 - RNA, 32 nt, Human
cucuaauaaaaauacaaaaauuagcuggacau

SEQ ID NO: 398459 - RNA, 32 nt, Human
cucuaauaaaaauacaaaaauuagcugggcau

SEQ ID NO: 398460 - RNA, 32 nt, Human
cucuaauaaaaauacaaaacuuagcugggcgu

SEQ ID NO: 398461 - RNA, 32 nt, Human
cucuaauaaaaauacgaaaaauuagcugggca

SEQ ID NO: 398462 - RNA, 32 nt, Human
cucuaauaaaaauauaaaaauuagccuggcau

SEQ ID NO: 398463 - RNA, 32 nt, Human
cucuaauaaccagcuacaaggaacggaggccc

SEQ ID NO: 398464 - RNA, 32 nt, Human
cucuaauaacuugcauuuccuuaucuauggau

SEQ ID NO: 398465 - RNA, 32 nt, Human
cucuaauaggugaugcaugagcaaacagugag

SEQ ID NO: 398466 - RNA, 32 nt, Human
cucuaauaugaacauuaguuugagguaguuuu

SEQ ID NO: 398467 - RNA, 21 nt, Human
cucuaaucccagguacuuggg

SEQ ID NO: 398468 - RNA, 32 nt, Human
cucuaaucccuguguuccuucucccccaucuu

SEQ ID NO: 398469 - RNA, 32 nt, Human
cucuaaucuccucuacaaucauccucccuugu

SEQ ID NO: 398470 - RNA, 32 nt, Human
cucuaaucugagcugcagccuggcugguccuc

SEQ ID NO: 398471 - RNA, 32 nt, Human
cucuaaugccugugucccuuacuuugguuaau

SEQ ID NO: 398472 - RNA, 18 nt, Human
cucuaauggacuguucca

SEQ ID NO: 398473 - RNA, 28 nt, Human
cucuaauuaagaacugccucauugagcc

SEQ ID NO: 398474 - RNA, 32 nt, Human
cucuaauuauuuuucuccugaacaaaauuacc

SEQ ID NO: 398475 - RNA, 32 nt, Human
cucuaauucaagcgaauguuggaacaccauga

SEQ ID NO: 398476 - RNA, 32 nt, Human
cucuaauuguaauccccacaugucgagggagg

SEQ ID NO: 398477 - RNA, 32 nt, Human
cucuacaaaaacuacaaaaauuagccgggugu

SEQ ID NO: 398478 - RNA, 32 nt, Human
cucuacaaaaaguacaaaaauuagucgggcgu

SEQ ID NO: 398479 - RNA, 32 nt, Human
cucuacaaaaaguagaaaaauuagcugagugu

SEQ ID NO: 398480 - RNA, 32 nt, Human
cucuacaaaaauaagaaaauuagccaggugua

SEQ ID NO: 398481 - RNA, 32 nt, Human
cucuacaaaaauacaaaaauuagccaggcgug

SEQ ID NO: 398482 - RNA, 32 nt, Human
cucuacaaaaauacaaaaauuagccaggugug

SEQ ID NO: 398483 - RNA, 32 nt, Human
cucuacaaaaauacaaaaauuagccagguuug

SEQ ID NO: 398484 - RNA, 32 nt, Human
cucuacaaaaauacaaaaauuaggccgggugc

SEQ ID NO: 398485 - RNA, 32 nt, Human
cucuacaaaaauacaaaauuagccagguaugg

SEQ ID NO: 398486 - RNA, 32 nt, Human
cucuacaaaacauacaaaaauuagcugagcgu

SEQ ID NO: 398487 - RNA, 32 nt, Human
cucuacaaaacaugcaaaaauuagcugggcau

SEQ ID NO: 398488 - RNA, 32 nt, Human
cucuacaaaacuuaaaaguuagccaggccugg

SEQ ID NO: 398489 - RNA, 19 nt, Human
cucuacaaaagaaaaauua

SEQ ID NO: 398490 - RNA, 32 nt, Human
cucuacaaaagaugcaagaauuagcugggugu

SEQ ID NO: 398491 - RNA, 32 nt, Human
cucuacaaaaguacaaaaauuagccaggcgug

SEQ ID NO: 398492 - RNA, 32 nt, Human
cucuacaaaauauacaaaaauuagccaggcau

SEQ ID NO: 398493 - RNA, 32 nt, Human
cucuacaaaauaucuaaaaauuagcugggcac

SEQ ID NO: 398494 - RNA, 32 nt, Human
cucuacaaacaauacaaaaauuagccaggcau

SEQ ID NO: 398495 - RNA, 32 nt, Human
cucuacaaacauuuuaaaaauuagcugggugu

SEQ ID NO: 398496 - RNA, 32 nt, Human
cucuacaaagaauacgaacauuagcugggucu

SEQ ID NO: 398497 - RNA, 32 nt, Human
cucuacaacagugaucaucacagaggacuucu

SEQ ID NO: 398498 - RNA, 32 nt, Human
cucuacaacuccugccacuguuggccaugucg

SEQ ID NO: 398499 - RNA, 32 nt, Human
cucuacaacugaguccuuaaacagggcaucuc

SEQ ID NO: 398500 - RNA, 32 nt, Human
cucuacaagugccugcuaucccucucccacuc

SEQ ID NO: 398501 - RNA, 32 nt, Human
cucuacacagaucagacucaugugcagaaucg

SEQ ID NO: 398502 - RNA, 18 nt, Human
cucuacaccaccaucacc

SEQ ID NO: 398503 - RNA, 32 nt, Human
cucuacacugcaagcugcauuccagccacaac

SEQ ID NO: 398504 - RNA, 32 nt, Human
cucuacacugcaccauccgccggcaaccgcuc

SEQ ID NO: 398505 - RNA, 18 nt, Human
cucuacacugggccugug

SEQ ID NO: 398506 - RNA, 32 nt, Human
cucuacagaagauacaaaaauuggcugggcgu

SEQ ID NO: 398507 - RNA, 32 nt, Human
cucuacagacacaauccucaaaccaacaaaac

SEQ ID NO: 398508 - RNA, 32 nt, Human
cucuacagacaggggcgcugcugcagaugcuc

SEQ ID NO: 398509 - RNA, 32 nt, Human
cucuacagaguccucaagcuggugucccucca

SEQ ID NO: 398510 - RNA, 32 nt, Human
cucuacagcagcuucacugccugaaaaugaaa

SEQ ID NO: 398511 - RNA, 32 nt, Human
cucuacagccuggaagacagaguaagauccaa

SEQ ID NO: 398512 - RNA, 32 nt, Human
cucuacaggaugagggagagguugauucuguc

SEQ ID NO: 398513 - RNA, 32 nt, Human
cucuacaggccagccucugccucacaguggac

SEQ ID NO: 398514 - RNA, 32 nt, Human
cucuacagguggggcagagagggugguggaca

SEQ ID NO: 398515 - RNA, 32 nt, Human
cucuacauaaaauacaaaaacuuagaugggca

SEQ ID NO: 398516 - RNA, 32 nt, Human
cucuacauaaaauacaaaaauuagcugggcgu

SEQ ID NO: 398517 - RNA, 32 nt, Human
cucuacauccccagcagggaguggccucuccc

SEQ ID NO: 398518 - RNA, 30 nt, Human
cucuacauccucuccagcaccuguuguuuc

SEQ ID NO: 398519 - RNA, 32 nt, Human
cucuacaucuucugccuuagucucaguuugug

SEQ ID NO: 398520 - RNA, 32 nt, Human
cucuacaugacacaguuaccacccucauucuu

SEQ ID NO: 398521 - RNA, 32 nt, Human
cucuacaugcuuguugacagagagagauacuc

SEQ ID NO: 398522 - RNA, 32 nt, Human
cucuaccaaaaauacaaaaauuaaccaugcgu

SEQ ID NO: 398523 - RNA, 32 nt, Human
cucuaccaaaaauacaaaaauuagccacgcau

SEQ ID NO: 398524 - RNA, 32 nt, Human
cucuaccaaaaauacaaaaauuagccagacgu

SEQ ID NO: 398525 - RNA, 32 nt, Human
cucuaccaaaaauacaaaaauuagccaggcau

SEQ ID NO: 398526 - RNA, 32 nt, Human
cucuaccaaaaauacaaaaauuagccaggcgu

SEQ ID NO: 398527 - RNA, 32 nt, Human
cucuaccaaaaauacaaaaauuagccgggcgu

SEQ ID NO: 398528 - RNA, 32 nt, Human
cucuaccaaaaauacaaaaauuagccgggugu

SEQ ID NO: 398529 - RNA, 32 nt, Human
cucuaccaaaaauacaaaaauuagcuagacau

SEQ ID NO: 398530 - RNA, 32 nt, Human
cucuaccaaaaauacaaaaauuagcugggcgu

SEQ ID NO: 398531 - RNA, 32 nt, Human
cucuaccaaaaauacaaaaauuagcugggcuu

SEQ ID NO: 398532 - RNA, 32 nt, Human
cucuaccaaaaauacaaaaauuagcugggugc

SEQ ID NO: 398533 - RNA, 32 nt, Human
cucuaccaaaaauacaaaaauucaccaggcau

SEQ ID NO: 398534 - RNA, 32 nt, Human
cucuaccaaaaauacaggaaauuaucugggca

SEQ ID NO: 398535 - RNA, 32 nt, Human
cucuaccaaaauacaaaaauuagccgggcaug

SEQ ID NO: 398536 - RNA, 32 nt, Human
cucuaccaaaauuacaaaaauuagccgagcau

SEQ ID NO: 398537 - RNA, 31 nt, Human
cucuaccacagcuacgugccagaguuguuuu

SEQ ID NO: 398538 - RNA, 32 nt, Human
cucuaccacagcuacgugccagaguuguuuuc

SEQ ID NO: 398539 - RNA, 32 nt, Human
cucuaccacagugucccugaaaccacaugcau

SEQ ID NO: 398540 - RNA, 32 nt, Human
cucuaccacccaggcuggagugcaguggugug

SEQ ID NO: 398541 - RNA, 26 nt, Human
cucuaccacccagucuggagugcagu

SEQ ID NO: 398542 - RNA, 32 nt, Human
cucuaccagcaucugcugagcuaugagccaaa

SEQ ID NO: 398543 - RNA, 32 nt, Human
cucuaccaggaggagaccagguugcaguggcg

SEQ ID NO: 398544 - RNA, 32 nt, Human
cucuaccaguuccuguuucuucugagccagac

SEQ ID NO: 398545 - RNA, 32 nt, Human
cucuacccacagauggcccugggaaucaauuc

SEQ ID NO: 398546 - RNA, 32 nt, Human
cucuacccacagugacgugguaucugaugaag

SEQ ID NO: 398547 - RNA, 32 nt, Human
cucuacccacccucuucucucuucucuucucc

SEQ ID NO: 398548 - RNA, 32 nt, Human
cucuacccagcccugggcaguucccucaacag

SEQ ID NO: 398549 - RNA, 32 nt, Human
cucuacccaggaacaaacugugccugaaccug

SEQ ID NO: 398550 - RNA, 20 nt, Human
cucuaccccagggcccucaa

SEQ ID NO: 398551 - RNA, 32 nt, Human
cucuacccccuucugagaacaucccccacaga

SEQ ID NO: 398552 - RNA, 32 nt, Human
cucuacccgccacugcauuccacagccuguag

SEQ ID NO: 398553 - RNA, 32 nt, Human
cucuacccuacaugaucuggagcaacagcuag

SEQ ID NO: 398554 - RNA, 32 nt, Human
cucuacccuacaugaucuggagcaacagcugg

SEQ ID NO: 398555 - RNA, 32 nt, Human
cucuacccucauucacaucuagccaagccagu

SEQ ID NO: 398556 - RNA, 32 nt, Human
cucuacccucauucauccuuuugggcuaauug

SEQ ID NO: 398557 - RNA, 32 nt, Human
cucuacccuccagaaccugacgacugggccau

SEQ ID NO: 398558 - RNA, 32 nt, Human
cucuacccugcucccugcuuuggcugaggggc

SEQ ID NO: 398559 - RNA, 32 nt, Human
cucuacccuucaggacccuccccaccagcuca

SEQ ID NO: 398560 - RNA, 32 nt, Human
cucuacccuuucacagugagugagugaguaca

SEQ ID NO: 398561 - RNA, 32 nt, Human
cucuaccuacuucuugguauuccgaauuguuc

SEQ ID NO: 398562 - RNA, 32 nt, Human
cucuaccucacugccaccacuccugcuuuuag

SEQ ID NO: 398563 - RNA, 32 nt, Human
cucuaccuccacccccaccggccugacgcugu

SEQ ID NO: 398564 - RNA, 32 nt, Human
cucuaccuccauccuugaaucauccacuuuua

SEQ ID NO: 398565 - RNA, 32 nt, Human
cucuaccucccaaagugcugggauuacagaca

SEQ ID NO: 398566 - RNA, 32 nt, Human
cucuaccucccaaagugcugggauuacaggca

SEQ ID NO: 398567 - RNA, 32 nt, Human
cucuaccucucuauacuaaucucccuacaaau

SEQ ID NO: 398568 - RNA, 20 nt, Human
cucuaccucuuugccuccug

SEQ ID NO: 398569 - RNA, 32 nt, Human
cucuaccugccugguccagcugggacccugcc

SEQ ID NO: 398570 - RNA, 32 nt, Human
cucuaccugcugugcuuauuugcauggacuuu

SEQ ID NO: 398571 - RNA, 32 nt, Human
cucuaccuggccugcuuacucucccacgugcc

SEQ ID NO: 398572 - RNA, 32 nt, Human
cucuaccuguucucugcaaucauccaaaauuu

SEQ ID NO: 398573 - RNA, 32 nt, Human
cucuaccuucaagaagcauuucaaggcuaaua

SEQ ID NO: 398574 - RNA, 32 nt, Human
cucuaccuucaccaccaccacugcccaucuug

SEQ ID NO: 398575 - RNA, 32 nt, Human
cucuaccuucccacucaccuuccccagcuaca

SEQ ID NO: 398576 - RNA, 17 nt, Human
cucuaccuuggugcucu

SEQ ID NO: 398577 - RNA, 32 nt, Human
cucuaccuuuuaaaauugaauaguuuauuucu

SEQ ID NO: 398578 - RNA, 29 nt, Human
cucuacgaaaaauacaaaaauuaacuggg

SEQ ID NO: 398579 - RNA, 32 nt, Human
cucuacgaaaaauacaaaaauuagcugggcau

SEQ ID NO: 398580 - RNA, 32 nt, Human
cucuacgaaaauuacaaaaauuagcuggcaug

SEQ ID NO: 398581 - RNA, 20 nt, Human
cucuacgaccgccguugccg

SEQ ID NO: 398582 - RNA, 32 nt, Human
cucuacgagaccagagagacuguaguucccua

SEQ ID NO: 398583 - RNA, 28 nt, Human
cucuacgccaaugaggccucaucugugc

SEQ ID NO: 398584 - RNA, 32 nt, Human
cucuacgcugugaauauugccuggugaucaag

SEQ ID NO: 398585 - RNA, 22 nt, Human
cucuacggaauucccuguauua

SEQ ID NO: 398586 - RNA, 32 nt, Human
cucuacgggaaagagagguaggagaggcugcg

SEQ ID NO: 398587 - RNA, 32 nt, Human
cucuacgucucugugcagaaccugagccgucc

SEQ ID NO: 398588 - RNA, 32 nt, Human
cucuacguugcccaggcuggucucgaacuccu

SEQ ID NO: 398589 - RNA, 32 nt, Human
cucuacuaaaaacacaaaaauuagcuaggcau

SEQ ID NO: 398590 - RNA, 32 nt, Human
cucuacuaaaaacacaaaaauuagcugagcau

SEQ ID NO: 398591 - RNA, 32 nt, Human
cucuacuaaaaacacaaaaauuagcugggcau

SEQ ID NO: 398592 - RNA, 32 nt, Human
cucuacuaaaaacacaaaaauuagcugggcgu

SEQ ID NO: 398593 - RNA, 32 nt, Human
cucuacuaaaaacacaaaaauuagcugggugu

SEQ ID NO: 398594 - RNA, 32 nt, Human
cucuacuaaaaacacaaaaauuaucugggcau

SEQ ID NO: 398595 - RNA, 32 nt, Human
cucuacuaaaaacacaaauuagccaggcgugg

SEQ ID NO: 398596 - RNA, 32 nt, Human
cucuacuaaaaacagaaaauuauccgggcgug

SEQ ID NO: 398597 - RNA, 32 nt, Human
cucuacuaaaaacauaaaaauuagcugggggu

SEQ ID NO: 398598 - RNA, 32 nt, Human
cucuacuaaaaacgcaaaauuagccgggcgug

SEQ ID NO: 398599 - RNA, 19 nt, Human
cucuacuaaaaauacaaaa

SEQ ID NO: 398600 - RNA, 32 nt, Human
cucuacuaaaaauacaaaaacuaacugggcgu

SEQ ID NO: 398601 - RNA, 32 nt, Human
cucuacuaaaaauacaaaaacuagccuggcaa

SEQ ID NO: 398602 - RNA, 32 nt, Human
cucuacuaaaaauacaaaaacuagcugggcau

SEQ ID NO: 398603 - RNA, 32 nt, Human
cucuacuaaaaauacaaaaacuuagccgggca

SEQ ID NO: 398604 - RNA, 32 nt, Human
cucuacuaaaaauacaaaaacuuagcugggug

SEQ ID NO: 398605 - RNA, 32 nt, Human
cucuacuaaaaauacaaaaagccagguguggu

SEQ ID NO: 398606 - RNA, 32 nt, Human
cucuacuaaaaauacaaaaaguagcugaaugu

SEQ ID NO: 398607 - RNA, 32 nt, Human
cucuacuaaaaauacaaaaaguuagcugggca

SEQ ID NO: 398608 - RNA, 32 nt, Human
cucuacuaaaaauacaaaaaucagcugggcau

SEQ ID NO: 398609 - RNA, 32 nt, Human
cucuacuaaaaauacaaaaaugagcuaggcau

SEQ ID NO: 398610 - RNA, 32 nt, Human
cucuacuaaaaauacaaaaaugagcugggcau

SEQ ID NO: 398611 - RNA, 32 nt, Human
cucuacuaaaaauacaaaaaugagcugggcuu

SEQ ID NO: 398612 - RNA, 32 nt, Human
cucuacuaaaaauacaaaaaugagcugggugu

SEQ ID NO: 398613 - RNA, 32 nt, Human
cucuacuaaaaauacaaaaauuaacagcagag

SEQ ID NO: 398614 - RNA, 32 nt, Human
cucuacuaaaaauacaaaaauuaaccaggcuu

SEQ ID NO: 398615 - RNA, 32 nt, Human
cucuacuaaaaauacaaaaauuaaccaguugu

SEQ ID NO: 398616 - RNA, 32 nt, Human
cucuacuaaaaauacaaaaauuaacugggcgu

SEQ ID NO: 398617 - RNA, 32 nt, Human
cucuacuaaaaauacaaaaauuaacugggugc

SEQ ID NO: 398618 - RNA, 32 nt, Human
cucuacuaaaaauacaaaaauuaacugggugu

SEQ ID NO: 398619 - RNA, 32 nt, Human
cucuacuaaaaauacaaaaauuaccugggcgu

SEQ ID NO: 398620 - RNA, 32 nt, Human
cucuacuaaaaauacaaaaauuagaugggugu

SEQ ID NO: 398621 - RNA, 32 nt, Human
cucuacuaaaaauacaaaaauuagcagagcau

SEQ ID NO: 398622 - RNA, 32 nt, Human
cucuacuaaaaauacaaaaauuagcagggcau

SEQ ID NO: 398623 - RNA, 32 nt, Human
cucuacuaaaaauacaaaaauuagccaagugc

SEQ ID NO: 398624 - RNA, 32 nt, Human
cucuacuaaaaauacaaaaauuagccaagugu

SEQ ID NO: 398625 - RNA, 32 nt, Human
cucuacuaaaaauacaaaaauuagccagacgu

SEQ ID NO: 398626 - RNA, 32 nt, Human
cucuacuaaaaauacaaaaauuagccaggacu

SEQ ID NO: 398627 - RNA, 32 nt, Human
cucuacuaaaaauacaaaaauuagccaggcac

SEQ ID NO: 398628 - RNA, 32 nt, Human
cucuacuaaaaauacaaaaauuagccaggcau

SEQ ID NO: 398629 - RNA, 32 nt, Human
cucuacuaaaaauacaaaaauuagccaggcgu

SEQ ID NO: 398630 - RNA, 32 nt, Human
cucuacuaaaaauacaaaaauuagccaggcuu

SEQ ID NO: 398631 - RNA, 32 nt, Human
cucuacuaaaaauacaaaaauuagccaggggu

SEQ ID NO: 398632 - RNA, 32 nt, Human
cucuacuaaaaauacaaaaauuagccagguau

SEQ ID NO: 398633 - RNA, 32 nt, Human
cucuacuaaaaauacaaaaauuagccaggugg

SEQ ID NO: 398634 - RNA, 32 nt, Human
cucuacuaaaaauacaaaaauuagccaggugu

SEQ ID NO: 398635 - RNA, 32 nt, Human
cucuacuaaaaauacaaaaauuagccagucac

SEQ ID NO: 398636 - RNA, 32 nt, Human
cucuacuaaaaauacaaaaauuagccaugcau

SEQ ID NO: 398637 - RNA, 32 nt, Human
cucuacuaaaaauacaaaaauuagccaugcgu

SEQ ID NO: 398638 - RNA, 32 nt, Human
cucuacuaaaaauacaaaaauuagcccgacau

SEQ ID NO: 398639 - RNA, 32 nt, Human
cucuacuaaaaauacaaaaauuagcccggcau

SEQ ID NO: 398640 - RNA, 32 nt, Human
cucuacuaaaaauacaaaaauuagcccggcgu

SEQ ID NO: 398641 - RNA, 32 nt, Human
cucuacuaaaaauacaaaaauuagcccggugu

SEQ ID NO: 398642 - RNA, 32 nt, Human
cucuacuaaaaauacaaaaauuagccgacaug

SEQ ID NO: 398643 - RNA, 32 nt, Human
cucuacuaaaaauacaaaaauuagccgagcau

SEQ ID NO: 398644 - RNA, 32 nt, Human
cucuacuaaaaauacaaaaauuagccgagcgu

SEQ ID NO: 398645 - RNA, 32 nt, Human
cucuacuaaaaauacaaaaauuagccgagugu

SEQ ID NO: 398646 - RNA, 32 nt, Human
cucuacuaaaaauacaaaaauuagccggacgc

SEQ ID NO: 398647 - RNA, 32 nt, Human
cucuacuaaaaauacaaaaauuagccggacgu

SEQ ID NO: 398648 - RNA, 32 nt, Human
cucuacuaaaaauacaaaaauuagccggcagg

SEQ ID NO: 398649 - RNA, 32 nt, Human
cucuacuaaaaauacaaaaauuagccgggcau

SEQ ID NO: 398650 - RNA, 32 nt, Human
cucuacuaaaaauacaaaaauuagccgggccu

SEQ ID NO: 398651 - RNA, 32 nt, Human
cucuacuaaaaauacaaaaauuagccgggcgu

SEQ ID NO: 398652 - RNA, 32 nt, Human
cucuacuaaaaauacaaaaauuagccggguag

SEQ ID NO: 398653 - RNA, 32 nt, Human
cucuacuaaaaauacaaaaauuagccgggugu

SEQ ID NO: 398654 - RNA, 32 nt, Human
cucuacuaaaaauacaaaaauuagccgguggu

SEQ ID NO: 398655 - RNA, 32 nt, Human
cucuacuaaaaauacaaaaauuagccgugcau

SEQ ID NO: 398656 - RNA, 32 nt, Human
cucuacuaaaaauacaaaaauuagccuggcau

SEQ ID NO: 398657 - RNA, 32 nt, Human
cucuacuaaaaauacaaaaauuagccuggcgu

SEQ ID NO: 398658 - RNA, 32 nt, Human
cucuacuaaaaauacaaaaauuagccuggggu

SEQ ID NO: 398659 - RNA, 32 nt, Human
cucuacuaaaaauacaaaaauuagccuggugu

SEQ ID NO: 398660 - RNA, 32 nt, Human
cucuacuaaaaauacaaaaauuagcggccggg

SEQ ID NO: 398661 - RNA, 32 nt, Human
cucuacuaaaaauacaaaaauuagcgggcgua

SEQ ID NO: 398662 - RNA, 32 nt, Human
cucuacuaaaaauacaaaaauuagcggggcgg

SEQ ID NO: 398663 - RNA, 32 nt, Human
cucuacuaaaaauacaaaaauuagcuaggcau

SEQ ID NO: 398664 - RNA, 32 nt, Human
cucuacuaaaaauacaaaaauuagcuaggcgg

SEQ ID NO: 398665 - RNA, 32 nt, Human
cucuacuaaaaauacaaaaauuagcuaggcgu

SEQ ID NO: 398666 - RNA, 32 nt, Human
cucuacuaaaaauacaaaaauuagcuagguau

SEQ ID NO: 398667 - RNA, 32 nt, Human
cucuacuaaaaauacaaaaauuagcugagcau

SEQ ID NO: 398668 - RNA, 32 nt, Human
cucuacuaaaaauacaaaaauuagcugagcuc

SEQ ID NO: 398669 - RNA, 32 nt, Human
cucuacuaaaaauacaaaaauuagcugaucau

SEQ ID NO: 398670 - RNA, 32 nt, Human
cucuacuaaaaauacaaaaauuagcugcacau

SEQ ID NO: 398671 - RNA, 32 nt, Human
cucuacuaaaaauacaaaaauuagcuggacau

SEQ ID NO: 398672 - RNA, 32 nt, Human
cucuacuaaaaauacaaaaauuagcuggacgu

SEQ ID NO: 398673 - RNA, 32 nt, Human
cucuacuaaaaauacaaaaauuagcuggaugu

SEQ ID NO: 398674 - RNA, 29 nt, Human
cucuacuaaaaauacaaaaauuagcuggg

SEQ ID NO: 398675 - RNA, 32 nt, Human
cucuacuaaaaauacaaaaauuagcugggcac

SEQ ID NO: 398676 - RNA, 32 nt, Human
cucuacuaaaaauacaaaaauuagcugggcau

SEQ ID NO: 398677 - RNA, 32 nt, Human
cucuacuaaaaauacaaaaauuagcugggcgc

SEQ ID NO: 398678 - RNA, 32 nt, Human
cucuacuaaaaauacaaaaauuagcugggcgg

SEQ ID NO: 398679 - RNA, 32 nt, Human
cucuacuaaaaauacaaaaauuagcugggcgu

SEQ ID NO: 398680 - RNA, 32 nt, Human
cucuacuaaaaauacaaaaauuagcugggggu

SEQ ID NO: 398681 - RNA, 32 nt, Human
cucuacuaaaaauacaaaaauuagcugggugc

SEQ ID NO: 398682 - RNA, 32 nt, Human
cucuacuaaaaauacaaaaauuagcugggugu

SEQ ID NO: 398683 - RNA, 32 nt, Human
cucuacuaaaaauacaaaaauuagcugugcau

SEQ ID NO: 398684 - RNA, 32 nt, Human
cucuacuaaaaauacaaaaauuagcuuggugu

SEQ ID NO: 398685 - RNA, 32 nt, Human
cucuacuaaaaauacaaaaauuaggcauggug

SEQ ID NO: 398686 - RNA, 32 nt, Human
cucuacuaaaaauacaaaaauuaggugggucu

SEQ ID NO: 398687 - RNA, 32 nt, Human
cucuacuaaaaauacaaaaauuagucaggcgc

SEQ ID NO: 398688 - RNA, 32 nt, Human
cucuacuaaaaauacaaaaauuagucaggcgu

SEQ ID NO: 398689 - RNA, 32 nt, Human
cucuacuaaaaauacaaaaauuagucaggugu

SEQ ID NO: 398690 - RNA, 32 nt, Human
cucuacuaaaaauacaaaaauuagucgggcgu

SEQ ID NO: 398691 - RNA, 32 nt, Human
cucuacuaaaaauacaaaaauuaguucggcau

SEQ ID NO: 398692 - RNA, 32 nt, Human
cucuacuaaaaauacaaaaauuaguugggcau

SEQ ID NO: 398693 - RNA, 32 nt, Human
cucuacuaaaaauacaaaaauuaucugggcac

SEQ ID NO: 398694 - RNA, 32 nt, Human
cucuacuaaaaauacaaaaauuaucugggcau

SEQ ID NO: 398695 - RNA, 32 nt, Human
cucuacuaaaaauacaaaaauuaucugggcuu

SEQ ID NO: 398696 - RNA, 32 nt, Human
cucuacuaaaaauacaaaaauuaucugggugu

SEQ ID NO: 398697 - RNA, 32 nt, Human
cucuacuaaaaauacaaaaauuggccgggugu

SEQ ID NO: 398698 - RNA, 32 nt, Human
cucuacuaaaaauacaaaaauuggcugggcau

SEQ ID NO: 398699 - RNA, 32 nt, Human
cucuacuaaaaauacaaaaauuggucgggcau

SEQ ID NO: 398700 - RNA, 32 nt, Human
cucuacuaaaaauacaaaaauuguccgggugu

SEQ ID NO: 398701 - RNA, 32 nt, Human
cucuacuaaaaauacaaaaauuuagccaggca

SEQ ID NO: 398702 - RNA, 32 nt, Human
cucuacuaaaaauacaaaaauuugcugggcau

SEQ ID NO: 398703 - RNA, 32 nt, Human
cucuacuaaaaauacaaaaauuugcugggcuu

SEQ ID NO: 398704 - RNA, 32 nt, Human
cucuacuaaaaauacaaaacaauuagccgggc

SEQ ID NO: 398705 - RNA, 32 nt, Human
cucuacuaaaaauacaaaacauuagccgggcg

SEQ ID NO: 398706 - RNA, 32 nt, Human
cucuacuaaaaauacaaaaccuagcugggcgu

SEQ ID NO: 398707 - RNA, 32 nt, Human
cucuacuaaaaauacaaaacuagcugggcauu

SEQ ID NO: 398708 - RNA, 32 nt, Human
cucuacuaaaaauacaaaagaaaauuagccgg

SEQ ID NO: 398709 - RNA, 32 nt, Human
cucuacuaaaaauacaaaaguuagcagggcgu

SEQ ID NO: 398710 - RNA, 32 nt, Human
cucuacuaaaaauacaaaaguuagccgggugu

SEQ ID NO: 398711 - RNA, 32 nt, Human
cucuacuaaaaauacaaaaguuagcuggggcu

SEQ ID NO: 398712 - RNA, 32 nt, Human
cucuacuaaaaauacaaaaguuagcugggugu

SEQ ID NO: 398713 - RNA, 32 nt, Human
cucuacuaaaaauacaaaauauuagcugggcg

SEQ ID NO: 398714 - RNA, 32 nt, Human
cucuacuaaaaauacaaaauuaacugggcgug

SEQ ID NO: 398715 - RNA, 32 nt, Human
cucuacuaaaaauacaaaauuaacugggugcg

SEQ ID NO: 398716 - RNA, 32 nt, Human
cucuacuaaaaauacaaaauuaccugggcgug

SEQ ID NO: 398717 - RNA, 32 nt, Human
cucuacuaaaaauacaaaauuagcugggcaug

SEQ ID NO: 398718 - RNA, 32 nt, Human
cucuacuaaaaauacaaaauuagcugggcgug

SEQ ID NO: 398719 - RNA, 32 nt, Human
cucuacuaaaaauacaaaauuagcuggguggg

SEQ ID NO: 398720 - RNA, 32 nt, Human
cucuacuaaaaauacaaaauuagcugggugug

SEQ ID NO: 398721 - RNA, 32 nt, Human
cucuacuaaaaauacaaaauuagucaggcauu

SEQ ID NO: 398722 - RNA, 32 nt, Human
cucuacuaaaaauacaaaauuagucgggcgua

SEQ ID NO: 398723 - RNA, 32 nt, Human
cucuacuaaaaauacaaaauuagucggguaug

SEQ ID NO: 398724 - RNA, 32 nt, Human
cucuacuaaaaauacaaaauuuaucugggugu

SEQ ID NO: 398725 - RNA, 32 nt, Human
cucuacuaaaaauacaaacaaaauuagcuggg

SEQ ID NO: 398726 - RNA, 32 nt, Human
cucuacuaaaaauacaaacaaauuagccgggc

SEQ ID NO: 398727 - RNA, 32 nt, Human
cucuacuaaaaauacaaacaauuaacugagca

SEQ ID NO: 398728 - RNA, 32 nt, Human
cucuacuaaaaauacaaacuuggcugggcuua

SEQ ID NO: 398729 - RNA, 32 nt, Human
cucuacuaaaaauacaaauauuagcuggauau

SEQ ID NO: 398730 - RNA, 32 nt, Human
cucuacuaaaaauacaagaauuagccaggugu

SEQ ID NO: 398731 - RNA, 32 nt, Human
cucuacuaaaaauacaagaauuagcugggcgu

SEQ ID NO: 398732 - RNA, 32 nt, Human
cucuacuaaaaauacaagaauuagcugggugu

SEQ ID NO: 398733 - RNA, 32 nt, Human
cucuacuaaaaauacaaggauuagcugggcau

SEQ ID NO: 398734 - RNA, 32 nt, Human
cucuacuaaaaauacaauaaauuagcugggca

SEQ ID NO: 398735 - RNA, 32 nt, Human
cucuacuaaaaauacaauaauuagcugggcgu

SEQ ID NO: 398736 - RNA, 32 nt, Human
cucuacuaaaaauacacaaaauuagcugggcg

SEQ ID NO: 398737 - RNA, 32 nt, Human
cucuacuaaaaauacacaaauuagcuaggcau

SEQ ID NO: 398738 - RNA, 32 nt, Human
cucuacuaaaaauacagaaaauuagcugggcg

SEQ ID NO: 398739 - RNA, 32 nt, Human
cucuacuaaaaauacagaaauuagccgggcau

SEQ ID NO: 398740 - RNA, 32 nt, Human
cucuacuaaaaauacagaaauuagccgggcgu

SEQ ID NO: 398741 - RNA, 32 nt, Human
cucuacuaaaaauacagaaauuagccggucau

SEQ ID NO: 398742 - RNA, 32 nt, Human
cucuacuaaaaauacagaaauuagcugggugu

SEQ ID NO: 398743 - RNA, 32 nt, Human
cucuacuaaaaauacagaaauucacagggugu

SEQ ID NO: 398744 - RNA, 32 nt, Human
cucuacuaaaaauacagaauuagcugagugug

SEQ ID NO: 398745 - RNA, 32 nt, Human
cucuacuaaaaauacagaauuagucaggcgug

SEQ ID NO: 398746 - RNA, 32 nt, Human
cucuacuaaaaauacagcaaauuagcugggcg

SEQ ID NO: 398747 - RNA, 32 nt, Human
cucuacuaaaaauaccaaaaauuagccgagcg

SEQ ID NO: 398748 - RNA, 32 nt, Human
cucuacuaaaaauaccaaaaauuagccgggcg

SEQ ID NO: 398749 - RNA, 32 nt, Human
cucuacuaaaaauaccaaaauuagcugggcau

SEQ ID NO: 398750 - RNA, 32 nt, Human
cucuacuaaaaauacgaaaauuagccuggcgu

SEQ ID NO: 398751 - RNA, 32 nt, Human
cucuacuaaaaauacgaaaauuagcugggugu

SEQ ID NO: 398752 - RNA, 32 nt, Human
cucuacuaaaaauacgaaacuuagcugggcgu

SEQ ID NO: 398753 - RNA, 32 nt, Human
cucuacuaaaaauacgaaaguuagucgggcau

SEQ ID NO: 398754 - RNA, 32 nt, Human
cucuacuaaaaauagaaaaauuaagcugggca

SEQ ID NO: 398755 - RNA, 32 nt, Human
cucuacuaaaaauagaaaaauuagcuaggcau

SEQ ID NO: 398756 - RNA, 32 nt, Human
cucuacuaaaaauagaaaaauuagcuggccau

SEQ ID NO: 398757 - RNA, 32 nt, Human
cucuacuaaaaauagaaaaauuagcugggcau

SEQ ID NO: 398758 - RNA, 32 nt, Human
cucuacuaaaaauauaaaaauuagcagggcau

SEQ ID NO: 398759 - RNA, 32 nt, Human
cucuacuaaaaauauaaaaauuagccaaguuu

SEQ ID NO: 398760 - RNA, 32 nt, Human
cucuacuaaaaauauaaaaauuagccaggcau

SEQ ID NO: 398761 - RNA, 32 nt, Human
cucuacuaaaaauauaaaaauuagccaggcgu

SEQ ID NO: 398762 - RNA, 32 nt, Human
cucuacuaaaaauauaaaaauuagccgggcau

SEQ ID NO: 398763 - RNA, 32 nt, Human
cucuacuaaaaauauaaaaauuagccgggcgu

SEQ ID NO: 398764 - RNA, 32 nt, Human
cucuacuaaaaauauaaaaauuagcugggugu

SEQ ID NO: 398765 - RNA, 32 nt, Human
cucuacuaaaaauauaaaaauuagucgggcau

SEQ ID NO: 398766 - RNA, 32 nt, Human
cucuacuaaaaauaucaaaauuagcugggcac

SEQ ID NO: 398767 - RNA, 32 nt, Human
cucuacuaaaaauaugaaaauuagcugggcau

SEQ ID NO: 398768 - RNA, 32 nt, Human
cucuacuaaaaauaugaaaauuagcugggcuu

SEQ ID NO: 398769 - RNA, 32 nt, Human
cucuacuaaaaaugcaaaaauuagccaggcgu

SEQ ID NO: 398770 - RNA, 32 nt, Human
cucuacuaaaaaugcaaaaauuagccgggcgu

SEQ ID NO: 398771 - RNA, 32 nt, Human
cucuacuaaaaaugcaaaaauuagcuggacgu

SEQ ID NO: 398772 - RNA, 32 nt, Human
cucuacuaaaaaugcaaaaauuagcugggugu

SEQ ID NO: 398773 - RNA, 32 nt, Human
cucuacuaaaaaugcaaaaauuaguccggcgu

SEQ ID NO: 398774 - RNA, 32 nt, Human
cucuacuaaaaaugcaaacauuagcugggcau

SEQ ID NO: 398775 - RNA, 32 nt, Human
cucuacuaaaaauuuaaaaauuagcugggcau

SEQ ID NO: 398776 - RNA, 32 nt, Human
cucuacuaaaaauuugaaauuagccaggcaug

SEQ ID NO: 398777 - RNA, 32 nt, Human
cucuacuaaaacaaauacaaaacuucgcuggg

SEQ ID NO: 398778 - RNA, 32 nt, Human
cucuacuaaaacuacaaaaauuaacugggugu

SEQ ID NO: 398779 - RNA, 32 nt, Human
cucuacuaaaaguacaaaaauuagccaggcgg

SEQ ID NO: 398780 - RNA, 32 nt, Human
cucuacuaaaaguacaaaaauuagccaggcgu

SEQ ID NO: 398781 - RNA, 32 nt, Human
cucuacuaaaaguacaaaaauuagccaggugg

SEQ ID NO: 398782 - RNA, 32 nt, Human
cucuacuaaaaguacaaaaauuagccgggcgu

SEQ ID NO: 398783 - RNA, 32 nt, Human
cucuacuaaaaguacaaaaauuagcuggaugu

SEQ ID NO: 398784 - RNA, 32 nt, Human
cucuacuaaaaguacaaaaauuagcuggcgug

SEQ ID NO: 398785 - RNA, 32 nt, Human
cucuacuaaaaguacaaaaauuagcugggcau

SEQ ID NO: 398786 - RNA, 32 nt, Human
cucuacuaaaaguacaaaaauuagucagguau

SEQ ID NO: 398787 - RNA, 32 nt, Human
cucuacuaaaaguacaaaaguuagucaggcau

SEQ ID NO: 398788 - RNA, 32 nt, Human
cucuacuaaaauacaaaaauuagccagacaug

SEQ ID NO: 398789 - RNA, 32 nt, Human
cucuacuaaaauacaaaaauuagccgggcgua

SEQ ID NO: 398790 - RNA, 32 nt, Human
cucuacuaaaauacaaaauuagccaggcgugg

SEQ ID NO: 398791 - RNA, 32 nt, Human
cucuacuaaaauacacaaauuagcuaggcauu

SEQ ID NO: 398792 - RNA, 32 nt, Human
cucuacuaaaauacauaaauuagccgggugug

SEQ ID NO: 398793 - RNA, 32 nt, Human
cucuacuaaacauacaaaaauuagcuaggcgu

SEQ ID NO: 398794 - RNA, 32 nt, Human
cucuacuaaacauacaaaauuagcugggcaug

SEQ ID NO: 398795 - RNA, 32 nt, Human
cucuacuaaacaugcaaaaauuaccugggcau

SEQ ID NO: 398796 - RNA, 32 nt, Human
cucuacuaaacaugcaaaaauuagcugggcac

SEQ ID NO: 398797 - RNA, 32 nt, Human
cucuacuaaagauacaaaaagauuagcugggc

SEQ ID NO: 398798 - RNA, 32 nt, Human
cucuacuaaagauacaaaaauuagccgggcau

SEQ ID NO: 398799 - RNA, 32 nt, Human
cucuacuaaagauacaaaaauuagcugggugu

SEQ ID NO: 398800 - RNA, 32 nt, Human
cucuacuaaagauacaaaaauuugcugagcgu

SEQ ID NO: 398801 - RNA, 32 nt, Human
cucuacuaaagauauaaaaauuagcuggaugu

SEQ ID NO: 398802 - RNA, 32 nt, Human
cucuacuaaauacaaaaauuagcugggcgugg

SEQ ID NO: 398803 - RNA, 32 nt, Human
cucuacuaaauacagaaaauuagccaggcaug

SEQ ID NO: 398804 - RNA, 32 nt, Human
cucuacuaaauauacaaaaauuagcugggugu

SEQ ID NO: 398805 - RNA, 32 nt, Human
cucuacuaaauauacaaaaauuaguugggugu

SEQ ID NO: 398806 - RNA, 32 nt, Human
cucuacuaacaauauaaaaauuagcugggagu

SEQ ID NO: 398807 - RNA, 32 nt, Human
cucuacuaagaauacaaaaauuagccaggagu

SEQ ID NO: 398808 - RNA, 32 nt, Human
cucuacuaagaauacaaaaauuagccgggugu

SEQ ID NO: 398809 - RNA, 32 nt, Human
cucuacuaagaauacaaaauuagcugggcaug

SEQ ID NO: 398810 - RNA, 32 nt, Human
cucuacuaagaauauaaaaauuagcuggguau

SEQ ID NO: 398811 - RNA, 32 nt, Human
cucuacuaauaauacaaaaauuagcugggcau

SEQ ID NO: 398812 - RNA, 32 nt, Human
cucuacuacaaauacaaaaauuagcuggacgu

SEQ ID NO: 398813 - RNA, 32 nt, Human
cucuacuacaaauacaaaaauuagcugggugu

SEQ ID NO: 398814 - RNA, 32 nt, Human
cucuacuacaaauacgaaaauuagcugggcgu

SEQ ID NO: 398815 - RNA, 32 nt, Human
cucuacuacaugugacuggcaguauuaagugu

SEQ ID NO: 398816 - RNA, 32 nt, Human
cucuacuagaaauacaaaaauuagccaggugu

SEQ ID NO: 398817 - RNA, 32 nt, Human
cucuacuagaaauacaaaaauuagcuggauau

SEQ ID NO: 398818 - RNA, 32 nt, Human
cucuacuagaaauacaaaacaauuagcugggu

SEQ ID NO: 398819 - RNA, 32 nt, Human
cucuacuauuaagggacgacugccuucaagca

SEQ ID NO: 398820 - RNA, 32 nt, Human
cucuacucaagagcuccgucuccgucucgccc

SEQ ID NO: 398821 - RNA, 32 nt, Human
cucuacucacauauaauaaauacuaucuuaua

SEQ ID NO: 398822 - RNA, 32 nt, Human
cucuacucacaucuuuuaaucuugaagacuag

SEQ ID NO: 398823 - RNA, 32 nt, Human
cucuacucacucacuucauuguccucaccauc

SEQ ID NO: 398824 - RNA, 24 nt, Human
cucuacucacugcaaccuccaccu

SEQ ID NO: 398825 - RNA, 32 nt, Human
cucuacucacugcaaccuccaccucccggguu

SEQ ID NO: 398826 - RNA, 32 nt, Human
cucuacucacugcagccucaaucuccuggucu

SEQ ID NO: 398827 - RNA, 32 nt, Human
cucuacuccagcccuucucccucccucccuuc

SEQ ID NO: 398828 - RNA, 32 nt, Human
cucuacucccagcgcuggcuccaggcuccuca

SEQ ID NO: 398829 - RNA, 32 nt, Human
cucuacucccccagcuucuugcucuugacccu

SEQ ID NO: 398830 - RNA, 32 nt, Human
cucuacucccuagaaugucugucucccaagac

SEQ ID NO: 398831 - RNA, 32 nt, Human
cucuacucccugagcuuccccaccccaagcgc

SEQ ID NO: 398832 - RNA, 32 nt, Human
cucuacucuccucugccaugaggccauuuuca

SEQ ID NO: 398833 - RNA, 32 nt, Human
cucuacucuggccaacaacuuuguucucaucg

SEQ ID NO: 398834 - RNA, 32 nt, Human
cucuacugaaaauacaaaaauuagcuggaugu

SEQ ID NO: 398835 - RNA, 32 nt, Human
cucuacugaaaauacaaaaauuagcugggcgu

SEQ ID NO: 398836 - RNA, 32 nt, Human
cucuacugaaaauacaaaaauuagcugggugu

SEQ ID NO: 398837 - RNA, 32 nt, Human
cucuacugaaaauacaaaaauuagucaggugc

SEQ ID NO: 398838 - RNA, 32 nt, Human
cucuacugaaaauacaagaaauuagcugggac

SEQ ID NO: 398839 - RNA, 32 nt, Human
cucuacugaaaauacaauaauuagcugggcgu

SEQ ID NO: 398840 - RNA, 32 nt, Human
cucuacugaaaguacaaaaauuagcugggugu

SEQ ID NO: 398841 - RNA, 32 nt, Human
cucuacugagcaauuccuauuccaaccacgcc

SEQ ID NO: 398842 - RNA, 32 nt, Human
cucuacugagcuguaacaaagccucuuuaaau

SEQ ID NO: 398843 - RNA, 32 nt, Human
cucuacugcccagccccuccugauuucuuugg

SEQ ID NO: 398844 - RNA, 32 nt, Human
cucuacugcccuggcccguucauccuguguau

SEQ ID NO: 398845 - RNA, 32 nt, Human
cucuacugccuccugaauacacaugaaccccu

SEQ ID NO: 398846 - RNA, 23 nt, Human
cucuacugccuuguuccauauua

SEQ ID NO: 398847 - RNA, 32 nt, Human
cucuacugcucccucccucucuugccucuuaa

SEQ ID NO: 398848 - RNA, 32 nt, Human
cucuacuggcccagggcuucagcucuugguua

SEQ ID NO: 398849 - RNA, 32 nt, Human
cucuacuggcugucccugagccucuaguuccu

SEQ ID NO: 398850 - RNA, 32 nt, Human
cucuacugggaauccuccucaggcagguccca

SEQ ID NO: 398851 - RNA, 32 nt, Human
cucuacuggggcagccuggcugugggagguga

SEQ ID NO: 398852 - RNA, 32 nt, Human
cucuacugucucaaaauuuuguuuuaaaauaa

SEQ ID NO: 398853 - RNA, 32 nt, Human
cucuacugugaaggagcagggagcugccgagg

SEQ ID NO: 398854 - RNA, 32 nt, Human
cucuacuguucuuucuuuaauaguggcaaaug

SEQ ID NO: 398855 - RNA, 32 nt, Human
cucuacuguuugggacaguaagccaaauaccu

SEQ ID NO: 398856 - RNA, 32 nt, Human
cucuacuuaaaauacaaauauuagcugggcau

SEQ ID NO: 398857 - RNA, 32 nt, Human
cucuacuuaagaugcgaaaauuagccuggugu

SEQ ID NO: 398858 - RNA, 21 nt, Human
cucuacuuggccuauuugcca

SEQ ID NO: 398859 - RNA, 32 nt, Human
cucuacuuugggcugcgguuucaggcuuuuug

SEQ ID NO: 398860 - RNA, 32 nt, Human
cucuagaaauuuuucagaugcuucugggagac

SEQ ID NO: 398861 - RNA, 32 nt, Human
cucuagaacacgaggaaaaacagggucuugua

SEQ ID NO: 398862 - RNA, 32 nt, Human
cucuagaacccccacuuccaggcacucucagu

SEQ ID NO: 398863 - RNA, 32 nt, Human
cucuagaaggcaaaauuuaccugcugacaauu

SEQ ID NO: 398864 - RNA, 32 nt, Human
cucuagacaaguacacaggcccugccacccug

SEQ ID NO: 398865 - RNA, 32 nt, Human
cucuagacacugccacacagggucugcaaggu

SEQ ID NO: 398866 - RNA, 32 nt, Human
cucuagacuagucugggcaacauagugaggcc

SEQ ID NO: 398867 - RNA, 32 nt, Human
cucuagagaaugcugugcuguggaugacugca

SEQ ID NO: 398868 - RNA, 32 nt, Human
cucuagagccagcacaggucacugccugaccu

SEQ ID NO: 398869 - RNA, 21 nt, Human
cucuagaggcaagccaggcca

SEQ ID NO: 398870 - RNA, 32 nt, Human
cucuagaggcugaggugggaggaucacuugag

SEQ ID NO: 398871 - RNA, 32 nt, Human
cucuagaguagcugggauuacaggcgcaugcc

SEQ ID NO: 398872 - RNA, 23 nt, Human
cucuagagucugggcaaaauguu

SEQ ID NO: 398873 - RNA, 21 nt, Human
cucuagaucucuuuugugcug

SEQ ID NO: 398874 - RNA, 32 nt, Human
cucuagcaaaaauacaaaaauuagucaggagu

SEQ ID NO: 398875 - RNA, 32 nt, Human
cucuagcaaauacuucuuucuccuugcuugcc

SEQ ID NO: 398876 - RNA, 32 nt, Human
cucuagcacgaguucaauaugaucugggaauu

SEQ ID NO: 398877 - RNA, 32 nt, Human
cucuagcaucagugccugcuccugccugcccu

SEQ ID NO: 398878 - RNA, 32 nt, Human
cucuagcauggccccagcauucagccagucgg

SEQ ID NO: 398879 - RNA, 32 nt, Human
cucuagcauuuucauguuuaucuuuaauagca

SEQ ID NO: 398880 - RNA, 32 nt, Human
cucuagccaaaucacaccccagagccagaggc

SEQ ID NO: 398881 - RNA, 32 nt, Human
cucuagccagccagccccagauacuccucaga

SEQ ID NO: 398882 - RNA, 32 nt, Human
cucuagccaguggcccucugcagccacgggga

SEQ ID NO: 398883 - RNA, 32 nt, Human
cucuagccauucuuuauuuauagugggucugc

SEQ ID NO: 398884 - RNA, 24 nt, Human
cucuagcccaggcuggagugcugu

SEQ ID NO: 398885 - RNA, 32 nt, Human
cucuagcccuacuccuuugcccaagacagaaa

SEQ ID NO: 398886 - RNA, 20 nt, Human
cucuagcccucuaaggcugg

SEQ ID NO: 398887 - RNA, 18 nt, Human
cucuagccgccgcugccg

SEQ ID NO: 398888 - RNA, 32 nt, Human
cucuagccucuccuggaaaggccuggauaugg

SEQ ID NO: 398889 - RNA, 32 nt, Human
cucuagccucugaccuugcuguugacucugaa

SEQ ID NO: 398890 - RNA, 21 nt, Human
cucuagccugagcgacagagu

SEQ ID NO: 398891 - RNA, 19 nt, Human
cucuagccuggcaacagag

SEQ ID NO: 398892 - RNA, 32 nt, Human
cucuagccuggcaacagagcaagacuccgucu

SEQ ID NO: 398893 - RNA, 22 nt, Human
cucuagccugggcaacaagagc

SEQ ID NO: 398894 - RNA, 24 nt, Human
cucuagccugggcaacaagaguga

SEQ ID NO: 398895 - RNA, 20 nt, Human
cucuagccugggcaacagag

SEQ ID NO: 398896 - RNA, 21 nt, Human
cucuagccugggcaacagagc

SEQ ID NO: 398897 - RNA, 21 nt, Human
cucuagccugggcaacagagu

SEQ ID NO: 398898 - RNA, 20 nt, Human
cucuagccugggcgacagag

SEQ ID NO: 398899 - RNA, 21 nt, Human
cucuagccugggcgacagagu

SEQ ID NO: 398900 - RNA, 25 nt, Human
cucuagccugggugacagagcgaga

SEQ ID NO: 398901 - RNA, 32 nt, Human
cucuagccuguggccugcuccugguugaagaa

SEQ ID NO: 398902 - RNA, 32 nt, Human
cucuagcgaaacuguuuuccucucuauucaga

SEQ ID NO: 398903 - RNA, 32 nt, Human
cucuagcucacuguugccucgcugucugccag

SEQ ID NO: 398904 - RNA, 25 nt, Human
cucuagcugccuugucgccaucgca

SEQ ID NO: 398905 - RNA, 32 nt, Human
cucuagcugcuggugguucuuucacagacauu

SEQ ID NO: 398906 - RNA, 32 nt, Human
cucuagcugggagcuuggccucuggcuccauc

SEQ ID NO: 398907 - RNA, 32 nt, Human
cucuagcugggugagagggugucccuugucac

SEQ ID NO: 398908 - RNA, 32 nt, Human
cucuagcuugcccagcaacuugcuuuccugug

SEQ ID NO: 398909 - RNA, 32 nt, Human
cucuagcuuuuugccagaacaaaggaggguac

SEQ ID NO: 398910 - RNA, 32 nt, Human
cucuaggacauaaauuagaggucuccaaaauc

SEQ ID NO: 398911 - RNA, 32 nt, Human
cucuaggagccccaauagcccaggagcuuggg

SEQ ID NO: 398912 - RNA, 32 nt, Human
cucuaggagccccaguagcccaggagcuuggg

SEQ ID NO: 398913 - RNA, 32 nt, Human
cucuaggaggccgaggagggcagaucaacuga

SEQ ID NO: 398914 - RNA, 32 nt, Human
cucuaggaggcgcccucaggagaggggcgggc

SEQ ID NO: 398915 - RNA, 32 nt, Human
cucuaggaggcucuggcucaaacagcaauagg

SEQ ID NO: 398916 - RNA, 26 nt, Human
cucuaggaggguuugggauaggaagc

SEQ ID NO: 398917 - RNA, 32 nt, Human
cucuaggauccaggcuccacagagcacaugac

SEQ ID NO: 398918 - RNA, 32 nt, Human
cucuaggaugucccucaccuggcagccaucug

SEQ ID NO: 398919 - RNA, 32 nt, Human
cucuaggcagaagaagcugggagggaggggga

SEQ ID NO: 398920 - RNA, 32 nt, Human
cucuaggcaggacugccaugcagugagcccuc

SEQ ID NO: 398921 - RNA, 32 nt, Human
cucuaggcaggcagggugcuccuggugucugc

SEQ ID NO: 398922 - RNA, 32 nt, Human
cucuaggccaucacuuuaauugaucucucuac

SEQ ID NO: 398923 - RNA, 32 nt, Human
cucuaggccauccccucuucuaccuccugcaa

SEQ ID NO: 398924 - RNA, 32 nt, Human
cucuaggccauggggagucccugaagacucga

SEQ ID NO: 398925 - RNA, 32 nt, Human
cucuaggcccccagccccacacugccuggggg

SEQ ID NO: 398926 - RNA, 32 nt, Human
cucuaggcggcucuggguaaguugucguucug

SEQ ID NO: 398927 - RNA, 32 nt, Human
cucuaggcucaagcgauccuccugccugagcc

SEQ ID NO: 398928 - RNA, 32 nt, Human
cucuaggcugccuggagggaaggaacaggccc

SEQ ID NO: 398929 - RNA, 32 nt, Human
cucuaggcugcgcgaaggaagaggguacgacg

SEQ ID NO: 398930 - RNA, 32 nt, Human
cucuaggcuucuccugcugaguccuggucuug

SEQ ID NO: 398931 - RNA, 32 nt, Human
cucuagggaacagcacugugagcaggggcugu

SEQ ID NO: 398932 - RNA, 32 nt, Human
cucuagggacaccuggugauuccuacacaagu

SEQ ID NO: 398933 - RNA, 32 nt, Human
cucuagggacacuggcagcuguggaaaugaau

SEQ ID NO: 398934 - RNA, 32 nt, Human
cucuagggaccccucgccccagccucauuccc

SEQ ID NO: 398935 - RNA, 32 nt, Human
cucuagggacuugaugguguugcuuggaaggc

SEQ ID NO: 398936 - RNA, 32 nt, Human
cucuagggagaguugcaggcagaggagauugg

SEQ ID NO: 398937 - RNA, 32 nt, Human
cucuagggagcacugugcccacucuuucuggg

SEQ ID NO: 398938 - RNA, 21 nt, Human
cucuagggcaacccagggcag

SEQ ID NO: 398939 - RNA, 32 nt, Human
cucuagggcauaauuuaugggcucagaaaggg

SEQ ID NO: 398940 - RNA, 32 nt, Human
cucuaggggagaauucauuucuggccuuuuca

SEQ ID NO: 398941 - RNA, 32 nt, Human
cucuaggggagagagcugcuagugagaugacu

SEQ ID NO: 398942 - RNA, 32 nt, Human
cucuaggggugaggaccuagcagucuguuuaa

SEQ ID NO: 398943 - RNA, 32 nt, Human
cucuaggggugcagcuuuggagcccagaggug

SEQ ID NO: 398944 - RNA, 32 nt, Human
cucuagggucuuggcagaauucugagcuugaa

SEQ ID NO: 398945 - RNA, 32 nt, Human
cucuagguacuaacucagcaguuuuucuguaa

SEQ ID NO: 398946 - RNA, 32 nt, Human
cucuaggucuccaugcauucuuccugcccuag

SEQ ID NO: 398947 - RNA, 32 nt, Human
cucuaggugaaaugagcggugguugagcccua

SEQ ID NO: 398948 - RNA, 32 nt, Human
cucuaggugaucugugaaaaugguucgcuauu

SEQ ID NO: 398949 - RNA, 20 nt, Human
cucuagguucaccuguguug

SEQ ID NO: 398950 - RNA, 19 nt, Human
cucuagguucuaggggugc

SEQ ID NO: 398951 - RNA, 32 nt, Human
cucuagguucuaggggugcaagccucugugug

SEQ ID NO: 398952 - RNA, 20 nt, Human
cucuagguucugggcaguug

SEQ ID NO: 398953 - RNA, 20 nt, Human
cucuagguuggugagugcug

SEQ ID NO: 398954 - RNA, 32 nt, Human
cucuaguaaaaauacaaaaauuagccaggcau

SEQ ID NO: 398955 - RNA, 32 nt, Human
cucuaguaaaaauacaaaaauuagcucagcau

SEQ ID NO: 398956 - RNA, 32 nt, Human
cucuaguaaaaauacaaaaauuagcugggcgu

SEQ ID NO: 398957 - RNA, 20 nt, Human
cucuaguaaaaauacaaaau

SEQ ID NO: 398958 - RNA, 32 nt, Human
cucuaguaaaaauacaaaauuuagucagacau

SEQ ID NO: 398959 - RNA, 32 nt, Human
cucuaguaggcaggccagguuagugaggaagg

SEQ ID NO: 398960 - RNA, 31 nt, Human
cucuaguagguggaaagguagguggagcagg

SEQ ID NO: 398961 - RNA, 32 nt, Human
cucuagucccagcuacuugggaggcuuaguca

SEQ ID NO: 398962 - RNA, 32 nt, Human
cucuagucccuuuaaacguuugccccuggcgu

SEQ ID NO: 398963 - RNA, 32 nt, Human
cucuagucuccaagccucuagcauagagcacu

SEQ ID NO: 398964 - RNA, 32 nt, Human
cucuagucuggggaacauaugagaccccugcc

SEQ ID NO: 398965 - RNA, 32 nt, Human
cucuagugaaaauacaaaaauuagccaggugu

SEQ ID NO: 398966 - RNA, 32 nt, Human
cucuagugcaggaggagaaggaggaggagcag

SEQ ID NO: 398967 - RNA, 21 nt, Human
cucuagugccuuucuagcaca

SEQ ID NO: 398968 - RNA, 32 nt, Human
cucuagugcuggguguggagugaggcaccacc

SEQ ID NO: 398969 - RNA, 31 nt, Human
cucuaguggguggaaacgggugguugccaug

SEQ ID NO: 398970 - RNA, 32 nt, Human
cucuaguguuugaguaaaggagacugaggaug

SEQ ID NO: 398971 - RNA, 32 nt, Human
cucuaguucccucauuccccgcgcccuucccg

SEQ ID NO: 398972 - RNA, 32 nt, Human
cucuaguuccucacucuuccuuuucagaaccu

SEQ ID NO: 398973 - RNA, 32 nt, Human
cucuaguugcccacacuagagugcaauggcgc

SEQ ID NO: 398974 - RNA, 32 nt, Human
cucuaguuuuccagacugcugguuuggguaac

SEQ ID NO: 398975 - RNA, 19 nt, Human
cucuaguuuuucuaacaua

SEQ ID NO: 398976 - RNA, 32 nt, Human
cucuauaaagcacuacacaagacuggauaauu

SEQ ID NO: 398977 - RNA, 32 nt, Human
cucuauaaccaccugcuucccacucagccugc

SEQ ID NO: 398978 - RNA, 32 nt, Human
cucuauacacuucaagacuuuacaggauuuuu

SEQ ID NO: 398979 - RNA, 32 nt, Human
cucuauacaucucuccccaacccuagguuccc

SEQ ID NO: 398980 - RNA, 32 nt, Human
cucuauacauuccagugccuagccaguuuguu

SEQ ID NO: 398981 - RNA, 32 nt, Human
cucuauaccuugccugugccuuaguguccucu

SEQ ID NO: 398982 - RNA, 32 nt, Human
cucuauagcuuaucuuggccccucucugugug

SEQ ID NO: 398983 - RNA, 32 nt, Human
cucuauagucucucuaggucauagcuuucaug

SEQ ID NO: 398984 - RNA, 32 nt, Human
cucuauaguuaaaaggcuuccucaucuauauu

SEQ ID NO: 398985 - RNA, 32 nt, Human
cucuauauacauguacacaaagccacacaguu

SEQ ID NO: 398986 - RNA, 32 nt, Human
cucuauauacauguuuuauauaccucauucug

SEQ ID NO: 398987 - RNA, 19 nt, Human
cucuauauacuucauguca

SEQ ID NO: 398988 - RNA, 32 nt, Human
cucuauaucccuuuuaucgguggacccaacaa

SEQ ID NO: 398989 - RNA, 32 nt, Human
cucuauauuuggaacgagaaaaggaacaaaua

SEQ ID NO: 398990 - RNA, 32 nt, Human
cucuaucaaaaauacaaaaauuagcuggcaug

SEQ ID NO: 398991 - RNA, 32 nt, Human
cucuaucacacaggcuggagggcaguggcagg

SEQ ID NO: 398992 - RNA, 32 nt, Human
cucuaucaccaccaccagcagagccugagcug

SEQ ID NO: 398993 - RNA, 32 nt, Human
cucuaucaccaggugggagugcaguggcacaa

SEQ ID NO: 398994 - RNA, 32 nt, Human
cucuaucacccaagcuggaguacaguggcaca

SEQ ID NO: 398995 - RNA, 32 nt, Human
cucuaucacccaagcuggagugcaguggcacc

SEQ ID NO: 398996 - RNA, 32 nt, Human
cucuaucacccaggcugaagugcaguagugca

SEQ ID NO: 398997 - RNA, 32 nt, Human
cucuaucacccaggcugaagugcagugguacg

SEQ ID NO: 398998 - RNA, 32 nt, Human
cucuaucacccaggcuggagugcaguggugca

SEQ ID NO: 398999 - RNA, 32 nt, Human
cucuaucacccaggcuggagugcaguguggcu

SEQ ID NO: 399000 - RNA, 25 nt, Human
cucuaucaccuaggcuggagugcag

SEQ ID NO: 399001 - RNA, 32 nt, Human
cucuaucaccuaggcuggagugcagcggcaug

SEQ ID NO: 399002 - RNA, 32 nt, Human
cucuauccaugcugucaacuccugccuccacc

SEQ ID NO: 399003 - RNA, 32 nt, Human
cucuaucccuagaguaagaccaacuugaaccu

SEQ ID NO: 399004 - RNA, 32 nt, Human
cucuauccucacccuguuuugugcucuucccc

SEQ ID NO: 399005 - RNA, 32 nt, Human
cucuauccuccacggccccauccaagccaggg

SEQ ID NO: 399006 - RNA, 32 nt, Human
cucuauccuucuucugguccuuccuagaaaau

SEQ ID NO: 399007 - RNA, 25 nt, Human
cucuaucgccaggcuggaguguagu

SEQ ID NO: 399008 - RNA, 32 nt, Human
cucuaucgccaggcuggaguguaguggcauga

SEQ ID NO: 399009 - RNA, 32 nt, Human
cucuaucgcccaggauggagugcaguggcuca

SEQ ID NO: 399010 - RNA, 26 nt, Human
cucuaucgcccaggcuggagugcagu

SEQ ID NO: 399011 - RNA, 32 nt, Human
cucuaucgcccaggcuggagugcaguggcgca

SEQ ID NO: 399012 - RNA, 26 nt, Human
cucuaucgccuaggcugaagcacagu

SEQ ID NO: 399013 - RNA, 32 nt, Human
cucuaucgccuaggcugaagcacaguggugcg

SEQ ID NO: 399014 - RNA, 32 nt, Human
cucuaucgcggucaacuuuccucaggaucuga

SEQ ID NO: 399015 - RNA, 32 nt, Human
cucuaucgcuugcucucuccugccucacuccu

SEQ ID NO: 399016 - RNA, 32 nt, Human
cucuaucggggucuucgagagccagacagccu

SEQ ID NO: 399017 - RNA, 32 nt, Human
cucuaucuccaccuccuuuucccagccuucag

SEQ ID NO: 399018 - RNA, 18 nt, Human
cucuaucucuggcuccug

SEQ ID NO: 399019 - RNA, 32 nt, Human
cucuaucugcagguccccagccuggguaaaga

SEQ ID NO: 399020 - RNA, 32 nt, Human
cucuaucugugguuuggcauuguaccugggua

SEQ ID NO: 399021 - RNA, 32 nt, Human
cucuaucuuuaaacgaaacaaagacaauuuau

SEQ ID NO: 399022 - RNA, 32 nt, Human
cucuaugaaaaauacaaaauuugcugggagug

SEQ ID NO: 399023 - RNA, 32 nt, Human
cucuaugaaccucugcugggcccagccccugu

SEQ ID NO: 399024 - RNA, 32 nt, Human
cucuaugaacucaucauuccagccugggcaac

SEQ ID NO: 399025 - RNA, 32 nt, Human
cucuaugaacuuaugaaaaccuucaguuacag

SEQ ID NO: 399026 - RNA, 29 nt, Human
cucuaugagggaacugcuggggccugcgg

SEQ ID NO: 399027 - RNA, 32 nt, Human
cucuaugcaaccuccaccuccuggguucaugc

SEQ ID NO: 399028 - RNA, 32 nt, Human
cucuaugccacugucugcuuagcccagcucag

SEQ ID NO: 399029 - RNA, 32 nt, Human
cucuaugcccacugcccuccucccucuccugg

SEQ ID NO: 399030 - RNA, 32 nt, Human
cucuaugcccuguuaaauggggagacaaaggg

SEQ ID NO: 399031 - RNA, 32 nt, Human
cucuaugcgacaggggcccaggaacagccuga

SEQ ID NO: 399032 - RNA, 32 nt, Human
cucuaugcuaucuccucuaaucuccccgcucu

SEQ ID NO: 399033 - RNA, 32 nt, Human
cucuaugcugggaaccagggaccaagaguaaa

SEQ ID NO: 399034 - RNA, 29 nt, Human
cucuauggagacguccccaugcccagaac

SEQ ID NO: 399035 - RNA, 32 nt, Human
cucuauggccaggccucacacauggcucugcc

SEQ ID NO: 399036 - RNA, 29 nt, Human
cucuauggcccaggcuggagcgcagcggu

SEQ ID NO: 399037 - RNA, 32 nt, Human
cucuauggcccaggcuggaguacagugacacg

SEQ ID NO: 399038 - RNA, 32 nt, Human
cucuaugggcagaucuaccccuuacuuauuau

SEQ ID NO: 399039 - RNA, 32 nt, Human
cucuaugggggugcgggggugucaugucuugc

SEQ ID NO: 399040 - RNA, 32 nt, Human
cucuaugguacaccugcuuauguguugccuca

SEQ ID NO: 399041 - RNA, 32 nt, Human
cucuaugucugaucuaggaggcugggggaaga

SEQ ID NO: 399042 - RNA, 32 nt, Human
cucuauguucagaccacuggagaggauagaga

SEQ ID NO: 399043 - RNA, 32 nt, Human
cucuauuaaaaauacaaaaauuagacuggcau

SEQ ID NO: 399044 - RNA, 32 nt, Human
cucuauuaaaaauacaaaaauuagccaggcau

SEQ ID NO: 399045 - RNA, 32 nt, Human
cucuauuaaaaauacaaaaauuagccgagagu

SEQ ID NO: 399046 - RNA, 32 nt, Human
cucuauuaaaaauacaaaaauuagccggaugu

SEQ ID NO: 399047 - RNA, 32 nt, Human
cucuauuaaaaauacaaaaauuagccgggagu

SEQ ID NO: 399048 - RNA, 32 nt, Human
cucuauuaaaaauacaaaaauuagccgggugu

SEQ ID NO: 399049 - RNA, 32 nt, Human
cucuauuaaaaauacaaaaauuagcugggcau

SEQ ID NO: 399050 - RNA, 32 nt, Human
cucuauuaaaaauacaaaaauuagcugggcgu

SEQ ID NO: 399051 - RNA, 32 nt, Human
cucuauuaaaaauacaaaaauuagcugggguu

SEQ ID NO: 399052 - RNA, 32 nt, Human
cucuauuaaaaauacaaaaauuagcugggugu

SEQ ID NO: 399053 - RNA, 32 nt, Human
cucuauuaaaaauaccaaaauuagcugggcau

SEQ ID NO: 399054 - RNA, 32 nt, Human
cucuauuaaaaauuuuacaaaaauuagcugcg

SEQ ID NO: 399055 - RNA, 32 nt, Human
cucuauuaacacagcuagaucuuuuucuucca

SEQ ID NO: 399056 - RNA, 32 nt, Human
cucuauuacucaggcuggaguaaaauggugcc

SEQ ID NO: 399057 - RNA, 32 nt, Human
cucuauuagucucuucucaggcugcuaauaaa

SEQ ID NO: 399058 - RNA, 32 nt, Human
cucuauuauggagaugugaaaagagagaccca

SEQ ID NO: 399059 - RNA, 32 nt, Human
cucuauucaagaaagcacacaggccuuugaug

SEQ ID NO: 399060 - RNA, 25 nt, Human
cucuauucagguaaaacaaugaaug

SEQ ID NO: 399061 - RNA, 32 nt, Human
cucuauucauguggcccugaacacugagcuca

SEQ ID NO: 399062 - RNA, 32 nt, Human
cucuauucauucucucaccaaacaagcuucua

SEQ ID NO: 399063 - RNA, 32 nt, Human
cucuauuccgacauccuccaacauggaggaaa

SEQ ID NO: 399064 - RNA, 32 nt, Human
cucuauucucucucagaguacaagcucucauc

SEQ ID NO: 399065 - RNA, 18 nt, Human
cucuauucuuggcuucug

SEQ ID NO: 399066 - RNA, 32 nt, Human
cucuauucuuuucucuuucuucauuuaacauu

SEQ ID NO: 399067 - RNA, 32 nt, Human
cucuauugccaaggagggcuucaagaagauua

SEQ ID NO: 399068 - RNA, 32 nt, Human
cucuauugcccaggcuggagugcacuggcgug

SEQ ID NO: 399069 - RNA, 26 nt, Human
cucuauugcccaggcuggagugcagu

SEQ ID NO: 399070 - RNA, 32 nt, Human
cucuauugcccaggcuggagugcaguggcuca

SEQ ID NO: 399071 - RNA, 32 nt, Human
cucuauugcccaggcuggagugcagugguaca

SEQ ID NO: 399072 - RNA, 32 nt, Human
cucuauugcccaggcuggagugcaguggugua

SEQ ID NO: 399073 - RNA, 32 nt, Human
cucuauugcccagucuggagugcaguggcaug

SEQ ID NO: 399074 - RNA, 32 nt, Human
cucuauugcucaggcuggagugugguggcagg

SEQ ID NO: 399075 - RNA, 32 nt, Human
cucuauugcucuucugucccgaagaugcaguc

SEQ ID NO: 399076 - RNA, 32 nt, Human
cucuauuggccaggcuggaguguaguggcacc

SEQ ID NO: 399077 - RNA, 26 nt, Human
cucuauuguucagacuggagugcagu

SEQ ID NO: 399078 - RNA, 32 nt, Human
cucuauuguucagacuggagugcaguggcaug

SEQ ID NO: 399079 - RNA, 32 nt, Human
cucuauuuauaucuacauuuccuuccagcuga

SEQ ID NO: 399080 - RNA, 20 nt, Human
cucuauuuccaaugcuccuc

SEQ ID NO: 399081 - RNA, 21 nt, Human
cucuauuucuauugggauaua

SEQ ID NO: 399082 - RNA, 32 nt, Human
cucuauuucucuuccugucacuuaaucuuuuc

SEQ ID NO: 399083 - RNA, 21 nt, Human
cucuauuucugucaaugacau

SEQ ID NO: 399084 - RNA, 16 nt, Human
cucuauuucuguggca

SEQ ID NO: 399085 - RNA, 32 nt, Human
cucuauuuguugcaaucuuucuccuuaggucc

SEQ ID NO: 399086 - RNA, 32 nt, Human
cucuauuuuacagaugagaaaacugaagcaca

SEQ ID NO: 399087 - RNA, 21 nt, Human
cucuauuuuaguacugacaug

SEQ ID NO: 399088 - RNA, 32 nt, Human
cucuauuuucacucuuggcggcugcccacacg

SEQ ID NO: 399089 - RNA, 32 nt, Human
cucuauuuucauccucaccaauccugccaggg

SEQ ID NO: 399090 - RNA, 32 nt, Human
cucuauuuuccucugcauuguacuaaucuguu

SEQ ID NO: 399091 - RNA, 32 nt, Human
cucuauuuuuauucuccuuuggccauugcagu

SEQ ID NO: 399092 - RNA, 23 nt, Human
cucucaaaaagagagaaaaagaa

SEQ ID NO: 399093 - RNA, 32 nt, Human
cucucaaaaagcuuauuaagccugaaaagcca

SEQ ID NO: 399094 - RNA, 32 nt, Human
cucucaaaaugcuggcauuacaggugugagcc

SEQ ID NO: 399095 - RNA, 32 nt, Human
cucucaaaaugcugggauuacaggugugagcc

SEQ ID NO: 399096 - RNA, 32 nt, Human
cucucaaacugcugggauuacaggcacgcgcc

SEQ ID NO: 399097 - RNA, 32 nt, Human
cucucaaacugcugggauuauaggcaugagcc

SEQ ID NO: 399098 - RNA, 32 nt, Human
cucucaaacuugagugcugaggagacucagau

SEQ ID NO: 399099 - RNA, 32 nt, Human
cucucaaagagcugggauuacaggcaugaguc

SEQ ID NO: 399100 - RNA, 32 nt, Human
cucucaaagcgcugggauuacaggcaugagcc

SEQ ID NO: 399101 - RNA, 32 nt, Human
cucucaaagugcugggauuaaaggcguaagcc

SEQ ID NO: 399102 - RNA, 32 nt, Human
cucucaaagugcugggauuacaagcaugagcc

SEQ ID NO: 399103 - RNA, 32 nt, Human
cucucaaagugcugggauuacaggcauaagcc

SEQ ID NO: 399104 - RNA, 32 nt, Human
cucucaaagugcugggauuacaggcaugagcc

SEQ ID NO: 399105 - RNA, 32 nt, Human
cucucaaagugcugggauuacaggccugagca

SEQ ID NO: 399106 - RNA, 32 nt, Human
cucucaaagugcugggauuacaggcgugagcc

SEQ ID NO: 399107 - RNA, 32 nt, Human
cucucaaagugcugggauuacaggcgugaggc

SEQ ID NO: 399108 - RNA, 32 nt, Human
cucucaaagugcugggauuacaggcgugaguc

SEQ ID NO: 399109 - RNA, 32 nt, Human
cucucaaagugcugggauuacaggcgugggcc

SEQ ID NO: 399110 - RNA, 32 nt, Human
cucucaaagugcugggauuacaggcuuacgcc

SEQ ID NO: 399111 - RNA, 32 nt, Human
cucucaaagugcugggauuacaggugugagcc

SEQ ID NO: 399112 - RNA, 32 nt, Human
cucucaaagugcugggauuacaggugugccac

SEQ ID NO: 399113 - RNA, 32 nt, Human
cucucaaagugcugggauuacgggcaugagcu

SEQ ID NO: 399114 - RNA, 32 nt, Human
cucucaaagugcugggauuacgggcgugagcc

SEQ ID NO: 399115 - RNA, 32 nt, Human
cucucaaagugcugggauuagaggcuugagcc

SEQ ID NO: 399116 - RNA, 32 nt, Human
cucucaaagugcugggauuagaggugugagcc

SEQ ID NO: 399117 - RNA, 32 nt, Human
cucucaaagugcugggauuaggcaugaacuac

SEQ ID NO: 399118 - RNA, 32 nt, Human
cucucaaagugcugggauuauaggcaugaacc

SEQ ID NO: 399119 - RNA, 32 nt, Human
cucucaaagugcugggauuauaggcgugagcc

SEQ ID NO: 399120 - RNA, 32 nt, Human
cucucaaagugcugggauuauaggcgugagcu

SEQ ID NO: 399121 - RNA, 32 nt, Human
cucucaaagugcugggauuauaggcuugagcc

SEQ ID NO: 399122 - RNA, 32 nt, Human
cucucaaagugcugguauuacaggcgugagcc

SEQ ID NO: 399123 - RNA, 32 nt, Human
cucucaaaguguugggauaacaggcaugagcc

SEQ ID NO: 399124 - RNA, 32 nt, Human
cucucaaaguguugggauuacaggcgugagcc

SEQ ID NO: 399125 - RNA, 32 nt, Human
cucucaaaguguugggauuacguguguaagcc

SEQ ID NO: 399126 - RNA, 21 nt, Human
cucucaaauaauuaaaaagga

SEQ ID NO: 399127 - RNA, 32 nt, Human
cucucaaauagcugggacuacaggcagcaaag

SEQ ID NO: 399128 - RNA, 24 nt, Human
cucucaaauguuuccagaaaaaag

SEQ ID NO: 399129 - RNA, 21 nt, Human
cucucaacaagugccacucca

SEQ ID NO: 399130 - RNA, 20 nt, Human
cucucaacacccaguuuccu

SEQ ID NO: 399131 - RNA, 24 nt, Human
cucucaacaccucggggaccccug

SEQ ID NO: 399132 - RNA, 19 nt, Human
cucucaacaccuuggcucc

SEQ ID NO: 399133 - RNA, 18 nt, Human
cucucaacagccccagca

SEQ ID NO: 399134 - RNA, 32 nt, Human
cucucaaccacaaccuccagcuacagggcucu

SEQ ID NO: 399135 - RNA, 32 nt, Human
cucucaacccaaagucuuccaccagccaauca

SEQ ID NO: 399136 - RNA, 32 nt, Human
cucucaacccccugucaugagcucuuucuagc

SEQ ID NO: 399137 - RNA, 32 nt, Human
cucucaaccucauucccaccucuggggccccu

SEQ ID NO: 399138 - RNA, 31 nt, Human
cucucaacuaacaaggaggcaggagagguca

SEQ ID NO: 399139 - RNA, 31 nt, Human
cucucaacuaauacuuugcuguugaaauguu

SEQ ID NO: 399140 - RNA, 22 nt, Human
cucucaacucacuguaaccucc

SEQ ID NO: 399141 - RNA, 32 nt, Human
cucucaacucacuguaaccuccgccucccgga

SEQ ID NO: 399142 - RNA, 21 nt, Human
cucucaacugcaguuuucuua

SEQ ID NO: 399143 - RNA, 32 nt, Human
cucucaagaccaccuggccaaaacugaacuaa

SEQ ID NO: 399144 - RNA, 32 nt, Human
cucucaagcucacucucuaggucuccagggua

SEQ ID NO: 399145 - RNA, 32 nt, Human
cucucaagcuguuuucccucugauuuacaaug

SEQ ID NO: 399146 - RNA, 32 nt, Human
cucucaaggguaucucaaguaccauuuagaau

SEQ ID NO: 399147 - RNA, 24 nt, Human
cucucaaguaacugggauuacagg

SEQ ID NO: 399148 - RNA, 32 nt, Human
cucucaaguagcugggacuacaggcaugugcc

SEQ ID NO: 399149 - RNA, 22 nt, Human
cucucaaguagcugggauuaca

SEQ ID NO: 399150 - RNA, 32 nt, Human
cucucaaguagcugggauuacaagcaccagcc

SEQ ID NO: 399151 - RNA, 32 nt, Human
cucucaaguagcugggauuacaagcaugcgcc

SEQ ID NO: 399152 - RNA, 24 nt, Human
cucucaaguagcugggauuacagg

SEQ ID NO: 399153 - RNA, 32 nt, Human
cucucaaguagcugggauuacaggcgcccgcc

SEQ ID NO: 399154 - RNA, 24 nt, Human
cucucaagugauccuccugccuca

SEQ ID NO: 399155 - RNA, 32 nt, Human
cucucaaguucagagcucugauguggaaagac

SEQ ID NO: 399156 - RNA, 32 nt, Human
cucucaauaccuuuugcuguguguuucugucu

SEQ ID NO: 399157 - RNA, 32 nt, Human
cucucaauagagagcuaugucuuacauucuuu

SEQ ID NO: 399158 - RNA, 24 nt, Human
cucucaaugaagagguauuuccua

SEQ ID NO: 399159 - RNA, 32 nt, Human
cucucacaaagucauccaguaagagagaucac

SEQ ID NO: 399160 - RNA, 32 nt, Human
cucucacaaggaaggccgcuguggagcgugga

SEQ ID NO: 399161 - RNA, 32 nt, Human
cucucacacacguguaugcacagcagagagac

SEQ ID NO: 399162 - RNA, 32 nt, Human
cucucacacaggcuccacagugcuucacccag

SEQ ID NO: 399163 - RNA, 32 nt, Human
cucucacacauacacacacaaacacauacaca

SEQ ID NO: 399164 - RNA, 32 nt, Human
cucucacacccaggcuggagugcagucucaac

SEQ ID NO: 399165 - RNA, 32 nt, Human
cucucacagacaaagaggccugggauauuagg

SEQ ID NO: 399166 - RNA, 32 nt, Human
cucucacagugaauuuugaugcauuuaaaaua

SEQ ID NO: 399167 - RNA, 32 nt, Human
cucucacaucccgugcggucaggaagcccuuc

SEQ ID NO: 399168 - RNA, 32 nt, Human
cucucacauuuggguaaaauguuuagcaggcu

SEQ ID NO: 399169 - RNA, 32 nt, Human
cucucaccaccaggguugcagucaggacaaga

SEQ ID NO: 399170 - RNA, 18 nt, Human
cucucaccaccuccucca

SEQ ID NO: 399171 - RNA, 32 nt, Human
cucucaccagcccaggcccucaggaggaggag

SEQ ID NO: 399172 - RNA, 32 nt, Human
cucucaccagcccuccuuucagccucuacaac

SEQ ID NO: 399173 - RNA, 32 nt, Human
cucucaccaggucaguugugcaucaaggcuac

SEQ ID NO: 399174 - RNA, 32 nt, Human
cucucacccaggccugaagugcaguggcauga

SEQ ID NO: 399175 - RNA, 24 nt, Human
cucucacccaggcuggaguagagu

SEQ ID NO: 399176 - RNA, 24 nt, Human
cucucacccaggcuggagugcagu

SEQ ID NO: 399177 - RNA, 32 nt, Human
cucucacccaggcuggagugcaguggcacaau

SEQ ID NO: 399178 - RNA, 24 nt, Human
cucucacccaggcuggaguggagu

SEQ ID NO: 399179 - RNA, 32 nt, Human
cucucacccaggcuggaguggaguggcgcuau

SEQ ID NO: 399180 - RNA, 22 nt, Human
cucucacccaggcuggagugua

SEQ ID NO: 399181 - RNA, 32 nt, Human
cucucacccaggcuggaguguaagugacauga

SEQ ID NO: 399182 - RNA, 32 nt, Human
cucucaccccgccauccccaccaguccccacc

SEQ ID NO: 399183 - RNA, 32 nt, Human
cucucaccccugccccuuagagucuaggugca

SEQ ID NO: 399184 - RNA, 32 nt, Human
cucucaccgcaaccuccgucuccuggguucaa

SEQ ID NO: 399185 - RNA, 32 nt, Human
cucucaccuccaccaccccucccugucccagc

SEQ ID NO: 399186 - RNA, 24 nt, Human
cucucaccucccagcccucagcca

SEQ ID NO: 399187 - RNA, 32 nt, Human
cucucaccuccuucauccccuaccuccugcag

SEQ ID NO: 399188 - RNA, 32 nt, Human
cucucaccugcacucccagcuacucgggaggc

SEQ ID NO: 399189 - RNA, 32 nt, Human
cucucaccugucuguucucuccccagucagcc

SEQ ID NO: 399190 - RNA, 32 nt, Human
cucucacgcuccacucugcagcuuggacaccc

SEQ ID NO: 399191 - RNA, 32 nt, Human
cucucacuacuaaaaauacaaaauuagccacg

SEQ ID NO: 399192 - RNA, 32 nt, Human
cucucacucacccuccggcuuccugucggggc

SEQ ID NO: 399193 - RNA, 32 nt, Human
cucucacucacugcaauugcuucuacucuggg

SEQ ID NO: 399194 - RNA, 32 nt, Human
cucucacucauguaugcauacaugcacagaga

SEQ ID NO: 399195 - RNA, 32 nt, Human
cucucacuccccuaagccuggugaaagaguca

SEQ ID NO: 399196 - RNA, 32 nt, Human
cucucacuccccucucaccuuuugcagucucc

SEQ ID NO: 399197 - RNA, 32 nt, Human
cucucacuccugaaagccccagaaggacacug

SEQ ID NO: 399198 - RNA, 20 nt, Human
cucucacuccugcugcugcc

SEQ ID NO: 399199 - RNA, 21 nt, Human
cucucacugaaauaaaaggaa

SEQ ID NO: 399200 - RNA, 19 nt, Human
cucucacugcaagaauuga

SEQ ID NO: 399201 - RNA, 32 nt, Human
cucucacuggauaguuuuuagauguguuucuu

SEQ ID NO: 399202 - RNA, 32 nt, Human
cucucacugucgcccaggcuggagugcagugg

SEQ ID NO: 399203 - RNA, 32 nt, Human
cucucacugucucuggcucacgcuucccgggc

SEQ ID NO: 399204 - RNA, 20 nt, Human
cucucacuuacccccauucc

SEQ ID NO: 399205 - RNA, 32 nt, Human
cucucacuuggccuugcugcuguccucugaga

SEQ ID NO: 399206 - RNA, 18 nt, Human
cucucacuuuaaagacau

SEQ ID NO: 399207 - RNA, 18 nt, Human
cucucacuuuagccaugg

SEQ ID NO: 399208 - RNA, 22 nt, Human
cucucacuuucagcacuauuga

SEQ ID NO: 399209 - RNA, 17 nt, Human
cucucacuuugcuguga

SEQ ID NO: 399210 - RNA, 22 nt, Human
cucucacuuuuuaaagcauuga

SEQ ID NO: 399211 - RNA, 32 nt, Human
cucucagaaagccaagagugcaggaugagagc

SEQ ID NO: 399212 - RNA, 32 nt, Human
cucucagaacagcuccuagaggcugcucauga

SEQ ID NO: 399213 - RNA, 32 nt, Human
cucucagaagcagaggaggcagguggguggag

SEQ ID NO: 399214 - RNA, 32 nt, Human
cucucagaagggagaggaggccuccaaaucua

SEQ ID NO: 399215 - RNA, 22 nt, Human
cucucagaagggugccaggcca

SEQ ID NO: 399216 - RNA, 32 nt, Human
cucucagaauauguggaagaggauguggagaa

SEQ ID NO: 399217 - RNA, 32 nt, Human
cucucagaccuuuugucacagggcuacaggac

SEQ ID NO: 399218 - RNA, 27 nt, Human
cucucagagaugccucaguuucccuag

SEQ ID NO: 399219 - RNA, 32 nt, Human
cucucagaggauccuauacauggaugugaugc

SEQ ID NO: 399220 - RNA, 32 nt, Human
cucucagaggcagcaugagcugagagggugau

SEQ ID NO: 399221 - RNA, 32 nt, Human
cucucagagugcugggaucacaggcgugagcc

SEQ ID NO: 399222 - RNA, 32 nt, Human
cucucagagugcugggauuauaggugugcgcc

SEQ ID NO: 399223 - RNA, 32 nt, Human
cucucagaguguugggauuacagccaugagcc

SEQ ID NO: 399224 - RNA, 32 nt, Human
cucucagaugcgauuuggaggaagggccauac

SEQ ID NO: 399225 - RNA, 32 nt, Human
cucucagauggucuuuuguuacugcaagauuu

SEQ ID NO: 399226 - RNA, 32 nt, Human
cucucagaugugccagguggugccagugccag

SEQ ID NO: 399227 - RNA, 32 nt, Human
cucucagauucuuccccaaaugaggcagggug

SEQ ID NO: 399228 - RNA, 32 nt, Human
cucucagcagggugucaggcuuggggauuuga

SEQ ID NO: 399229 - RNA, 32 nt, Human
cucucagcaguuauugaucauuucuuaaggaa

SEQ ID NO: 399230 - RNA, 32 nt, Human
cucucagcaguuuuugcugcuucagcucuucc

SEQ ID NO: 399231 - RNA, 32 nt, Human
cucucagcaugucuccuccaccacgggacccc

SEQ ID NO: 399232 - RNA, 17 nt, Human
cucucagccaacuucua

SEQ ID NO: 399233 - RNA, 32 nt, Human
cucucagccaacuucuagcucacugcacucac

SEQ ID NO: 399234 - RNA, 32 nt, Human
cucucagccauuucagcagccccgucaaccgc

SEQ ID NO: 399235 - RNA, 32 nt, Human
cucucagcccacugcacucuccacucugccag

SEQ ID NO: 399236 - RNA, 32 nt, Human
cucucagcccagggaucagggacugggcugcu

SEQ ID NO: 399237 - RNA, 32 nt, Human
cucucagcccccguuucagggucagcgggaac

SEQ ID NO: 399238 - RNA, 32 nt, Human
cucucagcccugccacugccccggcgugcucc

SEQ ID NO: 399239 - RNA, 32 nt, Human
cucucagccuugaagccguuucccucugcgau

SEQ ID NO: 399240 - RNA, 32 nt, Human
cucucagcgguggcuggcuggcauuuuucucu

SEQ ID NO: 399241 - RNA, 22 nt, Human
cucucagcucacugagcucucu

SEQ ID NO: 399242 - RNA, 32 nt, Human
cucucagcucacugcaaccuccaccucccagg

SEQ ID NO: 399243 - RNA, 32 nt, Human
cucucagcucacugcagcccugacugccuagg

SEQ ID NO: 399244 - RNA, 32 nt, Human
cucucagcucuagggcccucugcacacuggcc

SEQ ID NO: 399245 - RNA, 32 nt, Human
cucucagcucugccaccucuagcugcaugacc

SEQ ID NO: 399246 - RNA, 32 nt, Human
cucucagcugcacucacagcaccagugagacc

SEQ ID NO: 399247 - RNA, 32 nt, Human
cucucagcugugugugcacaugcacacccacc

SEQ ID NO: 399248 - RNA, 32 nt, Human
cucucagcuuccugauccacagaagcagcaug

SEQ ID NO: 399249 - RNA, 32 nt, Human
cucucaggaaaggugauggagccccagugaca

SEQ ID NO: 399250 - RNA, 32 nt, Human
cucucaggaccacugugggugccaccaggcac

SEQ ID NO: 399251 - RNA, 32 nt, Human
cucucaggacuguggcuggaggcugggucugc

SEQ ID NO: 399252 - RNA, 32 nt, Human
cucucaggagagaagcuuuugaccacggagua

SEQ ID NO: 399253 - RNA, 32 nt, Human
cucucaggaugaaggugacggugggcccagac

SEQ ID NO: 399254 - RNA, 32 nt, Human
cucucaggccagaacucaacagcuauuuuugg

SEQ ID NO: 399255 - RNA, 32 nt, Human
cucucaggccggcagccccagccugcuagcua

SEQ ID NO: 399256 - RNA, 32 nt, Human
cucucaggcgacgguugcucagcugggucuau

SEQ ID NO: 399257 - RNA, 32 nt, Human
cucucagggcaggcacauguacggggcauaca

SEQ ID NO: 399258 - RNA, 32 nt, Human
cucucagggcccugcucaccugcucuggcugu

SEQ ID NO: 399259 - RNA, 32 nt, Human
cucucagggcucuguugggucuaccucaucug

SEQ ID NO: 399260 - RNA, 18 nt, Human
cucucagggcugcagcuu

SEQ ID NO: 399261 - RNA, 32 nt, Human
cucucagggcugggaggaccccagugcccucc

SEQ ID NO: 399262 - RNA, 32 nt, Human
cucucaggggcagagucagggcuggagguaga

SEQ ID NO: 399263 - RNA, 32 nt, Human
cucucaggggccagggaggccacccaggaccu

SEQ ID NO: 399264 - RNA, 32 nt, Human
cucucagggugcuggggcagccccaggucccc

SEQ ID NO: 399265 - RNA, 32 nt, Human
cucucaggucccucucuccugcccuagaggga

SEQ ID NO: 399266 - RNA, 32 nt, Human
cucucaguaaagccuccuggcaccaggccuuc

SEQ ID NO: 399267 - RNA, 32 nt, Human
cucucaguagacacuggagcugcucugucccu

SEQ ID NO: 399268 - RNA, 32 nt, Human
cucucaguccagccuggaggugugcucugagg

SEQ ID NO: 399269 - RNA, 22 nt, Human
cucucaguccaggcaaagccca

SEQ ID NO: 399270 - RNA, 32 nt, Human
cucucaguccucagauguggaaauaaaacaaa

SEQ ID NO: 399271 - RNA, 32 nt, Human
cucucaguccugaugucacaggcgcggcaagg

SEQ ID NO: 399272 - RNA, 32 nt, Human
cucucagucuccauuuuaacagugcuuuugaa

SEQ ID NO: 399273 - RNA, 24 nt, Human
cucucagugccaccacccccggca

SEQ ID NO: 399274 - RNA, 32 nt, Human
cucucagugccuggcccagcuuccuucaaaau

SEQ ID NO: 399275 - RNA, 32 nt, Human
cucucaguguguggugccuagccuccaggugg

SEQ ID NO: 399276 - RNA, 32 nt, Human
cucucaguuacuaagcaauacuuccuggagag

SEQ ID NO: 399277 - RNA, 32 nt, Human
cucucauacaucaagccccagaggaggcggca

SEQ ID NO: 399278 - RNA, 32 nt, Human
cucucauaggugcuauagccccagggacccag

SEQ ID NO: 399279 - RNA, 32 nt, Human
cucucauagucuuaaugcgucuggaccacugg

SEQ ID NO: 399280 - RNA, 32 nt, Human
cucucaucacagucugagucugguccauugcu

SEQ ID NO: 399281 - RNA, 32 nt, Human
cucucaucacccaggcuagagugcaguggcac

SEQ ID NO: 399282 - RNA, 32 nt, Human
cucucaucguccggccuucucccuucaucuug

SEQ ID NO: 399283 - RNA, 32 nt, Human
cucucaugacuuaacuggcuucccucugcugc

SEQ ID NO: 399284 - RNA, 22 nt, Human
cucucaugagcaccucuuccca

SEQ ID NO: 399285 - RNA, 32 nt, Human
cucucaugauccaccugccccgggagggcagc

SEQ ID NO: 399286 - RNA, 32 nt, Human
cucucaugcacggacuggagggcugcuccaac

SEQ ID NO: 399287 - RNA, 32 nt, Human
cucucaugccuccugaggcuguuuuuggcugu

SEQ ID NO: 399288 - RNA, 19 nt, Human
cucucauggaauugacaua

SEQ ID NO: 399289 - RNA, 32 nt, Human
cucucauucuccauagucuguuuccuggaaag

SEQ ID NO: 399290 - RNA, 32 nt, Human
cucucauucucccacaaugugugaaagcccca

SEQ ID NO: 399291 - RNA, 32 nt, Human
cucucauucuuauugaaccucuagcucuacua

SEQ ID NO: 399292 - RNA, 32 nt, Human
cucucauugcagccucggcguuuguagaagag

SEQ ID NO: 399293 - RNA, 32 nt, Human
cucucauugcccaggcuggagugcagugagcu

SEQ ID NO: 399294 - RNA, 32 nt, Human
cucucauuggggucucacugucucuaguauuu

SEQ ID NO: 399295 - RNA, 32 nt, Human
cucucauuucccuucuccuucucccucagucu

SEQ ID NO: 399296 - RNA, 32 nt, Human
cucucauuuccucugaugucuggaugaucggc

SEQ ID NO: 399297 - RNA, 32 nt, Human
cucucauuuguaacugcaugcauuauucuuga

SEQ ID NO: 399298 - RNA, 31 nt, Human
cucucauuuguucacuuuacagcagagugcc

SEQ ID NO: 399299 - RNA, 32 nt, Human
cucucauuuucccaucuucugcccuuuacuau

SEQ ID NO: 399300 - RNA, 32 nt, Human
cucucauuuuucugaagucugggaccucaaca

SEQ ID NO: 399301 - RNA, 32 nt, Human
cucuccaaaauacuugugaaacaauuuaucuu

SEQ ID NO: 399302 - RNA, 32 nt, Human
cucuccaaacccuguuucaucuucccaagcau

SEQ ID NO: 399303 - RNA, 32 nt, Human
cucuccaaaccugcuugcuugcaccccucuag

SEQ ID NO: 399304 - RNA, 32 nt, Human
cucuccaaccugggugacagaccgagacccug

SEQ ID NO: 399305 - RNA, 32 nt, Human
cucuccaacugccaccaagagguccauuccuu

SEQ ID NO: 399306 - RNA, 32 nt, Human
cucuccaagacaggaggccccagauccccaga

SEQ ID NO: 399307 - RNA, 32 nt, Human
cucuccaagaucuauguaucccuggcccacgu

SEQ ID NO: 399308 - RNA, 32 nt, Human
cucuccaagcucaauucucuaagccccucagg

SEQ ID NO: 399309 - RNA, 32 nt, Human
cucuccaagggccaccacaguguguaacaaua

SEQ ID NO: 399310 - RNA, 32 nt, Human
cucuccaagugcugggauuacaggcaucagcc

SEQ ID NO: 399311 - RNA, 29 nt, Human
cucuccaauaaagcaccuuguugaaagaa

SEQ ID NO: 399312 - RNA, 32 nt, Human
cucuccacaauccucuuaaagccccaggccag

SEQ ID NO: 399313 - RNA, 32 nt, Human
cucuccacagaauguuugcagagcugggcagu

SEQ ID NO: 399314 - RNA, 32 nt, Human
cucuccacagcaccuuugugaacucaggaaug

SEQ ID NO: 399315 - RNA, 32 nt, Human
cucuccacagccccaucaaagaacagagagga

SEQ ID NO: 399316 - RNA, 31 nt, Human
cucuccacaggagcggaaaaagagagacugc

SEQ ID NO: 399317 - RNA, 32 nt, Human
cucuccacaggcaccucuggggucuugguaug

SEQ ID NO: 399318 - RNA, 32 nt, Human
cucuccacccaguucaauggugcaauggacca

SEQ ID NO: 399319 - RNA, 32 nt, Human
cucuccacccguucugccucagugguuucaaa

SEQ ID NO: 399320 - RNA, 32 nt, Human
cucuccaccucacuagcuccccaaucccugac

SEQ ID NO: 399321 - RNA, 32 nt, Human
cucuccacuccacgaggaugugaaacgguucu

SEQ ID NO: 399322 - RNA, 32 nt, Human
cucuccacuccccucuacucccucccuguaac

SEQ ID NO: 399323 - RNA, 32 nt, Human
cucuccacucucccucuccacuccccuuccug

SEQ ID NO: 399324 - RNA, 32 nt, Human
cucuccacugaauuccugaauuaugcauugca

SEQ ID NO: 399325 - RNA, 32 nt, Human
cucuccacuuccccucucccugcugaggaauc

SEQ ID NO: 399326 - RNA, 32 nt, Human
cucuccacuuucucucacaggcugcuagaaca

SEQ ID NO: 399327 - RNA, 32 nt, Human
cucuccagaauggcacauggcuccggggugcc

SEQ ID NO: 399328 - RNA, 22 nt, Human
cucuccagaccaagcucucccu

SEQ ID NO: 399329 - RNA, 32 nt, Human
cucuccagaccaagcucucccucccaguggcc

SEQ ID NO: 399330 - RNA, 19 nt, Human
cucuccagaccuccucucu

SEQ ID NO: 399331 - RNA, 32 nt, Human
cucuccagaggacacacagcucuggauuucua

SEQ ID NO: 399332 - RNA, 32 nt, Human
cucuccagauaccaauucuucaugccgagagc

SEQ ID NO: 399333 - RNA, 32 nt, Human
cucuccagcaaaggacacaucucuccagcaaa

SEQ ID NO: 399334 - RNA, 32 nt, Human
cucuccagcaagcccugaagucaguagugccu

SEQ ID NO: 399335 - RNA, 21 nt, Human
cucuccagcaggggaucccca

SEQ ID NO: 399336 - RNA, 24 nt, Human
cucuccagcagggugcuccugcuc

SEQ ID NO: 399337 - RNA, 32 nt, Human
cucuccagcaucucuccguagccugggugaag

SEQ ID NO: 399338 - RNA, 32 nt, Human
cucuccagcauuuggaauuccacccgccuugc

SEQ ID NO: 399339 - RNA, 32 nt, Human
cucuccagccccaggucuccugacauuguguu

SEQ ID NO: 399340 - RNA, 32 nt, Human
cucuccagccccauggcugcugcuggucagcc

SEQ ID NO: 399341 - RNA, 18 nt, Human
cucuccagccccugcagc

SEQ ID NO: 399342 - RNA, 32 nt, Human
cucuccagcccuuugggacuuccaaugggauc

SEQ ID NO: 399343 - RNA, 32 nt, Human
cucuccagcccuuuucuccaucccuguccaau

SEQ ID NO: 399344 - RNA, 32 nt, Human
cucuccagccugagcgacagagcgagacuccg

SEQ ID NO: 399345 - RNA, 32 nt, Human
cucuccagccugagguggugaaggcaggaugc

SEQ ID NO: 399346 - RNA, 32 nt, Human
cucuccagccuggcgacagagggagacuccau

SEQ ID NO: 399347 - RNA, 32 nt, Human
cucuccagccugggcaacagagcaaggcucug

SEQ ID NO: 399348 - RNA, 32 nt, Human
cucuccagccugggcgacaagagcgaaacucc

SEQ ID NO: 399349 - RNA, 32 nt, Human
cucuccagccugggcgacagagugagacucca

SEQ ID NO: 399350 - RNA, 32 nt, Human
cucuccagccuggggaacagagcaagacuguc

SEQ ID NO: 399351 - RNA, 32 nt, Human
cucuccagccugggugacacagcaagacucug

SEQ ID NO: 399352 - RNA, 32 nt, Human
cucuccagccugggugacagaggaagacucag

SEQ ID NO: 399353 - RNA, 32 nt, Human
cucuccagccuggguggcagagcgagacccug

SEQ ID NO: 399354 - RNA, 19 nt, Human
cucuccagcuccugcaccc

SEQ ID NO: 399355 - RNA, 32 nt, Human
cucuccagcugcagcauguuggugccauuuuc

SEQ ID NO: 399356 - RNA, 32 nt, Human
cucuccagcugccaccacagccuggaggcgcc

SEQ ID NO: 399357 - RNA, 32 nt, Human
cucuccagcuggauucuggagcuguucuccau

SEQ ID NO: 399358 - RNA, 32 nt, Human
cucuccaggaagguagcccagcacugugaaga

SEQ ID NO: 399359 - RNA, 32 nt, Human
cucuccaggaccaguggagagccccacccccg

SEQ ID NO: 399360 - RNA, 32 nt, Human
cucuccaggacugaggacagagcugcucuucu

SEQ ID NO: 399361 - RNA, 32 nt, Human
cucuccaggagcaaguccuguguggcaaaacu

SEQ ID NO: 399362 - RNA, 32 nt, Human
cucuccaggcagauagugcccucuccacaauc

SEQ ID NO: 399363 - RNA, 21 nt, Human
cucuccaggcccagcuccccu

SEQ ID NO: 399364 - RNA, 32 nt, Human
cucuccaggcuggagugcaguggcacaaucuc

SEQ ID NO: 399365 - RNA, 32 nt, Human
cucuccagggccugggccugauucaggugcag

SEQ ID NO: 399366 - RNA, 32 nt, Human
cucuccaggguaggccagcuugaggaaucuua

SEQ ID NO: 399367 - RNA, 19 nt, Human
cucuccagucaaggccacc

SEQ ID NO: 399368 - RNA, 32 nt, Human
cucuccagugccacuacugcgcuuucgaugca

SEQ ID NO: 399369 - RNA, 32 nt, Human
cucuccagugcuguccuugucugcaccacccg

SEQ ID NO: 399370 - RNA, 32 nt, Human
cucuccagugggagggcggcagcuccuguccc

SEQ ID NO: 399371 - RNA, 32 nt, Human
cucuccaguucccucagacucugucuucagcu

SEQ ID NO: 399372 - RNA, 32 nt, Human
cucuccaguucccuccuggucaccugcugccu

SEQ ID NO: 399373 - RNA, 32 nt, Human
cucuccauccacccaccuuucccucauucccu

SEQ ID NO: 399374 - RNA, 32 nt, Human
cucuccaucccuccuugcuggcccuccucccc

SEQ ID NO: 399375 - RNA, 32 nt, Human
cucuccaucccucugucccuugcucuucuuca

SEQ ID NO: 399376 - RNA, 32 nt, Human
cucuccaucccucuuuucuuuuguccuugccu

SEQ ID NO: 399377 - RNA, 32 nt, Human
cucuccaucccuuccuuccucccuccuucucc

SEQ ID NO: 399378 - RNA, 32 nt, Human
cucuccaucuacaaaguugcaguauuaugcaa

SEQ ID NO: 399379 - RNA, 32 nt, Human
cucuccaucuacuuuucccugugcauaauauc

SEQ ID NO: 399380 - RNA, 32 nt, Human
cucuccaucucucaccaaggcugcgucaaagc

SEQ ID NO: 399381 - RNA, 32 nt, Human
cucuccaucugaggcuccuucacuuucucucc

SEQ ID NO: 399382 - RNA, 32 nt, Human
cucuccaucuuucugcuucugggcuuucugaa

SEQ ID NO: 399383 - RNA, 32 nt, Human
cucuccaugccaccaccugcccuaccauuuau

SEQ ID NO: 399384 - RNA, 32 nt, Human
cucuccaugcuguggcccuggugauggcagag

SEQ ID NO: 399385 - RNA, 32 nt, Human
cucuccauucacuggucaaauaacuccaugag

SEQ ID NO: 399386 - RNA, 32 nt, Human
cucuccauuuccugccucuccuuucaccaagc

SEQ ID NO: 399387 - RNA, 32 nt, Human
cucuccauuugcuaccuguaguagccugccuc

SEQ ID NO: 399388 - RNA, 32 nt, Human
cucucccaacauacccaauccuggugaucagg

SEQ ID NO: 399389 - RNA, 32 nt, Human
cucucccaagaauacaaaaauuagccaggcau

SEQ ID NO: 399390 - RNA, 32 nt, Human
cucucccaaugccuccaucccauccccauggu

SEQ ID NO: 399391 - RNA, 32 nt, Human
cucucccaccacaggcucacacugcccuuacu

SEQ ID NO: 399392 - RNA, 32 nt, Human
cucucccaccaccugaauucuccaaggacucg

SEQ ID NO: 399393 - RNA, 20 nt, Human
cucucccaccucagccuccu

SEQ ID NO: 399394 - RNA, 32 nt, Human
cucucccaccucuaccuccacccccaccggcc

SEQ ID NO: 399395 - RNA, 32 nt, Human
cucucccaccugguuaccacagucuccauggg

SEQ ID NO: 399396 - RNA, 23 nt, Human
cucucccacggcugcaggucaga

SEQ ID NO: 399397 - RNA, 32 nt, Human
cucucccacuagacaaguccagccuggcaagg

SEQ ID NO: 399398 - RNA, 32 nt, Human
cucucccacucucccuucucucugagucuuau

SEQ ID NO: 399399 - RNA, 32 nt, Human
cucucccacugcaacuccacuuucuuugcauc

SEQ ID NO: 399400 - RNA, 32 nt, Human
cucucccacugcacacagggugguggcacauu

SEQ ID NO: 399401 - RNA, 32 nt, Human
cucucccacugcaccccuucuccuccaagaau

SEQ ID NO: 399402 - RNA, 32 nt, Human
cucucccacugcacccuggguugggugcacag

SEQ ID NO: 399403 - RNA, 32 nt, Human
cucucccacuuuucccuuccucuuuccccaca

SEQ ID NO: 399404 - RNA, 32 nt, Human
cucucccagaggagaucucuccccaguagugc

SEQ ID NO: 399405 - RNA, 22 nt, Human
cucucccagccaccuccuccca

SEQ ID NO: 399406 - RNA, 32 nt, Human
cucucccagccugugcuccuuucccucaucca

SEQ ID NO: 399407 - RNA, 32 nt, Human
cucucccagccuugccuggcugagcuguguuc

SEQ ID NO: 399408 - RNA, 32 nt, Human
cucucccagcgggccucccccuuccuacucag

SEQ ID NO: 399409 - RNA, 32 nt, Human
cucucccaggagcagugaguugugaguggaaa

SEQ ID NO: 399410 - RNA, 17 nt, Human
cucucccaggcucaccc

SEQ ID NO: 399411 - RNA, 32 nt, Human
cucucccaggggcuggcuucaggagggagcau

SEQ ID NO: 399412 - RNA, 32 nt, Human
cucucccaggucuacugcucccuggaaagccc

SEQ ID NO: 399413 - RNA, 32 nt, Human
cucucccagguuuccagcuugcaacugcuggu

SEQ ID NO: 399414 - RNA, 32 nt, Human
cucucccagucaaguggucaccagcaggacug

SEQ ID NO: 399415 - RNA, 32 nt, Human
cucucccaguccauuuccaaauguggccucca

SEQ ID NO: 399416 - RNA, 32 nt, Human
cucucccaucuggaucucccagccuuuuccaa

SEQ ID NO: 399417 - RNA, 32 nt, Human
cucucccaucuucucauauccuggcucuucuc

SEQ ID NO: 399418 - RNA, 32 nt, Human
cucucccauucuccgagcuuguccucagagaa

SEQ ID NO: 399419 - RNA, 32 nt, Human
cucucccauucugugaugaguacagcagagac

SEQ ID NO: 399420 - RNA, 32 nt, Human
cucuccccacagccuuccuccccaccaucccg

SEQ ID NO: 399421 - RNA, 32 nt, Human
cucuccccaccagccccauucucagguccuuu

SEQ ID NO: 399422 - RNA, 32 nt, Human
cucuccccacugucucucuucuuucugucagg

SEQ ID NO: 399423 - RNA, 32 nt, Human
cucuccccagccauucagagguuuccaaacua

SEQ ID NO: 399424 - RNA, 32 nt, Human
cucuccccagcccugagcacugugucaguucc

SEQ ID NO: 399425 - RNA, 32 nt, Human
cucuccccaggccucuggcugcagugaugccg

SEQ ID NO: 399426 - RNA, 32 nt, Human
cucuccccagggccuggcccuaccuccugguc

SEQ ID NO: 399427 - RNA, 32 nt, Human
cucuccccaggggagcccccaagggcggucgg

SEQ ID NO: 399428 - RNA, 32 nt, Human
cucuccccagguaguuggucagcuguggacuc

SEQ ID NO: 399429 - RNA, 32 nt, Human
cucuccccaguauuaucuuacuugcaaaaugg

SEQ ID NO: 399430 - RNA, 32 nt, Human
cucuccccagucugccccacuuccuggcuuua

SEQ ID NO: 399431 - RNA, 32 nt, Human
cucuccccaucuucccucaguucccauaaaac

SEQ ID NO: 399432 - RNA, 32 nt, Human
cucuccccaucuuggcugcuguccugccucug

SEQ ID NO: 399433 - RNA, 32 nt, Human
cucucccccaagagcuagcgugugguauagug

SEQ ID NO: 399434 - RNA, 32 nt, Human
cucucccccacccucuuuucccuucccaaagg

SEQ ID NO: 399435 - RNA, 32 nt, Human
cucucccccagccugccauguggcacugccca

SEQ ID NO: 399436 - RNA, 32 nt, Human
cucucccccaggaaacagugccuaaggaugau

SEQ ID NO: 399437 - RNA, 32 nt, Human
cucucccccaggcucuuucuccagcccugucu

SEQ ID NO: 399438 - RNA, 32 nt, Human
cucucccccaggcugcaguauuuugggcaggc

SEQ ID NO: 399439 - RNA, 32 nt, Human
cucucccccucaccauccccagauuuuaguug

SEQ ID NO: 399440 - RNA, 32 nt, Human
cucucccccuccacuuccucuccucccacccu

SEQ ID NO: 399441 - RNA, 32 nt, Human
cucucccccuccccaaacacaccaagaagcau

SEQ ID NO: 399442 - RNA, 32 nt, Human
cucucccccucggaggcggcgggcggaggcgg

SEQ ID NO: 399443 - RNA, 32 nt, Human
cucucccccuuccucucucccuucccuuccau

SEQ ID NO: 399444 - RNA, 32 nt, Human
cucuccccgcuccccagccucgggcgaggccg

SEQ ID NO: 399445 - RNA, 32 nt, Human
cucuccccgcugcgcucccucgcuccuucccu

SEQ ID NO: 399446 - RNA, 32 nt, Human
cucuccccgcuuccuauuuucucccuccaccu

SEQ ID NO: 399447 - RNA, 32 nt, Human
cucuccccggcaggccugagaaugagugggaa

SEQ ID NO: 399448 - RNA, 32 nt, Human
cucuccccgugcauggaaguccugguaaagga

SEQ ID NO: 399449 - RNA, 32 nt, Human
cucuccccguucaugcccugcacuacauagca

SEQ ID NO: 399450 - RNA, 32 nt, Human
cucuccccuacagggcccuugcugcgugaugg

SEQ ID NO: 399451 - RNA, 32 nt, Human
cucuccccuccagagcccugaguuucuuggcu

SEQ ID NO: 399452 - RNA, 32 nt, Human
cucuccccuccagccuuuggccuuggcuuuuc

SEQ ID NO: 399453 - RNA, 32 nt, Human
cucuccccuccccacuggcucugucugcucuc

SEQ ID NO: 399454 - RNA, 32 nt, Human
cucuccccucccccaccuuggcccccucuuug

SEQ ID NO: 399455 - RNA, 32 nt, Human
cucuccccucccccaguuucuccuccccuaaa

SEQ ID NO: 399456 - RNA, 32 nt, Human
cucuccccuccccucagugcccuugccccauc

SEQ ID NO: 399457 - RNA, 32 nt, Human
cucuccccuccccuccccuccccuccucuccu

SEQ ID NO: 399458 - RNA, 32 nt, Human
cucuccccuccccucuccggguucccccaccc

SEQ ID NO: 399459 - RNA, 32 nt, Human
cucuccccuccccuggcuuuccucucugccug

SEQ ID NO: 399460 - RNA, 32 nt, Human
cucuccccuccccuuccccucucgcaaacaug

SEQ ID NO: 399461 - RNA, 32 nt, Human
cucuccccuccccuuccuaccgcacccucagg

SEQ ID NO: 399462 - RNA, 32 nt, Human
cucuccccuccuccuccuugucacuggccucc

SEQ ID NO: 399463 - RNA, 32 nt, Human
cucuccccucucuacuuuaauucauuggagca

SEQ ID NO: 399464 - RNA, 32 nt, Human
cucuccccucucucuccaucccuuccuuccuc

SEQ ID NO: 399465 - RNA, 18 nt, Human
cucuccccugcagccgcg

SEQ ID NO: 399466 - RNA, 32 nt, Human
cucuccccugcccugcagcccugggccagaca

SEQ ID NO: 399467 - RNA, 32 nt, Human
cucuccccugcucucccaccucuaccuccacc

SEQ ID NO: 399468 - RNA, 32 nt, Human
cucuccccuucuacugccuccaacacggcggc

SEQ ID NO: 399469 - RNA, 18 nt, Human
cucucccgaccagcccca

SEQ ID NO: 399470 - RNA, 19 nt, Human
cucucccgccacccgggaa

SEQ ID NO: 399471 - RNA, 32 nt, Human
cucucccgcucccucugcuccaccaggacaca

SEQ ID NO: 399472 - RNA, 31 nt, Human
cucucccggcagggagcuggcauuccccaug

SEQ ID NO: 399473 - RNA, 32 nt, Human
cucucccggccaggagcgggaacucuuccagg

SEQ ID NO: 399474 - RNA, 32 nt, Human
cucucccguaccucagaagagugcaguacugg

SEQ ID NO: 399475 - RNA, 32 nt, Human
cucucccgugagccuccagaccgccccuggcc

SEQ ID NO: 399476 - RNA, 32 nt, Human
cucucccgugccucugcuuucuccagcagcug

SEQ ID NO: 399477 - RNA, 32 nt, Human
cucucccguuucucgauaccuuccuggaggaa

SEQ ID NO: 399478 - RNA, 32 nt, Human
cucucccuaaggguagccaggagaagucuccu

SEQ ID NO: 399479 - RNA, 32 nt, Human
cucucccuaccucccuccucaggggcaacaac

SEQ ID NO: 399480 - RNA, 32 nt, Human
cucucccuacugccugagcaaaccugaggccu

SEQ ID NO: 399481 - RNA, 32 nt, Human
cucucccuagugucccuucagccugggcugac

SEQ ID NO: 399482 - RNA, 32 nt, Human
cucucccucacaccucccuucaucccagggua

SEQ ID NO: 399483 - RNA, 32 nt, Human
cucucccucacugcucccagcaccuccugacc

SEQ ID NO: 399484 - RNA, 32 nt, Human
cucucccuccacacagccacacugccucaugc

SEQ ID NO: 399485 - RNA, 32 nt, Human
cucucccuccacccugccuccucgggcuccac

SEQ ID NO: 399486 - RNA, 32 nt, Human
cucucccuccacucagcucccagcugccggug

SEQ ID NO: 399487 - RNA, 32 nt, Human
cucucccuccacuccucccaacucuggccuug

SEQ ID NO: 399488 - RNA, 31 nt, Human
cucucccuccagcaugggccugugucucagc

SEQ ID NO: 399489 - RNA, 32 nt, Human
cucucccuccaggagcccccagcauguccuga

SEQ ID NO: 399490 - RNA, 32 nt, Human
cucucccuccugugucuugcgcuuuauguuuu

SEQ ID NO: 399491 - RNA, 32 nt, Human
cucucccuccuucuccuuccucugugauucac

SEQ ID NO: 399492 - RNA, 32 nt, Human
cucucccucuaggcucugccuucgaggucaga

SEQ ID NO: 399493 - RNA, 32 nt, Human
cucucccucucccacaccucacacacacauac

SEQ ID NO: 399494 - RNA, 32 nt, Human
cucucccucucuccaagacucuggcaguggcc

SEQ ID NO: 399495 - RNA, 18 nt, Human
cucucccucucuuagggu

SEQ ID NO: 399496 - RNA, 32 nt, Human
cucucccucuuccucugcucccgcggggucug

SEQ ID NO: 399497 - RNA, 32 nt, Human
cucucccugaaccugauccucagccuucaguu

SEQ ID NO: 399498 - RNA, 32 nt, Human
cucucccugcaaacaccacacacacauggcau

SEQ ID NO: 399499 - RNA, 32 nt, Human
cucucccugcagccacauguuucccaugaccu

SEQ ID NO: 399500 - RNA, 32 nt, Human
cucucccugcagcuuucacugcucuugccuaa

SEQ ID NO: 399501 - RNA, 32 nt, Human
cucucccugcauaggcugcugggaagcucaga

SEQ ID NO: 399502 - RNA, 32 nt, Human
cucucccugccacccuuccccaguucaccaaa

SEQ ID NO: 399503 - RNA, 32 nt, Human
cucucccugccccuuggugaccccguggcuuc

SEQ ID NO: 399504 - RNA, 32 nt, Human
cucucccugccucugagcucuggacucuguuu

SEQ ID NO: 399505 - RNA, 32 nt, Human
cucucccugccuggcacaugccugccagcguu

SEQ ID NO: 399506 - RNA, 27 nt, Human
cucucccugcuccacagcuuucagggu

SEQ ID NO: 399507 - RNA, 32 nt, Human
cucucccugcugucagcagugucucuggcaug

SEQ ID NO: 399508 - RNA, 32 nt, Human
cucucccuggacagcucugaggggcuccuugc

SEQ ID NO: 399509 - RNA, 32 nt, Human
cucucccuggacauacguuagcacauuggcau

SEQ ID NO: 399510 - RNA, 32 nt, Human
cucucccuggcuggagcagggagcuccaggag

SEQ ID NO: 399511 - RNA, 32 nt, Human
cucucccugggaggggacgaggggcggccuuc

SEQ ID NO: 399512 - RNA, 32 nt, Human
cucucccugggcuucucucucuucuaguucua

SEQ ID NO: 399513 - RNA, 31 nt, Human
cucucccuggugucucccccaagaccccaaa

SEQ ID NO: 399514 - RNA, 32 nt, Human
cucucccugugucgcuuaaacaacaguccuaa

SEQ ID NO: 399515 - RNA, 32 nt, Human
cucucccuucgcuccaagccucaggccaccgg

SEQ ID NO: 399516 - RNA, 32 nt, Human
cucucccuuuccagcucuccccaaaguccaca

SEQ ID NO: 399517 - RNA, 32 nt, Human
cucucccuuucucccuccauccuuccacuucc

SEQ ID NO: 399518 - RNA, 32 nt, Human
cucuccgaaaggcaucuaucugugcuauugca

SEQ ID NO: 399519 - RNA, 32 nt, Human
cucuccgaagaggaaagccacguagagugguu

SEQ ID NO: 399520 - RNA, 32 nt, Human
cucuccgaaugcugcgcaccgcgaugggccug

SEQ ID NO: 399521 - RNA, 32 nt, Human
cucuccgacuccgccaagcaagagcucaugga

SEQ ID NO: 399522 - RNA, 32 nt, Human
cucuccgagagaaaaccaaggugugucaaaug

SEQ ID NO: 399523 - RNA, 22 nt, Human
cucuccgauuccaccuccuccu

SEQ ID NO: 399524 - RNA, 32 nt, Human
cucuccgcagccgcccuccgccaagccccagc

SEQ ID NO: 399525 - RNA, 32 nt, Human
cucuccgcaggcccacuguccuuggguuuaau

SEQ ID NO: 399526 - RNA, 32 nt, Human
cucuccgcccacccuuacucccucccccucau

SEQ ID NO: 399527 - RNA, 32 nt, Human
cucuccgccccaggccagccagcuccaucucg

SEQ ID NO: 399528 - RNA, 32 nt, Human
cucuccgccucuccaucaccagccuucaucag

SEQ ID NO: 399529 - RNA, 32 nt, Human
cucuccgcgccuacccuucccgccucccucuc

SEQ ID NO: 399530 - RNA, 32 nt, Human
cucuccgcgguuaccugugccuagaggugauu

SEQ ID NO: 399531 - RNA, 32 nt, Human
cucuccgcuccagccucuccccagaacggcuc

SEQ ID NO: 399532 - RNA, 32 nt, Human
cucuccgcucuuuccagcaaagcugcucagag

SEQ ID NO: 399533 - RNA, 32 nt, Human
cucuccgcugggcucccagagcugcuggcguu

SEQ ID NO: 399534 - RNA, 32 nt, Human
cucuccggcaagggguuguugcacuagauuuc

SEQ ID NO: 399535 - RNA, 32 nt, Human
cucuccgggcccagaaccuccucaagucggcc

SEQ ID NO: 399536 - RNA, 32 nt, Human
cucuccgguacgugcccagcucaggccggcug

SEQ ID NO: 399537 - RNA, 32 nt, Human
cucuccggugccgccgcugccugcucccgcca

SEQ ID NO: 399538 - RNA, 32 nt, Human
cucuccguacaugcgccccacccccaugagcc

SEQ ID NO: 399539 - RNA, 32 nt, Human
cucuccgucuucuccccuccuucuuccccacu

SEQ ID NO: 399540 - RNA, 19 nt, Human
cucuccguguccccaccgg

SEQ ID NO: 399541 - RNA, 32 nt, Human
cucuccguugcucucccuggaucaggaacugg

SEQ ID NO: 399542 - RNA, 32 nt, Human
cucuccguuggccucagagucacuccugcccc

SEQ ID NO: 399543 - RNA, 32 nt, Human
cucuccuaaaaauacaaaaauuagccagaugu

SEQ ID NO: 399544 - RNA, 32 nt, Human
cucuccuaaaaauacaaaaauuagccgggcau

SEQ ID NO: 399545 - RNA, 32 nt, Human
cucuccuaaaaauacaaaaauuagcuggacau

SEQ ID NO: 399546 - RNA, 32 nt, Human
cucuccuaaaaauacaaaaauuagcuggaugu

SEQ ID NO: 399547 - RNA, 32 nt, Human
cucuccuaaaaauacaaaaauuggccgggcau

SEQ ID NO: 399548 - RNA, 32 nt, Human
cucuccuaaaaauacagaaaauuagccuggca

SEQ ID NO: 399549 - RNA, 32 nt, Human
cucuccuaaacuugcacucugcuccaucucag

SEQ ID NO: 399550 - RNA, 32 nt, Human
cucuccuaagcuccuucuuucauucugccauu

SEQ ID NO: 399551 - RNA, 20 nt, Human
cucuccuacccucuccucuu

SEQ ID NO: 399552 - RNA, 32 nt, Human
cucuccuaccugcugauugagccauccauuuu

SEQ ID NO: 399553 - RNA, 32 nt, Human
cucuccuagcucuccccuaagcuucuugaguc

SEQ ID NO: 399554 - RNA, 32 nt, Human
cucuccuaguaguacuuuuucucucuccauuu

SEQ ID NO: 399555 - RNA, 32 nt, Human
cucuccuaucuacugcuacagauccuguugaa

SEQ ID NO: 399556 - RNA, 32 nt, Human
cucuccuaugccaccccagguggggagggagg

SEQ ID NO: 399557 - RNA, 32 nt, Human
cucuccucaccccucuauccauuccucccgcc

SEQ ID NO: 399558 - RNA, 32 nt, Human
cucuccucacuccucuggacuuggcccugagc

SEQ ID NO: 399559 - RNA, 32 nt, Human
cucuccucagagggcggcacaggcugggcucc

SEQ ID NO: 399560 - RNA, 32 nt, Human
cucuccucaggggagcggggaggcagcugcug

SEQ ID NO: 399561 - RNA, 32 nt, Human
cucuccucaucuccaucucccaggcucuccac

SEQ ID NO: 399562 - RNA, 32 nt, Human
cucuccucauggcagcgacccaccuccagucc

SEQ ID NO: 399563 - RNA, 32 nt, Human
cucuccucauuucggugcauguccuuucugca

SEQ ID NO: 399564 - RNA, 32 nt, Human
cucuccuccaucuucuggcaaggacagaggcg

SEQ ID NO: 399565 - RNA, 32 nt, Human
cucuccucccacaucuguuccuccugcaacaa

SEQ ID NO: 399566 - RNA, 32 nt, Human
cucuccucccccacuccugcucccucucccuu

SEQ ID NO: 399567 - RNA, 32 nt, Human
cucuccucccccagccuuccuccggcuggcag

SEQ ID NO: 399568 - RNA, 32 nt, Human
cucuccuccccuuuuagcauuacugucuucug

SEQ ID NO: 399569 - RNA, 32 nt, Human
cucuccuccuccacuugccccuccuguggcac

SEQ ID NO: 399570 - RNA, 32 nt, Human
cucuccuccucccccucucuccuuccuuccuu

SEQ ID NO: 399571 - RNA, 32 nt, Human
cucuccuccuccgucgucaccccggccgcccu

SEQ ID NO: 399572 - RNA, 32 nt, Human
cucuccuccuucccucucccucucugcuuccu

SEQ ID NO: 399573 - RNA, 32 nt, Human
cucuccucgagcacgucacacacacaugccag

SEQ ID NO: 399574 - RNA, 32 nt, Human
cucuccucgcuguccccucucuguagugacug

SEQ ID NO: 399575 - RNA, 32 nt, Human
cucuccucgugcuucaaaaugacaggaauccu

SEQ ID NO: 399576 - RNA, 32 nt, Human
cucuccucguuucucuccuuccuuccuuucca

SEQ ID NO: 399577 - RNA, 32 nt, Human
cucuccucguuucucucuuacuccucauccuc

SEQ ID NO: 399578 - RNA, 32 nt, Human
cucuccucuccccucccugccccuugccucac

SEQ ID NO: 399579 - RNA, 32 nt, Human
cucuccucuccccucccuugcuuuccccagag

SEQ ID NO: 399580 - RNA, 32 nt, Human
cucuccucuccgcuucucucccccucugucuc

SEQ ID NO: 399581 - RNA, 32 nt, Human
cucuccucuccucaggcucaauaauuccaugg

SEQ ID NO: 399582 - RNA, 32 nt, Human
cucuccucuccucauucccaacccaaacucag

SEQ ID NO: 399583 - RNA, 32 nt, Human
cucuccucuccuccucugugcuccugucccuc

SEQ ID NO: 399584 - RNA, 32 nt, Human
cucuccucuccuccuuccugucuccucucucu

SEQ ID NO: 399585 - RNA, 32 nt, Human
cucuccucuccuccuucugcuuaauuuaccuu

SEQ ID NO: 399586 - RNA, 32 nt, Human
cucuccucuccuccuugucuggcucuguugac

SEQ ID NO: 399587 - RNA, 32 nt, Human
cucuccucucucccucucccucucccucucug

SEQ ID NO: 399588 - RNA, 32 nt, Human
cucuccucucucuaccccuccugucucuccuc

SEQ ID NO: 399589 - RNA, 32 nt, Human
cucuccucucucuuccucuccucucucuaccc

SEQ ID NO: 399590 - RNA, 32 nt, Human
cucuccucugcuaguccugauuuggaaacagu

SEQ ID NO: 399591 - RNA, 32 nt, Human
cucuccucuggccccucuggcuuuguuuggag

SEQ ID NO: 399592 - RNA, 32 nt, Human
cucuccucuuagcuggcuccagugcccagacc

SEQ ID NO: 399593 - RNA, 32 nt, Human
cucuccucuuccuuccccaacaauguaguuuu

SEQ ID NO: 399594 - RNA, 32 nt, Human
cucuccucuuuaugcucguguuucuggaggag

SEQ ID NO: 399595 - RNA, 32 nt, Human
cucuccugaaaauguuggcauaguaaauaaaa

SEQ ID NO: 399596 - RNA, 32 nt, Human
cucuccugacucuguguuuccuacaauucuac

SEQ ID NO: 399597 - RNA, 32 nt, Human
cucuccugagaugucaggaaggagggggccac

SEQ ID NO: 399598 - RNA, 32 nt, Human
cucuccugagauuguagcaggcagccaaacau

SEQ ID NO: 399599 - RNA, 32 nt, Human
cucuccugagccugucucucccuacccucuuc

SEQ ID NO: 399600 - RNA, 19 nt, Human
cucuccugaggaccucucu

SEQ ID NO: 399601 - RNA, 23 nt, Human
cucuccugaggaccucucuguca

SEQ ID NO: 399602 - RNA, 32 nt, Human
cucuccugagggccugaagagaacaaaaggca

SEQ ID NO: 399603 - RNA, 32 nt, Human
cucuccugagggggaauccuggugcucaaauu

SEQ ID NO: 399604 - RNA, 32 nt, Human
cucuccugaggggugagccaagcccugccaug

SEQ ID NO: 399605 - RNA, 32 nt, Human
cucuccugcaaggcagcucauacuuguacugu

SEQ ID NO: 399606 - RNA, 32 nt, Human
cucuccugcaccucccuggcccugccggccac

SEQ ID NO: 399607 - RNA, 32 nt, Human
cucuccugcaugccuggggcucuugggaucug

SEQ ID NO: 399608 - RNA, 32 nt, Human
cucuccugcccaggggcuagagagcagucucc

SEQ ID NO: 399609 - RNA, 32 nt, Human
cucuccugcccucugcucugccuggagugucg

SEQ ID NO: 399610 - RNA, 32 nt, Human
cucuccugcccuggccccggccccuccugcca

SEQ ID NO: 399611 - RNA, 32 nt, Human
cucuccugcccuuagggacaugcggcuaucaa

SEQ ID NO: 399612 - RNA, 22 nt, Human
cucuccugcccuuucuccucuu

SEQ ID NO: 399613 - RNA, 32 nt, Human
cucuccugccgucaucacuauggcaggaaaac

SEQ ID NO: 399614 - RNA, 21 nt, Human
cucuccugccucagccucccu

SEQ ID NO: 399615 - RNA, 20 nt, Human
cucuccugccucagccuccu

SEQ ID NO: 399616 - RNA, 31 nt, Human
cucuccugccucucuguuucuccaucuccuc

SEQ ID NO: 399617 - RNA, 21 nt, Human
cucuccugcguccuucuguca

SEQ ID NO: 399618 - RNA, 20 nt, Human
cucuccugcuagccaucucu

SEQ ID NO: 399619 - RNA, 32 nt, Human
cucuccugcugcucggguucugaggcacagcu

SEQ ID NO: 399620 - RNA, 32 nt, Human
cucuccuggacugccuugaauauccccuccca

SEQ ID NO: 399621 - RNA, 32 nt, Human
cucuccuggagcuguucuggucucagaggcuu

SEQ ID NO: 399622 - RNA, 32 nt, Human
cucuccuggccacauccuaugcuccacauuac

SEQ ID NO: 399623 - RNA, 32 nt, Human
cucuccuggccccuuuucacggauggggaauc

SEQ ID NO: 399624 - RNA, 32 nt, Human
cucuccuggccgccaaaccccagcuggaacuc

SEQ ID NO: 399625 - RNA, 32 nt, Human
cucuccuggccuggccuggcuguggagaaccg

SEQ ID NO: 399626 - RNA, 32 nt, Human
cucuccuggcgaggcuggcaagugggguccca

SEQ ID NO: 399627 - RNA, 32 nt, Human
cucuccugggcccucauuccgggcaggucccc

SEQ ID NO: 399628 - RNA, 32 nt, Human
cucuccugggcccuuccuuaggucaguaauug

SEQ ID NO: 399629 - RNA, 32 nt, Human
cucuccugggcucaggcgcuucucccaccuug

SEQ ID NO: 399630 - RNA, 32 nt, Human
cucuccugggcucuuccaggagcauugaacac

SEQ ID NO: 399631 - RNA, 32 nt, Human
cucuccugggcugucuuuuucuccagcagacc

SEQ ID NO: 399632 - RNA, 17 nt, Human
cucuccugggcuucuca

SEQ ID NO: 399633 - RNA, 32 nt, Human
cucuccuggggccuggcuuuggcuggaggggc

SEQ ID NO: 399634 - RNA, 32 nt, Human
cucuccugucucccacccccugccccagaccc

SEQ ID NO: 399635 - RNA, 32 nt, Human
cucuccuguggcagagacggagaagaugaaca

SEQ ID NO: 399636 - RNA, 32 nt, Human
cucuccugugugucugugacccugugcgcugu

SEQ ID NO: 399637 - RNA, 32 nt, Human
cucuccuuagggagcucgaguccuggugggga

SEQ ID NO: 399638 - RNA, 32 nt, Human
cucuccuuagugccuagcugugcaauguuugc

SEQ ID NO: 399639 - RNA, 21 nt, Human
cucuccuucagggaaaauguu

SEQ ID NO: 399640 - RNA, 32 nt, Human
cucuccuucaugacagccuccaccccacaacc

SEQ ID NO: 399641 - RNA, 32 nt, Human
cucuccuuccaagucuuuagaggaagguacua

SEQ ID NO: 399642 - RNA, 32 nt, Human
cucuccuucccaagcccccuuccuucauccuu

SEQ ID NO: 399643 - RNA, 32 nt, Human
cucuccuucccuccaccugggcucggagucag

SEQ ID NO: 399644 - RNA, 32 nt, Human
cucuccuucccuccuucccuccuuccuuccuu

SEQ ID NO: 399645 - RNA, 32 nt, Human
cucuccuuccuucuucccuugaucucccucuu

SEQ ID NO: 399646 - RNA, 32 nt, Human
cucuccuucucagcggugugauggcagaugga

SEQ ID NO: 399647 - RNA, 32 nt, Human
cucuccuucuucuuccugcuguccugcccaag

SEQ ID NO: 399648 - RNA, 32 nt, Human
cucuccuucuuucuccuucaagguucuuuccc

SEQ ID NO: 399649 - RNA, 32 nt, Human
cucuccuugacagcauccaggaaagguaauua

SEQ ID NO: 399650 - RNA, 32 nt, Human
cucuccuugcagcugcuuagacgcuggauuuu

SEQ ID NO: 399651 - RNA, 32 nt, Human
cucuccuugccagcuucuccccaggccagagc

SEQ ID NO: 399652 - RNA, 32 nt, Human
cucuccuuggauaccugauauuuuauuucaag

SEQ ID NO: 399653 - RNA, 32 nt, Human
cucuccuuguguguuuuuggagaagaugggca

SEQ ID NO: 399654 - RNA, 32 nt, Human
cucuccuuucaggcccuacuggacaggugaug

SEQ ID NO: 399655 - RNA, 32 nt, Human
cucuccuuuccaggagccccaggauuagcauc

SEQ ID NO: 399656 - RNA, 32 nt, Human
cucuccuuuccuuccucauccccaccuggucc

SEQ ID NO: 399657 - RNA, 32 nt, Human
cucuccuuuccuuucccugccuggagccuucu

SEQ ID NO: 399658 - RNA, 32 nt, Human
cucuccuuucucucuucucuuccuuccucucc

SEQ ID NO: 399659 - RNA, 22 nt, Human
cucuccuuucuuccucuugccu

SEQ ID NO: 399660 - RNA, 32 nt, Human
cucuccuuugccugcgcaggaauucuaacagg

SEQ ID NO: 399661 - RNA, 22 nt, Human
cucuccuuuucacuucuugccu

SEQ ID NO: 399662 - RNA, 32 nt, Human
cucuccuuuuccaggcugcugaguaaagucug

SEQ ID NO: 399663 - RNA, 32 nt, Human
cucuccuuuucccucuuacccucucucucuua

SEQ ID NO: 399664 - RNA, 32 nt, Human
cucuccuuuucuuccuccucuuccaacuccuu

SEQ ID NO: 399665 - RNA, 32 nt, Human
cucucgaagccuuccuguagagugaggugggu

SEQ ID NO: 399666 - RNA, 32 nt, Human
cucucgaagugcugggauuccaggcgugagcc

SEQ ID NO: 399667 - RNA, 20 nt, Human
cucucgacuccagagaccug

SEQ ID NO: 399668 - RNA, 32 nt, Human
cucucgacuuaaccaccucuucagguggccag

SEQ ID NO: 399669 - RNA, 32 nt, Human
cucucgagcagcugggauuacagguaugcgcc

SEQ ID NO: 399670 - RNA, 20 nt, Human
cucucgagccacgcgcgcuc

SEQ ID NO: 399671 - RNA, 32 nt, Human
cucucgaguagaugggauuauaggcaugugcc

SEQ ID NO: 399672 - RNA, 32 nt, Human
cucucgaguagcuaggauuacaggcaugcacc

SEQ ID NO: 399673 - RNA, 32 nt, Human
cucucgaguagcugggauuacaggcaccugcc

SEQ ID NO: 399674 - RNA, 32 nt, Human
cucucgaguagcugggauuacaggcaugcacc

SEQ ID NO: 399675 - RNA, 32 nt, Human
cucucgaguagcugggauuacaggcaugcgcc

SEQ ID NO: 399676 - RNA, 32 nt, Human
cucucgaguagcugggauuacaggcgcaugcc

SEQ ID NO: 399677 - RNA, 32 nt, Human
cucucgaguagcugggauuauaggcguccgcc

SEQ ID NO: 399678 - RNA, 32 nt, Human
cucucgaguggcugggauuacaggcauccgcc

SEQ ID NO: 399679 - RNA, 26 nt, Human
cucucgccacgacgguccccauucca

SEQ ID NO: 399680 - RNA, 23 nt, Human
cucucgccaggcuggaguguagu

SEQ ID NO: 399681 - RNA, 32 nt, Human
cucucgccaugguuggagugcaguggugcgau

SEQ ID NO: 399682 - RNA, 32 nt, Human
cucucgcccaggcuagagugcaguggcaugau

SEQ ID NO: 399683 - RNA, 22 nt, Human
cucucgcccaggcuggagugca

SEQ ID NO: 399684 - RNA, 32 nt, Human
cucucgcccaggcuggagugcaacgguacgau

SEQ ID NO: 399685 - RNA, 24 nt, Human
cucucgcccaggcuggagugcagu

SEQ ID NO: 399686 - RNA, 32 nt, Human
cucucgcccaggcuggagugcaguggcgugau

SEQ ID NO: 399687 - RNA, 32 nt, Human
cucucgcccaggcuggagugcagugggugggg

SEQ ID NO: 399688 - RNA, 32 nt, Human
cucucgcccaggcuggagugcaguggugcgac

SEQ ID NO: 399689 - RNA, 32 nt, Human
cucucgcccaggcuggagugcaguggugucau

SEQ ID NO: 399690 - RNA, 32 nt, Human
cucucgcccaggcuggagugcaguggugugau

SEQ ID NO: 399691 - RNA, 32 nt, Human
cucucgccgccgccuccacagccugggccucg

SEQ ID NO: 399692 - RNA, 32 nt, Human
cucucgccucaccccggcuccugggcuuugau

SEQ ID NO: 399693 - RNA, 32 nt, Human
cucucgccuguaaucccagcacuuugggaggc

SEQ ID NO: 399694 - RNA, 32 nt, Human
cucucgccuguaaucucagcacuuugggaggc

SEQ ID NO: 399695 - RNA, 32 nt, Human
cucucgcggccgcggcggcagcagcagcgcca

SEQ ID NO: 399696 - RNA, 32 nt, Human
cucucgcuccauccucccaagagccuccaagg

SEQ ID NO: 399697 - RNA, 32 nt, Human
cucucgcuccugcuggcuggacauggaggauu

SEQ ID NO: 399698 - RNA, 32 nt, Human
cucucgcugcagcuggagcugcaggucucgcc

SEQ ID NO: 399699 - RNA, 32 nt, Human
cucucgcugcucauguacggcugccugggggc

SEQ ID NO: 399700 - RNA, 32 nt, Human
cucucgcugucccugugcugcugguauuucau

SEQ ID NO: 399701 - RNA, 32 nt, Human
cucucgcuuugauauucuuaaauuccuaggua

SEQ ID NO: 399702 - RNA, 32 nt, Human
cucucggacccagggcugcacuuccaaugcuc

SEQ ID NO: 399703 - RNA, 32 nt, Human
cucucggagaaacccuguccacccaaccccga

SEQ ID NO: 399704 - RNA, 32 nt, Human
cucucggauucaaccgauucuugugccucagc

SEQ ID NO: 399705 - RNA, 32 nt, Human
cucucggcaccaguugaccuacugagaacaga

SEQ ID NO: 399706 - RNA, 31 nt, Human
cucucggccacuugcucuaugccaagcucca

SEQ ID NO: 399707 - RNA, 32 nt, Human
cucucggccccucugcuggcguccccggagcc

SEQ ID NO: 399708 - RNA, 20 nt, Human
cucucggccgggugcagugg

SEQ ID NO: 399709 - RNA, 32 nt, Human
cucucggccucggugaauuccaucucuuccau

SEQ ID NO: 399710 - RNA, 32 nt, Human
cucucggcucacugcaaccucugccucccagg

SEQ ID NO: 399711 - RNA, 32 nt, Human
cucucggcuccuccuccuccucccggcggugg

SEQ ID NO: 399712 - RNA, 32 nt, Human
cucucgggccagggagguugaggcugcaguga

SEQ ID NO: 399713 - RNA, 32 nt, Human
cucucgggcccaucugcgucugaggcugggag

SEQ ID NO: 399714 - RNA, 32 nt, Human
cucucggggcugggcuggggccgcucuuggcc

SEQ ID NO: 399715 - RNA, 32 nt, Human
cucucggggcuggggguucauuccuggggcac

SEQ ID NO: 399716 - RNA, 32 nt, Human
cucucgggggacgggggacagagccagggcuc

SEQ ID NO: 399717 - RNA, 32 nt, Human
cucucgggucuccuccuccucguuugcugccu

SEQ ID NO: 399718 - RNA, 32 nt, Human
cucucggguuagagcuuuuccacccacuucuc

SEQ ID NO: 399719 - RNA, 32 nt, Human
cucucggugagguugggagaaggaaaaggcuu

SEQ ID NO: 399720 - RNA, 32 nt, Human
cucucggugcagaugcacccugaaaacugacc

SEQ ID NO: 399721 - RNA, 32 nt, Human
cucucgguuccucuuuccucccaaguaaggga

SEQ ID NO: 399722 - RNA, 32 nt, Human
cucucgucacugggcucuguuuucacuguucg

SEQ ID NO: 399723 - RNA, 32 nt, Human
cucucgucgcccaggcuggaaugcaguggugc

SEQ ID NO: 399724 - RNA, 32 nt, Human
cucucgucuccagccagcaccaagaggauggu

SEQ ID NO: 399725 - RNA, 32 nt, Human
cucucgucuccuccccuccuucuugucacugg

SEQ ID NO: 399726 - RNA, 32 nt, Human
cucucgugcaggcguuugcagugugcagcuga

SEQ ID NO: 399727 - RNA, 32 nt, Human
cucucgugccagcugcuccgccuguccugccc

SEQ ID NO: 399728 - RNA, 32 nt, Human
cucucguggaaacagcacacagcaagcaacca

SEQ ID NO: 399729 - RNA, 32 nt, Human
cucucguuaccuuucuucuauaccuuggccuc

SEQ ID NO: 399730 - RNA, 32 nt, Human
cucucguucugucacccaggcuggagugcagu

SEQ ID NO: 399731 - RNA, 32 nt, Human
cucucguugccaaggcuggagugcaauggcac

SEQ ID NO: 399732 - RNA, 32 nt, Human
cucucguugcccaggcuggagugcaauggcgc

SEQ ID NO: 399733 - RNA, 32 nt, Human
cucucguugccgaggcuggaguguaguagugu

SEQ ID NO: 399734 - RNA, 32 nt, Human
cucucuaaaugcugggauugcaggcgugagcc

SEQ ID NO: 399735 - RNA, 32 nt, Human
cucucuaacccgagcuagagugcagugacgcg

SEQ ID NO: 399736 - RNA, 32 nt, Human
cucucuaagagagguugggaccaggcuagguu

SEQ ID NO: 399737 - RNA, 32 nt, Human
cucucuacacagagugguggggagacaaggag

SEQ ID NO: 399738 - RNA, 32 nt, Human
cucucuacauuaaagguauggaaggcgauagg

SEQ ID NO: 399739 - RNA, 32 nt, Human
cucucuagaggcaccuggcggggagccucuca

SEQ ID NO: 399740 - RNA, 32 nt, Human
cucucuagccuaucuuuugcuguagucacuuc

SEQ ID NO: 399741 - RNA, 32 nt, Human
cucucuagcuacucaagggagggggauguggg

SEQ ID NO: 399742 - RNA, 32 nt, Human
cucucuaggccauccccucuucuaccuccugc

SEQ ID NO: 399743 - RNA, 32 nt, Human
cucucuagugaauuugcuaacugugaagaaca

SEQ ID NO: 399744 - RNA, 32 nt, Human
cucucuauagccaugagacuccuuguggccuc

SEQ ID NO: 399745 - RNA, 32 nt, Human
cucucuaucuguguacuuccaccaugcuccag

SEQ ID NO: 399746 - RNA, 23 nt, Human
cucucuauggaaauaaaaaggaa

SEQ ID NO: 399747 - RNA, 32 nt, Human
cucucucaauauguccuaguuuucuucagccu

SEQ ID NO: 399748 - RNA, 32 nt, Human
cucucucaauccauaauccagcgaugcugcag

SEQ ID NO: 399749 - RNA, 32 nt, Human
cucucucacccaggccugaagugcaguggcau

SEQ ID NO: 399750 - RNA, 32 nt, Human
cucucucacccaggcuggaguagagugacaau

SEQ ID NO: 399751 - RNA, 32 nt, Human
cucucucacccaggcuggaguggaguggcgcu

SEQ ID NO: 399752 - RNA, 32 nt, Human
cucucucacccaggcuggaguguaagugacau

SEQ ID NO: 399753 - RNA, 32 nt, Human
cucucucagacucaguggacuguuuccuaaag

SEQ ID NO: 399754 - RNA, 32 nt, Human
cucucucagauaugugccugauauuuugugga

SEQ ID NO: 399755 - RNA, 32 nt, Human
cucucucauaccaacagaacuuccgguacuuc

SEQ ID NO: 399756 - RNA, 32 nt, Human
cucucucaucacagcuugugacucuuccacuu

SEQ ID NO: 399757 - RNA, 32 nt, Human
cucucucauuucccuucuccuucucccucagu

SEQ ID NO: 399758 - RNA, 32 nt, Human
cucucuccacccccucuccaacacuggccccu

SEQ ID NO: 399759 - RNA, 32 nt, Human
cucucuccaccgccuccucuggcuccccgguc

SEQ ID NO: 399760 - RNA, 32 nt, Human
cucucuccacucuuuccugggcucggggcauc

SEQ ID NO: 399761 - RNA, 32 nt, Human
cucucuccacugccaccucccuuguccccagu

SEQ ID NO: 399762 - RNA, 23 nt, Human
cucucuccagcaauagcugccca

SEQ ID NO: 399763 - RNA, 32 nt, Human
cucucuccaucucuauaccccucucucucaca

SEQ ID NO: 399764 - RNA, 32 nt, Human
cucucuccauuccccucugccuggugagccuu

SEQ ID NO: 399765 - RNA, 32 nt, Human
cucucucccccucaccauccccaaauuuuagu

SEQ ID NO: 399766 - RNA, 32 nt, Human
cucucuccccgguacgugacgagacuccacgg

SEQ ID NO: 399767 - RNA, 32 nt, Human
cucucuccccuaucacccccagccuggacacc

SEQ ID NO: 399768 - RNA, 32 nt, Human
cucucuccccuccccuccccuccccuccucuc

SEQ ID NO: 399769 - RNA, 32 nt, Human
cucucuccccucucucuccaucccuuccuucc

SEQ ID NO: 399770 - RNA, 32 nt, Human
cucucucccgccccuccuccucccuuucccac

SEQ ID NO: 399771 - RNA, 32 nt, Human
cucucucccuaaggcucccuuaagacucuagg

SEQ ID NO: 399772 - RNA, 32 nt, Human
cucucucccuccacucagcucccagcugccgg

SEQ ID NO: 399773 - RNA, 32 nt, Human
cucucucccucccucuugcucucccucccuuu

SEQ ID NO: 399774 - RNA, 32 nt, Human
cucucucccucugggcuggagcucagugaggg

SEQ ID NO: 399775 - RNA, 32 nt, Human
cucucucccugccaucaagcagccugccccag

SEQ ID NO: 399776 - RNA, 32 nt, Human
cucucucccuuucucacugcuucaccuuccca

SEQ ID NO: 399777 - RNA, 32 nt, Human
cucucucccuuucucccuccauccuuccacuu

SEQ ID NO: 399778 - RNA, 32 nt, Human
cucucucccuuucuuuccuucucuccuccuuu

SEQ ID NO: 399779 - RNA, 32 nt, Human
cucucucccuuucuuucucccagcuuugccuc

SEQ ID NO: 399780 - RNA, 32 nt, Human
cucucucccuuucuuuguuuuucuuucuuuuu

SEQ ID NO: 399781 - RNA, 32 nt, Human
cucucuccgucucuccuccccucucucucuuc

SEQ ID NO: 399782 - RNA, 32 nt, Human
cucucuccuaucuuucccucagucucccaagu

SEQ ID NO: 399783 - RNA, 32 nt, Human
cucucuccuccacugacuuccccuucccggau

SEQ ID NO: 399784 - RNA, 32 nt, Human
cucucuccuccccuccuuccucucuccucccc

SEQ ID NO: 399785 - RNA, 32 nt, Human
cucucuccuccccuccuuccucucuccucucc

SEQ ID NO: 399786 - RNA, 32 nt, Human
cucucuccuccccuucccuucucccaucucug

SEQ ID NO: 399787 - RNA, 19 nt, Human
cucucuccuccucaugcca

SEQ ID NO: 399788 - RNA, 32 nt, Human
cucucuccuccuccucccggcacgaccuggcc

SEQ ID NO: 399789 - RNA, 32 nt, Human
cucucuccuccuccuccuccgccgccggacac

SEQ ID NO: 399790 - RNA, 32 nt, Human
cucucuccuccuccuuccccauugcuguaaau

SEQ ID NO: 399791 - RNA, 32 nt, Human
cucucuccucuccucucucuucuccucuucuc

SEQ ID NO: 399792 - RNA, 32 nt, Human
cucucuccucuccuuugagaggucccuguguc

SEQ ID NO: 399793 - RNA, 32 nt, Human
cucucuccugaagccauuggccgcuccuccac

SEQ ID NO: 399794 - RNA, 32 nt, Human
cucucuccugccugcccugccucagccaggcc

SEQ ID NO: 399795 - RNA, 32 nt, Human
cucucuccuggugccugcaccugcacucuagu

SEQ ID NO: 399796 - RNA, 32 nt, Human
cucucuccuguuucccuucccuuccacugccu

SEQ ID NO: 399797 - RNA, 32 nt, Human
cucucuccuuccucccccuuuuauccuaccuc

SEQ ID NO: 399798 - RNA, 32 nt, Human
cucucuccuuccuuguuggagaugucuuaccu

SEQ ID NO: 399799 - RNA, 32 nt, Human
cucucuccuugacuccaaaggccagccugggu

SEQ ID NO: 399800 - RNA, 32 nt, Human
cucucuccuugccccuaacccaaaaagcuuca

SEQ ID NO: 399801 - RNA, 32 nt, Human
cucucuccuuucuccuccggcagccagcgcgc

SEQ ID NO: 399802 - RNA, 32 nt, Human
cucucuccuuuuccuuuuccuccucucuuccu

SEQ ID NO: 399803 - RNA, 32 nt, Human
cucucucgaccuucugguaucuuguuagagag

SEQ ID NO: 399804 - RNA, 32 nt, Human
cucucucgccaugguuggagugcaguggugcg

SEQ ID NO: 399805 - RNA, 32 nt, Human
cucucucgcccaggcuggagugcaacgguacg

SEQ ID NO: 399806 - RNA, 32 nt, Human
cucucucgcccaggcuggagugcaguggcgug

SEQ ID NO: 399807 - RNA, 32 nt, Human
cucucucgcccaggcuggagugcaguggugcg

SEQ ID NO: 399808 - RNA, 32 nt, Human
cucucucgcccaggcuggagugcaguggugug

SEQ ID NO: 399809 - RNA, 32 nt, Human
cucucucgcuggcaaaaguaugaucuaauuga

SEQ ID NO: 399810 - RNA, 32 nt, Human
cucucucggaggccauagaggcuggggguagc

SEQ ID NO: 399811 - RNA, 32 nt, Human
cucucucgggggaaccggacagcagcuuggca

SEQ ID NO: 399812 - RNA, 32 nt, Human
cucucucucacccaggcuggaguggaguggcg

SEQ ID NO: 399813 - RNA, 32 nt, Human
cucucucuccacccuccuguucugucuguacc

SEQ ID NO: 399814 - RNA, 32 nt, Human
cucucucuccaccuccuccugccuuccccacc

SEQ ID NO: 399815 - RNA, 32 nt, Human
cucucucuccaucccuuccuuccucccuccuu

SEQ ID NO: 399816 - RNA, 32 nt, Human
cucucucuccaucucucucuuucagucucucu

SEQ ID NO: 399817 - RNA, 32 nt, Human
cucucucucccagaacugguugcagcuaaaac

SEQ ID NO: 399818 - RNA, 32 nt, Human
cucucucucccccucaccaaucucuuucuucc

SEQ ID NO: 399819 - RNA, 32 nt, Human
cucucucuccccucagcugagucccuucccug

SEQ ID NO: 399820 - RNA, 32 nt, Human
cucucucucccucucucucccucucucuuuac

SEQ ID NO: 399821 - RNA, 32 nt, Human
cucucucucccucucuuugccugcugccaucc

SEQ ID NO: 399822 - RNA, 32 nt, Human
cucucucuccuaccauaauccccaccgcuucc

SEQ ID NO: 399823 - RNA, 32 nt, Human
cucucucuccucaggcagcagcaacgcggagg

SEQ ID NO: 399824 - RNA, 32 nt, Human
cucucucucuacauaccagcagcauaccaaau

SEQ ID NO: 399825 - RNA, 32 nt, Human
cucucucucugccuccccaccagccccgacuc

SEQ ID NO: 399826 - RNA, 32 nt, Human
cucucucucugccucugcugccaggcagggaa

SEQ ID NO: 399827 - RNA, 32 nt, Human
cucucucucugucuguggcaggaggcaaagag

SEQ ID NO: 399828 - RNA, 32 nt, Human
cucucucucuucaagucccuggcaucccugga

SEQ ID NO: 399829 - RNA, 32 nt, Human
cucucucucuuccucugucucucccucucucu

SEQ ID NO: 399830 - RNA, 32 nt, Human
cucucucucuuccucuucucucucuuccccuc

SEQ ID NO: 399831 - RNA, 32 nt, Human
cucucucucuuccucuuucuucauucagaucu

SEQ ID NO: 399832 - RNA, 32 nt, Human
cucucucucuuuccuuccuuccuuccuccuuu

SEQ ID NO: 399833 - RNA, 32 nt, Human
cucucucucuuugaucccauaaagcuacgagg

SEQ ID NO: 399834 - RNA, 32 nt, Human
cucucucucuuuuaucauuucucccccgccgc

SEQ ID NO: 399835 - RNA, 32 nt, Human
cucucucucuuuuccuccuuuccuuuuucuuu

SEQ ID NO: 399836 - RNA, 32 nt, Human
cucucucugauagucacuucaaucaaauggaa

SEQ ID NO: 399837 - RNA, 32 nt, Human
cucucucugccacccaccgcccccaaucuauc

SEQ ID NO: 399838 - RNA, 32 nt, Human
cucucucugccucuaucccauucuuuuuacau

SEQ ID NO: 399839 - RNA, 32 nt, Human
cucucucugccuggccccaggcugcuuccacu

SEQ ID NO: 399840 - RNA, 32 nt, Human
cucucucugccuuccuugcauguggccaccag

SEQ ID NO: 399841 - RNA, 32 nt, Human
cucucucugcucccaccccugccgcccucacc

SEQ ID NO: 399842 - RNA, 32 nt, Human
cucucucugcucccauccugggucuccaugcu

SEQ ID NO: 399843 - RNA, 32 nt, Human
cucucucugcuccuccuucccuccaugcacca

SEQ ID NO: 399844 - RNA, 32 nt, Human
cucucucuggcccucacucuuacucucuugca

SEQ ID NO: 399845 - RNA, 32 nt, Human
cucucucuggcgacgccucccacccaccacua

SEQ ID NO: 399846 - RNA, 32 nt, Human
cucucucugggccucaucagaccaaaccaaag

SEQ ID NO: 399847 - RNA, 32 nt, Human
cucucucugucacccaggcuagagugcagugg

SEQ ID NO: 399848 - RNA, 32 nt, Human
cucucucugucacccaggcuggagugcaaugg

SEQ ID NO: 399849 - RNA, 32 nt, Human
cucucucugucacccaggcuggagugcagugg

SEQ ID NO: 399850 - RNA, 32 nt, Human
cucucucugucacccaggcuggcgugcaaugg

SEQ ID NO: 399851 - RNA, 32 nt, Human
cucucucugucccccaggcugaagugcagcgg

SEQ ID NO: 399852 - RNA, 32 nt, Human
cucucucugucucucuuucucucuuucuuucu

SEQ ID NO: 399853 - RNA, 32 nt, Human
cucucucuguggcccaggcugaagugcagugg

SEQ ID NO: 399854 - RNA, 32 nt, Human
cucucucuguuacccaggcuagagugcaaugg

SEQ ID NO: 399855 - RNA, 32 nt, Human
cucucucuguugcccaggcuggaguacaaugg

SEQ ID NO: 399856 - RNA, 32 nt, Human
cucucucuguugcccaggcuggagugcaaugg

SEQ ID NO: 399857 - RNA, 32 nt, Human
cucucucuguugcccaggcuggagugcagugg

SEQ ID NO: 399858 - RNA, 32 nt, Human
cucucucuguugcccaggcuggaguguagugg

SEQ ID NO: 399859 - RNA, 32 nt, Human
cucucucuuagcauccugccuuagagccaggc

SEQ ID NO: 399860 - RNA, 32 nt, Human
cucucucuugcccuaucucucuuucuacuuca

SEQ ID NO: 399861 - RNA, 32 nt, Human
cucucucuuucucucuuuucucccucuccuac

SEQ ID NO: 399862 - RNA, 32 nt, Human
cucucucuuuuauauacauacacacacccaaa

SEQ ID NO: 399863 - RNA, 32 nt, Human
cucucucuuuuccccucuugcuccuuucuuuu

SEQ ID NO: 399864 - RNA, 32 nt, Human
cucucugaaaguuggcuugagaguuguuguca

SEQ ID NO: 399865 - RNA, 32 nt, Human
cucucugaacugugaucuuuguccucaugaac

SEQ ID NO: 399866 - RNA, 32 nt, Human
cucucugaauccagacaaauacagcccuuuuc

SEQ ID NO: 399867 - RNA, 32 nt, Human
cucucugaaugagaggcgcguagagcuggaag

SEQ ID NO: 399868 - RNA, 32 nt, Human
cucucugaccucagugcugcuggacucaguuc

SEQ ID NO: 399869 - RNA, 32 nt, Human
cucucugacucugcugggauuggcuuucgcca

SEQ ID NO: 399870 - RNA, 32 nt, Human
cucucugacuguccuuugccugugccaagguu

SEQ ID NO: 399871 - RNA, 32 nt, Human
cucucugacuuuguacaugucaccucaauucu

SEQ ID NO: 399872 - RNA, 32 nt, Human
cucucugagcacaagcugggcaaaucacuguc

SEQ ID NO: 399873 - RNA, 32 nt, Human
cucucugagccaucuucugauuuuucauugcu

SEQ ID NO: 399874 - RNA, 32 nt, Human
cucucugagcucugcauuugucuauucuccag

SEQ ID NO: 399875 - RNA, 32 nt, Human
cucucugaggcggaggaugcgggagcgcaucu

SEQ ID NO: 399876 - RNA, 32 nt, Human
cucucugaggcucaagccagaaauucaggcug

SEQ ID NO: 399877 - RNA, 32 nt, Human
cucucugaguguacauacaacauacucaagcg

SEQ ID NO: 399878 - RNA, 32 nt, Human
cucucugaucaagacaccgcagugauggagaa

SEQ ID NO: 399879 - RNA, 32 nt, Human
cucucugauccuaaagccugagcuagaaacca

SEQ ID NO: 399880 - RNA, 32 nt, Human
cucucugaugcugggauggagccccagcccca

SEQ ID NO: 399881 - RNA, 32 nt, Human
cucucugcaacaaaaauccagucuuucaggaa

SEQ ID NO: 399882 - RNA, 32 nt, Human
cucucugcaaccuccaccuccuggguucaaga

SEQ ID NO: 399883 - RNA, 32 nt, Human
cucucugcaacuuccgccuccuggguucaagc

SEQ ID NO: 399884 - RNA, 19 nt, Human
cucucugcacacagcccca

SEQ ID NO: 399885 - RNA, 32 nt, Human
cucucugcacuccagccugggugacagagcaa

SEQ ID NO: 399886 - RNA, 21 nt, Human
cucucugcagaccucuuccca

SEQ ID NO: 399887 - RNA, 32 nt, Human
cucucugcagagccagagggcaggccggcuuc

SEQ ID NO: 399888 - RNA, 32 nt, Human
cucucugcagaggcaaagucuacuuucuggua

SEQ ID NO: 399889 - RNA, 32 nt, Human
cucucugcagccgugcccuuguggagucagca

SEQ ID NO: 399890 - RNA, 32 nt, Human
cucucugcauccauuccacucuccacucuugc

SEQ ID NO: 399891 - RNA, 32 nt, Human
cucucugcccaccucugcuuccucuaggaaca

SEQ ID NO: 399892 - RNA, 32 nt, Human
cucucugcccaggagucagaggugccuccagg

SEQ ID NO: 399893 - RNA, 32 nt, Human
cucucugccccacaguccucaggcuccagcuu

SEQ ID NO: 399894 - RNA, 32 nt, Human
cucucugcccgcacaucccucuuccagccugc

SEQ ID NO: 399895 - RNA, 32 nt, Human
cucucugcccuccagccuucuucaccaugucc

SEQ ID NO: 399896 - RNA, 32 nt, Human
cucucugccgaucucccugccugggcuggcug

SEQ ID NO: 399897 - RNA, 32 nt, Human
cucucugccuccagaggggauuuauuggaccu

SEQ ID NO: 399898 - RNA, 19 nt, Human
cucucugccuucugcccca

SEQ ID NO: 399899 - RNA, 20 nt, Human
cucucugcggggcucacucu

SEQ ID NO: 399900 - RNA, 32 nt, Human
cucucugcuacagcuucuuggcuggcucugaa

SEQ ID NO: 399901 - RNA, 32 nt, Human
cucucugcuaugggcaugacuuucucuucgcu

SEQ ID NO: 399902 - RNA, 32 nt, Human
cucucugcuauguuaugccgucauccagugca

SEQ ID NO: 399903 - RNA, 32 nt, Human
cucucugcucacauuucucucucccauuuucu

SEQ ID NO: 399904 - RNA, 32 nt, Human
cucucugcuccucacccccaccccuguaccca

SEQ ID NO: 399905 - RNA, 32 nt, Human
cucucugcucuccccaggauggggucagagga

SEQ ID NO: 399906 - RNA, 32 nt, Human
cucucugcucugcuucuccuccugccgcugac

SEQ ID NO: 399907 - RNA, 32 nt, Human
cucucugcuuuuccugucugacucugacaagu

SEQ ID NO: 399908 - RNA, 32 nt, Human
cucucuggaacaugaggugaggccccagaaac

SEQ ID NO: 399909 - RNA, 32 nt, Human
cucucuggaagagaaaggaagagccagcaguu

SEQ ID NO: 399910 - RNA, 19 nt, Human
cucucuggaaggagacuga

SEQ ID NO: 399911 - RNA, 32 nt, Human
cucucuggaagguggcccugcccggacccucu

SEQ ID NO: 399912 - RNA, 32 nt, Human
cucucuggaccagcucgggugcagggccucug

SEQ ID NO: 399913 - RNA, 32 nt, Human
cucucuggauucauauuucuucaucugucaaa

SEQ ID NO: 399914 - RNA, 32 nt, Human
cucucuggauuccauagcuggaaucuccucuc

SEQ ID NO: 399915 - RNA, 32 nt, Human
cucucuggauuuccuuuugcuucauuauuccu

SEQ ID NO: 399916 - RNA, 32 nt, Human
cucucuggcagggccccauccugggcagaggg

SEQ ID NO: 399917 - RNA, 32 nt, Human
cucucuggccacucugcucugcacauuagagg

SEQ ID NO: 399918 - RNA, 32 nt, Human
cucucuggcccaagcuggagugcaguggcacg

SEQ ID NO: 399919 - RNA, 32 nt, Human
cucucuggcggccucugcagcagcacagccgg

SEQ ID NO: 399920 - RNA, 32 nt, Human
cucucuggcucaaugaucuacauucugaaguu

SEQ ID NO: 399921 - RNA, 32 nt, Human
cucucuggcugcccucugcucuuuucaucucu

SEQ ID NO: 399922 - RNA, 20 nt, Human
cucucuggcugggugcagug

SEQ ID NO: 399923 - RNA, 32 nt, Human
cucucuggcuuugggcggcaggucccugcacc

SEQ ID NO: 399924 - RNA, 32 nt, Human
cucucugggaggcagaugggagccauggcuua

SEQ ID NO: 399925 - RNA, 32 nt, Human
cucucugggaggcugaggcggguggaucacuu

SEQ ID NO: 399926 - RNA, 32 nt, Human
cucucugggauuccggacuggcuucgcccaac

SEQ ID NO: 399927 - RNA, 32 nt, Human
cucucugggcuggaggugggggugggggcagc

SEQ ID NO: 399928 - RNA, 32 nt, Human
cucucugggcuucaguugucucauucuguaaa

SEQ ID NO: 399929 - RNA, 32 nt, Human
cucucugggcuucaguuuccuccuugcuccau

SEQ ID NO: 399930 - RNA, 32 nt, Human
cucucugggcuuuguugaggcggcaguaugac

SEQ ID NO: 399931 - RNA, 32 nt, Human
cucucuggggccaaggccagagcuguggacac

SEQ ID NO: 399932 - RNA, 32 nt, Human
cucucuggggccucuuuaaauagggucaccaa

SEQ ID NO: 399933 - RNA, 32 nt, Human
cucucugggggaggcagggcuggaaugggaga

SEQ ID NO: 399934 - RNA, 31 nt, Human
cucucugggguaaauaccuggaaguggaaug

SEQ ID NO: 399935 - RNA, 32 nt, Human
cucucugggucucaguuucuucaucugggaaa

SEQ ID NO: 399936 - RNA, 32 nt, Human
cucucuggucccagacugccuccuugcccaug

SEQ ID NO: 399937 - RNA, 32 nt, Human
cucucuggucuucucccaggcuggaucugggc

SEQ ID NO: 399938 - RNA, 31 nt, Human
cucucugguucccagcaccugccugagaccu

SEQ ID NO: 399939 - RNA, 32 nt, Human
cucucuguacacugccccaggacugucauuuu

SEQ ID NO: 399940 - RNA, 32 nt, Human
cucucuguaccaacaauauacagacuuuacag

SEQ ID NO: 399941 - RNA, 32 nt, Human
cucucuguagccaggcuggagggcaauuguac

SEQ ID NO: 399942 - RNA, 32 nt, Human
cucucugucaccaggcuguauuacaguggugc

SEQ ID NO: 399943 - RNA, 32 nt, Human
cucucugucacccaaguuggagugcaguggcc

SEQ ID NO: 399944 - RNA, 32 nt, Human
cucucugucacccaggcuagagugcaguggag

SEQ ID NO: 399945 - RNA, 32 nt, Human
cucucugucacccaggcuggagugcaauggcg

SEQ ID NO: 399946 - RNA, 32 nt, Human
cucucugucacccaggcuggagugcaguggcg

SEQ ID NO: 399947 - RNA, 32 nt, Human
cucucugucacccaggcuggcgugcaauggcg

SEQ ID NO: 399948 - RNA, 32 nt, Human
cucucugucacccagguuggagugcaguggug

SEQ ID NO: 399949 - RNA, 32 nt, Human
cucucugucaccuaggcuggagggcaggguug

SEQ ID NO: 399950 - RNA, 32 nt, Human
cucucugucaccuaggcuggagugcaguggca

SEQ ID NO: 399951 - RNA, 32 nt, Human
cucucugucacugucuugaaucagacucagaa

SEQ ID NO: 399952 - RNA, 32 nt, Human
cucucugucaucugggcugcagugcaguggug

SEQ ID NO: 399953 - RNA, 32 nt, Human
cucucugucccccaggcugaagugcagcggca

SEQ ID NO: 399954 - RNA, 32 nt, Human
cucucugucccucaccucaccugcuuucuuca

SEQ ID NO: 399955 - RNA, 32 nt, Human
cucucuguccuuccaccccucccuccuugcuu

SEQ ID NO: 399956 - RNA, 32 nt, Human
cucucugucgccaggcuggaaugcagugcagu

SEQ ID NO: 399957 - RNA, 32 nt, Human
cucucugucgcccaggcuggaguacaguggug

SEQ ID NO: 399958 - RNA, 32 nt, Human
cucucugucgcccaggcuggagugcaguggcu

SEQ ID NO: 399959 - RNA, 32 nt, Human
cucucugucucagcaggugaugacggggguac

SEQ ID NO: 399960 - RNA, 32 nt, Human
cucucugucuccgaggcuggagugcaauguug

SEQ ID NO: 399961 - RNA, 32 nt, Human
cucucugucucucuuucucuccuuuuaauuuu

SEQ ID NO: 399962 - RNA, 32 nt, Human
cucucugucuucagggagcuccacccagcagc

SEQ ID NO: 399963 - RNA, 32 nt, Human
cucucugucuucauguggaagguuuagagcag

SEQ ID NO: 399964 - RNA, 32 nt, Human
cucucugucuuuucccuguugaucuccuguua

SEQ ID NO: 399965 - RNA, 32 nt, Human
cucucugugcagccucacagggcuuugccacg

SEQ ID NO: 399966 - RNA, 32 nt, Human
cucucugugcuucaguuucccauggcuggaau

SEQ ID NO: 399967 - RNA, 32 nt, Human
cucucuguggcccaggcugaagugcaguggug

SEQ ID NO: 399968 - RNA, 32 nt, Human
cucucuguggcgacuuuucugccuucccuucu

SEQ ID NO: 399969 - RNA, 32 nt, Human
cucucuguggcuagcuagagguuucuaaaaug

SEQ ID NO: 399970 - RNA, 32 nt, Human
cucucuguggugaaagccaagcacacuuuccu

SEQ ID NO: 399971 - RNA, 32 nt, Human
cucucugugugccaugacauagcaggaaaggc

SEQ ID NO: 399972 - RNA, 31 nt, Human
cucucuguguugucugggcccuuguuuacaa

SEQ ID NO: 399973 - RNA, 32 nt, Human
cucucuguuacccaggcuagagugcaauggcg

SEQ ID NO: 399974 - RNA, 32 nt, Human
cucucuguugcccaggcuggaguacaauggcg

SEQ ID NO: 399975 - RNA, 32 nt, Human
cucucuguugcccaggcuggagugcaauggca

SEQ ID NO: 399976 - RNA, 32 nt, Human
cucucuguugcccaggcuggagugcaguggca

SEQ ID NO: 399977 - RNA, 32 nt, Human
cucucuguugcccaggcuggagugcaguggcg

SEQ ID NO: 399978 - RNA, 32 nt, Human
cucucuguugcccaggcuggaguguaguggug

SEQ ID NO: 399979 - RNA, 32 nt, Human
cucucuguuugguuuagaaauugcucaauaag

SEQ ID NO: 399980 - RNA, 32 nt, Human
cucucuuaaaguuuacauugcugaaccaagaa

SEQ ID NO: 399981 - RNA, 32 nt, Human
cucucuuaaugccacggcagccacccugccau

SEQ ID NO: 399982 - RNA, 32 nt, Human
cucucuuacccaagcuggagugcagugacaug

SEQ ID NO: 399983 - RNA, 32 nt, Human
cucucuuaccuugcccuuucuacucagaacca

SEQ ID NO: 399984 - RNA, 32 nt, Human
cucucuuaggacugcugacuugguuaugcagu

SEQ ID NO: 399985 - RNA, 32 nt, Human
cucucuuauaucagacugcagcuccuggugau

SEQ ID NO: 399986 - RNA, 32 nt, Human
cucucuuaucacugggcagacgaggagguggu

SEQ ID NO: 399987 - RNA, 32 nt, Human
cucucuuauuuggaguuuccguugguuuaccu

SEQ ID NO: 399988 - RNA, 32 nt, Human
cucucuuauuugguucuugggcugcuucauaa

SEQ ID NO: 399989 - RNA, 32 nt, Human
cucucuucaccccguuagcuguuuucaaugua

SEQ ID NO: 399990 - RNA, 32 nt, Human
cucucuucaccccuggaaaaacaaaugaucug

SEQ ID NO: 399991 - RNA, 32 nt, Human
cucucuucacugcaucccaauccaucuacagg

SEQ ID NO: 399992 - RNA, 32 nt, Human
cucucuucauuuccucguaaggccaccaaacc

SEQ ID NO: 399993 - RNA, 32 nt, Human
cucucuucauuuucuuucaucuacauggcuga

SEQ ID NO: 399994 - RNA, 32 nt, Human
cucucuuccaauauccaugucucauacacuau

SEQ ID NO: 399995 - RNA, 32 nt, Human
cucucuucccagagacccuccccacaucaugc

SEQ ID NO: 399996 - RNA, 32 nt, Human
cucucuucccagcuucccagagauaaucaacc

SEQ ID NO: 399997 - RNA, 24 nt, Human
cucucuuccccucccuaccgcuca

SEQ ID NO: 399998 - RNA, 32 nt, Human
cucucuuccccucccucacccccuuuuucuua

SEQ ID NO: 399999 - RNA, 32 nt, Human
cucucuucccuaaugcucuccauacccccugc

SEQ ID NO: 400000 - RNA, 32 nt, Human
cucucuucccuccccuccucuccccuccccuc

SEQ ID NO: 400001 - RNA, 21 nt, Human
cucucuuccuccagggacucu

SEQ ID NO: 400002 - RNA, 22 nt, Human
cucucuuccucccaucuucuca

SEQ ID NO: 400003 - RNA, 32 nt, Human
cucucuuccuccucuagacucuguguuuggua

SEQ ID NO: 400004 - RNA, 32 nt, Human
cucucuuccugccuccagcucugccccaggcu

SEQ ID NO: 400005 - RNA, 32 nt, Human
cucucuuccuuuccuggucucucuuccuuucc

SEQ ID NO: 400006 - RNA, 32 nt, Human
cucucuuccuuuggaugaggggguccuugggu

SEQ ID NO: 400007 - RNA, 24 nt, Human
cucucuucgacagggccccacccu

SEQ ID NO: 400008 - RNA, 22 nt, Human
cucucuucuaauccaccacuca

SEQ ID NO: 400009 - RNA, 32 nt, Human
cucucuucuaauuccuccugaccacaaaaagc

SEQ ID NO: 400010 - RNA, 32 nt, Human
cucucuucuaccgucuccgauuuccuuugucc

SEQ ID NO: 400011 - RNA, 32 nt, Human
cucucuucuccaccaagccucucaccugucug

SEQ ID NO: 400012 - RNA, 32 nt, Human
cucucuucuccaucacccauacccacacauac

SEQ ID NO: 400013 - RNA, 32 nt, Human
cucucuucuccucugguuugcguccuuccugg

SEQ ID NO: 400014 - RNA, 32 nt, Human
cucucuucucuccccucugucccucuucagga

SEQ ID NO: 400015 - RNA, 32 nt, Human
cucucuucucuccuggcuaaagcugcucuccu

SEQ ID NO: 400016 - RNA, 32 nt, Human
cucucuucucucuuccucuccucucucucuuc

SEQ ID NO: 400017 - RNA, 32 nt, Human
cucucuucugcucuccacucagaugugggaca

SEQ ID NO: 400018 - RNA, 32 nt, Human
cucucuucuggguggagcuggccgggaaguuu

SEQ ID NO: 400019 - RNA, 32 nt, Human
cucucuucuuacuucugucacucuuccuucuc

SEQ ID NO: 400020 - RNA, 32 nt, Human
cucucuucuugcuuggcagcuggaccaaggga

SEQ ID NO: 400021 - RNA, 32 nt, Human
cucucuucuuucucucugagggagagggagcc

SEQ ID NO: 400022 - RNA, 32 nt, Human
cucucuugacaucagaugggguauucgauauu

SEQ ID NO: 400023 - RNA, 32 nt, Human
cucucuugcaagucaucucucuugcaaauggu

SEQ ID NO: 400024 - RNA, 32 nt, Human
cucucuugcacgcucucucuucucucccaggc

SEQ ID NO: 400025 - RNA, 32 nt, Human
cucucuugcccagacuggaauacaguggugug

SEQ ID NO: 400026 - RNA, 32 nt, Human
cucucuugcccaggcuggagugcaauggcacg

SEQ ID NO: 400027 - RNA, 32 nt, Human
cucucuugcccaggcuggagugcagugguaug

SEQ ID NO: 400028 - RNA, 32 nt, Human
cucucuugccuuugaccaacaugguacuaagg

SEQ ID NO: 400029 - RNA, 22 nt, Human
cucucuugcucaauaacucuca

SEQ ID NO: 400030 - RNA, 32 nt, Human
cucucuugcuuccucucuuccucucucuguuc

SEQ ID NO: 400031 - RNA, 32 nt, Human
cucucuuggaaaguccagucucuccucggcuu

SEQ ID NO: 400032 - RNA, 32 nt, Human
cucucuugggacucucccccucccaggcauuu

SEQ ID NO: 400033 - RNA, 32 nt, Human
cucucuuguauauguggguuaaagacccucag

SEQ ID NO: 400034 - RNA, 32 nt, Human
cucucuuguccaaggcuggaguguaguagugc

SEQ ID NO: 400035 - RNA, 32 nt, Human
cucucuuguccaccuauuaauuguuuacaaua

SEQ ID NO: 400036 - RNA, 32 nt, Human
cucucuuguccaggcuggagugcaauagcgcg

SEQ ID NO: 400037 - RNA, 32 nt, Human
cucucuugucccacccuucuucucuuccccau

SEQ ID NO: 400038 - RNA, 32 nt, Human
cucucuuuccucuuuagaaauggcaguuacug

SEQ ID NO: 400039 - RNA, 32 nt, Human
cucucuuucucucucuuuuccucucucucccu

SEQ ID NO: 400040 - RNA, 32 nt, Human
cucucuuucucuuccucuucuuucucucucuu

SEQ ID NO: 400041 - RNA, 32 nt, Human
cucucuuugcaacugucucucuucucagagug

SEQ ID NO: 400042 - RNA, 22 nt, Human
cucucuuugccauuuuuggagg

SEQ ID NO: 400043 - RNA, 32 nt, Human
cucucuuugccucgcucccggcucggcgggcu

SEQ ID NO: 400044 - RNA, 32 nt, Human
cucucuuuucugagagagaaggcaugggauuu

SEQ ID NO: 400045 - RNA, 32 nt, Human
cucucuuuucuuuccaaauaucccaggaagug

SEQ ID NO: 400046 - RNA, 32 nt, Human
cucucuuuuucugcucucuccucucucagucu

SEQ ID NO: 400047 - RNA, 32 nt, Human
cucugaaaaacaugcccccgaggcucugugca

SEQ ID NO: 400048 - RNA, 32 nt, Human
cucugaaaacacaguggagguuguggugaagg

SEQ ID NO: 400049 - RNA, 32 nt, Human
cucugaaaacagccaacuaacagcgccuccca

SEQ ID NO: 400050 - RNA, 32 nt, Human
cucugaaaaccagccaacauugucaugacaau

SEQ ID NO: 400051 - RNA, 32 nt, Human
cucugaaaagcaaccucuccugccacccagau

SEQ ID NO: 400052 - RNA, 20 nt, Human
cucugaaaaggcagcagguu

SEQ ID NO: 400053 - RNA, 23 nt, Human
cucugaaacaggcauacaggcuc

SEQ ID NO: 400054 - RNA, 21 nt, Human
cucugaaacgagcaacagguu

SEQ ID NO: 400055 - RNA, 32 nt, Human
cucugaaacguccuuuucuucugagagcccag

SEQ ID NO: 400056 - RNA, 32 nt, Human
cucugaaagaaaaagaaagaaaugaagaaaag

SEQ ID NO: 400057 - RNA, 32 nt, Human
cucugaaagccagcuuauugccgacuacugag

SEQ ID NO: 400058 - RNA, 32 nt, Human
cucugaaagcugguugaaggagagcagcaaaa

SEQ ID NO: 400059 - RNA, 32 nt, Human
cucugaaaguacugggauuacaagcauaagcc

SEQ ID NO: 400060 - RNA, 32 nt, Human
cucugaaagugcugggaucacagacaugagcc

SEQ ID NO: 400061 - RNA, 32 nt, Human
cucugaaagugcugggauuacaggcgugagac

SEQ ID NO: 400062 - RNA, 32 nt, Human
cucugaaaucagcuuuggagaugcuuucacuc

SEQ ID NO: 400063 - RNA, 32 nt, Human
cucugaaaugcaccauugacuggagcaguaau

SEQ ID NO: 400064 - RNA, 24 nt, Human
cucugaaauugcugggauuacagg

SEQ ID NO: 400065 - RNA, 32 nt, Human
cucugaaauugcugggauuacaggcaugagcc

SEQ ID NO: 400066 - RNA, 32 nt, Human
cucugaacagaacuuggccuuuuguugugaau

SEQ ID NO: 400067 - RNA, 24 nt, Human
cucugaacaggcacagcccuccca

SEQ ID NO: 400068 - RNA, 32 nt, Human
cucugaacagggcuuccagucaccuccagcaa

SEQ ID NO: 400069 - RNA, 32 nt, Human
cucugaacaguucugucucuacuaccugaucu

SEQ ID NO: 400070 - RNA, 21 nt, Human
cucugaacaucuucugacaca

SEQ ID NO: 400071 - RNA, 32 nt, Human
cucugaacauuuauuuccauugcaauuucugu

SEQ ID NO: 400072 - RNA, 32 nt, Human
cucugaacccagggaagacaagaaggaaagau

SEQ ID NO: 400073 - RNA, 32 nt, Human
cucugaacccugggagccccuuguggagucug

SEQ ID NO: 400074 - RNA, 32 nt, Human
cucugaacgauuuccgccuauuuggaagccuu

SEQ ID NO: 400075 - RNA, 32 nt, Human
cucugaacucagggagggcacauacuuagaua

SEQ ID NO: 400076 - RNA, 32 nt, Human
cucugaacugggugaacucuguggagggaggc

SEQ ID NO: 400077 - RNA, 32 nt, Human
cucugaagaaacagaaccagagagggaaggug

SEQ ID NO: 400078 - RNA, 32 nt, Human
cucugaagaagcagcauuugagcugagaccug

SEQ ID NO: 400079 - RNA, 32 nt, Human
cucugaagacuucucagauggauccuagucuc

SEQ ID NO: 400080 - RNA, 32 nt, Human
cucugaagaguggguuucacaagugaaaaaca

SEQ ID NO: 400081 - RNA, 18 nt, Human
cucugaagauauacaggu

SEQ ID NO: 400082 - RNA, 21 nt, Human
cucugaagaucccaacauggu

SEQ ID NO: 400083 - RNA, 21 nt, Human
cucugaagaucuuugugaggu

SEQ ID NO: 400084 - RNA, 32 nt, Human
cucugaagcacuccccaucucaggcccaaaca

SEQ ID NO: 400085 - RNA, 32 nt, Human
cucugaagcucuccucuuugagguccuggcag

SEQ ID NO: 400086 - RNA, 32 nt, Human
cucugaagcuucaaagugacacuguggaaauc

SEQ ID NO: 400087 - RNA, 32 nt, Human
cucugaaggagcuucagacccugaggaacaug

SEQ ID NO: 400088 - RNA, 32 nt, Human
cucugaaggaugcucuggcacacagauggugc

SEQ ID NO: 400089 - RNA, 32 nt, Human
cucugaaggcccagagagguuaaguaacuucc

SEQ ID NO: 400090 - RNA, 32 nt, Human
cucugaagggaggcccaguggcugcaauauuc

SEQ ID NO: 400091 - RNA, 27 nt, Human
cucugaaggggcuuggaaccaguccgc

SEQ ID NO: 400092 - RNA, 32 nt, Human
cucugaagggucagucuucggggaagagaggu

SEQ ID NO: 400093 - RNA, 19 nt, Human
cucugaagggugcacaggu

SEQ ID NO: 400094 - RNA, 32 nt, Human
cucugaagguucuagaucaagggaggcugcau

SEQ ID NO: 400095 - RNA, 32 nt, Human
cucugaaguagcugggauuacaggcauguguc

SEQ ID NO: 400096 - RNA, 18 nt, Human
cucugaauaccuucucca

SEQ ID NO: 400097 - RNA, 32 nt, Human
cucugaauaugauaacagccuguuucacauga

SEQ ID NO: 400098 - RNA, 32 nt, Human
cucugaaucccuccuauucaccuugcugcugu

SEQ ID NO: 400099 - RNA, 32 nt, Human
cucugaaugauggcuggagauugucuaucaag

SEQ ID NO: 400100 - RNA, 32 nt, Human
cucugaaugugcugggaaccucuuggagccug

SEQ ID NO: 400101 - RNA, 32 nt, Human
cucugaauugggugcagaagacaagggcagag

SEQ ID NO: 400102 - RNA, 32 nt, Human
cucugacaaagcccuggaggcucggccuugcu

SEQ ID NO: 400103 - RNA, 32 nt, Human
cucugacaaaggcuuuuccuuauagaauaacc

SEQ ID NO: 400104 - RNA, 32 nt, Human
cucugacacuccugagcgaacaggcucagaca

SEQ ID NO: 400105 - RNA, 32 nt, Human
cucugacagccagcucaaucccagaguguccc

SEQ ID NO: 400106 - RNA, 32 nt, Human
cucugacaggaucauggcuaugauggaggucc

SEQ ID NO: 400107 - RNA, 32 nt, Human
cucugacagggccugcuucuccccagcagugc

SEQ ID NO: 400108 - RNA, 32 nt, Human
cucugacaggucuccaaauuucucccagucgc

SEQ ID NO: 400109 - RNA, 32 nt, Human
cucugacauccaagcuggggugcaguggcgcg

SEQ ID NO: 400110 - RNA, 32 nt, Human
cucugacauccagcggggccaggccggggagu

SEQ ID NO: 400111 - RNA, 22 nt, Human
cucugacauccccagguucuca

SEQ ID NO: 400112 - RNA, 32 nt, Human
cucugacauguguacacaugcuugcacacaug

SEQ ID NO: 400113 - RNA, 32 nt, Human
cucugaccagcugugcggcaugggcuaaguca

SEQ ID NO: 400114 - RNA, 19 nt, Human
cucugacccaccuaccuca

SEQ ID NO: 400115 - RNA, 32 nt, Human
cucugacccagcuucaccucauggacaacccu

SEQ ID NO: 400116 - RNA, 21 nt, Human
cucugacccccagaaccuacc

SEQ ID NO: 400117 - RNA, 32 nt, Human
cucugacccguucucggagcaccuacagagag

SEQ ID NO: 400118 - RNA, 32 nt, Human
cucugacccuggaaugggguugguuuggacac

SEQ ID NO: 400119 - RNA, 32 nt, Human
cucugaccucagcuguggcucuuggugcuggc

SEQ ID NO: 400120 - RNA, 32 nt, Human
cucugaccucaucugcucccccagucuuuuua

SEQ ID NO: 400121 - RNA, 22 nt, Human
cucugaccuccagaccagaugg

SEQ ID NO: 400122 - RNA, 32 nt, Human
cucugaccugcccccgcucugccaucagcccc

SEQ ID NO: 400123 - RNA, 32 nt, Human
cucugaccugcuacuucuggaaaaagaaucaa

SEQ ID NO: 400124 - RNA, 32 nt, Human
cucugaccuuaaaucauuccuuaucucagaaa

SEQ ID NO: 400125 - RNA, 22 nt, Human
cucugacgaggaccccaggcca

SEQ ID NO: 400126 - RNA, 24 nt, Human
cucugacgaggaccccaggccacu

SEQ ID NO: 400127 - RNA, 26 nt, Human
cucugacgcacaggcuggagugcagu

SEQ ID NO: 400128 - RNA, 32 nt, Human
cucugacgcacaggcuggagugcaguggcucc

SEQ ID NO: 400129 - RNA, 32 nt, Human
cucugacggcagggcuuugucucauuccuuuu

SEQ ID NO: 400130 - RNA, 32 nt, Human
cucugacggcauuauagagagaggagaggagg

SEQ ID NO: 400131 - RNA, 32 nt, Human
cucugacuacucuugucuuccucucucaucaa

SEQ ID NO: 400132 - RNA, 32 nt, Human
cucugacuccccuccacuuuugggcccucagc

SEQ ID NO: 400133 - RNA, 32 nt, Human
cucugacucgaacaccugcaaaggacagggac

SEQ ID NO: 400134 - RNA, 32 nt, Human
cucugacucuucagcagcugaagauuaaugca

SEQ ID NO: 400135 - RNA, 32 nt, Human
cucugacucuucuguguuaaaacaugaaacua

SEQ ID NO: 400136 - RNA, 32 nt, Human
cucugacugcacccaggaggugacugggaagg

SEQ ID NO: 400137 - RNA, 32 nt, Human
cucugacugccaccccugccugccugcccggc

SEQ ID NO: 400138 - RNA, 32 nt, Human
cucugacugcccucagccuccaaggaaccuga

SEQ ID NO: 400139 - RNA, 32 nt, Human
cucugacugccugggcgcugcguguagcaucu

SEQ ID NO: 400140 - RNA, 32 nt, Human
cucugacugcucccacugauuucuuucucucc

SEQ ID NO: 400141 - RNA, 32 nt, Human
cucugacuuguccuaggccgauuucucuaugg

SEQ ID NO: 400142 - RNA, 25 nt, Human
cucugagaaaggggauagaaagcuc

SEQ ID NO: 400143 - RNA, 32 nt, Human
cucugagaaaugccaggaucguggcucacagg

SEQ ID NO: 400144 - RNA, 32 nt, Human
cucugagaagauggcugugccacccacguaug

SEQ ID NO: 400145 - RNA, 32 nt, Human
cucugagaaguuuaguaacuugucaacuguca

SEQ ID NO: 400146 - RNA, 32 nt, Human
cucugagaaucugagauucagggugugugacu

SEQ ID NO: 400147 - RNA, 32 nt, Human
cucugagaaugacugggucuuggcucuuugau

SEQ ID NO: 400148 - RNA, 32 nt, Human
cucugagaauggguugggggaggcgggugcag

SEQ ID NO: 400149 - RNA, 32 nt, Human
cucugagacagagagcaacgaccuuugaguua

SEQ ID NO: 400150 - RNA, 21 nt, Human
cucugagacagcaguaucaca

SEQ ID NO: 400151 - RNA, 32 nt, Human
cucugagacaguucuuuuggaaauuauaaaua

SEQ ID NO: 400152 - RNA, 22 nt, Human
cucugagacccaucuccugccu

SEQ ID NO: 400153 - RNA, 32 nt, Human
cucugagaccuccagaauuaggcaucauucua

SEQ ID NO: 400154 - RNA, 32 nt, Human
cucugagagaagcagaccagaaagauggaaag

SEQ ID NO: 400155 - RNA, 32 nt, Human
cucugagagccccagccugagccagucccagc

SEQ ID NO: 400156 - RNA, 32 nt, Human
cucugagagugcgagugcaccaugcucacugu

SEQ ID NO: 400157 - RNA, 21 nt, Human
cucugagaguucaacacauca

SEQ ID NO: 400158 - RNA, 21 nt, Human
cucugagaucuuggucuccug

SEQ ID NO: 400159 - RNA, 32 nt, Human
cucugagauguggagacugauggccaggcaag

SEQ ID NO: 400160 - RNA, 32 nt, Human
cucugagauguggucagagagguuucugugga

SEQ ID NO: 400161 - RNA, 21 nt, Human
cucugagcacauguccggggg

SEQ ID NO: 400162 - RNA, 32 nt, Human
cucugagcagcagcaggcaacuucgagaacgg

SEQ ID NO: 400163 - RNA, 32 nt, Human
cucugagcaggaagccccucaggcucacacgg

SEQ ID NO: 400164 - RNA, 32 nt, Human
cucugagcaggaauccuuugugcauugaagac

SEQ ID NO: 400165 - RNA, 32 nt, Human
cucugagccagcggcuucgggugcaggagcag

SEQ ID NO: 400166 - RNA, 32 nt, Human
cucugagcccaggaggaagagaaagcauuguc

SEQ ID NO: 400167 - RNA, 32 nt, Human
cucugagcccccagaagcagagcuuuguuuug

SEQ ID NO: 400168 - RNA, 32 nt, Human
cucugagcccugcucgguuuaggccugucugc

SEQ ID NO: 400169 - RNA, 32 nt, Human
cucugagcucaggggaacacaagugcacagag

SEQ ID NO: 400170 - RNA, 32 nt, Human
cucugagcucaucuuagucuccugggcgggcg

SEQ ID NO: 400171 - RNA, 19 nt, Human
cucugagcucuucuaacac

SEQ ID NO: 400172 - RNA, 32 nt, Human
cucugagcugccgcagguccgugccaugggga

SEQ ID NO: 400173 - RNA, 32 nt, Human
cucugagcuuaggcuuucuuguugccaaacca

SEQ ID NO: 400174 - RNA, 32 nt, Human
cucugagcuucucugagccuuguuugcucauc

SEQ ID NO: 400175 - RNA, 23 nt, Human
cucugaggaaagauggaggguuc

SEQ ID NO: 400176 - RNA, 22 nt, Human
cucugaggaagaagcaggacuu

SEQ ID NO: 400177 - RNA, 32 nt, Human
cucugaggaagaggagcgaggacaacguuggc

SEQ ID NO: 400178 - RNA, 32 nt, Human
cucugaggaaggcgugcgaaggcuccacagcu

SEQ ID NO: 400179 - RNA, 24 nt, Human
cucugaggacauggagagagacuc

SEQ ID NO: 400180 - RNA, 32 nt, Human
cucugaggacuaggguggaggcaguguuucuc

SEQ ID NO: 400181 - RNA, 32 nt, Human
cucugaggagagcgagccagaggaccuugaga

SEQ ID NO: 400182 - RNA, 32 nt, Human
cucugaggaggaagaacaggaagccuggguga

SEQ ID NO: 400183 - RNA, 32 nt, Human
cucugaggaucagagacauaauugguggggcc

SEQ ID NO: 400184 - RNA, 32 nt, Human
cucugaggaugguucuacaguugggauuuugg

SEQ ID NO: 400185 - RNA, 32 nt, Human
cucugaggcaaagauggggacaaggacuaaga

SEQ ID NO: 400186 - RNA, 18 nt, Human
cucugaggccggcuccug

SEQ ID NO: 400187 - RNA, 32 nt, Human
cucugaggcgcccuagggcugagggaggggcc

SEQ ID NO: 400188 - RNA, 32 nt, Human
cucugaggcucuguugagaaucaugcuuugga

SEQ ID NO: 400189 - RNA, 32 nt, Human
cucugaggcugagagaggaagugggcuuuguu

SEQ ID NO: 400190 - RNA, 32 nt, Human
cucugagggcagcagugcacguggaggagacg

SEQ ID NO: 400191 - RNA, 20 nt, Human
cucugagggccuggcuucug

SEQ ID NO: 400192 - RNA, 32 nt, Human
cucugaggggcaggaguuauccagaucccacu

SEQ ID NO: 400193 - RNA, 32 nt, Human
cucugaggggcagugcucaguucagacaaggg

SEQ ID NO: 400194 - RNA, 22 nt, Human
cucugaggguugaggaaggcuc

SEQ ID NO: 400195 - RNA, 32 nt, Human
cucugagguacucugcucacaggccccagaca

SEQ ID NO: 400196 - RNA, 32 nt, Human
cucugaggucugaucucugcucugucaaggac

SEQ ID NO: 400197 - RNA, 32 nt, Human
cucugaguaaaaccccucuuuaucuuugaccu

SEQ ID NO: 400198 - RNA, 32 nt, Human
cucugaguaagcugcugccaagcacauauccc

SEQ ID NO: 400199 - RNA, 23 nt, Human
cucugaguagcugggauuacagg

SEQ ID NO: 400200 - RNA, 32 nt, Human
cucugaguagugcuuuaccauuuuguggagcu

SEQ ID NO: 400201 - RNA, 32 nt, Human
cucugagucacugaaugucaccaggagaggug

SEQ ID NO: 400202 - RNA, 32 nt, Human
cucugagucauccuccgacagcacccaguuca

SEQ ID NO: 400203 - RNA, 32 nt, Human
cucugaguccacugcuccauuuauaaccccag

SEQ ID NO: 400204 - RNA, 20 nt, Human
cucugagucccugguuccug

SEQ ID NO: 400205 - RNA, 32 nt, Human
cucugagucgugaagaagggaggcagcgaggg

SEQ ID NO: 400206 - RNA, 32 nt, Human
cucugagucucccggcugcaggcggauuggau

SEQ ID NO: 400207 - RNA, 32 nt, Human
cucugagucugaaucucccaaagagagaaacc

SEQ ID NO: 400208 - RNA, 32 nt, Human
cucugagugagaugcccaggaggaggagcccu

SEQ ID NO: 400209 - RNA, 32 nt, Human
cucugaguggggagagguugggcagugaguga

SEQ ID NO: 400210 - RNA, 32 nt, Human
cucugaguugugcagcguggggugggguccgg

SEQ ID NO: 400211 - RNA, 23 nt, Human
cucugaguuucggucuccugucu

SEQ ID NO: 400212 - RNA, 18 nt, Human
cucugauaaauuguguuc

SEQ ID NO: 400213 - RNA, 32 nt, Human
cucugauaacugccuuuccuuccuucugugcc

SEQ ID NO: 400214 - RNA, 22 nt, Human
cucugauaauauuuauuuuaaa

SEQ ID NO: 400215 - RNA, 32 nt, Human
cucugauaccccucuguucucauaaagccuca

SEQ ID NO: 400216 - RNA, 23 nt, Human
cucugauagaauuuaauuuuaaa

SEQ ID NO: 400217 - RNA, 18 nt, Human
cucugauauacuggcuuc

SEQ ID NO: 400218 - RNA, 20 nt, Human
cucugauauacuggcuucug

SEQ ID NO: 400219 - RNA, 32 nt, Human
cucugaucaccaucacuguaucucaagguuca

SEQ ID NO: 400220 - RNA, 32 nt, Human
cucugaucagcaugggaaugugccucggccuc

SEQ ID NO: 400221 - RNA, 32 nt, Human
cucugaucagugucuuuucagcacuuugagca

SEQ ID NO: 400222 - RNA, 21 nt, Human
cucugauccacuucucugcuu

SEQ ID NO: 400223 - RNA, 32 nt, Human
cucugaucccccuccuuccucuccucccuccc

SEQ ID NO: 400224 - RNA, 32 nt, Human
cucugauccucagcagggaaggcgaggguuac

SEQ ID NO: 400225 - RNA, 32 nt, Human
cucugauccucauugcaugcaggaagagaaga

SEQ ID NO: 400226 - RNA, 32 nt, Human
cucugauccuuuugcccuuccuucccauaacg

SEQ ID NO: 400227 - RNA, 32 nt, Human
cucugaucguggcgcauggcuuggggauuaaa

SEQ ID NO: 400228 - RNA, 32 nt, Human
cucugaugcuaucgucucaucuggaagagaug

SEQ ID NO: 400229 - RNA, 32 nt, Human
cucugaugcucccaugcucaguacaguucacu

SEQ ID NO: 400230 - RNA, 32 nt, Human
cucugaugcucuucuucugugucucuauuucu

SEQ ID NO: 400231 - RNA, 32 nt, Human
cucugaugcugcugagccacuuugacaaucgu

SEQ ID NO: 400232 - RNA, 32 nt, Human
cucugauggcugaagccaucucuccccuguga

SEQ ID NO: 400233 - RNA, 32 nt, Human
cucugaugggaggagagagggaacuuauuucc

SEQ ID NO: 400234 - RNA, 32 nt, Human
cucugaugggcugcuagugggguggugcuggg

SEQ ID NO: 400235 - RNA, 32 nt, Human
cucugauggucuucagcauucaccuucgugug

SEQ ID NO: 400236 - RNA, 32 nt, Human
cucugauguagugcuaagucuagccuccagau

SEQ ID NO: 400237 - RNA, 32 nt, Human
cucugaugucaaggccagagcaguugagaaug

SEQ ID NO: 400238 - RNA, 32 nt, Human
cucugaugucucaaaauauauuguguuucucu

SEQ ID NO: 400239 - RNA, 32 nt, Human
cucugaugucucaaagauaacuguuuuccaaa

SEQ ID NO: 400240 - RNA, 32 nt, Human
cucugaugugccacauuguucugcuacuuccu

SEQ ID NO: 400241 - RNA, 21 nt, Human
cucugauucccucuucugccu

SEQ ID NO: 400242 - RNA, 32 nt, Human
cucugauucucagcugagcugugagggcuucc

SEQ ID NO: 400243 - RNA, 32 nt, Human
cucugauugcauucuuccccuaauccauuuuc

SEQ ID NO: 400244 - RNA, 32 nt, Human
cucugauugguuuuggggaaauguggagaaga

SEQ ID NO: 400245 - RNA, 32 nt, Human
cucugauuuagaugagcaagagcugcugaguu

SEQ ID NO: 400246 - RNA, 32 nt, Human
cucugauuugguuuguucugucucaggcuucu

SEQ ID NO: 400247 - RNA, 32 nt, Human
cucugauuuugccuuuuuguuuacugaggucc

SEQ ID NO: 400248 - RNA, 32 nt, Human
cucugauuuuucaaauggaagagagaacaguu

SEQ ID NO: 400249 - RNA, 32 nt, Human
cucugcaaaauauacaaaaauuagcugggugu

SEQ ID NO: 400250 - RNA, 32 nt, Human
cucugcaaaaugucauagcuuauauaaaugua

SEQ ID NO: 400251 - RNA, 21 nt, Human
cucugcaaaccaacaggcuac

SEQ ID NO: 400252 - RNA, 32 nt, Human
cucugcaacagaauaugacaccaucuucccag

SEQ ID NO: 400253 - RNA, 32 nt, Human
cucugcaagccucuccuccaccuucaccccaa

SEQ ID NO: 400254 - RNA, 32 nt, Human
cucugcaagggagggggagagaagcagaggga

SEQ ID NO: 400255 - RNA, 32 nt, Human
cucugcaagggaucaggaccagcaaccuuuau

SEQ ID NO: 400256 - RNA, 32 nt, Human
cucugcaagggugaggggccuggcaggaugga

SEQ ID NO: 400257 - RNA, 32 nt, Human
cucugcaaucuaccugcaccccugacccaccc

SEQ ID NO: 400258 - RNA, 32 nt, Human
cucugcacaaaagaagucaacgcaggaauaaa

SEQ ID NO: 400259 - RNA, 32 nt, Human
cucugcacagagagcugggcuugaguggaguu

SEQ ID NO: 400260 - RNA, 32 nt, Human
cucugcacaugaaucccacccacaugugacac

SEQ ID NO: 400261 - RNA, 32 nt, Human
cucugcacccagcccaagggguggccguccug

SEQ ID NO: 400262 - RNA, 22 nt, Human
cucugcacccagggaaaauguu

SEQ ID NO: 400263 - RNA, 32 nt, Human
cucugcaccucugaccacaccuuggcaagucu

SEQ ID NO: 400264 - RNA, 32 nt, Human
cucugcacuacaaaagcaaauuuuccagucuu

SEQ ID NO: 400265 - RNA, 24 nt, Human
cucugcacuccuugccuccugucu

SEQ ID NO: 400266 - RNA, 32 nt, Human
cucugcacugaccacacccuccugccugcccu

SEQ ID NO: 400267 - RNA, 32 nt, Human
cucugcacuguucccuuccacuuccucauccu

SEQ ID NO: 400268 - RNA, 32 nt, Human
cucugcacuucugcccuccauccugcuccacg

SEQ ID NO: 400269 - RNA, 21 nt, Human
cucugcagacagccaguccag

SEQ ID NO: 400270 - RNA, 32 nt, Human
cucugcagaccaccucuucuucugggagcugu

SEQ ID NO: 400271 - RNA, 21 nt, Human
cucugcagagacagguucuca

SEQ ID NO: 400272 - RNA, 32 nt, Human
cucugcagaggcugggggccuccacccagcag

SEQ ID NO: 400273 - RNA, 32 nt, Human
cucugcagagggccgauccuccagcccagaga

SEQ ID NO: 400274 - RNA, 32 nt, Human
cucugcagagucacugcaccaucaggcuuggc

SEQ ID NO: 400275 - RNA, 32 nt, Human
cucugcagaguccaugcugugagcuuccuacc

SEQ ID NO: 400276 - RNA, 32 nt, Human
cucugcagaguuuggaggggcucacugccacu

SEQ ID NO: 400277 - RNA, 32 nt, Human
cucugcagccccaaauggcuccugggccuugc

SEQ ID NO: 400278 - RNA, 32 nt, Human
cucugcagccuuucacuucagugcccaccugg

SEQ ID NO: 400279 - RNA, 32 nt, Human
cucugcagccuuucccaugcucugcccccugu

SEQ ID NO: 400280 - RNA, 16 nt, Human
cucugcagcucacccu

SEQ ID NO: 400281 - RNA, 32 nt, Human
cucugcagcuccuggccagcugauucagguca

SEQ ID NO: 400282 - RNA, 32 nt, Human
cucugcaggaccaggccauggagcucgaaguc

SEQ ID NO: 400283 - RNA, 32 nt, Human
cucugcaggagucugcaggucacccggagcag

SEQ ID NO: 400284 - RNA, 23 nt, Human
cucugcaggcccagcuccugccu

SEQ ID NO: 400285 - RNA, 32 nt, Human
cucugcaggccccagcccuggccuccaagcaa

SEQ ID NO: 400286 - RNA, 20 nt, Human
cucugcaggccucuuugcuc

SEQ ID NO: 400287 - RNA, 32 nt, Human
cucugcaggcuggagcugccuggggcagggcu

SEQ ID NO: 400288 - RNA, 32 nt, Human
cucugcagggccugggccugcugagccugaua

SEQ ID NO: 400289 - RNA, 32 nt, Human
cucugcagggcuugugaccaaugaagucauau

SEQ ID NO: 400290 - RNA, 32 nt, Human
cucugcagggugguccagccuaggugacaggg

SEQ ID NO: 400291 - RNA, 32 nt, Human
cucugcagguucuucauacagcugccucugcc

SEQ ID NO: 400292 - RNA, 32 nt, Human
cucugcaguauuagcccccuuuuugcuuggug

SEQ ID NO: 400293 - RNA, 32 nt, Human
cucugcaguccuccggggugggugggugggca

SEQ ID NO: 400294 - RNA, 32 nt, Human
cucugcagucuacaaaaucgccccagucaacu

SEQ ID NO: 400295 - RNA, 21 nt, Human
cucugcagucugaaccuggag

SEQ ID NO: 400296 - RNA, 32 nt, Human
cucugcaguguggcugcuucuugauucaucca

SEQ ID NO: 400297 - RNA, 32 nt, Human
cucugcauaugguuuucaucauguggaccuuc

SEQ ID NO: 400298 - RNA, 32 nt, Human
cucugcauccaucaccuaggagaugugacucu

SEQ ID NO: 400299 - RNA, 32 nt, Human
cucugcaucccccagcgucauguccugcccca

SEQ ID NO: 400300 - RNA, 32 nt, Human
cucugcaugauuagugcaauaaaacucccuuc

SEQ ID NO: 400301 - RNA, 32 nt, Human
cucugcaugcaugugacuugcuucuuuuugca

SEQ ID NO: 400302 - RNA, 20 nt, Human
cucugcauuccacuggcucu

SEQ ID NO: 400303 - RNA, 32 nt, Human
cucugcauuccuuuguuaucauccucuuucuc

SEQ ID NO: 400304 - RNA, 19 nt, Human
cucugcauucuggcuucug

SEQ ID NO: 400305 - RNA, 32 nt, Human
cucugcauuuccuuuccuggaucucugucuuu

SEQ ID NO: 400306 - RNA, 32 nt, Human
cucugcauuuguccaguaacucuggcugugcc

SEQ ID NO: 400307 - RNA, 32 nt, Human
cucugccaaaaauacaaaaguuagccgggcgu

SEQ ID NO: 400308 - RNA, 32 nt, Human
cucugccaaauccaccuccugaggagauuucc

SEQ ID NO: 400309 - RNA, 32 nt, Human
cucugccacaagugccagcccccacaucugua

SEQ ID NO: 400310 - RNA, 22 nt, Human
cucugccacaccccaggcccug

SEQ ID NO: 400311 - RNA, 32 nt, Human
cucugccacacggguucaggugauucucuugc

SEQ ID NO: 400312 - RNA, 32 nt, Human
cucugccacagguugcaucuugaccugguccu

SEQ ID NO: 400313 - RNA, 32 nt, Human
cucugccaccagcugcucgcagcccaugccug

SEQ ID NO: 400314 - RNA, 26 nt, Human
cucugccacccaagcuggagugcagu

SEQ ID NO: 400315 - RNA, 32 nt, Human
cucugccacccaagcuggagugcaguggcacg

SEQ ID NO: 400316 - RNA, 32 nt, Human
cucugccacccagacugaagugcaguggugcg

SEQ ID NO: 400317 - RNA, 32 nt, Human
cucugccacccaggcuggagugcaguggugca

SEQ ID NO: 400318 - RNA, 21 nt, Human
cucugccacccccuccugucu

SEQ ID NO: 400319 - RNA, 32 nt, Human
cucugccacuccccacccccagccucugccgg

SEQ ID NO: 400320 - RNA, 32 nt, Human
cucugccacugacccaccgccaccuccgcgga

SEQ ID NO: 400321 - RNA, 32 nt, Human
cucugccacuggaagggcagaguagccagggu

SEQ ID NO: 400322 - RNA, 32 nt, Human
cucugccacuggcuugcuuuuggaccuuggau

SEQ ID NO: 400323 - RNA, 23 nt, Human
cucugccacugggacggcuccug

SEQ ID NO: 400324 - RNA, 32 nt, Human
cucugccacugugcccaagccuggguaucaca

SEQ ID NO: 400325 - RNA, 32 nt, Human
cucugccacuuuucccuuccuaccucuuaacu

SEQ ID NO: 400326 - RNA, 32 nt, Human
cucugccagacaaucccuccuuuagccaggga

SEQ ID NO: 400327 - RNA, 32 nt, Human
cucugccagcauaaaccacucacaccccaggg

SEQ ID NO: 400328 - RNA, 32 nt, Human
cucugccagccagacuggagugcauuggcgag

SEQ ID NO: 400329 - RNA, 32 nt, Human
cucugccagccaggcuggagugcaguggcaug

SEQ ID NO: 400330 - RNA, 32 nt, Human
cucugccagggccuacuucuccccagcagugc

SEQ ID NO: 400331 - RNA, 32 nt, Human
cucugccagggccugcuucuccccagcagugc

SEQ ID NO: 400332 - RNA, 32 nt, Human
cucugccaggggucccagcuacucaggaggcu

SEQ ID NO: 400333 - RNA, 32 nt, Human
cucugccagguggcgaguacaccugcucacgu

SEQ ID NO: 400334 - RNA, 23 nt, Human
cucugccagugacagacaggcuc

SEQ ID NO: 400335 - RNA, 18 nt, Human
cucugccagugcucucug

SEQ ID NO: 400336 - RNA, 32 nt, Human
cucugccaguguccccagcacuuuuaggucau

SEQ ID NO: 400337 - RNA, 31 nt, Human
cucugccagugucucaggacagcagaguggg

SEQ ID NO: 400338 - RNA, 32 nt, Human
cucugccaucacccagcccaaacacaucagcu

SEQ ID NO: 400339 - RNA, 32 nt, Human
cucugccauccagcgccacaaagagacauucu

SEQ ID NO: 400340 - RNA, 32 nt, Human
cucugccaucguacuucaagagcagccaguag

SEQ ID NO: 400341 - RNA, 32 nt, Human
cucugccaucuucucuccuucccaaaggaucu

SEQ ID NO: 400342 - RNA, 18 nt, Human
cucugccaugaauuccug

SEQ ID NO: 400343 - RNA, 32 nt, Human
cucugccauuuacuugcugugugucuccagca

SEQ ID NO: 400344 - RNA, 32 nt, Human
cucugcccaaaagcuuuuccacacuuacaguc

SEQ ID NO: 400345 - RNA, 32 nt, Human
cucugcccaagugggccagcugcccucacuuc

SEQ ID NO: 400346 - RNA, 32 nt, Human
cucugcccacacuucccugccuagagacccgg

SEQ ID NO: 400347 - RNA, 19 nt, Human
cucugcccacccuggcucc

SEQ ID NO: 400348 - RNA, 21 nt, Human
cucugcccaccugagguccug

SEQ ID NO: 400349 - RNA, 32 nt, Human
cucugcccaccuggggucucucucccuaccuc

SEQ ID NO: 400350 - RNA, 24 nt, Human
cucugcccacuacaaccuccaccu

SEQ ID NO: 400351 - RNA, 19 nt, Human
cucugcccagaggcuccug

SEQ ID NO: 400352 - RNA, 32 nt, Human
cucugcccagaugccaucacaucccugauacu

SEQ ID NO: 400353 - RNA, 18 nt, Human
cucugcccagccucgcug

SEQ ID NO: 400354 - RNA, 20 nt, Human
cucugcccagcucuggcuuc

SEQ ID NO: 400355 - RNA, 32 nt, Human
cucugcccaggaucugagcucauuggucaaag

SEQ ID NO: 400356 - RNA, 32 nt, Human
cucugcccagugugggagggcagaucauuccc

SEQ ID NO: 400357 - RNA, 32 nt, Human
cucugcccaguucucugggucaagcuggaugg

SEQ ID NO: 400358 - RNA, 19 nt, Human
cucugcccaucggcuucug

SEQ ID NO: 400359 - RNA, 32 nt, Human
cucugcccauuguccaugauuuacacuaauug

SEQ ID NO: 400360 - RNA, 32 nt, Human
cucugccccagcucuggcuuccagaaaacccc

SEQ ID NO: 400361 - RNA, 20 nt, Human
cucugccccagguuccagga

SEQ ID NO: 400362 - RNA, 21 nt, Human
cucugccccaugugcccucaa

SEQ ID NO: 400363 - RNA, 32 nt, Human
cucugcccccugcuggcucuucugcccaauug

SEQ ID NO: 400364 - RNA, 16 nt, Human
cucugccccgcugccg

SEQ ID NO: 400365 - RNA, 32 nt, Human
cucugccccgcugcucugcugccuguccuggg

SEQ ID NO: 400366 - RNA, 24 nt, Human
cucugccccgguucaugguuccug

SEQ ID NO: 400367 - RNA, 32 nt, Human
cucugccccucacguuccuaccacagggccac

SEQ ID NO: 400368 - RNA, 32 nt, Human
cucugccccuccccacucucaggcuggugggg

SEQ ID NO: 400369 - RNA, 32 nt, Human
cucugccccucgggggacuggacacacauccu

SEQ ID NO: 400370 - RNA, 32 nt, Human
cucugccccucuucccuggccaggggcuucuc

SEQ ID NO: 400371 - RNA, 23 nt, Human
cucugccccucuuccuggcccug

SEQ ID NO: 400372 - RNA, 32 nt, Human
cucugccccugccccugccccucccagcaccu

SEQ ID NO: 400373 - RNA, 32 nt, Human
cucugccccugcccucccucuccuaucugaac

SEQ ID NO: 400374 - RNA, 32 nt, Human
cucugccccugccucccuaauuagcuagggcu

SEQ ID NO: 400375 - RNA, 32 nt, Human
cucugccccugugaacacccaucugcaguauc

SEQ ID NO: 400376 - RNA, 32 nt, Human
cucugccccuucuguuuccauaggaaucaugu

SEQ ID NO: 400377 - RNA, 32 nt, Human
cucugccccuugcccuccccugccccucacaa

SEQ ID NO: 400378 - RNA, 18 nt, Human
cucugcccgaccucgcug

SEQ ID NO: 400379 - RNA, 32 nt, Human
cucugcccgguuggaccuccucccuuuguuga

SEQ ID NO: 400380 - RNA, 32 nt, Human
cucugcccgucacuccccuugucaccucuugg

SEQ ID NO: 400381 - RNA, 32 nt, Human
cucugcccgugaggagcuucccgcagccgccu

SEQ ID NO: 400382 - RNA, 32 nt, Human
cucugcccucacaaccucagccuggccuucau

SEQ ID NO: 400383 - RNA, 32 nt, Human
cucugcccuccagaaccugcagccuggagggg

SEQ ID NO: 400384 - RNA, 32 nt, Human
cucugcccuccagaacuucaggcucucaguga

SEQ ID NO: 400385 - RNA, 32 nt, Human
cucugcccuccagaagcccucgucugggaauu

SEQ ID NO: 400386 - RNA, 21 nt, Human
cucugcccucccuggcuccug

SEQ ID NO: 400387 - RNA, 32 nt, Human
cucugcccuccuuccccuccccaaccccaggc

SEQ ID NO: 400388 - RNA, 32 nt, Human
cucugcccuccuuuuugguuuccuugguggua

SEQ ID NO: 400389 - RNA, 20 nt, Human
cucugcccucgcugcucuug

SEQ ID NO: 400390 - RNA, 20 nt, Human
cucugcccucugacucacug

SEQ ID NO: 400391 - RNA, 18 nt, Human
cucugcccucuuugccca

SEQ ID NO: 400392 - RNA, 32 nt, Human
cucugcccugagccaggagaccugccacaccc

SEQ ID NO: 400393 - RNA, 32 nt, Human
cucugcccugcacuugugcagaaagucaggga

SEQ ID NO: 400394 - RNA, 22 nt, Human
cucugcccugccccccaccccu

SEQ ID NO: 400395 - RNA, 32 nt, Human
cucugcccugcccuccagccugggacaauaaa

SEQ ID NO: 400396 - RNA, 22 nt, Human
cucugcccugcccuggccacug

SEQ ID NO: 400397 - RNA, 32 nt, Human
cucugcccuggaaccuaccagagcagagaagg

SEQ ID NO: 400398 - RNA, 15 nt, Human
cucugcccuggcuuc

SEQ ID NO: 400399 - RNA, 32 nt, Human
cucugcccugugccugggcacacacaggcauc

SEQ ID NO: 400400 - RNA, 32 nt, Human
cucugcccuuggcuugcccuccucagaguucu

SEQ ID NO: 400401 - RNA, 32 nt, Human
cucugcccuuguuauccugccacccgcagggg

SEQ ID NO: 400402 - RNA, 32 nt, Human
cucugcccuuuacuugaacaggagucuugauu

SEQ ID NO: 400403 - RNA, 32 nt, Human
cucugcccuuuccccuucucccccucccccuc

SEQ ID NO: 400404 - RNA, 32 nt, Human
cucugcccuuucucuguccuuaugcugucccg

SEQ ID NO: 400405 - RNA, 26 nt, Human
cucugcccuuugggcuggauuaccca

SEQ ID NO: 400406 - RNA, 32 nt, Human
cucugcccuuuugccuguccucaggccgcugg

SEQ ID NO: 400407 - RNA, 19 nt, Human
cucugccgaccggcuucug

SEQ ID NO: 400408 - RNA, 32 nt, Human
cucugccgagaucaaauggagcuucucgcuga

SEQ ID NO: 400409 - RNA, 26 nt, Human
cucugccgcccaaacuggagugcagu

SEQ ID NO: 400410 - RNA, 32 nt, Human
cucugccgcccaaacuggagugcaguggcaca

SEQ ID NO: 400411 - RNA, 26 nt, Human
cucugccgcccaggcgggagugcagu

SEQ ID NO: 400412 - RNA, 32 nt, Human
cucugccgcccaggcgggagugcaguggcagu

SEQ ID NO: 400413 - RNA, 26 nt, Human
cucugccgcccaggcuggacugcagu

SEQ ID NO: 400414 - RNA, 32 nt, Human
cucugccgcccaggcuggacugcagugacaca

SEQ ID NO: 400415 - RNA, 26 nt, Human
cucugccgcccaggcuggagugcagu

SEQ ID NO: 400416 - RNA, 32 nt, Human
cucugccgcccaggcuggagugcaguggcgcg

SEQ ID NO: 400417 - RNA, 17 nt, Human
cucugccgccgccgccg

SEQ ID NO: 400418 - RNA, 32 nt, Human
cucugccgcugcuuccaggcugggcagcacaa

SEQ ID NO: 400419 - RNA, 32 nt, Human
cucugccggaaaguccgcgccgccgcugccgc

SEQ ID NO: 400420 - RNA, 32 nt, Human
cucugccggggaggaggaggaggaggaagagg

SEQ ID NO: 400421 - RNA, 18 nt, Human
cucugccgggggcuucug

SEQ ID NO: 400422 - RNA, 20 nt, Human
cucugccuacaugacuacug

SEQ ID NO: 400423 - RNA, 32 nt, Human
cucugccuacugcgcaggccucaggcccaggg

SEQ ID NO: 400424 - RNA, 32 nt, Human
cucugccuagcuguuuacauuugcaaauguag

SEQ ID NO: 400425 - RNA, 32 nt, Human
cucugccuaggcccuggugaaaccacagguau

SEQ ID NO: 400426 - RNA, 19 nt, Human
cucugccuagggggcuccu

SEQ ID NO: 400427 - RNA, 32 nt, Human
cucugccuauagccccagcuacuugggaggcu

SEQ ID NO: 400428 - RNA, 20 nt, Human
cucugccucaaagacucuug

SEQ ID NO: 400429 - RNA, 22 nt, Human
cucugccucaaccccaggccac

SEQ ID NO: 400430 - RNA, 18 nt, Human
cucugccucaaggccggg

SEQ ID NO: 400431 - RNA, 20 nt, Human
cucugccucaaggcuguccu

SEQ ID NO: 400432 - RNA, 24 nt, Human
cucugccucaaggcuugguuccug

SEQ ID NO: 400433 - RNA, 18 nt, Human
cucugccucaaugcccug

SEQ ID NO: 400434 - RNA, 18 nt, Human
cucugccucacacuccug

SEQ ID NO: 400435 - RNA, 32 nt, Human
cucugccucacacuccuguccucugaacccac

SEQ ID NO: 400436 - RNA, 32 nt, Human
cucugccucacagcagacucuccacacccagc

SEQ ID NO: 400437 - RNA, 32 nt, Human
cucugccucacagcagacucuccacgcccagc

SEQ ID NO: 400438 - RNA, 32 nt, Human
cucugccucacagcagacucuccaugcccagc

SEQ ID NO: 400439 - RNA, 32 nt, Human
cucugccucacagcagacucuucacacccagc

SEQ ID NO: 400440 - RNA, 20 nt, Human
cucugccucaccugccuccu

SEQ ID NO: 400441 - RNA, 18 nt, Human
cucugccucacucucuug

SEQ ID NO: 400442 - RNA, 17 nt, Human
cucugccucacuucuuu

SEQ ID NO: 400443 - RNA, 20 nt, Human
cucugccucagcagccgcug

SEQ ID NO: 400444 - RNA, 16 nt, Human
cucugccucagccucc

SEQ ID NO: 400445 - RNA, 19 nt, Human
cucugccucagccuccucc

SEQ ID NO: 400446 - RNA, 18 nt, Human
cucugccucagccuccug

SEQ ID NO: 400447 - RNA, 19 nt, Human
cucugccucagccuuacug

SEQ ID NO: 400448 - RNA, 18 nt, Human
cucugccucagucaccug

SEQ ID NO: 400449 - RNA, 19 nt, Human
cucugccucaguggccucc

SEQ ID NO: 400450 - RNA, 32 nt, Human
cucugccucaguuuccccaucuguaaaauggg

SEQ ID NO: 400451 - RNA, 18 nt, Human
cucugccucauauucuug

SEQ ID NO: 400452 - RNA, 32 nt, Human
cucugccucauauucuuguuaggccagguggg

SEQ ID NO: 400453 - RNA, 32 nt, Human
cucugccucauccuccuccucauucagaccaa

SEQ ID NO: 400454 - RNA, 19 nt, Human
cucugccucauccugcccu

SEQ ID NO: 400455 - RNA, 18 nt, Human
cucugccucauuuuccug

SEQ ID NO: 400456 - RNA, 32 nt, Human
cucugccuccacccccucccuauuccugaugc

SEQ ID NO: 400457 - RNA, 32 nt, Human
cucugccuccacccuccuccucuucaccaggu

SEQ ID NO: 400458 - RNA, 18 nt, Human
cucugccuccacuuccug

SEQ ID NO: 400459 - RNA, 21 nt, Human
cucugccuccacuuccugcuu

SEQ ID NO: 400460 - RNA, 18 nt, Human
cucugccuccagggcucc

SEQ ID NO: 400461 - RNA, 19 nt, Human
cucugccuccccgcucuca

SEQ ID NO: 400462 - RNA, 32 nt, Human
cucugccuccccggaagaagaugaggaaucug

SEQ ID NO: 400463 - RNA, 17 nt, Human
cucugccuccccugccc

SEQ ID NO: 400464 - RNA, 32 nt, Human
cucugccuccccuuccccuccucuccccuccu

SEQ ID NO: 400465 - RNA, 19 nt, Human
cucugccucccguugcucu

SEQ ID NO: 400466 - RNA, 19 nt, Human
cucugccucccuaagcucc

SEQ ID NO: 400467 - RNA, 19 nt, Human
cucugccucccucacccug

SEQ ID NO: 400468 - RNA, 18 nt, Human
cucugccucccuccuccu

SEQ ID NO: 400469 - RNA, 19 nt, Human
cucugccucccucgcuccu

SEQ ID NO: 400470 - RNA, 32 nt, Human
cucugccucccucgcuccuccaacagcugccu

SEQ ID NO: 400471 - RNA, 16 nt, Human
cucugccucccucucc

SEQ ID NO: 400472 - RNA, 18 nt, Human
cucugccucccucugcug

SEQ ID NO: 400473 - RNA, 20 nt, Human
cucugccucccugcucucug

SEQ ID NO: 400474 - RNA, 32 nt, Human
cucugccucccugucaccucaggcuugacccc

SEQ ID NO: 400475 - RNA, 19 nt, Human
cucugccucccugucuacc

SEQ ID NO: 400476 - RNA, 16 nt, Human
cucugccuccgccucc

SEQ ID NO: 400477 - RNA, 21 nt, Human
cucugccuccggucacucuug

SEQ ID NO: 400478 - RNA, 17 nt, Human
cucugccuccuccccug

SEQ ID NO: 400479 - RNA, 16 nt, Human
cucugccuccuccucc

SEQ ID NO: 400480 - RNA, 17 nt, Human
cucugccuccucucucc

SEQ ID NO: 400481 - RNA, 16 nt, Human
cucugccuccugcucc

SEQ ID NO: 400482 - RNA, 16 nt, Human
cucugccuccugcuuu

SEQ ID NO: 400483 - RNA, 32 nt, Human
cucugccuccuggguucuccugccucacccuc

SEQ ID NO: 400484 - RNA, 18 nt, Human
cucugccuccuuccuccu

SEQ ID NO: 400485 - RNA, 32 nt, Human
cucugccuccuuccuucuuucucuucaacccc

SEQ ID NO: 400486 - RNA, 18 nt, Human
cucugccuccuuggcccc

SEQ ID NO: 400487 - RNA, 32 nt, Human
cucugccuccuuggccccacauuucugcaaac

SEQ ID NO: 400488 - RNA, 15 nt, Human
cucugccuccuuucc

SEQ ID NO: 400489 - RNA, 19 nt, Human
cucugccuccuuucugcug

SEQ ID NO: 400490 - RNA, 18 nt, Human
cucugccucgggccuucu

SEQ ID NO: 400491 - RNA, 17 nt, Human
cucugccucgguuuccu

SEQ ID NO: 400492 - RNA, 17 nt, Human
cucugccucgucuuucc

SEQ ID NO: 400493 - RNA, 32 nt, Human
cucugccucuccccaccuucuuuggagcaagg

SEQ ID NO: 400494 - RNA, 32 nt, Human
cucugccucucucagccgcaucacccuguugc

SEQ ID NO: 400495 - RNA, 18 nt, Human
cucugccucucucuccug

SEQ ID NO: 400496 - RNA, 20 nt, Human
cucugccucucuucucucug

SEQ ID NO: 400497 - RNA, 20 nt, Human
cucugccucucuuucuccug

SEQ ID NO: 400498 - RNA, 19 nt, Human
cucugccucugacucgcug

SEQ ID NO: 400499 - RNA, 32 nt, Human
cucugccucugccucauauucuuguuaggcca

SEQ ID NO: 400500 - RNA, 32 nt, Human
cucugccucugccucucccuuccaagcucugc

SEQ ID NO: 400501 - RNA, 20 nt, Human
cucugccucuggcccuccug

SEQ ID NO: 400502 - RNA, 18 nt, Human
cucugccucuggcuuucc

SEQ ID NO: 400503 - RNA, 18 nt, Human
cucugccucugucuccug

SEQ ID NO: 400504 - RNA, 19 nt, Human
cucugccucuguucucuug

SEQ ID NO: 400505 - RNA, 32 nt, Human
cucugccucuuccuccauacuagguuggaaaa

SEQ ID NO: 400506 - RNA, 17 nt, Human
cucugccucuugcaccu

SEQ ID NO: 400507 - RNA, 19 nt, Human
cucugccucuuuucuccug

SEQ ID NO: 400508 - RNA, 20 nt, Human
cucugccugacugaccccug

SEQ ID NO: 400509 - RNA, 32 nt, Human
cucugccugaggccuagucugcauuuguuugc

SEQ ID NO: 400510 - RNA, 32 nt, Human
cucugccugaugcucucauuaaaaucuaugca

SEQ ID NO: 400511 - RNA, 20 nt, Human
cucugccugauguggcuccu

SEQ ID NO: 400512 - RNA, 19 nt, Human
cucugccugcaccuuccug

SEQ ID NO: 400513 - RNA, 18 nt, Human
cucugccugcacgcccug

SEQ ID NO: 400514 - RNA, 16 nt, Human
cucugccugcagcucc

SEQ ID NO: 400515 - RNA, 32 nt, Human
cucugccugcagcugggccucugccucauccu

SEQ ID NO: 400516 - RNA, 17 nt, Human
cucugccugccccuccu

SEQ ID NO: 400517 - RNA, 32 nt, Human
cucugccugcccuguccuuccccuggcugaug

SEQ ID NO: 400518 - RNA, 25 nt, Human
cucugccugccggcugggcugccca

SEQ ID NO: 400519 - RNA, 32 nt, Human
cucugccugccugccugccugcuguccugggc

SEQ ID NO: 400520 - RNA, 32 nt, Human
cucugccugccuggcccucaaccuuccaugac

SEQ ID NO: 400521 - RNA, 32 nt, Human
cucugccugccuggggcccuggcuagccugca

SEQ ID NO: 400522 - RNA, 32 nt, Human
cucugccugccuggucugacccuccccugcuc

SEQ ID NO: 400523 - RNA, 19 nt, Human
cucugccugccuguuccug

SEQ ID NO: 400524 - RNA, 32 nt, Human
cucugccugcucaccacagccuggagagggca

SEQ ID NO: 400525 - RNA, 19 nt, Human
cucugccugcugggcucuu

SEQ ID NO: 400526 - RNA, 15 nt, Human
cucugccugcugucc

SEQ ID NO: 400527 - RNA, 32 nt, Human
cucugccugcugugcugcuuuucccccacaug

SEQ ID NO: 400528 - RNA, 32 nt, Human
cucugccuggagcccagguugcagguggugag

SEQ ID NO: 400529 - RNA, 18 nt, Human
cucugccuggccagcccu

SEQ ID NO: 400530 - RNA, 20 nt, Human
cucugccuggccugacccug

SEQ ID NO: 400531 - RNA, 23 nt, Human
cucugccuggcugagcacaucca

SEQ ID NO: 400532 - RNA, 32 nt, Human
cucugccugggcaagaguguggaggugccgag

SEQ ID NO: 400533 - RNA, 19 nt, Human
cucugccugggccucacug

SEQ ID NO: 400534 - RNA, 32 nt, Human
cucugccuggggccauugagcccagccuccag

SEQ ID NO: 400535 - RNA, 20 nt, Human
cucugccuggguucuuccug

SEQ ID NO: 400536 - RNA, 19 nt, Human
cucugccugguggcauccu

SEQ ID NO: 400537 - RNA, 18 nt, Human
cucugccugguggcccug

SEQ ID NO: 400538 - RNA, 19 nt, Human
cucugccuggugguuccug

SEQ ID NO: 400539 - RNA, 17 nt, Human
cucugccuguggccacu

SEQ ID NO: 400540 - RNA, 24 nt, Human
cucugccugugugaguggcuccug

SEQ ID NO: 400541 - RNA, 18 nt, Human
cucugccuguuacugcug

SEQ ID NO: 400542 - RNA, 19 nt, Human
cucugccuguuagacucuu

SEQ ID NO: 400543 - RNA, 16 nt, Human
cucugccuguuccucc

SEQ ID NO: 400544 - RNA, 32 nt, Human
cucugccuguucuggacuguguucugggccug

SEQ ID NO: 400545 - RNA, 17 nt, Human
cucugccuuagcacucc

SEQ ID NO: 400546 - RNA, 23 nt, Human
cucugccuuaggcucugucucca

SEQ ID NO: 400547 - RNA, 32 nt, Human
cucugccuucaaggagcuugcaguauagugag

SEQ ID NO: 400548 - RNA, 32 nt, Human
cucugccuucaaggcccccauggggcugucca

SEQ ID NO: 400549 - RNA, 19 nt, Human
cucugccuucaggacccug

SEQ ID NO: 400550 - RNA, 19 nt, Human
cucugccuucaggcuucug

SEQ ID NO: 400551 - RNA, 32 nt, Human
cucugccuucaggcuucugucaauuucauuau

SEQ ID NO: 400552 - RNA, 21 nt, Human
cucugccuucagggucaucca

SEQ ID NO: 400553 - RNA, 19 nt, Human
cucugccuucaugcaccug

SEQ ID NO: 400554 - RNA, 32 nt, Human
cucugccuuccagguucaagcuauucucaugc

SEQ ID NO: 400555 - RNA, 32 nt, Human
cucugccuuccagguucaagugauuagagaca

SEQ ID NO: 400556 - RNA, 32 nt, Human
cucugccuucucgcucugugagguaggggaag

SEQ ID NO: 400557 - RNA, 15 nt, Human
cucugccuucucucc

SEQ ID NO: 400558 - RNA, 32 nt, Human
cucugccuucugccaccucugccucaggagca

SEQ ID NO: 400559 - RNA, 32 nt, Human
cucugccuucugguuucguguccuggugcuua

SEQ ID NO: 400560 - RNA, 19 nt, Human
cucugccuucuguucucug

SEQ ID NO: 400561 - RNA, 18 nt, Human
cucugccuugcccuccug

SEQ ID NO: 400562 - RNA, 32 nt, Human
cucugccuugcuuugcuuauguuuagcuguuu

SEQ ID NO: 400563 - RNA, 17 nt, Human
cucugccuuggagcucc

SEQ ID NO: 400564 - RNA, 19 nt, Human
cucugccuuggccucacug

SEQ ID NO: 400565 - RNA, 21 nt, Human
cucugccuuuagggucaucca

SEQ ID NO: 400566 - RNA, 32 nt, Human
cucugccuuuccuucugcuccagagcaaauug

SEQ ID NO: 400567 - RNA, 18 nt, Human
cucugccuuugagcccug

SEQ ID NO: 400568 - RNA, 32 nt, Human
cucugccuuugagcuucuccucugcuccaaca

SEQ ID NO: 400569 - RNA, 32 nt, Human
cucugccuuugguggagggcaauuccuccucu

SEQ ID NO: 400570 - RNA, 19 nt, Human
cucugccuuugugauccug

SEQ ID NO: 400571 - RNA, 17 nt, Human
cucugccuuugugcucu

SEQ ID NO: 400572 - RNA, 18 nt, Human
cucugccuuuuagcuucu

SEQ ID NO: 400573 - RNA, 20 nt, Human
cucugcgacacugguuccag

SEQ ID NO: 400574 - RNA, 32 nt, Human
cucugcgagcagcugggagcggcggcggcggc

SEQ ID NO: 400575 - RNA, 32 nt, Human
cucugcgagccccugcacuccauccugcugac

SEQ ID NO: 400576 - RNA, 32 nt, Human
cucugcgaggcagcggcuggagagggaaccau

SEQ ID NO: 400577 - RNA, 32 nt, Human
cucugcgcccaggauggagugcaguggcauga

SEQ ID NO: 400578 - RNA, 18 nt, Human
cucugcgccgcugcugcc

SEQ ID NO: 400579 - RNA, 32 nt, Human
cucugcgccucuccaccuggcuucacugauuc

SEQ ID NO: 400580 - RNA, 21 nt, Human
cucugcgccugucccucccca

SEQ ID NO: 400581 - RNA, 32 nt, Human
cucugcgcggcccacugcaauccguggaggaa

SEQ ID NO: 400582 - RNA, 32 nt, Human
cucugcgcggucagagggagcgccuggcagca

SEQ ID NO: 400583 - RNA, 32 nt, Human
cucugcgcugagcagaaccagcucccccaacu

SEQ ID NO: 400584 - RNA, 21 nt, Human
cucugcgcuggacuucugcca

SEQ ID NO: 400585 - RNA, 32 nt, Human
cucugcgcugggcaggaccaaggcuaggcuuu

SEQ ID NO: 400586 - RNA, 32 nt, Human
cucugcggaccugcagccaucugugaggcccg

SEQ ID NO: 400587 - RNA, 32 nt, Human
cucugcggaucuccccugaccgcucuccacag

SEQ ID NO: 400588 - RNA, 32 nt, Human
cucugcggcuccucccaccccaccucuucuca

SEQ ID NO: 400589 - RNA, 32 nt, Human
cucugcggggcagggccuuccugguuuuguac

SEQ ID NO: 400590 - RNA, 20 nt, Human
cucugcggggccgguccagg

SEQ ID NO: 400591 - RNA, 23 nt, Human
cucugcggguccagcuccugcuu

SEQ ID NO: 400592 - RNA, 32 nt, Human
cucugcgguugagggcccagaggacagagaga

SEQ ID NO: 400593 - RNA, 32 nt, Human
cucugcgucccgagccucccccggcucuccgc

SEQ ID NO: 400594 - RNA, 18 nt, Human
cucugcgucccgcacccc

SEQ ID NO: 400595 - RNA, 23 nt, Human
cucugcgucuuucccucuuccgc

SEQ ID NO: 400596 - RNA, 32 nt, Human
cucugcguggugccaugaaggaaagaaaccuu

SEQ ID NO: 400597 - RNA, 20 nt, Human
cucugcgugguguggcuccu

SEQ ID NO: 400598 - RNA, 32 nt, Human
cucugcguuauuggcugugcucuccucaaugg

SEQ ID NO: 400599 - RNA, 19 nt, Human
cucugcguucaucacauca

SEQ ID NO: 400600 - RNA, 32 nt, Human
cucugcuaaaaauacaaaaauagcugggcgug

SEQ ID NO: 400601 - RNA, 32 nt, Human
cucugcuaaaaauacaaaaauuagccagaugu

SEQ ID NO: 400602 - RNA, 32 nt, Human
cucugcuaaaaauacaaaaauuagccaggcau

SEQ ID NO: 400603 - RNA, 32 nt, Human
cucugcuaaaaauacaaaaauuagccgggcgu

SEQ ID NO: 400604 - RNA, 32 nt, Human
cucugcuaaaaauacaaaaauuagccgggugu

SEQ ID NO: 400605 - RNA, 32 nt, Human
cucugcuaaaaauacaaaaauuagcugggugc

SEQ ID NO: 400606 - RNA, 32 nt, Human
cucugcuaaaaauacaaaaauuagcugggugu

SEQ ID NO: 400607 - RNA, 32 nt, Human
cucugcuaaaaauacaaaauuagcugggcgug

SEQ ID NO: 400608 - RNA, 32 nt, Human
cucugcuaaaaauacaaaauuuagcugggcau

SEQ ID NO: 400609 - RNA, 31 nt, Human
cucugcuaaaaauacaaaauuuagcugggua

SEQ ID NO: 400610 - RNA, 32 nt, Human
cucugcuaacaauacugaaauuagcugggugc

SEQ ID NO: 400611 - RNA, 32 nt, Human
cucugcuacacagcacggcuuuuucaaggcug

SEQ ID NO: 400612 - RNA, 32 nt, Human
cucugcuacagcccugggaggagccaggaucc

SEQ ID NO: 400613 - RNA, 32 nt, Human
cucugcuacugaggcaggggaguaguggagag

SEQ ID NO: 400614 - RNA, 32 nt, Human
cucugcuacuucugaaucuguuuugucuuccu

SEQ ID NO: 400615 - RNA, 32 nt, Human
cucugcuagaaauacaaaaauuggcugggcgc

SEQ ID NO: 400616 - RNA, 32 nt, Human
cucugcuagaacacaggaugcuucugcucucc

SEQ ID NO: 400617 - RNA, 32 nt, Human
cucugcuagccagcagagugagcaugcacagc

SEQ ID NO: 400618 - RNA, 32 nt, Human
cucugcuagcucccagccuuccauggcagugc

SEQ ID NO: 400619 - RNA, 32 nt, Human
cucugcuaguucagauggauugcaauuauaau

SEQ ID NO: 400620 - RNA, 32 nt, Human
cucugcucaacucucuaccacaugucacagcu

SEQ ID NO: 400621 - RNA, 31 nt, Human
cucugcucaauaaaauaccuguaacuggaaa

SEQ ID NO: 400622 - RNA, 32 nt, Human
cucugcucacuacaaccucugccucccagguu

SEQ ID NO: 400623 - RNA, 32 nt, Human
cucugcucacuacaagcucugccucccgaguu

SEQ ID NO: 400624 - RNA, 20 nt, Human
cucugcucacugcaaccucc

SEQ ID NO: 400625 - RNA, 22 nt, Human
cucugcucacugcaaccuccgc

SEQ ID NO: 400626 - RNA, 32 nt, Human
cucugcucacugcaaccuccgccucccagguu

SEQ ID NO: 400627 - RNA, 32 nt, Human
cucugcucacugcaaccuccgccucccggguu

SEQ ID NO: 400628 - RNA, 32 nt, Human
cucugcucacugcaaccucugccuccuggguu

SEQ ID NO: 400629 - RNA, 32 nt, Human
cucugcucacugcaagcucagccucucggguu

SEQ ID NO: 400630 - RNA, 32 nt, Human
cucugcucacugcaagcuccgccaucuggguu

SEQ ID NO: 400631 - RNA, 32 nt, Human
cucugcucacugcaagcuccgccucccggguu

SEQ ID NO: 400632 - RNA, 32 nt, Human
cucugcucacugcaagcuccgccuccuggguu

SEQ ID NO: 400633 - RNA, 32 nt, Human
cucugcucacuguaaccucugccuccuggguu

SEQ ID NO: 400634 - RNA, 32 nt, Human
cucugcucagccaagcuuguuaucagcuuuca

SEQ ID NO: 400635 - RNA, 32 nt, Human
cucugcuccaaccuucaagagauuuugcaagu

SEQ ID NO: 400636 - RNA, 18 nt, Human
cucugcuccacccaggcu

SEQ ID NO: 400637 - RNA, 32 nt, Human
cucugcuccacugucugcagcccagauccugu

SEQ ID NO: 400638 - RNA, 32 nt, Human
cucugcuccauuucacucuuguccucacagac

SEQ ID NO: 400639 - RNA, 32 nt, Human
cucugcuccccaggcuugagugagugugugcc

SEQ ID NO: 400640 - RNA, 19 nt, Human
cucugcucccucuuccucu

SEQ ID NO: 400641 - RNA, 32 nt, Human
cucugcuccugccucccaaaguccaugucugc

SEQ ID NO: 400642 - RNA, 32 nt, Human
cucugcuccuucacuguucccucuggcuuccc

SEQ ID NO: 400643 - RNA, 32 nt, Human
cucugcuccuugggagcggguggagagacacc

SEQ ID NO: 400644 - RNA, 32 nt, Human
cucugcucgccuuagcacuaccacuccugcca

SEQ ID NO: 400645 - RNA, 29 nt, Human
cucugcucggcucugucauccccugacug

SEQ ID NO: 400646 - RNA, 22 nt, Human
cucugcucucaccucucugcuu

SEQ ID NO: 400647 - RNA, 19 nt, Human
cucugcucucauugcuugu

SEQ ID NO: 400648 - RNA, 32 nt, Human
cucugcucuccgacuaccucagggaggauucu

SEQ ID NO: 400649 - RNA, 32 nt, Human
cucugcucuccucaaagacgcaaaacauuuuc

SEQ ID NO: 400650 - RNA, 32 nt, Human
cucugcucuccucccgcaauccugcuccaaga

SEQ ID NO: 400651 - RNA, 32 nt, Human
cucugcucuccucuauucuccaugucgacuga

SEQ ID NO: 400652 - RNA, 32 nt, Human
cucugcucuguggauguggacagcgauggcag

SEQ ID NO: 400653 - RNA, 32 nt, Human
cucugcucugugggguuuggagaaaugcuuug

SEQ ID NO: 400654 - RNA, 28 nt, Human
cucugcucuucugcagccucaucucugc

SEQ ID NO: 400655 - RNA, 32 nt, Human
cucugcugaauuuuuaaauguucacucuggcu

SEQ ID NO: 400656 - RNA, 32 nt, Human
cucugcugaccugcugaccugugcacacccca

SEQ ID NO: 400657 - RNA, 22 nt, Human
cucugcugacucugcagccccg

SEQ ID NO: 400658 - RNA, 31 nt, Human
cucugcugacuucuguccuuuuuggcagagc

SEQ ID NO: 400659 - RNA, 32 nt, Human
cucugcugagugacguaggcucugagauagcu

SEQ ID NO: 400660 - RNA, 32 nt, Human
cucugcugaucugagucugccugcagcaugga

SEQ ID NO: 400661 - RNA, 32 nt, Human
cucugcugcagauggaacaacagccauggaga

SEQ ID NO: 400662 - RNA, 32 nt, Human
cucugcugcagcccuggcugggcagacaggac

SEQ ID NO: 400663 - RNA, 20 nt, Human
cucugcugcagccgcugccg

SEQ ID NO: 400664 - RNA, 20 nt, Human
cucugcugcagcggcuccug

SEQ ID NO: 400665 - RNA, 32 nt, Human
cucugcugcagcuuuuucucucaguguucugg

SEQ ID NO: 400666 - RNA, 32 nt, Human
cucugcugcaguggaucccaggaagcuggcac

SEQ ID NO: 400667 - RNA, 32 nt, Human
cucugcugccagcccuuccucacuuuuggaaa

SEQ ID NO: 400668 - RNA, 26 nt, Human
cucugcugcccaggcuagagugcagu

SEQ ID NO: 400669 - RNA, 32 nt, Human
cucugcugcccaggcuagagugcaguggcgug

SEQ ID NO: 400670 - RNA, 32 nt, Human
cucugcugcccaggcuggaaugcaguggugcc

SEQ ID NO: 400671 - RNA, 26 nt, Human
cucugcugcccaggcuggaguacagu

SEQ ID NO: 400672 - RNA, 32 nt, Human
cucugcugcccaggcuggaguacagugaugug

SEQ ID NO: 400673 - RNA, 32 nt, Human
cucugcugcccaggcuggaguacaguggcaca

SEQ ID NO: 400674 - RNA, 32 nt, Human
cucugcugcccgggcuagagugcagugguggg

SEQ ID NO: 400675 - RNA, 32 nt, Human
cucugcugccuaggcugagugcagugguguga

SEQ ID NO: 400676 - RNA, 32 nt, Human
cucugcugccucuuugcuuucucucugagaug

SEQ ID NO: 400677 - RNA, 32 nt, Human
cucugcugccugggcaugggccugagugaggg

SEQ ID NO: 400678 - RNA, 20 nt, Human
cucugcugcgucuuugccca

SEQ ID NO: 400679 - RNA, 19 nt, Human
cucugcugcuaggcuucug

SEQ ID NO: 400680 - RNA, 32 nt, Human
cucugcugcucaggcuggagugcaguggugca

SEQ ID NO: 400681 - RNA, 32 nt, Human
cucugcugcuuugaaaucugguugaaaugaga

SEQ ID NO: 400682 - RNA, 32 nt, Human
cucugcugcuuuuggggaaugaggggaagcca

SEQ ID NO: 400683 - RNA, 23 nt, Human
cucugcuggaaacagcaggaaug

SEQ ID NO: 400684 - RNA, 32 nt, Human
cucugcuggcucaggaggaggggugagagacc

SEQ ID NO: 400685 - RNA, 32 nt, Human
cucugcuggcuucuuuuuccaugcguuaacuu

SEQ ID NO: 400686 - RNA, 32 nt, Human
cucugcugggaggagcgguuagagugugugug

SEQ ID NO: 400687 - RNA, 32 nt, Human
cucugcugggcgcgaaccugcccacccaccgg

SEQ ID NO: 400688 - RNA, 32 nt, Human
cucugcugguaguaaggaggccaguuuggagg

SEQ ID NO: 400689 - RNA, 20 nt, Human
cucugcuggucucuggcucu

SEQ ID NO: 400690 - RNA, 18 nt, Human
cucugcugguggcuccug

SEQ ID NO: 400691 - RNA, 23 nt, Human
cucugcugguucccaggcugcug

SEQ ID NO: 400692 - RNA, 32 nt, Human
cucugcugguuuggggcacaaggaagccuuag

SEQ ID NO: 400693 - RNA, 32 nt, Human
cucugcugucaacuucccaucuggcucagcau

SEQ ID NO: 400694 - RNA, 32 nt, Human
cucugcugucagcuucccaucuggcucagcau

SEQ ID NO: 400695 - RNA, 32 nt, Human
cucugcugucagucuuuguuucucccaguuuu

SEQ ID NO: 400696 - RNA, 21 nt, Human
cucugcugugaacacaccacu

SEQ ID NO: 400697 - RNA, 32 nt, Human
cucugcugugacgccacagccuggugaggagg

SEQ ID NO: 400698 - RNA, 32 nt, Human
cucugcugugcuggcuucccaugaccaccucc

SEQ ID NO: 400699 - RNA, 32 nt, Human
cucugcuuaccugucuggcucagcuugggcaa

SEQ ID NO: 400700 - RNA, 32 nt, Human
cucugcuuagcuggugggcaggggagagaggg

SEQ ID NO: 400701 - RNA, 32 nt, Human
cucugcuuagggugguuugaggugaguucuga

SEQ ID NO: 400702 - RNA, 32 nt, Human
cucugcuuccacucccuuucccauucaggcug

SEQ ID NO: 400703 - RNA, 32 nt, Human
cucugcuuccaggacugcccgaguguggaagg

SEQ ID NO: 400704 - RNA, 32 nt, Human
cucugcuuccauuuaaagcauggcaguggguu

SEQ ID NO: 400705 - RNA, 32 nt, Human
cucugcuucccggguucacaagcaauucucau

SEQ ID NO: 400706 - RNA, 18 nt, Human
cucugcuuccucagcccu

SEQ ID NO: 400707 - RNA, 20 nt, Human
cucugcuuccuggccaccug

SEQ ID NO: 400708 - RNA, 19 nt, Human
cucugcuuccugggcccug

SEQ ID NO: 400709 - RNA, 21 nt, Human
cucugcuucgcugcgccucca

SEQ ID NO: 400710 - RNA, 18 nt, Human
cucugcuucguggccccu

SEQ ID NO: 400711 - RNA, 32 nt, Human
cucugcuucuaguucuccaccuccagguuggg

SEQ ID NO: 400712 - RNA, 32 nt, Human
cucugcuucucccaccacuuagucucaacccg

SEQ ID NO: 400713 - RNA, 32 nt, Human
cucugcuucucccguuugccuccuuaucauga

SEQ ID NO: 400714 - RNA, 32 nt, Human
cucugcuucucccuccuccucaguaauuuauu

SEQ ID NO: 400715 - RNA, 32 nt, Human
cucugcuucucccucugccccucuccaggcgc

SEQ ID NO: 400716 - RNA, 18 nt, Human
cucugcuucucucuugcu

SEQ ID NO: 400717 - RNA, 20 nt, Human
cucugcuucucugacuucug

SEQ ID NO: 400718 - RNA, 17 nt, Human
cucugcuucugggcucc

SEQ ID NO: 400719 - RNA, 21 nt, Human
cucugcuucuugcuuugccca

SEQ ID NO: 400720 - RNA, 32 nt, Human
cucugcuugccacccuuggggccuccuucagu

SEQ ID NO: 400721 - RNA, 18 nt, Human
cucugcuugcggccccug

SEQ ID NO: 400722 - RNA, 24 nt, Human
cucugcuuggccacagcuuugcuc

SEQ ID NO: 400723 - RNA, 32 nt, Human
cucugcuuguugcucguccugcccuaaaccuu

SEQ ID NO: 400724 - RNA, 32 nt, Human
cucugcuuguuggcuuccgugugucaucaggg

SEQ ID NO: 400725 - RNA, 19 nt, Human
cucugcuuucuuccugcca

SEQ ID NO: 400726 - RNA, 32 nt, Human
cucugcuuucuuuccguccccuugggaucccu

SEQ ID NO: 400727 - RNA, 32 nt, Human
cucugcuuugggcucugcaggccaccagauac

SEQ ID NO: 400728 - RNA, 19 nt, Human
cucugcuuugggguuccug

SEQ ID NO: 400729 - RNA, 21 nt, Human
cucugcuuuucaucucugcuu

SEQ ID NO: 400730 - RNA, 32 nt, Human
cucuggaaacuggggucccacccuggggacuu

SEQ ID NO: 400731 - RNA, 32 nt, Human
cucuggaaagacaaucuagggagcccagaggc

SEQ ID NO: 400732 - RNA, 22 nt, Human
cucuggaaagacagcacaggcc

SEQ ID NO: 400733 - RNA, 32 nt, Human
cucuggaaaggggucauccucagucugauaau

SEQ ID NO: 400734 - RNA, 32 nt, Human
cucuggaaagucgugcacagcccaggaguguu

SEQ ID NO: 400735 - RNA, 32 nt, Human
cucuggaacccuguggcuucaaauccuuuggg

SEQ ID NO: 400736 - RNA, 32 nt, Human
cucuggaacuauucuucuagacuaucccacau

SEQ ID NO: 400737 - RNA, 32 nt, Human
cucuggaacucacaaaagcuggcuuuuauucc

SEQ ID NO: 400738 - RNA, 32 nt, Human
cucuggaacucaggugcuccugcuccaagguu

SEQ ID NO: 400739 - RNA, 32 nt, Human
cucuggaacugcuuccaugcaggugaggaggc

SEQ ID NO: 400740 - RNA, 32 nt, Human
cucuggaacuucuuccuuccuccugccucugc

SEQ ID NO: 400741 - RNA, 22 nt, Human
cucuggaagagcaguaucagca

SEQ ID NO: 400742 - RNA, 32 nt, Human
cucuggaagaggccuucccauggccauuucug

SEQ ID NO: 400743 - RNA, 32 nt, Human
cucuggaagaguugggauuauggaugcaugga

SEQ ID NO: 400744 - RNA, 19 nt, Human
cucuggaagcagcaucagg

SEQ ID NO: 400745 - RNA, 32 nt, Human
cucuggaagcagcucugaggggaacagucaca

SEQ ID NO: 400746 - RNA, 32 nt, Human
cucuggaagcggguccaaggugcugucacccc

SEQ ID NO: 400747 - RNA, 32 nt, Human
cucuggaagcgguacuguaucucucuccaagg

SEQ ID NO: 400748 - RNA, 32 nt, Human
cucuggaaggccacggcaggaggaucacuuua

SEQ ID NO: 400749 - RNA, 32 nt, Human
cucuggaagugacuccucuguccucuggaauc

SEQ ID NO: 400750 - RNA, 22 nt, Human
cucuggaaugaacaguaucaca

SEQ ID NO: 400751 - RNA, 32 nt, Human
cucuggacaaugaccagcacagagcccuaagc

SEQ ID NO: 400752 - RNA, 32 nt, Human
cucuggacacgugcugcagcuguggcugaggc

SEQ ID NO: 400753 - RNA, 32 nt, Human
cucuggacaggcaaggggaguuggcgcaggug

SEQ ID NO: 400754 - RNA, 32 nt, Human
cucuggacagguggggcacugaggcagcccag

SEQ ID NO: 400755 - RNA, 32 nt, Human
cucuggaccagccuguuggacccgcucuggac

SEQ ID NO: 400756 - RNA, 32 nt, Human
cucuggacccaguuaugcuuuuccugaauugc

SEQ ID NO: 400757 - RNA, 32 nt, Human
cucuggacccccacccuccauccucacccagc

SEQ ID NO: 400758 - RNA, 19 nt, Human
cucuggacccccagccagg

SEQ ID NO: 400759 - RNA, 32 nt, Human
cucuggaccuagccugucccagaagaggagaa

SEQ ID NO: 400760 - RNA, 32 nt, Human
cucuggaccuuucccccucucccugcggccuu

SEQ ID NO: 400761 - RNA, 32 nt, Human
cucuggacggccucucugaacuccuuugugag

SEQ ID NO: 400762 - RNA, 32 nt, Human
cucuggacucacagcuuccacccuuucacaca

SEQ ID NO: 400763 - RNA, 32 nt, Human
cucuggacucagugcuuccugucccaaggacc

SEQ ID NO: 400764 - RNA, 32 nt, Human
cucuggacugcacuguagggccuggagaccug

SEQ ID NO: 400765 - RNA, 32 nt, Human
cucuggacugcccagacccuucagagccagca

SEQ ID NO: 400766 - RNA, 32 nt, Human
cucuggacuguuuccccucucagcaucgcuuu

SEQ ID NO: 400767 - RNA, 32 nt, Human
cucuggacuucugcccucuuuugugccaugug

SEQ ID NO: 400768 - RNA, 32 nt, Human
cucuggagaccccagccccagagggcuuugug

SEQ ID NO: 400769 - RNA, 32 nt, Human
cucuggagagcaauguugaaucccugagaaga

SEQ ID NO: 400770 - RNA, 32 nt, Human
cucuggagaggugguuuaaagugagauuaugc

SEQ ID NO: 400771 - RNA, 32 nt, Human
cucuggagcaauguugcuuaggaugugugcau

SEQ ID NO: 400772 - RNA, 32 nt, Human
cucuggagcagcacuggcaggagcugcagcuu

SEQ ID NO: 400773 - RNA, 32 nt, Human
cucuggagccauccugauggcuuugggggccu

SEQ ID NO: 400774 - RNA, 30 nt, Human
cucuggagccucuccuuccuguucucuguc

SEQ ID NO: 400775 - RNA, 32 nt, Human
cugaaggugaaaugcagaguuggauaagaaau

SEQ ID NO: 400776 - RNA, 32 nt, Human
cugaaggugcaggggugagagcagggaaaugg

SEQ ID NO: 400777 - RNA, 32 nt, Human
cugaaggugggagccggugugggagcuuuuac

SEQ ID NO: 400778 - RNA, 22 nt, Human
cugaagguggggccuagggagg

SEQ ID NO: 400779 - RNA, 32 nt, Human
cugaagguggggucaagggaggccccaaaaca

SEQ ID NO: 400780 - RNA, 32 nt, Human
cugaagguguuccguggucagugagggcuggc

SEQ ID NO: 400781 - RNA, 32 nt, Human
cugaagguuaauuugaucaccaauggccaaug

SEQ ID NO: 400782 - RNA, 32 nt, Human
cugaagguucuugaggaucuaguuucaugccu

SEQ ID NO: 400783 - RNA, 32 nt, Human
cugaagguuguggcugacccauucuccuggga

SEQ ID NO: 400784 - RNA, 32 nt, Human
cugaaguaaccagcaaccuaggaacauagaag

SEQ ID NO: 400785 - RNA, 32 nt, Human
cugaaguaccaguuuccauuccugggcugaga

SEQ ID NO: 400786 - RNA, 25 nt, Human
cugaaguagcugggacuacaggcgu

SEQ ID NO: 400787 - RNA, 23 nt, Human
cugaaguagcugggauuacaggc

SEQ ID NO: 400788 - RNA, 32 nt, Human
cugaaguaucugugugcuuccagaaagcuuac

SEQ ID NO: 400789 - RNA, 32 nt, Human
cugaagucagaaguuugagaccagccuggcaa

SEQ ID NO: 400790 - RNA, 32 nt, Human
cugaagucagaaguuugagaccagccuggcca

SEQ ID NO: 400791 - RNA, 32 nt, Human
cugaagucagaaguuugagaccagccuugcca

SEQ ID NO: 400792 - RNA, 32 nt, Human
cugaagucagaauaugaaguggagcuaggaau

SEQ ID NO: 400793 - RNA, 32 nt, Human
cugaagucagcccuuugugucguccccuggcg

SEQ ID NO: 400794 - RNA, 32 nt, Human
cugaagucaggaguuaaagaccagccuggcca

SEQ ID NO: 400795 - RNA, 32 nt, Human
cugaagucaggaguuagagaccagccugucca

SEQ ID NO: 400796 - RNA, 32 nt, Human
cugaagucaggaguucaagaccauccuggcca

SEQ ID NO: 400797 - RNA, 32 nt, Human
cugaagucaggaguucgagaccagccuggcca

SEQ ID NO: 400798 - RNA, 32 nt, Human
cugaagucaggaguuugagaccagccugggca

SEQ ID NO: 400799 - RNA, 32 nt, Human
cugaagucagggauuugagaccagccuggcca

SEQ ID NO: 400800 - RNA, 32 nt, Human
cugaagucagguguuugagaccagccuggcca

SEQ ID NO: 400801 - RNA, 32 nt, Human
cugaaguccaauagaggagacuugaucucuag

SEQ ID NO: 400802 - RNA, 32 nt, Human
cugaaguccggaguuugagaccagccuggcca

SEQ ID NO: 400803 - RNA, 32 nt, Human
cugaagucucaaaucauugucuggaauuuucc

SEQ ID NO: 400804 - RNA, 32 nt, Human
cugaagucucacugcugagccuucagcuuuua

SEQ ID NO: 400805 - RNA, 32 nt, Human
cugaagucuccuggcauauguuaccgaaucaa

SEQ ID NO: 400806 - RNA, 32 nt, Human
cugaagucugguauucugguauucuggguuca

SEQ ID NO: 400807 - RNA, 32 nt, Human
cugaagucuguaauccuagcacuuugggaggc

SEQ ID NO: 400808 - RNA, 23 nt, Human
cugaagugaccaggcugaaaggg

SEQ ID NO: 400809 - RNA, 32 nt, Human
cugaagugaccaggcugaaagggaagcaauac

SEQ ID NO: 400810 - RNA, 32 nt, Human
cugaagugagccaggcagcucuggccaucuuu

SEQ ID NO: 400811 - RNA, 32 nt, Human
cugaagugagguagcagcucucuucugucagc

SEQ ID NO: 400812 - RNA, 32 nt, Human
cugaagugcagguugcucacagcauccuacaa

SEQ ID NO: 400813 - RNA, 32 nt, Human
cugaagugccaagagagcugagaggagcaguu

SEQ ID NO: 400814 - RNA, 32 nt, Human
cugaagugccucuucccuccccugcuggcgcu

SEQ ID NO: 400815 - RNA, 32 nt, Human
cugaagugccugaagguaggaaugggccggcg

SEQ ID NO: 400816 - RNA, 32 nt, Human
cugaagugcucagcauccuccucuuccucggu

SEQ ID NO: 400817 - RNA, 21 nt, Human
cugaagugcugggauuacagg

SEQ ID NO: 400818 - RNA, 22 nt, Human
cugaagugcugggauuacaggc

SEQ ID NO: 400819 - RNA, 24 nt, Human
cugaagugcugggauuacaggcgu

SEQ ID NO: 400820 - RNA, 20 nt, Human
cugaagugcugggauucagg

SEQ ID NO: 400821 - RNA, 32 nt, Human
cugaaguggaaguggacugacaugcucuucug

SEQ ID NO: 400822 - RNA, 32 nt, Human
cugaaguggagcgagagggaggugcuucgccg

SEQ ID NO: 400823 - RNA, 32 nt, Human
cugaaguggcaccaucuuuucugucuuccuga

SEQ ID NO: 400824 - RNA, 32 nt, Human
cugaagugggagaagaagcagguagaccaccu

SEQ ID NO: 400825 - RNA, 24 nt, Human
cugaagugggcagaucacgagguc

SEQ ID NO: 400826 - RNA, 32 nt, Human
cugaagugggcagauuacuugaggucaggagu

SEQ ID NO: 400827 - RNA, 32 nt, Human
cugaagugggguccccaacaagaucagaaagg

SEQ ID NO: 400828 - RNA, 32 nt, Human
cugaagugggugaaucacuugaggucaggagu

SEQ ID NO: 400829 - RNA, 21 nt, Human
cugaaguggguggaucacaag

SEQ ID NO: 400830 - RNA, 29 nt, Human
cugaagugucuguauguggucuuggcugg

SEQ ID NO: 400831 - RNA, 20 nt, Human
cugaagugugccaggcaagg

SEQ ID NO: 400832 - RNA, 32 nt, Human
cugaaguguggacaugauggcaggagcugcag

SEQ ID NO: 400833 - RNA, 32 nt, Human
cugaagugugggcugcaggugaacaggaauug

SEQ ID NO: 400834 - RNA, 24 nt, Human
cugaaguguuaggauuacaggcgu

SEQ ID NO: 400835 - RNA, 32 nt, Human
cugaaguguuccuuugggauccugguucccaa

SEQ ID NO: 400836 - RNA, 32 nt, Human
cugaaguuaugcauacuucugguaaaacaagu

SEQ ID NO: 400837 - RNA, 32 nt, Human
cugaaguucuuccagcaggucuguaaccacaa

SEQ ID NO: 400838 - RNA, 32 nt, Human
cugaaguugcuuaucagguuaaggagauuuug

SEQ ID NO: 400839 - RNA, 32 nt, Human
cugaaguuggcuuuucagccagcacugaaugu

SEQ ID NO: 400840 - RNA, 32 nt, Human
cugaaguuuccuuuuuguuaugucucuuucgg

SEQ ID NO: 400841 - RNA, 32 nt, Human
cugaaguuuuagcgcucagaacauggggaccc

SEQ ID NO: 400842 - RNA, 32 nt, Human
cugaaguuuucuagucccuccuuuuuguuugu

SEQ ID NO: 400843 - RNA, 32 nt, Human
cugaauaaggauuccaaagaggggacaccggc

SEQ ID NO: 400844 - RNA, 32 nt, Human
cugaauaagucucucauaaugagugcaguguc

SEQ ID NO: 400845 - RNA, 32 nt, Human
cugaauaaugucccucauuuugacuauaacug

SEQ ID NO: 400846 - RNA, 32 nt, Human
cugaauacaacacaacuagggucuaaaagaaa

SEQ ID NO: 400847 - RNA, 32 nt, Human
cugaauacauauaaugacuaugugccagcauu

SEQ ID NO: 400848 - RNA, 19 nt, Human
cugaauaccacuuaccuca

SEQ ID NO: 400849 - RNA, 32 nt, Human
cugaauagcaaggaccuucuggaacauaaucu

SEQ ID NO: 400850 - RNA, 21 nt, Human
cugaauagcugggacuacagg

SEQ ID NO: 400851 - RNA, 22 nt, Human
cugaauagcugggauuacaggc

SEQ ID NO: 400852 - RNA, 32 nt, Human
cugaauaggacuagcaacuucauagacgguug

SEQ ID NO: 400853 - RNA, 32 nt, Human
cugaauaguuaaaccuuugauggccauaaccu

SEQ ID NO: 400854 - RNA, 32 nt, Human
cugaauaguucuccccuuugagugcauuuaac

SEQ ID NO: 400855 - RNA, 32 nt, Human
cugaauaucaagagcaagacucuccaguaaca

SEQ ID NO: 400856 - RNA, 32 nt, Human
cugaauauuuuugagcaauuucuauaugauaa

SEQ ID NO: 400857 - RNA, 32 nt, Human
cugaaucacauagauucuccuccgucaguaac

SEQ ID NO: 400858 - RNA, 32 nt, Human
cugaaucaccagcauucaaacaaauauuucgg

SEQ ID NO: 400859 - RNA, 19 nt, Human
cugaaucacuguggccuca

SEQ ID NO: 400860 - RNA, 32 nt, Human
cugaauccaguggagcugggccaaguacgaca

SEQ ID NO: 400861 - RNA, 32 nt, Human
cugaauccgcagggaugucaacgucaauauca

SEQ ID NO: 400862 - RNA, 32 nt, Human
cugaauccgggcucuguagcagguccucuucu

SEQ ID NO: 400863 - RNA, 32 nt, Human
cugaaucgucugcuucccaaaauuccuauguu

SEQ ID NO: 400864 - RNA, 32 nt, Human
cugaaucuauuuuacagggaagcaucggaagg

SEQ ID NO: 400865 - RNA, 32 nt, Human
cugaaucucaagaguuaucugaaagugauaga

SEQ ID NO: 400866 - RNA, 32 nt, Human
cugaaucucaagaugggggcagggcugugcuu

SEQ ID NO: 400867 - RNA, 32 nt, Human
cugaaucucauucaccaugcugcccaggggcc

SEQ ID NO: 400868 - RNA, 32 nt, Human
cugaaucuccaggccucacgagguccccugug

SEQ ID NO: 400869 - RNA, 32 nt, Human
cugaaucucugacuuauugauuauggaaccug

SEQ ID NO: 400870 - RNA, 32 nt, Human
cugaaucucuguccugccacacauggucccag

SEQ ID NO: 400871 - RNA, 32 nt, Human
cugaaucugccaacgugguguuggaggcucca

SEQ ID NO: 400872 - RNA, 32 nt, Human
cugaaucugcuuguugaucaguguuugaagaa

SEQ ID NO: 400873 - RNA, 32 nt, Human
cugaaucugucuacccuucauucaugagaacu

SEQ ID NO: 400874 - RNA, 32 nt, Human
cugaaucuuuuggcccccuccugcaucccagg

SEQ ID NO: 400875 - RNA, 32 nt, Human
cugaaugaagacaaagaugauuuuaaagggcc

SEQ ID NO: 400876 - RNA, 32 nt, Human
cugaaugacaggcuuuauauaacugugucaac

SEQ ID NO: 400877 - RNA, 32 nt, Human
cugaaugacaugcucacagucacacagcaggc

SEQ ID NO: 400878 - RNA, 32 nt, Human
cugaaugagaagcccgcccugcccgucauccg

SEQ ID NO: 400879 - RNA, 32 nt, Human
cugaaugagcgggcguuuccuccuggggugac

SEQ ID NO: 400880 - RNA, 32 nt, Human
cugaaugagcuuggaagcagauuucuccucag

SEQ ID NO: 400881 - RNA, 32 nt, Human
cugaaugaguuuggaagcagauucuucccagc

SEQ ID NO: 400882 - RNA, 32 nt, Human
cugaaugcaccuauuauaaucuguggccccag

SEQ ID NO: 400883 - RNA, 31 nt, Human
cugaaugccaccucugggccucugcuccugg

SEQ ID NO: 400884 - RNA, 32 nt, Human
cugaaugccaccuggaaaacagccuggaccug

SEQ ID NO: 400885 - RNA, 32 nt, Human
cugaaugccaucacccuccccagggcucugca

SEQ ID NO: 400886 - RNA, 20 nt, Human
cugaaugccucucagcauca

SEQ ID NO: 400887 - RNA, 32 nt, Human
cugaaugccugagacucuagcagaaauggccu

SEQ ID NO: 400888 - RNA, 32 nt, Human
cugaaugcuaggcuggaaaguggugccuguug

SEQ ID NO: 400889 - RNA, 32 nt, Human
cugaaugcugccucuucuaccccuauguccaa

SEQ ID NO: 400890 - RNA, 32 nt, Human
cugaaugcuggaauuggcaauauuucagguuc

SEQ ID NO: 400891 - RNA, 32 nt, Human
cugaauggaauaaggcuaaaaauauguuuagu

SEQ ID NO: 400892 - RNA, 32 nt, Human
cugaauggacccucuucuaggccaaagagacc

SEQ ID NO: 400893 - RNA, 32 nt, Human
cugaauggagaaacguagucuuaccucguuuu

SEQ ID NO: 400894 - RNA, 32 nt, Human
cugaauggcagaaaggcgccuaccucaaggac

SEQ ID NO: 400895 - RNA, 32 nt, Human
cugaaugggagagagagggaagggggaaaugg

SEQ ID NO: 400896 - RNA, 32 nt, Human
cugaaugggagccagaauucacuaggagguca

SEQ ID NO: 400897 - RNA, 32 nt, Human
cugaaugggggagggggaggggagcacggggu

SEQ ID NO: 400898 - RNA, 31 nt, Human
cugaauggggguggaccuggcauuuaucugg

SEQ ID NO: 400899 - RNA, 32 nt, Human
cugaaugguauucgacgaguccuggccuucau

SEQ ID NO: 400900 - RNA, 32 nt, Human
cugaauggucugucauugucugccuuuaaaau

SEQ ID NO: 400901 - RNA, 32 nt, Human
cugaauguacugugugaugaugcaucaugcau

SEQ ID NO: 400902 - RNA, 32 nt, Human
cugaaugucccccgccugccgaguggcuggcg

SEQ ID NO: 400903 - RNA, 32 nt, Human
cugaauguggauacauuauuccuucacacagu

SEQ ID NO: 400904 - RNA, 32 nt, Human
cugaauguguaugucugugugggugcucuguc

SEQ ID NO: 400905 - RNA, 32 nt, Human
cugaauguguggucagcaucuguacaaaugca

SEQ ID NO: 400906 - RNA, 32 nt, Human
cugaauguuaaggauggggaaaaagaaugccu

SEQ ID NO: 400907 - RNA, 32 nt, Human
cugaauguuaaugucacaucugccuuuggaga

SEQ ID NO: 400908 - RNA, 32 nt, Human
cugaauguuugucccuaacauaggauuucaga

SEQ ID NO: 400909 - RNA, 32 nt, Human
cugaauguuuguccuucacauaccauuccaga

SEQ ID NO: 400910 - RNA, 32 nt, Human
cugaauuacccccauccuccuccuuucuggaa

SEQ ID NO: 400911 - RNA, 32 nt, Human
cugaauuacuauucuuuuagaaguugagacag

SEQ ID NO: 400912 - RNA, 32 nt, Human
cugaauucccuucaaagccaaaguuucuugag

SEQ ID NO: 400913 - RNA, 32 nt, Human
cugaauuccugcgccuuccugacgugagcccu

SEQ ID NO: 400914 - RNA, 32 nt, Human
cugaauucugccucccuguuauagucccuguc

SEQ ID NO: 400915 - RNA, 32 nt, Human
cugaauugaauccauuguugggcuuaaguuac

SEQ ID NO: 400916 - RNA, 32 nt, Human
cugaauugcuggcuaauuucuugauuugccac

SEQ ID NO: 400917 - RNA, 32 nt, Human
cugaauugcuggcuaauuucuugauuugcgac

SEQ ID NO: 400918 - RNA, 32 nt, Human
cugaauuggcaagucuguggugcugcucuuug

SEQ ID NO: 400919 - RNA, 32 nt, Human
cugaauuuauuuccucuccuucccccacccag

SEQ ID NO: 400920 - RNA, 32 nt, Human
cugaauuucacucccgcuucagugggguuucu

SEQ ID NO: 400921 - RNA, 18 nt, Human
cugaauuucuggguccuu

SEQ ID NO: 400922 - RNA, 32 nt, Human
cugaauuucuuaugacccucccaaaccaaagc

SEQ ID NO: 400923 - RNA, 32 nt, Human
cugaauuugcagcauuuucucaggugcuuuuu

SEQ ID NO: 400924 - RNA, 32 nt, Human
cugaauuugcagcugucucucugaugggugcc

SEQ ID NO: 400925 - RNA, 32 nt, Human
cugaauuuggauugccugcucucuuuaaagcg

SEQ ID NO: 400926 - RNA, 32 nt, Human
cugaauuuuccaacccacccccaaacuaaaca

SEQ ID NO: 400927 - RNA, 32 nt, Human
cugaauuuugaggcugggauuggcaacucugg

SEQ ID NO: 400928 - RNA, 32 nt, Human
cugaauuuugcuuccuuugggagcucauucuu

SEQ ID NO: 400929 - RNA, 32 nt, Human
cugaauuuuugggagcaggcaauaucugaagg

SEQ ID NO: 400930 - RNA, 32 nt, Human
cugacaaacaaccugcuccguggacgccugaa

SEQ ID NO: 400931 - RNA, 22 nt, Human
cugacaaacauggagaaacccc

SEQ ID NO: 400932 - RNA, 32 nt, Human
cugacaaacuuccaucaacccaaaaaguucca

SEQ ID NO: 400933 - RNA, 32 nt, Human
cugacaaagaagcccagggaggggaagagggu

SEQ ID NO: 400934 - RNA, 32 nt, Human
cugacaaagaggaggagcuggaggaagcaugc

SEQ ID NO: 400935 - RNA, 32 nt, Human
cugacaaaggggaagaaagacauaaagaaaag

SEQ ID NO: 400936 - RNA, 32 nt, Human
cugacaacacacugcccaugaagcuagggcag

SEQ ID NO: 400937 - RNA, 32 nt, Human
cugacaaccacagccauuucucugcacggggg

SEQ ID NO: 400938 - RNA, 32 nt, Human
cugacaaccagcugcagugucuaaguguuccu

SEQ ID NO: 400939 - RNA, 23 nt, Human
cugacaaccaguccuccacauca

SEQ ID NO: 400940 - RNA, 32 nt, Human
cugacaacccaaaacauauauacagauuguug

SEQ ID NO: 400941 - RNA, 32 nt, Human
cugacaacugagaguuuuagaagauuagacca

SEQ ID NO: 400942 - RNA, 32 nt, Human
cugacaacuuggcuuccaucuugugaggaccu

SEQ ID NO: 400943 - RNA, 19 nt, Human
cugacaagaaacacauucu

SEQ ID NO: 400944 - RNA, 32 nt, Human
cugacaagagcugagggagaaaauagaccuau

SEQ ID NO: 400945 - RNA, 32 nt, Human
cugacaaggagugaagcgcccacccagcggau

SEQ ID NO: 400946 - RNA, 32 nt, Human
cugacaagggcugaccugccucucacacacau

SEQ ID NO: 400947 - RNA, 32 nt, Human
cugacaagucugucuucucuucuugguuucau

SEQ ID NO: 400948 - RNA, 32 nt, Human
cugacaauccuugagaaucuuugcaugcagag

SEQ ID NO: 400949 - RNA, 32 nt, Human
cugacacaaaccaagaaaagguggugauugcc

SEQ ID NO: 400950 - RNA, 32 nt, Human
cugacacacacguuuccccgcugacggccacg

SEQ ID NO: 400951 - RNA, 20 nt, Human
cugacacacccucuggugcc

SEQ ID NO: 400952 - RNA, 24 nt, Human
cugacacacccuucccaauugcca

SEQ ID NO: 400953 - RNA, 21 nt, Human
cugacacagagccaucugcca

SEQ ID NO: 400954 - RNA, 32 nt, Human
cugacacagcaucacaucacacacacagaaau

SEQ ID NO: 400955 - RNA, 32 nt, Human
cugacacagccccagaccccacaaagccuucu

SEQ ID NO: 400956 - RNA, 32 nt, Human
cugacacaggaaaucauuucuaggacacagug

SEQ ID NO: 400957 - RNA, 32 nt, Human
cugacacaggaaccuucuggaagcacugauua

SEQ ID NO: 400958 - RNA, 22 nt, Human
cugacacagguguggcuacugg

SEQ ID NO: 400959 - RNA, 23 nt, Human
cugacacaucucgucuccccucu

SEQ ID NO: 400960 - RNA, 32 nt, Human
cugacaccaaaguauuuuaaacaaauaaaagg

SEQ ID NO: 400961 - RNA, 32 nt, Human
cugacaccacaaaauggacuuugcagguguga

SEQ ID NO: 400962 - RNA, 32 nt, Human
cugacaccaucucucccagcagucuugggguc

SEQ ID NO: 400963 - RNA, 32 nt, Human
cugacaccauggucaacuccuguuguggcucu

SEQ ID NO: 400964 - RNA, 32 nt, Human
cugacacccacuucuuuucuccuuccuccagg

SEQ ID NO: 400965 - RNA, 32 nt, Human
cugacaccccaccucuccccagaagagaagaa

SEQ ID NO: 400966 - RNA, 32 nt, Human
cugacaccccucccccuaauucucaucuguca

SEQ ID NO: 400967 - RNA, 32 nt, Human
cugacacccuucuccccuuccugguagaccuu

SEQ ID NO: 400968 - RNA, 32 nt, Human
cugacacccuucucuuucuucuuuuucuucac

SEQ ID NO: 400969 - RNA, 32 nt, Human
cugacacccuugugcuauuaauaaccagaaua

SEQ ID NO: 400970 - RNA, 32 nt, Human
cugacaccuaguuuaccaacauguuaauaaac

SEQ ID NO: 400971 - RNA, 32 nt, Human
cugacaccuauaaucucagcacuuugggaggc

SEQ ID NO: 400972 - RNA, 32 nt, Human
cugacaccuccagguccgccuggcaugggaca

SEQ ID NO: 400973 - RNA, 23 nt, Human
cugacaccuccccacaaccugca

SEQ ID NO: 400974 - RNA, 32 nt, Human
cugacaccucggccuuuucucuuccggagggg

SEQ ID NO: 400975 - RNA, 32 nt, Human
cugacaccugagucuuucuccugcugcacgga

SEQ ID NO: 400976 - RNA, 24 nt, Human
cugacaccugcaaucccaacauuu

SEQ ID NO: 400977 - RNA, 19 nt, Human
cugacaccugcugccugca

SEQ ID NO: 400978 - RNA, 32 nt, Human
cugacaccugggcuggagugcaguggugcaau

SEQ ID NO: 400979 - RNA, 32 nt, Human
cugacaccuguaaucccagcacauugggaggc

SEQ ID NO: 400980 - RNA, 32 nt, Human
cugacaccuguaaucccagcacuuugggaggc

SEQ ID NO: 400981 - RNA, 32 nt, Human
cugacaccuguaaucccagcauuuugggagac

SEQ ID NO: 400982 - RNA, 32 nt, Human
cugacaccuugauuuuagccuuggaagacuca

SEQ ID NO: 400983 - RNA, 25 nt, Human
cugacacgcagccuaguuccuuccu

SEQ ID NO: 400984 - RNA, 21 nt, Human
cugacacggagccaaugcaga

SEQ ID NO: 400985 - RNA, 32 nt, Human
cugacacgucucacagccuuccugccuucacu

SEQ ID NO: 400986 - RNA, 32 nt, Human
cugacacuaagcuagcacacagcacuugggcc

SEQ ID NO: 400987 - RNA, 22 nt, Human
cugacacucaugcagaaugaga

SEQ ID NO: 400988 - RNA, 21 nt, Human
cugacacugcaaaccugcaug

SEQ ID NO: 400989 - RNA, 32 nt, Human
cugacacugcaaaccugcaugggugggcuuug

SEQ ID NO: 400990 - RNA, 32 nt, Human
cugacacugccauuuuuccuuuuuggaggaaa

SEQ ID NO: 400991 - RNA, 32 nt, Human
cugacacugcugcaacaugcaacugguguagg

SEQ ID NO: 400992 - RNA, 32 nt, Human
cugacacuggguguugaggucauguggcaguc

SEQ ID NO: 400993 - RNA, 32 nt, Human
cugacacugucacccuccaccgacuuuguuuu

SEQ ID NO: 400994 - RNA, 32 nt, Human
cugacacugucucuuuuuccucccucuauacg

SEQ ID NO: 400995 - RNA, 32 nt, Human
cugacagaaaagagaaucugauagucaacacu

SEQ ID NO: 400996 - RNA, 32 nt, Human
cugacagaaacaagcauuccugccuucccucc

SEQ ID NO: 400997 - RNA, 32 nt, Human
cugacagaacaacaagguuaagcuucaucugc

SEQ ID NO: 400998 - RNA, 32 nt, Human
cugacagaaggugccuuugagagguggugagc

SEQ ID NO: 400999 - RNA, 32 nt, Human
cugacagaagucagggaagagucccuggguua

SEQ ID NO: 401000 - RNA, 18 nt, Human
cugacagaauuggcuuca

SEQ ID NO: 401001 - RNA, 32 nt, Human
cugacagauccaagaccuagaccuaggucuuu
